United States Patent 9,205,144 (IDENTIFICATION OF CONSERVED PEPTIDE BLOCKS IN HOMOLOGOUS POLYPEPTIDES) - sequence listing, part 9

SEQ ID NO: 307338 - protein, 8 aa, Influenza virus
RYSFELVS

SEQ ID NO: 307339 - protein, 8 aa, Influenza virus
GNGTLFRS

SEQ ID NO: 307340 - protein, 8 aa, Influenza virus
GTLFRSDL

SEQ ID NO: 307341 - protein, 8 aa, Influenza virus
CSTKCQTG

SEQ ID NO: 307342 - protein, 8 aa, Influenza virus
KCQSEIGW

SEQ ID NO: 307343 - protein, 8 aa, Influenza virus
QSEIGGIS

SEQ ID NO: 307344 - protein, 8 aa, Influenza virus
TGIGGINT

SEQ ID NO: 307345 - protein, 8 aa, Influenza virus
EIGGINTT

SEQ ID NO: 307346 - protein, 8 aa, Influenza virus
IGGINTTK

SEQ ID NO: 307347 - protein, 8 aa, Influenza virus
GGINTTKS

SEQ ID NO: 307348 - protein, 8 aa, Influenza virus
NFHNVHRN

SEQ ID NO: 307349 - protein, 8 aa, Influenza virus
FHNVHRST

SEQ ID NO: 307350 - protein, 8 aa, Influenza virus
HNVHRNAI

SEQ ID NO: 307351 - protein, 8 aa, Influenza virus
VKSLKLVT

SEQ ID NO: 307352 - protein, 8 aa, Influenza virus
LAIGPRNV

SEQ ID NO: 307353 - protein, 8 aa, Influenza virus
VTGLRNVP

SEQ ID NO: 307354 - protein, 8 aa, Influenza virus
LRNVPAIT

SEQ ID NO: 307355 - protein, 8 aa, Influenza virus
DKESTQKT

SEQ ID NO: 307356 - protein, 8 aa, Influenza virus
NNIVDQMN

SEQ ID NO: 307357 - protein, 8 aa, Influenza virus
IGERINQL

SEQ ID NO: 307358 - protein, 8 aa, Influenza virus
GERINQLS

SEQ ID NO: 307359 - protein, 8 aa, Influenza virus
IDLWSYNA

SEQ ID NO: 307360 - protein, 8 aa, Influenza virus
NLHEKVRQ

SEQ ID NO: 307361 - protein, 8 aa, Influenza virus
LHEKVRQM

SEQ ID NO: 307362 - protein, 8 aa, Influenza virus
HEKVRQML

SEQ ID NO: 307363 - protein, 8 aa, Influenza virus
LKNNAKDE

SEQ ID NO: 307364 - protein, 8 aa, Influenza virus
QDNAKDEG

SEQ ID NO: 307365 - protein, 8 aa, Influenza virus
FYHKCDNG

SEQ ID NO: 307366 - protein, 8 aa, Influenza virus
YHRCDNEC

SEQ ID NO: 307367 - protein, 8 aa, Influenza virus
HKCDNGCI

SEQ ID NO: 307368 - protein, 8 aa, Influenza virus
KCDNGCIE

SEQ ID NO: 307369 - protein, 8 aa, Influenza virus
NECIEKIR

SEQ ID NO: 307370 - protein, 8 aa, Influenza virus
KEFEKESR

SEQ ID NO: 307371 - protein, 8 aa, Influenza virus
KESRLNRQ

SEQ ID NO: 307372 - protein, 8 aa, Influenza virus
KLNRQEIG

SEQ ID NO: 307373 - protein, 8 aa, Influenza virus
EIEGARLD

SEQ ID NO: 307374 - protein, 8 aa, Influenza virus
SLVLAASI

SEQ ID NO: 307375 - protein, 8 aa, Influenza virus
LVLAASIM

SEQ ID NO: 307376 - protein, 8 aa, Influenza virus
ILAALIMG

SEQ ID NO: 307377 - protein, 8 aa, Influenza virus
LAASIMGF

SEQ ID NO: 307378 - protein, 8 aa, Influenza virus
WACGNGSC

SEQ ID NO: 307379 - protein, 8 aa, Influenza virus
ACGNGSCR

SEQ ID NO: 307380 - protein, 8 aa, Influenza virus
EKFIVLSV

SEQ ID NO: 307381 - protein, 8 aa, Influenza virus
TDTVNTLT

SEQ ID NO: 307382 - protein, 8 aa, Influenza virus
DTVNTLTE

SEQ ID NO: 307383 - protein, 8 aa, Influenza virus
ELVHGGIN

SEQ ID NO: 307384 - protein, 8 aa, Influenza virus
LVHGGINP

SEQ ID NO: 307385 - protein, 8 aa, Influenza virus
SLEGLILS

SEQ ID NO: 307386 - protein, 8 aa, Influenza virus
LEGLVLGN

SEQ ID NO: 307387 - protein, 8 aa, Influenza virus
KGLILGNP

SEQ ID NO: 307388 - protein, 8 aa, Influenza virus
SKACNSIS

SEQ ID NO: 307389 - protein, 8 aa, Influenza virus
KACNDISN

SEQ ID NO: 307390 - protein, 8 aa, Influenza virus
ACNDISNQ

SEQ ID NO: 307391 - protein, 8 aa, Influenza virus
QDSFYRSM

SEQ ID NO: 307392 - protein, 8 aa, Influenza virus
PPTSAEQV

SEQ ID NO: 307393 - protein, 8 aa, Influenza virus
EINRNFKP

SEQ ID NO: 307394 - protein, 8 aa, Influenza virus
INRNFKPN

SEQ ID NO: 307395 - protein, 8 aa, Influenza virus
NRNFKPNI

SEQ ID NO: 307396 - protein, 8 aa, Influenza virus
GPRPLIRG

SEQ ID NO: 307397 - protein, 8 aa, Influenza virus
PRPLIRGQ

SEQ ID NO: 307398 - protein, 8 aa, Influenza virus
RPLVMGQQ

SEQ ID NO: 307399 - protein, 8 aa, Influenza virus
PLVMGQQG

SEQ ID NO: 307400 - protein, 8 aa, Influenza virus
LIRGQQGR

SEQ ID NO: 307401 - protein, 8 aa, Influenza virus
LKNDLPIG

SEQ ID NO: 307402 - protein, 8 aa, Influenza virus
CPKYISSG

SEQ ID NO: 307403 - protein, 8 aa, Influenza virus
PKYISSGS

SEQ ID NO: 307404 - protein, 8 aa, Influenza virus
KYISSGSL

SEQ ID NO: 307405 - protein, 8 aa, Influenza virus
GPRNVPQV

SEQ ID NO: 307406 - protein, 8 aa, Influenza virus
PRNVPQVQ

SEQ ID NO: 307407 - protein, 8 aa, Influenza virus
RNVPQIQN

SEQ ID NO: 307408 - protein, 8 aa, Influenza virus
NVPQIQNR

SEQ ID NO: 307409 - protein, 8 aa, Influenza virus
VPQIQNRG

SEQ ID NO: 307410 - protein, 8 aa, Influenza virus
PQIQNRGL

SEQ ID NO: 307411 - protein, 8 aa, Influenza virus
QIQNRGLF

SEQ ID NO: 307412 - protein, 8 aa, Influenza virus
IQNRGLFG

SEQ ID NO: 307413 - protein, 8 aa, Influenza virus
NSEGTGIV

SEQ ID NO: 307414 - protein, 8 aa, Influenza virus
AEGIGIAA

SEQ ID NO: 307415 - protein, 8 aa, Influenza virus
TGIVADRD

SEQ ID NO: 307416 - protein, 8 aa, Influenza virus
EFSEVEIR

SEQ ID NO: 307417 - protein, 8 aa, Influenza virus
FSEVGSRI

SEQ ID NO: 307418 - protein, 8 aa, Influenza virus
SEVEIRIN

SEQ ID NO: 307419 - protein, 8 aa, Influenza virus
VEIRINMI

SEQ ID NO: 307420 - protein, 8 aa, Influenza virus
ESRINTIN

SEQ ID NO: 307421 - protein, 8 aa, Influenza virus
NMINSKIE

SEQ ID NO: 307422 - protein, 8 aa, Influenza virus
MINSKIED

SEQ ID NO: 307423 - protein, 8 aa, Influenza virus
NSKINDQI

SEQ ID NO: 307424 - protein, 8 aa, Influenza virus
IDDQIIDI

SEQ ID NO: 307425 - protein, 8 aa, Influenza virus
EDQITDIW

SEQ ID NO: 307426 - protein, 8 aa, Influenza virus
RNLHERIR

SEQ ID NO: 307427 - protein, 8 aa, Influenza virus
NLHERIRR

SEQ ID NO: 307428 - protein, 8 aa, Influenza virus
KRVLRENA

SEQ ID NO: 307429 - protein, 8 aa, Influenza virus
RVLRENAV

SEQ ID NO: 307430 - protein, 8 aa, Influenza virus
VLRENAVD

SEQ ID NO: 307431 - protein, 8 aa, Influenza virus
ENAIDNGD

SEQ ID NO: 307432 - protein, 8 aa, Influenza virus
NAIDNGDG

SEQ ID NO: 307433 - protein, 8 aa, Influenza virus
AIDNGDGC

SEQ ID NO: 307434 - protein, 8 aa, Influenza virus
IDNGDGCF

SEQ ID NO: 307435 - protein, 8 aa, Influenza virus
EILHKCND

SEQ ID NO: 307436 - protein, 8 aa, Influenza virus
RTGTYNHR

SEQ ID NO: 307437 - protein, 8 aa, Influenza virus
GTYNHKDY

SEQ ID NO: 307438 - protein, 8 aa, Influenza virus
TYNHKDYE

SEQ ID NO: 307439 - protein, 8 aa, Influenza virus
SKIERQKV

SEQ ID NO: 307440 - protein, 8 aa, Influenza virus
TNSSEKVN

SEQ ID NO: 307441 - protein, 8 aa, Influenza virus
NSSDKVDT

SEQ ID NO: 307442 - protein, 8 aa, Influenza virus
SSDKVDTL

SEQ ID NO: 307443 - protein, 8 aa, Influenza virus
SDKVDTLL

SEQ ID NO: 307444 - protein, 8 aa, Influenza virus
VDTLLESD

SEQ ID NO: 307445 - protein, 8 aa, Influenza virus
DTLLESDV

SEQ ID NO: 307446 - protein, 8 aa, Influenza virus
NGVPVTST

SEQ ID NO: 307447 - protein, 8 aa, Influenza virus
VTSTIDLI

SEQ ID NO: 307448 - protein, 8 aa, Influenza virus
TSTIDLIE

SEQ ID NO: 307449 - protein, 8 aa, Influenza virus
STIDLIET

SEQ ID NO: 307450 - protein, 8 aa, Influenza virus
EDPSAPHR

SEQ ID NO: 307451 - protein, 8 aa, Influenza virus
DPSAPHRL

SEQ ID NO: 307452 - protein, 8 aa, Influenza virus
PSAPHRLC

SEQ ID NO: 307453 - protein, 8 aa, Influenza virus
SAPHRLCY

SEQ ID NO: 307454 - protein, 8 aa, Influenza virus
LIAPSSWG

SEQ ID NO: 307455 - protein, 8 aa, Influenza virus
SWGEVIDG

SEQ ID NO: 307456 - protein, 8 aa, Influenza virus
RGTNSFYR

SEQ ID NO: 307457 - protein, 8 aa, Influenza virus
YRNLAWFV

SEQ ID NO: 307458 - protein, 8 aa, Influenza virus
GVYNNTTG

SEQ ID NO: 307459 - protein, 8 aa, Influenza virus
PYTLVTTS

SEQ ID NO: 307460 - protein, 8 aa, Influenza virus
YTLVTTSS

SEQ ID NO: 307461 - protein, 8 aa, Influenza virus
TLVTTSSW

SEQ ID NO: 307462 - protein, 8 aa, Influenza virus
LVTTSSWS

SEQ ID NO: 307463 - protein, 8 aa, Influenza virus
SWTKIYWY

SEQ ID NO: 307464 - protein, 8 aa, Influenza virus
WTKIYWYL

SEQ ID NO: 307465 - protein, 8 aa, Influenza virus
IDRNALGD

SEQ ID NO: 307466 - protein, 8 aa, Influenza virus
DKNALGEC

SEQ ID NO: 307467 - protein, 8 aa, Influenza virus
TGLKNVPA

SEQ ID NO: 307468 - protein, 8 aa, Influenza virus
QGMGMAAD

SEQ ID NO: 307469 - protein, 8 aa, Influenza virus
GMGMAADK

SEQ ID NO: 307470 - protein, 8 aa, Influenza virus
MGMAADKE

SEQ ID NO: 307471 - protein, 8 aa, Influenza virus
GEFNQVEQ

SEQ ID NO: 307472 - protein, 8 aa, Influenza virus
EFNQVEQR

SEQ ID NO: 307473 - protein, 8 aa, Influenza virus
FNQVEQRI

SEQ ID NO: 307474 - protein, 8 aa, Influenza virus
NQVEQRIN

SEQ ID NO: 307475 - protein, 8 aa, Influenza virus
VRNLHEQI

SEQ ID NO: 307476 - protein, 8 aa, Influenza virus
RNLHEQIK

SEQ ID NO: 307477 - protein, 8 aa, Influenza virus
NLHEQIKR

SEQ ID NO: 307478 - protein, 8 aa, Influenza virus
RNGTYNHI

SEQ ID NO: 307479 - protein, 8 aa, Influenza virus
EIEGIKLE

SEQ ID NO: 307480 - protein, 8 aa, Influenza virus
IEGIKLES

SEQ ID NO: 307481 - protein, 8 aa, Influenza virus
LESEDNVY

SEQ ID NO: 307482 - protein, 8 aa, Influenza virus
SEDNVYRA

SEQ ID NO: 307483 - protein, 8 aa, Influenza virus
EDNVYRAL

SEQ ID NO: 307484 - protein, 8 aa, Influenza virus
VLVGLILT

SEQ ID NO: 307485 - protein, 8 aa, Influenza virus
LVGLILTF

SEQ ID NO: 307486 - protein, 8 aa, Influenza virus
LSFIMWAG

SEQ ID NO: 307487 - protein, 8 aa, Influenza virus
MWACSNGN

SEQ ID NO: 307488 - protein, 8 aa, Influenza virus
WACSNGNC

SEQ ID NO: 307489 - protein, 8 aa, Influenza virus
ACSNGNCR

SEQ ID NO: 307490 - protein, 8 aa, Influenza virus
SNGNCRFH

SEQ ID NO: 307491 - protein, 8 aa, Influenza virus
SRYSKADK

SEQ ID NO: 307492 - protein, 8 aa, Influenza virus
SNNATDTV

SEQ ID NO: 307493 - protein, 8 aa, Influenza virus
NNATDTVD

SEQ ID NO: 307494 - protein, 8 aa, Influenza virus
NATDTVDT

SEQ ID NO: 307495 - protein, 8 aa, Influenza virus
ATDTVDTL

SEQ ID NO: 307496 - protein, 8 aa, Influenza virus
NAPNKFCY

SEQ ID NO: 307497 - protein, 8 aa, Influenza virus
APNKFCYP

SEQ ID NO: 307498 - protein, 8 aa, Influenza virus
PNKFCYPG

SEQ ID NO: 307499 - protein, 8 aa, Influenza virus
NKFCYPGE

SEQ ID NO: 307500 - protein, 8 aa, Influenza virus
KFCYPGEL

SEQ ID NO: 307501 - protein, 8 aa, Influenza virus
LCYPGEVD

SEQ ID NO: 307502 - protein, 8 aa, Influenza virus
RTELISPN

SEQ ID NO: 307503 - protein, 8 aa, Influenza virus
TELISPNK

SEQ ID NO: 307504 - protein, 8 aa, Influenza virus
ELISPNKW

SEQ ID NO: 307505 - protein, 8 aa, Influenza virus
LISPNKWG

SEQ ID NO: 307506 - protein, 8 aa, Influenza virus
PNKWGDIL

SEQ ID NO: 307507 - protein, 8 aa, Influenza virus
NKWGDILD

SEQ ID NO: 307508 - protein, 8 aa, Influenza virus
ASCRDNGA

SEQ ID NO: 307509 - protein, 8 aa, Influenza virus
GTSSFYRN

SEQ ID NO: 307510 - protein, 8 aa, Influenza virus
TSSFYRNL

SEQ ID NO: 307511 - protein, 8 aa, Influenza virus
DSFYRNLI

SEQ ID NO: 307512 - protein, 8 aa, Influenza virus
RNLIWLVQ

SEQ ID NO: 307513 - protein, 8 aa, Influenza virus
HHPDTEAV

SEQ ID NO: 307514 - protein, 8 aa, Influenza virus
HPDTEAVA

SEQ ID NO: 307515 - protein, 8 aa, Influenza virus
AINLYASK

SEQ ID NO: 307516 - protein, 8 aa, Influenza virus
INLYASKN

SEQ ID NO: 307517 - protein, 8 aa, Influenza virus
IFQSGVRV

SEQ ID NO: 307518 - protein, 8 aa, Influenza virus
FQSRIRMG

SEQ ID NO: 307519 - protein, 8 aa, Influenza virus
RVARCNTK

SEQ ID NO: 307520 - protein, 8 aa, Influenza virus
VARCNTKC

SEQ ID NO: 307521 - protein, 8 aa, Influenza virus
CQTSLGGV

SEQ ID NO: 307522 - protein, 8 aa, Influenza virus
DERGLFGA

SEQ ID NO: 307523 - protein, 8 aa, Influenza virus
VSTQKALN

SEQ ID NO: 307524 - protein, 8 aa, Influenza virus
VKNLHDQI

SEQ ID NO: 307525 - protein, 8 aa, Influenza virus
KNLHDQIK

SEQ ID NO: 307526 - protein, 8 aa, Influenza virus
CIASSTVM

SEQ ID NO: 307527 - protein, 8 aa, Influenza virus
IASSTVMV

SEQ ID NO: 307528 - protein, 8 aa, Influenza virus
ASSTVMVG

SEQ ID NO: 307529 - protein, 8 aa, Influenza virus
SSTVMVGL

SEQ ID NO: 307530 - protein, 8 aa, Influenza virus
STVMVGLI

SEQ ID NO: 307531 - protein, 8 aa, Influenza virus
TVMVGLIL

SEQ ID NO: 307532 - protein, 8 aa, Influenza virus
EGGWPGLV

SEQ ID NO: 307533 - protein, 8 aa, Influenza virus
GGWPGLVA

SEQ ID NO: 307534 - protein, 8 aa, Influenza virus
GWPGLVAG

SEQ ID NO: 307535 - protein, 8 aa, Influenza virus
WPGLVAGW

SEQ ID NO: 307536 - protein, 8 aa, Influenza virus
PGLVAGWY

SEQ ID NO: 307537 - protein, 8 aa, Influenza virus
LVAGWYGF

SEQ ID NO: 307538 - protein, 8 aa, Influenza virus
VAGWYGFQ

SEQ ID NO: 307539 - protein, 8 aa, Influenza virus
QGVGMAAD

SEQ ID NO: 307540 - protein, 8 aa, Influenza virus
WAYNAELL

SEQ ID NO: 307541 - protein, 8 aa, Influenza virus
YNAKLLVL

SEQ ID NO: 307542 - protein, 8 aa, Influenza virus
NAKLLVLL

SEQ ID NO: 307543 - protein, 8 aa, Influenza virus
AKLLVLLE

SEQ ID NO: 307544 - protein, 8 aa, Influenza virus
KLLVLLEN

SEQ ID NO: 307545 - protein, 8 aa, Influenza virus
LLVLLEND

SEQ ID NO: 307546 - protein, 8 aa, Influenza virus
LLENDKTL

SEQ ID NO: 307547 - protein, 8 aa, Influenza virus
LENDKTLD

SEQ ID NO: 307548 - protein, 8 aa, Influenza virus
GNGCFELL

SEQ ID NO: 307549 - protein, 8 aa, Influenza virus
NGCFELLH

SEQ ID NO: 307550 - protein, 8 aa, Influenza virus
LSIYSSVA

SEQ ID NO: 307551 - protein, 8 aa, Influenza virus
SIYSSVAS

SEQ ID NO: 307552 - protein, 8 aa, Influenza virus
IYSSVASS

SEQ ID NO: 307553 - protein, 8 aa, Influenza virus
LGNPECGL

SEQ ID NO: 307554 - protein, 8 aa, Influenza virus
SWSYIVER

SEQ ID NO: 307555 - protein, 8 aa, Influenza virus
GFYKNLIW

SEQ ID NO: 307556 - protein, 8 aa, Influenza virus
FYKNLLWL

SEQ ID NO: 307557 - protein, 8 aa, Influenza virus
VLVIWGIH

SEQ ID NO: 307558 - protein, 8 aa, Influenza virus
LVIWGIHH

SEQ ID NO: 307559 - protein, 8 aa, Influenza virus
VIWGIHHP

SEQ ID NO: 307560 - protein, 8 aa, Influenza virus
RMNYYWTI

SEQ ID NO: 307561 - protein, 8 aa, Influenza virus
PRDTIIFE

SEQ ID NO: 307562 - protein, 8 aa, Influenza virus
DTIIFEAT

SEQ ID NO: 307563 - protein, 8 aa, Influenza virus
TIIFEATG

SEQ ID NO: 307564 - protein, 8 aa, Influenza virus
EATGNLVA

SEQ ID NO: 307565 - protein, 8 aa, Influenza virus
ATGNLVAP

SEQ ID NO: 307566 - protein, 8 aa, Influenza virus
GALNSNLP

SEQ ID NO: 307567 - protein, 8 aa, Influenza virus
NIHSITIG

SEQ ID NO: 307568 - protein, 8 aa, Influenza virus
HPFTIGEC

SEQ ID NO: 307569 - protein, 8 aa, Influenza virus
PITIGKCS

SEQ ID NO: 307570 - protein, 8 aa, Influenza virus
RLRMATGL

SEQ ID NO: 307571 - protein, 8 aa, Influenza virus
MATGLRNV

SEQ ID NO: 307572 - protein, 8 aa, Influenza virus
KSTQTAID

SEQ ID NO: 307573 - protein, 8 aa, Influenza virus
DGISNKVN

SEQ ID NO: 307574 - protein, 8 aa, Influenza virus
RITNKVNS

SEQ ID NO: 307575 - protein, 8 aa, Influenza virus
LETRIENL

SEQ ID NO: 307576 - protein, 8 aa, Influenza virus
ETRIENLN

SEQ ID NO: 307577 - protein, 8 aa, Influenza virus
RKVDDGFL

SEQ ID NO: 307578 - protein, 8 aa, Influenza virus
DDGFIDVW

SEQ ID NO: 307579 - protein, 8 aa, Influenza virus
DGFIDVWT

SEQ ID NO: 307580 - protein, 8 aa, Influenza virus
GFIDVWTY

SEQ ID NO: 307581 - protein, 8 aa, Influenza virus
FIDVWTYN

SEQ ID NO: 307582 - protein, 8 aa, Influenza virus
RTLDYHDF

SEQ ID NO: 307583 - protein, 8 aa, Influenza virus
KYSKEAKL

SEQ ID NO: 307584 - protein, 8 aa, Influenza virus
IDGIKLES

SEQ ID NO: 307585 - protein, 8 aa, Influenza virus
ASTLVLLV

SEQ ID NO: 307586 - protein, 8 aa, Influenza virus
STLVLLVS

SEQ ID NO: 307587 - protein, 8 aa, Influenza virus
TLVLLVSL

SEQ ID NO: 307588 - protein, 8 aa, Influenza virus
WSLQCRIC

SEQ ID NO: 307589 - protein, 8 aa, Influenza virus
HTKDNSIR

SEQ ID NO: 307590 - protein, 8 aa, Influenza virus
SCSHFECR

SEQ ID NO: 307591 - protein, 8 aa, Influenza virus
HFECRTFF

SEQ ID NO: 307592 - protein, 8 aa, Influenza virus
RHSNGTIK

SEQ ID NO: 307593 - protein, 8 aa, Influenza virus
HSNGTVKB

SEQ ID NO: 307594 - protein, 8 aa, Influenza virus
SNGTVKBR

SEQ ID NO: 307595 - protein, 8 aa, Influenza virus
NGTVKBRS

SEQ ID NO: 307596 - protein, 8 aa, Influenza virus
GTVKBRSP

SEQ ID NO: 307597 - protein, 8 aa, Influenza virus
KDRSPFRA

SEQ ID NO: 307598 - protein, 8 aa, Influenza virus
ASACHDGV

SEQ ID NO: 307599 - protein, 8 aa, Influenza virus
KYNDIITD

SEQ ID NO: 307600 - protein, 8 aa, Influenza virus
YKGIITGT

SEQ ID NO: 307601 - protein, 8 aa, Influenza virus
GVITDTIK

SEQ ID NO: 307602 - protein, 8 aa, Influenza virus
QESECACI

SEQ ID NO: 307603 - protein, 8 aa, Influenza virus
ESECACIN

SEQ ID NO: 307604 - protein, 8 aa, Influenza virus
SECACING

SEQ ID NO: 307605 - protein, 8 aa, Influenza virus
ECACINGS

SEQ ID NO: 307606 - protein, 8 aa, Influenza virus
CACINGSC

SEQ ID NO: 307607 - protein, 8 aa, Influenza virus
APNYYYEE

SEQ ID NO: 307608 - protein, 8 aa, Influenza virus
PNYYYEEC

SEQ ID NO: 307609 - protein, 8 aa, Influenza virus
NYYYEECS

SEQ ID NO: 307610 - protein, 8 aa, Influenza virus
YYYEECSC

SEQ ID NO: 307611 - protein, 8 aa, Influenza virus
PWVSFNHN

SEQ ID NO: 307612 - protein, 8 aa, Influenza virus
WVSFNHNL

SEQ ID NO: 307613 - protein, 8 aa, Influenza virus
MGYICSGV

SEQ ID NO: 307614 - protein, 8 aa, Influenza virus
KGFSYRYG

SEQ ID NO: 307615 - protein, 8 aa, Influenza virus
GFSYRYGN

SEQ ID NO: 307616 - protein, 8 aa, Influenza virus
FSYRYGNG

SEQ ID NO: 307617 - protein, 8 aa, Influenza virus
SYRYGNGV

SEQ ID NO: 307618 - protein, 8 aa, Influenza virus
YRYGNGVW

SEQ ID NO: 307619 - protein, 8 aa, Influenza virus
ELTGMDCI

SEQ ID NO: 307620 - protein, 8 aa, Influenza virus
DGAELPFI

SEQ ID NO: 307621 - protein, 8 aa, Influenza virus
GAELPFII

SEQ ID NO: 307622 - protein, 8 aa, Influenza virus
EKNVAVTH

SEQ ID NO: 307623 - protein, 8 aa, Influenza virus
HNGKLCNL

SEQ ID NO: 307624 - protein, 8 aa, Influenza virus
VVGWISGN

SEQ ID NO: 307625 - protein, 8 aa, Influenza virus
GWVLGNPE

SEQ ID NO: 307626 - protein, 8 aa, Influenza virus
WISGNPEC

SEQ ID NO: 307627 - protein, 8 aa, Influenza virus
EELREQIS

SEQ ID NO: 307628 - protein, 8 aa, Influenza virus
GRMSYYWT

SEQ ID NO: 307629 - protein, 8 aa, Influenza virus
PFQNIHPA

SEQ ID NO: 307630 - protein, 8 aa, Influenza virus
FQNIHPAT

SEQ ID NO: 307631 - protein, 8 aa, Influenza virus
QNIHPATI

SEQ ID NO: 307632 - protein, 8 aa, Influenza virus
NIHPATIG

SEQ ID NO: 307633 - protein, 8 aa, Influenza virus
LRLATGLR

SEQ ID NO: 307634 - protein, 8 aa, Influenza virus
RLATGLRN

SEQ ID NO: 307635 - protein, 8 aa, Influenza virus
RGLRNVPS

SEQ ID NO: 307636 - protein, 8 aa, Influenza virus
GLTNIPSI

SEQ ID NO: 307637 - protein, 8 aa, Influenza virus
LSIQSKGL

SEQ ID NO: 307638 - protein, 8 aa, Influenza virus
SIQSKGLF

SEQ ID NO: 307639 - protein, 8 aa, Influenza virus
IHSRGLFG

SEQ ID NO: 307640 - protein, 8 aa, Influenza virus
TNKVNPVI

SEQ ID NO: 307641 - protein, 8 aa, Influenza virus
ENLNKRVD

SEQ ID NO: 307642 - protein, 8 aa, Influenza virus
NLNKRVDD

SEQ ID NO: 307643 - protein, 8 aa, Influenza virus
NRKVDDGF

SEQ ID NO: 307644 - protein, 8 aa, Influenza virus
KVDDGFVD

SEQ ID NO: 307645 - protein, 8 aa, Influenza virus
DNAKEIGN

SEQ ID NO: 307646 - protein, 8 aa, Influenza virus
EFYHRCDD

SEQ ID NO: 307647 - protein, 8 aa, Influenza virus
SIKNGTYD

SEQ ID NO: 307648 - protein, 8 aa, Influenza virus
IKNGTYDY

SEQ ID NO: 307649 - protein, 8 aa, Influenza virus
HQILAIYS

SEQ ID NO: 307650 - protein, 8 aa, Influenza virus
QILAIYSA

SEQ ID NO: 307651 - protein, 8 aa, Influenza virus
ILAIYSAV

SEQ ID NO: 307652 - protein, 8 aa, Influenza virus
SHGSLQCR

SEQ ID NO: 307653 - protein, 8 aa, Influenza virus
SLQCTICI

SEQ ID NO: 307654 - protein, 8 aa, Influenza virus
YRNWAKPQ

SEQ ID NO: 307655 - protein, 8 aa, Influenza virus
RNWAKPQC

SEQ ID NO: 307656 - protein, 8 aa, Influenza virus
REPYVSCK

SEQ ID NO: 307657 - protein, 8 aa, Influenza virus
DRSPYRTL

SEQ ID NO: 307658 - protein, 8 aa, Influenza virus
RSPYRTLL

SEQ ID NO: 307659 - protein, 8 aa, Influenza virus
SPYRTLLM

SEQ ID NO: 307660 - protein, 8 aa, Influenza virus
VPFYLGTK

SEQ ID NO: 307661 - protein, 8 aa, Influenza virus
NATARFIF

SEQ ID NO: 307662 - protein, 8 aa, Influenza virus
ESECVCVN

SEQ ID NO: 307663 - protein, 8 aa, Influenza virus
ICAVVMTD

SEQ ID NO: 307664 - protein, 8 aa, Influenza virus
KGSNRPVI

SEQ ID NO: 307665 - protein, 8 aa, Influenza virus
GSHGVKGW

SEQ ID NO: 307666 - protein, 8 aa, Influenza virus
SHGVKGWA

SEQ ID NO: 307667 - protein, 8 aa, Influenza virus
VKGWAFDE

SEQ ID NO: 307668 - protein, 8 aa, Influenza virus
MSGYSGIF

SEQ ID NO: 307669 - protein, 8 aa, Influenza virus
VELIRGRE

SEQ ID NO: 307670 - protein, 8 aa, Influenza virus
TSGIYGTG

SEQ ID NO: 307671 - protein, 8 aa, Influenza virus
GTYGKGSW

SEQ ID NO: 307672 - protein, 8 aa, Influenza virus
TYGAGSWP

SEQ ID NO: 307673 - protein, 8 aa, Influenza virus
TGSWPDGR

SEQ ID NO: 307674 - protein, 8 aa, Influenza virus
QICVGYHA

SEQ ID NO: 307675 - protein, 8 aa, Influenza virus
HSNNSTKK

SEQ ID NO: 307676 - protein, 8 aa, Influenza virus
NNSTKKVD

SEQ ID NO: 307677 - protein, 8 aa, Influenza virus
NSTEKIDT

SEQ ID NO: 307678 - protein, 8 aa, Influenza virus
IDTILERN

SEQ ID NO: 307679 - protein, 8 aa, Influenza virus
HAKDILER

SEQ ID NO: 307680 - protein, 8 aa, Influenza virus
NGKLCRLN

SEQ ID NO: 307681 - protein, 8 aa, Influenza virus
GKLCRLNG

SEQ ID NO: 307682 - protein, 8 aa, Influenza virus
LNGVPPLE

SEQ ID NO: 307683 - protein, 8 aa, Influenza virus
NGVPPLEL

SEQ ID NO: 307684 - protein, 8 aa, Influenza virus
TPPLELGD

SEQ ID NO: 307685 - protein, 8 aa, Influenza virus
GNPKCDRL

SEQ ID NO: 307686 - protein, 8 aa, Influenza virus
NPKCDRLL

SEQ ID NO: 307687 - protein, 8 aa, Influenza virus
WSYIMEKK

SEQ ID NO: 307688 - protein, 8 aa, Influenza virus
LNDYEELK

SEQ ID NO: 307689 - protein, 8 aa, Influenza virus
NDYEEFKH

SEQ ID NO: 307690 - protein, 8 aa, Influenza virus
HFEKIRIL

SEQ ID NO: 307691 - protein, 8 aa, Influenza virus
NNTSGEQV

SEQ ID NO: 307692 - protein, 8 aa, Influenza virus
NTSGEQVL

SEQ ID NO: 307693 - protein, 8 aa, Influenza virus
TSTVNKRS

SEQ ID NO: 307694 - protein, 8 aa, Influenza virus
GLGRRMEF

SEQ ID NO: 307695 - protein, 8 aa, Influenza virus
GRMEFFWT

SEQ ID NO: 307696 - protein, 8 aa, Influenza virus
KRGSSGVM

SEQ ID NO: 307697 - protein, 8 aa, Influenza virus
RGSSGVMK

SEQ ID NO: 307698 - protein, 8 aa, Influenza virus
GSSGVMKT

SEQ ID NO: 307699 - protein, 8 aa, Influenza virus
CDTKCQTP

SEQ ID NO: 307700 - protein, 8 aa, Influenza virus
DTKCQTPL

SEQ ID NO: 307701 - protein, 8 aa, Influenza virus
LVLATGLK

SEQ ID NO: 307702 - protein, 8 aa, Influenza virus
VLATGLKN

SEQ ID NO: 307703 - protein, 8 aa, Influenza virus
PQTESRGL

SEQ ID NO: 307704 - protein, 8 aa, Influenza virus
QIEARGLF

SEQ ID NO: 307705 - protein, 8 aa, Influenza virus
IEARGLFG

SEQ ID NO: 307706 - protein, 8 aa, Influenza virus
SVIEKMNI

SEQ ID NO: 307707 - protein, 8 aa, Influenza virus
VVEKMNTQ

SEQ ID NO: 307708 - protein, 8 aa, Influenza virus
IEKMNTRF

SEQ ID NO: 307709 - protein, 8 aa, Influenza virus
EKMNTRFE

SEQ ID NO: 307710 - protein, 8 aa, Influenza virus
KKMEDGFR

SEQ ID NO: 307711 - protein, 8 aa, Influenza virus
SNVKNLYE

SEQ ID NO: 307712 - protein, 8 aa, Influenza virus
NLYDRVRM

SEQ ID NO: 307713 - protein, 8 aa, Influenza virus
DKVRMQLK

SEQ ID NO: 307714 - protein, 8 aa, Influenza virus
LRDNAKET

SEQ ID NO: 307715 - protein, 8 aa, Influenza virus
RDNAKETG

SEQ ID NO: 307716 - protein, 8 aa, Influenza virus
DNAKETGN

SEQ ID NO: 307717 - protein, 8 aa, Influenza virus
NAKETGNG

SEQ ID NO: 307718 - protein, 8 aa, Influenza virus
AKETGNGC

SEQ ID NO: 307719 - protein, 8 aa, Influenza virus
KCNDECMN

SEQ ID NO: 307720 - protein, 8 aa, Influenza virus
CNDECMNS

SEQ ID NO: 307721 - protein, 8 aa, Influenza virus
SVKNGTYY

SEQ ID NO: 307722 - protein, 8 aa, Influenza virus
VKNGTYYY

SEQ ID NO: 307723 - protein, 8 aa, Influenza virus
TGTYDYPK

SEQ ID NO: 307724 - protein, 8 aa, Influenza virus
YDYPKYEK

SEQ ID NO: 307725 - protein, 8 aa, Influenza virus
NYSKYEEE

SEQ ID NO: 307726 - protein, 8 aa, Influenza virus
EESKLNRS

SEQ ID NO: 307727 - protein, 8 aa, Influenza virus
ESKLNRSE

SEQ ID NO: 307728 - protein, 8 aa, Influenza virus
SKLNRSEI

SEQ ID NO: 307729 - protein, 8 aa, Influenza virus
KLNRSEIK

SEQ ID NO: 307730 - protein, 8 aa, Influenza virus
NEIKGLKL

SEQ ID NO: 307731 - protein, 8 aa, Influenza virus
EIKGVKLR

SEQ ID NO: 307732 - protein, 8 aa, Influenza virus
AIMMAGIF

SEQ ID NO: 307733 - protein, 8 aa, Influenza virus
AGIFFWMC

SEQ ID NO: 307734 - protein, 8 aa, Influenza virus
GIFFWMCS

SEQ ID NO: 307735 - protein, 8 aa, Influenza virus
IFFWMCSN

SEQ ID NO: 307736 - protein, 8 aa, Influenza virus
FFWMCSNG

SEQ ID NO: 307737 - protein, 8 aa, Influenza virus
NNSTKKVD

SEQ ID NO: 307738 - protein, 8 aa, Influenza virus
NSTKKVDT

SEQ ID NO: 307739 - protein, 8 aa, Influenza virus
KADTILER

SEQ ID NO: 307740 - protein, 8 aa, Influenza virus
AQNILEKT

SEQ ID NO: 307741 - protein, 8 aa, Influenza virus
QDILERTH

SEQ ID NO: 307742 - protein, 8 aa, Influenza virus
PECDRFLS

SEQ ID NO: 307743 - protein, 8 aa, Influenza virus
LIVPEWSY

SEQ ID NO: 307744 - protein, 8 aa, Influenza virus
SIPEWSYI

SEQ ID NO: 307745 - protein, 8 aa, Influenza virus
SYIIEKEN

SEQ ID NO: 307746 - protein, 8 aa, Influenza virus
YIIEKENP

SEQ ID NO: 307747 - protein, 8 aa, Influenza virus
YNLCYPGS

SEQ ID NO: 307748 - protein, 8 aa, Influenza virus
GLCYPGNF

SEQ ID NO: 307749 - protein, 8 aa, Influenza virus
DYEELKYL

SEQ ID NO: 307750 - protein, 8 aa, Influenza virus
SVTHFEKI

SEQ ID NO: 307751 - protein, 8 aa, Influenza virus
VTHFEKIK

SEQ ID NO: 307752 - protein, 8 aa, Influenza virus
THFEKIKI

SEQ ID NO: 307753 - protein, 8 aa, Influenza virus
EKIKILPR

SEQ ID NO: 307754 - protein, 8 aa, Influenza virus
KVKILARN

SEQ ID NO: 307755 - protein, 8 aa, Influenza virus
VARGSYNN

SEQ ID NO: 307756 - protein, 8 aa, Influenza virus
RGSYNNTS

SEQ ID NO: 307757 - protein, 8 aa, Influenza virus
GIHHPNDE

SEQ ID NO: 307758 - protein, 8 aa, Influenza virus
GLESRMEF

SEQ ID NO: 307759 - protein, 8 aa, Influenza virus
WDTISFES

SEQ ID NO: 307760 - protein, 8 aa, Influenza virus
IMKTEKTF

SEQ ID NO: 307761 - protein, 8 aa, Influenza virus
MKTEKTFE

SEQ ID NO: 307762 - protein, 8 aa, Influenza virus
ENCETQCQ

SEQ ID NO: 307763 - protein, 8 aa, Influenza virus
NCETQCQT

SEQ ID NO: 307764 - protein, 8 aa, Influenza virus
PRYVKSEK

SEQ ID NO: 307765 - protein, 8 aa, Influenza virus
KYVKSKRL

SEQ ID NO: 307766 - protein, 8 aa, Influenza virus
RNVPQIEA

SEQ ID NO: 307767 - protein, 8 aa, Influenza virus
NVPQIEPR

SEQ ID NO: 307768 - protein, 8 aa, Influenza virus
AHKMESRG

SEQ ID NO: 307769 - protein, 8 aa, Influenza virus
KESTQKAV

SEQ ID NO: 307770 - protein, 8 aa, Influenza virus
ENSVIEKM

SEQ ID NO: 307771 - protein, 8 aa, Influenza virus
SVIEKINT

SEQ ID NO: 307772 - protein, 8 aa, Influenza virus
EKINTQFE

SEQ ID NO: 307773 - protein, 8 aa, Influenza virus
AVEKEFSN

SEQ ID NO: 307774 - protein, 8 aa, Influenza virus
KEFGNLER

SEQ ID NO: 307775 - protein, 8 aa, Influenza virus
EFGNLERR

SEQ ID NO: 307776 - protein, 8 aa, Influenza virus
FGNLERRL

SEQ ID NO: 307777 - protein, 8 aa, Influenza virus
GNLERRLE

SEQ ID NO: 307778 - protein, 8 aa, Influenza virus
LENLNKRM

SEQ ID NO: 307779 - protein, 8 aa, Influenza virus
ENLSKRME

SEQ ID NO: 307780 - protein, 8 aa, Influenza virus
NKKMEDGL

SEQ ID NO: 307781 - protein, 8 aa, Influenza virus
MEDGFLGV

SEQ ID NO: 307782 - protein, 8 aa, Influenza virus
SNVRNLYD

SEQ ID NO: 307783 - protein, 8 aa, Influenza virus
VRNLYDKV

SEQ ID NO: 307784 - protein, 8 aa, Influenza virus
RNLYDKVR

SEQ ID NO: 307785 - protein, 8 aa, Influenza virus
CMNSVKTG

SEQ ID NO: 307786 - protein, 8 aa, Influenza virus
MNSVKTGT

SEQ ID NO: 307787 - protein, 8 aa, Influenza virus
NSIRNGTY

SEQ ID NO: 307788 - protein, 8 aa, Influenza virus
SIRNGTYD

SEQ ID NO: 307789 - protein, 8 aa, Influenza virus
IRNGTYDY

SEQ ID NO: 307790 - protein, 8 aa, Influenza virus
RNGTYNYP

SEQ ID NO: 307791 - protein, 8 aa, Influenza virus
VELSSMGV

SEQ ID NO: 307792 - protein, 8 aa, Influenza virus
ELSSMGVY

SEQ ID NO: 307793 - protein, 8 aa, Influenza virus
AIMMAGIF

SEQ ID NO: 307794 - protein, 8 aa, Influenza virus
KIITIDSV

SEQ ID NO: 307795 - protein, 8 aa, Influenza virus
IITMGSVS

SEQ ID NO: 307796 - protein, 8 aa, Influenza virus
TIDSVSLT

SEQ ID NO: 307797 - protein, 8 aa, Influenza virus
HFKQHKCD

SEQ ID NO: 307798 - protein, 8 aa, Influenza virus
KEIVYLNN

SEQ ID NO: 307799 - protein, 8 aa, Influenza virus
IMYLNNTT

SEQ ID NO: 307800 - protein, 8 aa, Influenza virus
YLNNTTLE

SEQ ID NO: 307801 - protein, 8 aa, Influenza virus
GGGDIWVT

SEQ ID NO: 307802 - protein, 8 aa, Influenza virus
EPYVSCGP

SEQ ID NO: 307803 - protein, 8 aa, Influenza virus
SKCHQFAL

SEQ ID NO: 307804 - protein, 8 aa, Influenza virus
TIHDRSPH

SEQ ID NO: 307805 - protein, 8 aa, Influenza virus
IHDRSPHR

SEQ ID NO: 307806 - protein, 8 aa, Influenza virus
LGTKQVCA

SEQ ID NO: 307807 - protein, 8 aa, Influenza virus
GTKQVCAA

SEQ ID NO: 307808 - protein, 8 aa, Influenza virus
TKQVCAAW

SEQ ID NO: 307809 - protein, 8 aa, Influenza virus
KQVCAAWS

SEQ ID NO: 307810 - protein, 8 aa, Influenza virus
CVTGDDEN

SEQ ID NO: 307811 - protein, 8 aa, Influenza virus
VTGYEKNA

SEQ ID NO: 307812 - protein, 8 aa, Influenza virus
ATASFIYG

SEQ ID NO: 307813 - protein, 8 aa, Influenza virus
TASFIYGG

SEQ ID NO: 307814 - protein, 8 aa, Influenza virus
DTKILFIE

SEQ ID NO: 307815 - protein, 8 aa, Influenza virus
TKILFIEE

SEQ ID NO: 307816 - protein, 8 aa, Influenza virus
KILFIEEG

SEQ ID NO: 307817 - protein, 8 aa, Influenza virus
LFIEEGKV

SEQ ID NO: 307818 - protein, 8 aa, Influenza virus
EGKIVHVS

SEQ ID NO: 307819 - protein, 8 aa, Influenza virus
GKIVHVSP

SEQ ID NO: 307820 - protein, 8 aa, Influenza virus
KIVHVSPL

SEQ ID NO: 307821 - protein, 8 aa, Influenza virus
VHVSPLSG

SEQ ID NO: 307822 - protein, 8 aa, Influenza virus
RYPDVRCT

SEQ ID NO: 307823 - protein, 8 aa, Influenza virus
PDVRCICK

SEQ ID NO: 307824 - protein, 8 aa, Influenza virus
DVRCICKD

SEQ ID NO: 307825 - protein, 8 aa, Influenza virus
GSNRPIVD

SEQ ID NO: 307826 - protein, 8 aa, Influenza virus
SNRPIVDI

SEQ ID NO: 307827 - protein, 8 aa, Influenza virus
NRPIVDIN

SEQ ID NO: 307828 - protein, 8 aa, Influenza virus
SMEDYSIG

SEQ ID NO: 307829 - protein, 8 aa, Influenza virus
TPRSDDSS

SEQ ID NO: 307830 - protein, 8 aa, Influenza virus
PRNNDGSS

SEQ ID NO: 307831 - protein, 8 aa, Influenza virus
DSSSNSKS

SEQ ID NO: 307832 - protein, 8 aa, Influenza virus
SNSKSRDP

SEQ ID NO: 307833 - protein, 8 aa, Influenza virus
NSKSRDPN

SEQ ID NO: 307834 - protein, 8 aa, Influenza virus
DPNNERGT

SEQ ID NO: 307835 - protein, 8 aa, Influenza virus
PNNERGYP

SEQ ID NO: 307836 - protein, 8 aa, Influenza virus
NNERGNHG

SEQ ID NO: 307837 - protein, 8 aa, Influenza virus
NERGYPGV

SEQ ID NO: 307838 - protein, 8 aa, Influenza virus
ERGNHGVK

SEQ ID NO: 307839 - protein, 8 aa, Influenza virus
RGNHGVKG

SEQ ID NO: 307840 - protein, 8 aa, Influenza virus
GNDLWMGT

SEQ ID NO: 307841 - protein, 8 aa, Influenza virus
NDLWMGTT

SEQ ID NO: 307842 - protein, 8 aa, Influenza virus
VLMGRTIS

SEQ ID NO: 307843 - protein, 8 aa, Influenza virus
WMGRTIGK

SEQ ID NO: 307844 - protein, 8 aa, Influenza virus
FRVIGGWV

SEQ ID NO: 307845 - protein, 8 aa, Influenza virus
RVIGGWVT

SEQ ID NO: 307846 - protein, 8 aa, Influenza virus
VIGGWVTA

SEQ ID NO: 307847 - protein, 8 aa, Influenza virus
SKSQANRQ

SEQ ID NO: 307848 - protein, 8 aa, Influenza virus
RQVIVGNN

SEQ ID NO: 307849 - protein, 8 aa, Influenza virus
KNNWSGYS

SEQ ID NO: 307850 - protein, 8 aa, Influenza virus
KNCINRCF

SEQ ID NO: 307851 - protein, 8 aa, Influenza virus
NCINRCFY

SEQ ID NO: 307852 - protein, 8 aa, Influenza virus
VELIRGMP

SEQ ID NO: 307853 - protein, 8 aa, Influenza virus
ELIRGRRQ

SEQ ID NO: 307854 - protein, 8 aa, Influenza virus
LIRGRRQE

SEQ ID NO: 307855 - protein, 8 aa, Influenza virus
PQEARVWW

SEQ ID NO: 307856 - protein, 8 aa, Influenza virus
PDGANISF

SEQ ID NO: 307857 - protein, 8 aa, Influenza virus
DGANTNFM

SEQ ID NO: 307858 - protein, 8 aa, Influenza virus
GANTNFMP

SEQ ID NO: 307859 - protein, 8 aa, Influenza virus
ANIDFMPV

SEQ ID NO: 307860 - protein, 8 aa, Influenza virus
WDLYIERS

SEQ ID NO: 307861 - protein, 8 aa, Influenza virus
SDCYPYDV

SEQ ID NO: 307862 - protein, 8 aa, Influenza virus
CYPYDVQD

SEQ ID NO: 307863 - protein, 8 aa, Influenza virus
LVASSGNL

SEQ ID NO: 307864 - protein, 8 aa, Influenza virus
FARLNWLT

SEQ ID NO: 307865 - protein, 8 aa, Influenza virus
SIHWTIVK

SEQ ID NO: 307866 - protein, 8 aa, Influenza virus
APRGYYKM

SEQ ID NO: 307867 - protein, 8 aa, Influenza virus
PNGSIPNG

SEQ ID NO: 307868 - protein, 8 aa, Influenza virus
NGSIPNGK

SEQ ID NO: 307869 - protein, 8 aa, Influenza virus
GSIPNGKP

SEQ ID NO: 307870 - protein, 8 aa, Influenza virus
SIPNGKPF

SEQ ID NO: 307871 - protein, 8 aa, Influenza virus
IPNGKPFQ

SEQ ID NO: 307872 - protein, 8 aa, Influenza virus
PNGKPFQN

SEQ ID NO: 307873 - protein, 8 aa, Influenza virus
QDTLKLAT

SEQ ID NO: 307874 - protein, 8 aa, Influenza virus
GMRNIPER

SEQ ID NO: 307875 - protein, 8 aa, Influenza virus
MRNIPERQ

SEQ ID NO: 307876 - protein, 8 aa, Influenza virus
QARGIFGA

SEQ ID NO: 307877 - protein, 8 aa, Influenza virus
TRGLFGAK

SEQ ID NO: 307878 - protein, 8 aa, Influenza virus
QNSEGMGQ

SEQ ID NO: 307879 - protein, 8 aa, Influenza virus
QVNGKLNR

SEQ ID NO: 307880 - protein, 8 aa, Influenza virus
VEKTNEKF

SEQ ID NO: 307881 - protein, 8 aa, Influenza virus
DLADSEMN

SEQ ID NO: 307882 - protein, 8 aa, Influenza virus
EDIGNGCF

SEQ ID NO: 307883 - protein, 8 aa, Influenza virus
GNGCLKIY

SEQ ID NO: 307884 - protein, 8 aa, Influenza virus
NGCLKIYH

SEQ ID NO: 307885 - protein, 8 aa, Influenza virus
FKIYHRCD

SEQ ID NO: 307886 - protein, 8 aa, Influenza virus
IYHKCNNA

SEQ ID NO: 307887 - protein, 8 aa, Influenza virus
YHKCNNAC

SEQ ID NO: 307888 - protein, 8 aa, Influenza virus
GSIRNETY

SEQ ID NO: 307889 - protein, 8 aa, Influenza virus
DEALNNRL

SEQ ID NO: 307890 - protein, 8 aa, Influenza virus
EALSNRFQ

SEQ ID NO: 307891 - protein, 8 aa, Influenza virus
GYKNWILW

SEQ ID NO: 307892 - protein, 8 aa, Influenza virus
FAISCLLL

SEQ ID NO: 307893 - protein, 8 aa, Influenza virus
AISCLLLC

SEQ ID NO: 307894 - protein, 8 aa, Influenza virus
VPNGTMVK

SEQ ID NO: 307895 - protein, 8 aa, Influenza virus
PNGTMVKT

SEQ ID NO: 307896 - protein, 8 aa, Influenza virus
YPYDVQDY

SEQ ID NO: 307897 - protein, 8 aa, Influenza virus
SSGNLEFT

SEQ ID NO: 307898 - protein, 8 aa, Influenza virus
WGVHHPVT

SEQ ID NO: 307899 - protein, 8 aa, Influenza virus
ISVYWTIV

SEQ ID NO: 307900 - protein, 8 aa, Influenza virus
IYWTVVKP

SEQ ID NO: 307901 - protein, 8 aa, Influenza virus
GKSSIIRS

SEQ ID NO: 307902 - protein, 8 aa, Influenza virus
RSSIMRSD

SEQ ID NO: 307903 - protein, 8 aa, Influenza virus
SSIIRSDA

SEQ ID NO: 307904 - protein, 8 aa, Influenza virus
PNGSIPNN

SEQ ID NO: 307905 - protein, 8 aa, Influenza virus
NGSIPNNK

SEQ ID NO: 307906 - protein, 8 aa, Influenza virus
GSIPNNKP

SEQ ID NO: 307907 - protein, 8 aa, Influenza virus
SIPNGKPF

SEQ ID NO: 307908 - protein, 8 aa, Influenza virus
IPNGKPFQ

SEQ ID NO: 307909 - protein, 8 aa, Influenza virus
PNNKPFQN

SEQ ID NO: 307910 - protein, 8 aa, Influenza virus
INRITYGA

SEQ ID NO: 307911 - protein, 8 aa, Influenza virus
YGACPRYI

SEQ ID NO: 307912 - protein, 8 aa, Influenza virus
YVRQNTLK

SEQ ID NO: 307913 - protein, 8 aa, Influenza virus
GMRNIPER

SEQ ID NO: 307914 - protein, 8 aa, Influenza virus
MRNIPERQ

SEQ ID NO: 307915 - protein, 8 aa, Influenza virus
RNIPERQT

SEQ ID NO: 307916 - protein, 8 aa, Influenza virus
NIPERQTR

SEQ ID NO: 307917 - protein, 8 aa, Influenza virus
IPERQTRG

SEQ ID NO: 307918 - protein, 8 aa, Influenza virus
PERQTRGL

SEQ ID NO: 307919 - protein, 8 aa, Influenza virus
ERQTRGLF

SEQ ID NO: 307920 - protein, 8 aa, Influenza virus
RQTRGLFG

SEQ ID NO: 307921 - protein, 8 aa, Influenza virus
RHQNSEGM

SEQ ID NO: 307922 - protein, 8 aa, Influenza virus
HQNSEGMG

SEQ ID NO: 307923 - protein, 8 aa, Influenza virus
QNSEGMGQ

SEQ ID NO: 307924 - protein, 8 aa, Influenza virus
TQITGKLN

SEQ ID NO: 307925 - protein, 8 aa, Influenza virus
QISGKLNR

SEQ ID NO: 307926 - protein, 8 aa, Influenza virus
DLGNGCFK

SEQ ID NO: 307927 - protein, 8 aa, Influenza virus
HKCDNACM

SEQ ID NO: 307928 - protein, 8 aa, Influenza virus
NNRLQIKG

SEQ ID NO: 307929 - protein, 8 aa, Influenza virus
NRFHIKGV

SEQ ID NO: 307930 - protein, 8 aa, Influenza virus
LKSGYKEW

SEQ ID NO: 307931 - protein, 8 aa, Influenza virus
NPNQRIIT

SEQ ID NO: 307932 - protein, 8 aa, Influenza virus
PIQKIITI

SEQ ID NO: 307933 - protein, 8 aa, Influenza virus
QKIITISS

SEQ ID NO: 307934 - protein, 8 aa, Influenza virus
KIITIGSI

SEQ ID NO: 307935 - protein, 8 aa, Influenza virus
TTVTLHLK

SEQ ID NO: 307936 - protein, 8 aa, Influenza virus
TVTLYFKQ

SEQ ID NO: 307937 - protein, 8 aa, Influenza virus
YRNWTKPQ

SEQ ID NO: 307938 - protein, 8 aa, Influenza virus
RNWTKPQC

SEQ ID NO: 307939 - protein, 8 aa, Influenza virus
DNNATASF

SEQ ID NO: 307940 - protein, 8 aa, Influenza virus
RNATASFV

SEQ ID NO: 307941 - protein, 8 aa, Influenza virus
LIDSISSW

SEQ ID NO: 307942 - protein, 8 aa, Influenza virus
IDSISSWS

SEQ ID NO: 307943 - protein, 8 aa, Influenza virus
LFVKEGKI

SEQ ID NO: 307944 - protein, 8 aa, Influenza virus
SCYPRYSG

SEQ ID NO: 307945 - protein, 8 aa, Influenza virus
GIRCVCRD

SEQ ID NO: 307946 - protein, 8 aa, Influenza virus
RGSNRPIV

SEQ ID NO: 307947 - protein, 8 aa, Influenza virus
NRPVVDIR

SEQ ID NO: 307948 - protein, 8 aa, Influenza virus
GNDLWMGR

SEQ ID NO: 307949 - protein, 8 aa, Influenza virus
LRLGYETF

SEQ ID NO: 307950 - protein, 8 aa, Influenza virus
QISRQVIV

SEQ ID NO: 307951 - protein, 8 aa, Influenza virus
DVLWTSNS

SEQ ID NO: 307952 - protein, 8 aa, Influenza virus
GHHAVTNG

SEQ ID NO: 307953 - protein, 8 aa, Influenza virus
HHAVTNGT

SEQ ID NO: 307954 - protein, 8 aa, Influenza virus
VTNGTMVK

SEQ ID NO: 307955 - protein, 8 aa, Influenza virus
TNGTMVKT

SEQ ID NO: 307956 - protein, 8 aa, Influenza virus
TMVKTLTN

SEQ ID NO: 307957 - protein, 8 aa, Influenza virus
VKTLTGDQ

SEQ ID NO: 307958 - protein, 8 aa, Influenza virus
VEVITAQE

SEQ ID NO: 307959 - protein, 8 aa, Influenza virus
PELCPKPL

SEQ ID NO: 307960 - protein, 8 aa, Influenza virus
CPKPLKLV

SEQ ID NO: 307961 - protein, 8 aa, Influenza virus
SSPLRLVD

SEQ ID NO: 307962 - protein, 8 aa, Influenza virus
KPLKLVDG

SEQ ID NO: 307963 - protein, 8 aa, Influenza virus
DVPDYQSI

SEQ ID NO: 307964 - protein, 8 aa, Influenza virus
VPGYQSLR

SEQ ID NO: 307965 - protein, 8 aa, Influenza virus
PDYQSIRS

SEQ ID NO: 307966 - protein, 8 aa, Influenza virus
GYQSLRSI

SEQ ID NO: 307967 - protein, 8 aa, Influenza virus
KFEFIVEK

SEQ ID NO: 307968 - protein, 8 aa, Influenza virus
FITEEFQW

SEQ ID NO: 307969 - protein, 8 aa, Influenza virus
RANENDFF

SEQ ID NO: 307970 - protein, 8 aa, Influenza virus
LNWLVKSN

SEQ ID NO: 307971 - protein, 8 aa, Influenza virus
LTKTNNGD

SEQ ID NO: 307972 - protein, 8 aa, Influenza virus
TKTNNGDY

SEQ ID NO: 307973 - protein, 8 aa, Influenza virus
KSNPGRVT

SEQ ID NO: 307974 - protein, 8 aa, Influenza virus
TSVIPNIG

SEQ ID NO: 307975 - protein, 8 aa, Influenza virus
SVIPNIGS

SEQ ID NO: 307976 - protein, 8 aa, Influenza virus
IGSCVSRC

SEQ ID NO: 307977 - protein, 8 aa, Influenza virus
GSCVSRCH

SEQ ID NO: 307978 - protein, 8 aa, Influenza virus
SCISKCHT

SEQ ID NO: 307979 - protein, 8 aa, Influenza virus
SKCHTNRG

SEQ ID NO: 307980 - protein, 8 aa, Influenza virus
KCHTNRGS

SEQ ID NO: 307981 - protein, 8 aa, Influenza virus
FQNVSRTA

SEQ ID NO: 307982 - protein, 8 aa, Influenza virus
GNCPKYVK

SEQ ID NO: 307983 - protein, 8 aa, Influenza virus
QAAINQIN

SEQ ID NO: 307984 - protein, 8 aa, Influenza virus
AAINQING

SEQ ID NO: 307985 - protein, 8 aa, Influenza virus
VTDSEMSK

SEQ ID NO: 307986 - protein, 8 aa, Influenza virus
SKLFERVR

SEQ ID NO: 307987 - protein, 8 aa, Influenza virus
CGNNCIES

SEQ ID NO: 307988 - protein, 8 aa, Influenza virus
DNTCIESI

SEQ ID NO: 307989 - protein, 8 aa, Influenza virus
TYNHNIYR

SEQ ID NO: 307990 - protein, 8 aa, Influenza virus
HNVYRDEA

SEQ ID NO: 307991 - protein, 8 aa, Influenza virus
NVYRDEAI

SEQ ID NO: 307992 - protein, 8 aa, Influenza virus
VYRDEAIS

SEQ ID NO: 307993 - protein, 8 aa, Influenza virus
QIQGIKLT

SEQ ID NO: 307994 - protein, 8 aa, Influenza virus
FLLVALFL

SEQ ID NO: 307995 - protein, 8 aa, Influenza virus
ALFLAFIL

SEQ ID NO: 307996 - protein, 8 aa, Influenza virus
LLLTFILW

SEQ ID NO: 307997 - protein, 8 aa, Influenza virus
FLAFILWA

SEQ ID NO: 307998 - protein, 8 aa, Influenza virus
QNGNIRWQ

SEQ ID NO: 307999 - protein, 8 aa, Influenza virus
SDQICVGY

SEQ ID NO: 308000 - protein, 8 aa, Influenza virus
HANNSTER

SEQ ID NO: 308001 - protein, 8 aa, Influenza virus
STEHVDTI

SEQ ID NO: 308002 - protein, 8 aa, Influenza virus
ERVDTIME

SEQ ID NO: 308003 - protein, 8 aa, Influenza virus
GVKPLILG

SEQ ID NO: 308004 - protein, 8 aa, Influenza virus
KPLILGDC

SEQ ID NO: 308005 - protein, 8 aa, Influenza virus
FILKDCSV

SEQ ID NO: 308006 - protein, 8 aa, Influenza virus
ILGDCSVA

SEQ ID NO: 308007 - protein, 8 aa, Influenza virus
LKDCSVSG

SEQ ID NO: 308008 - protein, 8 aa, Influenza virus
KDCSVSGW

SEQ ID NO: 308009 - protein, 8 aa, Influenza virus
NAPEWSYI

SEQ ID NO: 308010 - protein, 8 aa, Influenza virus
DYEEMKHL

SEQ ID NO: 308011 - protein, 8 aa, Influenza virus
SFFRNMVW

SEQ ID NO: 308012 - protein, 8 aa, Influenza virus
FFRNLVWL

SEQ ID NO: 308013 - protein, 8 aa, Influenza virus
LLVLWGVH

SEQ ID NO: 308014 - protein, 8 aa, Influenza virus
LVLWGVHH

SEQ ID NO: 308015 - protein, 8 aa, Influenza virus
HISVGTST

SEQ ID NO: 308016 - protein, 8 aa, Influenza virus
TSTLNQRM

SEQ ID NO: 308017 - protein, 8 aa, Influenza virus
CQTPMGAV

SEQ ID NO: 308018 - protein, 8 aa, Influenza virus
QTPMGAVN

SEQ ID NO: 308019 - protein, 8 aa, Influenza virus
GAINTSMP

SEQ ID NO: 308020 - protein, 8 aa, Influenza virus
NSSKPFHN

SEQ ID NO: 308021 - protein, 8 aa, Influenza virus
SSKPFHNI

SEQ ID NO: 308022 - protein, 8 aa, Influenza virus
VHPLAIGE

SEQ ID NO: 308023 - protein, 8 aa, Influenza virus
RRKRRGLF

SEQ ID NO: 308024 - protein, 8 aa, Influenza virus
KRRGLFGA

SEQ ID NO: 308025 - protein, 8 aa, Influenza virus
ADRESTQK

SEQ ID NO: 308026 - protein, 8 aa, Influenza virus
DRESTQKA

SEQ ID NO: 308027 - protein, 8 aa, Influenza virus
ESTQKAVD

SEQ ID NO: 308028 - protein, 8 aa, Influenza virus
DGITNKIN

SEQ ID NO: 308029 - protein, 8 aa, Influenza virus
NRVNSIID

SEQ ID NO: 308030 - protein, 8 aa, Influenza virus
RVNSIIDK

SEQ ID NO: 308031 - protein, 8 aa, Influenza virus
IIDKMNIQ

SEQ ID NO: 308032 - protein, 8 aa, Influenza virus
IDKMNIQF

SEQ ID NO: 308033 - protein, 8 aa, Influenza virus
NLNKKMEE

SEQ ID NO: 308034 - protein, 8 aa, Influenza virus
EDGFLGVW

SEQ ID NO: 308035 - protein, 8 aa, Influenza virus
GFLGVWTY

SEQ ID NO: 308036 - protein, 8 aa, Influenza virus
NVKNLYDR

SEQ ID NO: 308037 - protein, 8 aa, Influenza virus
VKNLYDRV

SEQ ID NO: 308038 - protein, 8 aa, Influenza virus
KNLYNKVR

SEQ ID NO: 308039 - protein, 8 aa, Influenza virus
NLYDKVRH

SEQ ID NO: 308040 - protein, 8 aa, Influenza virus
MDSVRNGT

SEQ ID NO: 308041 - protein, 8 aa, Influenza virus
VSSLALAI

SEQ ID NO: 308042 - protein, 8 aa, Influenza virus
CIKICESR

SEQ ID NO: 308043 - protein, 8 aa, Influenza virus
HANNSTER

SEQ ID NO: 308044 - protein, 8 aa, Influenza virus
ANNSTEHV

SEQ ID NO: 308045 - protein, 8 aa, Influenza virus
NNSTEHVD

SEQ ID NO: 308046 - protein, 8 aa, Influenza virus
NSTERVDT

SEQ ID NO: 308047 - protein, 8 aa, Influenza virus
DILEKKHN

SEQ ID NO: 308048 - protein, 8 aa, Influenza virus
ILEKKHNG

SEQ ID NO: 308049 - protein, 8 aa, Influenza virus
LEGVKPLI

SEQ ID NO: 308050 - protein, 8 aa, Influenza virus
EGVKPLIL

SEQ ID NO: 308051 - protein, 8 aa, Influenza virus
VKPLILRN

SEQ ID NO: 308052 - protein, 8 aa, Influenza virus
WSYIVEKT

SEQ ID NO: 308053 - protein, 8 aa, Influenza virus
LKHLLSRT

SEQ ID NO: 308054 - protein, 8 aa, Influenza virus
KHLLSRTN

SEQ ID NO: 308055 - protein, 8 aa, Influenza virus
ENLLILWG

SEQ ID NO: 308056 - protein, 8 aa, Influenza virus
LWGVHHPN

SEQ ID NO: 308057 - protein, 8 aa, Influenza virus
WGVHHPND

SEQ ID NO: 308058 - protein, 8 aa, Influenza virus
KVNGQNGR

SEQ ID NO: 308059 - protein, 8 aa, Influenza virus
YAYKIVKT

SEQ ID NO: 308060 - protein, 8 aa, Influenza virus
YKIIKKGD

SEQ ID NO: 308061 - protein, 8 aa, Influenza virus
QTPMGAVN

SEQ ID NO: 308062 - protein, 8 aa, Influenza virus
TPMGAVNS

SEQ ID NO: 308063 - protein, 8 aa, Influenza virus
PMGAVNSS

SEQ ID NO: 308064 - protein, 8 aa, Influenza virus
MGAVNSSM

SEQ ID NO: 308065 - protein, 8 aa, Influenza virus
LATGLRNN

SEQ ID NO: 308066 - protein, 8 aa, Influenza virus
YGYHHSKE

SEQ ID NO: 308067 - protein, 8 aa, Influenza virus
GYHHSKEQ

SEQ ID NO: 308068 - protein, 8 aa, Influenza virus
YHHSKEQG

SEQ ID NO: 308069 - protein, 8 aa, Influenza virus
RHSNEQGS

SEQ ID NO: 308070 - protein, 8 aa, Influenza virus
KESTQKAM

SEQ ID NO: 308071 - protein, 8 aa, Influenza virus
EFNHLERR

SEQ ID NO: 308072 - protein, 8 aa, Influenza virus
MDSVRNGT

SEQ ID NO: 308073 - protein, 8 aa, Influenza virus
SIRNGTYS

SEQ ID NO: 308074 - protein, 8 aa, Influenza virus
IRNGTYSY

SEQ ID NO: 308075 - protein, 8 aa, Influenza virus
NGTYDYPH

SEQ ID NO: 308076 - protein, 8 aa, Influenza virus
GTYDYPHY

SEQ ID NO: 308077 - protein, 8 aa, Influenza virus
TVVSSLAL

SEQ ID NO: 308078 - protein, 8 aa, Influenza virus
VVSSLALA

SEQ ID NO: 308079 - protein, 8 aa, Influenza virus
CIYFCEFR

SEQ ID NO: 308080 - protein, 8 aa, Influenza virus
MTNQNSTW

SEQ ID NO: 308081 - protein, 8 aa, Influenza virus
TWVSQTYI

SEQ ID NO: 308082 - protein, 8 aa, Influenza virus
HSKDNGIR

SEQ ID NO: 308083 - protein, 8 aa, Influenza virus
VFAIREPF

SEQ ID NO: 308084 - protein, 8 aa, Influenza virus
FVTREPFI

SEQ ID NO: 308085 - protein, 8 aa, Influenza virus
IIREPFIS

SEQ ID NO: 308086 - protein, 8 aa, Influenza virus
PFISCSYL

SEQ ID NO: 308087 - protein, 8 aa, Influenza virus
FISCSYLE

SEQ ID NO: 308088 - protein, 8 aa, Influenza virus
KHSNGTAK

SEQ ID NO: 308089 - protein, 8 aa, Influenza virus
HSNGTAKD

SEQ ID NO: 308090 - protein, 8 aa, Influenza virus
SNGTAKDR

SEQ ID NO: 308091 - protein, 8 aa, Influenza virus
NGTAKDRS

SEQ ID NO: 308092 - protein, 8 aa, Influenza virus
GTAKDRSP

SEQ ID NO: 308093 - protein, 8 aa, Influenza virus
AKDRSPHR

SEQ ID NO: 308094 - protein, 8 aa, Influenza virus
KDRSPQRT

SEQ ID NO: 308095 - protein, 8 aa, Influenza virus
RSLMSCPV

SEQ ID NO: 308096 - protein, 8 aa, Influenza virus
SLMSCPVG

SEQ ID NO: 308097 - protein, 8 aa, Influenza virus
PVGVAPSP

SEQ ID NO: 308098 - protein, 8 aa, Influenza virus
VGVAPSPY

SEQ ID NO: 308099 - protein, 8 aa, Influenza virus
SACHDGAS

SEQ ID NO: 308100 - protein, 8 aa, Influenza virus
ACHDGASW

SEQ ID NO: 308101 - protein, 8 aa, Influenza virus
CHDGASWL

SEQ ID NO: 308102 - protein, 8 aa, Influenza virus
HDGASWLT

SEQ ID NO: 308103 - protein, 8 aa, Influenza virus
DGASWLTI

SEQ ID NO: 308104 - protein, 8 aa, Influenza virus
KYNGLITD

SEQ ID NO: 308105 - protein, 8 aa, Influenza virus
YNGLITDT

SEQ ID NO: 308106 - protein, 8 aa, Influenza virus
NGLITDTI

SEQ ID NO: 308107 - protein, 8 aa, Influenza virus
NVLRTQES

SEQ ID NO: 308108 - protein, 8 aa, Influenza virus
SCYPNAGE

SEQ ID NO: 308109 - protein, 8 aa, Influenza virus
RPWVSFTQ

SEQ ID NO: 308110 - protein, 8 aa, Influenza virus
CSGFFGDN

SEQ ID NO: 308111 - protein, 8 aa, Influenza virus
SGFFGDNP

SEQ ID NO: 308112 - protein, 8 aa, Influenza virus
FFGDNPRP

SEQ ID NO: 308113 - protein, 8 aa, Influenza virus
FGDNPRPD

SEQ ID NO: 308114 - protein, 8 aa, Influenza virus
DNPRPDDG

SEQ ID NO: 308115 - protein, 8 aa, Influenza virus
PRPDDGTG

SEQ ID NO: 308116 - protein, 8 aa, Influenza virus
DGTGSCSP

SEQ ID NO: 308117 - protein, 8 aa, Influenza virus
AHGVKGFS

SEQ ID NO: 308118 - protein, 8 aa, Influenza virus
YGIKGFSY

SEQ ID NO: 308119 - protein, 8 aa, Influenza virus
IKGFSFRY

SEQ ID NO: 308120 - protein, 8 aa, Influenza virus
GFSYKYGN

SEQ ID NO: 308121 - protein, 8 aa, Influenza virus
FSYKYGNG

SEQ ID NO: 308122 - protein, 8 aa, Influenza virus
YKYGNGVW

SEQ ID NO: 308123 - protein, 8 aa, Influenza virus
NSRSGFEI

SEQ ID NO: 308124 - protein, 8 aa, Influenza virus
ITNWSGYS

SEQ ID NO: 308125 - protein, 8 aa, Influenza virus
TGVDCIRP

SEQ ID NO: 308126 - protein, 8 aa, Influenza virus
GVDCIRPC

SEQ ID NO: 308127 - protein, 8 aa, Influenza virus
VDCIRPCF

SEQ ID NO: 308128 - protein, 8 aa, Influenza virus
TIWTSGSI

SEQ ID NO: 308129 - protein, 8 aa, Influenza virus
ISFCGVSG

SEQ ID NO: 308130 - protein, 8 aa, Influenza virus
TAGWSWPD

SEQ ID NO: 308131 - protein, 8 aa, Influenza virus
DWSWPDGA

SEQ ID NO: 308132 - protein, 8 aa, Influenza virus
AELPFSID

SEQ ID NO: 308133 - protein, 8 aa, Influenza virus
SDQICIGH

SEQ ID NO: 308134 - protein, 8 aa, Influenza virus
VDTIMEKI

SEQ ID NO: 308135 - protein, 8 aa, Influenza virus
TIMEKNVI

SEQ ID NO: 308136 - protein, 8 aa, Influenza virus
IVEKNVTV

SEQ ID NO: 308137 - protein, 8 aa, Influenza virus
HKGKLCSL

SEQ ID NO: 308138 - protein, 8 aa, Influenza virus
DCSVAGLV

SEQ ID NO: 308139 - protein, 8 aa, Influenza virus
SYIVEKAN

SEQ ID NO: 308140 - protein, 8 aa, Influenza virus
YIVEKANP

SEQ ID NO: 308141 - protein, 8 aa, Influenza virus
SSGLSSAC

SEQ ID NO: 308142 - protein, 8 aa, Influenza virus
SVGTPTLN

SEQ ID NO: 308143 - protein, 8 aa, Influenza virus
TSSLNQRS

SEQ ID NO: 308144 - protein, 8 aa, Influenza virus
IAIRPKVN

SEQ ID NO: 308145 - protein, 8 aa, Influenza virus
AIRPKVNG

SEQ ID NO: 308146 - protein, 8 aa, Influenza virus
IRPKVNGQ

SEQ ID NO: 308147 - protein, 8 aa, Influenza virus
LKVNGQSG

SEQ ID NO: 308148 - protein, 8 aa, Influenza virus
PEYAYRII

SEQ ID NO: 308149 - protein, 8 aa, Influenza virus
EYAYRIIK

SEQ ID NO: 308150 - protein, 8 aa, Influenza virus
KCQTPLVA

SEQ ID NO: 308151 - protein, 8 aa, Influenza virus
KPFHNVHP

SEQ ID NO: 308152 - protein, 8 aa, Influenza virus
LHNVHPFT

SEQ ID NO: 308153 - protein, 8 aa, Influenza virus
GGYAADKE

SEQ ID NO: 308154 - protein, 8 aa, Influenza virus
ANKESTQK

SEQ ID NO: 308155 - protein, 8 aa, Influenza virus
GQESPPKA

SEQ ID NO: 308156 - protein, 8 aa, Influenza virus
RKSTQKAI

SEQ ID NO: 308157 - protein, 8 aa, Influenza virus
ESTQKAVD

SEQ ID NO: 308158 - protein, 8 aa, Influenza virus
TQKAVDGI

SEQ ID NO: 308159 - protein, 8 aa, Influenza virus
QKAVDGIT

SEQ ID NO: 308160 - protein, 8 aa, Influenza virus
KAVDGITN

SEQ ID NO: 308161 - protein, 8 aa, Influenza virus
NSIIEKMN

SEQ ID NO: 308162 - protein, 8 aa, Influenza virus
DVWTYNTE

SEQ ID NO: 308163 - protein, 8 aa, Influenza virus
NLYDKVRF

SEQ ID NO: 308164 - protein, 8 aa, Influenza virus
LYDRVRLQ

SEQ ID NO: 308165 - protein, 8 aa, Influenza virus
YDRVRLQL

SEQ ID NO: 308166 - protein, 8 aa, Influenza virus
VQLQLRDN

SEQ ID NO: 308167 - protein, 8 aa, Influenza virus
RFQLRDNA

SEQ ID NO: 308168 - protein, 8 aa, Influenza virus
ECIESVRN

SEQ ID NO: 308169 - protein, 8 aa, Influenza virus
SVRNGTYK

SEQ ID NO: 308170 - protein, 8 aa, Influenza virus
VRNGTYKY

SEQ ID NO: 308171 - protein, 8 aa, Influenza virus
YKILSIYS

SEQ ID NO: 308172 - protein, 8 aa, Influenza virus
LSVYSTVA

SEQ ID NO: 308173 - protein, 8 aa, Influenza virus
SVYSTVAS

SEQ ID NO: 308174 - protein, 8 aa, Influenza virus
VVSSLALA

SEQ ID NO: 308175 - protein, 8 aa, Influenza virus
VSSLALAI

SEQ ID NO: 308176 - protein, 8 aa, Influenza virus
AIIIAGLS

SEQ ID NO: 308177 - protein, 8 aa, Influenza virus
IIIAGLSF

SEQ ID NO: 308178 - protein, 8 aa, Influenza virus
IIAGLSFW

SEQ ID NO: 308179 - protein, 8 aa, Influenza virus
ETGLSLCM

SEQ ID NO: 308180 - protein, 8 aa, Influenza virus
HKIITIGS

SEQ ID NO: 308181 - protein, 8 aa, Influenza virus
IIAIGSVS

SEQ ID NO: 308182 - protein, 8 aa, Influenza virus
IAIGSVSL

SEQ ID NO: 308183 - protein, 8 aa, Influenza virus
YRSWSKPQ

SEQ ID NO: 308184 - protein, 8 aa, Influenza virus
KNWSKPQC

SEQ ID NO: 308185 - protein, 8 aa, Influenza virus
KPQCKITG

SEQ ID NO: 308186 - protein, 8 aa, Influenza virus
PQCKITGF

SEQ ID NO: 308187 - protein, 8 aa, Influenza virus
QCKITGFA

SEQ ID NO: 308188 - protein, 8 aa, Influenza virus
CKITGFAP

SEQ ID NO: 308189 - protein, 8 aa, Influenza virus
KITGFAPF

SEQ ID NO: 308190 - protein, 8 aa, Influenza virus
QLSAGGDI

SEQ ID NO: 308191 - protein, 8 aa, Influenza virus
NKHSNGTM

SEQ ID NO: 308192 - protein, 8 aa, Influenza virus
PYRTLLMN

SEQ ID NO: 308193 - protein, 8 aa, Influenza virus
DGRAWLHI

SEQ ID NO: 308194 - protein, 8 aa, Influenza virus
KAWLHVCI

SEQ ID NO: 308195 - protein, 8 aa, Influenza virus
TGHDKNAT

SEQ ID NO: 308196 - protein, 8 aa, Influenza virus
DDRNATAN

SEQ ID NO: 308197 - protein, 8 aa, Influenza virus
TDGSASER

SEQ ID NO: 308198 - protein, 8 aa, Influenza virus
DGSASGEA

SEQ ID NO: 308199 - protein, 8 aa, Influenza virus
SPLLGSAQ

SEQ ID NO: 308200 - protein, 8 aa, Influenza virus
SGNAQHIE

SEQ ID NO: 308201 - protein, 8 aa, Influenza virus
SSSNCRDS

SEQ ID NO: 308202 - protein, 8 aa, Influenza virus
SSNCRDSN

SEQ ID NO: 308203 - protein, 8 aa, Influenza virus
CRDSNNER

SEQ ID NO: 308204 - protein, 8 aa, Influenza virus
RDSNNERG

SEQ ID NO: 308205 - protein, 8 aa, Influenza virus
GNHGVKGW

SEQ ID NO: 308206 - protein, 8 aa, Influenza virus
VKGWAFDS

SEQ ID NO: 308207 - protein, 8 aa, Influenza virus
NDIWMGRT

SEQ ID NO: 308208 - protein, 8 aa, Influenza virus
WMGRTINK

SEQ ID NO: 308209 - protein, 8 aa, Influenza virus
GRTIKEDS

SEQ ID NO: 308210 - protein, 8 aa, Influenza virus
RTISQDSR

SEQ ID NO: 308211 - protein, 8 aa, Influenza virus
GYETFRII

SEQ ID NO: 308212 - protein, 8 aa, Influenza virus
DNWSGYSG

SEQ ID NO: 308213 - protein, 8 aa, Influenza virus
HCINRCFY

SEQ ID NO: 308214 - protein, 8 aa, Influenza virus
GANINFMS

SEQ ID NO: 308215 - protein, 8 aa, Influenza virus
GKSDRICI

SEQ ID NO: 308216 - protein, 8 aa, Influenza virus
STTQIDTI

SEQ ID NO: 308217 - protein, 8 aa, Influenza virus
TQIDTILE

SEQ ID NO: 308218 - protein, 8 aa, Influenza virus
NTILEKNV

SEQ ID NO: 308219 - protein, 8 aa, Influenza virus
HSVELLED

SEQ ID NO: 308220 - protein, 8 aa, Influenza virus
QSWSCIVE

SEQ ID NO: 308221 - protein, 8 aa, Influenza virus
AQYGICYP

SEQ ID NO: 308222 - protein, 8 aa, Influenza virus
GICYPGVM

SEQ ID NO: 308223 - protein, 8 aa, Influenza virus
PVLYFWGV

SEQ ID NO: 308224 - protein, 8 aa, Influenza virus
YVRLGTER

SEQ ID NO: 308225 - protein, 8 aa, Influenza virus
GQKARIDY

SEQ ID NO: 308226 - protein, 8 aa, Influenza virus
RINYYWSV

SEQ ID NO: 308227 - protein, 8 aa, Influenza virus
IGYYWSVL

SEQ ID NO: 308228 - protein, 8 aa, Influenza virus
SMLKPGET

SEQ ID NO: 308229 - protein, 8 aa, Influenza virus
VAPWYAYR

SEQ ID NO: 308230 - protein, 8 aa, Influenza virus
QNVSPLWV

SEQ ID NO: 308231 - protein, 8 aa, Influenza virus
NVSPLWVG

SEQ ID NO: 308232 - protein, 8 aa, Influenza virus
WNGECPKY

SEQ ID NO: 308233 - protein, 8 aa, Influenza virus
NGECPKYV

SEQ ID NO: 308234 - protein, 8 aa, Influenza virus
ESTQRAVN

SEQ ID NO: 308235 - protein, 8 aa, Influenza virus
SIINKMNA

SEQ ID NO: 308236 - protein, 8 aa, Influenza virus
NKMNAQFE

SEQ ID NO: 308237 - protein, 8 aa, Influenza virus
NLNKRMEN

SEQ ID NO: 308238 - protein, 8 aa, Influenza virus
KRMEDGLL

SEQ ID NO: 308239 - protein, 8 aa, Influenza virus
DGLLDVWT

SEQ ID NO: 308240 - protein, 8 aa, Influenza virus
DLHDANVR

SEQ ID NO: 308241 - protein, 8 aa, Influenza virus
SQLKDNAN

SEQ ID NO: 308242 - protein, 8 aa, Influenza virus
QLKDNAND

SEQ ID NO: 308243 - protein, 8 aa, Influenza virus
LRDNAMIL

SEQ ID NO: 308244 - protein, 8 aa, Influenza virus
RDNAMILG

SEQ ID NO: 308245 - protein, 8 aa, Influenza virus
SVKNGTYK

SEQ ID NO: 308246 - protein, 8 aa, Influenza virus
VENGTYDY

SEQ ID NO: 308247 - protein, 8 aa, Influenza virus
ENGTYDYP

SEQ ID NO: 308248 - protein, 8 aa, Influenza virus
LGIYQILA

SEQ ID NO: 308249 - protein, 8 aa, Influenza virus
LNGSMQCR

SEQ ID NO: 308250 - protein, 8 aa, Influenza virus
NGSMQCRV

SEQ ID NO: 308251 - protein, 8 aa, Influenza virus
GSMQCRVC

SEQ ID NO: 308252 - protein, 8 aa, Influenza virus
RGYKMNIQ

SEQ ID NO: 308253 - protein, 8 aa, Influenza virus
GYKMNTKI

SEQ ID NO: 308254 - protein, 8 aa, Influenza virus
YKMNTKIL

SEQ ID NO: 308255 - protein, 8 aa, Influenza virus
NATETVEN

SEQ ID NO: 308256 - protein, 8 aa, Influenza virus
DVCYPGKI

SEQ ID NO: 308257 - protein, 8 aa, Influenza virus
DSSFYAEM

SEQ ID NO: 308258 - protein, 8 aa, Influenza virus
ALITWGIH

SEQ ID NO: 308259 - protein, 8 aa, Influenza virus
LITWGIHH

SEQ ID NO: 308260 - protein, 8 aa, Influenza virus
QTGRIDFH

SEQ ID NO: 308261 - protein, 8 aa, Influenza virus
TGRIDFHW

SEQ ID NO: 308262 - protein, 8 aa, Influenza virus
IFSFNGAF

SEQ ID NO: 308263 - protein, 8 aa, Influenza virus
FIAPDRAT

SEQ ID NO: 308264 - protein, 8 aa, Influenza virus
IAPDRATF

SEQ ID NO: 308265 - protein, 8 aa, Influenza virus
LPFQNISP

SEQ ID NO: 308266 - protein, 8 aa, Influenza virus
LGKCPRYV

SEQ ID NO: 308267 - protein, 8 aa, Influenza virus
IDGWYGFK

SEQ ID NO: 308268 - protein, 8 aa, Influenza virus
YGYKHQNA

SEQ ID NO: 308269 - protein, 8 aa, Influenza virus
GYKHQNAQ

SEQ ID NO: 308270 - protein, 8 aa, Influenza virus
IERTNQQF

SEQ ID NO: 308271 - protein, 8 aa, Influenza virus
EVERQIGN

SEQ ID NO: 308272 - protein, 8 aa, Influenza virus
TEMWSYNA

SEQ ID NO: 308273 - protein, 8 aa, Influenza virus
AELLVAIE

SEQ ID NO: 308274 - protein, 8 aa, Influenza virus
ELLVAIEN

SEQ ID NO: 308275 - protein, 8 aa, Influenza virus
DSEMKKLY

SEQ ID NO: 308276 - protein, 8 aa, Influenza virus
EMNSCFER

SEQ ID NO: 308277 - protein, 8 aa, Influenza virus
MKKLYERV

SEQ ID NO: 308278 - protein, 8 aa, Influenza virus
KLYEKVRR

SEQ ID NO: 308279 - protein, 8 aa, Influenza virus
VKRLLREN

SEQ ID NO: 308280 - protein, 8 aa, Influenza virus
KRLLRENA

SEQ ID NO: 308281 - protein, 8 aa, Influenza virus
YREEAIQN

SEQ ID NO: 308282 - protein, 8 aa, Influenza virus
REEAIQNR

SEQ ID NO: 308283 - protein, 8 aa, Influenza virus
KLNSGYKD

SEQ ID NO: 308284 - protein, 8 aa, Influenza virus
NSGYKDII

SEQ ID NO: 308285 - protein, 8 aa, Influenza virus
NGYKDVIL

SEQ ID NO: 308286 - protein, 8 aa, Influenza virus
GASCLILL

SEQ ID NO: 308287 - protein, 8 aa, Influenza virus
ASCLILLA

SEQ ID NO: 308288 - protein, 8 aa, Influenza virus
CVKNGNMQ

SEQ ID NO: 308289 - protein, 8 aa, Influenza virus
GARGDKIC

SEQ ID NO: 308290 - protein, 8 aa, Influenza virus
ARGDKICL

SEQ ID NO: 308291 - protein, 8 aa, Influenza virus
QCGLLGTV

SEQ ID NO: 308292 - protein, 8 aa, Influenza virus
CGLLGTVT

SEQ ID NO: 308293 - protein, 8 aa, Influenza virus
GLLGTVTG

SEQ ID NO: 308294 - protein, 8 aa, Influenza virus
LLGTVTGP

SEQ ID NO: 308295 - protein, 8 aa, Influenza virus
LGTVTGPP

SEQ ID NO: 308296 - protein, 8 aa, Influenza virus
CDQFLEFA

SEQ ID NO: 308297 - protein, 8 aa, Influenza virus
IIERREGS

SEQ ID NO: 308298 - protein, 8 aa, Influenza virus
IERREGSD

SEQ ID NO: 308299 - protein, 8 aa, Influenza virus
EGSDVCYP

SEQ ID NO: 308300 - protein, 8 aa, Influenza virus
GSDVCYPG

SEQ ID NO: 308301 - protein, 8 aa, Influenza virus
YPGKFANE

SEQ ID NO: 308302 - protein, 8 aa, Influenza virus
PGKFANEE

SEQ ID NO: 308303 - protein, 8 aa, Influenza virus
EESLRQII

SEQ ID NO: 308304 - protein, 8 aa, Influenza virus
IIRRSGGI

SEQ ID NO: 308305 - protein, 8 aa, Influenza virus
RKSGGIGK

SEQ ID NO: 308306 - protein, 8 aa, Influenza virus
KSGGIGKE

SEQ ID NO: 308307 - protein, 8 aa, Influenza virus
GIRTNGTA

SEQ ID NO: 308308 - protein, 8 aa, Influenza virus
IRTNGTAS

SEQ ID NO: 308309 - protein, 8 aa, Influenza virus
VIWGVHHS

SEQ ID NO: 308310 - protein, 8 aa, Influenza virus
YGSGSKLI

SEQ ID NO: 308311 - protein, 8 aa, Influenza virus
SSKYHQSF

SEQ ID NO: 308312 - protein, 8 aa, Influenza virus
RIDFHWLF

SEQ ID NO: 308313 - protein, 8 aa, Influenza virus
IDFHWLFL

SEQ ID NO: 308314 - protein, 8 aa, Influenza virus
RASFFRGG

SEQ ID NO: 308315 - protein, 8 aa, Influenza virus
CFYSGGTI

SEQ ID NO: 308316 - protein, 8 aa, Influenza virus
PFQNINPI

SEQ ID NO: 308317 - protein, 8 aa, Influenza virus
FQNINPKT

SEQ ID NO: 308318 - protein, 8 aa, Influenza virus
RAVGKCPK

SEQ ID NO: 308319 - protein, 8 aa, Influenza virus
CPRYIKQK

SEQ ID NO: 308320 - protein, 8 aa, Influenza virus
PKYVKQES

SEQ ID NO: 308321 - protein, 8 aa, Influenza virus
IKQKSLLL

SEQ ID NO: 308322 - protein, 8 aa, Influenza virus
GMRNIPEK

SEQ ID NO: 308323 - protein, 8 aa, Influenza virus
MRNIPEKP

SEQ ID NO: 308324 - protein, 8 aa, Influenza virus
RNIPEKPK

SEQ ID NO: 308325 - protein, 8 aa, Influenza virus
HLIGKTNQ

SEQ ID NO: 308326 - protein, 8 aa, Influenza virus
GRTNQQFE

SEQ ID NO: 308327 - protein, 8 aa, Influenza virus
QRFELIDN

SEQ ID NO: 308328 - protein, 8 aa, Influenza virus
GLIDNEFN

SEQ ID NO: 308329 - protein, 8 aa, Influenza virus
NEFTEIEQ

SEQ ID NO: 308330 - protein, 8 aa, Influenza virus
TRDSITEV

SEQ ID NO: 308331 - protein, 8 aa, Influenza virus
RDSITEVW

SEQ ID NO: 308332 - protein, 8 aa, Influenza virus
DLTDSEMN

SEQ ID NO: 308333 - protein, 8 aa, Influenza virus
LADSEMKK

SEQ ID NO: 308334 - protein, 8 aa, Influenza virus
ADSEMKKL

SEQ ID NO: 308335 - protein, 8 aa, Influenza virus
KKLYERVR

SEQ ID NO: 308336 - protein, 8 aa, Influenza virus
NNTYDHSR

SEQ ID NO: 308337 - protein, 8 aa, Influenza virus
NTYDHSRY

SEQ ID NO: 308338 - protein, 8 aa, Influenza virus
TYDHSRYR

SEQ ID NO: 308339 - protein, 8 aa, Influenza virus
YDHSRYRE

SEQ ID NO: 308340 - protein, 8 aa, Influenza virus
HTQYRTGS

SEQ ID NO: 308341 - protein, 8 aa, Influenza virus
TQYRAESL

SEQ ID NO: 308342 - protein, 8 aa, Influenza virus
QYRAESLQ

SEQ ID NO: 308343 - protein, 8 aa, Influenza virus
CFILLAIV

SEQ ID NO: 308344 - protein, 8 aa, Influenza virus
LAIAMGLG

SEQ ID NO: 308345 - protein, 8 aa, Influenza virus
SISLTIAA

SEQ ID NO: 308346 - protein, 8 aa, Influenza virus
IVCFLMQI

SEQ ID NO: 308347 - protein, 8 aa, Influenza virus
CFLMQITI

SEQ ID NO: 308348 - protein, 8 aa, Influenza virus
FLMQITIL

SEQ ID NO: 308349 - protein, 8 aa, Influenza virus
EKNITKIV

SEQ ID NO: 308350 - protein, 8 aa, Influenza virus
TEIVYLNH

SEQ ID NO: 308351 - protein, 8 aa, Influenza virus
ETLYLNHT

SEQ ID NO: 308352 - protein, 8 aa, Influenza virus
SKPQCQIA

SEQ ID NO: 308353 - protein, 8 aa, Influenza virus
KPQCQIKG

SEQ ID NO: 308354 - protein, 8 aa, Influenza virus
QCQITGLA

SEQ ID NO: 308355 - protein, 8 aa, Influenza virus
CQITGLAP

SEQ ID NO: 308356 - protein, 8 aa, Influenza virus
SASGDIWI

SEQ ID NO: 308357 - protein, 8 aa, Influenza virus
AGGNIWIT

SEQ ID NO: 308358 - protein, 8 aa, Influenza virus
SGDIWITR

SEQ ID NO: 308359 - protein, 8 aa, Influenza virus
EPYVSCDN

SEQ ID NO: 308360 - protein, 8 aa, Influenza virus
NRCYQFAL

SEQ ID NO: 308361 - protein, 8 aa, Influenza virus
QGTTLNNK

SEQ ID NO: 308362 - protein, 8 aa, Influenza virus
GTTLNNKH

SEQ ID NO: 308363 - protein, 8 aa, Influenza virus
TTLNNKHS

SEQ ID NO: 308364 - protein, 8 aa, Influenza virus
TLNNKHSN

SEQ ID NO: 308365 - protein, 8 aa, Influenza virus
LNNKHSNG

SEQ ID NO: 308366 - protein, 8 aa, Influenza virus
NNKHSNGT

SEQ ID NO: 308367 - protein, 8 aa, Influenza virus
VCVTGDDG

SEQ ID NO: 308368 - protein, 8 aa, Influenza virus
VCINGSCI

SEQ ID NO: 308369 - protein, 8 aa, Influenza virus
CINGSCIV

SEQ ID NO: 308370 - protein, 8 aa, Influenza virus
INGSCIVV

SEQ ID NO: 308371 - protein, 8 aa, Influenza virus
GSASRKAD

SEQ ID NO: 308372 - protein, 8 aa, Influenza virus
SASRKADT

SEQ ID NO: 308373 - protein, 8 aa, Influenza virus
ADTKYLFI

SEQ ID NO: 308374 - protein, 8 aa, Influenza virus
YLFIKEGK

SEQ ID NO: 308375 - protein, 8 aa, Influenza virus
IFVKEGKI

SEQ ID NO: 308376 - protein, 8 aa, Influenza virus
EGKVVHIS

SEQ ID NO: 308377 - protein, 8 aa, Influenza virus
GKVVHISP

SEQ ID NO: 308378 - protein, 8 aa, Influenza virus
KVVHISPL

SEQ ID NO: 308379 - protein, 8 aa, Influenza virus
VVHISPLS

SEQ ID NO: 308380 - protein, 8 aa, Influenza virus
DYSIGSSY

SEQ ID NO: 308381 - protein, 8 aa, Influenza virus
RNDDSSSN

SEQ ID NO: 308382 - protein, 8 aa, Influenza virus
NEDSSSNS

SEQ ID NO: 308383 - protein, 8 aa, Influenza virus
DDSSSNSN

SEQ ID NO: 308384 - protein, 8 aa, Influenza virus
SNCKDPNE

SEQ ID NO: 308385 - protein, 8 aa, Influenza virus
NCKDPNEE

SEQ ID NO: 308386 - protein, 8 aa, Influenza virus
DPNEERGS

SEQ ID NO: 308387 - protein, 8 aa, Influenza virus
PNEERGSP

SEQ ID NO: 308388 - protein, 8 aa, Influenza virus
NEERGSPG

SEQ ID NO: 308389 - protein, 8 aa, Influenza virus
EERGSPGV

SEQ ID NO: 308390 - protein, 8 aa, Influenza virus
GWAFDYGS

SEQ ID NO: 308391 - protein, 8 aa, Influenza virus
WAFDYGSD

SEQ ID NO: 308392 - protein, 8 aa, Influenza virus
YGSDVWMG

SEQ ID NO: 308393 - protein, 8 aa, Influenza virus
FKVIGGWT

SEQ ID NO: 308394 - protein, 8 aa, Influenza virus
VIDGWTTA

SEQ ID NO: 308395 - protein, 8 aa, Influenza virus
IDGWTTAN

SEQ ID NO: 308396 - protein, 8 aa, Influenza virus
DGWTTANS

SEQ ID NO: 308397 - protein, 8 aa, Influenza virus
TANSKSKT

SEQ ID NO: 308398 - protein, 8 aa, Influenza virus
VIVENNNW

SEQ ID NO: 308399 - protein, 8 aa, Influenza virus
IVNNNNWS

SEQ ID NO: 308400 - protein, 8 aa, Influenza virus
GIFSVESK

SEQ ID NO: 308401 - protein, 8 aa, Influenza virus
VRGRPQET

SEQ ID NO: 308402 - protein, 8 aa, Influenza virus
GANIKFMP

SEQ ID NO: 308403 - protein, 8 aa, Influenza virus
HAVTNGTK

SEQ ID NO: 308404 - protein, 8 aa, Influenza virus
AVTNGTKV

SEQ ID NO: 308405 - protein, 8 aa, Influenza virus
DTLTGRGI

SEQ ID NO: 308406 - protein, 8 aa, Influenza virus
GRGIEVVN

SEQ ID NO: 308407 - protein, 8 aa, Influenza virus
NATETVEN

SEQ ID NO: 308408 - protein, 8 aa, Influenza virus
TDMGQCGL

SEQ ID NO: 308409 - protein, 8 aa, Influenza virus
QCGLLGII

SEQ ID NO: 308410 - protein, 8 aa, Influenza virus
CGLLGIIT

SEQ ID NO: 308411 - protein, 8 aa, Influenza virus
GLLGIITG

SEQ ID NO: 308412 - protein, 8 aa, Influenza virus
LLGIITGP

SEQ ID NO: 308413 - protein, 8 aa, Influenza virus
LGIITGPP

SEQ ID NO: 308414 - protein, 8 aa, Influenza virus
GIITGPPQ

SEQ ID NO: 308415 - protein, 8 aa, Influenza virus
IITGPPQC

SEQ ID NO: 308416 - protein, 8 aa, Influenza virus
TDLIIERR

SEQ ID NO: 308417 - protein, 8 aa, Influenza virus
GNDICYPG

SEQ ID NO: 308418 - protein, 8 aa, Influenza virus
ICYPGKFT

SEQ ID NO: 308419 - protein, 8 aa, Influenza virus
ILRGSGGV

SEQ ID NO: 308420 - protein, 8 aa, Influenza virus
KETTGFTY

SEQ ID NO: 308421 - protein, 8 aa, Influenza virus
GFTYSGVR

SEQ ID NO: 308422 - protein, 8 aa, Influenza virus
FTYSEIRT

SEQ ID NO: 308423 - protein, 8 aa, Influenza virus
GSSSFYAE

SEQ ID NO: 308424 - protein, 8 aa, Influenza virus
WLLSNSNN

SEQ ID NO: 308425 - protein, 8 aa, Influenza virus
KLYGNGAK

SEQ ID NO: 308426 - protein, 8 aa, Influenza virus
YGSENKLI

SEQ ID NO: 308427 - protein, 8 aa, Influenza virus
GSENKLIT

SEQ ID NO: 308428 - protein, 8 aa, Influenza virus
NGNKLITV

SEQ ID NO: 308429 - protein, 8 aa, Influenza virus
SYNYHQSF

SEQ ID NO: 308430 - protein, 8 aa, Influenza virus
SKYLQSFT

SEQ ID NO: 308431 - protein, 8 aa, Influenza virus
SFVPSPGS

SEQ ID NO: 308432 - protein, 8 aa, Influenza virus
FTPSPGTR

SEQ ID NO: 308433 - protein, 8 aa, Influenza virus
KVDGQSGR

SEQ ID NO: 308434 - protein, 8 aa, Influenza virus
NGQTGRID

SEQ ID NO: 308435 - protein, 8 aa, Influenza virus
FHWLMLNS

SEQ ID NO: 308436 - protein, 8 aa, Influenza virus
HWMLLDPN

SEQ ID NO: 308437 - protein, 8 aa, Influenza virus
WLMLNPNG

SEQ ID NO: 308438 - protein, 8 aa, Influenza virus
LMLNSNDT

SEQ ID NO: 308439 - protein, 8 aa, Influenza virus
NPNDTVTG

SEQ ID NO: 308440 - protein, 8 aa, Influenza virus
NGTITFSS

SEQ ID NO: 308441 - protein, 8 aa, Influenza virus
DTVTGSFN

SEQ ID NO: 308442 - protein, 8 aa, Influenza virus
TVTGSFNG

SEQ ID NO: 308443 - protein, 8 aa, Influenza virus
TFTFNGSF

SEQ ID NO: 308444 - protein, 8 aa, Influenza virus
FTFNGSFI

SEQ ID NO: 308445 - protein, 8 aa, Influenza virus
APDRVSFF

SEQ ID NO: 308446 - protein, 8 aa, Influenza virus
YFHSGGTI

SEQ ID NO: 308447 - protein, 8 aa, Influenza virus
GGTIASSL

SEQ ID NO: 308448 - protein, 8 aa, Influenza virus
GTIASSLP

SEQ ID NO: 308449 - protein, 8 aa, Influenza virus
TIASSLPF

SEQ ID NO: 308450 - protein, 8 aa, Influenza virus
IASSLPFQ

SEQ ID NO: 308451 - protein, 8 aa, Influenza virus
ASSLPFQN

SEQ ID NO: 308452 - protein, 8 aa, Influenza virus
FQNINSRV

SEQ ID NO: 308453 - protein, 8 aa, Influenza virus
KNVPEIPR

SEQ ID NO: 308454 - protein, 8 aa, Influenza virus
KKRGLFGA

SEQ ID NO: 308455 - protein, 8 aa, Influenza virus
AYQKQMTR

SEQ ID NO: 308456 - protein, 8 aa, Influenza virus
YQKQMTRG

SEQ ID NO: 308457 - protein, 8 aa, Influenza virus
QKQMTRGL

SEQ ID NO: 308458 - protein, 8 aa, Influenza virus
KLNRFIEK

SEQ ID NO: 308459 - protein, 8 aa, Influenza virus
LNRFIEKT

SEQ ID NO: 308460 - protein, 8 aa, Influenza virus
NRLIDRTN

SEQ ID NO: 308461 - protein, 8 aa, Influenza virus
RLIDRTNH

SEQ ID NO: 308462 - protein, 8 aa, Influenza virus
FIEKTNQQ

SEQ ID NO: 308463 - protein, 8 aa, Influenza virus
LIDNEFIE

SEQ ID NO: 308464 - protein, 8 aa, Influenza virus
IDNEFNEV

SEQ ID NO: 308465 - protein, 8 aa, Influenza virus
DNEFNEVE

SEQ ID NO: 308466 - protein, 8 aa, Influenza virus
FNEVEKQI

SEQ ID NO: 308467 - protein, 8 aa, Influenza virus
TEVERQIG

SEQ ID NO: 308468 - protein, 8 aa, Influenza virus
RDSMTEVM

SEQ ID NO: 308469 - protein, 8 aa, Influenza virus
DSITELWS

SEQ ID NO: 308470 - protein, 8 aa, Influenza virus
SMTEVMVV

SEQ ID NO: 308471 - protein, 8 aa, Influenza virus
NLYERVRK

SEQ ID NO: 308472 - protein, 8 aa, Influenza virus
GCMASIRN

SEQ ID NO: 308473 - protein, 8 aa, Influenza virus
TYDHNKYR

SEQ ID NO: 308474 - protein, 8 aa, Influenza virus
TYREEAMQ

SEQ ID NO: 308475 - protein, 8 aa, Influenza virus
EEAMQNRV

SEQ ID NO: 308476 - protein, 8 aa, Influenza virus
EAMQNRVK

SEQ ID NO: 308477 - protein, 8 aa, Influenza virus
AMQNRVKI

SEQ ID NO: 308478 - protein, 8 aa, Influenza virus
QNRVKIDP

SEQ ID NO: 308479 - protein, 8 aa, Influenza virus
NRVKIDPV

SEQ ID NO: 308480 - protein, 8 aa, Influenza virus
RVKIDPVK

SEQ ID NO: 308481 - protein, 8 aa, Influenza virus
VKIDPVKL

SEQ ID NO: 308482 - protein, 8 aa, Influenza virus
NPVKQSSG

SEQ ID NO: 308483 - protein, 8 aa, Influenza virus
KLNSGYKD

SEQ ID NO: 308484 - protein, 8 aa, Influenza virus
NSGYKDII

SEQ ID NO: 308485 - protein, 8 aa, Influenza virus
SCFVLLAI

SEQ ID NO: 308486 - protein, 8 aa, Influenza virus
GSVNTVLS

SEQ ID NO: 308487 - protein, 8 aa, Influenza virus
SVNTVLSI

SEQ ID NO: 308488 - protein, 8 aa, Influenza virus
ILSTKALL

SEQ ID NO: 308489 - protein, 8 aa, Influenza virus
IIALLIGI

SEQ ID NO: 308490 - protein, 8 aa, Influenza virus
IGIGNLAF

SEQ ID NO: 308491 - protein, 8 aa, Influenza virus
GIGNLIFN

SEQ ID NO: 308492 - protein, 8 aa, Influenza virus
IGNLIFNT

SEQ ID NO: 308493 - protein, 8 aa, Influenza virus
AFNAVIHG

SEQ ID NO: 308494 - protein, 8 aa, Influenza virus
VTYNNTVI

SEQ ID NO: 308495 - protein, 8 aa, Influenza virus
NHTTINNI

SEQ ID NO: 308496 - protein, 8 aa, Influenza virus
HTTINNIT

SEQ ID NO: 308497 - protein, 8 aa, Influenza virus
NMTTTIIN

SEQ ID NO: 308498 - protein, 8 aa, Influenza virus
LPLPLCPF

SEQ ID NO: 308499 - protein, 8 aa, Influenza virus
PLPLCPFK

SEQ ID NO: 308500 - protein, 8 aa, Influenza virus
QGVLLGTK

SEQ ID NO: 308501 - protein, 8 aa, Influenza virus
GVLLGTKH

SEQ ID NO: 308502 - protein, 8 aa, Influenza virus
VLLGTKHS

SEQ ID NO: 308503 - protein, 8 aa, Influenza virus
SNGTINDR

SEQ ID NO: 308504 - protein, 8 aa, Influenza virus
NDRTPYRS

SEQ ID NO: 308505 - protein, 8 aa, Influenza virus
LIRFPVGT

SEQ ID NO: 308506 - protein, 8 aa, Influenza virus
IRFPVGTA

SEQ ID NO: 308507 - protein, 8 aa, Influenza virus
RFPVGTAP

SEQ ID NO: 308508 - protein, 8 aa, Influenza virus
FPIGTAPI

SEQ ID NO: 308509 - protein, 8 aa, Influenza virus
PIGTAPIL

SEQ ID NO: 308510 - protein, 8 aa, Influenza virus
VGTAPVLG

SEQ ID NO: 308511 - protein, 8 aa, Influenza virus
GNYKEMCA

SEQ ID NO: 308512 - protein, 8 aa, Influenza virus
NYKEIRIA

SEQ ID NO: 308513 - protein, 8 aa, Influenza virus
YREVCIAW

SEQ ID NO: 308514 - protein, 8 aa, Influenza virus
KEIRIAWS

SEQ ID NO: 308515 - protein, 8 aa, Influenza virus
VCIAWSSS

SEQ ID NO: 308516 - protein, 8 aa, Influenza virus
EWLHVCIT

SEQ ID NO: 308517 - protein, 8 aa, Influenza virus
WLHVCITG

SEQ ID NO: 308518 - protein, 8 aa, Influenza virus
HVSMTGND

SEQ ID NO: 308519 - protein, 8 aa, Influenza virus
GRMADSIK

SEQ ID NO: 308520 - protein, 8 aa, Influenza virus
RVTDSIKS

SEQ ID NO: 308521 - protein, 8 aa, Influenza virus
ESECQRID

SEQ ID NO: 308522 - protein, 8 aa, Influenza virus
SECLCIDG

SEQ ID NO: 308523 - protein, 8 aa, Influenza virus
ANNADHRV

SEQ ID NO: 308524 - protein, 8 aa, Influenza virus
NSAHHRVY

SEQ ID NO: 308525 - protein, 8 aa, Influenza virus
KADHRIYW

SEQ ID NO: 308526 - protein, 8 aa, Influenza virus
IYWIREGR

SEQ ID NO: 308527 - protein, 8 aa, Influenza virus
SCYVDVDV

SEQ ID NO: 308528 - protein, 8 aa, Influenza virus
CYVDTDVY

SEQ ID NO: 308529 - protein, 8 aa, Influenza virus
YVDVDVYC

SEQ ID NO: 308530 - protein, 8 aa, Influenza virus
DTDVYCIC

SEQ ID NO: 308531 - protein, 8 aa, Influenza virus
VDVYCICR

SEQ ID NO: 308532 - protein, 8 aa, Influenza virus
DPSVVSCD

SEQ ID NO: 308533 - protein, 8 aa, Influenza virus
PSVVSCDS

SEQ ID NO: 308534 - protein, 8 aa, Influenza virus
SVVSCDSP

SEQ ID NO: 308535 - protein, 8 aa, Influenza virus
VVSCDSPS

SEQ ID NO: 308536 - protein, 8 aa, Influenza virus
SPSNANGG

SEQ ID NO: 308537 - protein, 8 aa, Influenza virus
VKGFGFKS

SEQ ID NO: 308538 - protein, 8 aa, Influenza virus
KGFGFKSG

SEQ ID NO: 308539 - protein, 8 aa, Influenza virus
TVSTSGRL

SEQ ID NO: 308540 - protein, 8 aa, Influenza virus
SGRSSFEI

SEQ ID NO: 308541 - protein, 8 aa, Influenza virus
RLGFEIIK

SEQ ID NO: 308542 - protein, 8 aa, Influenza virus
LGFEIIKV

SEQ ID NO: 308543 - protein, 8 aa, Influenza virus
IKVSNGWI

SEQ ID NO: 308544 - protein, 8 aa, Influenza virus
VSNGWINS

SEQ ID NO: 308545 - protein, 8 aa, Influenza virus
IEGWINSP

SEQ ID NO: 308546 - protein, 8 aa, Influenza virus
AKSLTQTL

SEQ ID NO: 308547 - protein, 8 aa, Influenza virus
KDCFQSCF

SEQ ID NO: 308548 - protein, 8 aa, Influenza virus
DDDVSWTS

SEQ ID NO: 308549 - protein, 8 aa, Influenza virus
TADKICLG

SEQ ID NO: 308550 - protein, 8 aa, Influenza virus
NTLTEREV

SEQ ID NO: 308551 - protein, 8 aa, Influenza virus
GRCGLLGT

SEQ ID NO: 308552 - protein, 8 aa, Influenza virus
VIGPPQCD

SEQ ID NO: 308553 - protein, 8 aa, Influenza virus
NLIIERSE

SEQ ID NO: 308554 - protein, 8 aa, Influenza virus
GEALRQIL

SEQ ID NO: 308555 - protein, 8 aa, Influenza virus
LRQILRRS

SEQ ID NO: 308556 - protein, 8 aa, Influenza virus
RQILRRSG

SEQ ID NO: 308557 - protein, 8 aa, Influenza virus
QILRRSGG

SEQ ID NO: 308558 - protein, 8 aa, Influenza virus
ILRGSGGV

SEQ ID NO: 308559 - protein, 8 aa, Influenza virus
TRFTYSGI

SEQ ID NO: 308560 - protein, 8 aa, Influenza virus
RLGSSFYA

SEQ ID NO: 308561 - protein, 8 aa, Influenza virus
LGSSFYAE

SEQ ID NO: 308562 - protein, 8 aa, Influenza virus
TRSYKNKR

SEQ ID NO: 308563 - protein, 8 aa, Influenza virus
LYGSGSIL

SEQ ID NO: 308564 - protein, 8 aa, Influenza virus
VTVGSSKY

SEQ ID NO: 308565 - protein, 8 aa, Influenza virus
VESSNYQQ

SEQ ID NO: 308566 - protein, 8 aa, Influenza virus
WSSKYRRS

SEQ ID NO: 308567 - protein, 8 aa, Influenza virus
NDTVTFNF

SEQ ID NO: 308568 - protein, 8 aa, Influenza virus
DTVTFNFN

SEQ ID NO: 308569 - protein, 8 aa, Influenza virus
TVTFNFNG

SEQ ID NO: 308570 - protein, 8 aa, Influenza virus
VTFNFNGA

SEQ ID NO: 308571 - protein, 8 aa, Influenza virus
NNLPFQNI

SEQ ID NO: 308572 - protein, 8 aa, Influenza virus
VGECPRYV

SEQ ID NO: 308573 - protein, 8 aa, Influenza virus
KKRGLFGA

SEQ ID NO: 308574 - protein, 8 aa, Influenza virus
YGFKHQNA

SEQ ID NO: 308575 - protein, 8 aa, Influenza virus
GFKHQNAQ

SEQ ID NO: 308576 - protein, 8 aa, Influenza virus
FRHQKAQG

SEQ ID NO: 308577 - protein, 8 aa, Influenza virus
KLIDNEFT

SEQ ID NO: 308578 - protein, 8 aa, Influenza virus
IDNEFTEI

SEQ ID NO: 308579 - protein, 8 aa, Influenza virus
DNEFSEVE

SEQ ID NO: 308580 - protein, 8 aa, Influenza virus
EVEKQLGN

SEQ ID NO: 308581 - protein, 8 aa, Influenza virus
VEKQLGNV

SEQ ID NO: 308582 - protein, 8 aa, Influenza virus
VWSYNADL

SEQ ID NO: 308583 - protein, 8 aa, Influenza virus
QHIIDLAD

SEQ ID NO: 308584 - protein, 8 aa, Influenza virus
HTIDLTNS

SEQ ID NO: 308585 - protein, 8 aa, Influenza virus
IIDLADSE

SEQ ID NO: 308586 - protein, 8 aa, Influenza virus
IFHKCDDR

SEQ ID NO: 308587 - protein, 8 aa, Influenza virus
MASIRNNS

SEQ ID NO: 308588 - protein, 8 aa, Influenza virus
GSIRNNTY

SEQ ID NO: 308589 - protein, 8 aa, Influenza virus
NNSYDHSK

SEQ ID NO: 308590 - protein, 8 aa, Influenza virus
NSYDHSKY

SEQ ID NO: 308591 - protein, 8 aa, Influenza virus
TYDHRKYK

SEQ ID NO: 308592 - protein, 8 aa, Influenza virus
AMQNIIQI

SEQ ID NO: 308593 - protein, 8 aa, Influenza virus
QNRIRIDP

SEQ ID NO: 308594 - protein, 8 aa, Influenza virus
NRIRIDPV

SEQ ID NO: 308595 - protein, 8 aa, Influenza virus
VKIDPVEL

SEQ ID NO: 308596 - protein, 8 aa, Influenza virus
KIDPVELS

SEQ ID NO: 308597 - protein, 8 aa, Influenza virus
IDPVELSS

SEQ ID NO: 308598 - protein, 8 aa, Influenza virus
DPVELSSG

SEQ ID NO: 308599 - protein, 8 aa, Influenza virus
SGYKDVII

SEQ ID NO: 308600 - protein, 8 aa, Influenza virus
EIILWFSF

SEQ ID NO: 308601 - protein, 8 aa, Influenza virus
LGASCFLL

SEQ ID NO: 308602 - protein, 8 aa, Influenza virus
GASCFTLL

SEQ ID NO: 308603 - protein, 8 aa, Influenza virus
ASCFTLLA

SEQ ID NO: 308604 - protein, 8 aa, Influenza virus
SCFTLLAI

SEQ ID NO: 308605 - protein, 8 aa, Influenza virus
LIFMCVKN

SEQ ID NO: 308606 - protein, 8 aa, Influenza virus
IFMCVKNG

SEQ ID NO: 308607 - protein, 8 aa, Influenza virus
LIGISNIG

SEQ ID NO: 308608 - protein, 8 aa, Influenza virus
IGISNIGL

SEQ ID NO: 308609 - protein, 8 aa, Influenza virus
GISNIGLN

SEQ ID NO: 308610 - protein, 8 aa, Influenza virus
SNIGLNVS

SEQ ID NO: 308611 - protein, 8 aa, Influenza virus
NVGLNMSL

SEQ ID NO: 308612 - protein, 8 aa, Influenza virus
IGLNVSLH

SEQ ID NO: 308613 - protein, 8 aa, Influenza virus
KYVNNTTI

SEQ ID NO: 308614 - protein, 8 aa, Influenza virus
KIEGWVVV

SEQ ID NO: 308615 - protein, 8 aa, Influenza virus
VIEKDNAV

SEQ ID NO: 308616 - protein, 8 aa, Influenza virus
IEKDNAVR

SEQ ID NO: 308617 - protein, 8 aa, Influenza virus
PYVSCDPI

SEQ ID NO: 308618 - protein, 8 aa, Influenza virus
GTIHDRAA

SEQ ID NO: 308619 - protein, 8 aa, Influenza virus
RTTFRGLI

SEQ ID NO: 308620 - protein, 8 aa, Influenza virus
TAFRGLMS

SEQ ID NO: 308621 - protein, 8 aa, Influenza virus
FRGLLSTP

SEQ ID NO: 308622 - protein, 8 aa, Influenza virus
RGLMSTPL

SEQ ID NO: 308623 - protein, 8 aa, Influenza virus
GLLSTPLG

SEQ ID NO: 308624 - protein, 8 aa, Influenza virus
CHDGVSRM

SEQ ID NO: 308625 - protein, 8 aa, Influenza virus
HDGVSRMT

SEQ ID NO: 308626 - protein, 8 aa, Influenza virus
DGVSRMTI

SEQ ID NO: 308627 - protein, 8 aa, Influenza virus
GVSRMTIC

SEQ ID NO: 308628 - protein, 8 aa, Influenza virus
SRMTICVQ

SEQ ID NO: 308629 - protein, 8 aa, Influenza virus
DRRLTTTV

SEQ ID NO: 308630 - protein, 8 aa, Influenza virus
RRLTTTIR

SEQ ID NO: 308631 - protein, 8 aa, Influenza virus
TTIRTWAK

SEQ ID NO: 308632 - protein, 8 aa, Influenza virus
TVKTWAGN

SEQ ID NO: 308633 - protein, 8 aa, Influenza virus
IRTWAKNI

SEQ ID NO: 308634 - protein, 8 aa, Influenza virus
VRHNGTCA

SEQ ID NO: 308635 - protein, 8 aa, Influenza virus
SHNGTWAV

SEQ ID NO: 308636 - protein, 8 aa, Influenza virus
HNGTWAVV

SEQ ID NO: 308637 - protein, 8 aa, Influenza virus
NGTWAVVM

SEQ ID NO: 308638 - protein, 8 aa, Influenza virus
GTWAVVMT

SEQ ID NO: 308639 - protein, 8 aa, Influenza virus
AVVMTDGP

SEQ ID NO: 308640 - protein, 8 aa, Influenza virus
TDGSASSR

SEQ ID NO: 308641 - protein, 8 aa, Influenza virus
DGSASGQA

SEQ ID NO: 308642 - protein, 8 aa, Influenza virus
ASGQAYTK

SEQ ID NO: 308643 - protein, 8 aa, Influenza virus
VTCGCRDN

SEQ ID NO: 308644 - protein, 8 aa, Influenza virus
PVIEIDMS

SEQ ID NO: 308645 - protein, 8 aa, Influenza virus
MDHTSQYL

SEQ ID NO: 308646 - protein, 8 aa, Influenza virus
EHTSKYVC

SEQ ID NO: 308647 - protein, 8 aa, Influenza virus
YICTGILT

SEQ ID NO: 308648 - protein, 8 aa, Influenza virus
ICTGILTD

SEQ ID NO: 308649 - protein, 8 aa, Influenza virus
APGTKGFG

SEQ ID NO: 308650 - protein, 8 aa, Influenza virus
TKGFGFLN

SEQ ID NO: 308651 - protein, 8 aa, Influenza virus
DSTWLGRT

SEQ ID NO: 308652 - protein, 8 aa, Influenza virus
LRIPNAGI

SEQ ID NO: 308653 - protein, 8 aa, Influenza virus
RIPNAGID

SEQ ID NO: 308654 - protein, 8 aa, Influenza virus
NAGTDPDS

SEQ ID NO: 308655 - protein, 8 aa, Influenza virus
RQEIVDNK

SEQ ID NO: 308656 - protein, 8 aa, Influenza virus
QEIVDNSN

SEQ ID NO: 308657 - protein, 8 aa, Influenza virus
EIVDNKNW

SEQ ID NO: 308658 - protein, 8 aa, Influenza virus
IVDNSNWS

SEQ ID NO: 308659 - protein, 8 aa, Influenza virus
VDNSNWSG

SEQ ID NO: 308660 - protein, 8 aa, Influenza virus
DNSNWSGY

SEQ ID NO: 308661 - protein, 8 aa, Influenza virus
SNRSGYSG

SEQ ID NO: 308662 - protein, 8 aa, Influenza virus
MILVSTNA

SEQ ID NO: 308663 - protein, 8 aa, Influenza virus
LLASTNAH

SEQ ID NO: 308664 - protein, 8 aa, Influenza virus
TDTVNTLT

SEQ ID NO: 308665 - protein, 8 aa, Influenza virus
NTVNTLIE

SEQ ID NO: 308666 - protein, 8 aa, Influenza virus
VNTLTEQN

SEQ ID NO: 308667 - protein, 8 aa, Influenza virus
TLMEQNVP

SEQ ID NO: 308668 - protein, 8 aa, Influenza virus
LIEQKVPV

SEQ ID NO: 308669 - protein, 8 aa, Influenza virus
TEQNVPVT

SEQ ID NO: 308670 - protein, 8 aa, Influenza virus
EKHLAYCN

SEQ ID NO: 308671 - protein, 8 aa, Influenza virus
HLKDQAWS

SEQ ID NO: 308672 - protein, 8 aa, Influenza virus
LKDQAWSY

SEQ ID NO: 308673 - protein, 8 aa, Influenza virus
RDQGWSYI

SEQ ID NO: 308674 - protein, 8 aa, Influenza virus
NASTGAQS

SEQ ID NO: 308675 - protein, 8 aa, Influenza virus
IYDFNEGS

SEQ ID NO: 308676 - protein, 8 aa, Influenza virus
FNEGSYIN

SEQ ID NO: 308677 - protein, 8 aa, Influenza virus
NEGSYINN

SEQ ID NO: 308678 - protein, 8 aa, Influenza virus
NNENGDII

SEQ ID NO: 308679 - protein, 8 aa, Influenza virus
NEEGDIIF

SEQ ID NO: 308680 - protein, 8 aa, Influenza virus
EEGDIIFL

SEQ ID NO: 308681 - protein, 8 aa, Influenza virus
TKEQTALY

SEQ ID NO: 308682 - protein, 8 aa, Influenza virus
LKGESHCR

SEQ ID NO: 308683 - protein, 8 aa, Influenza virus
GESHCRII

SEQ ID NO: 308684 - protein, 8 aa, Influenza virus
ESHCRIIQ

SEQ ID NO: 308685 - protein, 8 aa, Influenza virus
SHGKIIQN

SEQ ID NO: 308686 - protein, 8 aa, Influenza virus
HCRIIQNE

SEQ ID NO: 308687 - protein, 8 aa, Influenza virus
NCYTKCQT

SEQ ID NO: 308688 - protein, 8 aa, Influenza virus
YTKCQTYA

SEQ ID NO: 308689 - protein, 8 aa, Influenza virus
TGAINSSR

SEQ ID NO: 308690 - protein, 8 aa, Influenza virus
FQNTSRHY

SEQ ID NO: 308691 - protein, 8 aa, Influenza virus
HYMGECPE

SEQ ID NO: 308692 - protein, 8 aa, Influenza virus
GECPKYAK

SEQ ID NO: 308693 - protein, 8 aa, Influenza virus
ECPEYVKK

SEQ ID NO: 308694 - protein, 8 aa, Influenza virus
NTPSIDPK

SEQ ID NO: 308695 - protein, 8 aa, Influenza virus
TPSIDPKG

SEQ ID NO: 308696 - protein, 8 aa, Influenza virus
PSIDPKGL

SEQ ID NO: 308697 - protein, 8 aa, Influenza virus
SIDPKGLF

SEQ ID NO: 308698 - protein, 8 aa, Influenza virus
IDPKGLFG

SEQ ID NO: 308699 - protein, 8 aa, Influenza virus
IEKITNKV

SEQ ID NO: 308700 - protein, 8 aa, Influenza virus
NKITNKVN

SEQ ID NO: 308701 - protein, 8 aa, Influenza virus
VVNHEFSK

SEQ ID NO: 308702 - protein, 8 aa, Influenza virus
HEFSEAEK

SEQ ID NO: 308703 - protein, 8 aa, Influenza virus
EKKINMIN

SEQ ID NO: 308704 - protein, 8 aa, Influenza virus
KRINMISD

SEQ ID NO: 308705 - protein, 8 aa, Influenza virus
RINVINDK

SEQ ID NO: 308706 - protein, 8 aa, Influenza virus
KIDDQIEE

SEQ ID NO: 308707 - protein, 8 aa, Influenza virus
IDDQIEEL

SEQ ID NO: 308708 - protein, 8 aa, Influenza virus
DDQIEELW

SEQ ID NO: 308709 - protein, 8 aa, Influenza virus
EVRRRLSV

SEQ ID NO: 308710 - protein, 8 aa, Influenza virus
VRRRLSVN

SEQ ID NO: 308711 - protein, 8 aa, Influenza virus
RRRLSVNA

SEQ ID NO: 308712 - protein, 8 aa, Influenza virus
RRLSVNAI

SEQ ID NO: 308713 - protein, 8 aa, Influenza virus
RLSVNAID

SEQ ID NO: 308714 - protein, 8 aa, Influenza virus
NAVDTGNG

SEQ ID NO: 308715 - protein, 8 aa, Influenza virus
AIDTGKGC

SEQ ID NO: 308716 - protein, 8 aa, Influenza virus
IDTGKGCF

SEQ ID NO: 308717 - protein, 8 aa, Influenza virus
NGTYDHKD

SEQ ID NO: 308718 - protein, 8 aa, Influenza virus
GTYNRKEY

SEQ ID NO: 308719 - protein, 8 aa, Influenza virus
TYNRKEYE

SEQ ID NO: 308720 - protein, 8 aa, Influenza virus
YNHKDYEE

SEQ ID NO: 308721 - protein, 8 aa, Influenza virus
NRKEYEEE

SEQ ID NO: 308722 - protein, 8 aa, Influenza virus
RSKINGVR

SEQ ID NO: 308723 - protein, 8 aa, Influenza virus
SKINGVIL

SEQ ID NO: 308724 - protein, 8 aa, Influenza virus
KINEVKLE

SEQ ID NO: 308725 - protein, 8 aa, Influenza virus
NSPETVDT

SEQ ID NO: 308726 - protein, 8 aa, Influenza virus
GHNGMLCA

SEQ ID NO: 308727 - protein, 8 aa, Influenza virus
SFYKSMRW

SEQ ID NO: 308728 - protein, 8 aa, Influenza virus
FYRSVRWL

SEQ ID NO: 308729 - protein, 8 aa, Influenza virus
YRSVRWLT

SEQ ID NO: 308730 - protein, 8 aa, Influenza virus
PVLKPGQT

SEQ ID NO: 308731 - protein, 8 aa, Influenza virus
IRSNGNLV

SEQ ID NO: 308732 - protein, 8 aa, Influenza virus
GGLNITLP

SEQ ID NO: 308733 - protein, 8 aa, Influenza virus
NTTLPFQD

SEQ ID NO: 308734 - protein, 8 aa, Influenza virus
ILPFHNVS

SEQ ID NO: 308735 - protein, 8 aa, Influenza virus
LPFQNVSR

SEQ ID NO: 308736 - protein, 8 aa, Influenza virus
PFQNVSRY

SEQ ID NO: 308737 - protein, 8 aa, Influenza virus
FQNVSRYA

SEQ ID NO: 308738 - protein, 8 aa, Influenza virus
QNVSRYAF

SEQ ID NO: 308739 - protein, 8 aa, Influenza virus
VSRYAFGN

SEQ ID NO: 308740 - protein, 8 aa, Influenza virus
RYAFGNCP

SEQ ID NO: 308741 - protein, 8 aa, Influenza virus
YAFGNCPR

SEQ ID NO: 308742 - protein, 8 aa, Influenza virus
AFGNCPRY

SEQ ID NO: 308743 - protein, 8 aa, Influenza virus
RSLKLAVG

SEQ ID NO: 308744 - protein, 8 aa, Influenza virus
QGAGMAAD

SEQ ID NO: 308745 - protein, 8 aa, Influenza virus
NKIEDQIQ

SEQ ID NO: 308746 - protein, 8 aa, Influenza virus
KIDDRIQD

SEQ ID NO: 308747 - protein, 8 aa, Influenza virus
DRIQDIWA

SEQ ID NO: 308748 - protein, 8 aa, Influenza virus
RIQDIWAY

SEQ ID NO: 308749 - protein, 8 aa, Influenza virus
KTLDEHDS

SEQ ID NO: 308750 - protein, 8 aa, Influenza virus
TLDEHVAN

SEQ ID NO: 308751 - protein, 8 aa, Influenza virus
DEHDTNVN

SEQ ID NO: 308752 - protein, 8 aa, Influenza virus
HNLYNKVK

SEQ ID NO: 308753 - protein, 8 aa, Influenza virus
ELYHKCND

SEQ ID NO: 308754 - protein, 8 aa, Influenza virus
DGTYKILT

SEQ ID NO: 308755 - protein, 8 aa, Influenza virus
STVASPLV

SEQ ID NO: 308756 - protein, 8 aa, Influenza virus
TAFLFWAM

SEQ ID NO: 308757 - protein, 8 aa, Influenza virus
AFFFWAMS

SEQ ID NO: 308758 - protein, 8 aa, Influenza virus
NSPETVDT

SEQ ID NO: 308759 - protein, 8 aa, Influenza virus
ELLHTGHN

SEQ ID NO: 308760 - protein, 8 aa, Influenza virus
SFYKSMRW

SEQ ID NO: 308761 - protein, 8 aa, Influenza virus
FYRSVRWL

SEQ ID NO: 308762 - protein, 8 aa, Influenza virus
YRSVRWLT

SEQ ID NO: 308763 - protein, 8 aa, Influenza virus
YYWSVLRP

SEQ ID NO: 308764 - protein, 8 aa, Influenza virus
PVLKPGQT

SEQ ID NO: 308765 - protein, 8 aa, Influenza virus
IRSNGNLV

SEQ ID NO: 308766 - protein, 8 aa, Influenza virus
GGLNITLP

SEQ ID NO: 308767 - protein, 8 aa, Influenza virus
NTTLPFQD

SEQ ID NO: 308768 - protein, 8 aa, Influenza virus
ILPFHNVS

SEQ ID NO: 308769 - protein, 8 aa, Influenza virus
LPFQNVSR

SEQ ID NO: 308770 - protein, 8 aa, Influenza virus
PFQNVSRY

SEQ ID NO: 308771 - protein, 8 aa, Influenza virus
FQNVSRYA

SEQ ID NO: 308772 - protein, 8 aa, Influenza virus
QNVSRYAF

SEQ ID NO: 308773 - protein, 8 aa, Influenza virus
VSRYAFGN

SEQ ID NO: 308774 - protein, 8 aa, Influenza virus
RYAFGNCP

SEQ ID NO: 308775 - protein, 8 aa, Influenza virus
YAFGNCPM

SEQ ID NO: 308776 - protein, 8 aa, Influenza virus
AFGNRSKY

SEQ ID NO: 308777 - protein, 8 aa, Influenza virus
RSLKLAVG

SEQ ID NO: 308778 - protein, 8 aa, Influenza virus
LAVGLRNL

SEQ ID NO: 308779 - protein, 8 aa, Influenza virus
QGAGMAAD

SEQ ID NO: 308780 - protein, 8 aa, Influenza virus
KVDNIVDK

SEQ ID NO: 308781 - protein, 8 aa, Influenza virus
NKIEDQIQ

SEQ ID NO: 308782 - protein, 8 aa, Influenza virus
PLDEHDAN

SEQ ID NO: 308783 - protein, 8 aa, Influenza virus
VANVNNLY

SEQ ID NO: 308784 - protein, 8 aa, Influenza virus
ANANNLYN

SEQ ID NO: 308785 - protein, 8 aa, Influenza virus
ANNLYNKV

SEQ ID NO: 308786 - protein, 8 aa, Influenza virus
HNLYNKVK

SEQ ID NO: 308787 - protein, 8 aa, Influenza virus
ELYHKCND

SEQ ID NO: 308788 - protein, 8 aa, Influenza virus
SEGAYKIL

SEQ ID NO: 308789 - protein, 8 aa, Influenza virus
STVASPLV

SEQ ID NO: 308790 - protein, 8 aa, Influenza virus
TAFLFWAM

SEQ ID NO: 308791 - protein, 8 aa, Influenza virus
AFFFWAMS

SEQ ID NO: 308792 - protein, 8 aa, Influenza virus
QCQITGSA

SEQ ID NO: 308793 - protein, 8 aa, Influenza virus
CQITGSAP

SEQ ID NO: 308794 - protein, 8 aa, Influenza virus
GSAPFSKG

SEQ ID NO: 308795 - protein, 8 aa, Influenza virus
LAAAGDIW

SEQ ID NO: 308796 - protein, 8 aa, Influenza virus
VTRDPYVS

SEQ ID NO: 308797 - protein, 8 aa, Influenza virus
TKQVFIAW

SEQ ID NO: 308798 - protein, 8 aa, Influenza virus
KQVCRAGS

SEQ ID NO: 308799 - protein, 8 aa, Influenza virus
WLHACVTG

SEQ ID NO: 308800 - protein, 8 aa, Influenza virus
LHICVSGD

SEQ ID NO: 308801 - protein, 8 aa, Influenza virus
HACVTGDD

SEQ ID NO: 308802 - protein, 8 aa, Influenza virus
EYECVCIN

SEQ ID NO: 308803 - protein, 8 aa, Influenza virus
ECVCIDGT

SEQ ID NO: 308804 - protein, 8 aa, Influenza virus
CVCIDGTC

SEQ ID NO: 308805 - protein, 8 aa, Influenza virus
IDGTCTVV

SEQ ID NO: 308806 - protein, 8 aa, Influenza virus
DGTCTVVM

SEQ ID NO: 308807 - protein, 8 aa, Influenza virus
SCTVVMTD

SEQ ID NO: 308808 - protein, 8 aa, Influenza virus
TVVLTDGV

SEQ ID NO: 308809 - protein, 8 aa, Influenza virus
GSAKHVEE

SEQ ID NO: 308810 - protein, 8 aa, Influenza virus
SAKHVEEC

SEQ ID NO: 308811 - protein, 8 aa, Influenza virus
ECSCYPQH

SEQ ID NO: 308812 - protein, 8 aa, Influenza virus
RVLWTSNS

SEQ ID NO: 308813 - protein, 8 aa, Influenza virus
FCGTSGTC

SEQ ID NO: 308814 - protein, 8 aa, Influenza virus
CGTSGTCG

SEQ ID NO: 308815 - protein, 8 aa, Influenza virus
TSGTYGAG

SEQ ID NO: 308816 - protein, 8 aa, Influenza virus
TYGTGSWA

SEQ ID NO: 308817 - protein, 8 aa, Influenza virus
GTGPWPDG

SEQ ID NO: 308818 - protein, 8 aa, Influenza virus
TGSCHDGA

SEQ ID NO: 308819 - protein, 8 aa, Influenza virus
SWPDGGNI

SEQ ID NO: 308820 - protein, 8 aa, Influenza virus
EIAQRLEN

SEQ ID NO: 308821 - protein, 8 aa, Influenza virus
IAQRLENV

SEQ ID NO: 308822 - protein, 8 aa, Influenza virus
AQRLENVF

SEQ ID NO: 308823 - protein, 8 aa, Influenza virus
QRLENVFA

SEQ ID NO: 308824 - protein, 8 aa, Influenza virus
RLENVFAG

SEQ ID NO: 308825 - protein, 8 aa, Influenza virus
GAKEISLS

SEQ ID NO: 308826 - protein, 8 aa, Influenza virus
EVALGYST

SEQ ID NO: 308827 - protein, 8 aa, Influenza virus
VALGYSTG

SEQ ID NO: 308828 - protein, 8 aa, Influenza virus
TRQMVQAM

SEQ ID NO: 308829 - protein, 8 aa, Influenza virus
MVQAMRAV

SEQ ID NO: 308830 - protein, 8 aa, Influenza virus
VQAMRAVG

SEQ ID NO: 308831 - protein, 8 aa, Influenza virus
QAMRAVGT

SEQ ID NO: 308832 - protein, 8 aa, Influenza virus
AMRTIGTQ

SEQ ID NO: 308833 - protein, 8 aa, Influenza virus
MRTIGTQP

SEQ ID NO: 308834 - protein, 8 aa, Influenza virus
NDLLDNLQ

SEQ ID NO: 308835 - protein, 8 aa, Influenza virus
DLLDNLQA

SEQ ID NO: 308836 - protein, 8 aa, Influenza virus
KRMGVQMH

SEQ ID NO: 308837 - protein, 8 aa, Influenza virus
GVQMHRFK

SEQ ID NO: 308838 - protein, 8 aa, Influenza virus
MREEYRQK

SEQ ID NO: 308839 - protein, 8 aa, Influenza virus
REEYRQKQ

SEQ ID NO: 308840 - protein, 8 aa, Influenza virus
RQNASEIR

SEQ ID NO: 308841 - protein, 8 aa, Influenza virus
ANEIRASV

SEQ ID NO: 308842 - protein, 8 aa, Influenza virus
GGIGKFYI

SEQ ID NO: 308843 - protein, 8 aa, Influenza virus
QEGRLIQN

SEQ ID NO: 308844 - protein, 8 aa, Influenza virus
EEHPSAGR

SEQ ID NO: 308845 - protein, 8 aa, Influenza virus
EHPSAGRD

SEQ ID NO: 308846 - protein, 8 aa, Influenza virus
ELTLYDKE

SEQ ID NO: 308847 - protein, 8 aa, Influenza virus
LTLYDKEE

SEQ ID NO: 308848 - protein, 8 aa, Influenza virus
KEEVRRIW

SEQ ID NO: 308849 - protein, 8 aa, Influenza virus
ELRRIWRQ

SEQ ID NO: 308850 - protein, 8 aa, Influenza virus
VMELVRMI

SEQ ID NO: 308851 - protein, 8 aa, Influenza virus
TRGAYERM

SEQ ID NO: 308852 - protein, 8 aa, Influenza virus
RGAYERMC

SEQ ID NO: 308853 - protein, 8 aa, Influenza virus
GAYERMCN

SEQ ID NO: 308854 - protein, 8 aa, Influenza virus
IEDLIFLT

SEQ ID NO: 308855 - protein, 8 aa, Influenza virus
PACVYGLV

SEQ ID NO: 308856 - protein, 8 aa, Influenza virus
ACVYGLVV

SEQ ID NO: 308857 - protein, 8 aa, Influenza virus
GGYDFERE

SEQ ID NO: 308858 - protein, 8 aa, Influenza virus
RLLQSSQV

SEQ ID NO: 308859 - protein, 8 aa, Influenza virus
PRGQLTTR

SEQ ID NO: 308860 - protein, 8 aa, Influenza virus
LTTRGVQI

SEQ ID NO: 308861 - protein, 8 aa, Influenza virus
QIASNENI

SEQ ID NO: 308862 - protein, 8 aa, Influenza virus
ASAGQVSV

SEQ ID NO: 308863 - protein, 8 aa, Influenza virus
SAGQVSVQ

SEQ ID NO: 308864 - protein, 8 aa, Influenza virus
AGQVSVQP

SEQ ID NO: 308865 - protein, 8 aa, Influenza virus
GNPEGRTS

SEQ ID NO: 308866 - protein, 8 aa, Influenza virus
NPEGRTSD

SEQ ID NO: 308867 - protein, 8 aa, Influenza virus
DMRTEIIK

SEQ ID NO: 308868 - protein, 8 aa, Influenza virus
EMSFQGRG

SEQ ID NO: 308869 - protein, 8 aa, Influenza virus
EFSDERAA

SEQ ID NO: 308870 - protein, 8 aa, Influenza virus
SDERAANP

SEQ ID NO: 308871 - protein, 8 aa, Influenza virus
SFDMSNDG

SEQ ID NO: 308872 - protein, 8 aa, Influenza virus
FDMSNDGS

SEQ ID NO: 308873 - protein, 8 aa, Influenza virus
DMSNDGSY

SEQ ID NO: 308874 - protein, 8 aa, Influenza virus
RIRRDQKS

SEQ ID NO: 308875 - protein, 8 aa, Influenza virus
IRRDQKSL

SEQ ID NO: 308876 - protein, 8 aa, Influenza virus
RRDQRALK

SEQ ID NO: 308877 - protein, 8 aa, Influenza virus
RDQRALKG

SEQ ID NO: 308878 - protein, 8 aa, Influenza virus
DQRALKGR

SEQ ID NO: 308879 - protein, 8 aa, Influenza virus
EVENEIRT

SEQ ID NO: 308880 - protein, 8 aa, Influenza virus
VENEIRTF

SEQ ID NO: 308881 - protein, 8 aa, Influenza virus
ENEIRTFS

SEQ ID NO: 308882 - protein, 8 aa, Influenza virus
NEIRTFSF

SEQ ID NO: 308883 - protein, 8 aa, Influenza virus
GDFVRQCF

SEQ ID NO: 308884 - protein, 8 aa, Influenza virus
CFNPMIAE

SEQ ID NO: 308885 - protein, 8 aa, Influenza virus
NPMIAELA

SEQ ID NO: 308886 - protein, 8 aa, Influenza virus
MIAELAEK

SEQ ID NO: 308887 - protein, 8 aa, Influenza virus
TETNKFAA

SEQ ID NO: 308888 - protein, 8 aa, Influenza virus
DFHFINEL

SEQ ID NO: 308889 - protein, 8 aa, Influenza virus
EGRDRTIA

SEQ ID NO: 308890 - protein, 8 aa, Influenza virus
GRDRTIAW

SEQ ID NO: 308891 - protein, 8 aa, Influenza virus
AWTAVNSI

SEQ ID NO: 308892 - protein, 8 aa, Influenza virus
WTAVNSIC

SEQ ID NO: 308893 - protein, 8 aa, Influenza virus
KPKSLPDL

SEQ ID NO: 308894 - protein, 8 aa, Influenza virus
PKSLPDLY

SEQ ID NO: 308895 - protein, 8 aa, Influenza virus
KSLPDLYD

SEQ ID NO: 308896 - protein, 8 aa, Influenza virus
REVHMYYL

SEQ ID NO: 308897 - protein, 8 aa, Influenza virus
EVHMYYLE

SEQ ID NO: 308898 - protein, 8 aa, Influenza virus
VHMYYLEK

SEQ ID NO: 308899 - protein, 8 aa, Influenza virus
IYYLEKAS

SEQ ID NO: 308900 - protein, 8 aa, Influenza virus
EDTHIHIF

SEQ ID NO: 308901 - protein, 8 aa, Influenza virus
DTHIHIFS

SEQ ID NO: 308902 - protein, 8 aa, Influenza virus
IGEEMATK

SEQ ID NO: 308903 - protein, 8 aa, Influenza virus
IRQEMASK

SEQ ID NO: 308904 - protein, 8 aa, Influenza virus
RLANYSLP

SEQ ID NO: 308905 - protein, 8 aa, Influenza virus
EPNGSIEG

SEQ ID NO: 308906 - protein, 8 aa, Influenza virus
SIEEPSHE

SEQ ID NO: 308907 - protein, 8 aa, Influenza virus
KCIRTFFG

SEQ ID NO: 308908 - protein, 8 aa, Influenza virus
MKTFFGWR

SEQ ID NO: 308909 - protein, 8 aa, Influenza virus
MWALGENM

SEQ ID NO: 308910 - protein, 8 aa, Influenza virus
ACELTGSS

SEQ ID NO: 308911 - protein, 8 aa, Influenza virus
EDLAPIEY

SEQ ID NO: 308912 - protein, 8 aa, Influenza virus
PIEHIASI

SEQ ID NO: 308913 - protein, 8 aa, Influenza virus
IEHIASIR

SEQ ID NO: 308914 - protein, 8 aa, Influenza virus
EHIASIRR

SEQ ID NO: 308915 - protein, 8 aa, Influenza virus
IASMRRSY

SEQ ID NO: 308916 - protein, 8 aa, Influenza virus
NYFTTEVS

SEQ ID NO: 308917 - protein, 8 aa, Influenza virus
SHKWEKYC

SEQ ID NO: 308918 - protein, 8 aa, Influenza virus
SMFLYVRT

SEQ ID NO: 308919 - protein, 8 aa, Influenza virus
VKEKDLTK

SEQ ID NO: 308920 - protein, 8 aa, Influenza virus
ETWPVGES

SEQ ID NO: 308921 - protein, 8 aa, Influenza virus
TWPVGESP

SEQ ID NO: 308922 - protein, 8 aa, Influenza virus
PIGESPKR

SEQ ID NO: 308923 - protein, 8 aa, Influenza virus
GMEEGSIG

SEQ ID NO: 308924 - protein, 8 aa, Influenza virus
FNSIYASP

SEQ ID NO: 308925 - protein, 8 aa, Influenza virus
NSIYASPQ

SEQ ID NO: 308926 - protein, 8 aa, Influenza virus
SIYASPQL

SEQ ID NO: 308927 - protein, 8 aa, Influenza virus
SRKLLLIT

SEQ ID NO: 308928 - protein, 8 aa, Influenza virus
RKLLLITQ

SEQ ID NO: 308929 - protein, 8 aa, Influenza virus
KLLLITQA

SEQ ID NO: 308930 - protein, 8 aa, Influenza virus
MLLIVQAL

SEQ ID NO: 308931 - protein, 8 aa, Influenza virus
LLITQALR

SEQ ID NO: 308932 - protein, 8 aa, Influenza virus
LITQALRD

SEQ ID NO: 308933 - protein, 8 aa, Influenza virus
SWFNSFLK

SEQ ID NO: 308934 - protein, 8 aa, Influenza virus
WFNSFLKH

SEQ ID NO: 308935 - protein, 8 aa, Influenza virus
LLFLEVPA

SEQ ID NO: 308936 - protein, 8 aa, Influenza virus
LFLEVPAQ

SEQ ID NO: 308937 - protein, 8 aa, Influenza virus
FLEVPAQN

SEQ ID NO: 308938 - protein, 8 aa, Influenza virus
LEVPAQNA

SEQ ID NO: 308939 - protein, 8 aa, Influenza virus
EVPAQNAI

SEQ ID NO: 308940 - protein, 8 aa, Influenza virus
NTETGALQ

SEQ ID NO: 308941 - protein, 8 aa, Influenza virus
TETGALQL

SEQ ID NO: 308942 - protein, 8 aa, Influenza virus
DNEPNGYA

SEQ ID NO: 308943 - protein, 8 aa, Influenza virus
AMAFLEDS

SEQ ID NO: 308944 - protein, 8 aa, Influenza virus
MAFLEDSH

SEQ ID NO: 308945 - protein, 8 aa, Influenza virus
AFLEDSHP

SEQ ID NO: 308946 - protein, 8 aa, Influenza virus
FLEDSHPG

SEQ ID NO: 308947 - protein, 8 aa, Influenza virus
ESHPGIFG

SEQ ID NO: 308948 - protein, 8 aa, Influenza virus
GIFESSCL

SEQ ID NO: 308949 - protein, 8 aa, Influenza virus
IDFLKDVT

SEQ ID NO: 308950 - protein, 8 aa, Influenza virus
GITTHFQR

SEQ ID NO: 308951 - protein, 8 aa, Influenza virus
KRRVRDSM

SEQ ID NO: 308952 - protein, 8 aa, Influenza virus
RRVRDSMT

SEQ ID NO: 308953 - protein, 8 aa, Influenza virus
RVRDNMTR

SEQ ID NO: 308954 - protein, 8 aa, Influenza virus
RDNMTRKM

SEQ ID NO: 308955 - protein, 8 aa, Influenza virus
RMITQRTI

SEQ ID NO: 308956 - protein, 8 aa, Influenza virus
SYIIRALT

SEQ ID NO: 308957 - protein, 8 aa, Influenza virus
VETLARNI

SEQ ID NO: 308958 - protein, 8 aa, Influenza virus
ETLARNIC

SEQ ID NO: 308959 - protein, 8 aa, Influenza virus
TSSQDTEI

SEQ ID NO: 308960 - protein, 8 aa, Influenza virus
TYMTRNQP

SEQ ID NO: 308961 - protein, 8 aa, Influenza virus
DWFRNVLS

SEQ ID NO: 308962 - protein, 8 aa, Influenza virus
NALSIAPI

SEQ ID NO: 308963 - protein, 8 aa, Influenza virus
ALSIAPIM

SEQ ID NO: 308964 - protein, 8 aa, Influenza virus
MKLRTQIS

SEQ ID NO: 308965 - protein, 8 aa, Influenza virus
KLRTQISA

SEQ ID NO: 308966 - protein, 8 aa, Influenza virus
LRTQVSAE

SEQ ID NO: 308967 - protein, 8 aa, Influenza virus
IDLRYFNE

SEQ ID NO: 308968 - protein, 8 aa, Influenza virus
KIKKIRPL

SEQ ID NO: 308969 - protein, 8 aa, Influenza virus
IKKIRPLL

SEQ ID NO: 308970 - protein, 8 aa, Influenza virus
VLNLGQKR

SEQ ID NO: 308971 - protein, 8 aa, Influenza virus
LNLGQKRH

SEQ ID NO: 308972 - protein, 8 aa, Influenza virus
NLGQKRHT

SEQ ID NO: 308973 - protein, 8 aa, Influenza virus
TAYWWDGL

SEQ ID NO: 308974 - protein, 8 aa, Influenza virus
AYWWDGLQ

SEQ ID NO: 308975 - protein, 8 aa, Influenza virus
GGIQAGVD

SEQ ID NO: 308976 - protein, 8 aa, Influenza virus
RCHRGDAQ

SEQ ID NO: 308977 - protein, 8 aa, Influenza virus
CHRGDAQI

SEQ ID NO: 308978 - protein, 8 aa, Influenza virus
TRRAFELK

SEQ ID NO: 308979 - protein, 8 aa, Influenza virus
PLNPFVGH

SEQ ID NO: 308980 - protein, 8 aa, Influenza virus
NPFVSHRE

SEQ ID NO: 308981 - protein, 8 aa, Influenza virus
VEAMMSRA

SEQ ID NO: 308982 - protein, 8 aa, Influenza virus
IDFESGRV

SEQ ID NO: 308983 - protein, 8 aa, Influenza virus
ELMSQSRT

SEQ ID NO: 308984 - protein, 8 aa, Influenza virus
KYPITAEK

SEQ ID NO: 308985 - protein, 8 aa, Influenza virus
RNEQGQML

SEQ ID NO: 308986 - protein, 8 aa, Influenza virus
NEQGQMLW

SEQ ID NO: 308987 - protein, 8 aa, Influenza virus
GSNRVMVS

SEQ ID NO: 308988 - protein, 8 aa, Influenza virus
HYPKVYKP

SEQ ID NO: 308989 - protein, 8 aa, Influenza virus
KVYKPYFE

SEQ ID NO: 308990 - protein, 8 aa, Influenza virus
VYKPYFEK

SEQ ID NO: 308991 - protein, 8 aa, Influenza virus
TNPGHADI

SEQ ID NO: 308992 - protein, 8 aa, Influenza virus
DLSTKEAQ

SEQ ID NO: 308993 - protein, 8 aa, Influenza virus
LSTKEAQD

SEQ ID NO: 308994 - protein, 8 aa, Influenza virus
SVKEAQDV

SEQ ID NO: 308995 - protein, 8 aa, Influenza virus
TKKKKEEL

SEQ ID NO: 308996 - protein, 8 aa, Influenza virus
TSSMYIEV

SEQ ID NO: 308997 - protein, 8 aa, Influenza virus
SSMYIEVL

SEQ ID NO: 308998 - protein, 8 aa, Influenza virus
TPGGEVIN

SEQ ID NO: 308999 - protein, 8 aa, Influenza virus
GGEVKNDE

SEQ ID NO: 309000 - protein, 8 aa, Influenza virus
VKNDEVDQ

SEQ ID NO: 309001 - protein, 8 aa, Influenza virus
KNDEVDQS

SEQ ID NO: 309002 - protein, 8 aa, Influenza virus
TVSADPLV

SEQ ID NO: 309003 - protein, 8 aa, Influenza virus
VNICKAAM

SEQ ID NO: 309004 - protein, 8 aa, Influenza virus
NICKAAMG

SEQ ID NO: 309005 - protein, 8 aa, Influenza virus
CKAAMGMR

SEQ ID NO: 309006 - protein, 8 aa, Influenza virus
KAAMGMRI

SEQ ID NO: 309007 - protein, 8 aa, Influenza virus
AAMGMRIS

SEQ ID NO: 309008 - protein, 8 aa, Influenza virus
AMGMRISS

SEQ ID NO: 309009 - protein, 8 aa, Influenza virus
GNLQALKI

SEQ ID NO: 309010 - protein, 8 aa, Influenza virus
VHMGYEEF

SEQ ID NO: 309011 - protein, 8 aa, Influenza virus
AIFRKATR

SEQ ID NO: 309012 - protein, 8 aa, Influenza virus
RKATKRLI

SEQ ID NO: 309013 - protein, 8 aa, Influenza virus
ATRKLIQL

SEQ ID NO: 309014 - protein, 8 aa, Influenza virus
RKLIQLIV

SEQ ID NO: 309015 - protein, 8 aa, Influenza virus
VVSGRDEQ

SEQ ID NO: 309016 - protein, 8 aa, Influenza virus
SGRDDQSI

SEQ ID NO: 309017 - protein, 8 aa, Influenza virus
EDRMIKAV

SEQ ID NO: 309018 - protein, 8 aa, Influenza virus
DRMIKAVR

SEQ ID NO: 309019 - protein, 8 aa, Influenza virus
HFQKDAKM

SEQ ID NO: 309020 - protein, 8 aa, Influenza virus
FQKDAKML

SEQ ID NO: 309021 - protein, 8 aa, Influenza virus
IMGMIGIL

SEQ ID NO: 309022 - protein, 8 aa, Influenza virus
MGMIGILS

SEQ ID NO: 309023 - protein, 8 aa, Influenza virus
GMIGILSD

SEQ ID NO: 309024 - protein, 8 aa, Influenza virus
RVSRMGVD

SEQ ID NO: 309025 - protein, 8 aa, Influenza virus
VSRMGVDE

SEQ ID NO: 309026 - protein, 8 aa, Influenza virus
DEYSSTEK

SEQ ID NO: 309027 - protein, 8 aa, Influenza virus
TVSIDRFL

SEQ ID NO: 309028 - protein, 8 aa, Influenza virus
FLRVRDQM

SEQ ID NO: 309029 - protein, 8 aa, Influenza virus
LRVRDQMG

SEQ ID NO: 309030 - protein, 8 aa, Influenza virus
RVRDQMGN

SEQ ID NO: 309031 - protein, 8 aa, Influenza virus
DQLGNILL

SEQ ID NO: 309032 - protein, 8 aa, Influenza virus
LGNILLSP

SEQ ID NO: 309033 - protein, 8 aa, Influenza virus
EISETQGT

SEQ ID NO: 309034 - protein, 8 aa, Influenza virus
ISETQGTE

SEQ ID NO: 309035 - protein, 8 aa, Influenza virus
QGIEKLTI

SEQ ID NO: 309036 - protein, 8 aa, Influenza virus
IQWSQEPT

SEQ ID NO: 309037 - protein, 8 aa, Influenza virus
RCQYSGFV

SEQ ID NO: 309038 - protein, 8 aa, Influenza virus
CQYSGFVR

SEQ ID NO: 309039 - protein, 8 aa, Influenza virus
IGTFDTVQ

SEQ ID NO: 309040 - protein, 8 aa, Influenza virus
GTFDTVQV

SEQ ID NO: 309041 - protein, 8 aa, Influenza virus
TFDTVQVI

SEQ ID NO: 309042 - protein, 8 aa, Influenza virus
FDTVQVIK

SEQ ID NO: 309043 - protein, 8 aa, Influenza virus
TVQVIKLL

SEQ ID NO: 309044 - protein, 8 aa, Influenza virus
VQVIKLLP

SEQ ID NO: 309045 - protein, 8 aa, Influenza virus
AAPPVQSK

SEQ ID NO: 309046 - protein, 8 aa, Influenza virus
PEQSKMQF

SEQ ID NO: 309047 - protein, 8 aa, Influenza virus
EQSKMQFS

SEQ ID NO: 309048 - protein, 8 aa, Influenza virus
GSGLRILI

SEQ ID NO: 309049 - protein, 8 aa, Influenza virus
SGLRILIR

SEQ ID NO: 309050 - protein, 8 aa, Influenza virus
TKRLAVLG

SEQ ID NO: 309051 - protein, 8 aa, Influenza virus
IGKDAGAL

SEQ ID NO: 309052 - protein, 8 aa, Influenza virus
LILGREDK

SEQ ID NO: 309053 - protein, 8 aa, Influenza virus
GKENKKYG

SEQ ID NO: 309054 - protein, 8 aa, Influenza virus
KENKKYGP

SEQ ID NO: 309055 - protein, 8 aa, Influenza virus
LSINELGN

SEQ ID NO: 309056 - protein, 8 aa, Influenza virus
IRMAINLV

SEQ ID NO: 309057 - protein, 9 aa, Influenza virus
KQGKTKATK

SEQ ID NO: 309058 - protein, 9 aa, Influenza virus
QGKTKATKM

SEQ ID NO: 309059 - protein, 9 aa, Influenza virus
SKSRGYKMN

SEQ ID NO: 309060 - protein, 9 aa, Influenza virus
IFIFILLTH

SEQ ID NO: 309061 - protein, 9 aa, Influenza virus
FIFILLTHW

SEQ ID NO: 309062 - protein, 9 aa, Influenza virus
RFSYVFCLA

SEQ ID NO: 309063 - protein, 9 aa, Influenza virus
SQITNGTTG

SEQ ID NO: 309064 - protein, 9 aa, Influenza virus
QITNGTTGN

SEQ ID NO: 309065 - protein, 9 aa, Influenza virus
ITNGTTGNP

SEQ ID NO: 309066 - protein, 9 aa, Influenza virus
TNGTTGNPI

SEQ ID NO: 309067 - protein, 9 aa, Influenza virus
NGTTGNPII

SEQ ID NO: 309068 - protein, 9 aa, Influenza virus
GTTGNPIIC

SEQ ID NO: 309069 - protein, 9 aa, Influenza virus
TTGNPIICL

SEQ ID NO: 309070 - protein, 9 aa, Influenza virus
NNNNNTATL

SEQ ID NO: 309071 - protein, 9 aa, Influenza virus
NNSTATLCL

SEQ ID NO: 309072 - protein, 9 aa, Influenza virus
GVIPLTTTP

SEQ ID NO: 309073 - protein, 9 aa, Influenza virus
VIPLTTTPT

SEQ ID NO: 309074 - protein, 9 aa, Influenza virus
IPLTTTPTK

SEQ ID NO: 309075 - protein, 9 aa, Influenza virus
PLTTTPTKS

SEQ ID NO: 309076 - protein, 9 aa, Influenza virus
LTTTPTKSY

SEQ ID NO: 309077 - protein, 9 aa, Influenza virus
TTTPTKSYF

SEQ ID NO: 309078 - protein, 9 aa, Influenza virus
TTPTKSYFA

SEQ ID NO: 309079 - protein, 9 aa, Influenza virus
TPTKSYFAN

SEQ ID NO: 309080 - protein, 9 aa, Influenza virus
PTKSYFANL

SEQ ID NO: 309081 - protein, 9 aa, Influenza virus
TKSYFANLK

SEQ ID NO: 309082 - protein, 9 aa, Influenza virus
KSYFANLKG

SEQ ID NO: 309083 - protein, 9 aa, Influenza virus
SYFANLKGT

SEQ ID NO: 309084 - protein, 9 aa, Influenza virus
IMHDRTKIR

SEQ ID NO: 309085 - protein, 9 aa, Influenza virus
MHDRTKIRQ

SEQ ID NO: 309086 - protein, 9 aa, Influenza virus
EKENSYPMI

SEQ ID NO: 309087 - protein, 9 aa, Influenza virus
LTVEVPYVC

SEQ ID NO: 309088 - protein, 9 aa, Influenza virus
GVTTHYVSQ

SEQ ID NO: 309089 - protein, 9 aa, Influenza virus
DEGLPQSGR

SEQ ID NO: 309090 - protein, 9 aa, Influenza virus
EGLPQSGRI

SEQ ID NO: 309091 - protein, 9 aa, Influenza virus
GLPQSGRIV

SEQ ID NO: 309092 - protein, 9 aa, Influenza virus
LPQSGRIVV

SEQ ID NO: 309093 - protein, 9 aa, Influenza virus
PQSGRIVVD

SEQ ID NO: 309094 - protein, 9 aa, Influenza virus
APSGIEYNG

SEQ ID NO: 309095 - protein, 9 aa, Influenza virus
SGIEYNGKS

SEQ ID NO: 309096 - protein, 9 aa, Influenza virus
GIEYNGKSL

SEQ ID NO: 309097 - protein, 9 aa, Influenza virus
IEYNGKSLG

SEQ ID NO: 309098 - protein, 9 aa, Influenza virus
EYNGKSLGI

SEQ ID NO: 309099 - protein, 9 aa, Influenza virus
YNGKSLGIQ

SEQ ID NO: 309100 - protein, 9 aa, Influenza virus
NGKSLGIQS

SEQ ID NO: 309101 - protein, 9 aa, Influenza virus
PSVKLPMGA

SEQ ID NO: 309102 - protein, 9 aa, Influenza virus
GAIGAIDSS

SEQ ID NO: 309103 - protein, 9 aa, Influenza virus
AIGAIDSSM

SEQ ID NO: 309104 - protein, 9 aa, Influenza virus
YGGLNKSKP

SEQ ID NO: 309105 - protein, 9 aa, Influenza virus
TSLTSLPFQ

SEQ ID NO: 309106 - protein, 9 aa, Influenza virus
SLTSLPFQN

SEQ ID NO: 309107 - protein, 9 aa, Influenza virus
LTSLPFQNI

SEQ ID NO: 309108 - protein, 9 aa, Influenza virus
GEHAKAIGN

SEQ ID NO: 309109 - protein, 9 aa, Influenza virus
IPIGERGLF

SEQ ID NO: 309110 - protein, 9 aa, Influenza virus
REREGGRRR

SEQ ID NO: 309111 - protein, 9 aa, Influenza virus
EREGGRRRK

SEQ ID NO: 309112 - protein, 9 aa, Influenza virus
RRKKRGLFG

SEQ ID NO: 309113 - protein, 9 aa, Influenza virus
KKKRGLFGA

SEQ ID NO: 309114 - protein, 9 aa, Influenza virus
KRRKKRGLF

SEQ ID NO: 309115 - protein, 9 aa, Influenza virus
RRKKRGLFG

SEQ ID NO: 309116 - protein, 9 aa, Influenza virus
RQKRGLFGA

SEQ ID NO: 309117 - protein, 9 aa, Influenza virus
KKRGLFGAI

SEQ ID NO: 309118 - protein, 9 aa, Influenza virus
THKQLTHHM

SEQ ID NO: 309119 - protein, 9 aa, Influenza virus
HKQLTHHMR

SEQ ID NO: 309120 - protein, 9 aa, Influenza virus
KQLTHHMRK

SEQ ID NO: 309121 - protein, 9 aa, Influenza virus
QLTHHMRKK

SEQ ID NO: 309122 - protein, 9 aa, Influenza virus
LTHHMRKKR

SEQ ID NO: 309123 - protein, 9 aa, Influenza virus
THHMRKKRG

SEQ ID NO: 309124 - protein, 9 aa, Influenza virus
HHMRKKRGL

SEQ ID NO: 309125 - protein, 9 aa, Influenza virus
HMRKKRGLF

SEQ ID NO: 309126 - protein, 9 aa, Influenza virus
MRKKRGLFG

SEQ ID NO: 309127 - protein, 9 aa, Influenza virus
RKKRGLFGA

SEQ ID NO: 309128 - protein, 9 aa, Influenza virus
RETRGLFGA

SEQ ID NO: 309129 - protein, 9 aa, Influenza virus
MTRGLFGAI

SEQ ID NO: 309130 - protein, 9 aa, Influenza virus
PRGLFGAIA

SEQ ID NO: 309131 - protein, 9 aa, Influenza virus
TKPRPRRGL

SEQ ID NO: 309132 - protein, 9 aa, Influenza virus
KPRPRRGLF

SEQ ID NO: 309133 - protein, 9 aa, Influenza virus
PRPRRGLFG

SEQ ID NO: 309134 - protein, 9 aa, Influenza virus
RPRRGLFGA

SEQ ID NO: 309135 - protein, 9 aa, Influenza virus
PRRGLFGAI

SEQ ID NO: 309136 - protein, 9 aa, Influenza virus
RRGLFGAIA

SEQ ID NO: 309137 - protein, 9 aa, Influenza virus
RGLFGAIAG

SEQ ID NO: 309138 - protein, 9 aa, Influenza virus
GLFGAIAGF

SEQ ID NO: 309139 - protein, 9 aa, Influenza virus
LFGAIAGFI

SEQ ID NO: 309140 - protein, 9 aa, Influenza virus
FGAIAGFIE

SEQ ID NO: 309141 - protein, 9 aa, Influenza virus
GAIAGFIEG

SEQ ID NO: 309142 - protein, 9 aa, Influenza virus
AIAGFIEGG

SEQ ID NO: 309143 - protein, 9 aa, Influenza virus
IAGFIEGGW

SEQ ID NO: 309144 - protein, 9 aa, Influenza virus
GRLVRFRHQ

SEQ ID NO: 309145 - protein, 9 aa, Influenza virus
RLVRFRHQN

SEQ ID NO: 309146 - protein, 9 aa, Influenza virus
LPTFDSLNI

SEQ ID NO: 309147 - protein, 9 aa, Influenza virus
PTFDSLNIT

SEQ ID NO: 309148 - protein, 9 aa, Influenza virus
TFDSLNITA

SEQ ID NO: 309149 - protein, 9 aa, Influenza virus
FDSLNITAA

SEQ ID NO: 309150 - protein, 9 aa, Influenza virus
DSLNITAAS

SEQ ID NO: 309151 - protein, 9 aa, Influenza virus
SLNITAASL

SEQ ID NO: 309152 - protein, 9 aa, Influenza virus
LNITAASLN

SEQ ID NO: 309153 - protein, 9 aa, Influenza virus
NITAASLND

SEQ ID NO: 309154 - protein, 9 aa, Influenza virus
ITAASLNDD

SEQ ID NO: 309155 - protein, 9 aa, Influenza virus
VTTRQASPS

SEQ ID NO: 309156 - protein, 9 aa, Influenza virus
TTRQASPSC

SEQ ID NO: 309157 - protein, 9 aa, Influenza virus
TRQASPSCL

SEQ ID NO: 309158 - protein, 9 aa, Influenza virus
RQASPSCLV

SEQ ID NO: 309159 - protein, 9 aa, Influenza virus
QASPSCLVV

SEQ ID NO: 309160 - protein, 9 aa, Influenza virus
ASPSCLVVR

SEQ ID NO: 309161 - protein, 9 aa, Influenza virus
EFPSTGNHG

SEQ ID NO: 309162 - protein, 9 aa, Influenza virus
FPSTGNHGS

SEQ ID NO: 309163 - protein, 9 aa, Influenza virus
PSTGNHGSL

SEQ ID NO: 309164 - protein, 9 aa, Influenza virus
STGNHGSLV

SEQ ID NO: 309165 - protein, 9 aa, Influenza virus
TGNHGSLVL

SEQ ID NO: 309166 - protein, 9 aa, Influenza virus
GNHGSLVLS

SEQ ID NO: 309167 - protein, 9 aa, Influenza virus
NHGSLVLSL

SEQ ID NO: 309168 - protein, 9 aa, Influenza virus
LCSVEYASK

SEQ ID NO: 309169 - protein, 9 aa, Influenza virus
CSVEYASKT

SEQ ID NO: 309170 - protein, 9 aa, Influenza virus
SVEYASKTR

SEQ ID NO: 309171 - protein, 9 aa, Influenza virus
VEYASKTRI

SEQ ID NO: 309172 - protein, 9 aa, Influenza virus
EYASKTRIS

SEQ ID NO: 309173 - protein, 9 aa, Influenza virus
YASKTRISE

SEQ ID NO: 309174 - protein, 9 aa, Influenza virus
DFRDMRKNT

SEQ ID NO: 309175 - protein, 9 aa, Influenza virus
FRDMRKNTL

SEQ ID NO: 309176 - protein, 9 aa, Influenza virus
IGLREQKQE

SEQ ID NO: 309177 - protein, 9 aa, Influenza virus
GLREQKQEF

SEQ ID NO: 309178 - protein, 9 aa, Influenza virus
LREQKQEFK

SEQ ID NO: 309179 - protein, 9 aa, Influenza virus
REQKQEFKM

SEQ ID NO: 309180 - protein, 9 aa, Influenza virus
EQKQEFKMN

SEQ ID NO: 309181 - protein, 9 aa, Influenza virus
QKQEFKMNP

SEQ ID NO: 309182 - protein, 9 aa, Influenza virus
KQEFKMNPN

SEQ ID NO: 309183 - protein, 9 aa, Influenza virus
QEFKMNPNK

SEQ ID NO: 309184 - protein, 9 aa, Influenza virus
EFKMNPNKK

SEQ ID NO: 309185 - protein, 9 aa, Influenza virus
FKMNPNKKI

SEQ ID NO: 309186 - protein, 9 aa, Influenza virus
KMNPNKKII

SEQ ID NO: 309187 - protein, 9 aa, Influenza virus
IIIAIGSVS

SEQ ID NO: 309188 - protein, 9 aa, Influenza virus
NRDITIGSI

SEQ ID NO: 309189 - protein, 9 aa, Influenza virus
RDITIGSIC

SEQ ID NO: 309190 - protein, 9 aa, Influenza virus
DITIGSICM

SEQ ID NO: 309191 - protein, 9 aa, Influenza virus
VPLVPCEPI

SEQ ID NO: 309192 - protein, 9 aa, Influenza virus
PLVPCEPII

SEQ ID NO: 309193 - protein, 9 aa, Influenza virus
LVPCEPIII

SEQ ID NO: 309194 - protein, 9 aa, Influenza virus
ILRTQESEC

SEQ ID NO: 309195 - protein, 9 aa, Influenza virus
RTQESECVC

SEQ ID NO: 309196 - protein, 9 aa, Influenza virus
IREGLILEY

SEQ ID NO: 309197 - protein, 9 aa, Influenza virus
REGLILEYY

SEQ ID NO: 309198 - protein, 9 aa, Influenza virus
YKYKIFKNG

SEQ ID NO: 309199 - protein, 9 aa, Influenza virus
KYKIFKNGK

SEQ ID NO: 309200 - protein, 9 aa, Influenza virus
GKKGKWLNQ

SEQ ID NO: 309201 - protein, 9 aa, Influenza virus
IQHLEECSC

SEQ ID NO: 309202 - protein, 9 aa, Influenza virus
SYLNVRCVC

SEQ ID NO: 309203 - protein, 9 aa, Influenza virus
KLDINMADY

SEQ ID NO: 309204 - protein, 9 aa, Influenza virus
NNYGVKGFG

SEQ ID NO: 309205 - protein, 9 aa, Influenza virus
NYGVKGFGF

SEQ ID NO: 309206 - protein, 9 aa, Influenza virus
IFLWCKIVT

SEQ ID NO: 309207 - protein, 9 aa, Influenza virus
FLWCKIVTT

SEQ ID NO: 309208 - protein, 9 aa, Influenza virus
LWCKIVTTV

SEQ ID NO: 309209 - protein, 9 aa, Influenza virus
WCKIVTTVG

SEQ ID NO: 309210 - protein, 9 aa, Influenza virus
CKIVTTVGW

SEQ ID NO: 309211 - protein, 9 aa, Influenza virus
KIVTTVGWS

SEQ ID NO: 309212 - protein, 9 aa, Influenza virus
IVTTVGWSW

SEQ ID NO: 309213 - protein, 9 aa, Influenza virus
VTTVGWSWP

SEQ ID NO: 309214 - protein, 9 aa, Influenza virus
TTVGWSWPD

SEQ ID NO: 309215 - protein, 9 aa, Influenza virus
RTSISCLYK

SEQ ID NO: 309216 - protein, 9 aa, Influenza virus
LHAYISFRN

SEQ ID NO: 309217 - protein, 9 aa, Influenza virus
HAYISFRNL

SEQ ID NO: 309218 - protein, 9 aa, Influenza virus
IGLREQKQE

SEQ ID NO: 309219 - protein, 9 aa, Influenza virus
GLREQKQEF

SEQ ID NO: 309220 - protein, 9 aa, Influenza virus
LREQKQEFK

SEQ ID NO: 309221 - protein, 9 aa, Influenza virus
REQKQEFKM

SEQ ID NO: 309222 - protein, 9 aa, Influenza virus
EQKQEFKMN

SEQ ID NO: 309223 - protein, 9 aa, Influenza virus
QKQEFKMNP

SEQ ID NO: 309224 - protein, 9 aa, Influenza virus
KQEFKMNPN

SEQ ID NO: 309225 - protein, 9 aa, Influenza virus
QEFKMNPNK

SEQ ID NO: 309226 - protein, 9 aa, Influenza virus
EFKMNPNKK

SEQ ID NO: 309227 - protein, 9 aa, Influenza virus
FKMNPNKKI

SEQ ID NO: 309228 - protein, 9 aa, Influenza virus
KMNPNKKII

SEQ ID NO: 309229 - protein, 9 aa, Influenza virus
NRDITIGSI

SEQ ID NO: 309230 - protein, 9 aa, Influenza virus
RDITIGSIC

SEQ ID NO: 309231 - protein, 9 aa, Influenza virus
DITIGSICM

SEQ ID NO: 309232 - protein, 9 aa, Influenza virus
DLNMGQPFY

SEQ ID NO: 309233 - protein, 9 aa, Influenza virus
GWAIYSKDN

SEQ ID NO: 309234 - protein, 9 aa, Influenza virus
SKDNSIRIG

SEQ ID NO: 309235 - protein, 9 aa, Influenza virus
KDNSIRIGS

SEQ ID NO: 309236 - protein, 9 aa, Influenza virus
DNSIRIGSK

SEQ ID NO: 309237 - protein, 9 aa, Influenza virus
NSIRIGSKG

SEQ ID NO: 309238 - protein, 9 aa, Influenza virus
SIRIGSKGD

SEQ ID NO: 309239 - protein, 9 aa, Influenza virus
IRIGSKGDV

SEQ ID NO: 309240 - protein, 9 aa, Influenza virus
RIGSKGDVF

SEQ ID NO: 309241 - protein, 9 aa, Influenza virus
IGSKGDVFV

SEQ ID NO: 309242 - protein, 9 aa, Influenza virus
GDVFVIREP

SEQ ID NO: 309243 - protein, 9 aa, Influenza virus
DVFVIREPF

SEQ ID NO: 309244 - protein, 9 aa, Influenza virus
FVIREPFIS

SEQ ID NO: 309245 - protein, 9 aa, Influenza virus
VIREPFISC

SEQ ID NO: 309246 - protein, 9 aa, Influenza virus
IREPFISCS

SEQ ID NO: 309247 - protein, 9 aa, Influenza virus
REPFISCSH

SEQ ID NO: 309248 - protein, 9 aa, Influenza virus
LECRTFFLT

SEQ ID NO: 309249 - protein, 9 aa, Influenza virus
ECRTFFLTQ

SEQ ID NO: 309250 - protein, 9 aa, Influenza virus
CRTFFLTQG

SEQ ID NO: 309251 - protein, 9 aa, Influenza virus
RTFFLTQGA

SEQ ID NO: 309252 - protein, 9 aa, Influenza virus
TFFLTQGAL

SEQ ID NO: 309253 - protein, 9 aa, Influenza virus
FFLTQGALL

SEQ ID NO: 309254 - protein, 9 aa, Influenza virus
FLTQGALLN

SEQ ID NO: 309255 - protein, 9 aa, Influenza virus
LTQGALLND

SEQ ID NO: 309256 - protein, 9 aa, Influenza virus
TQGALLNDK

SEQ ID NO: 309257 - protein, 9 aa, Influenza virus
QGALLNDKH

SEQ ID NO: 309258 - protein, 9 aa, Influenza virus
GALLNDKHS

SEQ ID NO: 309259 - protein, 9 aa, Influenza virus
ALLNDKHSN

SEQ ID NO: 309260 - protein, 9 aa, Influenza virus
LLNDKHSNG

SEQ ID NO: 309261 - protein, 9 aa, Influenza virus
LNDKHSNGT

SEQ ID NO: 309262 - protein, 9 aa, Influenza virus
NDKHSNGTI

SEQ ID NO: 309263 - protein, 9 aa, Influenza virus
DRSPYRTLM

SEQ ID NO: 309264 - protein, 9 aa, Influenza virus
RSPYRTLMS

SEQ ID NO: 309265 - protein, 9 aa, Influenza virus
SPYRTLMSC

SEQ ID NO: 309266 - protein, 9 aa, Influenza virus
PYRTLMSCP

SEQ ID NO: 309267 - protein, 9 aa, Influenza virus
RTLMSCPIG

SEQ ID NO: 309268 - protein, 9 aa, Influenza virus
IGEVPSPYN

SEQ ID NO: 309269 - protein, 9 aa, Influenza virus
GEAPSPYNS

SEQ ID NO: 309270 - protein, 9 aa, Influenza virus
EVPSPYNSR

SEQ ID NO: 309271 - protein, 9 aa, Influenza virus
VPSPYNSRF

SEQ ID NO: 309272 - protein, 9 aa, Influenza virus
PSPYNSRFE

SEQ ID NO: 309273 - protein, 9 aa, Influenza virus
SPYNSRFES

SEQ ID NO: 309274 - protein, 9 aa, Influenza virus
PYNSRFESV

SEQ ID NO: 309275 - protein, 9 aa, Influenza virus
YNSRFESVA

SEQ ID NO: 309276 - protein, 9 aa, Influenza virus
NSRFESVAW

SEQ ID NO: 309277 - protein, 9 aa, Influenza virus
SRFESVAWS

SEQ ID NO: 309278 - protein, 9 aa, Influenza virus
RFESVAWSA

SEQ ID NO: 309279 - protein, 9 aa, Influenza virus
FESVAWSAS

SEQ ID NO: 309280 - protein, 9 aa, Influenza virus
ESVAWSASA

SEQ ID NO: 309281 - protein, 9 aa, Influenza virus
SVAWSASAC

SEQ ID NO: 309282 - protein, 9 aa, Influenza virus
VAWSASACH

SEQ ID NO: 309283 - protein, 9 aa, Influenza virus
AWSASACHD

SEQ ID NO: 309284 - protein, 9 aa, Influenza virus
WSASACHDG

SEQ ID NO: 309285 - protein, 9 aa, Influenza virus
SASACHDGI

SEQ ID NO: 309286 - protein, 9 aa, Influenza virus
NWLTIGISG

SEQ ID NO: 309287 - protein, 9 aa, Influenza virus
WLTIGISGP

SEQ ID NO: 309288 - protein, 9 aa, Influenza virus
LTIGISGPD

SEQ ID NO: 309289 - protein, 9 aa, Influenza virus
TIGISGPDN

SEQ ID NO: 309290 - protein, 9 aa, Influenza virus
IGISGPDNG

SEQ ID NO: 309291 - protein, 9 aa, Influenza virus
GISGPDNGA

SEQ ID NO: 309292 - protein, 9 aa, Influenza virus
ISGPDNGAV

SEQ ID NO: 309293 - protein, 9 aa, Influenza virus
SGPDNGAVA

SEQ ID NO: 309294 - protein, 9 aa, Influenza virus
GPDNGAVAV

SEQ ID NO: 309295 - protein, 9 aa, Influenza virus
PDNGAVAVL

SEQ ID NO: 309296 - protein, 9 aa, Influenza virus
DNGAVAVLK

SEQ ID NO: 309297 - protein, 9 aa, Influenza virus
NGAVAVLKY

SEQ ID NO: 309298 - protein, 9 aa, Influenza virus
GAVAVLKYN

SEQ ID NO: 309299 - protein, 9 aa, Influenza virus
AVAVLKYNG

SEQ ID NO: 309300 - protein, 9 aa, Influenza virus
AVLKYNGII

SEQ ID NO: 309301 - protein, 9 aa, Influenza virus
VLKYNGIIT

SEQ ID NO: 309302 - protein, 9 aa, Influenza virus
ILRTQESEC

SEQ ID NO: 309303 - protein, 9 aa, Influenza virus
LRTQESECA

SEQ ID NO: 309304 - protein, 9 aa, Influenza virus
RTQESECAC

SEQ ID NO: 309305 - protein, 9 aa, Influenza virus
NGSCFTVMT

SEQ ID NO: 309306 - protein, 9 aa, Influenza virus
GSCFTVMTD

SEQ ID NO: 309307 - protein, 9 aa, Influenza virus
SCFTVMTDG

SEQ ID NO: 309308 - protein, 9 aa, Influenza virus
CFTVMTDGP

SEQ ID NO: 309309 - protein, 9 aa, Influenza virus
FTVMTDGPS

SEQ ID NO: 309310 - protein, 9 aa, Influenza virus
VMGQASYKI

SEQ ID NO: 309311 - protein, 9 aa, Influenza virus
YKYKIFKNG

SEQ ID NO: 309312 - protein, 9 aa, Influenza virus
KYKIFKNGK

SEQ ID NO: 309313 - protein, 9 aa, Influenza virus
GKKGKWLNQ

SEQ ID NO: 309314 - protein, 9 aa, Influenza virus
APNYHYEEC

SEQ ID NO: 309315 - protein, 9 aa, Influenza virus
PNYHYEECS

SEQ ID NO: 309316 - protein, 9 aa, Influenza virus
NYHYEECSC

SEQ ID NO: 309317 - protein, 9 aa, Influenza virus
YHYEECSCY

SEQ ID NO: 309318 - protein, 9 aa, Influenza virus
HYEECSCYP

SEQ ID NO: 309319 - protein, 9 aa, Influenza virus
YEECSCYPD

SEQ ID NO: 309320 - protein, 9 aa, Influenza virus
EECSCYPDS

SEQ ID NO: 309321 - protein, 9 aa, Influenza virus
TCVCRDNWH

SEQ ID NO: 309322 - protein, 9 aa, Influenza virus
CVCRDNWHG

SEQ ID NO: 309323 - protein, 9 aa, Influenza virus
VCRDNWHGS

SEQ ID NO: 309324 - protein, 9 aa, Influenza virus
CRDNWHGSN

SEQ ID NO: 309325 - protein, 9 aa, Influenza virus
RDNWHGSNR

SEQ ID NO: 309326 - protein, 9 aa, Influenza virus
DNWHGSNRP

SEQ ID NO: 309327 - protein, 9 aa, Influenza virus
NWHGSNRPW

SEQ ID NO: 309328 - protein, 9 aa, Influenza virus
WHGSNRPWV

SEQ ID NO: 309329 - protein, 9 aa, Influenza virus
HGSNRPWVS

SEQ ID NO: 309330 - protein, 9 aa, Influenza virus
GSNRPWVSF

SEQ ID NO: 309331 - protein, 9 aa, Influenza virus
SNRPWVSFN

SEQ ID NO: 309332 - protein, 9 aa, Influenza virus
NRPWVSFNQ

SEQ ID NO: 309333 - protein, 9 aa, Influenza virus
YQIGYICSG

SEQ ID NO: 309334 - protein, 9 aa, Influenza virus
GYICSGVFG

SEQ ID NO: 309335 - protein, 9 aa, Influenza virus
YICSGVFGD

SEQ ID NO: 309336 - protein, 9 aa, Influenza virus
ICSGVFGDN

SEQ ID NO: 309337 - protein, 9 aa, Influenza virus
CSGVFGDNP

SEQ ID NO: 309338 - protein, 9 aa, Influenza virus
SGVFGDNPR

SEQ ID NO: 309339 - protein, 9 aa, Influenza virus
GIFGDNPRP

SEQ ID NO: 309340 - protein, 9 aa, Influenza virus
GVKGFSFKY

SEQ ID NO: 309341 - protein, 9 aa, Influenza virus
KYGNGVWIG

SEQ ID NO: 309342 - protein, 9 aa, Influenza virus
YGNGVWIGR

SEQ ID NO: 309343 - protein, 9 aa, Influenza virus
GNGVWIGRT

SEQ ID NO: 309344 - protein, 9 aa, Influenza virus
NGVWIGRTK

SEQ ID NO: 309345 - protein, 9 aa, Influenza virus
GVWIGRTKS

SEQ ID NO: 309346 - protein, 9 aa, Influenza virus
GFEMIWDPN

SEQ ID NO: 309347 - protein, 9 aa, Influenza virus
FEMIWDPNG

SEQ ID NO: 309348 - protein, 9 aa, Influenza virus
EMIWDPNGW

SEQ ID NO: 309349 - protein, 9 aa, Influenza virus
TDWSGYSGS

SEQ ID NO: 309350 - protein, 9 aa, Influenza virus
DWSGYSGSF

SEQ ID NO: 309351 - protein, 9 aa, Influenza virus
WSGYSGSFV

SEQ ID NO: 309352 - protein, 9 aa, Influenza virus
SGYSGSFVQ

SEQ ID NO: 309353 - protein, 9 aa, Influenza virus
GYSGSFVQH

SEQ ID NO: 309354 - protein, 9 aa, Influenza virus
YSGSFVQHP

SEQ ID NO: 309355 - protein, 9 aa, Influenza virus
SGSFVQHPE

SEQ ID NO: 309356 - protein, 9 aa, Influenza virus
GSFVQHPEL

SEQ ID NO: 309357 - protein, 9 aa, Influenza virus
SFVQHPELT

SEQ ID NO: 309358 - protein, 9 aa, Influenza virus
FVQHPELTG

SEQ ID NO: 309359 - protein, 9 aa, Influenza virus
VQHPELTGL

SEQ ID NO: 309360 - protein, 9 aa, Influenza virus
QHPELTGLD

SEQ ID NO: 309361 - protein, 9 aa, Influenza virus
HPELTGLDC

SEQ ID NO: 309362 - protein, 9 aa, Influenza virus
DCIRPCFWV

SEQ ID NO: 309363 - protein, 9 aa, Influenza virus
CIRPCFWVE

SEQ ID NO: 309364 - protein, 9 aa, Influenza virus
IRPCFWVEL

SEQ ID NO: 309365 - protein, 9 aa, Influenza virus
RPCFWVELI

SEQ ID NO: 309366 - protein, 9 aa, Influenza virus
PCFWVELIR

SEQ ID NO: 309367 - protein, 9 aa, Influenza virus
CFWVELIRG

SEQ ID NO: 309368 - protein, 9 aa, Influenza virus
FWVELIRGR

SEQ ID NO: 309369 - protein, 9 aa, Influenza virus
WVELIRGRP

SEQ ID NO: 309370 - protein, 9 aa, Influenza virus
TTIWTSGSS

SEQ ID NO: 309371 - protein, 9 aa, Influenza virus
TIWTSGSSI

SEQ ID NO: 309372 - protein, 9 aa, Influenza virus
IWTSGSSIS

SEQ ID NO: 309373 - protein, 9 aa, Influenza virus
WTSGSSISF

SEQ ID NO: 309374 - protein, 9 aa, Influenza virus
TSGSSISFC

SEQ ID NO: 309375 - protein, 9 aa, Influenza virus
SGSSISFCG

SEQ ID NO: 309376 - protein, 9 aa, Influenza virus
GSSISFCGV

SEQ ID NO: 309377 - protein, 9 aa, Influenza virus
SSISFCGVN

SEQ ID NO: 309378 - protein, 9 aa, Influenza virus
IFLWCKIVT

SEQ ID NO: 309379 - protein, 9 aa, Influenza virus
FLWCKIVTT

SEQ ID NO: 309380 - protein, 9 aa, Influenza virus
LWCKIVTTV

SEQ ID NO: 309381 - protein, 9 aa, Influenza virus
WCKIVTTVG

SEQ ID NO: 309382 - protein, 9 aa, Influenza virus
CKIVTTVGW

SEQ ID NO: 309383 - protein, 9 aa, Influenza virus
KIVTTVGWS

SEQ ID NO: 309384 - protein, 9 aa, Influenza virus
IVTTVGWSW

SEQ ID NO: 309385 - protein, 9 aa, Influenza virus
VTTVGWSWP

SEQ ID NO: 309386 - protein, 9 aa, Influenza virus
TTVGWSWPD

SEQ ID NO: 309387 - protein, 9 aa, Influenza virus
WSWPDGAEL

SEQ ID NO: 309388 - protein, 9 aa, Influenza virus
SWPDGAELP

SEQ ID NO: 309389 - protein, 9 aa, Influenza virus
WPDGAELPF

SEQ ID NO: 309390 - protein, 9 aa, Influenza virus
AKAGVKMNP

SEQ ID NO: 309391 - protein, 9 aa, Influenza virus
KAGVKMNPN

SEQ ID NO: 309392 - protein, 9 aa, Influenza virus
AGVKMNPNQ

SEQ ID NO: 309393 - protein, 9 aa, Influenza virus
GVKMNPNQK

SEQ ID NO: 309394 - protein, 9 aa, Influenza virus
VKMNPNQKI

SEQ ID NO: 309395 - protein, 9 aa, Influenza virus
KMNPNQKII

SEQ ID NO: 309396 - protein, 9 aa, Influenza virus
IIIAIGSVS

SEQ ID NO: 309397 - protein, 9 aa, Influenza virus
KNNQVILCE

SEQ ID NO: 309398 - protein, 9 aa, Influenza virus
VPLVPCEPI

SEQ ID NO: 309399 - protein, 9 aa, Influenza virus
PLVPCEPII

SEQ ID NO: 309400 - protein, 9 aa, Influenza virus
LVPCEPIII

SEQ ID NO: 309401 - protein, 9 aa, Influenza virus
KTVVHLNST

SEQ ID NO: 309402 - protein, 9 aa, Influenza virus
EKEKEICSV

SEQ ID NO: 309403 - protein, 9 aa, Influenza virus
KEKEICSVV

SEQ ID NO: 309404 - protein, 9 aa, Influenza virus
GFAPFSKDN

SEQ ID NO: 309405 - protein, 9 aa, Influenza virus
FAPFSKDNS

SEQ ID NO: 309406 - protein, 9 aa, Influenza virus
APFSKDNSI

SEQ ID NO: 309407 - protein, 9 aa, Influenza virus
PFSKDNSIR

SEQ ID NO: 309408 - protein, 9 aa, Influenza virus
FSKDNSIRL

SEQ ID NO: 309409 - protein, 9 aa, Influenza virus
SKDNSIRLS

SEQ ID NO: 309410 - protein, 9 aa, Influenza virus
KDNSIRLSA

SEQ ID NO: 309411 - protein, 9 aa, Influenza virus
DNSIRLSAG

SEQ ID NO: 309412 - protein, 9 aa, Influenza virus
NSIRLSAGG

SEQ ID NO: 309413 - protein, 9 aa, Influenza virus
IWVTREPYV

SEQ ID NO: 309414 - protein, 9 aa, Influenza virus
WVTREPYVS

SEQ ID NO: 309415 - protein, 9 aa, Influenza virus
VTREPYVSC

SEQ ID NO: 309416 - protein, 9 aa, Influenza virus
TREPYVSCD

SEQ ID NO: 309417 - protein, 9 aa, Influenza virus
KCYQFALGQ

SEQ ID NO: 309418 - protein, 9 aa, Influenza virus
CYQFALGQG

SEQ ID NO: 309419 - protein, 9 aa, Influenza virus
YQFALGQGT

SEQ ID NO: 309420 - protein, 9 aa, Influenza virus
QFALGQGTT

SEQ ID NO: 309421 - protein, 9 aa, Influenza virus
FALGQGTTL

SEQ ID NO: 309422 - protein, 9 aa, Influenza virus
PYRTLLMNE

SEQ ID NO: 309423 - protein, 9 aa, Influenza virus
YRTLLMNEL

SEQ ID NO: 309424 - protein, 9 aa, Influenza virus
RTLLMNELG

SEQ ID NO: 309425 - protein, 9 aa, Influenza virus
TLLMNELGV

SEQ ID NO: 309426 - protein, 9 aa, Influenza virus
LLMNELGVP

SEQ ID NO: 309427 - protein, 9 aa, Influenza virus
LMNELGVPF

SEQ ID NO: 309428 - protein, 9 aa, Influenza virus
MNELGVPFH

SEQ ID NO: 309429 - protein, 9 aa, Influenza virus
NELGVPFHL

SEQ ID NO: 309430 - protein, 9 aa, Influenza virus
ELGVPFHLG

SEQ ID NO: 309431 - protein, 9 aa, Influenza virus
LGVPFHLGT

SEQ ID NO: 309432 - protein, 9 aa, Influenza virus
GVPFHLGTK

SEQ ID NO: 309433 - protein, 9 aa, Influenza virus
VPFHLGTKQ

SEQ ID NO: 309434 - protein, 9 aa, Influenza virus
PFHLGTKQV

SEQ ID NO: 309435 - protein, 9 aa, Influenza virus
FHLGTKQVC

SEQ ID NO: 309436 - protein, 9 aa, Influenza virus
TKQVCIAWS

SEQ ID NO: 309437 - protein, 9 aa, Influenza virus
KQVCIAWSS

SEQ ID NO: 309438 - protein, 9 aa, Influenza virus
QVCIAWSSS

SEQ ID NO: 309439 - protein, 9 aa, Influenza virus
VCIAWSSSS

SEQ ID NO: 309440 - protein, 9 aa, Influenza virus
CIAWSSSSC

SEQ ID NO: 309441 - protein, 9 aa, Influenza virus
IAWSSSSCH

SEQ ID NO: 309442 - protein, 9 aa, Influenza virus
AWSSSSCHD

SEQ ID NO: 309443 - protein, 9 aa, Influenza virus
WSSSSCHDG

SEQ ID NO: 309444 - protein, 9 aa, Influenza virus
SSSSCHDGK

SEQ ID NO: 309445 - protein, 9 aa, Influenza virus
SSSCHDGKA

SEQ ID NO: 309446 - protein, 9 aa, Influenza virus
SSCHDGKAW

SEQ ID NO: 309447 - protein, 9 aa, Influenza virus
SCHDGKAWL

SEQ ID NO: 309448 - protein, 9 aa, Influenza virus
CHDGKAWLH

SEQ ID NO: 309449 - protein, 9 aa, Influenza virus
DGKAWLHVC

SEQ ID NO: 309450 - protein, 9 aa, Influenza virus
AWLHVCVTG

SEQ ID NO: 309451 - protein, 9 aa, Influenza virus
NILRTQESE

SEQ ID NO: 309452 - protein, 9 aa, Influenza virus
ILRTQESEC

SEQ ID NO: 309453 - protein, 9 aa, Influenza virus
LRTQESECV

SEQ ID NO: 309454 - protein, 9 aa, Influenza virus
RTQESECVC

SEQ ID NO: 309455 - protein, 9 aa, Influenza virus
TQESECVCI

SEQ ID NO: 309456 - protein, 9 aa, Influenza virus
QESECVCIN

SEQ ID NO: 309457 - protein, 9 aa, Influenza virus
ESECVCING

SEQ ID NO: 309458 - protein, 9 aa, Influenza virus
CTVVMTDGS

SEQ ID NO: 309459 - protein, 9 aa, Influenza virus
TVVMTDGSA

SEQ ID NO: 309460 - protein, 9 aa, Influenza virus
VVMTDGSAS

SEQ ID NO: 309461 - protein, 9 aa, Influenza virus
VMTDGSASG

SEQ ID NO: 309462 - protein, 9 aa, Influenza virus
IRKGLILEY

SEQ ID NO: 309463 - protein, 9 aa, Influenza virus
REGLILEYY

SEQ ID NO: 309464 - protein, 9 aa, Influenza virus
GSAQHVEEC

SEQ ID NO: 309465 - protein, 9 aa, Influenza virus
SAQHVEECS

SEQ ID NO: 309466 - protein, 9 aa, Influenza virus
AQHVEECSC

SEQ ID NO: 309467 - protein, 9 aa, Influenza virus
QHVEECSCY

SEQ ID NO: 309468 - protein, 9 aa, Influenza virus
HVEECSCYP

SEQ ID NO: 309469 - protein, 9 aa, Influenza virus
VEECSCYPR

SEQ ID NO: 309470 - protein, 9 aa, Influenza virus
EECSCYPRY

SEQ ID NO: 309471 - protein, 9 aa, Influenza virus
SYLNVRCVC

SEQ ID NO: 309472 - protein, 9 aa, Influenza virus
VRCVCRDNW

SEQ ID NO: 309473 - protein, 9 aa, Influenza virus
RCVCRDNWK

SEQ ID NO: 309474 - protein, 9 aa, Influenza virus
CVCRDNWKG

SEQ ID NO: 309475 - protein, 9 aa, Influenza virus
VCRDNWKGS

SEQ ID NO: 309476 - protein, 9 aa, Influenza virus
CRDNWKGSN

SEQ ID NO: 309477 - protein, 9 aa, Influenza virus
RDNWKGSNR

SEQ ID NO: 309478 - protein, 9 aa, Influenza virus
DNWKGSNRP

SEQ ID NO: 309479 - protein, 9 aa, Influenza virus
NWKGSNRPI

SEQ ID NO: 309480 - protein, 9 aa, Influenza virus
KLDINMADY

SEQ ID NO: 309481 - protein, 9 aa, Influenza virus
YVCSGLVGD

SEQ ID NO: 309482 - protein, 9 aa, Influenza virus
VCSGLVGDT

SEQ ID NO: 309483 - protein, 9 aa, Influenza virus
CSGLVGDTP

SEQ ID NO: 309484 - protein, 9 aa, Influenza virus
SGLVGDTPR

SEQ ID NO: 309485 - protein, 9 aa, Influenza virus
GLVGDTPRK

SEQ ID NO: 309486 - protein, 9 aa, Influenza virus
HGVKGWAFD

SEQ ID NO: 309487 - protein, 9 aa, Influenza virus
GVKGWAFDD

SEQ ID NO: 309488 - protein, 9 aa, Influenza virus
RSGYETFKV

SEQ ID NO: 309489 - protein, 9 aa, Influenza virus
SGYSGIFSV

SEQ ID NO: 309490 - protein, 9 aa, Influenza virus
GYSGIFSVE

SEQ ID NO: 309491 - protein, 9 aa, Influenza virus
CINRCFYVE

SEQ ID NO: 309492 - protein, 9 aa, Influenza virus
INRCFYVEL

SEQ ID NO: 309493 - protein, 9 aa, Influenza virus
NRCFYVELI

SEQ ID NO: 309494 - protein, 9 aa, Influenza virus
RCFYVELIR

SEQ ID NO: 309495 - protein, 9 aa, Influenza virus
CFYVELIRG

SEQ ID NO: 309496 - protein, 9 aa, Influenza virus
FYVELIRGR

SEQ ID NO: 309497 - protein, 9 aa, Influenza virus
VWWTSNSIV

SEQ ID NO: 309498 - protein, 9 aa, Influenza virus
WTSNSIVVF

SEQ ID NO: 309499 - protein, 9 aa, Influenza virus
TSNSIVVFC

SEQ ID NO: 309500 - protein, 9 aa, Influenza virus
SNSIVVFCG

SEQ ID NO: 309501 - protein, 9 aa, Influenza virus
NSIVVFCGT

SEQ ID NO: 309502 - protein, 9 aa, Influenza virus
SIVVFCGTS

SEQ ID NO: 309503 - protein, 9 aa, Influenza virus
IVVFCGTSG

SEQ ID NO: 309504 - protein, 9 aa, Influenza virus
VVFCGTSGT

SEQ ID NO: 309505 - protein, 9 aa, Influenza virus
VFCGTSGTY

SEQ ID NO: 309506 - protein, 9 aa, Influenza virus
FCGTSGTYG

SEQ ID NO: 309507 - protein, 9 aa, Influenza virus
CGTSGTYGT

SEQ ID NO: 309508 - protein, 9 aa, Influenza virus
GTSGTYGTG

SEQ ID NO: 309509 - protein, 9 aa, Influenza virus
TSGTYGTGS

SEQ ID NO: 309510 - protein, 9 aa, Influenza virus
SGTYGTGSW

SEQ ID NO: 309511 - protein, 9 aa, Influenza virus
GTYGTGSWP

SEQ ID NO: 309512 - protein, 9 aa, Influenza virus
TYGTGSWPD

SEQ ID NO: 309513 - protein, 9 aa, Influenza virus
YGTGSWPDG

SEQ ID NO: 309514 - protein, 9 aa, Influenza virus
GTGSWPDGA

SEQ ID NO: 309515 - protein, 9 aa, Influenza virus
GSWPDGADI

SEQ ID NO: 309516 - protein, 9 aa, Influenza virus
RTSISCLYK

SEQ ID NO: 309517 - protein, 9 aa, Influenza virus
ADINLHAYI

SEQ ID NO: 309518 - protein, 9 aa, Influenza virus
DINLHAYIS

SEQ ID NO: 309519 - protein, 9 aa, Influenza virus
INLHAYISF

SEQ ID NO: 309520 - protein, 9 aa, Influenza virus
NLHAYISFR

SEQ ID NO: 309521 - protein, 9 aa, Influenza virus
LHAYISFRN

SEQ ID NO: 309522 - protein, 9 aa, Influenza virus
HAYISFRNL

SEQ ID NO: 309523 - protein, 9 aa, Influenza virus
ALLIGVGNL

SEQ ID NO: 309524 - protein, 9 aa, Influenza virus
GNLVFNTVI

SEQ ID NO: 309525 - protein, 9 aa, Influenza virus
NLVFNTVIH

SEQ ID NO: 309526 - protein, 9 aa, Influenza virus
LPLCPFRGF

SEQ ID NO: 309527 - protein, 9 aa, Influenza virus
PLCPFRGFF

SEQ ID NO: 309528 - protein, 9 aa, Influenza virus
LCPFRGFFP

SEQ ID NO: 309529 - protein, 9 aa, Influenza virus
CPFRGFFPF

SEQ ID NO: 309530 - protein, 9 aa, Influenza virus
PFRGFFPFH

SEQ ID NO: 309531 - protein, 9 aa, Influenza virus
FRGFFPFHK

SEQ ID NO: 309532 - protein, 9 aa, Influenza virus
RGFFPFHKD

SEQ ID NO: 309533 - protein, 9 aa, Influenza virus
GFFPFHKDN

SEQ ID NO: 309534 - protein, 9 aa, Influenza virus
FFPFHKDNA

SEQ ID NO: 309535 - protein, 9 aa, Influenza virus
FPFHKDNAI

SEQ ID NO: 309536 - protein, 9 aa, Influenza virus
PFHKDNAIR

SEQ ID NO: 309537 - protein, 9 aa, Influenza virus
FHKDNAIRL

SEQ ID NO: 309538 - protein, 9 aa, Influenza virus
HKDNAIRLG

SEQ ID NO: 309539 - protein, 9 aa, Influenza virus
KDNAIRLGE

SEQ ID NO: 309540 - protein, 9 aa, Influenza virus
DNAIRLGEN

SEQ ID NO: 309541 - protein, 9 aa, Influenza virus
IVTREPYVS

SEQ ID NO: 309542 - protein, 9 aa, Influenza virus
VTREPYVSC

SEQ ID NO: 309543 - protein, 9 aa, Influenza virus
TREPYVSCD

SEQ ID NO: 309544 - protein, 9 aa, Influenza virus
REPYVSCDN

SEQ ID NO: 309545 - protein, 9 aa, Influenza virus
NCWSFALAQ

SEQ ID NO: 309546 - protein, 9 aa, Influenza virus
CWSFALAQG

SEQ ID NO: 309547 - protein, 9 aa, Influenza virus
WSFALAQGA

SEQ ID NO: 309548 - protein, 9 aa, Influenza virus
SFALAQGAL

SEQ ID NO: 309549 - protein, 9 aa, Influenza virus
FALAQGALL

SEQ ID NO: 309550 - protein, 9 aa, Influenza virus
ALAQGALLG

SEQ ID NO: 309551 - protein, 9 aa, Influenza virus
LAQGALLGT

SEQ ID NO: 309552 - protein, 9 aa, Influenza virus
LLGTKHSNG

SEQ ID NO: 309553 - protein, 9 aa, Influenza virus
LGTKHSNGT

SEQ ID NO: 309554 - protein, 9 aa, Influenza virus
HSNGTIKDR

SEQ ID NO: 309555 - protein, 9 aa, Influenza virus
SNGTIKDRT

SEQ ID NO: 309556 - protein, 9 aa, Influenza virus
KDRTPYRSL

SEQ ID NO: 309557 - protein, 9 aa, Influenza virus
DRTPYRSLI

SEQ ID NO: 309558 - protein, 9 aa, Influenza virus
RTPYRSLIR

SEQ ID NO: 309559 - protein, 9 aa, Influenza virus
TPYRSLIRF

SEQ ID NO: 309560 - protein, 9 aa, Influenza virus
PYRSLIRFP

SEQ ID NO: 309561 - protein, 9 aa, Influenza virus
YRSLIRFPI

SEQ ID NO: 309562 - protein, 9 aa, Influenza virus
RSLIRFPIG

SEQ ID NO: 309563 - protein, 9 aa, Influenza virus
GTAPVLGNY

SEQ ID NO: 309564 - protein, 9 aa, Influenza virus
APVLGNYKE

SEQ ID NO: 309565 - protein, 9 aa, Influenza virus
CIAWSSSSC

SEQ ID NO: 309566 - protein, 9 aa, Influenza virus
IAWSSSSCF

SEQ ID NO: 309567 - protein, 9 aa, Influenza virus
AWSSSSCFD

SEQ ID NO: 309568 - protein, 9 aa, Influenza virus
WSSSSCFDG

SEQ ID NO: 309569 - protein, 9 aa, Influenza virus
SSSSCFDGK

SEQ ID NO: 309570 - protein, 9 aa, Influenza virus
SSSCFDGKE

SEQ ID NO: 309571 - protein, 9 aa, Influenza virus
SSCFDGKEW

SEQ ID NO: 309572 - protein, 9 aa, Influenza virus
SCFDGKEWM

SEQ ID NO: 309573 - protein, 9 aa, Influenza virus
CFDGKEWMH

SEQ ID NO: 309574 - protein, 9 aa, Influenza virus
FDGKEWMHV

SEQ ID NO: 309575 - protein, 9 aa, Influenza virus
DGKEWMHVC

SEQ ID NO: 309576 - protein, 9 aa, Influenza virus
KDILRTQES

SEQ ID NO: 309577 - protein, 9 aa, Influenza virus
DILRTQESE

SEQ ID NO: 309578 - protein, 9 aa, Influenza virus
ILRTQESEC

SEQ ID NO: 309579 - protein, 9 aa, Influenza virus
LRTQESECQ

SEQ ID NO: 309580 - protein, 9 aa, Influenza virus
RTQESECQC

SEQ ID NO: 309581 - protein, 9 aa, Influenza virus
TQESECQCI

SEQ ID NO: 309582 - protein, 9 aa, Influenza virus
TDGPAANSA

SEQ ID NO: 309583 - protein, 9 aa, Influenza virus
ADHRVYWIR

SEQ ID NO: 309584 - protein, 9 aa, Influenza virus
KIQHLEECS

SEQ ID NO: 309585 - protein, 9 aa, Influenza virus
IQHLEECSC

SEQ ID NO: 309586 - protein, 9 aa, Influenza virus
QHLEECSCY

SEQ ID NO: 309587 - protein, 9 aa, Influenza virus
HLEECSCYV

SEQ ID NO: 309588 - protein, 9 aa, Influenza virus
LEECSCYVD

SEQ ID NO: 309589 - protein, 9 aa, Influenza virus
DVYCICRDN

SEQ ID NO: 309590 - protein, 9 aa, Influenza virus
VYCICRDNW

SEQ ID NO: 309591 - protein, 9 aa, Influenza virus
YCICRDNWK

SEQ ID NO: 309592 - protein, 9 aa, Influenza virus
CICRDNWKG

SEQ ID NO: 309593 - protein, 9 aa, Influenza virus
ICRDNWKGS

SEQ ID NO: 309594 - protein, 9 aa, Influenza virus
CRDNWKGSN

SEQ ID NO: 309595 - protein, 9 aa, Influenza virus
RDNWKGSNR

SEQ ID NO: 309596 - protein, 9 aa, Influenza virus
DNWKGSNRP

SEQ ID NO: 309597 - protein, 9 aa, Influenza virus
NWKGSNRPW

SEQ ID NO: 309598 - protein, 9 aa, Influenza virus
WKGSNRPWM

SEQ ID NO: 309599 - protein, 9 aa, Influenza virus
KGSNRPWMR

SEQ ID NO: 309600 - protein, 9 aa, Influenza virus
GSNRPWMRI

SEQ ID NO: 309601 - protein, 9 aa, Influenza virus
SNRPWMRIN

SEQ ID NO: 309602 - protein, 9 aa, Influenza virus
NRPWMRINN

SEQ ID NO: 309603 - protein, 9 aa, Influenza virus
RPWMRINNE

SEQ ID NO: 309604 - protein, 9 aa, Influenza virus
PWMRINNET

SEQ ID NO: 309605 - protein, 9 aa, Influenza virus
WMRINNETI

SEQ ID NO: 309606 - protein, 9 aa, Influenza virus
INNETILET

SEQ ID NO: 309607 - protein, 9 aa, Influenza virus
NNETILETG

SEQ ID NO: 309608 - protein, 9 aa, Influenza virus
NETILETGY

SEQ ID NO: 309609 - protein, 9 aa, Influenza virus
ETILETGYV

SEQ ID NO: 309610 - protein, 9 aa, Influenza virus
TILETGYVC

SEQ ID NO: 309611 - protein, 9 aa, Influenza virus
ILETGYVCS

SEQ ID NO: 309612 - protein, 9 aa, Influenza virus
LETGYVCSK

SEQ ID NO: 309613 - protein, 9 aa, Influenza virus
ETGYVCSKF

SEQ ID NO: 309614 - protein, 9 aa, Influenza virus
TGYVCSKFH

SEQ ID NO: 309615 - protein, 9 aa, Influenza virus
GYVCSKFHS

SEQ ID NO: 309616 - protein, 9 aa, Influenza virus
YVCSKFHSD

SEQ ID NO: 309617 - protein, 9 aa, Influenza virus
VCSKFHSDT

SEQ ID NO: 309618 - protein, 9 aa, Influenza virus
CSKFHSDTP

SEQ ID NO: 309619 - protein, 9 aa, Influenza virus
SKFHSDTPR

SEQ ID NO: 309620 - protein, 9 aa, Influenza virus
KFHSDTPRP

SEQ ID NO: 309621 - protein, 9 aa, Influenza virus
FHSDTPRPA

SEQ ID NO: 309622 - protein, 9 aa, Influenza virus
HSDTPRPAD

SEQ ID NO: 309623 - protein, 9 aa, Influenza virus
SDTPRPADP

SEQ ID NO: 309624 - protein, 9 aa, Influenza virus
DTPRPADPS

SEQ ID NO: 309625 - protein, 9 aa, Influenza virus
GPGVKGFGF

SEQ ID NO: 309626 - protein, 9 aa, Influenza virus
PGVKGFGFK

SEQ ID NO: 309627 - protein, 9 aa, Influenza virus
GNDVWLGRT

SEQ ID NO: 309628 - protein, 9 aa, Influenza virus
NDVWLGRTV

SEQ ID NO: 309629 - protein, 9 aa, Influenza virus
DVWLGRTVS

SEQ ID NO: 309630 - protein, 9 aa, Influenza virus
RSGFEIIKV

SEQ ID NO: 309631 - protein, 9 aa, Influenza virus
TQTLVSNND

SEQ ID NO: 309632 - protein, 9 aa, Influenza virus
QTLVSNNDW

SEQ ID NO: 309633 - protein, 9 aa, Influenza virus
TLVSNNDWS

SEQ ID NO: 309634 - protein, 9 aa, Influenza virus
LVSNNDWSG

SEQ ID NO: 309635 - protein, 9 aa, Influenza virus
VSNNDWSGY

SEQ ID NO: 309636 - protein, 9 aa, Influenza virus
SNNDWSGYS

SEQ ID NO: 309637 - protein, 9 aa, Influenza virus
NNDWSGYSG

SEQ ID NO: 309638 - protein, 9 aa, Influenza virus
NDWSGYSGS

SEQ ID NO: 309639 - protein, 9 aa, Influenza virus
DWSGYSGSF

SEQ ID NO: 309640 - protein, 9 aa, Influenza virus
WSGYSGSFI

SEQ ID NO: 309641 - protein, 9 aa, Influenza virus
SGYSGSFIV

SEQ ID NO: 309642 - protein, 9 aa, Influenza virus
DCFQPCFYV

SEQ ID NO: 309643 - protein, 9 aa, Influenza virus
CFQPCFYVE

SEQ ID NO: 309644 - protein, 9 aa, Influenza virus
FQPCFYVEL

SEQ ID NO: 309645 - protein, 9 aa, Influenza virus
QPCFYVELI

SEQ ID NO: 309646 - protein, 9 aa, Influenza virus
PCFYVELIR

SEQ ID NO: 309647 - protein, 9 aa, Influenza virus
CFYVELIRG

SEQ ID NO: 309648 - protein, 9 aa, Influenza virus
FYVELIRGR

SEQ ID NO: 309649 - protein, 9 aa, Influenza virus
VSWTSNSIV

SEQ ID NO: 309650 - protein, 9 aa, Influenza virus
SWTSNSIVT

SEQ ID NO: 309651 - protein, 9 aa, Influenza virus
WTSNSIVTF

SEQ ID NO: 309652 - protein, 9 aa, Influenza virus
TSNSIVTFC

SEQ ID NO: 309653 - protein, 9 aa, Influenza virus
SNSIVTFCG

SEQ ID NO: 309654 - protein, 9 aa, Influenza virus
NSIVTFCGL

SEQ ID NO: 309655 - protein, 9 aa, Influenza virus
SIVTFCGLD

SEQ ID NO: 309656 - protein, 9 aa, Influenza virus
IVTFCGLDN

SEQ ID NO: 309657 - protein, 9 aa, Influenza virus
VTFCGLDNE

SEQ ID NO: 309658 - protein, 9 aa, Influenza virus
TFCGLDNEP

SEQ ID NO: 309659 - protein, 9 aa, Influenza virus
FCGLDNEPG

SEQ ID NO: 309660 - protein, 9 aa, Influenza virus
CGLDNEPGS

SEQ ID NO: 309661 - protein, 9 aa, Influenza virus
GLDNEPGSG

SEQ ID NO: 309662 - protein, 9 aa, Influenza virus
NEPGSGNWP

SEQ ID NO: 309663 - protein, 9 aa, Influenza virus
EPGSGNWPD

SEQ ID NO: 309664 - protein, 9 aa, Influenza virus
PGSGNWPDG

SEQ ID NO: 309665 - protein, 9 aa, Influenza virus
GSGNWPDGS

SEQ ID NO: 309666 - protein, 9 aa, Influenza virus
WPDGSNIGF

SEQ ID NO: 309667 - protein, 9 aa, Influenza virus
PDGSNIGFM

SEQ ID NO: 309668 - protein, 9 aa, Influenza virus
DGSNIGFMP

SEQ ID NO: 309669 - protein, 9 aa, Influenza virus
GSNIGFMPK

SEQ ID NO: 309670 - protein, 9 aa, Influenza virus
MNPNQKIIT

SEQ ID NO: 309671 - protein, 9 aa, Influenza virus
NPNQKIITI

SEQ ID NO: 309672 - protein, 9 aa, Influenza virus
PNQKIITIG

SEQ ID NO: 309673 - protein, 9 aa, Influenza virus
NQKIITIGS

SEQ ID NO: 309674 - protein, 9 aa, Influenza virus
IITIGSISI

SEQ ID NO: 309675 - protein, 9 aa, Influenza virus
LTTVGLLLQ

SEQ ID NO: 309676 - protein, 9 aa, Influenza virus
TTVGLLLQI

SEQ ID NO: 309677 - protein, 9 aa, Influenza virus
TVGLLLQIT

SEQ ID NO: 309678 - protein, 9 aa, Influenza virus
VGLLLQITS

SEQ ID NO: 309679 - protein, 9 aa, Influenza virus
GLLLQITSL

SEQ ID NO: 309680 - protein, 9 aa, Influenza virus
LLLQITSLC

SEQ ID NO: 309681 - protein, 9 aa, Influenza virus
LLQITSLCS

SEQ ID NO: 309682 - protein, 9 aa, Influenza virus
LQITSLCSI

SEQ ID NO: 309683 - protein, 9 aa, Influenza virus
QITSLCSIW

SEQ ID NO: 309684 - protein, 9 aa, Influenza virus
ITSLCSIWF

SEQ ID NO: 309685 - protein, 9 aa, Influenza virus
TSLCSIWFS

SEQ ID NO: 309686 - protein, 9 aa, Influenza virus
SLCSIWFSH

SEQ ID NO: 309687 - protein, 9 aa, Influenza virus
LCSIWFSHY

SEQ ID NO: 309688 - protein, 9 aa, Influenza virus
CSIWFSHYN

SEQ ID NO: 309689 - protein, 9 aa, Influenza virus
SIWFSHYNQ

SEQ ID NO: 309690 - protein, 9 aa, Influenza virus
IWFSHYNQV

SEQ ID NO: 309691 - protein, 9 aa, Influenza virus
WFSHYNQVT

SEQ ID NO: 309692 - protein, 9 aa, Influenza virus
FSHYNQVTQ

SEQ ID NO: 309693 - protein, 9 aa, Influenza virus
SHYNQVTQT

SEQ ID NO: 309694 - protein, 9 aa, Influenza virus
CSNNTTNYY

SEQ ID NO: 309695 - protein, 9 aa, Influenza virus
SNNTTNYYN

SEQ ID NO: 309696 - protein, 9 aa, Influenza virus
NNTTNYYNE

SEQ ID NO: 309697 - protein, 9 aa, Influenza virus
NTTNYYNET

SEQ ID NO: 309698 - protein, 9 aa, Influenza virus
TTNYYNETF

SEQ ID NO: 309699 - protein, 9 aa, Influenza virus
TNYYNETFV

SEQ ID NO: 309700 - protein, 9 aa, Influenza virus
NYYNETFVN

SEQ ID NO: 309701 - protein, 9 aa, Influenza virus
YYNETFVNV

SEQ ID NO: 309702 - protein, 9 aa, Influenza virus
YNETFVNVT

SEQ ID NO: 309703 - protein, 9 aa, Influenza virus
NETFVNVTN

SEQ ID NO: 309704 - protein, 9 aa, Influenza virus
ETFVNVTNV

SEQ ID NO: 309705 - protein, 9 aa, Influenza virus
TFVNVTNVQ

SEQ ID NO: 309706 - protein, 9 aa, Influenza virus
FVNVTNVQN

SEQ ID NO: 309707 - protein, 9 aa, Influenza virus
VNVTNVQNN

SEQ ID NO: 309708 - protein, 9 aa, Influenza virus
NVTNVQNNY

SEQ ID NO: 309709 - protein, 9 aa, Influenza virus
VTNVQNNYT

SEQ ID NO: 309710 - protein, 9 aa, Influenza virus
TNVQNNYTT

SEQ ID NO: 309711 - protein, 9 aa, Influenza virus
NVQNNYTTV

SEQ ID NO: 309712 - protein, 9 aa, Influenza virus
LCPIRGWAP

SEQ ID NO: 309713 - protein, 9 aa, Influenza virus
CPIRGWAPL

SEQ ID NO: 309714 - protein, 9 aa, Influenza virus
PIRGWAPLS

SEQ ID NO: 309715 - protein, 9 aa, Influenza virus
IRGWAPLSK

SEQ ID NO: 309716 - protein, 9 aa, Influenza virus
RGWAPLSKD

SEQ ID NO: 309717 - protein, 9 aa, Influenza virus
GWAPLSKDN

SEQ ID NO: 309718 - protein, 9 aa, Influenza virus
WAPLSKDNG

SEQ ID NO: 309719 - protein, 9 aa, Influenza virus
APLSKDNGI

SEQ ID NO: 309720 - protein, 9 aa, Influenza virus
PLSKDNGIR

SEQ ID NO: 309721 - protein, 9 aa, Influenza virus
LSKDNGIRI

SEQ ID NO: 309722 - protein, 9 aa, Influenza virus
SKDNGIRIG

SEQ ID NO: 309723 - protein, 9 aa, Influenza virus
KDNGIRIGS

SEQ ID NO: 309724 - protein, 9 aa, Influenza virus
DNGIRIGSR

SEQ ID NO: 309725 - protein, 9 aa, Influenza virus
NGIRIGSRG

SEQ ID NO: 309726 - protein, 9 aa, Influenza virus
GIRIGSRGE

SEQ ID NO: 309727 - protein, 9 aa, Influenza virus
IRIGSRGEV

SEQ ID NO: 309728 - protein, 9 aa, Influenza virus
RIGSRGEVF

SEQ ID NO: 309729 - protein, 9 aa, Influenza virus
IGSRGEVFV

SEQ ID NO: 309730 - protein, 9 aa, Influenza virus
GSRGEVFVI

SEQ ID NO: 309731 - protein, 9 aa, Influenza virus
SRGEVFVIR

SEQ ID NO: 309732 - protein, 9 aa, Influenza virus
RGEVFVIRE

SEQ ID NO: 309733 - protein, 9 aa, Influenza virus
GEVFVIREP

SEQ ID NO: 309734 - protein, 9 aa, Influenza virus
EVFVIREPF

SEQ ID NO: 309735 - protein, 9 aa, Influenza virus
VFVIREPFI

SEQ ID NO: 309736 - protein, 9 aa, Influenza virus
FVIREPFIS

SEQ ID NO: 309737 - protein, 9 aa, Influenza virus
VIREPFISC

SEQ ID NO: 309738 - protein, 9 aa, Influenza virus
IREPFISCS

SEQ ID NO: 309739 - protein, 9 aa, Influenza virus
REPFISCSI

SEQ ID NO: 309740 - protein, 9 aa, Influenza virus
ISCSISECR

SEQ ID NO: 309741 - protein, 9 aa, Influenza virus
SCSISECRT

SEQ ID NO: 309742 - protein, 9 aa, Influenza virus
CSISECRTF

SEQ ID NO: 309743 - protein, 9 aa, Influenza virus
SISECRTFF

SEQ ID NO: 309744 - protein, 9 aa, Influenza virus
ISECRTFFL

SEQ ID NO: 309745 - protein, 9 aa, Influenza virus
SECRTFFLT

SEQ ID NO: 309746 - protein, 9 aa, Influenza virus
ECRTFFLTQ

SEQ ID NO: 309747 - protein, 9 aa, Influenza virus
CRTFFLTQG

SEQ ID NO: 309748 - protein, 9 aa, Influenza virus
RTFFLTQGA

SEQ ID NO: 309749 - protein, 9 aa, Influenza virus
TFFLTQGAL

SEQ ID NO: 309750 - protein, 9 aa, Influenza virus
FFLTQGALL

SEQ ID NO: 309751 - protein, 9 aa, Influenza virus
FLTQGALLN

SEQ ID NO: 309752 - protein, 9 aa, Influenza virus
LTQGALLND

SEQ ID NO: 309753 - protein, 9 aa, Influenza virus
TQGALLNDK

SEQ ID NO: 309754 - protein, 9 aa, Influenza virus
QGALLNDKH

SEQ ID NO: 309755 - protein, 9 aa, Influenza virus
GALLNDKHS

SEQ ID NO: 309756 - protein, 9 aa, Influenza virus
ALLNDKHSN

SEQ ID NO: 309757 - protein, 9 aa, Influenza virus
LLNDKHSNG

SEQ ID NO: 309758 - protein, 9 aa, Influenza virus
LNDKHSNGT

SEQ ID NO: 309759 - protein, 9 aa, Influenza virus
NDKHSNGTV

SEQ ID NO: 309760 - protein, 9 aa, Influenza virus
DKHSNGTVK

SEQ ID NO: 309761 - protein, 9 aa, Influenza virus
KHSNGTVKD

SEQ ID NO: 309762 - protein, 9 aa, Influenza virus
HSNGTVKDR

SEQ ID NO: 309763 - protein, 9 aa, Influenza virus
SNGTVKDRS

SEQ ID NO: 309764 - protein, 9 aa, Influenza virus
NGTVKDRSP

SEQ ID NO: 309765 - protein, 9 aa, Influenza virus
GTVKDRSPF

SEQ ID NO: 309766 - protein, 9 aa, Influenza virus
TVKDRSPFR

SEQ ID NO: 309767 - protein, 9 aa, Influenza virus
VKDRSPFRT

SEQ ID NO: 309768 - protein, 9 aa, Influenza virus
KDRSPFRTL

SEQ ID NO: 309769 - protein, 9 aa, Influenza virus
DRSPFRTLM

SEQ ID NO: 309770 - protein, 9 aa, Influenza virus
RSPFRTLMS

SEQ ID NO: 309771 - protein, 9 aa, Influenza virus
SPFRTLMSC

SEQ ID NO: 309772 - protein, 9 aa, Influenza virus
PFRTLMSCP

SEQ ID NO: 309773 - protein, 9 aa, Influenza virus
FRTLMSCPI

SEQ ID NO: 309774 - protein, 9 aa, Influenza virus
RTLMSCPIG

SEQ ID NO: 309775 - protein, 9 aa, Influenza virus
TLMSCPIGV

SEQ ID NO: 309776 - protein, 9 aa, Influenza virus
LMSCPIGVA

SEQ ID NO: 309777 - protein, 9 aa, Influenza virus
MSCPIGVAP

SEQ ID NO: 309778 - protein, 9 aa, Influenza virus
SCPIGVAPS

SEQ ID NO: 309779 - protein, 9 aa, Influenza virus
CPIGVAPSP

SEQ ID NO: 309780 - protein, 9 aa, Influenza virus
PIGVAPSPS

SEQ ID NO: 309781 - protein, 9 aa, Influenza virus
IGVAPSPSN

SEQ ID NO: 309782 - protein, 9 aa, Influenza virus
GVAPSPSNS

SEQ ID NO: 309783 - protein, 9 aa, Influenza virus
VAPSPSNSR

SEQ ID NO: 309784 - protein, 9 aa, Influenza virus
APSPSNSRF

SEQ ID NO: 309785 - protein, 9 aa, Influenza virus
PSPSNSRFE

SEQ ID NO: 309786 - protein, 9 aa, Influenza virus
SPSNSRFES

SEQ ID NO: 309787 - protein, 9 aa, Influenza virus
PSNSRFESV

SEQ ID NO: 309788 - protein, 9 aa, Influenza virus
SNSRFESVA

SEQ ID NO: 309789 - protein, 9 aa, Influenza virus
NSRFESVAW

SEQ ID NO: 309790 - protein, 9 aa, Influenza virus
SRFESVAWS

SEQ ID NO: 309791 - protein, 9 aa, Influenza virus
RFESVAWSA

SEQ ID NO: 309792 - protein, 9 aa, Influenza virus
FESVAWSAT

SEQ ID NO: 309793 - protein, 9 aa, Influenza virus
ESVAWSATA

SEQ ID NO: 309794 - protein, 9 aa, Influenza virus
SVAWSATAC

SEQ ID NO: 309795 - protein, 9 aa, Influenza virus
VAWSATACS

SEQ ID NO: 309796 - protein, 9 aa, Influenza virus
AWSATACSD

SEQ ID NO: 309797 - protein, 9 aa, Influenza virus
WSATACSDG

SEQ ID NO: 309798 - protein, 9 aa, Influenza virus
SATACSDGP

SEQ ID NO: 309799 - protein, 9 aa, Influenza virus
ATACSDGPG

SEQ ID NO: 309800 - protein, 9 aa, Influenza virus
TACSDGPGW

SEQ ID NO: 309801 - protein, 9 aa, Influenza virus
ACSDGPGWL

SEQ ID NO: 309802 - protein, 9 aa, Influenza virus
CSDGPGWLT

SEQ ID NO: 309803 - protein, 9 aa, Influenza virus
SDGPGWLTL

SEQ ID NO: 309804 - protein, 9 aa, Influenza virus
DGPGWLTLG

SEQ ID NO: 309805 - protein, 9 aa, Influenza virus
GPGWLTLGI

SEQ ID NO: 309806 - protein, 9 aa, Influenza virus
PGWLTLGIT

SEQ ID NO: 309807 - protein, 9 aa, Influenza virus
GWLTLGITG

SEQ ID NO: 309808 - protein, 9 aa, Influenza virus
WLTLGITGP

SEQ ID NO: 309809 - protein, 9 aa, Influenza virus
LTLGITGPD

SEQ ID NO: 309810 - protein, 9 aa, Influenza virus
TLGITGPDA

SEQ ID NO: 309811 - protein, 9 aa, Influenza virus
LGITGPDAT

SEQ ID NO: 309812 - protein, 9 aa, Influenza virus
GITGPDATA

SEQ ID NO: 309813 - protein, 9 aa, Influenza virus
ITGPDATAV

SEQ ID NO: 309814 - protein, 9 aa, Influenza virus
TGPDATAVA

SEQ ID NO: 309815 - protein, 9 aa, Influenza virus
GPDATAVAV

SEQ ID NO: 309816 - protein, 9 aa, Influenza virus
PDATAVAVL

SEQ ID NO: 309817 - protein, 9 aa, Influenza virus
DATAVAVLK

SEQ ID NO: 309818 - protein, 9 aa, Influenza virus
ATAVAVLKY

SEQ ID NO: 309819 - protein, 9 aa, Influenza virus
TAVAVLKYN

SEQ ID NO: 309820 - protein, 9 aa, Influenza virus
AVAVLKYNG

SEQ ID NO: 309821 - protein, 9 aa, Influenza virus
VAVLKYNGI

SEQ ID NO: 309822 - protein, 9 aa, Influenza virus
AVLKYNGII

SEQ ID NO: 309823 - protein, 9 aa, Influenza virus
VLKYNGIIT

SEQ ID NO: 309824 - protein, 9 aa, Influenza virus
LKYNGIITD

SEQ ID NO: 309825 - protein, 9 aa, Influenza virus
KYNGIITDT

SEQ ID NO: 309826 - protein, 9 aa, Influenza virus
YNGIITDTL

SEQ ID NO: 309827 - protein, 9 aa, Influenza virus
NGIITDTLK

SEQ ID NO: 309828 - protein, 9 aa, Influenza virus
GIITDTLKS

SEQ ID NO: 309829 - protein, 9 aa, Influenza virus
IITDTLKSW

SEQ ID NO: 309830 - protein, 9 aa, Influenza virus
ITDTLKSWK

SEQ ID NO: 309831 - protein, 9 aa, Influenza virus
TDTLKSWKG

SEQ ID NO: 309832 - protein, 9 aa, Influenza virus
DTLKSWKGN

SEQ ID NO: 309833 - protein, 9 aa, Influenza virus
TLKSWKGNI

SEQ ID NO: 309834 - protein, 9 aa, Influenza virus
LKSWKGNIM

SEQ ID NO: 309835 - protein, 9 aa, Influenza virus
KSWKGNIMR

SEQ ID NO: 309836 - protein, 9 aa, Influenza virus
SWKGNIMRT

SEQ ID NO: 309837 - protein, 9 aa, Influenza virus
WKGNIMRTQ

SEQ ID NO: 309838 - protein, 9 aa, Influenza virus
KGNIMRTQE

SEQ ID NO: 309839 - protein, 9 aa, Influenza virus
GNIMRTQES

SEQ ID NO: 309840 - protein, 9 aa, Influenza virus
NIMRTQESE

SEQ ID NO: 309841 - protein, 9 aa, Influenza virus
IMRTQESEC

SEQ ID NO: 309842 - protein, 9 aa, Influenza virus
MRTQESECV

SEQ ID NO: 309843 - protein, 9 aa, Influenza virus
RTQESECVC

SEQ ID NO: 309844 - protein, 9 aa, Influenza virus
TQESECVCQ

SEQ ID NO: 309845 - protein, 9 aa, Influenza virus
QESECVCQD

SEQ ID NO: 309846 - protein, 9 aa, Influenza virus
ESECVCQDE

SEQ ID NO: 309847 - protein, 9 aa, Influenza virus
SECVCQDEF

SEQ ID NO: 309848 - protein, 9 aa, Influenza virus
ECVCQDEFC

SEQ ID NO: 309849 - protein, 9 aa, Influenza virus
CVCQDEFCY

SEQ ID NO: 309850 - protein, 9 aa, Influenza virus
VCQDEFCYT

SEQ ID NO: 309851 - protein, 9 aa, Influenza virus
CQDEFCYTL

SEQ ID NO: 309852 - protein, 9 aa, Influenza virus
QDEFCYTLI

SEQ ID NO: 309853 - protein, 9 aa, Influenza virus
DEFCYTLIT

SEQ ID NO: 309854 - protein, 9 aa, Influenza virus
EFCYTLITD

SEQ ID NO: 309855 - protein, 9 aa, Influenza virus
FCYTLITDG

SEQ ID NO: 309856 - protein, 9 aa, Influenza virus
CYTLITDGP

SEQ ID NO: 309857 - protein, 9 aa, Influenza virus
YTLITDGPS

SEQ ID NO: 309858 - protein, 9 aa, Influenza virus
TLITDGPSD

SEQ ID NO: 309859 - protein, 9 aa, Influenza virus
LITDGPSDA

SEQ ID NO: 309860 - protein, 9 aa, Influenza virus
ITDGPSDAQ

SEQ ID NO: 309861 - protein, 9 aa, Influenza virus
TDGPSDAQA

SEQ ID NO: 309862 - protein, 9 aa, Influenza virus
DGPSDAQAF

SEQ ID NO: 309863 - protein, 9 aa, Influenza virus
GPSDAQAFY

SEQ ID NO: 309864 - protein, 9 aa, Influenza virus
PSDAQAFYK

SEQ ID NO: 309865 - protein, 9 aa, Influenza virus
SDAQAFYKI

SEQ ID NO: 309866 - protein, 9 aa, Influenza virus
DAQAFYKIL

SEQ ID NO: 309867 - protein, 9 aa, Influenza virus
AQAFYKILK

SEQ ID NO: 309868 - protein, 9 aa, Influenza virus
QAFYKILKI

SEQ ID NO: 309869 - protein, 9 aa, Influenza virus
AFYKILKIR

SEQ ID NO: 309870 - protein, 9 aa, Influenza virus
FYKILKIRK

SEQ ID NO: 309871 - protein, 9 aa, Influenza virus
YKILKIRKG

SEQ ID NO: 309872 - protein, 9 aa, Influenza virus
KILKIRKGK

SEQ ID NO: 309873 - protein, 9 aa, Influenza virus
ILKIRKGKI

SEQ ID NO: 309874 - protein, 9 aa, Influenza virus
LKIRKGKIV

SEQ ID NO: 309875 - protein, 9 aa, Influenza virus
ATGFHFEEC

SEQ ID NO: 309876 - protein, 9 aa, Influenza virus
TGFHFEECS

SEQ ID NO: 309877 - protein, 9 aa, Influenza virus
GFHFEECSC

SEQ ID NO: 309878 - protein, 9 aa, Influenza virus
FHFEECSCY

SEQ ID NO: 309879 - protein, 9 aa, Influenza virus
HFEECSCYP

SEQ ID NO: 309880 - protein, 9 aa, Influenza virus
FEECSCYPS

SEQ ID NO: 309881 - protein, 9 aa, Influenza virus
EECSCYPSG

SEQ ID NO: 309882 - protein, 9 aa, Influenza virus
ECSCYPSGT

SEQ ID NO: 309883 - protein, 9 aa, Influenza virus
CSCYPSGTD

SEQ ID NO: 309884 - protein, 9 aa, Influenza virus
DIECVCRDN

SEQ ID NO: 309885 - protein, 9 aa, Influenza virus
IECVCRDNW

SEQ ID NO: 309886 - protein, 9 aa, Influenza virus
ECVCRDNWR

SEQ ID NO: 309887 - protein, 9 aa, Influenza virus
CVCRDNWRG

SEQ ID NO: 309888 - protein, 9 aa, Influenza virus
VCRDNWRGS

SEQ ID NO: 309889 - protein, 9 aa, Influenza virus
CRDNWRGSN

SEQ ID NO: 309890 - protein, 9 aa, Influenza virus
RDNWRGSNR

SEQ ID NO: 309891 - protein, 9 aa, Influenza virus
DNWRGSNRP

SEQ ID NO: 309892 - protein, 9 aa, Influenza virus
NWRGSNRPW

SEQ ID NO: 309893 - protein, 9 aa, Influenza virus
WRGSNRPWI

SEQ ID NO: 309894 - protein, 9 aa, Influenza virus
RGSNRPWIR

SEQ ID NO: 309895 - protein, 9 aa, Influenza virus
GSNRPWIRF

SEQ ID NO: 309896 - protein, 9 aa, Influenza virus
SNRPWIRFN

SEQ ID NO: 309897 - protein, 9 aa, Influenza virus
NRPWIRFNS

SEQ ID NO: 309898 - protein, 9 aa, Influenza virus
RPWIRFNSD

SEQ ID NO: 309899 - protein, 9 aa, Influenza virus
PWIRFNSDL

SEQ ID NO: 309900 - protein, 9 aa, Influenza virus
WIRFNSDLD

SEQ ID NO: 309901 - protein, 9 aa, Influenza virus
IRFNSDLDY

SEQ ID NO: 309902 - protein, 9 aa, Influenza virus
RFNSDLDYQ

SEQ ID NO: 309903 - protein, 9 aa, Influenza virus
FNSDLDYQI

SEQ ID NO: 309904 - protein, 9 aa, Influenza virus
NSDLDYQIG

SEQ ID NO: 309905 - protein, 9 aa, Influenza virus
SDLDYQIGY

SEQ ID NO: 309906 - protein, 9 aa, Influenza virus
DLDYQIGYV

SEQ ID NO: 309907 - protein, 9 aa, Influenza virus
LDYQIGYVC

SEQ ID NO: 309908 - protein, 9 aa, Influenza virus
DYQIGYVCS

SEQ ID NO: 309909 - protein, 9 aa, Influenza virus
YQIGYVCSG

SEQ ID NO: 309910 - protein, 9 aa, Influenza virus
QIGYVCSGI

SEQ ID NO: 309911 - protein, 9 aa, Influenza virus
IGYVCSGIF

SEQ ID NO: 309912 - protein, 9 aa, Influenza virus
GYVCSGIFG

SEQ ID NO: 309913 - protein, 9 aa, Influenza virus
YVCSGIFGD

SEQ ID NO: 309914 - protein, 9 aa, Influenza virus
VCSGIFGDN

SEQ ID NO: 309915 - protein, 9 aa, Influenza virus
CSGIFGDNP

SEQ ID NO: 309916 - protein, 9 aa, Influenza virus
SGIFGDNPR

SEQ ID NO: 309917 - protein, 9 aa, Influenza virus
GIFGDNPRP

SEQ ID NO: 309918 - protein, 9 aa, Influenza virus
FGDNPRPVD

SEQ ID NO: 309919 - protein, 9 aa, Influenza virus
GDNPRPVDG

SEQ ID NO: 309920 - protein, 9 aa, Influenza virus
PRPVDGTGS

SEQ ID NO: 309921 - protein, 9 aa, Influenza virus
RPVDGTGSC

SEQ ID NO: 309922 - protein, 9 aa, Influenza virus
SPVNNGKGR

SEQ ID NO: 309923 - protein, 9 aa, Influenza virus
PVNNGKGRY

SEQ ID NO: 309924 - protein, 9 aa, Influenza virus
VNNGKGRYG

SEQ ID NO: 309925 - protein, 9 aa, Influenza virus
NNGKGRYGV

SEQ ID NO: 309926 - protein, 9 aa, Influenza virus
NGKGRYGVK

SEQ ID NO: 309927 - protein, 9 aa, Influenza virus
GKGRYGVKG

SEQ ID NO: 309928 - protein, 9 aa, Influenza virus
KGRYGVKGF

SEQ ID NO: 309929 - protein, 9 aa, Influenza virus
GRYGVKGFS

SEQ ID NO: 309930 - protein, 9 aa, Influenza virus
RYGVKGFSF

SEQ ID NO: 309931 - protein, 9 aa, Influenza virus
YGVKGFSFR

SEQ ID NO: 309932 - protein, 9 aa, Influenza virus
GVKGFSFRY

SEQ ID NO: 309933 - protein, 9 aa, Influenza virus
VKGFSFRYG

SEQ ID NO: 309934 - protein, 9 aa, Influenza virus
KGFSFRYGD

SEQ ID NO: 309935 - protein, 9 aa, Influenza virus
GFSFRYGDG

SEQ ID NO: 309936 - protein, 9 aa, Influenza virus
FSFRYGDGV

SEQ ID NO: 309937 - protein, 9 aa, Influenza virus
SFRYGDGVW

SEQ ID NO: 309938 - protein, 9 aa, Influenza virus
FRYGDGVWI

SEQ ID NO: 309939 - protein, 9 aa, Influenza virus
RYGDGVWIG

SEQ ID NO: 309940 - protein, 9 aa, Influenza virus
YGDGVWIGR

SEQ ID NO: 309941 - protein, 9 aa, Influenza virus
GDGVWIGRT

SEQ ID NO: 309942 - protein, 9 aa, Influenza virus
DGVWIGRTK

SEQ ID NO: 309943 - protein, 9 aa, Influenza virus
GVWIGRTKS

SEQ ID NO: 309944 - protein, 9 aa, Influenza virus
VWIGRTKSL

SEQ ID NO: 309945 - protein, 9 aa, Influenza virus
WIGRTKSLE

SEQ ID NO: 309946 - protein, 9 aa, Influenza virus
IGRTKSLES

SEQ ID NO: 309947 - protein, 9 aa, Influenza virus
GRTKSLESR

SEQ ID NO: 309948 - protein, 9 aa, Influenza virus
RTKSLESRS

SEQ ID NO: 309949 - protein, 9 aa, Influenza virus
TKSLESRSG

SEQ ID NO: 309950 - protein, 9 aa, Influenza virus
KSLESRSGF

SEQ ID NO: 309951 - protein, 9 aa, Influenza virus
SLESRSGFE

SEQ ID NO: 309952 - protein, 9 aa, Influenza virus
LESRSGFEM

SEQ ID NO: 309953 - protein, 9 aa, Influenza virus
ESRSGFEMV

SEQ ID NO: 309954 - protein, 9 aa, Influenza virus
SRSGFEMVW

SEQ ID NO: 309955 - protein, 9 aa, Influenza virus
RSGFEMVWD

SEQ ID NO: 309956 - protein, 9 aa, Influenza virus
SGFEMVWDA

SEQ ID NO: 309957 - protein, 9 aa, Influenza virus
GFEMVWDAN

SEQ ID NO: 309958 - protein, 9 aa, Influenza virus
FEMVWDANG

SEQ ID NO: 309959 - protein, 9 aa, Influenza virus
EMVWDANGW

SEQ ID NO: 309960 - protein, 9 aa, Influenza virus
MVWDANGWV

SEQ ID NO: 309961 - protein, 9 aa, Influenza virus
VWDANGWVS

SEQ ID NO: 309962 - protein, 9 aa, Influenza virus
WDANGWVST

SEQ ID NO: 309963 - protein, 9 aa, Influenza virus
DANGWVSTD

SEQ ID NO: 309964 - protein, 9 aa, Influenza virus
ANGWVSTDK

SEQ ID NO: 309965 - protein, 9 aa, Influenza virus
NGWVSTDKD

SEQ ID NO: 309966 - protein, 9 aa, Influenza virus
GWVSTDKDS

SEQ ID NO: 309967 - protein, 9 aa, Influenza virus
WVSTDKDSN

SEQ ID NO: 309968 - protein, 9 aa, Influenza virus
VSTDKDSNG

SEQ ID NO: 309969 - protein, 9 aa, Influenza virus
STDKDSNGV

SEQ ID NO: 309970 - protein, 9 aa, Influenza virus
TDKDSNGVQ

SEQ ID NO: 309971 - protein, 9 aa, Influenza virus
DKDSNGVQD

SEQ ID NO: 309972 - protein, 9 aa, Influenza virus
KDSNGVQDI

SEQ ID NO: 309973 - protein, 9 aa, Influenza virus
DSNGVQDII

SEQ ID NO: 309974 - protein, 9 aa, Influenza virus
SNGVQDIID

SEQ ID NO: 309975 - protein, 9 aa, Influenza virus
NGVQDIIDN

SEQ ID NO: 309976 - protein, 9 aa, Influenza virus
GVQDIIDND

SEQ ID NO: 309977 - protein, 9 aa, Influenza virus
VQDIIDNDN

SEQ ID NO: 309978 - protein, 9 aa, Influenza virus
QDIIDNDNW

SEQ ID NO: 309979 - protein, 9 aa, Influenza virus
DIIDNDNWS

SEQ ID NO: 309980 - protein, 9 aa, Influenza virus
IIDNDNWSG

SEQ ID NO: 309981 - protein, 9 aa, Influenza virus
IDNDNWSGY

SEQ ID NO: 309982 - protein, 9 aa, Influenza virus
DNDNWSGYS

SEQ ID NO: 309983 - protein, 9 aa, Influenza virus
NDNWSGYSG

SEQ ID NO: 309984 - protein, 9 aa, Influenza virus
DNWSGYSGS

SEQ ID NO: 309985 - protein, 9 aa, Influenza virus
NWSGYSGSF

SEQ ID NO: 309986 - protein, 9 aa, Influenza virus
WSGYSGSFS

SEQ ID NO: 309987 - protein, 9 aa, Influenza virus
SGYSGSFSI

SEQ ID NO: 309988 - protein, 9 aa, Influenza virus
GYSGSFSIR

SEQ ID NO: 309989 - protein, 9 aa, Influenza virus
YSGSFSIRG

SEQ ID NO: 309990 - protein, 9 aa, Influenza virus
SGSFSIRGE

SEQ ID NO: 309991 - protein, 9 aa, Influenza virus
GSFSIRGET

SEQ ID NO: 309992 - protein, 9 aa, Influenza virus
SFSIRGETT

SEQ ID NO: 309993 - protein, 9 aa, Influenza virus
FSIRGETTG

SEQ ID NO: 309994 - protein, 9 aa, Influenza virus
SIRGETTGR

SEQ ID NO: 309995 - protein, 9 aa, Influenza virus
IRGETTGRN

SEQ ID NO: 309996 - protein, 9 aa, Influenza virus
RGETTGRNC

SEQ ID NO: 309997 - protein, 9 aa, Influenza virus
GETTGRNCT

SEQ ID NO: 309998 - protein, 9 aa, Influenza virus
ETTGRNCTV

SEQ ID NO: 309999 - protein, 9 aa, Influenza virus
TTGRNCTVP

SEQ ID NO: 310000 - protein, 9 aa, Influenza virus
TGRNCTVPC

SEQ ID NO: 310001 - protein, 9 aa, Influenza virus
GRNCTVPCF

SEQ ID NO: 310002 - protein, 9 aa, Influenza virus
RNCTVPCFW

SEQ ID NO: 310003 - protein, 9 aa, Influenza virus
NCTVPCFWV

SEQ ID NO: 310004 - protein, 9 aa, Influenza virus
CTVPCFWVE

SEQ ID NO: 310005 - protein, 9 aa, Influenza virus
TVPCFWVEM

SEQ ID NO: 310006 - protein, 9 aa, Influenza virus
VPCFWVEMI

SEQ ID NO: 310007 - protein, 9 aa, Influenza virus
PCFWVEMIR

SEQ ID NO: 310008 - protein, 9 aa, Influenza virus
CFWVEMIRG

SEQ ID NO: 310009 - protein, 9 aa, Influenza virus
FWVEMIRGQ

SEQ ID NO: 310010 - protein, 9 aa, Influenza virus
WVEMIRGQP

SEQ ID NO: 310011 - protein, 9 aa, Influenza virus
VEMIRGQPK

SEQ ID NO: 310012 - protein, 9 aa, Influenza virus
EMIRGQPKE

SEQ ID NO: 310013 - protein, 9 aa, Influenza virus
MIRGQPKEK

SEQ ID NO: 310014 - protein, 9 aa, Influenza virus
IRGQPKEKT

SEQ ID NO: 310015 - protein, 9 aa, Influenza virus
RGQPKEKTI

SEQ ID NO: 310016 - protein, 9 aa, Influenza virus
GQPKEKTIW

SEQ ID NO: 310017 - protein, 9 aa, Influenza virus
QPKEKTIWT

SEQ ID NO: 310018 - protein, 9 aa, Influenza virus
PKEKTIWTS

SEQ ID NO: 310019 - protein, 9 aa, Influenza virus
KEKTIWTSG

SEQ ID NO: 310020 - protein, 9 aa, Influenza virus
EKTIWTSGS

SEQ ID NO: 310021 - protein, 9 aa, Influenza virus
KTIWTSGSS

SEQ ID NO: 310022 - protein, 9 aa, Influenza virus
TIWTSGSSI

SEQ ID NO: 310023 - protein, 9 aa, Influenza virus
IWTSGSSIA

SEQ ID NO: 310024 - protein, 9 aa, Influenza virus
WTSGSSIAF

SEQ ID NO: 310025 - protein, 9 aa, Influenza virus
TSGSSIAFC

SEQ ID NO: 310026 - protein, 9 aa, Influenza virus
SGSSIAFCG

SEQ ID NO: 310027 - protein, 9 aa, Influenza virus
GSSIAFCGV

SEQ ID NO: 310028 - protein, 9 aa, Influenza virus
SSIAFCGVN

SEQ ID NO: 310029 - protein, 9 aa, Influenza virus
SIAFCGVNS

SEQ ID NO: 310030 - protein, 9 aa, Influenza virus
IAFCGVNSD

SEQ ID NO: 310031 - protein, 9 aa, Influenza virus
AFCGVNSDT

SEQ ID NO: 310032 - protein, 9 aa, Influenza virus
FCGVNSDTT

SEQ ID NO: 310033 - protein, 9 aa, Influenza virus
CGVNSDTTG

SEQ ID NO: 310034 - protein, 9 aa, Influenza virus
GVNSDTTGW

SEQ ID NO: 310035 - protein, 9 aa, Influenza virus
SDTTGWSWP

SEQ ID NO: 310036 - protein, 9 aa, Influenza virus
DTTGWSWPD

SEQ ID NO: 310037 - protein, 9 aa, Influenza virus
TTGWSWPDG

SEQ ID NO: 310038 - protein, 9 aa, Influenza virus
TGWSWPDGA

SEQ ID NO: 310039 - protein, 9 aa, Influenza virus
GWSWPDGAL

SEQ ID NO: 310040 - protein, 9 aa, Influenza virus
WSWPDGALL

SEQ ID NO: 310041 - protein, 9 aa, Influenza virus
SWPDGALLP

SEQ ID NO: 310042 - protein, 9 aa, Influenza virus
WPDGALLPF

SEQ ID NO: 310043 - protein, 9 aa, Influenza virus
PDGALLPFD

SEQ ID NO: 310044 - protein, 9 aa, Influenza virus
DGALLPFDI

SEQ ID NO: 310045 - protein, 9 aa, Influenza virus
GALLPFDID

SEQ ID NO: 310046 - protein, 9 aa, Influenza virus
ALLPFDIDK

SEQ ID NO: 310047 - protein, 9 aa, Influenza virus
MNPNQKIIT

SEQ ID NO: 310048 - protein, 9 aa, Influenza virus
NPNQKIITI

SEQ ID NO: 310049 - protein, 9 aa, Influenza virus
PNQKIITIG

SEQ ID NO: 310050 - protein, 9 aa, Influenza virus
NQKIITIGS

SEQ ID NO: 310051 - protein, 9 aa, Influenza virus
QKIITIGSV

SEQ ID NO: 310052 - protein, 9 aa, Influenza virus
KIITIGSVS

SEQ ID NO: 310053 - protein, 9 aa, Influenza virus
IITIGSVSL

SEQ ID NO: 310054 - protein, 9 aa, Influenza virus
TIGSVSLAL

SEQ ID NO: 310055 - protein, 9 aa, Influenza virus
NILLHIASI

SEQ ID NO: 310056 - protein, 9 aa, Influenza virus
TTEVYNETV

SEQ ID NO: 310057 - protein, 9 aa, Influenza virus
TEVYNETVR

SEQ ID NO: 310058 - protein, 9 aa, Influenza virus
EIYNETVRL

SEQ ID NO: 310059 - protein, 9 aa, Influenza virus
IYNETVRLE

SEQ ID NO: 310060 - protein, 9 aa, Influenza virus
YNETVRLET

SEQ ID NO: 310061 - protein, 9 aa, Influenza virus
TIPINNTVY

SEQ ID NO: 310062 - protein, 9 aa, Influenza virus
EFLNNTEPL

SEQ ID NO: 310063 - protein, 9 aa, Influenza virus
FLNNTEPLC

SEQ ID NO: 310064 - protein, 9 aa, Influenza virus
LNNTEPLCN

SEQ ID NO: 310065 - protein, 9 aa, Influenza virus
NNTEPLCNV

SEQ ID NO: 310066 - protein, 9 aa, Influenza virus
NTEPLCNVS

SEQ ID NO: 310067 - protein, 9 aa, Influenza virus
TEPLCNVSG

SEQ ID NO: 310068 - protein, 9 aa, Influenza virus
EPLCNVSGF

SEQ ID NO: 310069 - protein, 9 aa, Influenza virus
PLCNVSGFA

SEQ ID NO: 310070 - protein, 9 aa, Influenza virus
LCNVSGFAI

SEQ ID NO: 310071 - protein, 9 aa, Influenza virus
SGFAIVSKD

SEQ ID NO: 310072 - protein, 9 aa, Influenza virus
GFAIVSKDN

SEQ ID NO: 310073 - protein, 9 aa, Influenza virus
FAIVSKDNG

SEQ ID NO: 310074 - protein, 9 aa, Influenza virus
AIVSKDNGI

SEQ ID NO: 310075 - protein, 9 aa, Influenza virus
IVSKDNGIR

SEQ ID NO: 310076 - protein, 9 aa, Influenza virus
VSKDNGIRI

SEQ ID NO: 310077 - protein, 9 aa, Influenza virus
SKDNGIRIG

SEQ ID NO: 310078 - protein, 9 aa, Influenza virus
KDNGIRIGS

SEQ ID NO: 310079 - protein, 9 aa, Influenza virus
DNGIRIGSR

SEQ ID NO: 310080 - protein, 9 aa, Influenza virus
NGIRIGSRG

SEQ ID NO: 310081 - protein, 9 aa, Influenza virus
GIRIGSRGH

SEQ ID NO: 310082 - protein, 9 aa, Influenza virus
IRIGSRGHV

SEQ ID NO: 310083 - protein, 9 aa, Influenza virus
RIGSRGHVF

SEQ ID NO: 310084 - protein, 9 aa, Influenza virus
IGSRGHVFV

SEQ ID NO: 310085 - protein, 9 aa, Influenza virus
GSRGHVFVI

SEQ ID NO: 310086 - protein, 9 aa, Influenza virus
SRGHVFVIR

SEQ ID NO: 310087 - protein, 9 aa, Influenza virus
RGHVFVIRE

SEQ ID NO: 310088 - protein, 9 aa, Influenza virus
GHVFVIREP

SEQ ID NO: 310089 - protein, 9 aa, Influenza virus
HVFVIREPF

SEQ ID NO: 310090 - protein, 9 aa, Influenza virus
VFVIREPFV

SEQ ID NO: 310091 - protein, 9 aa, Influenza virus
FVIREPFVA

SEQ ID NO: 310092 - protein, 9 aa, Influenza virus
VIREPFVAC

SEQ ID NO: 310093 - protein, 9 aa, Influenza virus
IREPFVACG

SEQ ID NO: 310094 - protein, 9 aa, Influenza virus
REPFVACGP

SEQ ID NO: 310095 - protein, 9 aa, Influenza virus
EPFVACGPT

SEQ ID NO: 310096 - protein, 9 aa, Influenza virus
PFVACGPTE

SEQ ID NO: 310097 - protein, 9 aa, Influenza virus
FVACGPTEC

SEQ ID NO: 310098 - protein, 9 aa, Influenza virus
VACGPTECR

SEQ ID NO: 310099 - protein, 9 aa, Influenza virus
ACGPTECRT

SEQ ID NO: 310100 - protein, 9 aa, Influenza virus
CGPTECRTF

SEQ ID NO: 310101 - protein, 9 aa, Influenza virus
GPTECRTFF

SEQ ID NO: 310102 - protein, 9 aa, Influenza virus
PTECRTFFL

SEQ ID NO: 310103 - protein, 9 aa, Influenza virus
TECRTFFLT

SEQ ID NO: 310104 - protein, 9 aa, Influenza virus
ECRTFFLTQ

SEQ ID NO: 310105 - protein, 9 aa, Influenza virus
CRTFFLTQG

SEQ ID NO: 310106 - protein, 9 aa, Influenza virus
RTFFLTQGA

SEQ ID NO: 310107 - protein, 9 aa, Influenza virus
TFFLTQGAL

SEQ ID NO: 310108 - protein, 9 aa, Influenza virus
FFLTQGALL

SEQ ID NO: 310109 - protein, 9 aa, Influenza virus
FLTQGALLN

SEQ ID NO: 310110 - protein, 9 aa, Influenza virus
LTQGALLND

SEQ ID NO: 310111 - protein, 9 aa, Influenza virus
TQGALLNDK

SEQ ID NO: 310112 - protein, 9 aa, Influenza virus
QGALLNDKH

SEQ ID NO: 310113 - protein, 9 aa, Influenza virus
GALLNDKHS

SEQ ID NO: 310114 - protein, 9 aa, Influenza virus
ALLNDKHSN

SEQ ID NO: 310115 - protein, 9 aa, Influenza virus
LLNDKHSNN

SEQ ID NO: 310116 - protein, 9 aa, Influenza virus
LNDKHSNNT

SEQ ID NO: 310117 - protein, 9 aa, Influenza virus
NDKHSNNTV

SEQ ID NO: 310118 - protein, 9 aa, Influenza virus
DKHSNNTVK

SEQ ID NO: 310119 - protein, 9 aa, Influenza virus
KHSNNTVKD

SEQ ID NO: 310120 - protein, 9 aa, Influenza virus
HSNNTVKDR

SEQ ID NO: 310121 - protein, 9 aa, Influenza virus
SNNTVKDRS

SEQ ID NO: 310122 - protein, 9 aa, Influenza virus
NNTVKDRSP

SEQ ID NO: 310123 - protein, 9 aa, Influenza virus
NTVKDRSPY

SEQ ID NO: 310124 - protein, 9 aa, Influenza virus
TVKDRSPYR

SEQ ID NO: 310125 - protein, 9 aa, Influenza virus
VKDRSPYRA

SEQ ID NO: 310126 - protein, 9 aa, Influenza virus
KDRSPYRAL

SEQ ID NO: 310127 - protein, 9 aa, Influenza virus
DRSPYRALM

SEQ ID NO: 310128 - protein, 9 aa, Influenza virus
RSPYRALMS

SEQ ID NO: 310129 - protein, 9 aa, Influenza virus
SPYRALMSV

SEQ ID NO: 310130 - protein, 9 aa, Influenza virus
PYRALMSVP

SEQ ID NO: 310131 - protein, 9 aa, Influenza virus
YRALMSVPL

SEQ ID NO: 310132 - protein, 9 aa, Influenza virus
RALMSVPLG

SEQ ID NO: 310133 - protein, 9 aa, Influenza virus
ALMSVPLGS

SEQ ID NO: 310134 - protein, 9 aa, Influenza virus
LMSVPLGSS

SEQ ID NO: 310135 - protein, 9 aa, Influenza virus
MSVPLGSSP

SEQ ID NO: 310136 - protein, 9 aa, Influenza virus
SVPLGSSPN

SEQ ID NO: 310137 - protein, 9 aa, Influenza virus
VPLGSSPNA

SEQ ID NO: 310138 - protein, 9 aa, Influenza virus
PLGSSPNAY

SEQ ID NO: 310139 - protein, 9 aa, Influenza virus
LGSSPNAYQ

SEQ ID NO: 310140 - protein, 9 aa, Influenza virus
GSSPNAYQA

SEQ ID NO: 310141 - protein, 9 aa, Influenza virus
SSPNAYQAK

SEQ ID NO: 310142 - protein, 9 aa, Influenza virus
SPNAYQAKF

SEQ ID NO: 310143 - protein, 9 aa, Influenza virus
PNAYQAKFE

SEQ ID NO: 310144 - protein, 9 aa, Influenza virus
NAYQAKFES

SEQ ID NO: 310145 - protein, 9 aa, Influenza virus
AYQAKFESV

SEQ ID NO: 310146 - protein, 9 aa, Influenza virus
FESVAWSAT

SEQ ID NO: 310147 - protein, 9 aa, Influenza virus
ESVAWSATA

SEQ ID NO: 310148 - protein, 9 aa, Influenza virus
SVAWSATAC

SEQ ID NO: 310149 - protein, 9 aa, Influenza virus
VAWSATACH

SEQ ID NO: 310150 - protein, 9 aa, Influenza virus
AWSATACHD

SEQ ID NO: 310151 - protein, 9 aa, Influenza virus
WSATACHDG

SEQ ID NO: 310152 - protein, 9 aa, Influenza virus
SATACHDGK

SEQ ID NO: 310153 - protein, 9 aa, Influenza virus
ATACHDGKE

SEQ ID NO: 310154 - protein, 9 aa, Influenza virus
TACHDGKEW

SEQ ID NO: 310155 - protein, 9 aa, Influenza virus
ACHDGKEWL

SEQ ID NO: 310156 - protein, 9 aa, Influenza virus
GISGADDDA

SEQ ID NO: 310157 - protein, 9 aa, Influenza virus
ISGADDDAY

SEQ ID NO: 310158 - protein, 9 aa, Influenza virus
SGADDDAYA

SEQ ID NO: 310159 - protein, 9 aa, Influenza virus
GADDDAYAV

SEQ ID NO: 310160 - protein, 9 aa, Influenza virus
ADDDAYAVI

SEQ ID NO: 310161 - protein, 9 aa, Influenza virus
DDDAYAVIH

SEQ ID NO: 310162 - protein, 9 aa, Influenza virus
DDAYAVIHY

SEQ ID NO: 310163 - protein, 9 aa, Influenza virus
DAYAVIHYG

SEQ ID NO: 310164 - protein, 9 aa, Influenza virus
AYAVIHYGG

SEQ ID NO: 310165 - protein, 9 aa, Influenza virus
YAVIHYGGM

SEQ ID NO: 310166 - protein, 9 aa, Influenza virus
AVIHYGGMP

SEQ ID NO: 310167 - protein, 9 aa, Influenza virus
VIHYGGMPT

SEQ ID NO: 310168 - protein, 9 aa, Influenza virus
IHYGGMPTD

SEQ ID NO: 310169 - protein, 9 aa, Influenza virus
HYGGMPTDV

SEQ ID NO: 310170 - protein, 9 aa, Influenza virus
YGGMPTDVV

SEQ ID NO: 310171 - protein, 9 aa, Influenza virus
GGMPTDVVR

SEQ ID NO: 310172 - protein, 9 aa, Influenza virus
GMPTDVVRS

SEQ ID NO: 310173 - protein, 9 aa, Influenza virus
MPTDVVRSW

SEQ ID NO: 310174 - protein, 9 aa, Influenza virus
PTDVVRSWR

SEQ ID NO: 310175 - protein, 9 aa, Influenza virus
TDVVRSWRK

SEQ ID NO: 310176 - protein, 9 aa, Influenza virus
DVVRSWRKQ

SEQ ID NO: 310177 - protein, 9 aa, Influenza virus
VVRSWRKQI

SEQ ID NO: 310178 - protein, 9 aa, Influenza virus
VRSWRKQIL

SEQ ID NO: 310179 - protein, 9 aa, Influenza virus
RSWRKQILR

SEQ ID NO: 310180 - protein, 9 aa, Influenza virus
SWRKQILRT

SEQ ID NO: 310181 - protein, 9 aa, Influenza virus
WRKQILRTQ

SEQ ID NO: 310182 - protein, 9 aa, Influenza virus
RKQILRTQE

SEQ ID NO: 310183 - protein, 9 aa, Influenza virus
KQILRTQES

SEQ ID NO: 310184 - protein, 9 aa, Influenza virus
QILRTQESS

SEQ ID NO: 310185 - protein, 9 aa, Influenza virus
ILRTQESSC

SEQ ID NO: 310186 - protein, 9 aa, Influenza virus
LRTQESSCV

SEQ ID NO: 310187 - protein, 9 aa, Influenza virus
RTQESSCVC

SEQ ID NO: 310188 - protein, 9 aa, Influenza virus
TQESSCVCM

SEQ ID NO: 310189 - protein, 9 aa, Influenza virus
QESSCVCMK

SEQ ID NO: 310190 - protein, 9 aa, Influenza virus
ESSCVCMKG

SEQ ID NO: 310191 - protein, 9 aa, Influenza virus
CYWVMTDGP

SEQ ID NO: 310192 - protein, 9 aa, Influenza virus
YWVMTDGPA

SEQ ID NO: 310193 - protein, 9 aa, Influenza virus
WVMTDGPAN

SEQ ID NO: 310194 - protein, 9 aa, Influenza virus
VMTDGPANN

SEQ ID NO: 310195 - protein, 9 aa, Influenza virus
MTDGPANNQ

SEQ ID NO: 310196 - protein, 9 aa, Influenza virus
TDGPANNQA

SEQ ID NO: 310197 - protein, 9 aa, Influenza virus
DGPANNQAS

SEQ ID NO: 310198 - protein, 9 aa, Influenza virus
GPANNQASY

SEQ ID NO: 310199 - protein, 9 aa, Influenza virus
PANNQASYK

SEQ ID NO: 310200 - protein, 9 aa, Influenza virus
ANNQASYKI

SEQ ID NO: 310201 - protein, 9 aa, Influenza virus
NNQASYKIF

SEQ ID NO: 310202 - protein, 9 aa, Influenza virus
NQASYKIFK

SEQ ID NO: 310203 - protein, 9 aa, Influenza virus
QASYKIFKS

SEQ ID NO: 310204 - protein, 9 aa, Influenza virus
ASYKIFKSH

SEQ ID NO: 310205 - protein, 9 aa, Influenza virus
EVSFQGGHI

SEQ ID NO: 310206 - protein, 9 aa, Influenza virus
VSFQGGHIE

SEQ ID NO: 310207 - protein, 9 aa, Influenza virus
SFQGGHIEE

SEQ ID NO: 310208 - protein, 9 aa, Influenza virus
FQGGHIEEC

SEQ ID NO: 310209 - protein, 9 aa, Influenza virus
QGGHIEECS

SEQ ID NO: 310210 - protein, 9 aa, Influenza virus
GGHIEECSC

SEQ ID NO: 310211 - protein, 9 aa, Influenza virus
GHIEECSCY

SEQ ID NO: 310212 - protein, 9 aa, Influenza virus
HIEECSCYP

SEQ ID NO: 310213 - protein, 9 aa, Influenza virus
IEECSCYPN

SEQ ID NO: 310214 - protein, 9 aa, Influenza virus
EECSCYPNL

SEQ ID NO: 310215 - protein, 9 aa, Influenza virus
ECSCYPNLG

SEQ ID NO: 310216 - protein, 9 aa, Influenza virus
CSCYPNLGK

SEQ ID NO: 310217 - protein, 9 aa, Influenza virus
SCYPNLGKV

SEQ ID NO: 310218 - protein, 9 aa, Influenza virus
CYPNLGKVE

SEQ ID NO: 310219 - protein, 9 aa, Influenza virus
YPNLGKVEC

SEQ ID NO: 310220 - protein, 9 aa, Influenza virus
PNLGKVECV

SEQ ID NO: 310221 - protein, 9 aa, Influenza virus
NLGKVECVC

SEQ ID NO: 310222 - protein, 9 aa, Influenza virus
LGKVECVCR

SEQ ID NO: 310223 - protein, 9 aa, Influenza virus
GKVECVCRD

SEQ ID NO: 310224 - protein, 9 aa, Influenza virus
KVECVCRDN

SEQ ID NO: 310225 - protein, 9 aa, Influenza virus
VECVCRDNW

SEQ ID NO: 310226 - protein, 9 aa, Influenza virus
ECVCRDNWN

SEQ ID NO: 310227 - protein, 9 aa, Influenza virus
CVCRDNWNG

SEQ ID NO: 310228 - protein, 9 aa, Influenza virus
VCRDNWNGM

SEQ ID NO: 310229 - protein, 9 aa, Influenza virus
CRDNWNGMN

SEQ ID NO: 310230 - protein, 9 aa, Influenza virus
RDNWNGMNR

SEQ ID NO: 310231 - protein, 9 aa, Influenza virus
DNWNGMNRP

SEQ ID NO: 310232 - protein, 9 aa, Influenza virus
NWNGMNRPI

SEQ ID NO: 310233 - protein, 9 aa, Influenza virus
WNGMNRPIL

SEQ ID NO: 310234 - protein, 9 aa, Influenza virus
YEVGYLCAG

SEQ ID NO: 310235 - protein, 9 aa, Influenza virus
EVGYLCAGI

SEQ ID NO: 310236 - protein, 9 aa, Influenza virus
VGYLCAGIP

SEQ ID NO: 310237 - protein, 9 aa, Influenza virus
GYLCAGIPT

SEQ ID NO: 310238 - protein, 9 aa, Influenza virus
YLCAGIPTD

SEQ ID NO: 310239 - protein, 9 aa, Influenza virus
LCAGIPTDT

SEQ ID NO: 310240 - protein, 9 aa, Influenza virus
CAGIPTDTP

SEQ ID NO: 310241 - protein, 9 aa, Influenza virus
AGIPTDTPR

SEQ ID NO: 310242 - protein, 9 aa, Influenza virus
GIPTDTPRV

SEQ ID NO: 310243 - protein, 9 aa, Influenza virus
IPTDTPRVQ

SEQ ID NO: 310244 - protein, 9 aa, Influenza virus
PTDTPRVQD

SEQ ID NO: 310245 - protein, 9 aa, Influenza virus
TDTPRVQDS

SEQ ID NO: 310246 - protein, 9 aa, Influenza virus
AVGGSGTNN

SEQ ID NO: 310247 - protein, 9 aa, Influenza virus
VGGSGTNNY

SEQ ID NO: 310248 - protein, 9 aa, Influenza virus
GGSGTNNYG

SEQ ID NO: 310249 - protein, 9 aa, Influenza virus
GSGTNNYGV

SEQ ID NO: 310250 - protein, 9 aa, Influenza virus
SGTNNYGVK

SEQ ID NO: 310251 - protein, 9 aa, Influenza virus
GTNNYGVKG

SEQ ID NO: 310252 - protein, 9 aa, Influenza virus
TNNYGVKGF

SEQ ID NO: 310253 - protein, 9 aa, Influenza virus
NNYGVKGFG

SEQ ID NO: 310254 - protein, 9 aa, Influenza virus
NYGVKGFGF

SEQ ID NO: 310255 - protein, 9 aa, Influenza virus
YGVKGFGFR

SEQ ID NO: 310256 - protein, 9 aa, Influenza virus
GVKGFGFRQ

SEQ ID NO: 310257 - protein, 9 aa, Influenza virus
VKGFGFRQG

SEQ ID NO: 310258 - protein, 9 aa, Influenza virus
KGFGFRQGN

SEQ ID NO: 310259 - protein, 9 aa, Influenza virus
GFGFRQGNS

SEQ ID NO: 310260 - protein, 9 aa, Influenza virus
FGFRQGNSV

SEQ ID NO: 310261 - protein, 9 aa, Influenza virus
GFRQGNSVW

SEQ ID NO: 310262 - protein, 9 aa, Influenza virus
FRQGNSVWA

SEQ ID NO: 310263 - protein, 9 aa, Influenza virus
RQGNSVWAG

SEQ ID NO: 310264 - protein, 9 aa, Influenza virus
QGNSVWAGR

SEQ ID NO: 310265 - protein, 9 aa, Influenza virus
GNSVWAGRT

SEQ ID NO: 310266 - protein, 9 aa, Influenza virus
NSVWAGRTV

SEQ ID NO: 310267 - protein, 9 aa, Influenza virus
SVWAGRTVS

SEQ ID NO: 310268 - protein, 9 aa, Influenza virus
SISSRSGFE

SEQ ID NO: 310269 - protein, 9 aa, Influenza virus
SSRSGFEIL

SEQ ID NO: 310270 - protein, 9 aa, Influenza virus
SRSGFEILL

SEQ ID NO: 310271 - protein, 9 aa, Influenza virus
RSGFEILLI

SEQ ID NO: 310272 - protein, 9 aa, Influenza virus
SGFEILLIE

SEQ ID NO: 310273 - protein, 9 aa, Influenza virus
GFEILLIED

SEQ ID NO: 310274 - protein, 9 aa, Influenza virus
FEILLIEDG

SEQ ID NO: 310275 - protein, 9 aa, Influenza virus
EILLIEDGW

SEQ ID NO: 310276 - protein, 9 aa, Influenza virus
EVLNNKNWS

SEQ ID NO: 310277 - protein, 9 aa, Influenza virus
VLNNKNWSG

SEQ ID NO: 310278 - protein, 9 aa, Influenza virus
LNNKNWSGY

SEQ ID NO: 310279 - protein, 9 aa, Influenza virus
NNKNWSGYS

SEQ ID NO: 310280 - protein, 9 aa, Influenza virus
NKNWSGYSG

SEQ ID NO: 310281 - protein, 9 aa, Influenza virus
KNWSGYSGA

SEQ ID NO: 310282 - protein, 9 aa, Influenza virus
NWSGYSGAF

SEQ ID NO: 310283 - protein, 9 aa, Influenza virus
WSGYSGAFT

SEQ ID NO: 310284 - protein, 9 aa, Influenza virus
SGYSGAFTI

SEQ ID NO: 310285 - protein, 9 aa, Influenza virus
GYSGAFTIP

SEQ ID NO: 310286 - protein, 9 aa, Influenza virus
YSGAFTIPI

SEQ ID NO: 310287 - protein, 9 aa, Influenza virus
CLVPCFWLE

SEQ ID NO: 310288 - protein, 9 aa, Influenza virus
LVPCFWLEM

SEQ ID NO: 310289 - protein, 9 aa, Influenza virus
VPCFWLEMI

SEQ ID NO: 310290 - protein, 9 aa, Influenza virus
PCFWLEMIR

SEQ ID NO: 310291 - protein, 9 aa, Influenza virus
CFWLEMIRG

SEQ ID NO: 310292 - protein, 9 aa, Influenza virus
FWLEMIRGK

SEQ ID NO: 310293 - protein, 9 aa, Influenza virus
WLEMIRGKP

SEQ ID NO: 310294 - protein, 9 aa, Influenza virus
LEMIRGKPE

SEQ ID NO: 310295 - protein, 9 aa, Influenza virus
EMIRGKPEE

SEQ ID NO: 310296 - protein, 9 aa, Influenza virus
MIRGKPEER

SEQ ID NO: 310297 - protein, 9 aa, Influenza virus
PEERTSIWT

SEQ ID NO: 310298 - protein, 9 aa, Influenza virus
EERTSIWTS

SEQ ID NO: 310299 - protein, 9 aa, Influenza virus
ERTSIWTSS

SEQ ID NO: 310300 - protein, 9 aa, Influenza virus
RTSIWTSSS

SEQ ID NO: 310301 - protein, 9 aa, Influenza virus
TSIWTSSSS

SEQ ID NO: 310302 - protein, 9 aa, Influenza virus
SIWTSSSST

SEQ ID NO: 310303 - protein, 9 aa, Influenza virus
IWTSSSSTV

SEQ ID NO: 310304 - protein, 9 aa, Influenza virus
WTSSSSTVF

SEQ ID NO: 310305 - protein, 9 aa, Influenza virus
TSSSSTVFC

SEQ ID NO: 310306 - protein, 9 aa, Influenza virus
SSSSTVFCG

SEQ ID NO: 310307 - protein, 9 aa, Influenza virus
SSSTVFCGV

SEQ ID NO: 310308 - protein, 9 aa, Influenza virus
SSTVFCGVS

SEQ ID NO: 310309 - protein, 9 aa, Influenza virus
STVFCGVSS

SEQ ID NO: 310310 - protein, 9 aa, Influenza virus
TVFCGVSSE

SEQ ID NO: 310311 - protein, 9 aa, Influenza virus
VFCGVSSEV

SEQ ID NO: 310312 - protein, 9 aa, Influenza virus
FCGVSSEVP

SEQ ID NO: 310313 - protein, 9 aa, Influenza virus
CGVSSEVPG

SEQ ID NO: 310314 - protein, 9 aa, Influenza virus
GVSSEVPGW

SEQ ID NO: 310315 - protein, 9 aa, Influenza virus
VSSEVPGWS

SEQ ID NO: 310316 - protein, 9 aa, Influenza virus
SSEVPGWSW

SEQ ID NO: 310317 - protein, 9 aa, Influenza virus
SEVPGWSWD

SEQ ID NO: 310318 - protein, 9 aa, Influenza virus
EVPGWSWDD

SEQ ID NO: 310319 - protein, 9 aa, Influenza virus
VPGWSWDDG

SEQ ID NO: 310320 - protein, 9 aa, Influenza virus
PGWSWDDGA

SEQ ID NO: 310321 - protein, 9 aa, Influenza virus
GWSWDDGAI

SEQ ID NO: 310322 - protein, 9 aa, Influenza virus
WSWDDGAIL

SEQ ID NO: 310323 - protein, 9 aa, Influenza virus
SWDDGAILP

SEQ ID NO: 310324 - protein, 9 aa, Influenza virus
WDDGAILPF

SEQ ID NO: 310325 - protein, 9 aa, Influenza virus
DDGAILPFD

SEQ ID NO: 310326 - protein, 9 aa, Influenza virus
DGAILPFDI

SEQ ID NO: 310327 - protein, 9 aa, Influenza virus
GAILPFDID

SEQ ID NO: 310328 - protein, 9 aa, Influenza virus
AILPFDIDK

SEQ ID NO: 310329 - protein, 9 aa, Influenza virus
ILPFDIDKM

SEQ ID NO: 310330 - protein, 9 aa, Influenza virus
MNPNQKIIC

SEQ ID NO: 310331 - protein, 9 aa, Influenza virus
NPNQKIICI

SEQ ID NO: 310332 - protein, 9 aa, Influenza virus
PNQKIICIS

SEQ ID NO: 310333 - protein, 9 aa, Influenza virus
NQKIICISA

SEQ ID NO: 310334 - protein, 9 aa, Influenza virus
CISATGMTL

SEQ ID NO: 310335 - protein, 9 aa, Influenza virus
ISATGMTLS

SEQ ID NO: 310336 - protein, 9 aa, Influenza virus
SATGMTLSV

SEQ ID NO: 310337 - protein, 9 aa, Influenza virus
ATGMTLSVV

SEQ ID NO: 310338 - protein, 9 aa, Influenza virus
TGMTLSVVS

SEQ ID NO: 310339 - protein, 9 aa, Influenza virus
GMTLSVVSL

SEQ ID NO: 310340 - protein, 9 aa, Influenza virus
MTLSVVSLL

SEQ ID NO: 310341 - protein, 9 aa, Influenza virus
LSVVSLLIG

SEQ ID NO: 310342 - protein, 9 aa, Influenza virus
GLANLGLNI

SEQ ID NO: 310343 - protein, 9 aa, Influenza virus
LANLGLNIG

SEQ ID NO: 310344 - protein, 9 aa, Influenza virus
ANLGLNIGL

SEQ ID NO: 310345 - protein, 9 aa, Influenza virus
NLGLNIGLH

SEQ ID NO: 310346 - protein, 9 aa, Influenza virus
TTTTIINNN

SEQ ID NO: 310347 - protein, 9 aa, Influenza virus
KPLCEVNSW

SEQ ID NO: 310348 - protein, 9 aa, Influenza virus
PLCEVNSWH

SEQ ID NO: 310349 - protein, 9 aa, Influenza virus
LCEVNSWHI

SEQ ID NO: 310350 - protein, 9 aa, Influenza virus
CEVNSWHIL

SEQ ID NO: 310351 - protein, 9 aa, Influenza virus
EVNSWHILS

SEQ ID NO: 310352 - protein, 9 aa, Influenza virus
VNSWHILSK

SEQ ID NO: 310353 - protein, 9 aa, Influenza virus
NSWHILSKD

SEQ ID NO: 310354 - protein, 9 aa, Influenza virus
SWHILSKDN

SEQ ID NO: 310355 - protein, 9 aa, Influenza virus
WHILSKDNA

SEQ ID NO: 310356 - protein, 9 aa, Influenza virus
HILSKDNAI

SEQ ID NO: 310357 - protein, 9 aa, Influenza virus
ILSKDNAIR

SEQ ID NO: 310358 - protein, 9 aa, Influenza virus
LSKDNAIRI

SEQ ID NO: 310359 - protein, 9 aa, Influenza virus
SKDNAIRIG

SEQ ID NO: 310360 - protein, 9 aa, Influenza virus
KDNAIRIGE

SEQ ID NO: 310361 - protein, 9 aa, Influenza virus
DNAIRIGED

SEQ ID NO: 310362 - protein, 9 aa, Influenza virus
NAIRIGEDA

SEQ ID NO: 310363 - protein, 9 aa, Influenza virus
AIRIGEDAH

SEQ ID NO: 310364 - protein, 9 aa, Influenza virus
RIGEDAHIL

SEQ ID NO: 310365 - protein, 9 aa, Influenza virus
DAHILVTRE

SEQ ID NO: 310366 - protein, 9 aa, Influenza virus
AHILVTREP

SEQ ID NO: 310367 - protein, 9 aa, Influenza virus
HILVTREPY

SEQ ID NO: 310368 - protein, 9 aa, Influenza virus
ILVTREPYL

SEQ ID NO: 310369 - protein, 9 aa, Influenza virus
LVTREPYLS

SEQ ID NO: 310370 - protein, 9 aa, Influenza virus
VTREPYLSC

SEQ ID NO: 310371 - protein, 9 aa, Influenza virus
TREPYLSCG

SEQ ID NO: 310372 - protein, 9 aa, Influenza virus
REPYLSCGP

SEQ ID NO: 310373 - protein, 9 aa, Influenza virus
ECRMFALSQ

SEQ ID NO: 310374 - protein, 9 aa, Influenza virus
CRMFALSQG

SEQ ID NO: 310375 - protein, 9 aa, Influenza virus
RMFALSQGT

SEQ ID NO: 310376 - protein, 9 aa, Influenza virus
MFALSQGTT

SEQ ID NO: 310377 - protein, 9 aa, Influenza virus
FALSQGTTL

SEQ ID NO: 310378 - protein, 9 aa, Influenza virus
ALSQGTTLR

SEQ ID NO: 310379 - protein, 9 aa, Influenza virus
LSQGTTLRG

SEQ ID NO: 310380 - protein, 9 aa, Influenza virus
SQGTTLRGR

SEQ ID NO: 310381 - protein, 9 aa, Influenza virus
QGTTLRGRH

SEQ ID NO: 310382 - protein, 9 aa, Influenza virus
GTTLRGRHA

SEQ ID NO: 310383 - protein, 9 aa, Influenza virus
TTLRGRHAN

SEQ ID NO: 310384 - protein, 9 aa, Influenza virus
TLRGRHANG

SEQ ID NO: 310385 - protein, 9 aa, Influenza virus
LRGRHANGT

SEQ ID NO: 310386 - protein, 9 aa, Influenza virus
RGRHANGTI

SEQ ID NO: 310387 - protein, 9 aa, Influenza virus
GRHANGTIH

SEQ ID NO: 310388 - protein, 9 aa, Influenza virus
RHANGTIHD

SEQ ID NO: 310389 - protein, 9 aa, Influenza virus
HANGTIHDR

SEQ ID NO: 310390 - protein, 9 aa, Influenza virus
ANGTIHDRS

SEQ ID NO: 310391 - protein, 9 aa, Influenza virus
NGTIHDRSP

SEQ ID NO: 310392 - protein, 9 aa, Influenza virus
GTIHDRSPF

SEQ ID NO: 310393 - protein, 9 aa, Influenza virus
TIHDRSPFR

SEQ ID NO: 310394 - protein, 9 aa, Influenza virus
IHDRSPFRA

SEQ ID NO: 310395 - protein, 9 aa, Influenza virus
HDRSPFRAL

SEQ ID NO: 310396 - protein, 9 aa, Influenza virus
DRSPFRALI

SEQ ID NO: 310397 - protein, 9 aa, Influenza virus
RSPFRALIS

SEQ ID NO: 310398 - protein, 9 aa, Influenza virus
SPFRALISW

SEQ ID NO: 310399 - protein, 9 aa, Influenza virus
PFRALISWE

SEQ ID NO: 310400 - protein, 9 aa, Influenza virus
FRALISWEM

SEQ ID NO: 310401 - protein, 9 aa, Influenza virus
RALISWEMG

SEQ ID NO: 310402 - protein, 9 aa, Influenza virus
ALISWEMGQ

SEQ ID NO: 310403 - protein, 9 aa, Influenza virus
LISWEMGQA

SEQ ID NO: 310404 - protein, 9 aa, Influenza virus
ISWEMGQAP

SEQ ID NO: 310405 - protein, 9 aa, Influenza virus
SWEMGQAPS

SEQ ID NO: 310406 - protein, 9 aa, Influenza virus
WEMGQAPSP

SEQ ID NO: 310407 - protein, 9 aa, Influenza virus
EMGQAPSPY

SEQ ID NO: 310408 - protein, 9 aa, Influenza virus
MGQAPSPYN

SEQ ID NO: 310409 - protein, 9 aa, Influenza virus
VECVGWSST

SEQ ID NO: 310410 - protein, 9 aa, Influenza virus
ECVGWSSTS

SEQ ID NO: 310411 - protein, 9 aa, Influenza virus
CVGWSSTSC

SEQ ID NO: 310412 - protein, 9 aa, Influenza virus
VGWSSTSCH

SEQ ID NO: 310413 - protein, 9 aa, Influenza virus
GWSSTSCHD

SEQ ID NO: 310414 - protein, 9 aa, Influenza virus
WSSTSCHDG

SEQ ID NO: 310415 - protein, 9 aa, Influenza virus
SSTSCHDGI

SEQ ID NO: 310416 - protein, 9 aa, Influenza virus
STSCHDGIS

SEQ ID NO: 310417 - protein, 9 aa, Influenza virus
TSCHDGISR

SEQ ID NO: 310418 - protein, 9 aa, Influenza virus
SCHDGISRM

SEQ ID NO: 310419 - protein, 9 aa, Influenza virus
CHDGISRMS

SEQ ID NO: 310420 - protein, 9 aa, Influenza virus
SRMSICMSG

SEQ ID NO: 310421 - protein, 9 aa, Influenza virus
RMSICMSGP

SEQ ID NO: 310422 - protein, 9 aa, Influenza virus
MSICMSGPN

SEQ ID NO: 310423 - protein, 9 aa, Influenza virus
SICMSGPNN

SEQ ID NO: 310424 - protein, 9 aa, Influenza virus
ICMSGPNNN

SEQ ID NO: 310425 - protein, 9 aa, Influenza virus
CMSGPNNNA

SEQ ID NO: 310426 - protein, 9 aa, Influenza virus
MSGPNNNAS

SEQ ID NO: 310427 - protein, 9 aa, Influenza virus
SGPNNNASA

SEQ ID NO: 310428 - protein, 9 aa, Influenza virus
GPNNNASAV

SEQ ID NO: 310429 - protein, 9 aa, Influenza virus
PNNNASAVV

SEQ ID NO: 310430 - protein, 9 aa, Influenza virus
NNNASAVVW

SEQ ID NO: 310431 - protein, 9 aa, Influenza virus
NNASAVVWY

SEQ ID NO: 310432 - protein, 9 aa, Influenza virus
TEIASWAGN

SEQ ID NO: 310433 - protein, 9 aa, Influenza virus
EIASWAGNI

SEQ ID NO: 310434 - protein, 9 aa, Influenza virus
IASWAGNIL

SEQ ID NO: 310435 - protein, 9 aa, Influenza virus
ASWAGNILR

SEQ ID NO: 310436 - protein, 9 aa, Influenza virus
SWAGNILRT

SEQ ID NO: 310437 - protein, 9 aa, Influenza virus
WAGNILRTQ

SEQ ID NO: 310438 - protein, 9 aa, Influenza virus
AGNILRTQE

SEQ ID NO: 310439 - protein, 9 aa, Influenza virus
GNILRTQES

SEQ ID NO: 310440 - protein, 9 aa, Influenza virus
NILRTQESE

SEQ ID NO: 310441 - protein, 9 aa, Influenza virus
ILRTQESEC

SEQ ID NO: 310442 - protein, 9 aa, Influenza virus
LRTQESECV

SEQ ID NO: 310443 - protein, 9 aa, Influenza virus
RTQESECVC

SEQ ID NO: 310444 - protein, 9 aa, Influenza virus
TQESECVCH

SEQ ID NO: 310445 - protein, 9 aa, Influenza virus
QESECVCHN

SEQ ID NO: 310446 - protein, 9 aa, Influenza virus
ESECVCHNG

SEQ ID NO: 310447 - protein, 9 aa, Influenza virus
SECVCHNGI

SEQ ID NO: 310448 - protein, 9 aa, Influenza virus
ECVCHNGIC

SEQ ID NO: 310449 - protein, 9 aa, Influenza virus
CVCHNGICP

SEQ ID NO: 310450 - protein, 9 aa, Influenza virus
VCHNGICPV

SEQ ID NO: 310451 - protein, 9 aa, Influenza virus
CHNGICPVV

SEQ ID NO: 310452 - protein, 9 aa, Influenza virus
GICPVVMTD

SEQ ID NO: 310453 - protein, 9 aa, Influenza virus
ICPVVMTDG

SEQ ID NO: 310454 - protein, 9 aa, Influenza virus
CPVVMTDGP

SEQ ID NO: 310455 - protein, 9 aa, Influenza virus
PVVMTDGPA

SEQ ID NO: 310456 - protein, 9 aa, Influenza virus
VVMTDGPAN

SEQ ID NO: 310457 - protein, 9 aa, Influenza virus
TDGPANNRA

SEQ ID NO: 310458 - protein, 9 aa, Influenza virus
GSAQHIEEC

SEQ ID NO: 310459 - protein, 9 aa, Influenza virus
SAQHIEECS

SEQ ID NO: 310460 - protein, 9 aa, Influenza virus
AQHIEECSC

SEQ ID NO: 310461 - protein, 9 aa, Influenza virus
QHIEECSCY

SEQ ID NO: 310462 - protein, 9 aa, Influenza virus
HIEECSCYG

SEQ ID NO: 310463 - protein, 9 aa, Influenza virus
IEECSCYGA

SEQ ID NO: 310464 - protein, 9 aa, Influenza virus
IKCICRDNW

SEQ ID NO: 310465 - protein, 9 aa, Influenza virus
KCICRDNWK

SEQ ID NO: 310466 - protein, 9 aa, Influenza virus
CICRDNWKG

SEQ ID NO: 310467 - protein, 9 aa, Influenza virus
ICRDNWKGA

SEQ ID NO: 310468 - protein, 9 aa, Influenza virus
CRDNWKGAN

SEQ ID NO: 310469 - protein, 9 aa, Influenza virus
RDNWKGANR

SEQ ID NO: 310470 - protein, 9 aa, Influenza virus
DNWKGANRP

SEQ ID NO: 310471 - protein, 9 aa, Influenza virus
NWKGANRPV

SEQ ID NO: 310472 - protein, 9 aa, Influenza virus
WKGANRPVI

SEQ ID NO: 310473 - protein, 9 aa, Influenza virus
KGANRPVIT

SEQ ID NO: 310474 - protein, 9 aa, Influenza virus
GANRPVITI

SEQ ID NO: 310475 - protein, 9 aa, Influenza virus
ANRPVITIN

SEQ ID NO: 310476 - protein, 9 aa, Influenza virus
MTHTSKYLC

SEQ ID NO: 310477 - protein, 9 aa, Influenza virus
THTSKYLCS

SEQ ID NO: 310478 - protein, 9 aa, Influenza virus
YLCSKILTD

SEQ ID NO: 310479 - protein, 9 aa, Influenza virus
LCSKILTDT

SEQ ID NO: 310480 - protein, 9 aa, Influenza virus
CSKILTDTS

SEQ ID NO: 310481 - protein, 9 aa, Influenza virus
SKILTDTSR

SEQ ID NO: 310482 - protein, 9 aa, Influenza virus
KILTDTSRP

SEQ ID NO: 310483 - protein, 9 aa, Influenza virus
LTDTSRPND

SEQ ID NO: 310484 - protein, 9 aa, Influenza virus
TDTSRPNDP

SEQ ID NO: 310485 - protein, 9 aa, Influenza virus
GGSPDPGVK

SEQ ID NO: 310486 - protein, 9 aa, Influenza virus
GSPDPGVKG

SEQ ID NO: 310487 - protein, 9 aa, Influenza virus
SPDPGVKGF

SEQ ID NO: 310488 - protein, 9 aa, Influenza virus
PDPGVKGFA

SEQ ID NO: 310489 - protein, 9 aa, Influenza virus
DPGVKGFAF

SEQ ID NO: 310490 - protein, 9 aa, Influenza virus
PGVKGFAFL

SEQ ID NO: 310491 - protein, 9 aa, Influenza virus
GVKGFAFLD

SEQ ID NO: 310492 - protein, 9 aa, Influenza virus
VKGFAFLDG

SEQ ID NO: 310493 - protein, 9 aa, Influenza virus
NSWLGRTIS

SEQ ID NO: 310494 - protein, 9 aa, Influenza virus
SWLGRTISK

SEQ ID NO: 310495 - protein, 9 aa, Influenza virus
WLGRTISKD

SEQ ID NO: 310496 - protein, 9 aa, Influenza virus
LGRTISKDS

SEQ ID NO: 310497 - protein, 9 aa, Influenza virus
GRTISKDSR

SEQ ID NO: 310498 - protein, 9 aa, Influenza virus
RTISKDSRS

SEQ ID NO: 310499 - protein, 9 aa, Influenza virus
TISKDSRSG

SEQ ID NO: 310500 - protein, 9 aa, Influenza virus
ISKDSRSGY

SEQ ID NO: 310501 - protein, 9 aa, Influenza virus
SKDSRSGYE

SEQ ID NO: 310502 - protein, 9 aa, Influenza virus
KDSRSGYEM

SEQ ID NO: 310503 - protein, 9 aa, Influenza virus
DSRSGYEML

SEQ ID NO: 310504 - protein, 9 aa, Influenza virus
SRSGYEMLK

SEQ ID NO: 310505 - protein, 9 aa, Influenza virus
RSGYEMLKV

SEQ ID NO: 310506 - protein, 9 aa, Influenza virus
SGYEMLKVP

SEQ ID NO: 310507 - protein, 9 aa, Influenza virus
GYEMLKVPN

SEQ ID NO: 310508 - protein, 9 aa, Influenza virus
YEMLKVPNA

SEQ ID NO: 310509 - protein, 9 aa, Influenza virus
EMLKVPNAE

SEQ ID NO: 310510 - protein, 9 aa, Influenza virus
IVNNQNWSG

SEQ ID NO: 310511 - protein, 9 aa, Influenza virus
VNNQNWSGY

SEQ ID NO: 310512 - protein, 9 aa, Influenza virus
NNQNWSGYS

SEQ ID NO: 310513 - protein, 9 aa, Influenza virus
NQNWSGYSG

SEQ ID NO: 310514 - protein, 9 aa, Influenza virus
QNWSGYSGA

SEQ ID NO: 310515 - protein, 9 aa, Influenza virus
NWSGYSGAF

SEQ ID NO: 310516 - protein, 9 aa, Influenza virus
WSGYSGAFI

SEQ ID NO: 310517 - protein, 9 aa, Influenza virus
SGYSGAFID

SEQ ID NO: 310518 - protein, 9 aa, Influenza virus
GYSGAFIDY

SEQ ID NO: 310519 - protein, 9 aa, Influenza virus
YSGAFIDYW

SEQ ID NO: 310520 - protein, 9 aa, Influenza virus
RECFNPCFY

SEQ ID NO: 310521 - protein, 9 aa, Influenza virus
ECFNPCFYV

SEQ ID NO: 310522 - protein, 9 aa, Influenza virus
CFNPCFYVE

SEQ ID NO: 310523 - protein, 9 aa, Influenza virus
FNPCFYVEL

SEQ ID NO: 310524 - protein, 9 aa, Influenza virus
NPCFYVELI

SEQ ID NO: 310525 - protein, 9 aa, Influenza virus
PCFYVELIR

SEQ ID NO: 310526 - protein, 9 aa, Influenza virus
CFYVELIRG

SEQ ID NO: 310527 - protein, 9 aa, Influenza virus
FYVELIRGR

SEQ ID NO: 310528 - protein, 9 aa, Influenza virus
YVELIRGRP

SEQ ID NO: 310529 - protein, 9 aa, Influenza virus
VELIRGRPK

SEQ ID NO: 310530 - protein, 9 aa, Influenza virus
ELIRGRPKE

SEQ ID NO: 310531 - protein, 9 aa, Influenza virus
LIRGRPKES

SEQ ID NO: 310532 - protein, 9 aa, Influenza virus
ESSVLWTSN

SEQ ID NO: 310533 - protein, 9 aa, Influenza virus
VLWTSNSIV

SEQ ID NO: 310534 - protein, 9 aa, Influenza virus
LWTSNSIVA

SEQ ID NO: 310535 - protein, 9 aa, Influenza virus
WTSNSIVAL

SEQ ID NO: 310536 - protein, 9 aa, Influenza virus
TSNSIVALC

SEQ ID NO: 310537 - protein, 9 aa, Influenza virus
SNSIVALCG

SEQ ID NO: 310538 - protein, 9 aa, Influenza virus
NSIVALCGS

SEQ ID NO: 310539 - protein, 9 aa, Influenza virus
SIVALCGSK

SEQ ID NO: 310540 - protein, 9 aa, Influenza virus
IVALCGSKE

SEQ ID NO: 310541 - protein, 9 aa, Influenza virus
VALCGSKER

SEQ ID NO: 310542 - protein, 9 aa, Influenza virus
ALCGSKERL

SEQ ID NO: 310543 - protein, 9 aa, Influenza virus
LCGSKERLG

SEQ ID NO: 310544 - protein, 9 aa, Influenza virus
CGSKERLGS

SEQ ID NO: 310545 - protein, 9 aa, Influenza virus
GSKERLGSW

SEQ ID NO: 310546 - protein, 9 aa, Influenza virus
SKERLGSWS

SEQ ID NO: 310547 - protein, 9 aa, Influenza virus
KERLGSWSW

SEQ ID NO: 310548 - protein, 9 aa, Influenza virus
ERLGSWSWH

SEQ ID NO: 310549 - protein, 9 aa, Influenza virus
RLGSWSWHD

SEQ ID NO: 310550 - protein, 9 aa, Influenza virus
LGSWSWHDG

SEQ ID NO: 310551 - protein, 9 aa, Influenza virus
GSWSWHDGA

SEQ ID NO: 310552 - protein, 9 aa, Influenza virus
SWSWHDGAE

SEQ ID NO: 310553 - protein, 9 aa, Influenza virus
WSWHDGAEI

SEQ ID NO: 310554 - protein, 9 aa, Influenza virus
SWHDGAEII

SEQ ID NO: 310555 - protein, 9 aa, Influenza virus
WHDGAEIIY

SEQ ID NO: 310556 - protein, 9 aa, Influenza virus
HDGAEIIYF

SEQ ID NO: 310557 - protein, 9 aa, Influenza virus
DGAEIIYFK

SEQ ID NO: 310558 - protein, 9 aa, Influenza virus
MNPNQKLFA

SEQ ID NO: 310559 - protein, 9 aa, Influenza virus
NPNQKLFAL

SEQ ID NO: 310560 - protein, 9 aa, Influenza virus
PNQKLFALS

SEQ ID NO: 310561 - protein, 9 aa, Influenza virus
NQKLFALSG

SEQ ID NO: 310562 - protein, 9 aa, Influenza virus
QKLFALSGV

SEQ ID NO: 310563 - protein, 9 aa, Influenza virus
KLFALSGVA

SEQ ID NO: 310564 - protein, 9 aa, Influenza virus
LFALSGVAI

SEQ ID NO: 310565 - protein, 9 aa, Influenza virus
LNLLIGISN

SEQ ID NO: 310566 - protein, 9 aa, Influenza virus
NLLIGISNV

SEQ ID NO: 310567 - protein, 9 aa, Influenza virus
LLIGISNVG

SEQ ID NO: 310568 - protein, 9 aa, Influenza virus
LIGISNVGL

SEQ ID NO: 310569 - protein, 9 aa, Influenza virus
IGISNVGLN

SEQ ID NO: 310570 - protein, 9 aa, Influenza virus
SNVGLNVSL

SEQ ID NO: 310571 - protein, 9 aa, Influenza virus
NVGLNVSLH

SEQ ID NO: 310572 - protein, 9 aa, Influenza virus
VGLNVSLHL

SEQ ID NO: 310573 - protein, 9 aa, Influenza virus
GLNVSLHLK

SEQ ID NO: 310574 - protein, 9 aa, Influenza virus
ENTYVNNTT

SEQ ID NO: 310575 - protein, 9 aa, Influenza virus
NTYVNNTTV

SEQ ID NO: 310576 - protein, 9 aa, Influenza virus
TYVNNTTVI

SEQ ID NO: 310577 - protein, 9 aa, Influenza virus
YLMLNKSLC

SEQ ID NO: 310578 - protein, 9 aa, Influenza virus
LMLNKSLCK

SEQ ID NO: 310579 - protein, 9 aa, Influenza virus
MLNKSLCKV

SEQ ID NO: 310580 - protein, 9 aa, Influenza virus
GWVVVAKDN

SEQ ID NO: 310581 - protein, 9 aa, Influenza virus
WVVVAKDNA

SEQ ID NO: 310582 - protein, 9 aa, Influenza virus
VVVAKDNAI

SEQ ID NO: 310583 - protein, 9 aa, Influenza virus
VVAKDNAIR

SEQ ID NO: 310584 - protein, 9 aa, Influenza virus
VAKDNAIRF

SEQ ID NO: 310585 - protein, 9 aa, Influenza virus
AKDNAIRFG

SEQ ID NO: 310586 - protein, 9 aa, Influenza virus
KDNAIRFGE

SEQ ID NO: 310587 - protein, 9 aa, Influenza virus
DNAIRFGES

SEQ ID NO: 310588 - protein, 9 aa, Influenza virus
NAIRFGESE

SEQ ID NO: 310589 - protein, 9 aa, Influenza virus
AIRFGESEQ

SEQ ID NO: 310590 - protein, 9 aa, Influenza virus
IRFGESEQI

SEQ ID NO: 310591 - protein, 9 aa, Influenza virus
RFGESEQII

SEQ ID NO: 310592 - protein, 9 aa, Influenza virus
FGESEQIIV

SEQ ID NO: 310593 - protein, 9 aa, Influenza virus
GESEQIIVT

SEQ ID NO: 310594 - protein, 9 aa, Influenza virus
ESEQIIVTR

SEQ ID NO: 310595 - protein, 9 aa, Influenza virus
SEQIIVTRE

SEQ ID NO: 310596 - protein, 9 aa, Influenza virus
EQIIVTREP

SEQ ID NO: 310597 - protein, 9 aa, Influenza virus
QIIVTREPY

SEQ ID NO: 310598 - protein, 9 aa, Influenza virus
IIVTREPYV

SEQ ID NO: 310599 - protein, 9 aa, Influenza virus
IVTREPYVS

SEQ ID NO: 310600 - protein, 9 aa, Influenza virus
VTREPYVSC

SEQ ID NO: 310601 - protein, 9 aa, Influenza virus
TREPYVSCD

SEQ ID NO: 310602 - protein, 9 aa, Influenza virus
REPYVSCDP

SEQ ID NO: 310603 - protein, 9 aa, Influenza virus
EPYVSCDPL

SEQ ID NO: 310604 - protein, 9 aa, Influenza virus
GCKMYALHQ

SEQ ID NO: 310605 - protein, 9 aa, Influenza virus
CKMYALHQG

SEQ ID NO: 310606 - protein, 9 aa, Influenza virus
KMYALHQGT

SEQ ID NO: 310607 - protein, 9 aa, Influenza virus
MYALHQGTT

SEQ ID NO: 310608 - protein, 9 aa, Influenza virus
YALHQGTTI

SEQ ID NO: 310609 - protein, 9 aa, Influenza virus
ALHQGTTIR

SEQ ID NO: 310610 - protein, 9 aa, Influenza virus
LHQGTTIRN

SEQ ID NO: 310611 - protein, 9 aa, Influenza virus
HQGTTIRNK

SEQ ID NO: 310612 - protein, 9 aa, Influenza virus
QGTTIRNKH

SEQ ID NO: 310613 - protein, 9 aa, Influenza virus
GTTIRNKHS

SEQ ID NO: 310614 - protein, 9 aa, Influenza virus
TTIRNKHSN

SEQ ID NO: 310615 - protein, 9 aa, Influenza virus
TIRNKHSNG

SEQ ID NO: 310616 - protein, 9 aa, Influenza virus
IRNKHSNGT

SEQ ID NO: 310617 - protein, 9 aa, Influenza virus
RNKHSNGTI

SEQ ID NO: 310618 - protein, 9 aa, Influenza virus
NKHSNGTIH

SEQ ID NO: 310619 - protein, 9 aa, Influenza virus
KHSNGTIHD

SEQ ID NO: 310620 - protein, 9 aa, Influenza virus
HSNGTIHDR

SEQ ID NO: 310621 - protein, 9 aa, Influenza virus
SNGTIHDRT

SEQ ID NO: 310622 - protein, 9 aa, Influenza virus
TIHDRTAFR

SEQ ID NO: 310623 - protein, 9 aa, Influenza virus
IHDRTAFRG

SEQ ID NO: 310624 - protein, 9 aa, Influenza virus
HDRTAFRGL

SEQ ID NO: 310625 - protein, 9 aa, Influenza virus
DRTAFRGLI

SEQ ID NO: 310626 - protein, 9 aa, Influenza virus
RTAFRGLIS

SEQ ID NO: 310627 - protein, 9 aa, Influenza virus
TAFRGLIST

SEQ ID NO: 310628 - protein, 9 aa, Influenza virus
AFRGLISTP

SEQ ID NO: 310629 - protein, 9 aa, Influenza virus
FRGLISTPL

SEQ ID NO: 310630 - protein, 9 aa, Influenza virus
RGLISTPLG

SEQ ID NO: 310631 - protein, 9 aa, Influenza virus
SNSDFLCVG

SEQ ID NO: 310632 - protein, 9 aa, Influenza virus
NSDFLCVGW

SEQ ID NO: 310633 - protein, 9 aa, Influenza virus
SDFLCVGWS

SEQ ID NO: 310634 - protein, 9 aa, Influenza virus
DFLCVGWSS

SEQ ID NO: 310635 - protein, 9 aa, Influenza virus
FLCVGWSST

SEQ ID NO: 310636 - protein, 9 aa, Influenza virus
LCVGWSSTS

SEQ ID NO: 310637 - protein, 9 aa, Influenza virus
CVGWSSTSC

SEQ ID NO: 310638 - protein, 9 aa, Influenza virus
VGWSSTSCH

SEQ ID NO: 310639 - protein, 9 aa, Influenza virus
GWSSTSCHD

SEQ ID NO: 310640 - protein, 9 aa, Influenza virus
WSSTSCHDG

SEQ ID NO: 310641 - protein, 9 aa, Influenza virus
SSTSCHDGI

SEQ ID NO: 310642 - protein, 9 aa, Influenza virus
CHDGIGRMT

SEQ ID NO: 310643 - protein, 9 aa, Influenza virus
HDGIGRMTI

SEQ ID NO: 310644 - protein, 9 aa, Influenza virus
DGIGRMTIC

SEQ ID NO: 310645 - protein, 9 aa, Influenza virus
GRMTICVQG

SEQ ID NO: 310646 - protein, 9 aa, Influenza virus
RMTICVQGN

SEQ ID NO: 310647 - protein, 9 aa, Influenza virus
MTICVQGNN

SEQ ID NO: 310648 - protein, 9 aa, Influenza virus
QGNNDNATA

SEQ ID NO: 310649 - protein, 9 aa, Influenza virus
GNNDNATAT

SEQ ID NO: 310650 - protein, 9 aa, Influenza virus
NNDNATATV

SEQ ID NO: 310651 - protein, 9 aa, Influenza virus
NDNATATVY

SEQ ID NO: 310652 - protein, 9 aa, Influenza virus
DNATATVYY

SEQ ID NO: 310653 - protein, 9 aa, Influenza virus
NATATVYYD

SEQ ID NO: 310654 - protein, 9 aa, Influenza virus
ATATVYYDR

SEQ ID NO: 310655 - protein, 9 aa, Influenza virus
TATVYYDRR

SEQ ID NO: 310656 - protein, 9 aa, Influenza virus
ATVYYDRRL

SEQ ID NO: 310657 - protein, 9 aa, Influenza virus
TVYYDRRLT

SEQ ID NO: 310658 - protein, 9 aa, Influenza virus
VYYDRRLTT

SEQ ID NO: 310659 - protein, 9 aa, Influenza virus
YYDRRLTTT

SEQ ID NO: 310660 - protein, 9 aa, Influenza virus
YDRRLTTTI

SEQ ID NO: 310661 - protein, 9 aa, Influenza virus
RRLTTTIKT

SEQ ID NO: 310662 - protein, 9 aa, Influenza virus
RLTTTIKTW

SEQ ID NO: 310663 - protein, 9 aa, Influenza virus
LTTTIKTWA

SEQ ID NO: 310664 - protein, 9 aa, Influenza virus
TTTIKTWAG

SEQ ID NO: 310665 - protein, 9 aa, Influenza virus
TTIKTWAGN

SEQ ID NO: 310666 - protein, 9 aa, Influenza virus
TIKTWAGNI

SEQ ID NO: 310667 - protein, 9 aa, Influenza virus
IKTWAGNIL

SEQ ID NO: 310668 - protein, 9 aa, Influenza virus
KTWAGNILR

SEQ ID NO: 310669 - protein, 9 aa, Influenza virus
TWAGNILRT

SEQ ID NO: 310670 - protein, 9 aa, Influenza virus
WAGNILRTQ

SEQ ID NO: 310671 - protein, 9 aa, Influenza virus
AGNILRTQE

SEQ ID NO: 310672 - protein, 9 aa, Influenza virus
GNILRTQES

SEQ ID NO: 310673 - protein, 9 aa, Influenza virus
NILRTQESE

SEQ ID NO: 310674 - protein, 9 aa, Influenza virus
ILRTQESEC

SEQ ID NO: 310675 - protein, 9 aa, Influenza virus
LRTQESECV

SEQ ID NO: 310676 - protein, 9 aa, Influenza virus
RTQESECVC

SEQ ID NO: 310677 - protein, 9 aa, Influenza virus
TQESECVCH

SEQ ID NO: 310678 - protein, 9 aa, Influenza virus
QESECVCHN

SEQ ID NO: 310679 - protein, 9 aa, Influenza virus
ESECVCHNG

SEQ ID NO: 310680 - protein, 9 aa, Influenza virus
SECVCHNGT

SEQ ID NO: 310681 - protein, 9 aa, Influenza virus
ECVCHNGTC

SEQ ID NO: 310682 - protein, 9 aa, Influenza virus
CVCHNGTCV

SEQ ID NO: 310683 - protein, 9 aa, Influenza virus
GTCVVIMTD

SEQ ID NO: 310684 - protein, 9 aa, Influenza virus
TCVVIMTDG

SEQ ID NO: 310685 - protein, 9 aa, Influenza virus
MTDGSASSQ

SEQ ID NO: 310686 - protein, 9 aa, Influenza virus
TDGSASSQA

SEQ ID NO: 310687 - protein, 9 aa, Influenza virus
LKGSARHIE

SEQ ID NO: 310688 - protein, 9 aa, Influenza virus
KGSARHIEE

SEQ ID NO: 310689 - protein, 9 aa, Influenza virus
GSARHIEEC

SEQ ID NO: 310690 - protein, 9 aa, Influenza virus
SARHIEECS

SEQ ID NO: 310691 - protein, 9 aa, Influenza virus
ARHIEECSC

SEQ ID NO: 310692 - protein, 9 aa, Influenza virus
RHIEECSCY

SEQ ID NO: 310693 - protein, 9 aa, Influenza virus
HIEECSCYG

SEQ ID NO: 310694 - protein, 9 aa, Influenza virus
IEECSCYGH

SEQ ID NO: 310695 - protein, 9 aa, Influenza virus
EECSCYGHN

SEQ ID NO: 310696 - protein, 9 aa, Influenza virus
KVTCVCRDN

SEQ ID NO: 310697 - protein, 9 aa, Influenza virus
VTCVCRDNW

SEQ ID NO: 310698 - protein, 9 aa, Influenza virus
TCVCRDNWQ

SEQ ID NO: 310699 - protein, 9 aa, Influenza virus
CVCRDNWQG

SEQ ID NO: 310700 - protein, 9 aa, Influenza virus
VCRDNWQGA

SEQ ID NO: 310701 - protein, 9 aa, Influenza virus
CRDNWQGAN

SEQ ID NO: 310702 - protein, 9 aa, Influenza virus
RDNWQGANR

SEQ ID NO: 310703 - protein, 9 aa, Influenza virus
DNWQGANRP

SEQ ID NO: 310704 - protein, 9 aa, Influenza virus
NWQGANRPV

SEQ ID NO: 310705 - protein, 9 aa, Influenza virus
WQGANRPVI

SEQ ID NO: 310706 - protein, 9 aa, Influenza virus
QGANRPVIE

SEQ ID NO: 310707 - protein, 9 aa, Influenza virus
GANRPVIEI

SEQ ID NO: 310708 - protein, 9 aa, Influenza virus
ANRPVIEID

SEQ ID NO: 310709 - protein, 9 aa, Influenza virus
NRPVIEIDM

SEQ ID NO: 310710 - protein, 9 aa, Influenza virus
HTSQYLCTG

SEQ ID NO: 310711 - protein, 9 aa, Influenza virus
CTGVLTDTS

SEQ ID NO: 310712 - protein, 9 aa, Influenza virus
TGVLTDTSR

SEQ ID NO: 310713 - protein, 9 aa, Influenza virus
GVLTDTSRP

SEQ ID NO: 310714 - protein, 9 aa, Influenza virus
VLTDTSRPS

SEQ ID NO: 310715 - protein, 9 aa, Influenza virus
LTDTSRPSD

SEQ ID NO: 310716 - protein, 9 aa, Influenza virus
TDTSRPSDK

SEQ ID NO: 310717 - protein, 9 aa, Influenza virus
GDCNNPITG

SEQ ID NO: 310718 - protein, 9 aa, Influenza virus
DCNNPITGS

SEQ ID NO: 310719 - protein, 9 aa, Influenza virus
CNNPITGSP

SEQ ID NO: 310720 - protein, 9 aa, Influenza virus
NNPITGSPG

SEQ ID NO: 310721 - protein, 9 aa, Influenza virus
NPITGSPGA

SEQ ID NO: 310722 - protein, 9 aa, Influenza virus
PITGSPGAP

SEQ ID NO: 310723 - protein, 9 aa, Influenza virus
ITGSPGAPG

SEQ ID NO: 310724 - protein, 9 aa, Influenza virus
APGVKGFGF

SEQ ID NO: 310725 - protein, 9 aa, Influenza virus
PGVKGFGFL

SEQ ID NO: 310726 - protein, 9 aa, Influenza virus
GVKGFGFLD

SEQ ID NO: 310727 - protein, 9 aa, Influenza virus
GNTWLGRTI

SEQ ID NO: 310728 - protein, 9 aa, Influenza virus
NTWLGRTIS

SEQ ID NO: 310729 - protein, 9 aa, Influenza virus
TWLGRTISP

SEQ ID NO: 310730 - protein, 9 aa, Influenza virus
WLGRTISPR

SEQ ID NO: 310731 - protein, 9 aa, Influenza virus
LGRTISPRS

SEQ ID NO: 310732 - protein, 9 aa, Influenza virus
GRTISPRSR

SEQ ID NO: 310733 - protein, 9 aa, Influenza virus
TISPRSRSG

SEQ ID NO: 310734 - protein, 9 aa, Influenza virus
ISPRSRSGF

SEQ ID NO: 310735 - protein, 9 aa, Influenza virus
SPRSRSGFE

SEQ ID NO: 310736 - protein, 9 aa, Influenza virus
PRSRSGFEM

SEQ ID NO: 310737 - protein, 9 aa, Influenza virus
RSRSGFEML

SEQ ID NO: 310738 - protein, 9 aa, Influenza virus
SRSGFEMLK

SEQ ID NO: 310739 - protein, 9 aa, Influenza virus
RSGFEMLKI

SEQ ID NO: 310740 - protein, 9 aa, Influenza virus
SGFEMLKIP

SEQ ID NO: 310741 - protein, 9 aa, Influenza virus
GFEMLKIPN

SEQ ID NO: 310742 - protein, 9 aa, Influenza virus
FEMLKIPNA

SEQ ID NO: 310743 - protein, 9 aa, Influenza virus
EMLKIPNAG

SEQ ID NO: 310744 - protein, 9 aa, Influenza virus
LKIPNAGTD

SEQ ID NO: 310745 - protein, 9 aa, Influenza virus
KIPNAGTDP

SEQ ID NO: 310746 - protein, 9 aa, Influenza virus
NWSGYSGSF

SEQ ID NO: 310747 - protein, 9 aa, Influenza virus
WSGYSGSFI

SEQ ID NO: 310748 - protein, 9 aa, Influenza virus
SGYSGSFID

SEQ ID NO: 310749 - protein, 9 aa, Influenza virus
GYSGSFIDY

SEQ ID NO: 310750 - protein, 9 aa, Influenza virus
YSGSFIDYW

SEQ ID NO: 310751 - protein, 9 aa, Influenza virus
SGSFIDYWD

SEQ ID NO: 310752 - protein, 9 aa, Influenza virus
GSFIDYWDE

SEQ ID NO: 310753 - protein, 9 aa, Influenza virus
SECYNPCFY

SEQ ID NO: 310754 - protein, 9 aa, Influenza virus
ECYNPCFYV

SEQ ID NO: 310755 - protein, 9 aa, Influenza virus
CYNPCFYVE

SEQ ID NO: 310756 - protein, 9 aa, Influenza virus
YNPCFYVEL

SEQ ID NO: 310757 - protein, 9 aa, Influenza virus
NPCFYVELI

SEQ ID NO: 310758 - protein, 9 aa, Influenza virus
PCFYVELIR

SEQ ID NO: 310759 - protein, 9 aa, Influenza virus
CFYVELIRG

SEQ ID NO: 310760 - protein, 9 aa, Influenza virus
FYVELIRGR

SEQ ID NO: 310761 - protein, 9 aa, Influenza virus
YVELIRGRP

SEQ ID NO: 310762 - protein, 9 aa, Influenza virus
VELIRGRPE

SEQ ID NO: 310763 - protein, 9 aa, Influenza virus
ELIRGRPEE

SEQ ID NO: 310764 - protein, 9 aa, Influenza virus
LIRGRPEEA

SEQ ID NO: 310765 - protein, 9 aa, Influenza virus
IRGRPEEAK

SEQ ID NO: 310766 - protein, 9 aa, Influenza virus
RGRPEEAKY

SEQ ID NO: 310767 - protein, 9 aa, Influenza virus
GRPEEAKYV

SEQ ID NO: 310768 - protein, 9 aa, Influenza virus
RPEEAKYVW

SEQ ID NO: 310769 - protein, 9 aa, Influenza virus
PEEAKYVWW

SEQ ID NO: 310770 - protein, 9 aa, Influenza virus
EEAKYVWWT

SEQ ID NO: 310771 - protein, 9 aa, Influenza virus
EAKYVWWTS

SEQ ID NO: 310772 - protein, 9 aa, Influenza virus
AKYVWWTSN

SEQ ID NO: 310773 - protein, 9 aa, Influenza virus
KYVWWTSNS

SEQ ID NO: 310774 - protein, 9 aa, Influenza virus
YVWWTSNSL

SEQ ID NO: 310775 - protein, 9 aa, Influenza virus
VWWTSNSLV

SEQ ID NO: 310776 - protein, 9 aa, Influenza virus
WWTSNSLVA

SEQ ID NO: 310777 - protein, 9 aa, Influenza virus
WTSNSLVAL

SEQ ID NO: 310778 - protein, 9 aa, Influenza virus
TSNSLVALC

SEQ ID NO: 310779 - protein, 9 aa, Influenza virus
SNSLVALCG

SEQ ID NO: 310780 - protein, 9 aa, Influenza virus
NSLVALCGS

SEQ ID NO: 310781 - protein, 9 aa, Influenza virus
SLVALCGSP

SEQ ID NO: 310782 - protein, 9 aa, Influenza virus
LVALCGSPI

SEQ ID NO: 310783 - protein, 9 aa, Influenza virus
SVGSGSFPD

SEQ ID NO: 310784 - protein, 9 aa, Influenza virus
VGSGSFPDG

SEQ ID NO: 310785 - protein, 9 aa, Influenza virus
GSGSFPDGA

SEQ ID NO: 310786 - protein, 9 aa, Influenza virus
SGSFPDGAQ

SEQ ID NO: 310787 - protein, 9 aa, Influenza virus
GSFPDGAQI

SEQ ID NO: 310788 - protein, 9 aa, Influenza virus
SFPDGAQIQ

SEQ ID NO: 310789 - protein, 9 aa, Influenza virus
FPDGAQIQY

SEQ ID NO: 310790 - protein, 9 aa, Influenza virus
PDGAQIQYF

SEQ ID NO: 310791 - protein, 9 aa, Influenza virus
DGAQIQYFS

SEQ ID NO: 310792 - protein, 9 aa, Influenza virus
EYNETVRVE

SEQ ID NO: 310793 - protein, 9 aa, Influenza virus
KGFAPFSKD

SEQ ID NO: 310794 - protein, 9 aa, Influenza virus
GFAPFSKDN

SEQ ID NO: 310795 - protein, 9 aa, Influenza virus
FAPFSKDNG

SEQ ID NO: 310796 - protein, 9 aa, Influenza virus
APFSKDNGI

SEQ ID NO: 310797 - protein, 9 aa, Influenza virus
PFSKDNGIR

SEQ ID NO: 310798 - protein, 9 aa, Influenza virus
FSKDNGIRI

SEQ ID NO: 310799 - protein, 9 aa, Influenza virus
SKDNGIRIG

SEQ ID NO: 310800 - protein, 9 aa, Influenza virus
KDNGIRIGS

SEQ ID NO: 310801 - protein, 9 aa, Influenza virus
DNGIRIGSR

SEQ ID NO: 310802 - protein, 9 aa, Influenza virus
NGIRIGSRG

SEQ ID NO: 310803 - protein, 9 aa, Influenza virus
GIRIGSRGH

SEQ ID NO: 310804 - protein, 9 aa, Influenza virus
IRIGSRGHV

SEQ ID NO: 310805 - protein, 9 aa, Influenza virus
RIGSRGHVF

SEQ ID NO: 310806 - protein, 9 aa, Influenza virus
IGSRGHVFV

SEQ ID NO: 310807 - protein, 9 aa, Influenza virus
GSRGHVFVI

SEQ ID NO: 310808 - protein, 9 aa, Influenza virus
SRGHVFVIR

SEQ ID NO: 310809 - protein, 9 aa, Influenza virus
RGHVFVIRE

SEQ ID NO: 310810 - protein, 9 aa, Influenza virus
GHVFVIREP

SEQ ID NO: 310811 - protein, 9 aa, Influenza virus
HVFVIREPF

SEQ ID NO: 310812 - protein, 9 aa, Influenza virus
VFVIREPFV

SEQ ID NO: 310813 - protein, 9 aa, Influenza virus
FVIREPFVS

SEQ ID NO: 310814 - protein, 9 aa, Influenza virus
VIREPFVSC

SEQ ID NO: 310815 - protein, 9 aa, Influenza virus
IREPFVSCS

SEQ ID NO: 310816 - protein, 9 aa, Influenza virus
REPFVSCSP

SEQ ID NO: 310817 - protein, 9 aa, Influenza virus
ECRTFFLTQ

SEQ ID NO: 310818 - protein, 9 aa, Influenza virus
CRTFFLTQG

SEQ ID NO: 310819 - protein, 9 aa, Influenza virus
RTFFLTQGS

SEQ ID NO: 310820 - protein, 9 aa, Influenza virus
TFFLTQGSL

SEQ ID NO: 310821 - protein, 9 aa, Influenza virus
FFLTQGSLL

SEQ ID NO: 310822 - protein, 9 aa, Influenza virus
FLTQGSLLN

SEQ ID NO: 310823 - protein, 9 aa, Influenza virus
LTQGSLLND

SEQ ID NO: 310824 - protein, 9 aa, Influenza virus
TQGSLLNDK

SEQ ID NO: 310825 - protein, 9 aa, Influenza virus
QGSLLNDKH

SEQ ID NO: 310826 - protein, 9 aa, Influenza virus
GSLLNDKHS

SEQ ID NO: 310827 - protein, 9 aa, Influenza virus
SLLNDKHSN

SEQ ID NO: 310828 - protein, 9 aa, Influenza virus
LLNDKHSNG

SEQ ID NO: 310829 - protein, 9 aa, Influenza virus
LNDKHSNGT

SEQ ID NO: 310830 - protein, 9 aa, Influenza virus
NDKHSNGTV

SEQ ID NO: 310831 - protein, 9 aa, Influenza virus
DKHSNGTVK

SEQ ID NO: 310832 - protein, 9 aa, Influenza virus
KHSNGTVKD

SEQ ID NO: 310833 - protein, 9 aa, Influenza virus
HSNGTVKDR

SEQ ID NO: 310834 - protein, 9 aa, Influenza virus
SNGTVKDRS

SEQ ID NO: 310835 - protein, 9 aa, Influenza virus
NGTVKDRSP

SEQ ID NO: 310836 - protein, 9 aa, Influenza virus
GTVKDRSPY

SEQ ID NO: 310837 - protein, 9 aa, Influenza virus
TVKDRSPYR

SEQ ID NO: 310838 - protein, 9 aa, Influenza virus
VKDRSPYRT

SEQ ID NO: 310839 - protein, 9 aa, Influenza virus
KDRSPYRTL

SEQ ID NO: 310840 - protein, 9 aa, Influenza virus
DRSPYRTLM

SEQ ID NO: 310841 - protein, 9 aa, Influenza virus
RSPYRTLMS

SEQ ID NO: 310842 - protein, 9 aa, Influenza virus
SPYRTLMSV

SEQ ID NO: 310843 - protein, 9 aa, Influenza virus
PYRTLMSVE

SEQ ID NO: 310844 - protein, 9 aa, Influenza virus
RTLMSVEIG

SEQ ID NO: 310845 - protein, 9 aa, Influenza virus
TLMSVEIGQ

SEQ ID NO: 310846 - protein, 9 aa, Influenza virus
IGQSPNVYQ

SEQ ID NO: 310847 - protein, 9 aa, Influenza virus
GQSPNVYQA

SEQ ID NO: 310848 - protein, 9 aa, Influenza virus
QSPNVYQAR

SEQ ID NO: 310849 - protein, 9 aa, Influenza virus
SPNVYQARF

SEQ ID NO: 310850 - protein, 9 aa, Influenza virus
PNVYQARFE

SEQ ID NO: 310851 - protein, 9 aa, Influenza virus
NVYQARFEA

SEQ ID NO: 310852 - protein, 9 aa, Influenza virus
VYQARFEAV

SEQ ID NO: 310853 - protein, 9 aa, Influenza virus
YQARFEAVA

SEQ ID NO: 310854 - protein, 9 aa, Influenza virus
QARFEAVAW

SEQ ID NO: 310855 - protein, 9 aa, Influenza virus
ARFEAVAWS

SEQ ID NO: 310856 - protein, 9 aa, Influenza virus
RFEAVAWSA

SEQ ID NO: 310857 - protein, 9 aa, Influenza virus
FEAVAWSAT

SEQ ID NO: 310858 - protein, 9 aa, Influenza virus
EAVAWSATA

SEQ ID NO: 310859 - protein, 9 aa, Influenza virus
AVAWSATAC

SEQ ID NO: 310860 - protein, 9 aa, Influenza virus
VAWSATACH

SEQ ID NO: 310861 - protein, 9 aa, Influenza virus
AWSATACHD

SEQ ID NO: 310862 - protein, 9 aa, Influenza virus
WSATACHDG

SEQ ID NO: 310863 - protein, 9 aa, Influenza virus
SATACHDGK

SEQ ID NO: 310864 - protein, 9 aa, Influenza virus
ATACHDGKK

SEQ ID NO: 310865 - protein, 9 aa, Influenza virus
TACHDGKKW

SEQ ID NO: 310866 - protein, 9 aa, Influenza virus
ACHDGKKWM

SEQ ID NO: 310867 - protein, 9 aa, Influenza virus
CHDGKKWMT

SEQ ID NO: 310868 - protein, 9 aa, Influenza virus
SWAGDILRT

SEQ ID NO: 310869 - protein, 9 aa, Influenza virus
GDILRTQES

SEQ ID NO: 310870 - protein, 9 aa, Influenza virus
DILRTQESS

SEQ ID NO: 310871 - protein, 9 aa, Influenza virus
ILRTQESSC

SEQ ID NO: 310872 - protein, 9 aa, Influenza virus
LRTQESSCT

SEQ ID NO: 310873 - protein, 9 aa, Influenza virus
RTQESSCTC

SEQ ID NO: 310874 - protein, 9 aa, Influenza virus
TQESSCTCI

SEQ ID NO: 310875 - protein, 9 aa, Influenza virus
QESSCTCIQ

SEQ ID NO: 310876 - protein, 9 aa, Influenza virus
ESSCTCIQG

SEQ ID NO: 310877 - protein, 9 aa, Influenza virus
GECYWVMTD

SEQ ID NO: 310878 - protein, 9 aa, Influenza virus
ECYWVMTDG

SEQ ID NO: 310879 - protein, 9 aa, Influenza virus
CYWVMTDGP

SEQ ID NO: 310880 - protein, 9 aa, Influenza virus
YWVMTDGPA

SEQ ID NO: 310881 - protein, 9 aa, Influenza virus
WVMTDGPAN

SEQ ID NO: 310882 - protein, 9 aa, Influenza virus
VMTDGPANR

SEQ ID NO: 310883 - protein, 9 aa, Influenza virus
MTDGPANRQ

SEQ ID NO: 310884 - protein, 9 aa, Influenza virus
TDGPANRQA

SEQ ID NO: 310885 - protein, 9 aa, Influenza virus
FNGGHIEEC

SEQ ID NO: 310886 - protein, 9 aa, Influenza virus
NGGHIEECS

SEQ ID NO: 310887 - protein, 9 aa, Influenza virus
GGHIEECSC

SEQ ID NO: 310888 - protein, 9 aa, Influenza virus
GHIEECSCY

SEQ ID NO: 310889 - protein, 9 aa, Influenza virus
HIEECSCYP

SEQ ID NO: 310890 - protein, 9 aa, Influenza virus
IEECSCYPN

SEQ ID NO: 310891 - protein, 9 aa, Influenza virus
EECSCYPNE

SEQ ID NO: 310892 - protein, 9 aa, Influenza virus
ECSCYPNEG

SEQ ID NO: 310893 - protein, 9 aa, Influenza virus
CSCYPNEGK

SEQ ID NO: 310894 - protein, 9 aa, Influenza virus
SCYPNEGKV

SEQ ID NO: 310895 - protein, 9 aa, Influenza virus
CYPNEGKVE

SEQ ID NO: 310896 - protein, 9 aa, Influenza virus
YPNEGKVEC

SEQ ID NO: 310897 - protein, 9 aa, Influenza virus
PNEGKVECV

SEQ ID NO: 310898 - protein, 9 aa, Influenza virus
NEGKVECVC

SEQ ID NO: 310899 - protein, 9 aa, Influenza virus
EGKVECVCR

SEQ ID NO: 310900 - protein, 9 aa, Influenza virus
GKVECVCRD

SEQ ID NO: 310901 - protein, 9 aa, Influenza virus
KVECVCRDN

SEQ ID NO: 310902 - protein, 9 aa, Influenza virus
VECVCRDNW

SEQ ID NO: 310903 - protein, 9 aa, Influenza virus
ECVCRDNWT

SEQ ID NO: 310904 - protein, 9 aa, Influenza virus
CVCRDNWTG

SEQ ID NO: 310905 - protein, 9 aa, Influenza virus
VCRDNWTGT

SEQ ID NO: 310906 - protein, 9 aa, Influenza virus
CRDNWTGTN

SEQ ID NO: 310907 - protein, 9 aa, Influenza virus
RDNWTGTNR

SEQ ID NO: 310908 - protein, 9 aa, Influenza virus
DNWTGTNRP

SEQ ID NO: 310909 - protein, 9 aa, Influenza virus
NWTGTNRPV

SEQ ID NO: 310910 - protein, 9 aa, Influenza virus
WTGTNRPVL

SEQ ID NO: 310911 - protein, 9 aa, Influenza virus
TGTNRPVLV

SEQ ID NO: 310912 - protein, 9 aa, Influenza virus
GTNRPVLVI

SEQ ID NO: 310913 - protein, 9 aa, Influenza virus
TNRPVLVIS

SEQ ID NO: 310914 - protein, 9 aa, Influenza virus
LVISPDLSY

SEQ ID NO: 310915 - protein, 9 aa, Influenza virus
LSYRVGYLC

SEQ ID NO: 310916 - protein, 9 aa, Influenza virus
SYRVGYLCA

SEQ ID NO: 310917 - protein, 9 aa, Influenza virus
YRVGYLCAG

SEQ ID NO: 310918 - protein, 9 aa, Influenza virus
VGYLCAGLP

SEQ ID NO: 310919 - protein, 9 aa, Influenza virus
GYLCAGLPS

SEQ ID NO: 310920 - protein, 9 aa, Influenza virus
YLCAGLPSD

SEQ ID NO: 310921 - protein, 9 aa, Influenza virus
LCAGLPSDT

SEQ ID NO: 310922 - protein, 9 aa, Influenza virus
CAGLPSDTP

SEQ ID NO: 310923 - protein, 9 aa, Influenza virus
AGLPSDTPR

SEQ ID NO: 310924 - protein, 9 aa, Influenza virus
GLPSDTPRG

SEQ ID NO: 310925 - protein, 9 aa, Influenza virus
LPSDTPRGE

SEQ ID NO: 310926 - protein, 9 aa, Influenza virus
PSDTPRGED

SEQ ID NO: 310927 - protein, 9 aa, Influenza virus
SDTPRGEDS

SEQ ID NO: 310928 - protein, 9 aa, Influenza virus
DTPRGEDSQ

SEQ ID NO: 310929 - protein, 9 aa, Influenza virus
TPRGEDSQF

SEQ ID NO: 310930 - protein, 9 aa, Influenza virus
QGYGVKGFG

SEQ ID NO: 310931 - protein, 9 aa, Influenza virus
GYGVKGFGF

SEQ ID NO: 310932 - protein, 9 aa, Influenza virus
YGVKGFGFR

SEQ ID NO: 310933 - protein, 9 aa, Influenza virus
GVKGFGFRQ

SEQ ID NO: 310934 - protein, 9 aa, Influenza virus
VKGFGFRQG

SEQ ID NO: 310935 - protein, 9 aa, Influenza virus
KGFGFRQGN

SEQ ID NO: 310936 - protein, 9 aa, Influenza virus
GFGFRQGND

SEQ ID NO: 310937 - protein, 9 aa, Influenza virus
FGFRQGNDV

SEQ ID NO: 310938 - protein, 9 aa, Influenza virus
GFRQGNDVW

SEQ ID NO: 310939 - protein, 9 aa, Influenza virus
DNLNWSGYS

SEQ ID NO: 310940 - protein, 9 aa, Influenza virus
NLNWSGYSG

SEQ ID NO: 310941 - protein, 9 aa, Influenza virus
LNWSGYSGS

SEQ ID NO: 310942 - protein, 9 aa, Influenza virus
NWSGYSGSF

SEQ ID NO: 310943 - protein, 9 aa, Influenza virus
WSGYSGSFT

SEQ ID NO: 310944 - protein, 9 aa, Influenza virus
SGYSGSFTL

SEQ ID NO: 310945 - protein, 9 aa, Influenza virus
GYSGSFTLP

SEQ ID NO: 310946 - protein, 9 aa, Influenza virus
YSGSFTLPV

SEQ ID NO: 310947 - protein, 9 aa, Influenza virus
SGSFTLPVE

SEQ ID NO: 310948 - protein, 9 aa, Influenza virus
GSFTLPVEL

SEQ ID NO: 310949 - protein, 9 aa, Influenza virus
NCLVPCFWV

SEQ ID NO: 310950 - protein, 9 aa, Influenza virus
CLVPCFWVE

SEQ ID NO: 310951 - protein, 9 aa, Influenza virus
LVPCFWVEM

SEQ ID NO: 310952 - protein, 9 aa, Influenza virus
VPCFWVEMI

SEQ ID NO: 310953 - protein, 9 aa, Influenza virus
PCFWVEMIR

SEQ ID NO: 310954 - protein, 9 aa, Influenza virus
CFWVEMIRG

SEQ ID NO: 310955 - protein, 9 aa, Influenza virus
FWVEMIRGK

SEQ ID NO: 310956 - protein, 9 aa, Influenza virus
WVEMIRGKP

SEQ ID NO: 310957 - protein, 9 aa, Influenza virus
VEMIRGKPE

SEQ ID NO: 310958 - protein, 9 aa, Influenza virus
EMIRGKPEE

SEQ ID NO: 310959 - protein, 9 aa, Influenza virus
TIWTSSSSI

SEQ ID NO: 310960 - protein, 9 aa, Influenza virus
IWTSSSSIV

SEQ ID NO: 310961 - protein, 9 aa, Influenza virus
WTSSSSIVM

SEQ ID NO: 310962 - protein, 9 aa, Influenza virus
TSSSSIVMC

SEQ ID NO: 310963 - protein, 9 aa, Influenza virus
SSSSIVMCG

SEQ ID NO: 310964 - protein, 9 aa, Influenza virus
SSSIVMCGV

SEQ ID NO: 310965 - protein, 9 aa, Influenza virus
SSIVMCGVD

SEQ ID NO: 310966 - protein, 9 aa, Influenza virus
SIVMCGVDH

SEQ ID NO: 310967 - protein, 9 aa, Influenza virus
ADWSWHDGA

SEQ ID NO: 310968 - protein, 9 aa, Influenza virus
DWSWHDGAI

SEQ ID NO: 310969 - protein, 9 aa, Influenza virus
WSWHDGAIL

SEQ ID NO: 310970 - protein, 9 aa, Influenza virus
SWHDGAILP

SEQ ID NO: 310971 - protein, 9 aa, Influenza virus
WHDGAILPF

SEQ ID NO: 310972 - protein, 9 aa, Influenza virus
DGAILPFDI

SEQ ID NO: 310973 - protein, 9 aa, Influenza virus
LPFDIDKII

SEQ ID NO: 310974 - protein, 9 aa, Influenza virus
PFDIDKIIT

SEQ ID NO: 310975 - protein, 9 aa, Influenza virus
MNPNQKILC

SEQ ID NO: 310976 - protein, 9 aa, Influenza virus
NPNQKILCT

SEQ ID NO: 310977 - protein, 9 aa, Influenza virus
PNQKILCTS

SEQ ID NO: 310978 - protein, 9 aa, Influenza virus
NQKILCTSA

SEQ ID NO: 310979 - protein, 9 aa, Influenza virus
QKILCTSAT

SEQ ID NO: 310980 - protein, 9 aa, Influenza virus
KILCTSATA

SEQ ID NO: 310981 - protein, 9 aa, Influenza virus
ILCTSATAI

SEQ ID NO: 310982 - protein, 9 aa, Influenza virus
ANLGLNIGL

SEQ ID NO: 310983 - protein, 9 aa, Influenza virus
NLGLNIGLH

SEQ ID NO: 310984 - protein, 9 aa, Influenza virus
LGLNIGLHL

SEQ ID NO: 310985 - protein, 9 aa, Influenza virus
GLNIGLHLK

SEQ ID NO: 310986 - protein, 9 aa, Influenza virus
LNIGLHLKP

SEQ ID NO: 310987 - protein, 9 aa, Influenza virus
SQTIINNYY

SEQ ID NO: 310988 - protein, 9 aa, Influenza virus
QTIINNYYN

SEQ ID NO: 310989 - protein, 9 aa, Influenza virus
TIINNYYNE

SEQ ID NO: 310990 - protein, 9 aa, Influenza virus
IINNYYNET

SEQ ID NO: 310991 - protein, 9 aa, Influenza virus
INNYYNETN

SEQ ID NO: 310992 - protein, 9 aa, Influenza virus
ITQISNTNI

SEQ ID NO: 310993 - protein, 9 aa, Influenza virus
FNNLTKGLC

SEQ ID NO: 310994 - protein, 9 aa, Influenza virus
NNLTKGLCT

SEQ ID NO: 310995 - protein, 9 aa, Influenza virus
NLTKGLCTI

SEQ ID NO: 310996 - protein, 9 aa, Influenza virus
LTKGLCTIN

SEQ ID NO: 310997 - protein, 9 aa, Influenza virus
TKGLCTINS

SEQ ID NO: 310998 - protein, 9 aa, Influenza virus
KGLCTINSW

SEQ ID NO: 310999 - protein, 9 aa, Influenza virus
GLCTINSWH

SEQ ID NO: 311000 - protein, 9 aa, Influenza virus
LCTINSWHI

SEQ ID NO: 311001 - protein, 9 aa, Influenza virus
CTINSWHIY

SEQ ID NO: 311002 - protein, 9 aa, Influenza virus
TINSWHIYG

SEQ ID NO: 311003 - protein, 9 aa, Influenza virus
INSWHIYGK

SEQ ID NO: 311004 - protein, 9 aa, Influenza virus
NSWHIYGKD

SEQ ID NO: 311005 - protein, 9 aa, Influenza virus
SWHIYGKDN

SEQ ID NO: 311006 - protein, 9 aa, Influenza virus
WHIYGKDNA

SEQ ID NO: 311007 - protein, 9 aa, Influenza virus
HIYGKDNAV

SEQ ID NO: 311008 - protein, 9 aa, Influenza virus
IYGKDNAVR

SEQ ID NO: 311009 - protein, 9 aa, Influenza virus
YGKDNAVRI

SEQ ID NO: 311010 - protein, 9 aa, Influenza virus
GKDNAVRIG

SEQ ID NO: 311011 - protein, 9 aa, Influenza virus
KDNAVRIGE

SEQ ID NO: 311012 - protein, 9 aa, Influenza virus
DNAVRIGED

SEQ ID NO: 311013 - protein, 9 aa, Influenza virus
NAVRIGEDS

SEQ ID NO: 311014 - protein, 9 aa, Influenza virus
RIGEDSDVL

SEQ ID NO: 311015 - protein, 9 aa, Influenza virus
IGEDSDVLV

SEQ ID NO: 311016 - protein, 9 aa, Influenza virus
GEDSDVLVT

SEQ ID NO: 311017 - protein, 9 aa, Influenza virus
EDSDVLVTR

SEQ ID NO: 311018 - protein, 9 aa, Influenza virus
DSDVLVTRE

SEQ ID NO: 311019 - protein, 9 aa, Influenza virus
SDVLVTREP

SEQ ID NO: 311020 - protein, 9 aa, Influenza virus
DVLVTREPY

SEQ ID NO: 311021 - protein, 9 aa, Influenza virus
VLVTREPYV

SEQ ID NO: 311022 - protein, 9 aa, Influenza virus
LVTREPYVS

SEQ ID NO: 311023 - protein, 9 aa, Influenza virus
VTREPYVSC

SEQ ID NO: 311024 - protein, 9 aa, Influenza virus
TREPYVSCD

SEQ ID NO: 311025 - protein, 9 aa, Influenza virus
REPYVSCDP

SEQ ID NO: 311026 - protein, 9 aa, Influenza virus
EPYVSCDPD

SEQ ID NO: 311027 - protein, 9 aa, Influenza virus
PYVSCDPDE

SEQ ID NO: 311028 - protein, 9 aa, Influenza virus
YVSCDPDEC

SEQ ID NO: 311029 - protein, 9 aa, Influenza virus
VSCDPDECR

SEQ ID NO: 311030 - protein, 9 aa, Influenza virus
SCDPDECRF

SEQ ID NO: 311031 - protein, 9 aa, Influenza virus
CDPDECRFY

SEQ ID NO: 311032 - protein, 9 aa, Influenza virus
DPDECRFYA

SEQ ID NO: 311033 - protein, 9 aa, Influenza virus
PDECRFYAL

SEQ ID NO: 311034 - protein, 9 aa, Influenza virus
DECRFYALS

SEQ ID NO: 311035 - protein, 9 aa, Influenza virus
ECRFYALSQ

SEQ ID NO: 311036 - protein, 9 aa, Influenza virus
CRFYALSQG

SEQ ID NO: 311037 - protein, 9 aa, Influenza virus
RFYALSQGT

SEQ ID NO: 311038 - protein, 9 aa, Influenza virus
FYALSQGTT

SEQ ID NO: 311039 - protein, 9 aa, Influenza virus
YALSQGTTI

SEQ ID NO: 311040 - protein, 9 aa, Influenza virus
ALSQGTTIR

SEQ ID NO: 311041 - protein, 9 aa, Influenza virus
LSQGTTIRG

SEQ ID NO: 311042 - protein, 9 aa, Influenza virus
SQGTTIRGK

SEQ ID NO: 311043 - protein, 9 aa, Influenza virus
QGTTIRGKH

SEQ ID NO: 311044 - protein, 9 aa, Influenza virus
GTTIRGKHS

SEQ ID NO: 311045 - protein, 9 aa, Influenza virus
TTIRGKHSN

SEQ ID NO: 311046 - protein, 9 aa, Influenza virus
TIRGKHSNG

SEQ ID NO: 311047 - protein, 9 aa, Influenza virus
IRGKHSNGT

SEQ ID NO: 311048 - protein, 9 aa, Influenza virus
RGKHSNGTI

SEQ ID NO: 311049 - protein, 9 aa, Influenza virus
GKHSNGTIH

SEQ ID NO: 311050 - protein, 9 aa, Influenza virus
KHSNGTIHD

SEQ ID NO: 311051 - protein, 9 aa, Influenza virus
HSNGTIHDR

SEQ ID NO: 311052 - protein, 9 aa, Influenza virus
SNGTIHDRS

SEQ ID NO: 311053 - protein, 9 aa, Influenza virus
NGTIHDRSQ

SEQ ID NO: 311054 - protein, 9 aa, Influenza virus
GTIHDRSQY

SEQ ID NO: 311055 - protein, 9 aa, Influenza virus
TIHDRSQYR

SEQ ID NO: 311056 - protein, 9 aa, Influenza virus
IHDRSQYRA

SEQ ID NO: 311057 - protein, 9 aa, Influenza virus
HDRSQYRAL

SEQ ID NO: 311058 - protein, 9 aa, Influenza virus
DRSQYRALI

SEQ ID NO: 311059 - protein, 9 aa, Influenza virus
RSQYRALIS

SEQ ID NO: 311060 - protein, 9 aa, Influenza virus
SQYRALISW

SEQ ID NO: 311061 - protein, 9 aa, Influenza virus
QYRALISWP

SEQ ID NO: 311062 - protein, 9 aa, Influenza virus
YRALISWPL

SEQ ID NO: 311063 - protein, 9 aa, Influenza virus
RALISWPLS

SEQ ID NO: 311064 - protein, 9 aa, Influenza virus
ALISWPLSS

SEQ ID NO: 311065 - protein, 9 aa, Influenza virus
LISWPLSSP

SEQ ID NO: 311066 - protein, 9 aa, Influenza virus
ISWPLSSPP

SEQ ID NO: 311067 - protein, 9 aa, Influenza virus
SWPLSSPPT

SEQ ID NO: 311068 - protein, 9 aa, Influenza virus
WPLSSPPTV

SEQ ID NO: 311069 - protein, 9 aa, Influenza virus
PLSSPPTVY

SEQ ID NO: 311070 - protein, 9 aa, Influenza virus
LSSPPTVYN

SEQ ID NO: 311071 - protein, 9 aa, Influenza virus
SSPPTVYNS

SEQ ID NO: 311072 - protein, 9 aa, Influenza virus
SPPTVYNSR

SEQ ID NO: 311073 - protein, 9 aa, Influenza virus
RVECIGWSS

SEQ ID NO: 311074 - protein, 9 aa, Influenza virus
VECIGWSST

SEQ ID NO: 311075 - protein, 9 aa, Influenza virus
ECIGWSSTS

SEQ ID NO: 311076 - protein, 9 aa, Influenza virus
CIGWSSTSC

SEQ ID NO: 311077 - protein, 9 aa, Influenza virus
IGWSSTSCH

SEQ ID NO: 311078 - protein, 9 aa, Influenza virus
GWSSTSCHD

SEQ ID NO: 311079 - protein, 9 aa, Influenza virus
WSSTSCHDG

SEQ ID NO: 311080 - protein, 9 aa, Influenza virus
SSTSCHDGR

SEQ ID NO: 311081 - protein, 9 aa, Influenza virus
STSCHDGRA

SEQ ID NO: 311082 - protein, 9 aa, Influenza virus
TSCHDGRAR

SEQ ID NO: 311083 - protein, 9 aa, Influenza virus
SCHDGRARM

SEQ ID NO: 311084 - protein, 9 aa, Influenza virus
CHDGRARMS

SEQ ID NO: 311085 - protein, 9 aa, Influenza virus
RMSICISGP

SEQ ID NO: 311086 - protein, 9 aa, Influenza virus
MSICISGPN

SEQ ID NO: 311087 - protein, 9 aa, Influenza virus
SICISGPNN

SEQ ID NO: 311088 - protein, 9 aa, Influenza virus
ICISGPNNN

SEQ ID NO: 311089 - protein, 9 aa, Influenza virus
CISGPNNNA

SEQ ID NO: 311090 - protein, 9 aa, Influenza virus
ISGPNNNAS

SEQ ID NO: 311091 - protein, 9 aa, Influenza virus
SGPNNNASA

SEQ ID NO: 311092 - protein, 9 aa, Influenza virus
GPNNNASAV

SEQ ID NO: 311093 - protein, 9 aa, Influenza virus
PNNNASAVI

SEQ ID NO: 311094 - protein, 9 aa, Influenza virus
NNNASAVIW

SEQ ID NO: 311095 - protein, 9 aa, Influenza virus
NNASAVIWY

SEQ ID NO: 311096 - protein, 9 aa, Influenza virus
NASAVIWYN

SEQ ID NO: 311097 - protein, 9 aa, Influenza virus
RRPVTEINT

SEQ ID NO: 311098 - protein, 9 aa, Influenza virus
RPVTEINTW

SEQ ID NO: 311099 - protein, 9 aa, Influenza virus
PVTEINTWA

SEQ ID NO: 311100 - protein, 9 aa, Influenza virus
VTEINTWAR

SEQ ID NO: 311101 - protein, 9 aa, Influenza virus
TEINTWARN

SEQ ID NO: 311102 - protein, 9 aa, Influenza virus
EINTWARNI

SEQ ID NO: 311103 - protein, 9 aa, Influenza virus
INTWARNIL

SEQ ID NO: 311104 - protein, 9 aa, Influenza virus
NTWARNILR

SEQ ID NO: 311105 - protein, 9 aa, Influenza virus
TWARNILRT

SEQ ID NO: 311106 - protein, 9 aa, Influenza virus
WARNILRTQ

SEQ ID NO: 311107 - protein, 9 aa, Influenza virus
ARNILRTQE

SEQ ID NO: 311108 - protein, 9 aa, Influenza virus
RNILRTQES

SEQ ID NO: 311109 - protein, 9 aa, Influenza virus
NILRTQESE

SEQ ID NO: 311110 - protein, 9 aa, Influenza virus
ILRTQESEC

SEQ ID NO: 311111 - protein, 9 aa, Influenza virus
LRTQESECV

SEQ ID NO: 311112 - protein, 9 aa, Influenza virus
RTQESECVC

SEQ ID NO: 311113 - protein, 9 aa, Influenza virus
TQESECVCH

SEQ ID NO: 311114 - protein, 9 aa, Influenza virus
QESECVCHN

SEQ ID NO: 311115 - protein, 9 aa, Influenza virus
ESECVCHNG

SEQ ID NO: 311116 - protein, 9 aa, Influenza virus
SECVCHNGV

SEQ ID NO: 311117 - protein, 9 aa, Influenza virus
ECVCHNGVC

SEQ ID NO: 311118 - protein, 9 aa, Influenza virus
CVCHNGVCP

SEQ ID NO: 311119 - protein, 9 aa, Influenza virus
VCHNGVCPV

SEQ ID NO: 311120 - protein, 9 aa, Influenza virus
CHNGVCPVV

SEQ ID NO: 311121 - protein, 9 aa, Influenza virus
HNGVCPVVF

SEQ ID NO: 311122 - protein, 9 aa, Influenza virus
NGVCPVVFT

SEQ ID NO: 311123 - protein, 9 aa, Influenza virus
GVCPVVFTD

SEQ ID NO: 311124 - protein, 9 aa, Influenza virus
VCPVVFTDG

SEQ ID NO: 311125 - protein, 9 aa, Influenza virus
CPVVFTDGS

SEQ ID NO: 311126 - protein, 9 aa, Influenza virus
PVVFTDGSA

SEQ ID NO: 311127 - protein, 9 aa, Influenza virus
VVFTDGSAT

SEQ ID NO: 311128 - protein, 9 aa, Influenza virus
VFTDGSATG

SEQ ID NO: 311129 - protein, 9 aa, Influenza virus
FTDGSATGP

SEQ ID NO: 311130 - protein, 9 aa, Influenza virus
TDGSATGPA

SEQ ID NO: 311131 - protein, 9 aa, Influenza virus
DGSATGPAE

SEQ ID NO: 311132 - protein, 9 aa, Influenza virus
GSATGPAET

SEQ ID NO: 311133 - protein, 9 aa, Influenza virus
SATGPAETR

SEQ ID NO: 311134 - protein, 9 aa, Influenza virus
ATGPAETRV

SEQ ID NO: 311135 - protein, 9 aa, Influenza virus
TGPAETRVY

SEQ ID NO: 311136 - protein, 9 aa, Influenza virus
GPAETRVYY

SEQ ID NO: 311137 - protein, 9 aa, Influenza virus
PAETRVYYF

SEQ ID NO: 311138 - protein, 9 aa, Influenza virus
TRVYYFKEG

SEQ ID NO: 311139 - protein, 9 aa, Influenza virus
GKILKWEPL

SEQ ID NO: 311140 - protein, 9 aa, Influenza virus
KWEPLTGTA

SEQ ID NO: 311141 - protein, 9 aa, Influenza virus
LTGTAKHIE

SEQ ID NO: 311142 - protein, 9 aa, Influenza virus
TGTAKHIEE

SEQ ID NO: 311143 - protein, 9 aa, Influenza virus
GTAKHIEEC

SEQ ID NO: 311144 - protein, 9 aa, Influenza virus
TAKHIEECS

SEQ ID NO: 311145 - protein, 9 aa, Influenza virus
AKHIEECSC

SEQ ID NO: 311146 - protein, 9 aa, Influenza virus
KHIEECSCY

SEQ ID NO: 311147 - protein, 9 aa, Influenza virus
HIEECSCYG

SEQ ID NO: 311148 - protein, 9 aa, Influenza virus
IEECSCYGE

SEQ ID NO: 311149 - protein, 9 aa, Influenza virus
ITCTCRDNW

SEQ ID NO: 311150 - protein, 9 aa, Influenza virus
TCTCRDNWQ

SEQ ID NO: 311151 - protein, 9 aa, Influenza virus
CTCRDNWQG

SEQ ID NO: 311152 - protein, 9 aa, Influenza virus
TCRDNWQGS

SEQ ID NO: 311153 - protein, 9 aa, Influenza virus
CRDNWQGSN

SEQ ID NO: 311154 - protein, 9 aa, Influenza virus
RDNWQGSNR

SEQ ID NO: 311155 - protein, 9 aa, Influenza virus
DNWQGSNRP

SEQ ID NO: 311156 - protein, 9 aa, Influenza virus
NWQGSNRPV

SEQ ID NO: 311157 - protein, 9 aa, Influenza virus
WQGSNRPVI

SEQ ID NO: 311158 - protein, 9 aa, Influenza virus
QGSNRPVIQ

SEQ ID NO: 311159 - protein, 9 aa, Influenza virus
GSNRPVIQI

SEQ ID NO: 311160 - protein, 9 aa, Influenza virus
SNRPVIQID

SEQ ID NO: 311161 - protein, 9 aa, Influenza virus
NRPVIQIDP

SEQ ID NO: 311162 - protein, 9 aa, Influenza virus
AMTHTSQYI

SEQ ID NO: 311163 - protein, 9 aa, Influenza virus
MTHTSQYIC

SEQ ID NO: 311164 - protein, 9 aa, Influenza virus
THTSQYICS

SEQ ID NO: 311165 - protein, 9 aa, Influenza virus
HTSQYICSP

SEQ ID NO: 311166 - protein, 9 aa, Influenza virus
TSQYICSPV

SEQ ID NO: 311167 - protein, 9 aa, Influenza virus
SQYICSPVL

SEQ ID NO: 311168 - protein, 9 aa, Influenza virus
QYICSPVLT

SEQ ID NO: 311169 - protein, 9 aa, Influenza virus
YICSPVLTD

SEQ ID NO: 311170 - protein, 9 aa, Influenza virus
ICSPVLTDN

SEQ ID NO: 311171 - protein, 9 aa, Influenza virus
CSPVLTDNP

SEQ ID NO: 311172 - protein, 9 aa, Influenza virus
SPVLTDNPR

SEQ ID NO: 311173 - protein, 9 aa, Influenza virus
PVLTDNPRP

SEQ ID NO: 311174 - protein, 9 aa, Influenza virus
VLTDNPRPN

SEQ ID NO: 311175 - protein, 9 aa, Influenza virus
LTDNPRPND

SEQ ID NO: 311176 - protein, 9 aa, Influenza virus
TDNPRPNDP

SEQ ID NO: 311177 - protein, 9 aa, Influenza virus
DNPRPNDPA

SEQ ID NO: 311178 - protein, 9 aa, Influenza virus
VGKCNDPYP

SEQ ID NO: 311179 - protein, 9 aa, Influenza virus
GKCNDPYPG

SEQ ID NO: 311180 - protein, 9 aa, Influenza virus
KCNDPYPGN

SEQ ID NO: 311181 - protein, 9 aa, Influenza virus
CNDPYPGNN

SEQ ID NO: 311182 - protein, 9 aa, Influenza virus
NDPYPGNNN

SEQ ID NO: 311183 - protein, 9 aa, Influenza virus
DPYPGNNNN

SEQ ID NO: 311184 - protein, 9 aa, Influenza virus
PYPGNNNNG

SEQ ID NO: 311185 - protein, 9 aa, Influenza virus
YPGNNNNGV

SEQ ID NO: 311186 - protein, 9 aa, Influenza virus
PGNNNNGVK

SEQ ID NO: 311187 - protein, 9 aa, Influenza virus
GNNNNGVKG

SEQ ID NO: 311188 - protein, 9 aa, Influenza virus
NNNNGVKGF

SEQ ID NO: 311189 - protein, 9 aa, Influenza virus
NNNGVKGFS

SEQ ID NO: 311190 - protein, 9 aa, Influenza virus
NNGVKGFSY

SEQ ID NO: 311191 - protein, 9 aa, Influenza virus
NGVKGFSYL

SEQ ID NO: 311192 - protein, 9 aa, Influenza virus
GVKGFSYLD

SEQ ID NO: 311193 - protein, 9 aa, Influenza virus
VKGFSYLDG

SEQ ID NO: 311194 - protein, 9 aa, Influenza virus
NTWLGRTIS

SEQ ID NO: 311195 - protein, 9 aa, Influenza virus
TWLGRTIST

SEQ ID NO: 311196 - protein, 9 aa, Influenza virus
WLGRTISTA

SEQ ID NO: 311197 - protein, 9 aa, Influenza virus
LGRTISTAS

SEQ ID NO: 311198 - protein, 9 aa, Influenza virus
GRTISTASR

SEQ ID NO: 311199 - protein, 9 aa, Influenza virus
RTISTASRS

SEQ ID NO: 311200 - protein, 9 aa, Influenza virus
TISTASRSG

SEQ ID NO: 311201 - protein, 9 aa, Influenza virus
ISTASRSGY

SEQ ID NO: 311202 - protein, 9 aa, Influenza virus
STASRSGYE

SEQ ID NO: 311203 - protein, 9 aa, Influenza virus
TASRSGYEM

SEQ ID NO: 311204 - protein, 9 aa, Influenza virus
ASRSGYEML

SEQ ID NO: 311205 - protein, 9 aa, Influenza virus
SRSGYEMLK

SEQ ID NO: 311206 - protein, 9 aa, Influenza virus
RSGYEMLKV

SEQ ID NO: 311207 - protein, 9 aa, Influenza virus
SGYEMLKVP

SEQ ID NO: 311208 - protein, 9 aa, Influenza virus
GYEMLKVPN

SEQ ID NO: 311209 - protein, 9 aa, Influenza virus
YEMLKVPNA

SEQ ID NO: 311210 - protein, 9 aa, Influenza virus
EMLKVPNAL

SEQ ID NO: 311211 - protein, 9 aa, Influenza virus
MLKVPNALT

SEQ ID NO: 311212 - protein, 9 aa, Influenza virus
LKVPNALTD

SEQ ID NO: 311213 - protein, 9 aa, Influenza virus
KVPNALTDD

SEQ ID NO: 311214 - protein, 9 aa, Influenza virus
VPNALTDDR

SEQ ID NO: 311215 - protein, 9 aa, Influenza virus
PNALTDDRS

SEQ ID NO: 311216 - protein, 9 aa, Influenza virus
NALTDDRSK

SEQ ID NO: 311217 - protein, 9 aa, Influenza virus
ALTDDRSKP

SEQ ID NO: 311218 - protein, 9 aa, Influenza virus
QGQTIVLNT

SEQ ID NO: 311219 - protein, 9 aa, Influenza virus
GQTIVLNTD

SEQ ID NO: 311220 - protein, 9 aa, Influenza virus
QTIVLNTDW

SEQ ID NO: 311221 - protein, 9 aa, Influenza virus
TIVLNTDWS

SEQ ID NO: 311222 - protein, 9 aa, Influenza virus
IVLNTDWSG

SEQ ID NO: 311223 - protein, 9 aa, Influenza virus
VLNTDWSGY

SEQ ID NO: 311224 - protein, 9 aa, Influenza virus
LNTDWSGYS

SEQ ID NO: 311225 - protein, 9 aa, Influenza virus
NTDWSGYSG

SEQ ID NO: 311226 - protein, 9 aa, Influenza virus
TDWSGYSGS

SEQ ID NO: 311227 - protein, 9 aa, Influenza virus
DWSGYSGSF

SEQ ID NO: 311228 - protein, 9 aa, Influenza virus
WSGYSGSFM

SEQ ID NO: 311229 - protein, 9 aa, Influenza virus
SGYSGSFMD

SEQ ID NO: 311230 - protein, 9 aa, Influenza virus
GYSGSFMDY

SEQ ID NO: 311231 - protein, 9 aa, Influenza virus
YSGSFMDYW

SEQ ID NO: 311232 - protein, 9 aa, Influenza virus
SGSFMDYWA

SEQ ID NO: 311233 - protein, 9 aa, Influenza virus
GSFMDYWAE

SEQ ID NO: 311234 - protein, 9 aa, Influenza virus
SFMDYWAEG

SEQ ID NO: 311235 - protein, 9 aa, Influenza virus
DYWAEGECY

SEQ ID NO: 311236 - protein, 9 aa, Influenza virus
YWAEGECYR

SEQ ID NO: 311237 - protein, 9 aa, Influenza virus
WAEGECYRA

SEQ ID NO: 311238 - protein, 9 aa, Influenza virus
AEGECYRAC

SEQ ID NO: 311239 - protein, 9 aa, Influenza virus
EGECYRACF

SEQ ID NO: 311240 - protein, 9 aa, Influenza virus
GECYRACFY

SEQ ID NO: 311241 - protein, 9 aa, Influenza virus
ECYRACFYV

SEQ ID NO: 311242 - protein, 9 aa, Influenza virus
CYRACFYVE

SEQ ID NO: 311243 - protein, 9 aa, Influenza virus
YRACFYVEL

SEQ ID NO: 311244 - protein, 9 aa, Influenza virus
RACFYVELI

SEQ ID NO: 311245 - protein, 9 aa, Influenza virus
ACFYVELIR

SEQ ID NO: 311246 - protein, 9 aa, Influenza virus
CFYVELIRG

SEQ ID NO: 311247 - protein, 9 aa, Influenza virus
FYVELIRGR

SEQ ID NO: 311248 - protein, 9 aa, Influenza virus
YVELIRGRP

SEQ ID NO: 311249 - protein, 9 aa, Influenza virus
VELIRGRPK

SEQ ID NO: 311250 - protein, 9 aa, Influenza virus
ELIRGRPKE

SEQ ID NO: 311251 - protein, 9 aa, Influenza virus
LIRGRPKED

SEQ ID NO: 311252 - protein, 9 aa, Influenza virus
IRGRPKEDK

SEQ ID NO: 311253 - protein, 9 aa, Influenza virus
RGRPKEDKV

SEQ ID NO: 311254 - protein, 9 aa, Influenza virus
GRPKEDKVW

SEQ ID NO: 311255 - protein, 9 aa, Influenza virus
RPKEDKVWW

SEQ ID NO: 311256 - protein, 9 aa, Influenza virus
PKEDKVWWT

SEQ ID NO: 311257 - protein, 9 aa, Influenza virus
KEDKVWWTS

SEQ ID NO: 311258 - protein, 9 aa, Influenza virus
EDKVWWTSN

SEQ ID NO: 311259 - protein, 9 aa, Influenza virus
DKVWWTSNS

SEQ ID NO: 311260 - protein, 9 aa, Influenza virus
KVWWTSNSI

SEQ ID NO: 311261 - protein, 9 aa, Influenza virus
VWWTSNSIV

SEQ ID NO: 311262 - protein, 9 aa, Influenza virus
WWTSNSIVS

SEQ ID NO: 311263 - protein, 9 aa, Influenza virus
WTSNSIVSM

SEQ ID NO: 311264 - protein, 9 aa, Influenza virus
TSNSIVSMC

SEQ ID NO: 311265 - protein, 9 aa, Influenza virus
SNSIVSMCS

SEQ ID NO: 311266 - protein, 9 aa, Influenza virus
NSIVSMCSS

SEQ ID NO: 311267 - protein, 9 aa, Influenza virus
SIVSMCSST

SEQ ID NO: 311268 - protein, 9 aa, Influenza virus
IVSMCSSTE

SEQ ID NO: 311269 - protein, 9 aa, Influenza virus
VSMCSSTEF

SEQ ID NO: 311270 - protein, 9 aa, Influenza virus
SMCSSTEFL

SEQ ID NO: 311271 - protein, 9 aa, Influenza virus
MCSSTEFLG

SEQ ID NO: 311272 - protein, 9 aa, Influenza virus
CSSTEFLGQ

SEQ ID NO: 311273 - protein, 9 aa, Influenza virus
SSTEFLGQW

SEQ ID NO: 311274 - protein, 9 aa, Influenza virus
STEFLGQWN

SEQ ID NO: 311275 - protein, 9 aa, Influenza virus
TEFLGQWNW

SEQ ID NO: 311276 - protein, 9 aa, Influenza virus
EFLGQWNWP

SEQ ID NO: 311277 - protein, 9 aa, Influenza virus
FLGQWNWPD

SEQ ID NO: 311278 - protein, 9 aa, Influenza virus
LGQWNWPDG

SEQ ID NO: 311279 - protein, 9 aa, Influenza virus
GQWNWPDGA

SEQ ID NO: 311280 - protein, 9 aa, Influenza virus
QWNWPDGAK

SEQ ID NO: 311281 - protein, 9 aa, Influenza virus
WNWPDGAKI

SEQ ID NO: 311282 - protein, 9 aa, Influenza virus
NWPDGAKIE

SEQ ID NO: 311283 - protein, 9 aa, Influenza virus
WPDGAKIEY

SEQ ID NO: 311284 - protein, 9 aa, Influenza virus
PDGAKIEYF

SEQ ID NO: 311285 - protein, 9 aa, Influenza virus
DGAKIEYFL

SEQ ID NO: 311286 - protein, 9 aa, Influenza virus
GLDKICLGH

SEQ ID NO: 311287 - protein, 9 aa, Influenza virus
LDKICLGHH

SEQ ID NO: 311288 - protein, 9 aa, Influenza virus
DKICLGHHA

SEQ ID NO: 311289 - protein, 9 aa, Influenza virus
KICLGHHAV

SEQ ID NO: 311290 - protein, 9 aa, Influenza virus
ICLGHHAVS

SEQ ID NO: 311291 - protein, 9 aa, Influenza virus
CLGHHAVSN

SEQ ID NO: 311292 - protein, 9 aa, Influenza virus
LGHHAVSNG

SEQ ID NO: 311293 - protein, 9 aa, Influenza virus
GHHAVSNGT

SEQ ID NO: 311294 - protein, 9 aa, Influenza virus
NGTIVKTLT

SEQ ID NO: 311295 - protein, 9 aa, Influenza virus
KEEVTNATE

SEQ ID NO: 311296 - protein, 9 aa, Influenza virus
EEVTNATET

SEQ ID NO: 311297 - protein, 9 aa, Influenza virus
EVTNATETV

SEQ ID NO: 311298 - protein, 9 aa, Influenza virus
VTNATETVE

SEQ ID NO: 311299 - protein, 9 aa, Influenza virus
TNATETVES

SEQ ID NO: 311300 - protein, 9 aa, Influenza virus
KDLGNCHPI

SEQ ID NO: 311301 - protein, 9 aa, Influenza virus
DLGNCHPIG

SEQ ID NO: 311302 - protein, 9 aa, Influenza virus
LGNCHPIGM

SEQ ID NO: 311303 - protein, 9 aa, Influenza virus
GTWDTLIER

SEQ ID NO: 311304 - protein, 9 aa, Influenza virus
VNEEALRQK

SEQ ID NO: 311305 - protein, 9 aa, Influenza virus
NEEALRQKI

SEQ ID NO: 311306 - protein, 9 aa, Influenza virus
EEALRQKIM

SEQ ID NO: 311307 - protein, 9 aa, Influenza virus
EALRQKIME

SEQ ID NO: 311308 - protein, 9 aa, Influenza virus
ALRQKIMES

SEQ ID NO: 311309 - protein, 9 aa, Influenza virus
LRQKIMESG

SEQ ID NO: 311310 - protein, 9 aa, Influenza virus
RQKIMESGG

SEQ ID NO: 311311 - protein, 9 aa, Influenza virus
QKIMESGGI

SEQ ID NO: 311312 - protein, 9 aa, Influenza virus
SFYAELKWL

SEQ ID NO: 311313 - protein, 9 aa, Influenza virus
GQNFPQTTN

SEQ ID NO: 311314 - protein, 9 aa, Influenza virus
QNFPQTTNT

SEQ ID NO: 311315 - protein, 9 aa, Influenza virus
NFPQTTNTY

SEQ ID NO: 311316 - protein, 9 aa, Influenza virus
FPQTTNTYR

SEQ ID NO: 311317 - protein, 9 aa, Influenza virus
PQTTNTYRN

SEQ ID NO: 311318 - protein, 9 aa, Influenza virus
QTTNTYRNT

SEQ ID NO: 311319 - protein, 9 aa, Influenza virus
TTNTYRNTD

SEQ ID NO: 311320 - protein, 9 aa, Influenza virus
TNTYRNTDS

SEQ ID NO: 311321 - protein, 9 aa, Influenza virus
WGIHHPSST

SEQ ID NO: 311322 - protein, 9 aa, Influenza virus
LYGTQSLSI

SEQ ID NO: 311323 - protein, 9 aa, Influenza virus
YGTQSLSIS

SEQ ID NO: 311324 - protein, 9 aa, Influenza virus
GTQSLSISV

SEQ ID NO: 311325 - protein, 9 aa, Influenza virus
TQSLSISVG

SEQ ID NO: 311326 - protein, 9 aa, Influenza virus
QSLSISVGS

SEQ ID NO: 311327 - protein, 9 aa, Influenza virus
SLSISVGSS

SEQ ID NO: 311328 - protein, 9 aa, Influenza virus
LSISVGSST

SEQ ID NO: 311329 - protein, 9 aa, Influenza virus
SISVGSSTY

SEQ ID NO: 311330 - protein, 9 aa, Influenza virus
ISVGSSTYQ

SEQ ID NO: 311331 - protein, 9 aa, Influenza virus
SVGSSTYQN

SEQ ID NO: 311332 - protein, 9 aa, Influenza virus
VGSSTYQNN

SEQ ID NO: 311333 - protein, 9 aa, Influenza virus
GSSTYQNNF

SEQ ID NO: 311334 - protein, 9 aa, Influenza virus
SSTYQNNFV

SEQ ID NO: 311335 - protein, 9 aa, Influenza virus
STYQNNFVP

SEQ ID NO: 311336 - protein, 9 aa, Influenza virus
TYQNNFVPV

SEQ ID NO: 311337 - protein, 9 aa, Influenza virus
YQNNFVPVV

SEQ ID NO: 311338 - protein, 9 aa, Influenza virus
QNNFVPVVG

SEQ ID NO: 311339 - protein, 9 aa, Influenza virus
NNFVPVVGA

SEQ ID NO: 311340 - protein, 9 aa, Influenza virus
NFVPVVGAR

SEQ ID NO: 311341 - protein, 9 aa, Influenza virus
FVPVVGARP

SEQ ID NO: 311342 - protein, 9 aa, Influenza virus
VPVVGARPQ

SEQ ID NO: 311343 - protein, 9 aa, Influenza virus
PVVGARPQV

SEQ ID NO: 311344 - protein, 9 aa, Influenza virus
VVGARPQVN

SEQ ID NO: 311345 - protein, 9 aa, Influenza virus
VGARPQVNG

SEQ ID NO: 311346 - protein, 9 aa, Influenza virus
GARPQVNGQ

SEQ ID NO: 311347 - protein, 9 aa, Influenza virus
ARPQVNGQS

SEQ ID NO: 311348 - protein, 9 aa, Influenza virus
RPQVNGQSG

SEQ ID NO: 311349 - protein, 9 aa, Influenza virus
PQVNGQSGR

SEQ ID NO: 311350 - protein, 9 aa, Influenza virus
QVNGQSGRI

SEQ ID NO: 311351 - protein, 9 aa, Influenza virus
VNGQSGRID

SEQ ID NO: 311352 - protein, 9 aa, Influenza virus
NGQSGRIDF

SEQ ID NO: 311353 - protein, 9 aa, Influenza virus
GQSGRIDFH

SEQ ID NO: 311354 - protein, 9 aa, Influenza virus
QSGRIDFHW

SEQ ID NO: 311355 - protein, 9 aa, Influenza virus
PGDNITFSH

SEQ ID NO: 311356 - protein, 9 aa, Influenza virus
GDNITFSHN

SEQ ID NO: 311357 - protein, 9 aa, Influenza virus
DNITFSHNG

SEQ ID NO: 311358 - protein, 9 aa, Influenza virus
NITFSHNGG

SEQ ID NO: 311359 - protein, 9 aa, Influenza virus
ITFSHNGGL

SEQ ID NO: 311360 - protein, 9 aa, Influenza virus
TFSHNGGLI

SEQ ID NO: 311361 - protein, 9 aa, Influenza virus
FSHNGGLIA

SEQ ID NO: 311362 - protein, 9 aa, Influenza virus
SHNGGLIAP

SEQ ID NO: 311363 - protein, 9 aa, Influenza virus
HNGGLIAPS

SEQ ID NO: 311364 - protein, 9 aa, Influenza virus
NGGLIAPSR

SEQ ID NO: 311365 - protein, 9 aa, Influenza virus
GGLIAPSRV

SEQ ID NO: 311366 - protein, 9 aa, Influenza virus
CESKCFWKG

SEQ ID NO: 311367 - protein, 9 aa, Influenza virus
ESKCFWKGG

SEQ ID NO: 311368 - protein, 9 aa, Influenza virus
SKCFWKGGS

SEQ ID NO: 311369 - protein, 9 aa, Influenza virus
KCFWKGGSI

SEQ ID NO: 311370 - protein, 9 aa, Influenza virus
CFWKGGSIN

SEQ ID NO: 311371 - protein, 9 aa, Influenza virus
FWKGGSINT

SEQ ID NO: 311372 - protein, 9 aa, Influenza virus
GGSINTKLP

SEQ ID NO: 311373 - protein, 9 aa, Influenza virus
GSINTKLPF

SEQ ID NO: 311374 - protein, 9 aa, Influenza virus
SINTKLPFQ

SEQ ID NO: 311375 - protein, 9 aa, Influenza virus
INTKLPFQN

SEQ ID NO: 311376 - protein, 9 aa, Influenza virus
NTKLPFQNL

SEQ ID NO: 311377 - protein, 9 aa, Influenza virus
TKLPFQNLS

SEQ ID NO: 311378 - protein, 9 aa, Influenza virus
KLPFQNLSP

SEQ ID NO: 311379 - protein, 9 aa, Influenza virus
LPFQNLSPR

SEQ ID NO: 311380 - protein, 9 aa, Influenza virus
PFQNLSPRT

SEQ ID NO: 311381 - protein, 9 aa, Influenza virus
FQNLSPRTV

SEQ ID NO: 311382 - protein, 9 aa, Influenza virus
QNLSPRTVG

SEQ ID NO: 311383 - protein, 9 aa, Influenza virus
NLSPRTVGQ

SEQ ID NO: 311384 - protein, 9 aa, Influenza virus
LSPRTVGQC

SEQ ID NO: 311385 - protein, 9 aa, Influenza virus
SPRTVGQCP

SEQ ID NO: 311386 - protein, 9 aa, Influenza virus
PRTVGQCPK

SEQ ID NO: 311387 - protein, 9 aa, Influenza virus
RTVGQCPKY

SEQ ID NO: 311388 - protein, 9 aa, Influenza virus
TVGQCPKYV

SEQ ID NO: 311389 - protein, 9 aa, Influenza virus
VGQCPKYVN

SEQ ID NO: 311390 - protein, 9 aa, Influenza virus
GQCPKYVNK

SEQ ID NO: 311391 - protein, 9 aa, Influenza virus
KSLLLATGM

SEQ ID NO: 311392 - protein, 9 aa, Influenza virus
SLLLATGMR

SEQ ID NO: 311393 - protein, 9 aa, Influenza virus
LLLATGMRN

SEQ ID NO: 311394 - protein, 9 aa, Influenza virus
LLATGMRNV

SEQ ID NO: 311395 - protein, 9 aa, Influenza virus
LATGMRNVP

SEQ ID NO: 311396 - protein, 9 aa, Influenza virus
ATGMRNVPE

SEQ ID NO: 311397 - protein, 9 aa, Influenza virus
TGMRNVPEV

SEQ ID NO: 311398 - protein, 9 aa, Influenza virus
QGRGLFGAI

SEQ ID NO: 311399 - protein, 9 aa, Influenza virus
GRGLFGAIA

SEQ ID NO: 311400 - protein, 9 aa, Influenza virus
RGLFGAIAG

SEQ ID NO: 311401 - protein, 9 aa, Influenza virus
GLFGAIAGF

SEQ ID NO: 311402 - protein, 9 aa, Influenza virus
LFGAIAGFI

SEQ ID NO: 311403 - protein, 9 aa, Influenza virus
FGAIAGFIE

SEQ ID NO: 311404 - protein, 9 aa, Influenza virus
GAIAGFIEN

SEQ ID NO: 311405 - protein, 9 aa, Influenza virus
AIAGFIENG

SEQ ID NO: 311406 - protein, 9 aa, Influenza virus
IAGFIENGW

SEQ ID NO: 311407 - protein, 9 aa, Influenza virus
AGFIENGWE

SEQ ID NO: 311408 - protein, 9 aa, Influenza virus
GFIENGWEG

SEQ ID NO: 311409 - protein, 9 aa, Influenza virus
FIENGWEGM

SEQ ID NO: 311410 - protein, 9 aa, Influenza virus
IENGWEGMV

SEQ ID NO: 311411 - protein, 9 aa, Influenza virus
ENGWEGMVD

SEQ ID NO: 311412 - protein, 9 aa, Influenza virus
NGWEGMVDG

SEQ ID NO: 311413 - protein, 9 aa, Influenza virus
GWEGMVDGW

SEQ ID NO: 311414 - protein, 9 aa, Influenza virus
WEGMVDGWY

SEQ ID NO: 311415 - protein, 9 aa, Influenza virus
EGMVDGWYG

SEQ ID NO: 311416 - protein, 9 aa, Influenza virus
GMVDGWYGF

SEQ ID NO: 311417 - protein, 9 aa, Influenza virus
MVDGWYGFR

SEQ ID NO: 311418 - protein, 9 aa, Influenza virus
VDGWYGFRH

SEQ ID NO: 311419 - protein, 9 aa, Influenza virus
DGWYGFRHQ

SEQ ID NO: 311420 - protein, 9 aa, Influenza virus
GWYGFRHQN

SEQ ID NO: 311421 - protein, 9 aa, Influenza virus
WYGFRHQNA

SEQ ID NO: 311422 - protein, 9 aa, Influenza virus
YGFRHQNAQ

SEQ ID NO: 311423 - protein, 9 aa, Influenza virus
GFRHQNAQG

SEQ ID NO: 311424 - protein, 9 aa, Influenza virus
FRHQNAQGT

SEQ ID NO: 311425 - protein, 9 aa, Influenza virus
RHQNAQGTG

SEQ ID NO: 311426 - protein, 9 aa, Influenza virus
HQNAQGTGQ

SEQ ID NO: 311427 - protein, 9 aa, Influenza virus
QNAQGTGQA

SEQ ID NO: 311428 - protein, 9 aa, Influenza virus
NAQGTGQAA

SEQ ID NO: 311429 - protein, 9 aa, Influenza virus
AQGTGQAAD

SEQ ID NO: 311430 - protein, 9 aa, Influenza virus
QGTGQAADY

SEQ ID NO: 311431 - protein, 9 aa, Influenza virus
GTGQAADYK

SEQ ID NO: 311432 - protein, 9 aa, Influenza virus
TGQAADYKS

SEQ ID NO: 311433 - protein, 9 aa, Influenza virus
GQAADYKST

SEQ ID NO: 311434 - protein, 9 aa, Influenza virus
QAADYKSTQ

SEQ ID NO: 311435 - protein, 9 aa, Influenza virus
AADYKSTQA

SEQ ID NO: 311436 - protein, 9 aa, Influenza virus
ADYKSTQAA

SEQ ID NO: 311437 - protein, 9 aa, Influenza virus
DYKSTQAAI

SEQ ID NO: 311438 - protein, 9 aa, Influenza virus
AIDQITGKL

SEQ ID NO: 311439 - protein, 9 aa, Influenza virus
IDQITGKLN

SEQ ID NO: 311440 - protein, 9 aa, Influenza virus
DQITGKLNR

SEQ ID NO: 311441 - protein, 9 aa, Influenza virus
QITGKLNRL

SEQ ID NO: 311442 - protein, 9 aa, Influenza virus
ITGKLNRLI

SEQ ID NO: 311443 - protein, 9 aa, Influenza virus
TGKLNRLIE

SEQ ID NO: 311444 - protein, 9 aa, Influenza virus
GKLNRLIEK

SEQ ID NO: 311445 - protein, 9 aa, Influenza virus
KLNRLIEKT

SEQ ID NO: 311446 - protein, 9 aa, Influenza virus
LNRLIEKTN

SEQ ID NO: 311447 - protein, 9 aa, Influenza virus
NRLIEKTNT

SEQ ID NO: 311448 - protein, 9 aa, Influenza virus
RLIEKTNTE

SEQ ID NO: 311449 - protein, 9 aa, Influenza virus
LIEKTNTEF

SEQ ID NO: 311450 - protein, 9 aa, Influenza virus
IEKTNTEFE

SEQ ID NO: 311451 - protein, 9 aa, Influenza virus
EKTNTEFES

SEQ ID NO: 311452 - protein, 9 aa, Influenza virus
KTNTEFESI

SEQ ID NO: 311453 - protein, 9 aa, Influenza virus
TNTEFESIE

SEQ ID NO: 311454 - protein, 9 aa, Influenza virus
NTEFESIES

SEQ ID NO: 311455 - protein, 9 aa, Influenza virus
TEFESIESE

SEQ ID NO: 311456 - protein, 9 aa, Influenza virus
EFESIESEF

SEQ ID NO: 311457 - protein, 9 aa, Influenza virus
FESIESEFS

SEQ ID NO: 311458 - protein, 9 aa, Influenza virus
ESIESEFSE

SEQ ID NO: 311459 - protein, 9 aa, Influenza virus
SIESEFSEI

SEQ ID NO: 311460 - protein, 9 aa, Influenza virus
IESEFSEIE

SEQ ID NO: 311461 - protein, 9 aa, Influenza virus
ESEFSEIEH

SEQ ID NO: 311462 - protein, 9 aa, Influenza virus
SEFSEIEHQ

SEQ ID NO: 311463 - protein, 9 aa, Influenza virus
EFSEIEHQI

SEQ ID NO: 311464 - protein, 9 aa, Influenza virus
FSEIEHQIG

SEQ ID NO: 311465 - protein, 9 aa, Influenza virus
SEIEHQIGN

SEQ ID NO: 311466 - protein, 9 aa, Influenza virus
EIEHQIGNV

SEQ ID NO: 311467 - protein, 9 aa, Influenza virus
IEHQIGNVI

SEQ ID NO: 311468 - protein, 9 aa, Influenza virus
EHQIGNVIN

SEQ ID NO: 311469 - protein, 9 aa, Influenza virus
HQIGNVINW

SEQ ID NO: 311470 - protein, 9 aa, Influenza virus
QIGNVINWT

SEQ ID NO: 311471 - protein, 9 aa, Influenza virus
IGNVINWTK

SEQ ID NO: 311472 - protein, 9 aa, Influenza virus
GNVINWTKD

SEQ ID NO: 311473 - protein, 9 aa, Influenza virus
NVINWTKDS

SEQ ID NO: 311474 - protein, 9 aa, Influenza virus
VINWTKDSI

SEQ ID NO: 311475 - protein, 9 aa, Influenza virus
INWTKDSIT

SEQ ID NO: 311476 - protein, 9 aa, Influenza virus
NWTKDSITD

SEQ ID NO: 311477 - protein, 9 aa, Influenza virus
WTKDSITDI

SEQ ID NO: 311478 - protein, 9 aa, Influenza virus
TKDSITDIW

SEQ ID NO: 311479 - protein, 9 aa, Influenza virus
KDSITDIWT

SEQ ID NO: 311480 - protein, 9 aa, Influenza virus
DSITDIWTY

SEQ ID NO: 311481 - protein, 9 aa, Influenza virus
SITDIWTYQ

SEQ ID NO: 311482 - protein, 9 aa, Influenza virus
ITDIWTYQA

SEQ ID NO: 311483 - protein, 9 aa, Influenza virus
TDIWTYQAE

SEQ ID NO: 311484 - protein, 9 aa, Influenza virus
DIWTYQAEL

SEQ ID NO: 311485 - protein, 9 aa, Influenza virus
IWTYQAELL

SEQ ID NO: 311486 - protein, 9 aa, Influenza virus
WTYQAELLV

SEQ ID NO: 311487 - protein, 9 aa, Influenza virus
TYQAELLVA

SEQ ID NO: 311488 - protein, 9 aa, Influenza virus
YQAELLVAM

SEQ ID NO: 311489 - protein, 9 aa, Influenza virus
QAELLVAME

SEQ ID NO: 311490 - protein, 9 aa, Influenza virus
AELLVAMEN

SEQ ID NO: 311491 - protein, 9 aa, Influenza virus
ELLVAMENQ

SEQ ID NO: 311492 - protein, 9 aa, Influenza virus
LLVAMENQH

SEQ ID NO: 311493 - protein, 9 aa, Influenza virus
LVAMENQHT

SEQ ID NO: 311494 - protein, 9 aa, Influenza virus
VAMENQHTI

SEQ ID NO: 311495 - protein, 9 aa, Influenza virus
AMENQHTID

SEQ ID NO: 311496 - protein, 9 aa, Influenza virus
MENQHTIDM

SEQ ID NO: 311497 - protein, 9 aa, Influenza virus
ENQHTIDMA

SEQ ID NO: 311498 - protein, 9 aa, Influenza virus
NQHTIDMAD

SEQ ID NO: 311499 - protein, 9 aa, Influenza virus
QHTIDMADS

SEQ ID NO: 311500 - protein, 9 aa, Influenza virus
HTIDMADSE

SEQ ID NO: 311501 - protein, 9 aa, Influenza virus
TIDMADSEM

SEQ ID NO: 311502 - protein, 9 aa, Influenza virus
IDMADSEML

SEQ ID NO: 311503 - protein, 9 aa, Influenza virus
DMADSEMLN

SEQ ID NO: 311504 - protein, 9 aa, Influenza virus
MADSEMLNL

SEQ ID NO: 311505 - protein, 9 aa, Influenza virus
ADSEMLNLY

SEQ ID NO: 311506 - protein, 9 aa, Influenza virus
DSEMLNLYE

SEQ ID NO: 311507 - protein, 9 aa, Influenza virus
SEMLNLYER

SEQ ID NO: 311508 - protein, 9 aa, Influenza virus
EMLNLYERV

SEQ ID NO: 311509 - protein, 9 aa, Influenza virus
MLNLYERVR

SEQ ID NO: 311510 - protein, 9 aa, Influenza virus
LNLYERVRK

SEQ ID NO: 311511 - protein, 9 aa, Influenza virus
NLYERVRKQ

SEQ ID NO: 311512 - protein, 9 aa, Influenza virus
LYERVRKQL

SEQ ID NO: 311513 - protein, 9 aa, Influenza virus
YERVRKQLR

SEQ ID NO: 311514 - protein, 9 aa, Influenza virus
ERVRKQLRQ

SEQ ID NO: 311515 - protein, 9 aa, Influenza virus
RVRKQLRQN

SEQ ID NO: 311516 - protein, 9 aa, Influenza virus
VRKQLRQNA

SEQ ID NO: 311517 - protein, 9 aa, Influenza virus
RKQLRQNAE

SEQ ID NO: 311518 - protein, 9 aa, Influenza virus
KQLRQNAEE

SEQ ID NO: 311519 - protein, 9 aa, Influenza virus
QLRQNAEED

SEQ ID NO: 311520 - protein, 9 aa, Influenza virus
LRQNAEEDG

SEQ ID NO: 311521 - protein, 9 aa, Influenza virus
RQNAEEDGK

SEQ ID NO: 311522 - protein, 9 aa, Influenza virus
QNAEEDGKG

SEQ ID NO: 311523 - protein, 9 aa, Influenza virus
NAEEDGKGC

SEQ ID NO: 311524 - protein, 9 aa, Influenza virus
AEEDGKGCF

SEQ ID NO: 311525 - protein, 9 aa, Influenza virus
EEDGKGCFE

SEQ ID NO: 311526 - protein, 9 aa, Influenza virus
EDGKGCFEI

SEQ ID NO: 311527 - protein, 9 aa, Influenza virus
DGKGCFEIY

SEQ ID NO: 311528 - protein, 9 aa, Influenza virus
GKGCFEIYH

SEQ ID NO: 311529 - protein, 9 aa, Influenza virus
GCFEIYHKC

SEQ ID NO: 311530 - protein, 9 aa, Influenza virus
NCMESIRNN

SEQ ID NO: 311531 - protein, 9 aa, Influenza virus
CMESIRNNT

SEQ ID NO: 311532 - protein, 9 aa, Influenza virus
MESIRNNTY

SEQ ID NO: 311533 - protein, 9 aa, Influenza virus
ESIRNNTYD

SEQ ID NO: 311534 - protein, 9 aa, Influenza virus
SIRNNTYDH

SEQ ID NO: 311535 - protein, 9 aa, Influenza virus
IRNNTYDHT

SEQ ID NO: 311536 - protein, 9 aa, Influenza virus
RNNTYDHTQ

SEQ ID NO: 311537 - protein, 9 aa, Influenza virus
NNTYDHTQY

SEQ ID NO: 311538 - protein, 9 aa, Influenza virus
NTYDHTQYR

SEQ ID NO: 311539 - protein, 9 aa, Influenza virus
TYDHTQYRE

SEQ ID NO: 311540 - protein, 9 aa, Influenza virus
YDHTQYREE

SEQ ID NO: 311541 - protein, 9 aa, Influenza virus
HTQYREEAL

SEQ ID NO: 311542 - protein, 9 aa, Influenza virus
TQYREEALL

SEQ ID NO: 311543 - protein, 9 aa, Influenza virus
QYREEALLN

SEQ ID NO: 311544 - protein, 9 aa, Influenza virus
YREEALLNR

SEQ ID NO: 311545 - protein, 9 aa, Influenza virus
REEALLNRL

SEQ ID NO: 311546 - protein, 9 aa, Influenza virus
EEALLNRLN

SEQ ID NO: 311547 - protein, 9 aa, Influenza virus
EALLNRLNI

SEQ ID NO: 311548 - protein, 9 aa, Influenza virus
ALLNRLNIN

SEQ ID NO: 311549 - protein, 9 aa, Influenza virus
LLNRLNINP

SEQ ID NO: 311550 - protein, 9 aa, Influenza virus
LNRLNINPV

SEQ ID NO: 311551 - protein, 9 aa, Influenza virus
INPVKLSSG

SEQ ID NO: 311552 - protein, 9 aa, Influenza virus
NPVKLSSGY

SEQ ID NO: 311553 - protein, 9 aa, Influenza virus
PVKLSSGYK

SEQ ID NO: 311554 - protein, 9 aa, Influenza virus
VKLSSGYKD

SEQ ID NO: 311555 - protein, 9 aa, Influenza virus
LSSGYKDVI

SEQ ID NO: 311556 - protein, 9 aa, Influenza virus
SSGYKDVIL

SEQ ID NO: 311557 - protein, 9 aa, Influenza virus
SGYKDVILW

SEQ ID NO: 311558 - protein, 9 aa, Influenza virus
GYKDVILWF

SEQ ID NO: 311559 - protein, 9 aa, Influenza virus
YKDVILWFS

SEQ ID NO: 311560 - protein, 9 aa, Influenza virus
KDVILWFSF

SEQ ID NO: 311561 - protein, 9 aa, Influenza virus
DVILWFSFG

SEQ ID NO: 311562 - protein, 9 aa, Influenza virus
VILWFSFGA

SEQ ID NO: 311563 - protein, 9 aa, Influenza virus
ILWFSFGAS

SEQ ID NO: 311564 - protein, 9 aa, Influenza virus
LWFSFGASC

SEQ ID NO: 311565 - protein, 9 aa, Influenza virus
WFSFGASCF

SEQ ID NO: 311566 - protein, 9 aa, Influenza virus
FSFGASCFV

SEQ ID NO: 311567 - protein, 9 aa, Influenza virus
SFGASCFVL

SEQ ID NO: 311568 - protein, 9 aa, Influenza virus
FGASCFVLL

SEQ ID NO: 311569 - protein, 9 aa, Influenza virus
GASCFVLLA

SEQ ID NO: 311570 - protein, 9 aa, Influenza virus
FFCLKNGNM

SEQ ID NO: 311571 - protein, 9 aa, Influenza virus
FCLKNGNMR

SEQ ID NO: 311572 - protein, 9 aa, Influenza virus
NMRCTISLV

SEQ ID NO: 311573 - protein, 9 aa, Influenza virus
MRCTISLVK

SEQ ID NO: 311574 - protein, 9 aa, Influenza virus
RCTISLVKT

SEQ ID NO: 311575 - protein, 9 aa, Influenza virus
CTISLVKTT

SEQ ID NO: 311576 - protein, 9 aa, Influenza virus
TISLVKTTL

SEQ ID NO: 311577 - protein, 9 aa, Influenza virus
ISLVKTTLF

SEQ ID NO: 311578 - protein, 9 aa, Influenza virus
SLVKTTLFL

SEQ ID NO: 311579 - protein, 9 aa, Influenza virus
GLDKICLGH

SEQ ID NO: 311580 - protein, 9 aa, Influenza virus
LDKICLGHH

SEQ ID NO: 311581 - protein, 9 aa, Influenza virus
DKICLGHHA

SEQ ID NO: 311582 - protein, 9 aa, Influenza virus
KICLGHHAV

SEQ ID NO: 311583 - protein, 9 aa, Influenza virus
ICLGHHAVS

SEQ ID NO: 311584 - protein, 9 aa, Influenza virus
CLGHHAVSN

SEQ ID NO: 311585 - protein, 9 aa, Influenza virus
LGHHAVSNG

SEQ ID NO: 311586 - protein, 9 aa, Influenza virus
GHHAVSNGT

SEQ ID NO: 311587 - protein, 9 aa, Influenza virus
HHAVSNGTI

SEQ ID NO: 311588 - protein, 9 aa, Influenza virus
SNGTIVKTL

SEQ ID NO: 311589 - protein, 9 aa, Influenza virus
NGTIVKTLT

SEQ ID NO: 311590 - protein, 9 aa, Influenza virus
GTIVKTLTN

SEQ ID NO: 311591 - protein, 9 aa, Influenza virus
TIVKTLTNE

SEQ ID NO: 311592 - protein, 9 aa, Influenza virus
IVKTLTNEK

SEQ ID NO: 311593 - protein, 9 aa, Influenza virus
VKTLTNEKE

SEQ ID NO: 311594 - protein, 9 aa, Influenza virus
KTLTNEKEE

SEQ ID NO: 311595 - protein, 9 aa, Influenza virus
TLTNEKEEV

SEQ ID NO: 311596 - protein, 9 aa, Influenza virus
EKEEVTNAT

SEQ ID NO: 311597 - protein, 9 aa, Influenza virus
KEEVTNATE

SEQ ID NO: 311598 - protein, 9 aa, Influenza virus
EEVTNATET

SEQ ID NO: 311599 - protein, 9 aa, Influenza virus
EVTNATETV

SEQ ID NO: 311600 - protein, 9 aa, Influenza virus
VTNATETVE

SEQ ID NO: 311601 - protein, 9 aa, Influenza virus
TNATETVES

SEQ ID NO: 311602 - protein, 9 aa, Influenza virus
NATETVESK

SEQ ID NO: 311603 - protein, 9 aa, Influenza virus
YKDLGNCHP

SEQ ID NO: 311604 - protein, 9 aa, Influenza virus
KDLGNCHPI

SEQ ID NO: 311605 - protein, 9 aa, Influenza virus
DLGNCHPIG

SEQ ID NO: 311606 - protein, 9 aa, Influenza virus
LGNCHPIGM

SEQ ID NO: 311607 - protein, 9 aa, Influenza virus
CHPIGMVIG

SEQ ID NO: 311608 - protein, 9 aa, Influenza virus
GTPACDLHL

SEQ ID NO: 311609 - protein, 9 aa, Influenza virus
TPACDLHLT

SEQ ID NO: 311610 - protein, 9 aa, Influenza virus
PACDLHLTG

SEQ ID NO: 311611 - protein, 9 aa, Influenza virus
CDLHLTGTW

SEQ ID NO: 311612 - protein, 9 aa, Influenza virus
DLHLTGTWD

SEQ ID NO: 311613 - protein, 9 aa, Influenza virus
LHLTGTWDT

SEQ ID NO: 311614 - protein, 9 aa, Influenza virus
HLTGTWDTL

SEQ ID NO: 311615 - protein, 9 aa, Influenza virus
LTGTWDTLI

SEQ ID NO: 311616 - protein, 9 aa, Influenza virus
TGTWDTLIE

SEQ ID NO: 311617 - protein, 9 aa, Influenza virus
GTWDTLIER

SEQ ID NO: 311618 - protein, 9 aa, Influenza virus
TWDTLIERD

SEQ ID NO: 311619 - protein, 9 aa, Influenza virus
WDTLIERDN

SEQ ID NO: 311620 - protein, 9 aa, Influenza virus
DTLIERDNS

SEQ ID NO: 311621 - protein, 9 aa, Influenza virus
IAYCYPGAT

SEQ ID NO: 311622 - protein, 9 aa, Influenza virus
AYCYPGATV

SEQ ID NO: 311623 - protein, 9 aa, Influenza virus
YCYPGATVN

SEQ ID NO: 311624 - protein, 9 aa, Influenza virus
CYPGATVNE

SEQ ID NO: 311625 - protein, 9 aa, Influenza virus
YPGATVNEE

SEQ ID NO: 311626 - protein, 9 aa, Influenza virus
PGATVNEEA

SEQ ID NO: 311627 - protein, 9 aa, Influenza virus
GATVNEEAL

SEQ ID NO: 311628 - protein, 9 aa, Influenza virus
ATVNEEALR

SEQ ID NO: 311629 - protein, 9 aa, Influenza virus
TVNEEALRQ

SEQ ID NO: 311630 - protein, 9 aa, Influenza virus
VNEEALRQK

SEQ ID NO: 311631 - protein, 9 aa, Influenza virus
NEEALRQKI

SEQ ID NO: 311632 - protein, 9 aa, Influenza virus
EEALRQKIM

SEQ ID NO: 311633 - protein, 9 aa, Influenza virus
EALRQKIME

SEQ ID NO: 311634 - protein, 9 aa, Influenza virus
ALRQKIMES

SEQ ID NO: 311635 - protein, 9 aa, Influenza virus
LRQKIMESG

SEQ ID NO: 311636 - protein, 9 aa, Influenza virus
RQKIMESGG

SEQ ID NO: 311637 - protein, 9 aa, Influenza virus
QKIMESGGI

SEQ ID NO: 311638 - protein, 9 aa, Influenza virus
KIMESGGID

SEQ ID NO: 311639 - protein, 9 aa, Influenza virus
IMESGGIDK

SEQ ID NO: 311640 - protein, 9 aa, Influenza virus
MESGGIDKI

SEQ ID NO: 311641 - protein, 9 aa, Influenza virus
ESGGIDKIS

SEQ ID NO: 311642 - protein, 9 aa, Influenza virus
SGGIDKIST

SEQ ID NO: 311643 - protein, 9 aa, Influenza virus
FTYGSSINS

SEQ ID NO: 311644 - protein, 9 aa, Influenza virus
YGSSINSAG

SEQ ID NO: 311645 - protein, 9 aa, Influenza virus
GGNSFYAEL

SEQ ID NO: 311646 - protein, 9 aa, Influenza virus
GNSFYAELK

SEQ ID NO: 311647 - protein, 9 aa, Influenza virus
NSFYAELKW

SEQ ID NO: 311648 - protein, 9 aa, Influenza virus
SFYAELKWL

SEQ ID NO: 311649 - protein, 9 aa, Influenza virus
FYAELKWLV

SEQ ID NO: 311650 - protein, 9 aa, Influenza virus
YAELKWLVS

SEQ ID NO: 311651 - protein, 9 aa, Influenza virus
AELKWLVSK

SEQ ID NO: 311652 - protein, 9 aa, Influenza virus
ELKWLVSKS

SEQ ID NO: 311653 - protein, 9 aa, Influenza virus
LKWLVSKSK

SEQ ID NO: 311654 - protein, 9 aa, Influenza virus
KWLVSKSKG

SEQ ID NO: 311655 - protein, 9 aa, Influenza virus
WLVSKSKGQ

SEQ ID NO: 311656 - protein, 9 aa, Influenza virus
QNFPQTTNT

SEQ ID NO: 311657 - protein, 9 aa, Influenza virus
NFPQTTNTY

SEQ ID NO: 311658 - protein, 9 aa, Influenza virus
FPQTTNTYR

SEQ ID NO: 311659 - protein, 9 aa, Influenza virus
PQTTNTYRN

SEQ ID NO: 311660 - protein, 9 aa, Influenza virus
QTTNTYRNT

SEQ ID NO: 311661 - protein, 9 aa, Influenza virus
TTNTYRNTD

SEQ ID NO: 311662 - protein, 9 aa, Influenza virus
TNTYRNTDS

SEQ ID NO: 311663 - protein, 9 aa, Influenza virus
EHLIIWGIH

SEQ ID NO: 311664 - protein, 9 aa, Influenza virus
HLIIWGIHH

SEQ ID NO: 311665 - protein, 9 aa, Influenza virus
LIIWGIHHP

SEQ ID NO: 311666 - protein, 9 aa, Influenza virus
IIWGIHHPS

SEQ ID NO: 311667 - protein, 9 aa, Influenza virus
IWGIHHPSS

SEQ ID NO: 311668 - protein, 9 aa, Influenza virus
WGIHHPSST

SEQ ID NO: 311669 - protein, 9 aa, Influenza virus
GIHHPSSTQ

SEQ ID NO: 311670 - protein, 9 aa, Influenza virus
IHHPSSTQE

SEQ ID NO: 311671 - protein, 9 aa, Influenza virus
HHPSSTQEK

SEQ ID NO: 311672 - protein, 9 aa, Influenza virus
HPSSTQEKN

SEQ ID NO: 311673 - protein, 9 aa, Influenza virus
PSSTQEKND

SEQ ID NO: 311674 - protein, 9 aa, Influenza virus
SSTQEKNDL

SEQ ID NO: 311675 - protein, 9 aa, Influenza virus
STQEKNDLY

SEQ ID NO: 311676 - protein, 9 aa, Influenza virus
TQEKNDLYG

SEQ ID NO: 311677 - protein, 9 aa, Influenza virus
QEKNDLYGT

SEQ ID NO: 311678 - protein, 9 aa, Influenza virus
EKNDLYGTQ

SEQ ID NO: 311679 - protein, 9 aa, Influenza virus
KNDLYGTQS

SEQ ID NO: 311680 - protein, 9 aa, Influenza virus
NDLYGTQSL

SEQ ID NO: 311681 - protein, 9 aa, Influenza virus
DLYGTQSLS

SEQ ID NO: 311682 - protein, 9 aa, Influenza virus
LYGTQSLSI

SEQ ID NO: 311683 - protein, 9 aa, Influenza virus
YGTQSLSIS

SEQ ID NO: 311684 - protein, 9 aa, Influenza virus
GTQSLSISV

SEQ ID NO: 311685 - protein, 9 aa, Influenza virus
TQSLSISVG

SEQ ID NO: 311686 - protein, 9 aa, Influenza virus
QSLSISVGS

SEQ ID NO: 311687 - protein, 9 aa, Influenza virus
SLSISVGSS

SEQ ID NO: 311688 - protein, 9 aa, Influenza virus
LSISVGSST

SEQ ID NO: 311689 - protein, 9 aa, Influenza virus
SISVGSSTY

SEQ ID NO: 311690 - protein, 9 aa, Influenza virus
ISVGSSTYQ

SEQ ID NO: 311691 - protein, 9 aa, Influenza virus
SVGSSTYQN

SEQ ID NO: 311692 - protein, 9 aa, Influenza virus
VGSSTYQNN

SEQ ID NO: 311693 - protein, 9 aa, Influenza virus
GSSTYQNNF

SEQ ID NO: 311694 - protein, 9 aa, Influenza virus
SSTYQNNFV

SEQ ID NO: 311695 - protein, 9 aa, Influenza virus
STYQNNFVP

SEQ ID NO: 311696 - protein, 9 aa, Influenza virus
TYQNNFVPV

SEQ ID NO: 311697 - protein, 9 aa, Influenza virus
YQNNFVPVV

SEQ ID NO: 311698 - protein, 9 aa, Influenza virus
QNNFVPVVG

SEQ ID NO: 311699 - protein, 9 aa, Influenza virus
NNFVPVVGA

SEQ ID NO: 311700 - protein, 9 aa, Influenza virus
NFVPVVGAR

SEQ ID NO: 311701 - protein, 9 aa, Influenza virus
FVPVVGARP

SEQ ID NO: 311702 - protein, 9 aa, Influenza virus
VPVVGARPQ

SEQ ID NO: 311703 - protein, 9 aa, Influenza virus
PVVGARPQV

SEQ ID NO: 311704 - protein, 9 aa, Influenza virus
VVGARPQVN

SEQ ID NO: 311705 - protein, 9 aa, Influenza virus
VGARPQVNG

SEQ ID NO: 311706 - protein, 9 aa, Influenza virus
GARPQVNGQ

SEQ ID NO: 311707 - protein, 9 aa, Influenza virus
ARPQVNGQS

SEQ ID NO: 311708 - protein, 9 aa, Influenza virus
RPQVNGQSG

SEQ ID NO: 311709 - protein, 9 aa, Influenza virus
PQVNGQSGR

SEQ ID NO: 311710 - protein, 9 aa, Influenza virus
QVNGQSGRI

SEQ ID NO: 311711 - protein, 9 aa, Influenza virus
VNGQSGRID

SEQ ID NO: 311712 - protein, 9 aa, Influenza virus
NGQSGRIDF

SEQ ID NO: 311713 - protein, 9 aa, Influenza virus
GQSGRIDFH

SEQ ID NO: 311714 - protein, 9 aa, Influenza virus
QSGRIDFHW

SEQ ID NO: 311715 - protein, 9 aa, Influenza virus
SGRIDFHWT

SEQ ID NO: 311716 - protein, 9 aa, Influenza virus
VQPGDNITF

SEQ ID NO: 311717 - protein, 9 aa, Influenza virus
QPGDNITFS

SEQ ID NO: 311718 - protein, 9 aa, Influenza virus
PGDNITFSH

SEQ ID NO: 311719 - protein, 9 aa, Influenza virus
GDNITFSHN

SEQ ID NO: 311720 - protein, 9 aa, Influenza virus
DNITFSHNG

SEQ ID NO: 311721 - protein, 9 aa, Influenza virus
NITFSHNGG

SEQ ID NO: 311722 - protein, 9 aa, Influenza virus
ITFSHNGGL

SEQ ID NO: 311723 - protein, 9 aa, Influenza virus
TFSHNGGLI

SEQ ID NO: 311724 - protein, 9 aa, Influenza virus
FSHNGGLIA

SEQ ID NO: 311725 - protein, 9 aa, Influenza virus
SHNGGLIAP

SEQ ID NO: 311726 - protein, 9 aa, Influenza virus
HNGGLIAPS

SEQ ID NO: 311727 - protein, 9 aa, Influenza virus
NGGLIAPSR

SEQ ID NO: 311728 - protein, 9 aa, Influenza virus
GGLIAPSRV

SEQ ID NO: 311729 - protein, 9 aa, Influenza virus
GLIAPSRVS

SEQ ID NO: 311730 - protein, 9 aa, Influenza virus
LIAPSRVSK

SEQ ID NO: 311731 - protein, 9 aa, Influenza virus
IAPSRVSKL

SEQ ID NO: 311732 - protein, 9 aa, Influenza virus
APSRVSKLK

SEQ ID NO: 311733 - protein, 9 aa, Influenza virus
PSRVSKLKG

SEQ ID NO: 311734 - protein, 9 aa, Influenza virus
GRGLGIQSG

SEQ ID NO: 311735 - protein, 9 aa, Influenza virus
DNDCESKCF

SEQ ID NO: 311736 - protein, 9 aa, Influenza virus
NDCESKCFW

SEQ ID NO: 311737 - protein, 9 aa, Influenza virus
CESKCFWKG

SEQ ID NO: 311738 - protein, 9 aa, Influenza virus
ESKCFWKGG

SEQ ID NO: 311739 - protein, 9 aa, Influenza virus
SKCFWKGGS

SEQ ID NO: 311740 - protein, 9 aa, Influenza virus
KCFWKGGSI

SEQ ID NO: 311741 - protein, 9 aa, Influenza virus
CFWKGGSIN

SEQ ID NO: 311742 - protein, 9 aa, Influenza virus
FWKGGSINT

SEQ ID NO: 311743 - protein, 9 aa, Influenza virus
WKGGSINTK

SEQ ID NO: 311744 - protein, 9 aa, Influenza virus
KGGSINTKL

SEQ ID NO: 311745 - protein, 9 aa, Influenza virus
GGSINTKLP

SEQ ID NO: 311746 - protein, 9 aa, Influenza virus
GSINTKLPF

SEQ ID NO: 311747 - protein, 9 aa, Influenza virus
SINTKLPFQ

SEQ ID NO: 311748 - protein, 9 aa, Influenza virus
INTKLPFQN

SEQ ID NO: 311749 - protein, 9 aa, Influenza virus
NTKLPFQNL

SEQ ID NO: 311750 - protein, 9 aa, Influenza virus
TKLPFQNLS

SEQ ID NO: 311751 - protein, 9 aa, Influenza virus
KLPFQNLSP

SEQ ID NO: 311752 - protein, 9 aa, Influenza virus
LPFQNLSPR

SEQ ID NO: 311753 - protein, 9 aa, Influenza virus
PFQNLSPRT

SEQ ID NO: 311754 - protein, 9 aa, Influenza virus
FQNLSPRTV

SEQ ID NO: 311755 - protein, 9 aa, Influenza virus
QNLSPRTVG

SEQ ID NO: 311756 - protein, 9 aa, Influenza virus
NLSPRTVGQ

SEQ ID NO: 311757 - protein, 9 aa, Influenza virus
LSPRTVGQC

SEQ ID NO: 311758 - protein, 9 aa, Influenza virus
SPRTVGQCP

SEQ ID NO: 311759 - protein, 9 aa, Influenza virus
PRTVGQCPK

SEQ ID NO: 311760 - protein, 9 aa, Influenza virus
RTVGQCPKY

SEQ ID NO: 311761 - protein, 9 aa, Influenza virus
TVGQCPKYV

SEQ ID NO: 311762 - protein, 9 aa, Influenza virus
VGQCPKYVN

SEQ ID NO: 311763 - protein, 9 aa, Influenza virus
GQCPKYVNK

SEQ ID NO: 311764 - protein, 9 aa, Influenza virus
KSLLLATGM

SEQ ID NO: 311765 - protein, 9 aa, Influenza virus
SLLLATGMR

SEQ ID NO: 311766 - protein, 9 aa, Influenza virus
LLLATGMRN

SEQ ID NO: 311767 - protein, 9 aa, Influenza virus
LLATGMRNV

SEQ ID NO: 311768 - protein, 9 aa, Influenza virus
LATGMRNVP

SEQ ID NO: 311769 - protein, 9 aa, Influenza virus
ATGMRNVPE

SEQ ID NO: 311770 - protein, 9 aa, Influenza virus
TGMRNVPEV

SEQ ID NO: 311771 - protein, 9 aa, Influenza virus
QGRGLFGAI

SEQ ID NO: 311772 - protein, 9 aa, Influenza virus
GRGLFGAIA

SEQ ID NO: 311773 - protein, 9 aa, Influenza virus
RGLFGAIAG

SEQ ID NO: 311774 - protein, 9 aa, Influenza virus
GLFGAIAGF

SEQ ID NO: 311775 - protein, 9 aa, Influenza virus
LFGAIAGFI

SEQ ID NO: 311776 - protein, 9 aa, Influenza virus
FGAIAGFIE

SEQ ID NO: 311777 - protein, 9 aa, Influenza virus
GAIAGFIEN

SEQ ID NO: 311778 - protein, 9 aa, Influenza virus
AIAGFIENG

SEQ ID NO: 311779 - protein, 9 aa, Influenza virus
IAGFIENGW

SEQ ID NO: 311780 - protein, 9 aa, Influenza virus
AGFIENGWE

SEQ ID NO: 311781 - protein, 9 aa, Influenza virus
GFIENGWEG

SEQ ID NO: 311782 - protein, 9 aa, Influenza virus
FIENGWEGM

SEQ ID NO: 311783 - protein, 9 aa, Influenza virus
IENGWEGMV

SEQ ID NO: 311784 - protein, 9 aa, Influenza virus
ENGWEGMVD

SEQ ID NO: 311785 - protein, 9 aa, Influenza virus
NGWEGMVDG

SEQ ID NO: 311786 - protein, 9 aa, Influenza virus
GWEGMVDGW

SEQ ID NO: 311787 - protein, 9 aa, Influenza virus
WEGMVDGWY

SEQ ID NO: 311788 - protein, 9 aa, Influenza virus
EGMVDGWYG

SEQ ID NO: 311789 - protein, 9 aa, Influenza virus
GMVDGWYGF

SEQ ID NO: 311790 - protein, 9 aa, Influenza virus
MVDGWYGFR

SEQ ID NO: 311791 - protein, 9 aa, Influenza virus
VDGWYGFRH

SEQ ID NO: 311792 - protein, 9 aa, Influenza virus
DGWYGFRHQ

SEQ ID NO: 311793 - protein, 9 aa, Influenza virus
GWYGFRHQN

SEQ ID NO: 311794 - protein, 9 aa, Influenza virus
WYGFRHQNA

SEQ ID NO: 311795 - protein, 9 aa, Influenza virus
YGFRHQNAQ

SEQ ID NO: 311796 - protein, 9 aa, Influenza virus
GFRHQNAQG

SEQ ID NO: 311797 - protein, 9 aa, Influenza virus
FRHQNAQGT

SEQ ID NO: 311798 - protein, 9 aa, Influenza virus
RHQNAQGTG

SEQ ID NO: 311799 - protein, 9 aa, Influenza virus
HQNAQGTGQ

SEQ ID NO: 311800 - protein, 9 aa, Influenza virus
QNAQGTGQA

SEQ ID NO: 311801 - protein, 9 aa, Influenza virus
NAQGTGQAA

SEQ ID NO: 311802 - protein, 9 aa, Influenza virus
AQGTGQAAD

SEQ ID NO: 311803 - protein, 9 aa, Influenza virus
QGTGQAADY

SEQ ID NO: 311804 - protein, 9 aa, Influenza virus
GTGQAADYK

SEQ ID NO: 311805 - protein, 9 aa, Influenza virus
TGQAADYKS

SEQ ID NO: 311806 - protein, 9 aa, Influenza virus
GQAADYKST

SEQ ID NO: 311807 - protein, 9 aa, Influenza virus
QAADYKSTQ

SEQ ID NO: 311808 - protein, 9 aa, Influenza virus
AADYKSTQA

SEQ ID NO: 311809 - protein, 9 aa, Influenza virus
ADYKSTQAA

SEQ ID NO: 311810 - protein, 9 aa, Influenza virus
DYKSTQAAI

SEQ ID NO: 311811 - protein, 9 aa, Influenza virus
YKSTQAAID

SEQ ID NO: 311812 - protein, 9 aa, Influenza virus
KSTQAAIDQ

SEQ ID NO: 311813 - protein, 9 aa, Influenza virus
STQAAIDQI

SEQ ID NO: 311814 - protein, 9 aa, Influenza virus
TQAAIDQIT

SEQ ID NO: 311815 - protein, 9 aa, Influenza virus
QAAIDQITG

SEQ ID NO: 311816 - protein, 9 aa, Influenza virus
AAIDQITGK

SEQ ID NO: 311817 - protein, 9 aa, Influenza virus
AIDQITGKL

SEQ ID NO: 311818 - protein, 9 aa, Influenza virus
IDQITGKLN

SEQ ID NO: 311819 - protein, 9 aa, Influenza virus
DQITGKLNR

SEQ ID NO: 311820 - protein, 9 aa, Influenza virus
QITGKLNRL

SEQ ID NO: 311821 - protein, 9 aa, Influenza virus
ITGKLNRLI

SEQ ID NO: 311822 - protein, 9 aa, Influenza virus
TGKLNRLIE

SEQ ID NO: 311823 - protein, 9 aa, Influenza virus
GKLNRLIEK

SEQ ID NO: 311824 - protein, 9 aa, Influenza virus
KLNRLIEKT

SEQ ID NO: 311825 - protein, 9 aa, Influenza virus
LNRLIEKTN

SEQ ID NO: 311826 - protein, 9 aa, Influenza virus
NRLIEKTNT

SEQ ID NO: 311827 - protein, 9 aa, Influenza virus
RLIEKTNTE

SEQ ID NO: 311828 - protein, 9 aa, Influenza virus
LIEKTNTEF

SEQ ID NO: 311829 - protein, 9 aa, Influenza virus
IEKTNTEFE

SEQ ID NO: 311830 - protein, 9 aa, Influenza virus
EKTNTEFES

SEQ ID NO: 311831 - protein, 9 aa, Influenza virus
KTNTEFESI

SEQ ID NO: 311832 - protein, 9 aa, Influenza virus
TNTEFESIE

SEQ ID NO: 311833 - protein, 9 aa, Influenza virus
NTEFESIES

SEQ ID NO: 311834 - protein, 9 aa, Influenza virus
TEFESIESE

SEQ ID NO: 311835 - protein, 9 aa, Influenza virus
EFESIESEF

SEQ ID NO: 311836 - protein, 9 aa, Influenza virus
FESIESEFS

SEQ ID NO: 311837 - protein, 9 aa, Influenza virus
ESIESEFSE

SEQ ID NO: 311838 - protein, 9 aa, Influenza virus
SIESEFSEI

SEQ ID NO: 311839 - protein, 9 aa, Influenza virus
IESEFSEIE

SEQ ID NO: 311840 - protein, 9 aa, Influenza virus
ESEFSEIEH

SEQ ID NO: 311841 - protein, 9 aa, Influenza virus
SEFSEIEHQ

SEQ ID NO: 311842 - protein, 9 aa, Influenza virus
EFSEIEHQI

SEQ ID NO: 311843 - protein, 9 aa, Influenza virus
FSEIEHQIG

SEQ ID NO: 311844 - protein, 9 aa, Influenza virus
SEIEHQIGN

SEQ ID NO: 311845 - protein, 9 aa, Influenza virus
EIEHQIGNV

SEQ ID NO: 311846 - protein, 9 aa, Influenza virus
IEHQIGNVI

SEQ ID NO: 311847 - protein, 9 aa, Influenza virus
EHQIGNVIN

SEQ ID NO: 311848 - protein, 9 aa, Influenza virus
HQIGNVINW

SEQ ID NO: 311849 - protein, 9 aa, Influenza virus
QIGNVINWT

SEQ ID NO: 311850 - protein, 9 aa, Influenza virus
IGNVINWTK

SEQ ID NO: 311851 - protein, 9 aa, Influenza virus
GNVINWTKD

SEQ ID NO: 311852 - protein, 9 aa, Influenza virus
NVINWTKDS

SEQ ID NO: 311853 - protein, 9 aa, Influenza virus
VINWTKDSI

SEQ ID NO: 311854 - protein, 9 aa, Influenza virus
INWTKDSIT

SEQ ID NO: 311855 - protein, 9 aa, Influenza virus
NWTKDSITD

SEQ ID NO: 311856 - protein, 9 aa, Influenza virus
WTKDSITDI

SEQ ID NO: 311857 - protein, 9 aa, Influenza virus
TKDSITDIW

SEQ ID NO: 311858 - protein, 9 aa, Influenza virus
KDSITDIWT

SEQ ID NO: 311859 - protein, 9 aa, Influenza virus
DSITDIWTY

SEQ ID NO: 311860 - protein, 9 aa, Influenza virus
SITDIWTYQ

SEQ ID NO: 311861 - protein, 9 aa, Influenza virus
ITDIWTYQA

SEQ ID NO: 311862 - protein, 9 aa, Influenza virus
TDIWTYQAE

SEQ ID NO: 311863 - protein, 9 aa, Influenza virus
DIWTYQAEL

SEQ ID NO: 311864 - protein, 9 aa, Influenza virus
IWTYQAELL

SEQ ID NO: 311865 - protein, 9 aa, Influenza virus
WTYQAELLV

SEQ ID NO: 311866 - protein, 9 aa, Influenza virus
TYQAELLVA

SEQ ID NO: 311867 - protein, 9 aa, Influenza virus
YQAELLVAM

SEQ ID NO: 311868 - protein, 9 aa, Influenza virus
QAELLVAME

SEQ ID NO: 311869 - protein, 9 aa, Influenza virus
AELLVAMEN

SEQ ID NO: 311870 - protein, 9 aa, Influenza virus
ELLVAMENQ

SEQ ID NO: 311871 - protein, 9 aa, Influenza virus
LLVAMENQH

SEQ ID NO: 311872 - protein, 9 aa, Influenza virus
LVAMENQHT

SEQ ID NO: 311873 - protein, 9 aa, Influenza virus
VAMENQHTI

SEQ ID NO: 311874 - protein, 9 aa, Influenza virus
AMENQHTID

SEQ ID NO: 311875 - protein, 9 aa, Influenza virus
MENQHTIDM

SEQ ID NO: 311876 - protein, 9 aa, Influenza virus
ENQHTIDMA

SEQ ID NO: 311877 - protein, 9 aa, Influenza virus
NQHTIDMAD

SEQ ID NO: 311878 - protein, 9 aa, Influenza virus
QHTIDMADS

SEQ ID NO: 311879 - protein, 9 aa, Influenza virus
HTIDMADSE

SEQ ID NO: 311880 - protein, 9 aa, Influenza virus
TIDMADSEM

SEQ ID NO: 311881 - protein, 9 aa, Influenza virus
IDMADSEML

SEQ ID NO: 311882 - protein, 9 aa, Influenza virus
DMADSEMLN

SEQ ID NO: 311883 - protein, 9 aa, Influenza virus
MADSEMLNL

SEQ ID NO: 311884 - protein, 9 aa, Influenza virus
ADSEMLNLY

SEQ ID NO: 311885 - protein, 9 aa, Influenza virus
DSEMLNLYE

SEQ ID NO: 311886 - protein, 9 aa, Influenza virus
SEMLNLYER

SEQ ID NO: 311887 - protein, 9 aa, Influenza virus
EMLNLYERV

SEQ ID NO: 311888 - protein, 9 aa, Influenza virus
MLNLYERVR

SEQ ID NO: 311889 - protein, 9 aa, Influenza virus
LNLYERVRK

SEQ ID NO: 311890 - protein, 9 aa, Influenza virus
NLYERVRKQ

SEQ ID NO: 311891 - protein, 9 aa, Influenza virus
LYERVRKQL

SEQ ID NO: 311892 - protein, 9 aa, Influenza virus
YERVRKQLR

SEQ ID NO: 311893 - protein, 9 aa, Influenza virus
ERVRKQLRQ

SEQ ID NO: 311894 - protein, 9 aa, Influenza virus
RVRKQLRQN

SEQ ID NO: 311895 - protein, 9 aa, Influenza virus
VRKQLRQNA

SEQ ID NO: 311896 - protein, 9 aa, Influenza virus
RKQLRQNAE

SEQ ID NO: 311897 - protein, 9 aa, Influenza virus
KQLRQNAEE

SEQ ID NO: 311898 - protein, 9 aa, Influenza virus
QLRQNAEED

SEQ ID NO: 311899 - protein, 9 aa, Influenza virus
LRQNAEEDG

SEQ ID NO: 311900 - protein, 9 aa, Influenza virus
RQNAEEDGK

SEQ ID NO: 311901 - protein, 9 aa, Influenza virus
QNAEEDGKG

SEQ ID NO: 311902 - protein, 9 aa, Influenza virus
NAEEDGKGC

SEQ ID NO: 311903 - protein, 9 aa, Influenza virus
AEEDGKGCF

SEQ ID NO: 311904 - protein, 9 aa, Influenza virus
EEDGKGCFE

SEQ ID NO: 311905 - protein, 9 aa, Influenza virus
EDGKGCFEI

SEQ ID NO: 311906 - protein, 9 aa, Influenza virus
DGKGCFEIY

SEQ ID NO: 311907 - protein, 9 aa, Influenza virus
GKGCFEIYH

SEQ ID NO: 311908 - protein, 9 aa, Influenza virus
KGCFEIYHK

SEQ ID NO: 311909 - protein, 9 aa, Influenza virus
GCFEIYHKC

SEQ ID NO: 311910 - protein, 9 aa, Influenza virus
CFEIYHKCD

SEQ ID NO: 311911 - protein, 9 aa, Influenza virus
CDDNCMESI

SEQ ID NO: 311912 - protein, 9 aa, Influenza virus
DDNCMESIR

SEQ ID NO: 311913 - protein, 9 aa, Influenza virus
DNCMESIRN

SEQ ID NO: 311914 - protein, 9 aa, Influenza virus
NCMESIRNN

SEQ ID NO: 311915 - protein, 9 aa, Influenza virus
CMESIRNNT

SEQ ID NO: 311916 - protein, 9 aa, Influenza virus
MESIRNNTY

SEQ ID NO: 311917 - protein, 9 aa, Influenza virus
ESIRNNTYD

SEQ ID NO: 311918 - protein, 9 aa, Influenza virus
SIRNNTYDH

SEQ ID NO: 311919 - protein, 9 aa, Influenza virus
IRNNTYDHT

SEQ ID NO: 311920 - protein, 9 aa, Influenza virus
RNNTYDHTQ

SEQ ID NO: 311921 - protein, 9 aa, Influenza virus
NNTYDHTQY

SEQ ID NO: 311922 - protein, 9 aa, Influenza virus
NTYDHTQYR

SEQ ID NO: 311923 - protein, 9 aa, Influenza virus
TYDHTQYRE

SEQ ID NO: 311924 - protein, 9 aa, Influenza virus
YDHTQYREE

SEQ ID NO: 311925 - protein, 9 aa, Influenza virus
DHTQYREEA

SEQ ID NO: 311926 - protein, 9 aa, Influenza virus
HTQYREEAL

SEQ ID NO: 311927 - protein, 9 aa, Influenza virus
TQYREEALL

SEQ ID NO: 311928 - protein, 9 aa, Influenza virus
QYREEALLN

SEQ ID NO: 311929 - protein, 9 aa, Influenza virus
YREEALLNR

SEQ ID NO: 311930 - protein, 9 aa, Influenza virus
REEALLNRL

SEQ ID NO: 311931 - protein, 9 aa, Influenza virus
EEALLNRLN

SEQ ID NO: 311932 - protein, 9 aa, Influenza virus
EALLNRLNI

SEQ ID NO: 311933 - protein, 9 aa, Influenza virus
ALLNRLNIN

SEQ ID NO: 311934 - protein, 9 aa, Influenza virus
LLNRLNINP

SEQ ID NO: 311935 - protein, 9 aa, Influenza virus
LNRLNINPV

SEQ ID NO: 311936 - protein, 9 aa, Influenza virus
NRLNINPVK

SEQ ID NO: 311937 - protein, 9 aa, Influenza virus
RLNINPVKL

SEQ ID NO: 311938 - protein, 9 aa, Influenza virus
LNINPVKLS

SEQ ID NO: 311939 - protein, 9 aa, Influenza virus
NINPVKLSS

SEQ ID NO: 311940 - protein, 9 aa, Influenza virus
INPVKLSSG

SEQ ID NO: 311941 - protein, 9 aa, Influenza virus
NPVKLSSGY

SEQ ID NO: 311942 - protein, 9 aa, Influenza virus
PVKLSSGYK

SEQ ID NO: 311943 - protein, 9 aa, Influenza virus
VKLSSGYKD

SEQ ID NO: 311944 - protein, 9 aa, Influenza virus
KLSSGYKDV

SEQ ID NO: 311945 - protein, 9 aa, Influenza virus
LSSGYKDVI

SEQ ID NO: 311946 - protein, 9 aa, Influenza virus
SSGYKDVIL

SEQ ID NO: 311947 - protein, 9 aa, Influenza virus
SGYKDVILW

SEQ ID NO: 311948 - protein, 9 aa, Influenza virus
GYKDVILWF

SEQ ID NO: 311949 - protein, 9 aa, Influenza virus
YKDVILWFS

SEQ ID NO: 311950 - protein, 9 aa, Influenza virus
KDVILWFSF

SEQ ID NO: 311951 - protein, 9 aa, Influenza virus
DVILWFSFG

SEQ ID NO: 311952 - protein, 9 aa, Influenza virus
VILWFSFGA

SEQ ID NO: 311953 - protein, 9 aa, Influenza virus
ILWFSFGAS

SEQ ID NO: 311954 - protein, 9 aa, Influenza virus
LWFSFGASC

SEQ ID NO: 311955 - protein, 9 aa, Influenza virus
WFSFGASCF

SEQ ID NO: 311956 - protein, 9 aa, Influenza virus
FSFGASCFV

SEQ ID NO: 311957 - protein, 9 aa, Influenza virus
SFGASCFVL

SEQ ID NO: 311958 - protein, 9 aa, Influenza virus
FGASCFVLL

SEQ ID NO: 311959 - protein, 9 aa, Influenza virus
GASCFVLLA

SEQ ID NO: 311960 - protein, 9 aa, Influenza virus
ASCFVLLAV

SEQ ID NO: 311961 - protein, 9 aa, Influenza virus
SCFVLLAVI

SEQ ID NO: 311962 - protein, 9 aa, Influenza virus
IMGLVFFCL

SEQ ID NO: 311963 - protein, 9 aa, Influenza virus
MGLVFFCLK

SEQ ID NO: 311964 - protein, 9 aa, Influenza virus
GLVFFCLKN

SEQ ID NO: 311965 - protein, 9 aa, Influenza virus
LVFFCLKNG

SEQ ID NO: 311966 - protein, 9 aa, Influenza virus
VFFCLKNGN

SEQ ID NO: 311967 - protein, 9 aa, Influenza virus
FFCLKNGNM

SEQ ID NO: 311968 - protein, 9 aa, Influenza virus
FCLKNGNMR

SEQ ID NO: 311969 - protein, 9 aa, Influenza virus
CLKNGNMRC

SEQ ID NO: 311970 - protein, 9 aa, Influenza virus
LKNGNMRCT

SEQ ID NO: 311971 - protein, 9 aa, Influenza virus
KNGNMRCTI

SEQ ID NO: 311972 - protein, 9 aa, Influenza virus
NGNMRCTIC

SEQ ID NO: 311973 - protein, 9 aa, Influenza virus
GNMRCTICI

SEQ ID NO: 311974 - protein, 9 aa, Influenza virus
MNPNQKLFA

SEQ ID NO: 311975 - protein, 9 aa, Influenza virus
NPNQKLFAL

SEQ ID NO: 311976 - protein, 9 aa, Influenza virus
PNQKLFALS

SEQ ID NO: 311977 - protein, 9 aa, Influenza virus
NQKLFALSG

SEQ ID NO: 311978 - protein, 9 aa, Influenza virus
QKLFALSGV

SEQ ID NO: 311979 - protein, 9 aa, Influenza virus
KLFALSGVA

SEQ ID NO: 311980 - protein, 9 aa, Influenza virus
LFALSGVAI

SEQ ID NO: 311981 - protein, 9 aa, Influenza virus
FALSGVAIA

SEQ ID NO: 311982 - protein, 9 aa, Influenza virus
ALSGVAIAL

SEQ ID NO: 311983 - protein, 9 aa, Influenza virus
LSGVAIALS

SEQ ID NO: 311984 - protein, 9 aa, Influenza virus
LNLLIGISN

SEQ ID NO: 311985 - protein, 9 aa, Influenza virus
NLLIGISNV

SEQ ID NO: 311986 - protein, 9 aa, Influenza virus
LLIGISNVG

SEQ ID NO: 311987 - protein, 9 aa, Influenza virus
LIGISNVGL

SEQ ID NO: 311988 - protein, 9 aa, Influenza virus
IGISNVGLN

SEQ ID NO: 311989 - protein, 9 aa, Influenza virus
GISNVGLNV

SEQ ID NO: 311990 - protein, 9 aa, Influenza virus
ISNVGLNVS

SEQ ID NO: 311991 - protein, 9 aa, Influenza virus
SNVGLNVSL

SEQ ID NO: 311992 - protein, 9 aa, Influenza virus
NVGLNVSLH

SEQ ID NO: 311993 - protein, 9 aa, Influenza virus
VGLNVSLHL

SEQ ID NO: 311994 - protein, 9 aa, Influenza virus
GLNVSLHLK

SEQ ID NO: 311995 - protein, 9 aa, Influenza virus
EKGTKQEEN

SEQ ID NO: 311996 - protein, 9 aa, Influenza virus
TQNNTTLIE

SEQ ID NO: 311997 - protein, 9 aa, Influenza virus
QNNTTLIEN

SEQ ID NO: 311998 - protein, 9 aa, Influenza virus
NNTTLIENT

SEQ ID NO: 311999 - protein, 9 aa, Influenza virus
NTTLIENTY

SEQ ID NO: 312000 - protein, 9 aa, Influenza virus
TTLIENTYV

SEQ ID NO: 312001 - protein, 9 aa, Influenza virus
TLIENTYVN

SEQ ID NO: 312002 - protein, 9 aa, Influenza virus
LIENTYVNN

SEQ ID NO: 312003 - protein, 9 aa, Influenza virus
IENTYVNNT

SEQ ID NO: 312004 - protein, 9 aa, Influenza virus
ENTYVNNTT

SEQ ID NO: 312005 - protein, 9 aa, Influenza virus
NTYVNNTTV

SEQ ID NO: 312006 - protein, 9 aa, Influenza virus
TYVNNTTVI

SEQ ID NO: 312007 - protein, 9 aa, Influenza virus
YVNNTTVIN

SEQ ID NO: 312008 - protein, 9 aa, Influenza virus
VNNTTVINK

SEQ ID NO: 312009 - protein, 9 aa, Influenza virus
YLMLNKSLC

SEQ ID NO: 312010 - protein, 9 aa, Influenza virus
LMLNKSLCK

SEQ ID NO: 312011 - protein, 9 aa, Influenza virus
MLNKSLCKV

SEQ ID NO: 312012 - protein, 9 aa, Influenza virus
LNKSLCKVE

SEQ ID NO: 312013 - protein, 9 aa, Influenza virus
NKSLCKVEG

SEQ ID NO: 312014 - protein, 9 aa, Influenza virus
KSLCKVEGW

SEQ ID NO: 312015 - protein, 9 aa, Influenza virus
SLCKVEGWV

SEQ ID NO: 312016 - protein, 9 aa, Influenza virus
LCKVEGWVV

SEQ ID NO: 312017 - protein, 9 aa, Influenza virus
CKVEGWVVV

SEQ ID NO: 312018 - protein, 9 aa, Influenza virus
KVEGWVVVA

SEQ ID NO: 312019 - protein, 9 aa, Influenza virus
VEGWVVVAK

SEQ ID NO: 312020 - protein, 9 aa, Influenza virus
EGWVVVAKD

SEQ ID NO: 312021 - protein, 9 aa, Influenza virus
GWVVVAKDN

SEQ ID NO: 312022 - protein, 9 aa, Influenza virus
WVVVAKDNA

SEQ ID NO: 312023 - protein, 9 aa, Influenza virus
VVVAKDNAI

SEQ ID NO: 312024 - protein, 9 aa, Influenza virus
VVAKDNAIR

SEQ ID NO: 312025 - protein, 9 aa, Influenza virus
VAKDNAIRF

SEQ ID NO: 312026 - protein, 9 aa, Influenza virus
AKDNAIRFG

SEQ ID NO: 312027 - protein, 9 aa, Influenza virus
KDNAIRFGE

SEQ ID NO: 312028 - protein, 9 aa, Influenza virus
DNAIRFGES

SEQ ID NO: 312029 - protein, 9 aa, Influenza virus
NAIRFGESE

SEQ ID NO: 312030 - protein, 9 aa, Influenza virus
AIRFGESEQ

SEQ ID NO: 312031 - protein, 9 aa, Influenza virus
IRFGESEQI

SEQ ID NO: 312032 - protein, 9 aa, Influenza virus
RFGESEQII

SEQ ID NO: 312033 - protein, 9 aa, Influenza virus
FGESEQIIV

SEQ ID NO: 312034 - protein, 9 aa, Influenza virus
GESEQIIVT

SEQ ID NO: 312035 - protein, 9 aa, Influenza virus
ESEQIIVTR

SEQ ID NO: 312036 - protein, 9 aa, Influenza virus
SEQIIVTRE

SEQ ID NO: 312037 - protein, 9 aa, Influenza virus
EQIIVTREP

SEQ ID NO: 312038 - protein, 9 aa, Influenza virus
QIIVTREPY

SEQ ID NO: 312039 - protein, 9 aa, Influenza virus
IIVTREPYV

SEQ ID NO: 312040 - protein, 9 aa, Influenza virus
IVTREPYVS

SEQ ID NO: 312041 - protein, 9 aa, Influenza virus
VTREPYVSC

SEQ ID NO: 312042 - protein, 9 aa, Influenza virus
TREPYVSCD

SEQ ID NO: 312043 - protein, 9 aa, Influenza virus
REPYVSCDP

SEQ ID NO: 312044 - protein, 9 aa, Influenza virus
EPYVSCDPL

SEQ ID NO: 312045 - protein, 9 aa, Influenza virus
PYVSCDPLG

SEQ ID NO: 312046 - protein, 9 aa, Influenza virus
YVSCDPLGC

SEQ ID NO: 312047 - protein, 9 aa, Influenza virus
VSCDPLGCK

SEQ ID NO: 312048 - protein, 9 aa, Influenza virus
SCDPLGCKM

SEQ ID NO: 312049 - protein, 9 aa, Influenza virus
CDPLGCKMY

SEQ ID NO: 312050 - protein, 9 aa, Influenza virus
DPLGCKMYA

SEQ ID NO: 312051 - protein, 9 aa, Influenza virus
PLGCKMYAL

SEQ ID NO: 312052 - protein, 9 aa, Influenza virus
LGCKMYALH

SEQ ID NO: 312053 - protein, 9 aa, Influenza virus
GCKMYALHQ

SEQ ID NO: 312054 - protein, 9 aa, Influenza virus
CKMYALHQG

SEQ ID NO: 312055 - protein, 9 aa, Influenza virus
KMYALHQGT

SEQ ID NO: 312056 - protein, 9 aa, Influenza virus
MYALHQGTT

SEQ ID NO: 312057 - protein, 9 aa, Influenza virus
YALHQGTTI

SEQ ID NO: 312058 - protein, 9 aa, Influenza virus
ALHQGTTIR

SEQ ID NO: 312059 - protein, 9 aa, Influenza virus
LHQGTTIRN

SEQ ID NO: 312060 - protein, 9 aa, Influenza virus
HQGTTIRNK

SEQ ID NO: 312061 - protein, 9 aa, Influenza virus
QGTTIRNKH

SEQ ID NO: 312062 - protein, 9 aa, Influenza virus
GTTIRNKHS

SEQ ID NO: 312063 - protein, 9 aa, Influenza virus
TTIRNKHSN

SEQ ID NO: 312064 - protein, 9 aa, Influenza virus
TIRNKHSNG

SEQ ID NO: 312065 - protein, 9 aa, Influenza virus
IRNKHSNGT

SEQ ID NO: 312066 - protein, 9 aa, Influenza virus
RNKHSNGTI

SEQ ID NO: 312067 - protein, 9 aa, Influenza virus
NKHSNGTIH

SEQ ID NO: 312068 - protein, 9 aa, Influenza virus
KHSNGTIHD

SEQ ID NO: 312069 - protein, 9 aa, Influenza virus
HSNGTIHDR

SEQ ID NO: 312070 - protein, 9 aa, Influenza virus
SNGTIHDRT

SEQ ID NO: 312071 - protein, 9 aa, Influenza virus
NGTIHDRTA

SEQ ID NO: 312072 - protein, 9 aa, Influenza virus
GTIHDRTAF

SEQ ID NO: 312073 - protein, 9 aa, Influenza virus
TIHDRTAFR

SEQ ID NO: 312074 - protein, 9 aa, Influenza virus
IHDRTAFRG

SEQ ID NO: 312075 - protein, 9 aa, Influenza virus
HDRTAFRGL

SEQ ID NO: 312076 - protein, 9 aa, Influenza virus
DRTAFRGLI

SEQ ID NO: 312077 - protein, 9 aa, Influenza virus
RTAFRGLIS

SEQ ID NO: 312078 - protein, 9 aa, Influenza virus
TAFRGLIST

SEQ ID NO: 312079 - protein, 9 aa, Influenza virus
AFRGLISTP

SEQ ID NO: 312080 - protein, 9 aa, Influenza virus
FRGLISTPL

SEQ ID NO: 312081 - protein, 9 aa, Influenza virus
RGLISTPLG

SEQ ID NO: 312082 - protein, 9 aa, Influenza virus
GLISTPLGS

SEQ ID NO: 312083 - protein, 9 aa, Influenza virus
LISTPLGSP

SEQ ID NO: 312084 - protein, 9 aa, Influenza virus
ISTPLGSPP

SEQ ID NO: 312085 - protein, 9 aa, Influenza virus
STPLGSPPI

SEQ ID NO: 312086 - protein, 9 aa, Influenza virus
TPLGSPPIV

SEQ ID NO: 312087 - protein, 9 aa, Influenza virus
PLGSPPIVS

SEQ ID NO: 312088 - protein, 9 aa, Influenza virus
LGSPPIVSN

SEQ ID NO: 312089 - protein, 9 aa, Influenza virus
GSPPIVSNS

SEQ ID NO: 312090 - protein, 9 aa, Influenza virus
SPPIVSNSD

SEQ ID NO: 312091 - protein, 9 aa, Influenza virus
PPIVSNSDF

SEQ ID NO: 312092 - protein, 9 aa, Influenza virus
VSNSDFLCV

SEQ ID NO: 312093 - protein, 9 aa, Influenza virus
SNSDFLCVG

SEQ ID NO: 312094 - protein, 9 aa, Influenza virus
NSDFLCVGW

SEQ ID NO: 312095 - protein, 9 aa, Influenza virus
SDFLCVGWS

SEQ ID NO: 312096 - protein, 9 aa, Influenza virus
DFLCVGWSS

SEQ ID NO: 312097 - protein, 9 aa, Influenza virus
FLCVGWSST

SEQ ID NO: 312098 - protein, 9 aa, Influenza virus
LCVGWSSTS

SEQ ID NO: 312099 - protein, 9 aa, Influenza virus
CVGWSSTSC

SEQ ID NO: 312100 - protein, 9 aa, Influenza virus
VGWSSTSCH

SEQ ID NO: 312101 - protein, 9 aa, Influenza virus
GWSSTSCHD

SEQ ID NO: 312102 - protein, 9 aa, Influenza virus
WSSTSCHDG

SEQ ID NO: 312103 - protein, 9 aa, Influenza virus
SSTSCHDGI

SEQ ID NO: 312104 - protein, 9 aa, Influenza virus
STSCHDGIG

SEQ ID NO: 312105 - protein, 9 aa, Influenza virus
TSCHDGIGR

SEQ ID NO: 312106 - protein, 9 aa, Influenza virus
SCHDGIGRM

SEQ ID NO: 312107 - protein, 9 aa, Influenza virus
CHDGIGRMT

SEQ ID NO: 312108 - protein, 9 aa, Influenza virus
HDGIGRMTI

SEQ ID NO: 312109 - protein, 9 aa, Influenza virus
DGIGRMTIC

SEQ ID NO: 312110 - protein, 9 aa, Influenza virus
GIGRMTICV

SEQ ID NO: 312111 - protein, 9 aa, Influenza virus
IGRMTICVQ

SEQ ID NO: 312112 - protein, 9 aa, Influenza virus
GRMTICVQG

SEQ ID NO: 312113 - protein, 9 aa, Influenza virus
RMTICVQGN

SEQ ID NO: 312114 - protein, 9 aa, Influenza virus
MTICVQGNN

SEQ ID NO: 312115 - protein, 9 aa, Influenza virus
TICVQGNND

SEQ ID NO: 312116 - protein, 9 aa, Influenza virus
ICVQGNNDN

SEQ ID NO: 312117 - protein, 9 aa, Influenza virus
CVQGNNDNA

SEQ ID NO: 312118 - protein, 9 aa, Influenza virus
VQGNNDNAT

SEQ ID NO: 312119 - protein, 9 aa, Influenza virus
QGNNDNATA

SEQ ID NO: 312120 - protein, 9 aa, Influenza virus
GNNDNATAT

SEQ ID NO: 312121 - protein, 9 aa, Influenza virus
NNDNATATV

SEQ ID NO: 312122 - protein, 9 aa, Influenza virus
NDNATATVY

SEQ ID NO: 312123 - protein, 9 aa, Influenza virus
DNATATVYY

SEQ ID NO: 312124 - protein, 9 aa, Influenza virus
NATATVYYD

SEQ ID NO: 312125 - protein, 9 aa, Influenza virus
ATATVYYDR

SEQ ID NO: 312126 - protein, 9 aa, Influenza virus
TATVYYDRR

SEQ ID NO: 312127 - protein, 9 aa, Influenza virus
ATVYYDRRL

SEQ ID NO: 312128 - protein, 9 aa, Influenza virus
TVYYDRRLT

SEQ ID NO: 312129 - protein, 9 aa, Influenza virus
VYYDRRLTT

SEQ ID NO: 312130 - protein, 9 aa, Influenza virus
YYDRRLTTT

SEQ ID NO: 312131 - protein, 9 aa, Influenza virus
YDRRLTTTI

SEQ ID NO: 312132 - protein, 9 aa, Influenza virus
DRRLTTTIK

SEQ ID NO: 312133 - protein, 9 aa, Influenza virus
RRLTTTIKT

SEQ ID NO: 312134 - protein, 9 aa, Influenza virus
RLTTTIKTW

SEQ ID NO: 312135 - protein, 9 aa, Influenza virus
LTTTIKTWA

SEQ ID NO: 312136 - protein, 9 aa, Influenza virus
TTTIKTWAG

SEQ ID NO: 312137 - protein, 9 aa, Influenza virus
TTIKTWAGN

SEQ ID NO: 312138 - protein, 9 aa, Influenza virus
TIKTWAGNI

SEQ ID NO: 312139 - protein, 9 aa, Influenza virus
IKTWAGNIL

SEQ ID NO: 312140 - protein, 9 aa, Influenza virus
KTWAGNILR

SEQ ID NO: 312141 - protein, 9 aa, Influenza virus
TWAGNILRT

SEQ ID NO: 312142 - protein, 9 aa, Influenza virus
WAGNILRTQ

SEQ ID NO: 312143 - protein, 9 aa, Influenza virus
AGNILRTQE

SEQ ID NO: 312144 - protein, 9 aa, Influenza virus
GNILRTQES

SEQ ID NO: 312145 - protein, 9 aa, Influenza virus
NILRTQESE

SEQ ID NO: 312146 - protein, 9 aa, Influenza virus
ILRTQESEC

SEQ ID NO: 312147 - protein, 9 aa, Influenza virus
LRTQESECV

SEQ ID NO: 312148 - protein, 9 aa, Influenza virus
RTQESECVC

SEQ ID NO: 312149 - protein, 9 aa, Influenza virus
TQESECVCH

SEQ ID NO: 312150 - protein, 9 aa, Influenza virus
QESECVCHN

SEQ ID NO: 312151 - protein, 9 aa, Influenza virus
ESECVCHNG

SEQ ID NO: 312152 - protein, 9 aa, Influenza virus
SECVCHNGT

SEQ ID NO: 312153 - protein, 9 aa, Influenza virus
ECVCHNGTC

SEQ ID NO: 312154 - protein, 9 aa, Influenza virus
CVCHNGTCV

SEQ ID NO: 312155 - protein, 9 aa, Influenza virus
VCHNGTCVV

SEQ ID NO: 312156 - protein, 9 aa, Influenza virus
CHNGTCVVI

SEQ ID NO: 312157 - protein, 9 aa, Influenza virus
HNGTCVVIM

SEQ ID NO: 312158 - protein, 9 aa, Influenza virus
NGTCVVIMT

SEQ ID NO: 312159 - protein, 9 aa, Influenza virus
GTCVVIMTD

SEQ ID NO: 312160 - protein, 9 aa, Influenza virus
TCVVIMTDG

SEQ ID NO: 312161 - protein, 9 aa, Influenza virus
CVVIMTDGS

SEQ ID NO: 312162 - protein, 9 aa, Influenza virus
VVIMTDGSA

SEQ ID NO: 312163 - protein, 9 aa, Influenza virus
VIMTDGSAS

SEQ ID NO: 312164 - protein, 9 aa, Influenza virus
IMTDGSASS

SEQ ID NO: 312165 - protein, 9 aa, Influenza virus
MTDGSASSQ

SEQ ID NO: 312166 - protein, 9 aa, Influenza virus
TDGSASSQA

SEQ ID NO: 312167 - protein, 9 aa, Influenza virus
DGSASSQAY

SEQ ID NO: 312168 - protein, 9 aa, Influenza virus
GSASSQAYT

SEQ ID NO: 312169 - protein, 9 aa, Influenza virus
SASSQAYTK

SEQ ID NO: 312170 - protein, 9 aa, Influenza virus
ASSQAYTKV

SEQ ID NO: 312171 - protein, 9 aa, Influenza virus
QAYTKVLYF

SEQ ID NO: 312172 - protein, 9 aa, Influenza virus
AYTKVLYFH

SEQ ID NO: 312173 - protein, 9 aa, Influenza virus
YTKVLYFHK

SEQ ID NO: 312174 - protein, 9 aa, Influenza virus
TKVLYFHKG

SEQ ID NO: 312175 - protein, 9 aa, Influenza virus
KVLYFHKGL

SEQ ID NO: 312176 - protein, 9 aa, Influenza virus
YFHKGLVIK

SEQ ID NO: 312177 - protein, 9 aa, Influenza virus
FHKGLVIKE

SEQ ID NO: 312178 - protein, 9 aa, Influenza virus
HKGLVIKEE

SEQ ID NO: 312179 - protein, 9 aa, Influenza virus
KEEALKGSA

SEQ ID NO: 312180 - protein, 9 aa, Influenza virus
EEALKGSAR

SEQ ID NO: 312181 - protein, 9 aa, Influenza virus
EALKGSARH

SEQ ID NO: 312182 - protein, 9 aa, Influenza virus
LKGSARHIE

SEQ ID NO: 312183 - protein, 9 aa, Influenza virus
KGSARHIEE

SEQ ID NO: 312184 - protein, 9 aa, Influenza virus
GSARHIEEC

SEQ ID NO: 312185 - protein, 9 aa, Influenza virus
SARHIEECS

SEQ ID NO: 312186 - protein, 9 aa, Influenza virus
ARHIEECSC

SEQ ID NO: 312187 - protein, 9 aa, Influenza virus
RHIEECSCY

SEQ ID NO: 312188 - protein, 9 aa, Influenza virus
HIEECSCYG

SEQ ID NO: 312189 - protein, 9 aa, Influenza virus
IEECSCYGH

SEQ ID NO: 312190 - protein, 9 aa, Influenza virus
EECSCYGHN

SEQ ID NO: 312191 - protein, 9 aa, Influenza virus
ECSCYGHNS

SEQ ID NO: 312192 - protein, 9 aa, Influenza virus
CSCYGHNSK

SEQ ID NO: 312193 - protein, 9 aa, Influenza virus
CYGHNSKVT

SEQ ID NO: 312194 - protein, 9 aa, Influenza virus
YGHNSKVTC

SEQ ID NO: 312195 - protein, 9 aa, Influenza virus
SKVTCVCRD

SEQ ID NO: 312196 - protein, 9 aa, Influenza virus
KVTCVCRDN

SEQ ID NO: 312197 - protein, 9 aa, Influenza virus
VTCVCRDNW

SEQ ID NO: 312198 - protein, 9 aa, Influenza virus
TCVCRDNWQ

SEQ ID NO: 312199 - protein, 9 aa, Influenza virus
CVCRDNWQG

SEQ ID NO: 312200 - protein, 9 aa, Influenza virus
VCRDNWQGA

SEQ ID NO: 312201 - protein, 9 aa, Influenza virus
CRDNWQGAN

SEQ ID NO: 312202 - protein, 9 aa, Influenza virus
RDNWQGANR

SEQ ID NO: 312203 - protein, 9 aa, Influenza virus
DNWQGANRP

SEQ ID NO: 312204 - protein, 9 aa, Influenza virus
NWQGANRPV

SEQ ID NO: 312205 - protein, 9 aa, Influenza virus
WQGANRPVI

SEQ ID NO: 312206 - protein, 9 aa, Influenza virus
QGANRPVIE

SEQ ID NO: 312207 - protein, 9 aa, Influenza virus
GANRPVIEI

SEQ ID NO: 312208 - protein, 9 aa, Influenza virus
ANRPVIEID

SEQ ID NO: 312209 - protein, 9 aa, Influenza virus
NRPVIEIDM

SEQ ID NO: 312210 - protein, 9 aa, Influenza virus
AMEHTSQYL

SEQ ID NO: 312211 - protein, 9 aa, Influenza virus
MEHTSQYLC

SEQ ID NO: 312212 - protein, 9 aa, Influenza virus
EHTSQYLCT

SEQ ID NO: 312213 - protein, 9 aa, Influenza virus
HTSQYLCTG

SEQ ID NO: 312214 - protein, 9 aa, Influenza virus
TSQYLCTGV

SEQ ID NO: 312215 - protein, 9 aa, Influenza virus
SQYLCTGVL

SEQ ID NO: 312216 - protein, 9 aa, Influenza virus
QYLCTGVLT

SEQ ID NO: 312217 - protein, 9 aa, Influenza virus
YLCTGVLTD

SEQ ID NO: 312218 - protein, 9 aa, Influenza virus
LCTGVLTDT

SEQ ID NO: 312219 - protein, 9 aa, Influenza virus
CTGVLTDTS

SEQ ID NO: 312220 - protein, 9 aa, Influenza virus
TGVLTDTSR

SEQ ID NO: 312221 - protein, 9 aa, Influenza virus
GVLTDTSRP

SEQ ID NO: 312222 - protein, 9 aa, Influenza virus
VLTDTSRPS

SEQ ID NO: 312223 - protein, 9 aa, Influenza virus
LTDTSRPSD

SEQ ID NO: 312224 - protein, 9 aa, Influenza virus
TDTSRPSDK

SEQ ID NO: 312225 - protein, 9 aa, Influenza virus
GDCNNPITG

SEQ ID NO: 312226 - protein, 9 aa, Influenza virus
DCNNPITGS

SEQ ID NO: 312227 - protein, 9 aa, Influenza virus
CNNPITGSP

SEQ ID NO: 312228 - protein, 9 aa, Influenza virus
NNPITGSPG

SEQ ID NO: 312229 - protein, 9 aa, Influenza virus
NPITGSPGA

SEQ ID NO: 312230 - protein, 9 aa, Influenza virus
PITGSPGAP

SEQ ID NO: 312231 - protein, 9 aa, Influenza virus
ITGSPGAPG

SEQ ID NO: 312232 - protein, 9 aa, Influenza virus
TGSPGAPGV

SEQ ID NO: 312233 - protein, 9 aa, Influenza virus
GSPGAPGVK

SEQ ID NO: 312234 - protein, 9 aa, Influenza virus
SPGAPGVKG

SEQ ID NO: 312235 - protein, 9 aa, Influenza virus
PGAPGVKGF

SEQ ID NO: 312236 - protein, 9 aa, Influenza virus
GAPGVKGFG

SEQ ID NO: 312237 - protein, 9 aa, Influenza virus
APGVKGFGF

SEQ ID NO: 312238 - protein, 9 aa, Influenza virus
PGVKGFGFL

SEQ ID NO: 312239 - protein, 9 aa, Influenza virus
GVKGFGFLD

SEQ ID NO: 312240 - protein, 9 aa, Influenza virus
VKGFGFLDS

SEQ ID NO: 312241 - protein, 9 aa, Influenza virus
GNTWLGRTI

SEQ ID NO: 312242 - protein, 9 aa, Influenza virus
NTWLGRTIS

SEQ ID NO: 312243 - protein, 9 aa, Influenza virus
TWLGRTISP

SEQ ID NO: 312244 - protein, 9 aa, Influenza virus
WLGRTISPR

SEQ ID NO: 312245 - protein, 9 aa, Influenza virus
LGRTISPRS

SEQ ID NO: 312246 - protein, 9 aa, Influenza virus
GRTISPRSR

SEQ ID NO: 312247 - protein, 9 aa, Influenza virus
RTISPRSRS

SEQ ID NO: 312248 - protein, 9 aa, Influenza virus
TISPRSRSG

SEQ ID NO: 312249 - protein, 9 aa, Influenza virus
ISPRSRSGF

SEQ ID NO: 312250 - protein, 9 aa, Influenza virus
SPRSRSGFE

SEQ ID NO: 312251 - protein, 9 aa, Influenza virus
PRSRSGFEM

SEQ ID NO: 312252 - protein, 9 aa, Influenza virus
RSRSGFEML

SEQ ID NO: 312253 - protein, 9 aa, Influenza virus
SRSGFEMLK

SEQ ID NO: 312254 - protein, 9 aa, Influenza virus
RSGFEMLKI

SEQ ID NO: 312255 - protein, 9 aa, Influenza virus
SGFEMLKIP

SEQ ID NO: 312256 - protein, 9 aa, Influenza virus
GFEMLKIPN

SEQ ID NO: 312257 - protein, 9 aa, Influenza virus
FEMLKIPNA

SEQ ID NO: 312258 - protein, 9 aa, Influenza virus
EMLKIPNAG

SEQ ID NO: 312259 - protein, 9 aa, Influenza virus
MLKIPNAGT

SEQ ID NO: 312260 - protein, 9 aa, Influenza virus
LKIPNAGTD

SEQ ID NO: 312261 - protein, 9 aa, Influenza virus
KIPNAGTDP

SEQ ID NO: 312262 - protein, 9 aa, Influenza virus
IPNAGTDPN

SEQ ID NO: 312263 - protein, 9 aa, Influenza virus
PNAGTDPNS

SEQ ID NO: 312264 - protein, 9 aa, Influenza virus
TERQEIVDN

SEQ ID NO: 312265 - protein, 9 aa, Influenza virus
ERQEIVDNN

SEQ ID NO: 312266 - protein, 9 aa, Influenza virus
NNNWSGYSG

SEQ ID NO: 312267 - protein, 9 aa, Influenza virus
NNWSGYSGS

SEQ ID NO: 312268 - protein, 9 aa, Influenza virus
NWSGYSGSF

SEQ ID NO: 312269 - protein, 9 aa, Influenza virus
WSGYSGSFI

SEQ ID NO: 312270 - protein, 9 aa, Influenza virus
SGYSGSFID

SEQ ID NO: 312271 - protein, 9 aa, Influenza virus
GYSGSFIDY

SEQ ID NO: 312272 - protein, 9 aa, Influenza virus
YSGSFIDYW

SEQ ID NO: 312273 - protein, 9 aa, Influenza virus
SGSFIDYWD

SEQ ID NO: 312274 - protein, 9 aa, Influenza virus
GSFIDYWDE

SEQ ID NO: 312275 - protein, 9 aa, Influenza virus
SECYNPCFY

SEQ ID NO: 312276 - protein, 9 aa, Influenza virus
ECYNPCFYV

SEQ ID NO: 312277 - protein, 9 aa, Influenza virus
CYNPCFYVE

SEQ ID NO: 312278 - protein, 9 aa, Influenza virus
YNPCFYVEL

SEQ ID NO: 312279 - protein, 9 aa, Influenza virus
NPCFYVELI

SEQ ID NO: 312280 - protein, 9 aa, Influenza virus
PCFYVELIR

SEQ ID NO: 312281 - protein, 9 aa, Influenza virus
CFYVELIRG

SEQ ID NO: 312282 - protein, 9 aa, Influenza virus
FYVELIRGR

SEQ ID NO: 312283 - protein, 9 aa, Influenza virus
YVELIRGRP

SEQ ID NO: 312284 - protein, 9 aa, Influenza virus
VELIRGRPE

SEQ ID NO: 312285 - protein, 9 aa, Influenza virus
ELIRGRPEE

SEQ ID NO: 312286 - protein, 9 aa, Influenza virus
LIRGRPEEA

SEQ ID NO: 312287 - protein, 9 aa, Influenza virus
IRGRPEEAK

SEQ ID NO: 312288 - protein, 9 aa, Influenza virus
RGRPEEAKY

SEQ ID NO: 312289 - protein, 9 aa, Influenza virus
GRPEEAKYV

SEQ ID NO: 312290 - protein, 9 aa, Influenza virus
RPEEAKYVW

SEQ ID NO: 312291 - protein, 9 aa, Influenza virus
PEEAKYVWW

SEQ ID NO: 312292 - protein, 9 aa, Influenza virus
EEAKYVWWT

SEQ ID NO: 312293 - protein, 9 aa, Influenza virus
EAKYVWWTS

SEQ ID NO: 312294 - protein, 9 aa, Influenza virus
AKYVWWTSN

SEQ ID NO: 312295 - protein, 9 aa, Influenza virus
KYVWWTSNS

SEQ ID NO: 312296 - protein, 9 aa, Influenza virus
YVWWTSNSL

SEQ ID NO: 312297 - protein, 9 aa, Influenza virus
VWWTSNSLV

SEQ ID NO: 312298 - protein, 9 aa, Influenza virus
WWTSNSLVA

SEQ ID NO: 312299 - protein, 9 aa, Influenza virus
WTSNSLVAL

SEQ ID NO: 312300 - protein, 9 aa, Influenza virus
TSNSLVALC

SEQ ID NO: 312301 - protein, 9 aa, Influenza virus
SNSLVALCG

SEQ ID NO: 312302 - protein, 9 aa, Influenza virus
NSLVALCGS

SEQ ID NO: 312303 - protein, 9 aa, Influenza virus
SLVALCGSP

SEQ ID NO: 312304 - protein, 9 aa, Influenza virus
LVALCGSPI

SEQ ID NO: 312305 - protein, 9 aa, Influenza virus
VALCGSPIS

SEQ ID NO: 312306 - protein, 9 aa, Influenza virus
ALCGSPISV

SEQ ID NO: 312307 - protein, 9 aa, Influenza virus
LCGSPISVG

SEQ ID NO: 312308 - protein, 9 aa, Influenza virus
CGSPISVGS

SEQ ID NO: 312309 - protein, 9 aa, Influenza virus
GSPISVGSG

SEQ ID NO: 312310 - protein, 9 aa, Influenza virus
SPISVGSGS

SEQ ID NO: 312311 - protein, 9 aa, Influenza virus
PISVGSGSF

SEQ ID NO: 312312 - protein, 9 aa, Influenza virus
ISVGSGSFP

SEQ ID NO: 312313 - protein, 9 aa, Influenza virus
SVGSGSFPD

SEQ ID NO: 312314 - protein, 9 aa, Influenza virus
VGSGSFPDG

SEQ ID NO: 312315 - protein, 9 aa, Influenza virus
GSGSFPDGA

SEQ ID NO: 312316 - protein, 9 aa, Influenza virus
SGSFPDGAQ

SEQ ID NO: 312317 - protein, 9 aa, Influenza virus
GSFPDGAQI

SEQ ID NO: 312318 - protein, 9 aa, Influenza virus
SFPDGAQIQ

SEQ ID NO: 312319 - protein, 9 aa, Influenza virus
FPDGAQIQY

SEQ ID NO: 312320 - protein, 9 aa, Influenza virus
PDGAQIQYF

SEQ ID NO: 312321 - protein, 9 aa, Influenza virus
DGAQIQYFS

SEQ ID NO: 312322 - protein, 9 aa, Influenza virus
QADEICIGY

SEQ ID NO: 312323 - protein, 9 aa, Influenza virus
ADEICIGYL

SEQ ID NO: 312324 - protein, 9 aa, Influenza virus
DEICIGYLS

SEQ ID NO: 312325 - protein, 9 aa, Influenza virus
EICIGYLSN

SEQ ID NO: 312326 - protein, 9 aa, Influenza virus
ICIGYLSNN

SEQ ID NO: 312327 - protein, 9 aa, Influenza virus
CIGYLSNNS

SEQ ID NO: 312328 - protein, 9 aa, Influenza virus
IGYLSNNST

SEQ ID NO: 312329 - protein, 9 aa, Influenza virus
GYLSNNSTE

SEQ ID NO: 312330 - protein, 9 aa, Influenza virus
YLSNNSTEK

SEQ ID NO: 312331 - protein, 9 aa, Influenza virus
LSNNSTEKV

SEQ ID NO: 312332 - protein, 9 aa, Influenza virus
SNNSTEKVD

SEQ ID NO: 312333 - protein, 9 aa, Influenza virus
NNSTEKVDT

SEQ ID NO: 312334 - protein, 9 aa, Influenza virus
NSTEKVDTI

SEQ ID NO: 312335 - protein, 9 aa, Influenza virus
STEKVDTII

SEQ ID NO: 312336 - protein, 9 aa, Influenza virus
TEKVDTIIE

SEQ ID NO: 312337 - protein, 9 aa, Influenza virus
EKVDTIIES

SEQ ID NO: 312338 - protein, 9 aa, Influenza virus
KVDTIIESN

SEQ ID NO: 312339 - protein, 9 aa, Influenza virus
VDTIIESNV

SEQ ID NO: 312340 - protein, 9 aa, Influenza virus
DTIIESNVT

SEQ ID NO: 312341 - protein, 9 aa, Influenza virus
TIIESNVTV

SEQ ID NO: 312342 - protein, 9 aa, Influenza virus
IIESNVTVT

SEQ ID NO: 312343 - protein, 9 aa, Influenza virus
IESNVTVTS

SEQ ID NO: 312344 - protein, 9 aa, Influenza virus
ESNVTVTSS

SEQ ID NO: 312345 - protein, 9 aa, Influenza virus
SNVTVTSSV

SEQ ID NO: 312346 - protein, 9 aa, Influenza virus
NVTVTSSVE

SEQ ID NO: 312347 - protein, 9 aa, Influenza virus
VTVTSSVEL

SEQ ID NO: 312348 - protein, 9 aa, Influenza virus
TVTSSVELV

SEQ ID NO: 312349 - protein, 9 aa, Influenza virus
VTSSVELVE

SEQ ID NO: 312350 - protein, 9 aa, Influenza virus
TSSVELVEN

SEQ ID NO: 312351 - protein, 9 aa, Influenza virus
HTGSFCSID

SEQ ID NO: 312352 - protein, 9 aa, Influenza virus
TGSFCSIDG

SEQ ID NO: 312353 - protein, 9 aa, Influenza virus
GSFCSIDGK

SEQ ID NO: 312354 - protein, 9 aa, Influenza virus
FCSIDGKAP

SEQ ID NO: 312355 - protein, 9 aa, Influenza virus
CSIDGKAPI

SEQ ID NO: 312356 - protein, 9 aa, Influenza virus
SIDGKAPIS

SEQ ID NO: 312357 - protein, 9 aa, Influenza virus
IDGKAPISL

SEQ ID NO: 312358 - protein, 9 aa, Influenza virus
DGKAPISLG

SEQ ID NO: 312359 - protein, 9 aa, Influenza virus
GKAPISLGD

SEQ ID NO: 312360 - protein, 9 aa, Influenza virus
KAPISLGDC

SEQ ID NO: 312361 - protein, 9 aa, Influenza virus
APISLGDCS

SEQ ID NO: 312362 - protein, 9 aa, Influenza virus
PISLGDCSF

SEQ ID NO: 312363 - protein, 9 aa, Influenza virus
ISLGDCSFA

SEQ ID NO: 312364 - protein, 9 aa, Influenza virus
SLGDCSFAG

SEQ ID NO: 312365 - protein, 9 aa, Influenza virus
LGDCSFAGW

SEQ ID NO: 312366 - protein, 9 aa, Influenza virus
GDCSFAGWI

SEQ ID NO: 312367 - protein, 9 aa, Influenza virus
DCSFAGWIL

SEQ ID NO: 312368 - protein, 9 aa, Influenza virus
CSFAGWILG

SEQ ID NO: 312369 - protein, 9 aa, Influenza virus
SFAGWILGN

SEQ ID NO: 312370 - protein, 9 aa, Influenza virus
FAGWILGNP

SEQ ID NO: 312371 - protein, 9 aa, Influenza virus
AGWILGNPM

SEQ ID NO: 312372 - protein, 9 aa, Influenza virus
GWILGNPMC

SEQ ID NO: 312373 - protein, 9 aa, Influenza virus
WILGNPMCD

SEQ ID NO: 312374 - protein, 9 aa, Influenza virus
ILGNPMCDD

SEQ ID NO: 312375 - protein, 9 aa, Influenza virus
LGNPMCDDL

SEQ ID NO: 312376 - protein, 9 aa, Influenza virus
GNPMCDDLI

SEQ ID NO: 312377 - protein, 9 aa, Influenza virus
NPMCDDLIG

SEQ ID NO: 312378 - protein, 9 aa, Influenza virus
PMCDDLIGK

SEQ ID NO: 312379 - protein, 9 aa, Influenza virus
CDDLIGKTS

SEQ ID NO: 312380 - protein, 9 aa, Influenza virus
DDLIGKTSW

SEQ ID NO: 312381 - protein, 9 aa, Influenza virus
DLIGKTSWS

SEQ ID NO: 312382 - protein, 9 aa, Influenza virus
LIGKTSWSY

SEQ ID NO: 312383 - protein, 9 aa, Influenza virus
IGKTSWSYI

SEQ ID NO: 312384 - protein, 9 aa, Influenza virus
GKTSWSYIV

SEQ ID NO: 312385 - protein, 9 aa, Influenza virus
KTSWSYIVE

SEQ ID NO: 312386 - protein, 9 aa, Influenza virus
TSWSYIVEK

SEQ ID NO: 312387 - protein, 9 aa, Influenza virus
SWSYIVEKP

SEQ ID NO: 312388 - protein, 9 aa, Influenza virus
WSYIVEKPN

SEQ ID NO: 312389 - protein, 9 aa, Influenza virus
SYIVEKPNP

SEQ ID NO: 312390 - protein, 9 aa, Influenza virus
NPTNGICYP

SEQ ID NO: 312391 - protein, 9 aa, Influenza virus
PTNGICYPG

SEQ ID NO: 312392 - protein, 9 aa, Influenza virus
NGICYPGTL

SEQ ID NO: 312393 - protein, 9 aa, Influenza virus
GICYPGTLE

SEQ ID NO: 312394 - protein, 9 aa, Influenza virus
SFFRNMVWL

SEQ ID NO: 312395 - protein, 9 aa, Influenza virus
FFRNMVWLI

SEQ ID NO: 312396 - protein, 9 aa, Influenza virus
WLIHQSGTY

SEQ ID NO: 312397 - protein, 9 aa, Influenza virus
LIHQSGTYP

SEQ ID NO: 312398 - protein, 9 aa, Influenza virus
HQSGTYPVI

SEQ ID NO: 312399 - protein, 9 aa, Influenza virus
FNNTKGRDV

SEQ ID NO: 312400 - protein, 9 aa, Influenza virus
NNTKGRDVL

SEQ ID NO: 312401 - protein, 9 aa, Influenza virus
LYKKDSSYV

SEQ ID NO: 312402 - protein, 9 aa, Influenza virus
VNGQAGRMT

SEQ ID NO: 312403 - protein, 9 aa, Influenza virus
NGQAGRMTF

SEQ ID NO: 312404 - protein, 9 aa, Influenza virus
GQAGRMTFY

SEQ ID NO: 312405 - protein, 9 aa, Influenza virus
QAGRMTFYW

SEQ ID NO: 312406 - protein, 9 aa, Influenza virus
AGRMTFYWT

SEQ ID NO: 312407 - protein, 9 aa, Influenza virus
GRMTFYWTI

SEQ ID NO: 312408 - protein, 9 aa, Influenza virus
RMTFYWTIV

SEQ ID NO: 312409 - protein, 9 aa, Influenza virus
TFESNGAFL

SEQ ID NO: 312410 - protein, 9 aa, Influenza virus
FESNGAFLA

SEQ ID NO: 312411 - protein, 9 aa, Influenza virus
ESNGAFLAP

SEQ ID NO: 312412 - protein, 9 aa, Influenza virus
SNGAFLAPR

SEQ ID NO: 312413 - protein, 9 aa, Influenza virus
NGAFLAPRY

SEQ ID NO: 312414 - protein, 9 aa, Influenza virus
GAFLAPRYA

SEQ ID NO: 312415 - protein, 9 aa, Influenza virus
FLAPRYAFE

SEQ ID NO: 312416 - protein, 9 aa, Influenza virus
LAPRYAFEL

SEQ ID NO: 312417 - protein, 9 aa, Influenza virus
APRYAFELV

SEQ ID NO: 312418 - protein, 9 aa, Influenza virus
PRYAFELVS

SEQ ID NO: 312419 - protein, 9 aa, Influenza virus
KCQSEIGGI

SEQ ID NO: 312420 - protein, 9 aa, Influenza virus
CQSEIGGIN

SEQ ID NO: 312421 - protein, 9 aa, Influenza virus
QSEIGGINT

SEQ ID NO: 312422 - protein, 9 aa, Influenza virus
HNVHRNTIG

SEQ ID NO: 312423 - protein, 9 aa, Influenza virus
NVHRNTIGD

SEQ ID NO: 312424 - protein, 9 aa, Influenza virus
VHRNTIGDC

SEQ ID NO: 312425 - protein, 9 aa, Influenza virus
HRNTIGDCP

SEQ ID NO: 312426 - protein, 9 aa, Influenza virus
RNTIGDCPK

SEQ ID NO: 312427 - protein, 9 aa, Influenza virus
NTIGDCPKY

SEQ ID NO: 312428 - protein, 9 aa, Influenza virus
TIGDCPKYV

SEQ ID NO: 312429 - protein, 9 aa, Influenza virus
IGDCPKYVN

SEQ ID NO: 312430 - protein, 9 aa, Influenza virus
GDCPKYVNV

SEQ ID NO: 312431 - protein, 9 aa, Influenza virus
DCPKYVNVK

SEQ ID NO: 312432 - protein, 9 aa, Influenza virus
CPKYVNVKS

SEQ ID NO: 312433 - protein, 9 aa, Influenza virus
PKYVNVKSL

SEQ ID NO: 312434 - protein, 9 aa, Influenza virus
KYVNVKSLK

SEQ ID NO: 312435 - protein, 9 aa, Influenza virus
YVNVKSLKL

SEQ ID NO: 312436 - protein, 9 aa, Influenza virus
VNVKSLKLA

SEQ ID NO: 312437 - protein, 9 aa, Influenza virus
NVKSLKLAT

SEQ ID NO: 312438 - protein, 9 aa, Influenza virus
VKSLKLATG

SEQ ID NO: 312439 - protein, 9 aa, Influenza virus
KSLKLATGL

SEQ ID NO: 312440 - protein, 9 aa, Influenza virus
SLKLATGLR

SEQ ID NO: 312441 - protein, 9 aa, Influenza virus
LKLATGLRN

SEQ ID NO: 312442 - protein, 9 aa, Influenza virus
KLATGLRNV

SEQ ID NO: 312443 - protein, 9 aa, Influenza virus
LATGLRNVP

SEQ ID NO: 312444 - protein, 9 aa, Influenza virus
ATGLRNVPA

SEQ ID NO: 312445 - protein, 9 aa, Influenza virus
TGLRNVPAI

SEQ ID NO: 312446 - protein, 9 aa, Influenza virus
GLRNVPAIA

SEQ ID NO: 312447 - protein, 9 aa, Influenza virus
TRGLFGAIA

SEQ ID NO: 312448 - protein, 9 aa, Influenza virus
RGLFGAIAG

SEQ ID NO: 312449 - protein, 9 aa, Influenza virus
GLFGAIAGF

SEQ ID NO: 312450 - protein, 9 aa, Influenza virus
LFGAIAGFI

SEQ ID NO: 312451 - protein, 9 aa, Influenza virus
FGAIAGFIE

SEQ ID NO: 312452 - protein, 9 aa, Influenza virus
GAIAGFIEG

SEQ ID NO: 312453 - protein, 9 aa, Influenza virus
AIAGFIEGG

SEQ ID NO: 312454 - protein, 9 aa, Influenza virus
IAGFIEGGW

SEQ ID NO: 312455 - protein, 9 aa, Influenza virus
AGFIEGGWP

SEQ ID NO: 312456 - protein, 9 aa, Influenza virus
GFIEGGWPG

SEQ ID NO: 312457 - protein, 9 aa, Influenza virus
FIEGGWPGL

SEQ ID NO: 312458 - protein, 9 aa, Influenza virus
IEGGWPGLI

SEQ ID NO: 312459 - protein, 9 aa, Influenza virus
EGGWPGLIN

SEQ ID NO: 312460 - protein, 9 aa, Influenza virus
GGWPGLING

SEQ ID NO: 312461 - protein, 9 aa, Influenza virus
GWPGLINGW

SEQ ID NO: 312462 - protein, 9 aa, Influenza virus
WPGLINGWY

SEQ ID NO: 312463 - protein, 9 aa, Influenza virus
PGLINGWYG

SEQ ID NO: 312464 - protein, 9 aa, Influenza virus
GLINGWYGF

SEQ ID NO: 312465 - protein, 9 aa, Influenza virus
LINGWYGFQ

SEQ ID NO: 312466 - protein, 9 aa, Influenza virus
INGWYGFQH

SEQ ID NO: 312467 - protein, 9 aa, Influenza virus
NGWYGFQHR

SEQ ID NO: 312468 - protein, 9 aa, Influenza virus
GWYGFQHRN

SEQ ID NO: 312469 - protein, 9 aa, Influenza virus
WYGFQHRNE

SEQ ID NO: 312470 - protein, 9 aa, Influenza virus
YGFQHRNEE

SEQ ID NO: 312471 - protein, 9 aa, Influenza virus
GFQHRNEEG

SEQ ID NO: 312472 - protein, 9 aa, Influenza virus
FQHRNEEGT

SEQ ID NO: 312473 - protein, 9 aa, Influenza virus
QHRNEEGTG

SEQ ID NO: 312474 - protein, 9 aa, Influenza virus
HRNEEGTGI

SEQ ID NO: 312475 - protein, 9 aa, Influenza virus
RNEEGTGIA

SEQ ID NO: 312476 - protein, 9 aa, Influenza virus
NEEGTGIAA

SEQ ID NO: 312477 - protein, 9 aa, Influenza virus
EEGTGIAAD

SEQ ID NO: 312478 - protein, 9 aa, Influenza virus
EGTGIAADK

SEQ ID NO: 312479 - protein, 9 aa, Influenza virus
GTGIAADKE

SEQ ID NO: 312480 - protein, 9 aa, Influenza virus
TGIAADKES

SEQ ID NO: 312481 - protein, 9 aa, Influenza virus
GIAADKEST

SEQ ID NO: 312482 - protein, 9 aa, Influenza virus
IAADKESTQ

SEQ ID NO: 312483 - protein, 9 aa, Influenza virus
AADKESTQK

SEQ ID NO: 312484 - protein, 9 aa, Influenza virus
ADKESTQKA

SEQ ID NO: 312485 - protein, 9 aa, Influenza virus
IEERINQLS

SEQ ID NO: 312486 - protein, 9 aa, Influenza virus
DIWSYNAQL

SEQ ID NO: 312487 - protein, 9 aa, Influenza virus
IWSYNAQLL

SEQ ID NO: 312488 - protein, 9 aa, Influenza virus
WSYNAQLLV

SEQ ID NO: 312489 - protein, 9 aa, Influenza virus
SYNAQLLVL

SEQ ID NO: 312490 - protein, 9 aa, Influenza virus
YNAQLLVLL

SEQ ID NO: 312491 - protein, 9 aa, Influenza virus
NAQLLVLLE

SEQ ID NO: 312492 - protein, 9 aa, Influenza virus
AQLLVLLEN

SEQ ID NO: 312493 - protein, 9 aa, Influenza virus
QLLVLLENE

SEQ ID NO: 312494 - protein, 9 aa, Influenza virus
LLVLLENEK

SEQ ID NO: 312495 - protein, 9 aa, Influenza virus
LVLLENEKT

SEQ ID NO: 312496 - protein, 9 aa, Influenza virus
VLLENEKTL

SEQ ID NO: 312497 - protein, 9 aa, Influenza virus
LLENEKTLD

SEQ ID NO: 312498 - protein, 9 aa, Influenza virus
LENEKTLDL

SEQ ID NO: 312499 - protein, 9 aa, Influenza virus
ENEKTLDLH

SEQ ID NO: 312500 - protein, 9 aa, Influenza virus
NEKTLDLHD

SEQ ID NO: 312501 - protein, 9 aa, Influenza virus
EKTLDLHDS

SEQ ID NO: 312502 - protein, 9 aa, Influenza virus
KTLDLHDSN

SEQ ID NO: 312503 - protein, 9 aa, Influenza virus
TLDLHDSNV

SEQ ID NO: 312504 - protein, 9 aa, Influenza virus
LDLHDSNVR

SEQ ID NO: 312505 - protein, 9 aa, Influenza virus
DLHDSNVRN

SEQ ID NO: 312506 - protein, 9 aa, Influenza virus
LHDSNVRNL

SEQ ID NO: 312507 - protein, 9 aa, Influenza virus
HDSNVRNLH

SEQ ID NO: 312508 - protein, 9 aa, Influenza virus
DSNVRNLHE

SEQ ID NO: 312509 - protein, 9 aa, Influenza virus
SNVRNLHEK

SEQ ID NO: 312510 - protein, 9 aa, Influenza virus
LHEKVRRML

SEQ ID NO: 312511 - protein, 9 aa, Influenza virus
LKDNAKDEG

SEQ ID NO: 312512 - protein, 9 aa, Influenza virus
KDNAKDEGN

SEQ ID NO: 312513 - protein, 9 aa, Influenza virus
DNAKDEGNG

SEQ ID NO: 312514 - protein, 9 aa, Influenza virus
NAKDEGNGC

SEQ ID NO: 312515 - protein, 9 aa, Influenza virus
AKDEGNGCF

SEQ ID NO: 312516 - protein, 9 aa, Influenza virus
KDEGNGCFT

SEQ ID NO: 312517 - protein, 9 aa, Influenza virus
DEGNGCFTF

SEQ ID NO: 312518 - protein, 9 aa, Influenza virus
EGNGCFTFY

SEQ ID NO: 312519 - protein, 9 aa, Influenza virus
GNGCFTFYH

SEQ ID NO: 312520 - protein, 9 aa, Influenza virus
NGCFTFYHK

SEQ ID NO: 312521 - protein, 9 aa, Influenza virus
GCFTFYHKC

SEQ ID NO: 312522 - protein, 9 aa, Influenza virus
CFTFYHKCD

SEQ ID NO: 312523 - protein, 9 aa, Influenza virus
FTFYHKCDN

SEQ ID NO: 312524 - protein, 9 aa, Influenza virus
FYHKCDNEC

SEQ ID NO: 312525 - protein, 9 aa, Influenza virus
YHKCDNECI

SEQ ID NO: 312526 - protein, 9 aa, Influenza virus
HKCDNECIE

SEQ ID NO: 312527 - protein, 9 aa, Influenza virus
NECIEKVRN

SEQ ID NO: 312528 - protein, 9 aa, Influenza virus
ECIEKVRNG

SEQ ID NO: 312529 - protein, 9 aa, Influenza virus
CIEKVRNGT

SEQ ID NO: 312530 - protein, 9 aa, Influenza virus
IEKVRNGTY

SEQ ID NO: 312531 - protein, 9 aa, Influenza virus
EKVRNGTYD

SEQ ID NO: 312532 - protein, 9 aa, Influenza virus
KVRNGTYDH

SEQ ID NO: 312533 - protein, 9 aa, Influenza virus
VRNGTYDHK

SEQ ID NO: 312534 - protein, 9 aa, Influenza virus
RNGTYDHKE

SEQ ID NO: 312535 - protein, 9 aa, Influenza virus
NGTYDHKEF

SEQ ID NO: 312536 - protein, 9 aa, Influenza virus
GTYDHKEFE

SEQ ID NO: 312537 - protein, 9 aa, Influenza virus
TYDHKEFEE

SEQ ID NO: 312538 - protein, 9 aa, Influenza virus
YDHKEFEEE

SEQ ID NO: 312539 - protein, 9 aa, Influenza virus
DHKEFEEES

SEQ ID NO: 312540 - protein, 9 aa, Influenza virus
HKEFEEESK

SEQ ID NO: 312541 - protein, 9 aa, Influenza virus
EESKLNRQE

SEQ ID NO: 312542 - protein, 9 aa, Influenza virus
ESKLNRQEI

SEQ ID NO: 312543 - protein, 9 aa, Influenza virus
SKLNRQEIE

SEQ ID NO: 312544 - protein, 9 aa, Influenza virus
KLNRQEIEG

SEQ ID NO: 312545 - protein, 9 aa, Influenza virus
LNRQEIEGV

SEQ ID NO: 312546 - protein, 9 aa, Influenza virus
NRQEIEGVK

SEQ ID NO: 312547 - protein, 9 aa, Influenza virus
RQEIEGVKL

SEQ ID NO: 312548 - protein, 9 aa, Influenza virus
QEIEGVKLD

SEQ ID NO: 312549 - protein, 9 aa, Influenza virus
GNVYKILSI

SEQ ID NO: 312550 - protein, 9 aa, Influenza virus
NVYKILSIY

SEQ ID NO: 312551 - protein, 9 aa, Influenza virus
VYKILSIYS

SEQ ID NO: 312552 - protein, 9 aa, Influenza virus
YKILSIYSC

SEQ ID NO: 312553 - protein, 9 aa, Influenza virus
KILSIYSCI

SEQ ID NO: 312554 - protein, 9 aa, Influenza virus
ILSIYSCIA

SEQ ID NO: 312555 - protein, 9 aa, Influenza virus
LSIYSCIAS

SEQ ID NO: 312556 - protein, 9 aa, Influenza virus
SIYSCIASS

SEQ ID NO: 312557 - protein, 9 aa, Influenza virus
IYSCIASSL

SEQ ID NO: 312558 - protein, 9 aa, Influenza virus
YSCIASSLV

SEQ ID NO: 312559 - protein, 9 aa, Influenza virus
SCIASSLVL

SEQ ID NO: 312560 - protein, 9 aa, Influenza virus
CIASSLVLA

SEQ ID NO: 312561 - protein, 9 aa, Influenza virus
IASSLVLAA

SEQ ID NO: 312562 - protein, 9 aa, Influenza virus
ASSLVLAAI

SEQ ID NO: 312563 - protein, 9 aa, Influenza virus
SSLVLAAII

SEQ ID NO: 312564 - protein, 9 aa, Influenza virus
SLVLAAIIM

SEQ ID NO: 312565 - protein, 9 aa, Influenza virus
LVLAAIIMG

SEQ ID NO: 312566 - protein, 9 aa, Influenza virus
WACSNGSCR

SEQ ID NO: 312567 - protein, 9 aa, Influenza virus
ACSNGSCRC

SEQ ID NO: 312568 - protein, 9 aa, Influenza virus
CSNGSCRCT

SEQ ID NO: 312569 - protein, 9 aa, Influenza virus
SNGSCRCTI

SEQ ID NO: 312570 - protein, 9 aa, Influenza virus
NGSCRCTIC

SEQ ID NO: 312571 - protein, 9 aa, Influenza virus
GSCRCTICI

SEQ ID NO: 312572 - protein, 9 aa, Influenza virus
MEKFIILST

SEQ ID NO: 312573 - protein, 9 aa, Influenza virus
FAYDKICIG

SEQ ID NO: 312574 - protein, 9 aa, Influenza virus
AYDKICIGY

SEQ ID NO: 312575 - protein, 9 aa, Influenza virus
YDKICIGYQ

SEQ ID NO: 312576 - protein, 9 aa, Influenza virus
DKICIGYQT

SEQ ID NO: 312577 - protein, 9 aa, Influenza virus
KICIGYQTN

SEQ ID NO: 312578 - protein, 9 aa, Influenza virus
ICIGYQTNN

SEQ ID NO: 312579 - protein, 9 aa, Influenza virus
CIGYQTNNS

SEQ ID NO: 312580 - protein, 9 aa, Influenza virus
IGYQTNNST

SEQ ID NO: 312581 - protein, 9 aa, Influenza virus
GYQTNNSTE

SEQ ID NO: 312582 - protein, 9 aa, Influenza virus
YQTNNSTET

SEQ ID NO: 312583 - protein, 9 aa, Influenza virus
QTNNSTETV

SEQ ID NO: 312584 - protein, 9 aa, Influenza virus
TNNSTETVN

SEQ ID NO: 312585 - protein, 9 aa, Influenza virus
NNSTETVNT

SEQ ID NO: 312586 - protein, 9 aa, Influenza virus
NSTETVNTL

SEQ ID NO: 312587 - protein, 9 aa, Influenza virus
STETVNTLI

SEQ ID NO: 312588 - protein, 9 aa, Influenza virus
TETVNTLIE

SEQ ID NO: 312589 - protein, 9 aa, Influenza virus
ETVNTLIEQ

SEQ ID NO: 312590 - protein, 9 aa, Influenza virus
TVNTLIEQN

SEQ ID NO: 312591 - protein, 9 aa, Influenza virus
VNTLIEQNV

SEQ ID NO: 312592 - protein, 9 aa, Influenza virus
NTLIEQNVP

SEQ ID NO: 312593 - protein, 9 aa, Influenza virus
TLIEQNVPV

SEQ ID NO: 312594 - protein, 9 aa, Influenza virus
LIEQNVPVT

SEQ ID NO: 312595 - protein, 9 aa, Influenza virus
IEQNVPVTQ

SEQ ID NO: 312596 - protein, 9 aa, Influenza virus
EQNVPVTQV

SEQ ID NO: 312597 - protein, 9 aa, Influenza virus
QNVPVTQVE

SEQ ID NO: 312598 - protein, 9 aa, Influenza virus
NVPVTQVEE

SEQ ID NO: 312599 - protein, 9 aa, Influenza virus
VPVTQVEEL

SEQ ID NO: 312600 - protein, 9 aa, Influenza virus
PVTQVEELV

SEQ ID NO: 312601 - protein, 9 aa, Influenza virus
VTQVEELVH

SEQ ID NO: 312602 - protein, 9 aa, Influenza virus
TQVEELVHG

SEQ ID NO: 312603 - protein, 9 aa, Influenza virus
QVEELVHGG

SEQ ID NO: 312604 - protein, 9 aa, Influenza virus
VEELVHGGI

SEQ ID NO: 312605 - protein, 9 aa, Influenza virus
EELVHGGID

SEQ ID NO: 312606 - protein, 9 aa, Influenza virus
ELVHGGIDP

SEQ ID NO: 312607 - protein, 9 aa, Influenza virus
TELGSPLVL

SEQ ID NO: 312608 - protein, 9 aa, Influenza virus
ELGSPLVLD

SEQ ID NO: 312609 - protein, 9 aa, Influenza virus
LGSPLVLDD

SEQ ID NO: 312610 - protein, 9 aa, Influenza virus
GSPLVLDDC

SEQ ID NO: 312611 - protein, 9 aa, Influenza virus
SPLVLDDCS

SEQ ID NO: 312612 - protein, 9 aa, Influenza virus
PLVLDDCSL

SEQ ID NO: 312613 - protein, 9 aa, Influenza virus
LVLDDCSLE

SEQ ID NO: 312614 - protein, 9 aa, Influenza virus
VLDDCSLEG

SEQ ID NO: 312615 - protein, 9 aa, Influenza virus
LDDCSLEGL

SEQ ID NO: 312616 - protein, 9 aa, Influenza virus
DDCSLEGLI

SEQ ID NO: 312617 - protein, 9 aa, Influenza virus
DCSLEGLIL

SEQ ID NO: 312618 - protein, 9 aa, Influenza virus
CSLEGLILG

SEQ ID NO: 312619 - protein, 9 aa, Influenza virus
SLEGLILGN

SEQ ID NO: 312620 - protein, 9 aa, Influenza virus
LEGLILGNP

SEQ ID NO: 312621 - protein, 9 aa, Influenza virus
EGLILGNPK

SEQ ID NO: 312622 - protein, 9 aa, Influenza virus
GLILGNPKC

SEQ ID NO: 312623 - protein, 9 aa, Influenza virus
LILGNPKCD

SEQ ID NO: 312624 - protein, 9 aa, Influenza virus
ILGNPKCDL

SEQ ID NO: 312625 - protein, 9 aa, Influenza virus
LGNPKCDLY

SEQ ID NO: 312626 - protein, 9 aa, Influenza virus
GNPKCDLYL

SEQ ID NO: 312627 - protein, 9 aa, Influenza virus
NPKCDLYLN

SEQ ID NO: 312628 - protein, 9 aa, Influenza virus
PKCDLYLNG

SEQ ID NO: 312629 - protein, 9 aa, Influenza virus
KCDLYLNGR

SEQ ID NO: 312630 - protein, 9 aa, Influenza virus
CDLYLNGRE

SEQ ID NO: 312631 - protein, 9 aa, Influenza virus
DLYLNGREW

SEQ ID NO: 312632 - protein, 9 aa, Influenza virus
LYLNGREWS

SEQ ID NO: 312633 - protein, 9 aa, Influenza virus
YLNGREWSY

SEQ ID NO: 312634 - protein, 9 aa, Influenza virus
LNGREWSYI

SEQ ID NO: 312635 - protein, 9 aa, Influenza virus
NGREWSYIV

SEQ ID NO: 312636 - protein, 9 aa, Influenza virus
GREWSYIVE

SEQ ID NO: 312637 - protein, 9 aa, Influenza virus
REWSYIVER

SEQ ID NO: 312638 - protein, 9 aa, Influenza virus
EWSYIVERP

SEQ ID NO: 312639 - protein, 9 aa, Influenza virus
WSYIVERPK

SEQ ID NO: 312640 - protein, 9 aa, Influenza virus
SYIVERPKE

SEQ ID NO: 312641 - protein, 9 aa, Influenza virus
YIVERPKEM

SEQ ID NO: 312642 - protein, 9 aa, Influenza virus
IVERPKEME

SEQ ID NO: 312643 - protein, 9 aa, Influenza virus
VERPKEMEG

SEQ ID NO: 312644 - protein, 9 aa, Influenza virus
ERPKEMEGI

SEQ ID NO: 312645 - protein, 9 aa, Influenza virus
RPKEMEGIC

SEQ ID NO: 312646 - protein, 9 aa, Influenza virus
PKEMEGICY

SEQ ID NO: 312647 - protein, 9 aa, Influenza virus
KEMEGICYP

SEQ ID NO: 312648 - protein, 9 aa, Influenza virus
EMEGICYPG

SEQ ID NO: 312649 - protein, 9 aa, Influenza virus
MEGICYPGS

SEQ ID NO: 312650 - protein, 9 aa, Influenza virus
EGICYPGSI

SEQ ID NO: 312651 - protein, 9 aa, Influenza virus
GICYPGSIE

SEQ ID NO: 312652 - protein, 9 aa, Influenza virus
ICYPGSIEN

SEQ ID NO: 312653 - protein, 9 aa, Influenza virus
CYPGSIENQ

SEQ ID NO: 312654 - protein, 9 aa, Influenza virus
YPGSIENQE

SEQ ID NO: 312655 - protein, 9 aa, Influenza virus
PGSIENQEE

SEQ ID NO: 312656 - protein, 9 aa, Influenza virus
GSIENQEEL

SEQ ID NO: 312657 - protein, 9 aa, Influenza virus
SIENQEELR

SEQ ID NO: 312658 - protein, 9 aa, Influenza virus
IENQEELRS

SEQ ID NO: 312659 - protein, 9 aa, Influenza virus
ENQEELRSL

SEQ ID NO: 312660 - protein, 9 aa, Influenza virus
NQEELRSLF

SEQ ID NO: 312661 - protein, 9 aa, Influenza virus
QEELRSLFS

SEQ ID NO: 312662 - protein, 9 aa, Influenza virus
EELRSLFSS

SEQ ID NO: 312663 - protein, 9 aa, Influenza virus
ELRSLFSSI

SEQ ID NO: 312664 - protein, 9 aa, Influenza virus
LRSLFSSIK

SEQ ID NO: 312665 - protein, 9 aa, Influenza virus
RSLFSSIKK

SEQ ID NO: 312666 - protein, 9 aa, Influenza virus
SLFSSIKKY

SEQ ID NO: 312667 - protein, 9 aa, Influenza virus
LFSSIKKYE

SEQ ID NO: 312668 - protein, 9 aa, Influenza virus
FSSIKKYER

SEQ ID NO: 312669 - protein, 9 aa, Influenza virus
SSIKKYERV

SEQ ID NO: 312670 - protein, 9 aa, Influenza virus
SIKKYERVK

SEQ ID NO: 312671 - protein, 9 aa, Influenza virus
IKKYERVKM

SEQ ID NO: 312672 - protein, 9 aa, Influenza virus
KKYERVKMF

SEQ ID NO: 312673 - protein, 9 aa, Influenza virus
KYERVKMFD

SEQ ID NO: 312674 - protein, 9 aa, Influenza virus
YERVKMFDF

SEQ ID NO: 312675 - protein, 9 aa, Influenza virus
ERVKMFDFT

SEQ ID NO: 312676 - protein, 9 aa, Influenza virus
RVKMFDFTK

SEQ ID NO: 312677 - protein, 9 aa, Influenza virus
VKMFDFTKW

SEQ ID NO: 312678 - protein, 9 aa, Influenza virus
KMFDFTKWN

SEQ ID NO: 312679 - protein, 9 aa, Influenza virus
MFDFTKWNV

SEQ ID NO: 312680 - protein, 9 aa, Influenza virus
FDFTKWNVT

SEQ ID NO: 312681 - protein, 9 aa, Influenza virus
DFTKWNVTY

SEQ ID NO: 312682 - protein, 9 aa, Influenza virus
FTKWNVTYT

SEQ ID NO: 312683 - protein, 9 aa, Influenza virus
TKWNVTYTG

SEQ ID NO: 312684 - protein, 9 aa, Influenza virus
KWNVTYTGT

SEQ ID NO: 312685 - protein, 9 aa, Influenza virus
WNVTYTGTS

SEQ ID NO: 312686 - protein, 9 aa, Influenza virus
NVTYTGTSK

SEQ ID NO: 312687 - protein, 9 aa, Influenza virus
VTYTGTSKA

SEQ ID NO: 312688 - protein, 9 aa, Influenza virus
TYTGTSKAC

SEQ ID NO: 312689 - protein, 9 aa, Influenza virus
YTGTSKACN

SEQ ID NO: 312690 - protein, 9 aa, Influenza virus
SKACNNTSN

SEQ ID NO: 312691 - protein, 9 aa, Influenza virus
TSNQGSFYR

SEQ ID NO: 312692 - protein, 9 aa, Influenza virus
SNQGSFYRS

SEQ ID NO: 312693 - protein, 9 aa, Influenza virus
NQGSFYRSM

SEQ ID NO: 312694 - protein, 9 aa, Influenza virus
QGSFYRSMR

SEQ ID NO: 312695 - protein, 9 aa, Influenza virus
GSFYRSMRW

SEQ ID NO: 312696 - protein, 9 aa, Influenza virus
SFYRSMRWL

SEQ ID NO: 312697 - protein, 9 aa, Influenza virus
FYRSMRWLT

SEQ ID NO: 312698 - protein, 9 aa, Influenza virus
YRSMRWLTL

SEQ ID NO: 312699 - protein, 9 aa, Influenza virus
RSMRWLTLK

SEQ ID NO: 312700 - protein, 9 aa, Influenza virus
SMRWLTLKS

SEQ ID NO: 312701 - protein, 9 aa, Influenza virus
MRWLTLKSG

SEQ ID NO: 312702 - protein, 9 aa, Influenza virus
RWLTLKSGQ

SEQ ID NO: 312703 - protein, 9 aa, Influenza virus
WLTLKSGQF

SEQ ID NO: 312704 - protein, 9 aa, Influenza virus
LTLKSGQFP

SEQ ID NO: 312705 - protein, 9 aa, Influenza virus
TLKSGQFPV

SEQ ID NO: 312706 - protein, 9 aa, Influenza virus
LKSGQFPVQ

SEQ ID NO: 312707 - protein, 9 aa, Influenza virus
KSGQFPVQT

SEQ ID NO: 312708 - protein, 9 aa, Influenza virus
SGQFPVQTD

SEQ ID NO: 312709 - protein, 9 aa, Influenza virus
GQFPVQTDE

SEQ ID NO: 312710 - protein, 9 aa, Influenza virus
QFPVQTDEY

SEQ ID NO: 312711 - protein, 9 aa, Influenza virus
FPVQTDEYK

SEQ ID NO: 312712 - protein, 9 aa, Influenza virus
PVQTDEYKN

SEQ ID NO: 312713 - protein, 9 aa, Influenza virus
VQTDEYKNT

SEQ ID NO: 312714 - protein, 9 aa, Influenza virus
QTDEYKNTR

SEQ ID NO: 312715 - protein, 9 aa, Influenza virus
TDEYKNTRD

SEQ ID NO: 312716 - protein, 9 aa, Influenza virus
DEYKNTRDS

SEQ ID NO: 312717 - protein, 9 aa, Influenza virus
EYKNTRDSD

SEQ ID NO: 312718 - protein, 9 aa, Influenza virus
YKNTRDSDI

SEQ ID NO: 312719 - protein, 9 aa, Influenza virus
FTWAIHHPP

SEQ ID NO: 312720 - protein, 9 aa, Influenza virus
TWAIHHPPT

SEQ ID NO: 312721 - protein, 9 aa, Influenza virus
WAIHHPPTS

SEQ ID NO: 312722 - protein, 9 aa, Influenza virus
AIHHPPTSD

SEQ ID NO: 312723 - protein, 9 aa, Influenza virus
IHHPPTSDE

SEQ ID NO: 312724 - protein, 9 aa, Influenza virus
HHPPTSDEQ

SEQ ID NO: 312725 - protein, 9 aa, Influenza virus
HPPTSDEQV

SEQ ID NO: 312726 - protein, 9 aa, Influenza virus
EINRSFKPN

SEQ ID NO: 312727 - protein, 9 aa, Influenza virus
INRSFKPNI

SEQ ID NO: 312728 - protein, 9 aa, Influenza virus
NRSFKPNIG

SEQ ID NO: 312729 - protein, 9 aa, Influenza virus
RSFKPNIGP

SEQ ID NO: 312730 - protein, 9 aa, Influenza virus
SFKPNIGPR

SEQ ID NO: 312731 - protein, 9 aa, Influenza virus
FKPNIGPRP

SEQ ID NO: 312732 - protein, 9 aa, Influenza virus
KPNIGPRPL

SEQ ID NO: 312733 - protein, 9 aa, Influenza virus
PNIGPRPLV

SEQ ID NO: 312734 - protein, 9 aa, Influenza virus
NIGPRPLVR

SEQ ID NO: 312735 - protein, 9 aa, Influenza virus
IGPRPLVRG

SEQ ID NO: 312736 - protein, 9 aa, Influenza virus
GPRPLVRGQ

SEQ ID NO: 312737 - protein, 9 aa, Influenza virus
PRPLVRGQQ

SEQ ID NO: 312738 - protein, 9 aa, Influenza virus
RPLVRGQQG

SEQ ID NO: 312739 - protein, 9 aa, Influenza virus
PLVRGQQGR

SEQ ID NO: 312740 - protein, 9 aa, Influenza virus
LVRGQQGRM

SEQ ID NO: 312741 - protein, 9 aa, Influenza virus
VRGQQGRMD

SEQ ID NO: 312742 - protein, 9 aa, Influenza virus
RGQQGRMDY

SEQ ID NO: 312743 - protein, 9 aa, Influenza virus
GQQGRMDYY

SEQ ID NO: 312744 - protein, 9 aa, Influenza virus
QQGRMDYYW

SEQ ID NO: 312745 - protein, 9 aa, Influenza virus
QGRMDYYWA

SEQ ID NO: 312746 - protein, 9 aa, Influenza virus
GRMDYYWAV

SEQ ID NO: 312747 - protein, 9 aa, Influenza virus
RMDYYWAVL

SEQ ID NO: 312748 - protein, 9 aa, Influenza virus
MDYYWAVLK

SEQ ID NO: 312749 - protein, 9 aa, Influenza virus
DYYWAVLKP

SEQ ID NO: 312750 - protein, 9 aa, Influenza virus
YYWAVLKPG

SEQ ID NO: 312751 - protein, 9 aa, Influenza virus
YWAVLKPGQ

SEQ ID NO: 312752 - protein, 9 aa, Influenza virus
WAVLKPGQT

SEQ ID NO: 312753 - protein, 9 aa, Influenza virus
AVLKPGQTV

SEQ ID NO: 312754 - protein, 9 aa, Influenza virus
VLKPGQTVK

SEQ ID NO: 312755 - protein, 9 aa, Influenza virus
LKPGQTVKI

SEQ ID NO: 312756 - protein, 9 aa, Influenza virus
KPGQTVKIQ

SEQ ID NO: 312757 - protein, 9 aa, Influenza virus
PGQTVKIQT

SEQ ID NO: 312758 - protein, 9 aa, Influenza virus
GQTVKIQTN

SEQ ID NO: 312759 - protein, 9 aa, Influenza virus
QTVKIQTNG

SEQ ID NO: 312760 - protein, 9 aa, Influenza virus
TVKIQTNGN

SEQ ID NO: 312761 - protein, 9 aa, Influenza virus
VKIQTNGNL

SEQ ID NO: 312762 - protein, 9 aa, Influenza virus
KIQTNGNLI

SEQ ID NO: 312763 - protein, 9 aa, Influenza virus
IQTNGNLIA

SEQ ID NO: 312764 - protein, 9 aa, Influenza virus
QTNGNLIAP

SEQ ID NO: 312765 - protein, 9 aa, Influenza virus
TNGNLIAPE

SEQ ID NO: 312766 - protein, 9 aa, Influenza virus
NGNLIAPEY

SEQ ID NO: 312767 - protein, 9 aa, Influenza virus
GNLIAPEYG

SEQ ID NO: 312768 - protein, 9 aa, Influenza virus
NLIAPEYGH

SEQ ID NO: 312769 - protein, 9 aa, Influenza virus
LIAPEYGHL

SEQ ID NO: 312770 - protein, 9 aa, Influenza virus
IAPEYGHLI

SEQ ID NO: 312771 - protein, 9 aa, Influenza virus
APEYGHLIT

SEQ ID NO: 312772 - protein, 9 aa, Influenza virus
PEYGHLITG

SEQ ID NO: 312773 - protein, 9 aa, Influenza virus
EYGHLITGK

SEQ ID NO: 312774 - protein, 9 aa, Influenza virus
YGHLITGKS

SEQ ID NO: 312775 - protein, 9 aa, Influenza virus
GHLITGKSH

SEQ ID NO: 312776 - protein, 9 aa, Influenza virus
HLITGKSHG

SEQ ID NO: 312777 - protein, 9 aa, Influenza virus
LITGKSHGR

SEQ ID NO: 312778 - protein, 9 aa, Influenza virus
ITGKSHGRI

SEQ ID NO: 312779 - protein, 9 aa, Influenza virus
TGKSHGRIL

SEQ ID NO: 312780 - protein, 9 aa, Influenza virus
GKSHGRILK

SEQ ID NO: 312781 - protein, 9 aa, Influenza virus
KSHGRILKN

SEQ ID NO: 312782 - protein, 9 aa, Influenza virus
SHGRILKNN

SEQ ID NO: 312783 - protein, 9 aa, Influenza virus
HGRILKNNL

SEQ ID NO: 312784 - protein, 9 aa, Influenza virus
GRILKNNLP

SEQ ID NO: 312785 - protein, 9 aa, Influenza virus
TECQLNEGV

SEQ ID NO: 312786 - protein, 9 aa, Influenza virus
ECQLNEGVM

SEQ ID NO: 312787 - protein, 9 aa, Influenza virus
CQLNEGVMN

SEQ ID NO: 312788 - protein, 9 aa, Influenza virus
QLNEGVMNT

SEQ ID NO: 312789 - protein, 9 aa, Influenza virus
LNEGVMNTS

SEQ ID NO: 312790 - protein, 9 aa, Influenza virus
NEGVMNTSK

SEQ ID NO: 312791 - protein, 9 aa, Influenza virus
EGVMNTSKP

SEQ ID NO: 312792 - protein, 9 aa, Influenza virus
GVMNTSKPF

SEQ ID NO: 312793 - protein, 9 aa, Influenza virus
VMNTSKPFQ

SEQ ID NO: 312794 - protein, 9 aa, Influenza virus
MNTSKPFQN

SEQ ID NO: 312795 - protein, 9 aa, Influenza virus
NTSKPFQNT

SEQ ID NO: 312796 - protein, 9 aa, Influenza virus
TSKPFQNTS

SEQ ID NO: 312797 - protein, 9 aa, Influenza virus
SKPFQNTSK

SEQ ID NO: 312798 - protein, 9 aa, Influenza virus
KPFQNTSKH

SEQ ID NO: 312799 - protein, 9 aa, Influenza virus
PFQNTSKHY

SEQ ID NO: 312800 - protein, 9 aa, Influenza virus
FQNTSKHYI

SEQ ID NO: 312801 - protein, 9 aa, Influenza virus
QNTSKHYIG

SEQ ID NO: 312802 - protein, 9 aa, Influenza virus
NTSKHYIGK

SEQ ID NO: 312803 - protein, 9 aa, Influenza virus
TSKHYIGKC

SEQ ID NO: 312804 - protein, 9 aa, Influenza virus
SKHYIGKCP

SEQ ID NO: 312805 - protein, 9 aa, Influenza virus
KHYIGKCPK

SEQ ID NO: 312806 - protein, 9 aa, Influenza virus
HYIGKCPKY

SEQ ID NO: 312807 - protein, 9 aa, Influenza virus
YIGKCPKYI

SEQ ID NO: 312808 - protein, 9 aa, Influenza virus
IGKCPKYIP

SEQ ID NO: 312809 - protein, 9 aa, Influenza virus
GKCPKYIPS

SEQ ID NO: 312810 - protein, 9 aa, Influenza virus
KCPKYIPSG

SEQ ID NO: 312811 - protein, 9 aa, Influenza virus
CPKYIPSGS

SEQ ID NO: 312812 - protein, 9 aa, Influenza virus
PKYIPSGSL

SEQ ID NO: 312813 - protein, 9 aa, Influenza virus
KYIPSGSLK

SEQ ID NO: 312814 - protein, 9 aa, Influenza virus
YIPSGSLKL

SEQ ID NO: 312815 - protein, 9 aa, Influenza virus
IPSGSLKLA

SEQ ID NO: 312816 - protein, 9 aa, Influenza virus
PSGSLKLAI

SEQ ID NO: 312817 - protein, 9 aa, Influenza virus
SGSLKLAIG

SEQ ID NO: 312818 - protein, 9 aa, Influenza virus
GSLKLAIGL

SEQ ID NO: 312819 - protein, 9 aa, Influenza virus
SLKLAIGLR

SEQ ID NO: 312820 - protein, 9 aa, Influenza virus
LKLAIGLRN

SEQ ID NO: 312821 - protein, 9 aa, Influenza virus
KLAIGLRNV

SEQ ID NO: 312822 - protein, 9 aa, Influenza virus
LAIGLRNVP

SEQ ID NO: 312823 - protein, 9 aa, Influenza virus
AIGLRNVPQ

SEQ ID NO: 312824 - protein, 9 aa, Influenza virus
IGLRNVPQA

SEQ ID NO: 312825 - protein, 9 aa, Influenza virus
GLRNVPQAQ

SEQ ID NO: 312826 - protein, 9 aa, Influenza virus
RNVPQAQDR

SEQ ID NO: 312827 - protein, 9 aa, Influenza virus
NVPQAQDRG

SEQ ID NO: 312828 - protein, 9 aa, Influenza virus
VPQAQDRGL

SEQ ID NO: 312829 - protein, 9 aa, Influenza virus
PQAQDRGLF

SEQ ID NO: 312830 - protein, 9 aa, Influenza virus
QAQDRGLFG

SEQ ID NO: 312831 - protein, 9 aa, Influenza virus
AQDRGLFGA

SEQ ID NO: 312832 - protein, 9 aa, Influenza virus
QNRGLFGAI

SEQ ID NO: 312833 - protein, 9 aa, Influenza virus
NRGLFGAIA

SEQ ID NO: 312834 - protein, 9 aa, Influenza virus
RGLFGAIAG

SEQ ID NO: 312835 - protein, 9 aa, Influenza virus
GLFGAIAGF

SEQ ID NO: 312836 - protein, 9 aa, Influenza virus
LFGAIAGFI

SEQ ID NO: 312837 - protein, 9 aa, Influenza virus
FGAIAGFIE

SEQ ID NO: 312838 - protein, 9 aa, Influenza virus
GAIAGFIEG

SEQ ID NO: 312839 - protein, 9 aa, Influenza virus
AIAGFIEGG

SEQ ID NO: 312840 - protein, 9 aa, Influenza virus
IAGFIEGGW

SEQ ID NO: 312841 - protein, 9 aa, Influenza virus
AGFIEGGWP

SEQ ID NO: 312842 - protein, 9 aa, Influenza virus
GFIEGGWPG

SEQ ID NO: 312843 - protein, 9 aa, Influenza virus
FIEGGWPGL

SEQ ID NO: 312844 - protein, 9 aa, Influenza virus
IEGGWPGLV

SEQ ID NO: 312845 - protein, 9 aa, Influenza virus
EGGWPGLVA

SEQ ID NO: 312846 - protein, 9 aa, Influenza virus
GGWPGLVAG

SEQ ID NO: 312847 - protein, 9 aa, Influenza virus
GWPGLVAGW

SEQ ID NO: 312848 - protein, 9 aa, Influenza virus
WPGLVAGWY

SEQ ID NO: 312849 - protein, 9 aa, Influenza virus
PGLVAGWYG

SEQ ID NO: 312850 - protein, 9 aa, Influenza virus
GLVAGWYGF

SEQ ID NO: 312851 - protein, 9 aa, Influenza virus
LVAGWYGFQ

SEQ ID NO: 312852 - protein, 9 aa, Influenza virus
VAGWYGFQH

SEQ ID NO: 312853 - protein, 9 aa, Influenza virus
AGWYGFQHQ

SEQ ID NO: 312854 - protein, 9 aa, Influenza virus
GWYGFQHQN

SEQ ID NO: 312855 - protein, 9 aa, Influenza virus
WYGFQHQNA

SEQ ID NO: 312856 - protein, 9 aa, Influenza virus
YGFQHQNAE

SEQ ID NO: 312857 - protein, 9 aa, Influenza virus
GFQHQNAEG

SEQ ID NO: 312858 - protein, 9 aa, Influenza virus
FQHQNAEGT

SEQ ID NO: 312859 - protein, 9 aa, Influenza virus
QHQNAEGTG

SEQ ID NO: 312860 - protein, 9 aa, Influenza virus
HQNAEGTGI

SEQ ID NO: 312861 - protein, 9 aa, Influenza virus
QNAEGTGIA

SEQ ID NO: 312862 - protein, 9 aa, Influenza virus
NAEGTGIAA

SEQ ID NO: 312863 - protein, 9 aa, Influenza virus
AEGTGIAAD

SEQ ID NO: 312864 - protein, 9 aa, Influenza virus
EGTGIAADR

SEQ ID NO: 312865 - protein, 9 aa, Influenza virus
GTGIAADRD

SEQ ID NO: 312866 - protein, 9 aa, Influenza virus
TGIAADRDS

SEQ ID NO: 312867 - protein, 9 aa, Influenza virus
GIAADRDST

SEQ ID NO: 312868 - protein, 9 aa, Influenza virus
IAADRDSTQ

SEQ ID NO: 312869 - protein, 9 aa, Influenza virus
AADRDSTQK

SEQ ID NO: 312870 - protein, 9 aa, Influenza virus
ADRDSTQKA

SEQ ID NO: 312871 - protein, 9 aa, Influenza virus
DRDSTQKAI

SEQ ID NO: 312872 - protein, 9 aa, Influenza virus
RDSTQKAID

SEQ ID NO: 312873 - protein, 9 aa, Influenza virus
DSTQKAIDN

SEQ ID NO: 312874 - protein, 9 aa, Influenza virus
STQKAIDNM

SEQ ID NO: 312875 - protein, 9 aa, Influenza virus
TQKAIDNMQ

SEQ ID NO: 312876 - protein, 9 aa, Influenza virus
QKAIDNMQN

SEQ ID NO: 312877 - protein, 9 aa, Influenza virus
KAIDNMQNK

SEQ ID NO: 312878 - protein, 9 aa, Influenza virus
AIDNMQNKL

SEQ ID NO: 312879 - protein, 9 aa, Influenza virus
IDNMQNKLN

SEQ ID NO: 312880 - protein, 9 aa, Influenza virus
DNMQNKLNN

SEQ ID NO: 312881 - protein, 9 aa, Influenza virus
NMQNKLNNV

SEQ ID NO: 312882 - protein, 9 aa, Influenza virus
MQNKLNNVI

SEQ ID NO: 312883 - protein, 9 aa, Influenza virus
QNKLNNVID

SEQ ID NO: 312884 - protein, 9 aa, Influenza virus
NKLNNVIDK

SEQ ID NO: 312885 - protein, 9 aa, Influenza virus
KLNNVIDKM

SEQ ID NO: 312886 - protein, 9 aa, Influenza virus
LNNVIDKMN

SEQ ID NO: 312887 - protein, 9 aa, Influenza virus
NNVIDKMNK

SEQ ID NO: 312888 - protein, 9 aa, Influenza virus
NVIDKMNKQ

SEQ ID NO: 312889 - protein, 9 aa, Influenza virus
VIDKMNKQF

SEQ ID NO: 312890 - protein, 9 aa, Influenza virus
EFSEVESRI

SEQ ID NO: 312891 - protein, 9 aa, Influenza virus
FSEVESRIN

SEQ ID NO: 312892 - protein, 9 aa, Influenza virus
VESRINMIN

SEQ ID NO: 312893 - protein, 9 aa, Influenza virus
ESRINMINS

SEQ ID NO: 312894 - protein, 9 aa, Influenza virus
SRINMINSK

SEQ ID NO: 312895 - protein, 9 aa, Influenza virus
RINMINSKI

SEQ ID NO: 312896 - protein, 9 aa, Influenza virus
INMINSKID

SEQ ID NO: 312897 - protein, 9 aa, Influenza virus
NMINSKIDD

SEQ ID NO: 312898 - protein, 9 aa, Influenza virus
MINSKIDDQ

SEQ ID NO: 312899 - protein, 9 aa, Influenza virus
INSKIDDQI

SEQ ID NO: 312900 - protein, 9 aa, Influenza virus
IDDQITDIW

SEQ ID NO: 312901 - protein, 9 aa, Influenza virus
DDQITDIWA

SEQ ID NO: 312902 - protein, 9 aa, Influenza virus
DQITDIWAY

SEQ ID NO: 312903 - protein, 9 aa, Influenza virus
QITDIWAYN

SEQ ID NO: 312904 - protein, 9 aa, Influenza virus
ITDIWAYNA

SEQ ID NO: 312905 - protein, 9 aa, Influenza virus
TDIWAYNAE

SEQ ID NO: 312906 - protein, 9 aa, Influenza virus
DIWAYNAEL

SEQ ID NO: 312907 - protein, 9 aa, Influenza virus
IWAYNAELL

SEQ ID NO: 312908 - protein, 9 aa, Influenza virus
WAYNAELLV

SEQ ID NO: 312909 - protein, 9 aa, Influenza virus
AYNAELLVL

SEQ ID NO: 312910 - protein, 9 aa, Influenza virus
YNAELLVLL

SEQ ID NO: 312911 - protein, 9 aa, Influenza virus
NAELLVLLE

SEQ ID NO: 312912 - protein, 9 aa, Influenza virus
AELLVLLEN

SEQ ID NO: 312913 - protein, 9 aa, Influenza virus
ELLVLLENQ

SEQ ID NO: 312914 - protein, 9 aa, Influenza virus
LLVLLENQK

SEQ ID NO: 312915 - protein, 9 aa, Influenza virus
LVLLENQKT

SEQ ID NO: 312916 - protein, 9 aa, Influenza virus
VLLENQKTL

SEQ ID NO: 312917 - protein, 9 aa, Influenza virus
LLENQKTLD

SEQ ID NO: 312918 - protein, 9 aa, Influenza virus
LENQKTLDE

SEQ ID NO: 312919 - protein, 9 aa, Influenza virus
ENQKTLDEH

SEQ ID NO: 312920 - protein, 9 aa, Influenza virus
NQKTLDEHD

SEQ ID NO: 312921 - protein, 9 aa, Influenza virus
QKTLDEHDA

SEQ ID NO: 312922 - protein, 9 aa, Influenza virus
KTLDEHDAN

SEQ ID NO: 312923 - protein, 9 aa, Influenza virus
TLDEHDANV

SEQ ID NO: 312924 - protein, 9 aa, Influenza virus
LDEHDANVR

SEQ ID NO: 312925 - protein, 9 aa, Influenza virus
DEHDANVRN

SEQ ID NO: 312926 - protein, 9 aa, Influenza virus
EHDANVRNL

SEQ ID NO: 312927 - protein, 9 aa, Influenza virus
HDANVRNLH

SEQ ID NO: 312928 - protein, 9 aa, Influenza virus
DANVRNLHD

SEQ ID NO: 312929 - protein, 9 aa, Influenza virus
ANVRNLHDR

SEQ ID NO: 312930 - protein, 9 aa, Influenza virus
NVRNLHDRV

SEQ ID NO: 312931 - protein, 9 aa, Influenza virus
VRNLHDRVR

SEQ ID NO: 312932 - protein, 9 aa, Influenza virus
RNLHDRVRR

SEQ ID NO: 312933 - protein, 9 aa, Influenza virus
RVLRENAID

SEQ ID NO: 312934 - protein, 9 aa, Influenza virus
ENAIDTGDG

SEQ ID NO: 312935 - protein, 9 aa, Influenza virus
NAIDTGDGC

SEQ ID NO: 312936 - protein, 9 aa, Influenza virus
AIDTGDGCF

SEQ ID NO: 312937 - protein, 9 aa, Influenza virus
IDTGDGCFE

SEQ ID NO: 312938 - protein, 9 aa, Influenza virus
DTGDGCFEI

SEQ ID NO: 312939 - protein, 9 aa, Influenza virus
TGDGCFEIL

SEQ ID NO: 312940 - protein, 9 aa, Influenza virus
GDGCFEILH

SEQ ID NO: 312941 - protein, 9 aa, Influenza virus
DGCFEILHK

SEQ ID NO: 312942 - protein, 9 aa, Influenza virus
GCFEILHKC

SEQ ID NO: 312943 - protein, 9 aa, Influenza virus
CFEILHKCD

SEQ ID NO: 312944 - protein, 9 aa, Influenza virus
FEILHKCDN

SEQ ID NO: 312945 - protein, 9 aa, Influenza virus
TIRNGTYNH

SEQ ID NO: 312946 - protein, 9 aa, Influenza virus
IRNGTYNHK

SEQ ID NO: 312947 - protein, 9 aa, Influenza virus
GTYNHKEYE

SEQ ID NO: 312948 - protein, 9 aa, Influenza virus
YEEESKIER

SEQ ID NO: 312949 - protein, 9 aa, Influenza virus
EEESKIERQ

SEQ ID NO: 312950 - protein, 9 aa, Influenza virus
EESKIERQK

SEQ ID NO: 312951 - protein, 9 aa, Influenza virus
ESKIERQKI

SEQ ID NO: 312952 - protein, 9 aa, Influenza virus
ERQKINGVK

SEQ ID NO: 312953 - protein, 9 aa, Influenza virus
RQKINGVKL

SEQ ID NO: 312954 - protein, 9 aa, Influenza virus
QKINGVKLE

SEQ ID NO: 312955 - protein, 9 aa, Influenza virus
KINGVKLEE

SEQ ID NO: 312956 - protein, 9 aa, Influenza virus
INGVKLEEN

SEQ ID NO: 312957 - protein, 9 aa, Influenza virus
NGVKLEENS

SEQ ID NO: 312958 - protein, 9 aa, Influenza virus
GVKLEENST

SEQ ID NO: 312959 - protein, 9 aa, Influenza virus
VKLEENSTY

SEQ ID NO: 312960 - protein, 9 aa, Influenza virus
KLEENSTYK

SEQ ID NO: 312961 - protein, 9 aa, Influenza virus
LEENSTYKI

SEQ ID NO: 312962 - protein, 9 aa, Influenza virus
EENSTYKIL

SEQ ID NO: 312963 - protein, 9 aa, Influenza virus
ENSTYKILS

SEQ ID NO: 312964 - protein, 9 aa, Influenza virus
NSTYKILSI

SEQ ID NO: 312965 - protein, 9 aa, Influenza virus
STYKILSIY

SEQ ID NO: 312966 - protein, 9 aa, Influenza virus
TYKILSIYS

SEQ ID NO: 312967 - protein, 9 aa, Influenza virus
YKILSIYSS

SEQ ID NO: 312968 - protein, 9 aa, Influenza virus
KILSIYSSV

SEQ ID NO: 312969 - protein, 9 aa, Influenza virus
ILSIYSSVA

SEQ ID NO: 312970 - protein, 9 aa, Influenza virus
LSIYSSVAS

SEQ ID NO: 312971 - protein, 9 aa, Influenza virus
SIYSSVASS

SEQ ID NO: 312972 - protein, 9 aa, Influenza virus
IYSSVASSL

SEQ ID NO: 312973 - protein, 9 aa, Influenza virus
YSSVASSLV

SEQ ID NO: 312974 - protein, 9 aa, Influenza virus
SSVASSLVL

SEQ ID NO: 312975 - protein, 9 aa, Influenza virus
SVASSLVLL

SEQ ID NO: 312976 - protein, 9 aa, Influenza virus
VASSLVLLL

SEQ ID NO: 312977 - protein, 9 aa, Influenza virus
ASSLVLLLM

SEQ ID NO: 312978 - protein, 9 aa, Influenza virus
SSLVLLLMI

SEQ ID NO: 312979 - protein, 9 aa, Influenza virus
SLVLLLMII

SEQ ID NO: 312980 - protein, 9 aa, Influenza virus
LVLLLMIIG

SEQ ID NO: 312981 - protein, 9 aa, Influenza virus
VLLLMIIGG

SEQ ID NO: 312982 - protein, 9 aa, Influenza virus
LLLMIIGGF

SEQ ID NO: 312983 - protein, 9 aa, Influenza virus
LLMIIGGFI

SEQ ID NO: 312984 - protein, 9 aa, Influenza virus
LMIIGGFIF

SEQ ID NO: 312985 - protein, 9 aa, Influenza virus
MIIGGFIFG

SEQ ID NO: 312986 - protein, 9 aa, Influenza virus
IIGGFIFGC

SEQ ID NO: 312987 - protein, 9 aa, Influenza virus
IGGFIFGCQ

SEQ ID NO: 312988 - protein, 9 aa, Influenza virus
GGFIFGCQN

SEQ ID NO: 312989 - protein, 9 aa, Influenza virus
GFIFGCQNG

SEQ ID NO: 312990 - protein, 9 aa, Influenza virus
FIFGCQNGN

SEQ ID NO: 312991 - protein, 9 aa, Influenza virus
IFGCQNGNV

SEQ ID NO: 312992 - protein, 9 aa, Influenza virus
FGCQNGNVR

SEQ ID NO: 312993 - protein, 9 aa, Influenza virus
GCQNGNVRC

SEQ ID NO: 312994 - protein, 9 aa, Influenza virus
CQNGNVRCT

SEQ ID NO: 312995 - protein, 9 aa, Influenza virus
QNGNVRCTF

SEQ ID NO: 312996 - protein, 9 aa, Influenza virus
NGNVRCTFC

SEQ ID NO: 312997 - protein, 9 aa, Influenza virus
GNVRCTFCI

SEQ ID NO: 312998 - protein, 9 aa, Influenza virus
ADRICVGYL

SEQ ID NO: 312999 - protein, 9 aa, Influenza virus
DRICVGYLS

SEQ ID NO: 313000 - protein, 9 aa, Influenza virus
RICVGYLST

SEQ ID NO: 313001 - protein, 9 aa, Influenza virus
ICVGYLSTN

SEQ ID NO: 313002 - protein, 9 aa, Influenza virus
CVGYLSTNS

SEQ ID NO: 313003 - protein, 9 aa, Influenza virus
VGYLSTNSS

SEQ ID NO: 313004 - protein, 9 aa, Influenza virus
GYLSTNSSE

SEQ ID NO: 313005 - protein, 9 aa, Influenza virus
YLSTNSSER

SEQ ID NO: 313006 - protein, 9 aa, Influenza virus
LSTNSSERV

SEQ ID NO: 313007 - protein, 9 aa, Influenza virus
STNSSERVD

SEQ ID NO: 313008 - protein, 9 aa, Influenza virus
TNSSERVDT

SEQ ID NO: 313009 - protein, 9 aa, Influenza virus
NSSERVDTL

SEQ ID NO: 313010 - protein, 9 aa, Influenza virus
SSERVDTLL

SEQ ID NO: 313011 - protein, 9 aa, Influenza virus
SERVDTLLE

SEQ ID NO: 313012 - protein, 9 aa, Influenza virus
EKVDTLLEN

SEQ ID NO: 313013 - protein, 9 aa, Influenza virus
VDTLLENGV

SEQ ID NO: 313014 - protein, 9 aa, Influenza virus
DTLLENGVP

SEQ ID NO: 313015 - protein, 9 aa, Influenza virus
TLLENGVPV

SEQ ID NO: 313016 - protein, 9 aa, Influenza virus
LLENGVPVT

SEQ ID NO: 313017 - protein, 9 aa, Influenza virus
LENGVPVTS

SEQ ID NO: 313018 - protein, 9 aa, Influenza virus
ENGVPVTSS

SEQ ID NO: 313019 - protein, 9 aa, Influenza virus
VPVTSSVDL

SEQ ID NO: 313020 - protein, 9 aa, Influenza virus
PVTSSVDLV

SEQ ID NO: 313021 - protein, 9 aa, Influenza virus
VTSSVDLVE

SEQ ID NO: 313022 - protein, 9 aa, Influenza virus
TSSVDLVET

SEQ ID NO: 313023 - protein, 9 aa, Influenza virus
DLVETNHTG

SEQ ID NO: 313024 - protein, 9 aa, Influenza virus
LVETNHTGT

SEQ ID NO: 313025 - protein, 9 aa, Influenza virus
VETNHTGTY

SEQ ID NO: 313026 - protein, 9 aa, Influenza virus
ETNHTGTYC

SEQ ID NO: 313027 - protein, 9 aa, Influenza virus
TNHTGTYCS

SEQ ID NO: 313028 - protein, 9 aa, Influenza virus
NHTGTYCSL

SEQ ID NO: 313029 - protein, 9 aa, Influenza virus
HTGTYCSLN

SEQ ID NO: 313030 - protein, 9 aa, Influenza virus
TGTYCSLNG

SEQ ID NO: 313031 - protein, 9 aa, Influenza virus
GISPVHLGD

SEQ ID NO: 313032 - protein, 9 aa, Influenza virus
ISPVHLGDC

SEQ ID NO: 313033 - protein, 9 aa, Influenza virus
SPVHLGDCS

SEQ ID NO: 313034 - protein, 9 aa, Influenza virus
PVHLGDCSF

SEQ ID NO: 313035 - protein, 9 aa, Influenza virus
VHLGDCSFE

SEQ ID NO: 313036 - protein, 9 aa, Influenza virus
HLGDCSFEG

SEQ ID NO: 313037 - protein, 9 aa, Influenza virus
LGDCSFEGW

SEQ ID NO: 313038 - protein, 9 aa, Influenza virus
GDCSFEGWI

SEQ ID NO: 313039 - protein, 9 aa, Influenza virus
DCSFEGWIV

SEQ ID NO: 313040 - protein, 9 aa, Influenza virus
CSFEGWIVG

SEQ ID NO: 313041 - protein, 9 aa, Influenza virus
SFEGWIVGN

SEQ ID NO: 313042 - protein, 9 aa, Influenza virus
FEGWIVGNP

SEQ ID NO: 313043 - protein, 9 aa, Influenza virus
EGWIVGNPA

SEQ ID NO: 313044 - protein, 9 aa, Influenza virus
GWIVGNPAC

SEQ ID NO: 313045 - protein, 9 aa, Influenza virus
GIREWSYLI

SEQ ID NO: 313046 - protein, 9 aa, Influenza virus
IREWSYLIE

SEQ ID NO: 313047 - protein, 9 aa, Influenza virus
REWSYLIED

SEQ ID NO: 313048 - protein, 9 aa, Influenza virus
EWSYLIEDP

SEQ ID NO: 313049 - protein, 9 aa, Influenza virus
WSYLIEDPS

SEQ ID NO: 313050 - protein, 9 aa, Influenza virus
SYLIEDPSA

SEQ ID NO: 313051 - protein, 9 aa, Influenza virus
YLIEDPSAP

SEQ ID NO: 313052 - protein, 9 aa, Influenza virus
LIEDPSAPH

SEQ ID NO: 313053 - protein, 9 aa, Influenza virus
IEDPSAPHG

SEQ ID NO: 313054 - protein, 9 aa, Influenza virus
EDPSAPHGL

SEQ ID NO: 313055 - protein, 9 aa, Influenza virus
DPSAPHGLC

SEQ ID NO: 313056 - protein, 9 aa, Influenza virus
PSAPHGLCY

SEQ ID NO: 313057 - protein, 9 aa, Influenza virus
SAPHGLCYP

SEQ ID NO: 313058 - protein, 9 aa, Influenza virus
APHGLCYPG

SEQ ID NO: 313059 - protein, 9 aa, Influenza virus
PHGLCYPGE

SEQ ID NO: 313060 - protein, 9 aa, Influenza virus
HGLCYPGEL

SEQ ID NO: 313061 - protein, 9 aa, Influenza virus
GLCYPGELD

SEQ ID NO: 313062 - protein, 9 aa, Influenza virus
LCYPGELDN

SEQ ID NO: 313063 - protein, 9 aa, Influenza virus
CYPGELDNN

SEQ ID NO: 313064 - protein, 9 aa, Influenza virus
YPGELDNNG

SEQ ID NO: 313065 - protein, 9 aa, Influenza virus
PGELDNNGE

SEQ ID NO: 313066 - protein, 9 aa, Influenza virus
GELDNNGEL

SEQ ID NO: 313067 - protein, 9 aa, Influenza virus
ELDNNGELR

SEQ ID NO: 313068 - protein, 9 aa, Influenza virus
LDNNGELRH

SEQ ID NO: 313069 - protein, 9 aa, Influenza virus
DNNGELRHL

SEQ ID NO: 313070 - protein, 9 aa, Influenza virus
NNGELRHLF

SEQ ID NO: 313071 - protein, 9 aa, Influenza virus
NGELRHLFS

SEQ ID NO: 313072 - protein, 9 aa, Influenza virus
GELRHLFSG

SEQ ID NO: 313073 - protein, 9 aa, Influenza virus
ELRHLFSGI

SEQ ID NO: 313074 - protein, 9 aa, Influenza virus
LRHLFSGIR

SEQ ID NO: 313075 - protein, 9 aa, Influenza virus
RHLFSGIRS

SEQ ID NO: 313076 - protein, 9 aa, Influenza virus
HLFSGIRSF

SEQ ID NO: 313077 - protein, 9 aa, Influenza virus
LFSGIRSFS

SEQ ID NO: 313078 - protein, 9 aa, Influenza virus
FSGIRSFSR

SEQ ID NO: 313079 - protein, 9 aa, Influenza virus
SGIRSFSRT

SEQ ID NO: 313080 - protein, 9 aa, Influenza virus
GIRSFSRTE

SEQ ID NO: 313081 - protein, 9 aa, Influenza virus
IRSFSRTEL

SEQ ID NO: 313082 - protein, 9 aa, Influenza virus
RSFSRTELI

SEQ ID NO: 313083 - protein, 9 aa, Influenza virus
SFSRTELIA

SEQ ID NO: 313084 - protein, 9 aa, Influenza virus
FSRTELIAP

SEQ ID NO: 313085 - protein, 9 aa, Influenza virus
KGTNSFYRN

SEQ ID NO: 313086 - protein, 9 aa, Influenza virus
SFYRNLVWF

SEQ ID NO: 313087 - protein, 9 aa, Influenza virus
FYRNLVWFV

SEQ ID NO: 313088 - protein, 9 aa, Influenza virus
GGYPVIKKT

SEQ ID NO: 313089 - protein, 9 aa, Influenza virus
KTYNNTTGR

SEQ ID NO: 313090 - protein, 9 aa, Influenza virus
TYNNTTGRD

SEQ ID NO: 313091 - protein, 9 aa, Influenza virus
YNNTTGRDV

SEQ ID NO: 313092 - protein, 9 aa, Influenza virus
NNTTGRDVL

SEQ ID NO: 313093 - protein, 9 aa, Influenza virus
NTTGRDVLV

SEQ ID NO: 313094 - protein, 9 aa, Influenza virus
TTGRDVLVL

SEQ ID NO: 313095 - protein, 9 aa, Influenza virus
TGRDVLVLW

SEQ ID NO: 313096 - protein, 9 aa, Influenza virus
GRDVLVLWG

SEQ ID NO: 313097 - protein, 9 aa, Influenza virus
RDVLVLWGI

SEQ ID NO: 313098 - protein, 9 aa, Influenza virus
DVLVLWGIH

SEQ ID NO: 313099 - protein, 9 aa, Influenza virus
VLVLWGIHH

SEQ ID NO: 313100 - protein, 9 aa, Influenza virus
LVLWGIHHP

SEQ ID NO: 313101 - protein, 9 aa, Influenza virus
PYTLVSTSS

SEQ ID NO: 313102 - protein, 9 aa, Influenza virus
YTLVSTSSW

SEQ ID NO: 313103 - protein, 9 aa, Influenza virus
TLVSTSSWS

SEQ ID NO: 313104 - protein, 9 aa, Influenza virus
GVRPGYNGQ

SEQ ID NO: 313105 - protein, 9 aa, Influenza virus
VRPGYNGQR

SEQ ID NO: 313106 - protein, 9 aa, Influenza virus
RPGYNGQKS

SEQ ID NO: 313107 - protein, 9 aa, Influenza virus
PGYNGQKSW

SEQ ID NO: 313108 - protein, 9 aa, Influenza virus
GYNGQRSWM

SEQ ID NO: 313109 - protein, 9 aa, Influenza virus
YNGQRSWMK

SEQ ID NO: 313110 - protein, 9 aa, Influenza virus
NGQRSWMKI

SEQ ID NO: 313111 - protein, 9 aa, Influenza virus
GQRSWMKIY

SEQ ID NO: 313112 - protein, 9 aa, Influenza virus
QRSWMKIYW

SEQ ID NO: 313113 - protein, 9 aa, Influenza virus
SWMKIYWSL

SEQ ID NO: 313114 - protein, 9 aa, Influenza virus
ISFESNGGL

SEQ ID NO: 313115 - protein, 9 aa, Influenza virus
SFESNGGLL

SEQ ID NO: 313116 - protein, 9 aa, Influenza virus
FESNGGLLA

SEQ ID NO: 313117 - protein, 9 aa, Influenza virus
ESNGGLLAP

SEQ ID NO: 313118 - protein, 9 aa, Influenza virus
SNGGLLAPR

SEQ ID NO: 313119 - protein, 9 aa, Influenza virus
NGGLLAPRY

SEQ ID NO: 313120 - protein, 9 aa, Influenza virus
GGLLAPRYG

SEQ ID NO: 313121 - protein, 9 aa, Influenza virus
GLLAPRYGY

SEQ ID NO: 313122 - protein, 9 aa, Influenza virus
LLAPRYGYI

SEQ ID NO: 313123 - protein, 9 aa, Influenza virus
LAPRYGYII

SEQ ID NO: 313124 - protein, 9 aa, Influenza virus
APRYGYIIE

SEQ ID NO: 313125 - protein, 9 aa, Influenza virus
PRYGYIIEE

SEQ ID NO: 313126 - protein, 9 aa, Influenza virus
RYGYIIEEY

SEQ ID NO: 313127 - protein, 9 aa, Influenza virus
YGYIIEEYG

SEQ ID NO: 313128 - protein, 9 aa, Influenza virus
GYIIEEYGK

SEQ ID NO: 313129 - protein, 9 aa, Influenza virus
YIIEEYGKG

SEQ ID NO: 313130 - protein, 9 aa, Influenza virus
IIEEYGKGR

SEQ ID NO: 313131 - protein, 9 aa, Influenza virus
IEEYGKGRI

SEQ ID NO: 313132 - protein, 9 aa, Influenza virus
EEYGKGRIF

SEQ ID NO: 313133 - protein, 9 aa, Influenza virus
EYGKGRIFQ

SEQ ID NO: 313134 - protein, 9 aa, Influenza virus
YGKGRIFQS

SEQ ID NO: 313135 - protein, 9 aa, Influenza virus
GKGRIFQSR

SEQ ID NO: 313136 - protein, 9 aa, Influenza virus
KGRIFQSRI

SEQ ID NO: 313137 - protein, 9 aa, Influenza virus
GRIFQSRIR

SEQ ID NO: 313138 - protein, 9 aa, Influenza virus
KCNTKCQTS

SEQ ID NO: 313139 - protein, 9 aa, Influenza virus
CNTKCQTSV

SEQ ID NO: 313140 - protein, 9 aa, Influenza virus
NTKCQTSVG

SEQ ID NO: 313141 - protein, 9 aa, Influenza virus
TKCQTSVGG

SEQ ID NO: 313142 - protein, 9 aa, Influenza virus
KCQTSVGGI

SEQ ID NO: 313143 - protein, 9 aa, Influenza virus
CQTSVGGIN

SEQ ID NO: 313144 - protein, 9 aa, Influenza virus
QTSVGGINT

SEQ ID NO: 313145 - protein, 9 aa, Influenza virus
TSVGGINTN

SEQ ID NO: 313146 - protein, 9 aa, Influenza virus
SVGGINTNK

SEQ ID NO: 313147 - protein, 9 aa, Influenza virus
VGGINTNKT

SEQ ID NO: 313148 - protein, 9 aa, Influenza virus
GGINTNKTF

SEQ ID NO: 313149 - protein, 9 aa, Influenza virus
GINTNKTFQ

SEQ ID NO: 313150 - protein, 9 aa, Influenza virus
INTNKTFQN

SEQ ID NO: 313151 - protein, 9 aa, Influenza virus
NTNKTFQNI

SEQ ID NO: 313152 - protein, 9 aa, Influenza virus
TNKTFQNIE

SEQ ID NO: 313153 - protein, 9 aa, Influenza virus
NKTFQNIER

SEQ ID NO: 313154 - protein, 9 aa, Influenza virus
KTFQNIERN

SEQ ID NO: 313155 - protein, 9 aa, Influenza virus
TFQNIERNA

SEQ ID NO: 313156 - protein, 9 aa, Influenza virus
FQNIERNAL

SEQ ID NO: 313157 - protein, 9 aa, Influenza virus
QNIERNALG

SEQ ID NO: 313158 - protein, 9 aa, Influenza virus
NIERNALGD

SEQ ID NO: 313159 - protein, 9 aa, Influenza virus
IERNALGDC

SEQ ID NO: 313160 - protein, 9 aa, Influenza virus
ERNALGDCP

SEQ ID NO: 313161 - protein, 9 aa, Influenza virus
RNALGDCPK

SEQ ID NO: 313162 - protein, 9 aa, Influenza virus
NALGDCPKY

SEQ ID NO: 313163 - protein, 9 aa, Influenza virus
ALGDCPKYI

SEQ ID NO: 313164 - protein, 9 aa, Influenza virus
LGDCPKYIK

SEQ ID NO: 313165 - protein, 9 aa, Influenza virus
GDCPKYIKS

SEQ ID NO: 313166 - protein, 9 aa, Influenza virus
DCPKYIKSG

SEQ ID NO: 313167 - protein, 9 aa, Influenza virus
CPKYIKSGQ

SEQ ID NO: 313168 - protein, 9 aa, Influenza virus
PKYIKSGQL

SEQ ID NO: 313169 - protein, 9 aa, Influenza virus
KYIKSGQLK

SEQ ID NO: 313170 - protein, 9 aa, Influenza virus
YIKSGQLKL

SEQ ID NO: 313171 - protein, 9 aa, Influenza virus
IKSGQLKLA

SEQ ID NO: 313172 - protein, 9 aa, Influenza virus
KSGQLKLAT

SEQ ID NO: 313173 - protein, 9 aa, Influenza virus
SGQLKLATG

SEQ ID NO: 313174 - protein, 9 aa, Influenza virus
GQLKLATGL

SEQ ID NO: 313175 - protein, 9 aa, Influenza virus
QLKLATGLR

SEQ ID NO: 313176 - protein, 9 aa, Influenza virus
LKLATGLRN

SEQ ID NO: 313177 - protein, 9 aa, Influenza virus
KLATGLRNV

SEQ ID NO: 313178 - protein, 9 aa, Influenza virus
LATGLRNVP

SEQ ID NO: 313179 - protein, 9 aa, Influenza virus
ATGLRNVPA

SEQ ID NO: 313180 - protein, 9 aa, Influenza virus
RGLFGAIAG

SEQ ID NO: 313181 - protein, 9 aa, Influenza virus
GLFGAIAGF

SEQ ID NO: 313182 - protein, 9 aa, Influenza virus
LFGAIAGFI

SEQ ID NO: 313183 - protein, 9 aa, Influenza virus
FGAIAGFIE

SEQ ID NO: 313184 - protein, 9 aa, Influenza virus
GAIAGFIEG

SEQ ID NO: 313185 - protein, 9 aa, Influenza virus
AIAGFIEGG

SEQ ID NO: 313186 - protein, 9 aa, Influenza virus
IAGFIEGGW

SEQ ID NO: 313187 - protein, 9 aa, Influenza virus
AGFIEGGWP

SEQ ID NO: 313188 - protein, 9 aa, Influenza virus
GFIEGGWPG

SEQ ID NO: 313189 - protein, 9 aa, Influenza virus
FIEGGWPGL

SEQ ID NO: 313190 - protein, 9 aa, Influenza virus
IEGGWPGLI

SEQ ID NO: 313191 - protein, 9 aa, Influenza virus
EGGWPGLIN

SEQ ID NO: 313192 - protein, 9 aa, Influenza virus
GGWPGLING

SEQ ID NO: 313193 - protein, 9 aa, Influenza virus
GWPGLINGW

SEQ ID NO: 313194 - protein, 9 aa, Influenza virus
WPGLINGWY

SEQ ID NO: 313195 - protein, 9 aa, Influenza virus
PGLINGWYG

SEQ ID NO: 313196 - protein, 9 aa, Influenza virus
GLINGWYGF

SEQ ID NO: 313197 - protein, 9 aa, Influenza virus
LINGWYGFQ

SEQ ID NO: 313198 - protein, 9 aa, Influenza virus
INGWYGFQH

SEQ ID NO: 313199 - protein, 9 aa, Influenza virus
NGWYGFQHQ

SEQ ID NO: 313200 - protein, 9 aa, Influenza virus
GWYGFQHQN

SEQ ID NO: 313201 - protein, 9 aa, Influenza virus
WYGFQHQNE

SEQ ID NO: 313202 - protein, 9 aa, Influenza virus
YGFQHQNEQ

SEQ ID NO: 313203 - protein, 9 aa, Influenza virus
GFQHQNEQG

SEQ ID NO: 313204 - protein, 9 aa, Influenza virus
FQHQNEQGV

SEQ ID NO: 313205 - protein, 9 aa, Influenza virus
QHQNEQGVG

SEQ ID NO: 313206 - protein, 9 aa, Influenza virus
HQNEQGTGI

SEQ ID NO: 313207 - protein, 9 aa, Influenza virus
QNEQGTGIA

SEQ ID NO: 313208 - protein, 9 aa, Influenza virus
NEQGTGIAA

SEQ ID NO: 313209 - protein, 9 aa, Influenza virus
EQGTGIAAD

SEQ ID NO: 313210 - protein, 9 aa, Influenza virus
QGTGIAADK

SEQ ID NO: 313211 - protein, 9 aa, Influenza virus
GTGIAADKE

SEQ ID NO: 313212 - protein, 9 aa, Influenza virus
TGIAADKES

SEQ ID NO: 313213 - protein, 9 aa, Influenza virus
GIAADKEST

SEQ ID NO: 313214 - protein, 9 aa, Influenza virus
IAADKESTQ

SEQ ID NO: 313215 - protein, 9 aa, Influenza virus
AADKESTQK

SEQ ID NO: 313216 - protein, 9 aa, Influenza virus
ADKESTQKA

SEQ ID NO: 313217 - protein, 9 aa, Influenza virus
DKESTQKAI

SEQ ID NO: 313218 - protein, 9 aa, Influenza virus
KESTQKAID

SEQ ID NO: 313219 - protein, 9 aa, Influenza virus
ESTQKAIDQ

SEQ ID NO: 313220 - protein, 9 aa, Influenza virus
STQKAIDQI

SEQ ID NO: 313221 - protein, 9 aa, Influenza virus
TQKAIDQIT

SEQ ID NO: 313222 - protein, 9 aa, Influenza virus
QKAIDQITT

SEQ ID NO: 313223 - protein, 9 aa, Influenza virus
KAIDQITTK

SEQ ID NO: 313224 - protein, 9 aa, Influenza virus
AIDQITTKI

SEQ ID NO: 313225 - protein, 9 aa, Influenza virus
IDQITTKIN

SEQ ID NO: 313226 - protein, 9 aa, Influenza virus
DQITTKINN

SEQ ID NO: 313227 - protein, 9 aa, Influenza virus
QITTKINNI

SEQ ID NO: 313228 - protein, 9 aa, Influenza virus
ITTKINNII

SEQ ID NO: 313229 - protein, 9 aa, Influenza virus
TTKINNIID

SEQ ID NO: 313230 - protein, 9 aa, Influenza virus
TKINNIIDK

SEQ ID NO: 313231 - protein, 9 aa, Influenza virus
KINNIIDKM

SEQ ID NO: 313232 - protein, 9 aa, Influenza virus
INNIIDKMN

SEQ ID NO: 313233 - protein, 9 aa, Influenza virus
NNIIDKMNG

SEQ ID NO: 313234 - protein, 9 aa, Influenza virus
NIIDKMNGN

SEQ ID NO: 313235 - protein, 9 aa, Influenza virus
IIDKMNGNY

SEQ ID NO: 313236 - protein, 9 aa, Influenza virus
IDKMNGNYD

SEQ ID NO: 313237 - protein, 9 aa, Influenza virus
DKMNGNYDS

SEQ ID NO: 313238 - protein, 9 aa, Influenza virus
KMNGNYDSI

SEQ ID NO: 313239 - protein, 9 aa, Influenza virus
MNGNYDSIR

SEQ ID NO: 313240 - protein, 9 aa, Influenza virus
NGNYDSIRG

SEQ ID NO: 313241 - protein, 9 aa, Influenza virus
GNYDSIRGE

SEQ ID NO: 313242 - protein, 9 aa, Influenza virus
NYDSIRGEF

SEQ ID NO: 313243 - protein, 9 aa, Influenza virus
YDSIRGEFN

SEQ ID NO: 313244 - protein, 9 aa, Influenza virus
DSIRGEFNQ

SEQ ID NO: 313245 - protein, 9 aa, Influenza virus
SIRGEFNQV

SEQ ID NO: 313246 - protein, 9 aa, Influenza virus
IRGEFNQVE

SEQ ID NO: 313247 - protein, 9 aa, Influenza virus
RGEFNQVEK

SEQ ID NO: 313248 - protein, 9 aa, Influenza virus
GEFNQVEKR

SEQ ID NO: 313249 - protein, 9 aa, Influenza virus
EFNQVEKRI

SEQ ID NO: 313250 - protein, 9 aa, Influenza virus
FNQVEKRIN

SEQ ID NO: 313251 - protein, 9 aa, Influenza virus
NQVEKRINM

SEQ ID NO: 313252 - protein, 9 aa, Influenza virus
QVEQRINML

SEQ ID NO: 313253 - protein, 9 aa, Influenza virus
VEQRINMLA

SEQ ID NO: 313254 - protein, 9 aa, Influenza virus
EQRINMLAD

SEQ ID NO: 313255 - protein, 9 aa, Influenza virus
QRINMLADR

SEQ ID NO: 313256 - protein, 9 aa, Influenza virus
RINMLADRI

SEQ ID NO: 313257 - protein, 9 aa, Influenza virus
INMLADRID

SEQ ID NO: 313258 - protein, 9 aa, Influenza virus
NMLADRIDD

SEQ ID NO: 313259 - protein, 9 aa, Influenza virus
MLADRIDDA

SEQ ID NO: 313260 - protein, 9 aa, Influenza virus
LADRIDDAV

SEQ ID NO: 313261 - protein, 9 aa, Influenza virus
ADRIDDAVT

SEQ ID NO: 313262 - protein, 9 aa, Influenza virus
DRIDDAVTD

SEQ ID NO: 313263 - protein, 9 aa, Influenza virus
RIDDAVTDV

SEQ ID NO: 313264 - protein, 9 aa, Influenza virus
IDDAVTDVW

SEQ ID NO: 313265 - protein, 9 aa, Influenza virus
DDAVTDVWS

SEQ ID NO: 313266 - protein, 9 aa, Influenza virus
DAVTDVWSY

SEQ ID NO: 313267 - protein, 9 aa, Influenza virus
AVTDVWSYN

SEQ ID NO: 313268 - protein, 9 aa, Influenza virus
VTDVWSYNA

SEQ ID NO: 313269 - protein, 9 aa, Influenza virus
TDVWSYNAK

SEQ ID NO: 313270 - protein, 9 aa, Influenza virus
DVWSYNAKL

SEQ ID NO: 313271 - protein, 9 aa, Influenza virus
VWSYNAKLL

SEQ ID NO: 313272 - protein, 9 aa, Influenza virus
WSYNAKLLV

SEQ ID NO: 313273 - protein, 9 aa, Influenza virus
SYNAKLLVL

SEQ ID NO: 313274 - protein, 9 aa, Influenza virus
YNAKLLVLL

SEQ ID NO: 313275 - protein, 9 aa, Influenza virus
NAKLLVLLE

SEQ ID NO: 313276 - protein, 9 aa, Influenza virus
AKLLVLLEN

SEQ ID NO: 313277 - protein, 9 aa, Influenza virus
KLLVLLEND

SEQ ID NO: 313278 - protein, 9 aa, Influenza virus
LLVLLENDK

SEQ ID NO: 313279 - protein, 9 aa, Influenza virus
LVLLENDKT

SEQ ID NO: 313280 - protein, 9 aa, Influenza virus
VLLENDKTL

SEQ ID NO: 313281 - protein, 9 aa, Influenza virus
LLENDKTLD

SEQ ID NO: 313282 - protein, 9 aa, Influenza virus
LENDKTLDM

SEQ ID NO: 313283 - protein, 9 aa, Influenza virus
ENDKTLDMH

SEQ ID NO: 313284 - protein, 9 aa, Influenza virus
NDKTLDMHD

SEQ ID NO: 313285 - protein, 9 aa, Influenza virus
DKTLDMHDA

SEQ ID NO: 313286 - protein, 9 aa, Influenza virus
KTLDMHDAN

SEQ ID NO: 313287 - protein, 9 aa, Influenza virus
TLDMHDANV

SEQ ID NO: 313288 - protein, 9 aa, Influenza virus
LDMHDANVR

SEQ ID NO: 313289 - protein, 9 aa, Influenza virus
DMHDANVRN

SEQ ID NO: 313290 - protein, 9 aa, Influenza virus
MHDANVRNL

SEQ ID NO: 313291 - protein, 9 aa, Influenza virus
HDANVRNLH

SEQ ID NO: 313292 - protein, 9 aa, Influenza virus
DANVRNLHD

SEQ ID NO: 313293 - protein, 9 aa, Influenza virus
ANVRNLHDQ

SEQ ID NO: 313294 - protein, 9 aa, Influenza virus
NVRNLHDQV

SEQ ID NO: 313295 - protein, 9 aa, Influenza virus
VRNLHDQVR

SEQ ID NO: 313296 - protein, 9 aa, Influenza virus
NAIDEGNGC

SEQ ID NO: 313297 - protein, 9 aa, Influenza virus
AIDEGNGCF

SEQ ID NO: 313298 - protein, 9 aa, Influenza virus
IDEGNGCFE

SEQ ID NO: 313299 - protein, 9 aa, Influenza virus
DEGNGCFEL

SEQ ID NO: 313300 - protein, 9 aa, Influenza virus
EGNGCFELL

SEQ ID NO: 313301 - protein, 9 aa, Influenza virus
GNGCFELLH

SEQ ID NO: 313302 - protein, 9 aa, Influenza virus
NGCFELLHK

SEQ ID NO: 313303 - protein, 9 aa, Influenza virus
GCFELLHKC

SEQ ID NO: 313304 - protein, 9 aa, Influenza virus
CFELLHKCN

SEQ ID NO: 313305 - protein, 9 aa, Influenza virus
FELLHKCND

SEQ ID NO: 313306 - protein, 9 aa, Influenza virus
ELLHKCNDS

SEQ ID NO: 313307 - protein, 9 aa, Influenza virus
LLHKCNDSC

SEQ ID NO: 313308 - protein, 9 aa, Influenza virus
LHKCNDSCM

SEQ ID NO: 313309 - protein, 9 aa, Influenza virus
HKCNDSCME

SEQ ID NO: 313310 - protein, 9 aa, Influenza virus
KCNDSCMET

SEQ ID NO: 313311 - protein, 9 aa, Influenza virus
CNDSCMETI

SEQ ID NO: 313312 - protein, 9 aa, Influenza virus
NDSCMETIR

SEQ ID NO: 313313 - protein, 9 aa, Influenza virus
DSCMETIRN

SEQ ID NO: 313314 - protein, 9 aa, Influenza virus
SCMETIRNG

SEQ ID NO: 313315 - protein, 9 aa, Influenza virus
CMETIRNGT

SEQ ID NO: 313316 - protein, 9 aa, Influenza virus
METIRNGTY

SEQ ID NO: 313317 - protein, 9 aa, Influenza virus
ETIRNGTYN

SEQ ID NO: 313318 - protein, 9 aa, Influenza virus
TIRNGTYNH

SEQ ID NO: 313319 - protein, 9 aa, Influenza virus
IRNGTYNHT

SEQ ID NO: 313320 - protein, 9 aa, Influenza virus
EYAEESKLK

SEQ ID NO: 313321 - protein, 9 aa, Influenza virus
YAEESKLKR

SEQ ID NO: 313322 - protein, 9 aa, Influenza virus
AEESKLKRQ

SEQ ID NO: 313323 - protein, 9 aa, Influenza virus
EESKLKRQE

SEQ ID NO: 313324 - protein, 9 aa, Influenza virus
ESKLKRQEI

SEQ ID NO: 313325 - protein, 9 aa, Influenza virus
SKLKRQEIE

SEQ ID NO: 313326 - protein, 9 aa, Influenza virus
KLKRQEIEG

SEQ ID NO: 313327 - protein, 9 aa, Influenza virus
LKRQEIEGI

SEQ ID NO: 313328 - protein, 9 aa, Influenza virus
KRQEIEGIK

SEQ ID NO: 313329 - protein, 9 aa, Influenza virus
RQEIEGIKL

SEQ ID NO: 313330 - protein, 9 aa, Influenza virus
QEIEGIKLK

SEQ ID NO: 313331 - protein, 9 aa, Influenza virus
EIEGIKLKS

SEQ ID NO: 313332 - protein, 9 aa, Influenza virus
SEDNVYKAL

SEQ ID NO: 313333 - protein, 9 aa, Influenza virus
EDNVYKALS

SEQ ID NO: 313334 - protein, 9 aa, Influenza virus
DNVYKALSI

SEQ ID NO: 313335 - protein, 9 aa, Influenza virus
NVYKALSIY

SEQ ID NO: 313336 - protein, 9 aa, Influenza virus
VYKALSIYS

SEQ ID NO: 313337 - protein, 9 aa, Influenza virus
YKALSIYSC

SEQ ID NO: 313338 - protein, 9 aa, Influenza virus
KALSIYSCI

SEQ ID NO: 313339 - protein, 9 aa, Influenza virus
ALSIYSCIA

SEQ ID NO: 313340 - protein, 9 aa, Influenza virus
LSIYSCIAS

SEQ ID NO: 313341 - protein, 9 aa, Influenza virus
SIYSCIASS

SEQ ID NO: 313342 - protein, 9 aa, Influenza virus
IYSCIASSV

SEQ ID NO: 313343 - protein, 9 aa, Influenza virus
YSCIASSVV

SEQ ID NO: 313344 - protein, 9 aa, Influenza virus
SCIASSVVL

SEQ ID NO: 313345 - protein, 9 aa, Influenza virus
CIASSVVLV

SEQ ID NO: 313346 - protein, 9 aa, Influenza virus
IASSVVLVG

SEQ ID NO: 313347 - protein, 9 aa, Influenza virus
ASSVVLVGL

SEQ ID NO: 313348 - protein, 9 aa, Influenza virus
SSVVLVGLI

SEQ ID NO: 313349 - protein, 9 aa, Influenza virus
SVVLVGLIL

SEQ ID NO: 313350 - protein, 9 aa, Influenza virus
VLVGLILAF

SEQ ID NO: 313351 - protein, 9 aa, Influenza virus
LVGLILAFI

SEQ ID NO: 313352 - protein, 9 aa, Influenza virus
VGLILAFIM

SEQ ID NO: 313353 - protein, 9 aa, Influenza virus
GLILAFIMW

SEQ ID NO: 313354 - protein, 9 aa, Influenza virus
LILAFIMWA

SEQ ID NO: 313355 - protein, 9 aa, Influenza virus
ILAFIMWAC

SEQ ID NO: 313356 - protein, 9 aa, Influenza virus
FIMWACSSG

SEQ ID NO: 313357 - protein, 9 aa, Influenza virus
IMWACSSGN

SEQ ID NO: 313358 - protein, 9 aa, Influenza virus
MWACSSGNC

SEQ ID NO: 313359 - protein, 9 aa, Influenza virus
WACSSGNCR

SEQ ID NO: 313360 - protein, 9 aa, Influenza virus
ACSSGNCRF

SEQ ID NO: 313361 - protein, 9 aa, Influenza virus
CSSGNCRFN

SEQ ID NO: 313362 - protein, 9 aa, Influenza virus
MIALILVAL

SEQ ID NO: 313363 - protein, 9 aa, Influenza virus
IALILVALA

SEQ ID NO: 313364 - protein, 9 aa, Influenza virus
ALILVALAL

SEQ ID NO: 313365 - protein, 9 aa, Influenza virus
LILVALALS

SEQ ID NO: 313366 - protein, 9 aa, Influenza virus
ILVALALSH

SEQ ID NO: 313367 - protein, 9 aa, Influenza virus
LVALALSHT

SEQ ID NO: 313368 - protein, 9 aa, Influenza virus
VALALSHTA

SEQ ID NO: 313369 - protein, 9 aa, Influenza virus
ALALSHTAY

SEQ ID NO: 313370 - protein, 9 aa, Influenza virus
LALSHTAYS

SEQ ID NO: 313371 - protein, 9 aa, Influenza virus
ALSHTAYSQ

SEQ ID NO: 313372 - protein, 9 aa, Influenza virus
LSHTAYSQI

SEQ ID NO: 313373 - protein, 9 aa, Influenza virus
SHTAYSQIT

SEQ ID NO: 313374 - protein, 9 aa, Influenza virus
HTAYSQITN

SEQ ID NO: 313375 - protein, 9 aa, Influenza virus
TAYSQITNG

SEQ ID NO: 313376 - protein, 9 aa, Influenza virus
AYSQITNGT

SEQ ID NO: 313377 - protein, 9 aa, Influenza virus
YSQITNGTT

SEQ ID NO: 313378 - protein, 9 aa, Influenza virus
SQITNGTTG

SEQ ID NO: 313379 - protein, 9 aa, Influenza virus
QITNGTTGN

SEQ ID NO: 313380 - protein, 9 aa, Influenza virus
ITNGTTGNP

SEQ ID NO: 313381 - protein, 9 aa, Influenza virus
TNGTTGNPI

SEQ ID NO: 313382 - protein, 9 aa, Influenza virus
NGTTGNPII

SEQ ID NO: 313383 - protein, 9 aa, Influenza virus
GTTGNPIIC

SEQ ID NO: 313384 - protein, 9 aa, Influenza virus
TTGNPIICL

SEQ ID NO: 313385 - protein, 9 aa, Influenza virus
TGNPIICLG

SEQ ID NO: 313386 - protein, 9 aa, Influenza virus
GNPIICLGH

SEQ ID NO: 313387 - protein, 9 aa, Influenza virus
NPIICLGHH

SEQ ID NO: 313388 - protein, 9 aa, Influenza virus
PIICLGHHA

SEQ ID NO: 313389 - protein, 9 aa, Influenza virus
IICLGHHAV

SEQ ID NO: 313390 - protein, 9 aa, Influenza virus
ICLGHHAVE

SEQ ID NO: 313391 - protein, 9 aa, Influenza virus
CLGHHAVEN

SEQ ID NO: 313392 - protein, 9 aa, Influenza virus
LGHHAVENG

SEQ ID NO: 313393 - protein, 9 aa, Influenza virus
GHHAVENGT

SEQ ID NO: 313394 - protein, 9 aa, Influenza virus
HHAVENGTS

SEQ ID NO: 313395 - protein, 9 aa, Influenza virus
HAVENGTSV

SEQ ID NO: 313396 - protein, 9 aa, Influenza virus
AVENGTSVK

SEQ ID NO: 313397 - protein, 9 aa, Influenza virus
VENGTSVKT

SEQ ID NO: 313398 - protein, 9 aa, Influenza virus
ENGTSVKTL

SEQ ID NO: 313399 - protein, 9 aa, Influenza virus
NGTSVKTLT

SEQ ID NO: 313400 - protein, 9 aa, Influenza virus
GTSVKTLTD

SEQ ID NO: 313401 - protein, 9 aa, Influenza virus
TSVKTLTDN

SEQ ID NO: 313402 - protein, 9 aa, Influenza virus
SVKTLTDNH

SEQ ID NO: 313403 - protein, 9 aa, Influenza virus
VKTLTDNHV

SEQ ID NO: 313404 - protein, 9 aa, Influenza virus
KTLTDNHVE

SEQ ID NO: 313405 - protein, 9 aa, Influenza virus
TLTDNHVEV

SEQ ID NO: 313406 - protein, 9 aa, Influenza virus
LTDNHVEVV

SEQ ID NO: 313407 - protein, 9 aa, Influenza virus
TDNHVEVVS

SEQ ID NO: 313408 - protein, 9 aa, Influenza virus
DNHVEVVSA

SEQ ID NO: 313409 - protein, 9 aa, Influenza virus
NHVEVVSAK

SEQ ID NO: 313410 - protein, 9 aa, Influenza virus
HVEVVSAKE

SEQ ID NO: 313411 - protein, 9 aa, Influenza virus
VEVVSAKEL

SEQ ID NO: 313412 - protein, 9 aa, Influenza virus
EVVSAKELV

SEQ ID NO: 313413 - protein, 9 aa, Influenza virus
VVSAKELVE

SEQ ID NO: 313414 - protein, 9 aa, Influenza virus
VSAKELVET

SEQ ID NO: 313415 - protein, 9 aa, Influenza virus
SAKELVETN

SEQ ID NO: 313416 - protein, 9 aa, Influenza virus
AKELVETNH

SEQ ID NO: 313417 - protein, 9 aa, Influenza virus
KELVETNHT

SEQ ID NO: 313418 - protein, 9 aa, Influenza virus
ELVETNHTD

SEQ ID NO: 313419 - protein, 9 aa, Influenza virus
LVETNHTDE

SEQ ID NO: 313420 - protein, 9 aa, Influenza virus
VETNHTDEL

SEQ ID NO: 313421 - protein, 9 aa, Influenza virus
ETNHTDELC

SEQ ID NO: 313422 - protein, 9 aa, Influenza virus
TNHTDELCP

SEQ ID NO: 313423 - protein, 9 aa, Influenza virus
NHTDELCPS

SEQ ID NO: 313424 - protein, 9 aa, Influenza virus
HTDELCPSP

SEQ ID NO: 313425 - protein, 9 aa, Influenza virus
TDELCPSPL

SEQ ID NO: 313426 - protein, 9 aa, Influenza virus
DELCPSPLK

SEQ ID NO: 313427 - protein, 9 aa, Influenza virus
ELCPSPLKL

SEQ ID NO: 313428 - protein, 9 aa, Influenza virus
LCPSPLKLV

SEQ ID NO: 313429 - protein, 9 aa, Influenza virus
CPSPLKLVD

SEQ ID NO: 313430 - protein, 9 aa, Influenza virus
PSPLKLVDG

SEQ ID NO: 313431 - protein, 9 aa, Influenza virus
SPLKLVDGQ

SEQ ID NO: 313432 - protein, 9 aa, Influenza virus
PLKLVDGQD

SEQ ID NO: 313433 - protein, 9 aa, Influenza virus
LKLVDGQDC

SEQ ID NO: 313434 - protein, 9 aa, Influenza virus
KLVDGQDCD

SEQ ID NO: 313435 - protein, 9 aa, Influenza virus
LVDGQDCDL

SEQ ID NO: 313436 - protein, 9 aa, Influenza virus
VDGQDCDLI

SEQ ID NO: 313437 - protein, 9 aa, Influenza virus
DGQDCDLIN

SEQ ID NO: 313438 - protein, 9 aa, Influenza virus
GQDCDLING

SEQ ID NO: 313439 - protein, 9 aa, Influenza virus
QDCDLINGA

SEQ ID NO: 313440 - protein, 9 aa, Influenza virus
DCDLINGAL

SEQ ID NO: 313441 - protein, 9 aa, Influenza virus
CDLINGALG

SEQ ID NO: 313442 - protein, 9 aa, Influenza virus
DLINGALGS

SEQ ID NO: 313443 - protein, 9 aa, Influenza virus
LINGALGSP

SEQ ID NO: 313444 - protein, 9 aa, Influenza virus
INGALGSPG

SEQ ID NO: 313445 - protein, 9 aa, Influenza virus
NGALGSPGC

SEQ ID NO: 313446 - protein, 9 aa, Influenza virus
GALGSPGCD

SEQ ID NO: 313447 - protein, 9 aa, Influenza virus
ALGSPGCDR

SEQ ID NO: 313448 - protein, 9 aa, Influenza virus
LGSPGCDRL

SEQ ID NO: 313449 - protein, 9 aa, Influenza virus
GSPGCDRLQ

SEQ ID NO: 313450 - protein, 9 aa, Influenza virus
SPGCDRLQD

SEQ ID NO: 313451 - protein, 9 aa, Influenza virus
PGCDRLQDT

SEQ ID NO: 313452 - protein, 9 aa, Influenza virus
GCDRLQDTT

SEQ ID NO: 313453 - protein, 9 aa, Influenza virus
CDRLQDTTW

SEQ ID NO: 313454 - protein, 9 aa, Influenza virus
DRLQDTTWD

SEQ ID NO: 313455 - protein, 9 aa, Influenza virus
RLQDTTWDV

SEQ ID NO: 313456 - protein, 9 aa, Influenza virus
LQDTTWDVF

SEQ ID NO: 313457 - protein, 9 aa, Influenza virus
QDTTWDVFI

SEQ ID NO: 313458 - protein, 9 aa, Influenza virus
DTTWDVFIE

SEQ ID NO: 313459 - protein, 9 aa, Influenza virus
TTWDVFIER

SEQ ID NO: 313460 - protein, 9 aa, Influenza virus
TWDVFIERP

SEQ ID NO: 313461 - protein, 9 aa, Influenza virus
WDVFIERPT

SEQ ID NO: 313462 - protein, 9 aa, Influenza virus
DVFIERPTA

SEQ ID NO: 313463 - protein, 9 aa, Influenza virus
VFIERPTAV

SEQ ID NO: 313464 - protein, 9 aa, Influenza virus
FIERPTAVD

SEQ ID NO: 313465 - protein, 9 aa, Influenza virus
IERPTAVDT

SEQ ID NO: 313466 - protein, 9 aa, Influenza virus
ERPTAVDTC

SEQ ID NO: 313467 - protein, 9 aa, Influenza virus
RPTAVDTCY

SEQ ID NO: 313468 - protein, 9 aa, Influenza virus
PTAVDTCYP

SEQ ID NO: 313469 - protein, 9 aa, Influenza virus
TAVDTCYPF

SEQ ID NO: 313470 - protein, 9 aa, Influenza virus
AVDTCYPFD

SEQ ID NO: 313471 - protein, 9 aa, Influenza virus
VDTCYPFDV

SEQ ID NO: 313472 - protein, 9 aa, Influenza virus
DTCYPFDVP

SEQ ID NO: 313473 - protein, 9 aa, Influenza virus
TCYPFDVPD

SEQ ID NO: 313474 - protein, 9 aa, Influenza virus
CYPFDVPDY

SEQ ID NO: 313475 - protein, 9 aa, Influenza virus
YPFDVPDYQ

SEQ ID NO: 313476 - protein, 9 aa, Influenza virus
PFDVPDYQS

SEQ ID NO: 313477 - protein, 9 aa, Influenza virus
FDVPDYQSL

SEQ ID NO: 313478 - protein, 9 aa, Influenza virus
DVPDYQSLR

SEQ ID NO: 313479 - protein, 9 aa, Influenza virus
VPDYQSLRS

SEQ ID NO: 313480 - protein, 9 aa, Influenza virus
PDYQSLRSI

SEQ ID NO: 313481 - protein, 9 aa, Influenza virus
DYQSLRSIL

SEQ ID NO: 313482 - protein, 9 aa, Influenza virus
YQSLRSILA

SEQ ID NO: 313483 - protein, 9 aa, Influenza virus
QSLRSILAS

SEQ ID NO: 313484 - protein, 9 aa, Influenza virus
SLRSILASS

SEQ ID NO: 313485 - protein, 9 aa, Influenza virus
LRSILASSG

SEQ ID NO: 313486 - protein, 9 aa, Influenza virus
RSILASSGS

SEQ ID NO: 313487 - protein, 9 aa, Influenza virus
SILASSGSL

SEQ ID NO: 313488 - protein, 9 aa, Influenza virus
ILASSGSLE

SEQ ID NO: 313489 - protein, 9 aa, Influenza virus
LASSGSLEF

SEQ ID NO: 313490 - protein, 9 aa, Influenza virus
ASSGSLEFI

SEQ ID NO: 313491 - protein, 9 aa, Influenza virus
SSGSLEFIA

SEQ ID NO: 313492 - protein, 9 aa, Influenza virus
SGSLEFIAE

SEQ ID NO: 313493 - protein, 9 aa, Influenza virus
GSLEFIAEQ

SEQ ID NO: 313494 - protein, 9 aa, Influenza virus
SLEFIAEQF

SEQ ID NO: 313495 - protein, 9 aa, Influenza virus
LEFIAEQFT

SEQ ID NO: 313496 - protein, 9 aa, Influenza virus
EFIAEQFTW

SEQ ID NO: 313497 - protein, 9 aa, Influenza virus
FIAEQFTWN

SEQ ID NO: 313498 - protein, 9 aa, Influenza virus
IAEQFTWNG

SEQ ID NO: 313499 - protein, 9 aa, Influenza virus
AEQFTWNGV

SEQ ID NO: 313500 - protein, 9 aa, Influenza virus
EQFTWNGVK

SEQ ID NO: 313501 - protein, 9 aa, Influenza virus
QFTWNGVKV

SEQ ID NO: 313502 - protein, 9 aa, Influenza virus
FTWNGVKVD

SEQ ID NO: 313503 - protein, 9 aa, Influenza virus
TWNGVKVDG

SEQ ID NO: 313504 - protein, 9 aa, Influenza virus
WNGVKVDGS

SEQ ID NO: 313505 - protein, 9 aa, Influenza virus
NGVKVDGSS

SEQ ID NO: 313506 - protein, 9 aa, Influenza virus
GVKVDGSSS

SEQ ID NO: 313507 - protein, 9 aa, Influenza virus
VKVDGSSSA

SEQ ID NO: 313508 - protein, 9 aa, Influenza virus
KVDGSSSAC

SEQ ID NO: 313509 - protein, 9 aa, Influenza virus
VDGSSSACL

SEQ ID NO: 313510 - protein, 9 aa, Influenza virus
DGSSSACLR

SEQ ID NO: 313511 - protein, 9 aa, Influenza virus
GSSSACLRG

SEQ ID NO: 313512 - protein, 9 aa, Influenza virus
SSSACLRGG

SEQ ID NO: 313513 - protein, 9 aa, Influenza virus
SSACLRGGR

SEQ ID NO: 313514 - protein, 9 aa, Influenza virus
SACLRGGRN

SEQ ID NO: 313515 - protein, 9 aa, Influenza virus
ACLRGGRNS

SEQ ID NO: 313516 - protein, 9 aa, Influenza virus
CLRGGRNSF

SEQ ID NO: 313517 - protein, 9 aa, Influenza virus
LRGGRNSFF

SEQ ID NO: 313518 - protein, 9 aa, Influenza virus
RGGRNSFFS

SEQ ID NO: 313519 - protein, 9 aa, Influenza virus
GGRNSFFSR

SEQ ID NO: 313520 - protein, 9 aa, Influenza virus
GRNSFFSRL

SEQ ID NO: 313521 - protein, 9 aa, Influenza virus
RNSFFSRLN

SEQ ID NO: 313522 - protein, 9 aa, Influenza virus
NSFFSRLNW

SEQ ID NO: 313523 - protein, 9 aa, Influenza virus
SFFSRLNWL

SEQ ID NO: 313524 - protein, 9 aa, Influenza virus
FFSRLNWLT

SEQ ID NO: 313525 - protein, 9 aa, Influenza virus
FSRLNWLTK

SEQ ID NO: 313526 - protein, 9 aa, Influenza virus
SRLNWLTKA

SEQ ID NO: 313527 - protein, 9 aa, Influenza virus
RLNWLTKAT

SEQ ID NO: 313528 - protein, 9 aa, Influenza virus
LNWLTKATN

SEQ ID NO: 313529 - protein, 9 aa, Influenza virus
NWLTKATNG

SEQ ID NO: 313530 - protein, 9 aa, Influenza virus
WLTKATNGN

SEQ ID NO: 313531 - protein, 9 aa, Influenza virus
LTKATNGNY

SEQ ID NO: 313532 - protein, 9 aa, Influenza virus
TKATNGNYG

SEQ ID NO: 313533 - protein, 9 aa, Influenza virus
KATNGNYGP

SEQ ID NO: 313534 - protein, 9 aa, Influenza virus
ATNGNYGPI

SEQ ID NO: 313535 - protein, 9 aa, Influenza virus
TNGNYGPIN

SEQ ID NO: 313536 - protein, 9 aa, Influenza virus
NGNYGPINV

SEQ ID NO: 313537 - protein, 9 aa, Influenza virus
GNYGPINVT

SEQ ID NO: 313538 - protein, 9 aa, Influenza virus
NYGPINVTK

SEQ ID NO: 313539 - protein, 9 aa, Influenza virus
YGPINVTKE

SEQ ID NO: 313540 - protein, 9 aa, Influenza virus
GPINVTKEN

SEQ ID NO: 313541 - protein, 9 aa, Influenza virus
PINVTKENT

SEQ ID NO: 313542 - protein, 9 aa, Influenza virus
INVTKENTG

SEQ ID NO: 313543 - protein, 9 aa, Influenza virus
NVTKENTGS

SEQ ID NO: 313544 - protein, 9 aa, Influenza virus
VTKENTGSY

SEQ ID NO: 313545 - protein, 9 aa, Influenza virus
TKENTGSYV

SEQ ID NO: 313546 - protein, 9 aa, Influenza virus
KENTGSYVR

SEQ ID NO: 313547 - protein, 9 aa, Influenza virus
ENTGSYVRL

SEQ ID NO: 313548 - protein, 9 aa, Influenza virus
NTGSYVRLY

SEQ ID NO: 313549 - protein, 9 aa, Influenza virus
TGSYVRLYL

SEQ ID NO: 313550 - protein, 9 aa, Influenza virus
GSYVRLYLW

SEQ ID NO: 313551 - protein, 9 aa, Influenza virus
SYVRLYLWG

SEQ ID NO: 313552 - protein, 9 aa, Influenza virus
YVRLYLWGV

SEQ ID NO: 313553 - protein, 9 aa, Influenza virus
VRLYLWGVH

SEQ ID NO: 313554 - protein, 9 aa, Influenza virus
RLYLWGVHH

SEQ ID NO: 313555 - protein, 9 aa, Influenza virus
LYLWGVHHP

SEQ ID NO: 313556 - protein, 9 aa, Influenza virus
YLWGVHHPS

SEQ ID NO: 313557 - protein, 9 aa, Influenza virus
LWGVHHPSS

SEQ ID NO: 313558 - protein, 9 aa, Influenza virus
WGVHHPSSD

SEQ ID NO: 313559 - protein, 9 aa, Influenza virus
GVHHPSSDN

SEQ ID NO: 313560 - protein, 9 aa, Influenza virus
VHHPSSDNE

SEQ ID NO: 313561 - protein, 9 aa, Influenza virus
HHPSSDNEQ

SEQ ID NO: 313562 - protein, 9 aa, Influenza virus
HPSSDNEQT

SEQ ID NO: 313563 - protein, 9 aa, Influenza virus
PSSDNEQTD

SEQ ID NO: 313564 - protein, 9 aa, Influenza virus
SSDNEQTDL

SEQ ID NO: 313565 - protein, 9 aa, Influenza virus
SDNEQTDLY

SEQ ID NO: 313566 - protein, 9 aa, Influenza virus
DNEQTDLYK

SEQ ID NO: 313567 - protein, 9 aa, Influenza virus
NEQTDLYKV

SEQ ID NO: 313568 - protein, 9 aa, Influenza virus
EQTDLYKVA

SEQ ID NO: 313569 - protein, 9 aa, Influenza virus
QTDLYKVAT

SEQ ID NO: 313570 - protein, 9 aa, Influenza virus
TDLYKVATG

SEQ ID NO: 313571 - protein, 9 aa, Influenza virus
DLYKVATGR

SEQ ID NO: 313572 - protein, 9 aa, Influenza virus
LYKVATGRV

SEQ ID NO: 313573 - protein, 9 aa, Influenza virus
YKVATGRVT

SEQ ID NO: 313574 - protein, 9 aa, Influenza virus
KVATGRVTV

SEQ ID NO: 313575 - protein, 9 aa, Influenza virus
VATGRVTVS

SEQ ID NO: 313576 - protein, 9 aa, Influenza virus
ATGRVTVST

SEQ ID NO: 313577 - protein, 9 aa, Influenza virus
TGRVTVSTR

SEQ ID NO: 313578 - protein, 9 aa, Influenza virus
GRVTVSTRS

SEQ ID NO: 313579 - protein, 9 aa, Influenza virus
RVTVSTRSD

SEQ ID NO: 313580 - protein, 9 aa, Influenza virus
VTVSTRSDQ

SEQ ID NO: 313581 - protein, 9 aa, Influenza virus
TVSTRSDQI

SEQ ID NO: 313582 - protein, 9 aa, Influenza virus
VSTRSDQIS

SEQ ID NO: 313583 - protein, 9 aa, Influenza virus
STRSDQISI

SEQ ID NO: 313584 - protein, 9 aa, Influenza virus
TRSDQISIV

SEQ ID NO: 313585 - protein, 9 aa, Influenza virus
RSDQISIVP

SEQ ID NO: 313586 - protein, 9 aa, Influenza virus
SDQISIVPN

SEQ ID NO: 313587 - protein, 9 aa, Influenza virus
DQISIVPNI

SEQ ID NO: 313588 - protein, 9 aa, Influenza virus
QISIVPNIG

SEQ ID NO: 313589 - protein, 9 aa, Influenza virus
ISIVPNIGS

SEQ ID NO: 313590 - protein, 9 aa, Influenza virus
SIVPNIGSR

SEQ ID NO: 313591 - protein, 9 aa, Influenza virus
IVPNIGSRP

SEQ ID NO: 313592 - protein, 9 aa, Influenza virus
VPNIGSRPR

SEQ ID NO: 313593 - protein, 9 aa, Influenza virus
PNIGSRPRV

SEQ ID NO: 313594 - protein, 9 aa, Influenza virus
NIGSRPRVR

SEQ ID NO: 313595 - protein, 9 aa, Influenza virus
IGSRPRVRN

SEQ ID NO: 313596 - protein, 9 aa, Influenza virus
GSRPRVRNQ

SEQ ID NO: 313597 - protein, 9 aa, Influenza virus
SRPRVRNQS

SEQ ID NO: 313598 - protein, 9 aa, Influenza virus
RPRVRNQSG

SEQ ID NO: 313599 - protein, 9 aa, Influenza virus
PRVRNQSGR

SEQ ID NO: 313600 - protein, 9 aa, Influenza virus
RVRNQSGRI

SEQ ID NO: 313601 - protein, 9 aa, Influenza virus
VRNQSGRIS

SEQ ID NO: 313602 - protein, 9 aa, Influenza virus
RNQSGRISI

SEQ ID NO: 313603 - protein, 9 aa, Influenza virus
NQSGRISIY

SEQ ID NO: 313604 - protein, 9 aa, Influenza virus
QSGRISIYW

SEQ ID NO: 313605 - protein, 9 aa, Influenza virus
SGRISIYWT

SEQ ID NO: 313606 - protein, 9 aa, Influenza virus
GRISIYWTL

SEQ ID NO: 313607 - protein, 9 aa, Influenza virus
RISIYWTLV

SEQ ID NO: 313608 - protein, 9 aa, Influenza virus
ISIYWTLVN

SEQ ID NO: 313609 - protein, 9 aa, Influenza virus
SIYWTLVNP

SEQ ID NO: 313610 - protein, 9 aa, Influenza virus
IYWTLVNPG

SEQ ID NO: 313611 - protein, 9 aa, Influenza virus
YWTLVNPGD

SEQ ID NO: 313612 - protein, 9 aa, Influenza virus
WTLVNPGDS

SEQ ID NO: 313613 - protein, 9 aa, Influenza virus
TLVNPGDSI

SEQ ID NO: 313614 - protein, 9 aa, Influenza virus
LVNPGDSII

SEQ ID NO: 313615 - protein, 9 aa, Influenza virus
VNPGDSIIF

SEQ ID NO: 313616 - protein, 9 aa, Influenza virus
NPGDSIIFN

SEQ ID NO: 313617 - protein, 9 aa, Influenza virus
PGDSIIFNS

SEQ ID NO: 313618 - protein, 9 aa, Influenza virus
GDSIIFNSI

SEQ ID NO: 313619 - protein, 9 aa, Influenza virus
DSIIFNSIG

SEQ ID NO: 313620 - protein, 9 aa, Influenza virus
SIIFNSIGN

SEQ ID NO: 313621 - protein, 9 aa, Influenza virus
IIFNSIGNL

SEQ ID NO: 313622 - protein, 9 aa, Influenza virus
IFNSIGNLI

SEQ ID NO: 313623 - protein, 9 aa, Influenza virus
FNSIGNLIA

SEQ ID NO: 313624 - protein, 9 aa, Influenza virus
NSIGNLIAP

SEQ ID NO: 313625 - protein, 9 aa, Influenza virus
SIGNLIAPR

SEQ ID NO: 313626 - protein, 9 aa, Influenza virus
IGNLIAPRG

SEQ ID NO: 313627 - protein, 9 aa, Influenza virus
GNLIAPRGH

SEQ ID NO: 313628 - protein, 9 aa, Influenza virus
NLIAPRGHY

SEQ ID NO: 313629 - protein, 9 aa, Influenza virus
LIAPRGHYK

SEQ ID NO: 313630 - protein, 9 aa, Influenza virus
IAPRGHYKI

SEQ ID NO: 313631 - protein, 9 aa, Influenza virus
APRGHYKIS

SEQ ID NO: 313632 - protein, 9 aa, Influenza virus
PRGHYKISK

SEQ ID NO: 313633 - protein, 9 aa, Influenza virus
RGHYKISKS

SEQ ID NO: 313634 - protein, 9 aa, Influenza virus
GHYKISKST

SEQ ID NO: 313635 - protein, 9 aa, Influenza virus
HYKISKSTK

SEQ ID NO: 313636 - protein, 9 aa, Influenza virus
YKISKSTKS

SEQ ID NO: 313637 - protein, 9 aa, Influenza virus
KISKSTKST

SEQ ID NO: 313638 - protein, 9 aa, Influenza virus
ISKSTKSTV

SEQ ID NO: 313639 - protein, 9 aa, Influenza virus
SKSTKSTVL

SEQ ID NO: 313640 - protein, 9 aa, Influenza virus
KSTKSTVLK

SEQ ID NO: 313641 - protein, 9 aa, Influenza virus
STKSTVLKS

SEQ ID NO: 313642 - protein, 9 aa, Influenza virus
TKSTVLKSD

SEQ ID NO: 313643 - protein, 9 aa, Influenza virus
KSTVLKSDK

SEQ ID NO: 313644 - protein, 9 aa, Influenza virus
STVLKSDKR

SEQ ID NO: 313645 - protein, 9 aa, Influenza virus
TVLKSDKRI

SEQ ID NO: 313646 - protein, 9 aa, Influenza virus
VLKSDKRIG

SEQ ID NO: 313647 - protein, 9 aa, Influenza virus
LKSDKRIGS

SEQ ID NO: 313648 - protein, 9 aa, Influenza virus
KSDKRIGSC

SEQ ID NO: 313649 - protein, 9 aa, Influenza virus
SDKRIGSCT

SEQ ID NO: 313650 - protein, 9 aa, Influenza virus
DKRIGSCTS

SEQ ID NO: 313651 - protein, 9 aa, Influenza virus
KRIGSCTSP

SEQ ID NO: 313652 - protein, 9 aa, Influenza virus
RIGSCTSPC

SEQ ID NO: 313653 - protein, 9 aa, Influenza virus
IGSCTSPCL

SEQ ID NO: 313654 - protein, 9 aa, Influenza virus
GSCTSPCLT

SEQ ID NO: 313655 - protein, 9 aa, Influenza virus
SCTSPCLTD

SEQ ID NO: 313656 - protein, 9 aa, Influenza virus
CTSPCLTDK

SEQ ID NO: 313657 - protein, 9 aa, Influenza virus
TSPCLTDKG

SEQ ID NO: 313658 - protein, 9 aa, Influenza virus
SPCLTDKGS

SEQ ID NO: 313659 - protein, 9 aa, Influenza virus
PCLTDKGSI

SEQ ID NO: 313660 - protein, 9 aa, Influenza virus
CLTDKGSIQ

SEQ ID NO: 313661 - protein, 9 aa, Influenza virus
LTDKGSIQS

SEQ ID NO: 313662 - protein, 9 aa, Influenza virus
TDKGSIQSD

SEQ ID NO: 313663 - protein, 9 aa, Influenza virus
DKGSIQSDK

SEQ ID NO: 313664 - protein, 9 aa, Influenza virus
KGSIQSDKP

SEQ ID NO: 313665 - protein, 9 aa, Influenza virus
GSIQSDKPF

SEQ ID NO: 313666 - protein, 9 aa, Influenza virus
SIQSDKPFQ

SEQ ID NO: 313667 - protein, 9 aa, Influenza virus
IQSDKPFQN

SEQ ID NO: 313668 - protein, 9 aa, Influenza virus
QSDKPFQNV

SEQ ID NO: 313669 - protein, 9 aa, Influenza virus
SDKPFQNVS

SEQ ID NO: 313670 - protein, 9 aa, Influenza virus
DKPFQNVSR

SEQ ID NO: 313671 - protein, 9 aa, Influenza virus
KPFQNVSRI

SEQ ID NO: 313672 - protein, 9 aa, Influenza virus
PFQNVSRIA

SEQ ID NO: 313673 - protein, 9 aa, Influenza virus
FQNVSRIAI

SEQ ID NO: 313674 - protein, 9 aa, Influenza virus
QNVSRIAIG

SEQ ID NO: 313675 - protein, 9 aa, Influenza virus
NVSRIAIGN

SEQ ID NO: 313676 - protein, 9 aa, Influenza virus
VSRIAIGNC

SEQ ID NO: 313677 - protein, 9 aa, Influenza virus
SRIAIGNCP

SEQ ID NO: 313678 - protein, 9 aa, Influenza virus
RIAIGNCPK

SEQ ID NO: 313679 - protein, 9 aa, Influenza virus
IAIGNCPKY

SEQ ID NO: 313680 - protein, 9 aa, Influenza virus
AIGNCPKYV

SEQ ID NO: 313681 - protein, 9 aa, Influenza virus
IGNCPKYVK

SEQ ID NO: 313682 - protein, 9 aa, Influenza virus
GNCPKYVKQ

SEQ ID NO: 313683 - protein, 9 aa, Influenza virus
NCPKYVKQG

SEQ ID NO: 313684 - protein, 9 aa, Influenza virus
CPKYVKQGS

SEQ ID NO: 313685 - protein, 9 aa, Influenza virus
PKYVKQGSL

SEQ ID NO: 313686 - protein, 9 aa, Influenza virus
KYVKQGSLM

SEQ ID NO: 313687 - protein, 9 aa, Influenza virus
YVKQGSLML

SEQ ID NO: 313688 - protein, 9 aa, Influenza virus
VKQGSLMLA

SEQ ID NO: 313689 - protein, 9 aa, Influenza virus
KQGSLMLAT

SEQ ID NO: 313690 - protein, 9 aa, Influenza virus
QGSLMLATG

SEQ ID NO: 313691 - protein, 9 aa, Influenza virus
GSLMLATGM

SEQ ID NO: 313692 - protein, 9 aa, Influenza virus
SLMLATGMR

SEQ ID NO: 313693 - protein, 9 aa, Influenza virus
LMLATGMRN

SEQ ID NO: 313694 - protein, 9 aa, Influenza virus
MLATGMRNI

SEQ ID NO: 313695 - protein, 9 aa, Influenza virus
LATGMRNIP

SEQ ID NO: 313696 - protein, 9 aa, Influenza virus
ATGMRNIPG

SEQ ID NO: 313697 - protein, 9 aa, Influenza virus
TGMRNIPGK

SEQ ID NO: 313698 - protein, 9 aa, Influenza virus
GMRNIPGKQ

SEQ ID NO: 313699 - protein, 9 aa, Influenza virus
MRNIPGKQA

SEQ ID NO: 313700 - protein, 9 aa, Influenza virus
RNIPGKQAK

SEQ ID NO: 313701 - protein, 9 aa, Influenza virus
NIPGKQAKG

SEQ ID NO: 313702 - protein, 9 aa, Influenza virus
IPGKQAKGL

SEQ ID NO: 313703 - protein, 9 aa, Influenza virus
PGKQAKGLF

SEQ ID NO: 313704 - protein, 9 aa, Influenza virus
GKQAKGLFG

SEQ ID NO: 313705 - protein, 9 aa, Influenza virus
KQAKGLFGA

SEQ ID NO: 313706 - protein, 9 aa, Influenza virus
QAKGLFGAI

SEQ ID NO: 313707 - protein, 9 aa, Influenza virus
AKGLFGAIA

SEQ ID NO: 313708 - protein, 9 aa, Influenza virus
KGLFGAIAG

SEQ ID NO: 313709 - protein, 9 aa, Influenza virus
GLFGAIAGF

SEQ ID NO: 313710 - protein, 9 aa, Influenza virus
LFGAIAGFI

SEQ ID NO: 313711 - protein, 9 aa, Influenza virus
FGAIAGFIE

SEQ ID NO: 313712 - protein, 9 aa, Influenza virus
GAIAGFIEN

SEQ ID NO: 313713 - protein, 9 aa, Influenza virus
AIAGFIENG

SEQ ID NO: 313714 - protein, 9 aa, Influenza virus
IAGFIENGW

SEQ ID NO: 313715 - protein, 9 aa, Influenza virus
AGFIENGWQ

SEQ ID NO: 313716 - protein, 9 aa, Influenza virus
GFIENGWQG

SEQ ID NO: 313717 - protein, 9 aa, Influenza virus
FIENGWQGL

SEQ ID NO: 313718 - protein, 9 aa, Influenza virus
IENGWQGLI

SEQ ID NO: 313719 - protein, 9 aa, Influenza virus
ENGWQGLID

SEQ ID NO: 313720 - protein, 9 aa, Influenza virus
NGWQGLIDG

SEQ ID NO: 313721 - protein, 9 aa, Influenza virus
GWQGLIDGW

SEQ ID NO: 313722 - protein, 9 aa, Influenza virus
WQGLIDGWY

SEQ ID NO: 313723 - protein, 9 aa, Influenza virus
QGLIDGWYG

SEQ ID NO: 313724 - protein, 9 aa, Influenza virus
GLIDGWYGF

SEQ ID NO: 313725 - protein, 9 aa, Influenza virus
LIDGWYGFR

SEQ ID NO: 313726 - protein, 9 aa, Influenza virus
IDGWYGFRH

SEQ ID NO: 313727 - protein, 9 aa, Influenza virus
DGWYGFRHQ

SEQ ID NO: 313728 - protein, 9 aa, Influenza virus
GWYGFRHQN

SEQ ID NO: 313729 - protein, 9 aa, Influenza virus
WYGFRHQNA

SEQ ID NO: 313730 - protein, 9 aa, Influenza virus
YGFRHQNAE

SEQ ID NO: 313731 - protein, 9 aa, Influenza virus
GFRHQNAEG

SEQ ID NO: 313732 - protein, 9 aa, Influenza virus
FRHQNAEGT

SEQ ID NO: 313733 - protein, 9 aa, Influenza virus
RHQNAEGTG

SEQ ID NO: 313734 - protein, 9 aa, Influenza virus
HQNAEGTGT

SEQ ID NO: 313735 - protein, 9 aa, Influenza virus
QNAEGTGTA

SEQ ID NO: 313736 - protein, 9 aa, Influenza virus
NAEGTGTAA

SEQ ID NO: 313737 - protein, 9 aa, Influenza virus
AEGTGTAAD

SEQ ID NO: 313738 - protein, 9 aa, Influenza virus
EGTGTAADL

SEQ ID NO: 313739 - protein, 9 aa, Influenza virus
GTGTAADLK

SEQ ID NO: 313740 - protein, 9 aa, Influenza virus
TGTAADLKS

SEQ ID NO: 313741 - protein, 9 aa, Influenza virus
GTAADLKST

SEQ ID NO: 313742 - protein, 9 aa, Influenza virus
TAADLKSTQ

SEQ ID NO: 313743 - protein, 9 aa, Influenza virus
AADLKSTQA

SEQ ID NO: 313744 - protein, 9 aa, Influenza virus
ADLKSTQAA

SEQ ID NO: 313745 - protein, 9 aa, Influenza virus
DLKSTQAAI

SEQ ID NO: 313746 - protein, 9 aa, Influenza virus
LKSTQAAID

SEQ ID NO: 313747 - protein, 9 aa, Influenza virus
KSTQAAIDQ

SEQ ID NO: 313748 - protein, 9 aa, Influenza virus
STQAAIDQI

SEQ ID NO: 313749 - protein, 9 aa, Influenza virus
TQAAIDQIN

SEQ ID NO: 313750 - protein, 9 aa, Influenza virus
QAAIDQING

SEQ ID NO: 313751 - protein, 9 aa, Influenza virus
AAIDQINGK

SEQ ID NO: 313752 - protein, 9 aa, Influenza virus
AIDQINGKL

SEQ ID NO: 313753 - protein, 9 aa, Influenza virus
IDQINGKLN

SEQ ID NO: 313754 - protein, 9 aa, Influenza virus
DQINGKLNR

SEQ ID NO: 313755 - protein, 9 aa, Influenza virus
QINGKLNRL

SEQ ID NO: 313756 - protein, 9 aa, Influenza virus
INGKLNRLI

SEQ ID NO: 313757 - protein, 9 aa, Influenza virus
NGKLNRLIE

SEQ ID NO: 313758 - protein, 9 aa, Influenza virus
GKLNRLIEK

SEQ ID NO: 313759 - protein, 9 aa, Influenza virus
KLNRLIEKT

SEQ ID NO: 313760 - protein, 9 aa, Influenza virus
LNRLIEKTN

SEQ ID NO: 313761 - protein, 9 aa, Influenza virus
NRLIEKTNE

SEQ ID NO: 313762 - protein, 9 aa, Influenza virus
RLIEKTNEK

SEQ ID NO: 313763 - protein, 9 aa, Influenza virus
LIEKTNEKY

SEQ ID NO: 313764 - protein, 9 aa, Influenza virus
IEKTNEKYH

SEQ ID NO: 313765 - protein, 9 aa, Influenza virus
EKTNEKYHQ

SEQ ID NO: 313766 - protein, 9 aa, Influenza virus
KTNEKYHQI

SEQ ID NO: 313767 - protein, 9 aa, Influenza virus
TNEKYHQIE

SEQ ID NO: 313768 - protein, 9 aa, Influenza virus
NEKYHQIEK

SEQ ID NO: 313769 - protein, 9 aa, Influenza virus
EKYHQIEKE

SEQ ID NO: 313770 - protein, 9 aa, Influenza virus
KYHQIEKEF

SEQ ID NO: 313771 - protein, 9 aa, Influenza virus
YHQIEKEFE

SEQ ID NO: 313772 - protein, 9 aa, Influenza virus
HQIEKEFEQ

SEQ ID NO: 313773 - protein, 9 aa, Influenza virus
QIEKEFEQV

SEQ ID NO: 313774 - protein, 9 aa, Influenza virus
IEKEFEQVE

SEQ ID NO: 313775 - protein, 9 aa, Influenza virus
EKEFEQVEG

SEQ ID NO: 313776 - protein, 9 aa, Influenza virus
KEFEQVEGR

SEQ ID NO: 313777 - protein, 9 aa, Influenza virus
EFEQVEGRI

SEQ ID NO: 313778 - protein, 9 aa, Influenza virus
FEQVEGRIQ

SEQ ID NO: 313779 - protein, 9 aa, Influenza virus
EQVEGRIQD

SEQ ID NO: 313780 - protein, 9 aa, Influenza virus
QVEGRIQDL

SEQ ID NO: 313781 - protein, 9 aa, Influenza virus
VEGRIQDLE

SEQ ID NO: 313782 - protein, 9 aa, Influenza virus
EGRIQDLEK

SEQ ID NO: 313783 - protein, 9 aa, Influenza virus
GRIQDLEKY

SEQ ID NO: 313784 - protein, 9 aa, Influenza virus
RIQDLEKYV

SEQ ID NO: 313785 - protein, 9 aa, Influenza virus
IQDLEKYVE

SEQ ID NO: 313786 - protein, 9 aa, Influenza virus
QDLEKYVED

SEQ ID NO: 313787 - protein, 9 aa, Influenza virus
DLEKYVEDT

SEQ ID NO: 313788 - protein, 9 aa, Influenza virus
LEKYVEDTK

SEQ ID NO: 313789 - protein, 9 aa, Influenza virus
EKYVEDTKI

SEQ ID NO: 313790 - protein, 9 aa, Influenza virus
KYVEDTKID

SEQ ID NO: 313791 - protein, 9 aa, Influenza virus
YVEDTKIDL

SEQ ID NO: 313792 - protein, 9 aa, Influenza virus
VEDTKIDLW

SEQ ID NO: 313793 - protein, 9 aa, Influenza virus
EDTKIDLWS

SEQ ID NO: 313794 - protein, 9 aa, Influenza virus
DTKIDLWSY

SEQ ID NO: 313795 - protein, 9 aa, Influenza virus
TKIDLWSYN

SEQ ID NO: 313796 - protein, 9 aa, Influenza virus
KIDLWSYNA

SEQ ID NO: 313797 - protein, 9 aa, Influenza virus
IDLWSYNAE

SEQ ID NO: 313798 - protein, 9 aa, Influenza virus
DLWSYNAEL

SEQ ID NO: 313799 - protein, 9 aa, Influenza virus
LWSYNAELL

SEQ ID NO: 313800 - protein, 9 aa, Influenza virus
WSYNAELLV

SEQ ID NO: 313801 - protein, 9 aa, Influenza virus
SYNAELLVA

SEQ ID NO: 313802 - protein, 9 aa, Influenza virus
YNAELLVAL

SEQ ID NO: 313803 - protein, 9 aa, Influenza virus
NAELLVALE

SEQ ID NO: 313804 - protein, 9 aa, Influenza virus
AELLVALEN

SEQ ID NO: 313805 - protein, 9 aa, Influenza virus
ELLVALENQ

SEQ ID NO: 313806 - protein, 9 aa, Influenza virus
LLVALENQH

SEQ ID NO: 313807 - protein, 9 aa, Influenza virus
LVALENQHT

SEQ ID NO: 313808 - protein, 9 aa, Influenza virus
VALENQHTI

SEQ ID NO: 313809 - protein, 9 aa, Influenza virus
ALENQHTID

SEQ ID NO: 313810 - protein, 9 aa, Influenza virus
LENQHTIDV

SEQ ID NO: 313811 - protein, 9 aa, Influenza virus
ENQHTIDVT

SEQ ID NO: 313812 - protein, 9 aa, Influenza virus
NQHTIDVTD

SEQ ID NO: 313813 - protein, 9 aa, Influenza virus
QHTIDVTDS

SEQ ID NO: 313814 - protein, 9 aa, Influenza virus
HTIDVTDSE

SEQ ID NO: 313815 - protein, 9 aa, Influenza virus
TIDVTDSEM

SEQ ID NO: 313816 - protein, 9 aa, Influenza virus
IDVTDSEMN

SEQ ID NO: 313817 - protein, 9 aa, Influenza virus
DVTDSEMNK

SEQ ID NO: 313818 - protein, 9 aa, Influenza virus
VTDSEMNKL

SEQ ID NO: 313819 - protein, 9 aa, Influenza virus
TDSEMNKLF

SEQ ID NO: 313820 - protein, 9 aa, Influenza virus
DSEMNKLFE

SEQ ID NO: 313821 - protein, 9 aa, Influenza virus
SEMNKLFER

SEQ ID NO: 313822 - protein, 9 aa, Influenza virus
EMNKLFERV

SEQ ID NO: 313823 - protein, 9 aa, Influenza virus
MNKLFERVR

SEQ ID NO: 313824 - protein, 9 aa, Influenza virus
NKLFERVRR

SEQ ID NO: 313825 - protein, 9 aa, Influenza virus
KLFERVRRQ

SEQ ID NO: 313826 - protein, 9 aa, Influenza virus
LFERVRRQL

SEQ ID NO: 313827 - protein, 9 aa, Influenza virus
FERVRRQLR

SEQ ID NO: 313828 - protein, 9 aa, Influenza virus
ERVRRQLRE

SEQ ID NO: 313829 - protein, 9 aa, Influenza virus
RVRRQLREN

SEQ ID NO: 313830 - protein, 9 aa, Influenza virus
VRRQLRENA

SEQ ID NO: 313831 - protein, 9 aa, Influenza virus
RRQLRENAE

SEQ ID NO: 313832 - protein, 9 aa, Influenza virus
RQLRENAED

SEQ ID NO: 313833 - protein, 9 aa, Influenza virus
QLRENAEDQ

SEQ ID NO: 313834 - protein, 9 aa, Influenza virus
LRENAEDQG

SEQ ID NO: 313835 - protein, 9 aa, Influenza virus
RENAEDQGN

SEQ ID NO: 313836 - protein, 9 aa, Influenza virus
ENAEDQGNG

SEQ ID NO: 313837 - protein, 9 aa, Influenza virus
NAEDQGNGC

SEQ ID NO: 313838 - protein, 9 aa, Influenza virus
AEDQGNGCF

SEQ ID NO: 313839 - protein, 9 aa, Influenza virus
EDQGNGCFE

SEQ ID NO: 313840 - protein, 9 aa, Influenza virus
DQGNGCFEI

SEQ ID NO: 313841 - protein, 9 aa, Influenza virus
QGNGCFEIF

SEQ ID NO: 313842 - protein, 9 aa, Influenza virus
GNGCFEIFH

SEQ ID NO: 313843 - protein, 9 aa, Influenza virus
NGCFEIFHQ

SEQ ID NO: 313844 - protein, 9 aa, Influenza virus
GCFEIFHQC

SEQ ID NO: 313845 - protein, 9 aa, Influenza virus
CFEIFHQCD

SEQ ID NO: 313846 - protein, 9 aa, Influenza virus
FEIFHQCDN

SEQ ID NO: 313847 - protein, 9 aa, Influenza virus
EIFHQCDNN

SEQ ID NO: 313848 - protein, 9 aa, Influenza virus
IFHQCDNNC

SEQ ID NO: 313849 - protein, 9 aa, Influenza virus
FHQCDNNCI

SEQ ID NO: 313850 - protein, 9 aa, Influenza virus
HQCDNNCIE

SEQ ID NO: 313851 - protein, 9 aa, Influenza virus
QCDNNCIES

SEQ ID NO: 313852 - protein, 9 aa, Influenza virus
CDNNCIESI

SEQ ID NO: 313853 - protein, 9 aa, Influenza virus
DNNCIESIR

SEQ ID NO: 313854 - protein, 9 aa, Influenza virus
NNCIESIRN

SEQ ID NO: 313855 - protein, 9 aa, Influenza virus
NCIESIRNG

SEQ ID NO: 313856 - protein, 9 aa, Influenza virus
CIESIRNGT

SEQ ID NO: 313857 - protein, 9 aa, Influenza virus
IESIRNGTY

SEQ ID NO: 313858 - protein, 9 aa, Influenza virus
ESIRNGTYD

SEQ ID NO: 313859 - protein, 9 aa, Influenza virus
SIRNGTYDH

SEQ ID NO: 313860 - protein, 9 aa, Influenza virus
IRNGTYDHN

SEQ ID NO: 313861 - protein, 9 aa, Influenza virus
RNGTYDHNI

SEQ ID NO: 313862 - protein, 9 aa, Influenza virus
NGTYDHNIY

SEQ ID NO: 313863 - protein, 9 aa, Influenza virus
GTYDHNIYR

SEQ ID NO: 313864 - protein, 9 aa, Influenza virus
TYDHNIYRD

SEQ ID NO: 313865 - protein, 9 aa, Influenza virus
YDHNIYRDE

SEQ ID NO: 313866 - protein, 9 aa, Influenza virus
DHNIYRDEA

SEQ ID NO: 313867 - protein, 9 aa, Influenza virus
HNIYRDEAI

SEQ ID NO: 313868 - protein, 9 aa, Influenza virus
NIYRDEAIN

SEQ ID NO: 313869 - protein, 9 aa, Influenza virus
IYRDEAINN

SEQ ID NO: 313870 - protein, 9 aa, Influenza virus
YRDEAINNR

SEQ ID NO: 313871 - protein, 9 aa, Influenza virus
RDEAINNRI

SEQ ID NO: 313872 - protein, 9 aa, Influenza virus
DEAINNRIK

SEQ ID NO: 313873 - protein, 9 aa, Influenza virus
EAINNRIKI

SEQ ID NO: 313874 - protein, 9 aa, Influenza virus
AINNRIKIN

SEQ ID NO: 313875 - protein, 9 aa, Influenza virus
INNRIKINP

SEQ ID NO: 313876 - protein, 9 aa, Influenza virus
NNRIKINPV

SEQ ID NO: 313877 - protein, 9 aa, Influenza virus
NRIKINPVT

SEQ ID NO: 313878 - protein, 9 aa, Influenza virus
RIKINPVTL

SEQ ID NO: 313879 - protein, 9 aa, Influenza virus
IKINPVTLT

SEQ ID NO: 313880 - protein, 9 aa, Influenza virus
KINPVTLTM

SEQ ID NO: 313881 - protein, 9 aa, Influenza virus
INPVTLTMG

SEQ ID NO: 313882 - protein, 9 aa, Influenza virus
NPVTLTMGY

SEQ ID NO: 313883 - protein, 9 aa, Influenza virus
PVTLTMGYK

SEQ ID NO: 313884 - protein, 9 aa, Influenza virus
VTLTMGYKD

SEQ ID NO: 313885 - protein, 9 aa, Influenza virus
TLTMGYKDI

SEQ ID NO: 313886 - protein, 9 aa, Influenza virus
LTMGYKDII

SEQ ID NO: 313887 - protein, 9 aa, Influenza virus
TMGYKDIIL

SEQ ID NO: 313888 - protein, 9 aa, Influenza virus
MGYKDIILW

SEQ ID NO: 313889 - protein, 9 aa, Influenza virus
GYKDIILWI

SEQ ID NO: 313890 - protein, 9 aa, Influenza virus
YKDIILWIS

SEQ ID NO: 313891 - protein, 9 aa, Influenza virus
KDIILWISF

SEQ ID NO: 313892 - protein, 9 aa, Influenza virus
DIILWISFS

SEQ ID NO: 313893 - protein, 9 aa, Influenza virus
IILWISFSM

SEQ ID NO: 313894 - protein, 9 aa, Influenza virus
ILWISFSMS

SEQ ID NO: 313895 - protein, 9 aa, Influenza virus
LWISFSMSC

SEQ ID NO: 313896 - protein, 9 aa, Influenza virus
WISFSMSCF

SEQ ID NO: 313897 - protein, 9 aa, Influenza virus
ISFSMSCFV

SEQ ID NO: 313898 - protein, 9 aa, Influenza virus
SFSMSCFVF

SEQ ID NO: 313899 - protein, 9 aa, Influenza virus
FSMSCFVFV

SEQ ID NO: 313900 - protein, 9 aa, Influenza virus
SMSCFVFVA

SEQ ID NO: 313901 - protein, 9 aa, Influenza virus
MSCFVFVAL

SEQ ID NO: 313902 - protein, 9 aa, Influenza virus
SCFVFVALI

SEQ ID NO: 313903 - protein, 9 aa, Influenza virus
CFVFVALIL

SEQ ID NO: 313904 - protein, 9 aa, Influenza virus
FVFVALILG

SEQ ID NO: 313905 - protein, 9 aa, Influenza virus
VFVALILGF

SEQ ID NO: 313906 - protein, 9 aa, Influenza virus
FVALILGFV

SEQ ID NO: 313907 - protein, 9 aa, Influenza virus
VALILGFVL

SEQ ID NO: 313908 - protein, 9 aa, Influenza virus
ALILGFVLW

SEQ ID NO: 313909 - protein, 9 aa, Influenza virus
LILGFVLWA

SEQ ID NO: 313910 - protein, 9 aa, Influenza virus
ILGFVLWAC

SEQ ID NO: 313911 - protein, 9 aa, Influenza virus
LGFVLWACQ

SEQ ID NO: 313912 - protein, 9 aa, Influenza virus
GFVLWACQN

SEQ ID NO: 313913 - protein, 9 aa, Influenza virus
FVLWACQNG

SEQ ID NO: 313914 - protein, 9 aa, Influenza virus
VLWACQNGN

SEQ ID NO: 313915 - protein, 9 aa, Influenza virus
LWACQNGNI

SEQ ID NO: 313916 - protein, 9 aa, Influenza virus
WACQNGNIR

SEQ ID NO: 313917 - protein, 9 aa, Influenza virus
ACQNGNIRC

SEQ ID NO: 313918 - protein, 9 aa, Influenza virus
CQNGNIRCQ

SEQ ID NO: 313919 - protein, 9 aa, Influenza virus
QNGNIRCQI

SEQ ID NO: 313920 - protein, 9 aa, Influenza virus
NGNIRCQIC

SEQ ID NO: 313921 - protein, 9 aa, Influenza virus
GNIRCQICI

SEQ ID NO: 313922 - protein, 9 aa, Influenza virus
MNTQIIVIL

SEQ ID NO: 313923 - protein, 9 aa, Influenza virus
NTQIIVILV

SEQ ID NO: 313924 - protein, 9 aa, Influenza virus
TQIIVILVL

SEQ ID NO: 313925 - protein, 9 aa, Influenza virus
QIIVILVLG

SEQ ID NO: 313926 - protein, 9 aa, Influenza virus
IIVILVLGL

SEQ ID NO: 313927 - protein, 9 aa, Influenza virus
IVILVLGLS

SEQ ID NO: 313928 - protein, 9 aa, Influenza virus
VILVLGLSM

SEQ ID NO: 313929 - protein, 9 aa, Influenza virus
ILVLGLSMV

SEQ ID NO: 313930 - protein, 9 aa, Influenza virus
LVLGLSMVK

SEQ ID NO: 313931 - protein, 9 aa, Influenza virus
VLGLSMVKS

SEQ ID NO: 313932 - protein, 9 aa, Influenza virus
LGLSMVKSD

SEQ ID NO: 313933 - protein, 9 aa, Influenza virus
GLSMVKSDK

SEQ ID NO: 313934 - protein, 9 aa, Influenza virus
LSMVKSDKI

SEQ ID NO: 313935 - protein, 9 aa, Influenza virus
SMVKSDKIC

SEQ ID NO: 313936 - protein, 9 aa, Influenza virus
MVKSDKICL

SEQ ID NO: 313937 - protein, 9 aa, Influenza virus
VKSDKICLG

SEQ ID NO: 313938 - protein, 9 aa, Influenza virus
KSDKICLGH

SEQ ID NO: 313939 - protein, 9 aa, Influenza virus
SDKICLGHH

SEQ ID NO: 313940 - protein, 9 aa, Influenza virus
DKICLGHHA

SEQ ID NO: 313941 - protein, 9 aa, Influenza virus
KICLGHHAV

SEQ ID NO: 313942 - protein, 9 aa, Influenza virus
ICLGHHAVA

SEQ ID NO: 313943 - protein, 9 aa, Influenza virus
CLGHHAVAN

SEQ ID NO: 313944 - protein, 9 aa, Influenza virus
LGHHAVANG

SEQ ID NO: 313945 - protein, 9 aa, Influenza virus
GHHAVANGT

SEQ ID NO: 313946 - protein, 9 aa, Influenza virus
HHAVANGTK

SEQ ID NO: 313947 - protein, 9 aa, Influenza virus
HAVANGTKV

SEQ ID NO: 313948 - protein, 9 aa, Influenza virus
AVANGTKVN

SEQ ID NO: 313949 - protein, 9 aa, Influenza virus
VANGTKVNT

SEQ ID NO: 313950 - protein, 9 aa, Influenza virus
ANGTKVNTL

SEQ ID NO: 313951 - protein, 9 aa, Influenza virus
NGTKVNTLT

SEQ ID NO: 313952 - protein, 9 aa, Influenza virus
GTKVNTLTE

SEQ ID NO: 313953 - protein, 9 aa, Influenza virus
TKVNTLTER

SEQ ID NO: 313954 - protein, 9 aa, Influenza virus
KVNTLTERG

SEQ ID NO: 313955 - protein, 9 aa, Influenza virus
VNTLTERGV

SEQ ID NO: 313956 - protein, 9 aa, Influenza virus
NTLTERGVE

SEQ ID NO: 313957 - protein, 9 aa, Influenza virus
TLTERGVEV

SEQ ID NO: 313958 - protein, 9 aa, Influenza virus
LTERGVEVV

SEQ ID NO: 313959 - protein, 9 aa, Influenza virus
TERGVEVVN

SEQ ID NO: 313960 - protein, 9 aa, Influenza virus
ERGVEVVNA

SEQ ID NO: 313961 - protein, 9 aa, Influenza virus
RGVEVVNAT

SEQ ID NO: 313962 - protein, 9 aa, Influenza virus
GVEVVNATE

SEQ ID NO: 313963 - protein, 9 aa, Influenza virus
VEVVNATET

SEQ ID NO: 313964 - protein, 9 aa, Influenza virus
EVVNATETV

SEQ ID NO: 313965 - protein, 9 aa, Influenza virus
VVNATETVE

SEQ ID NO: 313966 - protein, 9 aa, Influenza virus
VNATETVEI

SEQ ID NO: 313967 - protein, 9 aa, Influenza virus
NATETVEIT

SEQ ID NO: 313968 - protein, 9 aa, Influenza virus
ATETVEITG

SEQ ID NO: 313969 - protein, 9 aa, Influenza virus
TETVEITGI

SEQ ID NO: 313970 - protein, 9 aa, Influenza virus
ETVEITGID

SEQ ID NO: 313971 - protein, 9 aa, Influenza virus
TVEITGIDK

SEQ ID NO: 313972 - protein, 9 aa, Influenza virus
VEITGIDKV

SEQ ID NO: 313973 - protein, 9 aa, Influenza virus
EITGIDKVC

SEQ ID NO: 313974 - protein, 9 aa, Influenza virus
ITGIDKVCT

SEQ ID NO: 313975 - protein, 9 aa, Influenza virus
TGIDKVCTK

SEQ ID NO: 313976 - protein, 9 aa, Influenza virus
GIDKVCTKG

SEQ ID NO: 313977 - protein, 9 aa, Influenza virus
IDKVCTKGK

SEQ ID NO: 313978 - protein, 9 aa, Influenza virus
DKVCTKGKK

SEQ ID NO: 313979 - protein, 9 aa, Influenza virus
KVCTKGKKA

SEQ ID NO: 313980 - protein, 9 aa, Influenza virus
VCTKGKKAV

SEQ ID NO: 313981 - protein, 9 aa, Influenza virus
CTKGKKAVD

SEQ ID NO: 313982 - protein, 9 aa, Influenza virus
TKGKKAVDL

SEQ ID NO: 313983 - protein, 9 aa, Influenza virus
KGKKAVDLG

SEQ ID NO: 313984 - protein, 9 aa, Influenza virus
GKKAVDLGS

SEQ ID NO: 313985 - protein, 9 aa, Influenza virus
KKAVDLGSC

SEQ ID NO: 313986 - protein, 9 aa, Influenza virus
KAVDLGSCG

SEQ ID NO: 313987 - protein, 9 aa, Influenza virus
AVDLGSCGI

SEQ ID NO: 313988 - protein, 9 aa, Influenza virus
VDLGSCGIL

SEQ ID NO: 313989 - protein, 9 aa, Influenza virus
DLGSCGILG

SEQ ID NO: 313990 - protein, 9 aa, Influenza virus
LGSCGILGT

SEQ ID NO: 313991 - protein, 9 aa, Influenza virus
GSCGILGTI

SEQ ID NO: 313992 - protein, 9 aa, Influenza virus
SCGILGTII

SEQ ID NO: 313993 - protein, 9 aa, Influenza virus
CGILGTIIG

SEQ ID NO: 313994 - protein, 9 aa, Influenza virus
GILGTIIGP

SEQ ID NO: 313995 - protein, 9 aa, Influenza virus
ILGTIIGPP

SEQ ID NO: 313996 - protein, 9 aa, Influenza virus
LGTIIGPPQ

SEQ ID NO: 313997 - protein, 9 aa, Influenza virus
GTIIGPPQC

SEQ ID NO: 313998 - protein, 9 aa, Influenza virus
TIIGPPQCD

SEQ ID NO: 313999 - protein, 9 aa, Influenza virus
IIGPPQCDL

SEQ ID NO: 314000 - protein, 9 aa, Influenza virus
IGPPQCDLH

SEQ ID NO: 314001 - protein, 9 aa, Influenza virus
GPPQCDLHL

SEQ ID NO: 314002 - protein, 9 aa, Influenza virus
PPQCDLHLE

SEQ ID NO: 314003 - protein, 9 aa, Influenza virus
PQCDLHLEF

SEQ ID NO: 314004 - protein, 9 aa, Influenza virus
QCDLHLEFK

SEQ ID NO: 314005 - protein, 9 aa, Influenza virus
CDLHLEFKA

SEQ ID NO: 314006 - protein, 9 aa, Influenza virus
DLHLEFKAD

SEQ ID NO: 314007 - protein, 9 aa, Influenza virus
LHLEFKADL

SEQ ID NO: 314008 - protein, 9 aa, Influenza virus
HLEFKADLI

SEQ ID NO: 314009 - protein, 9 aa, Influenza virus
LEFKADLII

SEQ ID NO: 314010 - protein, 9 aa, Influenza virus
EFKADLIIE

SEQ ID NO: 314011 - protein, 9 aa, Influenza virus
FKADLIIER

SEQ ID NO: 314012 - protein, 9 aa, Influenza virus
KADLIIERR

SEQ ID NO: 314013 - protein, 9 aa, Influenza virus
ADLIIERRN

SEQ ID NO: 314014 - protein, 9 aa, Influenza virus
DLIIERRNS

SEQ ID NO: 314015 - protein, 9 aa, Influenza virus
LIIERRNSS

SEQ ID NO: 314016 - protein, 9 aa, Influenza virus
IIERRNSSD

SEQ ID NO: 314017 - protein, 9 aa, Influenza virus
IERRNSSDI

SEQ ID NO: 314018 - protein, 9 aa, Influenza virus
ERRNSSDIC

SEQ ID NO: 314019 - protein, 9 aa, Influenza virus
RRNSSDICY

SEQ ID NO: 314020 - protein, 9 aa, Influenza virus
RNSSDICYP

SEQ ID NO: 314021 - protein, 9 aa, Influenza virus
NSSDICYPG

SEQ ID NO: 314022 - protein, 9 aa, Influenza virus
SSDICYPGR

SEQ ID NO: 314023 - protein, 9 aa, Influenza virus
SDICYPGRF

SEQ ID NO: 314024 - protein, 9 aa, Influenza virus
DICYPGRFT

SEQ ID NO: 314025 - protein, 9 aa, Influenza virus
ICYPGRFTN

SEQ ID NO: 314026 - protein, 9 aa, Influenza virus
CYPGRFTNE

SEQ ID NO: 314027 - protein, 9 aa, Influenza virus
YPGRFTNEE

SEQ ID NO: 314028 - protein, 9 aa, Influenza virus
PGRFTNEEA

SEQ ID NO: 314029 - protein, 9 aa, Influenza virus
GRFTNEEAL

SEQ ID NO: 314030 - protein, 9 aa, Influenza virus
RFTNEEALR

SEQ ID NO: 314031 - protein, 9 aa, Influenza virus
FTNEEALRQ

SEQ ID NO: 314032 - protein, 9 aa, Influenza virus
TNEEALRQI

SEQ ID NO: 314033 - protein, 9 aa, Influenza virus
NEEALRQII

SEQ ID NO: 314034 - protein, 9 aa, Influenza virus
EEALRQIIR

SEQ ID NO: 314035 - protein, 9 aa, Influenza virus
EALRQIIRE

SEQ ID NO: 314036 - protein, 9 aa, Influenza virus
ALRQIIRES

SEQ ID NO: 314037 - protein, 9 aa, Influenza virus
LRQIIRESG

SEQ ID NO: 314038 - protein, 9 aa, Influenza virus
RQIIRESGG

SEQ ID NO: 314039 - protein, 9 aa, Influenza virus
QIIRESGGI

SEQ ID NO: 314040 - protein, 9 aa, Influenza virus
IIRESGGID

SEQ ID NO: 314041 - protein, 9 aa, Influenza virus
IRESGGIDK

SEQ ID NO: 314042 - protein, 9 aa, Influenza virus
RESGGIDKE

SEQ ID NO: 314043 - protein, 9 aa, Influenza virus
ESGGIDKES

SEQ ID NO: 314044 - protein, 9 aa, Influenza virus
SGGIDKESM

SEQ ID NO: 314045 - protein, 9 aa, Influenza virus
GGIDKESMG

SEQ ID NO: 314046 - protein, 9 aa, Influenza virus
GIDKESMGF

SEQ ID NO: 314047 - protein, 9 aa, Influenza virus
IDKESMGFR

SEQ ID NO: 314048 - protein, 9 aa, Influenza virus
DKESMGFRY

SEQ ID NO: 314049 - protein, 9 aa, Influenza virus
KESMGFRYS

SEQ ID NO: 314050 - protein, 9 aa, Influenza virus
ESMGFRYSG

SEQ ID NO: 314051 - protein, 9 aa, Influenza virus
SMGFRYSGI

SEQ ID NO: 314052 - protein, 9 aa, Influenza virus
MGFRYSGIR

SEQ ID NO: 314053 - protein, 9 aa, Influenza virus
GFRYSGIRT

SEQ ID NO: 314054 - protein, 9 aa, Influenza virus
FRYSGIRTD

SEQ ID NO: 314055 - protein, 9 aa, Influenza virus
RYSGIRTDG

SEQ ID NO: 314056 - protein, 9 aa, Influenza virus
YSGIRTDGA

SEQ ID NO: 314057 - protein, 9 aa, Influenza virus
SGIRTDGAT

SEQ ID NO: 314058 - protein, 9 aa, Influenza virus
GIRTDGATS

SEQ ID NO: 314059 - protein, 9 aa, Influenza virus
IRTDGATSA

SEQ ID NO: 314060 - protein, 9 aa, Influenza virus
RTDGATSAC

SEQ ID NO: 314061 - protein, 9 aa, Influenza virus
TDGATSACK

SEQ ID NO: 314062 - protein, 9 aa, Influenza virus
DGATSACKR

SEQ ID NO: 314063 - protein, 9 aa, Influenza virus
GATSACKRT

SEQ ID NO: 314064 - protein, 9 aa, Influenza virus
ATSACKRTV

SEQ ID NO: 314065 - protein, 9 aa, Influenza virus
TSACKRTVS

SEQ ID NO: 314066 - protein, 9 aa, Influenza virus
SACKRTVSS

SEQ ID NO: 314067 - protein, 9 aa, Influenza virus
ACKRTVSSF

SEQ ID NO: 314068 - protein, 9 aa, Influenza virus
CKRTVSSFY

SEQ ID NO: 314069 - protein, 9 aa, Influenza virus
KRTVSSFYS

SEQ ID NO: 314070 - protein, 9 aa, Influenza virus
RTVSSFYSE

SEQ ID NO: 314071 - protein, 9 aa, Influenza virus
TVSSFYSEM

SEQ ID NO: 314072 - protein, 9 aa, Influenza virus
VSSFYSEMK

SEQ ID NO: 314073 - protein, 9 aa, Influenza virus
SSFYSEMKW

SEQ ID NO: 314074 - protein, 9 aa, Influenza virus
SFYSEMKWL

SEQ ID NO: 314075 - protein, 9 aa, Influenza virus
FYSEMKWLS

SEQ ID NO: 314076 - protein, 9 aa, Influenza virus
YSEMKWLSS

SEQ ID NO: 314077 - protein, 9 aa, Influenza virus
SEMKWLSSS

SEQ ID NO: 314078 - protein, 9 aa, Influenza virus
EMKWLSSSM

SEQ ID NO: 314079 - protein, 9 aa, Influenza virus
MKWLSSSMN

SEQ ID NO: 314080 - protein, 9 aa, Influenza virus
KWLSSSMNN

SEQ ID NO: 314081 - protein, 9 aa, Influenza virus
WLSSSMNNQ

SEQ ID NO: 314082 - protein, 9 aa, Influenza virus
LSSSMNNQV

SEQ ID NO: 314083 - protein, 9 aa, Influenza virus
SSSMNNQVF

SEQ ID NO: 314084 - protein, 9 aa, Influenza virus
SSMNNQVFP

SEQ ID NO: 314085 - protein, 9 aa, Influenza virus
SMNNQVFPQ

SEQ ID NO: 314086 - protein, 9 aa, Influenza virus
MNNQVFPQL

SEQ ID NO: 314087 - protein, 9 aa, Influenza virus
NNQVFPQLN

SEQ ID NO: 314088 - protein, 9 aa, Influenza virus
NQVFPQLNQ

SEQ ID NO: 314089 - protein, 9 aa, Influenza virus
QVFPQLNQT

SEQ ID NO: 314090 - protein, 9 aa, Influenza virus
VFPQLNQTY

SEQ ID NO: 314091 - protein, 9 aa, Influenza virus
FPQLNQTYR

SEQ ID NO: 314092 - protein, 9 aa, Influenza virus
PQLNQTYRN

SEQ ID NO: 314093 - protein, 9 aa, Influenza virus
QLNQTYRNT

SEQ ID NO: 314094 - protein, 9 aa, Influenza virus
LNQTYRNTR

SEQ ID NO: 314095 - protein, 9 aa, Influenza virus
NQTYRNTRK

SEQ ID NO: 314096 - protein, 9 aa, Influenza virus
QTYRNTRKE

SEQ ID NO: 314097 - protein, 9 aa, Influenza virus
TYRNTRKEP

SEQ ID NO: 314098 - protein, 9 aa, Influenza virus
YRNTRKEPA

SEQ ID NO: 314099 - protein, 9 aa, Influenza virus
RNTRKEPAL

SEQ ID NO: 314100 - protein, 9 aa, Influenza virus
NTRKEPALI

SEQ ID NO: 314101 - protein, 9 aa, Influenza virus
TRKEPALIV

SEQ ID NO: 314102 - protein, 9 aa, Influenza virus
RKEPALIVW

SEQ ID NO: 314103 - protein, 9 aa, Influenza virus
KEPALIVWG

SEQ ID NO: 314104 - protein, 9 aa, Influenza virus
EPALIVWGV

SEQ ID NO: 314105 - protein, 9 aa, Influenza virus
PALIVWGVH

SEQ ID NO: 314106 - protein, 9 aa, Influenza virus
ALIVWGVHH

SEQ ID NO: 314107 - protein, 9 aa, Influenza virus
LIVWGVHHS

SEQ ID NO: 314108 - protein, 9 aa, Influenza virus
IVWGVHHSS

SEQ ID NO: 314109 - protein, 9 aa, Influenza virus
VWGVHHSSS

SEQ ID NO: 314110 - protein, 9 aa, Influenza virus
WGVHHSSSL

SEQ ID NO: 314111 - protein, 9 aa, Influenza virus
GVHHSSSLD

SEQ ID NO: 314112 - protein, 9 aa, Influenza virus
VHHSSSLDE

SEQ ID NO: 314113 - protein, 9 aa, Influenza virus
HHSSSLDEQ

SEQ ID NO: 314114 - protein, 9 aa, Influenza virus
HSSSLDEQN

SEQ ID NO: 314115 - protein, 9 aa, Influenza virus
SSSLDEQNK

SEQ ID NO: 314116 - protein, 9 aa, Influenza virus
SSLDEQNKL

SEQ ID NO: 314117 - protein, 9 aa, Influenza virus
SLDEQNKLY

SEQ ID NO: 314118 - protein, 9 aa, Influenza virus
LDEQNKLYG

SEQ ID NO: 314119 - protein, 9 aa, Influenza virus
DEQNKLYGT

SEQ ID NO: 314120 - protein, 9 aa, Influenza virus
EQNKLYGTG

SEQ ID NO: 314121 - protein, 9 aa, Influenza virus
QNKLYGTGN

SEQ ID NO: 314122 - protein, 9 aa, Influenza virus
NKLYGTGNK

SEQ ID NO: 314123 - protein, 9 aa, Influenza virus
KLYGTGNKL

SEQ ID NO: 314124 - protein, 9 aa, Influenza virus
LYGTGNKLI

SEQ ID NO: 314125 - protein, 9 aa, Influenza virus
YGTGNKLIT

SEQ ID NO: 314126 - protein, 9 aa, Influenza virus
GTGNKLITV

SEQ ID NO: 314127 - protein, 9 aa, Influenza virus
TGNKLITVG

SEQ ID NO: 314128 - protein, 9 aa, Influenza virus
GNKLITVGS

SEQ ID NO: 314129 - protein, 9 aa, Influenza virus
NKLITVGSS

SEQ ID NO: 314130 - protein, 9 aa, Influenza virus
KLITVGSSK

SEQ ID NO: 314131 - protein, 9 aa, Influenza virus
LITVGSSKY

SEQ ID NO: 314132 - protein, 9 aa, Influenza virus
ITVGSSKYQ

SEQ ID NO: 314133 - protein, 9 aa, Influenza virus
TVGSSKYQQ

SEQ ID NO: 314134 - protein, 9 aa, Influenza virus
VGSSKYQQS

SEQ ID NO: 314135 - protein, 9 aa, Influenza virus
GSSKYQQSF

SEQ ID NO: 314136 - protein, 9 aa, Influenza virus
SSKYQQSFS

SEQ ID NO: 314137 - protein, 9 aa, Influenza virus
SKYQQSFSP

SEQ ID NO: 314138 - protein, 9 aa, Influenza virus
KYQQSFSPS

SEQ ID NO: 314139 - protein, 9 aa, Influenza virus
YQQSFSPSP

SEQ ID NO: 314140 - protein, 9 aa, Influenza virus
QQSFSPSPG

SEQ ID NO: 314141 - protein, 9 aa, Influenza virus
QSFSPSPGA

SEQ ID NO: 314142 - protein, 9 aa, Influenza virus
SFSPSPGAR

SEQ ID NO: 314143 - protein, 9 aa, Influenza virus
FSPSPGARP

SEQ ID NO: 314144 - protein, 9 aa, Influenza virus
SPSPGARPK

SEQ ID NO: 314145 - protein, 9 aa, Influenza virus
PSPGARPKV

SEQ ID NO: 314146 - protein, 9 aa, Influenza virus
SPGARPKVN

SEQ ID NO: 314147 - protein, 9 aa, Influenza virus
PGARPKVNG

SEQ ID NO: 314148 - protein, 9 aa, Influenza virus
GARPKVNGQ

SEQ ID NO: 314149 - protein, 9 aa, Influenza virus
ARPKVNGQA

SEQ ID NO: 314150 - protein, 9 aa, Influenza virus
RPKVNGQAG

SEQ ID NO: 314151 - protein, 9 aa, Influenza virus
PKVNGQAGR

SEQ ID NO: 314152 - protein, 9 aa, Influenza virus
KVNGQAGRI

SEQ ID NO: 314153 - protein, 9 aa, Influenza virus
VNGQAGRID

SEQ ID NO: 314154 - protein, 9 aa, Influenza virus
NGQAGRIDF

SEQ ID NO: 314155 - protein, 9 aa, Influenza virus
GQAGRIDFH

SEQ ID NO: 314156 - protein, 9 aa, Influenza virus
QAGRIDFHW

SEQ ID NO: 314157 - protein, 9 aa, Influenza virus
AGRIDFHWM

SEQ ID NO: 314158 - protein, 9 aa, Influenza virus
GRIDFHWML

SEQ ID NO: 314159 - protein, 9 aa, Influenza virus
RIDFHWMLL

SEQ ID NO: 314160 - protein, 9 aa, Influenza virus
IDFHWMLLD

SEQ ID NO: 314161 - protein, 9 aa, Influenza virus
DFHWMLLDP

SEQ ID NO: 314162 - protein, 9 aa, Influenza virus
FHWMLLDPG

SEQ ID NO: 314163 - protein, 9 aa, Influenza virus
HWMLLDPGD

SEQ ID NO: 314164 - protein, 9 aa, Influenza virus
WMLLDPGDT

SEQ ID NO: 314165 - protein, 9 aa, Influenza virus
MLLDPGDTV

SEQ ID NO: 314166 - protein, 9 aa, Influenza virus
LLDPGDTVT

SEQ ID NO: 314167 - protein, 9 aa, Influenza virus
LDPGDTVTF

SEQ ID NO: 314168 - protein, 9 aa, Influenza virus
DPGDTVTFT

SEQ ID NO: 314169 - protein, 9 aa, Influenza virus
PGDTVTFTF

SEQ ID NO: 314170 - protein, 9 aa, Influenza virus
GDTVTFTFN

SEQ ID NO: 314171 - protein, 9 aa, Influenza virus
DTVTFTFNG

SEQ ID NO: 314172 - protein, 9 aa, Influenza virus
TVTFTFNGA

SEQ ID NO: 314173 - protein, 9 aa, Influenza virus
VTFTFNGAF

SEQ ID NO: 314174 - protein, 9 aa, Influenza virus
TFTFNGAFI

SEQ ID NO: 314175 - protein, 9 aa, Influenza virus
FTFNGAFIA

SEQ ID NO: 314176 - protein, 9 aa, Influenza virus
TFNGAFIAP

SEQ ID NO: 314177 - protein, 9 aa, Influenza virus
FNGAFIAPD

SEQ ID NO: 314178 - protein, 9 aa, Influenza virus
NGAFIAPDR

SEQ ID NO: 314179 - protein, 9 aa, Influenza virus
GAFIAPDRA

SEQ ID NO: 314180 - protein, 9 aa, Influenza virus
AFIAPDRAT

SEQ ID NO: 314181 - protein, 9 aa, Influenza virus
FIAPDRATF

SEQ ID NO: 314182 - protein, 9 aa, Influenza virus
IAPDRATFL

SEQ ID NO: 314183 - protein, 9 aa, Influenza virus
APDRATFLR

SEQ ID NO: 314184 - protein, 9 aa, Influenza virus
PDRATFLRS

SEQ ID NO: 314185 - protein, 9 aa, Influenza virus
DRATFLRSN

SEQ ID NO: 314186 - protein, 9 aa, Influenza virus
RATFLRSNA

SEQ ID NO: 314187 - protein, 9 aa, Influenza virus
ATFLRSNAP

SEQ ID NO: 314188 - protein, 9 aa, Influenza virus
TFLRSNAPS

SEQ ID NO: 314189 - protein, 9 aa, Influenza virus
FLRSNAPSG

SEQ ID NO: 314190 - protein, 9 aa, Influenza virus
LRSNAPSGI

SEQ ID NO: 314191 - protein, 9 aa, Influenza virus
RSNAPSGIE

SEQ ID NO: 314192 - protein, 9 aa, Influenza virus
SNAPSGIEY

SEQ ID NO: 314193 - protein, 9 aa, Influenza virus
NAPSGIEYN

SEQ ID NO: 314194 - protein, 9 aa, Influenza virus
APSGIEYNG

SEQ ID NO: 314195 - protein, 9 aa, Influenza virus
PSGIEYNGK

SEQ ID NO: 314196 - protein, 9 aa, Influenza virus
SGIEYNGKS

SEQ ID NO: 314197 - protein, 9 aa, Influenza virus
GIEYNGKSL

SEQ ID NO: 314198 - protein, 9 aa, Influenza virus
IEYNGKSLG

SEQ ID NO: 314199 - protein, 9 aa, Influenza virus
EYNGKSLGI

SEQ ID NO: 314200 - protein, 9 aa, Influenza virus
YNGKSLGIQ

SEQ ID NO: 314201 - protein, 9 aa, Influenza virus
NGKSLGIQS

SEQ ID NO: 314202 - protein, 9 aa, Influenza virus
GKSLGIQSD

SEQ ID NO: 314203 - protein, 9 aa, Influenza virus
KSLGIQSDA

SEQ ID NO: 314204 - protein, 9 aa, Influenza virus
SLGIQSDAQ

SEQ ID NO: 314205 - protein, 9 aa, Influenza virus
LGIQSDAQI

SEQ ID NO: 314206 - protein, 9 aa, Influenza virus
GIQSDAQID

SEQ ID NO: 314207 - protein, 9 aa, Influenza virus
IQSDAQIDE

SEQ ID NO: 314208 - protein, 9 aa, Influenza virus
QSDAQIDES

SEQ ID NO: 314209 - protein, 9 aa, Influenza virus
SDAQIDESC

SEQ ID NO: 314210 - protein, 9 aa, Influenza virus
DAQIDESCE

SEQ ID NO: 314211 - protein, 9 aa, Influenza virus
AQIDESCEG

SEQ ID NO: 314212 - protein, 9 aa, Influenza virus
QIDESCEGE

SEQ ID NO: 314213 - protein, 9 aa, Influenza virus
IDESCEGEC

SEQ ID NO: 314214 - protein, 9 aa, Influenza virus
DESCEGECF

SEQ ID NO: 314215 - protein, 9 aa, Influenza virus
ESCEGECFY

SEQ ID NO: 314216 - protein, 9 aa, Influenza virus
SCEGECFYS

SEQ ID NO: 314217 - protein, 9 aa, Influenza virus
CEGECFYSG

SEQ ID NO: 314218 - protein, 9 aa, Influenza virus
EGECFYSGG

SEQ ID NO: 314219 - protein, 9 aa, Influenza virus
GECFYSGGT

SEQ ID NO: 314220 - protein, 9 aa, Influenza virus
ECFYSGGTI

SEQ ID NO: 314221 - protein, 9 aa, Influenza virus
CFYSGGTIN

SEQ ID NO: 314222 - protein, 9 aa, Influenza virus
FYSGGTINS

SEQ ID NO: 314223 - protein, 9 aa, Influenza virus
YSGGTINSP

SEQ ID NO: 314224 - protein, 9 aa, Influenza virus
SGGTINSPL

SEQ ID NO: 314225 - protein, 9 aa, Influenza virus
GGTINSPLP

SEQ ID NO: 314226 - protein, 9 aa, Influenza virus
GTINSPLPF

SEQ ID NO: 314227 - protein, 9 aa, Influenza virus
TINSPLPFQ

SEQ ID NO: 314228 - protein, 9 aa, Influenza virus
INSPLPFQN

SEQ ID NO: 314229 - protein, 9 aa, Influenza virus
NSPLPFQNI

SEQ ID NO: 314230 - protein, 9 aa, Influenza virus
SPLPFQNID

SEQ ID NO: 314231 - protein, 9 aa, Influenza virus
PLPFQNIDS

SEQ ID NO: 314232 - protein, 9 aa, Influenza virus
LPFQNIDSR

SEQ ID NO: 314233 - protein, 9 aa, Influenza virus
PFQNIDSRA

SEQ ID NO: 314234 - protein, 9 aa, Influenza virus
FQNIDSRAV

SEQ ID NO: 314235 - protein, 9 aa, Influenza virus
QNIDSRAVG

SEQ ID NO: 314236 - protein, 9 aa, Influenza virus
NIDSRAVGK

SEQ ID NO: 314237 - protein, 9 aa, Influenza virus
IDSRAVGKC

SEQ ID NO: 314238 - protein, 9 aa, Influenza virus
DSRAVGKCP

SEQ ID NO: 314239 - protein, 9 aa, Influenza virus
SRAVGKCPR

SEQ ID NO: 314240 - protein, 9 aa, Influenza virus
RAVGKCPRY

SEQ ID NO: 314241 - protein, 9 aa, Influenza virus
AVGKCPRYV

SEQ ID NO: 314242 - protein, 9 aa, Influenza virus
VGKCPRYVK

SEQ ID NO: 314243 - protein, 9 aa, Influenza virus
GKCPRYVKQ

SEQ ID NO: 314244 - protein, 9 aa, Influenza virus
KCPRYVKQS

SEQ ID NO: 314245 - protein, 9 aa, Influenza virus
CPRYVKQSS

SEQ ID NO: 314246 - protein, 9 aa, Influenza virus
PRYVKQSSL

SEQ ID NO: 314247 - protein, 9 aa, Influenza virus
RYVKQSSLP

SEQ ID NO: 314248 - protein, 9 aa, Influenza virus
YVKQSSLPL

SEQ ID NO: 314249 - protein, 9 aa, Influenza virus
VKQSSLPLA

SEQ ID NO: 314250 - protein, 9 aa, Influenza virus
KQSSLPLAL

SEQ ID NO: 314251 - protein, 9 aa, Influenza virus
QSSLPLALG

SEQ ID NO: 314252 - protein, 9 aa, Influenza virus
SSLPLALGM

SEQ ID NO: 314253 - protein, 9 aa, Influenza virus
SLPLALGMK

SEQ ID NO: 314254 - protein, 9 aa, Influenza virus
LPLALGMKN

SEQ ID NO: 314255 - protein, 9 aa, Influenza virus
PLALGMKNV

SEQ ID NO: 314256 - protein, 9 aa, Influenza virus
LALGMKNVP

SEQ ID NO: 314257 - protein, 9 aa, Influenza virus
ALGMKNVPE

SEQ ID NO: 314258 - protein, 9 aa, Influenza virus
LGMKNVPEK

SEQ ID NO: 314259 - protein, 9 aa, Influenza virus
GMKNVPEKI

SEQ ID NO: 314260 - protein, 9 aa, Influenza virus
MKNVPEKIR

SEQ ID NO: 314261 - protein, 9 aa, Influenza virus
KNVPEKIRT

SEQ ID NO: 314262 - protein, 9 aa, Influenza virus
NVPEKIRTR

SEQ ID NO: 314263 - protein, 9 aa, Influenza virus
VPEKIRTRG

SEQ ID NO: 314264 - protein, 9 aa, Influenza virus
PEKIRTRGL

SEQ ID NO: 314265 - protein, 9 aa, Influenza virus
EKIRTRGLF

SEQ ID NO: 314266 - protein, 9 aa, Influenza virus
KIRTRGLFG

SEQ ID NO: 314267 - protein, 9 aa, Influenza virus
IRTRGLFGA

SEQ ID NO: 314268 - protein, 9 aa, Influenza virus
RTRGLFGAI

SEQ ID NO: 314269 - protein, 9 aa, Influenza virus
TRGLFGAIA

SEQ ID NO: 314270 - protein, 9 aa, Influenza virus
RGLFGAIAG

SEQ ID NO: 314271 - protein, 9 aa, Influenza virus
GLFGAIAGF

SEQ ID NO: 314272 - protein, 9 aa, Influenza virus
LFGAIAGFI

SEQ ID NO: 314273 - protein, 9 aa, Influenza virus
FGAIAGFIE

SEQ ID NO: 314274 - protein, 9 aa, Influenza virus
GAIAGFIEN

SEQ ID NO: 314275 - protein, 9 aa, Influenza virus
AIAGFIENG

SEQ ID NO: 314276 - protein, 9 aa, Influenza virus
IAGFIENGW

SEQ ID NO: 314277 - protein, 9 aa, Influenza virus
AGFIENGWE

SEQ ID NO: 314278 - protein, 9 aa, Influenza virus
GFIENGWEG

SEQ ID NO: 314279 - protein, 9 aa, Influenza virus
FIENGWEGL

SEQ ID NO: 314280 - protein, 9 aa, Influenza virus
IENGWEGLI

SEQ ID NO: 314281 - protein, 9 aa, Influenza virus
ENGWEGLID

SEQ ID NO: 314282 - protein, 9 aa, Influenza virus
NGWEGLIDG

SEQ ID NO: 314283 - protein, 9 aa, Influenza virus
GWEGLIDGW

SEQ ID NO: 314284 - protein, 9 aa, Influenza virus
WEGLIDGWY

SEQ ID NO: 314285 - protein, 9 aa, Influenza virus
EGLIDGWYG

SEQ ID NO: 314286 - protein, 9 aa, Influenza virus
GLIDGWYGF

SEQ ID NO: 314287 - protein, 9 aa, Influenza virus
LIDGWYGFR

SEQ ID NO: 314288 - protein, 9 aa, Influenza virus
IDGWYGFRH

SEQ ID NO: 314289 - protein, 9 aa, Influenza virus
DGWYGFRHQ

SEQ ID NO: 314290 - protein, 9 aa, Influenza virus
GWYGFRHQN

SEQ ID NO: 314291 - protein, 9 aa, Influenza virus
WYGFRHQNA

SEQ ID NO: 314292 - protein, 9 aa, Influenza virus
YGFRHQNAQ

SEQ ID NO: 314293 - protein, 9 aa, Influenza virus
GFRHQNAQG

SEQ ID NO: 314294 - protein, 9 aa, Influenza virus
FRHQNAQGQ

SEQ ID NO: 314295 - protein, 9 aa, Influenza virus
RHQNAQGQG

SEQ ID NO: 314296 - protein, 9 aa, Influenza virus
HQNAQGQGT

SEQ ID NO: 314297 - protein, 9 aa, Influenza virus
QNAQGQGTA

SEQ ID NO: 314298 - protein, 9 aa, Influenza virus
NAQGQGTAA

SEQ ID NO: 314299 - protein, 9 aa, Influenza virus
AQGQGTAAD

SEQ ID NO: 314300 - protein, 9 aa, Influenza virus
QGQGTAADY

SEQ ID NO: 314301 - protein, 9 aa, Influenza virus
GQGTAADYK

SEQ ID NO: 314302 - protein, 9 aa, Influenza virus
QGTAADYKS

SEQ ID NO: 314303 - protein, 9 aa, Influenza virus
GTAADYKST

SEQ ID NO: 314304 - protein, 9 aa, Influenza virus
TAADYKSTQ

SEQ ID NO: 314305 - protein, 9 aa, Influenza virus
AADYKSTQA

SEQ ID NO: 314306 - protein, 9 aa, Influenza virus
ADYKSTQAA

SEQ ID NO: 314307 - protein, 9 aa, Influenza virus
DYKSTQAAI

SEQ ID NO: 314308 - protein, 9 aa, Influenza virus
YKSTQAAID

SEQ ID NO: 314309 - protein, 9 aa, Influenza virus
KSTQAAIDQ

SEQ ID NO: 314310 - protein, 9 aa, Influenza virus
STQAAIDQI

SEQ ID NO: 314311 - protein, 9 aa, Influenza virus
TQAAIDQIT

SEQ ID NO: 314312 - protein, 9 aa, Influenza virus
QAAIDQITG

SEQ ID NO: 314313 - protein, 9 aa, Influenza virus
AAIDQITGK

SEQ ID NO: 314314 - protein, 9 aa, Influenza virus
AIDQITGKL

SEQ ID NO: 314315 - protein, 9 aa, Influenza virus
IDQITGKLN

SEQ ID NO: 314316 - protein, 9 aa, Influenza virus
DQITGKLNR

SEQ ID NO: 314317 - protein, 9 aa, Influenza virus
QITGKLNRL

SEQ ID NO: 314318 - protein, 9 aa, Influenza virus
ITGKLNRLI

SEQ ID NO: 314319 - protein, 9 aa, Influenza virus
TGKLNRLIE

SEQ ID NO: 314320 - protein, 9 aa, Influenza virus
GKLNRLIEK

SEQ ID NO: 314321 - protein, 9 aa, Influenza virus
KLNRLIEKT

SEQ ID NO: 314322 - protein, 9 aa, Influenza virus
LNRLIEKTN

SEQ ID NO: 314323 - protein, 9 aa, Influenza virus
NRLIEKTNK

SEQ ID NO: 314324 - protein, 9 aa, Influenza virus
RLIEKTNKQ

SEQ ID NO: 314325 - protein, 9 aa, Influenza virus
LIEKTNKQF

SEQ ID NO: 314326 - protein, 9 aa, Influenza virus
IEKTNKQFE

SEQ ID NO: 314327 - protein, 9 aa, Influenza virus
EKTNKQFEL

SEQ ID NO: 314328 - protein, 9 aa, Influenza virus
KTNKQFELI

SEQ ID NO: 314329 - protein, 9 aa, Influenza virus
TNKQFELID

SEQ ID NO: 314330 - protein, 9 aa, Influenza virus
NKQFELIDN

SEQ ID NO: 314331 - protein, 9 aa, Influenza virus
KQFELIDNE

SEQ ID NO: 314332 - protein, 9 aa, Influenza virus
QFELIDNEF

SEQ ID NO: 314333 - protein, 9 aa, Influenza virus
FELIDNEFT

SEQ ID NO: 314334 - protein, 9 aa, Influenza virus
ELIDNEFTE

SEQ ID NO: 314335 - protein, 9 aa, Influenza virus
LIDNEFTEV

SEQ ID NO: 314336 - protein, 9 aa, Influenza virus
IDNEFTEVE

SEQ ID NO: 314337 - protein, 9 aa, Influenza virus
DNEFTEVEQ

SEQ ID NO: 314338 - protein, 9 aa, Influenza virus
NEFTEVEQQ

SEQ ID NO: 314339 - protein, 9 aa, Influenza virus
EFTEVEQQI

SEQ ID NO: 314340 - protein, 9 aa, Influenza virus
FTEVEQQIG

SEQ ID NO: 314341 - protein, 9 aa, Influenza virus
TEVEQQIGN

SEQ ID NO: 314342 - protein, 9 aa, Influenza virus
EVEQQIGNV

SEQ ID NO: 314343 - protein, 9 aa, Influenza virus
VEQQIGNVI

SEQ ID NO: 314344 - protein, 9 aa, Influenza virus
EQQIGNVIN

SEQ ID NO: 314345 - protein, 9 aa, Influenza virus
QQIGNVINW

SEQ ID NO: 314346 - protein, 9 aa, Influenza virus
QIGNVINWT

SEQ ID NO: 314347 - protein, 9 aa, Influenza virus
IGNVINWTR

SEQ ID NO: 314348 - protein, 9 aa, Influenza virus
GNVINWTRD

SEQ ID NO: 314349 - protein, 9 aa, Influenza virus
NVINWTRDS

SEQ ID NO: 314350 - protein, 9 aa, Influenza virus
VINWTRDSL

SEQ ID NO: 314351 - protein, 9 aa, Influenza virus
INWTRDSLT

SEQ ID NO: 314352 - protein, 9 aa, Influenza virus
NWTRDSLTE

SEQ ID NO: 314353 - protein, 9 aa, Influenza virus
WTRDSLTEI

SEQ ID NO: 314354 - protein, 9 aa, Influenza virus
TRDSLTEIW

SEQ ID NO: 314355 - protein, 9 aa, Influenza virus
RDSLTEIWS

SEQ ID NO: 314356 - protein, 9 aa, Influenza virus
DSLTEIWSY

SEQ ID NO: 314357 - protein, 9 aa, Influenza virus
SLTEIWSYN

SEQ ID NO: 314358 - protein, 9 aa, Influenza virus
LTEIWSYNA

SEQ ID NO: 314359 - protein, 9 aa, Influenza virus
TEIWSYNAE

SEQ ID NO: 314360 - protein, 9 aa, Influenza virus
EIWSYNAEL

SEQ ID NO: 314361 - protein, 9 aa, Influenza virus
IWSYNAELL

SEQ ID NO: 314362 - protein, 9 aa, Influenza virus
WSYNAELLV

SEQ ID NO: 314363 - protein, 9 aa, Influenza virus
SYNAELLVA

SEQ ID NO: 314364 - protein, 9 aa, Influenza virus
YNAELLVAM

SEQ ID NO: 314365 - protein, 9 aa, Influenza virus
NAELLVAME

SEQ ID NO: 314366 - protein, 9 aa, Influenza virus
AELLVAMEN

SEQ ID NO: 314367 - protein, 9 aa, Influenza virus
ELLVAMENQ

SEQ ID NO: 314368 - protein, 9 aa, Influenza virus
LLVAMENQH

SEQ ID NO: 314369 - protein, 9 aa, Influenza virus
LVAMENQHT

SEQ ID NO: 314370 - protein, 9 aa, Influenza virus
VAMENQHTI

SEQ ID NO: 314371 - protein, 9 aa, Influenza virus
AMENQHTID

SEQ ID NO: 314372 - protein, 9 aa, Influenza virus
MENQHTIDL

SEQ ID NO: 314373 - protein, 9 aa, Influenza virus
ENQHTIDLA

SEQ ID NO: 314374 - protein, 9 aa, Influenza virus
NQHTIDLAD

SEQ ID NO: 314375 - protein, 9 aa, Influenza virus
QHTIDLADS

SEQ ID NO: 314376 - protein, 9 aa, Influenza virus
HTIDLADSE

SEQ ID NO: 314377 - protein, 9 aa, Influenza virus
TIDLADSEM

SEQ ID NO: 314378 - protein, 9 aa, Influenza virus
IDLADSEMN

SEQ ID NO: 314379 - protein, 9 aa, Influenza virus
DLADSEMNK

SEQ ID NO: 314380 - protein, 9 aa, Influenza virus
LADSEMNKL

SEQ ID NO: 314381 - protein, 9 aa, Influenza virus
ADSEMNKLY

SEQ ID NO: 314382 - protein, 9 aa, Influenza virus
DSEMNKLYE

SEQ ID NO: 314383 - protein, 9 aa, Influenza virus
SEMNKLYER

SEQ ID NO: 314384 - protein, 9 aa, Influenza virus
EMNKLYERV

SEQ ID NO: 314385 - protein, 9 aa, Influenza virus
MNKLYERVR

SEQ ID NO: 314386 - protein, 9 aa, Influenza virus
NKLYERVRR

SEQ ID NO: 314387 - protein, 9 aa, Influenza virus
KLYERVRRQ

SEQ ID NO: 314388 - protein, 9 aa, Influenza virus
LYERVRRQL

SEQ ID NO: 314389 - protein, 9 aa, Influenza virus
YERVRRQLR

SEQ ID NO: 314390 - protein, 9 aa, Influenza virus
ERVRRQLRE

SEQ ID NO: 314391 - protein, 9 aa, Influenza virus
RVRRQLREN

SEQ ID NO: 314392 - protein, 9 aa, Influenza virus
VRRQLRENA

SEQ ID NO: 314393 - protein, 9 aa, Influenza virus
RRQLRENAE

SEQ ID NO: 314394 - protein, 9 aa, Influenza virus
RQLRENAEE

SEQ ID NO: 314395 - protein, 9 aa, Influenza virus
QLRENAEED

SEQ ID NO: 314396 - protein, 9 aa, Influenza virus
LRENAEEDG

SEQ ID NO: 314397 - protein, 9 aa, Influenza virus
RENAEEDGT

SEQ ID NO: 314398 - protein, 9 aa, Influenza virus
ENAEEDGTG

SEQ ID NO: 314399 - protein, 9 aa, Influenza virus
NAEEDGTGC

SEQ ID NO: 314400 - protein, 9 aa, Influenza virus
AEEDGTGCF

SEQ ID NO: 314401 - protein, 9 aa, Influenza virus
EEDGTGCFE

SEQ ID NO: 314402 - protein, 9 aa, Influenza virus
EDGTGCFEI

SEQ ID NO: 314403 - protein, 9 aa, Influenza virus
DGTGCFEIF

SEQ ID NO: 314404 - protein, 9 aa, Influenza virus
GTGCFEIFH

SEQ ID NO: 314405 - protein, 9 aa, Influenza virus
TGCFEIFHR

SEQ ID NO: 314406 - protein, 9 aa, Influenza virus
GCFEIFHRC

SEQ ID NO: 314407 - protein, 9 aa, Influenza virus
CFEIFHRCD

SEQ ID NO: 314408 - protein, 9 aa, Influenza virus
FEIFHRCDD

SEQ ID NO: 314409 - protein, 9 aa, Influenza virus
EIFHRCDDQ

SEQ ID NO: 314410 - protein, 9 aa, Influenza virus
IFHRCDDQC

SEQ ID NO: 314411 - protein, 9 aa, Influenza virus
FHRCDDQCM

SEQ ID NO: 314412 - protein, 9 aa, Influenza virus
HRCDDQCME

SEQ ID NO: 314413 - protein, 9 aa, Influenza virus
RCDDQCMES

SEQ ID NO: 314414 - protein, 9 aa, Influenza virus
CDDQCMESI

SEQ ID NO: 314415 - protein, 9 aa, Influenza virus
DDQCMESIR

SEQ ID NO: 314416 - protein, 9 aa, Influenza virus
DQCMESIRN

SEQ ID NO: 314417 - protein, 9 aa, Influenza virus
QCMESIRNN

SEQ ID NO: 314418 - protein, 9 aa, Influenza virus
CMESIRNNT

SEQ ID NO: 314419 - protein, 9 aa, Influenza virus
MESIRNNTY

SEQ ID NO: 314420 - protein, 9 aa, Influenza virus
ESIRNNTYN

SEQ ID NO: 314421 - protein, 9 aa, Influenza virus
SIRNNTYNH

SEQ ID NO: 314422 - protein, 9 aa, Influenza virus
IRNNTYNHT

SEQ ID NO: 314423 - protein, 9 aa, Influenza virus
RNNTYNHTE

SEQ ID NO: 314424 - protein, 9 aa, Influenza virus
NNTYNHTEY

SEQ ID NO: 314425 - protein, 9 aa, Influenza virus
NTYNHTEYR

SEQ ID NO: 314426 - protein, 9 aa, Influenza virus
TYNHTEYRQ

SEQ ID NO: 314427 - protein, 9 aa, Influenza virus
YNHTEYRQE

SEQ ID NO: 314428 - protein, 9 aa, Influenza virus
NHTEYRQEA

SEQ ID NO: 314429 - protein, 9 aa, Influenza virus
HTEYRQEAL

SEQ ID NO: 314430 - protein, 9 aa, Influenza virus
TEYRQEALQ

SEQ ID NO: 314431 - protein, 9 aa, Influenza virus
EYRQEALQN

SEQ ID NO: 314432 - protein, 9 aa, Influenza virus
YRQEALQNR

SEQ ID NO: 314433 - protein, 9 aa, Influenza virus
RQEALQNRI

SEQ ID NO: 314434 - protein, 9 aa, Influenza virus
QEALQNRIM

SEQ ID NO: 314435 - protein, 9 aa, Influenza virus
EALQNRIMI

SEQ ID NO: 314436 - protein, 9 aa, Influenza virus
ALQNRIMIN

SEQ ID NO: 314437 - protein, 9 aa, Influenza virus
LQNRIMINP

SEQ ID NO: 314438 - protein, 9 aa, Influenza virus
QNRIMINPV

SEQ ID NO: 314439 - protein, 9 aa, Influenza virus
NRIMINPVK

SEQ ID NO: 314440 - protein, 9 aa, Influenza virus
RIMINPVKL

SEQ ID NO: 314441 - protein, 9 aa, Influenza virus
IMINPVKLS

SEQ ID NO: 314442 - protein, 9 aa, Influenza virus
MINPVKLSS

SEQ ID NO: 314443 - protein, 9 aa, Influenza virus
INPVKLSSG

SEQ ID NO: 314444 - protein, 9 aa, Influenza virus
NPVKLSSGY

SEQ ID NO: 314445 - protein, 9 aa, Influenza virus
PVKLSSGYK

SEQ ID NO: 314446 - protein, 9 aa, Influenza virus
VKLSSGYKD

SEQ ID NO: 314447 - protein, 9 aa, Influenza virus
KLSSGYKDV

SEQ ID NO: 314448 - protein, 9 aa, Influenza virus
LSSGYKDVI

SEQ ID NO: 314449 - protein, 9 aa, Influenza virus
SSGYKDVIL

SEQ ID NO: 314450 - protein, 9 aa, Influenza virus
SGYKDVILW

SEQ ID NO: 314451 - protein, 9 aa, Influenza virus
GYKDVILWF

SEQ ID NO: 314452 - protein, 9 aa, Influenza virus
YKDVILWFS

SEQ ID NO: 314453 - protein, 9 aa, Influenza virus
KDVILWFSF

SEQ ID NO: 314454 - protein, 9 aa, Influenza virus
DVILWFSFG

SEQ ID NO: 314455 - protein, 9 aa, Influenza virus
VILWFSFGA

SEQ ID NO: 314456 - protein, 9 aa, Influenza virus
ILWFSFGAS

SEQ ID NO: 314457 - protein, 9 aa, Influenza virus
LWFSFGASC

SEQ ID NO: 314458 - protein, 9 aa, Influenza virus
WFSFGASCV

SEQ ID NO: 314459 - protein, 9 aa, Influenza virus
FSFGASCVM

SEQ ID NO: 314460 - protein, 9 aa, Influenza virus
SFGASCVML

SEQ ID NO: 314461 - protein, 9 aa, Influenza virus
FGASCVMLL

SEQ ID NO: 314462 - protein, 9 aa, Influenza virus
GASCVMLLA

SEQ ID NO: 314463 - protein, 9 aa, Influenza virus
ASCVMLLAI

SEQ ID NO: 314464 - protein, 9 aa, Influenza virus
SCVMLLAIA

SEQ ID NO: 314465 - protein, 9 aa, Influenza virus
CVMLLAIAM

SEQ ID NO: 314466 - protein, 9 aa, Influenza virus
VMLLAIAMG

SEQ ID NO: 314467 - protein, 9 aa, Influenza virus
MLLAIAMGL

SEQ ID NO: 314468 - protein, 9 aa, Influenza virus
LLAIAMGLI

SEQ ID NO: 314469 - protein, 9 aa, Influenza virus
LAIAMGLIF

SEQ ID NO: 314470 - protein, 9 aa, Influenza virus
AIAMGLIFM

SEQ ID NO: 314471 - protein, 9 aa, Influenza virus
IAMGLIFMC

SEQ ID NO: 314472 - protein, 9 aa, Influenza virus
AMGLIFMCV

SEQ ID NO: 314473 - protein, 9 aa, Influenza virus
MGLIFMCVK

SEQ ID NO: 314474 - protein, 9 aa, Influenza virus
GLIFMCVKN

SEQ ID NO: 314475 - protein, 9 aa, Influenza virus
LIFMCVKNG

SEQ ID NO: 314476 - protein, 9 aa, Influenza virus
IFMCVKNGN

SEQ ID NO: 314477 - protein, 9 aa, Influenza virus
FMCVKNGNL

SEQ ID NO: 314478 - protein, 9 aa, Influenza virus
MCVKNGNLR

SEQ ID NO: 314479 - protein, 9 aa, Influenza virus
CVKNGNLRC

SEQ ID NO: 314480 - protein, 9 aa, Influenza virus
VKNGNLRCT

SEQ ID NO: 314481 - protein, 9 aa, Influenza virus
KNGNLRCTI

SEQ ID NO: 314482 - protein, 9 aa, Influenza virus
NGNLRCTIC

SEQ ID NO: 314483 - protein, 9 aa, Influenza virus
GNLRCTICI

SEQ ID NO: 314484 - protein, 9 aa, Influenza virus
QPNDGQVLY

SEQ ID NO: 314485 - protein, 9 aa, Influenza virus
PNDGQVLYF

SEQ ID NO: 314486 - protein, 9 aa, Influenza virus
GRYSKADKI

SEQ ID NO: 314487 - protein, 9 aa, Influenza virus
RYSKADKIC

SEQ ID NO: 314488 - protein, 9 aa, Influenza virus
YSKADKICI

SEQ ID NO: 314489 - protein, 9 aa, Influenza virus
SKADKICIG

SEQ ID NO: 314490 - protein, 9 aa, Influenza virus
KADKICIGY

SEQ ID NO: 314491 - protein, 9 aa, Influenza virus
ADKICIGYL

SEQ ID NO: 314492 - protein, 9 aa, Influenza virus
DKICIGYLS

SEQ ID NO: 314493 - protein, 9 aa, Influenza virus
KICIGYLSN

SEQ ID NO: 314494 - protein, 9 aa, Influenza virus
ICIGYLSNN

SEQ ID NO: 314495 - protein, 9 aa, Influenza virus
CIGYLSNNS

SEQ ID NO: 314496 - protein, 9 aa, Influenza virus
IGYLSNNSS

SEQ ID NO: 314497 - protein, 9 aa, Influenza virus
GYLSNNSSD

SEQ ID NO: 314498 - protein, 9 aa, Influenza virus
YLSNNSSDT

SEQ ID NO: 314499 - protein, 9 aa, Influenza virus
LSNNSSDTV

SEQ ID NO: 314500 - protein, 9 aa, Influenza virus
SNNSSDTVD

SEQ ID NO: 314501 - protein, 9 aa, Influenza virus
NNSSDTVDT

SEQ ID NO: 314502 - protein, 9 aa, Influenza virus
NSSDTVDTL

SEQ ID NO: 314503 - protein, 9 aa, Influenza virus
SSDTVDTLT

SEQ ID NO: 314504 - protein, 9 aa, Influenza virus
SDTVDTLTE

SEQ ID NO: 314505 - protein, 9 aa, Influenza virus
DTVDTLTEN

SEQ ID NO: 314506 - protein, 9 aa, Influenza virus
TVDTLTENG

SEQ ID NO: 314507 - protein, 9 aa, Influenza virus
VDTLTENGV

SEQ ID NO: 314508 - protein, 9 aa, Influenza virus
DTLTENGVP

SEQ ID NO: 314509 - protein, 9 aa, Influenza virus
TLTENGVPV

SEQ ID NO: 314510 - protein, 9 aa, Influenza virus
LTENGVPVT

SEQ ID NO: 314511 - protein, 9 aa, Influenza virus
TENGVPVTS

SEQ ID NO: 314512 - protein, 9 aa, Influenza virus
ENGVPVTSS

SEQ ID NO: 314513 - protein, 9 aa, Influenza virus
NGVPVTSSI

SEQ ID NO: 314514 - protein, 9 aa, Influenza virus
GVPVTSSVD

SEQ ID NO: 314515 - protein, 9 aa, Influenza virus
VPVTSSVDL

SEQ ID NO: 314516 - protein, 9 aa, Influenza virus
PVTSSVDLV

SEQ ID NO: 314517 - protein, 9 aa, Influenza virus
VTSSVDLVE

SEQ ID NO: 314518 - protein, 9 aa, Influenza virus
TSSVDLVET

SEQ ID NO: 314519 - protein, 9 aa, Influenza virus
SSVDLVETN

SEQ ID NO: 314520 - protein, 9 aa, Influenza virus
SVDLVETNH

SEQ ID NO: 314521 - protein, 9 aa, Influenza virus
VDLVETNHT

SEQ ID NO: 314522 - protein, 9 aa, Influenza virus
DLVETNHTG

SEQ ID NO: 314523 - protein, 9 aa, Influenza virus
LVETNHTGT

SEQ ID NO: 314524 - protein, 9 aa, Influenza virus
VETNHTGTY

SEQ ID NO: 314525 - protein, 9 aa, Influenza virus
ETNHTGTYC

SEQ ID NO: 314526 - protein, 9 aa, Influenza virus
TNHTGTYCS

SEQ ID NO: 314527 - protein, 9 aa, Influenza virus
NHTGTYCSL

SEQ ID NO: 314528 - protein, 9 aa, Influenza virus
HTGTYCSLN

SEQ ID NO: 314529 - protein, 9 aa, Influenza virus
TGTYCSLNG

SEQ ID NO: 314530 - protein, 9 aa, Influenza virus
GTYCSLNGV

SEQ ID NO: 314531 - protein, 9 aa, Influenza virus
TYCSLNGVS

SEQ ID NO: 314532 - protein, 9 aa, Influenza virus
YCSLNGVSP

SEQ ID NO: 314533 - protein, 9 aa, Influenza virus
CSLNGVSPI

SEQ ID NO: 314534 - protein, 9 aa, Influenza virus
SLNGVSPIH

SEQ ID NO: 314535 - protein, 9 aa, Influenza virus
LNGVSPIHL

SEQ ID NO: 314536 - protein, 9 aa, Influenza virus
NGVSPIHLG

SEQ ID NO: 314537 - protein, 9 aa, Influenza virus
GVSPIHLGD

SEQ ID NO: 314538 - protein, 9 aa, Influenza virus
VSPIHLGDC

SEQ ID NO: 314539 - protein, 9 aa, Influenza virus
SPIHLGDCS

SEQ ID NO: 314540 - protein, 9 aa, Influenza virus
PIHLGDCSF

SEQ ID NO: 314541 - protein, 9 aa, Influenza virus
IHLGDCSFE

SEQ ID NO: 314542 - protein, 9 aa, Influenza virus
HLGDCSFEG

SEQ ID NO: 314543 - protein, 9 aa, Influenza virus
LGDCSFEGW

SEQ ID NO: 314544 - protein, 9 aa, Influenza virus
GDCSFEGWI

SEQ ID NO: 314545 - protein, 9 aa, Influenza virus
DCSFEGWIV

SEQ ID NO: 314546 - protein, 9 aa, Influenza virus
CSFEGWIVG

SEQ ID NO: 314547 - protein, 9 aa, Influenza virus
SFEGWIVGN

SEQ ID NO: 314548 - protein, 9 aa, Influenza virus
FEGWIVGNP

SEQ ID NO: 314549 - protein, 9 aa, Influenza virus
EGWIVGNPS

SEQ ID NO: 314550 - protein, 9 aa, Influenza virus
GWIVGNPSC

SEQ ID NO: 314551 - protein, 9 aa, Influenza virus
WIVGNPSCA

SEQ ID NO: 314552 - protein, 9 aa, Influenza virus
IVGNPSCAT

SEQ ID NO: 314553 - protein, 9 aa, Influenza virus
VGNPSCATN

SEQ ID NO: 314554 - protein, 9 aa, Influenza virus
GNPSCATNI

SEQ ID NO: 314555 - protein, 9 aa, Influenza virus
NPSCATNIN

SEQ ID NO: 314556 - protein, 9 aa, Influenza virus
PSCATNINI

SEQ ID NO: 314557 - protein, 9 aa, Influenza virus
SCATNINIR

SEQ ID NO: 314558 - protein, 9 aa, Influenza virus
CATNINIRE

SEQ ID NO: 314559 - protein, 9 aa, Influenza virus
ATNINIREW

SEQ ID NO: 314560 - protein, 9 aa, Influenza virus
TNINIREWS

SEQ ID NO: 314561 - protein, 9 aa, Influenza virus
NINIREWSY

SEQ ID NO: 314562 - protein, 9 aa, Influenza virus
INIREWSYL

SEQ ID NO: 314563 - protein, 9 aa, Influenza virus
NIREWSYLI

SEQ ID NO: 314564 - protein, 9 aa, Influenza virus
IREWSYLIE

SEQ ID NO: 314565 - protein, 9 aa, Influenza virus
REWSYLIED

SEQ ID NO: 314566 - protein, 9 aa, Influenza virus
EWSYLIEDP

SEQ ID NO: 314567 - protein, 9 aa, Influenza virus
WSYLIEDPN

SEQ ID NO: 314568 - protein, 9 aa, Influenza virus
SYLIEDPNA

SEQ ID NO: 314569 - protein, 9 aa, Influenza virus
YLIEDPNAP

SEQ ID NO: 314570 - protein, 9 aa, Influenza virus
LIEDPNAPN

SEQ ID NO: 314571 - protein, 9 aa, Influenza virus
IEDPNAPNK

SEQ ID NO: 314572 - protein, 9 aa, Influenza virus
EDPNAPNKL

SEQ ID NO: 314573 - protein, 9 aa, Influenza virus
DPNAPNKLC

SEQ ID NO: 314574 - protein, 9 aa, Influenza virus
PNAPNKLCF

SEQ ID NO: 314575 - protein, 9 aa, Influenza virus
NAPNKLCFP

SEQ ID NO: 314576 - protein, 9 aa, Influenza virus
APHKLCFPG

SEQ ID NO: 314577 - protein, 9 aa, Influenza virus
PNKLCFPGE

SEQ ID NO: 314578 - protein, 9 aa, Influenza virus
KLCFPGELD

SEQ ID NO: 314579 - protein, 9 aa, Influenza virus
LCFPGELDN

SEQ ID NO: 314580 - protein, 9 aa, Influenza virus
CFPGELDNN

SEQ ID NO: 314581 - protein, 9 aa, Influenza virus
FPGELDNNG

SEQ ID NO: 314582 - protein, 9 aa, Influenza virus
PGELDNNGE

SEQ ID NO: 314583 - protein, 9 aa, Influenza virus
GELDNNGEL

SEQ ID NO: 314584 - protein, 9 aa, Influenza virus
ELDNNGELR

SEQ ID NO: 314585 - protein, 9 aa, Influenza virus
LDNNGELRH

SEQ ID NO: 314586 - protein, 9 aa, Influenza virus
DNNGELRHL

SEQ ID NO: 314587 - protein, 9 aa, Influenza virus
NNGELRHLF

SEQ ID NO: 314588 - protein, 9 aa, Influenza virus
NGELRHLFS

SEQ ID NO: 314589 - protein, 9 aa, Influenza virus
GELRHLFSG

SEQ ID NO: 314590 - protein, 9 aa, Influenza virus
ELRHLFSGV

SEQ ID NO: 314591 - protein, 9 aa, Influenza virus
LRHLFSGVN

SEQ ID NO: 314592 - protein, 9 aa, Influenza virus
RHLFSGVNS

SEQ ID NO: 314593 - protein, 9 aa, Influenza virus
HLFSGVNSF

SEQ ID NO: 314594 - protein, 9 aa, Influenza virus
LFSGVNSFS

SEQ ID NO: 314595 - protein, 9 aa, Influenza virus
FSGVNSFSR

SEQ ID NO: 314596 - protein, 9 aa, Influenza virus
SGVNSFSRT

SEQ ID NO: 314597 - protein, 9 aa, Influenza virus
GVNSFSRTE

SEQ ID NO: 314598 - protein, 9 aa, Influenza virus
VNSFSRTEL

SEQ ID NO: 314599 - protein, 9 aa, Influenza virus
NSFSRTELI

SEQ ID NO: 314600 - protein, 9 aa, Influenza virus
SFSRTELIS

SEQ ID NO: 314601 - protein, 9 aa, Influenza virus
FSRTELISP

SEQ ID NO: 314602 - protein, 9 aa, Influenza virus
SRTELISPS

SEQ ID NO: 314603 - protein, 9 aa, Influenza virus
RTELISPSK

SEQ ID NO: 314604 - protein, 9 aa, Influenza virus
TELISPSKW

SEQ ID NO: 314605 - protein, 9 aa, Influenza virus
ELISPSKWG

SEQ ID NO: 314606 - protein, 9 aa, Influenza virus
PSKWGNVLD

SEQ ID NO: 314607 - protein, 9 aa, Influenza virus
SKWGNVLDG

SEQ ID NO: 314608 - protein, 9 aa, Influenza virus
KWGNVLDGV

SEQ ID NO: 314609 - protein, 9 aa, Influenza virus
WGNVLDGVT

SEQ ID NO: 314610 - protein, 9 aa, Influenza virus
GNVLDGVTA

SEQ ID NO: 314611 - protein, 9 aa, Influenza virus
NVLDGVTAS

SEQ ID NO: 314612 - protein, 9 aa, Influenza virus
VLDGVTASC

SEQ ID NO: 314613 - protein, 9 aa, Influenza virus
LDGVTASCL

SEQ ID NO: 314614 - protein, 9 aa, Influenza virus
DGVTASCLD

SEQ ID NO: 314615 - protein, 9 aa, Influenza virus
GVTASCLDR

SEQ ID NO: 314616 - protein, 9 aa, Influenza virus
VTASCLDRG

SEQ ID NO: 314617 - protein, 9 aa, Influenza virus
TASCLDRGA

SEQ ID NO: 314618 - protein, 9 aa, Influenza virus
GASSFYRNL

SEQ ID NO: 314619 - protein, 9 aa, Influenza virus
SSFYRNLVW

SEQ ID NO: 314620 - protein, 9 aa, Influenza virus
SFYRNLVWL

SEQ ID NO: 314621 - protein, 9 aa, Influenza virus
FYRNLVWLV

SEQ ID NO: 314622 - protein, 9 aa, Influenza virus
YRNLVWLVK

SEQ ID NO: 314623 - protein, 9 aa, Influenza virus
IGEYPVVKG

SEQ ID NO: 314624 - protein, 9 aa, Influenza virus
VKGEYNNTT

SEQ ID NO: 314625 - protein, 9 aa, Influenza virus
KGDYNNTTG

SEQ ID NO: 314626 - protein, 9 aa, Influenza virus
GDYNNTTGR

SEQ ID NO: 314627 - protein, 9 aa, Influenza virus
DYNNTTGRD

SEQ ID NO: 314628 - protein, 9 aa, Influenza virus
YNNTTGRDV

SEQ ID NO: 314629 - protein, 9 aa, Influenza virus
NNTTGRDVL

SEQ ID NO: 314630 - protein, 9 aa, Influenza virus
NTTGRDVLV

SEQ ID NO: 314631 - protein, 9 aa, Influenza virus
TTGRDVLVL

SEQ ID NO: 314632 - protein, 9 aa, Influenza virus
TGRDVLVLW

SEQ ID NO: 314633 - protein, 9 aa, Influenza virus
GRDVLVLWG

SEQ ID NO: 314634 - protein, 9 aa, Influenza virus
RDVLVLWGI

SEQ ID NO: 314635 - protein, 9 aa, Influenza virus
DVLVLWGIH

SEQ ID NO: 314636 - protein, 9 aa, Influenza virus
VLVLWGIHH

SEQ ID NO: 314637 - protein, 9 aa, Influenza virus
LVLWGIHHP

SEQ ID NO: 314638 - protein, 9 aa, Influenza virus
VLWGIHHPD

SEQ ID NO: 314639 - protein, 9 aa, Influenza virus
LWGIHHPDT

SEQ ID NO: 314640 - protein, 9 aa, Influenza virus
WGIHHPDTE

SEQ ID NO: 314641 - protein, 9 aa, Influenza virus
GIHHPDTEA

SEQ ID NO: 314642 - protein, 9 aa, Influenza virus
IHHPDTETT

SEQ ID NO: 314643 - protein, 9 aa, Influenza virus
HHPDTETTA

SEQ ID NO: 314644 - protein, 9 aa, Influenza virus
ATNLYVNKN

SEQ ID NO: 314645 - protein, 9 aa, Influenza virus
TNLYVNKNP

SEQ ID NO: 314646 - protein, 9 aa, Influenza virus
KLYVNKNPY

SEQ ID NO: 314647 - protein, 9 aa, Influenza virus
LYVNKNPYT

SEQ ID NO: 314648 - protein, 9 aa, Influenza virus
YVNKNPYTL

SEQ ID NO: 314649 - protein, 9 aa, Influenza virus
VNKNPYTLV

SEQ ID NO: 314650 - protein, 9 aa, Influenza virus
NKNPYTLVS

SEQ ID NO: 314651 - protein, 9 aa, Influenza virus
KNPYTLVST

SEQ ID NO: 314652 - protein, 9 aa, Influenza virus
NPYTLVSTK

SEQ ID NO: 314653 - protein, 9 aa, Influenza virus
PYTLVSTKE

SEQ ID NO: 314654 - protein, 9 aa, Influenza virus
YTLVSTKEW

SEQ ID NO: 314655 - protein, 9 aa, Influenza virus
TLVSTKEWS

SEQ ID NO: 314656 - protein, 9 aa, Influenza virus
LVSTKEWSK

SEQ ID NO: 314657 - protein, 9 aa, Influenza virus
VSTKEWSKR

SEQ ID NO: 314658 - protein, 9 aa, Influenza virus
STKEWSKRY

SEQ ID NO: 314659 - protein, 9 aa, Influenza virus
TKEWSKRYE

SEQ ID NO: 314660 - protein, 9 aa, Influenza virus
KEWSKRYEL

SEQ ID NO: 314661 - protein, 9 aa, Influenza virus
EWSKRYELE

SEQ ID NO: 314662 - protein, 9 aa, Influenza virus
WSKRYELEI

SEQ ID NO: 314663 - protein, 9 aa, Influenza virus
SKRYELEIG

SEQ ID NO: 314664 - protein, 9 aa, Influenza virus
KRYELEIGT

SEQ ID NO: 314665 - protein, 9 aa, Influenza virus
RYELEIGTR

SEQ ID NO: 314666 - protein, 9 aa, Influenza virus
YELEIGTRI

SEQ ID NO: 314667 - protein, 9 aa, Influenza virus
ELEIGTRIG

SEQ ID NO: 314668 - protein, 9 aa, Influenza virus
LEIGTRIGD

SEQ ID NO: 314669 - protein, 9 aa, Influenza virus
EIGTRIGDG

SEQ ID NO: 314670 - protein, 9 aa, Influenza virus
IGTRIGDGQ

SEQ ID NO: 314671 - protein, 9 aa, Influenza virus
GTRIGDGQR

SEQ ID NO: 314672 - protein, 9 aa, Influenza virus
TRIGDGQRS

SEQ ID NO: 314673 - protein, 9 aa, Influenza virus
RIGDGQRSW

SEQ ID NO: 314674 - protein, 9 aa, Influenza virus
IGDGQRSWM

SEQ ID NO: 314675 - protein, 9 aa, Influenza virus
GDGQRSWMK

SEQ ID NO: 314676 - protein, 9 aa, Influenza virus
DGQRSWMKL

SEQ ID NO: 314677 - protein, 9 aa, Influenza virus
GQRSWMKLY

SEQ ID NO: 314678 - protein, 9 aa, Influenza virus
QRSWMKLYW

SEQ ID NO: 314679 - protein, 9 aa, Influenza virus
RSWMKLYWH

SEQ ID NO: 314680 - protein, 9 aa, Influenza virus
SWMKLYWHL

SEQ ID NO: 314681 - protein, 9 aa, Influenza virus
WMKLYWHLM

SEQ ID NO: 314682 - protein, 9 aa, Influenza virus
MKIYWHLMH

SEQ ID NO: 314683 - protein, 9 aa, Influenza virus
KIYWHLMHP

SEQ ID NO: 314684 - protein, 9 aa, Influenza virus
IYWHLMHPG

SEQ ID NO: 314685 - protein, 9 aa, Influenza virus
YWHLMHPGE

SEQ ID NO: 314686 - protein, 9 aa, Influenza virus
WHLMHPGER

SEQ ID NO: 314687 - protein, 9 aa, Influenza virus
HLMHPGERI

SEQ ID NO: 314688 - protein, 9 aa, Influenza virus
PGERITFES

SEQ ID NO: 314689 - protein, 9 aa, Influenza virus
GERITFESN

SEQ ID NO: 314690 - protein, 9 aa, Influenza virus
ERITFESNG

SEQ ID NO: 314691 - protein, 9 aa, Influenza virus
RITFESNGG

SEQ ID NO: 314692 - protein, 9 aa, Influenza virus
ITFESNGGL

SEQ ID NO: 314693 - protein, 9 aa, Influenza virus
TFESNGGLL

SEQ ID NO: 314694 - protein, 9 aa, Influenza virus
FESNGGLLA

SEQ ID NO: 314695 - protein, 9 aa, Influenza virus
ESNGGLLAP

SEQ ID NO: 314696 - protein, 9 aa, Influenza virus
SNGGLLAPR

SEQ ID NO: 314697 - protein, 9 aa, Influenza virus
NGGLLAPRY

SEQ ID NO: 314698 - protein, 9 aa, Influenza virus
GGLLAPRYG

SEQ ID NO: 314699 - protein, 9 aa, Influenza virus
GLLAPRYGY

SEQ ID NO: 314700 - protein, 9 aa, Influenza virus
LLAPRYGYI

SEQ ID NO: 314701 - protein, 9 aa, Influenza virus
LAPRYGYII

SEQ ID NO: 314702 - protein, 9 aa, Influenza virus
APRYGYIIE

SEQ ID NO: 314703 - protein, 9 aa, Influenza virus
PRYGYIIEK

SEQ ID NO: 314704 - protein, 9 aa, Influenza virus
RYGYIIEKY

SEQ ID NO: 314705 - protein, 9 aa, Influenza virus
YGYIIEKYG

SEQ ID NO: 314706 - protein, 9 aa, Influenza virus
GYIIEKYGT

SEQ ID NO: 314707 - protein, 9 aa, Influenza virus
YIIEKYGTG

SEQ ID NO: 314708 - protein, 9 aa, Influenza virus
IIEKYGTGR

SEQ ID NO: 314709 - protein, 9 aa, Influenza virus
IEKYGTGRI

SEQ ID NO: 314710 - protein, 9 aa, Influenza virus
EKYGTGRIF

SEQ ID NO: 314711 - protein, 9 aa, Influenza virus
KYGTGRIFQ

SEQ ID NO: 314712 - protein, 9 aa, Influenza virus
YGTGRIFQS

SEQ ID NO: 314713 - protein, 9 aa, Influenza virus
GTGRIFQSG

SEQ ID NO: 314714 - protein, 9 aa, Influenza virus
TGRIFQSGV

SEQ ID NO: 314715 - protein, 9 aa, Influenza virus
GRIFQSGVR

SEQ ID NO: 314716 - protein, 9 aa, Influenza virus
RIFQSGVRM

SEQ ID NO: 314717 - protein, 9 aa, Influenza virus
IFQSGVRMA

SEQ ID NO: 314718 - protein, 9 aa, Influenza virus
RMAKCNTKC

SEQ ID NO: 314719 - protein, 9 aa, Influenza virus
MAKCNTKCQ

SEQ ID NO: 314720 - protein, 9 aa, Influenza virus
AKCNTKCQT

SEQ ID NO: 314721 - protein, 9 aa, Influenza virus
KCNTKCQTS

SEQ ID NO: 314722 - protein, 9 aa, Influenza virus
CNTKCQTSM

SEQ ID NO: 314723 - protein, 9 aa, Influenza virus
NTKCQTSMG

SEQ ID NO: 314724 - protein, 9 aa, Influenza virus
TKCQTSMGG

SEQ ID NO: 314725 - protein, 9 aa, Influenza virus
KCQTSVGGI

SEQ ID NO: 314726 - protein, 9 aa, Influenza virus
GGINTNKTF

SEQ ID NO: 314727 - protein, 9 aa, Influenza virus
GINTNKTFQ

SEQ ID NO: 314728 - protein, 9 aa, Influenza virus
INTNKTFQN

SEQ ID NO: 314729 - protein, 9 aa, Influenza virus
NTNKTFQNI

SEQ ID NO: 314730 - protein, 9 aa, Influenza virus
TNKTFQNIE

SEQ ID NO: 314731 - protein, 9 aa, Influenza virus
NKTFQNIER

SEQ ID NO: 314732 - protein, 9 aa, Influenza virus
KTFQNIERN

SEQ ID NO: 314733 - protein, 9 aa, Influenza virus
TFQNIERNA

SEQ ID NO: 314734 - protein, 9 aa, Influenza virus
FQNIERNAL

SEQ ID NO: 314735 - protein, 9 aa, Influenza virus
QNIERNALG

SEQ ID NO: 314736 - protein, 9 aa, Influenza virus
NIERNALGD

SEQ ID NO: 314737 - protein, 9 aa, Influenza virus
IERNALGDC

SEQ ID NO: 314738 - protein, 9 aa, Influenza virus
ERNALGDCP

SEQ ID NO: 314739 - protein, 9 aa, Influenza virus
RNALGDCPK

SEQ ID NO: 314740 - protein, 9 aa, Influenza virus
NALGDCPKY

SEQ ID NO: 314741 - protein, 9 aa, Influenza virus
ALGDCPKYI

SEQ ID NO: 314742 - protein, 9 aa, Influenza virus
LGDCPKYIK

SEQ ID NO: 314743 - protein, 9 aa, Influenza virus
GDCPKYIKS

SEQ ID NO: 314744 - protein, 9 aa, Influenza virus
DCPKYIKSG

SEQ ID NO: 314745 - protein, 9 aa, Influenza virus
CPKYIKSGQ

SEQ ID NO: 314746 - protein, 9 aa, Influenza virus
PKYIKSGQL

SEQ ID NO: 314747 - protein, 9 aa, Influenza virus
KYIKSGQLK

SEQ ID NO: 314748 - protein, 9 aa, Influenza virus
YIKSGQLKL

SEQ ID NO: 314749 - protein, 9 aa, Influenza virus
IKSGQLKLA

SEQ ID NO: 314750 - protein, 9 aa, Influenza virus
KSGQLKLAT

SEQ ID NO: 314751 - protein, 9 aa, Influenza virus
SGQLKLATG

SEQ ID NO: 314752 - protein, 9 aa, Influenza virus
GQLKLATGL

SEQ ID NO: 314753 - protein, 9 aa, Influenza virus
QLKLATGLR

SEQ ID NO: 314754 - protein, 9 aa, Influenza virus
LKLATGLRN

SEQ ID NO: 314755 - protein, 9 aa, Influenza virus
KLATGLRNV

SEQ ID NO: 314756 - protein, 9 aa, Influenza virus
LATGLRNVP

SEQ ID NO: 314757 - protein, 9 aa, Influenza virus
ATGLRNVPS

SEQ ID NO: 314758 - protein, 9 aa, Influenza virus
TGLRNVPSI

SEQ ID NO: 314759 - protein, 9 aa, Influenza virus
IPIGERGLF

SEQ ID NO: 314760 - protein, 9 aa, Influenza virus
GERGLFGAI

SEQ ID NO: 314761 - protein, 9 aa, Influenza virus
ERGLFGAIA

SEQ ID NO: 314762 - protein, 9 aa, Influenza virus
RGLFGAIAG

SEQ ID NO: 314763 - protein, 9 aa, Influenza virus
GLFGAIAGF

SEQ ID NO: 314764 - protein, 9 aa, Influenza virus
LFGAIAGFI

SEQ ID NO: 314765 - protein, 9 aa, Influenza virus
FGAIAGFIE

SEQ ID NO: 314766 - protein, 9 aa, Influenza virus
GAIAGFIEG

SEQ ID NO: 314767 - protein, 9 aa, Influenza virus
AIAGFIEGG

SEQ ID NO: 314768 - protein, 9 aa, Influenza virus
IAGFIEGGW

SEQ ID NO: 314769 - protein, 9 aa, Influenza virus
AGFIEGGWP

SEQ ID NO: 314770 - protein, 9 aa, Influenza virus
GFIEGGWPG

SEQ ID NO: 314771 - protein, 9 aa, Influenza virus
FIEGGWPGL

SEQ ID NO: 314772 - protein, 9 aa, Influenza virus
IEGGWPGLI

SEQ ID NO: 314773 - protein, 9 aa, Influenza virus
EGGWPGLIN

SEQ ID NO: 314774 - protein, 9 aa, Influenza virus
GGWPGLING

SEQ ID NO: 314775 - protein, 9 aa, Influenza virus
GWPGLINGW

SEQ ID NO: 314776 - protein, 9 aa, Influenza virus
WPGLINGWY

SEQ ID NO: 314777 - protein, 9 aa, Influenza virus
PGLINGWYG

SEQ ID NO: 314778 - protein, 9 aa, Influenza virus
GLINGWYGF

SEQ ID NO: 314779 - protein, 9 aa, Influenza virus
LINGWYGFQ

SEQ ID NO: 314780 - protein, 9 aa, Influenza virus
INGWYGFQH

SEQ ID NO: 314781 - protein, 9 aa, Influenza virus
NGWYGFQHQ

SEQ ID NO: 314782 - protein, 9 aa, Influenza virus
GWYGFQHQN

SEQ ID NO: 314783 - protein, 9 aa, Influenza virus
WYGFQHQNE

SEQ ID NO: 314784 - protein, 9 aa, Influenza virus
YGFQHQNEQ

SEQ ID NO: 314785 - protein, 9 aa, Influenza virus
GFQHQNEQG

SEQ ID NO: 314786 - protein, 9 aa, Influenza virus
FQHQNEQGT

SEQ ID NO: 314787 - protein, 9 aa, Influenza virus
QHQNEQGTG

SEQ ID NO: 314788 - protein, 9 aa, Influenza virus
HQNEQGTGI

SEQ ID NO: 314789 - protein, 9 aa, Influenza virus
QNEQGTGIA

SEQ ID NO: 314790 - protein, 9 aa, Influenza virus
NEQGTGIAA

SEQ ID NO: 314791 - protein, 9 aa, Influenza virus
EQGTGIAAD

SEQ ID NO: 314792 - protein, 9 aa, Influenza virus
QGTGIAADK

SEQ ID NO: 314793 - protein, 9 aa, Influenza virus
GTGIAADKA

SEQ ID NO: 314794 - protein, 9 aa, Influenza virus
TGIAADKAS

SEQ ID NO: 314795 - protein, 9 aa, Influenza virus
GIAADKAST

SEQ ID NO: 314796 - protein, 9 aa, Influenza virus
IAADKASTQ

SEQ ID NO: 314797 - protein, 9 aa, Influenza virus
AADKASTQK

SEQ ID NO: 314798 - protein, 9 aa, Influenza virus
ADKASTQKA

SEQ ID NO: 314799 - protein, 9 aa, Influenza virus
DKASTQKAI

SEQ ID NO: 314800 - protein, 9 aa, Influenza virus
KASTQKAID

SEQ ID NO: 314801 - protein, 9 aa, Influenza virus
ASTQKAIDE

SEQ ID NO: 314802 - protein, 9 aa, Influenza virus
STQKAINEI

SEQ ID NO: 314803 - protein, 9 aa, Influenza virus
TQKAINEIT

SEQ ID NO: 314804 - protein, 9 aa, Influenza virus
QKAINEITT

SEQ ID NO: 314805 - protein, 9 aa, Influenza virus
KAINEITTK

SEQ ID NO: 314806 - protein, 9 aa, Influenza virus
AINEITTKI

SEQ ID NO: 314807 - protein, 9 aa, Influenza virus
INEITTKIN

SEQ ID NO: 314808 - protein, 9 aa, Influenza virus
NEITTKINN

SEQ ID NO: 314809 - protein, 9 aa, Influenza virus
EITTKINNI

SEQ ID NO: 314810 - protein, 9 aa, Influenza virus
ITTKINNII

SEQ ID NO: 314811 - protein, 9 aa, Influenza virus
TTKINNIIE

SEQ ID NO: 314812 - protein, 9 aa, Influenza virus
TKINNIIEK

SEQ ID NO: 314813 - protein, 9 aa, Influenza virus
KINNIIEKM

SEQ ID NO: 314814 - protein, 9 aa, Influenza virus
INNIIEKMN

SEQ ID NO: 314815 - protein, 9 aa, Influenza virus
NNIIEKMNG

SEQ ID NO: 314816 - protein, 9 aa, Influenza virus
NIIEKMNGN

SEQ ID NO: 314817 - protein, 9 aa, Influenza virus
IIEKMNGNY

SEQ ID NO: 314818 - protein, 9 aa, Influenza virus
IEKMNGNYD

SEQ ID NO: 314819 - protein, 9 aa, Influenza virus
EKMNGNYDS

SEQ ID NO: 314820 - protein, 9 aa, Influenza virus
KMNGNYDSI

SEQ ID NO: 314821 - protein, 9 aa, Influenza virus
MNGNYDSIR

SEQ ID NO: 314822 - protein, 9 aa, Influenza virus
NGNYDSIRG

SEQ ID NO: 314823 - protein, 9 aa, Influenza virus
GNYDSIRGE

SEQ ID NO: 314824 - protein, 9 aa, Influenza virus
NYDSIRGEF

SEQ ID NO: 314825 - protein, 9 aa, Influenza virus
YDSIRGEFN

SEQ ID NO: 314826 - protein, 9 aa, Influenza virus
DSIRGEFNQ

SEQ ID NO: 314827 - protein, 9 aa, Influenza virus
SIRGEFNQV

SEQ ID NO: 314828 - protein, 9 aa, Influenza virus
IRGEFNQVE

SEQ ID NO: 314829 - protein, 9 aa, Influenza virus
RGEFNQVEK

SEQ ID NO: 314830 - protein, 9 aa, Influenza virus
GEFNQVEKR

SEQ ID NO: 314831 - protein, 9 aa, Influenza virus
EFNQVEKRI

SEQ ID NO: 314832 - protein, 9 aa, Influenza virus
FNQVEKRIN

SEQ ID NO: 314833 - protein, 9 aa, Influenza virus
NQVEKRINM

SEQ ID NO: 314834 - protein, 9 aa, Influenza virus
QVEKRINML

SEQ ID NO: 314835 - protein, 9 aa, Influenza virus
VEKRINMLA

SEQ ID NO: 314836 - protein, 9 aa, Influenza virus
EKRINMLAD

SEQ ID NO: 314837 - protein, 9 aa, Influenza virus
KRINMLADR

SEQ ID NO: 314838 - protein, 9 aa, Influenza virus
RINMLADRV

SEQ ID NO: 314839 - protein, 9 aa, Influenza virus
INMLADRVD

SEQ ID NO: 314840 - protein, 9 aa, Influenza virus
NMLADRVDD

SEQ ID NO: 314841 - protein, 9 aa, Influenza virus
MLADRVDDA

SEQ ID NO: 314842 - protein, 9 aa, Influenza virus
LADRVDDAV

SEQ ID NO: 314843 - protein, 9 aa, Influenza virus
ADRVDDAVT

SEQ ID NO: 314844 - protein, 9 aa, Influenza virus
DRVDDAVTD

SEQ ID NO: 314845 - protein, 9 aa, Influenza virus
RVDDAVTDI

SEQ ID NO: 314846 - protein, 9 aa, Influenza virus
VDDAVTDIW

SEQ ID NO: 314847 - protein, 9 aa, Influenza virus
DDAVTDIWS

SEQ ID NO: 314848 - protein, 9 aa, Influenza virus
DAVTDIWSY

SEQ ID NO: 314849 - protein, 9 aa, Influenza virus
AVTDIWSYN

SEQ ID NO: 314850 - protein, 9 aa, Influenza virus
VTDIWSYNA

SEQ ID NO: 314851 - protein, 9 aa, Influenza virus
TDIWSYNAK

SEQ ID NO: 314852 - protein, 9 aa, Influenza virus
DIWSYNAKL

SEQ ID NO: 314853 - protein, 9 aa, Influenza virus
IWSYNAKLL

SEQ ID NO: 314854 - protein, 9 aa, Influenza virus
WSYNAKLLV

SEQ ID NO: 314855 - protein, 9 aa, Influenza virus
SYNAKLLVL

SEQ ID NO: 314856 - protein, 9 aa, Influenza virus
YNAKLLVLI

SEQ ID NO: 314857 - protein, 9 aa, Influenza virus
NAKLLVLIE

SEQ ID NO: 314858 - protein, 9 aa, Influenza virus
AKLLVLIEN

SEQ ID NO: 314859 - protein, 9 aa, Influenza virus
KLLVLIEND

SEQ ID NO: 314860 - protein, 9 aa, Influenza virus
LLVLIENDR

SEQ ID NO: 314861 - protein, 9 aa, Influenza virus
LVLIENDRT

SEQ ID NO: 314862 - protein, 9 aa, Influenza virus
VLIENDRTL

SEQ ID NO: 314863 - protein, 9 aa, Influenza virus
LIENDRTLD

SEQ ID NO: 314864 - protein, 9 aa, Influenza virus
IENDRTLDL

SEQ ID NO: 314865 - protein, 9 aa, Influenza virus
ENDRTLDLH

SEQ ID NO: 314866 - protein, 9 aa, Influenza virus
NDRTLDLHD

SEQ ID NO: 314867 - protein, 9 aa, Influenza virus
DRTLDLHDA

SEQ ID NO: 314868 - protein, 9 aa, Influenza virus
RTLDLHDAN

SEQ ID NO: 314869 - protein, 9 aa, Influenza virus
TLDLHDANV

SEQ ID NO: 314870 - protein, 9 aa, Influenza virus
LDLHDANVR

SEQ ID NO: 314871 - protein, 9 aa, Influenza virus
DLHDANVRN

SEQ ID NO: 314872 - protein, 9 aa, Influenza virus
LHDANVRNL

SEQ ID NO: 314873 - protein, 9 aa, Influenza virus
HDANVRNLH

SEQ ID NO: 314874 - protein, 9 aa, Influenza virus
DANVRNLHD

SEQ ID NO: 314875 - protein, 9 aa, Influenza virus
ANVRNLHDQ

SEQ ID NO: 314876 - protein, 9 aa, Influenza virus
NVRNLHDQV

SEQ ID NO: 314877 - protein, 9 aa, Influenza virus
VRNLHDQVK

SEQ ID NO: 314878 - protein, 9 aa, Influenza virus
RNLHDQVKR

SEQ ID NO: 314879 - protein, 9 aa, Influenza virus
LKNNAIDEG

SEQ ID NO: 314880 - protein, 9 aa, Influenza virus
KNNAIDEGD

SEQ ID NO: 314881 - protein, 9 aa, Influenza virus
NNAIDEGDG

SEQ ID NO: 314882 - protein, 9 aa, Influenza virus
NAIDEGDGC

SEQ ID NO: 314883 - protein, 9 aa, Influenza virus
AIDEGDGCF

SEQ ID NO: 314884 - protein, 9 aa, Influenza virus
IDEGDGCFN

SEQ ID NO: 314885 - protein, 9 aa, Influenza virus
DEGDGCFNL

SEQ ID NO: 314886 - protein, 9 aa, Influenza virus
EGDGCFNLL

SEQ ID NO: 314887 - protein, 9 aa, Influenza virus
GDGCFNLLH

SEQ ID NO: 314888 - protein, 9 aa, Influenza virus
DGCFNLLHK

SEQ ID NO: 314889 - protein, 9 aa, Influenza virus
GCFNLLHKC

SEQ ID NO: 314890 - protein, 9 aa, Influenza virus
CFNLLHKCN

SEQ ID NO: 314891 - protein, 9 aa, Influenza virus
FNLLHKCND

SEQ ID NO: 314892 - protein, 9 aa, Influenza virus
NLLHKCNDS

SEQ ID NO: 314893 - protein, 9 aa, Influenza virus
LLHKCNDSC

SEQ ID NO: 314894 - protein, 9 aa, Influenza virus
LHKCNDSCM

SEQ ID NO: 314895 - protein, 9 aa, Influenza virus
HKCNDSCME

SEQ ID NO: 314896 - protein, 9 aa, Influenza virus
KCNDSCMET

SEQ ID NO: 314897 - protein, 9 aa, Influenza virus
CNDSCMETI

SEQ ID NO: 314898 - protein, 9 aa, Influenza virus
NDSCMETIR

SEQ ID NO: 314899 - protein, 9 aa, Influenza virus
DSCMETIRN

SEQ ID NO: 314900 - protein, 9 aa, Influenza virus
SCMETIRNG

SEQ ID NO: 314901 - protein, 9 aa, Influenza virus
CMETIRNGT

SEQ ID NO: 314902 - protein, 9 aa, Influenza virus
METIRNGTY

SEQ ID NO: 314903 - protein, 9 aa, Influenza virus
ETIRNGTYN

SEQ ID NO: 314904 - protein, 9 aa, Influenza virus
TIRNGTYNH

SEQ ID NO: 314905 - protein, 9 aa, Influenza virus
IRNGTYNHE

SEQ ID NO: 314906 - protein, 9 aa, Influenza virus
RNGTYNHED

SEQ ID NO: 314907 - protein, 9 aa, Influenza virus
NGTYNHEDY

SEQ ID NO: 314908 - protein, 9 aa, Influenza virus
GTYNHEDYK

SEQ ID NO: 314909 - protein, 9 aa, Influenza virus
TYNHEDYKE

SEQ ID NO: 314910 - protein, 9 aa, Influenza virus
YNHEDYKEE

SEQ ID NO: 314911 - protein, 9 aa, Influenza virus
NHEDYKEES

SEQ ID NO: 314912 - protein, 9 aa, Influenza virus
HEDYKEESQ

SEQ ID NO: 314913 - protein, 9 aa, Influenza virus
EDYKEESQL

SEQ ID NO: 314914 - protein, 9 aa, Influenza virus
DYKEESQLK

SEQ ID NO: 314915 - protein, 9 aa, Influenza virus
YKEESQLKR

SEQ ID NO: 314916 - protein, 9 aa, Influenza virus
KEESQLKRQ

SEQ ID NO: 314917 - protein, 9 aa, Influenza virus
EESQLKRQE

SEQ ID NO: 314918 - protein, 9 aa, Influenza virus
ESQLKRQEI

SEQ ID NO: 314919 - protein, 9 aa, Influenza virus
SQLKRQEIE

SEQ ID NO: 314920 - protein, 9 aa, Influenza virus
QLKRQEIEG

SEQ ID NO: 314921 - protein, 9 aa, Influenza virus
LKRQEIEGI

SEQ ID NO: 314922 - protein, 9 aa, Influenza virus
KRQEIEGIK

SEQ ID NO: 314923 - protein, 9 aa, Influenza virus
RQEIEGIKL

SEQ ID NO: 314924 - protein, 9 aa, Influenza virus
QEIEGIKLK

SEQ ID NO: 314925 - protein, 9 aa, Influenza virus
EIEGIKLKT

SEQ ID NO: 314926 - protein, 9 aa, Influenza virus
IEGIKLKTE

SEQ ID NO: 314927 - protein, 9 aa, Influenza virus
EGIKLKTED

SEQ ID NO: 314928 - protein, 9 aa, Influenza virus
GIKLKTEDN

SEQ ID NO: 314929 - protein, 9 aa, Influenza virus
IKLKTEDNV

SEQ ID NO: 314930 - protein, 9 aa, Influenza virus
KLKTEDNVY

SEQ ID NO: 314931 - protein, 9 aa, Influenza virus
LKTEDNVYK

SEQ ID NO: 314932 - protein, 9 aa, Influenza virus
KTEDNVYKV

SEQ ID NO: 314933 - protein, 9 aa, Influenza virus
TEDNVYKVL

SEQ ID NO: 314934 - protein, 9 aa, Influenza virus
EDNVYKVLS

SEQ ID NO: 314935 - protein, 9 aa, Influenza virus
DNVYKVLSI

SEQ ID NO: 314936 - protein, 9 aa, Influenza virus
NVYKVLSIY

SEQ ID NO: 314937 - protein, 9 aa, Influenza virus
VYKVLSIYS

SEQ ID NO: 314938 - protein, 9 aa, Influenza virus
YKILSIYSC

SEQ ID NO: 314939 - protein, 9 aa, Influenza virus
KILSIYSCI

SEQ ID NO: 314940 - protein, 9 aa, Influenza virus
ILSIYSCIA

SEQ ID NO: 314941 - protein, 9 aa, Influenza virus
LSIYSCIAS

SEQ ID NO: 314942 - protein, 9 aa, Influenza virus
SIYSCIASS

SEQ ID NO: 314943 - protein, 9 aa, Influenza virus
IYSCIASSI

SEQ ID NO: 314944 - protein, 9 aa, Influenza virus
YSCIASSIV

SEQ ID NO: 314945 - protein, 9 aa, Influenza virus
SCIASSVVL

SEQ ID NO: 314946 - protein, 9 aa, Influenza virus
CIASSIVLV

SEQ ID NO: 314947 - protein, 9 aa, Influenza virus
IASSIVLVG

SEQ ID NO: 314948 - protein, 9 aa, Influenza virus
ASSIVMVGL

SEQ ID NO: 314949 - protein, 9 aa, Influenza virus
SSIVMVGLI

SEQ ID NO: 314950 - protein, 9 aa, Influenza virus
SIVLVGLIL

SEQ ID NO: 314951 - protein, 9 aa, Influenza virus
IVMVGLILA

SEQ ID NO: 314952 - protein, 9 aa, Influenza virus
VLVGLILAF

SEQ ID NO: 314953 - protein, 9 aa, Influenza virus
LVGLILAFI

SEQ ID NO: 314954 - protein, 9 aa, Influenza virus
VGLILAFIM

SEQ ID NO: 314955 - protein, 9 aa, Influenza virus
GLILAFIMW

SEQ ID NO: 314956 - protein, 9 aa, Influenza virus
LILAFIMWA

SEQ ID NO: 314957 - protein, 9 aa, Influenza virus
ILAFIMWAC

SEQ ID NO: 314958 - protein, 9 aa, Influenza virus
LAFIMWACS

SEQ ID NO: 314959 - protein, 9 aa, Influenza virus
AFIMWACSS

SEQ ID NO: 314960 - protein, 9 aa, Influenza virus
FIMWACSSG

SEQ ID NO: 314961 - protein, 9 aa, Influenza virus
IMWACSSGN

SEQ ID NO: 314962 - protein, 9 aa, Influenza virus
MWACSSGNC

SEQ ID NO: 314963 - protein, 9 aa, Influenza virus
WACSSGNCR

SEQ ID NO: 314964 - protein, 9 aa, Influenza virus
ACSSGNCRF

SEQ ID NO: 314965 - protein, 9 aa, Influenza virus
CSSGNCRFN

SEQ ID NO: 314966 - protein, 9 aa, Influenza virus
SSGNCRFNV

SEQ ID NO: 314967 - protein, 9 aa, Influenza virus
SGNCRFNVC

SEQ ID NO: 314968 - protein, 9 aa, Influenza virus
GNCRFNVCI

SEQ ID NO: 314969 - protein, 9 aa, Influenza virus
KQGKTKATK

SEQ ID NO: 314970 - protein, 9 aa, Influenza virus
QGKTKATKM

SEQ ID NO: 314971 - protein, 9 aa, Influenza virus
GKTKATKMK

SEQ ID NO: 314972 - protein, 9 aa, Influenza virus
KTKATKMKA

SEQ ID NO: 314973 - protein, 9 aa, Influenza virus
TKATKMKAI

SEQ ID NO: 314974 - protein, 9 aa, Influenza virus
KATKMKAIL

SEQ ID NO: 314975 - protein, 9 aa, Influenza virus
ATKMKAILV

SEQ ID NO: 314976 - protein, 9 aa, Influenza virus
TKMKAILVV

SEQ ID NO: 314977 - protein, 9 aa, Influenza virus
TAYSQITNG

SEQ ID NO: 314978 - protein, 9 aa, Influenza virus
AYSQITNGT

SEQ ID NO: 314979 - protein, 9 aa, Influenza virus
YSQITNGTT

SEQ ID NO: 314980 - protein, 9 aa, Influenza virus
SQITNGTTG

SEQ ID NO: 314981 - protein, 9 aa, Influenza virus
QITNGTTGN

SEQ ID NO: 314982 - protein, 9 aa, Influenza virus
ITNGTTGNP

SEQ ID NO: 314983 - protein, 9 aa, Influenza virus
TNGTTGNPI

SEQ ID NO: 314984 - protein, 9 aa, Influenza virus
NGTTGNPII

SEQ ID NO: 314985 - protein, 9 aa, Influenza virus
GTTGNPIIC

SEQ ID NO: 314986 - protein, 9 aa, Influenza virus
TTGNPIICL

SEQ ID NO: 314987 - protein, 9 aa, Influenza virus
TGNPIICLG

SEQ ID NO: 314988 - protein, 9 aa, Influenza virus
SNAPSGIEY

SEQ ID NO: 314989 - protein, 9 aa, Influenza virus
NAPSGIEYN

SEQ ID NO: 314990 - protein, 9 aa, Influenza virus
APSGIEYNG

SEQ ID NO: 314991 - protein, 9 aa, Influenza virus
PSGIEYNGK

SEQ ID NO: 314992 - protein, 9 aa, Influenza virus
SGIEYNGKS

SEQ ID NO: 314993 - protein, 9 aa, Influenza virus
GIEYNGKSL

SEQ ID NO: 314994 - protein, 9 aa, Influenza virus
IEYNGKSLG

SEQ ID NO: 314995 - protein, 9 aa, Influenza virus
EYNGKSLGI

SEQ ID NO: 314996 - protein, 9 aa, Influenza virus
YNGKSLGIQ

SEQ ID NO: 314997 - protein, 9 aa, Influenza virus
NGKSLGIQS

SEQ ID NO: 314998 - protein, 9 aa, Influenza virus
TSLTSLPFQ

SEQ ID NO: 314999 - protein, 9 aa, Influenza virus
SLTSLPFQN

SEQ ID NO: 315000 - protein, 9 aa, Influenza virus
LTSLPFQNI

SEQ ID NO: 315001 - protein, 9 aa, Influenza virus
RGLFGAIAG

SEQ ID NO: 315002 - protein, 9 aa, Influenza virus
GLFGAIAGF

SEQ ID NO: 315003 - protein, 9 aa, Influenza virus
LFGAIAGFI

SEQ ID NO: 315004 - protein, 9 aa, Influenza virus
FGAIAGFIE

SEQ ID NO: 315005 - protein, 9 aa, Influenza virus
GAIAGFIEG

SEQ ID NO: 315006 - protein, 9 aa, Influenza virus
AIAGFIEGG

SEQ ID NO: 315007 - protein, 9 aa, Influenza virus
IAGFIEGGW

SEQ ID NO: 315008 - protein, 9 aa, Influenza virus
AGFIEGGWT

SEQ ID NO: 315009 - protein, 9 aa, Influenza virus
GFIEGGWTG

SEQ ID NO: 315010 - protein, 9 aa, Influenza virus
FIEGGWTGM

SEQ ID NO: 315011 - protein, 9 aa, Influenza virus
IEGGWTGMV

SEQ ID NO: 315012 - protein, 9 aa, Influenza virus
EGGWTGMVD

SEQ ID NO: 315013 - protein, 9 aa, Influenza virus
GGWTGMVDG

SEQ ID NO: 315014 - protein, 9 aa, Influenza virus
GWTGMVDGW

SEQ ID NO: 315015 - protein, 9 aa, Influenza virus
WTGMVDGWY

SEQ ID NO: 315016 - protein, 9 aa, Influenza virus
TGMVDGWYG

SEQ ID NO: 315017 - protein, 9 aa, Influenza virus
GMVDGWYGY

SEQ ID NO: 315018 - protein, 9 aa, Influenza virus
MVDGWYGYH

SEQ ID NO: 315019 - protein, 9 aa, Influenza virus
VDGWYGYHH

SEQ ID NO: 315020 - protein, 9 aa, Influenza virus
DGWYGYHHQ

SEQ ID NO: 315021 - protein, 9 aa, Influenza virus
GWYGYHHQN

SEQ ID NO: 315022 - protein, 9 aa, Influenza virus
YNAELLVLL

SEQ ID NO: 315023 - protein, 9 aa, Influenza virus
NAELLVLLE

SEQ ID NO: 315024 - protein, 9 aa, Influenza virus
AELLVLLEN

SEQ ID NO: 315025 - protein, 9 aa, Influenza virus
LLENERTLD

SEQ ID NO: 315026 - protein, 9 aa, Influenza virus
GNGCFEFYH

SEQ ID NO: 315027 - protein, 9 aa, Influenza virus
LAIYSTVAS

SEQ ID NO: 315028 - protein, 9 aa, Influenza virus
LCSVEYASK

SEQ ID NO: 315029 - protein, 9 aa, Influenza virus
CSVEYASKT

SEQ ID NO: 315030 - protein, 9 aa, Influenza virus
SVEYASKTR

SEQ ID NO: 315031 - protein, 9 aa, Influenza virus
VEYASKTRI

SEQ ID NO: 315032 - protein, 9 aa, Influenza virus
EYASKTRIS

SEQ ID NO: 315033 - protein, 9 aa, Influenza virus
YASKTRISE

SEQ ID NO: 315034 - protein, 9 aa, Influenza virus
QCRICIRAD

SEQ ID NO: 315035 - protein, 9 aa, Influenza virus
CRICIRADG

SEQ ID NO: 315036 - protein, 9 aa, Influenza virus
RICILDQNF

SEQ ID NO: 315037 - protein, 9 aa, Influenza virus
ICIDFRDMR

SEQ ID NO: 315038 - protein, 9 aa, Influenza virus
CILDQNFRN

SEQ ID NO: 315039 - protein, 9 aa, Influenza virus
ILDQNFRNI

SEQ ID NO: 315040 - protein, 9 aa, Influenza virus
DFRDMRKNT

SEQ ID NO: 315041 - protein, 9 aa, Influenza virus
DQNFRNIRK

SEQ ID NO: 315042 - protein, 9 aa, Influenza virus
KQGKTKATK

SEQ ID NO: 315043 - protein, 9 aa, Influenza virus
QGKTKATKM

SEQ ID NO: 315044 - protein, 9 aa, Influenza virus
GKTKATKMK

SEQ ID NO: 315045 - protein, 9 aa, Influenza virus
KTKATKMKA

SEQ ID NO: 315046 - protein, 9 aa, Influenza virus
TKATKMKAI

SEQ ID NO: 315047 - protein, 9 aa, Influenza virus
KATKMKAIL

SEQ ID NO: 315048 - protein, 9 aa, Influenza virus
ATKMKAILV

SEQ ID NO: 315049 - protein, 9 aa, Influenza virus
TKMKAILVV

SEQ ID NO: 315050 - protein, 9 aa, Influenza virus
KMKAILVVL

SEQ ID NO: 315051 - protein, 9 aa, Influenza virus
IIIVVLLYT

SEQ ID NO: 315052 - protein, 9 aa, Influenza virus
ADTLCIGYH

SEQ ID NO: 315053 - protein, 9 aa, Influenza virus
DTLCIGYHA

SEQ ID NO: 315054 - protein, 9 aa, Influenza virus
TLCIGYHAN

SEQ ID NO: 315055 - protein, 9 aa, Influenza virus
LCIGYHANN

SEQ ID NO: 315056 - protein, 9 aa, Influenza virus
CIGYHANNS

SEQ ID NO: 315057 - protein, 9 aa, Influenza virus
IGYHANNST

SEQ ID NO: 315058 - protein, 9 aa, Influenza virus
GYHANNSTD

SEQ ID NO: 315059 - protein, 9 aa, Influenza virus
YHANNSTDT

SEQ ID NO: 315060 - protein, 9 aa, Influenza virus
HANNSTDTV

SEQ ID NO: 315061 - protein, 9 aa, Influenza virus
ANNSTDTVD

SEQ ID NO: 315062 - protein, 9 aa, Influenza virus
NNSTDTVDT

SEQ ID NO: 315063 - protein, 9 aa, Influenza virus
NSTDTVDTV

SEQ ID NO: 315064 - protein, 9 aa, Influenza virus
STDTVDTVL

SEQ ID NO: 315065 - protein, 9 aa, Influenza virus
TDTVDTVLE

SEQ ID NO: 315066 - protein, 9 aa, Influenza virus
DTVDTVLEK

SEQ ID NO: 315067 - protein, 9 aa, Influenza virus
TVDTVLEKN

SEQ ID NO: 315068 - protein, 9 aa, Influenza virus
VDTVLEKNV

SEQ ID NO: 315069 - protein, 9 aa, Influenza virus
DTVLEKNVT

SEQ ID NO: 315070 - protein, 9 aa, Influenza virus
TVLEKNVTV

SEQ ID NO: 315071 - protein, 9 aa, Influenza virus
VLEKNVTVT

SEQ ID NO: 315072 - protein, 9 aa, Influenza virus
LEKNVTVTH

SEQ ID NO: 315073 - protein, 9 aa, Influenza virus
EKNVTVTHS

SEQ ID NO: 315074 - protein, 9 aa, Influenza virus
KNVTVTHSV

SEQ ID NO: 315075 - protein, 9 aa, Influenza virus
NVTVTHSVN

SEQ ID NO: 315076 - protein, 9 aa, Influenza virus
VTVTHSVNL

SEQ ID NO: 315077 - protein, 9 aa, Influenza virus
TVTHSVNLL

SEQ ID NO: 315078 - protein, 9 aa, Influenza virus
VTHSVNLLE

SEQ ID NO: 315079 - protein, 9 aa, Influenza virus
IAGWILGNP

SEQ ID NO: 315080 - protein, 9 aa, Influenza virus
AGWILGNPE

SEQ ID NO: 315081 - protein, 9 aa, Influenza virus
GWILGNPEC

SEQ ID NO: 315082 - protein, 9 aa, Influenza virus
DYEELREQL

SEQ ID NO: 315083 - protein, 9 aa, Influenza virus
YEELREQLS

SEQ ID NO: 315084 - protein, 9 aa, Influenza virus
EELREQLSS

SEQ ID NO: 315085 - protein, 9 aa, Influenza virus
ELREQLSSV

SEQ ID NO: 315086 - protein, 9 aa, Influenza virus
LREQLSSVS

SEQ ID NO: 315087 - protein, 9 aa, Influenza virus
REQLSSVSS

SEQ ID NO: 315088 - protein, 9 aa, Influenza virus
EQLSSVSSF

SEQ ID NO: 315089 - protein, 9 aa, Influenza virus
QLSSVSSFE

SEQ ID NO: 315090 - protein, 9 aa, Influenza virus
LSSVSSFER

SEQ ID NO: 315091 - protein, 9 aa, Influenza virus
SSVSSFERF

SEQ ID NO: 315092 - protein, 9 aa, Influenza virus
SVSSFERFE

SEQ ID NO: 315093 - protein, 9 aa, Influenza virus
VSSFERFEI

SEQ ID NO: 315094 - protein, 9 aa, Influenza virus
SSFERFEIF

SEQ ID NO: 315095 - protein, 9 aa, Influenza virus
SFERFEIFP

SEQ ID NO: 315096 - protein, 9 aa, Influenza virus
FERFEIFPK

SEQ ID NO: 315097 - protein, 9 aa, Influenza virus
KEKENSYPM

SEQ ID NO: 315098 - protein, 9 aa, Influenza virus
EKENSYPMI

SEQ ID NO: 315099 - protein, 9 aa, Influenza virus
VLVLWGIHH

SEQ ID NO: 315100 - protein, 9 aa, Influenza virus
LVLWGIHHP

SEQ ID NO: 315101 - protein, 9 aa, Influenza virus
GRMNYYWTL

SEQ ID NO: 315102 - protein, 9 aa, Influenza virus
DKITFEATG

SEQ ID NO: 315103 - protein, 9 aa, Influenza virus
KITFEATGN

SEQ ID NO: 315104 - protein, 9 aa, Influenza virus
ITFEATGNL

SEQ ID NO: 315105 - protein, 9 aa, Influenza virus
FEATGNLVV

SEQ ID NO: 315106 - protein, 9 aa, Influenza virus
EATGNLVVP

SEQ ID NO: 315107 - protein, 9 aa, Influenza virus
TSLTSLPFQ

SEQ ID NO: 315108 - protein, 9 aa, Influenza virus
SLTSLPFQN

SEQ ID NO: 315109 - protein, 9 aa, Influenza virus
LTSLPFQNI

SEQ ID NO: 315110 - protein, 9 aa, Influenza virus
SLPFQNIHP

SEQ ID NO: 315111 - protein, 9 aa, Influenza virus
PITIGKCPK

SEQ ID NO: 315112 - protein, 9 aa, Influenza virus
ITIGKCPKY

SEQ ID NO: 315113 - protein, 9 aa, Influenza virus
TIGKCPKYV

SEQ ID NO: 315114 - protein, 9 aa, Influenza virus
IGKCPKYVK

SEQ ID NO: 315115 - protein, 9 aa, Influenza virus
GKCPKYVKS

SEQ ID NO: 315116 - protein, 9 aa, Influenza virus
KCPKYVKST

SEQ ID NO: 315117 - protein, 9 aa, Influenza virus
KLRLATGLR

SEQ ID NO: 315118 - protein, 9 aa, Influenza virus
LRLATGLRN

SEQ ID NO: 315119 - protein, 9 aa, Influenza virus
RLATGLRNV

SEQ ID NO: 315120 - protein, 9 aa, Influenza virus
LATGLRNVP

SEQ ID NO: 315121 - protein, 9 aa, Influenza virus
ATGLRNVPS

SEQ ID NO: 315122 - protein, 9 aa, Influenza virus
TGLRNVPSI

SEQ ID NO: 315123 - protein, 9 aa, Influenza virus
GLRNVPSIQ

SEQ ID NO: 315124 - protein, 9 aa, Influenza virus
LRNVPSIQS

SEQ ID NO: 315125 - protein, 9 aa, Influenza virus
RNVPSIQSR

SEQ ID NO: 315126 - protein, 9 aa, Influenza virus
NVPSIQSRG

SEQ ID NO: 315127 - protein, 9 aa, Influenza virus
VPSIQSRGL

SEQ ID NO: 315128 - protein, 9 aa, Influenza virus
PSIQSRGLF

SEQ ID NO: 315129 - protein, 9 aa, Influenza virus
SIQSRGLFG

SEQ ID NO: 315130 - protein, 9 aa, Influenza virus
IQSRGLFGA

SEQ ID NO: 315131 - protein, 9 aa, Influenza virus
QSRGLFGAI

SEQ ID NO: 315132 - protein, 9 aa, Influenza virus
SRGLFGAIA

SEQ ID NO: 315133 - protein, 9 aa, Influenza virus
RGLFGAIAG

SEQ ID NO: 315134 - protein, 9 aa, Influenza virus
GLFGAIAGF

SEQ ID NO: 315135 - protein, 9 aa, Influenza virus
LFGAIAGFI

SEQ ID NO: 315136 - protein, 9 aa, Influenza virus
FGAIAGFIE

SEQ ID NO: 315137 - protein, 9 aa, Influenza virus
GAIAGFIEG

SEQ ID NO: 315138 - protein, 9 aa, Influenza virus
AIAGFIEGG

SEQ ID NO: 315139 - protein, 9 aa, Influenza virus
IAGFIEGGW

SEQ ID NO: 315140 - protein, 9 aa, Influenza virus
AGFIEGGWT

SEQ ID NO: 315141 - protein, 9 aa, Influenza virus
GFIEGGWTG

SEQ ID NO: 315142 - protein, 9 aa, Influenza virus
FIEGGWTGM

SEQ ID NO: 315143 - protein, 9 aa, Influenza virus
IEGGWTGMV

SEQ ID NO: 315144 - protein, 9 aa, Influenza virus
EGGWTGMVD

SEQ ID NO: 315145 - protein, 9 aa, Influenza virus
GGWTGMVDG

SEQ ID NO: 315146 - protein, 9 aa, Influenza virus
GWTGMVDGW

SEQ ID NO: 315147 - protein, 9 aa, Influenza virus
WTGMVDGWY

SEQ ID NO: 315148 - protein, 9 aa, Influenza virus
TGMVDGWYG

SEQ ID NO: 315149 - protein, 9 aa, Influenza virus
GMVDGWYGY

SEQ ID NO: 315150 - protein, 9 aa, Influenza virus
MVDGWYGYH

SEQ ID NO: 315151 - protein, 9 aa, Influenza virus
VDGWYGYHH

SEQ ID NO: 315152 - protein, 9 aa, Influenza virus
DGWYGYHHQ

SEQ ID NO: 315153 - protein, 9 aa, Influenza virus
GWYGYHHQN

SEQ ID NO: 315154 - protein, 9 aa, Influenza virus
WYGYHHQNE

SEQ ID NO: 315155 - protein, 9 aa, Influenza virus
YGYHHQNEQ

SEQ ID NO: 315156 - protein, 9 aa, Influenza virus
GYHHQNEQG

SEQ ID NO: 315157 - protein, 9 aa, Influenza virus
YHHQNEQGS

SEQ ID NO: 315158 - protein, 9 aa, Influenza virus
HHQNEQGSG

SEQ ID NO: 315159 - protein, 9 aa, Influenza virus
HQNEQGSGY

SEQ ID NO: 315160 - protein, 9 aa, Influenza virus
QNEQGSGYA

SEQ ID NO: 315161 - protein, 9 aa, Influenza virus
NEQGSGYAA

SEQ ID NO: 315162 - protein, 9 aa, Influenza virus
EQGSGYAAD

SEQ ID NO: 315163 - protein, 9 aa, Influenza virus
QGSGYAADL

SEQ ID NO: 315164 - protein, 9 aa, Influenza virus
GSGYAADLK

SEQ ID NO: 315165 - protein, 9 aa, Influenza virus
SGYAADLKS

SEQ ID NO: 315166 - protein, 9 aa, Influenza virus
GYAADLKST

SEQ ID NO: 315167 - protein, 9 aa, Influenza virus
YAADLKSTQ

SEQ ID NO: 315168 - protein, 9 aa, Influenza virus
ITNKVNSVI

SEQ ID NO: 315169 - protein, 9 aa, Influenza virus
TNKVNSVIE

SEQ ID NO: 315170 - protein, 9 aa, Influenza virus
NKVNSVIEK

SEQ ID NO: 315171 - protein, 9 aa, Influenza virus
KVNSVIEKM

SEQ ID NO: 315172 - protein, 9 aa, Influenza virus
VNSVIEKMN

SEQ ID NO: 315173 - protein, 9 aa, Influenza virus
NSVIEKMNT

SEQ ID NO: 315174 - protein, 9 aa, Influenza virus
SVIEKMNTQ

SEQ ID NO: 315175 - protein, 9 aa, Influenza virus
VIEKMNTQF

SEQ ID NO: 315176 - protein, 9 aa, Influenza virus
IEKMNTQFT

SEQ ID NO: 315177 - protein, 9 aa, Influenza virus
EKMNTQFTA

SEQ ID NO: 315178 - protein, 9 aa, Influenza virus
KMNTQFTAV

SEQ ID NO: 315179 - protein, 9 aa, Influenza virus
MNTQFTAVG

SEQ ID NO: 315180 - protein, 9 aa, Influenza virus
NTQFTAVGK

SEQ ID NO: 315181 - protein, 9 aa, Influenza virus
TQFTAVGKE

SEQ ID NO: 315182 - protein, 9 aa, Influenza virus
QFTAVGKEF

SEQ ID NO: 315183 - protein, 9 aa, Influenza virus
FTAVGKEFN

SEQ ID NO: 315184 - protein, 9 aa, Influenza virus
RIENLNKKV

SEQ ID NO: 315185 - protein, 9 aa, Influenza virus
IENLNKKVD

SEQ ID NO: 315186 - protein, 9 aa, Influenza virus
ENLNKKVDD

SEQ ID NO: 315187 - protein, 9 aa, Influenza virus
NLNKKVDDG

SEQ ID NO: 315188 - protein, 9 aa, Influenza virus
LNKKVDDGF

SEQ ID NO: 315189 - protein, 9 aa, Influenza virus
NKKVDDGFL

SEQ ID NO: 315190 - protein, 9 aa, Influenza virus
KKVDDGFLD

SEQ ID NO: 315191 - protein, 9 aa, Influenza virus
DDGFLDIWT

SEQ ID NO: 315192 - protein, 9 aa, Influenza virus
DGFLDIWTY

SEQ ID NO: 315193 - protein, 9 aa, Influenza virus
GFLDIWTYN

SEQ ID NO: 315194 - protein, 9 aa, Influenza virus
FLDIWTYNA

SEQ ID NO: 315195 - protein, 9 aa, Influenza virus
LDIWTYNAE

SEQ ID NO: 315196 - protein, 9 aa, Influenza virus
DIWTYNAEL

SEQ ID NO: 315197 - protein, 9 aa, Influenza virus
IWTYNAELL

SEQ ID NO: 315198 - protein, 9 aa, Influenza virus
WTYNAELLV

SEQ ID NO: 315199 - protein, 9 aa, Influenza virus
TYNAELLVL

SEQ ID NO: 315200 - protein, 9 aa, Influenza virus
YNAELLVLL

SEQ ID NO: 315201 - protein, 9 aa, Influenza virus
NAELLVLLE

SEQ ID NO: 315202 - protein, 9 aa, Influenza virus
AELLVLLEN

SEQ ID NO: 315203 - protein, 9 aa, Influenza virus
ELLVLLENE

SEQ ID NO: 315204 - protein, 9 aa, Influenza virus
LLVLLENER

SEQ ID NO: 315205 - protein, 9 aa, Influenza virus
LVLLENERT

SEQ ID NO: 315206 - protein, 9 aa, Influenza virus
VLLENERTL

SEQ ID NO: 315207 - protein, 9 aa, Influenza virus
LLENERTLD

SEQ ID NO: 315208 - protein, 9 aa, Influenza virus
LENERTLDY

SEQ ID NO: 315209 - protein, 9 aa, Influenza virus
ENERTLDYH

SEQ ID NO: 315210 - protein, 9 aa, Influenza virus
NERTLDYHD

SEQ ID NO: 315211 - protein, 9 aa, Influenza virus
ERTLDYHDS

SEQ ID NO: 315212 - protein, 9 aa, Influenza virus
NNAKEIGNG

SEQ ID NO: 315213 - protein, 9 aa, Influenza virus
NAKEIGNGC

SEQ ID NO: 315214 - protein, 9 aa, Influenza virus
AKEIGNGCF

SEQ ID NO: 315215 - protein, 9 aa, Influenza virus
KEIGNGCFE

SEQ ID NO: 315216 - protein, 9 aa, Influenza virus
EIGNGCFEF

SEQ ID NO: 315217 - protein, 9 aa, Influenza virus
IGNGCFEFY

SEQ ID NO: 315218 - protein, 9 aa, Influenza virus
GNGCFEFYH

SEQ ID NO: 315219 - protein, 9 aa, Influenza virus
NGCFEFYHK

SEQ ID NO: 315220 - protein, 9 aa, Influenza virus
GCFEFYHKC

SEQ ID NO: 315221 - protein, 9 aa, Influenza virus
CFEFYHKCD

SEQ ID NO: 315222 - protein, 9 aa, Influenza virus
FEFYHKCDN

SEQ ID NO: 315223 - protein, 9 aa, Influenza virus
CMESVKNGT

SEQ ID NO: 315224 - protein, 9 aa, Influenza virus
MESVKNGTY

SEQ ID NO: 315225 - protein, 9 aa, Influenza virus
ESVKNGTYD

SEQ ID NO: 315226 - protein, 9 aa, Influenza virus
SVKNGTYDY

SEQ ID NO: 315227 - protein, 9 aa, Influenza virus
VKNGTYDYP

SEQ ID NO: 315228 - protein, 9 aa, Influenza virus
KNGTYDYPK

SEQ ID NO: 315229 - protein, 9 aa, Influenza virus
NGTYDYPKY

SEQ ID NO: 315230 - protein, 9 aa, Influenza virus
GTYDYPKYS

SEQ ID NO: 315231 - protein, 9 aa, Influenza virus
TYDYPKYSE

SEQ ID NO: 315232 - protein, 9 aa, Influenza virus
YDYPKYSEE

SEQ ID NO: 315233 - protein, 9 aa, Influenza virus
DYPKYSEEA

SEQ ID NO: 315234 - protein, 9 aa, Influenza virus
YPKYSEEAK

SEQ ID NO: 315235 - protein, 9 aa, Influenza virus
PKYSEEAKL

SEQ ID NO: 315236 - protein, 9 aa, Influenza virus
IYQILAIYS

SEQ ID NO: 315237 - protein, 9 aa, Influenza virus
YQILAIYST

SEQ ID NO: 315238 - protein, 9 aa, Influenza virus
QILAIYSTV

SEQ ID NO: 315239 - protein, 9 aa, Influenza virus
ILAIYSTVA

SEQ ID NO: 315240 - protein, 9 aa, Influenza virus
LAIYSTVAS

SEQ ID NO: 315241 - protein, 9 aa, Influenza virus
AIYSTVASS

SEQ ID NO: 315242 - protein, 9 aa, Influenza virus
IYSTVASSL

SEQ ID NO: 315243 - protein, 9 aa, Influenza virus
YSTVASSLV

SEQ ID NO: 315244 - protein, 9 aa, Influenza virus
STVASSLVL

SEQ ID NO: 315245 - protein, 9 aa, Influenza virus
ASSLVLVVS

SEQ ID NO: 315246 - protein, 9 aa, Influenza virus
SSLVLVVSL

SEQ ID NO: 315247 - protein, 9 aa, Influenza virus
SLVLVVSLG

SEQ ID NO: 315248 - protein, 9 aa, Influenza virus
LVLVVSLGA

SEQ ID NO: 315249 - protein, 9 aa, Influenza virus
VLVVSLGAI

SEQ ID NO: 315250 - protein, 9 aa, Influenza virus
LVVSLGAIS

SEQ ID NO: 315251 - protein, 9 aa, Influenza virus
VVSLGAISF

SEQ ID NO: 315252 - protein, 9 aa, Influenza virus
VSLGAISFW

SEQ ID NO: 315253 - protein, 9 aa, Influenza virus
SLGAISFWM

SEQ ID NO: 315254 - protein, 9 aa, Influenza virus
LGAISFWMC

SEQ ID NO: 315255 - protein, 9 aa, Influenza virus
GAISFWMCS

SEQ ID NO: 315256 - protein, 9 aa, Influenza virus
AISFWMCSN

SEQ ID NO: 315257 - protein, 9 aa, Influenza virus
ISFWMCSNG

SEQ ID NO: 315258 - protein, 9 aa, Influenza virus
SFWMCSNGS

SEQ ID NO: 315259 - protein, 9 aa, Influenza virus
FWMCSNGSL

SEQ ID NO: 315260 - protein, 9 aa, Influenza virus
WMCSNGSLQ

SEQ ID NO: 315261 - protein, 9 aa, Influenza virus
MCSNGSLQC

SEQ ID NO: 315262 - protein, 9 aa, Influenza virus
CSNGSLQCR

SEQ ID NO: 315263 - protein, 9 aa, Influenza virus
SNGSLQCRI

SEQ ID NO: 315264 - protein, 9 aa, Influenza virus
NGSLQCRIC

SEQ ID NO: 315265 - protein, 9 aa, Influenza virus
GSLQCRICI

SEQ ID NO: 315266 - protein, 9 aa, Influenza virus
LCSVEYASK

SEQ ID NO: 315267 - protein, 9 aa, Influenza virus
CSVEYASKT

SEQ ID NO: 315268 - protein, 9 aa, Influenza virus
SVEYASKTR

SEQ ID NO: 315269 - protein, 9 aa, Influenza virus
VEYASKTRI

SEQ ID NO: 315270 - protein, 9 aa, Influenza virus
EYASKTRIS

SEQ ID NO: 315271 - protein, 9 aa, Influenza virus
YASKTRISE

SEQ ID NO: 315272 - protein, 9 aa, Influenza virus
QCRICIRAD

SEQ ID NO: 315273 - protein, 9 aa, Influenza virus
CRICIRADG

SEQ ID NO: 315274 - protein, 9 aa, Influenza virus
RICILDQNF

SEQ ID NO: 315275 - protein, 9 aa, Influenza virus
ICILDQNFR

SEQ ID NO: 315276 - protein, 9 aa, Influenza virus
CILDQNFRN

SEQ ID NO: 315277 - protein, 9 aa, Influenza virus
ILDQNFRNI

SEQ ID NO: 315278 - protein, 9 aa, Influenza virus
DFRDMRKNT

SEQ ID NO: 315279 - protein, 9 aa, Influenza virus
DQNFRNIRK

SEQ ID NO: 315280 - protein, 9 aa, Influenza virus
IGLREQKQE

SEQ ID NO: 315281 - protein, 9 aa, Influenza virus
GLREQKQEF

SEQ ID NO: 315282 - protein, 9 aa, Influenza virus
LREQKQEFK

SEQ ID NO: 315283 - protein, 9 aa, Influenza virus
REQKQEFKM

SEQ ID NO: 315284 - protein, 9 aa, Influenza virus
EQKQEFKMN

SEQ ID NO: 315285 - protein, 9 aa, Influenza virus
QKQEFKMNP

SEQ ID NO: 315286 - protein, 9 aa, Influenza virus
KQEFKMNPN

SEQ ID NO: 315287 - protein, 9 aa, Influenza virus
QEFKMNPNQ

SEQ ID NO: 315288 - protein, 9 aa, Influenza virus
EFKMNPNQK

SEQ ID NO: 315289 - protein, 9 aa, Influenza virus
FKMNPNQKI

SEQ ID NO: 315290 - protein, 9 aa, Influenza virus
KMNPNQKII

SEQ ID NO: 315291 - protein, 9 aa, Influenza virus
GWAIYSKDN

SEQ ID NO: 315292 - protein, 9 aa, Influenza virus
WAIYSKDNS

SEQ ID NO: 315293 - protein, 9 aa, Influenza virus
YSKDNSIRI

SEQ ID NO: 315294 - protein, 9 aa, Influenza virus
SKDNSIRIG

SEQ ID NO: 315295 - protein, 9 aa, Influenza virus
KDNSIRIGS

SEQ ID NO: 315296 - protein, 9 aa, Influenza virus
DNSIRIGSK

SEQ ID NO: 315297 - protein, 9 aa, Influenza virus
NSIRIGSKG

SEQ ID NO: 315298 - protein, 9 aa, Influenza virus
SIRIGSKGD

SEQ ID NO: 315299 - protein, 9 aa, Influenza virus
IRIGSKGDV

SEQ ID NO: 315300 - protein, 9 aa, Influenza virus
RIGSKGDVF

SEQ ID NO: 315301 - protein, 9 aa, Influenza virus
IGSKGDVFV

SEQ ID NO: 315302 - protein, 9 aa, Influenza virus
GSKGDVFVI

SEQ ID NO: 315303 - protein, 9 aa, Influenza virus
SKGDVFVIR

SEQ ID NO: 315304 - protein, 9 aa, Influenza virus
KGDVFVIRE

SEQ ID NO: 315305 - protein, 9 aa, Influenza virus
GDVFVIREP

SEQ ID NO: 315306 - protein, 9 aa, Influenza virus
DVFVIREPF

SEQ ID NO: 315307 - protein, 9 aa, Influenza virus
VFVIREPFI

SEQ ID NO: 315308 - protein, 9 aa, Influenza virus
FVIREPFIS

SEQ ID NO: 315309 - protein, 9 aa, Influenza virus
VIREPFISC

SEQ ID NO: 315310 - protein, 9 aa, Influenza virus
IREPFISCS

SEQ ID NO: 315311 - protein, 9 aa, Influenza virus
REPFISCSP

SEQ ID NO: 315312 - protein, 9 aa, Influenza virus
EPFISCSPL

SEQ ID NO: 315313 - protein, 9 aa, Influenza virus
PFISCSPLE

SEQ ID NO: 315314 - protein, 9 aa, Influenza virus
FISCSPLEC

SEQ ID NO: 315315 - protein, 9 aa, Influenza virus
ISCSPLECR

SEQ ID NO: 315316 - protein, 9 aa, Influenza virus
LECRTFFLT

SEQ ID NO: 315317 - protein, 9 aa, Influenza virus
ECRTFFLTQ

SEQ ID NO: 315318 - protein, 9 aa, Influenza virus
CRTFFLTQG

SEQ ID NO: 315319 - protein, 9 aa, Influenza virus
RTFFLTQGA

SEQ ID NO: 315320 - protein, 9 aa, Influenza virus
TFFLTQGAL

SEQ ID NO: 315321 - protein, 9 aa, Influenza virus
FFLTQGALL

SEQ ID NO: 315322 - protein, 9 aa, Influenza virus
FLTQGALLN

SEQ ID NO: 315323 - protein, 9 aa, Influenza virus
LTQGALLND

SEQ ID NO: 315324 - protein, 9 aa, Influenza virus
TQGALLNDK

SEQ ID NO: 315325 - protein, 9 aa, Influenza virus
QGALLNDKH

SEQ ID NO: 315326 - protein, 9 aa, Influenza virus
GALLNDKHS

SEQ ID NO: 315327 - protein, 9 aa, Influenza virus
ALLNDKHSN

SEQ ID NO: 315328 - protein, 9 aa, Influenza virus
LLNDKHSNG

SEQ ID NO: 315329 - protein, 9 aa, Influenza virus
LNDKHSNGT

SEQ ID NO: 315330 - protein, 9 aa, Influenza virus
NDKHSNGTI

SEQ ID NO: 315331 - protein, 9 aa, Influenza virus
DKHSNGTIK

SEQ ID NO: 315332 - protein, 9 aa, Influenza virus
HSNGTIKDR

SEQ ID NO: 315333 - protein, 9 aa, Influenza virus
SNGTIKDRS

SEQ ID NO: 315334 - protein, 9 aa, Influenza virus
KDRSPYRTL

SEQ ID NO: 315335 - protein, 9 aa, Influenza virus
DRSPYRTLM

SEQ ID NO: 315336 - protein, 9 aa, Influenza virus
RSPYRTLMS

SEQ ID NO: 315337 - protein, 9 aa, Influenza virus
SPYRTLMSC

SEQ ID NO: 315338 - protein, 9 aa, Influenza virus
PYRTLMSCP

SEQ ID NO: 315339 - protein, 9 aa, Influenza virus
RTLMSCPIG

SEQ ID NO: 315340 - protein, 9 aa, Influenza virus
TLMSCPIGE

SEQ ID NO: 315341 - protein, 9 aa, Influenza virus
LMSCPIGEV

SEQ ID NO: 315342 - protein, 9 aa, Influenza virus
MSCPIGEVP

SEQ ID NO: 315343 - protein, 9 aa, Influenza virus
SCPIGEVPS

SEQ ID NO: 315344 - protein, 9 aa, Influenza virus
CPIGEVPSP

SEQ ID NO: 315345 - protein, 9 aa, Influenza virus
PIGEVPSPY

SEQ ID NO: 315346 - protein, 9 aa, Influenza virus
IGEVPSPYN

SEQ ID NO: 315347 - protein, 9 aa, Influenza virus
GEVPSPYNS

SEQ ID NO: 315348 - protein, 9 aa, Influenza virus
EVPSPYNSR

SEQ ID NO: 315349 - protein, 9 aa, Influenza virus
VPSPYNSRF

SEQ ID NO: 315350 - protein, 9 aa, Influenza virus
PSPYNSRFE

SEQ ID NO: 315351 - protein, 9 aa, Influenza virus
SPYNSRFES

SEQ ID NO: 315352 - protein, 9 aa, Influenza virus
PYNSRFESV

SEQ ID NO: 315353 - protein, 9 aa, Influenza virus
YNSRFESVA

SEQ ID NO: 315354 - protein, 9 aa, Influenza virus
NSRFESVAW

SEQ ID NO: 315355 - protein, 9 aa, Influenza virus
SRFESVAWS

SEQ ID NO: 315356 - protein, 9 aa, Influenza virus
RFESVAWSA

SEQ ID NO: 315357 - protein, 9 aa, Influenza virus
FESVAWSAS

SEQ ID NO: 315358 - protein, 9 aa, Influenza virus
ESVAWSASA

SEQ ID NO: 315359 - protein, 9 aa, Influenza virus
SVAWSASAC

SEQ ID NO: 315360 - protein, 9 aa, Influenza virus
VAWSASACH

SEQ ID NO: 315361 - protein, 9 aa, Influenza virus
AWSASACHD

SEQ ID NO: 315362 - protein, 9 aa, Influenza virus
WSASACHDG

SEQ ID NO: 315363 - protein, 9 aa, Influenza virus
SASACHDGI

SEQ ID NO: 315364 - protein, 9 aa, Influenza virus
NWLTIGISG

SEQ ID NO: 315365 - protein, 9 aa, Influenza virus
WLTIGISGP

SEQ ID NO: 315366 - protein, 9 aa, Influenza virus
LTIGISGPD

SEQ ID NO: 315367 - protein, 9 aa, Influenza virus
TIGISGPDN

SEQ ID NO: 315368 - protein, 9 aa, Influenza virus
IGISGPDNG

SEQ ID NO: 315369 - protein, 9 aa, Influenza virus
GISGPDNGA

SEQ ID NO: 315370 - protein, 9 aa, Influenza virus
ISGPDNGAV

SEQ ID NO: 315371 - protein, 9 aa, Influenza virus
SGPDNGAVA

SEQ ID NO: 315372 - protein, 9 aa, Influenza virus
GPDNGAVAV

SEQ ID NO: 315373 - protein, 9 aa, Influenza virus
PDNGAVAVL

SEQ ID NO: 315374 - protein, 9 aa, Influenza virus
DNGAVAVLK

SEQ ID NO: 315375 - protein, 9 aa, Influenza virus
NGAVAVLKY

SEQ ID NO: 315376 - protein, 9 aa, Influenza virus
GAVAVLKYN

SEQ ID NO: 315377 - protein, 9 aa, Influenza virus
AVAVLKYNG

SEQ ID NO: 315378 - protein, 9 aa, Influenza virus
VAVLKYNGI

SEQ ID NO: 315379 - protein, 9 aa, Influenza virus
AVLKYNGII

SEQ ID NO: 315380 - protein, 9 aa, Influenza virus
VLKYNGIIT

SEQ ID NO: 315381 - protein, 9 aa, Influenza virus
LKYNGIITD

SEQ ID NO: 315382 - protein, 9 aa, Influenza virus
KYNGIITDT

SEQ ID NO: 315383 - protein, 9 aa, Influenza virus
GIITDTIKS

SEQ ID NO: 315384 - protein, 9 aa, Influenza virus
IITDTIKSW

SEQ ID NO: 315385 - protein, 9 aa, Influenza virus
NILRTQESE

SEQ ID NO: 315386 - protein, 9 aa, Influenza virus
ILRTQESEC

SEQ ID NO: 315387 - protein, 9 aa, Influenza virus
LRTQESECA

SEQ ID NO: 315388 - protein, 9 aa, Influenza virus
RTQESECAC

SEQ ID NO: 315389 - protein, 9 aa, Influenza virus
TQESECACV

SEQ ID NO: 315390 - protein, 9 aa, Influenza virus
QESECACVN

SEQ ID NO: 315391 - protein, 9 aa, Influenza virus
ESECACVNG

SEQ ID NO: 315392 - protein, 9 aa, Influenza virus
SECACVNGS

SEQ ID NO: 315393 - protein, 9 aa, Influenza virus
ECACVNGSC

SEQ ID NO: 315394 - protein, 9 aa, Influenza virus
NGSCFTVMT

SEQ ID NO: 315395 - protein, 9 aa, Influenza virus
GSCFTVMTD

SEQ ID NO: 315396 - protein, 9 aa, Influenza virus
SCFTVMTDG

SEQ ID NO: 315397 - protein, 9 aa, Influenza virus
CFTVMTDGP

SEQ ID NO: 315398 - protein, 9 aa, Influenza virus
FTVMTDGPS

SEQ ID NO: 315399 - protein, 9 aa, Influenza virus
VMGQASYKI

SEQ ID NO: 315400 - protein, 9 aa, Influenza virus
APNYHYEEC

SEQ ID NO: 315401 - protein, 9 aa, Influenza virus
PNYHYEECS

SEQ ID NO: 315402 - protein, 9 aa, Influenza virus
NYHYEECSC

SEQ ID NO: 315403 - protein, 9 aa, Influenza virus
YHYEECSCY

SEQ ID NO: 315404 - protein, 9 aa, Influenza virus
HYEECSCYP

SEQ ID NO: 315405 - protein, 9 aa, Influenza virus
YEECSCYPD

SEQ ID NO: 315406 - protein, 9 aa, Influenza virus
EECSCYPDS

SEQ ID NO: 315407 - protein, 9 aa, Influenza virus
ITCVCRDNW

SEQ ID NO: 315408 - protein, 9 aa, Influenza virus
TCVCRDNWH

SEQ ID NO: 315409 - protein, 9 aa, Influenza virus
CVCRDNWHG

SEQ ID NO: 315410 - protein, 9 aa, Influenza virus
VCRDNWHGS

SEQ ID NO: 315411 - protein, 9 aa, Influenza virus
CRDNWHGSN

SEQ ID NO: 315412 - protein, 9 aa, Influenza virus
RDNWHGSNR

SEQ ID NO: 315413 - protein, 9 aa, Influenza virus
DNWHGSNRP

SEQ ID NO: 315414 - protein, 9 aa, Influenza virus
NWHGSNRPW

SEQ ID NO: 315415 - protein, 9 aa, Influenza virus
WHGSNRPWV

SEQ ID NO: 315416 - protein, 9 aa, Influenza virus
HGSNRPWVS

SEQ ID NO: 315417 - protein, 9 aa, Influenza virus
GSNRPWVSF

SEQ ID NO: 315418 - protein, 9 aa, Influenza virus
SNRPWVSFN

SEQ ID NO: 315419 - protein, 9 aa, Influenza virus
NRPWVSFNQ

SEQ ID NO: 315420 - protein, 9 aa, Influenza virus
RPWVSFNQN

SEQ ID NO: 315421 - protein, 9 aa, Influenza virus
PWVSFNQNL

SEQ ID NO: 315422 - protein, 9 aa, Influenza virus
YQIGYICSG

SEQ ID NO: 315423 - protein, 9 aa, Influenza virus
IGYICSGIF

SEQ ID NO: 315424 - protein, 9 aa, Influenza virus
GYICSGIFG

SEQ ID NO: 315425 - protein, 9 aa, Influenza virus
YICSGIFGD

SEQ ID NO: 315426 - protein, 9 aa, Influenza virus
ICSGIFGDN

SEQ ID NO: 315427 - protein, 9 aa, Influenza virus
CSGIFGDNP

SEQ ID NO: 315428 - protein, 9 aa, Influenza virus
SGIFGDNPR

SEQ ID NO: 315429 - protein, 9 aa, Influenza virus
GIFGDNPRP

SEQ ID NO: 315430 - protein, 9 aa, Influenza virus
GANGVKGFS

SEQ ID NO: 315431 - protein, 9 aa, Influenza virus
ANGVKGFSF

SEQ ID NO: 315432 - protein, 9 aa, Influenza virus
GVKGFSFKY

SEQ ID NO: 315433 - protein, 9 aa, Influenza virus
VKGFSFKYG

SEQ ID NO: 315434 - protein, 9 aa, Influenza virus
KGFSFKYGN

SEQ ID NO: 315435 - protein, 9 aa, Influenza virus
GFSFKYGNG

SEQ ID NO: 315436 - protein, 9 aa, Influenza virus
FSFKYGNGV

SEQ ID NO: 315437 - protein, 9 aa, Influenza virus
SFKYGNGVW

SEQ ID NO: 315438 - protein, 9 aa, Influenza virus
KYGNGVWIG

SEQ ID NO: 315439 - protein, 9 aa, Influenza virus
YGNGVWIGR

SEQ ID NO: 315440 - protein, 9 aa, Influenza virus
GNGVWIGRT

SEQ ID NO: 315441 - protein, 9 aa, Influenza virus
NGVWIGRTK

SEQ ID NO: 315442 - protein, 9 aa, Influenza virus
GVWIGRTKS

SEQ ID NO: 315443 - protein, 9 aa, Influenza virus
VWIGRTKSI

SEQ ID NO: 315444 - protein, 9 aa, Influenza virus
GFEMIWDPN

SEQ ID NO: 315445 - protein, 9 aa, Influenza virus
FEMIWDPNG

SEQ ID NO: 315446 - protein, 9 aa, Influenza virus
EMIWDPNGW

SEQ ID NO: 315447 - protein, 9 aa, Influenza virus
MIWDPNGWT

SEQ ID NO: 315448 - protein, 9 aa, Influenza virus
NEWSGYSGS

SEQ ID NO: 315449 - protein, 9 aa, Influenza virus
EWSGYSGSF

SEQ ID NO: 315450 - protein, 9 aa, Influenza virus
WSGYSGSFV

SEQ ID NO: 315451 - protein, 9 aa, Influenza virus
SGYSGSFVQ

SEQ ID NO: 315452 - protein, 9 aa, Influenza virus
GYSGSFVQH

SEQ ID NO: 315453 - protein, 9 aa, Influenza virus
YSGSFVQHP

SEQ ID NO: 315454 - protein, 9 aa, Influenza virus
SGSFVQHPE

SEQ ID NO: 315455 - protein, 9 aa, Influenza virus
GSFVQHPEL

SEQ ID NO: 315456 - protein, 9 aa, Influenza virus
SFVQHPELT

SEQ ID NO: 315457 - protein, 9 aa, Influenza virus
FVQHPELTG

SEQ ID NO: 315458 - protein, 9 aa, Influenza virus
VQHPELTGL

SEQ ID NO: 315459 - protein, 9 aa, Influenza virus
QHPELTGLD

SEQ ID NO: 315460 - protein, 9 aa, Influenza virus
HPELTGLDC

SEQ ID NO: 315461 - protein, 9 aa, Influenza virus
PELTGLDCI

SEQ ID NO: 315462 - protein, 9 aa, Influenza virus
DCIRPCFWV

SEQ ID NO: 315463 - protein, 9 aa, Influenza virus
CIRPCFWVE

SEQ ID NO: 315464 - protein, 9 aa, Influenza virus
IRPCFWVEL

SEQ ID NO: 315465 - protein, 9 aa, Influenza virus
RPCFWVELI

SEQ ID NO: 315466 - protein, 9 aa, Influenza virus
PCFWVELIR

SEQ ID NO: 315467 - protein, 9 aa, Influenza virus
CFWVELIRG

SEQ ID NO: 315468 - protein, 9 aa, Influenza virus
FWVELIRGR

SEQ ID NO: 315469 - protein, 9 aa, Influenza virus
WVELIRGRP

SEQ ID NO: 315470 - protein, 9 aa, Influenza virus
TTIWTSGSS

SEQ ID NO: 315471 - protein, 9 aa, Influenza virus
TIWTSGSSI

SEQ ID NO: 315472 - protein, 9 aa, Influenza virus
IWTSGSSIS

SEQ ID NO: 315473 - protein, 9 aa, Influenza virus
WTSGSSISF

SEQ ID NO: 315474 - protein, 9 aa, Influenza virus
TSGSSISFC

SEQ ID NO: 315475 - protein, 9 aa, Influenza virus
SGSSISFCG

SEQ ID NO: 315476 - protein, 9 aa, Influenza virus
GSSISFCGV

SEQ ID NO: 315477 - protein, 9 aa, Influenza virus
SSISFCGVN

SEQ ID NO: 315478 - protein, 9 aa, Influenza virus
SISFCGVNS

SEQ ID NO: 315479 - protein, 9 aa, Influenza virus
GWSWPDGAE

SEQ ID NO: 315480 - protein, 9 aa, Influenza virus
WSWPDGAEL

SEQ ID NO: 315481 - protein, 9 aa, Influenza virus
SWPDGAELP

SEQ ID NO: 315482 - protein, 9 aa, Influenza virus
WPDGAELPF

SEQ ID NO: 315483 - protein, 9 aa, Influenza virus
PDGAELPFT

SEQ ID NO: 315484 - protein, 9 aa, Influenza virus
DGAELPFTI

SEQ ID NO: 315485 - protein, 9 aa, Influenza virus
DLPFTQEQK

SEQ ID NO: 315486 - protein, 9 aa, Influenza virus
DTICIGYHA

SEQ ID NO: 315487 - protein, 9 aa, Influenza virus
TICIGYHAN

SEQ ID NO: 315488 - protein, 9 aa, Influenza virus
ICIGYHANN

SEQ ID NO: 315489 - protein, 9 aa, Influenza virus
CIGYHANNS

SEQ ID NO: 315490 - protein, 9 aa, Influenza virus
IGYHANNST

SEQ ID NO: 315491 - protein, 9 aa, Influenza virus
GYHANNSTD

SEQ ID NO: 315492 - protein, 9 aa, Influenza virus
YHANNSTDT

SEQ ID NO: 315493 - protein, 9 aa, Influenza virus
HANNSTDTV

SEQ ID NO: 315494 - protein, 9 aa, Influenza virus
ANNSTDTVD

SEQ ID NO: 315495 - protein, 9 aa, Influenza virus
NNSTDTVDT

SEQ ID NO: 315496 - protein, 9 aa, Influenza virus
KNVTVTHSV

SEQ ID NO: 315497 - protein, 9 aa, Influenza virus
NVTVTHSVN

SEQ ID NO: 315498 - protein, 9 aa, Influenza virus
VTVTHSVNL

SEQ ID NO: 315499 - protein, 9 aa, Influenza virus
TVTHSVNLL

SEQ ID NO: 315500 - protein, 9 aa, Influenza virus
VTHSVNLLE

SEQ ID NO: 315501 - protein, 9 aa, Influenza virus
VAGWILGNP

SEQ ID NO: 315502 - protein, 9 aa, Influenza virus
GWILGNPEC

SEQ ID NO: 315503 - protein, 9 aa, Influenza virus
YEELREQLS

SEQ ID NO: 315504 - protein, 9 aa, Influenza virus
PFQNVHPVT

SEQ ID NO: 315505 - protein, 9 aa, Influenza virus
FQNVHPVTI

SEQ ID NO: 315506 - protein, 9 aa, Influenza virus
QNVHPVTIG

SEQ ID NO: 315507 - protein, 9 aa, Influenza virus
HPVTIGECP

SEQ ID NO: 315508 - protein, 9 aa, Influenza virus
PVTIGECPK

SEQ ID NO: 315509 - protein, 9 aa, Influenza virus
VTIGECPKY

SEQ ID NO: 315510 - protein, 9 aa, Influenza virus
TIGECPKYV

SEQ ID NO: 315511 - protein, 9 aa, Influenza virus
IGECPKYVK

SEQ ID NO: 315512 - protein, 9 aa, Influenza virus
GECPKYVKS

SEQ ID NO: 315513 - protein, 9 aa, Influenza virus
LRMVTGLRN

SEQ ID NO: 315514 - protein, 9 aa, Influenza virus
SIQSRGLFG

SEQ ID NO: 315515 - protein, 9 aa, Influenza virus
IQSRGLFGA

SEQ ID NO: 315516 - protein, 9 aa, Influenza virus
QSRGLFGAI

SEQ ID NO: 315517 - protein, 9 aa, Influenza virus
SRGLFGAIA

SEQ ID NO: 315518 - protein, 9 aa, Influenza virus
RGLFGAIAG

SEQ ID NO: 315519 - protein, 9 aa, Influenza virus
GLFGAIAGF

SEQ ID NO: 315520 - protein, 9 aa, Influenza virus
LFGAIAGFI

SEQ ID NO: 315521 - protein, 9 aa, Influenza virus
FGAIAGFIE

SEQ ID NO: 315522 - protein, 9 aa, Influenza virus
GAIAGFIEG

SEQ ID NO: 315523 - protein, 9 aa, Influenza virus
AIAGFIEGG

SEQ ID NO: 315524 - protein, 9 aa, Influenza virus
IAGFIEGGW

SEQ ID NO: 315525 - protein, 9 aa, Influenza virus
AGFIEGGWT

SEQ ID NO: 315526 - protein, 9 aa, Influenza virus
GFIEGGWTG

SEQ ID NO: 315527 - protein, 9 aa, Influenza virus
FIEGGWTGM

SEQ ID NO: 315528 - protein, 9 aa, Influenza virus
IEGGWTGMI

SEQ ID NO: 315529 - protein, 9 aa, Influenza virus
EGGWTGMID

SEQ ID NO: 315530 - protein, 9 aa, Influenza virus
GGWTGMIDG

SEQ ID NO: 315531 - protein, 9 aa, Influenza virus
GWTGMIDGW

SEQ ID NO: 315532 - protein, 9 aa, Influenza virus
WTGMIDGWY

SEQ ID NO: 315533 - protein, 9 aa, Influenza virus
TGMIDGWYG

SEQ ID NO: 315534 - protein, 9 aa, Influenza virus
GMIDGWYGY

SEQ ID NO: 315535 - protein, 9 aa, Influenza virus
NEQGSGYAA

SEQ ID NO: 315536 - protein, 9 aa, Influenza virus
EQGSGYAAD

SEQ ID NO: 315537 - protein, 9 aa, Influenza virus
ENLNKKVDD

SEQ ID NO: 315538 - protein, 9 aa, Influenza virus
NLNKKVDDG

SEQ ID NO: 315539 - protein, 9 aa, Influenza virus
LNKKVDDGF

SEQ ID NO: 315540 - protein, 9 aa, Influenza virus
DIWTYNAEL

SEQ ID NO: 315541 - protein, 9 aa, Influenza virus
IWTYNAELL

SEQ ID NO: 315542 - protein, 9 aa, Influenza virus
WTYNAELLV

SEQ ID NO: 315543 - protein, 9 aa, Influenza virus
TYNAELLVL

SEQ ID NO: 315544 - protein, 9 aa, Influenza virus
YNAELLVLL

SEQ ID NO: 315545 - protein, 9 aa, Influenza virus
NAELLVLLE

SEQ ID NO: 315546 - protein, 9 aa, Influenza virus
AELLVLLEN

SEQ ID NO: 315547 - protein, 9 aa, Influenza virus
ELLVLLENE

SEQ ID NO: 315548 - protein, 9 aa, Influenza virus
LLVLLENER

SEQ ID NO: 315549 - protein, 9 aa, Influenza virus
LVLLENERT

SEQ ID NO: 315550 - protein, 9 aa, Influenza virus
VLLENERTL

SEQ ID NO: 315551 - protein, 9 aa, Influenza virus
LLENERTLD

SEQ ID NO: 315552 - protein, 9 aa, Influenza virus
LENERTLDF

SEQ ID NO: 315553 - protein, 9 aa, Influenza virus
ENERTLDFH

SEQ ID NO: 315554 - protein, 9 aa, Influenza virus
NERTLDFHD

SEQ ID NO: 315555 - protein, 9 aa, Influenza virus
ERTLDFHDS

SEQ ID NO: 315556 - protein, 9 aa, Influenza virus
RTLDFHDSN

SEQ ID NO: 315557 - protein, 9 aa, Influenza virus
TLDFHDSNV

SEQ ID NO: 315558 - protein, 9 aa, Influenza virus
NNAKEIGNG

SEQ ID NO: 315559 - protein, 9 aa, Influenza virus
NAKEIGNGC

SEQ ID NO: 315560 - protein, 9 aa, Influenza virus
AKEIGNGCF

SEQ ID NO: 315561 - protein, 9 aa, Influenza virus
KEIGNGCFE

SEQ ID NO: 315562 - protein, 9 aa, Influenza virus
EIGNGCFEF

SEQ ID NO: 315563 - protein, 9 aa, Influenza virus
IGNGCFEFY

SEQ ID NO: 315564 - protein, 9 aa, Influenza virus
GNGCFEFYH

SEQ ID NO: 315565 - protein, 9 aa, Influenza virus
NGCFEFYHK

SEQ ID NO: 315566 - protein, 9 aa, Influenza virus
GCFEFYHKC

SEQ ID NO: 315567 - protein, 9 aa, Influenza virus
CFEFYHKCN

SEQ ID NO: 315568 - protein, 9 aa, Influenza virus
FEFYHKCNN

SEQ ID NO: 315569 - protein, 9 aa, Influenza virus
CMESVKNGT

SEQ ID NO: 315570 - protein, 9 aa, Influenza virus
MESVKNGTY

SEQ ID NO: 315571 - protein, 9 aa, Influenza virus
SVKNGTYDY

SEQ ID NO: 315572 - protein, 9 aa, Influenza virus
SFWMCSNGS

SEQ ID NO: 315573 - protein, 9 aa, Influenza virus
FWMCSNGSL

SEQ ID NO: 315574 - protein, 9 aa, Influenza virus
WMCSNGSLQ

SEQ ID NO: 315575 - protein, 9 aa, Influenza virus
MCSNGSLQC

SEQ ID NO: 315576 - protein, 9 aa, Influenza virus
CSNGSLQCR

SEQ ID NO: 315577 - protein, 9 aa, Influenza virus
SNGSLQCRI

SEQ ID NO: 315578 - protein, 9 aa, Influenza virus
NGSLQCRIC

SEQ ID NO: 315579 - protein, 9 aa, Influenza virus
GSLQCRICI

SEQ ID NO: 315580 - protein, 9 aa, Influenza virus
KNNQVILCE

SEQ ID NO: 315581 - protein, 9 aa, Influenza virus
YRNWSKPQC

SEQ ID NO: 315582 - protein, 9 aa, Influenza virus
ITGFAPFSK

SEQ ID NO: 315583 - protein, 9 aa, Influenza virus
TGFAPFSKD

SEQ ID NO: 315584 - protein, 9 aa, Influenza virus
GFAPFSKDN

SEQ ID NO: 315585 - protein, 9 aa, Influenza virus
FAPFSKDNS

SEQ ID NO: 315586 - protein, 9 aa, Influenza virus
APFSKDNSI

SEQ ID NO: 315587 - protein, 9 aa, Influenza virus
PFSKDNSIR

SEQ ID NO: 315588 - protein, 9 aa, Influenza virus
FSKDNSIRL

SEQ ID NO: 315589 - protein, 9 aa, Influenza virus
SKDNSIRLS

SEQ ID NO: 315590 - protein, 9 aa, Influenza virus
KDNSIRLSA

SEQ ID NO: 315591 - protein, 9 aa, Influenza virus
DNSIRLSAG

SEQ ID NO: 315592 - protein, 9 aa, Influenza virus
NSIRLSAGG

SEQ ID NO: 315593 - protein, 9 aa, Influenza virus
SIRLSAGGD

SEQ ID NO: 315594 - protein, 9 aa, Influenza virus
IRLSAGGDI

SEQ ID NO: 315595 - protein, 9 aa, Influenza virus
RLSAGGDIW

SEQ ID NO: 315596 - protein, 9 aa, Influenza virus
LSAGGDIWV

SEQ ID NO: 315597 - protein, 9 aa, Influenza virus
SAGGDIWVT

SEQ ID NO: 315598 - protein, 9 aa, Influenza virus
AGGDIWVTR

SEQ ID NO: 315599 - protein, 9 aa, Influenza virus
GGDIWVTRE

SEQ ID NO: 315600 - protein, 9 aa, Influenza virus
GDIWVTREP

SEQ ID NO: 315601 - protein, 9 aa, Influenza virus
DIWVTREPY

SEQ ID NO: 315602 - protein, 9 aa, Influenza virus
IWVTREPYV

SEQ ID NO: 315603 - protein, 9 aa, Influenza virus
WVTREPYVS

SEQ ID NO: 315604 - protein, 9 aa, Influenza virus
VTREPYVSC

SEQ ID NO: 315605 - protein, 9 aa, Influenza virus
TREPYVSCD

SEQ ID NO: 315606 - protein, 9 aa, Influenza virus
KCYQFALGQ

SEQ ID NO: 315607 - protein, 9 aa, Influenza virus
CYQFALGQG

SEQ ID NO: 315608 - protein, 9 aa, Influenza virus
YQFALGQGT

SEQ ID NO: 315609 - protein, 9 aa, Influenza virus
QFALGQGTT

SEQ ID NO: 315610 - protein, 9 aa, Influenza virus
FALGQGTTL

SEQ ID NO: 315611 - protein, 9 aa, Influenza virus
ALGQGTTLN

SEQ ID NO: 315612 - protein, 9 aa, Influenza virus
LGQGTTLNN

SEQ ID NO: 315613 - protein, 9 aa, Influenza virus
DRTPYRTLL

SEQ ID NO: 315614 - protein, 9 aa, Influenza virus
RTPYRTLLM

SEQ ID NO: 315615 - protein, 9 aa, Influenza virus
PYRTLLMNE

SEQ ID NO: 315616 - protein, 9 aa, Influenza virus
YRTLLMNEL

SEQ ID NO: 315617 - protein, 9 aa, Influenza virus
RTLLMNELG

SEQ ID NO: 315618 - protein, 9 aa, Influenza virus
TLLMNELGV

SEQ ID NO: 315619 - protein, 9 aa, Influenza virus
LLMNELGVP

SEQ ID NO: 315620 - protein, 9 aa, Influenza virus
LMNELGVPF

SEQ ID NO: 315621 - protein, 9 aa, Influenza virus
MNELGVPFH

SEQ ID NO: 315622 - protein, 9 aa, Influenza virus
NELGVPFHL

SEQ ID NO: 315623 - protein, 9 aa, Influenza virus
ELGVPFHLG

SEQ ID NO: 315624 - protein, 9 aa, Influenza virus
LGVPFHLGT

SEQ ID NO: 315625 - protein, 9 aa, Influenza virus
GVPFHLGTK

SEQ ID NO: 315626 - protein, 9 aa, Influenza virus
PFHLGTKQV

SEQ ID NO: 315627 - protein, 9 aa, Influenza virus
FHLGTKQVC

SEQ ID NO: 315628 - protein, 9 aa, Influenza virus
LGTKQVCIA

SEQ ID NO: 315629 - protein, 9 aa, Influenza virus
GTKQVCIAW

SEQ ID NO: 315630 - protein, 9 aa, Influenza virus
TKQVCIAWS

SEQ ID NO: 315631 - protein, 9 aa, Influenza virus
KQVCIAWSS

SEQ ID NO: 315632 - protein, 9 aa, Influenza virus
QVCIAWSSS

SEQ ID NO: 315633 - protein, 9 aa, Influenza virus
VCIAWSSSS

SEQ ID NO: 315634 - protein, 9 aa, Influenza virus
CIAWSSSSC

SEQ ID NO: 315635 - protein, 9 aa, Influenza virus
IAWSSSSCH

SEQ ID NO: 315636 - protein, 9 aa, Influenza virus
AWSSSSCHD

SEQ ID NO: 315637 - protein, 9 aa, Influenza virus
WSSSSCHDG

SEQ ID NO: 315638 - protein, 9 aa, Influenza virus
SSSSCHDGK

SEQ ID NO: 315639 - protein, 9 aa, Influenza virus
SSSCHDGKA

SEQ ID NO: 315640 - protein, 9 aa, Influenza virus
SSCHDGKAW

SEQ ID NO: 315641 - protein, 9 aa, Influenza virus
SCHDGKAWL

SEQ ID NO: 315642 - protein, 9 aa, Influenza virus
CHDGKAWLH

SEQ ID NO: 315643 - protein, 9 aa, Influenza virus
HDGKAWLHV

SEQ ID NO: 315644 - protein, 9 aa, Influenza virus
DGKAWLHVC

SEQ ID NO: 315645 - protein, 9 aa, Influenza virus
AWLHVCVTG

SEQ ID NO: 315646 - protein, 9 aa, Influenza virus
NILRTQESE

SEQ ID NO: 315647 - protein, 9 aa, Influenza virus
ILRTQESEC

SEQ ID NO: 315648 - protein, 9 aa, Influenza virus
LRTQESECV

SEQ ID NO: 315649 - protein, 9 aa, Influenza virus
RTQESECVC

SEQ ID NO: 315650 - protein, 9 aa, Influenza virus
TQESECVCI

SEQ ID NO: 315651 - protein, 9 aa, Influenza virus
TCTVVMTDG

SEQ ID NO: 315652 - protein, 9 aa, Influenza virus
CTVVMTDGS

SEQ ID NO: 315653 - protein, 9 aa, Influenza virus
TVVMTDGSA

SEQ ID NO: 315654 - protein, 9 aa, Influenza virus
VVMTDGSAS

SEQ ID NO: 315655 - protein, 9 aa, Influenza virus
VMTDGSASG

SEQ ID NO: 315656 - protein, 9 aa, Influenza virus
GSAQHVEEC

SEQ ID NO: 315657 - protein, 9 aa, Influenza virus
SAQHVEECS

SEQ ID NO: 315658 - protein, 9 aa, Influenza virus
AQHVEECSC

SEQ ID NO: 315659 - protein, 9 aa, Influenza virus
QHVEECSCY

SEQ ID NO: 315660 - protein, 9 aa, Influenza virus
HVEECSCYP

SEQ ID NO: 315661 - protein, 9 aa, Influenza virus
VEECSCYPR

SEQ ID NO: 315662 - protein, 9 aa, Influenza virus
EECSCYPRY

SEQ ID NO: 315663 - protein, 9 aa, Influenza virus
ECSCYPRYP

SEQ ID NO: 315664 - protein, 9 aa, Influenza virus
VRCVCRDNW

SEQ ID NO: 315665 - protein, 9 aa, Influenza virus
RCVCRDNWK

SEQ ID NO: 315666 - protein, 9 aa, Influenza virus
CVCRDNWKG

SEQ ID NO: 315667 - protein, 9 aa, Influenza virus
VCRDNWKGS

SEQ ID NO: 315668 - protein, 9 aa, Influenza virus
CRDNWKGSN

SEQ ID NO: 315669 - protein, 9 aa, Influenza virus
RDNWKGSNR

SEQ ID NO: 315670 - protein, 9 aa, Influenza virus
DNWKGSNRP

SEQ ID NO: 315671 - protein, 9 aa, Influenza virus
NWKGSNRPI

SEQ ID NO: 315672 - protein, 9 aa, Influenza virus
WKGSNRPIV

SEQ ID NO: 315673 - protein, 9 aa, Influenza virus
KGSNRPIVD

SEQ ID NO: 315674 - protein, 9 aa, Influenza virus
GSNRPIVDI

SEQ ID NO: 315675 - protein, 9 aa, Influenza virus
SSYVCSGLV

SEQ ID NO: 315676 - protein, 9 aa, Influenza virus
SYVCSGLVG

SEQ ID NO: 315677 - protein, 9 aa, Influenza virus
YVCSGLVGD

SEQ ID NO: 315678 - protein, 9 aa, Influenza virus
VCSGLVGDT

SEQ ID NO: 315679 - protein, 9 aa, Influenza virus
CSGLVGDTP

SEQ ID NO: 315680 - protein, 9 aa, Influenza virus
SGLVGDTPR

SEQ ID NO: 315681 - protein, 9 aa, Influenza virus
GGHGVKGWA

SEQ ID NO: 315682 - protein, 9 aa, Influenza virus
GHGVKGWAF

SEQ ID NO: 315683 - protein, 9 aa, Influenza virus
HGVKGWAFD

SEQ ID NO: 315684 - protein, 9 aa, Influenza virus
GVKGWAFDD

SEQ ID NO: 315685 - protein, 9 aa, Influenza virus
RSGYETFKV

SEQ ID NO: 315686 - protein, 9 aa, Influenza virus
SGYETFKVI

SEQ ID NO: 315687 - protein, 9 aa, Influenza virus
RSGYSGIFS

SEQ ID NO: 315688 - protein, 9 aa, Influenza virus
SGYSGIFSV

SEQ ID NO: 315689 - protein, 9 aa, Influenza virus
GYSGIFSVE

SEQ ID NO: 315690 - protein, 9 aa, Influenza virus
SCINRCFYV

SEQ ID NO: 315691 - protein, 9 aa, Influenza virus
CINRCFYVE

SEQ ID NO: 315692 - protein, 9 aa, Influenza virus
INRCFYVEL

SEQ ID NO: 315693 - protein, 9 aa, Influenza virus
NRCFYVELI

SEQ ID NO: 315694 - protein, 9 aa, Influenza virus
RCFYVELIR

SEQ ID NO: 315695 - protein, 9 aa, Influenza virus
CFYVELIRG

SEQ ID NO: 315696 - protein, 9 aa, Influenza virus
FYVELIRGR

SEQ ID NO: 315697 - protein, 9 aa, Influenza virus
YVELIRGRK

SEQ ID NO: 315698 - protein, 9 aa, Influenza virus
VWWTSNSIV

SEQ ID NO: 315699 - protein, 9 aa, Influenza virus
WWTSNSIVV

SEQ ID NO: 315700 - protein, 9 aa, Influenza virus
WTSNSIVVF

SEQ ID NO: 315701 - protein, 9 aa, Influenza virus
TSNSIVVFC

SEQ ID NO: 315702 - protein, 9 aa, Influenza virus
SNSIVVFCG

SEQ ID NO: 315703 - protein, 9 aa, Influenza virus
NSIVVFCGT

SEQ ID NO: 315704 - protein, 9 aa, Influenza virus
SIVVFCGTS

SEQ ID NO: 315705 - protein, 9 aa, Influenza virus
IVVFCGTSG

SEQ ID NO: 315706 - protein, 9 aa, Influenza virus
VVFCGTSGT

SEQ ID NO: 315707 - protein, 9 aa, Influenza virus
VFCGTSGTY

SEQ ID NO: 315708 - protein, 9 aa, Influenza virus
FCGTSGTYG

SEQ ID NO: 315709 - protein, 9 aa, Influenza virus
GTYGTGSWP

SEQ ID NO: 315710 - protein, 9 aa, Influenza virus
TYGTGSWPD

SEQ ID NO: 315711 - protein, 9 aa, Influenza virus
YGTGSWPDG

SEQ ID NO: 315712 - protein, 9 aa, Influenza virus
GTGSWPDGA

SEQ ID NO: 315713 - protein, 9 aa, Influenza virus
GSWPDGADI

SEQ ID NO: 315714 - protein, 9 aa, Influenza virus
RTSISCLYK

SEQ ID NO: 315715 - protein, 9 aa, Influenza virus
TSISCLYKL

SEQ ID NO: 315716 - protein, 9 aa, Influenza virus
SISCLYKLS

SEQ ID NO: 315717 - protein, 9 aa, Influenza virus
ISCLYKLSQ

SEQ ID NO: 315718 - protein, 9 aa, Influenza virus
SCLYKLSQF

SEQ ID NO: 315719 - protein, 9 aa, Influenza virus
MDNQTKTMT

SEQ ID NO: 315720 - protein, 9 aa, Influenza virus
DNQTKTMTI

SEQ ID NO: 315721 - protein, 9 aa, Influenza virus
NQTKTMTIT

SEQ ID NO: 315722 - protein, 9 aa, Influenza virus
QTKTMTITF

SEQ ID NO: 315723 - protein, 9 aa, Influenza virus
TKTMTITFL

SEQ ID NO: 315724 - protein, 9 aa, Influenza virus
KTMTITFLI

SEQ ID NO: 315725 - protein, 9 aa, Influenza virus
TMTITFLIL

SEQ ID NO: 315726 - protein, 9 aa, Influenza virus
GDQICIGYH

SEQ ID NO: 315727 - protein, 9 aa, Influenza virus
DQICIGYHA

SEQ ID NO: 315728 - protein, 9 aa, Influenza virus
QICIGYHAN

SEQ ID NO: 315729 - protein, 9 aa, Influenza virus
ICIGYHANN

SEQ ID NO: 315730 - protein, 9 aa, Influenza virus
CIGYHANNS

SEQ ID NO: 315731 - protein, 9 aa, Influenza virus
IGYHANNST

SEQ ID NO: 315732 - protein, 9 aa, Influenza virus
GYHANNSTE

SEQ ID NO: 315733 - protein, 9 aa, Influenza virus
YHANNSTEK

SEQ ID NO: 315734 - protein, 9 aa, Influenza virus
NNSTEKVDT

SEQ ID NO: 315735 - protein, 9 aa, Influenza virus
DTILERNVT

SEQ ID NO: 315736 - protein, 9 aa, Influenza virus
TILERNVTV

SEQ ID NO: 315737 - protein, 9 aa, Influenza virus
ILERNVTVT

SEQ ID NO: 315738 - protein, 9 aa, Influenza virus
LERNVTVTH

SEQ ID NO: 315739 - protein, 9 aa, Influenza virus
ERNVTVTHA

SEQ ID NO: 315740 - protein, 9 aa, Influenza virus
RNVTVTHAK

SEQ ID NO: 315741 - protein, 9 aa, Influenza virus
NVTVTHAKD

SEQ ID NO: 315742 - protein, 9 aa, Influenza virus
VTVTHAKDI

SEQ ID NO: 315743 - protein, 9 aa, Influenza virus
TVTHAKDIL

SEQ ID NO: 315744 - protein, 9 aa, Influenza virus
VTHAKDILE

SEQ ID NO: 315745 - protein, 9 aa, Influenza virus
THAKDILEK

SEQ ID NO: 315746 - protein, 9 aa, Influenza virus
DILEKTHNG

SEQ ID NO: 315747 - protein, 9 aa, Influenza virus
ILEKTHNGK

SEQ ID NO: 315748 - protein, 9 aa, Influenza virus
LEKTHNGKL

SEQ ID NO: 315749 - protein, 9 aa, Influenza virus
EKTHNGKLC

SEQ ID NO: 315750 - protein, 9 aa, Influenza virus
THNGKLCKL

SEQ ID NO: 315751 - protein, 9 aa, Influenza virus
HNGKLCKLN

SEQ ID NO: 315752 - protein, 9 aa, Influenza virus
NGKLCKLNG

SEQ ID NO: 315753 - protein, 9 aa, Influenza virus
LNGIPPLEL

SEQ ID NO: 315754 - protein, 9 aa, Influenza virus
GIPPLELGD

SEQ ID NO: 315755 - protein, 9 aa, Influenza virus
IPPLELGDC

SEQ ID NO: 315756 - protein, 9 aa, Influenza virus
PPLELGDCS

SEQ ID NO: 315757 - protein, 9 aa, Influenza virus
PLELGDCSI

SEQ ID NO: 315758 - protein, 9 aa, Influenza virus
LELGDCSIA

SEQ ID NO: 315759 - protein, 9 aa, Influenza virus
ELGDCSIAG

SEQ ID NO: 315760 - protein, 9 aa, Influenza virus
LGDCSIAGW

SEQ ID NO: 315761 - protein, 9 aa, Influenza virus
GDCSIAGWL

SEQ ID NO: 315762 - protein, 9 aa, Influenza virus
DCSIAGWLL

SEQ ID NO: 315763 - protein, 9 aa, Influenza virus
CSIAGWLLG

SEQ ID NO: 315764 - protein, 9 aa, Influenza virus
SIAGWLLGN

SEQ ID NO: 315765 - protein, 9 aa, Influenza virus
IAGWLLGNP

SEQ ID NO: 315766 - protein, 9 aa, Influenza virus
AGWLLGNPE

SEQ ID NO: 315767 - protein, 9 aa, Influenza virus
GWLLGNPEC

SEQ ID NO: 315768 - protein, 9 aa, Influenza virus
WLLGNPECD

SEQ ID NO: 315769 - protein, 9 aa, Influenza virus
LLGNPECDR

SEQ ID NO: 315770 - protein, 9 aa, Influenza virus
LGNPECDRL

SEQ ID NO: 315771 - protein, 9 aa, Influenza virus
GNPECDRLL

SEQ ID NO: 315772 - protein, 9 aa, Influenza virus
VPEWSYIVE

SEQ ID NO: 315773 - protein, 9 aa, Influenza virus
PEWSYIMEK

SEQ ID NO: 315774 - protein, 9 aa, Influenza virus
EWSYIVEKE

SEQ ID NO: 315775 - protein, 9 aa, Influenza virus
PSFFRNMVW

SEQ ID NO: 315776 - protein, 9 aa, Influenza virus
SFFRNMVWL

SEQ ID NO: 315777 - protein, 9 aa, Influenza virus
FFRNMVWLT

SEQ ID NO: 315778 - protein, 9 aa, Influenza virus
RSYNNTSGE

SEQ ID NO: 315779 - protein, 9 aa, Influenza virus
SYNNTSGEQ

SEQ ID NO: 315780 - protein, 9 aa, Influenza virus
YNNTSGEQM

SEQ ID NO: 315781 - protein, 9 aa, Influenza virus
NNTSGEQML

SEQ ID NO: 315782 - protein, 9 aa, Influenza virus
RMEFSWTLL

SEQ ID NO: 315783 - protein, 9 aa, Influenza virus
INFESTGNL

SEQ ID NO: 315784 - protein, 9 aa, Influenza virus
NFESTGNLI

SEQ ID NO: 315785 - protein, 9 aa, Influenza virus
FESTGNLIA

SEQ ID NO: 315786 - protein, 9 aa, Influenza virus
ESTGNLIAP

SEQ ID NO: 315787 - protein, 9 aa, Influenza virus
STGNLIAPE

SEQ ID NO: 315788 - protein, 9 aa, Influenza virus
TGNLIAPEY

SEQ ID NO: 315789 - protein, 9 aa, Influenza virus
GNLIAPEYG

SEQ ID NO: 315790 - protein, 9 aa, Influenza virus
NLIAPEYGF

SEQ ID NO: 315791 - protein, 9 aa, Influenza virus
LIAPEYGFK

SEQ ID NO: 315792 - protein, 9 aa, Influenza virus
IAPEYGFKI

SEQ ID NO: 315793 - protein, 9 aa, Influenza virus
APEYGFKIS

SEQ ID NO: 315794 - protein, 9 aa, Influenza virus
PEYGFKISK

SEQ ID NO: 315795 - protein, 9 aa, Influenza virus
EYGFKISKR

SEQ ID NO: 315796 - protein, 9 aa, Influenza virus
YGFKISKRG

SEQ ID NO: 315797 - protein, 9 aa, Influenza virus
GFKISKRGS

SEQ ID NO: 315798 - protein, 9 aa, Influenza virus
FKISKRGSS

SEQ ID NO: 315799 - protein, 9 aa, Influenza virus
KISKRGSSG

SEQ ID NO: 315800 - protein, 9 aa, Influenza virus
ISKRGSSGI

SEQ ID NO: 315801 - protein, 9 aa, Influenza virus
SKRGSSGIM

SEQ ID NO: 315802 - protein, 9 aa, Influenza virus
KRGSSGIMK

SEQ ID NO: 315803 - protein, 9 aa, Influenza virus
RGSSGIMKT

SEQ ID NO: 315804 - protein, 9 aa, Influenza virus
CETKCQTPL

SEQ ID NO: 315805 - protein, 9 aa, Influenza virus
ETKCQTPLG

SEQ ID NO: 315806 - protein, 9 aa, Influenza virus
TKCQTPLGA

SEQ ID NO: 315807 - protein, 9 aa, Influenza virus
KCQTPLGAI

SEQ ID NO: 315808 - protein, 9 aa, Influenza virus
CQTPLGAIN

SEQ ID NO: 315809 - protein, 9 aa, Influenza virus
QTPLGAINT

SEQ ID NO: 315810 - protein, 9 aa, Influenza virus
TPLGAINTT

SEQ ID NO: 315811 - protein, 9 aa, Influenza virus
PLGAINTTL

SEQ ID NO: 315812 - protein, 9 aa, Influenza virus
LGAINTTLP

SEQ ID NO: 315813 - protein, 9 aa, Influenza virus
GAINTTLPF

SEQ ID NO: 315814 - protein, 9 aa, Influenza virus
AINTTLPFH

SEQ ID NO: 315815 - protein, 9 aa, Influenza virus
INTTLPFHN

SEQ ID NO: 315816 - protein, 9 aa, Influenza virus
NTTLPFHNI

SEQ ID NO: 315817 - protein, 9 aa, Influenza virus
TTLPFHNIH

SEQ ID NO: 315818 - protein, 9 aa, Influenza virus
TLPFHNIHP

SEQ ID NO: 315819 - protein, 9 aa, Influenza virus
LPFHNIHPL

SEQ ID NO: 315820 - protein, 9 aa, Influenza virus
PFHNIHPLT

SEQ ID NO: 315821 - protein, 9 aa, Influenza virus
FHNIHPLTI

SEQ ID NO: 315822 - protein, 9 aa, Influenza virus
HNIHPLTIG

SEQ ID NO: 315823 - protein, 9 aa, Influenza virus
NIHPLTIGE

SEQ ID NO: 315824 - protein, 9 aa, Influenza virus
IHPLTIGEC

SEQ ID NO: 315825 - protein, 9 aa, Influenza virus
HPLTIGECP

SEQ ID NO: 315826 - protein, 9 aa, Influenza virus
PLTIGECPK

SEQ ID NO: 315827 - protein, 9 aa, Influenza virus
LTIGECPKY

SEQ ID NO: 315828 - protein, 9 aa, Influenza virus
TIGECPKYV

SEQ ID NO: 315829 - protein, 9 aa, Influenza virus
IGECPKYVK

SEQ ID NO: 315830 - protein, 9 aa, Influenza virus
GECPKYVKS

SEQ ID NO: 315831 - protein, 9 aa, Influenza virus
LVLATGLRN

SEQ ID NO: 315832 - protein, 9 aa, Influenza virus
PQIESRGLF

SEQ ID NO: 315833 - protein, 9 aa, Influenza virus
QIESRGLFG

SEQ ID NO: 315834 - protein, 9 aa, Influenza virus
IESRGLFGA

SEQ ID NO: 315835 - protein, 9 aa, Influenza virus
ESRGLFGAI

SEQ ID NO: 315836 - protein, 9 aa, Influenza virus
SRGLFGAIA

SEQ ID NO: 315837 - protein, 9 aa, Influenza virus
RGLFGAIAG

SEQ ID NO: 315838 - protein, 9 aa, Influenza virus
GLFGAIAGF

SEQ ID NO: 315839 - protein, 9 aa, Influenza virus
LFGAIAGFI

SEQ ID NO: 315840 - protein, 9 aa, Influenza virus
FGAIAGFIE

SEQ ID NO: 315841 - protein, 9 aa, Influenza virus
GAIAGFIEG

SEQ ID NO: 315842 - protein, 9 aa, Influenza virus
AIAGFIEGG

SEQ ID NO: 315843 - protein, 9 aa, Influenza virus
IAGFIEGGW

SEQ ID NO: 315844 - protein, 9 aa, Influenza virus
AGFIEGGWQ

SEQ ID NO: 315845 - protein, 9 aa, Influenza virus
GFIEGGWQG

SEQ ID NO: 315846 - protein, 9 aa, Influenza virus
FIEGGWQGM

SEQ ID NO: 315847 - protein, 9 aa, Influenza virus
IEGGWQGMV

SEQ ID NO: 315848 - protein, 9 aa, Influenza virus
EGGWQGMVD

SEQ ID NO: 315849 - protein, 9 aa, Influenza virus
GGWQGMVDG

SEQ ID NO: 315850 - protein, 9 aa, Influenza virus
GWQGMVDGW

SEQ ID NO: 315851 - protein, 9 aa, Influenza virus
WQGMVDGWY

SEQ ID NO: 315852 - protein, 9 aa, Influenza virus
QGMVDGWYG

SEQ ID NO: 315853 - protein, 9 aa, Influenza virus
GMVDGWYGY

SEQ ID NO: 315854 - protein, 9 aa, Influenza virus
MVDGWYGYH

SEQ ID NO: 315855 - protein, 9 aa, Influenza virus
VDGWYGYHH

SEQ ID NO: 315856 - protein, 9 aa, Influenza virus
DGWYGYHHS

SEQ ID NO: 315857 - protein, 9 aa, Influenza virus
GWYGYHHSN

SEQ ID NO: 315858 - protein, 9 aa, Influenza virus
WYGYHHSND

SEQ ID NO: 315859 - protein, 9 aa, Influenza virus
YGYHHSNDQ

SEQ ID NO: 315860 - protein, 9 aa, Influenza virus
GYHHSNDQG

SEQ ID NO: 315861 - protein, 9 aa, Influenza virus
YHHSNDQGS

SEQ ID NO: 315862 - protein, 9 aa, Influenza virus
HHSNDQGSG

SEQ ID NO: 315863 - protein, 9 aa, Influenza virus
HSNDQGSGY

SEQ ID NO: 315864 - protein, 9 aa, Influenza virus
SNDQGSGYA

SEQ ID NO: 315865 - protein, 9 aa, Influenza virus
NDQGSGYAA

SEQ ID NO: 315866 - protein, 9 aa, Influenza virus
DQGSGYAAD

SEQ ID NO: 315867 - protein, 9 aa, Influenza virus
QGSGYAADK

SEQ ID NO: 315868 - protein, 9 aa, Influenza virus
GSGYAADKE

SEQ ID NO: 315869 - protein, 9 aa, Influenza virus
SGYAADKES

SEQ ID NO: 315870 - protein, 9 aa, Influenza virus
GYAADKEST

SEQ ID NO: 315871 - protein, 9 aa, Influenza virus
YAADKESTQ

SEQ ID NO: 315872 - protein, 9 aa, Influenza virus
AADKESTQK

SEQ ID NO: 315873 - protein, 9 aa, Influenza virus
ADKESTQKA

SEQ ID NO: 315874 - protein, 9 aa, Influenza virus
NSVIEKMNT

SEQ ID NO: 315875 - protein, 9 aa, Influenza virus
VGKEFNNLE

SEQ ID NO: 315876 - protein, 9 aa, Influenza virus
NLERRLENL

SEQ ID NO: 315877 - protein, 9 aa, Influenza virus
LERRLENLN

SEQ ID NO: 315878 - protein, 9 aa, Influenza virus
ERRLENLNK

SEQ ID NO: 315879 - protein, 9 aa, Influenza virus
RRLENLNKK

SEQ ID NO: 315880 - protein, 9 aa, Influenza virus
RLENLNKKM

SEQ ID NO: 315881 - protein, 9 aa, Influenza virus
LENLNKKME

SEQ ID NO: 315882 - protein, 9 aa, Influenza virus
ENLNKKMED

SEQ ID NO: 315883 - protein, 9 aa, Influenza virus
NLNKKMEDG

SEQ ID NO: 315884 - protein, 9 aa, Influenza virus
LNKKMEDGF

SEQ ID NO: 315885 - protein, 9 aa, Influenza virus
VWTYNAELL

SEQ ID NO: 315886 - protein, 9 aa, Influenza virus
WTYNAELLV

SEQ ID NO: 315887 - protein, 9 aa, Influenza virus
TYNAELLVL

SEQ ID NO: 315888 - protein, 9 aa, Influenza virus
YNAELLVLM

SEQ ID NO: 315889 - protein, 9 aa, Influenza virus
NAELLVLME

SEQ ID NO: 315890 - protein, 9 aa, Influenza virus
AELLVLMEN

SEQ ID NO: 315891 - protein, 9 aa, Influenza virus
ELLVLMENE

SEQ ID NO: 315892 - protein, 9 aa, Influenza virus
LLVLMENER

SEQ ID NO: 315893 - protein, 9 aa, Influenza virus
LVLMENERT

SEQ ID NO: 315894 - protein, 9 aa, Influenza virus
VLMENERTL

SEQ ID NO: 315895 - protein, 9 aa, Influenza virus
LMENERTLD

SEQ ID NO: 315896 - protein, 9 aa, Influenza virus
MENERTLDF

SEQ ID NO: 315897 - protein, 9 aa, Influenza virus
ENERTLDFH

SEQ ID NO: 315898 - protein, 9 aa, Influenza virus
NERTLDFHD

SEQ ID NO: 315899 - protein, 9 aa, Influenza virus
ERTLDFHDS

SEQ ID NO: 315900 - protein, 9 aa, Influenza virus
RTLDFHDSN

SEQ ID NO: 315901 - protein, 9 aa, Influenza virus
TLDFHDSNV

SEQ ID NO: 315902 - protein, 9 aa, Influenza virus
LDFHDSNVK

SEQ ID NO: 315903 - protein, 9 aa, Influenza virus
DFHDSNVKN

SEQ ID NO: 315904 - protein, 9 aa, Influenza virus
FHDSNVKNL

SEQ ID NO: 315905 - protein, 9 aa, Influenza virus
HDSNVKNLY

SEQ ID NO: 315906 - protein, 9 aa, Influenza virus
DSNVKNLYD

SEQ ID NO: 315907 - protein, 9 aa, Influenza virus
NLYDKVRMQ

SEQ ID NO: 315908 - protein, 9 aa, Influenza virus
LYDKVRMQL

SEQ ID NO: 315909 - protein, 9 aa, Influenza virus
YDKVRMQLR

SEQ ID NO: 315910 - protein, 9 aa, Influenza virus
DKVRMQLRD

SEQ ID NO: 315911 - protein, 9 aa, Influenza virus
KVRMQLRDN

SEQ ID NO: 315912 - protein, 9 aa, Influenza virus
VRMQLRDNA

SEQ ID NO: 315913 - protein, 9 aa, Influenza virus
RMQLRDNAK

SEQ ID NO: 315914 - protein, 9 aa, Influenza virus
MQLRDNAKE

SEQ ID NO: 315915 - protein, 9 aa, Influenza virus
QLRDNAKEI

SEQ ID NO: 315916 - protein, 9 aa, Influenza virus
LRDNAKEIG

SEQ ID NO: 315917 - protein, 9 aa, Influenza virus
DNAKEIGNG

SEQ ID NO: 315918 - protein, 9 aa, Influenza virus
NAKEIGNGC

SEQ ID NO: 315919 - protein, 9 aa, Influenza virus
AKEIGNGCF

SEQ ID NO: 315920 - protein, 9 aa, Influenza virus
KEIGNGCFE

SEQ ID NO: 315921 - protein, 9 aa, Influenza virus
EIGNGCFEF

SEQ ID NO: 315922 - protein, 9 aa, Influenza virus
IGNGCFEFY

SEQ ID NO: 315923 - protein, 9 aa, Influenza virus
GNGCFEFYH

SEQ ID NO: 315924 - protein, 9 aa, Influenza virus
NGCFEFYHK

SEQ ID NO: 315925 - protein, 9 aa, Influenza virus
GCFEFYHKC

SEQ ID NO: 315926 - protein, 9 aa, Influenza virus
CFEFYHKCD

SEQ ID NO: 315927 - protein, 9 aa, Influenza virus
FEFYHKCDD

SEQ ID NO: 315928 - protein, 9 aa, Influenza virus
EFYHKCDDE

SEQ ID NO: 315929 - protein, 9 aa, Influenza virus
FYHKCDDEC

SEQ ID NO: 315930 - protein, 9 aa, Influenza virus
YHKCDDECM

SEQ ID NO: 315931 - protein, 9 aa, Influenza virus
HKCDDECMN

SEQ ID NO: 315932 - protein, 9 aa, Influenza virus
KCDDECMNS

SEQ ID NO: 315933 - protein, 9 aa, Influenza virus
SVKNGTYDY

SEQ ID NO: 315934 - protein, 9 aa, Influenza virus
NGTYDYPKY

SEQ ID NO: 315935 - protein, 9 aa, Influenza virus
GTYDYPKYE

SEQ ID NO: 315936 - protein, 9 aa, Influenza virus
TYDYPKYEE

SEQ ID NO: 315937 - protein, 9 aa, Influenza virus
YDYPKYEEE

SEQ ID NO: 315938 - protein, 9 aa, Influenza virus
DYPKYEEES

SEQ ID NO: 315939 - protein, 9 aa, Influenza virus
YPKYEEESK

SEQ ID NO: 315940 - protein, 9 aa, Influenza virus
PKYEEESKL

SEQ ID NO: 315941 - protein, 9 aa, Influenza virus
KYEEESKLN

SEQ ID NO: 315942 - protein, 9 aa, Influenza virus
YEEESKLNR

SEQ ID NO: 315943 - protein, 9 aa, Influenza virus
EEESKLNRN

SEQ ID NO: 315944 - protein, 9 aa, Influenza virus
EESKLNRNE

SEQ ID NO: 315945 - protein, 9 aa, Influenza virus
ESKLNRNEI

SEQ ID NO: 315946 - protein, 9 aa, Influenza virus
SKLNRNEIK

SEQ ID NO: 315947 - protein, 9 aa, Influenza virus
KLNRNEIKG

SEQ ID NO: 315948 - protein, 9 aa, Influenza virus
MGVYQILAI

SEQ ID NO: 315949 - protein, 9 aa, Influenza virus
GVYQILAIY

SEQ ID NO: 315950 - protein, 9 aa, Influenza virus
VYQILAIYA

SEQ ID NO: 315951 - protein, 9 aa, Influenza virus
YQILAIYAT

SEQ ID NO: 315952 - protein, 9 aa, Influenza virus
QILAIYATV

SEQ ID NO: 315953 - protein, 9 aa, Influenza virus
ILAIYATVA

SEQ ID NO: 315954 - protein, 9 aa, Influenza virus
LAIYATVAG

SEQ ID NO: 315955 - protein, 9 aa, Influenza virus
AIYATVAGS

SEQ ID NO: 315956 - protein, 9 aa, Influenza virus
IYATVAGSL

SEQ ID NO: 315957 - protein, 9 aa, Influenza virus
YATVAGSLS

SEQ ID NO: 315958 - protein, 9 aa, Influenza virus
ATVAGSLSL

SEQ ID NO: 315959 - protein, 9 aa, Influenza virus
TVAGSLSLA

SEQ ID NO: 315960 - protein, 9 aa, Influenza virus
VAGSLSLAI

SEQ ID NO: 315961 - protein, 9 aa, Influenza virus
AGSLSLAIM

SEQ ID NO: 315962 - protein, 9 aa, Influenza virus
GSLSLAIMI

SEQ ID NO: 315963 - protein, 9 aa, Influenza virus
SLSLAIMIA

SEQ ID NO: 315964 - protein, 9 aa, Influenza virus
LSLAIMIAG

SEQ ID NO: 315965 - protein, 9 aa, Influenza virus
SLAIMIAGI

SEQ ID NO: 315966 - protein, 9 aa, Influenza virus
LAIMIAGIS

SEQ ID NO: 315967 - protein, 9 aa, Influenza virus
AGISFWMCS

SEQ ID NO: 315968 - protein, 9 aa, Influenza virus
GISFWMCSN

SEQ ID NO: 315969 - protein, 9 aa, Influenza virus
ISFWMCSNG

SEQ ID NO: 315970 - protein, 9 aa, Influenza virus
SFWMCSNGS

SEQ ID NO: 315971 - protein, 9 aa, Influenza virus
FWMCSNGSL

SEQ ID NO: 315972 - protein, 9 aa, Influenza virus
WMCSNGSLQ

SEQ ID NO: 315973 - protein, 9 aa, Influenza virus
MCSNGSLQC

SEQ ID NO: 315974 - protein, 9 aa, Influenza virus
CSNGSLQCR

SEQ ID NO: 315975 - protein, 9 aa, Influenza virus
SNGSLQCRI

SEQ ID NO: 315976 - protein, 9 aa, Influenza virus
NGSLQCRIC

SEQ ID NO: 315977 - protein, 9 aa, Influenza virus
GSLQCRICI

SEQ ID NO: 315978 - protein, 9 aa, Influenza virus
VRGDQICIG

SEQ ID NO: 315979 - protein, 9 aa, Influenza virus
RGDQICIGY

SEQ ID NO: 315980 - protein, 9 aa, Influenza virus
GDQICIGYH

SEQ ID NO: 315981 - protein, 9 aa, Influenza virus
DQICIGYHA

SEQ ID NO: 315982 - protein, 9 aa, Influenza virus
QICIGYHAN

SEQ ID NO: 315983 - protein, 9 aa, Influenza virus
ICIGYHANN

SEQ ID NO: 315984 - protein, 9 aa, Influenza virus
CIGYHANNS

SEQ ID NO: 315985 - protein, 9 aa, Influenza virus
IGYHANNST

SEQ ID NO: 315986 - protein, 9 aa, Influenza virus
GYHANNSTE

SEQ ID NO: 315987 - protein, 9 aa, Influenza virus
YHANNSTEK

SEQ ID NO: 315988 - protein, 9 aa, Influenza virus
NNSTEKVDT

SEQ ID NO: 315989 - protein, 9 aa, Influenza virus
KVDTILERN

SEQ ID NO: 315990 - protein, 9 aa, Influenza virus
VDTILERNV

SEQ ID NO: 315991 - protein, 9 aa, Influenza virus
DTILERNVT

SEQ ID NO: 315992 - protein, 9 aa, Influenza virus
TILERNVTV

SEQ ID NO: 315993 - protein, 9 aa, Influenza virus
ILERNVTVT

SEQ ID NO: 315994 - protein, 9 aa, Influenza virus
LERNVTVTH

SEQ ID NO: 315995 - protein, 9 aa, Influenza virus
ERNVTVTHA

SEQ ID NO: 315996 - protein, 9 aa, Influenza virus
RNVTVTHAK

SEQ ID NO: 315997 - protein, 9 aa, Influenza virus
NVTVTHAKD

SEQ ID NO: 315998 - protein, 9 aa, Influenza virus
VTVTHAKDI

SEQ ID NO: 315999 - protein, 9 aa, Influenza virus
TVTHAKDIL

SEQ ID NO: 316000 - protein, 9 aa, Influenza virus
VTHAKDILE

SEQ ID NO: 316001 - protein, 9 aa, Influenza virus
THAKDILEK

SEQ ID NO: 316002 - protein, 9 aa, Influenza virus
HAKDILEKT

SEQ ID NO: 316003 - protein, 9 aa, Influenza virus
AKDILEKTH

SEQ ID NO: 316004 - protein, 9 aa, Influenza virus
KDILEKTHN

SEQ ID NO: 316005 - protein, 9 aa, Influenza virus
DILEKTHNG

SEQ ID NO: 316006 - protein, 9 aa, Influenza virus
ILEKTHNGK

SEQ ID NO: 316007 - protein, 9 aa, Influenza virus
LEKTHNGKL

SEQ ID NO: 316008 - protein, 9 aa, Influenza virus
EKTHNGKLC

SEQ ID NO: 316009 - protein, 9 aa, Influenza virus
KTHNGKLCK

SEQ ID NO: 316010 - protein, 9 aa, Influenza virus
THNGKLCKL

SEQ ID NO: 316011 - protein, 9 aa, Influenza virus
HNGKLCKLN

SEQ ID NO: 316012 - protein, 9 aa, Influenza virus
NGKLCKLNG

SEQ ID NO: 316013 - protein, 9 aa, Influenza virus
GKLCKLNGI

SEQ ID NO: 316014 - protein, 9 aa, Influenza virus
KLCKLNGIP

SEQ ID NO: 316015 - protein, 9 aa, Influenza virus
LCKLNGIPP

SEQ ID NO: 316016 - protein, 9 aa, Influenza virus
CKLNGIPPL

SEQ ID NO: 316017 - protein, 9 aa, Influenza virus
KLNGIPPLE

SEQ ID NO: 316018 - protein, 9 aa, Influenza virus
LNGIPPLEL

SEQ ID NO: 316019 - protein, 9 aa, Influenza virus
NGIPPLELG

SEQ ID NO: 316020 - protein, 9 aa, Influenza virus
GIPPLELGD

SEQ ID NO: 316021 - protein, 9 aa, Influenza virus
IPPLELGDC

SEQ ID NO: 316022 - protein, 9 aa, Influenza virus
PPLELGDCS

SEQ ID NO: 316023 - protein, 9 aa, Influenza virus
PLELGDCSI

SEQ ID NO: 316024 - protein, 9 aa, Influenza virus
LELGDCSIA

SEQ ID NO: 316025 - protein, 9 aa, Influenza virus
ELGDCSIAG

SEQ ID NO: 316026 - protein, 9 aa, Influenza virus
LGDCSIAGW

SEQ ID NO: 316027 - protein, 9 aa, Influenza virus
GDCSIAGWL

SEQ ID NO: 316028 - protein, 9 aa, Influenza virus
DCSIAGWLL

SEQ ID NO: 316029 - protein, 9 aa, Influenza virus
CSIAGWLLG

SEQ ID NO: 316030 - protein, 9 aa, Influenza virus
SIAGWLLGN

SEQ ID NO: 316031 - protein, 9 aa, Influenza virus
IAGWLLGNP

SEQ ID NO: 316032 - protein, 9 aa, Influenza virus
AGWLLGNPE

SEQ ID NO: 316033 - protein, 9 aa, Influenza virus
GWLLGNPEC

SEQ ID NO: 316034 - protein, 9 aa, Influenza virus
WLLGNPECD

SEQ ID NO: 316035 - protein, 9 aa, Influenza virus
LLGNPECDR

SEQ ID NO: 316036 - protein, 9 aa, Influenza virus
LGNPECDRL

SEQ ID NO: 316037 - protein, 9 aa, Influenza virus
GNPECDRLL

SEQ ID NO: 316038 - protein, 9 aa, Influenza virus
NPECDRLLS

SEQ ID NO: 316039 - protein, 9 aa, Influenza virus
LSVPEWSYI

SEQ ID NO: 316040 - protein, 9 aa, Influenza virus
VPEWSYIME

SEQ ID NO: 316041 - protein, 9 aa, Influenza virus
PEWSYIMEK

SEQ ID NO: 316042 - protein, 9 aa, Influenza virus
EWSYIMEKE

SEQ ID NO: 316043 - protein, 9 aa, Influenza virus
WSYIMEKEN

SEQ ID NO: 316044 - protein, 9 aa, Influenza virus
SYIMEKENP

SEQ ID NO: 316045 - protein, 9 aa, Influenza virus
GLCYPGSFN

SEQ ID NO: 316046 - protein, 9 aa, Influenza virus
LCYPGSFND

SEQ ID NO: 316047 - protein, 9 aa, Influenza virus
CYPGSFNDY

SEQ ID NO: 316048 - protein, 9 aa, Influenza virus
YPGSFNDYE

SEQ ID NO: 316049 - protein, 9 aa, Influenza virus
PGSFNDYEE

SEQ ID NO: 316050 - protein, 9 aa, Influenza virus
GSFNDYEEL

SEQ ID NO: 316051 - protein, 9 aa, Influenza virus
SFNDYEELK

SEQ ID NO: 316052 - protein, 9 aa, Influenza virus
FNDYEELKH

SEQ ID NO: 316053 - protein, 9 aa, Influenza virus
NDYEELKHL

SEQ ID NO: 316054 - protein, 9 aa, Influenza virus
VKHFEKVKI

SEQ ID NO: 316055 - protein, 9 aa, Influenza virus
KHFEKVKIL

SEQ ID NO: 316056 - protein, 9 aa, Influenza virus
HFEKVKILP

SEQ ID NO: 316057 - protein, 9 aa, Influenza virus
FEKVKILPK

SEQ ID NO: 316058 - protein, 9 aa, Influenza virus
EKVKILPKD

SEQ ID NO: 316059 - protein, 9 aa, Influenza virus
PSFFRNMVW

SEQ ID NO: 316060 - protein, 9 aa, Influenza virus
SFFRNMVWL

SEQ ID NO: 316061 - protein, 9 aa, Influenza virus
FFRNMVWLT

SEQ ID NO: 316062 - protein, 9 aa, Influenza virus
VAKGSYNNT

SEQ ID NO: 316063 - protein, 9 aa, Influenza virus
AKGSYNNTS

SEQ ID NO: 316064 - protein, 9 aa, Influenza virus
KGSYNNTSG

SEQ ID NO: 316065 - protein, 9 aa, Influenza virus
GSYNNTSGE

SEQ ID NO: 316066 - protein, 9 aa, Influenza virus
SYNNTSGEQ

SEQ ID NO: 316067 - protein, 9 aa, Influenza virus
YNNTSGEQM

SEQ ID NO: 316068 - protein, 9 aa, Influenza virus
NNTSGEQML

SEQ ID NO: 316069 - protein, 9 aa, Influenza virus
NTSGEQMLI

SEQ ID NO: 316070 - protein, 9 aa, Influenza virus
TSGEQMLII

SEQ ID NO: 316071 - protein, 9 aa, Influenza virus
SGEQMLIIW

SEQ ID NO: 316072 - protein, 9 aa, Influenza virus
GEQMLIIWG

SEQ ID NO: 316073 - protein, 9 aa, Influenza virus
LIIWGVHHP

SEQ ID NO: 316074 - protein, 9 aa, Influenza virus
IWGVHHPND

SEQ ID NO: 316075 - protein, 9 aa, Influenza virus
WGVHHPNDE

SEQ ID NO: 316076 - protein, 9 aa, Influenza virus
LYQNVGTYV

SEQ ID NO: 316077 - protein, 9 aa, Influenza virus
YQNVGTYVS

SEQ ID NO: 316078 - protein, 9 aa, Influenza virus
RMEFSWTLL

SEQ ID NO: 316079 - protein, 9 aa, Influenza virus
WDTINFEST

SEQ ID NO: 316080 - protein, 9 aa, Influenza virus
DTINFESTG

SEQ ID NO: 316081 - protein, 9 aa, Influenza virus
TINFESTGN

SEQ ID NO: 316082 - protein, 9 aa, Influenza virus
INFESTGNL

SEQ ID NO: 316083 - protein, 9 aa, Influenza virus
NFESTGNLI

SEQ ID NO: 316084 - protein, 9 aa, Influenza virus
FESTGNLIA

SEQ ID NO: 316085 - protein, 9 aa, Influenza virus
ESTGNLIAP

SEQ ID NO: 316086 - protein, 9 aa, Influenza virus
STGNLIAPE

SEQ ID NO: 316087 - protein, 9 aa, Influenza virus
TGNLIAPEY

SEQ ID NO: 316088 - protein, 9 aa, Influenza virus
GNLIAPEYG

SEQ ID NO: 316089 - protein, 9 aa, Influenza virus
NLIAPEYGF

SEQ ID NO: 316090 - protein, 9 aa, Influenza virus
LIAPEYGFK

SEQ ID NO: 316091 - protein, 9 aa, Influenza virus
IAPEYGFKI

SEQ ID NO: 316092 - protein, 9 aa, Influenza virus
APEYGFKIS

SEQ ID NO: 316093 - protein, 9 aa, Influenza virus
PEYGFKISK

SEQ ID NO: 316094 - protein, 9 aa, Influenza virus
EYGFKISKR

SEQ ID NO: 316095 - protein, 9 aa, Influenza virus
YGFKISKRG

SEQ ID NO: 316096 - protein, 9 aa, Influenza virus
GFKISKRGS

SEQ ID NO: 316097 - protein, 9 aa, Influenza virus
FKISKRGSS

SEQ ID NO: 316098 - protein, 9 aa, Influenza virus
KISKRGSSG

SEQ ID NO: 316099 - protein, 9 aa, Influenza virus
ISKRGSSGI

SEQ ID NO: 316100 - protein, 9 aa, Influenza virus
SKRGSSGIM

SEQ ID NO: 316101 - protein, 9 aa, Influenza virus
KRGSSGIMK

SEQ ID NO: 316102 - protein, 9 aa, Influenza virus
RGSSGIMKT

SEQ ID NO: 316103 - protein, 9 aa, Influenza virus
GSSGIMKTE

SEQ ID NO: 316104 - protein, 9 aa, Influenza virus
SGIMKTEGT

SEQ ID NO: 316105 - protein, 9 aa, Influenza virus
GIMKTEGTL

SEQ ID NO: 316106 - protein, 9 aa, Influenza virus
NCETKCQTP

SEQ ID NO: 316107 - protein, 9 aa, Influenza virus
CETKCQTPL

SEQ ID NO: 316108 - protein, 9 aa, Influenza virus
ETKCQTPLG

SEQ ID NO: 316109 - protein, 9 aa, Influenza virus
TKCQTPLGA

SEQ ID NO: 316110 - protein, 9 aa, Influenza virus
KCQTPLGAI

SEQ ID NO: 316111 - protein, 9 aa, Influenza virus
CQTPLGAIN

SEQ ID NO: 316112 - protein, 9 aa, Influenza virus
QTPLGAINT

SEQ ID NO: 316113 - protein, 9 aa, Influenza virus
TPLGAINTT

SEQ ID NO: 316114 - protein, 9 aa, Influenza virus
PLGAINTTL

SEQ ID NO: 316115 - protein, 9 aa, Influenza virus
LGAINTTLP

SEQ ID NO: 316116 - protein, 9 aa, Influenza virus
GAINTTLPF

SEQ ID NO: 316117 - protein, 9 aa, Influenza virus
AINTTLPFH

SEQ ID NO: 316118 - protein, 9 aa, Influenza virus
INTTLPFHN

SEQ ID NO: 316119 - protein, 9 aa, Influenza virus
NTTLPFHNV

SEQ ID NO: 316120 - protein, 9 aa, Influenza virus
TTLPFHNVH

SEQ ID NO: 316121 - protein, 9 aa, Influenza virus
TLPFHNVHP

SEQ ID NO: 316122 - protein, 9 aa, Influenza virus
LPFHNVHPL

SEQ ID NO: 316123 - protein, 9 aa, Influenza virus
PFHNVHPLT

SEQ ID NO: 316124 - protein, 9 aa, Influenza virus
FHNVHPLTI

SEQ ID NO: 316125 - protein, 9 aa, Influenza virus
HNVHPLTIG

SEQ ID NO: 316126 - protein, 9 aa, Influenza virus
NVHPLTIGE

SEQ ID NO: 316127 - protein, 9 aa, Influenza virus
VHPLTIGEC

SEQ ID NO: 316128 - protein, 9 aa, Influenza virus
HPLTIGECP

SEQ ID NO: 316129 - protein, 9 aa, Influenza virus
PLTIGECPK

SEQ ID NO: 316130 - protein, 9 aa, Influenza virus
LTIGECPKY

SEQ ID NO: 316131 - protein, 9 aa, Influenza virus
TIGECPKYV

SEQ ID NO: 316132 - protein, 9 aa, Influenza virus
IGECPKYVK

SEQ ID NO: 316133 - protein, 9 aa, Influenza virus
GECPKYVKS

SEQ ID NO: 316134 - protein, 9 aa, Influenza virus
ECPKYVKSE

SEQ ID NO: 316135 - protein, 9 aa, Influenza virus
CPKYVKSEK

SEQ ID NO: 316136 - protein, 9 aa, Influenza virus
PKYVKSEKL

SEQ ID NO: 316137 - protein, 9 aa, Influenza virus
KYVKSEKLV

SEQ ID NO: 316138 - protein, 9 aa, Influenza virus
YVKSEKLVL

SEQ ID NO: 316139 - protein, 9 aa, Influenza virus
VKSEKLVLA

SEQ ID NO: 316140 - protein, 9 aa, Influenza virus
KSEKLVLAT

SEQ ID NO: 316141 - protein, 9 aa, Influenza virus
SEKLVLATG

SEQ ID NO: 316142 - protein, 9 aa, Influenza virus
EKLVLATGL

SEQ ID NO: 316143 - protein, 9 aa, Influenza virus
KLVLATGLR

SEQ ID NO: 316144 - protein, 9 aa, Influenza virus
LVLATGLRN

SEQ ID NO: 316145 - protein, 9 aa, Influenza virus
VLATGLRNV

SEQ ID NO: 316146 - protein, 9 aa, Influenza virus
LATGLRNVP

SEQ ID NO: 316147 - protein, 9 aa, Influenza virus
ATGLRNVPQ

SEQ ID NO: 316148 - protein, 9 aa, Influenza virus
TGLRNVPQI

SEQ ID NO: 316149 - protein, 9 aa, Influenza virus
GLRNVPQIE

SEQ ID NO: 316150 - protein, 9 aa, Influenza virus
RNVPQIESR

SEQ ID NO: 316151 - protein, 9 aa, Influenza virus
NVPQIESRG

SEQ ID NO: 316152 - protein, 9 aa, Influenza virus
VPQIESRGL

SEQ ID NO: 316153 - protein, 9 aa, Influenza virus
PQIESRGLF

SEQ ID NO: 316154 - protein, 9 aa, Influenza virus
QIESRGLFG

SEQ ID NO: 316155 - protein, 9 aa, Influenza virus
IESRGLFGA

SEQ ID NO: 316156 - protein, 9 aa, Influenza virus
ESRGLFGAI

SEQ ID NO: 316157 - protein, 9 aa, Influenza virus
SRGLFGAIA

SEQ ID NO: 316158 - protein, 9 aa, Influenza virus
RGLFGAIAG

SEQ ID NO: 316159 - protein, 9 aa, Influenza virus
GLFGAIAGF

SEQ ID NO: 316160 - protein, 9 aa, Influenza virus
LFGAIAGFI

SEQ ID NO: 316161 - protein, 9 aa, Influenza virus
FGAIAGFIE

SEQ ID NO: 316162 - protein, 9 aa, Influenza virus
GAIAGFIEG

SEQ ID NO: 316163 - protein, 9 aa, Influenza virus
AIAGFIEGG

SEQ ID NO: 316164 - protein, 9 aa, Influenza virus
IAGFIEGGW

SEQ ID NO: 316165 - protein, 9 aa, Influenza virus
AGFIEGGWQ

SEQ ID NO: 316166 - protein, 9 aa, Influenza virus
GFIEGGWQG

SEQ ID NO: 316167 - protein, 9 aa, Influenza virus
FIEGGWQGM

SEQ ID NO: 316168 - protein, 9 aa, Influenza virus
IEGGWQGMV

SEQ ID NO: 316169 - protein, 9 aa, Influenza virus
EGGWQGMVD

SEQ ID NO: 316170 - protein, 9 aa, Influenza virus
GGWQGMVDG

SEQ ID NO: 316171 - protein, 9 aa, Influenza virus
GWQGMVDGW

SEQ ID NO: 316172 - protein, 9 aa, Influenza virus
WQGMVDGWY

SEQ ID NO: 316173 - protein, 9 aa, Influenza virus
QGMVDGWYG

SEQ ID NO: 316174 - protein, 9 aa, Influenza virus
GMVDGWYGY

SEQ ID NO: 316175 - protein, 9 aa, Influenza virus
MVDGWYGYH

SEQ ID NO: 316176 - protein, 9 aa, Influenza virus
VDGWYGYHH

SEQ ID NO: 316177 - protein, 9 aa, Influenza virus
DGWYGYHHS

SEQ ID NO: 316178 - protein, 9 aa, Influenza virus
GWYGYHHSN

SEQ ID NO: 316179 - protein, 9 aa, Influenza virus
WYGYHHSND

SEQ ID NO: 316180 - protein, 9 aa, Influenza virus
YGYHHSNDQ

SEQ ID NO: 316181 - protein, 9 aa, Influenza virus
GYHHSNDQG

SEQ ID NO: 316182 - protein, 9 aa, Influenza virus
YHHSNDQGS

SEQ ID NO: 316183 - protein, 9 aa, Influenza virus
HHSNDQGSG

SEQ ID NO: 316184 - protein, 9 aa, Influenza virus
HSNDQGSGY

SEQ ID NO: 316185 - protein, 9 aa, Influenza virus
SNDQGSGYA

SEQ ID NO: 316186 - protein, 9 aa, Influenza virus
NDQGSGYAA

SEQ ID NO: 316187 - protein, 9 aa, Influenza virus
DQGSGYAAD

SEQ ID NO: 316188 - protein, 9 aa, Influenza virus
QGSGYAADK

SEQ ID NO: 316189 - protein, 9 aa, Influenza virus
GSGYAADKE

SEQ ID NO: 316190 - protein, 9 aa, Influenza virus
SGYAADKES

SEQ ID NO: 316191 - protein, 9 aa, Influenza virus
GYAADKEST

SEQ ID NO: 316192 - protein, 9 aa, Influenza virus
YAADKESTQ

SEQ ID NO: 316193 - protein, 9 aa, Influenza virus
AADKESTQK

SEQ ID NO: 316194 - protein, 9 aa, Influenza virus
ADKESTQKA

SEQ ID NO: 316195 - protein, 9 aa, Influenza virus
DKESTQKAF

SEQ ID NO: 316196 - protein, 9 aa, Influenza virus
VNSVIEKMN

SEQ ID NO: 316197 - protein, 9 aa, Influenza virus
NSVIEKMNT

SEQ ID NO: 316198 - protein, 9 aa, Influenza virus
SVIEKMNTQ

SEQ ID NO: 316199 - protein, 9 aa, Influenza virus
IEKMNTQFE

SEQ ID NO: 316200 - protein, 9 aa, Influenza virus
AVGKEFSNL

SEQ ID NO: 316201 - protein, 9 aa, Influenza virus
VGKEFSNLE

SEQ ID NO: 316202 - protein, 9 aa, Influenza virus
KEFSNLERR

SEQ ID NO: 316203 - protein, 9 aa, Influenza virus
EFSNLERRL

SEQ ID NO: 316204 - protein, 9 aa, Influenza virus
FSNLERRLE

SEQ ID NO: 316205 - protein, 9 aa, Influenza virus
SNLERRLEN

SEQ ID NO: 316206 - protein, 9 aa, Influenza virus
NLERRLENL

SEQ ID NO: 316207 - protein, 9 aa, Influenza virus
LERRLENLN

SEQ ID NO: 316208 - protein, 9 aa, Influenza virus
ERRLENLNK

SEQ ID NO: 316209 - protein, 9 aa, Influenza virus
RRLENLNKK

SEQ ID NO: 316210 - protein, 9 aa, Influenza virus
RLENLNKKM

SEQ ID NO: 316211 - protein, 9 aa, Influenza virus
LENLNKKME

SEQ ID NO: 316212 - protein, 9 aa, Influenza virus
ENLNKKMED

SEQ ID NO: 316213 - protein, 9 aa, Influenza virus
NLNKKMEDG

SEQ ID NO: 316214 - protein, 9 aa, Influenza virus
LNKKMEDGF

SEQ ID NO: 316215 - protein, 9 aa, Influenza virus
MEDGFLDVW

SEQ ID NO: 316216 - protein, 9 aa, Influenza virus
EDGFLDVWT

SEQ ID NO: 316217 - protein, 9 aa, Influenza virus
DGFLDVWTY

SEQ ID NO: 316218 - protein, 9 aa, Influenza virus
GFLDVWTYN

SEQ ID NO: 316219 - protein, 9 aa, Influenza virus
FLDVWTYNA

SEQ ID NO: 316220 - protein, 9 aa, Influenza virus
LDVWTYNAE

SEQ ID NO: 316221 - protein, 9 aa, Influenza virus
DVWTYNAEL

SEQ ID NO: 316222 - protein, 9 aa, Influenza virus
VWTYNAELL

SEQ ID NO: 316223 - protein, 9 aa, Influenza virus
WTYNAELLV

SEQ ID NO: 316224 - protein, 9 aa, Influenza virus
TYNAELLVL

SEQ ID NO: 316225 - protein, 9 aa, Influenza virus
YNAELLVLM

SEQ ID NO: 316226 - protein, 9 aa, Influenza virus
NAELLVLME

SEQ ID NO: 316227 - protein, 9 aa, Influenza virus
AELLVLMEN

SEQ ID NO: 316228 - protein, 9 aa, Influenza virus
ELLVLMENE

SEQ ID NO: 316229 - protein, 9 aa, Influenza virus
LLVLMENER

SEQ ID NO: 316230 - protein, 9 aa, Influenza virus
LVLMENERT

SEQ ID NO: 316231 - protein, 9 aa, Influenza virus
VLMENERTL

SEQ ID NO: 316232 - protein, 9 aa, Influenza virus
LMENERTLD

SEQ ID NO: 316233 - protein, 9 aa, Influenza virus
MENERTLDF

SEQ ID NO: 316234 - protein, 9 aa, Influenza virus
ENERTLDFH

SEQ ID NO: 316235 - protein, 9 aa, Influenza virus
NERTLDFHD

SEQ ID NO: 316236 - protein, 9 aa, Influenza virus
ERTLDFHDS

SEQ ID NO: 316237 - protein, 9 aa, Influenza virus
RTLDFHDSN

SEQ ID NO: 316238 - protein, 9 aa, Influenza virus
TLDFHDSNV

SEQ ID NO: 316239 - protein, 9 aa, Influenza virus
LDFHDSNVK

SEQ ID NO: 316240 - protein, 9 aa, Influenza virus
DFHDSNVKN

SEQ ID NO: 316241 - protein, 9 aa, Influenza virus
FHDSNVKNL

SEQ ID NO: 316242 - protein, 9 aa, Influenza virus
HDSNVKNLY

SEQ ID NO: 316243 - protein, 9 aa, Influenza virus
DSNVKNLYD

SEQ ID NO: 316244 - protein, 9 aa, Influenza virus
VKNLYDKVR

SEQ ID NO: 316245 - protein, 9 aa, Influenza virus
KNLYDKVRM

SEQ ID NO: 316246 - protein, 9 aa, Influenza virus
NLYDKVRMQ

SEQ ID NO: 316247 - protein, 9 aa, Influenza virus
LYDKVRMQL

SEQ ID NO: 316248 - protein, 9 aa, Influenza virus
YDKVRMQLR

SEQ ID NO: 316249 - protein, 9 aa, Influenza virus
DKVRMQLRD

SEQ ID NO: 316250 - protein, 9 aa, Influenza virus
KVRMQLRDN

SEQ ID NO: 316251 - protein, 9 aa, Influenza virus
VRMQLRDNV

SEQ ID NO: 316252 - protein, 9 aa, Influenza virus
RMQLRDNVK

SEQ ID NO: 316253 - protein, 9 aa, Influenza virus
MQLRDNVKE

SEQ ID NO: 316254 - protein, 9 aa, Influenza virus
QLRDNVKEL

SEQ ID NO: 316255 - protein, 9 aa, Influenza virus
LRDNVKELG

SEQ ID NO: 316256 - protein, 9 aa, Influenza virus
RDNVKELGN

SEQ ID NO: 316257 - protein, 9 aa, Influenza virus
DNVKELGNG

SEQ ID NO: 316258 - protein, 9 aa, Influenza virus
NVKELGNGC

SEQ ID NO: 316259 - protein, 9 aa, Influenza virus
VKELGNGCF

SEQ ID NO: 316260 - protein, 9 aa, Influenza virus
KELGNGCFE

SEQ ID NO: 316261 - protein, 9 aa, Influenza virus
ELGNGCFEF

SEQ ID NO: 316262 - protein, 9 aa, Influenza virus
LGNGCFEFY

SEQ ID NO: 316263 - protein, 9 aa, Influenza virus
GNGCFEFYH

SEQ ID NO: 316264 - protein, 9 aa, Influenza virus
NGCFEFYHK

SEQ ID NO: 316265 - protein, 9 aa, Influenza virus
GCFEFYHKC

SEQ ID NO: 316266 - protein, 9 aa, Influenza virus
CFEFYHKCD

SEQ ID NO: 316267 - protein, 9 aa, Influenza virus
FEFYHKCDD

SEQ ID NO: 316268 - protein, 9 aa, Influenza virus
EFYHKCDDE

SEQ ID NO: 316269 - protein, 9 aa, Influenza virus
FYHKCDDEC

SEQ ID NO: 316270 - protein, 9 aa, Influenza virus
YHKCDDECM

SEQ ID NO: 316271 - protein, 9 aa, Influenza virus
CMNSVKNGT

SEQ ID NO: 316272 - protein, 9 aa, Influenza virus
MNSVKNGTY

SEQ ID NO: 316273 - protein, 9 aa, Influenza virus
SVKNGTYDY

SEQ ID NO: 316274 - protein, 9 aa, Influenza virus
KNGTYDYPK

SEQ ID NO: 316275 - protein, 9 aa, Influenza virus
NGTYDYPKY

SEQ ID NO: 316276 - protein, 9 aa, Influenza virus
GTYDYPKYE

SEQ ID NO: 316277 - protein, 9 aa, Influenza virus
TYDYPKYEE

SEQ ID NO: 316278 - protein, 9 aa, Influenza virus
YDYPKYEEE

SEQ ID NO: 316279 - protein, 9 aa, Influenza virus
DYPKYEEES

SEQ ID NO: 316280 - protein, 9 aa, Influenza virus
YPKYEEESK

SEQ ID NO: 316281 - protein, 9 aa, Influenza virus
PKYEEESKL

SEQ ID NO: 316282 - protein, 9 aa, Influenza virus
KYEEESKLN

SEQ ID NO: 316283 - protein, 9 aa, Influenza virus
YEEESKLNR

SEQ ID NO: 316284 - protein, 9 aa, Influenza virus
EEESKLNRN

SEQ ID NO: 316285 - protein, 9 aa, Influenza virus
EESKLNRNE

SEQ ID NO: 316286 - protein, 9 aa, Influenza virus
ESKLNRNEI

SEQ ID NO: 316287 - protein, 9 aa, Influenza virus
SKLNRNEIK

SEQ ID NO: 316288 - protein, 9 aa, Influenza virus
KLNRNEIKG

SEQ ID NO: 316289 - protein, 9 aa, Influenza virus
LNRNEIKGV

SEQ ID NO: 316290 - protein, 9 aa, Influenza virus
NRNEIKGVK

SEQ ID NO: 316291 - protein, 9 aa, Influenza virus
RNEIKGVKL

SEQ ID NO: 316292 - protein, 9 aa, Influenza virus
NEIKGVKLS

SEQ ID NO: 316293 - protein, 9 aa, Influenza virus
EIKGVKLSS

SEQ ID NO: 316294 - protein, 9 aa, Influenza virus
IKGVKLSSM

SEQ ID NO: 316295 - protein, 9 aa, Influenza virus
KGVKLSSMG

SEQ ID NO: 316296 - protein, 9 aa, Influenza virus
GVKLSSMGV

SEQ ID NO: 316297 - protein, 9 aa, Influenza virus
VKLSSMGVY

SEQ ID NO: 316298 - protein, 9 aa, Influenza virus
KLSSMGVYQ

SEQ ID NO: 316299 - protein, 9 aa, Influenza virus
LSSMGVYQI

SEQ ID NO: 316300 - protein, 9 aa, Influenza virus
SSMGVYQIL

SEQ ID NO: 316301 - protein, 9 aa, Influenza virus
SMGVYQILA

SEQ ID NO: 316302 - protein, 9 aa, Influenza virus
MGVYQILAI

SEQ ID NO: 316303 - protein, 9 aa, Influenza virus
GVYQILAIY

SEQ ID NO: 316304 - protein, 9 aa, Influenza virus
VYQILAIYA

SEQ ID NO: 316305 - protein, 9 aa, Influenza virus
YQILAIYAT

SEQ ID NO: 316306 - protein, 9 aa, Influenza virus
QILAIYATV

SEQ ID NO: 316307 - protein, 9 aa, Influenza virus
ILAIYATVA

SEQ ID NO: 316308 - protein, 9 aa, Influenza virus
LAIYATVAG

SEQ ID NO: 316309 - protein, 9 aa, Influenza virus
AIYATVAGS

SEQ ID NO: 316310 - protein, 9 aa, Influenza virus
IYATVAGSL

SEQ ID NO: 316311 - protein, 9 aa, Influenza virus
YATVAGSLS

SEQ ID NO: 316312 - protein, 9 aa, Influenza virus
ATVAGSLSL

SEQ ID NO: 316313 - protein, 9 aa, Influenza virus
TVAGSLSLA

SEQ ID NO: 316314 - protein, 9 aa, Influenza virus
VAGSLSLAI

SEQ ID NO: 316315 - protein, 9 aa, Influenza virus
AGSLSLAIM

SEQ ID NO: 316316 - protein, 9 aa, Influenza virus
GSLSLAIMM

SEQ ID NO: 316317 - protein, 9 aa, Influenza virus
SLSLAIMMA

SEQ ID NO: 316318 - protein, 9 aa, Influenza virus
LSLAIMMAG

SEQ ID NO: 316319 - protein, 9 aa, Influenza virus
SLAIMMAGI

SEQ ID NO: 316320 - protein, 9 aa, Influenza virus
LAIMMAGIS

SEQ ID NO: 316321 - protein, 9 aa, Influenza virus
AGISFWMCS

SEQ ID NO: 316322 - protein, 9 aa, Influenza virus
GISFWMCSN

SEQ ID NO: 316323 - protein, 9 aa, Influenza virus
ISFWMCSNG

SEQ ID NO: 316324 - protein, 9 aa, Influenza virus
SFWMCSNGS

SEQ ID NO: 316325 - protein, 9 aa, Influenza virus
FWMCSNGSL

SEQ ID NO: 316326 - protein, 9 aa, Influenza virus
WMCSNGSLQ

SEQ ID NO: 316327 - protein, 9 aa, Influenza virus
MCSNGSLQC

SEQ ID NO: 316328 - protein, 9 aa, Influenza virus
CSNGSLQCR

SEQ ID NO: 316329 - protein, 9 aa, Influenza virus
SNGSLQCRI

SEQ ID NO: 316330 - protein, 9 aa, Influenza virus
NGSLQCRIC

SEQ ID NO: 316331 - protein, 9 aa, Influenza virus
GSLQCRICI

SEQ ID NO: 316332 - protein, 9 aa, Influenza virus
MNPNQKIIT

SEQ ID NO: 316333 - protein, 9 aa, Influenza virus
NPNQKIITI

SEQ ID NO: 316334 - protein, 9 aa, Influenza virus
PNQKIITIG

SEQ ID NO: 316335 - protein, 9 aa, Influenza virus
NQKIITIGS

SEQ ID NO: 316336 - protein, 9 aa, Influenza virus
QKIITIGSV

SEQ ID NO: 316337 - protein, 9 aa, Influenza virus
KIITIGSVS

SEQ ID NO: 316338 - protein, 9 aa, Influenza virus
IITIGSVSL

SEQ ID NO: 316339 - protein, 9 aa, Influenza virus
ITIGSVSLT

SEQ ID NO: 316340 - protein, 9 aa, Influenza virus
QIAILATTV

SEQ ID NO: 316341 - protein, 9 aa, Influenza virus
IAILATTVT

SEQ ID NO: 316342 - protein, 9 aa, Influenza virus
AILATTVTL

SEQ ID NO: 316343 - protein, 9 aa, Influenza virus
ILATTVTLH

SEQ ID NO: 316344 - protein, 9 aa, Influenza virus
LATTVTLHF

SEQ ID NO: 316345 - protein, 9 aa, Influenza virus
ATTVTLHFK

SEQ ID NO: 316346 - protein, 9 aa, Influenza virus
TTVTLHFKQ

SEQ ID NO: 316347 - protein, 9 aa, Influenza virus
TVTLHFKQH

SEQ ID NO: 316348 - protein, 9 aa, Influenza virus
VTLHFKQHE

SEQ ID NO: 316349 - protein, 9 aa, Influenza virus
TLHFKQHEC

SEQ ID NO: 316350 - protein, 9 aa, Influenza virus
LHFKQHECD

SEQ ID NO: 316351 - protein, 9 aa, Influenza virus
PCEPIIIER

SEQ ID NO: 316352 - protein, 9 aa, Influenza virus
CEPIIIERN

SEQ ID NO: 316353 - protein, 9 aa, Influenza virus
TEIVYLNNT

SEQ ID NO: 316354 - protein, 9 aa, Influenza virus
EIVYLNNTT

SEQ ID NO: 316355 - protein, 9 aa, Influenza virus
YRNWSKPQC

SEQ ID NO: 316356 - protein, 9 aa, Influenza virus
WSKPQCQIT

SEQ ID NO: 316357 - protein, 9 aa, Influenza virus
SKPQCQITG

SEQ ID NO: 316358 - protein, 9 aa, Influenza virus
KPQCQITGF

SEQ ID NO: 316359 - protein, 9 aa, Influenza virus
PQCQITGFA

SEQ ID NO: 316360 - protein, 9 aa, Influenza virus
QCQITGFAP

SEQ ID NO: 316361 - protein, 9 aa, Influenza virus
CQITGFAPF

SEQ ID NO: 316362 - protein, 9 aa, Influenza virus
QITGFAPFS

SEQ ID NO: 316363 - protein, 9 aa, Influenza virus
ITGFAPFSK

SEQ ID NO: 316364 - protein, 9 aa, Influenza virus
TGFAPFSKD

SEQ ID NO: 316365 - protein, 9 aa, Influenza virus
GFAPFSKDN

SEQ ID NO: 316366 - protein, 9 aa, Influenza virus
FAPFSKDNS

SEQ ID NO: 316367 - protein, 9 aa, Influenza virus
APFSKDNSI

SEQ ID NO: 316368 - protein, 9 aa, Influenza virus
PFSKDNSIR

SEQ ID NO: 316369 - protein, 9 aa, Influenza virus
FSKDNSIRL

SEQ ID NO: 316370 - protein, 9 aa, Influenza virus
SKDNSIRLS

SEQ ID NO: 316371 - protein, 9 aa, Influenza virus
KDNSIRLSA

SEQ ID NO: 316372 - protein, 9 aa, Influenza virus
DNSIRLSAG

SEQ ID NO: 316373 - protein, 9 aa, Influenza virus
NSIRLSAGG

SEQ ID NO: 316374 - protein, 9 aa, Influenza virus
SIRLSAGGD

SEQ ID NO: 316375 - protein, 9 aa, Influenza virus
IRLSAGGDI

SEQ ID NO: 316376 - protein, 9 aa, Influenza virus
RLSAGGDIW

SEQ ID NO: 316377 - protein, 9 aa, Influenza virus
LSAGGDIWV

SEQ ID NO: 316378 - protein, 9 aa, Influenza virus
SAGGDIWVT

SEQ ID NO: 316379 - protein, 9 aa, Influenza virus
AGGDIWVTR

SEQ ID NO: 316380 - protein, 9 aa, Influenza virus
GGDIWVTRE

SEQ ID NO: 316381 - protein, 9 aa, Influenza virus
GDIWVTREP

SEQ ID NO: 316382 - protein, 9 aa, Influenza virus
DIWVTREPY

SEQ ID NO: 316383 - protein, 9 aa, Influenza virus
IWVTREPYV

SEQ ID NO: 316384 - protein, 9 aa, Influenza virus
WVTREPYVS

SEQ ID NO: 316385 - protein, 9 aa, Influenza virus
VTREPYVSC

SEQ ID NO: 316386 - protein, 9 aa, Influenza virus
TREPYVSCD

SEQ ID NO: 316387 - protein, 9 aa, Influenza virus
REPYVSCDP

SEQ ID NO: 316388 - protein, 9 aa, Influenza virus
GKCYQFALG

SEQ ID NO: 316389 - protein, 9 aa, Influenza virus
KCYQFALGQ

SEQ ID NO: 316390 - protein, 9 aa, Influenza virus
CYQFALGQG

SEQ ID NO: 316391 - protein, 9 aa, Influenza virus
YQFALGQGT

SEQ ID NO: 316392 - protein, 9 aa, Influenza virus
QFALGQGTT

SEQ ID NO: 316393 - protein, 9 aa, Influenza virus
FALGQGTTL

SEQ ID NO: 316394 - protein, 9 aa, Influenza virus
ALGQGTTLD

SEQ ID NO: 316395 - protein, 9 aa, Influenza virus
LGQGTTLDN

SEQ ID NO: 316396 - protein, 9 aa, Influenza virus
GQGTTLDNK

SEQ ID NO: 316397 - protein, 9 aa, Influenza virus
QGTTLDNKH

SEQ ID NO: 316398 - protein, 9 aa, Influenza virus
GTTLDNKHS

SEQ ID NO: 316399 - protein, 9 aa, Influenza virus
TTLDNKHSN

SEQ ID NO: 316400 - protein, 9 aa, Influenza virus
TLDNKHSNG

SEQ ID NO: 316401 - protein, 9 aa, Influenza virus
LDNKHSNGT

SEQ ID NO: 316402 - protein, 9 aa, Influenza virus
DNKHSNGTI

SEQ ID NO: 316403 - protein, 9 aa, Influenza virus
NKHSNGTIH

SEQ ID NO: 316404 - protein, 9 aa, Influenza virus
KHSNGTIHD

SEQ ID NO: 316405 - protein, 9 aa, Influenza virus
HSNGTIHDR

SEQ ID NO: 316406 - protein, 9 aa, Influenza virus
TIHDRIPHR

SEQ ID NO: 316407 - protein, 9 aa, Influenza virus
IHDRIPHRT

SEQ ID NO: 316408 - protein, 9 aa, Influenza virus
HDRIPHRTL

SEQ ID NO: 316409 - protein, 9 aa, Influenza virus
DRIPHRTLL

SEQ ID NO: 316410 - protein, 9 aa, Influenza virus
RIPHRTLLM

SEQ ID NO: 316411 - protein, 9 aa, Influenza virus
IPHRTLLMN

SEQ ID NO: 316412 - protein, 9 aa, Influenza virus
PHRTLLMNE

SEQ ID NO: 316413 - protein, 9 aa, Influenza virus
HRTLLMNEL

SEQ ID NO: 316414 - protein, 9 aa, Influenza virus
RTLLMNELG

SEQ ID NO: 316415 - protein, 9 aa, Influenza virus
TLLMNELGV

SEQ ID NO: 316416 - protein, 9 aa, Influenza virus
LLMNELGVP

SEQ ID NO: 316417 - protein, 9 aa, Influenza virus
LMNELGVPF

SEQ ID NO: 316418 - protein, 9 aa, Influenza virus
MNELGVPFH

SEQ ID NO: 316419 - protein, 9 aa, Influenza virus
NELGVPFHL

SEQ ID NO: 316420 - protein, 9 aa, Influenza virus
ELGVPFHLG

SEQ ID NO: 316421 - protein, 9 aa, Influenza virus
LGVPFHLGT

SEQ ID NO: 316422 - protein, 9 aa, Influenza virus
GVPFHLGTK

SEQ ID NO: 316423 - protein, 9 aa, Influenza virus
VPFHLGTKQ

SEQ ID NO: 316424 - protein, 9 aa, Influenza virus
PFHLGTKQV

SEQ ID NO: 316425 - protein, 9 aa, Influenza virus
FHLGTKQVC

SEQ ID NO: 316426 - protein, 9 aa, Influenza virus
HLGTKQVCV

SEQ ID NO: 316427 - protein, 9 aa, Influenza virus
LGTKQVCVA

SEQ ID NO: 316428 - protein, 9 aa, Influenza virus
GTKQVCVAW

SEQ ID NO: 316429 - protein, 9 aa, Influenza virus
TKQVCVAWS

SEQ ID NO: 316430 - protein, 9 aa, Influenza virus
KQVCVAWSS

SEQ ID NO: 316431 - protein, 9 aa, Influenza virus
QVCVAWSSS

SEQ ID NO: 316432 - protein, 9 aa, Influenza virus
VCVAWSSSS

SEQ ID NO: 316433 - protein, 9 aa, Influenza virus
CVAWSSSSC

SEQ ID NO: 316434 - protein, 9 aa, Influenza virus
VAWSSSSCH

SEQ ID NO: 316435 - protein, 9 aa, Influenza virus
AWSSSSCHD

SEQ ID NO: 316436 - protein, 9 aa, Influenza virus
WSSSSCHDG

SEQ ID NO: 316437 - protein, 9 aa, Influenza virus
SSSSCHDGK

SEQ ID NO: 316438 - protein, 9 aa, Influenza virus
SSSCHDGKA

SEQ ID NO: 316439 - protein, 9 aa, Influenza virus
SSCHDGKAW

SEQ ID NO: 316440 - protein, 9 aa, Influenza virus
SCHDGKAWL

SEQ ID NO: 316441 - protein, 9 aa, Influenza virus
CHDGKAWLH

SEQ ID NO: 316442 - protein, 9 aa, Influenza virus
HDGKAWLHV

SEQ ID NO: 316443 - protein, 9 aa, Influenza virus
DGKAWLHVC

SEQ ID NO: 316444 - protein, 9 aa, Influenza virus
GKAWLHVCV

SEQ ID NO: 316445 - protein, 9 aa, Influenza virus
KAWLHVCVT

SEQ ID NO: 316446 - protein, 9 aa, Influenza virus
AWLHVCVTG

SEQ ID NO: 316447 - protein, 9 aa, Influenza virus
WLHVCVTGD

SEQ ID NO: 316448 - protein, 9 aa, Influenza virus
LHVCVTGDD

SEQ ID NO: 316449 - protein, 9 aa, Influenza virus
CVTGDDRNA

SEQ ID NO: 316450 - protein, 9 aa, Influenza virus
VTGDDRNAT

SEQ ID NO: 316451 - protein, 9 aa, Influenza virus
TGDDRNATA

SEQ ID NO: 316452 - protein, 9 aa, Influenza virus
GDDRNATAS

SEQ ID NO: 316453 - protein, 9 aa, Influenza virus
DDRNATASF

SEQ ID NO: 316454 - protein, 9 aa, Influenza virus
DRNATASFI

SEQ ID NO: 316455 - protein, 9 aa, Influenza virus
RNATASFIY

SEQ ID NO: 316456 - protein, 9 aa, Influenza virus
NATASFIYD

SEQ ID NO: 316457 - protein, 9 aa, Influenza virus
ATASFIYDG

SEQ ID NO: 316458 - protein, 9 aa, Influenza virus
DSIGSWSQN

SEQ ID NO: 316459 - protein, 9 aa, Influenza virus
SIGSWSQNI

SEQ ID NO: 316460 - protein, 9 aa, Influenza virus
IGSWSQNIL

SEQ ID NO: 316461 - protein, 9 aa, Influenza virus
GSWSQNILR

SEQ ID NO: 316462 - protein, 9 aa, Influenza virus
SWSQNILRT

SEQ ID NO: 316463 - protein, 9 aa, Influenza virus
WSQNILRTQ

SEQ ID NO: 316464 - protein, 9 aa, Influenza virus
SQNILRTQE

SEQ ID NO: 316465 - protein, 9 aa, Influenza virus
QNILRTQES

SEQ ID NO: 316466 - protein, 9 aa, Influenza virus
NILRTQESE

SEQ ID NO: 316467 - protein, 9 aa, Influenza virus
ILRTQESEC

SEQ ID NO: 316468 - protein, 9 aa, Influenza virus
LRTQESECV

SEQ ID NO: 316469 - protein, 9 aa, Influenza virus
RTQESECVC

SEQ ID NO: 316470 - protein, 9 aa, Influenza virus
TQESECVCI

SEQ ID NO: 316471 - protein, 9 aa, Influenza virus
QESECVCIN

SEQ ID NO: 316472 - protein, 9 aa, Influenza virus
ESECVCING

SEQ ID NO: 316473 - protein, 9 aa, Influenza virus
SECVCINGT

SEQ ID NO: 316474 - protein, 9 aa, Influenza virus
ECVCINGTC

SEQ ID NO: 316475 - protein, 9 aa, Influenza virus
CVCINGTCT

SEQ ID NO: 316476 - protein, 9 aa, Influenza virus
VCINGTCTV

SEQ ID NO: 316477 - protein, 9 aa, Influenza virus
CINGTCTVV

SEQ ID NO: 316478 - protein, 9 aa, Influenza virus
INGTCTVVM

SEQ ID NO: 316479 - protein, 9 aa, Influenza virus
NGTCTVVMT

SEQ ID NO: 316480 - protein, 9 aa, Influenza virus
GTCTVVMTD

SEQ ID NO: 316481 - protein, 9 aa, Influenza virus
TCTVVMTDG

SEQ ID NO: 316482 - protein, 9 aa, Influenza virus
CTVVMTDGS

SEQ ID NO: 316483 - protein, 9 aa, Influenza virus
TVVMTDGSA

SEQ ID NO: 316484 - protein, 9 aa, Influenza virus
VVMTDGSAS

SEQ ID NO: 316485 - protein, 9 aa, Influenza virus
VMTDGSASG

SEQ ID NO: 316486 - protein, 9 aa, Influenza virus
MTDGSASGR

SEQ ID NO: 316487 - protein, 9 aa, Influenza virus
TDGSASGRA

SEQ ID NO: 316488 - protein, 9 aa, Influenza virus
DGSASGRAD

SEQ ID NO: 316489 - protein, 9 aa, Influenza virus
GSASGRADT

SEQ ID NO: 316490 - protein, 9 aa, Influenza virus
SASGRADTR

SEQ ID NO: 316491 - protein, 9 aa, Influenza virus
ASGRADTRI

SEQ ID NO: 316492 - protein, 9 aa, Influenza virus
SGRADTRIL

SEQ ID NO: 316493 - protein, 9 aa, Influenza virus
GRADTRILF

SEQ ID NO: 316494 - protein, 9 aa, Influenza virus
RADTRILFI

SEQ ID NO: 316495 - protein, 9 aa, Influenza virus
ADTRILFIK

SEQ ID NO: 316496 - protein, 9 aa, Influenza virus
DTRILFIKE

SEQ ID NO: 316497 - protein, 9 aa, Influenza virus
TRILFIKEG

SEQ ID NO: 316498 - protein, 9 aa, Influenza virus
RILFIKEGK

SEQ ID NO: 316499 - protein, 9 aa, Influenza virus
ILFIKEGKI

SEQ ID NO: 316500 - protein, 9 aa, Influenza virus
EGKIVHISP

SEQ ID NO: 316501 - protein, 9 aa, Influenza virus
GKIVHISPL

SEQ ID NO: 316502 - protein, 9 aa, Influenza virus
VHISPLSGS

SEQ ID NO: 316503 - protein, 9 aa, Influenza virus
HISPLSGSA

SEQ ID NO: 316504 - protein, 9 aa, Influenza virus
ISPLSGSAQ

SEQ ID NO: 316505 - protein, 9 aa, Influenza virus
SPLSGSAQH

SEQ ID NO: 316506 - protein, 9 aa, Influenza virus
PLSGSAQHI

SEQ ID NO: 316507 - protein, 9 aa, Influenza virus
LSGSAQHIE

SEQ ID NO: 316508 - protein, 9 aa, Influenza virus
SGSAQHIEE

SEQ ID NO: 316509 - protein, 9 aa, Influenza virus
GSAQHIEEC

SEQ ID NO: 316510 - protein, 9 aa, Influenza virus
SAQHIEECS

SEQ ID NO: 316511 - protein, 9 aa, Influenza virus
AQHIEECSC

SEQ ID NO: 316512 - protein, 9 aa, Influenza virus
QHIEECSCY

SEQ ID NO: 316513 - protein, 9 aa, Influenza virus
HIEECSCYP

SEQ ID NO: 316514 - protein, 9 aa, Influenza virus
IEECSCYPR

SEQ ID NO: 316515 - protein, 9 aa, Influenza virus
EECSCYPRY

SEQ ID NO: 316516 - protein, 9 aa, Influenza virus
ECSCYPRYP

SEQ ID NO: 316517 - protein, 9 aa, Influenza virus
CSCYPRYPD

SEQ ID NO: 316518 - protein, 9 aa, Influenza virus
SCYPRYPDV

SEQ ID NO: 316519 - protein, 9 aa, Influenza virus
CYPRYPDVR

SEQ ID NO: 316520 - protein, 9 aa, Influenza virus
YPRYPDVRC

SEQ ID NO: 316521 - protein, 9 aa, Influenza virus
RYPDVRCIC

SEQ ID NO: 316522 - protein, 9 aa, Influenza virus
YPDVRCICR

SEQ ID NO: 316523 - protein, 9 aa, Influenza virus
PDVRCICRD

SEQ ID NO: 316524 - protein, 9 aa, Influenza virus
DVRCICRDN

SEQ ID NO: 316525 - protein, 9 aa, Influenza virus
VRCICRDNW

SEQ ID NO: 316526 - protein, 9 aa, Influenza virus
RCICRDNWK

SEQ ID NO: 316527 - protein, 9 aa, Influenza virus
CICRDNWKG

SEQ ID NO: 316528 - protein, 9 aa, Influenza virus
ICRDNWKGS

SEQ ID NO: 316529 - protein, 9 aa, Influenza virus
CRDNWKGSN

SEQ ID NO: 316530 - protein, 9 aa, Influenza virus
RDNWKGSNR

SEQ ID NO: 316531 - protein, 9 aa, Influenza virus
DNWKGSNRP

SEQ ID NO: 316532 - protein, 9 aa, Influenza virus
NWKGSNRPV

SEQ ID NO: 316533 - protein, 9 aa, Influenza virus
GSNRPVIDI

SEQ ID NO: 316534 - protein, 9 aa, Influenza virus
SNRPVIDIN

SEQ ID NO: 316535 - protein, 9 aa, Influenza virus
DINMEDYSI

SEQ ID NO: 316536 - protein, 9 aa, Influenza virus
INMEDYSID

SEQ ID NO: 316537 - protein, 9 aa, Influenza virus
NMEDYSIDS

SEQ ID NO: 316538 - protein, 9 aa, Influenza virus
DYSIDSSYV

SEQ ID NO: 316539 - protein, 9 aa, Influenza virus
YSIDSSYVC

SEQ ID NO: 316540 - protein, 9 aa, Influenza virus
SIDSSYVCS

SEQ ID NO: 316541 - protein, 9 aa, Influenza virus
IDSSYVCSG

SEQ ID NO: 316542 - protein, 9 aa, Influenza virus
DSSYVCSGL

SEQ ID NO: 316543 - protein, 9 aa, Influenza virus
SSYVCSGLV

SEQ ID NO: 316544 - protein, 9 aa, Influenza virus
SYVCSGLVG

SEQ ID NO: 316545 - protein, 9 aa, Influenza virus
YVCSGLVGD

SEQ ID NO: 316546 - protein, 9 aa, Influenza virus
VCSGLVGDT

SEQ ID NO: 316547 - protein, 9 aa, Influenza virus
CSGLVGDTP

SEQ ID NO: 316548 - protein, 9 aa, Influenza virus
SGLVGDTPR

SEQ ID NO: 316549 - protein, 9 aa, Influenza virus
GLVGDTPRN

SEQ ID NO: 316550 - protein, 9 aa, Influenza virus
LVGDTPRND

SEQ ID NO: 316551 - protein, 9 aa, Influenza virus
VGDTPRNDD

SEQ ID NO: 316552 - protein, 9 aa, Influenza virus
GDTPRNDDS

SEQ ID NO: 316553 - protein, 9 aa, Influenza virus
DTPRNDDSS

SEQ ID NO: 316554 - protein, 9 aa, Influenza virus
TPRNDDSSS

SEQ ID NO: 316555 - protein, 9 aa, Influenza virus
SNSNCRDPN

SEQ ID NO: 316556 - protein, 9 aa, Influenza virus
NSNCRDPNN

SEQ ID NO: 316557 - protein, 9 aa, Influenza virus
SNCRDPNNE

SEQ ID NO: 316558 - protein, 9 aa, Influenza virus
NCRDPNNER

SEQ ID NO: 316559 - protein, 9 aa, Influenza virus
CRDPNNERG

SEQ ID NO: 316560 - protein, 9 aa, Influenza virus
PNNERGNPG

SEQ ID NO: 316561 - protein, 9 aa, Influenza virus
NNERGNPGV

SEQ ID NO: 316562 - protein, 9 aa, Influenza virus
NERGNPGVK

SEQ ID NO: 316563 - protein, 9 aa, Influenza virus
ERGNPGVKG

SEQ ID NO: 316564 - protein, 9 aa, Influenza virus
RGNPGVKGW

SEQ ID NO: 316565 - protein, 9 aa, Influenza virus
GNPGVKGWA

SEQ ID NO: 316566 - protein, 9 aa, Influenza virus
NPGVKGWAF

SEQ ID NO: 316567 - protein, 9 aa, Influenza virus
PGVKGWAFD

SEQ ID NO: 316568 - protein, 9 aa, Influenza virus
GVKGWAFDN

SEQ ID NO: 316569 - protein, 9 aa, Influenza virus
VKGWAFDNG

SEQ ID NO: 316570 - protein, 9 aa, Influenza virus
GDDVWMGRT

SEQ ID NO: 316571 - protein, 9 aa, Influenza virus
DDVWMGRTI

SEQ ID NO: 316572 - protein, 9 aa, Influenza virus
DVWMGRTIS

SEQ ID NO: 316573 - protein, 9 aa, Influenza virus
KDLRSGYET

SEQ ID NO: 316574 - protein, 9 aa, Influenza virus
DLRSGYETF

SEQ ID NO: 316575 - protein, 9 aa, Influenza virus
LRSGYETFK

SEQ ID NO: 316576 - protein, 9 aa, Influenza virus
RSGYETFKV

SEQ ID NO: 316577 - protein, 9 aa, Influenza virus
SGYETFKVI

SEQ ID NO: 316578 - protein, 9 aa, Influenza virus
GYETFKVIG

SEQ ID NO: 316579 - protein, 9 aa, Influenza virus
YETFKVIGG

SEQ ID NO: 316580 - protein, 9 aa, Influenza virus
ETFKVIGGW

SEQ ID NO: 316581 - protein, 9 aa, Influenza virus
TFKVIGGWS

SEQ ID NO: 316582 - protein, 9 aa, Influenza virus
FKVIGGWST

SEQ ID NO: 316583 - protein, 9 aa, Influenza virus
NNNWSGYSG

SEQ ID NO: 316584 - protein, 9 aa, Influenza virus
NNWSGYSGI

SEQ ID NO: 316585 - protein, 9 aa, Influenza virus
NWSGYSGIF

SEQ ID NO: 316586 - protein, 9 aa, Influenza virus
WSGYSGIFS

SEQ ID NO: 316587 - protein, 9 aa, Influenza virus
SGYSGIFSV

SEQ ID NO: 316588 - protein, 9 aa, Influenza virus
GYSGIFSVE

SEQ ID NO: 316589 - protein, 9 aa, Influenza virus
YSGIFSVEG

SEQ ID NO: 316590 - protein, 9 aa, Influenza virus
SGIFSVEGK

SEQ ID NO: 316591 - protein, 9 aa, Influenza virus
KSCINRCFY

SEQ ID NO: 316592 - protein, 9 aa, Influenza virus
SCINRCFYV

SEQ ID NO: 316593 - protein, 9 aa, Influenza virus
CINRCFYVE

SEQ ID NO: 316594 - protein, 9 aa, Influenza virus
INRCFYVEL

SEQ ID NO: 316595 - protein, 9 aa, Influenza virus
NRCFYVELI

SEQ ID NO: 316596 - protein, 9 aa, Influenza virus
RCFYVELIR

SEQ ID NO: 316597 - protein, 9 aa, Influenza virus
CFYVELIRG

SEQ ID NO: 316598 - protein, 9 aa, Influenza virus
FYVELIRGR

SEQ ID NO: 316599 - protein, 9 aa, Influenza virus
YVELIRGRP

SEQ ID NO: 316600 - protein, 9 aa, Influenza virus
VELIRGRPQ

SEQ ID NO: 316601 - protein, 9 aa, Influenza virus
ELIRGRPQE

SEQ ID NO: 316602 - protein, 9 aa, Influenza virus
PQETRVWWT

SEQ ID NO: 316603 - protein, 9 aa, Influenza virus
QETRVWWTS

SEQ ID NO: 316604 - protein, 9 aa, Influenza virus
ETRVWWTSN

SEQ ID NO: 316605 - protein, 9 aa, Influenza virus
TRVWWTSNS

SEQ ID NO: 316606 - protein, 9 aa, Influenza virus
RVWWTSNSI

SEQ ID NO: 316607 - protein, 9 aa, Influenza virus
VWWTSNSIV

SEQ ID NO: 316608 - protein, 9 aa, Influenza virus
WWTSNSIVV

SEQ ID NO: 316609 - protein, 9 aa, Influenza virus
WTSNSIVVF

SEQ ID NO: 316610 - protein, 9 aa, Influenza virus
TSNSIVVFC

SEQ ID NO: 316611 - protein, 9 aa, Influenza virus
SNSIVVFCG

SEQ ID NO: 316612 - protein, 9 aa, Influenza virus
NSIVVFCGT

SEQ ID NO: 316613 - protein, 9 aa, Influenza virus
SIVVFCGTS

SEQ ID NO: 316614 - protein, 9 aa, Influenza virus
IVVFCGTSG

SEQ ID NO: 316615 - protein, 9 aa, Influenza virus
VVFCGTSGT

SEQ ID NO: 316616 - protein, 9 aa, Influenza virus
VFCGTSGTY

SEQ ID NO: 316617 - protein, 9 aa, Influenza virus
FCGTSGTYG

SEQ ID NO: 316618 - protein, 9 aa, Influenza virus
CGTSGTYGT

SEQ ID NO: 316619 - protein, 9 aa, Influenza virus
GTSGTYGTG

SEQ ID NO: 316620 - protein, 9 aa, Influenza virus
TSGTYGTGS

SEQ ID NO: 316621 - protein, 9 aa, Influenza virus
SGTYGTGSW

SEQ ID NO: 316622 - protein, 9 aa, Influenza virus
GTYGTGSWP

SEQ ID NO: 316623 - protein, 9 aa, Influenza virus
TYGTGSWPD

SEQ ID NO: 316624 - protein, 9 aa, Influenza virus
YGTGSWPDG

SEQ ID NO: 316625 - protein, 9 aa, Influenza virus
GTGSWPDGA

SEQ ID NO: 316626 - protein, 9 aa, Influenza virus
TGSWPDGAN

SEQ ID NO: 316627 - protein, 9 aa, Influenza virus
GSWPDGANI

SEQ ID NO: 316628 - protein, 9 aa, Influenza virus
SWPDGANIN

SEQ ID NO: 316629 - protein, 9 aa, Influenza virus
WPDGANINF

SEQ ID NO: 316630 - protein, 9 aa, Influenza virus
PDGANINFM

SEQ ID NO: 316631 - protein, 9 aa, Influenza virus
DGANINFMP

SEQ ID NO: 316632 - protein, 9 aa, Influenza virus
GANINFMPI

SEQ ID NO: 316633 - protein, 9 aa, Influenza virus
MLSLIMRTV

SEQ ID NO: 316634 - protein, 9 aa, Influenza virus
LSLIMRTVI

SEQ ID NO: 316635 - protein, 9 aa, Influenza virus
SLIMRTVIA

SEQ ID NO: 316636 - protein, 9 aa, Influenza virus
HSMSGFRSN

SEQ ID NO: 316637 - protein, 9 aa, Influenza virus
IMRTVIALS

SEQ ID NO: 316638 - protein, 9 aa, Influenza virus
IFIFILLTH

SEQ ID NO: 316639 - protein, 9 aa, Influenza virus
FIFILLTHW

SEQ ID NO: 316640 - protein, 9 aa, Influenza virus
RFSYVFCLA

SEQ ID NO: 316641 - protein, 9 aa, Influenza virus
NNNNNTATL

SEQ ID NO: 316642 - protein, 9 aa, Influenza virus
NNSTATLCL

SEQ ID NO: 316643 - protein, 9 aa, Influenza virus
TATLCLGHH

SEQ ID NO: 316644 - protein, 9 aa, Influenza virus
ATLCLGHHA

SEQ ID NO: 316645 - protein, 9 aa, Influenza virus
TLCLGHHAV

SEQ ID NO: 316646 - protein, 9 aa, Influenza virus
LCLGHHAVP

SEQ ID NO: 316647 - protein, 9 aa, Influenza virus
CLGHHAVPN

SEQ ID NO: 316648 - protein, 9 aa, Influenza virus
LGHHAVPNG

SEQ ID NO: 316649 - protein, 9 aa, Influenza virus
GHHAVPNGT

SEQ ID NO: 316650 - protein, 9 aa, Influenza virus
DQIEVTNAT

SEQ ID NO: 316651 - protein, 9 aa, Influenza virus
QIEVTNATE

SEQ ID NO: 316652 - protein, 9 aa, Influenza virus
IEVTNATEL

SEQ ID NO: 316653 - protein, 9 aa, Influenza virus
EVTNATELV

SEQ ID NO: 316654 - protein, 9 aa, Influenza virus
VTNATELVQ

SEQ ID NO: 316655 - protein, 9 aa, Influenza virus
TNATELVQS

SEQ ID NO: 316656 - protein, 9 aa, Influenza virus
WEKNCTLID

SEQ ID NO: 316657 - protein, 9 aa, Influenza virus
CTLIDALLG

SEQ ID NO: 316658 - protein, 9 aa, Influenza virus
TLIDALLGD

SEQ ID NO: 316659 - protein, 9 aa, Influenza virus
LIDALLGDP

SEQ ID NO: 316660 - protein, 9 aa, Influenza virus
DALLGDPHC

SEQ ID NO: 316661 - protein, 9 aa, Influenza virus
ALLGDPQCD

SEQ ID NO: 316662 - protein, 9 aa, Influenza virus
SLRSLVASS

SEQ ID NO: 316663 - protein, 9 aa, Influenza virus
LRSLVASSG

SEQ ID NO: 316664 - protein, 9 aa, Influenza virus
RSLVASSGT

SEQ ID NO: 316665 - protein, 9 aa, Influenza virus
SLVASSGTL

SEQ ID NO: 316666 - protein, 9 aa, Influenza virus
LVASSGTLE

SEQ ID NO: 316667 - protein, 9 aa, Influenza virus
VASSGTLEF

SEQ ID NO: 316668 - protein, 9 aa, Influenza virus
SFFSRLNWL

SEQ ID NO: 316669 - protein, 9 aa, Influenza virus
FFSRLNWLT

SEQ ID NO: 316670 - protein, 9 aa, Influenza virus
FDKLYIWGV

SEQ ID NO: 316671 - protein, 9 aa, Influenza virus
DKLYIWGVH

SEQ ID NO: 316672 - protein, 9 aa, Influenza virus
KLYIWGVHH

SEQ ID NO: 316673 - protein, 9 aa, Influenza virus
LYIWGVHHP

SEQ ID NO: 316674 - protein, 9 aa, Influenza virus
YWTIVKPGD

SEQ ID NO: 316675 - protein, 9 aa, Influenza virus
STGNLIAPR

SEQ ID NO: 316676 - protein, 9 aa, Influenza virus
TGNLIAPRG

SEQ ID NO: 316677 - protein, 9 aa, Influenza virus
GNLIAPRGY

SEQ ID NO: 316678 - protein, 9 aa, Influenza virus
NLIAPRGYF

SEQ ID NO: 316679 - protein, 9 aa, Influenza virus
LIAPRGYFK

SEQ ID NO: 316680 - protein, 9 aa, Influenza virus
LNNEIRWPP

SEQ ID NO: 316681 - protein, 9 aa, Influenza virus
SECITPNGS

SEQ ID NO: 316682 - protein, 9 aa, Influenza virus
ECITPNGSI

SEQ ID NO: 316683 - protein, 9 aa, Influenza virus
CITPNGSIP

SEQ ID NO: 316684 - protein, 9 aa, Influenza virus
ITPNGSIPN

SEQ ID NO: 316685 - protein, 9 aa, Influenza virus
TPNGSIPND

SEQ ID NO: 316686 - protein, 9 aa, Influenza virus
GSIPNDKPF

SEQ ID NO: 316687 - protein, 9 aa, Influenza virus
SIPNDKPFQ

SEQ ID NO: 316688 - protein, 9 aa, Influenza virus
IPNDKPFQN

SEQ ID NO: 316689 - protein, 9 aa, Influenza virus
NDKPFQNVN

SEQ ID NO: 316690 - protein, 9 aa, Influenza virus
KPFQNVNRI

SEQ ID NO: 316691 - protein, 9 aa, Influenza virus
PFQNVNRIT

SEQ ID NO: 316692 - protein, 9 aa, Influenza virus
FQNVNRITY

SEQ ID NO: 316693 - protein, 9 aa, Influenza virus
QNVNRITYG

SEQ ID NO: 316694 - protein, 9 aa, Influenza virus
TLKLATGMR

SEQ ID NO: 316695 - protein, 9 aa, Influenza virus
LKLATGMRN

SEQ ID NO: 316696 - protein, 9 aa, Influenza virus
KLATGMRNV

SEQ ID NO: 316697 - protein, 9 aa, Influenza virus
LATGMRNVP

SEQ ID NO: 316698 - protein, 9 aa, Influenza virus
ATGMRNVPE

SEQ ID NO: 316699 - protein, 9 aa, Influenza virus
TGMRNVPEK

SEQ ID NO: 316700 - protein, 9 aa, Influenza virus
GMRNVPEKQ

SEQ ID NO: 316701 - protein, 9 aa, Influenza virus
TRGIFGAIA

SEQ ID NO: 316702 - protein, 9 aa, Influenza virus
RGIFGAIAG

SEQ ID NO: 316703 - protein, 9 aa, Influenza virus
GIFGAIAGF

SEQ ID NO: 316704 - protein, 9 aa, Influenza virus
IFGAIAGFI

SEQ ID NO: 316705 - protein, 9 aa, Influenza virus
FGAIAGFIE

SEQ ID NO: 316706 - protein, 9 aa, Influenza virus
GAIAGFIEN

SEQ ID NO: 316707 - protein, 9 aa, Influenza virus
AIAGFIENG

SEQ ID NO: 316708 - protein, 9 aa, Influenza virus
IAGFIENGW

SEQ ID NO: 316709 - protein, 9 aa, Influenza virus
AGFIENGWE

SEQ ID NO: 316710 - protein, 9 aa, Influenza virus
GFIENGWEG

SEQ ID NO: 316711 - protein, 9 aa, Influenza virus
FIENGWEGM

SEQ ID NO: 316712 - protein, 9 aa, Influenza virus
IENGWEGMV

SEQ ID NO: 316713 - protein, 9 aa, Influenza virus
ENGWEGMVD

SEQ ID NO: 316714 - protein, 9 aa, Influenza virus
NGWEGMVDG

SEQ ID NO: 316715 - protein, 9 aa, Influenza virus
GWEGMVDGW

SEQ ID NO: 316716 - protein, 9 aa, Influenza virus
WEGMVDGWY

SEQ ID NO: 316717 - protein, 9 aa, Influenza virus
EGMVDGWYG

SEQ ID NO: 316718 - protein, 9 aa, Influenza virus
GMVDGWYGF

SEQ ID NO: 316719 - protein, 9 aa, Influenza virus
MVDGWYGFR

SEQ ID NO: 316720 - protein, 9 aa, Influenza virus
VDGWYGFRH

SEQ ID NO: 316721 - protein, 9 aa, Influenza virus
DGWYGFRHQ

SEQ ID NO: 316722 - protein, 9 aa, Influenza virus
GWYGFRHQN

SEQ ID NO: 316723 - protein, 9 aa, Influenza virus
GRLVRFRHQ

SEQ ID NO: 316724 - protein, 9 aa, Influenza virus
RLVRFRHQN

SEQ ID NO: 316725 - protein, 9 aa, Influenza virus
WYGFRHQNS

SEQ ID NO: 316726 - protein, 9 aa, Influenza virus
YGFRHQNSE

SEQ ID NO: 316727 - protein, 9 aa, Influenza virus
GFRHQNSEG

SEQ ID NO: 316728 - protein, 9 aa, Influenza virus
NSEGTGQAA

SEQ ID NO: 316729 - protein, 9 aa, Influenza virus
SEGTGQAAD

SEQ ID NO: 316730 - protein, 9 aa, Influenza virus
EGTGQAADL

SEQ ID NO: 316731 - protein, 9 aa, Influenza virus
GTGQAADLK

SEQ ID NO: 316732 - protein, 9 aa, Influenza virus
TGQAADLKS

SEQ ID NO: 316733 - protein, 9 aa, Influenza virus
GQAADLKST

SEQ ID NO: 316734 - protein, 9 aa, Influenza virus
QAADLKSTQ

SEQ ID NO: 316735 - protein, 9 aa, Influenza virus
AADLKSTQA

SEQ ID NO: 316736 - protein, 9 aa, Influenza virus
ADLKSTQAA

SEQ ID NO: 316737 - protein, 9 aa, Influenza virus
DLKSTQAAI

SEQ ID NO: 316738 - protein, 9 aa, Influenza virus
LKSTQAAID

SEQ ID NO: 316739 - protein, 9 aa, Influenza virus
KSTQAAIDQ

SEQ ID NO: 316740 - protein, 9 aa, Influenza virus
STQAAIDQI

SEQ ID NO: 316741 - protein, 9 aa, Influenza virus
IGKTNEKFH

SEQ ID NO: 316742 - protein, 9 aa, Influenza virus
GKTNEKFHQ

SEQ ID NO: 316743 - protein, 9 aa, Influenza virus
KTNEKFHQI

SEQ ID NO: 316744 - protein, 9 aa, Influenza virus
TNEKFHQIE

SEQ ID NO: 316745 - protein, 9 aa, Influenza virus
NEKFHQIEK

SEQ ID NO: 316746 - protein, 9 aa, Influenza virus
EKFHQIEKE

SEQ ID NO: 316747 - protein, 9 aa, Influenza virus
KFHQIEKEF

SEQ ID NO: 316748 - protein, 9 aa, Influenza virus
FHQIEKEFS

SEQ ID NO: 316749 - protein, 9 aa, Influenza virus
HQIEKEFSE

SEQ ID NO: 316750 - protein, 9 aa, Influenza virus
QIEKEFSEV

SEQ ID NO: 316751 - protein, 9 aa, Influenza virus
IEKEFSEVE

SEQ ID NO: 316752 - protein, 9 aa, Influenza virus
EKEFSEVEG

SEQ ID NO: 316753 - protein, 9 aa, Influenza virus
KEFSEVEGR

SEQ ID NO: 316754 - protein, 9 aa, Influenza virus
EFSEVEGRI

SEQ ID NO: 316755 - protein, 9 aa, Influenza virus
FSEVEGRIQ

SEQ ID NO: 316756 - protein, 9 aa, Influenza virus
SEVEGRIQD

SEQ ID NO: 316757 - protein, 9 aa, Influenza virus
EVEGRIQDL

SEQ ID NO: 316758 - protein, 9 aa, Influenza virus
VEGRIQDLE

SEQ ID NO: 316759 - protein, 9 aa, Influenza virus
EGRIQDLEK

SEQ ID NO: 316760 - protein, 9 aa, Influenza virus
GRIQDLEKY

SEQ ID NO: 316761 - protein, 9 aa, Influenza virus
RIQDLEKYV

SEQ ID NO: 316762 - protein, 9 aa, Influenza virus
IQDLEKYVE

SEQ ID NO: 316763 - protein, 9 aa, Influenza virus
QDLEKYVED

SEQ ID NO: 316764 - protein, 9 aa, Influenza virus
DLEKYVEDT

SEQ ID NO: 316765 - protein, 9 aa, Influenza virus
LEKYVEDTK

SEQ ID NO: 316766 - protein, 9 aa, Influenza virus
EKYVEDTKI

SEQ ID NO: 316767 - protein, 9 aa, Influenza virus
KYVEDTKID

SEQ ID NO: 316768 - protein, 9 aa, Influenza virus
YVEDTKIDL

SEQ ID NO: 316769 - protein, 9 aa, Influenza virus
VEDTKIDLW

SEQ ID NO: 316770 - protein, 9 aa, Influenza virus
EDTKIDLWS

SEQ ID NO: 316771 - protein, 9 aa, Influenza virus
DTKIDLWSY

SEQ ID NO: 316772 - protein, 9 aa, Influenza virus
TKIDLWSYN

SEQ ID NO: 316773 - protein, 9 aa, Influenza virus
KIDLWSYNA

SEQ ID NO: 316774 - protein, 9 aa, Influenza virus
IDLWSYNAE

SEQ ID NO: 316775 - protein, 9 aa, Influenza virus
DLWSYNAEL

SEQ ID NO: 316776 - protein, 9 aa, Influenza virus
LWSYNAELL

SEQ ID NO: 316777 - protein, 9 aa, Influenza virus
WSYNAELLV

SEQ ID NO: 316778 - protein, 9 aa, Influenza virus
SYNAELLVA

SEQ ID NO: 316779 - protein, 9 aa, Influenza virus
YNAELLVAL

SEQ ID NO: 316780 - protein, 9 aa, Influenza virus
NAELLVALE

SEQ ID NO: 316781 - protein, 9 aa, Influenza virus
AELLVALEN

SEQ ID NO: 316782 - protein, 9 aa, Influenza virus
ELLVALENQ

SEQ ID NO: 316783 - protein, 9 aa, Influenza virus
LLVALENQH

SEQ ID NO: 316784 - protein, 9 aa, Influenza virus
LVALENQHT

SEQ ID NO: 316785 - protein, 9 aa, Influenza virus
VALENQHTI

SEQ ID NO: 316786 - protein, 9 aa, Influenza virus
ALENQHTID

SEQ ID NO: 316787 - protein, 9 aa, Influenza virus
LENQHTIDL

SEQ ID NO: 316788 - protein, 9 aa, Influenza virus
ENQHTIDLT

SEQ ID NO: 316789 - protein, 9 aa, Influenza virus
NQHTIDLTD

SEQ ID NO: 316790 - protein, 9 aa, Influenza virus
QHTIDLTDS

SEQ ID NO: 316791 - protein, 9 aa, Influenza virus
HTIDLTDSE

SEQ ID NO: 316792 - protein, 9 aa, Influenza virus
TIDLTDSEM

SEQ ID NO: 316793 - protein, 9 aa, Influenza virus
IDLTDSEMN

SEQ ID NO: 316794 - protein, 9 aa, Influenza virus
DLTDSEMNK

SEQ ID NO: 316795 - protein, 9 aa, Influenza virus
LTDSEMNKL

SEQ ID NO: 316796 - protein, 9 aa, Influenza virus
TDSEMNKLF

SEQ ID NO: 316797 - protein, 9 aa, Influenza virus
DSEMNKLFE

SEQ ID NO: 316798 - protein, 9 aa, Influenza virus
EMNKLFEKT

SEQ ID NO: 316799 - protein, 9 aa, Influenza virus
TKKQLRENA

SEQ ID NO: 316800 - protein, 9 aa, Influenza virus
KKQLRENAE

SEQ ID NO: 316801 - protein, 9 aa, Influenza virus
KQLRENAED

SEQ ID NO: 316802 - protein, 9 aa, Influenza virus
QLRENAEDM

SEQ ID NO: 316803 - protein, 9 aa, Influenza virus
LRENAEDMG

SEQ ID NO: 316804 - protein, 9 aa, Influenza virus
RENAEDMGN

SEQ ID NO: 316805 - protein, 9 aa, Influenza virus
ENAEDMGNG

SEQ ID NO: 316806 - protein, 9 aa, Influenza virus
NAEDMGNGC

SEQ ID NO: 316807 - protein, 9 aa, Influenza virus
AEDMGNGCF

SEQ ID NO: 316808 - protein, 9 aa, Influenza virus
GNGCFKIYH

SEQ ID NO: 316809 - protein, 9 aa, Influenza virus
GCFKIYHKC

SEQ ID NO: 316810 - protein, 9 aa, Influenza virus
CFKIYHKCD

SEQ ID NO: 316811 - protein, 9 aa, Influenza virus
FKIYHKCDN

SEQ ID NO: 316812 - protein, 9 aa, Influenza virus
IYHKCDNAC

SEQ ID NO: 316813 - protein, 9 aa, Influenza virus
SIRNGTYDH

SEQ ID NO: 316814 - protein, 9 aa, Influenza virus
YRDEALNNR

SEQ ID NO: 316815 - protein, 9 aa, Influenza virus
GYKDWILWI

SEQ ID NO: 316816 - protein, 9 aa, Influenza virus
YKDWILWIS

SEQ ID NO: 316817 - protein, 9 aa, Influenza virus
KDWILWISF

SEQ ID NO: 316818 - protein, 9 aa, Influenza virus
DWILWISFA

SEQ ID NO: 316819 - protein, 9 aa, Influenza virus
WILWISFAI

SEQ ID NO: 316820 - protein, 9 aa, Influenza virus
ILWISFAIS

SEQ ID NO: 316821 - protein, 9 aa, Influenza virus
LWISFAISC

SEQ ID NO: 316822 - protein, 9 aa, Influenza virus
WISFAISCF

SEQ ID NO: 316823 - protein, 9 aa, Influenza virus
ISFAISCFL

SEQ ID NO: 316824 - protein, 9 aa, Influenza virus
SFAISCFLL

SEQ ID NO: 316825 - protein, 9 aa, Influenza virus
FAISCFLLC

SEQ ID NO: 316826 - protein, 9 aa, Influenza virus
LGFIMWACQ

SEQ ID NO: 316827 - protein, 9 aa, Influenza virus
GFIMWACQK

SEQ ID NO: 316828 - protein, 9 aa, Influenza virus
FIMWACQKG

SEQ ID NO: 316829 - protein, 9 aa, Influenza virus
IMWACQKGN

SEQ ID NO: 316830 - protein, 9 aa, Influenza virus
MWACQKGNI

SEQ ID NO: 316831 - protein, 9 aa, Influenza virus
WACQKGNIR

SEQ ID NO: 316832 - protein, 9 aa, Influenza virus
ACQKGNIRC

SEQ ID NO: 316833 - protein, 9 aa, Influenza virus
CQKGNIRCN

SEQ ID NO: 316834 - protein, 9 aa, Influenza virus
QKGNIRCNI

SEQ ID NO: 316835 - protein, 9 aa, Influenza virus
KGNIRCNIC

SEQ ID NO: 316836 - protein, 9 aa, Influenza virus
GNIRCNICI

SEQ ID NO: 316837 - protein, 9 aa, Influenza virus
HSMSGFRSN

SEQ ID NO: 316838 - protein, 9 aa, Influenza virus
MKTIIIVLS

SEQ ID NO: 316839 - protein, 9 aa, Influenza virus
NNNNNTATL

SEQ ID NO: 316840 - protein, 9 aa, Influenza virus
NNSTATLCL

SEQ ID NO: 316841 - protein, 9 aa, Influenza virus
TATLCLGHH

SEQ ID NO: 316842 - protein, 9 aa, Influenza virus
ATLCLGHHA

SEQ ID NO: 316843 - protein, 9 aa, Influenza virus
TLCLGHHAV

SEQ ID NO: 316844 - protein, 9 aa, Influenza virus
LCLGHHAVP

SEQ ID NO: 316845 - protein, 9 aa, Influenza virus
CLGHHAVPN

SEQ ID NO: 316846 - protein, 9 aa, Influenza virus
LGHHAVPNG

SEQ ID NO: 316847 - protein, 9 aa, Influenza virus
GHHAVPNGT

SEQ ID NO: 316848 - protein, 9 aa, Influenza virus
HHAVPNGTI

SEQ ID NO: 316849 - protein, 9 aa, Influenza virus
HAVPNGTIV

SEQ ID NO: 316850 - protein, 9 aa, Influenza virus
AVPNGTIVK

SEQ ID NO: 316851 - protein, 9 aa, Influenza virus
VPNGTIVKT

SEQ ID NO: 316852 - protein, 9 aa, Influenza virus
PNGTIVKTI

SEQ ID NO: 316853 - protein, 9 aa, Influenza virus
NGTIVKTIT

SEQ ID NO: 316854 - protein, 9 aa, Influenza virus
DQIEVTNAT

SEQ ID NO: 316855 - protein, 9 aa, Influenza virus
QIEVTNATE

SEQ ID NO: 316856 - protein, 9 aa, Influenza virus
IEVTNATEL

SEQ ID NO: 316857 - protein, 9 aa, Influenza virus
EVTNATELV

SEQ ID NO: 316858 - protein, 9 aa, Influenza virus
VTNATELVQ

SEQ ID NO: 316859 - protein, 9 aa, Influenza virus
TNATELVQS

SEQ ID NO: 316860 - protein, 9 aa, Influenza virus
KNCTLIDAL

SEQ ID NO: 316861 - protein, 9 aa, Influenza virus
CTLIDALLG

SEQ ID NO: 316862 - protein, 9 aa, Influenza virus
TLIDALLGD

SEQ ID NO: 316863 - protein, 9 aa, Influenza virus
LIDALLGDP

SEQ ID NO: 316864 - protein, 9 aa, Influenza virus
IDALLGDPQ

SEQ ID NO: 316865 - protein, 9 aa, Influenza virus
DALLGDPQC

SEQ ID NO: 316866 - protein, 9 aa, Influenza virus
ALLGDPQCD

SEQ ID NO: 316867 - protein, 9 aa, Influenza virus
CYPYDVPDY

SEQ ID NO: 316868 - protein, 9 aa, Influenza virus
SLRSLVASS

SEQ ID NO: 316869 - protein, 9 aa, Influenza virus
LRSLVASSG

SEQ ID NO: 316870 - protein, 9 aa, Influenza virus
RSLVASSGT

SEQ ID NO: 316871 - protein, 9 aa, Influenza virus
SLVASSGTL

SEQ ID NO: 316872 - protein, 9 aa, Influenza virus
LVASSGTLE

SEQ ID NO: 316873 - protein, 9 aa, Influenza virus
VASSGTLEF

SEQ ID NO: 316874 - protein, 9 aa, Influenza virus
SFFSRLNWL

SEQ ID NO: 316875 - protein, 9 aa, Influenza virus
FFSRLNWLT

SEQ ID NO: 316876 - protein, 9 aa, Influenza virus
FDKLYIWGV

SEQ ID NO: 316877 - protein, 9 aa, Influenza virus
DKLYIWGVH

SEQ ID NO: 316878 - protein, 9 aa, Influenza virus
KLYIWGVHH

SEQ ID NO: 316879 - protein, 9 aa, Influenza virus
LYIWGVHHP

SEQ ID NO: 316880 - protein, 9 aa, Influenza virus
SIYWTIVKP

SEQ ID NO: 316881 - protein, 9 aa, Influenza virus
IYWTIVKPG

SEQ ID NO: 316882 - protein, 9 aa, Influenza virus
YWTIVKPGD

SEQ ID NO: 316883 - protein, 9 aa, Influenza virus
STGNLIAPR

SEQ ID NO: 316884 - protein, 9 aa, Influenza virus
TGNLIAPRG

SEQ ID NO: 316885 - protein, 9 aa, Influenza virus
GNLIAPRGY

SEQ ID NO: 316886 - protein, 9 aa, Influenza virus
NLIAPRGYF

SEQ ID NO: 316887 - protein, 9 aa, Influenza virus
LIAPRGYFK

SEQ ID NO: 316888 - protein, 9 aa, Influenza virus
IAPRGYFKI

SEQ ID NO: 316889 - protein, 9 aa, Influenza virus
LNNEIRWPP

SEQ ID NO: 316890 - protein, 9 aa, Influenza virus
SECITPNGS

SEQ ID NO: 316891 - protein, 9 aa, Influenza virus
ECITPNGSI

SEQ ID NO: 316892 - protein, 9 aa, Influenza virus
CITPNGSIP

SEQ ID NO: 316893 - protein, 9 aa, Influenza virus
ITPNGSIPN

SEQ ID NO: 316894 - protein, 9 aa, Influenza virus
TPNGSIPND

SEQ ID NO: 316895 - protein, 9 aa, Influenza virus
PNGSIPNDK

SEQ ID NO: 316896 - protein, 9 aa, Influenza virus
NGSIPNDKP

SEQ ID NO: 316897 - protein, 9 aa, Influenza virus
GSIPNDKPF

SEQ ID NO: 316898 - protein, 9 aa, Influenza virus
SIPNDKPFQ

SEQ ID NO: 316899 - protein, 9 aa, Influenza virus
IPNDKPFQN

SEQ ID NO: 316900 - protein, 9 aa, Influenza virus
PNDKPFQNV

SEQ ID NO: 316901 - protein, 9 aa, Influenza virus
NDKPFQNVN

SEQ ID NO: 316902 - protein, 9 aa, Influenza virus
DKPFQNVNR

SEQ ID NO: 316903 - protein, 9 aa, Influenza virus
KPFQNVNRI

SEQ ID NO: 316904 - protein, 9 aa, Influenza virus
PFQNVNRIT

SEQ ID NO: 316905 - protein, 9 aa, Influenza virus
FQNVNRITY

SEQ ID NO: 316906 - protein, 9 aa, Influenza virus
QNVNRITYG

SEQ ID NO: 316907 - protein, 9 aa, Influenza virus
NVNRITYGA

SEQ ID NO: 316908 - protein, 9 aa, Influenza virus
VNRITYGAC

SEQ ID NO: 316909 - protein, 9 aa, Influenza virus
NRITYGACP

SEQ ID NO: 316910 - protein, 9 aa, Influenza virus
ITYGACPRY

SEQ ID NO: 316911 - protein, 9 aa, Influenza virus
TYGACPRYV

SEQ ID NO: 316912 - protein, 9 aa, Influenza virus
YVKQNTLKL

SEQ ID NO: 316913 - protein, 9 aa, Influenza virus
VKQNTLKLA

SEQ ID NO: 316914 - protein, 9 aa, Influenza virus
KQNTLKLAT

SEQ ID NO: 316915 - protein, 9 aa, Influenza virus
QNTLKLATG

SEQ ID NO: 316916 - protein, 9 aa, Influenza virus
NTLKLATGM

SEQ ID NO: 316917 - protein, 9 aa, Influenza virus
TLKLATGMR

SEQ ID NO: 316918 - protein, 9 aa, Influenza virus
LKLATGMRN

SEQ ID NO: 316919 - protein, 9 aa, Influenza virus
KLATGMRNV

SEQ ID NO: 316920 - protein, 9 aa, Influenza virus
LATGMRNVP

SEQ ID NO: 316921 - protein, 9 aa, Influenza virus
ATGMRNVPE

SEQ ID NO: 316922 - protein, 9 aa, Influenza virus
TGMRNVPEK

SEQ ID NO: 316923 - protein, 9 aa, Influenza virus
GMRNVPEKQ

SEQ ID NO: 316924 - protein, 9 aa, Influenza virus
MRNVPEKQT

SEQ ID NO: 316925 - protein, 9 aa, Influenza virus
RNVPEKQTR

SEQ ID NO: 316926 - protein, 9 aa, Influenza virus
NVPEKQTRG

SEQ ID NO: 316927 - protein, 9 aa, Influenza virus
PEKQTRGIF

SEQ ID NO: 316928 - protein, 9 aa, Influenza virus
EKQTRGIFG

SEQ ID NO: 316929 - protein, 9 aa, Influenza virus
KQTRGIFGA

SEQ ID NO: 316930 - protein, 9 aa, Influenza virus
QTRGIFGAI

SEQ ID NO: 316931 - protein, 9 aa, Influenza virus
TRGIFGAIA

SEQ ID NO: 316932 - protein, 9 aa, Influenza virus
RGIFGAIAG

SEQ ID NO: 316933 - protein, 9 aa, Influenza virus
GIFGAIAGF

SEQ ID NO: 316934 - protein, 9 aa, Influenza virus
IFGAIAGFI

SEQ ID NO: 316935 - protein, 9 aa, Influenza virus
FGAIAGFIE

SEQ ID NO: 316936 - protein, 9 aa, Influenza virus
GAIAGFIEN

SEQ ID NO: 316937 - protein, 9 aa, Influenza virus
AIAGFIENG

SEQ ID NO: 316938 - protein, 9 aa, Influenza virus
IAGFIENGW

SEQ ID NO: 316939 - protein, 9 aa, Influenza virus
AGFIENGWE

SEQ ID NO: 316940 - protein, 9 aa, Influenza virus
GFIENGWEG

SEQ ID NO: 316941 - protein, 9 aa, Influenza virus
FIENGWEGM

SEQ ID NO: 316942 - protein, 9 aa, Influenza virus
IENGWEGMV

SEQ ID NO: 316943 - protein, 9 aa, Influenza virus
ENGWEGMVD

SEQ ID NO: 316944 - protein, 9 aa, Influenza virus
NGWEGMVDG

SEQ ID NO: 316945 - protein, 9 aa, Influenza virus
GWEGMVDGW

SEQ ID NO: 316946 - protein, 9 aa, Influenza virus
WEGMVDGWY

SEQ ID NO: 316947 - protein, 9 aa, Influenza virus
EGMVDGWYG

SEQ ID NO: 316948 - protein, 9 aa, Influenza virus
GMVDGWYGF

SEQ ID NO: 316949 - protein, 9 aa, Influenza virus
MVDGWYGFR

SEQ ID NO: 316950 - protein, 9 aa, Influenza virus
VDGWYGFRH

SEQ ID NO: 316951 - protein, 9 aa, Influenza virus
DGWYGFRHQ

SEQ ID NO: 316952 - protein, 9 aa, Influenza virus
GWYGFRHQN

SEQ ID NO: 316953 - protein, 9 aa, Influenza virus
GRLVRFRHQ

SEQ ID NO: 316954 - protein, 9 aa, Influenza virus
RLVRFRHQN

SEQ ID NO: 316955 - protein, 9 aa, Influenza virus
WYGFRHQNS

SEQ ID NO: 316956 - protein, 9 aa, Influenza virus
YGFRHQNSE

SEQ ID NO: 316957 - protein, 9 aa, Influenza virus
GFRHQNSEG

SEQ ID NO: 316958 - protein, 9 aa, Influenza virus
RHQNSEGTG

SEQ ID NO: 316959 - protein, 9 aa, Influenza virus
HQNSEGTGQ

SEQ ID NO: 316960 - protein, 9 aa, Influenza virus
NSEGTGQAA

SEQ ID NO: 316961 - protein, 9 aa, Influenza virus
SEGTGQAAD

SEQ ID NO: 316962 - protein, 9 aa, Influenza virus
EGTGQAADL

SEQ ID NO: 316963 - protein, 9 aa, Influenza virus
GTGQAADLK

SEQ ID NO: 316964 - protein, 9 aa, Influenza virus
TGQAADLKS

SEQ ID NO: 316965 - protein, 9 aa, Influenza virus
GQAADLKST

SEQ ID NO: 316966 - protein, 9 aa, Influenza virus
QAADLKSTQ

SEQ ID NO: 316967 - protein, 9 aa, Influenza virus
AADLKSTQA

SEQ ID NO: 316968 - protein, 9 aa, Influenza virus
ADLKSTQAA

SEQ ID NO: 316969 - protein, 9 aa, Influenza virus
DLKSTQAAI

SEQ ID NO: 316970 - protein, 9 aa, Influenza virus
LKSTQAAIN

SEQ ID NO: 316971 - protein, 9 aa, Influenza virus
KSTQAAINQ

SEQ ID NO: 316972 - protein, 9 aa, Influenza virus
STQAAINQI

SEQ ID NO: 316973 - protein, 9 aa, Influenza virus
IGKTNEKFH

SEQ ID NO: 316974 - protein, 9 aa, Influenza virus
GKTNEKFHQ

SEQ ID NO: 316975 - protein, 9 aa, Influenza virus
KTNEKFHQI

SEQ ID NO: 316976 - protein, 9 aa, Influenza virus
TNEKFHQIE

SEQ ID NO: 316977 - protein, 9 aa, Influenza virus
NEKFHQIEK

SEQ ID NO: 316978 - protein, 9 aa, Influenza virus
EKFHQIEKE

SEQ ID NO: 316979 - protein, 9 aa, Influenza virus
KFHQIEKEF

SEQ ID NO: 316980 - protein, 9 aa, Influenza virus
FHQIEKEFS

SEQ ID NO: 316981 - protein, 9 aa, Influenza virus
HQIEKEFSE

SEQ ID NO: 316982 - protein, 9 aa, Influenza virus
QIEKEFSEV

SEQ ID NO: 316983 - protein, 9 aa, Influenza virus
IEKEFSEVE

SEQ ID NO: 316984 - protein, 9 aa, Influenza virus
EKEFSEVEG

SEQ ID NO: 316985 - protein, 9 aa, Influenza virus
KEFSEVEGR

SEQ ID NO: 316986 - protein, 9 aa, Influenza virus
EFSEVEGRI

SEQ ID NO: 316987 - protein, 9 aa, Influenza virus
FSEVEGRIQ

SEQ ID NO: 316988 - protein, 9 aa, Influenza virus
SEVEGRIQD

SEQ ID NO: 316989 - protein, 9 aa, Influenza virus
EVEGRIQDL

SEQ ID NO: 316990 - protein, 9 aa, Influenza virus
VEGRIQDLE

SEQ ID NO: 316991 - protein, 9 aa, Influenza virus
EGRIQDLEK

SEQ ID NO: 316992 - protein, 9 aa, Influenza virus
GRIQDLEKY

SEQ ID NO: 316993 - protein, 9 aa, Influenza virus
RIQDLEKYV

SEQ ID NO: 316994 - protein, 9 aa, Influenza virus
IQDLEKYVE

SEQ ID NO: 316995 - protein, 9 aa, Influenza virus
QDLEKYVED

SEQ ID NO: 316996 - protein, 9 aa, Influenza virus
DLEKYVEDT

SEQ ID NO: 316997 - protein, 9 aa, Influenza virus
LEKYVEDTK

SEQ ID NO: 316998 - protein, 9 aa, Influenza virus
EKYVEDTKI

SEQ ID NO: 316999 - protein, 9 aa, Influenza virus
KYVEDTKID

SEQ ID NO: 317000 - protein, 9 aa, Influenza virus
YVEDTKIDL

SEQ ID NO: 317001 - protein, 9 aa, Influenza virus
VEDTKIDLW

SEQ ID NO: 317002 - protein, 9 aa, Influenza virus
EDTKIDLWS

SEQ ID NO: 317003 - protein, 9 aa, Influenza virus
DTKIDLWSY

SEQ ID NO: 317004 - protein, 9 aa, Influenza virus
TKIDLWSYN

SEQ ID NO: 317005 - protein, 9 aa, Influenza virus
KIDLWSYNA

SEQ ID NO: 317006 - protein, 9 aa, Influenza virus
IDLWSYNAE

SEQ ID NO: 317007 - protein, 9 aa, Influenza virus
DLWSYNAEL

SEQ ID NO: 317008 - protein, 9 aa, Influenza virus
LWSYNAELL

SEQ ID NO: 317009 - protein, 9 aa, Influenza virus
WSYNAELLV

SEQ ID NO: 317010 - protein, 9 aa, Influenza virus
SYNAELLVA

SEQ ID NO: 317011 - protein, 9 aa, Influenza virus
YNAELLVAL

SEQ ID NO: 317012 - protein, 9 aa, Influenza virus
NAELLVALE

SEQ ID NO: 317013 - protein, 9 aa, Influenza virus
AELLVALEN

SEQ ID NO: 317014 - protein, 9 aa, Influenza virus
ELLVALENQ

SEQ ID NO: 317015 - protein, 9 aa, Influenza virus
LLVALENQH

SEQ ID NO: 317016 - protein, 9 aa, Influenza virus
LVALENQHT

SEQ ID NO: 317017 - protein, 9 aa, Influenza virus
VALENQHTI

SEQ ID NO: 317018 - protein, 9 aa, Influenza virus
ALENQHTID

SEQ ID NO: 317019 - protein, 9 aa, Influenza virus
LENQHTIDL

SEQ ID NO: 317020 - protein, 9 aa, Influenza virus
ENQHTIDLT

SEQ ID NO: 317021 - protein, 9 aa, Influenza virus
NQHTIDLTD

SEQ ID NO: 317022 - protein, 9 aa, Influenza virus
QHTIDLTDS

SEQ ID NO: 317023 - protein, 9 aa, Influenza virus
HTIDLTDSE

SEQ ID NO: 317024 - protein, 9 aa, Influenza virus
TIDLTDSEM

SEQ ID NO: 317025 - protein, 9 aa, Influenza virus
IDLTDSEMN

SEQ ID NO: 317026 - protein, 9 aa, Influenza virus
DLTDSEMNK

SEQ ID NO: 317027 - protein, 9 aa, Influenza virus
LTDSEMNKL

SEQ ID NO: 317028 - protein, 9 aa, Influenza virus
TDSEMNKLF

SEQ ID NO: 317029 - protein, 9 aa, Influenza virus
DSEMNKLFE

SEQ ID NO: 317030 - protein, 9 aa, Influenza virus
SEMNKLFER

SEQ ID NO: 317031 - protein, 9 aa, Influenza virus
EMNKLFERT

SEQ ID NO: 317032 - protein, 9 aa, Influenza virus
TKKQLRENA

SEQ ID NO: 317033 - protein, 9 aa, Influenza virus
KKQLRENAE

SEQ ID NO: 317034 - protein, 9 aa, Influenza virus
KQLRENAED

SEQ ID NO: 317035 - protein, 9 aa, Influenza virus
QLRENAEDM

SEQ ID NO: 317036 - protein, 9 aa, Influenza virus
LRENAEDMG

SEQ ID NO: 317037 - protein, 9 aa, Influenza virus
RENAEDMGN

SEQ ID NO: 317038 - protein, 9 aa, Influenza virus
ENAEDMGNG

SEQ ID NO: 317039 - protein, 9 aa, Influenza virus
NAEDMGNGC

SEQ ID NO: 317040 - protein, 9 aa, Influenza virus
AEDMGNGCF

SEQ ID NO: 317041 - protein, 9 aa, Influenza virus
EDMGNGCFK

SEQ ID NO: 317042 - protein, 9 aa, Influenza virus
DMGNGCFKI

SEQ ID NO: 317043 - protein, 9 aa, Influenza virus
MGNGCFKIY

SEQ ID NO: 317044 - protein, 9 aa, Influenza virus
GNGCFKIYH

SEQ ID NO: 317045 - protein, 9 aa, Influenza virus
NGCFKIYHK

SEQ ID NO: 317046 - protein, 9 aa, Influenza virus
GCFKIYHKC

SEQ ID NO: 317047 - protein, 9 aa, Influenza virus
CFKIYHKCD

SEQ ID NO: 317048 - protein, 9 aa, Influenza virus
FKIYHKCDN

SEQ ID NO: 317049 - protein, 9 aa, Influenza virus
IYHKCDNAC

SEQ ID NO: 317050 - protein, 9 aa, Influenza virus
CIGSIRNGT

SEQ ID NO: 317051 - protein, 9 aa, Influenza virus
IGSIRNGTY

SEQ ID NO: 317052 - protein, 9 aa, Influenza virus
GSIRNGTYD

SEQ ID NO: 317053 - protein, 9 aa, Influenza virus
SIRNGTYDH

SEQ ID NO: 317054 - protein, 9 aa, Influenza virus
IRNGTYDHD

SEQ ID NO: 317055 - protein, 9 aa, Influenza virus
YRDEALNNR

SEQ ID NO: 317056 - protein, 9 aa, Influenza virus
RDEALNNRF

SEQ ID NO: 317057 - protein, 9 aa, Influenza virus
DEALNNRFQ

SEQ ID NO: 317058 - protein, 9 aa, Influenza virus
EALNNRFQI

SEQ ID NO: 317059 - protein, 9 aa, Influenza virus
ALNNRFQIK

SEQ ID NO: 317060 - protein, 9 aa, Influenza virus
GYKDWILWI

SEQ ID NO: 317061 - protein, 9 aa, Influenza virus
YKDWILWIS

SEQ ID NO: 317062 - protein, 9 aa, Influenza virus
KDWILWISF

SEQ ID NO: 317063 - protein, 9 aa, Influenza virus
DWILWISFA

SEQ ID NO: 317064 - protein, 9 aa, Influenza virus
WILWISFAI

SEQ ID NO: 317065 - protein, 9 aa, Influenza virus
ILWISFAIS

SEQ ID NO: 317066 - protein, 9 aa, Influenza virus
LWISFAISC

SEQ ID NO: 317067 - protein, 9 aa, Influenza virus
WISFAISCF

SEQ ID NO: 317068 - protein, 9 aa, Influenza virus
ISFAISCFL

SEQ ID NO: 317069 - protein, 9 aa, Influenza virus
SFAISCFLL

SEQ ID NO: 317070 - protein, 9 aa, Influenza virus
FAISCFLLC

SEQ ID NO: 317071 - protein, 9 aa, Influenza virus
LGFIMWACQ

SEQ ID NO: 317072 - protein, 9 aa, Influenza virus
GFIMWACQK

SEQ ID NO: 317073 - protein, 9 aa, Influenza virus
FIMWACQKG

SEQ ID NO: 317074 - protein, 9 aa, Influenza virus
IMWACQKGN

SEQ ID NO: 317075 - protein, 9 aa, Influenza virus
MWACQKGNI

SEQ ID NO: 317076 - protein, 9 aa, Influenza virus
WACQKGNIR

SEQ ID NO: 317077 - protein, 9 aa, Influenza virus
ACQKGNIRC

SEQ ID NO: 317078 - protein, 9 aa, Influenza virus
CQKGNIRCN

SEQ ID NO: 317079 - protein, 9 aa, Influenza virus
QKGNIRCNI

SEQ ID NO: 317080 - protein, 9 aa, Influenza virus
KGNIRCNIC

SEQ ID NO: 317081 - protein, 9 aa, Influenza virus
GNIRCNICI

SEQ ID NO: 317082 - protein, 9 aa, Influenza virus
AKAGVKMNP

SEQ ID NO: 317083 - protein, 9 aa, Influenza virus
KAGVKMNPN

SEQ ID NO: 317084 - protein, 9 aa, Influenza virus
AGVKMNPNQ

SEQ ID NO: 317085 - protein, 9 aa, Influenza virus
GVKMNPNQK

SEQ ID NO: 317086 - protein, 9 aa, Influenza virus
VKMNPNQKI

SEQ ID NO: 317087 - protein, 9 aa, Influenza virus
KMNPNQKII

SEQ ID NO: 317088 - protein, 9 aa, Influenza virus
MNPNQKIIT

SEQ ID NO: 317089 - protein, 9 aa, Influenza virus
EKEKEICSV

SEQ ID NO: 317090 - protein, 9 aa, Influenza virus
KEKEICSVV

SEQ ID NO: 317091 - protein, 9 aa, Influenza virus
YRNWSKPQC

SEQ ID NO: 317092 - protein, 9 aa, Influenza virus
ITGFAPFSK

SEQ ID NO: 317093 - protein, 9 aa, Influenza virus
TGFAPFSKD

SEQ ID NO: 317094 - protein, 9 aa, Influenza virus
GFAPFSKDN

SEQ ID NO: 317095 - protein, 9 aa, Influenza virus
FAPFSKDNS

SEQ ID NO: 317096 - protein, 9 aa, Influenza virus
APFSKDNSI

SEQ ID NO: 317097 - protein, 9 aa, Influenza virus
PFSKDNSIR

SEQ ID NO: 317098 - protein, 9 aa, Influenza virus
FSKDNSIRL

SEQ ID NO: 317099 - protein, 9 aa, Influenza virus
SKDNSIRLS

SEQ ID NO: 317100 - protein, 9 aa, Influenza virus
KDNSIRLSA

SEQ ID NO: 317101 - protein, 9 aa, Influenza virus
DNSIRLSAG

SEQ ID NO: 317102 - protein, 9 aa, Influenza virus
NSIRLSAGG

SEQ ID NO: 317103 - protein, 9 aa, Influenza virus
SIRLSAGGD

SEQ ID NO: 317104 - protein, 9 aa, Influenza virus
IRLSAGGDI

SEQ ID NO: 317105 - protein, 9 aa, Influenza virus
RLSAGGDIW

SEQ ID NO: 317106 - protein, 9 aa, Influenza virus
LSAGGDIWV

SEQ ID NO: 317107 - protein, 9 aa, Influenza virus
SAGGDIWVT

SEQ ID NO: 317108 - protein, 9 aa, Influenza virus
AGGDIWVTR

SEQ ID NO: 317109 - protein, 9 aa, Influenza virus
GGDIWVTRE

SEQ ID NO: 317110 - protein, 9 aa, Influenza virus
GDIWVTREP

SEQ ID NO: 317111 - protein, 9 aa, Influenza virus
DIWVTREPY

SEQ ID NO: 317112 - protein, 9 aa, Influenza virus
IWVTREPYV

SEQ ID NO: 317113 - protein, 9 aa, Influenza virus
WVTREPYVS

SEQ ID NO: 317114 - protein, 9 aa, Influenza virus
VTREPYVSC

SEQ ID NO: 317115 - protein, 9 aa, Influenza virus
TREPYVSCD

SEQ ID NO: 317116 - protein, 9 aa, Influenza virus
DKCYQFALG

SEQ ID NO: 317117 - protein, 9 aa, Influenza virus
KCYQFALGQ

SEQ ID NO: 317118 - protein, 9 aa, Influenza virus
CYQFALGQG

SEQ ID NO: 317119 - protein, 9 aa, Influenza virus
YQFALGQGT

SEQ ID NO: 317120 - protein, 9 aa, Influenza virus
QFALGQGTT

SEQ ID NO: 317121 - protein, 9 aa, Influenza virus
FALGQGTTL

SEQ ID NO: 317122 - protein, 9 aa, Influenza virus
ALGQGTTLN

SEQ ID NO: 317123 - protein, 9 aa, Influenza virus
LGQGTTLNN

SEQ ID NO: 317124 - protein, 9 aa, Influenza virus
RTPYRTLLM

SEQ ID NO: 317125 - protein, 9 aa, Influenza virus
TPYRTLLMN

SEQ ID NO: 317126 - protein, 9 aa, Influenza virus
PYRTLLMNE

SEQ ID NO: 317127 - protein, 9 aa, Influenza virus
YRTLLMNEL

SEQ ID NO: 317128 - protein, 9 aa, Influenza virus
RTLLMNELG

SEQ ID NO: 317129 - protein, 9 aa, Influenza virus
TLLMNELGV

SEQ ID NO: 317130 - protein, 9 aa, Influenza virus
LLMNELGVP

SEQ ID NO: 317131 - protein, 9 aa, Influenza virus
LMNELGVPF

SEQ ID NO: 317132 - protein, 9 aa, Influenza virus
MNELGVPFH

SEQ ID NO: 317133 - protein, 9 aa, Influenza virus
NELGVPFHL

SEQ ID NO: 317134 - protein, 9 aa, Influenza virus
ELGVPFHLG

SEQ ID NO: 317135 - protein, 9 aa, Influenza virus
LGVPFHLGT

SEQ ID NO: 317136 - protein, 9 aa, Influenza virus
GVPFHLGTK

SEQ ID NO: 317137 - protein, 9 aa, Influenza virus
VPFHLGTKQ

SEQ ID NO: 317138 - protein, 9 aa, Influenza virus
PFHLGTKQV

SEQ ID NO: 317139 - protein, 9 aa, Influenza virus
FHLGTKQVC

SEQ ID NO: 317140 - protein, 9 aa, Influenza virus
HLGTKQVCI

SEQ ID NO: 317141 - protein, 9 aa, Influenza virus
LGTKQVCIA

SEQ ID NO: 317142 - protein, 9 aa, Influenza virus
GTKQVCIAW

SEQ ID NO: 317143 - protein, 9 aa, Influenza virus
TKQVCIAWS

SEQ ID NO: 317144 - protein, 9 aa, Influenza virus
KQVCIAWSS

SEQ ID NO: 317145 - protein, 9 aa, Influenza virus
QVCIAWSSS

SEQ ID NO: 317146 - protein, 9 aa, Influenza virus
VCIAWSSSS

SEQ ID NO: 317147 - protein, 9 aa, Influenza virus
CIAWSSSSC

SEQ ID NO: 317148 - protein, 9 aa, Influenza virus
IAWSSSSCH

SEQ ID NO: 317149 - protein, 9 aa, Influenza virus
AWSSSSCHD

SEQ ID NO: 317150 - protein, 9 aa, Influenza virus
WSSSSCHDG

SEQ ID NO: 317151 - protein, 9 aa, Influenza virus
SSSSCHDGK

SEQ ID NO: 317152 - protein, 9 aa, Influenza virus
SSSCHDGKA

SEQ ID NO: 317153 - protein, 9 aa, Influenza virus
SSCHDGKAW

SEQ ID NO: 317154 - protein, 9 aa, Influenza virus
SCHDGKAWL

SEQ ID NO: 317155 - protein, 9 aa, Influenza virus
CHDGKAWLH

SEQ ID NO: 317156 - protein, 9 aa, Influenza virus
HDGKAWLHV

SEQ ID NO: 317157 - protein, 9 aa, Influenza virus
DGKAWLHVC

SEQ ID NO: 317158 - protein, 9 aa, Influenza virus
GKAWLHVCV

SEQ ID NO: 317159 - protein, 9 aa, Influenza virus
KAWLHVCVT

SEQ ID NO: 317160 - protein, 9 aa, Influenza virus
AWLHVCVTG

SEQ ID NO: 317161 - protein, 9 aa, Influenza virus
KNATASFIY

SEQ ID NO: 317162 - protein, 9 aa, Influenza virus
NATASFIYN

SEQ ID NO: 317163 - protein, 9 aa, Influenza virus
ATASFIYNG

SEQ ID NO: 317164 - protein, 9 aa, Influenza virus
EILRTQESE

SEQ ID NO: 317165 - protein, 9 aa, Influenza virus
ILRTQESEC

SEQ ID NO: 317166 - protein, 9 aa, Influenza virus
LRTQESECV

SEQ ID NO: 317167 - protein, 9 aa, Influenza virus
RTQESECVC

SEQ ID NO: 317168 - protein, 9 aa, Influenza virus
TQESECVCI

SEQ ID NO: 317169 - protein, 9 aa, Influenza virus
QESECVCIN

SEQ ID NO: 317170 - protein, 9 aa, Influenza virus
ESECVCING

SEQ ID NO: 317171 - protein, 9 aa, Influenza virus
SECVCINGT

SEQ ID NO: 317172 - protein, 9 aa, Influenza virus
ECVCINGTC

SEQ ID NO: 317173 - protein, 9 aa, Influenza virus
CVCINGTCT

SEQ ID NO: 317174 - protein, 9 aa, Influenza virus
VCINGTCTV

SEQ ID NO: 317175 - protein, 9 aa, Influenza virus
CINGTCTVV

SEQ ID NO: 317176 - protein, 9 aa, Influenza virus
INGTCTVVM

SEQ ID NO: 317177 - protein, 9 aa, Influenza virus
NGTCTVVMT

SEQ ID NO: 317178 - protein, 9 aa, Influenza virus
GTCTVVMTD

SEQ ID NO: 317179 - protein, 9 aa, Influenza virus
TCTVVMTDG

SEQ ID NO: 317180 - protein, 9 aa, Influenza virus
CTVVMTDGS

SEQ ID NO: 317181 - protein, 9 aa, Influenza virus
TVVMTDGSA

SEQ ID NO: 317182 - protein, 9 aa, Influenza virus
VVMTDGSAS

SEQ ID NO: 317183 - protein, 9 aa, Influenza virus
VMTDGSASG

SEQ ID NO: 317184 - protein, 9 aa, Influenza virus
EYYFVKEGK

SEQ ID NO: 317185 - protein, 9 aa, Influenza virus
YYFVKEGKI

SEQ ID NO: 317186 - protein, 9 aa, Influenza virus
YFVKEGKIV

SEQ ID NO: 317187 - protein, 9 aa, Influenza virus
LSGSAQHVE

SEQ ID NO: 317188 - protein, 9 aa, Influenza virus
SGSAQHVEE

SEQ ID NO: 317189 - protein, 9 aa, Influenza virus
GSAQHVEEC

SEQ ID NO: 317190 - protein, 9 aa, Influenza virus
SAQHVEECS

SEQ ID NO: 317191 - protein, 9 aa, Influenza virus
AQHVEECSC

SEQ ID NO: 317192 - protein, 9 aa, Influenza virus
QHVEECSCY

SEQ ID NO: 317193 - protein, 9 aa, Influenza virus
HVEECSCYP

SEQ ID NO: 317194 - protein, 9 aa, Influenza virus
VEECSCYPR

SEQ ID NO: 317195 - protein, 9 aa, Influenza virus
EECSCYPRY

SEQ ID NO: 317196 - protein, 9 aa, Influenza virus
ECSCYPRYP

SEQ ID NO: 317197 - protein, 9 aa, Influenza virus
CSCYPRYPG

SEQ ID NO: 317198 - protein, 9 aa, Influenza virus
VRCVCRDNW

SEQ ID NO: 317199 - protein, 9 aa, Influenza virus
RCVCRDNWK

SEQ ID NO: 317200 - protein, 9 aa, Influenza virus
CVCRDNWKG

SEQ ID NO: 317201 - protein, 9 aa, Influenza virus
VCRDNWKGS

SEQ ID NO: 317202 - protein, 9 aa, Influenza virus
CRDNWKGSN

SEQ ID NO: 317203 - protein, 9 aa, Influenza virus
RDNWKGSNR

SEQ ID NO: 317204 - protein, 9 aa, Influenza virus
DNWKGSNRP

SEQ ID NO: 317205 - protein, 9 aa, Influenza virus
NWKGSNRPI

SEQ ID NO: 317206 - protein, 9 aa, Influenza virus
WKGSNRPIV

SEQ ID NO: 317207 - protein, 9 aa, Influenza virus
KGSNRPIVD

SEQ ID NO: 317208 - protein, 9 aa, Influenza virus
GSNRPIVDI

SEQ ID NO: 317209 - protein, 9 aa, Influenza virus
SNRPIVDIN

SEQ ID NO: 317210 - protein, 9 aa, Influenza virus
SSYVCSGLV

SEQ ID NO: 317211 - protein, 9 aa, Influenza virus
SYVCSGLVG

SEQ ID NO: 317212 - protein, 9 aa, Influenza virus
YVCSGLVGD

SEQ ID NO: 317213 - protein, 9 aa, Influenza virus
VCSGLVGDT

SEQ ID NO: 317214 - protein, 9 aa, Influenza virus
CSGLVGDTP

SEQ ID NO: 317215 - protein, 9 aa, Influenza virus
SGLVGDTPR

SEQ ID NO: 317216 - protein, 9 aa, Influenza virus
GLVGDTPRK

SEQ ID NO: 317217 - protein, 9 aa, Influenza virus
HGVKGWAFD

SEQ ID NO: 317218 - protein, 9 aa, Influenza virus
GVKGWAFDD

SEQ ID NO: 317219 - protein, 9 aa, Influenza virus
VKGWAFDDG

SEQ ID NO: 317220 - protein, 9 aa, Influenza virus
GNDVWMGRT

SEQ ID NO: 317221 - protein, 9 aa, Influenza virus
NDVWMGRTI

SEQ ID NO: 317222 - protein, 9 aa, Influenza virus
DVWMGRTIS

SEQ ID NO: 317223 - protein, 9 aa, Influenza virus
RSGYETFKV

SEQ ID NO: 317224 - protein, 9 aa, Influenza virus
SGYETFKVI

SEQ ID NO: 317225 - protein, 9 aa, Influenza virus
RSGYSGIFS

SEQ ID NO: 317226 - protein, 9 aa, Influenza virus
SGYSGIFSV

SEQ ID NO: 317227 - protein, 9 aa, Influenza virus
GYSGIFSVE

SEQ ID NO: 317228 - protein, 9 aa, Influenza virus
YSGIFSVEG

SEQ ID NO: 317229 - protein, 9 aa, Influenza virus
SGIFSVEGK

SEQ ID NO: 317230 - protein, 9 aa, Influenza virus
KSCINRCFY

SEQ ID NO: 317231 - protein, 9 aa, Influenza virus
SCINRCFYV

SEQ ID NO: 317232 - protein, 9 aa, Influenza virus
CINRCFYVE

SEQ ID NO: 317233 - protein, 9 aa, Influenza virus
INRCFYVEL

SEQ ID NO: 317234 - protein, 9 aa, Influenza virus
NRCFYVELI

SEQ ID NO: 317235 - protein, 9 aa, Influenza virus
RCFYVELIR

SEQ ID NO: 317236 - protein, 9 aa, Influenza virus
CFYVELIRG

SEQ ID NO: 317237 - protein, 9 aa, Influenza virus
FYVELIRGR

SEQ ID NO: 317238 - protein, 9 aa, Influenza virus
EVLWTSNSI

SEQ ID NO: 317239 - protein, 9 aa, Influenza virus
VLWTSNSIV

SEQ ID NO: 317240 - protein, 9 aa, Influenza virus
LWTSNSIVV

SEQ ID NO: 317241 - protein, 9 aa, Influenza virus
WTSNSIVVF

SEQ ID NO: 317242 - protein, 9 aa, Influenza virus
TSNSIVVFC

SEQ ID NO: 317243 - protein, 9 aa, Influenza virus
SNSIVVFCG

SEQ ID NO: 317244 - protein, 9 aa, Influenza virus
NSIVVFCGT

SEQ ID NO: 317245 - protein, 9 aa, Influenza virus
SIVVFCGTS

SEQ ID NO: 317246 - protein, 9 aa, Influenza virus
IVVFCGTSG

SEQ ID NO: 317247 - protein, 9 aa, Influenza virus
VVFCGTSGT

SEQ ID NO: 317248 - protein, 9 aa, Influenza virus
VFCGTSGTY

SEQ ID NO: 317249 - protein, 9 aa, Influenza virus
FCGTSGTYG

SEQ ID NO: 317250 - protein, 9 aa, Influenza virus
CGTSGTYGT

SEQ ID NO: 317251 - protein, 9 aa, Influenza virus
GTSGTYGTG

SEQ ID NO: 317252 - protein, 9 aa, Influenza virus
TSGTYGTGS

SEQ ID NO: 317253 - protein, 9 aa, Influenza virus
SGTYGTGSW

SEQ ID NO: 317254 - protein, 9 aa, Influenza virus
GTYGTGSWP

SEQ ID NO: 317255 - protein, 9 aa, Influenza virus
TYGTGSWPD

SEQ ID NO: 317256 - protein, 9 aa, Influenza virus
YGTGSWPDG

SEQ ID NO: 317257 - protein, 9 aa, Influenza virus
GTGSWPDGA

SEQ ID NO: 317258 - protein, 9 aa, Influenza virus
TGSWPDGAD

SEQ ID NO: 317259 - protein, 9 aa, Influenza virus
GSWPDGADI

SEQ ID NO: 317260 - protein, 9 aa, Influenza virus
ADINLHAYI

SEQ ID NO: 317261 - protein, 9 aa, Influenza virus
DINLHAYIS

SEQ ID NO: 317262 - protein, 9 aa, Influenza virus
INLHAYISF

SEQ ID NO: 317263 - protein, 9 aa, Influenza virus
NLHAYISFR

SEQ ID NO: 317264 - protein, 9 aa, Influenza virus
LHAYISFRN

SEQ ID NO: 317265 - protein, 9 aa, Influenza virus
HAYISFRNL

SEQ ID NO: 317266 - protein, 9 aa, Influenza virus
YTGNPVICL

SEQ ID NO: 317267 - protein, 9 aa, Influenza virus
TGNPVICLG

SEQ ID NO: 317268 - protein, 9 aa, Influenza virus
GNPVICLGH

SEQ ID NO: 317269 - protein, 9 aa, Influenza virus
NPVICLGHH

SEQ ID NO: 317270 - protein, 9 aa, Influenza virus
PVICLGHHA

SEQ ID NO: 317271 - protein, 9 aa, Influenza virus
VICLGHHAV

SEQ ID NO: 317272 - protein, 9 aa, Influenza virus
WICMGHHAV

SEQ ID NO: 317273 - protein, 9 aa, Influenza virus
GHHAVPNGT

SEQ ID NO: 317274 - protein, 9 aa, Influenza virus
VPNGTMVKT

SEQ ID NO: 317275 - protein, 9 aa, Influenza virus
NGTMVKTLT

SEQ ID NO: 317276 - protein, 9 aa, Influenza virus
GTMVKTLTD

SEQ ID NO: 317277 - protein, 9 aa, Influenza virus
IEVVTAQEL

SEQ ID NO: 317278 - protein, 9 aa, Influenza virus
EVVTAQELV

SEQ ID NO: 317279 - protein, 9 aa, Influenza virus
VVTAQELVE

SEQ ID NO: 317280 - protein, 9 aa, Influenza virus
VTAQELVES

SEQ ID NO: 317281 - protein, 9 aa, Influenza virus
TAQELVESQ

SEQ ID NO: 317282 - protein, 9 aa, Influenza virus
ELCPSPLRL

SEQ ID NO: 317283 - protein, 9 aa, Influenza virus
LCPSPLRLV

SEQ ID NO: 317284 - protein, 9 aa, Influenza virus
CPSPLRLVD

SEQ ID NO: 317285 - protein, 9 aa, Influenza virus
SPLRLVDGQ

SEQ ID NO: 317286 - protein, 9 aa, Influenza virus
CDIVNGALG

SEQ ID NO: 317287 - protein, 9 aa, Influenza virus
DIVNGALGS

SEQ ID NO: 317288 - protein, 9 aa, Influenza virus
IVNGALGSP

SEQ ID NO: 317289 - protein, 9 aa, Influenza virus
VNGALGSPG

SEQ ID NO: 317290 - protein, 9 aa, Influenza virus
NGALGSPGC

SEQ ID NO: 317291 - protein, 9 aa, Influenza virus
GALGSPGCD

SEQ ID NO: 317292 - protein, 9 aa, Influenza virus
ALGSPGCDH

SEQ ID NO: 317293 - protein, 9 aa, Influenza virus
LGSPGCDHL

SEQ ID NO: 317294 - protein, 9 aa, Influenza virus
EWDVFIERP

SEQ ID NO: 317295 - protein, 9 aa, Influenza virus
DTCYPFDVP

SEQ ID NO: 317296 - protein, 9 aa, Influenza virus
TCYPFDVPD

SEQ ID NO: 317297 - protein, 9 aa, Influenza virus
CYPFDVPDY

SEQ ID NO: 317298 - protein, 9 aa, Influenza virus
YPFDVPDYQ

SEQ ID NO: 317299 - protein, 9 aa, Influenza virus
PFDVPDYQS

SEQ ID NO: 317300 - protein, 9 aa, Influenza virus
DVPDYQSLR

SEQ ID NO: 317301 - protein, 9 aa, Influenza virus
VPDYQSLRS

SEQ ID NO: 317302 - protein, 9 aa, Influenza virus
PDYQSLRSI

SEQ ID NO: 317303 - protein, 9 aa, Influenza virus
DYQSLRSIL

SEQ ID NO: 317304 - protein, 9 aa, Influenza virus
YQSLRSILA

SEQ ID NO: 317305 - protein, 9 aa, Influenza virus
QSLRSILAN

SEQ ID NO: 317306 - protein, 9 aa, Influenza virus
SLRSILANN

SEQ ID NO: 317307 - protein, 9 aa, Influenza virus
LRSILANNG

SEQ ID NO: 317308 - protein, 9 aa, Influenza virus
RSILANNGK

SEQ ID NO: 317309 - protein, 9 aa, Influenza virus
SILANNGKF

SEQ ID NO: 317310 - protein, 9 aa, Influenza virus
ILANNGKFE

SEQ ID NO: 317311 - protein, 9 aa, Influenza virus
LANNGKFEF

SEQ ID NO: 317312 - protein, 9 aa, Influenza virus
ANNGKFEFI

SEQ ID NO: 317313 - protein, 9 aa, Influenza virus
NNGKFEFIA

SEQ ID NO: 317314 - protein, 9 aa, Influenza virus
NGKFEFIAE

SEQ ID NO: 317315 - protein, 9 aa, Influenza virus
GKFEFIAEE

SEQ ID NO: 317316 - protein, 9 aa, Influenza virus
KFEFIAEEF

SEQ ID NO: 317317 - protein, 9 aa, Influenza virus
TVKQNGKSG

SEQ ID NO: 317318 - protein, 9 aa, Influenza virus
VKQNGKSGA

SEQ ID NO: 317319 - protein, 9 aa, Influenza virus
KQNGKSGAC

SEQ ID NO: 317320 - protein, 9 aa, Influenza virus
QNGKSGACK

SEQ ID NO: 317321 - protein, 9 aa, Influenza virus
NGKSGACKR

SEQ ID NO: 317322 - protein, 9 aa, Influenza virus
GKSGACKRA

SEQ ID NO: 317323 - protein, 9 aa, Influenza virus
KSGACKRAN

SEQ ID NO: 317324 - protein, 9 aa, Influenza virus
NDFFNRLNW

SEQ ID NO: 317325 - protein, 9 aa, Influenza virus
DFFNRLNWL

SEQ ID NO: 317326 - protein, 9 aa, Influenza virus
AYPLQNLTK

SEQ ID NO: 317327 - protein, 9 aa, Influenza virus
YPLQNLTKV

SEQ ID NO: 317328 - protein, 9 aa, Influenza virus
PLQNLTKVN

SEQ ID NO: 317329 - protein, 9 aa, Influenza virus
QNLTKVNNG

SEQ ID NO: 317330 - protein, 9 aa, Influenza virus
NLTKVNNGD

SEQ ID NO: 317331 - protein, 9 aa, Influenza virus
LTKVNNGDY

SEQ ID NO: 317332 - protein, 9 aa, Influenza virus
NNGDYARLY

SEQ ID NO: 317333 - protein, 9 aa, Influenza virus
NGDYARLYI

SEQ ID NO: 317334 - protein, 9 aa, Influenza virus
GDYARLYIW

SEQ ID NO: 317335 - protein, 9 aa, Influenza virus
DYARLYIWG

SEQ ID NO: 317336 - protein, 9 aa, Influenza virus
YARLYIWGV

SEQ ID NO: 317337 - protein, 9 aa, Influenza virus
ARLYIWGVH

SEQ ID NO: 317338 - protein, 9 aa, Influenza virus
RLYIWGVHH

SEQ ID NO: 317339 - protein, 9 aa, Influenza virus
LYIWGVHHP

SEQ ID NO: 317340 - protein, 9 aa, Influenza virus
YIWGVHHPS

SEQ ID NO: 317341 - protein, 9 aa, Influenza virus
IWGVHHPST

SEQ ID NO: 317342 - protein, 9 aa, Influenza virus
WGVHHPSTD

SEQ ID NO: 317343 - protein, 9 aa, Influenza virus
GVHHPSTDT

SEQ ID NO: 317344 - protein, 9 aa, Influenza virus
VHHPSTDTE

SEQ ID NO: 317345 - protein, 9 aa, Influenza virus
HHPSTDTEQ

SEQ ID NO: 317346 - protein, 9 aa, Influenza virus
LYKNNPGRV

SEQ ID NO: 317347 - protein, 9 aa, Influenza virus
YKNNPGRVT

SEQ ID NO: 317348 - protein, 9 aa, Influenza virus
NNPGRVTVS

SEQ ID NO: 317349 - protein, 9 aa, Influenza virus
NPGRVTVST

SEQ ID NO: 317350 - protein, 9 aa, Influenza virus
PGRVTVSTK

SEQ ID NO: 317351 - protein, 9 aa, Influenza virus
QTSVVPNIG

SEQ ID NO: 317352 - protein, 9 aa, Influenza virus
RPWVRGQSG

SEQ ID NO: 317353 - protein, 9 aa, Influenza virus
PWVRGQSGR

SEQ ID NO: 317354 - protein, 9 aa, Influenza virus
VRGQSGRIS

SEQ ID NO: 317355 - protein, 9 aa, Influenza virus
RGQSGRISF

SEQ ID NO: 317356 - protein, 9 aa, Influenza virus
GQSGRISFY

SEQ ID NO: 317357 - protein, 9 aa, Influenza virus
QSGRISFYW

SEQ ID NO: 317358 - protein, 9 aa, Influenza virus
SGRISFYWT

SEQ ID NO: 317359 - protein, 9 aa, Influenza virus
GRISFYWTI

SEQ ID NO: 317360 - protein, 9 aa, Influenza virus
RISFYWTIV

SEQ ID NO: 317361 - protein, 9 aa, Influenza virus
ISFYWTIVE

SEQ ID NO: 317362 - protein, 9 aa, Influenza virus
SFYWTIVEP

SEQ ID NO: 317363 - protein, 9 aa, Influenza virus
FYWTIVEPG

SEQ ID NO: 317364 - protein, 9 aa, Influenza virus
YWTIVEPGD

SEQ ID NO: 317365 - protein, 9 aa, Influenza virus
PGDLIVFNT

SEQ ID NO: 317366 - protein, 9 aa, Influenza virus
GDLIVFNTI

SEQ ID NO: 317367 - protein, 9 aa, Influenza virus
DLIVFNTIG

SEQ ID NO: 317368 - protein, 9 aa, Influenza virus
LIVFNTIGN

SEQ ID NO: 317369 - protein, 9 aa, Influenza virus
IVFNTIGNL

SEQ ID NO: 317370 - protein, 9 aa, Influenza virus
VFNTIGNLI

SEQ ID NO: 317371 - protein, 9 aa, Influenza virus
FNTIGNLIA

SEQ ID NO: 317372 - protein, 9 aa, Influenza virus
NTIGNLIAP

SEQ ID NO: 317373 - protein, 9 aa, Influenza virus
TIGNLIAPR

SEQ ID NO: 317374 - protein, 9 aa, Influenza virus
IGNLIAPRG

SEQ ID NO: 317375 - protein, 9 aa, Influenza virus
GNLIAPRGH

SEQ ID NO: 317376 - protein, 9 aa, Influenza virus
NLIAPRGHY

SEQ ID NO: 317377 - protein, 9 aa, Influenza virus
LIAPRGHYK

SEQ ID NO: 317378 - protein, 9 aa, Influenza virus
IAPRGHYKL

SEQ ID NO: 317379 - protein, 9 aa, Influenza virus
IGSCVSKCH

SEQ ID NO: 317380 - protein, 9 aa, Influenza virus
GSCVSKCHT

SEQ ID NO: 317381 - protein, 9 aa, Influenza virus
SKCHTDRGS

SEQ ID NO: 317382 - protein, 9 aa, Influenza virus
KPFQNISRI

SEQ ID NO: 317383 - protein, 9 aa, Influenza virus
PFQNISRIS

SEQ ID NO: 317384 - protein, 9 aa, Influenza virus
GDCPKYVKQ

SEQ ID NO: 317385 - protein, 9 aa, Influenza virus
DCPKYVKQG

SEQ ID NO: 317386 - protein, 9 aa, Influenza virus
CPKYVKQGS

SEQ ID NO: 317387 - protein, 9 aa, Influenza virus
PKYVKQGSL

SEQ ID NO: 317388 - protein, 9 aa, Influenza virus
KYVKQGSLK

SEQ ID NO: 317389 - protein, 9 aa, Influenza virus
YVKQGSLKL

SEQ ID NO: 317390 - protein, 9 aa, Influenza virus
VKQGSLKLA

SEQ ID NO: 317391 - protein, 9 aa, Influenza virus
KQGSLKLAT

SEQ ID NO: 317392 - protein, 9 aa, Influenza virus
QGSLKLATG

SEQ ID NO: 317393 - protein, 9 aa, Influenza virus
GSLKLATGM

SEQ ID NO: 317394 - protein, 9 aa, Influenza virus
SLKLATGMR

SEQ ID NO: 317395 - protein, 9 aa, Influenza virus
LKLATGMRN

SEQ ID NO: 317396 - protein, 9 aa, Influenza virus
KLATGMRNI

SEQ ID NO: 317397 - protein, 9 aa, Influenza virus
LATGMRNIP

SEQ ID NO: 317398 - protein, 9 aa, Influenza virus
ATGMRNIPE

SEQ ID NO: 317399 - protein, 9 aa, Influenza virus
TGMRNIPEK

SEQ ID NO: 317400 - protein, 9 aa, Influenza virus
RGLFGAIAG

SEQ ID NO: 317401 - protein, 9 aa, Influenza virus
GLFGAIAGF

SEQ ID NO: 317402 - protein, 9 aa, Influenza virus
LFGAIAGFI

SEQ ID NO: 317403 - protein, 9 aa, Influenza virus
FGAIAGFIE

SEQ ID NO: 317404 - protein, 9 aa, Influenza virus
GAIAGFIEN

SEQ ID NO: 317405 - protein, 9 aa, Influenza virus
AIAGFIENG

SEQ ID NO: 317406 - protein, 9 aa, Influenza virus
IAGFIENGW

SEQ ID NO: 317407 - protein, 9 aa, Influenza virus
AGFIENGWQ

SEQ ID NO: 317408 - protein, 9 aa, Influenza virus
GFIENGWQG

SEQ ID NO: 317409 - protein, 9 aa, Influenza virus
FIENGWQGL

SEQ ID NO: 317410 - protein, 9 aa, Influenza virus
IENGWQGLI

SEQ ID NO: 317411 - protein, 9 aa, Influenza virus
ENGWQGLID

SEQ ID NO: 317412 - protein, 9 aa, Influenza virus
NGWQGLIDG

SEQ ID NO: 317413 - protein, 9 aa, Influenza virus
GWQGLIDGW

SEQ ID NO: 317414 - protein, 9 aa, Influenza virus
WQGLIDGWY

SEQ ID NO: 317415 - protein, 9 aa, Influenza virus
QGLIDGWYG

SEQ ID NO: 317416 - protein, 9 aa, Influenza virus
GLIDGWYGF

SEQ ID NO: 317417 - protein, 9 aa, Influenza virus
LIDGWYGFR

SEQ ID NO: 317418 - protein, 9 aa, Influenza virus
IDGWYGFRH

SEQ ID NO: 317419 - protein, 9 aa, Influenza virus
DGWYGFRHQ

SEQ ID NO: 317420 - protein, 9 aa, Influenza virus
GWYGFRHQN

SEQ ID NO: 317421 - protein, 9 aa, Influenza virus
WYGFRHQNA

SEQ ID NO: 317422 - protein, 9 aa, Influenza virus
YGFRHQNAE

SEQ ID NO: 317423 - protein, 9 aa, Influenza virus
GFRHQNAEG

SEQ ID NO: 317424 - protein, 9 aa, Influenza virus
FRHQNAEGT

SEQ ID NO: 317425 - protein, 9 aa, Influenza virus
RHQNAEGTG

SEQ ID NO: 317426 - protein, 9 aa, Influenza virus
HQNAEGTGT

SEQ ID NO: 317427 - protein, 9 aa, Influenza virus
QNAEGTGTA

SEQ ID NO: 317428 - protein, 9 aa, Influenza virus
NAEGTGTAA

SEQ ID NO: 317429 - protein, 9 aa, Influenza virus
AEGTGTAAD

SEQ ID NO: 317430 - protein, 9 aa, Influenza virus
EGTGTAADL

SEQ ID NO: 317431 - protein, 9 aa, Influenza virus
GTGTAADLK

SEQ ID NO: 317432 - protein, 9 aa, Influenza virus
TGTAADLKS

SEQ ID NO: 317433 - protein, 9 aa, Influenza virus
GTAADLKST

SEQ ID NO: 317434 - protein, 9 aa, Influenza virus
TAADLKSTQ

SEQ ID NO: 317435 - protein, 9 aa, Influenza virus
AADLKSTQA

SEQ ID NO: 317436 - protein, 9 aa, Influenza virus
ADLKSTQAA

SEQ ID NO: 317437 - protein, 9 aa, Influenza virus
DLKSTQAAI

SEQ ID NO: 317438 - protein, 9 aa, Influenza virus
LKSTQAAID

SEQ ID NO: 317439 - protein, 9 aa, Influenza virus
KSTQAAIDQ

SEQ ID NO: 317440 - protein, 9 aa, Influenza virus
STQAAIDQI

SEQ ID NO: 317441 - protein, 9 aa, Influenza virus
TQAAIDQIN

SEQ ID NO: 317442 - protein, 9 aa, Influenza virus
QAAIDQING

SEQ ID NO: 317443 - protein, 9 aa, Influenza virus
AAIDQINGK

SEQ ID NO: 317444 - protein, 9 aa, Influenza virus
AIDQINGKL

SEQ ID NO: 317445 - protein, 9 aa, Influenza virus
IDQINGKLN

SEQ ID NO: 317446 - protein, 9 aa, Influenza virus
DQINGKLNR

SEQ ID NO: 317447 - protein, 9 aa, Influenza virus
QINGKLNRL

SEQ ID NO: 317448 - protein, 9 aa, Influenza virus
INGKLNRLI

SEQ ID NO: 317449 - protein, 9 aa, Influenza virus
NGKLNRLIE

SEQ ID NO: 317450 - protein, 9 aa, Influenza virus
GKLNRLIEK

SEQ ID NO: 317451 - protein, 9 aa, Influenza virus
KLNRLIEKT

SEQ ID NO: 317452 - protein, 9 aa, Influenza virus
LNRLIEKTN

SEQ ID NO: 317453 - protein, 9 aa, Influenza virus
NRLIEKTNE

SEQ ID NO: 317454 - protein, 9 aa, Influenza virus
RLIEKTNEK

SEQ ID NO: 317455 - protein, 9 aa, Influenza virus
LIEKTNEKY

SEQ ID NO: 317456 - protein, 9 aa, Influenza virus
IEKTNEKYH

SEQ ID NO: 317457 - protein, 9 aa, Influenza virus
EKTNEKYHQ

SEQ ID NO: 317458 - protein, 9 aa, Influenza virus
KTNEKYHQI

SEQ ID NO: 317459 - protein, 9 aa, Influenza virus
TNEKYHQIE

SEQ ID NO: 317460 - protein, 9 aa, Influenza virus
NEKYHQIEK

SEQ ID NO: 317461 - protein, 9 aa, Influenza virus
EKYHQIEKE

SEQ ID NO: 317462 - protein, 9 aa, Influenza virus
KYHQIEKEF

SEQ ID NO: 317463 - protein, 9 aa, Influenza virus
YHQIEKEFE

SEQ ID NO: 317464 - protein, 9 aa, Influenza virus
HQIEKEFEQ

SEQ ID NO: 317465 - protein, 9 aa, Influenza virus
QIEKEFEQV

SEQ ID NO: 317466 - protein, 9 aa, Influenza virus
IEKEFEQVE

SEQ ID NO: 317467 - protein, 9 aa, Influenza virus
EKEFEQVEG

SEQ ID NO: 317468 - protein, 9 aa, Influenza virus
KEFEQVEGR

SEQ ID NO: 317469 - protein, 9 aa, Influenza virus
EFEQVEGRI

SEQ ID NO: 317470 - protein, 9 aa, Influenza virus
FEQVEGRIQ

SEQ ID NO: 317471 - protein, 9 aa, Influenza virus
EQVEGRIQD

SEQ ID NO: 317472 - protein, 9 aa, Influenza virus
QVEGRIQDL

SEQ ID NO: 317473 - protein, 9 aa, Influenza virus
VEGRIQDLE

SEQ ID NO: 317474 - protein, 9 aa, Influenza virus
QDLEKYVED

SEQ ID NO: 317475 - protein, 9 aa, Influenza virus
DLEKYVEDT

SEQ ID NO: 317476 - protein, 9 aa, Influenza virus
LEKYVEDTK

SEQ ID NO: 317477 - protein, 9 aa, Influenza virus
EKYVEDTKI

SEQ ID NO: 317478 - protein, 9 aa, Influenza virus
KYVEDTKID

SEQ ID NO: 317479 - protein, 9 aa, Influenza virus
YVEDTKIDL

SEQ ID NO: 317480 - protein, 9 aa, Influenza virus
VEDTKIDLW

SEQ ID NO: 317481 - protein, 9 aa, Influenza virus
EDTKIDLWS

SEQ ID NO: 317482 - protein, 9 aa, Influenza virus
DTKIDLWSY

SEQ ID NO: 317483 - protein, 9 aa, Influenza virus
TKIDLWSYN

SEQ ID NO: 317484 - protein, 9 aa, Influenza virus
KIDLWSYNA

SEQ ID NO: 317485 - protein, 9 aa, Influenza virus
IDLWSYNAE

SEQ ID NO: 317486 - protein, 9 aa, Influenza virus
DLWSYNAEL

SEQ ID NO: 317487 - protein, 9 aa, Influenza virus
LWSYNAELL

SEQ ID NO: 317488 - protein, 9 aa, Influenza virus
WSYNAELLV

SEQ ID NO: 317489 - protein, 9 aa, Influenza virus
SYNAELLVA

SEQ ID NO: 317490 - protein, 9 aa, Influenza virus
YNAELLVAL

SEQ ID NO: 317491 - protein, 9 aa, Influenza virus
NAELLVALE

SEQ ID NO: 317492 - protein, 9 aa, Influenza virus
AELLVALEN

SEQ ID NO: 317493 - protein, 9 aa, Influenza virus
ELLVALENQ

SEQ ID NO: 317494 - protein, 9 aa, Influenza virus
LLVALENQH

SEQ ID NO: 317495 - protein, 9 aa, Influenza virus
LVALENQHT

SEQ ID NO: 317496 - protein, 9 aa, Influenza virus
VALENQHTI

SEQ ID NO: 317497 - protein, 9 aa, Influenza virus
ALENQHTID

SEQ ID NO: 317498 - protein, 9 aa, Influenza virus
LENQHTIDV

SEQ ID NO: 317499 - protein, 9 aa, Influenza virus
ENQHTIDVT

SEQ ID NO: 317500 - protein, 9 aa, Influenza virus
NQHTIDVTD

SEQ ID NO: 317501 - protein, 9 aa, Influenza virus
QHTIDVTDS

SEQ ID NO: 317502 - protein, 9 aa, Influenza virus
HTIDVTDSE

SEQ ID NO: 317503 - protein, 9 aa, Influenza virus
TIDVTDSEM

SEQ ID NO: 317504 - protein, 9 aa, Influenza virus
IDVTDSEMN

SEQ ID NO: 317505 - protein, 9 aa, Influenza virus
DVTDSEMNK

SEQ ID NO: 317506 - protein, 9 aa, Influenza virus
VTDSEMNKL

SEQ ID NO: 317507 - protein, 9 aa, Influenza virus
TDSEMNKLF

SEQ ID NO: 317508 - protein, 9 aa, Influenza virus
DSEMNKLFE

SEQ ID NO: 317509 - protein, 9 aa, Influenza virus
SEMNKLFER

SEQ ID NO: 317510 - protein, 9 aa, Influenza virus
EMNKLFERV

SEQ ID NO: 317511 - protein, 9 aa, Influenza virus
MNKLFERVR

SEQ ID NO: 317512 - protein, 9 aa, Influenza virus
KLFERVRRQ

SEQ ID NO: 317513 - protein, 9 aa, Influenza virus
LFERVRRQL

SEQ ID NO: 317514 - protein, 9 aa, Influenza virus
FERVRRQLR

SEQ ID NO: 317515 - protein, 9 aa, Influenza virus
ERVRRQLRE

SEQ ID NO: 317516 - protein, 9 aa, Influenza virus
RVRRQLREN

SEQ ID NO: 317517 - protein, 9 aa, Influenza virus
VRRQLRENA

SEQ ID NO: 317518 - protein, 9 aa, Influenza virus
RRQLRENAE

SEQ ID NO: 317519 - protein, 9 aa, Influenza virus
RQLRENAED

SEQ ID NO: 317520 - protein, 9 aa, Influenza virus
QLRENAEDK

SEQ ID NO: 317521 - protein, 9 aa, Influenza virus
LRENAEDKG

SEQ ID NO: 317522 - protein, 9 aa, Influenza virus
RENAEDKGN

SEQ ID NO: 317523 - protein, 9 aa, Influenza virus
ENAEDKGNG

SEQ ID NO: 317524 - protein, 9 aa, Influenza virus
NAEDKGNGC

SEQ ID NO: 317525 - protein, 9 aa, Influenza virus
AEDKGNGCF

SEQ ID NO: 317526 - protein, 9 aa, Influenza virus
EDKGNGCFE

SEQ ID NO: 317527 - protein, 9 aa, Influenza virus
DKGNGCFEI

SEQ ID NO: 317528 - protein, 9 aa, Influenza virus
KGNGCFEIF

SEQ ID NO: 317529 - protein, 9 aa, Influenza virus
GNGCFEIFH

SEQ ID NO: 317530 - protein, 9 aa, Influenza virus
NGCFEIFHQ

SEQ ID NO: 317531 - protein, 9 aa, Influenza virus
GCFEIFHQC

SEQ ID NO: 317532 - protein, 9 aa, Influenza virus
CFEIFHQCD

SEQ ID NO: 317533 - protein, 9 aa, Influenza virus
FEIFHQCDN

SEQ ID NO: 317534 - protein, 9 aa, Influenza virus
CDNNCIESI

SEQ ID NO: 317535 - protein, 9 aa, Influenza virus
DNNCIESIR

SEQ ID NO: 317536 - protein, 9 aa, Influenza virus
NNCIESIRN

SEQ ID NO: 317537 - protein, 9 aa, Influenza virus
NCIESIRNG

SEQ ID NO: 317538 - protein, 9 aa, Influenza virus
CIESIRNGT

SEQ ID NO: 317539 - protein, 9 aa, Influenza virus
IESIRNGTY

SEQ ID NO: 317540 - protein, 9 aa, Influenza virus
ESIRNGTYD

SEQ ID NO: 317541 - protein, 9 aa, Influenza virus
SIRNGTYDH

SEQ ID NO: 317542 - protein, 9 aa, Influenza virus
IRNGTYDHD

SEQ ID NO: 317543 - protein, 9 aa, Influenza virus
HDIYRDEAI

SEQ ID NO: 317544 - protein, 9 aa, Influenza virus
YRDEAINNR

SEQ ID NO: 317545 - protein, 9 aa, Influenza virus
RDEAINNRF

SEQ ID NO: 317546 - protein, 9 aa, Influenza virus
DEAINNRFQ

SEQ ID NO: 317547 - protein, 9 aa, Influenza virus
EAINNRFQI

SEQ ID NO: 317548 - protein, 9 aa, Influenza virus
AINNRFQIQ

SEQ ID NO: 317549 - protein, 9 aa, Influenza virus
INNRFQIQG

SEQ ID NO: 317550 - protein, 9 aa, Influenza virus
NNRFQIQGV

SEQ ID NO: 317551 - protein, 9 aa, Influenza virus
NRFQIQGVK

SEQ ID NO: 317552 - protein, 9 aa, Influenza virus
RFQIQGVKL

SEQ ID NO: 317553 - protein, 9 aa, Influenza virus
FQIQGVKLT

SEQ ID NO: 317554 - protein, 9 aa, Influenza virus
QIQGVKLTQ

SEQ ID NO: 317555 - protein, 9 aa, Influenza virus
IQGVKLTQG

SEQ ID NO: 317556 - protein, 9 aa, Influenza virus
QGVKLTQGY

SEQ ID NO: 317557 - protein, 9 aa, Influenza virus
GVKLTQGYK

SEQ ID NO: 317558 - protein, 9 aa, Influenza virus
VKLTQGYKD

SEQ ID NO: 317559 - protein, 9 aa, Influenza virus
KLTQGYKDI

SEQ ID NO: 317560 - protein, 9 aa, Influenza virus
LTQGYKDII

SEQ ID NO: 317561 - protein, 9 aa, Influenza virus
TQGYKDIIL

SEQ ID NO: 317562 - protein, 9 aa, Influenza virus
QGYKDIILW

SEQ ID NO: 317563 - protein, 9 aa, Influenza virus
GYKDIILWI

SEQ ID NO: 317564 - protein, 9 aa, Influenza virus
YKDIILWIS

SEQ ID NO: 317565 - protein, 9 aa, Influenza virus
KDIILWISF

SEQ ID NO: 317566 - protein, 9 aa, Influenza virus
DIILWISFS

SEQ ID NO: 317567 - protein, 9 aa, Influenza virus
IILWISFSI

SEQ ID NO: 317568 - protein, 9 aa, Influenza virus
ILWISFSIS

SEQ ID NO: 317569 - protein, 9 aa, Influenza virus
LWISFSISC

SEQ ID NO: 317570 - protein, 9 aa, Influenza virus
WISFSISCF

SEQ ID NO: 317571 - protein, 9 aa, Influenza virus
ISFSISCFL

SEQ ID NO: 317572 - protein, 9 aa, Influenza virus
SFSISCFLL

SEQ ID NO: 317573 - protein, 9 aa, Influenza virus
FSISCFLLV

SEQ ID NO: 317574 - protein, 9 aa, Influenza virus
VTTRQASPS

SEQ ID NO: 317575 - protein, 9 aa, Influenza virus
TTRQASPSC

SEQ ID NO: 317576 - protein, 9 aa, Influenza virus
TRQASPSCL

SEQ ID NO: 317577 - protein, 9 aa, Influenza virus
RQASPSCLV

SEQ ID NO: 317578 - protein, 9 aa, Influenza virus
QASPSCLVV

SEQ ID NO: 317579 - protein, 9 aa, Influenza virus
ASPSCLVVR

SEQ ID NO: 317580 - protein, 9 aa, Influenza virus
SISCFLLVA

SEQ ID NO: 317581 - protein, 9 aa, Influenza virus
ISCFLLVAL

SEQ ID NO: 317582 - protein, 9 aa, Influenza virus
SCFLLVALL

SEQ ID NO: 317583 - protein, 9 aa, Influenza virus
CFLLVALLL

SEQ ID NO: 317584 - protein, 9 aa, Influenza virus
ALLLAFILW

SEQ ID NO: 317585 - protein, 9 aa, Influenza virus
LLLAFILWA

SEQ ID NO: 317586 - protein, 9 aa, Influenza virus
LLAFILWAC

SEQ ID NO: 317587 - protein, 9 aa, Influenza virus
LAFILWACQ

SEQ ID NO: 317588 - protein, 9 aa, Influenza virus
AFILWACQN

SEQ ID NO: 317589 - protein, 9 aa, Influenza virus
FILWACQNG

SEQ ID NO: 317590 - protein, 9 aa, Influenza virus
ILWACQNGN

SEQ ID NO: 317591 - protein, 9 aa, Influenza virus
LWACQNGNI

SEQ ID NO: 317592 - protein, 9 aa, Influenza virus
WACQNGNIR

SEQ ID NO: 317593 - protein, 9 aa, Influenza virus
ACQNGNIRC

SEQ ID NO: 317594 - protein, 9 aa, Influenza virus
CQNGNIRCQ

SEQ ID NO: 317595 - protein, 9 aa, Influenza virus
QNGNIRCQI

SEQ ID NO: 317596 - protein, 9 aa, Influenza virus
NGNIRCQIC

SEQ ID NO: 317597 - protein, 9 aa, Influenza virus
GNIRCQICI

SEQ ID NO: 317598 - protein, 9 aa, Influenza virus
SVKMEKIVL

SEQ ID NO: 317599 - protein, 9 aa, Influenza virus
VKMEKIVLL

SEQ ID NO: 317600 - protein, 9 aa, Influenza virus
KMEKIVLLL

SEQ ID NO: 317601 - protein, 9 aa, Influenza virus
SDQICIGYH

SEQ ID NO: 317602 - protein, 9 aa, Influenza virus
DQICIGYHA

SEQ ID NO: 317603 - protein, 9 aa, Influenza virus
QICIGYHAN

SEQ ID NO: 317604 - protein, 9 aa, Influenza virus
ICIGYHANN

SEQ ID NO: 317605 - protein, 9 aa, Influenza virus
CIGYHANNS

SEQ ID NO: 317606 - protein, 9 aa, Influenza virus
IGYHANNST

SEQ ID NO: 317607 - protein, 9 aa, Influenza virus
GYHANNSTE

SEQ ID NO: 317608 - protein, 9 aa, Influenza virus
QVDTIMEKN

SEQ ID NO: 317609 - protein, 9 aa, Influenza virus
VDTIMEKNV

SEQ ID NO: 317610 - protein, 9 aa, Influenza virus
DTIMEKNVT

SEQ ID NO: 317611 - protein, 9 aa, Influenza virus
TIMEKNVTV

SEQ ID NO: 317612 - protein, 9 aa, Influenza virus
IMEKNVTVT

SEQ ID NO: 317613 - protein, 9 aa, Influenza virus
MEKNVTVTH

SEQ ID NO: 317614 - protein, 9 aa, Influenza virus
EKNVTVTHA

SEQ ID NO: 317615 - protein, 9 aa, Influenza virus
KNVTVTHAQ

SEQ ID NO: 317616 - protein, 9 aa, Influenza virus
NVTVTHAQD

SEQ ID NO: 317617 - protein, 9 aa, Influenza virus
VTVTHAQDI

SEQ ID NO: 317618 - protein, 9 aa, Influenza virus
TVTHAQDIL

SEQ ID NO: 317619 - protein, 9 aa, Influenza virus
VTHAQDILE

SEQ ID NO: 317620 - protein, 9 aa, Influenza virus
THAQDILEK

SEQ ID NO: 317621 - protein, 9 aa, Influenza virus
KPLILRDCS

SEQ ID NO: 317622 - protein, 9 aa, Influenza virus
PLILRDCSV

SEQ ID NO: 317623 - protein, 9 aa, Influenza virus
ILRDCSVAG

SEQ ID NO: 317624 - protein, 9 aa, Influenza virus
LRDCSVAGW

SEQ ID NO: 317625 - protein, 9 aa, Influenza virus
RDCSVAGWL

SEQ ID NO: 317626 - protein, 9 aa, Influenza virus
DCSVAGWLL

SEQ ID NO: 317627 - protein, 9 aa, Influenza virus
CSVAGWLLG

SEQ ID NO: 317628 - protein, 9 aa, Influenza virus
SVAGWLLGN

SEQ ID NO: 317629 - protein, 9 aa, Influenza virus
VAGWLLGNP

SEQ ID NO: 317630 - protein, 9 aa, Influenza virus
AGWLLGNPM

SEQ ID NO: 317631 - protein, 9 aa, Influenza virus
GWLLGNPMC

SEQ ID NO: 317632 - protein, 9 aa, Influenza virus
WLLGNPMCD

SEQ ID NO: 317633 - protein, 9 aa, Influenza virus
LLGNPMCDE

SEQ ID NO: 317634 - protein, 9 aa, Influenza virus
LGNPMCDEF

SEQ ID NO: 317635 - protein, 9 aa, Influenza virus
VPEWSYIVE

SEQ ID NO: 317636 - protein, 9 aa, Influenza virus
PEWSYIVEK

SEQ ID NO: 317637 - protein, 9 aa, Influenza virus
ADHPPKVAW

SEQ ID NO: 317638 - protein, 9 aa, Influenza virus
NGRSSFFRN

SEQ ID NO: 317639 - protein, 9 aa, Influenza virus
LLVLWGIHH

SEQ ID NO: 317640 - protein, 9 aa, Influenza virus
YISVGTSTL

SEQ ID NO: 317641 - protein, 9 aa, Influenza virus
ISVGTSTLN

SEQ ID NO: 317642 - protein, 9 aa, Influenza virus
SVGTSTLNQ

SEQ ID NO: 317643 - protein, 9 aa, Influenza virus
VGTSTLNQR

SEQ ID NO: 317644 - protein, 9 aa, Influenza virus
GTSTLNQRL

SEQ ID NO: 317645 - protein, 9 aa, Influenza virus
FESNGNFIA

SEQ ID NO: 317646 - protein, 9 aa, Influenza virus
ESNGNFIAP

SEQ ID NO: 317647 - protein, 9 aa, Influenza virus
SNGNFIAPE

SEQ ID NO: 317648 - protein, 9 aa, Influenza virus
NGNFIAPEY

SEQ ID NO: 317649 - protein, 9 aa, Influenza virus
GNFIAPEYA

SEQ ID NO: 317650 - protein, 9 aa, Influenza virus
NFIAPEYAY

SEQ ID NO: 317651 - protein, 9 aa, Influenza virus
FIAPEYAYK

SEQ ID NO: 317652 - protein, 9 aa, Influenza virus
IAPEYAYKI

SEQ ID NO: 317653 - protein, 9 aa, Influenza virus
PSVKLPMGA

SEQ ID NO: 317654 - protein, 9 aa, Influenza virus
CQTPMGAIN

SEQ ID NO: 317655 - protein, 9 aa, Influenza virus
GAIGAIDSS

SEQ ID NO: 317656 - protein, 9 aa, Influenza virus
AIGAIDSSM

SEQ ID NO: 317657 - protein, 9 aa, Influenza virus
IGAIDSSMP

SEQ ID NO: 317658 - protein, 9 aa, Influenza virus
SSMPFHNIH

SEQ ID NO: 317659 - protein, 9 aa, Influenza virus
SMPFHNIHP

SEQ ID NO: 317660 - protein, 9 aa, Influenza virus
MPFHNIHPL

SEQ ID NO: 317661 - protein, 9 aa, Influenza virus
PFHNIHPLT

SEQ ID NO: 317662 - protein, 9 aa, Influenza virus
FHNIHPLTI

SEQ ID NO: 317663 - protein, 9 aa, Influenza virus
HNIHPLTIG

SEQ ID NO: 317664 - protein, 9 aa, Influenza virus
HPLTIGECP

SEQ ID NO: 317665 - protein, 9 aa, Influenza virus
PLTIGECPK

SEQ ID NO: 317666 - protein, 9 aa, Influenza virus
LTIGECPKY

SEQ ID NO: 317667 - protein, 9 aa, Influenza virus
TIGECPKYV

SEQ ID NO: 317668 - protein, 9 aa, Influenza virus
IGECPKYVK

SEQ ID NO: 317669 - protein, 9 aa, Influenza virus
GECPKYVKS

SEQ ID NO: 317670 - protein, 9 aa, Influenza virus
LVLATGLRN

SEQ ID NO: 317671 - protein, 9 aa, Influenza virus
REREGGRRR

SEQ ID NO: 317672 - protein, 9 aa, Influenza virus
EREGGRRRK

SEQ ID NO: 317673 - protein, 9 aa, Influenza virus
RRKKRGLFG

SEQ ID NO: 317674 - protein, 9 aa, Influenza virus
KKKRGLFGA

SEQ ID NO: 317675 - protein, 9 aa, Influenza virus
KRRKKRGLF

SEQ ID NO: 317676 - protein, 9 aa, Influenza virus
RRKKRGLFG

SEQ ID NO: 317677 - protein, 9 aa, Influenza virus
RQKRGLFGA

SEQ ID NO: 317678 - protein, 9 aa, Influenza virus
KKRGLFGAI

SEQ ID NO: 317679 - protein, 9 aa, Influenza virus
KRGLFGAIA

SEQ ID NO: 317680 - protein, 9 aa, Influenza virus
RRGLFGAIA

SEQ ID NO: 317681 - protein, 9 aa, Influenza virus
RGLFGAIAG

SEQ ID NO: 317682 - protein, 9 aa, Influenza virus
GLFGAIAGF

SEQ ID NO: 317683 - protein, 9 aa, Influenza virus
LFGAIAGFI

SEQ ID NO: 317684 - protein, 9 aa, Influenza virus
FGAIAGFIE

SEQ ID NO: 317685 - protein, 9 aa, Influenza virus
GAIAGFIEG

SEQ ID NO: 317686 - protein, 9 aa, Influenza virus
AIAGFIEGG

SEQ ID NO: 317687 - protein, 9 aa, Influenza virus
IAGFIEGGW

SEQ ID NO: 317688 - protein, 9 aa, Influenza virus
AGFIEGGWQ

SEQ ID NO: 317689 - protein, 9 aa, Influenza virus
GFIEGGWQG

SEQ ID NO: 317690 - protein, 9 aa, Influenza virus
FIEGGWQGM

SEQ ID NO: 317691 - protein, 9 aa, Influenza virus
IEGGWQGMV

SEQ ID NO: 317692 - protein, 9 aa, Influenza virus
EGGWQGMVD

SEQ ID NO: 317693 - protein, 9 aa, Influenza virus
GGWQGMVDG

SEQ ID NO: 317694 - protein, 9 aa, Influenza virus
GWQGMVDGW

SEQ ID NO: 317695 - protein, 9 aa, Influenza virus
WQGMVDGWY

SEQ ID NO: 317696 - protein, 9 aa, Influenza virus
QGMVDGWYG

SEQ ID NO: 317697 - protein, 9 aa, Influenza virus
GMVDGWYGY

SEQ ID NO: 317698 - protein, 9 aa, Influenza virus
MVDGWYGYH

SEQ ID NO: 317699 - protein, 9 aa, Influenza virus
VDGWYGYHH

SEQ ID NO: 317700 - protein, 9 aa, Influenza virus
DGWYGYHHS

SEQ ID NO: 317701 - protein, 9 aa, Influenza virus
GWYGYHHSN

SEQ ID NO: 317702 - protein, 9 aa, Influenza virus
NEQGSGYAA

SEQ ID NO: 317703 - protein, 9 aa, Influenza virus
EQGSGYAAD

SEQ ID NO: 317704 - protein, 9 aa, Influenza virus
QGSGYAADK

SEQ ID NO: 317705 - protein, 9 aa, Influenza virus
GSGYAADKE

SEQ ID NO: 317706 - protein, 9 aa, Influenza virus
SGYAADKES

SEQ ID NO: 317707 - protein, 9 aa, Influenza virus
GYAADKEST

SEQ ID NO: 317708 - protein, 9 aa, Influenza virus
YAADKESTQ

SEQ ID NO: 317709 - protein, 9 aa, Influenza virus
AADKESTQK

SEQ ID NO: 317710 - protein, 9 aa, Influenza virus
ADKESTQKA

SEQ ID NO: 317711 - protein, 9 aa, Influenza virus
ESTQKAIDG

SEQ ID NO: 317712 - protein, 9 aa, Influenza virus
DGVTNKVNS

SEQ ID NO: 317713 - protein, 9 aa, Influenza virus
GVTNKVNSI

SEQ ID NO: 317714 - protein, 9 aa, Influenza virus
VTNKVNSII

SEQ ID NO: 317715 - protein, 9 aa, Influenza virus
TNKVNSIID

SEQ ID NO: 317716 - protein, 9 aa, Influenza virus
KVNSIIDKM

SEQ ID NO: 317717 - protein, 9 aa, Influenza virus
VNSIIDKMN

SEQ ID NO: 317718 - protein, 9 aa, Influenza virus
NSIIDKMNT

SEQ ID NO: 317719 - protein, 9 aa, Influenza virus
IIDKMNTQF

SEQ ID NO: 317720 - protein, 9 aa, Influenza virus
LERRIENLN

SEQ ID NO: 317721 - protein, 9 aa, Influenza virus
LNKKMEDGF

SEQ ID NO: 317722 - protein, 9 aa, Influenza virus
GFLDVWTYN

SEQ ID NO: 317723 - protein, 9 aa, Influenza virus
FLDVWTYNA

SEQ ID NO: 317724 - protein, 9 aa, Influenza virus
LDVWTYNAE

SEQ ID NO: 317725 - protein, 9 aa, Influenza virus
DVWTYNAEL

SEQ ID NO: 317726 - protein, 9 aa, Influenza virus
VWTYNAELL

SEQ ID NO: 317727 - protein, 9 aa, Influenza virus
WTYNAELLV

SEQ ID NO: 317728 - protein, 9 aa, Influenza virus
TYNAELLVL

SEQ ID NO: 317729 - protein, 9 aa, Influenza virus
YNAELLVLM

SEQ ID NO: 317730 - protein, 9 aa, Influenza virus
NAELLVLME

SEQ ID NO: 317731 - protein, 9 aa, Influenza virus
AELLVLMEN

SEQ ID NO: 317732 - protein, 9 aa, Influenza virus
ELLVLMENE

SEQ ID NO: 317733 - protein, 9 aa, Influenza virus
LLVLMENER

SEQ ID NO: 317734 - protein, 9 aa, Influenza virus
LVLMENERT

SEQ ID NO: 317735 - protein, 9 aa, Influenza virus
VLMENERTL

SEQ ID NO: 317736 - protein, 9 aa, Influenza virus
LMENERTLD

SEQ ID NO: 317737 - protein, 9 aa, Influenza virus
MENERTLDF

SEQ ID NO: 317738 - protein, 9 aa, Influenza virus
ENERTLDFH

SEQ ID NO: 317739 - protein, 9 aa, Influenza virus
NERTLDFHD

SEQ ID NO: 317740 - protein, 9 aa, Influenza virus
ERTLDFHDS

SEQ ID NO: 317741 - protein, 9 aa, Influenza virus
RTLDFHDSN

SEQ ID NO: 317742 - protein, 9 aa, Influenza virus
TLDFHDSNV

SEQ ID NO: 317743 - protein, 9 aa, Influenza virus
LDFHDSNVK

SEQ ID NO: 317744 - protein, 9 aa, Influenza virus
DFHDSNVKN

SEQ ID NO: 317745 - protein, 9 aa, Influenza virus
FHDSNVKNL

SEQ ID NO: 317746 - protein, 9 aa, Influenza virus
HDSNVKNLY

SEQ ID NO: 317747 - protein, 9 aa, Influenza virus
DSNVKNLYD

SEQ ID NO: 317748 - protein, 9 aa, Influenza virus
SNVKNLYDK

SEQ ID NO: 317749 - protein, 9 aa, Influenza virus
NVKNLYDKV

SEQ ID NO: 317750 - protein, 9 aa, Influenza virus
VKNLYDKVR

SEQ ID NO: 317751 - protein, 9 aa, Influenza virus
NLYDKVRLQ

SEQ ID NO: 317752 - protein, 9 aa, Influenza virus
LYDKVRLQL

SEQ ID NO: 317753 - protein, 9 aa, Influenza virus
KVRLQLRDN

SEQ ID NO: 317754 - protein, 9 aa, Influenza virus
VRLQLRDNA

SEQ ID NO: 317755 - protein, 9 aa, Influenza virus
RLQLRDNAK

SEQ ID NO: 317756 - protein, 9 aa, Influenza virus
LQLRDNAKE

SEQ ID NO: 317757 - protein, 9 aa, Influenza virus
QLRDNAKEL

SEQ ID NO: 317758 - protein, 9 aa, Influenza virus
LRDNAKELG

SEQ ID NO: 317759 - protein, 9 aa, Influenza virus
RDNAKELGN

SEQ ID NO: 317760 - protein, 9 aa, Influenza virus
DNAKELGNG

SEQ ID NO: 317761 - protein, 9 aa, Influenza virus
NAKELGNGC

SEQ ID NO: 317762 - protein, 9 aa, Influenza virus
AKELGNGCF

SEQ ID NO: 317763 - protein, 9 aa, Influenza virus
KELGNGCFE

SEQ ID NO: 317764 - protein, 9 aa, Influenza virus
ELGNGCFEF

SEQ ID NO: 317765 - protein, 9 aa, Influenza virus
LGNGCFEFY

SEQ ID NO: 317766 - protein, 9 aa, Influenza virus
GNGCFEFYH

SEQ ID NO: 317767 - protein, 9 aa, Influenza virus
NGCFEFYHK

SEQ ID NO: 317768 - protein, 9 aa, Influenza virus
GCFEFYHKC

SEQ ID NO: 317769 - protein, 9 aa, Influenza virus
CFEFYHKCD

SEQ ID NO: 317770 - protein, 9 aa, Influenza virus
FEFYHKCDN

SEQ ID NO: 317771 - protein, 9 aa, Influenza virus
CMESVRNGT

SEQ ID NO: 317772 - protein, 9 aa, Influenza virus
MESVRNGTY

SEQ ID NO: 317773 - protein, 9 aa, Influenza virus
TYQILSIYS

SEQ ID NO: 317774 - protein, 9 aa, Influenza virus
YQILSIYST

SEQ ID NO: 317775 - protein, 9 aa, Influenza virus
QILSIYSTV

SEQ ID NO: 317776 - protein, 9 aa, Influenza virus
ILSIYSTVA

SEQ ID NO: 317777 - protein, 9 aa, Influenza virus
LSIYSTVAS

SEQ ID NO: 317778 - protein, 9 aa, Influenza virus
SIYSTVASS

SEQ ID NO: 317779 - protein, 9 aa, Influenza virus
IYSTVASSL

SEQ ID NO: 317780 - protein, 9 aa, Influenza virus
EFPSTGNHG

SEQ ID NO: 317781 - protein, 9 aa, Influenza virus
FPSTGNHGS

SEQ ID NO: 317782 - protein, 9 aa, Influenza virus
PSTGNHGSL

SEQ ID NO: 317783 - protein, 9 aa, Influenza virus
STGNHGSLV

SEQ ID NO: 317784 - protein, 9 aa, Influenza virus
TGNHGSLVL

SEQ ID NO: 317785 - protein, 9 aa, Influenza virus
GNHGSLVLS

SEQ ID NO: 317786 - protein, 9 aa, Influenza virus
NHGSLVLSL

SEQ ID NO: 317787 - protein, 9 aa, Influenza virus
HGSLVLSLW

SEQ ID NO: 317788 - protein, 9 aa, Influenza virus
AGLSLWMCS

SEQ ID NO: 317789 - protein, 9 aa, Influenza virus
GLSLWMCSN

SEQ ID NO: 317790 - protein, 9 aa, Influenza virus
LSLWMCSNG

SEQ ID NO: 317791 - protein, 9 aa, Influenza virus
SLWMCSNGS

SEQ ID NO: 317792 - protein, 9 aa, Influenza virus
LWMCSNGSL

SEQ ID NO: 317793 - protein, 9 aa, Influenza virus
WMCSNGSLQ

SEQ ID NO: 317794 - protein, 9 aa, Influenza virus
MCSNGSLQC

SEQ ID NO: 317795 - protein, 9 aa, Influenza virus
CSNGSLQCR

SEQ ID NO: 317796 - protein, 9 aa, Influenza virus
SNGSLQCRI

SEQ ID NO: 317797 - protein, 9 aa, Influenza virus
NGSLQCRIC

SEQ ID NO: 317798 - protein, 9 aa, Influenza virus
GSLQCRICI

SEQ ID NO: 317799 - protein, 9 aa, Influenza virus
FKFVSSDCS

SEQ ID NO: 317800 - protein, 9 aa, Influenza virus
RFVNSDCSK

SEQ ID NO: 317801 - protein, 9 aa, Influenza virus
SVKMEKIVL

SEQ ID NO: 317802 - protein, 9 aa, Influenza virus
VKMEKIVLL

SEQ ID NO: 317803 - protein, 9 aa, Influenza virus
KMEKIVLLL

SEQ ID NO: 317804 - protein, 9 aa, Influenza virus
SDQICIGYH

SEQ ID NO: 317805 - protein, 9 aa, Influenza virus
DQICIGYHA

SEQ ID NO: 317806 - protein, 9 aa, Influenza virus
QICIGYHAN

SEQ ID NO: 317807 - protein, 9 aa, Influenza virus
ICIGYHANN

SEQ ID NO: 317808 - protein, 9 aa, Influenza virus
CIGYHANNS

SEQ ID NO: 317809 - protein, 9 aa, Influenza virus
IGYHANNST

SEQ ID NO: 317810 - protein, 9 aa, Influenza virus
GYHANNSTE

SEQ ID NO: 317811 - protein, 9 aa, Influenza virus
YHANNSTEQ

SEQ ID NO: 317812 - protein, 9 aa, Influenza virus
HANNSTEQV

SEQ ID NO: 317813 - protein, 9 aa, Influenza virus
ANNSTEQVD

SEQ ID NO: 317814 - protein, 9 aa, Influenza virus
NNSTEQVDT

SEQ ID NO: 317815 - protein, 9 aa, Influenza virus
NSTEQVDTI

SEQ ID NO: 317816 - protein, 9 aa, Influenza virus
STEQVDTIM

SEQ ID NO: 317817 - protein, 9 aa, Influenza virus
TEQVDTIME

SEQ ID NO: 317818 - protein, 9 aa, Influenza virus
EQVDTIMEK

SEQ ID NO: 317819 - protein, 9 aa, Influenza virus
QVDTIMEKN

SEQ ID NO: 317820 - protein, 9 aa, Influenza virus
VDTIMEKNV

SEQ ID NO: 317821 - protein, 9 aa, Influenza virus
DTIMEKNVT

SEQ ID NO: 317822 - protein, 9 aa, Influenza virus
TIMEKNVTV

SEQ ID NO: 317823 - protein, 9 aa, Influenza virus
IMEKNVTVT

SEQ ID NO: 317824 - protein, 9 aa, Influenza virus
MEKNVTVTH

SEQ ID NO: 317825 - protein, 9 aa, Influenza virus
EKNVTVTHA

SEQ ID NO: 317826 - protein, 9 aa, Influenza virus
KNVTVTHAQ

SEQ ID NO: 317827 - protein, 9 aa, Influenza virus
NVTVTHAQD

SEQ ID NO: 317828 - protein, 9 aa, Influenza virus
VTVTHAQDI

SEQ ID NO: 317829 - protein, 9 aa, Influenza virus
TVTHAQDIL

SEQ ID NO: 317830 - protein, 9 aa, Influenza virus
VTHAQDILE

SEQ ID NO: 317831 - protein, 9 aa, Influenza virus
THAQDILEK

SEQ ID NO: 317832 - protein, 9 aa, Influenza virus
DILEKTHNG

SEQ ID NO: 317833 - protein, 9 aa, Influenza virus
LDGVKPLIL

SEQ ID NO: 317834 - protein, 9 aa, Influenza virus
GVKPLILRD

SEQ ID NO: 317835 - protein, 9 aa, Influenza virus
VKPLILRDC

SEQ ID NO: 317836 - protein, 9 aa, Influenza virus
KPLILRDCS

SEQ ID NO: 317837 - protein, 9 aa, Influenza virus
PLILRDCSV

SEQ ID NO: 317838 - protein, 9 aa, Influenza virus
LILRDCSVA

SEQ ID NO: 317839 - protein, 9 aa, Influenza virus
ILRDCSVAG

SEQ ID NO: 317840 - protein, 9 aa, Influenza virus
LRDCSVAGW

SEQ ID NO: 317841 - protein, 9 aa, Influenza virus
RDCSVAGWL

SEQ ID NO: 317842 - protein, 9 aa, Influenza virus
DCSVAGWLL

SEQ ID NO: 317843 - protein, 9 aa, Influenza virus
CSVAGWLLG

SEQ ID NO: 317844 - protein, 9 aa, Influenza virus
SVAGWLLGN

SEQ ID NO: 317845 - protein, 9 aa, Influenza virus
VAGWLLGNP

SEQ ID NO: 317846 - protein, 9 aa, Influenza virus
AGWLLGNPM

SEQ ID NO: 317847 - protein, 9 aa, Influenza virus
GWLLGNPMC

SEQ ID NO: 317848 - protein, 9 aa, Influenza virus
WLLGNPMCD

SEQ ID NO: 317849 - protein, 9 aa, Influenza virus
LLGNPMCDE

SEQ ID NO: 317850 - protein, 9 aa, Influenza virus
LGNPMCDEF

SEQ ID NO: 317851 - protein, 9 aa, Influenza virus
NVPEWSYIV

SEQ ID NO: 317852 - protein, 9 aa, Influenza virus
VPEWSYIVE

SEQ ID NO: 317853 - protein, 9 aa, Influenza virus
PEWSYIVEK

SEQ ID NO: 317854 - protein, 9 aa, Influenza virus
FNDYEELKH

SEQ ID NO: 317855 - protein, 9 aa, Influenza virus
NDYEELKHL

SEQ ID NO: 317856 - protein, 9 aa, Influenza virus
DYEELKHLL

SEQ ID NO: 317857 - protein, 9 aa, Influenza virus
YEELKHLLS

SEQ ID NO: 317858 - protein, 9 aa, Influenza virus
EELKHLLSR

SEQ ID NO: 317859 - protein, 9 aa, Influenza virus
ELKHLLSRI

SEQ ID NO: 317860 - protein, 9 aa, Influenza virus
ADHPPKVAW

SEQ ID NO: 317861 - protein, 9 aa, Influenza virus
SFFRNVVWL

SEQ ID NO: 317862 - protein, 9 aa, Influenza virus
LLVLWGIHH

SEQ ID NO: 317863 - protein, 9 aa, Influenza virus
TYISVGTST

SEQ ID NO: 317864 - protein, 9 aa, Influenza virus
YISVGTSTL

SEQ ID NO: 317865 - protein, 9 aa, Influenza virus
ISVGTSTLN

SEQ ID NO: 317866 - protein, 9 aa, Influenza virus
SVGTSTLNQ

SEQ ID NO: 317867 - protein, 9 aa, Influenza virus
VGTSTLNQR

SEQ ID NO: 317868 - protein, 9 aa, Influenza virus
GTSTLNQRL

SEQ ID NO: 317869 - protein, 9 aa, Influenza virus
INFESNGNF

SEQ ID NO: 317870 - protein, 9 aa, Influenza virus
NFESNGNFI

SEQ ID NO: 317871 - protein, 9 aa, Influenza virus
FESNGNFIA

SEQ ID NO: 317872 - protein, 9 aa, Influenza virus
ESNGNFIAP

SEQ ID NO: 317873 - protein, 9 aa, Influenza virus
SNGNFIAPE

SEQ ID NO: 317874 - protein, 9 aa, Influenza virus
NGNFIAPEY

SEQ ID NO: 317875 - protein, 9 aa, Influenza virus
GNFIAPEYA

SEQ ID NO: 317876 - protein, 9 aa, Influenza virus
NFIAPEYAY

SEQ ID NO: 317877 - protein, 9 aa, Influenza virus
FIAPEYAYK

SEQ ID NO: 317878 - protein, 9 aa, Influenza virus
IAPEYAYKI

SEQ ID NO: 317879 - protein, 9 aa, Influenza virus
PEYAYKIVK

SEQ ID NO: 317880 - protein, 9 aa, Influenza virus
AYKIVKKGD

SEQ ID NO: 317881 - protein, 9 aa, Influenza virus
YKIVKKGDS

SEQ ID NO: 317882 - protein, 9 aa, Influenza virus
PSVKLPMGA

SEQ ID NO: 317883 - protein, 9 aa, Influenza virus
CQTPIGAIN

SEQ ID NO: 317884 - protein, 9 aa, Influenza virus
QTPIGAINS

SEQ ID NO: 317885 - protein, 9 aa, Influenza virus
TPIGAINSS

SEQ ID NO: 317886 - protein, 9 aa, Influenza virus
IGAINSSMP

SEQ ID NO: 317887 - protein, 9 aa, Influenza virus
GAIGAIDSS

SEQ ID NO: 317888 - protein, 9 aa, Influenza virus
AIGAIDSSM

SEQ ID NO: 317889 - protein, 9 aa, Influenza virus
IGAIDSSMP

SEQ ID NO: 317890 - protein, 9 aa, Influenza virus
GAINSSMPF

SEQ ID NO: 317891 - protein, 9 aa, Influenza virus
AINSSMPFH

SEQ ID NO: 317892 - protein, 9 aa, Influenza virus
INSSMPFHN

SEQ ID NO: 317893 - protein, 9 aa, Influenza virus
NSSMPFHNI

SEQ ID NO: 317894 - protein, 9 aa, Influenza virus
SSMPFHNIH

SEQ ID NO: 317895 - protein, 9 aa, Influenza virus
SMPFHNIHP

SEQ ID NO: 317896 - protein, 9 aa, Influenza virus
MPFHNIHPL

SEQ ID NO: 317897 - protein, 9 aa, Influenza virus
PFHNIHPLT

SEQ ID NO: 317898 - protein, 9 aa, Influenza virus
FHNIHPLTI

SEQ ID NO: 317899 - protein, 9 aa, Influenza virus
HNIHPLTIG

SEQ ID NO: 317900 - protein, 9 aa, Influenza virus
NIHPLTIGE

SEQ ID NO: 317901 - protein, 9 aa, Influenza virus
IHPLTIGEC

SEQ ID NO: 317902 - protein, 9 aa, Influenza virus
HPLTIGECP

SEQ ID NO: 317903 - protein, 9 aa, Influenza virus
PLTIGECPK

SEQ ID NO: 317904 - protein, 9 aa, Influenza virus
LTIGECPKY

SEQ ID NO: 317905 - protein, 9 aa, Influenza virus
TIGECPKYV

SEQ ID NO: 317906 - protein, 9 aa, Influenza virus
IGECPKYVK

SEQ ID NO: 317907 - protein, 9 aa, Influenza virus
GECPKYVKS

SEQ ID NO: 317908 - protein, 9 aa, Influenza virus
ECPKYVKSN

SEQ ID NO: 317909 - protein, 9 aa, Influenza virus
RLVLATGLR

SEQ ID NO: 317910 - protein, 9 aa, Influenza virus
LVLATGLRN

SEQ ID NO: 317911 - protein, 9 aa, Influenza virus
REREGGRRR

SEQ ID NO: 317912 - protein, 9 aa, Influenza virus
EREGGRRRK

SEQ ID NO: 317913 - protein, 9 aa, Influenza virus
RKKRGLFGA

SEQ ID NO: 317914 - protein, 9 aa, Influenza virus
KKRGLFGAI

SEQ ID NO: 317915 - protein, 9 aa, Influenza virus
KKRGLFGAI

SEQ ID NO: 317916 - protein, 9 aa, Influenza virus
KRGLFGAIA

SEQ ID NO: 317917 - protein, 9 aa, Influenza virus
RGLFGAIAG

SEQ ID NO: 317918 - protein, 9 aa, Influenza virus
GLFGAIAGF

SEQ ID NO: 317919 - protein, 9 aa, Influenza virus
LFGAIAGFI

SEQ ID NO: 317920 - protein, 9 aa, Influenza virus
FGAIAGFIE

SEQ ID NO: 317921 - protein, 9 aa, Influenza virus
GAIAGFIEG

SEQ ID NO: 317922 - protein, 9 aa, Influenza virus
AIAGFIEGG

SEQ ID NO: 317923 - protein, 9 aa, Influenza virus
IAGFIEGGW

SEQ ID NO: 317924 - protein, 9 aa, Influenza virus
AGFIEGGWQ

SEQ ID NO: 317925 - protein, 9 aa, Influenza virus
GFIEGGWQG

SEQ ID NO: 317926 - protein, 9 aa, Influenza virus
FIEGGWQGM

SEQ ID NO: 317927 - protein, 9 aa, Influenza virus
IEGGWQGMV

SEQ ID NO: 317928 - protein, 9 aa, Influenza virus
EGGWQGMVD

SEQ ID NO: 317929 - protein, 9 aa, Influenza virus
GGWQGMVDG

SEQ ID NO: 317930 - protein, 9 aa, Influenza virus
GWQGMVDGW

SEQ ID NO: 317931 - protein, 9 aa, Influenza virus
WQGMVDGWY

SEQ ID NO: 317932 - protein, 9 aa, Influenza virus
QGMVDGWYG

SEQ ID NO: 317933 - protein, 9 aa, Influenza virus
GMVDGWYGY

SEQ ID NO: 317934 - protein, 9 aa, Influenza virus
MVDGWYGYH

SEQ ID NO: 317935 - protein, 9 aa, Influenza virus
VDGWYGYHH

SEQ ID NO: 317936 - protein, 9 aa, Influenza virus
DGWYGYHHS

SEQ ID NO: 317937 - protein, 9 aa, Influenza virus
GWYGYHHSN

SEQ ID NO: 317938 - protein, 9 aa, Influenza virus
WYGYHHSNE

SEQ ID NO: 317939 - protein, 9 aa, Influenza virus
GYHHSNEQG

SEQ ID NO: 317940 - protein, 9 aa, Influenza virus
HHSNEQGSG

SEQ ID NO: 317941 - protein, 9 aa, Influenza virus
HSNEQGSGY

SEQ ID NO: 317942 - protein, 9 aa, Influenza virus
SNEQGSGYA

SEQ ID NO: 317943 - protein, 9 aa, Influenza virus
NEQGSGYAA

SEQ ID NO: 317944 - protein, 9 aa, Influenza virus
EQGSGYAAD

SEQ ID NO: 317945 - protein, 9 aa, Influenza virus
QGSGYAADK

SEQ ID NO: 317946 - protein, 9 aa, Influenza virus
GSGYAADKE

SEQ ID NO: 317947 - protein, 9 aa, Influenza virus
SGYAADKES

SEQ ID NO: 317948 - protein, 9 aa, Influenza virus
GYAADKEST

SEQ ID NO: 317949 - protein, 9 aa, Influenza virus
YAADKESTQ

SEQ ID NO: 317950 - protein, 9 aa, Influenza virus
AADKESTQK

SEQ ID NO: 317951 - protein, 9 aa, Influenza virus
ADKESTQKA

SEQ ID NO: 317952 - protein, 9 aa, Influenza virus
ESTQKAIDG

SEQ ID NO: 317953 - protein, 9 aa, Influenza virus
STQKAIDGV

SEQ ID NO: 317954 - protein, 9 aa, Influenza virus
TQKAIDGVT

SEQ ID NO: 317955 - protein, 9 aa, Influenza virus
QKAIDGVTN

SEQ ID NO: 317956 - protein, 9 aa, Influenza virus
KAIDGVTNK

SEQ ID NO: 317957 - protein, 9 aa, Influenza virus
AIDGVTNKV

SEQ ID NO: 317958 - protein, 9 aa, Influenza virus
IDGVTNKVN

SEQ ID NO: 317959 - protein, 9 aa, Influenza virus
DGVTNKVNS

SEQ ID NO: 317960 - protein, 9 aa, Influenza virus
GVTNKVNSI

SEQ ID NO: 317961 - protein, 9 aa, Influenza virus
VTNKVNSII

SEQ ID NO: 317962 - protein, 9 aa, Influenza virus
TNKVNSIID

SEQ ID NO: 317963 - protein, 9 aa, Influenza virus
NKVNSIIDK

SEQ ID NO: 317964 - protein, 9 aa, Influenza virus
KVNSIIDKM

SEQ ID NO: 317965 - protein, 9 aa, Influenza virus
VNSIIDKMN

SEQ ID NO: 317966 - protein, 9 aa, Influenza virus
NSIIDKMNT

SEQ ID NO: 317967 - protein, 9 aa, Influenza virus
SIIDKMNTQ

SEQ ID NO: 317968 - protein, 9 aa, Influenza virus
IIDKMNTQF

SEQ ID NO: 317969 - protein, 9 aa, Influenza virus
IDKMNTQFE

SEQ ID NO: 317970 - protein, 9 aa, Influenza virus
DKMNTQFEA

SEQ ID NO: 317971 - protein, 9 aa, Influenza virus
KMNTQFEAV

SEQ ID NO: 317972 - protein, 9 aa, Influenza virus
MNTQFEAVG

SEQ ID NO: 317973 - protein, 9 aa, Influenza virus
NTQFEAVGR

SEQ ID NO: 317974 - protein, 9 aa, Influenza virus
TQFEAVGRE

SEQ ID NO: 317975 - protein, 9 aa, Influenza virus
QFEAVGREF

SEQ ID NO: 317976 - protein, 9 aa, Influenza virus
FEAVGREFN

SEQ ID NO: 317977 - protein, 9 aa, Influenza virus
LERRIENLN

SEQ ID NO: 317978 - protein, 9 aa, Influenza virus
ERRIENLNK

SEQ ID NO: 317979 - protein, 9 aa, Influenza virus
RRIENLNKK

SEQ ID NO: 317980 - protein, 9 aa, Influenza virus
RIENLNKKM

SEQ ID NO: 317981 - protein, 9 aa, Influenza virus
IENLNKKME

SEQ ID NO: 317982 - protein, 9 aa, Influenza virus
ENLNKKMED

SEQ ID NO: 317983 - protein, 9 aa, Influenza virus
NLNKKMEDG

SEQ ID NO: 317984 - protein, 9 aa, Influenza virus
LNKKMEDGF

SEQ ID NO: 317985 - protein, 9 aa, Influenza virus
NKKMEDGFL

SEQ ID NO: 317986 - protein, 9 aa, Influenza virus
KKMEDGFLD

SEQ ID NO: 317987 - protein, 9 aa, Influenza virus
KMEDGFLDV

SEQ ID NO: 317988 - protein, 9 aa, Influenza virus
MEDGFLDVW

SEQ ID NO: 317989 - protein, 9 aa, Influenza virus
EDGFLDVWT

SEQ ID NO: 317990 - protein, 9 aa, Influenza virus
DGFLDVWTY

SEQ ID NO: 317991 - protein, 9 aa, Influenza virus
GFLDVWTYN

SEQ ID NO: 317992 - protein, 9 aa, Influenza virus
FLDVWTYNA

SEQ ID NO: 317993 - protein, 9 aa, Influenza virus
LDVWTYNAE

SEQ ID NO: 317994 - protein, 9 aa, Influenza virus
DVWTYNAEL

SEQ ID NO: 317995 - protein, 9 aa, Influenza virus
VWTYNAELL

SEQ ID NO: 317996 - protein, 9 aa, Influenza virus
WTYNAELLV

SEQ ID NO: 317997 - protein, 9 aa, Influenza virus
TYNAELLVL

SEQ ID NO: 317998 - protein, 9 aa, Influenza virus
YNAELLVLM

SEQ ID NO: 317999 - protein, 9 aa, Influenza virus
NAELLVLME

SEQ ID NO: 318000 - protein, 9 aa, Influenza virus
AELLVLMEN

SEQ ID NO: 318001 - protein, 9 aa, Influenza virus
ELLVLMENE

SEQ ID NO: 318002 - protein, 9 aa, Influenza virus
LLVLMENER

SEQ ID NO: 318003 - protein, 9 aa, Influenza virus
LVLMENERT

SEQ ID NO: 318004 - protein, 9 aa, Influenza virus
VLMENERTL

SEQ ID NO: 318005 - protein, 9 aa, Influenza virus
LMENERTLD

SEQ ID NO: 318006 - protein, 9 aa, Influenza virus
MENERTLDF

SEQ ID NO: 318007 - protein, 9 aa, Influenza virus
ENERTLDFH

SEQ ID NO: 318008 - protein, 9 aa, Influenza virus
NERTLDFHD

SEQ ID NO: 318009 - protein, 9 aa, Influenza virus
ERTLDFHDS

SEQ ID NO: 318010 - protein, 9 aa, Influenza virus
RTLDFHDSN

SEQ ID NO: 318011 - protein, 9 aa, Influenza virus
TLDFHDSNV

SEQ ID NO: 318012 - protein, 9 aa, Influenza virus
LDFHDSNVK

SEQ ID NO: 318013 - protein, 9 aa, Influenza virus
DFHDSNVKN

SEQ ID NO: 318014 - protein, 9 aa, Influenza virus
FHDSNVKNL

SEQ ID NO: 318015 - protein, 9 aa, Influenza virus
HDSNVKNLY

SEQ ID NO: 318016 - protein, 9 aa, Influenza virus
DSNVKNLYD

SEQ ID NO: 318017 - protein, 9 aa, Influenza virus
SNVKNLYDK

SEQ ID NO: 318018 - protein, 9 aa, Influenza virus
NVKNLYDKV

SEQ ID NO: 318019 - protein, 9 aa, Influenza virus
VKNLYDKVR

SEQ ID NO: 318020 - protein, 9 aa, Influenza virus
KNLYDKVRL

SEQ ID NO: 318021 - protein, 9 aa, Influenza virus
NLYDKVRLQ

SEQ ID NO: 318022 - protein, 9 aa, Influenza virus
LYDKVRLQL

SEQ ID NO: 318023 - protein, 9 aa, Influenza virus
YDKVRLQLR

SEQ ID NO: 318024 - protein, 9 aa, Influenza virus
DKVRLQLRD

SEQ ID NO: 318025 - protein, 9 aa, Influenza virus
KVRLQLRDN

SEQ ID NO: 318026 - protein, 9 aa, Influenza virus
VRLQLRDNA

SEQ ID NO: 318027 - protein, 9 aa, Influenza virus
RLQLRDNAK

SEQ ID NO: 318028 - protein, 9 aa, Influenza virus
LQLRDNAKE

SEQ ID NO: 318029 - protein, 9 aa, Influenza virus
QLRDNAKEL

SEQ ID NO: 318030 - protein, 9 aa, Influenza virus
LRDNAKELG

SEQ ID NO: 318031 - protein, 9 aa, Influenza virus
RDNAKELGN

SEQ ID NO: 318032 - protein, 9 aa, Influenza virus
DNAKELGNG

SEQ ID NO: 318033 - protein, 9 aa, Influenza virus
NAKELGNGC

SEQ ID NO: 318034 - protein, 9 aa, Influenza virus
AKELGNGCF

SEQ ID NO: 318035 - protein, 9 aa, Influenza virus
KELGNGCFE

SEQ ID NO: 318036 - protein, 9 aa, Influenza virus
ELGNGCFEF

SEQ ID NO: 318037 - protein, 9 aa, Influenza virus
LGNGCFEFY

SEQ ID NO: 318038 - protein, 9 aa, Influenza virus
GNGCFEFYH

SEQ ID NO: 318039 - protein, 9 aa, Influenza virus
NGCFEFYHK

SEQ ID NO: 318040 - protein, 9 aa, Influenza virus
GCFEFYHKC

SEQ ID NO: 318041 - protein, 9 aa, Influenza virus
CFEFYHKCD

SEQ ID NO: 318042 - protein, 9 aa, Influenza virus
FEFYHKCDN

SEQ ID NO: 318043 - protein, 9 aa, Influenza virus
CMESVRNGT

SEQ ID NO: 318044 - protein, 9 aa, Influenza virus
MESVRNGTY

SEQ ID NO: 318045 - protein, 9 aa, Influenza virus
SVRNGTYDY

SEQ ID NO: 318046 - protein, 9 aa, Influenza virus
NGTYDYPQY

SEQ ID NO: 318047 - protein, 9 aa, Influenza virus
GTYQILSIY

SEQ ID NO: 318048 - protein, 9 aa, Influenza virus
TYQILSIYS

SEQ ID NO: 318049 - protein, 9 aa, Influenza virus
YQILSIYST

SEQ ID NO: 318050 - protein, 9 aa, Influenza virus
QILSIYSTV

SEQ ID NO: 318051 - protein, 9 aa, Influenza virus
ILSIYSTVA

SEQ ID NO: 318052 - protein, 9 aa, Influenza virus
LSIYSTVAS

SEQ ID NO: 318053 - protein, 9 aa, Influenza virus
SIYSTVASS

SEQ ID NO: 318054 - protein, 9 aa, Influenza virus
IYSTVASSL

SEQ ID NO: 318055 - protein, 9 aa, Influenza virus
YSTVASSLA

SEQ ID NO: 318056 - protein, 9 aa, Influenza virus
STVASSLAL

SEQ ID NO: 318057 - protein, 9 aa, Influenza virus
TVASSLALA

SEQ ID NO: 318058 - protein, 9 aa, Influenza virus
VASSLALAI

SEQ ID NO: 318059 - protein, 9 aa, Influenza virus
ASSLALAIM

SEQ ID NO: 318060 - protein, 9 aa, Influenza virus
EFPSTGNHG

SEQ ID NO: 318061 - protein, 9 aa, Influenza virus
FPSTGNHGS

SEQ ID NO: 318062 - protein, 9 aa, Influenza virus
PSTGNHGSL

SEQ ID NO: 318063 - protein, 9 aa, Influenza virus
STGNHGSLV

SEQ ID NO: 318064 - protein, 9 aa, Influenza virus
TGNHGSLVL

SEQ ID NO: 318065 - protein, 9 aa, Influenza virus
GNHGSLVLS

SEQ ID NO: 318066 - protein, 9 aa, Influenza virus
NHGSLVLSL

SEQ ID NO: 318067 - protein, 9 aa, Influenza virus
HGSLVLSLW

SEQ ID NO: 318068 - protein, 9 aa, Influenza virus
AGLSLWMCS

SEQ ID NO: 318069 - protein, 9 aa, Influenza virus
GLSLWMCSN

SEQ ID NO: 318070 - protein, 9 aa, Influenza virus
LSLWMCSNG

SEQ ID NO: 318071 - protein, 9 aa, Influenza virus
SLWMCSNGS

SEQ ID NO: 318072 - protein, 9 aa, Influenza virus
LWMCSNGSL

SEQ ID NO: 318073 - protein, 9 aa, Influenza virus
WMCSNGSLQ

SEQ ID NO: 318074 - protein, 9 aa, Influenza virus
MCSNGSLQC

SEQ ID NO: 318075 - protein, 9 aa, Influenza virus
CSNGSLQCR

SEQ ID NO: 318076 - protein, 9 aa, Influenza virus
SNGSLQCRI

SEQ ID NO: 318077 - protein, 9 aa, Influenza virus
NGSLQCRIC

SEQ ID NO: 318078 - protein, 9 aa, Influenza virus
GSLQCRICI

SEQ ID NO: 318079 - protein, 9 aa, Influenza virus
FKFVSSDCS

SEQ ID NO: 318080 - protein, 9 aa, Influenza virus
RFVNSDCSK

SEQ ID NO: 318081 - protein, 9 aa, Influenza virus
LVFREQKQE

SEQ ID NO: 318082 - protein, 9 aa, Influenza virus
GLREQKQEF

SEQ ID NO: 318083 - protein, 9 aa, Influenza virus
LREQKQEFK

SEQ ID NO: 318084 - protein, 9 aa, Influenza virus
REQKQEFKM

SEQ ID NO: 318085 - protein, 9 aa, Influenza virus
EQKQEFKMN

SEQ ID NO: 318086 - protein, 9 aa, Influenza virus
QKQEFKMNP

SEQ ID NO: 318087 - protein, 9 aa, Influenza virus
KQEFKMNPN

SEQ ID NO: 318088 - protein, 9 aa, Influenza virus
QEFKMNPNK

SEQ ID NO: 318089 - protein, 9 aa, Influenza virus
EFKMNPNKK

SEQ ID NO: 318090 - protein, 9 aa, Influenza virus
FKMNPNKKI

SEQ ID NO: 318091 - protein, 9 aa, Influenza virus
KMNPNKKII

SEQ ID NO: 318092 - protein, 9 aa, Influenza virus
NRDITIGSI

SEQ ID NO: 318093 - protein, 9 aa, Influenza virus
EIITIGSIC

SEQ ID NO: 318094 - protein, 9 aa, Influenza virus
IITIGSICM

SEQ ID NO: 318095 - protein, 9 aa, Influenza virus
NLDLNMGQP

SEQ ID NO: 318096 - protein, 9 aa, Influenza virus
LDLNMGQPF

SEQ ID NO: 318097 - protein, 9 aa, Influenza virus
DLNMGQPFY

SEQ ID NO: 318098 - protein, 9 aa, Influenza virus
LNMGQPFYS

SEQ ID NO: 318099 - protein, 9 aa, Influenza virus
GPSHSIHTG

SEQ ID NO: 318100 - protein, 9 aa, Influenza virus
YENNTWVNQ

SEQ ID NO: 318101 - protein, 9 aa, Influenza virus
ENNTWVNQT

SEQ ID NO: 318102 - protein, 9 aa, Influenza virus
NNTWVNQTY

SEQ ID NO: 318103 - protein, 9 aa, Influenza virus
GWAVYSKDN

SEQ ID NO: 318104 - protein, 9 aa, Influenza virus
YSKDNSIRI

SEQ ID NO: 318105 - protein, 9 aa, Influenza virus
SKDNSIRIG

SEQ ID NO: 318106 - protein, 9 aa, Influenza virus
KDNSIRIGS

SEQ ID NO: 318107 - protein, 9 aa, Influenza virus
DNSIRIGSK

SEQ ID NO: 318108 - protein, 9 aa, Influenza virus
NSIRIGSKG

SEQ ID NO: 318109 - protein, 9 aa, Influenza virus
SIRIGSKGD

SEQ ID NO: 318110 - protein, 9 aa, Influenza virus
IRIGSKGDV

SEQ ID NO: 318111 - protein, 9 aa, Influenza virus
RIGSKGDVF

SEQ ID NO: 318112 - protein, 9 aa, Influenza virus
IGSKGDVFV

SEQ ID NO: 318113 - protein, 9 aa, Influenza virus
GDVFVIREP

SEQ ID NO: 318114 - protein, 9 aa, Influenza virus
DVFVIREPF

SEQ ID NO: 318115 - protein, 9 aa, Influenza virus
FVIREPFIS

SEQ ID NO: 318116 - protein, 9 aa, Influenza virus
IREPFISCS

SEQ ID NO: 318117 - protein, 9 aa, Influenza virus
REPFISCSH

SEQ ID NO: 318118 - protein, 9 aa, Influenza virus
EPFISCSHL

SEQ ID NO: 318119 - protein, 9 aa, Influenza virus
PFISCSHLE

SEQ ID NO: 318120 - protein, 9 aa, Influenza virus
FISCSHLEC

SEQ ID NO: 318121 - protein, 9 aa, Influenza virus
ISCSHLECR

SEQ ID NO: 318122 - protein, 9 aa, Influenza virus
SCSHLECRT

SEQ ID NO: 318123 - protein, 9 aa, Influenza virus
CSHLECRTF

SEQ ID NO: 318124 - protein, 9 aa, Influenza virus
SHLECRTFF

SEQ ID NO: 318125 - protein, 9 aa, Influenza virus
HLECRTFFL

SEQ ID NO: 318126 - protein, 9 aa, Influenza virus
LECRTFFLT

SEQ ID NO: 318127 - protein, 9 aa, Influenza virus
ECRTFFLTQ

SEQ ID NO: 318128 - protein, 9 aa, Influenza virus
CRTFFLTQG

SEQ ID NO: 318129 - protein, 9 aa, Influenza virus
RTFFLTQGA

SEQ ID NO: 318130 - protein, 9 aa, Influenza virus
TFFLTQGAL

SEQ ID NO: 318131 - protein, 9 aa, Influenza virus
FFLTQGALL

SEQ ID NO: 318132 - protein, 9 aa, Influenza virus
FLTQGALLN

SEQ ID NO: 318133 - protein, 9 aa, Influenza virus
LTQGALLND

SEQ ID NO: 318134 - protein, 9 aa, Influenza virus
TQGALLNDK

SEQ ID NO: 318135 - protein, 9 aa, Influenza virus
QGALLNDKH

SEQ ID NO: 318136 - protein, 9 aa, Influenza virus
GALLNDKHS

SEQ ID NO: 318137 - protein, 9 aa, Influenza virus
ALLNDKHSN

SEQ ID NO: 318138 - protein, 9 aa, Influenza virus
LLNDKHSNG

SEQ ID NO: 318139 - protein, 9 aa, Influenza virus
LNDKHSNGT

SEQ ID NO: 318140 - protein, 9 aa, Influenza virus
NDKHSNGTV

SEQ ID NO: 318141 - protein, 9 aa, Influenza virus
KHSNGTVKD

SEQ ID NO: 318142 - protein, 9 aa, Influenza virus
HSNGTVKDR

SEQ ID NO: 318143 - protein, 9 aa, Influenza virus
SNGTVKDRS

SEQ ID NO: 318144 - protein, 9 aa, Influenza virus
NGTVKDRSP

SEQ ID NO: 318145 - protein, 9 aa, Influenza virus
KDRSPHRTL

SEQ ID NO: 318146 - protein, 9 aa, Influenza virus
DRSPHRTLM

SEQ ID NO: 318147 - protein, 9 aa, Influenza virus
RSPHRTLMS

SEQ ID NO: 318148 - protein, 9 aa, Influenza virus
SPHRTLMSC

SEQ ID NO: 318149 - protein, 9 aa, Influenza virus
PHRTLMSCP

SEQ ID NO: 318150 - protein, 9 aa, Influenza virus
RTLMSCPVG

SEQ ID NO: 318151 - protein, 9 aa, Influenza virus
PVGEAPSPY

SEQ ID NO: 318152 - protein, 9 aa, Influenza virus
GEAPSPYNS

SEQ ID NO: 318153 - protein, 9 aa, Influenza virus
EAPSPYNSR

SEQ ID NO: 318154 - protein, 9 aa, Influenza virus
APSPYNSRF

SEQ ID NO: 318155 - protein, 9 aa, Influenza virus
PSPYNSRFE

SEQ ID NO: 318156 - protein, 9 aa, Influenza virus
SPYNSRFES

SEQ ID NO: 318157 - protein, 9 aa, Influenza virus
PYNSRFESV

SEQ ID NO: 318158 - protein, 9 aa, Influenza virus
YNSRFESVA

SEQ ID NO: 318159 - protein, 9 aa, Influenza virus
NSRFESVAW

SEQ ID NO: 318160 - protein, 9 aa, Influenza virus
SRFESVAWS

SEQ ID NO: 318161 - protein, 9 aa, Influenza virus
RFESVAWSA

SEQ ID NO: 318162 - protein, 9 aa, Influenza virus
FESVAWSAS

SEQ ID NO: 318163 - protein, 9 aa, Influenza virus
ESVAWSASA

SEQ ID NO: 318164 - protein, 9 aa, Influenza virus
SVAWSASAC

SEQ ID NO: 318165 - protein, 9 aa, Influenza virus
VAWSASACH

SEQ ID NO: 318166 - protein, 9 aa, Influenza virus
AWSASACHD

SEQ ID NO: 318167 - protein, 9 aa, Influenza virus
WSASACHDG

SEQ ID NO: 318168 - protein, 9 aa, Influenza virus
SASACHDGT

SEQ ID NO: 318169 - protein, 9 aa, Influenza virus
ASACHDGTS

SEQ ID NO: 318170 - protein, 9 aa, Influenza virus
SACHDGTSW

SEQ ID NO: 318171 - protein, 9 aa, Influenza virus
ACHDGTSWL

SEQ ID NO: 318172 - protein, 9 aa, Influenza virus
CHDGTSWLT

SEQ ID NO: 318173 - protein, 9 aa, Influenza virus
HDGTSWLTI

SEQ ID NO: 318174 - protein, 9 aa, Influenza virus
SWLTIGISG

SEQ ID NO: 318175 - protein, 9 aa, Influenza virus
WLTIGISGP

SEQ ID NO: 318176 - protein, 9 aa, Influenza virus
LTIGISGPD

SEQ ID NO: 318177 - protein, 9 aa, Influenza virus
TIGISGPDN

SEQ ID NO: 318178 - protein, 9 aa, Influenza virus
IGISGPDNG

SEQ ID NO: 318179 - protein, 9 aa, Influenza virus
GISGPDNGA

SEQ ID NO: 318180 - protein, 9 aa, Influenza virus
ISGPDNGAV

SEQ ID NO: 318181 - protein, 9 aa, Influenza virus
SGPDNGAVA

SEQ ID NO: 318182 - protein, 9 aa, Influenza virus
GPDNGAVAV

SEQ ID NO: 318183 - protein, 9 aa, Influenza virus
PDNGAVAVL

SEQ ID NO: 318184 - protein, 9 aa, Influenza virus
DNGAVAVLK

SEQ ID NO: 318185 - protein, 9 aa, Influenza virus
NGAVAVLKY

SEQ ID NO: 318186 - protein, 9 aa, Influenza virus
GAVAVLKYN

SEQ ID NO: 318187 - protein, 9 aa, Influenza virus
AVAVLKYNG

SEQ ID NO: 318188 - protein, 9 aa, Influenza virus
KYNGIITDT

SEQ ID NO: 318189 - protein, 9 aa, Influenza virus
YNGIITDTI

SEQ ID NO: 318190 - protein, 9 aa, Influenza virus
GIITDTIKS

SEQ ID NO: 318191 - protein, 9 aa, Influenza virus
IITDTIKSW

SEQ ID NO: 318192 - protein, 9 aa, Influenza virus
ITDTIKSWR

SEQ ID NO: 318193 - protein, 9 aa, Influenza virus
NILRTQESE

SEQ ID NO: 318194 - protein, 9 aa, Influenza virus
ILRTQESEC

SEQ ID NO: 318195 - protein, 9 aa, Influenza virus
LRTQESECA

SEQ ID NO: 318196 - protein, 9 aa, Influenza virus
RTQESECAC

SEQ ID NO: 318197 - protein, 9 aa, Influenza virus
TQESECACV

SEQ ID NO: 318198 - protein, 9 aa, Influenza virus
QESECACVN

SEQ ID NO: 318199 - protein, 9 aa, Influenza virus
ESECACVNG

SEQ ID NO: 318200 - protein, 9 aa, Influenza virus
GSCFTVMTD

SEQ ID NO: 318201 - protein, 9 aa, Influenza virus
SCFTVMTDG

SEQ ID NO: 318202 - protein, 9 aa, Influenza virus
CFTVMTDGP

SEQ ID NO: 318203 - protein, 9 aa, Influenza virus
FTVMTDGPS

SEQ ID NO: 318204 - protein, 9 aa, Influenza virus
YKYKIFKNG

SEQ ID NO: 318205 - protein, 9 aa, Influenza virus
KYKIFKNGK

SEQ ID NO: 318206 - protein, 9 aa, Influenza virus
GKKGKWLNQ

SEQ ID NO: 318207 - protein, 9 aa, Influenza virus
APNYHYEEC

SEQ ID NO: 318208 - protein, 9 aa, Influenza virus
PNYHYEECS

SEQ ID NO: 318209 - protein, 9 aa, Influenza virus
NYHYEECSC

SEQ ID NO: 318210 - protein, 9 aa, Influenza virus
YHYEECSCY

SEQ ID NO: 318211 - protein, 9 aa, Influenza virus
HYEECSCYP

SEQ ID NO: 318212 - protein, 9 aa, Influenza virus
YEECSCYPD

SEQ ID NO: 318213 - protein, 9 aa, Influenza virus
EECSCYPDA

SEQ ID NO: 318214 - protein, 9 aa, Influenza virus
ECSCYPDAG

SEQ ID NO: 318215 - protein, 9 aa, Influenza virus
CSCYPDAGE

SEQ ID NO: 318216 - protein, 9 aa, Influenza virus
TCVCRDNWH

SEQ ID NO: 318217 - protein, 9 aa, Influenza virus
CVCRDNWHG

SEQ ID NO: 318218 - protein, 9 aa, Influenza virus
VCRDNWHGS

SEQ ID NO: 318219 - protein, 9 aa, Influenza virus
CRDNWHGSN

SEQ ID NO: 318220 - protein, 9 aa, Influenza virus
RDNWHGSNR

SEQ ID NO: 318221 - protein, 9 aa, Influenza virus
DNWHGSNRP

SEQ ID NO: 318222 - protein, 9 aa, Influenza virus
NWHGSNRPW

SEQ ID NO: 318223 - protein, 9 aa, Influenza virus
WHGSNRPWV

SEQ ID NO: 318224 - protein, 9 aa, Influenza virus
HGSNRPWVS

SEQ ID NO: 318225 - protein, 9 aa, Influenza virus
GSNRPWVSF

SEQ ID NO: 318226 - protein, 9 aa, Influenza virus
SNRPWVSFN

SEQ ID NO: 318227 - protein, 9 aa, Influenza virus
NRPWVSFNQ

SEQ ID NO: 318228 - protein, 9 aa, Influenza virus
YQIGYICSG

SEQ ID NO: 318229 - protein, 9 aa, Influenza virus
IGYICSGVF

SEQ ID NO: 318230 - protein, 9 aa, Influenza virus
GYICSGVFG

SEQ ID NO: 318231 - protein, 9 aa, Influenza virus
YICSGVFGD

SEQ ID NO: 318232 - protein, 9 aa, Influenza virus
ICSGVFGDN

SEQ ID NO: 318233 - protein, 9 aa, Influenza virus
CSGVFGDNP

SEQ ID NO: 318234 - protein, 9 aa, Influenza virus
SGVFGDNPR

SEQ ID NO: 318235 - protein, 9 aa, Influenza virus
GVFGDNPRP

SEQ ID NO: 318236 - protein, 9 aa, Influenza virus
FGDNPRPND

SEQ ID NO: 318237 - protein, 9 aa, Influenza virus
GDNPRPNDG

SEQ ID NO: 318238 - protein, 9 aa, Influenza virus
GVKGFSFKY

SEQ ID NO: 318239 - protein, 9 aa, Influenza virus
VKGFSFKYG

SEQ ID NO: 318240 - protein, 9 aa, Influenza virus
KGFSFKYGN

SEQ ID NO: 318241 - protein, 9 aa, Influenza virus
GFSFKYGNG

SEQ ID NO: 318242 - protein, 9 aa, Influenza virus
FKYGNGVWI

SEQ ID NO: 318243 - protein, 9 aa, Influenza virus
KYGNGVWIG

SEQ ID NO: 318244 - protein, 9 aa, Influenza virus
YGNGVWIGR

SEQ ID NO: 318245 - protein, 9 aa, Influenza virus
GNGVWIGRT

SEQ ID NO: 318246 - protein, 9 aa, Influenza virus
NGVWIGRTK

SEQ ID NO: 318247 - protein, 9 aa, Influenza virus
GVWIGRTKS

SEQ ID NO: 318248 - protein, 9 aa, Influenza virus
VWIGRTKST

SEQ ID NO: 318249 - protein, 9 aa, Influenza virus
SRSGFEMIW

SEQ ID NO: 318250 - protein, 9 aa, Influenza virus
RSGFEMIWD

SEQ ID NO: 318251 - protein, 9 aa, Influenza virus
SGFEMIWDP

SEQ ID NO: 318252 - protein, 9 aa, Influenza virus
GFEMIWDPN

SEQ ID NO: 318253 - protein, 9 aa, Influenza virus
FEMIWDPNG

SEQ ID NO: 318254 - protein, 9 aa, Influenza virus
EMIWDPNGW

SEQ ID NO: 318255 - protein, 9 aa, Influenza virus
ITDWSGYSG

SEQ ID NO: 318256 - protein, 9 aa, Influenza virus
TDWSGYSGS

SEQ ID NO: 318257 - protein, 9 aa, Influenza virus
DWSGYSGSF

SEQ ID NO: 318258 - protein, 9 aa, Influenza virus
WSGYSGSFV

SEQ ID NO: 318259 - protein, 9 aa, Influenza virus
SGYSGSFVQ

SEQ ID NO: 318260 - protein, 9 aa, Influenza virus
GYSGSFVQH

SEQ ID NO: 318261 - protein, 9 aa, Influenza virus
YSGSFVQHP

SEQ ID NO: 318262 - protein, 9 aa, Influenza virus
SGSFVQHPE

SEQ ID NO: 318263 - protein, 9 aa, Influenza virus
GSFVQHPEL

SEQ ID NO: 318264 - protein, 9 aa, Influenza virus
SFVQHPELT

SEQ ID NO: 318265 - protein, 9 aa, Influenza virus
FVQHPELTG

SEQ ID NO: 318266 - protein, 9 aa, Influenza virus
VQHPELTGL

SEQ ID NO: 318267 - protein, 9 aa, Influenza virus
QHPELTGLD

SEQ ID NO: 318268 - protein, 9 aa, Influenza virus
HPELTGLDC

SEQ ID NO: 318269 - protein, 9 aa, Influenza virus
TGLDCIRPC

SEQ ID NO: 318270 - protein, 9 aa, Influenza virus
DCIRPCFWV

SEQ ID NO: 318271 - protein, 9 aa, Influenza virus
CIRPCFWVE

SEQ ID NO: 318272 - protein, 9 aa, Influenza virus
IRPCFWVEL

SEQ ID NO: 318273 - protein, 9 aa, Influenza virus
RPCFWVELI

SEQ ID NO: 318274 - protein, 9 aa, Influenza virus
PCFWVELIR

SEQ ID NO: 318275 - protein, 9 aa, Influenza virus
CFWVELIRG

SEQ ID NO: 318276 - protein, 9 aa, Influenza virus
FWVELIRGR

SEQ ID NO: 318277 - protein, 9 aa, Influenza virus
WVELIRGRP

SEQ ID NO: 318278 - protein, 9 aa, Influenza virus
VELIRGRPK

SEQ ID NO: 318279 - protein, 9 aa, Influenza virus
ELIRGRPKE

SEQ ID NO: 318280 - protein, 9 aa, Influenza virus
TIWTSGSSI

SEQ ID NO: 318281 - protein, 9 aa, Influenza virus
IWTSGSSIS

SEQ ID NO: 318282 - protein, 9 aa, Influenza virus
WTSGSSISF

SEQ ID NO: 318283 - protein, 9 aa, Influenza virus
TSGSSISFC

SEQ ID NO: 318284 - protein, 9 aa, Influenza virus
SGSSISFCG

SEQ ID NO: 318285 - protein, 9 aa, Influenza virus
GSSISFCGV

SEQ ID NO: 318286 - protein, 9 aa, Influenza virus
SSISFCGVN

SEQ ID NO: 318287 - protein, 9 aa, Influenza virus
IFLWCKIVT

SEQ ID NO: 318288 - protein, 9 aa, Influenza virus
FLWCKIVTT

SEQ ID NO: 318289 - protein, 9 aa, Influenza virus
LWCKIVTTV

SEQ ID NO: 318290 - protein, 9 aa, Influenza virus
WCKIVTTVG

SEQ ID NO: 318291 - protein, 9 aa, Influenza virus
CKIVTTVGW

SEQ ID NO: 318292 - protein, 9 aa, Influenza virus
KIVTTVGWS

SEQ ID NO: 318293 - protein, 9 aa, Influenza virus
IVTTVGWSW

SEQ ID NO: 318294 - protein, 9 aa, Influenza virus
VTTVGWSWP

SEQ ID NO: 318295 - protein, 9 aa, Influenza virus
SWSWPDGAE

SEQ ID NO: 318296 - protein, 9 aa, Influenza virus
WSWPDGAEL

SEQ ID NO: 318297 - protein, 9 aa, Influenza virus
SWPDGAELP

SEQ ID NO: 318298 - protein, 9 aa, Influenza virus
WPDGAELPF

SEQ ID NO: 318299 - protein, 9 aa, Influenza virus
ELPFTIDKS

SEQ ID NO: 318300 - protein, 9 aa, Influenza virus
GDQICIGYH

SEQ ID NO: 318301 - protein, 9 aa, Influenza virus
DQICIGYHA

SEQ ID NO: 318302 - protein, 9 aa, Influenza virus
QICIGYHAN

SEQ ID NO: 318303 - protein, 9 aa, Influenza virus
ICIGYHANN

SEQ ID NO: 318304 - protein, 9 aa, Influenza virus
CIGYHANNS

SEQ ID NO: 318305 - protein, 9 aa, Influenza virus
IGYHANNST

SEQ ID NO: 318306 - protein, 9 aa, Influenza virus
GYHANNSTE

SEQ ID NO: 318307 - protein, 9 aa, Influenza virus
YHANNSTEQ

SEQ ID NO: 318308 - protein, 9 aa, Influenza virus
HANNSTEQV

SEQ ID NO: 318309 - protein, 9 aa, Influenza virus
ANNSTEQVD

SEQ ID NO: 318310 - protein, 9 aa, Influenza virus
NNSTEQVDT

SEQ ID NO: 318311 - protein, 9 aa, Influenza virus
NSTEQVDTI

SEQ ID NO: 318312 - protein, 9 aa, Influenza virus
EQVDTIMEK

SEQ ID NO: 318313 - protein, 9 aa, Influenza virus
QVDTIMEKN

SEQ ID NO: 318314 - protein, 9 aa, Influenza virus
VDTIMEKNV

SEQ ID NO: 318315 - protein, 9 aa, Influenza virus
DTIMEKNVT

SEQ ID NO: 318316 - protein, 9 aa, Influenza virus
TIMEKNVTV

SEQ ID NO: 318317 - protein, 9 aa, Influenza virus
IMEKNVTVT

SEQ ID NO: 318318 - protein, 9 aa, Influenza virus
EKNVTVTHA

SEQ ID NO: 318319 - protein, 9 aa, Influenza virus
KNVTVTHAQ

SEQ ID NO: 318320 - protein, 9 aa, Influenza virus
NVTVTHAQD

SEQ ID NO: 318321 - protein, 9 aa, Influenza virus
AGWLLGNPM

SEQ ID NO: 318322 - protein, 9 aa, Influenza virus
GWLLGNPMC

SEQ ID NO: 318323 - protein, 9 aa, Influenza virus
VPEWSYIVE

SEQ ID NO: 318324 - protein, 9 aa, Influenza virus
PEWSYIVEK

SEQ ID NO: 318325 - protein, 9 aa, Influenza virus
EWSYIVEKD

SEQ ID NO: 318326 - protein, 9 aa, Influenza virus
WSYIVEKDN

SEQ ID NO: 318327 - protein, 9 aa, Influenza virus
SYIVEKDNP

SEQ ID NO: 318328 - protein, 9 aa, Influenza virus
YYNGRSSFF

SEQ ID NO: 318329 - protein, 9 aa, Influenza virus
SSFFRNVVW

SEQ ID NO: 318330 - protein, 9 aa, Influenza virus
SFFRNVVWL

SEQ ID NO: 318331 - protein, 9 aa, Influenza virus
FFRNVVWLI

SEQ ID NO: 318332 - protein, 9 aa, Influenza virus
FRNVVWLIK

SEQ ID NO: 318333 - protein, 9 aa, Influenza virus
RNVVWLIKK

SEQ ID NO: 318334 - protein, 9 aa, Influenza virus
GTSTLNQRS

SEQ ID NO: 318335 - protein, 9 aa, Influenza virus
IATRPKVNG

SEQ ID NO: 318336 - protein, 9 aa, Influenza virus
ATRPKVNGQ

SEQ ID NO: 318337 - protein, 9 aa, Influenza virus
RPKVNGQSG

SEQ ID NO: 318338 - protein, 9 aa, Influenza virus
FESNGNFIA

SEQ ID NO: 318339 - protein, 9 aa, Influenza virus
ESNGNFIAP

SEQ ID NO: 318340 - protein, 9 aa, Influenza virus
SNGNFIAPE

SEQ ID NO: 318341 - protein, 9 aa, Influenza virus
NGNFIAPEY

SEQ ID NO: 318342 - protein, 9 aa, Influenza virus
GNFIAPEYA

SEQ ID NO: 318343 - protein, 9 aa, Influenza virus
NFIAPEYAY

SEQ ID NO: 318344 - protein, 9 aa, Influenza virus
FIAPEYAYK

SEQ ID NO: 318345 - protein, 9 aa, Influenza virus
IAPEYAYKI

SEQ ID NO: 318346 - protein, 9 aa, Influenza virus
PEYAYKIVK

SEQ ID NO: 318347 - protein, 9 aa, Influenza virus
YGNCDTKCQ

SEQ ID NO: 318348 - protein, 9 aa, Influenza virus
GNCDTKCQT

SEQ ID NO: 318349 - protein, 9 aa, Influenza virus
NCDTKCQTP

SEQ ID NO: 318350 - protein, 9 aa, Influenza virus
RKRKRKTRG

SEQ ID NO: 318351 - protein, 9 aa, Influenza virus
KRKRKTRGL

SEQ ID NO: 318352 - protein, 9 aa, Influenza virus
RKRKTRGLF

SEQ ID NO: 318353 - protein, 9 aa, Influenza virus
KRKTRGLFG

SEQ ID NO: 318354 - protein, 9 aa, Influenza virus
EKRRKKRGL

SEQ ID NO: 318355 - protein, 9 aa, Influenza virus
KRRKKRGLF

SEQ ID NO: 318356 - protein, 9 aa, Influenza virus
RRKKRGLFG

SEQ ID NO: 318357 - protein, 9 aa, Influenza virus
RKKRGLFGA

SEQ ID NO: 318358 - protein, 9 aa, Influenza virus
ETRGLFGAI

SEQ ID NO: 318359 - protein, 9 aa, Influenza virus
TRGLFGAIA

SEQ ID NO: 318360 - protein, 9 aa, Influenza virus
RGLFGAIAG

SEQ ID NO: 318361 - protein, 9 aa, Influenza virus
GLFGAIAGF

SEQ ID NO: 318362 - protein, 9 aa, Influenza virus
LFGAIAGFI

SEQ ID NO: 318363 - protein, 9 aa, Influenza virus
FGAIAGFIE

SEQ ID NO: 318364 - protein, 9 aa, Influenza virus
GAIAGFIEG

SEQ ID NO: 318365 - protein, 9 aa, Influenza virus
AIAGFIEGG

SEQ ID NO: 318366 - protein, 9 aa, Influenza virus
IAGFIEGGW

SEQ ID NO: 318367 - protein, 9 aa, Influenza virus
AGFIEGGWQ

SEQ ID NO: 318368 - protein, 9 aa, Influenza virus
GFIEGGWQG

SEQ ID NO: 318369 - protein, 9 aa, Influenza virus
FIEGGWQGM

SEQ ID NO: 318370 - protein, 9 aa, Influenza virus
IEGGWQGMV

SEQ ID NO: 318371 - protein, 9 aa, Influenza virus
EGGWQGMVD

SEQ ID NO: 318372 - protein, 9 aa, Influenza virus
GGWQGMVDG

SEQ ID NO: 318373 - protein, 9 aa, Influenza virus
GWQGMVDGW

SEQ ID NO: 318374 - protein, 9 aa, Influenza virus
WQGMVDGWY

SEQ ID NO: 318375 - protein, 9 aa, Influenza virus
QGMVDGWYG

SEQ ID NO: 318376 - protein, 9 aa, Influenza virus
GMVDGWYGY

SEQ ID NO: 318377 - protein, 9 aa, Influenza virus
MVDGWYGYH

SEQ ID NO: 318378 - protein, 9 aa, Influenza virus
VDGWYGYHH

SEQ ID NO: 318379 - protein, 9 aa, Influenza virus
DGWYGYHHS

SEQ ID NO: 318380 - protein, 9 aa, Influenza virus
GWYGYHHSN

SEQ ID NO: 318381 - protein, 9 aa, Influenza virus
NEQGSGYAA

SEQ ID NO: 318382 - protein, 9 aa, Influenza virus
EQGSGYAAD

SEQ ID NO: 318383 - protein, 9 aa, Influenza virus
QGSGYAADK

SEQ ID NO: 318384 - protein, 9 aa, Influenza virus
GSGYAADKE

SEQ ID NO: 318385 - protein, 9 aa, Influenza virus
SGYAADKES

SEQ ID NO: 318386 - protein, 9 aa, Influenza virus
GYAADKEST

SEQ ID NO: 318387 - protein, 9 aa, Influenza virus
YAADKESTQ

SEQ ID NO: 318388 - protein, 9 aa, Influenza virus
AADKESTQK

SEQ ID NO: 318389 - protein, 9 aa, Influenza virus
ADKESTQKA

SEQ ID NO: 318390 - protein, 9 aa, Influenza virus
ESTQKAIDG

SEQ ID NO: 318391 - protein, 9 aa, Influenza virus
STQKAIDGI

SEQ ID NO: 318392 - protein, 9 aa, Influenza virus
TQKAIDGIT

SEQ ID NO: 318393 - protein, 9 aa, Influenza virus
VWTYNAELL

SEQ ID NO: 318394 - protein, 9 aa, Influenza virus
WTYNAELLV

SEQ ID NO: 318395 - protein, 9 aa, Influenza virus
TYNAELLVL

SEQ ID NO: 318396 - protein, 9 aa, Influenza virus
YNAELLVLM

SEQ ID NO: 318397 - protein, 9 aa, Influenza virus
NAELLVLME

SEQ ID NO: 318398 - protein, 9 aa, Influenza virus
AELLVLMEN

SEQ ID NO: 318399 - protein, 9 aa, Influenza virus
ELLVLMENE

SEQ ID NO: 318400 - protein, 9 aa, Influenza virus
LLVLMENER

SEQ ID NO: 318401 - protein, 9 aa, Influenza virus
LVLMENERT

SEQ ID NO: 318402 - protein, 9 aa, Influenza virus
VLMENERTL

SEQ ID NO: 318403 - protein, 9 aa, Influenza virus
LMENERTLD

SEQ ID NO: 318404 - protein, 9 aa, Influenza virus
MENERTLDF

SEQ ID NO: 318405 - protein, 9 aa, Influenza virus
ENERTLDFH

SEQ ID NO: 318406 - protein, 9 aa, Influenza virus
NERTLDFHD

SEQ ID NO: 318407 - protein, 9 aa, Influenza virus
ERTLDFHDS

SEQ ID NO: 318408 - protein, 9 aa, Influenza virus
RTLDFHDSN

SEQ ID NO: 318409 - protein, 9 aa, Influenza virus
TLDFHDSNV

SEQ ID NO: 318410 - protein, 9 aa, Influenza virus
LDFHDSNVK

SEQ ID NO: 318411 - protein, 9 aa, Influenza virus
DFHDSNVKN

SEQ ID NO: 318412 - protein, 9 aa, Influenza virus
FHDSNVKNL

SEQ ID NO: 318413 - protein, 9 aa, Influenza virus
HDSNVKNLY

SEQ ID NO: 318414 - protein, 9 aa, Influenza virus
DSNVKNLYD

SEQ ID NO: 318415 - protein, 9 aa, Influenza virus
SNVKNLYDK

SEQ ID NO: 318416 - protein, 9 aa, Influenza virus
NVKNLYDKV

SEQ ID NO: 318417 - protein, 9 aa, Influenza virus
VKNLYDKVR

SEQ ID NO: 318418 - protein, 9 aa, Influenza virus
NLYDKVRLQ

SEQ ID NO: 318419 - protein, 9 aa, Influenza virus
LYDKVRLQL

SEQ ID NO: 318420 - protein, 9 aa, Influenza virus
VRLQLRDNA

SEQ ID NO: 318421 - protein, 9 aa, Influenza virus
DNAKELGNG

SEQ ID NO: 318422 - protein, 9 aa, Influenza virus
NAKELGNGC

SEQ ID NO: 318423 - protein, 9 aa, Influenza virus
AKELGNGCF

SEQ ID NO: 318424 - protein, 9 aa, Influenza virus
KELGNGCFE

SEQ ID NO: 318425 - protein, 9 aa, Influenza virus
ELGNGCFEF

SEQ ID NO: 318426 - protein, 9 aa, Influenza virus
LGNGCFEFY

SEQ ID NO: 318427 - protein, 9 aa, Influenza virus
GNGCFEFYH

SEQ ID NO: 318428 - protein, 9 aa, Influenza virus
NGCFEFYHK

SEQ ID NO: 318429 - protein, 9 aa, Influenza virus
GCFEFYHKC

SEQ ID NO: 318430 - protein, 9 aa, Influenza virus
CFEFYHKCD

SEQ ID NO: 318431 - protein, 9 aa, Influenza virus
FEFYHKCDN

SEQ ID NO: 318432 - protein, 9 aa, Influenza virus
ECMESVRNG

SEQ ID NO: 318433 - protein, 9 aa, Influenza virus
CMESVRNGT

SEQ ID NO: 318434 - protein, 9 aa, Influenza virus
MESVRNGTY

SEQ ID NO: 318435 - protein, 9 aa, Influenza virus
ESVRNGTYD

SEQ ID NO: 318436 - protein, 9 aa, Influenza virus
SVRNGTYDY

SEQ ID NO: 318437 - protein, 9 aa, Influenza virus
ILSIYSTVA

SEQ ID NO: 318438 - protein, 9 aa, Influenza virus
LSIYSTVAS

SEQ ID NO: 318439 - protein, 9 aa, Influenza virus
SIYSTVASS

SEQ ID NO: 318440 - protein, 9 aa, Influenza virus
IYSTVASSL

SEQ ID NO: 318441 - protein, 9 aa, Influenza virus
VASSLALAI

SEQ ID NO: 318442 - protein, 9 aa, Influenza virus
LAIMIAGLS

SEQ ID NO: 318443 - protein, 9 aa, Influenza virus
AIMIAGLSF

SEQ ID NO: 318444 - protein, 9 aa, Influenza virus
IMIAGLSFW

SEQ ID NO: 318445 - protein, 9 aa, Influenza virus
IAGLSFWMC

SEQ ID NO: 318446 - protein, 9 aa, Influenza virus
AGLSFWMCS

SEQ ID NO: 318447 - protein, 9 aa, Influenza virus
GLSFWMCSN

SEQ ID NO: 318448 - protein, 9 aa, Influenza virus
LSFWMCSNG

SEQ ID NO: 318449 - protein, 9 aa, Influenza virus
SFWMCSNGS

SEQ ID NO: 318450 - protein, 9 aa, Influenza virus
FWMCSNGSL

SEQ ID NO: 318451 - protein, 9 aa, Influenza virus
WMCSNGSLQ

SEQ ID NO: 318452 - protein, 9 aa, Influenza virus
MCSNGSLQC

SEQ ID NO: 318453 - protein, 9 aa, Influenza virus
CSNGSLQCR

SEQ ID NO: 318454 - protein, 9 aa, Influenza virus
SNGSLQCRI

SEQ ID NO: 318455 - protein, 9 aa, Influenza virus
NGSLQCRIC

SEQ ID NO: 318456 - protein, 9 aa, Influenza virus
GSLQCRICI

SEQ ID NO: 318457 - protein, 9 aa, Influenza virus
IITIGSVSL

SEQ ID NO: 318458 - protein, 9 aa, Influenza virus
YRNWSKPQC

SEQ ID NO: 318459 - protein, 9 aa, Influenza virus
KPQCQITGF

SEQ ID NO: 318460 - protein, 9 aa, Influenza virus
PQCQITGFA

SEQ ID NO: 318461 - protein, 9 aa, Influenza virus
QCQITGFAP

SEQ ID NO: 318462 - protein, 9 aa, Influenza virus
CQITGFAPF

SEQ ID NO: 318463 - protein, 9 aa, Influenza virus
ITGFAPFSK

SEQ ID NO: 318464 - protein, 9 aa, Influenza virus
TGFAPFSKD

SEQ ID NO: 318465 - protein, 9 aa, Influenza virus
GFAPFSKDN

SEQ ID NO: 318466 - protein, 9 aa, Influenza virus
FAPFSKDNS

SEQ ID NO: 318467 - protein, 9 aa, Influenza virus
APFSKDNSI

SEQ ID NO: 318468 - protein, 9 aa, Influenza virus
PFSKDNSIR

SEQ ID NO: 318469 - protein, 9 aa, Influenza virus
FSKDNSIRL

SEQ ID NO: 318470 - protein, 9 aa, Influenza virus
SKDNSIRLS

SEQ ID NO: 318471 - protein, 9 aa, Influenza virus
KDNSIRLSA

SEQ ID NO: 318472 - protein, 9 aa, Influenza virus
DNSIRLSAG

SEQ ID NO: 318473 - protein, 9 aa, Influenza virus
NSIRLSAGG

SEQ ID NO: 318474 - protein, 9 aa, Influenza virus
RLSAGGDIW

SEQ ID NO: 318475 - protein, 9 aa, Influenza virus
IWVTREPYV

SEQ ID NO: 318476 - protein, 9 aa, Influenza virus
WVTREPYVS

SEQ ID NO: 318477 - protein, 9 aa, Influenza virus
VTREPYVSC

SEQ ID NO: 318478 - protein, 9 aa, Influenza virus
TREPYVSCD

SEQ ID NO: 318479 - protein, 9 aa, Influenza virus
KCYQFALGQ

SEQ ID NO: 318480 - protein, 9 aa, Influenza virus
CYQFALGQG

SEQ ID NO: 318481 - protein, 9 aa, Influenza virus
YQFALGQGT

SEQ ID NO: 318482 - protein, 9 aa, Influenza virus
QFALGQGTT

SEQ ID NO: 318483 - protein, 9 aa, Influenza virus
FALGQGTTL

SEQ ID NO: 318484 - protein, 9 aa, Influenza virus
ALGQGTTLD

SEQ ID NO: 318485 - protein, 9 aa, Influenza virus
LGQGTTLDN

SEQ ID NO: 318486 - protein, 9 aa, Influenza virus
KHSNGTIHD

SEQ ID NO: 318487 - protein, 9 aa, Influenza virus
HSNGTIHDR

SEQ ID NO: 318488 - protein, 9 aa, Influenza virus
SNGTIHDRI

SEQ ID NO: 318489 - protein, 9 aa, Influenza virus
PHRTLLMNE

SEQ ID NO: 318490 - protein, 9 aa, Influenza virus
HRTLLMNEL

SEQ ID NO: 318491 - protein, 9 aa, Influenza virus
RTLLMNELG

SEQ ID NO: 318492 - protein, 9 aa, Influenza virus
TLLMNELGV

SEQ ID NO: 318493 - protein, 9 aa, Influenza virus
LLMNELGVP

SEQ ID NO: 318494 - protein, 9 aa, Influenza virus
LMNELGVPF

SEQ ID NO: 318495 - protein, 9 aa, Influenza virus
MNELGVPFH

SEQ ID NO: 318496 - protein, 9 aa, Influenza virus
NELGVPFHL

SEQ ID NO: 318497 - protein, 9 aa, Influenza virus
ELGVPFHLG

SEQ ID NO: 318498 - protein, 9 aa, Influenza virus
LGVPFHLGT

SEQ ID NO: 318499 - protein, 9 aa, Influenza virus
GVPFHLGTK

SEQ ID NO: 318500 - protein, 9 aa, Influenza virus
VPFHLGTKQ

SEQ ID NO: 318501 - protein, 9 aa, Influenza virus
PFHLGTKQV

SEQ ID NO: 318502 - protein, 9 aa, Influenza virus
FHLGTKQVC

SEQ ID NO: 318503 - protein, 9 aa, Influenza virus
HLGTKQVCI

SEQ ID NO: 318504 - protein, 9 aa, Influenza virus
LGTKQVCIA

SEQ ID NO: 318505 - protein, 9 aa, Influenza virus
GTKQVCIAW

SEQ ID NO: 318506 - protein, 9 aa, Influenza virus
TKQVCIAWS

SEQ ID NO: 318507 - protein, 9 aa, Influenza virus
KQVCIAWSS

SEQ ID NO: 318508 - protein, 9 aa, Influenza virus
QVCIAWSSS

SEQ ID NO: 318509 - protein, 9 aa, Influenza virus
VCIAWSSSS

SEQ ID NO: 318510 - protein, 9 aa, Influenza virus
CIAWSSSSC

SEQ ID NO: 318511 - protein, 9 aa, Influenza virus
IAWSSSSCH

SEQ ID NO: 318512 - protein, 9 aa, Influenza virus
AWSSSSCHD

SEQ ID NO: 318513 - protein, 9 aa, Influenza virus
WSSSSCHDG

SEQ ID NO: 318514 - protein, 9 aa, Influenza virus
SSSSCHDGK

SEQ ID NO: 318515 - protein, 9 aa, Influenza virus
SSSCHDGKA

SEQ ID NO: 318516 - protein, 9 aa, Influenza virus
SSCHDGKAW

SEQ ID NO: 318517 - protein, 9 aa, Influenza virus
SCHDGKAWL

SEQ ID NO: 318518 - protein, 9 aa, Influenza virus
CHDGKAWLH

SEQ ID NO: 318519 - protein, 9 aa, Influenza virus
HDGKAWLHV

SEQ ID NO: 318520 - protein, 9 aa, Influenza virus
DGKAWLHVC

SEQ ID NO: 318521 - protein, 9 aa, Influenza virus
GKAWLHVCV

SEQ ID NO: 318522 - protein, 9 aa, Influenza virus
AWLHVCVTG

SEQ ID NO: 318523 - protein, 9 aa, Influenza virus
WLHVCVTGD

SEQ ID NO: 318524 - protein, 9 aa, Influenza virus
LHVCVTGDD

SEQ ID NO: 318525 - protein, 9 aa, Influenza virus
TGDDRNATA

SEQ ID NO: 318526 - protein, 9 aa, Influenza virus
GDDRNATAS

SEQ ID NO: 318527 - protein, 9 aa, Influenza virus
SWSQNILRT

SEQ ID NO: 318528 - protein, 9 aa, Influenza virus
WSQNILRTQ

SEQ ID NO: 318529 - protein, 9 aa, Influenza virus
SQNILRTQE

SEQ ID NO: 318530 - protein, 9 aa, Influenza virus
QNILRTQES

SEQ ID NO: 318531 - protein, 9 aa, Influenza virus
NILRTQESE

SEQ ID NO: 318532 - protein, 9 aa, Influenza virus
ILRTQESEC

SEQ ID NO: 318533 - protein, 9 aa, Influenza virus
LRTQESECV

SEQ ID NO: 318534 - protein, 9 aa, Influenza virus
RTQESECVC

SEQ ID NO: 318535 - protein, 9 aa, Influenza virus
TQESECVCI

SEQ ID NO: 318536 - protein, 9 aa, Influenza virus
QESECVCIN

SEQ ID NO: 318537 - protein, 9 aa, Influenza virus
CTVVMTDGS

SEQ ID NO: 318538 - protein, 9 aa, Influenza virus
TVVMTDGSA

SEQ ID NO: 318539 - protein, 9 aa, Influenza virus
VVMTDGSAS

SEQ ID NO: 318540 - protein, 9 aa, Influenza virus
VMTDGSASG

SEQ ID NO: 318541 - protein, 9 aa, Influenza virus
TDGSASGRA

SEQ ID NO: 318542 - protein, 9 aa, Influenza virus
SPLSGSAQH

SEQ ID NO: 318543 - protein, 9 aa, Influenza virus
PLSGSAQHI

SEQ ID NO: 318544 - protein, 9 aa, Influenza virus
LSGSAQHIE

SEQ ID NO: 318545 - protein, 9 aa, Influenza virus
GSAQHIEEC

SEQ ID NO: 318546 - protein, 9 aa, Influenza virus
SAQHIEECS

SEQ ID NO: 318547 - protein, 9 aa, Influenza virus
AQHIEECSC

SEQ ID NO: 318548 - protein, 9 aa, Influenza virus
QHIEECSCY

SEQ ID NO: 318549 - protein, 9 aa, Influenza virus
HIEECSCYP

SEQ ID NO: 318550 - protein, 9 aa, Influenza virus
SYPNVRCVC

SEQ ID NO: 318551 - protein, 9 aa, Influenza virus
VRCVCRDNW

SEQ ID NO: 318552 - protein, 9 aa, Influenza virus
RCVCRDNWK

SEQ ID NO: 318553 - protein, 9 aa, Influenza virus
CVCRDNWKG

SEQ ID NO: 318554 - protein, 9 aa, Influenza virus
VCRDNWKGS

SEQ ID NO: 318555 - protein, 9 aa, Influenza virus
CRDNWKGSN

SEQ ID NO: 318556 - protein, 9 aa, Influenza virus
RDNWKGSNR

SEQ ID NO: 318557 - protein, 9 aa, Influenza virus
DNWKGSNRP

SEQ ID NO: 318558 - protein, 9 aa, Influenza virus
NWKGSNRPV

SEQ ID NO: 318559 - protein, 9 aa, Influenza virus
KLDINMADY

SEQ ID NO: 318560 - protein, 9 aa, Influenza virus
SSYVCSGLV

SEQ ID NO: 318561 - protein, 9 aa, Influenza virus
SYVCSGLVG

SEQ ID NO: 318562 - protein, 9 aa, Influenza virus
YVCSGLVGD

SEQ ID NO: 318563 - protein, 9 aa, Influenza virus
VCSGLVGDT

SEQ ID NO: 318564 - protein, 9 aa, Influenza virus
CSGLVGDTP

SEQ ID NO: 318565 - protein, 9 aa, Influenza virus
SGLVGDTPR

SEQ ID NO: 318566 - protein, 9 aa, Influenza virus
GLVGDTPRN

SEQ ID NO: 318567 - protein, 9 aa, Influenza virus
LVGDTPRND

SEQ ID NO: 318568 - protein, 9 aa, Influenza virus
VGDTPRNDD

SEQ ID NO: 318569 - protein, 9 aa, Influenza virus
GDTPRNDDS

SEQ ID NO: 318570 - protein, 9 aa, Influenza virus
SSSNCRDPN

SEQ ID NO: 318571 - protein, 9 aa, Influenza virus
SSNCRDPNN

SEQ ID NO: 318572 - protein, 9 aa, Influenza virus
SNCRDPNNE

SEQ ID NO: 318573 - protein, 9 aa, Influenza virus
NCRDPNNER

SEQ ID NO: 318574 - protein, 9 aa, Influenza virus
GNPGVKGWA

SEQ ID NO: 318575 - protein, 9 aa, Influenza virus
NPGVKGWAF

SEQ ID NO: 318576 - protein, 9 aa, Influenza virus
PGVKGWAFD

SEQ ID NO: 318577 - protein, 9 aa, Influenza virus
GVKGWAFDN

SEQ ID NO: 318578 - protein, 9 aa, Influenza virus
DVWMGRTIS

SEQ ID NO: 318579 - protein, 9 aa, Influenza virus
GRTISKDSR

SEQ ID NO: 318580 - protein, 9 aa, Influenza virus
SKDSRSGYE

SEQ ID NO: 318581 - protein, 9 aa, Influenza virus
KDSRSGYET

SEQ ID NO: 318582 - protein, 9 aa, Influenza virus
DSRSGYETF

SEQ ID NO: 318583 - protein, 9 aa, Influenza virus
SRSGYETFR

SEQ ID NO: 318584 - protein, 9 aa, Influenza virus
RSGYETFRV

SEQ ID NO: 318585 - protein, 9 aa, Influenza virus
SGYETFRVI

SEQ ID NO: 318586 - protein, 9 aa, Influenza virus
NWSGYSGIF

SEQ ID NO: 318587 - protein, 9 aa, Influenza virus
WSGYSGIFS

SEQ ID NO: 318588 - protein, 9 aa, Influenza virus
SGYSGIFSV

SEQ ID NO: 318589 - protein, 9 aa, Influenza virus
GYSGIFSVE

SEQ ID NO: 318590 - protein, 9 aa, Influenza virus
SCINRCFYV

SEQ ID NO: 318591 - protein, 9 aa, Influenza virus
CINRCFYVE

SEQ ID NO: 318592 - protein, 9 aa, Influenza virus
INRCFYVEL

SEQ ID NO: 318593 - protein, 9 aa, Influenza virus
NRCFYVELI

SEQ ID NO: 318594 - protein, 9 aa, Influenza virus
RCFYVELIR

SEQ ID NO: 318595 - protein, 9 aa, Influenza virus
CFYVELIRG

SEQ ID NO: 318596 - protein, 9 aa, Influenza virus
FYVELIRGR

SEQ ID NO: 318597 - protein, 9 aa, Influenza virus
YVELIRGRP

SEQ ID NO: 318598 - protein, 9 aa, Influenza virus
VELIRGRPQ

SEQ ID NO: 318599 - protein, 9 aa, Influenza virus
ELIRGRPQE

SEQ ID NO: 318600 - protein, 9 aa, Influenza virus
RVWWTSNSI

SEQ ID NO: 318601 - protein, 9 aa, Influenza virus
VWWTSNSIV

SEQ ID NO: 318602 - protein, 9 aa, Influenza virus
WWTSNSIVV

SEQ ID NO: 318603 - protein, 9 aa, Influenza virus
WTSNSIVVF

SEQ ID NO: 318604 - protein, 9 aa, Influenza virus
TSNSIVVFC

SEQ ID NO: 318605 - protein, 9 aa, Influenza virus
SNSIVVFCG

SEQ ID NO: 318606 - protein, 9 aa, Influenza virus
NSIVVFCGT

SEQ ID NO: 318607 - protein, 9 aa, Influenza virus
SIVVFCGTS

SEQ ID NO: 318608 - protein, 9 aa, Influenza virus
IVVFCGTSG

SEQ ID NO: 318609 - protein, 9 aa, Influenza virus
VVFCGTSGT

SEQ ID NO: 318610 - protein, 9 aa, Influenza virus
VFCGTSGTY

SEQ ID NO: 318611 - protein, 9 aa, Influenza virus
FCGTSGTYG

SEQ ID NO: 318612 - protein, 9 aa, Influenza virus
CGTSGTYGT

SEQ ID NO: 318613 - protein, 9 aa, Influenza virus
GTSGTYGTG

SEQ ID NO: 318614 - protein, 9 aa, Influenza virus
TSGTYGTGS

SEQ ID NO: 318615 - protein, 9 aa, Influenza virus
SGTYGTGSW

SEQ ID NO: 318616 - protein, 9 aa, Influenza virus
GTYGTGSWP

SEQ ID NO: 318617 - protein, 9 aa, Influenza virus
TYGTGSWPD

SEQ ID NO: 318618 - protein, 9 aa, Influenza virus
YGTGSWPDG

SEQ ID NO: 318619 - protein, 9 aa, Influenza virus
GTGSWPDGA

SEQ ID NO: 318620 - protein, 9 aa, Influenza virus
TGSWPDGAN

SEQ ID NO: 318621 - protein, 9 aa, Influenza virus
GSWPDGANI

SEQ ID NO: 318622 - protein, 9 aa, Influenza virus
SWPDGANIN

SEQ ID NO: 318623 - protein, 9 aa, Influenza virus
WPDGANINF

SEQ ID NO: 318624 - protein, 9 aa, Influenza virus
PDGANINFM

SEQ ID NO: 318625 - protein, 9 aa, Influenza virus
DGANINFMP

SEQ ID NO: 318626 - protein, 9 aa, Influenza virus
GKSDKICIG

SEQ ID NO: 318627 - protein, 9 aa, Influenza virus
KSDKICIGY

SEQ ID NO: 318628 - protein, 9 aa, Influenza virus
SDKICIGYH

SEQ ID NO: 318629 - protein, 9 aa, Influenza virus
DKICIGYHA

SEQ ID NO: 318630 - protein, 9 aa, Influenza virus
KICIGYHAN

SEQ ID NO: 318631 - protein, 9 aa, Influenza virus
ICIGYHANN

SEQ ID NO: 318632 - protein, 9 aa, Influenza virus
CIGYHANNS

SEQ ID NO: 318633 - protein, 9 aa, Influenza virus
IGYHANNST

SEQ ID NO: 318634 - protein, 9 aa, Influenza virus
GYHANNSTT

SEQ ID NO: 318635 - protein, 9 aa, Influenza virus
YHANNSTTQ

SEQ ID NO: 318636 - protein, 9 aa, Influenza virus
HANNSTTQV

SEQ ID NO: 318637 - protein, 9 aa, Influenza virus
ANNSTTQVD

SEQ ID NO: 318638 - protein, 9 aa, Influenza virus
NNSTTQVDT

SEQ ID NO: 318639 - protein, 9 aa, Influenza virus
NSTTQVDTI

SEQ ID NO: 318640 - protein, 9 aa, Influenza virus
VDTILEKNV

SEQ ID NO: 318641 - protein, 9 aa, Influenza virus
DTILEKNVT

SEQ ID NO: 318642 - protein, 9 aa, Influenza virus
TILEKNVTV

SEQ ID NO: 318643 - protein, 9 aa, Influenza virus
ILEKNVTVT

SEQ ID NO: 318644 - protein, 9 aa, Influenza virus
LEKNVTVTH

SEQ ID NO: 318645 - protein, 9 aa, Influenza virus
EKNVTVTHS

SEQ ID NO: 318646 - protein, 9 aa, Influenza virus
KNVTVTHSV

SEQ ID NO: 318647 - protein, 9 aa, Influenza virus
NVTVTHSVE

SEQ ID NO: 318648 - protein, 9 aa, Influenza virus
VTVTHSVEL

SEQ ID NO: 318649 - protein, 9 aa, Influenza virus
TVTHSVELL

SEQ ID NO: 318650 - protein, 9 aa, Influenza virus
VTHSVELLE

SEQ ID NO: 318651 - protein, 9 aa, Influenza virus
THSVELLEN

SEQ ID NO: 318652 - protein, 9 aa, Influenza virus
EGWILGNPQ

SEQ ID NO: 318653 - protein, 9 aa, Influenza virus
GWILGNPQC

SEQ ID NO: 318654 - protein, 9 aa, Influenza virus
WILGNPQCD

SEQ ID NO: 318655 - protein, 9 aa, Influenza virus
QSWSYIVER

SEQ ID NO: 318656 - protein, 9 aa, Influenza virus
SWSYIVERP

SEQ ID NO: 318657 - protein, 9 aa, Influenza virus
AQNGICYPG

SEQ ID NO: 318658 - protein, 9 aa, Influenza virus
SSFYRNLLW

SEQ ID NO: 318659 - protein, 9 aa, Influenza virus
SFYRNLLWI

SEQ ID NO: 318660 - protein, 9 aa, Influenza virus
PILYFWGVH

SEQ ID NO: 318661 - protein, 9 aa, Influenza virus
ILYFWGVHH

SEQ ID NO: 318662 - protein, 9 aa, Influenza virus
LYFWGVHHP

SEQ ID NO: 318663 - protein, 9 aa, Influenza virus
RGRIDYYWS

SEQ ID NO: 318664 - protein, 9 aa, Influenza virus
RIDYYWSVL

SEQ ID NO: 318665 - protein, 9 aa, Influenza virus
WSVLKPGET

SEQ ID NO: 318666 - protein, 9 aa, Influenza virus
SVLKPGETL

SEQ ID NO: 318667 - protein, 9 aa, Influenza virus
VLKPGETLN

SEQ ID NO: 318668 - protein, 9 aa, Influenza virus
LKPGETLNV

SEQ ID NO: 318669 - protein, 9 aa, Influenza virus
KPGETLNVE

SEQ ID NO: 318670 - protein, 9 aa, Influenza virus
PGETLNVES

SEQ ID NO: 318671 - protein, 9 aa, Influenza virus
GETLNVESN

SEQ ID NO: 318672 - protein, 9 aa, Influenza virus
ETLNVESNG

SEQ ID NO: 318673 - protein, 9 aa, Influenza virus
TLNVESNGN

SEQ ID NO: 318674 - protein, 9 aa, Influenza virus
LNVESNGNL

SEQ ID NO: 318675 - protein, 9 aa, Influenza virus
NVESNGNLI

SEQ ID NO: 318676 - protein, 9 aa, Influenza virus
VESNGNLIA

SEQ ID NO: 318677 - protein, 9 aa, Influenza virus
ESNGNLIAP

SEQ ID NO: 318678 - protein, 9 aa, Influenza virus
SNGNLIAPW

SEQ ID NO: 318679 - protein, 9 aa, Influenza virus
NGNLIAPWY

SEQ ID NO: 318680 - protein, 9 aa, Influenza virus
GNLIAPWYA

SEQ ID NO: 318681 - protein, 9 aa, Influenza virus
NLIAPWYAY

SEQ ID NO: 318682 - protein, 9 aa, Influenza virus
LIAPWYAYK

SEQ ID NO: 318683 - protein, 9 aa, Influenza virus
NNNKGAVFK

SEQ ID NO: 318684 - protein, 9 aa, Influenza virus
TNKTFQNVS

SEQ ID NO: 318685 - protein, 9 aa, Influenza virus
NKTFQNVSP

SEQ ID NO: 318686 - protein, 9 aa, Influenza virus
KTFQNVSPL

SEQ ID NO: 318687 - protein, 9 aa, Influenza virus
TFQNVSPLW

SEQ ID NO: 318688 - protein, 9 aa, Influenza virus
FQNVSPLWI

SEQ ID NO: 318689 - protein, 9 aa, Influenza virus
QNVSPLWIG

SEQ ID NO: 318690 - protein, 9 aa, Influenza virus
WIGECPKYV

SEQ ID NO: 318691 - protein, 9 aa, Influenza virus
GECPKYVKS

SEQ ID NO: 318692 - protein, 9 aa, Influenza virus
SLRLATGLR

SEQ ID NO: 318693 - protein, 9 aa, Influenza virus
LRLATGLRN

SEQ ID NO: 318694 - protein, 9 aa, Influenza virus
RLATGLRNV

SEQ ID NO: 318695 - protein, 9 aa, Influenza virus
LATGLRNVP

SEQ ID NO: 318696 - protein, 9 aa, Influenza virus
ATGLRNVPQ

SEQ ID NO: 318697 - protein, 9 aa, Influenza virus
TRGLFGAIA

SEQ ID NO: 318698 - protein, 9 aa, Influenza virus
RGLFGAIAG

SEQ ID NO: 318699 - protein, 9 aa, Influenza virus
GLFGAIAGF

SEQ ID NO: 318700 - protein, 9 aa, Influenza virus
LFGAIAGFI

SEQ ID NO: 318701 - protein, 9 aa, Influenza virus
FGAIAGFIE

SEQ ID NO: 318702 - protein, 9 aa, Influenza virus
GAIAGFIEG

SEQ ID NO: 318703 - protein, 9 aa, Influenza virus
AIAGFIEGG

SEQ ID NO: 318704 - protein, 9 aa, Influenza virus
IAGFIEGGW

SEQ ID NO: 318705 - protein, 9 aa, Influenza virus
AGFIEGGWT

SEQ ID NO: 318706 - protein, 9 aa, Influenza virus
GFIEGGWTG

SEQ ID NO: 318707 - protein, 9 aa, Influenza virus
FIEGGWTGM

SEQ ID NO: 318708 - protein, 9 aa, Influenza virus
IEGGWTGMI

SEQ ID NO: 318709 - protein, 9 aa, Influenza virus
EGGWTGMID

SEQ ID NO: 318710 - protein, 9 aa, Influenza virus
GGWTGMIDG

SEQ ID NO: 318711 - protein, 9 aa, Influenza virus
GWTGMIDGW

SEQ ID NO: 318712 - protein, 9 aa, Influenza virus
WTGMIDGWY

SEQ ID NO: 318713 - protein, 9 aa, Influenza virus
TGMIDGWYG

SEQ ID NO: 318714 - protein, 9 aa, Influenza virus
GMIDGWYGY

SEQ ID NO: 318715 - protein, 9 aa, Influenza virus
MIDGWYGYH

SEQ ID NO: 318716 - protein, 9 aa, Influenza virus
IDGWYGYHH

SEQ ID NO: 318717 - protein, 9 aa, Influenza virus
DGWYGYHHE

SEQ ID NO: 318718 - protein, 9 aa, Influenza virus
GWYGYHHEN

SEQ ID NO: 318719 - protein, 9 aa, Influenza virus
WYGYHHENS

SEQ ID NO: 318720 - protein, 9 aa, Influenza virus
YGYHHENSQ

SEQ ID NO: 318721 - protein, 9 aa, Influenza virus
GYHHENSQG

SEQ ID NO: 318722 - protein, 9 aa, Influenza virus
YHHENSQGS

SEQ ID NO: 318723 - protein, 9 aa, Influenza virus
HHENSQGSG

SEQ ID NO: 318724 - protein, 9 aa, Influenza virus
HENSQGSGY

SEQ ID NO: 318725 - protein, 9 aa, Influenza virus
ENSQGSGYA

SEQ ID NO: 318726 - protein, 9 aa, Influenza virus
NSQGSGYAA

SEQ ID NO: 318727 - protein, 9 aa, Influenza virus
SQGSGYAAD

SEQ ID NO: 318728 - protein, 9 aa, Influenza virus
QGSGYAADK

SEQ ID NO: 318729 - protein, 9 aa, Influenza virus
GSGYAADKE

SEQ ID NO: 318730 - protein, 9 aa, Influenza virus
SGYAADKES

SEQ ID NO: 318731 - protein, 9 aa, Influenza virus
GYAADKEST

SEQ ID NO: 318732 - protein, 9 aa, Influenza virus
YAADKESTQ

SEQ ID NO: 318733 - protein, 9 aa, Influenza virus
AADKESTQK

SEQ ID NO: 318734 - protein, 9 aa, Influenza virus
ADKESTQKA

SEQ ID NO: 318735 - protein, 9 aa, Influenza virus
ITNKVNSII

SEQ ID NO: 318736 - protein, 9 aa, Influenza virus
NSIIDKMNT

SEQ ID NO: 318737 - protein, 9 aa, Influenza virus
IIDKMNTQF

SEQ ID NO: 318738 - protein, 9 aa, Influenza virus
KMNTQFEAV

SEQ ID NO: 318739 - protein, 9 aa, Influenza virus
HEFSNLERR

SEQ ID NO: 318740 - protein, 9 aa, Influenza virus
EFSNLERRI

SEQ ID NO: 318741 - protein, 9 aa, Influenza virus
NLNKRMEDG

SEQ ID NO: 318742 - protein, 9 aa, Influenza virus
LNKRMEDGF

SEQ ID NO: 318743 - protein, 9 aa, Influenza virus
NKRMEDGFL

SEQ ID NO: 318744 - protein, 9 aa, Influenza virus
DGFLDVWTY

SEQ ID NO: 318745 - protein, 9 aa, Influenza virus
GFLDVWTYN

SEQ ID NO: 318746 - protein, 9 aa, Influenza virus
FLDVWTYNA

SEQ ID NO: 318747 - protein, 9 aa, Influenza virus
LDVWTYNAE

SEQ ID NO: 318748 - protein, 9 aa, Influenza virus
DVWTYNAEL

SEQ ID NO: 318749 - protein, 9 aa, Influenza virus
VWTYNAELL

SEQ ID NO: 318750 - protein, 9 aa, Influenza virus
WTYNAELLV

SEQ ID NO: 318751 - protein, 9 aa, Influenza virus
TYNAELLVL

SEQ ID NO: 318752 - protein, 9 aa, Influenza virus
YNAELLVLL

SEQ ID NO: 318753 - protein, 9 aa, Influenza virus
NAELLVLLE

SEQ ID NO: 318754 - protein, 9 aa, Influenza virus
AELLVLLEN

SEQ ID NO: 318755 - protein, 9 aa, Influenza virus
ELLVLLENE

SEQ ID NO: 318756 - protein, 9 aa, Influenza virus
LLVLLENER

SEQ ID NO: 318757 - protein, 9 aa, Influenza virus
LVLLENERT

SEQ ID NO: 318758 - protein, 9 aa, Influenza virus
VLLENERTL

SEQ ID NO: 318759 - protein, 9 aa, Influenza virus
LLENERTLD

SEQ ID NO: 318760 - protein, 9 aa, Influenza virus
ENERTLDLH

SEQ ID NO: 318761 - protein, 9 aa, Influenza virus
NERTLDLHD

SEQ ID NO: 318762 - protein, 9 aa, Influenza virus
ERTLDLHDA

SEQ ID NO: 318763 - protein, 9 aa, Influenza virus
RTLDLHDAN

SEQ ID NO: 318764 - protein, 9 aa, Influenza virus
TLDLHDANV

SEQ ID NO: 318765 - protein, 9 aa, Influenza virus
LDLHDANVK

SEQ ID NO: 318766 - protein, 9 aa, Influenza virus
VKSQLRDNA

SEQ ID NO: 318767 - protein, 9 aa, Influenza virus
SQLRDNAND

SEQ ID NO: 318768 - protein, 9 aa, Influenza virus
LRDNANDLG

SEQ ID NO: 318769 - protein, 9 aa, Influenza virus
RDNANDLGN

SEQ ID NO: 318770 - protein, 9 aa, Influenza virus
DNANDLGNG

SEQ ID NO: 318771 - protein, 9 aa, Influenza virus
NANDLGNGC

SEQ ID NO: 318772 - protein, 9 aa, Influenza virus
ANDLGNGCF

SEQ ID NO: 318773 - protein, 9 aa, Influenza virus
NDLGNGCFE

SEQ ID NO: 318774 - protein, 9 aa, Influenza virus
DLGNGCFEF

SEQ ID NO: 318775 - protein, 9 aa, Influenza virus
LGNGCFEFW

SEQ ID NO: 318776 - protein, 9 aa, Influenza virus
GNGCFEFWH

SEQ ID NO: 318777 - protein, 9 aa, Influenza virus
NGCFEFWHK

SEQ ID NO: 318778 - protein, 9 aa, Influenza virus
GCFEFWHKC

SEQ ID NO: 318779 - protein, 9 aa, Influenza virus
CFEFWHKCD

SEQ ID NO: 318780 - protein, 9 aa, Influenza virus
FEFWHKCDN

SEQ ID NO: 318781 - protein, 9 aa, Influenza virus
EFWHKCDNE

SEQ ID NO: 318782 - protein, 9 aa, Influenza virus
FWHKCDNEC

SEQ ID NO: 318783 - protein, 9 aa, Influenza virus
SVKNGTYDY

SEQ ID NO: 318784 - protein, 9 aa, Influenza virus
KNGTYDYPK

SEQ ID NO: 318785 - protein, 9 aa, Influenza virus
NGTYDYPKY

SEQ ID NO: 318786 - protein, 9 aa, Influenza virus
GTYDYPKYQ

SEQ ID NO: 318787 - protein, 9 aa, Influenza virus
LGVYQILAI

SEQ ID NO: 318788 - protein, 9 aa, Influenza virus
GVYQILAIY

SEQ ID NO: 318789 - protein, 9 aa, Influenza virus
VYQILAIYS

SEQ ID NO: 318790 - protein, 9 aa, Influenza virus
YQILAIYST

SEQ ID NO: 318791 - protein, 9 aa, Influenza virus
QILAIYSTV

SEQ ID NO: 318792 - protein, 9 aa, Influenza virus
ILAIYSTVS

SEQ ID NO: 318793 - protein, 9 aa, Influenza virus
LAIYSTVSS

SEQ ID NO: 318794 - protein, 9 aa, Influenza virus
AIYSTVSSS

SEQ ID NO: 318795 - protein, 9 aa, Influenza virus
IYSTVSSSL

SEQ ID NO: 318796 - protein, 9 aa, Influenza virus
YSTVSSSLV

SEQ ID NO: 318797 - protein, 9 aa, Influenza virus
STVSSSLVL

SEQ ID NO: 318798 - protein, 9 aa, Influenza virus
TVSSSLVLV

SEQ ID NO: 318799 - protein, 9 aa, Influenza virus
VSSSLVLVG

SEQ ID NO: 318800 - protein, 9 aa, Influenza virus
SSSLVLVGL

SEQ ID NO: 318801 - protein, 9 aa, Influenza virus
SSLVLVGLI

SEQ ID NO: 318802 - protein, 9 aa, Influenza virus
WMCSNGSMQ

SEQ ID NO: 318803 - protein, 9 aa, Influenza virus
MCSNGSMQC

SEQ ID NO: 318804 - protein, 9 aa, Influenza virus
CSNGSMQCR

SEQ ID NO: 318805 - protein, 9 aa, Influenza virus
GSMQCRICI

SEQ ID NO: 318806 - protein, 9 aa, Influenza virus
SMQCRICIG

SEQ ID NO: 318807 - protein, 9 aa, Influenza virus
MQCRICIGS

SEQ ID NO: 318808 - protein, 9 aa, Influenza virus
SKSRGYKMN

SEQ ID NO: 318809 - protein, 9 aa, Influenza virus
KSRGYKMNT

SEQ ID NO: 318810 - protein, 9 aa, Influenza virus
SRGYKMNTQ

SEQ ID NO: 318811 - protein, 9 aa, Influenza virus
RGYKMNTQI

SEQ ID NO: 318812 - protein, 9 aa, Influenza virus
GYKMNTQIL

SEQ ID NO: 318813 - protein, 9 aa, Influenza virus
GCDHSDNAD

SEQ ID NO: 318814 - protein, 9 aa, Influenza virus
CDHSDNADK

SEQ ID NO: 318815 - protein, 9 aa, Influenza virus
DHSDNADKI

SEQ ID NO: 318816 - protein, 9 aa, Influenza virus
HSDNADKIC

SEQ ID NO: 318817 - protein, 9 aa, Influenza virus
SDNADKICL

SEQ ID NO: 318818 - protein, 9 aa, Influenza virus
DNADKICLG

SEQ ID NO: 318819 - protein, 9 aa, Influenza virus
GDKICLGHH

SEQ ID NO: 318820 - protein, 9 aa, Influenza virus
DKICLGHHA

SEQ ID NO: 318821 - protein, 9 aa, Influenza virus
KICLGHHAV

SEQ ID NO: 318822 - protein, 9 aa, Influenza virus
NGTKVNTLT

SEQ ID NO: 318823 - protein, 9 aa, Influenza virus
TLTERGIEV

SEQ ID NO: 318824 - protein, 9 aa, Influenza virus
LTERGIEVV

SEQ ID NO: 318825 - protein, 9 aa, Influenza virus
TERGIEVVN

SEQ ID NO: 318826 - protein, 9 aa, Influenza virus
ERGIEVVNA

SEQ ID NO: 318827 - protein, 9 aa, Influenza virus
RGIEVVNAT

SEQ ID NO: 318828 - protein, 9 aa, Influenza virus
GIEVVNATE

SEQ ID NO: 318829 - protein, 9 aa, Influenza virus
IEVVNATET

SEQ ID NO: 318830 - protein, 9 aa, Influenza virus
EVVNATETV

SEQ ID NO: 318831 - protein, 9 aa, Influenza virus
VVNATETVE

SEQ ID NO: 318832 - protein, 9 aa, Influenza virus
VNATETVET

SEQ ID NO: 318833 - protein, 9 aa, Influenza virus
GPPQCDQFL

SEQ ID NO: 318834 - protein, 9 aa, Influenza virus
PPQCDQFLE

SEQ ID NO: 318835 - protein, 9 aa, Influenza virus
PQCDQFLEF

SEQ ID NO: 318836 - protein, 9 aa, Influenza virus
SSSFYAEMK

SEQ ID NO: 318837 - protein, 9 aa, Influenza virus
SSFYAEMKW

SEQ ID NO: 318838 - protein, 9 aa, Influenza virus
SFYAEMKWL

SEQ ID NO: 318839 - protein, 9 aa, Influenza virus
FYAEMKWLL

SEQ ID NO: 318840 - protein, 9 aa, Influenza virus
YAEMKWLLS

SEQ ID NO: 318841 - protein, 9 aa, Influenza virus
AEMKWLLSN

SEQ ID NO: 318842 - protein, 9 aa, Influenza virus
ALIIWGVHH

SEQ ID NO: 318843 - protein, 9 aa, Influenza virus
NGQSGRIDF

SEQ ID NO: 318844 - protein, 9 aa, Influenza virus
GQSGRIDFH

SEQ ID NO: 318845 - protein, 9 aa, Influenza virus
QSGRIDFHW

SEQ ID NO: 318846 - protein, 9 aa, Influenza virus
FTFNGAFIA

SEQ ID NO: 318847 - protein, 9 aa, Influenza virus
TFNGAFIAP

SEQ ID NO: 318848 - protein, 9 aa, Influenza virus
FNGAFIAPD

SEQ ID NO: 318849 - protein, 9 aa, Influenza virus
NGAFIAPDR

SEQ ID NO: 318850 - protein, 9 aa, Influenza virus
GAFIAPDRA

SEQ ID NO: 318851 - protein, 9 aa, Influenza virus
AFIAPDRAS

SEQ ID NO: 318852 - protein, 9 aa, Influenza virus
FIAPDRASF

SEQ ID NO: 318853 - protein, 9 aa, Influenza virus
GKCPRYVKQ

SEQ ID NO: 318854 - protein, 9 aa, Influenza virus
SLLLATGMR

SEQ ID NO: 318855 - protein, 9 aa, Influenza virus
LLLATGMRN

SEQ ID NO: 318856 - protein, 9 aa, Influenza virus
LLATGMRNV

SEQ ID NO: 318857 - protein, 9 aa, Influenza virus
LATGMRNVP

SEQ ID NO: 318858 - protein, 9 aa, Influenza virus
ATGMRNVPE

SEQ ID NO: 318859 - protein, 9 aa, Influenza virus
THKQLTHHM

SEQ ID NO: 318860 - protein, 9 aa, Influenza virus
HKQLTHHMR

SEQ ID NO: 318861 - protein, 9 aa, Influenza virus
KQLTHHMRK

SEQ ID NO: 318862 - protein, 9 aa, Influenza virus
QLTHHMRKK

SEQ ID NO: 318863 - protein, 9 aa, Influenza virus
LTHHMRKKR

SEQ ID NO: 318864 - protein, 9 aa, Influenza virus
THHMRKKRG

SEQ ID NO: 318865 - protein, 9 aa, Influenza virus
HHMRKKRGL

SEQ ID NO: 318866 - protein, 9 aa, Influenza virus
HMRKKRGLF

SEQ ID NO: 318867 - protein, 9 aa, Influenza virus
MRKKRGLFG

SEQ ID NO: 318868 - protein, 9 aa, Influenza virus
RKKRGLFGA

SEQ ID NO: 318869 - protein, 9 aa, Influenza virus
RETRGLFGA

SEQ ID NO: 318870 - protein, 9 aa, Influenza virus
MTRGLFGAI

SEQ ID NO: 318871 - protein, 9 aa, Influenza virus
PRGLFGAIA

SEQ ID NO: 318872 - protein, 9 aa, Influenza virus
TKPRPRRGL

SEQ ID NO: 318873 - protein, 9 aa, Influenza virus
KPRPRRGLF

SEQ ID NO: 318874 - protein, 9 aa, Influenza virus
PRPRRGLFG

SEQ ID NO: 318875 - protein, 9 aa, Influenza virus
RPRRGLFGA

SEQ ID NO: 318876 - protein, 9 aa, Influenza virus
PRRGLFGAI

SEQ ID NO: 318877 - protein, 9 aa, Influenza virus
RRGLFGAIA

SEQ ID NO: 318878 - protein, 9 aa, Influenza virus
RGLFGAIAG

SEQ ID NO: 318879 - protein, 9 aa, Influenza virus
GLFGAIAGF

SEQ ID NO: 318880 - protein, 9 aa, Influenza virus
LFGAIAGFI

SEQ ID NO: 318881 - protein, 9 aa, Influenza virus
FGAIAGFIE

SEQ ID NO: 318882 - protein, 9 aa, Influenza virus
GAIAGFIEN

SEQ ID NO: 318883 - protein, 9 aa, Influenza virus
AIAGFIENG

SEQ ID NO: 318884 - protein, 9 aa, Influenza virus
IAGFIENGW

SEQ ID NO: 318885 - protein, 9 aa, Influenza virus
AGFIENGWE

SEQ ID NO: 318886 - protein, 9 aa, Influenza virus
GFIENGWEG

SEQ ID NO: 318887 - protein, 9 aa, Influenza virus
FIENGWEGL

SEQ ID NO: 318888 - protein, 9 aa, Influenza virus
IENGWEGLI

SEQ ID NO: 318889 - protein, 9 aa, Influenza virus
ENGWEGLID

SEQ ID NO: 318890 - protein, 9 aa, Influenza virus
NGWEGLIDG

SEQ ID NO: 318891 - protein, 9 aa, Influenza virus
GWEGLIDGW

SEQ ID NO: 318892 - protein, 9 aa, Influenza virus
WEGLIDGWY

SEQ ID NO: 318893 - protein, 9 aa, Influenza virus
EGLIDGWYG

SEQ ID NO: 318894 - protein, 9 aa, Influenza virus
GLIDGWYGF

SEQ ID NO: 318895 - protein, 9 aa, Influenza virus
LIDGWYGFR

SEQ ID NO: 318896 - protein, 9 aa, Influenza virus
IDGWYGFRH

SEQ ID NO: 318897 - protein, 9 aa, Influenza virus
DGWYGFRHQ

SEQ ID NO: 318898 - protein, 9 aa, Influenza virus
GWYGFRHQN

SEQ ID NO: 318899 - protein, 9 aa, Influenza virus
WYGFRHQNA

SEQ ID NO: 318900 - protein, 9 aa, Influenza virus
YGFRHQNAQ

SEQ ID NO: 318901 - protein, 9 aa, Influenza virus
GFRHQNAQG

SEQ ID NO: 318902 - protein, 9 aa, Influenza virus
FRHQNAQGE

SEQ ID NO: 318903 - protein, 9 aa, Influenza virus
RHQNAQGEG

SEQ ID NO: 318904 - protein, 9 aa, Influenza virus
HQNAQGEGT

SEQ ID NO: 318905 - protein, 9 aa, Influenza virus
QNAQGEGTA

SEQ ID NO: 318906 - protein, 9 aa, Influenza virus
NAQGEGTAA

SEQ ID NO: 318907 - protein, 9 aa, Influenza virus
AQGEGTAAD

SEQ ID NO: 318908 - protein, 9 aa, Influenza virus
QGEGTAADY

SEQ ID NO: 318909 - protein, 9 aa, Influenza virus
GEGTAADYK

SEQ ID NO: 318910 - protein, 9 aa, Influenza virus
EGTAADYKS

SEQ ID NO: 318911 - protein, 9 aa, Influenza virus
GTAADYKST

SEQ ID NO: 318912 - protein, 9 aa, Influenza virus
TAADYKSTQ

SEQ ID NO: 318913 - protein, 9 aa, Influenza virus
AADYKSTQS

SEQ ID NO: 318914 - protein, 9 aa, Influenza virus
ADYKSTQSA

SEQ ID NO: 318915 - protein, 9 aa, Influenza virus
DYKSTQSAI

SEQ ID NO: 318916 - protein, 9 aa, Influenza virus
YKSTQSAID

SEQ ID NO: 318917 - protein, 9 aa, Influenza virus
KSTQSAIDQ

SEQ ID NO: 318918 - protein, 9 aa, Influenza virus
STQSAIDQI

SEQ ID NO: 318919 - protein, 9 aa, Influenza virus
TQSAIDQIT

SEQ ID NO: 318920 - protein, 9 aa, Influenza virus
QSAIDQITG

SEQ ID NO: 318921 - protein, 9 aa, Influenza virus
SAIDQITGK

SEQ ID NO: 318922 - protein, 9 aa, Influenza virus
AIDQITGKL

SEQ ID NO: 318923 - protein, 9 aa, Influenza virus
IDQITGKLN

SEQ ID NO: 318924 - protein, 9 aa, Influenza virus
DQITGKLNR

SEQ ID NO: 318925 - protein, 9 aa, Influenza virus
QITGKLNRL

SEQ ID NO: 318926 - protein, 9 aa, Influenza virus
ITGKLNRLI

SEQ ID NO: 318927 - protein, 9 aa, Influenza virus
KTNQQFELI

SEQ ID NO: 318928 - protein, 9 aa, Influenza virus
EQQIGNVIN

SEQ ID NO: 318929 - protein, 9 aa, Influenza virus
QQIGNVINW

SEQ ID NO: 318930 - protein, 9 aa, Influenza virus
QIGNVINWT

SEQ ID NO: 318931 - protein, 9 aa, Influenza virus
IGNVINWTR

SEQ ID NO: 318932 - protein, 9 aa, Influenza virus
GNVINWTRD

SEQ ID NO: 318933 - protein, 9 aa, Influenza virus
NVINWTRDS

SEQ ID NO: 318934 - protein, 9 aa, Influenza virus
WSYNAELLV

SEQ ID NO: 318935 - protein, 9 aa, Influenza virus
SYNAELLVA

SEQ ID NO: 318936 - protein, 9 aa, Influenza virus
AELLVAMEN

SEQ ID NO: 318937 - protein, 9 aa, Influenza virus
ELLVAMENQ

SEQ ID NO: 318938 - protein, 9 aa, Influenza virus
LLVAMENQH

SEQ ID NO: 318939 - protein, 9 aa, Influenza virus
LVAMENQHT

SEQ ID NO: 318940 - protein, 9 aa, Influenza virus
VAMENQHTI

SEQ ID NO: 318941 - protein, 9 aa, Influenza virus
AMENQHTID

SEQ ID NO: 318942 - protein, 9 aa, Influenza virus
MENQHTIDL

SEQ ID NO: 318943 - protein, 9 aa, Influenza virus
ENQHTIDLA

SEQ ID NO: 318944 - protein, 9 aa, Influenza virus
NQHTIDLAD

SEQ ID NO: 318945 - protein, 9 aa, Influenza virus
QHTIDLADS

SEQ ID NO: 318946 - protein, 9 aa, Influenza virus
HTIDLADSE

SEQ ID NO: 318947 - protein, 9 aa, Influenza virus
TIDLADSEM

SEQ ID NO: 318948 - protein, 9 aa, Influenza virus
SEMNKLYER

SEQ ID NO: 318949 - protein, 9 aa, Influenza virus
EMNKLYERV

SEQ ID NO: 318950 - protein, 9 aa, Influenza virus
VRKQLRENA

SEQ ID NO: 318951 - protein, 9 aa, Influenza virus
RKQLRENAE

SEQ ID NO: 318952 - protein, 9 aa, Influenza virus
KQLRENAEE

SEQ ID NO: 318953 - protein, 9 aa, Influenza virus
QLRENAEED

SEQ ID NO: 318954 - protein, 9 aa, Influenza virus
LRENAEEDG

SEQ ID NO: 318955 - protein, 9 aa, Influenza virus
RENAEEDGT

SEQ ID NO: 318956 - protein, 9 aa, Influenza virus
ENAEEDGTG

SEQ ID NO: 318957 - protein, 9 aa, Influenza virus
NAEEDGTGC

SEQ ID NO: 318958 - protein, 9 aa, Influenza virus
AEEDGTGCF

SEQ ID NO: 318959 - protein, 9 aa, Influenza virus
EEDGTGCFE

SEQ ID NO: 318960 - protein, 9 aa, Influenza virus
EDGTGCFEI

SEQ ID NO: 318961 - protein, 9 aa, Influenza virus
DGTGCFEIF

SEQ ID NO: 318962 - protein, 9 aa, Influenza virus
GTGCFEIFH

SEQ ID NO: 318963 - protein, 9 aa, Influenza virus
TGCFEIFHK

SEQ ID NO: 318964 - protein, 9 aa, Influenza virus
GCFEIFHKC

SEQ ID NO: 318965 - protein, 9 aa, Influenza virus
CFEIFHKCD

SEQ ID NO: 318966 - protein, 9 aa, Influenza virus
FEIFHKCDD

SEQ ID NO: 318967 - protein, 9 aa, Influenza virus
CMESIRNNT

SEQ ID NO: 318968 - protein, 9 aa, Influenza virus
MESIRNNTY

SEQ ID NO: 318969 - protein, 9 aa, Influenza virus
ESIRNNTYD

SEQ ID NO: 318970 - protein, 9 aa, Influenza virus
SIRNNTYDH

SEQ ID NO: 318971 - protein, 9 aa, Influenza virus
YRTESLQNR

SEQ ID NO: 318972 - protein, 9 aa, Influenza virus
SGYKDIILW

SEQ ID NO: 318973 - protein, 9 aa, Influenza virus
GYKDIILWF

SEQ ID NO: 318974 - protein, 9 aa, Influenza virus
YKDIILWFS

SEQ ID NO: 318975 - protein, 9 aa, Influenza virus
KDIILWFSF

SEQ ID NO: 318976 - protein, 9 aa, Influenza virus
DIILWFSFG

SEQ ID NO: 318977 - protein, 9 aa, Influenza virus
IILWFSFGA

SEQ ID NO: 318978 - protein, 9 aa, Influenza virus
ILWFSFGAS

SEQ ID NO: 318979 - protein, 9 aa, Influenza virus
LWFSFGASC

SEQ ID NO: 318980 - protein, 9 aa, Influenza virus
WFSFGASCF

SEQ ID NO: 318981 - protein, 9 aa, Influenza virus
FSFGASCFL

SEQ ID NO: 318982 - protein, 9 aa, Influenza virus
SFGASCFLL

SEQ ID NO: 318983 - protein, 9 aa, Influenza virus
FGASCFLLL

SEQ ID NO: 318984 - protein, 9 aa, Influenza virus
GASCFLLLA

SEQ ID NO: 318985 - protein, 9 aa, Influenza virus
FICIKNGNM

SEQ ID NO: 318986 - protein, 9 aa, Influenza virus
KNGNMRCTI

SEQ ID NO: 318987 - protein, 9 aa, Influenza virus
NGNMRCTIC

SEQ ID NO: 318988 - protein, 9 aa, Influenza virus
GNMRCTICI

SEQ ID NO: 318989 - protein, 9 aa, Influenza virus
TCSALFVYS

SEQ ID NO: 318990 - protein, 9 aa, Influenza virus
CSALFVYSL

SEQ ID NO: 318991 - protein, 9 aa, Influenza virus
SALFVYSLR

SEQ ID NO: 318992 - protein, 9 aa, Influenza virus
ALFVYSLRK

SEQ ID NO: 318993 - protein, 9 aa, Influenza virus
SKSRGYKMN

SEQ ID NO: 318994 - protein, 9 aa, Influenza virus
KSRGYKMNT

SEQ ID NO: 318995 - protein, 9 aa, Influenza virus
SRGYKMNTQ

SEQ ID NO: 318996 - protein, 9 aa, Influenza virus
RGYKMNTQI

SEQ ID NO: 318997 - protein, 9 aa, Influenza virus
GYKMNTQIL

SEQ ID NO: 318998 - protein, 9 aa, Influenza virus
YKMNTQILI

SEQ ID NO: 318999 - protein, 9 aa, Influenza virus
KMNTQILIL

SEQ ID NO: 319000 - protein, 9 aa, Influenza virus
AKGDKICLG

SEQ ID NO: 319001 - protein, 9 aa, Influenza virus
KGDKICLGH

SEQ ID NO: 319002 - protein, 9 aa, Influenza virus
GDKICLGHH

SEQ ID NO: 319003 - protein, 9 aa, Influenza virus
DKICLGHHA

SEQ ID NO: 319004 - protein, 9 aa, Influenza virus
KICLGHHAV

SEQ ID NO: 319005 - protein, 9 aa, Influenza virus
ICLGHHAVA

SEQ ID NO: 319006 - protein, 9 aa, Influenza virus
CLGHHAVAN

SEQ ID NO: 319007 - protein, 9 aa, Influenza virus
LGHHAVANG

SEQ ID NO: 319008 - protein, 9 aa, Influenza virus
GHHAVANGT

SEQ ID NO: 319009 - protein, 9 aa, Influenza virus
HHAVANGTK

SEQ ID NO: 319010 - protein, 9 aa, Influenza virus
HAVANGTKV

SEQ ID NO: 319011 - protein, 9 aa, Influenza virus
AVANGTKVN

SEQ ID NO: 319012 - protein, 9 aa, Influenza virus
VANGTKVNT

SEQ ID NO: 319013 - protein, 9 aa, Influenza virus
ANGTKVNTL

SEQ ID NO: 319014 - protein, 9 aa, Influenza virus
NGTKVNTLT

SEQ ID NO: 319015 - protein, 9 aa, Influenza virus
GTKVNTLTE

SEQ ID NO: 319016 - protein, 9 aa, Influenza virus
TKVNTLTER

SEQ ID NO: 319017 - protein, 9 aa, Influenza virus
KVNTLTERG

SEQ ID NO: 319018 - protein, 9 aa, Influenza virus
VNTLTERGI

SEQ ID NO: 319019 - protein, 9 aa, Influenza virus
NTLTERGIE

SEQ ID NO: 319020 - protein, 9 aa, Influenza virus
TLTERGIEV

SEQ ID NO: 319021 - protein, 9 aa, Influenza virus
LTERGIEVV

SEQ ID NO: 319022 - protein, 9 aa, Influenza virus
TERGIEVVN

SEQ ID NO: 319023 - protein, 9 aa, Influenza virus
ERGIEVVNA

SEQ ID NO: 319024 - protein, 9 aa, Influenza virus
RGIEVVNAT

SEQ ID NO: 319025 - protein, 9 aa, Influenza virus
GIEVVNATE

SEQ ID NO: 319026 - protein, 9 aa, Influenza virus
IEVVNATET

SEQ ID NO: 319027 - protein, 9 aa, Influenza virus
EVVNATETV

SEQ ID NO: 319028 - protein, 9 aa, Influenza virus
VVNATETVE

SEQ ID NO: 319029 - protein, 9 aa, Influenza virus
VNATETVET

SEQ ID NO: 319030 - protein, 9 aa, Influenza virus
NATETVETA

SEQ ID NO: 319031 - protein, 9 aa, Influenza virus
DLGQCGLLG

SEQ ID NO: 319032 - protein, 9 aa, Influenza virus
LGQCGLLGT

SEQ ID NO: 319033 - protein, 9 aa, Influenza virus
CGLLGTLIG

SEQ ID NO: 319034 - protein, 9 aa, Influenza virus
GLLGTLIGP

SEQ ID NO: 319035 - protein, 9 aa, Influenza virus
LLGTLIGPP

SEQ ID NO: 319036 - protein, 9 aa, Influenza virus
IGPPQCDQF

SEQ ID NO: 319037 - protein, 9 aa, Influenza virus
GPPQCDQFL

SEQ ID NO: 319038 - protein, 9 aa, Influenza virus
PPQCDQFLE

SEQ ID NO: 319039 - protein, 9 aa, Influenza virus
PQCDQFLEF

SEQ ID NO: 319040 - protein, 9 aa, Influenza virus
SDLIIERRE

SEQ ID NO: 319041 - protein, 9 aa, Influenza virus
DLIIERREG

SEQ ID NO: 319042 - protein, 9 aa, Influenza virus
LIIERREGT

SEQ ID NO: 319043 - protein, 9 aa, Influenza virus
IIERREGTD

SEQ ID NO: 319044 - protein, 9 aa, Influenza virus
EGTDVCYPG

SEQ ID NO: 319045 - protein, 9 aa, Influenza virus
CYPGKFTNE

SEQ ID NO: 319046 - protein, 9 aa, Influenza virus
YPGKFTNEE

SEQ ID NO: 319047 - protein, 9 aa, Influenza virus
FTNEESLRQ

SEQ ID NO: 319048 - protein, 9 aa, Influenza virus
TNEESLRQI

SEQ ID NO: 319049 - protein, 9 aa, Influenza virus
NEESLRQIL

SEQ ID NO: 319050 - protein, 9 aa, Influenza virus
EESLRQILR

SEQ ID NO: 319051 - protein, 9 aa, Influenza virus
LRQILRRSG

SEQ ID NO: 319052 - protein, 9 aa, Influenza virus
RQILRRSGG

SEQ ID NO: 319053 - protein, 9 aa, Influenza virus
QILRRSGGI

SEQ ID NO: 319054 - protein, 9 aa, Influenza virus
RRSGGIGKE

SEQ ID NO: 319055 - protein, 9 aa, Influenza virus
GFTYSGIRT

SEQ ID NO: 319056 - protein, 9 aa, Influenza virus
FTYSGIRTN

SEQ ID NO: 319057 - protein, 9 aa, Influenza virus
TYSGIRTNG

SEQ ID NO: 319058 - protein, 9 aa, Influenza virus
YSGIRTNGA

SEQ ID NO: 319059 - protein, 9 aa, Influenza virus
RSGSSFYAE

SEQ ID NO: 319060 - protein, 9 aa, Influenza virus
SGSSFYAEM

SEQ ID NO: 319061 - protein, 9 aa, Influenza virus
GSSFYAEMK

SEQ ID NO: 319062 - protein, 9 aa, Influenza virus
SSFYAEMKW

SEQ ID NO: 319063 - protein, 9 aa, Influenza virus
SFYAEMKWL

SEQ ID NO: 319064 - protein, 9 aa, Influenza virus
FYAEMKWLL

SEQ ID NO: 319065 - protein, 9 aa, Influenza virus
YAEMKWLLS

SEQ ID NO: 319066 - protein, 9 aa, Influenza virus
AEMKWLLSN

SEQ ID NO: 319067 - protein, 9 aa, Influenza virus
EMKWLLSNS

SEQ ID NO: 319068 - protein, 9 aa, Influenza virus
MKWLLSNSD

SEQ ID NO: 319069 - protein, 9 aa, Influenza virus
KWLLSNSDN

SEQ ID NO: 319070 - protein, 9 aa, Influenza virus
ALIIWGVHH

SEQ ID NO: 319071 - protein, 9 aa, Influenza virus
LIIWGVHHS

SEQ ID NO: 319072 - protein, 9 aa, Influenza virus
SEQTKLYGS

SEQ ID NO: 319073 - protein, 9 aa, Influenza virus
EQTKLYGSG

SEQ ID NO: 319074 - protein, 9 aa, Influenza virus
QTKLYGSGN

SEQ ID NO: 319075 - protein, 9 aa, Influenza virus
TKLYGSGNK

SEQ ID NO: 319076 - protein, 9 aa, Influenza virus
KLYGSGNKL

SEQ ID NO: 319077 - protein, 9 aa, Influenza virus
LYGSGNKLI

SEQ ID NO: 319078 - protein, 9 aa, Influenza virus
PGARRIDFH

SEQ ID NO: 319079 - protein, 9 aa, Influenza virus
GARRIDFHW

SEQ ID NO: 319080 - protein, 9 aa, Influenza virus
ARRIDFHWL

SEQ ID NO: 319081 - protein, 9 aa, Influenza virus
RRIDFHWLL

SEQ ID NO: 319082 - protein, 9 aa, Influenza virus
PQVNGQSGR

SEQ ID NO: 319083 - protein, 9 aa, Influenza virus
QVNGQSGRI

SEQ ID NO: 319084 - protein, 9 aa, Influenza virus
VNGQSGRID

SEQ ID NO: 319085 - protein, 9 aa, Influenza virus
NGQSGRIDF

SEQ ID NO: 319086 - protein, 9 aa, Influenza virus
GQSGRIDFH

SEQ ID NO: 319087 - protein, 9 aa, Influenza virus
QSGRIDFHW

SEQ ID NO: 319088 - protein, 9 aa, Influenza virus
SGRIDFHWL

SEQ ID NO: 319089 - protein, 9 aa, Influenza virus
GRIDFHWLL

SEQ ID NO: 319090 - protein, 9 aa, Influenza virus
RIDFHWLLL

SEQ ID NO: 319091 - protein, 9 aa, Influenza virus
NDTVTFTFN

SEQ ID NO: 319092 - protein, 9 aa, Influenza virus
DTVTFTFNG

SEQ ID NO: 319093 - protein, 9 aa, Influenza virus
TVTFTFNGA

SEQ ID NO: 319094 - protein, 9 aa, Influenza virus
VTFTFNGAF

SEQ ID NO: 319095 - protein, 9 aa, Influenza virus
TFTFNGAFI

SEQ ID NO: 319096 - protein, 9 aa, Influenza virus
FTFNGAFIA

SEQ ID NO: 319097 - protein, 9 aa, Influenza virus
TFNGAFIAP

SEQ ID NO: 319098 - protein, 9 aa, Influenza virus
FNGAFIAPD

SEQ ID NO: 319099 - protein, 9 aa, Influenza virus
NGAFIAPDR

SEQ ID NO: 319100 - protein, 9 aa, Influenza virus
GAFIAPDRA

SEQ ID NO: 319101 - protein, 9 aa, Influenza virus
AFIAPDRAS

SEQ ID NO: 319102 - protein, 9 aa, Influenza virus
FIAPDRASF

SEQ ID NO: 319103 - protein, 9 aa, Influenza virus
IAPDRASFF

SEQ ID NO: 319104 - protein, 9 aa, Influenza virus
APDRASFFR

SEQ ID NO: 319105 - protein, 9 aa, Influenza virus
PDRASFFRG

SEQ ID NO: 319106 - protein, 9 aa, Influenza virus
GGTIVSSLP

SEQ ID NO: 319107 - protein, 9 aa, Influenza virus
GTIVSSLPF

SEQ ID NO: 319108 - protein, 9 aa, Influenza virus
TIVSSLPFQ

SEQ ID NO: 319109 - protein, 9 aa, Influenza virus
IVSSLPFQN

SEQ ID NO: 319110 - protein, 9 aa, Influenza virus
VSSLPFQNI

SEQ ID NO: 319111 - protein, 9 aa, Influenza virus
SSLPFQNIN

SEQ ID NO: 319112 - protein, 9 aa, Influenza virus
SLPFQNINP

SEQ ID NO: 319113 - protein, 9 aa, Influenza virus
LPFQNINSR

SEQ ID NO: 319114 - protein, 9 aa, Influenza virus
TVGKCPRYV

SEQ ID NO: 319115 - protein, 9 aa, Influenza virus
VGKCPRYVK

SEQ ID NO: 319116 - protein, 9 aa, Influenza virus
GKCPRYVKQ

SEQ ID NO: 319117 - protein, 9 aa, Influenza virus
CPRYVKQKS

SEQ ID NO: 319118 - protein, 9 aa, Influenza virus
VKQKSLLLA

SEQ ID NO: 319119 - protein, 9 aa, Influenza virus
KQKSLLLAT

SEQ ID NO: 319120 - protein, 9 aa, Influenza virus
QKSLLLATG

SEQ ID NO: 319121 - protein, 9 aa, Influenza virus
KSLLLATGM

SEQ ID NO: 319122 - protein, 9 aa, Influenza virus
SLLLATGMR

SEQ ID NO: 319123 - protein, 9 aa, Influenza virus
LLLATGMRN

SEQ ID NO: 319124 - protein, 9 aa, Influenza virus
LLATGMRNV

SEQ ID NO: 319125 - protein, 9 aa, Influenza virus
LATGMRNVP

SEQ ID NO: 319126 - protein, 9 aa, Influenza virus
ATGMRNVPE

SEQ ID NO: 319127 - protein, 9 aa, Influenza virus
TGMRNVPEK

SEQ ID NO: 319128 - protein, 9 aa, Influenza virus
GMRNVPEKP

SEQ ID NO: 319129 - protein, 9 aa, Influenza virus
MRNVPEKPK

SEQ ID NO: 319130 - protein, 9 aa, Influenza virus
PKPRGLFGA

SEQ ID NO: 319131 - protein, 9 aa, Influenza virus
KPRGLFGAI

SEQ ID NO: 319132 - protein, 9 aa, Influenza virus
PRGLFGAIA

SEQ ID NO: 319133 - protein, 9 aa, Influenza virus
RGLFGAIAG

SEQ ID NO: 319134 - protein, 9 aa, Influenza virus
GLFGAIAGF

SEQ ID NO: 319135 - protein, 9 aa, Influenza virus
LFGAIAGFI

SEQ ID NO: 319136 - protein, 9 aa, Influenza virus
FGAIAGFIE

SEQ ID NO: 319137 - protein, 9 aa, Influenza virus
GAIAGFIEN

SEQ ID NO: 319138 - protein, 9 aa, Influenza virus
AIAGFIENG

SEQ ID NO: 319139 - protein, 9 aa, Influenza virus
IAGFIENGW

SEQ ID NO: 319140 - protein, 9 aa, Influenza virus
AGFIENGWE

SEQ ID NO: 319141 - protein, 9 aa, Influenza virus
GFIENGWEG

SEQ ID NO: 319142 - protein, 9 aa, Influenza virus
FIENGWEGL

SEQ ID NO: 319143 - protein, 9 aa, Influenza virus
IENGWEGLI

SEQ ID NO: 319144 - protein, 9 aa, Influenza virus
ENGWEGLIN

SEQ ID NO: 319145 - protein, 9 aa, Influenza virus
NGWEGLING

SEQ ID NO: 319146 - protein, 9 aa, Influenza virus
GWEGLINGW

SEQ ID NO: 319147 - protein, 9 aa, Influenza virus
WEGLINGWY

SEQ ID NO: 319148 - protein, 9 aa, Influenza virus
EGLINGWYG

SEQ ID NO: 319149 - protein, 9 aa, Influenza virus
GLINGWYGF

SEQ ID NO: 319150 - protein, 9 aa, Influenza virus
LINGWYGFR

SEQ ID NO: 319151 - protein, 9 aa, Influenza virus
INGWYGFRH

SEQ ID NO: 319152 - protein, 9 aa, Influenza virus
NGWYGFRHQ

SEQ ID NO: 319153 - protein, 9 aa, Influenza virus
GWYGFRHQN

SEQ ID NO: 319154 - protein, 9 aa, Influenza virus
WYGFRHQNA

SEQ ID NO: 319155 - protein, 9 aa, Influenza virus
YGFRHQNAQ

SEQ ID NO: 319156 - protein, 9 aa, Influenza virus
GFRHQNAQG

SEQ ID NO: 319157 - protein, 9 aa, Influenza virus
FRHQNAQGE

SEQ ID NO: 319158 - protein, 9 aa, Influenza virus
RHQNAQGEG

SEQ ID NO: 319159 - protein, 9 aa, Influenza virus
HQNAQGEGT

SEQ ID NO: 319160 - protein, 9 aa, Influenza virus
QNAQGEGTA

SEQ ID NO: 319161 - protein, 9 aa, Influenza virus
NAQGEGTAA

SEQ ID NO: 319162 - protein, 9 aa, Influenza virus
AQGEGTAAD

SEQ ID NO: 319163 - protein, 9 aa, Influenza virus
QGEGTAADY

SEQ ID NO: 319164 - protein, 9 aa, Influenza virus
GEGTAADYK

SEQ ID NO: 319165 - protein, 9 aa, Influenza virus
EGTAADYKS

SEQ ID NO: 319166 - protein, 9 aa, Influenza virus
GTAADYKST

SEQ ID NO: 319167 - protein, 9 aa, Influenza virus
TAADYKSTQ

SEQ ID NO: 319168 - protein, 9 aa, Influenza virus
AADYKSTQS

SEQ ID NO: 319169 - protein, 9 aa, Influenza virus
ADYKSTQSA

SEQ ID NO: 319170 - protein, 9 aa, Influenza virus
DYKSTQSAI

SEQ ID NO: 319171 - protein, 9 aa, Influenza virus
YKSTQSAID

SEQ ID NO: 319172 - protein, 9 aa, Influenza virus
KSTQSAIDQ

SEQ ID NO: 319173 - protein, 9 aa, Influenza virus
STQSAIDQI

SEQ ID NO: 319174 - protein, 9 aa, Influenza virus
TQSAIDQIT

SEQ ID NO: 319175 - protein, 9 aa, Influenza virus
QSAIDQITG

SEQ ID NO: 319176 - protein, 9 aa, Influenza virus
SAIDQITGK

SEQ ID NO: 319177 - protein, 9 aa, Influenza virus
AIDQITGKL

SEQ ID NO: 319178 - protein, 9 aa, Influenza virus
IDQITGKLN

SEQ ID NO: 319179 - protein, 9 aa, Influenza virus
DQITGKLNR

SEQ ID NO: 319180 - protein, 9 aa, Influenza virus
QITGKLNRL

SEQ ID NO: 319181 - protein, 9 aa, Influenza virus
ITGKLNRLI

SEQ ID NO: 319182 - protein, 9 aa, Influenza virus
TGKLNRLIG

SEQ ID NO: 319183 - protein, 9 aa, Influenza virus
GKLNRLIGK

SEQ ID NO: 319184 - protein, 9 aa, Influenza virus
KLNRLIGKT

SEQ ID NO: 319185 - protein, 9 aa, Influenza virus
LNRLIGKTN

SEQ ID NO: 319186 - protein, 9 aa, Influenza virus
NRLIGKTNQ

SEQ ID NO: 319187 - protein, 9 aa, Influenza virus
RLIGKTNQQ

SEQ ID NO: 319188 - protein, 9 aa, Influenza virus
LIGKTNQQF

SEQ ID NO: 319189 - protein, 9 aa, Influenza virus
IGKTNQQFE

SEQ ID NO: 319190 - protein, 9 aa, Influenza virus
GKTNQQFEL

SEQ ID NO: 319191 - protein, 9 aa, Influenza virus
KTNQQFELI

SEQ ID NO: 319192 - protein, 9 aa, Influenza virus
TNQQFELID

SEQ ID NO: 319193 - protein, 9 aa, Influenza virus
NQQFELIDN

SEQ ID NO: 319194 - protein, 9 aa, Influenza virus
QQFELIDNE

SEQ ID NO: 319195 - protein, 9 aa, Influenza virus
QFELIDNEF

SEQ ID NO: 319196 - protein, 9 aa, Influenza virus
FELIDNEFN

SEQ ID NO: 319197 - protein, 9 aa, Influenza virus
ELIDNEFNE

SEQ ID NO: 319198 - protein, 9 aa, Influenza virus
NEFNEIEQQ

SEQ ID NO: 319199 - protein, 9 aa, Influenza virus
EFNEIEQQI

SEQ ID NO: 319200 - protein, 9 aa, Influenza virus
FNEIEQQIG

SEQ ID NO: 319201 - protein, 9 aa, Influenza virus
NEIEQQIGN

SEQ ID NO: 319202 - protein, 9 aa, Influenza virus
EIEQQIGNV

SEQ ID NO: 319203 - protein, 9 aa, Influenza virus
IEQQIGNVI

SEQ ID NO: 319204 - protein, 9 aa, Influenza virus
EQQIGNVIN

SEQ ID NO: 319205 - protein, 9 aa, Influenza virus
QQIGNVINW

SEQ ID NO: 319206 - protein, 9 aa, Influenza virus
QIGNVINWT

SEQ ID NO: 319207 - protein, 9 aa, Influenza virus
IGNVINWTR

SEQ ID NO: 319208 - protein, 9 aa, Influenza virus
GNVINWTRD

SEQ ID NO: 319209 - protein, 9 aa, Influenza virus
NVINWTRDA

SEQ ID NO: 319210 - protein, 9 aa, Influenza virus
VINWTRDAM

SEQ ID NO: 319211 - protein, 9 aa, Influenza virus
INWTRDAMT

SEQ ID NO: 319212 - protein, 9 aa, Influenza virus
NWTRDAMTE

SEQ ID NO: 319213 - protein, 9 aa, Influenza virus
WTRDAMTEI

SEQ ID NO: 319214 - protein, 9 aa, Influenza virus
TRDAMTEIW

SEQ ID NO: 319215 - protein, 9 aa, Influenza virus
RDAMTEIWS

SEQ ID NO: 319216 - protein, 9 aa, Influenza virus
DAMTEIWSY

SEQ ID NO: 319217 - protein, 9 aa, Influenza virus
AMTEIWSYN

SEQ ID NO: 319218 - protein, 9 aa, Influenza virus
MTEIWSYNA

SEQ ID NO: 319219 - protein, 9 aa, Influenza virus
TEIWSYNAE

SEQ ID NO: 319220 - protein, 9 aa, Influenza virus
EIWSYNAEL

SEQ ID NO: 319221 - protein, 9 aa, Influenza virus
IWSYNAELL

SEQ ID NO: 319222 - protein, 9 aa, Influenza virus
WSYNAELLV

SEQ ID NO: 319223 - protein, 9 aa, Influenza virus
SYNAELLVA

SEQ ID NO: 319224 - protein, 9 aa, Influenza virus
YNAELLVAM

SEQ ID NO: 319225 - protein, 9 aa, Influenza virus
NAELLVAME

SEQ ID NO: 319226 - protein, 9 aa, Influenza virus
AELLVAMEN

SEQ ID NO: 319227 - protein, 9 aa, Influenza virus
ELLVAMENQ

SEQ ID NO: 319228 - protein, 9 aa, Influenza virus
LLVAMENQH

SEQ ID NO: 319229 - protein, 9 aa, Influenza virus
LVAMENQHT

SEQ ID NO: 319230 - protein, 9 aa, Influenza virus
VAMENQHTI

SEQ ID NO: 319231 - protein, 9 aa, Influenza virus
AMENQHTID

SEQ ID NO: 319232 - protein, 9 aa, Influenza virus
MENQHTIDL

SEQ ID NO: 319233 - protein, 9 aa, Influenza virus
ENQHTIDLA

SEQ ID NO: 319234 - protein, 9 aa, Influenza virus
NQHTIDLAD

SEQ ID NO: 319235 - protein, 9 aa, Influenza virus
QHTIDLADS

SEQ ID NO: 319236 - protein, 9 aa, Influenza virus
HTIDLADSE

SEQ ID NO: 319237 - protein, 9 aa, Influenza virus
TIDLADSEM

SEQ ID NO: 319238 - protein, 9 aa, Influenza virus
IDLADSEMS

SEQ ID NO: 319239 - protein, 9 aa, Influenza virus
DLADSEMSK

SEQ ID NO: 319240 - protein, 9 aa, Influenza virus
LADSEMSKL

SEQ ID NO: 319241 - protein, 9 aa, Influenza virus
ADSEMSKLY

SEQ ID NO: 319242 - protein, 9 aa, Influenza virus
DSEMSKLYE

SEQ ID NO: 319243 - protein, 9 aa, Influenza virus
SEMSKLYER

SEQ ID NO: 319244 - protein, 9 aa, Influenza virus
EMSKLYERV

SEQ ID NO: 319245 - protein, 9 aa, Influenza virus
MSKLYERVK

SEQ ID NO: 319246 - protein, 9 aa, Influenza virus
KLYERVKKQ

SEQ ID NO: 319247 - protein, 9 aa, Influenza virus
LYERVKKQL

SEQ ID NO: 319248 - protein, 9 aa, Influenza virus
YERVKKQLR

SEQ ID NO: 319249 - protein, 9 aa, Influenza virus
ERVKKQLRE

SEQ ID NO: 319250 - protein, 9 aa, Influenza virus
RVKKQLREN

SEQ ID NO: 319251 - protein, 9 aa, Influenza virus
VKKQLRENA

SEQ ID NO: 319252 - protein, 9 aa, Influenza virus
KKQLRENAE

SEQ ID NO: 319253 - protein, 9 aa, Influenza virus
KQLRENAEE

SEQ ID NO: 319254 - protein, 9 aa, Influenza virus
QLRENAEED

SEQ ID NO: 319255 - protein, 9 aa, Influenza virus
LRENAEEDG

SEQ ID NO: 319256 - protein, 9 aa, Influenza virus
RENAEEDGT

SEQ ID NO: 319257 - protein, 9 aa, Influenza virus
ENAEEDGTG

SEQ ID NO: 319258 - protein, 9 aa, Influenza virus
NAEEDGTGC

SEQ ID NO: 319259 - protein, 9 aa, Influenza virus
AEEDGTGCF

SEQ ID NO: 319260 - protein, 9 aa, Influenza virus
EEDGTGCFE

SEQ ID NO: 319261 - protein, 9 aa, Influenza virus
EDGTGCFEI

SEQ ID NO: 319262 - protein, 9 aa, Influenza virus
DGTGCFEIF

SEQ ID NO: 319263 - protein, 9 aa, Influenza virus
GTGCFEIFH

SEQ ID NO: 319264 - protein, 9 aa, Influenza virus
TGCFEIFHK

SEQ ID NO: 319265 - protein, 9 aa, Influenza virus
GCFEIFHKC

SEQ ID NO: 319266 - protein, 9 aa, Influenza virus
CFEIFHKCD

SEQ ID NO: 319267 - protein, 9 aa, Influenza virus
FEIFHKCDD

SEQ ID NO: 319268 - protein, 9 aa, Influenza virus
EIFHKCDDQ

SEQ ID NO: 319269 - protein, 9 aa, Influenza virus
IFHKCDDQC

SEQ ID NO: 319270 - protein, 9 aa, Influenza virus
FHKCDDQCM

SEQ ID NO: 319271 - protein, 9 aa, Influenza virus
HKCDDQCME

SEQ ID NO: 319272 - protein, 9 aa, Influenza virus
KCDDQCMES

SEQ ID NO: 319273 - protein, 9 aa, Influenza virus
CDDQCMESI

SEQ ID NO: 319274 - protein, 9 aa, Influenza virus
DDQCMESIR

SEQ ID NO: 319275 - protein, 9 aa, Influenza virus
DQCMESIRN

SEQ ID NO: 319276 - protein, 9 aa, Influenza virus
QCMESIRNN

SEQ ID NO: 319277 - protein, 9 aa, Influenza virus
CMESIRNNT

SEQ ID NO: 319278 - protein, 9 aa, Influenza virus
MESIRNNTY

SEQ ID NO: 319279 - protein, 9 aa, Influenza virus
ESIRNNTYD

SEQ ID NO: 319280 - protein, 9 aa, Influenza virus
SIRNNTYDH

SEQ ID NO: 319281 - protein, 9 aa, Influenza virus
IRNNTYDHT

SEQ ID NO: 319282 - protein, 9 aa, Influenza virus
RNNTYDHTQ

SEQ ID NO: 319283 - protein, 9 aa, Influenza virus
NNTYDHTQY

SEQ ID NO: 319284 - protein, 9 aa, Influenza virus
NTYDHTQYR

SEQ ID NO: 319285 - protein, 9 aa, Influenza virus
HTQYRTESL

SEQ ID NO: 319286 - protein, 9 aa, Influenza virus
QYRTESLQN

SEQ ID NO: 319287 - protein, 9 aa, Influenza virus
YRTESLQNR

SEQ ID NO: 319288 - protein, 9 aa, Influenza virus
RTESLQNRI

SEQ ID NO: 319289 - protein, 9 aa, Influenza virus
TESLQNRIQ

SEQ ID NO: 319290 - protein, 9 aa, Influenza virus
ESLQNRIQI

SEQ ID NO: 319291 - protein, 9 aa, Influenza virus
SLQNRIQID

SEQ ID NO: 319292 - protein, 9 aa, Influenza virus
LQNRIQIDP

SEQ ID NO: 319293 - protein, 9 aa, Influenza virus
QNRIQIDPV

SEQ ID NO: 319294 - protein, 9 aa, Influenza virus
NRIQIDPVK

SEQ ID NO: 319295 - protein, 9 aa, Influenza virus
RIQIDPVKL

SEQ ID NO: 319296 - protein, 9 aa, Influenza virus
IQIDPVKLS

SEQ ID NO: 319297 - protein, 9 aa, Influenza virus
QIDPVKLSS

SEQ ID NO: 319298 - protein, 9 aa, Influenza virus
IDPVKLSSG

SEQ ID NO: 319299 - protein, 9 aa, Influenza virus
DPVKLSSGY

SEQ ID NO: 319300 - protein, 9 aa, Influenza virus
PVKLSSGYK

SEQ ID NO: 319301 - protein, 9 aa, Influenza virus
VKLSSGYKD

SEQ ID NO: 319302 - protein, 9 aa, Influenza virus
KLSSGYKDI

SEQ ID NO: 319303 - protein, 9 aa, Influenza virus
LSSGYKDII

SEQ ID NO: 319304 - protein, 9 aa, Influenza virus
SSGYKDIIL

SEQ ID NO: 319305 - protein, 9 aa, Influenza virus
SGYKDIILW

SEQ ID NO: 319306 - protein, 9 aa, Influenza virus
GYKDIILWF

SEQ ID NO: 319307 - protein, 9 aa, Influenza virus
YKDIILWFS

SEQ ID NO: 319308 - protein, 9 aa, Influenza virus
KDIILWFSF

SEQ ID NO: 319309 - protein, 9 aa, Influenza virus
DIILWFSFG

SEQ ID NO: 319310 - protein, 9 aa, Influenza virus
IILWFSFGA

SEQ ID NO: 319311 - protein, 9 aa, Influenza virus
ILWFSFGAS

SEQ ID NO: 319312 - protein, 9 aa, Influenza virus
LWFSFGASC

SEQ ID NO: 319313 - protein, 9 aa, Influenza virus
WFSFGASCF

SEQ ID NO: 319314 - protein, 9 aa, Influenza virus
FSFGASCFL

SEQ ID NO: 319315 - protein, 9 aa, Influenza virus
SFGASCFLL

SEQ ID NO: 319316 - protein, 9 aa, Influenza virus
FGASCFLLL

SEQ ID NO: 319317 - protein, 9 aa, Influenza virus
GASCFLLLA

SEQ ID NO: 319318 - protein, 9 aa, Influenza virus
ASCFLLLAI

SEQ ID NO: 319319 - protein, 9 aa, Influenza virus
SCFLLLAIA

SEQ ID NO: 319320 - protein, 9 aa, Influenza virus
LLAIAMGLV

SEQ ID NO: 319321 - protein, 9 aa, Influenza virus
LAIAMGLVF

SEQ ID NO: 319322 - protein, 9 aa, Influenza virus
AIAMGLVFI

SEQ ID NO: 319323 - protein, 9 aa, Influenza virus
IAMGLVFIC

SEQ ID NO: 319324 - protein, 9 aa, Influenza virus
AMGLVFICI

SEQ ID NO: 319325 - protein, 9 aa, Influenza virus
MGLVFICIK

SEQ ID NO: 319326 - protein, 9 aa, Influenza virus
GLVFICIKN

SEQ ID NO: 319327 - protein, 9 aa, Influenza virus
LVFICIKNG

SEQ ID NO: 319328 - protein, 9 aa, Influenza virus
VFICIKNGN

SEQ ID NO: 319329 - protein, 9 aa, Influenza virus
FICIKNGNM

SEQ ID NO: 319330 - protein, 9 aa, Influenza virus
ICIKNGNMQ

SEQ ID NO: 319331 - protein, 9 aa, Influenza virus
CIKNGNMQC

SEQ ID NO: 319332 - protein, 9 aa, Influenza virus
IKNGNMQCT

SEQ ID NO: 319333 - protein, 9 aa, Influenza virus
KNGNMQCTI

SEQ ID NO: 319334 - protein, 9 aa, Influenza virus
NGNMQCTIC

SEQ ID NO: 319335 - protein, 9 aa, Influenza virus
GNMQCTICI

SEQ ID NO: 319336 - protein, 9 aa, Influenza virus
TCSALFVYS

SEQ ID NO: 319337 - protein, 9 aa, Influenza virus
CSALFVYSL

SEQ ID NO: 319338 - protein, 9 aa, Influenza virus
SALFVYSLR

SEQ ID NO: 319339 - protein, 9 aa, Influenza virus
ALFVYSLRK

SEQ ID NO: 319340 - protein, 9 aa, Influenza virus
MNPNQKIIT

SEQ ID NO: 319341 - protein, 9 aa, Influenza virus
NPNQKIITI

SEQ ID NO: 319342 - protein, 9 aa, Influenza virus
PNQKIITIG

SEQ ID NO: 319343 - protein, 9 aa, Influenza virus
NQKIITIGS

SEQ ID NO: 319344 - protein, 9 aa, Influenza virus
QKIITIGSV

SEQ ID NO: 319345 - protein, 9 aa, Influenza virus
KIITIGSVS

SEQ ID NO: 319346 - protein, 9 aa, Influenza virus
IITIGSVSL

SEQ ID NO: 319347 - protein, 9 aa, Influenza virus
ITIGSVSLT

SEQ ID NO: 319348 - protein, 9 aa, Influenza virus
TIGSVSLTI

SEQ ID NO: 319349 - protein, 9 aa, Influenza virus
IGSVSLTIA

SEQ ID NO: 319350 - protein, 9 aa, Influenza virus
GSVSLTIAT

SEQ ID NO: 319351 - protein, 9 aa, Influenza virus
CFLMQIAIL

SEQ ID NO: 319352 - protein, 9 aa, Influenza virus
ERNITEIVY

SEQ ID NO: 319353 - protein, 9 aa, Influenza virus
RNITEIVYL

SEQ ID NO: 319354 - protein, 9 aa, Influenza virus
NITEIVYLN

SEQ ID NO: 319355 - protein, 9 aa, Influenza virus
ITEIVYLNN

SEQ ID NO: 319356 - protein, 9 aa, Influenza virus
TEIVYLNNT

SEQ ID NO: 319357 - protein, 9 aa, Influenza virus
YRSWSKPQC

SEQ ID NO: 319358 - protein, 9 aa, Influenza virus
RSWSKPQCQ

SEQ ID NO: 319359 - protein, 9 aa, Influenza virus
SWSKPQCQI

SEQ ID NO: 319360 - protein, 9 aa, Influenza virus
WSKPQCQIT

SEQ ID NO: 319361 - protein, 9 aa, Influenza virus
SKPQCQITG

SEQ ID NO: 319362 - protein, 9 aa, Influenza virus
QCQITGFAP

SEQ ID NO: 319363 - protein, 9 aa, Influenza virus
GFAPFSKDN

SEQ ID NO: 319364 - protein, 9 aa, Influenza virus
FAPFSKDNS

SEQ ID NO: 319365 - protein, 9 aa, Influenza virus
APFSKDNSI

SEQ ID NO: 319366 - protein, 9 aa, Influenza virus
PFSKDNSIR

SEQ ID NO: 319367 - protein, 9 aa, Influenza virus
FSKDNSIRL

SEQ ID NO: 319368 - protein, 9 aa, Influenza virus
SKDNSIRLS

SEQ ID NO: 319369 - protein, 9 aa, Influenza virus
KDNSIRLSA

SEQ ID NO: 319370 - protein, 9 aa, Influenza virus
DNSIRLSAG

SEQ ID NO: 319371 - protein, 9 aa, Influenza virus
NSIRLSAGG

SEQ ID NO: 319372 - protein, 9 aa, Influenza virus
SIRLSAGGD

SEQ ID NO: 319373 - protein, 9 aa, Influenza virus
IRLSAGGDI

SEQ ID NO: 319374 - protein, 9 aa, Influenza virus
RLSAGGDIW

SEQ ID NO: 319375 - protein, 9 aa, Influenza virus
LSAGGDIWI

SEQ ID NO: 319376 - protein, 9 aa, Influenza virus
SAGGDIWIT

SEQ ID NO: 319377 - protein, 9 aa, Influenza virus
AGGDIWITR

SEQ ID NO: 319378 - protein, 9 aa, Influenza virus
GGDIWITRE

SEQ ID NO: 319379 - protein, 9 aa, Influenza virus
GDIWITREP

SEQ ID NO: 319380 - protein, 9 aa, Influenza virus
DIWITREPY

SEQ ID NO: 319381 - protein, 9 aa, Influenza virus
IWITREPYV

SEQ ID NO: 319382 - protein, 9 aa, Influenza virus
WITREPYVS

SEQ ID NO: 319383 - protein, 9 aa, Influenza virus
ITREPYVSC

SEQ ID NO: 319384 - protein, 9 aa, Influenza virus
TREPYVSCD

SEQ ID NO: 319385 - protein, 9 aa, Influenza virus
REPYVSCDT

SEQ ID NO: 319386 - protein, 9 aa, Influenza virus
SKCYQFALG

SEQ ID NO: 319387 - protein, 9 aa, Influenza virus
KCYQFALGQ

SEQ ID NO: 319388 - protein, 9 aa, Influenza virus
CYQFALGQG

SEQ ID NO: 319389 - protein, 9 aa, Influenza virus
YQFALGQGT

SEQ ID NO: 319390 - protein, 9 aa, Influenza virus
QFALGQGTT

SEQ ID NO: 319391 - protein, 9 aa, Influenza virus
FALGQGTTL

SEQ ID NO: 319392 - protein, 9 aa, Influenza virus
ALGQGTTLD

SEQ ID NO: 319393 - protein, 9 aa, Influenza virus
LGQGTTLDN

SEQ ID NO: 319394 - protein, 9 aa, Influenza virus
GQGTTLDNK

SEQ ID NO: 319395 - protein, 9 aa, Influenza virus
QGTTLDNKH

SEQ ID NO: 319396 - protein, 9 aa, Influenza virus
GTTLDNKHS

SEQ ID NO: 319397 - protein, 9 aa, Influenza virus
TTLDNKHSN

SEQ ID NO: 319398 - protein, 9 aa, Influenza virus
TLDNKHSNG

SEQ ID NO: 319399 - protein, 9 aa, Influenza virus
LDNKHSNGT

SEQ ID NO: 319400 - protein, 9 aa, Influenza virus
NKHSNGTIH

SEQ ID NO: 319401 - protein, 9 aa, Influenza virus
KHSNGTIHD

SEQ ID NO: 319402 - protein, 9 aa, Influenza virus
HSNGTIHDR

SEQ ID NO: 319403 - protein, 9 aa, Influenza virus
SNGTIHDRI

SEQ ID NO: 319404 - protein, 9 aa, Influenza virus
HDRIPHRTL

SEQ ID NO: 319405 - protein, 9 aa, Influenza virus
DRIPHRTLL

SEQ ID NO: 319406 - protein, 9 aa, Influenza virus
RIPHRTLLM

SEQ ID NO: 319407 - protein, 9 aa, Influenza virus
IPHRTLLMN

SEQ ID NO: 319408 - protein, 9 aa, Influenza virus
PHRTLLMNE

SEQ ID NO: 319409 - protein, 9 aa, Influenza virus
HRTLLMNEL

SEQ ID NO: 319410 - protein, 9 aa, Influenza virus
RTLLMNELG

SEQ ID NO: 319411 - protein, 9 aa, Influenza virus
TLLMNELGV

SEQ ID NO: 319412 - protein, 9 aa, Influenza virus
LLMNELGVP

SEQ ID NO: 319413 - protein, 9 aa, Influenza virus
LMNELGVPF

SEQ ID NO: 319414 - protein, 9 aa, Influenza virus
MNELGVPFH

SEQ ID NO: 319415 - protein, 9 aa, Influenza virus
NELGVPFHL

SEQ ID NO: 319416 - protein, 9 aa, Influenza virus
ELGVPFHLG

SEQ ID NO: 319417 - protein, 9 aa, Influenza virus
LGVPFHLGT

SEQ ID NO: 319418 - protein, 9 aa, Influenza virus
GVPFHLGTK

SEQ ID NO: 319419 - protein, 9 aa, Influenza virus
VPFHLGTKQ

SEQ ID NO: 319420 - protein, 9 aa, Influenza virus
PFHLGTKQV

SEQ ID NO: 319421 - protein, 9 aa, Influenza virus
FHLGTKQVC

SEQ ID NO: 319422 - protein, 9 aa, Influenza virus
HLGTKQVCI

SEQ ID NO: 319423 - protein, 9 aa, Influenza virus
LGTKQVCIA

SEQ ID NO: 319424 - protein, 9 aa, Influenza virus
GTKQVCIAW

SEQ ID NO: 319425 - protein, 9 aa, Influenza virus
TKQVCIAWS

SEQ ID NO: 319426 - protein, 9 aa, Influenza virus
KQVCIAWSS

SEQ ID NO: 319427 - protein, 9 aa, Influenza virus
QVCIAWSSS

SEQ ID NO: 319428 - protein, 9 aa, Influenza virus
VCIAWSSSS

SEQ ID NO: 319429 - protein, 9 aa, Influenza virus
CIAWSSSSC

SEQ ID NO: 319430 - protein, 9 aa, Influenza virus
IAWSSSSCH

SEQ ID NO: 319431 - protein, 9 aa, Influenza virus
AWSSSSCHD

SEQ ID NO: 319432 - protein, 9 aa, Influenza virus
WSSSSCHDG

SEQ ID NO: 319433 - protein, 9 aa, Influenza virus
SSSSCHDGK

SEQ ID NO: 319434 - protein, 9 aa, Influenza virus
SSSCHDGKA

SEQ ID NO: 319435 - protein, 9 aa, Influenza virus
SSCHDGKAW

SEQ ID NO: 319436 - protein, 9 aa, Influenza virus
SCHDGKAWL

SEQ ID NO: 319437 - protein, 9 aa, Influenza virus
CHDGKAWLH

SEQ ID NO: 319438 - protein, 9 aa, Influenza virus
HDGKAWLHV

SEQ ID NO: 319439 - protein, 9 aa, Influenza virus
DGKAWLHVC

SEQ ID NO: 319440 - protein, 9 aa, Influenza virus
GKAWLHVCV

SEQ ID NO: 319441 - protein, 9 aa, Influenza virus
KAWLHVCVT

SEQ ID NO: 319442 - protein, 9 aa, Influenza virus
AWLHVCVTG

SEQ ID NO: 319443 - protein, 9 aa, Influenza virus
WLHVCVTGD

SEQ ID NO: 319444 - protein, 9 aa, Influenza virus
LHVCVTGDD

SEQ ID NO: 319445 - protein, 9 aa, Influenza virus
HVCVTGDDR

SEQ ID NO: 319446 - protein, 9 aa, Influenza virus
VCVTGDDRN

SEQ ID NO: 319447 - protein, 9 aa, Influenza virus
CVTGDDRNA

SEQ ID NO: 319448 - protein, 9 aa, Influenza virus
VTGDDRNAT

SEQ ID NO: 319449 - protein, 9 aa, Influenza virus
TGDDRNATA

SEQ ID NO: 319450 - protein, 9 aa, Influenza virus
GDDRNATAS

SEQ ID NO: 319451 - protein, 9 aa, Influenza virus
DDRNATASF

SEQ ID NO: 319452 - protein, 9 aa, Influenza virus
DRNATASFI

SEQ ID NO: 319453 - protein, 9 aa, Influenza virus
RNATASFIY

SEQ ID NO: 319454 - protein, 9 aa, Influenza virus
NATASFIYN

SEQ ID NO: 319455 - protein, 9 aa, Influenza virus
ATASFIYNG

SEQ ID NO: 319456 - protein, 9 aa, Influenza virus
LVDSIGSWS

SEQ ID NO: 319457 - protein, 9 aa, Influenza virus
VDSIGSWSQ

SEQ ID NO: 319458 - protein, 9 aa, Influenza virus
DSIGSWSQN

SEQ ID NO: 319459 - protein, 9 aa, Influenza virus
SIGSWSQNI

SEQ ID NO: 319460 - protein, 9 aa, Influenza virus
IGSWSQNIL

SEQ ID NO: 319461 - protein, 9 aa, Influenza virus
GSWSQNILR

SEQ ID NO: 319462 - protein, 9 aa, Influenza virus
SWSQNILRT

SEQ ID NO: 319463 - protein, 9 aa, Influenza virus
WSQNILRTQ

SEQ ID NO: 319464 - protein, 9 aa, Influenza virus
SQNILRTQE

SEQ ID NO: 319465 - protein, 9 aa, Influenza virus
QNILRTQES

SEQ ID NO: 319466 - protein, 9 aa, Influenza virus
NILRTQESE

SEQ ID NO: 319467 - protein, 9 aa, Influenza virus
ILRTQESEC

SEQ ID NO: 319468 - protein, 9 aa, Influenza virus
LRTQESECV

SEQ ID NO: 319469 - protein, 9 aa, Influenza virus
RTQESECVC

SEQ ID NO: 319470 - protein, 9 aa, Influenza virus
TQESECVCI

SEQ ID NO: 319471 - protein, 9 aa, Influenza virus
QESECVCIN

SEQ ID NO: 319472 - protein, 9 aa, Influenza virus
ESECVCING

SEQ ID NO: 319473 - protein, 9 aa, Influenza virus
SECVCINGS

SEQ ID NO: 319474 - protein, 9 aa, Influenza virus
ECVCINGSC

SEQ ID NO: 319475 - protein, 9 aa, Influenza virus
CVCINGSCT

SEQ ID NO: 319476 - protein, 9 aa, Influenza virus
VCINGSCTV

SEQ ID NO: 319477 - protein, 9 aa, Influenza virus
CINGSCTVV

SEQ ID NO: 319478 - protein, 9 aa, Influenza virus
INGSCTVVM

SEQ ID NO: 319479 - protein, 9 aa, Influenza virus
NGSCTVVMT

SEQ ID NO: 319480 - protein, 9 aa, Influenza virus
GSCTVVMTD

SEQ ID NO: 319481 - protein, 9 aa, Influenza virus
SCTVVMTDG

SEQ ID NO: 319482 - protein, 9 aa, Influenza virus
CTVVMTDGS

SEQ ID NO: 319483 - protein, 9 aa, Influenza virus
TVVMTDGSA

SEQ ID NO: 319484 - protein, 9 aa, Influenza virus
VVMTDGSAS

SEQ ID NO: 319485 - protein, 9 aa, Influenza virus
VMTDGSASG

SEQ ID NO: 319486 - protein, 9 aa, Influenza virus
MTDGSASGK

SEQ ID NO: 319487 - protein, 9 aa, Influenza virus
TDGSASGKA

SEQ ID NO: 319488 - protein, 9 aa, Influenza virus
DGSASGKAD

SEQ ID NO: 319489 - protein, 9 aa, Influenza virus
GSASGKADT

SEQ ID NO: 319490 - protein, 9 aa, Influenza virus
ASGKADTRI

SEQ ID NO: 319491 - protein, 9 aa, Influenza virus
EGKIVHISP

SEQ ID NO: 319492 - protein, 9 aa, Influenza virus
GKIVHISPL

SEQ ID NO: 319493 - protein, 9 aa, Influenza virus
KIVHISPLS

SEQ ID NO: 319494 - protein, 9 aa, Influenza virus
IVHISPLSG

SEQ ID NO: 319495 - protein, 9 aa, Influenza virus
VHISPLSGS

SEQ ID NO: 319496 - protein, 9 aa, Influenza virus
HISPLSGSA

SEQ ID NO: 319497 - protein, 9 aa, Influenza virus
ISPLSGSAQ

SEQ ID NO: 319498 - protein, 9 aa, Influenza virus
SPLSGSAQH

SEQ ID NO: 319499 - protein, 9 aa, Influenza virus
PLSGSAQHI

SEQ ID NO: 319500 - protein, 9 aa, Influenza virus
LSGSAQHIE

SEQ ID NO: 319501 - protein, 9 aa, Influenza virus
SGSAQHIEE

SEQ ID NO: 319502 - protein, 9 aa, Influenza virus
GSAQHIEEC

SEQ ID NO: 319503 - protein, 9 aa, Influenza virus
SAQHIEECS

SEQ ID NO: 319504 - protein, 9 aa, Influenza virus
AQHIEECSC

SEQ ID NO: 319505 - protein, 9 aa, Influenza virus
QHIEECSCY

SEQ ID NO: 319506 - protein, 9 aa, Influenza virus
HIEECSCYP

SEQ ID NO: 319507 - protein, 9 aa, Influenza virus
IEECSCYPR

SEQ ID NO: 319508 - protein, 9 aa, Influenza virus
EECSCYPRY

SEQ ID NO: 319509 - protein, 9 aa, Influenza virus
ECSCYPRYP

SEQ ID NO: 319510 - protein, 9 aa, Influenza virus
CSCYPRYPN

SEQ ID NO: 319511 - protein, 9 aa, Influenza virus
SCYPRYPNV

SEQ ID NO: 319512 - protein, 9 aa, Influenza virus
CYPRYPNVR

SEQ ID NO: 319513 - protein, 9 aa, Influenza virus
YPRYPNVRC

SEQ ID NO: 319514 - protein, 9 aa, Influenza virus
PRYPNVRCV

SEQ ID NO: 319515 - protein, 9 aa, Influenza virus
RYPNVRCVC

SEQ ID NO: 319516 - protein, 9 aa, Influenza virus
YPNVRCVCR

SEQ ID NO: 319517 - protein, 9 aa, Influenza virus
PNVRCVCRD

SEQ ID NO: 319518 - protein, 9 aa, Influenza virus
NVRCVCRDN

SEQ ID NO: 319519 - protein, 9 aa, Influenza virus
VRCVCRDNW

SEQ ID NO: 319520 - protein, 9 aa, Influenza virus
RCVCRDNWK

SEQ ID NO: 319521 - protein, 9 aa, Influenza virus
CVCRDNWKG

SEQ ID NO: 319522 - protein, 9 aa, Influenza virus
VCRDNWKGS

SEQ ID NO: 319523 - protein, 9 aa, Influenza virus
CRDNWKGSN

SEQ ID NO: 319524 - protein, 9 aa, Influenza virus
RDNWKGSNR

SEQ ID NO: 319525 - protein, 9 aa, Influenza virus
DNWKGSNRP

SEQ ID NO: 319526 - protein, 9 aa, Influenza virus
NWKGSNRPV

SEQ ID NO: 319527 - protein, 9 aa, Influenza virus
WKGSNRPVI

SEQ ID NO: 319528 - protein, 9 aa, Influenza virus
KGSNRPVID

SEQ ID NO: 319529 - protein, 9 aa, Influenza virus
GSNRPVIDI

SEQ ID NO: 319530 - protein, 9 aa, Influenza virus
SNRPVIDIN

SEQ ID NO: 319531 - protein, 9 aa, Influenza virus
NRPVIDINM

SEQ ID NO: 319532 - protein, 9 aa, Influenza virus
IDSSYVCSG

SEQ ID NO: 319533 - protein, 9 aa, Influenza virus
DSSYVCSGL

SEQ ID NO: 319534 - protein, 9 aa, Influenza virus
SSYVCSGLV

SEQ ID NO: 319535 - protein, 9 aa, Influenza virus
SYVCSGLVG

SEQ ID NO: 319536 - protein, 9 aa, Influenza virus
YVCSGLVGD

SEQ ID NO: 319537 - protein, 9 aa, Influenza virus
VCSGLVGDT

SEQ ID NO: 319538 - protein, 9 aa, Influenza virus
CSGLVGDTP

SEQ ID NO: 319539 - protein, 9 aa, Influenza virus
SGLVGDTPR

SEQ ID NO: 319540 - protein, 9 aa, Influenza virus
GLVGDTPRN

SEQ ID NO: 319541 - protein, 9 aa, Influenza virus
LVGDTPRNE

SEQ ID NO: 319542 - protein, 9 aa, Influenza virus
VGDTPRNED

SEQ ID NO: 319543 - protein, 9 aa, Influenza virus
GDTPRNEDG

SEQ ID NO: 319544 - protein, 9 aa, Influenza virus
DTPRNEDGS

SEQ ID NO: 319545 - protein, 9 aa, Influenza virus
TPRNEDGSS

SEQ ID NO: 319546 - protein, 9 aa, Influenza virus
PRNEDGSSS

SEQ ID NO: 319547 - protein, 9 aa, Influenza virus
RNEDGSSSS

SEQ ID NO: 319548 - protein, 9 aa, Influenza virus
NEDGSSSSN

SEQ ID NO: 319549 - protein, 9 aa, Influenza virus
EDGSSSSNC

SEQ ID NO: 319550 - protein, 9 aa, Influenza virus
SSSNCRDPN

SEQ ID NO: 319551 - protein, 9 aa, Influenza virus
SNCRDPNEE

SEQ ID NO: 319552 - protein, 9 aa, Influenza virus
DPNEERGNP

SEQ ID NO: 319553 - protein, 9 aa, Influenza virus
PNEERGNPG

SEQ ID NO: 319554 - protein, 9 aa, Influenza virus
NEERGNPGV

SEQ ID NO: 319555 - protein, 9 aa, Influenza virus
EERGNPGVK

SEQ ID NO: 319556 - protein, 9 aa, Influenza virus
ERGNPGVKG

SEQ ID NO: 319557 - protein, 9 aa, Influenza virus
RGNPGVKGW

SEQ ID NO: 319558 - protein, 9 aa, Influenza virus
GNPGVKGWA

SEQ ID NO: 319559 - protein, 9 aa, Influenza virus
NPGVKGWAF

SEQ ID NO: 319560 - protein, 9 aa, Influenza virus
PGVKGWAFD

SEQ ID NO: 319561 - protein, 9 aa, Influenza virus
GVKGWAFDS

SEQ ID NO: 319562 - protein, 9 aa, Influenza virus
VKGWAFDSG

SEQ ID NO: 319563 - protein, 9 aa, Influenza virus
KGWAFDSGD

SEQ ID NO: 319564 - protein, 9 aa, Influenza virus
GWAFDSGDD

SEQ ID NO: 319565 - protein, 9 aa, Influenza virus
SGDDVWMGR

SEQ ID NO: 319566 - protein, 9 aa, Influenza virus
GDDVWMGRT

SEQ ID NO: 319567 - protein, 9 aa, Influenza virus
DDVWMGRTI

SEQ ID NO: 319568 - protein, 9 aa, Influenza virus
DVWMGRTIS

SEQ ID NO: 319569 - protein, 9 aa, Influenza virus
VWMGRTISR

SEQ ID NO: 319570 - protein, 9 aa, Influenza virus
WMGRTISRD

SEQ ID NO: 319571 - protein, 9 aa, Influenza virus
MGRTISRDS

SEQ ID NO: 319572 - protein, 9 aa, Influenza virus
GRTISRDSR

SEQ ID NO: 319573 - protein, 9 aa, Influenza virus
RTISRDSRS

SEQ ID NO: 319574 - protein, 9 aa, Influenza virus
TISRDSRSG

SEQ ID NO: 319575 - protein, 9 aa, Influenza virus
ISRDSRSGY

SEQ ID NO: 319576 - protein, 9 aa, Influenza virus
SRDSRSGYE

SEQ ID NO: 319577 - protein, 9 aa, Influenza virus
RDSRSGYET

SEQ ID NO: 319578 - protein, 9 aa, Influenza virus
DSRSGYETF

SEQ ID NO: 319579 - protein, 9 aa, Influenza virus
SRSGYETFR

SEQ ID NO: 319580 - protein, 9 aa, Influenza virus
RSGYETFRV

SEQ ID NO: 319581 - protein, 9 aa, Influenza virus
SGYETFRVI

SEQ ID NO: 319582 - protein, 9 aa, Influenza virus
GYETFRVIG

SEQ ID NO: 319583 - protein, 9 aa, Influenza virus
YETFRVIGG

SEQ ID NO: 319584 - protein, 9 aa, Influenza virus
ETFRVIGGW

SEQ ID NO: 319585 - protein, 9 aa, Influenza virus
TFRVIGGWT

SEQ ID NO: 319586 - protein, 9 aa, Influenza virus
VIGGWTTAN

SEQ ID NO: 319587 - protein, 9 aa, Influenza virus
IGGWTTANS

SEQ ID NO: 319588 - protein, 9 aa, Influenza virus
GGWTTANSK

SEQ ID NO: 319589 - protein, 9 aa, Influenza virus
GWTTANSKS

SEQ ID NO: 319590 - protein, 9 aa, Influenza virus
WTTANSKSQ

SEQ ID NO: 319591 - protein, 9 aa, Influenza virus
RQVIVDNNN

SEQ ID NO: 319592 - protein, 9 aa, Influenza virus
QVIVDNNNW

SEQ ID NO: 319593 - protein, 9 aa, Influenza virus
IVDNNNWSG

SEQ ID NO: 319594 - protein, 9 aa, Influenza virus
VDNNNWSGY

SEQ ID NO: 319595 - protein, 9 aa, Influenza virus
DNNNWSGYS

SEQ ID NO: 319596 - protein, 9 aa, Influenza virus
NNNWSGYSG

SEQ ID NO: 319597 - protein, 9 aa, Influenza virus
NNWSGYSGI

SEQ ID NO: 319598 - protein, 9 aa, Influenza virus
NWSGYSGIF

SEQ ID NO: 319599 - protein, 9 aa, Influenza virus
WSGYSGIFS

SEQ ID NO: 319600 - protein, 9 aa, Influenza virus
SGYSGIFSV

SEQ ID NO: 319601 - protein, 9 aa, Influenza virus
GYSGIFSVE

SEQ ID NO: 319602 - protein, 9 aa, Influenza virus
KSCINRCFY

SEQ ID NO: 319603 - protein, 9 aa, Influenza virus
SCINRCFYV

SEQ ID NO: 319604 - protein, 9 aa, Influenza virus
CINRCFYVE

SEQ ID NO: 319605 - protein, 9 aa, Influenza virus
INRCFYVEL

SEQ ID NO: 319606 - protein, 9 aa, Influenza virus
NRCFYVELI

SEQ ID NO: 319607 - protein, 9 aa, Influenza virus
RCFYVELIR

SEQ ID NO: 319608 - protein, 9 aa, Influenza virus
CFYVELIRG

SEQ ID NO: 319609 - protein, 9 aa, Influenza virus
FYVELIRGR

SEQ ID NO: 319610 - protein, 9 aa, Influenza virus
YVELIRGRP

SEQ ID NO: 319611 - protein, 9 aa, Influenza virus
VELIRGRPK

SEQ ID NO: 319612 - protein, 9 aa, Influenza virus
ELIRGRPKE

SEQ ID NO: 319613 - protein, 9 aa, Influenza virus
LIRGRPKET

SEQ ID NO: 319614 - protein, 9 aa, Influenza virus
PKETRVWWT

SEQ ID NO: 319615 - protein, 9 aa, Influenza virus
KETRVWWTS

SEQ ID NO: 319616 - protein, 9 aa, Influenza virus
ETRVWWTSN

SEQ ID NO: 319617 - protein, 9 aa, Influenza virus
TRVWWTSNS

SEQ ID NO: 319618 - protein, 9 aa, Influenza virus
RVWWTSNSI

SEQ ID NO: 319619 - protein, 9 aa, Influenza virus
VWWTSNSIV

SEQ ID NO: 319620 - protein, 9 aa, Influenza virus
WWTSNSIVV

SEQ ID NO: 319621 - protein, 9 aa, Influenza virus
WTSNSIVVF

SEQ ID NO: 319622 - protein, 9 aa, Influenza virus
TSNSIVVFC

SEQ ID NO: 319623 - protein, 9 aa, Influenza virus
SNSIVVFCG

SEQ ID NO: 319624 - protein, 9 aa, Influenza virus
NSIVVFCGT

SEQ ID NO: 319625 - protein, 9 aa, Influenza virus
SIVVFCGTS

SEQ ID NO: 319626 - protein, 9 aa, Influenza virus
IVVFCGTSG

SEQ ID NO: 319627 - protein, 9 aa, Influenza virus
VVFCGTSGT

SEQ ID NO: 319628 - protein, 9 aa, Influenza virus
VFCGTSGTY

SEQ ID NO: 319629 - protein, 9 aa, Influenza virus
FCGTSGTYG

SEQ ID NO: 319630 - protein, 9 aa, Influenza virus
CGTSGTYGT

SEQ ID NO: 319631 - protein, 9 aa, Influenza virus
GTSGTYGTG

SEQ ID NO: 319632 - protein, 9 aa, Influenza virus
TSGTYGTGS

SEQ ID NO: 319633 - protein, 9 aa, Influenza virus
SGTYGTGSW

SEQ ID NO: 319634 - protein, 9 aa, Influenza virus
GTYGTGSWP

SEQ ID NO: 319635 - protein, 9 aa, Influenza virus
TYGTGSWPD

SEQ ID NO: 319636 - protein, 9 aa, Influenza virus
YGTGSWPDG

SEQ ID NO: 319637 - protein, 9 aa, Influenza virus
GTGSWPDGA

SEQ ID NO: 319638 - protein, 9 aa, Influenza virus
TGSWPDGAN

SEQ ID NO: 319639 - protein, 9 aa, Influenza virus
GSWPDGANI

SEQ ID NO: 319640 - protein, 9 aa, Influenza virus
SWPDGANIN

SEQ ID NO: 319641 - protein, 9 aa, Influenza virus
WPDGANINF

SEQ ID NO: 319642 - protein, 9 aa, Influenza virus
PDGANINFM

SEQ ID NO: 319643 - protein, 9 aa, Influenza virus
DGANINFMP

SEQ ID NO: 319644 - protein, 9 aa, Influenza virus
SKSRGYKMN

SEQ ID NO: 319645 - protein, 9 aa, Influenza virus
KSRGYKMNT

SEQ ID NO: 319646 - protein, 9 aa, Influenza virus
SRGYKMNNQ

SEQ ID NO: 319647 - protein, 9 aa, Influenza virus
RGYKMNTQI

SEQ ID NO: 319648 - protein, 9 aa, Influenza virus
GYKMNTQIL

SEQ ID NO: 319649 - protein, 9 aa, Influenza virus
YKMNTQILV

SEQ ID NO: 319650 - protein, 9 aa, Influenza virus
KMNTQILVF

SEQ ID NO: 319651 - protein, 9 aa, Influenza virus
GDKICLGHH

SEQ ID NO: 319652 - protein, 9 aa, Influenza virus
DKICLGHHA

SEQ ID NO: 319653 - protein, 9 aa, Influenza virus
KICLGHHAV

SEQ ID NO: 319654 - protein, 9 aa, Influenza virus
ICLGHHAVA

SEQ ID NO: 319655 - protein, 9 aa, Influenza virus
CLGHHAVAN

SEQ ID NO: 319656 - protein, 9 aa, Influenza virus
LGHHAVANG

SEQ ID NO: 319657 - protein, 9 aa, Influenza virus
GHHAVANGT

SEQ ID NO: 319658 - protein, 9 aa, Influenza virus
HHAVANGTK

SEQ ID NO: 319659 - protein, 9 aa, Influenza virus
HAVANGTKV

SEQ ID NO: 319660 - protein, 9 aa, Influenza virus
NGTKVNTLT

SEQ ID NO: 319661 - protein, 9 aa, Influenza virus
GTKVNTLTE

SEQ ID NO: 319662 - protein, 9 aa, Influenza virus
VNTLTERGI

SEQ ID NO: 319663 - protein, 9 aa, Influenza virus
NTLTERGIE

SEQ ID NO: 319664 - protein, 9 aa, Influenza virus
TLTERGIEV

SEQ ID NO: 319665 - protein, 9 aa, Influenza virus
LTERGIEVV

SEQ ID NO: 319666 - protein, 9 aa, Influenza virus
TERGIEVVN

SEQ ID NO: 319667 - protein, 9 aa, Influenza virus
ERGIEVVNA

SEQ ID NO: 319668 - protein, 9 aa, Influenza virus
RGIEVVNAT

SEQ ID NO: 319669 - protein, 9 aa, Influenza virus
GIEVVNATE

SEQ ID NO: 319670 - protein, 9 aa, Influenza virus
IEVVNATET

SEQ ID NO: 319671 - protein, 9 aa, Influenza virus
EVVNATETV

SEQ ID NO: 319672 - protein, 9 aa, Influenza virus
VVNATETVE

SEQ ID NO: 319673 - protein, 9 aa, Influenza virus
VNATETVET

SEQ ID NO: 319674 - protein, 9 aa, Influenza virus
TDLGQCGLL

SEQ ID NO: 319675 - protein, 9 aa, Influenza virus
DLGQCGLLG

SEQ ID NO: 319676 - protein, 9 aa, Influenza virus
LGQCGLLGT

SEQ ID NO: 319677 - protein, 9 aa, Influenza virus
GQCGLLGTL

SEQ ID NO: 319678 - protein, 9 aa, Influenza virus
CGLLGTLIG

SEQ ID NO: 319679 - protein, 9 aa, Influenza virus
GLLGTLIGP

SEQ ID NO: 319680 - protein, 9 aa, Influenza virus
LLGTLIGPP

SEQ ID NO: 319681 - protein, 9 aa, Influenza virus
LGTLIGPPQ

SEQ ID NO: 319682 - protein, 9 aa, Influenza virus
GTLIGPPQC

SEQ ID NO: 319683 - protein, 9 aa, Influenza virus
TLIGPPQCD

SEQ ID NO: 319684 - protein, 9 aa, Influenza virus
IGPPQCDQF

SEQ ID NO: 319685 - protein, 9 aa, Influenza virus
GPPQCDQFL

SEQ ID NO: 319686 - protein, 9 aa, Influenza virus
PPQCDQFLE

SEQ ID NO: 319687 - protein, 9 aa, Influenza virus
PQCDQFLEF

SEQ ID NO: 319688 - protein, 9 aa, Influenza virus
DLIIERREG

SEQ ID NO: 319689 - protein, 9 aa, Influenza virus
DVCYPGKFT

SEQ ID NO: 319690 - protein, 9 aa, Influenza virus
VCYPGKFTN

SEQ ID NO: 319691 - protein, 9 aa, Influenza virus
LRQILRGSG

SEQ ID NO: 319692 - protein, 9 aa, Influenza virus
RQILRGSGG

SEQ ID NO: 319693 - protein, 9 aa, Influenza virus
QILRGSGGI

SEQ ID NO: 319694 - protein, 9 aa, Influenza virus
GFTYSGIRT

SEQ ID NO: 319695 - protein, 9 aa, Influenza virus
GSSFYAEMK

SEQ ID NO: 319696 - protein, 9 aa, Influenza virus
SSSFYAEMK

SEQ ID NO: 319697 - protein, 9 aa, Influenza virus
SSFYAEMKW

SEQ ID NO: 319698 - protein, 9 aa, Influenza virus
SFYAEMKWL

SEQ ID NO: 319699 - protein, 9 aa, Influenza virus
FYAEMKWLL

SEQ ID NO: 319700 - protein, 9 aa, Influenza virus
YAEMKWLLS

SEQ ID NO: 319701 - protein, 9 aa, Influenza virus
AEMKWLLSN

SEQ ID NO: 319702 - protein, 9 aa, Influenza virus
EMKWLLSNS

SEQ ID NO: 319703 - protein, 9 aa, Influenza virus
MKWLLSNSD

SEQ ID NO: 319704 - protein, 9 aa, Influenza virus
KWLLSNSDN

SEQ ID NO: 319705 - protein, 9 aa, Influenza virus
PALIIWGVH

SEQ ID NO: 319706 - protein, 9 aa, Influenza virus
ALIIWGVHH

SEQ ID NO: 319707 - protein, 9 aa, Influenza virus
LIIWGVHHS

SEQ ID NO: 319708 - protein, 9 aa, Influenza virus
EQTKLYGSG

SEQ ID NO: 319709 - protein, 9 aa, Influenza virus
KLYGSGNKL

SEQ ID NO: 319710 - protein, 9 aa, Influenza virus
LYGSGNKLI

SEQ ID NO: 319711 - protein, 9 aa, Influenza virus
YGSGNKLIT

SEQ ID NO: 319712 - protein, 9 aa, Influenza virus
GSGNKLITV

SEQ ID NO: 319713 - protein, 9 aa, Influenza virus
SSKYQQSFT

SEQ ID NO: 319714 - protein, 9 aa, Influenza virus
SKYQQSFTP

SEQ ID NO: 319715 - protein, 9 aa, Influenza virus
KYQQSFTPS

SEQ ID NO: 319716 - protein, 9 aa, Influenza virus
YQQSFTPSP

SEQ ID NO: 319717 - protein, 9 aa, Influenza virus
QQSFTPSPG

SEQ ID NO: 319718 - protein, 9 aa, Influenza virus
QSFTPSPGA

SEQ ID NO: 319719 - protein, 9 aa, Influenza virus
SFTPSPGAR

SEQ ID NO: 319720 - protein, 9 aa, Influenza virus
QVNGQSGRI

SEQ ID NO: 319721 - protein, 9 aa, Influenza virus
VNGQSGRID

SEQ ID NO: 319722 - protein, 9 aa, Influenza virus
NGQSGRIDF

SEQ ID NO: 319723 - protein, 9 aa, Influenza virus
GQSGRIDFH

SEQ ID NO: 319724 - protein, 9 aa, Influenza virus
QSGRIDFHW

SEQ ID NO: 319725 - protein, 9 aa, Influenza virus
SGRIDFHWL

SEQ ID NO: 319726 - protein, 9 aa, Influenza virus
FHWLLLDPN

SEQ ID NO: 319727 - protein, 9 aa, Influenza virus
WLLLDPNDT

SEQ ID NO: 319728 - protein, 9 aa, Influenza virus
LLDPNDTVT

SEQ ID NO: 319729 - protein, 9 aa, Influenza virus
LDPNDTVTF

SEQ ID NO: 319730 - protein, 9 aa, Influenza virus
NDTVTFTFN

SEQ ID NO: 319731 - protein, 9 aa, Influenza virus
DTVTFTFNG

SEQ ID NO: 319732 - protein, 9 aa, Influenza virus
FTFNGAFIA

SEQ ID NO: 319733 - protein, 9 aa, Influenza virus
TFNGAFIAP

SEQ ID NO: 319734 - protein, 9 aa, Influenza virus
FNGAFIAPD

SEQ ID NO: 319735 - protein, 9 aa, Influenza virus
NGAFIAPDR

SEQ ID NO: 319736 - protein, 9 aa, Influenza virus
GAFIAPDRA

SEQ ID NO: 319737 - protein, 9 aa, Influenza virus
AFIAPDRAS

SEQ ID NO: 319738 - protein, 9 aa, Influenza virus
FIAPDRASF

SEQ ID NO: 319739 - protein, 9 aa, Influenza virus
IAPDRASFF

SEQ ID NO: 319740 - protein, 9 aa, Influenza virus
GGTIVSSLP

SEQ ID NO: 319741 - protein, 9 aa, Influenza virus
GTIVSSLPF

SEQ ID NO: 319742 - protein, 9 aa, Influenza virus
TIVSSLPFQ

SEQ ID NO: 319743 - protein, 9 aa, Influenza virus
IVSSLPFQN

SEQ ID NO: 319744 - protein, 9 aa, Influenza virus
VSSLPFQNI

SEQ ID NO: 319745 - protein, 9 aa, Influenza virus
SSLPFQNIN

SEQ ID NO: 319746 - protein, 9 aa, Influenza virus
SLPFQNINP

SEQ ID NO: 319747 - protein, 9 aa, Influenza virus
LPFQNINPR

SEQ ID NO: 319748 - protein, 9 aa, Influenza virus
PFQNINPRT

SEQ ID NO: 319749 - protein, 9 aa, Influenza virus
VGKCPRYVK

SEQ ID NO: 319750 - protein, 9 aa, Influenza virus
GKCPRYVKQ

SEQ ID NO: 319751 - protein, 9 aa, Influenza virus
SLLLATGMR

SEQ ID NO: 319752 - protein, 9 aa, Influenza virus
LLLATGMRN

SEQ ID NO: 319753 - protein, 9 aa, Influenza virus
LLATGMRNV

SEQ ID NO: 319754 - protein, 9 aa, Influenza virus
LATGMRNVP

SEQ ID NO: 319755 - protein, 9 aa, Influenza virus
ATGMRNVPE

SEQ ID NO: 319756 - protein, 9 aa, Influenza virus
TGMRNVPEN

SEQ ID NO: 319757 - protein, 9 aa, Influenza virus
GMRNVPENP

SEQ ID NO: 319758 - protein, 9 aa, Influenza virus
MRNVPENPK

SEQ ID NO: 319759 - protein, 9 aa, Influenza virus
CSPLSRCRE

SEQ ID NO: 319760 - protein, 9 aa, Influenza virus
RKRGLFGAI

SEQ ID NO: 319761 - protein, 9 aa, Influenza virus
LSRCRETRG

SEQ ID NO: 319762 - protein, 9 aa, Influenza virus
SRCRETRGL

SEQ ID NO: 319763 - protein, 9 aa, Influenza virus
RCRETRGLF

SEQ ID NO: 319764 - protein, 9 aa, Influenza virus
CRETRGLFG

SEQ ID NO: 319765 - protein, 9 aa, Influenza virus
RETRGLFGA

SEQ ID NO: 319766 - protein, 9 aa, Influenza virus
MTRGLFGAI

SEQ ID NO: 319767 - protein, 9 aa, Influenza virus
TRGLFGAIA

SEQ ID NO: 319768 - protein, 9 aa, Influenza virus
TKPRPRRGL

SEQ ID NO: 319769 - protein, 9 aa, Influenza virus
KPRPRRGLF

SEQ ID NO: 319770 - protein, 9 aa, Influenza virus
PRPRRGLFG

SEQ ID NO: 319771 - protein, 9 aa, Influenza virus
RPRRGLFGA

SEQ ID NO: 319772 - protein, 9 aa, Influenza virus
PRRGLFGAI

SEQ ID NO: 319773 - protein, 9 aa, Influenza virus
RRGLFGAIA

SEQ ID NO: 319774 - protein, 9 aa, Influenza virus
RGLFGAIAG

SEQ ID NO: 319775 - protein, 9 aa, Influenza virus
GLFGAIAGF

SEQ ID NO: 319776 - protein, 9 aa, Influenza virus
LFGAIAGFI

SEQ ID NO: 319777 - protein, 9 aa, Influenza virus
FGAIAGFIE

SEQ ID NO: 319778 - protein, 9 aa, Influenza virus
GAIAGFIEN

SEQ ID NO: 319779 - protein, 9 aa, Influenza virus
AIAGFIENG

SEQ ID NO: 319780 - protein, 9 aa, Influenza virus
IAGFIENGW

SEQ ID NO: 319781 - protein, 9 aa, Influenza virus
AGFIENGWE

SEQ ID NO: 319782 - protein, 9 aa, Influenza virus
GFIENGWEG

SEQ ID NO: 319783 - protein, 9 aa, Influenza virus
FIENGWEGL

SEQ ID NO: 319784 - protein, 9 aa, Influenza virus
IENGWEGLI

SEQ ID NO: 319785 - protein, 9 aa, Influenza virus
ENGWEGLID

SEQ ID NO: 319786 - protein, 9 aa, Influenza virus
NGWEGLIDG

SEQ ID NO: 319787 - protein, 9 aa, Influenza virus
GWEGLIDGW

SEQ ID NO: 319788 - protein, 9 aa, Influenza virus
WEGLIDGWY

SEQ ID NO: 319789 - protein, 9 aa, Influenza virus
EGLIDGWYG

SEQ ID NO: 319790 - protein, 9 aa, Influenza virus
GLIDGWYGF

SEQ ID NO: 319791 - protein, 9 aa, Influenza virus
LIDGWYGFR

SEQ ID NO: 319792 - protein, 9 aa, Influenza virus
IDGWYGFRH

SEQ ID NO: 319793 - protein, 9 aa, Influenza virus
DGWYGFRHQ

SEQ ID NO: 319794 - protein, 9 aa, Influenza virus
GWYGFRHQN

SEQ ID NO: 319795 - protein, 9 aa, Influenza virus
WYGFRHQNA

SEQ ID NO: 319796 - protein, 9 aa, Influenza virus
YGFRHQNAQ

SEQ ID NO: 319797 - protein, 9 aa, Influenza virus
GFRHQNAQG

SEQ ID NO: 319798 - protein, 9 aa, Influenza virus
FRHQNAQGE

SEQ ID NO: 319799 - protein, 9 aa, Influenza virus
RHQNAQGEG

SEQ ID NO: 319800 - protein, 9 aa, Influenza virus
HQNAQGEGT

SEQ ID NO: 319801 - protein, 9 aa, Influenza virus
QNAQGEGTA

SEQ ID NO: 319802 - protein, 9 aa, Influenza virus
NAQGEGTAA

SEQ ID NO: 319803 - protein, 9 aa, Influenza virus
AQGEGTAAD

SEQ ID NO: 319804 - protein, 9 aa, Influenza virus
QGEGTAADY

SEQ ID NO: 319805 - protein, 9 aa, Influenza virus
GEGTAADYK

SEQ ID NO: 319806 - protein, 9 aa, Influenza virus
EGTAADYKS

SEQ ID NO: 319807 - protein, 9 aa, Influenza virus
GTAADYKST

SEQ ID NO: 319808 - protein, 9 aa, Influenza virus
TAADYKSTQ

SEQ ID NO: 319809 - protein, 9 aa, Influenza virus
AADYKSTQS

SEQ ID NO: 319810 - protein, 9 aa, Influenza virus
ADYKSTQSA

SEQ ID NO: 319811 - protein, 9 aa, Influenza virus
DYKSTQSAI

SEQ ID NO: 319812 - protein, 9 aa, Influenza virus
YKSTQSAID

SEQ ID NO: 319813 - protein, 9 aa, Influenza virus
KSTQSAIDQ

SEQ ID NO: 319814 - protein, 9 aa, Influenza virus
STQSAIDQI

SEQ ID NO: 319815 - protein, 9 aa, Influenza virus
TQSAIDQIT

SEQ ID NO: 319816 - protein, 9 aa, Influenza virus
QSAIDQITG

SEQ ID NO: 319817 - protein, 9 aa, Influenza virus
SAIDQITGK

SEQ ID NO: 319818 - protein, 9 aa, Influenza virus
AIDQITGKL

SEQ ID NO: 319819 - protein, 9 aa, Influenza virus
IDQITGKLN

SEQ ID NO: 319820 - protein, 9 aa, Influenza virus
DQITGKLNR

SEQ ID NO: 319821 - protein, 9 aa, Influenza virus
QITGKLNRL

SEQ ID NO: 319822 - protein, 9 aa, Influenza virus
ITGKLNRLI

SEQ ID NO: 319823 - protein, 9 aa, Influenza virus
TGKLNRLID

SEQ ID NO: 319824 - protein, 9 aa, Influenza virus
GKLNRLIDK

SEQ ID NO: 319825 - protein, 9 aa, Influenza virus
KLNRLIDKT

SEQ ID NO: 319826 - protein, 9 aa, Influenza virus
LNRLIDKTN

SEQ ID NO: 319827 - protein, 9 aa, Influenza virus
NRLIDKTNQ

SEQ ID NO: 319828 - protein, 9 aa, Influenza virus
RLIDKTNQQ

SEQ ID NO: 319829 - protein, 9 aa, Influenza virus
LIDKTNQQF

SEQ ID NO: 319830 - protein, 9 aa, Influenza virus
IDKTNQQFE

SEQ ID NO: 319831 - protein, 9 aa, Influenza virus
DKTNQQFEL

SEQ ID NO: 319832 - protein, 9 aa, Influenza virus
KTNQQFELI

SEQ ID NO: 319833 - protein, 9 aa, Influenza virus
TNQQFELID

SEQ ID NO: 319834 - protein, 9 aa, Influenza virus
NQQFELIDN

SEQ ID NO: 319835 - protein, 9 aa, Influenza virus
QQFELIDNE

SEQ ID NO: 319836 - protein, 9 aa, Influenza virus
QFELIDNEF

SEQ ID NO: 319837 - protein, 9 aa, Influenza virus
IDNEFNEIE

SEQ ID NO: 319838 - protein, 9 aa, Influenza virus
FNEIEQQIG

SEQ ID NO: 319839 - protein, 9 aa, Influenza virus
NEIEQQIGN

SEQ ID NO: 319840 - protein, 9 aa, Influenza virus
EIEQQIGNV

SEQ ID NO: 319841 - protein, 9 aa, Influenza virus
IEQQIGNVI

SEQ ID NO: 319842 - protein, 9 aa, Influenza virus
EQQIGNVIN

SEQ ID NO: 319843 - protein, 9 aa, Influenza virus
QQIGNVINW

SEQ ID NO: 319844 - protein, 9 aa, Influenza virus
QIGNVINWT

SEQ ID NO: 319845 - protein, 9 aa, Influenza virus
IGNVINWTR

SEQ ID NO: 319846 - protein, 9 aa, Influenza virus
GNVINWTRD

SEQ ID NO: 319847 - protein, 9 aa, Influenza virus
NVINWTRDS

SEQ ID NO: 319848 - protein, 9 aa, Influenza virus
VINWTRDSM

SEQ ID NO: 319849 - protein, 9 aa, Influenza virus
INWTRDSMT

SEQ ID NO: 319850 - protein, 9 aa, Influenza virus
NWTRDSMTE

SEQ ID NO: 319851 - protein, 9 aa, Influenza virus
WTRDSMTEV

SEQ ID NO: 319852 - protein, 9 aa, Influenza virus
TRDSMTEVW

SEQ ID NO: 319853 - protein, 9 aa, Influenza virus
RDSMTEVWS

SEQ ID NO: 319854 - protein, 9 aa, Influenza virus
DSMTEVWSY

SEQ ID NO: 319855 - protein, 9 aa, Influenza virus
SMTEVWSYN

SEQ ID NO: 319856 - protein, 9 aa, Influenza virus
MTEVWSYNA

SEQ ID NO: 319857 - protein, 9 aa, Influenza virus
TEVWSYNAE

SEQ ID NO: 319858 - protein, 9 aa, Influenza virus
EVWSYNAEL

SEQ ID NO: 319859 - protein, 9 aa, Influenza virus
VWSYNAELL

SEQ ID NO: 319860 - protein, 9 aa, Influenza virus
WSYNAELLV

SEQ ID NO: 319861 - protein, 9 aa, Influenza virus
SYNAELLVA

SEQ ID NO: 319862 - protein, 9 aa, Influenza virus
YNAELLVAM

SEQ ID NO: 319863 - protein, 9 aa, Influenza virus
NAELLVAME

SEQ ID NO: 319864 - protein, 9 aa, Influenza virus
AELLVAMEN

SEQ ID NO: 319865 - protein, 9 aa, Influenza virus
ELLVAMENQ

SEQ ID NO: 319866 - protein, 9 aa, Influenza virus
LLVAMENQH

SEQ ID NO: 319867 - protein, 9 aa, Influenza virus
LVAMENQHT

SEQ ID NO: 319868 - protein, 9 aa, Influenza virus
VAMENQHTI

SEQ ID NO: 319869 - protein, 9 aa, Influenza virus
AMENQHTID

SEQ ID NO: 319870 - protein, 9 aa, Influenza virus
MENQHTIDL

SEQ ID NO: 319871 - protein, 9 aa, Influenza virus
ENQHTIDLA

SEQ ID NO: 319872 - protein, 9 aa, Influenza virus
NQHTIDLAD

SEQ ID NO: 319873 - protein, 9 aa, Influenza virus
QHTIDLADS

SEQ ID NO: 319874 - protein, 9 aa, Influenza virus
HTIDLADSE

SEQ ID NO: 319875 - protein, 9 aa, Influenza virus
TIDLADSEM

SEQ ID NO: 319876 - protein, 9 aa, Influenza virus
IDLADSEMN

SEQ ID NO: 319877 - protein, 9 aa, Influenza virus
DLADSEMNK

SEQ ID NO: 319878 - protein, 9 aa, Influenza virus
LADSEMNKL

SEQ ID NO: 319879 - protein, 9 aa, Influenza virus
ADSEMNKLY

SEQ ID NO: 319880 - protein, 9 aa, Influenza virus
DSEMNKLYE

SEQ ID NO: 319881 - protein, 9 aa, Influenza virus
SEMNKLYER

SEQ ID NO: 319882 - protein, 9 aa, Influenza virus
EMNKLYERV

SEQ ID NO: 319883 - protein, 9 aa, Influenza virus
KLYERVRKQ

SEQ ID NO: 319884 - protein, 9 aa, Influenza virus
LYERVRKQL

SEQ ID NO: 319885 - protein, 9 aa, Influenza virus
YERVRKQLR

SEQ ID NO: 319886 - protein, 9 aa, Influenza virus
ERVRKQLRE

SEQ ID NO: 319887 - protein, 9 aa, Influenza virus
RVRKQLREN

SEQ ID NO: 319888 - protein, 9 aa, Influenza virus
VRKQLRENA

SEQ ID NO: 319889 - protein, 9 aa, Influenza virus
RKQLRENAE

SEQ ID NO: 319890 - protein, 9 aa, Influenza virus
KQLRENAEE

SEQ ID NO: 319891 - protein, 9 aa, Influenza virus
QLRENAEED

SEQ ID NO: 319892 - protein, 9 aa, Influenza virus
LRENAEEDG

SEQ ID NO: 319893 - protein, 9 aa, Influenza virus
RENAEEDGT

SEQ ID NO: 319894 - protein, 9 aa, Influenza virus
ENAEEDGTG

SEQ ID NO: 319895 - protein, 9 aa, Influenza virus
NAEEDGTGC

SEQ ID NO: 319896 - protein, 9 aa, Influenza virus
AEEDGTGCF

SEQ ID NO: 319897 - protein, 9 aa, Influenza virus
EEDGTGCFE

SEQ ID NO: 319898 - protein, 9 aa, Influenza virus
EDGTGCFEI

SEQ ID NO: 319899 - protein, 9 aa, Influenza virus
DGTGCFEIF

SEQ ID NO: 319900 - protein, 9 aa, Influenza virus
GTGCFEIFH

SEQ ID NO: 319901 - protein, 9 aa, Influenza virus
TGCFEIFHK

SEQ ID NO: 319902 - protein, 9 aa, Influenza virus
GCFEIFHKC

SEQ ID NO: 319903 - protein, 9 aa, Influenza virus
CFEIFHKCD

SEQ ID NO: 319904 - protein, 9 aa, Influenza virus
FEIFHKCDD

SEQ ID NO: 319905 - protein, 9 aa, Influenza virus
CMESIRNNT

SEQ ID NO: 319906 - protein, 9 aa, Influenza virus
MESIRNNTY

SEQ ID NO: 319907 - protein, 9 aa, Influenza virus
ESIRNNTYD

SEQ ID NO: 319908 - protein, 9 aa, Influenza virus
SIRNNTYDH

SEQ ID NO: 319909 - protein, 9 aa, Influenza virus
IRNNTYDHT

SEQ ID NO: 319910 - protein, 9 aa, Influenza virus
QYRTESLQN

SEQ ID NO: 319911 - protein, 9 aa, Influenza virus
YRTESLQNR

SEQ ID NO: 319912 - protein, 9 aa, Influenza virus
RTESLQNRI

SEQ ID NO: 319913 - protein, 9 aa, Influenza virus
ESLQNRIQI

SEQ ID NO: 319914 - protein, 9 aa, Influenza virus
QNRIQIDPV

SEQ ID NO: 319915 - protein, 9 aa, Influenza virus
NRIQIDPVK

SEQ ID NO: 319916 - protein, 9 aa, Influenza virus
RIQIDPVKL

SEQ ID NO: 319917 - protein, 9 aa, Influenza virus
DPVKLSSGY

SEQ ID NO: 319918 - protein, 9 aa, Influenza virus
PVKLSSGYK

SEQ ID NO: 319919 - protein, 9 aa, Influenza virus
VKLSSGYKD

SEQ ID NO: 319920 - protein, 9 aa, Influenza virus
SSGYKDIIL

SEQ ID NO: 319921 - protein, 9 aa, Influenza virus
SGYKDIILW

SEQ ID NO: 319922 - protein, 9 aa, Influenza virus
GYKDIILWF

SEQ ID NO: 319923 - protein, 9 aa, Influenza virus
YKDIILWFS

SEQ ID NO: 319924 - protein, 9 aa, Influenza virus
KDIILWFSF

SEQ ID NO: 319925 - protein, 9 aa, Influenza virus
DIILWFSFG

SEQ ID NO: 319926 - protein, 9 aa, Influenza virus
IILWFSFGA

SEQ ID NO: 319927 - protein, 9 aa, Influenza virus
ILWFSFGAS

SEQ ID NO: 319928 - protein, 9 aa, Influenza virus
LWFSFGASC

SEQ ID NO: 319929 - protein, 9 aa, Influenza virus
WFSFGASCF

SEQ ID NO: 319930 - protein, 9 aa, Influenza virus
FSFGASCFL

SEQ ID NO: 319931 - protein, 9 aa, Influenza virus
SFGASCFLL

SEQ ID NO: 319932 - protein, 9 aa, Influenza virus
FGASCFLLL

SEQ ID NO: 319933 - protein, 9 aa, Influenza virus
GASCFLLLA

SEQ ID NO: 319934 - protein, 9 aa, Influenza virus
ASCFLLLAI

SEQ ID NO: 319935 - protein, 9 aa, Influenza virus
FICIKNGNM

SEQ ID NO: 319936 - protein, 9 aa, Influenza virus
ICIKNGNMR

SEQ ID NO: 319937 - protein, 9 aa, Influenza virus
CIKNGNMRC

SEQ ID NO: 319938 - protein, 9 aa, Influenza virus
IKNGNMRCT

SEQ ID NO: 319939 - protein, 9 aa, Influenza virus
KNGNMRCTI

SEQ ID NO: 319940 - protein, 9 aa, Influenza virus
NGNMRCTIC

SEQ ID NO: 319941 - protein, 9 aa, Influenza virus
GNMRCTICI

SEQ ID NO: 319942 - protein, 9 aa, Influenza virus
GVVNTTLST

SEQ ID NO: 319943 - protein, 9 aa, Influenza virus
VVNTTLSTI

SEQ ID NO: 319944 - protein, 9 aa, Influenza virus
VNTTLSTIA

SEQ ID NO: 319945 - protein, 9 aa, Influenza virus
NTTLSTIAL

SEQ ID NO: 319946 - protein, 9 aa, Influenza virus
TTLSTIALL

SEQ ID NO: 319947 - protein, 9 aa, Influenza virus
TLSTIALLI

SEQ ID NO: 319948 - protein, 9 aa, Influenza virus
LSTIALLIG

SEQ ID NO: 319949 - protein, 9 aa, Influenza virus
STIALLIGV

SEQ ID NO: 319950 - protein, 9 aa, Influenza virus
TIALLIGVG

SEQ ID NO: 319951 - protein, 9 aa, Influenza virus
IALLIGVGN

SEQ ID NO: 319952 - protein, 9 aa, Influenza virus
ALLIGVGNL

SEQ ID NO: 319953 - protein, 9 aa, Influenza virus
IGVGNLVFN

SEQ ID NO: 319954 - protein, 9 aa, Influenza virus
GVGNLVFNT

SEQ ID NO: 319955 - protein, 9 aa, Influenza virus
VGNLVFNTV

SEQ ID NO: 319956 - protein, 9 aa, Influenza virus
GNLVFNTVI

SEQ ID NO: 319957 - protein, 9 aa, Influenza virus
NLVFNTVIH

SEQ ID NO: 319958 - protein, 9 aa, Influenza virus
LVFNTVIHE

SEQ ID NO: 319959 - protein, 9 aa, Influenza virus
ITYNNTVIN

SEQ ID NO: 319960 - protein, 9 aa, Influenza virus
TYNNTVINN

SEQ ID NO: 319961 - protein, 9 aa, Influenza virus
YNNTVINNI

SEQ ID NO: 319962 - protein, 9 aa, Influenza virus
NNTVINNIT

SEQ ID NO: 319963 - protein, 9 aa, Influenza virus
NTVINNITT

SEQ ID NO: 319964 - protein, 9 aa, Influenza virus
TVINNITTT

SEQ ID NO: 319965 - protein, 9 aa, Influenza virus
VINNITTTI

SEQ ID NO: 319966 - protein, 9 aa, Influenza virus
INNITTTII

SEQ ID NO: 319967 - protein, 9 aa, Influenza virus
NNITTTIIT

SEQ ID NO: 319968 - protein, 9 aa, Influenza virus
FKSPLPLCP

SEQ ID NO: 319969 - protein, 9 aa, Influenza virus
KSPLPLCPF

SEQ ID NO: 319970 - protein, 9 aa, Influenza virus
PLPLCPFRG

SEQ ID NO: 319971 - protein, 9 aa, Influenza virus
LPLCPFRGF

SEQ ID NO: 319972 - protein, 9 aa, Influenza virus
PLCPFRGFF

SEQ ID NO: 319973 - protein, 9 aa, Influenza virus
LCPFRGFFP

SEQ ID NO: 319974 - protein, 9 aa, Influenza virus
CPFRGFFPF

SEQ ID NO: 319975 - protein, 9 aa, Influenza virus
PFRGFFPFH

SEQ ID NO: 319976 - protein, 9 aa, Influenza virus
FRGFFPFHK

SEQ ID NO: 319977 - protein, 9 aa, Influenza virus
RGFFPFHKD

SEQ ID NO: 319978 - protein, 9 aa, Influenza virus
GFFPFHKDN

SEQ ID NO: 319979 - protein, 9 aa, Influenza virus
FFPFHKDNA

SEQ ID NO: 319980 - protein, 9 aa, Influenza virus
FPFHKDNAI

SEQ ID NO: 319981 - protein, 9 aa, Influenza virus
PFHKDNAIR

SEQ ID NO: 319982 - protein, 9 aa, Influenza virus
FHKDNAIRL

SEQ ID NO: 319983 - protein, 9 aa, Influenza virus
HKDNAIRLG

SEQ ID NO: 319984 - protein, 9 aa, Influenza virus
KDNAIRLGE

SEQ ID NO: 319985 - protein, 9 aa, Influenza virus
DNAIRLGEN

SEQ ID NO: 319986 - protein, 9 aa, Influenza virus
NAIRLGENK

SEQ ID NO: 319987 - protein, 9 aa, Influenza virus
DVIVTREPY

SEQ ID NO: 319988 - protein, 9 aa, Influenza virus
VIVTREPYV

SEQ ID NO: 319989 - protein, 9 aa, Influenza virus
IVTREPYVS

SEQ ID NO: 319990 - protein, 9 aa, Influenza virus
VTREPYVSC

SEQ ID NO: 319991 - protein, 9 aa, Influenza virus
TREPYVSCD

SEQ ID NO: 319992 - protein, 9 aa, Influenza virus
REPYVSCDN

SEQ ID NO: 319993 - protein, 9 aa, Influenza virus
NCWSFALAQ

SEQ ID NO: 319994 - protein, 9 aa, Influenza virus
CWSFALAQG

SEQ ID NO: 319995 - protein, 9 aa, Influenza virus
WSFALAQGA

SEQ ID NO: 319996 - protein, 9 aa, Influenza virus
SFALAQGAL

SEQ ID NO: 319997 - protein, 9 aa, Influenza virus
FALAQGALL

SEQ ID NO: 319998 - protein, 9 aa, Influenza virus
ALAQGALLG

SEQ ID NO: 319999 - protein, 9 aa, Influenza virus
LAQGALLGT

SEQ ID NO: 320000 - protein, 9 aa, Influenza virus
AQGALLGTK

SEQ ID NO: 320001 - protein, 9 aa, Influenza virus
QGALLGTKH

SEQ ID NO: 320002 - protein, 9 aa, Influenza virus
GALLGTKHS

SEQ ID NO: 320003 - protein, 9 aa, Influenza virus
ALLGTKHSN

SEQ ID NO: 320004 - protein, 9 aa, Influenza virus
LLGTKHSNG

SEQ ID NO: 320005 - protein, 9 aa, Influenza virus
LGTKHSNGT

SEQ ID NO: 320006 - protein, 9 aa, Influenza virus
HSNGTIKDR

SEQ ID NO: 320007 - protein, 9 aa, Influenza virus
KDRTPYRSL

SEQ ID NO: 320008 - protein, 9 aa, Influenza virus
DRTPYRSLI

SEQ ID NO: 320009 - protein, 9 aa, Influenza virus
RTPYRSLIR

SEQ ID NO: 320010 - protein, 9 aa, Influenza virus
TPYRSLIRF

SEQ ID NO: 320011 - protein, 9 aa, Influenza virus
PYRSLIRFP

SEQ ID NO: 320012 - protein, 9 aa, Influenza virus
YRSLIRFPI

SEQ ID NO: 320013 - protein, 9 aa, Influenza virus
RSLIRFPIG

SEQ ID NO: 320014 - protein, 9 aa, Influenza virus
SLIRFPIGT

SEQ ID NO: 320015 - protein, 9 aa, Influenza virus
LIRFPIGTA

SEQ ID NO: 320016 - protein, 9 aa, Influenza virus
IRFPIGTAP

SEQ ID NO: 320017 - protein, 9 aa, Influenza virus
FPIGTAPVL

SEQ ID NO: 320018 - protein, 9 aa, Influenza virus
PIGTAPVLG

SEQ ID NO: 320019 - protein, 9 aa, Influenza virus
IGTAPVLGN

SEQ ID NO: 320020 - protein, 9 aa, Influenza virus
GTAPVLGNY

SEQ ID NO: 320021 - protein, 9 aa, Influenza virus
TAPVLGNYK

SEQ ID NO: 320022 - protein, 9 aa, Influenza virus
APVLGNYKE

SEQ ID NO: 320023 - protein, 9 aa, Influenza virus
PVLGNYKEI

SEQ ID NO: 320024 - protein, 9 aa, Influenza virus
VLGNYKEIC

SEQ ID NO: 320025 - protein, 9 aa, Influenza virus
LGNYKEICI

SEQ ID NO: 320026 - protein, 9 aa, Influenza virus
GNYKEICIA

SEQ ID NO: 320027 - protein, 9 aa, Influenza virus
NYKEICIAW

SEQ ID NO: 320028 - protein, 9 aa, Influenza virus
YKEICIAWS

SEQ ID NO: 320029 - protein, 9 aa, Influenza virus
KEICIAWSS

SEQ ID NO: 320030 - protein, 9 aa, Influenza virus
EICIAWSSS

SEQ ID NO: 320031 - protein, 9 aa, Influenza virus
ICIAWSSSS

SEQ ID NO: 320032 - protein, 9 aa, Influenza virus
CIAWSSSSC

SEQ ID NO: 320033 - protein, 9 aa, Influenza virus
IAWSSSSCF

SEQ ID NO: 320034 - protein, 9 aa, Influenza virus
AWSSSSCFD

SEQ ID NO: 320035 - protein, 9 aa, Influenza virus
WSSSSCFDG

SEQ ID NO: 320036 - protein, 9 aa, Influenza virus
SSSSCFDGK

SEQ ID NO: 320037 - protein, 9 aa, Influenza virus
SSSCFDGKE

SEQ ID NO: 320038 - protein, 9 aa, Influenza virus
SSCFDGKEW

SEQ ID NO: 320039 - protein, 9 aa, Influenza virus
SCFDGKEWM

SEQ ID NO: 320040 - protein, 9 aa, Influenza virus
CFDGKEWMH

SEQ ID NO: 320041 - protein, 9 aa, Influenza virus
FDGKEWMHV

SEQ ID NO: 320042 - protein, 9 aa, Influenza virus
DGKEWMHVC

SEQ ID NO: 320043 - protein, 9 aa, Influenza virus
GKEWMHVCM

SEQ ID NO: 320044 - protein, 9 aa, Influenza virus
KEWMHVCMT

SEQ ID NO: 320045 - protein, 9 aa, Influenza virus
EWMHVCMTG

SEQ ID NO: 320046 - protein, 9 aa, Influenza virus
GRMTDSIKS

SEQ ID NO: 320047 - protein, 9 aa, Influenza virus
RMTDSIKSW

SEQ ID NO: 320048 - protein, 9 aa, Influenza virus
MTDSIKSWR

SEQ ID NO: 320049 - protein, 9 aa, Influenza virus
TDSIKSWRK

SEQ ID NO: 320050 - protein, 9 aa, Influenza virus
DSIKSWRKD

SEQ ID NO: 320051 - protein, 9 aa, Influenza virus
SIKSWRKDI

SEQ ID NO: 320052 - protein, 9 aa, Influenza virus
IKSWRKDIL

SEQ ID NO: 320053 - protein, 9 aa, Influenza virus
KSWRKDILR

SEQ ID NO: 320054 - protein, 9 aa, Influenza virus
SWRKDILRT

SEQ ID NO: 320055 - protein, 9 aa, Influenza virus
WRKDILRTQ

SEQ ID NO: 320056 - protein, 9 aa, Influenza virus
RKDILRTQE

SEQ ID NO: 320057 - protein, 9 aa, Influenza virus
KDILRTQES

SEQ ID NO: 320058 - protein, 9 aa, Influenza virus
DILRTQESE

SEQ ID NO: 320059 - protein, 9 aa, Influenza virus
ILRTQESEC

SEQ ID NO: 320060 - protein, 9 aa, Influenza virus
LRTQESECQ

SEQ ID NO: 320061 - protein, 9 aa, Influenza virus
RTQESECQC

SEQ ID NO: 320062 - protein, 9 aa, Influenza virus
TQESECQCI

SEQ ID NO: 320063 - protein, 9 aa, Influenza virus
QESECQCID

SEQ ID NO: 320064 - protein, 9 aa, Influenza virus
ESECQCIDG

SEQ ID NO: 320065 - protein, 9 aa, Influenza virus
GTCVVAVTD

SEQ ID NO: 320066 - protein, 9 aa, Influenza virus
TCVVAVTDG

SEQ ID NO: 320067 - protein, 9 aa, Influenza virus
CVVAVTDGP

SEQ ID NO: 320068 - protein, 9 aa, Influenza virus
VVAVTDGPA

SEQ ID NO: 320069 - protein, 9 aa, Influenza virus
VAVTDGPAA

SEQ ID NO: 320070 - protein, 9 aa, Influenza virus
AVTDGPAAN

SEQ ID NO: 320071 - protein, 9 aa, Influenza virus
VTDGPAANS

SEQ ID NO: 320072 - protein, 9 aa, Influenza virus
TDGPAANSA

SEQ ID NO: 320073 - protein, 9 aa, Influenza virus
DGPAANSAD

SEQ ID NO: 320074 - protein, 9 aa, Influenza virus
GPAANSADH

SEQ ID NO: 320075 - protein, 9 aa, Influenza virus
PAANSADHR

SEQ ID NO: 320076 - protein, 9 aa, Influenza virus
AANSADHRV

SEQ ID NO: 320077 - protein, 9 aa, Influenza virus
ANSADHRVY

SEQ ID NO: 320078 - protein, 9 aa, Influenza virus
NSADHRVYW

SEQ ID NO: 320079 - protein, 9 aa, Influenza virus
SADHRVYWI

SEQ ID NO: 320080 - protein, 9 aa, Influenza virus
ADHRVYWIR

SEQ ID NO: 320081 - protein, 9 aa, Influenza virus
DHRVYWIRE

SEQ ID NO: 320082 - protein, 9 aa, Influenza virus
HRVYWIREG

SEQ ID NO: 320083 - protein, 9 aa, Influenza virus
RVYWIREGR

SEQ ID NO: 320084 - protein, 9 aa, Influenza virus
KIQHLEECS

SEQ ID NO: 320085 - protein, 9 aa, Influenza virus
IQHLEECSC

SEQ ID NO: 320086 - protein, 9 aa, Influenza virus
QHLEECSCY

SEQ ID NO: 320087 - protein, 9 aa, Influenza virus
HLEECSCYV

SEQ ID NO: 320088 - protein, 9 aa, Influenza virus
LEECSCYVD

SEQ ID NO: 320089 - protein, 9 aa, Influenza virus
EECSCYVDI

SEQ ID NO: 320090 - protein, 9 aa, Influenza virus
ECSCYVDID

SEQ ID NO: 320091 - protein, 9 aa, Influenza virus
CSCYVDIDV

SEQ ID NO: 320092 - protein, 9 aa, Influenza virus
SCYVDIDVY

SEQ ID NO: 320093 - protein, 9 aa, Influenza virus
CYVDIDVYC

SEQ ID NO: 320094 - protein, 9 aa, Influenza virus
DIDVYCICR

SEQ ID NO: 320095 - protein, 9 aa, Influenza virus
IDVYCICRD

SEQ ID NO: 320096 - protein, 9 aa, Influenza virus
DVYCICRDN

SEQ ID NO: 320097 - protein, 9 aa, Influenza virus
VYCICRDNW

SEQ ID NO: 320098 - protein, 9 aa, Influenza virus
YCICRDNWK

SEQ ID NO: 320099 - protein, 9 aa, Influenza virus
CICRDNWKG

SEQ ID NO: 320100 - protein, 9 aa, Influenza virus
ICRDNWKGS

SEQ ID NO: 320101 - protein, 9 aa, Influenza virus
CRDNWKGSN

SEQ ID NO: 320102 - protein, 9 aa, Influenza virus
RDNWKGSNR

SEQ ID NO: 320103 - protein, 9 aa, Influenza virus
DNWKGSNRP

SEQ ID NO: 320104 - protein, 9 aa, Influenza virus
NWKGSNRPW

SEQ ID NO: 320105 - protein, 9 aa, Influenza virus
WKGSNRPWM

SEQ ID NO: 320106 - protein, 9 aa, Influenza virus
KGSNRPWMR

SEQ ID NO: 320107 - protein, 9 aa, Influenza virus
GSNRPWMRI

SEQ ID NO: 320108 - protein, 9 aa, Influenza virus
SNRPWMRIN

SEQ ID NO: 320109 - protein, 9 aa, Influenza virus
NRPWMRINN

SEQ ID NO: 320110 - protein, 9 aa, Influenza virus
RPWMRINNE

SEQ ID NO: 320111 - protein, 9 aa, Influenza virus
PWMRINNET

SEQ ID NO: 320112 - protein, 9 aa, Influenza virus
WMRINNETI

SEQ ID NO: 320113 - protein, 9 aa, Influenza virus
MRINNETIL

SEQ ID NO: 320114 - protein, 9 aa, Influenza virus
RINNETILE

SEQ ID NO: 320115 - protein, 9 aa, Influenza virus
INNETILET

SEQ ID NO: 320116 - protein, 9 aa, Influenza virus
NNETILETG

SEQ ID NO: 320117 - protein, 9 aa, Influenza virus
NETILETGY

SEQ ID NO: 320118 - protein, 9 aa, Influenza virus
ETILETGYV

SEQ ID NO: 320119 - protein, 9 aa, Influenza virus
TILETGYVC

SEQ ID NO: 320120 - protein, 9 aa, Influenza virus
ILETGYVCS

SEQ ID NO: 320121 - protein, 9 aa, Influenza virus
LETGYVCSK

SEQ ID NO: 320122 - protein, 9 aa, Influenza virus
ETGYVCSKF

SEQ ID NO: 320123 - protein, 9 aa, Influenza virus
TGYVCSKFH

SEQ ID NO: 320124 - protein, 9 aa, Influenza virus
GYVCSKFHS

SEQ ID NO: 320125 - protein, 9 aa, Influenza virus
YVCSKFHSD

SEQ ID NO: 320126 - protein, 9 aa, Influenza virus
VCSKFHSDT

SEQ ID NO: 320127 - protein, 9 aa, Influenza virus
CSKFHSDTP

SEQ ID NO: 320128 - protein, 9 aa, Influenza virus
SKFHSDTPR

SEQ ID NO: 320129 - protein, 9 aa, Influenza virus
KFHSDTPRP

SEQ ID NO: 320130 - protein, 9 aa, Influenza virus
FHSDTPRPA

SEQ ID NO: 320131 - protein, 9 aa, Influenza virus
HSDTPRPAD

SEQ ID NO: 320132 - protein, 9 aa, Influenza virus
SDTPRPADP

SEQ ID NO: 320133 - protein, 9 aa, Influenza virus
DTPRPADPS

SEQ ID NO: 320134 - protein, 9 aa, Influenza virus
DPSTVSCDS

SEQ ID NO: 320135 - protein, 9 aa, Influenza virus
PSTVSCDSP

SEQ ID NO: 320136 - protein, 9 aa, Influenza virus
STVSCDSPS

SEQ ID NO: 320137 - protein, 9 aa, Influenza virus
TVSCDSPSN

SEQ ID NO: 320138 - protein, 9 aa, Influenza virus
SCDSPSNVN

SEQ ID NO: 320139 - protein, 9 aa, Influenza virus
CDSPSNVNG

SEQ ID NO: 320140 - protein, 9 aa, Influenza virus
DSPSNVNGG

SEQ ID NO: 320141 - protein, 9 aa, Influenza virus
NGGPGVKGF

SEQ ID NO: 320142 - protein, 9 aa, Influenza virus
GGPGVKGFG

SEQ ID NO: 320143 - protein, 9 aa, Influenza virus
GPGVKGFGF

SEQ ID NO: 320144 - protein, 9 aa, Influenza virus
PGVKGFGFK

SEQ ID NO: 320145 - protein, 9 aa, Influenza virus
GVKGFGFKA

SEQ ID NO: 320146 - protein, 9 aa, Influenza virus
VKGFGFKAG

SEQ ID NO: 320147 - protein, 9 aa, Influenza virus
GNDVWLGRT

SEQ ID NO: 320148 - protein, 9 aa, Influenza virus
NDVWLGRTV

SEQ ID NO: 320149 - protein, 9 aa, Influenza virus
DVWLGRTVS

SEQ ID NO: 320150 - protein, 9 aa, Influenza virus
VWLGRTVST

SEQ ID NO: 320151 - protein, 9 aa, Influenza virus
WLGRTVSTS

SEQ ID NO: 320152 - protein, 9 aa, Influenza virus
LGRTVSTSG

SEQ ID NO: 320153 - protein, 9 aa, Influenza virus
GRTVSTSGR

SEQ ID NO: 320154 - protein, 9 aa, Influenza virus
RTVSTSGRS

SEQ ID NO: 320155 - protein, 9 aa, Influenza virus
SGRSGFEII

SEQ ID NO: 320156 - protein, 9 aa, Influenza virus
RSGFEIIKV

SEQ ID NO: 320157 - protein, 9 aa, Influenza virus
VTEGWINSP

SEQ ID NO: 320158 - protein, 9 aa, Influenza virus
EGWINSPNH

SEQ ID NO: 320159 - protein, 9 aa, Influenza virus
GWINSPNHA

SEQ ID NO: 320160 - protein, 9 aa, Influenza virus
WINSPNHAK

SEQ ID NO: 320161 - protein, 9 aa, Influenza virus
INSPNHAKS

SEQ ID NO: 320162 - protein, 9 aa, Influenza virus
AKSVTQTLV

SEQ ID NO: 320163 - protein, 9 aa, Influenza virus
KSITQTLVS

SEQ ID NO: 320164 - protein, 9 aa, Influenza virus
SITQTLVSN

SEQ ID NO: 320165 - protein, 9 aa, Influenza virus
ITQTLVSNN

SEQ ID NO: 320166 - protein, 9 aa, Influenza virus
TQTLVSNND

SEQ ID NO: 320167 - protein, 9 aa, Influenza virus
QTLVSNNDW

SEQ ID NO: 320168 - protein, 9 aa, Influenza virus
TLVSNNDWS

SEQ ID NO: 320169 - protein, 9 aa, Influenza virus
LVSNNDWSG

SEQ ID NO: 320170 - protein, 9 aa, Influenza virus
VSNNDWSGY

SEQ ID NO: 320171 - protein, 9 aa, Influenza virus
SNNDWSGYS

SEQ ID NO: 320172 - protein, 9 aa, Influenza virus
NNDWSGYSG

SEQ ID NO: 320173 - protein, 9 aa, Influenza virus
NDWSGYSGS

SEQ ID NO: 320174 - protein, 9 aa, Influenza virus
DWSGYSGSF

SEQ ID NO: 320175 - protein, 9 aa, Influenza virus
WSGYSGSFI

SEQ ID NO: 320176 - protein, 9 aa, Influenza virus
SGYSGSFIV

SEQ ID NO: 320177 - protein, 9 aa, Influenza virus
KDCFQPCFY

SEQ ID NO: 320178 - protein, 9 aa, Influenza virus
DCFQPCFYV

SEQ ID NO: 320179 - protein, 9 aa, Influenza virus
CFQPCFYVE

SEQ ID NO: 320180 - protein, 9 aa, Influenza virus
FQPCFYVEL

SEQ ID NO: 320181 - protein, 9 aa, Influenza virus
QPCFYVELI

SEQ ID NO: 320182 - protein, 9 aa, Influenza virus
PCFYVELIR

SEQ ID NO: 320183 - protein, 9 aa, Influenza virus
CFYVELIRG

SEQ ID NO: 320184 - protein, 9 aa, Influenza virus
FYVELIRGR

SEQ ID NO: 320185 - protein, 9 aa, Influenza virus
YVELIRGRP

SEQ ID NO: 320186 - protein, 9 aa, Influenza virus
VELIRGRPN

SEQ ID NO: 320187 - protein, 9 aa, Influenza virus
NDDVSWTSN

SEQ ID NO: 320188 - protein, 9 aa, Influenza virus
DDVSWTSNS

SEQ ID NO: 320189 - protein, 9 aa, Influenza virus
DVSWTSNSI

SEQ ID NO: 320190 - protein, 9 aa, Influenza virus
VSWTSNSIV

SEQ ID NO: 320191 - protein, 9 aa, Influenza virus
SWTSNSIVT

SEQ ID NO: 320192 - protein, 9 aa, Influenza virus
WTSNSIVTF

SEQ ID NO: 320193 - protein, 9 aa, Influenza virus
TSNSIVTFC

SEQ ID NO: 320194 - protein, 9 aa, Influenza virus
SNSIVTFCG

SEQ ID NO: 320195 - protein, 9 aa, Influenza virus
NSIVTFCGL

SEQ ID NO: 320196 - protein, 9 aa, Influenza virus
SIVTFCGLD

SEQ ID NO: 320197 - protein, 9 aa, Influenza virus
IVTFCGLDN

SEQ ID NO: 320198 - protein, 9 aa, Influenza virus
VTFCGLDNE

SEQ ID NO: 320199 - protein, 9 aa, Influenza virus
TFCGLDNEP

SEQ ID NO: 320200 - protein, 9 aa, Influenza virus
FCGLDNEPG

SEQ ID NO: 320201 - protein, 9 aa, Influenza virus
CGLDNEPGS

SEQ ID NO: 320202 - protein, 9 aa, Influenza virus
GLDNEPGSG

SEQ ID NO: 320203 - protein, 9 aa, Influenza virus
LDNEPGSGN

SEQ ID NO: 320204 - protein, 9 aa, Influenza virus
DNEPGSGNW

SEQ ID NO: 320205 - protein, 9 aa, Influenza virus
NEPGSGNWP

SEQ ID NO: 320206 - protein, 9 aa, Influenza virus
EPGSGNWPD

SEQ ID NO: 320207 - protein, 9 aa, Influenza virus
PGSGNWPDG

SEQ ID NO: 320208 - protein, 9 aa, Influenza virus
GSGNWPDGS

SEQ ID NO: 320209 - protein, 9 aa, Influenza virus
SGNWPDGSN

SEQ ID NO: 320210 - protein, 9 aa, Influenza virus
GNWPDGSNI

SEQ ID NO: 320211 - protein, 9 aa, Influenza virus
NWPDGSNIG

SEQ ID NO: 320212 - protein, 9 aa, Influenza virus
WPDGSNIGF

SEQ ID NO: 320213 - protein, 9 aa, Influenza virus
PDGSNIGFM

SEQ ID NO: 320214 - protein, 9 aa, Influenza virus
DGSNIGFMP

SEQ ID NO: 320215 - protein, 9 aa, Influenza virus
GSNIGFMPK

SEQ ID NO: 320216 - protein, 9 aa, Influenza virus
SKSRGYKMN

SEQ ID NO: 320217 - protein, 9 aa, Influenza virus
KSRGYKMNT

SEQ ID NO: 320218 - protein, 9 aa, Influenza virus
SRGYKMNTQ

SEQ ID NO: 320219 - protein, 9 aa, Influenza virus
RGYKMNTQI

SEQ ID NO: 320220 - protein, 9 aa, Influenza virus
GYKMNTQIL

SEQ ID NO: 320221 - protein, 9 aa, Influenza virus
YKMNTQILV

SEQ ID NO: 320222 - protein, 9 aa, Influenza virus
KMNTQILVF

SEQ ID NO: 320223 - protein, 9 aa, Influenza virus
GCDHSDNAD

SEQ ID NO: 320224 - protein, 9 aa, Influenza virus
CDHSDNADK

SEQ ID NO: 320225 - protein, 9 aa, Influenza virus
DHSDNADKI

SEQ ID NO: 320226 - protein, 9 aa, Influenza virus
HSDNADKIC

SEQ ID NO: 320227 - protein, 9 aa, Influenza virus
SDNADKICL

SEQ ID NO: 320228 - protein, 9 aa, Influenza virus
DNADKICLG

SEQ ID NO: 320229 - protein, 9 aa, Influenza virus
ADKICLGHH

SEQ ID NO: 320230 - protein, 9 aa, Influenza virus
DKICLGHHA

SEQ ID NO: 320231 - protein, 9 aa, Influenza virus
KICLGHHAV

SEQ ID NO: 320232 - protein, 9 aa, Influenza virus
NGTKVNTLT

SEQ ID NO: 320233 - protein, 9 aa, Influenza virus
GTKVNTLTE

SEQ ID NO: 320234 - protein, 9 aa, Influenza virus
TKVNTLTER

SEQ ID NO: 320235 - protein, 9 aa, Influenza virus
KVNTLTERG

SEQ ID NO: 320236 - protein, 9 aa, Influenza virus
VNTLTERGV

SEQ ID NO: 320237 - protein, 9 aa, Influenza virus
NTLTERGVE

SEQ ID NO: 320238 - protein, 9 aa, Influenza virus
TLTERGVEV

SEQ ID NO: 320239 - protein, 9 aa, Influenza virus
LTERGVEVV

SEQ ID NO: 320240 - protein, 9 aa, Influenza virus
TERGVEVVN

SEQ ID NO: 320241 - protein, 9 aa, Influenza virus
ERGVEVVNA

SEQ ID NO: 320242 - protein, 9 aa, Influenza virus
RGVEVVNAT

SEQ ID NO: 320243 - protein, 9 aa, Influenza virus
GVEVVNATE

SEQ ID NO: 320244 - protein, 9 aa, Influenza virus
VEVVNATET

SEQ ID NO: 320245 - protein, 9 aa, Influenza virus
EVVNATETV

SEQ ID NO: 320246 - protein, 9 aa, Influenza virus
VVNATETVE

SEQ ID NO: 320247 - protein, 9 aa, Influenza virus
VNATETVER

SEQ ID NO: 320248 - protein, 9 aa, Influenza virus
DLGQCGLLG

SEQ ID NO: 320249 - protein, 9 aa, Influenza virus
LGQCGLLGT

SEQ ID NO: 320250 - protein, 9 aa, Influenza virus
TGPPQCDQF

SEQ ID NO: 320251 - protein, 9 aa, Influenza virus
GPPQCDQFL

SEQ ID NO: 320252 - protein, 9 aa, Influenza virus
PPQCDQFLE

SEQ ID NO: 320253 - protein, 9 aa, Influenza virus
PQCDQFLEF

SEQ ID NO: 320254 - protein, 9 aa, Influenza virus
DLIIERREG

SEQ ID NO: 320255 - protein, 9 aa, Influenza virus
EEALRQILR

SEQ ID NO: 320256 - protein, 9 aa, Influenza virus
LRQILRESG

SEQ ID NO: 320257 - protein, 9 aa, Influenza virus
RQILRESGG

SEQ ID NO: 320258 - protein, 9 aa, Influenza virus
MGFTYSGIR

SEQ ID NO: 320259 - protein, 9 aa, Influenza virus
GFTYSGIRT

SEQ ID NO: 320260 - protein, 9 aa, Influenza virus
FTYSGIRTN

SEQ ID NO: 320261 - protein, 9 aa, Influenza virus
TYSGIRTNG

SEQ ID NO: 320262 - protein, 9 aa, Influenza virus
RSGSSFYAE

SEQ ID NO: 320263 - protein, 9 aa, Influenza virus
SGSSFYAEM

SEQ ID NO: 320264 - protein, 9 aa, Influenza virus
GSSFYAEMK

SEQ ID NO: 320265 - protein, 9 aa, Influenza virus
SSFYAEMKW

SEQ ID NO: 320266 - protein, 9 aa, Influenza virus
SFYAEMKWL

SEQ ID NO: 320267 - protein, 9 aa, Influenza virus
FYAEMKWLL

SEQ ID NO: 320268 - protein, 9 aa, Influenza virus
YAEMKWLLS

SEQ ID NO: 320269 - protein, 9 aa, Influenza virus
AEMKWLLSN

SEQ ID NO: 320270 - protein, 9 aa, Influenza virus
FPQMTKSYK

SEQ ID NO: 320271 - protein, 9 aa, Influenza virus
PQMTKSYKN

SEQ ID NO: 320272 - protein, 9 aa, Influenza virus
PALIIWGIH

SEQ ID NO: 320273 - protein, 9 aa, Influenza virus
ALIIWGIHH

SEQ ID NO: 320274 - protein, 9 aa, Influenza virus
EQTKLYGSG

SEQ ID NO: 320275 - protein, 9 aa, Influenza virus
TVGSSNYQQ

SEQ ID NO: 320276 - protein, 9 aa, Influenza virus
VGSSNYQQS

SEQ ID NO: 320277 - protein, 9 aa, Influenza virus
RPQVNGQSG

SEQ ID NO: 320278 - protein, 9 aa, Influenza virus
PQVNGQSGR

SEQ ID NO: 320279 - protein, 9 aa, Influenza virus
QVNGQSGRI

SEQ ID NO: 320280 - protein, 9 aa, Influenza virus
VNGQSGRID

SEQ ID NO: 320281 - protein, 9 aa, Influenza virus
NGQSGRIDF

SEQ ID NO: 320282 - protein, 9 aa, Influenza virus
GQSGRIDFH

SEQ ID NO: 320283 - protein, 9 aa, Influenza virus
QSGRIDFHW

SEQ ID NO: 320284 - protein, 9 aa, Influenza virus
SGRIDFHWL

SEQ ID NO: 320285 - protein, 9 aa, Influenza virus
NDTVTFSFN

SEQ ID NO: 320286 - protein, 9 aa, Influenza virus
DTVTFSFNG

SEQ ID NO: 320287 - protein, 9 aa, Influenza virus
TVTFSFNGA

SEQ ID NO: 320288 - protein, 9 aa, Influenza virus
VTFSFNGAF

SEQ ID NO: 320289 - protein, 9 aa, Influenza virus
TFSFNGAFI

SEQ ID NO: 320290 - protein, 9 aa, Influenza virus
FSFNGAFIA

SEQ ID NO: 320291 - protein, 9 aa, Influenza virus
SFNGAFIAP

SEQ ID NO: 320292 - protein, 9 aa, Influenza virus
FNGAFIAPD

SEQ ID NO: 320293 - protein, 9 aa, Influenza virus
NGAFIAPDR

SEQ ID NO: 320294 - protein, 9 aa, Influenza virus
GAFIAPDRA

SEQ ID NO: 320295 - protein, 9 aa, Influenza virus
AFIAPDRAS

SEQ ID NO: 320296 - protein, 9 aa, Influenza virus
FIAPDRASF

SEQ ID NO: 320297 - protein, 9 aa, Influenza virus
SNLPFQNIN

SEQ ID NO: 320298 - protein, 9 aa, Influenza virus
LPFQNINSR

SEQ ID NO: 320299 - protein, 9 aa, Influenza virus
PFQNINSRA

SEQ ID NO: 320300 - protein, 9 aa, Influenza virus
VGKCPRYVK

SEQ ID NO: 320301 - protein, 9 aa, Influenza virus
GKCPRYVKQ

SEQ ID NO: 320302 - protein, 9 aa, Influenza virus
SLLLATGMK

SEQ ID NO: 320303 - protein, 9 aa, Influenza virus
LLLATGMKN

SEQ ID NO: 320304 - protein, 9 aa, Influenza virus
LLATGMKNV

SEQ ID NO: 320305 - protein, 9 aa, Influenza virus
LATGMKNVP

SEQ ID NO: 320306 - protein, 9 aa, Influenza virus
ATGMKNVPE

SEQ ID NO: 320307 - protein, 9 aa, Influenza virus
THKQLTHHM

SEQ ID NO: 320308 - protein, 9 aa, Influenza virus
HKQLTHHMR

SEQ ID NO: 320309 - protein, 9 aa, Influenza virus
KQLTHHMRK

SEQ ID NO: 320310 - protein, 9 aa, Influenza virus
QLTHHMRKK

SEQ ID NO: 320311 - protein, 9 aa, Influenza virus
LTHHMRKKR

SEQ ID NO: 320312 - protein, 9 aa, Influenza virus
THHMRKKRG

SEQ ID NO: 320313 - protein, 9 aa, Influenza virus
HHMRKKRGL

SEQ ID NO: 320314 - protein, 9 aa, Influenza virus
HMRKKRGLF

SEQ ID NO: 320315 - protein, 9 aa, Influenza virus
MRKKRGLFG

SEQ ID NO: 320316 - protein, 9 aa, Influenza virus
RKKRGLFGA

SEQ ID NO: 320317 - protein, 9 aa, Influenza virus
EKRGLFGAI

SEQ ID NO: 320318 - protein, 9 aa, Influenza virus
RGLFGAIAG

SEQ ID NO: 320319 - protein, 9 aa, Influenza virus
GLFGAIAGF

SEQ ID NO: 320320 - protein, 9 aa, Influenza virus
LFGAIAGFI

SEQ ID NO: 320321 - protein, 9 aa, Influenza virus
FGAIAGFIE

SEQ ID NO: 320322 - protein, 9 aa, Influenza virus
GAIAGFIEN

SEQ ID NO: 320323 - protein, 9 aa, Influenza virus
AIAGFIENG

SEQ ID NO: 320324 - protein, 9 aa, Influenza virus
IAGFIENGW

SEQ ID NO: 320325 - protein, 9 aa, Influenza virus
AGFIENGWE

SEQ ID NO: 320326 - protein, 9 aa, Influenza virus
GFIENGWEG

SEQ ID NO: 320327 - protein, 9 aa, Influenza virus
FIENGWEGL

SEQ ID NO: 320328 - protein, 9 aa, Influenza virus
IENGWEGLI

SEQ ID NO: 320329 - protein, 9 aa, Influenza virus
ENGWEGLID

SEQ ID NO: 320330 - protein, 9 aa, Influenza virus
NGWEGLIDG

SEQ ID NO: 320331 - protein, 9 aa, Influenza virus
GWEGLIDGW

SEQ ID NO: 320332 - protein, 9 aa, Influenza virus
WEGLIDGWY

SEQ ID NO: 320333 - protein, 9 aa, Influenza virus
EGLIDGWYG

SEQ ID NO: 320334 - protein, 9 aa, Influenza virus
GLIDGWYGF

SEQ ID NO: 320335 - protein, 9 aa, Influenza virus
LIDGWYGFR

SEQ ID NO: 320336 - protein, 9 aa, Influenza virus
IDGWYGFRH

SEQ ID NO: 320337 - protein, 9 aa, Influenza virus
DGWYGFRHQ

SEQ ID NO: 320338 - protein, 9 aa, Influenza virus
GWYGFRHQN

SEQ ID NO: 320339 - protein, 9 aa, Influenza virus
WYGFRHQNA

SEQ ID NO: 320340 - protein, 9 aa, Influenza virus
YGFRHQNAQ

SEQ ID NO: 320341 - protein, 9 aa, Influenza virus
GFRHQNAQG

SEQ ID NO: 320342 - protein, 9 aa, Influenza virus
FRHQNAQGE

SEQ ID NO: 320343 - protein, 9 aa, Influenza virus
RHQNAQGEG

SEQ ID NO: 320344 - protein, 9 aa, Influenza virus
HQNAQGEGT

SEQ ID NO: 320345 - protein, 9 aa, Influenza virus
QNAQGEGTA

SEQ ID NO: 320346 - protein, 9 aa, Influenza virus
NAQGEGTAA

SEQ ID NO: 320347 - protein, 9 aa, Influenza virus
AQGEGTAAD

SEQ ID NO: 320348 - protein, 9 aa, Influenza virus
QGEGTAADY

SEQ ID NO: 320349 - protein, 9 aa, Influenza virus
GEGTAADYK

SEQ ID NO: 320350 - protein, 9 aa, Influenza virus
EGTAADYKS

SEQ ID NO: 320351 - protein, 9 aa, Influenza virus
GTAADYKST

SEQ ID NO: 320352 - protein, 9 aa, Influenza virus
TAADYKSTQ

SEQ ID NO: 320353 - protein, 9 aa, Influenza virus
AADYKSTQS

SEQ ID NO: 320354 - protein, 9 aa, Influenza virus
ADYKSTQSA

SEQ ID NO: 320355 - protein, 9 aa, Influenza virus
DYKSTQSAI

SEQ ID NO: 320356 - protein, 9 aa, Influenza virus
YKSTQSAID

SEQ ID NO: 320357 - protein, 9 aa, Influenza virus
KSTQSAIDQ

SEQ ID NO: 320358 - protein, 9 aa, Influenza virus
STQSAIDQI

SEQ ID NO: 320359 - protein, 9 aa, Influenza virus
TQSAIDQIT

SEQ ID NO: 320360 - protein, 9 aa, Influenza virus
QSAIDQITG

SEQ ID NO: 320361 - protein, 9 aa, Influenza virus
SAIDQITGK

SEQ ID NO: 320362 - protein, 9 aa, Influenza virus
AIDQITGKL

SEQ ID NO: 320363 - protein, 9 aa, Influenza virus
IDQITGKLN

SEQ ID NO: 320364 - protein, 9 aa, Influenza virus
DQITGKLNR

SEQ ID NO: 320365 - protein, 9 aa, Influenza virus
QITGKLNRL

SEQ ID NO: 320366 - protein, 9 aa, Influenza virus
ITGKLNRLI

SEQ ID NO: 320367 - protein, 9 aa, Influenza virus
TGKLNRLIE

SEQ ID NO: 320368 - protein, 9 aa, Influenza virus
GKLNRLIEK

SEQ ID NO: 320369 - protein, 9 aa, Influenza virus
KLNRLIEKT

SEQ ID NO: 320370 - protein, 9 aa, Influenza virus
LNRLIEKTN

SEQ ID NO: 320371 - protein, 9 aa, Influenza virus
NRLIEKTNQ

SEQ ID NO: 320372 - protein, 9 aa, Influenza virus
RLIEKTNQQ

SEQ ID NO: 320373 - protein, 9 aa, Influenza virus
LIEKTNQQF

SEQ ID NO: 320374 - protein, 9 aa, Influenza virus
IEKTNQQFE

SEQ ID NO: 320375 - protein, 9 aa, Influenza virus
EKTNQQFEL

SEQ ID NO: 320376 - protein, 9 aa, Influenza virus
KTNQQFELI

SEQ ID NO: 320377 - protein, 9 aa, Influenza virus
TNQQFELID

SEQ ID NO: 320378 - protein, 9 aa, Influenza virus
NQQFELIDN

SEQ ID NO: 320379 - protein, 9 aa, Influenza virus
QQFELIDNE

SEQ ID NO: 320380 - protein, 9 aa, Influenza virus
QFELIDNEF

SEQ ID NO: 320381 - protein, 9 aa, Influenza virus
FELIDNEFT

SEQ ID NO: 320382 - protein, 9 aa, Influenza virus
ELIDNEFTE

SEQ ID NO: 320383 - protein, 9 aa, Influenza virus
IDNEFTEVE

SEQ ID NO: 320384 - protein, 9 aa, Influenza virus
EVEKQIGNV

SEQ ID NO: 320385 - protein, 9 aa, Influenza virus
VEKQIGNVI

SEQ ID NO: 320386 - protein, 9 aa, Influenza virus
EKQIGNVIN

SEQ ID NO: 320387 - protein, 9 aa, Influenza virus
KQIGNVINW

SEQ ID NO: 320388 - protein, 9 aa, Influenza virus
QIGNVINWT

SEQ ID NO: 320389 - protein, 9 aa, Influenza virus
IGNVINWTR

SEQ ID NO: 320390 - protein, 9 aa, Influenza virus
GNVINWTRD

SEQ ID NO: 320391 - protein, 9 aa, Influenza virus
NVINWTRDS

SEQ ID NO: 320392 - protein, 9 aa, Influenza virus
VINWTRDSM

SEQ ID NO: 320393 - protein, 9 aa, Influenza virus
INWTRDSMT

SEQ ID NO: 320394 - protein, 9 aa, Influenza virus
NWTRDSMTE

SEQ ID NO: 320395 - protein, 9 aa, Influenza virus
TEVWSYNAE

SEQ ID NO: 320396 - protein, 9 aa, Influenza virus
EVWSYNAEL

SEQ ID NO: 320397 - protein, 9 aa, Influenza virus
VWSYNAELL

SEQ ID NO: 320398 - protein, 9 aa, Influenza virus
WSYNAELLV

SEQ ID NO: 320399 - protein, 9 aa, Influenza virus
SYNAELLVA

SEQ ID NO: 320400 - protein, 9 aa, Influenza virus
YNAELLVAM

SEQ ID NO: 320401 - protein, 9 aa, Influenza virus
NAELLVAME

SEQ ID NO: 320402 - protein, 9 aa, Influenza virus
AELLVAMEN

SEQ ID NO: 320403 - protein, 9 aa, Influenza virus
ELLVAMENQ

SEQ ID NO: 320404 - protein, 9 aa, Influenza virus
LLVAMENQH

SEQ ID NO: 320405 - protein, 9 aa, Influenza virus
LVAMENQHT

SEQ ID NO: 320406 - protein, 9 aa, Influenza virus
VAMENQHTI

SEQ ID NO: 320407 - protein, 9 aa, Influenza virus
AMENQHTID

SEQ ID NO: 320408 - protein, 9 aa, Influenza virus
MENQHTIDL

SEQ ID NO: 320409 - protein, 9 aa, Influenza virus
ENQHTIDLA

SEQ ID NO: 320410 - protein, 9 aa, Influenza virus
NQHTIDLAD

SEQ ID NO: 320411 - protein, 9 aa, Influenza virus
QHTIDLADS

SEQ ID NO: 320412 - protein, 9 aa, Influenza virus
HTIDLADSE

SEQ ID NO: 320413 - protein, 9 aa, Influenza virus
TIDLADSEM

SEQ ID NO: 320414 - protein, 9 aa, Influenza virus
IDLADSEMN

SEQ ID NO: 320415 - protein, 9 aa, Influenza virus
DLADSEMNK

SEQ ID NO: 320416 - protein, 9 aa, Influenza virus
LADSEMNKL

SEQ ID NO: 320417 - protein, 9 aa, Influenza virus
ADSEMNKLY

SEQ ID NO: 320418 - protein, 9 aa, Influenza virus
DSEMNKLYE

SEQ ID NO: 320419 - protein, 9 aa, Influenza virus
SEMNKLYER

SEQ ID NO: 320420 - protein, 9 aa, Influenza virus
EMNKLYERV

SEQ ID NO: 320421 - protein, 9 aa, Influenza virus
MNKLYERVR

SEQ ID NO: 320422 - protein, 9 aa, Influenza virus
NKLYERVKR

SEQ ID NO: 320423 - protein, 9 aa, Influenza virus
KLYERVKRQ

SEQ ID NO: 320424 - protein, 9 aa, Influenza virus
LYERVKRQL

SEQ ID NO: 320425 - protein, 9 aa, Influenza virus
YERVKRQLR

SEQ ID NO: 320426 - protein, 9 aa, Influenza virus
ERVKRQLRE

SEQ ID NO: 320427 - protein, 9 aa, Influenza virus
RVKRQLREN

SEQ ID NO: 320428 - protein, 9 aa, Influenza virus
VRRQLRENA

SEQ ID NO: 320429 - protein, 9 aa, Influenza virus
RRQLRENAE

SEQ ID NO: 320430 - protein, 9 aa, Influenza virus
RQLRENAEE

SEQ ID NO: 320431 - protein, 9 aa, Influenza virus
QLRENAEED

SEQ ID NO: 320432 - protein, 9 aa, Influenza virus
LRENAEEDG

SEQ ID NO: 320433 - protein, 9 aa, Influenza virus
RENAEEDGT

SEQ ID NO: 320434 - protein, 9 aa, Influenza virus
ENAEEDGTG

SEQ ID NO: 320435 - protein, 9 aa, Influenza virus
NAEEDGTGC

SEQ ID NO: 320436 - protein, 9 aa, Influenza virus
AEEDGTGCF

SEQ ID NO: 320437 - protein, 9 aa, Influenza virus
EEDGTGCFE

SEQ ID NO: 320438 - protein, 9 aa, Influenza virus
EDGTGCFEI

SEQ ID NO: 320439 - protein, 9 aa, Influenza virus
DGTGCFEIF

SEQ ID NO: 320440 - protein, 9 aa, Influenza virus
GTGCFEIFH

SEQ ID NO: 320441 - protein, 9 aa, Influenza virus
TGCFEIFHK

SEQ ID NO: 320442 - protein, 9 aa, Influenza virus
GCFEIFHKC

SEQ ID NO: 320443 - protein, 9 aa, Influenza virus
CFEIFHKCD

SEQ ID NO: 320444 - protein, 9 aa, Influenza virus
FEIFHKCDD

SEQ ID NO: 320445 - protein, 9 aa, Influenza virus
EIFHKCDDD

SEQ ID NO: 320446 - protein, 9 aa, Influenza virus
IFHKCDDDC

SEQ ID NO: 320447 - protein, 9 aa, Influenza virus
FHKCDDDCM

SEQ ID NO: 320448 - protein, 9 aa, Influenza virus
CMASIRNNT

SEQ ID NO: 320449 - protein, 9 aa, Influenza virus
MASIRNNTY

SEQ ID NO: 320450 - protein, 9 aa, Influenza virus
ASIRNNTYD

SEQ ID NO: 320451 - protein, 9 aa, Influenza virus
SIRNNTYDH

SEQ ID NO: 320452 - protein, 9 aa, Influenza virus
IRNNTYDHS

SEQ ID NO: 320453 - protein, 9 aa, Influenza virus
RNNTYDHSK

SEQ ID NO: 320454 - protein, 9 aa, Influenza virus
NNTYDHSKY

SEQ ID NO: 320455 - protein, 9 aa, Influenza virus
NTYDHSKYR

SEQ ID NO: 320456 - protein, 9 aa, Influenza virus
QNRIQIDPV

SEQ ID NO: 320457 - protein, 9 aa, Influenza virus
IQIDPVKLS

SEQ ID NO: 320458 - protein, 9 aa, Influenza virus
IDPVKLSSG

SEQ ID NO: 320459 - protein, 9 aa, Influenza virus
DPVKLSSGY

SEQ ID NO: 320460 - protein, 9 aa, Influenza virus
PVKLSSGYK

SEQ ID NO: 320461 - protein, 9 aa, Influenza virus
VKLSSGYKD

SEQ ID NO: 320462 - protein, 9 aa, Influenza virus
KLSSGYKDV

SEQ ID NO: 320463 - protein, 9 aa, Influenza virus
LSSGYKDVI

SEQ ID NO: 320464 - protein, 9 aa, Influenza virus
SSGYKDVIL

SEQ ID NO: 320465 - protein, 9 aa, Influenza virus
SGYKDVILW

SEQ ID NO: 320466 - protein, 9 aa, Influenza virus
GYKDVILWF

SEQ ID NO: 320467 - protein, 9 aa, Influenza virus
YKDVILWFS

SEQ ID NO: 320468 - protein, 9 aa, Influenza virus
KDVILWFSF

SEQ ID NO: 320469 - protein, 9 aa, Influenza virus
DVILWFSFG

SEQ ID NO: 320470 - protein, 9 aa, Influenza virus
VILWFSFGA

SEQ ID NO: 320471 - protein, 9 aa, Influenza virus
ILWFSFGAS

SEQ ID NO: 320472 - protein, 9 aa, Influenza virus
LWFSFGASC

SEQ ID NO: 320473 - protein, 9 aa, Influenza virus
WFSFGASCF

SEQ ID NO: 320474 - protein, 9 aa, Influenza virus
FSFGASCFI

SEQ ID NO: 320475 - protein, 9 aa, Influenza virus
SFGASCFIL

SEQ ID NO: 320476 - protein, 9 aa, Influenza virus
GASCFILLA

SEQ ID NO: 320477 - protein, 9 aa, Influenza virus
ASCFILLAI

SEQ ID NO: 320478 - protein, 9 aa, Influenza virus
LVFICVKNG

SEQ ID NO: 320479 - protein, 9 aa, Influenza virus
VFICVKNGN

SEQ ID NO: 320480 - protein, 9 aa, Influenza virus
FICVKNGNM

SEQ ID NO: 320481 - protein, 9 aa, Influenza virus
ICVKNGNMR

SEQ ID NO: 320482 - protein, 9 aa, Influenza virus
CVKNGNMRC

SEQ ID NO: 320483 - protein, 9 aa, Influenza virus
VKNGNMRCT

SEQ ID NO: 320484 - protein, 9 aa, Influenza virus
KNGNMRCTI

SEQ ID NO: 320485 - protein, 9 aa, Influenza virus
NGNMRCTIC

SEQ ID NO: 320486 - protein, 9 aa, Influenza virus
GNMRCTICI

SEQ ID NO: 320487 - protein, 9 aa, Influenza virus
MNPNQKLFA

SEQ ID NO: 320488 - protein, 9 aa, Influenza virus
NPNQKLFAL

SEQ ID NO: 320489 - protein, 9 aa, Influenza virus
PNQKLFALS

SEQ ID NO: 320490 - protein, 9 aa, Influenza virus
NQKLFALSG

SEQ ID NO: 320491 - protein, 9 aa, Influenza virus
QKLFALSGV

SEQ ID NO: 320492 - protein, 9 aa, Influenza virus
KLFALSGVA

SEQ ID NO: 320493 - protein, 9 aa, Influenza virus
LFALSGVAI

SEQ ID NO: 320494 - protein, 9 aa, Influenza virus
FALSGVAIA

SEQ ID NO: 320495 - protein, 9 aa, Influenza virus
ALSGVAIAL

SEQ ID NO: 320496 - protein, 9 aa, Influenza virus
LSGVAIALS

SEQ ID NO: 320497 - protein, 9 aa, Influenza virus
SGVAIALSV

SEQ ID NO: 320498 - protein, 9 aa, Influenza virus
GVAIALSVL

SEQ ID NO: 320499 - protein, 9 aa, Influenza virus
VAIALSVLN

SEQ ID NO: 320500 - protein, 9 aa, Influenza virus
AIALSVLNL

SEQ ID NO: 320501 - protein, 9 aa, Influenza virus
IALSVLNLL

SEQ ID NO: 320502 - protein, 9 aa, Influenza virus
ALSVLNLLI

SEQ ID NO: 320503 - protein, 9 aa, Influenza virus
LSVLNLLIG

SEQ ID NO: 320504 - protein, 9 aa, Influenza virus
SVLNLLIGI

SEQ ID NO: 320505 - protein, 9 aa, Influenza virus
VLNLLIGIS

SEQ ID NO: 320506 - protein, 9 aa, Influenza virus
LNLLIGISN

SEQ ID NO: 320507 - protein, 9 aa, Influenza virus
NLLIGISNV

SEQ ID NO: 320508 - protein, 9 aa, Influenza virus
LLIGISNVG

SEQ ID NO: 320509 - protein, 9 aa, Influenza virus
LIGISNVGL

SEQ ID NO: 320510 - protein, 9 aa, Influenza virus
IGISNVGLN

SEQ ID NO: 320511 - protein, 9 aa, Influenza virus
SNVGLNVSL

SEQ ID NO: 320512 - protein, 9 aa, Influenza virus
NVGLNVSLH

SEQ ID NO: 320513 - protein, 9 aa, Influenza virus
VGLNVSLHL

SEQ ID NO: 320514 - protein, 9 aa, Influenza virus
GLNVSLHLK

SEQ ID NO: 320515 - protein, 9 aa, Influenza virus
ENTYVNNTT

SEQ ID NO: 320516 - protein, 9 aa, Influenza virus
NTYVNNTTI

SEQ ID NO: 320517 - protein, 9 aa, Influenza virus
TYVNNTTII

SEQ ID NO: 320518 - protein, 9 aa, Influenza virus
SYLLLNKSL

SEQ ID NO: 320519 - protein, 9 aa, Influenza virus
YLLLNKSLC

SEQ ID NO: 320520 - protein, 9 aa, Influenza virus
LLLNKSLCN

SEQ ID NO: 320521 - protein, 9 aa, Influenza virus
LLNKSLCNV

SEQ ID NO: 320522 - protein, 9 aa, Influenza virus
LNKSLCNVE

SEQ ID NO: 320523 - protein, 9 aa, Influenza virus
NKSLCNVEG

SEQ ID NO: 320524 - protein, 9 aa, Influenza virus
KSLCNVEGW

SEQ ID NO: 320525 - protein, 9 aa, Influenza virus
SLCNVEGWV

SEQ ID NO: 320526 - protein, 9 aa, Influenza virus
LCNVEGWVV

SEQ ID NO: 320527 - protein, 9 aa, Influenza virus
CNVEGWVVI

SEQ ID NO: 320528 - protein, 9 aa, Influenza virus
VEGWVVIAK

SEQ ID NO: 320529 - protein, 9 aa, Influenza virus
EGWVVIAKD

SEQ ID NO: 320530 - protein, 9 aa, Influenza virus
GWVVIAKDN

SEQ ID NO: 320531 - protein, 9 aa, Influenza virus
WVVIAKDNA

SEQ ID NO: 320532 - protein, 9 aa, Influenza virus
VVIAKDNAV

SEQ ID NO: 320533 - protein, 9 aa, Influenza virus
VIAKDNAVR

SEQ ID NO: 320534 - protein, 9 aa, Influenza virus
IAKDNAVRF

SEQ ID NO: 320535 - protein, 9 aa, Influenza virus
AKDNAVRFG

SEQ ID NO: 320536 - protein, 9 aa, Influenza virus
KDNAVRFGE

SEQ ID NO: 320537 - protein, 9 aa, Influenza virus
DNAVRFGES

SEQ ID NO: 320538 - protein, 9 aa, Influenza virus
NAVRFGESE

SEQ ID NO: 320539 - protein, 9 aa, Influenza virus
AVRFGESEQ

SEQ ID NO: 320540 - protein, 9 aa, Influenza virus
VRFGESEQI

SEQ ID NO: 320541 - protein, 9 aa, Influenza virus
RFGESEQII

SEQ ID NO: 320542 - protein, 9 aa, Influenza virus
FGESEQIIV

SEQ ID NO: 320543 - protein, 9 aa, Influenza virus
GESEQIIVT

SEQ ID NO: 320544 - protein, 9 aa, Influenza virus
ESEQIIVTR

SEQ ID NO: 320545 - protein, 9 aa, Influenza virus
SEQIIVTRE

SEQ ID NO: 320546 - protein, 9 aa, Influenza virus
EQIIVTREP

SEQ ID NO: 320547 - protein, 9 aa, Influenza virus
QIIVTREPY

SEQ ID NO: 320548 - protein, 9 aa, Influenza virus
IIVTREPYV

SEQ ID NO: 320549 - protein, 9 aa, Influenza virus
IVTREPYVS

SEQ ID NO: 320550 - protein, 9 aa, Influenza virus
VTREPYVSC

SEQ ID NO: 320551 - protein, 9 aa, Influenza virus
TREPYVSCD

SEQ ID NO: 320552 - protein, 9 aa, Influenza virus
REPYVSCDP

SEQ ID NO: 320553 - protein, 9 aa, Influenza virus
EPYVSCDPT

SEQ ID NO: 320554 - protein, 9 aa, Influenza virus
GCKMYALHQ

SEQ ID NO: 320555 - protein, 9 aa, Influenza virus
CKMYALHQG

SEQ ID NO: 320556 - protein, 9 aa, Influenza virus
KMYALHQGT

SEQ ID NO: 320557 - protein, 9 aa, Influenza virus
MYALHQGTT

SEQ ID NO: 320558 - protein, 9 aa, Influenza virus
YALHQGTTI

SEQ ID NO: 320559 - protein, 9 aa, Influenza virus
ALHQGTTIR

SEQ ID NO: 320560 - protein, 9 aa, Influenza virus
LHQGTTIRN

SEQ ID NO: 320561 - protein, 9 aa, Influenza virus
HQGTTIRNK

SEQ ID NO: 320562 - protein, 9 aa, Influenza virus
QGTTIRNKH

SEQ ID NO: 320563 - protein, 9 aa, Influenza virus
GTTIRNKHS

SEQ ID NO: 320564 - protein, 9 aa, Influenza virus
TTIRNKHSN

SEQ ID NO: 320565 - protein, 9 aa, Influenza virus
TIRNKHSNG

SEQ ID NO: 320566 - protein, 9 aa, Influenza virus
IRNKHSNGT

SEQ ID NO: 320567 - protein, 9 aa, Influenza virus
RNKHSNGTI

SEQ ID NO: 320568 - protein, 9 aa, Influenza virus
NKHSNGTIH

SEQ ID NO: 320569 - protein, 9 aa, Influenza virus
KHSNGTIHD

SEQ ID NO: 320570 - protein, 9 aa, Influenza virus
HSNGTIHDR

SEQ ID NO: 320571 - protein, 9 aa, Influenza virus
SNGTIHDRT

SEQ ID NO: 320572 - protein, 9 aa, Influenza virus
NGTIHDRTA

SEQ ID NO: 320573 - protein, 9 aa, Influenza virus
GTIHDRTAF

SEQ ID NO: 320574 - protein, 9 aa, Influenza virus
TIHDRTAFR

SEQ ID NO: 320575 - protein, 9 aa, Influenza virus
IHDRTAFRG

SEQ ID NO: 320576 - protein, 9 aa, Influenza virus
HDRTAFRGL

SEQ ID NO: 320577 - protein, 9 aa, Influenza virus
DRTAFRGLI

SEQ ID NO: 320578 - protein, 9 aa, Influenza virus
RTAFRGLIS

SEQ ID NO: 320579 - protein, 9 aa, Influenza virus
TAFRGLIST

SEQ ID NO: 320580 - protein, 9 aa, Influenza virus
FRGLISTPL

SEQ ID NO: 320581 - protein, 9 aa, Influenza virus
RGLISTPLG

SEQ ID NO: 320582 - protein, 9 aa, Influenza virus
SNSDFMCVG

SEQ ID NO: 320583 - protein, 9 aa, Influenza virus
NSDFMCVGW

SEQ ID NO: 320584 - protein, 9 aa, Influenza virus
SDFMCVGWS

SEQ ID NO: 320585 - protein, 9 aa, Influenza virus
DFMCVGWSS

SEQ ID NO: 320586 - protein, 9 aa, Influenza virus
FMCVGWSST

SEQ ID NO: 320587 - protein, 9 aa, Influenza virus
MCVGWSSTT

SEQ ID NO: 320588 - protein, 9 aa, Influenza virus
CVGWSSTTC

SEQ ID NO: 320589 - protein, 9 aa, Influenza virus
VGWSSTTCH

SEQ ID NO: 320590 - protein, 9 aa, Influenza virus
GWSSTTCHD

SEQ ID NO: 320591 - protein, 9 aa, Influenza virus
WSSTTCHDG

SEQ ID NO: 320592 - protein, 9 aa, Influenza virus
SSTTCHDGI

SEQ ID NO: 320593 - protein, 9 aa, Influenza virus
CHDGIGRMT

SEQ ID NO: 320594 - protein, 9 aa, Influenza virus
HDGIGRMTI

SEQ ID NO: 320595 - protein, 9 aa, Influenza virus
DGIGRMTIC

SEQ ID NO: 320596 - protein, 9 aa, Influenza virus
GRMTICIQG

SEQ ID NO: 320597 - protein, 9 aa, Influenza virus
RMTICIQGN

SEQ ID NO: 320598 - protein, 9 aa, Influenza virus
MTICIQGNN

SEQ ID NO: 320599 - protein, 9 aa, Influenza virus
QGNNDNATA

SEQ ID NO: 320600 - protein, 9 aa, Influenza virus
GNNDNATAT

SEQ ID NO: 320601 - protein, 9 aa, Influenza virus
NNDNATATV

SEQ ID NO: 320602 - protein, 9 aa, Influenza virus
NDNATATVY

SEQ ID NO: 320603 - protein, 9 aa, Influenza virus
DNATATVYY

SEQ ID NO: 320604 - protein, 9 aa, Influenza virus
NATATVYYN

SEQ ID NO: 320605 - protein, 9 aa, Influenza virus
ATATVYYNR

SEQ ID NO: 320606 - protein, 9 aa, Influenza virus
TATVYYNRR

SEQ ID NO: 320607 - protein, 9 aa, Influenza virus
ATVYYNRRL

SEQ ID NO: 320608 - protein, 9 aa, Influenza virus
TVYYNRRLT

SEQ ID NO: 320609 - protein, 9 aa, Influenza virus
VYYNRRLTT

SEQ ID NO: 320610 - protein, 9 aa, Influenza virus
YYNRRLTTT

SEQ ID NO: 320611 - protein, 9 aa, Influenza virus
YNRRLTTTI

SEQ ID NO: 320612 - protein, 9 aa, Influenza virus
RRLTTTIKT

SEQ ID NO: 320613 - protein, 9 aa, Influenza virus
RLTTTIKTW

SEQ ID NO: 320614 - protein, 9 aa, Influenza virus
LTTTIKTWA

SEQ ID NO: 320615 - protein, 9 aa, Influenza virus
TTTIKTWAR

SEQ ID NO: 320616 - protein, 9 aa, Influenza virus
TTIKTWARN

SEQ ID NO: 320617 - protein, 9 aa, Influenza virus
TIKTWARNI

SEQ ID NO: 320618 - protein, 9 aa, Influenza virus
IKTWARNIL

SEQ ID NO: 320619 - protein, 9 aa, Influenza virus
KTWARNILR

SEQ ID NO: 320620 - protein, 9 aa, Influenza virus
TWARNILRT

SEQ ID NO: 320621 - protein, 9 aa, Influenza virus
WARNILRTQ

SEQ ID NO: 320622 - protein, 9 aa, Influenza virus
ARNILRTQE

SEQ ID NO: 320623 - protein, 9 aa, Influenza virus
RNILRTQES

SEQ ID NO: 320624 - protein, 9 aa, Influenza virus
NILRTQESE

SEQ ID NO: 320625 - protein, 9 aa, Influenza virus
ILRTQESEC

SEQ ID NO: 320626 - protein, 9 aa, Influenza virus
LRTQESECV

SEQ ID NO: 320627 - protein, 9 aa, Influenza virus
RTQESECVC

SEQ ID NO: 320628 - protein, 9 aa, Influenza virus
TQESECVCH

SEQ ID NO: 320629 - protein, 9 aa, Influenza virus
QESECVCHN

SEQ ID NO: 320630 - protein, 9 aa, Influenza virus
ESECVCHNG

SEQ ID NO: 320631 - protein, 9 aa, Influenza virus
SECVCHNGT

SEQ ID NO: 320632 - protein, 9 aa, Influenza virus
ECVCHNGTC

SEQ ID NO: 320633 - protein, 9 aa, Influenza virus
CVCHNGTCA

SEQ ID NO: 320634 - protein, 9 aa, Influenza virus
VCHNGTCAV

SEQ ID NO: 320635 - protein, 9 aa, Influenza virus
HNGTCAVVM

SEQ ID NO: 320636 - protein, 9 aa, Influenza virus
NGTCAVVMT

SEQ ID NO: 320637 - protein, 9 aa, Influenza virus
GTCAVVMTD

SEQ ID NO: 320638 - protein, 9 aa, Influenza virus
TCAVVMTDG

SEQ ID NO: 320639 - protein, 9 aa, Influenza virus
AVVMTDGSA

SEQ ID NO: 320640 - protein, 9 aa, Influenza virus
VVMTDGSAS

SEQ ID NO: 320641 - protein, 9 aa, Influenza virus
VMTDGSASS

SEQ ID NO: 320642 - protein, 9 aa, Influenza virus
MTDGSASSQ

SEQ ID NO: 320643 - protein, 9 aa, Influenza virus
TDGSASSQA

SEQ ID NO: 320644 - protein, 9 aa, Influenza virus
LKGSARHIE

SEQ ID NO: 320645 - protein, 9 aa, Influenza virus
KGSARHIEE

SEQ ID NO: 320646 - protein, 9 aa, Influenza virus
GSARHIEEC

SEQ ID NO: 320647 - protein, 9 aa, Influenza virus
SARHIEECS

SEQ ID NO: 320648 - protein, 9 aa, Influenza virus
ARHIEECSC

SEQ ID NO: 320649 - protein, 9 aa, Influenza virus
RHIEECSCY

SEQ ID NO: 320650 - protein, 9 aa, Influenza virus
HIEECSCYG

SEQ ID NO: 320651 - protein, 9 aa, Influenza virus
IEECSCYGH

SEQ ID NO: 320652 - protein, 9 aa, Influenza virus
EECSCYGHN

SEQ ID NO: 320653 - protein, 9 aa, Influenza virus
VTCVCRDNW

SEQ ID NO: 320654 - protein, 9 aa, Influenza virus
TCVCRDNWQ

SEQ ID NO: 320655 - protein, 9 aa, Influenza virus
CVCRDNWQG

SEQ ID NO: 320656 - protein, 9 aa, Influenza virus
VCRDNWQGA

SEQ ID NO: 320657 - protein, 9 aa, Influenza virus
CRDNWQGAN

SEQ ID NO: 320658 - protein, 9 aa, Influenza virus
RDNWQGANR

SEQ ID NO: 320659 - protein, 9 aa, Influenza virus
DNWQGANRP

SEQ ID NO: 320660 - protein, 9 aa, Influenza virus
NWQGANRPI

SEQ ID NO: 320661 - protein, 9 aa, Influenza virus
WQGANRPII

SEQ ID NO: 320662 - protein, 9 aa, Influenza virus
QGANRPIIE

SEQ ID NO: 320663 - protein, 9 aa, Influenza virus
GANRPIIEI

SEQ ID NO: 320664 - protein, 9 aa, Influenza virus
ANRPIIEID

SEQ ID NO: 320665 - protein, 9 aa, Influenza virus
NRPIIEIDM

SEQ ID NO: 320666 - protein, 9 aa, Influenza virus
RPIIEIDMN

SEQ ID NO: 320667 - protein, 9 aa, Influenza virus
LEHTSRYVC

SEQ ID NO: 320668 - protein, 9 aa, Influenza virus
EHTSRYVCT

SEQ ID NO: 320669 - protein, 9 aa, Influenza virus
HTSRYVCTG

SEQ ID NO: 320670 - protein, 9 aa, Influenza virus
YVCTGILTD

SEQ ID NO: 320671 - protein, 9 aa, Influenza virus
VCTGILTDT

SEQ ID NO: 320672 - protein, 9 aa, Influenza virus
CTGILTDTS

SEQ ID NO: 320673 - protein, 9 aa, Influenza virus
TGILTDTSR

SEQ ID NO: 320674 - protein, 9 aa, Influenza virus
GILTDTSRP

SEQ ID NO: 320675 - protein, 9 aa, Influenza virus
ILTDTSRPG

SEQ ID NO: 320676 - protein, 9 aa, Influenza virus
LTDTSRPGD

SEQ ID NO: 320677 - protein, 9 aa, Influenza virus
TDTSRPGDK

SEQ ID NO: 320678 - protein, 9 aa, Influenza virus
GDCSNPITG

SEQ ID NO: 320679 - protein, 9 aa, Influenza virus
DCSNPITGS

SEQ ID NO: 320680 - protein, 9 aa, Influenza virus
CSNPITGSP

SEQ ID NO: 320681 - protein, 9 aa, Influenza virus
SNPITGSPG

SEQ ID NO: 320682 - protein, 9 aa, Influenza virus
NPITGSPGA

SEQ ID NO: 320683 - protein, 9 aa, Influenza virus
PITGSPGAP

SEQ ID NO: 320684 - protein, 9 aa, Influenza virus
ITGSPGAPG

SEQ ID NO: 320685 - protein, 9 aa, Influenza virus
APGVKGFGF

SEQ ID NO: 320686 - protein, 9 aa, Influenza virus
PGVKGFGFL

SEQ ID NO: 320687 - protein, 9 aa, Influenza virus
GVKGFGFLN

SEQ ID NO: 320688 - protein, 9 aa, Influenza virus
VKGFGFLNG

SEQ ID NO: 320689 - protein, 9 aa, Influenza virus
DNTWLGRTI

SEQ ID NO: 320690 - protein, 9 aa, Influenza virus
NTWLGRTIS

SEQ ID NO: 320691 - protein, 9 aa, Influenza virus
TWLGRTISP

SEQ ID NO: 320692 - protein, 9 aa, Influenza virus
WLGRTISPR

SEQ ID NO: 320693 - protein, 9 aa, Influenza virus
LGRTISPRS

SEQ ID NO: 320694 - protein, 9 aa, Influenza virus
GRTISPRSR

SEQ ID NO: 320695 - protein, 9 aa, Influenza virus
RTISPRSRS

SEQ ID NO: 320696 - protein, 9 aa, Influenza virus
TISPRSRSG

SEQ ID NO: 320697 - protein, 9 aa, Influenza virus
ISPRSRSGF

SEQ ID NO: 320698 - protein, 9 aa, Influenza virus
SPRSRSGFE

SEQ ID NO: 320699 - protein, 9 aa, Influenza virus
PRSRSGFEM

SEQ ID NO: 320700 - protein, 9 aa, Influenza virus
RSRSGFEML

SEQ ID NO: 320701 - protein, 9 aa, Influenza virus
SRSGFEMLK

SEQ ID NO: 320702 - protein, 9 aa, Influenza virus
RSGFEMLKI

SEQ ID NO: 320703 - protein, 9 aa, Influenza virus
SGFEMLKIP

SEQ ID NO: 320704 - protein, 9 aa, Influenza virus
GFEMLKIPN

SEQ ID NO: 320705 - protein, 9 aa, Influenza virus
FEMLKIPNA

SEQ ID NO: 320706 - protein, 9 aa, Influenza virus
EMLKIPNAG

SEQ ID NO: 320707 - protein, 9 aa, Influenza virus
MLKIPNAGT

SEQ ID NO: 320708 - protein, 9 aa, Influenza virus
LKIPNAGTD

SEQ ID NO: 320709 - protein, 9 aa, Influenza virus
KIPNAGTDP

SEQ ID NO: 320710 - protein, 9 aa, Influenza virus
RQEIVDNNN

SEQ ID NO: 320711 - protein, 9 aa, Influenza virus
QEIVDNNNW

SEQ ID NO: 320712 - protein, 9 aa, Influenza virus
EIVDNNNWS

SEQ ID NO: 320713 - protein, 9 aa, Influenza virus
IVDNNNWSG

SEQ ID NO: 320714 - protein, 9 aa, Influenza virus
VDNNNWSGY

SEQ ID NO: 320715 - protein, 9 aa, Influenza virus
DNNNWSGYS

SEQ ID NO: 320716 - protein, 9 aa, Influenza virus
NNNWSGYSG

SEQ ID NO: 320717 - protein, 9 aa, Influenza virus
NNWSGYSGS

SEQ ID NO: 320718 - protein, 9 aa, Influenza virus
NWSGYSGSF

SEQ ID NO: 320719 - protein, 9 aa, Influenza virus
WSGYSGSFI

SEQ ID NO: 320720 - protein, 9 aa, Influenza virus
SGYSGSFID

SEQ ID NO: 320721 - protein, 9 aa, Influenza virus
GYSGSFIDY

SEQ ID NO: 320722 - protein, 9 aa, Influenza virus
YSGSFIDYW

SEQ ID NO: 320723 - protein, 9 aa, Influenza virus
SGSFIDYWN

SEQ ID NO: 320724 - protein, 9 aa, Influenza virus
GSFIDYWND

SEQ ID NO: 320725 - protein, 9 aa, Influenza virus
SECYNPCFY

SEQ ID NO: 320726 - protein, 9 aa, Influenza virus
ECYNPCFYV

SEQ ID NO: 320727 - protein, 9 aa, Influenza virus
CYNPCFYVE

SEQ ID NO: 320728 - protein, 9 aa, Influenza virus
YNPCFYVEL

SEQ ID NO: 320729 - protein, 9 aa, Influenza virus
NPCFYVELI

SEQ ID NO: 320730 - protein, 9 aa, Influenza virus
PCFYVELIR

SEQ ID NO: 320731 - protein, 9 aa, Influenza virus
CFYVELIRG

SEQ ID NO: 320732 - protein, 9 aa, Influenza virus
FYVELIRGR

SEQ ID NO: 320733 - protein, 9 aa, Influenza virus
YVELIRGRP

SEQ ID NO: 320734 - protein, 9 aa, Influenza virus
VELIRGRPE

SEQ ID NO: 320735 - protein, 9 aa, Influenza virus
ELIRGRPEE

SEQ ID NO: 320736 - protein, 9 aa, Influenza virus
LIRGRPEEA

SEQ ID NO: 320737 - protein, 9 aa, Influenza virus
IRGRPEEAK

SEQ ID NO: 320738 - protein, 9 aa, Influenza virus
RGRPEEAKY

SEQ ID NO: 320739 - protein, 9 aa, Influenza virus
GRPEEAKYV

SEQ ID NO: 320740 - protein, 9 aa, Influenza virus
RPEEAKYVW

SEQ ID NO: 320741 - protein, 9 aa, Influenza virus
PEEAKYVWW

SEQ ID NO: 320742 - protein, 9 aa, Influenza virus
EEAKYVWWT

SEQ ID NO: 320743 - protein, 9 aa, Influenza virus
EAKYVWWTS

SEQ ID NO: 320744 - protein, 9 aa, Influenza virus
AKYVWWTSN

SEQ ID NO: 320745 - protein, 9 aa, Influenza virus
KYVWWTSNS

SEQ ID NO: 320746 - protein, 9 aa, Influenza virus
YVWWTSNSL

SEQ ID NO: 320747 - protein, 9 aa, Influenza virus
VWWTSNSLI

SEQ ID NO: 320748 - protein, 9 aa, Influenza virus
WWTSNSLIA

SEQ ID NO: 320749 - protein, 9 aa, Influenza virus
WTSNSLIAL

SEQ ID NO: 320750 - protein, 9 aa, Influenza virus
TSNSLIALC

SEQ ID NO: 320751 - protein, 9 aa, Influenza virus
SNSLIALCG

SEQ ID NO: 320752 - protein, 9 aa, Influenza virus
NSLIALCGS

SEQ ID NO: 320753 - protein, 9 aa, Influenza virus
SLIALCGSP

SEQ ID NO: 320754 - protein, 9 aa, Influenza virus
PVGSGSFPD

SEQ ID NO: 320755 - protein, 9 aa, Influenza virus
VGSGSFPDG

SEQ ID NO: 320756 - protein, 9 aa, Influenza virus
GSGSFPDGA

SEQ ID NO: 320757 - protein, 9 aa, Influenza virus
SGSFPDGAQ

SEQ ID NO: 320758 - protein, 9 aa, Influenza virus
GSFPDGAQI

SEQ ID NO: 320759 - protein, 9 aa, Influenza virus
SFPDGAQIQ

SEQ ID NO: 320760 - protein, 9 aa, Influenza virus
FPDGAQIQY

SEQ ID NO: 320761 - protein, 9 aa, Influenza virus
PDGAQIQYF

SEQ ID NO: 320762 - protein, 9 aa, Influenza virus
DGAQIQYFS

SEQ ID NO: 320763 - protein, 9 aa, Influenza virus
LLASTNAYD

SEQ ID NO: 320764 - protein, 9 aa, Influenza virus
LASTNAYDR

SEQ ID NO: 320765 - protein, 9 aa, Influenza virus
ASTNAYDRI

SEQ ID NO: 320766 - protein, 9 aa, Influenza virus
STNAYDRIC

SEQ ID NO: 320767 - protein, 9 aa, Influenza virus
TNAYDRICI

SEQ ID NO: 320768 - protein, 9 aa, Influenza virus
NAYDRICIG

SEQ ID NO: 320769 - protein, 9 aa, Influenza virus
AYDRICIGY

SEQ ID NO: 320770 - protein, 9 aa, Influenza virus
YDRICIGYQ

SEQ ID NO: 320771 - protein, 9 aa, Influenza virus
DRICIGYQS

SEQ ID NO: 320772 - protein, 9 aa, Influenza virus
RICIGYQSN

SEQ ID NO: 320773 - protein, 9 aa, Influenza virus
ICIGYQSNN

SEQ ID NO: 320774 - protein, 9 aa, Influenza virus
CIGYQSNNS

SEQ ID NO: 320775 - protein, 9 aa, Influenza virus
IGYQSNNST

SEQ ID NO: 320776 - protein, 9 aa, Influenza virus
GYQSNNSTD

SEQ ID NO: 320777 - protein, 9 aa, Influenza virus
YQSNNSTDT

SEQ ID NO: 320778 - protein, 9 aa, Influenza virus
QSNNSTDTV

SEQ ID NO: 320779 - protein, 9 aa, Influenza virus
SNNSTDTVN

SEQ ID NO: 320780 - protein, 9 aa, Influenza virus
NNSTDTVNT

SEQ ID NO: 320781 - protein, 9 aa, Influenza virus
NSTDTVNTL

SEQ ID NO: 320782 - protein, 9 aa, Influenza virus
STDTVNTLI

SEQ ID NO: 320783 - protein, 9 aa, Influenza virus
TDTVNTLIE

SEQ ID NO: 320784 - protein, 9 aa, Influenza virus
DTVNTLIEQ

SEQ ID NO: 320785 - protein, 9 aa, Influenza virus
TVNTLIEQN

SEQ ID NO: 320786 - protein, 9 aa, Influenza virus
TLIEQNVPV

SEQ ID NO: 320787 - protein, 9 aa, Influenza virus
LIEQNVPVT

SEQ ID NO: 320788 - protein, 9 aa, Influenza virus
IEQNVPVTQ

SEQ ID NO: 320789 - protein, 9 aa, Influenza virus
EQNVPVTQT

SEQ ID NO: 320790 - protein, 9 aa, Influenza virus
QNVPVTQTM

SEQ ID NO: 320791 - protein, 9 aa, Influenza virus
NVPVTQTME

SEQ ID NO: 320792 - protein, 9 aa, Influenza virus
VPVTQTMEL

SEQ ID NO: 320793 - protein, 9 aa, Influenza virus
PVTQTMELV

SEQ ID NO: 320794 - protein, 9 aa, Influenza virus
VTQTMELVE

SEQ ID NO: 320795 - protein, 9 aa, Influenza virus
TQTMELVET

SEQ ID NO: 320796 - protein, 9 aa, Influenza virus
QTMELVETE

SEQ ID NO: 320797 - protein, 9 aa, Influenza virus
TMELVETEK

SEQ ID NO: 320798 - protein, 9 aa, Influenza virus
MELVETEKH

SEQ ID NO: 320799 - protein, 9 aa, Influenza virus
EKHPAYCNT

SEQ ID NO: 320800 - protein, 9 aa, Influenza virus
KHPAYCNTD

SEQ ID NO: 320801 - protein, 9 aa, Influenza virus
HPAYCNTDL

SEQ ID NO: 320802 - protein, 9 aa, Influenza virus
PAYCNTDLG

SEQ ID NO: 320803 - protein, 9 aa, Influenza virus
AYCNTDLGA

SEQ ID NO: 320804 - protein, 9 aa, Influenza virus
YCNTDLGAP

SEQ ID NO: 320805 - protein, 9 aa, Influenza virus
CNTDLGAPL

SEQ ID NO: 320806 - protein, 9 aa, Influenza virus
NTDLGAPLE

SEQ ID NO: 320807 - protein, 9 aa, Influenza virus
TDLGAPLEL

SEQ ID NO: 320808 - protein, 9 aa, Influenza virus
DLGAPLELR

SEQ ID NO: 320809 - protein, 9 aa, Influenza virus
LGAPLELRD

SEQ ID NO: 320810 - protein, 9 aa, Influenza virus
GAPLELRDC

SEQ ID NO: 320811 - protein, 9 aa, Influenza virus
APLELRDCK

SEQ ID NO: 320812 - protein, 9 aa, Influenza virus
PLELRDCKI

SEQ ID NO: 320813 - protein, 9 aa, Influenza virus
LELRDCKIE

SEQ ID NO: 320814 - protein, 9 aa, Influenza virus
ELRDCKIEA

SEQ ID NO: 320815 - protein, 9 aa, Influenza virus
LRDCKIEAV

SEQ ID NO: 320816 - protein, 9 aa, Influenza virus
RDCKIEAVI

SEQ ID NO: 320817 - protein, 9 aa, Influenza virus
DCKIEAVIY

SEQ ID NO: 320818 - protein, 9 aa, Influenza virus
CKIEAVIYG

SEQ ID NO: 320819 - protein, 9 aa, Influenza virus
KIEAVIYGN

SEQ ID NO: 320820 - protein, 9 aa, Influenza virus
IEAVIYGNP

SEQ ID NO: 320821 - protein, 9 aa, Influenza virus
EAVIYGNPK

SEQ ID NO: 320822 - protein, 9 aa, Influenza virus
AVIYGNPKC

SEQ ID NO: 320823 - protein, 9 aa, Influenza virus
VIYGNPKCD

SEQ ID NO: 320824 - protein, 9 aa, Influenza virus
IYGNPKCDI

SEQ ID NO: 320825 - protein, 9 aa, Influenza virus
YGNPKCDIH

SEQ ID NO: 320826 - protein, 9 aa, Influenza virus
GNPKCDIHL

SEQ ID NO: 320827 - protein, 9 aa, Influenza virus
NPKCDIHLK

SEQ ID NO: 320828 - protein, 9 aa, Influenza virus
PKCDIHLKD

SEQ ID NO: 320829 - protein, 9 aa, Influenza virus
KCDIHLKDQ

SEQ ID NO: 320830 - protein, 9 aa, Influenza virus
HLKDQGWSY

SEQ ID NO: 320831 - protein, 9 aa, Influenza virus
LKDQGWSYI

SEQ ID NO: 320832 - protein, 9 aa, Influenza virus
KDQGWSYIV

SEQ ID NO: 320833 - protein, 9 aa, Influenza virus
DQGWSYIVE

SEQ ID NO: 320834 - protein, 9 aa, Influenza virus
QGWSYIVER

SEQ ID NO: 320835 - protein, 9 aa, Influenza virus
GWSYIVERP

SEQ ID NO: 320836 - protein, 9 aa, Influenza virus
WSYIVERPS

SEQ ID NO: 320837 - protein, 9 aa, Influenza virus
SYIVERPSA

SEQ ID NO: 320838 - protein, 9 aa, Influenza virus
YIVERPSAP

SEQ ID NO: 320839 - protein, 9 aa, Influenza virus
IVERPSAPE

SEQ ID NO: 320840 - protein, 9 aa, Influenza virus
VERPSAPEG

SEQ ID NO: 320841 - protein, 9 aa, Influenza virus
ERPSAPEGM

SEQ ID NO: 320842 - protein, 9 aa, Influenza virus
RPSAPEGMC

SEQ ID NO: 320843 - protein, 9 aa, Influenza virus
PSAPEGMCY

SEQ ID NO: 320844 - protein, 9 aa, Influenza virus
SAPEGMCYP

SEQ ID NO: 320845 - protein, 9 aa, Influenza virus
APEGMCYPG

SEQ ID NO: 320846 - protein, 9 aa, Influenza virus
PEGMCYPGS

SEQ ID NO: 320847 - protein, 9 aa, Influenza virus
EGMCYPGSV

SEQ ID NO: 320848 - protein, 9 aa, Influenza virus
GMCYPGSVE

SEQ ID NO: 320849 - protein, 9 aa, Influenza virus
MCYPGSVEN

SEQ ID NO: 320850 - protein, 9 aa, Influenza virus
CYPGSVENL

SEQ ID NO: 320851 - protein, 9 aa, Influenza virus
YPGSVENLE

SEQ ID NO: 320852 - protein, 9 aa, Influenza virus
PGSVENLEE

SEQ ID NO: 320853 - protein, 9 aa, Influenza virus
GSVENLEEL

SEQ ID NO: 320854 - protein, 9 aa, Influenza virus
SVENLEELR

SEQ ID NO: 320855 - protein, 9 aa, Influenza virus
VENLEELRF

SEQ ID NO: 320856 - protein, 9 aa, Influenza virus
ENLEELRFV

SEQ ID NO: 320857 - protein, 9 aa, Influenza virus
NLEELRFVF

SEQ ID NO: 320858 - protein, 9 aa, Influenza virus
LEELRFVFS

SEQ ID NO: 320859 - protein, 9 aa, Influenza virus
EELRFVFSN

SEQ ID NO: 320860 - protein, 9 aa, Influenza virus
ELRFVFSNA

SEQ ID NO: 320861 - protein, 9 aa, Influenza virus
LRFVFSNAA

SEQ ID NO: 320862 - protein, 9 aa, Influenza virus
RFVFSNAAS

SEQ ID NO: 320863 - protein, 9 aa, Influenza virus
FVFSNAASY

SEQ ID NO: 320864 - protein, 9 aa, Influenza virus
VFSNAASYK

SEQ ID NO: 320865 - protein, 9 aa, Influenza virus
FSNAASYKR

SEQ ID NO: 320866 - protein, 9 aa, Influenza virus
SNAASYKRI

SEQ ID NO: 320867 - protein, 9 aa, Influenza virus
NAASYKRIR

SEQ ID NO: 320868 - protein, 9 aa, Influenza virus
AASYKRIRL

SEQ ID NO: 320869 - protein, 9 aa, Influenza virus
ASYKRIRLF

SEQ ID NO: 320870 - protein, 9 aa, Influenza virus
SYKRIRLFD

SEQ ID NO: 320871 - protein, 9 aa, Influenza virus
YKRIRLFDY

SEQ ID NO: 320872 - protein, 9 aa, Influenza virus
KRIRLFDYS

SEQ ID NO: 320873 - protein, 9 aa, Influenza virus
RIRLFDYSR

SEQ ID NO: 320874 - protein, 9 aa, Influenza virus
IRLFDYSRW

SEQ ID NO: 320875 - protein, 9 aa, Influenza virus
RLFDYSRWN

SEQ ID NO: 320876 - protein, 9 aa, Influenza virus
LFDYSRWNV

SEQ ID NO: 320877 - protein, 9 aa, Influenza virus
FDYSRWNVT

SEQ ID NO: 320878 - protein, 9 aa, Influenza virus
WNVTSSGTS

SEQ ID NO: 320879 - protein, 9 aa, Influenza virus
NVTSSGTSK

SEQ ID NO: 320880 - protein, 9 aa, Influenza virus
VTSSGTSKA

SEQ ID NO: 320881 - protein, 9 aa, Influenza virus
TSSGTSKAC

SEQ ID NO: 320882 - protein, 9 aa, Influenza virus
SSGTSKACN

SEQ ID NO: 320883 - protein, 9 aa, Influenza virus
SGTSKACNA

SEQ ID NO: 320884 - protein, 9 aa, Influenza virus
GTSKACNAS

SEQ ID NO: 320885 - protein, 9 aa, Influenza virus
TSKACNAST

SEQ ID NO: 320886 - protein, 9 aa, Influenza virus
SKACNASTG

SEQ ID NO: 320887 - protein, 9 aa, Influenza virus
KACNASTGG

SEQ ID NO: 320888 - protein, 9 aa, Influenza virus
ACNASTGGQ

SEQ ID NO: 320889 - protein, 9 aa, Influenza virus
CNASTGGQS

SEQ ID NO: 320890 - protein, 9 aa, Influenza virus
NASTGGQSF

SEQ ID NO: 320891 - protein, 9 aa, Influenza virus
ASTGGQSFY

SEQ ID NO: 320892 - protein, 9 aa, Influenza virus
STGGQSFYR

SEQ ID NO: 320893 - protein, 9 aa, Influenza virus
TGGQSFYRS

SEQ ID NO: 320894 - protein, 9 aa, Influenza virus
GGQSFYRSI

SEQ ID NO: 320895 - protein, 9 aa, Influenza virus
GQSFYRSIN

SEQ ID NO: 320896 - protein, 9 aa, Influenza virus
QSFYRSINW

SEQ ID NO: 320897 - protein, 9 aa, Influenza virus
SFYRSINWL

SEQ ID NO: 320898 - protein, 9 aa, Influenza virus
FYRSINWLT

SEQ ID NO: 320899 - protein, 9 aa, Influenza virus
YRSINWLTK

SEQ ID NO: 320900 - protein, 9 aa, Influenza virus
RSINWLTKK

SEQ ID NO: 320901 - protein, 9 aa, Influenza virus
SINWLTKKK

SEQ ID NO: 320902 - protein, 9 aa, Influenza virus
INWLTKKKP

SEQ ID NO: 320903 - protein, 9 aa, Influenza virus
NWLTKKKPD

SEQ ID NO: 320904 - protein, 9 aa, Influenza virus
WLTKKKPDT

SEQ ID NO: 320905 - protein, 9 aa, Influenza virus
LTKKKPDTY

SEQ ID NO: 320906 - protein, 9 aa, Influenza virus
TKKKPDTYD

SEQ ID NO: 320907 - protein, 9 aa, Influenza virus
KKKPDTYDF

SEQ ID NO: 320908 - protein, 9 aa, Influenza virus
KKPDTYDFN

SEQ ID NO: 320909 - protein, 9 aa, Influenza virus
KPDTYDFNE

SEQ ID NO: 320910 - protein, 9 aa, Influenza virus
NPEAYNFNE

SEQ ID NO: 320911 - protein, 9 aa, Influenza virus
PDTYDFNEG

SEQ ID NO: 320912 - protein, 9 aa, Influenza virus
DTYDFNEGS

SEQ ID NO: 320913 - protein, 9 aa, Influenza virus
TYDFNEGSY

SEQ ID NO: 320914 - protein, 9 aa, Influenza virus
FNEGSYVNN

SEQ ID NO: 320915 - protein, 9 aa, Influenza virus
NNEDGDIIF

SEQ ID NO: 320916 - protein, 9 aa, Influenza virus
NEDGDIIFL

SEQ ID NO: 320917 - protein, 9 aa, Influenza virus
EDGDIIFLW

SEQ ID NO: 320918 - protein, 9 aa, Influenza virus
DGDIIFLWG

SEQ ID NO: 320919 - protein, 9 aa, Influenza virus
GDIIFLWGI

SEQ ID NO: 320920 - protein, 9 aa, Influenza virus
DIIFLWGIH

SEQ ID NO: 320921 - protein, 9 aa, Influenza virus
IIFLWGIHH

SEQ ID NO: 320922 - protein, 9 aa, Influenza virus
IFLWGIHHP

SEQ ID NO: 320923 - protein, 9 aa, Influenza virus
FLWGIHHPP

SEQ ID NO: 320924 - protein, 9 aa, Influenza virus
LWGIHHPPD

SEQ ID NO: 320925 - protein, 9 aa, Influenza virus
WGIHHPPDT

SEQ ID NO: 320926 - protein, 9 aa, Influenza virus
GIHHPPDTK

SEQ ID NO: 320927 - protein, 9 aa, Influenza virus
IHHPPDTKE

SEQ ID NO: 320928 - protein, 9 aa, Influenza virus
HHPPDTKEQ

SEQ ID NO: 320929 - protein, 9 aa, Influenza virus
HPPDTKEQT

SEQ ID NO: 320930 - protein, 9 aa, Influenza virus
TKEQTTLYK

SEQ ID NO: 320931 - protein, 9 aa, Influenza virus
KEQTTLYKN

SEQ ID NO: 320932 - protein, 9 aa, Influenza virus
EQTTLYKNA

SEQ ID NO: 320933 - protein, 9 aa, Influenza virus
QTTLYKNAN

SEQ ID NO: 320934 - protein, 9 aa, Influenza virus
TTLYKNANT

SEQ ID NO: 320935 - protein, 9 aa, Influenza virus
TLYKNANTL

SEQ ID NO: 320936 - protein, 9 aa, Influenza virus
LYKNANTLS

SEQ ID NO: 320937 - protein, 9 aa, Influenza virus
YKNANTLSS

SEQ ID NO: 320938 - protein, 9 aa, Influenza virus
KNANTLSSV

SEQ ID NO: 320939 - protein, 9 aa, Influenza virus
NANTLSSVT

SEQ ID NO: 320940 - protein, 9 aa, Influenza virus
ANTLSSVTT

SEQ ID NO: 320941 - protein, 9 aa, Influenza virus
NTLSSVTTN

SEQ ID NO: 320942 - protein, 9 aa, Influenza virus
TLSSVTTNT

SEQ ID NO: 320943 - protein, 9 aa, Influenza virus
LSSVTTNTI

SEQ ID NO: 320944 - protein, 9 aa, Influenza virus
SSVTTNTIN

SEQ ID NO: 320945 - protein, 9 aa, Influenza virus
SVTTNTINR

SEQ ID NO: 320946 - protein, 9 aa, Influenza virus
VTTNTINRS

SEQ ID NO: 320947 - protein, 9 aa, Influenza virus
TTNTINRSF

SEQ ID NO: 320948 - protein, 9 aa, Influenza virus
TNTINRSFQ

SEQ ID NO: 320949 - protein, 9 aa, Influenza virus
NTINRSFQP

SEQ ID NO: 320950 - protein, 9 aa, Influenza virus
TINRSFQPN

SEQ ID NO: 320951 - protein, 9 aa, Influenza virus
INRSFQPNI

SEQ ID NO: 320952 - protein, 9 aa, Influenza virus
NRSFQPNIG

SEQ ID NO: 320953 - protein, 9 aa, Influenza virus
RSFQPNIGP

SEQ ID NO: 320954 - protein, 9 aa, Influenza virus
SFQPNIGPR

SEQ ID NO: 320955 - protein, 9 aa, Influenza virus
FQPNIGPRP

SEQ ID NO: 320956 - protein, 9 aa, Influenza virus
QPNIGPRPL

SEQ ID NO: 320957 - protein, 9 aa, Influenza virus
PNIGPRPLV

SEQ ID NO: 320958 - protein, 9 aa, Influenza virus
NIGPRPLVR

SEQ ID NO: 320959 - protein, 9 aa, Influenza virus
IGPRPLVRG

SEQ ID NO: 320960 - protein, 9 aa, Influenza virus
GPRPLVRGQ

SEQ ID NO: 320961 - protein, 9 aa, Influenza virus
PRPLVRGQQ

SEQ ID NO: 320962 - protein, 9 aa, Influenza virus
RPLVRGQQG

SEQ ID NO: 320963 - protein, 9 aa, Influenza virus
PLVRGQQGR

SEQ ID NO: 320964 - protein, 9 aa, Influenza virus
LVRGQQGRM

SEQ ID NO: 320965 - protein, 9 aa, Influenza virus
VRGQQGRMD

SEQ ID NO: 320966 - protein, 9 aa, Influenza virus
RGQQGRMDY

SEQ ID NO: 320967 - protein, 9 aa, Influenza virus
GQQGRMDYY

SEQ ID NO: 320968 - protein, 9 aa, Influenza virus
QQGRMDYYW

SEQ ID NO: 320969 - protein, 9 aa, Influenza virus
QGRMDYYWG

SEQ ID NO: 320970 - protein, 9 aa, Influenza virus
GRMDYYWGI

SEQ ID NO: 320971 - protein, 9 aa, Influenza virus
RMDYYWGIL

SEQ ID NO: 320972 - protein, 9 aa, Influenza virus
MDYYWGILK

SEQ ID NO: 320973 - protein, 9 aa, Influenza virus
DYYWGILKR

SEQ ID NO: 320974 - protein, 9 aa, Influenza virus
YYWGILKRG

SEQ ID NO: 320975 - protein, 9 aa, Influenza virus
YWGILKRGE

SEQ ID NO: 320976 - protein, 9 aa, Influenza virus
WGILKRGET

SEQ ID NO: 320977 - protein, 9 aa, Influenza virus
GILKRGETL

SEQ ID NO: 320978 - protein, 9 aa, Influenza virus
ILKRGETLK

SEQ ID NO: 320979 - protein, 9 aa, Influenza virus
LKRGETLKI

SEQ ID NO: 320980 - protein, 9 aa, Influenza virus
KRGETLKIR

SEQ ID NO: 320981 - protein, 9 aa, Influenza virus
RGETLKIRT

SEQ ID NO: 320982 - protein, 9 aa, Influenza virus
GETLKIRTN

SEQ ID NO: 320983 - protein, 9 aa, Influenza virus
ETLKIRTNG

SEQ ID NO: 320984 - protein, 9 aa, Influenza virus
TLKIRTNGN

SEQ ID NO: 320985 - protein, 9 aa, Influenza virus
LKIRTNGNL

SEQ ID NO: 320986 - protein, 9 aa, Influenza virus
KIRTNGNLI

SEQ ID NO: 320987 - protein, 9 aa, Influenza virus
IRTNGNLIA

SEQ ID NO: 320988 - protein, 9 aa, Influenza virus
RTNGNLIAP

SEQ ID NO: 320989 - protein, 9 aa, Influenza virus
TNGNLIAPE

SEQ ID NO: 320990 - protein, 9 aa, Influenza virus
NGNLIAPEF

SEQ ID NO: 320991 - protein, 9 aa, Influenza virus
GNLIAPEFG

SEQ ID NO: 320992 - protein, 9 aa, Influenza virus
NLIAPEFGY

SEQ ID NO: 320993 - protein, 9 aa, Influenza virus
LIAPEFGYL

SEQ ID NO: 320994 - protein, 9 aa, Influenza virus
IAPEFGYLL

SEQ ID NO: 320995 - protein, 9 aa, Influenza virus
APEFGYLLK

SEQ ID NO: 320996 - protein, 9 aa, Influenza virus
PEFGYLLKG

SEQ ID NO: 320997 - protein, 9 aa, Influenza virus
EFGYLLKGE

SEQ ID NO: 320998 - protein, 9 aa, Influenza virus
FGYLLKGES

SEQ ID NO: 320999 - protein, 9 aa, Influenza virus
GYLLKGESH

SEQ ID NO: 321000 - protein, 9 aa, Influenza virus
YLLKGESHG

SEQ ID NO: 321001 - protein, 9 aa, Influenza virus
LLKGESHGR

SEQ ID NO: 321002 - protein, 9 aa, Influenza virus
GESHGRIIQ

SEQ ID NO: 321003 - protein, 9 aa, Influenza virus
ESHGRIIQN

SEQ ID NO: 321004 - protein, 9 aa, Influenza virus
SHGRIIQNE

SEQ ID NO: 321005 - protein, 9 aa, Influenza virus
HGRIIQNED

SEQ ID NO: 321006 - protein, 9 aa, Influenza virus
GRIIQNEDI

SEQ ID NO: 321007 - protein, 9 aa, Influenza virus
RIIQNEDIP

SEQ ID NO: 321008 - protein, 9 aa, Influenza virus
IIQNEDIPI

SEQ ID NO: 321009 - protein, 9 aa, Influenza virus
IQNEDIPIG

SEQ ID NO: 321010 - protein, 9 aa, Influenza virus
QNEDIPIGN

SEQ ID NO: 321011 - protein, 9 aa, Influenza virus
NEDIPIGNC

SEQ ID NO: 321012 - protein, 9 aa, Influenza virus
NCHTKCQTY

SEQ ID NO: 321013 - protein, 9 aa, Influenza virus
CHTKCQTYA

SEQ ID NO: 321014 - protein, 9 aa, Influenza virus
HTKCQTYAG

SEQ ID NO: 321015 - protein, 9 aa, Influenza virus
TKCQTYAGA

SEQ ID NO: 321016 - protein, 9 aa, Influenza virus
KCQTYAGAI

SEQ ID NO: 321017 - protein, 9 aa, Influenza virus
CQTYAGAIN

SEQ ID NO: 321018 - protein, 9 aa, Influenza virus
QTYAGAINS

SEQ ID NO: 321019 - protein, 9 aa, Influenza virus
TYAGAINSS

SEQ ID NO: 321020 - protein, 9 aa, Influenza virus
YAGAINSSK

SEQ ID NO: 321021 - protein, 9 aa, Influenza virus
AGAINSSKP

SEQ ID NO: 321022 - protein, 9 aa, Influenza virus
GAINSSKPF

SEQ ID NO: 321023 - protein, 9 aa, Influenza virus
AINSSKPFQ

SEQ ID NO: 321024 - protein, 9 aa, Influenza virus
INSSKPFQN

SEQ ID NO: 321025 - protein, 9 aa, Influenza virus
NSSKPFQNA

SEQ ID NO: 321026 - protein, 9 aa, Influenza virus
SSKPFQNAS

SEQ ID NO: 321027 - protein, 9 aa, Influenza virus
SKPFQNASR

SEQ ID NO: 321028 - protein, 9 aa, Influenza virus
KPFQNASRH

SEQ ID NO: 321029 - protein, 9 aa, Influenza virus
PFQNASRHY

SEQ ID NO: 321030 - protein, 9 aa, Influenza virus
FQNASRHYM

SEQ ID NO: 321031 - protein, 9 aa, Influenza virus
QNASRHYMG

SEQ ID NO: 321032 - protein, 9 aa, Influenza virus
NASRHYMGE

SEQ ID NO: 321033 - protein, 9 aa, Influenza virus
ASRHYMGEC

SEQ ID NO: 321034 - protein, 9 aa, Influenza virus
SRHYMGECP

SEQ ID NO: 321035 - protein, 9 aa, Influenza virus
RHYMGECPK

SEQ ID NO: 321036 - protein, 9 aa, Influenza virus
HYMGECPKY

SEQ ID NO: 321037 - protein, 9 aa, Influenza virus
YMGECPKYV

SEQ ID NO: 321038 - protein, 9 aa, Influenza virus
MGECPKYVK

SEQ ID NO: 321039 - protein, 9 aa, Influenza virus
GECPKYVKK

SEQ ID NO: 321040 - protein, 9 aa, Influenza virus
YVKKASLRL

SEQ ID NO: 321041 - protein, 9 aa, Influenza virus
VKKASLRLA

SEQ ID NO: 321042 - protein, 9 aa, Influenza virus
KKASLRLAV

SEQ ID NO: 321043 - protein, 9 aa, Influenza virus
KASLRLAVG

SEQ ID NO: 321044 - protein, 9 aa, Influenza virus
ASLRLAVGL

SEQ ID NO: 321045 - protein, 9 aa, Influenza virus
SLRLAVGLR

SEQ ID NO: 321046 - protein, 9 aa, Influenza virus
LRLAVGLRN

SEQ ID NO: 321047 - protein, 9 aa, Influenza virus
RLAVGLRNT

SEQ ID NO: 321048 - protein, 9 aa, Influenza virus
LAVGLRNTP

SEQ ID NO: 321049 - protein, 9 aa, Influenza virus
AVGLRNTPS

SEQ ID NO: 321050 - protein, 9 aa, Influenza virus
VGLRNTPSI

SEQ ID NO: 321051 - protein, 9 aa, Influenza virus
GLRNTPSIE

SEQ ID NO: 321052 - protein, 9 aa, Influenza virus
LRNTPSIEP

SEQ ID NO: 321053 - protein, 9 aa, Influenza virus
RNTPSIEPK

SEQ ID NO: 321054 - protein, 9 aa, Influenza virus
NTPSIEPKG

SEQ ID NO: 321055 - protein, 9 aa, Influenza virus
TPSIEPKGL

SEQ ID NO: 321056 - protein, 9 aa, Influenza virus
PSIEPKGLF

SEQ ID NO: 321057 - protein, 9 aa, Influenza virus
SIEPKGLFG

SEQ ID NO: 321058 - protein, 9 aa, Influenza virus
IEPKGLFGA

SEQ ID NO: 321059 - protein, 9 aa, Influenza virus
EPKGLFGAI

SEQ ID NO: 321060 - protein, 9 aa, Influenza virus
PKGLFGAIA

SEQ ID NO: 321061 - protein, 9 aa, Influenza virus
KGLFGAIAG

SEQ ID NO: 321062 - protein, 9 aa, Influenza virus
GLFGAIAGF

SEQ ID NO: 321063 - protein, 9 aa, Influenza virus
LFGAIAGFI

SEQ ID NO: 321064 - protein, 9 aa, Influenza virus
FGAIAGFIE

SEQ ID NO: 321065 - protein, 9 aa, Influenza virus
GAIAGFIEG

SEQ ID NO: 321066 - protein, 9 aa, Influenza virus
AIAGFIEGG

SEQ ID NO: 321067 - protein, 9 aa, Influenza virus
IAGFIEGGW

SEQ ID NO: 321068 - protein, 9 aa, Influenza virus
AGFIEGGWS

SEQ ID NO: 321069 - protein, 9 aa, Influenza virus
GFIEGGWSG

SEQ ID NO: 321070 - protein, 9 aa, Influenza virus
FIEGGWSGM

SEQ ID NO: 321071 - protein, 9 aa, Influenza virus
IEGGWSGMI

SEQ ID NO: 321072 - protein, 9 aa, Influenza virus
EGGWSGMID

SEQ ID NO: 321073 - protein, 9 aa, Influenza virus
GGWSGMIDG

SEQ ID NO: 321074 - protein, 9 aa, Influenza virus
GWSGMIDGW

SEQ ID NO: 321075 - protein, 9 aa, Influenza virus
WSGMIDGWY

SEQ ID NO: 321076 - protein, 9 aa, Influenza virus
SGMIDGWYG

SEQ ID NO: 321077 - protein, 9 aa, Influenza virus
GMIDGWYGF

SEQ ID NO: 321078 - protein, 9 aa, Influenza virus
MIDGWYGFH

SEQ ID NO: 321079 - protein, 9 aa, Influenza virus
IDGWYGFHH

SEQ ID NO: 321080 - protein, 9 aa, Influenza virus
DGWYGFHHS

SEQ ID NO: 321081 - protein, 9 aa, Influenza virus
GWYGFHHSN

SEQ ID NO: 321082 - protein, 9 aa, Influenza virus
WYGFHHSNS

SEQ ID NO: 321083 - protein, 9 aa, Influenza virus
YGFHHSNSE

SEQ ID NO: 321084 - protein, 9 aa, Influenza virus
GFHHSNSEG

SEQ ID NO: 321085 - protein, 9 aa, Influenza virus
FHHSNSEGT

SEQ ID NO: 321086 - protein, 9 aa, Influenza virus
HHSNSEGTG

SEQ ID NO: 321087 - protein, 9 aa, Influenza virus
HSNSEGTGM

SEQ ID NO: 321088 - protein, 9 aa, Influenza virus
SNSEGTGMA

SEQ ID NO: 321089 - protein, 9 aa, Influenza virus
NSEGTGMAA

SEQ ID NO: 321090 - protein, 9 aa, Influenza virus
SEGTGMAAD

SEQ ID NO: 321091 - protein, 9 aa, Influenza virus
EGTGMAADQ

SEQ ID NO: 321092 - protein, 9 aa, Influenza virus
GTGMAADQK

SEQ ID NO: 321093 - protein, 9 aa, Influenza virus
TGMAADQKS

SEQ ID NO: 321094 - protein, 9 aa, Influenza virus
GMAADQKST

SEQ ID NO: 321095 - protein, 9 aa, Influenza virus
MAADQKSTQ

SEQ ID NO: 321096 - protein, 9 aa, Influenza virus
AADQKSTQE

SEQ ID NO: 321097 - protein, 9 aa, Influenza virus
ADQKSTQEA

SEQ ID NO: 321098 - protein, 9 aa, Influenza virus
DQKSTQEAI

SEQ ID NO: 321099 - protein, 9 aa, Influenza virus
QKSTQEAID

SEQ ID NO: 321100 - protein, 9 aa, Influenza virus
KSTQEAIDK

SEQ ID NO: 321101 - protein, 9 aa, Influenza virus
STQEAIDKI

SEQ ID NO: 321102 - protein, 9 aa, Influenza virus
TQEAIDKIT

SEQ ID NO: 321103 - protein, 9 aa, Influenza virus
QEAIDKITN

SEQ ID NO: 321104 - protein, 9 aa, Influenza virus
EAIDKITNK

SEQ ID NO: 321105 - protein, 9 aa, Influenza virus
AIDKITNKV

SEQ ID NO: 321106 - protein, 9 aa, Influenza virus
IDKITNKVN

SEQ ID NO: 321107 - protein, 9 aa, Influenza virus
DKITNKVNN

SEQ ID NO: 321108 - protein, 9 aa, Influenza virus
KITNKVNNI

SEQ ID NO: 321109 - protein, 9 aa, Influenza virus
ITNKVNNIV

SEQ ID NO: 321110 - protein, 9 aa, Influenza virus
TNKVNNIVD

SEQ ID NO: 321111 - protein, 9 aa, Influenza virus
NKVNNIVDK

SEQ ID NO: 321112 - protein, 9 aa, Influenza virus
KVNNIVDKM

SEQ ID NO: 321113 - protein, 9 aa, Influenza virus
VNNIVDKMN

SEQ ID NO: 321114 - protein, 9 aa, Influenza virus
NNIVDKMNR

SEQ ID NO: 321115 - protein, 9 aa, Influenza virus
NIVDKMNRE

SEQ ID NO: 321116 - protein, 9 aa, Influenza virus
IVDKMNREF

SEQ ID NO: 321117 - protein, 9 aa, Influenza virus
VDKMNREFE

SEQ ID NO: 321118 - protein, 9 aa, Influenza virus
DKMNREFEV

SEQ ID NO: 321119 - protein, 9 aa, Influenza virus
KMNREFEVV

SEQ ID NO: 321120 - protein, 9 aa, Influenza virus
MNREFEVVN

SEQ ID NO: 321121 - protein, 9 aa, Influenza virus
NREFEVVNH

SEQ ID NO: 321122 - protein, 9 aa, Influenza virus
REFEVVNHE

SEQ ID NO: 321123 - protein, 9 aa, Influenza virus
EFEVVNHEF

SEQ ID NO: 321124 - protein, 9 aa, Influenza virus
FEVVNHEFS

SEQ ID NO: 321125 - protein, 9 aa, Influenza virus
EKRINMIND

SEQ ID NO: 321126 - protein, 9 aa, Influenza virus
KRINMINDK

SEQ ID NO: 321127 - protein, 9 aa, Influenza virus
RINMINDKI

SEQ ID NO: 321128 - protein, 9 aa, Influenza virus
INMINDKID

SEQ ID NO: 321129 - protein, 9 aa, Influenza virus
NMINDKIDD

SEQ ID NO: 321130 - protein, 9 aa, Influenza virus
MINDKIDDQ

SEQ ID NO: 321131 - protein, 9 aa, Influenza virus
INDKIDDQI

SEQ ID NO: 321132 - protein, 9 aa, Influenza virus
NDKIDDQIE

SEQ ID NO: 321133 - protein, 9 aa, Influenza virus
DKIDDQIED

SEQ ID NO: 321134 - protein, 9 aa, Influenza virus
KIDDQIEDL

SEQ ID NO: 321135 - protein, 9 aa, Influenza virus
IDDQIEDLW

SEQ ID NO: 321136 - protein, 9 aa, Influenza virus
DDQIEDLWA

SEQ ID NO: 321137 - protein, 9 aa, Influenza virus
DQIEDLWAY

SEQ ID NO: 321138 - protein, 9 aa, Influenza virus
QIEDLWAYN

SEQ ID NO: 321139 - protein, 9 aa, Influenza virus
IEDLWAYNA

SEQ ID NO: 321140 - protein, 9 aa, Influenza virus
EDLWAYNAE

SEQ ID NO: 321141 - protein, 9 aa, Influenza virus
DLWAYNAEL

SEQ ID NO: 321142 - protein, 9 aa, Influenza virus
LWAYNAELL

SEQ ID NO: 321143 - protein, 9 aa, Influenza virus
WAYNAELLV

SEQ ID NO: 321144 - protein, 9 aa, Influenza virus
AYNAELLVL

SEQ ID NO: 321145 - protein, 9 aa, Influenza virus
YNAELLVLL

SEQ ID NO: 321146 - protein, 9 aa, Influenza virus
NAELLVLLE

SEQ ID NO: 321147 - protein, 9 aa, Influenza virus
AELLVLLEN

SEQ ID NO: 321148 - protein, 9 aa, Influenza virus
ELLVLLENQ

SEQ ID NO: 321149 - protein, 9 aa, Influenza virus
LLVLLENQK

SEQ ID NO: 321150 - protein, 9 aa, Influenza virus
LVLLENQKT

SEQ ID NO: 321151 - protein, 9 aa, Influenza virus
VLLENQKTL

SEQ ID NO: 321152 - protein, 9 aa, Influenza virus
LLENQKTLD

SEQ ID NO: 321153 - protein, 9 aa, Influenza virus
LENQKTLDE

SEQ ID NO: 321154 - protein, 9 aa, Influenza virus
ENQKTLDEH

SEQ ID NO: 321155 - protein, 9 aa, Influenza virus
NQKTLDEHD

SEQ ID NO: 321156 - protein, 9 aa, Influenza virus
QKTLDEHDS

SEQ ID NO: 321157 - protein, 9 aa, Influenza virus
KTLDEHDSN

SEQ ID NO: 321158 - protein, 9 aa, Influenza virus
TLDEHDSNV

SEQ ID NO: 321159 - protein, 9 aa, Influenza virus
LDEHDSNVK

SEQ ID NO: 321160 - protein, 9 aa, Influenza virus
DEHDSNVKN

SEQ ID NO: 321161 - protein, 9 aa, Influenza virus
EHDSNVKNL

SEQ ID NO: 321162 - protein, 9 aa, Influenza virus
HDSNVKNLF

SEQ ID NO: 321163 - protein, 9 aa, Influenza virus
DSNVKNLFD

SEQ ID NO: 321164 - protein, 9 aa, Influenza virus
SNVKNLFDE

SEQ ID NO: 321165 - protein, 9 aa, Influenza virus
NVKNLFDEV

SEQ ID NO: 321166 - protein, 9 aa, Influenza virus
VKNLFDEVK

SEQ ID NO: 321167 - protein, 9 aa, Influenza virus
KNLFDEVKR

SEQ ID NO: 321168 - protein, 9 aa, Influenza virus
NLFDEVKRR

SEQ ID NO: 321169 - protein, 9 aa, Influenza virus
LFDEVKRRL

SEQ ID NO: 321170 - protein, 9 aa, Influenza virus
FDEVKRRLS

SEQ ID NO: 321171 - protein, 9 aa, Influenza virus
DEVKRRLSA

SEQ ID NO: 321172 - protein, 9 aa, Influenza virus
EVKRRLSAN

SEQ ID NO: 321173 - protein, 9 aa, Influenza virus
VKRRLSANA

SEQ ID NO: 321174 - protein, 9 aa, Influenza virus
RRLSANAID

SEQ ID NO: 321175 - protein, 9 aa, Influenza virus
NAIDAGNGC

SEQ ID NO: 321176 - protein, 9 aa, Influenza virus
AIDAGNGCF

SEQ ID NO: 321177 - protein, 9 aa, Influenza virus
IDAGNGCFD

SEQ ID NO: 321178 - protein, 9 aa, Influenza virus
DAGNGCFDI

SEQ ID NO: 321179 - protein, 9 aa, Influenza virus
AGNGCFDIL

SEQ ID NO: 321180 - protein, 9 aa, Influenza virus
GNGCFDILH

SEQ ID NO: 321181 - protein, 9 aa, Influenza virus
NGCFDILHK

SEQ ID NO: 321182 - protein, 9 aa, Influenza virus
GCFDILHKC

SEQ ID NO: 321183 - protein, 9 aa, Influenza virus
CFDILHKCN

SEQ ID NO: 321184 - protein, 9 aa, Influenza virus
FDILHKCNN

SEQ ID NO: 321185 - protein, 9 aa, Influenza virus
DILHKCNNE

SEQ ID NO: 321186 - protein, 9 aa, Influenza virus
ILHKCNNEC

SEQ ID NO: 321187 - protein, 9 aa, Influenza virus
LHKCNNECM

SEQ ID NO: 321188 - protein, 9 aa, Influenza virus
HKCNNECME

SEQ ID NO: 321189 - protein, 9 aa, Influenza virus
KCNNECMET

SEQ ID NO: 321190 - protein, 9 aa, Influenza virus
CNNECMETI

SEQ ID NO: 321191 - protein, 9 aa, Influenza virus
NNECMETIK

SEQ ID NO: 321192 - protein, 9 aa, Influenza virus
NECMETIKN

SEQ ID NO: 321193 - protein, 9 aa, Influenza virus
ECMETIKNG

SEQ ID NO: 321194 - protein, 9 aa, Influenza virus
CMETIKNGT

SEQ ID NO: 321195 - protein, 9 aa, Influenza virus
METIKNGTY

SEQ ID NO: 321196 - protein, 9 aa, Influenza virus
ETIKNGTYN

SEQ ID NO: 321197 - protein, 9 aa, Influenza virus
TIKNGTYNH

SEQ ID NO: 321198 - protein, 9 aa, Influenza virus
IKNGTYDHK

SEQ ID NO: 321199 - protein, 9 aa, Influenza virus
KNGTYDHKE

SEQ ID NO: 321200 - protein, 9 aa, Influenza virus
NGTYNHKEY

SEQ ID NO: 321201 - protein, 9 aa, Influenza virus
GTYNHKEYE

SEQ ID NO: 321202 - protein, 9 aa, Influenza virus
TYDHKEYEE

SEQ ID NO: 321203 - protein, 9 aa, Influenza virus
YNHKEYEEE

SEQ ID NO: 321204 - protein, 9 aa, Influenza virus
DHKEYEEEA

SEQ ID NO: 321205 - protein, 9 aa, Influenza virus
HKEYEEEAK

SEQ ID NO: 321206 - protein, 9 aa, Influenza virus
KEYEEEAKL

SEQ ID NO: 321207 - protein, 9 aa, Influenza virus
EYEEEAKLE

SEQ ID NO: 321208 - protein, 9 aa, Influenza virus
YEEEAKLER

SEQ ID NO: 321209 - protein, 9 aa, Influenza virus
EEEAKLERS

SEQ ID NO: 321210 - protein, 9 aa, Influenza virus
EEAKLERSK

SEQ ID NO: 321211 - protein, 9 aa, Influenza virus
EAKLERSKI

SEQ ID NO: 321212 - protein, 9 aa, Influenza virus
AKLERSKIN

SEQ ID NO: 321213 - protein, 9 aa, Influenza virus
KLERSKING

SEQ ID NO: 321214 - protein, 9 aa, Influenza virus
LERSKINGV

SEQ ID NO: 321215 - protein, 9 aa, Influenza virus
ERSKINGVK

SEQ ID NO: 321216 - protein, 9 aa, Influenza virus
RSKINGVKL

SEQ ID NO: 321217 - protein, 9 aa, Influenza virus
SKINGVKLE

SEQ ID NO: 321218 - protein, 9 aa, Influenza virus
KINGVKLEE

SEQ ID NO: 321219 - protein, 9 aa, Influenza virus
INGVKLEEN

SEQ ID NO: 321220 - protein, 9 aa, Influenza virus
NGVKLEENT

SEQ ID NO: 321221 - protein, 9 aa, Influenza virus
GVKLEENTT

SEQ ID NO: 321222 - protein, 9 aa, Influenza virus
VKLEENTTY

SEQ ID NO: 321223 - protein, 9 aa, Influenza virus
KLEENTTYK

SEQ ID NO: 321224 - protein, 9 aa, Influenza virus
LEENTTYKI

SEQ ID NO: 321225 - protein, 9 aa, Influenza virus
EENTTYKIL

SEQ ID NO: 321226 - protein, 9 aa, Influenza virus
ENTTYKILS

SEQ ID NO: 321227 - protein, 9 aa, Influenza virus
NTTYKILSI

SEQ ID NO: 321228 - protein, 9 aa, Influenza virus
TTYKILSIY

SEQ ID NO: 321229 - protein, 9 aa, Influenza virus
TYKILSIYS

SEQ ID NO: 321230 - protein, 9 aa, Influenza virus
YKILSIYST

SEQ ID NO: 321231 - protein, 9 aa, Influenza virus
KILSIYSTV

SEQ ID NO: 321232 - protein, 9 aa, Influenza virus
ILSIYSTVA

SEQ ID NO: 321233 - protein, 9 aa, Influenza virus
LSIYSTVAA

SEQ ID NO: 321234 - protein, 9 aa, Influenza virus
SIYSTVAAS

SEQ ID NO: 321235 - protein, 9 aa, Influenza virus
IYSTVAASL

SEQ ID NO: 321236 - protein, 9 aa, Influenza virus
YSTVAASLC

SEQ ID NO: 321237 - protein, 9 aa, Influenza virus
STVAASLCL

SEQ ID NO: 321238 - protein, 9 aa, Influenza virus
TVAASLCLA

SEQ ID NO: 321239 - protein, 9 aa, Influenza virus
VAASLCLAI

SEQ ID NO: 321240 - protein, 9 aa, Influenza virus
AASLCLAIL

SEQ ID NO: 321241 - protein, 9 aa, Influenza virus
ASLCLAILI

SEQ ID NO: 321242 - protein, 9 aa, Influenza virus
SLCLAILIA

SEQ ID NO: 321243 - protein, 9 aa, Influenza virus
LCLAILIAG

SEQ ID NO: 321244 - protein, 9 aa, Influenza virus
CLAILIAGG

SEQ ID NO: 321245 - protein, 9 aa, Influenza virus
LAILIAGGL

SEQ ID NO: 321246 - protein, 9 aa, Influenza virus
AILIAGGLI

SEQ ID NO: 321247 - protein, 9 aa, Influenza virus
ILIAGGLIL

SEQ ID NO: 321248 - protein, 9 aa, Influenza virus
LIAGGLILG

SEQ ID NO: 321249 - protein, 9 aa, Influenza virus
IAGGLILGM

SEQ ID NO: 321250 - protein, 9 aa, Influenza virus
AGGLILGMQ

SEQ ID NO: 321251 - protein, 9 aa, Influenza virus
GGLILGMQN

SEQ ID NO: 321252 - protein, 9 aa, Influenza virus
GLILGMQNG

SEQ ID NO: 321253 - protein, 9 aa, Influenza virus
LILGMQNGS

SEQ ID NO: 321254 - protein, 9 aa, Influenza virus
ILGMQNGSC

SEQ ID NO: 321255 - protein, 9 aa, Influenza virus
LGMQNGSCR

SEQ ID NO: 321256 - protein, 9 aa, Influenza virus
GMQNGSCRC

SEQ ID NO: 321257 - protein, 9 aa, Influenza virus
MQNGSCRCM

SEQ ID NO: 321258 - protein, 9 aa, Influenza virus
QNGSCRCMF

SEQ ID NO: 321259 - protein, 9 aa, Influenza virus
NGSCRCMFC

SEQ ID NO: 321260 - protein, 9 aa, Influenza virus
GSCRCMFCI

SEQ ID NO: 321261 - protein, 9 aa, Influenza virus
RWKHVTNTI

SEQ ID NO: 321262 - protein, 9 aa, Influenza virus
WKHVTNTIL

SEQ ID NO: 321263 - protein, 9 aa, Influenza virus
GYQSTNSTE

SEQ ID NO: 321264 - protein, 9 aa, Influenza virus
YQSTNSTET

SEQ ID NO: 321265 - protein, 9 aa, Influenza virus
QSTNSTETV

SEQ ID NO: 321266 - protein, 9 aa, Influenza virus
TNSTETVDT

SEQ ID NO: 321267 - protein, 9 aa, Influenza virus
EHNGMLCAT

SEQ ID NO: 321268 - protein, 9 aa, Influenza virus
IEGLIYGNP

SEQ ID NO: 321269 - protein, 9 aa, Influenza virus
EGLIYGNPS

SEQ ID NO: 321270 - protein, 9 aa, Influenza virus
GLIYGNPSC

SEQ ID NO: 321271 - protein, 9 aa, Influenza virus
LIYGNPSCD

SEQ ID NO: 321272 - protein, 9 aa, Influenza virus
WSYIVERPS

SEQ ID NO: 321273 - protein, 9 aa, Influenza virus
SYIVERPSA

SEQ ID NO: 321274 - protein, 9 aa, Influenza virus
FYRSMRWLT

SEQ ID NO: 321275 - protein, 9 aa, Influenza virus
VLKPGQTLR

SEQ ID NO: 321276 - protein, 9 aa, Influenza virus
LKPGQTLRI

SEQ ID NO: 321277 - protein, 9 aa, Influenza virus
KPGQTLRIR

SEQ ID NO: 321278 - protein, 9 aa, Influenza virus
PGQTLRIRS

SEQ ID NO: 321279 - protein, 9 aa, Influenza virus
GQTLRIRSN

SEQ ID NO: 321280 - protein, 9 aa, Influenza virus
QTLRIRSNG

SEQ ID NO: 321281 - protein, 9 aa, Influenza virus
TLRIRSNGN

SEQ ID NO: 321282 - protein, 9 aa, Influenza virus
LRIRSNGNL

SEQ ID NO: 321283 - protein, 9 aa, Influenza virus
IRSNGNLIA

SEQ ID NO: 321284 - protein, 9 aa, Influenza virus
RSNGNLIAP

SEQ ID NO: 321285 - protein, 9 aa, Influenza virus
SNGNLIAPW

SEQ ID NO: 321286 - protein, 9 aa, Influenza virus
NGNLIAPWY

SEQ ID NO: 321287 - protein, 9 aa, Influenza virus
GNLIAPWYG

SEQ ID NO: 321288 - protein, 9 aa, Influenza virus
NLIAPWYGH

SEQ ID NO: 321289 - protein, 9 aa, Influenza virus
LPFQNVSKY

SEQ ID NO: 321290 - protein, 9 aa, Influenza virus
FQNVSKYAF

SEQ ID NO: 321291 - protein, 9 aa, Influenza virus
QNVSKYAFG

SEQ ID NO: 321292 - protein, 9 aa, Influenza virus
SLKLAVGLR

SEQ ID NO: 321293 - protein, 9 aa, Influenza virus
LKLAVGLRN

SEQ ID NO: 321294 - protein, 9 aa, Influenza virus
RGLFGAIAG

SEQ ID NO: 321295 - protein, 9 aa, Influenza virus
GLFGAIAGF

SEQ ID NO: 321296 - protein, 9 aa, Influenza virus
LFGAIAGFI

SEQ ID NO: 321297 - protein, 9 aa, Influenza virus
FGAIAGFIE

SEQ ID NO: 321298 - protein, 9 aa, Influenza virus
GAIAGFIEG

SEQ ID NO: 321299 - protein, 9 aa, Influenza virus
AIAGFIEGG

SEQ ID NO: 321300 - protein, 9 aa, Influenza virus
IAGFIEGGW

SEQ ID NO: 321301 - protein, 9 aa, Influenza virus
AGFIEGGWS

SEQ ID NO: 321302 - protein, 9 aa, Influenza virus
GFIEGGWSG

SEQ ID NO: 321303 - protein, 9 aa, Influenza virus
FIEGGWSGL

SEQ ID NO: 321304 - protein, 9 aa, Influenza virus
IEGGWSGLV

SEQ ID NO: 321305 - protein, 9 aa, Influenza virus
EGGWSGLVA

SEQ ID NO: 321306 - protein, 9 aa, Influenza virus
GGWSGLVAG

SEQ ID NO: 321307 - protein, 9 aa, Influenza virus
GWSGLVAGW

SEQ ID NO: 321308 - protein, 9 aa, Influenza virus
WSGLVAGWY

SEQ ID NO: 321309 - protein, 9 aa, Influenza virus
SGLVAGWYG

SEQ ID NO: 321310 - protein, 9 aa, Influenza virus
GLVAGWYGF

SEQ ID NO: 321311 - protein, 9 aa, Influenza virus
LVAGWYGFQ

SEQ ID NO: 321312 - protein, 9 aa, Influenza virus
VAGWYGFQH

SEQ ID NO: 321313 - protein, 9 aa, Influenza virus
AGWYGFQHS

SEQ ID NO: 321314 - protein, 9 aa, Influenza virus
GWYGFQHSN

SEQ ID NO: 321315 - protein, 9 aa, Influenza virus
WYGFQHSND

SEQ ID NO: 321316 - protein, 9 aa, Influenza virus
YGFQHSNDQ

SEQ ID NO: 321317 - protein, 9 aa, Influenza virus
GFQHSNDQG

SEQ ID NO: 321318 - protein, 9 aa, Influenza virus
DQIQDIWAY

SEQ ID NO: 321319 - protein, 9 aa, Influenza virus
QIQDIWAYN

SEQ ID NO: 321320 - protein, 9 aa, Influenza virus
IQDIWAYNA

SEQ ID NO: 321321 - protein, 9 aa, Influenza virus
QDIWAYNAE

SEQ ID NO: 321322 - protein, 9 aa, Influenza virus
DIWAYNAEL

SEQ ID NO: 321323 - protein, 9 aa, Influenza virus
IWAYNAELL

SEQ ID NO: 321324 - protein, 9 aa, Influenza virus
WAYNAELLV

SEQ ID NO: 321325 - protein, 9 aa, Influenza virus
AYNAELLVL

SEQ ID NO: 321326 - protein, 9 aa, Influenza virus
YNAELLVLL

SEQ ID NO: 321327 - protein, 9 aa, Influenza virus
NAELLVLLE

SEQ ID NO: 321328 - protein, 9 aa, Influenza virus
AELLVLLEN

SEQ ID NO: 321329 - protein, 9 aa, Influenza virus
ELLVLLENQ

SEQ ID NO: 321330 - protein, 9 aa, Influenza virus
LLVLLENQK

SEQ ID NO: 321331 - protein, 9 aa, Influenza virus
LVLLENQKT

SEQ ID NO: 321332 - protein, 9 aa, Influenza virus
VLLENQKTL

SEQ ID NO: 321333 - protein, 9 aa, Influenza virus
LLENQKTLD

SEQ ID NO: 321334 - protein, 9 aa, Influenza virus
LENQKTLDE

SEQ ID NO: 321335 - protein, 9 aa, Influenza virus
ENQKTLDEH

SEQ ID NO: 321336 - protein, 9 aa, Influenza virus
NQKTLDEHD

SEQ ID NO: 321337 - protein, 9 aa, Influenza virus
EDGKGCFEL

SEQ ID NO: 321338 - protein, 9 aa, Influenza virus
DGKGCFELY

SEQ ID NO: 321339 - protein, 9 aa, Influenza virus
GKGCFELYH

SEQ ID NO: 321340 - protein, 9 aa, Influenza virus
KGCFELYHK

SEQ ID NO: 321341 - protein, 9 aa, Influenza virus
GCFELYHKC

SEQ ID NO: 321342 - protein, 9 aa, Influenza virus
CFELYHKCD

SEQ ID NO: 321343 - protein, 9 aa, Influenza virus
CMETIRNGT

SEQ ID NO: 321344 - protein, 9 aa, Influenza virus
METIRNGTY

SEQ ID NO: 321345 - protein, 9 aa, Influenza virus
EGTYKILTI

SEQ ID NO: 321346 - protein, 9 aa, Influenza virus
GTYKILTIY

SEQ ID NO: 321347 - protein, 9 aa, Influenza virus
TYKILTIYS

SEQ ID NO: 321348 - protein, 9 aa, Influenza virus
YKILTIYST

SEQ ID NO: 321349 - protein, 9 aa, Influenza virus
KILTIYSTV

SEQ ID NO: 321350 - protein, 9 aa, Influenza virus
ILTIYSTVA

SEQ ID NO: 321351 - protein, 9 aa, Influenza virus
LTIYSTVAS

SEQ ID NO: 321352 - protein, 9 aa, Influenza virus
TIYSTVASS

SEQ ID NO: 321353 - protein, 9 aa, Influenza virus
IYSTVASSL

SEQ ID NO: 321354 - protein, 9 aa, Influenza virus
RWKHVTNTI

SEQ ID NO: 321355 - protein, 9 aa, Influenza virus
WKHVTNTIL

SEQ ID NO: 321356 - protein, 9 aa, Influenza virus
GYQSTNSTE

SEQ ID NO: 321357 - protein, 9 aa, Influenza virus
YQSTNSTET

SEQ ID NO: 321358 - protein, 9 aa, Influenza virus
QSTNSTETV

SEQ ID NO: 321359 - protein, 9 aa, Influenza virus
TNSTETVDT

SEQ ID NO: 321360 - protein, 9 aa, Influenza virus
EHNGMLCAT

SEQ ID NO: 321361 - protein, 9 aa, Influenza virus
IEGLIYGNP

SEQ ID NO: 321362 - protein, 9 aa, Influenza virus
EGLIYGNPS

SEQ ID NO: 321363 - protein, 9 aa, Influenza virus
GLIYGNPSC

SEQ ID NO: 321364 - protein, 9 aa, Influenza virus
LIYGNPSCD

SEQ ID NO: 321365 - protein, 9 aa, Influenza virus
WSYIVERPS

SEQ ID NO: 321366 - protein, 9 aa, Influenza virus
SYIVERPSA

SEQ ID NO: 321367 - protein, 9 aa, Influenza virus
FYRSMRWLT

SEQ ID NO: 321368 - protein, 9 aa, Influenza virus
SVLKPGQTL

SEQ ID NO: 321369 - protein, 9 aa, Influenza virus
VLKPGQTLR

SEQ ID NO: 321370 - protein, 9 aa, Influenza virus
LKPGQTLRI

SEQ ID NO: 321371 - protein, 9 aa, Influenza virus
KPGQTLRIR

SEQ ID NO: 321372 - protein, 9 aa, Influenza virus
PGQTLRIRS

SEQ ID NO: 321373 - protein, 9 aa, Influenza virus
GQTLRIRSN

SEQ ID NO: 321374 - protein, 9 aa, Influenza virus
QTLRIRSNG

SEQ ID NO: 321375 - protein, 9 aa, Influenza virus
TLRIRSNGN

SEQ ID NO: 321376 - protein, 9 aa, Influenza virus
LRIRSNGNL

SEQ ID NO: 321377 - protein, 9 aa, Influenza virus
IRSNGNLIA

SEQ ID NO: 321378 - protein, 9 aa, Influenza virus
RSNGNLIAP

SEQ ID NO: 321379 - protein, 9 aa, Influenza virus
SNGNLIAPW

SEQ ID NO: 321380 - protein, 9 aa, Influenza virus
NGNLIAPWY

SEQ ID NO: 321381 - protein, 9 aa, Influenza virus
GNLIAPWYG

SEQ ID NO: 321382 - protein, 9 aa, Influenza virus
NLIAPWYGH

SEQ ID NO: 321383 - protein, 9 aa, Influenza virus
LPFQNVSKY

SEQ ID NO: 321384 - protein, 9 aa, Influenza virus
FQNVSKYAF

SEQ ID NO: 321385 - protein, 9 aa, Influenza virus
QNVSKYAFG

SEQ ID NO: 321386 - protein, 9 aa, Influenza virus
YAFGNCSKY

SEQ ID NO: 321387 - protein, 9 aa, Influenza virus
SLKLAVGLR

SEQ ID NO: 321388 - protein, 9 aa, Influenza virus
LKLAVGLRN

SEQ ID NO: 321389 - protein, 9 aa, Influenza virus
RGLFGAIAG

SEQ ID NO: 321390 - protein, 9 aa, Influenza virus
GLFGAIAGF

SEQ ID NO: 321391 - protein, 9 aa, Influenza virus
LFGAIAGFI

SEQ ID NO: 321392 - protein, 9 aa, Influenza virus
FGAIAGFIE

SEQ ID NO: 321393 - protein, 9 aa, Influenza virus
GAIAGFIEG

SEQ ID NO: 321394 - protein, 9 aa, Influenza virus
AIAGFIEGG

SEQ ID NO: 321395 - protein, 9 aa, Influenza virus
IAGFIEGGW

SEQ ID NO: 321396 - protein, 9 aa, Influenza virus
AGFIEGGWS

SEQ ID NO: 321397 - protein, 9 aa, Influenza virus
GFIEGGWSG

SEQ ID NO: 321398 - protein, 9 aa, Influenza virus
FIEGGWSGL

SEQ ID NO: 321399 - protein, 9 aa, Influenza virus
IEGGWSGLV

SEQ ID NO: 321400 - protein, 9 aa, Influenza virus
EGGWSGLVA

SEQ ID NO: 321401 - protein, 9 aa, Influenza virus
GGWSGLVAG

SEQ ID NO: 321402 - protein, 9 aa, Influenza virus
GWSGLVAGW

SEQ ID NO: 321403 - protein, 9 aa, Influenza virus
WSGLVAGWY

SEQ ID NO: 321404 - protein, 9 aa, Influenza virus
SGLVAGWYG

SEQ ID NO: 321405 - protein, 9 aa, Influenza virus
GLVAGWYGF

SEQ ID NO: 321406 - protein, 9 aa, Influenza virus
LVAGWYGFQ

SEQ ID NO: 321407 - protein, 9 aa, Influenza virus
VAGWYGFQH

SEQ ID NO: 321408 - protein, 9 aa, Influenza virus
AGWYGFQHS

SEQ ID NO: 321409 - protein, 9 aa, Influenza virus
GWYGFQHSN

SEQ ID NO: 321410 - protein, 9 aa, Influenza virus
WYGFQHSND

SEQ ID NO: 321411 - protein, 9 aa, Influenza virus
YGFQHSNDQ

SEQ ID NO: 321412 - protein, 9 aa, Influenza virus
GFQHSNDQG

SEQ ID NO: 321413 - protein, 9 aa, Influenza virus
DDQIQDIWA

SEQ ID NO: 321414 - protein, 9 aa, Influenza virus
DQIQDIWAY

SEQ ID NO: 321415 - protein, 9 aa, Influenza virus
QIQDIWAYN

SEQ ID NO: 321416 - protein, 9 aa, Influenza virus
IQDIWAYNA

SEQ ID NO: 321417 - protein, 9 aa, Influenza virus
QDIWAYNAE

SEQ ID NO: 321418 - protein, 9 aa, Influenza virus
DIWAYNAEL

SEQ ID NO: 321419 - protein, 9 aa, Influenza virus
IWAYNAELL

SEQ ID NO: 321420 - protein, 9 aa, Influenza virus
WAYNAELLV

SEQ ID NO: 321421 - protein, 9 aa, Influenza virus
AYNAELLVL

SEQ ID NO: 321422 - protein, 9 aa, Influenza virus
YNAELLVLL

SEQ ID NO: 321423 - protein, 9 aa, Influenza virus
NAELLVLLE

SEQ ID NO: 321424 - protein, 9 aa, Influenza virus
AELLVLLEN

SEQ ID NO: 321425 - protein, 9 aa, Influenza virus
ELLVLLENQ

SEQ ID NO: 321426 - protein, 9 aa, Influenza virus
LLVLLENQK

SEQ ID NO: 321427 - protein, 9 aa, Influenza virus
LVLLENQKT

SEQ ID NO: 321428 - protein, 9 aa, Influenza virus
VLLENQKTL

SEQ ID NO: 321429 - protein, 9 aa, Influenza virus
LLENQKTLD

SEQ ID NO: 321430 - protein, 9 aa, Influenza virus
LENQKTLDE

SEQ ID NO: 321431 - protein, 9 aa, Influenza virus
ENQKTLDEH

SEQ ID NO: 321432 - protein, 9 aa, Influenza virus
NQKTLDEHD

SEQ ID NO: 321433 - protein, 9 aa, Influenza virus
QKTLDEHDA

SEQ ID NO: 321434 - protein, 9 aa, Influenza virus
KTLDEHDAN

SEQ ID NO: 321435 - protein, 9 aa, Influenza virus
LDEHDANVN

SEQ ID NO: 321436 - protein, 9 aa, Influenza virus
EDGKGCFEL

SEQ ID NO: 321437 - protein, 9 aa, Influenza virus
DGKGCFELY

SEQ ID NO: 321438 - protein, 9 aa, Influenza virus
GKGCFELYH

SEQ ID NO: 321439 - protein, 9 aa, Influenza virus
KGCFELYHK

SEQ ID NO: 321440 - protein, 9 aa, Influenza virus
GCFELYHKC

SEQ ID NO: 321441 - protein, 9 aa, Influenza virus
CFELYHKCD

SEQ ID NO: 321442 - protein, 9 aa, Influenza virus
CMETIRNGT

SEQ ID NO: 321443 - protein, 9 aa, Influenza virus
METIRNGTY

SEQ ID NO: 321444 - protein, 9 aa, Influenza virus
EGTYKILTI

SEQ ID NO: 321445 - protein, 9 aa, Influenza virus
GTYKILTIY

SEQ ID NO: 321446 - protein, 9 aa, Influenza virus
TYKILTIYS

SEQ ID NO: 321447 - protein, 9 aa, Influenza virus
YKILTIYST

SEQ ID NO: 321448 - protein, 9 aa, Influenza virus
KILTIYSTV

SEQ ID NO: 321449 - protein, 9 aa, Influenza virus
ILTIYSTVA

SEQ ID NO: 321450 - protein, 9 aa, Influenza virus
LTIYSTVAS

SEQ ID NO: 321451 - protein, 9 aa, Influenza virus
TIYSTVASS

SEQ ID NO: 321452 - protein, 9 aa, Influenza virus
IYSTVASSL

SEQ ID NO: 321453 - protein, 9 aa, Influenza virus
IAIGSVSRT

SEQ ID NO: 321454 - protein, 9 aa, Influenza virus
VPLVPCEPI

SEQ ID NO: 321455 - protein, 9 aa, Influenza virus
PLVPCEPII

SEQ ID NO: 321456 - protein, 9 aa, Influenza virus
LVPCEPIII

SEQ ID NO: 321457 - protein, 9 aa, Influenza virus
WSKPQCQIT

SEQ ID NO: 321458 - protein, 9 aa, Influenza virus
SKPQCQITG

SEQ ID NO: 321459 - protein, 9 aa, Influenza virus
KPQCQITGF

SEQ ID NO: 321460 - protein, 9 aa, Influenza virus
PQCQITGFA

SEQ ID NO: 321461 - protein, 9 aa, Influenza virus
QCQITGFAP

SEQ ID NO: 321462 - protein, 9 aa, Influenza virus
RLSAGGDIW

SEQ ID NO: 321463 - protein, 9 aa, Influenza virus
VTREPYVSC

SEQ ID NO: 321464 - protein, 9 aa, Influenza virus
KCYQFALGQ

SEQ ID NO: 321465 - protein, 9 aa, Influenza virus
CYQFALGQG

SEQ ID NO: 321466 - protein, 9 aa, Influenza virus
YQFALGQGT

SEQ ID NO: 321467 - protein, 9 aa, Influenza virus
QFALGQGTT

SEQ ID NO: 321468 - protein, 9 aa, Influenza virus
FALGQGTTL

SEQ ID NO: 321469 - protein, 9 aa, Influenza virus
PHRTLLMNE

SEQ ID NO: 321470 - protein, 9 aa, Influenza virus
HRTLLMNEL

SEQ ID NO: 321471 - protein, 9 aa, Influenza virus
RTLLMNELG

SEQ ID NO: 321472 - protein, 9 aa, Influenza virus
TLLMNELGV

SEQ ID NO: 321473 - protein, 9 aa, Influenza virus
LLMNELGVP

SEQ ID NO: 321474 - protein, 9 aa, Influenza virus
LMNELGVPF

SEQ ID NO: 321475 - protein, 9 aa, Influenza virus
MNELGVPFH

SEQ ID NO: 321476 - protein, 9 aa, Influenza virus
NELGVPFHL

SEQ ID NO: 321477 - protein, 9 aa, Influenza virus
TKQVCIAWS

SEQ ID NO: 321478 - protein, 9 aa, Influenza virus
KQVCIAWSS

SEQ ID NO: 321479 - protein, 9 aa, Influenza virus
QVCIAWSSS

SEQ ID NO: 321480 - protein, 9 aa, Influenza virus
VCIAWSSSS

SEQ ID NO: 321481 - protein, 9 aa, Influenza virus
CIAWSSSSC

SEQ ID NO: 321482 - protein, 9 aa, Influenza virus
IAWSSSSCH

SEQ ID NO: 321483 - protein, 9 aa, Influenza virus
AWSSSSCHD

SEQ ID NO: 321484 - protein, 9 aa, Influenza virus
WSSSSCHDG

SEQ ID NO: 321485 - protein, 9 aa, Influenza virus
SSSSCHDGK

SEQ ID NO: 321486 - protein, 9 aa, Influenza virus
SSSCHDGKA

SEQ ID NO: 321487 - protein, 9 aa, Influenza virus
SSCHDGKAW

SEQ ID NO: 321488 - protein, 9 aa, Influenza virus
SCHDGKAWL

SEQ ID NO: 321489 - protein, 9 aa, Influenza virus
CHDGKAWLH

SEQ ID NO: 321490 - protein, 9 aa, Influenza virus
NILRTQESE

SEQ ID NO: 321491 - protein, 9 aa, Influenza virus
ILRTQESEC

SEQ ID NO: 321492 - protein, 9 aa, Influenza virus
LRTQESECV

SEQ ID NO: 321493 - protein, 9 aa, Influenza virus
RTQESECVC

SEQ ID NO: 321494 - protein, 9 aa, Influenza virus
TQESECVCI

SEQ ID NO: 321495 - protein, 9 aa, Influenza virus
ESECVCING

SEQ ID NO: 321496 - protein, 9 aa, Influenza virus
INGTCTVVM

SEQ ID NO: 321497 - protein, 9 aa, Influenza virus
GTCTVVMTD

SEQ ID NO: 321498 - protein, 9 aa, Influenza virus
GSAQHVEEC

SEQ ID NO: 321499 - protein, 9 aa, Influenza virus
SAQHVEECS

SEQ ID NO: 321500 - protein, 9 aa, Influenza virus
AQHVEECSC

SEQ ID NO: 321501 - protein, 9 aa, Influenza virus
QHVEECSCY

SEQ ID NO: 321502 - protein, 9 aa, Influenza virus
HVEECSCYP

SEQ ID NO: 321503 - protein, 9 aa, Influenza virus
VEECSCYPR

SEQ ID NO: 321504 - protein, 9 aa, Influenza virus
EECSCYPRY

SEQ ID NO: 321505 - protein, 9 aa, Influenza virus
CVCRDNWKG

SEQ ID NO: 321506 - protein, 9 aa, Influenza virus
VCRDNWKGS

SEQ ID NO: 321507 - protein, 9 aa, Influenza virus
CRDNWKGSN

SEQ ID NO: 321508 - protein, 9 aa, Influenza virus
RDNWKGSNR

SEQ ID NO: 321509 - protein, 9 aa, Influenza virus
DNWKGSNRP

SEQ ID NO: 321510 - protein, 9 aa, Influenza virus
NWKGSNRPV

SEQ ID NO: 321511 - protein, 9 aa, Influenza virus
YVCSGLVGD

SEQ ID NO: 321512 - protein, 9 aa, Influenza virus
VCSGLVGDT

SEQ ID NO: 321513 - protein, 9 aa, Influenza virus
CSGLVGDTP

SEQ ID NO: 321514 - protein, 9 aa, Influenza virus
SGLVGDTPR

SEQ ID NO: 321515 - protein, 9 aa, Influenza virus
GLVGDTPRN

SEQ ID NO: 321516 - protein, 9 aa, Influenza virus
PGVKGWAFD

SEQ ID NO: 321517 - protein, 9 aa, Influenza virus
CINRCFYVE

SEQ ID NO: 321518 - protein, 9 aa, Influenza virus
INRCFYVEL

SEQ ID NO: 321519 - protein, 9 aa, Influenza virus
NRCFYVELI

SEQ ID NO: 321520 - protein, 9 aa, Influenza virus
RCFYVELIR

SEQ ID NO: 321521 - protein, 9 aa, Influenza virus
CFYVELIRG

SEQ ID NO: 321522 - protein, 9 aa, Influenza virus
FYVELIRGR

SEQ ID NO: 321523 - protein, 9 aa, Influenza virus
YVELIRGRP

SEQ ID NO: 321524 - protein, 9 aa, Influenza virus
FCGTSGTYG

SEQ ID NO: 321525 - protein, 9 aa, Influenza virus
GTYGTGSWP

SEQ ID NO: 321526 - protein, 9 aa, Influenza virus
TYGTGSWPD

SEQ ID NO: 321527 - protein, 9 aa, Influenza virus
TGSWPDGAN

SEQ ID NO: 321528 - protein, 9 aa, Influenza virus
GSWPDGANI

SEQ ID NO: 321529 - protein, 9 aa, Influenza virus
MLKMSLLTE

SEQ ID NO: 321530 - protein, 9 aa, Influenza virus
LKMSLLTEV

SEQ ID NO: 321531 - protein, 9 aa, Influenza virus
KMSLLTEVE

SEQ ID NO: 321532 - protein, 9 aa, Influenza virus
MSLLTEVET

SEQ ID NO: 321533 - protein, 9 aa, Influenza virus
SLLTEVETY

SEQ ID NO: 321534 - protein, 9 aa, Influenza virus
LLTEVETYV

SEQ ID NO: 321535 - protein, 9 aa, Influenza virus
LTEVETYVL

SEQ ID NO: 321536 - protein, 9 aa, Influenza virus
TEVETYVLS

SEQ ID NO: 321537 - protein, 9 aa, Influenza virus
EVETYVLSI

SEQ ID NO: 321538 - protein, 9 aa, Influenza virus
VETYVLSIV

SEQ ID NO: 321539 - protein, 9 aa, Influenza virus
ETYVLSIVP

SEQ ID NO: 321540 - protein, 9 aa, Influenza virus
TYVLSIVPS

SEQ ID NO: 321541 - protein, 9 aa, Influenza virus
YVLSIVPSG

SEQ ID NO: 321542 - protein, 9 aa, Influenza virus
VLSIVPSGP

SEQ ID NO: 321543 - protein, 9 aa, Influenza virus
LSIVPSGPL

SEQ ID NO: 321544 - protein, 9 aa, Influenza virus
SIVPSGPLK

SEQ ID NO: 321545 - protein, 9 aa, Influenza virus
IVPSGPLKA

SEQ ID NO: 321546 - protein, 9 aa, Influenza virus
VPSGPLKAE

SEQ ID NO: 321547 - protein, 9 aa, Influenza virus
PSGPLKAEI

SEQ ID NO: 321548 - protein, 9 aa, Influenza virus
SGPLKAEIA

SEQ ID NO: 321549 - protein, 9 aa, Influenza virus
GPLKAEIAQ

SEQ ID NO: 321550 - protein, 9 aa, Influenza virus
PLKAEIAQR

SEQ ID NO: 321551 - protein, 9 aa, Influenza virus
LKAEIAQRL

SEQ ID NO: 321552 - protein, 9 aa, Influenza virus
KAEIAQRLE

SEQ ID NO: 321553 - protein, 9 aa, Influenza virus
AEIAQRLED

SEQ ID NO: 321554 - protein, 9 aa, Influenza virus
EIAQRLEDV

SEQ ID NO: 321555 - protein, 9 aa, Influenza virus
IAQRLEDVF

SEQ ID NO: 321556 - protein, 9 aa, Influenza virus
AQRLEDVFA

SEQ ID NO: 321557 - protein, 9 aa, Influenza virus
QRLEDVFAG

SEQ ID NO: 321558 - protein, 9 aa, Influenza virus
RLEDVFAGK

SEQ ID NO: 321559 - protein, 9 aa, Influenza virus
LEDVFAGKN

SEQ ID NO: 321560 - protein, 9 aa, Influenza virus
VFAGKNTDL

SEQ ID NO: 321561 - protein, 9 aa, Influenza virus
FAGKNTDLE

SEQ ID NO: 321562 - protein, 9 aa, Influenza virus
AGKNTDLEA

SEQ ID NO: 321563 - protein, 9 aa, Influenza virus
GKNTDLEAL

SEQ ID NO: 321564 - protein, 9 aa, Influenza virus
KNTDLEALM

SEQ ID NO: 321565 - protein, 9 aa, Influenza virus
NTDLEALME

SEQ ID NO: 321566 - protein, 9 aa, Influenza virus
TDLEALMEW

SEQ ID NO: 321567 - protein, 9 aa, Influenza virus
DLEALMEWL

SEQ ID NO: 321568 - protein, 9 aa, Influenza virus
LEALMEWLK

SEQ ID NO: 321569 - protein, 9 aa, Influenza virus
EALMEWLKT

SEQ ID NO: 321570 - protein, 9 aa, Influenza virus
ALMEWLKTR

SEQ ID NO: 321571 - protein, 9 aa, Influenza virus
LMEWLKTRP

SEQ ID NO: 321572 - protein, 9 aa, Influenza virus
MEWLKTRPI

SEQ ID NO: 321573 - protein, 9 aa, Influenza virus
EWLKTRPIL

SEQ ID NO: 321574 - protein, 9 aa, Influenza virus
WLKTRPILS

SEQ ID NO: 321575 - protein, 9 aa, Influenza virus
LKTRPILSP

SEQ ID NO: 321576 - protein, 9 aa, Influenza virus
KTRPILSPL

SEQ ID NO: 321577 - protein, 9 aa, Influenza virus
TRPILSPLT

SEQ ID NO: 321578 - protein, 9 aa, Influenza virus
RPILSPLTK

SEQ ID NO: 321579 - protein, 9 aa, Influenza virus
PILSPLTKG

SEQ ID NO: 321580 - protein, 9 aa, Influenza virus
ILSPLTKGI

SEQ ID NO: 321581 - protein, 9 aa, Influenza virus
LSPLTKGIL

SEQ ID NO: 321582 - protein, 9 aa, Influenza virus
SPLTKGILG

SEQ ID NO: 321583 - protein, 9 aa, Influenza virus
PLTKGILGF

SEQ ID NO: 321584 - protein, 9 aa, Influenza virus
LTKGILGFV

SEQ ID NO: 321585 - protein, 9 aa, Influenza virus
TKGILGFVF

SEQ ID NO: 321586 - protein, 9 aa, Influenza virus
KGILGFVFT

SEQ ID NO: 321587 - protein, 9 aa, Influenza virus
GILGFVFTL

SEQ ID NO: 321588 - protein, 9 aa, Influenza virus
ILGFVFTLT

SEQ ID NO: 321589 - protein, 9 aa, Influenza virus
LGFVFTLTV

SEQ ID NO: 321590 - protein, 9 aa, Influenza virus
GFVFTLTVP

SEQ ID NO: 321591 - protein, 9 aa, Influenza virus
FVFTLTVPS

SEQ ID NO: 321592 - protein, 9 aa, Influenza virus
VFTLTVPSE

SEQ ID NO: 321593 - protein, 9 aa, Influenza virus
FTLTVPSER

SEQ ID NO: 321594 - protein, 9 aa, Influenza virus
TLTVPSERG

SEQ ID NO: 321595 - protein, 9 aa, Influenza virus
LTVPSERGL

SEQ ID NO: 321596 - protein, 9 aa, Influenza virus
TVPSERGLQ

SEQ ID NO: 321597 - protein, 9 aa, Influenza virus
VPSERGLQR

SEQ ID NO: 321598 - protein, 9 aa, Influenza virus
PSERGLQRR

SEQ ID NO: 321599 - protein, 9 aa, Influenza virus
SERGLQRRR

SEQ ID NO: 321600 - protein, 9 aa, Influenza virus
ERGLQRRRF

SEQ ID NO: 321601 - protein, 9 aa, Influenza virus
RGLQRRRFV

SEQ ID NO: 321602 - protein, 9 aa, Influenza virus
GLQRRRFVQ

SEQ ID NO: 321603 - protein, 9 aa, Influenza virus
LQRRRFVQN

SEQ ID NO: 321604 - protein, 9 aa, Influenza virus
QRRRFVQNA

SEQ ID NO: 321605 - protein, 9 aa, Influenza virus
RRRFVQNAL

SEQ ID NO: 321606 - protein, 9 aa, Influenza virus
RRFVQNALN

SEQ ID NO: 321607 - protein, 9 aa, Influenza virus
RFVQNALNG

SEQ ID NO: 321608 - protein, 9 aa, Influenza virus
FVQNALNGN

SEQ ID NO: 321609 - protein, 9 aa, Influenza virus
VQNALNGNG

SEQ ID NO: 321610 - protein, 9 aa, Influenza virus
QNALNGNGD

SEQ ID NO: 321611 - protein, 9 aa, Influenza virus
NALNGNGDP

SEQ ID NO: 321612 - protein, 9 aa, Influenza virus
ALNGNGDPN

SEQ ID NO: 321613 - protein, 9 aa, Influenza virus
LNGNGDPNN

SEQ ID NO: 321614 - protein, 9 aa, Influenza virus
NGNGDPNNM

SEQ ID NO: 321615 - protein, 9 aa, Influenza virus
GNGDPNNMD

SEQ ID NO: 321616 - protein, 9 aa, Influenza virus
NGDPNNMDR

SEQ ID NO: 321617 - protein, 9 aa, Influenza virus
GDPNNMDRA

SEQ ID NO: 321618 - protein, 9 aa, Influenza virus
DPNNMDRAV

SEQ ID NO: 321619 - protein, 9 aa, Influenza virus
PNNMDRAVK

SEQ ID NO: 321620 - protein, 9 aa, Influenza virus
NNMDRAVKL

SEQ ID NO: 321621 - protein, 9 aa, Influenza virus
NMDRAVKLY

SEQ ID NO: 321622 - protein, 9 aa, Influenza virus
MDRAVKLYR

SEQ ID NO: 321623 - protein, 9 aa, Influenza virus
DRAVKLYRK

SEQ ID NO: 321624 - protein, 9 aa, Influenza virus
RAVKLYRKL

SEQ ID NO: 321625 - protein, 9 aa, Influenza virus
AVKLYRKLK

SEQ ID NO: 321626 - protein, 9 aa, Influenza virus
VKLYRKLKR

SEQ ID NO: 321627 - protein, 9 aa, Influenza virus
KLYRKLKRE

SEQ ID NO: 321628 - protein, 9 aa, Influenza virus
LYRKLKREI

SEQ ID NO: 321629 - protein, 9 aa, Influenza virus
YRKLKREIT

SEQ ID NO: 321630 - protein, 9 aa, Influenza virus
RKLKREITF

SEQ ID NO: 321631 - protein, 9 aa, Influenza virus
KLKREITFH

SEQ ID NO: 321632 - protein, 9 aa, Influenza virus
LKREITFHG

SEQ ID NO: 321633 - protein, 9 aa, Influenza virus
KREITFHGA

SEQ ID NO: 321634 - protein, 9 aa, Influenza virus
REITFHGAK

SEQ ID NO: 321635 - protein, 9 aa, Influenza virus
EITFHGAKE

SEQ ID NO: 321636 - protein, 9 aa, Influenza virus
ITFHGAKEV

SEQ ID NO: 321637 - protein, 9 aa, Influenza virus
TFHGAKEVA

SEQ ID NO: 321638 - protein, 9 aa, Influenza virus
FHGAKEVAL

SEQ ID NO: 321639 - protein, 9 aa, Influenza virus
GAKEVALSY

SEQ ID NO: 321640 - protein, 9 aa, Influenza virus
AKEVALSYS

SEQ ID NO: 321641 - protein, 9 aa, Influenza virus
EVALSYSTG

SEQ ID NO: 321642 - protein, 9 aa, Influenza virus
VALSYSTGA

SEQ ID NO: 321643 - protein, 9 aa, Influenza virus
ALSYSTGAL

SEQ ID NO: 321644 - protein, 9 aa, Influenza virus
LSYSTGALA

SEQ ID NO: 321645 - protein, 9 aa, Influenza virus
SYSTGALAS

SEQ ID NO: 321646 - protein, 9 aa, Influenza virus
YSTGALASC

SEQ ID NO: 321647 - protein, 9 aa, Influenza virus
STGALASCM

SEQ ID NO: 321648 - protein, 9 aa, Influenza virus
TGALASCMG

SEQ ID NO: 321649 - protein, 9 aa, Influenza virus
GALASCMGL

SEQ ID NO: 321650 - protein, 9 aa, Influenza virus
ALASCMGLI

SEQ ID NO: 321651 - protein, 9 aa, Influenza virus
LASCMGLIY

SEQ ID NO: 321652 - protein, 9 aa, Influenza virus
ASCMGLIYN

SEQ ID NO: 321653 - protein, 9 aa, Influenza virus
SCMGLIYNR

SEQ ID NO: 321654 - protein, 9 aa, Influenza virus
CMGLIYNRM

SEQ ID NO: 321655 - protein, 9 aa, Influenza virus
MGLIYNRMG

SEQ ID NO: 321656 - protein, 9 aa, Influenza virus
GLIYNRMGT

SEQ ID NO: 321657 - protein, 9 aa, Influenza virus
LIYNRMGTV

SEQ ID NO: 321658 - protein, 9 aa, Influenza virus
IYNRMGTVT

SEQ ID NO: 321659 - protein, 9 aa, Influenza virus
AFGLVCATC

SEQ ID NO: 321660 - protein, 9 aa, Influenza virus
FGLVCATCE

SEQ ID NO: 321661 - protein, 9 aa, Influenza virus
GLVCATCEQ

SEQ ID NO: 321662 - protein, 9 aa, Influenza virus
LVCATCEQI

SEQ ID NO: 321663 - protein, 9 aa, Influenza virus
VCATCEQIA

SEQ ID NO: 321664 - protein, 9 aa, Influenza virus
CATCEQIAD

SEQ ID NO: 321665 - protein, 9 aa, Influenza virus
ATCEQIADS

SEQ ID NO: 321666 - protein, 9 aa, Influenza virus
TCEQIADSQ

SEQ ID NO: 321667 - protein, 9 aa, Influenza virus
CEQIADSQH

SEQ ID NO: 321668 - protein, 9 aa, Influenza virus
EQIADSQHR

SEQ ID NO: 321669 - protein, 9 aa, Influenza virus
QIADSQHRS

SEQ ID NO: 321670 - protein, 9 aa, Influenza virus
IADSQHRSH

SEQ ID NO: 321671 - protein, 9 aa, Influenza virus
ADSQHRSHR

SEQ ID NO: 321672 - protein, 9 aa, Influenza virus
DSQHRSHRQ

SEQ ID NO: 321673 - protein, 9 aa, Influenza virus
SQHRSHRQM

SEQ ID NO: 321674 - protein, 9 aa, Influenza virus
QHRSHRQMV

SEQ ID NO: 321675 - protein, 9 aa, Influenza virus
TTTNPLIRH

SEQ ID NO: 321676 - protein, 9 aa, Influenza virus
TTNPLIRHE

SEQ ID NO: 321677 - protein, 9 aa, Influenza virus
TNPLIRHEN

SEQ ID NO: 321678 - protein, 9 aa, Influenza virus
NPLIRHENR

SEQ ID NO: 321679 - protein, 9 aa, Influenza virus
PLIRHENRM

SEQ ID NO: 321680 - protein, 9 aa, Influenza virus
LIRHENRMV

SEQ ID NO: 321681 - protein, 9 aa, Influenza virus
IRHENRMVL

SEQ ID NO: 321682 - protein, 9 aa, Influenza virus
RHENRMVLA

SEQ ID NO: 321683 - protein, 9 aa, Influenza virus
HENRMVLAS

SEQ ID NO: 321684 - protein, 9 aa, Influenza virus
ENRMVLAST

SEQ ID NO: 321685 - protein, 9 aa, Influenza virus
NRMVLASTT

SEQ ID NO: 321686 - protein, 9 aa, Influenza virus
RMVLASTTA

SEQ ID NO: 321687 - protein, 9 aa, Influenza virus
MVLASTTAK

SEQ ID NO: 321688 - protein, 9 aa, Influenza virus
VLASTTAKA

SEQ ID NO: 321689 - protein, 9 aa, Influenza virus
LASTTAKAM

SEQ ID NO: 321690 - protein, 9 aa, Influenza virus
ASTTAKAME

SEQ ID NO: 321691 - protein, 9 aa, Influenza virus
STTAKAMEQ

SEQ ID NO: 321692 - protein, 9 aa, Influenza virus
TTAKAMEQM

SEQ ID NO: 321693 - protein, 9 aa, Influenza virus
TAKAMEQMA

SEQ ID NO: 321694 - protein, 9 aa, Influenza virus
AKAMEQMAG

SEQ ID NO: 321695 - protein, 9 aa, Influenza virus
KAMEQMAGS

SEQ ID NO: 321696 - protein, 9 aa, Influenza virus
AMEQMAGSS

SEQ ID NO: 321697 - protein, 9 aa, Influenza virus
MEQMAGSSE

SEQ ID NO: 321698 - protein, 9 aa, Influenza virus
EQMAGSSEQ

SEQ ID NO: 321699 - protein, 9 aa, Influenza virus
QMAGSSEQA

SEQ ID NO: 321700 - protein, 9 aa, Influenza virus
MAGSSEQAA

SEQ ID NO: 321701 - protein, 9 aa, Influenza virus
AGSSEQAAE

SEQ ID NO: 321702 - protein, 9 aa, Influenza virus
GSSEQAAEA

SEQ ID NO: 321703 - protein, 9 aa, Influenza virus
SSEQAAEAM

SEQ ID NO: 321704 - protein, 9 aa, Influenza virus
SEQAAEAME

SEQ ID NO: 321705 - protein, 9 aa, Influenza virus
EQAAEAMEV

SEQ ID NO: 321706 - protein, 9 aa, Influenza virus
QAAEAMEVA

SEQ ID NO: 321707 - protein, 9 aa, Influenza virus
ARQMVQAMR

SEQ ID NO: 321708 - protein, 9 aa, Influenza virus
RQMVQAMRT

SEQ ID NO: 321709 - protein, 9 aa, Influenza virus
MVQAMRTIG

SEQ ID NO: 321710 - protein, 9 aa, Influenza virus
VQAMRTIGT

SEQ ID NO: 321711 - protein, 9 aa, Influenza virus
AMRTIGTHP

SEQ ID NO: 321712 - protein, 9 aa, Influenza virus
DLLENLQAY

SEQ ID NO: 321713 - protein, 9 aa, Influenza virus
LLENLQAYQ

SEQ ID NO: 321714 - protein, 9 aa, Influenza virus
LENLQAYQK

SEQ ID NO: 321715 - protein, 9 aa, Influenza virus
ENLQAYQKR

SEQ ID NO: 321716 - protein, 9 aa, Influenza virus
NLQAYQKRM

SEQ ID NO: 321717 - protein, 9 aa, Influenza virus
LQAYQKRMG

SEQ ID NO: 321718 - protein, 9 aa, Influenza virus
QAYQKRMGV

SEQ ID NO: 321719 - protein, 9 aa, Influenza virus
AYQKRMGVQ

SEQ ID NO: 321720 - protein, 9 aa, Influenza virus
YQKRMGVQM

SEQ ID NO: 321721 - protein, 9 aa, Influenza virus
QKRMGVQMQ

SEQ ID NO: 321722 - protein, 9 aa, Influenza virus
KRMGVQMQR

SEQ ID NO: 321723 - protein, 9 aa, Influenza virus
RMGVQMQRF

SEQ ID NO: 321724 - protein, 9 aa, Influenza virus
MGVQMQRFK

SEQ ID NO: 321725 - protein, 9 aa, Influenza virus
GVQMQRFRR

SEQ ID NO: 321726 - protein, 9 aa, Influenza virus
VQMQRFRRP

SEQ ID NO: 321727 - protein, 9 aa, Influenza virus
QMQRFRRPD

SEQ ID NO: 321728 - protein, 9 aa, Influenza virus
MQRFRRPDS

SEQ ID NO: 321729 - protein, 9 aa, Influenza virus
QRFRRPDSS

SEQ ID NO: 321730 - protein, 9 aa, Influenza virus
RFRRPDSSW

SEQ ID NO: 321731 - protein, 9 aa, Influenza virus
FRRPDSSWL

SEQ ID NO: 321732 - protein, 9 aa, Influenza virus
RRPDSSWLF

SEQ ID NO: 321733 - protein, 9 aa, Influenza virus
RPDSSWLFG

SEQ ID NO: 321734 - protein, 9 aa, Influenza virus
PDSSWLFGG

SEQ ID NO: 321735 - protein, 9 aa, Influenza virus
SRHCSKYHW

SEQ ID NO: 321736 - protein, 9 aa, Influenza virus
RHCSKYHWN

SEQ ID NO: 321737 - protein, 9 aa, Influenza virus
HCSKYHWNL

SEQ ID NO: 321738 - protein, 9 aa, Influenza virus
CSKYHWNLA

SEQ ID NO: 321739 - protein, 9 aa, Influenza virus
SKYHWNLAL

SEQ ID NO: 321740 - protein, 9 aa, Influenza virus
KYHWNLALD

SEQ ID NO: 321741 - protein, 9 aa, Influenza virus
YHWNLALDI

SEQ ID NO: 321742 - protein, 9 aa, Influenza virus
HWNLALDIV

SEQ ID NO: 321743 - protein, 9 aa, Influenza virus
WNLALDIVD

SEQ ID NO: 321744 - protein, 9 aa, Influenza virus
NLALDIVDS

SEQ ID NO: 321745 - protein, 9 aa, Influenza virus
MSLLTEVET

SEQ ID NO: 321746 - protein, 9 aa, Influenza virus
SLLTEVETP

SEQ ID NO: 321747 - protein, 9 aa, Influenza virus
RPTRNGWGC

SEQ ID NO: 321748 - protein, 9 aa, Influenza virus
GILHLILWI

SEQ ID NO: 321749 - protein, 9 aa, Influenza virus
GVPESMREE

SEQ ID NO: 321750 - protein, 9 aa, Influenza virus
VPESMREEY

SEQ ID NO: 321751 - protein, 9 aa, Influenza virus
PESMREEYR

SEQ ID NO: 321752 - protein, 9 aa, Influenza virus
SMREEYRQE

SEQ ID NO: 321753 - protein, 9 aa, Influenza virus
HFVSIELEG

SEQ ID NO: 321754 - protein, 9 aa, Influenza virus
SKSRVDNHS

SEQ ID NO: 321755 - protein, 9 aa, Influenza virus
KSRVDNHSM

SEQ ID NO: 321756 - protein, 9 aa, Influenza virus
SRVDNHSMS

SEQ ID NO: 321757 - protein, 9 aa, Influenza virus
RVDNHSMSD

SEQ ID NO: 321758 - protein, 9 aa, Influenza virus
VDNHSMSDI

SEQ ID NO: 321759 - protein, 9 aa, Influenza virus
DNHSMSDIE

SEQ ID NO: 321760 - protein, 9 aa, Influenza virus
NHSMSDIEA

SEQ ID NO: 321761 - protein, 9 aa, Influenza virus
HSMSDIEAM

SEQ ID NO: 321762 - protein, 9 aa, Influenza virus
SMSDIEAMA

SEQ ID NO: 321763 - protein, 9 aa, Influenza virus
MSDIEAMAS

SEQ ID NO: 321764 - protein, 9 aa, Influenza virus
SDIEAMASQ

SEQ ID NO: 321765 - protein, 9 aa, Influenza virus
DIEAMASQG

SEQ ID NO: 321766 - protein, 9 aa, Influenza virus
IEAMASQGT

SEQ ID NO: 321767 - protein, 9 aa, Influenza virus
EAMASQGTK

SEQ ID NO: 321768 - protein, 9 aa, Influenza virus
AMASQGTKR

SEQ ID NO: 321769 - protein, 9 aa, Influenza virus
MASQGTKRS

SEQ ID NO: 321770 - protein, 9 aa, Influenza virus
ASQGTKRSY

SEQ ID NO: 321771 - protein, 9 aa, Influenza virus
SQGTKRSYE

SEQ ID NO: 321772 - protein, 9 aa, Influenza virus
QGTKRSYEQ

SEQ ID NO: 321773 - protein, 9 aa, Influenza virus
GTKRSYEQM

SEQ ID NO: 321774 - protein, 9 aa, Influenza virus
TKRSYEQME

SEQ ID NO: 321775 - protein, 9 aa, Influenza virus
KRSYEQMET

SEQ ID NO: 321776 - protein, 9 aa, Influenza virus
RSYEQMETG

SEQ ID NO: 321777 - protein, 9 aa, Influenza virus
SYEQMETGG

SEQ ID NO: 321778 - protein, 9 aa, Influenza virus
YEQMETGGE

SEQ ID NO: 321779 - protein, 9 aa, Influenza virus
SEQMETGGE

SEQ ID NO: 321780 - protein, 9 aa, Influenza virus
EQMETGGER

SEQ ID NO: 321781 - protein, 9 aa, Influenza virus
QMETGGERQ

SEQ ID NO: 321782 - protein, 9 aa, Influenza virus
ATEIRASVG

SEQ ID NO: 321783 - protein, 9 aa, Influenza virus
TEIRASVGR

SEQ ID NO: 321784 - protein, 9 aa, Influenza virus
EIRASVGRM

SEQ ID NO: 321785 - protein, 9 aa, Influenza virus
IRASVGRMV

SEQ ID NO: 321786 - protein, 9 aa, Influenza virus
GGIGRFYIQ

SEQ ID NO: 321787 - protein, 9 aa, Influenza virus
GIGRFYIQM

SEQ ID NO: 321788 - protein, 9 aa, Influenza virus
IGRFYIQMC

SEQ ID NO: 321789 - protein, 9 aa, Influenza virus
GRFYIQMCT

SEQ ID NO: 321790 - protein, 9 aa, Influenza virus
RFYIQMCTE

SEQ ID NO: 321791 - protein, 9 aa, Influenza virus
FYIQMCTEL

SEQ ID NO: 321792 - protein, 9 aa, Influenza virus
YIQMCTELK

SEQ ID NO: 321793 - protein, 9 aa, Influenza virus
IQMCTELKL

SEQ ID NO: 321794 - protein, 9 aa, Influenza virus
QMCTELKLS

SEQ ID NO: 321795 - protein, 9 aa, Influenza virus
MCTELKLSD

SEQ ID NO: 321796 - protein, 9 aa, Influenza virus
YEGRLIQNS

SEQ ID NO: 321797 - protein, 9 aa, Influenza virus
EGRLIQNSI

SEQ ID NO: 321798 - protein, 9 aa, Influenza virus
GRLIQNSIT

SEQ ID NO: 321799 - protein, 9 aa, Influenza virus
RLIQNSITI

SEQ ID NO: 321800 - protein, 9 aa, Influenza virus
LIQNSITIE

SEQ ID NO: 321801 - protein, 9 aa, Influenza virus
QNSITIERM

SEQ ID NO: 321802 - protein, 9 aa, Influenza virus
TIERMVLSA

SEQ ID NO: 321803 - protein, 9 aa, Influenza virus
IERMVLSAF

SEQ ID NO: 321804 - protein, 9 aa, Influenza virus
ERMVLSAFD

SEQ ID NO: 321805 - protein, 9 aa, Influenza virus
RMVLSAFDE

SEQ ID NO: 321806 - protein, 9 aa, Influenza virus
MVLSAFDER

SEQ ID NO: 321807 - protein, 9 aa, Influenza virus
VLSAFDERR

SEQ ID NO: 321808 - protein, 9 aa, Influenza virus
LSAFDERRN

SEQ ID NO: 321809 - protein, 9 aa, Influenza virus
SAFDERRNK

SEQ ID NO: 321810 - protein, 9 aa, Influenza virus
AFDERRNKY

SEQ ID NO: 321811 - protein, 9 aa, Influenza virus
FDERRNKYL

SEQ ID NO: 321812 - protein, 9 aa, Influenza virus
DERRNKYLE

SEQ ID NO: 321813 - protein, 9 aa, Influenza virus
ERRNKYLEE

SEQ ID NO: 321814 - protein, 9 aa, Influenza virus
RRNKYLEEH

SEQ ID NO: 321815 - protein, 9 aa, Influenza virus
RNKYLEEHP

SEQ ID NO: 321816 - protein, 9 aa, Influenza virus
NKYLEEHPS

SEQ ID NO: 321817 - protein, 9 aa, Influenza virus
KYLEEHPSA

SEQ ID NO: 321818 - protein, 9 aa, Influenza virus
YLEEHPSAG

SEQ ID NO: 321819 - protein, 9 aa, Influenza virus
LEEHPSAGK

SEQ ID NO: 321820 - protein, 9 aa, Influenza virus
EEHPSAGKD

SEQ ID NO: 321821 - protein, 9 aa, Influenza virus
EHPSAGKDP

SEQ ID NO: 321822 - protein, 9 aa, Influenza virus
HPSAGKDPK

SEQ ID NO: 321823 - protein, 9 aa, Influenza virus
PSAGKDPKK

SEQ ID NO: 321824 - protein, 9 aa, Influenza virus
SAGKDPKKT

SEQ ID NO: 321825 - protein, 9 aa, Influenza virus
AGKDPKKTG

SEQ ID NO: 321826 - protein, 9 aa, Influenza virus
GKDPKKTGG

SEQ ID NO: 321827 - protein, 9 aa, Influenza virus
KDPKKTGGP

SEQ ID NO: 321828 - protein, 9 aa, Influenza virus
DPKKTGGPI

SEQ ID NO: 321829 - protein, 9 aa, Influenza virus
PKKTGGPIY

SEQ ID NO: 321830 - protein, 9 aa, Influenza virus
KKTGGPIYR

SEQ ID NO: 321831 - protein, 9 aa, Influenza virus
KTGGPIYRR

SEQ ID NO: 321832 - protein, 9 aa, Influenza virus
EIRRIWRQA

SEQ ID NO: 321833 - protein, 9 aa, Influenza virus
IRRIWRQAN

SEQ ID NO: 321834 - protein, 9 aa, Influenza virus
RRIWRQANN

SEQ ID NO: 321835 - protein, 9 aa, Influenza virus
RIWRQANNG

SEQ ID NO: 321836 - protein, 9 aa, Influenza virus
IWRQANNGE

SEQ ID NO: 321837 - protein, 9 aa, Influenza virus
WRQANNGED

SEQ ID NO: 321838 - protein, 9 aa, Influenza virus
RQANNGEDA

SEQ ID NO: 321839 - protein, 9 aa, Influenza virus
AGLTHIMIW

SEQ ID NO: 321840 - protein, 9 aa, Influenza virus
GLTHIMIWH

SEQ ID NO: 321841 - protein, 9 aa, Influenza virus
LTHIMIWHS

SEQ ID NO: 321842 - protein, 9 aa, Influenza virus
THIMIWHSN

SEQ ID NO: 321843 - protein, 9 aa, Influenza virus
HIMIWHSNL

SEQ ID NO: 321844 - protein, 9 aa, Influenza virus
IMIWHSNLN

SEQ ID NO: 321845 - protein, 9 aa, Influenza virus
MIWHSNLND

SEQ ID NO: 321846 - protein, 9 aa, Influenza virus
IWHSNLNDA

SEQ ID NO: 321847 - protein, 9 aa, Influenza virus
WHSNLNDAT

SEQ ID NO: 321848 - protein, 9 aa, Influenza virus
HSNLNDATY

SEQ ID NO: 321849 - protein, 9 aa, Influenza virus
SNLNDATYQ

SEQ ID NO: 321850 - protein, 9 aa, Influenza virus
NLNDATYQR

SEQ ID NO: 321851 - protein, 9 aa, Influenza virus
LNDATYQRT

SEQ ID NO: 321852 - protein, 9 aa, Influenza virus
NDATYQRTR

SEQ ID NO: 321853 - protein, 9 aa, Influenza virus
DATYQRTRA

SEQ ID NO: 321854 - protein, 9 aa, Influenza virus
ATYQRTRAL

SEQ ID NO: 321855 - protein, 9 aa, Influenza virus
TYQRTRALV

SEQ ID NO: 321856 - protein, 9 aa, Influenza virus
YQRTRALVR

SEQ ID NO: 321857 - protein, 9 aa, Influenza virus
QRTRALVRT

SEQ ID NO: 321858 - protein, 9 aa, Influenza virus
RTRALVRTG

SEQ ID NO: 321859 - protein, 9 aa, Influenza virus
TRALVRTGM

SEQ ID NO: 321860 - protein, 9 aa, Influenza virus
RALVRTGMD

SEQ ID NO: 321861 - protein, 9 aa, Influenza virus
ALVRTGMDP

SEQ ID NO: 321862 - protein, 9 aa, Influenza virus
LVRTGMDPR

SEQ ID NO: 321863 - protein, 9 aa, Influenza virus
VRTGMDPRM

SEQ ID NO: 321864 - protein, 9 aa, Influenza virus
RTGMDPRMC

SEQ ID NO: 321865 - protein, 9 aa, Influenza virus
TGMDPRMCS

SEQ ID NO: 321866 - protein, 9 aa, Influenza virus
GMDPRMCSL

SEQ ID NO: 321867 - protein, 9 aa, Influenza virus
MDPRMCSLM

SEQ ID NO: 321868 - protein, 9 aa, Influenza virus
DPRMCSLMQ

SEQ ID NO: 321869 - protein, 9 aa, Influenza virus
PRMCSLMQG

SEQ ID NO: 321870 - protein, 9 aa, Influenza virus
RMCSLMQGS

SEQ ID NO: 321871 - protein, 9 aa, Influenza virus
MCSLMQGST

SEQ ID NO: 321872 - protein, 9 aa, Influenza virus
CSLMQGSTL

SEQ ID NO: 321873 - protein, 9 aa, Influenza virus
SLMQGSTLP

SEQ ID NO: 321874 - protein, 9 aa, Influenza virus
LMQGSTLPR

SEQ ID NO: 321875 - protein, 9 aa, Influenza virus
MQGSTLPRR

SEQ ID NO: 321876 - protein, 9 aa, Influenza virus
QGSTLPRRS

SEQ ID NO: 321877 - protein, 9 aa, Influenza virus
GSTLPRRSG

SEQ ID NO: 321878 - protein, 9 aa, Influenza virus
STLPRRSGA

SEQ ID NO: 321879 - protein, 9 aa, Influenza virus
TLPRRSGAA

SEQ ID NO: 321880 - protein, 9 aa, Influenza virus
LPRRSGAAG

SEQ ID NO: 321881 - protein, 9 aa, Influenza virus
PRRSGAAGA

SEQ ID NO: 321882 - protein, 9 aa, Influenza virus
RRSGAAGAA

SEQ ID NO: 321883 - protein, 9 aa, Influenza virus
RSGAAGAAV

SEQ ID NO: 321884 - protein, 9 aa, Influenza virus
SGAAGAAVK

SEQ ID NO: 321885 - protein, 9 aa, Influenza virus
GAAGAAVKG

SEQ ID NO: 321886 - protein, 9 aa, Influenza virus
AAGAAVKGV

SEQ ID NO: 321887 - protein, 9 aa, Influenza virus
AGAAVKGVG

SEQ ID NO: 321888 - protein, 9 aa, Influenza virus
GAAVKGVGT

SEQ ID NO: 321889 - protein, 9 aa, Influenza virus
AAVKGVGTM

SEQ ID NO: 321890 - protein, 9 aa, Influenza virus
VMELIRMIK

SEQ ID NO: 321891 - protein, 9 aa, Influenza virus
MELIRMIKR

SEQ ID NO: 321892 - protein, 9 aa, Influenza virus
ELIRMIKRG

SEQ ID NO: 321893 - protein, 9 aa, Influenza virus
LIRMIKRGI

SEQ ID NO: 321894 - protein, 9 aa, Influenza virus
IRMIKRGIN

SEQ ID NO: 321895 - protein, 9 aa, Influenza virus
RMIKRGIND

SEQ ID NO: 321896 - protein, 9 aa, Influenza virus
MIKRGINDR

SEQ ID NO: 321897 - protein, 9 aa, Influenza virus
IKRGINDRN

SEQ ID NO: 321898 - protein, 9 aa, Influenza virus
KRGINDRNF

SEQ ID NO: 321899 - protein, 9 aa, Influenza virus
RGINDRNFW

SEQ ID NO: 321900 - protein, 9 aa, Influenza virus
GINDRNFWR

SEQ ID NO: 321901 - protein, 9 aa, Influenza virus
INDRNFWRG

SEQ ID NO: 321902 - protein, 9 aa, Influenza virus
NDRNFWRGE

SEQ ID NO: 321903 - protein, 9 aa, Influenza virus
DRNFWRGEN

SEQ ID NO: 321904 - protein, 9 aa, Influenza virus
RNFWRGENG

SEQ ID NO: 321905 - protein, 9 aa, Influenza virus
NFWRGENGR

SEQ ID NO: 321906 - protein, 9 aa, Influenza virus
FWRGENGRR

SEQ ID NO: 321907 - protein, 9 aa, Influenza virus
WRGENGRRT

SEQ ID NO: 321908 - protein, 9 aa, Influenza virus
RGENGRRTR

SEQ ID NO: 321909 - protein, 9 aa, Influenza virus
TRIAYERMC

SEQ ID NO: 321910 - protein, 9 aa, Influenza virus
RIAYERMCN

SEQ ID NO: 321911 - protein, 9 aa, Influenza virus
IAYERMCNI

SEQ ID NO: 321912 - protein, 9 aa, Influenza virus
AYERMCNIL

SEQ ID NO: 321913 - protein, 9 aa, Influenza virus
YERMCNILK

SEQ ID NO: 321914 - protein, 9 aa, Influenza virus
ERMCNILKG

SEQ ID NO: 321915 - protein, 9 aa, Influenza virus
RMCNILKGK

SEQ ID NO: 321916 - protein, 9 aa, Influenza virus
MCNILKGKF

SEQ ID NO: 321917 - protein, 9 aa, Influenza virus
CNILKGKFQ

SEQ ID NO: 321918 - protein, 9 aa, Influenza virus
NILKGKFQT

SEQ ID NO: 321919 - protein, 9 aa, Influenza virus
ILKGKFQTA

SEQ ID NO: 321920 - protein, 9 aa, Influenza virus
LKGKFQTAA

SEQ ID NO: 321921 - protein, 9 aa, Influenza virus
SKGSSKQQH

SEQ ID NO: 321922 - protein, 9 aa, Influenza virus
KGKFQTAAQ

SEQ ID NO: 321923 - protein, 9 aa, Influenza virus
GKFQTAAQR

SEQ ID NO: 321924 - protein, 9 aa, Influenza virus
KFQTAAQRA

SEQ ID NO: 321925 - protein, 9 aa, Influenza virus
FQTAAQRAM

SEQ ID NO: 321926 - protein, 9 aa, Influenza virus
QTAAQRAMM

SEQ ID NO: 321927 - protein, 9 aa, Influenza virus
TAAQRAMMD

SEQ ID NO: 321928 - protein, 9 aa, Influenza virus
AAQRAMMDQ

SEQ ID NO: 321929 - protein, 9 aa, Influenza virus
AQRAMMDQV

SEQ ID NO: 321930 - protein, 9 aa, Influenza virus
QRAMMDQVR

SEQ ID NO: 321931 - protein, 9 aa, Influenza virus
RAMMDQVRE

SEQ ID NO: 321932 - protein, 9 aa, Influenza virus
AMMDQVRES

SEQ ID NO: 321933 - protein, 9 aa, Influenza virus
MMDQVRESR

SEQ ID NO: 321934 - protein, 9 aa, Influenza virus
MDQVRESRN

SEQ ID NO: 321935 - protein, 9 aa, Influenza virus
DQVRESRNP

SEQ ID NO: 321936 - protein, 9 aa, Influenza virus
QVRESRNPG

SEQ ID NO: 321937 - protein, 9 aa, Influenza virus
VRESRNPGN

SEQ ID NO: 321938 - protein, 9 aa, Influenza virus
RESRNPGNA

SEQ ID NO: 321939 - protein, 9 aa, Influenza virus
ESRNPGNAE

SEQ ID NO: 321940 - protein, 9 aa, Influenza virus
SRNPGNAEI

SEQ ID NO: 321941 - protein, 9 aa, Influenza virus
RNPGNAEIE

SEQ ID NO: 321942 - protein, 9 aa, Influenza virus
NPGNAEIED

SEQ ID NO: 321943 - protein, 9 aa, Influenza virus
PGNAEIEDL

SEQ ID NO: 321944 - protein, 9 aa, Influenza virus
GNAEIEDLI

SEQ ID NO: 321945 - protein, 9 aa, Influenza virus
NAEIEDLIF

SEQ ID NO: 321946 - protein, 9 aa, Influenza virus
AEIEDLIFL

SEQ ID NO: 321947 - protein, 9 aa, Influenza virus
EIEDLIFLA

SEQ ID NO: 321948 - protein, 9 aa, Influenza virus
IEDLIFLAR

SEQ ID NO: 321949 - protein, 9 aa, Influenza virus
EDLIFLARS

SEQ ID NO: 321950 - protein, 9 aa, Influenza virus
DLIFLARSA

SEQ ID NO: 321951 - protein, 9 aa, Influenza virus
LIFLARSAL

SEQ ID NO: 321952 - protein, 9 aa, Influenza virus
IFLARSALI

SEQ ID NO: 321953 - protein, 9 aa, Influenza virus
FLARSALIL

SEQ ID NO: 321954 - protein, 9 aa, Influenza virus
LARSALILR

SEQ ID NO: 321955 - protein, 9 aa, Influenza virus
ARSALILRG

SEQ ID NO: 321956 - protein, 9 aa, Influenza virus
RSALILRGS

SEQ ID NO: 321957 - protein, 9 aa, Influenza virus
SASALILRG

SEQ ID NO: 321958 - protein, 9 aa, Influenza virus
ASALILRGS

SEQ ID NO: 321959 - protein, 9 aa, Influenza virus
SALILRGSV

SEQ ID NO: 321960 - protein, 9 aa, Influenza virus
ALILRGSVA

SEQ ID NO: 321961 - protein, 9 aa, Influenza virus
LILRGSVAH

SEQ ID NO: 321962 - protein, 9 aa, Influenza virus
ILRGSVAHK

SEQ ID NO: 321963 - protein, 9 aa, Influenza virus
LRGSVAHKS

SEQ ID NO: 321964 - protein, 9 aa, Influenza virus
RGSVAHKSC

SEQ ID NO: 321965 - protein, 9 aa, Influenza virus
GSVAHKSCL

SEQ ID NO: 321966 - protein, 9 aa, Influenza virus
SVAHKSCLP

SEQ ID NO: 321967 - protein, 9 aa, Influenza virus
VAHKSCLPA

SEQ ID NO: 321968 - protein, 9 aa, Influenza virus
AHKSCLPAC

SEQ ID NO: 321969 - protein, 9 aa, Influenza virus
HKSCLPACV

SEQ ID NO: 321970 - protein, 9 aa, Influenza virus
KSCLPACVY

SEQ ID NO: 321971 - protein, 9 aa, Influenza virus
SCLPACVYG

SEQ ID NO: 321972 - protein, 9 aa, Influenza virus
CLPACVYGL

SEQ ID NO: 321973 - protein, 9 aa, Influenza virus
LPACVYGLA

SEQ ID NO: 321974 - protein, 9 aa, Influenza virus
PACVYGLAV

SEQ ID NO: 321975 - protein, 9 aa, Influenza virus
SGYDFEREG

SEQ ID NO: 321976 - protein, 9 aa, Influenza virus
GYDFEREGY

SEQ ID NO: 321977 - protein, 9 aa, Influenza virus
YDFEREGYS

SEQ ID NO: 321978 - protein, 9 aa, Influenza virus
DFEREGYSL

SEQ ID NO: 321979 - protein, 9 aa, Influenza virus
FEREGYSLV

SEQ ID NO: 321980 - protein, 9 aa, Influenza virus
EREGYSLVG

SEQ ID NO: 321981 - protein, 9 aa, Influenza virus
REGYSLVGI

SEQ ID NO: 321982 - protein, 9 aa, Influenza virus
EGYSLVGID

SEQ ID NO: 321983 - protein, 9 aa, Influenza virus
GYSLVGIDP

SEQ ID NO: 321984 - protein, 9 aa, Influenza virus
YSLVGIDPF

SEQ ID NO: 321985 - protein, 9 aa, Influenza virus
SLVGIDPFK

SEQ ID NO: 321986 - protein, 9 aa, Influenza virus
LVGIDPFKL

SEQ ID NO: 321987 - protein, 9 aa, Influenza virus
VGIDPFKLL

SEQ ID NO: 321988 - protein, 9 aa, Influenza virus
GIDPFKLLQ

SEQ ID NO: 321989 - protein, 9 aa, Influenza virus
DPDPFRLLQ

SEQ ID NO: 321990 - protein, 9 aa, Influenza virus
PDPFRLLQN

SEQ ID NO: 321991 - protein, 9 aa, Influenza virus
DPFKLLQNS

SEQ ID NO: 321992 - protein, 9 aa, Influenza virus
PFKLLQNSQ

SEQ ID NO: 321993 - protein, 9 aa, Influenza virus
FRLLQNSQV

SEQ ID NO: 321994 - protein, 9 aa, Influenza virus
PRLLQNSQV

SEQ ID NO: 321995 - protein, 9 aa, Influenza virus
SLIRPNENP

SEQ ID NO: 321996 - protein, 9 aa, Influenza virus
RPNENPAHK

SEQ ID NO: 321997 - protein, 9 aa, Influenza virus
PNENPAHKS

SEQ ID NO: 321998 - protein, 9 aa, Influenza virus
NENPAHKSQ

SEQ ID NO: 321999 - protein, 9 aa, Influenza virus
ENPAHKSQL

SEQ ID NO: 322000 - protein, 9 aa, Influenza virus
NPAHKSQLV

SEQ ID NO: 322001 - protein, 9 aa, Influenza virus
PAHKSQLVW

SEQ ID NO: 322002 - protein, 9 aa, Influenza virus
AHKSQLVWM

SEQ ID NO: 322003 - protein, 9 aa, Influenza virus
HKSQLVWMA

SEQ ID NO: 322004 - protein, 9 aa, Influenza virus
KSQLVWMAC

SEQ ID NO: 322005 - protein, 9 aa, Influenza virus
SQLVWMACH

SEQ ID NO: 322006 - protein, 9 aa, Influenza virus
QLVWMACHS

SEQ ID NO: 322007 - protein, 9 aa, Influenza virus
LVWMACHSA

SEQ ID NO: 322008 - protein, 9 aa, Influenza virus
VWMACHSAA

SEQ ID NO: 322009 - protein, 9 aa, Influenza virus
WMACHSAAF

SEQ ID NO: 322010 - protein, 9 aa, Influenza virus
MACHSAAFE

SEQ ID NO: 322011 - protein, 9 aa, Influenza virus
ACHSAAFED

SEQ ID NO: 322012 - protein, 9 aa, Influenza virus
CHSAAFEDL

SEQ ID NO: 322013 - protein, 9 aa, Influenza virus
HSAAFEDLR

SEQ ID NO: 322014 - protein, 9 aa, Influenza virus
SAAFEDLRV

SEQ ID NO: 322015 - protein, 9 aa, Influenza virus
AAFEDLRVS

SEQ ID NO: 322016 - protein, 9 aa, Influenza virus
PRGKLSTRG

SEQ ID NO: 322017 - protein, 9 aa, Influenza virus
LSTRGVQIA

SEQ ID NO: 322018 - protein, 9 aa, Influenza virus
STRGVQIAS

SEQ ID NO: 322019 - protein, 9 aa, Influenza virus
TRGVQIASN

SEQ ID NO: 322020 - protein, 9 aa, Influenza virus
RGVQIASNE

SEQ ID NO: 322021 - protein, 9 aa, Influenza virus
GVQIASNEN

SEQ ID NO: 322022 - protein, 9 aa, Influenza virus
TLELRSRYW

SEQ ID NO: 322023 - protein, 9 aa, Influenza virus
LELRSRYWA

SEQ ID NO: 322024 - protein, 9 aa, Influenza virus
ELRSRYWAI

SEQ ID NO: 322025 - protein, 9 aa, Influenza virus
LRSRYWAIR

SEQ ID NO: 322026 - protein, 9 aa, Influenza virus
RSRYWAIRT

SEQ ID NO: 322027 - protein, 9 aa, Influenza virus
SRYWAIRTR

SEQ ID NO: 322028 - protein, 9 aa, Influenza virus
RYWAIRTRS

SEQ ID NO: 322029 - protein, 9 aa, Influenza virus
YWAIRTRSG

SEQ ID NO: 322030 - protein, 9 aa, Influenza virus
WAIRTRSGG

SEQ ID NO: 322031 - protein, 9 aa, Influenza virus
AIRTRSGGN

SEQ ID NO: 322032 - protein, 9 aa, Influenza virus
IRTRSGGNT

SEQ ID NO: 322033 - protein, 9 aa, Influenza virus
RTRSGGNTN

SEQ ID NO: 322034 - protein, 9 aa, Influenza virus
TRSGGNTNQ

SEQ ID NO: 322035 - protein, 9 aa, Influenza virus
ASAGQISVQ

SEQ ID NO: 322036 - protein, 9 aa, Influenza virus
SAGQISVQP

SEQ ID NO: 322037 - protein, 9 aa, Influenza virus
SVQPTFSVQ

SEQ ID NO: 322038 - protein, 9 aa, Influenza virus
VQPTFSVQR

SEQ ID NO: 322039 - protein, 9 aa, Influenza virus
QPTFSVQRN

SEQ ID NO: 322040 - protein, 9 aa, Influenza virus
PTFSVQRNL

SEQ ID NO: 322041 - protein, 9 aa, Influenza virus
TFSVQRNLP

SEQ ID NO: 322042 - protein, 9 aa, Influenza virus
FSVQRNLPF

SEQ ID NO: 322043 - protein, 9 aa, Influenza virus
SVQRNLPFE

SEQ ID NO: 322044 - protein, 9 aa, Influenza virus
VQRNLPFER

SEQ ID NO: 322045 - protein, 9 aa, Influenza virus
GNTEGRTSD

SEQ ID NO: 322046 - protein, 9 aa, Influenza virus
TEGRTSDMR

SEQ ID NO: 322047 - protein, 9 aa, Influenza virus
EGRTSDMRT

SEQ ID NO: 322048 - protein, 9 aa, Influenza virus
GRTSDMRTE

SEQ ID NO: 322049 - protein, 9 aa, Influenza virus
RTSDMRTEI

SEQ ID NO: 322050 - protein, 9 aa, Influenza virus
TSDMRTEII

SEQ ID NO: 322051 - protein, 9 aa, Influenza virus
SDMRTEIIR

SEQ ID NO: 322052 - protein, 9 aa, Influenza virus
RRAEIIKME

SEQ ID NO: 322053 - protein, 9 aa, Influenza virus
TEIIIRMME

SEQ ID NO: 322054 - protein, 9 aa, Influenza virus
EIIIRMMEN

SEQ ID NO: 322055 - protein, 9 aa, Influenza virus
IIIRMMENA

SEQ ID NO: 322056 - protein, 9 aa, Influenza virus
DVSFQGRGV

SEQ ID NO: 322057 - protein, 9 aa, Influenza virus
VSFQGRGVF

SEQ ID NO: 322058 - protein, 9 aa, Influenza virus
SFQGRGVFE

SEQ ID NO: 322059 - protein, 9 aa, Influenza virus
FQGRGVFEL

SEQ ID NO: 322060 - protein, 9 aa, Influenza virus
QGRGVFELS

SEQ ID NO: 322061 - protein, 9 aa, Influenza virus
GRGVFELSD

SEQ ID NO: 322062 - protein, 9 aa, Influenza virus
RRGQGHLDE

SEQ ID NO: 322063 - protein, 9 aa, Influenza virus
RGVFELSDE

SEQ ID NO: 322064 - protein, 9 aa, Influenza virus
GVFELSDEK

SEQ ID NO: 322065 - protein, 9 aa, Influenza virus
VFELSDEKA

SEQ ID NO: 322066 - protein, 9 aa, Influenza virus
FELSDEKAT

SEQ ID NO: 322067 - protein, 9 aa, Influenza virus
ATNPIVPSF

SEQ ID NO: 322068 - protein, 9 aa, Influenza virus
TNPIVPSFD

SEQ ID NO: 322069 - protein, 9 aa, Influenza virus
NPIVPSFDM

SEQ ID NO: 322070 - protein, 9 aa, Influenza virus
PIVPSFDMS

SEQ ID NO: 322071 - protein, 9 aa, Influenza virus
IVPSFDMSN

SEQ ID NO: 322072 - protein, 9 aa, Influenza virus
VPSFDMSNE

SEQ ID NO: 322073 - protein, 9 aa, Influenza virus
PSFDMSNEG

SEQ ID NO: 322074 - protein, 9 aa, Influenza virus
FDMSNEGSY

SEQ ID NO: 322075 - protein, 9 aa, Influenza virus
MSNEGSYFF

SEQ ID NO: 322076 - protein, 9 aa, Influenza virus
SNEGSYFFG

SEQ ID NO: 322077 - protein, 9 aa, Influenza virus
NEGSYFFGD

SEQ ID NO: 322078 - protein, 9 aa, Influenza virus
EGSYFFGDN

SEQ ID NO: 322079 - protein, 9 aa, Influenza virus
GSYFFGDNA

SEQ ID NO: 322080 - protein, 9 aa, Influenza virus
SYFFGDNAE

SEQ ID NO: 322081 - protein, 9 aa, Influenza virus
YFFGDNAEE

SEQ ID NO: 322082 - protein, 9 aa, Influenza virus
FFGDNAEEY

SEQ ID NO: 322083 - protein, 9 aa, Influenza virus
NAEEYRRLR

SEQ ID NO: 322084 - protein, 9 aa, Influenza virus
MLFVQSYFQ

SEQ ID NO: 322085 - protein, 9 aa, Influenza virus
LFVQSYFQL

SEQ ID NO: 322086 - protein, 9 aa, Influenza virus
FVQSYFQLF

SEQ ID NO: 322087 - protein, 9 aa, Influenza virus
VQSYFQLFL

SEQ ID NO: 322088 - protein, 9 aa, Influenza virus
QSYFQLFLV

SEQ ID NO: 322089 - protein, 9 aa, Influenza virus
SYFQLFLVC

SEQ ID NO: 322090 - protein, 9 aa, Influenza virus
YFQLFLVCV

SEQ ID NO: 322091 - protein, 9 aa, Influenza virus
FQLFLVCVS

SEQ ID NO: 322092 - protein, 9 aa, Influenza virus
QLFLVCVSL

SEQ ID NO: 322093 - protein, 9 aa, Influenza virus
LFLVCVSLL

SEQ ID NO: 322094 - protein, 9 aa, Influenza virus
FLVCVSLLQ

SEQ ID NO: 322095 - protein, 9 aa, Influenza virus
LVCVSLLQS

SEQ ID NO: 322096 - protein, 9 aa, Influenza virus
VCVSLLQSA

SEQ ID NO: 322097 - protein, 9 aa, Influenza virus
CVSLLQSAI

SEQ ID NO: 322098 - protein, 9 aa, Influenza virus
VSLLQSAIL

SEQ ID NO: 322099 - protein, 9 aa, Influenza virus
SLLQSAILS

SEQ ID NO: 322100 - protein, 9 aa, Influenza virus
LLQSAILSL

SEQ ID NO: 322101 - protein, 9 aa, Influenza virus
SSFQVDCFL

SEQ ID NO: 322102 - protein, 9 aa, Influenza virus
SFQVDCFLW

SEQ ID NO: 322103 - protein, 9 aa, Influenza virus
FQVDCFLWH

SEQ ID NO: 322104 - protein, 9 aa, Influenza virus
QVDCFLWHV

SEQ ID NO: 322105 - protein, 9 aa, Influenza virus
VDCFLWHVR

SEQ ID NO: 322106 - protein, 9 aa, Influenza virus
GDAPFLDRL

SEQ ID NO: 322107 - protein, 9 aa, Influenza virus
DAPFLDRLR

SEQ ID NO: 322108 - protein, 9 aa, Influenza virus
APFLDRLRR

SEQ ID NO: 322109 - protein, 9 aa, Influenza virus
PFLDRLRRD

SEQ ID NO: 322110 - protein, 9 aa, Influenza virus
FLDRLRRDQ

SEQ ID NO: 322111 - protein, 9 aa, Influenza virus
SLLLLQANL

SEQ ID NO: 322112 - protein, 9 aa, Influenza virus
LLLLQANLC

SEQ ID NO: 322113 - protein, 9 aa, Influenza virus
LLLQANLCR

SEQ ID NO: 322114 - protein, 9 aa, Influenza virus
LLQANLCRF

SEQ ID NO: 322115 - protein, 9 aa, Influenza virus
LQANLCRFL

SEQ ID NO: 322116 - protein, 9 aa, Influenza virus
QANLCRFLE

SEQ ID NO: 322117 - protein, 9 aa, Influenza virus
ANLCRFLET

SEQ ID NO: 322118 - protein, 9 aa, Influenza virus
NLCRFLETR

SEQ ID NO: 322119 - protein, 9 aa, Influenza virus
DRLRRDQKS

SEQ ID NO: 322120 - protein, 9 aa, Influenza virus
RLRRDQKSL

SEQ ID NO: 322121 - protein, 9 aa, Influenza virus
RRDQKSLRG

SEQ ID NO: 322122 - protein, 9 aa, Influenza virus
RDQKSLRGR

SEQ ID NO: 322123 - protein, 9 aa, Influenza virus
PMRTPIAFL

SEQ ID NO: 322124 - protein, 9 aa, Influenza virus
MRTPIAFLT

SEQ ID NO: 322125 - protein, 9 aa, Influenza virus
RTPIAFLTS

SEQ ID NO: 322126 - protein, 9 aa, Influenza virus
TPIAFLTSS

SEQ ID NO: 322127 - protein, 9 aa, Influenza virus
PIAFLTSSI

SEQ ID NO: 322128 - protein, 9 aa, Influenza virus
IAFLTSSIV

SEQ ID NO: 322129 - protein, 9 aa, Influenza virus
AFLTSSIVC

SEQ ID NO: 322130 - protein, 9 aa, Influenza virus
FLTSSIVCP

SEQ ID NO: 322131 - protein, 9 aa, Influenza virus
IASVPASRY

SEQ ID NO: 322132 - protein, 9 aa, Influenza virus
ASVPASRYL

SEQ ID NO: 322133 - protein, 9 aa, Influenza virus
SKITLKFAF

SEQ ID NO: 322134 - protein, 9 aa, Influenza virus
KITLKFAFN

SEQ ID NO: 322135 - protein, 9 aa, Influenza virus
ITLKFAFNM

SEQ ID NO: 322136 - protein, 9 aa, Influenza virus
AGVETMVIL

SEQ ID NO: 322137 - protein, 9 aa, Influenza virus
GVETMVILS

SEQ ID NO: 322138 - protein, 9 aa, Influenza virus
NWPSSSGGL

SEQ ID NO: 322139 - protein, 9 aa, Influenza virus
SRNGKWREQ

SEQ ID NO: 322140 - protein, 9 aa, Influenza virus
RNGKWREQL

SEQ ID NO: 322141 - protein, 9 aa, Influenza virus
NGKWREQLS

SEQ ID NO: 322142 - protein, 9 aa, Influenza virus
GKWREQLSQ

SEQ ID NO: 322143 - protein, 9 aa, Influenza virus
KWREQLSQK

SEQ ID NO: 322144 - protein, 9 aa, Influenza virus
WREQLSQKF

SEQ ID NO: 322145 - protein, 9 aa, Influenza virus
REQLSQKFE

SEQ ID NO: 322146 - protein, 9 aa, Influenza virus
EQLSQKFEE

SEQ ID NO: 322147 - protein, 9 aa, Influenza virus
QLSQKFEEI

SEQ ID NO: 322148 - protein, 9 aa, Influenza virus
LSQKFEEIR

SEQ ID NO: 322149 - protein, 9 aa, Influenza virus
VRGDQMAHC

SEQ ID NO: 322150 - protein, 9 aa, Influenza virus
RRDQMAHCR

SEQ ID NO: 322151 - protein, 9 aa, Influenza virus
HRLKITENS

SEQ ID NO: 322152 - protein, 9 aa, Influenza virus
RLKITENSF

SEQ ID NO: 322153 - protein, 9 aa, Influenza virus
LKITENSFE

SEQ ID NO: 322154 - protein, 9 aa, Influenza virus
KITENSFEQ

SEQ ID NO: 322155 - protein, 9 aa, Influenza virus
ITENSFEQI

SEQ ID NO: 322156 - protein, 9 aa, Influenza virus
TENSFEQIT

SEQ ID NO: 322157 - protein, 9 aa, Influenza virus
ENSFEQITF

SEQ ID NO: 322158 - protein, 9 aa, Influenza virus
NSFEQITFM

SEQ ID NO: 322159 - protein, 9 aa, Influenza virus
SFEQITFMQ

SEQ ID NO: 322160 - protein, 9 aa, Influenza virus
FEQITFMQA

SEQ ID NO: 322161 - protein, 9 aa, Influenza virus
EQITFMQAL

SEQ ID NO: 322162 - protein, 9 aa, Influenza virus
QITFMQALQ

SEQ ID NO: 322163 - protein, 9 aa, Influenza virus
ITFMQALQL

SEQ ID NO: 322164 - protein, 9 aa, Influenza virus
TAFSGMSAN

SEQ ID NO: 322165 - protein, 9 aa, Influenza virus
AFSGMSANG

SEQ ID NO: 322166 - protein, 9 aa, Influenza virus
FSGMSANGD

SEQ ID NO: 322167 - protein, 9 aa, Influenza virus
SGMSANGDI

SEQ ID NO: 322168 - protein, 9 aa, Influenza virus
GMSANGDIL

SEQ ID NO: 322169 - protein, 9 aa, Influenza virus
FQYLLFQDI

SEQ ID NO: 322170 - protein, 9 aa, Influenza virus
QYLLFQDIL

SEQ ID NO: 322171 - protein, 9 aa, Influenza virus
YLLFQDILM

SEQ ID NO: 322172 - protein, 9 aa, Influenza virus
LLFQDILMR

SEQ ID NO: 322173 - protein, 9 aa, Influenza virus
LFQDILMRM

SEQ ID NO: 322174 - protein, 9 aa, Influenza virus
LWHVRKRFA

SEQ ID NO: 322175 - protein, 9 aa, Influenza virus
WHVRKRFAD

SEQ ID NO: 322176 - protein, 9 aa, Influenza virus
HVRKRFADQ

SEQ ID NO: 322177 - protein, 9 aa, Influenza virus
VRKRFADQE

SEQ ID NO: 322178 - protein, 9 aa, Influenza virus
RKRFADQEL

SEQ ID NO: 322179 - protein, 9 aa, Influenza virus
KRFADQELG

SEQ ID NO: 322180 - protein, 9 aa, Influenza virus
RFADQELGD

SEQ ID NO: 322181 - protein, 9 aa, Influenza virus
FADQELGDA

SEQ ID NO: 322182 - protein, 9 aa, Influenza virus
ADQELGDAP

SEQ ID NO: 322183 - protein, 9 aa, Influenza virus
DQELGDAPF

SEQ ID NO: 322184 - protein, 9 aa, Influenza virus
QELGDAPFL

SEQ ID NO: 322185 - protein, 9 aa, Influenza virus
ELGDAPFLD

SEQ ID NO: 322186 - protein, 9 aa, Influenza virus
LGDAPFLDR

SEQ ID NO: 322187 - protein, 9 aa, Influenza virus
GDAPFLDRL

SEQ ID NO: 322188 - protein, 9 aa, Influenza virus
DAPFLDRLR

SEQ ID NO: 322189 - protein, 9 aa, Influenza virus
APFLDRLRR

SEQ ID NO: 322190 - protein, 9 aa, Influenza virus
PFLDRLRRD

SEQ ID NO: 322191 - protein, 9 aa, Influenza virus
FLDRLRRDQ

SEQ ID NO: 322192 - protein, 9 aa, Influenza virus
LDRLRRDQK

SEQ ID NO: 322193 - protein, 9 aa, Influenza virus
DRLRRDQKS

SEQ ID NO: 322194 - protein, 9 aa, Influenza virus
RLRRDQKSL

SEQ ID NO: 322195 - protein, 9 aa, Influenza virus
LRRDQKSLR

SEQ ID NO: 322196 - protein, 9 aa, Influenza virus
RRDQKSLRG

SEQ ID NO: 322197 - protein, 9 aa, Influenza virus
RDQKSLRGR

SEQ ID NO: 322198 - protein, 9 aa, Influenza virus
DQKSLRGRG

SEQ ID NO: 322199 - protein, 9 aa, Influenza virus
QKSLRGRGS

SEQ ID NO: 322200 - protein, 9 aa, Influenza virus
KSLRGRGST

SEQ ID NO: 322201 - protein, 9 aa, Influenza virus
SLRGRGSTL

SEQ ID NO: 322202 - protein, 9 aa, Influenza virus
LRGRGSTLG

SEQ ID NO: 322203 - protein, 9 aa, Influenza virus
RGRGSTLGL

SEQ ID NO: 322204 - protein, 9 aa, Influenza virus
GRGSTLGLD

SEQ ID NO: 322205 - protein, 9 aa, Influenza virus
RGSTLGLDI

SEQ ID NO: 322206 - protein, 9 aa, Influenza virus
GSTLGLDIR

SEQ ID NO: 322207 - protein, 9 aa, Influenza virus
STLGLDIRT

SEQ ID NO: 322208 - protein, 9 aa, Influenza virus
TLGLDIRTA

SEQ ID NO: 322209 - protein, 9 aa, Influenza virus
LGLDIRTAT

SEQ ID NO: 322210 - protein, 9 aa, Influenza virus
GLDIRTATR

SEQ ID NO: 322211 - protein, 9 aa, Influenza virus
LDIRTATRE

SEQ ID NO: 322212 - protein, 9 aa, Influenza virus
DIRTATREG

SEQ ID NO: 322213 - protein, 9 aa, Influenza virus
IRTATREGK

SEQ ID NO: 322214 - protein, 9 aa, Influenza virus
RTATREGKH

SEQ ID NO: 322215 - protein, 9 aa, Influenza virus
TATREGKHI

SEQ ID NO: 322216 - protein, 9 aa, Influenza virus
ATREGKHIV

SEQ ID NO: 322217 - protein, 9 aa, Influenza virus
TREGKHIVE

SEQ ID NO: 322218 - protein, 9 aa, Influenza virus
REGKHIVER

SEQ ID NO: 322219 - protein, 9 aa, Influenza virus
EGKHIVERI

SEQ ID NO: 322220 - protein, 9 aa, Influenza virus
GKHIVERIL

SEQ ID NO: 322221 - protein, 9 aa, Influenza virus
KHIVERILE

SEQ ID NO: 322222 - protein, 9 aa, Influenza virus
HIVERILEE

SEQ ID NO: 322223 - protein, 9 aa, Influenza virus
IVERILEEE

SEQ ID NO: 322224 - protein, 9 aa, Influenza virus
VERILEEES

SEQ ID NO: 322225 - protein, 9 aa, Influenza virus
ERILEEESD

SEQ ID NO: 322226 - protein, 9 aa, Influenza virus
RILEEESDE

SEQ ID NO: 322227 - protein, 9 aa, Influenza virus
ILEEESDEA

SEQ ID NO: 322228 - protein, 9 aa, Influenza virus
LEEESDEAL

SEQ ID NO: 322229 - protein, 9 aa, Influenza virus
EEESDEALK

SEQ ID NO: 322230 - protein, 9 aa, Influenza virus
EESDEALKM

SEQ ID NO: 322231 - protein, 9 aa, Influenza virus
ESDEALKMT

SEQ ID NO: 322232 - protein, 9 aa, Influenza virus
SDEALKMTI

SEQ ID NO: 322233 - protein, 9 aa, Influenza virus
DEALKMTIA

SEQ ID NO: 322234 - protein, 9 aa, Influenza virus
EALKMTIAS

SEQ ID NO: 322235 - protein, 9 aa, Influenza virus
ALKMTIASD

SEQ ID NO: 322236 - protein, 9 aa, Influenza virus
LKMTIASDI

SEQ ID NO: 322237 - protein, 9 aa, Influenza virus
KMTIASDIL

SEQ ID NO: 322238 - protein, 9 aa, Influenza virus
MTIASDILT

SEQ ID NO: 322239 - protein, 9 aa, Influenza virus
TIASDILTR

SEQ ID NO: 322240 - protein, 9 aa, Influenza virus
IASDILKRM

SEQ ID NO: 322241 - protein, 9 aa, Influenza virus
ASDILKRMS

SEQ ID NO: 322242 - protein, 9 aa, Influenza virus
RPHPEDLNG

SEQ ID NO: 322243 - protein, 9 aa, Influenza virus
QKFEEIRWL

SEQ ID NO: 322244 - protein, 9 aa, Influenza virus
KFEEIRWLI

SEQ ID NO: 322245 - protein, 9 aa, Influenza virus
TENSFEQIT

SEQ ID NO: 322246 - protein, 9 aa, Influenza virus
ENSFEQITF

SEQ ID NO: 322247 - protein, 9 aa, Influenza virus
NSFEQITFM

SEQ ID NO: 322248 - protein, 9 aa, Influenza virus
SFEQITFMQ

SEQ ID NO: 322249 - protein, 9 aa, Influenza virus
FEQITFMQA

SEQ ID NO: 322250 - protein, 9 aa, Influenza virus
EQITFMQAL

SEQ ID NO: 322251 - protein, 9 aa, Influenza virus
QITFMQALQ

SEQ ID NO: 322252 - protein, 9 aa, Influenza virus
ITFMQALQL

SEQ ID NO: 322253 - protein, 9 aa, Influenza virus
TFMQALQLL

SEQ ID NO: 322254 - protein, 9 aa, Influenza virus
FMQALQLLL

SEQ ID NO: 322255 - protein, 9 aa, Influenza virus
MQALQLLLE

SEQ ID NO: 322256 - protein, 9 aa, Influenza virus
QALQLLLEV

SEQ ID NO: 322257 - protein, 9 aa, Influenza virus
ALQLLLEVE

SEQ ID NO: 322258 - protein, 9 aa, Influenza virus
LQLLLEVEQ

SEQ ID NO: 322259 - protein, 9 aa, Influenza virus
QLLLEVEQE

SEQ ID NO: 322260 - protein, 9 aa, Influenza virus
EVEQEIRTF

SEQ ID NO: 322261 - protein, 9 aa, Influenza virus
VEQEIRTFS

SEQ ID NO: 322262 - protein, 9 aa, Influenza virus
EIRTFSFQL

SEQ ID NO: 322263 - protein, 9 aa, Influenza virus
IRTFSFQLI

SEQ ID NO: 322264 - protein, 9 aa, Influenza virus
RTFSFQLIN

SEQ ID NO: 322265 - protein, 9 aa, Influenza virus
TFSFQLILI

SEQ ID NO: 322266 - protein, 9 aa, Influenza virus
FSFQLINNK

SEQ ID NO: 322267 - protein, 9 aa, Influenza virus
SFQLINNKK

SEQ ID NO: 322268 - protein, 9 aa, Influenza virus
FQLINNKKP

SEQ ID NO: 322269 - protein, 9 aa, Influenza virus
MEDFVRQCF

SEQ ID NO: 322270 - protein, 9 aa, Influenza virus
EDFVRQCFN

SEQ ID NO: 322271 - protein, 9 aa, Influenza virus
DFVRQCFNP

SEQ ID NO: 322272 - protein, 9 aa, Influenza virus
FVRQCFNPM

SEQ ID NO: 322273 - protein, 9 aa, Influenza virus
VRQCFNPMI

SEQ ID NO: 322274 - protein, 9 aa, Influenza virus
RQCFNPMIV

SEQ ID NO: 322275 - protein, 9 aa, Influenza virus
QCFNPMIVE

SEQ ID NO: 322276 - protein, 9 aa, Influenza virus
CFNPMIVEL

SEQ ID NO: 322277 - protein, 9 aa, Influenza virus
FNPMIVELA

SEQ ID NO: 322278 - protein, 9 aa, Influenza virus
NPMIVELAE

SEQ ID NO: 322279 - protein, 9 aa, Influenza virus
PMIVELAEK

SEQ ID NO: 322280 - protein, 9 aa, Influenza virus
VELAEKAMK

SEQ ID NO: 322281 - protein, 9 aa, Influenza virus
ELAEKAMKE

SEQ ID NO: 322282 - protein, 9 aa, Influenza virus
LAEKAMKEY

SEQ ID NO: 322283 - protein, 9 aa, Influenza virus
AEKAMKEYG

SEQ ID NO: 322284 - protein, 9 aa, Influenza virus
EKAMKEYGE

SEQ ID NO: 322285 - protein, 9 aa, Influenza virus
ETNKFAAIC

SEQ ID NO: 322286 - protein, 9 aa, Influenza virus
TNKFAAICT

SEQ ID NO: 322287 - protein, 9 aa, Influenza virus
NKFAAICTH

SEQ ID NO: 322288 - protein, 9 aa, Influenza virus
KFAAICTHL

SEQ ID NO: 322289 - protein, 9 aa, Influenza virus
FAAICTHLE

SEQ ID NO: 322290 - protein, 9 aa, Influenza virus
AAICTHLEV

SEQ ID NO: 322291 - protein, 9 aa, Influenza virus
AICTHLEVC

SEQ ID NO: 322292 - protein, 9 aa, Influenza virus
ICTHLEVCF

SEQ ID NO: 322293 - protein, 9 aa, Influenza virus
CTHLEVCFM

SEQ ID NO: 322294 - protein, 9 aa, Influenza virus
THLEVCFMY

SEQ ID NO: 322295 - protein, 9 aa, Influenza virus
HLEVCFMYS

SEQ ID NO: 322296 - protein, 9 aa, Influenza virus
LEVCFMYSD

SEQ ID NO: 322297 - protein, 9 aa, Influenza virus
EVCFMYSDF

SEQ ID NO: 322298 - protein, 9 aa, Influenza virus
VCFMYSDFH

SEQ ID NO: 322299 - protein, 9 aa, Influenza virus
CFMYSDFHF

SEQ ID NO: 322300 - protein, 9 aa, Influenza virus
FMYSDFHFI

SEQ ID NO: 322301 - protein, 9 aa, Influenza virus
MYSDFHFID

SEQ ID NO: 322302 - protein, 9 aa, Influenza virus
YSDFHFIDE

SEQ ID NO: 322303 - protein, 9 aa, Influenza virus
SDFHFIDER

SEQ ID NO: 322304 - protein, 9 aa, Influenza virus
DPNALLKHR

SEQ ID NO: 322305 - protein, 9 aa, Influenza virus
PNALLKHRF

SEQ ID NO: 322306 - protein, 9 aa, Influenza virus
NALLKHRFE

SEQ ID NO: 322307 - protein, 9 aa, Influenza virus
ALLKHRFEI

SEQ ID NO: 322308 - protein, 9 aa, Influenza virus
LLKHRFEII

SEQ ID NO: 322309 - protein, 9 aa, Influenza virus
LKHRFEIIE

SEQ ID NO: 322310 - protein, 9 aa, Influenza virus
KHRFEIIEG

SEQ ID NO: 322311 - protein, 9 aa, Influenza virus
HRFEIIEGR

SEQ ID NO: 322312 - protein, 9 aa, Influenza virus
RFEIIEGRD

SEQ ID NO: 322313 - protein, 9 aa, Influenza virus
FEIIEGRDR

SEQ ID NO: 322314 - protein, 9 aa, Influenza virus
EIIEGRDRT

SEQ ID NO: 322315 - protein, 9 aa, Influenza virus
AWTVVNSIC

SEQ ID NO: 322316 - protein, 9 aa, Influenza virus
KPKFLPDLY

SEQ ID NO: 322317 - protein, 9 aa, Influenza virus
PKFLPDLYD

SEQ ID NO: 322318 - protein, 9 aa, Influenza virus
KFLPDLYDY

SEQ ID NO: 322319 - protein, 9 aa, Influenza virus
FLPDLYDYK

SEQ ID NO: 322320 - protein, 9 aa, Influenza virus
LPDLYDYKE

SEQ ID NO: 322321 - protein, 9 aa, Influenza virus
PDLYDYKEN

SEQ ID NO: 322322 - protein, 9 aa, Influenza virus
DLYDYKENR

SEQ ID NO: 322323 - protein, 9 aa, Influenza virus
LYDYKENRF

SEQ ID NO: 322324 - protein, 9 aa, Influenza virus
RFIEIGVTR

SEQ ID NO: 322325 - protein, 9 aa, Influenza virus
FIEIGVTRR

SEQ ID NO: 322326 - protein, 9 aa, Influenza virus
IEIGVTRRE

SEQ ID NO: 322327 - protein, 9 aa, Influenza virus
EIGVTRREV

SEQ ID NO: 322328 - protein, 9 aa, Influenza virus
IGVTRREVH

SEQ ID NO: 322329 - protein, 9 aa, Influenza virus
GVTRREVHI

SEQ ID NO: 322330 - protein, 9 aa, Influenza virus
VTRREVHIY

SEQ ID NO: 322331 - protein, 9 aa, Influenza virus
TRREVHIYY

SEQ ID NO: 322332 - protein, 9 aa, Influenza virus
RREVHIYYL

SEQ ID NO: 322333 - protein, 9 aa, Influenza virus
REVHIYYLE

SEQ ID NO: 322334 - protein, 9 aa, Influenza virus
EVHIYYLEK

SEQ ID NO: 322335 - protein, 9 aa, Influenza virus
VHIYYLEKA

SEQ ID NO: 322336 - protein, 9 aa, Influenza virus
YYLEKANKI

SEQ ID NO: 322337 - protein, 9 aa, Influenza virus
YLEKANKIK

SEQ ID NO: 322338 - protein, 9 aa, Influenza virus
LEKANKIKS

SEQ ID NO: 322339 - protein, 9 aa, Influenza virus
EKANKIKSE

SEQ ID NO: 322340 - protein, 9 aa, Influenza virus
EKTHIHIFS

SEQ ID NO: 322341 - protein, 9 aa, Influenza virus
KTHIHIFSF

SEQ ID NO: 322342 - protein, 9 aa, Influenza virus
THIHIFSFT

SEQ ID NO: 322343 - protein, 9 aa, Influenza virus
HIHIFSFTG

SEQ ID NO: 322344 - protein, 9 aa, Influenza virus
IHIFSFTGE

SEQ ID NO: 322345 - protein, 9 aa, Influenza virus
HIFSFTGEE

SEQ ID NO: 322346 - protein, 9 aa, Influenza virus
IFSFTGEEM

SEQ ID NO: 322347 - protein, 9 aa, Influenza virus
FSFTGEEMA

SEQ ID NO: 322348 - protein, 9 aa, Influenza virus
SFTGEEMAT

SEQ ID NO: 322349 - protein, 9 aa, Influenza virus
FTGEEMATK

SEQ ID NO: 322350 - protein, 9 aa, Influenza virus
DYTLDEESR

SEQ ID NO: 322351 - protein, 9 aa, Influenza virus
YTLDEESRA

SEQ ID NO: 322352 - protein, 9 aa, Influenza virus
TLDEESRAR

SEQ ID NO: 322353 - protein, 9 aa, Influenza virus
LDEESRARI

SEQ ID NO: 322354 - protein, 9 aa, Influenza virus
ASSKSRARI

SEQ ID NO: 322355 - protein, 9 aa, Influenza virus
DEESRARIK

SEQ ID NO: 322356 - protein, 9 aa, Influenza virus
EESRARIKT

SEQ ID NO: 322357 - protein, 9 aa, Influenza virus
ESRARIKTR

SEQ ID NO: 322358 - protein, 9 aa, Influenza virus
SRARIKTRL

SEQ ID NO: 322359 - protein, 9 aa, Influenza virus
RARIKTRLF

SEQ ID NO: 322360 - protein, 9 aa, Influenza virus
ARIKTRLFT

SEQ ID NO: 322361 - protein, 9 aa, Influenza virus
RIKTRLFTI

SEQ ID NO: 322362 - protein, 9 aa, Influenza virus
IKTRLFTIR

SEQ ID NO: 322363 - protein, 9 aa, Influenza virus
KTRLFTIRQ

SEQ ID NO: 322364 - protein, 9 aa, Influenza virus
TRLFTIRQE

SEQ ID NO: 322365 - protein, 9 aa, Influenza virus
RLFTIRQEM

SEQ ID NO: 322366 - protein, 9 aa, Influenza virus
LFTIRQEMA

SEQ ID NO: 322367 - protein, 9 aa, Influenza virus
FTIRQEMAS

SEQ ID NO: 322368 - protein, 9 aa, Influenza virus
TIRQEMASR

SEQ ID NO: 322369 - protein, 9 aa, Influenza virus
RGLWDSFRQ

SEQ ID NO: 322370 - protein, 9 aa, Influenza virus
GLWDSFRQS

SEQ ID NO: 322371 - protein, 9 aa, Influenza virus
LWDSFRQSE

SEQ ID NO: 322372 - protein, 9 aa, Influenza virus
WDSFRQSER

SEQ ID NO: 322373 - protein, 9 aa, Influenza virus
DSFRQSERG

SEQ ID NO: 322374 - protein, 9 aa, Influenza virus
SFRQSERGE

SEQ ID NO: 322375 - protein, 9 aa, Influenza virus
FRQSERGEE

SEQ ID NO: 322376 - protein, 9 aa, Influenza virus
RQSERGEET

SEQ ID NO: 322377 - protein, 9 aa, Influenza virus
QSERGEETI

SEQ ID NO: 322378 - protein, 9 aa, Influenza virus
SERGEETIE

SEQ ID NO: 322379 - protein, 9 aa, Influenza virus
ERGEETIEE

SEQ ID NO: 322380 - protein, 9 aa, Influenza virus
RGEETIEER

SEQ ID NO: 322381 - protein, 9 aa, Influenza virus
GEETIEERF

SEQ ID NO: 322382 - protein, 9 aa, Influenza virus
EETIEERFE

SEQ ID NO: 322383 - protein, 9 aa, Influenza virus
ETIEERFEI

SEQ ID NO: 322384 - protein, 9 aa, Influenza virus
RSIEEKFEI

SEQ ID NO: 322385 - protein, 9 aa, Influenza virus
LADQSLPPN

SEQ ID NO: 322386 - protein, 9 aa, Influenza virus
ADQSLPPNF

SEQ ID NO: 322387 - protein, 9 aa, Influenza virus
DQSLPPNFS

SEQ ID NO: 322388 - protein, 9 aa, Influenza virus
QSLPPNFSS

SEQ ID NO: 322389 - protein, 9 aa, Influenza virus
NFRAYVDGF

SEQ ID NO: 322390 - protein, 9 aa, Influenza virus
FRAYVDGFE

SEQ ID NO: 322391 - protein, 9 aa, Influenza virus
RAYVDGFEP

SEQ ID NO: 322392 - protein, 9 aa, Influenza virus
AYVDGFEPN

SEQ ID NO: 322393 - protein, 9 aa, Influenza virus
YVDGFEPNG

SEQ ID NO: 322394 - protein, 9 aa, Influenza virus
VDGFEPNGC

SEQ ID NO: 322395 - protein, 9 aa, Influenza virus
DGFEPNGCI

SEQ ID NO: 322396 - protein, 9 aa, Influenza virus
GFEPNGCIE

SEQ ID NO: 322397 - protein, 9 aa, Influenza virus
FEPNGCIEG

SEQ ID NO: 322398 - protein, 9 aa, Influenza virus
EPNGCIEGK

SEQ ID NO: 322399 - protein, 9 aa, Influenza virus
PNGCIEGKL

SEQ ID NO: 322400 - protein, 9 aa, Influenza virus
NGCIEGKLS

SEQ ID NO: 322401 - protein, 9 aa, Influenza virus
GCIEGKLSQ

SEQ ID NO: 322402 - protein, 9 aa, Influenza virus
CIEGKLSQM

SEQ ID NO: 322403 - protein, 9 aa, Influenza virus
IEGKLSQMS

SEQ ID NO: 322404 - protein, 9 aa, Influenza virus
EGKLSQMSK

SEQ ID NO: 322405 - protein, 9 aa, Influenza virus
KLSQMSKEV

SEQ ID NO: 322406 - protein, 9 aa, Influenza virus
CSQRSKFLL

SEQ ID NO: 322407 - protein, 9 aa, Influenza virus
SQRSKFLLM

SEQ ID NO: 322408 - protein, 9 aa, Influenza virus
QRSKFLLMD

SEQ ID NO: 322409 - protein, 9 aa, Influenza virus
RSKFLLMDA

SEQ ID NO: 322410 - protein, 9 aa, Influenza virus
SKFLLMDAL

SEQ ID NO: 322411 - protein, 9 aa, Influenza virus
KFLLMDALK

SEQ ID NO: 322412 - protein, 9 aa, Influenza virus
FLLMDALKL

SEQ ID NO: 322413 - protein, 9 aa, Influenza virus
LLMDALKLS

SEQ ID NO: 322414 - protein, 9 aa, Influenza virus
LMDALKLSI

SEQ ID NO: 322415 - protein, 9 aa, Influenza virus
MDALKLSIE

SEQ ID NO: 322416 - protein, 9 aa, Influenza virus
DALKLSIED

SEQ ID NO: 322417 - protein, 9 aa, Influenza virus
ALKLSIEDP

SEQ ID NO: 322418 - protein, 9 aa, Influenza virus
LKLSIEDPS

SEQ ID NO: 322419 - protein, 9 aa, Influenza virus
KLSIEDPSH

SEQ ID NO: 322420 - protein, 9 aa, Influenza virus
LSIEDPSHE

SEQ ID NO: 322421 - protein, 9 aa, Influenza virus
KASKEPEVH

SEQ ID NO: 322422 - protein, 9 aa, Influenza virus
ASKEPEVHE

SEQ ID NO: 322423 - protein, 9 aa, Influenza virus
SIEDPSHEG

SEQ ID NO: 322424 - protein, 9 aa, Influenza virus
IEDPSHEGE

SEQ ID NO: 322425 - protein, 9 aa, Influenza virus
EDPSHEGEG

SEQ ID NO: 322426 - protein, 9 aa, Influenza virus
DPSHEGEGI

SEQ ID NO: 322427 - protein, 9 aa, Influenza virus
PSHEGEGIP

SEQ ID NO: 322428 - protein, 9 aa, Influenza virus
SHEGEGIPL

SEQ ID NO: 322429 - protein, 9 aa, Influenza virus
HEGEGIPLY

SEQ ID NO: 322430 - protein, 9 aa, Influenza virus
EGEGIPLYD

SEQ ID NO: 322431 - protein, 9 aa, Influenza virus
GEGIPLYDA

SEQ ID NO: 322432 - protein, 9 aa, Influenza virus
EGIPLYDAI

SEQ ID NO: 322433 - protein, 9 aa, Influenza virus
GIPLYDAIK

SEQ ID NO: 322434 - protein, 9 aa, Influenza virus
IPLYDAIKC

SEQ ID NO: 322435 - protein, 9 aa, Influenza virus
KCMKTFFGW

SEQ ID NO: 322436 - protein, 9 aa, Influenza virus
CMKTFFGWK

SEQ ID NO: 322437 - protein, 9 aa, Influenza virus
KTFFGWKEP

SEQ ID NO: 322438 - protein, 9 aa, Influenza virus
LKDEEKIPK

SEQ ID NO: 322439 - protein, 9 aa, Influenza virus
LKWALGENM

SEQ ID NO: 322440 - protein, 9 aa, Influenza virus
KWALGENMA

SEQ ID NO: 322441 - protein, 9 aa, Influenza virus
WALGENMAP

SEQ ID NO: 322442 - protein, 9 aa, Influenza virus
ALGENMAPE

SEQ ID NO: 322443 - protein, 9 aa, Influenza virus
LGENMAPEK

SEQ ID NO: 322444 - protein, 9 aa, Influenza virus
GENMAPEKV

SEQ ID NO: 322445 - protein, 9 aa, Influenza virus
ENMAPEKVD

SEQ ID NO: 322446 - protein, 9 aa, Influenza virus
NMAPEKVDF

SEQ ID NO: 322447 - protein, 9 aa, Influenza virus
MAPEKVDFD

SEQ ID NO: 322448 - protein, 9 aa, Influenza virus
WIQSEFNKA

SEQ ID NO: 322449 - protein, 9 aa, Influenza virus
IQSEFNKAC

SEQ ID NO: 322450 - protein, 9 aa, Influenza virus
QNEFNKACE

SEQ ID NO: 322451 - protein, 9 aa, Influenza virus
NEFNKACEL

SEQ ID NO: 322452 - protein, 9 aa, Influenza virus
EFNKACELT

SEQ ID NO: 322453 - protein, 9 aa, Influenza virus
FNKACELTD

SEQ ID NO: 322454 - protein, 9 aa, Influenza virus
NKACELTDS

SEQ ID NO: 322455 - protein, 9 aa, Influenza virus
KACELTDSS

SEQ ID NO: 322456 - protein, 9 aa, Influenza virus
KTAYELTDS

SEQ ID NO: 322457 - protein, 9 aa, Influenza virus
TAYELTDSS

SEQ ID NO: 322458 - protein, 9 aa, Influenza virus
ACELTDSSW

SEQ ID NO: 322459 - protein, 9 aa, Influenza virus
WIELDEIGE

SEQ ID NO: 322460 - protein, 9 aa, Influenza virus
IELDEIGED

SEQ ID NO: 322461 - protein, 9 aa, Influenza virus
ELDEIGEDV

SEQ ID NO: 322462 - protein, 9 aa, Influenza virus
LDEIGEDVA

SEQ ID NO: 322463 - protein, 9 aa, Influenza virus
DEIGEDVAP

SEQ ID NO: 322464 - protein, 9 aa, Influenza virus
EIGEDVAPI

SEQ ID NO: 322465 - protein, 9 aa, Influenza virus
IGEDVAPIE

SEQ ID NO: 322466 - protein, 9 aa, Influenza virus
GEDVAPIEH

SEQ ID NO: 322467 - protein, 9 aa, Influenza virus
APIEHIASM

SEQ ID NO: 322468 - protein, 9 aa, Influenza virus
PIEHIASMR

SEQ ID NO: 322469 - protein, 9 aa, Influenza virus
IEHIASMRR

SEQ ID NO: 322470 - protein, 9 aa, Influenza virus
IASMRRNYF

SEQ ID NO: 322471 - protein, 9 aa, Influenza virus
ASMRRNYFT

SEQ ID NO: 322472 - protein, 9 aa, Influenza virus
RRNYFTAEV

SEQ ID NO: 322473 - protein, 9 aa, Influenza virus
RNYFTAEVS

SEQ ID NO: 322474 - protein, 9 aa, Influenza virus
YFTAEVSHC

SEQ ID NO: 322475 - protein, 9 aa, Influenza virus
FTAEVSHCR

SEQ ID NO: 322476 - protein, 9 aa, Influenza virus
TAEVSHCRA

SEQ ID NO: 322477 - protein, 9 aa, Influenza virus
AEVSHCRAT

SEQ ID NO: 322478 - protein, 9 aa, Influenza virus
EVSHCRATE

SEQ ID NO: 322479 - protein, 9 aa, Influenza virus
VSHCRATEY

SEQ ID NO: 322480 - protein, 9 aa, Influenza virus
ISKSRATEY

SEQ ID NO: 322481 - protein, 9 aa, Influenza virus
SHCRATEYI

SEQ ID NO: 322482 - protein, 9 aa, Influenza virus
HCRATEYIM

SEQ ID NO: 322483 - protein, 9 aa, Influenza virus
CRATEYIMK

SEQ ID NO: 322484 - protein, 9 aa, Influenza virus
RATEYIMKG

SEQ ID NO: 322485 - protein, 9 aa, Influenza virus
ATEYIMKGV

SEQ ID NO: 322486 - protein, 9 aa, Influenza virus
TEYIMKGVY

SEQ ID NO: 322487 - protein, 9 aa, Influenza virus
MKGVYINTA

SEQ ID NO: 322488 - protein, 9 aa, Influenza virus
KGVYINTAL

SEQ ID NO: 322489 - protein, 9 aa, Influenza virus
GVYINTALL

SEQ ID NO: 322490 - protein, 9 aa, Influenza virus
VYINTALLN

SEQ ID NO: 322491 - protein, 9 aa, Influenza virus
YINTALLNA

SEQ ID NO: 322492 - protein, 9 aa, Influenza virus
INTALLNAS

SEQ ID NO: 322493 - protein, 9 aa, Influenza virus
NTALLNASC

SEQ ID NO: 322494 - protein, 9 aa, Influenza virus
TALLNASCA

SEQ ID NO: 322495 - protein, 9 aa, Influenza virus
ALLNASCAA

SEQ ID NO: 322496 - protein, 9 aa, Influenza virus
LLNASCAAM

SEQ ID NO: 322497 - protein, 9 aa, Influenza virus
LNASCAAMD

SEQ ID NO: 322498 - protein, 9 aa, Influenza virus
NASCAAMDD

SEQ ID NO: 322499 - protein, 9 aa, Influenza virus
ASCAAMDDF

SEQ ID NO: 322500 - protein, 9 aa, Influenza virus
SCAAMDDFQ

SEQ ID NO: 322501 - protein, 9 aa, Influenza virus
CAAMDDFQL

SEQ ID NO: 322502 - protein, 9 aa, Influenza virus
AAMDDFQLI

SEQ ID NO: 322503 - protein, 9 aa, Influenza virus
AMDDFQLIP

SEQ ID NO: 322504 - protein, 9 aa, Influenza virus
MDDFQLIPM

SEQ ID NO: 322505 - protein, 9 aa, Influenza virus
DDFQLIPMI

SEQ ID NO: 322506 - protein, 9 aa, Influenza virus
DFQLIPMIS

SEQ ID NO: 322507 - protein, 9 aa, Influenza virus
FQLIPMISK

SEQ ID NO: 322508 - protein, 9 aa, Influenza virus
QLIPMISKC

SEQ ID NO: 322509 - protein, 9 aa, Influenza virus
LIPMISKCR

SEQ ID NO: 322510 - protein, 9 aa, Influenza virus
IPMISKCRT

SEQ ID NO: 322511 - protein, 9 aa, Influenza virus
PMISKCRTK

SEQ ID NO: 322512 - protein, 9 aa, Influenza virus
MISKCRTKE

SEQ ID NO: 322513 - protein, 9 aa, Influenza virus
ISKCRTKEG

SEQ ID NO: 322514 - protein, 9 aa, Influenza virus
SKCRTKEGR

SEQ ID NO: 322515 - protein, 9 aa, Influenza virus
KCRTKEGRR

SEQ ID NO: 322516 - protein, 9 aa, Influenza virus
CRTKEGRRK

SEQ ID NO: 322517 - protein, 9 aa, Influenza virus
RTKEGRRKT

SEQ ID NO: 322518 - protein, 9 aa, Influenza virus
TKEGRRKTN

SEQ ID NO: 322519 - protein, 9 aa, Influenza virus
KEGRRKTNL

SEQ ID NO: 322520 - protein, 9 aa, Influenza virus
EGRRKTNLY

SEQ ID NO: 322521 - protein, 9 aa, Influenza virus
GRRKTNLYG

SEQ ID NO: 322522 - protein, 9 aa, Influenza virus
RRKTNLYGF

SEQ ID NO: 322523 - protein, 9 aa, Influenza virus
RKTNLYGFI

SEQ ID NO: 322524 - protein, 9 aa, Influenza virus
KTNLYGFII

SEQ ID NO: 322525 - protein, 9 aa, Influenza virus
TNLYGFIIK

SEQ ID NO: 322526 - protein, 9 aa, Influenza virus
NLYGFIIKG

SEQ ID NO: 322527 - protein, 9 aa, Influenza virus
LYGFIIKGR

SEQ ID NO: 322528 - protein, 9 aa, Influenza virus
YGFIIKGRS

SEQ ID NO: 322529 - protein, 9 aa, Influenza virus
GFIIKGRSH

SEQ ID NO: 322530 - protein, 9 aa, Influenza virus
FIIKGRSHL

SEQ ID NO: 322531 - protein, 9 aa, Influenza virus
IIKGRSHLR

SEQ ID NO: 322532 - protein, 9 aa, Influenza virus
IKGRSHLRN

SEQ ID NO: 322533 - protein, 9 aa, Influenza virus
KGRSHLRND

SEQ ID NO: 322534 - protein, 9 aa, Influenza virus
GRSHLRNDT

SEQ ID NO: 322535 - protein, 9 aa, Influenza virus
RSHLRNDTD

SEQ ID NO: 322536 - protein, 9 aa, Influenza virus
SHLRNDTDV

SEQ ID NO: 322537 - protein, 9 aa, Influenza virus
HLRNDTDVV

SEQ ID NO: 322538 - protein, 9 aa, Influenza virus
LRNDTDVVN

SEQ ID NO: 322539 - protein, 9 aa, Influenza virus
RNDTDVVNF

SEQ ID NO: 322540 - protein, 9 aa, Influenza virus
NDTDVVNFV

SEQ ID NO: 322541 - protein, 9 aa, Influenza virus
DTDVVNFVS

SEQ ID NO: 322542 - protein, 9 aa, Influenza virus
TDVVNFVSM

SEQ ID NO: 322543 - protein, 9 aa, Influenza virus
DVVNFVSME

SEQ ID NO: 322544 - protein, 9 aa, Influenza virus
GSLNFVSME

SEQ ID NO: 322545 - protein, 9 aa, Influenza virus
VVNFVSMEF

SEQ ID NO: 322546 - protein, 9 aa, Influenza virus
VNFVSMEFS

SEQ ID NO: 322547 - protein, 9 aa, Influenza virus
NFVSMEFSL

SEQ ID NO: 322548 - protein, 9 aa, Influenza virus
FVSMEFSLT

SEQ ID NO: 322549 - protein, 9 aa, Influenza virus
VSMEFSLTD

SEQ ID NO: 322550 - protein, 9 aa, Influenza virus
SMEFSLTDP

SEQ ID NO: 322551 - protein, 9 aa, Influenza virus
MEFSLTDPR

SEQ ID NO: 322552 - protein, 9 aa, Influenza virus
EFSLTDPRL

SEQ ID NO: 322553 - protein, 9 aa, Influenza virus
FSLTDPRLE

SEQ ID NO: 322554 - protein, 9 aa, Influenza virus
KWEKYCVLE

SEQ ID NO: 322555 - protein, 9 aa, Influenza virus
PMFLYVRTN

SEQ ID NO: 322556 - protein, 9 aa, Influenza virus
MFLYVRTNG

SEQ ID NO: 322557 - protein, 9 aa, Influenza virus
FLYVRTNGT

SEQ ID NO: 322558 - protein, 9 aa, Influenza virus
LYVRTNGTS

SEQ ID NO: 322559 - protein, 9 aa, Influenza virus
YVRTNGTSK

SEQ ID NO: 322560 - protein, 9 aa, Influenza virus
VRTNGTSKI

SEQ ID NO: 322561 - protein, 9 aa, Influenza virus
RTNGTSKIK

SEQ ID NO: 322562 - protein, 9 aa, Influenza virus
TNGTSKIKM

SEQ ID NO: 322563 - protein, 9 aa, Influenza virus
NGTSKIKMK

SEQ ID NO: 322564 - protein, 9 aa, Influenza virus
GTSKIKMKW

SEQ ID NO: 322565 - protein, 9 aa, Influenza virus
TSKIKMKWG

SEQ ID NO: 322566 - protein, 9 aa, Influenza virus
SKIKMKWGM

SEQ ID NO: 322567 - protein, 9 aa, Influenza virus
KIKMKWGME

SEQ ID NO: 322568 - protein, 9 aa, Influenza virus
IKMKWGMEM

SEQ ID NO: 322569 - protein, 9 aa, Influenza virus
KMKWGMEMR

SEQ ID NO: 322570 - protein, 9 aa, Influenza virus
MKWGMEMRR

SEQ ID NO: 322571 - protein, 9 aa, Influenza virus
KWGMEMRRC

SEQ ID NO: 322572 - protein, 9 aa, Influenza virus
WGMEMRRCL

SEQ ID NO: 322573 - protein, 9 aa, Influenza virus
GMEMRRCLL

SEQ ID NO: 322574 - protein, 9 aa, Influenza virus
MEMRRCLLQ

SEQ ID NO: 322575 - protein, 9 aa, Influenza virus
EMRRCLLQS

SEQ ID NO: 322576 - protein, 9 aa, Influenza virus
MRRCLLQSL

SEQ ID NO: 322577 - protein, 9 aa, Influenza virus
RRCLLQSLQ

SEQ ID NO: 322578 - protein, 9 aa, Influenza virus
RCLLQSLQQ

SEQ ID NO: 322579 - protein, 9 aa, Influenza virus
CLLQSLQQI

SEQ ID NO: 322580 - protein, 9 aa, Influenza virus
LLQSLQQIE

SEQ ID NO: 322581 - protein, 9 aa, Influenza virus
LQSLQQIES

SEQ ID NO: 322582 - protein, 9 aa, Influenza virus
QSLQQIESM

SEQ ID NO: 322583 - protein, 9 aa, Influenza virus
SLQQIESMI

SEQ ID NO: 322584 - protein, 9 aa, Influenza virus
LQQIESMIE

SEQ ID NO: 322585 - protein, 9 aa, Influenza virus
QQIESMIEA

SEQ ID NO: 322586 - protein, 9 aa, Influenza virus
QIESMIEAE

SEQ ID NO: 322587 - protein, 9 aa, Influenza virus
IESMIEAES

SEQ ID NO: 322588 - protein, 9 aa, Influenza virus
ESMIEAESS

SEQ ID NO: 322589 - protein, 9 aa, Influenza virus
SMIEAESSV

SEQ ID NO: 322590 - protein, 9 aa, Influenza virus
MIEAESSVK

SEQ ID NO: 322591 - protein, 9 aa, Influenza virus
IEAESSVKE

SEQ ID NO: 322592 - protein, 9 aa, Influenza virus
EAESSVKEK

SEQ ID NO: 322593 - protein, 9 aa, Influenza virus
AESSVKEKD

SEQ ID NO: 322594 - protein, 9 aa, Influenza virus
ESSVKEKDM

SEQ ID NO: 322595 - protein, 9 aa, Influenza virus
SSVKEKDMT

SEQ ID NO: 322596 - protein, 9 aa, Influenza virus
SVKEKDMTK

SEQ ID NO: 322597 - protein, 9 aa, Influenza virus
VKEKDMTKE

SEQ ID NO: 322598 - protein, 9 aa, Influenza virus
KEKDMTKEF

SEQ ID NO: 322599 - protein, 9 aa, Influenza virus
EKDMTKEFF

SEQ ID NO: 322600 - protein, 9 aa, Influenza virus
KDMTKEFFE

SEQ ID NO: 322601 - protein, 9 aa, Influenza virus
ETWPIGESP

SEQ ID NO: 322602 - protein, 9 aa, Influenza virus
WPIGESPKG

SEQ ID NO: 322603 - protein, 9 aa, Influenza virus
GVEEGSIGK

SEQ ID NO: 322604 - protein, 9 aa, Influenza virus
VEEGSIGKV

SEQ ID NO: 322605 - protein, 9 aa, Influenza virus
EEGSIGKVC

SEQ ID NO: 322606 - protein, 9 aa, Influenza virus
EGSIGKVCR

SEQ ID NO: 322607 - protein, 9 aa, Influenza virus
GSIGKVCRT

SEQ ID NO: 322608 - protein, 9 aa, Influenza virus
SIGKVCRTL

SEQ ID NO: 322609 - protein, 9 aa, Influenza virus
IGKVCRTLL

SEQ ID NO: 322610 - protein, 9 aa, Influenza virus
GKVCRTLLA

SEQ ID NO: 322611 - protein, 9 aa, Influenza virus
KVCRTLLAK

SEQ ID NO: 322612 - protein, 9 aa, Influenza virus
VCRTLLAKS

SEQ ID NO: 322613 - protein, 9 aa, Influenza virus
CRTLLAKSV

SEQ ID NO: 322614 - protein, 9 aa, Influenza virus
RTLLAKSVF

SEQ ID NO: 322615 - protein, 9 aa, Influenza virus
TLLAKSVFN

SEQ ID NO: 322616 - protein, 9 aa, Influenza virus
LLAKSVFNS

SEQ ID NO: 322617 - protein, 9 aa, Influenza virus
LAKSVFNSL

SEQ ID NO: 322618 - protein, 9 aa, Influenza virus
AKSVFNSLY

SEQ ID NO: 322619 - protein, 9 aa, Influenza virus
KSVFNSLYA

SEQ ID NO: 322620 - protein, 9 aa, Influenza virus
SVFNSLYAS

SEQ ID NO: 322621 - protein, 9 aa, Influenza virus
VFNSLYASP

SEQ ID NO: 322622 - protein, 9 aa, Influenza virus
FNSLYASPQ

SEQ ID NO: 322623 - protein, 9 aa, Influenza virus
NSLYASPQL

SEQ ID NO: 322624 - protein, 9 aa, Influenza virus
SLYASPQLE

SEQ ID NO: 322625 - protein, 9 aa, Influenza virus
LYASPQLEG

SEQ ID NO: 322626 - protein, 9 aa, Influenza virus
YASPQLEGF

SEQ ID NO: 322627 - protein, 9 aa, Influenza virus
ASPQLEGFS

SEQ ID NO: 322628 - protein, 9 aa, Influenza virus
SPQLEGFSA

SEQ ID NO: 322629 - protein, 9 aa, Influenza virus
PQLEGFSAE

SEQ ID NO: 322630 - protein, 9 aa, Influenza virus
QLEGFSAES

SEQ ID NO: 322631 - protein, 9 aa, Influenza virus
LEGFSAESR

SEQ ID NO: 322632 - protein, 9 aa, Influenza virus
EGFSAESRK

SEQ ID NO: 322633 - protein, 9 aa, Influenza virus
GFSAESRKL

SEQ ID NO: 322634 - protein, 9 aa, Influenza virus
FSAESRKLL

SEQ ID NO: 322635 - protein, 9 aa, Influenza virus
SAESRKLLL

SEQ ID NO: 322636 - protein, 9 aa, Influenza virus
AESRKLLLI

SEQ ID NO: 322637 - protein, 9 aa, Influenza virus
ESRKLLLIV

SEQ ID NO: 322638 - protein, 9 aa, Influenza virus
SRKLLLIVQ

SEQ ID NO: 322639 - protein, 9 aa, Influenza virus
RKLLLIVQA

SEQ ID NO: 322640 - protein, 9 aa, Influenza virus
LLIVQALRD

SEQ ID NO: 322641 - protein, 9 aa, Influenza virus
QALRDNLEP

SEQ ID NO: 322642 - protein, 9 aa, Influenza virus
ALRDNLEPG

SEQ ID NO: 322643 - protein, 9 aa, Influenza virus
LRDNLEPGT

SEQ ID NO: 322644 - protein, 9 aa, Influenza virus
RDNLEPGTF

SEQ ID NO: 322645 - protein, 9 aa, Influenza virus
DNLEPGTFD

SEQ ID NO: 322646 - protein, 9 aa, Influenza virus
NLEPGTFDL

SEQ ID NO: 322647 - protein, 9 aa, Influenza virus
LEPGTFDLG

SEQ ID NO: 322648 - protein, 9 aa, Influenza virus
EPGTFDLGG

SEQ ID NO: 322649 - protein, 9 aa, Influenza virus
PGTFDLGGL

SEQ ID NO: 322650 - protein, 9 aa, Influenza virus
GTFDLGGLY

SEQ ID NO: 322651 - protein, 9 aa, Influenza virus
GLYEAIEEC

SEQ ID NO: 322652 - protein, 9 aa, Influenza virus
LYEAIEECL

SEQ ID NO: 322653 - protein, 9 aa, Influenza virus
YEAIEECLI

SEQ ID NO: 322654 - protein, 9 aa, Influenza virus
EAIEECLIN

SEQ ID NO: 322655 - protein, 9 aa, Influenza virus
AIEECLIND

SEQ ID NO: 322656 - protein, 9 aa, Influenza virus
IEECLINDP

SEQ ID NO: 322657 - protein, 9 aa, Influenza virus
EECLINDPW

SEQ ID NO: 322658 - protein, 9 aa, Influenza virus
ECLINDPWV

SEQ ID NO: 322659 - protein, 9 aa, Influenza virus
CLINDPWVL

SEQ ID NO: 322660 - protein, 9 aa, Influenza virus
LINDPWVLL

SEQ ID NO: 322661 - protein, 9 aa, Influenza virus
INDPWVLLN

SEQ ID NO: 322662 - protein, 9 aa, Influenza virus
NDPWVLLNA

SEQ ID NO: 322663 - protein, 9 aa, Influenza virus
DPWVLLNAS

SEQ ID NO: 322664 - protein, 9 aa, Influenza virus
PWVLLNASW

SEQ ID NO: 322665 - protein, 9 aa, Influenza virus
WVLLNASWF

SEQ ID NO: 322666 - protein, 9 aa, Influenza virus
VLLNASWFN

SEQ ID NO: 322667 - protein, 9 aa, Influenza virus
LLNASWFNS

SEQ ID NO: 322668 - protein, 9 aa, Influenza virus
LNASWFNSF

SEQ ID NO: 322669 - protein, 9 aa, Influenza virus
NASWFNSFL

SEQ ID NO: 322670 - protein, 9 aa, Influenza virus
ASWFNSFLT

SEQ ID NO: 322671 - protein, 9 aa, Influenza virus
SWFNSFLTH

SEQ ID NO: 322672 - protein, 9 aa, Influenza virus
SSLTHALRE

SEQ ID NO: 322673 - protein, 9 aa, Influenza virus
SLTHALREL

SEQ ID NO: 322674 - protein, 9 aa, Influenza virus
LTHALRELW

SEQ ID NO: 322675 - protein, 9 aa, Influenza virus
THALRELWQ

SEQ ID NO: 322676 - protein, 9 aa, Influenza virus
HALRELWQC

SEQ ID NO: 322677 - protein, 9 aa, Influenza virus
ALRELWQCY

SEQ ID NO: 322678 - protein, 9 aa, Influenza virus
LRELWQCYY

SEQ ID NO: 322679 - protein, 9 aa, Influenza virus
RELWQCYYL

SEQ ID NO: 322680 - protein, 9 aa, Influenza virus
ELWQCYYLL

SEQ ID NO: 322681 - protein, 9 aa, Influenza virus
MDVNPTLLF

SEQ ID NO: 322682 - protein, 9 aa, Influenza virus
DVNPTLLFL

SEQ ID NO: 322683 - protein, 9 aa, Influenza virus
VNPTLLFLK

SEQ ID NO: 322684 - protein, 9 aa, Influenza virus
INPTLLFLK

SEQ ID NO: 322685 - protein, 9 aa, Influenza virus
NPTLLFLKV

SEQ ID NO: 322686 - protein, 9 aa, Influenza virus
PTLLFLKVP

SEQ ID NO: 322687 - protein, 9 aa, Influenza virus
LLFLKVPAQ

SEQ ID NO: 322688 - protein, 9 aa, Influenza virus
YFFLKVPVQ

SEQ ID NO: 322689 - protein, 9 aa, Influenza virus
KVPAQNAIS

SEQ ID NO: 322690 - protein, 9 aa, Influenza virus
VPAQNAIST

SEQ ID NO: 322691 - protein, 9 aa, Influenza virus
PAQNAISTT

SEQ ID NO: 322692 - protein, 9 aa, Influenza virus
AQNAISTTF

SEQ ID NO: 322693 - protein, 9 aa, Influenza virus
QNAISTTFP

SEQ ID NO: 322694 - protein, 9 aa, Influenza virus
NAISTTFPY

SEQ ID NO: 322695 - protein, 9 aa, Influenza virus
AISTTFPYT

SEQ ID NO: 322696 - protein, 9 aa, Influenza virus
ISTTFPYTG

SEQ ID NO: 322697 - protein, 9 aa, Influenza virus
STTFPYTGD

SEQ ID NO: 322698 - protein, 9 aa, Influenza virus
TTFPYTGDP

SEQ ID NO: 322699 - protein, 9 aa, Influenza virus
TFPYTGDPP

SEQ ID NO: 322700 - protein, 9 aa, Influenza virus
FPYTGDPPY

SEQ ID NO: 322701 - protein, 9 aa, Influenza virus
PYTGDPPYS

SEQ ID NO: 322702 - protein, 9 aa, Influenza virus
YTGDPPYSH

SEQ ID NO: 322703 - protein, 9 aa, Influenza virus
TGDPPYSHG

SEQ ID NO: 322704 - protein, 9 aa, Influenza virus
GDPPYSHGT

SEQ ID NO: 322705 - protein, 9 aa, Influenza virus
DPPYSHGTG

SEQ ID NO: 322706 - protein, 9 aa, Influenza virus
PPYSHGTGT

SEQ ID NO: 322707 - protein, 9 aa, Influenza virus
PYSHGTGTG

SEQ ID NO: 322708 - protein, 9 aa, Influenza virus
YSHGTGTGY

SEQ ID NO: 322709 - protein, 9 aa, Influenza virus
SHGTGTGYT

SEQ ID NO: 322710 - protein, 9 aa, Influenza virus
HGTGTGYTM

SEQ ID NO: 322711 - protein, 9 aa, Influenza virus
GTGTGYTMD

SEQ ID NO: 322712 - protein, 9 aa, Influenza virus
TGTGYTMDT

SEQ ID NO: 322713 - protein, 9 aa, Influenza virus
GTGYTMDTV

SEQ ID NO: 322714 - protein, 9 aa, Influenza virus
TGYTMDTVN

SEQ ID NO: 322715 - protein, 9 aa, Influenza virus
GYTMDTVNR

SEQ ID NO: 322716 - protein, 9 aa, Influenza virus
YTMDTVNRT

SEQ ID NO: 322717 - protein, 9 aa, Influenza virus
TMDTVNRTH

SEQ ID NO: 322718 - protein, 9 aa, Influenza virus
MDTVNRTHQ

SEQ ID NO: 322719 - protein, 9 aa, Influenza virus
DTVNRTHQY

SEQ ID NO: 322720 - protein, 9 aa, Influenza virus
TVNRTHQYS

SEQ ID NO: 322721 - protein, 9 aa, Influenza virus
VNRTHQYSE

SEQ ID NO: 322722 - protein, 9 aa, Influenza virus
NRTHQYSEK

SEQ ID NO: 322723 - protein, 9 aa, Influenza virus
RTHQYSEKG

SEQ ID NO: 322724 - protein, 9 aa, Influenza virus
THQYSEKGK

SEQ ID NO: 322725 - protein, 9 aa, Influenza virus
HQYSEKGKW

SEQ ID NO: 322726 - protein, 9 aa, Influenza virus
NTETGAPQL

SEQ ID NO: 322727 - protein, 9 aa, Influenza virus
TETGAPQLN

SEQ ID NO: 322728 - protein, 9 aa, Influenza virus
ETGAPQLNP

SEQ ID NO: 322729 - protein, 9 aa, Influenza virus
TGAPQLNPI

SEQ ID NO: 322730 - protein, 9 aa, Influenza virus
GAPQLNPID

SEQ ID NO: 322731 - protein, 9 aa, Influenza virus
APQLNPIDG

SEQ ID NO: 322732 - protein, 9 aa, Influenza virus
PQLNPIDGP

SEQ ID NO: 322733 - protein, 9 aa, Influenza virus
QLNPIDGPL

SEQ ID NO: 322734 - protein, 9 aa, Influenza virus
LNPIDGPLP

SEQ ID NO: 322735 - protein, 9 aa, Influenza virus
NPIDGPLPE

SEQ ID NO: 322736 - protein, 9 aa, Influenza virus
DNEPSGYAQ

SEQ ID NO: 322737 - protein, 9 aa, Influenza virus
NEPSGYAQT

SEQ ID NO: 322738 - protein, 9 aa, Influenza virus
EPSGYAQTD

SEQ ID NO: 322739 - protein, 9 aa, Influenza virus
PSGYAQTDC

SEQ ID NO: 322740 - protein, 9 aa, Influenza virus
SGYAQTDCV

SEQ ID NO: 322741 - protein, 9 aa, Influenza virus
GYAQTDCVL

SEQ ID NO: 322742 - protein, 9 aa, Influenza virus
YAQTDCVLE

SEQ ID NO: 322743 - protein, 9 aa, Influenza virus
AQTDCVLEA

SEQ ID NO: 322744 - protein, 9 aa, Influenza virus
QTDCVLEAM

SEQ ID NO: 322745 - protein, 9 aa, Influenza virus
TDCVLEAMA

SEQ ID NO: 322746 - protein, 9 aa, Influenza virus
DCVLEAMAF

SEQ ID NO: 322747 - protein, 9 aa, Influenza virus
CVLEAMAFL

SEQ ID NO: 322748 - protein, 9 aa, Influenza virus
VLEAMAFLE

SEQ ID NO: 322749 - protein, 9 aa, Influenza virus
LEAMAFLEE

SEQ ID NO: 322750 - protein, 9 aa, Influenza virus
EAMAFLEES

SEQ ID NO: 322751 - protein, 9 aa, Influenza virus
AMAFLEESH

SEQ ID NO: 322752 - protein, 9 aa, Influenza virus
MAFLEESHP

SEQ ID NO: 322753 - protein, 9 aa, Influenza virus
AFLEESHPG

SEQ ID NO: 322754 - protein, 9 aa, Influenza virus
LEESHPGIF

SEQ ID NO: 322755 - protein, 9 aa, Influenza virus
EESHPGIFE

SEQ ID NO: 322756 - protein, 9 aa, Influenza virus
SHPGIFENS

SEQ ID NO: 322757 - protein, 9 aa, Influenza virus
HPGIFENSC

SEQ ID NO: 322758 - protein, 9 aa, Influenza virus
PGIFENSCL

SEQ ID NO: 322759 - protein, 9 aa, Influenza virus
GIFENSCLE

SEQ ID NO: 322760 - protein, 9 aa, Influenza virus
IFENSCLET

SEQ ID NO: 322761 - protein, 9 aa, Influenza virus
VQQTRVDKL

SEQ ID NO: 322762 - protein, 9 aa, Influenza virus
QQTRVDKLT

SEQ ID NO: 322763 - protein, 9 aa, Influenza virus
QTRVDKLTQ

SEQ ID NO: 322764 - protein, 9 aa, Influenza virus
TRVDKLTQG

SEQ ID NO: 322765 - protein, 9 aa, Influenza virus
RVDKLTQGR

SEQ ID NO: 322766 - protein, 9 aa, Influenza virus
VDKLTQGRQ

SEQ ID NO: 322767 - protein, 9 aa, Influenza virus
DKLTQGRQT

SEQ ID NO: 322768 - protein, 9 aa, Influenza virus
KLTQGRQTY

SEQ ID NO: 322769 - protein, 9 aa, Influenza virus
LTQGRQTYD

SEQ ID NO: 322770 - protein, 9 aa, Influenza virus
TQGRQTYDW

SEQ ID NO: 322771 - protein, 9 aa, Influenza virus
QGRQTYDWT

SEQ ID NO: 322772 - protein, 9 aa, Influenza virus
GRQTYDWTL

SEQ ID NO: 322773 - protein, 9 aa, Influenza virus
RQTYDWTLN

SEQ ID NO: 322774 - protein, 9 aa, Influenza virus
QTYDWTLNR

SEQ ID NO: 322775 - protein, 9 aa, Influenza virus
TYDWTLNRN

SEQ ID NO: 322776 - protein, 9 aa, Influenza virus
YDWTLNRNQ

SEQ ID NO: 322777 - protein, 9 aa, Influenza virus
DWTLNRNQP

SEQ ID NO: 322778 - protein, 9 aa, Influenza virus
WTLNRNQPA

SEQ ID NO: 322779 - protein, 9 aa, Influenza virus
TLNRNQPAA

SEQ ID NO: 322780 - protein, 9 aa, Influenza virus
LNRNQPAAT

SEQ ID NO: 322781 - protein, 9 aa, Influenza virus
NRNQPAATA

SEQ ID NO: 322782 - protein, 9 aa, Influenza virus
RNQPAATAL

SEQ ID NO: 322783 - protein, 9 aa, Influenza virus
NQPAATALA

SEQ ID NO: 322784 - protein, 9 aa, Influenza virus
QPAATALAN

SEQ ID NO: 322785 - protein, 9 aa, Influenza virus
PAATALANT

SEQ ID NO: 322786 - protein, 9 aa, Influenza virus
AATALANTI

SEQ ID NO: 322787 - protein, 9 aa, Influenza virus
ATALANTIE

SEQ ID NO: 322788 - protein, 9 aa, Influenza virus
TALANTIEV

SEQ ID NO: 322789 - protein, 9 aa, Influenza virus
ALANTIEVF

SEQ ID NO: 322790 - protein, 9 aa, Influenza virus
LANTIEVFR

SEQ ID NO: 322791 - protein, 9 aa, Influenza virus
ANTIEVFRS

SEQ ID NO: 322792 - protein, 9 aa, Influenza virus
NTIEVFRSN

SEQ ID NO: 322793 - protein, 9 aa, Influenza virus
NESGRLIDF

SEQ ID NO: 322794 - protein, 9 aa, Influenza virus
ESGRLIDFL

SEQ ID NO: 322795 - protein, 9 aa, Influenza virus
SGRLIDFLK

SEQ ID NO: 322796 - protein, 9 aa, Influenza virus
GRLIDFLKD

SEQ ID NO: 322797 - protein, 9 aa, Influenza virus
RLIDFLKDV

SEQ ID NO: 322798 - protein, 9 aa, Influenza virus
LIDFLKDVM

SEQ ID NO: 322799 - protein, 9 aa, Influenza virus
EITTHFQRK

SEQ ID NO: 322800 - protein, 9 aa, Influenza virus
ITTHFQRKR

SEQ ID NO: 322801 - protein, 9 aa, Influenza virus
TTHFQRKRR

SEQ ID NO: 322802 - protein, 9 aa, Influenza virus
THFQRKRRV

SEQ ID NO: 322803 - protein, 9 aa, Influenza virus
HFQRKRRVR

SEQ ID NO: 322804 - protein, 9 aa, Influenza virus
FQRKRRVRD

SEQ ID NO: 322805 - protein, 9 aa, Influenza virus
QRKRRVRDN

SEQ ID NO: 322806 - protein, 9 aa, Influenza virus
RKRRVRDNM

SEQ ID NO: 322807 - protein, 9 aa, Influenza virus
KRRVRDNMT

SEQ ID NO: 322808 - protein, 9 aa, Influenza virus
TKKMVTQRT

SEQ ID NO: 322809 - protein, 9 aa, Influenza virus
KMVTQRTIG

SEQ ID NO: 322810 - protein, 9 aa, Influenza virus
MVTQRTIGK

SEQ ID NO: 322811 - protein, 9 aa, Influenza virus
VTQRTIGKK

SEQ ID NO: 322812 - protein, 9 aa, Influenza virus
TQRTIGKKK

SEQ ID NO: 322813 - protein, 9 aa, Influenza virus
QRTIGKKKQ

SEQ ID NO: 322814 - protein, 9 aa, Influenza virus
SYLIRALTL

SEQ ID NO: 322815 - protein, 9 aa, Influenza virus
YLIRALTLN

SEQ ID NO: 322816 - protein, 9 aa, Influenza virus
LIRALTLNT

SEQ ID NO: 322817 - protein, 9 aa, Influenza virus
IRALTLNTM

SEQ ID NO: 322818 - protein, 9 aa, Influenza virus
RALTLNTMT

SEQ ID NO: 322819 - protein, 9 aa, Influenza virus
ALTLNTMTK

SEQ ID NO: 322820 - protein, 9 aa, Influenza virus
LTLNTMTKD

SEQ ID NO: 322821 - protein, 9 aa, Influenza virus
TLNTMTKDA

SEQ ID NO: 322822 - protein, 9 aa, Influenza virus
LNTMTKDAE

SEQ ID NO: 322823 - protein, 9 aa, Influenza virus
NTMTKDAER

SEQ ID NO: 322824 - protein, 9 aa, Influenza virus
TMTKDAERG

SEQ ID NO: 322825 - protein, 9 aa, Influenza virus
MTKDAERGK

SEQ ID NO: 322826 - protein, 9 aa, Influenza virus
TKDAERGKL

SEQ ID NO: 322827 - protein, 9 aa, Influenza virus
KDAERGKLK

SEQ ID NO: 322828 - protein, 9 aa, Influenza virus
DAERGKLKR

SEQ ID NO: 322829 - protein, 9 aa, Influenza virus
AERGKLKRR

SEQ ID NO: 322830 - protein, 9 aa, Influenza virus
ERGKLKRRA

SEQ ID NO: 322831 - protein, 9 aa, Influenza virus
RGKLKRRAI

SEQ ID NO: 322832 - protein, 9 aa, Influenza virus
GKLKRRAIA

SEQ ID NO: 322833 - protein, 9 aa, Influenza virus
KLKRRAIAT

SEQ ID NO: 322834 - protein, 9 aa, Influenza virus
LKRRAIATP

SEQ ID NO: 322835 - protein, 9 aa, Influenza virus
KRRAIATPG

SEQ ID NO: 322836 - protein, 9 aa, Influenza virus
RRAIATPGM

SEQ ID NO: 322837 - protein, 9 aa, Influenza virus
RAIATPGMQ

SEQ ID NO: 322838 - protein, 9 aa, Influenza virus
AIATPGMQI

SEQ ID NO: 322839 - protein, 9 aa, Influenza virus
IATPGMQIR

SEQ ID NO: 322840 - protein, 9 aa, Influenza virus
ATPGMQIRG

SEQ ID NO: 322841 - protein, 9 aa, Influenza virus
TPGMQIRGF

SEQ ID NO: 322842 - protein, 9 aa, Influenza virus
PGMQIRGFV

SEQ ID NO: 322843 - protein, 9 aa, Influenza virus
GMQIRGFVY

SEQ ID NO: 322844 - protein, 9 aa, Influenza virus
MQIRGFVYF

SEQ ID NO: 322845 - protein, 9 aa, Influenza virus
QIRGFVYFV

SEQ ID NO: 322846 - protein, 9 aa, Influenza virus
IRGFVYFVE

SEQ ID NO: 322847 - protein, 9 aa, Influenza virus
RGFVYFVET

SEQ ID NO: 322848 - protein, 9 aa, Influenza virus
GFVYFVETL

SEQ ID NO: 322849 - protein, 9 aa, Influenza virus
FVYFVETLA

SEQ ID NO: 322850 - protein, 9 aa, Influenza virus
VYFVETLAR

SEQ ID NO: 322851 - protein, 9 aa, Influenza virus
VETLARSIC

SEQ ID NO: 322852 - protein, 9 aa, Influenza virus
LARSICEKL

SEQ ID NO: 322853 - protein, 9 aa, Influenza virus
ARSICEKLE

SEQ ID NO: 322854 - protein, 9 aa, Influenza virus
RSICEKLEQ

SEQ ID NO: 322855 - protein, 9 aa, Influenza virus
SICEKLEQS

SEQ ID NO: 322856 - protein, 9 aa, Influenza virus
ICEKLEQSG

SEQ ID NO: 322857 - protein, 9 aa, Influenza virus
CEKLEQSGL

SEQ ID NO: 322858 - protein, 9 aa, Influenza virus
EKLEQSGLP

SEQ ID NO: 322859 - protein, 9 aa, Influenza virus
KLEQSGLPV

SEQ ID NO: 322860 - protein, 9 aa, Influenza virus
LEQSGLPVG

SEQ ID NO: 322861 - protein, 9 aa, Influenza virus
EQSGLPVGG

SEQ ID NO: 322862 - protein, 9 aa, Influenza virus
QSGLPVGGN

SEQ ID NO: 322863 - protein, 9 aa, Influenza virus
SGLPVGGNE

SEQ ID NO: 322864 - protein, 9 aa, Influenza virus
GLPVGGNEK

SEQ ID NO: 322865 - protein, 9 aa, Influenza virus
LPVGGNEKK

SEQ ID NO: 322866 - protein, 9 aa, Influenza virus
PVGGNEKKA

SEQ ID NO: 322867 - protein, 9 aa, Influenza virus
VGGNEKKAK

SEQ ID NO: 322868 - protein, 9 aa, Influenza virus
GGNEKKAKL

SEQ ID NO: 322869 - protein, 9 aa, Influenza virus
GNEKKAKLA

SEQ ID NO: 322870 - protein, 9 aa, Influenza virus
NEKKAKLAN

SEQ ID NO: 322871 - protein, 9 aa, Influenza virus
EKKAKLANV

SEQ ID NO: 322872 - protein, 9 aa, Influenza virus
KKAKLANVV

SEQ ID NO: 322873 - protein, 9 aa, Influenza virus
KAKLANVVR

SEQ ID NO: 322874 - protein, 9 aa, Influenza virus
AKLANVVRK

SEQ ID NO: 322875 - protein, 9 aa, Influenza virus
KLANVVRKM

SEQ ID NO: 322876 - protein, 9 aa, Influenza virus
LANVVRKMM

SEQ ID NO: 322877 - protein, 9 aa, Influenza virus
ANVVRKMMT

SEQ ID NO: 322878 - protein, 9 aa, Influenza virus
NVVRKMMTN

SEQ ID NO: 322879 - protein, 9 aa, Influenza virus
VVRKMMTNS

SEQ ID NO: 322880 - protein, 9 aa, Influenza virus
VRKMMTNSQ

SEQ ID NO: 322881 - protein, 9 aa, Influenza virus
RKMMTNSQD

SEQ ID NO: 322882 - protein, 9 aa, Influenza virus
KMMTNSQDT

SEQ ID NO: 322883 - protein, 9 aa, Influenza virus
MMTNSQDTE

SEQ ID NO: 322884 - protein, 9 aa, Influenza virus
TNSQDTELS

SEQ ID NO: 322885 - protein, 9 aa, Influenza virus
NSQDTELSF

SEQ ID NO: 322886 - protein, 9 aa, Influenza virus
SQDTELSFT

SEQ ID NO: 322887 - protein, 9 aa, Influenza virus
QDTELSFTI

SEQ ID NO: 322888 - protein, 9 aa, Influenza virus
DTELSFTIT

SEQ ID NO: 322889 - protein, 9 aa, Influenza virus
TELSFTITG

SEQ ID NO: 322890 - protein, 9 aa, Influenza virus
ELSFTITGD

SEQ ID NO: 322891 - protein, 9 aa, Influenza virus
LSFTITGDN

SEQ ID NO: 322892 - protein, 9 aa, Influenza virus
SFTITGDNT

SEQ ID NO: 322893 - protein, 9 aa, Influenza virus
FTITGDNTK

SEQ ID NO: 322894 - protein, 9 aa, Influenza virus
TITGDNTKW

SEQ ID NO: 322895 - protein, 9 aa, Influenza virus
ITGDNTKWN

SEQ ID NO: 322896 - protein, 9 aa, Influenza virus
TGDNTKWNE

SEQ ID NO: 322897 - protein, 9 aa, Influenza virus
GDNTKWNEN

SEQ ID NO: 322898 - protein, 9 aa, Influenza virus
DNTKWNENQ

SEQ ID NO: 322899 - protein, 9 aa, Influenza virus
NTKWNENQN

SEQ ID NO: 322900 - protein, 9 aa, Influenza virus
TKWNENQNP

SEQ ID NO: 322901 - protein, 9 aa, Influenza virus
KWNENQNPR

SEQ ID NO: 322902 - protein, 9 aa, Influenza virus
WNENQNPRM

SEQ ID NO: 322903 - protein, 9 aa, Influenza virus
NENQNPRMF

SEQ ID NO: 322904 - protein, 9 aa, Influenza virus
ENQNPRMFL

SEQ ID NO: 322905 - protein, 9 aa, Influenza virus
NQNQNPRMF

SEQ ID NO: 322906 - protein, 9 aa, Influenza virus
QNQNPRMFL

SEQ ID NO: 322907 - protein, 9 aa, Influenza virus
NQNPRMFLA

SEQ ID NO: 322908 - protein, 9 aa, Influenza virus
QNPRMFLAM

SEQ ID NO: 322909 - protein, 9 aa, Influenza virus
NPRMFLAMI

SEQ ID NO: 322910 - protein, 9 aa, Influenza virus
PRMFLAMIT

SEQ ID NO: 322911 - protein, 9 aa, Influenza virus
RMFLAMITY

SEQ ID NO: 322912 - protein, 9 aa, Influenza virus
MFLAMITYI

SEQ ID NO: 322913 - protein, 9 aa, Influenza virus
FLAMITYIT

SEQ ID NO: 322914 - protein, 9 aa, Influenza virus
LAMITYITR

SEQ ID NO: 322915 - protein, 9 aa, Influenza virus
QPEWFRNIL

SEQ ID NO: 322916 - protein, 9 aa, Influenza virus
PEWFRNILS

SEQ ID NO: 322917 - protein, 9 aa, Influenza virus
WFRNVLSIA

SEQ ID NO: 322918 - protein, 9 aa, Influenza virus
FRNVLSIAP

SEQ ID NO: 322919 - protein, 9 aa, Influenza virus
RNVLSIAPI

SEQ ID NO: 322920 - protein, 9 aa, Influenza virus
NVLSIAPIM

SEQ ID NO: 322921 - protein, 9 aa, Influenza virus
VLSIAPIMF

SEQ ID NO: 322922 - protein, 9 aa, Influenza virus
LSIAPIMFS

SEQ ID NO: 322923 - protein, 9 aa, Influenza virus
SIAPIMFSN

SEQ ID NO: 322924 - protein, 9 aa, Influenza virus
IAPIMFSNK

SEQ ID NO: 322925 - protein, 9 aa, Influenza virus
APIMFSNKM

SEQ ID NO: 322926 - protein, 9 aa, Influenza virus
PIMFSNKMA

SEQ ID NO: 322927 - protein, 9 aa, Influenza virus
IMFSNKMAR

SEQ ID NO: 322928 - protein, 9 aa, Influenza virus
MFSNKMARL

SEQ ID NO: 322929 - protein, 9 aa, Influenza virus
FSNKMARLG

SEQ ID NO: 322930 - protein, 9 aa, Influenza virus
SNKMARLGK

SEQ ID NO: 322931 - protein, 9 aa, Influenza virus
NKMARLGKG

SEQ ID NO: 322932 - protein, 9 aa, Influenza virus
KMARLGKGY

SEQ ID NO: 322933 - protein, 9 aa, Influenza virus
MARLGKGYM

SEQ ID NO: 322934 - protein, 9 aa, Influenza virus
ARLGKGYMF

SEQ ID NO: 322935 - protein, 9 aa, Influenza virus
RLGKGYMFE

SEQ ID NO: 322936 - protein, 9 aa, Influenza virus
LGKGYMFES

SEQ ID NO: 322937 - protein, 9 aa, Influenza virus
GKGYMFESK

SEQ ID NO: 322938 - protein, 9 aa, Influenza virus
GYMFESKSM

SEQ ID NO: 322939 - protein, 9 aa, Influenza virus
KIEKIEKIR

SEQ ID NO: 322940 - protein, 9 aa, Influenza virus
IEKIEKIRP

SEQ ID NO: 322941 - protein, 9 aa, Influenza virus
EKIEKIRPL

SEQ ID NO: 322942 - protein, 9 aa, Influenza virus
GTASLSPGM

SEQ ID NO: 322943 - protein, 9 aa, Influenza virus
TASLSPGMM

SEQ ID NO: 322944 - protein, 9 aa, Influenza virus
ASLSPGMMM

SEQ ID NO: 322945 - protein, 9 aa, Influenza virus
SLSPGMMMG

SEQ ID NO: 322946 - protein, 9 aa, Influenza virus
LSPGMMMGM

SEQ ID NO: 322947 - protein, 9 aa, Influenza virus
SPGMMMGMF

SEQ ID NO: 322948 - protein, 9 aa, Influenza virus
PGMMMGMFN

SEQ ID NO: 322949 - protein, 9 aa, Influenza virus
GMMMGMFNM

SEQ ID NO: 322950 - protein, 9 aa, Influenza virus
MMMGMFNML

SEQ ID NO: 322951 - protein, 9 aa, Influenza virus
MMGMFNMLS

SEQ ID NO: 322952 - protein, 9 aa, Influenza virus
MGMFNMLST

SEQ ID NO: 322953 - protein, 9 aa, Influenza virus
GMFNMLSTV

SEQ ID NO: 322954 - protein, 9 aa, Influenza virus
MFNMLSTVL

SEQ ID NO: 322955 - protein, 9 aa, Influenza virus
FNMLSTVLG

SEQ ID NO: 322956 - protein, 9 aa, Influenza virus
NMLSTVLGV

SEQ ID NO: 322957 - protein, 9 aa, Influenza virus
MLSTVLGVS

SEQ ID NO: 322958 - protein, 9 aa, Influenza virus
LSTVLGVSI

SEQ ID NO: 322959 - protein, 9 aa, Influenza virus
STVLGVSIL

SEQ ID NO: 322960 - protein, 9 aa, Influenza virus
TVLGVSILN

SEQ ID NO: 322961 - protein, 9 aa, Influenza virus
VLGVSILNL

SEQ ID NO: 322962 - protein, 9 aa, Influenza virus
LGVSILNLG

SEQ ID NO: 322963 - protein, 9 aa, Influenza virus
GVSILNLGQ

SEQ ID NO: 322964 - protein, 9 aa, Influenza virus
VSILNLGQK

SEQ ID NO: 322965 - protein, 9 aa, Influenza virus
LNLGQKRYT

SEQ ID NO: 322966 - protein, 9 aa, Influenza virus
TTYWWDGLQ

SEQ ID NO: 322967 - protein, 9 aa, Influenza virus
TYWWDGLQS

SEQ ID NO: 322968 - protein, 9 aa, Influenza virus
YWWDGLQSS

SEQ ID NO: 322969 - protein, 9 aa, Influenza virus
WWDGLQSSD

SEQ ID NO: 322970 - protein, 9 aa, Influenza virus
WDGLQSSDD

SEQ ID NO: 322971 - protein, 9 aa, Influenza virus
DGLQSSDDF

SEQ ID NO: 322972 - protein, 9 aa, Influenza virus
GLQSSDDFA

SEQ ID NO: 322973 - protein, 9 aa, Influenza virus
LQSSDDFAL

SEQ ID NO: 322974 - protein, 9 aa, Influenza virus
QSSDDFALI

SEQ ID NO: 322975 - protein, 9 aa, Influenza virus
SSDDFALIV

SEQ ID NO: 322976 - protein, 9 aa, Influenza virus
SDDFALIVN

SEQ ID NO: 322977 - protein, 9 aa, Influenza virus
DDFALIVNA

SEQ ID NO: 322978 - protein, 9 aa, Influenza virus
DFALIVNAP

SEQ ID NO: 322979 - protein, 9 aa, Influenza virus
GIQAGVDRF

SEQ ID NO: 322980 - protein, 9 aa, Influenza virus
IQAGVDRFY

SEQ ID NO: 322981 - protein, 9 aa, Influenza virus
QAGVDRFYR

SEQ ID NO: 322982 - protein, 9 aa, Influenza virus
AGVDRFYRT

SEQ ID NO: 322983 - protein, 9 aa, Influenza virus
GVDRFYRTC

SEQ ID NO: 322984 - protein, 9 aa, Influenza virus
VDRFYRTCK

SEQ ID NO: 322985 - protein, 9 aa, Influenza virus
DRFYRTCKL

SEQ ID NO: 322986 - protein, 9 aa, Influenza virus
RFYRTCKLV

SEQ ID NO: 322987 - protein, 9 aa, Influenza virus
FYRTCKLVG

SEQ ID NO: 322988 - protein, 9 aa, Influenza virus
YRTCKLVGI

SEQ ID NO: 322989 - protein, 9 aa, Influenza virus
RTCKLVGIN

SEQ ID NO: 322990 - protein, 9 aa, Influenza virus
TCKLVGINM

SEQ ID NO: 322991 - protein, 9 aa, Influenza virus
CKLVGINMS

SEQ ID NO: 322992 - protein, 9 aa, Influenza virus
KLVGINMSK

SEQ ID NO: 322993 - protein, 9 aa, Influenza virus
LVGINMSKK

SEQ ID NO: 322994 - protein, 9 aa, Influenza virus
VGINMSKKK

SEQ ID NO: 322995 - protein, 9 aa, Influenza virus
GINMSKKKS

SEQ ID NO: 322996 - protein, 9 aa, Influenza virus
INMSKKKSY

SEQ ID NO: 322997 - protein, 9 aa, Influenza virus
NMSKKKSYI

SEQ ID NO: 322998 - protein, 9 aa, Influenza virus
MSKKKSYIN

SEQ ID NO: 322999 - protein, 9 aa, Influenza virus
SKKKSYINR

SEQ ID NO: 323000 - protein, 9 aa, Influenza virus
KKKSYINRT

SEQ ID NO: 323001 - protein, 9 aa, Influenza virus
KKSYINRTG

SEQ ID NO: 323002 - protein, 9 aa, Influenza virus
KSYINRTGT

SEQ ID NO: 323003 - protein, 9 aa, Influenza virus
SYINRTGTF

SEQ ID NO: 323004 - protein, 9 aa, Influenza virus
YINRTGTFE

SEQ ID NO: 323005 - protein, 9 aa, Influenza virus
INRTGTFEF

SEQ ID NO: 323006 - protein, 9 aa, Influenza virus
NRTGTFEFT

SEQ ID NO: 323007 - protein, 9 aa, Influenza virus
RTGTFEFTS

SEQ ID NO: 323008 - protein, 9 aa, Influenza virus
TGTFEFTSF

SEQ ID NO: 323009 - protein, 9 aa, Influenza virus
GTFEFTSFF

SEQ ID NO: 323010 - protein, 9 aa, Influenza virus
TFEFTSFFY

SEQ ID NO: 323011 - protein, 9 aa, Influenza virus
FEFTSFFYR

SEQ ID NO: 323012 - protein, 9 aa, Influenza virus
EFTSFFYRY

SEQ ID NO: 323013 - protein, 9 aa, Influenza virus
FTSFFYRYG

SEQ ID NO: 323014 - protein, 9 aa, Influenza virus
TSFFYRYGF

SEQ ID NO: 323015 - protein, 9 aa, Influenza virus
SFFYRYGFV

SEQ ID NO: 323016 - protein, 9 aa, Influenza virus
FFYRYGFVA

SEQ ID NO: 323017 - protein, 9 aa, Influenza virus
FYRYGFVAN

SEQ ID NO: 323018 - protein, 9 aa, Influenza virus
YRYGFVANF

SEQ ID NO: 323019 - protein, 9 aa, Influenza virus
RYGFVANFS

SEQ ID NO: 323020 - protein, 9 aa, Influenza virus
YGFVANFSM

SEQ ID NO: 323021 - protein, 9 aa, Influenza virus
GFVANFSME

SEQ ID NO: 323022 - protein, 9 aa, Influenza virus
FVANFSMEL

SEQ ID NO: 323023 - protein, 9 aa, Influenza virus
VANFSMELP

SEQ ID NO: 323024 - protein, 9 aa, Influenza virus
ANFSMELPS

SEQ ID NO: 323025 - protein, 9 aa, Influenza virus
NFSMELPSF

SEQ ID NO: 323026 - protein, 9 aa, Influenza virus
FSMELPSFG

SEQ ID NO: 323027 - protein, 9 aa, Influenza virus
SMELPSFGV

SEQ ID NO: 323028 - protein, 9 aa, Influenza virus
MELPSFGVS

SEQ ID NO: 323029 - protein, 9 aa, Influenza virus
ELPSFGVSG

SEQ ID NO: 323030 - protein, 9 aa, Influenza virus
LPSFGVSGI

SEQ ID NO: 323031 - protein, 9 aa, Influenza virus
PSFGVSGIN

SEQ ID NO: 323032 - protein, 9 aa, Influenza virus
SFGVSGINE

SEQ ID NO: 323033 - protein, 9 aa, Influenza virus
FGVSGINES

SEQ ID NO: 323034 - protein, 9 aa, Influenza virus
GVSGINESA

SEQ ID NO: 323035 - protein, 9 aa, Influenza virus
VSGINESAD

SEQ ID NO: 323036 - protein, 9 aa, Influenza virus
SGINESADM

SEQ ID NO: 323037 - protein, 9 aa, Influenza virus
GINESADMS

SEQ ID NO: 323038 - protein, 9 aa, Influenza virus
INESADMSI

SEQ ID NO: 323039 - protein, 9 aa, Influenza virus
NESADMSIG

SEQ ID NO: 323040 - protein, 9 aa, Influenza virus
ESADMSIGV

SEQ ID NO: 323041 - protein, 9 aa, Influenza virus
SADMSIGVT

SEQ ID NO: 323042 - protein, 9 aa, Influenza virus
ADMSIGVTV

SEQ ID NO: 323043 - protein, 9 aa, Influenza virus
DMSIGVTVI

SEQ ID NO: 323044 - protein, 9 aa, Influenza virus
MSIGVTVIK

SEQ ID NO: 323045 - protein, 9 aa, Influenza virus
SIGVTVIKN

SEQ ID NO: 323046 - protein, 9 aa, Influenza virus
IGVTVIKNN

SEQ ID NO: 323047 - protein, 9 aa, Influenza virus
GVTVIKNNM

SEQ ID NO: 323048 - protein, 9 aa, Influenza virus
VTVIKNNMI

SEQ ID NO: 323049 - protein, 9 aa, Influenza virus
TVIKNNMIN

SEQ ID NO: 323050 - protein, 9 aa, Influenza virus
VIKNNMINN

SEQ ID NO: 323051 - protein, 9 aa, Influenza virus
IKNNMINND

SEQ ID NO: 323052 - protein, 9 aa, Influenza virus
KNNMINNDL

SEQ ID NO: 323053 - protein, 9 aa, Influenza virus
NNMINNDLG

SEQ ID NO: 323054 - protein, 9 aa, Influenza virus
NMINNDLGP

SEQ ID NO: 323055 - protein, 9 aa, Influenza virus
MINNDLGPA

SEQ ID NO: 323056 - protein, 9 aa, Influenza virus
INNDLGPAT

SEQ ID NO: 323057 - protein, 9 aa, Influenza virus
NNDLGPATA

SEQ ID NO: 323058 - protein, 9 aa, Influenza virus
NDLGPATAQ

SEQ ID NO: 323059 - protein, 9 aa, Influenza virus
DLGPATAQM

SEQ ID NO: 323060 - protein, 9 aa, Influenza virus
LGPATAQMA

SEQ ID NO: 323061 - protein, 9 aa, Influenza virus
GPATAQMAL

SEQ ID NO: 323062 - protein, 9 aa, Influenza virus
PATAQMALQ

SEQ ID NO: 323063 - protein, 9 aa, Influenza virus
ATAQMALQL

SEQ ID NO: 323064 - protein, 9 aa, Influenza virus
TAQMALQLF

SEQ ID NO: 323065 - protein, 9 aa, Influenza virus
AQMALQLFI

SEQ ID NO: 323066 - protein, 9 aa, Influenza virus
QMALQLFIK

SEQ ID NO: 323067 - protein, 9 aa, Influenza virus
MALQLFIKD

SEQ ID NO: 323068 - protein, 9 aa, Influenza virus
ALQLFIKDY

SEQ ID NO: 323069 - protein, 9 aa, Influenza virus
LQLFIKDYR

SEQ ID NO: 323070 - protein, 9 aa, Influenza virus
QLFIKDYRY

SEQ ID NO: 323071 - protein, 9 aa, Influenza virus
LFIKDYRYT

SEQ ID NO: 323072 - protein, 9 aa, Influenza virus
FIKDYRYTY

SEQ ID NO: 323073 - protein, 9 aa, Influenza virus
IKDYRYTYR

SEQ ID NO: 323074 - protein, 9 aa, Influenza virus
KDYRYTYRC

SEQ ID NO: 323075 - protein, 9 aa, Influenza virus
DYRYTYRCH

SEQ ID NO: 323076 - protein, 9 aa, Influenza virus
YRYTYRCHR

SEQ ID NO: 323077 - protein, 9 aa, Influenza virus
RYTYRCHRG

SEQ ID NO: 323078 - protein, 9 aa, Influenza virus
YTYRCHRGD

SEQ ID NO: 323079 - protein, 9 aa, Influenza virus
TYRCHRGDT

SEQ ID NO: 323080 - protein, 9 aa, Influenza virus
YRCHRGDTQ

SEQ ID NO: 323081 - protein, 9 aa, Influenza virus
RCHRGDTQI

SEQ ID NO: 323082 - protein, 9 aa, Influenza virus
QIQTRRSFE

SEQ ID NO: 323083 - protein, 9 aa, Influenza virus
IQTRRSFEL

SEQ ID NO: 323084 - protein, 9 aa, Influenza virus
QTRRSFELK

SEQ ID NO: 323085 - protein, 9 aa, Influenza virus
GLLVSDGGP

SEQ ID NO: 323086 - protein, 9 aa, Influenza virus
LLVSDGGPN

SEQ ID NO: 323087 - protein, 9 aa, Influenza virus
LVSDGGPNL

SEQ ID NO: 323088 - protein, 9 aa, Influenza virus
VSDGGPNLY

SEQ ID NO: 323089 - protein, 9 aa, Influenza virus
SDGGPNLYN

SEQ ID NO: 323090 - protein, 9 aa, Influenza virus
DGGPNLYNI

SEQ ID NO: 323091 - protein, 9 aa, Influenza virus
GGPNLYNIR

SEQ ID NO: 323092 - protein, 9 aa, Influenza virus
GPNLYNIRN

SEQ ID NO: 323093 - protein, 9 aa, Influenza virus
PNLYNIRNL

SEQ ID NO: 323094 - protein, 9 aa, Influenza virus
NLYNIRNLH

SEQ ID NO: 323095 - protein, 9 aa, Influenza virus
LYNIRNLHI

SEQ ID NO: 323096 - protein, 9 aa, Influenza virus
YNIRNLHIP

SEQ ID NO: 323097 - protein, 9 aa, Influenza virus
NIRNLHIPE

SEQ ID NO: 323098 - protein, 9 aa, Influenza virus
IRNLHIPEV

SEQ ID NO: 323099 - protein, 9 aa, Influenza virus
RNLHIPEVC

SEQ ID NO: 323100 - protein, 9 aa, Influenza virus
NLHIPEVCL

SEQ ID NO: 323101 - protein, 9 aa, Influenza virus
LHIPEVCLK

SEQ ID NO: 323102 - protein, 9 aa, Influenza virus
HIPEVCLKW

SEQ ID NO: 323103 - protein, 9 aa, Influenza virus
IPEVCLKWE

SEQ ID NO: 323104 - protein, 9 aa, Influenza virus
PEVCLKWEL

SEQ ID NO: 323105 - protein, 9 aa, Influenza virus
EVCLKWELM

SEQ ID NO: 323106 - protein, 9 aa, Influenza virus
VCLKWELMD

SEQ ID NO: 323107 - protein, 9 aa, Influenza virus
YQGRLCNPL

SEQ ID NO: 323108 - protein, 9 aa, Influenza virus
QGRLCNPLN

SEQ ID NO: 323109 - protein, 9 aa, Influenza virus
GRLCNPLNP

SEQ ID NO: 323110 - protein, 9 aa, Influenza virus
RLCNPLNPF

SEQ ID NO: 323111 - protein, 9 aa, Influenza virus
LCNPLNPFV

SEQ ID NO: 323112 - protein, 9 aa, Influenza virus
CNPLNPFVS

SEQ ID NO: 323113 - protein, 9 aa, Influenza virus
NPLNPFVSH

SEQ ID NO: 323114 - protein, 9 aa, Influenza virus
HPRGLLEVG

SEQ ID NO: 323115 - protein, 9 aa, Influenza virus
PRGLLEVGT

SEQ ID NO: 323116 - protein, 9 aa, Influenza virus
RGLLEVGTR

SEQ ID NO: 323117 - protein, 9 aa, Influenza virus
GLLEVGTRW

SEQ ID NO: 323118 - protein, 9 aa, Influenza virus
LLEVGTRWM

SEQ ID NO: 323119 - protein, 9 aa, Influenza virus
LEVGTRWMK

SEQ ID NO: 323120 - protein, 9 aa, Influenza virus
EVGTRWMKI

SEQ ID NO: 323121 - protein, 9 aa, Influenza virus
VGTRWMKII

SEQ ID NO: 323122 - protein, 9 aa, Influenza virus
GTRWMKIIR

SEQ ID NO: 323123 - protein, 9 aa, Influenza virus
TRWMKIIRV

SEQ ID NO: 323124 - protein, 9 aa, Influenza virus
RWMKIIRVG

SEQ ID NO: 323125 - protein, 9 aa, Influenza virus
WMKIIRVGC

SEQ ID NO: 323126 - protein, 9 aa, Influenza virus
MKIIRVGCV

SEQ ID NO: 323127 - protein, 9 aa, Influenza virus
KIIRVGCVI

SEQ ID NO: 323128 - protein, 9 aa, Influenza virus
IIRVGCVIL

SEQ ID NO: 323129 - protein, 9 aa, Influenza virus
IRVGCVILL

SEQ ID NO: 323130 - protein, 9 aa, Influenza virus
RVGCVILLN

SEQ ID NO: 323131 - protein, 9 aa, Influenza virus
VGCVILLNP

SEQ ID NO: 323132 - protein, 9 aa, Influenza virus
GCVILLNPF

SEQ ID NO: 323133 - protein, 9 aa, Influenza virus
CVILLNPFV

SEQ ID NO: 323134 - protein, 9 aa, Influenza virus
VILLNPFVS

SEQ ID NO: 323135 - protein, 9 aa, Influenza virus
ILLNPFVSH

SEQ ID NO: 323136 - protein, 9 aa, Influenza virus
LLNPFVSHK

SEQ ID NO: 323137 - protein, 9 aa, Influenza virus
MEYDAVATT

SEQ ID NO: 323138 - protein, 9 aa, Influenza virus
EYDAVATTH

SEQ ID NO: 323139 - protein, 9 aa, Influenza virus
YDAVATTHS

SEQ ID NO: 323140 - protein, 9 aa, Influenza virus
DAVATTHSW

SEQ ID NO: 323141 - protein, 9 aa, Influenza virus
AVATTHSWI

SEQ ID NO: 323142 - protein, 9 aa, Influenza virus
VATTHSWIP

SEQ ID NO: 323143 - protein, 9 aa, Influenza virus
ATTHSWIPK

SEQ ID NO: 323144 - protein, 9 aa, Influenza virus
TTHSWIPKR

SEQ ID NO: 323145 - protein, 9 aa, Influenza virus
THSWIPKRN

SEQ ID NO: 323146 - protein, 9 aa, Influenza virus
HSWIPKRNR

SEQ ID NO: 323147 - protein, 9 aa, Influenza virus
SWIPKRNRS

SEQ ID NO: 323148 - protein, 9 aa, Influenza virus
WIPKRNRSI

SEQ ID NO: 323149 - protein, 9 aa, Influenza virus
IPKRNRSIL

SEQ ID NO: 323150 - protein, 9 aa, Influenza virus
PKRNRSILN

SEQ ID NO: 323151 - protein, 9 aa, Influenza virus
KRNRSILNT

SEQ ID NO: 323152 - protein, 9 aa, Influenza virus
RNRSILNTS

SEQ ID NO: 323153 - protein, 9 aa, Influenza virus
NRSILNTSQ

SEQ ID NO: 323154 - protein, 9 aa, Influenza virus
RSILNTSQR

SEQ ID NO: 323155 - protein, 9 aa, Influenza virus
SILNTSQRG

SEQ ID NO: 323156 - protein, 9 aa, Influenza virus
ICNSNAITR

SEQ ID NO: 323157 - protein, 9 aa, Influenza virus
CNSNAITRS

SEQ ID NO: 323158 - protein, 9 aa, Influenza virus
NSNAITRSG

SEQ ID NO: 323159 - protein, 9 aa, Influenza virus
SNAITRSGQ

SEQ ID NO: 323160 - protein, 9 aa, Influenza virus
NAITRSGQN

SEQ ID NO: 323161 - protein, 9 aa, Influenza virus
AITRSGQNH

SEQ ID NO: 323162 - protein, 9 aa, Influenza virus
ITRSGQNHG

SEQ ID NO: 323163 - protein, 9 aa, Influenza virus
TRSGQNHGI

SEQ ID NO: 323164 - protein, 9 aa, Influenza virus
RSGQNHGIC

SEQ ID NO: 323165 - protein, 9 aa, Influenza virus
SGQNHGICA

SEQ ID NO: 323166 - protein, 9 aa, Influenza virus
GQNHGICAV

SEQ ID NO: 323167 - protein, 9 aa, Influenza virus
QNHGICAVA

SEQ ID NO: 323168 - protein, 9 aa, Influenza virus
NHGICAVAT

SEQ ID NO: 323169 - protein, 9 aa, Influenza virus
HGICAVATT

SEQ ID NO: 323170 - protein, 9 aa, Influenza virus
GICAVATTH

SEQ ID NO: 323171 - protein, 9 aa, Influenza virus
ICAVATTHS

SEQ ID NO: 323172 - protein, 9 aa, Influenza virus
CAVATTHSW

SEQ ID NO: 323173 - protein, 9 aa, Influenza virus
AVATTHSWV

SEQ ID NO: 323174 - protein, 9 aa, Influenza virus
VATTHSWVP

SEQ ID NO: 323175 - protein, 9 aa, Influenza virus
ATTHSWVPI

SEQ ID NO: 323176 - protein, 9 aa, Influenza virus
TTHSWVPIL

SEQ ID NO: 323177 - protein, 9 aa, Influenza virus
THSWVPILN

SEQ ID NO: 323178 - protein, 9 aa, Influenza virus
HSWVPILNT

SEQ ID NO: 323179 - protein, 9 aa, Influenza virus
SWVPILNTS

SEQ ID NO: 323180 - protein, 9 aa, Influenza virus
WVPILNTSQ

SEQ ID NO: 323181 - protein, 9 aa, Influenza virus
VPILNTSQR

SEQ ID NO: 323182 - protein, 9 aa, Influenza virus
PILNTSQRG

SEQ ID NO: 323183 - protein, 9 aa, Influenza virus
ILNTSQRGI

SEQ ID NO: 323184 - protein, 9 aa, Influenza virus
LNTSQRGIL

SEQ ID NO: 323185 - protein, 9 aa, Influenza virus
NTSQRGILE

SEQ ID NO: 323186 - protein, 9 aa, Influenza virus
TSQRGILED

SEQ ID NO: 323187 - protein, 9 aa, Influenza virus
SQRGILEDE

SEQ ID NO: 323188 - protein, 9 aa, Influenza virus
QRGILEDEQ

SEQ ID NO: 323189 - protein, 9 aa, Influenza virus
RGILEDEQM

SEQ ID NO: 323190 - protein, 9 aa, Influenza virus
GILEDEQMY

SEQ ID NO: 323191 - protein, 9 aa, Influenza virus
ILEDEQMYQ

SEQ ID NO: 323192 - protein, 9 aa, Influenza virus
LEDEQMYQK

SEQ ID NO: 323193 - protein, 9 aa, Influenza virus
EDEQMYQKC

SEQ ID NO: 323194 - protein, 9 aa, Influenza virus
DEQMYQKCC

SEQ ID NO: 323195 - protein, 9 aa, Influenza virus
EQMYQKCCN

SEQ ID NO: 323196 - protein, 9 aa, Influenza virus
QMYQKCCNL

SEQ ID NO: 323197 - protein, 9 aa, Influenza virus
MYQKCCNLF

SEQ ID NO: 323198 - protein, 9 aa, Influenza virus
YQKCCNLFE

SEQ ID NO: 323199 - protein, 9 aa, Influenza virus
QKCCNLFEK

SEQ ID NO: 323200 - protein, 9 aa, Influenza virus
KCCNLFEKF

SEQ ID NO: 323201 - protein, 9 aa, Influenza virus
CCNLFEKFF

SEQ ID NO: 323202 - protein, 9 aa, Influenza virus
CNLFEKFFP

SEQ ID NO: 323203 - protein, 9 aa, Influenza virus
NLFEKFFPS

SEQ ID NO: 323204 - protein, 9 aa, Influenza virus
LFEKFFPSS

SEQ ID NO: 323205 - protein, 9 aa, Influenza virus
FEKFFPSSS

SEQ ID NO: 323206 - protein, 9 aa, Influenza virus
EKFFPSSSY

SEQ ID NO: 323207 - protein, 9 aa, Influenza virus
KFFPSSSYR

SEQ ID NO: 323208 - protein, 9 aa, Influenza virus
FFPSSSYRR

SEQ ID NO: 323209 - protein, 9 aa, Influenza virus
FPSSSYRRP

SEQ ID NO: 323210 - protein, 9 aa, Influenza virus
PSSSYRRPV

SEQ ID NO: 323211 - protein, 9 aa, Influenza virus
SSSYRRPVG

SEQ ID NO: 323212 - protein, 9 aa, Influenza virus
SSYRRPVGI

SEQ ID NO: 323213 - protein, 9 aa, Influenza virus
SYRRPVGIS

SEQ ID NO: 323214 - protein, 9 aa, Influenza virus
YRRPVGISS

SEQ ID NO: 323215 - protein, 9 aa, Influenza virus
RRPVGISSM

SEQ ID NO: 323216 - protein, 9 aa, Influenza virus
RPVGISSMV

SEQ ID NO: 323217 - protein, 9 aa, Influenza virus
PVGISSMVE

SEQ ID NO: 323218 - protein, 9 aa, Influenza virus
VGISSMVEA

SEQ ID NO: 323219 - protein, 9 aa, Influenza virus
GISSMVEAM

SEQ ID NO: 323220 - protein, 9 aa, Influenza virus
ISSMVEAMV

SEQ ID NO: 323221 - protein, 9 aa, Influenza virus
SSMVEAMVS

SEQ ID NO: 323222 - protein, 9 aa, Influenza virus
SMVEAMVSR

SEQ ID NO: 323223 - protein, 9 aa, Influenza virus
MVEAMVSRA

SEQ ID NO: 323224 - protein, 9 aa, Influenza virus
VEAMVSRAR

SEQ ID NO: 323225 - protein, 9 aa, Influenza virus
EAMVSRARI

SEQ ID NO: 323226 - protein, 9 aa, Influenza virus
AMVSRARID

SEQ ID NO: 323227 - protein, 9 aa, Influenza virus
MVSRARIDA

SEQ ID NO: 323228 - protein, 9 aa, Influenza virus
VSRARIDAR

SEQ ID NO: 323229 - protein, 9 aa, Influenza virus
SRARIDARI

SEQ ID NO: 323230 - protein, 9 aa, Influenza virus
RARIDARID

SEQ ID NO: 323231 - protein, 9 aa, Influenza virus
ARIDARIDF

SEQ ID NO: 323232 - protein, 9 aa, Influenza virus
RIDARIDFE

SEQ ID NO: 323233 - protein, 9 aa, Influenza virus
IDARIDFES

SEQ ID NO: 323234 - protein, 9 aa, Influenza virus
DARIDFESG

SEQ ID NO: 323235 - protein, 9 aa, Influenza virus
ARIDFESGR

SEQ ID NO: 323236 - protein, 9 aa, Influenza virus
RIDFESGRI

SEQ ID NO: 323237 - protein, 9 aa, Influenza virus
GKKEEFSEI

SEQ ID NO: 323238 - protein, 9 aa, Influenza virus
EELRRQKSL

SEQ ID NO: 323239 - protein, 9 aa, Influenza virus
ELRRQKSLI

SEQ ID NO: 323240 - protein, 9 aa, Influenza virus
LRRQKSLIW

SEQ ID NO: 323241 - protein, 9 aa, Influenza virus
RRQKWWVWL

SEQ ID NO: 323242 - protein, 9 aa, Influenza virus
RQKWWVWLW

SEQ ID NO: 323243 - protein, 9 aa, Influenza virus
QKSLIWLWL

SEQ ID NO: 323244 - protein, 9 aa, Influenza virus
KSLIWLWLV

SEQ ID NO: 323245 - protein, 9 aa, Influenza virus
WWVWLWLVL

SEQ ID NO: 323246 - protein, 9 aa, Influenza virus
WVWLWLVLR

SEQ ID NO: 323247 - protein, 9 aa, Influenza virus
VWLWLVLRE

SEQ ID NO: 323248 - protein, 9 aa, Influenza virus
WLWLVLREK

SEQ ID NO: 323249 - protein, 9 aa, Influenza virus
LWLVLREKM

SEQ ID NO: 323250 - protein, 9 aa, Influenza virus
WLVLREKMP

SEQ ID NO: 323251 - protein, 9 aa, Influenza virus
SKSRSNIFN

SEQ ID NO: 323252 - protein, 9 aa, Influenza virus
KSRSNIFNM

SEQ ID NO: 323253 - protein, 9 aa, Influenza virus
SRSNIFNME

SEQ ID NO: 323254 - protein, 9 aa, Influenza virus
RSNIFNMER

SEQ ID NO: 323255 - protein, 9 aa, Influenza virus
SNIFNMERI

SEQ ID NO: 323256 - protein, 9 aa, Influenza virus
NIFNMERIK

SEQ ID NO: 323257 - protein, 9 aa, Influenza virus
IFNMERIKE

SEQ ID NO: 323258 - protein, 9 aa, Influenza virus
FNMERIKEL

SEQ ID NO: 323259 - protein, 9 aa, Influenza virus
NMERIKELR

SEQ ID NO: 323260 - protein, 9 aa, Influenza virus
LMSQSRTRE

SEQ ID NO: 323261 - protein, 9 aa, Influenza virus
MSQSRTREI

SEQ ID NO: 323262 - protein, 9 aa, Influenza virus
SQSRTREIL

SEQ ID NO: 323263 - protein, 9 aa, Influenza virus
QSRTREILT

SEQ ID NO: 323264 - protein, 9 aa, Influenza virus
SRTREILTK

SEQ ID NO: 323265 - protein, 9 aa, Influenza virus
RTREILTKT

SEQ ID NO: 323266 - protein, 9 aa, Influenza virus
TREILTKTT

SEQ ID NO: 323267 - protein, 9 aa, Influenza virus
REILTKTTV

SEQ ID NO: 323268 - protein, 9 aa, Influenza virus
EILTKTTVD

SEQ ID NO: 323269 - protein, 9 aa, Influenza virus
ILTKTTVDH

SEQ ID NO: 323270 - protein, 9 aa, Influenza virus
LTKTTVDHM

SEQ ID NO: 323271 - protein, 9 aa, Influenza virus
TKTTVDHMA

SEQ ID NO: 323272 - protein, 9 aa, Influenza virus
KTTVDHMAI

SEQ ID NO: 323273 - protein, 9 aa, Influenza virus
TTVDHMAII

SEQ ID NO: 323274 - protein, 9 aa, Influenza virus
TVDHMAIIK

SEQ ID NO: 323275 - protein, 9 aa, Influenza virus
VDHMAIIKK

SEQ ID NO: 323276 - protein, 9 aa, Influenza virus
DHMAIIKKY

SEQ ID NO: 323277 - protein, 9 aa, Influenza virus
HMAIIKKYT

SEQ ID NO: 323278 - protein, 9 aa, Influenza virus
MAIIKKYTS

SEQ ID NO: 323279 - protein, 9 aa, Influenza virus
AIIKKYTSG

SEQ ID NO: 323280 - protein, 9 aa, Influenza virus
IIKKYTSGR

SEQ ID NO: 323281 - protein, 9 aa, Influenza virus
IKKYTSGRQ

SEQ ID NO: 323282 - protein, 9 aa, Influenza virus
GHNQEYTSG

SEQ ID NO: 323283 - protein, 9 aa, Influenza virus
HNQEYTSGR

SEQ ID NO: 323284 - protein, 9 aa, Influenza virus
NQEYTSGRQ

SEQ ID NO: 323285 - protein, 9 aa, Influenza virus
KKYTSGRQE

SEQ ID NO: 323286 - protein, 9 aa, Influenza virus
KYTSGRQEK

SEQ ID NO: 323287 - protein, 9 aa, Influenza virus
YTSGRQEKN

SEQ ID NO: 323288 - protein, 9 aa, Influenza virus
TSGRQEKNP

SEQ ID NO: 323289 - protein, 9 aa, Influenza virus
SGRQEKNPA

SEQ ID NO: 323290 - protein, 9 aa, Influenza virus
GRQEKNPAL

SEQ ID NO: 323291 - protein, 9 aa, Influenza virus
RQEKNPALR

SEQ ID NO: 323292 - protein, 9 aa, Influenza virus
QEKNPALRM

SEQ ID NO: 323293 - protein, 9 aa, Influenza virus
EKNPALRMK

SEQ ID NO: 323294 - protein, 9 aa, Influenza virus
KNPALRMKW

SEQ ID NO: 323295 - protein, 9 aa, Influenza virus
NPALRMKWM

SEQ ID NO: 323296 - protein, 9 aa, Influenza virus
PALRMKWMM

SEQ ID NO: 323297 - protein, 9 aa, Influenza virus
ALRMKWMMA

SEQ ID NO: 323298 - protein, 9 aa, Influenza virus
LRMKWMMAM

SEQ ID NO: 323299 - protein, 9 aa, Influenza virus
RMKWMMAMK

SEQ ID NO: 323300 - protein, 9 aa, Influenza virus
MKWMMAMKY

SEQ ID NO: 323301 - protein, 9 aa, Influenza virus
KWMMAMKYP

SEQ ID NO: 323302 - protein, 9 aa, Influenza virus
WMMAMKYPI

SEQ ID NO: 323303 - protein, 9 aa, Influenza virus
MMAMKYPIT

SEQ ID NO: 323304 - protein, 9 aa, Influenza virus
MAMKYPITA

SEQ ID NO: 323305 - protein, 9 aa, Influenza virus
AMKYPITAD

SEQ ID NO: 323306 - protein, 9 aa, Influenza virus
IPERNEQGQ

SEQ ID NO: 323307 - protein, 9 aa, Influenza virus
RNEQGQTLW

SEQ ID NO: 323308 - protein, 9 aa, Influenza virus
MVSPLAVTW

SEQ ID NO: 323309 - protein, 9 aa, Influenza virus
VSPLAVTWW

SEQ ID NO: 323310 - protein, 9 aa, Influenza virus
SPLAVTWWN

SEQ ID NO: 323311 - protein, 9 aa, Influenza virus
PLAVTWWNR

SEQ ID NO: 323312 - protein, 9 aa, Influenza virus
LAVTWWNRN

SEQ ID NO: 323313 - protein, 9 aa, Influenza virus
AVTWWNRNG

SEQ ID NO: 323314 - protein, 9 aa, Influenza virus
VTWWNRNGP

SEQ ID NO: 323315 - protein, 9 aa, Influenza virus
HYPKVYKTY

SEQ ID NO: 323316 - protein, 9 aa, Influenza virus
YPKVYKTYF

SEQ ID NO: 323317 - protein, 9 aa, Influenza virus
GTFGPVHFR

SEQ ID NO: 323318 - protein, 9 aa, Influenza virus
TFGPVHFRN

SEQ ID NO: 323319 - protein, 9 aa, Influenza virus
FGPVHFRNQ

SEQ ID NO: 323320 - protein, 9 aa, Influenza virus
GPVHFRNQV

SEQ ID NO: 323321 - protein, 9 aa, Influenza virus
PVHFRNQVK

SEQ ID NO: 323322 - protein, 9 aa, Influenza virus
VHFRNQVKI

SEQ ID NO: 323323 - protein, 9 aa, Influenza virus
HFRNQVKIR

SEQ ID NO: 323324 - protein, 9 aa, Influenza virus
FRNQVKIRR

SEQ ID NO: 323325 - protein, 9 aa, Influenza virus
RNQVKIRRR

SEQ ID NO: 323326 - protein, 9 aa, Influenza virus
NQVKIRRRV

SEQ ID NO: 323327 - protein, 9 aa, Influenza virus
QVKIRRRVD

SEQ ID NO: 323328 - protein, 9 aa, Influenza virus
VKIRRRVDI

SEQ ID NO: 323329 - protein, 9 aa, Influenza virus
KIRRRVDIN

SEQ ID NO: 323330 - protein, 9 aa, Influenza virus
IRRRVDINP

SEQ ID NO: 323331 - protein, 9 aa, Influenza virus
RRRVDINPG

SEQ ID NO: 323332 - protein, 9 aa, Influenza virus
RRVDINPGH

SEQ ID NO: 323333 - protein, 9 aa, Influenza virus
RVDINPGHA

SEQ ID NO: 323334 - protein, 9 aa, Influenza virus
VDINPGHAD

SEQ ID NO: 323335 - protein, 9 aa, Influenza virus
AKEAQDVIM

SEQ ID NO: 323336 - protein, 9 aa, Influenza virus
KEAQDVIME

SEQ ID NO: 323337 - protein, 9 aa, Influenza virus
EAQDVIMEV

SEQ ID NO: 323338 - protein, 9 aa, Influenza virus
AQDVIMEVV

SEQ ID NO: 323339 - protein, 9 aa, Influenza virus
QDVIMEVVF

SEQ ID NO: 323340 - protein, 9 aa, Influenza virus
DVIMEVVFP

SEQ ID NO: 323341 - protein, 9 aa, Influenza virus
VIMEVVFPN

SEQ ID NO: 323342 - protein, 9 aa, Influenza virus
IMEVVFPNE

SEQ ID NO: 323343 - protein, 9 aa, Influenza virus
MEVVFPNEV

SEQ ID NO: 323344 - protein, 9 aa, Influenza virus
EVVFPNEVG

SEQ ID NO: 323345 - protein, 9 aa, Influenza virus
VVFPNEVGA

SEQ ID NO: 323346 - protein, 9 aa, Influenza virus
VFPNEVGAR

SEQ ID NO: 323347 - protein, 9 aa, Influenza virus
FPNEVGARI

SEQ ID NO: 323348 - protein, 9 aa, Influenza virus
PNEVGARIL

SEQ ID NO: 323349 - protein, 9 aa, Influenza virus
NEVGARILT

SEQ ID NO: 323350 - protein, 9 aa, Influenza virus
EVGARILTS

SEQ ID NO: 323351 - protein, 9 aa, Influenza virus
VGARILTSE

SEQ ID NO: 323352 - protein, 9 aa, Influenza virus
GARILTSES

SEQ ID NO: 323353 - protein, 9 aa, Influenza virus
ARILTSESQ

SEQ ID NO: 323354 - protein, 9 aa, Influenza virus
RILTSESQL

SEQ ID NO: 323355 - protein, 9 aa, Influenza virus
IAPLMVAYM

SEQ ID NO: 323356 - protein, 9 aa, Influenza virus
APLMVAYML

SEQ ID NO: 323357 - protein, 9 aa, Influenza virus
PLMVAYMLE

SEQ ID NO: 323358 - protein, 9 aa, Influenza virus
LMVAYMLER

SEQ ID NO: 323359 - protein, 9 aa, Influenza virus
MVAYMLERE

SEQ ID NO: 323360 - protein, 9 aa, Influenza virus
VAYMLEREL

SEQ ID NO: 323361 - protein, 9 aa, Influenza virus
AYMLERELV

SEQ ID NO: 323362 - protein, 9 aa, Influenza virus
YMLERELVR

SEQ ID NO: 323363 - protein, 9 aa, Influenza virus
MLERELVRK

SEQ ID NO: 323364 - protein, 9 aa, Influenza virus
LERELVRKT

SEQ ID NO: 323365 - protein, 9 aa, Influenza virus
ERELVRKTR

SEQ ID NO: 323366 - protein, 9 aa, Influenza virus
RELVRKTRF

SEQ ID NO: 323367 - protein, 9 aa, Influenza virus
ELVRKTRFL

SEQ ID NO: 323368 - protein, 9 aa, Influenza virus
LVRKTRFLP

SEQ ID NO: 323369 - protein, 9 aa, Influenza virus
VRKTRFLPV

SEQ ID NO: 323370 - protein, 9 aa, Influenza virus
RKTRFLPVA

SEQ ID NO: 323371 - protein, 9 aa, Influenza virus
KTRFLPVAG

SEQ ID NO: 323372 - protein, 9 aa, Influenza virus
TRFLPVAGG

SEQ ID NO: 323373 - protein, 9 aa, Influenza virus
RFLPVAGGT

SEQ ID NO: 323374 - protein, 9 aa, Influenza virus
FLPVAGGTS

SEQ ID NO: 323375 - protein, 9 aa, Influenza virus
LPVAGGTSS

SEQ ID NO: 323376 - protein, 9 aa, Influenza virus
GGTSSVYIE

SEQ ID NO: 323377 - protein, 9 aa, Influenza virus
GTSSVYIEV

SEQ ID NO: 323378 - protein, 9 aa, Influenza virus
TSSVYIEVL

SEQ ID NO: 323379 - protein, 9 aa, Influenza virus
SSVYIEVLH

SEQ ID NO: 323380 - protein, 9 aa, Influenza virus
SVYIEVLHL

SEQ ID NO: 323381 - protein, 9 aa, Influenza virus
VYIEVLHLT

SEQ ID NO: 323382 - protein, 9 aa, Influenza virus
YIEVLHLTQ

SEQ ID NO: 323383 - protein, 9 aa, Influenza virus
IEVLHLTQG

SEQ ID NO: 323384 - protein, 9 aa, Influenza virus
EVLHLTQGT

SEQ ID NO: 323385 - protein, 9 aa, Influenza virus
VLHLTQGTC

SEQ ID NO: 323386 - protein, 9 aa, Influenza virus
LHLTQGTCW

SEQ ID NO: 323387 - protein, 9 aa, Influenza virus
HLTQGTCWE

SEQ ID NO: 323388 - protein, 9 aa, Influenza virus
LTQGTCWEQ

SEQ ID NO: 323389 - protein, 9 aa, Influenza virus
TQGTCWEQM

SEQ ID NO: 323390 - protein, 9 aa, Influenza virus
QGTCWEQMY

SEQ ID NO: 323391 - protein, 9 aa, Influenza virus
GTCWEQMYT

SEQ ID NO: 323392 - protein, 9 aa, Influenza virus
TCWEQMYTP

SEQ ID NO: 323393 - protein, 9 aa, Influenza virus
CWEQMYTPG

SEQ ID NO: 323394 - protein, 9 aa, Influenza virus
WEQMYTPGG

SEQ ID NO: 323395 - protein, 9 aa, Influenza virus
EQMYTPGGE

SEQ ID NO: 323396 - protein, 9 aa, Influenza virus
QMYTPGGEV

SEQ ID NO: 323397 - protein, 9 aa, Influenza virus
YTPGGEVRN

SEQ ID NO: 323398 - protein, 9 aa, Influenza virus
TPGGEVRND

SEQ ID NO: 323399 - protein, 9 aa, Influenza virus
VRNDDVDQS

SEQ ID NO: 323400 - protein, 9 aa, Influenza virus
RNDDVDQSL

SEQ ID NO: 323401 - protein, 9 aa, Influenza virus
NDDVDQSLI

SEQ ID NO: 323402 - protein, 9 aa, Influenza virus
DDVDQSLII

SEQ ID NO: 323403 - protein, 9 aa, Influenza virus
DVDQSLIIA

SEQ ID NO: 323404 - protein, 9 aa, Influenza virus
VDQSLIIAA

SEQ ID NO: 323405 - protein, 9 aa, Influenza virus
DQSLIIAAR

SEQ ID NO: 323406 - protein, 9 aa, Influenza virus
QSLIIAARN

SEQ ID NO: 323407 - protein, 9 aa, Influenza virus
SLIIAARNI

SEQ ID NO: 323408 - protein, 9 aa, Influenza virus
LIIAARNIV

SEQ ID NO: 323409 - protein, 9 aa, Influenza virus
IIAARNIVR

SEQ ID NO: 323410 - protein, 9 aa, Influenza virus
IAARNIVRR

SEQ ID NO: 323411 - protein, 9 aa, Influenza virus
AARNIVRRA

SEQ ID NO: 323412 - protein, 9 aa, Influenza virus
ARNIVRRAA

SEQ ID NO: 323413 - protein, 9 aa, Influenza virus
RNIVRRAAV

SEQ ID NO: 323414 - protein, 9 aa, Influenza virus
NIVRRAAVS

SEQ ID NO: 323415 - protein, 9 aa, Influenza virus
IVRRAAVSA

SEQ ID NO: 323416 - protein, 9 aa, Influenza virus
VRRAAVSAD

SEQ ID NO: 323417 - protein, 9 aa, Influenza virus
RRAAVSADP

SEQ ID NO: 323418 - protein, 9 aa, Influenza virus
RAAVSADPL

SEQ ID NO: 323419 - protein, 9 aa, Influenza virus
AAVSADPLA

SEQ ID NO: 323420 - protein, 9 aa, Influenza virus
AVSADPLAS

SEQ ID NO: 323421 - protein, 9 aa, Influenza virus
VSADPLASL

SEQ ID NO: 323422 - protein, 9 aa, Influenza virus
SADPLASLL

SEQ ID NO: 323423 - protein, 9 aa, Influenza virus
ADPLASLLE

SEQ ID NO: 323424 - protein, 9 aa, Influenza virus
DPLASLLEM

SEQ ID NO: 323425 - protein, 9 aa, Influenza virus
PLASLLEMC

SEQ ID NO: 323426 - protein, 9 aa, Influenza virus
LASLLEMCH

SEQ ID NO: 323427 - protein, 9 aa, Influenza virus
ASLLEMCHS

SEQ ID NO: 323428 - protein, 9 aa, Influenza virus
SLLEMCHST

SEQ ID NO: 323429 - protein, 9 aa, Influenza virus
LLEMCHSTQ

SEQ ID NO: 323430 - protein, 9 aa, Influenza virus
LEMCHSTQI

SEQ ID NO: 323431 - protein, 9 aa, Influenza virus
EMCHSTQIG

SEQ ID NO: 323432 - protein, 9 aa, Influenza virus
MCHSTQIGG

SEQ ID NO: 323433 - protein, 9 aa, Influenza virus
DILRQNPTE

SEQ ID NO: 323434 - protein, 9 aa, Influenza virus
ILRQNPTEE

SEQ ID NO: 323435 - protein, 9 aa, Influenza virus
LRQNPTEEQ

SEQ ID NO: 323436 - protein, 9 aa, Influenza virus
RQNPTEEQA

SEQ ID NO: 323437 - protein, 9 aa, Influenza virus
QNPTEEQAV

SEQ ID NO: 323438 - protein, 9 aa, Influenza virus
NPTEEQAVD

SEQ ID NO: 323439 - protein, 9 aa, Influenza virus
PTEEQAVDI

SEQ ID NO: 323440 - protein, 9 aa, Influenza virus
TEEQAVDIC

SEQ ID NO: 323441 - protein, 9 aa, Influenza virus
EEQAVDICK

SEQ ID NO: 323442 - protein, 9 aa, Influenza virus
EQAVDICKA

SEQ ID NO: 323443 - protein, 9 aa, Influenza virus
QAVDICKAA

SEQ ID NO: 323444 - protein, 9 aa, Influenza virus
AVDICKAAM

SEQ ID NO: 323445 - protein, 9 aa, Influenza virus
VDICKAAMG

SEQ ID NO: 323446 - protein, 9 aa, Influenza virus
ICKAAMGLR

SEQ ID NO: 323447 - protein, 9 aa, Influenza virus
CKAAMGLRI

SEQ ID NO: 323448 - protein, 9 aa, Influenza virus
KAAMGLRIS

SEQ ID NO: 323449 - protein, 9 aa, Influenza virus
AAMGLRISS

SEQ ID NO: 323450 - protein, 9 aa, Influenza virus
AMGLRISSS

SEQ ID NO: 323451 - protein, 9 aa, Influenza virus
MGLRISSSF

SEQ ID NO: 323452 - protein, 9 aa, Influenza virus
GLRISSSFS

SEQ ID NO: 323453 - protein, 9 aa, Influenza virus
LRISSSFSF

SEQ ID NO: 323454 - protein, 9 aa, Influenza virus
RISSSFSFG

SEQ ID NO: 323455 - protein, 9 aa, Influenza virus
ISSSFSFGG

SEQ ID NO: 323456 - protein, 9 aa, Influenza virus
SSSFSFGGF

SEQ ID NO: 323457 - protein, 9 aa, Influenza virus
SSFSFGGFT

SEQ ID NO: 323458 - protein, 9 aa, Influenza virus
SFSFGGFTF

SEQ ID NO: 323459 - protein, 9 aa, Influenza virus
FSFGGFTFK

SEQ ID NO: 323460 - protein, 9 aa, Influenza virus
SFGGFTFKR

SEQ ID NO: 323461 - protein, 9 aa, Influenza virus
FGGFTFKRT

SEQ ID NO: 323462 - protein, 9 aa, Influenza virus
GGFTFKRTS

SEQ ID NO: 323463 - protein, 9 aa, Influenza virus
GFTFKRTSG

SEQ ID NO: 323464 - protein, 9 aa, Influenza virus
FTFKRTSGS

SEQ ID NO: 323465 - protein, 9 aa, Influenza virus
TFKRTSGSS

SEQ ID NO: 323466 - protein, 9 aa, Influenza virus
EEEVLTGNL

SEQ ID NO: 323467 - protein, 9 aa, Influenza virus
EEVLTGNLQ

SEQ ID NO: 323468 - protein, 9 aa, Influenza virus
EVLTGNLQT

SEQ ID NO: 323469 - protein, 9 aa, Influenza virus
VLTGNLQTL

SEQ ID NO: 323470 - protein, 9 aa, Influenza virus
LTGNLQTLK

SEQ ID NO: 323471 - protein, 9 aa, Influenza virus
TGNLQTLKI

SEQ ID NO: 323472 - protein, 9 aa, Influenza virus
EGYEEFTMV

SEQ ID NO: 323473 - protein, 9 aa, Influenza virus
GYEEFTMVG

SEQ ID NO: 323474 - protein, 9 aa, Influenza virus
RATAILRKA

SEQ ID NO: 323475 - protein, 9 aa, Influenza virus
ATAILRKAT

SEQ ID NO: 323476 - protein, 9 aa, Influenza virus
TAILRKATR

SEQ ID NO: 323477 - protein, 9 aa, Influenza virus
RKATRRLIQ

SEQ ID NO: 323478 - protein, 9 aa, Influenza virus
KATRRLIQL

SEQ ID NO: 323479 - protein, 9 aa, Influenza virus
TRRLIQLIV

SEQ ID NO: 323480 - protein, 9 aa, Influenza virus
RLIQLIVSG

SEQ ID NO: 323481 - protein, 9 aa, Influenza virus
LIQLIVSGR

SEQ ID NO: 323482 - protein, 9 aa, Influenza virus
IVAMVFSQE

SEQ ID NO: 323483 - protein, 9 aa, Influenza virus
VAMVFSQED

SEQ ID NO: 323484 - protein, 9 aa, Influenza virus
AMVFSQEDC

SEQ ID NO: 323485 - protein, 9 aa, Influenza virus
MVFSQEDCM

SEQ ID NO: 323486 - protein, 9 aa, Influenza virus
VFSQEDCMI

SEQ ID NO: 323487 - protein, 9 aa, Influenza virus
FSQEDCMIK

SEQ ID NO: 323488 - protein, 9 aa, Influenza virus
SQEDCMIKA

SEQ ID NO: 323489 - protein, 9 aa, Influenza virus
QEDCMIKAV

SEQ ID NO: 323490 - protein, 9 aa, Influenza virus
EDCMIKAVR

SEQ ID NO: 323491 - protein, 9 aa, Influenza virus
DCMIKAVRG

SEQ ID NO: 323492 - protein, 9 aa, Influenza virus
CMIKAVRGD

SEQ ID NO: 323493 - protein, 9 aa, Influenza virus
MIKAVRGDL

SEQ ID NO: 323494 - protein, 9 aa, Influenza virus
IKAVRGDLN

SEQ ID NO: 323495 - protein, 9 aa, Influenza virus
KAVRGDLNF

SEQ ID NO: 323496 - protein, 9 aa, Influenza virus
AVRGDLNFV

SEQ ID NO: 323497 - protein, 9 aa, Influenza virus
VRGDLNFVN

SEQ ID NO: 323498 - protein, 9 aa, Influenza virus
RGDLNFVNR

SEQ ID NO: 323499 - protein, 9 aa, Influenza virus
GDLNFVNRA

SEQ ID NO: 323500 - protein, 9 aa, Influenza virus
DLNFVNRAN

SEQ ID NO: 323501 - protein, 9 aa, Influenza virus
LNFVNRANQ

SEQ ID NO: 323502 - protein, 9 aa, Influenza virus
NFVNRANQR

SEQ ID NO: 323503 - protein, 9 aa, Influenza virus
FVNRANQRL

SEQ ID NO: 323504 - protein, 9 aa, Influenza virus
VNRANQRLN

SEQ ID NO: 323505 - protein, 9 aa, Influenza virus
NRANQRLNP

SEQ ID NO: 323506 - protein, 9 aa, Influenza virus
RANQRLNPM

SEQ ID NO: 323507 - protein, 9 aa, Influenza virus
ANQRLNPMH

SEQ ID NO: 323508 - protein, 9 aa, Influenza virus
NQRLNPMHQ

SEQ ID NO: 323509 - protein, 9 aa, Influenza virus
QRLNPMHQL

SEQ ID NO: 323510 - protein, 9 aa, Influenza virus
RLNPMHQLL

SEQ ID NO: 323511 - protein, 9 aa, Influenza virus
LNPMHQLLR

SEQ ID NO: 323512 - protein, 9 aa, Influenza virus
NPMHQLLRH

SEQ ID NO: 323513 - protein, 9 aa, Influenza virus
PMHQLLRHF

SEQ ID NO: 323514 - protein, 9 aa, Influenza virus
MHQLLRHFQ

SEQ ID NO: 323515 - protein, 9 aa, Influenza virus
HQLLRHFQK

SEQ ID NO: 323516 - protein, 9 aa, Influenza virus
QLLRHFQKD

SEQ ID NO: 323517 - protein, 9 aa, Influenza virus
LLRHFQKDA

SEQ ID NO: 323518 - protein, 9 aa, Influenza virus
LRHFQKDAK

SEQ ID NO: 323519 - protein, 9 aa, Influenza virus
RHFQKDAKV

SEQ ID NO: 323520 - protein, 9 aa, Influenza virus
HFQKDAKVL

SEQ ID NO: 323521 - protein, 9 aa, Influenza virus
RVSKMGVDE

SEQ ID NO: 323522 - protein, 9 aa, Influenza virus
VSKMGVDEY

SEQ ID NO: 323523 - protein, 9 aa, Influenza virus
SKMGVDEYS

SEQ ID NO: 323524 - protein, 9 aa, Influenza virus
KMGVDEYSS

SEQ ID NO: 323525 - protein, 9 aa, Influenza virus
MGVDEYSST

SEQ ID NO: 323526 - protein, 9 aa, Influenza virus
GVDEYSSTE

SEQ ID NO: 323527 - protein, 9 aa, Influenza virus
VDEYSSTER

SEQ ID NO: 323528 - protein, 9 aa, Influenza virus
VVSIDRFLR

SEQ ID NO: 323529 - protein, 9 aa, Influenza virus
VSIDRFLRV

SEQ ID NO: 323530 - protein, 9 aa, Influenza virus
SIDRFLRVR

SEQ ID NO: 323531 - protein, 9 aa, Influenza virus
IDRFLRVRD

SEQ ID NO: 323532 - protein, 9 aa, Influenza virus
DRFLRVRDQ

SEQ ID NO: 323533 - protein, 9 aa, Influenza virus
RFLRVRDQR

SEQ ID NO: 323534 - protein, 9 aa, Influenza virus
FLRVRDQRG

SEQ ID NO: 323535 - protein, 9 aa, Influenza virus
LRVRDQRGN

SEQ ID NO: 323536 - protein, 9 aa, Influenza virus
RGNVLLSPE

SEQ ID NO: 323537 - protein, 9 aa, Influenza virus
GNVLLSPEE

SEQ ID NO: 323538 - protein, 9 aa, Influenza virus
NVLLSPEEV

SEQ ID NO: 323539 - protein, 9 aa, Influenza virus
VLLSPEEVS

SEQ ID NO: 323540 - protein, 9 aa, Influenza virus
LLSPEEVSE

SEQ ID NO: 323541 - protein, 9 aa, Influenza virus
LSPEEVSET

SEQ ID NO: 323542 - protein, 9 aa, Influenza virus
SPEEVSETQ

SEQ ID NO: 323543 - protein, 9 aa, Influenza virus
PEEVSETQG

SEQ ID NO: 323544 - protein, 9 aa, Influenza virus
EEVSETQGT

SEQ ID NO: 323545 - protein, 9 aa, Influenza virus
EVSETQGTE

SEQ ID NO: 323546 - protein, 9 aa, Influenza virus
EKLTITYSS

SEQ ID NO: 323547 - protein, 9 aa, Influenza virus
KLTITYSSS

SEQ ID NO: 323548 - protein, 9 aa, Influenza virus
LTITYSSSM

SEQ ID NO: 323549 - protein, 9 aa, Influenza virus
TITYSSSMM

SEQ ID NO: 323550 - protein, 9 aa, Influenza virus
ITYSSSMMW

SEQ ID NO: 323551 - protein, 9 aa, Influenza virus
TYSSSMMWE

SEQ ID NO: 323552 - protein, 9 aa, Influenza virus
YSSSMMWEI

SEQ ID NO: 323553 - protein, 9 aa, Influenza virus
SSSMMWEIN

SEQ ID NO: 323554 - protein, 9 aa, Influenza virus
SSMMWEING

SEQ ID NO: 323555 - protein, 9 aa, Influenza virus
SMMWEINGP

SEQ ID NO: 323556 - protein, 9 aa, Influenza virus
MMWEINGPE

SEQ ID NO: 323557 - protein, 9 aa, Influenza virus
MWEINGPES

SEQ ID NO: 323558 - protein, 9 aa, Influenza virus
WEINGPESV

SEQ ID NO: 323559 - protein, 9 aa, Influenza virus
EINGPESVL

SEQ ID NO: 323560 - protein, 9 aa, Influenza virus
INGPESVLV

SEQ ID NO: 323561 - protein, 9 aa, Influenza virus
NGPESVLVN

SEQ ID NO: 323562 - protein, 9 aa, Influenza virus
GPESVLVNT

SEQ ID NO: 323563 - protein, 9 aa, Influenza virus
PESVLVNTY

SEQ ID NO: 323564 - protein, 9 aa, Influenza virus
ESVLVNTYQ

SEQ ID NO: 323565 - protein, 9 aa, Influenza virus
SVLVNTYQW

SEQ ID NO: 323566 - protein, 9 aa, Influenza virus
VLVNTYQWI

SEQ ID NO: 323567 - protein, 9 aa, Influenza virus
LVNTYQWII

SEQ ID NO: 323568 - protein, 9 aa, Influenza virus
VNTYQWIIR

SEQ ID NO: 323569 - protein, 9 aa, Influenza virus
NTYQWIIRN

SEQ ID NO: 323570 - protein, 9 aa, Influenza virus
TYQWIIRNW

SEQ ID NO: 323571 - protein, 9 aa, Influenza virus
YQWIIRNWE

SEQ ID NO: 323572 - protein, 9 aa, Influenza virus
KIQWSQDPT

SEQ ID NO: 323573 - protein, 9 aa, Influenza virus
LYNKMEFEP

SEQ ID NO: 323574 - protein, 9 aa, Influenza virus
YNKMEFEPF

SEQ ID NO: 323575 - protein, 9 aa, Influenza virus
NKMEFEPFQ

SEQ ID NO: 323576 - protein, 9 aa, Influenza virus
KMEFEPFQS

SEQ ID NO: 323577 - protein, 9 aa, Influenza virus
MEFEPFQSL

SEQ ID NO: 323578 - protein, 9 aa, Influenza virus
EFEPFQSLV

SEQ ID NO: 323579 - protein, 9 aa, Influenza virus
FEPFQSLVP

SEQ ID NO: 323580 - protein, 9 aa, Influenza virus
EPFQSLVPK

SEQ ID NO: 323581 - protein, 9 aa, Influenza virus
PFQSLVPKA

SEQ ID NO: 323582 - protein, 9 aa, Influenza virus
RGQYSGFVR

SEQ ID NO: 323583 - protein, 9 aa, Influenza virus
QYSGFVRTL

SEQ ID NO: 323584 - protein, 9 aa, Influenza virus
YSGFVRTLF

SEQ ID NO: 323585 - protein, 9 aa, Influenza virus
SGFVRTLFQ

SEQ ID NO: 323586 - protein, 9 aa, Influenza virus
GFVRTLFQQ

SEQ ID NO: 323587 - protein, 9 aa, Influenza virus
FVRTLFQQM

SEQ ID NO: 323588 - protein, 9 aa, Influenza virus
VRTLFQQMR

SEQ ID NO: 323589 - protein, 9 aa, Influenza virus
RTLFQQMRD

SEQ ID NO: 323590 - protein, 9 aa, Influenza virus
TLFQQMRDV

SEQ ID NO: 323591 - protein, 9 aa, Influenza virus
LFQQMRDVL

SEQ ID NO: 323592 - protein, 9 aa, Influenza virus
FQQMRDVLG

SEQ ID NO: 323593 - protein, 9 aa, Influenza virus
QQMRDVLGT

SEQ ID NO: 323594 - protein, 9 aa, Influenza virus
QMRDVLGTF

SEQ ID NO: 323595 - protein, 9 aa, Influenza virus
MRDVLGTFD

SEQ ID NO: 323596 - protein, 9 aa, Influenza virus
RDVLGTFDT

SEQ ID NO: 323597 - protein, 9 aa, Influenza virus
GTFDTVQII

SEQ ID NO: 323598 - protein, 9 aa, Influenza virus
TFDTVQIIK

SEQ ID NO: 323599 - protein, 9 aa, Influenza virus
TVQIIKLLP

SEQ ID NO: 323600 - protein, 9 aa, Influenza virus
VQIIKLLPF

SEQ ID NO: 323601 - protein, 9 aa, Influenza virus
QIIKLLPFA

SEQ ID NO: 323602 - protein, 9 aa, Influenza virus
IIKLLPFAA

SEQ ID NO: 323603 - protein, 9 aa, Influenza virus
IKLLPFAAA

SEQ ID NO: 323604 - protein, 9 aa, Influenza virus
KLLPFAAAP

SEQ ID NO: 323605 - protein, 9 aa, Influenza virus
LLPFAAAPP

SEQ ID NO: 323606 - protein, 9 aa, Influenza virus
LPFAAAPPE

SEQ ID NO: 323607 - protein, 9 aa, Influenza virus
PFAAAPPEQ

SEQ ID NO: 323608 - protein, 9 aa, Influenza virus
FAAAPPEQS

SEQ ID NO: 323609 - protein, 9 aa, Influenza virus
AAPPEQSRM

SEQ ID NO: 323610 - protein, 9 aa, Influenza virus
APPEQSRMQ

SEQ ID NO: 323611 - protein, 9 aa, Influenza virus
PPEQSRMQF

SEQ ID NO: 323612 - protein, 9 aa, Influenza virus
PEQSRMQFS

SEQ ID NO: 323613 - protein, 9 aa, Influenza virus
EQSRMQFSS

SEQ ID NO: 323614 - protein, 9 aa, Influenza virus
QSRMQFSSL

SEQ ID NO: 323615 - protein, 9 aa, Influenza virus
SRMQFSSLT

SEQ ID NO: 323616 - protein, 9 aa, Influenza virus
RMQFSSLTV

SEQ ID NO: 323617 - protein, 9 aa, Influenza virus
MQFSSLTVN

SEQ ID NO: 323618 - protein, 9 aa, Influenza virus
QFSSLTVNV

SEQ ID NO: 323619 - protein, 9 aa, Influenza virus
FSSLTVNVR

SEQ ID NO: 323620 - protein, 9 aa, Influenza virus
SSLTVNVRG

SEQ ID NO: 323621 - protein, 9 aa, Influenza virus
SLTVNVRGS

SEQ ID NO: 323622 - protein, 9 aa, Influenza virus
LTVNVRGSG

SEQ ID NO: 323623 - protein, 9 aa, Influenza virus
TVNVRGSGM

SEQ ID NO: 323624 - protein, 9 aa, Influenza virus
VNVRGSGMR

SEQ ID NO: 323625 - protein, 9 aa, Influenza virus
NVRGSGMRI

SEQ ID NO: 323626 - protein, 9 aa, Influenza virus
VRGSGMRIL

SEQ ID NO: 323627 - protein, 9 aa, Influenza virus
RGSGMRILV

SEQ ID NO: 323628 - protein, 9 aa, Influenza virus
GSGMRILVR

SEQ ID NO: 323629 - protein, 9 aa, Influenza virus
SGMRILVRG

SEQ ID NO: 323630 - protein, 9 aa, Influenza virus
GMRILVRGN

SEQ ID NO: 323631 - protein, 9 aa, Influenza virus
MRILVRGNS

SEQ ID NO: 323632 - protein, 9 aa, Influenza virus
RILVRGNSP

SEQ ID NO: 323633 - protein, 9 aa, Influenza virus
LVRGNSPVF

SEQ ID NO: 323634 - protein, 9 aa, Influenza virus
VRGNSPVFN

SEQ ID NO: 323635 - protein, 9 aa, Influenza virus
RGNSPVFNY

SEQ ID NO: 323636 - protein, 9 aa, Influenza virus
GNSPVFNYN

SEQ ID NO: 323637 - protein, 9 aa, Influenza virus
NSPVFNYNK

SEQ ID NO: 323638 - protein, 9 aa, Influenza virus
TKRLTVLGK

SEQ ID NO: 323639 - protein, 9 aa, Influenza virus
KRLTVLGKD

SEQ ID NO: 323640 - protein, 9 aa, Influenza virus
RLTVLGKDA

SEQ ID NO: 323641 - protein, 9 aa, Influenza virus
LTVLGKDAG

SEQ ID NO: 323642 - protein, 9 aa, Influenza virus
AGAGALAED

SEQ ID NO: 323643 - protein, 9 aa, Influenza virus
GAGALAEDP

SEQ ID NO: 323644 - protein, 9 aa, Influenza virus
AGVESAVLR

SEQ ID NO: 323645 - protein, 9 aa, Influenza virus
GVESAVLRG

SEQ ID NO: 323646 - protein, 9 aa, Influenza virus
VESAVLRGF

SEQ ID NO: 323647 - protein, 9 aa, Influenza virus
ESAVLRGFL

SEQ ID NO: 323648 - protein, 9 aa, Influenza virus
SAVLRGFLI

SEQ ID NO: 323649 - protein, 9 aa, Influenza virus
AVLRGFLIL

SEQ ID NO: 323650 - protein, 9 aa, Influenza virus
VLRGFLILG

SEQ ID NO: 323651 - protein, 9 aa, Influenza virus
LRGFLILGK

SEQ ID NO: 323652 - protein, 9 aa, Influenza virus
RGFLILGKE

SEQ ID NO: 323653 - protein, 9 aa, Influenza virus
GFLILGKED

SEQ ID NO: 323654 - protein, 9 aa, Influenza virus
FLILGKEDK

SEQ ID NO: 323655 - protein, 9 aa, Influenza virus
GKEDKRYGP

SEQ ID NO: 323656 - protein, 9 aa, Influenza virus
QKKDKRYGP

SEQ ID NO: 323657 - protein, 9 aa, Influenza virus
KEDKRYGPA

SEQ ID NO: 323658 - protein, 9 aa, Influenza virus
EDKRYGPAL

SEQ ID NO: 323659 - protein, 9 aa, Influenza virus
DKRYGPALS

SEQ ID NO: 323660 - protein, 9 aa, Influenza virus
KRYGPALSI

SEQ ID NO: 323661 - protein, 9 aa, Influenza virus
RYGPALSIN

SEQ ID NO: 323662 - protein, 9 aa, Influenza virus
YGPALSINE

SEQ ID NO: 323663 - protein, 9 aa, Influenza virus
GPALSINEL

SEQ ID NO: 323664 - protein, 9 aa, Influenza virus
PALSINELS

SEQ ID NO: 323665 - protein, 9 aa, Influenza virus
ALSINELSN

SEQ ID NO: 323666 - protein, 9 aa, Influenza virus
LAKGEKANV

SEQ ID NO: 323667 - protein, 9 aa, Influenza virus
AKGEKANVL

SEQ ID NO: 323668 - protein, 9 aa, Influenza virus
KGEKANVLI

SEQ ID NO: 323669 - protein, 9 aa, Influenza virus
GEKANVLIG

SEQ ID NO: 323670 - protein, 9 aa, Influenza virus
EKANVLIGQ

SEQ ID NO: 323671 - protein, 9 aa, Influenza virus
KANVLIGQG

SEQ ID NO: 323672 - protein, 9 aa, Influenza virus
ANVLIGQGD

SEQ ID NO: 323673 - protein, 9 aa, Influenza virus
NVLIGQGDV

SEQ ID NO: 323674 - protein, 9 aa, Influenza virus
VLIGQGDVV

SEQ ID NO: 323675 - protein, 9 aa, Influenza virus
LIGQGDVVL

SEQ ID NO: 323676 - protein, 9 aa, Influenza virus
IGQGDVVLV

SEQ ID NO: 323677 - protein, 9 aa, Influenza virus
GQGDVVLVM

SEQ ID NO: 323678 - protein, 9 aa, Influenza virus
QGDVVLVMK

SEQ ID NO: 323679 - protein, 9 aa, Influenza virus
GDVVLVMKR

SEQ ID NO: 323680 - protein, 9 aa, Influenza virus
DVVLVMKRK

SEQ ID NO: 323681 - protein, 9 aa, Influenza virus
VVLVMKRKR

SEQ ID NO: 323682 - protein, 9 aa, Influenza virus
VLVMKRKRD

SEQ ID NO: 323683 - protein, 9 aa, Influenza virus
LVMKRKRDS

SEQ ID NO: 323684 - protein, 9 aa, Influenza virus
VMKRKRDSS

SEQ ID NO: 323685 - protein, 9 aa, Influenza virus
MKRKRDSSI

SEQ ID NO: 323686 - protein, 9 aa, Influenza virus
KRKRDSSIL

SEQ ID NO: 323687 - protein, 9 aa, Influenza virus
RKRDSSILT

SEQ ID NO: 323688 - protein, 9 aa, Influenza virus
KRDSSILTD

SEQ ID NO: 323689 - protein, 9 aa, Influenza virus
RDSSILTDS

SEQ ID NO: 323690 - protein, 9 aa, Influenza virus
DSSILTDSQ

SEQ ID NO: 323691 - protein, 9 aa, Influenza virus
SSILTDSQT

SEQ ID NO: 323692 - protein, 9 aa, Influenza virus
SILTDSQTA

SEQ ID NO: 323693 - protein, 9 aa, Influenza virus
ILTDSQTAT

SEQ ID NO: 323694 - protein, 9 aa, Influenza virus
LTDSQTATK

SEQ ID NO: 323695 - protein, 9 aa, Influenza virus
TDSQTATKR

SEQ ID NO: 323696 - protein, 9 aa, Influenza virus
DSQTATKRI

SEQ ID NO: 323697 - protein, 9 aa, Influenza virus
SQTATKRIR

SEQ ID NO: 323698 - protein, 9 aa, Influenza virus
QTATKRIRM

SEQ ID NO: 323699 - protein, 9 aa, Influenza virus
TATKRIRMA

SEQ ID NO: 323700 - protein, 9 aa, Influenza virus
ATKRIRMAI

SEQ ID NO: 323701 - protein, 9 aa, Influenza virus
RIRMAINQC

SEQ ID NO: 323702 - protein, 9 aa, Influenza virus
IRMAINWGR

SEQ ID NO: 323703 - protein, 9 aa, Influenza virus
RMAINWGRI

SEQ ID NO: 323704 - protein, 9 aa, Influenza virus
MATNECRII

SEQ ID NO: 323705 - protein, 9 aa, Influenza virus
GKTKATKMK

SEQ ID NO: 323706 - protein, 9 aa, Influenza virus
IFNFILLTH

SEQ ID NO: 323707 - protein, 9 aa, Influenza virus
FIFLLLTHW

SEQ ID NO: 323708 - protein, 9 aa, Influenza virus
VLSCIFCLA

SEQ ID NO: 323709 - protein, 9 aa, Influenza virus
SDNADKICL

SEQ ID NO: 323710 - protein, 9 aa, Influenza virus
EKENSYPKI

SEQ ID NO: 323711 - protein, 9 aa, Influenza virus
APSGVEYNG

SEQ ID NO: 323712 - protein, 9 aa, Influenza virus
SGVEYNGKS

SEQ ID NO: 323713 - protein, 9 aa, Influenza virus
GVEYNGKSL

SEQ ID NO: 323714 - protein, 9 aa, Influenza virus
VEYNGKSLG

SEQ ID NO: 323715 - protein, 9 aa, Influenza virus
IGAIDSSMP

SEQ ID NO: 323716 - protein, 9 aa, Influenza virus
PAKLLKERG

SEQ ID NO: 323717 - protein, 9 aa, Influenza virus
KLLKERGFF

SEQ ID NO: 323718 - protein, 9 aa, Influenza virus
LLKERGFFG

SEQ ID NO: 323719 - protein, 9 aa, Influenza virus
RRKRGLFGA

SEQ ID NO: 323720 - protein, 9 aa, Influenza virus
TRRQKRGLF

SEQ ID NO: 323721 - protein, 9 aa, Influenza virus
RRQKRGLFG

SEQ ID NO: 323722 - protein, 9 aa, Influenza virus
RKKRGLFGA

SEQ ID NO: 323723 - protein, 9 aa, Influenza virus
QKRGLFGAI

SEQ ID NO: 323724 - protein, 9 aa, Influenza virus
AHKQLTHHM

SEQ ID NO: 323725 - protein, 9 aa, Influenza virus
RMTRGLFGA

SEQ ID NO: 323726 - protein, 9 aa, Influenza virus
ETRGLFGAI

SEQ ID NO: 323727 - protein, 9 aa, Influenza virus
TRGLFGAIA

SEQ ID NO: 323728 - protein, 9 aa, Influenza virus
RGIFGAIAG

SEQ ID NO: 323729 - protein, 9 aa, Influenza virus
GIFGAIAGF

SEQ ID NO: 323730 - protein, 9 aa, Influenza virus
IFGAIAGFI

SEQ ID NO: 323731 - protein, 9 aa, Influenza virus
GAIAGFIEN

SEQ ID NO: 323732 - protein, 9 aa, Influenza virus
AIAGFIENG

SEQ ID NO: 323733 - protein, 9 aa, Influenza virus
IAGFIENGW

SEQ ID NO: 323734 - protein, 9 aa, Influenza virus
RFVNSDCSK

SEQ ID NO: 323735 - protein, 9 aa, Influenza virus
DQNFRNIRK

SEQ ID NO: 323736 - protein, 9 aa, Influenza virus
LVFREQKQE

SEQ ID NO: 323737 - protein, 9 aa, Influenza virus
FSGSQKQEF

SEQ ID NO: 323738 - protein, 9 aa, Influenza virus
SGSQKQEFK

SEQ ID NO: 323739 - protein, 9 aa, Influenza virus
GSQKQEFKM

SEQ ID NO: 323740 - protein, 9 aa, Influenza virus
SQKQEFKMN

SEQ ID NO: 323741 - protein, 9 aa, Influenza virus
QKQEIKMNP

SEQ ID NO: 323742 - protein, 9 aa, Influenza virus
KQEIKMNPN

SEQ ID NO: 323743 - protein, 9 aa, Influenza virus
QEFKMNPNQ

SEQ ID NO: 323744 - protein, 9 aa, Influenza virus
EFKMNPNQK

SEQ ID NO: 323745 - protein, 9 aa, Influenza virus
FKMNPNQKI

SEQ ID NO: 323746 - protein, 9 aa, Influenza virus
KMNPNQKII

SEQ ID NO: 323747 - protein, 9 aa, Influenza virus
ILRTQESSC

SEQ ID NO: 323748 - protein, 9 aa, Influenza virus
RTQESECAC

SEQ ID NO: 323749 - protein, 9 aa, Influenza virus
IRKGLILEY

SEQ ID NO: 323750 - protein, 9 aa, Influenza virus
VMGQASYKI

SEQ ID NO: 323751 - protein, 9 aa, Influenza virus
GKRGKWVKS

SEQ ID NO: 323752 - protein, 9 aa, Influenza virus
IKHLEECSC

SEQ ID NO: 323753 - protein, 9 aa, Influenza virus
SYPNVRCVC

SEQ ID NO: 323754 - protein, 9 aa, Influenza virus
DNYGVKGFG

SEQ ID NO: 323755 - protein, 9 aa, Influenza virus
LVFREQKQE

SEQ ID NO: 323756 - protein, 9 aa, Influenza virus
FSGSQKQEF

SEQ ID NO: 323757 - protein, 9 aa, Influenza virus
SGSQKQEFK

SEQ ID NO: 323758 - protein, 9 aa, Influenza virus
GSQKQEFKM

SEQ ID NO: 323759 - protein, 9 aa, Influenza virus
SQKQEFKMN

SEQ ID NO: 323760 - protein, 9 aa, Influenza virus
QKQEIKMNP

SEQ ID NO: 323761 - protein, 9 aa, Influenza virus
KQEIKMNPN

SEQ ID NO: 323762 - protein, 9 aa, Influenza virus
QEFKMNPNQ

SEQ ID NO: 323763 - protein, 9 aa, Influenza virus
EFKMNPNQK

SEQ ID NO: 323764 - protein, 9 aa, Influenza virus
FKMNPNQKI

SEQ ID NO: 323765 - protein, 9 aa, Influenza virus
KMNPNQKII

SEQ ID NO: 323766 - protein, 9 aa, Influenza virus
ASQYGPSHS

SEQ ID NO: 323767 - protein, 9 aa, Influenza virus
GWAIYTKDN

SEQ ID NO: 323768 - protein, 9 aa, Influenza virus
TKDNSIRIG

SEQ ID NO: 323769 - protein, 9 aa, Influenza virus
KDNSVRIGS

SEQ ID NO: 323770 - protein, 9 aa, Influenza virus
DNSVRIGSK

SEQ ID NO: 323771 - protein, 9 aa, Influenza virus
NSVRIGSKG

SEQ ID NO: 323772 - protein, 9 aa, Influenza virus
SVRIGSKGD

SEQ ID NO: 323773 - protein, 9 aa, Influenza virus
VRIGSKGDV

SEQ ID NO: 323774 - protein, 9 aa, Influenza virus
RIGSKGDIF

SEQ ID NO: 323775 - protein, 9 aa, Influenza virus
IGSKGDIFV

SEQ ID NO: 323776 - protein, 9 aa, Influenza virus
GDIFVIREP

SEQ ID NO: 323777 - protein, 9 aa, Influenza virus
DIFVIREPF

SEQ ID NO: 323778 - protein, 9 aa, Influenza virus
FVMREPFIS

SEQ ID NO: 323779 - protein, 9 aa, Influenza virus
VMREPFISC

SEQ ID NO: 323780 - protein, 9 aa, Influenza virus
MREPFISCS

SEQ ID NO: 323781 - protein, 9 aa, Influenza virus
REPFISCSP

SEQ ID NO: 323782 - protein, 9 aa, Influenza virus
LECKTFFLT

SEQ ID NO: 323783 - protein, 9 aa, Influenza virus
ECKTFFLTQ

SEQ ID NO: 323784 - protein, 9 aa, Influenza virus
CKTFFLTQG

SEQ ID NO: 323785 - protein, 9 aa, Influenza virus
KTFFLTQGA

SEQ ID NO: 323786 - protein, 9 aa, Influenza virus
TQGALLNDR

SEQ ID NO: 323787 - protein, 9 aa, Influenza virus
QGALLNDRH

SEQ ID NO: 323788 - protein, 9 aa, Influenza virus
GALLNDRHS

SEQ ID NO: 323789 - protein, 9 aa, Influenza virus
ALLNDRHSN

SEQ ID NO: 323790 - protein, 9 aa, Influenza virus
LLNDRHSNG

SEQ ID NO: 323791 - protein, 9 aa, Influenza virus
LNDRHSNGT

SEQ ID NO: 323792 - protein, 9 aa, Influenza virus
NDKHSNGTV

SEQ ID NO: 323793 - protein, 9 aa, Influenza virus
DRSPYRALM

SEQ ID NO: 323794 - protein, 9 aa, Influenza virus
RSPYRALMS

SEQ ID NO: 323795 - protein, 9 aa, Influenza virus
SPYRALMSC

SEQ ID NO: 323796 - protein, 9 aa, Influenza virus
PYRALMSCP

SEQ ID NO: 323797 - protein, 9 aa, Influenza virus
RTLMSCPVG

SEQ ID NO: 323798 - protein, 9 aa, Influenza virus
VGEAPSPYN

SEQ ID NO: 323799 - protein, 9 aa, Influenza virus
GEVPSPYNS

SEQ ID NO: 323800 - protein, 9 aa, Influenza virus
EAPSPYNSR

SEQ ID NO: 323801 - protein, 9 aa, Influenza virus
APSPYNSRF

SEQ ID NO: 323802 - protein, 9 aa, Influenza virus
PSPYNSKFE

SEQ ID NO: 323803 - protein, 9 aa, Influenza virus
SPYNSKFES

SEQ ID NO: 323804 - protein, 9 aa, Influenza virus
PYNSKFESV

SEQ ID NO: 323805 - protein, 9 aa, Influenza virus
YNSKFESVA

SEQ ID NO: 323806 - protein, 9 aa, Influenza virus
NSKFESVAW

SEQ ID NO: 323807 - protein, 9 aa, Influenza virus
SKFESVAWS

SEQ ID NO: 323808 - protein, 9 aa, Influenza virus
KFESVAWSA

SEQ ID NO: 323809 - protein, 9 aa, Influenza virus
SASACHDGM

SEQ ID NO: 323810 - protein, 9 aa, Influenza virus
SWLTIGISG

SEQ ID NO: 323811 - protein, 9 aa, Influenza virus
WITIGISGP

SEQ ID NO: 323812 - protein, 9 aa, Influenza virus
ITIGISGPD

SEQ ID NO: 323813 - protein, 9 aa, Influenza virus
TIGISGPDD

SEQ ID NO: 323814 - protein, 9 aa, Influenza virus
IGISGPDDG

SEQ ID NO: 323815 - protein, 9 aa, Influenza virus
GISGPDDGA

SEQ ID NO: 323816 - protein, 9 aa, Influenza virus
ISGPDDGAV

SEQ ID NO: 323817 - protein, 9 aa, Influenza virus
SGPDDGAVA

SEQ ID NO: 323818 - protein, 9 aa, Influenza virus
GPDDGAVAV

SEQ ID NO: 323819 - protein, 9 aa, Influenza virus
PDDGAVAVL

SEQ ID NO: 323820 - protein, 9 aa, Influenza virus
DDGAVAVLK

SEQ ID NO: 323821 - protein, 9 aa, Influenza virus
DGAVAVLKY

SEQ ID NO: 323822 - protein, 9 aa, Influenza virus
EAVAVLKYN

SEQ ID NO: 323823 - protein, 9 aa, Influenza virus
AVAVVKYNG

SEQ ID NO: 323824 - protein, 9 aa, Influenza virus
AVLKYNGMI

SEQ ID NO: 323825 - protein, 9 aa, Influenza virus
VLKYNGMIT

SEQ ID NO: 323826 - protein, 9 aa, Influenza virus
IMRTQESEC

SEQ ID NO: 323827 - protein, 9 aa, Influenza virus
LRTQESECV

SEQ ID NO: 323828 - protein, 9 aa, Influenza virus
RTQESECVC

SEQ ID NO: 323829 - protein, 9 aa, Influenza virus
NGSCFTIMT

SEQ ID NO: 323830 - protein, 9 aa, Influenza virus
GSCFTIMTD

SEQ ID NO: 323831 - protein, 9 aa, Influenza virus
SCFTIMTDG

SEQ ID NO: 323832 - protein, 9 aa, Influenza virus
CFTIMTDGP

SEQ ID NO: 323833 - protein, 9 aa, Influenza virus
FTIMTDGPS

SEQ ID NO: 323834 - protein, 9 aa, Influenza virus
EKGKVVKSV

SEQ ID NO: 323835 - protein, 9 aa, Influenza virus
APNFHYEEC

SEQ ID NO: 323836 - protein, 9 aa, Influenza virus
PNFHYEECS

SEQ ID NO: 323837 - protein, 9 aa, Influenza virus
NFHYEECSC

SEQ ID NO: 323838 - protein, 9 aa, Influenza virus
FHYEECSCY

SEQ ID NO: 323839 - protein, 9 aa, Influenza virus
YYEECSCYP

SEQ ID NO: 323840 - protein, 9 aa, Influenza virus
YEECSCYPE

SEQ ID NO: 323841 - protein, 9 aa, Influenza virus
EECSCYPDT

SEQ ID NO: 323842 - protein, 9 aa, Influenza virus
MCVCRDNWH

SEQ ID NO: 323843 - protein, 9 aa, Influenza virus
CVCRDNWHA

SEQ ID NO: 323844 - protein, 9 aa, Influenza virus
VCRDNWHAS

SEQ ID NO: 323845 - protein, 9 aa, Influenza virus
CRDNWHASN

SEQ ID NO: 323846 - protein, 9 aa, Influenza virus
RDNWHASNR

SEQ ID NO: 323847 - protein, 9 aa, Influenza virus
DNWHASNRP

SEQ ID NO: 323848 - protein, 9 aa, Influenza virus
NWHASNRPW

SEQ ID NO: 323849 - protein, 9 aa, Influenza virus
WHASNRPWV

SEQ ID NO: 323850 - protein, 9 aa, Influenza virus
HASNRPWVS

SEQ ID NO: 323851 - protein, 9 aa, Influenza virus
ASNRPWVSF

SEQ ID NO: 323852 - protein, 9 aa, Influenza virus
SNRPWVSFD

SEQ ID NO: 323853 - protein, 9 aa, Influenza virus
NRPWVSFDQ

SEQ ID NO: 323854 - protein, 9 aa, Influenza virus
YQMGYICSG

SEQ ID NO: 323855 - protein, 9 aa, Influenza virus
GYICSGIFG

SEQ ID NO: 323856 - protein, 9 aa, Influenza virus
YICSGIFGD

SEQ ID NO: 323857 - protein, 9 aa, Influenza virus
ICSGIFGDN

SEQ ID NO: 323858 - protein, 9 aa, Influenza virus
CSGIFGDNP

SEQ ID NO: 323859 - protein, 9 aa, Influenza virus
SGIFGDNPR

SEQ ID NO: 323860 - protein, 9 aa, Influenza virus
GVFGDNPRP

SEQ ID NO: 323861 - protein, 9 aa, Influenza virus
GVKGFSYKY

SEQ ID NO: 323862 - protein, 9 aa, Influenza virus
RYGNGVWIG

SEQ ID NO: 323863 - protein, 9 aa, Influenza virus
YDNGVWIGR

SEQ ID NO: 323864 - protein, 9 aa, Influenza virus
DNGVWIGRT

SEQ ID NO: 323865 - protein, 9 aa, Influenza virus
DGVWIGRTK

SEQ ID NO: 323866 - protein, 9 aa, Influenza virus
GVWIGRTKN

SEQ ID NO: 323867 - protein, 9 aa, Influenza virus
GFEMIWDPD

SEQ ID NO: 323868 - protein, 9 aa, Influenza virus
FEMIWDPDG

SEQ ID NO: 323869 - protein, 9 aa, Influenza virus
EMIWDPDGW

SEQ ID NO: 323870 - protein, 9 aa, Influenza virus
NEWSGYSGS

SEQ ID NO: 323871 - protein, 9 aa, Influenza virus
EWSGYSGSF

SEQ ID NO: 323872 - protein, 9 aa, Influenza virus
WSGYSGSFI

SEQ ID NO: 323873 - protein, 9 aa, Influenza virus
SGYSGSFIQ

SEQ ID NO: 323874 - protein, 9 aa, Influenza virus
GYSGSFIQH

SEQ ID NO: 323875 - protein, 9 aa, Influenza virus
YSGSFIQHP

SEQ ID NO: 323876 - protein, 9 aa, Influenza virus
SGSFIQHPE

SEQ ID NO: 323877 - protein, 9 aa, Influenza virus
GSFIQHPEL

SEQ ID NO: 323878 - protein, 9 aa, Influenza virus
SFIQHPELT

SEQ ID NO: 323879 - protein, 9 aa, Influenza virus
FIQHPELTG

SEQ ID NO: 323880 - protein, 9 aa, Influenza virus
VQHPELTGM

SEQ ID NO: 323881 - protein, 9 aa, Influenza virus
QHPELTGMN

SEQ ID NO: 323882 - protein, 9 aa, Influenza virus
HPELTGMNC

SEQ ID NO: 323883 - protein, 9 aa, Influenza virus
DCMRPCFWV

SEQ ID NO: 323884 - protein, 9 aa, Influenza virus
CMRPCFWVE

SEQ ID NO: 323885 - protein, 9 aa, Influenza virus
MRPCFWVEL

SEQ ID NO: 323886 - protein, 9 aa, Influenza virus
RPCFWVELV

SEQ ID NO: 323887 - protein, 9 aa, Influenza virus
PCFWVELVR

SEQ ID NO: 323888 - protein, 9 aa, Influenza virus
CFWVELVRG

SEQ ID NO: 323889 - protein, 9 aa, Influenza virus
FWVELVRGL

SEQ ID NO: 323890 - protein, 9 aa, Influenza virus
WVELVRGLP

SEQ ID NO: 323891 - protein, 9 aa, Influenza virus
ATIWTSGSS

SEQ ID NO: 323892 - protein, 9 aa, Influenza virus
TIWASGSSI

SEQ ID NO: 323893 - protein, 9 aa, Influenza virus
IWASGSSIS

SEQ ID NO: 323894 - protein, 9 aa, Influenza virus
WASGSSISF

SEQ ID NO: 323895 - protein, 9 aa, Influenza virus
ASGSSISFC

SEQ ID NO: 323896 - protein, 9 aa, Influenza virus
SGSIISFCG

SEQ ID NO: 323897 - protein, 9 aa, Influenza virus
GSIISFCGV

SEQ ID NO: 323898 - protein, 9 aa, Influenza virus
SSISFCGVD

SEQ ID NO: 323899 - protein, 9 aa, Influenza virus
WSWPDGADL

SEQ ID NO: 323900 - protein, 9 aa, Influenza virus
SWPDGADLP

SEQ ID NO: 323901 - protein, 9 aa, Influenza virus
WPDGADLPF

SEQ ID NO: 323902 - protein, 9 aa, Influenza virus
KNNQVILCG

SEQ ID NO: 323903 - protein, 9 aa, Influenza virus
GFAPFAKDN

SEQ ID NO: 323904 - protein, 9 aa, Influenza virus
FAPFAKDNS

SEQ ID NO: 323905 - protein, 9 aa, Influenza virus
APFAKDNSI

SEQ ID NO: 323906 - protein, 9 aa, Influenza virus
PFAKDNSIR

SEQ ID NO: 323907 - protein, 9 aa, Influenza virus
FAKDNSIRL

SEQ ID NO: 323908 - protein, 9 aa, Influenza virus
AKDNSIRLS

SEQ ID NO: 323909 - protein, 9 aa, Influenza virus
KDNSVRLSA

SEQ ID NO: 323910 - protein, 9 aa, Influenza virus
DNSIRLSAS

SEQ ID NO: 323911 - protein, 9 aa, Influenza virus
NSIRLSASG

SEQ ID NO: 323912 - protein, 9 aa, Influenza virus
IWITREPYV

SEQ ID NO: 323913 - protein, 9 aa, Influenza virus
WITREPYVS

SEQ ID NO: 323914 - protein, 9 aa, Influenza virus
ITREPYVSC

SEQ ID NO: 323915 - protein, 9 aa, Influenza virus
TREPYVSCG

SEQ ID NO: 323916 - protein, 9 aa, Influenza virus
RCYQFALGQ

SEQ ID NO: 323917 - protein, 9 aa, Influenza virus
PHRTLLMNE

SEQ ID NO: 323918 - protein, 9 aa, Influenza virus
HRTLLMNEL

SEQ ID NO: 323919 - protein, 9 aa, Influenza virus
RTLLMSELG

SEQ ID NO: 323920 - protein, 9 aa, Influenza virus
TLLMSELGV

SEQ ID NO: 323921 - protein, 9 aa, Influenza virus
LLMSELGVP

SEQ ID NO: 323922 - protein, 9 aa, Influenza virus
LMSELGVPF

SEQ ID NO: 323923 - protein, 9 aa, Influenza virus
MSELGVPFH

SEQ ID NO: 323924 - protein, 9 aa, Influenza virus
SELGVPFHL

SEQ ID NO: 323925 - protein, 9 aa, Influenza virus
ELGVPFHLA

SEQ ID NO: 323926 - protein, 9 aa, Influenza virus
LGVPFHLAT

SEQ ID NO: 323927 - protein, 9 aa, Influenza virus
GVPFHLGTR

SEQ ID NO: 323928 - protein, 9 aa, Influenza virus
VPFHLGTRQ

SEQ ID NO: 323929 - protein, 9 aa, Influenza virus
PFHLGTRQV

SEQ ID NO: 323930 - protein, 9 aa, Influenza virus
FHLGTRQVC

SEQ ID NO: 323931 - protein, 9 aa, Influenza virus
TRQVCIAWS

SEQ ID NO: 323932 - protein, 9 aa, Influenza virus
RQVCIAWSS

SEQ ID NO: 323933 - protein, 9 aa, Influenza virus
QVCMAWSSS

SEQ ID NO: 323934 - protein, 9 aa, Influenza virus
VCMAWSSSS

SEQ ID NO: 323935 - protein, 9 aa, Influenza virus
CMAWSSSSC

SEQ ID NO: 323936 - protein, 9 aa, Influenza virus
MAWSSSSCH

SEQ ID NO: 323937 - protein, 9 aa, Influenza virus
AWSSSSCYD

SEQ ID NO: 323938 - protein, 9 aa, Influenza virus
WSSSSCYDG

SEQ ID NO: 323939 - protein, 9 aa, Influenza virus
SSSSCHDGR

SEQ ID NO: 323940 - protein, 9 aa, Influenza virus
SSSCHDGRA

SEQ ID NO: 323941 - protein, 9 aa, Influenza virus
SSCHDGRAW

SEQ ID NO: 323942 - protein, 9 aa, Influenza virus
SCHDGRAWL

SEQ ID NO: 323943 - protein, 9 aa, Influenza virus
CHDGRAWLH

SEQ ID NO: 323944 - protein, 9 aa, Influenza virus
DGRAWLHVC

SEQ ID NO: 323945 - protein, 9 aa, Influenza virus
AWLHVCITG

SEQ ID NO: 323946 - protein, 9 aa, Influenza virus
KILRTQESE

SEQ ID NO: 323947 - protein, 9 aa, Influenza virus
LRTQESECI

SEQ ID NO: 323948 - protein, 9 aa, Influenza virus
TQESECICI

SEQ ID NO: 323949 - protein, 9 aa, Influenza virus
QESECVCIS

SEQ ID NO: 323950 - protein, 9 aa, Influenza virus
ESECVCISG

SEQ ID NO: 323951 - protein, 9 aa, Influenza virus
CAVVMTDGS

SEQ ID NO: 323952 - protein, 9 aa, Influenza virus
AVVMTDGSA

SEQ ID NO: 323953 - protein, 9 aa, Influenza virus
VVMTDGNAS

SEQ ID NO: 323954 - protein, 9 aa, Influenza virus
VMTDGSASE

SEQ ID NO: 323955 - protein, 9 aa, Influenza virus
IREGLILEY

SEQ ID NO: 323956 - protein, 9 aa, Influenza virus
RKGLILEYY

SEQ ID NO: 323957 - protein, 9 aa, Influenza virus
GSAQHIEEC

SEQ ID NO: 323958 - protein, 9 aa, Influenza virus
SAQHIEECS

SEQ ID NO: 323959 - protein, 9 aa, Influenza virus
AQHIEECSC

SEQ ID NO: 323960 - protein, 9 aa, Influenza virus
QHIEECSCY

SEQ ID NO: 323961 - protein, 9 aa, Influenza virus
HIEECSCYP

SEQ ID NO: 323962 - protein, 9 aa, Influenza virus
IEECSCYPR

SEQ ID NO: 323963 - protein, 9 aa, Influenza virus
EECSCYPQY

SEQ ID NO: 323964 - protein, 9 aa, Influenza virus
SYPNVRCVC

SEQ ID NO: 323965 - protein, 9 aa, Influenza virus
VRCICRDNW

SEQ ID NO: 323966 - protein, 9 aa, Influenza virus
RCICRDNWK

SEQ ID NO: 323967 - protein, 9 aa, Influenza virus
CICRDNWKG

SEQ ID NO: 323968 - protein, 9 aa, Influenza virus
ICRDNWKGS

SEQ ID NO: 323969 - protein, 9 aa, Influenza virus
CRDNWRGSN

SEQ ID NO: 323970 - protein, 9 aa, Influenza virus
RDNWRGSNR

SEQ ID NO: 323971 - protein, 9 aa, Influenza virus
DNWRGSNRP

SEQ ID NO: 323972 - protein, 9 aa, Influenza virus
NWKGSNRPV

SEQ ID NO: 323973 - protein, 9 aa, Influenza virus
YLCSGLVGD

SEQ ID NO: 323974 - protein, 9 aa, Influenza virus
LCSGLVGDT

SEQ ID NO: 323975 - protein, 9 aa, Influenza virus
GLVGDTPRN

SEQ ID NO: 323976 - protein, 9 aa, Influenza virus
PGVKGWAFD

SEQ ID NO: 323977 - protein, 9 aa, Influenza virus
GVKGWAFDN

SEQ ID NO: 323978 - protein, 9 aa, Influenza virus
RSGYETFRV

SEQ ID NO: 323979 - protein, 9 aa, Influenza virus
SGYSGVFSV

SEQ ID NO: 323980 - protein, 9 aa, Influenza virus
GYSGVFSVE

SEQ ID NO: 323981 - protein, 9 aa, Influenza virus
CVNRCFYVE

SEQ ID NO: 323982 - protein, 9 aa, Influenza virus
VNRCFYVEL

SEQ ID NO: 323983 - protein, 9 aa, Influenza virus
FYVELIRGS

SEQ ID NO: 323984 - protein, 9 aa, Influenza virus
VLWTSNSIV

SEQ ID NO: 323985 - protein, 9 aa, Influenza virus
WTSNSIIVF

SEQ ID NO: 323986 - protein, 9 aa, Influenza virus
TSNSIIVFC

SEQ ID NO: 323987 - protein, 9 aa, Influenza virus
SNSIIVFCG

SEQ ID NO: 323988 - protein, 9 aa, Influenza virus
NSIIVFCGT

SEQ ID NO: 323989 - protein, 9 aa, Influenza virus
SIIVFCGTS

SEQ ID NO: 323990 - protein, 9 aa, Influenza virus
IIVFCGTSG

SEQ ID NO: 323991 - protein, 9 aa, Influenza virus
IVFCGTSGT

SEQ ID NO: 323992 - protein, 9 aa, Influenza virus
AFCGTSGTY

SEQ ID NO: 323993 - protein, 9 aa, Influenza virus
CGTSGTYGS

SEQ ID NO: 323994 - protein, 9 aa, Influenza virus
GTSGTYGSG

SEQ ID NO: 323995 - protein, 9 aa, Influenza virus
TSGTYGSGS

SEQ ID NO: 323996 - protein, 9 aa, Influenza virus
SGTYGSGSW

SEQ ID NO: 323997 - protein, 9 aa, Influenza virus
GTYGSGSWP

SEQ ID NO: 323998 - protein, 9 aa, Influenza virus
TYGSGSWPD

SEQ ID NO: 323999 - protein, 9 aa, Influenza virus
YGSGSWPDG

SEQ ID NO: 324000 - protein, 9 aa, Influenza virus
GSGSWPDGA

SEQ ID NO: 324001 - protein, 9 aa, Influenza virus
GSWPDGANI

SEQ ID NO: 324002 - protein, 9 aa, Influenza virus
ADIKSHAYI

SEQ ID NO: 324003 - protein, 9 aa, Influenza virus
SISCLYKLS

SEQ ID NO: 324004 - protein, 9 aa, Influenza virus
ISCLYKLSQ

SEQ ID NO: 324005 - protein, 9 aa, Influenza virus
NFMPYISFA

SEQ ID NO: 324006 - protein, 9 aa, Influenza virus
ALLIGIGNL

SEQ ID NO: 324007 - protein, 9 aa, Influenza virus
GNLIFNTVI

SEQ ID NO: 324008 - protein, 9 aa, Influenza virus
NLIFNTVIH

SEQ ID NO: 324009 - protein, 9 aa, Influenza virus
LPLCPFKGF

SEQ ID NO: 324010 - protein, 9 aa, Influenza virus
PLCPFKGFF

SEQ ID NO: 324011 - protein, 9 aa, Influenza virus
LCPFKGFFP

SEQ ID NO: 324012 - protein, 9 aa, Influenza virus
CPFKGFFPF

SEQ ID NO: 324013 - protein, 9 aa, Influenza virus
PFKGFFPFH

SEQ ID NO: 324014 - protein, 9 aa, Influenza virus
FKGFFPFHK

SEQ ID NO: 324015 - protein, 9 aa, Influenza virus
KGFFPFHKD

SEQ ID NO: 324016 - protein, 9 aa, Influenza virus
FPFHKDNAL

SEQ ID NO: 324017 - protein, 9 aa, Influenza virus
PFHKDNALR

SEQ ID NO: 324018 - protein, 9 aa, Influenza virus
FHKDNALRL

SEQ ID NO: 324019 - protein, 9 aa, Influenza virus
HKDNALRLA

SEQ ID NO: 324020 - protein, 9 aa, Influenza virus
KDNALRLAE

SEQ ID NO: 324021 - protein, 9 aa, Influenza virus
DNALRLAEN

SEQ ID NO: 324022 - protein, 9 aa, Influenza virus
IVTREPYIS

SEQ ID NO: 324023 - protein, 9 aa, Influenza virus
VTREPYISC

SEQ ID NO: 324024 - protein, 9 aa, Influenza virus
TREPYISCD

SEQ ID NO: 324025 - protein, 9 aa, Influenza virus
REPYISCDN

SEQ ID NO: 324026 - protein, 9 aa, Influenza virus
DCWSFALAQ

SEQ ID NO: 324027 - protein, 9 aa, Influenza virus
WSFALAQGT

SEQ ID NO: 324028 - protein, 9 aa, Influenza virus
SFALAQGTL

SEQ ID NO: 324029 - protein, 9 aa, Influenza virus
FALAQGALV

SEQ ID NO: 324030 - protein, 9 aa, Influenza virus
ALAQGALVG

SEQ ID NO: 324031 - protein, 9 aa, Influenza virus
LAQGALVGT

SEQ ID NO: 324032 - protein, 9 aa, Influenza virus
LVGTKHSNG

SEQ ID NO: 324033 - protein, 9 aa, Influenza virus
LGTNHSNGT

SEQ ID NO: 324034 - protein, 9 aa, Influenza virus
HSNGTNKDR

SEQ ID NO: 324035 - protein, 9 aa, Influenza virus
SNGTNKDRT

SEQ ID NO: 324036 - protein, 9 aa, Influenza virus
KDRTSYRSL

SEQ ID NO: 324037 - protein, 9 aa, Influenza virus
DRTSYRSLI

SEQ ID NO: 324038 - protein, 9 aa, Influenza virus
RTPYRSLIQ

SEQ ID NO: 324039 - protein, 9 aa, Influenza virus
TPYRSLIQF

SEQ ID NO: 324040 - protein, 9 aa, Influenza virus
PYRSLIQFP

SEQ ID NO: 324041 - protein, 9 aa, Influenza virus
YRSLIRFPV

SEQ ID NO: 324042 - protein, 9 aa, Influenza virus
RSLIRFPVG

SEQ ID NO: 324043 - protein, 9 aa, Influenza virus
GVAPVLGNY

SEQ ID NO: 324044 - protein, 9 aa, Influenza virus
APVLGNYRE

SEQ ID NO: 324045 - protein, 9 aa, Influenza virus
CVAWSSSSC

SEQ ID NO: 324046 - protein, 9 aa, Influenza virus
VAWSSSSCF

SEQ ID NO: 324047 - protein, 9 aa, Influenza virus
SSSSCFDGR

SEQ ID NO: 324048 - protein, 9 aa, Influenza virus
SSSCFDGRE

SEQ ID NO: 324049 - protein, 9 aa, Influenza virus
SSCFDGREW

SEQ ID NO: 324050 - protein, 9 aa, Influenza virus
SCFDGKEWL

SEQ ID NO: 324051 - protein, 9 aa, Influenza virus
CFDGKEWLH

SEQ ID NO: 324052 - protein, 9 aa, Influenza virus
FDGKEWMHI

SEQ ID NO: 324053 - protein, 9 aa, Influenza virus
DGKEWMHIC

SEQ ID NO: 324054 - protein, 9 aa, Influenza virus
RDILRTQES

SEQ ID NO: 324055 - protein, 9 aa, Influenza virus
NILRTQESE

SEQ ID NO: 324056 - protein, 9 aa, Influenza virus
TQESECQCL

SEQ ID NO: 324057 - protein, 9 aa, Influenza virus
TDGPAANNA

SEQ ID NO: 324058 - protein, 9 aa, Influenza virus
ADHRIYWIR

SEQ ID NO: 324059 - protein, 9 aa, Influenza virus
KIKHLEECS

SEQ ID NO: 324060 - protein, 9 aa, Influenza virus
IKHLEECSC

SEQ ID NO: 324061 - protein, 9 aa, Influenza virus
KHLEECSCY

SEQ ID NO: 324062 - protein, 9 aa, Influenza virus
HLEECSCYT

SEQ ID NO: 324063 - protein, 9 aa, Influenza virus
LEECSCYTD

SEQ ID NO: 324064 - protein, 9 aa, Influenza virus
DVYCVCRDN

SEQ ID NO: 324065 - protein, 9 aa, Influenza virus
VYCVCRDNW

SEQ ID NO: 324066 - protein, 9 aa, Influenza virus
YCVCRDNWK

SEQ ID NO: 324067 - protein, 9 aa, Influenza virus
CVCRDNWKG

SEQ ID NO: 324068 - protein, 9 aa, Influenza virus
VCRDNWKGS

SEQ ID NO: 324069 - protein, 9 aa, Influenza virus
WKGSNRPWV

SEQ ID NO: 324070 - protein, 9 aa, Influenza virus
KGSNRPWVR

SEQ ID NO: 324071 - protein, 9 aa, Influenza virus
GSNRPWVRM

SEQ ID NO: 324072 - protein, 9 aa, Influenza virus
SNRPWVRMN

SEQ ID NO: 324073 - protein, 9 aa, Influenza virus
NRPWVRMNN

SEQ ID NO: 324074 - protein, 9 aa, Influenza virus
RPWVRMNNE

SEQ ID NO: 324075 - protein, 9 aa, Influenza virus
PWVRMNNET

SEQ ID NO: 324076 - protein, 9 aa, Influenza virus
WVRMNNETI

SEQ ID NO: 324077 - protein, 9 aa, Influenza virus
MNNETILET

SEQ ID NO: 324078 - protein, 9 aa, Influenza virus
SNETILETG

SEQ ID NO: 324079 - protein, 9 aa, Influenza virus
NETIIETGY

SEQ ID NO: 324080 - protein, 9 aa, Influenza virus
ETILETGYI

SEQ ID NO: 324081 - protein, 9 aa, Influenza virus
TILETGYIC

SEQ ID NO: 324082 - protein, 9 aa, Influenza virus
ILETGYICS

SEQ ID NO: 324083 - protein, 9 aa, Influenza virus
LETGYICSK

SEQ ID NO: 324084 - protein, 9 aa, Influenza virus
ETGYICSKF

SEQ ID NO: 324085 - protein, 9 aa, Influenza virus
TGYICSKFH

SEQ ID NO: 324086 - protein, 9 aa, Influenza virus
GYICSKFHS

SEQ ID NO: 324087 - protein, 9 aa, Influenza virus
YICSKFHSD

SEQ ID NO: 324088 - protein, 9 aa, Influenza virus
ICSKFHSDT

SEQ ID NO: 324089 - protein, 9 aa, Influenza virus
FHSDTPRPD

SEQ ID NO: 324090 - protein, 9 aa, Influenza virus
HSDTPRPDD

SEQ ID NO: 324091 - protein, 9 aa, Influenza virus
SDTPRPDDP

SEQ ID NO: 324092 - protein, 9 aa, Influenza virus
DTPRPDDPS

SEQ ID NO: 324093 - protein, 9 aa, Influenza virus
RRGVKGFGF

SEQ ID NO: 324094 - protein, 9 aa, Influenza virus
RGVKGFGFK

SEQ ID NO: 324095 - protein, 9 aa, Influenza virus
GDDVWLGRT

SEQ ID NO: 324096 - protein, 9 aa, Influenza virus
DDVWLGRTV

SEQ ID NO: 324097 - protein, 9 aa, Influenza virus
DVWLGRTIS

SEQ ID NO: 324098 - protein, 9 aa, Influenza virus
RSGFEVIKV

SEQ ID NO: 324099 - protein, 9 aa, Influenza virus
TQTLVSNSD

SEQ ID NO: 324100 - protein, 9 aa, Influenza virus
QTLVSNSDW

SEQ ID NO: 324101 - protein, 9 aa, Influenza virus
TLVSNSDWS

SEQ ID NO: 324102 - protein, 9 aa, Influenza virus
LVSNSDWSG

SEQ ID NO: 324103 - protein, 9 aa, Influenza virus
VSNSDWSGY

SEQ ID NO: 324104 - protein, 9 aa, Influenza virus
SNSDWSGYS

SEQ ID NO: 324105 - protein, 9 aa, Influenza virus
NSDWSGYSG

SEQ ID NO: 324106 - protein, 9 aa, Influenza virus
SDWSGYSGS

SEQ ID NO: 324107 - protein, 9 aa, Influenza virus
WSGYSGSFV

SEQ ID NO: 324108 - protein, 9 aa, Influenza virus
SGYSGSFII

SEQ ID NO: 324109 - protein, 9 aa, Influenza virus
GCFQPCFYI

SEQ ID NO: 324110 - protein, 9 aa, Influenza virus
CFQPCFYIE

SEQ ID NO: 324111 - protein, 9 aa, Influenza virus
FQPCFYIEL

SEQ ID NO: 324112 - protein, 9 aa, Influenza virus
QPCFYIELI

SEQ ID NO: 324113 - protein, 9 aa, Influenza virus
PCFYIELIR

SEQ ID NO: 324114 - protein, 9 aa, Influenza virus
CFYIELIRG

SEQ ID NO: 324115 - protein, 9 aa, Influenza virus
FYIELIRGR

SEQ ID NO: 324116 - protein, 9 aa, Influenza virus
VSWASNSIV

SEQ ID NO: 324117 - protein, 9 aa, Influenza virus
SWTSNSMVT

SEQ ID NO: 324118 - protein, 9 aa, Influenza virus
WTSNSMVTF

SEQ ID NO: 324119 - protein, 9 aa, Influenza virus
TSNSMVTFC

SEQ ID NO: 324120 - protein, 9 aa, Influenza virus
SNSMVTFCG

SEQ ID NO: 324121 - protein, 9 aa, Influenza virus
NSMVTFCGL

SEQ ID NO: 324122 - protein, 9 aa, Influenza virus
SIVTFCGLN

SEQ ID NO: 324123 - protein, 9 aa, Influenza virus
IVTFCGLNN

SEQ ID NO: 324124 - protein, 9 aa, Influenza virus
VTFCGLNNE

SEQ ID NO: 324125 - protein, 9 aa, Influenza virus
TFCGLNNEP

SEQ ID NO: 324126 - protein, 9 aa, Influenza virus
FCGLNNEPG

SEQ ID NO: 324127 - protein, 9 aa, Influenza virus
CGLNNEPGS

SEQ ID NO: 324128 - protein, 9 aa, Influenza virus
GLNNEPGSG

SEQ ID NO: 324129 - protein, 9 aa, Influenza virus
NEPGSGDWP

SEQ ID NO: 324130 - protein, 9 aa, Influenza virus
EPGSGDWPD

SEQ ID NO: 324131 - protein, 9 aa, Influenza virus
PGSGDWPDG

SEQ ID NO: 324132 - protein, 9 aa, Influenza virus
GSGNWPDGA

SEQ ID NO: 324133 - protein, 9 aa, Influenza virus
WPDGANIGF

SEQ ID NO: 324134 - protein, 9 aa, Influenza virus
PDGANIGFM

SEQ ID NO: 324135 - protein, 9 aa, Influenza virus
DGANIGFMP

SEQ ID NO: 324136 - protein, 9 aa, Influenza virus
GANIGFMPK

SEQ ID NO: 324137 - protein, 9 aa, Influenza virus
MNPNQKIVT

SEQ ID NO: 324138 - protein, 9 aa, Influenza virus
NPNQKIVTI

SEQ ID NO: 324139 - protein, 9 aa, Influenza virus
PNQMIITIG

SEQ ID NO: 324140 - protein, 9 aa, Influenza virus
NQKIVTIGS

SEQ ID NO: 324141 - protein, 9 aa, Influenza virus
IITIGSVSI

SEQ ID NO: 324142 - protein, 9 aa, Influenza virus
LTTIGLLLQ

SEQ ID NO: 324143 - protein, 9 aa, Influenza virus
TTIGLLLQI

SEQ ID NO: 324144 - protein, 9 aa, Influenza virus
TIGLLLQIT

SEQ ID NO: 324145 - protein, 9 aa, Influenza virus
IGLLLQITS

SEQ ID NO: 324146 - protein, 9 aa, Influenza virus
GLLLQIISL

SEQ ID NO: 324147 - protein, 9 aa, Influenza virus
LLLQIISLC

SEQ ID NO: 324148 - protein, 9 aa, Influenza virus
LLQIISLCS

SEQ ID NO: 324149 - protein, 9 aa, Influenza virus
LQIISLCSI

SEQ ID NO: 324150 - protein, 9 aa, Influenza virus
QIISLCSIW

SEQ ID NO: 324151 - protein, 9 aa, Influenza virus
IISLCSIWF

SEQ ID NO: 324152 - protein, 9 aa, Influenza virus
ISLCSIWFS

SEQ ID NO: 324153 - protein, 9 aa, Influenza virus
IWFSHYNQM

SEQ ID NO: 324154 - protein, 9 aa, Influenza virus
WFSHYNQMT

SEQ ID NO: 324155 - protein, 9 aa, Influenza virus
FSHYNQMTQ

SEQ ID NO: 324156 - protein, 9 aa, Influenza virus
SHYNQMTQA

SEQ ID NO: 324157 - protein, 9 aa, Influenza virus
CSNDTINYY

SEQ ID NO: 324158 - protein, 9 aa, Influenza virus
SNDTINYYN

SEQ ID NO: 324159 - protein, 9 aa, Influenza virus
NDTINYYNE

SEQ ID NO: 324160 - protein, 9 aa, Influenza virus
DTINYYNET

SEQ ID NO: 324161 - protein, 9 aa, Influenza virus
TINYYNETF

SEQ ID NO: 324162 - protein, 9 aa, Influenza virus
INYYNETFV

SEQ ID NO: 324163 - protein, 9 aa, Influenza virus
YYNETFVNI

SEQ ID NO: 324164 - protein, 9 aa, Influenza virus
YNETFVNIT

SEQ ID NO: 324165 - protein, 9 aa, Influenza virus
NETFVNVTH

SEQ ID NO: 324166 - protein, 9 aa, Influenza virus
ETFVNVTHV

SEQ ID NO: 324167 - protein, 9 aa, Influenza virus
TFVNVTHVQ

SEQ ID NO: 324168 - protein, 9 aa, Influenza virus
FVNVTHVQN

SEQ ID NO: 324169 - protein, 9 aa, Influenza virus
VNVTHVQNN

SEQ ID NO: 324170 - protein, 9 aa, Influenza virus
NVTHVQNNY

SEQ ID NO: 324171 - protein, 9 aa, Influenza virus
VTHVQNNYT

SEQ ID NO: 324172 - protein, 9 aa, Influenza virus
THVQNNYTT

SEQ ID NO: 324173 - protein, 9 aa, Influenza virus
NVQNNYTTI

SEQ ID NO: 324174 - protein, 9 aa, Influenza virus
LCPVKGWAP

SEQ ID NO: 324175 - protein, 9 aa, Influenza virus
CPVKGWAPL

SEQ ID NO: 324176 - protein, 9 aa, Influenza virus
PVKGWAPLS

SEQ ID NO: 324177 - protein, 9 aa, Influenza virus
VKGWAPLSK

SEQ ID NO: 324178 - protein, 9 aa, Influenza virus
KGWAPLSKD

SEQ ID NO: 324179 - protein, 9 aa, Influenza virus
EVFVIREPC

SEQ ID NO: 324180 - protein, 9 aa, Influenza virus
VFVIREPCI

SEQ ID NO: 324181 - protein, 9 aa, Influenza virus
FVIREPFVS

SEQ ID NO: 324182 - protein, 9 aa, Influenza virus
VIREPCISC

SEQ ID NO: 324183 - protein, 9 aa, Influenza virus
IREPFVSCS

SEQ ID NO: 324184 - protein, 9 aa, Influenza virus
REPFISCSV

SEQ ID NO: 324185 - protein, 9 aa, Influenza virus
ISCSINECR

SEQ ID NO: 324186 - protein, 9 aa, Influenza virus
SCSINECRT

SEQ ID NO: 324187 - protein, 9 aa, Influenza virus
CSINECRTF

SEQ ID NO: 324188 - protein, 9 aa, Influenza virus
SINECRTFF

SEQ ID NO: 324189 - protein, 9 aa, Influenza virus
INECRTFFL

SEQ ID NO: 324190 - protein, 9 aa, Influenza virus
NECRTFFLT

SEQ ID NO: 324191 - protein, 9 aa, Influenza virus
FRTLMSCPM

SEQ ID NO: 324192 - protein, 9 aa, Influenza virus
RTLMSCPMG

SEQ ID NO: 324193 - protein, 9 aa, Influenza virus
TLMSCPMGV

SEQ ID NO: 324194 - protein, 9 aa, Influenza virus
LMSCPMGVA

SEQ ID NO: 324195 - protein, 9 aa, Influenza virus
MSCPMGVAP

SEQ ID NO: 324196 - protein, 9 aa, Influenza virus
SCPMGVAPS

SEQ ID NO: 324197 - protein, 9 aa, Influenza virus
CPMGVAPSP

SEQ ID NO: 324198 - protein, 9 aa, Influenza virus
PMGVAPSPS

SEQ ID NO: 324199 - protein, 9 aa, Influenza virus
MGVAPSPSN

SEQ ID NO: 324200 - protein, 9 aa, Influenza virus
SATACSDGS

SEQ ID NO: 324201 - protein, 9 aa, Influenza virus
ATACSDGSG

SEQ ID NO: 324202 - protein, 9 aa, Influenza virus
TACSDGSGW

SEQ ID NO: 324203 - protein, 9 aa, Influenza virus
ACSDGSGWL

SEQ ID NO: 324204 - protein, 9 aa, Influenza virus
CSDGSGWLT

SEQ ID NO: 324205 - protein, 9 aa, Influenza virus
SDGPGWLTI

SEQ ID NO: 324206 - protein, 9 aa, Influenza virus
DGPGWLTIG

SEQ ID NO: 324207 - protein, 9 aa, Influenza virus
GPGWLTIGI

SEQ ID NO: 324208 - protein, 9 aa, Influenza virus
PGWLTIGIT

SEQ ID NO: 324209 - protein, 9 aa, Influenza virus
GWLTIGITG

SEQ ID NO: 324210 - protein, 9 aa, Influenza virus
WLTIGITGP

SEQ ID NO: 324211 - protein, 9 aa, Influenza virus
LTIGITGPD

SEQ ID NO: 324212 - protein, 9 aa, Influenza virus
TLGITGPDS

SEQ ID NO: 324213 - protein, 9 aa, Influenza virus
LGITGPDST

SEQ ID NO: 324214 - protein, 9 aa, Influenza virus
GITGPDSTA

SEQ ID NO: 324215 - protein, 9 aa, Influenza virus
ITGPDSTAV

SEQ ID NO: 324216 - protein, 9 aa, Influenza virus
TGPDSTAVA

SEQ ID NO: 324217 - protein, 9 aa, Influenza virus
GPDSTAVAV

SEQ ID NO: 324218 - protein, 9 aa, Influenza virus
PDSTAVAVI

SEQ ID NO: 324219 - protein, 9 aa, Influenza virus
DSTAVAVIK

SEQ ID NO: 324220 - protein, 9 aa, Influenza virus
STAVAVIKY

SEQ ID NO: 324221 - protein, 9 aa, Influenza virus
TAVAVIKYN

SEQ ID NO: 324222 - protein, 9 aa, Influenza virus
AVAVIKYNG

SEQ ID NO: 324223 - protein, 9 aa, Influenza virus
VAVIKYNGI

SEQ ID NO: 324224 - protein, 9 aa, Influenza virus
AVIKYNGII

SEQ ID NO: 324225 - protein, 9 aa, Influenza virus
VIKYNGIIT

SEQ ID NO: 324226 - protein, 9 aa, Influenza virus
IKYNGIITD

SEQ ID NO: 324227 - protein, 9 aa, Influenza virus
KYNGVITDT

SEQ ID NO: 324228 - protein, 9 aa, Influenza virus
YNGVITDTL

SEQ ID NO: 324229 - protein, 9 aa, Influenza virus
NGVITDTLK

SEQ ID NO: 324230 - protein, 9 aa, Influenza virus
GVITDTLKS

SEQ ID NO: 324231 - protein, 9 aa, Influenza virus
VITDTLKSW

SEQ ID NO: 324232 - protein, 9 aa, Influenza virus
ITDTFKSWK

SEQ ID NO: 324233 - protein, 9 aa, Influenza virus
TDTFKSWKG

SEQ ID NO: 324234 - protein, 9 aa, Influenza virus
DTFKSWKGN

SEQ ID NO: 324235 - protein, 9 aa, Influenza virus
TFKSWKGNI

SEQ ID NO: 324236 - protein, 9 aa, Influenza virus
FKSWKGNIM

SEQ ID NO: 324237 - protein, 9 aa, Influenza virus
QDEFCYTLM

SEQ ID NO: 324238 - protein, 9 aa, Influenza virus
DEFCYTLMT

SEQ ID NO: 324239 - protein, 9 aa, Influenza virus
EFCYTLMTD

SEQ ID NO: 324240 - protein, 9 aa, Influenza virus
FCYTLMTDG

SEQ ID NO: 324241 - protein, 9 aa, Influenza virus
CYTLMTDGP

SEQ ID NO: 324242 - protein, 9 aa, Influenza virus
YTLMTDGPS

SEQ ID NO: 324243 - protein, 9 aa, Influenza virus
TLMTDGPSD

SEQ ID NO: 324244 - protein, 9 aa, Influenza virus
LMTDGPSDA

SEQ ID NO: 324245 - protein, 9 aa, Influenza virus
MTDGPSDAQ

SEQ ID NO: 324246 - protein, 9 aa, Influenza virus
TDGPSNAQA

SEQ ID NO: 324247 - protein, 9 aa, Influenza virus
DGPSNAQAF

SEQ ID NO: 324248 - protein, 9 aa, Influenza virus
GPSNAQAFY

SEQ ID NO: 324249 - protein, 9 aa, Influenza virus
PSNAQAFYK

SEQ ID NO: 324250 - protein, 9 aa, Influenza virus
SNAQAFYKI

SEQ ID NO: 324251 - protein, 9 aa, Influenza virus
NAQAFYKIL

SEQ ID NO: 324252 - protein, 9 aa, Influenza virus
GQAFYKILK

SEQ ID NO: 324253 - protein, 9 aa, Influenza virus
AFYKILKIK

SEQ ID NO: 324254 - protein, 9 aa, Influenza virus
FYKILKIKK

SEQ ID NO: 324255 - protein, 9 aa, Influenza virus
YKILKIKKG

SEQ ID NO: 324256 - protein, 9 aa, Influenza virus
KILKIKKGK

SEQ ID NO: 324257 - protein, 9 aa, Influenza virus
ILKIKKGKI

SEQ ID NO: 324258 - protein, 9 aa, Influenza virus
LKIKKGKIV

SEQ ID NO: 324259 - protein, 9 aa, Influenza virus
ATGYHFEEC

SEQ ID NO: 324260 - protein, 9 aa, Influenza virus
TGYHFEECS

SEQ ID NO: 324261 - protein, 9 aa, Influenza virus
GYHFEECSC

SEQ ID NO: 324262 - protein, 9 aa, Influenza virus
YHFEECSCY

SEQ ID NO: 324263 - protein, 9 aa, Influenza virus
ECSCYPSGE

SEQ ID NO: 324264 - protein, 9 aa, Influenza virus
CSCYPSGEN

SEQ ID NO: 324265 - protein, 9 aa, Influenza virus
NVECVCRDN

SEQ ID NO: 324266 - protein, 9 aa, Influenza virus
VECVCRDNW

SEQ ID NO: 324267 - protein, 9 aa, Influenza virus
WRGSNRPWV

SEQ ID NO: 324268 - protein, 9 aa, Influenza virus
QGSNRPWIR

SEQ ID NO: 324269 - protein, 9 aa, Influenza virus
RPWIRFNSN

SEQ ID NO: 324270 - protein, 9 aa, Influenza virus
PWIRFNSNL

SEQ ID NO: 324271 - protein, 9 aa, Influenza virus
WIRFNSNLD

SEQ ID NO: 324272 - protein, 9 aa, Influenza virus
IRFNSNLDY

SEQ ID NO: 324273 - protein, 9 aa, Influenza virus
RFNSNLDYQ

SEQ ID NO: 324274 - protein, 9 aa, Influenza virus
FNSNLDYQI

SEQ ID NO: 324275 - protein, 9 aa, Influenza virus
NSNLDYQIG

SEQ ID NO: 324276 - protein, 9 aa, Influenza virus
SNLDYQIGY

SEQ ID NO: 324277 - protein, 9 aa, Influenza virus
DLDYQIGYI

SEQ ID NO: 324278 - protein, 9 aa, Influenza virus
LDYQIGYIC

SEQ ID NO: 324279 - protein, 9 aa, Influenza virus
DYQIGYICS

SEQ ID NO: 324280 - protein, 9 aa, Influenza virus
YQIGYICSG

SEQ ID NO: 324281 - protein, 9 aa, Influenza virus
QIGYVCSGV

SEQ ID NO: 324282 - protein, 9 aa, Influenza virus
IGYVCSGVF

SEQ ID NO: 324283 - protein, 9 aa, Influenza virus
GYVCSGVFG

SEQ ID NO: 324284 - protein, 9 aa, Influenza virus
YVCSGVFGD

SEQ ID NO: 324285 - protein, 9 aa, Influenza virus
VCSGVFGDN

SEQ ID NO: 324286 - protein, 9 aa, Influenza virus
CSGVFGDNP

SEQ ID NO: 324287 - protein, 9 aa, Influenza virus
SGVFGDNPR

SEQ ID NO: 324288 - protein, 9 aa, Influenza virus
GVFGDNPRP

SEQ ID NO: 324289 - protein, 9 aa, Influenza virus
FGDNPRPAD

SEQ ID NO: 324290 - protein, 9 aa, Influenza virus
GDNPRPADG

SEQ ID NO: 324291 - protein, 9 aa, Influenza virus
PRPADGTGS

SEQ ID NO: 324292 - protein, 9 aa, Influenza virus
RPADGTGSC

SEQ ID NO: 324293 - protein, 9 aa, Influenza virus
GPINNGKGR

SEQ ID NO: 324294 - protein, 9 aa, Influenza virus
PINNGKGRY

SEQ ID NO: 324295 - protein, 9 aa, Influenza virus
INNGKGRYG

SEQ ID NO: 324296 - protein, 9 aa, Influenza virus
EVWIGRTKS

SEQ ID NO: 324297 - protein, 9 aa, Influenza virus
RTKNLESRS

SEQ ID NO: 324298 - protein, 9 aa, Influenza virus
TKNLESRSG

SEQ ID NO: 324299 - protein, 9 aa, Influenza virus
KSLESRRGF

SEQ ID NO: 324300 - protein, 9 aa, Influenza virus
SLESRRGFE

SEQ ID NO: 324301 - protein, 9 aa, Influenza virus
ESRSGFEMI

SEQ ID NO: 324302 - protein, 9 aa, Influenza virus
SRSGFEMIW

SEQ ID NO: 324303 - protein, 9 aa, Influenza virus
RSGFEMIWD

SEQ ID NO: 324304 - protein, 9 aa, Influenza virus
SGFEMIWDA

SEQ ID NO: 324305 - protein, 9 aa, Influenza virus
GFEMIWDAN

SEQ ID NO: 324306 - protein, 9 aa, Influenza virus
FEMIWDANG

SEQ ID NO: 324307 - protein, 9 aa, Influenza virus
EMIWDANGW

SEQ ID NO: 324308 - protein, 9 aa, Influenza virus
MIWDANGWV

SEQ ID NO: 324309 - protein, 9 aa, Influenza virus
IWDANGWVS

SEQ ID NO: 324310 - protein, 9 aa, Influenza virus
WDDNGWVST

SEQ ID NO: 324311 - protein, 9 aa, Influenza virus
DANGWVTAD

SEQ ID NO: 324312 - protein, 9 aa, Influenza virus
ANGWVTADK

SEQ ID NO: 324313 - protein, 9 aa, Influenza virus
NGWVSTDKN

SEQ ID NO: 324314 - protein, 9 aa, Influenza virus
GWVSTDKNS

SEQ ID NO: 324315 - protein, 9 aa, Influenza virus
WVSTDKNSN

SEQ ID NO: 324316 - protein, 9 aa, Influenza virus
VSTDKNSNG

SEQ ID NO: 324317 - protein, 9 aa, Influenza virus
STDKNSNGV

SEQ ID NO: 324318 - protein, 9 aa, Influenza virus
TDKNSNGVQ

SEQ ID NO: 324319 - protein, 9 aa, Influenza virus
DKNSNGVQD

SEQ ID NO: 324320 - protein, 9 aa, Influenza virus
KNSNGVQDI

SEQ ID NO: 324321 - protein, 9 aa, Influenza virus
NSNGVQDII

SEQ ID NO: 324322 - protein, 9 aa, Influenza virus
GVQDIIDNN

SEQ ID NO: 324323 - protein, 9 aa, Influenza virus
VQDIIDNNN

SEQ ID NO: 324324 - protein, 9 aa, Influenza virus
QDIIDNNNW

SEQ ID NO: 324325 - protein, 9 aa, Influenza virus
DIIDNNNWS

SEQ ID NO: 324326 - protein, 9 aa, Influenza virus
IIDNNNWSG

SEQ ID NO: 324327 - protein, 9 aa, Influenza virus
IDNNNWSGY

SEQ ID NO: 324328 - protein, 9 aa, Influenza virus
DNNNWSGYS

SEQ ID NO: 324329 - protein, 9 aa, Influenza virus
NNNWSGYSG

SEQ ID NO: 324330 - protein, 9 aa, Influenza virus
NNWSGYSGS

SEQ ID NO: 324331 - protein, 9 aa, Influenza virus
YSGSFSIRW

SEQ ID NO: 324332 - protein, 9 aa, Influenza virus
SGSFSIRWE

SEQ ID NO: 324333 - protein, 9 aa, Influenza virus
GSFSIRWET

SEQ ID NO: 324334 - protein, 9 aa, Influenza virus
SFSIRWETT

SEQ ID NO: 324335 - protein, 9 aa, Influenza virus
FSIRWETTG

SEQ ID NO: 324336 - protein, 9 aa, Influenza virus
SIRWETTGR

SEQ ID NO: 324337 - protein, 9 aa, Influenza virus
IRWETTGRN

SEQ ID NO: 324338 - protein, 9 aa, Influenza virus
RWETTGRNC

SEQ ID NO: 324339 - protein, 9 aa, Influenza virus
WETTGRNCT

SEQ ID NO: 324340 - protein, 9 aa, Influenza virus
ETTGRNCTI

SEQ ID NO: 324341 - protein, 9 aa, Influenza virus
TTGRNCTIP

SEQ ID NO: 324342 - protein, 9 aa, Influenza virus
TGRNCTIPC

SEQ ID NO: 324343 - protein, 9 aa, Influenza virus
GRNCTIPCF

SEQ ID NO: 324344 - protein, 9 aa, Influenza virus
RNCTIPCFW

SEQ ID NO: 324345 - protein, 9 aa, Influenza virus
NCTIPCFWV

SEQ ID NO: 324346 - protein, 9 aa, Influenza virus
CTIPCFWVE

SEQ ID NO: 324347 - protein, 9 aa, Influenza virus
TIPCFWVEM

SEQ ID NO: 324348 - protein, 9 aa, Influenza virus
IPCFWVEMI

SEQ ID NO: 324349 - protein, 9 aa, Influenza virus
MIRGQPNER

SEQ ID NO: 324350 - protein, 9 aa, Influenza virus
IRGQPKEKA

SEQ ID NO: 324351 - protein, 9 aa, Influenza virus
RGQPKEKAI

SEQ ID NO: 324352 - protein, 9 aa, Influenza virus
GQPKEKAIW

SEQ ID NO: 324353 - protein, 9 aa, Influenza virus
QPKEKAIWT

SEQ ID NO: 324354 - protein, 9 aa, Influenza virus
PKEKAIWTS

SEQ ID NO: 324355 - protein, 9 aa, Influenza virus
KEKAIWTSG

SEQ ID NO: 324356 - protein, 9 aa, Influenza virus
EKAIWTSGS

SEQ ID NO: 324357 - protein, 9 aa, Influenza virus
KAIWTSGSS

SEQ ID NO: 324358 - protein, 9 aa, Influenza virus
AIWTSGSSI

SEQ ID NO: 324359 - protein, 9 aa, Influenza virus
SSIAFCGVD

SEQ ID NO: 324360 - protein, 9 aa, Influenza virus
SIAFCGVDS

SEQ ID NO: 324361 - protein, 9 aa, Influenza virus
IAFCGVDSD

SEQ ID NO: 324362 - protein, 9 aa, Influenza virus
AFCGVDSDT

SEQ ID NO: 324363 - protein, 9 aa, Influenza virus
FCGVDSDTT

SEQ ID NO: 324364 - protein, 9 aa, Influenza virus
CGVDSDTTG

SEQ ID NO: 324365 - protein, 9 aa, Influenza virus
GVDSDTTGW

SEQ ID NO: 324366 - protein, 9 aa, Influenza virus
SDTTSWSWP

SEQ ID NO: 324367 - protein, 9 aa, Influenza virus
DTTSWSWPD

SEQ ID NO: 324368 - protein, 9 aa, Influenza virus
TTSWSWPDG

SEQ ID NO: 324369 - protein, 9 aa, Influenza virus
TSWSWPDGA

SEQ ID NO: 324370 - protein, 9 aa, Influenza virus
SWSWPDGAL

SEQ ID NO: 324371 - protein, 9 aa, Influenza virus
WPWPDGALL

SEQ ID NO: 324372 - protein, 9 aa, Influenza virus
SWPDGALFP

SEQ ID NO: 324373 - protein, 9 aa, Influenza virus
WPDGALLPL

SEQ ID NO: 324374 - protein, 9 aa, Influenza virus
PDGALLPLT

SEQ ID NO: 324375 - protein, 9 aa, Influenza virus
ALLPFDIDR

SEQ ID NO: 324376 - protein, 9 aa, Influenza virus
QKIITIGSI

SEQ ID NO: 324377 - protein, 9 aa, Influenza virus
KIITIGSIS

SEQ ID NO: 324378 - protein, 9 aa, Influenza virus
IITIGSISL

SEQ ID NO: 324379 - protein, 9 aa, Influenza virus
TIGSISLGL

SEQ ID NO: 324380 - protein, 9 aa, Influenza virus
NILLHVASI

SEQ ID NO: 324381 - protein, 9 aa, Influenza virus
TTEIYNETV

SEQ ID NO: 324382 - protein, 9 aa, Influenza virus
TEIYNETVR

SEQ ID NO: 324383 - protein, 9 aa, Influenza virus
EVYNETVRL

SEQ ID NO: 324384 - protein, 9 aa, Influenza virus
VYNETVRLE

SEQ ID NO: 324385 - protein, 9 aa, Influenza virus
YNETVRVET

SEQ ID NO: 324386 - protein, 9 aa, Influenza virus
IIPVNNTIY

SEQ ID NO: 324387 - protein, 9 aa, Influenza virus
DFLNNTEPL

SEQ ID NO: 324388 - protein, 9 aa, Influenza virus
FFNNTEPLC

SEQ ID NO: 324389 - protein, 9 aa, Influenza virus
LNNTEPLCE

SEQ ID NO: 324390 - protein, 9 aa, Influenza virus
NNTEPLCEV

SEQ ID NO: 324391 - protein, 9 aa, Influenza virus
NTEPLCEVS

SEQ ID NO: 324392 - protein, 9 aa, Influenza virus
TEPLCEVSG

SEQ ID NO: 324393 - protein, 9 aa, Influenza virus
EPLCEVSGF

SEQ ID NO: 324394 - protein, 9 aa, Influenza virus
PLCEVSGFA

SEQ ID NO: 324395 - protein, 9 aa, Influenza virus
LCEVSGFAI

SEQ ID NO: 324396 - protein, 9 aa, Influenza virus
SGFAIFSKD

SEQ ID NO: 324397 - protein, 9 aa, Influenza virus
GFAIFSKDN

SEQ ID NO: 324398 - protein, 9 aa, Influenza virus
FAIISKDNG

SEQ ID NO: 324399 - protein, 9 aa, Influenza virus
AIFSKDNGI

SEQ ID NO: 324400 - protein, 9 aa, Influenza virus
IFSKDNGIR

SEQ ID NO: 324401 - protein, 9 aa, Influenza virus
VSKDNGIRV

SEQ ID NO: 324402 - protein, 9 aa, Influenza virus
SKDNGIRVG

SEQ ID NO: 324403 - protein, 9 aa, Influenza virus
KDNGIRVGS

SEQ ID NO: 324404 - protein, 9 aa, Influenza virus
DNGIRVGSR

SEQ ID NO: 324405 - protein, 9 aa, Influenza virus
NGIRVGSRG

SEQ ID NO: 324406 - protein, 9 aa, Influenza virus
GIRVGSRGH

SEQ ID NO: 324407 - protein, 9 aa, Influenza virus
IRIGSRGHI

SEQ ID NO: 324408 - protein, 9 aa, Influenza virus
RIGSRGHIF

SEQ ID NO: 324409 - protein, 9 aa, Influenza virus
IGSRGHIFV

SEQ ID NO: 324410 - protein, 9 aa, Influenza virus
GSRGHIFVI

SEQ ID NO: 324411 - protein, 9 aa, Influenza virus
SRGHIFVIR

SEQ ID NO: 324412 - protein, 9 aa, Influenza virus
RGHIFVIRE

SEQ ID NO: 324413 - protein, 9 aa, Influenza virus
GHIFVIREP

SEQ ID NO: 324414 - protein, 9 aa, Influenza virus
HIFVIREPF

SEQ ID NO: 324415 - protein, 9 aa, Influenza virus
IFVIREPFV

SEQ ID NO: 324416 - protein, 9 aa, Influenza virus
FVIREPFVS

SEQ ID NO: 324417 - protein, 9 aa, Influenza virus
VIREPFVSC

SEQ ID NO: 324418 - protein, 9 aa, Influenza virus
IREPFVSCG

SEQ ID NO: 324419 - protein, 9 aa, Influenza virus
REPFVSCGP

SEQ ID NO: 324420 - protein, 9 aa, Influenza virus
EPFVACGPS

SEQ ID NO: 324421 - protein, 9 aa, Influenza virus
PFVACGPSE

SEQ ID NO: 324422 - protein, 9 aa, Influenza virus
FVACGPSEC

SEQ ID NO: 324423 - protein, 9 aa, Influenza virus
VACGPSECR

SEQ ID NO: 324424 - protein, 9 aa, Influenza virus
ACGPSECRT

SEQ ID NO: 324425 - protein, 9 aa, Influenza virus
CGPSECRTF

SEQ ID NO: 324426 - protein, 9 aa, Influenza virus
GPSECRTFF

SEQ ID NO: 324427 - protein, 9 aa, Influenza virus
PSECRTFFL

SEQ ID NO: 324428 - protein, 9 aa, Influenza virus
SECRTFFLT

SEQ ID NO: 324429 - protein, 9 aa, Influenza virus
TPCVLLNDK

SEQ ID NO: 324430 - protein, 9 aa, Influenza virus
QGALLNDRH

SEQ ID NO: 324431 - protein, 9 aa, Influenza virus
GALLNDRHS

SEQ ID NO: 324432 - protein, 9 aa, Influenza virus
ALLNDRHSN

SEQ ID NO: 324433 - protein, 9 aa, Influenza virus
DKHSNNTVR

SEQ ID NO: 324434 - protein, 9 aa, Influenza virus
KHSNNTVRD

SEQ ID NO: 324435 - protein, 9 aa, Influenza virus
YRALMSVLL

SEQ ID NO: 324436 - protein, 9 aa, Influenza virus
RALMSVPMG

SEQ ID NO: 324437 - protein, 9 aa, Influenza virus
ALMSVPMGS

SEQ ID NO: 324438 - protein, 9 aa, Influenza virus
LMSVLLGSS

SEQ ID NO: 324439 - protein, 9 aa, Influenza virus
MSVPLGSSS

SEQ ID NO: 324440 - protein, 9 aa, Influenza virus
SVLLGSSPN

SEQ ID NO: 324441 - protein, 9 aa, Influenza virus
VPMGSSPNA

SEQ ID NO: 324442 - protein, 9 aa, Influenza virus
PMGSSPNAY

SEQ ID NO: 324443 - protein, 9 aa, Influenza virus
MGSSPNAYQ

SEQ ID NO: 324444 - protein, 9 aa, Influenza virus
SSPNAYQAR

SEQ ID NO: 324445 - protein, 9 aa, Influenza virus
SPNAYQARF

SEQ ID NO: 324446 - protein, 9 aa, Influenza virus
PNAYQARFE

SEQ ID NO: 324447 - protein, 9 aa, Influenza virus
NAYQARFES

SEQ ID NO: 324448 - protein, 9 aa, Influenza virus
AYQARFESV

SEQ ID NO: 324449 - protein, 9 aa, Influenza virus
FESVGWSAT

SEQ ID NO: 324450 - protein, 9 aa, Influenza virus
ESVGWSATA

SEQ ID NO: 324451 - protein, 9 aa, Influenza virus
SVGWSATAC

SEQ ID NO: 324452 - protein, 9 aa, Influenza virus
VGWSATACH

SEQ ID NO: 324453 - protein, 9 aa, Influenza virus
GWSATACHD

SEQ ID NO: 324454 - protein, 9 aa, Influenza virus
ATACHDGKK

SEQ ID NO: 324455 - protein, 9 aa, Influenza virus
TACHDGKKW

SEQ ID NO: 324456 - protein, 9 aa, Influenza virus
ACHDGKKWL

SEQ ID NO: 324457 - protein, 9 aa, Influenza virus
GVSGADDDA

SEQ ID NO: 324458 - protein, 9 aa, Influenza virus
VSGADDDAY

SEQ ID NO: 324459 - protein, 9 aa, Influenza virus
SGADNDAYA

SEQ ID NO: 324460 - protein, 9 aa, Influenza virus
GADNDAYAV

SEQ ID NO: 324461 - protein, 9 aa, Influenza virus
ADNDAYAVI

SEQ ID NO: 324462 - protein, 9 aa, Influenza virus
DNDAYAVIH

SEQ ID NO: 324463 - protein, 9 aa, Influenza virus
NDAYAVIHY

SEQ ID NO: 324464 - protein, 9 aa, Influenza virus
YAVIHYGGV

SEQ ID NO: 324465 - protein, 9 aa, Influenza virus
AVIHYGGVP

SEQ ID NO: 324466 - protein, 9 aa, Influenza virus
VIHYGGVPT

SEQ ID NO: 324467 - protein, 9 aa, Influenza virus
IHYGGVPTD

SEQ ID NO: 324468 - protein, 9 aa, Influenza virus
HYGGVPTDV

SEQ ID NO: 324469 - protein, 9 aa, Influenza virus
YGGVPTDVV

SEQ ID NO: 324470 - protein, 9 aa, Influenza virus
GGVPTDVVR

SEQ ID NO: 324471 - protein, 9 aa, Influenza virus
GVPTDVVRS

SEQ ID NO: 324472 - protein, 9 aa, Influenza virus
VPTDVVRSW

SEQ ID NO: 324473 - protein, 9 aa, Influenza virus
PTDVVRSWK

SEQ ID NO: 324474 - protein, 9 aa, Influenza virus
TDVVRSWKK

SEQ ID NO: 324475 - protein, 9 aa, Influenza virus
DVVRSWKKQ

SEQ ID NO: 324476 - protein, 9 aa, Influenza virus
VVRSWKKQI

SEQ ID NO: 324477 - protein, 9 aa, Influenza virus
VRSWKKQIL

SEQ ID NO: 324478 - protein, 9 aa, Influenza virus
RSWKKQILR

SEQ ID NO: 324479 - protein, 9 aa, Influenza virus
SWKKQILRT

SEQ ID NO: 324480 - protein, 9 aa, Influenza virus
WKKQILRTQ

SEQ ID NO: 324481 - protein, 9 aa, Influenza virus
KKQILRTQE

SEQ ID NO: 324482 - protein, 9 aa, Influenza virus
KKILRTQES

SEQ ID NO: 324483 - protein, 9 aa, Influenza virus
KILRTQESS

SEQ ID NO: 324484 - protein, 9 aa, Influenza virus
TQESSCVCV

SEQ ID NO: 324485 - protein, 9 aa, Influenza virus
QESSCVCMN

SEQ ID NO: 324486 - protein, 9 aa, Influenza virus
ESSCVCMNG

SEQ ID NO: 324487 - protein, 9 aa, Influenza virus
WVMTDGPAS

SEQ ID NO: 324488 - protein, 9 aa, Influenza virus
VMTDGPANS

SEQ ID NO: 324489 - protein, 9 aa, Influenza virus
MTDGPANSQ

SEQ ID NO: 324490 - protein, 9 aa, Influenza virus
TDGPANSQA

SEQ ID NO: 324491 - protein, 9 aa, Influenza virus
DGPANSQAS

SEQ ID NO: 324492 - protein, 9 aa, Influenza virus
GPANSQASY

SEQ ID NO: 324493 - protein, 9 aa, Influenza virus
PANSQASYK

SEQ ID NO: 324494 - protein, 9 aa, Influenza virus
ANSQASYKI

SEQ ID NO: 324495 - protein, 9 aa, Influenza virus
NSQASYKIF

SEQ ID NO: 324496 - protein, 9 aa, Influenza virus
SQASYKIFK

SEQ ID NO: 324497 - protein, 9 aa, Influenza virus
QASYRIFKS

SEQ ID NO: 324498 - protein, 9 aa, Influenza virus
ASYKIFKSQ

SEQ ID NO: 324499 - protein, 9 aa, Influenza virus
EISFQGGHI

SEQ ID NO: 324500 - protein, 9 aa, Influenza virus
ISFQGGHIE

SEQ ID NO: 324501 - protein, 9 aa, Influenza virus
LFQGGHIEE

SEQ ID NO: 324502 - protein, 9 aa, Influenza virus
FRGGHIEEC

SEQ ID NO: 324503 - protein, 9 aa, Influenza virus
QSGHIEECS

SEQ ID NO: 324504 - protein, 9 aa, Influenza virus
EECSCYPNM

SEQ ID NO: 324505 - protein, 9 aa, Influenza virus
ECSCYPNMG

SEQ ID NO: 324506 - protein, 9 aa, Influenza virus
CSCYPNMGK

SEQ ID NO: 324507 - protein, 9 aa, Influenza virus
SCYPNMGKV

SEQ ID NO: 324508 - protein, 9 aa, Influenza virus
CYPNMGKVE

SEQ ID NO: 324509 - protein, 9 aa, Influenza virus
YPNMGKVEC

SEQ ID NO: 324510 - protein, 9 aa, Influenza virus
PNMGKVECV

SEQ ID NO: 324511 - protein, 9 aa, Influenza virus
NMGKVECVC

SEQ ID NO: 324512 - protein, 9 aa, Influenza virus
MGKVECVCR

SEQ ID NO: 324513 - protein, 9 aa, Influenza virus
GQVECVCRD

SEQ ID NO: 324514 - protein, 9 aa, Influenza virus
QVECVCRDN

SEQ ID NO: 324515 - protein, 9 aa, Influenza virus
NWNGMNRPV

SEQ ID NO: 324516 - protein, 9 aa, Influenza virus
WNGMNRPVL

SEQ ID NO: 324517 - protein, 9 aa, Influenza virus
YNVGYLCAG

SEQ ID NO: 324518 - protein, 9 aa, Influenza virus
NVGYLCAGI

SEQ ID NO: 324519 - protein, 9 aa, Influenza virus
GIPTDTPRI

SEQ ID NO: 324520 - protein, 9 aa, Influenza virus
IPTDTPRIQ

SEQ ID NO: 324521 - protein, 9 aa, Influenza virus
PTDTPRIQD

SEQ ID NO: 324522 - protein, 9 aa, Influenza virus
TDTPRVQDN

SEQ ID NO: 324523 - protein, 9 aa, Influenza virus
AIGGSGTNN

SEQ ID NO: 324524 - protein, 9 aa, Influenza virus
IGGSGTNNY

SEQ ID NO: 324525 - protein, 9 aa, Influenza virus
GGSGTDNYG

SEQ ID NO: 324526 - protein, 9 aa, Influenza virus
GSGTDNYGV

SEQ ID NO: 324527 - protein, 9 aa, Influenza virus
SGTDNYGVK

SEQ ID NO: 324528 - protein, 9 aa, Influenza virus
GTDNYGVKG

SEQ ID NO: 324529 - protein, 9 aa, Influenza virus
TDNYGVKGF

SEQ ID NO: 324530 - protein, 9 aa, Influenza virus
DNYGVKGFG

SEQ ID NO: 324531 - protein, 9 aa, Influenza virus
KGFGFRQGT

SEQ ID NO: 324532 - protein, 9 aa, Influenza virus
GFGFRQGTS

SEQ ID NO: 324533 - protein, 9 aa, Influenza virus
FGFRQGTSV

SEQ ID NO: 324534 - protein, 9 aa, Influenza virus
GFRQGTSVW

SEQ ID NO: 324535 - protein, 9 aa, Influenza virus
FRQGTSVWA

SEQ ID NO: 324536 - protein, 9 aa, Influenza virus
RQGTSVWAG

SEQ ID NO: 324537 - protein, 9 aa, Influenza virus
QGTSVWAGR

SEQ ID NO: 324538 - protein, 9 aa, Influenza virus
GTSVWAGRT

SEQ ID NO: 324539 - protein, 9 aa, Influenza virus
NSVWAGRTI

SEQ ID NO: 324540 - protein, 9 aa, Influenza virus
SVWAGRTIS

SEQ ID NO: 324541 - protein, 9 aa, Influenza virus
STSSRSGFE

SEQ ID NO: 324542 - protein, 9 aa, Influenza virus
SSRSGFEVL

SEQ ID NO: 324543 - protein, 9 aa, Influenza virus
SRSGFEVLL

SEQ ID NO: 324544 - protein, 9 aa, Influenza virus
RSGFEVLLI

SEQ ID NO: 324545 - protein, 9 aa, Influenza virus
SGFEVLLIE

SEQ ID NO: 324546 - protein, 9 aa, Influenza virus
GFEVLLIED

SEQ ID NO: 324547 - protein, 9 aa, Influenza virus
FEVLLIEDG

SEQ ID NO: 324548 - protein, 9 aa, Influenza virus
EVLLIEDGW

SEQ ID NO: 324549 - protein, 9 aa, Influenza virus
EVLNNMNWS

SEQ ID NO: 324550 - protein, 9 aa, Influenza virus
VLNNKHWSG

SEQ ID NO: 324551 - protein, 9 aa, Influenza virus
LDNKNWSGY

SEQ ID NO: 324552 - protein, 9 aa, Influenza virus
NNKHWSGYS

SEQ ID NO: 324553 - protein, 9 aa, Influenza virus
NMNWSGYSG

SEQ ID NO: 324554 - protein, 9 aa, Influenza virus
KNWSGYSGS

SEQ ID NO: 324555 - protein, 9 aa, Influenza virus
NWSGYSGSF

SEQ ID NO: 324556 - protein, 9 aa, Influenza virus
WSGYSGSFT

SEQ ID NO: 324557 - protein, 9 aa, Influenza virus
SGYSGSFTI

SEQ ID NO: 324558 - protein, 9 aa, Influenza virus
GYSGSFTIP

SEQ ID NO: 324559 - protein, 9 aa, Influenza virus
YSGAFTIPT

SEQ ID NO: 324560 - protein, 9 aa, Influenza virus
CIVPCFWLE

SEQ ID NO: 324561 - protein, 9 aa, Influenza virus
IVPCFWLEM

SEQ ID NO: 324562 - protein, 9 aa, Influenza virus
FWLEMIRGR

SEQ ID NO: 324563 - protein, 9 aa, Influenza virus
WLEMIRGRP

SEQ ID NO: 324564 - protein, 9 aa, Influenza virus
LEMIRGRPE

SEQ ID NO: 324565 - protein, 9 aa, Influenza virus
EMIRGRPEE

SEQ ID NO: 324566 - protein, 9 aa, Influenza virus
MIRGRPEER

SEQ ID NO: 324567 - protein, 9 aa, Influenza virus
PEEGTSIWT

SEQ ID NO: 324568 - protein, 9 aa, Influenza virus
EEGTSIWTS

SEQ ID NO: 324569 - protein, 9 aa, Influenza virus
EGTSIWTSS

SEQ ID NO: 324570 - protein, 9 aa, Influenza virus
GTSIWTSSS

SEQ ID NO: 324571 - protein, 9 aa, Influenza virus
NSIWTSSSS

SEQ ID NO: 324572 - protein, 9 aa, Influenza virus
STVFCGVSG

SEQ ID NO: 324573 - protein, 9 aa, Influenza virus
TVFCGVSGE

SEQ ID NO: 324574 - protein, 9 aa, Influenza virus
VFCGVSGEV

SEQ ID NO: 324575 - protein, 9 aa, Influenza virus
FCGVSGEVP

SEQ ID NO: 324576 - protein, 9 aa, Influenza virus
CGVSGEVPG

SEQ ID NO: 324577 - protein, 9 aa, Influenza virus
GVSGEVPGW

SEQ ID NO: 324578 - protein, 9 aa, Influenza virus
VSGEVPGWS

SEQ ID NO: 324579 - protein, 9 aa, Influenza virus
SGEVPGWSW

SEQ ID NO: 324580 - protein, 9 aa, Influenza virus
GEVPGWSWD

SEQ ID NO: 324581 - protein, 9 aa, Influenza virus
EAPGWSWDD

SEQ ID NO: 324582 - protein, 9 aa, Influenza virus
APGWSWDDG

SEQ ID NO: 324583 - protein, 9 aa, Influenza virus
PGWSWGDGA

SEQ ID NO: 324584 - protein, 9 aa, Influenza virus
EWSWDDGAI

SEQ ID NO: 324585 - protein, 9 aa, Influenza virus
WDDGAILPL

SEQ ID NO: 324586 - protein, 9 aa, Influenza virus
DDGAILPFG

SEQ ID NO: 324587 - protein, 9 aa, Influenza virus
DGAILPFGI

SEQ ID NO: 324588 - protein, 9 aa, Influenza virus
GAILPFGID

SEQ ID NO: 324589 - protein, 9 aa, Influenza virus
AILPLTSIR

SEQ ID NO: 324590 - protein, 9 aa, Influenza virus
MNPNQKITC

SEQ ID NO: 324591 - protein, 9 aa, Influenza virus
NPNQKITCI

SEQ ID NO: 324592 - protein, 9 aa, Influenza virus
PNQKITCIS

SEQ ID NO: 324593 - protein, 9 aa, Influenza virus
NQKITCISA

SEQ ID NO: 324594 - protein, 9 aa, Influenza virus
CISATGVTL

SEQ ID NO: 324595 - protein, 9 aa, Influenza virus
ISATGVTLS

SEQ ID NO: 324596 - protein, 9 aa, Influenza virus
SATGVTLSV

SEQ ID NO: 324597 - protein, 9 aa, Influenza virus
ATGVTLSVV

SEQ ID NO: 324598 - protein, 9 aa, Influenza virus
TGVTLSVVS

SEQ ID NO: 324599 - protein, 9 aa, Influenza virus
GVTLSVVSL

SEQ ID NO: 324600 - protein, 9 aa, Influenza virus
VTLSVVSLL

SEQ ID NO: 324601 - protein, 9 aa, Influenza virus
LSVVSLLVG

SEQ ID NO: 324602 - protein, 9 aa, Influenza virus
GIANLGLNI

SEQ ID NO: 324603 - protein, 9 aa, Influenza virus
IANLGLNIG

SEQ ID NO: 324604 - protein, 9 aa, Influenza virus
ANLGLNIGI

SEQ ID NO: 324605 - protein, 9 aa, Influenza virus
NLGLNIGIH

SEQ ID NO: 324606 - protein, 9 aa, Influenza virus
KPLCEVSSW

SEQ ID NO: 324607 - protein, 9 aa, Influenza virus
PLCEVSSWH

SEQ ID NO: 324608 - protein, 9 aa, Influenza virus
LCEVSSWHI

SEQ ID NO: 324609 - protein, 9 aa, Influenza virus
CEVSSWHIL

SEQ ID NO: 324610 - protein, 9 aa, Influenza virus
EVSSWHILS

SEQ ID NO: 324611 - protein, 9 aa, Influenza virus
VSSWHILSK

SEQ ID NO: 324612 - protein, 9 aa, Influenza virus
SSWHILSKD

SEQ ID NO: 324613 - protein, 9 aa, Influenza virus
SWHIFSKDN

SEQ ID NO: 324614 - protein, 9 aa, Influenza virus
WHIFSKDNA

SEQ ID NO: 324615 - protein, 9 aa, Influenza virus
HIFSKDNAI

SEQ ID NO: 324616 - protein, 9 aa, Influenza virus
IFSKDNAIR

SEQ ID NO: 324617 - protein, 9 aa, Influenza virus
FSKDNAIRI

SEQ ID NO: 324618 - protein, 9 aa, Influenza virus
DNAIRIGEN

SEQ ID NO: 324619 - protein, 9 aa, Influenza virus
NAIRIGENA

SEQ ID NO: 324620 - protein, 9 aa, Influenza virus
AIRIGENAH

SEQ ID NO: 324621 - protein, 9 aa, Influenza virus
RIGENAHIL

SEQ ID NO: 324622 - protein, 9 aa, Influenza virus
NAHILVTRE

SEQ ID NO: 324623 - protein, 9 aa, Influenza virus
AHVLVTREP

SEQ ID NO: 324624 - protein, 9 aa, Influenza virus
HVLVTREPY

SEQ ID NO: 324625 - protein, 9 aa, Influenza virus
VLVTREPYL

SEQ ID NO: 324626 - protein, 9 aa, Influenza virus
TREPYLSCD

SEQ ID NO: 324627 - protein, 9 aa, Influenza virus
REPYLSCDP

SEQ ID NO: 324628 - protein, 9 aa, Influenza virus
GCRMFALSQ

SEQ ID NO: 324629 - protein, 9 aa, Influenza virus
LSQGTTLKG

SEQ ID NO: 324630 - protein, 9 aa, Influenza virus
SQGTTLRGQ

SEQ ID NO: 324631 - protein, 9 aa, Influenza virus
QGTTLRGQH

SEQ ID NO: 324632 - protein, 9 aa, Influenza virus
GTTLRGQHA

SEQ ID NO: 324633 - protein, 9 aa, Influenza virus
TTLRGQHAN

SEQ ID NO: 324634 - protein, 9 aa, Influenza virus
TLRGQHANG

SEQ ID NO: 324635 - protein, 9 aa, Influenza virus
LRGQHANGT

SEQ ID NO: 324636 - protein, 9 aa, Influenza virus
RGQHANGTI

SEQ ID NO: 324637 - protein, 9 aa, Influenza virus
GQHANGTIH

SEQ ID NO: 324638 - protein, 9 aa, Influenza virus
QHANGTIHD

SEQ ID NO: 324639 - protein, 9 aa, Influenza virus
HANGTMHDR

SEQ ID NO: 324640 - protein, 9 aa, Influenza virus
ANGTMHDRS

SEQ ID NO: 324641 - protein, 9 aa, Influenza virus
NGTIHDRSQ

SEQ ID NO: 324642 - protein, 9 aa, Influenza virus
GTIHDRSQF

SEQ ID NO: 324643 - protein, 9 aa, Influenza virus
TIHDRSQFR

SEQ ID NO: 324644 - protein, 9 aa, Influenza virus
IHDRSQFRA

SEQ ID NO: 324645 - protein, 9 aa, Influenza virus
HDRSQFRAL

SEQ ID NO: 324646 - protein, 9 aa, Influenza virus
DRSPFRALV

SEQ ID NO: 324647 - protein, 9 aa, Influenza virus
RSPFRALVS

SEQ ID NO: 324648 - protein, 9 aa, Influenza virus
SPFRALVSW

SEQ ID NO: 324649 - protein, 9 aa, Influenza virus
PFRALVSWE

SEQ ID NO: 324650 - protein, 9 aa, Influenza virus
FRALVSWEM

SEQ ID NO: 324651 - protein, 9 aa, Influenza virus
RALVSWEMG

SEQ ID NO: 324652 - protein, 9 aa, Influenza virus
ALVSWEMGQ

SEQ ID NO: 324653 - protein, 9 aa, Influenza virus
LVSWEMGQA

SEQ ID NO: 324654 - protein, 9 aa, Influenza virus
VSWEMGQAP

SEQ ID NO: 324655 - protein, 9 aa, Influenza virus
SWGMGQAPS

SEQ ID NO: 324656 - protein, 9 aa, Influenza virus
WGMGQAPSP

SEQ ID NO: 324657 - protein, 9 aa, Influenza virus
GMGQAPSPY

SEQ ID NO: 324658 - protein, 9 aa, Influenza virus
MGQAPSPYT

SEQ ID NO: 324659 - protein, 9 aa, Influenza virus
VECIGWSST

SEQ ID NO: 324660 - protein, 9 aa, Influenza virus
ECIGWSSTS

SEQ ID NO: 324661 - protein, 9 aa, Influenza virus
CIGWSSTSC

SEQ ID NO: 324662 - protein, 9 aa, Influenza virus
IGWSSTSCH

SEQ ID NO: 324663 - protein, 9 aa, Influenza virus
SSTSCHDGM

SEQ ID NO: 324664 - protein, 9 aa, Influenza virus
STSCHDGMS

SEQ ID NO: 324665 - protein, 9 aa, Influenza virus
TSCHDGMSR

SEQ ID NO: 324666 - protein, 9 aa, Influenza virus
SCHDGMSRM

SEQ ID NO: 324667 - protein, 9 aa, Influenza virus
CHDGMSRMS

SEQ ID NO: 324668 - protein, 9 aa, Influenza virus
SRMSICISG

SEQ ID NO: 324669 - protein, 9 aa, Influenza virus
RMSICISGP

SEQ ID NO: 324670 - protein, 9 aa, Influenza virus
MSICISGPN

SEQ ID NO: 324671 - protein, 9 aa, Influenza virus
SICISGPNN

SEQ ID NO: 324672 - protein, 9 aa, Influenza virus
ICISGPNNN

SEQ ID NO: 324673 - protein, 9 aa, Influenza virus
CISGPNNNA

SEQ ID NO: 324674 - protein, 9 aa, Influenza virus
ISGPNNNAS

SEQ ID NO: 324675 - protein, 9 aa, Influenza virus
SGPNDNASA

SEQ ID NO: 324676 - protein, 9 aa, Influenza virus
GPNDNASAV

SEQ ID NO: 324677 - protein, 9 aa, Influenza virus
PNDNASAVV

SEQ ID NO: 324678 - protein, 9 aa, Influenza virus
NDNASAVVW

SEQ ID NO: 324679 - protein, 9 aa, Influenza virus
DNASAVVWY

SEQ ID NO: 324680 - protein, 9 aa, Influenza virus
TEIPSWAGN

SEQ ID NO: 324681 - protein, 9 aa, Influenza virus
EIPSWAGNI

SEQ ID NO: 324682 - protein, 9 aa, Influenza virus
IPSWAGNIL

SEQ ID NO: 324683 - protein, 9 aa, Influenza virus
PSWAGNILR

SEQ ID NO: 324684 - protein, 9 aa, Influenza virus
SWEGNILRT

SEQ ID NO: 324685 - protein, 9 aa, Influenza virus
WEGNILRTQ

SEQ ID NO: 324686 - protein, 9 aa, Influenza virus
EGNILRTQE

SEQ ID NO: 324687 - protein, 9 aa, Influenza virus
QESECVCHK

SEQ ID NO: 324688 - protein, 9 aa, Influenza virus
ESECVCHKG

SEQ ID NO: 324689 - protein, 9 aa, Influenza virus
SECVCHKGI

SEQ ID NO: 324690 - protein, 9 aa, Influenza virus
ECVCHKGIC

SEQ ID NO: 324691 - protein, 9 aa, Influenza virus
CVCHKGICP

SEQ ID NO: 324692 - protein, 9 aa, Influenza virus
VCHKGICPV

SEQ ID NO: 324693 - protein, 9 aa, Influenza virus
CHKGICPVV

SEQ ID NO: 324694 - protein, 9 aa, Influenza virus
GVCPVVMTD

SEQ ID NO: 324695 - protein, 9 aa, Influenza virus
VCPVVMTDG

SEQ ID NO: 324696 - protein, 9 aa, Influenza virus
VVMTDGPAS

SEQ ID NO: 324697 - protein, 9 aa, Influenza virus
TDGPANNKA

SEQ ID NO: 324698 - protein, 9 aa, Influenza virus
GNAQHIEEC

SEQ ID NO: 324699 - protein, 9 aa, Influenza virus
NAQHIEECS

SEQ ID NO: 324700 - protein, 9 aa, Influenza virus
IEECSCYGS

SEQ ID NO: 324701 - protein, 9 aa, Influenza virus
VKCICRDNW

SEQ ID NO: 324702 - protein, 9 aa, Influenza virus
KCVCRDNWK

SEQ ID NO: 324703 - protein, 9 aa, Influenza virus
CVCRDNWKG

SEQ ID NO: 324704 - protein, 9 aa, Influenza virus
VCRDNWKGA

SEQ ID NO: 324705 - protein, 9 aa, Influenza virus
CRDNWRGAN

SEQ ID NO: 324706 - protein, 9 aa, Influenza virus
RDNWRGANR

SEQ ID NO: 324707 - protein, 9 aa, Influenza virus
DNWRGANRP

SEQ ID NO: 324708 - protein, 9 aa, Influenza virus
NWKGANRPI

SEQ ID NO: 324709 - protein, 9 aa, Influenza virus
WKGANRPII

SEQ ID NO: 324710 - protein, 9 aa, Influenza virus
KGANRPIIT

SEQ ID NO: 324711 - protein, 9 aa, Influenza virus
GANRPVIII

SEQ ID NO: 324712 - protein, 9 aa, Influenza virus
ANRPVITID

SEQ ID NO: 324713 - protein, 9 aa, Influenza virus
MTHMSKYLC

SEQ ID NO: 324714 - protein, 9 aa, Influenza virus
THMSKYLCS

SEQ ID NO: 324715 - protein, 9 aa, Influenza virus
YLCSKVLTD

SEQ ID NO: 324716 - protein, 9 aa, Influenza virus
LCSKVLTDT

SEQ ID NO: 324717 - protein, 9 aa, Influenza virus
CSKVLTDTS

SEQ ID NO: 324718 - protein, 9 aa, Influenza virus
SKVLTDTSR

SEQ ID NO: 324719 - protein, 9 aa, Influenza virus
KVLTDTSRP

SEQ ID NO: 324720 - protein, 9 aa, Influenza virus
LTDTSRPSD

SEQ ID NO: 324721 - protein, 9 aa, Influenza virus
TDTSRPSDP

SEQ ID NO: 324722 - protein, 9 aa, Influenza virus
GGGPDPGVK

SEQ ID NO: 324723 - protein, 9 aa, Influenza virus
GGPDPGVKG

SEQ ID NO: 324724 - protein, 9 aa, Influenza virus
GPDPGVKGF

SEQ ID NO: 324725 - protein, 9 aa, Influenza virus
GVKGFAFLN

SEQ ID NO: 324726 - protein, 9 aa, Influenza virus
VKGFAFLNG

SEQ ID NO: 324727 - protein, 9 aa, Influenza virus
NSWLGRTTS

SEQ ID NO: 324728 - protein, 9 aa, Influenza virus
SWLGRTTSK

SEQ ID NO: 324729 - protein, 9 aa, Influenza virus
WLGRTTSKD

SEQ ID NO: 324730 - protein, 9 aa, Influenza virus
LGRTTSKDS

SEQ ID NO: 324731 - protein, 9 aa, Influenza virus
GRTTSKDSR

SEQ ID NO: 324732 - protein, 9 aa, Influenza virus
RTTSKDSRS

SEQ ID NO: 324733 - protein, 9 aa, Influenza virus
TTSKDSRSG

SEQ ID NO: 324734 - protein, 9 aa, Influenza virus
TSKDSRSGY

SEQ ID NO: 324735 - protein, 9 aa, Influenza virus
SKDLRSGYE

SEQ ID NO: 324736 - protein, 9 aa, Influenza virus
KDSRSGYEV

SEQ ID NO: 324737 - protein, 9 aa, Influenza virus
DSRSGYEVL

SEQ ID NO: 324738 - protein, 9 aa, Influenza virus
SRSGYEVLK

SEQ ID NO: 324739 - protein, 9 aa, Influenza virus
RSGYEVLKV

SEQ ID NO: 324740 - protein, 9 aa, Influenza virus
SGYEVLKVP

SEQ ID NO: 324741 - protein, 9 aa, Influenza virus
GYEVLKVPN

SEQ ID NO: 324742 - protein, 9 aa, Influenza virus
YEVLKVPNA

SEQ ID NO: 324743 - protein, 9 aa, Influenza virus
EVLKVPNAE

SEQ ID NO: 324744 - protein, 9 aa, Influenza virus
IVNNQDWSG

SEQ ID NO: 324745 - protein, 9 aa, Influenza virus
VNNQDWSGY

SEQ ID NO: 324746 - protein, 9 aa, Influenza virus
NNQDWSGYS

SEQ ID NO: 324747 - protein, 9 aa, Influenza virus
NQDWSGYSG

SEQ ID NO: 324748 - protein, 9 aa, Influenza virus
QNWSGYSGS

SEQ ID NO: 324749 - protein, 9 aa, Influenza virus
NWSGYSGSF

SEQ ID NO: 324750 - protein, 9 aa, Influenza virus
WSGYSGSFI

SEQ ID NO: 324751 - protein, 9 aa, Influenza virus
SGYSGSFID

SEQ ID NO: 324752 - protein, 9 aa, Influenza virus
GYSGSFIDY

SEQ ID NO: 324753 - protein, 9 aa, Influenza virus
YSGSFIDYW

SEQ ID NO: 324754 - protein, 9 aa, Influenza virus
KECFNPCFY

SEQ ID NO: 324755 - protein, 9 aa, Influenza virus
KCFNPCFYV

SEQ ID NO: 324756 - protein, 9 aa, Influenza virus
FYVELIRGM

SEQ ID NO: 324757 - protein, 9 aa, Influenza virus
YVELIRGMP

SEQ ID NO: 324758 - protein, 9 aa, Influenza virus
VELIRGMPK

SEQ ID NO: 324759 - protein, 9 aa, Influenza virus
ELIRGMPKE

SEQ ID NO: 324760 - protein, 9 aa, Influenza virus
LIRGRPKEN

SEQ ID NO: 324761 - protein, 9 aa, Influenza virus
ESSVFWTSN

SEQ ID NO: 324762 - protein, 9 aa, Influenza virus
VFWTSNSIV

SEQ ID NO: 324763 - protein, 9 aa, Influenza virus
FWTSNSIVA

SEQ ID NO: 324764 - protein, 9 aa, Influenza virus
SIVALCGSR

SEQ ID NO: 324765 - protein, 9 aa, Influenza virus
IVALCGSRE

SEQ ID NO: 324766 - protein, 9 aa, Influenza virus
VALCGSRER

SEQ ID NO: 324767 - protein, 9 aa, Influenza virus
ALCGSRERL

SEQ ID NO: 324768 - protein, 9 aa, Influenza virus
LCGSRERLG

SEQ ID NO: 324769 - protein, 9 aa, Influenza virus
CGSRERLGS

SEQ ID NO: 324770 - protein, 9 aa, Influenza virus
GSRERLGSW

SEQ ID NO: 324771 - protein, 9 aa, Influenza virus
SRERLGSWS

SEQ ID NO: 324772 - protein, 9 aa, Influenza virus
RERLGSWSW

SEQ ID NO: 324773 - protein, 9 aa, Influenza virus
EQLGSWSWH

SEQ ID NO: 324774 - protein, 9 aa, Influenza virus
QLGSWSWHD

SEQ ID NO: 324775 - protein, 9 aa, Influenza virus
SWHDGAEIT

SEQ ID NO: 324776 - protein, 9 aa, Influenza virus
WHDGAEITY

SEQ ID NO: 324777 - protein, 9 aa, Influenza virus
HDGAEITYF

SEQ ID NO: 324778 - protein, 9 aa, Influenza virus
DGAEITYFK

SEQ ID NO: 324779 - protein, 9 aa, Influenza virus
MNPNQKLFT

SEQ ID NO: 324780 - protein, 9 aa, Influenza virus
NPNQKLFAS

SEQ ID NO: 324781 - protein, 9 aa, Influenza virus
PNQKLFASS

SEQ ID NO: 324782 - protein, 9 aa, Influenza virus
NQKLFASSG

SEQ ID NO: 324783 - protein, 9 aa, Influenza virus
QKLFASSGI

SEQ ID NO: 324784 - protein, 9 aa, Influenza virus
KLFASSGIA

SEQ ID NO: 324785 - protein, 9 aa, Influenza virus
LFASSGIAI

SEQ ID NO: 324786 - protein, 9 aa, Influenza virus
LNLIIGISN

SEQ ID NO: 324787 - protein, 9 aa, Influenza virus
NLIIGISNV

SEQ ID NO: 324788 - protein, 9 aa, Influenza virus
LIIGISNVG

SEQ ID NO: 324789 - protein, 9 aa, Influenza virus
IIGISNVGL

SEQ ID NO: 324790 - protein, 9 aa, Influenza virus
IGISNMSLN

SEQ ID NO: 324791 - protein, 9 aa, Influenza virus
SNMSLNISL

SEQ ID NO: 324792 - protein, 9 aa, Influenza virus
NMSLNISLY

SEQ ID NO: 324793 - protein, 9 aa, Influenza virus
MSLNISLYS

SEQ ID NO: 324794 - protein, 9 aa, Influenza virus
SLNISLYSK

SEQ ID NO: 324795 - protein, 9 aa, Influenza virus
ENKYVNNTT

SEQ ID NO: 324796 - protein, 9 aa, Influenza virus
NTYVNNTTI

SEQ ID NO: 324797 - protein, 9 aa, Influenza virus
TYVNNTTII

SEQ ID NO: 324798 - protein, 9 aa, Influenza virus
YLLLNKSLC

SEQ ID NO: 324799 - protein, 9 aa, Influenza virus
LLLNKSLCN

SEQ ID NO: 324800 - protein, 9 aa, Influenza virus
LLNKSLCNV

SEQ ID NO: 324801 - protein, 9 aa, Influenza virus
GWVVIAKDN

SEQ ID NO: 324802 - protein, 9 aa, Influenza virus
WVVIAKDNA

SEQ ID NO: 324803 - protein, 9 aa, Influenza virus
VVIAKDNAV

SEQ ID NO: 324804 - protein, 9 aa, Influenza virus
VIAKDNAVR

SEQ ID NO: 324805 - protein, 9 aa, Influenza virus
IAKDNAVRF

SEQ ID NO: 324806 - protein, 9 aa, Influenza virus
AKDNAVRFG

SEQ ID NO: 324807 - protein, 9 aa, Influenza virus
KDNAVRFGE

SEQ ID NO: 324808 - protein, 9 aa, Influenza virus
DNAVRFGES

SEQ ID NO: 324809 - protein, 9 aa, Influenza virus
NAVRFGESE

SEQ ID NO: 324810 - protein, 9 aa, Influenza virus
AVRFGESEQ

SEQ ID NO: 324811 - protein, 9 aa, Influenza virus
VRFGESEQI

SEQ ID NO: 324812 - protein, 9 aa, Influenza virus
RFGESEQVI

SEQ ID NO: 324813 - protein, 9 aa, Influenza virus
FGESEQVIV

SEQ ID NO: 324814 - protein, 9 aa, Influenza virus
GESEQVIVT

SEQ ID NO: 324815 - protein, 9 aa, Influenza virus
ESEQVIVTR

SEQ ID NO: 324816 - protein, 9 aa, Influenza virus
SEQVIVTRE

SEQ ID NO: 324817 - protein, 9 aa, Influenza virus
EQVIVTREP

SEQ ID NO: 324818 - protein, 9 aa, Influenza virus
QVIVTREPY

SEQ ID NO: 324819 - protein, 9 aa, Influenza virus
VIVTREPYV

SEQ ID NO: 324820 - protein, 9 aa, Influenza virus
EPYVSCDPT

SEQ ID NO: 324821 - protein, 9 aa, Influenza virus
GCRMYALHQ

SEQ ID NO: 324822 - protein, 9 aa, Influenza virus
CRMYALHQG

SEQ ID NO: 324823 - protein, 9 aa, Influenza virus
RMYALHQGT

SEQ ID NO: 324824 - protein, 9 aa, Influenza virus
HQGTTIRNR

SEQ ID NO: 324825 - protein, 9 aa, Influenza virus
QGTTIRNRH

SEQ ID NO: 324826 - protein, 9 aa, Influenza virus
GTTIRNRHS

SEQ ID NO: 324827 - protein, 9 aa, Influenza virus
TTIRNRHSN

SEQ ID NO: 324828 - protein, 9 aa, Influenza virus
TIRNKHSNS

SEQ ID NO: 324829 - protein, 9 aa, Influenza virus
IRNKHSNST

SEQ ID NO: 324830 - protein, 9 aa, Influenza virus
RNKHSNSTT

SEQ ID NO: 324831 - protein, 9 aa, Influenza virus
NKHSNSTTH

SEQ ID NO: 324832 - protein, 9 aa, Influenza virus
KHSNSTTHD

SEQ ID NO: 324833 - protein, 9 aa, Influenza virus
HSNSTTHDR

SEQ ID NO: 324834 - protein, 9 aa, Influenza virus
SNSTTHDRT

SEQ ID NO: 324835 - protein, 9 aa, Influenza virus
TTHDRTAFR

SEQ ID NO: 324836 - protein, 9 aa, Influenza virus
THDRTAFRG

SEQ ID NO: 324837 - protein, 9 aa, Influenza virus
HDRTTFRGL

SEQ ID NO: 324838 - protein, 9 aa, Influenza virus
DRTAFRGLM

SEQ ID NO: 324839 - protein, 9 aa, Influenza virus
RTAFRGLMS

SEQ ID NO: 324840 - protein, 9 aa, Influenza virus
TAFRGLMST

SEQ ID NO: 324841 - protein, 9 aa, Influenza virus
AFRGLISTH

SEQ ID NO: 324842 - protein, 9 aa, Influenza virus
FRGLISTHL

SEQ ID NO: 324843 - protein, 9 aa, Influenza virus
RGLMSTPLG

SEQ ID NO: 324844 - protein, 9 aa, Influenza virus
SNSDFMCVG

SEQ ID NO: 324845 - protein, 9 aa, Influenza virus
NSDFMCVGW

SEQ ID NO: 324846 - protein, 9 aa, Influenza virus
SDFMCVGWS

SEQ ID NO: 324847 - protein, 9 aa, Influenza virus
DFMCVGWSS

SEQ ID NO: 324848 - protein, 9 aa, Influenza virus
FMCVGWSST

SEQ ID NO: 324849 - protein, 9 aa, Influenza virus
MCVGWSSTT

SEQ ID NO: 324850 - protein, 9 aa, Influenza virus
CVGWSSTTC

SEQ ID NO: 324851 - protein, 9 aa, Influenza virus
VGWSSTTCH

SEQ ID NO: 324852 - protein, 9 aa, Influenza virus
GWSSTTCHD

SEQ ID NO: 324853 - protein, 9 aa, Influenza virus
WSSTTCHDG

SEQ ID NO: 324854 - protein, 9 aa, Influenza virus
SSTTCHDGI

SEQ ID NO: 324855 - protein, 9 aa, Influenza virus
CHDGVGRMT

SEQ ID NO: 324856 - protein, 9 aa, Influenza virus
HDGVGRMTI

SEQ ID NO: 324857 - protein, 9 aa, Influenza virus
DGVGRMTIC

SEQ ID NO: 324858 - protein, 9 aa, Influenza virus
GRMTICIQG

SEQ ID NO: 324859 - protein, 9 aa, Influenza virus
RMTICIQGN

SEQ ID NO: 324860 - protein, 9 aa, Influenza virus
MTICIQGNN

SEQ ID NO: 324861 - protein, 9 aa, Influenza virus
QGNNNNATA

SEQ ID NO: 324862 - protein, 9 aa, Influenza virus
GNNNNATAT

SEQ ID NO: 324863 - protein, 9 aa, Influenza virus
NNNNATATV

SEQ ID NO: 324864 - protein, 9 aa, Influenza virus
NNNATATVY

SEQ ID NO: 324865 - protein, 9 aa, Influenza virus
NNATATVYY

SEQ ID NO: 324866 - protein, 9 aa, Influenza virus
NATATVYYN

SEQ ID NO: 324867 - protein, 9 aa, Influenza virus
ATATVYYNR

SEQ ID NO: 324868 - protein, 9 aa, Influenza virus
TATVYYNRR

SEQ ID NO: 324869 - protein, 9 aa, Influenza virus
ATVYYNRRL

SEQ ID NO: 324870 - protein, 9 aa, Influenza virus
TVYYNRRLT

SEQ ID NO: 324871 - protein, 9 aa, Influenza virus
VYYNRRLTT

SEQ ID NO: 324872 - protein, 9 aa, Influenza virus
YYNRRLTTT

SEQ ID NO: 324873 - protein, 9 aa, Influenza virus
YNRRLTTTI

SEQ ID NO: 324874 - protein, 9 aa, Influenza virus
KRLTTTIKT

SEQ ID NO: 324875 - protein, 9 aa, Influenza virus
RLTTTIKPW

SEQ ID NO: 324876 - protein, 9 aa, Influenza virus
LTTTIKPWA

SEQ ID NO: 324877 - protein, 9 aa, Influenza virus
TTTIKTWAR

SEQ ID NO: 324878 - protein, 9 aa, Influenza virus
TTIKTWARN

SEQ ID NO: 324879 - protein, 9 aa, Influenza virus
TIKTWARNI

SEQ ID NO: 324880 - protein, 9 aa, Influenza virus
IKTWARNIL

SEQ ID NO: 324881 - protein, 9 aa, Influenza virus
KTWARNILR

SEQ ID NO: 324882 - protein, 9 aa, Influenza virus
TWARNILRT

SEQ ID NO: 324883 - protein, 9 aa, Influenza virus
WARNILRTQ

SEQ ID NO: 324884 - protein, 9 aa, Influenza virus
ARNILRTQE

SEQ ID NO: 324885 - protein, 9 aa, Influenza virus
RNILRTQES

SEQ ID NO: 324886 - protein, 9 aa, Influenza virus
KILRTQESE

SEQ ID NO: 324887 - protein, 9 aa, Influenza virus
QDSECVSHN

SEQ ID NO: 324888 - protein, 9 aa, Influenza virus
ESECVCHNS

SEQ ID NO: 324889 - protein, 9 aa, Influenza virus
SECVCHNST

SEQ ID NO: 324890 - protein, 9 aa, Influenza virus
ECVCHNSTC

SEQ ID NO: 324891 - protein, 9 aa, Influenza virus
CVCHNGTCA

SEQ ID NO: 324892 - protein, 9 aa, Influenza virus
GTCAVVMTD

SEQ ID NO: 324893 - protein, 9 aa, Influenza virus
TCAVVMTDG

SEQ ID NO: 324894 - protein, 9 aa, Influenza virus
MTDGPANNQ

SEQ ID NO: 324895 - protein, 9 aa, Influenza virus
TDGPANNQA

SEQ ID NO: 324896 - protein, 9 aa, Influenza virus
LKGSAKHIE

SEQ ID NO: 324897 - protein, 9 aa, Influenza virus
KGSAKHIEE

SEQ ID NO: 324898 - protein, 9 aa, Influenza virus
GSAKHIEEC

SEQ ID NO: 324899 - protein, 9 aa, Influenza virus
SAKHIEECS

SEQ ID NO: 324900 - protein, 9 aa, Influenza virus
AKHIEECSC

SEQ ID NO: 324901 - protein, 9 aa, Influenza virus
KHIEECSCY

SEQ ID NO: 324902 - protein, 9 aa, Influenza virus
HIEEWSCYG

SEQ ID NO: 324903 - protein, 9 aa, Influenza virus
IEECPCYGH

SEQ ID NO: 324904 - protein, 9 aa, Influenza virus
EECSCYGHS

SEQ ID NO: 324905 - protein, 9 aa, Influenza virus
RVTCVCRDN

SEQ ID NO: 324906 - protein, 9 aa, Influenza virus
ATCVCRDNW

SEQ ID NO: 324907 - protein, 9 aa, Influenza virus
SCVCRDNWQ

SEQ ID NO: 324908 - protein, 9 aa, Influenza virus
CICRDNWQG

SEQ ID NO: 324909 - protein, 9 aa, Influenza virus
GCRDNWQGA

SEQ ID NO: 324910 - protein, 9 aa, Influenza virus
NWQGANRPI

SEQ ID NO: 324911 - protein, 9 aa, Influenza virus
WQGANRPII

SEQ ID NO: 324912 - protein, 9 aa, Influenza virus
QGANRPIIE

SEQ ID NO: 324913 - protein, 9 aa, Influenza virus
GANRPIIEI

SEQ ID NO: 324914 - protein, 9 aa, Influenza virus
ANRPIIEID

SEQ ID NO: 324915 - protein, 9 aa, Influenza virus
NRPIIEIDM

SEQ ID NO: 324916 - protein, 9 aa, Influenza virus
HTSRYVCTG

SEQ ID NO: 324917 - protein, 9 aa, Influenza virus
CTGILTDTS

SEQ ID NO: 324918 - protein, 9 aa, Influenza virus
TGILTDTSR

SEQ ID NO: 324919 - protein, 9 aa, Influenza virus
GILTDTSRP

SEQ ID NO: 324920 - protein, 9 aa, Influenza virus
ILTDTSRPG

SEQ ID NO: 324921 - protein, 9 aa, Influenza virus
LTDTSRPGD

SEQ ID NO: 324922 - protein, 9 aa, Influenza virus
TDTSRPGDK

SEQ ID NO: 324923 - protein, 9 aa, Influenza virus
GDCSNPITG

SEQ ID NO: 324924 - protein, 9 aa, Influenza virus
DCSNPITGS

SEQ ID NO: 324925 - protein, 9 aa, Influenza virus
CSNPITGSP

SEQ ID NO: 324926 - protein, 9 aa, Influenza virus
SNPITGSPG

SEQ ID NO: 324927 - protein, 9 aa, Influenza virus
NPITGSPSA

SEQ ID NO: 324928 - protein, 9 aa, Influenza virus
PITGSPSAP

SEQ ID NO: 324929 - protein, 9 aa, Influenza virus
ITGSPSAPG

SEQ ID NO: 324930 - protein, 9 aa, Influenza virus
APGIKGFGF

SEQ ID NO: 324931 - protein, 9 aa, Influenza virus
PGIKGFGFL

SEQ ID NO: 324932 - protein, 9 aa, Influenza virus
GVKGFGFLN

SEQ ID NO: 324933 - protein, 9 aa, Influenza virus
DNTWLGRTI

SEQ ID NO: 324934 - protein, 9 aa, Influenza virus
STWLGRTIS

SEQ ID NO: 324935 - protein, 9 aa, Influenza virus
TWLGRTFSP

SEQ ID NO: 324936 - protein, 9 aa, Influenza virus
WLGRTISPK

SEQ ID NO: 324937 - protein, 9 aa, Influenza virus
LGRTISPKL

SEQ ID NO: 324938 - protein, 9 aa, Influenza virus
GRTISPRLR

SEQ ID NO: 324939 - protein, 9 aa, Influenza virus
TISPRLRSG

SEQ ID NO: 324940 - protein, 9 aa, Influenza virus
ISPKLRSGF

SEQ ID NO: 324941 - protein, 9 aa, Influenza virus
SPKLRSGFE

SEQ ID NO: 324942 - protein, 9 aa, Influenza virus
PRLRSGFEM

SEQ ID NO: 324943 - protein, 9 aa, Influenza virus
KLRSGFEML

SEQ ID NO: 324944 - protein, 9 aa, Influenza virus
LRSGFEMLK

SEQ ID NO: 324945 - protein, 9 aa, Influenza virus
RSGFEMLKV

SEQ ID NO: 324946 - protein, 9 aa, Influenza virus
SGFEMLKVP

SEQ ID NO: 324947 - protein, 9 aa, Influenza virus
GFEMLKVPN

SEQ ID NO: 324948 - protein, 9 aa, Influenza virus
FEMLKVPNA

SEQ ID NO: 324949 - protein, 9 aa, Influenza virus
EMLKIPNAE

SEQ ID NO: 324950 - protein, 9 aa, Influenza virus
LKIPNAETD

SEQ ID NO: 324951 - protein, 9 aa, Influenza virus
KIPNAETDP

SEQ ID NO: 324952 - protein, 9 aa, Influenza virus
DWSGYSGSF

SEQ ID NO: 324953 - protein, 9 aa, Influenza virus
SGSFIDYWN

SEQ ID NO: 324954 - protein, 9 aa, Influenza virus
GSFIDYWND

SEQ ID NO: 324955 - protein, 9 aa, Influenza virus
NECYNPCFY

SEQ ID NO: 324956 - protein, 9 aa, Influenza virus
VCYNPCFYV

SEQ ID NO: 324957 - protein, 9 aa, Influenza virus
RGRPEEVKY

SEQ ID NO: 324958 - protein, 9 aa, Influenza virus
GRPEEVKYV

SEQ ID NO: 324959 - protein, 9 aa, Influenza virus
RPEEAKYVE

SEQ ID NO: 324960 - protein, 9 aa, Influenza virus
PEEAKYVEW

SEQ ID NO: 324961 - protein, 9 aa, Influenza virus
EEAKYVEWT

SEQ ID NO: 324962 - protein, 9 aa, Influenza virus
EAKYVEWTS

SEQ ID NO: 324963 - protein, 9 aa, Influenza virus
AKYVEWTSN

SEQ ID NO: 324964 - protein, 9 aa, Influenza virus
KYVEWTSNS

SEQ ID NO: 324965 - protein, 9 aa, Influenza virus
YVEWTSNSL

SEQ ID NO: 324966 - protein, 9 aa, Influenza virus
VWWTSNSLI

SEQ ID NO: 324967 - protein, 9 aa, Influenza virus
WWTSNSLIA

SEQ ID NO: 324968 - protein, 9 aa, Influenza virus
WTSNSLIAL

SEQ ID NO: 324969 - protein, 9 aa, Influenza virus
TSNSLIALC

SEQ ID NO: 324970 - protein, 9 aa, Influenza virus
SNSLIALCG

SEQ ID NO: 324971 - protein, 9 aa, Influenza virus
NSLIALCGS

SEQ ID NO: 324972 - protein, 9 aa, Influenza virus
SLIALCGSP

SEQ ID NO: 324973 - protein, 9 aa, Influenza virus
LVALCGSPV

SEQ ID NO: 324974 - protein, 9 aa, Influenza virus
PVGSGSFPD

SEQ ID NO: 324975 - protein, 9 aa, Influenza virus
VGPGSFPDG

SEQ ID NO: 324976 - protein, 9 aa, Influenza virus
GPGSFPDGA

SEQ ID NO: 324977 - protein, 9 aa, Influenza virus
PGSFPDGAQ

SEQ ID NO: 324978 - protein, 9 aa, Influenza virus
GSFPNGAQI

SEQ ID NO: 324979 - protein, 9 aa, Influenza virus
SFPDGAQIK

SEQ ID NO: 324980 - protein, 9 aa, Influenza virus
FPDGAQIKY

SEQ ID NO: 324981 - protein, 9 aa, Influenza virus
PDGAQIKYF

SEQ ID NO: 324982 - protein, 9 aa, Influenza virus
DGAQIKYFS

SEQ ID NO: 324983 - protein, 9 aa, Influenza virus
EYNETVRIE

SEQ ID NO: 324984 - protein, 9 aa, Influenza virus
QGFAPFSKD

SEQ ID NO: 324985 - protein, 9 aa, Influenza virus
DNGIRIGSK

SEQ ID NO: 324986 - protein, 9 aa, Influenza virus
NGIRIGSKG

SEQ ID NO: 324987 - protein, 9 aa, Influenza virus
GIRIGSKGH

SEQ ID NO: 324988 - protein, 9 aa, Influenza virus
IRIGSRGHI

SEQ ID NO: 324989 - protein, 9 aa, Influenza virus
RIGSRGHIF

SEQ ID NO: 324990 - protein, 9 aa, Influenza virus
IGSRGHIFV

SEQ ID NO: 324991 - protein, 9 aa, Influenza virus
GSRGHIFVI

SEQ ID NO: 324992 - protein, 9 aa, Influenza virus
SRGHIFVIR

SEQ ID NO: 324993 - protein, 9 aa, Influenza virus
RGHIFVIRE

SEQ ID NO: 324994 - protein, 9 aa, Influenza virus
GHIFVIREP

SEQ ID NO: 324995 - protein, 9 aa, Influenza virus
HIFVIREPF

SEQ ID NO: 324996 - protein, 9 aa, Influenza virus
IFVIREPFV

SEQ ID NO: 324997 - protein, 9 aa, Influenza virus
FIIREPFVS

SEQ ID NO: 324998 - protein, 9 aa, Influenza virus
IIREPFVSC

SEQ ID NO: 324999 - protein, 9 aa, Influenza virus
GCRTFFLTQ

SEQ ID NO: 325000 - protein, 9 aa, Influenza virus
CRTFFLTHG

SEQ ID NO: 325001 - protein, 9 aa, Influenza virus
RTFFLTHGS

SEQ ID NO: 325002 - protein, 9 aa, Influenza virus
TFFLTHGSL

SEQ ID NO: 325003 - protein, 9 aa, Influenza virus
FFLTHGSLL

SEQ ID NO: 325004 - protein, 9 aa, Influenza virus
FLTHGSLLN

SEQ ID NO: 325005 - protein, 9 aa, Influenza virus
LTHGSLLND

SEQ ID NO: 325006 - protein, 9 aa, Influenza virus
TQGSLLNDR

SEQ ID NO: 325007 - protein, 9 aa, Influenza virus
QGSLLNDRH

SEQ ID NO: 325008 - protein, 9 aa, Influenza virus
GSLLNDRHS

SEQ ID NO: 325009 - protein, 9 aa, Influenza virus
SLLNDRHSN

SEQ ID NO: 325010 - protein, 9 aa, Influenza virus
LLNDRHSNG

SEQ ID NO: 325011 - protein, 9 aa, Influenza virus
LNDRHSNGT

SEQ ID NO: 325012 - protein, 9 aa, Influenza virus
NDKHSNGTI

SEQ ID NO: 325013 - protein, 9 aa, Influenza virus
DKHSNGTIK

SEQ ID NO: 325014 - protein, 9 aa, Influenza virus
KHSNGTIKD

SEQ ID NO: 325015 - protein, 9 aa, Influenza virus
HSNGTIKDR

SEQ ID NO: 325016 - protein, 9 aa, Influenza virus
SNGTIKDRS

SEQ ID NO: 325017 - protein, 9 aa, Influenza virus
NGTIKDRSP

SEQ ID NO: 325018 - protein, 9 aa, Influenza virus
GTVKDRSPF

SEQ ID NO: 325019 - protein, 9 aa, Influenza virus
TVKDRSPFR

SEQ ID NO: 325020 - protein, 9 aa, Influenza virus
VKDRSPFRT

SEQ ID NO: 325021 - protein, 9 aa, Influenza virus
KDRSPFRTL

SEQ ID NO: 325022 - protein, 9 aa, Influenza virus
DRSPFRTLM

SEQ ID NO: 325023 - protein, 9 aa, Influenza virus
RSPFRTLMS

SEQ ID NO: 325024 - protein, 9 aa, Influenza virus
SPFRTLMSV

SEQ ID NO: 325025 - protein, 9 aa, Influenza virus
PYRTLMSVK

SEQ ID NO: 325026 - protein, 9 aa, Influenza virus
RTLMSVKIG

SEQ ID NO: 325027 - protein, 9 aa, Influenza virus
TLMSVKIGQ

SEQ ID NO: 325028 - protein, 9 aa, Influenza virus
VGQSPNVYQ

SEQ ID NO: 325029 - protein, 9 aa, Influenza virus
GQSPNVYQS

SEQ ID NO: 325030 - protein, 9 aa, Influenza virus
QSPNVYQAK

SEQ ID NO: 325031 - protein, 9 aa, Influenza virus
SPNVYQAKF

SEQ ID NO: 325032 - protein, 9 aa, Influenza virus
PNVYQAKFE

SEQ ID NO: 325033 - protein, 9 aa, Influenza virus
NVYQARFES

SEQ ID NO: 325034 - protein, 9 aa, Influenza virus
VYQARFESV

SEQ ID NO: 325035 - protein, 9 aa, Influenza virus
YQARFESVA

SEQ ID NO: 325036 - protein, 9 aa, Influenza virus
QARFESVAW

SEQ ID NO: 325037 - protein, 9 aa, Influenza virus
ARFESVAWS

SEQ ID NO: 325038 - protein, 9 aa, Influenza virus
RFESVAWSA

SEQ ID NO: 325039 - protein, 9 aa, Influenza virus
FESVAWSAT

SEQ ID NO: 325040 - protein, 9 aa, Influenza virus
ESVAWSATA

SEQ ID NO: 325041 - protein, 9 aa, Influenza virus
SVAWSATAC

SEQ ID NO: 325042 - protein, 9 aa, Influenza virus
SATACHDGR

SEQ ID NO: 325043 - protein, 9 aa, Influenza virus
ATACHDGRK

SEQ ID NO: 325044 - protein, 9 aa, Influenza virus
TACHDGRKW

SEQ ID NO: 325045 - protein, 9 aa, Influenza virus
ACHDGRKWM

SEQ ID NO: 325046 - protein, 9 aa, Influenza virus
CHDGRKWMT

SEQ ID NO: 325047 - protein, 9 aa, Influenza virus
SWAGNILRT

SEQ ID NO: 325048 - protein, 9 aa, Influenza virus
GNILRTQES

SEQ ID NO: 325049 - protein, 9 aa, Influenza virus
NILRTQESS

SEQ ID NO: 325050 - protein, 9 aa, Influenza virus
IMRTQESSC

SEQ ID NO: 325051 - protein, 9 aa, Influenza virus
MRTQESSCT

SEQ ID NO: 325052 - protein, 9 aa, Influenza virus
QESSCTCIK

SEQ ID NO: 325053 - protein, 9 aa, Influenza virus
ESSCTCIKG

SEQ ID NO: 325054 - protein, 9 aa, Influenza virus
GDCYWVMTD

SEQ ID NO: 325055 - protein, 9 aa, Influenza virus
DCYWVMTDG

SEQ ID NO: 325056 - protein, 9 aa, Influenza virus
CFWVMTDGP

SEQ ID NO: 325057 - protein, 9 aa, Influenza virus
FWVMTDGPA

SEQ ID NO: 325058 - protein, 9 aa, Influenza virus
VMTDGPANK

SEQ ID NO: 325059 - protein, 9 aa, Influenza virus
MTDGPANKQ

SEQ ID NO: 325060 - protein, 9 aa, Influenza virus
TDGPANKQA

SEQ ID NO: 325061 - protein, 9 aa, Influenza virus
FSGGHIEEC

SEQ ID NO: 325062 - protein, 9 aa, Influenza virus
SGGHIEECS

SEQ ID NO: 325063 - protein, 9 aa, Influenza virus
EGHIEECSC

SEQ ID NO: 325064 - protein, 9 aa, Influenza virus
EECSCYPND

SEQ ID NO: 325065 - protein, 9 aa, Influenza virus
ECSCYPNDG

SEQ ID NO: 325066 - protein, 9 aa, Influenza virus
CSCYPNDGK

SEQ ID NO: 325067 - protein, 9 aa, Influenza virus
SCYPNDGKV

SEQ ID NO: 325068 - protein, 9 aa, Influenza virus
CYPNDGKVE

SEQ ID NO: 325069 - protein, 9 aa, Influenza virus
YPNDGKVEC

SEQ ID NO: 325070 - protein, 9 aa, Influenza virus
PNEGKVECI

SEQ ID NO: 325071 - protein, 9 aa, Influenza virus
NEGKVECIC

SEQ ID NO: 325072 - protein, 9 aa, Influenza virus
EGKVECICR

SEQ ID NO: 325073 - protein, 9 aa, Influenza virus
GKVECICRD

SEQ ID NO: 325074 - protein, 9 aa, Influenza virus
KVECICRDN

SEQ ID NO: 325075 - protein, 9 aa, Influenza virus
VECICRDNW

SEQ ID NO: 325076 - protein, 9 aa, Influenza virus
ECICRDNWT

SEQ ID NO: 325077 - protein, 9 aa, Influenza virus
CICRDNWTG

SEQ ID NO: 325078 - protein, 9 aa, Influenza virus
ICRDNWTGT

SEQ ID NO: 325079 - protein, 9 aa, Influenza virus
NWTGTNRPI

SEQ ID NO: 325080 - protein, 9 aa, Influenza virus
WTGTNRPIL

SEQ ID NO: 325081 - protein, 9 aa, Influenza virus
TGTNRPILV

SEQ ID NO: 325082 - protein, 9 aa, Influenza virus
GTNRPILVI

SEQ ID NO: 325083 - protein, 9 aa, Influenza virus
TNRPILVIS

SEQ ID NO: 325084 - protein, 9 aa, Influenza virus
LVISSDLSY

SEQ ID NO: 325085 - protein, 9 aa, Influenza virus
LSYTVGYLC

SEQ ID NO: 325086 - protein, 9 aa, Influenza virus
SYTVGYLCA

SEQ ID NO: 325087 - protein, 9 aa, Influenza virus
YTVGYLCAG

SEQ ID NO: 325088 - protein, 9 aa, Influenza virus
VGYLCAGIP

SEQ ID NO: 325089 - protein, 9 aa, Influenza virus
GYLCAGIPT

SEQ ID NO: 325090 - protein, 9 aa, Influenza virus
YLCAGIPTD

SEQ ID NO: 325091 - protein, 9 aa, Influenza virus
LCAGIPTDT

SEQ ID NO: 325092 - protein, 9 aa, Influenza virus
CAGIPTDTP

SEQ ID NO: 325093 - protein, 9 aa, Influenza virus
AGIPTDTPR

SEQ ID NO: 325094 - protein, 9 aa, Influenza virus
GIPTDTPRG

SEQ ID NO: 325095 - protein, 9 aa, Influenza virus
IPTDTPRGE

SEQ ID NO: 325096 - protein, 9 aa, Influenza virus
PTDTPRGED

SEQ ID NO: 325097 - protein, 9 aa, Influenza virus
TDTPRGEDS

SEQ ID NO: 325098 - protein, 9 aa, Influenza virus
DTPRGEDAQ

SEQ ID NO: 325099 - protein, 9 aa, Influenza virus
TPRGEDAQF

SEQ ID NO: 325100 - protein, 9 aa, Influenza virus
KGYGVKGFG

SEQ ID NO: 325101 - protein, 9 aa, Influenza virus
KGFGFRQGT

SEQ ID NO: 325102 - protein, 9 aa, Influenza virus
GFGFRQGTD

SEQ ID NO: 325103 - protein, 9 aa, Influenza virus
FGFRQGTDV

SEQ ID NO: 325104 - protein, 9 aa, Influenza virus
GFRQGTDVW

SEQ ID NO: 325105 - protein, 9 aa, Influenza virus
DDPNWSGYS

SEQ ID NO: 325106 - protein, 9 aa, Influenza virus
DPNWSGYSG

SEQ ID NO: 325107 - protein, 9 aa, Influenza virus
PNWSGYSGS

SEQ ID NO: 325108 - protein, 9 aa, Influenza virus
YSGSFTLPI

SEQ ID NO: 325109 - protein, 9 aa, Influenza virus
SGSFTLPIE

SEQ ID NO: 325110 - protein, 9 aa, Influenza virus
GSFTLPIEL

SEQ ID NO: 325111 - protein, 9 aa, Influenza virus
DCLVPCFWV

SEQ ID NO: 325112 - protein, 9 aa, Influenza virus
FWVEMIRGR

SEQ ID NO: 325113 - protein, 9 aa, Influenza virus
WVEMIRGEP

SEQ ID NO: 325114 - protein, 9 aa, Influenza virus
VEMIRGEPE

SEQ ID NO: 325115 - protein, 9 aa, Influenza virus
EMIRGRPEE

SEQ ID NO: 325116 - protein, 9 aa, Influenza virus
TIWTSSSSV

SEQ ID NO: 325117 - protein, 9 aa, Influenza virus
IWTSSSSVV

SEQ ID NO: 325118 - protein, 9 aa, Influenza virus
WTSSSSVVM

SEQ ID NO: 325119 - protein, 9 aa, Influenza virus
TSSSSVVMC

SEQ ID NO: 325120 - protein, 9 aa, Influenza virus
SSSSVVMCG

SEQ ID NO: 325121 - protein, 9 aa, Influenza virus
SSSVVMCGV

SEQ ID NO: 325122 - protein, 9 aa, Influenza virus
SSVVMCGVD

SEQ ID NO: 325123 - protein, 9 aa, Influenza virus
SIVMCGVDY

SEQ ID NO: 325124 - protein, 9 aa, Influenza virus
ASWSWHDGA

SEQ ID NO: 325125 - protein, 9 aa, Influenza virus
SWSWHDGAI

SEQ ID NO: 325126 - protein, 9 aa, Influenza virus
WSWHDGAVL

SEQ ID NO: 325127 - protein, 9 aa, Influenza virus
SWHDGAVLP

SEQ ID NO: 325128 - protein, 9 aa, Influenza virus
WHDGAVLPF

SEQ ID NO: 325129 - protein, 9 aa, Influenza virus
DGAVLPFDI

SEQ ID NO: 325130 - protein, 9 aa, Influenza virus
LPFDFDKIS

SEQ ID NO: 325131 - protein, 9 aa, Influenza virus
PFDFDKISQ

SEQ ID NO: 325132 - protein, 9 aa, Influenza virus
MNPNQKILF

SEQ ID NO: 325133 - protein, 9 aa, Influenza virus
NPNQKILCA

SEQ ID NO: 325134 - protein, 9 aa, Influenza virus
PNQKILCAS

SEQ ID NO: 325135 - protein, 9 aa, Influenza virus
NQKILCASA

SEQ ID NO: 325136 - protein, 9 aa, Influenza virus
QKILCTSAI

SEQ ID NO: 325137 - protein, 9 aa, Influenza virus
KILCTSAIA

SEQ ID NO: 325138 - protein, 9 aa, Influenza virus
ILCTSAIAI

SEQ ID NO: 325139 - protein, 9 aa, Influenza virus
VNLGLNIGL

SEQ ID NO: 325140 - protein, 9 aa, Influenza virus
NLGLNVGLH

SEQ ID NO: 325141 - protein, 9 aa, Influenza virus
LGLNVGLHL

SEQ ID NO: 325142 - protein, 9 aa, Influenza virus
GLNIGLHLR

SEQ ID NO: 325143 - protein, 9 aa, Influenza virus
LNIGLHLRP

SEQ ID NO: 325144 - protein, 9 aa, Influenza virus
SQTVINNYY

SEQ ID NO: 325145 - protein, 9 aa, Influenza virus
QTVINNYYN

SEQ ID NO: 325146 - protein, 9 aa, Influenza virus
TVINNYYNE

SEQ ID NO: 325147 - protein, 9 aa, Influenza virus
VINNYYNET

SEQ ID NO: 325148 - protein, 9 aa, Influenza virus
INNYYNKTN

SEQ ID NO: 325149 - protein, 9 aa, Influenza virus
VTQISNTNI

SEQ ID NO: 325150 - protein, 9 aa, Influenza virus
FNNLTRELC

SEQ ID NO: 325151 - protein, 9 aa, Influenza virus
NNLTRELCT

SEQ ID NO: 325152 - protein, 9 aa, Influenza virus
NLTRELCTI

SEQ ID NO: 325153 - protein, 9 aa, Influenza virus
LTRELCTIN

SEQ ID NO: 325154 - protein, 9 aa, Influenza virus
TRELCTINS

SEQ ID NO: 325155 - protein, 9 aa, Influenza virus
RELCTINSW

SEQ ID NO: 325156 - protein, 9 aa, Influenza virus
ELCTINSWH

SEQ ID NO: 325157 - protein, 9 aa, Influenza virus
CTINSWHIF

SEQ ID NO: 325158 - protein, 9 aa, Influenza virus
TINSWHIFG

SEQ ID NO: 325159 - protein, 9 aa, Influenza virus
INSWHIFGK

SEQ ID NO: 325160 - protein, 9 aa, Influenza virus
NSWHIFGKD

SEQ ID NO: 325161 - protein, 9 aa, Influenza virus
SWHIFGKDN

SEQ ID NO: 325162 - protein, 9 aa, Influenza virus
WHIFGKDNA

SEQ ID NO: 325163 - protein, 9 aa, Influenza virus
HIFGKDNAI

SEQ ID NO: 325164 - protein, 9 aa, Influenza virus
IFGKDNAIR

SEQ ID NO: 325165 - protein, 9 aa, Influenza virus
FGKDNAIRI

SEQ ID NO: 325166 - protein, 9 aa, Influenza virus
GKDNAIRIG

SEQ ID NO: 325167 - protein, 9 aa, Influenza virus
KDNAIRIGE

SEQ ID NO: 325168 - protein, 9 aa, Influenza virus
DNAVRIGEN

SEQ ID NO: 325169 - protein, 9 aa, Influenza virus
NAVRIGENS

SEQ ID NO: 325170 - protein, 9 aa, Influenza virus
RIGENSDVL

SEQ ID NO: 325171 - protein, 9 aa, Influenza virus
IGENSDVLV

SEQ ID NO: 325172 - protein, 9 aa, Influenza virus
GENSDVLVT

SEQ ID NO: 325173 - protein, 9 aa, Influenza virus
ENSDVLVTR

SEQ ID NO: 325174 - protein, 9 aa, Influenza virus
NSDVLVTRE

SEQ ID NO: 325175 - protein, 9 aa, Influenza virus
SDILVTREP

SEQ ID NO: 325176 - protein, 9 aa, Influenza virus
DILVTREPY

SEQ ID NO: 325177 - protein, 9 aa, Influenza virus
ILVTREPYV

SEQ ID NO: 325178 - protein, 9 aa, Influenza virus
TREPYVSCE

SEQ ID NO: 325179 - protein, 9 aa, Influenza virus
REPYVSCEP

SEQ ID NO: 325180 - protein, 9 aa, Influenza virus
EPYVSCEPD

SEQ ID NO: 325181 - protein, 9 aa, Influenza virus
PYVSCEPDE

SEQ ID NO: 325182 - protein, 9 aa, Influenza virus
YVSCEPDEC

SEQ ID NO: 325183 - protein, 9 aa, Influenza virus
VSCDPDGCR

SEQ ID NO: 325184 - protein, 9 aa, Influenza virus
SCEPDECRF

SEQ ID NO: 325185 - protein, 9 aa, Influenza virus
CEPDECRFY

SEQ ID NO: 325186 - protein, 9 aa, Influenza virus
EPDECRFYA

SEQ ID NO: 325187 - protein, 9 aa, Influenza virus
PDGCRFYAL

SEQ ID NO: 325188 - protein, 9 aa, Influenza virus
DGCRFYALS

SEQ ID NO: 325189 - protein, 9 aa, Influenza virus
GCRFYALSQ

SEQ ID NO: 325190 - protein, 9 aa, Influenza virus
SQGTTIRGR

SEQ ID NO: 325191 - protein, 9 aa, Influenza virus
QGTTIRGRH

SEQ ID NO: 325192 - protein, 9 aa, Influenza virus
GTTIRGRHS

SEQ ID NO: 325193 - protein, 9 aa, Influenza virus
TTIRGRHSN

SEQ ID NO: 325194 - protein, 9 aa, Influenza virus
TIRGRHSNG

SEQ ID NO: 325195 - protein, 9 aa, Influenza virus
IRGRHSNGT

SEQ ID NO: 325196 - protein, 9 aa, Influenza virus
RGRHSNGTI

SEQ ID NO: 325197 - protein, 9 aa, Influenza virus
GRHSNGTIH

SEQ ID NO: 325198 - protein, 9 aa, Influenza virus
RHSNGTIHD

SEQ ID NO: 325199 - protein, 9 aa, Influenza virus
IHDRSQYRS

SEQ ID NO: 325200 - protein, 9 aa, Influenza virus
HDRSQYRSL

SEQ ID NO: 325201 - protein, 9 aa, Influenza virus
DRSQYRSLI

SEQ ID NO: 325202 - protein, 9 aa, Influenza virus
RSQYRSLIS

SEQ ID NO: 325203 - protein, 9 aa, Influenza virus
SQYRSLISW

SEQ ID NO: 325204 - protein, 9 aa, Influenza virus
QYRSLISWP

SEQ ID NO: 325205 - protein, 9 aa, Influenza virus
YRSLISWPL

SEQ ID NO: 325206 - protein, 9 aa, Influenza virus
RSLISWPLS

SEQ ID NO: 325207 - protein, 9 aa, Influenza virus
SLISWPLSS

SEQ ID NO: 325208 - protein, 9 aa, Influenza virus
LVSWPLSSP

SEQ ID NO: 325209 - protein, 9 aa, Influenza virus
VSWPLSSPP

SEQ ID NO: 325210 - protein, 9 aa, Influenza virus
SWPQSSPPT

SEQ ID NO: 325211 - protein, 9 aa, Influenza virus
WPQSSPPTV

SEQ ID NO: 325212 - protein, 9 aa, Influenza virus
PQSSPPTVY

SEQ ID NO: 325213 - protein, 9 aa, Influenza virus
QSSPPTVYN

SEQ ID NO: 325214 - protein, 9 aa, Influenza virus
SSPPTVYNT

SEQ ID NO: 325215 - protein, 9 aa, Influenza virus
SPPTVYNTR

SEQ ID NO: 325216 - protein, 9 aa, Influenza virus
RIECIGWSS

SEQ ID NO: 325217 - protein, 9 aa, Influenza virus
IECIGWSST

SEQ ID NO: 325218 - protein, 9 aa, Influenza virus
SSTSCHDGK

SEQ ID NO: 325219 - protein, 9 aa, Influenza virus
STSCHDGKS

SEQ ID NO: 325220 - protein, 9 aa, Influenza virus
TSCHDGKSR

SEQ ID NO: 325221 - protein, 9 aa, Influenza virus
SCHDGKSRM

SEQ ID NO: 325222 - protein, 9 aa, Influenza virus
CHDGKSRMS

SEQ ID NO: 325223 - protein, 9 aa, Influenza virus
RMSICVSGP

SEQ ID NO: 325224 - protein, 9 aa, Influenza virus
MSICVSGPN

SEQ ID NO: 325225 - protein, 9 aa, Influenza virus
SICVSGPNN

SEQ ID NO: 325226 - protein, 9 aa, Influenza virus
ICVSGPNNN

SEQ ID NO: 325227 - protein, 9 aa, Influenza virus
CVSGPNNNA

SEQ ID NO: 325228 - protein, 9 aa, Influenza virus
VSGPNNNAS

SEQ ID NO: 325229 - protein, 9 aa, Influenza virus
GPNNNASAI

SEQ ID NO: 325230 - protein, 9 aa, Influenza virus
PNNNASAVV

SEQ ID NO: 325231 - protein, 9 aa, Influenza virus
NNNASAVVW

SEQ ID NO: 325232 - protein, 9 aa, Influenza virus
NNASAVVWY

SEQ ID NO: 325233 - protein, 9 aa, Influenza virus
NASAVVWYN

SEQ ID NO: 325234 - protein, 9 aa, Influenza virus
RRPVAEINT

SEQ ID NO: 325235 - protein, 9 aa, Influenza virus
RPVAEINTW

SEQ ID NO: 325236 - protein, 9 aa, Influenza virus
PVAEINTWA

SEQ ID NO: 325237 - protein, 9 aa, Influenza virus
VAEINTWAR

SEQ ID NO: 325238 - protein, 9 aa, Influenza virus
AEINTWARN

SEQ ID NO: 325239 - protein, 9 aa, Influenza virus
QESECVCHS

SEQ ID NO: 325240 - protein, 9 aa, Influenza virus
ESECVCHSG

SEQ ID NO: 325241 - protein, 9 aa, Influenza virus
SECVCHNGI

SEQ ID NO: 325242 - protein, 9 aa, Influenza virus
ECVCHNGIC

SEQ ID NO: 325243 - protein, 9 aa, Influenza virus
CVCHNGICP

SEQ ID NO: 325244 - protein, 9 aa, Influenza virus
VCHNGICPV

SEQ ID NO: 325245 - protein, 9 aa, Influenza virus
CHNGICPVV

SEQ ID NO: 325246 - protein, 9 aa, Influenza virus
HNGICPVVF

SEQ ID NO: 325247 - protein, 9 aa, Influenza virus
NGICPVVFT

SEQ ID NO: 325248 - protein, 9 aa, Influenza virus
GICPVVFTD

SEQ ID NO: 325249 - protein, 9 aa, Influenza virus
ICPVVFTDG

SEQ ID NO: 325250 - protein, 9 aa, Influenza virus
DGSATGPAD

SEQ ID NO: 325251 - protein, 9 aa, Influenza virus
GSATGPADT

SEQ ID NO: 325252 - protein, 9 aa, Influenza virus
SATGPADTR

SEQ ID NO: 325253 - protein, 9 aa, Influenza virus
ATGPAETRI

SEQ ID NO: 325254 - protein, 9 aa, Influenza virus
TGPAETRIY

SEQ ID NO: 325255 - protein, 9 aa, Influenza virus
GPAETRIYY

SEQ ID NO: 325256 - protein, 9 aa, Influenza virus
PAETRIYYF

SEQ ID NO: 325257 - protein, 9 aa, Influenza virus
TRIYYFKEG

SEQ ID NO: 325258 - protein, 9 aa, Influenza virus
GKILKWESL

SEQ ID NO: 325259 - protein, 9 aa, Influenza virus
KWESLTGTA

SEQ ID NO: 325260 - protein, 9 aa, Influenza virus
LAGTAKHIE

SEQ ID NO: 325261 - protein, 9 aa, Influenza virus
AGTAKHIEE

SEQ ID NO: 325262 - protein, 9 aa, Influenza virus
AKHIEECSS

SEQ ID NO: 325263 - protein, 9 aa, Influenza virus
RHIEECSCY

SEQ ID NO: 325264 - protein, 9 aa, Influenza virus
IEECSCYGV

SEQ ID NO: 325265 - protein, 9 aa, Influenza virus
VTCTCRDNW

SEQ ID NO: 325266 - protein, 9 aa, Influenza virus
ICTCRDNWQ

SEQ ID NO: 325267 - protein, 9 aa, Influenza virus
QGSNRPVIR

SEQ ID NO: 325268 - protein, 9 aa, Influenza virus
GSNRPVIRI

SEQ ID NO: 325269 - protein, 9 aa, Influenza virus
SNRPVIQIN

SEQ ID NO: 325270 - protein, 9 aa, Influenza virus
NRPVIQINP

SEQ ID NO: 325271 - protein, 9 aa, Influenza virus
VMTHTSQYI

SEQ ID NO: 325272 - protein, 9 aa, Influenza virus
MKHTSQYIC

SEQ ID NO: 325273 - protein, 9 aa, Influenza virus
KHTSQYICS

SEQ ID NO: 325274 - protein, 9 aa, Influenza virus
DNPRPNDPT

SEQ ID NO: 325275 - protein, 9 aa, Influenza virus
IGKCNDPYP

SEQ ID NO: 325276 - protein, 9 aa, Influenza virus
GKCNEPYPG

SEQ ID NO: 325277 - protein, 9 aa, Influenza virus
KCNEPYPGN

SEQ ID NO: 325278 - protein, 9 aa, Influenza virus
CNEPYPGNN

SEQ ID NO: 325279 - protein, 9 aa, Influenza virus
NEPYPGNNN

SEQ ID NO: 325280 - protein, 9 aa, Influenza virus
EPYPGNNNN

SEQ ID NO: 325281 - protein, 9 aa, Influenza virus
PYPGNNNKG

SEQ ID NO: 325282 - protein, 9 aa, Influenza virus
YPGNNNKGV

SEQ ID NO: 325283 - protein, 9 aa, Influenza virus
PGNNBNGVK

SEQ ID NO: 325284 - protein, 9 aa, Influenza virus
GNNBNGVKG

SEQ ID NO: 325285 - protein, 9 aa, Influenza virus
NNBNGVKGF

SEQ ID NO: 325286 - protein, 9 aa, Influenza virus
NNNGVKGFA

SEQ ID NO: 325287 - protein, 9 aa, Influenza virus
NNGVKGFAY

SEQ ID NO: 325288 - protein, 9 aa, Influenza virus
NGVKGFAYL

SEQ ID NO: 325289 - protein, 9 aa, Influenza virus
GVKGFSYLN

SEQ ID NO: 325290 - protein, 9 aa, Influenza virus
VKGFSYLNG

SEQ ID NO: 325291 - protein, 9 aa, Influenza virus
NTWLGRTTS

SEQ ID NO: 325292 - protein, 9 aa, Influenza virus
TWLGRTISI

SEQ ID NO: 325293 - protein, 9 aa, Influenza virus
WLGRTISIA

SEQ ID NO: 325294 - protein, 9 aa, Influenza virus
LGRTISIAS

SEQ ID NO: 325295 - protein, 9 aa, Influenza virus
GRTISIASR

SEQ ID NO: 325296 - protein, 9 aa, Influenza virus
RTISIASRS

SEQ ID NO: 325297 - protein, 9 aa, Influenza virus
TISIASRSG

SEQ ID NO: 325298 - protein, 9 aa, Influenza virus
ISIASRSGY

SEQ ID NO: 325299 - protein, 9 aa, Influenza virus
SIASRSGYE

SEQ ID NO: 325300 - protein, 9 aa, Influenza virus
IASRSGYEM

SEQ ID NO: 325301 - protein, 9 aa, Influenza virus
ASRSGYEVL

SEQ ID NO: 325302 - protein, 9 aa, Influenza virus
SRYGYEMLK

SEQ ID NO: 325303 - protein, 9 aa, Influenza virus
RAGYEMLKV

SEQ ID NO: 325304 - protein, 9 aa, Influenza virus
SGYEVLRVP

SEQ ID NO: 325305 - protein, 9 aa, Influenza virus
MLKVPNALI

SEQ ID NO: 325306 - protein, 9 aa, Influenza virus
LRVPNALTD

SEQ ID NO: 325307 - protein, 9 aa, Influenza virus
KVPNALTDN

SEQ ID NO: 325308 - protein, 9 aa, Influenza virus
VPNALTDDK

SEQ ID NO: 325309 - protein, 9 aa, Influenza virus
PNALTDDKS

SEQ ID NO: 325310 - protein, 9 aa, Influenza virus
NALTDDKSK

SEQ ID NO: 325311 - protein, 9 aa, Influenza virus
ALTDNRSKP

SEQ ID NO: 325312 - protein, 9 aa, Influenza virus
QGQTVVLNT

SEQ ID NO: 325313 - protein, 9 aa, Influenza virus
GQTVVLNTD

SEQ ID NO: 325314 - protein, 9 aa, Influenza virus
QTVVLNTDW

SEQ ID NO: 325315 - protein, 9 aa, Influenza virus
TVVLNTDWS

SEQ ID NO: 325316 - protein, 9 aa, Influenza virus
VVLNTDWSG

SEQ ID NO: 325317 - protein, 9 aa, Influenza virus
VLDTDWSGY

SEQ ID NO: 325318 - protein, 9 aa, Influenza virus
LDTDWSGYS

SEQ ID NO: 325319 - protein, 9 aa, Influenza virus
WSGYSGSFI

SEQ ID NO: 325320 - protein, 9 aa, Influenza virus
SGYSGSFID

SEQ ID NO: 325321 - protein, 9 aa, Influenza virus
GYSGSFIDY

SEQ ID NO: 325322 - protein, 9 aa, Influenza virus
YSGSFIDYW

SEQ ID NO: 325323 - protein, 9 aa, Influenza virus
SGSFIDYWA

SEQ ID NO: 325324 - protein, 9 aa, Influenza virus
GSFIDYWAK

SEQ ID NO: 325325 - protein, 9 aa, Influenza virus
SFIDYWAKG

SEQ ID NO: 325326 - protein, 9 aa, Influenza virus
DYWAEGDCY

SEQ ID NO: 325327 - protein, 9 aa, Influenza virus
YWAEGDCYR

SEQ ID NO: 325328 - protein, 9 aa, Influenza virus
WAEGDCYRA

SEQ ID NO: 325329 - protein, 9 aa, Influenza virus
AEGDCYRAC

SEQ ID NO: 325330 - protein, 9 aa, Influenza virus
EGDCYRACF

SEQ ID NO: 325331 - protein, 9 aa, Influenza virus
GDCYRACFY

SEQ ID NO: 325332 - protein, 9 aa, Influenza virus
DCYRACFYV

SEQ ID NO: 325333 - protein, 9 aa, Influenza virus
LIRGRPKEE

SEQ ID NO: 325334 - protein, 9 aa, Influenza virus
IRGRPKEEK

SEQ ID NO: 325335 - protein, 9 aa, Influenza virus
RGRPKEEKV

SEQ ID NO: 325336 - protein, 9 aa, Influenza virus
GRPKEEKVW

SEQ ID NO: 325337 - protein, 9 aa, Influenza virus
RPKEEKVWW

SEQ ID NO: 325338 - protein, 9 aa, Influenza virus
PKEEKVWWT

SEQ ID NO: 325339 - protein, 9 aa, Influenza virus
KEEKVWWTS

SEQ ID NO: 325340 - protein, 9 aa, Influenza virus
EEKVWWTSN

SEQ ID NO: 325341 - protein, 9 aa, Influenza virus
EKVWWTSNS

SEQ ID NO: 325342 - protein, 9 aa, Influenza virus
RVWWTSNSI

SEQ ID NO: 325343 - protein, 9 aa, Influenza virus
VWWTSNSII

SEQ ID NO: 325344 - protein, 9 aa, Influenza virus
WWTSNSIIS

SEQ ID NO: 325345 - protein, 9 aa, Influenza virus
WTSNSIISM

SEQ ID NO: 325346 - protein, 9 aa, Influenza virus
SIISMCSST

SEQ ID NO: 325347 - protein, 9 aa, Influenza virus
IISMCSSTE

SEQ ID NO: 325348 - protein, 9 aa, Influenza virus
ISMCSSTEF

SEQ ID NO: 325349 - protein, 9 aa, Influenza virus
STEFLGQWD

SEQ ID NO: 325350 - protein, 9 aa, Influenza virus
TEFLGQWDW

SEQ ID NO: 325351 - protein, 9 aa, Influenza virus
EFLGQWDWP

SEQ ID NO: 325352 - protein, 9 aa, Influenza virus
FLGQWDWPD

SEQ ID NO: 325353 - protein, 9 aa, Influenza virus
LGQWDWPDG

SEQ ID NO: 325354 - protein, 9 aa, Influenza virus
GQWDWPDGA

SEQ ID NO: 325355 - protein, 9 aa, Influenza virus
QWDWPDGAK

SEQ ID NO: 325356 - protein, 9 aa, Influenza virus
WDWPDGAKI

SEQ ID NO: 325357 - protein, 9 aa, Influenza virus
DWPDGAKIE

SEQ ID NO: 325358 - protein, 9 aa, Influenza virus
WPDGAEIEY

SEQ ID NO: 325359 - protein, 9 aa, Influenza virus
PDGAEIEYF

SEQ ID NO: 325360 - protein, 9 aa, Influenza virus
DGAEIEYFL

SEQ ID NO: 325361 - protein, 9 aa, Influenza virus
GIDKICLGH

SEQ ID NO: 325362 - protein, 9 aa, Influenza virus
IDKICLGHH

SEQ ID NO: 325363 - protein, 9 aa, Influenza virus
DRICLGHHA

SEQ ID NO: 325364 - protein, 9 aa, Influenza virus
RICLGHHAV

SEQ ID NO: 325365 - protein, 9 aa, Influenza virus
ICLGHHAVP

SEQ ID NO: 325366 - protein, 9 aa, Influenza virus
CLGHHAVPN

SEQ ID NO: 325367 - protein, 9 aa, Influenza virus
LGHHAVPNG

SEQ ID NO: 325368 - protein, 9 aa, Influenza virus
GHHAVPNGT

SEQ ID NO: 325369 - protein, 9 aa, Influenza virus
NGTVVKTLT

SEQ ID NO: 325370 - protein, 9 aa, Influenza virus
QEEVTNATE

SEQ ID NO: 325371 - protein, 9 aa, Influenza virus
TNATETVEN

SEQ ID NO: 325372 - protein, 9 aa, Influenza virus
KDLGSCHPI

SEQ ID NO: 325373 - protein, 9 aa, Influenza virus
DLGSCHPIG

SEQ ID NO: 325374 - protein, 9 aa, Influenza virus
LGSCHPIGM

SEQ ID NO: 325375 - protein, 9 aa, Influenza virus
GKWDTLIER

SEQ ID NO: 325376 - protein, 9 aa, Influenza virus
INEEALRQK

SEQ ID NO: 325377 - protein, 9 aa, Influenza virus
NEGALRQKI

SEQ ID NO: 325378 - protein, 9 aa, Influenza virus
EGALRQKIM

SEQ ID NO: 325379 - protein, 9 aa, Influenza virus
GALRQKIME

SEQ ID NO: 325380 - protein, 9 aa, Influenza virus
RQKVMESGG

SEQ ID NO: 325381 - protein, 9 aa, Influenza virus
QKIMESGGV

SEQ ID NO: 325382 - protein, 9 aa, Influenza virus
SFYTELKWL

SEQ ID NO: 325383 - protein, 9 aa, Influenza virus
GQNFPQTAN

SEQ ID NO: 325384 - protein, 9 aa, Influenza virus
QNFPQTANT

SEQ ID NO: 325385 - protein, 9 aa, Influenza virus
NFPQTANTY

SEQ ID NO: 325386 - protein, 9 aa, Influenza virus
FPQTANTYR

SEQ ID NO: 325387 - protein, 9 aa, Influenza virus
PQTANTYRN

SEQ ID NO: 325388 - protein, 9 aa, Influenza virus
QTANTYRNT

SEQ ID NO: 325389 - protein, 9 aa, Influenza virus
TANTYRNTD

SEQ ID NO: 325390 - protein, 9 aa, Influenza virus
TNTYRNTDT

SEQ ID NO: 325391 - protein, 9 aa, Influenza virus
WGIHHPSSA

SEQ ID NO: 325392 - protein, 9 aa, Influenza virus
LYGAQSLSI

SEQ ID NO: 325393 - protein, 9 aa, Influenza virus
YGTQPLSIS

SEQ ID NO: 325394 - protein, 9 aa, Influenza virus
GTQSLSISI

SEQ ID NO: 325395 - protein, 9 aa, Influenza virus
TQSLSISIG

SEQ ID NO: 325396 - protein, 9 aa, Influenza virus
QSLSISIGS

SEQ ID NO: 325397 - protein, 9 aa, Influenza virus
SLSISIGSS

SEQ ID NO: 325398 - protein, 9 aa, Influenza virus
LSISIGSST

SEQ ID NO: 325399 - protein, 9 aa, Influenza virus
SISVESSTY

SEQ ID NO: 325400 - protein, 9 aa, Influenza virus
ISIGSSTYQ

SEQ ID NO: 325401 - protein, 9 aa, Influenza virus
SIGSSTYQN

SEQ ID NO: 325402 - protein, 9 aa, Influenza virus
VGSSTYQNS

SEQ ID NO: 325403 - protein, 9 aa, Influenza virus
GSSTYQNSF

SEQ ID NO: 325404 - protein, 9 aa, Influenza virus
SSTYQNSFV

SEQ ID NO: 325405 - protein, 9 aa, Influenza virus
STYQNSFVP

SEQ ID NO: 325406 - protein, 9 aa, Influenza virus
TYQNSFVPV

SEQ ID NO: 325407 - protein, 9 aa, Influenza virus
YQNSFVPVV

SEQ ID NO: 325408 - protein, 9 aa, Influenza virus
QNSFVPVVG

SEQ ID NO: 325409 - protein, 9 aa, Influenza virus
NSFVPVVGA

SEQ ID NO: 325410 - protein, 9 aa, Influenza virus
SFVPVVGAR

SEQ ID NO: 325411 - protein, 9 aa, Influenza virus
FVPVIGARP

SEQ ID NO: 325412 - protein, 9 aa, Influenza virus
VPVIGARPQ

SEQ ID NO: 325413 - protein, 9 aa, Influenza virus
PVIGARPQV

SEQ ID NO: 325414 - protein, 9 aa, Influenza virus
VIGARPQVN

SEQ ID NO: 325415 - protein, 9 aa, Influenza virus
IGARPQVNG

SEQ ID NO: 325416 - protein, 9 aa, Influenza virus
RARPQVNGQ

SEQ ID NO: 325417 - protein, 9 aa, Influenza virus
DRPLVNGQR

SEQ ID NO: 325418 - protein, 9 aa, Influenza virus
RPLVNGQSG

SEQ ID NO: 325419 - protein, 9 aa, Influenza virus
PQVNGQRGR

SEQ ID NO: 325420 - protein, 9 aa, Influenza virus
QVNGQSGRV

SEQ ID NO: 325421 - protein, 9 aa, Influenza virus
VNGQSGRIE

SEQ ID NO: 325422 - protein, 9 aa, Influenza virus
NGQSGRIEF

SEQ ID NO: 325423 - protein, 9 aa, Influenza virus
GQSGRIEFH

SEQ ID NO: 325424 - protein, 9 aa, Influenza virus
QSGRIEFHW

SEQ ID NO: 325425 - protein, 9 aa, Influenza virus
PGDSITFSH

SEQ ID NO: 325426 - protein, 9 aa, Influenza virus
GDSITFSHN

SEQ ID NO: 325427 - protein, 9 aa, Influenza virus
DSITFSHNG

SEQ ID NO: 325428 - protein, 9 aa, Influenza virus
SITFSHNGG

SEQ ID NO: 325429 - protein, 9 aa, Influenza virus
ITFSHNGGR

SEQ ID NO: 325430 - protein, 9 aa, Influenza virus
TFSHNGGRI

SEQ ID NO: 325431 - protein, 9 aa, Influenza virus
FSHNGGRIA

SEQ ID NO: 325432 - protein, 9 aa, Influenza virus
SHNGGRIAP

SEQ ID NO: 325433 - protein, 9 aa, Influenza virus
HNGGLIAPD

SEQ ID NO: 325434 - protein, 9 aa, Influenza virus
NGGLIAPDR

SEQ ID NO: 325435 - protein, 9 aa, Influenza virus
GGLIAPDRV

SEQ ID NO: 325436 - protein, 9 aa, Influenza virus
CESKCFWRG

SEQ ID NO: 325437 - protein, 9 aa, Influenza virus
ESKCFWRGG

SEQ ID NO: 325438 - protein, 9 aa, Influenza virus
SKCFWRGGS

SEQ ID NO: 325439 - protein, 9 aa, Influenza virus
KCFWRGGSI

SEQ ID NO: 325440 - protein, 9 aa, Influenza virus
CFWRGGSIN

SEQ ID NO: 325441 - protein, 9 aa, Influenza virus
FWRGGSINT

SEQ ID NO: 325442 - protein, 9 aa, Influenza virus
GGSINTRLP

SEQ ID NO: 325443 - protein, 9 aa, Influenza virus
GSINTRLPF

SEQ ID NO: 325444 - protein, 9 aa, Influenza virus
SINTRLPFQ

SEQ ID NO: 325445 - protein, 9 aa, Influenza virus
INTRLPFQN

SEQ ID NO: 325446 - protein, 9 aa, Influenza virus
NTRLPFQNL

SEQ ID NO: 325447 - protein, 9 aa, Influenza virus
TRLPFQNLS

SEQ ID NO: 325448 - protein, 9 aa, Influenza virus
RLPFQNLSP

SEQ ID NO: 325449 - protein, 9 aa, Influenza virus
VGQCPKYVS

SEQ ID NO: 325450 - protein, 9 aa, Influenza virus
GQCPKYVSK

SEQ ID NO: 325451 - protein, 9 aa, Influenza virus
RSLLLATGM

SEQ ID NO: 325452 - protein, 9 aa, Influenza virus
SLMLATGMR

SEQ ID NO: 325453 - protein, 9 aa, Influenza virus
LMLATGMRN

SEQ ID NO: 325454 - protein, 9 aa, Influenza virus
MLATGMRNV

SEQ ID NO: 325455 - protein, 9 aa, Influenza virus
TGMRNVPEI

SEQ ID NO: 325456 - protein, 9 aa, Influenza virus
QERGLFGAI

SEQ ID NO: 325457 - protein, 9 aa, Influenza virus
ERGLFGAIA

SEQ ID NO: 325458 - protein, 9 aa, Influenza virus
RGLFGAKAG

SEQ ID NO: 325459 - protein, 9 aa, Influenza virus
GLFGAKAGF

SEQ ID NO: 325460 - protein, 9 aa, Influenza virus
LFGAKAGFI

SEQ ID NO: 325461 - protein, 9 aa, Influenza virus
FGAKAGFIE

SEQ ID NO: 325462 - protein, 9 aa, Influenza virus
GAKAGFIEN

SEQ ID NO: 325463 - protein, 9 aa, Influenza virus
AKAGFIENG

SEQ ID NO: 325464 - protein, 9 aa, Influenza virus
KAGFIENGW

SEQ ID NO: 325465 - protein, 9 aa, Influenza virus
IENGWEGMI

SEQ ID NO: 325466 - protein, 9 aa, Influenza virus
ENGWEGMID

SEQ ID NO: 325467 - protein, 9 aa, Influenza virus
NGWEGMIDG

SEQ ID NO: 325468 - protein, 9 aa, Influenza virus
GWEGMIDGW

SEQ ID NO: 325469 - protein, 9 aa, Influenza virus
WEGMIDGWY

SEQ ID NO: 325470 - protein, 9 aa, Influenza virus
EGMIDGWYG

SEQ ID NO: 325471 - protein, 9 aa, Influenza virus
GMIDGWYGF

SEQ ID NO: 325472 - protein, 9 aa, Influenza virus
MIDGWYGFR

SEQ ID NO: 325473 - protein, 9 aa, Influenza virus
IDGWYGFRH

SEQ ID NO: 325474 - protein, 9 aa, Influenza virus
FRHQNAQGI

SEQ ID NO: 325475 - protein, 9 aa, Influenza virus
RHQNAQGIG

SEQ ID NO: 325476 - protein, 9 aa, Influenza virus
HQNAQGIGQ

SEQ ID NO: 325477 - protein, 9 aa, Influenza virus
QNAQGIGQA

SEQ ID NO: 325478 - protein, 9 aa, Influenza virus
NAQGIGQAA

SEQ ID NO: 325479 - protein, 9 aa, Influenza virus
AQGIGQAAD

SEQ ID NO: 325480 - protein, 9 aa, Influenza virus
QGIGQAADY

SEQ ID NO: 325481 - protein, 9 aa, Influenza virus
GIGQAADYK

SEQ ID NO: 325482 - protein, 9 aa, Influenza virus
IGQAADYKS

SEQ ID NO: 325483 - protein, 9 aa, Influenza virus
GQAADYEST

SEQ ID NO: 325484 - protein, 9 aa, Influenza virus
QAADYESTQ

SEQ ID NO: 325485 - protein, 9 aa, Influenza virus
AADYKSTQT

SEQ ID NO: 325486 - protein, 9 aa, Influenza virus
ADYKSTQTA

SEQ ID NO: 325487 - protein, 9 aa, Influenza virus
DYKSTQAAV

SEQ ID NO: 325488 - protein, 9 aa, Influenza virus
AVDQITGKL

SEQ ID NO: 325489 - protein, 9 aa, Influenza virus
VDQITGKLN

SEQ ID NO: 325490 - protein, 9 aa, Influenza virus
VQITGKLNR

SEQ ID NO: 325491 - protein, 9 aa, Influenza virus
QVTGKLNRL

SEQ ID NO: 325492 - protein, 9 aa, Influenza virus
VTGKLNRLI

SEQ ID NO: 325493 - protein, 9 aa, Influenza virus
FESIESEFN

SEQ ID NO: 325494 - protein, 9 aa, Influenza virus
ESIESEFNE

SEQ ID NO: 325495 - protein, 9 aa, Influenza virus
SIESEFNEI

SEQ ID NO: 325496 - protein, 9 aa, Influenza virus
IESEFNEIE

SEQ ID NO: 325497 - protein, 9 aa, Influenza virus
ESEFNEIEH

SEQ ID NO: 325498 - protein, 9 aa, Influenza virus
SEFNEIEHQ

SEQ ID NO: 325499 - protein, 9 aa, Influenza virus
EFNEIEHQI

SEQ ID NO: 325500 - protein, 9 aa, Influenza virus
FNEIEHQIG

SEQ ID NO: 325501 - protein, 9 aa, Influenza virus
NEIEHQIGN

SEQ ID NO: 325502 - protein, 9 aa, Influenza virus
ETEHQIGNV

SEQ ID NO: 325503 - protein, 9 aa, Influenza virus
TEHQIGNVI

SEQ ID NO: 325504 - protein, 9 aa, Influenza virus
EHQISNVIN

SEQ ID NO: 325505 - protein, 9 aa, Influenza virus
HQISNVINW

SEQ ID NO: 325506 - protein, 9 aa, Influenza virus
SITYIWTYQ

SEQ ID NO: 325507 - protein, 9 aa, Influenza virus
ITYIWTYQA

SEQ ID NO: 325508 - protein, 9 aa, Influenza virus
TYIWTYQAE

SEQ ID NO: 325509 - protein, 9 aa, Influenza virus
YIWTYQAEL

SEQ ID NO: 325510 - protein, 9 aa, Influenza virus
WTYQEELLV

SEQ ID NO: 325511 - protein, 9 aa, Influenza virus
TYQAELLIA

SEQ ID NO: 325512 - protein, 9 aa, Influenza virus
YNAELLVAM

SEQ ID NO: 325513 - protein, 9 aa, Influenza virus
NAELLVAME

SEQ ID NO: 325514 - protein, 9 aa, Influenza virus
ENQHTIDLA

SEQ ID NO: 325515 - protein, 9 aa, Influenza virus
NQHTIDLAD

SEQ ID NO: 325516 - protein, 9 aa, Influenza virus
QHTIDLADS

SEQ ID NO: 325517 - protein, 9 aa, Influenza virus
HTIDLADSE

SEQ ID NO: 325518 - protein, 9 aa, Influenza virus
TIEMTDSEM

SEQ ID NO: 325519 - protein, 9 aa, Influenza virus
IDLADSEML

SEQ ID NO: 325520 - protein, 9 aa, Influenza virus
DMGDSEMLN

SEQ ID NO: 325521 - protein, 9 aa, Influenza virus
MTDSEMLNL

SEQ ID NO: 325522 - protein, 9 aa, Influenza virus
TDSEMLNLY

SEQ ID NO: 325523 - protein, 9 aa, Influenza virus
DSEMLNLYD

SEQ ID NO: 325524 - protein, 9 aa, Influenza virus
SEMLNLYDR

SEQ ID NO: 325525 - protein, 9 aa, Influenza virus
EMLNLYDRV

SEQ ID NO: 325526 - protein, 9 aa, Influenza virus
MLNLYDRVR

SEQ ID NO: 325527 - protein, 9 aa, Influenza virus
LNLYDRVRK

SEQ ID NO: 325528 - protein, 9 aa, Influenza virus
NLYDRVRKQ

SEQ ID NO: 325529 - protein, 9 aa, Influenza virus
LYDRVRKQL

SEQ ID NO: 325530 - protein, 9 aa, Influenza virus
YDRVRKQLR

SEQ ID NO: 325531 - protein, 9 aa, Influenza virus
DRVRKQLRQ

SEQ ID NO: 325532 - protein, 9 aa, Influenza virus
RQNAEEDGR

SEQ ID NO: 325533 - protein, 9 aa, Influenza virus
QNAEEDGRG

SEQ ID NO: 325534 - protein, 9 aa, Influenza virus
NAEEDGRGC

SEQ ID NO: 325535 - protein, 9 aa, Influenza virus
AEEDGRGCF

SEQ ID NO: 325536 - protein, 9 aa, Influenza virus
EEDGRGCFE

SEQ ID NO: 325537 - protein, 9 aa, Influenza virus
EDGRGCFEI

SEQ ID NO: 325538 - protein, 9 aa, Influenza virus
DGRGCFEIY

SEQ ID NO: 325539 - protein, 9 aa, Influenza virus
GRGCFEIYH

SEQ ID NO: 325540 - protein, 9 aa, Influenza virus
GCFEIYHAC

SEQ ID NO: 325541 - protein, 9 aa, Influenza virus
SCMESIRNN

SEQ ID NO: 325542 - protein, 9 aa, Influenza virus
CMERIRNNT

SEQ ID NO: 325543 - protein, 9 aa, Influenza virus
MERIRNNTY

SEQ ID NO: 325544 - protein, 9 aa, Influenza virus
ERIRNNTYD

SEQ ID NO: 325545 - protein, 9 aa, Influenza virus
SIRNNTYNH

SEQ ID NO: 325546 - protein, 9 aa, Influenza virus
IRNNTYDHS

SEQ ID NO: 325547 - protein, 9 aa, Influenza virus
RNNTYDHSQ

SEQ ID NO: 325548 - protein, 9 aa, Influenza virus
NNTYDHSQY

SEQ ID NO: 325549 - protein, 9 aa, Influenza virus
NTYDHSQYR

SEQ ID NO: 325550 - protein, 9 aa, Influenza virus
TYDHSQYRE

SEQ ID NO: 325551 - protein, 9 aa, Influenza virus
YDHSQYREE

SEQ ID NO: 325552 - protein, 9 aa, Influenza virus
HSQYREEAL

SEQ ID NO: 325553 - protein, 9 aa, Influenza virus
SQYREEALL

SEQ ID NO: 325554 - protein, 9 aa, Influenza virus
QYREESLLN

SEQ ID NO: 325555 - protein, 9 aa, Influenza virus
YREESLLNR

SEQ ID NO: 325556 - protein, 9 aa, Influenza virus
REESLLNRL

SEQ ID NO: 325557 - protein, 9 aa, Influenza virus
EEALLNRLS

SEQ ID NO: 325558 - protein, 9 aa, Influenza virus
EALLNRLSI

SEQ ID NO: 325559 - protein, 9 aa, Influenza virus
ALLNRLSIN

SEQ ID NO: 325560 - protein, 9 aa, Influenza virus
LLNRLNINS

SEQ ID NO: 325561 - protein, 9 aa, Influenza virus
LNRLNINSV

SEQ ID NO: 325562 - protein, 9 aa, Influenza virus
INSVKLSSG

SEQ ID NO: 325563 - protein, 9 aa, Influenza virus
NSVKLSSGY

SEQ ID NO: 325564 - protein, 9 aa, Influenza virus
SVKLSSGYK

SEQ ID NO: 325565 - protein, 9 aa, Influenza virus
VTLSSGYKD

SEQ ID NO: 325566 - protein, 9 aa, Influenza virus
LSSGYKDII

SEQ ID NO: 325567 - protein, 9 aa, Influenza virus
SSGYKDIIL

SEQ ID NO: 325568 - protein, 9 aa, Influenza virus
SGYKDIILW

SEQ ID NO: 325569 - protein, 9 aa, Influenza virus
GYKDIILWF

SEQ ID NO: 325570 - protein, 9 aa, Influenza virus
YKDIILWFS

SEQ ID NO: 325571 - protein, 9 aa, Influenza virus
KDIILWFSF

SEQ ID NO: 325572 - protein, 9 aa, Influenza virus
DIILWFSFG

SEQ ID NO: 325573 - protein, 9 aa, Influenza virus
IILWFSFGA

SEQ ID NO: 325574 - protein, 9 aa, Influenza virus
LWFSFGASS

SEQ ID NO: 325575 - protein, 9 aa, Influenza virus
WFSFGASSF

SEQ ID NO: 325576 - protein, 9 aa, Influenza virus
FSFGASCFI

SEQ ID NO: 325577 - protein, 9 aa, Influenza virus
SFGASCFIL

SEQ ID NO: 325578 - protein, 9 aa, Influenza virus
FGASCFILL

SEQ ID NO: 325579 - protein, 9 aa, Influenza virus
GASCFILLA

SEQ ID NO: 325580 - protein, 9 aa, Influenza virus
FFCLRNGNM

SEQ ID NO: 325581 - protein, 9 aa, Influenza virus
FCLRNGNMR

SEQ ID NO: 325582 - protein, 9 aa, Influenza virus
GIDKICLGH

SEQ ID NO: 325583 - protein, 9 aa, Influenza virus
IDKICLGHH

SEQ ID NO: 325584 - protein, 9 aa, Influenza virus
DRICLGHHA

SEQ ID NO: 325585 - protein, 9 aa, Influenza virus
RICLGHHAV

SEQ ID NO: 325586 - protein, 9 aa, Influenza virus
ICLGHHAVP

SEQ ID NO: 325587 - protein, 9 aa, Influenza virus
CLGHHAVPN

SEQ ID NO: 325588 - protein, 9 aa, Influenza virus
LGHHAVPNG

SEQ ID NO: 325589 - protein, 9 aa, Influenza virus
GHHAVPNGT

SEQ ID NO: 325590 - protein, 9 aa, Influenza virus
HHAVPNGTI

SEQ ID NO: 325591 - protein, 9 aa, Influenza virus
PNGTIVKTL

SEQ ID NO: 325592 - protein, 9 aa, Influenza virus
NGTVVKTLT

SEQ ID NO: 325593 - protein, 9 aa, Influenza virus
GTIVKTLTS

SEQ ID NO: 325594 - protein, 9 aa, Influenza virus
TIVKTLTSE

SEQ ID NO: 325595 - protein, 9 aa, Influenza virus
IVKTLTNEQ

SEQ ID NO: 325596 - protein, 9 aa, Influenza virus
VKTLTNEQE

SEQ ID NO: 325597 - protein, 9 aa, Influenza virus
KTLTNEQEE

SEQ ID NO: 325598 - protein, 9 aa, Influenza virus
TLTNEQEEV

SEQ ID NO: 325599 - protein, 9 aa, Influenza virus
EQEEVTNAT

SEQ ID NO: 325600 - protein, 9 aa, Influenza virus
QEEVTNATE

SEQ ID NO: 325601 - protein, 9 aa, Influenza virus
EKVTNATET

SEQ ID NO: 325602 - protein, 9 aa, Influenza virus
KVTNATETV

SEQ ID NO: 325603 - protein, 9 aa, Influenza virus
TNATETVEN

SEQ ID NO: 325604 - protein, 9 aa, Influenza virus
NATETVEST

SEQ ID NO: 325605 - protein, 9 aa, Influenza virus
YKDLGSCHP

SEQ ID NO: 325606 - protein, 9 aa, Influenza virus
KDLGSCHPI

SEQ ID NO: 325607 - protein, 9 aa, Influenza virus
DLGSCHPIG

SEQ ID NO: 325608 - protein, 9 aa, Influenza virus
LGSCHPIGM

SEQ ID NO: 325609 - protein, 9 aa, Influenza virus
CHPIGMIIG

SEQ ID NO: 325610 - protein, 9 aa, Influenza virus
GTPVCDPHL

SEQ ID NO: 325611 - protein, 9 aa, Influenza virus
TPACDLYLT

SEQ ID NO: 325612 - protein, 9 aa, Influenza virus
PVCDPHLTG

SEQ ID NO: 325613 - protein, 9 aa, Influenza virus
CDPHLTGTW

SEQ ID NO: 325614 - protein, 9 aa, Influenza virus
DLYLTGTWD

SEQ ID NO: 325615 - protein, 9 aa, Influenza virus
PHLTGTWDT

SEQ ID NO: 325616 - protein, 9 aa, Influenza virus
YLTGTWDTL

SEQ ID NO: 325617 - protein, 9 aa, Influenza virus
LTGIWDTLI

SEQ ID NO: 325618 - protein, 9 aa, Influenza virus
TGMWDTLIE

SEQ ID NO: 325619 - protein, 9 aa, Influenza virus
GIWDTLIER

SEQ ID NO: 325620 - protein, 9 aa, Influenza virus
TWDTLIERE

SEQ ID NO: 325621 - protein, 9 aa, Influenza virus
WDTLIEREN

SEQ ID NO: 325622 - protein, 9 aa, Influenza virus
DTLIERENA

SEQ ID NO: 325623 - protein, 9 aa, Influenza virus
IAHCYPGAT

SEQ ID NO: 325624 - protein, 9 aa, Influenza virus
AHCYPGATI

SEQ ID NO: 325625 - protein, 9 aa, Influenza virus
HCYPGATIN

SEQ ID NO: 325626 - protein, 9 aa, Influenza virus
CYPGATINE

SEQ ID NO: 325627 - protein, 9 aa, Influenza virus
YPGATINEE

SEQ ID NO: 325628 - protein, 9 aa, Influenza virus
PGATINEEA

SEQ ID NO: 325629 - protein, 9 aa, Influenza virus
GATINEEAL

SEQ ID NO: 325630 - protein, 9 aa, Influenza virus
ATINEEALR

SEQ ID NO: 325631 - protein, 9 aa, Influenza virus
TINEEALRQ

SEQ ID NO: 325632 - protein, 9 aa, Influenza virus
INEEALRQK

SEQ ID NO: 325633 - protein, 9 aa, Influenza virus
NEGALRQKI

SEQ ID NO: 325634 - protein, 9 aa, Influenza virus
EGALRQKIM

SEQ ID NO: 325635 - protein, 9 aa, Influenza virus
GALRQKIME

SEQ ID NO: 325636 - protein, 9 aa, Influenza virus
KIMESGGIS

SEQ ID NO: 325637 - protein, 9 aa, Influenza virus
IMESGGISK

SEQ ID NO: 325638 - protein, 9 aa, Influenza virus
MESGGISKI

SEQ ID NO: 325639 - protein, 9 aa, Influenza virus
ESGGIDKIG

SEQ ID NO: 325640 - protein, 9 aa, Influenza virus
SGGIDKIGT

SEQ ID NO: 325641 - protein, 9 aa, Influenza virus
FIYGSSINS

SEQ ID NO: 325642 - protein, 9 aa, Influenza virus
YESSINPAG

SEQ ID NO: 325643 - protein, 9 aa, Influenza virus
GGDSFYAEL

SEQ ID NO: 325644 - protein, 9 aa, Influenza virus
GDSFYAELK

SEQ ID NO: 325645 - protein, 9 aa, Influenza virus
DSFYAELKW

SEQ ID NO: 325646 - protein, 9 aa, Influenza virus
FYAELKWLI

SEQ ID NO: 325647 - protein, 9 aa, Influenza virus
YAELKWLIS

SEQ ID NO: 325648 - protein, 9 aa, Influenza virus
AELKWLISK

SEQ ID NO: 325649 - protein, 9 aa, Influenza virus
ELKWLVSKT

SEQ ID NO: 325650 - protein, 9 aa, Influenza virus
LKWLVSKTK

SEQ ID NO: 325651 - protein, 9 aa, Influenza virus
KWLVSKTKG

SEQ ID NO: 325652 - protein, 9 aa, Influenza virus
WLVSKTKGQ

SEQ ID NO: 325653 - protein, 9 aa, Influenza virus
QNFPQTANT

SEQ ID NO: 325654 - protein, 9 aa, Influenza virus
NFPQTANTY

SEQ ID NO: 325655 - protein, 9 aa, Influenza virus
FPQTANTYR

SEQ ID NO: 325656 - protein, 9 aa, Influenza virus
PQTANTYRN

SEQ ID NO: 325657 - protein, 9 aa, Influenza virus
QTANTYRNT

SEQ ID NO: 325658 - protein, 9 aa, Influenza virus
TANTYRNTD

SEQ ID NO: 325659 - protein, 9 aa, Influenza virus
ANTYRNTDS

SEQ ID NO: 325660 - protein, 9 aa, Influenza virus
EHLIVWGIH

SEQ ID NO: 325661 - protein, 9 aa, Influenza virus
HLIVWGIHH

SEQ ID NO: 325662 - protein, 9 aa, Influenza virus
LIVWGIHHP

SEQ ID NO: 325663 - protein, 9 aa, Influenza virus
IVWGIHHPS

SEQ ID NO: 325664 - protein, 9 aa, Influenza virus
VWGIHHPSS

SEQ ID NO: 325665 - protein, 9 aa, Influenza virus
WGIHHPSSA

SEQ ID NO: 325666 - protein, 9 aa, Influenza virus
GIHHPSSTK

SEQ ID NO: 325667 - protein, 9 aa, Influenza virus
IHHPSSTKE

SEQ ID NO: 325668 - protein, 9 aa, Influenza virus
HHPSSTKEK

SEQ ID NO: 325669 - protein, 9 aa, Influenza virus
HPSSTKEKN

SEQ ID NO: 325670 - protein, 9 aa, Influenza virus
PSSTKEKND

SEQ ID NO: 325671 - protein, 9 aa, Influenza virus
SSTKEKNDL

SEQ ID NO: 325672 - protein, 9 aa, Influenza virus
STKEKNDLY

SEQ ID NO: 325673 - protein, 9 aa, Influenza virus
TKEKNDLYG

SEQ ID NO: 325674 - protein, 9 aa, Influenza virus
KEKNDLYGT

SEQ ID NO: 325675 - protein, 9 aa, Influenza virus
EKNELYGTQ

SEQ ID NO: 325676 - protein, 9 aa, Influenza virus
KNDLYGTQP

SEQ ID NO: 325677 - protein, 9 aa, Influenza virus
NELYGTQSL

SEQ ID NO: 325678 - protein, 9 aa, Influenza virus
ELYGTQSLS

SEQ ID NO: 325679 - protein, 9 aa, Influenza virus
LYGTQPLSI

SEQ ID NO: 325680 - protein, 9 aa, Influenza virus
YGTQPLSIS

SEQ ID NO: 325681 - protein, 9 aa, Influenza virus
GTQSLSISI

SEQ ID NO: 325682 - protein, 9 aa, Influenza virus
TQSLSISVE

SEQ ID NO: 325683 - protein, 9 aa, Influenza virus
QSLSISVES

SEQ ID NO: 325684 - protein, 9 aa, Influenza virus
SLSISVESS

SEQ ID NO: 325685 - protein, 9 aa, Influenza virus
LSISVESST

SEQ ID NO: 325686 - protein, 9 aa, Influenza virus
SISVESSTY

SEQ ID NO: 325687 - protein, 9 aa, Influenza virus
ISVESSTYQ

SEQ ID NO: 325688 - protein, 9 aa, Influenza virus
SVESSTYQN

SEQ ID NO: 325689 - protein, 9 aa, Influenza virus
VGSSTYQNS

SEQ ID NO: 325690 - protein, 9 aa, Influenza virus
GSSTYQNSF

SEQ ID NO: 325691 - protein, 9 aa, Influenza virus
SSTYQNSFV

SEQ ID NO: 325692 - protein, 9 aa, Influenza virus
STYQNSFVP

SEQ ID NO: 325693 - protein, 9 aa, Influenza virus
TYQNSFVPV

SEQ ID NO: 325694 - protein, 9 aa, Influenza virus
YQNSFVPVV

SEQ ID NO: 325695 - protein, 9 aa, Influenza virus
QNSFVPVVG

SEQ ID NO: 325696 - protein, 9 aa, Influenza virus
NSFVPVVGA

SEQ ID NO: 325697 - protein, 9 aa, Influenza virus
SFVPVVGAR

SEQ ID NO: 325698 - protein, 9 aa, Influenza virus
VNGQSGRIN

SEQ ID NO: 325699 - protein, 9 aa, Influenza virus
NGQSGRINF

SEQ ID NO: 325700 - protein, 9 aa, Influenza virus
GQSGRINFH

SEQ ID NO: 325701 - protein, 9 aa, Influenza virus
QSGRINFHW

SEQ ID NO: 325702 - protein, 9 aa, Influenza virus
SGRINFHWT

SEQ ID NO: 325703 - protein, 9 aa, Influenza virus
VRPGDNITF

SEQ ID NO: 325704 - protein, 9 aa, Influenza virus
RPGDNITFS

SEQ ID NO: 325705 - protein, 9 aa, Influenza virus
PGDNITFSD

SEQ ID NO: 325706 - protein, 9 aa, Influenza virus
GDNITFSDN

SEQ ID NO: 325707 - protein, 9 aa, Influenza virus
DNIIFSHNG

SEQ ID NO: 325708 - protein, 9 aa, Influenza virus
NITFSDNGG

SEQ ID NO: 325709 - protein, 9 aa, Influenza virus
ITFLHNGGL

SEQ ID NO: 325710 - protein, 9 aa, Influenza virus
IFSHNGGLI

SEQ ID NO: 325711 - protein, 9 aa, Influenza virus
FSDNGGLIA

SEQ ID NO: 325712 - protein, 9 aa, Influenza virus
SDNGGLIAP

SEQ ID NO: 325713 - protein, 9 aa, Influenza virus
DNGGLIAPS

SEQ ID NO: 325714 - protein, 9 aa, Influenza virus
NGGLIAPDR

SEQ ID NO: 325715 - protein, 9 aa, Influenza virus
GGLVAPSRV

SEQ ID NO: 325716 - protein, 9 aa, Influenza virus
GLIAPSRVT

SEQ ID NO: 325717 - protein, 9 aa, Influenza virus
LIAPSRVTK

SEQ ID NO: 325718 - protein, 9 aa, Influenza virus
IAPSRVTKL

SEQ ID NO: 325719 - protein, 9 aa, Influenza virus
APSRVSKLR

SEQ ID NO: 325720 - protein, 9 aa, Influenza virus
PSRVSKLRG

SEQ ID NO: 325721 - protein, 9 aa, Influenza virus
GRGLGIQSE

SEQ ID NO: 325722 - protein, 9 aa, Influenza virus
DNNCESKCF

SEQ ID NO: 325723 - protein, 9 aa, Influenza virus
NNCESKCFW

SEQ ID NO: 325724 - protein, 9 aa, Influenza virus
CESKCFWRG

SEQ ID NO: 325725 - protein, 9 aa, Influenza virus
ESKCFWRGG

SEQ ID NO: 325726 - protein, 9 aa, Influenza virus
SKCFWRGGS

SEQ ID NO: 325727 - protein, 9 aa, Influenza virus
KCFWRGGSI

SEQ ID NO: 325728 - protein, 9 aa, Influenza virus
CFWKGGSIK

SEQ ID NO: 325729 - protein, 9 aa, Influenza virus
FWKGGSIKT

SEQ ID NO: 325730 - protein, 9 aa, Influenza virus
WKGGSIKTK

SEQ ID NO: 325731 - protein, 9 aa, Influenza virus
KGGSIKTKL

SEQ ID NO: 325732 - protein, 9 aa, Influenza virus
GGSIKTKLP

SEQ ID NO: 325733 - protein, 9 aa, Influenza virus
GSIKTKLPF

SEQ ID NO: 325734 - protein, 9 aa, Influenza virus
SIKTKLPFQ

SEQ ID NO: 325735 - protein, 9 aa, Influenza virus
IKTKLPFQN

SEQ ID NO: 325736 - protein, 9 aa, Influenza virus
KTKLPFQNL

SEQ ID NO: 325737 - protein, 9 aa, Influenza virus
TRLPFQNLS

SEQ ID NO: 325738 - protein, 9 aa, Influenza virus
RLPFQNLSP

SEQ ID NO: 325739 - protein, 9 aa, Influenza virus
VGQCPKYVS

SEQ ID NO: 325740 - protein, 9 aa, Influenza virus
GQCPKYVSK

SEQ ID NO: 325741 - protein, 9 aa, Influenza virus
RSLLLATGM

SEQ ID NO: 325742 - protein, 9 aa, Influenza virus
SLMLATGMR

SEQ ID NO: 325743 - protein, 9 aa, Influenza virus
LMLATGMRN

SEQ ID NO: 325744 - protein, 9 aa, Influenza virus
MLATGMRNV

SEQ ID NO: 325745 - protein, 9 aa, Influenza virus
TGMRNVPEI

SEQ ID NO: 325746 - protein, 9 aa, Influenza virus
QERGLFGAI

SEQ ID NO: 325747 - protein, 9 aa, Influenza virus
ERGLFGAIA

SEQ ID NO: 325748 - protein, 9 aa, Influenza virus
LFGAIAGFL

SEQ ID NO: 325749 - protein, 9 aa, Influenza virus
FGAIAGFLE

SEQ ID NO: 325750 - protein, 9 aa, Influenza virus
GAIAGFLEN

SEQ ID NO: 325751 - protein, 9 aa, Influenza virus
AKAGFIENG

SEQ ID NO: 325752 - protein, 9 aa, Influenza virus
KAGFIENGW

SEQ ID NO: 325753 - protein, 9 aa, Influenza virus
GTGQAADYE

SEQ ID NO: 325754 - protein, 9 aa, Influenza virus
TGQAADYES

SEQ ID NO: 325755 - protein, 9 aa, Influenza virus
GQAADYEST

SEQ ID NO: 325756 - protein, 9 aa, Influenza virus
QAADYESTQ

SEQ ID NO: 325757 - protein, 9 aa, Influenza virus
AADYESTQA

SEQ ID NO: 325758 - protein, 9 aa, Influenza virus
ADYKSTQKT

SEQ ID NO: 325759 - protein, 9 aa, Influenza virus
DYKSTQAAV

SEQ ID NO: 325760 - protein, 9 aa, Influenza virus
YKSTQAAVD

SEQ ID NO: 325761 - protein, 9 aa, Influenza virus
KSTQAAVDQ

SEQ ID NO: 325762 - protein, 9 aa, Influenza virus
STQAAVDQI

SEQ ID NO: 325763 - protein, 9 aa, Influenza virus
TQAAVDQIT

SEQ ID NO: 325764 - protein, 9 aa, Influenza virus
QAAVDQITG

SEQ ID NO: 325765 - protein, 9 aa, Influenza virus
AAVDQITGK

SEQ ID NO: 325766 - protein, 9 aa, Influenza virus
AVDQITGKL

SEQ ID NO: 325767 - protein, 9 aa, Influenza virus
VDQITGKLN

SEQ ID NO: 325768 - protein, 9 aa, Influenza virus
DQVTGKLNR

SEQ ID NO: 325769 - protein, 9 aa, Influenza virus
QVTGKLNRL

SEQ ID NO: 325770 - protein, 9 aa, Influenza virus
VTGKLNRLI

SEQ ID NO: 325771 - protein, 9 aa, Influenza virus
FESIESEFN

SEQ ID NO: 325772 - protein, 9 aa, Influenza virus
ESIESEFNE

SEQ ID NO: 325773 - protein, 9 aa, Influenza virus
SIESEFNEI

SEQ ID NO: 325774 - protein, 9 aa, Influenza virus
IESEFNEIE

SEQ ID NO: 325775 - protein, 9 aa, Influenza virus
ESEFNEIEH

SEQ ID NO: 325776 - protein, 9 aa, Influenza virus
SEFNEIEHQ

SEQ ID NO: 325777 - protein, 9 aa, Influenza virus
EFNEIEHQI

SEQ ID NO: 325778 - protein, 9 aa, Influenza virus
FNEIEHQIG

SEQ ID NO: 325779 - protein, 9 aa, Influenza virus
NEIEHQIGN

SEQ ID NO: 325780 - protein, 9 aa, Influenza virus
ETEHQIGNV

SEQ ID NO: 325781 - protein, 9 aa, Influenza virus
TEHQIGNVI

SEQ ID NO: 325782 - protein, 9 aa, Influenza virus
EYQIGNVIN

SEQ ID NO: 325783 - protein, 9 aa, Influenza virus
YQIGNVINW

SEQ ID NO: 325784 - protein, 9 aa, Influenza virus
WTYQAELLI

SEQ ID NO: 325785 - protein, 9 aa, Influenza virus
TYNAELLVA

SEQ ID NO: 325786 - protein, 9 aa, Influenza virus
YNAELLVAM

SEQ ID NO: 325787 - protein, 9 aa, Influenza virus
NAELLVAME

SEQ ID NO: 325788 - protein, 9 aa, Influenza virus
HTIDLADSE

SEQ ID NO: 325789 - protein, 9 aa, Influenza virus
TIDLADSEM

SEQ ID NO: 325790 - protein, 9 aa, Influenza virus
IDLADSEML

SEQ ID NO: 325791 - protein, 9 aa, Influenza virus
DMADSTMLN

SEQ ID NO: 325792 - protein, 9 aa, Influenza virus
MADSTMLNL

SEQ ID NO: 325793 - protein, 9 aa, Influenza virus
DSEMLNLYD

SEQ ID NO: 325794 - protein, 9 aa, Influenza virus
SEMLNLYDR

SEQ ID NO: 325795 - protein, 9 aa, Influenza virus
EMLNLYDRV

SEQ ID NO: 325796 - protein, 9 aa, Influenza virus
MLNLYDRVR

SEQ ID NO: 325797 - protein, 9 aa, Influenza virus
LNLYDRVRK

SEQ ID NO: 325798 - protein, 9 aa, Influenza virus
NLYDRVRKQ

SEQ ID NO: 325799 - protein, 9 aa, Influenza virus
LYDRVRKQL

SEQ ID NO: 325800 - protein, 9 aa, Influenza virus
YDRVRKQLR

SEQ ID NO: 325801 - protein, 9 aa, Influenza virus
DRVRKQLRQ

SEQ ID NO: 325802 - protein, 9 aa, Influenza virus
RQNAEEDGR

SEQ ID NO: 325803 - protein, 9 aa, Influenza virus
QNAEEDGRG

SEQ ID NO: 325804 - protein, 9 aa, Influenza virus
NAEEDGRGC

SEQ ID NO: 325805 - protein, 9 aa, Influenza virus
AEEDGRGCF

SEQ ID NO: 325806 - protein, 9 aa, Influenza virus
EEDGRGCFE

SEQ ID NO: 325807 - protein, 9 aa, Influenza virus
EDGRGCFEI

SEQ ID NO: 325808 - protein, 9 aa, Influenza virus
DGRGCFEIY

SEQ ID NO: 325809 - protein, 9 aa, Influenza virus
GRGCFEIYH

SEQ ID NO: 325810 - protein, 9 aa, Influenza virus
KGCFEIYHA

SEQ ID NO: 325811 - protein, 9 aa, Influenza virus
GCFEIYHAC

SEQ ID NO: 325812 - protein, 9 aa, Influenza virus
CFEIYHACD

SEQ ID NO: 325813 - protein, 9 aa, Influenza virus
CDDSCMESI

SEQ ID NO: 325814 - protein, 9 aa, Influenza virus
DDSCMESIR

SEQ ID NO: 325815 - protein, 9 aa, Influenza virus
DSCMESIRN

SEQ ID NO: 325816 - protein, 9 aa, Influenza virus
SCMESIRNN

SEQ ID NO: 325817 - protein, 9 aa, Influenza virus
CMESIRDNT

SEQ ID NO: 325818 - protein, 9 aa, Influenza virus
MERIRNNTY

SEQ ID NO: 325819 - protein, 9 aa, Influenza virus
ERIRNNTYD

SEQ ID NO: 325820 - protein, 9 aa, Influenza virus
SIRDNTYDH

SEQ ID NO: 325821 - protein, 9 aa, Influenza virus
IRNNTYDHA

SEQ ID NO: 325822 - protein, 9 aa, Influenza virus
RNNTYDHAQ

SEQ ID NO: 325823 - protein, 9 aa, Influenza virus
NNTYDHAQY

SEQ ID NO: 325824 - protein, 9 aa, Influenza virus
NTYDHAQYR

SEQ ID NO: 325825 - protein, 9 aa, Influenza virus
TYDHAQYRE

SEQ ID NO: 325826 - protein, 9 aa, Influenza virus
YDHAQYREE

SEQ ID NO: 325827 - protein, 9 aa, Influenza virus
DHAQYREEA

SEQ ID NO: 325828 - protein, 9 aa, Influenza virus
HAQYREEAL

SEQ ID NO: 325829 - protein, 9 aa, Influenza virus
AQYREEALL

SEQ ID NO: 325830 - protein, 9 aa, Influenza virus
EEALLNRLS

SEQ ID NO: 325831 - protein, 9 aa, Influenza virus
EALLNRLSI

SEQ ID NO: 325832 - protein, 9 aa, Influenza virus
ALLNRLSIN

SEQ ID NO: 325833 - protein, 9 aa, Influenza virus
LLNRLNINS

SEQ ID NO: 325834 - protein, 9 aa, Influenza virus
LNRLNINSV

SEQ ID NO: 325835 - protein, 9 aa, Influenza virus
NRLNINSVK

SEQ ID NO: 325836 - protein, 9 aa, Influenza virus
RLNINSVKL

SEQ ID NO: 325837 - protein, 9 aa, Influenza virus
LNINSVKLS

SEQ ID NO: 325838 - protein, 9 aa, Influenza virus
NINSVKLSS

SEQ ID NO: 325839 - protein, 9 aa, Influenza virus
INSVKLSSG

SEQ ID NO: 325840 - protein, 9 aa, Influenza virus
NSVKLSSGY

SEQ ID NO: 325841 - protein, 9 aa, Influenza virus
SVKLSSGYK

SEQ ID NO: 325842 - protein, 9 aa, Influenza virus
VTLSSGYKD

SEQ ID NO: 325843 - protein, 9 aa, Influenza virus
KLSSGYKDI

SEQ ID NO: 325844 - protein, 9 aa, Influenza virus
LSSGYKDII

SEQ ID NO: 325845 - protein, 9 aa, Influenza virus
SSGYKDIIL

SEQ ID NO: 325846 - protein, 9 aa, Influenza virus
SGYKDIILW

SEQ ID NO: 325847 - protein, 9 aa, Influenza virus
GYKDIILWF

SEQ ID NO: 325848 - protein, 9 aa, Influenza virus
YKDIILWFS

SEQ ID NO: 325849 - protein, 9 aa, Influenza virus
KDIILWFSF

SEQ ID NO: 325850 - protein, 9 aa, Influenza virus
DIILWFSFG

SEQ ID NO: 325851 - protein, 9 aa, Influenza virus
IILWFSFGA

SEQ ID NO: 325852 - protein, 9 aa, Influenza virus
FSFGASCFI

SEQ ID NO: 325853 - protein, 9 aa, Influenza virus
SFGASCFIL

SEQ ID NO: 325854 - protein, 9 aa, Influenza virus
FGASCFILL

SEQ ID NO: 325855 - protein, 9 aa, Influenza virus
GASCFILLA

SEQ ID NO: 325856 - protein, 9 aa, Influenza virus
ASCFILLAV

SEQ ID NO: 325857 - protein, 9 aa, Influenza virus
SCFVLLAVV

SEQ ID NO: 325858 - protein, 9 aa, Influenza virus
VMGLVFFCL

SEQ ID NO: 325859 - protein, 9 aa, Influenza virus
MGLVFFCLR

SEQ ID NO: 325860 - protein, 9 aa, Influenza virus
GLVFFCLRN

SEQ ID NO: 325861 - protein, 9 aa, Influenza virus
LVFFCLRNG

SEQ ID NO: 325862 - protein, 9 aa, Influenza virus
VFFCLRNGN

SEQ ID NO: 325863 - protein, 9 aa, Influenza virus
FFCLRNGNM

SEQ ID NO: 325864 - protein, 9 aa, Influenza virus
FCLRNGNMR

SEQ ID NO: 325865 - protein, 9 aa, Influenza virus
CLRNGNMRC

SEQ ID NO: 325866 - protein, 9 aa, Influenza virus
LRNGNMRCT

SEQ ID NO: 325867 - protein, 9 aa, Influenza virus
RNGNMRCTI

SEQ ID NO: 325868 - protein, 9 aa, Influenza virus
NGNMRCTIL

SEQ ID NO: 325869 - protein, 9 aa, Influenza virus
MNPNQKLFT

SEQ ID NO: 325870 - protein, 9 aa, Influenza virus
NPNQKLFTL

SEQ ID NO: 325871 - protein, 9 aa, Influenza virus
PNQKLFTLS

SEQ ID NO: 325872 - protein, 9 aa, Influenza virus
NQKLFTLSG

SEQ ID NO: 325873 - protein, 9 aa, Influenza virus
QKLFTLSGV

SEQ ID NO: 325874 - protein, 9 aa, Influenza virus
KLFTLSGVA

SEQ ID NO: 325875 - protein, 9 aa, Influenza virus
LFTLSGVAI

SEQ ID NO: 325876 - protein, 9 aa, Influenza virus
FTLSGVAIA

SEQ ID NO: 325877 - protein, 9 aa, Influenza virus
TLSGVAIAL

SEQ ID NO: 325878 - protein, 9 aa, Influenza virus
LSGVAVALS

SEQ ID NO: 325879 - protein, 9 aa, Influenza virus
LNLIIGISN

SEQ ID NO: 325880 - protein, 9 aa, Influenza virus
NLIIGISNV

SEQ ID NO: 325881 - protein, 9 aa, Influenza virus
LIIGISNVG

SEQ ID NO: 325882 - protein, 9 aa, Influenza virus
IIGISNVGL

SEQ ID NO: 325883 - protein, 9 aa, Influenza virus
GISNVGLKV

SEQ ID NO: 325884 - protein, 9 aa, Influenza virus
ISNVGLKVS

SEQ ID NO: 325885 - protein, 9 aa, Influenza virus
SNVGLKVSL

SEQ ID NO: 325886 - protein, 9 aa, Influenza virus
NVGLKVSLH

SEQ ID NO: 325887 - protein, 9 aa, Influenza virus
VGLNISLHL

SEQ ID NO: 325888 - protein, 9 aa, Influenza virus
GLKVSLHLK

SEQ ID NO: 325889 - protein, 9 aa, Influenza virus
EKGAKQEEN

SEQ ID NO: 325890 - protein, 9 aa, Influenza virus
TQNNTTVVE

SEQ ID NO: 325891 - protein, 9 aa, Influenza virus
QNNTTVVEN

SEQ ID NO: 325892 - protein, 9 aa, Influenza virus
NNTTVVENT

SEQ ID NO: 325893 - protein, 9 aa, Influenza virus
NTTVVENTY

SEQ ID NO: 325894 - protein, 9 aa, Influenza virus
TTVVENTYV

SEQ ID NO: 325895 - protein, 9 aa, Influenza virus
TVVENTYVN

SEQ ID NO: 325896 - protein, 9 aa, Influenza virus
VVENTYVNN

SEQ ID NO: 325897 - protein, 9 aa, Influenza virus
VENTYVNNT

SEQ ID NO: 325898 - protein, 9 aa, Influenza virus
ENKYVNNTT

SEQ ID NO: 325899 - protein, 9 aa, Influenza virus
NTYVNNTTI

SEQ ID NO: 325900 - protein, 9 aa, Influenza virus
TYVNNTTII

SEQ ID NO: 325901 - protein, 9 aa, Influenza virus
YVNNTTIIT

SEQ ID NO: 325902 - protein, 9 aa, Influenza virus
VNNTTIITK

SEQ ID NO: 325903 - protein, 9 aa, Influenza virus
YLLLNKSLC

SEQ ID NO: 325904 - protein, 9 aa, Influenza virus
LVLNKSLCK

SEQ ID NO: 325905 - protein, 9 aa, Influenza virus
VLNKSLCKV

SEQ ID NO: 325906 - protein, 9 aa, Influenza virus
LNKSLCNVE

SEQ ID NO: 325907 - protein, 9 aa, Influenza virus
NKSLCNVEG

SEQ ID NO: 325908 - protein, 9 aa, Influenza virus
KSLCNVEGW

SEQ ID NO: 325909 - protein, 9 aa, Influenza virus
SLCNVEGWV

SEQ ID NO: 325910 - protein, 9 aa, Influenza virus
LCNVEGWVV

SEQ ID NO: 325911 - protein, 9 aa, Influenza virus
CNVEGWVVI

SEQ ID NO: 325912 - protein, 9 aa, Influenza virus
NVEGWVVIA

SEQ ID NO: 325913 - protein, 9 aa, Influenza virus
VEGWVVIAK

SEQ ID NO: 325914 - protein, 9 aa, Influenza virus
EGWVVIAKD

SEQ ID NO: 325915 - protein, 9 aa, Influenza virus
GWVVIAKDN

SEQ ID NO: 325916 - protein, 9 aa, Influenza virus
WVVIAKDNA

SEQ ID NO: 325917 - protein, 9 aa, Influenza virus
VVIAKDNAV

SEQ ID NO: 325918 - protein, 9 aa, Influenza virus
VIAKDNAVR

SEQ ID NO: 325919 - protein, 9 aa, Influenza virus
IAKDNAVRF

SEQ ID NO: 325920 - protein, 9 aa, Influenza virus
AKDNAVRFG

SEQ ID NO: 325921 - protein, 9 aa, Influenza virus
KDNAVRFGE

SEQ ID NO: 325922 - protein, 9 aa, Influenza virus
DNAVRFGES

SEQ ID NO: 325923 - protein, 9 aa, Influenza virus
NAVRFGESE

SEQ ID NO: 325924 - protein, 9 aa, Influenza virus
AVRFGESEQ

SEQ ID NO: 325925 - protein, 9 aa, Influenza virus
IRFGESEQV

SEQ ID NO: 325926 - protein, 9 aa, Influenza virus
RFGESEQVI

SEQ ID NO: 325927 - protein, 9 aa, Influenza virus
FGESEQVIV

SEQ ID NO: 325928 - protein, 9 aa, Influenza virus
GESEQVIVT

SEQ ID NO: 325929 - protein, 9 aa, Influenza virus
ESEQVIVTR

SEQ ID NO: 325930 - protein, 9 aa, Influenza virus
SEQVIVTRE

SEQ ID NO: 325931 - protein, 9 aa, Influenza virus
EQVIVTREP

SEQ ID NO: 325932 - protein, 9 aa, Influenza virus
QVIVTREPY

SEQ ID NO: 325933 - protein, 9 aa, Influenza virus
VIVTREPYV

SEQ ID NO: 325934 - protein, 9 aa, Influenza virus
EPYVSCDPT

SEQ ID NO: 325935 - protein, 9 aa, Influenza virus
PYVSCDPSG

SEQ ID NO: 325936 - protein, 9 aa, Influenza virus
YVSCDPTGC

SEQ ID NO: 325937 - protein, 9 aa, Influenza virus
VSCDPLGCR

SEQ ID NO: 325938 - protein, 9 aa, Influenza virus
SCDPLGCRM

SEQ ID NO: 325939 - protein, 9 aa, Influenza virus
CDPLGCRMY

SEQ ID NO: 325940 - protein, 9 aa, Influenza virus
DPLGCRMYA

SEQ ID NO: 325941 - protein, 9 aa, Influenza virus
PLGCRMYAL

SEQ ID NO: 325942 - protein, 9 aa, Influenza virus
LGCRMYALH

SEQ ID NO: 325943 - protein, 9 aa, Influenza virus
GCRMYALHQ

SEQ ID NO: 325944 - protein, 9 aa, Influenza virus
CRMYALHQG

SEQ ID NO: 325945 - protein, 9 aa, Influenza virus
RMYALHQGT

SEQ ID NO: 325946 - protein, 9 aa, Influenza virus
HQGTTIRNR

SEQ ID NO: 325947 - protein, 9 aa, Influenza virus
QGTTIRNRH

SEQ ID NO: 325948 - protein, 9 aa, Influenza virus
GTTIRNRHS

SEQ ID NO: 325949 - protein, 9 aa, Influenza virus
TTIRNRHSN

SEQ ID NO: 325950 - protein, 9 aa, Influenza virus
TIRNRHSNG

SEQ ID NO: 325951 - protein, 9 aa, Influenza virus
IRNRHSNGT

SEQ ID NO: 325952 - protein, 9 aa, Influenza virus
RNRHSNGTI

SEQ ID NO: 325953 - protein, 9 aa, Influenza virus
NRHSNGTIH

SEQ ID NO: 325954 - protein, 9 aa, Influenza virus
RHSNGTIHD

SEQ ID NO: 325955 - protein, 9 aa, Influenza virus
DRTAFRGLM

SEQ ID NO: 325956 - protein, 9 aa, Influenza virus
RTAFRGLMS

SEQ ID NO: 325957 - protein, 9 aa, Influenza virus
TAFRGLMST

SEQ ID NO: 325958 - protein, 9 aa, Influenza virus
AFRGLMSTP

SEQ ID NO: 325959 - protein, 9 aa, Influenza virus
FRGLMSTPL

SEQ ID NO: 325960 - protein, 9 aa, Influenza virus
RGLMSTPLG

SEQ ID NO: 325961 - protein, 9 aa, Influenza virus
GLISTPLGT

SEQ ID NO: 325962 - protein, 9 aa, Influenza virus
LISTPLGTP

SEQ ID NO: 325963 - protein, 9 aa, Influenza virus
ISTPLGTPP

SEQ ID NO: 325964 - protein, 9 aa, Influenza virus
STPLGSPPV

SEQ ID NO: 325965 - protein, 9 aa, Influenza virus
TPLGSPPVV

SEQ ID NO: 325966 - protein, 9 aa, Influenza virus
PLGSPPVVS

SEQ ID NO: 325967 - protein, 9 aa, Influenza virus
LGSPPVVSN

SEQ ID NO: 325968 - protein, 9 aa, Influenza virus
GSPPVVSNS

SEQ ID NO: 325969 - protein, 9 aa, Influenza virus
SPPVVSNSD

SEQ ID NO: 325970 - protein, 9 aa, Influenza virus
PPVVSNSDF

SEQ ID NO: 325971 - protein, 9 aa, Influenza virus
VSNSEFLCV

SEQ ID NO: 325972 - protein, 9 aa, Influenza virus
SNSEFLCVG

SEQ ID NO: 325973 - protein, 9 aa, Influenza virus
NSEFLCVGW

SEQ ID NO: 325974 - protein, 9 aa, Influenza virus
SEFLCVGWS

SEQ ID NO: 325975 - protein, 9 aa, Influenza virus
EFLCVGWSS

SEQ ID NO: 325976 - protein, 9 aa, Influenza virus
FICVGWSST

SEQ ID NO: 325977 - protein, 9 aa, Influenza virus
ICVGWSSTS

SEQ ID NO: 325978 - protein, 9 aa, Influenza virus
CVGWSSTTC

SEQ ID NO: 325979 - protein, 9 aa, Influenza virus
VGWSSTTCH

SEQ ID NO: 325980 - protein, 9 aa, Influenza virus
GWSSTTCHD

SEQ ID NO: 325981 - protein, 9 aa, Influenza virus
WSSTTCHDG

SEQ ID NO: 325982 - protein, 9 aa, Influenza virus
SSTSCHDGV

SEQ ID NO: 325983 - protein, 9 aa, Influenza virus
STSCHDGVG

SEQ ID NO: 325984 - protein, 9 aa, Influenza virus
TSCHDGVGR

SEQ ID NO: 325985 - protein, 9 aa, Influenza virus
SCHDGVGRM

SEQ ID NO: 325986 - protein, 9 aa, Influenza virus
CHDGVGRMT

SEQ ID NO: 325987 - protein, 9 aa, Influenza virus
HDGVGRMTI

SEQ ID NO: 325988 - protein, 9 aa, Influenza virus
DGVGRMTIC

SEQ ID NO: 325989 - protein, 9 aa, Influenza virus
GVGRMTICV

SEQ ID NO: 325990 - protein, 9 aa, Influenza virus
VGRMTICVQ

SEQ ID NO: 325991 - protein, 9 aa, Influenza virus
GRMTICIQG

SEQ ID NO: 325992 - protein, 9 aa, Influenza virus
RMTICIQGN

SEQ ID NO: 325993 - protein, 9 aa, Influenza virus
MTICIQGNN

SEQ ID NO: 325994 - protein, 9 aa, Influenza virus
TICVQGNNN

SEQ ID NO: 325995 - protein, 9 aa, Influenza virus
ICVQGNNNN

SEQ ID NO: 325996 - protein, 9 aa, Influenza virus
CVQGNNNNA

SEQ ID NO: 325997 - protein, 9 aa, Influenza virus
VQGNNNNAT

SEQ ID NO: 325998 - protein, 9 aa, Influenza virus
QGNNNNATA

SEQ ID NO: 325999 - protein, 9 aa, Influenza virus
GNNNNATAT

SEQ ID NO: 326000 - protein, 9 aa, Influenza virus
NNNNATATV

SEQ ID NO: 326001 - protein, 9 aa, Influenza virus
NNNATATVY

SEQ ID NO: 326002 - protein, 9 aa, Influenza virus
NNATATVYY

SEQ ID NO: 326003 - protein, 9 aa, Influenza virus
NATATVYYN

SEQ ID NO: 326004 - protein, 9 aa, Influenza virus
ATATVYYNR

SEQ ID NO: 326005 - protein, 9 aa, Influenza virus
TATVYYNRR

SEQ ID NO: 326006 - protein, 9 aa, Influenza virus
ATVYYNRRL

SEQ ID NO: 326007 - protein, 9 aa, Influenza virus
TVYYNRRLT

SEQ ID NO: 326008 - protein, 9 aa, Influenza virus
VYYNRRLTT

SEQ ID NO: 326009 - protein, 9 aa, Influenza virus
YYNRRLTTT

SEQ ID NO: 326010 - protein, 9 aa, Influenza virus
YNRRLTTTI

SEQ ID NO: 326011 - protein, 9 aa, Influenza virus
NRRLTTTIK

SEQ ID NO: 326012 - protein, 9 aa, Influenza virus
RRLTTTIKP

SEQ ID NO: 326013 - protein, 9 aa, Influenza virus
RLTTTIKPW

SEQ ID NO: 326014 - protein, 9 aa, Influenza virus
LTTTIKPWA

SEQ ID NO: 326015 - protein, 9 aa, Influenza virus
TTTIKTWAR

SEQ ID NO: 326016 - protein, 9 aa, Influenza virus
TTIKTWARN

SEQ ID NO: 326017 - protein, 9 aa, Influenza virus
TIKTWARNI

SEQ ID NO: 326018 - protein, 9 aa, Influenza virus
IKTWARNIL

SEQ ID NO: 326019 - protein, 9 aa, Influenza virus
KTWARNILR

SEQ ID NO: 326020 - protein, 9 aa, Influenza virus
TWARNILRT

SEQ ID NO: 326021 - protein, 9 aa, Influenza virus
WARNILRTQ

SEQ ID NO: 326022 - protein, 9 aa, Influenza virus
ARNILRTQE

SEQ ID NO: 326023 - protein, 9 aa, Influenza virus
RNILRTQES

SEQ ID NO: 326024 - protein, 9 aa, Influenza virus
KILRTQESE

SEQ ID NO: 326025 - protein, 9 aa, Influenza virus
CVCHNGTCA

SEQ ID NO: 326026 - protein, 9 aa, Influenza virus
VCHNGTCAV

SEQ ID NO: 326027 - protein, 9 aa, Influenza virus
CHNGTCVVV

SEQ ID NO: 326028 - protein, 9 aa, Influenza virus
HNGTCVVVM

SEQ ID NO: 326029 - protein, 9 aa, Influenza virus
NGTCVVVMT

SEQ ID NO: 326030 - protein, 9 aa, Influenza virus
GTCVVVMTD

SEQ ID NO: 326031 - protein, 9 aa, Influenza virus
TCVVVMTDG

SEQ ID NO: 326032 - protein, 9 aa, Influenza virus
CVVVMTDGS

SEQ ID NO: 326033 - protein, 9 aa, Influenza virus
VVVMTDGSA

SEQ ID NO: 326034 - protein, 9 aa, Influenza virus
VVMTDGSAS

SEQ ID NO: 326035 - protein, 9 aa, Influenza virus
VMTDGSASS

SEQ ID NO: 326036 - protein, 9 aa, Influenza virus
MTDGPANSQ

SEQ ID NO: 326037 - protein, 9 aa, Influenza virus
TDGPANSQA

SEQ ID NO: 326038 - protein, 9 aa, Influenza virus
DGSASSQAH

SEQ ID NO: 326039 - protein, 9 aa, Influenza virus
GSASSQAHT

SEQ ID NO: 326040 - protein, 9 aa, Influenza virus
SASSQAHTK

SEQ ID NO: 326041 - protein, 9 aa, Influenza virus
ASSQAHTKV

SEQ ID NO: 326042 - protein, 9 aa, Influenza virus
QAHTKVLYF

SEQ ID NO: 326043 - protein, 9 aa, Influenza virus
AHTKVLYFH

SEQ ID NO: 326044 - protein, 9 aa, Influenza virus
HTKVLYFHK

SEQ ID NO: 326045 - protein, 9 aa, Influenza virus
TKVMYFHKG

SEQ ID NO: 326046 - protein, 9 aa, Influenza virus
KVLYFHKGI

SEQ ID NO: 326047 - protein, 9 aa, Influenza virus
YFHKGLIIK

SEQ ID NO: 326048 - protein, 9 aa, Influenza virus
FHKGLIIKE

SEQ ID NO: 326049 - protein, 9 aa, Influenza virus
HKGLIIKEE

SEQ ID NO: 326050 - protein, 9 aa, Influenza virus
KEEPLKGSA

SEQ ID NO: 326051 - protein, 9 aa, Influenza virus
EEPLKGSAK

SEQ ID NO: 326052 - protein, 9 aa, Influenza virus
EPLKGSAKH

SEQ ID NO: 326053 - protein, 9 aa, Influenza virus
LKGSAKHIE

SEQ ID NO: 326054 - protein, 9 aa, Influenza virus
KGSAKHIEE

SEQ ID NO: 326055 - protein, 9 aa, Influenza virus
GSAKHIEEC

SEQ ID NO: 326056 - protein, 9 aa, Influenza virus
SAKHIEECS

SEQ ID NO: 326057 - protein, 9 aa, Influenza virus
AKHIEECSC

SEQ ID NO: 326058 - protein, 9 aa, Influenza virus
KHIEECSCY

SEQ ID NO: 326059 - protein, 9 aa, Influenza virus
HIEECPCYG

SEQ ID NO: 326060 - protein, 9 aa, Influenza virus
IEECPCYGH

SEQ ID NO: 326061 - protein, 9 aa, Influenza virus
EECSCYGHD

SEQ ID NO: 326062 - protein, 9 aa, Influenza virus
ECSCYGHDS

SEQ ID NO: 326063 - protein, 9 aa, Influenza virus
CSCYGHDSK

SEQ ID NO: 326064 - protein, 9 aa, Influenza virus
CYGHDSKVT

SEQ ID NO: 326065 - protein, 9 aa, Influenza virus
YGHDSKVTC

SEQ ID NO: 326066 - protein, 9 aa, Influenza virus
QKVTCVCRD

SEQ ID NO: 326067 - protein, 9 aa, Influenza virus
KITCVCRDN

SEQ ID NO: 326068 - protein, 9 aa, Influenza virus
ITCVCRDNW

SEQ ID NO: 326069 - protein, 9 aa, Influenza virus
NWQGANRPI

SEQ ID NO: 326070 - protein, 9 aa, Influenza virus
WQGANRPII

SEQ ID NO: 326071 - protein, 9 aa, Influenza virus
QGANRPIIE

SEQ ID NO: 326072 - protein, 9 aa, Influenza virus
GANRPIIEI

SEQ ID NO: 326073 - protein, 9 aa, Influenza virus
ANRPVIKID

SEQ ID NO: 326074 - protein, 9 aa, Influenza virus
NRPVIKIDM

SEQ ID NO: 326075 - protein, 9 aa, Influenza virus
TLEHTSRYV

SEQ ID NO: 326076 - protein, 9 aa, Influenza virus
LEHTSRYVC

SEQ ID NO: 326077 - protein, 9 aa, Influenza virus
EHTSRYVCT

SEQ ID NO: 326078 - protein, 9 aa, Influenza virus
HTSRYVCTG

SEQ ID NO: 326079 - protein, 9 aa, Influenza virus
TSRYVCTGI

SEQ ID NO: 326080 - protein, 9 aa, Influenza virus
SRYVCTGIL

SEQ ID NO: 326081 - protein, 9 aa, Influenza virus
RYVCTGILT

SEQ ID NO: 326082 - protein, 9 aa, Influenza virus
YVCTGILTD

SEQ ID NO: 326083 - protein, 9 aa, Influenza virus
VCTGILTDT

SEQ ID NO: 326084 - protein, 9 aa, Influenza virus
CTGILTDTS

SEQ ID NO: 326085 - protein, 9 aa, Influenza virus
TGILTDTSR

SEQ ID NO: 326086 - protein, 9 aa, Influenza virus
GILTDTSRP

SEQ ID NO: 326087 - protein, 9 aa, Influenza virus
ILTDTSRPG

SEQ ID NO: 326088 - protein, 9 aa, Influenza virus
LTDTSRPGD

SEQ ID NO: 326089 - protein, 9 aa, Influenza virus
TDTSRPGDK

SEQ ID NO: 326090 - protein, 9 aa, Influenza virus
GDCSNPITG

SEQ ID NO: 326091 - protein, 9 aa, Influenza virus
DCSNPITGS

SEQ ID NO: 326092 - protein, 9 aa, Influenza virus
CSNPITGSP

SEQ ID NO: 326093 - protein, 9 aa, Influenza virus
SNPITGSPG

SEQ ID NO: 326094 - protein, 9 aa, Influenza virus
NPITGSPSA

SEQ ID NO: 326095 - protein, 9 aa, Influenza virus
PITGSPSAP

SEQ ID NO: 326096 - protein, 9 aa, Influenza virus
ITGSPSAPG

SEQ ID NO: 326097 - protein, 9 aa, Influenza virus
TGSPSAPGV

SEQ ID NO: 326098 - protein, 9 aa, Influenza virus
GSPSAPGVK

SEQ ID NO: 326099 - protein, 9 aa, Influenza virus
SPSAPGVKG

SEQ ID NO: 326100 - protein, 9 aa, Influenza virus
PSAPGVKGF

SEQ ID NO: 326101 - protein, 9 aa, Influenza virus
SAPGVKGFG

SEQ ID NO: 326102 - protein, 9 aa, Influenza virus
GVKGFGFLN

SEQ ID NO: 326103 - protein, 9 aa, Influenza virus
VKGFGFLNG

SEQ ID NO: 326104 - protein, 9 aa, Influenza virus
SNTWLGRTI

SEQ ID NO: 326105 - protein, 9 aa, Influenza virus
NTWLGGTIS

SEQ ID NO: 326106 - protein, 9 aa, Influenza virus
TWLGRTFSP

SEQ ID NO: 326107 - protein, 9 aa, Influenza virus
WLGGTISPR

SEQ ID NO: 326108 - protein, 9 aa, Influenza virus
LGRTISPHS

SEQ ID NO: 326109 - protein, 9 aa, Influenza virus
GRTISPHSR

SEQ ID NO: 326110 - protein, 9 aa, Influenza virus
GTISPRSRS

SEQ ID NO: 326111 - protein, 9 aa, Influenza virus
TFSPRSRSG

SEQ ID NO: 326112 - protein, 9 aa, Influenza virus
FSPRSRSGF

SEQ ID NO: 326113 - protein, 9 aa, Influenza virus
RSGFEMLKV

SEQ ID NO: 326114 - protein, 9 aa, Influenza virus
SGFEMLKVP

SEQ ID NO: 326115 - protein, 9 aa, Influenza virus
GFEMLKVPN

SEQ ID NO: 326116 - protein, 9 aa, Influenza virus
FEMLKVPNA

SEQ ID NO: 326117 - protein, 9 aa, Influenza virus
EMLKIPNAE

SEQ ID NO: 326118 - protein, 9 aa, Influenza virus
MLKIPNAET

SEQ ID NO: 326119 - protein, 9 aa, Influenza virus
LKIPNAETD

SEQ ID NO: 326120 - protein, 9 aa, Influenza virus
KIPNAETDP

SEQ ID NO: 326121 - protein, 9 aa, Influenza virus
IPNAETDPN

SEQ ID NO: 326122 - protein, 9 aa, Influenza virus
PNAETDPNS

SEQ ID NO: 326123 - protein, 9 aa, Influenza virus
AERQEIVDN

SEQ ID NO: 326124 - protein, 9 aa, Influenza virus
ERQEIVDNS

SEQ ID NO: 326125 - protein, 9 aa, Influenza virus
NSNWSGYSG

SEQ ID NO: 326126 - protein, 9 aa, Influenza virus
SNWSGYSGS

SEQ ID NO: 326127 - protein, 9 aa, Influenza virus
KWSGYSGSF

SEQ ID NO: 326128 - protein, 9 aa, Influenza virus
SGSFIDYWN

SEQ ID NO: 326129 - protein, 9 aa, Influenza virus
GSFIDYWDD

SEQ ID NO: 326130 - protein, 9 aa, Influenza virus
NECYNPCFY

SEQ ID NO: 326131 - protein, 9 aa, Influenza virus
VCYNPCFYV

SEQ ID NO: 326132 - protein, 9 aa, Influenza virus
LIRGRPEEV

SEQ ID NO: 326133 - protein, 9 aa, Influenza virus
IRGRPEEVK

SEQ ID NO: 326134 - protein, 9 aa, Influenza virus
RGRPEEVKY

SEQ ID NO: 326135 - protein, 9 aa, Influenza virus
GRPEEVKYV

SEQ ID NO: 326136 - protein, 9 aa, Influenza virus
RPEEVKYVW

SEQ ID NO: 326137 - protein, 9 aa, Influenza virus
PEEVKYVWW

SEQ ID NO: 326138 - protein, 9 aa, Influenza virus
EEVKYVWWT

SEQ ID NO: 326139 - protein, 9 aa, Influenza virus
EVKYVWWTS

SEQ ID NO: 326140 - protein, 9 aa, Influenza virus
VKYVWWTSN

SEQ ID NO: 326141 - protein, 9 aa, Influenza virus
VWWTSNSLI

SEQ ID NO: 326142 - protein, 9 aa, Influenza virus
WWTSNSLIA

SEQ ID NO: 326143 - protein, 9 aa, Influenza virus
WTSNSLIAL

SEQ ID NO: 326144 - protein, 9 aa, Influenza virus
TSNSLIALC

SEQ ID NO: 326145 - protein, 9 aa, Influenza virus
SNSLIALCG

SEQ ID NO: 326146 - protein, 9 aa, Influenza virus
NSLIALCGS

SEQ ID NO: 326147 - protein, 9 aa, Influenza virus
SLIALCGSP

SEQ ID NO: 326148 - protein, 9 aa, Influenza virus
LVALCGSPV

SEQ ID NO: 326149 - protein, 9 aa, Influenza virus
VALCGSPVS

SEQ ID NO: 326150 - protein, 9 aa, Influenza virus
ALCGSPVSV

SEQ ID NO: 326151 - protein, 9 aa, Influenza virus
LCGSPVSVG

SEQ ID NO: 326152 - protein, 9 aa, Influenza virus
CGSPVSVGS

SEQ ID NO: 326153 - protein, 9 aa, Influenza virus
GSPVSVGSG

SEQ ID NO: 326154 - protein, 9 aa, Influenza virus
SPVSVGSGS

SEQ ID NO: 326155 - protein, 9 aa, Influenza virus
PVSVGSGSF

SEQ ID NO: 326156 - protein, 9 aa, Influenza virus
VSVGSGSFP

SEQ ID NO: 326157 - protein, 9 aa, Influenza virus
PVGSGSFPD

SEQ ID NO: 326158 - protein, 9 aa, Influenza virus
SGSFPDGAK

SEQ ID NO: 326159 - protein, 9 aa, Influenza virus
GSFPNGAQI

SEQ ID NO: 326160 - protein, 9 aa, Influenza virus
SFPDGAKIQ

SEQ ID NO: 326161 - protein, 9 aa, Influenza virus
FPDGAKIQY

SEQ ID NO: 326162 - protein, 9 aa, Influenza virus
PDGAKIQYF

SEQ ID NO: 326163 - protein, 9 aa, Influenza virus
DGAKIQYFS

SEQ ID NO: 326164 - protein, 9 aa, Influenza virus
KADEICIGY

SEQ ID NO: 326165 - protein, 9 aa, Influenza virus
ADEICIGYM

SEQ ID NO: 326166 - protein, 9 aa, Influenza virus
DEICIGYMS

SEQ ID NO: 326167 - protein, 9 aa, Influenza virus
EICIGYMSN

SEQ ID NO: 326168 - protein, 9 aa, Influenza virus
ICIGYMSNN

SEQ ID NO: 326169 - protein, 9 aa, Influenza virus
CIGYMSNNS

SEQ ID NO: 326170 - protein, 9 aa, Influenza virus
IGYMSNNST

SEQ ID NO: 326171 - protein, 9 aa, Influenza virus
GYLSNNSTD

SEQ ID NO: 326172 - protein, 9 aa, Influenza virus
YLSNNSTDK

SEQ ID NO: 326173 - protein, 9 aa, Influenza virus
LSNNSTDKV

SEQ ID NO: 326174 - protein, 9 aa, Influenza virus
SNNSTDKVD

SEQ ID NO: 326175 - protein, 9 aa, Influenza virus
NNSTDKVDT

SEQ ID NO: 326176 - protein, 9 aa, Influenza virus
NSTDKVDTI

SEQ ID NO: 326177 - protein, 9 aa, Influenza virus
STDKVDTII

SEQ ID NO: 326178 - protein, 9 aa, Influenza virus
TDKVDTIIE

SEQ ID NO: 326179 - protein, 9 aa, Influenza virus
DKVDTIIEN

SEQ ID NO: 326180 - protein, 9 aa, Influenza virus
KVDTIIENN

SEQ ID NO: 326181 - protein, 9 aa, Influenza virus
VDTIIENNV

SEQ ID NO: 326182 - protein, 9 aa, Influenza virus
DTIIENNVT

SEQ ID NO: 326183 - protein, 9 aa, Influenza virus
TIIENNVTV

SEQ ID NO: 326184 - protein, 9 aa, Influenza virus
IIENNVTVT

SEQ ID NO: 326185 - protein, 9 aa, Influenza virus
IENNVTVTS

SEQ ID NO: 326186 - protein, 9 aa, Influenza virus
ENNVTVTSS

SEQ ID NO: 326187 - protein, 9 aa, Influenza virus
NNVTVTSSV

SEQ ID NO: 326188 - protein, 9 aa, Influenza virus
NVTVTSSIE

SEQ ID NO: 326189 - protein, 9 aa, Influenza virus
VTVTSSIEL

SEQ ID NO: 326190 - protein, 9 aa, Influenza virus
TVTSSIELV

SEQ ID NO: 326191 - protein, 9 aa, Influenza virus
VTSSIELVE

SEQ ID NO: 326192 - protein, 9 aa, Influenza virus
TSSVELVET

SEQ ID NO: 326193 - protein, 9 aa, Influenza virus
HTGSFCSIN

SEQ ID NO: 326194 - protein, 9 aa, Influenza virus
TGSFCSING

SEQ ID NO: 326195 - protein, 9 aa, Influenza virus
GSFCSINGK

SEQ ID NO: 326196 - protein, 9 aa, Influenza virus
FCSINGKQP

SEQ ID NO: 326197 - protein, 9 aa, Influenza virus
CSINGKQPI

SEQ ID NO: 326198 - protein, 9 aa, Influenza virus
SINGKQPIS

SEQ ID NO: 326199 - protein, 9 aa, Influenza virus
INGKQPISL

SEQ ID NO: 326200 - protein, 9 aa, Influenza virus
NGKQPISLG

SEQ ID NO: 326201 - protein, 9 aa, Influenza virus
GKQPISLGD

SEQ ID NO: 326202 - protein, 9 aa, Influenza virus
KQPISLGDC

SEQ ID NO: 326203 - protein, 9 aa, Influenza virus
QPISLGDCS

SEQ ID NO: 326204 - protein, 9 aa, Influenza virus
ISLGDCSFT

SEQ ID NO: 326205 - protein, 9 aa, Influenza virus
SLGGCSFAG

SEQ ID NO: 326206 - protein, 9 aa, Influenza virus
LGGCSFAGW

SEQ ID NO: 326207 - protein, 9 aa, Influenza virus
GDCSFAGWL

SEQ ID NO: 326208 - protein, 9 aa, Influenza virus
DCSFAGWLL

SEQ ID NO: 326209 - protein, 9 aa, Influenza virus
CSFAGWLLG

SEQ ID NO: 326210 - protein, 9 aa, Influenza virus
SFTGWILGN

SEQ ID NO: 326211 - protein, 9 aa, Influenza virus
FAGWLLGNP

SEQ ID NO: 326212 - protein, 9 aa, Influenza virus
AGWILGNPR

SEQ ID NO: 326213 - protein, 9 aa, Influenza virus
GWILGNPRC

SEQ ID NO: 326214 - protein, 9 aa, Influenza virus
WILGNPRCD

SEQ ID NO: 326215 - protein, 9 aa, Influenza virus
ILGNPMCDE

SEQ ID NO: 326216 - protein, 9 aa, Influenza virus
LGNPMCDEL

SEQ ID NO: 326217 - protein, 9 aa, Influenza virus
GNPMCDELI

SEQ ID NO: 326218 - protein, 9 aa, Influenza virus
NPMCDELIG

SEQ ID NO: 326219 - protein, 9 aa, Influenza virus
PMCDELIGK

SEQ ID NO: 326220 - protein, 9 aa, Influenza virus
CDELIGKTS

SEQ ID NO: 326221 - protein, 9 aa, Influenza virus
DELIGKTSW

SEQ ID NO: 326222 - protein, 9 aa, Influenza virus
ELIGKTSWS

SEQ ID NO: 326223 - protein, 9 aa, Influenza virus
LIEKTSWSY

SEQ ID NO: 326224 - protein, 9 aa, Influenza virus
IEKTSWSYI

SEQ ID NO: 326225 - protein, 9 aa, Influenza virus
EKTSWSYIV

SEQ ID NO: 326226 - protein, 9 aa, Influenza virus
TSWSYIVER

SEQ ID NO: 326227 - protein, 9 aa, Influenza virus
SWSYIVEKT

SEQ ID NO: 326228 - protein, 9 aa, Influenza virus
WSYIVEKTN

SEQ ID NO: 326229 - protein, 9 aa, Influenza virus
SYIVEKTNP

SEQ ID NO: 326230 - protein, 9 aa, Influenza virus
NPANGICYP

SEQ ID NO: 326231 - protein, 9 aa, Influenza virus
PANGICYPG

SEQ ID NO: 326232 - protein, 9 aa, Influenza virus
NGICYPGSL

SEQ ID NO: 326233 - protein, 9 aa, Influenza virus
GICYPGSLD

SEQ ID NO: 326234 - protein, 9 aa, Influenza virus
SFFRHMVWL

SEQ ID NO: 326235 - protein, 9 aa, Influenza virus
FFRHMVWLI

SEQ ID NO: 326236 - protein, 9 aa, Influenza virus
WLVHQSGTY

SEQ ID NO: 326237 - protein, 9 aa, Influenza virus
LVHQSGTYP

SEQ ID NO: 326238 - protein, 9 aa, Influenza virus
HQSGTYPVV

SEQ ID NO: 326239 - protein, 9 aa, Influenza virus
FNNTKERDV

SEQ ID NO: 326240 - protein, 9 aa, Influenza virus
NNTKGRYVL

SEQ ID NO: 326241 - protein, 9 aa, Influenza virus
LYKKDSSYI

SEQ ID NO: 326242 - protein, 9 aa, Influenza virus
INGQAGRMT

SEQ ID NO: 326243 - protein, 9 aa, Influenza virus
AGRMTFYWK

SEQ ID NO: 326244 - protein, 9 aa, Influenza virus
GRMTFYWKI

SEQ ID NO: 326245 - protein, 9 aa, Influenza virus
RMTFYWKIV

SEQ ID NO: 326246 - protein, 9 aa, Influenza virus
TFESNGAFI

SEQ ID NO: 326247 - protein, 9 aa, Influenza virus
FESNGAFIA

SEQ ID NO: 326248 - protein, 9 aa, Influenza virus
ESNGAFIAP

SEQ ID NO: 326249 - protein, 9 aa, Influenza virus
SNGAFIAPR

SEQ ID NO: 326250 - protein, 9 aa, Influenza virus
NGAFIAPRY

SEQ ID NO: 326251 - protein, 9 aa, Influenza virus
GAFIAPRYA

SEQ ID NO: 326252 - protein, 9 aa, Influenza virus
FIAPRYAFE

SEQ ID NO: 326253 - protein, 9 aa, Influenza virus
LAPRYAFEI

SEQ ID NO: 326254 - protein, 9 aa, Influenza virus
APRYAFEIV

SEQ ID NO: 326255 - protein, 9 aa, Influenza virus
PRYAFEIVS

SEQ ID NO: 326256 - protein, 9 aa, Influenza virus
KCQTEIGGI

SEQ ID NO: 326257 - protein, 9 aa, Influenza virus
CQTEIGGIN

SEQ ID NO: 326258 - protein, 9 aa, Influenza virus
QTEIGGINT

SEQ ID NO: 326259 - protein, 9 aa, Influenza virus
HSVHRNTIG

SEQ ID NO: 326260 - protein, 9 aa, Influenza virus
SVHRNTIGD

SEQ ID NO: 326261 - protein, 9 aa, Influenza virus
VHRNTFGDC

SEQ ID NO: 326262 - protein, 9 aa, Influenza virus
HRNTFGDCP

SEQ ID NO: 326263 - protein, 9 aa, Influenza virus
RSTIGDCPK

SEQ ID NO: 326264 - protein, 9 aa, Influenza virus
NTIGNCPKY

SEQ ID NO: 326265 - protein, 9 aa, Influenza virus
TIGDCPKYM

SEQ ID NO: 326266 - protein, 9 aa, Influenza virus
IGDCPKYMN

SEQ ID NO: 326267 - protein, 9 aa, Influenza virus
GDCPKYMNV

SEQ ID NO: 326268 - protein, 9 aa, Influenza virus
DCPKYVNVR

SEQ ID NO: 326269 - protein, 9 aa, Influenza virus
CPKYVNVRS

SEQ ID NO: 326270 - protein, 9 aa, Influenza virus
PKYMNVKSL

SEQ ID NO: 326271 - protein, 9 aa, Influenza virus
KYVNVRSLK

SEQ ID NO: 326272 - protein, 9 aa, Influenza virus
YVNVRSLKL

SEQ ID NO: 326273 - protein, 9 aa, Influenza virus
VNVRSLKLA

SEQ ID NO: 326274 - protein, 9 aa, Influenza virus
NVRSLKLAT

SEQ ID NO: 326275 - protein, 9 aa, Influenza virus
VRSLKLATG

SEQ ID NO: 326276 - protein, 9 aa, Influenza virus
KSLKLATGP

SEQ ID NO: 326277 - protein, 9 aa, Influenza virus
SLKLATGPR

SEQ ID NO: 326278 - protein, 9 aa, Influenza virus
LKLATGPRN

SEQ ID NO: 326279 - protein, 9 aa, Influenza virus
KLATGLRNI

SEQ ID NO: 326280 - protein, 9 aa, Influenza virus
LATGLRNIP

SEQ ID NO: 326281 - protein, 9 aa, Influenza virus
ATGLRNIPA

SEQ ID NO: 326282 - protein, 9 aa, Influenza virus
TGLRNIPAI

SEQ ID NO: 326283 - protein, 9 aa, Influenza virus
GLRNIPAIA

SEQ ID NO: 326284 - protein, 9 aa, Influenza virus
SRGLFGAIA

SEQ ID NO: 326285 - protein, 9 aa, Influenza virus
RGLFGAKAG

SEQ ID NO: 326286 - protein, 9 aa, Influenza virus
GLFGAKAGF

SEQ ID NO: 326287 - protein, 9 aa, Influenza virus
LFGAKAGFI

SEQ ID NO: 326288 - protein, 9 aa, Influenza virus
FGAKAGFIE

SEQ ID NO: 326289 - protein, 9 aa, Influenza virus
GAKAGFIEG

SEQ ID NO: 326290 - protein, 9 aa, Influenza virus
AKAGFIEGG

SEQ ID NO: 326291 - protein, 9 aa, Influenza virus
KAGFIEGGW

SEQ ID NO: 326292 - protein, 9 aa, Influenza virus
WYGFQHRND

SEQ ID NO: 326293 - protein, 9 aa, Influenza virus
YGFQHRNDE

SEQ ID NO: 326294 - protein, 9 aa, Influenza virus
GFQHRDEEG

SEQ ID NO: 326295 - protein, 9 aa, Influenza virus
FQHRNDEGT

SEQ ID NO: 326296 - protein, 9 aa, Influenza virus
QHRNDEGTG

SEQ ID NO: 326297 - protein, 9 aa, Influenza virus
HRDEEGTGI

SEQ ID NO: 326298 - protein, 9 aa, Influenza virus
RNDEGTGIA

SEQ ID NO: 326299 - protein, 9 aa, Influenza virus
NDEGTGIAA

SEQ ID NO: 326300 - protein, 9 aa, Influenza virus
EEGTGVAAD

SEQ ID NO: 326301 - protein, 9 aa, Influenza virus
EGTGIAADR

SEQ ID NO: 326302 - protein, 9 aa, Influenza virus
GTGIAADRE

SEQ ID NO: 326303 - protein, 9 aa, Influenza virus
TGIAADRES

SEQ ID NO: 326304 - protein, 9 aa, Influenza virus
GIAADREST

SEQ ID NO: 326305 - protein, 9 aa, Influenza virus
IAADRESTQ

SEQ ID NO: 326306 - protein, 9 aa, Influenza virus
AADRESTQK

SEQ ID NO: 326307 - protein, 9 aa, Influenza virus
ADRESTQKA

SEQ ID NO: 326308 - protein, 9 aa, Influenza virus
IEERINHLS

SEQ ID NO: 326309 - protein, 9 aa, Influenza virus
NIWSYNAQL

SEQ ID NO: 326310 - protein, 9 aa, Influenza virus
IWSYNARLL

SEQ ID NO: 326311 - protein, 9 aa, Influenza virus
WSYNARLLV

SEQ ID NO: 326312 - protein, 9 aa, Influenza virus
SYNAQLLVW

SEQ ID NO: 326313 - protein, 9 aa, Influenza virus
YNAQLLVWL

SEQ ID NO: 326314 - protein, 9 aa, Influenza virus
NAQLLVWLE

SEQ ID NO: 326315 - protein, 9 aa, Influenza virus
AQLLVWLEN

SEQ ID NO: 326316 - protein, 9 aa, Influenza virus
QLLVWLENE

SEQ ID NO: 326317 - protein, 9 aa, Influenza virus
LLVWLENEK

SEQ ID NO: 326318 - protein, 9 aa, Influenza virus
LVWLENEKT

SEQ ID NO: 326319 - protein, 9 aa, Influenza virus
VWLENEKTL

SEQ ID NO: 326320 - protein, 9 aa, Influenza virus
WLENEKTLD

SEQ ID NO: 326321 - protein, 9 aa, Influenza virus
LDLHDSNVK

SEQ ID NO: 326322 - protein, 9 aa, Influenza virus
DLHDSNVRS

SEQ ID NO: 326323 - protein, 9 aa, Influenza virus
LHDSNVRSL

SEQ ID NO: 326324 - protein, 9 aa, Influenza virus
HDSNVRSLH

SEQ ID NO: 326325 - protein, 9 aa, Influenza virus
DSNVRSLHE

SEQ ID NO: 326326 - protein, 9 aa, Influenza virus
SNVRNLHER

SEQ ID NO: 326327 - protein, 9 aa, Influenza virus
LHERVRRML

SEQ ID NO: 326328 - protein, 9 aa, Influenza virus
LRDNAKDEG

SEQ ID NO: 326329 - protein, 9 aa, Influenza virus
RDNAKDEGN

SEQ ID NO: 326330 - protein, 9 aa, Influenza virus
GNAKDEGNG

SEQ ID NO: 326331 - protein, 9 aa, Influenza virus
RDEGNGCFT

SEQ ID NO: 326332 - protein, 9 aa, Influenza virus
NGCFPFYHK

SEQ ID NO: 326333 - protein, 9 aa, Influenza virus
GCFTFYHRC

SEQ ID NO: 326334 - protein, 9 aa, Influenza virus
CFTFYHKCN

SEQ ID NO: 326335 - protein, 9 aa, Influenza virus
FTFYHKCDD

SEQ ID NO: 326336 - protein, 9 aa, Influenza virus
FYHKCDNKC

SEQ ID NO: 326337 - protein, 9 aa, Influenza virus
YHKCDNKCI

SEQ ID NO: 326338 - protein, 9 aa, Influenza virus
HKCDNKCIE

SEQ ID NO: 326339 - protein, 9 aa, Influenza virus
NECIERVRN

SEQ ID NO: 326340 - protein, 9 aa, Influenza virus
ECIERVRNG

SEQ ID NO: 326341 - protein, 9 aa, Influenza virus
CIERVRNGT

SEQ ID NO: 326342 - protein, 9 aa, Influenza virus
IERVRNGTY

SEQ ID NO: 326343 - protein, 9 aa, Influenza virus
ERVRNGTYD

SEQ ID NO: 326344 - protein, 9 aa, Influenza virus
RVRNGTYDH

SEQ ID NO: 326345 - protein, 9 aa, Influenza virus
IRNGTYDHK

SEQ ID NO: 326346 - protein, 9 aa, Influenza virus
GTYDHKEFK

SEQ ID NO: 326347 - protein, 9 aa, Influenza virus
TYDHKEFEK

SEQ ID NO: 326348 - protein, 9 aa, Influenza virus
YDHKEFEKE

SEQ ID NO: 326349 - protein, 9 aa, Influenza virus
DHKEFEKES

SEQ ID NO: 326350 - protein, 9 aa, Influenza virus
HKEFEEESR

SEQ ID NO: 326351 - protein, 9 aa, Influenza virus
EESKINRQE

SEQ ID NO: 326352 - protein, 9 aa, Influenza virus
ESKINRQEI

SEQ ID NO: 326353 - protein, 9 aa, Influenza virus
SKINRQEIE

SEQ ID NO: 326354 - protein, 9 aa, Influenza virus
KINRQEIEG

SEQ ID NO: 326355 - protein, 9 aa, Influenza virus
INRQEIEGV

SEQ ID NO: 326356 - protein, 9 aa, Influenza virus
NRQEIEGVR

SEQ ID NO: 326357 - protein, 9 aa, Influenza virus
RQEIEGVRL

SEQ ID NO: 326358 - protein, 9 aa, Influenza virus
QEIEGVKLN

SEQ ID NO: 326359 - protein, 9 aa, Influenza virus
GNIYKILSI

SEQ ID NO: 326360 - protein, 9 aa, Influenza virus
NIYKILSIY

SEQ ID NO: 326361 - protein, 9 aa, Influenza virus
IYKILSIYS

SEQ ID NO: 326362 - protein, 9 aa, Influenza virus
KILSIYSCV

SEQ ID NO: 326363 - protein, 9 aa, Influenza virus
ILSICSCIA

SEQ ID NO: 326364 - protein, 9 aa, Influenza virus
LSIYSCVAS

SEQ ID NO: 326365 - protein, 9 aa, Influenza virus
SIYSCVASS

SEQ ID NO: 326366 - protein, 9 aa, Influenza virus
ICSCIASSL

SEQ ID NO: 326367 - protein, 9 aa, Influenza virus
YSCIASSLI

SEQ ID NO: 326368 - protein, 9 aa, Influenza virus
SCIASSLIL

SEQ ID NO: 326369 - protein, 9 aa, Influenza virus
CIASSLILA

SEQ ID NO: 326370 - protein, 9 aa, Influenza virus
IASSLILAA

SEQ ID NO: 326371 - protein, 9 aa, Influenza virus
ASSLVLAAL

SEQ ID NO: 326372 - protein, 9 aa, Influenza virus
SSLVLAALI

SEQ ID NO: 326373 - protein, 9 aa, Influenza virus
SLVLAALIM

SEQ ID NO: 326374 - protein, 9 aa, Influenza virus
LVLAALIMG

SEQ ID NO: 326375 - protein, 9 aa, Influenza virus
WTCSNGSCR

SEQ ID NO: 326376 - protein, 9 aa, Influenza virus
TCSNGSCRC

SEQ ID NO: 326377 - protein, 9 aa, Influenza virus
CNNGSCRCT

SEQ ID NO: 326378 - protein, 9 aa, Influenza virus
NNGSCRCTI

SEQ ID NO: 326379 - protein, 9 aa, Influenza virus
MEKFIVLSI

SEQ ID NO: 326380 - protein, 9 aa, Influenza virus
LAYDKICIG

SEQ ID NO: 326381 - protein, 9 aa, Influenza virus
GYQTNNSTD

SEQ ID NO: 326382 - protein, 9 aa, Influenza virus
YQTNNSTDT

SEQ ID NO: 326383 - protein, 9 aa, Influenza virus
QTNNSTDTV

SEQ ID NO: 326384 - protein, 9 aa, Influenza virus
TNNSTDTVN

SEQ ID NO: 326385 - protein, 9 aa, Influenza virus
NNSTDTVNT

SEQ ID NO: 326386 - protein, 9 aa, Influenza virus
NSTDTVNTL

SEQ ID NO: 326387 - protein, 9 aa, Influenza virus
STDTVNTLI

SEQ ID NO: 326388 - protein, 9 aa, Influenza virus
TDTVNTLIE

SEQ ID NO: 326389 - protein, 9 aa, Influenza virus
DTVNTLIEQ

SEQ ID NO: 326390 - protein, 9 aa, Influenza virus
TVNTLSEQN

SEQ ID NO: 326391 - protein, 9 aa, Influenza virus
VNTLSEQNV

SEQ ID NO: 326392 - protein, 9 aa, Influenza virus
NTLSEQNVP

SEQ ID NO: 326393 - protein, 9 aa, Influenza virus
TLSEQNVPV

SEQ ID NO: 326394 - protein, 9 aa, Influenza virus
LSEQNVPVT

SEQ ID NO: 326395 - protein, 9 aa, Influenza virus
SEQNVPVTQ

SEQ ID NO: 326396 - protein, 9 aa, Influenza virus
EQNIPVTQV

SEQ ID NO: 326397 - protein, 9 aa, Influenza virus
QNIPVTQVE

SEQ ID NO: 326398 - protein, 9 aa, Influenza virus
NIPVTQVEE

SEQ ID NO: 326399 - protein, 9 aa, Influenza virus
IPVTQVEEL

SEQ ID NO: 326400 - protein, 9 aa, Influenza virus
TQVEELVHR

SEQ ID NO: 326401 - protein, 9 aa, Influenza virus
QVEELVHGQ

SEQ ID NO: 326402 - protein, 9 aa, Influenza virus
VEELVHGQV

SEQ ID NO: 326403 - protein, 9 aa, Influenza virus
EELVHGQVN

SEQ ID NO: 326404 - protein, 9 aa, Influenza virus
ELVHGQVNP

SEQ ID NO: 326405 - protein, 9 aa, Influenza virus
TELGAPLVL

SEQ ID NO: 326406 - protein, 9 aa, Influenza virus
ELGAPLVLD

SEQ ID NO: 326407 - protein, 9 aa, Influenza virus
LGAPLVLDD

SEQ ID NO: 326408 - protein, 9 aa, Influenza virus
GAPLVLDDC

SEQ ID NO: 326409 - protein, 9 aa, Influenza virus
APLVLDDCS

SEQ ID NO: 326410 - protein, 9 aa, Influenza virus
LVLDDCSLK

SEQ ID NO: 326411 - protein, 9 aa, Influenza virus
VLDDCSLKG

SEQ ID NO: 326412 - protein, 9 aa, Influenza virus
LDDCSLEGI

SEQ ID NO: 326413 - protein, 9 aa, Influenza virus
DDCSLEGII

SEQ ID NO: 326414 - protein, 9 aa, Influenza virus
DCSLEGIIL

SEQ ID NO: 326415 - protein, 9 aa, Influenza virus
CSLEGIILG

SEQ ID NO: 326416 - protein, 9 aa, Influenza virus
SLEGIILGN

SEQ ID NO: 326417 - protein, 9 aa, Influenza virus
LEGIILGNP

SEQ ID NO: 326418 - protein, 9 aa, Influenza virus
EGIILGNPK

SEQ ID NO: 326419 - protein, 9 aa, Influenza virus
GIILGNPKC

SEQ ID NO: 326420 - protein, 9 aa, Influenza virus
IILGNPKCD

SEQ ID NO: 326421 - protein, 9 aa, Influenza virus
ILGNPKCDP

SEQ ID NO: 326422 - protein, 9 aa, Influenza virus
LGNPKCDPY

SEQ ID NO: 326423 - protein, 9 aa, Influenza virus
GNPKCDPYL

SEQ ID NO: 326424 - protein, 9 aa, Influenza virus
NPKCDPYLN

SEQ ID NO: 326425 - protein, 9 aa, Influenza virus
PKCDPYLNG

SEQ ID NO: 326426 - protein, 9 aa, Influenza virus
KCDPYLNGR

SEQ ID NO: 326427 - protein, 9 aa, Influenza virus
CDPYLNGRE

SEQ ID NO: 326428 - protein, 9 aa, Influenza virus
DPYLNGREW

SEQ ID NO: 326429 - protein, 9 aa, Influenza virus
PYLNGREWS

SEQ ID NO: 326430 - protein, 9 aa, Influenza virus
YLSGREWSY

SEQ ID NO: 326431 - protein, 9 aa, Influenza virus
LSGREWSYI

SEQ ID NO: 326432 - protein, 9 aa, Influenza virus
SGREWSYIV

SEQ ID NO: 326433 - protein, 9 aa, Influenza virus
EWSYIVERT

SEQ ID NO: 326434 - protein, 9 aa, Influenza virus
WSYIVERTK

SEQ ID NO: 326435 - protein, 9 aa, Influenza virus
SYIVERTKE

SEQ ID NO: 326436 - protein, 9 aa, Influenza virus
YIVERTKEM

SEQ ID NO: 326437 - protein, 9 aa, Influenza virus
IVERTKEME

SEQ ID NO: 326438 - protein, 9 aa, Influenza virus
VERTKEMEG

SEQ ID NO: 326439 - protein, 9 aa, Influenza virus
ERPKEMEGV

SEQ ID NO: 326440 - protein, 9 aa, Influenza virus
RPKEMEGVC

SEQ ID NO: 326441 - protein, 9 aa, Influenza virus
PKEMEGVCY

SEQ ID NO: 326442 - protein, 9 aa, Influenza virus
KEMEGVCYP

SEQ ID NO: 326443 - protein, 9 aa, Influenza virus
EMEGVCYPG

SEQ ID NO: 326444 - protein, 9 aa, Influenza virus
MEGVCYPGS

SEQ ID NO: 326445 - protein, 9 aa, Influenza virus
EGVCYPGSI

SEQ ID NO: 326446 - protein, 9 aa, Influenza virus
GVCYPGSIE

SEQ ID NO: 326447 - protein, 9 aa, Influenza virus
VCYPGSIEN

SEQ ID NO: 326448 - protein, 9 aa, Influenza virus
CYPGSVENQ

SEQ ID NO: 326449 - protein, 9 aa, Influenza virus
YPGSIKNQE

SEQ ID NO: 326450 - protein, 9 aa, Influenza virus
PGSIKNQEE

SEQ ID NO: 326451 - protein, 9 aa, Influenza virus
GSIKNQEEL

SEQ ID NO: 326452 - protein, 9 aa, Influenza virus
SIENQEELK

SEQ ID NO: 326453 - protein, 9 aa, Influenza virus
IENQEELRF

SEQ ID NO: 326454 - protein, 9 aa, Influenza virus
ENQEELRFL

SEQ ID NO: 326455 - protein, 9 aa, Influenza virus
NQEELRFLF

SEQ ID NO: 326456 - protein, 9 aa, Influenza virus
QEELRFLFS

SEQ ID NO: 326457 - protein, 9 aa, Influenza virus
EELRFLFSS

SEQ ID NO: 326458 - protein, 9 aa, Influenza virus
ELRFLFSSI

SEQ ID NO: 326459 - protein, 9 aa, Influenza virus
LRFLFSSIK

SEQ ID NO: 326460 - protein, 9 aa, Influenza virus
RFLFSSIKK

SEQ ID NO: 326461 - protein, 9 aa, Influenza virus
FLFSSIKKY

SEQ ID NO: 326462 - protein, 9 aa, Influenza virus
LFSSIKRYE

SEQ ID NO: 326463 - protein, 9 aa, Influenza virus
FSSIKRYER

SEQ ID NO: 326464 - protein, 9 aa, Influenza virus
SSIKRYERV

SEQ ID NO: 326465 - protein, 9 aa, Influenza virus
SIKRYERVK

SEQ ID NO: 326466 - protein, 9 aa, Influenza virus
IKRYERVKM

SEQ ID NO: 326467 - protein, 9 aa, Influenza virus
KRYERVKMF

SEQ ID NO: 326468 - protein, 9 aa, Influenza virus
RYERVKMFD

SEQ ID NO: 326469 - protein, 9 aa, Influenza virus
ERVKMFDFS

SEQ ID NO: 326470 - protein, 9 aa, Influenza virus
RVKMFDFSK

SEQ ID NO: 326471 - protein, 9 aa, Influenza virus
VKMFDFSKW

SEQ ID NO: 326472 - protein, 9 aa, Influenza virus
KMFDFSKWN

SEQ ID NO: 326473 - protein, 9 aa, Influenza virus
MFDFSKWNV

SEQ ID NO: 326474 - protein, 9 aa, Influenza virus
FDFSKWNVT

SEQ ID NO: 326475 - protein, 9 aa, Influenza virus
DFSKWNVTY

SEQ ID NO: 326476 - protein, 9 aa, Influenza virus
FSKWNVTYT

SEQ ID NO: 326477 - protein, 9 aa, Influenza virus
SKWNVTYTG

SEQ ID NO: 326478 - protein, 9 aa, Influenza virus
KWNVTYTGI

SEQ ID NO: 326479 - protein, 9 aa, Influenza virus
WNVTYTGIS

SEQ ID NO: 326480 - protein, 9 aa, Influenza virus
NVTYTGTSR

SEQ ID NO: 326481 - protein, 9 aa, Influenza virus
VTYTGTSRA

SEQ ID NO: 326482 - protein, 9 aa, Influenza virus
TYTGTSRAC

SEQ ID NO: 326483 - protein, 9 aa, Influenza virus
YTGTSRACN

SEQ ID NO: 326484 - protein, 9 aa, Influenza virus
SKACNDTSN

SEQ ID NO: 326485 - protein, 9 aa, Influenza virus
ISNQGSFYR

SEQ ID NO: 326486 - protein, 9 aa, Influenza virus
SNQGSFYRN

SEQ ID NO: 326487 - protein, 9 aa, Influenza virus
NQGSFYRSI

SEQ ID NO: 326488 - protein, 9 aa, Influenza virus
QGSFYRNMR

SEQ ID NO: 326489 - protein, 9 aa, Influenza virus
GSFYRSIRW

SEQ ID NO: 326490 - protein, 9 aa, Influenza virus
SFYRNMRWL

SEQ ID NO: 326491 - protein, 9 aa, Influenza virus
FYRSIRWLT

SEQ ID NO: 326492 - protein, 9 aa, Influenza virus
YRSIRWLTL

SEQ ID NO: 326493 - protein, 9 aa, Influenza virus
RNMRWLTLK

SEQ ID NO: 326494 - protein, 9 aa, Influenza virus
NMRWLTLKS

SEQ ID NO: 326495 - protein, 9 aa, Influenza virus
MRWLTLKSE

SEQ ID NO: 326496 - protein, 9 aa, Influenza virus
RWLTLKSEQ

SEQ ID NO: 326497 - protein, 9 aa, Influenza virus
WLTLKSEQF

SEQ ID NO: 326498 - protein, 9 aa, Influenza virus
LTLKSEQFP

SEQ ID NO: 326499 - protein, 9 aa, Influenza virus
TLKSEQFPV

SEQ ID NO: 326500 - protein, 9 aa, Influenza virus
LKSEQFPVQ

SEQ ID NO: 326501 - protein, 9 aa, Influenza virus
KSEQFPVQT

SEQ ID NO: 326502 - protein, 9 aa, Influenza virus
SEQFPVQTD

SEQ ID NO: 326503 - protein, 9 aa, Influenza virus
EQFPVQTDE

SEQ ID NO: 326504 - protein, 9 aa, Influenza virus
QTDEYKNTG

SEQ ID NO: 326505 - protein, 9 aa, Influenza virus
TDEYKNTGD

SEQ ID NO: 326506 - protein, 9 aa, Influenza virus
DEYKNTGDS

SEQ ID NO: 326507 - protein, 9 aa, Influenza virus
EYKNTRDSN

SEQ ID NO: 326508 - protein, 9 aa, Influenza virus
YKNTGDSDI

SEQ ID NO: 326509 - protein, 9 aa, Influenza virus
FMWAIHHPP

SEQ ID NO: 326510 - protein, 9 aa, Influenza virus
MWAIHHPPT

SEQ ID NO: 326511 - protein, 9 aa, Influenza virus
WAIHHPPTT

SEQ ID NO: 326512 - protein, 9 aa, Influenza virus
AIHHPPTSN

SEQ ID NO: 326513 - protein, 9 aa, Influenza virus
IHHPPTSNE

SEQ ID NO: 326514 - protein, 9 aa, Influenza virus
HHPPTSNEQ

SEQ ID NO: 326515 - protein, 9 aa, Influenza virus
HPPTSNEQV

SEQ ID NO: 326516 - protein, 9 aa, Influenza virus
EINRSFRPN

SEQ ID NO: 326517 - protein, 9 aa, Influenza virus
INRSFRPNI

SEQ ID NO: 326518 - protein, 9 aa, Influenza virus
NRSFRPNIG

SEQ ID NO: 326519 - protein, 9 aa, Influenza virus
RSFRPNIGP

SEQ ID NO: 326520 - protein, 9 aa, Influenza virus
SFRPNIGPR

SEQ ID NO: 326521 - protein, 9 aa, Influenza virus
FRPNIGPRP

SEQ ID NO: 326522 - protein, 9 aa, Influenza virus
KPNIGPRPF

SEQ ID NO: 326523 - protein, 9 aa, Influenza virus
PNIGPRPFV

SEQ ID NO: 326524 - protein, 9 aa, Influenza virus
NIGPRPFVR

SEQ ID NO: 326525 - protein, 9 aa, Influenza virus
IGPRPFVRG

SEQ ID NO: 326526 - protein, 9 aa, Influenza virus
GPRPFVRGQ

SEQ ID NO: 326527 - protein, 9 aa, Influenza virus
PRPFVRGQQ

SEQ ID NO: 326528 - protein, 9 aa, Influenza virus
RPFVRGQQG

SEQ ID NO: 326529 - protein, 9 aa, Influenza virus
PFVRGQQGR

SEQ ID NO: 326530 - protein, 9 aa, Influenza virus
FVRGQQGRM

SEQ ID NO: 326531 - protein, 9 aa, Influenza virus
VREQQGRMD

SEQ ID NO: 326532 - protein, 9 aa, Influenza virus
REQQGRMDY

SEQ ID NO: 326533 - protein, 9 aa, Influenza virus
EQQGRMDYY

SEQ ID NO: 326534 - protein, 9 aa, Influenza virus
GRMDYYWAI

SEQ ID NO: 326535 - protein, 9 aa, Influenza virus
RMDYYWAIL

SEQ ID NO: 326536 - protein, 9 aa, Influenza virus
MDYYWAILK

SEQ ID NO: 326537 - protein, 9 aa, Influenza virus
DYYWAILKP

SEQ ID NO: 326538 - protein, 9 aa, Influenza virus
YYWAILKPG

SEQ ID NO: 326539 - protein, 9 aa, Influenza virus
YWAILKPGQ

SEQ ID NO: 326540 - protein, 9 aa, Influenza virus
WAILKPGQT

SEQ ID NO: 326541 - protein, 9 aa, Influenza virus
AILKPGQTV

SEQ ID NO: 326542 - protein, 9 aa, Influenza virus
ILKPGQTVK

SEQ ID NO: 326543 - protein, 9 aa, Influenza virus
KPGQTVKIK

SEQ ID NO: 326544 - protein, 9 aa, Influenza virus
PGQTVKIKT

SEQ ID NO: 326545 - protein, 9 aa, Influenza virus
GQTVKIQTS

SEQ ID NO: 326546 - protein, 9 aa, Influenza virus
QTVKIQTSG

SEQ ID NO: 326547 - protein, 9 aa, Influenza virus
TVKIQTSGN

SEQ ID NO: 326548 - protein, 9 aa, Influenza virus
VKIKTNGNL

SEQ ID NO: 326549 - protein, 9 aa, Influenza virus
KIQTSGNLI

SEQ ID NO: 326550 - protein, 9 aa, Influenza virus
IKTNGNLIA

SEQ ID NO: 326551 - protein, 9 aa, Influenza virus
QTSGNLIAP

SEQ ID NO: 326552 - protein, 9 aa, Influenza virus
TSGNLIAPE

SEQ ID NO: 326553 - protein, 9 aa, Influenza virus
SGNLIAPEY

SEQ ID NO: 326554 - protein, 9 aa, Influenza virus
NLIAPEYGY

SEQ ID NO: 326555 - protein, 9 aa, Influenza virus
LIAPEYGYL

SEQ ID NO: 326556 - protein, 9 aa, Influenza virus
IAPEYGHLV

SEQ ID NO: 326557 - protein, 9 aa, Influenza virus
APEYGHLVT

SEQ ID NO: 326558 - protein, 9 aa, Influenza virus
PEYGHLVTG

SEQ ID NO: 326559 - protein, 9 aa, Influenza virus
EYGHLVTGK

SEQ ID NO: 326560 - protein, 9 aa, Influenza virus
YGHLVTGKS

SEQ ID NO: 326561 - protein, 9 aa, Influenza virus
GHLVTGKSH

SEQ ID NO: 326562 - protein, 9 aa, Influenza virus
HLVTGKSHG

SEQ ID NO: 326563 - protein, 9 aa, Influenza virus
LVTGKSHGR

SEQ ID NO: 326564 - protein, 9 aa, Influenza virus
ITGKSHGRV

SEQ ID NO: 326565 - protein, 9 aa, Influenza virus
TGKSHGRVL

SEQ ID NO: 326566 - protein, 9 aa, Influenza virus
GKSHGRVLK

SEQ ID NO: 326567 - protein, 9 aa, Influenza virus
KSHGRVLKN

SEQ ID NO: 326568 - protein, 9 aa, Influenza virus
SHGRILKND

SEQ ID NO: 326569 - protein, 9 aa, Influenza virus
HGRILKNDL

SEQ ID NO: 326570 - protein, 9 aa, Influenza virus
GRILKNDLP

SEQ ID NO: 326571 - protein, 9 aa, Influenza virus
TGCQLNEGV

SEQ ID NO: 326572 - protein, 9 aa, Influenza virus
KCQLNEGVM

SEQ ID NO: 326573 - protein, 9 aa, Influenza virus
CQLNEGIMN

SEQ ID NO: 326574 - protein, 9 aa, Influenza virus
QLNEGIMNT

SEQ ID NO: 326575 - protein, 9 aa, Influenza virus
LNEGVINTS

SEQ ID NO: 326576 - protein, 9 aa, Influenza virus
NEGIMNTSK

SEQ ID NO: 326577 - protein, 9 aa, Influenza virus
EGIMNTSKP

SEQ ID NO: 326578 - protein, 9 aa, Influenza virus
GVINTSKPF

SEQ ID NO: 326579 - protein, 9 aa, Influenza virus
IMNTSKPFQ

SEQ ID NO: 326580 - protein, 9 aa, Influenza virus
MNTSKPLQN

SEQ ID NO: 326581 - protein, 9 aa, Influenza virus
NTSKPFQNI

SEQ ID NO: 326582 - protein, 9 aa, Influenza virus
TSKPLQNTS

SEQ ID NO: 326583 - protein, 9 aa, Influenza virus
SKPFQNICK

SEQ ID NO: 326584 - protein, 9 aa, Influenza virus
KPLQNTSKH

SEQ ID NO: 326585 - protein, 9 aa, Influenza virus
PFQNICKPY

SEQ ID NO: 326586 - protein, 9 aa, Influenza virus
FQNTSRHYI

SEQ ID NO: 326587 - protein, 9 aa, Influenza virus
QNICKPYIG

SEQ ID NO: 326588 - protein, 9 aa, Influenza virus
NICKPYIGK

SEQ ID NO: 326589 - protein, 9 aa, Influenza virus
ICKPYIGKC

SEQ ID NO: 326590 - protein, 9 aa, Influenza virus
CKPYIGKCP

SEQ ID NO: 326591 - protein, 9 aa, Influenza virus
KHYIGKCPR

SEQ ID NO: 326592 - protein, 9 aa, Influenza virus
HYIGKCPRY

SEQ ID NO: 326593 - protein, 9 aa, Influenza virus
YIGKCPRYI

SEQ ID NO: 326594 - protein, 9 aa, Influenza virus
IGKCPRYIP

SEQ ID NO: 326595 - protein, 9 aa, Influenza virus
GKCPRYIPS

SEQ ID NO: 326596 - protein, 9 aa, Influenza virus
KCPKYIPSN

SEQ ID NO: 326597 - protein, 9 aa, Influenza virus
CPKYIPSNS

SEQ ID NO: 326598 - protein, 9 aa, Influenza virus
PKYIPSNSL

SEQ ID NO: 326599 - protein, 9 aa, Influenza virus
KYIPSNSLK

SEQ ID NO: 326600 - protein, 9 aa, Influenza virus
YIPSNSLKL

SEQ ID NO: 326601 - protein, 9 aa, Influenza virus
IPSNSLKLA

SEQ ID NO: 326602 - protein, 9 aa, Influenza virus
PSNSLKLAI

SEQ ID NO: 326603 - protein, 9 aa, Influenza virus
SNSLKLAIG

SEQ ID NO: 326604 - protein, 9 aa, Influenza virus
NSLKLAIGL

SEQ ID NO: 326605 - protein, 9 aa, Influenza virus
SLKLAIGPR

SEQ ID NO: 326606 - protein, 9 aa, Influenza virus
LKLAIGPRN

SEQ ID NO: 326607 - protein, 9 aa, Influenza virus
KLAIGPRNV

SEQ ID NO: 326608 - protein, 9 aa, Influenza virus
LAIGPRNVP

SEQ ID NO: 326609 - protein, 9 aa, Influenza virus
AIGPRNVPQ

SEQ ID NO: 326610 - protein, 9 aa, Influenza virus
IGLRNVPQV

SEQ ID NO: 326611 - protein, 9 aa, Influenza virus
GLRNVPQVQ

SEQ ID NO: 326612 - protein, 9 aa, Influenza virus
RNVPQVQNR

SEQ ID NO: 326613 - protein, 9 aa, Influenza virus
NVPQVQNRG

SEQ ID NO: 326614 - protein, 9 aa, Influenza virus
VPQVQNRGL

SEQ ID NO: 326615 - protein, 9 aa, Influenza virus
PQVQNRGLF

SEQ ID NO: 326616 - protein, 9 aa, Influenza virus
QVQNRGLFG

SEQ ID NO: 326617 - protein, 9 aa, Influenza virus
VQNRGLFGA

SEQ ID NO: 326618 - protein, 9 aa, Influenza virus
QDRGLFGAI

SEQ ID NO: 326619 - protein, 9 aa, Influenza virus
DRGLFGAIA

SEQ ID NO: 326620 - protein, 9 aa, Influenza virus
RGLFGAKAG

SEQ ID NO: 326621 - protein, 9 aa, Influenza virus
GLFGAKAGF

SEQ ID NO: 326622 - protein, 9 aa, Influenza virus
LFGAKAGFI

SEQ ID NO: 326623 - protein, 9 aa, Influenza virus
FGAKAGFIE

SEQ ID NO: 326624 - protein, 9 aa, Influenza virus
GAKAGFIEG

SEQ ID NO: 326625 - protein, 9 aa, Influenza virus
AKAGFIEGG

SEQ ID NO: 326626 - protein, 9 aa, Influenza virus
KAGFIEGGW

SEQ ID NO: 326627 - protein, 9 aa, Influenza virus
AGFIEGRWP

SEQ ID NO: 326628 - protein, 9 aa, Influenza virus
GFIEGRWPG

SEQ ID NO: 326629 - protein, 9 aa, Influenza virus
FIEGRWPGL

SEQ ID NO: 326630 - protein, 9 aa, Influenza virus
IEGRWPGLV

SEQ ID NO: 326631 - protein, 9 aa, Influenza virus
EGRWPGLVA

SEQ ID NO: 326632 - protein, 9 aa, Influenza virus
GRWPGLVAG

SEQ ID NO: 326633 - protein, 9 aa, Influenza virus
RWPGLVAGW

SEQ ID NO: 326634 - protein, 9 aa, Influenza virus
WYGFQHQNS

SEQ ID NO: 326635 - protein, 9 aa, Influenza virus
YGFQHQNSE

SEQ ID NO: 326636 - protein, 9 aa, Influenza virus
GFQHQNSEG

SEQ ID NO: 326637 - protein, 9 aa, Influenza virus
FQHQNSEGT

SEQ ID NO: 326638 - protein, 9 aa, Influenza virus
QHQNSEGTG

SEQ ID NO: 326639 - protein, 9 aa, Influenza virus
HQNAEGTGM

SEQ ID NO: 326640 - protein, 9 aa, Influenza virus
QNAEGTGMA

SEQ ID NO: 326641 - protein, 9 aa, Influenza virus
NAEGTGMAA

SEQ ID NO: 326642 - protein, 9 aa, Influenza virus
AEGTGMAAD

SEQ ID NO: 326643 - protein, 9 aa, Influenza virus
EGTGMAADR

SEQ ID NO: 326644 - protein, 9 aa, Influenza virus
GTGMAADRD

SEQ ID NO: 326645 - protein, 9 aa, Influenza virus
TGMAADRDS

SEQ ID NO: 326646 - protein, 9 aa, Influenza virus
GMAADRDST

SEQ ID NO: 326647 - protein, 9 aa, Influenza virus
MAADRDSTQ

SEQ ID NO: 326648 - protein, 9 aa, Influenza virus
AADRDSTQR

SEQ ID NO: 326649 - protein, 9 aa, Influenza virus
ADRDSTQRA

SEQ ID NO: 326650 - protein, 9 aa, Influenza virus
DRDSTQRAI

SEQ ID NO: 326651 - protein, 9 aa, Influenza virus
RDSTQRAID

SEQ ID NO: 326652 - protein, 9 aa, Influenza virus
DSTQRAIDN

SEQ ID NO: 326653 - protein, 9 aa, Influenza virus
STQRAIDNM

SEQ ID NO: 326654 - protein, 9 aa, Influenza virus
TQRAIDNMQ

SEQ ID NO: 326655 - protein, 9 aa, Influenza virus
QRAIDNMQN

SEQ ID NO: 326656 - protein, 9 aa, Influenza virus
RAIDNMQNK

SEQ ID NO: 326657 - protein, 9 aa, Influenza virus
AIDIMQNKL

SEQ ID NO: 326658 - protein, 9 aa, Influenza virus
IDIMQNKLN

SEQ ID NO: 326659 - protein, 9 aa, Influenza virus
DNMQNRLNN

SEQ ID NO: 326660 - protein, 9 aa, Influenza virus
IMQNKLNNV

SEQ ID NO: 326661 - protein, 9 aa, Influenza virus
MQNRLNNVI

SEQ ID NO: 326662 - protein, 9 aa, Influenza virus
QNRLNNVID

SEQ ID NO: 326663 - protein, 9 aa, Influenza virus
NRLNNVIDK

SEQ ID NO: 326664 - protein, 9 aa, Influenza virus
RLNNVIDKM

SEQ ID NO: 326665 - protein, 9 aa, Influenza virus
LNNVIDKMY

SEQ ID NO: 326666 - protein, 9 aa, Influenza virus
NNVIDKMYK

SEQ ID NO: 326667 - protein, 9 aa, Influenza virus
NVIDKMYKQ

SEQ ID NO: 326668 - protein, 9 aa, Influenza virus
VIDKMNNQF

SEQ ID NO: 326669 - protein, 9 aa, Influenza virus
EFSKVETRI

SEQ ID NO: 326670 - protein, 9 aa, Influenza virus
FSKVETRIN

SEQ ID NO: 326671 - protein, 9 aa, Influenza virus
VETRINMIN

SEQ ID NO: 326672 - protein, 9 aa, Influenza virus
ETRINMINS

SEQ ID NO: 326673 - protein, 9 aa, Influenza virus
TRINMINSK

SEQ ID NO: 326674 - protein, 9 aa, Influenza virus
RINTINSKI

SEQ ID NO: 326675 - protein, 9 aa, Influenza virus
INMINSKIE

SEQ ID NO: 326676 - protein, 9 aa, Influenza virus
NMINSKIED

SEQ ID NO: 326677 - protein, 9 aa, Influenza virus
TINSKIDDQ

SEQ ID NO: 326678 - protein, 9 aa, Influenza virus
INSKIDDQV

SEQ ID NO: 326679 - protein, 9 aa, Influenza virus
IDDQVTDIW

SEQ ID NO: 326680 - protein, 9 aa, Influenza virus
DDQVTDIWA

SEQ ID NO: 326681 - protein, 9 aa, Influenza virus
DQVTDIWAY

SEQ ID NO: 326682 - protein, 9 aa, Influenza virus
QVTDIWAYN

SEQ ID NO: 326683 - protein, 9 aa, Influenza virus
VTDIWAYNA

SEQ ID NO: 326684 - protein, 9 aa, Influenza virus
IDIWAYNAE

SEQ ID NO: 326685 - protein, 9 aa, Influenza virus
IWAYNAELI

SEQ ID NO: 326686 - protein, 9 aa, Influenza virus
WAYNAELIV

SEQ ID NO: 326687 - protein, 9 aa, Influenza virus
AYNAELIVL

SEQ ID NO: 326688 - protein, 9 aa, Influenza virus
YNAELIVLL

SEQ ID NO: 326689 - protein, 9 aa, Influenza virus
NAELIVLLE

SEQ ID NO: 326690 - protein, 9 aa, Influenza virus
AELIVLLEN

SEQ ID NO: 326691 - protein, 9 aa, Influenza virus
ELIVLLENQ

SEQ ID NO: 326692 - protein, 9 aa, Influenza virus
LIVLLENQK

SEQ ID NO: 326693 - protein, 9 aa, Influenza virus
IVLLENQKT

SEQ ID NO: 326694 - protein, 9 aa, Influenza virus
DANVRNLHE

SEQ ID NO: 326695 - protein, 9 aa, Influenza virus
ANVRNLHER

SEQ ID NO: 326696 - protein, 9 aa, Influenza virus
NVRNLHDRI

SEQ ID NO: 326697 - protein, 9 aa, Influenza virus
VRNLHDRIR

SEQ ID NO: 326698 - protein, 9 aa, Influenza virus
RNLHDRIRR

SEQ ID NO: 326699 - protein, 9 aa, Influenza virus
RILKENAID

SEQ ID NO: 326700 - protein, 9 aa, Influenza virus
ENAIDAGDG

SEQ ID NO: 326701 - protein, 9 aa, Influenza virus
NAVDTGDGC

SEQ ID NO: 326702 - protein, 9 aa, Influenza virus
ALDTGDGCF

SEQ ID NO: 326703 - protein, 9 aa, Influenza virus
LDTGDGCFE

SEQ ID NO: 326704 - protein, 9 aa, Influenza virus
DAGDGCFEI

SEQ ID NO: 326705 - protein, 9 aa, Influenza virus
AGDGCFEIL

SEQ ID NO: 326706 - protein, 9 aa, Influenza virus
DGCFEILHR

SEQ ID NO: 326707 - protein, 9 aa, Influenza virus
GCFEILHRC

SEQ ID NO: 326708 - protein, 9 aa, Influenza virus
CFEILHRCD

SEQ ID NO: 326709 - protein, 9 aa, Influenza virus
FEILHKCDD

SEQ ID NO: 326710 - protein, 9 aa, Influenza virus
TIKNGTYNH

SEQ ID NO: 326711 - protein, 9 aa, Influenza virus
IRNGTYNHR

SEQ ID NO: 326712 - protein, 9 aa, Influenza virus
GTYNHREYE

SEQ ID NO: 326713 - protein, 9 aa, Influenza virus
YEEESKLER

SEQ ID NO: 326714 - protein, 9 aa, Influenza virus
EEESKLERQ

SEQ ID NO: 326715 - protein, 9 aa, Influenza virus
EESKLERQK

SEQ ID NO: 326716 - protein, 9 aa, Influenza virus
ESKLERQKI

SEQ ID NO: 326717 - protein, 9 aa, Influenza virus
ERQRINGVK

SEQ ID NO: 326718 - protein, 9 aa, Influenza virus
RQRINGVKL

SEQ ID NO: 326719 - protein, 9 aa, Influenza virus
QRINGVKLE

SEQ ID NO: 326720 - protein, 9 aa, Influenza virus
RINGVKLEE

SEQ ID NO: 326721 - protein, 9 aa, Influenza virus
VNGVKLEEN

SEQ ID NO: 326722 - protein, 9 aa, Influenza virus
SGVKLEENS

SEQ ID NO: 326723 - protein, 9 aa, Influenza virus
VASSLVLLF

SEQ ID NO: 326724 - protein, 9 aa, Influenza virus
ASSLVLLFM

SEQ ID NO: 326725 - protein, 9 aa, Influenza virus
SSLVLLFMI

SEQ ID NO: 326726 - protein, 9 aa, Influenza virus
SLVLLFMII

SEQ ID NO: 326727 - protein, 9 aa, Influenza virus
LVLLFMIIG

SEQ ID NO: 326728 - protein, 9 aa, Influenza virus
VLLFMIIGG

SEQ ID NO: 326729 - protein, 9 aa, Influenza virus
LLFMIIGGF

SEQ ID NO: 326730 - protein, 9 aa, Influenza virus
LFMIIGGFI

SEQ ID NO: 326731 - protein, 9 aa, Influenza virus
FMIIGGFIF

SEQ ID NO: 326732 - protein, 9 aa, Influenza virus
IFGCQNGNI

SEQ ID NO: 326733 - protein, 9 aa, Influenza virus
FGCQNGNIR

SEQ ID NO: 326734 - protein, 9 aa, Influenza virus
GCQNGNIRC

SEQ ID NO: 326735 - protein, 9 aa, Influenza virus
CQNGNIRCT

SEQ ID NO: 326736 - protein, 9 aa, Influenza virus
QNGNIRCTF

SEQ ID NO: 326737 - protein, 9 aa, Influenza virus
NGNIRCTFC

SEQ ID NO: 326738 - protein, 9 aa, Influenza virus
GNIRCTFCI

SEQ ID NO: 326739 - protein, 9 aa, Influenza virus
ADRICIGYL

SEQ ID NO: 326740 - protein, 9 aa, Influenza virus
DKICVGYLS

SEQ ID NO: 326741 - protein, 9 aa, Influenza virus
KICVGYLST

SEQ ID NO: 326742 - protein, 9 aa, Influenza virus
ICIGYLSTN

SEQ ID NO: 326743 - protein, 9 aa, Influenza virus
CIGYLSTNS

SEQ ID NO: 326744 - protein, 9 aa, Influenza virus
VGYLSTNST

SEQ ID NO: 326745 - protein, 9 aa, Influenza virus
GYLSTNSTE

SEQ ID NO: 326746 - protein, 9 aa, Influenza virus
YLSTNSSEK

SEQ ID NO: 326747 - protein, 9 aa, Influenza virus
LSTNSSEKV

SEQ ID NO: 326748 - protein, 9 aa, Influenza virus
STNSSEKVD

SEQ ID NO: 326749 - protein, 9 aa, Influenza virus
TNSSEKVDT

SEQ ID NO: 326750 - protein, 9 aa, Influenza virus
NSSEKVDTL

SEQ ID NO: 326751 - protein, 9 aa, Influenza virus
SSEKVDTLL

SEQ ID NO: 326752 - protein, 9 aa, Influenza virus
SEKVDTLLE

SEQ ID NO: 326753 - protein, 9 aa, Influenza virus
ERVDTLLEN

SEQ ID NO: 326754 - protein, 9 aa, Influenza virus
VDTLLENDV

SEQ ID NO: 326755 - protein, 9 aa, Influenza virus
DTLLENDVP

SEQ ID NO: 326756 - protein, 9 aa, Influenza virus
TLLENDVPV

SEQ ID NO: 326757 - protein, 9 aa, Influenza virus
LLENDVPVT

SEQ ID NO: 326758 - protein, 9 aa, Influenza virus
LENDVPVTS

SEQ ID NO: 326759 - protein, 9 aa, Influenza virus
ENDVPVTSS

SEQ ID NO: 326760 - protein, 9 aa, Influenza virus
VPVTSSIDL

SEQ ID NO: 326761 - protein, 9 aa, Influenza virus
PVTSSVDLI

SEQ ID NO: 326762 - protein, 9 aa, Influenza virus
VTSSVDLIE

SEQ ID NO: 326763 - protein, 9 aa, Influenza virus
TSSVDLIET

SEQ ID NO: 326764 - protein, 9 aa, Influenza virus
DLIETNHTG

SEQ ID NO: 326765 - protein, 9 aa, Influenza virus
LIETNHTGT

SEQ ID NO: 326766 - protein, 9 aa, Influenza virus
IETNHTGTY

SEQ ID NO: 326767 - protein, 9 aa, Influenza virus
ETSHTGTYC

SEQ ID NO: 326768 - protein, 9 aa, Influenza virus
TSHTGTYCS

SEQ ID NO: 326769 - protein, 9 aa, Influenza virus
SHTGTYCSL

SEQ ID NO: 326770 - protein, 9 aa, Influenza virus
HTGTYCSLD

SEQ ID NO: 326771 - protein, 9 aa, Influenza virus
TGTYCSLDG

SEQ ID NO: 326772 - protein, 9 aa, Influenza virus
GVSPVHLGD

SEQ ID NO: 326773 - protein, 9 aa, Influenza virus
VSPVHLGDC

SEQ ID NO: 326774 - protein, 9 aa, Influenza virus
SPVHLGDCR

SEQ ID NO: 326775 - protein, 9 aa, Influenza virus
PVHLGDCRF

SEQ ID NO: 326776 - protein, 9 aa, Influenza virus
VHLGDCRFE

SEQ ID NO: 326777 - protein, 9 aa, Influenza virus
HLGDCRFEG

SEQ ID NO: 326778 - protein, 9 aa, Influenza virus
LGDCRFEGW

SEQ ID NO: 326779 - protein, 9 aa, Influenza virus
GDCRFEGWI

SEQ ID NO: 326780 - protein, 9 aa, Influenza virus
DCRFEGWIV

SEQ ID NO: 326781 - protein, 9 aa, Influenza virus
CRFEGWIVG

SEQ ID NO: 326782 - protein, 9 aa, Influenza virus
RFEGWIVGN

SEQ ID NO: 326783 - protein, 9 aa, Influenza virus
FEGWIGGNP

SEQ ID NO: 326784 - protein, 9 aa, Influenza virus
EGWIVGNPS

SEQ ID NO: 326785 - protein, 9 aa, Influenza virus
GWIVGNPSC

SEQ ID NO: 326786 - protein, 9 aa, Influenza virus
GVREWSYLI

SEQ ID NO: 326787 - protein, 9 aa, Influenza virus
VREWSYLIE

SEQ ID NO: 326788 - protein, 9 aa, Influenza virus
WSYLIEDPG

SEQ ID NO: 326789 - protein, 9 aa, Influenza virus
SYLIEDPGA

SEQ ID NO: 326790 - protein, 9 aa, Influenza virus
YLIEDPGAP

SEQ ID NO: 326791 - protein, 9 aa, Influenza virus
LIEDPGAPH

SEQ ID NO: 326792 - protein, 9 aa, Influenza virus
IEDPGAPHG

SEQ ID NO: 326793 - protein, 9 aa, Influenza virus
EDPGAPHGL

SEQ ID NO: 326794 - protein, 9 aa, Influenza virus
DPGAPHGLC

SEQ ID NO: 326795 - protein, 9 aa, Influenza virus
PGAPHGLCY

SEQ ID NO: 326796 - protein, 9 aa, Influenza virus
GAPHGLCYP

SEQ ID NO: 326797 - protein, 9 aa, Influenza virus
APHRLCYPG

SEQ ID NO: 326798 - protein, 9 aa, Influenza virus
PHRLCYPGE

SEQ ID NO: 326799 - protein, 9 aa, Influenza virus
HRLCYPGEL

SEQ ID NO: 326800 - protein, 9 aa, Influenza virus
GLCYPGELN

SEQ ID NO: 326801 - protein, 9 aa, Influenza virus
LCYPGELNN

SEQ ID NO: 326802 - protein, 9 aa, Influenza virus
CYPGELNNN

SEQ ID NO: 326803 - protein, 9 aa, Influenza virus
YPGELNNNG

SEQ ID NO: 326804 - protein, 9 aa, Influenza virus
PGELNNNGE

SEQ ID NO: 326805 - protein, 9 aa, Influenza virus
GELNNNGEL

SEQ ID NO: 326806 - protein, 9 aa, Influenza virus
ELNNNGELR

SEQ ID NO: 326807 - protein, 9 aa, Influenza virus
LNNNGELRH

SEQ ID NO: 326808 - protein, 9 aa, Influenza virus
NNNGELRHL

SEQ ID NO: 326809 - protein, 9 aa, Influenza virus
LRHLFSGIK

SEQ ID NO: 326810 - protein, 9 aa, Influenza virus
RHLFSGIKS

SEQ ID NO: 326811 - protein, 9 aa, Influenza virus
HLFSGIKSF

SEQ ID NO: 326812 - protein, 9 aa, Influenza virus
LFSGIKSFS

SEQ ID NO: 326813 - protein, 9 aa, Influenza virus
FSGIKSFSR

SEQ ID NO: 326814 - protein, 9 aa, Influenza virus
SGIKSFSRT

SEQ ID NO: 326815 - protein, 9 aa, Influenza virus
GIKSFSRTE

SEQ ID NO: 326816 - protein, 9 aa, Influenza virus
IKSFSRTEL

SEQ ID NO: 326817 - protein, 9 aa, Influenza virus
KSFSRTELI

SEQ ID NO: 326818 - protein, 9 aa, Influenza virus
SFSRTELIP

SEQ ID NO: 326819 - protein, 9 aa, Influenza virus
FSRTELIPP

SEQ ID NO: 326820 - protein, 9 aa, Influenza virus
TGTSSFYRN

SEQ ID NO: 326821 - protein, 9 aa, Influenza virus
SFYRNLIWF

SEQ ID NO: 326822 - protein, 9 aa, Influenza virus
FYRNLIWFV

SEQ ID NO: 326823 - protein, 9 aa, Influenza virus
GTYNNTTGR

SEQ ID NO: 326824 - protein, 9 aa, Influenza virus
AYNNTTGRD

SEQ ID NO: 326825 - protein, 9 aa, Influenza virus
TTGRDVLVM

SEQ ID NO: 326826 - protein, 9 aa, Influenza virus
TGRDVLVMW

SEQ ID NO: 326827 - protein, 9 aa, Influenza virus
GRDVLVMWG

SEQ ID NO: 326828 - protein, 9 aa, Influenza virus
RDVLVMWGI

SEQ ID NO: 326829 - protein, 9 aa, Influenza virus
DVLVMWGIH

SEQ ID NO: 326830 - protein, 9 aa, Influenza virus
VLVMWGIHH

SEQ ID NO: 326831 - protein, 9 aa, Influenza virus
LVMWGIHHP

SEQ ID NO: 326832 - protein, 9 aa, Influenza virus
PYTLVSTKS

SEQ ID NO: 326833 - protein, 9 aa, Influenza virus
YTLVSTKSW

SEQ ID NO: 326834 - protein, 9 aa, Influenza virus
TLVSTKSWS

SEQ ID NO: 326835 - protein, 9 aa, Influenza virus
GIRPGYNGQ

SEQ ID NO: 326836 - protein, 9 aa, Influenza virus
IRPGYNGQK

SEQ ID NO: 326837 - protein, 9 aa, Influenza virus
RPGYNGQRS

SEQ ID NO: 326838 - protein, 9 aa, Influenza virus
PGYNGQRSW

SEQ ID NO: 326839 - protein, 9 aa, Influenza virus
GYNGQKSWM

SEQ ID NO: 326840 - protein, 9 aa, Influenza virus
YNGQKSWMK

SEQ ID NO: 326841 - protein, 9 aa, Influenza virus
NGQKSWMKI

SEQ ID NO: 326842 - protein, 9 aa, Influenza virus
GQKSWMKIY

SEQ ID NO: 326843 - protein, 9 aa, Influenza virus
QKSWMKIYW

SEQ ID NO: 326844 - protein, 9 aa, Influenza virus
SWMKIYWYL

SEQ ID NO: 326845 - protein, 9 aa, Influenza virus
ITFESNGGL

SEQ ID NO: 326846 - protein, 9 aa, Influenza virus
TFESNGGLL

SEQ ID NO: 326847 - protein, 9 aa, Influenza virus
FESNGGFLA

SEQ ID NO: 326848 - protein, 9 aa, Influenza virus
ESNGGFLAP

SEQ ID NO: 326849 - protein, 9 aa, Influenza virus
SNGGLLAPK

SEQ ID NO: 326850 - protein, 9 aa, Influenza virus
NGGLLAPKY

SEQ ID NO: 326851 - protein, 9 aa, Influenza virus
GGLLAPKYG

SEQ ID NO: 326852 - protein, 9 aa, Influenza virus
GLLAPKYGY

SEQ ID NO: 326853 - protein, 9 aa, Influenza virus
LLAPKYGYI

SEQ ID NO: 326854 - protein, 9 aa, Influenza virus
LAPKYGYII

SEQ ID NO: 326855 - protein, 9 aa, Influenza virus
APKYGYIIE

SEQ ID NO: 326856 - protein, 9 aa, Influenza virus
PKYGYIIEE

SEQ ID NO: 326857 - protein, 9 aa, Influenza virus
KYGYIIEEY

SEQ ID NO: 326858 - protein, 9 aa, Influenza virus
GYIIEEYGR

SEQ ID NO: 326859 - protein, 9 aa, Influenza virus
YIIEEYGRG

SEQ ID NO: 326860 - protein, 9 aa, Influenza virus
IIEEYGRGR

SEQ ID NO: 326861 - protein, 9 aa, Influenza virus
IEEYGRGRI

SEQ ID NO: 326862 - protein, 9 aa, Influenza virus
EEYGRGRIF

SEQ ID NO: 326863 - protein, 9 aa, Influenza virus
EYGRGRIFQ

SEQ ID NO: 326864 - protein, 9 aa, Influenza virus
YGRGRIFQS

SEQ ID NO: 326865 - protein, 9 aa, Influenza virus
GKGRIFQSP

SEQ ID NO: 326866 - protein, 9 aa, Influenza virus
KGRIFQSPI

SEQ ID NO: 326867 - protein, 9 aa, Influenza virus
GRIFQSPIR

SEQ ID NO: 326868 - protein, 9 aa, Influenza virus
RCNTKCQTS

SEQ ID NO: 326869 - protein, 9 aa, Influenza virus
CNTRCQTSV

SEQ ID NO: 326870 - protein, 9 aa, Influenza virus
NTRCQTSVG

SEQ ID NO: 326871 - protein, 9 aa, Influenza virus
TRCQTSVGG

SEQ ID NO: 326872 - protein, 9 aa, Influenza virus
RCQTSVGGI

SEQ ID NO: 326873 - protein, 9 aa, Influenza virus
CQTSVGGID

SEQ ID NO: 326874 - protein, 9 aa, Influenza virus
QTSVGGIDT

SEQ ID NO: 326875 - protein, 9 aa, Influenza virus
TSVGGIDTN

SEQ ID NO: 326876 - protein, 9 aa, Influenza virus
SVGGINTNR

SEQ ID NO: 326877 - protein, 9 aa, Influenza virus
VGGINTNRT

SEQ ID NO: 326878 - protein, 9 aa, Influenza virus
GGINTNRTF

SEQ ID NO: 326879 - protein, 9 aa, Influenza virus
GINTNRTFQ

SEQ ID NO: 326880 - protein, 9 aa, Influenza virus
INTNRTFQN

SEQ ID NO: 326881 - protein, 9 aa, Influenza virus
NTNRTFQNI

SEQ ID NO: 326882 - protein, 9 aa, Influenza virus
TNRTFQNID

SEQ ID NO: 326883 - protein, 9 aa, Influenza virus
NRTFQNIDK

SEQ ID NO: 326884 - protein, 9 aa, Influenza virus
RTFQNIDKN

SEQ ID NO: 326885 - protein, 9 aa, Influenza virus
TFQNIDKNA

SEQ ID NO: 326886 - protein, 9 aa, Influenza virus
FQNIDKNAL

SEQ ID NO: 326887 - protein, 9 aa, Influenza virus
QNIDKNALG

SEQ ID NO: 326888 - protein, 9 aa, Influenza virus
NIDKNALGD

SEQ ID NO: 326889 - protein, 9 aa, Influenza virus
IDKNALGDC

SEQ ID NO: 326890 - protein, 9 aa, Influenza virus
DKNALGDCP

SEQ ID NO: 326891 - protein, 9 aa, Influenza virus
KNALGDCPK

SEQ ID NO: 326892 - protein, 9 aa, Influenza virus
NALGNCPKY

SEQ ID NO: 326893 - protein, 9 aa, Influenza virus
ALGNCPKYI

SEQ ID NO: 326894 - protein, 9 aa, Influenza virus
LGNCPKYIK

SEQ ID NO: 326895 - protein, 9 aa, Influenza virus
GNCPKYIKS

SEQ ID NO: 326896 - protein, 9 aa, Influenza virus
NCPKYIKSG

SEQ ID NO: 326897 - protein, 9 aa, Influenza virus
CPKYIKSDQ

SEQ ID NO: 326898 - protein, 9 aa, Influenza virus
PKYIKSDQL

SEQ ID NO: 326899 - protein, 9 aa, Influenza virus
KYIKSDQLK

SEQ ID NO: 326900 - protein, 9 aa, Influenza virus
YIKSDQLKL

SEQ ID NO: 326901 - protein, 9 aa, Influenza virus
IKSDQLKLA

SEQ ID NO: 326902 - protein, 9 aa, Influenza virus
KSDQLKLAT

SEQ ID NO: 326903 - protein, 9 aa, Influenza virus
SDQLKLATG

SEQ ID NO: 326904 - protein, 9 aa, Influenza virus
DQLKLATGL

SEQ ID NO: 326905 - protein, 9 aa, Influenza virus
QLKLATGLK

SEQ ID NO: 326906 - protein, 9 aa, Influenza virus
LKLATGLKN

SEQ ID NO: 326907 - protein, 9 aa, Influenza virus
KLATGLRNI

SEQ ID NO: 326908 - protein, 9 aa, Influenza virus
LATGLRNIP

SEQ ID NO: 326909 - protein, 9 aa, Influenza virus
ATGLRNVPT

SEQ ID NO: 326910 - protein, 9 aa, Influenza virus
RAVDGTIAG

SEQ ID NO: 326911 - protein, 9 aa, Influenza virus
GFFGAIAGF

SEQ ID NO: 326912 - protein, 9 aa, Influenza virus
LLGAIAGFI

SEQ ID NO: 326913 - protein, 9 aa, Influenza virus
LGAIAGFIE

SEQ ID NO: 326914 - protein, 9 aa, Influenza virus
GTIAGFIEG

SEQ ID NO: 326915 - protein, 9 aa, Influenza virus
TIAGFIEGG

SEQ ID NO: 326916 - protein, 9 aa, Influenza virus
FQHQNEQGT

SEQ ID NO: 326917 - protein, 9 aa, Influenza virus
QHQNEQGTG

SEQ ID NO: 326918 - protein, 9 aa, Influenza virus
HQNEQGVGM

SEQ ID NO: 326919 - protein, 9 aa, Influenza virus
QNEQGVGMA

SEQ ID NO: 326920 - protein, 9 aa, Influenza virus
NEQGVGMAA

SEQ ID NO: 326921 - protein, 9 aa, Influenza virus
EQGVGMAAD

SEQ ID NO: 326922 - protein, 9 aa, Influenza virus
QGVGMAADK

SEQ ID NO: 326923 - protein, 9 aa, Influenza virus
GVGMAADKE

SEQ ID NO: 326924 - protein, 9 aa, Influenza virus
VGMAADKES

SEQ ID NO: 326925 - protein, 9 aa, Influenza virus
GMAADKEST

SEQ ID NO: 326926 - protein, 9 aa, Influenza virus
MAADKESTQ

SEQ ID NO: 326927 - protein, 9 aa, Influenza virus
AAEKESTQK

SEQ ID NO: 326928 - protein, 9 aa, Influenza virus
AEKESTQKA

SEQ ID NO: 326929 - protein, 9 aa, Influenza virus
EKESTQKAI

SEQ ID NO: 326930 - protein, 9 aa, Influenza virus
ESTQKAIDR

SEQ ID NO: 326931 - protein, 9 aa, Influenza virus
STQKAIDRI

SEQ ID NO: 326932 - protein, 9 aa, Influenza virus
TQKAIDRIT

SEQ ID NO: 326933 - protein, 9 aa, Influenza virus
QKAIDRITT

SEQ ID NO: 326934 - protein, 9 aa, Influenza virus
KAIDRITTK

SEQ ID NO: 326935 - protein, 9 aa, Influenza virus
AIDRITTKI

SEQ ID NO: 326936 - protein, 9 aa, Influenza virus
IDRITTKIN

SEQ ID NO: 326937 - protein, 9 aa, Influenza virus
DRITTKINN

SEQ ID NO: 326938 - protein, 9 aa, Influenza virus
RITTKINNI

SEQ ID NO: 326939 - protein, 9 aa, Influenza virus
TTKINNIIE

SEQ ID NO: 326940 - protein, 9 aa, Influenza virus
TKINNIIEK

SEQ ID NO: 326941 - protein, 9 aa, Influenza virus
KINNIIEKM

SEQ ID NO: 326942 - protein, 9 aa, Influenza virus
INNIIEKMN

SEQ ID NO: 326943 - protein, 9 aa, Influenza virus
NNIIEKMNG

SEQ ID NO: 326944 - protein, 9 aa, Influenza virus
NIIEKMNGN

SEQ ID NO: 326945 - protein, 9 aa, Influenza virus
IIEKMNGNY

SEQ ID NO: 326946 - protein, 9 aa, Influenza virus
IEKMNGNYD

SEQ ID NO: 326947 - protein, 9 aa, Influenza virus
EKMNGNYDS

SEQ ID NO: 326948 - protein, 9 aa, Influenza virus
YDSIRGEFS

SEQ ID NO: 326949 - protein, 9 aa, Influenza virus
DSIRGEFSQ

SEQ ID NO: 326950 - protein, 9 aa, Influenza virus
SIRGEFSQV

SEQ ID NO: 326951 - protein, 9 aa, Influenza virus
IRGEFSQVE

SEQ ID NO: 326952 - protein, 9 aa, Influenza virus
RGEFSQVEQ

SEQ ID NO: 326953 - protein, 9 aa, Influenza virus
GEFSQVEQR

SEQ ID NO: 326954 - protein, 9 aa, Influenza virus
EFSQVEQRI

SEQ ID NO: 326955 - protein, 9 aa, Influenza virus
FSQVEQRIN

SEQ ID NO: 326956 - protein, 9 aa, Influenza virus
SQVEQRINM

SEQ ID NO: 326957 - protein, 9 aa, Influenza virus
QVEKRINML

SEQ ID NO: 326958 - protein, 9 aa, Influenza virus
VEKRINMLA

SEQ ID NO: 326959 - protein, 9 aa, Influenza virus
EKRINMLAD

SEQ ID NO: 326960 - protein, 9 aa, Influenza virus
KRINMLADR

SEQ ID NO: 326961 - protein, 9 aa, Influenza virus
RIDDAVTDI

SEQ ID NO: 326962 - protein, 9 aa, Influenza virus
IDDAVTDIW

SEQ ID NO: 326963 - protein, 9 aa, Influenza virus
DDAVTDIWS

SEQ ID NO: 326964 - protein, 9 aa, Influenza virus
DAVTDIWSY

SEQ ID NO: 326965 - protein, 9 aa, Influenza virus
AVTDIWSYN

SEQ ID NO: 326966 - protein, 9 aa, Influenza virus
VTDIWSYNA

SEQ ID NO: 326967 - protein, 9 aa, Influenza virus
TDIWSYNAK

SEQ ID NO: 326968 - protein, 9 aa, Influenza virus
DIWSYNAKL

SEQ ID NO: 326969 - protein, 9 aa, Influenza virus
IWSYNAKLL

SEQ ID NO: 326970 - protein, 9 aa, Influenza virus
WSYNARLLV

SEQ ID NO: 326971 - protein, 9 aa, Influenza virus
SYNARLLVL

SEQ ID NO: 326972 - protein, 9 aa, Influenza virus
YNARLLVLL

SEQ ID NO: 326973 - protein, 9 aa, Influenza virus
NARLLVLLE

SEQ ID NO: 326974 - protein, 9 aa, Influenza virus
ARLLVLLEN

SEQ ID NO: 326975 - protein, 9 aa, Influenza virus
RLLVLLEND

SEQ ID NO: 326976 - protein, 9 aa, Influenza virus
LLENDKTLN

SEQ ID NO: 326977 - protein, 9 aa, Influenza virus
LENDKTLNM

SEQ ID NO: 326978 - protein, 9 aa, Influenza virus
ENDKTLDLH

SEQ ID NO: 326979 - protein, 9 aa, Influenza virus
NDKTLNMHD

SEQ ID NO: 326980 - protein, 9 aa, Influenza virus
DKTLNMHDA

SEQ ID NO: 326981 - protein, 9 aa, Influenza virus
KTLNMHDAN

SEQ ID NO: 326982 - protein, 9 aa, Influenza virus
TLDLHDANV

SEQ ID NO: 326983 - protein, 9 aa, Influenza virus
LDMHDANVK

SEQ ID NO: 326984 - protein, 9 aa, Influenza virus
DMHDANVKN

SEQ ID NO: 326985 - protein, 9 aa, Influenza virus
MHDANVKNL

SEQ ID NO: 326986 - protein, 9 aa, Influenza virus
HDANVKNLH

SEQ ID NO: 326987 - protein, 9 aa, Influenza virus
DANVRNLHE

SEQ ID NO: 326988 - protein, 9 aa, Influenza virus
ANVRNLHEQ

SEQ ID NO: 326989 - protein, 9 aa, Influenza virus
NVRNLHEQV

SEQ ID NO: 326990 - protein, 9 aa, Influenza virus
VRNLHEQVR

SEQ ID NO: 326991 - protein, 9 aa, Influenza virus
NAVDEGNGC

SEQ ID NO: 326992 - protein, 9 aa, Influenza virus
AVDEGNGCF

SEQ ID NO: 326993 - protein, 9 aa, Influenza virus
VDEGNGCFE

SEQ ID NO: 326994 - protein, 9 aa, Influenza virus
NEGNGCFEL

SEQ ID NO: 326995 - protein, 9 aa, Influenza virus
FELLHKCNN

SEQ ID NO: 326996 - protein, 9 aa, Influenza virus
ELLHKCNNS

SEQ ID NO: 326997 - protein, 9 aa, Influenza virus
LLHKCNNSC

SEQ ID NO: 326998 - protein, 9 aa, Influenza virus
LHKCNNSCM

SEQ ID NO: 326999 - protein, 9 aa, Influenza virus
HKCNNSCME

SEQ ID NO: 327000 - protein, 9 aa, Influenza virus
KCNNSCMET

SEQ ID NO: 327001 - protein, 9 aa, Influenza virus
CNNSCMETI

SEQ ID NO: 327002 - protein, 9 aa, Influenza virus
NNSCMETIR

SEQ ID NO: 327003 - protein, 9 aa, Influenza virus
NSCMETIRN

SEQ ID NO: 327004 - protein, 9 aa, Influenza virus
SCMDTIRNG

SEQ ID NO: 327005 - protein, 9 aa, Influenza virus
CMDTIRNGT

SEQ ID NO: 327006 - protein, 9 aa, Influenza virus
MDTIRNGTY

SEQ ID NO: 327007 - protein, 9 aa, Influenza virus
ETIRNGTYD

SEQ ID NO: 327008 - protein, 9 aa, Influenza virus
TIRNGTYDH

SEQ ID NO: 327009 - protein, 9 aa, Influenza virus
IRNGTYDHT

SEQ ID NO: 327010 - protein, 9 aa, Influenza virus
EYEEESKLK

SEQ ID NO: 327011 - protein, 9 aa, Influenza virus
YEEESKLKR

SEQ ID NO: 327012 - protein, 9 aa, Influenza virus
EEESKLKRQ

SEQ ID NO: 327013 - protein, 9 aa, Influenza virus
SKLKRQEIN

SEQ ID NO: 327014 - protein, 9 aa, Influenza virus
KLKRQEING

SEQ ID NO: 327015 - protein, 9 aa, Influenza virus
LKRQEINGI

SEQ ID NO: 327016 - protein, 9 aa, Influenza virus
KRQEINGIK

SEQ ID NO: 327017 - protein, 9 aa, Influenza virus
RQEINGIKL

SEQ ID NO: 327018 - protein, 9 aa, Influenza virus
QEINGIKLK

SEQ ID NO: 327019 - protein, 9 aa, Influenza virus
EINGIKLKS

SEQ ID NO: 327020 - protein, 9 aa, Influenza virus
SDDSVYKAL

SEQ ID NO: 327021 - protein, 9 aa, Influenza virus
DDSVYKALS

SEQ ID NO: 327022 - protein, 9 aa, Influenza virus
DSVYKALSI

SEQ ID NO: 327023 - protein, 9 aa, Influenza virus
SVYKALSIY

SEQ ID NO: 327024 - protein, 9 aa, Influenza virus
VYRALSIYS

SEQ ID NO: 327025 - protein, 9 aa, Influenza virus
YRALSIYSC

SEQ ID NO: 327026 - protein, 9 aa, Influenza virus
RALSIYSCI

SEQ ID NO: 327027 - protein, 9 aa, Influenza virus
IYSCIASSI

SEQ ID NO: 327028 - protein, 9 aa, Influenza virus
YSCIASSIV

SEQ ID NO: 327029 - protein, 9 aa, Influenza virus
SCIASSIVL

SEQ ID NO: 327030 - protein, 9 aa, Influenza virus
CIASSIVLV

SEQ ID NO: 327031 - protein, 9 aa, Influenza virus
IASSIVLVG

SEQ ID NO: 327032 - protein, 9 aa, Influenza virus
ASSIVLVGL

SEQ ID NO: 327033 - protein, 9 aa, Influenza virus
SSIVLVGLI

SEQ ID NO: 327034 - protein, 9 aa, Influenza virus
SIVLVGLIL

SEQ ID NO: 327035 - protein, 9 aa, Influenza virus
VLVGLILSF

SEQ ID NO: 327036 - protein, 9 aa, Influenza virus
LVGLILSFI

SEQ ID NO: 327037 - protein, 9 aa, Influenza virus
VGLILSFIM

SEQ ID NO: 327038 - protein, 9 aa, Influenza virus
GLILSFIMW

SEQ ID NO: 327039 - protein, 9 aa, Influenza virus
LILSFIMWA

SEQ ID NO: 327040 - protein, 9 aa, Influenza virus
ILSFIMWAC

SEQ ID NO: 327041 - protein, 9 aa, Influenza virus
FIMWACSNG

SEQ ID NO: 327042 - protein, 9 aa, Influenza virus
IMWACSNGS

SEQ ID NO: 327043 - protein, 9 aa, Influenza virus
MWACSNGSC

SEQ ID NO: 327044 - protein, 9 aa, Influenza virus
WACSNGSCR

SEQ ID NO: 327045 - protein, 9 aa, Influenza virus
ACSNGSCRF

SEQ ID NO: 327046 - protein, 9 aa, Influenza virus
CNSGNCRFN

SEQ ID NO: 327047 - protein, 9 aa, Influenza virus
GSEHTAYSQ

SEQ ID NO: 327048 - protein, 9 aa, Influenza virus
SEHTAYSQI

SEQ ID NO: 327049 - protein, 9 aa, Influenza virus
EHTAYSQIT

SEQ ID NO: 327050 - protein, 9 aa, Influenza virus
SRLNWLTKE

SEQ ID NO: 327051 - protein, 9 aa, Influenza virus
RLNWLTKET

SEQ ID NO: 327052 - protein, 9 aa, Influenza virus
LNWLTKETN

SEQ ID NO: 327053 - protein, 9 aa, Influenza virus
NWLTKETNG

SEQ ID NO: 327054 - protein, 9 aa, Influenza virus
WLTKETNGN

SEQ ID NO: 327055 - protein, 9 aa, Influenza virus
LTKETNGNY

SEQ ID NO: 327056 - protein, 9 aa, Influenza virus
TKETNGNYG

SEQ ID NO: 327057 - protein, 9 aa, Influenza virus
KETNGNYGP

SEQ ID NO: 327058 - protein, 9 aa, Influenza virus
ETNGNYGPI

SEQ ID NO: 327059 - protein, 9 aa, Influenza virus
LVLGLSMVR

SEQ ID NO: 327060 - protein, 9 aa, Influenza virus
VLGLSMVRS

SEQ ID NO: 327061 - protein, 9 aa, Influenza virus
LGLSMVRSD

SEQ ID NO: 327062 - protein, 9 aa, Influenza virus
GLSMVRSDK

SEQ ID NO: 327063 - protein, 9 aa, Influenza virus
LSMVRSDKI

SEQ ID NO: 327064 - protein, 9 aa, Influenza virus
SMVRSDKIC

SEQ ID NO: 327065 - protein, 9 aa, Influenza virus
MVRSDKICL

SEQ ID NO: 327066 - protein, 9 aa, Influenza virus
VRSDKICLG

SEQ ID NO: 327067 - protein, 9 aa, Influenza virus
RSDKICLGH

SEQ ID NO: 327068 - protein, 9 aa, Influenza virus
ICLGHHAVP

SEQ ID NO: 327069 - protein, 9 aa, Influenza virus
CLGHHAVPN

SEQ ID NO: 327070 - protein, 9 aa, Influenza virus
LGHHAVPNG

SEQ ID NO: 327071 - protein, 9 aa, Influenza virus
GHHAVPNGT

SEQ ID NO: 327072 - protein, 9 aa, Influenza virus
HHAVPNGTK

SEQ ID NO: 327073 - protein, 9 aa, Influenza virus
HAVPNGTKV

SEQ ID NO: 327074 - protein, 9 aa, Influenza virus
AVPNGTKVN

SEQ ID NO: 327075 - protein, 9 aa, Influenza virus
VPNGTKVNT

SEQ ID NO: 327076 - protein, 9 aa, Influenza virus
PNGTKVNTL

SEQ ID NO: 327077 - protein, 9 aa, Influenza virus
TKVNTLTEK

SEQ ID NO: 327078 - protein, 9 aa, Influenza virus
KVNTLTEKG

SEQ ID NO: 327079 - protein, 9 aa, Influenza virus
VNTLTEKGV

SEQ ID NO: 327080 - protein, 9 aa, Influenza virus
NTLTEKGVE

SEQ ID NO: 327081 - protein, 9 aa, Influenza virus
TLTEKGVEV

SEQ ID NO: 327082 - protein, 9 aa, Influenza virus
LTEKGVEVV

SEQ ID NO: 327083 - protein, 9 aa, Influenza virus
TEKGVEVVN

SEQ ID NO: 327084 - protein, 9 aa, Influenza virus
EKGVEVVNA

SEQ ID NO: 327085 - protein, 9 aa, Influenza virus
KGVEVVNAT

SEQ ID NO: 327086 - protein, 9 aa, Influenza virus
ETVEITGIN

SEQ ID NO: 327087 - protein, 9 aa, Influenza virus
TVEITGINK

SEQ ID NO: 327088 - protein, 9 aa, Influenza virus
VEITGINKV

SEQ ID NO: 327089 - protein, 9 aa, Influenza virus
EITGINKVC

SEQ ID NO: 327090 - protein, 9 aa, Influenza virus
ITGINKVCT

SEQ ID NO: 327091 - protein, 9 aa, Influenza virus
TGINKVCTK

SEQ ID NO: 327092 - protein, 9 aa, Influenza virus
GINKVCTKG

SEQ ID NO: 327093 - protein, 9 aa, Influenza virus
INKVCTKGK

SEQ ID NO: 327094 - protein, 9 aa, Influenza virus
NKVCTKGKK

SEQ ID NO: 327095 - protein, 9 aa, Influenza virus
IIGPPQCDS

SEQ ID NO: 327096 - protein, 9 aa, Influenza virus
IGPPQCDSH

SEQ ID NO: 327097 - protein, 9 aa, Influenza virus
GPPQCDSHL

SEQ ID NO: 327098 - protein, 9 aa, Influenza virus
PPQCDSHLK

SEQ ID NO: 327099 - protein, 9 aa, Influenza virus
PQCDSHLKF

SEQ ID NO: 327100 - protein, 9 aa, Influenza virus
QCDSHLKFK

SEQ ID NO: 327101 - protein, 9 aa, Influenza virus
CDSHLKFKA

SEQ ID NO: 327102 - protein, 9 aa, Influenza virus
DSHLKFKAD

SEQ ID NO: 327103 - protein, 9 aa, Influenza virus
SHLKFKADL

SEQ ID NO: 327104 - protein, 9 aa, Influenza virus
HLKFKADLI

SEQ ID NO: 327105 - protein, 9 aa, Influenza virus
LKFKADLII

SEQ ID NO: 327106 - protein, 9 aa, Influenza virus
KFKADLIIE

SEQ ID NO: 327107 - protein, 9 aa, Influenza virus
SSDICYPGK

SEQ ID NO: 327108 - protein, 9 aa, Influenza virus
SDICYPGKF

SEQ ID NO: 327109 - protein, 9 aa, Influenza virus
DICYPGKFT

SEQ ID NO: 327110 - protein, 9 aa, Influenza virus
ICYPGKFTN

SEQ ID NO: 327111 - protein, 9 aa, Influenza virus
CYPGKFTNE

SEQ ID NO: 327112 - protein, 9 aa, Influenza virus
YPGKFTNEE

SEQ ID NO: 327113 - protein, 9 aa, Influenza virus
PGKFTNEEA

SEQ ID NO: 327114 - protein, 9 aa, Influenza virus
GKFTNEEAL

SEQ ID NO: 327115 - protein, 9 aa, Influenza virus
KFTNEEALR

SEQ ID NO: 327116 - protein, 9 aa, Influenza virus
ESGGIDKEP

SEQ ID NO: 327117 - protein, 9 aa, Influenza virus
SGGIDKEPM

SEQ ID NO: 327118 - protein, 9 aa, Influenza virus
GGIDKEPMG

SEQ ID NO: 327119 - protein, 9 aa, Influenza virus
GIDKEPMGF

SEQ ID NO: 327120 - protein, 9 aa, Influenza virus
IDKEPMGFR

SEQ ID NO: 327121 - protein, 9 aa, Influenza virus
DKEPMGFRY

SEQ ID NO: 327122 - protein, 9 aa, Influenza virus
KEPMGFRYS

SEQ ID NO: 327123 - protein, 9 aa, Influenza virus
EPMGFRYSG

SEQ ID NO: 327124 - protein, 9 aa, Influenza virus
PMGFRYSGI

SEQ ID NO: 327125 - protein, 9 aa, Influenza virus
MGFRYSGIK

SEQ ID NO: 327126 - protein, 9 aa, Influenza virus
GFRYSGIKT

SEQ ID NO: 327127 - protein, 9 aa, Influenza virus
FRYSGIKTD

SEQ ID NO: 327128 - protein, 9 aa, Influenza virus
RYSGIKTDG

SEQ ID NO: 327129 - protein, 9 aa, Influenza virus
YSGIKTDGA

SEQ ID NO: 327130 - protein, 9 aa, Influenza virus
SGIKTDGAT

SEQ ID NO: 327131 - protein, 9 aa, Influenza virus
GIKTDGATS

SEQ ID NO: 327132 - protein, 9 aa, Influenza virus
IKTDGATSA

SEQ ID NO: 327133 - protein, 9 aa, Influenza virus
KTDGATSAC

SEQ ID NO: 327134 - protein, 9 aa, Influenza virus
FYSEMKWLL

SEQ ID NO: 327135 - protein, 9 aa, Influenza virus
YSEMKWLLS

SEQ ID NO: 327136 - protein, 9 aa, Influenza virus
SEMKWLLSS

SEQ ID NO: 327137 - protein, 9 aa, Influenza virus
EMKWLLSSK

SEQ ID NO: 327138 - protein, 9 aa, Influenza virus
MKWLLSSKA

SEQ ID NO: 327139 - protein, 9 aa, Influenza virus
KWLLSSKAN

SEQ ID NO: 327140 - protein, 9 aa, Influenza virus
WLLSSKANQ

SEQ ID NO: 327141 - protein, 9 aa, Influenza virus
LLSSKANQV

SEQ ID NO: 327142 - protein, 9 aa, Influenza virus
LSSKANQVF

SEQ ID NO: 327143 - protein, 9 aa, Influenza virus
SSKANQVFP

SEQ ID NO: 327144 - protein, 9 aa, Influenza virus
SKANQVFPQ

SEQ ID NO: 327145 - protein, 9 aa, Influenza virus
KANQVFPQL

SEQ ID NO: 327146 - protein, 9 aa, Influenza virus
ANQVFPQLN

SEQ ID NO: 327147 - protein, 9 aa, Influenza virus
QLNQTYRNN

SEQ ID NO: 327148 - protein, 9 aa, Influenza virus
LNQTYRNNR

SEQ ID NO: 327149 - protein, 9 aa, Influenza virus
NQTYRNNRK

SEQ ID NO: 327150 - protein, 9 aa, Influenza virus
QTYRNNRKE

SEQ ID NO: 327151 - protein, 9 aa, Influenza virus
TYRNNRKEP

SEQ ID NO: 327152 - protein, 9 aa, Influenza virus
YRNNRKEPA

SEQ ID NO: 327153 - protein, 9 aa, Influenza virus
RNNRKEPAL

SEQ ID NO: 327154 - protein, 9 aa, Influenza virus
NNRKEPALI

SEQ ID NO: 327155 - protein, 9 aa, Influenza virus
NRKEPALIV

SEQ ID NO: 327156 - protein, 9 aa, Influenza virus
DEQNKLYGA

SEQ ID NO: 327157 - protein, 9 aa, Influenza virus
EQNKLYGAG

SEQ ID NO: 327158 - protein, 9 aa, Influenza virus
QNKLYGAGN

SEQ ID NO: 327159 - protein, 9 aa, Influenza virus
NKLYGAGNK

SEQ ID NO: 327160 - protein, 9 aa, Influenza virus
KLYGAGNKL

SEQ ID NO: 327161 - protein, 9 aa, Influenza virus
LYGAGNKLI

SEQ ID NO: 327162 - protein, 9 aa, Influenza virus
YGAGNKLIT

SEQ ID NO: 327163 - protein, 9 aa, Influenza virus
GAGNKLITV

SEQ ID NO: 327164 - protein, 9 aa, Influenza virus
AGNKLITVG

SEQ ID NO: 327165 - protein, 9 aa, Influenza virus
ITVGSSKYR

SEQ ID NO: 327166 - protein, 9 aa, Influenza virus
TVGSSKYRQ

SEQ ID NO: 327167 - protein, 9 aa, Influenza virus
VGSSKYRQS

SEQ ID NO: 327168 - protein, 9 aa, Influenza virus
GSSKYRQSF

SEQ ID NO: 327169 - protein, 9 aa, Influenza virus
SSKYRQSFS

SEQ ID NO: 327170 - protein, 9 aa, Influenza virus
SKYRQSFSP

SEQ ID NO: 327171 - protein, 9 aa, Influenza virus
KYRQSFSPS

SEQ ID NO: 327172 - protein, 9 aa, Influenza virus
YRQSFSPSP

SEQ ID NO: 327173 - protein, 9 aa, Influenza virus
RQSFSPSPG

SEQ ID NO: 327174 - protein, 9 aa, Influenza virus
QSFSPSPGD

SEQ ID NO: 327175 - protein, 9 aa, Influenza virus
SFSPSPGDR

SEQ ID NO: 327176 - protein, 9 aa, Influenza virus
FSPSPGDRP

SEQ ID NO: 327177 - protein, 9 aa, Influenza virus
SPSPGDRPK

SEQ ID NO: 327178 - protein, 9 aa, Influenza virus
PSPGDRPKV

SEQ ID NO: 327179 - protein, 9 aa, Influenza virus
SPGDRPKVN

SEQ ID NO: 327180 - protein, 9 aa, Influenza virus
PGDRPKVNG

SEQ ID NO: 327181 - protein, 9 aa, Influenza virus
GDRPKVNGQ

SEQ ID NO: 327182 - protein, 9 aa, Influenza virus
DRPKVNGQA

SEQ ID NO: 327183 - protein, 9 aa, Influenza virus
LRSNAPSGV

SEQ ID NO: 327184 - protein, 9 aa, Influenza virus
RSNAPSGVE

SEQ ID NO: 327185 - protein, 9 aa, Influenza virus
SNAPSGVEY

SEQ ID NO: 327186 - protein, 9 aa, Influenza virus
NAPSGVEYN

SEQ ID NO: 327187 - protein, 9 aa, Influenza virus
APSGVEYNG

SEQ ID NO: 327188 - protein, 9 aa, Influenza virus
PSGVEYNGK

SEQ ID NO: 327189 - protein, 9 aa, Influenza virus
SGVEYNGKS

SEQ ID NO: 327190 - protein, 9 aa, Influenza virus
GVEYNGKSL

SEQ ID NO: 327191 - protein, 9 aa, Influenza virus
VEYNGKSLG

SEQ ID NO: 327192 - protein, 9 aa, Influenza virus
LPFQNIDSW

SEQ ID NO: 327193 - protein, 9 aa, Influenza virus
PFQNIDSWA

SEQ ID NO: 327194 - protein, 9 aa, Influenza virus
FQNIDSWAV

SEQ ID NO: 327195 - protein, 9 aa, Influenza virus
QNIDSWAVG

SEQ ID NO: 327196 - protein, 9 aa, Influenza virus
NIDSWAVGR

SEQ ID NO: 327197 - protein, 9 aa, Influenza virus
IDSWAVGRC

SEQ ID NO: 327198 - protein, 9 aa, Influenza virus
DSWAVGRCP

SEQ ID NO: 327199 - protein, 9 aa, Influenza virus
SWAVGRCPR

SEQ ID NO: 327200 - protein, 9 aa, Influenza virus
WAVGRCPRY

SEQ ID NO: 327201 - protein, 9 aa, Influenza virus
AVGRCPRYV

SEQ ID NO: 327202 - protein, 9 aa, Influenza virus
VGRCPRYVK

SEQ ID NO: 327203 - protein, 9 aa, Influenza virus
GRCPRYVKQ

SEQ ID NO: 327204 - protein, 9 aa, Influenza virus
RCPRYVKQS

SEQ ID NO: 327205 - protein, 9 aa, Influenza virus
MKNVPEKIH

SEQ ID NO: 327206 - protein, 9 aa, Influenza virus
KNVPEKIHT

SEQ ID NO: 327207 - protein, 9 aa, Influenza virus
NVPEKIHTR

SEQ ID NO: 327208 - protein, 9 aa, Influenza virus
VPEKIHTRG

SEQ ID NO: 327209 - protein, 9 aa, Influenza virus
PEKIHTRGL

SEQ ID NO: 327210 - protein, 9 aa, Influenza virus
EKIHTRGLF

SEQ ID NO: 327211 - protein, 9 aa, Influenza virus
KIHTRGLFG

SEQ ID NO: 327212 - protein, 9 aa, Influenza virus
IHTRGLFGA

SEQ ID NO: 327213 - protein, 9 aa, Influenza virus
HTRGLFGAI

SEQ ID NO: 327214 - protein, 9 aa, Influenza virus
VKRRPVAKA

SEQ ID NO: 327215 - protein, 9 aa, Influenza virus
KRRPVAKAG

SEQ ID NO: 327216 - protein, 9 aa, Influenza virus
RRPVAKAGF

SEQ ID NO: 327217 - protein, 9 aa, Influenza virus
RPVAKAGFI

SEQ ID NO: 327218 - protein, 9 aa, Influenza virus
PVAKAGFIE

SEQ ID NO: 327219 - protein, 9 aa, Influenza virus
VAKAGFIEN

SEQ ID NO: 327220 - protein, 9 aa, Influenza virus
AKAGFIENG

SEQ ID NO: 327221 - protein, 9 aa, Influenza virus
KAGFIENGW

SEQ ID NO: 327222 - protein, 9 aa, Influenza virus
NRLIEKTNT

SEQ ID NO: 327223 - protein, 9 aa, Influenza virus
RLIEKTNTQ

SEQ ID NO: 327224 - protein, 9 aa, Influenza virus
LIEKTNTQF

SEQ ID NO: 327225 - protein, 9 aa, Influenza virus
IEKTNTQFE

SEQ ID NO: 327226 - protein, 9 aa, Influenza virus
EKTNTQFEL

SEQ ID NO: 327227 - protein, 9 aa, Influenza virus
KTNTQFELI

SEQ ID NO: 327228 - protein, 9 aa, Influenza virus
TNTQFELID

SEQ ID NO: 327229 - protein, 9 aa, Influenza virus
NTQFELIDN

SEQ ID NO: 327230 - protein, 9 aa, Influenza virus
TQFELIDNE

SEQ ID NO: 327231 - protein, 9 aa, Influenza virus
MINPVKLSG

SEQ ID NO: 327232 - protein, 9 aa, Influenza virus
INPVKLSGG

SEQ ID NO: 327233 - protein, 9 aa, Influenza virus
NPVKLSGGY

SEQ ID NO: 327234 - protein, 9 aa, Influenza virus
PVKLSGGYK

SEQ ID NO: 327235 - protein, 9 aa, Influenza virus
VKLSGGYKD

SEQ ID NO: 327236 - protein, 9 aa, Influenza virus
KLSGGYKDV

SEQ ID NO: 327237 - protein, 9 aa, Influenza virus
LSGGYKDVI

SEQ ID NO: 327238 - protein, 9 aa, Influenza virus
SGGYKDVIL

SEQ ID NO: 327239 - protein, 9 aa, Influenza virus
GGYKDVILW

SEQ ID NO: 327240 - protein, 9 aa, Influenza virus
VKYSRADKI

SEQ ID NO: 327241 - protein, 9 aa, Influenza virus
KYSRADKIC

SEQ ID NO: 327242 - protein, 9 aa, Influenza virus
YSRADKICI

SEQ ID NO: 327243 - protein, 9 aa, Influenza virus
SRADKICIG

SEQ ID NO: 327244 - protein, 9 aa, Influenza virus
RADKICIGY

SEQ ID NO: 327245 - protein, 9 aa, Influenza virus
CIGYLSNNA

SEQ ID NO: 327246 - protein, 9 aa, Influenza virus
IGYLSNNST

SEQ ID NO: 327247 - protein, 9 aa, Influenza virus
GYLSNNSTD

SEQ ID NO: 327248 - protein, 9 aa, Influenza virus
YLSNNSTDK

SEQ ID NO: 327249 - protein, 9 aa, Influenza virus
LSNNSTDKV

SEQ ID NO: 327250 - protein, 9 aa, Influenza virus
SNNSTDKVD

SEQ ID NO: 327251 - protein, 9 aa, Influenza virus
NNSTDKVDT

SEQ ID NO: 327252 - protein, 9 aa, Influenza virus
NSTDKVDTL

SEQ ID NO: 327253 - protein, 9 aa, Influenza virus
STDKVDTLT

SEQ ID NO: 327254 - protein, 9 aa, Influenza virus
TDTVDTLTE

SEQ ID NO: 327255 - protein, 9 aa, Influenza virus
DKVDTLTEN

SEQ ID NO: 327256 - protein, 9 aa, Influenza virus
KVDTLTENG

SEQ ID NO: 327257 - protein, 9 aa, Influenza virus
IDTLTETGV

SEQ ID NO: 327258 - protein, 9 aa, Influenza virus
DTLTETGVP

SEQ ID NO: 327259 - protein, 9 aa, Influenza virus
TLTETGVPV

SEQ ID NO: 327260 - protein, 9 aa, Influenza virus
LTETGVPVT

SEQ ID NO: 327261 - protein, 9 aa, Influenza virus
TETGVPVTS

SEQ ID NO: 327262 - protein, 9 aa, Influenza virus
ETGVPVTSS

SEQ ID NO: 327263 - protein, 9 aa, Influenza virus
NGVPVTSSV

SEQ ID NO: 327264 - protein, 9 aa, Influenza virus
GVPVTSSID

SEQ ID NO: 327265 - protein, 9 aa, Influenza virus
VPVTSSIDL

SEQ ID NO: 327266 - protein, 9 aa, Influenza virus
PVTSSIDLV

SEQ ID NO: 327267 - protein, 9 aa, Influenza virus
VTSSIDLVE

SEQ ID NO: 327268 - protein, 9 aa, Influenza virus
TSSIDLVET

SEQ ID NO: 327269 - protein, 9 aa, Influenza virus
SSIDLVETN

SEQ ID NO: 327270 - protein, 9 aa, Influenza virus
SIDLVETNH

SEQ ID NO: 327271 - protein, 9 aa, Influenza virus
IDLVETNHT

SEQ ID NO: 327272 - protein, 9 aa, Influenza virus
GTYCSLNGI

SEQ ID NO: 327273 - protein, 9 aa, Influenza virus
TYCSLNGIS

SEQ ID NO: 327274 - protein, 9 aa, Influenza virus
YCSLNGISP

SEQ ID NO: 327275 - protein, 9 aa, Influenza virus
CSLNGISPI

SEQ ID NO: 327276 - protein, 9 aa, Influenza virus
SLNGISPIH

SEQ ID NO: 327277 - protein, 9 aa, Influenza virus
LNGISPIHL

SEQ ID NO: 327278 - protein, 9 aa, Influenza virus
NGISPIHLG

SEQ ID NO: 327279 - protein, 9 aa, Influenza virus
GISPIHLGD

SEQ ID NO: 327280 - protein, 9 aa, Influenza virus
ISPIHLGDC

SEQ ID NO: 327281 - protein, 9 aa, Influenza virus
SPVHLGDCS

SEQ ID NO: 327282 - protein, 9 aa, Influenza virus
PVHLGDCSF

SEQ ID NO: 327283 - protein, 9 aa, Influenza virus
VHLGDCSFE

SEQ ID NO: 327284 - protein, 9 aa, Influenza virus
IVGNPSCAS

SEQ ID NO: 327285 - protein, 9 aa, Influenza virus
VGNPSCASN

SEQ ID NO: 327286 - protein, 9 aa, Influenza virus
GNPSCASNI

SEQ ID NO: 327287 - protein, 9 aa, Influenza virus
NPSCASNIN

SEQ ID NO: 327288 - protein, 9 aa, Influenza virus
PSCASNINI

SEQ ID NO: 327289 - protein, 9 aa, Influenza virus
SCASNINIR

SEQ ID NO: 327290 - protein, 9 aa, Influenza virus
CASNINIRE

SEQ ID NO: 327291 - protein, 9 aa, Influenza virus
ASNINIREW

SEQ ID NO: 327292 - protein, 9 aa, Influenza virus
SNINIREWS

SEQ ID NO: 327293 - protein, 9 aa, Influenza virus
LIEDPNAPH

SEQ ID NO: 327294 - protein, 9 aa, Influenza virus
IEDPNAPHK

SEQ ID NO: 327295 - protein, 9 aa, Influenza virus
EDPNAPHKL

SEQ ID NO: 327296 - protein, 9 aa, Influenza virus
DPNAPHKLC

SEQ ID NO: 327297 - protein, 9 aa, Influenza virus
PNAPHKLCF

SEQ ID NO: 327298 - protein, 9 aa, Influenza virus
NAPHKLCFP

SEQ ID NO: 327299 - protein, 9 aa, Influenza virus
APNKLCFPG

SEQ ID NO: 327300 - protein, 9 aa, Influenza virus
PHKLCFPGE

SEQ ID NO: 327301 - protein, 9 aa, Influenza virus
KLCYPGELD

SEQ ID NO: 327302 - protein, 9 aa, Influenza virus
LCYPGELDN

SEQ ID NO: 327303 - protein, 9 aa, Influenza virus
CYPGELDNN

SEQ ID NO: 327304 - protein, 9 aa, Influenza virus
YPGELDNNG

SEQ ID NO: 327305 - protein, 9 aa, Influenza virus
PGEVDNNGE

SEQ ID NO: 327306 - protein, 9 aa, Influenza virus
GEVDNNGEL

SEQ ID NO: 327307 - protein, 9 aa, Influenza virus
EVDNNGELR

SEQ ID NO: 327308 - protein, 9 aa, Influenza virus
VDNNGELRH

SEQ ID NO: 327309 - protein, 9 aa, Influenza virus
SFSRTELIN

SEQ ID NO: 327310 - protein, 9 aa, Influenza virus
FSRTELINP

SEQ ID NO: 327311 - protein, 9 aa, Influenza virus
SRTELIPPS

SEQ ID NO: 327312 - protein, 9 aa, Influenza virus
RTELINPSK

SEQ ID NO: 327313 - protein, 9 aa, Influenza virus
TELINPSKW

SEQ ID NO: 327314 - protein, 9 aa, Influenza virus
ELIPPSKWG

SEQ ID NO: 327315 - protein, 9 aa, Influenza virus
PSKWGDILE

SEQ ID NO: 327316 - protein, 9 aa, Influenza virus
SKWGDILEG

SEQ ID NO: 327317 - protein, 9 aa, Influenza virus
KWGDILEGT

SEQ ID NO: 327318 - protein, 9 aa, Influenza virus
WGDILEGTT

SEQ ID NO: 327319 - protein, 9 aa, Influenza virus
GDILEGTTA

SEQ ID NO: 327320 - protein, 9 aa, Influenza virus
DILEGTTAS

SEQ ID NO: 327321 - protein, 9 aa, Influenza virus
ILEGTTASC

SEQ ID NO: 327322 - protein, 9 aa, Influenza virus
LEGTTASCQ

SEQ ID NO: 327323 - protein, 9 aa, Influenza virus
EGTTASCQN

SEQ ID NO: 327324 - protein, 9 aa, Influenza virus
GTTASCQNR

SEQ ID NO: 327325 - protein, 9 aa, Influenza virus
TTASCQNRG

SEQ ID NO: 327326 - protein, 9 aa, Influenza virus
TASCQNRGA

SEQ ID NO: 327327 - protein, 9 aa, Influenza virus
GANSFYRNL

SEQ ID NO: 327328 - protein, 9 aa, Influenza virus
SSFYRNLIW

SEQ ID NO: 327329 - protein, 9 aa, Influenza virus
SFYRNLIWL

SEQ ID NO: 327330 - protein, 9 aa, Influenza virus
FYRNLIWLV

SEQ ID NO: 327331 - protein, 9 aa, Influenza virus
YRNLIWLVN

SEQ ID NO: 327332 - protein, 9 aa, Influenza virus
NGKYPVIKG

SEQ ID NO: 327333 - protein, 9 aa, Influenza virus
VKGDYNNTT

SEQ ID NO: 327334 - protein, 9 aa, Influenza virus
KGEYNNTTG

SEQ ID NO: 327335 - protein, 9 aa, Influenza virus
GEYNNTTGR

SEQ ID NO: 327336 - protein, 9 aa, Influenza virus
EYNNTTGRD

SEQ ID NO: 327337 - protein, 9 aa, Influenza virus
LWGIHHPDS

SEQ ID NO: 327338 - protein, 9 aa, Influenza virus
WGIHHPDSE

SEQ ID NO: 327339 - protein, 9 aa, Influenza virus
GIHHPDTET

SEQ ID NO: 327340 - protein, 9 aa, Influenza virus
IHHPDSETT

SEQ ID NO: 327341 - protein, 9 aa, Influenza virus
HHPDSETTA

SEQ ID NO: 327342 - protein, 9 aa, Influenza virus
ATKLYVNKN

SEQ ID NO: 327343 - protein, 9 aa, Influenza virus
TKLYVNKNP

SEQ ID NO: 327344 - protein, 9 aa, Influenza virus
NLYVNKNPY

SEQ ID NO: 327345 - protein, 9 aa, Influenza virus
LYASKNPYT

SEQ ID NO: 327346 - protein, 9 aa, Influenza virus
YASKNPYTL

SEQ ID NO: 327347 - protein, 9 aa, Influenza virus
ASKNPYTLV

SEQ ID NO: 327348 - protein, 9 aa, Influenza virus
SKNPYTLVS

SEQ ID NO: 327349 - protein, 9 aa, Influenza virus
LVSTKEWSR

SEQ ID NO: 327350 - protein, 9 aa, Influenza virus
VSTKEWSRR

SEQ ID NO: 327351 - protein, 9 aa, Influenza virus
STKEWSRRY

SEQ ID NO: 327352 - protein, 9 aa, Influenza virus
TKEWSRRYE

SEQ ID NO: 327353 - protein, 9 aa, Influenza virus
KEWSRRYEL

SEQ ID NO: 327354 - protein, 9 aa, Influenza virus
EWSRRYELE

SEQ ID NO: 327355 - protein, 9 aa, Influenza virus
WSRRYELEI

SEQ ID NO: 327356 - protein, 9 aa, Influenza virus
SRRYELEIG

SEQ ID NO: 327357 - protein, 9 aa, Influenza virus
RRYELEIGT

SEQ ID NO: 327358 - protein, 9 aa, Influenza virus
RYELEIGAR

SEQ ID NO: 327359 - protein, 9 aa, Influenza virus
YELEIGARI

SEQ ID NO: 327360 - protein, 9 aa, Influenza virus
ELEIGARIG

SEQ ID NO: 327361 - protein, 9 aa, Influenza virus
LEIGARIGE

SEQ ID NO: 327362 - protein, 9 aa, Influenza virus
EIGARIGEG

SEQ ID NO: 327363 - protein, 9 aa, Influenza virus
IGARIGEGQ

SEQ ID NO: 327364 - protein, 9 aa, Influenza virus
GARIGEGQR

SEQ ID NO: 327365 - protein, 9 aa, Influenza virus
ARIGEGQRS

SEQ ID NO: 327366 - protein, 9 aa, Influenza virus
RIGEGQRSW

SEQ ID NO: 327367 - protein, 9 aa, Influenza virus
IGEGQRSWM

SEQ ID NO: 327368 - protein, 9 aa, Influenza virus
GEGQRSWMK

SEQ ID NO: 327369 - protein, 9 aa, Influenza virus
DGQRSWMKI

SEQ ID NO: 327370 - protein, 9 aa, Influenza virus
GQRSWMKIY

SEQ ID NO: 327371 - protein, 9 aa, Influenza virus
QRSWMKIYW

SEQ ID NO: 327372 - protein, 9 aa, Influenza virus
RSWMKIYWH

SEQ ID NO: 327373 - protein, 9 aa, Influenza virus
SWMKIYWHL

SEQ ID NO: 327374 - protein, 9 aa, Influenza virus
WMKIYWHLM

SEQ ID NO: 327375 - protein, 9 aa, Influenza virus
MKLYWHLMR

SEQ ID NO: 327376 - protein, 9 aa, Influenza virus
KLYWHLMRP

SEQ ID NO: 327377 - protein, 9 aa, Influenza virus
LYWHLMRPG

SEQ ID NO: 327378 - protein, 9 aa, Influenza virus
YWHLMRPGE

SEQ ID NO: 327379 - protein, 9 aa, Influenza virus
WHLMRPGER

SEQ ID NO: 327380 - protein, 9 aa, Influenza virus
HLMRPGERI

SEQ ID NO: 327381 - protein, 9 aa, Influenza virus
PGERIMFES

SEQ ID NO: 327382 - protein, 9 aa, Influenza virus
GERIMFESN

SEQ ID NO: 327383 - protein, 9 aa, Influenza virus
ERIMFESNG

SEQ ID NO: 327384 - protein, 9 aa, Influenza virus
RIMFESNGG

SEQ ID NO: 327385 - protein, 9 aa, Influenza virus
IMFESNGGL

SEQ ID NO: 327386 - protein, 9 aa, Influenza virus
MFESNGGLI

SEQ ID NO: 327387 - protein, 9 aa, Influenza virus
FESNGGLIA

SEQ ID NO: 327388 - protein, 9 aa, Influenza virus
ESNGGLIAP

SEQ ID NO: 327389 - protein, 9 aa, Influenza virus
SNGGLIAPR

SEQ ID NO: 327390 - protein, 9 aa, Influenza virus
NGGLIAPRY

SEQ ID NO: 327391 - protein, 9 aa, Influenza virus
GGLIAPRYG

SEQ ID NO: 327392 - protein, 9 aa, Influenza virus
GLIAPRYGY

SEQ ID NO: 327393 - protein, 9 aa, Influenza virus
LIAPRYGYI

SEQ ID NO: 327394 - protein, 9 aa, Influenza virus
IAPRYGYII

SEQ ID NO: 327395 - protein, 9 aa, Influenza virus
GYIIEKYGS

SEQ ID NO: 327396 - protein, 9 aa, Influenza virus
YIIEKYGSG

SEQ ID NO: 327397 - protein, 9 aa, Influenza virus
IIEKYGSGR

SEQ ID NO: 327398 - protein, 9 aa, Influenza virus
IEKYGSGRI

SEQ ID NO: 327399 - protein, 9 aa, Influenza virus
EKYGSGRIF

SEQ ID NO: 327400 - protein, 9 aa, Influenza virus
KYGSGRIFQ

SEQ ID NO: 327401 - protein, 9 aa, Influenza virus
YGSGRIFQS

SEQ ID NO: 327402 - protein, 9 aa, Influenza virus
GSGRIFQSG

SEQ ID NO: 327403 - protein, 9 aa, Influenza virus
SGRIFQSGV

SEQ ID NO: 327404 - protein, 9 aa, Influenza virus
GRIFQSGIR

SEQ ID NO: 327405 - protein, 9 aa, Influenza virus
RIFQSGVRL

SEQ ID NO: 327406 - protein, 9 aa, Influenza virus
IFQSGVRLA

SEQ ID NO: 327407 - protein, 9 aa, Influenza virus
RLAKCNTKC

SEQ ID NO: 327408 - protein, 9 aa, Influenza virus
LAKCNTKCQ

SEQ ID NO: 327409 - protein, 9 aa, Influenza virus
ARCNTKCQT

SEQ ID NO: 327410 - protein, 9 aa, Influenza virus
RCNTKCQTS

SEQ ID NO: 327411 - protein, 9 aa, Influenza virus
CNTKCQTSV

SEQ ID NO: 327412 - protein, 9 aa, Influenza virus
NTKCQTSVG

SEQ ID NO: 327413 - protein, 9 aa, Influenza virus
TKCQTSVGG

SEQ ID NO: 327414 - protein, 9 aa, Influenza virus
KCQTSMGGI

SEQ ID NO: 327415 - protein, 9 aa, Influenza virus
GGVNTNKTF

SEQ ID NO: 327416 - protein, 9 aa, Influenza virus
GVNTNKTFQ

SEQ ID NO: 327417 - protein, 9 aa, Influenza virus
VNTNKTFQN

SEQ ID NO: 327418 - protein, 9 aa, Influenza virus
DTNKTFQNI

SEQ ID NO: 327419 - protein, 9 aa, Influenza virus
TNKTFQNID

SEQ ID NO: 327420 - protein, 9 aa, Influenza virus
NKTFQNIDR

SEQ ID NO: 327421 - protein, 9 aa, Influenza virus
KTFQNIDRN

SEQ ID NO: 327422 - protein, 9 aa, Influenza virus
TFQNIDRNA

SEQ ID NO: 327423 - protein, 9 aa, Influenza virus
FQNIDRNAI

SEQ ID NO: 327424 - protein, 9 aa, Influenza virus
QNIDRNAIG

SEQ ID NO: 327425 - protein, 9 aa, Influenza virus
NIDRNAIGD

SEQ ID NO: 327426 - protein, 9 aa, Influenza virus
IDRNAIGDC

SEQ ID NO: 327427 - protein, 9 aa, Influenza virus
DRNAIGDCP

SEQ ID NO: 327428 - protein, 9 aa, Influenza virus
RNAIGDCPK

SEQ ID NO: 327429 - protein, 9 aa, Influenza virus
NAIGDCPKY

SEQ ID NO: 327430 - protein, 9 aa, Influenza virus
AIGDCPKYI

SEQ ID NO: 327431 - protein, 9 aa, Influenza virus
IGDCPKYIK

SEQ ID NO: 327432 - protein, 9 aa, Influenza virus
ATGLRNVPI

SEQ ID NO: 327433 - protein, 9 aa, Influenza virus
TGLRNVPIP

SEQ ID NO: 327434 - protein, 9 aa, Influenza virus
VERGLFGAI

SEQ ID NO: 327435 - protein, 9 aa, Influenza virus
GTGIAADKT

SEQ ID NO: 327436 - protein, 9 aa, Influenza virus
TGIAADKTS

SEQ ID NO: 327437 - protein, 9 aa, Influenza virus
GIAADKTST

SEQ ID NO: 327438 - protein, 9 aa, Influenza virus
IAADKTSTQ

SEQ ID NO: 327439 - protein, 9 aa, Influenza virus
AADKTSTQK

SEQ ID NO: 327440 - protein, 9 aa, Influenza virus
ADKTSTQKA

SEQ ID NO: 327441 - protein, 9 aa, Influenza virus
DKTSTQKAI

SEQ ID NO: 327442 - protein, 9 aa, Influenza virus
KASTQKAIN

SEQ ID NO: 327443 - protein, 9 aa, Influenza virus
ASTQKAINE

SEQ ID NO: 327444 - protein, 9 aa, Influenza virus
STQKAIDEI

SEQ ID NO: 327445 - protein, 9 aa, Influenza virus
TQKAIDEIT

SEQ ID NO: 327446 - protein, 9 aa, Influenza virus
QKAIDEITT

SEQ ID NO: 327447 - protein, 9 aa, Influenza virus
KAIDEITTK

SEQ ID NO: 327448 - protein, 9 aa, Influenza virus
AIDEITTKI

SEQ ID NO: 327449 - protein, 9 aa, Influenza virus
IDEITTKIN

SEQ ID NO: 327450 - protein, 9 aa, Influenza virus
DEITTKINN

SEQ ID NO: 327451 - protein, 9 aa, Influenza virus
QVEKRINMI

SEQ ID NO: 327452 - protein, 9 aa, Influenza virus
VEKRINMIA

SEQ ID NO: 327453 - protein, 9 aa, Influenza virus
EKRINMIAD

SEQ ID NO: 327454 - protein, 9 aa, Influenza virus
KRINMIADR

SEQ ID NO: 327455 - protein, 9 aa, Influenza virus
RINMIADRV

SEQ ID NO: 327456 - protein, 9 aa, Influenza virus
INMIADRVD

SEQ ID NO: 327457 - protein, 9 aa, Influenza virus
NMIADRVDD

SEQ ID NO: 327458 - protein, 9 aa, Influenza virus
MIADRVDDA

SEQ ID NO: 327459 - protein, 9 aa, Influenza virus
IADRVDDAV

SEQ ID NO: 327460 - protein, 9 aa, Influenza virus
ADWVDDAVT

SEQ ID NO: 327461 - protein, 9 aa, Influenza virus
DWVDDAVTD

SEQ ID NO: 327462 - protein, 9 aa, Influenza virus
RVDDAVTDV

SEQ ID NO: 327463 - protein, 9 aa, Influenza virus
VDDAVTDVW

SEQ ID NO: 327464 - protein, 9 aa, Influenza virus
DDAVTDVWS

SEQ ID NO: 327465 - protein, 9 aa, Influenza virus
DAVTDVWSY

SEQ ID NO: 327466 - protein, 9 aa, Influenza virus
AVTDVWSYN

SEQ ID NO: 327467 - protein, 9 aa, Influenza virus
VTDVWSYNA

SEQ ID NO: 327468 - protein, 9 aa, Influenza virus
TDVWSYNAK

SEQ ID NO: 327469 - protein, 9 aa, Influenza virus
DVWSYNAKL

SEQ ID NO: 327470 - protein, 9 aa, Influenza virus
VWSYNAKLL

SEQ ID NO: 327471 - protein, 9 aa, Influenza virus
YNAKLLVLL

SEQ ID NO: 327472 - protein, 9 aa, Influenza virus
NAKLLVLLE

SEQ ID NO: 327473 - protein, 9 aa, Influenza virus
AKLLVLLEN

SEQ ID NO: 327474 - protein, 9 aa, Influenza virus
KLLVLLENG

SEQ ID NO: 327475 - protein, 9 aa, Influenza virus
LLVLLENGR

SEQ ID NO: 327476 - protein, 9 aa, Influenza virus
LVLLENGRT

SEQ ID NO: 327477 - protein, 9 aa, Influenza virus
VLLENGRTL

SEQ ID NO: 327478 - protein, 9 aa, Influenza virus
LLENGRTLD

SEQ ID NO: 327479 - protein, 9 aa, Influenza virus
LENGRTLDL

SEQ ID NO: 327480 - protein, 9 aa, Influenza virus
ENGRTLDLH

SEQ ID NO: 327481 - protein, 9 aa, Influenza virus
NGRTLDLHD

SEQ ID NO: 327482 - protein, 9 aa, Influenza virus
GRTLDLHDA

SEQ ID NO: 327483 - protein, 9 aa, Influenza virus
RTLGLHDAN

SEQ ID NO: 327484 - protein, 9 aa, Influenza virus
TLGLHDANV

SEQ ID NO: 327485 - protein, 9 aa, Influenza virus
LDLHDANVK

SEQ ID NO: 327486 - protein, 9 aa, Influenza virus
DLHDANVKN

SEQ ID NO: 327487 - protein, 9 aa, Influenza virus
LHDANVKNL

SEQ ID NO: 327488 - protein, 9 aa, Influenza virus
HDANVKNLH

SEQ ID NO: 327489 - protein, 9 aa, Influenza virus
DANVRNLHE

SEQ ID NO: 327490 - protein, 9 aa, Influenza virus
ANVRNLHEQ

SEQ ID NO: 327491 - protein, 9 aa, Influenza virus
NVRNLHEQI

SEQ ID NO: 327492 - protein, 9 aa, Influenza virus
VRNLHEQIK

SEQ ID NO: 327493 - protein, 9 aa, Influenza virus
RNLHEQIKR

SEQ ID NO: 327494 - protein, 9 aa, Influenza virus
LKDNAIDEG

SEQ ID NO: 327495 - protein, 9 aa, Influenza virus
KDNAIDEGD

SEQ ID NO: 327496 - protein, 9 aa, Influenza virus
DNAIDEGDG

SEQ ID NO: 327497 - protein, 9 aa, Influenza virus
IDEGDGCFS

SEQ ID NO: 327498 - protein, 9 aa, Influenza virus
DEGDGCFSI

SEQ ID NO: 327499 - protein, 9 aa, Influenza virus
EGDGCFSIL

SEQ ID NO: 327500 - protein, 9 aa, Influenza virus
GDGCFSILH

SEQ ID NO: 327501 - protein, 9 aa, Influenza virus
DGCFSILHK

SEQ ID NO: 327502 - protein, 9 aa, Influenza virus
GCFSILHKC

SEQ ID NO: 327503 - protein, 9 aa, Influenza virus
CFSILHKCN

SEQ ID NO: 327504 - protein, 9 aa, Influenza virus
FSILHKCND

SEQ ID NO: 327505 - protein, 9 aa, Influenza virus
SILHKCNDS

SEQ ID NO: 327506 - protein, 9 aa, Influenza virus
ILHKCNDSC

SEQ ID NO: 327507 - protein, 9 aa, Influenza virus
FHKCNDSCM

SEQ ID NO: 327508 - protein, 9 aa, Influenza virus
KCNDSCMEA

SEQ ID NO: 327509 - protein, 9 aa, Influenza virus
CNDSCMEAI

SEQ ID NO: 327510 - protein, 9 aa, Influenza virus
NDSCMEAIR

SEQ ID NO: 327511 - protein, 9 aa, Influenza virus
DSCMEAIRN

SEQ ID NO: 327512 - protein, 9 aa, Influenza virus
SCMEAIRNG

SEQ ID NO: 327513 - protein, 9 aa, Influenza virus
CMEAIRNGT

SEQ ID NO: 327514 - protein, 9 aa, Influenza virus
MEAIRNGTY

SEQ ID NO: 327515 - protein, 9 aa, Influenza virus
EAIRNGTYN

SEQ ID NO: 327516 - protein, 9 aa, Influenza virus
AIRNGTYNH

SEQ ID NO: 327517 - protein, 9 aa, Influenza virus
GTYNHEDYR

SEQ ID NO: 327518 - protein, 9 aa, Influenza virus
TYNHEDYRE

SEQ ID NO: 327519 - protein, 9 aa, Influenza virus
YNHEDYREE

SEQ ID NO: 327520 - protein, 9 aa, Influenza virus
NHEDYREES

SEQ ID NO: 327521 - protein, 9 aa, Influenza virus
HEDYREESQ

SEQ ID NO: 327522 - protein, 9 aa, Influenza virus
EDYREESQL

SEQ ID NO: 327523 - protein, 9 aa, Influenza virus
DYREESQLK

SEQ ID NO: 327524 - protein, 9 aa, Influenza virus
YREESQLKR

SEQ ID NO: 327525 - protein, 9 aa, Influenza virus
REESQLKRQ

SEQ ID NO: 327526 - protein, 9 aa, Influenza virus
EESQLKKQE

SEQ ID NO: 327527 - protein, 9 aa, Influenza virus
ESQLKKQEI

SEQ ID NO: 327528 - protein, 9 aa, Influenza virus
SQLKKQEIE

SEQ ID NO: 327529 - protein, 9 aa, Influenza virus
QLKKQEIEG

SEQ ID NO: 327530 - protein, 9 aa, Influenza virus
LKKQEIEGI

SEQ ID NO: 327531 - protein, 9 aa, Influenza virus
KKQEIEGIK

SEQ ID NO: 327532 - protein, 9 aa, Influenza virus
KQEIEGIKL

SEQ ID NO: 327533 - protein, 9 aa, Influenza virus
EIEGIKLKS

SEQ ID NO: 327534 - protein, 9 aa, Influenza virus
IEGIKLKSE

SEQ ID NO: 327535 - protein, 9 aa, Influenza virus
EGIKLKSED

SEQ ID NO: 327536 - protein, 9 aa, Influenza virus
GIKLKSEDN

SEQ ID NO: 327537 - protein, 9 aa, Influenza virus
IKLKTEDNI

SEQ ID NO: 327538 - protein, 9 aa, Influenza virus
KLKTEDNIY

SEQ ID NO: 327539 - protein, 9 aa, Influenza virus
LKTEDNIYK

SEQ ID NO: 327540 - protein, 9 aa, Influenza virus
KTEDNVYKI

SEQ ID NO: 327541 - protein, 9 aa, Influenza virus
TEDNVYKIL

SEQ ID NO: 327542 - protein, 9 aa, Influenza virus
EDNVYKILS

SEQ ID NO: 327543 - protein, 9 aa, Influenza virus
DNVYKILSI

SEQ ID NO: 327544 - protein, 9 aa, Influenza virus
NVYKILSIY

SEQ ID NO: 327545 - protein, 9 aa, Influenza virus
VYKILSIYS

SEQ ID NO: 327546 - protein, 9 aa, Influenza virus
YKVLSIYSC

SEQ ID NO: 327547 - protein, 9 aa, Influenza virus
KVLSIYSCI

SEQ ID NO: 327548 - protein, 9 aa, Influenza virus
VLSIYSCIA

SEQ ID NO: 327549 - protein, 9 aa, Influenza virus
LAIYSCIAS

SEQ ID NO: 327550 - protein, 9 aa, Influenza virus
AIYSCIASS

SEQ ID NO: 327551 - protein, 9 aa, Influenza virus
IYSCIASST

SEQ ID NO: 327552 - protein, 9 aa, Influenza virus
YSCIASSTV

SEQ ID NO: 327553 - protein, 9 aa, Influenza virus
SCIASSIVL

SEQ ID NO: 327554 - protein, 9 aa, Influenza virus
CIASSIVMV

SEQ ID NO: 327555 - protein, 9 aa, Influenza virus
IASSIVMVG

SEQ ID NO: 327556 - protein, 9 aa, Influenza virus
ASSVVLVGL

SEQ ID NO: 327557 - protein, 9 aa, Influenza virus
SSVVLVGLI

SEQ ID NO: 327558 - protein, 9 aa, Influenza virus
SVVLVGLIL

SEQ ID NO: 327559 - protein, 9 aa, Influenza virus
VVLVGLILA

SEQ ID NO: 327560 - protein, 9 aa, Influenza virus
VMVGLILAF

SEQ ID NO: 327561 - protein, 9 aa, Influenza virus
MVGLILAFI

SEQ ID NO: 327562 - protein, 9 aa, Influenza virus
VGLILAFIL

SEQ ID NO: 327563 - protein, 9 aa, Influenza virus
GLILAFILW

SEQ ID NO: 327564 - protein, 9 aa, Influenza virus
LILAFILWA

SEQ ID NO: 327565 - protein, 9 aa, Influenza virus
ILAFILWAC

SEQ ID NO: 327566 - protein, 9 aa, Influenza virus
LAFILWACS

SEQ ID NO: 327567 - protein, 9 aa, Influenza virus
AFIMWACSN

SEQ ID NO: 327568 - protein, 9 aa, Influenza virus
FIMWACSNG

SEQ ID NO: 327569 - protein, 9 aa, Influenza virus
IMWACSNGS

SEQ ID NO: 327570 - protein, 9 aa, Influenza virus
MWACSNGSC

SEQ ID NO: 327571 - protein, 9 aa, Influenza virus
WACSNGSCR

SEQ ID NO: 327572 - protein, 9 aa, Influenza virus
ACSNGSCRF

SEQ ID NO: 327573 - protein, 9 aa, Influenza virus
CSNGSCRFN

SEQ ID NO: 327574 - protein, 9 aa, Influenza virus
SNGSCRFNV

SEQ ID NO: 327575 - protein, 9 aa, Influenza virus
NGSCRFNVC

SEQ ID NO: 327576 - protein, 9 aa, Influenza virus
GSCRFNVCI

SEQ ID NO: 327577 - protein, 9 aa, Influenza virus
GKTKATKME

SEQ ID NO: 327578 - protein, 9 aa, Influenza virus
KTKATKMEA

SEQ ID NO: 327579 - protein, 9 aa, Influenza virus
TKATKMEAI

SEQ ID NO: 327580 - protein, 9 aa, Influenza virus
KATKMEAIL

SEQ ID NO: 327581 - protein, 9 aa, Influenza virus
ATKMKAIIV

SEQ ID NO: 327582 - protein, 9 aa, Influenza virus
TKMKAIIVV

SEQ ID NO: 327583 - protein, 9 aa, Influenza virus
SNAPSGVEY

SEQ ID NO: 327584 - protein, 9 aa, Influenza virus
NAPSGVEYN

SEQ ID NO: 327585 - protein, 9 aa, Influenza virus
APSGVEYNG

SEQ ID NO: 327586 - protein, 9 aa, Influenza virus
PSGVEYNGK

SEQ ID NO: 327587 - protein, 9 aa, Influenza virus
SGVEYNGKS

SEQ ID NO: 327588 - protein, 9 aa, Influenza virus
GVEYNGKSL

SEQ ID NO: 327589 - protein, 9 aa, Influenza virus
VEYNGKSLG

SEQ ID NO: 327590 - protein, 9 aa, Influenza virus
GAIAGFIEN

SEQ ID NO: 327591 - protein, 9 aa, Influenza virus
AIAGFIENG

SEQ ID NO: 327592 - protein, 9 aa, Influenza virus
IAGFIENGW

SEQ ID NO: 327593 - protein, 9 aa, Influenza virus
AGFIEGGWP

SEQ ID NO: 327594 - protein, 9 aa, Influenza virus
GFIEGGWPG

SEQ ID NO: 327595 - protein, 9 aa, Influenza virus
FIEGGWPGL

SEQ ID NO: 327596 - protein, 9 aa, Influenza virus
IEGGWTGMI

SEQ ID NO: 327597 - protein, 9 aa, Influenza virus
EGGWTGMID

SEQ ID NO: 327598 - protein, 9 aa, Influenza virus
GGWTGMIDG

SEQ ID NO: 327599 - protein, 9 aa, Influenza virus
GWTGMIDGW

SEQ ID NO: 327600 - protein, 9 aa, Influenza virus
WTGMIDGWY

SEQ ID NO: 327601 - protein, 9 aa, Influenza virus
TGMIDGWYG

SEQ ID NO: 327602 - protein, 9 aa, Influenza virus
GMIDGWYGY

SEQ ID NO: 327603 - protein, 9 aa, Influenza virus
MIDGWYGYH

SEQ ID NO: 327604 - protein, 9 aa, Influenza virus
IDGWYGYHH

SEQ ID NO: 327605 - protein, 9 aa, Influenza virus
DGWYGFRHQ

SEQ ID NO: 327606 - protein, 9 aa, Influenza virus
GWYGFRHQN

SEQ ID NO: 327607 - protein, 9 aa, Influenza virus
YQAELLVAM

SEQ ID NO: 327608 - protein, 9 aa, Influenza virus
QAELLVAME

SEQ ID NO: 327609 - protein, 9 aa, Influenza virus
AELLVAMEN

SEQ ID NO: 327610 - protein, 9 aa, Influenza virus
AMENQHTID

SEQ ID NO: 327611 - protein, 9 aa, Influenza virus
GKGCFEIYH

SEQ ID NO: 327612 - protein, 9 aa, Influenza virus
LSIYSCIAS

SEQ ID NO: 327613 - protein, 9 aa, Influenza virus
QCRICIDFR

SEQ ID NO: 327614 - protein, 9 aa, Influenza virus
CRICILDQN

SEQ ID NO: 327615 - protein, 9 aa, Influenza virus
TISLVKTTL

SEQ ID NO: 327616 - protein, 9 aa, Influenza virus
ISLVKTTLF

SEQ ID NO: 327617 - protein, 9 aa, Influenza virus
SLVKTTLFL

SEQ ID NO: 327618 - protein, 9 aa, Influenza virus
IDFRDMRKN

SEQ ID NO: 327619 - protein, 9 aa, Influenza virus
LDQNFRNIR

SEQ ID NO: 327620 - protein, 9 aa, Influenza virus
FRDMRKNTL

SEQ ID NO: 327621 - protein, 9 aa, Influenza virus
GKTKATKME

SEQ ID NO: 327622 - protein, 9 aa, Influenza virus
KTKATKMEA

SEQ ID NO: 327623 - protein, 9 aa, Influenza virus
TKATKMEAI

SEQ ID NO: 327624 - protein, 9 aa, Influenza virus
KATKMEAIL

SEQ ID NO: 327625 - protein, 9 aa, Influenza virus
ATKMKAIIV

SEQ ID NO: 327626 - protein, 9 aa, Influenza virus
TKMKAIIVV

SEQ ID NO: 327627 - protein, 9 aa, Influenza virus
KMKAIIVVL

SEQ ID NO: 327628 - protein, 9 aa, Influenza virus
ADTICIGYH

SEQ ID NO: 327629 - protein, 9 aa, Influenza virus
DTICIGYHA

SEQ ID NO: 327630 - protein, 9 aa, Influenza virus
TICIGYHAN

SEQ ID NO: 327631 - protein, 9 aa, Influenza virus
ICIGYHANN

SEQ ID NO: 327632 - protein, 9 aa, Influenza virus
CVGYHANNS

SEQ ID NO: 327633 - protein, 9 aa, Influenza virus
VGYHANNST

SEQ ID NO: 327634 - protein, 9 aa, Influenza virus
NSTDTVDTI

SEQ ID NO: 327635 - protein, 9 aa, Influenza virus
STDTVDTIL

SEQ ID NO: 327636 - protein, 9 aa, Influenza virus
TDTVDTILE

SEQ ID NO: 327637 - protein, 9 aa, Influenza virus
DTVDTILEK

SEQ ID NO: 327638 - protein, 9 aa, Influenza virus
TVDTILEKN

SEQ ID NO: 327639 - protein, 9 aa, Influenza virus
VDTILEKNV

SEQ ID NO: 327640 - protein, 9 aa, Influenza virus
DTILEKNVT

SEQ ID NO: 327641 - protein, 9 aa, Influenza virus
TILEKNVTV

SEQ ID NO: 327642 - protein, 9 aa, Influenza virus
ILEKNVTVT

SEQ ID NO: 327643 - protein, 9 aa, Influenza virus
LERNVTVTH

SEQ ID NO: 327644 - protein, 9 aa, Influenza virus
ERNVTVTHS

SEQ ID NO: 327645 - protein, 9 aa, Influenza virus
RNVTVTHSV

SEQ ID NO: 327646 - protein, 9 aa, Influenza virus
NVTVTHSVD

SEQ ID NO: 327647 - protein, 9 aa, Influenza virus
VTVTHSVNI

SEQ ID NO: 327648 - protein, 9 aa, Influenza virus
TVTHSVNIL

SEQ ID NO: 327649 - protein, 9 aa, Influenza virus
VTHSVNILE

SEQ ID NO: 327650 - protein, 9 aa, Influenza virus
VAGWILGNP

SEQ ID NO: 327651 - protein, 9 aa, Influenza virus
AGWLLGNPE

SEQ ID NO: 327652 - protein, 9 aa, Influenza virus
GWLLGNPEC

SEQ ID NO: 327653 - protein, 9 aa, Influenza virus
NYEELREQL

SEQ ID NO: 327654 - protein, 9 aa, Influenza virus
YEELKEQLS

SEQ ID NO: 327655 - protein, 9 aa, Influenza virus
EELKEQLST

SEQ ID NO: 327656 - protein, 9 aa, Influenza virus
ELKEQLSTV

SEQ ID NO: 327657 - protein, 9 aa, Influenza virus
LKEQLSTVS

SEQ ID NO: 327658 - protein, 9 aa, Influenza virus
KEQLSTVSS

SEQ ID NO: 327659 - protein, 9 aa, Influenza virus
EQLSTVSSF

SEQ ID NO: 327660 - protein, 9 aa, Influenza virus
QLSTVSSFE

SEQ ID NO: 327661 - protein, 9 aa, Influenza virus
LSSVSSFEK

SEQ ID NO: 327662 - protein, 9 aa, Influenza virus
SSVSSFEKF

SEQ ID NO: 327663 - protein, 9 aa, Influenza virus
SVSSFEKFE

SEQ ID NO: 327664 - protein, 9 aa, Influenza virus
VSSFEKFEI

SEQ ID NO: 327665 - protein, 9 aa, Influenza virus
SSFEKFEIF

SEQ ID NO: 327666 - protein, 9 aa, Influenza virus
SFEKFEIFP

SEQ ID NO: 327667 - protein, 9 aa, Influenza virus
FEKFEIFPK

SEQ ID NO: 327668 - protein, 9 aa, Influenza virus
KEKENSYPK

SEQ ID NO: 327669 - protein, 9 aa, Influenza virus
EKENSYPKI

SEQ ID NO: 327670 - protein, 9 aa, Influenza virus
VLVLWGVHH

SEQ ID NO: 327671 - protein, 9 aa, Influenza virus
LVLWGVHHP

SEQ ID NO: 327672 - protein, 9 aa, Influenza virus
GRINYYWTL

SEQ ID NO: 327673 - protein, 9 aa, Influenza virus
DTIIFEANG

SEQ ID NO: 327674 - protein, 9 aa, Influenza virus
TIIFEANGN

SEQ ID NO: 327675 - protein, 9 aa, Influenza virus
IIFEANGNL

SEQ ID NO: 327676 - protein, 9 aa, Influenza virus
FEANGNLIA

SEQ ID NO: 327677 - protein, 9 aa, Influenza virus
EANGNLIAP

SEQ ID NO: 327678 - protein, 9 aa, Influenza virus
SLPFQNVHP

SEQ ID NO: 327679 - protein, 9 aa, Influenza virus
PVTIGECPK

SEQ ID NO: 327680 - protein, 9 aa, Influenza virus
VTIGECPKY

SEQ ID NO: 327681 - protein, 9 aa, Influenza virus
TIGECPKYV

SEQ ID NO: 327682 - protein, 9 aa, Influenza virus
IGECPKYVR

SEQ ID NO: 327683 - protein, 9 aa, Influenza virus
GECPKYVRS

SEQ ID NO: 327684 - protein, 9 aa, Influenza virus
ECPKYVRSA

SEQ ID NO: 327685 - protein, 9 aa, Influenza virus
KLRMVTGLR

SEQ ID NO: 327686 - protein, 9 aa, Influenza virus
LRMVTGLRN

SEQ ID NO: 327687 - protein, 9 aa, Influenza virus
RMVTGLRNI

SEQ ID NO: 327688 - protein, 9 aa, Influenza virus
MVTGLRNIP

SEQ ID NO: 327689 - protein, 9 aa, Influenza virus
VTGLRNIPS

SEQ ID NO: 327690 - protein, 9 aa, Influenza virus
TGLRNIPSI

SEQ ID NO: 327691 - protein, 9 aa, Influenza virus
GLRNIPSIQ

SEQ ID NO: 327692 - protein, 9 aa, Influenza virus
LRNIPSIQS

SEQ ID NO: 327693 - protein, 9 aa, Influenza virus
RNIPSIQSR

SEQ ID NO: 327694 - protein, 9 aa, Influenza virus
NIPSIQSRG

SEQ ID NO: 327695 - protein, 9 aa, Influenza virus
IPSIQSRGL

SEQ ID NO: 327696 - protein, 9 aa, Influenza virus
PSVQSRGLF

SEQ ID NO: 327697 - protein, 9 aa, Influenza virus
SVQSRGLFG

SEQ ID NO: 327698 - protein, 9 aa, Influenza virus
VQSRGLFGA

SEQ ID NO: 327699 - protein, 9 aa, Influenza virus
IEGGWTGMI

SEQ ID NO: 327700 - protein, 9 aa, Influenza virus
EGGWTGMID

SEQ ID NO: 327701 - protein, 9 aa, Influenza virus
GGWTGMIDG

SEQ ID NO: 327702 - protein, 9 aa, Influenza virus
GWTGMIDGW

SEQ ID NO: 327703 - protein, 9 aa, Influenza virus
WTGMIDGWY

SEQ ID NO: 327704 - protein, 9 aa, Influenza virus
TGMIDGWYG

SEQ ID NO: 327705 - protein, 9 aa, Influenza virus
GMIDGWYGY

SEQ ID NO: 327706 - protein, 9 aa, Influenza virus
MIDGWYGYH

SEQ ID NO: 327707 - protein, 9 aa, Influenza virus
IDGWYGYHH

SEQ ID NO: 327708 - protein, 9 aa, Influenza virus
WYGYHHQNG

SEQ ID NO: 327709 - protein, 9 aa, Influenza virus
YGYHHQNGQ

SEQ ID NO: 327710 - protein, 9 aa, Influenza virus
GYHHQNGQG

SEQ ID NO: 327711 - protein, 9 aa, Influenza virus
YHHQNGQGS

SEQ ID NO: 327712 - protein, 9 aa, Influenza virus
HHQNGQGSG

SEQ ID NO: 327713 - protein, 9 aa, Influenza virus
HQNGQGSGY

SEQ ID NO: 327714 - protein, 9 aa, Influenza virus
QNGQGSGYA

SEQ ID NO: 327715 - protein, 9 aa, Influenza virus
NGQGSGYAA

SEQ ID NO: 327716 - protein, 9 aa, Influenza virus
GQGSGYAAD

SEQ ID NO: 327717 - protein, 9 aa, Influenza virus
QGSGYAADQ

SEQ ID NO: 327718 - protein, 9 aa, Influenza virus
GSGYAADQK

SEQ ID NO: 327719 - protein, 9 aa, Influenza virus
SGYAADQKS

SEQ ID NO: 327720 - protein, 9 aa, Influenza virus
GYAADQKST

SEQ ID NO: 327721 - protein, 9 aa, Influenza virus
YAADQKSTQ

SEQ ID NO: 327722 - protein, 9 aa, Influenza virus
ISNKVNSVI

SEQ ID NO: 327723 - protein, 9 aa, Influenza virus
SNKVNSVIE

SEQ ID NO: 327724 - protein, 9 aa, Influenza virus
NKVNSIIEK

SEQ ID NO: 327725 - protein, 9 aa, Influenza virus
KVNSIIEKM

SEQ ID NO: 327726 - protein, 9 aa, Influenza virus
VNSIIEKMN

SEQ ID NO: 327727 - protein, 9 aa, Influenza virus
NSVIEKMNI

SEQ ID NO: 327728 - protein, 9 aa, Influenza virus
SVIEKMNIQ

SEQ ID NO: 327729 - protein, 9 aa, Influenza virus
VIEKMNIQF

SEQ ID NO: 327730 - protein, 9 aa, Influenza virus
IEKMNIQFT

SEQ ID NO: 327731 - protein, 9 aa, Influenza virus
EKMNIQFTS

SEQ ID NO: 327732 - protein, 9 aa, Influenza virus
KMNIQFTSV

SEQ ID NO: 327733 - protein, 9 aa, Influenza virus
MNIQFTSVG

SEQ ID NO: 327734 - protein, 9 aa, Influenza virus
NIQFTSVGK

SEQ ID NO: 327735 - protein, 9 aa, Influenza virus
IQFTSVGKE

SEQ ID NO: 327736 - protein, 9 aa, Influenza virus
QFTSVGKEF

SEQ ID NO: 327737 - protein, 9 aa, Influenza virus
FTAVGKEFS

SEQ ID NO: 327738 - protein, 9 aa, Influenza virus
RMENLNKKV

SEQ ID NO: 327739 - protein, 9 aa, Influenza virus
MENLNKKVD

SEQ ID NO: 327740 - protein, 9 aa, Influenza virus
ENLNKKIDD

SEQ ID NO: 327741 - protein, 9 aa, Influenza virus
NLNKKIDDG

SEQ ID NO: 327742 - protein, 9 aa, Influenza virus
LNKKIDDGF

SEQ ID NO: 327743 - protein, 9 aa, Influenza virus
NKKVDDGFI

SEQ ID NO: 327744 - protein, 9 aa, Influenza virus
KKVDDGFID

SEQ ID NO: 327745 - protein, 9 aa, Influenza virus
DDGFIDIWT

SEQ ID NO: 327746 - protein, 9 aa, Influenza virus
DGFIDIWTY

SEQ ID NO: 327747 - protein, 9 aa, Influenza virus
GFIDIWTYN

SEQ ID NO: 327748 - protein, 9 aa, Influenza virus
FIDIWTYNA

SEQ ID NO: 327749 - protein, 9 aa, Influenza virus
IDIWTYNAE

SEQ ID NO: 327750 - protein, 9 aa, Influenza virus
DVWTYNAEL

SEQ ID NO: 327751 - protein, 9 aa, Influenza virus
VWTYNAELL

SEQ ID NO: 327752 - protein, 9 aa, Influenza virus
WTYNAELLI

SEQ ID NO: 327753 - protein, 9 aa, Influenza virus
TYNAELLIL

SEQ ID NO: 327754 - protein, 9 aa, Influenza virus
YNAELLILL

SEQ ID NO: 327755 - protein, 9 aa, Influenza virus
NAELLILLE

SEQ ID NO: 327756 - protein, 9 aa, Influenza virus
AELLILLEN

SEQ ID NO: 327757 - protein, 9 aa, Influenza virus
ELLILLENE

SEQ ID NO: 327758 - protein, 9 aa, Influenza virus
LLILLENER

SEQ ID NO: 327759 - protein, 9 aa, Influenza virus
LILLENERT

SEQ ID NO: 327760 - protein, 9 aa, Influenza virus
ILLENERTL

SEQ ID NO: 327761 - protein, 9 aa, Influenza virus
LENERTLDF

SEQ ID NO: 327762 - protein, 9 aa, Influenza virus
ENERTLDFH

SEQ ID NO: 327763 - protein, 9 aa, Influenza virus
NERTLDFHD

SEQ ID NO: 327764 - protein, 9 aa, Influenza virus
ERTLDFHDS

SEQ ID NO: 327765 - protein, 9 aa, Influenza virus
NNAKELGNG

SEQ ID NO: 327766 - protein, 9 aa, Influenza virus
NAKELGNGC

SEQ ID NO: 327767 - protein, 9 aa, Influenza virus
AKELGNGCF

SEQ ID NO: 327768 - protein, 9 aa, Influenza virus
KELGNGCFE

SEQ ID NO: 327769 - protein, 9 aa, Influenza virus
ELGNGCFEF

SEQ ID NO: 327770 - protein, 9 aa, Influenza virus
LGNGCFEFY

SEQ ID NO: 327771 - protein, 9 aa, Influenza virus
CFEFYHKCN

SEQ ID NO: 327772 - protein, 9 aa, Influenza virus
FEFYHKCND

SEQ ID NO: 327773 - protein, 9 aa, Influenza virus
CMESVRNGT

SEQ ID NO: 327774 - protein, 9 aa, Influenza virus
MESVRNGTY

SEQ ID NO: 327775 - protein, 9 aa, Influenza virus
ESVKNGTYN

SEQ ID NO: 327776 - protein, 9 aa, Influenza virus
SVKNGTYNY

SEQ ID NO: 327777 - protein, 9 aa, Influenza virus
VKNGTYNYP

SEQ ID NO: 327778 - protein, 9 aa, Influenza virus
KNGTYNYPK

SEQ ID NO: 327779 - protein, 9 aa, Influenza virus
NGTYNYPKY

SEQ ID NO: 327780 - protein, 9 aa, Influenza virus
GTYNYPKYS

SEQ ID NO: 327781 - protein, 9 aa, Influenza virus
TYNYPKYSE

SEQ ID NO: 327782 - protein, 9 aa, Influenza virus
YNYPKYSEE

SEQ ID NO: 327783 - protein, 9 aa, Influenza virus
DYPKYSEES

SEQ ID NO: 327784 - protein, 9 aa, Influenza virus
YPKYSEESK

SEQ ID NO: 327785 - protein, 9 aa, Influenza virus
PKYSEESKL

SEQ ID NO: 327786 - protein, 9 aa, Influenza virus
VYQILAIYS

SEQ ID NO: 327787 - protein, 9 aa, Influenza virus
HQILAIYST

SEQ ID NO: 327788 - protein, 9 aa, Influenza virus
QILAIYSTA

SEQ ID NO: 327789 - protein, 9 aa, Influenza virus
ILAIYSTAA

SEQ ID NO: 327790 - protein, 9 aa, Influenza virus
LAIYSTAAS

SEQ ID NO: 327791 - protein, 9 aa, Influenza virus
AIYSTAASS

SEQ ID NO: 327792 - protein, 9 aa, Influenza virus
IYSTAASSL

SEQ ID NO: 327793 - protein, 9 aa, Influenza virus
YSTAASSLV

SEQ ID NO: 327794 - protein, 9 aa, Influenza virus
STAASSLVL

SEQ ID NO: 327795 - protein, 9 aa, Influenza virus
ASSLVLLVS

SEQ ID NO: 327796 - protein, 9 aa, Influenza virus
SSLVLLVSL

SEQ ID NO: 327797 - protein, 9 aa, Influenza virus
SLVLLVSLG

SEQ ID NO: 327798 - protein, 9 aa, Influenza virus
LVLLVSLGA

SEQ ID NO: 327799 - protein, 9 aa, Influenza virus
VLLVSLGAI

SEQ ID NO: 327800 - protein, 9 aa, Influenza virus
LLVSLGAIS

SEQ ID NO: 327801 - protein, 9 aa, Influenza virus
LVSLGAISF

SEQ ID NO: 327802 - protein, 9 aa, Influenza virus
VSLGAVSFW

SEQ ID NO: 327803 - protein, 9 aa, Influenza virus
SLGAVSFWM

SEQ ID NO: 327804 - protein, 9 aa, Influenza virus
AISFWMCSG

SEQ ID NO: 327805 - protein, 9 aa, Influenza virus
ISFWMCSGH

SEQ ID NO: 327806 - protein, 9 aa, Influenza virus
SFWMCSGHS

SEQ ID NO: 327807 - protein, 9 aa, Influenza virus
FWMCSGHSC

SEQ ID NO: 327808 - protein, 9 aa, Influenza virus
WMCSNGSLR

SEQ ID NO: 327809 - protein, 9 aa, Influenza virus
MCSNGSLRC

SEQ ID NO: 327810 - protein, 9 aa, Influenza virus
CSNGSLRCR

SEQ ID NO: 327811 - protein, 9 aa, Influenza virus
SNGSLQCRV

SEQ ID NO: 327812 - protein, 9 aa, Influenza virus
NGSLQCRVC

SEQ ID NO: 327813 - protein, 9 aa, Influenza virus
GSLQCRVCI

SEQ ID NO: 327814 - protein, 9 aa, Influenza virus
QCRICIDFR

SEQ ID NO: 327815 - protein, 9 aa, Influenza virus
CRICILDQN

SEQ ID NO: 327816 - protein, 9 aa, Influenza virus
RICIDFRDM

SEQ ID NO: 327817 - protein, 9 aa, Influenza virus
ICIDFRDMR

SEQ ID NO: 327818 - protein, 9 aa, Influenza virus
CIDFRDMRK

SEQ ID NO: 327819 - protein, 9 aa, Influenza virus
IDFRDMRKN

SEQ ID NO: 327820 - protein, 9 aa, Influenza virus
LDQNFRNIR

SEQ ID NO: 327821 - protein, 9 aa, Influenza virus
FRDMRKNTL

SEQ ID NO: 327822 - protein, 9 aa, Influenza virus
GWAIYTKDN

SEQ ID NO: 327823 - protein, 9 aa, Influenza virus
WAIYTKDNS

SEQ ID NO: 327824 - protein, 9 aa, Influenza virus
YTKDNSIRI

SEQ ID NO: 327825 - protein, 9 aa, Influenza virus
TKDNSIRIG

SEQ ID NO: 327826 - protein, 9 aa, Influenza virus
KDNSVRIGS

SEQ ID NO: 327827 - protein, 9 aa, Influenza virus
DNSVRIGSK

SEQ ID NO: 327828 - protein, 9 aa, Influenza virus
NSVRIGSKG

SEQ ID NO: 327829 - protein, 9 aa, Influenza virus
SVRIGSKGD

SEQ ID NO: 327830 - protein, 9 aa, Influenza virus
VRIGSKGDV

SEQ ID NO: 327831 - protein, 9 aa, Influenza virus
RIGSKGDIF

SEQ ID NO: 327832 - protein, 9 aa, Influenza virus
IGSKGDIFV

SEQ ID NO: 327833 - protein, 9 aa, Influenza virus
GSKGDIFVI

SEQ ID NO: 327834 - protein, 9 aa, Influenza virus
SKGDIFVIR

SEQ ID NO: 327835 - protein, 9 aa, Influenza virus
KGDIFVIRE

SEQ ID NO: 327836 - protein, 9 aa, Influenza virus
GDIFVIREP

SEQ ID NO: 327837 - protein, 9 aa, Influenza virus
DIFVIREPF

SEQ ID NO: 327838 - protein, 9 aa, Influenza virus
IFVIREPFI

SEQ ID NO: 327839 - protein, 9 aa, Influenza virus
FVMREPFIS

SEQ ID NO: 327840 - protein, 9 aa, Influenza virus
VMREPFISC

SEQ ID NO: 327841 - protein, 9 aa, Influenza virus
MREPFISCS

SEQ ID NO: 327842 - protein, 9 aa, Influenza virus
REPFISCSH

SEQ ID NO: 327843 - protein, 9 aa, Influenza virus
EPFISCSHL

SEQ ID NO: 327844 - protein, 9 aa, Influenza virus
PFISCSHLE

SEQ ID NO: 327845 - protein, 9 aa, Influenza virus
FISCSHLEC

SEQ ID NO: 327846 - protein, 9 aa, Influenza virus
ISCSHLECR

SEQ ID NO: 327847 - protein, 9 aa, Influenza virus
LECKTFFLT

SEQ ID NO: 327848 - protein, 9 aa, Influenza virus
ECKTFFLTQ

SEQ ID NO: 327849 - protein, 9 aa, Influenza virus
CKTFFLTQG

SEQ ID NO: 327850 - protein, 9 aa, Influenza virus
KTFFLTQGA

SEQ ID NO: 327851 - protein, 9 aa, Influenza virus
TQGALLNDR

SEQ ID NO: 327852 - protein, 9 aa, Influenza virus
QGALLNDRH

SEQ ID NO: 327853 - protein, 9 aa, Influenza virus
GALLNDRHS

SEQ ID NO: 327854 - protein, 9 aa, Influenza virus
ALLNDRHSN

SEQ ID NO: 327855 - protein, 9 aa, Influenza virus
LLNDRHSNG

SEQ ID NO: 327856 - protein, 9 aa, Influenza virus
LNDRHSNGT

SEQ ID NO: 327857 - protein, 9 aa, Influenza virus
NDKHSNGTV

SEQ ID NO: 327858 - protein, 9 aa, Influenza virus
DKHSNGTVK

SEQ ID NO: 327859 - protein, 9 aa, Influenza virus
HSNGTVKDR

SEQ ID NO: 327860 - protein, 9 aa, Influenza virus
SNGTVKDRS

SEQ ID NO: 327861 - protein, 9 aa, Influenza virus
KDRSPYRAL

SEQ ID NO: 327862 - protein, 9 aa, Influenza virus
DRSPYRALM

SEQ ID NO: 327863 - protein, 9 aa, Influenza virus
RSPYRALMS

SEQ ID NO: 327864 - protein, 9 aa, Influenza virus
SPYRALMSC

SEQ ID NO: 327865 - protein, 9 aa, Influenza virus
PYRALMSCP

SEQ ID NO: 327866 - protein, 9 aa, Influenza virus
RALMSCPLG

SEQ ID NO: 327867 - protein, 9 aa, Influenza virus
ALMSCPLGE

SEQ ID NO: 327868 - protein, 9 aa, Influenza virus
LMSCPLGEA

SEQ ID NO: 327869 - protein, 9 aa, Influenza virus
MSCPLGEAP

SEQ ID NO: 327870 - protein, 9 aa, Influenza virus
SCPLGEAPS

SEQ ID NO: 327871 - protein, 9 aa, Influenza virus
CPLGEAPSP

SEQ ID NO: 327872 - protein, 9 aa, Influenza virus
PLGEAPSPY

SEQ ID NO: 327873 - protein, 9 aa, Influenza virus
LGEAPSPYN

SEQ ID NO: 327874 - protein, 9 aa, Influenza virus
GEAPSPYNS

SEQ ID NO: 327875 - protein, 9 aa, Influenza virus
EAPSPYNSK

SEQ ID NO: 327876 - protein, 9 aa, Influenza virus
APSPYNSKF

SEQ ID NO: 327877 - protein, 9 aa, Influenza virus
PSPYNSKFE

SEQ ID NO: 327878 - protein, 9 aa, Influenza virus
SPYNSKFES

SEQ ID NO: 327879 - protein, 9 aa, Influenza virus
PYNSKFESV

SEQ ID NO: 327880 - protein, 9 aa, Influenza virus
YNSKFESVA

SEQ ID NO: 327881 - protein, 9 aa, Influenza virus
NSKFESVAW

SEQ ID NO: 327882 - protein, 9 aa, Influenza virus
SKFESVAWS

SEQ ID NO: 327883 - protein, 9 aa, Influenza virus
KFESVAWSA

SEQ ID NO: 327884 - protein, 9 aa, Influenza virus
SASACHDGM

SEQ ID NO: 327885 - protein, 9 aa, Influenza virus
GWLTIGISG

SEQ ID NO: 327886 - protein, 9 aa, Influenza virus
WITIGISGP

SEQ ID NO: 327887 - protein, 9 aa, Influenza virus
ITIGISGPD

SEQ ID NO: 327888 - protein, 9 aa, Influenza virus
TIGISGPDD

SEQ ID NO: 327889 - protein, 9 aa, Influenza virus
IGISGPDDG

SEQ ID NO: 327890 - protein, 9 aa, Influenza virus
GISGPDDGA

SEQ ID NO: 327891 - protein, 9 aa, Influenza virus
ISGPDDGAV

SEQ ID NO: 327892 - protein, 9 aa, Influenza virus
SGPDDGAVA

SEQ ID NO: 327893 - protein, 9 aa, Influenza virus
GPDDGAVAV

SEQ ID NO: 327894 - protein, 9 aa, Influenza virus
PDDGAVAVL

SEQ ID NO: 327895 - protein, 9 aa, Influenza virus
DDGAVAVLK

SEQ ID NO: 327896 - protein, 9 aa, Influenza virus
DGAVAVLKY

SEQ ID NO: 327897 - protein, 9 aa, Influenza virus
GAVAVLKYK

SEQ ID NO: 327898 - protein, 9 aa, Influenza virus
AVAVLKYKG

SEQ ID NO: 327899 - protein, 9 aa, Influenza virus
VAVLKYKGI

SEQ ID NO: 327900 - protein, 9 aa, Influenza virus
AVLKYKGII

SEQ ID NO: 327901 - protein, 9 aa, Influenza virus
VLKYKGIIT

SEQ ID NO: 327902 - protein, 9 aa, Influenza virus
LKYNGIITG

SEQ ID NO: 327903 - protein, 9 aa, Influenza virus
KYNGIITGT

SEQ ID NO: 327904 - protein, 9 aa, Influenza virus
GIITGTIKS

SEQ ID NO: 327905 - protein, 9 aa, Influenza virus
IITGTIKSW

SEQ ID NO: 327906 - protein, 9 aa, Influenza virus
QILRTQESE

SEQ ID NO: 327907 - protein, 9 aa, Influenza virus
LRTQESECV

SEQ ID NO: 327908 - protein, 9 aa, Influenza virus
RTQESECVC

SEQ ID NO: 327909 - protein, 9 aa, Influenza virus
TQESECVCM

SEQ ID NO: 327910 - protein, 9 aa, Influenza virus
QESECVCMN

SEQ ID NO: 327911 - protein, 9 aa, Influenza virus
ESECVCMNG

SEQ ID NO: 327912 - protein, 9 aa, Influenza virus
SECVCMNGS

SEQ ID NO: 327913 - protein, 9 aa, Influenza virus
ECVCMNGSC

SEQ ID NO: 327914 - protein, 9 aa, Influenza virus
NGSCFTIMT

SEQ ID NO: 327915 - protein, 9 aa, Influenza virus
GSCFTIMTD

SEQ ID NO: 327916 - protein, 9 aa, Influenza virus
SCFTIMTDG

SEQ ID NO: 327917 - protein, 9 aa, Influenza virus
CFTIMTDGP

SEQ ID NO: 327918 - protein, 9 aa, Influenza virus
FTIMTDGPS

SEQ ID NO: 327919 - protein, 9 aa, Influenza virus
APNFHYEEC

SEQ ID NO: 327920 - protein, 9 aa, Influenza virus
PNFHYEECS

SEQ ID NO: 327921 - protein, 9 aa, Influenza virus
NFHYEECSC

SEQ ID NO: 327922 - protein, 9 aa, Influenza virus
FHYEECSCY

SEQ ID NO: 327923 - protein, 9 aa, Influenza virus
YYEECSCYP

SEQ ID NO: 327924 - protein, 9 aa, Influenza virus
YEECSCYPE

SEQ ID NO: 327925 - protein, 9 aa, Influenza virus
EECSCYPDT

SEQ ID NO: 327926 - protein, 9 aa, Influenza virus
VMCVCRDNW

SEQ ID NO: 327927 - protein, 9 aa, Influenza virus
MCVCRDNWH

SEQ ID NO: 327928 - protein, 9 aa, Influenza virus
CVCRDNWHA

SEQ ID NO: 327929 - protein, 9 aa, Influenza virus
VCRDNWHAS

SEQ ID NO: 327930 - protein, 9 aa, Influenza virus
CRDNWHASN

SEQ ID NO: 327931 - protein, 9 aa, Influenza virus
RDNWHASNR

SEQ ID NO: 327932 - protein, 9 aa, Influenza virus
DNWHASNRP

SEQ ID NO: 327933 - protein, 9 aa, Influenza virus
NWHASNRPW

SEQ ID NO: 327934 - protein, 9 aa, Influenza virus
WHASNRPWV

SEQ ID NO: 327935 - protein, 9 aa, Influenza virus
HASNRPWVS

SEQ ID NO: 327936 - protein, 9 aa, Influenza virus
ASNRPWVSF

SEQ ID NO: 327937 - protein, 9 aa, Influenza virus
SNRPWVSFD

SEQ ID NO: 327938 - protein, 9 aa, Influenza virus
NRPWVSFDQ

SEQ ID NO: 327939 - protein, 9 aa, Influenza virus
RPWVSFDQN

SEQ ID NO: 327940 - protein, 9 aa, Influenza virus
PWVSFDQNL

SEQ ID NO: 327941 - protein, 9 aa, Influenza virus
YQMGYICSG

SEQ ID NO: 327942 - protein, 9 aa, Influenza virus
IGYICSGVF

SEQ ID NO: 327943 - protein, 9 aa, Influenza virus
GYICSGVFG

SEQ ID NO: 327944 - protein, 9 aa, Influenza virus
YICSGVFGD

SEQ ID NO: 327945 - protein, 9 aa, Influenza virus
ICSGVFGDN

SEQ ID NO: 327946 - protein, 9 aa, Influenza virus
CSGVFGDNP

SEQ ID NO: 327947 - protein, 9 aa, Influenza virus
SGVFGDNPR

SEQ ID NO: 327948 - protein, 9 aa, Influenza virus
GVFGDNPRP

SEQ ID NO: 327949 - protein, 9 aa, Influenza virus
GADGVKGFS

SEQ ID NO: 327950 - protein, 9 aa, Influenza virus
ANGVKGFSY

SEQ ID NO: 327951 - protein, 9 aa, Influenza virus
GVKGFSYKY

SEQ ID NO: 327952 - protein, 9 aa, Influenza virus
VKGFSYKYG

SEQ ID NO: 327953 - protein, 9 aa, Influenza virus
KGFSYKYGN

SEQ ID NO: 327954 - protein, 9 aa, Influenza virus
GFSYKYGNG

SEQ ID NO: 327955 - protein, 9 aa, Influenza virus
FSYKYGNGV

SEQ ID NO: 327956 - protein, 9 aa, Influenza virus
SYKYGNGVW

SEQ ID NO: 327957 - protein, 9 aa, Influenza virus
RYGNGVWIG

SEQ ID NO: 327958 - protein, 9 aa, Influenza virus
YDNGVWIGR

SEQ ID NO: 327959 - protein, 9 aa, Influenza virus
DNGVWIGRT

SEQ ID NO: 327960 - protein, 9 aa, Influenza virus
NGVWMGRTK

SEQ ID NO: 327961 - protein, 9 aa, Influenza virus
VWIGRTKSN

SEQ ID NO: 327962 - protein, 9 aa, Influenza virus
GFEMIWDPD

SEQ ID NO: 327963 - protein, 9 aa, Influenza virus
FEMIWDPDG

SEQ ID NO: 327964 - protein, 9 aa, Influenza virus
EMIWDPDGW

SEQ ID NO: 327965 - protein, 9 aa, Influenza virus
MIWDPDGWT

SEQ ID NO: 327966 - protein, 9 aa, Influenza virus
TDWSGYSGS

SEQ ID NO: 327967 - protein, 9 aa, Influenza virus
DWSGYSGSF

SEQ ID NO: 327968 - protein, 9 aa, Influenza virus
VQHPELTGM

SEQ ID NO: 327969 - protein, 9 aa, Influenza virus
QHPELTGMN

SEQ ID NO: 327970 - protein, 9 aa, Influenza virus
HPELTGMNC

SEQ ID NO: 327971 - protein, 9 aa, Influenza virus
PELTGLDCM

SEQ ID NO: 327972 - protein, 9 aa, Influenza virus
DCMRPCFWV

SEQ ID NO: 327973 - protein, 9 aa, Influenza virus
CMRPCFWVE

SEQ ID NO: 327974 - protein, 9 aa, Influenza virus
MRPCFWVEL

SEQ ID NO: 327975 - protein, 9 aa, Influenza virus
RPCFWVELV

SEQ ID NO: 327976 - protein, 9 aa, Influenza virus
PCFWVELVR

SEQ ID NO: 327977 - protein, 9 aa, Influenza virus
CFWVELVRG

SEQ ID NO: 327978 - protein, 9 aa, Influenza virus
FWVELVRGL

SEQ ID NO: 327979 - protein, 9 aa, Influenza virus
WVELVRGLP

SEQ ID NO: 327980 - protein, 9 aa, Influenza virus
ATIWTSGSS

SEQ ID NO: 327981 - protein, 9 aa, Influenza virus
TIWASGSSI

SEQ ID NO: 327982 - protein, 9 aa, Influenza virus
IWASGSSIS

SEQ ID NO: 327983 - protein, 9 aa, Influenza virus
WASGSSISF

SEQ ID NO: 327984 - protein, 9 aa, Influenza virus
ASGSSISFC

SEQ ID NO: 327985 - protein, 9 aa, Influenza virus
SASSISFCG

SEQ ID NO: 327986 - protein, 9 aa, Influenza virus
GSIISFCGV

SEQ ID NO: 327987 - protein, 9 aa, Influenza virus
SSISFCGVD

SEQ ID NO: 327988 - protein, 9 aa, Influenza virus
SISFCGVDS

SEQ ID NO: 327989 - protein, 9 aa, Influenza virus
NWSWPDGAE

SEQ ID NO: 327990 - protein, 9 aa, Influenza virus
WSWPDGADL

SEQ ID NO: 327991 - protein, 9 aa, Influenza virus
SWPDGADLP

SEQ ID NO: 327992 - protein, 9 aa, Influenza virus
WPDGADLPF

SEQ ID NO: 327993 - protein, 9 aa, Influenza virus
PDGADLPFT

SEQ ID NO: 327994 - protein, 9 aa, Influenza virus
DGADLPFTI

SEQ ID NO: 327995 - protein, 9 aa, Influenza virus
DTLCIGYHA

SEQ ID NO: 327996 - protein, 9 aa, Influenza virus
TLCIGYHAN

SEQ ID NO: 327997 - protein, 9 aa, Influenza virus
LCIGYHANN

SEQ ID NO: 327998 - protein, 9 aa, Influenza virus
CVGYHANNS

SEQ ID NO: 327999 - protein, 9 aa, Influenza virus
VGYHANNST

SEQ ID NO: 328000 - protein, 9 aa, Influenza virus
GYHANNSTE

SEQ ID NO: 328001 - protein, 9 aa, Influenza virus
YHANNSTET

SEQ ID NO: 328002 - protein, 9 aa, Influenza virus
HANNSTETV

SEQ ID NO: 328003 - protein, 9 aa, Influenza virus
ANNSTETVD

SEQ ID NO: 328004 - protein, 9 aa, Influenza virus
NNSTETVDT

SEQ ID NO: 328005 - protein, 9 aa, Influenza virus
KNITVTHSV

SEQ ID NO: 328006 - protein, 9 aa, Influenza virus
NITVTHSVN

SEQ ID NO: 328007 - protein, 9 aa, Influenza virus
ITVTHSVNL

SEQ ID NO: 328008 - protein, 9 aa, Influenza virus
TVTHSINLL

SEQ ID NO: 328009 - protein, 9 aa, Influenza virus
VTHSINLLE

SEQ ID NO: 328010 - protein, 9 aa, Influenza virus
IAGWLLGNP

SEQ ID NO: 328011 - protein, 9 aa, Influenza virus
GWLLGNPEC

SEQ ID NO: 328012 - protein, 9 aa, Influenza virus
YEELREHLS

SEQ ID NO: 328013 - protein, 9 aa, Influenza virus
PFQNIHPVT

SEQ ID NO: 328014 - protein, 9 aa, Influenza virus
FQNIHPVTI

SEQ ID NO: 328015 - protein, 9 aa, Influenza virus
QNIHPVTIG

SEQ ID NO: 328016 - protein, 9 aa, Influenza virus
HPITIGECP

SEQ ID NO: 328017 - protein, 9 aa, Influenza virus
PITIGECPK

SEQ ID NO: 328018 - protein, 9 aa, Influenza virus
ITIGECPKY

SEQ ID NO: 328019 - protein, 9 aa, Influenza virus
TIGKCPKYV

SEQ ID NO: 328020 - protein, 9 aa, Influenza virus
IGECPKYVR

SEQ ID NO: 328021 - protein, 9 aa, Influenza virus
GECPKYVRS

SEQ ID NO: 328022 - protein, 9 aa, Influenza virus
LRMATGLRN

SEQ ID NO: 328023 - protein, 9 aa, Influenza virus
SIQSKGLFG

SEQ ID NO: 328024 - protein, 9 aa, Influenza virus
IHSRGLFGA

SEQ ID NO: 328025 - protein, 9 aa, Influenza virus
QTRGLFGAI

SEQ ID NO: 328026 - protein, 9 aa, Influenza virus
SKGLFGAIA

SEQ ID NO: 328027 - protein, 9 aa, Influenza virus
IEGGWTGMV

SEQ ID NO: 328028 - protein, 9 aa, Influenza virus
EGGWTGMVD

SEQ ID NO: 328029 - protein, 9 aa, Influenza virus
GGWTGMVDG

SEQ ID NO: 328030 - protein, 9 aa, Influenza virus
GWTGMVDGW

SEQ ID NO: 328031 - protein, 9 aa, Influenza virus
WTGMVDGWY

SEQ ID NO: 328032 - protein, 9 aa, Influenza virus
TGMVDGWYG

SEQ ID NO: 328033 - protein, 9 aa, Influenza virus
GMVDGWYGY

SEQ ID NO: 328034 - protein, 9 aa, Influenza virus
NEQGSGFAA

SEQ ID NO: 328035 - protein, 9 aa, Influenza virus
EQGSGFAAD

SEQ ID NO: 328036 - protein, 9 aa, Influenza virus
ESLNNKVDD

SEQ ID NO: 328037 - protein, 9 aa, Influenza virus
NLNKKIDDG

SEQ ID NO: 328038 - protein, 9 aa, Influenza virus
LNKKVDDGL

SEQ ID NO: 328039 - protein, 9 aa, Influenza virus
DVWTYNAEL

SEQ ID NO: 328040 - protein, 9 aa, Influenza virus
VWTYNAELL

SEQ ID NO: 328041 - protein, 9 aa, Influenza virus
WTYNAELLI

SEQ ID NO: 328042 - protein, 9 aa, Influenza virus
TYNAELLIL

SEQ ID NO: 328043 - protein, 9 aa, Influenza virus
YNAELLILL

SEQ ID NO: 328044 - protein, 9 aa, Influenza virus
NAELLILLE

SEQ ID NO: 328045 - protein, 9 aa, Influenza virus
AELLILLEN

SEQ ID NO: 328046 - protein, 9 aa, Influenza virus
ELLILLENE

SEQ ID NO: 328047 - protein, 9 aa, Influenza virus
LLILLENER

SEQ ID NO: 328048 - protein, 9 aa, Influenza virus
LILLENERT

SEQ ID NO: 328049 - protein, 9 aa, Influenza virus
ILLENERTL

SEQ ID NO: 328050 - protein, 9 aa, Influenza virus
LENERTLDY

SEQ ID NO: 328051 - protein, 9 aa, Influenza virus
ENERTLDYH

SEQ ID NO: 328052 - protein, 9 aa, Influenza virus
NERTLDYHD

SEQ ID NO: 328053 - protein, 9 aa, Influenza virus
ERTLDYHDS

SEQ ID NO: 328054 - protein, 9 aa, Influenza virus
RTLDYHDSN

SEQ ID NO: 328055 - protein, 9 aa, Influenza virus
TLDYHDSNV

SEQ ID NO: 328056 - protein, 9 aa, Influenza virus
NNAKELGNG

SEQ ID NO: 328057 - protein, 9 aa, Influenza virus
NAKELGNGC

SEQ ID NO: 328058 - protein, 9 aa, Influenza virus
AKELGNGCF

SEQ ID NO: 328059 - protein, 9 aa, Influenza virus
KELGNGCFE

SEQ ID NO: 328060 - protein, 9 aa, Influenza virus
ELGNGCFEF

SEQ ID NO: 328061 - protein, 9 aa, Influenza virus
LGNGCFEFY

SEQ ID NO: 328062 - protein, 9 aa, Influenza virus
NGCFEFYHR

SEQ ID NO: 328063 - protein, 9 aa, Influenza virus
GCFEFYHRC

SEQ ID NO: 328064 - protein, 9 aa, Influenza virus
CFEFYHKCD

SEQ ID NO: 328065 - protein, 9 aa, Influenza virus
FEFYHKCDD

SEQ ID NO: 328066 - protein, 9 aa, Influenza virus
CMDSVKNGT

SEQ ID NO: 328067 - protein, 9 aa, Influenza virus
MDSVKNGTY

SEQ ID NO: 328068 - protein, 9 aa, Influenza virus
SVRNGTYDY

SEQ ID NO: 328069 - protein, 9 aa, Influenza virus
CFWMCSNGS

SEQ ID NO: 328070 - protein, 9 aa, Influenza virus
FWMCPNGSL

SEQ ID NO: 328071 - protein, 9 aa, Influenza virus
WMCPNGSLQ

SEQ ID NO: 328072 - protein, 9 aa, Influenza virus
MCSNGSLHG

SEQ ID NO: 328073 - protein, 9 aa, Influenza virus
CSNGSLQCK

SEQ ID NO: 328074 - protein, 9 aa, Influenza virus
SNGSLQCKI

SEQ ID NO: 328075 - protein, 9 aa, Influenza virus
NGSLQCKIC

SEQ ID NO: 328076 - protein, 9 aa, Influenza virus
GSLQCKICI

SEQ ID NO: 328077 - protein, 9 aa, Influenza virus
KNNQVILCG

SEQ ID NO: 328078 - protein, 9 aa, Influenza virus
YRNWSMPQC

SEQ ID NO: 328079 - protein, 9 aa, Influenza virus
IKGFAPFSK

SEQ ID NO: 328080 - protein, 9 aa, Influenza virus
KGFAPFSKD

SEQ ID NO: 328081 - protein, 9 aa, Influenza virus
DNSIRLSAS

SEQ ID NO: 328082 - protein, 9 aa, Influenza virus
NSIRLSASG

SEQ ID NO: 328083 - protein, 9 aa, Influenza virus
SIRLSAGGA

SEQ ID NO: 328084 - protein, 9 aa, Influenza virus
IRLSAGGAI

SEQ ID NO: 328085 - protein, 9 aa, Influenza virus
RLSAGGAIW

SEQ ID NO: 328086 - protein, 9 aa, Influenza virus
LSAGGAIWV

SEQ ID NO: 328087 - protein, 9 aa, Influenza virus
SAGGAIWVT

SEQ ID NO: 328088 - protein, 9 aa, Influenza virus
AGGAIWVTR

SEQ ID NO: 328089 - protein, 9 aa, Influenza virus
GGAIWVTRE

SEQ ID NO: 328090 - protein, 9 aa, Influenza virus
GAIWVTREP

SEQ ID NO: 328091 - protein, 9 aa, Influenza virus
AIWVTREPY

SEQ ID NO: 328092 - protein, 9 aa, Influenza virus
IWITREPYV

SEQ ID NO: 328093 - protein, 9 aa, Influenza virus
WITREPYVS

SEQ ID NO: 328094 - protein, 9 aa, Influenza virus
ITREPYVSC

SEQ ID NO: 328095 - protein, 9 aa, Influenza virus
TREPYVSCE

SEQ ID NO: 328096 - protein, 9 aa, Influenza virus
RCYQFALGQ

SEQ ID NO: 328097 - protein, 9 aa, Influenza virus
ALGQGTTLD

SEQ ID NO: 328098 - protein, 9 aa, Influenza virus
LGQGTTLDN

SEQ ID NO: 328099 - protein, 9 aa, Influenza virus
DRTPHRTLL

SEQ ID NO: 328100 - protein, 9 aa, Influenza virus
RTPHRTLLM

SEQ ID NO: 328101 - protein, 9 aa, Influenza virus
PHRTLLMNE

SEQ ID NO: 328102 - protein, 9 aa, Influenza virus
HRTLLMNEL

SEQ ID NO: 328103 - protein, 9 aa, Influenza virus
RTLLMSELG

SEQ ID NO: 328104 - protein, 9 aa, Influenza virus
TLLMNELGI

SEQ ID NO: 328105 - protein, 9 aa, Influenza virus
LLMNELGIP

SEQ ID NO: 328106 - protein, 9 aa, Influenza virus
LMNELGIPF

SEQ ID NO: 328107 - protein, 9 aa, Influenza virus
MNELGIPFH

SEQ ID NO: 328108 - protein, 9 aa, Influenza virus
NELGIPFHL

SEQ ID NO: 328109 - protein, 9 aa, Influenza virus
ELGIPFHLG

SEQ ID NO: 328110 - protein, 9 aa, Influenza virus
LGIPFHLGT

SEQ ID NO: 328111 - protein, 9 aa, Influenza virus
GVPFHLGTR

SEQ ID NO: 328112 - protein, 9 aa, Influenza virus
PFHLGTRQV

SEQ ID NO: 328113 - protein, 9 aa, Influenza virus
FHLGTRQVC

SEQ ID NO: 328114 - protein, 9 aa, Influenza virus
LGTRQVCIA

SEQ ID NO: 328115 - protein, 9 aa, Influenza virus
GTRQVCIAW

SEQ ID NO: 328116 - protein, 9 aa, Influenza virus
TRQVCIAWS

SEQ ID NO: 328117 - protein, 9 aa, Influenza virus
RQVCIAWSS

SEQ ID NO: 328118 - protein, 9 aa, Influenza virus
QVCMAWSSS

SEQ ID NO: 328119 - protein, 9 aa, Influenza virus
VCMAWSSSS

SEQ ID NO: 328120 - protein, 9 aa, Influenza virus
CMAWSSSSC

SEQ ID NO: 328121 - protein, 9 aa, Influenza virus
MAWSSSSCH

SEQ ID NO: 328122 - protein, 9 aa, Influenza virus
AWSSSSCYD

SEQ ID NO: 328123 - protein, 9 aa, Influenza virus
WSSSSCYDG

SEQ ID NO: 328124 - protein, 9 aa, Influenza virus
SSSSCYDGK

SEQ ID NO: 328125 - protein, 9 aa, Influenza virus
SSSCYDGKA

SEQ ID NO: 328126 - protein, 9 aa, Influenza virus
SSCYDGKAW

SEQ ID NO: 328127 - protein, 9 aa, Influenza virus
SCYDGKAWL

SEQ ID NO: 328128 - protein, 9 aa, Influenza virus
CYDGKAWLH

SEQ ID NO: 328129 - protein, 9 aa, Influenza virus
YDGKAWLHV

SEQ ID NO: 328130 - protein, 9 aa, Influenza virus
DGRAWLHVC

SEQ ID NO: 328131 - protein, 9 aa, Influenza virus
AWLHVCITG

SEQ ID NO: 328132 - protein, 9 aa, Influenza virus
KILRTQESE

SEQ ID NO: 328133 - protein, 9 aa, Influenza virus
ILRTHESEC

SEQ ID NO: 328134 - protein, 9 aa, Influenza virus
LRTQESECI

SEQ ID NO: 328135 - protein, 9 aa, Influenza virus
RTQESECIC

SEQ ID NO: 328136 - protein, 9 aa, Influenza virus
TQESECICI

SEQ ID NO: 328137 - protein, 9 aa, Influenza virus
ICTVVMTDG

SEQ ID NO: 328138 - protein, 9 aa, Influenza virus
CAVVMTDGS

SEQ ID NO: 328139 - protein, 9 aa, Influenza virus
AVVMTDGSA

SEQ ID NO: 328140 - protein, 9 aa, Influenza virus
VIMTDGSAS

SEQ ID NO: 328141 - protein, 9 aa, Influenza virus
IMTDGSASG

SEQ ID NO: 328142 - protein, 9 aa, Influenza virus
GSAQHIEEC

SEQ ID NO: 328143 - protein, 9 aa, Influenza virus
SAQHIEECS

SEQ ID NO: 328144 - protein, 9 aa, Influenza virus
AQHIEECSC

SEQ ID NO: 328145 - protein, 9 aa, Influenza virus
QHIEECSCY

SEQ ID NO: 328146 - protein, 9 aa, Influenza virus
HIEECSCYP

SEQ ID NO: 328147 - protein, 9 aa, Influenza virus
IEECSCYPR

SEQ ID NO: 328148 - protein, 9 aa, Influenza virus
EECSCYPRF

SEQ ID NO: 328149 - protein, 9 aa, Influenza virus
ECSCYPRFP

SEQ ID NO: 328150 - protein, 9 aa, Influenza virus
VRCICRDNW

SEQ ID NO: 328151 - protein, 9 aa, Influenza virus
RCICRDNWK

SEQ ID NO: 328152 - protein, 9 aa, Influenza virus
CICRDNWKG

SEQ ID NO: 328153 - protein, 9 aa, Influenza virus
ICRDNWKGS

SEQ ID NO: 328154 - protein, 9 aa, Influenza virus
CRDNWRGSN

SEQ ID NO: 328155 - protein, 9 aa, Influenza virus
RDNWRGSNR

SEQ ID NO: 328156 - protein, 9 aa, Influenza virus
DNWRGSNRP

SEQ ID NO: 328157 - protein, 9 aa, Influenza virus
NWKGSNRPV

SEQ ID NO: 328158 - protein, 9 aa, Influenza virus
WKGSNRPVV

SEQ ID NO: 328159 - protein, 9 aa, Influenza virus
KGSNRPVVD

SEQ ID NO: 328160 - protein, 9 aa, Influenza virus
GSNRPVVDI

SEQ ID NO: 328161 - protein, 9 aa, Influenza virus
SSYMCSGLV

SEQ ID NO: 328162 - protein, 9 aa, Influenza virus
SYMCSGLVG

SEQ ID NO: 328163 - protein, 9 aa, Influenza virus
YMCSGLVGD

SEQ ID NO: 328164 - protein, 9 aa, Influenza virus
MCSGLVGDT

SEQ ID NO: 328165 - protein, 9 aa, Influenza virus
GNHGVKGWA

SEQ ID NO: 328166 - protein, 9 aa, Influenza virus
NHGVKGWAF

SEQ ID NO: 328167 - protein, 9 aa, Influenza virus
PGVKGWAFD

SEQ ID NO: 328168 - protein, 9 aa, Influenza virus
GVKGWAFDN

SEQ ID NO: 328169 - protein, 9 aa, Influenza virus
RLGYETFKV

SEQ ID NO: 328170 - protein, 9 aa, Influenza virus
LGYETFKVI

SEQ ID NO: 328171 - protein, 9 aa, Influenza virus
WSGYSGIFS

SEQ ID NO: 328172 - protein, 9 aa, Influenza virus
SGYSGVFSV

SEQ ID NO: 328173 - protein, 9 aa, Influenza virus
GYSGVFSVE

SEQ ID NO: 328174 - protein, 9 aa, Influenza virus
NCINRCFYV

SEQ ID NO: 328175 - protein, 9 aa, Influenza virus
YVELIRGRR

SEQ ID NO: 328176 - protein, 9 aa, Influenza virus
VLWTSNSIV

SEQ ID NO: 328177 - protein, 9 aa, Influenza virus
LWTSNSIVV

SEQ ID NO: 328178 - protein, 9 aa, Influenza virus
WTSNSVVVF

SEQ ID NO: 328179 - protein, 9 aa, Influenza virus
TSNSVVVFC

SEQ ID NO: 328180 - protein, 9 aa, Influenza virus
SNSIVAFCG

SEQ ID NO: 328181 - protein, 9 aa, Influenza virus
NSVVVFCGT

SEQ ID NO: 328182 - protein, 9 aa, Influenza virus
SIVVFCGTP

SEQ ID NO: 328183 - protein, 9 aa, Influenza virus
IVVFCGASG

SEQ ID NO: 328184 - protein, 9 aa, Influenza virus
VEFCGTSGT

SEQ ID NO: 328185 - protein, 9 aa, Influenza virus
AFCGTSGTY

SEQ ID NO: 328186 - protein, 9 aa, Influenza virus
FCGTSGIYG

SEQ ID NO: 328187 - protein, 9 aa, Influenza virus
GTYGTGTWP

SEQ ID NO: 328188 - protein, 9 aa, Influenza virus
TYGTGTWPD

SEQ ID NO: 328189 - protein, 9 aa, Influenza virus
YGTGTWPDG

SEQ ID NO: 328190 - protein, 9 aa, Influenza virus
GTGTWPDGA

SEQ ID NO: 328191 - protein, 9 aa, Influenza virus
GSWPDGANI

SEQ ID NO: 328192 - protein, 9 aa, Influenza virus
MDNQTKKMT

SEQ ID NO: 328193 - protein, 9 aa, Influenza virus
DKQTKTMTI

SEQ ID NO: 328194 - protein, 9 aa, Influenza virus
KQTKTMTIT

SEQ ID NO: 328195 - protein, 9 aa, Influenza virus
QTKKMTITF

SEQ ID NO: 328196 - protein, 9 aa, Influenza virus
TKKMTITFL

SEQ ID NO: 328197 - protein, 9 aa, Influenza virus
KKMTITFLI

SEQ ID NO: 328198 - protein, 9 aa, Influenza virus
KMTITFLIL

SEQ ID NO: 328199 - protein, 9 aa, Influenza virus
GDQICVGYH

SEQ ID NO: 328200 - protein, 9 aa, Influenza virus
DQICIGYHS

SEQ ID NO: 328201 - protein, 9 aa, Influenza virus
QICIGYHSN

SEQ ID NO: 328202 - protein, 9 aa, Influenza virus
ICIGYHSNN

SEQ ID NO: 328203 - protein, 9 aa, Influenza virus
CIGYHSNNS

SEQ ID NO: 328204 - protein, 9 aa, Influenza virus
IGYHSNNST

SEQ ID NO: 328205 - protein, 9 aa, Influenza virus
GYHSNNSTE

SEQ ID NO: 328206 - protein, 9 aa, Influenza virus
YHSNNSTEK

SEQ ID NO: 328207 - protein, 9 aa, Influenza virus
NNSTETVDT

SEQ ID NO: 328208 - protein, 9 aa, Influenza virus
DTILEQNVT

SEQ ID NO: 328209 - protein, 9 aa, Influenza virus
TILEQNVTV

SEQ ID NO: 328210 - protein, 9 aa, Influenza virus
ILEQNVTVT

SEQ ID NO: 328211 - protein, 9 aa, Influenza virus
LEQNVTVTH

SEQ ID NO: 328212 - protein, 9 aa, Influenza virus
EQNVTVTHA

SEQ ID NO: 328213 - protein, 9 aa, Influenza virus
RNVTVTHAQ

SEQ ID NO: 328214 - protein, 9 aa, Influenza virus
NVTVTHAQD

SEQ ID NO: 328215 - protein, 9 aa, Influenza virus
VTVTHAQDI

SEQ ID NO: 328216 - protein, 9 aa, Influenza virus
TVTHAQDIL

SEQ ID NO: 328217 - protein, 9 aa, Influenza virus
VTHAQDILE

SEQ ID NO: 328218 - protein, 9 aa, Influenza virus
THAQDILEK

SEQ ID NO: 328219 - protein, 9 aa, Influenza virus
NILEKTHNG

SEQ ID NO: 328220 - protein, 9 aa, Influenza virus
ILEKVHNGK

SEQ ID NO: 328221 - protein, 9 aa, Influenza virus
LEKVHNGKL

SEQ ID NO: 328222 - protein, 9 aa, Influenza virus
EKVHNGKLC

SEQ ID NO: 328223 - protein, 9 aa, Influenza virus
THNGKLCRL

SEQ ID NO: 328224 - protein, 9 aa, Influenza virus
HNGKLCRLS

SEQ ID NO: 328225 - protein, 9 aa, Influenza virus
NGKLCRLSG

SEQ ID NO: 328226 - protein, 9 aa, Influenza virus
LSGIPPLEL

SEQ ID NO: 328227 - protein, 9 aa, Influenza virus
GIPPLELRD

SEQ ID NO: 328228 - protein, 9 aa, Influenza virus
IPPLELRDC

SEQ ID NO: 328229 - protein, 9 aa, Influenza virus
PPLELRDCS

SEQ ID NO: 328230 - protein, 9 aa, Influenza virus
PLELRDCSI

SEQ ID NO: 328231 - protein, 9 aa, Influenza virus
LELRDCSIA

SEQ ID NO: 328232 - protein, 9 aa, Influenza virus
ELRDCSIAG

SEQ ID NO: 328233 - protein, 9 aa, Influenza virus
LRDCSIAGW

SEQ ID NO: 328234 - protein, 9 aa, Influenza virus
RDCSIAGWL

SEQ ID NO: 328235 - protein, 9 aa, Influenza virus
AGWLLGNPK

SEQ ID NO: 328236 - protein, 9 aa, Influenza virus
GWLLGNPKC

SEQ ID NO: 328237 - protein, 9 aa, Influenza virus
WLLGNPKCD

SEQ ID NO: 328238 - protein, 9 aa, Influenza virus
LLGNPECDI

SEQ ID NO: 328239 - protein, 9 aa, Influenza virus
LGNPECDIL

SEQ ID NO: 328240 - protein, 9 aa, Influenza virus
GNPECDILL

SEQ ID NO: 328241 - protein, 9 aa, Influenza virus
VPEWSYIME

SEQ ID NO: 328242 - protein, 9 aa, Influenza virus
PEWSYIVEK

SEQ ID NO: 328243 - protein, 9 aa, Influenza virus
EWSYIMEKE

SEQ ID NO: 328244 - protein, 9 aa, Influenza virus
SSFFRNMVW

SEQ ID NO: 328245 - protein, 9 aa, Influenza virus
SFFRNMIWL

SEQ ID NO: 328246 - protein, 9 aa, Influenza virus
FFRNMIWLT

SEQ ID NO: 328247 - protein, 9 aa, Influenza virus
GSYNNTSGE

SEQ ID NO: 328248 - protein, 9 aa, Influenza virus
SYNNTNGEQ

SEQ ID NO: 328249 - protein, 9 aa, Influenza virus
YNNTNGEQI

SEQ ID NO: 328250 - protein, 9 aa, Influenza virus
NNTNGEQIL

SEQ ID NO: 328251 - protein, 9 aa, Influenza virus
RMEFSWTIL

SEQ ID NO: 328252 - protein, 9 aa, Influenza virus
ISFESTGNL

SEQ ID NO: 328253 - protein, 9 aa, Influenza virus
NFESTGNLV

SEQ ID NO: 328254 - protein, 9 aa, Influenza virus
FESTGNLVA

SEQ ID NO: 328255 - protein, 9 aa, Influenza virus
ESTGNLVAP

SEQ ID NO: 328256 - protein, 9 aa, Influenza virus
STGNLVAPE

SEQ ID NO: 328257 - protein, 9 aa, Influenza virus
TGNLVAPEY

SEQ ID NO: 328258 - protein, 9 aa, Influenza virus
GNLVAPEYG

SEQ ID NO: 328259 - protein, 9 aa, Influenza virus
NLVAPEYGF

SEQ ID NO: 328260 - protein, 9 aa, Influenza virus
LVAPEYGFK

SEQ ID NO: 328261 - protein, 9 aa, Influenza virus
VAPEYGFKI

SEQ ID NO: 328262 - protein, 9 aa, Influenza virus
APEYGFRIS

SEQ ID NO: 328263 - protein, 9 aa, Influenza virus
PEYGFRISK

SEQ ID NO: 328264 - protein, 9 aa, Influenza virus
EYGFRISKR

SEQ ID NO: 328265 - protein, 9 aa, Influenza virus
YGFRISKRG

SEQ ID NO: 328266 - protein, 9 aa, Influenza virus
GFKISKRGG

SEQ ID NO: 328267 - protein, 9 aa, Influenza virus
FKISKRGGS

SEQ ID NO: 328268 - protein, 9 aa, Influenza virus
KISKRGGSG

SEQ ID NO: 328269 - protein, 9 aa, Influenza virus
ISKRGGSGI

SEQ ID NO: 328270 - protein, 9 aa, Influenza virus
SKRGGSGIM

SEQ ID NO: 328271 - protein, 9 aa, Influenza virus
KRGGSGIMK

SEQ ID NO: 328272 - protein, 9 aa, Influenza virus
RGGSGIMKT

SEQ ID NO: 328273 - protein, 9 aa, Influenza virus
CETRCQTPL

SEQ ID NO: 328274 - protein, 9 aa, Influenza virus
ETRCQTPLG

SEQ ID NO: 328275 - protein, 9 aa, Influenza virus
TRCQTPLGA

SEQ ID NO: 328276 - protein, 9 aa, Influenza virus
RCQTPLGAI

SEQ ID NO: 328277 - protein, 9 aa, Influenza virus
CQTPLGALN

SEQ ID NO: 328278 - protein, 9 aa, Influenza virus
QTPLGALNT

SEQ ID NO: 328279 - protein, 9 aa, Influenza virus
TPLGALNTT

SEQ ID NO: 328280 - protein, 9 aa, Influenza virus
PLGALNTTL

SEQ ID NO: 328281 - protein, 9 aa, Influenza virus
LGALNTTLP

SEQ ID NO: 328282 - protein, 9 aa, Influenza virus
GALNTTLPF

SEQ ID NO: 328283 - protein, 9 aa, Influenza virus
ALNTTLPFH

SEQ ID NO: 328284 - protein, 9 aa, Influenza virus
LNTTLPFHN

SEQ ID NO: 328285 - protein, 9 aa, Influenza virus
NTTLPFHNV

SEQ ID NO: 328286 - protein, 9 aa, Influenza virus
TTLPFHNVH

SEQ ID NO: 328287 - protein, 9 aa, Influenza virus
TLPFHNVHP

SEQ ID NO: 328288 - protein, 9 aa, Influenza virus
LPFHNVHPL

SEQ ID NO: 328289 - protein, 9 aa, Influenza virus
PFHNVHPLT

SEQ ID NO: 328290 - protein, 9 aa, Influenza virus
FHNVHPLTI

SEQ ID NO: 328291 - protein, 9 aa, Influenza virus
HNVHPLTIG

SEQ ID NO: 328292 - protein, 9 aa, Influenza virus
NVHPLTIGE

SEQ ID NO: 328293 - protein, 9 aa, Influenza virus
VHPLTIGEC

SEQ ID NO: 328294 - protein, 9 aa, Influenza virus
HPLAIGECP

SEQ ID NO: 328295 - protein, 9 aa, Influenza virus
PLAIGECPK

SEQ ID NO: 328296 - protein, 9 aa, Influenza virus
LAIGECPKY

SEQ ID NO: 328297 - protein, 9 aa, Influenza virus
AIGECPKYV

SEQ ID NO: 328298 - protein, 9 aa, Influenza virus
IGECPKYIK

SEQ ID NO: 328299 - protein, 9 aa, Influenza virus
GECPKYIKS

SEQ ID NO: 328300 - protein, 9 aa, Influenza virus
LVLATGPRN

SEQ ID NO: 328301 - protein, 9 aa, Influenza virus
PQMESRGLF

SEQ ID NO: 328302 - protein, 9 aa, Influenza virus
QIEPRGLFG

SEQ ID NO: 328303 - protein, 9 aa, Influenza virus
MESRGLFGA

SEQ ID NO: 328304 - protein, 9 aa, Influenza virus
EPRGLFGAI

SEQ ID NO: 328305 - protein, 9 aa, Influenza virus
PRGLFGAIA

SEQ ID NO: 328306 - protein, 9 aa, Influenza virus
IEGGWQGMI

SEQ ID NO: 328307 - protein, 9 aa, Influenza virus
EGGWQGMID

SEQ ID NO: 328308 - protein, 9 aa, Influenza virus
GGWQGMIDG

SEQ ID NO: 328309 - protein, 9 aa, Influenza virus
GWQGMIDGW

SEQ ID NO: 328310 - protein, 9 aa, Influenza virus
WQGMIDGWY

SEQ ID NO: 328311 - protein, 9 aa, Influenza virus
QGMIDGWYG

SEQ ID NO: 328312 - protein, 9 aa, Influenza virus
GMIDGWYGY

SEQ ID NO: 328313 - protein, 9 aa, Influenza virus
MIDGWYGYH

SEQ ID NO: 328314 - protein, 9 aa, Influenza virus
IDGWYGYHH

SEQ ID NO: 328315 - protein, 9 aa, Influenza virus
YHHSNDQGA

SEQ ID NO: 328316 - protein, 9 aa, Influenza virus
HHSNDQGAG

SEQ ID NO: 328317 - protein, 9 aa, Influenza virus
HSNDQGAGY

SEQ ID NO: 328318 - protein, 9 aa, Influenza virus
SNDQGAGYA

SEQ ID NO: 328319 - protein, 9 aa, Influenza virus
NDQGAGYAA

SEQ ID NO: 328320 - protein, 9 aa, Influenza virus
DQGAGYAAD

SEQ ID NO: 328321 - protein, 9 aa, Influenza virus
QGAGYAADK

SEQ ID NO: 328322 - protein, 9 aa, Influenza virus
GAGYAADKE

SEQ ID NO: 328323 - protein, 9 aa, Influenza virus
AGYAADKES

SEQ ID NO: 328324 - protein, 9 aa, Influenza virus
GYAADKAST

SEQ ID NO: 328325 - protein, 9 aa, Influenza virus
YAADKASTQ

SEQ ID NO: 328326 - protein, 9 aa, Influenza virus
AADKESTQR

SEQ ID NO: 328327 - protein, 9 aa, Influenza virus
ADKESTQRA

SEQ ID NO: 328328 - protein, 9 aa, Influenza virus
NFVIEKMNT

SEQ ID NO: 328329 - protein, 9 aa, Influenza virus
VGKEFSNLE

SEQ ID NO: 328330 - protein, 9 aa, Influenza virus
NLEKRLENL

SEQ ID NO: 328331 - protein, 9 aa, Influenza virus
LEKRLENLN

SEQ ID NO: 328332 - protein, 9 aa, Influenza virus
EKRLENLNK

SEQ ID NO: 328333 - protein, 9 aa, Influenza virus
KRLENLNKK

SEQ ID NO: 328334 - protein, 9 aa, Influenza virus
RLENLNKKV

SEQ ID NO: 328335 - protein, 9 aa, Influenza virus
LENLNKKVE

SEQ ID NO: 328336 - protein, 9 aa, Influenza virus
ENLNKKVED

SEQ ID NO: 328337 - protein, 9 aa, Influenza virus
NLNKKVEDG

SEQ ID NO: 328338 - protein, 9 aa, Influenza virus
LNKKVEDGF

SEQ ID NO: 328339 - protein, 9 aa, Influenza virus
VWTYNVELL

SEQ ID NO: 328340 - protein, 9 aa, Influenza virus
WTYNVELLV

SEQ ID NO: 328341 - protein, 9 aa, Influenza virus
TYNVELLVL

SEQ ID NO: 328342 - protein, 9 aa, Influenza virus
YNVELLVLM

SEQ ID NO: 328343 - protein, 9 aa, Influenza virus
NVELLVLME

SEQ ID NO: 328344 - protein, 9 aa, Influenza virus
AEVLVLMEN

SEQ ID NO: 328345 - protein, 9 aa, Influenza virus
LLVLMENEM

SEQ ID NO: 328346 - protein, 9 aa, Influenza virus
LVLMENEMT

SEQ ID NO: 328347 - protein, 9 aa, Influenza virus
VLMENEMTL

SEQ ID NO: 328348 - protein, 9 aa, Influenza virus
LMENEMTLD

SEQ ID NO: 328349 - protein, 9 aa, Influenza virus
MENERTLDY

SEQ ID NO: 328350 - protein, 9 aa, Influenza virus
ENERTLDYH

SEQ ID NO: 328351 - protein, 9 aa, Influenza virus
NERTLDYHD

SEQ ID NO: 328352 - protein, 9 aa, Influenza virus
ERTLDYHDS

SEQ ID NO: 328353 - protein, 9 aa, Influenza virus
RTLDYHDSN

SEQ ID NO: 328354 - protein, 9 aa, Influenza virus
TLDYHDSNV

SEQ ID NO: 328355 - protein, 9 aa, Influenza virus
LDFHDSNVR

SEQ ID NO: 328356 - protein, 9 aa, Influenza virus
DFHDSNVRN

SEQ ID NO: 328357 - protein, 9 aa, Influenza virus
FHDSNVRNL

SEQ ID NO: 328358 - protein, 9 aa, Influenza virus
HDSNVRNLY

SEQ ID NO: 328359 - protein, 9 aa, Influenza virus
DSNVRNLYD

SEQ ID NO: 328360 - protein, 9 aa, Influenza virus
NLYNKVRMQ

SEQ ID NO: 328361 - protein, 9 aa, Influenza virus
LYNKVRMQL

SEQ ID NO: 328362 - protein, 9 aa, Influenza virus
YNKVRMQLR

SEQ ID NO: 328363 - protein, 9 aa, Influenza virus
NKVRMQLRD

SEQ ID NO: 328364 - protein, 9 aa, Influenza virus
KVRMQLKDN

SEQ ID NO: 328365 - protein, 9 aa, Influenza virus
VRMQLRDNV

SEQ ID NO: 328366 - protein, 9 aa, Influenza virus
RMQLRDNVK

SEQ ID NO: 328367 - protein, 9 aa, Influenza virus
MQLRDNVKE

SEQ ID NO: 328368 - protein, 9 aa, Influenza virus
QLRDNVKEL

SEQ ID NO: 328369 - protein, 9 aa, Influenza virus
LRDNVKELG

SEQ ID NO: 328370 - protein, 9 aa, Influenza virus
DNVKELGNG

SEQ ID NO: 328371 - protein, 9 aa, Influenza virus
NVKELGNGC

SEQ ID NO: 328372 - protein, 9 aa, Influenza virus
VKELGNGCF

SEQ ID NO: 328373 - protein, 9 aa, Influenza virus
KELGNGCFE

SEQ ID NO: 328374 - protein, 9 aa, Influenza virus
ELGNGCFEF

SEQ ID NO: 328375 - protein, 9 aa, Influenza virus
LGNGCFEFY

SEQ ID NO: 328376 - protein, 9 aa, Influenza virus
CFEFYHKCN

SEQ ID NO: 328377 - protein, 9 aa, Influenza virus
FEFYHKCDN

SEQ ID NO: 328378 - protein, 9 aa, Influenza virus
EFYHKCDNE

SEQ ID NO: 328379 - protein, 9 aa, Influenza virus
FYHKCDNEC

SEQ ID NO: 328380 - protein, 9 aa, Influenza virus
YHKCDNECM

SEQ ID NO: 328381 - protein, 9 aa, Influenza virus
HKCDDECMD

SEQ ID NO: 328382 - protein, 9 aa, Influenza virus
KCDDECMDS

SEQ ID NO: 328383 - protein, 9 aa, Influenza virus
SVRNGTYDY

SEQ ID NO: 328384 - protein, 9 aa, Influenza virus
NGTYDYSKY

SEQ ID NO: 328385 - protein, 9 aa, Influenza virus
GTYDYSKYE

SEQ ID NO: 328386 - protein, 9 aa, Influenza virus
TYDYSKYEE

SEQ ID NO: 328387 - protein, 9 aa, Influenza virus
YDYSKYEEE

SEQ ID NO: 328388 - protein, 9 aa, Influenza virus
DYSKYEEES

SEQ ID NO: 328389 - protein, 9 aa, Influenza virus
YSKYEEESK

SEQ ID NO: 328390 - protein, 9 aa, Influenza virus
SKYEEESKL

SEQ ID NO: 328391 - protein, 9 aa, Influenza virus
KYEEESKLK

SEQ ID NO: 328392 - protein, 9 aa, Influenza virus
YEEESKLKR

SEQ ID NO: 328393 - protein, 9 aa, Influenza virus
EEESKLKRN

SEQ ID NO: 328394 - protein, 9 aa, Influenza virus
EESKLKRNE

SEQ ID NO: 328395 - protein, 9 aa, Influenza virus
ESKLKRNEI

SEQ ID NO: 328396 - protein, 9 aa, Influenza virus
SKLKRNEIK

SEQ ID NO: 328397 - protein, 9 aa, Influenza virus
KLKRNEIKG

SEQ ID NO: 328398 - protein, 9 aa, Influenza virus
MGIYQILAI

SEQ ID NO: 328399 - protein, 9 aa, Influenza virus
GIYQILAIY

SEQ ID NO: 328400 - protein, 9 aa, Influenza virus
IYQILAIYA

SEQ ID NO: 328401 - protein, 9 aa, Influenza virus
GSLSLAIMM

SEQ ID NO: 328402 - protein, 9 aa, Influenza virus
SLSLAIMMA

SEQ ID NO: 328403 - protein, 9 aa, Influenza virus
LSLAIMMAG

SEQ ID NO: 328404 - protein, 9 aa, Influenza virus
SLAIMMAGI

SEQ ID NO: 328405 - protein, 9 aa, Influenza virus
LAIMMAGIS

SEQ ID NO: 328406 - protein, 9 aa, Influenza virus
AGISLWMCS

SEQ ID NO: 328407 - protein, 9 aa, Influenza virus
GISLWMCSN

SEQ ID NO: 328408 - protein, 9 aa, Influenza virus
ISLWMCSNG

SEQ ID NO: 328409 - protein, 9 aa, Influenza virus
SLWMCSNGS

SEQ ID NO: 328410 - protein, 9 aa, Influenza virus
LWMCSNGSL

SEQ ID NO: 328411 - protein, 9 aa, Influenza virus
VKGDQICIG

SEQ ID NO: 328412 - protein, 9 aa, Influenza virus
KGDQICIGY

SEQ ID NO: 328413 - protein, 9 aa, Influenza virus
GDQICVGYH

SEQ ID NO: 328414 - protein, 9 aa, Influenza virus
DQICIGYHS

SEQ ID NO: 328415 - protein, 9 aa, Influenza virus
QICIGYHSN

SEQ ID NO: 328416 - protein, 9 aa, Influenza virus
ICIGYHSNN

SEQ ID NO: 328417 - protein, 9 aa, Influenza virus
CIGYHSNNS

SEQ ID NO: 328418 - protein, 9 aa, Influenza virus
IGYHSNNST

SEQ ID NO: 328419 - protein, 9 aa, Influenza virus
GYHSNNSTE

SEQ ID NO: 328420 - protein, 9 aa, Influenza virus
YHSNNSTEK

SEQ ID NO: 328421 - protein, 9 aa, Influenza virus
NNSTETVDT

SEQ ID NO: 328422 - protein, 9 aa, Influenza virus
TVDTILERN

SEQ ID NO: 328423 - protein, 9 aa, Influenza virus
IDTILERNV

SEQ ID NO: 328424 - protein, 9 aa, Influenza virus
RNVTVTHAQ

SEQ ID NO: 328425 - protein, 9 aa, Influenza virus
NVTVTHAQD

SEQ ID NO: 328426 - protein, 9 aa, Influenza virus
VTVTHAQDI

SEQ ID NO: 328427 - protein, 9 aa, Influenza virus
TVTHAQDIL

SEQ ID NO: 328428 - protein, 9 aa, Influenza virus
VTHAQDILE

SEQ ID NO: 328429 - protein, 9 aa, Influenza virus
THAQDILEK

SEQ ID NO: 328430 - protein, 9 aa, Influenza virus
HAQDILEKT

SEQ ID NO: 328431 - protein, 9 aa, Influenza virus
AQDILEKTH

SEQ ID NO: 328432 - protein, 9 aa, Influenza virus
QDILEKTHN

SEQ ID NO: 328433 - protein, 9 aa, Influenza virus
NILEKTHNG

SEQ ID NO: 328434 - protein, 9 aa, Influenza virus
ILEKTHNGR

SEQ ID NO: 328435 - protein, 9 aa, Influenza virus
LEKAHNGKL

SEQ ID NO: 328436 - protein, 9 aa, Influenza virus
EKTHNGRLC

SEQ ID NO: 328437 - protein, 9 aa, Influenza virus
KTHNGKLCR

SEQ ID NO: 328438 - protein, 9 aa, Influenza virus
THNGKLCRL

SEQ ID NO: 328439 - protein, 9 aa, Influenza virus
HNGKLCRLS

SEQ ID NO: 328440 - protein, 9 aa, Influenza virus
NGKLCRLSG

SEQ ID NO: 328441 - protein, 9 aa, Influenza virus
GKLCRLSGI

SEQ ID NO: 328442 - protein, 9 aa, Influenza virus
KLCRLSGIP

SEQ ID NO: 328443 - protein, 9 aa, Influenza virus
LCRLSGIPP

SEQ ID NO: 328444 - protein, 9 aa, Influenza virus
CRLSGIPPL

SEQ ID NO: 328445 - protein, 9 aa, Influenza virus
RLSGIPPLE

SEQ ID NO: 328446 - protein, 9 aa, Influenza virus
LSGIPPLEL

SEQ ID NO: 328447 - protein, 9 aa, Influenza virus
SGIPPLELG

SEQ ID NO: 328448 - protein, 9 aa, Influenza virus
LELGDCSIT

SEQ ID NO: 328449 - protein, 9 aa, Influenza virus
ELGDCSITG

SEQ ID NO: 328450 - protein, 9 aa, Influenza virus
LGDCSITGW

SEQ ID NO: 328451 - protein, 9 aa, Influenza virus
GNCSIAGWL

SEQ ID NO: 328452 - protein, 9 aa, Influenza virus
DCSITGWLL

SEQ ID NO: 328453 - protein, 9 aa, Influenza virus
NPECDRLLR

SEQ ID NO: 328454 - protein, 9 aa, Influenza virus
LRVPEWSYI

SEQ ID NO: 328455 - protein, 9 aa, Influenza virus
VPEWSYIVE

SEQ ID NO: 328456 - protein, 9 aa, Influenza virus
PEWSYIVER

SEQ ID NO: 328457 - protein, 9 aa, Influenza virus
EWSYIVERE

SEQ ID NO: 328458 - protein, 9 aa, Influenza virus
WSYIVEREN

SEQ ID NO: 328459 - protein, 9 aa, Influenza virus
SYIVERENP

SEQ ID NO: 328460 - protein, 9 aa, Influenza virus
SLCYPGSFN

SEQ ID NO: 328461 - protein, 9 aa, Influenza virus
LCYPGSFNN

SEQ ID NO: 328462 - protein, 9 aa, Influenza virus
CYPGSFNNY

SEQ ID NO: 328463 - protein, 9 aa, Influenza virus
YPGSFNNYE

SEQ ID NO: 328464 - protein, 9 aa, Influenza virus
PGSFNNYEE

SEQ ID NO: 328465 - protein, 9 aa, Influenza virus
GSFNNYEEL

SEQ ID NO: 328466 - protein, 9 aa, Influenza virus
SFNNYEELK

SEQ ID NO: 328467 - protein, 9 aa, Influenza virus
FNNYEELKH

SEQ ID NO: 328468 - protein, 9 aa, Influenza virus
NNYEELKHL

SEQ ID NO: 328469 - protein, 9 aa, Influenza virus
VTHFEKVKI

SEQ ID NO: 328470 - protein, 9 aa, Influenza virus
THFEKVKIL

SEQ ID NO: 328471 - protein, 9 aa, Influenza virus
HFEKVRILP

SEQ ID NO: 328472 - protein, 9 aa, Influenza virus
FEKVKILPR

SEQ ID NO: 328473 - protein, 9 aa, Influenza virus
EKVKILPRD

SEQ ID NO: 328474 - protein, 9 aa, Influenza virus
SSFFRNMVW

SEQ ID NO: 328475 - protein, 9 aa, Influenza virus
SFFRNMIWL

SEQ ID NO: 328476 - protein, 9 aa, Influenza virus
FFRNMIWLT

SEQ ID NO: 328477 - protein, 9 aa, Influenza virus
IAKRSYNNT

SEQ ID NO: 328478 - protein, 9 aa, Influenza virus
AKRSYNNTS

SEQ ID NO: 328479 - protein, 9 aa, Influenza virus
KRSYNNTSG

SEQ ID NO: 328480 - protein, 9 aa, Influenza virus
RSYNNTSGE

SEQ ID NO: 328481 - protein, 9 aa, Influenza virus
SYNNTNGEQ

SEQ ID NO: 328482 - protein, 9 aa, Influenza virus
YNNTNGEQI

SEQ ID NO: 328483 - protein, 9 aa, Influenza virus
NNTNGEQIL

SEQ ID NO: 328484 - protein, 9 aa, Influenza virus
NTSGEQMLV

SEQ ID NO: 328485 - protein, 9 aa, Influenza virus
TSGEQMLVI

SEQ ID NO: 328486 - protein, 9 aa, Influenza virus
SGEQMLVIW

SEQ ID NO: 328487 - protein, 9 aa, Influenza virus
GEQMLVIWG

SEQ ID NO: 328488 - protein, 9 aa, Influenza virus
LIIWGIHHP

SEQ ID NO: 328489 - protein, 9 aa, Influenza virus
IWGIHHPND

SEQ ID NO: 328490 - protein, 9 aa, Influenza virus
WGIHHPNDD

SEQ ID NO: 328491 - protein, 9 aa, Influenza virus
LYQKVGTYV

SEQ ID NO: 328492 - protein, 9 aa, Influenza virus
YQKVGTYVS

SEQ ID NO: 328493 - protein, 9 aa, Influenza virus
RMEFSWTIL

SEQ ID NO: 328494 - protein, 9 aa, Influenza virus
WDVINFEST

SEQ ID NO: 328495 - protein, 9 aa, Influenza virus
DVINFESTG

SEQ ID NO: 328496 - protein, 9 aa, Influenza virus
VINFESTGN

SEQ ID NO: 328497 - protein, 9 aa, Influenza virus
ISFESTGNL

SEQ ID NO: 328498 - protein, 9 aa, Influenza virus
NFESTGNLV

SEQ ID NO: 328499 - protein, 9 aa, Influenza virus
FESTGNLVA

SEQ ID NO: 328500 - protein, 9 aa, Influenza virus
ESTGNLVAP

SEQ ID NO: 328501 - protein, 9 aa, Influenza virus
STGNLVAPE

SEQ ID NO: 328502 - protein, 9 aa, Influenza virus
TGNLVAPEY

SEQ ID NO: 328503 - protein, 9 aa, Influenza virus
GNLVAPEYG

SEQ ID NO: 328504 - protein, 9 aa, Influenza virus
NLVAPEYGF

SEQ ID NO: 328505 - protein, 9 aa, Influenza virus
LVAPEYGFK

SEQ ID NO: 328506 - protein, 9 aa, Influenza virus
VAPEYGFKI

SEQ ID NO: 328507 - protein, 9 aa, Influenza virus
APEYGFRIS

SEQ ID NO: 328508 - protein, 9 aa, Influenza virus
PEYGFKISR

SEQ ID NO: 328509 - protein, 9 aa, Influenza virus
EYGFKISRR

SEQ ID NO: 328510 - protein, 9 aa, Influenza virus
YGFRISKRG

SEQ ID NO: 328511 - protein, 9 aa, Influenza virus
GFKISKRGG

SEQ ID NO: 328512 - protein, 9 aa, Influenza virus
FKISKRGGS

SEQ ID NO: 328513 - protein, 9 aa, Influenza virus
KISKRGGSG

SEQ ID NO: 328514 - protein, 9 aa, Influenza virus
ISKRGGSGI

SEQ ID NO: 328515 - protein, 9 aa, Influenza virus
SKRGGSGIM

SEQ ID NO: 328516 - protein, 9 aa, Influenza virus
KRGGSGIMK

SEQ ID NO: 328517 - protein, 9 aa, Influenza virus
RGGSGIMKT

SEQ ID NO: 328518 - protein, 9 aa, Influenza virus
GGSGIMKTE

SEQ ID NO: 328519 - protein, 9 aa, Influenza virus
SGIMKTEKT

SEQ ID NO: 328520 - protein, 9 aa, Influenza virus
GIMKTEKTL

SEQ ID NO: 328521 - protein, 9 aa, Influenza virus
NCETKCQSP

SEQ ID NO: 328522 - protein, 9 aa, Influenza virus
CETKCQSPL

SEQ ID NO: 328523 - protein, 9 aa, Influenza virus
ETKCQSPLG

SEQ ID NO: 328524 - protein, 9 aa, Influenza virus
TKCQSPLGA

SEQ ID NO: 328525 - protein, 9 aa, Influenza virus
KCQTPLGAL

SEQ ID NO: 328526 - protein, 9 aa, Influenza virus
CQTPLGALN

SEQ ID NO: 328527 - protein, 9 aa, Influenza virus
QTPLGALNT

SEQ ID NO: 328528 - protein, 9 aa, Influenza virus
TPLGALNTT

SEQ ID NO: 328529 - protein, 9 aa, Influenza virus
PLGALNTTL

SEQ ID NO: 328530 - protein, 9 aa, Influenza virus
LGALNTTLP

SEQ ID NO: 328531 - protein, 9 aa, Influenza virus
GALNTTLPF

SEQ ID NO: 328532 - protein, 9 aa, Influenza virus
ALNTTLPFH

SEQ ID NO: 328533 - protein, 9 aa, Influenza virus
LNTTLPFHN

SEQ ID NO: 328534 - protein, 9 aa, Influenza virus
NTTLPFHNI

SEQ ID NO: 328535 - protein, 9 aa, Influenza virus
TTLPFHNIH

SEQ ID NO: 328536 - protein, 9 aa, Influenza virus
TLPFHNIHP

SEQ ID NO: 328537 - protein, 9 aa, Influenza virus
LPFHNIHPL

SEQ ID NO: 328538 - protein, 9 aa, Influenza virus
PFHNIHPLT

SEQ ID NO: 328539 - protein, 9 aa, Influenza virus
FHNIHPLTI

SEQ ID NO: 328540 - protein, 9 aa, Influenza virus
HNIHPLTIG

SEQ ID NO: 328541 - protein, 9 aa, Influenza virus
NIHPLTIGE

SEQ ID NO: 328542 - protein, 9 aa, Influenza virus
IHPLTIGEC

SEQ ID NO: 328543 - protein, 9 aa, Influenza virus
HPLTMGECP

SEQ ID NO: 328544 - protein, 9 aa, Influenza virus
PLTIGECPR

SEQ ID NO: 328545 - protein, 9 aa, Influenza virus
LTIGECPRY

SEQ ID NO: 328546 - protein, 9 aa, Influenza virus
TIGECPRYV

SEQ ID NO: 328547 - protein, 9 aa, Influenza virus
IGECPKYVR

SEQ ID NO: 328548 - protein, 9 aa, Influenza virus
GECPKYVRS

SEQ ID NO: 328549 - protein, 9 aa, Influenza virus
ECPKYVKSD

SEQ ID NO: 328550 - protein, 9 aa, Influenza virus
CPKYVKSDR

SEQ ID NO: 328551 - protein, 9 aa, Influenza virus
PKYVKSDRL

SEQ ID NO: 328552 - protein, 9 aa, Influenza virus
KYVKSDRLV

SEQ ID NO: 328553 - protein, 9 aa, Influenza virus
YVKSDRLVL

SEQ ID NO: 328554 - protein, 9 aa, Influenza virus
VKSDRLVLA

SEQ ID NO: 328555 - protein, 9 aa, Influenza virus
KSDRLVLAT

SEQ ID NO: 328556 - protein, 9 aa, Influenza virus
SDRLVLATG

SEQ ID NO: 328557 - protein, 9 aa, Influenza virus
DRLVLATGL

SEQ ID NO: 328558 - protein, 9 aa, Influenza virus
RLVLATGLR

SEQ ID NO: 328559 - protein, 9 aa, Influenza virus
LVLATGPRN

SEQ ID NO: 328560 - protein, 9 aa, Influenza virus
VLATGLRNI

SEQ ID NO: 328561 - protein, 9 aa, Influenza virus
LATGLRNIP

SEQ ID NO: 328562 - protein, 9 aa, Influenza virus
ATGLRNIPQ

SEQ ID NO: 328563 - protein, 9 aa, Influenza virus
TGLRNIPQI

SEQ ID NO: 328564 - protein, 9 aa, Influenza virus
GLRNIPQIE

SEQ ID NO: 328565 - protein, 9 aa, Influenza virus
RNIPQIESR

SEQ ID NO: 328566 - protein, 9 aa, Influenza virus
NIPQIESRG

SEQ ID NO: 328567 - protein, 9 aa, Influenza virus
IPQIESRGL

SEQ ID NO: 328568 - protein, 9 aa, Influenza virus
PQMESRGLF

SEQ ID NO: 328569 - protein, 9 aa, Influenza virus
QMESRGLFG

SEQ ID NO: 328570 - protein, 9 aa, Influenza virus
MESRGLFGA

SEQ ID NO: 328571 - protein, 9 aa, Influenza virus
EPRGLFGAI

SEQ ID NO: 328572 - protein, 9 aa, Influenza virus
PRGLFGAIA

SEQ ID NO: 328573 - protein, 9 aa, Influenza virus
IEGGWQGMI

SEQ ID NO: 328574 - protein, 9 aa, Influenza virus
EGGWQGMID

SEQ ID NO: 328575 - protein, 9 aa, Influenza virus
GGWQGMIDG

SEQ ID NO: 328576 - protein, 9 aa, Influenza virus
GWQGMIDGW

SEQ ID NO: 328577 - protein, 9 aa, Influenza virus
WQGMIDGWY

SEQ ID NO: 328578 - protein, 9 aa, Influenza virus
QGMIDGWYG

SEQ ID NO: 328579 - protein, 9 aa, Influenza virus
GMIDGWYGY

SEQ ID NO: 328580 - protein, 9 aa, Influenza virus
MIDGWYGYH

SEQ ID NO: 328581 - protein, 9 aa, Influenza virus
IDGWYGYHH

SEQ ID NO: 328582 - protein, 9 aa, Influenza virus
YHHSNDQGA

SEQ ID NO: 328583 - protein, 9 aa, Influenza virus
HHSNDQGAG

SEQ ID NO: 328584 - protein, 9 aa, Influenza virus
HSNDQGAGY

SEQ ID NO: 328585 - protein, 9 aa, Influenza virus
SNDQGAGYA

SEQ ID NO: 328586 - protein, 9 aa, Influenza virus
NDQGAGYAA

SEQ ID NO: 328587 - protein, 9 aa, Influenza virus
DQGAGYAAD

SEQ ID NO: 328588 - protein, 9 aa, Influenza virus
QGAGYAADK

SEQ ID NO: 328589 - protein, 9 aa, Influenza virus
GSGYAADKA

SEQ ID NO: 328590 - protein, 9 aa, Influenza virus
SGYAADKAS

SEQ ID NO: 328591 - protein, 9 aa, Influenza virus
GYAADKAST

SEQ ID NO: 328592 - protein, 9 aa, Influenza virus
YAADKASTQ

SEQ ID NO: 328593 - protein, 9 aa, Influenza virus
AADKASTQK

SEQ ID NO: 328594 - protein, 9 aa, Influenza virus
ADKASTQKA

SEQ ID NO: 328595 - protein, 9 aa, Influenza virus
DKESTQKAI

SEQ ID NO: 328596 - protein, 9 aa, Influenza virus
VNSIIEKMN

SEQ ID NO: 328597 - protein, 9 aa, Influenza virus
NSIIEKMNT

SEQ ID NO: 328598 - protein, 9 aa, Influenza virus
SIIEKMNTQ

SEQ ID NO: 328599 - protein, 9 aa, Influenza virus
IEKMNIQFE

SEQ ID NO: 328600 - protein, 9 aa, Influenza virus
AVGKEFNNL

SEQ ID NO: 328601 - protein, 9 aa, Influenza virus
VGKEFNNLE

SEQ ID NO: 328602 - protein, 9 aa, Influenza virus
KEFSNLEKR

SEQ ID NO: 328603 - protein, 9 aa, Influenza virus
EFSNLEKRL

SEQ ID NO: 328604 - protein, 9 aa, Influenza virus
FSNLEKRLE

SEQ ID NO: 328605 - protein, 9 aa, Influenza virus
SNLEKRLEN

SEQ ID NO: 328606 - protein, 9 aa, Influenza virus
NLEKRLENL

SEQ ID NO: 328607 - protein, 9 aa, Influenza virus
LEKRLENLN

SEQ ID NO: 328608 - protein, 9 aa, Influenza virus
EKRLENLNK

SEQ ID NO: 328609 - protein, 9 aa, Influenza virus
KRLENLNKK

SEQ ID NO: 328610 - protein, 9 aa, Influenza virus
RLENLNKKV

SEQ ID NO: 328611 - protein, 9 aa, Influenza virus
LENLNKKVE

SEQ ID NO: 328612 - protein, 9 aa, Influenza virus
ENLNKKVED

SEQ ID NO: 328613 - protein, 9 aa, Influenza virus
NLNKKVEDG

SEQ ID NO: 328614 - protein, 9 aa, Influenza virus
LNKKVEDGF

SEQ ID NO: 328615 - protein, 9 aa, Influenza virus
MEDGFIDVW

SEQ ID NO: 328616 - protein, 9 aa, Influenza virus
EDGFIDVWT

SEQ ID NO: 328617 - protein, 9 aa, Influenza virus
DGFIDVWTY

SEQ ID NO: 328618 - protein, 9 aa, Influenza virus
GFIDVWTYN

SEQ ID NO: 328619 - protein, 9 aa, Influenza virus
FIDVWTYNA

SEQ ID NO: 328620 - protein, 9 aa, Influenza virus
IDVWTYNAE

SEQ ID NO: 328621 - protein, 9 aa, Influenza virus
DVWTYNTEL

SEQ ID NO: 328622 - protein, 9 aa, Influenza virus
LLVLMENEM

SEQ ID NO: 328623 - protein, 9 aa, Influenza virus
LVLMENEMT

SEQ ID NO: 328624 - protein, 9 aa, Influenza virus
VLMENEMTL

SEQ ID NO: 328625 - protein, 9 aa, Influenza virus
LMENEMTLD

SEQ ID NO: 328626 - protein, 9 aa, Influenza virus
MENEMTLDF

SEQ ID NO: 328627 - protein, 9 aa, Influenza virus
ENEMTLDFH

SEQ ID NO: 328628 - protein, 9 aa, Influenza virus
NEMTLDFHD

SEQ ID NO: 328629 - protein, 9 aa, Influenza virus
EMTLDFHDS

SEQ ID NO: 328630 - protein, 9 aa, Influenza virus
MTLDFHDSN

SEQ ID NO: 328631 - protein, 9 aa, Influenza virus
TLDFHDSSV

SEQ ID NO: 328632 - protein, 9 aa, Influenza virus
LDFHDSNVR

SEQ ID NO: 328633 - protein, 9 aa, Influenza virus
DFHDSNVKS

SEQ ID NO: 328634 - protein, 9 aa, Influenza virus
FHDSNVKSL

SEQ ID NO: 328635 - protein, 9 aa, Influenza virus
HDSNVKSLY

SEQ ID NO: 328636 - protein, 9 aa, Influenza virus
DSNVKSLYD

SEQ ID NO: 328637 - protein, 9 aa, Influenza virus
VKSLYDKVR

SEQ ID NO: 328638 - protein, 9 aa, Influenza virus
KSLYDKVRM

SEQ ID NO: 328639 - protein, 9 aa, Influenza virus
SLYDKVRMQ

SEQ ID NO: 328640 - protein, 9 aa, Influenza virus
LYNKVRMQL

SEQ ID NO: 328641 - protein, 9 aa, Influenza virus
YNKVRMQLR

SEQ ID NO: 328642 - protein, 9 aa, Influenza virus
NKVRMQLRD

SEQ ID NO: 328643 - protein, 9 aa, Influenza virus
KVRMQLKDN

SEQ ID NO: 328644 - protein, 9 aa, Influenza virus
VRMQLRDNA

SEQ ID NO: 328645 - protein, 9 aa, Influenza virus
RMQLRDNAK

SEQ ID NO: 328646 - protein, 9 aa, Influenza virus
MQLRDNAKE

SEQ ID NO: 328647 - protein, 9 aa, Influenza virus
QLRDNAKEI

SEQ ID NO: 328648 - protein, 9 aa, Influenza virus
LRDNAKEIG

SEQ ID NO: 328649 - protein, 9 aa, Influenza virus
RDNAKEIGN

SEQ ID NO: 328650 - protein, 9 aa, Influenza virus
DNAKEIGNG

SEQ ID NO: 328651 - protein, 9 aa, Influenza virus
NAKEIGNGC

SEQ ID NO: 328652 - protein, 9 aa, Influenza virus
AKEIGNGCF

SEQ ID NO: 328653 - protein, 9 aa, Influenza virus
KEIGNGCFE

SEQ ID NO: 328654 - protein, 9 aa, Influenza virus
EIGNGCFEF

SEQ ID NO: 328655 - protein, 9 aa, Influenza virus
IGNGCFEFY

SEQ ID NO: 328656 - protein, 9 aa, Influenza virus
CFEFYHKCN

SEQ ID NO: 328657 - protein, 9 aa, Influenza virus
FEFYHKCDN

SEQ ID NO: 328658 - protein, 9 aa, Influenza virus
EFYHKCDNE

SEQ ID NO: 328659 - protein, 9 aa, Influenza virus
FYHKCDNEC

SEQ ID NO: 328660 - protein, 9 aa, Influenza virus
YHKCDNECM

SEQ ID NO: 328661 - protein, 9 aa, Influenza virus
CMNSVRNGT

SEQ ID NO: 328662 - protein, 9 aa, Influenza virus
MNSVRNGTY

SEQ ID NO: 328663 - protein, 9 aa, Influenza virus
SVRNGTYDY

SEQ ID NO: 328664 - protein, 9 aa, Influenza virus
RNGTYDYPK

SEQ ID NO: 328665 - protein, 9 aa, Influenza virus
NGTYYYPKY

SEQ ID NO: 328666 - protein, 9 aa, Influenza virus
GTYYYPKYE

SEQ ID NO: 328667 - protein, 9 aa, Influenza virus
TYYYPKYEE

SEQ ID NO: 328668 - protein, 9 aa, Influenza virus
YYYPKYEEE

SEQ ID NO: 328669 - protein, 9 aa, Influenza virus
YYPKYEEES

SEQ ID NO: 328670 - protein, 9 aa, Influenza virus
YPKYEEESR

SEQ ID NO: 328671 - protein, 9 aa, Influenza virus
PKYEEESRL

SEQ ID NO: 328672 - protein, 9 aa, Influenza virus
KYEEESKLK

SEQ ID NO: 328673 - protein, 9 aa, Influenza virus
YEEESKLKR

SEQ ID NO: 328674 - protein, 9 aa, Influenza virus
EEESKLKRN

SEQ ID NO: 328675 - protein, 9 aa, Influenza virus
EESKLKRNE

SEQ ID NO: 328676 - protein, 9 aa, Influenza virus
ESKLKRNEI

SEQ ID NO: 328677 - protein, 9 aa, Influenza virus
SKLKRNEIK

SEQ ID NO: 328678 - protein, 9 aa, Influenza virus
KLKRNEIKG

SEQ ID NO: 328679 - protein, 9 aa, Influenza virus
LKRNEIKGV

SEQ ID NO: 328680 - protein, 9 aa, Influenza virus
KRNEIKGVK

SEQ ID NO: 328681 - protein, 9 aa, Influenza virus
RNEIKGVEL

SEQ ID NO: 328682 - protein, 9 aa, Influenza virus
NEIKGVELS

SEQ ID NO: 328683 - protein, 9 aa, Influenza virus
EIKGVKLSN

SEQ ID NO: 328684 - protein, 9 aa, Influenza virus
IKGVKLSNM

SEQ ID NO: 328685 - protein, 9 aa, Influenza virus
KGVKLSNMG

SEQ ID NO: 328686 - protein, 9 aa, Influenza virus
GVKLSNMGV

SEQ ID NO: 328687 - protein, 9 aa, Influenza virus
VKLSNMGVY

SEQ ID NO: 328688 - protein, 9 aa, Influenza virus
KLSNMGVYQ

SEQ ID NO: 328689 - protein, 9 aa, Influenza virus
LSNMGVYQI

SEQ ID NO: 328690 - protein, 9 aa, Influenza virus
SNMGVYQIL

SEQ ID NO: 328691 - protein, 9 aa, Influenza virus
NMGVYQILA

SEQ ID NO: 328692 - protein, 9 aa, Influenza virus
MGIYQILAI

SEQ ID NO: 328693 - protein, 9 aa, Influenza virus
GIYQILAIY

SEQ ID NO: 328694 - protein, 9 aa, Influenza virus
IYQILAIYA

SEQ ID NO: 328695 - protein, 9 aa, Influenza virus
YQVLAIYAT

SEQ ID NO: 328696 - protein, 9 aa, Influenza virus
QVLAIYATV

SEQ ID NO: 328697 - protein, 9 aa, Influenza virus
ILVIYATVA

SEQ ID NO: 328698 - protein, 9 aa, Influenza virus
GSLSLAIMI

SEQ ID NO: 328699 - protein, 9 aa, Influenza virus
SLSLAIMIA

SEQ ID NO: 328700 - protein, 9 aa, Influenza virus
LSLAIMIAG

SEQ ID NO: 328701 - protein, 9 aa, Influenza virus
SLAIMIAGI

SEQ ID NO: 328702 - protein, 9 aa, Influenza virus
LAIMIAGIS

SEQ ID NO: 328703 - protein, 9 aa, Influenza virus
AGISLWMCS

SEQ ID NO: 328704 - protein, 9 aa, Influenza virus
GISLWMCSN

SEQ ID NO: 328705 - protein, 9 aa, Influenza virus
ISLWMCSNG

SEQ ID NO: 328706 - protein, 9 aa, Influenza virus
SLWMCSNGS

SEQ ID NO: 328707 - protein, 9 aa, Influenza virus
LWMCSNGSL

SEQ ID NO: 328708 - protein, 9 aa, Influenza virus
SNGSLQFRI

SEQ ID NO: 328709 - protein, 9 aa, Influenza virus
NGSLQCRVC

SEQ ID NO: 328710 - protein, 9 aa, Influenza virus
GSLQCRVCI

SEQ ID NO: 328711 - protein, 9 aa, Influenza virus
MNPNQKTIT

SEQ ID NO: 328712 - protein, 9 aa, Influenza virus
NPNQKTITI

SEQ ID NO: 328713 - protein, 9 aa, Influenza virus
PNQKTITIG

SEQ ID NO: 328714 - protein, 9 aa, Influenza virus
NQKTITIGS

SEQ ID NO: 328715 - protein, 9 aa, Influenza virus
QKIITIGSA

SEQ ID NO: 328716 - protein, 9 aa, Influenza virus
KIITIGSAS

SEQ ID NO: 328717 - protein, 9 aa, Influenza virus
IITIGSASL

SEQ ID NO: 328718 - protein, 9 aa, Influenza virus
ITIGSASLT

SEQ ID NO: 328719 - protein, 9 aa, Influenza virus
QIAILVTTV

SEQ ID NO: 328720 - protein, 9 aa, Influenza virus
IAILVTTVT

SEQ ID NO: 328721 - protein, 9 aa, Influenza virus
AILVTTVTL

SEQ ID NO: 328722 - protein, 9 aa, Influenza virus
ILVTTVTLH

SEQ ID NO: 328723 - protein, 9 aa, Influenza virus
LVTTVTLHF

SEQ ID NO: 328724 - protein, 9 aa, Influenza virus
VTTVTLHFK

SEQ ID NO: 328725 - protein, 9 aa, Influenza virus
TTITLHFKQ

SEQ ID NO: 328726 - protein, 9 aa, Influenza virus
TVTLHFKQN

SEQ ID NO: 328727 - protein, 9 aa, Influenza virus
VTLHFKQNE

SEQ ID NO: 328728 - protein, 9 aa, Influenza virus
TLHFKQNEC

SEQ ID NO: 328729 - protein, 9 aa, Influenza virus
LHFKQNECS

SEQ ID NO: 328730 - protein, 9 aa, Influenza virus
PCEPIIVER

SEQ ID NO: 328731 - protein, 9 aa, Influenza virus
CEPIIVERN

SEQ ID NO: 328732 - protein, 9 aa, Influenza virus
TEIVYLNDT

SEQ ID NO: 328733 - protein, 9 aa, Influenza virus
EIVYLNDTI

SEQ ID NO: 328734 - protein, 9 aa, Influenza virus
YRSWSKPQC

SEQ ID NO: 328735 - protein, 9 aa, Influenza virus
WSKPQCKIT

SEQ ID NO: 328736 - protein, 9 aa, Influenza virus
SKPQCKITG

SEQ ID NO: 328737 - protein, 9 aa, Influenza virus
KPQCKITGF

SEQ ID NO: 328738 - protein, 9 aa, Influenza virus
PQCKITGFA

SEQ ID NO: 328739 - protein, 9 aa, Influenza virus
QCKITGFAP

SEQ ID NO: 328740 - protein, 9 aa, Influenza virus
CKITGFAPF

SEQ ID NO: 328741 - protein, 9 aa, Influenza virus
KITGFAPFS

SEQ ID NO: 328742 - protein, 9 aa, Influenza virus
DNSIRLSAS

SEQ ID NO: 328743 - protein, 9 aa, Influenza virus
NSIRLSASG

SEQ ID NO: 328744 - protein, 9 aa, Influenza virus
SIRLSADGD

SEQ ID NO: 328745 - protein, 9 aa, Influenza virus
IRLSADGDI

SEQ ID NO: 328746 - protein, 9 aa, Influenza virus
RLSADGDIW

SEQ ID NO: 328747 - protein, 9 aa, Influenza virus
LSAGGDIWI

SEQ ID NO: 328748 - protein, 9 aa, Influenza virus
SAGGDIWIT

SEQ ID NO: 328749 - protein, 9 aa, Influenza virus
AGGDIWITR

SEQ ID NO: 328750 - protein, 9 aa, Influenza virus
GGDIWITRE

SEQ ID NO: 328751 - protein, 9 aa, Influenza virus
GDIWITREP

SEQ ID NO: 328752 - protein, 9 aa, Influenza virus
DIWITREPY

SEQ ID NO: 328753 - protein, 9 aa, Influenza virus
IWITREPYV

SEQ ID NO: 328754 - protein, 9 aa, Influenza virus
WITREPYVS

SEQ ID NO: 328755 - protein, 9 aa, Influenza virus
ITREPYVSC

SEQ ID NO: 328756 - protein, 9 aa, Influenza virus
TREPYVSCS

SEQ ID NO: 328757 - protein, 9 aa, Influenza virus
REPYVSCDT

SEQ ID NO: 328758 - protein, 9 aa, Influenza virus
SKCYQFALG

SEQ ID NO: 328759 - protein, 9 aa, Influenza virus
YQFALGQGA

SEQ ID NO: 328760 - protein, 9 aa, Influenza virus
ALGQGTTLN

SEQ ID NO: 328761 - protein, 9 aa, Influenza virus
LGQGTTLEN

SEQ ID NO: 328762 - protein, 9 aa, Influenza virus
GQGTTLNNK

SEQ ID NO: 328763 - protein, 9 aa, Influenza virus
QGTTLENKH

SEQ ID NO: 328764 - protein, 9 aa, Influenza virus
GTTLENKHS

SEQ ID NO: 328765 - protein, 9 aa, Influenza virus
TTLENKHSN

SEQ ID NO: 328766 - protein, 9 aa, Influenza virus
TLDNKHSND

SEQ ID NO: 328767 - protein, 9 aa, Influenza virus
LDNKHSNDT

SEQ ID NO: 328768 - protein, 9 aa, Influenza virus
DNKHSNDTI

SEQ ID NO: 328769 - protein, 9 aa, Influenza virus
NKHSNDTIH

SEQ ID NO: 328770 - protein, 9 aa, Influenza virus
KHSNDTIHD

SEQ ID NO: 328771 - protein, 9 aa, Influenza virus
HSNDTIHDR

SEQ ID NO: 328772 - protein, 9 aa, Influenza virus
TVHDRIPHR

SEQ ID NO: 328773 - protein, 9 aa, Influenza virus
VHDRIPHRT

SEQ ID NO: 328774 - protein, 9 aa, Influenza virus
HDRTPHRTL

SEQ ID NO: 328775 - protein, 9 aa, Influenza virus
DRTPHRTLL

SEQ ID NO: 328776 - protein, 9 aa, Influenza virus
RTPHRTLLM

SEQ ID NO: 328777 - protein, 9 aa, Influenza virus
TPHRTLLMN

SEQ ID NO: 328778 - protein, 9 aa, Influenza virus
LLMNELGVS

SEQ ID NO: 328779 - protein, 9 aa, Influenza virus
LMNELGVSF

SEQ ID NO: 328780 - protein, 9 aa, Influenza virus
MNELGVSFH

SEQ ID NO: 328781 - protein, 9 aa, Influenza virus
NELGVSFHL

SEQ ID NO: 328782 - protein, 9 aa, Influenza virus
ELGVSFHLG

SEQ ID NO: 328783 - protein, 9 aa, Influenza virus
LGVSFHLGT

SEQ ID NO: 328784 - protein, 9 aa, Influenza virus
GVPFHLGTR

SEQ ID NO: 328785 - protein, 9 aa, Influenza virus
VPFHLGTRQ

SEQ ID NO: 328786 - protein, 9 aa, Influenza virus
PFHLGTRQV

SEQ ID NO: 328787 - protein, 9 aa, Influenza virus
FHLGTRQVC

SEQ ID NO: 328788 - protein, 9 aa, Influenza virus
HLGTRQVCI

SEQ ID NO: 328789 - protein, 9 aa, Influenza virus
LGTRQVCIA

SEQ ID NO: 328790 - protein, 9 aa, Influenza virus
GTRQVCIAW

SEQ ID NO: 328791 - protein, 9 aa, Influenza virus
TRQVCIAWS

SEQ ID NO: 328792 - protein, 9 aa, Influenza virus
RQVCIAWSS

SEQ ID NO: 328793 - protein, 9 aa, Influenza virus
QVCIAWSSS

SEQ ID NO: 328794 - protein, 9 aa, Influenza virus
VCIAWSSSS

SEQ ID NO: 328795 - protein, 9 aa, Influenza virus
CIAWSSSSC

SEQ ID NO: 328796 - protein, 9 aa, Influenza virus
IAWSSSSCH

SEQ ID NO: 328797 - protein, 9 aa, Influenza virus
SSSSCHDGR

SEQ ID NO: 328798 - protein, 9 aa, Influenza virus
SSSCHDGRA

SEQ ID NO: 328799 - protein, 9 aa, Influenza virus
SSCHDGRAW

SEQ ID NO: 328800 - protein, 9 aa, Influenza virus
SCHDGRAWL

SEQ ID NO: 328801 - protein, 9 aa, Influenza virus
CHDGRAWLH

SEQ ID NO: 328802 - protein, 9 aa, Influenza virus
HDGRAWLHV

SEQ ID NO: 328803 - protein, 9 aa, Influenza virus
DGRAWLHVC

SEQ ID NO: 328804 - protein, 9 aa, Influenza virus
GKAWLHVCI

SEQ ID NO: 328805 - protein, 9 aa, Influenza virus
KAWLHVCIT

SEQ ID NO: 328806 - protein, 9 aa, Influenza virus
AWLHVCITG

SEQ ID NO: 328807 - protein, 9 aa, Influenza virus
WLHVCITGD

SEQ ID NO: 328808 - protein, 9 aa, Influenza virus
LHVCITGDD

SEQ ID NO: 328809 - protein, 9 aa, Influenza virus
CVTGDDKNA

SEQ ID NO: 328810 - protein, 9 aa, Influenza virus
VTGDDKNAT

SEQ ID NO: 328811 - protein, 9 aa, Influenza virus
TGDDKNATA

SEQ ID NO: 328812 - protein, 9 aa, Influenza virus
GDDKNATAS

SEQ ID NO: 328813 - protein, 9 aa, Influenza virus
DDKNATASF

SEQ ID NO: 328814 - protein, 9 aa, Influenza virus
DKNATASFI

SEQ ID NO: 328815 - protein, 9 aa, Influenza virus
KNATASFIY

SEQ ID NO: 328816 - protein, 9 aa, Influenza virus
NATASFIYN

SEQ ID NO: 328817 - protein, 9 aa, Influenza virus
ATASFIYNG

SEQ ID NO: 328818 - protein, 9 aa, Influenza virus
DSIVSWSQN

SEQ ID NO: 328819 - protein, 9 aa, Influenza virus
SIVSWSQNI

SEQ ID NO: 328820 - protein, 9 aa, Influenza virus
IVSWSQNIL

SEQ ID NO: 328821 - protein, 9 aa, Influenza virus
VSWSQNILR

SEQ ID NO: 328822 - protein, 9 aa, Influenza virus
WSHNILRTQ

SEQ ID NO: 328823 - protein, 9 aa, Influenza virus
SQNILRTHE

SEQ ID NO: 328824 - protein, 9 aa, Influenza virus
HNILRTQES

SEQ ID NO: 328825 - protein, 9 aa, Influenza virus
LRTHESECV

SEQ ID NO: 328826 - protein, 9 aa, Influenza virus
RTHESECVC

SEQ ID NO: 328827 - protein, 9 aa, Influenza virus
TQESECICI

SEQ ID NO: 328828 - protein, 9 aa, Influenza virus
QESECVCIS

SEQ ID NO: 328829 - protein, 9 aa, Influenza virus
ESECVCISG

SEQ ID NO: 328830 - protein, 9 aa, Influenza virus
SECVCINGS

SEQ ID NO: 328831 - protein, 9 aa, Influenza virus
ECVCINGSC

SEQ ID NO: 328832 - protein, 9 aa, Influenza virus
CVCINGSCT

SEQ ID NO: 328833 - protein, 9 aa, Influenza virus
VCINGSCTV

SEQ ID NO: 328834 - protein, 9 aa, Influenza virus
CINGSCTVV

SEQ ID NO: 328835 - protein, 9 aa, Influenza virus
INGSCTVVM

SEQ ID NO: 328836 - protein, 9 aa, Influenza virus
NGSCTVVMT

SEQ ID NO: 328837 - protein, 9 aa, Influenza virus
GSCTVVMTD

SEQ ID NO: 328838 - protein, 9 aa, Influenza virus
SCTVVMTDG

SEQ ID NO: 328839 - protein, 9 aa, Influenza virus
CAVVMTDGS

SEQ ID NO: 328840 - protein, 9 aa, Influenza virus
AVVMTDGSA

SEQ ID NO: 328841 - protein, 9 aa, Influenza virus
MTDGSASGK

SEQ ID NO: 328842 - protein, 9 aa, Influenza virus
TDGSASGKA

SEQ ID NO: 328843 - protein, 9 aa, Influenza virus
DGSASGKAD

SEQ ID NO: 328844 - protein, 9 aa, Influenza virus
GSASGKADT

SEQ ID NO: 328845 - protein, 9 aa, Influenza virus
SASGKADTR

SEQ ID NO: 328846 - protein, 9 aa, Influenza virus
ASGKADTRI

SEQ ID NO: 328847 - protein, 9 aa, Influenza virus
SGKADTRIL

SEQ ID NO: 328848 - protein, 9 aa, Influenza virus
GKADTRILF

SEQ ID NO: 328849 - protein, 9 aa, Influenza virus
KADTRILFI

SEQ ID NO: 328850 - protein, 9 aa, Influenza virus
ADTRILFIE

SEQ ID NO: 328851 - protein, 9 aa, Influenza virus
DTRILFIEE

SEQ ID NO: 328852 - protein, 9 aa, Influenza virus
TRILFIEEG

SEQ ID NO: 328853 - protein, 9 aa, Influenza virus
RILFIEEGK

SEQ ID NO: 328854 - protein, 9 aa, Influenza virus
ILFIEEGKI

SEQ ID NO: 328855 - protein, 9 aa, Influenza virus
EGKIIHISP

SEQ ID NO: 328856 - protein, 9 aa, Influenza virus
GKIIHISPL

SEQ ID NO: 328857 - protein, 9 aa, Influenza virus
IHISPLSGS

SEQ ID NO: 328858 - protein, 9 aa, Influenza virus
HIGPLSGSA

SEQ ID NO: 328859 - protein, 9 aa, Influenza virus
IGPLSGSAQ

SEQ ID NO: 328860 - protein, 9 aa, Influenza virus
GPLSGSAQH

SEQ ID NO: 328861 - protein, 9 aa, Influenza virus
PLSGSAQHV

SEQ ID NO: 328862 - protein, 9 aa, Influenza virus
LSGSAQHVE

SEQ ID NO: 328863 - protein, 9 aa, Influenza virus
SGSAQHVEE

SEQ ID NO: 328864 - protein, 9 aa, Influenza virus
GSAQHVEEC

SEQ ID NO: 328865 - protein, 9 aa, Influenza virus
SAQHVEECS

SEQ ID NO: 328866 - protein, 9 aa, Influenza virus
AQHVEECSC

SEQ ID NO: 328867 - protein, 9 aa, Influenza virus
QHVEECSCY

SEQ ID NO: 328868 - protein, 9 aa, Influenza virus
HVEECSCYP

SEQ ID NO: 328869 - protein, 9 aa, Influenza virus
VEECSCYPR

SEQ ID NO: 328870 - protein, 9 aa, Influenza virus
EECSCYSRY

SEQ ID NO: 328871 - protein, 9 aa, Influenza virus
ECSCYPQYP

SEQ ID NO: 328872 - protein, 9 aa, Influenza virus
CSCYPRYPG

SEQ ID NO: 328873 - protein, 9 aa, Influenza virus
SCYPRYPGV

SEQ ID NO: 328874 - protein, 9 aa, Influenza virus
CYPRYPGVR

SEQ ID NO: 328875 - protein, 9 aa, Influenza virus
YPRYPGVRC

SEQ ID NO: 328876 - protein, 9 aa, Influenza virus
RYPGVRCIC

SEQ ID NO: 328877 - protein, 9 aa, Influenza virus
YPGVRCICR

SEQ ID NO: 328878 - protein, 9 aa, Influenza virus
PGVRCICRD

SEQ ID NO: 328879 - protein, 9 aa, Influenza virus
GVRCICRDN

SEQ ID NO: 328880 - protein, 9 aa, Influenza virus
VRCVCRDNW

SEQ ID NO: 328881 - protein, 9 aa, Influenza virus
RCVCRDNWK

SEQ ID NO: 328882 - protein, 9 aa, Influenza virus
CVCRDNWKG

SEQ ID NO: 328883 - protein, 9 aa, Influenza virus
VCRDNWKGS

SEQ ID NO: 328884 - protein, 9 aa, Influenza virus
CRDNWRGSN

SEQ ID NO: 328885 - protein, 9 aa, Influenza virus
RDNWRGSNR

SEQ ID NO: 328886 - protein, 9 aa, Influenza virus
DNWRGSNRP

SEQ ID NO: 328887 - protein, 9 aa, Influenza virus
NWKGSNRPI

SEQ ID NO: 328888 - protein, 9 aa, Influenza virus
GSNRPVVDI

SEQ ID NO: 328889 - protein, 9 aa, Influenza virus
SNRPVVDIN

SEQ ID NO: 328890 - protein, 9 aa, Influenza virus
DINMADYSI

SEQ ID NO: 328891 - protein, 9 aa, Influenza virus
INMADYSID

SEQ ID NO: 328892 - protein, 9 aa, Influenza virus
NMADYSIDS

SEQ ID NO: 328893 - protein, 9 aa, Influenza virus
DYSIDSSYI

SEQ ID NO: 328894 - protein, 9 aa, Influenza virus
YSIDSSYIC

SEQ ID NO: 328895 - protein, 9 aa, Influenza virus
SIDSSYICS

SEQ ID NO: 328896 - protein, 9 aa, Influenza virus
IDSSYICSG

SEQ ID NO: 328897 - protein, 9 aa, Influenza virus
DSSYICSGL

SEQ ID NO: 328898 - protein, 9 aa, Influenza virus
SSYICSGLV

SEQ ID NO: 328899 - protein, 9 aa, Influenza virus
SYICSGLVG

SEQ ID NO: 328900 - protein, 9 aa, Influenza virus
YICSGLVGD

SEQ ID NO: 328901 - protein, 9 aa, Influenza virus
ICSGLVGDT

SEQ ID NO: 328902 - protein, 9 aa, Influenza virus
LVGDTPRNG

SEQ ID NO: 328903 - protein, 9 aa, Influenza virus
VGDTPRNGD

SEQ ID NO: 328904 - protein, 9 aa, Influenza virus
GDTPRNDDR

SEQ ID NO: 328905 - protein, 9 aa, Influenza virus
DTPRNDDRS

SEQ ID NO: 328906 - protein, 9 aa, Influenza virus
TPRNDDRSS

SEQ ID NO: 328907 - protein, 9 aa, Influenza virus
SNSNCRNPN

SEQ ID NO: 328908 - protein, 9 aa, Influenza virus
NSNCRNPNN

SEQ ID NO: 328909 - protein, 9 aa, Influenza virus
SNCRNPNNE

SEQ ID NO: 328910 - protein, 9 aa, Influenza virus
NCRNPNNER

SEQ ID NO: 328911 - protein, 9 aa, Influenza virus
CRNPNNERG

SEQ ID NO: 328912 - protein, 9 aa, Influenza virus
PNNERGNQG

SEQ ID NO: 328913 - protein, 9 aa, Influenza virus
NNERGNQGV

SEQ ID NO: 328914 - protein, 9 aa, Influenza virus
NERGNQGVK

SEQ ID NO: 328915 - protein, 9 aa, Influenza virus
ERGNQGVKG

SEQ ID NO: 328916 - protein, 9 aa, Influenza virus
RGNQGVKGW

SEQ ID NO: 328917 - protein, 9 aa, Influenza virus
GNQGVKGWA

SEQ ID NO: 328918 - protein, 9 aa, Influenza virus
NQGVKGWAF

SEQ ID NO: 328919 - protein, 9 aa, Influenza virus
QGVKGWAFD

SEQ ID NO: 328920 - protein, 9 aa, Influenza virus
GVKGWAFDS

SEQ ID NO: 328921 - protein, 9 aa, Influenza virus
VKGWAFDSG

SEQ ID NO: 328922 - protein, 9 aa, Influenza virus
GNDVWMGRT

SEQ ID NO: 328923 - protein, 9 aa, Influenza virus
NDVWMGRTI

SEQ ID NO: 328924 - protein, 9 aa, Influenza virus
DVWMGRTIN

SEQ ID NO: 328925 - protein, 9 aa, Influenza virus
KDSRSGYET

SEQ ID NO: 328926 - protein, 9 aa, Influenza virus
DSRSGYETF

SEQ ID NO: 328927 - protein, 9 aa, Influenza virus
SRSGYETFK

SEQ ID NO: 328928 - protein, 9 aa, Influenza virus
RSGYETFRV

SEQ ID NO: 328929 - protein, 9 aa, Influenza virus
SGYETFRVI

SEQ ID NO: 328930 - protein, 9 aa, Influenza virus
GYETFRVIG

SEQ ID NO: 328931 - protein, 9 aa, Influenza virus
YETFRVIGG

SEQ ID NO: 328932 - protein, 9 aa, Influenza virus
ETFRVIGGW

SEQ ID NO: 328933 - protein, 9 aa, Influenza virus
TFKVIGGWT

SEQ ID NO: 328934 - protein, 9 aa, Influenza virus
FKVIGGWTT

SEQ ID NO: 328935 - protein, 9 aa, Influenza virus
SDNRSGYSG

SEQ ID NO: 328936 - protein, 9 aa, Influenza virus
DNRSGYSGI

SEQ ID NO: 328937 - protein, 9 aa, Influenza virus
NRSGYSGIF

SEQ ID NO: 328938 - protein, 9 aa, Influenza virus
RSGYSGIFS

SEQ ID NO: 328939 - protein, 9 aa, Influenza virus
YSGIFSVEN

SEQ ID NO: 328940 - protein, 9 aa, Influenza virus
SGIFSVEHK

SEQ ID NO: 328941 - protein, 9 aa, Influenza virus
KGCINRCFY

SEQ ID NO: 328942 - protein, 9 aa, Influenza virus
GCINRCFYV

SEQ ID NO: 328943 - protein, 9 aa, Influenza virus
CVNRCFYVE

SEQ ID NO: 328944 - protein, 9 aa, Influenza virus
VNRCFYVEL

SEQ ID NO: 328945 - protein, 9 aa, Influenza virus
YVELIRGRK

SEQ ID NO: 328946 - protein, 9 aa, Influenza virus
VELIRGRKQ

SEQ ID NO: 328947 - protein, 9 aa, Influenza virus
ELIRGRKQE

SEQ ID NO: 328948 - protein, 9 aa, Influenza virus
KQETRVWWT

SEQ ID NO: 328949 - protein, 9 aa, Influenza virus
QEARVWWTS

SEQ ID NO: 328950 - protein, 9 aa, Influenza virus
EARVWWTSN

SEQ ID NO: 328951 - protein, 9 aa, Influenza virus
ARVWWTSNS

SEQ ID NO: 328952 - protein, 9 aa, Influenza virus
VWWTSNSIA

SEQ ID NO: 328953 - protein, 9 aa, Influenza virus
WWTSNSIAV

SEQ ID NO: 328954 - protein, 9 aa, Influenza virus
WTSNSIAVF

SEQ ID NO: 328955 - protein, 9 aa, Influenza virus
TSNSIAVFC

SEQ ID NO: 328956 - protein, 9 aa, Influenza virus
SNSIAVFCG

SEQ ID NO: 328957 - protein, 9 aa, Influenza virus
NSIAVFCGT

SEQ ID NO: 328958 - protein, 9 aa, Influenza virus
SIAVFCGTS

SEQ ID NO: 328959 - protein, 9 aa, Influenza virus
IAVFCGTSG

SEQ ID NO: 328960 - protein, 9 aa, Influenza virus
AVFCGTSGT

SEQ ID NO: 328961 - protein, 9 aa, Influenza virus
TGSWPDGAD

SEQ ID NO: 328962 - protein, 9 aa, Influenza virus
GSWPDGADI

SEQ ID NO: 328963 - protein, 9 aa, Influenza virus
SWPDGADIN

SEQ ID NO: 328964 - protein, 9 aa, Influenza virus
WPDGANINL

SEQ ID NO: 328965 - protein, 9 aa, Influenza virus
PDGANINLM

SEQ ID NO: 328966 - protein, 9 aa, Influenza virus
DGANINLMP

SEQ ID NO: 328967 - protein, 9 aa, Influenza virus
GANINLMPI

SEQ ID NO: 328968 - protein, 9 aa, Influenza virus
LIMRTVIAL

SEQ ID NO: 328969 - protein, 9 aa, Influenza virus
SMSGFRSNL

SEQ ID NO: 328970 - protein, 9 aa, Influenza virus
IFNFILLTH

SEQ ID NO: 328971 - protein, 9 aa, Influenza virus
FNFILLTHW

SEQ ID NO: 328972 - protein, 9 aa, Influenza virus
VLSCIFCLA

SEQ ID NO: 328973 - protein, 9 aa, Influenza virus
MATLCLGHH

SEQ ID NO: 328974 - protein, 9 aa, Influenza virus
LCLGHHAVA

SEQ ID NO: 328975 - protein, 9 aa, Influenza virus
CLGHHAVAN

SEQ ID NO: 328976 - protein, 9 aa, Influenza virus
LGHHAVANG

SEQ ID NO: 328977 - protein, 9 aa, Influenza virus
GHHAVANGT

SEQ ID NO: 328978 - protein, 9 aa, Influenza virus
DHIEVTNAT

SEQ ID NO: 328979 - protein, 9 aa, Influenza virus
HIEVTNATE

SEQ ID NO: 328980 - protein, 9 aa, Influenza virus
VEVTNATEL

SEQ ID NO: 328981 - protein, 9 aa, Influenza virus
TNATELVQN

SEQ ID NO: 328982 - protein, 9 aa, Influenza virus
CTLMDALLG

SEQ ID NO: 328983 - protein, 9 aa, Influenza virus
TLMDALLGD

SEQ ID NO: 328984 - protein, 9 aa, Influenza virus
LMDALLGDP

SEQ ID NO: 328985 - protein, 9 aa, Influenza virus
DALLGDPQC

SEQ ID NO: 328986 - protein, 9 aa, Influenza virus
ALLGDPHCD

SEQ ID NO: 328987 - protein, 9 aa, Influenza virus
SLRSLIASS

SEQ ID NO: 328988 - protein, 9 aa, Influenza virus
LRSLIASSG

SEQ ID NO: 328989 - protein, 9 aa, Influenza virus
RSLIASSGT

SEQ ID NO: 328990 - protein, 9 aa, Influenza virus
SLIASSGTL

SEQ ID NO: 328991 - protein, 9 aa, Influenza virus
LIASSGTLE

SEQ ID NO: 328992 - protein, 9 aa, Influenza virus
IASSGTLEF

SEQ ID NO: 328993 - protein, 9 aa, Influenza virus
GFFSRLNWL

SEQ ID NO: 328994 - protein, 9 aa, Influenza virus
FFSRLNWLH

SEQ ID NO: 328995 - protein, 9 aa, Influenza virus
FDKLYVWGV

SEQ ID NO: 328996 - protein, 9 aa, Influenza virus
DKLYVWGVH

SEQ ID NO: 328997 - protein, 9 aa, Influenza virus
KLYVWGVHH

SEQ ID NO: 328998 - protein, 9 aa, Influenza virus
LYVWGVHHP

SEQ ID NO: 328999 - protein, 9 aa, Influenza virus
YWTVVKPGD

SEQ ID NO: 329000 - protein, 9 aa, Influenza virus
SNGNLIAPR

SEQ ID NO: 329001 - protein, 9 aa, Influenza virus
NGNLIAPRG

SEQ ID NO: 329002 - protein, 9 aa, Influenza virus
GNLVAPRGY

SEQ ID NO: 329003 - protein, 9 aa, Influenza virus
NLVAPRGYF

SEQ ID NO: 329004 - protein, 9 aa, Influenza virus
LVAPRGYFK

SEQ ID NO: 329005 - protein, 9 aa, Influenza virus
SACITPNGS

SEQ ID NO: 329006 - protein, 9 aa, Influenza virus
ACITPNGSI

SEQ ID NO: 329007 - protein, 9 aa, Influenza virus
CITPNGSIS

SEQ ID NO: 329008 - protein, 9 aa, Influenza virus
ITPNGSISN

SEQ ID NO: 329009 - protein, 9 aa, Influenza virus
TPNGSISND

SEQ ID NO: 329010 - protein, 9 aa, Influenza virus
GSISNDKPF

SEQ ID NO: 329011 - protein, 9 aa, Influenza virus
SISNDKPFQ

SEQ ID NO: 329012 - protein, 9 aa, Influenza virus
ISNDKPFQN

SEQ ID NO: 329013 - protein, 9 aa, Influenza virus
NEKPFQNVN

SEQ ID NO: 329014 - protein, 9 aa, Influenza virus
KPFQNVNKI

SEQ ID NO: 329015 - protein, 9 aa, Influenza virus
PFQNVNKIT

SEQ ID NO: 329016 - protein, 9 aa, Influenza virus
FQNVNKITY

SEQ ID NO: 329017 - protein, 9 aa, Influenza virus
QNVNKITYG

SEQ ID NO: 329018 - protein, 9 aa, Influenza virus
KLATGMRNI

SEQ ID NO: 329019 - protein, 9 aa, Influenza virus
LATGMRNIP

SEQ ID NO: 329020 - protein, 9 aa, Influenza virus
ATGMRNIPE

SEQ ID NO: 329021 - protein, 9 aa, Influenza virus
TGMRNVPER

SEQ ID NO: 329022 - protein, 9 aa, Influenza virus
GMRNVPERQ

SEQ ID NO: 329023 - protein, 9 aa, Influenza virus
TRGLFGAIA

SEQ ID NO: 329024 - protein, 9 aa, Influenza virus
RGLFGAIAG

SEQ ID NO: 329025 - protein, 9 aa, Influenza virus
GLFGAIAGF

SEQ ID NO: 329026 - protein, 9 aa, Influenza virus
LFGAIAGFI

SEQ ID NO: 329027 - protein, 9 aa, Influenza virus
IENGWEGMI

SEQ ID NO: 329028 - protein, 9 aa, Influenza virus
ENGWEGMID

SEQ ID NO: 329029 - protein, 9 aa, Influenza virus
NGWEGMIDG

SEQ ID NO: 329030 - protein, 9 aa, Influenza virus
GWEGMIDGW

SEQ ID NO: 329031 - protein, 9 aa, Influenza virus
WEGMIDGWY

SEQ ID NO: 329032 - protein, 9 aa, Influenza virus
EGMIDGWYG

SEQ ID NO: 329033 - protein, 9 aa, Influenza virus
GMIDGWYGF

SEQ ID NO: 329034 - protein, 9 aa, Influenza virus
MIDGWYGFR

SEQ ID NO: 329035 - protein, 9 aa, Influenza virus
IDGWYGFRH

SEQ ID NO: 329036 - protein, 9 aa, Influenza virus
DGWYGFRYQ

SEQ ID NO: 329037 - protein, 9 aa, Influenza virus
GWYGFRYQN

SEQ ID NO: 329038 - protein, 9 aa, Influenza virus
WYGFRYQNS

SEQ ID NO: 329039 - protein, 9 aa, Influenza virus
YGFRYQNSE

SEQ ID NO: 329040 - protein, 9 aa, Influenza virus
GFRYQNSEG

SEQ ID NO: 329041 - protein, 9 aa, Influenza virus
NSEGIGQAA

SEQ ID NO: 329042 - protein, 9 aa, Influenza virus
SEGIGQAAD

SEQ ID NO: 329043 - protein, 9 aa, Influenza virus
EGIGQAADL

SEQ ID NO: 329044 - protein, 9 aa, Influenza virus
GIGQAADLK

SEQ ID NO: 329045 - protein, 9 aa, Influenza virus
IGQAADLKS

SEQ ID NO: 329046 - protein, 9 aa, Influenza virus
AADLKSTQT

SEQ ID NO: 329047 - protein, 9 aa, Influenza virus
ADLKSTQTA

SEQ ID NO: 329048 - protein, 9 aa, Influenza virus
DLKSTQTAI

SEQ ID NO: 329049 - protein, 9 aa, Influenza virus
LKSTQAAIN

SEQ ID NO: 329050 - protein, 9 aa, Influenza virus
KSTQAAINQ

SEQ ID NO: 329051 - protein, 9 aa, Influenza virus
STQAAINQI

SEQ ID NO: 329052 - protein, 9 aa, Influenza virus
IEKTNEKFH

SEQ ID NO: 329053 - protein, 9 aa, Influenza virus
EKTNEKFHQ

SEQ ID NO: 329054 - protein, 9 aa, Influenza virus
RTNEKFHQI

SEQ ID NO: 329055 - protein, 9 aa, Influenza virus
QIEKEFSEI

SEQ ID NO: 329056 - protein, 9 aa, Influenza virus
IEKEFSEIE

SEQ ID NO: 329057 - protein, 9 aa, Influenza virus
EKEFSEIEG

SEQ ID NO: 329058 - protein, 9 aa, Influenza virus
KEFSEIEGR

SEQ ID NO: 329059 - protein, 9 aa, Influenza virus
EFSEIEGRI

SEQ ID NO: 329060 - protein, 9 aa, Influenza virus
FSEIEGRIQ

SEQ ID NO: 329061 - protein, 9 aa, Influenza virus
SEIEGRIQD

SEQ ID NO: 329062 - protein, 9 aa, Influenza virus
EIEGRIQDL

SEQ ID NO: 329063 - protein, 9 aa, Influenza virus
IEGRIQDLE

SEQ ID NO: 329064 - protein, 9 aa, Influenza virus
EGRIQDLER

SEQ ID NO: 329065 - protein, 9 aa, Influenza virus
GRIQDLERY

SEQ ID NO: 329066 - protein, 9 aa, Influenza virus
RIQDLERYV

SEQ ID NO: 329067 - protein, 9 aa, Influenza virus
IQDLERYVE

SEQ ID NO: 329068 - protein, 9 aa, Influenza virus
QDLERYVED

SEQ ID NO: 329069 - protein, 9 aa, Influenza virus
DLERYVEDT

SEQ ID NO: 329070 - protein, 9 aa, Influenza virus
LERYVEDTK

SEQ ID NO: 329071 - protein, 9 aa, Influenza virus
EKYVEDTKV

SEQ ID NO: 329072 - protein, 9 aa, Influenza virus
KYVEDTKVD

SEQ ID NO: 329073 - protein, 9 aa, Influenza virus
YVEDTKVDL

SEQ ID NO: 329074 - protein, 9 aa, Influenza virus
VEDTKVDLW

SEQ ID NO: 329075 - protein, 9 aa, Influenza virus
EDTKVDLWS

SEQ ID NO: 329076 - protein, 9 aa, Influenza virus
DTKVDLWSY

SEQ ID NO: 329077 - protein, 9 aa, Influenza virus
TKVDLWSYN

SEQ ID NO: 329078 - protein, 9 aa, Influenza virus
KVDLWSYNA

SEQ ID NO: 329079 - protein, 9 aa, Influenza virus
VDLWSYNAE

SEQ ID NO: 329080 - protein, 9 aa, Influenza virus
DLWSYNAGL

SEQ ID NO: 329081 - protein, 9 aa, Influenza virus
LWSYNAGLL

SEQ ID NO: 329082 - protein, 9 aa, Influenza virus
WSYNAGLLV

SEQ ID NO: 329083 - protein, 9 aa, Influenza virus
SYNAGLLVA

SEQ ID NO: 329084 - protein, 9 aa, Influenza virus
YNAGLLVAL

SEQ ID NO: 329085 - protein, 9 aa, Influenza virus
NAGLLVALE

SEQ ID NO: 329086 - protein, 9 aa, Influenza virus
AGLLVALEN

SEQ ID NO: 329087 - protein, 9 aa, Influenza virus
GLLVALENQ

SEQ ID NO: 329088 - protein, 9 aa, Influenza virus
VLVALENQH

SEQ ID NO: 329089 - protein, 9 aa, Influenza virus
LVALENQNT

SEQ ID NO: 329090 - protein, 9 aa, Influenza virus
VALENQNTI

SEQ ID NO: 329091 - protein, 9 aa, Influenza virus
ALENQHTIH

SEQ ID NO: 329092 - protein, 9 aa, Influenza virus
LENQHTIHL

SEQ ID NO: 329093 - protein, 9 aa, Influenza virus
ENQHTIHLT

SEQ ID NO: 329094 - protein, 9 aa, Influenza virus
NQHTIHLTD

SEQ ID NO: 329095 - protein, 9 aa, Influenza virus
QHTIDLTDA

SEQ ID NO: 329096 - protein, 9 aa, Influenza virus
HTIDLTDAE

SEQ ID NO: 329097 - protein, 9 aa, Influenza virus
TIDLTDAEM

SEQ ID NO: 329098 - protein, 9 aa, Influenza virus
IDLTDAEMN

SEQ ID NO: 329099 - protein, 9 aa, Influenza virus
DLTDAEMNK

SEQ ID NO: 329100 - protein, 9 aa, Influenza virus
LTDAEMNKL

SEQ ID NO: 329101 - protein, 9 aa, Influenza virus
TDAEMNKLF

SEQ ID NO: 329102 - protein, 9 aa, Influenza virus
DAEMNKLFE

SEQ ID NO: 329103 - protein, 9 aa, Influenza virus
EMNKLFERT

SEQ ID NO: 329104 - protein, 9 aa, Influenza virus
TRRQLRENA

SEQ ID NO: 329105 - protein, 9 aa, Influenza virus
RRQLRENAE

SEQ ID NO: 329106 - protein, 9 aa, Influenza virus
RQLRENAED

SEQ ID NO: 329107 - protein, 9 aa, Influenza virus
QLRENAEDI

SEQ ID NO: 329108 - protein, 9 aa, Influenza virus
LRENAEDIG

SEQ ID NO: 329109 - protein, 9 aa, Influenza virus
RENAEDMGG

SEQ ID NO: 329110 - protein, 9 aa, Influenza virus
ENAEDMGGG

SEQ ID NO: 329111 - protein, 9 aa, Influenza virus
NAEDMGGGC

SEQ ID NO: 329112 - protein, 9 aa, Influenza virus
AEDMGGGCF

SEQ ID NO: 329113 - protein, 9 aa, Influenza virus
GGGCFKIYH

SEQ ID NO: 329114 - protein, 9 aa, Influenza virus
GCFTIYHKC

SEQ ID NO: 329115 - protein, 9 aa, Influenza virus
CFTIYHKCD

SEQ ID NO: 329116 - protein, 9 aa, Influenza virus
FTIYHKCDN

SEQ ID NO: 329117 - protein, 9 aa, Influenza virus
IYHKCDNSC

SEQ ID NO: 329118 - protein, 9 aa, Influenza virus
SIRNGTYNH

SEQ ID NO: 329119 - protein, 9 aa, Influenza virus
YRDEAVNNR

SEQ ID NO: 329120 - protein, 9 aa, Influenza virus
GYKDWVLWI

SEQ ID NO: 329121 - protein, 9 aa, Influenza virus
YKDWVLWIS

SEQ ID NO: 329122 - protein, 9 aa, Influenza virus
KDWVLWISF

SEQ ID NO: 329123 - protein, 9 aa, Influenza virus
DWVLWISFA

SEQ ID NO: 329124 - protein, 9 aa, Influenza virus
WVLWISFAI

SEQ ID NO: 329125 - protein, 9 aa, Influenza virus
VLWISFAIS

SEQ ID NO: 329126 - protein, 9 aa, Influenza virus
LWISFATSC

SEQ ID NO: 329127 - protein, 9 aa, Influenza virus
WISFATSCF

SEQ ID NO: 329128 - protein, 9 aa, Influenza virus
ISFATSCFL

SEQ ID NO: 329129 - protein, 9 aa, Influenza virus
SFAISCFLI

SEQ ID NO: 329130 - protein, 9 aa, Influenza virus
FAISCFLIC

SEQ ID NO: 329131 - protein, 9 aa, Influenza virus
LGFIVWACQ

SEQ ID NO: 329132 - protein, 9 aa, Influenza virus
GFIMWACQR

SEQ ID NO: 329133 - protein, 9 aa, Influenza virus
FIMWACQRG

SEQ ID NO: 329134 - protein, 9 aa, Influenza virus
IMWACQRGN

SEQ ID NO: 329135 - protein, 9 aa, Influenza virus
MWACQRGNI

SEQ ID NO: 329136 - protein, 9 aa, Influenza virus
WACQRGNIR

SEQ ID NO: 329137 - protein, 9 aa, Influenza virus
ACQRGNIRC

SEQ ID NO: 329138 - protein, 9 aa, Influenza virus
CQRGNIRCN

SEQ ID NO: 329139 - protein, 9 aa, Influenza virus
QRGNIRCNI

SEQ ID NO: 329140 - protein, 9 aa, Influenza virus
RGNIRCNIC

SEQ ID NO: 329141 - protein, 9 aa, Influenza virus
GNIKCNICI

SEQ ID NO: 329142 - protein, 9 aa, Influenza virus
SMSGFRSNL

SEQ ID NO: 329143 - protein, 9 aa, Influenza virus
MATLCLGHH

SEQ ID NO: 329144 - protein, 9 aa, Influenza virus
HHAVPNGTL

SEQ ID NO: 329145 - protein, 9 aa, Influenza virus
HAVPNGTLV

SEQ ID NO: 329146 - protein, 9 aa, Influenza virus
AVPNGTLVK

SEQ ID NO: 329147 - protein, 9 aa, Influenza virus
VPNGTLVKT

SEQ ID NO: 329148 - protein, 9 aa, Influenza virus
PNGTLVKTI

SEQ ID NO: 329149 - protein, 9 aa, Influenza virus
NGTLVKTIT

SEQ ID NO: 329150 - protein, 9 aa, Influenza virus
DHIEVTNAT

SEQ ID NO: 329151 - protein, 9 aa, Influenza virus
HIEVTNATE

SEQ ID NO: 329152 - protein, 9 aa, Influenza virus
VEVTNATEL

SEQ ID NO: 329153 - protein, 9 aa, Influenza virus
TNATELVQN

SEQ ID NO: 329154 - protein, 9 aa, Influenza virus
CTLMDALLG

SEQ ID NO: 329155 - protein, 9 aa, Influenza virus
TLMDALLGD

SEQ ID NO: 329156 - protein, 9 aa, Influenza virus
LMDALLGDP

SEQ ID NO: 329157 - protein, 9 aa, Influenza virus
IDALLGDPH

SEQ ID NO: 329158 - protein, 9 aa, Influenza virus
DALLGDPHC

SEQ ID NO: 329159 - protein, 9 aa, Influenza virus
ALLGDPHCD

SEQ ID NO: 329160 - protein, 9 aa, Influenza virus
CYPYYVPDY

SEQ ID NO: 329161 - protein, 9 aa, Influenza virus
SLRSLIASS

SEQ ID NO: 329162 - protein, 9 aa, Influenza virus
LRSLIASSG

SEQ ID NO: 329163 - protein, 9 aa, Influenza virus
RSLIASSGT

SEQ ID NO: 329164 - protein, 9 aa, Influenza virus
SLIASSGTL

SEQ ID NO: 329165 - protein, 9 aa, Influenza virus
LIASSGTLE

SEQ ID NO: 329166 - protein, 9 aa, Influenza virus
IASSGTLEF

SEQ ID NO: 329167 - protein, 9 aa, Influenza virus
GFFSRLNWL

SEQ ID NO: 329168 - protein, 9 aa, Influenza virus
FFSRLNWLH

SEQ ID NO: 329169 - protein, 9 aa, Influenza virus
FDKLYVWGV

SEQ ID NO: 329170 - protein, 9 aa, Influenza virus
DKLYVWGVH

SEQ ID NO: 329171 - protein, 9 aa, Influenza virus
KLYVWGVHH

SEQ ID NO: 329172 - protein, 9 aa, Influenza virus
LYVWGVHHP

SEQ ID NO: 329173 - protein, 9 aa, Influenza virus
SVYWTVVKP

SEQ ID NO: 329174 - protein, 9 aa, Influenza virus
VYWTVVKPG

SEQ ID NO: 329175 - protein, 9 aa, Influenza virus
YWTVVKPGD

SEQ ID NO: 329176 - protein, 9 aa, Influenza virus
SNGNLIAPR

SEQ ID NO: 329177 - protein, 9 aa, Influenza virus
NGNLIAPRG

SEQ ID NO: 329178 - protein, 9 aa, Influenza virus
NLIAPRGYY

SEQ ID NO: 329179 - protein, 9 aa, Influenza virus
LIAPRGYFR

SEQ ID NO: 329180 - protein, 9 aa, Influenza virus
IAPRGYFKM

SEQ ID NO: 329181 - protein, 9 aa, Influenza virus
SACITPNGS

SEQ ID NO: 329182 - protein, 9 aa, Influenza virus
ACITPNGSI

SEQ ID NO: 329183 - protein, 9 aa, Influenza virus
CITPNGSIS

SEQ ID NO: 329184 - protein, 9 aa, Influenza virus
ITPNGSISN

SEQ ID NO: 329185 - protein, 9 aa, Influenza virus
TPNGSIPNE

SEQ ID NO: 329186 - protein, 9 aa, Influenza virus
PNGSIPNEK

SEQ ID NO: 329187 - protein, 9 aa, Influenza virus
NGSIPNEKP

SEQ ID NO: 329188 - protein, 9 aa, Influenza virus
GSIPNEKPF

SEQ ID NO: 329189 - protein, 9 aa, Influenza virus
SIPNEKPFQ

SEQ ID NO: 329190 - protein, 9 aa, Influenza virus
IPNEKPFQN

SEQ ID NO: 329191 - protein, 9 aa, Influenza virus
PNEKPFQNV

SEQ ID NO: 329192 - protein, 9 aa, Influenza virus
NEKPFQNVN

SEQ ID NO: 329193 - protein, 9 aa, Influenza virus
DKPFQNVNK

SEQ ID NO: 329194 - protein, 9 aa, Influenza virus
KPFQNVNKI

SEQ ID NO: 329195 - protein, 9 aa, Influenza virus
PFQNVNKIT

SEQ ID NO: 329196 - protein, 9 aa, Influenza virus
FQNVNKITY

SEQ ID NO: 329197 - protein, 9 aa, Influenza virus
QNVNKITYG

SEQ ID NO: 329198 - protein, 9 aa, Influenza virus
NVNKITYGA

SEQ ID NO: 329199 - protein, 9 aa, Influenza virus
VNKITYGAC

SEQ ID NO: 329200 - protein, 9 aa, Influenza virus
NKITYGACP

SEQ ID NO: 329201 - protein, 9 aa, Influenza virus
ITYGACPKY

SEQ ID NO: 329202 - protein, 9 aa, Influenza virus
TYGACPKYV

SEQ ID NO: 329203 - protein, 9 aa, Influenza virus
YVKQSTLKL

SEQ ID NO: 329204 - protein, 9 aa, Influenza virus
VKQSTLKLA

SEQ ID NO: 329205 - protein, 9 aa, Influenza virus
KQSTLKLAT

SEQ ID NO: 329206 - protein, 9 aa, Influenza virus
QSTLKLATG

SEQ ID NO: 329207 - protein, 9 aa, Influenza virus
STLKLATGM

SEQ ID NO: 329208 - protein, 9 aa, Influenza virus
KLATGMRNI

SEQ ID NO: 329209 - protein, 9 aa, Influenza virus
LATGMRNIP

SEQ ID NO: 329210 - protein, 9 aa, Influenza virus
ATGMRNIPE

SEQ ID NO: 329211 - protein, 9 aa, Influenza virus
TGMRNIPEK

SEQ ID NO: 329212 - protein, 9 aa, Influenza virus
GMRNVPETQ

SEQ ID NO: 329213 - protein, 9 aa, Influenza virus
MRNVPETQT

SEQ ID NO: 329214 - protein, 9 aa, Influenza virus
RNVPETQTR

SEQ ID NO: 329215 - protein, 9 aa, Influenza virus
NVPETQTRG

SEQ ID NO: 329216 - protein, 9 aa, Influenza virus
PEKQTRGLF

SEQ ID NO: 329217 - protein, 9 aa, Influenza virus
EKQTRGLFG

SEQ ID NO: 329218 - protein, 9 aa, Influenza virus
KQTRGLFGA

SEQ ID NO: 329219 - protein, 9 aa, Influenza virus
QTRGLFGAI

SEQ ID NO: 329220 - protein, 9 aa, Influenza virus
TRGLFGAIA

SEQ ID NO: 329221 - protein, 9 aa, Influenza virus
RGLFGAIAG

SEQ ID NO: 329222 - protein, 9 aa, Influenza virus
GLFGAIAGF

SEQ ID NO: 329223 - protein, 9 aa, Influenza virus
LFGAIAGFI

SEQ ID NO: 329224 - protein, 9 aa, Influenza virus
IENGWEGMM

SEQ ID NO: 329225 - protein, 9 aa, Influenza virus
ENGWEGMMD

SEQ ID NO: 329226 - protein, 9 aa, Influenza virus
NGWEGMMDG

SEQ ID NO: 329227 - protein, 9 aa, Influenza virus
GWEGMMDGW

SEQ ID NO: 329228 - protein, 9 aa, Influenza virus
WEGMMDGWY

SEQ ID NO: 329229 - protein, 9 aa, Influenza virus
EGMMDGWYG

SEQ ID NO: 329230 - protein, 9 aa, Influenza virus
GMMDGWYGF

SEQ ID NO: 329231 - protein, 9 aa, Influenza virus
MMDGWYGFR

SEQ ID NO: 329232 - protein, 9 aa, Influenza virus
MDGWYGFRH

SEQ ID NO: 329233 - protein, 9 aa, Influenza virus
NGWYGFRHQ

SEQ ID NO: 329234 - protein, 9 aa, Influenza virus
GWYGFRHHN

SEQ ID NO: 329235 - protein, 9 aa, Influenza virus
WYGFRHHNS

SEQ ID NO: 329236 - protein, 9 aa, Influenza virus
YGFRHHNSE

SEQ ID NO: 329237 - protein, 9 aa, Influenza virus
GFRHHNSEG

SEQ ID NO: 329238 - protein, 9 aa, Influenza virus
RHQNSEGIG

SEQ ID NO: 329239 - protein, 9 aa, Influenza virus
HQNSEGIGQ

SEQ ID NO: 329240 - protein, 9 aa, Influenza virus
NSEGIGQAA

SEQ ID NO: 329241 - protein, 9 aa, Influenza virus
SEGIGQAAD

SEQ ID NO: 329242 - protein, 9 aa, Influenza virus
EGIGQAADL

SEQ ID NO: 329243 - protein, 9 aa, Influenza virus
GIGQAADLK

SEQ ID NO: 329244 - protein, 9 aa, Influenza virus
IGQAADLKS

SEQ ID NO: 329245 - protein, 9 aa, Influenza virus
DLKSTQAAV

SEQ ID NO: 329246 - protein, 9 aa, Influenza virus
LKSTQAAID

SEQ ID NO: 329247 - protein, 9 aa, Influenza virus
KSTQAAIDQ

SEQ ID NO: 329248 - protein, 9 aa, Influenza virus
STQAAIDQI

SEQ ID NO: 329249 - protein, 9 aa, Influenza virus
IEKTNEKFH

SEQ ID NO: 329250 - protein, 9 aa, Influenza virus
EKTNEKFHQ

SEQ ID NO: 329251 - protein, 9 aa, Influenza virus
KEFTEVEGR

SEQ ID NO: 329252 - protein, 9 aa, Influenza virus
EFTEVEGRI

SEQ ID NO: 329253 - protein, 9 aa, Influenza virus
FTEVEGRIQ

SEQ ID NO: 329254 - protein, 9 aa, Influenza virus
TEVEGRIQD

SEQ ID NO: 329255 - protein, 9 aa, Influenza virus
EGRIQDLER

SEQ ID NO: 329256 - protein, 9 aa, Influenza virus
GRIQDLERY

SEQ ID NO: 329257 - protein, 9 aa, Influenza virus
RIQDLERYV

SEQ ID NO: 329258 - protein, 9 aa, Influenza virus
IQDLERYVE

SEQ ID NO: 329259 - protein, 9 aa, Influenza virus
QDLERYVED

SEQ ID NO: 329260 - protein, 9 aa, Influenza virus
DLERYVEDT

SEQ ID NO: 329261 - protein, 9 aa, Influenza virus
LERYVEDTK

SEQ ID NO: 329262 - protein, 9 aa, Influenza virus
EKYVEDTKV

SEQ ID NO: 329263 - protein, 9 aa, Influenza virus
KYVEDTKVD

SEQ ID NO: 329264 - protein, 9 aa, Influenza virus
YVEDTKVDL

SEQ ID NO: 329265 - protein, 9 aa, Influenza virus
VEDTKVDLW

SEQ ID NO: 329266 - protein, 9 aa, Influenza virus
EDTKVDLWS

SEQ ID NO: 329267 - protein, 9 aa, Influenza virus
DTKVDLWSY

SEQ ID NO: 329268 - protein, 9 aa, Influenza virus
TKVDLWSYN

SEQ ID NO: 329269 - protein, 9 aa, Influenza virus
KVDLWSYNA

SEQ ID NO: 329270 - protein, 9 aa, Influenza virus
IDLWSYNAG

SEQ ID NO: 329271 - protein, 9 aa, Influenza virus
DLWSYNAGL

SEQ ID NO: 329272 - protein, 9 aa, Influenza virus
LWSYNAGLL

SEQ ID NO: 329273 - protein, 9 aa, Influenza virus
WSYNAGLLV

SEQ ID NO: 329274 - protein, 9 aa, Influenza virus
SYNAGLLVA

SEQ ID NO: 329275 - protein, 9 aa, Influenza virus
YNAGLLVAL

SEQ ID NO: 329276 - protein, 9 aa, Influenza virus
NAGLLVALE

SEQ ID NO: 329277 - protein, 9 aa, Influenza virus
AGLLVALEN

SEQ ID NO: 329278 - protein, 9 aa, Influenza virus
GLLVALENQ

SEQ ID NO: 329279 - protein, 9 aa, Influenza virus
LLVALENQN

SEQ ID NO: 329280 - protein, 9 aa, Influenza virus
ALENQHTIH

SEQ ID NO: 329281 - protein, 9 aa, Influenza virus
LENQHTIHL

SEQ ID NO: 329282 - protein, 9 aa, Influenza virus
ENQHTIHLT

SEQ ID NO: 329283 - protein, 9 aa, Influenza virus
NQHTIHLTD

SEQ ID NO: 329284 - protein, 9 aa, Influenza virus
QHTIHLTDS

SEQ ID NO: 329285 - protein, 9 aa, Influenza virus
HTIHLTDSE

SEQ ID NO: 329286 - protein, 9 aa, Influenza virus
TIHLTDSEM

SEQ ID NO: 329287 - protein, 9 aa, Influenza virus
IDLTDSEMS

SEQ ID NO: 329288 - protein, 9 aa, Influenza virus
DLTDSEMSK

SEQ ID NO: 329289 - protein, 9 aa, Influenza virus
LTDSEMSKL

SEQ ID NO: 329290 - protein, 9 aa, Influenza virus
TDSEMSKLF

SEQ ID NO: 329291 - protein, 9 aa, Influenza virus
DSEMSKLFE

SEQ ID NO: 329292 - protein, 9 aa, Influenza virus
SEMNKLFEK

SEQ ID NO: 329293 - protein, 9 aa, Influenza virus
EMNKLFEKT

SEQ ID NO: 329294 - protein, 9 aa, Influenza virus
TRKQLRENA

SEQ ID NO: 329295 - protein, 9 aa, Influenza virus
RKQLRENAE

SEQ ID NO: 329296 - protein, 9 aa, Influenza virus
RQLRENAED

SEQ ID NO: 329297 - protein, 9 aa, Influenza virus
QLRENAEEM

SEQ ID NO: 329298 - protein, 9 aa, Influenza virus
LRENAEDLG

SEQ ID NO: 329299 - protein, 9 aa, Influenza virus
RENAEDLGN

SEQ ID NO: 329300 - protein, 9 aa, Influenza virus
ENAEEMGNG

SEQ ID NO: 329301 - protein, 9 aa, Influenza virus
NAEEMGNGC

SEQ ID NO: 329302 - protein, 9 aa, Influenza virus
AEDMGNGCL

SEQ ID NO: 329303 - protein, 9 aa, Influenza virus
EDMGNGCFT

SEQ ID NO: 329304 - protein, 9 aa, Influenza virus
DMGNGCFTI

SEQ ID NO: 329305 - protein, 9 aa, Influenza virus
MGNGCFTIY

SEQ ID NO: 329306 - protein, 9 aa, Influenza virus
GNGCFTIYH

SEQ ID NO: 329307 - protein, 9 aa, Influenza virus
NGCFTIYHK

SEQ ID NO: 329308 - protein, 9 aa, Influenza virus
GCFTIYHKC

SEQ ID NO: 329309 - protein, 9 aa, Influenza virus
CFTIYHKCD

SEQ ID NO: 329310 - protein, 9 aa, Influenza virus
FTIYHKCDN

SEQ ID NO: 329311 - protein, 9 aa, Influenza virus
IYHKCDNSC

SEQ ID NO: 329312 - protein, 9 aa, Influenza virus
CIESIRNGT

SEQ ID NO: 329313 - protein, 9 aa, Influenza virus
IESIRNGTY

SEQ ID NO: 329314 - protein, 9 aa, Influenza virus
ESIRNGTYD

SEQ ID NO: 329315 - protein, 9 aa, Influenza virus
SIRNGTYNH

SEQ ID NO: 329316 - protein, 9 aa, Influenza virus
IRNGTYDHN

SEQ ID NO: 329317 - protein, 9 aa, Influenza virus
YRDEAVNNR

SEQ ID NO: 329318 - protein, 9 aa, Influenza virus
RDEAVNNRF

SEQ ID NO: 329319 - protein, 9 aa, Influenza virus
DEAVNNRFQ

SEQ ID NO: 329320 - protein, 9 aa, Influenza virus
EAVNNRFQI

SEQ ID NO: 329321 - protein, 9 aa, Influenza virus
AVNNRFQIK

SEQ ID NO: 329322 - protein, 9 aa, Influenza virus
GYKDWVLWI

SEQ ID NO: 329323 - protein, 9 aa, Influenza virus
YKDWVLWIS

SEQ ID NO: 329324 - protein, 9 aa, Influenza virus
KDWVLWISF

SEQ ID NO: 329325 - protein, 9 aa, Influenza virus
DWVLWISFA

SEQ ID NO: 329326 - protein, 9 aa, Influenza virus
WVLWISFAI

SEQ ID NO: 329327 - protein, 9 aa, Influenza virus
VLWISFAIS

SEQ ID NO: 329328 - protein, 9 aa, Influenza virus
LWISFATSC

SEQ ID NO: 329329 - protein, 9 aa, Influenza virus
WISFATSCF

SEQ ID NO: 329330 - protein, 9 aa, Influenza virus
ISFATSCFL

SEQ ID NO: 329331 - protein, 9 aa, Influenza virus
SFATSCFLL

SEQ ID NO: 329332 - protein, 9 aa, Influenza virus
FATSCFLLC

SEQ ID NO: 329333 - protein, 9 aa, Influenza virus
LGFIVWACQ

SEQ ID NO: 329334 - protein, 9 aa, Influenza virus
GFIMWACQR

SEQ ID NO: 329335 - protein, 9 aa, Influenza virus
FIMWACQRG

SEQ ID NO: 329336 - protein, 9 aa, Influenza virus
IMWACQRGN

SEQ ID NO: 329337 - protein, 9 aa, Influenza virus
MWACQRGNI

SEQ ID NO: 329338 - protein, 9 aa, Influenza virus
WACQRGNIR

SEQ ID NO: 329339 - protein, 9 aa, Influenza virus
ACQRGNIRC

SEQ ID NO: 329340 - protein, 9 aa, Influenza virus
CQRGNIRCN

SEQ ID NO: 329341 - protein, 9 aa, Influenza virus
QRGNIRCNI

SEQ ID NO: 329342 - protein, 9 aa, Influenza virus
RGNIRCNIC

SEQ ID NO: 329343 - protein, 9 aa, Influenza virus
GNIKCNICI

SEQ ID NO: 329344 - protein, 9 aa, Influenza virus
MNPNQKIIA

SEQ ID NO: 329345 - protein, 9 aa, Influenza virus
YRKWSKPQC

SEQ ID NO: 329346 - protein, 9 aa, Influenza virus
IAGFAPFSK

SEQ ID NO: 329347 - protein, 9 aa, Influenza virus
SKDNSIRLA

SEQ ID NO: 329348 - protein, 9 aa, Influenza virus
KDNSIRLAA

SEQ ID NO: 329349 - protein, 9 aa, Influenza virus
DNSIRLAAG

SEQ ID NO: 329350 - protein, 9 aa, Influenza virus
NSIRLAAGG

SEQ ID NO: 329351 - protein, 9 aa, Influenza virus
SIRLSAGGA

SEQ ID NO: 329352 - protein, 9 aa, Influenza virus
IRLSAGGAI

SEQ ID NO: 329353 - protein, 9 aa, Influenza virus
RLSAGGAIW

SEQ ID NO: 329354 - protein, 9 aa, Influenza virus
LSAGGAIWV

SEQ ID NO: 329355 - protein, 9 aa, Influenza virus
SAGGAIWVT

SEQ ID NO: 329356 - protein, 9 aa, Influenza virus
AGGAIWVTR

SEQ ID NO: 329357 - protein, 9 aa, Influenza virus
GGAIWVTRE

SEQ ID NO: 329358 - protein, 9 aa, Influenza virus
GDIWVTREL

SEQ ID NO: 329359 - protein, 9 aa, Influenza virus
DIWVTRELY

SEQ ID NO: 329360 - protein, 9 aa, Influenza virus
IWVTRELYV

SEQ ID NO: 329361 - protein, 9 aa, Influenza virus
WVTRELYVS

SEQ ID NO: 329362 - protein, 9 aa, Influenza virus
VTRELYVSC

SEQ ID NO: 329363 - protein, 9 aa, Influenza virus
TREPYVSCS

SEQ ID NO: 329364 - protein, 9 aa, Influenza virus
GKCYQFALG

SEQ ID NO: 329365 - protein, 9 aa, Influenza virus
ALGQGTTLD

SEQ ID NO: 329366 - protein, 9 aa, Influenza virus
LGQGTTLDN

SEQ ID NO: 329367 - protein, 9 aa, Influenza virus
RIPHRTLLM

SEQ ID NO: 329368 - protein, 9 aa, Influenza virus
IPHRTLLMN

SEQ ID NO: 329369 - protein, 9 aa, Influenza virus
PHRTLLMNE

SEQ ID NO: 329370 - protein, 9 aa, Influenza virus
HRTLLMNEL

SEQ ID NO: 329371 - protein, 9 aa, Influenza virus
LMSELGVPF

SEQ ID NO: 329372 - protein, 9 aa, Influenza virus
MSELGVPFH

SEQ ID NO: 329373 - protein, 9 aa, Influenza virus
SELGVPFHL

SEQ ID NO: 329374 - protein, 9 aa, Influenza virus
GVPFHLGTR

SEQ ID NO: 329375 - protein, 9 aa, Influenza virus
VPFHLGTRQ

SEQ ID NO: 329376 - protein, 9 aa, Influenza virus
PFHLGTRQV

SEQ ID NO: 329377 - protein, 9 aa, Influenza virus
FHLGTRQVC

SEQ ID NO: 329378 - protein, 9 aa, Influenza virus
HLGTRQVCI

SEQ ID NO: 329379 - protein, 9 aa, Influenza virus
LGTRQVCIA

SEQ ID NO: 329380 - protein, 9 aa, Influenza virus
GTRQVCIAW

SEQ ID NO: 329381 - protein, 9 aa, Influenza virus
TRQVCIAWS

SEQ ID NO: 329382 - protein, 9 aa, Influenza virus
RQVCIAWSS

SEQ ID NO: 329383 - protein, 9 aa, Influenza virus
QVCMAWSSS

SEQ ID NO: 329384 - protein, 9 aa, Influenza virus
VCMAWSSSS

SEQ ID NO: 329385 - protein, 9 aa, Influenza virus
CMAWSSSSC

SEQ ID NO: 329386 - protein, 9 aa, Influenza virus
MAWSSSSCH

SEQ ID NO: 329387 - protein, 9 aa, Influenza virus
GKAWLHVCI

SEQ ID NO: 329388 - protein, 9 aa, Influenza virus
KAWLHVCIT

SEQ ID NO: 329389 - protein, 9 aa, Influenza virus
AWLHVCITG

SEQ ID NO: 329390 - protein, 9 aa, Influenza virus
ENATASFIY

SEQ ID NO: 329391 - protein, 9 aa, Influenza virus
NATASFIYD

SEQ ID NO: 329392 - protein, 9 aa, Influenza virus
ATASFIYDG

SEQ ID NO: 329393 - protein, 9 aa, Influenza virus
KILRTQESE

SEQ ID NO: 329394 - protein, 9 aa, Influenza virus
QESECICIN

SEQ ID NO: 329395 - protein, 9 aa, Influenza virus
ESECICING

SEQ ID NO: 329396 - protein, 9 aa, Influenza virus
SECICINGT

SEQ ID NO: 329397 - protein, 9 aa, Influenza virus
ECICINGTC

SEQ ID NO: 329398 - protein, 9 aa, Influenza virus
CVCINGTCA

SEQ ID NO: 329399 - protein, 9 aa, Influenza virus
VCINGTCAV

SEQ ID NO: 329400 - protein, 9 aa, Influenza virus
CINGTCAVV

SEQ ID NO: 329401 - protein, 9 aa, Influenza virus
INGTCAVVM

SEQ ID NO: 329402 - protein, 9 aa, Influenza virus
NGTCAVVMT

SEQ ID NO: 329403 - protein, 9 aa, Influenza virus
GTCAVVMTD

SEQ ID NO: 329404 - protein, 9 aa, Influenza virus
TCAVVMTDG

SEQ ID NO: 329405 - protein, 9 aa, Influenza virus
CAVVMTDGS

SEQ ID NO: 329406 - protein, 9 aa, Influenza virus
AVVMTDGSA

SEQ ID NO: 329407 - protein, 9 aa, Influenza virus
VVMTDGNAS

SEQ ID NO: 329408 - protein, 9 aa, Influenza virus
VMTDGSASE

SEQ ID NO: 329409 - protein, 9 aa, Influenza virus
LSGSAQHIE

SEQ ID NO: 329410 - protein, 9 aa, Influenza virus
SGSAQHIEE

SEQ ID NO: 329411 - protein, 9 aa, Influenza virus
GSAQHIEEC

SEQ ID NO: 329412 - protein, 9 aa, Influenza virus
SAQHIEECS

SEQ ID NO: 329413 - protein, 9 aa, Influenza virus
AQHIEECSC

SEQ ID NO: 329414 - protein, 9 aa, Influenza virus
QHIEECSCY

SEQ ID NO: 329415 - protein, 9 aa, Influenza virus
HIEECSCYP

SEQ ID NO: 329416 - protein, 9 aa, Influenza virus
IEECSCYPR

SEQ ID NO: 329417 - protein, 9 aa, Influenza virus
EECSCYPRF

SEQ ID NO: 329418 - protein, 9 aa, Influenza virus
ECSCYPRFP

SEQ ID NO: 329419 - protein, 9 aa, Influenza virus
CSCYPRYPN

SEQ ID NO: 329420 - protein, 9 aa, Influenza virus
VRCICRDNW

SEQ ID NO: 329421 - protein, 9 aa, Influenza virus
RCICRDNWK

SEQ ID NO: 329422 - protein, 9 aa, Influenza virus
CICRDNWKG

SEQ ID NO: 329423 - protein, 9 aa, Influenza virus
ICRDNWKGS

SEQ ID NO: 329424 - protein, 9 aa, Influenza virus
CRDNWRGSN

SEQ ID NO: 329425 - protein, 9 aa, Influenza virus
RDNWRGSNR

SEQ ID NO: 329426 - protein, 9 aa, Influenza virus
NWKGSNRPV

SEQ ID NO: 329427 - protein, 9 aa, Influenza virus
WKGSNRPVV

SEQ ID NO: 329428 - protein, 9 aa, Influenza virus
KGSNRPVVD

SEQ ID NO: 329429 - protein, 9 aa, Influenza virus
GSNRPVVDI

SEQ ID NO: 329430 - protein, 9 aa, Influenza virus
SNRPVVDIN

SEQ ID NO: 329431 - protein, 9 aa, Influenza virus
SRYVCSGLV

SEQ ID NO: 329432 - protein, 9 aa, Influenza virus
RYVCSGLVG

SEQ ID NO: 329433 - protein, 9 aa, Influenza virus
YMCSGLVGD

SEQ ID NO: 329434 - protein, 9 aa, Influenza virus
MCSGLVGDT

SEQ ID NO: 329435 - protein, 9 aa, Influenza virus
GLVGDTPRN

SEQ ID NO: 329436 - protein, 9 aa, Influenza virus
PGVKGWAFD

SEQ ID NO: 329437 - protein, 9 aa, Influenza virus
GVKGWAFDN

SEQ ID NO: 329438 - protein, 9 aa, Influenza virus
VKGWAFDNG

SEQ ID NO: 329439 - protein, 9 aa, Influenza virus
GDDVWMGRT

SEQ ID NO: 329440 - protein, 9 aa, Influenza virus
DDVWMGRTI

SEQ ID NO: 329441 - protein, 9 aa, Influenza virus
DVWMGRTIN

SEQ ID NO: 329442 - protein, 9 aa, Influenza virus
RLGYETFKV

SEQ ID NO: 329443 - protein, 9 aa, Influenza virus
LGYETFKVI

SEQ ID NO: 329444 - protein, 9 aa, Influenza virus
WSGYSGIFS

SEQ ID NO: 329445 - protein, 9 aa, Influenza virus
SGYSGVFSV

SEQ ID NO: 329446 - protein, 9 aa, Influenza virus
YSGIFSVES

SEQ ID NO: 329447 - protein, 9 aa, Influenza virus
SGIFSVESK

SEQ ID NO: 329448 - protein, 9 aa, Influenza virus
KSCVNRCFY

SEQ ID NO: 329449 - protein, 9 aa, Influenza virus
SCVNRCFYV

SEQ ID NO: 329450 - protein, 9 aa, Influenza virus
CVNRCFYVE

SEQ ID NO: 329451 - protein, 9 aa, Influenza virus
VNRCFYVEL

SEQ ID NO: 329452 - protein, 9 aa, Influenza virus
FYVELIRGS

SEQ ID NO: 329453 - protein, 9 aa, Influenza virus
EVWWTSNSI

SEQ ID NO: 329454 - protein, 9 aa, Influenza virus
VWWTSNSIV

SEQ ID NO: 329455 - protein, 9 aa, Influenza virus
WWTSNSIVV

SEQ ID NO: 329456 - protein, 9 aa, Influenza virus
CGTSGTYGS

SEQ ID NO: 329457 - protein, 9 aa, Influenza virus
GTSGTYGSG

SEQ ID NO: 329458 - protein, 9 aa, Influenza virus
TSGTYGSGS

SEQ ID NO: 329459 - protein, 9 aa, Influenza virus
SGTYGSGSW

SEQ ID NO: 329460 - protein, 9 aa, Influenza virus
GTYGSGSWP

SEQ ID NO: 329461 - protein, 9 aa, Influenza virus
TYGSGSWPD

SEQ ID NO: 329462 - protein, 9 aa, Influenza virus
YGSGSWPDG

SEQ ID NO: 329463 - protein, 9 aa, Influenza virus
GSGSWPDGA

SEQ ID NO: 329464 - protein, 9 aa, Influenza virus
TGSWPDGAN

SEQ ID NO: 329465 - protein, 9 aa, Influenza virus
GSWPDGANI

SEQ ID NO: 329466 - protein, 9 aa, Influenza virus
ADINLMPIY

SEQ ID NO: 329467 - protein, 9 aa, Influenza virus
DIKSHAYIS

SEQ ID NO: 329468 - protein, 9 aa, Influenza virus
IKSHAYISF

SEQ ID NO: 329469 - protein, 9 aa, Influenza virus
GLMGRTRIS

SEQ ID NO: 329470 - protein, 9 aa, Influenza virus
YTGNPVICM

SEQ ID NO: 329471 - protein, 9 aa, Influenza virus
TGNPVICMG

SEQ ID NO: 329472 - protein, 9 aa, Influenza virus
GNPVICMGH

SEQ ID NO: 329473 - protein, 9 aa, Influenza virus
NPVICMGHH

SEQ ID NO: 329474 - protein, 9 aa, Influenza virus
PVICMGHHA

SEQ ID NO: 329475 - protein, 9 aa, Influenza virus
VICMGHHAV

SEQ ID NO: 329476 - protein, 9 aa, Influenza virus
GHHAVSNGT

SEQ ID NO: 329477 - protein, 9 aa, Influenza virus
VSNGTMVKT

SEQ ID NO: 329478 - protein, 9 aa, Influenza virus
NGTMVKTLA

SEQ ID NO: 329479 - protein, 9 aa, Influenza virus
GTIVKTLTD

SEQ ID NO: 329480 - protein, 9 aa, Influenza virus
VEVVTAQEL

SEQ ID NO: 329481 - protein, 9 aa, Influenza virus
EVVAAQELV

SEQ ID NO: 329482 - protein, 9 aa, Influenza virus
VVAAQELVE

SEQ ID NO: 329483 - protein, 9 aa, Influenza virus
VAAQELVES

SEQ ID NO: 329484 - protein, 9 aa, Influenza virus
AAQELVESQ

SEQ ID NO: 329485 - protein, 9 aa, Influenza virus
ELCPSPLKL

SEQ ID NO: 329486 - protein, 9 aa, Influenza virus
LCPSPLRLI

SEQ ID NO: 329487 - protein, 9 aa, Influenza virus
CPSPLRLID

SEQ ID NO: 329488 - protein, 9 aa, Influenza virus
SPLRLIDGQ

SEQ ID NO: 329489 - protein, 9 aa, Influenza virus
CDIINGALG

SEQ ID NO: 329490 - protein, 9 aa, Influenza virus
DIINGALGS

SEQ ID NO: 329491 - protein, 9 aa, Influenza virus
IINGALGSP

SEQ ID NO: 329492 - protein, 9 aa, Influenza virus
INGALGSPG

SEQ ID NO: 329493 - protein, 9 aa, Influenza virus
NSALGSPGC

SEQ ID NO: 329494 - protein, 9 aa, Influenza virus
SALGSPGCD

SEQ ID NO: 329495 - protein, 9 aa, Influenza virus
ALGSPGCDR

SEQ ID NO: 329496 - protein, 9 aa, Influenza virus
LGSPGCDRL

SEQ ID NO: 329497 - protein, 9 aa, Influenza virus
EWDIFIERP

SEQ ID NO: 329498 - protein, 9 aa, Influenza virus
TCYPFDVPE

SEQ ID NO: 329499 - protein, 9 aa, Influenza virus
CYPFDVPEY

SEQ ID NO: 329500 - protein, 9 aa, Influenza virus
YPFDVPEYQ

SEQ ID NO: 329501 - protein, 9 aa, Influenza virus
PFDVPEYQS

SEQ ID NO: 329502 - protein, 9 aa, Influenza virus
DVPEYQSLR

SEQ ID NO: 329503 - protein, 9 aa, Influenza virus
VPEYQSLRS

SEQ ID NO: 329504 - protein, 9 aa, Influenza virus
PEYQSLRSI

SEQ ID NO: 329505 - protein, 9 aa, Influenza virus
EYQSLRSIL

SEQ ID NO: 329506 - protein, 9 aa, Influenza virus
YQSIRSILA

SEQ ID NO: 329507 - protein, 9 aa, Influenza virus
RSILANNGR

SEQ ID NO: 329508 - protein, 9 aa, Influenza virus
SILANNGRF

SEQ ID NO: 329509 - protein, 9 aa, Influenza virus
ILANNGRFE

SEQ ID NO: 329510 - protein, 9 aa, Influenza virus
LANNGRFEF

SEQ ID NO: 329511 - protein, 9 aa, Influenza virus
ANNGRFEFI

SEQ ID NO: 329512 - protein, 9 aa, Influenza virus
NNGRFEFIA

SEQ ID NO: 329513 - protein, 9 aa, Influenza virus
NGRFEFIAE

SEQ ID NO: 329514 - protein, 9 aa, Influenza virus
GRFEFIAEE

SEQ ID NO: 329515 - protein, 9 aa, Influenza virus
RFEFIAEEF

SEQ ID NO: 329516 - protein, 9 aa, Influenza virus
TVKQNGKSS

SEQ ID NO: 329517 - protein, 9 aa, Influenza virus
VKQNGKSSA

SEQ ID NO: 329518 - protein, 9 aa, Influenza virus
KQNGKSSAC

SEQ ID NO: 329519 - protein, 9 aa, Influenza virus
QNGKSSACK

SEQ ID NO: 329520 - protein, 9 aa, Influenza virus
NGKSSACKR

SEQ ID NO: 329521 - protein, 9 aa, Influenza virus
GKSSACKRA

SEQ ID NO: 329522 - protein, 9 aa, Influenza virus
KSSACKRAN

SEQ ID NO: 329523 - protein, 9 aa, Influenza virus
NDFFRRLNW

SEQ ID NO: 329524 - protein, 9 aa, Influenza virus
DFFRRLNWL

SEQ ID NO: 329525 - protein, 9 aa, Influenza virus
EYPLQNLTK

SEQ ID NO: 329526 - protein, 9 aa, Influenza virus
YPLQNLTKI

SEQ ID NO: 329527 - protein, 9 aa, Influenza virus
PLQNLTKIN

SEQ ID NO: 329528 - protein, 9 aa, Influenza virus
QNLTKINNG

SEQ ID NO: 329529 - protein, 9 aa, Influenza virus
NLTKINNGD

SEQ ID NO: 329530 - protein, 9 aa, Influenza virus
LTKINNGDY

SEQ ID NO: 329531 - protein, 9 aa, Influenza virus
NNGDYTRLY

SEQ ID NO: 329532 - protein, 9 aa, Influenza virus
NGDYTRLYI

SEQ ID NO: 329533 - protein, 9 aa, Influenza virus
GDYTRLYIW

SEQ ID NO: 329534 - protein, 9 aa, Influenza virus
DYTRLYIWG

SEQ ID NO: 329535 - protein, 9 aa, Influenza virus
YTRLYIWGV

SEQ ID NO: 329536 - protein, 9 aa, Influenza virus
TRLYIWGVH

SEQ ID NO: 329537 - protein, 9 aa, Influenza virus
GVHHPSTDK

SEQ ID NO: 329538 - protein, 9 aa, Influenza virus
VHHPSTDKE

SEQ ID NO: 329539 - protein, 9 aa, Influenza virus
HHPSTDKEQ

SEQ ID NO: 329540 - protein, 9 aa, Influenza virus
LYKNSPGRV

SEQ ID NO: 329541 - protein, 9 aa, Influenza virus
YKNSPGRVT

SEQ ID NO: 329542 - protein, 9 aa, Influenza virus
NSPGRVTVS

SEQ ID NO: 329543 - protein, 9 aa, Influenza virus
SPGRVTVST

SEQ ID NO: 329544 - protein, 9 aa, Influenza virus
PGRVTVSTQ

SEQ ID NO: 329545 - protein, 9 aa, Influenza virus
QTSVVPNID

SEQ ID NO: 329546 - protein, 9 aa, Influenza virus
RPLVRGQSG

SEQ ID NO: 329547 - protein, 9 aa, Influenza virus
PLVRGQSGR

SEQ ID NO: 329548 - protein, 9 aa, Influenza virus
VRGQSGRVS

SEQ ID NO: 329549 - protein, 9 aa, Influenza virus
RGQSGRVSF

SEQ ID NO: 329550 - protein, 9 aa, Influenza virus
GQSGRVSFY

SEQ ID NO: 329551 - protein, 9 aa, Influenza virus
QSGRVSFYW

SEQ ID NO: 329552 - protein, 9 aa, Influenza virus
SGRVSFYWT

SEQ ID NO: 329553 - protein, 9 aa, Influenza virus
GRVSFYWTI

SEQ ID NO: 329554 - protein, 9 aa, Influenza virus
RVSFYWTIV

SEQ ID NO: 329555 - protein, 9 aa, Influenza virus
VSFYWTIVE

SEQ ID NO: 329556 - protein, 9 aa, Influenza virus
SFYWTIVDP

SEQ ID NO: 329557 - protein, 9 aa, Influenza virus
FYWTIVDPG

SEQ ID NO: 329558 - protein, 9 aa, Influenza virus
YWTIVDPGD

SEQ ID NO: 329559 - protein, 9 aa, Influenza virus
PGDIIVFNT

SEQ ID NO: 329560 - protein, 9 aa, Influenza virus
GDIIVFNTI

SEQ ID NO: 329561 - protein, 9 aa, Influenza virus
DIIVFNTIG

SEQ ID NO: 329562 - protein, 9 aa, Influenza virus
IIVFNTIGN

SEQ ID NO: 329563 - protein, 9 aa, Influenza virus
ILFNTIGNL

SEQ ID NO: 329564 - protein, 9 aa, Influenza virus
VFNTIGNLV

SEQ ID NO: 329565 - protein, 9 aa, Influenza virus
FNTIGNLVA

SEQ ID NO: 329566 - protein, 9 aa, Influenza virus
NTIGNLVAP

SEQ ID NO: 329567 - protein, 9 aa, Influenza virus
TIGNLVAPR

SEQ ID NO: 329568 - protein, 9 aa, Influenza virus
IGNLVAPRG

SEQ ID NO: 329569 - protein, 9 aa, Influenza virus
GNLVAPRGH

SEQ ID NO: 329570 - protein, 9 aa, Influenza virus
NLVAPRGHY

SEQ ID NO: 329571 - protein, 9 aa, Influenza virus
LVAPRGHYK

SEQ ID NO: 329572 - protein, 9 aa, Influenza virus
VAPRGHYKL

SEQ ID NO: 329573 - protein, 9 aa, Influenza virus
IGSCASKCH

SEQ ID NO: 329574 - protein, 9 aa, Influenza virus
GSCASKCHT

SEQ ID NO: 329575 - protein, 9 aa, Influenza virus
SKCHTDKGS

SEQ ID NO: 329576 - protein, 9 aa, Influenza virus
KPFQNISRV

SEQ ID NO: 329577 - protein, 9 aa, Influenza virus
PFQNISRIA

SEQ ID NO: 329578 - protein, 9 aa, Influenza virus
GDCPKYIKQ

SEQ ID NO: 329579 - protein, 9 aa, Influenza virus
ECPKYVKQG

SEQ ID NO: 329580 - protein, 9 aa, Influenza virus
CPKYIKQGS

SEQ ID NO: 329581 - protein, 9 aa, Influenza virus
PKYIKQGSL

SEQ ID NO: 329582 - protein, 9 aa, Influenza virus
KYIKQGSLK

SEQ ID NO: 329583 - protein, 9 aa, Influenza virus
YIKQGSLKL

SEQ ID NO: 329584 - protein, 9 aa, Influenza virus
IKQGSLKLA

SEQ ID NO: 329585 - protein, 9 aa, Influenza virus
KQGSLRLAT

SEQ ID NO: 329586 - protein, 9 aa, Influenza virus
QGSLRLATG

SEQ ID NO: 329587 - protein, 9 aa, Influenza virus
GSLRLATGM

SEQ ID NO: 329588 - protein, 9 aa, Influenza virus
RLATGMRNI

SEQ ID NO: 329589 - protein, 9 aa, Influenza virus
TGMRNIPER

SEQ ID NO: 329590 - protein, 9 aa, Influenza virus
KGLFGAIAG

SEQ ID NO: 329591 - protein, 9 aa, Influenza virus
WYGFRHQNS

SEQ ID NO: 329592 - protein, 9 aa, Influenza virus
YGFRHQNSE

SEQ ID NO: 329593 - protein, 9 aa, Influenza virus
GFRHQNSEG

SEQ ID NO: 329594 - protein, 9 aa, Influenza virus
FRHQNSEGT

SEQ ID NO: 329595 - protein, 9 aa, Influenza virus
RHQNSEGTG

SEQ ID NO: 329596 - protein, 9 aa, Influenza virus
QNSEGTGTA

SEQ ID NO: 329597 - protein, 9 aa, Influenza virus
SEGTGTAAD

SEQ ID NO: 329598 - protein, 9 aa, Influenza virus
AADLKSTQT

SEQ ID NO: 329599 - protein, 9 aa, Influenza virus
ADLKSTQTA

SEQ ID NO: 329600 - protein, 9 aa, Influenza virus
DLKSTQTAI

SEQ ID NO: 329601 - protein, 9 aa, Influenza virus
LKSTQTAID

SEQ ID NO: 329602 - protein, 9 aa, Influenza virus
KSTQTAIDQ

SEQ ID NO: 329603 - protein, 9 aa, Influenza virus
STQTAIDQI

SEQ ID NO: 329604 - protein, 9 aa, Influenza virus
TQTAIDQIN

SEQ ID NO: 329605 - protein, 9 aa, Influenza virus
QTAIDQING

SEQ ID NO: 329606 - protein, 9 aa, Influenza virus
TAIDQINGK

SEQ ID NO: 329607 - protein, 9 aa, Influenza virus
AIDQITGKL

SEQ ID NO: 329608 - protein, 9 aa, Influenza virus
IDQITGKLN

SEQ ID NO: 329609 - protein, 9 aa, Influenza virus
DQITGKLNR

SEQ ID NO: 329610 - protein, 9 aa, Influenza virus
QITGKLNRL

SEQ ID NO: 329611 - protein, 9 aa, Influenza virus
ITGKLNRLI

SEQ ID NO: 329612 - protein, 9 aa, Influenza virus
TGKLNRLIE

SEQ ID NO: 329613 - protein, 9 aa, Influenza virus
GKLNRLIER

SEQ ID NO: 329614 - protein, 9 aa, Influenza virus
KLNRLIERT

SEQ ID NO: 329615 - protein, 9 aa, Influenza virus
LNRLIERTN

SEQ ID NO: 329616 - protein, 9 aa, Influenza virus
NRLIERTNE

SEQ ID NO: 329617 - protein, 9 aa, Influenza virus
RLIEKTNDK

SEQ ID NO: 329618 - protein, 9 aa, Influenza virus
LIERTNEKY

SEQ ID NO: 329619 - protein, 9 aa, Influenza virus
IEKTNDKYH

SEQ ID NO: 329620 - protein, 9 aa, Influenza virus
EKTNDKYHQ

SEQ ID NO: 329621 - protein, 9 aa, Influenza virus
RTNEKYHQI

SEQ ID NO: 329622 - protein, 9 aa, Influenza virus
TNDKYHQIE

SEQ ID NO: 329623 - protein, 9 aa, Influenza virus
NDKYHQIEK

SEQ ID NO: 329624 - protein, 9 aa, Influenza virus
DKYHQIEKE

SEQ ID NO: 329625 - protein, 9 aa, Influenza virus
YHQIEKEFG

SEQ ID NO: 329626 - protein, 9 aa, Influenza virus
HQIEKEFGQ

SEQ ID NO: 329627 - protein, 9 aa, Influenza virus
QIEKEFGQV

SEQ ID NO: 329628 - protein, 9 aa, Influenza virus
IEKEFGQVE

SEQ ID NO: 329629 - protein, 9 aa, Influenza virus
EKEFGQVEG

SEQ ID NO: 329630 - protein, 9 aa, Influenza virus
KEFGQVEGR

SEQ ID NO: 329631 - protein, 9 aa, Influenza virus
EFGQVEGRI

SEQ ID NO: 329632 - protein, 9 aa, Influenza virus
FGQVEGRIQ

SEQ ID NO: 329633 - protein, 9 aa, Influenza virus
GQVEGRIQD

SEQ ID NO: 329634 - protein, 9 aa, Influenza virus
QVEGRIQYL

SEQ ID NO: 329635 - protein, 9 aa, Influenza virus
VEGRTQDLE

SEQ ID NO: 329636 - protein, 9 aa, Influenza virus
QDLERYVED

SEQ ID NO: 329637 - protein, 9 aa, Influenza virus
DLERYVEDT

SEQ ID NO: 329638 - protein, 9 aa, Influenza virus
LERYVEDTK

SEQ ID NO: 329639 - protein, 9 aa, Influenza virus
EKYVEDTKV

SEQ ID NO: 329640 - protein, 9 aa, Influenza virus
KYVEDTKVD

SEQ ID NO: 329641 - protein, 9 aa, Influenza virus
YVEDTKVDL

SEQ ID NO: 329642 - protein, 9 aa, Influenza virus
VEDTKVDLW

SEQ ID NO: 329643 - protein, 9 aa, Influenza virus
EDTKVDLWS

SEQ ID NO: 329644 - protein, 9 aa, Influenza virus
DTKVDLWSY

SEQ ID NO: 329645 - protein, 9 aa, Influenza virus
TKVDLWSYN

SEQ ID NO: 329646 - protein, 9 aa, Influenza virus
KVDLWSYNA

SEQ ID NO: 329647 - protein, 9 aa, Influenza virus
VDLWSYNAE

SEQ ID NO: 329648 - protein, 9 aa, Influenza virus
LENQHTIDM

SEQ ID NO: 329649 - protein, 9 aa, Influenza virus
ENQHTIDMT

SEQ ID NO: 329650 - protein, 9 aa, Influenza virus
NQHTIDMTD

SEQ ID NO: 329651 - protein, 9 aa, Influenza virus
QHTIDMTDS

SEQ ID NO: 329652 - protein, 9 aa, Influenza virus
HTIDMTDSE

SEQ ID NO: 329653 - protein, 9 aa, Influenza virus
TIDMTDSEM

SEQ ID NO: 329654 - protein, 9 aa, Influenza virus
IDVTDSEMD

SEQ ID NO: 329655 - protein, 9 aa, Influenza virus
DVTDSEMNR

SEQ ID NO: 329656 - protein, 9 aa, Influenza virus
VTDSEMNRL

SEQ ID NO: 329657 - protein, 9 aa, Influenza virus
TDSEMNRLF

SEQ ID NO: 329658 - protein, 9 aa, Influenza virus
DSEMNRLFE

SEQ ID NO: 329659 - protein, 9 aa, Influenza virus
SEMDKLFER

SEQ ID NO: 329660 - protein, 9 aa, Influenza virus
EMNRLFERV

SEQ ID NO: 329661 - protein, 9 aa, Influenza virus
MNKLFERVK

SEQ ID NO: 329662 - protein, 9 aa, Influenza virus
KLFERVRHQ

SEQ ID NO: 329663 - protein, 9 aa, Influenza virus
LFERVRHQL

SEQ ID NO: 329664 - protein, 9 aa, Influenza virus
FERVRHQLR

SEQ ID NO: 329665 - protein, 9 aa, Influenza virus
ERVRHQLRE

SEQ ID NO: 329666 - protein, 9 aa, Influenza virus
RVRHQLREN

SEQ ID NO: 329667 - protein, 9 aa, Influenza virus
VRHQLRENA

SEQ ID NO: 329668 - protein, 9 aa, Influenza virus
RHQLRENAE

SEQ ID NO: 329669 - protein, 9 aa, Influenza virus
HQLRENAED

SEQ ID NO: 329670 - protein, 9 aa, Influenza virus
QLRENAEDR

SEQ ID NO: 329671 - protein, 9 aa, Influenza virus
LRENAEDRG

SEQ ID NO: 329672 - protein, 9 aa, Influenza virus
RENAEDRGN

SEQ ID NO: 329673 - protein, 9 aa, Influenza virus
ENAEDRGNG

SEQ ID NO: 329674 - protein, 9 aa, Influenza virus
NAEDRGNGC

SEQ ID NO: 329675 - protein, 9 aa, Influenza virus
AEDRGNGCF

SEQ ID NO: 329676 - protein, 9 aa, Influenza virus
EDRGNGCFE

SEQ ID NO: 329677 - protein, 9 aa, Influenza virus
DRGNGCFEI

SEQ ID NO: 329678 - protein, 9 aa, Influenza virus
RGNGCFEIF

SEQ ID NO: 329679 - protein, 9 aa, Influenza virus
NGCFEIFHK

SEQ ID NO: 329680 - protein, 9 aa, Influenza virus
GCFEIFHKC

SEQ ID NO: 329681 - protein, 9 aa, Influenza virus
CFEIFHKCD

SEQ ID NO: 329682 - protein, 9 aa, Influenza virus
FEIFHKCDN

SEQ ID NO: 329683 - protein, 9 aa, Influenza virus
CDNSCIESI

SEQ ID NO: 329684 - protein, 9 aa, Influenza virus
DNSCIESIR

SEQ ID NO: 329685 - protein, 9 aa, Influenza virus
NSCIESIRN

SEQ ID NO: 329686 - protein, 9 aa, Influenza virus
SCIESIRNG

SEQ ID NO: 329687 - protein, 9 aa, Influenza virus
ESIRNGTYN

SEQ ID NO: 329688 - protein, 9 aa, Influenza virus
SIRNGTYNH

SEQ ID NO: 329689 - protein, 9 aa, Influenza virus
IRNGTYNHD

SEQ ID NO: 329690 - protein, 9 aa, Influenza virus
HDVYRDEAI

SEQ ID NO: 329691 - protein, 9 aa, Influenza virus
YRDEAISNR

SEQ ID NO: 329692 - protein, 9 aa, Influenza virus
RDEAISNRF

SEQ ID NO: 329693 - protein, 9 aa, Influenza virus
DEAISNRFQ

SEQ ID NO: 329694 - protein, 9 aa, Influenza virus
EAISNRFQI

SEQ ID NO: 329695 - protein, 9 aa, Influenza virus
AISNRFQIQ

SEQ ID NO: 329696 - protein, 9 aa, Influenza virus
ISNRFQIQG

SEQ ID NO: 329697 - protein, 9 aa, Influenza virus
SNRFQIQGV

SEQ ID NO: 329698 - protein, 9 aa, Influenza virus
NRFQIQGVR

SEQ ID NO: 329699 - protein, 9 aa, Influenza virus
RFQIQGVRL

SEQ ID NO: 329700 - protein, 9 aa, Influenza virus
FQIQGVRLT

SEQ ID NO: 329701 - protein, 9 aa, Influenza virus
QIQGVRLTQ

SEQ ID NO: 329702 - protein, 9 aa, Influenza virus
IQGVRLTQG

SEQ ID NO: 329703 - protein, 9 aa, Influenza virus
QGVRLTQGY

SEQ ID NO: 329704 - protein, 9 aa, Influenza virus
GVRLTQGYK

SEQ ID NO: 329705 - protein, 9 aa, Influenza virus
VRLTQGYKD

SEQ ID NO: 329706 - protein, 9 aa, Influenza virus
RLTQGYKDI

SEQ ID NO: 329707 - protein, 9 aa, Influenza virus
LAQGYKDII

SEQ ID NO: 329708 - protein, 9 aa, Influenza virus
AQGYKDIIL

SEQ ID NO: 329709 - protein, 9 aa, Influenza virus
GYKDIILWV

SEQ ID NO: 329710 - protein, 9 aa, Influenza virus
YKDIILWVS

SEQ ID NO: 329711 - protein, 9 aa, Influenza virus
KDIILWVSF

SEQ ID NO: 329712 - protein, 9 aa, Influenza virus
DIILWVSFS

SEQ ID NO: 329713 - protein, 9 aa, Influenza virus
IILWVSFSI

SEQ ID NO: 329714 - protein, 9 aa, Influenza virus
ILWVSFSIS

SEQ ID NO: 329715 - protein, 9 aa, Influenza virus
LWVSFSISC

SEQ ID NO: 329716 - protein, 9 aa, Influenza virus
WVSFSISCF

SEQ ID NO: 329717 - protein, 9 aa, Influenza virus
VSFSISCFL

SEQ ID NO: 329718 - protein, 9 aa, Influenza virus
FSISCFLLA

SEQ ID NO: 329719 - protein, 9 aa, Influenza virus
SISCFLLAA

SEQ ID NO: 329720 - protein, 9 aa, Influenza virus
ISCFLLAAL

SEQ ID NO: 329721 - protein, 9 aa, Influenza virus
SCFLLAALL

SEQ ID NO: 329722 - protein, 9 aa, Influenza virus
CFLLAALLL

SEQ ID NO: 329723 - protein, 9 aa, Influenza virus
ALLIAFVLW

SEQ ID NO: 329724 - protein, 9 aa, Influenza virus
LLIAFVLWA

SEQ ID NO: 329725 - protein, 9 aa, Influenza virus
LIAFVLWAC

SEQ ID NO: 329726 - protein, 9 aa, Influenza virus
IAFVLWACQ

SEQ ID NO: 329727 - protein, 9 aa, Influenza virus
AFVLWACQN

SEQ ID NO: 329728 - protein, 9 aa, Influenza virus
FVLWACQNG

SEQ ID NO: 329729 - protein, 9 aa, Influenza virus
VLWACQNGN

SEQ ID NO: 329730 - protein, 9 aa, Influenza virus
LWACQNGNL

SEQ ID NO: 329731 - protein, 9 aa, Influenza virus
WACQNGNLR

SEQ ID NO: 329732 - protein, 9 aa, Influenza virus
ACQNGNLRC

SEQ ID NO: 329733 - protein, 9 aa, Influenza virus
CQNGNLRCQ

SEQ ID NO: 329734 - protein, 9 aa, Influenza virus
QNGNLRCQI

SEQ ID NO: 329735 - protein, 9 aa, Influenza virus
NGNLRCQIC

SEQ ID NO: 329736 - protein, 9 aa, Influenza virus
GNLRCQICI

SEQ ID NO: 329737 - protein, 9 aa, Influenza virus
ICQMEKIVL

SEQ ID NO: 329738 - protein, 9 aa, Influenza virus
CQMEKIVLL

SEQ ID NO: 329739 - protein, 9 aa, Influenza virus
QMEKIVLLF

SEQ ID NO: 329740 - protein, 9 aa, Influenza virus
GDQICIGYH

SEQ ID NO: 329741 - protein, 9 aa, Influenza virus
DHICIGYHA

SEQ ID NO: 329742 - protein, 9 aa, Influenza virus
HICIGYHAN

SEQ ID NO: 329743 - protein, 9 aa, Influenza virus
ICVGYHANN

SEQ ID NO: 329744 - protein, 9 aa, Influenza virus
CVGYHANNS

SEQ ID NO: 329745 - protein, 9 aa, Influenza virus
VGYHANNST

SEQ ID NO: 329746 - protein, 9 aa, Influenza virus
GYHANNSTK

SEQ ID NO: 329747 - protein, 9 aa, Influenza virus
QIDTIMEKN

SEQ ID NO: 329748 - protein, 9 aa, Influenza virus
VDTIMERNV

SEQ ID NO: 329749 - protein, 9 aa, Influenza virus
DTIMERNVT

SEQ ID NO: 329750 - protein, 9 aa, Influenza virus
TIMERNVTV

SEQ ID NO: 329751 - protein, 9 aa, Influenza virus
IMERNVTVT

SEQ ID NO: 329752 - protein, 9 aa, Influenza virus
MERNVTVTH

SEQ ID NO: 329753 - protein, 9 aa, Influenza virus
ERNVTVTHA

SEQ ID NO: 329754 - protein, 9 aa, Influenza virus
RNVTVTHAQ

SEQ ID NO: 329755 - protein, 9 aa, Influenza virus
NVTVTHAQN

SEQ ID NO: 329756 - protein, 9 aa, Influenza virus
VTVTHAQNI

SEQ ID NO: 329757 - protein, 9 aa, Influenza virus
TVTHAQNIL

SEQ ID NO: 329758 - protein, 9 aa, Influenza virus
VTHAQNILE

SEQ ID NO: 329759 - protein, 9 aa, Influenza virus
THAQDILER

SEQ ID NO: 329760 - protein, 9 aa, Influenza virus
KPLILKDCS

SEQ ID NO: 329761 - protein, 9 aa, Influenza virus
PLILKDCSV

SEQ ID NO: 329762 - protein, 9 aa, Influenza virus
ILKDCSVAG

SEQ ID NO: 329763 - protein, 9 aa, Influenza virus
LKDCSVAGW

SEQ ID NO: 329764 - protein, 9 aa, Influenza virus
KDCSVAGWL

SEQ ID NO: 329765 - protein, 9 aa, Influenza virus
DCSIAGWLL

SEQ ID NO: 329766 - protein, 9 aa, Influenza virus
CSIAGWLLG

SEQ ID NO: 329767 - protein, 9 aa, Influenza virus
SIAGWLLGN

SEQ ID NO: 329768 - protein, 9 aa, Influenza virus
IAGWLLGNP

SEQ ID NO: 329769 - protein, 9 aa, Influenza virus
AGWLLGNPL

SEQ ID NO: 329770 - protein, 9 aa, Influenza virus
GWLLGNPLC

SEQ ID NO: 329771 - protein, 9 aa, Influenza virus
WLLGNPLCD

SEQ ID NO: 329772 - protein, 9 aa, Influenza virus
LLGNPLCDE

SEQ ID NO: 329773 - protein, 9 aa, Influenza virus
LGNPLCDEF

SEQ ID NO: 329774 - protein, 9 aa, Influenza virus
VSEWSYIVE

SEQ ID NO: 329775 - protein, 9 aa, Influenza virus
SEWSYIVEK

SEQ ID NO: 329776 - protein, 9 aa, Influenza virus
TGRSSFFRN

SEQ ID NO: 329777 - protein, 9 aa, Influenza virus
LLILWGIHH

SEQ ID NO: 329778 - protein, 9 aa, Influenza virus
YVSVGTSTL

SEQ ID NO: 329779 - protein, 9 aa, Influenza virus
VSVGTSTLN

SEQ ID NO: 329780 - protein, 9 aa, Influenza virus
SIGTSTLNQ

SEQ ID NO: 329781 - protein, 9 aa, Influenza virus
IGTSTLNQR

SEQ ID NO: 329782 - protein, 9 aa, Influenza virus
GTSTLNQRS

SEQ ID NO: 329783 - protein, 9 aa, Influenza virus
FESTGNFIA

SEQ ID NO: 329784 - protein, 9 aa, Influenza virus
ESTGNFIAP

SEQ ID NO: 329785 - protein, 9 aa, Influenza virus
STGNFIAPE

SEQ ID NO: 329786 - protein, 9 aa, Influenza virus
NGNFIAPEN

SEQ ID NO: 329787 - protein, 9 aa, Influenza virus
GNFIAPENA

SEQ ID NO: 329788 - protein, 9 aa, Influenza virus
NFIAPENAY

SEQ ID NO: 329789 - protein, 9 aa, Influenza virus
FIAPENAYK

SEQ ID NO: 329790 - protein, 9 aa, Influenza virus
IAPENAYKI

SEQ ID NO: 329791 - protein, 9 aa, Influenza virus
CQTPIGAIN

SEQ ID NO: 329792 - protein, 9 aa, Influenza virus
SSMPFHNVH

SEQ ID NO: 329793 - protein, 9 aa, Influenza virus
SMPFHNVHP

SEQ ID NO: 329794 - protein, 9 aa, Influenza virus
MPFHNVHPL

SEQ ID NO: 329795 - protein, 9 aa, Influenza virus
PFHNVHPLT

SEQ ID NO: 329796 - protein, 9 aa, Influenza virus
FHNVHPLTI

SEQ ID NO: 329797 - protein, 9 aa, Influenza virus
HNVHPLTIG

SEQ ID NO: 329798 - protein, 9 aa, Influenza virus
HPFTIGECP

SEQ ID NO: 329799 - protein, 9 aa, Influenza virus
PFTIGECPK

SEQ ID NO: 329800 - protein, 9 aa, Influenza virus
FTIGECPKY

SEQ ID NO: 329801 - protein, 9 aa, Influenza virus
TIGECPRYV

SEQ ID NO: 329802 - protein, 9 aa, Influenza virus
IGECPRYVK

SEQ ID NO: 329803 - protein, 9 aa, Influenza virus
GECPRYVKS

SEQ ID NO: 329804 - protein, 9 aa, Influenza virus
LVLATGPRN

SEQ ID NO: 329805 - protein, 9 aa, Influenza virus
RRKRGLFGA

SEQ ID NO: 329806 - protein, 9 aa, Influenza virus
TRRQKRGLF

SEQ ID NO: 329807 - protein, 9 aa, Influenza virus
RRQKRGLFG

SEQ ID NO: 329808 - protein, 9 aa, Influenza virus
RKKRGLFGA

SEQ ID NO: 329809 - protein, 9 aa, Influenza virus
QKRGLFGAI

SEQ ID NO: 329810 - protein, 9 aa, Influenza virus
TRGLFGAIA

SEQ ID NO: 329811 - protein, 9 aa, Influenza virus
IEGGWQGMI

SEQ ID NO: 329812 - protein, 9 aa, Influenza virus
EGGWQGMID

SEQ ID NO: 329813 - protein, 9 aa, Influenza virus
GGWQGMIDG

SEQ ID NO: 329814 - protein, 9 aa, Influenza virus
GWQGMIDGW

SEQ ID NO: 329815 - protein, 9 aa, Influenza virus
WQGMIDGWY

SEQ ID NO: 329816 - protein, 9 aa, Influenza virus
QGMIDGWYG

SEQ ID NO: 329817 - protein, 9 aa, Influenza virus
GMVDGWYGF

SEQ ID NO: 329818 - protein, 9 aa, Influenza virus
MVDGWYGFH

SEQ ID NO: 329819 - protein, 9 aa, Influenza virus
VDGWYGFHH

SEQ ID NO: 329820 - protein, 9 aa, Influenza virus
DGWYGFHHS

SEQ ID NO: 329821 - protein, 9 aa, Influenza virus
GWYGFHHSN

SEQ ID NO: 329822 - protein, 9 aa, Influenza virus
NGQGSGYAA

SEQ ID NO: 329823 - protein, 9 aa, Influenza virus
GQGSGYAAD

SEQ ID NO: 329824 - protein, 9 aa, Influenza virus
QGSGYAADQ

SEQ ID NO: 329825 - protein, 9 aa, Influenza virus
GSGYAADQE

SEQ ID NO: 329826 - protein, 9 aa, Influenza virus
SGYAADQES

SEQ ID NO: 329827 - protein, 9 aa, Influenza virus
GYAADQEST

SEQ ID NO: 329828 - protein, 9 aa, Influenza virus
YAADQESTQ

SEQ ID NO: 329829 - protein, 9 aa, Influenza virus
AADKESTQR

SEQ ID NO: 329830 - protein, 9 aa, Influenza virus
ADKESTQRA

SEQ ID NO: 329831 - protein, 9 aa, Influenza virus
ESTQRAIDG

SEQ ID NO: 329832 - protein, 9 aa, Influenza virus
DGITNKVNS

SEQ ID NO: 329833 - protein, 9 aa, Influenza virus
GITNKVNSI

SEQ ID NO: 329834 - protein, 9 aa, Influenza virus
ITNKVNSII

SEQ ID NO: 329835 - protein, 9 aa, Influenza virus
TNKVNSIIN

SEQ ID NO: 329836 - protein, 9 aa, Influenza virus
KVNSIINKM

SEQ ID NO: 329837 - protein, 9 aa, Influenza virus
VNSIINKMN

SEQ ID NO: 329838 - protein, 9 aa, Influenza virus
NSIINKMNT

SEQ ID NO: 329839 - protein, 9 aa, Influenza virus
IINKMNTQF

SEQ ID NO: 329840 - protein, 9 aa, Influenza virus
LEKRIENLN

SEQ ID NO: 329841 - protein, 9 aa, Influenza virus
LNRKMEDGF

SEQ ID NO: 329842 - protein, 9 aa, Influenza virus
GFLNVWTYN

SEQ ID NO: 329843 - protein, 9 aa, Influenza virus
FLNVWTYNA

SEQ ID NO: 329844 - protein, 9 aa, Influenza virus
LNVWTYNAE

SEQ ID NO: 329845 - protein, 9 aa, Influenza virus
NVWTYNAEL

SEQ ID NO: 329846 - protein, 9 aa, Influenza virus
NAEILVLME

SEQ ID NO: 329847 - protein, 9 aa, Influenza virus
AEILVLMEN

SEQ ID NO: 329848 - protein, 9 aa, Influenza virus
MENERTLDL

SEQ ID NO: 329849 - protein, 9 aa, Influenza virus
ENERTLDLH

SEQ ID NO: 329850 - protein, 9 aa, Influenza virus
NERTLDLHD

SEQ ID NO: 329851 - protein, 9 aa, Influenza virus
ERTLDLHDS

SEQ ID NO: 329852 - protein, 9 aa, Influenza virus
RTLDLHDSN

SEQ ID NO: 329853 - protein, 9 aa, Influenza virus
TLDLHDSNV

SEQ ID NO: 329854 - protein, 9 aa, Influenza virus
LDLHDSNVK

SEQ ID NO: 329855 - protein, 9 aa, Influenza virus
DLHDSNVKN

SEQ ID NO: 329856 - protein, 9 aa, Influenza virus
LHDSNVKNL

SEQ ID NO: 329857 - protein, 9 aa, Influenza virus
HDSNVRNLY

SEQ ID NO: 329858 - protein, 9 aa, Influenza virus
DSNVKNLYE

SEQ ID NO: 329859 - protein, 9 aa, Influenza virus
SNVKNLYEK

SEQ ID NO: 329860 - protein, 9 aa, Influenza virus
NVKNLYEKV

SEQ ID NO: 329861 - protein, 9 aa, Influenza virus
VKNLYEKVR

SEQ ID NO: 329862 - protein, 9 aa, Influenza virus
NLYEKVRLQ

SEQ ID NO: 329863 - protein, 9 aa, Influenza virus
LYEKVRLQL

SEQ ID NO: 329864 - protein, 9 aa, Influenza virus
KVRLQLKDN

SEQ ID NO: 329865 - protein, 9 aa, Influenza virus
VRLQLKDNA

SEQ ID NO: 329866 - protein, 9 aa, Influenza virus
RLQLKDNAK

SEQ ID NO: 329867 - protein, 9 aa, Influenza virus
LQLKDNAKE

SEQ ID NO: 329868 - protein, 9 aa, Influenza virus
QLKDNAKEL

SEQ ID NO: 329869 - protein, 9 aa, Influenza virus
LKDNAKELG

SEQ ID NO: 329870 - protein, 9 aa, Influenza virus
KDNAKELGN

SEQ ID NO: 329871 - protein, 9 aa, Influenza virus
DNARELGNG

SEQ ID NO: 329872 - protein, 9 aa, Influenza virus
NARELGNGC

SEQ ID NO: 329873 - protein, 9 aa, Influenza virus
ARELGNGCF

SEQ ID NO: 329874 - protein, 9 aa, Influenza virus
RELGNGCFE

SEQ ID NO: 329875 - protein, 9 aa, Influenza virus
NGCFEFYHR

SEQ ID NO: 329876 - protein, 9 aa, Influenza virus
GCFEFYHRC

SEQ ID NO: 329877 - protein, 9 aa, Influenza virus
CFEFYHRCD

SEQ ID NO: 329878 - protein, 9 aa, Influenza virus
FEFYHRCDN

SEQ ID NO: 329879 - protein, 9 aa, Influenza virus
CMESIRNGT

SEQ ID NO: 329880 - protein, 9 aa, Influenza virus
MESIRNGTY

SEQ ID NO: 329881 - protein, 9 aa, Influenza virus
IYQILSIYS

SEQ ID NO: 329882 - protein, 9 aa, Influenza virus
YQILSVYST

SEQ ID NO: 329883 - protein, 9 aa, Influenza virus
QILSIYSTA

SEQ ID NO: 329884 - protein, 9 aa, Influenza virus
ILSIYSTAA

SEQ ID NO: 329885 - protein, 9 aa, Influenza virus
LSIYSTAAS

SEQ ID NO: 329886 - protein, 9 aa, Influenza virus
SIYSTAASS

SEQ ID NO: 329887 - protein, 9 aa, Influenza virus
IYSTAASSL

SEQ ID NO: 329888 - protein, 9 aa, Influenza virus
AGLSFWMCS

SEQ ID NO: 329889 - protein, 9 aa, Influenza virus
GLSFWMCSN

SEQ ID NO: 329890 - protein, 9 aa, Influenza virus
LSFWMCSNG

SEQ ID NO: 329891 - protein, 9 aa, Influenza virus
SFWMCSNGS

SEQ ID NO: 329892 - protein, 9 aa, Influenza virus
FWMCSNGSL

SEQ ID NO: 329893 - protein, 9 aa, Influenza virus
WMCFNGSLQ

SEQ ID NO: 329894 - protein, 9 aa, Influenza virus
MCFNGSLQC

SEQ ID NO: 329895 - protein, 9 aa, Influenza virus
CSNGSLQCK

SEQ ID NO: 329896 - protein, 9 aa, Influenza virus
SNGSLQCRV

SEQ ID NO: 329897 - protein, 9 aa, Influenza virus
NGSLQCRVC

SEQ ID NO: 329898 - protein, 9 aa, Influenza virus
GSLQCRVCI

SEQ ID NO: 329899 - protein, 9 aa, Influenza virus
IKFVSSDCS

SEQ ID NO: 329900 - protein, 9 aa, Influenza virus
ICQMEKIVL

SEQ ID NO: 329901 - protein, 9 aa, Influenza virus
CQMEKIVLL

SEQ ID NO: 329902 - protein, 9 aa, Influenza virus
QMEKIVLLF

SEQ ID NO: 329903 - protein, 9 aa, Influenza virus
SDHICIGYH

SEQ ID NO: 329904 - protein, 9 aa, Influenza virus
DHICIGYHA

SEQ ID NO: 329905 - protein, 9 aa, Influenza virus
HICIGYHAN

SEQ ID NO: 329906 - protein, 9 aa, Influenza virus
ICVGYHANN

SEQ ID NO: 329907 - protein, 9 aa, Influenza virus
CVGYHANNS

SEQ ID NO: 329908 - protein, 9 aa, Influenza virus
VGYHANNST

SEQ ID NO: 329909 - protein, 9 aa, Influenza virus
GYHANNSTK

SEQ ID NO: 329910 - protein, 9 aa, Influenza virus
YHANNSTKQ

SEQ ID NO: 329911 - protein, 9 aa, Influenza virus
HANNSTKQV

SEQ ID NO: 329912 - protein, 9 aa, Influenza virus
ANNSTKQVD

SEQ ID NO: 329913 - protein, 9 aa, Influenza virus
NNSTKQVDT

SEQ ID NO: 329914 - protein, 9 aa, Influenza virus
NSTKQVDTI

SEQ ID NO: 329915 - protein, 9 aa, Influenza virus
STKQVDTIM

SEQ ID NO: 329916 - protein, 9 aa, Influenza virus
TKQVDTIME

SEQ ID NO: 329917 - protein, 9 aa, Influenza virus
KQVDTIMEK

SEQ ID NO: 329918 - protein, 9 aa, Influenza virus
QVDTIMERN

SEQ ID NO: 329919 - protein, 9 aa, Influenza virus
VDTIMERNV

SEQ ID NO: 329920 - protein, 9 aa, Influenza virus
DTIMERNVT

SEQ ID NO: 329921 - protein, 9 aa, Influenza virus
TIMERNVTV

SEQ ID NO: 329922 - protein, 9 aa, Influenza virus
IMERNVTVT

SEQ ID NO: 329923 - protein, 9 aa, Influenza virus
MERNVTVTH

SEQ ID NO: 329924 - protein, 9 aa, Influenza virus
ERNVTVTHA

SEQ ID NO: 329925 - protein, 9 aa, Influenza virus
RNVTVTHAQ

SEQ ID NO: 329926 - protein, 9 aa, Influenza virus
NVTVTHAQN

SEQ ID NO: 329927 - protein, 9 aa, Influenza virus
VTVTHAQNI

SEQ ID NO: 329928 - protein, 9 aa, Influenza virus
TVTHAQNIL

SEQ ID NO: 329929 - protein, 9 aa, Influenza virus
VTHAQNILE

SEQ ID NO: 329930 - protein, 9 aa, Influenza virus
THAQDILER

SEQ ID NO: 329931 - protein, 9 aa, Influenza virus
DILERTHNG

SEQ ID NO: 329932 - protein, 9 aa, Influenza virus
LNGVKPLIL

SEQ ID NO: 329933 - protein, 9 aa, Influenza virus
GVKPLILKD

SEQ ID NO: 329934 - protein, 9 aa, Influenza virus
VKPLILKDC

SEQ ID NO: 329935 - protein, 9 aa, Influenza virus
KPLILKDCS

SEQ ID NO: 329936 - protein, 9 aa, Influenza virus
PLILKDCSV

SEQ ID NO: 329937 - protein, 9 aa, Influenza virus
LILKDCSVA

SEQ ID NO: 329938 - protein, 9 aa, Influenza virus
ILKDCSVAG

SEQ ID NO: 329939 - protein, 9 aa, Influenza virus
LKDCSVAGW

SEQ ID NO: 329940 - protein, 9 aa, Influenza virus
KDCSVAGWL

SEQ ID NO: 329941 - protein, 9 aa, Influenza virus
AGWLLGNPL

SEQ ID NO: 329942 - protein, 9 aa, Influenza virus
GWLLGNPLC

SEQ ID NO: 329943 - protein, 9 aa, Influenza virus
WLLGNPLCD

SEQ ID NO: 329944 - protein, 9 aa, Influenza virus
LLGNPLCDE

SEQ ID NO: 329945 - protein, 9 aa, Influenza virus
LGNPLCDEF

SEQ ID NO: 329946 - protein, 9 aa, Influenza virus
NVSEWSYIV

SEQ ID NO: 329947 - protein, 9 aa, Influenza virus
VSEWSYIVE

SEQ ID NO: 329948 - protein, 9 aa, Influenza virus
SEWSYIVEK

SEQ ID NO: 329949 - protein, 9 aa, Influenza virus
FNNYEELKH

SEQ ID NO: 329950 - protein, 9 aa, Influenza virus
NNYEELKHL

SEQ ID NO: 329951 - protein, 9 aa, Influenza virus
NYEELKHLL

SEQ ID NO: 329952 - protein, 9 aa, Influenza virus
YEELKHLMS

SEQ ID NO: 329953 - protein, 9 aa, Influenza virus
EELKHLMSS

SEQ ID NO: 329954 - protein, 9 aa, Influenza virus
ELKHLMSST

SEQ ID NO: 329955 - protein, 9 aa, Influenza virus
SFYRNVVWL

SEQ ID NO: 329956 - protein, 9 aa, Influenza virus
LLILWGIHH

SEQ ID NO: 329957 - protein, 9 aa, Influenza virus
TYISIGTST

SEQ ID NO: 329958 - protein, 9 aa, Influenza virus
YISIGTSTL

SEQ ID NO: 329959 - protein, 9 aa, Influenza virus
ISIGTSTLN

SEQ ID NO: 329960 - protein, 9 aa, Influenza virus
SIGTSTLNQ

SEQ ID NO: 329961 - protein, 9 aa, Influenza virus
IGTSTLNQR

SEQ ID NO: 329962 - protein, 9 aa, Influenza virus
GTSTLNLRL

SEQ ID NO: 329963 - protein, 9 aa, Influenza virus
IHFESNGNF

SEQ ID NO: 329964 - protein, 9 aa, Influenza virus
HFESNGNFI

SEQ ID NO: 329965 - protein, 9 aa, Influenza virus
FDSNGNFIA

SEQ ID NO: 329966 - protein, 9 aa, Influenza virus
DSNGNFIAP

SEQ ID NO: 329967 - protein, 9 aa, Influenza virus
SNGNFITPE

SEQ ID NO: 329968 - protein, 9 aa, Influenza virus
NGNFIAPEN

SEQ ID NO: 329969 - protein, 9 aa, Influenza virus
GNFIAPENA

SEQ ID NO: 329970 - protein, 9 aa, Influenza virus
NFIAPENAY

SEQ ID NO: 329971 - protein, 9 aa, Influenza virus
FIAPENAYK

SEQ ID NO: 329972 - protein, 9 aa, Influenza virus
IAPENAYKI

SEQ ID NO: 329973 - protein, 9 aa, Influenza virus
PENAYKIVK

SEQ ID NO: 329974 - protein, 9 aa, Influenza virus
AYKIVKEGD

SEQ ID NO: 329975 - protein, 9 aa, Influenza virus
YKIVKEGDS

SEQ ID NO: 329976 - protein, 9 aa, Influenza virus
CQTPMGAIN

SEQ ID NO: 329977 - protein, 9 aa, Influenza virus
QTPMGAINS

SEQ ID NO: 329978 - protein, 9 aa, Influenza virus
TPMGAINSS

SEQ ID NO: 329979 - protein, 9 aa, Influenza virus
MGAINSSMP

SEQ ID NO: 329980 - protein, 9 aa, Influenza virus
GAVNSSMPF

SEQ ID NO: 329981 - protein, 9 aa, Influenza virus
AVNSSMPFH

SEQ ID NO: 329982 - protein, 9 aa, Influenza virus
VNSSMPFHN

SEQ ID NO: 329983 - protein, 9 aa, Influenza virus
NSSMPFHNV

SEQ ID NO: 329984 - protein, 9 aa, Influenza virus
SSMPFHNVH

SEQ ID NO: 329985 - protein, 9 aa, Influenza virus
SMPFHNVHP

SEQ ID NO: 329986 - protein, 9 aa, Influenza virus
MPFHNVHPL

SEQ ID NO: 329987 - protein, 9 aa, Influenza virus
PFHNVHPLT

SEQ ID NO: 329988 - protein, 9 aa, Influenza virus
FHNVHPLTI

SEQ ID NO: 329989 - protein, 9 aa, Influenza virus
HNVHPLTIG

SEQ ID NO: 329990 - protein, 9 aa, Influenza virus
NVHPLTIGE

SEQ ID NO: 329991 - protein, 9 aa, Influenza virus
VHPLTIGEC

SEQ ID NO: 329992 - protein, 9 aa, Influenza virus
PLTIGKCPK

SEQ ID NO: 329993 - protein, 9 aa, Influenza virus
LTIGKCPKY

SEQ ID NO: 329994 - protein, 9 aa, Influenza virus
ECPKYVKSD

SEQ ID NO: 329995 - protein, 9 aa, Influenza virus
KLVLATGLR

SEQ ID NO: 329996 - protein, 9 aa, Influenza virus
LILATGLRN

SEQ ID NO: 329997 - protein, 9 aa, Influenza virus
RKRGLFGAI

SEQ ID NO: 329998 - protein, 9 aa, Influenza virus
KRGLFGAIA

SEQ ID NO: 329999 - protein, 9 aa, Influenza virus
TRGLFGAIA

SEQ ID NO: 330000 - protein, 9 aa, Influenza virus
IEGGWQGMI

SEQ ID NO: 330001 - protein, 9 aa, Influenza virus
EGGWQGMID

SEQ ID NO: 330002 - protein, 9 aa, Influenza virus
GGWQGMIDG

SEQ ID NO: 330003 - protein, 9 aa, Influenza virus
GWQGMIDGW

SEQ ID NO: 330004 - protein, 9 aa, Influenza virus
WQGMIDGWY

SEQ ID NO: 330005 - protein, 9 aa, Influenza virus
QGMIDGWYG

SEQ ID NO: 330006 - protein, 9 aa, Influenza virus
GMVDGWYGF

SEQ ID NO: 330007 - protein, 9 aa, Influenza virus
MVDGWYGFH

SEQ ID NO: 330008 - protein, 9 aa, Influenza virus
VDGWYGFHH

SEQ ID NO: 330009 - protein, 9 aa, Influenza virus
DGWYGFHHS

SEQ ID NO: 330010 - protein, 9 aa, Influenza virus
GWYGFHHSN

SEQ ID NO: 330011 - protein, 9 aa, Influenza virus
WYGFHHSNE

SEQ ID NO: 330012 - protein, 9 aa, Influenza virus
GFHHSNEQG

SEQ ID NO: 330013 - protein, 9 aa, Influenza virus
HHSNGQGSG

SEQ ID NO: 330014 - protein, 9 aa, Influenza virus
HSNGQGSGY

SEQ ID NO: 330015 - protein, 9 aa, Influenza virus
SNGQGSGYA

SEQ ID NO: 330016 - protein, 9 aa, Influenza virus
NGQGSGYAA

SEQ ID NO: 330017 - protein, 9 aa, Influenza virus
GQGSGYAAD

SEQ ID NO: 330018 - protein, 9 aa, Influenza virus
QGSGYAADQ

SEQ ID NO: 330019 - protein, 9 aa, Influenza virus
GSGYAADQE

SEQ ID NO: 330020 - protein, 9 aa, Influenza virus
SGYAADQES

SEQ ID NO: 330021 - protein, 9 aa, Influenza virus
GYAADQEST

SEQ ID NO: 330022 - protein, 9 aa, Influenza virus
YAADQESTQ

SEQ ID NO: 330023 - protein, 9 aa, Influenza virus
AADKESTQR

SEQ ID NO: 330024 - protein, 9 aa, Influenza virus
ADKESTQRA

SEQ ID NO: 330025 - protein, 9 aa, Influenza virus
ESTQRAIDG

SEQ ID NO: 330026 - protein, 9 aa, Influenza virus
STQKAIDGI

SEQ ID NO: 330027 - protein, 9 aa, Influenza virus
TQKAIDGIT

SEQ ID NO: 330028 - protein, 9 aa, Influenza virus
QKAIDGITN

SEQ ID NO: 330029 - protein, 9 aa, Influenza virus
KAIDGITNK

SEQ ID NO: 330030 - protein, 9 aa, Influenza virus
AIDGITNKV

SEQ ID NO: 330031 - protein, 9 aa, Influenza virus
IDGITNKVN

SEQ ID NO: 330032 - protein, 9 aa, Influenza virus
DGITNKVNS

SEQ ID NO: 330033 - protein, 9 aa, Influenza virus
GITNKVNSI

SEQ ID NO: 330034 - protein, 9 aa, Influenza virus
ITNKVNSII

SEQ ID NO: 330035 - protein, 9 aa, Influenza virus
TNKVNSIIN

SEQ ID NO: 330036 - protein, 9 aa, Influenza virus
NKVNSIINK

SEQ ID NO: 330037 - protein, 9 aa, Influenza virus
KVNSIINKM

SEQ ID NO: 330038 - protein, 9 aa, Influenza virus
VNSIINKMN

SEQ ID NO: 330039 - protein, 9 aa, Influenza virus
NSIINKMNT

SEQ ID NO: 330040 - protein, 9 aa, Influenza virus
SIINKMNTQ

SEQ ID NO: 330041 - protein, 9 aa, Influenza virus
IINKMNTQF

SEQ ID NO: 330042 - protein, 9 aa, Influenza virus
INKMNTQFE

SEQ ID NO: 330043 - protein, 9 aa, Influenza virus
NKMNTQFEA

SEQ ID NO: 330044 - protein, 9 aa, Influenza virus
KMNTQFEAI

SEQ ID NO: 330045 - protein, 9 aa, Influenza virus
MNTQFEAIG

SEQ ID NO: 330046 - protein, 9 aa, Influenza virus
NTQFEAVGK

SEQ ID NO: 330047 - protein, 9 aa, Influenza virus
TQFEAVGKE

SEQ ID NO: 330048 - protein, 9 aa, Influenza virus
QFEAVGKEF

SEQ ID NO: 330049 - protein, 9 aa, Influenza virus
FEAVGKEFN

SEQ ID NO: 330050 - protein, 9 aa, Influenza virus
LEKRIENLN

SEQ ID NO: 330051 - protein, 9 aa, Influenza virus
EKRIENLNK

SEQ ID NO: 330052 - protein, 9 aa, Influenza virus
KRIENLNKK

SEQ ID NO: 330053 - protein, 9 aa, Influenza virus
RIESLNKKM

SEQ ID NO: 330054 - protein, 9 aa, Influenza virus
IESLNKKME

SEQ ID NO: 330055 - protein, 9 aa, Influenza virus
ESLNKKMED

SEQ ID NO: 330056 - protein, 9 aa, Influenza virus
SLNKKMEDG

SEQ ID NO: 330057 - protein, 9 aa, Influenza virus
LNRKMEDGF

SEQ ID NO: 330058 - protein, 9 aa, Influenza virus
NRKMEDGFL

SEQ ID NO: 330059 - protein, 9 aa, Influenza virus
RKMEDGFLD

SEQ ID NO: 330060 - protein, 9 aa, Influenza virus
LDFHDSNVR

SEQ ID NO: 330061 - protein, 9 aa, Influenza virus
DFHDSNVRN

SEQ ID NO: 330062 - protein, 9 aa, Influenza virus
FHDSNVRNL

SEQ ID NO: 330063 - protein, 9 aa, Influenza virus
HDSNVRNLY

SEQ ID NO: 330064 - protein, 9 aa, Influenza virus
DSNVKNLYE

SEQ ID NO: 330065 - protein, 9 aa, Influenza virus
SNVKNLYEK

SEQ ID NO: 330066 - protein, 9 aa, Influenza virus
NVKNLYEKV

SEQ ID NO: 330067 - protein, 9 aa, Influenza virus
VKNLYEKVR

SEQ ID NO: 330068 - protein, 9 aa, Influenza virus
KNLYEKVRL

SEQ ID NO: 330069 - protein, 9 aa, Influenza virus
NLYEKVRLQ

SEQ ID NO: 330070 - protein, 9 aa, Influenza virus
LYEKVRLQL

SEQ ID NO: 330071 - protein, 9 aa, Influenza virus
YDKVRLQLK

SEQ ID NO: 330072 - protein, 9 aa, Influenza virus
DKVRLQLKD

SEQ ID NO: 330073 - protein, 9 aa, Influenza virus
KVRLQLKDN

SEQ ID NO: 330074 - protein, 9 aa, Influenza virus
VRLQLKDNA

SEQ ID NO: 330075 - protein, 9 aa, Influenza virus
RLQLKDNAK

SEQ ID NO: 330076 - protein, 9 aa, Influenza virus
LQLKDNAKE

SEQ ID NO: 330077 - protein, 9 aa, Influenza virus
QLKDNAKEL

SEQ ID NO: 330078 - protein, 9 aa, Influenza virus
LKDNAKELG

SEQ ID NO: 330079 - protein, 9 aa, Influenza virus
KDNAKELGN

SEQ ID NO: 330080 - protein, 9 aa, Influenza virus
NGCFEFYHR

SEQ ID NO: 330081 - protein, 9 aa, Influenza virus
GCFEFYHRC

SEQ ID NO: 330082 - protein, 9 aa, Influenza virus
CFEFYHRCD

SEQ ID NO: 330083 - protein, 9 aa, Influenza virus
FEFYHRCDN

SEQ ID NO: 330084 - protein, 9 aa, Influenza virus
CMESIRNGT

SEQ ID NO: 330085 - protein, 9 aa, Influenza virus
MESIRNGTY

SEQ ID NO: 330086 - protein, 9 aa, Influenza virus
SIRNGTYNY

SEQ ID NO: 330087 - protein, 9 aa, Influenza virus
NGTYNYPQY

SEQ ID NO: 330088 - protein, 9 aa, Influenza virus
GIYQILSIY

SEQ ID NO: 330089 - protein, 9 aa, Influenza virus
IYQILSIYS

SEQ ID NO: 330090 - protein, 9 aa, Influenza virus
QILSIYSTA

SEQ ID NO: 330091 - protein, 9 aa, Influenza virus
ILSIYSTAA

SEQ ID NO: 330092 - protein, 9 aa, Influenza virus
LSIYSTAAS

SEQ ID NO: 330093 - protein, 9 aa, Influenza virus
SIYSTAASS

SEQ ID NO: 330094 - protein, 9 aa, Influenza virus
IYSTAASSL

SEQ ID NO: 330095 - protein, 9 aa, Influenza virus
YSTVASSLV

SEQ ID NO: 330096 - protein, 9 aa, Influenza virus
STVASSLVL

SEQ ID NO: 330097 - protein, 9 aa, Influenza virus
TVASSLVLA

SEQ ID NO: 330098 - protein, 9 aa, Influenza virus
VASSLVLAI

SEQ ID NO: 330099 - protein, 9 aa, Influenza virus
ASSLVLAIM

SEQ ID NO: 330100 - protein, 9 aa, Influenza virus
AGLFLWMCS

SEQ ID NO: 330101 - protein, 9 aa, Influenza virus
GLFLWMCSN

SEQ ID NO: 330102 - protein, 9 aa, Influenza virus
LFLWMCSNG

SEQ ID NO: 330103 - protein, 9 aa, Influenza virus
FLWMCSNGS

SEQ ID NO: 330104 - protein, 9 aa, Influenza virus
FWMCSNGSL

SEQ ID NO: 330105 - protein, 9 aa, Influenza virus
WMCFNGSLQ

SEQ ID NO: 330106 - protein, 9 aa, Influenza virus
MCFNGSLQC

SEQ ID NO: 330107 - protein, 9 aa, Influenza virus
CSNGSLQCK

SEQ ID NO: 330108 - protein, 9 aa, Influenza virus
SNGSLQCRV

SEQ ID NO: 330109 - protein, 9 aa, Influenza virus
NGSLQCRVC

SEQ ID NO: 330110 - protein, 9 aa, Influenza virus
GSLQCRVCI

SEQ ID NO: 330111 - protein, 9 aa, Influenza virus
IKICESRLR

SEQ ID NO: 330112 - protein, 9 aa, Influenza virus
FSGSQKQEF

SEQ ID NO: 330113 - protein, 9 aa, Influenza virus
SGSQKQEFK

SEQ ID NO: 330114 - protein, 9 aa, Influenza virus
GSQKQEFKM

SEQ ID NO: 330115 - protein, 9 aa, Influenza virus
SQKQEFKMN

SEQ ID NO: 330116 - protein, 9 aa, Influenza virus
QKQEIKMNP

SEQ ID NO: 330117 - protein, 9 aa, Influenza virus
KQEIKMNPN

SEQ ID NO: 330118 - protein, 9 aa, Influenza virus
QEIKMNPNQ

SEQ ID NO: 330119 - protein, 9 aa, Influenza virus
EIKMNPNQK

SEQ ID NO: 330120 - protein, 9 aa, Influenza virus
IKMNPNQKI

SEQ ID NO: 330121 - protein, 9 aa, Influenza virus
KMNPNQKII

SEQ ID NO: 330122 - protein, 9 aa, Influenza virus
IEIITIGSI

SEQ ID NO: 330123 - protein, 9 aa, Influenza virus
RDITIGSIC

SEQ ID NO: 330124 - protein, 9 aa, Influenza virus
DITIGSICM

SEQ ID NO: 330125 - protein, 9 aa, Influenza virus
YENTTWVNQ

SEQ ID NO: 330126 - protein, 9 aa, Influenza virus
ENNTWGNQT

SEQ ID NO: 330127 - protein, 9 aa, Influenza virus
NNTWVNQTF

SEQ ID NO: 330128 - protein, 9 aa, Influenza virus
GWAVHSKDN

SEQ ID NO: 330129 - protein, 9 aa, Influenza virus
HSKDNSIRI

SEQ ID NO: 330130 - protein, 9 aa, Influenza virus
SKDNGIRIG

SEQ ID NO: 330131 - protein, 9 aa, Influenza virus
KDNGIRIGS

SEQ ID NO: 330132 - protein, 9 aa, Influenza virus
DNSIRIGSR

SEQ ID NO: 330133 - protein, 9 aa, Influenza virus
NSIRIGSRG

SEQ ID NO: 330134 - protein, 9 aa, Influenza virus
SIRIGSRGD

SEQ ID NO: 330135 - protein, 9 aa, Influenza virus
IRIGSRGDV

SEQ ID NO: 330136 - protein, 9 aa, Influenza virus
RIGSRGDVF

SEQ ID NO: 330137 - protein, 9 aa, Influenza virus
IGSRGDVFV

SEQ ID NO: 330138 - protein, 9 aa, Influenza virus
GDVFVVREP

SEQ ID NO: 330139 - protein, 9 aa, Influenza virus
DVFVVREPF

SEQ ID NO: 330140 - protein, 9 aa, Influenza virus
FVVREPFIS

SEQ ID NO: 330141 - protein, 9 aa, Influenza virus
VREPFISCS

SEQ ID NO: 330142 - protein, 9 aa, Influenza virus
REPFVSCSH

SEQ ID NO: 330143 - protein, 9 aa, Influenza virus
EPFISCSHM

SEQ ID NO: 330144 - protein, 9 aa, Influenza virus
PFISCSHME

SEQ ID NO: 330145 - protein, 9 aa, Influenza virus
FISCSHMEC

SEQ ID NO: 330146 - protein, 9 aa, Influenza virus
ISCSHMECR

SEQ ID NO: 330147 - protein, 9 aa, Influenza virus
SCSHMECRT

SEQ ID NO: 330148 - protein, 9 aa, Influenza virus
CSHMECRTF

SEQ ID NO: 330149 - protein, 9 aa, Influenza virus
SHMECRTFF

SEQ ID NO: 330150 - protein, 9 aa, Influenza virus
HMECRTFFL

SEQ ID NO: 330151 - protein, 9 aa, Influenza virus
MECRTFFLT

SEQ ID NO: 330152 - protein, 9 aa, Influenza virus
ECRTFFLTH

SEQ ID NO: 330153 - protein, 9 aa, Influenza virus
CRTFFLTHG

SEQ ID NO: 330154 - protein, 9 aa, Influenza virus
RTFFLTQGS

SEQ ID NO: 330155 - protein, 9 aa, Influenza virus
TFFLTQGSL

SEQ ID NO: 330156 - protein, 9 aa, Influenza virus
FFLTQGSLL

SEQ ID NO: 330157 - protein, 9 aa, Influenza virus
FLTQGSLLN

SEQ ID NO: 330158 - protein, 9 aa, Influenza virus
LTQGSLLND

SEQ ID NO: 330159 - protein, 9 aa, Influenza virus
TQGSLLNDK

SEQ ID NO: 330160 - protein, 9 aa, Influenza virus
QGSLLNDKH

SEQ ID NO: 330161 - protein, 9 aa, Influenza virus
GSLLNDKHS

SEQ ID NO: 330162 - protein, 9 aa, Influenza virus
SLLNDKHSN

SEQ ID NO: 330163 - protein, 9 aa, Influenza virus
LLNDKHSNE

SEQ ID NO: 330164 - protein, 9 aa, Influenza virus
LNDKHSNET

SEQ ID NO: 330165 - protein, 9 aa, Influenza virus
NDKHSNGTI

SEQ ID NO: 330166 - protein, 9 aa, Influenza virus
KHSNGTIKD

SEQ ID NO: 330167 - protein, 9 aa, Influenza virus
HSNGTIKDR

SEQ ID NO: 330168 - protein, 9 aa, Influenza virus
SNGTIKDRS

SEQ ID NO: 330169 - protein, 9 aa, Influenza virus
NGTIKDRSP

SEQ ID NO: 330170 - protein, 9 aa, Influenza virus
KDRSPYRTL

SEQ ID NO: 330171 - protein, 9 aa, Influenza virus
DRSPYRTLM

SEQ ID NO: 330172 - protein, 9 aa, Influenza virus
RSPYRTLMS

SEQ ID NO: 330173 - protein, 9 aa, Influenza virus
SPYRTLMSC

SEQ ID NO: 330174 - protein, 9 aa, Influenza virus
PYRTLMSCP

SEQ ID NO: 330175 - protein, 9 aa, Influenza virus
RTLMSCPMG

SEQ ID NO: 330176 - protein, 9 aa, Influenza virus
PMGEAPSPY

SEQ ID NO: 330177 - protein, 9 aa, Influenza virus
GEVPSPYNS

SEQ ID NO: 330178 - protein, 9 aa, Influenza virus
EAPSPYNSK

SEQ ID NO: 330179 - protein, 9 aa, Influenza virus
APSPYNSKF

SEQ ID NO: 330180 - protein, 9 aa, Influenza virus
PSPYNSKFE

SEQ ID NO: 330181 - protein, 9 aa, Influenza virus
SPYNSKFES

SEQ ID NO: 330182 - protein, 9 aa, Influenza virus
PYNSKFESV

SEQ ID NO: 330183 - protein, 9 aa, Influenza virus
YNSKFESVA

SEQ ID NO: 330184 - protein, 9 aa, Influenza virus
NSKFESVAW

SEQ ID NO: 330185 - protein, 9 aa, Influenza virus
SASACHDGI

SEQ ID NO: 330186 - protein, 9 aa, Influenza virus
ASACHDGIS

SEQ ID NO: 330187 - protein, 9 aa, Influenza virus
SACHDGISW

SEQ ID NO: 330188 - protein, 9 aa, Influenza virus
ACHDGISWL

SEQ ID NO: 330189 - protein, 9 aa, Influenza virus
CHDGISWLT

SEQ ID NO: 330190 - protein, 9 aa, Influenza virus
HDGISWLTI

SEQ ID NO: 330191 - protein, 9 aa, Influenza virus
NWLTIGISG

SEQ ID NO: 330192 - protein, 9 aa, Influenza virus
WLTIGVSGP

SEQ ID NO: 330193 - protein, 9 aa, Influenza virus
LTIGVSGPD

SEQ ID NO: 330194 - protein, 9 aa, Influenza virus
TIGISGPDS

SEQ ID NO: 330195 - protein, 9 aa, Influenza virus
IGISGPDNE

SEQ ID NO: 330196 - protein, 9 aa, Influenza virus
GISGPDNEA

SEQ ID NO: 330197 - protein, 9 aa, Influenza virus
ISGPDNEAV

SEQ ID NO: 330198 - protein, 9 aa, Influenza virus
SGPDNEAVA

SEQ ID NO: 330199 - protein, 9 aa, Influenza virus
GPDNEAVAV

SEQ ID NO: 330200 - protein, 9 aa, Influenza virus
PDNEAVAVL

SEQ ID NO: 330201 - protein, 9 aa, Influenza virus
DNEAVAVLK

SEQ ID NO: 330202 - protein, 9 aa, Influenza virus
NEAVAVLKY

SEQ ID NO: 330203 - protein, 9 aa, Influenza virus
EAVAVLKYN

SEQ ID NO: 330204 - protein, 9 aa, Influenza virus
AVAVVKYNG

SEQ ID NO: 330205 - protein, 9 aa, Influenza virus
KYNGMITDT

SEQ ID NO: 330206 - protein, 9 aa, Influenza virus
YNGMITDTI

SEQ ID NO: 330207 - protein, 9 aa, Influenza virus
GMITDTIKS

SEQ ID NO: 330208 - protein, 9 aa, Influenza virus
MITDTIKSW

SEQ ID NO: 330209 - protein, 9 aa, Influenza virus
ITDTIKSWG

SEQ ID NO: 330210 - protein, 9 aa, Influenza virus
NIMRTQESE

SEQ ID NO: 330211 - protein, 9 aa, Influenza virus
IMRTQESEC

SEQ ID NO: 330212 - protein, 9 aa, Influenza virus
MRTQESECA

SEQ ID NO: 330213 - protein, 9 aa, Influenza virus
TQESECACI

SEQ ID NO: 330214 - protein, 9 aa, Influenza virus
QESECACIN

SEQ ID NO: 330215 - protein, 9 aa, Influenza virus
ESECACING

SEQ ID NO: 330216 - protein, 9 aa, Influenza virus
GSCFTIMTD

SEQ ID NO: 330217 - protein, 9 aa, Influenza virus
SCFTIMTDG

SEQ ID NO: 330218 - protein, 9 aa, Influenza virus
CFTIMTDGP

SEQ ID NO: 330219 - protein, 9 aa, Influenza virus
FTIMTDGPS

SEQ ID NO: 330220 - protein, 9 aa, Influenza virus
GKRGKWVKS

SEQ ID NO: 330221 - protein, 9 aa, Influenza virus
APDYHYEEC

SEQ ID NO: 330222 - protein, 9 aa, Influenza virus
PDYHYEECS

SEQ ID NO: 330223 - protein, 9 aa, Influenza virus
DYHYEECSC

SEQ ID NO: 330224 - protein, 9 aa, Influenza virus
YEECSCYPN

SEQ ID NO: 330225 - protein, 9 aa, Influenza virus
EECSCYPDS

SEQ ID NO: 330226 - protein, 9 aa, Influenza virus
ECSCYPDAS

SEQ ID NO: 330227 - protein, 9 aa, Influenza virus
CSCYPDASE

SEQ ID NO: 330228 - protein, 9 aa, Influenza virus
ICVCRDNWH

SEQ ID NO: 330229 - protein, 9 aa, Influenza virus
WHGSNRPWI

SEQ ID NO: 330230 - protein, 9 aa, Influenza virus
HGSNRPWIS

SEQ ID NO: 330231 - protein, 9 aa, Influenza virus
GSNRPWISF

SEQ ID NO: 330232 - protein, 9 aa, Influenza virus
SNRPWISFN

SEQ ID NO: 330233 - protein, 9 aa, Influenza virus
NRPWISFNQ

SEQ ID NO: 330234 - protein, 9 aa, Influenza virus
YRIGYICSG

SEQ ID NO: 330235 - protein, 9 aa, Influenza virus
IGYICSGIF

SEQ ID NO: 330236 - protein, 9 aa, Influenza virus
GYICSGIFG

SEQ ID NO: 330237 - protein, 9 aa, Influenza virus
YICSGIFGD

SEQ ID NO: 330238 - protein, 9 aa, Influenza virus
ICSGIFGDN

SEQ ID NO: 330239 - protein, 9 aa, Influenza virus
CSGIFGDNP

SEQ ID NO: 330240 - protein, 9 aa, Influenza virus
SGIFGDNPR

SEQ ID NO: 330241 - protein, 9 aa, Influenza virus
GIFGDNPRP

SEQ ID NO: 330242 - protein, 9 aa, Influenza virus
FGDTPRPND

SEQ ID NO: 330243 - protein, 9 aa, Influenza virus
GDTPRPNDG

SEQ ID NO: 330244 - protein, 9 aa, Influenza virus
GIKGFSFKY

SEQ ID NO: 330245 - protein, 9 aa, Influenza virus
IKGFSFKYG

SEQ ID NO: 330246 - protein, 9 aa, Influenza virus
KGFSFRYGN

SEQ ID NO: 330247 - protein, 9 aa, Influenza virus
GFSFRYGNG

SEQ ID NO: 330248 - protein, 9 aa, Influenza virus
FRYGNGVWI

SEQ ID NO: 330249 - protein, 9 aa, Influenza virus
RYGNGVWIG

SEQ ID NO: 330250 - protein, 9 aa, Influenza virus
YGNGAWIGR

SEQ ID NO: 330251 - protein, 9 aa, Influenza virus
GNGAWIGRT

SEQ ID NO: 330252 - protein, 9 aa, Influenza virus
NGAWIGRTK

SEQ ID NO: 330253 - protein, 9 aa, Influenza virus
VWIGRTKSP

SEQ ID NO: 330254 - protein, 9 aa, Influenza virus
SRSGFEMVW

SEQ ID NO: 330255 - protein, 9 aa, Influenza virus
RSGFEMVWD

SEQ ID NO: 330256 - protein, 9 aa, Influenza virus
SGFEMVWDP

SEQ ID NO: 330257 - protein, 9 aa, Influenza virus
GFEMVWDPN

SEQ ID NO: 330258 - protein, 9 aa, Influenza virus
FEMVWDPNG

SEQ ID NO: 330259 - protein, 9 aa, Influenza virus
EMVWDPNGW

SEQ ID NO: 330260 - protein, 9 aa, Influenza virus
LTDWSGYSG

SEQ ID NO: 330261 - protein, 9 aa, Influenza virus
TEWSGYSGS

SEQ ID NO: 330262 - protein, 9 aa, Influenza virus
WSGYSGSFI

SEQ ID NO: 330263 - protein, 9 aa, Influenza virus
SGYSGSFIQ

SEQ ID NO: 330264 - protein, 9 aa, Influenza virus
GYSGSFIQH

SEQ ID NO: 330265 - protein, 9 aa, Influenza virus
YSGSFIQHP

SEQ ID NO: 330266 - protein, 9 aa, Influenza virus
SGSFIQHPE

SEQ ID NO: 330267 - protein, 9 aa, Influenza virus
GSFIQHPEL

SEQ ID NO: 330268 - protein, 9 aa, Influenza virus
SFIQHPELT

SEQ ID NO: 330269 - protein, 9 aa, Influenza virus
FIQHPELTG

SEQ ID NO: 330270 - protein, 9 aa, Influenza virus
IQHPELTGL

SEQ ID NO: 330271 - protein, 9 aa, Influenza virus
QHPELTGLN

SEQ ID NO: 330272 - protein, 9 aa, Influenza virus
HPELTGLNC

SEQ ID NO: 330273 - protein, 9 aa, Influenza virus
TGLDCMRPC

SEQ ID NO: 330274 - protein, 9 aa, Influenza virus
DCMRPCFWV

SEQ ID NO: 330275 - protein, 9 aa, Influenza virus
CMRPCFWVE

SEQ ID NO: 330276 - protein, 9 aa, Influenza virus
MRPCFWVEL

SEQ ID NO: 330277 - protein, 9 aa, Influenza virus
RPCFWVELV

SEQ ID NO: 330278 - protein, 9 aa, Influenza virus
PCFWVELVR

SEQ ID NO: 330279 - protein, 9 aa, Influenza virus
CFWVELVRG

SEQ ID NO: 330280 - protein, 9 aa, Influenza virus
FWVELIRGQ

SEQ ID NO: 330281 - protein, 9 aa, Influenza virus
WVELIRGQP

SEQ ID NO: 330282 - protein, 9 aa, Influenza virus
VELIRGQPK

SEQ ID NO: 330283 - protein, 9 aa, Influenza virus
ELIRGQPKE

SEQ ID NO: 330284 - protein, 9 aa, Influenza virus
TVWTSGSSI

SEQ ID NO: 330285 - protein, 9 aa, Influenza virus
VWTSGSSIS

SEQ ID NO: 330286 - protein, 9 aa, Influenza virus
WTSGSIISF

SEQ ID NO: 330287 - protein, 9 aa, Influenza virus
TSGSIISFC

SEQ ID NO: 330288 - protein, 9 aa, Influenza virus
SGSIISFCG

SEQ ID NO: 330289 - protein, 9 aa, Influenza virus
GSIISFCGV

SEQ ID NO: 330290 - protein, 9 aa, Influenza virus
SSISFCGVS

SEQ ID NO: 330291 - protein, 9 aa, Influenza virus
GWSWPDGAE

SEQ ID NO: 330292 - protein, 9 aa, Influenza virus
WSWPDDAEL

SEQ ID NO: 330293 - protein, 9 aa, Influenza virus
SWPDDAELP

SEQ ID NO: 330294 - protein, 9 aa, Influenza virus
WPDDAELPF

SEQ ID NO: 330295 - protein, 9 aa, Influenza virus
ELPFTIDKY

SEQ ID NO: 330296 - protein, 9 aa, Influenza virus
SDQICIGYH

SEQ ID NO: 330297 - protein, 9 aa, Influenza virus
DRICIGYHA

SEQ ID NO: 330298 - protein, 9 aa, Influenza virus
RICIGYHAN

SEQ ID NO: 330299 - protein, 9 aa, Influenza virus
ICIGHHANN

SEQ ID NO: 330300 - protein, 9 aa, Influenza virus
CIGHHANNS

SEQ ID NO: 330301 - protein, 9 aa, Influenza virus
IGYHANNSK

SEQ ID NO: 330302 - protein, 9 aa, Influenza virus
GYHANNSTK

SEQ ID NO: 330303 - protein, 9 aa, Influenza virus
YHANNSTKQ

SEQ ID NO: 330304 - protein, 9 aa, Influenza virus
HANNSTKQV

SEQ ID NO: 330305 - protein, 9 aa, Influenza virus
ANNSTKQVD

SEQ ID NO: 330306 - protein, 9 aa, Influenza virus
NNSTKQVDT

SEQ ID NO: 330307 - protein, 9 aa, Influenza virus
NSTKQVDTI

SEQ ID NO: 330308 - protein, 9 aa, Influenza virus
KQVDTIMEK

SEQ ID NO: 330309 - protein, 9 aa, Influenza virus
QIDTIMEKN

SEQ ID NO: 330310 - protein, 9 aa, Influenza virus
IDTIMEKNV

SEQ ID NO: 330311 - protein, 9 aa, Influenza virus
DTIMERNVT

SEQ ID NO: 330312 - protein, 9 aa, Influenza virus
TIMERNVTV

SEQ ID NO: 330313 - protein, 9 aa, Influenza virus
IMERNVTVT

SEQ ID NO: 330314 - protein, 9 aa, Influenza virus
ERNVTVTHA

SEQ ID NO: 330315 - protein, 9 aa, Influenza virus
RNVTVTHAQ

SEQ ID NO: 330316 - protein, 9 aa, Influenza virus
NVTVTHAQN

SEQ ID NO: 330317 - protein, 9 aa, Influenza virus
AGLVLGNPM

SEQ ID NO: 330318 - protein, 9 aa, Influenza virus
GWLIGNPKC

SEQ ID NO: 330319 - protein, 9 aa, Influenza virus
APEWSYIVE

SEQ ID NO: 330320 - protein, 9 aa, Influenza virus
EWSYIVEKN

SEQ ID NO: 330321 - protein, 9 aa, Influenza virus
WSYIVEKDS

SEQ ID NO: 330322 - protein, 9 aa, Influenza virus
SYIVEKDSP

SEQ ID NO: 330323 - protein, 9 aa, Influenza virus
YHTGRSSFF

SEQ ID NO: 330324 - protein, 9 aa, Influenza virus
SSFYRNVVW

SEQ ID NO: 330325 - protein, 9 aa, Influenza virus
SFYRNVVWL

SEQ ID NO: 330326 - protein, 9 aa, Influenza virus
FFRNVVWLT

SEQ ID NO: 330327 - protein, 9 aa, Influenza virus
FRNVVWLTK

SEQ ID NO: 330328 - protein, 9 aa, Influenza virus
RNVVWLTKK

SEQ ID NO: 330329 - protein, 9 aa, Influenza virus
GTSTLNQRL

SEQ ID NO: 330330 - protein, 9 aa, Influenza virus
IATRPQVNG

SEQ ID NO: 330331 - protein, 9 aa, Influenza virus
ATRPQVNGQ

SEQ ID NO: 330332 - protein, 9 aa, Influenza virus
RPQVNGQRG

SEQ ID NO: 330333 - protein, 9 aa, Influenza virus
FESTGNFIA

SEQ ID NO: 330334 - protein, 9 aa, Influenza virus
ESTGNFIAP

SEQ ID NO: 330335 - protein, 9 aa, Influenza virus
STGNFIAPE

SEQ ID NO: 330336 - protein, 9 aa, Influenza virus
TGNFIAPEY

SEQ ID NO: 330337 - protein, 9 aa, Influenza virus
NFIAPEYAF

SEQ ID NO: 330338 - protein, 9 aa, Influenza virus
FIAPEYAYR

SEQ ID NO: 330339 - protein, 9 aa, Influenza virus
IAPEYAYRI

SEQ ID NO: 330340 - protein, 9 aa, Influenza virus
PEYAYKIIK

SEQ ID NO: 330341 - protein, 9 aa, Influenza virus
YGNCNTKCQ

SEQ ID NO: 330342 - protein, 9 aa, Influenza virus
GNCNTKCQT

SEQ ID NO: 330343 - protein, 9 aa, Influenza virus
NCNTKCQTP

SEQ ID NO: 330344 - protein, 9 aa, Influenza virus
ERRRKKRGL

SEQ ID NO: 330345 - protein, 9 aa, Influenza virus
RRRKKRGLF

SEQ ID NO: 330346 - protein, 9 aa, Influenza virus
KKRGLFGAI

SEQ ID NO: 330347 - protein, 9 aa, Influenza virus
KRGLFGAIA

SEQ ID NO: 330348 - protein, 9 aa, Influenza virus
FIEGGWQGL

SEQ ID NO: 330349 - protein, 9 aa, Influenza virus
IEGGWQGMI

SEQ ID NO: 330350 - protein, 9 aa, Influenza virus
EGGWQGMID

SEQ ID NO: 330351 - protein, 9 aa, Influenza virus
GGWQGMIDG

SEQ ID NO: 330352 - protein, 9 aa, Influenza virus
GWQGMIDGW

SEQ ID NO: 330353 - protein, 9 aa, Influenza virus
WQGMIDGWY

SEQ ID NO: 330354 - protein, 9 aa, Influenza virus
QGMIDGWYG

SEQ ID NO: 330355 - protein, 9 aa, Influenza virus
GMIDGWYGY

SEQ ID NO: 330356 - protein, 9 aa, Influenza virus
MIDGWYGYH

SEQ ID NO: 330357 - protein, 9 aa, Influenza virus
IDGWYGYHH

SEQ ID NO: 330358 - protein, 9 aa, Influenza virus
DGWYGYHHI

SEQ ID NO: 330359 - protein, 9 aa, Influenza virus
GWYGYHHIN

SEQ ID NO: 330360 - protein, 9 aa, Influenza virus
NGQGSGYAA

SEQ ID NO: 330361 - protein, 9 aa, Influenza virus
GQGSGYAAD

SEQ ID NO: 330362 - protein, 9 aa, Influenza virus
QGSGYAADR

SEQ ID NO: 330363 - protein, 9 aa, Influenza virus
GSGYAADKK

SEQ ID NO: 330364 - protein, 9 aa, Influenza virus
SGYAADKKS

SEQ ID NO: 330365 - protein, 9 aa, Influenza virus
GYAADKKST

SEQ ID NO: 330366 - protein, 9 aa, Influenza virus
YAADKKSTQ

SEQ ID NO: 330367 - protein, 9 aa, Influenza virus
AADKKSTQK

SEQ ID NO: 330368 - protein, 9 aa, Influenza virus
ADKKSTQKA

SEQ ID NO: 330369 - protein, 9 aa, Influenza virus
ESTQKAING

SEQ ID NO: 330370 - protein, 9 aa, Influenza virus
STQKAINGI

SEQ ID NO: 330371 - protein, 9 aa, Influenza virus
TQKAINGIT

SEQ ID NO: 330372 - protein, 9 aa, Influenza virus
VWTYNTELL

SEQ ID NO: 330373 - protein, 9 aa, Influenza virus
WTYNTELLV

SEQ ID NO: 330374 - protein, 9 aa, Influenza virus
TYNTELLVL

SEQ ID NO: 330375 - protein, 9 aa, Influenza virus
YNAELFVLM

SEQ ID NO: 330376 - protein, 9 aa, Influenza virus
NTELLVLME

SEQ ID NO: 330377 - protein, 9 aa, Influenza virus
TELLVLMEN

SEQ ID NO: 330378 - protein, 9 aa, Influenza virus
ELLVLIENE

SEQ ID NO: 330379 - protein, 9 aa, Influenza virus
LFVLMENER

SEQ ID NO: 330380 - protein, 9 aa, Influenza virus
FVLMENERT

SEQ ID NO: 330381 - protein, 9 aa, Influenza virus
VLIENERTL

SEQ ID NO: 330382 - protein, 9 aa, Influenza virus
LMENERTLY

SEQ ID NO: 330383 - protein, 9 aa, Influenza virus
MENERTLDL

SEQ ID NO: 330384 - protein, 9 aa, Influenza virus
ENERTLDLH

SEQ ID NO: 330385 - protein, 9 aa, Influenza virus
NERTLDLHD

SEQ ID NO: 330386 - protein, 9 aa, Influenza virus
ERTLDLHDS

SEQ ID NO: 330387 - protein, 9 aa, Influenza virus
RTLDLHDSN

SEQ ID NO: 330388 - protein, 9 aa, Influenza virus
TLDLHDSNV

SEQ ID NO: 330389 - protein, 9 aa, Influenza virus
LDLHDSNVK

SEQ ID NO: 330390 - protein, 9 aa, Influenza virus
DLHDSNVKN

SEQ ID NO: 330391 - protein, 9 aa, Influenza virus
LHDSNVKNL

SEQ ID NO: 330392 - protein, 9 aa, Influenza virus
HDSNVRNLY

SEQ ID NO: 330393 - protein, 9 aa, Influenza virus
DSNVRNLYD

SEQ ID NO: 330394 - protein, 9 aa, Influenza virus
SNVRNLYDK

SEQ ID NO: 330395 - protein, 9 aa, Influenza virus
NVRNLYDKV

SEQ ID NO: 330396 - protein, 9 aa, Influenza virus
VRNLYDKVR

SEQ ID NO: 330397 - protein, 9 aa, Influenza virus
NLYNKVRLQ

SEQ ID NO: 330398 - protein, 9 aa, Influenza virus
LYNKVRLQL

SEQ ID NO: 330399 - protein, 9 aa, Influenza virus
VRLQLKDNA

SEQ ID NO: 330400 - protein, 9 aa, Influenza virus
DNARELGNG

SEQ ID NO: 330401 - protein, 9 aa, Influenza virus
NARELGNGC

SEQ ID NO: 330402 - protein, 9 aa, Influenza virus
ARELGNGCF

SEQ ID NO: 330403 - protein, 9 aa, Influenza virus
RELGNGCFE

SEQ ID NO: 330404 - protein, 9 aa, Influenza virus
EMGNGCFEF

SEQ ID NO: 330405 - protein, 9 aa, Influenza virus
MGNGCFEFY

SEQ ID NO: 330406 - protein, 9 aa, Influenza virus
NGCFEFYHR

SEQ ID NO: 330407 - protein, 9 aa, Influenza virus
GCFEFYHRC

SEQ ID NO: 330408 - protein, 9 aa, Influenza virus
CFEFYHRCD

SEQ ID NO: 330409 - protein, 9 aa, Influenza virus
FEFYHKCDD

SEQ ID NO: 330410 - protein, 9 aa, Influenza virus
ECMESVKNG

SEQ ID NO: 330411 - protein, 9 aa, Influenza virus
CMESVKNGT

SEQ ID NO: 330412 - protein, 9 aa, Influenza virus
MESVKNGTY

SEQ ID NO: 330413 - protein, 9 aa, Influenza virus
ESVRNGTYN

SEQ ID NO: 330414 - protein, 9 aa, Influenza virus
SVRNGTYNY

SEQ ID NO: 330415 - protein, 9 aa, Influenza virus
ILSIYSTVV

SEQ ID NO: 330416 - protein, 9 aa, Influenza virus
LSIYSTVVS

SEQ ID NO: 330417 - protein, 9 aa, Influenza virus
SIYSTVVSS

SEQ ID NO: 330418 - protein, 9 aa, Influenza virus
IYSTVVSSL

SEQ ID NO: 330419 - protein, 9 aa, Influenza virus
VVSSLVLAI

SEQ ID NO: 330420 - protein, 9 aa, Influenza virus
LAIMVAGLS

SEQ ID NO: 330421 - protein, 9 aa, Influenza virus
AIMVAGLSF

SEQ ID NO: 330422 - protein, 9 aa, Influenza virus
IMVAGLSFW

SEQ ID NO: 330423 - protein, 9 aa, Influenza virus
VAGLSFWMC

SEQ ID NO: 330424 - protein, 9 aa, Influenza virus
AGLFFWMCS

SEQ ID NO: 330425 - protein, 9 aa, Influenza virus
GLFFWMCSN

SEQ ID NO: 330426 - protein, 9 aa, Influenza virus
LFFWMCSNG

SEQ ID NO: 330427 - protein, 9 aa, Influenza virus
FFWMCSNGS

SEQ ID NO: 330428 - protein, 9 aa, Influenza virus
YWMCSNGSL

SEQ ID NO: 330429 - protein, 9 aa, Influenza virus
SNGSLQCRV

SEQ ID NO: 330430 - protein, 9 aa, Influenza virus
NGSLQCTIC

SEQ ID NO: 330431 - protein, 9 aa, Influenza virus
GSLQCTICI

SEQ ID NO: 330432 - protein, 9 aa, Influenza virus
IITIGSISL

SEQ ID NO: 330433 - protein, 9 aa, Influenza virus
YRDWSKPQC

SEQ ID NO: 330434 - protein, 9 aa, Influenza virus
KPQCQVTGF

SEQ ID NO: 330435 - protein, 9 aa, Influenza virus
PQCQVTGFA

SEQ ID NO: 330436 - protein, 9 aa, Influenza virus
QCQVTGFAP

SEQ ID NO: 330437 - protein, 9 aa, Influenza virus
CQVTGFAPF

SEQ ID NO: 330438 - protein, 9 aa, Influenza virus
VTGFAPFSK

SEQ ID NO: 330439 - protein, 9 aa, Influenza virus
AGFAPFSKD

SEQ ID NO: 330440 - protein, 9 aa, Influenza virus
PFSKDNSIQ

SEQ ID NO: 330441 - protein, 9 aa, Influenza virus
FSKDNSIQL

SEQ ID NO: 330442 - protein, 9 aa, Influenza virus
SKDNSIQLS

SEQ ID NO: 330443 - protein, 9 aa, Influenza virus
KDNSIQLSA

SEQ ID NO: 330444 - protein, 9 aa, Influenza virus
DNSIQLSAG

SEQ ID NO: 330445 - protein, 9 aa, Influenza virus
NSIQLSAGG

SEQ ID NO: 330446 - protein, 9 aa, Influenza virus
RLSAGGNIW

SEQ ID NO: 330447 - protein, 9 aa, Influenza virus
IWITREPYV

SEQ ID NO: 330448 - protein, 9 aa, Influenza virus
WITREPYVS

SEQ ID NO: 330449 - protein, 9 aa, Influenza virus
ITREPYVSC

SEQ ID NO: 330450 - protein, 9 aa, Influenza virus
TREPYVSCS

SEQ ID NO: 330451 - protein, 9 aa, Influenza virus
RCYQFALGQ

SEQ ID NO: 330452 - protein, 9 aa, Influenza virus
ALGQGTTLN

SEQ ID NO: 330453 - protein, 9 aa, Influenza virus
LGQGTTLNN

SEQ ID NO: 330454 - protein, 9 aa, Influenza virus
NHSNGTIHD

SEQ ID NO: 330455 - protein, 9 aa, Influenza virus
SNGTIHDRT

SEQ ID NO: 330456 - protein, 9 aa, Influenza virus
PHRTLLMSE

SEQ ID NO: 330457 - protein, 9 aa, Influenza virus
HRTLLMSEL

SEQ ID NO: 330458 - protein, 9 aa, Influenza virus
RTLLMSELG

SEQ ID NO: 330459 - protein, 9 aa, Influenza virus
TLLMSELGV

SEQ ID NO: 330460 - protein, 9 aa, Influenza virus
LLMSELGVP

SEQ ID NO: 330461 - protein, 9 aa, Influenza virus
LMSELGVPF

SEQ ID NO: 330462 - protein, 9 aa, Influenza virus
MSELGVPFH

SEQ ID NO: 330463 - protein, 9 aa, Influenza virus
SELGVPFHL

SEQ ID NO: 330464 - protein, 9 aa, Influenza virus
ELGIPFHLG

SEQ ID NO: 330465 - protein, 9 aa, Influenza virus
LGIPFHLGT

SEQ ID NO: 330466 - protein, 9 aa, Influenza virus
GVPFHLGTR

SEQ ID NO: 330467 - protein, 9 aa, Influenza virus
VPFHLGTRQ

SEQ ID NO: 330468 - protein, 9 aa, Influenza virus
PFHLGTRQV

SEQ ID NO: 330469 - protein, 9 aa, Influenza virus
FHLGTRQVC

SEQ ID NO: 330470 - protein, 9 aa, Influenza virus
HLGTRQVCI

SEQ ID NO: 330471 - protein, 9 aa, Influenza virus
LGTRQVCIA

SEQ ID NO: 330472 - protein, 9 aa, Influenza virus
GTRQVCIAW

SEQ ID NO: 330473 - protein, 9 aa, Influenza virus
TRQVCIAWS

SEQ ID NO: 330474 - protein, 9 aa, Influenza virus
RQVCIAWSS

SEQ ID NO: 330475 - protein, 9 aa, Influenza virus
QVCMAWSSS

SEQ ID NO: 330476 - protein, 9 aa, Influenza virus
VCMAWSSSS

SEQ ID NO: 330477 - protein, 9 aa, Influenza virus
CMAWSSSSC

SEQ ID NO: 330478 - protein, 9 aa, Influenza virus
MAWSSSSCH

SEQ ID NO: 330479 - protein, 9 aa, Influenza virus
AWSRSSCHD

SEQ ID NO: 330480 - protein, 9 aa, Influenza virus
WSSSSCYDG

SEQ ID NO: 330481 - protein, 9 aa, Influenza virus
SSSSCHDGR

SEQ ID NO: 330482 - protein, 9 aa, Influenza virus
SSSCHDGRA

SEQ ID NO: 330483 - protein, 9 aa, Influenza virus
SSCHDGRAW

SEQ ID NO: 330484 - protein, 9 aa, Influenza virus
SCHDGRAWL

SEQ ID NO: 330485 - protein, 9 aa, Influenza virus
CHDGRAWLH

SEQ ID NO: 330486 - protein, 9 aa, Influenza virus
HDGRAWLHV

SEQ ID NO: 330487 - protein, 9 aa, Influenza virus
DGRAWLHVC

SEQ ID NO: 330488 - protein, 9 aa, Influenza virus
GRAWLHVCV

SEQ ID NO: 330489 - protein, 9 aa, Influenza virus
AWLHICVTG

SEQ ID NO: 330490 - protein, 9 aa, Influenza virus
WLHICVTGD

SEQ ID NO: 330491 - protein, 9 aa, Influenza virus
LHICVTGDD

SEQ ID NO: 330492 - protein, 9 aa, Influenza virus
TGDDKNATA

SEQ ID NO: 330493 - protein, 9 aa, Influenza virus
GDDKNATAS

SEQ ID NO: 330494 - protein, 9 aa, Influenza virus
SWSKNILRT

SEQ ID NO: 330495 - protein, 9 aa, Influenza virus
WSKNILRTQ

SEQ ID NO: 330496 - protein, 9 aa, Influenza virus
SKNILRTQE

SEQ ID NO: 330497 - protein, 9 aa, Influenza virus
KNILRTQES

SEQ ID NO: 330498 - protein, 9 aa, Influenza virus
LRTQESECI

SEQ ID NO: 330499 - protein, 9 aa, Influenza virus
RTQESECIC

SEQ ID NO: 330500 - protein, 9 aa, Influenza virus
TQESECICI

SEQ ID NO: 330501 - protein, 9 aa, Influenza virus
QESECVCIS

SEQ ID NO: 330502 - protein, 9 aa, Influenza virus
CAVVMTDGS

SEQ ID NO: 330503 - protein, 9 aa, Influenza virus
AVVMTDGSA

SEQ ID NO: 330504 - protein, 9 aa, Influenza virus
VVMTDGNAS

SEQ ID NO: 330505 - protein, 9 aa, Influenza virus
IMTDGSASG

SEQ ID NO: 330506 - protein, 9 aa, Influenza virus
TDGSASGKA

SEQ ID NO: 330507 - protein, 9 aa, Influenza virus
SPLTGSAQH

SEQ ID NO: 330508 - protein, 9 aa, Influenza virus
PLTGSAQHI

SEQ ID NO: 330509 - protein, 9 aa, Influenza virus
LTGSAQHIE

SEQ ID NO: 330510 - protein, 9 aa, Influenza virus
GSAQHVEEC

SEQ ID NO: 330511 - protein, 9 aa, Influenza virus
SAQHVEECS

SEQ ID NO: 330512 - protein, 9 aa, Influenza virus
AQHVEECSC

SEQ ID NO: 330513 - protein, 9 aa, Influenza virus
QHVEECSCY

SEQ ID NO: 330514 - protein, 9 aa, Influenza virus
HVEECSCYP

SEQ ID NO: 330515 - protein, 9 aa, Influenza virus
SYLNVRCVC

SEQ ID NO: 330516 - protein, 9 aa, Influenza virus
IRCVCRDNW

SEQ ID NO: 330517 - protein, 9 aa, Influenza virus
RCICRDNWK

SEQ ID NO: 330518 - protein, 9 aa, Influenza virus
CICRDNWKG

SEQ ID NO: 330519 - protein, 9 aa, Influenza virus
ICRDNWKGS

SEQ ID NO: 330520 - protein, 9 aa, Influenza virus
CRDNWMGSN

SEQ ID NO: 330521 - protein, 9 aa, Influenza virus
RDNWMGSNR

SEQ ID NO: 330522 - protein, 9 aa, Influenza virus
DNWMGSNRP

SEQ ID NO: 330523 - protein, 9 aa, Influenza virus
NWKGSNRPI

SEQ ID NO: 330524 - protein, 9 aa, Influenza virus
SSYICSGLV

SEQ ID NO: 330525 - protein, 9 aa, Influenza virus
SYICSGLVG

SEQ ID NO: 330526 - protein, 9 aa, Influenza virus
YICSGLVGD

SEQ ID NO: 330527 - protein, 9 aa, Influenza virus
ICSGLVGDT

SEQ ID NO: 330528 - protein, 9 aa, Influenza virus
LVGDTPRNN

SEQ ID NO: 330529 - protein, 9 aa, Influenza virus
VGDTPRNND

SEQ ID NO: 330530 - protein, 9 aa, Influenza virus
GDTPRNDDG

SEQ ID NO: 330531 - protein, 9 aa, Influenza virus
SNSNCKDPN

SEQ ID NO: 330532 - protein, 9 aa, Influenza virus
NSNCKDPNN

SEQ ID NO: 330533 - protein, 9 aa, Influenza virus
SNCKDPNNE

SEQ ID NO: 330534 - protein, 9 aa, Influenza virus
NCKDPNNER

SEQ ID NO: 330535 - protein, 9 aa, Influenza virus
GNSGVKGWA

SEQ ID NO: 330536 - protein, 9 aa, Influenza virus
NSGVKGWAF

SEQ ID NO: 330537 - protein, 9 aa, Influenza virus
SGVKGWAFD

SEQ ID NO: 330538 - protein, 9 aa, Influenza virus
GVKGWAFDY

SEQ ID NO: 330539 - protein, 9 aa, Influenza virus
DIWMGRTIS

SEQ ID NO: 330540 - protein, 9 aa, Influenza virus
GRTISKNSR

SEQ ID NO: 330541 - protein, 9 aa, Influenza virus
SKNSRSGYE

SEQ ID NO: 330542 - protein, 9 aa, Influenza virus
KNSRSGYET

SEQ ID NO: 330543 - protein, 9 aa, Influenza virus
SRSGYETFK

SEQ ID NO: 330544 - protein, 9 aa, Influenza virus
RSGYETFKV

SEQ ID NO: 330545 - protein, 9 aa, Influenza virus
SGYETFKVI

SEQ ID NO: 330546 - protein, 9 aa, Influenza virus
NWSGYSGVF

SEQ ID NO: 330547 - protein, 9 aa, Influenza virus
WSGYSGVFS

SEQ ID NO: 330548 - protein, 9 aa, Influenza virus
SGYSGVFSV

SEQ ID NO: 330549 - protein, 9 aa, Influenza virus
GYSGVFSVE

SEQ ID NO: 330550 - protein, 9 aa, Influenza virus
SCVNRCFYV

SEQ ID NO: 330551 - protein, 9 aa, Influenza virus
CVNRCFYVE

SEQ ID NO: 330552 - protein, 9 aa, Influenza virus
VNRCFYVEL

SEQ ID NO: 330553 - protein, 9 aa, Influenza virus
YVEMIRGRP

SEQ ID NO: 330554 - protein, 9 aa, Influenza virus
VELIRGRPK

SEQ ID NO: 330555 - protein, 9 aa, Influenza virus
ELIRGRPKE

SEQ ID NO: 330556 - protein, 9 aa, Influenza virus
RVWWTTNSI

SEQ ID NO: 330557 - protein, 9 aa, Influenza virus
VWWTSNSII

SEQ ID NO: 330558 - protein, 9 aa, Influenza virus
WWTSNSIVA

SEQ ID NO: 330559 - protein, 9 aa, Influenza virus
WTSNSIVAF

SEQ ID NO: 330560 - protein, 9 aa, Influenza virus
TSNSIVAFC

SEQ ID NO: 330561 - protein, 9 aa, Influenza virus
SNSIVAFCG

SEQ ID NO: 330562 - protein, 9 aa, Influenza virus
NSIVAFCGT

SEQ ID NO: 330563 - protein, 9 aa, Influenza virus
SIVAFCGTS

SEQ ID NO: 330564 - protein, 9 aa, Influenza virus
IVAFCGTSG

SEQ ID NO: 330565 - protein, 9 aa, Influenza virus
VAFCGTSGT

SEQ ID NO: 330566 - protein, 9 aa, Influenza virus
AFCGTSGTY

SEQ ID NO: 330567 - protein, 9 aa, Influenza virus
TGSWPDGAD

SEQ ID NO: 330568 - protein, 9 aa, Influenza virus
GSWPDGADI

SEQ ID NO: 330569 - protein, 9 aa, Influenza virus
SWPDGADIN

SEQ ID NO: 330570 - protein, 9 aa, Influenza virus
WPDGANINL

SEQ ID NO: 330571 - protein, 9 aa, Influenza virus
PDGANINLM

SEQ ID NO: 330572 - protein, 9 aa, Influenza virus
DGANINLMP

SEQ ID NO: 330573 - protein, 9 aa, Influenza virus
GRSDKICIG

SEQ ID NO: 330574 - protein, 9 aa, Influenza virus
RSDKICIGY

SEQ ID NO: 330575 - protein, 9 aa, Influenza virus
SDRICIGYH

SEQ ID NO: 330576 - protein, 9 aa, Influenza virus
DRICIGYHA

SEQ ID NO: 330577 - protein, 9 aa, Influenza virus
RICIGYHAN

SEQ ID NO: 330578 - protein, 9 aa, Influenza virus
YHANNSTTK

SEQ ID NO: 330579 - protein, 9 aa, Influenza virus
HANNSTTKV

SEQ ID NO: 330580 - protein, 9 aa, Influenza virus
ANNSTTKVD

SEQ ID NO: 330581 - protein, 9 aa, Influenza virus
NNSTTKVDT

SEQ ID NO: 330582 - protein, 9 aa, Influenza virus
NSTTKVDTI

SEQ ID NO: 330583 - protein, 9 aa, Influenza virus
VDTLLEKNV

SEQ ID NO: 330584 - protein, 9 aa, Influenza virus
DTLLEKNVT

SEQ ID NO: 330585 - protein, 9 aa, Influenza virus
TLLEKNVTV

SEQ ID NO: 330586 - protein, 9 aa, Influenza virus
LLEKNVTVT

SEQ ID NO: 330587 - protein, 9 aa, Influenza virus
LERNVTVTH

SEQ ID NO: 330588 - protein, 9 aa, Influenza virus
ERNVTVTHS

SEQ ID NO: 330589 - protein, 9 aa, Influenza virus
KNVTVTHSI

SEQ ID NO: 330590 - protein, 9 aa, Influenza virus
NVTVTHSIE

SEQ ID NO: 330591 - protein, 9 aa, Influenza virus
VTVTHSIEL

SEQ ID NO: 330592 - protein, 9 aa, Influenza virus
TVTHSIELL

SEQ ID NO: 330593 - protein, 9 aa, Influenza virus
VTHSIELLE

SEQ ID NO: 330594 - protein, 9 aa, Influenza virus
THSVELLES

SEQ ID NO: 330595 - protein, 9 aa, Influenza virus
EGWILGNPR

SEQ ID NO: 330596 - protein, 9 aa, Influenza virus
GWILGNPRC

SEQ ID NO: 330597 - protein, 9 aa, Influenza virus
WILGNPRCD

SEQ ID NO: 330598 - protein, 9 aa, Influenza virus
RSWSYIVER

SEQ ID NO: 330599 - protein, 9 aa, Influenza virus
SWSYVVERP

SEQ ID NO: 330600 - protein, 9 aa, Influenza virus
AQHGICYPG

SEQ ID NO: 330601 - protein, 9 aa, Influenza virus
PSFYRNLLW

SEQ ID NO: 330602 - protein, 9 aa, Influenza virus
SFYRNLVWI

SEQ ID NO: 330603 - protein, 9 aa, Influenza virus
SVLYFWGVH

SEQ ID NO: 330604 - protein, 9 aa, Influenza virus
VLYFWGVHH

SEQ ID NO: 330605 - protein, 9 aa, Influenza virus
LYFWGIHHP

SEQ ID NO: 330606 - protein, 9 aa, Influenza virus
RGRIDYFWS

SEQ ID NO: 330607 - protein, 9 aa, Influenza virus
RIDYFWSIL

SEQ ID NO: 330608 - protein, 9 aa, Influenza virus
WSILKPGET

SEQ ID NO: 330609 - protein, 9 aa, Influenza virus
SILKPGETL

SEQ ID NO: 330610 - protein, 9 aa, Influenza virus
ILKPGETLN

SEQ ID NO: 330611 - protein, 9 aa, Influenza virus
LRPGETLNV

SEQ ID NO: 330612 - protein, 9 aa, Influenza virus
RPGETLNVE

SEQ ID NO: 330613 - protein, 9 aa, Influenza virus
PGETLKVES

SEQ ID NO: 330614 - protein, 9 aa, Influenza virus
GETLKVESN

SEQ ID NO: 330615 - protein, 9 aa, Influenza virus
ETLKVESNG

SEQ ID NO: 330616 - protein, 9 aa, Influenza virus
TLKVESNGN

SEQ ID NO: 330617 - protein, 9 aa, Influenza virus
LKVESNGNL

SEQ ID NO: 330618 - protein, 9 aa, Influenza virus
NVESNGNLV

SEQ ID NO: 330619 - protein, 9 aa, Influenza virus
VESNGNLVA

SEQ ID NO: 330620 - protein, 9 aa, Influenza virus
ESNGNLVAP

SEQ ID NO: 330621 - protein, 9 aa, Influenza virus
SNGNLVAPW

SEQ ID NO: 330622 - protein, 9 aa, Influenza virus
NGNLVAPWY

SEQ ID NO: 330623 - protein, 9 aa, Influenza virus
GNLVAPWYA

SEQ ID NO: 330624 - protein, 9 aa, Influenza virus
NLVAPWYAY

SEQ ID NO: 330625 - protein, 9 aa, Influenza virus
LIAPWYAYR

SEQ ID NO: 330626 - protein, 9 aa, Influenza virus
TNKTFQNIS

SEQ ID NO: 330627 - protein, 9 aa, Influenza virus
NKTFQNISP

SEQ ID NO: 330628 - protein, 9 aa, Influenza virus
KTFQNISPV

SEQ ID NO: 330629 - protein, 9 aa, Influenza virus
TFQNISPVW

SEQ ID NO: 330630 - protein, 9 aa, Influenza virus
FQNISPVWI

SEQ ID NO: 330631 - protein, 9 aa, Influenza virus
QNISPVWIG

SEQ ID NO: 330632 - protein, 9 aa, Influenza virus
WIGKCPKYV

SEQ ID NO: 330633 - protein, 9 aa, Influenza virus
GKCPKYVKS

SEQ ID NO: 330634 - protein, 9 aa, Influenza virus
SLKLATGLR

SEQ ID NO: 330635 - protein, 9 aa, Influenza virus
LKLATGLRN

SEQ ID NO: 330636 - protein, 9 aa, Influenza virus
KLATGLRNV

SEQ ID NO: 330637 - protein, 9 aa, Influenza virus
LATGLRNIP

SEQ ID NO: 330638 - protein, 9 aa, Influenza virus
ATGLRNIPQ

SEQ ID NO: 330639 - protein, 9 aa, Influenza virus
TRGIFGAIA

SEQ ID NO: 330640 - protein, 9 aa, Influenza virus
RGIFGAIAG

SEQ ID NO: 330641 - protein, 9 aa, Influenza virus
GIFGAIAGF

SEQ ID NO: 330642 - protein, 9 aa, Influenza virus
IFGAIAGFI

SEQ ID NO: 330643 - protein, 9 aa, Influenza virus
FIEGGWTGL

SEQ ID NO: 330644 - protein, 9 aa, Influenza virus
IEGGWTGMV

SEQ ID NO: 330645 - protein, 9 aa, Influenza virus
EGGWTGMVD

SEQ ID NO: 330646 - protein, 9 aa, Influenza virus
GGWTGMVDG

SEQ ID NO: 330647 - protein, 9 aa, Influenza virus
GWTGMVDGW

SEQ ID NO: 330648 - protein, 9 aa, Influenza virus
WTGMVDGWY

SEQ ID NO: 330649 - protein, 9 aa, Influenza virus
TGMVDGWYG

SEQ ID NO: 330650 - protein, 9 aa, Influenza virus
GMVDGWYGY

SEQ ID NO: 330651 - protein, 9 aa, Influenza virus
MVDGWYGYH

SEQ ID NO: 330652 - protein, 9 aa, Influenza virus
VDGWYGYHH

SEQ ID NO: 330653 - protein, 9 aa, Influenza virus
QGSGYAADR

SEQ ID NO: 330654 - protein, 9 aa, Influenza virus
GSGYAADRE

SEQ ID NO: 330655 - protein, 9 aa, Influenza virus
SGYAADRES

SEQ ID NO: 330656 - protein, 9 aa, Influenza virus
GYAADREST

SEQ ID NO: 330657 - protein, 9 aa, Influenza virus
YAADRESTQ

SEQ ID NO: 330658 - protein, 9 aa, Influenza virus
AADRESTQK

SEQ ID NO: 330659 - protein, 9 aa, Influenza virus
ADRESTQKA

SEQ ID NO: 330660 - protein, 9 aa, Influenza virus
ITTKVNSII

SEQ ID NO: 330661 - protein, 9 aa, Influenza virus
NSIINKMNT

SEQ ID NO: 330662 - protein, 9 aa, Influenza virus
IINKMNTQF

SEQ ID NO: 330663 - protein, 9 aa, Influenza virus
KMNTQFEAI

SEQ ID NO: 330664 - protein, 9 aa, Influenza virus
HEFSSLERR

SEQ ID NO: 330665 - protein, 9 aa, Influenza virus
EFSSLERRI

SEQ ID NO: 330666 - protein, 9 aa, Influenza virus
NLNKRMQDG

SEQ ID NO: 330667 - protein, 9 aa, Influenza virus
LNKRMQDGF

SEQ ID NO: 330668 - protein, 9 aa, Influenza virus
NKRMQDGFL

SEQ ID NO: 330669 - protein, 9 aa, Influenza virus
DGFLNVWTY

SEQ ID NO: 330670 - protein, 9 aa, Influenza virus
GFLNVWTYN

SEQ ID NO: 330671 - protein, 9 aa, Influenza virus
FLNVWTYNA

SEQ ID NO: 330672 - protein, 9 aa, Influenza virus
LNVWTYNAE

SEQ ID NO: 330673 - protein, 9 aa, Influenza virus
NVWTYNAEL

SEQ ID NO: 330674 - protein, 9 aa, Influenza virus
WTYNAELLI

SEQ ID NO: 330675 - protein, 9 aa, Influenza virus
TYNAELLIL

SEQ ID NO: 330676 - protein, 9 aa, Influenza virus
YNAELLILL

SEQ ID NO: 330677 - protein, 9 aa, Influenza virus
NAELLILLE

SEQ ID NO: 330678 - protein, 9 aa, Influenza virus
AELLILLEN

SEQ ID NO: 330679 - protein, 9 aa, Influenza virus
ELLILLENE

SEQ ID NO: 330680 - protein, 9 aa, Influenza virus
LLILLENER

SEQ ID NO: 330681 - protein, 9 aa, Influenza virus
LILLENERT

SEQ ID NO: 330682 - protein, 9 aa, Influenza virus
ILLENERTL

SEQ ID NO: 330683 - protein, 9 aa, Influenza virus
LLENGRTLD

SEQ ID NO: 330684 - protein, 9 aa, Influenza virus
ENERTLDMH

SEQ ID NO: 330685 - protein, 9 aa, Influenza virus
NERTLDMHD

SEQ ID NO: 330686 - protein, 9 aa, Influenza virus
ERTLDMHDA

SEQ ID NO: 330687 - protein, 9 aa, Influenza virus
RTLDMHDAN

SEQ ID NO: 330688 - protein, 9 aa, Influenza virus
TLDMHDANV

SEQ ID NO: 330689 - protein, 9 aa, Influenza virus
LDMHDANVK

SEQ ID NO: 330690 - protein, 9 aa, Influenza virus
VRSQLRDNA

SEQ ID NO: 330691 - protein, 9 aa, Influenza virus
SQLRDNAKD

SEQ ID NO: 330692 - protein, 9 aa, Influenza virus
LRDNAKDLG

SEQ ID NO: 330693 - protein, 9 aa, Influenza virus
RDNAKDLGN

SEQ ID NO: 330694 - protein, 9 aa, Influenza virus
DNAKDLGNG

SEQ ID NO: 330695 - protein, 9 aa, Influenza virus
NAKDLGNGC

SEQ ID NO: 330696 - protein, 9 aa, Influenza virus
AKDLGNGCF

SEQ ID NO: 330697 - protein, 9 aa, Influenza virus
KDLGNGCFE

SEQ ID NO: 330698 - protein, 9 aa, Influenza virus
CFEFWHKCN

SEQ ID NO: 330699 - protein, 9 aa, Influenza virus
FEFWHKCDD

SEQ ID NO: 330700 - protein, 9 aa, Influenza virus
EFWHKCDDE

SEQ ID NO: 330701 - protein, 9 aa, Influenza virus
FWHKCDDEC

SEQ ID NO: 330702 - protein, 9 aa, Influenza virus
SVKNGTYNY

SEQ ID NO: 330703 - protein, 9 aa, Influenza virus
KNGTYNYPK

SEQ ID NO: 330704 - protein, 9 aa, Influenza virus
NGTYNYPKY

SEQ ID NO: 330705 - protein, 9 aa, Influenza virus
GTYNYPKYQ

SEQ ID NO: 330706 - protein, 9 aa, Influenza virus
FGVYQILAI

SEQ ID NO: 330707 - protein, 9 aa, Influenza virus
DVYQILAIY

SEQ ID NO: 330708 - protein, 9 aa, Influenza virus
IYQILAIYS

SEQ ID NO: 330709 - protein, 9 aa, Influenza virus
QILSIYSTV

SEQ ID NO: 330710 - protein, 9 aa, Influenza virus
ILSIYSTVS

SEQ ID NO: 330711 - protein, 9 aa, Influenza virus
LAIYSTISS

SEQ ID NO: 330712 - protein, 9 aa, Influenza virus
AIYSTISSS

SEQ ID NO: 330713 - protein, 9 aa, Influenza virus
IYSTISSSL

SEQ ID NO: 330714 - protein, 9 aa, Influenza virus
YSTISSSLV

SEQ ID NO: 330715 - protein, 9 aa, Influenza virus
TVSSSLVLA

SEQ ID NO: 330716 - protein, 9 aa, Influenza virus
VSSSLVLAG

SEQ ID NO: 330717 - protein, 9 aa, Influenza virus
SSSLVLMGL

SEQ ID NO: 330718 - protein, 9 aa, Influenza virus
SSLVLVGLV

SEQ ID NO: 330719 - protein, 9 aa, Influenza virus
WMCSNSSMQ

SEQ ID NO: 330720 - protein, 9 aa, Influenza virus
MCSNSSMQC

SEQ ID NO: 330721 - protein, 9 aa, Influenza virus
CSNGSMQCK

SEQ ID NO: 330722 - protein, 9 aa, Influenza virus
GSMQCKICI

SEQ ID NO: 330723 - protein, 9 aa, Influenza virus
MKSRGYKMN

SEQ ID NO: 330724 - protein, 9 aa, Influenza virus
KSRGYKMNN

SEQ ID NO: 330725 - protein, 9 aa, Influenza virus
SRGYKMNNQ

SEQ ID NO: 330726 - protein, 9 aa, Influenza virus
RGYKMNNQI

SEQ ID NO: 330727 - protein, 9 aa, Influenza virus
GYKMNTRIL

SEQ ID NO: 330728 - protein, 9 aa, Influenza virus
ADKICLGHH

SEQ ID NO: 330729 - protein, 9 aa, Influenza virus
NGTKVDTLT

SEQ ID NO: 330730 - protein, 9 aa, Influenza virus
TLTERGVEV

SEQ ID NO: 330731 - protein, 9 aa, Influenza virus
LTERGVEVV

SEQ ID NO: 330732 - protein, 9 aa, Influenza virus
TERGVEVVN

SEQ ID NO: 330733 - protein, 9 aa, Influenza virus
ERGVEVVNA

SEQ ID NO: 330734 - protein, 9 aa, Influenza virus
RGVEVVNAT

SEQ ID NO: 330735 - protein, 9 aa, Influenza virus
GVEVVNATE

SEQ ID NO: 330736 - protein, 9 aa, Influenza virus
VEVVNATET

SEQ ID NO: 330737 - protein, 9 aa, Influenza virus
EVVDATETV

SEQ ID NO: 330738 - protein, 9 aa, Influenza virus
VVDATETVE

SEQ ID NO: 330739 - protein, 9 aa, Influenza virus
VNATETVER

SEQ ID NO: 330740 - protein, 9 aa, Influenza virus
GPPQCDLFL

SEQ ID NO: 330741 - protein, 9 aa, Influenza virus
PPQCDLFLE

SEQ ID NO: 330742 - protein, 9 aa, Influenza virus
PQCDLFLEF

SEQ ID NO: 330743 - protein, 9 aa, Influenza virus
PSFYAEMKW

SEQ ID NO: 330744 - protein, 9 aa, Influenza virus
SFYAEMEWL

SEQ ID NO: 330745 - protein, 9 aa, Influenza virus
FYAEMEWLL

SEQ ID NO: 330746 - protein, 9 aa, Influenza virus
YAEMEWLLS

SEQ ID NO: 330747 - protein, 9 aa, Influenza virus
AEMKWLLSS

SEQ ID NO: 330748 - protein, 9 aa, Influenza virus
ALIIWGIHH

SEQ ID NO: 330749 - protein, 9 aa, Influenza virus
NGQSGRINF

SEQ ID NO: 330750 - protein, 9 aa, Influenza virus
GQSGRIDFY

SEQ ID NO: 330751 - protein, 9 aa, Influenza virus
QSGRIDFYW

SEQ ID NO: 330752 - protein, 9 aa, Influenza virus
FSFNGAFIA

SEQ ID NO: 330753 - protein, 9 aa, Influenza virus
SFNGAFIAP

SEQ ID NO: 330754 - protein, 9 aa, Influenza virus
FNGAFIAPN

SEQ ID NO: 330755 - protein, 9 aa, Influenza virus
NGAFIAPNR

SEQ ID NO: 330756 - protein, 9 aa, Influenza virus
GAFIAPDRV

SEQ ID NO: 330757 - protein, 9 aa, Influenza virus
AFIAPDRVS

SEQ ID NO: 330758 - protein, 9 aa, Influenza virus
FIAPDRVSF

SEQ ID NO: 330759 - protein, 9 aa, Influenza virus
GRCPRYVKQ

SEQ ID NO: 330760 - protein, 9 aa, Influenza virus
SLLLATGMK

SEQ ID NO: 330761 - protein, 9 aa, Influenza virus
LLLATGMKN

SEQ ID NO: 330762 - protein, 9 aa, Influenza virus
LLATGMKNV

SEQ ID NO: 330763 - protein, 9 aa, Influenza virus
LATGMKNVP

SEQ ID NO: 330764 - protein, 9 aa, Influenza virus
ATGMKNVPE

SEQ ID NO: 330765 - protein, 9 aa, Influenza virus
AHKQLTHHM

SEQ ID NO: 330766 - protein, 9 aa, Influenza virus
RMTRGLFGA

SEQ ID NO: 330767 - protein, 9 aa, Influenza virus
ETRGLFGAI

SEQ ID NO: 330768 - protein, 9 aa, Influenza virus
TRGLFGAIA

SEQ ID NO: 330769 - protein, 9 aa, Influenza virus
IENGWEGLV

SEQ ID NO: 330770 - protein, 9 aa, Influenza virus
ENGWEGLIN

SEQ ID NO: 330771 - protein, 9 aa, Influenza virus
NGWEGLING

SEQ ID NO: 330772 - protein, 9 aa, Influenza virus
GWEGLINGW

SEQ ID NO: 330773 - protein, 9 aa, Influenza virus
WEGLINGWY

SEQ ID NO: 330774 - protein, 9 aa, Influenza virus
EGLINGWYG

SEQ ID NO: 330775 - protein, 9 aa, Influenza virus
GLINGWYGF

SEQ ID NO: 330776 - protein, 9 aa, Influenza virus
LINGWYGFR

SEQ ID NO: 330777 - protein, 9 aa, Influenza virus
INGWYGFRH

SEQ ID NO: 330778 - protein, 9 aa, Influenza virus
NGWYGFRHQ

SEQ ID NO: 330779 - protein, 9 aa, Influenza virus
GWYGYRHQN

SEQ ID NO: 330780 - protein, 9 aa, Influenza virus
WYGYRHQNA

SEQ ID NO: 330781 - protein, 9 aa, Influenza virus
YGYRHQNAQ

SEQ ID NO: 330782 - protein, 9 aa, Influenza virus
GYRHQNAQG

SEQ ID NO: 330783 - protein, 9 aa, Influenza virus
YRHQNAQGE

SEQ ID NO: 330784 - protein, 9 aa, Influenza virus
KHQNAQGEG

SEQ ID NO: 330785 - protein, 9 aa, Influenza virus
HQNAQGEGI

SEQ ID NO: 330786 - protein, 9 aa, Influenza virus
QNAQGEGIA

SEQ ID NO: 330787 - protein, 9 aa, Influenza virus
NAQGEGIAA

SEQ ID NO: 330788 - protein, 9 aa, Influenza virus
AQGEGIAAD

SEQ ID NO: 330789 - protein, 9 aa, Influenza virus
QGEGIAADY

SEQ ID NO: 330790 - protein, 9 aa, Influenza virus
GEGIAADYK

SEQ ID NO: 330791 - protein, 9 aa, Influenza virus
EGIAADYKS

SEQ ID NO: 330792 - protein, 9 aa, Influenza virus
GIAADYKST

SEQ ID NO: 330793 - protein, 9 aa, Influenza virus
IAADYKSTQ

SEQ ID NO: 330794 - protein, 9 aa, Influenza virus
DYKSTQSAV

SEQ ID NO: 330795 - protein, 9 aa, Influenza virus
YKSTQSAIN

SEQ ID NO: 330796 - protein, 9 aa, Influenza virus
KSTQSAINQ

SEQ ID NO: 330797 - protein, 9 aa, Influenza virus
STQSAIDQV

SEQ ID NO: 330798 - protein, 9 aa, Influenza virus
TQSAIDQVT

SEQ ID NO: 330799 - protein, 9 aa, Influenza virus
QSAIDQVTG

SEQ ID NO: 330800 - protein, 9 aa, Influenza virus
SAIDQVTGK

SEQ ID NO: 330801 - protein, 9 aa, Influenza virus
AIDQVTGKL

SEQ ID NO: 330802 - protein, 9 aa, Influenza virus
IDQVTGKLN

SEQ ID NO: 330803 - protein, 9 aa, Influenza virus
DQVTGKLNR

SEQ ID NO: 330804 - protein, 9 aa, Influenza virus
QVTGKLNRL

SEQ ID NO: 330805 - protein, 9 aa, Influenza virus
VTGKLNRLI

SEQ ID NO: 330806 - protein, 9 aa, Influenza virus
KTNQQFEMI

SEQ ID NO: 330807 - protein, 9 aa, Influenza virus
EKQIGNVIN

SEQ ID NO: 330808 - protein, 9 aa, Influenza virus
KQIGNVINW

SEQ ID NO: 330809 - protein, 9 aa, Influenza virus
QLGNVINWT

SEQ ID NO: 330810 - protein, 9 aa, Influenza virus
IGNVINWTQ

SEQ ID NO: 330811 - protein, 9 aa, Influenza virus
GNVINWTQD

SEQ ID NO: 330812 - protein, 9 aa, Influenza virus
NVINWTRDA

SEQ ID NO: 330813 - protein, 9 aa, Influenza virus
WSYNAEFLV

SEQ ID NO: 330814 - protein, 9 aa, Influenza virus
SYNAEFLVA

SEQ ID NO: 330815 - protein, 9 aa, Influenza virus
AEFLVAVEN

SEQ ID NO: 330816 - protein, 9 aa, Influenza virus
EFLVAVENQ

SEQ ID NO: 330817 - protein, 9 aa, Influenza virus
FLVAVENQH

SEQ ID NO: 330818 - protein, 9 aa, Influenza virus
LVAVENQHT

SEQ ID NO: 330819 - protein, 9 aa, Influenza virus
VAVENQHTI

SEQ ID NO: 330820 - protein, 9 aa, Influenza virus
AVENQHTID

SEQ ID NO: 330821 - protein, 9 aa, Influenza virus
VENQHTIDL

SEQ ID NO: 330822 - protein, 9 aa, Influenza virus
ENQHTIDLT

SEQ ID NO: 330823 - protein, 9 aa, Influenza virus
NQHTIDLTD

SEQ ID NO: 330824 - protein, 9 aa, Influenza virus
QHTIDLTDS

SEQ ID NO: 330825 - protein, 9 aa, Influenza virus
HTIDLTDSE

SEQ ID NO: 330826 - protein, 9 aa, Influenza virus
TIDLTDSEM

SEQ ID NO: 330827 - protein, 9 aa, Influenza virus
SEMSKLYER

SEQ ID NO: 330828 - protein, 9 aa, Influenza virus
EMSKLYERV

SEQ ID NO: 330829 - protein, 9 aa, Influenza virus
VKKQLRENA

SEQ ID NO: 330830 - protein, 9 aa, Influenza virus
KKQLRENAE

SEQ ID NO: 330831 - protein, 9 aa, Influenza virus
RQLRENAEE

SEQ ID NO: 330832 - protein, 9 aa, Influenza virus
LLRENAEED

SEQ ID NO: 330833 - protein, 9 aa, Influenza virus
RENAEEDGN

SEQ ID NO: 330834 - protein, 9 aa, Influenza virus
ENAEEDGNG

SEQ ID NO: 330835 - protein, 9 aa, Influenza virus
NAEEDGNGC

SEQ ID NO: 330836 - protein, 9 aa, Influenza virus
AEEDGNGCF

SEQ ID NO: 330837 - protein, 9 aa, Influenza virus
EEDGNGCFE

SEQ ID NO: 330838 - protein, 9 aa, Influenza virus
EDGNGCFEI

SEQ ID NO: 330839 - protein, 9 aa, Influenza virus
DGNGCFEIF

SEQ ID NO: 330840 - protein, 9 aa, Influenza virus
GNGCFEIFH

SEQ ID NO: 330841 - protein, 9 aa, Influenza virus
NGCFEIFHQ

SEQ ID NO: 330842 - protein, 9 aa, Influenza virus
GCFEIFHQC

SEQ ID NO: 330843 - protein, 9 aa, Influenza virus
CFEIFHQCD

SEQ ID NO: 330844 - protein, 9 aa, Influenza virus
FEIFHQCDN

SEQ ID NO: 330845 - protein, 9 aa, Influenza virus
CMASIRNNT

SEQ ID NO: 330846 - protein, 9 aa, Influenza virus
MASIRNNTY

SEQ ID NO: 330847 - protein, 9 aa, Influenza virus
ASIRNNTYD

SEQ ID NO: 330848 - protein, 9 aa, Influenza virus
SIRNNTYNH

SEQ ID NO: 330849 - protein, 9 aa, Influenza virus
YREEAMQNR

SEQ ID NO: 330850 - protein, 9 aa, Influenza virus
SGYKDVILW

SEQ ID NO: 330851 - protein, 9 aa, Influenza virus
GYKDVILWF

SEQ ID NO: 330852 - protein, 9 aa, Influenza virus
YKDVILWFS

SEQ ID NO: 330853 - protein, 9 aa, Influenza virus
KDVILWFSF

SEQ ID NO: 330854 - protein, 9 aa, Influenza virus
DVILWFSFG

SEQ ID NO: 330855 - protein, 9 aa, Influenza virus
VILWFSFGA

SEQ ID NO: 330856 - protein, 9 aa, Influenza virus
FSFGASCFI

SEQ ID NO: 330857 - protein, 9 aa, Influenza virus
SFGASCFIL

SEQ ID NO: 330858 - protein, 9 aa, Influenza virus
FGASCFILL

SEQ ID NO: 330859 - protein, 9 aa, Influenza virus
GASCFILLA

SEQ ID NO: 330860 - protein, 9 aa, Influenza virus
FICVKNGNM

SEQ ID NO: 330861 - protein, 9 aa, Influenza virus
KNGNMQCTI

SEQ ID NO: 330862 - protein, 9 aa, Influenza virus
NGNMQCTIC

SEQ ID NO: 330863 - protein, 9 aa, Influenza virus
GNMQCTICI

SEQ ID NO: 330864 - protein, 9 aa, Influenza virus
VKGDKICLG

SEQ ID NO: 330865 - protein, 9 aa, Influenza virus
NADKICLGH

SEQ ID NO: 330866 - protein, 9 aa, Influenza virus
ADKICLGHH

SEQ ID NO: 330867 - protein, 9 aa, Influenza virus
ICLGHHAVS

SEQ ID NO: 330868 - protein, 9 aa, Influenza virus
CLGHHAVSN

SEQ ID NO: 330869 - protein, 9 aa, Influenza virus
LGHHAVSNG

SEQ ID NO: 330870 - protein, 9 aa, Influenza virus
GHHAVSNGT

SEQ ID NO: 330871 - protein, 9 aa, Influenza virus
HHAVSNGTK

SEQ ID NO: 330872 - protein, 9 aa, Influenza virus
HAVSNGTKV

SEQ ID NO: 330873 - protein, 9 aa, Influenza virus
AVSNGTKVN

SEQ ID NO: 330874 - protein, 9 aa, Influenza virus
VSNGTKVNT

SEQ ID NO: 330875 - protein, 9 aa, Influenza virus
SNGTKVNTL

SEQ ID NO: 330876 - protein, 9 aa, Influenza virus
NGTKINTLT

SEQ ID NO: 330877 - protein, 9 aa, Influenza virus
GTKINTLTE

SEQ ID NO: 330878 - protein, 9 aa, Influenza virus
TKVNTLTEK

SEQ ID NO: 330879 - protein, 9 aa, Influenza virus
KVNTLTEKG

SEQ ID NO: 330880 - protein, 9 aa, Influenza virus
VNTLTEKGI

SEQ ID NO: 330881 - protein, 9 aa, Influenza virus
NTLTEKGIE

SEQ ID NO: 330882 - protein, 9 aa, Influenza virus
TLTEKGIEV

SEQ ID NO: 330883 - protein, 9 aa, Influenza virus
LTEKGIEVV

SEQ ID NO: 330884 - protein, 9 aa, Influenza virus
TEKGIEVVN

SEQ ID NO: 330885 - protein, 9 aa, Influenza virus
EKGIEVVNA

SEQ ID NO: 330886 - protein, 9 aa, Influenza virus
KGIEVVNAT

SEQ ID NO: 330887 - protein, 9 aa, Influenza virus
GVEVVNATE

SEQ ID NO: 330888 - protein, 9 aa, Influenza virus
VEVVNATET

SEQ ID NO: 330889 - protein, 9 aa, Influenza virus
VNATETVER

SEQ ID NO: 330890 - protein, 9 aa, Influenza virus
NATETVETT

SEQ ID NO: 330891 - protein, 9 aa, Influenza virus
DLGRCGLLG

SEQ ID NO: 330892 - protein, 9 aa, Influenza virus
LGRCGLLGT

SEQ ID NO: 330893 - protein, 9 aa, Influenza virus
CGLLGTLTG

SEQ ID NO: 330894 - protein, 9 aa, Influenza virus
GLLGTLTGP

SEQ ID NO: 330895 - protein, 9 aa, Influenza virus
LLGTLTGPP

SEQ ID NO: 330896 - protein, 9 aa, Influenza virus
TGPPQCDQF

SEQ ID NO: 330897 - protein, 9 aa, Influenza virus
GPPQCDKFL

SEQ ID NO: 330898 - protein, 9 aa, Influenza virus
PPQCDKFLE

SEQ ID NO: 330899 - protein, 9 aa, Influenza virus
PQCDKFLEF

SEQ ID NO: 330900 - protein, 9 aa, Influenza virus
ADLIIERRE

SEQ ID NO: 330901 - protein, 9 aa, Influenza virus
DLIIERKEG

SEQ ID NO: 330902 - protein, 9 aa, Influenza virus
LIIERREGN

SEQ ID NO: 330903 - protein, 9 aa, Influenza virus
IIERREGND

SEQ ID NO: 330904 - protein, 9 aa, Influenza virus
EGTDICYPG

SEQ ID NO: 330905 - protein, 9 aa, Influenza virus
CYPGRFTNE

SEQ ID NO: 330906 - protein, 9 aa, Influenza virus
YPGRFTNEE

SEQ ID NO: 330907 - protein, 9 aa, Influenza virus
FVNEEALRQ

SEQ ID NO: 330908 - protein, 9 aa, Influenza virus
VNEEALRQI

SEQ ID NO: 330909 - protein, 9 aa, Influenza virus
NEEALRQIL

SEQ ID NO: 330910 - protein, 9 aa, Influenza virus
EEALRQILR

SEQ ID NO: 330911 - protein, 9 aa, Influenza virus
LRQILRGSG

SEQ ID NO: 330912 - protein, 9 aa, Influenza virus
RQILRGSGG

SEQ ID NO: 330913 - protein, 9 aa, Influenza virus
QILRGSGGI

SEQ ID NO: 330914 - protein, 9 aa, Influenza virus
RRSGGISKE

SEQ ID NO: 330915 - protein, 9 aa, Influenza virus
GFTYNGIRT

SEQ ID NO: 330916 - protein, 9 aa, Influenza virus
FTYNGIRTN

SEQ ID NO: 330917 - protein, 9 aa, Influenza virus
TYNGIRTNG

SEQ ID NO: 330918 - protein, 9 aa, Influenza virus
YNGIRTNGA

SEQ ID NO: 330919 - protein, 9 aa, Influenza virus
RLGSSFYAE

SEQ ID NO: 330920 - protein, 9 aa, Influenza virus
LGSSFYAEM

SEQ ID NO: 330921 - protein, 9 aa, Influenza virus
GSSFYAELK

SEQ ID NO: 330922 - protein, 9 aa, Influenza virus
AEMKWLLSS

SEQ ID NO: 330923 - protein, 9 aa, Influenza virus
EMKWLLSNT

SEQ ID NO: 330924 - protein, 9 aa, Influenza virus
MKWLLSNTD

SEQ ID NO: 330925 - protein, 9 aa, Influenza virus
KWLLSNTDN

SEQ ID NO: 330926 - protein, 9 aa, Influenza virus
ALIIWGIHH

SEQ ID NO: 330927 - protein, 9 aa, Influenza virus
LIIWGIHHS

SEQ ID NO: 330928 - protein, 9 aa, Influenza virus
SEQTKLYGN

SEQ ID NO: 330929 - protein, 9 aa, Influenza virus
EQTKLYGNG

SEQ ID NO: 330930 - protein, 9 aa, Influenza virus
QTKLYGNGN

SEQ ID NO: 330931 - protein, 9 aa, Influenza virus
TKLYGNGNK

SEQ ID NO: 330932 - protein, 9 aa, Influenza virus
KLYGNGNKL

SEQ ID NO: 330933 - protein, 9 aa, Influenza virus
LYGSGNKLV

SEQ ID NO: 330934 - protein, 9 aa, Influenza virus
PGARPQVNG

SEQ ID NO: 330935 - protein, 9 aa, Influenza virus
GARPQVNGQ

SEQ ID NO: 330936 - protein, 9 aa, Influenza virus
ARPQVNGQS

SEQ ID NO: 330937 - protein, 9 aa, Influenza virus
RPQVNGQSG

SEQ ID NO: 330938 - protein, 9 aa, Influenza virus
PQVNGQFGR

SEQ ID NO: 330939 - protein, 9 aa, Influenza virus
QVNGQFGRI

SEQ ID NO: 330940 - protein, 9 aa, Influenza virus
VNGQFGRID

SEQ ID NO: 330941 - protein, 9 aa, Influenza virus
NGQFGRIDF

SEQ ID NO: 330942 - protein, 9 aa, Influenza virus
GQFGRIDFH

SEQ ID NO: 330943 - protein, 9 aa, Influenza virus
QFGRIDFHW

SEQ ID NO: 330944 - protein, 9 aa, Influenza virus
FGRIDFHWL

SEQ ID NO: 330945 - protein, 9 aa, Influenza virus
GRIDFHWLM

SEQ ID NO: 330946 - protein, 9 aa, Influenza virus
RIDFHWLML

SEQ ID NO: 330947 - protein, 9 aa, Influenza virus
NDTVTFSFN

SEQ ID NO: 330948 - protein, 9 aa, Influenza virus
DTVTFSFNG

SEQ ID NO: 330949 - protein, 9 aa, Influenza virus
TVTFSFNGA

SEQ ID NO: 330950 - protein, 9 aa, Influenza virus
VTFSFNGAF

SEQ ID NO: 330951 - protein, 9 aa, Influenza virus
TFSFNGAFI

SEQ ID NO: 330952 - protein, 9 aa, Influenza virus
FSFNGAFIA

SEQ ID NO: 330953 - protein, 9 aa, Influenza virus
SFNGAFIAP

SEQ ID NO: 330954 - protein, 9 aa, Influenza virus
FNGAFIAPN

SEQ ID NO: 330955 - protein, 9 aa, Influenza virus
NGAFIAPNR

SEQ ID NO: 330956 - protein, 9 aa, Influenza virus
GAFIAPNRA

SEQ ID NO: 330957 - protein, 9 aa, Influenza virus
AFIAPNRAS

SEQ ID NO: 330958 - protein, 9 aa, Influenza virus
FIAPNRASF

SEQ ID NO: 330959 - protein, 9 aa, Influenza virus
IAPDRASFL

SEQ ID NO: 330960 - protein, 9 aa, Influenza virus
APDRASFLR

SEQ ID NO: 330961 - protein, 9 aa, Influenza virus
PDRASFLRG

SEQ ID NO: 330962 - protein, 9 aa, Influenza virus
GGTIISNLP

SEQ ID NO: 330963 - protein, 9 aa, Influenza virus
GTIISNLPF

SEQ ID NO: 330964 - protein, 9 aa, Influenza virus
TIISNLPFQ

SEQ ID NO: 330965 - protein, 9 aa, Influenza virus
IISNLPFQN

SEQ ID NO: 330966 - protein, 9 aa, Influenza virus
ISNLPFQNI

SEQ ID NO: 330967 - protein, 9 aa, Influenza virus
SNLPFQNIN

SEQ ID NO: 330968 - protein, 9 aa, Influenza virus
SLPFQNINS

SEQ ID NO: 330969 - protein, 9 aa, Influenza virus
LPFQNINPR

SEQ ID NO: 330970 - protein, 9 aa, Influenza virus
TVGRCPRYV

SEQ ID NO: 330971 - protein, 9 aa, Influenza virus
VGRCPRYVK

SEQ ID NO: 330972 - protein, 9 aa, Influenza virus
GRCPRYVKQ

SEQ ID NO: 330973 - protein, 9 aa, Influenza virus
CPRYVKQTS

SEQ ID NO: 330974 - protein, 9 aa, Influenza virus
VKQTSLLLA

SEQ ID NO: 330975 - protein, 9 aa, Influenza virus
KQTSLLLAT

SEQ ID NO: 330976 - protein, 9 aa, Influenza virus
QTSLLLATG

SEQ ID NO: 330977 - protein, 9 aa, Influenza virus
TSLLLATGM

SEQ ID NO: 330978 - protein, 9 aa, Influenza virus
SLLLATGMK

SEQ ID NO: 330979 - protein, 9 aa, Influenza virus
LLLATGMKN

SEQ ID NO: 330980 - protein, 9 aa, Influenza virus
LLATGMKNV

SEQ ID NO: 330981 - protein, 9 aa, Influenza virus
LATGMKNVP

SEQ ID NO: 330982 - protein, 9 aa, Influenza virus
ATGMKNVPE

SEQ ID NO: 330983 - protein, 9 aa, Influenza virus
TGMRNVPEN

SEQ ID NO: 330984 - protein, 9 aa, Influenza virus
GMRNVPENP

SEQ ID NO: 330985 - protein, 9 aa, Influenza virus
MRNVPENPK

SEQ ID NO: 330986 - protein, 9 aa, Influenza virus
PKKRGLFGA

SEQ ID NO: 330987 - protein, 9 aa, Influenza virus
KKRGLFGAI

SEQ ID NO: 330988 - protein, 9 aa, Influenza virus
KRGLFGAIA

SEQ ID NO: 330989 - protein, 9 aa, Influenza virus
IENGWEGLV

SEQ ID NO: 330990 - protein, 9 aa, Influenza virus
ENGWEGLID

SEQ ID NO: 330991 - protein, 9 aa, Influenza virus
NGWEGLIDG

SEQ ID NO: 330992 - protein, 9 aa, Influenza virus
GWEGLIDGW

SEQ ID NO: 330993 - protein, 9 aa, Influenza virus
WEGLIDGWY

SEQ ID NO: 330994 - protein, 9 aa, Influenza virus
EGLIDGWYG

SEQ ID NO: 330995 - protein, 9 aa, Influenza virus
GLIDGWYGF

SEQ ID NO: 330996 - protein, 9 aa, Influenza virus
LIDGWYGFR

SEQ ID NO: 330997 - protein, 9 aa, Influenza virus
IDGWYGFRH

SEQ ID NO: 330998 - protein, 9 aa, Influenza virus
DGWYGFRHQ

SEQ ID NO: 330999 - protein, 9 aa, Influenza virus
WYGFRHQNT

SEQ ID NO: 331000 - protein, 9 aa, Influenza virus
YGFRHQNTQ

SEQ ID NO: 331001 - protein, 9 aa, Influenza virus
GFRHQNTQG

SEQ ID NO: 331002 - protein, 9 aa, Influenza virus
HQNTQGEGT

SEQ ID NO: 331003 - protein, 9 aa, Influenza virus
QNTQGEGTA

SEQ ID NO: 331004 - protein, 9 aa, Influenza virus
NTQGEGTAA

SEQ ID NO: 331005 - protein, 9 aa, Influenza virus
TQGEGTAAD

SEQ ID NO: 331006 - protein, 9 aa, Influenza virus
TGKLNRLID

SEQ ID NO: 331007 - protein, 9 aa, Influenza virus
GKLNRLIDK

SEQ ID NO: 331008 - protein, 9 aa, Influenza virus
KLNRLIDKT

SEQ ID NO: 331009 - protein, 9 aa, Influenza virus
LNRLIDKTN

SEQ ID NO: 331010 - protein, 9 aa, Influenza virus
NRLIDKTNQ

SEQ ID NO: 331011 - protein, 9 aa, Influenza virus
RLIDKTNQQ

SEQ ID NO: 331012 - protein, 9 aa, Influenza virus
LIDKTNQQF

SEQ ID NO: 331013 - protein, 9 aa, Influenza virus
IDKTNQQFE

SEQ ID NO: 331014 - protein, 9 aa, Influenza virus
DKTNQQFEL

SEQ ID NO: 331015 - protein, 9 aa, Influenza virus
RTNQQFELI

SEQ ID NO: 331016 - protein, 9 aa, Influenza virus
TNQQFELIN

SEQ ID NO: 331017 - protein, 9 aa, Influenza virus
NQQFELINN

SEQ ID NO: 331018 - protein, 9 aa, Influenza virus
QQFELINNE

SEQ ID NO: 331019 - protein, 9 aa, Influenza virus
QFELINNEF

SEQ ID NO: 331020 - protein, 9 aa, Influenza virus
FELINNEFN

SEQ ID NO: 331021 - protein, 9 aa, Influenza virus
ELINNEFNE

SEQ ID NO: 331022 - protein, 9 aa, Influenza virus
NEFNEVEQQ

SEQ ID NO: 331023 - protein, 9 aa, Influenza virus
EFNEVEQQI

SEQ ID NO: 331024 - protein, 9 aa, Influenza virus
FNEVEQQIG

SEQ ID NO: 331025 - protein, 9 aa, Influenza virus
NEVEQQIGN

SEQ ID NO: 331026 - protein, 9 aa, Influenza virus
EVEQQIGNV

SEQ ID NO: 331027 - protein, 9 aa, Influenza virus
VEQQIGNVI

SEQ ID NO: 331028 - protein, 9 aa, Influenza virus
EKQIGNVIN

SEQ ID NO: 331029 - protein, 9 aa, Influenza virus
KQIGNVINW

SEQ ID NO: 331030 - protein, 9 aa, Influenza virus
IGNVINWTQ

SEQ ID NO: 331031 - protein, 9 aa, Influenza virus
GNVINWTQD

SEQ ID NO: 331032 - protein, 9 aa, Influenza virus
NVINWTQDA

SEQ ID NO: 331033 - protein, 9 aa, Influenza virus
VINWTQDAM

SEQ ID NO: 331034 - protein, 9 aa, Influenza virus
INWTQDAMT

SEQ ID NO: 331035 - protein, 9 aa, Influenza virus
NWTQDAMTE

SEQ ID NO: 331036 - protein, 9 aa, Influenza virus
WTQDAMTEV

SEQ ID NO: 331037 - protein, 9 aa, Influenza virus
TQDAMTEVW

SEQ ID NO: 331038 - protein, 9 aa, Influenza virus
QDAMTEVWS

SEQ ID NO: 331039 - protein, 9 aa, Influenza virus
DAMTEVWSY

SEQ ID NO: 331040 - protein, 9 aa, Influenza virus
AMTEVWSYN

SEQ ID NO: 331041 - protein, 9 aa, Influenza virus
MTEVWSYNA

SEQ ID NO: 331042 - protein, 9 aa, Influenza virus
TEVWSYNAE

SEQ ID NO: 331043 - protein, 9 aa, Influenza virus
EVWSYNAEL

SEQ ID NO: 331044 - protein, 9 aa, Influenza virus
VWSYNAELL

SEQ ID NO: 331045 - protein, 9 aa, Influenza virus
YNAELLVAL

SEQ ID NO: 331046 - protein, 9 aa, Influenza virus
NAELLVALE

SEQ ID NO: 331047 - protein, 9 aa, Influenza virus
AELLVALEN

SEQ ID NO: 331048 - protein, 9 aa, Influenza virus
ELLVALENQ

SEQ ID NO: 331049 - protein, 9 aa, Influenza virus
LLVALENQH

SEQ ID NO: 331050 - protein, 9 aa, Influenza virus
LVALENQHT

SEQ ID NO: 331051 - protein, 9 aa, Influenza virus
VALENQHTI

SEQ ID NO: 331052 - protein, 9 aa, Influenza virus
ALENQHTID

SEQ ID NO: 331053 - protein, 9 aa, Influenza virus
LENQHTIDL

SEQ ID NO: 331054 - protein, 9 aa, Influenza virus
ENQHTIDLT

SEQ ID NO: 331055 - protein, 9 aa, Influenza virus
NQHTIDLTD

SEQ ID NO: 331056 - protein, 9 aa, Influenza virus
QHTIDLTDS

SEQ ID NO: 331057 - protein, 9 aa, Influenza virus
HTIDLTDSE

SEQ ID NO: 331058 - protein, 9 aa, Influenza virus
TIDLTDSEM

SEQ ID NO: 331059 - protein, 9 aa, Influenza virus
IDLADSEMN

SEQ ID NO: 331060 - protein, 9 aa, Influenza virus
DLADSEMNK

SEQ ID NO: 331061 - protein, 9 aa, Influenza virus
LADSEMNKL

SEQ ID NO: 331062 - protein, 9 aa, Influenza virus
ADSEMNKLY

SEQ ID NO: 331063 - protein, 9 aa, Influenza virus
DSEMNKLYE

SEQ ID NO: 331064 - protein, 9 aa, Influenza virus
SEMNKLYER

SEQ ID NO: 331065 - protein, 9 aa, Influenza virus
EMNKLYERV

SEQ ID NO: 331066 - protein, 9 aa, Influenza virus
MSKLYERVR

SEQ ID NO: 331067 - protein, 9 aa, Influenza virus
KLYERVRKQ

SEQ ID NO: 331068 - protein, 9 aa, Influenza virus
LYERVRKQL

SEQ ID NO: 331069 - protein, 9 aa, Influenza virus
YERVRKQLR

SEQ ID NO: 331070 - protein, 9 aa, Influenza virus
ERVRKQLRE

SEQ ID NO: 331071 - protein, 9 aa, Influenza virus
RVRKQLREN

SEQ ID NO: 331072 - protein, 9 aa, Influenza virus
VRKQLRENA

SEQ ID NO: 331073 - protein, 9 aa, Influenza virus
RKQLRENAE

SEQ ID NO: 331074 - protein, 9 aa, Influenza virus
RQLRENAEE

SEQ ID NO: 331075 - protein, 9 aa, Influenza virus
FEIFHKCDN

SEQ ID NO: 331076 - protein, 9 aa, Influenza virus
EIFHKCDDH

SEQ ID NO: 331077 - protein, 9 aa, Influenza virus
IFHKCDDHC

SEQ ID NO: 331078 - protein, 9 aa, Influenza virus
FHKCDDHCM

SEQ ID NO: 331079 - protein, 9 aa, Influenza virus
HKCDDHCME

SEQ ID NO: 331080 - protein, 9 aa, Influenza virus
KCDDHCMES

SEQ ID NO: 331081 - protein, 9 aa, Influenza virus
CDDHCMESI

SEQ ID NO: 331082 - protein, 9 aa, Influenza virus
DDHCMESIR

SEQ ID NO: 331083 - protein, 9 aa, Influenza virus
DHCMESIRN

SEQ ID NO: 331084 - protein, 9 aa, Influenza virus
HCMESIRNN

SEQ ID NO: 331085 - protein, 9 aa, Influenza virus
CMASIRNNT

SEQ ID NO: 331086 - protein, 9 aa, Influenza virus
MASIRNNTY

SEQ ID NO: 331087 - protein, 9 aa, Influenza virus
ASIRNNTYD

SEQ ID NO: 331088 - protein, 9 aa, Influenza virus
SIRNNTYNH

SEQ ID NO: 331089 - protein, 9 aa, Influenza virus
IRNNTYDHS

SEQ ID NO: 331090 - protein, 9 aa, Influenza virus
RNNTYDHSK

SEQ ID NO: 331091 - protein, 9 aa, Influenza virus
NNTYDHSKY

SEQ ID NO: 331092 - protein, 9 aa, Influenza virus
NTYDHSKYR

SEQ ID NO: 331093 - protein, 9 aa, Influenza virus
HSKYREEAM

SEQ ID NO: 331094 - protein, 9 aa, Influenza virus
KYREEAMQN

SEQ ID NO: 331095 - protein, 9 aa, Influenza virus
YREEAMQNR

SEQ ID NO: 331096 - protein, 9 aa, Influenza virus
REEAMQNRI

SEQ ID NO: 331097 - protein, 9 aa, Influenza virus
EEAMQNRIQ

SEQ ID NO: 331098 - protein, 9 aa, Influenza virus
EAMQNRIQI

SEQ ID NO: 331099 - protein, 9 aa, Influenza virus
AMQNRIQID

SEQ ID NO: 331100 - protein, 9 aa, Influenza virus
MQNRIQIDP

SEQ ID NO: 331101 - protein, 9 aa, Influenza virus
QNRIQIDSV

SEQ ID NO: 331102 - protein, 9 aa, Influenza virus
NRIQIDSVK

SEQ ID NO: 331103 - protein, 9 aa, Influenza virus
RIQIDSVKL

SEQ ID NO: 331104 - protein, 9 aa, Influenza virus
IQIDSVKLS

SEQ ID NO: 331105 - protein, 9 aa, Influenza virus
QIDSVKLSS

SEQ ID NO: 331106 - protein, 9 aa, Influenza virus
IDSVKLSSG

SEQ ID NO: 331107 - protein, 9 aa, Influenza virus
DSVKLSSGY

SEQ ID NO: 331108 - protein, 9 aa, Influenza virus
SVKLSSGYK

SEQ ID NO: 331109 - protein, 9 aa, Influenza virus
VKLSGGYKD

SEQ ID NO: 331110 - protein, 9 aa, Influenza virus
KLSSGYKDV

SEQ ID NO: 331111 - protein, 9 aa, Influenza virus
LSSGYKDVI

SEQ ID NO: 331112 - protein, 9 aa, Influenza virus
SSGYKDVIL

SEQ ID NO: 331113 - protein, 9 aa, Influenza virus
SGYKDVILW

SEQ ID NO: 331114 - protein, 9 aa, Influenza virus
GYKDVILWF

SEQ ID NO: 331115 - protein, 9 aa, Influenza virus
YKDVILWFS

SEQ ID NO: 331116 - protein, 9 aa, Influenza virus
KDVILWFSF

SEQ ID NO: 331117 - protein, 9 aa, Influenza virus
DVILWFSFG

SEQ ID NO: 331118 - protein, 9 aa, Influenza virus
VILWFSFGA

SEQ ID NO: 331119 - protein, 9 aa, Influenza virus
FSFGASCFI

SEQ ID NO: 331120 - protein, 9 aa, Influenza virus
SFGASCFIL

SEQ ID NO: 331121 - protein, 9 aa, Influenza virus
FGASCFILL

SEQ ID NO: 331122 - protein, 9 aa, Influenza virus
GASCFILLA

SEQ ID NO: 331123 - protein, 9 aa, Influenza virus
ASCFILLAI

SEQ ID NO: 331124 - protein, 9 aa, Influenza virus
SCFILLAIA

SEQ ID NO: 331125 - protein, 9 aa, Influenza virus
LLAIVMGLV

SEQ ID NO: 331126 - protein, 9 aa, Influenza virus
LAIVMGLVF

SEQ ID NO: 331127 - protein, 9 aa, Influenza virus
AIVMGLVFI

SEQ ID NO: 331128 - protein, 9 aa, Influenza virus
IVMGLVFIC

SEQ ID NO: 331129 - protein, 9 aa, Influenza virus
VMGLVFICI

SEQ ID NO: 331130 - protein, 9 aa, Influenza virus
MGLVFMCVK

SEQ ID NO: 331131 - protein, 9 aa, Influenza virus
GLVFMCVKN

SEQ ID NO: 331132 - protein, 9 aa, Influenza virus
LVFMCVKNG

SEQ ID NO: 331133 - protein, 9 aa, Influenza virus
VFMCVKNGN

SEQ ID NO: 331134 - protein, 9 aa, Influenza virus
FMCVKNGNM

SEQ ID NO: 331135 - protein, 9 aa, Influenza virus
ICIKNGNMR

SEQ ID NO: 331136 - protein, 9 aa, Influenza virus
CIKNGNMRC

SEQ ID NO: 331137 - protein, 9 aa, Influenza virus
IKNGNMRCT

SEQ ID NO: 331138 - protein, 9 aa, Influenza virus
KNGNMRCTI

SEQ ID NO: 331139 - protein, 9 aa, Influenza virus
NGNMRCTIC

SEQ ID NO: 331140 - protein, 9 aa, Influenza virus
GNMRCTICI

SEQ ID NO: 331141 - protein, 9 aa, Influenza virus
QKIITIGSI

SEQ ID NO: 331142 - protein, 9 aa, Influenza virus
KIITIGSIS

SEQ ID NO: 331143 - protein, 9 aa, Influenza virus
ITIGSVSLI

SEQ ID NO: 331144 - protein, 9 aa, Influenza virus
TIGSVSLII

SEQ ID NO: 331145 - protein, 9 aa, Influenza virus
IGSVSLTIT

SEQ ID NO: 331146 - protein, 9 aa, Influenza virus
GSVSLTITT

SEQ ID NO: 331147 - protein, 9 aa, Influenza virus
CFLMQIAVL

SEQ ID NO: 331148 - protein, 9 aa, Influenza virus
KRNITEIVY

SEQ ID NO: 331149 - protein, 9 aa, Influenza virus
KNITEIVYL

SEQ ID NO: 331150 - protein, 9 aa, Influenza virus
NITKIVYLN

SEQ ID NO: 331151 - protein, 9 aa, Influenza virus
ITEIVYLNH

SEQ ID NO: 331152 - protein, 9 aa, Influenza virus
TETLYLNHT

SEQ ID NO: 331153 - protein, 9 aa, Influenza virus
YRNWSKPQC

SEQ ID NO: 331154 - protein, 9 aa, Influenza virus
RNWSKPQCQ

SEQ ID NO: 331155 - protein, 9 aa, Influenza virus
NWSKPQCQI

SEQ ID NO: 331156 - protein, 9 aa, Influenza virus
WSKPQCQIS

SEQ ID NO: 331157 - protein, 9 aa, Influenza virus
SKPQCQISG

SEQ ID NO: 331158 - protein, 9 aa, Influenza virus
QCQISGFAP

SEQ ID NO: 331159 - protein, 9 aa, Influenza virus
GFAPFAKDN

SEQ ID NO: 331160 - protein, 9 aa, Influenza virus
FAPFAKDNS

SEQ ID NO: 331161 - protein, 9 aa, Influenza virus
APFAKDNSI

SEQ ID NO: 331162 - protein, 9 aa, Influenza virus
PFAKDNSIR

SEQ ID NO: 331163 - protein, 9 aa, Influenza virus
FAKDNSIRL

SEQ ID NO: 331164 - protein, 9 aa, Influenza virus
AKDNSIRLS

SEQ ID NO: 331165 - protein, 9 aa, Influenza virus
KDNSVRLSA

SEQ ID NO: 331166 - protein, 9 aa, Influenza virus
DNSVRLSAS

SEQ ID NO: 331167 - protein, 9 aa, Influenza virus
NSVRLSASG

SEQ ID NO: 331168 - protein, 9 aa, Influenza virus
SIRLSAGGH

SEQ ID NO: 331169 - protein, 9 aa, Influenza virus
IRLSAGGHI

SEQ ID NO: 331170 - protein, 9 aa, Influenza virus
RLSAGGHIW

SEQ ID NO: 331171 - protein, 9 aa, Influenza virus
LSAGGHIWV

SEQ ID NO: 331172 - protein, 9 aa, Influenza virus
SAGGHIWVT

SEQ ID NO: 331173 - protein, 9 aa, Influenza virus
AGGHIWVTR

SEQ ID NO: 331174 - protein, 9 aa, Influenza virus
GGHIWVTRE

SEQ ID NO: 331175 - protein, 9 aa, Influenza virus
GHIWVTREP

SEQ ID NO: 331176 - protein, 9 aa, Influenza virus
HIWVTREPY

SEQ ID NO: 331177 - protein, 9 aa, Influenza virus
IWVTREPYV

SEQ ID NO: 331178 - protein, 9 aa, Influenza virus
WVTREPYVS

SEQ ID NO: 331179 - protein, 9 aa, Influenza virus
VTREPYVSC

SEQ ID NO: 331180 - protein, 9 aa, Influenza virus
TREPYVSCS

SEQ ID NO: 331181 - protein, 9 aa, Influenza virus
REPYVSCGP

SEQ ID NO: 331182 - protein, 9 aa, Influenza virus
NKCYQFALG

SEQ ID NO: 331183 - protein, 9 aa, Influenza virus
RCYQFALGQ

SEQ ID NO: 331184 - protein, 9 aa, Influenza virus
ALGQGTTLY

SEQ ID NO: 331185 - protein, 9 aa, Influenza virus
LGQGTTLYN

SEQ ID NO: 331186 - protein, 9 aa, Influenza virus
GQGTTLDNE

SEQ ID NO: 331187 - protein, 9 aa, Influenza virus
QGTTLDNEH

SEQ ID NO: 331188 - protein, 9 aa, Influenza virus
GTTLDNEHS

SEQ ID NO: 331189 - protein, 9 aa, Influenza virus
TTLDNEHSN

SEQ ID NO: 331190 - protein, 9 aa, Influenza virus
TLDNEHSNG

SEQ ID NO: 331191 - protein, 9 aa, Influenza virus
LDNEHSNGT

SEQ ID NO: 331192 - protein, 9 aa, Influenza virus
NEHSNGTIH

SEQ ID NO: 331193 - protein, 9 aa, Influenza virus
EHSNGTIHD

SEQ ID NO: 331194 - protein, 9 aa, Influenza virus
HSNGTTHDR

SEQ ID NO: 331195 - protein, 9 aa, Influenza virus
SNGTIHDRT

SEQ ID NO: 331196 - protein, 9 aa, Influenza virus
HDRTPHRTL

SEQ ID NO: 331197 - protein, 9 aa, Influenza virus
DRTPHRTLL

SEQ ID NO: 331198 - protein, 9 aa, Influenza virus
RTPHRTLLM

SEQ ID NO: 331199 - protein, 9 aa, Influenza virus
TPHRTLLMN

SEQ ID NO: 331200 - protein, 9 aa, Influenza virus
SHRTLLMNE

SEQ ID NO: 331201 - protein, 9 aa, Influenza virus
GVPFHLGTR

SEQ ID NO: 331202 - protein, 9 aa, Influenza virus
VPFHLGTRQ

SEQ ID NO: 331203 - protein, 9 aa, Influenza virus
PFHLGTRQV

SEQ ID NO: 331204 - protein, 9 aa, Influenza virus
FHLGTRQVC

SEQ ID NO: 331205 - protein, 9 aa, Influenza virus
HLGTRQVCI

SEQ ID NO: 331206 - protein, 9 aa, Influenza virus
LGTRQVCIA

SEQ ID NO: 331207 - protein, 9 aa, Influenza virus
GTRQVCIAW

SEQ ID NO: 331208 - protein, 9 aa, Influenza virus
TRQVCIAWS

SEQ ID NO: 331209 - protein, 9 aa, Influenza virus
RQVCIAWSS

SEQ ID NO: 331210 - protein, 9 aa, Influenza virus
QVCMAWSSS

SEQ ID NO: 331211 - protein, 9 aa, Influenza virus
VCMAWSSSS

SEQ ID NO: 331212 - protein, 9 aa, Influenza virus
CMAWSSSSC

SEQ ID NO: 331213 - protein, 9 aa, Influenza virus
MAWSSSSCH

SEQ ID NO: 331214 - protein, 9 aa, Influenza virus
HDGKAWLHI

SEQ ID NO: 331215 - protein, 9 aa, Influenza virus
DGKAWLHIC

SEQ ID NO: 331216 - protein, 9 aa, Influenza virus
GKAWLHVCI

SEQ ID NO: 331217 - protein, 9 aa, Influenza virus
KAWLHVCIT

SEQ ID NO: 331218 - protein, 9 aa, Influenza virus
AWLHICVTG

SEQ ID NO: 331219 - protein, 9 aa, Influenza virus
WLHICVTGD

SEQ ID NO: 331220 - protein, 9 aa, Influenza virus
LHICVTGDD

SEQ ID NO: 331221 - protein, 9 aa, Influenza virus
HVCITGDDR

SEQ ID NO: 331222 - protein, 9 aa, Influenza virus
VCVTGDDKN

SEQ ID NO: 331223 - protein, 9 aa, Influenza virus
CITGDDRNA

SEQ ID NO: 331224 - protein, 9 aa, Influenza virus
ITGDDRNAT

SEQ ID NO: 331225 - protein, 9 aa, Influenza virus
TGDDKNATA

SEQ ID NO: 331226 - protein, 9 aa, Influenza virus
GDDKNATAS

SEQ ID NO: 331227 - protein, 9 aa, Influenza virus
DDKNATASF

SEQ ID NO: 331228 - protein, 9 aa, Influenza virus
DKNATASFI

SEQ ID NO: 331229 - protein, 9 aa, Influenza virus
KNATASFIY

SEQ ID NO: 331230 - protein, 9 aa, Influenza virus
NATASFIYD

SEQ ID NO: 331231 - protein, 9 aa, Influenza virus
ATASFIYDG

SEQ ID NO: 331232 - protein, 9 aa, Influenza virus
LVDSIVSWS

SEQ ID NO: 331233 - protein, 9 aa, Influenza virus
VDSIVSWSQ

SEQ ID NO: 331234 - protein, 9 aa, Influenza virus
DSIVSWSQN

SEQ ID NO: 331235 - protein, 9 aa, Influenza virus
SIVSWSQNI

SEQ ID NO: 331236 - protein, 9 aa, Influenza virus
IVSWSQNIL

SEQ ID NO: 331237 - protein, 9 aa, Influenza virus
VSWSQNILR

SEQ ID NO: 331238 - protein, 9 aa, Influenza virus
SECVCINGT

SEQ ID NO: 331239 - protein, 9 aa, Influenza virus
ECVCINGTC

SEQ ID NO: 331240 - protein, 9 aa, Influenza virus
CVCINGTCT

SEQ ID NO: 331241 - protein, 9 aa, Influenza virus
VCINGTCTV

SEQ ID NO: 331242 - protein, 9 aa, Influenza virus
CINGTCTVV

SEQ ID NO: 331243 - protein, 9 aa, Influenza virus
INGTCTVVM

SEQ ID NO: 331244 - protein, 9 aa, Influenza virus
NGTCTVVMT

SEQ ID NO: 331245 - protein, 9 aa, Influenza virus
GTCTVVMTD

SEQ ID NO: 331246 - protein, 9 aa, Influenza virus
TCTVVMTDG

SEQ ID NO: 331247 - protein, 9 aa, Influenza virus
CTVVMTDGN

SEQ ID NO: 331248 - protein, 9 aa, Influenza virus
TVVMTDGNA

SEQ ID NO: 331249 - protein, 9 aa, Influenza virus
VVMTDGNAS

SEQ ID NO: 331250 - protein, 9 aa, Influenza virus
VMTDGNASG

SEQ ID NO: 331251 - protein, 9 aa, Influenza virus
MTDGNASGK

SEQ ID NO: 331252 - protein, 9 aa, Influenza virus
TDGNASGKA

SEQ ID NO: 331253 - protein, 9 aa, Influenza virus
DGNASGKAD

SEQ ID NO: 331254 - protein, 9 aa, Influenza virus
GNASGKADT

SEQ ID NO: 331255 - protein, 9 aa, Influenza virus
ASGKAETRI

SEQ ID NO: 331256 - protein, 9 aa, Influenza virus
EGKIIHISP

SEQ ID NO: 331257 - protein, 9 aa, Influenza virus
GKIIHISPL

SEQ ID NO: 331258 - protein, 9 aa, Influenza virus
KIIHISPLS

SEQ ID NO: 331259 - protein, 9 aa, Influenza virus
IIHISPLSG

SEQ ID NO: 331260 - protein, 9 aa, Influenza virus
IHISPLSGS

SEQ ID NO: 331261 - protein, 9 aa, Influenza virus
IEECSCYPQ

SEQ ID NO: 331262 - protein, 9 aa, Influenza virus
EECSCYPQY

SEQ ID NO: 331263 - protein, 9 aa, Influenza virus
ECSCYPQYP

SEQ ID NO: 331264 - protein, 9 aa, Influenza virus
CSCYPQYPN

SEQ ID NO: 331265 - protein, 9 aa, Influenza virus
SCYPQYPNV

SEQ ID NO: 331266 - protein, 9 aa, Influenza virus
CYPQYPNVR

SEQ ID NO: 331267 - protein, 9 aa, Influenza virus
YPQYPNVRC

SEQ ID NO: 331268 - protein, 9 aa, Influenza virus
PQYPNVRCV

SEQ ID NO: 331269 - protein, 9 aa, Influenza virus
QYPNVRCVC

SEQ ID NO: 331270 - protein, 9 aa, Influenza virus
YPDVRCVCR

SEQ ID NO: 331271 - protein, 9 aa, Influenza virus
PDVRCVCRD

SEQ ID NO: 331272 - protein, 9 aa, Influenza virus
DVRCVCRDN

SEQ ID NO: 331273 - protein, 9 aa, Influenza virus
NWKGSNRPI

SEQ ID NO: 331274 - protein, 9 aa, Influenza virus
WKGSNRPII

SEQ ID NO: 331275 - protein, 9 aa, Influenza virus
KGSNRPIID

SEQ ID NO: 331276 - protein, 9 aa, Influenza virus
GSNRPVIDV

SEQ ID NO: 331277 - protein, 9 aa, Influenza virus
SNRPVIDVN

SEQ ID NO: 331278 - protein, 9 aa, Influenza virus
NRPVIDVNM

SEQ ID NO: 331279 - protein, 9 aa, Influenza virus
INSSYVCSG

SEQ ID NO: 331280 - protein, 9 aa, Influenza virus
NSSYVCSGL

SEQ ID NO: 331281 - protein, 9 aa, Influenza virus
SSYLCSGLV

SEQ ID NO: 331282 - protein, 9 aa, Influenza virus
SYLCSGLVG

SEQ ID NO: 331283 - protein, 9 aa, Influenza virus
LVGDTPRND

SEQ ID NO: 331284 - protein, 9 aa, Influenza virus
VGDTPRNDD

SEQ ID NO: 331285 - protein, 9 aa, Influenza virus
GDTPRNEDS

SEQ ID NO: 331286 - protein, 9 aa, Influenza virus
DTPRNEDSS

SEQ ID NO: 331287 - protein, 9 aa, Influenza virus
TPRNEDSSS

SEQ ID NO: 331288 - protein, 9 aa, Influenza virus
PRNEDSSSS

SEQ ID NO: 331289 - protein, 9 aa, Influenza virus
RNEDSSSSS

SEQ ID NO: 331290 - protein, 9 aa, Influenza virus
NEDSSSSSN

SEQ ID NO: 331291 - protein, 9 aa, Influenza virus
EDSSSSSNC

SEQ ID NO: 331292 - protein, 9 aa, Influenza virus
SSSNCKDPN

SEQ ID NO: 331293 - protein, 9 aa, Influenza virus
SNCRDPNNE

SEQ ID NO: 331294 - protein, 9 aa, Influenza virus
DPNDERGNP

SEQ ID NO: 331295 - protein, 9 aa, Influenza virus
PNDERGNPG

SEQ ID NO: 331296 - protein, 9 aa, Influenza virus
NDERGNPGV

SEQ ID NO: 331297 - protein, 9 aa, Influenza virus
DERGNPGVK

SEQ ID NO: 331298 - protein, 9 aa, Influenza virus
EKGNPGVKG

SEQ ID NO: 331299 - protein, 9 aa, Influenza virus
KGNPGVKGW

SEQ ID NO: 331300 - protein, 9 aa, Influenza virus
GSPGVKGWA

SEQ ID NO: 331301 - protein, 9 aa, Influenza virus
SPGVKGWAF

SEQ ID NO: 331302 - protein, 9 aa, Influenza virus
GVKGWAFDN

SEQ ID NO: 331303 - protein, 9 aa, Influenza virus
VKGWAFDNG

SEQ ID NO: 331304 - protein, 9 aa, Influenza virus
KGWAFDNGD

SEQ ID NO: 331305 - protein, 9 aa, Influenza virus
GWAFDNGDD

SEQ ID NO: 331306 - protein, 9 aa, Influenza virus
NGDDVWMGR

SEQ ID NO: 331307 - protein, 9 aa, Influenza virus
GNDVWMGRT

SEQ ID NO: 331308 - protein, 9 aa, Influenza virus
NDVWMGRTI

SEQ ID NO: 331309 - protein, 9 aa, Influenza virus
VWMGRTISK

SEQ ID NO: 331310 - protein, 9 aa, Influenza virus
WMGRTISKD

SEQ ID NO: 331311 - protein, 9 aa, Influenza virus
MGRTISKDS

SEQ ID NO: 331312 - protein, 9 aa, Influenza virus
GRTISKDSR

SEQ ID NO: 331313 - protein, 9 aa, Influenza virus
RTISKDSRS

SEQ ID NO: 331314 - protein, 9 aa, Influenza virus
TISKDSRSG

SEQ ID NO: 331315 - protein, 9 aa, Influenza virus
ISKDSRSGY

SEQ ID NO: 331316 - protein, 9 aa, Influenza virus
SKDSRSGYE

SEQ ID NO: 331317 - protein, 9 aa, Influenza virus
KDSRSGYET

SEQ ID NO: 331318 - protein, 9 aa, Influenza virus
SRSGYETFK

SEQ ID NO: 331319 - protein, 9 aa, Influenza virus
RSGYETFKV

SEQ ID NO: 331320 - protein, 9 aa, Influenza virus
SGYETFKVI

SEQ ID NO: 331321 - protein, 9 aa, Influenza virus
GYETFRVIS

SEQ ID NO: 331322 - protein, 9 aa, Influenza virus
YETFRVISG

SEQ ID NO: 331323 - protein, 9 aa, Influenza virus
ETFRVISGW

SEQ ID NO: 331324 - protein, 9 aa, Influenza virus
TFRVIGGWA

SEQ ID NO: 331325 - protein, 9 aa, Influenza virus
VIGGWATAN

SEQ ID NO: 331326 - protein, 9 aa, Influenza virus
IGGWATANS

SEQ ID NO: 331327 - protein, 9 aa, Influenza virus
GGWATANSK

SEQ ID NO: 331328 - protein, 9 aa, Influenza virus
GWATANSKS

SEQ ID NO: 331329 - protein, 9 aa, Influenza virus
WATANSKSQ

SEQ ID NO: 331330 - protein, 9 aa, Influenza virus
RQVIVDNSN

SEQ ID NO: 331331 - protein, 9 aa, Influenza virus
QVIVDNSNW

SEQ ID NO: 331332 - protein, 9 aa, Influenza virus
IVDNNNWFG

SEQ ID NO: 331333 - protein, 9 aa, Influenza virus
VDNSNWSGY

SEQ ID NO: 331334 - protein, 9 aa, Influenza virus
DNNNWFGYF

SEQ ID NO: 331335 - protein, 9 aa, Influenza virus
NNNWFGYFG

SEQ ID NO: 331336 - protein, 9 aa, Influenza virus
SNWSGYSGI

SEQ ID NO: 331337 - protein, 9 aa, Influenza virus
NWFGYFGIF

SEQ ID NO: 331338 - protein, 9 aa, Influenza virus
WFGYFGIFF

SEQ ID NO: 331339 - protein, 9 aa, Influenza virus
FGYFGIFFV

SEQ ID NO: 331340 - protein, 9 aa, Influenza virus
GYFGIFFVE

SEQ ID NO: 331341 - protein, 9 aa, Influenza virus
KSCVNRCFY

SEQ ID NO: 331342 - protein, 9 aa, Influenza virus
SCVNRCFYV

SEQ ID NO: 331343 - protein, 9 aa, Influenza virus
CVNRCFYVE

SEQ ID NO: 331344 - protein, 9 aa, Influenza virus
VNRCFYVEL

SEQ ID NO: 331345 - protein, 9 aa, Influenza virus
FYVELIRGM

SEQ ID NO: 331346 - protein, 9 aa, Influenza virus
YVELIRGMP

SEQ ID NO: 331347 - protein, 9 aa, Influenza virus
VELIRGRPQ

SEQ ID NO: 331348 - protein, 9 aa, Influenza virus
ELIRGRPQE

SEQ ID NO: 331349 - protein, 9 aa, Influenza virus
LIRGRPQET

SEQ ID NO: 331350 - protein, 9 aa, Influenza virus
PQETRVWWT

SEQ ID NO: 331351 - protein, 9 aa, Influenza virus
QETRVWWTS

SEQ ID NO: 331352 - protein, 9 aa, Influenza virus
ENRVWWTSN

SEQ ID NO: 331353 - protein, 9 aa, Influenza virus
NRVWWTSNS

SEQ ID NO: 331354 - protein, 9 aa, Influenza virus
GVWWTSNSI

SEQ ID NO: 331355 - protein, 9 aa, Influenza virus
VWWTSNSII

SEQ ID NO: 331356 - protein, 9 aa, Influenza virus
WWTSNSIIV

SEQ ID NO: 331357 - protein, 9 aa, Influenza virus
WTSNSIIVF

SEQ ID NO: 331358 - protein, 9 aa, Influenza virus
TSNSIIVFC

SEQ ID NO: 331359 - protein, 9 aa, Influenza virus
SNSIIVFCG

SEQ ID NO: 331360 - protein, 9 aa, Influenza virus
NSIIVFCGT

SEQ ID NO: 331361 - protein, 9 aa, Influenza virus
SIIVFCGTS

SEQ ID NO: 331362 - protein, 9 aa, Influenza virus
IIVFCGTSG

SEQ ID NO: 331363 - protein, 9 aa, Influenza virus
IVFCGTSGT

SEQ ID NO: 331364 - protein, 9 aa, Influenza virus
VFCGTSGNY

SEQ ID NO: 331365 - protein, 9 aa, Influenza virus
SWPDGANIS

SEQ ID NO: 331366 - protein, 9 aa, Influenza virus
WPDGANISF

SEQ ID NO: 331367 - protein, 9 aa, Influenza virus
PDGANISFM

SEQ ID NO: 331368 - protein, 9 aa, Influenza virus
DGANISFMP

SEQ ID NO: 331369 - protein, 9 aa, Influenza virus
KSRGYKMNN

SEQ ID NO: 331370 - protein, 9 aa, Influenza virus
SRGYKMNTQ

SEQ ID NO: 331371 - protein, 9 aa, Influenza virus
RGYKMNNQI

SEQ ID NO: 331372 - protein, 9 aa, Influenza virus
GYKMNNQIL

SEQ ID NO: 331373 - protein, 9 aa, Influenza virus
YKMNNQILI

SEQ ID NO: 331374 - protein, 9 aa, Influenza virus
KMNTRILIL

SEQ ID NO: 331375 - protein, 9 aa, Influenza virus
ADKICLGHH

SEQ ID NO: 331376 - protein, 9 aa, Influenza virus
ICLGHHAVS

SEQ ID NO: 331377 - protein, 9 aa, Influenza virus
CLGHHAVSN

SEQ ID NO: 331378 - protein, 9 aa, Influenza virus
LGHHAVSNG

SEQ ID NO: 331379 - protein, 9 aa, Influenza virus
GHHAVSNGT

SEQ ID NO: 331380 - protein, 9 aa, Influenza virus
HHAVSNGTK

SEQ ID NO: 331381 - protein, 9 aa, Influenza virus
HAVSNGTKV

SEQ ID NO: 331382 - protein, 9 aa, Influenza virus
NGTRVNTLT

SEQ ID NO: 331383 - protein, 9 aa, Influenza virus
GTRVNTLTE

SEQ ID NO: 331384 - protein, 9 aa, Influenza virus
VNTLTERGV

SEQ ID NO: 331385 - protein, 9 aa, Influenza virus
NTLTERGVE

SEQ ID NO: 331386 - protein, 9 aa, Influenza virus
TLTERGVEV

SEQ ID NO: 331387 - protein, 9 aa, Influenza virus
LTERGVEVV

SEQ ID NO: 331388 - protein, 9 aa, Influenza virus
TERGVEVVN

SEQ ID NO: 331389 - protein, 9 aa, Influenza virus
ERGVEVVNA

SEQ ID NO: 331390 - protein, 9 aa, Influenza virus
RGVEVVNAT

SEQ ID NO: 331391 - protein, 9 aa, Influenza virus
GVEVVNATE

SEQ ID NO: 331392 - protein, 9 aa, Influenza virus
VEVVNATET

SEQ ID NO: 331393 - protein, 9 aa, Influenza virus
EVVDATETV

SEQ ID NO: 331394 - protein, 9 aa, Influenza virus
VVDATETVE

SEQ ID NO: 331395 - protein, 9 aa, Influenza virus
VNATETVER

SEQ ID NO: 331396 - protein, 9 aa, Influenza virus
VDLGQCGLL

SEQ ID NO: 331397 - protein, 9 aa, Influenza virus
DLGQCGILG

SEQ ID NO: 331398 - protein, 9 aa, Influenza virus
LGQCGILGI

SEQ ID NO: 331399 - protein, 9 aa, Influenza virus
GQCGLLGTI

SEQ ID NO: 331400 - protein, 9 aa, Influenza virus
CGLLGTITG

SEQ ID NO: 331401 - protein, 9 aa, Influenza virus
GLLGTITGP

SEQ ID NO: 331402 - protein, 9 aa, Influenza virus
LLGTITGPP

SEQ ID NO: 331403 - protein, 9 aa, Influenza virus
LGTITGPPQ

SEQ ID NO: 331404 - protein, 9 aa, Influenza virus
GTITGPPQC

SEQ ID NO: 331405 - protein, 9 aa, Influenza virus
TITGPPQCD

SEQ ID NO: 331406 - protein, 9 aa, Influenza virus
TGPPQCDQF

SEQ ID NO: 331407 - protein, 9 aa, Influenza virus
GPPQCDLFL

SEQ ID NO: 331408 - protein, 9 aa, Influenza virus
PPQCDLFLE

SEQ ID NO: 331409 - protein, 9 aa, Influenza virus
PQCDLFLEF

SEQ ID NO: 331410 - protein, 9 aa, Influenza virus
NLIIERREG

SEQ ID NO: 331411 - protein, 9 aa, Influenza virus
DVCYPGKFV

SEQ ID NO: 331412 - protein, 9 aa, Influenza virus
VCYPGKFVN

SEQ ID NO: 331413 - protein, 9 aa, Influenza virus
LRQILRESG

SEQ ID NO: 331414 - protein, 9 aa, Influenza virus
RQILRESGG

SEQ ID NO: 331415 - protein, 9 aa, Influenza virus
QILRESGGI

SEQ ID NO: 331416 - protein, 9 aa, Influenza virus
GFTYSGIMT

SEQ ID NO: 331417 - protein, 9 aa, Influenza virus
ESSFYAEMK

SEQ ID NO: 331418 - protein, 9 aa, Influenza virus
PSFYAEMKW

SEQ ID NO: 331419 - protein, 9 aa, Influenza virus
EMKWLLSNT

SEQ ID NO: 331420 - protein, 9 aa, Influenza virus
MKWLLSNTD

SEQ ID NO: 331421 - protein, 9 aa, Influenza virus
KWLLSNTDN

SEQ ID NO: 331422 - protein, 9 aa, Influenza virus
PALIIWGIH

SEQ ID NO: 331423 - protein, 9 aa, Influenza virus
ALIIWGIHH

SEQ ID NO: 331424 - protein, 9 aa, Influenza virus
LIIWGIHHS

SEQ ID NO: 331425 - protein, 9 aa, Influenza virus
EQTRLYGSG

SEQ ID NO: 331426 - protein, 9 aa, Influenza virus
RLYGSGNKL

SEQ ID NO: 331427 - protein, 9 aa, Influenza virus
LYGSGAKLI

SEQ ID NO: 331428 - protein, 9 aa, Influenza virus
YGSGAKLIT

SEQ ID NO: 331429 - protein, 9 aa, Influenza virus
GSGAKLITV

SEQ ID NO: 331430 - protein, 9 aa, Influenza virus
SSNYQQSFV

SEQ ID NO: 331431 - protein, 9 aa, Influenza virus
SNYQQSFVP

SEQ ID NO: 331432 - protein, 9 aa, Influenza virus
NYQQSFVPS

SEQ ID NO: 331433 - protein, 9 aa, Influenza virus
YQQSFVPSP

SEQ ID NO: 331434 - protein, 9 aa, Influenza virus
QQSFVPSPG

SEQ ID NO: 331435 - protein, 9 aa, Influenza virus
QSFVPSPGA

SEQ ID NO: 331436 - protein, 9 aa, Influenza virus
SFVPSPGAR

SEQ ID NO: 331437 - protein, 9 aa, Influenza virus
QVNGQFGRI

SEQ ID NO: 331438 - protein, 9 aa, Influenza virus
VNGQFGRIN

SEQ ID NO: 331439 - protein, 9 aa, Influenza virus
NGQFGRINF

SEQ ID NO: 331440 - protein, 9 aa, Influenza virus
GQFGRINFH

SEQ ID NO: 331441 - protein, 9 aa, Influenza virus
QFGRINFHW

SEQ ID NO: 331442 - protein, 9 aa, Influenza virus
FGRINFHWL

SEQ ID NO: 331443 - protein, 9 aa, Influenza virus
FHWLMLNPN

SEQ ID NO: 331444 - protein, 9 aa, Influenza virus
WLMLNPNDT

SEQ ID NO: 331445 - protein, 9 aa, Influenza virus
MLNPNDTVT

SEQ ID NO: 331446 - protein, 9 aa, Influenza virus
LNPNDTVTF

SEQ ID NO: 331447 - protein, 9 aa, Influenza virus
NDTVTFSFN

SEQ ID NO: 331448 - protein, 9 aa, Influenza virus
DTVTFSFNG

SEQ ID NO: 331449 - protein, 9 aa, Influenza virus
FSFNGAFIA

SEQ ID NO: 331450 - protein, 9 aa, Influenza virus
SFNGAFIAP

SEQ ID NO: 331451 - protein, 9 aa, Influenza virus
FNGAFVAPD

SEQ ID NO: 331452 - protein, 9 aa, Influenza virus
NGAFVAPDR

SEQ ID NO: 331453 - protein, 9 aa, Influenza virus
GAFIAPDRV

SEQ ID NO: 331454 - protein, 9 aa, Influenza virus
AFIAPDRVS

SEQ ID NO: 331455 - protein, 9 aa, Influenza virus
FIAPDRVSF

SEQ ID NO: 331456 - protein, 9 aa, Influenza virus
IAPDRASFL

SEQ ID NO: 331457 - protein, 9 aa, Influenza virus
GGTIISNLP

SEQ ID NO: 331458 - protein, 9 aa, Influenza virus
GTIISNLPF

SEQ ID NO: 331459 - protein, 9 aa, Influenza virus
TIISNLPFQ

SEQ ID NO: 331460 - protein, 9 aa, Influenza virus
IISNLPFQN

SEQ ID NO: 331461 - protein, 9 aa, Influenza virus
ISNLPFQNI

SEQ ID NO: 331462 - protein, 9 aa, Influenza virus
SNLPFQNIN

SEQ ID NO: 331463 - protein, 9 aa, Influenza virus
NLPFQNINS

SEQ ID NO: 331464 - protein, 9 aa, Influenza virus
LPFQNINSR

SEQ ID NO: 331465 - protein, 9 aa, Influenza virus
PFQNINSRA

SEQ ID NO: 331466 - protein, 9 aa, Influenza virus
IGKCPRYVK

SEQ ID NO: 331467 - protein, 9 aa, Influenza virus
GRCPRYVKQ

SEQ ID NO: 331468 - protein, 9 aa, Influenza virus
SLLLATGMK

SEQ ID NO: 331469 - protein, 9 aa, Influenza virus
LLLATGMKN

SEQ ID NO: 331470 - protein, 9 aa, Influenza virus
LLATGMKNV

SEQ ID NO: 331471 - protein, 9 aa, Influenza virus
LATGMKNVP

SEQ ID NO: 331472 - protein, 9 aa, Influenza virus
ATGMKNVPE

SEQ ID NO: 331473 - protein, 9 aa, Influenza virus
TGMKNVPEI

SEQ ID NO: 331474 - protein, 9 aa, Influenza virus
GMKNVPEIP

SEQ ID NO: 331475 - protein, 9 aa, Influenza virus
MKNVPEIPK

SEQ ID NO: 331476 - protein, 9 aa, Influenza virus
CSPLSRCRK

SEQ ID NO: 331477 - protein, 9 aa, Influenza virus
SPLSRCRET

SEQ ID NO: 331478 - protein, 9 aa, Influenza virus
AYRKRMTRG

SEQ ID NO: 331479 - protein, 9 aa, Influenza virus
SRCRKTRGL

SEQ ID NO: 331480 - protein, 9 aa, Influenza virus
RKRMTRGLF

SEQ ID NO: 331481 - protein, 9 aa, Influenza virus
KRMTRGLFG

SEQ ID NO: 331482 - protein, 9 aa, Influenza virus
RMTRGLFGA

SEQ ID NO: 331483 - protein, 9 aa, Influenza virus
ETRGLFGAI

SEQ ID NO: 331484 - protein, 9 aa, Influenza virus
ARGLFGAIA

SEQ ID NO: 331485 - protein, 9 aa, Influenza virus
IENGWEGLV

SEQ ID NO: 331486 - protein, 9 aa, Influenza virus
ENGWEGLVD

SEQ ID NO: 331487 - protein, 9 aa, Influenza virus
NGWEGLVDG

SEQ ID NO: 331488 - protein, 9 aa, Influenza virus
GWEGLVDGW

SEQ ID NO: 331489 - protein, 9 aa, Influenza virus
WEGLVDGWY

SEQ ID NO: 331490 - protein, 9 aa, Influenza virus
EGLVDGWYG

SEQ ID NO: 331491 - protein, 9 aa, Influenza virus
GLVDGWYGF

SEQ ID NO: 331492 - protein, 9 aa, Influenza virus
LVDGWYGFR

SEQ ID NO: 331493 - protein, 9 aa, Influenza virus
VDGWYGFRH

SEQ ID NO: 331494 - protein, 9 aa, Influenza virus
NGWYGFRHQ

SEQ ID NO: 331495 - protein, 9 aa, Influenza virus
GWYGFKHQN

SEQ ID NO: 331496 - protein, 9 aa, Influenza virus
WYGFKHQNA

SEQ ID NO: 331497 - protein, 9 aa, Influenza virus
YGFKHQNAQ

SEQ ID NO: 331498 - protein, 9 aa, Influenza virus
GFKHQNAQG

SEQ ID NO: 331499 - protein, 9 aa, Influenza virus
FKHQNAQGE

SEQ ID NO: 331500 - protein, 9 aa, Influenza virus
KHQNAQGEG

SEQ ID NO: 331501 - protein, 9 aa, Influenza virus
HQNAQGEGI

SEQ ID NO: 331502 - protein, 9 aa, Influenza virus
QNAQGEGIA

SEQ ID NO: 331503 - protein, 9 aa, Influenza virus
NAQGEGIAA

SEQ ID NO: 331504 - protein, 9 aa, Influenza virus
AQGEGIAAD

SEQ ID NO: 331505 - protein, 9 aa, Influenza virus
QGEGIAADY

SEQ ID NO: 331506 - protein, 9 aa, Influenza virus
GEGIAADYK

SEQ ID NO: 331507 - protein, 9 aa, Influenza virus
EGIAADYKS

SEQ ID NO: 331508 - protein, 9 aa, Influenza virus
GIAADYKST

SEQ ID NO: 331509 - protein, 9 aa, Influenza virus
IAADYKSTQ

SEQ ID NO: 331510 - protein, 9 aa, Influenza virus
AADYKSTPS

SEQ ID NO: 331511 - protein, 9 aa, Influenza virus
ADYKSTPSA

SEQ ID NO: 331512 - protein, 9 aa, Influenza virus
DYKSTQSAV

SEQ ID NO: 331513 - protein, 9 aa, Influenza virus
YKSTQSAIN

SEQ ID NO: 331514 - protein, 9 aa, Influenza virus
KSTQSAINQ

SEQ ID NO: 331515 - protein, 9 aa, Influenza virus
STQSAINQI

SEQ ID NO: 331516 - protein, 9 aa, Influenza virus
TQSAINQIT

SEQ ID NO: 331517 - protein, 9 aa, Influenza virus
QSAINQITG

SEQ ID NO: 331518 - protein, 9 aa, Influenza virus
SAINQITGK

SEQ ID NO: 331519 - protein, 9 aa, Influenza virus
AINQITGKL

SEQ ID NO: 331520 - protein, 9 aa, Influenza virus
INQITGKLN

SEQ ID NO: 331521 - protein, 9 aa, Influenza virus
NQITGKLNR

SEQ ID NO: 331522 - protein, 9 aa, Influenza virus
QITGKLNRI

SEQ ID NO: 331523 - protein, 9 aa, Influenza virus
ITGKLNRII

SEQ ID NO: 331524 - protein, 9 aa, Influenza virus
TGKLNRLIE

SEQ ID NO: 331525 - protein, 9 aa, Influenza virus
GKLNRLIEK

SEQ ID NO: 331526 - protein, 9 aa, Influenza virus
KLNRLIEKT

SEQ ID NO: 331527 - protein, 9 aa, Influenza virus
LNRLIEKTN

SEQ ID NO: 331528 - protein, 9 aa, Influenza virus
NRLIEKTNQ

SEQ ID NO: 331529 - protein, 9 aa, Influenza virus
RLIEKTNQQ

SEQ ID NO: 331530 - protein, 9 aa, Influenza virus
LIEKTNQQF

SEQ ID NO: 331531 - protein, 9 aa, Influenza virus
IEKTNQQFE

SEQ ID NO: 331532 - protein, 9 aa, Influenza virus
EKTNQQFEL

SEQ ID NO: 331533 - protein, 9 aa, Influenza virus
KTNQQFEMI

SEQ ID NO: 331534 - protein, 9 aa, Influenza virus
TNQQFEMID

SEQ ID NO: 331535 - protein, 9 aa, Influenza virus
NQQFEMIDN

SEQ ID NO: 331536 - protein, 9 aa, Influenza virus
QQFEMIDNE

SEQ ID NO: 331537 - protein, 9 aa, Influenza virus
QFEMIDNEF

SEQ ID NO: 331538 - protein, 9 aa, Influenza virus
IDNEFTEVE

SEQ ID NO: 331539 - protein, 9 aa, Influenza virus
FTEVEKQIG

SEQ ID NO: 331540 - protein, 9 aa, Influenza virus
TEVEKQIGN

SEQ ID NO: 331541 - protein, 9 aa, Influenza virus
EVEKQIGNV

SEQ ID NO: 331542 - protein, 9 aa, Influenza virus
VEKQIGNVI

SEQ ID NO: 331543 - protein, 9 aa, Influenza virus
EKQIGNVIN

SEQ ID NO: 331544 - protein, 9 aa, Influenza virus
KQIGNVINW

SEQ ID NO: 331545 - protein, 9 aa, Influenza virus
NVINWTRDA

SEQ ID NO: 331546 - protein, 9 aa, Influenza virus
VINWTRDSI

SEQ ID NO: 331547 - protein, 9 aa, Influenza virus
INWTRDSIT

SEQ ID NO: 331548 - protein, 9 aa, Influenza virus
NWTRDSITE

SEQ ID NO: 331549 - protein, 9 aa, Influenza virus
WTRDSMTEI

SEQ ID NO: 331550 - protein, 9 aa, Influenza virus
TRDSMTEIW

SEQ ID NO: 331551 - protein, 9 aa, Influenza virus
RDSMTEIWS

SEQ ID NO: 331552 - protein, 9 aa, Influenza virus
DSMTEIWSY

SEQ ID NO: 331553 - protein, 9 aa, Influenza virus
SMTEIWSYN

SEQ ID NO: 331554 - protein, 9 aa, Influenza virus
MTEIWSYNA

SEQ ID NO: 331555 - protein, 9 aa, Influenza virus
TEIWSYNAE

SEQ ID NO: 331556 - protein, 9 aa, Influenza virus
EIWSYNAEL

SEQ ID NO: 331557 - protein, 9 aa, Influenza virus
IWSYNAELL

SEQ ID NO: 331558 - protein, 9 aa, Influenza virus
MVVYAELLV

SEQ ID NO: 331559 - protein, 9 aa, Influenza virus
SYNAEFLVA

SEQ ID NO: 331560 - protein, 9 aa, Influenza virus
YNAEFLVAM

SEQ ID NO: 331561 - protein, 9 aa, Influenza virus
NAEFLVAME

SEQ ID NO: 331562 - protein, 9 aa, Influenza virus
IDLADSEMD

SEQ ID NO: 331563 - protein, 9 aa, Influenza virus
DLADSEMDK

SEQ ID NO: 331564 - protein, 9 aa, Influenza virus
LADSEMDKL

SEQ ID NO: 331565 - protein, 9 aa, Influenza virus
ADSEMDKLY

SEQ ID NO: 331566 - protein, 9 aa, Influenza virus
DSEMDKLYE

SEQ ID NO: 331567 - protein, 9 aa, Influenza virus
SEMDKLYER

SEQ ID NO: 331568 - protein, 9 aa, Influenza virus
EMDKLYERV

SEQ ID NO: 331569 - protein, 9 aa, Influenza virus
KLYERVRRQ

SEQ ID NO: 331570 - protein, 9 aa, Influenza virus
LYERVRRQL

SEQ ID NO: 331571 - protein, 9 aa, Influenza virus
YERVRRQLR

SEQ ID NO: 331572 - protein, 9 aa, Influenza virus
ERVRRQLRE

SEQ ID NO: 331573 - protein, 9 aa, Influenza virus
RVRRQLREN

SEQ ID NO: 331574 - protein, 9 aa, Influenza virus
VRRQLRENA

SEQ ID NO: 331575 - protein, 9 aa, Influenza virus
RRQLRENAE

SEQ ID NO: 331576 - protein, 9 aa, Influenza virus
RQLRENAEE

SEQ ID NO: 331577 - protein, 9 aa, Influenza virus
FEIFHKCDN

SEQ ID NO: 331578 - protein, 9 aa, Influenza virus
CMASIRNNT

SEQ ID NO: 331579 - protein, 9 aa, Influenza virus
MASIRNNTY

SEQ ID NO: 331580 - protein, 9 aa, Influenza virus
ASIRNNTYD

SEQ ID NO: 331581 - protein, 9 aa, Influenza virus
SIRNSTYDH

SEQ ID NO: 331582 - protein, 9 aa, Influenza virus
IRNNTYDHS

SEQ ID NO: 331583 - protein, 9 aa, Influenza virus
KYREEAMQN

SEQ ID NO: 331584 - protein, 9 aa, Influenza virus
YREEAMQNR

SEQ ID NO: 331585 - protein, 9 aa, Influenza virus
REEAMQNRI

SEQ ID NO: 331586 - protein, 9 aa, Influenza virus
EAMQNRIQI

SEQ ID NO: 331587 - protein, 9 aa, Influenza virus
QNRIQINPV

SEQ ID NO: 331588 - protein, 9 aa, Influenza virus
NRIQINPVK

SEQ ID NO: 331589 - protein, 9 aa, Influenza virus
RIQINPVKL

SEQ ID NO: 331590 - protein, 9 aa, Influenza virus
NPVKLSSGY

SEQ ID NO: 331591 - protein, 9 aa, Influenza virus
PVKLSGGYK

SEQ ID NO: 331592 - protein, 9 aa, Influenza virus
VKLSSGYKE

SEQ ID NO: 331593 - protein, 9 aa, Influenza virus
SSGYKDVIL

SEQ ID NO: 331594 - protein, 9 aa, Influenza virus
SGYKDVILW

SEQ ID NO: 331595 - protein, 9 aa, Influenza virus
GYKDVILWF

SEQ ID NO: 331596 - protein, 9 aa, Influenza virus
YKDVILWFS

SEQ ID NO: 331597 - protein, 9 aa, Influenza virus
KDVILWFSF

SEQ ID NO: 331598 - protein, 9 aa, Influenza virus
DVILWFSFG

SEQ ID NO: 331599 - protein, 9 aa, Influenza virus
VILWFSFGA

SEQ ID NO: 331600 - protein, 9 aa, Influenza virus
FSFGASCFI

SEQ ID NO: 331601 - protein, 9 aa, Influenza virus
SFGASCFIL

SEQ ID NO: 331602 - protein, 9 aa, Influenza virus
FGASCFILL

SEQ ID NO: 331603 - protein, 9 aa, Influenza virus
GASCFILLA

SEQ ID NO: 331604 - protein, 9 aa, Influenza virus
ASCFILLAI

SEQ ID NO: 331605 - protein, 9 aa, Influenza virus
FICVKNGNM

SEQ ID NO: 331606 - protein, 9 aa, Influenza virus
ICVKNGNMR

SEQ ID NO: 331607 - protein, 9 aa, Influenza virus
CVKNGNMRC

SEQ ID NO: 331608 - protein, 9 aa, Influenza virus
VKNGNMRCT

SEQ ID NO: 331609 - protein, 9 aa, Influenza virus
KNGNHAVHY

SEQ ID NO: 331610 - protein, 9 aa, Influenza virus
NGNMQCTIC

SEQ ID NO: 331611 - protein, 9 aa, Influenza virus
GIVNTTLST

SEQ ID NO: 331612 - protein, 9 aa, Influenza virus
IVNTTLSTI

SEQ ID NO: 331613 - protein, 9 aa, Influenza virus
VNTVLSIIA

SEQ ID NO: 331614 - protein, 9 aa, Influenza virus
NTILSTKAL

SEQ ID NO: 331615 - protein, 9 aa, Influenza virus
TTLSTIALI

SEQ ID NO: 331616 - protein, 9 aa, Influenza virus
TLSTIALII

SEQ ID NO: 331617 - protein, 9 aa, Influenza virus
LSTIALIIG

SEQ ID NO: 331618 - protein, 9 aa, Influenza virus
STIALLIGI

SEQ ID NO: 331619 - protein, 9 aa, Influenza virus
TIALLIGIG

SEQ ID NO: 331620 - protein, 9 aa, Influenza virus
IALLIGIGN

SEQ ID NO: 331621 - protein, 9 aa, Influenza virus
ALLIGIGNL

SEQ ID NO: 331622 - protein, 9 aa, Influenza virus
IGVGNLIFN

SEQ ID NO: 331623 - protein, 9 aa, Influenza virus
GVGNLIFNT

SEQ ID NO: 331624 - protein, 9 aa, Influenza virus
VGNLIFNTV

SEQ ID NO: 331625 - protein, 9 aa, Influenza virus
GNLIFNTVI

SEQ ID NO: 331626 - protein, 9 aa, Influenza virus
NLIFNTVIH

SEQ ID NO: 331627 - protein, 9 aa, Influenza virus
LIFNTVIHG

SEQ ID NO: 331628 - protein, 9 aa, Influenza virus
ITYNSTVVN

SEQ ID NO: 331629 - protein, 9 aa, Influenza virus
TYNSTVVNN

SEQ ID NO: 331630 - protein, 9 aa, Influenza virus
YNSTVVNNI

SEQ ID NO: 331631 - protein, 9 aa, Influenza virus
NSTVVNNIT

SEQ ID NO: 331632 - protein, 9 aa, Influenza virus
STVVNNITT

SEQ ID NO: 331633 - protein, 9 aa, Influenza virus
TVVNNITTT

SEQ ID NO: 331634 - protein, 9 aa, Influenza virus
VVNNITTTI

SEQ ID NO: 331635 - protein, 9 aa, Influenza virus
VNNITTTIV

SEQ ID NO: 331636 - protein, 9 aa, Influenza virus
NNITTTIVT

SEQ ID NO: 331637 - protein, 9 aa, Influenza virus
FKSSLPLCP

SEQ ID NO: 331638 - protein, 9 aa, Influenza virus
KSSLPLCPF

SEQ ID NO: 331639 - protein, 9 aa, Influenza virus
SLPLCPFRG

SEQ ID NO: 331640 - protein, 9 aa, Influenza virus
LPLCPFQGF

SEQ ID NO: 331641 - protein, 9 aa, Influenza virus
PLCPFQGFF

SEQ ID NO: 331642 - protein, 9 aa, Influenza virus
LCPFQGFFP

SEQ ID NO: 331643 - protein, 9 aa, Influenza virus
CPFQGFFPF

SEQ ID NO: 331644 - protein, 9 aa, Influenza virus
PFQGFFPFH

SEQ ID NO: 331645 - protein, 9 aa, Influenza virus
FQGFFPFHK

SEQ ID NO: 331646 - protein, 9 aa, Influenza virus
QGFFPFHKD

SEQ ID NO: 331647 - protein, 9 aa, Influenza virus
FPFHKDNAL

SEQ ID NO: 331648 - protein, 9 aa, Influenza virus
PFHKGNSAR

SEQ ID NO: 331649 - protein, 9 aa, Influenza virus
FHKDNAIRP

SEQ ID NO: 331650 - protein, 9 aa, Influenza virus
HKGNSARLI

SEQ ID NO: 331651 - protein, 9 aa, Influenza virus
KDNAIRPGE

SEQ ID NO: 331652 - protein, 9 aa, Influenza virus
DNAIRPGEN

SEQ ID NO: 331653 - protein, 9 aa, Influenza virus
NALRLAENK

SEQ ID NO: 331654 - protein, 9 aa, Influenza virus
DVIITREPY

SEQ ID NO: 331655 - protein, 9 aa, Influenza virus
VIVTREPYI

SEQ ID NO: 331656 - protein, 9 aa, Influenza virus
IVTREPYIS

SEQ ID NO: 331657 - protein, 9 aa, Influenza virus
VTREPYISC

SEQ ID NO: 331658 - protein, 9 aa, Influenza virus
TREPYISCD

SEQ ID NO: 331659 - protein, 9 aa, Influenza virus
REPYVSCDY

SEQ ID NO: 331660 - protein, 9 aa, Influenza virus
DCWSFALAQ

SEQ ID NO: 331661 - protein, 9 aa, Influenza virus
WSFALAQGV

SEQ ID NO: 331662 - protein, 9 aa, Influenza virus
SFALAQGVL

SEQ ID NO: 331663 - protein, 9 aa, Influenza virus
FALAQGALV

SEQ ID NO: 331664 - protein, 9 aa, Influenza virus
ALAQGALVG

SEQ ID NO: 331665 - protein, 9 aa, Influenza virus
LAQGALVGT

SEQ ID NO: 331666 - protein, 9 aa, Influenza virus
AQGALLGTN

SEQ ID NO: 331667 - protein, 9 aa, Influenza virus
QGALLGTNH

SEQ ID NO: 331668 - protein, 9 aa, Influenza virus
GALLGTNHS

SEQ ID NO: 331669 - protein, 9 aa, Influenza virus
ALLGTNHSN

SEQ ID NO: 331670 - protein, 9 aa, Influenza virus
LVGTKHSNG

SEQ ID NO: 331671 - protein, 9 aa, Influenza virus
LGTNHSNGT

SEQ ID NO: 331672 - protein, 9 aa, Influenza virus
HSNGTVKDR

SEQ ID NO: 331673 - protein, 9 aa, Influenza virus
KDRTSYRSL

SEQ ID NO: 331674 - protein, 9 aa, Influenza virus
DRTSYRSLI

SEQ ID NO: 331675 - protein, 9 aa, Influenza virus
RTPYRSLIQ

SEQ ID NO: 331676 - protein, 9 aa, Influenza virus
TPYRSLIQF

SEQ ID NO: 331677 - protein, 9 aa, Influenza virus
PYRSLIQFP

SEQ ID NO: 331678 - protein, 9 aa, Influenza virus
YRSLIQFPM

SEQ ID NO: 331679 - protein, 9 aa, Influenza virus
RSLIQFPIG

SEQ ID NO: 331680 - protein, 9 aa, Influenza virus
SLIRFPIGV

SEQ ID NO: 331681 - protein, 9 aa, Influenza virus
LIRFPIGVA

SEQ ID NO: 331682 - protein, 9 aa, Influenza virus
IRFPIGVAP

SEQ ID NO: 331683 - protein, 9 aa, Influenza virus
FPIGVAPVL

SEQ ID NO: 331684 - protein, 9 aa, Influenza virus
PIGVAPVLG

SEQ ID NO: 331685 - protein, 9 aa, Influenza virus
IGVAPVLGN

SEQ ID NO: 331686 - protein, 9 aa, Influenza virus
GVAPVLGNY

SEQ ID NO: 331687 - protein, 9 aa, Influenza virus
VAPVLGNYK

SEQ ID NO: 331688 - protein, 9 aa, Influenza virus
APVLGNYRE

SEQ ID NO: 331689 - protein, 9 aa, Influenza virus
PVLGNYREI

SEQ ID NO: 331690 - protein, 9 aa, Influenza virus
VLGNYREIC

SEQ ID NO: 331691 - protein, 9 aa, Influenza virus
LGNYKEICV

SEQ ID NO: 331692 - protein, 9 aa, Influenza virus
GNYKEICVA

SEQ ID NO: 331693 - protein, 9 aa, Influenza virus
NYKEICVAW

SEQ ID NO: 331694 - protein, 9 aa, Influenza virus
YKEICVAWS

SEQ ID NO: 331695 - protein, 9 aa, Influenza virus
KEICVAWSS

SEQ ID NO: 331696 - protein, 9 aa, Influenza virus
EICVAWSSS

SEQ ID NO: 331697 - protein, 9 aa, Influenza virus
ICVAWSSSS

SEQ ID NO: 331698 - protein, 9 aa, Influenza virus
CVAWSSSSC

SEQ ID NO: 331699 - protein, 9 aa, Influenza virus
VAWSSSSCF

SEQ ID NO: 331700 - protein, 9 aa, Influenza virus
AWSSTSCFD

SEQ ID NO: 331701 - protein, 9 aa, Influenza virus
WSSTSCFDG

SEQ ID NO: 331702 - protein, 9 aa, Influenza virus
SSTSCFDGK

SEQ ID NO: 331703 - protein, 9 aa, Influenza virus
STSCFDGKE

SEQ ID NO: 331704 - protein, 9 aa, Influenza virus
TSCFDGKEW

SEQ ID NO: 331705 - protein, 9 aa, Influenza virus
FDGKEWMHI

SEQ ID NO: 331706 - protein, 9 aa, Influenza virus
DGKEWMHVS

SEQ ID NO: 331707 - protein, 9 aa, Influenza virus
GKEWMHVCI

SEQ ID NO: 331708 - protein, 9 aa, Influenza virus
KEWMHVCIT

SEQ ID NO: 331709 - protein, 9 aa, Influenza virus
EWMHVCITG

SEQ ID NO: 331710 - protein, 9 aa, Influenza virus
GKMTDSIKS

SEQ ID NO: 331711 - protein, 9 aa, Influenza virus
KMTDSIKSW

SEQ ID NO: 331712 - protein, 9 aa, Influenza virus
MSDSIKSWR

SEQ ID NO: 331713 - protein, 9 aa, Influenza virus
TDSIKSWRR

SEQ ID NO: 331714 - protein, 9 aa, Influenza virus
DSIKSWRRD

SEQ ID NO: 331715 - protein, 9 aa, Influenza virus
SIKSWRRDI

SEQ ID NO: 331716 - protein, 9 aa, Influenza virus
IKSWRRDIL

SEQ ID NO: 331717 - protein, 9 aa, Influenza virus
KSWRRDILR

SEQ ID NO: 331718 - protein, 9 aa, Influenza virus
SWRRDILRT

SEQ ID NO: 331719 - protein, 9 aa, Influenza virus
WRRDILRTQ

SEQ ID NO: 331720 - protein, 9 aa, Influenza virus
RRDILRTQE

SEQ ID NO: 331721 - protein, 9 aa, Influenza virus
RDILRTQES

SEQ ID NO: 331722 - protein, 9 aa, Influenza virus
RTQESECQR

SEQ ID NO: 331723 - protein, 9 aa, Influenza virus
TQESECQRI

SEQ ID NO: 331724 - protein, 9 aa, Influenza virus
QESECQCIG

SEQ ID NO: 331725 - protein, 9 aa, Influenza virus
ESECQCIGG

SEQ ID NO: 331726 - protein, 9 aa, Influenza virus
GTCVVTVTD

SEQ ID NO: 331727 - protein, 9 aa, Influenza virus
TCVVTVTDG

SEQ ID NO: 331728 - protein, 9 aa, Influenza virus
CVVTVTDGP

SEQ ID NO: 331729 - protein, 9 aa, Influenza virus
VVTVTDGPA

SEQ ID NO: 331730 - protein, 9 aa, Influenza virus
VTVTDGPAA

SEQ ID NO: 331731 - protein, 9 aa, Influenza virus
TVTDGPAAN

SEQ ID NO: 331732 - protein, 9 aa, Influenza virus
VTDGPAANN

SEQ ID NO: 331733 - protein, 9 aa, Influenza virus
TDGPAANNA

SEQ ID NO: 331734 - protein, 9 aa, Influenza virus
DGPAANNAD

SEQ ID NO: 331735 - protein, 9 aa, Influenza virus
GPAANNADH

SEQ ID NO: 331736 - protein, 9 aa, Influenza virus
PAANNADHR

SEQ ID NO: 331737 - protein, 9 aa, Influenza virus
AANSADHRI

SEQ ID NO: 331738 - protein, 9 aa, Influenza virus
ANSADHRIY

SEQ ID NO: 331739 - protein, 9 aa, Influenza virus
NSADHRIYW

SEQ ID NO: 331740 - protein, 9 aa, Influenza virus
SADHRIYWI

SEQ ID NO: 331741 - protein, 9 aa, Influenza virus
ADHRIYWIR

SEQ ID NO: 331742 - protein, 9 aa, Influenza virus
DHRIYWIRE

SEQ ID NO: 331743 - protein, 9 aa, Influenza virus
HRIYWIREG

SEQ ID NO: 331744 - protein, 9 aa, Influenza virus
RVYWIREGK

SEQ ID NO: 331745 - protein, 9 aa, Influenza virus
KIKHLEECS

SEQ ID NO: 331746 - protein, 9 aa, Influenza virus
IKHLEECSC

SEQ ID NO: 331747 - protein, 9 aa, Influenza virus
KHLEECSCY

SEQ ID NO: 331748 - protein, 9 aa, Influenza virus
HLEECSCYM

SEQ ID NO: 331749 - protein, 9 aa, Influenza virus
LEECSCYMD

SEQ ID NO: 331750 - protein, 9 aa, Influenza virus
EECSCYMDI

SEQ ID NO: 331751 - protein, 9 aa, Influenza virus
ECSCYMDID

SEQ ID NO: 331752 - protein, 9 aa, Influenza virus
CSCYVDIDI

SEQ ID NO: 331753 - protein, 9 aa, Influenza virus
SCYVDIDIY

SEQ ID NO: 331754 - protein, 9 aa, Influenza virus
CYVDIDIYC

SEQ ID NO: 331755 - protein, 9 aa, Influenza virus
DIDIYCICR

SEQ ID NO: 331756 - protein, 9 aa, Influenza virus
IDIYCICRD

SEQ ID NO: 331757 - protein, 9 aa, Influenza virus
DIYCICRDN

SEQ ID NO: 331758 - protein, 9 aa, Influenza virus
IYCICRDNW

SEQ ID NO: 331759 - protein, 9 aa, Influenza virus
YCVCRDNWK

SEQ ID NO: 331760 - protein, 9 aa, Influenza virus
CVCRDNWKG

SEQ ID NO: 331761 - protein, 9 aa, Influenza virus
VCRDNWKGS

SEQ ID NO: 331762 - protein, 9 aa, Influenza virus
WKGSNRPWI

SEQ ID NO: 331763 - protein, 9 aa, Influenza virus
KGSNRPWIR

SEQ ID NO: 331764 - protein, 9 aa, Influenza virus
GSNRPWIRI

SEQ ID NO: 331765 - protein, 9 aa, Influenza virus
SNRPWIRIN

SEQ ID NO: 331766 - protein, 9 aa, Influenza virus
NRPWIRINN

SEQ ID NO: 331767 - protein, 9 aa, Influenza virus
RPWIRINNE

SEQ ID NO: 331768 - protein, 9 aa, Influenza virus
PWIRINNET

SEQ ID NO: 331769 - protein, 9 aa, Influenza virus
WIRINNETI

SEQ ID NO: 331770 - protein, 9 aa, Influenza virus
IRINNETIL

SEQ ID NO: 331771 - protein, 9 aa, Influenza virus
RISNETILE

SEQ ID NO: 331772 - protein, 9 aa, Influenza virus
ISNETILET

SEQ ID NO: 331773 - protein, 9 aa, Influenza virus
SNETILETG

SEQ ID NO: 331774 - protein, 9 aa, Influenza virus
NETIVETGY

SEQ ID NO: 331775 - protein, 9 aa, Influenza virus
ETIVETGYV

SEQ ID NO: 331776 - protein, 9 aa, Influenza virus
TIVETGYVC

SEQ ID NO: 331777 - protein, 9 aa, Influenza virus
ILETRYVCS

SEQ ID NO: 331778 - protein, 9 aa, Influenza virus
VETGYVCSK

SEQ ID NO: 331779 - protein, 9 aa, Influenza virus
ETGYICSKF

SEQ ID NO: 331780 - protein, 9 aa, Influenza virus
TRYVCSKFH

SEQ ID NO: 331781 - protein, 9 aa, Influenza virus
RYVCSKFHS

SEQ ID NO: 331782 - protein, 9 aa, Influenza virus
FHSDTPRPD

SEQ ID NO: 331783 - protein, 9 aa, Influenza virus
HSDTPRPDD

SEQ ID NO: 331784 - protein, 9 aa, Influenza virus
SDTPRPDDP

SEQ ID NO: 331785 - protein, 9 aa, Influenza virus
DTPRPDDPS

SEQ ID NO: 331786 - protein, 9 aa, Influenza virus
DPSTMSCDS

SEQ ID NO: 331787 - protein, 9 aa, Influenza virus
PSTMSCDSP

SEQ ID NO: 331788 - protein, 9 aa, Influenza virus
STMSCDSPS

SEQ ID NO: 331789 - protein, 9 aa, Influenza virus
TMSCDSPSN

SEQ ID NO: 331790 - protein, 9 aa, Influenza virus
SCDSPSNIN

SEQ ID NO: 331791 - protein, 9 aa, Influenza virus
CDSPSNING

SEQ ID NO: 331792 - protein, 9 aa, Influenza virus
DSPSNINGG

SEQ ID NO: 331793 - protein, 9 aa, Influenza virus
NGGLGVKGF

SEQ ID NO: 331794 - protein, 9 aa, Influenza virus
GGLGVKGFG

SEQ ID NO: 331795 - protein, 9 aa, Influenza virus
GLGVKGFGF

SEQ ID NO: 331796 - protein, 9 aa, Influenza virus
LGVKGFGFK

SEQ ID NO: 331797 - protein, 9 aa, Influenza virus
GVKGFGFKT

SEQ ID NO: 331798 - protein, 9 aa, Influenza virus
VKGFGFKTG

SEQ ID NO: 331799 - protein, 9 aa, Influenza virus
GDDVWLGRT

SEQ ID NO: 331800 - protein, 9 aa, Influenza virus
DDVWLGRTV

SEQ ID NO: 331801 - protein, 9 aa, Influenza virus
VWLGRTVSN

SEQ ID NO: 331802 - protein, 9 aa, Influenza virus
WLGRTVSNS

SEQ ID NO: 331803 - protein, 9 aa, Influenza virus
LGRTVSNSG

SEQ ID NO: 331804 - protein, 9 aa, Influenza virus
GRTVSNSGR

SEQ ID NO: 331805 - protein, 9 aa, Influenza virus
RTVSNSGRS

SEQ ID NO: 331806 - protein, 9 aa, Influenza virus
SGRSGFEVI

SEQ ID NO: 331807 - protein, 9 aa, Influenza virus
RSGFEVIKV

SEQ ID NO: 331808 - protein, 9 aa, Influenza virus
VAEGWINSP

SEQ ID NO: 331809 - protein, 9 aa, Influenza virus
EGWINSPSQ

SEQ ID NO: 331810 - protein, 9 aa, Influenza virus
GWINSPNHV

SEQ ID NO: 331811 - protein, 9 aa, Influenza virus
WINSPNHVK

SEQ ID NO: 331812 - protein, 9 aa, Influenza virus
INSPNHVKS

SEQ ID NO: 331813 - protein, 9 aa, Influenza virus
AKSITQTLV

SEQ ID NO: 331814 - protein, 9 aa, Influenza virus
KSVTQTLVS

SEQ ID NO: 331815 - protein, 9 aa, Influenza virus
SVTQTLVSN

SEQ ID NO: 331816 - protein, 9 aa, Influenza virus
VTQTLVSNN

SEQ ID NO: 331817 - protein, 9 aa, Influenza virus
TQTLVSNSD

SEQ ID NO: 331818 - protein, 9 aa, Influenza virus
QTLVSNDDW

SEQ ID NO: 331819 - protein, 9 aa, Influenza virus
TLVSNSDWS

SEQ ID NO: 331820 - protein, 9 aa, Influenza virus
LVSNSDWSG

SEQ ID NO: 331821 - protein, 9 aa, Influenza virus
VSNSDWSGY

SEQ ID NO: 331822 - protein, 9 aa, Influenza virus
SNDDWSGYS

SEQ ID NO: 331823 - protein, 9 aa, Influenza virus
NSDWSGYSG

SEQ ID NO: 331824 - protein, 9 aa, Influenza virus
SDWSGYSGS

SEQ ID NO: 331825 - protein, 9 aa, Influenza virus
WSGYSGSFV

SEQ ID NO: 331826 - protein, 9 aa, Influenza virus
SGYSGSFII

SEQ ID NO: 331827 - protein, 9 aa, Influenza virus
NGCFQPCFY

SEQ ID NO: 331828 - protein, 9 aa, Influenza virus
GCFQPCFYI

SEQ ID NO: 331829 - protein, 9 aa, Influenza virus
CFQPCFYIE

SEQ ID NO: 331830 - protein, 9 aa, Influenza virus
FQPCFYIEL

SEQ ID NO: 331831 - protein, 9 aa, Influenza virus
QPCFYIELI

SEQ ID NO: 331832 - protein, 9 aa, Influenza virus
PCFYIELIR

SEQ ID NO: 331833 - protein, 9 aa, Influenza virus
CFYIELIRG

SEQ ID NO: 331834 - protein, 9 aa, Influenza virus
FYIELIRGR

SEQ ID NO: 331835 - protein, 9 aa, Influenza virus
YIELIRGRP

SEQ ID NO: 331836 - protein, 9 aa, Influenza virus
IELIRGRPN

SEQ ID NO: 331837 - protein, 9 aa, Influenza virus
NDNVSWTSN

SEQ ID NO: 331838 - protein, 9 aa, Influenza virus
DNVSWTSNS

SEQ ID NO: 331839 - protein, 9 aa, Influenza virus
NVSWTSNSI

SEQ ID NO: 331840 - protein, 9 aa, Influenza virus
VSWASNSIV

SEQ ID NO: 331841 - protein, 9 aa, Influenza virus
SWASNSIVT

SEQ ID NO: 331842 - protein, 9 aa, Influenza virus
WASNSIVTF

SEQ ID NO: 331843 - protein, 9 aa, Influenza virus
ASNSIVTFC

SEQ ID NO: 331844 - protein, 9 aa, Influenza virus
SIVTFCGLN

SEQ ID NO: 331845 - protein, 9 aa, Influenza virus
IVTFCGLNN

SEQ ID NO: 331846 - protein, 9 aa, Influenza virus
VTFCGLNNE

SEQ ID NO: 331847 - protein, 9 aa, Influenza virus
TFCGLNNEP

SEQ ID NO: 331848 - protein, 9 aa, Influenza virus
FCGLNNEPG

SEQ ID NO: 331849 - protein, 9 aa, Influenza virus
CGLNNEPGS

SEQ ID NO: 331850 - protein, 9 aa, Influenza virus
GLNNEPGSG

SEQ ID NO: 331851 - protein, 9 aa, Influenza virus
LNNEPGSGN

SEQ ID NO: 331852 - protein, 9 aa, Influenza virus
NNEPGSGNW

SEQ ID NO: 331853 - protein, 9 aa, Influenza virus
GSGNWPDGA

SEQ ID NO: 331854 - protein, 9 aa, Influenza virus
SGNWPDGSD

SEQ ID NO: 331855 - protein, 9 aa, Influenza virus
GHWPDGSNI

SEQ ID NO: 331856 - protein, 9 aa, Influenza virus
NWPDGANIG

SEQ ID NO: 331857 - protein, 9 aa, Influenza virus
WPDGANIGF

SEQ ID NO: 331858 - protein, 9 aa, Influenza virus
PDGSDIGFM

SEQ ID NO: 331859 - protein, 9 aa, Influenza virus
DGANIGFMP

SEQ ID NO: 331860 - protein, 9 aa, Influenza virus
GANIGFMPK

SEQ ID NO: 331861 - protein, 9 aa, Influenza virus
MKSRGYKMN

SEQ ID NO: 331862 - protein, 9 aa, Influenza virus
KSRGYKMNI

SEQ ID NO: 331863 - protein, 9 aa, Influenza virus
SRGYKMNTK

SEQ ID NO: 331864 - protein, 9 aa, Influenza virus
RGYKMNTKI

SEQ ID NO: 331865 - protein, 9 aa, Influenza virus
GYKMNIQIL

SEQ ID NO: 331866 - protein, 9 aa, Influenza virus
YKMNIQILI

SEQ ID NO: 331867 - protein, 9 aa, Influenza virus
KMNTKILVL

SEQ ID NO: 331868 - protein, 9 aa, Influenza virus
GDKICLGHH

SEQ ID NO: 331869 - protein, 9 aa, Influenza virus
DKICLGRHA

SEQ ID NO: 331870 - protein, 9 aa, Influenza virus
KICLGRHAV

SEQ ID NO: 331871 - protein, 9 aa, Influenza virus
NGTKVDTLT

SEQ ID NO: 331872 - protein, 9 aa, Influenza virus
GTKVDTLTE

SEQ ID NO: 331873 - protein, 9 aa, Influenza virus
TKVDTLTEK

SEQ ID NO: 331874 - protein, 9 aa, Influenza virus
KVDTLTEKG

SEQ ID NO: 331875 - protein, 9 aa, Influenza virus
VDTLTEKGI

SEQ ID NO: 331876 - protein, 9 aa, Influenza virus
DTLTEKGIE

SEQ ID NO: 331877 - protein, 9 aa, Influenza virus
TLTEKGIEV

SEQ ID NO: 331878 - protein, 9 aa, Influenza virus
LTEKGIEVV

SEQ ID NO: 331879 - protein, 9 aa, Influenza virus
TEKGIEVVN

SEQ ID NO: 331880 - protein, 9 aa, Influenza virus
EKGIEVVNA

SEQ ID NO: 331881 - protein, 9 aa, Influenza virus
KGIEVVNAT

SEQ ID NO: 331882 - protein, 9 aa, Influenza virus
GIEVVNATE

SEQ ID NO: 331883 - protein, 9 aa, Influenza virus
IEVVNATET

SEQ ID NO: 331884 - protein, 9 aa, Influenza virus
VNATETVEQ

SEQ ID NO: 331885 - protein, 9 aa, Influenza virus
DLGKCGLLG

SEQ ID NO: 331886 - protein, 9 aa, Influenza virus
LGQCGLLGI

SEQ ID NO: 331887 - protein, 9 aa, Influenza virus
IGPPQCDQF

SEQ ID NO: 331888 - protein, 9 aa, Influenza virus
GPPQCDLFL

SEQ ID NO: 331889 - protein, 9 aa, Influenza virus
PPQCDLFLE

SEQ ID NO: 331890 - protein, 9 aa, Influenza virus
PQCDLFLEF

SEQ ID NO: 331891 - protein, 9 aa, Influenza virus
NLIIERREG

SEQ ID NO: 331892 - protein, 9 aa, Influenza virus
EETLRQILR

SEQ ID NO: 331893 - protein, 9 aa, Influenza virus
LRQILRKSG

SEQ ID NO: 331894 - protein, 9 aa, Influenza virus
RQILRKSGG

SEQ ID NO: 331895 - protein, 9 aa, Influenza virus
MGFTYTGVR

SEQ ID NO: 331896 - protein, 9 aa, Influenza virus
GFTYTGVRT

SEQ ID NO: 331897 - protein, 9 aa, Influenza virus
FTYTGVRTN

SEQ ID NO: 331898 - protein, 9 aa, Influenza virus
TYTGVRTNG

SEQ ID NO: 331899 - protein, 9 aa, Influenza virus
RSRSSFYAE

SEQ ID NO: 331900 - protein, 9 aa, Influenza virus
SRSSFYAEM

SEQ ID NO: 331901 - protein, 9 aa, Influenza virus
RSSFYAEMK

SEQ ID NO: 331902 - protein, 9 aa, Influenza virus
PSFYAEMKW

SEQ ID NO: 331903 - protein, 9 aa, Influenza virus
SFYAEMEWL

SEQ ID NO: 331904 - protein, 9 aa, Influenza virus
FYAEMEWLL

SEQ ID NO: 331905 - protein, 9 aa, Influenza virus
YAEMEWLLS

SEQ ID NO: 331906 - protein, 9 aa, Influenza virus
AEMKWLLSS

SEQ ID NO: 331907 - protein, 9 aa, Influenza virus
FPQTTKSYK

SEQ ID NO: 331908 - protein, 9 aa, Influenza virus
PQTTKSYKN

SEQ ID NO: 331909 - protein, 9 aa, Influenza virus
PALIVWGIH

SEQ ID NO: 331910 - protein, 9 aa, Influenza virus
ALIVWGIHH

SEQ ID NO: 331911 - protein, 9 aa, Influenza virus
EQTRLYGSG

SEQ ID NO: 331912 - protein, 9 aa, Influenza virus
TVGSSKYQQ

SEQ ID NO: 331913 - protein, 9 aa, Influenza virus
VGSSKYQQS

SEQ ID NO: 331914 - protein, 9 aa, Influenza virus
RPQINGQSG

SEQ ID NO: 331915 - protein, 9 aa, Influenza virus
PQINGQSGR

SEQ ID NO: 331916 - protein, 9 aa, Influenza virus
QINGQSGRI

SEQ ID NO: 331917 - protein, 9 aa, Influenza virus
INGQSGRID

SEQ ID NO: 331918 - protein, 9 aa, Influenza virus
GQSGRIDFY

SEQ ID NO: 331919 - protein, 9 aa, Influenza virus
QSGRIDFYW

SEQ ID NO: 331920 - protein, 9 aa, Influenza virus
SGRIDFYWL

SEQ ID NO: 331921 - protein, 9 aa, Influenza virus
NDTVTFTFN

SEQ ID NO: 331922 - protein, 9 aa, Influenza virus
DTVTFTFNG

SEQ ID NO: 331923 - protein, 9 aa, Influenza virus
TVTFTFNGA

SEQ ID NO: 331924 - protein, 9 aa, Influenza virus
VTFTFNGAF

SEQ ID NO: 331925 - protein, 9 aa, Influenza virus
TFTFNGAFI

SEQ ID NO: 331926 - protein, 9 aa, Influenza virus
FTFNGAFIA

SEQ ID NO: 331927 - protein, 9 aa, Influenza virus
TFNGAFIAP

SEQ ID NO: 331928 - protein, 9 aa, Influenza virus
FNGAFVAPD

SEQ ID NO: 331929 - protein, 9 aa, Influenza virus
NGAFVAPDR

SEQ ID NO: 331930 - protein, 9 aa, Influenza virus
GAFVAPDRV

SEQ ID NO: 331931 - protein, 9 aa, Influenza virus
AFVAPDRVS

SEQ ID NO: 331932 - protein, 9 aa, Influenza virus
FVAPDRVSF

SEQ ID NO: 331933 - protein, 9 aa, Influenza virus
SSLPFQNIN

SEQ ID NO: 331934 - protein, 9 aa, Influenza virus
LPFQNINPR

SEQ ID NO: 331935 - protein, 9 aa, Influenza virus
PFQNINSRT

SEQ ID NO: 331936 - protein, 9 aa, Influenza virus
IGKCPRYVK

SEQ ID NO: 331937 - protein, 9 aa, Influenza virus
GKCPKYVKQ

SEQ ID NO: 331938 - protein, 9 aa, Influenza virus
SLMLATGMK

SEQ ID NO: 331939 - protein, 9 aa, Influenza virus
LMLATGMKN

SEQ ID NO: 331940 - protein, 9 aa, Influenza virus
MLATGMKNV

SEQ ID NO: 331941 - protein, 9 aa, Influenza virus
LATGMRNVP

SEQ ID NO: 331942 - protein, 9 aa, Influenza virus
ATGMRNVPE

SEQ ID NO: 331943 - protein, 9 aa, Influenza virus
AHKQLTHHM

SEQ ID NO: 331944 - protein, 9 aa, Influenza virus
KKRKKRGLF

SEQ ID NO: 331945 - protein, 9 aa, Influenza virus
KKKKRGLFG

SEQ ID NO: 331946 - protein, 9 aa, Influenza virus
KKREKRGLF

SEQ ID NO: 331947 - protein, 9 aa, Influenza virus
RRRGLFGAI

SEQ ID NO: 331948 - protein, 9 aa, Influenza virus
KGLFGAIAG

SEQ ID NO: 331949 - protein, 9 aa, Influenza virus
IENGWEGLV

SEQ ID NO: 331950 - protein, 9 aa, Influenza virus
ENGWEGLVD

SEQ ID NO: 331951 - protein, 9 aa, Influenza virus
NGWEGLVDG

SEQ ID NO: 331952 - protein, 9 aa, Influenza virus
GWEGLVDGW

SEQ ID NO: 331953 - protein, 9 aa, Influenza virus
WEGLVDGWY

SEQ ID NO: 331954 - protein, 9 aa, Influenza virus
EGLVDGWYG

SEQ ID NO: 331955 - protein, 9 aa, Influenza virus
GLVDGWYGF

SEQ ID NO: 331956 - protein, 9 aa, Influenza virus
LVDGWYGFR

SEQ ID NO: 331957 - protein, 9 aa, Influenza virus
VDGWYGFRH

SEQ ID NO: 331958 - protein, 9 aa, Influenza virus
DGWYGYRHQ

SEQ ID NO: 331959 - protein, 9 aa, Influenza virus
GWYGYRHQN

SEQ ID NO: 331960 - protein, 9 aa, Influenza virus
WYGYRHQNA

SEQ ID NO: 331961 - protein, 9 aa, Influenza virus
YGYRHQNAQ

SEQ ID NO: 331962 - protein, 9 aa, Influenza virus
GYRHQNAQG

SEQ ID NO: 331963 - protein, 9 aa, Influenza virus
YRHQNAQGE

SEQ ID NO: 331964 - protein, 9 aa, Influenza virus
KHQNAQGEG

SEQ ID NO: 331965 - protein, 9 aa, Influenza virus
HQNSQGEGT

SEQ ID NO: 331966 - protein, 9 aa, Influenza virus
QNSQGEGTA

SEQ ID NO: 331967 - protein, 9 aa, Influenza virus
NSQGEGTAA

SEQ ID NO: 331968 - protein, 9 aa, Influenza virus
SQGEGTAAD

SEQ ID NO: 331969 - protein, 9 aa, Influenza virus
DYKSTQSAV

SEQ ID NO: 331970 - protein, 9 aa, Influenza virus
YKSTQSAIN

SEQ ID NO: 331971 - protein, 9 aa, Influenza virus
KSTQSAINQ

SEQ ID NO: 331972 - protein, 9 aa, Influenza virus
STQSAINQI

SEQ ID NO: 331973 - protein, 9 aa, Influenza virus
TQSAINQIT

SEQ ID NO: 331974 - protein, 9 aa, Influenza virus
QSAINQITG

SEQ ID NO: 331975 - protein, 9 aa, Influenza virus
SAINQITGK

SEQ ID NO: 331976 - protein, 9 aa, Influenza virus
AINQITGKL

SEQ ID NO: 331977 - protein, 9 aa, Influenza virus
INQITGKLN

SEQ ID NO: 331978 - protein, 9 aa, Influenza virus
NQITGKLNR

SEQ ID NO: 331979 - protein, 9 aa, Influenza virus
QITRKLNRL

SEQ ID NO: 331980 - protein, 9 aa, Influenza virus
ITRKLNRLI

SEQ ID NO: 331981 - protein, 9 aa, Influenza virus
TGKLNRLID

SEQ ID NO: 331982 - protein, 9 aa, Influenza virus
GKLNRLIDK

SEQ ID NO: 331983 - protein, 9 aa, Influenza virus
KLNRLIDKT

SEQ ID NO: 331984 - protein, 9 aa, Influenza virus
LNRLIDKTN

SEQ ID NO: 331985 - protein, 9 aa, Influenza virus
NRLIDKTNQ

SEQ ID NO: 331986 - protein, 9 aa, Influenza virus
RLIDKTNQQ

SEQ ID NO: 331987 - protein, 9 aa, Influenza virus
LIDKTNQQF

SEQ ID NO: 331988 - protein, 9 aa, Influenza virus
IDKTNQQFE

SEQ ID NO: 331989 - protein, 9 aa, Influenza virus
DKTNQQFEL

SEQ ID NO: 331990 - protein, 9 aa, Influenza virus
RTNQQFELI

SEQ ID NO: 331991 - protein, 9 aa, Influenza virus
TNQQFEMID

SEQ ID NO: 331992 - protein, 9 aa, Influenza virus
NQQFEMIDN

SEQ ID NO: 331993 - protein, 9 aa, Influenza virus
QQFEMIDNE

SEQ ID NO: 331994 - protein, 9 aa, Influenza virus
QFEMIDNEF

SEQ ID NO: 331995 - protein, 9 aa, Influenza virus
FELIDNEFN

SEQ ID NO: 331996 - protein, 9 aa, Influenza virus
ELIDNEFNE

SEQ ID NO: 331997 - protein, 9 aa, Influenza virus
IDNEFNEIE

SEQ ID NO: 331998 - protein, 9 aa, Influenza virus
EIEKQIGNV

SEQ ID NO: 331999 - protein, 9 aa, Influenza virus
IEKQIGNVI

SEQ ID NO: 332000 - protein, 9 aa, Influenza virus
EQQIGNVIN

SEQ ID NO: 332001 - protein, 9 aa, Influenza virus
QQIGNVINW

SEQ ID NO: 332002 - protein, 9 aa, Influenza virus
QLGNVINWT

SEQ ID NO: 332003 - protein, 9 aa, Influenza virus
LGNVINWTR

SEQ ID NO: 332004 - protein, 9 aa, Influenza virus
VINWTRDSI

SEQ ID NO: 332005 - protein, 9 aa, Influenza virus
INWTRDSIT

SEQ ID NO: 332006 - protein, 9 aa, Influenza virus
NWTRDSITE

SEQ ID NO: 332007 - protein, 9 aa, Influenza virus
IEVWSYNAE

SEQ ID NO: 332008 - protein, 9 aa, Influenza virus
EVWSYNAEF

SEQ ID NO: 332009 - protein, 9 aa, Influenza virus
VWSYNAEFL

SEQ ID NO: 332010 - protein, 9 aa, Influenza virus
WSYNAEFLV

SEQ ID NO: 332011 - protein, 9 aa, Influenza virus
SYNAEFLVA

SEQ ID NO: 332012 - protein, 9 aa, Influenza virus
YNAEFLVAV

SEQ ID NO: 332013 - protein, 9 aa, Influenza virus
NAEFLVAVE

SEQ ID NO: 332014 - protein, 9 aa, Influenza virus
AEFLVAVEN

SEQ ID NO: 332015 - protein, 9 aa, Influenza virus
EFLVAVENQ

SEQ ID NO: 332016 - protein, 9 aa, Influenza virus
FLVAVENQH

SEQ ID NO: 332017 - protein, 9 aa, Influenza virus
LVAVENQHT

SEQ ID NO: 332018 - protein, 9 aa, Influenza virus
VAVENQHTI

SEQ ID NO: 332019 - protein, 9 aa, Influenza virus
AVENQHTID

SEQ ID NO: 332020 - protein, 9 aa, Influenza virus
VENQHTIDL

SEQ ID NO: 332021 - protein, 9 aa, Influenza virus
ENQHTIDLT

SEQ ID NO: 332022 - protein, 9 aa, Influenza virus
NQHTIDLTD

SEQ ID NO: 332023 - protein, 9 aa, Influenza virus
QHTIDLTDS

SEQ ID NO: 332024 - protein, 9 aa, Influenza virus
HTIDLTDSE

SEQ ID NO: 332025 - protein, 9 aa, Influenza virus
TIDLTDSEM

SEQ ID NO: 332026 - protein, 9 aa, Influenza virus
IDLTDSEMN

SEQ ID NO: 332027 - protein, 9 aa, Influenza virus
DLTDSEMNK

SEQ ID NO: 332028 - protein, 9 aa, Influenza virus
LTDSEMNKL

SEQ ID NO: 332029 - protein, 9 aa, Influenza virus
TDSEMNKLY

SEQ ID NO: 332030 - protein, 9 aa, Influenza virus
ESEMNKLYE

SEQ ID NO: 332031 - protein, 9 aa, Influenza virus
SEMNKLYEK

SEQ ID NO: 332032 - protein, 9 aa, Influenza virus
EMNKLYEKV

SEQ ID NO: 332033 - protein, 9 aa, Influenza virus
MNKLYERVK

SEQ ID NO: 332034 - protein, 9 aa, Influenza virus
NKLYERVRR

SEQ ID NO: 332035 - protein, 9 aa, Influenza virus
KLYERVRRQ

SEQ ID NO: 332036 - protein, 9 aa, Influenza virus
LYERVRRQL

SEQ ID NO: 332037 - protein, 9 aa, Influenza virus
YERVRRQLR

SEQ ID NO: 332038 - protein, 9 aa, Influenza virus
ERVRRQLRE

SEQ ID NO: 332039 - protein, 9 aa, Influenza virus
RVRRQLREN

SEQ ID NO: 332040 - protein, 9 aa, Influenza virus
VKRQLRENA

SEQ ID NO: 332041 - protein, 9 aa, Influenza virus
KRQLRENAE

SEQ ID NO: 332042 - protein, 9 aa, Influenza virus
KQLRENAEE

SEQ ID NO: 332043 - protein, 9 aa, Influenza virus
LRENAEEDC

SEQ ID NO: 332044 - protein, 9 aa, Influenza virus
RENAEEDGN

SEQ ID NO: 332045 - protein, 9 aa, Influenza virus
ENAEEDGNG

SEQ ID NO: 332046 - protein, 9 aa, Influenza virus
NAEEDGNGC

SEQ ID NO: 332047 - protein, 9 aa, Influenza virus
AEEDGNGCF

SEQ ID NO: 332048 - protein, 9 aa, Influenza virus
EEDGNGCFE

SEQ ID NO: 332049 - protein, 9 aa, Influenza virus
EDGNGCFEI

SEQ ID NO: 332050 - protein, 9 aa, Influenza virus
DGNGCFEIF

SEQ ID NO: 332051 - protein, 9 aa, Influenza virus
GNGCFEIFH

SEQ ID NO: 332052 - protein, 9 aa, Influenza virus
NGCFEIFHQ

SEQ ID NO: 332053 - protein, 9 aa, Influenza virus
GCFEIFHQC

SEQ ID NO: 332054 - protein, 9 aa, Influenza virus
CFEIFHQCD

SEQ ID NO: 332055 - protein, 9 aa, Influenza virus
FEIFHQCDN

SEQ ID NO: 332056 - protein, 9 aa, Influenza virus
EIFHQCDND

SEQ ID NO: 332057 - protein, 9 aa, Influenza virus
IFHQCDNDC

SEQ ID NO: 332058 - protein, 9 aa, Influenza virus
FHQCDNDCM

SEQ ID NO: 332059 - protein, 9 aa, Influenza virus
CMESIRNNT

SEQ ID NO: 332060 - protein, 9 aa, Influenza virus
MESIRNNTY

SEQ ID NO: 332061 - protein, 9 aa, Influenza virus
ESIRNNTYD

SEQ ID NO: 332062 - protein, 9 aa, Influenza virus
SIRNNSYDH

SEQ ID NO: 332063 - protein, 9 aa, Influenza virus
IRNNTYDHK

SEQ ID NO: 332064 - protein, 9 aa, Influenza virus
RNNTYDHKK

SEQ ID NO: 332065 - protein, 9 aa, Influenza virus
NNTYDHKKY

SEQ ID NO: 332066 - protein, 9 aa, Influenza virus
NTYDHKKYR

SEQ ID NO: 332067 - protein, 9 aa, Influenza virus
QNRIQIDAV

SEQ ID NO: 332068 - protein, 9 aa, Influenza virus
IQIDAVKLS

SEQ ID NO: 332069 - protein, 9 aa, Influenza virus
IDAVKLSSG

SEQ ID NO: 332070 - protein, 9 aa, Influenza virus
DAVKLSSGY

SEQ ID NO: 332071 - protein, 9 aa, Influenza virus
AVKLSSGYK

SEQ ID NO: 332072 - protein, 9 aa, Influenza virus
VKLSSGYKE

SEQ ID NO: 332073 - protein, 9 aa, Influenza virus
KLSSGYKDI

SEQ ID NO: 332074 - protein, 9 aa, Influenza virus
LSSGYKDII

SEQ ID NO: 332075 - protein, 9 aa, Influenza virus
SSGYKDIIL

SEQ ID NO: 332076 - protein, 9 aa, Influenza virus
SGYKDIILW

SEQ ID NO: 332077 - protein, 9 aa, Influenza virus
GYKDIILWF

SEQ ID NO: 332078 - protein, 9 aa, Influenza virus
YKDIILWFS

SEQ ID NO: 332079 - protein, 9 aa, Influenza virus
KDIILWFSF

SEQ ID NO: 332080 - protein, 9 aa, Influenza virus
DIILWFSFG

SEQ ID NO: 332081 - protein, 9 aa, Influenza virus
IILWFSFGA

SEQ ID NO: 332082 - protein, 9 aa, Influenza virus
ILWFSLGAS

SEQ ID NO: 332083 - protein, 9 aa, Influenza virus
LWFSLGASC

SEQ ID NO: 332084 - protein, 9 aa, Influenza virus
WFSLGASCF

SEQ ID NO: 332085 - protein, 9 aa, Influenza virus
FSFGASCFL

SEQ ID NO: 332086 - protein, 9 aa, Influenza virus
SFGASCFLL

SEQ ID NO: 332087 - protein, 9 aa, Influenza virus
GASCFLLLA

SEQ ID NO: 332088 - protein, 9 aa, Influenza virus
ASCFLLLAI

SEQ ID NO: 332089 - protein, 9 aa, Influenza virus
LVFMCVKNG

SEQ ID NO: 332090 - protein, 9 aa, Influenza virus
VFMCVKNGN

SEQ ID NO: 332091 - protein, 9 aa, Influenza virus
FMCVKNGNM

SEQ ID NO: 332092 - protein, 9 aa, Influenza virus
MCVKNGNMR

SEQ ID NO: 332093 - protein, 9 aa, Influenza virus
CIKNGNMRC

SEQ ID NO: 332094 - protein, 9 aa, Influenza virus
IKNGNMRCT

SEQ ID NO: 332095 - protein, 9 aa, Influenza virus
KNGNMQCTI

SEQ ID NO: 332096 - protein, 9 aa, Influenza virus
NGNMQCTIC

SEQ ID NO: 332097 - protein, 9 aa, Influenza virus
GNMQCTICI

SEQ ID NO: 332098 - protein, 9 aa, Influenza virus
MNPSQKLFA

SEQ ID NO: 332099 - protein, 9 aa, Influenza virus
NPNQKLFAS

SEQ ID NO: 332100 - protein, 9 aa, Influenza virus
PNQKLFASS

SEQ ID NO: 332101 - protein, 9 aa, Influenza virus
NQKLFASSG

SEQ ID NO: 332102 - protein, 9 aa, Influenza virus
QKLFASSGI

SEQ ID NO: 332103 - protein, 9 aa, Influenza virus
KLFASSGIA

SEQ ID NO: 332104 - protein, 9 aa, Influenza virus
LFASSGIAI

SEQ ID NO: 332105 - protein, 9 aa, Influenza virus
FASSGIAIV

SEQ ID NO: 332106 - protein, 9 aa, Influenza virus
ASSGIAIVL

SEQ ID NO: 332107 - protein, 9 aa, Influenza virus
SSGIAIVLG

SEQ ID NO: 332108 - protein, 9 aa, Influenza virus
SGVAIALSI

SEQ ID NO: 332109 - protein, 9 aa, Influenza virus
GVAIALSIL

SEQ ID NO: 332110 - protein, 9 aa, Influenza virus
VAIALSILN

SEQ ID NO: 332111 - protein, 9 aa, Influenza virus
AIALSILNL

SEQ ID NO: 332112 - protein, 9 aa, Influenza virus
IALSILNLL

SEQ ID NO: 332113 - protein, 9 aa, Influenza virus
ALSILNLLI

SEQ ID NO: 332114 - protein, 9 aa, Influenza virus
LSILNLLIG

SEQ ID NO: 332115 - protein, 9 aa, Influenza virus
SILNLLIGI

SEQ ID NO: 332116 - protein, 9 aa, Influenza virus
ILNLLIGIS

SEQ ID NO: 332117 - protein, 9 aa, Influenza virus
INLLIGISN

SEQ ID NO: 332118 - protein, 9 aa, Influenza virus
NLLIGISNM

SEQ ID NO: 332119 - protein, 9 aa, Influenza virus
LLIGISNMS

SEQ ID NO: 332120 - protein, 9 aa, Influenza virus
LIGISNMSL

SEQ ID NO: 332121 - protein, 9 aa, Influenza virus
IGISNMSLN

SEQ ID NO: 332122 - protein, 9 aa, Influenza virus
SNMSLNISL

SEQ ID NO: 332123 - protein, 9 aa, Influenza virus
NMSLNISLY

SEQ ID NO: 332124 - protein, 9 aa, Influenza virus
MSLNISLYS

SEQ ID NO: 332125 - protein, 9 aa, Influenza virus
SLNISLYSK

SEQ ID NO: 332126 - protein, 9 aa, Influenza virus
KNTYVNNTT

SEQ ID NO: 332127 - protein, 9 aa, Influenza virus
NTYVNNTTV

SEQ ID NO: 332128 - protein, 9 aa, Influenza virus
TYVNNTTVI

SEQ ID NO: 332129 - protein, 9 aa, Influenza virus
NYLMLNKSL

SEQ ID NO: 332130 - protein, 9 aa, Influenza virus
YLMLNKSLC

SEQ ID NO: 332131 - protein, 9 aa, Influenza virus
LMLNKSLCK

SEQ ID NO: 332132 - protein, 9 aa, Influenza virus
MLNKSLCKV

SEQ ID NO: 332133 - protein, 9 aa, Influenza virus
LNKSLCKVE

SEQ ID NO: 332134 - protein, 9 aa, Influenza virus
NKSLCKVEG

SEQ ID NO: 332135 - protein, 9 aa, Influenza virus
KSLCKVEGW

SEQ ID NO: 332136 - protein, 9 aa, Influenza virus
SLCKVEGWV

SEQ ID NO: 332137 - protein, 9 aa, Influenza virus
LCKVEGWVV

SEQ ID NO: 332138 - protein, 9 aa, Influenza virus
CKVEGWVVV

SEQ ID NO: 332139 - protein, 9 aa, Influenza virus
VEGWVVVAK

SEQ ID NO: 332140 - protein, 9 aa, Influenza virus
EGWVVVAKD

SEQ ID NO: 332141 - protein, 9 aa, Influenza virus
GWVVVAKDN

SEQ ID NO: 332142 - protein, 9 aa, Influenza virus
WVVVAKDNA

SEQ ID NO: 332143 - protein, 9 aa, Influenza virus
VVVAKDNAI

SEQ ID NO: 332144 - protein, 9 aa, Influenza virus
VVAKDNAIR

SEQ ID NO: 332145 - protein, 9 aa, Influenza virus
VAKDNAIRF

SEQ ID NO: 332146 - protein, 9 aa, Influenza virus
AKDNAIRFG

SEQ ID NO: 332147 - protein, 9 aa, Influenza virus
KDNAIRFGE

SEQ ID NO: 332148 - protein, 9 aa, Influenza virus
DNAIRFGES

SEQ ID NO: 332149 - protein, 9 aa, Influenza virus
NAIRFGESE

SEQ ID NO: 332150 - protein, 9 aa, Influenza virus
AIRFGESEQ

SEQ ID NO: 332151 - protein, 9 aa, Influenza virus
IRFGESEQI

SEQ ID NO: 332152 - protein, 9 aa, Influenza virus
RFGESEQVI

SEQ ID NO: 332153 - protein, 9 aa, Influenza virus
FGESEQVIV

SEQ ID NO: 332154 - protein, 9 aa, Influenza virus
GESEQVIVT

SEQ ID NO: 332155 - protein, 9 aa, Influenza virus
ESEQVIVTR

SEQ ID NO: 332156 - protein, 9 aa, Influenza virus
SEQVIVTRE

SEQ ID NO: 332157 - protein, 9 aa, Influenza virus
EQVIVTREP

SEQ ID NO: 332158 - protein, 9 aa, Influenza virus
QVIVTREPY

SEQ ID NO: 332159 - protein, 9 aa, Influenza virus
VIVTREPYV

SEQ ID NO: 332160 - protein, 9 aa, Influenza virus
VVTREPYVS

SEQ ID NO: 332161 - protein, 9 aa, Influenza virus
EPYVSCDPL

SEQ ID NO: 332162 - protein, 9 aa, Influenza virus
SCKMYALHQ

SEQ ID NO: 332163 - protein, 9 aa, Influenza virus
CRMYALHQG

SEQ ID NO: 332164 - protein, 9 aa, Influenza virus
RMYALHQGT

SEQ ID NO: 332165 - protein, 9 aa, Influenza virus
TIRNKHSNS

SEQ ID NO: 332166 - protein, 9 aa, Influenza virus
IRNKHSNST

SEQ ID NO: 332167 - protein, 9 aa, Influenza virus
RNKHSNSTT

SEQ ID NO: 332168 - protein, 9 aa, Influenza virus
NKHSNSTTH

SEQ ID NO: 332169 - protein, 9 aa, Influenza virus
KHSNSTTHD

SEQ ID NO: 332170 - protein, 9 aa, Influenza virus
HSNSTTHDR

SEQ ID NO: 332171 - protein, 9 aa, Influenza virus
SNSTTHDRT

SEQ ID NO: 332172 - protein, 9 aa, Influenza virus
NSTTHDRTA

SEQ ID NO: 332173 - protein, 9 aa, Influenza virus
STTHDRTAF

SEQ ID NO: 332174 - protein, 9 aa, Influenza virus
TTHDRTAFR

SEQ ID NO: 332175 - protein, 9 aa, Influenza virus
THDRTAFRG

SEQ ID NO: 332176 - protein, 9 aa, Influenza virus
HDRTTFRGL

SEQ ID NO: 332177 - protein, 9 aa, Influenza virus
DRTTFRGLL

SEQ ID NO: 332178 - protein, 9 aa, Influenza virus
RTAFRGLMS

SEQ ID NO: 332179 - protein, 9 aa, Influenza virus
AAFRGLIST

SEQ ID NO: 332180 - protein, 9 aa, Influenza virus
FRGLISTHL

SEQ ID NO: 332181 - protein, 9 aa, Influenza virus
RGLISTHLG

SEQ ID NO: 332182 - protein, 9 aa, Influenza virus
SNSDFLCVG

SEQ ID NO: 332183 - protein, 9 aa, Influenza virus
NSDFICVGW

SEQ ID NO: 332184 - protein, 9 aa, Influenza virus
SDFICVGWS

SEQ ID NO: 332185 - protein, 9 aa, Influenza virus
DFLCVGWSS

SEQ ID NO: 332186 - protein, 9 aa, Influenza virus
FICVGWSST

SEQ ID NO: 332187 - protein, 9 aa, Influenza virus
ICVGWSSTS

SEQ ID NO: 332188 - protein, 9 aa, Influenza virus
CVGWSSTSC

SEQ ID NO: 332189 - protein, 9 aa, Influenza virus
VGWSSTSCH

SEQ ID NO: 332190 - protein, 9 aa, Influenza virus
GWSSTSCHD

SEQ ID NO: 332191 - protein, 9 aa, Influenza virus
WSSTSCHDG

SEQ ID NO: 332192 - protein, 9 aa, Influenza virus
SSTSCHDGI

SEQ ID NO: 332193 - protein, 9 aa, Influenza virus
CHDGVGRMT

SEQ ID NO: 332194 - protein, 9 aa, Influenza virus
HDGVGRMTI

SEQ ID NO: 332195 - protein, 9 aa, Influenza virus
DGVGRMTIC

SEQ ID NO: 332196 - protein, 9 aa, Influenza virus
GRMTICVQG

SEQ ID NO: 332197 - protein, 9 aa, Influenza virus
RMTICVQGN

SEQ ID NO: 332198 - protein, 9 aa, Influenza virus
MTICVQGNN

SEQ ID NO: 332199 - protein, 9 aa, Influenza virus
QGDNENATA

SEQ ID NO: 332200 - protein, 9 aa, Influenza virus
GDNENATAT

SEQ ID NO: 332201 - protein, 9 aa, Influenza virus
DNENATATV

SEQ ID NO: 332202 - protein, 9 aa, Influenza virus
NENATATVY

SEQ ID NO: 332203 - protein, 9 aa, Influenza virus
ENATATVYY

SEQ ID NO: 332204 - protein, 9 aa, Influenza virus
NATATVYYD

SEQ ID NO: 332205 - protein, 9 aa, Influenza virus
ATATVYYDR

SEQ ID NO: 332206 - protein, 9 aa, Influenza virus
TATVYYDRR

SEQ ID NO: 332207 - protein, 9 aa, Influenza virus
ATVYYDRRL

SEQ ID NO: 332208 - protein, 9 aa, Influenza virus
TVYYDRRLT

SEQ ID NO: 332209 - protein, 9 aa, Influenza virus
VYYDRRLTT

SEQ ID NO: 332210 - protein, 9 aa, Influenza virus
YYDRRLTTT

SEQ ID NO: 332211 - protein, 9 aa, Influenza virus
YDRRLTTTI

SEQ ID NO: 332212 - protein, 9 aa, Influenza virus
KRLTTTIKT

SEQ ID NO: 332213 - protein, 9 aa, Influenza virus
RLTTTIRTW

SEQ ID NO: 332214 - protein, 9 aa, Influenza virus
LTTTIRTWA

SEQ ID NO: 332215 - protein, 9 aa, Influenza virus
TTTIKTWAK

SEQ ID NO: 332216 - protein, 9 aa, Influenza virus
TTIKTWAKN

SEQ ID NO: 332217 - protein, 9 aa, Influenza virus
TIKTWAKNI

SEQ ID NO: 332218 - protein, 9 aa, Influenza virus
IKTWAKNIL

SEQ ID NO: 332219 - protein, 9 aa, Influenza virus
KTWAKNILR

SEQ ID NO: 332220 - protein, 9 aa, Influenza virus
TWAKNILRT

SEQ ID NO: 332221 - protein, 9 aa, Influenza virus
WAKNILRTQ

SEQ ID NO: 332222 - protein, 9 aa, Influenza virus
AKNILRTQE

SEQ ID NO: 332223 - protein, 9 aa, Influenza virus
KNILRTQES

SEQ ID NO: 332224 - protein, 9 aa, Influenza virus
NILRTQDSE

SEQ ID NO: 332225 - protein, 9 aa, Influenza virus
ILRTQDSEC

SEQ ID NO: 332226 - protein, 9 aa, Influenza virus
LRTQDSECV

SEQ ID NO: 332227 - protein, 9 aa, Influenza virus
RTQESECVR

SEQ ID NO: 332228 - protein, 9 aa, Influenza virus
TQESECVRH

SEQ ID NO: 332229 - protein, 9 aa, Influenza virus
QESECVRHN

SEQ ID NO: 332230 - protein, 9 aa, Influenza virus
ESECVCHNS

SEQ ID NO: 332231 - protein, 9 aa, Influenza virus
SECVCHNST

SEQ ID NO: 332232 - protein, 9 aa, Influenza virus
ECVCHNSTC

SEQ ID NO: 332233 - protein, 9 aa, Influenza virus
CVCHNGTCV

SEQ ID NO: 332234 - protein, 9 aa, Influenza virus
VCHNGTCVV

SEQ ID NO: 332235 - protein, 9 aa, Influenza virus
HNSTCVVVM

SEQ ID NO: 332236 - protein, 9 aa, Influenza virus
NSTCVVVMT

SEQ ID NO: 332237 - protein, 9 aa, Influenza virus
STCVVVMTD

SEQ ID NO: 332238 - protein, 9 aa, Influenza virus
TCVVVMTDG

SEQ ID NO: 332239 - protein, 9 aa, Influenza virus
VVVMTDGPA

SEQ ID NO: 332240 - protein, 9 aa, Influenza virus
VVMTDGPAN

SEQ ID NO: 332241 - protein, 9 aa, Influenza virus
VMTDGPANN

SEQ ID NO: 332242 - protein, 9 aa, Influenza virus
MTDGPANNQ

SEQ ID NO: 332243 - protein, 9 aa, Influenza virus
TDGPANNQA

SEQ ID NO: 332244 - protein, 9 aa, Influenza virus
LKGSAKHIE

SEQ ID NO: 332245 - protein, 9 aa, Influenza virus
KGSAKHIEE

SEQ ID NO: 332246 - protein, 9 aa, Influenza virus
GSAKHIEEC

SEQ ID NO: 332247 - protein, 9 aa, Influenza virus
SAKHIEECS

SEQ ID NO: 332248 - protein, 9 aa, Influenza virus
AKHIEECSC

SEQ ID NO: 332249 - protein, 9 aa, Influenza virus
KHIEECSCY

SEQ ID NO: 332250 - protein, 9 aa, Influenza virus
HIEEWSCYG

SEQ ID NO: 332251 - protein, 9 aa, Influenza virus
IEEWSCYGH

SEQ ID NO: 332252 - protein, 9 aa, Influenza virus
EECSCYGHS

SEQ ID NO: 332253 - protein, 9 aa, Influenza virus
ATCVCRDNW

SEQ ID NO: 332254 - protein, 9 aa, Influenza virus
SCVCRDNWQ

SEQ ID NO: 332255 - protein, 9 aa, Influenza virus
CGCRDNWQG

SEQ ID NO: 332256 - protein, 9 aa, Influenza virus
GCRDNWQGA

SEQ ID NO: 332257 - protein, 9 aa, Influenza virus
NWQGANRPV

SEQ ID NO: 332258 - protein, 9 aa, Influenza virus
WQGANRPVI

SEQ ID NO: 332259 - protein, 9 aa, Influenza virus
QGANRPVIE

SEQ ID NO: 332260 - protein, 9 aa, Influenza virus
GANRPVIEI

SEQ ID NO: 332261 - protein, 9 aa, Influenza virus
ANRPVIEID

SEQ ID NO: 332262 - protein, 9 aa, Influenza virus
NRPVIEIDM

SEQ ID NO: 332263 - protein, 9 aa, Influenza virus
RPVIEIDMN

SEQ ID NO: 332264 - protein, 9 aa, Influenza virus
LEHTSRYIC

SEQ ID NO: 332265 - protein, 9 aa, Influenza virus
EHTSRYICT

SEQ ID NO: 332266 - protein, 9 aa, Influenza virus
HTSRYICTG

SEQ ID NO: 332267 - protein, 9 aa, Influenza virus
YLCTGVLTD

SEQ ID NO: 332268 - protein, 9 aa, Influenza virus
LCTGVLTDT

SEQ ID NO: 332269 - protein, 9 aa, Influenza virus
CTGVLTDTS

SEQ ID NO: 332270 - protein, 9 aa, Influenza virus
TGVLTDTSR

SEQ ID NO: 332271 - protein, 9 aa, Influenza virus
GVLTDTSRP

SEQ ID NO: 332272 - protein, 9 aa, Influenza virus
VLTDTSRPS

SEQ ID NO: 332273 - protein, 9 aa, Influenza virus
LTDTSRPSD

SEQ ID NO: 332274 - protein, 9 aa, Influenza virus
TDTSRPSDK

SEQ ID NO: 332275 - protein, 9 aa, Influenza virus
GDCNNPITG

SEQ ID NO: 332276 - protein, 9 aa, Influenza virus
DCNNPITGS

SEQ ID NO: 332277 - protein, 9 aa, Influenza virus
CNNPITGSP

SEQ ID NO: 332278 - protein, 9 aa, Influenza virus
NNPITGSPG

SEQ ID NO: 332279 - protein, 9 aa, Influenza virus
NPITGSPGV

SEQ ID NO: 332280 - protein, 9 aa, Influenza virus
PITGSPGVP

SEQ ID NO: 332281 - protein, 9 aa, Influenza virus
ITGSPGVPG

SEQ ID NO: 332282 - protein, 9 aa, Influenza virus
APGIKGFGF

SEQ ID NO: 332283 - protein, 9 aa, Influenza virus
PGIKGFGFL

SEQ ID NO: 332284 - protein, 9 aa, Influenza virus
GVKGFGFLD

SEQ ID NO: 332285 - protein, 9 aa, Influenza virus
VKGFGFLDS

SEQ ID NO: 332286 - protein, 9 aa, Influenza virus
GNTWLGRTI

SEQ ID NO: 332287 - protein, 9 aa, Influenza virus
STWLGRTIS

SEQ ID NO: 332288 - protein, 9 aa, Influenza virus
WLGRTISPK

SEQ ID NO: 332289 - protein, 9 aa, Influenza virus
LGRTISPRL

SEQ ID NO: 332290 - protein, 9 aa, Influenza virus
GRTISPRLR

SEQ ID NO: 332291 - protein, 9 aa, Influenza virus
RTISPRLRS

SEQ ID NO: 332292 - protein, 9 aa, Influenza virus
TISPRLRSG

SEQ ID NO: 332293 - protein, 9 aa, Influenza virus
ISPRLRSGF

SEQ ID NO: 332294 - protein, 9 aa, Influenza virus
SPRLRSGFE

SEQ ID NO: 332295 - protein, 9 aa, Influenza virus
PRLRSGFEM

SEQ ID NO: 332296 - protein, 9 aa, Influenza virus
RLRSGFEML

SEQ ID NO: 332297 - protein, 9 aa, Influenza virus
LRSGFEMLK

SEQ ID NO: 332298 - protein, 9 aa, Influenza virus
RNGFEMLKI

SEQ ID NO: 332299 - protein, 9 aa, Influenza virus
SGFEMLRIP

SEQ ID NO: 332300 - protein, 9 aa, Influenza virus
GFEMLKIHN

SEQ ID NO: 332301 - protein, 9 aa, Influenza virus
FEMLKIHNA

SEQ ID NO: 332302 - protein, 9 aa, Influenza virus
EMLKIPNAE

SEQ ID NO: 332303 - protein, 9 aa, Influenza virus
MLKIPNAET

SEQ ID NO: 332304 - protein, 9 aa, Influenza virus
LKIPNAETD

SEQ ID NO: 332305 - protein, 9 aa, Influenza virus
KIPNAETDP

SEQ ID NO: 332306 - protein, 9 aa, Influenza virus
RQEIVSNDN

SEQ ID NO: 332307 - protein, 9 aa, Influenza virus
QEIVSNDNW

SEQ ID NO: 332308 - protein, 9 aa, Influenza virus
EIVSNDNWS

SEQ ID NO: 332309 - protein, 9 aa, Influenza virus
IVSNDNWSG

SEQ ID NO: 332310 - protein, 9 aa, Influenza virus
VSNDNWSGY

SEQ ID NO: 332311 - protein, 9 aa, Influenza virus
SNDNWSGYS

SEQ ID NO: 332312 - protein, 9 aa, Influenza virus
NDNWSGYSG

SEQ ID NO: 332313 - protein, 9 aa, Influenza virus
DNWSGYSGS

SEQ ID NO: 332314 - protein, 9 aa, Influenza virus
NRSGYSGSF

SEQ ID NO: 332315 - protein, 9 aa, Influenza virus
RSGYSGSFI

SEQ ID NO: 332316 - protein, 9 aa, Influenza virus
SGSFIDYWD

SEQ ID NO: 332317 - protein, 9 aa, Influenza virus
GSFIDYWDE

SEQ ID NO: 332318 - protein, 9 aa, Influenza virus
NECYNPCFY

SEQ ID NO: 332319 - protein, 9 aa, Influenza virus
RPEEAKYVE

SEQ ID NO: 332320 - protein, 9 aa, Influenza virus
PEEAKYVEW

SEQ ID NO: 332321 - protein, 9 aa, Influenza virus
EEAKYVEWT

SEQ ID NO: 332322 - protein, 9 aa, Influenza virus
EAKYVEWTS

SEQ ID NO: 332323 - protein, 9 aa, Influenza virus
AKYVEWTSN

SEQ ID NO: 332324 - protein, 9 aa, Influenza virus
KYVEWTSNS

SEQ ID NO: 332325 - protein, 9 aa, Influenza virus
YVEWTSNSL

SEQ ID NO: 332326 - protein, 9 aa, Influenza virus
VWWTSNSLV

SEQ ID NO: 332327 - protein, 9 aa, Influenza virus
WWTSNSLVA

SEQ ID NO: 332328 - protein, 9 aa, Influenza virus
WTSNSLVAL

SEQ ID NO: 332329 - protein, 9 aa, Influenza virus
TSNSLVALC

SEQ ID NO: 332330 - protein, 9 aa, Influenza virus
SNSLVALCG

SEQ ID NO: 332331 - protein, 9 aa, Influenza virus
NSLVALCGS

SEQ ID NO: 332332 - protein, 9 aa, Influenza virus
SLVALCGSP

SEQ ID NO: 332333 - protein, 9 aa, Influenza virus
SVGSGSFPD

SEQ ID NO: 332334 - protein, 9 aa, Influenza virus
VGPGSFPDG

SEQ ID NO: 332335 - protein, 9 aa, Influenza virus
GPGSFPDGA

SEQ ID NO: 332336 - protein, 9 aa, Influenza virus
PGSFPDGAQ

SEQ ID NO: 332337 - protein, 9 aa, Influenza virus
GFFPDGPQI

SEQ ID NO: 332338 - protein, 9 aa, Influenza virus
SFPDGAQIK

SEQ ID NO: 332339 - protein, 9 aa, Influenza virus
FPDGAQIKY

SEQ ID NO: 332340 - protein, 9 aa, Influenza virus
PDGAQIKYF

SEQ ID NO: 332341 - protein, 9 aa, Influenza virus
DGAQIKYFS

SEQ ID NO: 332342 - protein, 9 aa, Influenza virus
LLVSTNAYD

SEQ ID NO: 332343 - protein, 9 aa, Influenza virus
LVSTNAYDR

SEQ ID NO: 332344 - protein, 9 aa, Influenza virus
VSTNAYDRI

SEQ ID NO: 332345 - protein, 9 aa, Influenza virus
STNAHDRIC

SEQ ID NO: 332346 - protein, 9 aa, Influenza virus
TNAHDRICI

SEQ ID NO: 332347 - protein, 9 aa, Influenza virus
NAHDRICIG

SEQ ID NO: 332348 - protein, 9 aa, Influenza virus
AHDRICIGY

SEQ ID NO: 332349 - protein, 9 aa, Influenza virus
HDRICIGYQ

SEQ ID NO: 332350 - protein, 9 aa, Influenza virus
GYQSNNSTN

SEQ ID NO: 332351 - protein, 9 aa, Influenza virus
YQSNNSTNT

SEQ ID NO: 332352 - protein, 9 aa, Influenza virus
QSNNSTNTV

SEQ ID NO: 332353 - protein, 9 aa, Influenza virus
SNNSTNTVN

SEQ ID NO: 332354 - protein, 9 aa, Influenza virus
NNSTDTVDT

SEQ ID NO: 332355 - protein, 9 aa, Influenza virus
NSTDTVDTL

SEQ ID NO: 332356 - protein, 9 aa, Influenza virus
STNTVNTLI

SEQ ID NO: 332357 - protein, 9 aa, Influenza virus
TNTVNTLIE

SEQ ID NO: 332358 - protein, 9 aa, Influenza virus
DTVDTLIEQ

SEQ ID NO: 332359 - protein, 9 aa, Influenza virus
TVNTLMEQN

SEQ ID NO: 332360 - protein, 9 aa, Influenza virus
TLMEQNVPV

SEQ ID NO: 332361 - protein, 9 aa, Influenza virus
LIEQNIPVT

SEQ ID NO: 332362 - protein, 9 aa, Influenza virus
IEQNIPVTQ

SEQ ID NO: 332363 - protein, 9 aa, Influenza virus
EQNVPVTQA

SEQ ID NO: 332364 - protein, 9 aa, Influenza virus
QNVPVTQAM

SEQ ID NO: 332365 - protein, 9 aa, Influenza virus
NVPVTQAME

SEQ ID NO: 332366 - protein, 9 aa, Influenza virus
VPVTQAMEL

SEQ ID NO: 332367 - protein, 9 aa, Influenza virus
PVTQAMELV

SEQ ID NO: 332368 - protein, 9 aa, Influenza virus
VTQAMELVE

SEQ ID NO: 332369 - protein, 9 aa, Influenza virus
TQTMELVEA

SEQ ID NO: 332370 - protein, 9 aa, Influenza virus
QTMELVEAE

SEQ ID NO: 332371 - protein, 9 aa, Influenza virus
TMELVEAEK

SEQ ID NO: 332372 - protein, 9 aa, Influenza virus
MELVEAEKH

SEQ ID NO: 332373 - protein, 9 aa, Influenza virus
EKHSAYCNT

SEQ ID NO: 332374 - protein, 9 aa, Influenza virus
KHSAYCNTD

SEQ ID NO: 332375 - protein, 9 aa, Influenza virus
HSAYCNTDL

SEQ ID NO: 332376 - protein, 9 aa, Influenza virus
SAYCNTDLG

SEQ ID NO: 332377 - protein, 9 aa, Influenza virus
AYCNTDLGT

SEQ ID NO: 332378 - protein, 9 aa, Influenza virus
YCNTDLGTP

SEQ ID NO: 332379 - protein, 9 aa, Influenza virus
CNTDLGTPL

SEQ ID NO: 332380 - protein, 9 aa, Influenza virus
NTDLGTPLE

SEQ ID NO: 332381 - protein, 9 aa, Influenza virus
TDLGTPLEL

SEQ ID NO: 332382 - protein, 9 aa, Influenza virus
DLGTPLELR

SEQ ID NO: 332383 - protein, 9 aa, Influenza virus
LGTPLELRD

SEQ ID NO: 332384 - protein, 9 aa, Influenza virus
GTPLELRDC

SEQ ID NO: 332385 - protein, 9 aa, Influenza virus
TPLELRDCK

SEQ ID NO: 332386 - protein, 9 aa, Influenza virus
PLELRDCKV

SEQ ID NO: 332387 - protein, 9 aa, Influenza virus
LELRDCKVE

SEQ ID NO: 332388 - protein, 9 aa, Influenza virus
ELRDCKVEA

SEQ ID NO: 332389 - protein, 9 aa, Influenza virus
LRDCKVEAV

SEQ ID NO: 332390 - protein, 9 aa, Influenza virus
RDCKVEAVI

SEQ ID NO: 332391 - protein, 9 aa, Influenza virus
DCKVEAVIY

SEQ ID NO: 332392 - protein, 9 aa, Influenza virus
CKVEAVIYG

SEQ ID NO: 332393 - protein, 9 aa, Influenza virus
KVEAVIYGN

SEQ ID NO: 332394 - protein, 9 aa, Influenza virus
VEAVIYGNP

SEQ ID NO: 332395 - protein, 9 aa, Influenza virus
IYGNPKCDV

SEQ ID NO: 332396 - protein, 9 aa, Influenza virus
YGNPKCDVH

SEQ ID NO: 332397 - protein, 9 aa, Influenza virus
GNPKCDVHL

SEQ ID NO: 332398 - protein, 9 aa, Influenza virus
NPKCDVHLK

SEQ ID NO: 332399 - protein, 9 aa, Influenza virus
PKCDVHLKD

SEQ ID NO: 332400 - protein, 9 aa, Influenza virus
KCDVHLKDQ

SEQ ID NO: 332401 - protein, 9 aa, Influenza virus
HLKDQSWSY

SEQ ID NO: 332402 - protein, 9 aa, Influenza virus
LKDQDWSYI

SEQ ID NO: 332403 - protein, 9 aa, Influenza virus
KDQDWSYIV

SEQ ID NO: 332404 - protein, 9 aa, Influenza virus
DQSWSYIVE

SEQ ID NO: 332405 - protein, 9 aa, Influenza virus
QDWSYIVER

SEQ ID NO: 332406 - protein, 9 aa, Influenza virus
SWSYIVERP

SEQ ID NO: 332407 - protein, 9 aa, Influenza virus
PEGMCYPGF

SEQ ID NO: 332408 - protein, 9 aa, Influenza virus
EGMCYPGSI

SEQ ID NO: 332409 - protein, 9 aa, Influenza virus
GMCYPGSIE

SEQ ID NO: 332410 - protein, 9 aa, Influenza virus
MCYPGSIEN

SEQ ID NO: 332411 - protein, 9 aa, Influenza virus
CYPGSIENL

SEQ ID NO: 332412 - protein, 9 aa, Influenza virus
YPGSIENLE

SEQ ID NO: 332413 - protein, 9 aa, Influenza virus
PGSIENLEE

SEQ ID NO: 332414 - protein, 9 aa, Influenza virus
GSIENLEEL

SEQ ID NO: 332415 - protein, 9 aa, Influenza virus
SIENLEELR

SEQ ID NO: 332416 - protein, 9 aa, Influenza virus
IENLEELRF

SEQ ID NO: 332417 - protein, 9 aa, Influenza virus
EELRFVFSS

SEQ ID NO: 332418 - protein, 9 aa, Influenza virus
ELRFVFSSA

SEQ ID NO: 332419 - protein, 9 aa, Influenza virus
LRFVFSSAA

SEQ ID NO: 332420 - protein, 9 aa, Influenza virus
RFVFSSAAS

SEQ ID NO: 332421 - protein, 9 aa, Influenza virus
FVFSSAASY

SEQ ID NO: 332422 - protein, 9 aa, Influenza virus
VFSSAASYK

SEQ ID NO: 332423 - protein, 9 aa, Influenza virus
FSSAASYKR

SEQ ID NO: 332424 - protein, 9 aa, Influenza virus
SSAASYKRI

SEQ ID NO: 332425 - protein, 9 aa, Influenza virus
SAASYKRIR

SEQ ID NO: 332426 - protein, 9 aa, Influenza virus
AASYKRVRL

SEQ ID NO: 332427 - protein, 9 aa, Influenza virus
ASYKRVRLF

SEQ ID NO: 332428 - protein, 9 aa, Influenza virus
SYKRVRLFD

SEQ ID NO: 332429 - protein, 9 aa, Influenza virus
YKRVRLFDY

SEQ ID NO: 332430 - protein, 9 aa, Influenza virus
KRVRLFDYS

SEQ ID NO: 332431 - protein, 9 aa, Influenza virus
RIRLFDYSK

SEQ ID NO: 332432 - protein, 9 aa, Influenza virus
IRLFDYSKW

SEQ ID NO: 332433 - protein, 9 aa, Influenza virus
RLFDYSKWN

SEQ ID NO: 332434 - protein, 9 aa, Influenza virus
LFDYSKWNV

SEQ ID NO: 332435 - protein, 9 aa, Influenza virus
FDYSKWNVT

SEQ ID NO: 332436 - protein, 9 aa, Influenza virus
WNVTRSGTS

SEQ ID NO: 332437 - protein, 9 aa, Influenza virus
NVTRSGTSK

SEQ ID NO: 332438 - protein, 9 aa, Influenza virus
VTRSGTSKA

SEQ ID NO: 332439 - protein, 9 aa, Influenza virus
TRSGTSKAC

SEQ ID NO: 332440 - protein, 9 aa, Influenza virus
RSGTSKACN

SEQ ID NO: 332441 - protein, 9 aa, Influenza virus
SGTSKACSA

SEQ ID NO: 332442 - protein, 9 aa, Influenza virus
GTSKACSAS

SEQ ID NO: 332443 - protein, 9 aa, Influenza virus
TSKACSAST

SEQ ID NO: 332444 - protein, 9 aa, Influenza virus
SKACSASTG

SEQ ID NO: 332445 - protein, 9 aa, Influenza virus
KACSASTGG

SEQ ID NO: 332446 - protein, 9 aa, Influenza virus
ACSASTGGQ

SEQ ID NO: 332447 - protein, 9 aa, Influenza virus
CNASTGGQA

SEQ ID NO: 332448 - protein, 9 aa, Influenza virus
NASTGGQAF

SEQ ID NO: 332449 - protein, 9 aa, Influenza virus
ASTGGQAFY

SEQ ID NO: 332450 - protein, 9 aa, Influenza virus
STGGQAFYR

SEQ ID NO: 332451 - protein, 9 aa, Influenza virus
TGGQAFYRS

SEQ ID NO: 332452 - protein, 9 aa, Influenza virus
GGQAFYRSI

SEQ ID NO: 332453 - protein, 9 aa, Influenza virus
GQAFYRSIN

SEQ ID NO: 332454 - protein, 9 aa, Influenza virus
QAFYRSINW

SEQ ID NO: 332455 - protein, 9 aa, Influenza virus
AFYRSINWL

SEQ ID NO: 332456 - protein, 9 aa, Influenza virus
SINWLTKKE

SEQ ID NO: 332457 - protein, 9 aa, Influenza virus
INWLTKKKN

SEQ ID NO: 332458 - protein, 9 aa, Influenza virus
NWLTKKKNP

SEQ ID NO: 332459 - protein, 9 aa, Influenza virus
WLTKKKNPE

SEQ ID NO: 332460 - protein, 9 aa, Influenza virus
LTKKKNPEA

SEQ ID NO: 332461 - protein, 9 aa, Influenza virus
TKKKNPEAY

SEQ ID NO: 332462 - protein, 9 aa, Influenza virus
KKKNPEAYN

SEQ ID NO: 332463 - protein, 9 aa, Influenza virus
KKNPEAYNF

SEQ ID NO: 332464 - protein, 9 aa, Influenza virus
KNPEAYNFN

SEQ ID NO: 332465 - protein, 9 aa, Influenza virus
PEAYNFNEG

SEQ ID NO: 332466 - protein, 9 aa, Influenza virus
DTYDFNEGT

SEQ ID NO: 332467 - protein, 9 aa, Influenza virus
TYDFNEGTY

SEQ ID NO: 332468 - protein, 9 aa, Influenza virus
FNEGTYINN

SEQ ID NO: 332469 - protein, 9 aa, Influenza virus
NNEDGNIIF

SEQ ID NO: 332470 - protein, 9 aa, Influenza virus
NEDGNIIFL

SEQ ID NO: 332471 - protein, 9 aa, Influenza virus
EDGNIIFLW

SEQ ID NO: 332472 - protein, 9 aa, Influenza virus
DGNIIFLWG

SEQ ID NO: 332473 - protein, 9 aa, Influenza virus
GNIIFLWGI

SEQ ID NO: 332474 - protein, 9 aa, Influenza virus
NIIFLWGIH

SEQ ID NO: 332475 - protein, 9 aa, Influenza virus
LWGIHHPPN

SEQ ID NO: 332476 - protein, 9 aa, Influenza virus
WGIHHPPDA

SEQ ID NO: 332477 - protein, 9 aa, Influenza virus
GIHHPPDAK

SEQ ID NO: 332478 - protein, 9 aa, Influenza virus
IHHPPDAKE

SEQ ID NO: 332479 - protein, 9 aa, Influenza virus
HHPPDAKEQ

SEQ ID NO: 332480 - protein, 9 aa, Influenza virus
HPPDAKEQT

SEQ ID NO: 332481 - protein, 9 aa, Influenza virus
AKEQTTLYK

SEQ ID NO: 332482 - protein, 9 aa, Influenza virus
KEQTALYKN

SEQ ID NO: 332483 - protein, 9 aa, Influenza virus
EQTALYKNA

SEQ ID NO: 332484 - protein, 9 aa, Influenza virus
QTALYKNAN

SEQ ID NO: 332485 - protein, 9 aa, Influenza virus
TALYKNANT

SEQ ID NO: 332486 - protein, 9 aa, Influenza virus
ALYKNANTL

SEQ ID NO: 332487 - protein, 9 aa, Influenza virus
LYKNTNTLS

SEQ ID NO: 332488 - protein, 9 aa, Influenza virus
YKNTNTLSS

SEQ ID NO: 332489 - protein, 9 aa, Influenza virus
KNTNTLSSV

SEQ ID NO: 332490 - protein, 9 aa, Influenza virus
NTNTLSSVT

SEQ ID NO: 332491 - protein, 9 aa, Influenza virus
TNTLSSVTT

SEQ ID NO: 332492 - protein, 9 aa, Influenza virus
NTLSSVNTN

SEQ ID NO: 332493 - protein, 9 aa, Influenza virus
TLSSVNTNT

SEQ ID NO: 332494 - protein, 9 aa, Influenza virus
LSSVNTNTI

SEQ ID NO: 332495 - protein, 9 aa, Influenza virus
SSVNTNTIN

SEQ ID NO: 332496 - protein, 9 aa, Influenza virus
SVNTNTINR

SEQ ID NO: 332497 - protein, 9 aa, Influenza virus
VTTNTINRI

SEQ ID NO: 332498 - protein, 9 aa, Influenza virus
TTNTINRIF

SEQ ID NO: 332499 - protein, 9 aa, Influenza virus
TNTINRIFQ

SEQ ID NO: 332500 - protein, 9 aa, Influenza virus
NTINRIFQP

SEQ ID NO: 332501 - protein, 9 aa, Influenza virus
TINRSFRPN

SEQ ID NO: 332502 - protein, 9 aa, Influenza virus
INRSFRPNI

SEQ ID NO: 332503 - protein, 9 aa, Influenza virus
NRIFQPNIG

SEQ ID NO: 332504 - protein, 9 aa, Influenza virus
RIFQPNIGP

SEQ ID NO: 332505 - protein, 9 aa, Influenza virus
IFQPNIGPR

SEQ ID NO: 332506 - protein, 9 aa, Influenza virus
FRPNIGPRP

SEQ ID NO: 332507 - protein, 9 aa, Influenza virus
RPNIGPRPL

SEQ ID NO: 332508 - protein, 9 aa, Influenza virus
PNIGPRALV

SEQ ID NO: 332509 - protein, 9 aa, Influenza virus
NIGPRALVR

SEQ ID NO: 332510 - protein, 9 aa, Influenza virus
IGPRPLVRE

SEQ ID NO: 332511 - protein, 9 aa, Influenza virus
GPRPLVREQ

SEQ ID NO: 332512 - protein, 9 aa, Influenza virus
PRPLVREQQ

SEQ ID NO: 332513 - protein, 9 aa, Influenza virus
RALVRGQQG

SEQ ID NO: 332514 - protein, 9 aa, Influenza virus
PLVRGQQGT

SEQ ID NO: 332515 - protein, 9 aa, Influenza virus
LVRGQQGTM

SEQ ID NO: 332516 - protein, 9 aa, Influenza virus
VRGQQGWMD

SEQ ID NO: 332517 - protein, 9 aa, Influenza virus
REQQGRMDY

SEQ ID NO: 332518 - protein, 9 aa, Influenza virus
EQQGRMDYY

SEQ ID NO: 332519 - protein, 9 aa, Influenza virus
QQGWMDYYW

SEQ ID NO: 332520 - protein, 9 aa, Influenza virus
QGWMDYYWG

SEQ ID NO: 332521 - protein, 9 aa, Influenza virus
GTMDYYWGI

SEQ ID NO: 332522 - protein, 9 aa, Influenza virus
TMDYYWGIL

SEQ ID NO: 332523 - protein, 9 aa, Influenza virus
APEFGYLLR

SEQ ID NO: 332524 - protein, 9 aa, Influenza virus
PEFGYLLRG

SEQ ID NO: 332525 - protein, 9 aa, Influenza virus
EFGYLLRGE

SEQ ID NO: 332526 - protein, 9 aa, Influenza virus
FGYLLRGES

SEQ ID NO: 332527 - protein, 9 aa, Influenza virus
GYLLKGESY

SEQ ID NO: 332528 - protein, 9 aa, Influenza virus
YLLKGESYG

SEQ ID NO: 332529 - protein, 9 aa, Influenza virus
LLKGESYGR

SEQ ID NO: 332530 - protein, 9 aa, Influenza virus
GESYGRIIQ

SEQ ID NO: 332531 - protein, 9 aa, Influenza virus
ESYGRIIQN

SEQ ID NO: 332532 - protein, 9 aa, Influenza virus
SYGRIIQNE

SEQ ID NO: 332533 - protein, 9 aa, Influenza virus
YGRIIQNED

SEQ ID NO: 332534 - protein, 9 aa, Influenza virus
CRIIQNEDI

SEQ ID NO: 332535 - protein, 9 aa, Influenza virus
KIIQNEDIP

SEQ ID NO: 332536 - protein, 9 aa, Influenza virus
TIQNEDIPI

SEQ ID NO: 332537 - protein, 9 aa, Influenza virus
IQNEDIPIE

SEQ ID NO: 332538 - protein, 9 aa, Influenza virus
QNEDIPIGS

SEQ ID NO: 332539 - protein, 9 aa, Influenza virus
NEDIPIGSC

SEQ ID NO: 332540 - protein, 9 aa, Influenza virus
NCNTKCQTY

SEQ ID NO: 332541 - protein, 9 aa, Influenza virus
CNTKCQTYA

SEQ ID NO: 332542 - protein, 9 aa, Influenza virus
NTKCQTYAG

SEQ ID NO: 332543 - protein, 9 aa, Influenza virus
TKCQTYTGA

SEQ ID NO: 332544 - protein, 9 aa, Influenza virus
KCQTYTGAI

SEQ ID NO: 332545 - protein, 9 aa, Influenza virus
CQTYTGAIN

SEQ ID NO: 332546 - protein, 9 aa, Influenza virus
QTYTGAINS

SEQ ID NO: 332547 - protein, 9 aa, Influenza virus
TYTGAINSS

SEQ ID NO: 332548 - protein, 9 aa, Influenza virus
YAGAVNSSK

SEQ ID NO: 332549 - protein, 9 aa, Influenza virus
TGAINSSKP

SEQ ID NO: 332550 - protein, 9 aa, Influenza virus
GAINSSRPF

SEQ ID NO: 332551 - protein, 9 aa, Influenza virus
AINSSRPFQ

SEQ ID NO: 332552 - protein, 9 aa, Influenza virus
INSSRPFQN

SEQ ID NO: 332553 - protein, 9 aa, Influenza virus
NSSRPFQNA

SEQ ID NO: 332554 - protein, 9 aa, Influenza virus
SSRPFQNAS

SEQ ID NO: 332555 - protein, 9 aa, Influenza virus
SRPFQNASR

SEQ ID NO: 332556 - protein, 9 aa, Influenza virus
RPFQNASRH

SEQ ID NO: 332557 - protein, 9 aa, Influenza virus
PFQNASRYY

SEQ ID NO: 332558 - protein, 9 aa, Influenza virus
FQNASRHHM

SEQ ID NO: 332559 - protein, 9 aa, Influenza virus
QNASRHHMG

SEQ ID NO: 332560 - protein, 9 aa, Influenza virus
NASRYYMGE

SEQ ID NO: 332561 - protein, 9 aa, Influenza virus
ASRHHMGEC

SEQ ID NO: 332562 - protein, 9 aa, Influenza virus
SRHHMGECP

SEQ ID NO: 332563 - protein, 9 aa, Influenza virus
RHHMGECPK

SEQ ID NO: 332564 - protein, 9 aa, Influenza virus
HYMGECPNY

SEQ ID NO: 332565 - protein, 9 aa, Influenza virus
YMGECPEYV

SEQ ID NO: 332566 - protein, 9 aa, Influenza virus
MGECPKYVR

SEQ ID NO: 332567 - protein, 9 aa, Influenza virus
GECPKYVRK

SEQ ID NO: 332568 - protein, 9 aa, Influenza virus
YVKKESLRL

SEQ ID NO: 332569 - protein, 9 aa, Influenza virus
VKKESLRLA

SEQ ID NO: 332570 - protein, 9 aa, Influenza virus
KKESLRLAV

SEQ ID NO: 332571 - protein, 9 aa, Influenza virus
KESLRLAVG

SEQ ID NO: 332572 - protein, 9 aa, Influenza virus
ESLRLAVGL

SEQ ID NO: 332573 - protein, 9 aa, Influenza virus
SLRLALGLR

SEQ ID NO: 332574 - protein, 9 aa, Influenza virus
LRLALGLRN

SEQ ID NO: 332575 - protein, 9 aa, Influenza virus
RLALGLRNT

SEQ ID NO: 332576 - protein, 9 aa, Influenza virus
LALGLRNTP

SEQ ID NO: 332577 - protein, 9 aa, Influenza virus
ALGLRNTPS

SEQ ID NO: 332578 - protein, 9 aa, Influenza virus
VGLRNTPSV

SEQ ID NO: 332579 - protein, 9 aa, Influenza virus
GLRNTPSVE

SEQ ID NO: 332580 - protein, 9 aa, Influenza virus
LRNTPSVEP

SEQ ID NO: 332581 - protein, 9 aa, Influenza virus
RNTPSVEPR

SEQ ID NO: 332582 - protein, 9 aa, Influenza virus
NTPSVEPRG

SEQ ID NO: 332583 - protein, 9 aa, Influenza virus
TPSVEPKGL

SEQ ID NO: 332584 - protein, 9 aa, Influenza virus
PSVEPRGLF

SEQ ID NO: 332585 - protein, 9 aa, Influenza virus
SVEPKGLFG

SEQ ID NO: 332586 - protein, 9 aa, Influenza virus
VEPRGLFGA

SEQ ID NO: 332587 - protein, 9 aa, Influenza virus
EPRGLFGAI

SEQ ID NO: 332588 - protein, 9 aa, Influenza virus
PRGLFGAIA

SEQ ID NO: 332589 - protein, 9 aa, Influenza virus
RGLFGAIAG

SEQ ID NO: 332590 - protein, 9 aa, Influenza virus
AGFIEGGWC

SEQ ID NO: 332591 - protein, 9 aa, Influenza virus
GFIEGGWCG

SEQ ID NO: 332592 - protein, 9 aa, Influenza virus
FIEGGWCGM

SEQ ID NO: 332593 - protein, 9 aa, Influenza virus
IEGGWCGMI

SEQ ID NO: 332594 - protein, 9 aa, Influenza virus
EGGWCGMID

SEQ ID NO: 332595 - protein, 9 aa, Influenza virus
GGWCGMIDG

SEQ ID NO: 332596 - protein, 9 aa, Influenza virus
GWCGMIDGW

SEQ ID NO: 332597 - protein, 9 aa, Influenza virus
WCGMIDGWY

SEQ ID NO: 332598 - protein, 9 aa, Influenza virus
CGMIDGWYG

SEQ ID NO: 332599 - protein, 9 aa, Influenza virus
WYGFHHSNA

SEQ ID NO: 332600 - protein, 9 aa, Influenza virus
YGFHHSNAE

SEQ ID NO: 332601 - protein, 9 aa, Influenza virus
GFHHSNAEG

SEQ ID NO: 332602 - protein, 9 aa, Influenza virus
FHHSNAEGT

SEQ ID NO: 332603 - protein, 9 aa, Influenza virus
HHSNAEGTG

SEQ ID NO: 332604 - protein, 9 aa, Influenza virus
HSNAEGTGM

SEQ ID NO: 332605 - protein, 9 aa, Influenza virus
SNAEGTGMA

SEQ ID NO: 332606 - protein, 9 aa, Influenza virus
NAEGTGMAA

SEQ ID NO: 332607 - protein, 9 aa, Influenza virus
AEGTGMAAD

SEQ ID NO: 332608 - protein, 9 aa, Influenza virus
QKSTQEAIG

SEQ ID NO: 332609 - protein, 9 aa, Influenza virus
KSTQEAIEK

SEQ ID NO: 332610 - protein, 9 aa, Influenza virus
STQEAINKI

SEQ ID NO: 332611 - protein, 9 aa, Influenza virus
TQEAIEKIT

SEQ ID NO: 332612 - protein, 9 aa, Influenza virus
QEAINKITN

SEQ ID NO: 332613 - protein, 9 aa, Influenza virus
EAIEKITNK

SEQ ID NO: 332614 - protein, 9 aa, Influenza virus
AIDKITNKI

SEQ ID NO: 332615 - protein, 9 aa, Influenza virus
IDKITNKIN

SEQ ID NO: 332616 - protein, 9 aa, Influenza virus
DKITNKINN

SEQ ID NO: 332617 - protein, 9 aa, Influenza virus
KITNKINNI

SEQ ID NO: 332618 - protein, 9 aa, Influenza virus
ITNKINNIV

SEQ ID NO: 332619 - protein, 9 aa, Influenza virus
TNKINNIVD

SEQ ID NO: 332620 - protein, 9 aa, Influenza virus
NKINNIVDK

SEQ ID NO: 332621 - protein, 9 aa, Influenza virus
KINNIVDKM

SEQ ID NO: 332622 - protein, 9 aa, Influenza virus
INNIVDKMN

SEQ ID NO: 332623 - protein, 9 aa, Influenza virus
VDKMNREFG

SEQ ID NO: 332624 - protein, 9 aa, Influenza virus
DKMNREFGV

SEQ ID NO: 332625 - protein, 9 aa, Influenza virus
KMNREFGVV

SEQ ID NO: 332626 - protein, 9 aa, Influenza virus
MNREFGVVN

SEQ ID NO: 332627 - protein, 9 aa, Influenza virus
NREFGVVNH

SEQ ID NO: 332628 - protein, 9 aa, Influenza virus
REFGVVNHE

SEQ ID NO: 332629 - protein, 9 aa, Influenza virus
EFGVVNHEF

SEQ ID NO: 332630 - protein, 9 aa, Influenza virus
FGVVNHEFS

SEQ ID NO: 332631 - protein, 9 aa, Influenza virus
EKKINMIND

SEQ ID NO: 332632 - protein, 9 aa, Influenza virus
KKINMINDK

SEQ ID NO: 332633 - protein, 9 aa, Influenza virus
KINMINDKI

SEQ ID NO: 332634 - protein, 9 aa, Influenza virus
INMINDKIN

SEQ ID NO: 332635 - protein, 9 aa, Influenza virus
NMINDKIND

SEQ ID NO: 332636 - protein, 9 aa, Influenza virus
MINDKINDQ

SEQ ID NO: 332637 - protein, 9 aa, Influenza virus
INDKINDQI

SEQ ID NO: 332638 - protein, 9 aa, Influenza virus
NDKINDQIE

SEQ ID NO: 332639 - protein, 9 aa, Influenza virus
DKINDQIED

SEQ ID NO: 332640 - protein, 9 aa, Influenza virus
KINDQIEDL

SEQ ID NO: 332641 - protein, 9 aa, Influenza virus
INDQIEDLW

SEQ ID NO: 332642 - protein, 9 aa, Influenza virus
NDQIEDLWA

SEQ ID NO: 332643 - protein, 9 aa, Influenza virus
DQIENLWAY

SEQ ID NO: 332644 - protein, 9 aa, Influenza virus
QIENLWAYN

SEQ ID NO: 332645 - protein, 9 aa, Influenza virus
IENLWAYNA

SEQ ID NO: 332646 - protein, 9 aa, Influenza virus
EGLWAYNAE

SEQ ID NO: 332647 - protein, 9 aa, Influenza virus
GLWAYNAEL

SEQ ID NO: 332648 - protein, 9 aa, Influenza virus
LVLLENQKI

SEQ ID NO: 332649 - protein, 9 aa, Influenza virus
VLLENQKIL

SEQ ID NO: 332650 - protein, 9 aa, Influenza virus
LLENQKILD

SEQ ID NO: 332651 - protein, 9 aa, Influenza virus
LENQKTLDK

SEQ ID NO: 332652 - protein, 9 aa, Influenza virus
ENQKILDEH

SEQ ID NO: 332653 - protein, 9 aa, Influenza virus
NQKILDEHD

SEQ ID NO: 332654 - protein, 9 aa, Influenza virus
QKILDEHDS

SEQ ID NO: 332655 - protein, 9 aa, Influenza virus
KTLDKHDSN

SEQ ID NO: 332656 - protein, 9 aa, Influenza virus
ILDEHDSNV

SEQ ID NO: 332657 - protein, 9 aa, Influenza virus
LDKHDSNVK

SEQ ID NO: 332658 - protein, 9 aa, Influenza virus
DEHDSNVEN

SEQ ID NO: 332659 - protein, 9 aa, Influenza virus
KHDSNVKNL

SEQ ID NO: 332660 - protein, 9 aa, Influenza virus
HDSNVENLF

SEQ ID NO: 332661 - protein, 9 aa, Influenza virus
DSNVENLFD

SEQ ID NO: 332662 - protein, 9 aa, Influenza virus
SNVENLFDE

SEQ ID NO: 332663 - protein, 9 aa, Influenza virus
NVENLFDEV

SEQ ID NO: 332664 - protein, 9 aa, Influenza virus
VKNLFDEVR

SEQ ID NO: 332665 - protein, 9 aa, Influenza virus
KNLFDEVRR

SEQ ID NO: 332666 - protein, 9 aa, Influenza virus
NLFDEVRRR

SEQ ID NO: 332667 - protein, 9 aa, Influenza virus
LFDEVRRRL

SEQ ID NO: 332668 - protein, 9 aa, Influenza virus
FDEVRRRLS

SEQ ID NO: 332669 - protein, 9 aa, Influenza virus
DEVKRRLST

SEQ ID NO: 332670 - protein, 9 aa, Influenza virus
EVKRRLSTN

SEQ ID NO: 332671 - protein, 9 aa, Influenza virus
VKRRLSTNA

SEQ ID NO: 332672 - protein, 9 aa, Influenza virus
RRLSTNAID

SEQ ID NO: 332673 - protein, 9 aa, Influenza virus
NAIDTGNGC

SEQ ID NO: 332674 - protein, 9 aa, Influenza virus
AIDTGNGCF

SEQ ID NO: 332675 - protein, 9 aa, Influenza virus
IDTGNGCFD

SEQ ID NO: 332676 - protein, 9 aa, Influenza virus
DTGNGCFDI

SEQ ID NO: 332677 - protein, 9 aa, Influenza virus
TGNGCFDIL

SEQ ID NO: 332678 - protein, 9 aa, Influenza virus
GKGCFDILH

SEQ ID NO: 332679 - protein, 9 aa, Influenza virus
KGCFDILHK

SEQ ID NO: 332680 - protein, 9 aa, Influenza virus
CFDILHKCD

SEQ ID NO: 332681 - protein, 9 aa, Influenza virus
FDILHKCDN

SEQ ID NO: 332682 - protein, 9 aa, Influenza virus
DILHKCDNE

SEQ ID NO: 332683 - protein, 9 aa, Influenza virus
ILHKCDNEC

SEQ ID NO: 332684 - protein, 9 aa, Influenza virus
LHKCDNECM

SEQ ID NO: 332685 - protein, 9 aa, Influenza virus
HKCDNECME

SEQ ID NO: 332686 - protein, 9 aa, Influenza virus
KCDNECMET

SEQ ID NO: 332687 - protein, 9 aa, Influenza virus
CDNECMETI

SEQ ID NO: 332688 - protein, 9 aa, Influenza virus
DNECMETIK

SEQ ID NO: 332689 - protein, 9 aa, Influenza virus
NKCMETIKN

SEQ ID NO: 332690 - protein, 9 aa, Influenza virus
KCMETIKNG

SEQ ID NO: 332691 - protein, 9 aa, Influenza virus
ETIKNGTYD

SEQ ID NO: 332692 - protein, 9 aa, Influenza virus
TIKNGTYDH

SEQ ID NO: 332693 - protein, 9 aa, Influenza virus
IKNGTYNHK

SEQ ID NO: 332694 - protein, 9 aa, Influenza virus
KNGTYNHKE

SEQ ID NO: 332695 - protein, 9 aa, Influenza virus
NGTYDHKEY

SEQ ID NO: 332696 - protein, 9 aa, Influenza virus
GTYDHKEYE

SEQ ID NO: 332697 - protein, 9 aa, Influenza virus
TYNHKEYEE

SEQ ID NO: 332698 - protein, 9 aa, Influenza virus
YDHKEYEEE

SEQ ID NO: 332699 - protein, 9 aa, Influenza virus
NHKEYEEEA

SEQ ID NO: 332700 - protein, 9 aa, Influenza virus
HKDYEEEAK

SEQ ID NO: 332701 - protein, 9 aa, Influenza virus
KDYEEEAKL

SEQ ID NO: 332702 - protein, 9 aa, Influenza virus
DYEEEAKLE

SEQ ID NO: 332703 - protein, 9 aa, Influenza virus
YEEEAKLEK

SEQ ID NO: 332704 - protein, 9 aa, Influenza virus
EEEAKLEKS

SEQ ID NO: 332705 - protein, 9 aa, Influenza virus
EEAKLEKSR

SEQ ID NO: 332706 - protein, 9 aa, Influenza virus
EAKLEKSRI

SEQ ID NO: 332707 - protein, 9 aa, Influenza virus
AKLEKSRIN

SEQ ID NO: 332708 - protein, 9 aa, Influenza virus
KLERSKINE

SEQ ID NO: 332709 - protein, 9 aa, Influenza virus
LEKSRINGV

SEQ ID NO: 332710 - protein, 9 aa, Influenza virus
EKSRINGVK

SEQ ID NO: 332711 - protein, 9 aa, Influenza virus
RSKINEVKL

SEQ ID NO: 332712 - protein, 9 aa, Influenza virus
SKINGVRLE

SEQ ID NO: 332713 - protein, 9 aa, Influenza virus
KINEVKLEE

SEQ ID NO: 332714 - protein, 9 aa, Influenza virus
INGVILEEN

SEQ ID NO: 332715 - protein, 9 aa, Influenza virus
NGVILEENT

SEQ ID NO: 332716 - protein, 9 aa, Influenza virus
GVKLEENTS

SEQ ID NO: 332717 - protein, 9 aa, Influenza virus
VRLEENTTY

SEQ ID NO: 332718 - protein, 9 aa, Influenza virus
KLEENTSYK

SEQ ID NO: 332719 - protein, 9 aa, Influenza virus
LEENTSYKI

SEQ ID NO: 332720 - protein, 9 aa, Influenza virus
EENTTYRIL

SEQ ID NO: 332721 - protein, 9 aa, Influenza virus
ENTSYKILS

SEQ ID NO: 332722 - protein, 9 aa, Influenza virus
NTTYRILSI

SEQ ID NO: 332723 - protein, 9 aa, Influenza virus
TSYKILSIY

SEQ ID NO: 332724 - protein, 9 aa, Influenza virus
SYKILSIYS

SEQ ID NO: 332725 - protein, 9 aa, Influenza virus
YRILSIYST

SEQ ID NO: 332726 - protein, 9 aa, Influenza virus
RILSIYSTV

SEQ ID NO: 332727 - protein, 9 aa, Influenza virus
VAASLCLAV

SEQ ID NO: 332728 - protein, 9 aa, Influenza virus
AASLCLAVL

SEQ ID NO: 332729 - protein, 9 aa, Influenza virus
ASLCLAVLI

SEQ ID NO: 332730 - protein, 9 aa, Influenza virus
SLCLAILVA

SEQ ID NO: 332731 - protein, 9 aa, Influenza virus
LCLAILVAG

SEQ ID NO: 332732 - protein, 9 aa, Influenza virus
CLAVLIAGG

SEQ ID NO: 332733 - protein, 9 aa, Influenza virus
LAVLIAGGL

SEQ ID NO: 332734 - protein, 9 aa, Influenza virus
AILVAGGLI

SEQ ID NO: 332735 - protein, 9 aa, Influenza virus
ILVAGGLIL

SEQ ID NO: 332736 - protein, 9 aa, Influenza virus
LVAGGLILG

SEQ ID NO: 332737 - protein, 9 aa, Influenza virus
VAGGLILGM

SEQ ID NO: 332738 - protein, 9 aa, Influenza virus
ILGMQNGSY

SEQ ID NO: 332739 - protein, 9 aa, Influenza virus
LGMQNGSYR

SEQ ID NO: 332740 - protein, 9 aa, Influenza virus
GMQNGSYRC

SEQ ID NO: 332741 - protein, 9 aa, Influenza virus
MQNGSYRCM

SEQ ID NO: 332742 - protein, 9 aa, Influenza virus
QNGSYRCMF

SEQ ID NO: 332743 - protein, 9 aa, Influenza virus
NGSYRCMFC

SEQ ID NO: 332744 - protein, 9 aa, Influenza virus
GSYRCMFCI

SEQ ID NO: 332745 - protein, 9 aa, Influenza virus
GHQSTNSTE

SEQ ID NO: 332746 - protein, 9 aa, Influenza virus
HQSTNSTET

SEQ ID NO: 332747 - protein, 9 aa, Influenza virus
QSTNSTEAV

SEQ ID NO: 332748 - protein, 9 aa, Influenza virus
TNSTETVNT

SEQ ID NO: 332749 - protein, 9 aa, Influenza virus
EHNGILCAT

SEQ ID NO: 332750 - protein, 9 aa, Influenza virus
IEGLVYGNP

SEQ ID NO: 332751 - protein, 9 aa, Influenza virus
EGLVYGNPS

SEQ ID NO: 332752 - protein, 9 aa, Influenza virus
GLVYGNPSC

SEQ ID NO: 332753 - protein, 9 aa, Influenza virus
LVYGNPSCD

SEQ ID NO: 332754 - protein, 9 aa, Influenza virus
WSYIVERSS

SEQ ID NO: 332755 - protein, 9 aa, Influenza virus
SYIVERSSA

SEQ ID NO: 332756 - protein, 9 aa, Influenza virus
FYRNMRWLT

SEQ ID NO: 332757 - protein, 9 aa, Influenza virus
ILKPGQTLR

SEQ ID NO: 332758 - protein, 9 aa, Influenza virus
LKPGQTLRV

SEQ ID NO: 332759 - protein, 9 aa, Influenza virus
KPGQTLRVR

SEQ ID NO: 332760 - protein, 9 aa, Influenza virus
PGQTLRVRS

SEQ ID NO: 332761 - protein, 9 aa, Influenza virus
GQTLRVRSN

SEQ ID NO: 332762 - protein, 9 aa, Influenza virus
QTLRVRSNG

SEQ ID NO: 332763 - protein, 9 aa, Influenza virus
TLRVRSNGN

SEQ ID NO: 332764 - protein, 9 aa, Influenza virus
LRVRSNGNL

SEQ ID NO: 332765 - protein, 9 aa, Influenza virus
VRSNGNLIA

SEQ ID NO: 332766 - protein, 9 aa, Influenza virus
RSDGNLIAP

SEQ ID NO: 332767 - protein, 9 aa, Influenza virus
SDGNLIAPW

SEQ ID NO: 332768 - protein, 9 aa, Influenza virus
NGNLIAPWF

SEQ ID NO: 332769 - protein, 9 aa, Influenza virus
GNLIAPWFG

SEQ ID NO: 332770 - protein, 9 aa, Influenza virus
NLIAPWFGH

SEQ ID NO: 332771 - protein, 9 aa, Influenza virus
LPFHNVSKY

SEQ ID NO: 332772 - protein, 9 aa, Influenza virus
FHNVSKYAF

SEQ ID NO: 332773 - protein, 9 aa, Influenza virus
HNVSKYAFG

SEQ ID NO: 332774 - protein, 9 aa, Influenza virus
SLKLAIGLR

SEQ ID NO: 332775 - protein, 9 aa, Influenza virus
LKLAIGLRN

SEQ ID NO: 332776 - protein, 9 aa, Influenza virus
RGIFGAIAG

SEQ ID NO: 332777 - protein, 9 aa, Influenza virus
GIFGAIAGF

SEQ ID NO: 332778 - protein, 9 aa, Influenza virus
AGFIEGGWP

SEQ ID NO: 332779 - protein, 9 aa, Influenza virus
GFIEGGWPG

SEQ ID NO: 332780 - protein, 9 aa, Influenza virus
FIEGGWPGL

SEQ ID NO: 332781 - protein, 9 aa, Influenza virus
IEGGWPGLV

SEQ ID NO: 332782 - protein, 9 aa, Influenza virus
EGGWPGLVA

SEQ ID NO: 332783 - protein, 9 aa, Influenza virus
GGWPGLVAG

SEQ ID NO: 332784 - protein, 9 aa, Influenza virus
GWPGLVAGW

SEQ ID NO: 332785 - protein, 9 aa, Influenza virus
WPGLVAGWY

SEQ ID NO: 332786 - protein, 9 aa, Influenza virus
PGLVAGWYG

SEQ ID NO: 332787 - protein, 9 aa, Influenza virus
GLIAGWYGF

SEQ ID NO: 332788 - protein, 9 aa, Influenza virus
LIAGWYGFQ

SEQ ID NO: 332789 - protein, 9 aa, Influenza virus
IAGWYGFQH

SEQ ID NO: 332790 - protein, 9 aa, Influenza virus
AGWYGFQHT

SEQ ID NO: 332791 - protein, 9 aa, Influenza virus
WYGFQHSNA

SEQ ID NO: 332792 - protein, 9 aa, Influenza virus
YGFQHSNAQ

SEQ ID NO: 332793 - protein, 9 aa, Influenza virus
GFQHSNAQG

SEQ ID NO: 332794 - protein, 9 aa, Influenza virus
DQIQDVWAY

SEQ ID NO: 332795 - protein, 9 aa, Influenza virus
QIQDVWAYN

SEQ ID NO: 332796 - protein, 9 aa, Influenza virus
IQDVWAYNA

SEQ ID NO: 332797 - protein, 9 aa, Influenza virus
QDVWAYNAE

SEQ ID NO: 332798 - protein, 9 aa, Influenza virus
DVWAYNAEL

SEQ ID NO: 332799 - protein, 9 aa, Influenza virus
VWAYNAELL

SEQ ID NO: 332800 - protein, 9 aa, Influenza virus
NAELLVLLG

SEQ ID NO: 332801 - protein, 9 aa, Influenza virus
AELLVLLGN

SEQ ID NO: 332802 - protein, 9 aa, Influenza virus
ELLVLLGNQ

SEQ ID NO: 332803 - protein, 9 aa, Influenza virus
LLVLLGNQK

SEQ ID NO: 332804 - protein, 9 aa, Influenza virus
LVLLGNQKT

SEQ ID NO: 332805 - protein, 9 aa, Influenza virus
VLLGNQKTL

SEQ ID NO: 332806 - protein, 9 aa, Influenza virus
LLGNQKTLD

SEQ ID NO: 332807 - protein, 9 aa, Influenza virus
LGNQKTLDE

SEQ ID NO: 332808 - protein, 9 aa, Influenza virus
GNQKTLDEH

SEQ ID NO: 332809 - protein, 9 aa, Influenza virus
NQKTLDEHE

SEQ ID NO: 332810 - protein, 9 aa, Influenza virus
EDGNGCFEL

SEQ ID NO: 332811 - protein, 9 aa, Influenza virus
DGNGCFELY

SEQ ID NO: 332812 - protein, 9 aa, Influenza virus
GNGCFELYH

SEQ ID NO: 332813 - protein, 9 aa, Influenza virus
NGCFELYHK

SEQ ID NO: 332814 - protein, 9 aa, Influenza virus
GCFDLYHKC

SEQ ID NO: 332815 - protein, 9 aa, Influenza virus
CFDLYHKCD

SEQ ID NO: 332816 - protein, 9 aa, Influenza virus
CMATIRNGT

SEQ ID NO: 332817 - protein, 9 aa, Influenza virus
MATIRNGTY

SEQ ID NO: 332818 - protein, 9 aa, Influenza virus
EGIYKILTI

SEQ ID NO: 332819 - protein, 9 aa, Influenza virus
GIYKILTIY

SEQ ID NO: 332820 - protein, 9 aa, Influenza virus
IYKILTIYS

SEQ ID NO: 332821 - protein, 9 aa, Influenza virus
YKILSIYST

SEQ ID NO: 332822 - protein, 9 aa, Influenza virus
KILTIYSTA

SEQ ID NO: 332823 - protein, 9 aa, Influenza virus
ILTIYSTAA

SEQ ID NO: 332824 - protein, 9 aa, Influenza virus
LTIYSTAAS

SEQ ID NO: 332825 - protein, 9 aa, Influenza virus
TIYSTAASS

SEQ ID NO: 332826 - protein, 9 aa, Influenza virus
IYSTAASSL

SEQ ID NO: 332827 - protein, 9 aa, Influenza virus
GHQSTNSTE

SEQ ID NO: 332828 - protein, 9 aa, Influenza virus
HQSTNSTET

SEQ ID NO: 332829 - protein, 9 aa, Influenza virus
QSTNSTEAV

SEQ ID NO: 332830 - protein, 9 aa, Influenza virus
TNSTETVNT

SEQ ID NO: 332831 - protein, 9 aa, Influenza virus
EHNGILCAT

SEQ ID NO: 332832 - protein, 9 aa, Influenza virus
IEGLVYGNP

SEQ ID NO: 332833 - protein, 9 aa, Influenza virus
EGLVYGNPS

SEQ ID NO: 332834 - protein, 9 aa, Influenza virus
GLVYGNPSC

SEQ ID NO: 332835 - protein, 9 aa, Influenza virus
LVYGNPSCD

SEQ ID NO: 332836 - protein, 9 aa, Influenza virus
WSYIVERSS

SEQ ID NO: 332837 - protein, 9 aa, Influenza virus
SYIVERSSA

SEQ ID NO: 332838 - protein, 9 aa, Influenza virus
FYRNMRWLT

SEQ ID NO: 332839 - protein, 9 aa, Influenza virus
AVLKPGQTL

SEQ ID NO: 332840 - protein, 9 aa, Influenza virus
ILKPGQTLR

SEQ ID NO: 332841 - protein, 9 aa, Influenza virus
LKPGQTLRV

SEQ ID NO: 332842 - protein, 9 aa, Influenza virus
KPGQTLRVR

SEQ ID NO: 332843 - protein, 9 aa, Influenza virus
PGQTLRVRS

SEQ ID NO: 332844 - protein, 9 aa, Influenza virus
GQTLRVRSN

SEQ ID NO: 332845 - protein, 9 aa, Influenza virus
QTLRVRSNG

SEQ ID NO: 332846 - protein, 9 aa, Influenza virus
TLRVRSNGN

SEQ ID NO: 332847 - protein, 9 aa, Influenza virus
LRVRSNGNL

SEQ ID NO: 332848 - protein, 9 aa, Influenza virus
VRSNGNLIA

SEQ ID NO: 332849 - protein, 9 aa, Influenza virus
RSDGNLIAP

SEQ ID NO: 332850 - protein, 9 aa, Influenza virus
SDGNLIAPW

SEQ ID NO: 332851 - protein, 9 aa, Influenza virus
NGNLIAPWF

SEQ ID NO: 332852 - protein, 9 aa, Influenza virus
GNLIAPWFG

SEQ ID NO: 332853 - protein, 9 aa, Influenza virus
NLIAPWFGH

SEQ ID NO: 332854 - protein, 9 aa, Influenza virus
LPFHNVSKY

SEQ ID NO: 332855 - protein, 9 aa, Influenza virus
FHNVSKYAF

SEQ ID NO: 332856 - protein, 9 aa, Influenza virus
HNVSKYAFG

SEQ ID NO: 332857 - protein, 9 aa, Influenza virus
YAFGNCPKY

SEQ ID NO: 332858 - protein, 9 aa, Influenza virus
SLKLAIGLR

SEQ ID NO: 332859 - protein, 9 aa, Influenza virus
LKLAIGLRN

SEQ ID NO: 332860 - protein, 9 aa, Influenza virus
AGFIEGGWP

SEQ ID NO: 332861 - protein, 9 aa, Influenza virus
GFIEGGWPG

SEQ ID NO: 332862 - protein, 9 aa, Influenza virus
FIEGGWPGL

SEQ ID NO: 332863 - protein, 9 aa, Influenza virus
IEGGWPGLV

SEQ ID NO: 332864 - protein, 9 aa, Influenza virus
EGGWPGLVA

SEQ ID NO: 332865 - protein, 9 aa, Influenza virus
GGWPGLVAG

SEQ ID NO: 332866 - protein, 9 aa, Influenza virus
GWPGLVAGW

SEQ ID NO: 332867 - protein, 9 aa, Influenza virus
WPGLVAGWY

SEQ ID NO: 332868 - protein, 9 aa, Influenza virus
PGLVAGWYG

SEQ ID NO: 332869 - protein, 9 aa, Influenza virus
GLIAGWYGF

SEQ ID NO: 332870 - protein, 9 aa, Influenza virus
LIAGWYGFQ

SEQ ID NO: 332871 - protein, 9 aa, Influenza virus
IAGWYGFQH

SEQ ID NO: 332872 - protein, 9 aa, Influenza virus
AGWYGFQHT

SEQ ID NO: 332873 - protein, 9 aa, Influenza virus
WYGFQHSNA

SEQ ID NO: 332874 - protein, 9 aa, Influenza virus
YGFQHSNAQ

SEQ ID NO: 332875 - protein, 9 aa, Influenza virus
GFQHSNAQG

SEQ ID NO: 332876 - protein, 9 aa, Influenza virus
DDQIQDVWA

SEQ ID NO: 332877 - protein, 9 aa, Influenza virus
DQIQDVWAY

SEQ ID NO: 332878 - protein, 9 aa, Influenza virus
QIQDVWAYN

SEQ ID NO: 332879 - protein, 9 aa, Influenza virus
IQDVWAYNA

SEQ ID NO: 332880 - protein, 9 aa, Influenza virus
QDVWAYNAE

SEQ ID NO: 332881 - protein, 9 aa, Influenza virus
DVWAYNAEL

SEQ ID NO: 332882 - protein, 9 aa, Influenza virus
VWAYNAELL

SEQ ID NO: 332883 - protein, 9 aa, Influenza virus
NAELLVLLG

SEQ ID NO: 332884 - protein, 9 aa, Influenza virus
AELLVLLGN

SEQ ID NO: 332885 - protein, 9 aa, Influenza virus
ELLVLLGNQ

SEQ ID NO: 332886 - protein, 9 aa, Influenza virus
LLVLLGNQK

SEQ ID NO: 332887 - protein, 9 aa, Influenza virus
LVLLGNQKT

SEQ ID NO: 332888 - protein, 9 aa, Influenza virus
VLLGNQKTL

SEQ ID NO: 332889 - protein, 9 aa, Influenza virus
LLGNQKTLD

SEQ ID NO: 332890 - protein, 9 aa, Influenza virus
LGNQKTLDE

SEQ ID NO: 332891 - protein, 9 aa, Influenza virus
GNQKTLDEH

SEQ ID NO: 332892 - protein, 9 aa, Influenza virus
NQKPLDEHD

SEQ ID NO: 332893 - protein, 9 aa, Influenza virus
QKTLDEHEA

SEQ ID NO: 332894 - protein, 9 aa, Influenza virus
KTLDEHDSN

SEQ ID NO: 332895 - protein, 9 aa, Influenza virus
LDEHDANVH

SEQ ID NO: 332896 - protein, 9 aa, Influenza virus
EDGNGCFEL

SEQ ID NO: 332897 - protein, 9 aa, Influenza virus
DGNGCFELY

SEQ ID NO: 332898 - protein, 9 aa, Influenza virus
GNGCFELYH

SEQ ID NO: 332899 - protein, 9 aa, Influenza virus
NGCFELYHK

SEQ ID NO: 332900 - protein, 9 aa, Influenza virus
GCFDLYHKC

SEQ ID NO: 332901 - protein, 9 aa, Influenza virus
CFDLYHKCD

SEQ ID NO: 332902 - protein, 9 aa, Influenza virus
CMATIRNGT

SEQ ID NO: 332903 - protein, 9 aa, Influenza virus
MATIRNGTY

SEQ ID NO: 332904 - protein, 9 aa, Influenza virus
EGIYKILTI

SEQ ID NO: 332905 - protein, 9 aa, Influenza virus
GIYKILTIY

SEQ ID NO: 332906 - protein, 9 aa, Influenza virus
IYKILTIYS

SEQ ID NO: 332907 - protein, 9 aa, Influenza virus
YKILSIYST

SEQ ID NO: 332908 - protein, 9 aa, Influenza virus
KILTIYSTA

SEQ ID NO: 332909 - protein, 9 aa, Influenza virus
ILTIYSTAA

SEQ ID NO: 332910 - protein, 9 aa, Influenza virus
LTIYSTAAS

SEQ ID NO: 332911 - protein, 9 aa, Influenza virus
TIYSTAASS

SEQ ID NO: 332912 - protein, 9 aa, Influenza virus
IYSTAASSL

SEQ ID NO: 332913 - protein, 9 aa, Influenza virus
WLKPQCQIT

SEQ ID NO: 332914 - protein, 9 aa, Influenza virus
LKPQCQITG

SEQ ID NO: 332915 - protein, 9 aa, Influenza virus
KPQCLITGF

SEQ ID NO: 332916 - protein, 9 aa, Influenza virus
PQCQITGFV

SEQ ID NO: 332917 - protein, 9 aa, Influenza virus
QCQITGFVP

SEQ ID NO: 332918 - protein, 9 aa, Influenza virus
RLSASGDIW

SEQ ID NO: 332919 - protein, 9 aa, Influenza virus
LTREPYVSC

SEQ ID NO: 332920 - protein, 9 aa, Influenza virus
NCYQFALGQ

SEQ ID NO: 332921 - protein, 9 aa, Influenza virus
CYQFALGHG

SEQ ID NO: 332922 - protein, 9 aa, Influenza virus
YQFALGHGT

SEQ ID NO: 332923 - protein, 9 aa, Influenza virus
QFALGHGTT

SEQ ID NO: 332924 - protein, 9 aa, Influenza virus
FALGHGTTL

SEQ ID NO: 332925 - protein, 9 aa, Influenza virus
PYRTLLMSE

SEQ ID NO: 332926 - protein, 9 aa, Influenza virus
YRTLLMSEL

SEQ ID NO: 332927 - protein, 9 aa, Influenza virus
RTLLMSELG

SEQ ID NO: 332928 - protein, 9 aa, Influenza virus
TLLMSELGV

SEQ ID NO: 332929 - protein, 9 aa, Influenza virus
LLMSELGVP

SEQ ID NO: 332930 - protein, 9 aa, Influenza virus
LMSELGVPF

SEQ ID NO: 332931 - protein, 9 aa, Influenza virus
MSELGVPFH

SEQ ID NO: 332932 - protein, 9 aa, Influenza virus
SELGVPFHL

SEQ ID NO: 332933 - protein, 9 aa, Influenza virus
TKQVCMAWS

SEQ ID NO: 332934 - protein, 9 aa, Influenza virus
KQVCMAWSS

SEQ ID NO: 332935 - protein, 9 aa, Influenza virus
QVCMAWSSS

SEQ ID NO: 332936 - protein, 9 aa, Influenza virus
VCMAWSSSS

SEQ ID NO: 332937 - protein, 9 aa, Influenza virus
CMAWSSSSC

SEQ ID NO: 332938 - protein, 9 aa, Influenza virus
MAWSSSSCH

SEQ ID NO: 332939 - protein, 9 aa, Influenza virus
AWSSSSCYD

SEQ ID NO: 332940 - protein, 9 aa, Influenza virus
WSSSSCYDG

SEQ ID NO: 332941 - protein, 9 aa, Influenza virus
SSSSCHDGR

SEQ ID NO: 332942 - protein, 9 aa, Influenza virus
SSSCHDGRA

SEQ ID NO: 332943 - protein, 9 aa, Influenza virus
SSCHDGRAW

SEQ ID NO: 332944 - protein, 9 aa, Influenza virus
SCHDGRAWL

SEQ ID NO: 332945 - protein, 9 aa, Influenza virus
CHDGRAWLH

SEQ ID NO: 332946 - protein, 9 aa, Influenza virus
SILRTQESE

SEQ ID NO: 332947 - protein, 9 aa, Influenza virus
ILITQESEC

SEQ ID NO: 332948 - protein, 9 aa, Influenza virus
LRTQESECI

SEQ ID NO: 332949 - protein, 9 aa, Influenza virus
RTQESECIC

SEQ ID NO: 332950 - protein, 9 aa, Influenza virus
TQESECICI

SEQ ID NO: 332951 - protein, 9 aa, Influenza virus
ESECVCISG

SEQ ID NO: 332952 - protein, 9 aa, Influenza virus
INGTCAVVM

SEQ ID NO: 332953 - protein, 9 aa, Influenza virus
GTCAVVMTD

SEQ ID NO: 332954 - protein, 9 aa, Influenza virus
GSAQHIEEC

SEQ ID NO: 332955 - protein, 9 aa, Influenza virus
SAQHIEECS

SEQ ID NO: 332956 - protein, 9 aa, Influenza virus
AQHIEECSC

SEQ ID NO: 332957 - protein, 9 aa, Influenza virus
QHIEECSCY

SEQ ID NO: 332958 - protein, 9 aa, Influenza virus
HIEECSCYP

SEQ ID NO: 332959 - protein, 9 aa, Influenza virus
IEECSCYPR

SEQ ID NO: 332960 - protein, 9 aa, Influenza virus
EECSCYPQY

SEQ ID NO: 332961 - protein, 9 aa, Influenza virus
CVCRDNWRG

SEQ ID NO: 332962 - protein, 9 aa, Influenza virus
VCRDNWRGS

SEQ ID NO: 332963 - protein, 9 aa, Influenza virus
CRDNWRGSN

SEQ ID NO: 332964 - protein, 9 aa, Influenza virus
RDNWRGSNR

SEQ ID NO: 332965 - protein, 9 aa, Influenza virus
DNWRGSNRP

SEQ ID NO: 332966 - protein, 9 aa, Influenza virus
NWRGSNRPV

SEQ ID NO: 332967 - protein, 9 aa, Influenza virus
YLCSGLVGD

SEQ ID NO: 332968 - protein, 9 aa, Influenza virus
LCSGLVGDT

SEQ ID NO: 332969 - protein, 9 aa, Influenza virus
GLVGDTPRS

SEQ ID NO: 332970 - protein, 9 aa, Influenza virus
SGVKGWAFD

SEQ ID NO: 332971 - protein, 9 aa, Influenza virus
CVNRCFYVE

SEQ ID NO: 332972 - protein, 9 aa, Influenza virus
VNRCFYVEL

SEQ ID NO: 332973 - protein, 9 aa, Influenza virus
NRCFYVELV

SEQ ID NO: 332974 - protein, 9 aa, Influenza virus
RCFYVELVR

SEQ ID NO: 332975 - protein, 9 aa, Influenza virus
CFYVELVRG

SEQ ID NO: 332976 - protein, 9 aa, Influenza virus
FYVELVRGR

SEQ ID NO: 332977 - protein, 9 aa, Influenza virus
YVELVRGRP

SEQ ID NO: 332978 - protein, 9 aa, Influenza virus
FCGTSGSYG

SEQ ID NO: 332979 - protein, 9 aa, Influenza virus
GSYGTGSWP

SEQ ID NO: 332980 - protein, 9 aa, Influenza virus
SYGTGSWPD

SEQ ID NO: 332981 - protein, 9 aa, Influenza virus
TGSWPDGAD

SEQ ID NO: 332982 - protein, 9 aa, Influenza virus
GSWPDGADI

SEQ ID NO: 332983 - protein, 9 aa, Influenza virus
VETYVLSII

SEQ ID NO: 332984 - protein, 9 aa, Influenza virus
ETYVLSIIP

SEQ ID NO: 332985 - protein, 9 aa, Influenza virus
TYVLSIIPS

SEQ ID NO: 332986 - protein, 9 aa, Influenza virus
YVLSIIPSG

SEQ ID NO: 332987 - protein, 9 aa, Influenza virus
VLSIIPSGP

SEQ ID NO: 332988 - protein, 9 aa, Influenza virus
LSIIPSGPL

SEQ ID NO: 332989 - protein, 9 aa, Influenza virus
SIIPSGPLK

SEQ ID NO: 332990 - protein, 9 aa, Influenza virus
IIPSGPLKA

SEQ ID NO: 332991 - protein, 9 aa, Influenza virus
IPSGPLKAE

SEQ ID NO: 332992 - protein, 9 aa, Influenza virus
PLKAEIAQK

SEQ ID NO: 332993 - protein, 9 aa, Influenza virus
LKAEIAQKL

SEQ ID NO: 332994 - protein, 9 aa, Influenza virus
KAEIAQKLE

SEQ ID NO: 332995 - protein, 9 aa, Influenza virus
AEIAQRLES

SEQ ID NO: 332996 - protein, 9 aa, Influenza virus
EIAQRLESV

SEQ ID NO: 332997 - protein, 9 aa, Influenza virus
IAQRLESVF

SEQ ID NO: 332998 - protein, 9 aa, Influenza virus
AQRLESVFA

SEQ ID NO: 332999 - protein, 9 aa, Influenza virus
QRLESVFAG

SEQ ID NO: 333000 - protein, 9 aa, Influenza virus
RLESVFAGK

SEQ ID NO: 333001 - protein, 9 aa, Influenza virus
LESVFAGKN

SEQ ID NO: 333002 - protein, 9 aa, Influenza virus
VFAGKNADL

SEQ ID NO: 333003 - protein, 9 aa, Influenza virus
FAGKNADLE

SEQ ID NO: 333004 - protein, 9 aa, Influenza virus
AGKNADLEA

SEQ ID NO: 333005 - protein, 9 aa, Influenza virus
GKNADLEAL

SEQ ID NO: 333006 - protein, 9 aa, Influenza virus
KNADLEALM

SEQ ID NO: 333007 - protein, 9 aa, Influenza virus
NADLEALME

SEQ ID NO: 333008 - protein, 9 aa, Influenza virus
ADLEALMEW

SEQ ID NO: 333009 - protein, 9 aa, Influenza virus
DLEALMEWI

SEQ ID NO: 333010 - protein, 9 aa, Influenza virus
LEALMEWIK

SEQ ID NO: 333011 - protein, 9 aa, Influenza virus
EALMEWIKT

SEQ ID NO: 333012 - protein, 9 aa, Influenza virus
ALMEWIKTR

SEQ ID NO: 333013 - protein, 9 aa, Influenza virus
LMEWIKTRP

SEQ ID NO: 333014 - protein, 9 aa, Influenza virus
MEWIKTRPI

SEQ ID NO: 333015 - protein, 9 aa, Influenza virus
EWIKTRPIL

SEQ ID NO: 333016 - protein, 9 aa, Influenza virus
WIKTRPILS

SEQ ID NO: 333017 - protein, 9 aa, Influenza virus
IKTRPILSP

SEQ ID NO: 333018 - protein, 9 aa, Influenza virus
ILSPLTKGM

SEQ ID NO: 333019 - protein, 9 aa, Influenza virus
LSPLTKGML

SEQ ID NO: 333020 - protein, 9 aa, Influenza virus
SPLTKGMLG

SEQ ID NO: 333021 - protein, 9 aa, Influenza virus
PLTKGMLGF

SEQ ID NO: 333022 - protein, 9 aa, Influenza virus
LTKGMLGFV

SEQ ID NO: 333023 - protein, 9 aa, Influenza virus
TKGMLGFVF

SEQ ID NO: 333024 - protein, 9 aa, Influenza virus
KGMLGFVFT

SEQ ID NO: 333025 - protein, 9 aa, Influenza virus
GMLGFVFTL

SEQ ID NO: 333026 - protein, 9 aa, Influenza virus
MLGFVFTLT

SEQ ID NO: 333027 - protein, 9 aa, Influenza virus
RGLQRRRFI

SEQ ID NO: 333028 - protein, 9 aa, Influenza virus
GLQRRRFIQ

SEQ ID NO: 333029 - protein, 9 aa, Influenza virus
LQRRRFIQN

SEQ ID NO: 333030 - protein, 9 aa, Influenza virus
QRRRFIQNA

SEQ ID NO: 333031 - protein, 9 aa, Influenza virus
RRRFIQNAL

SEQ ID NO: 333032 - protein, 9 aa, Influenza virus
RRFVQNALS

SEQ ID NO: 333033 - protein, 9 aa, Influenza virus
RFVQNALSG

SEQ ID NO: 333034 - protein, 9 aa, Influenza virus
FVQNALSGN

SEQ ID NO: 333035 - protein, 9 aa, Influenza virus
VQNALSGNG

SEQ ID NO: 333036 - protein, 9 aa, Influenza virus
QNALSGNGD

SEQ ID NO: 333037 - protein, 9 aa, Influenza virus
NALSGNGDP

SEQ ID NO: 333038 - protein, 9 aa, Influenza virus
ALSGNGDPN

SEQ ID NO: 333039 - protein, 9 aa, Influenza virus
LSGNGDPNN

SEQ ID NO: 333040 - protein, 9 aa, Influenza virus
SGNGDPNNM

SEQ ID NO: 333041 - protein, 9 aa, Influenza virus
NGDPNNMDK

SEQ ID NO: 333042 - protein, 9 aa, Influenza virus
GDPNNMDKA

SEQ ID NO: 333043 - protein, 9 aa, Influenza virus
DPNNMDKAV

SEQ ID NO: 333044 - protein, 9 aa, Influenza virus
PNNMDKAVK

SEQ ID NO: 333045 - protein, 9 aa, Influenza virus
NNMDKAVKL

SEQ ID NO: 333046 - protein, 9 aa, Influenza virus
NMDKAVKLY

SEQ ID NO: 333047 - protein, 9 aa, Influenza virus
MDRAVKLYK

SEQ ID NO: 333048 - protein, 9 aa, Influenza virus
DRAVKLYKK

SEQ ID NO: 333049 - protein, 9 aa, Influenza virus
RAVKLYKKL

SEQ ID NO: 333050 - protein, 9 aa, Influenza virus
AVKLYKKLK

SEQ ID NO: 333051 - protein, 9 aa, Influenza virus
VKLYKKLKR

SEQ ID NO: 333052 - protein, 9 aa, Influenza virus
KLYKKLKRE

SEQ ID NO: 333053 - protein, 9 aa, Influenza virus
LYKKLKREI

SEQ ID NO: 333054 - protein, 9 aa, Influenza virus
YKKLKREIT

SEQ ID NO: 333055 - protein, 9 aa, Influenza virus
KKLKREITF

SEQ ID NO: 333056 - protein, 9 aa, Influenza virus
KLKREMTFH

SEQ ID NO: 333057 - protein, 9 aa, Influenza virus
LKREMTFHG

SEQ ID NO: 333058 - protein, 9 aa, Influenza virus
KREMTFHGA

SEQ ID NO: 333059 - protein, 9 aa, Influenza virus
REMTFHGAK

SEQ ID NO: 333060 - protein, 9 aa, Influenza virus
EMTFHGAKE

SEQ ID NO: 333061 - protein, 9 aa, Influenza virus
ITFHGAKEI

SEQ ID NO: 333062 - protein, 9 aa, Influenza virus
TFHGAKEIA

SEQ ID NO: 333063 - protein, 9 aa, Influenza virus
FHGAKEIAL

SEQ ID NO: 333064 - protein, 9 aa, Influenza virus
GAKEIALSY

SEQ ID NO: 333065 - protein, 9 aa, Influenza virus
AKEIALSYS

SEQ ID NO: 333066 - protein, 9 aa, Influenza virus
EIALSYSAG

SEQ ID NO: 333067 - protein, 9 aa, Influenza virus
IALSYSAGA

SEQ ID NO: 333068 - protein, 9 aa, Influenza virus
ALSYSAGAL

SEQ ID NO: 333069 - protein, 9 aa, Influenza virus
LSYSAGALA

SEQ ID NO: 333070 - protein, 9 aa, Influenza virus
SYSAGALAS

SEQ ID NO: 333071 - protein, 9 aa, Influenza virus
YSAGALASC

SEQ ID NO: 333072 - protein, 9 aa, Influenza virus
SAGALASCM

SEQ ID NO: 333073 - protein, 9 aa, Influenza virus
AGALASCMG

SEQ ID NO: 333074 - protein, 9 aa, Influenza virus
GLIYNRMGA

SEQ ID NO: 333075 - protein, 9 aa, Influenza virus
LIYNRMGAV

SEQ ID NO: 333076 - protein, 9 aa, Influenza virus
IYNRMGAVT

SEQ ID NO: 333077 - protein, 9 aa, Influenza virus
AFGLICATC

SEQ ID NO: 333078 - protein, 9 aa, Influenza virus
FGLICATCE

SEQ ID NO: 333079 - protein, 9 aa, Influenza virus
GLICATCEQ

SEQ ID NO: 333080 - protein, 9 aa, Influenza virus
LICATCEQI

SEQ ID NO: 333081 - protein, 9 aa, Influenza virus
ICATCEQIA

SEQ ID NO: 333082 - protein, 9 aa, Influenza virus
ATCEQIADA

SEQ ID NO: 333083 - protein, 9 aa, Influenza virus
TCEQIADAQ

SEQ ID NO: 333084 - protein, 9 aa, Influenza virus
CEQIADAQH

SEQ ID NO: 333085 - protein, 9 aa, Influenza virus
EQIADSQHK

SEQ ID NO: 333086 - protein, 9 aa, Influenza virus
QIADSQHKS

SEQ ID NO: 333087 - protein, 9 aa, Influenza virus
IADSQHKSH

SEQ ID NO: 333088 - protein, 9 aa, Influenza virus
ADSQHKSHR

SEQ ID NO: 333089 - protein, 9 aa, Influenza virus
DSQHKSHRQ

SEQ ID NO: 333090 - protein, 9 aa, Influenza virus
SQHKSHRQM

SEQ ID NO: 333091 - protein, 9 aa, Influenza virus
QHRSHRQMA

SEQ ID NO: 333092 - protein, 9 aa, Influenza virus
ATTNPLIKH

SEQ ID NO: 333093 - protein, 9 aa, Influenza virus
TTNPLIKHE

SEQ ID NO: 333094 - protein, 9 aa, Influenza virus
TNPLIKHEN

SEQ ID NO: 333095 - protein, 9 aa, Influenza virus
NPLIKHENR

SEQ ID NO: 333096 - protein, 9 aa, Influenza virus
PLIKHENRM

SEQ ID NO: 333097 - protein, 9 aa, Influenza virus
LIKHENRMV

SEQ ID NO: 333098 - protein, 9 aa, Influenza virus
IKHENRMVL

SEQ ID NO: 333099 - protein, 9 aa, Influenza virus
KHENRMVLA

SEQ ID NO: 333100 - protein, 9 aa, Influenza virus
HENRMVIAS

SEQ ID NO: 333101 - protein, 9 aa, Influenza virus
ENRMVIAST

SEQ ID NO: 333102 - protein, 9 aa, Influenza virus
NRMVIASTT

SEQ ID NO: 333103 - protein, 9 aa, Influenza virus
RMVIASTTA

SEQ ID NO: 333104 - protein, 9 aa, Influenza virus
MVIASTTAK

SEQ ID NO: 333105 - protein, 9 aa, Influenza virus
VIASTTAKA

SEQ ID NO: 333106 - protein, 9 aa, Influenza virus
IASTTAKAM

SEQ ID NO: 333107 - protein, 9 aa, Influenza virus
TTAKAMEQV

SEQ ID NO: 333108 - protein, 9 aa, Influenza virus
TAKAMEQVA

SEQ ID NO: 333109 - protein, 9 aa, Influenza virus
AKAMEQVAG

SEQ ID NO: 333110 - protein, 9 aa, Influenza virus
KAMEQVAGS

SEQ ID NO: 333111 - protein, 9 aa, Influenza virus
AMEQVAGSS

SEQ ID NO: 333112 - protein, 9 aa, Influenza virus
MEQVAGSSE

SEQ ID NO: 333113 - protein, 9 aa, Influenza virus
EQVAGSSEQ

SEQ ID NO: 333114 - protein, 9 aa, Influenza virus
QVAGSSEQA

SEQ ID NO: 333115 - protein, 9 aa, Influenza virus
VAGSSEQAA

SEQ ID NO: 333116 - protein, 9 aa, Influenza virus
SSEQAAEAI

SEQ ID NO: 333117 - protein, 9 aa, Influenza virus
SEQAAEAMD

SEQ ID NO: 333118 - protein, 9 aa, Influenza virus
EQAAEAMEI

SEQ ID NO: 333119 - protein, 9 aa, Influenza virus
QAAEAMEIA

SEQ ID NO: 333120 - protein, 9 aa, Influenza virus
TRQMVHAMR

SEQ ID NO: 333121 - protein, 9 aa, Influenza virus
RQMVHAMRT

SEQ ID NO: 333122 - protein, 9 aa, Influenza virus
MVHAMRTIG

SEQ ID NO: 333123 - protein, 9 aa, Influenza virus
VHAMRTIGT

SEQ ID NO: 333124 - protein, 9 aa, Influenza virus
AMRAIGTHP

SEQ ID NO: 333125 - protein, 9 aa, Influenza virus
DLLENLQTY

SEQ ID NO: 333126 - protein, 9 aa, Influenza virus
LLENLQTYQ

SEQ ID NO: 333127 - protein, 9 aa, Influenza virus
LENLQTYQK

SEQ ID NO: 333128 - protein, 9 aa, Influenza virus
ENLQTYQKR

SEQ ID NO: 333129 - protein, 9 aa, Influenza virus
NLQTYQKRM

SEQ ID NO: 333130 - protein, 9 aa, Influenza virus
LQTYQKRMG

SEQ ID NO: 333131 - protein, 9 aa, Influenza virus
QTYQKRMGV

SEQ ID NO: 333132 - protein, 9 aa, Influenza virus
TYQKRMGVQ

SEQ ID NO: 333133 - protein, 9 aa, Influenza virus
YQKRMGVQL

SEQ ID NO: 333134 - protein, 9 aa, Influenza virus
QKRMGVQLQ

SEQ ID NO: 333135 - protein, 9 aa, Influenza virus
KRMGVQLQR

SEQ ID NO: 333136 - protein, 9 aa, Influenza virus
RMGVQLQRF

SEQ ID NO: 333137 - protein, 9 aa, Influenza virus
MGVQLQRFK

SEQ ID NO: 333138 - protein, 9 aa, Influenza virus
SSRHCSKYH

SEQ ID NO: 333139 - protein, 9 aa, Influenza virus
SLLTEVETL

SEQ ID NO: 333140 - protein, 9 aa, Influenza virus
GIVHLILWI

SEQ ID NO: 333141 - protein, 9 aa, Influenza virus
GVPKSMREE

SEQ ID NO: 333142 - protein, 9 aa, Influenza virus
VPKSMREEY

SEQ ID NO: 333143 - protein, 9 aa, Influenza virus
PESMREEYQ

SEQ ID NO: 333144 - protein, 9 aa, Influenza virus
SMREEYQQE

SEQ ID NO: 333145 - protein, 9 aa, Influenza virus
HFVNIELED

SEQ ID NO: 333146 - protein, 9 aa, Influenza virus
MSDINIMAS

SEQ ID NO: 333147 - protein, 9 aa, Influenza virus
SDINIMASQ

SEQ ID NO: 333148 - protein, 9 aa, Influenza virus
DINIMASQG

SEQ ID NO: 333149 - protein, 9 aa, Influenza virus
INIMASQGT

SEQ ID NO: 333150 - protein, 9 aa, Influenza virus
NIMASQGTK

SEQ ID NO: 333151 - protein, 9 aa, Influenza virus
IMASQGTKR

SEQ ID NO: 333152 - protein, 9 aa, Influenza virus
MALQGTKRS

SEQ ID NO: 333153 - protein, 9 aa, Influenza virus
ASQGTKRSH

SEQ ID NO: 333154 - protein, 9 aa, Influenza virus
SQGTKRSHE

SEQ ID NO: 333155 - protein, 9 aa, Influenza virus
QGTKRSHEQ

SEQ ID NO: 333156 - protein, 9 aa, Influenza virus
GTKRSHEQM

SEQ ID NO: 333157 - protein, 9 aa, Influenza virus
TKRSHEQME

SEQ ID NO: 333158 - protein, 9 aa, Influenza virus
KRSHEQMET

SEQ ID NO: 333159 - protein, 9 aa, Influenza virus
RSYEQMETD

SEQ ID NO: 333160 - protein, 9 aa, Influenza virus
SYEQMETDG

SEQ ID NO: 333161 - protein, 9 aa, Influenza virus
YEQMETDGD

SEQ ID NO: 333162 - protein, 9 aa, Influenza virus
EQMETDGDR

SEQ ID NO: 333163 - protein, 9 aa, Influenza virus
QMETDGDRQ

SEQ ID NO: 333164 - protein, 9 aa, Influenza virus
ATEIRSSVG

SEQ ID NO: 333165 - protein, 9 aa, Influenza virus
TEIRASVGK

SEQ ID NO: 333166 - protein, 9 aa, Influenza virus
EIRASVGKM

SEQ ID NO: 333167 - protein, 9 aa, Influenza virus
IRASVGRMI

SEQ ID NO: 333168 - protein, 9 aa, Influenza virus
DGIGRFYIQ

SEQ ID NO: 333169 - protein, 9 aa, Influenza virus
GIGRFYVQM

SEQ ID NO: 333170 - protein, 9 aa, Influenza virus
IGRFYVQMC

SEQ ID NO: 333171 - protein, 9 aa, Influenza virus
GRFYVQMCT

SEQ ID NO: 333172 - protein, 9 aa, Influenza virus
RFYVQMCTE

SEQ ID NO: 333173 - protein, 9 aa, Influenza virus
FYVQMCTEL

SEQ ID NO: 333174 - protein, 9 aa, Influenza virus
YVQMCTELK

SEQ ID NO: 333175 - protein, 9 aa, Influenza virus
VQMCTELKL

SEQ ID NO: 333176 - protein, 9 aa, Influenza virus
QMCTELKLN

SEQ ID NO: 333177 - protein, 9 aa, Influenza virus
MCTELKLND

SEQ ID NO: 333178 - protein, 9 aa, Influenza virus
YDGRLIQNS

SEQ ID NO: 333179 - protein, 9 aa, Influenza virus
EGRLIQNSL

SEQ ID NO: 333180 - protein, 9 aa, Influenza virus
GRLIQNSLT

SEQ ID NO: 333181 - protein, 9 aa, Influenza virus
RLIQNSLTI

SEQ ID NO: 333182 - protein, 9 aa, Influenza virus
LIQNSLTIE

SEQ ID NO: 333183 - protein, 9 aa, Influenza virus
QNSLTIEKM

SEQ ID NO: 333184 - protein, 9 aa, Influenza virus
TIEKMVLSA

SEQ ID NO: 333185 - protein, 9 aa, Influenza virus
IEKMVLSAF

SEQ ID NO: 333186 - protein, 9 aa, Influenza virus
EKMVLSAFD

SEQ ID NO: 333187 - protein, 9 aa, Influenza virus
KMVLSAFDE

SEQ ID NO: 333188 - protein, 9 aa, Influenza virus
SAFDERRNR

SEQ ID NO: 333189 - protein, 9 aa, Influenza virus
AFDERRNRY

SEQ ID NO: 333190 - protein, 9 aa, Influenza virus
FDERRNRYL

SEQ ID NO: 333191 - protein, 9 aa, Influenza virus
DERRNRYLE

SEQ ID NO: 333192 - protein, 9 aa, Influenza virus
ERRNRYLEE

SEQ ID NO: 333193 - protein, 9 aa, Influenza virus
RRNRYLEEH

SEQ ID NO: 333194 - protein, 9 aa, Influenza virus
RNRYLEEHP

SEQ ID NO: 333195 - protein, 9 aa, Influenza virus
NRYLEEHPS

SEQ ID NO: 333196 - protein, 9 aa, Influenza virus
RYLEEHPSA

SEQ ID NO: 333197 - protein, 9 aa, Influenza virus
YLEEHPSTG

SEQ ID NO: 333198 - protein, 9 aa, Influenza virus
LEEHPNAGK

SEQ ID NO: 333199 - protein, 9 aa, Influenza virus
EEHPNAGKD

SEQ ID NO: 333200 - protein, 9 aa, Influenza virus
EHPNAGKDP

SEQ ID NO: 333201 - protein, 9 aa, Influenza virus
HPNAGKDPK

SEQ ID NO: 333202 - protein, 9 aa, Influenza virus
PNAGKDPKK

SEQ ID NO: 333203 - protein, 9 aa, Influenza virus
NAGKDPKKT

SEQ ID NO: 333204 - protein, 9 aa, Influenza virus
TGKDPKKTG

SEQ ID NO: 333205 - protein, 9 aa, Influenza virus
KKTGGPIYK

SEQ ID NO: 333206 - protein, 9 aa, Influenza virus
KTGGPIYKR

SEQ ID NO: 333207 - protein, 9 aa, Influenza virus
EIRRVWRQA

SEQ ID NO: 333208 - protein, 9 aa, Influenza virus
IRRVWRQAN

SEQ ID NO: 333209 - protein, 9 aa, Influenza virus
RRVWRQANN

SEQ ID NO: 333210 - protein, 9 aa, Influenza virus
RVWRQANNG

SEQ ID NO: 333211 - protein, 9 aa, Influenza virus
VWRQANNGE

SEQ ID NO: 333212 - protein, 9 aa, Influenza virus
WRQANNGDD

SEQ ID NO: 333213 - protein, 9 aa, Influenza virus
RQANNGDDA

SEQ ID NO: 333214 - protein, 9 aa, Influenza virus
AGLTHLMIW

SEQ ID NO: 333215 - protein, 9 aa, Influenza virus
GLTHLMIWH

SEQ ID NO: 333216 - protein, 9 aa, Influenza virus
LTHLMIWHS

SEQ ID NO: 333217 - protein, 9 aa, Influenza virus
THLMIWHSN

SEQ ID NO: 333218 - protein, 9 aa, Influenza virus
HLMIWHSNL

SEQ ID NO: 333219 - protein, 9 aa, Influenza virus
LMIWHSNLN

SEQ ID NO: 333220 - protein, 9 aa, Influenza virus
IWHSNLNDT

SEQ ID NO: 333221 - protein, 9 aa, Influenza virus
WHSNLNDTT

SEQ ID NO: 333222 - protein, 9 aa, Influenza virus
HSNLNDTTY

SEQ ID NO: 333223 - protein, 9 aa, Influenza virus
SNLNDTTYQ

SEQ ID NO: 333224 - protein, 9 aa, Influenza virus
NLNDTTYQR

SEQ ID NO: 333225 - protein, 9 aa, Influenza virus
LNDTTYQRT

SEQ ID NO: 333226 - protein, 9 aa, Influenza virus
NDTTYQRTR

SEQ ID NO: 333227 - protein, 9 aa, Influenza virus
DTTYQRTRA

SEQ ID NO: 333228 - protein, 9 aa, Influenza virus
TTYQRTRAL

SEQ ID NO: 333229 - protein, 9 aa, Influenza virus
QRTRALVRS

SEQ ID NO: 333230 - protein, 9 aa, Influenza virus
RTRALVRSG

SEQ ID NO: 333231 - protein, 9 aa, Influenza virus
TRALVRSGM

SEQ ID NO: 333232 - protein, 9 aa, Influenza virus
RALVRSGMD

SEQ ID NO: 333233 - protein, 9 aa, Influenza virus
ALVRSGMDP

SEQ ID NO: 333234 - protein, 9 aa, Influenza virus
LVRSGMDPR

SEQ ID NO: 333235 - protein, 9 aa, Influenza virus
VRSGMDPRM

SEQ ID NO: 333236 - protein, 9 aa, Influenza virus
RSGMDPRMC

SEQ ID NO: 333237 - protein, 9 aa, Influenza virus
SGMDPRMCS

SEQ ID NO: 333238 - protein, 9 aa, Influenza virus
RSGAAGAAI

SEQ ID NO: 333239 - protein, 9 aa, Influenza virus
SGAAGAAIK

SEQ ID NO: 333240 - protein, 9 aa, Influenza virus
GAAGAAIKG

SEQ ID NO: 333241 - protein, 9 aa, Influenza virus
AAGAAVKGI

SEQ ID NO: 333242 - protein, 9 aa, Influenza virus
AGAAVKGIG

SEQ ID NO: 333243 - protein, 9 aa, Influenza virus
GAAVKGIGT

SEQ ID NO: 333244 - protein, 9 aa, Influenza virus
AAVKGVGTI

SEQ ID NO: 333245 - protein, 9 aa, Influenza virus
AMELIRMIK

SEQ ID NO: 333246 - protein, 9 aa, Influenza virus
MELIRMVKR

SEQ ID NO: 333247 - protein, 9 aa, Influenza virus
ELIRMVKRG

SEQ ID NO: 333248 - protein, 9 aa, Influenza virus
LIRMVKRGI

SEQ ID NO: 333249 - protein, 9 aa, Influenza virus
IRMVKRGIN

SEQ ID NO: 333250 - protein, 9 aa, Influenza virus
RMVKRGIND

SEQ ID NO: 333251 - protein, 9 aa, Influenza virus
MVKRGINDR

SEQ ID NO: 333252 - protein, 9 aa, Influenza virus
VKRGINDRN

SEQ ID NO: 333253 - protein, 9 aa, Influenza virus
KRGVNDRNF

SEQ ID NO: 333254 - protein, 9 aa, Influenza virus
RGVNDRNFW

SEQ ID NO: 333255 - protein, 9 aa, Influenza virus
GVNDRNFWR

SEQ ID NO: 333256 - protein, 9 aa, Influenza virus
VNDRNFWRG

SEQ ID NO: 333257 - protein, 9 aa, Influenza virus
NDRNFWRGD

SEQ ID NO: 333258 - protein, 9 aa, Influenza virus
DRNFWRGDN

SEQ ID NO: 333259 - protein, 9 aa, Influenza virus
RNFWRGDNG

SEQ ID NO: 333260 - protein, 9 aa, Influenza virus
NFWRGDNGR

SEQ ID NO: 333261 - protein, 9 aa, Influenza virus
FWRGENGRK

SEQ ID NO: 333262 - protein, 9 aa, Influenza virus
WRGENGRKT

SEQ ID NO: 333263 - protein, 9 aa, Influenza virus
RGENGRKTR

SEQ ID NO: 333264 - protein, 9 aa, Influenza virus
TRVAYERMC

SEQ ID NO: 333265 - protein, 9 aa, Influenza virus
RVAYERMCN

SEQ ID NO: 333266 - protein, 9 aa, Influenza virus
VAYERMCNI

SEQ ID NO: 333267 - protein, 9 aa, Influenza virus
GKFQTAAQK

SEQ ID NO: 333268 - protein, 9 aa, Influenza virus
KFQTAAQKA

SEQ ID NO: 333269 - protein, 9 aa, Influenza virus
FQTAAQKAM

SEQ ID NO: 333270 - protein, 9 aa, Influenza virus
QTAAQRAMV

SEQ ID NO: 333271 - protein, 9 aa, Influenza virus
TAAQRAMVD

SEQ ID NO: 333272 - protein, 9 aa, Influenza virus
AAQRAMVDQ

SEQ ID NO: 333273 - protein, 9 aa, Influenza virus
AQRAMVDQV

SEQ ID NO: 333274 - protein, 9 aa, Influenza virus
QRAMVDQVR

SEQ ID NO: 333275 - protein, 9 aa, Influenza virus
RAMVDQVRE

SEQ ID NO: 333276 - protein, 9 aa, Influenza virus
AMVDQVRES

SEQ ID NO: 333277 - protein, 9 aa, Influenza virus
MVDQVRESR

SEQ ID NO: 333278 - protein, 9 aa, Influenza virus
VDQVRESRN

SEQ ID NO: 333279 - protein, 9 aa, Influenza virus
DQVREGRNP

SEQ ID NO: 333280 - protein, 9 aa, Influenza virus
QVREGRNPG

SEQ ID NO: 333281 - protein, 9 aa, Influenza virus
VREGRNPGN

SEQ ID NO: 333282 - protein, 9 aa, Influenza virus
REGRNPGNA

SEQ ID NO: 333283 - protein, 9 aa, Influenza virus
EGRNPGNAE

SEQ ID NO: 333284 - protein, 9 aa, Influenza virus
GRNPGNAEI

SEQ ID NO: 333285 - protein, 9 aa, Influenza virus
RSPGNAEIE

SEQ ID NO: 333286 - protein, 9 aa, Influenza virus
SPGNAEIED

SEQ ID NO: 333287 - protein, 9 aa, Influenza virus
GNAEIEDLT

SEQ ID NO: 333288 - protein, 9 aa, Influenza virus
NAEIEDLTF

SEQ ID NO: 333289 - protein, 9 aa, Influenza virus
AEIEDLTFL

SEQ ID NO: 333290 - protein, 9 aa, Influenza virus
EIEDLTFLA

SEQ ID NO: 333291 - protein, 9 aa, Influenza virus
IEDLTFLAR

SEQ ID NO: 333292 - protein, 9 aa, Influenza virus
EDLTFLARS

SEQ ID NO: 333293 - protein, 9 aa, Influenza virus
DLTFLARSA

SEQ ID NO: 333294 - protein, 9 aa, Influenza virus
LTFLARSAL

SEQ ID NO: 333295 - protein, 9 aa, Influenza virus
TFLARSALI

SEQ ID NO: 333296 - protein, 9 aa, Influenza virus
FSARSALIL

SEQ ID NO: 333297 - protein, 9 aa, Influenza virus
SARSALILR

SEQ ID NO: 333298 - protein, 9 aa, Influenza virus
RSALILRGA

SEQ ID NO: 333299 - protein, 9 aa, Influenza virus
SALILRGSI

SEQ ID NO: 333300 - protein, 9 aa, Influenza virus
ALILRGSIA

SEQ ID NO: 333301 - protein, 9 aa, Influenza virus
LILRGSIAH

SEQ ID NO: 333302 - protein, 9 aa, Influenza virus
ILRGSIAHK

SEQ ID NO: 333303 - protein, 9 aa, Influenza virus
LRGSIAHKS

SEQ ID NO: 333304 - protein, 9 aa, Influenza virus
RGSIAHKSC

SEQ ID NO: 333305 - protein, 9 aa, Influenza virus
GSIAHKSCL

SEQ ID NO: 333306 - protein, 9 aa, Influenza virus
SIAHKSCLP

SEQ ID NO: 333307 - protein, 9 aa, Influenza virus
IAHKSCLPA

SEQ ID NO: 333308 - protein, 9 aa, Influenza virus
HKSCLPACA

SEQ ID NO: 333309 - protein, 9 aa, Influenza virus
KSCLPACAY

SEQ ID NO: 333310 - protein, 9 aa, Influenza virus
SCLPACAYG

SEQ ID NO: 333311 - protein, 9 aa, Influenza virus
CLPACVYGP

SEQ ID NO: 333312 - protein, 9 aa, Influenza virus
LPACVYGPA

SEQ ID NO: 333313 - protein, 9 aa, Influenza virus
PACVYGPAV

SEQ ID NO: 333314 - protein, 9 aa, Influenza virus
SGHDFEREG

SEQ ID NO: 333315 - protein, 9 aa, Influenza virus
GHDFEREGY

SEQ ID NO: 333316 - protein, 9 aa, Influenza virus
HDFEREGYS

SEQ ID NO: 333317 - protein, 9 aa, Influenza virus
DFEKEGYSL

SEQ ID NO: 333318 - protein, 9 aa, Influenza virus
FEKEGYSLV

SEQ ID NO: 333319 - protein, 9 aa, Influenza virus
EKEGYSLVG

SEQ ID NO: 333320 - protein, 9 aa, Influenza virus
KEGYSLVGI

SEQ ID NO: 333321 - protein, 9 aa, Influenza virus
EGYSLVGVD

SEQ ID NO: 333322 - protein, 9 aa, Influenza virus
GYSLVGVDP

SEQ ID NO: 333323 - protein, 9 aa, Influenza virus
YSLVGVDPF

SEQ ID NO: 333324 - protein, 9 aa, Influenza virus
SLVGIDPFR

SEQ ID NO: 333325 - protein, 9 aa, Influenza virus
LVGIDPFRL

SEQ ID NO: 333326 - protein, 9 aa, Influenza virus
VGIDPFRLL

SEQ ID NO: 333327 - protein, 9 aa, Influenza virus
GIDPFRLLQ

SEQ ID NO: 333328 - protein, 9 aa, Influenza virus
DPFRLLQNS

SEQ ID NO: 333329 - protein, 9 aa, Influenza virus
PFRLLQNSQ

SEQ ID NO: 333330 - protein, 9 aa, Influenza virus
FKLLQNSQV

SEQ ID NO: 333331 - protein, 9 aa, Influenza virus
SLMRPNENP

SEQ ID NO: 333332 - protein, 9 aa, Influenza virus
RSNENPAHK

SEQ ID NO: 333333 - protein, 9 aa, Influenza virus
SNENPAHKS

SEQ ID NO: 333334 - protein, 9 aa, Influenza virus
NENPVHKSQ

SEQ ID NO: 333335 - protein, 9 aa, Influenza virus
ENPVHKSQL

SEQ ID NO: 333336 - protein, 9 aa, Influenza virus
NPVHKSQLI

SEQ ID NO: 333337 - protein, 9 aa, Influenza virus
PVHKSQLIW

SEQ ID NO: 333338 - protein, 9 aa, Influenza virus
VHKSQLIWM

SEQ ID NO: 333339 - protein, 9 aa, Influenza virus
HKSQLIWMA

SEQ ID NO: 333340 - protein, 9 aa, Influenza virus
KSQLIWMAC

SEQ ID NO: 333341 - protein, 9 aa, Influenza virus
SQLVWMACN

SEQ ID NO: 333342 - protein, 9 aa, Influenza virus
QLVWMACNS

SEQ ID NO: 333343 - protein, 9 aa, Influenza virus
LVWMACNSA

SEQ ID NO: 333344 - protein, 9 aa, Influenza virus
VWMACNSAA

SEQ ID NO: 333345 - protein, 9 aa, Influenza virus
WMACNSAAF

SEQ ID NO: 333346 - protein, 9 aa, Influenza virus
MACNSAAFE

SEQ ID NO: 333347 - protein, 9 aa, Influenza virus
ACNSAAFED

SEQ ID NO: 333348 - protein, 9 aa, Influenza virus
CNSAAFEDL

SEQ ID NO: 333349 - protein, 9 aa, Influenza virus
NSAAFEDLR

SEQ ID NO: 333350 - protein, 9 aa, Influenza virus
SAAFEDLRL

SEQ ID NO: 333351 - protein, 9 aa, Influenza virus
AAFEDLRLL

SEQ ID NO: 333352 - protein, 9 aa, Influenza virus
PRGQLSTRG

SEQ ID NO: 333353 - protein, 9 aa, Influenza virus
LSTRGVQVA

SEQ ID NO: 333354 - protein, 9 aa, Influenza virus
STRGVQVAS

SEQ ID NO: 333355 - protein, 9 aa, Influenza virus
TRGVQVASN

SEQ ID NO: 333356 - protein, 9 aa, Influenza virus
RGVQVASNE

SEQ ID NO: 333357 - protein, 9 aa, Influenza virus
GVQVASNEN

SEQ ID NO: 333358 - protein, 9 aa, Influenza virus
TLELRSGYW

SEQ ID NO: 333359 - protein, 9 aa, Influenza virus
LELRSGYWA

SEQ ID NO: 333360 - protein, 9 aa, Influenza virus
ELRSGYWAI

SEQ ID NO: 333361 - protein, 9 aa, Influenza virus
LRSGYWAIR

SEQ ID NO: 333362 - protein, 9 aa, Influenza virus
RSGYWAIRT

SEQ ID NO: 333363 - protein, 9 aa, Influenza virus
SGYWAIRTR

SEQ ID NO: 333364 - protein, 9 aa, Influenza virus
GYWAIRTRS

SEQ ID NO: 333365 - protein, 9 aa, Influenza virus
IRTKSGGNT

SEQ ID NO: 333366 - protein, 9 aa, Influenza virus
RTRSGGNTS

SEQ ID NO: 333367 - protein, 9 aa, Influenza virus
TRSGGNTSQ

SEQ ID NO: 333368 - protein, 9 aa, Influenza virus
ASAGQTSVQ

SEQ ID NO: 333369 - protein, 9 aa, Influenza virus
SAGQTSVQP

SEQ ID NO: 333370 - protein, 9 aa, Influenza virus
STQPTFSVQ

SEQ ID NO: 333371 - protein, 9 aa, Influenza virus
TQPTFSVQR

SEQ ID NO: 333372 - protein, 9 aa, Influenza virus
QPAFSVQRN

SEQ ID NO: 333373 - protein, 9 aa, Influenza virus
PAFSVQRNL

SEQ ID NO: 333374 - protein, 9 aa, Influenza virus
AFSVQRNLP

SEQ ID NO: 333375 - protein, 9 aa, Influenza virus
FSVQRSLPF

SEQ ID NO: 333376 - protein, 9 aa, Influenza virus
SVQRNLPFD

SEQ ID NO: 333377 - protein, 9 aa, Influenza virus
VQRNLPFEK

SEQ ID NO: 333378 - protein, 9 aa, Influenza virus
GNNEGRTSD

SEQ ID NO: 333379 - protein, 9 aa, Influenza virus
NEGRTSDMR

SEQ ID NO: 333380 - protein, 9 aa, Influenza virus
EGRTSDMRA

SEQ ID NO: 333381 - protein, 9 aa, Influenza virus
GRTSDMRAE

SEQ ID NO: 333382 - protein, 9 aa, Influenza virus
RTSDMRAEI

SEQ ID NO: 333383 - protein, 9 aa, Influenza virus
TSDMRAEII

SEQ ID NO: 333384 - protein, 9 aa, Influenza virus
SDMRTEVIR

SEQ ID NO: 333385 - protein, 9 aa, Influenza virus
DLSFQGRGV

SEQ ID NO: 333386 - protein, 9 aa, Influenza virus
LSFQGRGVF

SEQ ID NO: 333387 - protein, 9 aa, Influenza virus
SFRGRGVFE

SEQ ID NO: 333388 - protein, 9 aa, Influenza virus
FRGRGVFEL

SEQ ID NO: 333389 - protein, 9 aa, Influenza virus
RGRGVFELS

SEQ ID NO: 333390 - protein, 9 aa, Influenza virus
GRGVFEFSD

SEQ ID NO: 333391 - protein, 9 aa, Influenza virus
RGVFEFSDE

SEQ ID NO: 333392 - protein, 9 aa, Influenza virus
GVFELSDER

SEQ ID NO: 333393 - protein, 9 aa, Influenza virus
VFELSDERA

SEQ ID NO: 333394 - protein, 9 aa, Influenza virus
FELSDERAT

SEQ ID NO: 333395 - protein, 9 aa, Influenza virus
AANPIVPSF

SEQ ID NO: 333396 - protein, 9 aa, Influenza virus
TNPIVPSFE

SEQ ID NO: 333397 - protein, 9 aa, Influenza virus
NPIVPSFEM

SEQ ID NO: 333398 - protein, 9 aa, Influenza virus
PIVPSFDMN

SEQ ID NO: 333399 - protein, 9 aa, Influenza virus
IVPSFDMNN

SEQ ID NO: 333400 - protein, 9 aa, Influenza virus
VPSFDMNNE

SEQ ID NO: 333401 - protein, 9 aa, Influenza virus
PSFDMNNEG

SEQ ID NO: 333402 - protein, 9 aa, Influenza virus
FDMNNEGSY

SEQ ID NO: 333403 - protein, 9 aa, Influenza virus
MNNEGSYFF

SEQ ID NO: 333404 - protein, 9 aa, Influenza virus
NNEGSYFFG

SEQ ID NO: 333405 - protein, 9 aa, Influenza virus
KEGSYFFGD

SEQ ID NO: 333406 - protein, 9 aa, Influenza virus
SYFFGDNAK

SEQ ID NO: 333407 - protein, 9 aa, Influenza virus
YFFGDSAEE

SEQ ID NO: 333408 - protein, 9 aa, Influenza virus
FFGDNAEEF

SEQ ID NO: 333409 - protein, 9 aa, Influenza virus
TSFQVDCYL

SEQ ID NO: 333410 - protein, 9 aa, Influenza virus
SFQVDCYLW

SEQ ID NO: 333411 - protein, 9 aa, Influenza virus
FQVDCYLWH

SEQ ID NO: 333412 - protein, 9 aa, Influenza virus
QVDCFLWHI

SEQ ID NO: 333413 - protein, 9 aa, Influenza virus
VDCFLWHIR

SEQ ID NO: 333414 - protein, 9 aa, Influenza virus
SDAPFLDRL

SEQ ID NO: 333415 - protein, 9 aa, Influenza virus
DAPFDDRLR

SEQ ID NO: 333416 - protein, 9 aa, Influenza virus
APFDDRLRR

SEQ ID NO: 333417 - protein, 9 aa, Influenza virus
PFDDRLRRD

SEQ ID NO: 333418 - protein, 9 aa, Influenza virus
FDDRLRRDQ

SEQ ID NO: 333419 - protein, 9 aa, Influenza virus
SSLLLQANL

SEQ ID NO: 333420 - protein, 9 aa, Influenza virus
SLLLQANLC

SEQ ID NO: 333421 - protein, 9 aa, Influenza virus
DRLRRDQRS

SEQ ID NO: 333422 - protein, 9 aa, Influenza virus
RLRRDQRSL

SEQ ID NO: 333423 - protein, 9 aa, Influenza virus
RRDQKSLKG

SEQ ID NO: 333424 - protein, 9 aa, Influenza virus
RDQKSLKGR

SEQ ID NO: 333425 - protein, 9 aa, Influenza virus
LKMPASRYL

SEQ ID NO: 333426 - protein, 9 aa, Influenza virus
SVPASRYLI

SEQ ID NO: 333427 - protein, 9 aa, Influenza virus
VPASRYLID

SEQ ID NO: 333428 - protein, 9 aa, Influenza virus
PASRYLTDM

SEQ ID NO: 333429 - protein, 9 aa, Influenza virus
VRRDQMAHC

SEQ ID NO: 333430 - protein, 9 aa, Influenza virus
RHRLKITEN

SEQ ID NO: 333431 - protein, 9 aa, Influenza virus
RDQMAHCRM

SEQ ID NO: 333432 - protein, 9 aa, Influenza virus
FQVDCFLWH

SEQ ID NO: 333433 - protein, 9 aa, Influenza virus
QVDCFLWHV

SEQ ID NO: 333434 - protein, 9 aa, Influenza virus
VDCFLWHVR

SEQ ID NO: 333435 - protein, 9 aa, Influenza virus
DCFLWHVRK

SEQ ID NO: 333436 - protein, 9 aa, Influenza virus
CFLWHVRKR

SEQ ID NO: 333437 - protein, 9 aa, Influenza virus
MTIASDILK

SEQ ID NO: 333438 - protein, 9 aa, Influenza virus
TIASDILKR

SEQ ID NO: 333439 - protein, 9 aa, Influenza virus
IASDILTRM

SEQ ID NO: 333440 - protein, 9 aa, Influenza virus
ASDILTRMS

SEQ ID NO: 333441 - protein, 9 aa, Influenza virus
QKFEEVRWL

SEQ ID NO: 333442 - protein, 9 aa, Influenza virus
KFEEVRWLI

SEQ ID NO: 333443 - protein, 9 aa, Influenza virus
TESSFEQIT

SEQ ID NO: 333444 - protein, 9 aa, Influenza virus
ESSFEQITF

SEQ ID NO: 333445 - protein, 9 aa, Influenza virus
NSFEQITFL

SEQ ID NO: 333446 - protein, 9 aa, Influenza virus
SFEQITFLQ

SEQ ID NO: 333447 - protein, 9 aa, Influenza virus
FEQITFLQA

SEQ ID NO: 333448 - protein, 9 aa, Influenza virus
EQITFLQAL

SEQ ID NO: 333449 - protein, 9 aa, Influenza virus
QITFLQALQ

SEQ ID NO: 333450 - protein, 9 aa, Influenza virus
ITFLQALQL

SEQ ID NO: 333451 - protein, 9 aa, Influenza virus
TFLQALQLL

SEQ ID NO: 333452 - protein, 9 aa, Influenza virus
FMQALQLLF

SEQ ID NO: 333453 - protein, 9 aa, Influenza virus
MQALQLLFE

SEQ ID NO: 333454 - protein, 9 aa, Influenza virus
QALQLLFEV

SEQ ID NO: 333455 - protein, 9 aa, Influenza virus
ALQLLFEVE

SEQ ID NO: 333456 - protein, 9 aa, Influenza virus
LQLLFEVEQ

SEQ ID NO: 333457 - protein, 9 aa, Influenza virus
QLLFEVEQE

SEQ ID NO: 333458 - protein, 9 aa, Influenza virus
EVEQEIRAF

SEQ ID NO: 333459 - protein, 9 aa, Influenza virus
VEQEIRAFS

SEQ ID NO: 333460 - protein, 9 aa, Influenza virus
EIRAFSFQL

SEQ ID NO: 333461 - protein, 9 aa, Influenza virus
IRAFSFQLI

SEQ ID NO: 333462 - protein, 9 aa, Influenza virus
RTFSFQLIL

SEQ ID NO: 333463 - protein, 9 aa, Influenza virus
TFSFQLINN

SEQ ID NO: 333464 - protein, 9 aa, Influenza virus
MENFVRQCF

SEQ ID NO: 333465 - protein, 9 aa, Influenza virus
ENFVRQCFN

SEQ ID NO: 333466 - protein, 9 aa, Influenza virus
NFVRQCFNP

SEQ ID NO: 333467 - protein, 9 aa, Influenza virus
VRQCFNPMV

SEQ ID NO: 333468 - protein, 9 aa, Influenza virus
RQCFNPMII

SEQ ID NO: 333469 - protein, 9 aa, Influenza virus
QCFNPMIIE

SEQ ID NO: 333470 - protein, 9 aa, Influenza virus
CFNPMIIEL

SEQ ID NO: 333471 - protein, 9 aa, Influenza virus
FNPMIIELA

SEQ ID NO: 333472 - protein, 9 aa, Influenza virus
NPMIIELAE

SEQ ID NO: 333473 - protein, 9 aa, Influenza virus
PMIIELAEK

SEQ ID NO: 333474 - protein, 9 aa, Influenza virus
VELAEKTMK

SEQ ID NO: 333475 - protein, 9 aa, Influenza virus
ELAEKTMKE

SEQ ID NO: 333476 - protein, 9 aa, Influenza virus
LAEKTMKEY

SEQ ID NO: 333477 - protein, 9 aa, Influenza virus
AEKTMKEYG

SEQ ID NO: 333478 - protein, 9 aa, Influenza virus
EKTMKEYGE

SEQ ID NO: 333479 - protein, 9 aa, Influenza virus
ETNKLAAIC

SEQ ID NO: 333480 - protein, 9 aa, Influenza virus
TNKLAAICT

SEQ ID NO: 333481 - protein, 9 aa, Influenza virus
NKLAAICTH

SEQ ID NO: 333482 - protein, 9 aa, Influenza virus
KFAAICTHM

SEQ ID NO: 333483 - protein, 9 aa, Influenza virus
FAAICTHME

SEQ ID NO: 333484 - protein, 9 aa, Influenza virus
AAICTHMEV

SEQ ID NO: 333485 - protein, 9 aa, Influenza virus
AICTHMEVC

SEQ ID NO: 333486 - protein, 9 aa, Influenza virus
ICTHMEVCF

SEQ ID NO: 333487 - protein, 9 aa, Influenza virus
CTHMEVCFM

SEQ ID NO: 333488 - protein, 9 aa, Influenza virus
THMEVCFMY

SEQ ID NO: 333489 - protein, 9 aa, Influenza virus
HMEVCFMYS

SEQ ID NO: 333490 - protein, 9 aa, Influenza virus
MEVCFMYSD

SEQ ID NO: 333491 - protein, 9 aa, Influenza virus
EICFMYSDF

SEQ ID NO: 333492 - protein, 9 aa, Influenza virus
ICFMYSDFH

SEQ ID NO: 333493 - protein, 9 aa, Influenza virus
MYSDFHFIN

SEQ ID NO: 333494 - protein, 9 aa, Influenza virus
YSDFHFINE

SEQ ID NO: 333495 - protein, 9 aa, Influenza virus
SDFHFINEQ

SEQ ID NO: 333496 - protein, 9 aa, Influenza virus
DSNALLKHR

SEQ ID NO: 333497 - protein, 9 aa, Influenza virus
SNALLKHRF

SEQ ID NO: 333498 - protein, 9 aa, Influenza virus
NVLLKHRFE

SEQ ID NO: 333499 - protein, 9 aa, Influenza virus
VLLKHRFEI

SEQ ID NO: 333500 - protein, 9 aa, Influenza virus
EIIEGRDRI

SEQ ID NO: 333501 - protein, 9 aa, Influenza virus
AWTVVNSLC

SEQ ID NO: 333502 - protein, 9 aa, Influenza virus
KPRFLPDLY

SEQ ID NO: 333503 - protein, 9 aa, Influenza virus
PRFLPDLYD

SEQ ID NO: 333504 - protein, 9 aa, Influenza virus
RFLPDLYDY

SEQ ID NO: 333505 - protein, 9 aa, Influenza virus
YLPDLYDYK

SEQ ID NO: 333506 - protein, 9 aa, Influenza virus
PDLYDYKED

SEQ ID NO: 333507 - protein, 9 aa, Influenza virus
DLYDYKEDR

SEQ ID NO: 333508 - protein, 9 aa, Influenza virus
LYDYKEDRF

SEQ ID NO: 333509 - protein, 9 aa, Influenza virus
RFVEIGVTR

SEQ ID NO: 333510 - protein, 9 aa, Influenza virus
FVEIGVTRR

SEQ ID NO: 333511 - protein, 9 aa, Influenza virus
VEIGVTRRE

SEQ ID NO: 333512 - protein, 9 aa, Influenza virus
EIGVTRREI

SEQ ID NO: 333513 - protein, 9 aa, Influenza virus
IGVTRREIH

SEQ ID NO: 333514 - protein, 9 aa, Influenza virus
GVTRREVHT

SEQ ID NO: 333515 - protein, 9 aa, Influenza virus
VTRREVHTY

SEQ ID NO: 333516 - protein, 9 aa, Influenza virus
TRREVHTYY

SEQ ID NO: 333517 - protein, 9 aa, Influenza virus
RREVHTYYL

SEQ ID NO: 333518 - protein, 9 aa, Influenza virus
REVHTYYLE

SEQ ID NO: 333519 - protein, 9 aa, Influenza virus
EVHTYYLEK

SEQ ID NO: 333520 - protein, 9 aa, Influenza virus
VHTYYLEKA

SEQ ID NO: 333521 - protein, 9 aa, Influenza virus
YYLEKASKI

SEQ ID NO: 333522 - protein, 9 aa, Influenza virus
YLEKASKIK

SEQ ID NO: 333523 - protein, 9 aa, Influenza virus
LEKANKIKT

SEQ ID NO: 333524 - protein, 9 aa, Influenza virus
EKANKIKTE

SEQ ID NO: 333525 - protein, 9 aa, Influenza virus
ENTHIHIFS

SEQ ID NO: 333526 - protein, 9 aa, Influenza virus
NTHIHIFSF

SEQ ID NO: 333527 - protein, 9 aa, Influenza virus
THIHIFSFN

SEQ ID NO: 333528 - protein, 9 aa, Influenza virus
HIHIFSFNG

SEQ ID NO: 333529 - protein, 9 aa, Influenza virus
IHIFSFNGE

SEQ ID NO: 333530 - protein, 9 aa, Influenza virus
HIFSFNGEE

SEQ ID NO: 333531 - protein, 9 aa, Influenza virus
IFSFNGEEM

SEQ ID NO: 333532 - protein, 9 aa, Influenza virus
FSFNGEEMA

SEQ ID NO: 333533 - protein, 9 aa, Influenza virus
SFNGEEMAT

SEQ ID NO: 333534 - protein, 9 aa, Influenza virus
FTGEEMATR

SEQ ID NO: 333535 - protein, 9 aa, Influenza virus
DYTIDEESR

SEQ ID NO: 333536 - protein, 9 aa, Influenza virus
YTIDEESRA

SEQ ID NO: 333537 - protein, 9 aa, Influenza virus
TIDEESRAR

SEQ ID NO: 333538 - protein, 9 aa, Influenza virus
IDEESRARI

SEQ ID NO: 333539 - protein, 9 aa, Influenza virus
RLFTIRQEL

SEQ ID NO: 333540 - protein, 9 aa, Influenza virus
LFTIRQELA

SEQ ID NO: 333541 - protein, 9 aa, Influenza virus
FTIRQEMAN

SEQ ID NO: 333542 - protein, 9 aa, Influenza virus
TIRQEMANR

SEQ ID NO: 333543 - protein, 9 aa, Influenza virus
RSLWDSFRQ

SEQ ID NO: 333544 - protein, 9 aa, Influenza virus
SLWDSFRQS

SEQ ID NO: 333545 - protein, 9 aa, Influenza virus
FRQSERGED

SEQ ID NO: 333546 - protein, 9 aa, Influenza virus
RQSERGEDT

SEQ ID NO: 333547 - protein, 9 aa, Influenza virus
QSERGEDTI

SEQ ID NO: 333548 - protein, 9 aa, Influenza virus
SERGEDTIE

SEQ ID NO: 333549 - protein, 9 aa, Influenza virus
ERGEDTIEE

SEQ ID NO: 333550 - protein, 9 aa, Influenza virus
RGEETIEEK

SEQ ID NO: 333551 - protein, 9 aa, Influenza virus
GEETIEEKF

SEQ ID NO: 333552 - protein, 9 aa, Influenza virus
EETIEEKFE

SEQ ID NO: 333553 - protein, 9 aa, Influenza virus
ETIEEKFEI

SEQ ID NO: 333554 - protein, 9 aa, Influenza virus
LANQSLPPN

SEQ ID NO: 333555 - protein, 9 aa, Influenza virus
ANQSLPPNF

SEQ ID NO: 333556 - protein, 9 aa, Influenza virus
NQSLPPNFS

SEQ ID NO: 333557 - protein, 9 aa, Influenza virus
QSLPPNFSC

SEQ ID NO: 333558 - protein, 9 aa, Influenza virus
NFRVYVDGF

SEQ ID NO: 333559 - protein, 9 aa, Influenza virus
FRAYVDGFK

SEQ ID NO: 333560 - protein, 9 aa, Influenza virus
RAYVDGFKP

SEQ ID NO: 333561 - protein, 9 aa, Influenza virus
AYVDGFKPN

SEQ ID NO: 333562 - protein, 9 aa, Influenza virus
YVDGFKPNG

SEQ ID NO: 333563 - protein, 9 aa, Influenza virus
VDGFEPNGY

SEQ ID NO: 333564 - protein, 9 aa, Influenza virus
DGFEPNGYI

SEQ ID NO: 333565 - protein, 9 aa, Influenza virus
GFEPNGYIE

SEQ ID NO: 333566 - protein, 9 aa, Influenza virus
FEPNGYIEG

SEQ ID NO: 333567 - protein, 9 aa, Influenza virus
EPNGYIEGK

SEQ ID NO: 333568 - protein, 9 aa, Influenza virus
PNGYIEGKL

SEQ ID NO: 333569 - protein, 9 aa, Influenza virus
NGYIEGKLS

SEQ ID NO: 333570 - protein, 9 aa, Influenza virus
GYIEGKLSQ

SEQ ID NO: 333571 - protein, 9 aa, Influenza virus
YIEGKLSQM

SEQ ID NO: 333572 - protein, 9 aa, Influenza virus
IESKLSQMS

SEQ ID NO: 333573 - protein, 9 aa, Influenza virus
EGKLSQMSR

SEQ ID NO: 333574 - protein, 9 aa, Influenza virus
KLSQMSREV

SEQ ID NO: 333575 - protein, 9 aa, Influenza virus
CHQRSKFLL

SEQ ID NO: 333576 - protein, 9 aa, Influenza virus
HQRSKFLLM

SEQ ID NO: 333577 - protein, 9 aa, Influenza virus
RSKFLLMDS

SEQ ID NO: 333578 - protein, 9 aa, Influenza virus
SKFLLMDSL

SEQ ID NO: 333579 - protein, 9 aa, Influenza virus
KFLLMDSLK

SEQ ID NO: 333580 - protein, 9 aa, Influenza virus
FLLMDSLKL

SEQ ID NO: 333581 - protein, 9 aa, Influenza virus
LLMDSLKLS

SEQ ID NO: 333582 - protein, 9 aa, Influenza virus
LMDSLKLSI

SEQ ID NO: 333583 - protein, 9 aa, Influenza virus
MDSLKLSIE

SEQ ID NO: 333584 - protein, 9 aa, Influenza virus
DSLKLSIED

SEQ ID NO: 333585 - protein, 9 aa, Influenza virus
SLKLSIEDP

SEQ ID NO: 333586 - protein, 9 aa, Influenza virus
LKLSIEDPN

SEQ ID NO: 333587 - protein, 9 aa, Influenza virus
KLSIEDPNH

SEQ ID NO: 333588 - protein, 9 aa, Influenza virus
LSIEDPNHE

SEQ ID NO: 333589 - protein, 9 aa, Influenza virus
SIEDPNHEG

SEQ ID NO: 333590 - protein, 9 aa, Influenza virus
IEDPNHEGE

SEQ ID NO: 333591 - protein, 9 aa, Influenza virus
EDPNHEGEG

SEQ ID NO: 333592 - protein, 9 aa, Influenza virus
DPNHEGEGI

SEQ ID NO: 333593 - protein, 9 aa, Influenza virus
PNHEGEGIP

SEQ ID NO: 333594 - protein, 9 aa, Influenza virus
NHEGEGIPL

SEQ ID NO: 333595 - protein, 9 aa, Influenza virus
HEGEGIPLH

SEQ ID NO: 333596 - protein, 9 aa, Influenza virus
EGEGIPLHD

SEQ ID NO: 333597 - protein, 9 aa, Influenza virus
GEGIPLHDA

SEQ ID NO: 333598 - protein, 9 aa, Influenza virus
EGIPLYDAV

SEQ ID NO: 333599 - protein, 9 aa, Influenza virus
GIPLYDAVR

SEQ ID NO: 333600 - protein, 9 aa, Influenza virus
IPLYDAVRC

SEQ ID NO: 333601 - protein, 9 aa, Influenza virus
KCIKTFFGW

SEQ ID NO: 333602 - protein, 9 aa, Influenza virus
CIKTFFGWK

SEQ ID NO: 333603 - protein, 9 aa, Influenza virus
RTFFGWKEP

SEQ ID NO: 333604 - protein, 9 aa, Influenza virus
LRWALGENM

SEQ ID NO: 333605 - protein, 9 aa, Influenza virus
RWALGENMA

SEQ ID NO: 333606 - protein, 9 aa, Influenza virus
WVLGENMAP

SEQ ID NO: 333607 - protein, 9 aa, Influenza virus
VLGENMAPE

SEQ ID NO: 333608 - protein, 9 aa, Influenza virus
GENMAPEKM

SEQ ID NO: 333609 - protein, 9 aa, Influenza virus
ENMAPEKMD

SEQ ID NO: 333610 - protein, 9 aa, Influenza virus
NMAPEKMDF

SEQ ID NO: 333611 - protein, 9 aa, Influenza virus
MAPEKVDFE

SEQ ID NO: 333612 - protein, 9 aa, Influenza virus
WIQNEFNKA

SEQ ID NO: 333613 - protein, 9 aa, Influenza virus
IQNEFNKAC

SEQ ID NO: 333614 - protein, 9 aa, Influenza virus
QSEFNKACE

SEQ ID NO: 333615 - protein, 9 aa, Influenza virus
SEFNKACEL

SEQ ID NO: 333616 - protein, 9 aa, Influenza virus
KACELTDSI

SEQ ID NO: 333617 - protein, 9 aa, Influenza virus
ACELTDSIW

SEQ ID NO: 333618 - protein, 9 aa, Influenza virus
WLELDEIGE

SEQ ID NO: 333619 - protein, 9 aa, Influenza virus
LELDEIGED

SEQ ID NO: 333620 - protein, 9 aa, Influenza virus
ELDEIGEDI

SEQ ID NO: 333621 - protein, 9 aa, Influenza virus
LDEIGEDIA

SEQ ID NO: 333622 - protein, 9 aa, Influenza virus
DEIGEDIAP

SEQ ID NO: 333623 - protein, 9 aa, Influenza virus
EIGEDIAPI

SEQ ID NO: 333624 - protein, 9 aa, Influenza virus
IGEDIAPIE

SEQ ID NO: 333625 - protein, 9 aa, Influenza virus
GEDVAPIEY

SEQ ID NO: 333626 - protein, 9 aa, Influenza virus
APIEYIASM

SEQ ID NO: 333627 - protein, 9 aa, Influenza virus
PIEYIASMR

SEQ ID NO: 333628 - protein, 9 aa, Influenza virus
IEYIASMRR

SEQ ID NO: 333629 - protein, 9 aa, Influenza virus
VASMRRNYF

SEQ ID NO: 333630 - protein, 9 aa, Influenza virus
ASMRRDYFT

SEQ ID NO: 333631 - protein, 9 aa, Influenza virus
RRNYFTAEI

SEQ ID NO: 333632 - protein, 9 aa, Influenza virus
RNYFTAEIS

SEQ ID NO: 333633 - protein, 9 aa, Influenza virus
YFTAEISHC

SEQ ID NO: 333634 - protein, 9 aa, Influenza virus
FTAEISHCR

SEQ ID NO: 333635 - protein, 9 aa, Influenza virus
TAEISHCRA

SEQ ID NO: 333636 - protein, 9 aa, Influenza virus
AEISHCRAT

SEQ ID NO: 333637 - protein, 9 aa, Influenza virus
EISHCRATE

SEQ ID NO: 333638 - protein, 9 aa, Influenza virus
ISHCRATEY

SEQ ID NO: 333639 - protein, 9 aa, Influenza virus
SYCRATEYI

SEQ ID NO: 333640 - protein, 9 aa, Influenza virus
YCRATEYIM

SEQ ID NO: 333641 - protein, 9 aa, Influenza virus
CRATEYMMK

SEQ ID NO: 333642 - protein, 9 aa, Influenza virus
RATEYMMKG

SEQ ID NO: 333643 - protein, 9 aa, Influenza virus
ATEYMMKGV

SEQ ID NO: 333644 - protein, 9 aa, Influenza virus
TEYMMKGVY

SEQ ID NO: 333645 - protein, 9 aa, Influenza virus
MKGVYVNTA

SEQ ID NO: 333646 - protein, 9 aa, Influenza virus
KGVYVNTAL

SEQ ID NO: 333647 - protein, 9 aa, Influenza virus
GVYVNTALL

SEQ ID NO: 333648 - protein, 9 aa, Influenza virus
VYVNTALLN

SEQ ID NO: 333649 - protein, 9 aa, Influenza virus
YVNTALLNA

SEQ ID NO: 333650 - protein, 9 aa, Influenza virus
VNTALLNAS

SEQ ID NO: 333651 - protein, 9 aa, Influenza virus
TAMLNASCA

SEQ ID NO: 333652 - protein, 9 aa, Influenza virus
AMLNASCAA

SEQ ID NO: 333653 - protein, 9 aa, Influenza virus
MLNASCAAM

SEQ ID NO: 333654 - protein, 9 aa, Influenza virus
LNASCAAME

SEQ ID NO: 333655 - protein, 9 aa, Influenza virus
NASCAAMDE

SEQ ID NO: 333656 - protein, 9 aa, Influenza virus
ASCAAMDEF

SEQ ID NO: 333657 - protein, 9 aa, Influenza virus
SCAAMDEFQ

SEQ ID NO: 333658 - protein, 9 aa, Influenza virus
CAAMDEFQL

SEQ ID NO: 333659 - protein, 9 aa, Influenza virus
AAMDEFQLI

SEQ ID NO: 333660 - protein, 9 aa, Influenza virus
AMDEFQLIP

SEQ ID NO: 333661 - protein, 9 aa, Influenza virus
MDEFQLIPM

SEQ ID NO: 333662 - protein, 9 aa, Influenza virus
DEFQLIPMI

SEQ ID NO: 333663 - protein, 9 aa, Influenza virus
EFQLIPMIS

SEQ ID NO: 333664 - protein, 9 aa, Influenza virus
LIPMISKCK

SEQ ID NO: 333665 - protein, 9 aa, Influenza virus
IPMISKCKT

SEQ ID NO: 333666 - protein, 9 aa, Influenza virus
PMISKCRTR

SEQ ID NO: 333667 - protein, 9 aa, Influenza virus
MISKCRTRE

SEQ ID NO: 333668 - protein, 9 aa, Influenza virus
ISKCRTREG

SEQ ID NO: 333669 - protein, 9 aa, Influenza virus
SKCRTREGR

SEQ ID NO: 333670 - protein, 9 aa, Influenza virus
KCRTREGRR

SEQ ID NO: 333671 - protein, 9 aa, Influenza virus
CRTREGRRK

SEQ ID NO: 333672 - protein, 9 aa, Influenza virus
RTREGRRKT

SEQ ID NO: 333673 - protein, 9 aa, Influenza virus
TREGRRKTN

SEQ ID NO: 333674 - protein, 9 aa, Influenza virus
REGRRKTNL

SEQ ID NO: 333675 - protein, 9 aa, Influenza virus
EGRRRTNLY

SEQ ID NO: 333676 - protein, 9 aa, Influenza virus
RRRTNLYGF

SEQ ID NO: 333677 - protein, 9 aa, Influenza virus
RRTNLYGFI

SEQ ID NO: 333678 - protein, 9 aa, Influenza virus
KTNLYGFIV

SEQ ID NO: 333679 - protein, 9 aa, Influenza virus
TNLYGFIVK

SEQ ID NO: 333680 - protein, 9 aa, Influenza virus
NLYGFIVKG

SEQ ID NO: 333681 - protein, 9 aa, Influenza virus
LYGFIVKGR

SEQ ID NO: 333682 - protein, 9 aa, Influenza virus
YGFIVKGRS

SEQ ID NO: 333683 - protein, 9 aa, Influenza virus
GFIVKGRSH

SEQ ID NO: 333684 - protein, 9 aa, Influenza virus
FIVKGRSHL

SEQ ID NO: 333685 - protein, 9 aa, Influenza virus
IVKGRSHLR

SEQ ID NO: 333686 - protein, 9 aa, Influenza virus
VKGRSHLRN

SEQ ID NO: 333687 - protein, 9 aa, Influenza virus
RNDTDVVNY

SEQ ID NO: 333688 - protein, 9 aa, Influenza virus
NDTDVVNYV

SEQ ID NO: 333689 - protein, 9 aa, Influenza virus
DTDVVNYVS

SEQ ID NO: 333690 - protein, 9 aa, Influenza virus
TDVVNYVSM

SEQ ID NO: 333691 - protein, 9 aa, Influenza virus
DVVNYVSME

SEQ ID NO: 333692 - protein, 9 aa, Influenza virus
VVNYVSMEF

SEQ ID NO: 333693 - protein, 9 aa, Influenza virus
VNYVSMEFS

SEQ ID NO: 333694 - protein, 9 aa, Influenza virus
NYVSMEFSL

SEQ ID NO: 333695 - protein, 9 aa, Influenza virus
YVSMEFSLT

SEQ ID NO: 333696 - protein, 9 aa, Influenza virus
LSMEFSLTD

SEQ ID NO: 333697 - protein, 9 aa, Influenza virus
MEFSLTDPK

SEQ ID NO: 333698 - protein, 9 aa, Influenza virus
EFSLTDPRF

SEQ ID NO: 333699 - protein, 9 aa, Influenza virus
FSLTDPRFE

SEQ ID NO: 333700 - protein, 9 aa, Influenza virus
KWEKYCILE

SEQ ID NO: 333701 - protein, 9 aa, Influenza virus
PMFLYIRTN

SEQ ID NO: 333702 - protein, 9 aa, Influenza virus
MFLYIRTNG

SEQ ID NO: 333703 - protein, 9 aa, Influenza virus
FLYIRTNGT

SEQ ID NO: 333704 - protein, 9 aa, Influenza virus
LYIRTNGTS

SEQ ID NO: 333705 - protein, 9 aa, Influenza virus
YIRTNGTSK

SEQ ID NO: 333706 - protein, 9 aa, Influenza virus
VRTNGTSKV

SEQ ID NO: 333707 - protein, 9 aa, Influenza virus
RTNGTSKVK

SEQ ID NO: 333708 - protein, 9 aa, Influenza virus
TNGTSKVKM

SEQ ID NO: 333709 - protein, 9 aa, Influenza virus
NGTSKVKMK

SEQ ID NO: 333710 - protein, 9 aa, Influenza virus
GTSKVKMKW

SEQ ID NO: 333711 - protein, 9 aa, Influenza virus
TSKVKMKWG

SEQ ID NO: 333712 - protein, 9 aa, Influenza virus
SKVKMKWGM

SEQ ID NO: 333713 - protein, 9 aa, Influenza virus
KVKMKWGME

SEQ ID NO: 333714 - protein, 9 aa, Influenza virus
VKMKWGMEM

SEQ ID NO: 333715 - protein, 9 aa, Influenza virus
KMKWGMELR

SEQ ID NO: 333716 - protein, 9 aa, Influenza virus
MKWGMELRR

SEQ ID NO: 333717 - protein, 9 aa, Influenza virus
KWGMELRRC

SEQ ID NO: 333718 - protein, 9 aa, Influenza virus
WGMELRRCL

SEQ ID NO: 333719 - protein, 9 aa, Influenza virus
GMELRRCLL

SEQ ID NO: 333720 - protein, 9 aa, Influenza virus
MELRRCLLQ

SEQ ID NO: 333721 - protein, 9 aa, Influenza virus
ELRRCLLQS

SEQ ID NO: 333722 - protein, 9 aa, Influenza virus
LRRCLLQSL

SEQ ID NO: 333723 - protein, 9 aa, Influenza virus
QSLQQIESI

SEQ ID NO: 333724 - protein, 9 aa, Influenza virus
SLQQIESMV

SEQ ID NO: 333725 - protein, 9 aa, Influenza virus
LQQIESMVE

SEQ ID NO: 333726 - protein, 9 aa, Influenza virus
QQIESMVEA

SEQ ID NO: 333727 - protein, 9 aa, Influenza virus
QIESMVEAE

SEQ ID NO: 333728 - protein, 9 aa, Influenza virus
IESMVEAES

SEQ ID NO: 333729 - protein, 9 aa, Influenza virus
ESMVEAESS

SEQ ID NO: 333730 - protein, 9 aa, Influenza virus
SMIEAESSI

SEQ ID NO: 333731 - protein, 9 aa, Influenza virus
MIEAESSIK

SEQ ID NO: 333732 - protein, 9 aa, Influenza virus
IEAESSIKE

SEQ ID NO: 333733 - protein, 9 aa, Influenza virus
EAESSIKEK

SEQ ID NO: 333734 - protein, 9 aa, Influenza virus
AESSIKEKD

SEQ ID NO: 333735 - protein, 9 aa, Influenza virus
ESSIKEKDM

SEQ ID NO: 333736 - protein, 9 aa, Influenza virus
SSIKEKDMT

SEQ ID NO: 333737 - protein, 9 aa, Influenza virus
SIKEKDMTK

SEQ ID NO: 333738 - protein, 9 aa, Influenza virus
IKEKDMTKE

SEQ ID NO: 333739 - protein, 9 aa, Influenza virus
KEKDMTREF

SEQ ID NO: 333740 - protein, 9 aa, Influenza virus
EKDMTREFF

SEQ ID NO: 333741 - protein, 9 aa, Influenza virus
KDMTREFFE

SEQ ID NO: 333742 - protein, 9 aa, Influenza virus
EAWPIGESP

SEQ ID NO: 333743 - protein, 9 aa, Influenza virus
WPIGESPRG

SEQ ID NO: 333744 - protein, 9 aa, Influenza virus
GVEESSIGK

SEQ ID NO: 333745 - protein, 9 aa, Influenza virus
VEESSIGKV

SEQ ID NO: 333746 - protein, 9 aa, Influenza virus
EESSIGKVC

SEQ ID NO: 333747 - protein, 9 aa, Influenza virus
ESSIGKVCR

SEQ ID NO: 333748 - protein, 9 aa, Influenza virus
SSIGKVCRT

SEQ ID NO: 333749 - protein, 9 aa, Influenza virus
KVCRALLAK

SEQ ID NO: 333750 - protein, 9 aa, Influenza virus
VCRALLAKS

SEQ ID NO: 333751 - protein, 9 aa, Influenza virus
LLAKSVFNC

SEQ ID NO: 333752 - protein, 9 aa, Influenza virus
LAKSVFNCL

SEQ ID NO: 333753 - protein, 9 aa, Influenza virus
AKSVFNCLY

SEQ ID NO: 333754 - protein, 9 aa, Influenza virus
KSVFNCLYA

SEQ ID NO: 333755 - protein, 9 aa, Influenza virus
SVFNCLYAS

SEQ ID NO: 333756 - protein, 9 aa, Influenza virus
VFNSLYASS

SEQ ID NO: 333757 - protein, 9 aa, Influenza virus
FNSLYASSQ

SEQ ID NO: 333758 - protein, 9 aa, Influenza virus
NSLYASSQL

SEQ ID NO: 333759 - protein, 9 aa, Influenza virus
SLYASSQLE

SEQ ID NO: 333760 - protein, 9 aa, Influenza virus
LYASSQLEG

SEQ ID NO: 333761 - protein, 9 aa, Influenza virus
YASSQLEGF

SEQ ID NO: 333762 - protein, 9 aa, Influenza virus
ASSQLEGFS

SEQ ID NO: 333763 - protein, 9 aa, Influenza virus
SSQLEGFSA

SEQ ID NO: 333764 - protein, 9 aa, Influenza virus
SQLEGFSAE

SEQ ID NO: 333765 - protein, 9 aa, Influenza virus
GFSAESRKM

SEQ ID NO: 333766 - protein, 9 aa, Influenza virus
FSAESRKML

SEQ ID NO: 333767 - protein, 9 aa, Influenza virus
SAESRKMLL

SEQ ID NO: 333768 - protein, 9 aa, Influenza virus
AESRKLLLV

SEQ ID NO: 333769 - protein, 9 aa, Influenza virus
ESRKLLLVV

SEQ ID NO: 333770 - protein, 9 aa, Influenza virus
SRKLLLVVQ

SEQ ID NO: 333771 - protein, 9 aa, Influenza virus
RKLLLVVQA

SEQ ID NO: 333772 - protein, 9 aa, Influenza virus
LLVVQALRD

SEQ ID NO: 333773 - protein, 9 aa, Influenza virus
QALRDSLEP

SEQ ID NO: 333774 - protein, 9 aa, Influenza virus
ALRDSLEPG

SEQ ID NO: 333775 - protein, 9 aa, Influenza virus
LRDSLEPGT

SEQ ID NO: 333776 - protein, 9 aa, Influenza virus
RDSLEPGTF

SEQ ID NO: 333777 - protein, 9 aa, Influenza virus
DSLEPGTFD

SEQ ID NO: 333778 - protein, 9 aa, Influenza virus
NLEPGTFDI

SEQ ID NO: 333779 - protein, 9 aa, Influenza virus
LEPGTFDLE

SEQ ID NO: 333780 - protein, 9 aa, Influenza virus
EPGTFDLEG

SEQ ID NO: 333781 - protein, 9 aa, Influenza virus
PGTFDLEGL

SEQ ID NO: 333782 - protein, 9 aa, Influenza virus
GTFDLEGLY

SEQ ID NO: 333783 - protein, 9 aa, Influenza virus
GLYESIEEC

SEQ ID NO: 333784 - protein, 9 aa, Influenza virus
LYESIEECL

SEQ ID NO: 333785 - protein, 9 aa, Influenza virus
YESIEECLI

SEQ ID NO: 333786 - protein, 9 aa, Influenza virus
ESIEECLIN

SEQ ID NO: 333787 - protein, 9 aa, Influenza virus
SIEECLIND

SEQ ID NO: 333788 - protein, 9 aa, Influenza virus
VEECLINDP

SEQ ID NO: 333789 - protein, 9 aa, Influenza virus
ASWFNSFLA

SEQ ID NO: 333790 - protein, 9 aa, Influenza virus
SWFNSFLAH

SEQ ID NO: 333791 - protein, 9 aa, Influenza virus
SFLAHALKL

SEQ ID NO: 333792 - protein, 9 aa, Influenza virus
FLAHALKLV

SEQ ID NO: 333793 - protein, 9 aa, Influenza virus
LAHALKLVV

SEQ ID NO: 333794 - protein, 9 aa, Influenza virus
AHALKLVVA

SEQ ID NO: 333795 - protein, 9 aa, Influenza virus
HALKLVVAM

SEQ ID NO: 333796 - protein, 9 aa, Influenza virus
ALKLVVAML

SEQ ID NO: 333797 - protein, 9 aa, Influenza virus
VNPTLLFLE

SEQ ID NO: 333798 - protein, 9 aa, Influenza virus
NPTLLFLKI

SEQ ID NO: 333799 - protein, 9 aa, Influenza virus
PTLLFLKIP

SEQ ID NO: 333800 - protein, 9 aa, Influenza virus
LLFLKIPAQ

SEQ ID NO: 333801 - protein, 9 aa, Influenza virus
KIPAQNAIS

SEQ ID NO: 333802 - protein, 9 aa, Influenza virus
IPAQNAIST

SEQ ID NO: 333803 - protein, 9 aa, Influenza virus
PVQNAISTT

SEQ ID NO: 333804 - protein, 9 aa, Influenza virus
VQNAISTTF

SEQ ID NO: 333805 - protein, 9 aa, Influenza virus
TGYTMDTVS

SEQ ID NO: 333806 - protein, 9 aa, Influenza virus
GYTMDTVSR

SEQ ID NO: 333807 - protein, 9 aa, Influenza virus
YTMDTVSRT

SEQ ID NO: 333808 - protein, 9 aa, Influenza virus
MDTVSRTHQ

SEQ ID NO: 333809 - protein, 9 aa, Influenza virus
NRTHQYSER

SEQ ID NO: 333810 - protein, 9 aa, Influenza virus
RTHQYSERG

SEQ ID NO: 333811 - protein, 9 aa, Influenza virus
THQYSERGR

SEQ ID NO: 333812 - protein, 9 aa, Influenza virus
HQYSERGRW

SEQ ID NO: 333813 - protein, 9 aa, Influenza virus
NSETGAPQL

SEQ ID NO: 333814 - protein, 9 aa, Influenza virus
SETGAPQLN

SEQ ID NO: 333815 - protein, 9 aa, Influenza virus
EIGAPQLNP

SEQ ID NO: 333816 - protein, 9 aa, Influenza virus
IGAPQLNPI

SEQ ID NO: 333817 - protein, 9 aa, Influenza virus
KAPQLNPID

SEQ ID NO: 333818 - protein, 9 aa, Influenza virus
ALQLNPIDG

SEQ ID NO: 333819 - protein, 9 aa, Influenza virus
LQLNPIDGP

SEQ ID NO: 333820 - protein, 9 aa, Influenza virus
NPIDGPLPK

SEQ ID NO: 333821 - protein, 9 aa, Influenza virus
DNEPTGYAQ

SEQ ID NO: 333822 - protein, 9 aa, Influenza virus
NEPTGYAQT

SEQ ID NO: 333823 - protein, 9 aa, Influenza virus
EPTGYAQTD

SEQ ID NO: 333824 - protein, 9 aa, Influenza virus
PTGYAQTDC

SEQ ID NO: 333825 - protein, 9 aa, Influenza virus
TGYAQTDCV

SEQ ID NO: 333826 - protein, 9 aa, Influenza virus
DCVLEAMAL

SEQ ID NO: 333827 - protein, 9 aa, Influenza virus
VLEAMALLE

SEQ ID NO: 333828 - protein, 9 aa, Influenza virus
LEAMAFLEK

SEQ ID NO: 333829 - protein, 9 aa, Influenza virus
EAMAFLEKS

SEQ ID NO: 333830 - protein, 9 aa, Influenza virus
AMAFLEKSH

SEQ ID NO: 333831 - protein, 9 aa, Influenza virus
MAFLEKSHP

SEQ ID NO: 333832 - protein, 9 aa, Influenza virus
AFLEKSHPG

SEQ ID NO: 333833 - protein, 9 aa, Influenza virus
LEKSHPGIF

SEQ ID NO: 333834 - protein, 9 aa, Influenza virus
EKSHPGIFE

SEQ ID NO: 333835 - protein, 9 aa, Influenza virus
SHPGLFENS

SEQ ID NO: 333836 - protein, 9 aa, Influenza virus
HPGLFENSC

SEQ ID NO: 333837 - protein, 9 aa, Influenza virus
PGIFENSCI

SEQ ID NO: 333838 - protein, 9 aa, Influenza virus
GIFENSCIE

SEQ ID NO: 333839 - protein, 9 aa, Influenza virus
IFENSCIET

SEQ ID NO: 333840 - protein, 9 aa, Influenza virus
IQQTRVDKL

SEQ ID NO: 333841 - protein, 9 aa, Influenza virus
QQTRVDRLT

SEQ ID NO: 333842 - protein, 9 aa, Influenza virus
QTRVDRLTQ

SEQ ID NO: 333843 - protein, 9 aa, Influenza virus
TRVDRLTQG

SEQ ID NO: 333844 - protein, 9 aa, Influenza virus
RVDRLTQGR

SEQ ID NO: 333845 - protein, 9 aa, Influenza virus
VDRLTQGRQ

SEQ ID NO: 333846 - protein, 9 aa, Influenza virus
DRLTQGRQT

SEQ ID NO: 333847 - protein, 9 aa, Influenza virus
KLTQGRQTF

SEQ ID NO: 333848 - protein, 9 aa, Influenza virus
LTQGRQTFD

SEQ ID NO: 333849 - protein, 9 aa, Influenza virus
TQGRQTFDW

SEQ ID NO: 333850 - protein, 9 aa, Influenza virus
QGRQTFDWT

SEQ ID NO: 333851 - protein, 9 aa, Influenza virus
GRQTFDWTL

SEQ ID NO: 333852 - protein, 9 aa, Influenza virus
RQTFDWTLN

SEQ ID NO: 333853 - protein, 9 aa, Influenza virus
QTFDWTLNR

SEQ ID NO: 333854 - protein, 9 aa, Influenza virus
TFDWTLNRN

SEQ ID NO: 333855 - protein, 9 aa, Influenza virus
FDWTLNRNQ

SEQ ID NO: 333856 - protein, 9 aa, Influenza virus
TALANTIEI

SEQ ID NO: 333857 - protein, 9 aa, Influenza virus
ALANTIEIF

SEQ ID NO: 333858 - protein, 9 aa, Influenza virus
LANTIEIFR

SEQ ID NO: 333859 - protein, 9 aa, Influenza virus
ANTIEIFRS

SEQ ID NO: 333860 - protein, 9 aa, Influenza virus
NTIEIFRSN

SEQ ID NO: 333861 - protein, 9 aa, Influenza virus
SESGRLIDF

SEQ ID NO: 333862 - protein, 9 aa, Influenza virus
ESGRLMDFL

SEQ ID NO: 333863 - protein, 9 aa, Influenza virus
SGRLMDFLK

SEQ ID NO: 333864 - protein, 9 aa, Influenza virus
GRLMDFLKD

SEQ ID NO: 333865 - protein, 9 aa, Influenza virus
RLMDFLKDV

SEQ ID NO: 333866 - protein, 9 aa, Influenza virus
LIDFLKDVI

SEQ ID NO: 333867 - protein, 9 aa, Influenza virus
EVTTHFQRK

SEQ ID NO: 333868 - protein, 9 aa, Influenza virus
VTTHFQRKR

SEQ ID NO: 333869 - protein, 9 aa, Influenza virus
VTHFQRKRR

SEQ ID NO: 333870 - protein, 9 aa, Influenza virus
THFQRKRRI

SEQ ID NO: 333871 - protein, 9 aa, Influenza virus
HFQRKRRIR

SEQ ID NO: 333872 - protein, 9 aa, Influenza virus
FQRKRRIRD

SEQ ID NO: 333873 - protein, 9 aa, Influenza virus
QRKRRIRDN

SEQ ID NO: 333874 - protein, 9 aa, Influenza virus
RKRRVRDNV

SEQ ID NO: 333875 - protein, 9 aa, Influenza virus
KRRVRDNVT

SEQ ID NO: 333876 - protein, 9 aa, Influenza virus
TKKMITQRT

SEQ ID NO: 333877 - protein, 9 aa, Influenza virus
KMITQRTIG

SEQ ID NO: 333878 - protein, 9 aa, Influenza virus
MITQRTIGK

SEQ ID NO: 333879 - protein, 9 aa, Influenza virus
ITQRTIGKK

SEQ ID NO: 333880 - protein, 9 aa, Influenza virus
TQRTVGKKK

SEQ ID NO: 333881 - protein, 9 aa, Influenza virus
QRTIGKKKH

SEQ ID NO: 333882 - protein, 9 aa, Influenza virus
GYLIRALTL

SEQ ID NO: 333883 - protein, 9 aa, Influenza virus
YLIRTLTLN

SEQ ID NO: 333884 - protein, 9 aa, Influenza virus
LIRTLTLNT

SEQ ID NO: 333885 - protein, 9 aa, Influenza virus
IRTLTLNTM

SEQ ID NO: 333886 - protein, 9 aa, Influenza virus
RTLTLNTMT

SEQ ID NO: 333887 - protein, 9 aa, Influenza virus
GMQIRGFVH

SEQ ID NO: 333888 - protein, 9 aa, Influenza virus
MQIRGFVHF

SEQ ID NO: 333889 - protein, 9 aa, Influenza virus
QIRGFVHFV

SEQ ID NO: 333890 - protein, 9 aa, Influenza virus
IRGFVHFVE

SEQ ID NO: 333891 - protein, 9 aa, Influenza virus
RGFVYFVEA

SEQ ID NO: 333892 - protein, 9 aa, Influenza virus
GFVYFVEAL

SEQ ID NO: 333893 - protein, 9 aa, Influenza virus
FVYFVEALA

SEQ ID NO: 333894 - protein, 9 aa, Influenza virus
VYFVEALAR

SEQ ID NO: 333895 - protein, 9 aa, Influenza virus
VEALARSIC

SEQ ID NO: 333896 - protein, 9 aa, Influenza virus
LARRICEKL

SEQ ID NO: 333897 - protein, 9 aa, Influenza virus
ARRICEKLE

SEQ ID NO: 333898 - protein, 9 aa, Influenza virus
RRICEKLEQ

SEQ ID NO: 333899 - protein, 9 aa, Influenza virus
RICEKLEQS

SEQ ID NO: 333900 - protein, 9 aa, Influenza virus
NVVRKMMTS

SEQ ID NO: 333901 - protein, 9 aa, Influenza virus
VVRKMMTSS

SEQ ID NO: 333902 - protein, 9 aa, Influenza virus
VRKMMTSSQ

SEQ ID NO: 333903 - protein, 9 aa, Influenza virus
RKMMTSSQD

SEQ ID NO: 333904 - protein, 9 aa, Influenza virus
KMMTSSQDT

SEQ ID NO: 333905 - protein, 9 aa, Influenza virus
MMTSSQDTE

SEQ ID NO: 333906 - protein, 9 aa, Influenza virus
TNSQDTEIS

SEQ ID NO: 333907 - protein, 9 aa, Influenza virus
NSQDTEISF

SEQ ID NO: 333908 - protein, 9 aa, Influenza virus
SQDTEISFT

SEQ ID NO: 333909 - protein, 9 aa, Influenza virus
QDTEISFTI

SEQ ID NO: 333910 - protein, 9 aa, Influenza virus
DTEISFTIT

SEQ ID NO: 333911 - protein, 9 aa, Influenza virus
TEISFTITG

SEQ ID NO: 333912 - protein, 9 aa, Influenza virus
EISFTITGD

SEQ ID NO: 333913 - protein, 9 aa, Influenza virus
ISFTITGDN

SEQ ID NO: 333914 - protein, 9 aa, Influenza virus
WNENQNPRV

SEQ ID NO: 333915 - protein, 9 aa, Influenza virus
NENQNPRVF

SEQ ID NO: 333916 - protein, 9 aa, Influenza virus
ENQNPRVFL

SEQ ID NO: 333917 - protein, 9 aa, Influenza virus
NQNPRIFLA

SEQ ID NO: 333918 - protein, 9 aa, Influenza virus
QNPRIFLAM

SEQ ID NO: 333919 - protein, 9 aa, Influenza virus
NPRIFLAMI

SEQ ID NO: 333920 - protein, 9 aa, Influenza virus
PRIFLAMIT

SEQ ID NO: 333921 - protein, 9 aa, Influenza virus
RIFLAMITY

SEQ ID NO: 333922 - protein, 9 aa, Influenza virus
IFLAMITYI

SEQ ID NO: 333923 - protein, 9 aa, Influenza virus
FLTMITYIT

SEQ ID NO: 333924 - protein, 9 aa, Influenza virus
LAMITYITK

SEQ ID NO: 333925 - protein, 9 aa, Influenza virus
QPEWFRNVL

SEQ ID NO: 333926 - protein, 9 aa, Influenza virus
PEWFRNVLS

SEQ ID NO: 333927 - protein, 9 aa, Influenza virus
WFRNILSMA

SEQ ID NO: 333928 - protein, 9 aa, Influenza virus
FRNILSMAP

SEQ ID NO: 333929 - protein, 9 aa, Influenza virus
RNILSMAPI

SEQ ID NO: 333930 - protein, 9 aa, Influenza virus
NILSMAPIM

SEQ ID NO: 333931 - protein, 9 aa, Influenza virus
ILSMAPIMF

SEQ ID NO: 333932 - protein, 9 aa, Influenza virus
LSMAPIMFS

SEQ ID NO: 333933 - protein, 9 aa, Influenza virus
SMAPIMFSN

SEQ ID NO: 333934 - protein, 9 aa, Influenza virus
MAPIMFSNK

SEQ ID NO: 333935 - protein, 9 aa, Influenza virus
IMFSNKVAR

SEQ ID NO: 333936 - protein, 9 aa, Influenza virus
MFSNKVARL

SEQ ID NO: 333937 - protein, 9 aa, Influenza virus
FSNKVARLG

SEQ ID NO: 333938 - protein, 9 aa, Influenza virus
SNKMARLGR

SEQ ID NO: 333939 - protein, 9 aa, Influenza virus
NKMARLGRG

SEQ ID NO: 333940 - protein, 9 aa, Influenza virus
KMARLGRGY

SEQ ID NO: 333941 - protein, 9 aa, Influenza virus
MARLGRGYM

SEQ ID NO: 333942 - protein, 9 aa, Influenza virus
ARLGRGYMF

SEQ ID NO: 333943 - protein, 9 aa, Influenza virus
RLGRGYMFE

SEQ ID NO: 333944 - protein, 9 aa, Influenza virus
LGRGYMFES

SEQ ID NO: 333945 - protein, 9 aa, Influenza virus
GRGYMFESK

SEQ ID NO: 333946 - protein, 9 aa, Influenza virus
GYMFESKRM

SEQ ID NO: 333947 - protein, 9 aa, Influenza virus
GAASLSPGM

SEQ ID NO: 333948 - protein, 9 aa, Influenza virus
AASLSPGMM

SEQ ID NO: 333949 - protein, 9 aa, Influenza virus
VSLSPGMMM

SEQ ID NO: 333950 - protein, 9 aa, Influenza virus
VLGVSVLNL

SEQ ID NO: 333951 - protein, 9 aa, Influenza virus
LGVSVLNLG

SEQ ID NO: 333952 - protein, 9 aa, Influenza virus
GVSVLNLGQ

SEQ ID NO: 333953 - protein, 9 aa, Influenza virus
VSILNLGQR

SEQ ID NO: 333954 - protein, 9 aa, Influenza virus
LNLGQKKYT

SEQ ID NO: 333955 - protein, 9 aa, Influenza virus
TIYWWDGLQ

SEQ ID NO: 333956 - protein, 9 aa, Influenza virus
IYWWDGLQS

SEQ ID NO: 333957 - protein, 9 aa, Influenza virus
SSDDFALIL

SEQ ID NO: 333958 - protein, 9 aa, Influenza virus
SDDFALILN

SEQ ID NO: 333959 - protein, 9 aa, Influenza virus
DDFALILNA

SEQ ID NO: 333960 - protein, 9 aa, Influenza virus
DFALIVNAS

SEQ ID NO: 333961 - protein, 9 aa, Influenza virus
GIQAGVNRF

SEQ ID NO: 333962 - protein, 9 aa, Influenza virus
IQAGVNRFY

SEQ ID NO: 333963 - protein, 9 aa, Influenza virus
QAGVNRFYR

SEQ ID NO: 333964 - protein, 9 aa, Influenza virus
AGVDRFYRI

SEQ ID NO: 333965 - protein, 9 aa, Influenza virus
GVDRFYRIC

SEQ ID NO: 333966 - protein, 9 aa, Influenza virus
VDRFYRICK

SEQ ID NO: 333967 - protein, 9 aa, Influenza virus
DRFYRICKL

SEQ ID NO: 333968 - protein, 9 aa, Influenza virus
RFYRTCKLL

SEQ ID NO: 333969 - protein, 9 aa, Influenza virus
FYRTCKLLG

SEQ ID NO: 333970 - protein, 9 aa, Influenza virus
YRTCKLLGI

SEQ ID NO: 333971 - protein, 9 aa, Influenza virus
RTCKLLGIN

SEQ ID NO: 333972 - protein, 9 aa, Influenza virus
TCKLLGINM

SEQ ID NO: 333973 - protein, 9 aa, Influenza virus
CKLLGINMS

SEQ ID NO: 333974 - protein, 9 aa, Influenza virus
KLLGINMSK

SEQ ID NO: 333975 - protein, 9 aa, Influenza virus
LLGINMSKK

SEQ ID NO: 333976 - protein, 9 aa, Influenza virus
LGINMSKKK

SEQ ID NO: 333977 - protein, 9 aa, Influenza virus
NMSKRKSYI

SEQ ID NO: 333978 - protein, 9 aa, Influenza virus
MSKRKSYIN

SEQ ID NO: 333979 - protein, 9 aa, Influenza virus
SKKKSYINK

SEQ ID NO: 333980 - protein, 9 aa, Influenza virus
KKKSYINKT

SEQ ID NO: 333981 - protein, 9 aa, Influenza virus
KKSYINKTG

SEQ ID NO: 333982 - protein, 9 aa, Influenza virus
KSYINKTGT

SEQ ID NO: 333983 - protein, 9 aa, Influenza virus
SYINKTGTF

SEQ ID NO: 333984 - protein, 9 aa, Influenza virus
YINKTGTFE

SEQ ID NO: 333985 - protein, 9 aa, Influenza virus
INKTGTFEF

SEQ ID NO: 333986 - protein, 9 aa, Influenza virus
NKTGTFEFT

SEQ ID NO: 333987 - protein, 9 aa, Influenza virus
KTGTFEFTS

SEQ ID NO: 333988 - protein, 9 aa, Influenza virus
LPSFGVSGV

SEQ ID NO: 333989 - protein, 9 aa, Influenza virus
PSFGVSGVN

SEQ ID NO: 333990 - protein, 9 aa, Influenza virus
SFGVSGVNE

SEQ ID NO: 333991 - protein, 9 aa, Influenza virus
FGVSGVNES

SEQ ID NO: 333992 - protein, 9 aa, Influenza virus
GVSGVNESA

SEQ ID NO: 333993 - protein, 9 aa, Influenza virus
VSGVNESAD

SEQ ID NO: 333994 - protein, 9 aa, Influenza virus
SGVNESADM

SEQ ID NO: 333995 - protein, 9 aa, Influenza virus
GVNESADMS

SEQ ID NO: 333996 - protein, 9 aa, Influenza virus
VNESADMSI

SEQ ID NO: 333997 - protein, 9 aa, Influenza virus
ESADMSIGI

SEQ ID NO: 333998 - protein, 9 aa, Influenza virus
SADMSIGIT

SEQ ID NO: 333999 - protein, 9 aa, Influenza virus
ADMSIGITV

SEQ ID NO: 334000 - protein, 9 aa, Influenza virus
DMSIGITVI

SEQ ID NO: 334001 - protein, 9 aa, Influenza virus
MSIGITVIK

SEQ ID NO: 334002 - protein, 9 aa, Influenza virus
SIGITVIKN

SEQ ID NO: 334003 - protein, 9 aa, Influenza virus
IGITVIKNN

SEQ ID NO: 334004 - protein, 9 aa, Influenza virus
GITVIKNNM

SEQ ID NO: 334005 - protein, 9 aa, Influenza virus
ITVIKNNMI

SEQ ID NO: 334006 - protein, 9 aa, Influenza virus
TVIRNNMIN

SEQ ID NO: 334007 - protein, 9 aa, Influenza virus
VIRNNMINN

SEQ ID NO: 334008 - protein, 9 aa, Influenza virus
IRNNMINND

SEQ ID NO: 334009 - protein, 9 aa, Influenza virus
RNNMINNDL

SEQ ID NO: 334010 - protein, 9 aa, Influenza virus
YRYTYRCHK

SEQ ID NO: 334011 - protein, 9 aa, Influenza virus
RYTYRCHKG

SEQ ID NO: 334012 - protein, 9 aa, Influenza virus
YTYRCHKGD

SEQ ID NO: 334013 - protein, 9 aa, Influenza virus
TYRCHKGDT

SEQ ID NO: 334014 - protein, 9 aa, Influenza virus
YRCHKGDTQ

SEQ ID NO: 334015 - protein, 9 aa, Influenza virus
RCHKGDTQI

SEQ ID NO: 334016 - protein, 9 aa, Influenza virus
QIQTKRSFE

SEQ ID NO: 334017 - protein, 9 aa, Influenza virus
IQTRRSFEI

SEQ ID NO: 334018 - protein, 9 aa, Influenza virus
QTRRSFEIK

SEQ ID NO: 334019 - protein, 9 aa, Influenza virus
GLLISDGGP

SEQ ID NO: 334020 - protein, 9 aa, Influenza virus
LLISDGGPN

SEQ ID NO: 334021 - protein, 9 aa, Influenza virus
LISDGGPNL

SEQ ID NO: 334022 - protein, 9 aa, Influenza virus
ISDGGPNLY

SEQ ID NO: 334023 - protein, 9 aa, Influenza virus
ADGGPNLYN

SEQ ID NO: 334024 - protein, 9 aa, Influenza virus
IRNLHIPEA

SEQ ID NO: 334025 - protein, 9 aa, Influenza virus
NLHIPEAGL

SEQ ID NO: 334026 - protein, 9 aa, Influenza virus
LHIPEAGLK

SEQ ID NO: 334027 - protein, 9 aa, Influenza virus
IPEVCLKWD

SEQ ID NO: 334028 - protein, 9 aa, Influenza virus
PEVCLKWDL

SEQ ID NO: 334029 - protein, 9 aa, Influenza virus
EVCLKWDLM

SEQ ID NO: 334030 - protein, 9 aa, Influenza virus
VCLKWDLMD

SEQ ID NO: 334031 - protein, 9 aa, Influenza virus
YRGRLCNPL

SEQ ID NO: 334032 - protein, 9 aa, Influenza virus
RGRLCNPLN

SEQ ID NO: 334033 - protein, 9 aa, Influenza virus
GRLCNPMNP

SEQ ID NO: 334034 - protein, 9 aa, Influenza virus
LCNPMNPFV

SEQ ID NO: 334035 - protein, 9 aa, Influenza virus
CNPLNPFVN

SEQ ID NO: 334036 - protein, 9 aa, Influenza virus
NPLNPFVNH

SEQ ID NO: 334037 - protein, 9 aa, Influenza virus
IEYDAVATT

SEQ ID NO: 334038 - protein, 9 aa, Influenza virus
AVATTHSWV

SEQ ID NO: 334039 - protein, 9 aa, Influenza virus
VATTHSWVP

SEQ ID NO: 334040 - protein, 9 aa, Influenza virus
ATTHSWVPK

SEQ ID NO: 334041 - protein, 9 aa, Influenza virus
TTHSWVPKR

SEQ ID NO: 334042 - protein, 9 aa, Influenza virus
THSWVPKRN

SEQ ID NO: 334043 - protein, 9 aa, Influenza virus
HSWVPKRNR

SEQ ID NO: 334044 - protein, 9 aa, Influenza virus
SWVPKRNRS

SEQ ID NO: 334045 - protein, 9 aa, Influenza virus
WVPKRNRSI

SEQ ID NO: 334046 - protein, 9 aa, Influenza virus
VPKRNRSIL

SEQ ID NO: 334047 - protein, 9 aa, Influenza virus
ILNTSQRGV

SEQ ID NO: 334048 - protein, 9 aa, Influenza virus
LNTSQRGVL

SEQ ID NO: 334049 - protein, 9 aa, Influenza virus
NTSQRGVLE

SEQ ID NO: 334050 - protein, 9 aa, Influenza virus
TSQRGVLED

SEQ ID NO: 334051 - protein, 9 aa, Influenza virus
SQRGVLEDE

SEQ ID NO: 334052 - protein, 9 aa, Influenza virus
QRGVLEDEQ

SEQ ID NO: 334053 - protein, 9 aa, Influenza virus
RGVLEDEQM

SEQ ID NO: 334054 - protein, 9 aa, Influenza virus
GVLEDEQMY

SEQ ID NO: 334055 - protein, 9 aa, Influenza virus
VLEDEQMYQ

SEQ ID NO: 334056 - protein, 9 aa, Influenza virus
LEDEQMYQR

SEQ ID NO: 334057 - protein, 9 aa, Influenza virus
EDEQMYQRC

SEQ ID NO: 334058 - protein, 9 aa, Influenza virus
DEQMYQRCC

SEQ ID NO: 334059 - protein, 9 aa, Influenza virus
EQMYQRCCN

SEQ ID NO: 334060 - protein, 9 aa, Influenza virus
QMYQRCCNL

SEQ ID NO: 334061 - protein, 9 aa, Influenza virus
MYQRCCNLF

SEQ ID NO: 334062 - protein, 9 aa, Influenza virus
YQRCCNLFE

SEQ ID NO: 334063 - protein, 9 aa, Influenza virus
QRCCNLFEK

SEQ ID NO: 334064 - protein, 9 aa, Influenza virus
RCCNLFEKF

SEQ ID NO: 334065 - protein, 9 aa, Influenza virus
CCSLFEKFF

SEQ ID NO: 334066 - protein, 9 aa, Influenza virus
CSLFEKFFP

SEQ ID NO: 334067 - protein, 9 aa, Influenza virus
SLFEKFFPS

SEQ ID NO: 334068 - protein, 9 aa, Influenza virus
PSSSYRRPI

SEQ ID NO: 334069 - protein, 9 aa, Influenza virus
SSSYRRPIG

SEQ ID NO: 334070 - protein, 9 aa, Influenza virus
SSYRRPIGI

SEQ ID NO: 334071 - protein, 9 aa, Influenza virus
SYRRPIGIS

SEQ ID NO: 334072 - protein, 9 aa, Influenza virus
YRRPIGISS

SEQ ID NO: 334073 - protein, 9 aa, Influenza virus
RRPIGISSM

SEQ ID NO: 334074 - protein, 9 aa, Influenza virus
RPIGISSMV

SEQ ID NO: 334075 - protein, 9 aa, Influenza virus
PIGISSMVE

SEQ ID NO: 334076 - protein, 9 aa, Influenza virus
IGISSMVEA

SEQ ID NO: 334077 - protein, 9 aa, Influenza virus
GISSMMEAM

SEQ ID NO: 334078 - protein, 9 aa, Influenza virus
ISSMMEAMV

SEQ ID NO: 334079 - protein, 9 aa, Influenza virus
SSMMEAMVS

SEQ ID NO: 334080 - protein, 9 aa, Influenza virus
SMMEAMVSR

SEQ ID NO: 334081 - protein, 9 aa, Influenza virus
MMEAMVSRA

SEQ ID NO: 334082 - protein, 9 aa, Influenza virus
MEAMVSRAR

SEQ ID NO: 334083 - protein, 9 aa, Influenza virus
EAMISRARI

SEQ ID NO: 334084 - protein, 9 aa, Influenza virus
AMISRARID

SEQ ID NO: 334085 - protein, 9 aa, Influenza virus
MISRARIDA

SEQ ID NO: 334086 - protein, 9 aa, Influenza virus
ISRARIDAR

SEQ ID NO: 334087 - protein, 9 aa, Influenza virus
SRARIDARV

SEQ ID NO: 334088 - protein, 9 aa, Influenza virus
RARIDARVD

SEQ ID NO: 334089 - protein, 9 aa, Influenza virus
ARIDARVDF

SEQ ID NO: 334090 - protein, 9 aa, Influenza virus
RIDARVDFE

SEQ ID NO: 334091 - protein, 9 aa, Influenza virus
IDARVDFES

SEQ ID NO: 334092 - protein, 9 aa, Influenza virus
DARVDFESG

SEQ ID NO: 334093 - protein, 9 aa, Influenza virus
ARVDFESGR

SEQ ID NO: 334094 - protein, 9 aa, Influenza virus
RVDFESGRI

SEQ ID NO: 334095 - protein, 9 aa, Influenza virus
GKKEFSEIM

SEQ ID NO: 334096 - protein, 9 aa, Influenza virus
EELRRQKWW

SEQ ID NO: 334097 - protein, 9 aa, Influenza virus
ELRRQKWWV

SEQ ID NO: 334098 - protein, 9 aa, Influenza virus
LRRQKWWVW

SEQ ID NO: 334099 - protein, 9 aa, Influenza virus
RRQKSLIWL

SEQ ID NO: 334100 - protein, 9 aa, Influenza virus
RQKSLIWLW

SEQ ID NO: 334101 - protein, 9 aa, Influenza virus
QKWWVWLWL

SEQ ID NO: 334102 - protein, 9 aa, Influenza virus
KWWVWLWLV

SEQ ID NO: 334103 - protein, 9 aa, Influenza virus
SLIWLWLVL

SEQ ID NO: 334104 - protein, 9 aa, Influenza virus
LIWLWLVLR

SEQ ID NO: 334105 - protein, 9 aa, Influenza virus
IWLWLVLRE

SEQ ID NO: 334106 - protein, 9 aa, Influenza virus
SESRSNIFN

SEQ ID NO: 334107 - protein, 9 aa, Influenza virus
ESRSNIFNM

SEQ ID NO: 334108 - protein, 9 aa, Influenza virus
SRSIIFNME

SEQ ID NO: 334109 - protein, 9 aa, Influenza virus
RSIIFNMER

SEQ ID NO: 334110 - protein, 9 aa, Influenza virus
SIIFNMERI

SEQ ID NO: 334111 - protein, 9 aa, Influenza virus
IIFNMERIK

SEQ ID NO: 334112 - protein, 9 aa, Influenza virus
LMLQSRTRE

SEQ ID NO: 334113 - protein, 9 aa, Influenza virus
MLQSRTREI

SEQ ID NO: 334114 - protein, 9 aa, Influenza virus
LQSRTREIL

SEQ ID NO: 334115 - protein, 9 aa, Influenza virus
QSRTRGILT

SEQ ID NO: 334116 - protein, 9 aa, Influenza virus
SRTREILTR

SEQ ID NO: 334117 - protein, 9 aa, Influenza virus
RTREILTRT

SEQ ID NO: 334118 - protein, 9 aa, Influenza virus
TREILTRTT

SEQ ID NO: 334119 - protein, 9 aa, Influenza virus
REILTRTTV

SEQ ID NO: 334120 - protein, 9 aa, Influenza virus
EILTRTTVD

SEQ ID NO: 334121 - protein, 9 aa, Influenza virus
ILTRTTVDH

SEQ ID NO: 334122 - protein, 9 aa, Influenza virus
LTRTTVDHM

SEQ ID NO: 334123 - protein, 9 aa, Influenza virus
TRTTVDHMA

SEQ ID NO: 334124 - protein, 9 aa, Influenza virus
RTTVDHMAI

SEQ ID NO: 334125 - protein, 9 aa, Influenza virus
MAIIKRYTS

SEQ ID NO: 334126 - protein, 9 aa, Influenza virus
AIIKKYTSA

SEQ ID NO: 334127 - protein, 9 aa, Influenza virus
IIKKYTSAR

SEQ ID NO: 334128 - protein, 9 aa, Influenza virus
IKKYTSARQ

SEQ ID NO: 334129 - protein, 9 aa, Influenza virus
KKYTSARQE

SEQ ID NO: 334130 - protein, 9 aa, Influenza virus
KYTSARQEK

SEQ ID NO: 334131 - protein, 9 aa, Influenza virus
YTSARQEKN

SEQ ID NO: 334132 - protein, 9 aa, Influenza virus
TSARQEKNP

SEQ ID NO: 334133 - protein, 9 aa, Influenza virus
SGRQEKNPS

SEQ ID NO: 334134 - protein, 9 aa, Influenza virus
GRQEKNPSL

SEQ ID NO: 334135 - protein, 9 aa, Influenza virus
RQEKNPSLR

SEQ ID NO: 334136 - protein, 9 aa, Influenza virus
QEKNPSLRM

SEQ ID NO: 334137 - protein, 9 aa, Influenza virus
EKNPSLRMK

SEQ ID NO: 334138 - protein, 9 aa, Influenza virus
KNPSLRMKW

SEQ ID NO: 334139 - protein, 9 aa, Influenza virus
NPSLRMKWM

SEQ ID NO: 334140 - protein, 9 aa, Influenza virus
PSLRMKWMM

SEQ ID NO: 334141 - protein, 9 aa, Influenza virus
SLRMKWMMA

SEQ ID NO: 334142 - protein, 9 aa, Influenza virus
RMKWMMAMR

SEQ ID NO: 334143 - protein, 9 aa, Influenza virus
MKWMMAMRY

SEQ ID NO: 334144 - protein, 9 aa, Influenza virus
KWMMAMRYP

SEQ ID NO: 334145 - protein, 9 aa, Influenza virus
WMMAMRYPI

SEQ ID NO: 334146 - protein, 9 aa, Influenza virus
MMAMRYPIT

SEQ ID NO: 334147 - protein, 9 aa, Influenza virus
MAMRYPITA

SEQ ID NO: 334148 - protein, 9 aa, Influenza virus
AMRYPITAD

SEQ ID NO: 334149 - protein, 9 aa, Influenza virus
VPERNEQGQ

SEQ ID NO: 334150 - protein, 9 aa, Influenza virus
RNEHGQTLW

SEQ ID NO: 334151 - protein, 9 aa, Influenza virus
MISPLAVTW

SEQ ID NO: 334152 - protein, 9 aa, Influenza virus
ISPLAVTWW

SEQ ID NO: 334153 - protein, 9 aa, Influenza virus
LAVTWWNRK

SEQ ID NO: 334154 - protein, 9 aa, Influenza virus
AVTWWNRKG

SEQ ID NO: 334155 - protein, 9 aa, Influenza virus
VTWWNRKGP

SEQ ID NO: 334156 - protein, 9 aa, Influenza virus
HYPKIYKTY

SEQ ID NO: 334157 - protein, 9 aa, Influenza virus
YPKIYKTYF

SEQ ID NO: 334158 - protein, 9 aa, Influenza virus
GTFGPVHFQ

SEQ ID NO: 334159 - protein, 9 aa, Influenza virus
TFGPVHFQN

SEQ ID NO: 334160 - protein, 9 aa, Influenza virus
FGPVHFQNQ

SEQ ID NO: 334161 - protein, 9 aa, Influenza virus
GPVHFRNQI

SEQ ID NO: 334162 - protein, 9 aa, Influenza virus
PVHFRNQIK

SEQ ID NO: 334163 - protein, 9 aa, Influenza virus
VHFRNQIKI

SEQ ID NO: 334164 - protein, 9 aa, Influenza virus
HFRNQIKIR

SEQ ID NO: 334165 - protein, 9 aa, Influenza virus
FRNQIKIRR

SEQ ID NO: 334166 - protein, 9 aa, Influenza virus
RNQIKIRRR

SEQ ID NO: 334167 - protein, 9 aa, Influenza virus
NQIKIRRRV

SEQ ID NO: 334168 - protein, 9 aa, Influenza virus
QIKIRRRVD

SEQ ID NO: 334169 - protein, 9 aa, Influenza virus
VKIRRRVDT

SEQ ID NO: 334170 - protein, 9 aa, Influenza virus
KIRRRVDTN

SEQ ID NO: 334171 - protein, 9 aa, Influenza virus
IRRRVDTNP

SEQ ID NO: 334172 - protein, 9 aa, Influenza virus
RRRVDTNPG

SEQ ID NO: 334173 - protein, 9 aa, Influenza virus
RRVDTNPGH

SEQ ID NO: 334174 - protein, 9 aa, Influenza virus
RVDTNPGHA

SEQ ID NO: 334175 - protein, 9 aa, Influenza virus
VDTNPGHAD

SEQ ID NO: 334176 - protein, 9 aa, Influenza virus
SKEAQDVIM

SEQ ID NO: 334177 - protein, 9 aa, Influenza virus
VFPNEVGAK

SEQ ID NO: 334178 - protein, 9 aa, Influenza virus
FPNEVGAKI

SEQ ID NO: 334179 - protein, 9 aa, Influenza virus
PNEVGAKIL

SEQ ID NO: 334180 - protein, 9 aa, Influenza virus
NEVGAKILT

SEQ ID NO: 334181 - protein, 9 aa, Influenza virus
EVGAKILTS

SEQ ID NO: 334182 - protein, 9 aa, Influenza virus
VGAKILTSE

SEQ ID NO: 334183 - protein, 9 aa, Influenza virus
GAKILTSES

SEQ ID NO: 334184 - protein, 9 aa, Influenza virus
AKILTSESQ

SEQ ID NO: 334185 - protein, 9 aa, Influenza virus
KILTSESQL

SEQ ID NO: 334186 - protein, 9 aa, Influenza virus
ISPLMVAYM

SEQ ID NO: 334187 - protein, 9 aa, Influenza virus
SPLMVAYML

SEQ ID NO: 334188 - protein, 9 aa, Influenza virus
RKTRFLPVS

SEQ ID NO: 334189 - protein, 9 aa, Influenza virus
KTRFLPVSG

SEQ ID NO: 334190 - protein, 9 aa, Influenza virus
TRFLPVSGG

SEQ ID NO: 334191 - protein, 9 aa, Influenza virus
RFLPVSGGT

SEQ ID NO: 334192 - protein, 9 aa, Influenza virus
FLPVAGGTG

SEQ ID NO: 334193 - protein, 9 aa, Influenza virus
LPVAGGTGS

SEQ ID NO: 334194 - protein, 9 aa, Influenza virus
GGTGSVYIE

SEQ ID NO: 334195 - protein, 9 aa, Influenza virus
GTGSVYIEV

SEQ ID NO: 334196 - protein, 9 aa, Influenza virus
TGSVYIEVL

SEQ ID NO: 334197 - protein, 9 aa, Influenza virus
GSVYIEVLH

SEQ ID NO: 334198 - protein, 9 aa, Influenza virus
SIYIEVLHL

SEQ ID NO: 334199 - protein, 9 aa, Influenza virus
IYIEVLHLT

SEQ ID NO: 334200 - protein, 9 aa, Influenza virus
YVEVLHLTQ

SEQ ID NO: 334201 - protein, 9 aa, Influenza virus
VEVLHLTQG

SEQ ID NO: 334202 - protein, 9 aa, Influenza virus
EVLHLTQGA

SEQ ID NO: 334203 - protein, 9 aa, Influenza virus
VLHLTQGAC

SEQ ID NO: 334204 - protein, 9 aa, Influenza virus
LHLTQGACW

SEQ ID NO: 334205 - protein, 9 aa, Influenza virus
HLTQGACWE

SEQ ID NO: 334206 - protein, 9 aa, Influenza virus
LTQGACWEQ

SEQ ID NO: 334207 - protein, 9 aa, Influenza virus
TQGACWEQL

SEQ ID NO: 334208 - protein, 9 aa, Influenza virus
QGACWEQLY

SEQ ID NO: 334209 - protein, 9 aa, Influenza virus
GACWEQLYT

SEQ ID NO: 334210 - protein, 9 aa, Influenza virus
ACWEQLYTP

SEQ ID NO: 334211 - protein, 9 aa, Influenza virus
CWEQLYTPG

SEQ ID NO: 334212 - protein, 9 aa, Influenza virus
WEQLYTPGG

SEQ ID NO: 334213 - protein, 9 aa, Influenza virus
EQMYTPGGG

SEQ ID NO: 334214 - protein, 9 aa, Influenza virus
QMYTPGGGV

SEQ ID NO: 334215 - protein, 9 aa, Influenza virus
YTPGGGVRN

SEQ ID NO: 334216 - protein, 9 aa, Influenza virus
TPGGGVRND

SEQ ID NO: 334217 - protein, 9 aa, Influenza virus
VRNDDIDQS

SEQ ID NO: 334218 - protein, 9 aa, Influenza virus
RNDDIDQSL

SEQ ID NO: 334219 - protein, 9 aa, Influenza virus
NDDIDQSLI

SEQ ID NO: 334220 - protein, 9 aa, Influenza virus
DDIDQSLII

SEQ ID NO: 334221 - protein, 9 aa, Influenza virus
DIDQSLIIA

SEQ ID NO: 334222 - protein, 9 aa, Influenza virus
IDQSLIIAA

SEQ ID NO: 334223 - protein, 9 aa, Influenza virus
DQSLVIAAR

SEQ ID NO: 334224 - protein, 9 aa, Influenza virus
QSLIIAARS

SEQ ID NO: 334225 - protein, 9 aa, Influenza virus
SLIIAARSI

SEQ ID NO: 334226 - protein, 9 aa, Influenza virus
LIIAARSIV

SEQ ID NO: 334227 - protein, 9 aa, Influenza virus
IIAARSIVR

SEQ ID NO: 334228 - protein, 9 aa, Influenza virus
IAARSIVRR

SEQ ID NO: 334229 - protein, 9 aa, Influenza virus
AARSIVRRA

SEQ ID NO: 334230 - protein, 9 aa, Influenza virus
ARNIVRRAT

SEQ ID NO: 334231 - protein, 9 aa, Influenza virus
RNIVRRATV

SEQ ID NO: 334232 - protein, 9 aa, Influenza virus
NIVRRATVS

SEQ ID NO: 334233 - protein, 9 aa, Influenza virus
IVRRATVSA

SEQ ID NO: 334234 - protein, 9 aa, Influenza virus
VRRATVSAD

SEQ ID NO: 334235 - protein, 9 aa, Influenza virus
RRATVSADP

SEQ ID NO: 334236 - protein, 9 aa, Influenza virus
RATVSADPL

SEQ ID NO: 334237 - protein, 9 aa, Influenza virus
ATVSADPLA

SEQ ID NO: 334238 - protein, 9 aa, Influenza virus
TVSADPLAS

SEQ ID NO: 334239 - protein, 9 aa, Influenza virus
VSADPLLSL

SEQ ID NO: 334240 - protein, 9 aa, Influenza virus
SADPLLSLL

SEQ ID NO: 334241 - protein, 9 aa, Influenza virus
ADPLLSLLE

SEQ ID NO: 334242 - protein, 9 aa, Influenza virus
DPLLSLLEM

SEQ ID NO: 334243 - protein, 9 aa, Influenza virus
PLLSLLEMC

SEQ ID NO: 334244 - protein, 9 aa, Influenza virus
LLSLLEMCH

SEQ ID NO: 334245 - protein, 9 aa, Influenza virus
ASLLEMCHG

SEQ ID NO: 334246 - protein, 9 aa, Influenza virus
LLEMCHSTR

SEQ ID NO: 334247 - protein, 9 aa, Influenza virus
LEMCHSTRI

SEQ ID NO: 334248 - protein, 9 aa, Influenza virus
EMCHSTRIG

SEQ ID NO: 334249 - protein, 9 aa, Influenza virus
MCHSTRIGG

SEQ ID NO: 334250 - protein, 9 aa, Influenza virus
DILKQNPTE

SEQ ID NO: 334251 - protein, 9 aa, Influenza virus
ILKQNPTEE

SEQ ID NO: 334252 - protein, 9 aa, Influenza virus
LKQNPTEEQ

SEQ ID NO: 334253 - protein, 9 aa, Influenza virus
KQNPTEEQA

SEQ ID NO: 334254 - protein, 9 aa, Influenza virus
NPTEEQAVG

SEQ ID NO: 334255 - protein, 9 aa, Influenza virus
PTEEQAVGI

SEQ ID NO: 334256 - protein, 9 aa, Influenza virus
TEEQAVGIC

SEQ ID NO: 334257 - protein, 9 aa, Influenza virus
EEQAVGICK

SEQ ID NO: 334258 - protein, 9 aa, Influenza virus
EQAVGICKA

SEQ ID NO: 334259 - protein, 9 aa, Influenza virus
QAVGICKAA

SEQ ID NO: 334260 - protein, 9 aa, Influenza virus
AVDICKAAI

SEQ ID NO: 334261 - protein, 9 aa, Influenza virus
VDICKAAIG

SEQ ID NO: 334262 - protein, 9 aa, Influenza virus
ICKAAIGLR

SEQ ID NO: 334263 - protein, 9 aa, Influenza virus
CKAAIGLRI

SEQ ID NO: 334264 - protein, 9 aa, Influenza virus
KAAIGLRIS

SEQ ID NO: 334265 - protein, 9 aa, Influenza virus
AAIGLRISS

SEQ ID NO: 334266 - protein, 9 aa, Influenza virus
AIGLRISSS

SEQ ID NO: 334267 - protein, 9 aa, Influenza virus
IGLRISSSF

SEQ ID NO: 334268 - protein, 9 aa, Influenza virus
GLKISSSFS

SEQ ID NO: 334269 - protein, 9 aa, Influenza virus
LKISSSFSF

SEQ ID NO: 334270 - protein, 9 aa, Influenza virus
KISSSFSFG

SEQ ID NO: 334271 - protein, 9 aa, Influenza virus
GGFTFKRTK

SEQ ID NO: 334272 - protein, 9 aa, Influenza virus
GFTFKRTKG

SEQ ID NO: 334273 - protein, 9 aa, Influenza virus
FTFKRTKGS

SEQ ID NO: 334274 - protein, 9 aa, Influenza virus
TFKRTKGSS

SEQ ID NO: 334275 - protein, 9 aa, Influenza virus
EEEMLTGNL

SEQ ID NO: 334276 - protein, 9 aa, Influenza virus
EEMLTGNLQ

SEQ ID NO: 334277 - protein, 9 aa, Influenza virus
EMLTGNLQT

SEQ ID NO: 334278 - protein, 9 aa, Influenza virus
MLTGNLQTL

SEQ ID NO: 334279 - protein, 9 aa, Influenza virus
LTGNLQTLR

SEQ ID NO: 334280 - protein, 9 aa, Influenza virus
TGNLQTLKL

SEQ ID NO: 334281 - protein, 9 aa, Influenza virus
EGYEEFTLV

SEQ ID NO: 334282 - protein, 9 aa, Influenza virus
GYEEFTLVG

SEQ ID NO: 334283 - protein, 9 aa, Influenza virus
RATAILKKA

SEQ ID NO: 334284 - protein, 9 aa, Influenza virus
ATAILKKAT

SEQ ID NO: 334285 - protein, 9 aa, Influenza virus
TAILKKATR

SEQ ID NO: 334286 - protein, 9 aa, Influenza virus
RKATRRLVQ

SEQ ID NO: 334287 - protein, 9 aa, Influenza virus
KATRRLVQL

SEQ ID NO: 334288 - protein, 9 aa, Influenza virus
TRRLVQLIV

SEQ ID NO: 334289 - protein, 9 aa, Influenza virus
RLVQLIVSG

SEQ ID NO: 334290 - protein, 9 aa, Influenza virus
LVQLIVSGR

SEQ ID NO: 334291 - protein, 9 aa, Influenza virus
VVAMVFSQE

SEQ ID NO: 334292 - protein, 9 aa, Influenza virus
VAMVFSQEE

SEQ ID NO: 334293 - protein, 9 aa, Influenza virus
AMVFSQEEC

SEQ ID NO: 334294 - protein, 9 aa, Influenza virus
MVFSQEECM

SEQ ID NO: 334295 - protein, 9 aa, Influenza virus
VFSQEDCMV

SEQ ID NO: 334296 - protein, 9 aa, Influenza virus
FSQEDCMVK

SEQ ID NO: 334297 - protein, 9 aa, Influenza virus
SQEDCMVKA

SEQ ID NO: 334298 - protein, 9 aa, Influenza virus
QEDCMVKAV

SEQ ID NO: 334299 - protein, 9 aa, Influenza virus
EDCMVKAVR

SEQ ID NO: 334300 - protein, 9 aa, Influenza virus
DCMVKAVRG

SEQ ID NO: 334301 - protein, 9 aa, Influenza virus
CMVKAVRGD

SEQ ID NO: 334302 - protein, 9 aa, Influenza virus
MVKAVRGDL

SEQ ID NO: 334303 - protein, 9 aa, Influenza virus
VKAVRGDLN

SEQ ID NO: 334304 - protein, 9 aa, Influenza virus
NRANQRLNT

SEQ ID NO: 334305 - protein, 9 aa, Influenza virus
RANQRLNTM

SEQ ID NO: 334306 - protein, 9 aa, Influenza virus
ANQRLNTMH

SEQ ID NO: 334307 - protein, 9 aa, Influenza virus
NQRLNTMHQ

SEQ ID NO: 334308 - protein, 9 aa, Influenza virus
QRLNTMHQL

SEQ ID NO: 334309 - protein, 9 aa, Influenza virus
RLNTMHQLL

SEQ ID NO: 334310 - protein, 9 aa, Influenza virus
LNTMHQLLR

SEQ ID NO: 334311 - protein, 9 aa, Influenza virus
NTMHQLLRH

SEQ ID NO: 334312 - protein, 9 aa, Influenza virus
TMHQLLRHF

SEQ ID NO: 334313 - protein, 9 aa, Influenza virus
LLRHFQKNA

SEQ ID NO: 334314 - protein, 9 aa, Influenza virus
LRHFQKDAR

SEQ ID NO: 334315 - protein, 9 aa, Influenza virus
RHFQKDAKI

SEQ ID NO: 334316 - protein, 9 aa, Influenza virus
HFQKDAKIL

SEQ ID NO: 334317 - protein, 9 aa, Influenza virus
RISKMGVDE

SEQ ID NO: 334318 - protein, 9 aa, Influenza virus
ISKMGVDEY

SEQ ID NO: 334319 - protein, 9 aa, Influenza virus
SKVGVDEYS

SEQ ID NO: 334320 - protein, 9 aa, Influenza virus
KMGVDEYSN

SEQ ID NO: 334321 - protein, 9 aa, Influenza virus
MGVDEYSNA

SEQ ID NO: 334322 - protein, 9 aa, Influenza virus
GVDEYSNAE

SEQ ID NO: 334323 - protein, 9 aa, Influenza virus
VDEYSNAER

SEQ ID NO: 334324 - protein, 9 aa, Influenza virus
IVSIDRFLR

SEQ ID NO: 334325 - protein, 9 aa, Influenza virus
VNIDRFLRV

SEQ ID NO: 334326 - protein, 9 aa, Influenza virus
NIDRFLRVR

SEQ ID NO: 334327 - protein, 9 aa, Influenza virus
IDRFLRVKD

SEQ ID NO: 334328 - protein, 9 aa, Influenza virus
DRFLRVKDQ

SEQ ID NO: 334329 - protein, 9 aa, Influenza virus
RFLRVRDQQ

SEQ ID NO: 334330 - protein, 9 aa, Influenza virus
FLRVRDQQG

SEQ ID NO: 334331 - protein, 9 aa, Influenza virus
LRVRDQQGN

SEQ ID NO: 334332 - protein, 9 aa, Influenza virus
QGNVLLSPE

SEQ ID NO: 334333 - protein, 9 aa, Influenza virus
GNILLSPEE

SEQ ID NO: 334334 - protein, 9 aa, Influenza virus
NILLSPEEV

SEQ ID NO: 334335 - protein, 9 aa, Influenza virus
ILLSPEEVS

SEQ ID NO: 334336 - protein, 9 aa, Influenza virus
SPEEVSEAQ

SEQ ID NO: 334337 - protein, 9 aa, Influenza virus
PEEVSEAQG

SEQ ID NO: 334338 - protein, 9 aa, Influenza virus
EEVSETQGI

SEQ ID NO: 334339 - protein, 9 aa, Influenza virus
EVSETQGIE

SEQ ID NO: 334340 - protein, 9 aa, Influenza virus
ERLTITYSS

SEQ ID NO: 334341 - protein, 9 aa, Influenza virus
RLTITYSSS

SEQ ID NO: 334342 - protein, 9 aa, Influenza virus
LTITYSSSL

SEQ ID NO: 334343 - protein, 9 aa, Influenza virus
TITYSSSLM

SEQ ID NO: 334344 - protein, 9 aa, Influenza virus
ITYSSSLMW

SEQ ID NO: 334345 - protein, 9 aa, Influenza virus
TYSSSLMWE

SEQ ID NO: 334346 - protein, 9 aa, Influenza virus
YSSSLMWEI

SEQ ID NO: 334347 - protein, 9 aa, Influenza virus
SSSLMWEIN

SEQ ID NO: 334348 - protein, 9 aa, Influenza virus
SSLMWEING

SEQ ID NO: 334349 - protein, 9 aa, Influenza virus
SLMWEINGP

SEQ ID NO: 334350 - protein, 9 aa, Influenza virus
LMWEINGPE

SEQ ID NO: 334351 - protein, 9 aa, Influenza virus
MWEVNGPES

SEQ ID NO: 334352 - protein, 9 aa, Influenza virus
WEVNGPESV

SEQ ID NO: 334353 - protein, 9 aa, Influenza virus
EVNGPESVL

SEQ ID NO: 334354 - protein, 9 aa, Influenza virus
INGPESVLI

SEQ ID NO: 334355 - protein, 9 aa, Influenza virus
NGPESVLIN

SEQ ID NO: 334356 - protein, 9 aa, Influenza virus
GPESVLINT

SEQ ID NO: 334357 - protein, 9 aa, Influenza virus
PESVLINTY

SEQ ID NO: 334358 - protein, 9 aa, Influenza virus
ESVLINTYQ

SEQ ID NO: 334359 - protein, 9 aa, Influenza virus
SVLINTYQW

SEQ ID NO: 334360 - protein, 9 aa, Influenza virus
VLINTYQWI

SEQ ID NO: 334361 - protein, 9 aa, Influenza virus
LINTYQWII

SEQ ID NO: 334362 - protein, 9 aa, Influenza virus
INTYQWIIR

SEQ ID NO: 334363 - protein, 9 aa, Influenza virus
NTYQWVIRN

SEQ ID NO: 334364 - protein, 9 aa, Influenza virus
TYQWVIRNW

SEQ ID NO: 334365 - protein, 9 aa, Influenza virus
YQWVIRNWE

SEQ ID NO: 334366 - protein, 9 aa, Influenza virus
KIQWSQNPA

SEQ ID NO: 334367 - protein, 9 aa, Influenza virus
LYNKIEFEP

SEQ ID NO: 334368 - protein, 9 aa, Influenza virus
YNKIEFEPF

SEQ ID NO: 334369 - protein, 9 aa, Influenza virus
NKIEFEPFQ

SEQ ID NO: 334370 - protein, 9 aa, Influenza virus
KIEFEPFQS

SEQ ID NO: 334371 - protein, 9 aa, Influenza virus
IEFEPFQSL

SEQ ID NO: 334372 - protein, 9 aa, Influenza virus
EFEPFQSLI

SEQ ID NO: 334373 - protein, 9 aa, Influenza virus
FEPFQSLIP

SEQ ID NO: 334374 - protein, 9 aa, Influenza virus
EPFQSLVPR

SEQ ID NO: 334375 - protein, 9 aa, Influenza virus
PFQSLVPRA

SEQ ID NO: 334376 - protein, 9 aa, Influenza virus
RSRYSGFVR

SEQ ID NO: 334377 - protein, 9 aa, Influenza virus
RYSGFVRTL

SEQ ID NO: 334378 - protein, 9 aa, Influenza virus
TLFQQMRDI

SEQ ID NO: 334379 - protein, 9 aa, Influenza virus
LFQQMRDIL

SEQ ID NO: 334380 - protein, 9 aa, Influenza virus
FQQMRDILG

SEQ ID NO: 334381 - protein, 9 aa, Influenza virus
QQMRDILGT

SEQ ID NO: 334382 - protein, 9 aa, Influenza virus
QMRDILGTF

SEQ ID NO: 334383 - protein, 9 aa, Influenza virus
MRDILGTFD

SEQ ID NO: 334384 - protein, 9 aa, Influenza virus
RDILGTFDT

SEQ ID NO: 334385 - protein, 9 aa, Influenza virus
GTFDTTQII

SEQ ID NO: 334386 - protein, 9 aa, Influenza virus
TFDTTQIIK

SEQ ID NO: 334387 - protein, 9 aa, Influenza virus
TTQIIKLLP

SEQ ID NO: 334388 - protein, 9 aa, Influenza virus
TQIIKLLPF

SEQ ID NO: 334389 - protein, 9 aa, Influenza virus
QVIKLLPFA

SEQ ID NO: 334390 - protein, 9 aa, Influenza virus
VIKLLPFAA

SEQ ID NO: 334391 - protein, 9 aa, Influenza virus
IKLLPFASA

SEQ ID NO: 334392 - protein, 9 aa, Influenza virus
KLLPFASAP

SEQ ID NO: 334393 - protein, 9 aa, Influenza virus
LLPFASAPP

SEQ ID NO: 334394 - protein, 9 aa, Influenza virus
LPFAAAPPK

SEQ ID NO: 334395 - protein, 9 aa, Influenza virus
PFAAAPPKQ

SEQ ID NO: 334396 - protein, 9 aa, Influenza virus
FAAAPPKQS

SEQ ID NO: 334397 - protein, 9 aa, Influenza virus
AAPPKQSRM

SEQ ID NO: 334398 - protein, 9 aa, Influenza virus
APPKQSRMQ

SEQ ID NO: 334399 - protein, 9 aa, Influenza virus
PPKQSRMQF

SEQ ID NO: 334400 - protein, 9 aa, Influenza virus
PKQSRMQFS

SEQ ID NO: 334401 - protein, 9 aa, Influenza virus
KQSRMQFSS

SEQ ID NO: 334402 - protein, 9 aa, Influenza virus
QSKMQFSSL

SEQ ID NO: 334403 - protein, 9 aa, Influenza virus
SKMQFSSLT

SEQ ID NO: 334404 - protein, 9 aa, Influenza virus
KMQFSSLTV

SEQ ID NO: 334405 - protein, 9 aa, Influenza virus
MQFSSLTVS

SEQ ID NO: 334406 - protein, 9 aa, Influenza virus
QFSSLTVSV

SEQ ID NO: 334407 - protein, 9 aa, Influenza virus
FSSLTVSVR

SEQ ID NO: 334408 - protein, 9 aa, Influenza virus
SSLTVSVRG

SEQ ID NO: 334409 - protein, 9 aa, Influenza virus
SLTVNVRGT

SEQ ID NO: 334410 - protein, 9 aa, Influenza virus
LTVNVRGTG

SEQ ID NO: 334411 - protein, 9 aa, Influenza virus
TVNVRGSGL

SEQ ID NO: 334412 - protein, 9 aa, Influenza virus
VNVRGSGLR

SEQ ID NO: 334413 - protein, 9 aa, Influenza virus
NVRGSGLRI

SEQ ID NO: 334414 - protein, 9 aa, Influenza virus
VRGSGLRIL

SEQ ID NO: 334415 - protein, 9 aa, Influenza virus
RGSGLRILV

SEQ ID NO: 334416 - protein, 9 aa, Influenza virus
GSGLRILVR

SEQ ID NO: 334417 - protein, 9 aa, Influenza virus
SGLRILVRG

SEQ ID NO: 334418 - protein, 9 aa, Influenza virus
GLRILVRGN

SEQ ID NO: 334419 - protein, 9 aa, Influenza virus
LRILVRGNS

SEQ ID NO: 334420 - protein, 9 aa, Influenza virus
RILIRGNSP

SEQ ID NO: 334421 - protein, 9 aa, Influenza virus
LIRGNSPVF

SEQ ID NO: 334422 - protein, 9 aa, Influenza virus
IRGNSPVFN

SEQ ID NO: 334423 - protein, 9 aa, Influenza virus
RGNSPIFNY

SEQ ID NO: 334424 - protein, 9 aa, Influenza virus
GNSPIFNYN

SEQ ID NO: 334425 - protein, 9 aa, Influenza virus
NSPVFNYNR

SEQ ID NO: 334426 - protein, 9 aa, Influenza virus
TKRLTILGK

SEQ ID NO: 334427 - protein, 9 aa, Influenza virus
KRLTILGKD

SEQ ID NO: 334428 - protein, 9 aa, Influenza virus
RLTILGKDA

SEQ ID NO: 334429 - protein, 9 aa, Influenza virus
LTILGKDAG

SEQ ID NO: 334430 - protein, 9 aa, Influenza virus
SGVESAVLR

SEQ ID NO: 334431 - protein, 9 aa, Influenza virus
AVLRGFLII

SEQ ID NO: 334432 - protein, 9 aa, Influenza virus
VLRGFLIIG

SEQ ID NO: 334433 - protein, 9 aa, Influenza virus
LRGFLIIGK

SEQ ID NO: 334434 - protein, 9 aa, Influenza virus
RGFLIIGKE

SEQ ID NO: 334435 - protein, 9 aa, Influenza virus
GFLIIGKED

SEQ ID NO: 334436 - protein, 9 aa, Influenza virus
FLIIGKEDR

SEQ ID NO: 334437 - protein, 9 aa, Influenza virus
GKEDRRYGP

SEQ ID NO: 334438 - protein, 9 aa, Influenza virus
KEDRRYGPA

SEQ ID NO: 334439 - protein, 9 aa, Influenza virus
EDRRYGPAL

SEQ ID NO: 334440 - protein, 9 aa, Influenza virus
DRRYGPALS

SEQ ID NO: 334441 - protein, 9 aa, Influenza virus
RRYGPALSI

SEQ ID NO: 334442 - protein, 9 aa, Influenza virus
RYGPALSIS

SEQ ID NO: 334443 - protein, 9 aa, Influenza virus
YGPALSISE

SEQ ID NO: 334444 - protein, 9 aa, Influenza virus
GPALSISEL

SEQ ID NO: 334445 - protein, 9 aa, Influenza virus
PALSISELS

SEQ ID NO: 334446 - protein, 9 aa, Influenza virus
ALSINELSS

SEQ ID NO: 334447 - protein, 9 aa, Influenza virus
LTKGEKANV

SEQ ID NO: 334448 - protein, 9 aa, Influenza virus
TKGEKANVL

SEQ ID NO: 334449 - protein, 9 aa, Influenza virus
NVLIGQGDI

SEQ ID NO: 334450 - protein, 9 aa, Influenza virus
VLIGQGDIV

SEQ ID NO: 334451 - protein, 9 aa, Influenza virus
LIGQGDIVL

SEQ ID NO: 334452 - protein, 9 aa, Influenza virus
IGQGDIVLV

SEQ ID NO: 334453 - protein, 9 aa, Influenza virus
GQGDIVLVM

SEQ ID NO: 334454 - protein, 9 aa, Influenza virus
QGDIVLVMK

SEQ ID NO: 334455 - protein, 9 aa, Influenza virus
GDIVLVMKR

SEQ ID NO: 334456 - protein, 9 aa, Influenza virus
DIVLVMKRK

SEQ ID NO: 334457 - protein, 9 aa, Influenza virus
IVLVMKRKR

SEQ ID NO: 334458 - protein, 9 aa, Influenza virus
VLVMKRKRN

SEQ ID NO: 334459 - protein, 9 aa, Influenza virus
LVMKRKRNS

SEQ ID NO: 334460 - protein, 9 aa, Influenza virus
VMKRKRNSS

SEQ ID NO: 334461 - protein, 9 aa, Influenza virus
MKRKRNSSI

SEQ ID NO: 334462 - protein, 9 aa, Influenza virus
KRKRNSSIL

SEQ ID NO: 334463 - protein, 9 aa, Influenza virus
RKRNSSILT

SEQ ID NO: 334464 - protein, 9 aa, Influenza virus
KRNSSILTD

SEQ ID NO: 334465 - protein, 9 aa, Influenza virus
RNSSILTDS

SEQ ID NO: 334466 - protein, 9 aa, Influenza virus
NSSILTDSQ

SEQ ID NO: 334467 - protein, 9 aa, Influenza virus
DSQTATKRL

SEQ ID NO: 334468 - protein, 9 aa, Influenza virus
SQTATKRLR

SEQ ID NO: 334469 - protein, 9 aa, Influenza virus
QTATKRLRM

SEQ ID NO: 334470 - protein, 9 aa, Influenza virus
TATKRLRMA

SEQ ID NO: 334471 - protein, 9 aa, Influenza virus
ATKRLRMAI

SEQ ID NO: 334472 - protein, 9 aa, Influenza virus
RIRMATNEC

SEQ ID NO: 334473 - protein, 9 aa, Influenza virus
IRMATNECR

SEQ ID NO: 334474 - protein, 9 aa, Influenza virus
RMATNECRI

SEQ ID NO: 334475 - protein, 9 aa, Influenza virus
MAINWGRIV

SEQ ID NO: 334476 - protein, 9 aa, Influenza virus
GKTKATKME

SEQ ID NO: 334477 - protein, 9 aa, Influenza virus
IFIFLLLTH

SEQ ID NO: 334478 - protein, 9 aa, Influenza virus
FNFILLTHW

SEQ ID NO: 334479 - protein, 9 aa, Influenza virus
DNNKNATNP

SEQ ID NO: 334480 - protein, 9 aa, Influenza virus
NNNKGAVFK

SEQ ID NO: 334481 - protein, 9 aa, Influenza virus
RRRKRGLFG

SEQ ID NO: 334482 - protein, 9 aa, Influenza virus
IHKQLTHHM

SEQ ID NO: 334483 - protein, 9 aa, Influenza virus
RKTRGLFGA

SEQ ID NO: 334484 - protein, 9 aa, Influenza virus
KTRGLFGAI

SEQ ID NO: 334485 - protein, 9 aa, Influenza virus
KRGLFGAIA

SEQ ID NO: 334486 - protein, 9 aa, Influenza virus
KGLFGAIAG

SEQ ID NO: 334487 - protein, 9 aa, Influenza virus
LDQNFRNIR

SEQ ID NO: 334488 - protein, 9 aa, Influenza virus
VFREQKQEF

SEQ ID NO: 334489 - protein, 9 aa, Influenza virus
FREQKQEFK

SEQ ID NO: 334490 - protein, 9 aa, Influenza virus
AKAGVKMNP

SEQ ID NO: 334491 - protein, 9 aa, Influenza virus
KAGVKMNPN

SEQ ID NO: 334492 - protein, 9 aa, Influenza virus
QEIKMNPNQ

SEQ ID NO: 334493 - protein, 9 aa, Influenza virus
EIKMNPNQK

SEQ ID NO: 334494 - protein, 9 aa, Influenza virus
IKMNPNQKI

SEQ ID NO: 334495 - protein, 9 aa, Influenza virus
KMNPNQKIM

SEQ ID NO: 334496 - protein, 9 aa, Influenza virus
IMRTQESEC

SEQ ID NO: 334497 - protein, 9 aa, Influenza virus
RTQESSCTC

SEQ ID NO: 334498 - protein, 9 aa, Influenza virus
RKGLILEYY

SEQ ID NO: 334499 - protein, 9 aa, Influenza virus
EKGKVVKSV

SEQ ID NO: 334500 - protein, 9 aa, Influenza virus
VQHLEECSC

SEQ ID NO: 334501 - protein, 9 aa, Influenza virus
VFREQKQEF

SEQ ID NO: 334502 - protein, 9 aa, Influenza virus
FREQKQEFK

SEQ ID NO: 334503 - protein, 9 aa, Influenza virus
QEIKMNPNQ

SEQ ID NO: 334504 - protein, 9 aa, Influenza virus
EIKMNPNQK

SEQ ID NO: 334505 - protein, 9 aa, Influenza virus
IKMNPNQKI

SEQ ID NO: 334506 - protein, 9 aa, Influenza virus
KMNPNQKIM

SEQ ID NO: 334507 - protein, 9 aa, Influenza virus
GWAVYSKDN

SEQ ID NO: 334508 - protein, 9 aa, Influenza virus
SKDNSVRIG

SEQ ID NO: 334509 - protein, 9 aa, Influenza virus
KDNGIRIGS

SEQ ID NO: 334510 - protein, 9 aa, Influenza virus
DNGIRIGSK

SEQ ID NO: 334511 - protein, 9 aa, Influenza virus
NGIRIGSKG

SEQ ID NO: 334512 - protein, 9 aa, Influenza virus
GIRIGSKGD

SEQ ID NO: 334513 - protein, 9 aa, Influenza virus
IRIGSKGDI

SEQ ID NO: 334514 - protein, 9 aa, Influenza virus
RIGSRGDVF

SEQ ID NO: 334515 - protein, 9 aa, Influenza virus
IGSRGDVFV

SEQ ID NO: 334516 - protein, 9 aa, Influenza virus
GDIFVMREP

SEQ ID NO: 334517 - protein, 9 aa, Influenza virus
DIFVMREPF

SEQ ID NO: 334518 - protein, 9 aa, Influenza virus
FVVREPFIS

SEQ ID NO: 334519 - protein, 9 aa, Influenza virus
VVREPFISC

SEQ ID NO: 334520 - protein, 9 aa, Influenza virus
VREPFISCS

SEQ ID NO: 334521 - protein, 9 aa, Influenza virus
REPFISCSQ

SEQ ID NO: 334522 - protein, 9 aa, Influenza virus
MECRTFFLT

SEQ ID NO: 334523 - protein, 9 aa, Influenza virus
NDRHSNGTV

SEQ ID NO: 334524 - protein, 9 aa, Influenza virus
DRSPHRTLM

SEQ ID NO: 334525 - protein, 9 aa, Influenza virus
RSPHRTLMS

SEQ ID NO: 334526 - protein, 9 aa, Influenza virus
SPHRTLMSC

SEQ ID NO: 334527 - protein, 9 aa, Influenza virus
PHRTLMSCP

SEQ ID NO: 334528 - protein, 9 aa, Influenza virus
RALMSCPLG

SEQ ID NO: 334529 - protein, 9 aa, Influenza virus
LGEAPSPYN

SEQ ID NO: 334530 - protein, 9 aa, Influenza virus
EAPSPYNSK

SEQ ID NO: 334531 - protein, 9 aa, Influenza virus
APSPYNSKF

SEQ ID NO: 334532 - protein, 9 aa, Influenza virus
SASACHDGT

SEQ ID NO: 334533 - protein, 9 aa, Influenza virus
GWLTIGISG

SEQ ID NO: 334534 - protein, 9 aa, Influenza virus
LTIGVSGPD

SEQ ID NO: 334535 - protein, 9 aa, Influenza virus
TIGISGPDS

SEQ ID NO: 334536 - protein, 9 aa, Influenza virus
IGISGPDNE

SEQ ID NO: 334537 - protein, 9 aa, Influenza virus
GISGPDNEA

SEQ ID NO: 334538 - protein, 9 aa, Influenza virus
ISGPDNEAV

SEQ ID NO: 334539 - protein, 9 aa, Influenza virus
SGPDNEAVA

SEQ ID NO: 334540 - protein, 9 aa, Influenza virus
GPDNEAVAV

SEQ ID NO: 334541 - protein, 9 aa, Influenza virus
PDNEAVAVL

SEQ ID NO: 334542 - protein, 9 aa, Influenza virus
DNEAVAVLK

SEQ ID NO: 334543 - protein, 9 aa, Influenza virus
NEAVAVLKY

SEQ ID NO: 334544 - protein, 9 aa, Influenza virus
GAVAVVKYN

SEQ ID NO: 334545 - protein, 9 aa, Influenza virus
AVAVLKYKG

SEQ ID NO: 334546 - protein, 9 aa, Influenza virus
AVVKYNGII

SEQ ID NO: 334547 - protein, 9 aa, Influenza virus
VVKYNGIIT

SEQ ID NO: 334548 - protein, 9 aa, Influenza virus
MRTQESECA

SEQ ID NO: 334549 - protein, 9 aa, Influenza virus
NGSCFTVLT

SEQ ID NO: 334550 - protein, 9 aa, Influenza virus
GSCFTVLTD

SEQ ID NO: 334551 - protein, 9 aa, Influenza virus
SCFTVLTDG

SEQ ID NO: 334552 - protein, 9 aa, Influenza virus
CFTVLTDGP

SEQ ID NO: 334553 - protein, 9 aa, Influenza virus
FTVLTDGPS

SEQ ID NO: 334554 - protein, 9 aa, Influenza virus
GKRGKWVKS

SEQ ID NO: 334555 - protein, 9 aa, Influenza virus
APNFYYEEC

SEQ ID NO: 334556 - protein, 9 aa, Influenza virus
PNFYYEECS

SEQ ID NO: 334557 - protein, 9 aa, Influenza virus
NFYYEECSC

SEQ ID NO: 334558 - protein, 9 aa, Influenza virus
FYYEECSCY

SEQ ID NO: 334559 - protein, 9 aa, Influenza virus
EECSCYPDA

SEQ ID NO: 334560 - protein, 9 aa, Influenza virus
VCVCRDNWH

SEQ ID NO: 334561 - protein, 9 aa, Influenza virus
WHASNRPWI

SEQ ID NO: 334562 - protein, 9 aa, Influenza virus
HASNRPWIS

SEQ ID NO: 334563 - protein, 9 aa, Influenza virus
ASNRPWISF

SEQ ID NO: 334564 - protein, 9 aa, Influenza virus
ANRPWVSFN

SEQ ID NO: 334565 - protein, 9 aa, Influenza virus
NRPWISFDQ

SEQ ID NO: 334566 - protein, 9 aa, Influenza virus
YKIGYICSG

SEQ ID NO: 334567 - protein, 9 aa, Influenza virus
ICSGVFGDS

SEQ ID NO: 334568 - protein, 9 aa, Influenza virus
CSGVFGDSP

SEQ ID NO: 334569 - protein, 9 aa, Influenza virus
SGVFGDSPR

SEQ ID NO: 334570 - protein, 9 aa, Influenza virus
GVFGDNPRS

SEQ ID NO: 334571 - protein, 9 aa, Influenza virus
GVKGFSFRY

SEQ ID NO: 334572 - protein, 9 aa, Influenza virus
KYDNGVWIG

SEQ ID NO: 334573 - protein, 9 aa, Influenza virus
YGDGVWIGR

SEQ ID NO: 334574 - protein, 9 aa, Influenza virus
GDGVWIGRT

SEQ ID NO: 334575 - protein, 9 aa, Influenza virus
NGVWMGRTK

SEQ ID NO: 334576 - protein, 9 aa, Influenza virus
GFEMVWDPN

SEQ ID NO: 334577 - protein, 9 aa, Influenza virus
FEMVWDPNG

SEQ ID NO: 334578 - protein, 9 aa, Influenza virus
EMVWDPNGW

SEQ ID NO: 334579 - protein, 9 aa, Influenza virus
NDWSGYSGS

SEQ ID NO: 334580 - protein, 9 aa, Influenza virus
IQHPELTGL

SEQ ID NO: 334581 - protein, 9 aa, Influenza virus
QHPELTGLN

SEQ ID NO: 334582 - protein, 9 aa, Influenza virus
HPELTGLNC

SEQ ID NO: 334583 - protein, 9 aa, Influenza virus
NCIRPCFWV

SEQ ID NO: 334584 - protein, 9 aa, Influenza virus
CIKPCFWVE

SEQ ID NO: 334585 - protein, 9 aa, Influenza virus
IKPCFWVEL

SEQ ID NO: 334586 - protein, 9 aa, Influenza virus
KPCFWVELI

SEQ ID NO: 334587 - protein, 9 aa, Influenza virus
FWVELIRGQ

SEQ ID NO: 334588 - protein, 9 aa, Influenza virus
WVELIRGQP

SEQ ID NO: 334589 - protein, 9 aa, Influenza virus
TVWTSGSSI

SEQ ID NO: 334590 - protein, 9 aa, Influenza virus
VWTSGSSIS

SEQ ID NO: 334591 - protein, 9 aa, Influenza virus
WTSGSIISF

SEQ ID NO: 334592 - protein, 9 aa, Influenza virus
TSGSIISFC

SEQ ID NO: 334593 - protein, 9 aa, Influenza virus
ASSISFCGV

SEQ ID NO: 334594 - protein, 9 aa, Influenza virus
SSISFCGVS

SEQ ID NO: 334595 - protein, 9 aa, Influenza virus
WSWPDGAEV

SEQ ID NO: 334596 - protein, 9 aa, Influenza virus
SWPDGAEVP

SEQ ID NO: 334597 - protein, 9 aa, Influenza virus
WPDGAEVPF

SEQ ID NO: 334598 - protein, 9 aa, Influenza virus
GFVPFSKDN

SEQ ID NO: 334599 - protein, 9 aa, Influenza virus
FVPFSKDNS

SEQ ID NO: 334600 - protein, 9 aa, Influenza virus
VPFSKDNSI

SEQ ID NO: 334601 - protein, 9 aa, Influenza virus
PFTKDNSIR

SEQ ID NO: 334602 - protein, 9 aa, Influenza virus
FTKDNSIRL

SEQ ID NO: 334603 - protein, 9 aa, Influenza virus
TKDNSIRLS

SEQ ID NO: 334604 - protein, 9 aa, Influenza virus
KDNSIRLAA

SEQ ID NO: 334605 - protein, 9 aa, Influenza virus
DNSVRLSAG

SEQ ID NO: 334606 - protein, 9 aa, Influenza virus
NSVRLSAGG

SEQ ID NO: 334607 - protein, 9 aa, Influenza virus
IWVTRELYV

SEQ ID NO: 334608 - protein, 9 aa, Influenza virus
WVTRELYVS

SEQ ID NO: 334609 - protein, 9 aa, Influenza virus
VTRELYVSC

SEQ ID NO: 334610 - protein, 9 aa, Influenza virus
TREPYVSCS

SEQ ID NO: 334611 - protein, 9 aa, Influenza virus
NCYQFALGQ

SEQ ID NO: 334612 - protein, 9 aa, Influenza virus
PHRTLLMSE

SEQ ID NO: 334613 - protein, 9 aa, Influenza virus
HRTLLMSEL

SEQ ID NO: 334614 - protein, 9 aa, Influenza virus
TLLMNELGI

SEQ ID NO: 334615 - protein, 9 aa, Influenza virus
LLMNELGIP

SEQ ID NO: 334616 - protein, 9 aa, Influenza virus
LMNELGIPF

SEQ ID NO: 334617 - protein, 9 aa, Influenza virus
MNELGIPFH

SEQ ID NO: 334618 - protein, 9 aa, Influenza virus
NELGIPFHL

SEQ ID NO: 334619 - protein, 9 aa, Influenza virus
ELGIPFHLG

SEQ ID NO: 334620 - protein, 9 aa, Influenza virus
LGIPFHLGT

SEQ ID NO: 334621 - protein, 9 aa, Influenza virus
GVPFHLATK

SEQ ID NO: 334622 - protein, 9 aa, Influenza virus
VPFHLATKQ

SEQ ID NO: 334623 - protein, 9 aa, Influenza virus
PFHLATKQV

SEQ ID NO: 334624 - protein, 9 aa, Influenza virus
FHLATKQVC

SEQ ID NO: 334625 - protein, 9 aa, Influenza virus
TKQVCMAWS

SEQ ID NO: 334626 - protein, 9 aa, Influenza virus
KQVCMAWSS

SEQ ID NO: 334627 - protein, 9 aa, Influenza virus
QVCVAWSSS

SEQ ID NO: 334628 - protein, 9 aa, Influenza virus
VCVAWSSSS

SEQ ID NO: 334629 - protein, 9 aa, Influenza virus
CVAWSSSSC

SEQ ID NO: 334630 - protein, 9 aa, Influenza virus
VAWSSSSCH

SEQ ID NO: 334631 - protein, 9 aa, Influenza virus
SSSSCYDGK

SEQ ID NO: 334632 - protein, 9 aa, Influenza virus
SSSCYDGKA

SEQ ID NO: 334633 - protein, 9 aa, Influenza virus
SSCYDGKAW

SEQ ID NO: 334634 - protein, 9 aa, Influenza virus
SCYDGKAWL

SEQ ID NO: 334635 - protein, 9 aa, Influenza virus
CYDGKAWLH

SEQ ID NO: 334636 - protein, 9 aa, Influenza virus
DGKAWLHIC

SEQ ID NO: 334637 - protein, 9 aa, Influenza virus
AWLHICVTG

SEQ ID NO: 334638 - protein, 9 aa, Influenza virus
EILRTQESE

SEQ ID NO: 334639 - protein, 9 aa, Influenza virus
QESECICIN

SEQ ID NO: 334640 - protein, 9 aa, Influenza virus
ESECICING

SEQ ID NO: 334641 - protein, 9 aa, Influenza virus
CTVVMTDGN

SEQ ID NO: 334642 - protein, 9 aa, Influenza virus
TVVMTDGNA

SEQ ID NO: 334643 - protein, 9 aa, Influenza virus
VIMTDGSAS

SEQ ID NO: 334644 - protein, 9 aa, Influenza virus
VMTDGNASG

SEQ ID NO: 334645 - protein, 9 aa, Influenza virus
GNAQHVEEC

SEQ ID NO: 334646 - protein, 9 aa, Influenza virus
NAQHVEECS

SEQ ID NO: 334647 - protein, 9 aa, Influenza virus
VEECSCYPQ

SEQ ID NO: 334648 - protein, 9 aa, Influenza virus
EECSCYPRF

SEQ ID NO: 334649 - protein, 9 aa, Influenza virus
IRCVCRDNW

SEQ ID NO: 334650 - protein, 9 aa, Influenza virus
RCVCRDNWR

SEQ ID NO: 334651 - protein, 9 aa, Influenza virus
CVCRDNWRG

SEQ ID NO: 334652 - protein, 9 aa, Influenza virus
VCRDNWRGS

SEQ ID NO: 334653 - protein, 9 aa, Influenza virus
NWRGSNRPV

SEQ ID NO: 334654 - protein, 9 aa, Influenza virus
YMCSGLVGD

SEQ ID NO: 334655 - protein, 9 aa, Influenza virus
MCSGLVGDT

SEQ ID NO: 334656 - protein, 9 aa, Influenza virus
GLVGDTPRS

SEQ ID NO: 334657 - protein, 9 aa, Influenza virus
QGVKGWAFD

SEQ ID NO: 334658 - protein, 9 aa, Influenza virus
GVKGWAFDS

SEQ ID NO: 334659 - protein, 9 aa, Influenza virus
RLGYETFKV

SEQ ID NO: 334660 - protein, 9 aa, Influenza virus
SGYSGIFSI

SEQ ID NO: 334661 - protein, 9 aa, Influenza virus
GYSGIFSIE

SEQ ID NO: 334662 - protein, 9 aa, Influenza virus
FYVELVRGR

SEQ ID NO: 334663 - protein, 9 aa, Influenza virus
VWWTSNSII

SEQ ID NO: 334664 - protein, 9 aa, Influenza virus
WTSNSIVAF

SEQ ID NO: 334665 - protein, 9 aa, Influenza virus
TSNSIVAFC

SEQ ID NO: 334666 - protein, 9 aa, Influenza virus
SNSIVAFCG

SEQ ID NO: 334667 - protein, 9 aa, Influenza virus
NSIVAFCGT

SEQ ID NO: 334668 - protein, 9 aa, Influenza virus
SIVAFCGTS

SEQ ID NO: 334669 - protein, 9 aa, Influenza virus
IVAFCGTSG

SEQ ID NO: 334670 - protein, 9 aa, Influenza virus
IAFCGTSGT

SEQ ID NO: 334671 - protein, 9 aa, Influenza virus
CGTSGTYGA

SEQ ID NO: 334672 - protein, 9 aa, Influenza virus
GTSGTYGAG

SEQ ID NO: 334673 - protein, 9 aa, Influenza virus
TSGTYGAGS

SEQ ID NO: 334674 - protein, 9 aa, Influenza virus
SGTYGAGSW

SEQ ID NO: 334675 - protein, 9 aa, Influenza virus
GTYGAGSWP

SEQ ID NO: 334676 - protein, 9 aa, Influenza virus
TYGAGSWPD

SEQ ID NO: 334677 - protein, 9 aa, Influenza virus
YGAGSWPDG

SEQ ID NO: 334678 - protein, 9 aa, Influenza virus
GAGSWPDGA

SEQ ID NO: 334679 - protein, 9 aa, Influenza virus
GSWPDGADL

SEQ ID NO: 334680 - protein, 9 aa, Influenza virus
TSISCLYKL

SEQ ID NO: 334681 - protein, 9 aa, Influenza virus
DIKSHAYIS

SEQ ID NO: 334682 - protein, 9 aa, Influenza virus
IKSHAYISF

SEQ ID NO: 334683 - protein, 9 aa, Influenza virus
GLMGRTRIS

SEQ ID NO: 334684 - protein, 9 aa, Influenza virus
ALFIGVGNL

SEQ ID NO: 334685 - protein, 9 aa, Influenza virus
GNLAFNAVI

SEQ ID NO: 334686 - protein, 9 aa, Influenza virus
NLAFNAVIH

SEQ ID NO: 334687 - protein, 9 aa, Influenza virus
LPLCPFQGF

SEQ ID NO: 334688 - protein, 9 aa, Influenza virus
PLCPFQGFF

SEQ ID NO: 334689 - protein, 9 aa, Influenza virus
LCPFQGFFP

SEQ ID NO: 334690 - protein, 9 aa, Influenza virus
CPFQGFFPF

SEQ ID NO: 334691 - protein, 9 aa, Influenza virus
PFQGFFPFH

SEQ ID NO: 334692 - protein, 9 aa, Influenza virus
FQGFFPFHK

SEQ ID NO: 334693 - protein, 9 aa, Influenza virus
QGFFPFHKD

SEQ ID NO: 334694 - protein, 9 aa, Influenza virus
FPFHKDNAV

SEQ ID NO: 334695 - protein, 9 aa, Influenza virus
PFHKDNAVR

SEQ ID NO: 334696 - protein, 9 aa, Influenza virus
FHKDNAVRL

SEQ ID NO: 334697 - protein, 9 aa, Influenza virus
HKDNAVRLG

SEQ ID NO: 334698 - protein, 9 aa, Influenza virus
KDNAVRLGE

SEQ ID NO: 334699 - protein, 9 aa, Influenza virus
DNAVRLGEN

SEQ ID NO: 334700 - protein, 9 aa, Influenza virus
LVTREPYIS

SEQ ID NO: 334701 - protein, 9 aa, Influenza virus
ITREPYVSC

SEQ ID NO: 334702 - protein, 9 aa, Influenza virus
REPYVSCDY

SEQ ID NO: 334703 - protein, 9 aa, Influenza virus
GCWSFALAQ

SEQ ID NO: 334704 - protein, 9 aa, Influenza virus
WSFALSQGA

SEQ ID NO: 334705 - protein, 9 aa, Influenza virus
SFALAQGVL

SEQ ID NO: 334706 - protein, 9 aa, Influenza virus
FALAQGTLL

SEQ ID NO: 334707 - protein, 9 aa, Influenza virus
ALAQGTLLG

SEQ ID NO: 334708 - protein, 9 aa, Influenza virus
LAQGTLLGT

SEQ ID NO: 334709 - protein, 9 aa, Influenza virus
LLGTNHSNG

SEQ ID NO: 334710 - protein, 9 aa, Influenza virus
VGTKHSNGT

SEQ ID NO: 334711 - protein, 9 aa, Influenza virus
HSNGTVKDR

SEQ ID NO: 334712 - protein, 9 aa, Influenza virus
SNGTVKDRT

SEQ ID NO: 334713 - protein, 9 aa, Influenza virus
EDRTPYRSL

SEQ ID NO: 334714 - protein, 9 aa, Influenza virus
DRAPYRSLI

SEQ ID NO: 334715 - protein, 9 aa, Influenza virus
RTSYRSLIR

SEQ ID NO: 334716 - protein, 9 aa, Influenza virus
TSYRSLIRF

SEQ ID NO: 334717 - protein, 9 aa, Influenza virus
SYRSLIRFP

SEQ ID NO: 334718 - protein, 9 aa, Influenza virus
YRSLIQFPI

SEQ ID NO: 334719 - protein, 9 aa, Influenza virus
RSLIQFPIG

SEQ ID NO: 334720 - protein, 9 aa, Influenza virus
GTAPILGNY

SEQ ID NO: 334721 - protein, 9 aa, Influenza virus
APILGNYKE

SEQ ID NO: 334722 - protein, 9 aa, Influenza virus
CAAWSSSSC

SEQ ID NO: 334723 - protein, 9 aa, Influenza virus
AAWSSSSCF

SEQ ID NO: 334724 - protein, 9 aa, Influenza virus
SCFDGREWM

SEQ ID NO: 334725 - protein, 9 aa, Influenza virus
CFDGREWMH

SEQ ID NO: 334726 - protein, 9 aa, Influenza virus
FDGKEWLHV

SEQ ID NO: 334727 - protein, 9 aa, Influenza virus
DGKEWLHVC

SEQ ID NO: 334728 - protein, 9 aa, Influenza virus
NNILRTQES

SEQ ID NO: 334729 - protein, 9 aa, Influenza virus
TDGPAASSA

SEQ ID NO: 334730 - protein, 9 aa, Influenza virus
ADHRIYWIK

SEQ ID NO: 334731 - protein, 9 aa, Influenza virus
RIQHLEECS

SEQ ID NO: 334732 - protein, 9 aa, Influenza virus
VQHLEECSC

SEQ ID NO: 334733 - protein, 9 aa, Influenza virus
RHLEECSCY

SEQ ID NO: 334734 - protein, 9 aa, Influenza virus
LEECSCYMD

SEQ ID NO: 334735 - protein, 9 aa, Influenza virus
DIYCICRDN

SEQ ID NO: 334736 - protein, 9 aa, Influenza virus
IYCICRDNW

SEQ ID NO: 334737 - protein, 9 aa, Influenza virus
WKGSNRPWI

SEQ ID NO: 334738 - protein, 9 aa, Influenza virus
KGSNRPWIR

SEQ ID NO: 334739 - protein, 9 aa, Influenza virus
GSNRPWVRI

SEQ ID NO: 334740 - protein, 9 aa, Influenza virus
SNRPWMRIS

SEQ ID NO: 334741 - protein, 9 aa, Influenza virus
NRPWMRISN

SEQ ID NO: 334742 - protein, 9 aa, Influenza virus
RPWMRISNE

SEQ ID NO: 334743 - protein, 9 aa, Influenza virus
PWMRISNET

SEQ ID NO: 334744 - protein, 9 aa, Influenza virus
WMRISNETI

SEQ ID NO: 334745 - protein, 9 aa, Influenza virus
ISNETILET

SEQ ID NO: 334746 - protein, 9 aa, Influenza virus
NNETIIETG

SEQ ID NO: 334747 - protein, 9 aa, Influenza virus
NETIVETGY

SEQ ID NO: 334748 - protein, 9 aa, Influenza virus
ETIIETGYV

SEQ ID NO: 334749 - protein, 9 aa, Influenza virus
TIIETGYVC

SEQ ID NO: 334750 - protein, 9 aa, Influenza virus
IIETGYVCS

SEQ ID NO: 334751 - protein, 9 aa, Influenza virus
IETGYVCSK

SEQ ID NO: 334752 - protein, 9 aa, Influenza virus
ETGYVCGKF

SEQ ID NO: 334753 - protein, 9 aa, Influenza virus
FHSDTPRPV

SEQ ID NO: 334754 - protein, 9 aa, Influenza virus
HSDTPRPVD

SEQ ID NO: 334755 - protein, 9 aa, Influenza virus
SDTPRPVDP

SEQ ID NO: 334756 - protein, 9 aa, Influenza virus
DTPRPVDPS

SEQ ID NO: 334757 - protein, 9 aa, Influenza virus
GLGVKGFGF

SEQ ID NO: 334758 - protein, 9 aa, Influenza virus
LGVKGFGFK

SEQ ID NO: 334759 - protein, 9 aa, Influenza virus
QNDVWLGRT

SEQ ID NO: 334760 - protein, 9 aa, Influenza virus
NDVWLGRTI

SEQ ID NO: 334761 - protein, 9 aa, Influenza virus
DVWLGRTMS

SEQ ID NO: 334762 - protein, 9 aa, Influenza virus
RSGFEIIRV

SEQ ID NO: 334763 - protein, 9 aa, Influenza virus
IQTLVSNND

SEQ ID NO: 334764 - protein, 9 aa, Influenza virus
QTLVANNDW

SEQ ID NO: 334765 - protein, 9 aa, Influenza virus
TLVANNDWS

SEQ ID NO: 334766 - protein, 9 aa, Influenza virus
SGYSGSFVI

SEQ ID NO: 334767 - protein, 9 aa, Influenza virus
GCFQPCFYV

SEQ ID NO: 334768 - protein, 9 aa, Influenza virus
QPCFYVELT

SEQ ID NO: 334769 - protein, 9 aa, Influenza virus
PCFYVELTR

SEQ ID NO: 334770 - protein, 9 aa, Influenza virus
CFYVELTRG

SEQ ID NO: 334771 - protein, 9 aa, Influenza virus
FYIELIRGK

SEQ ID NO: 334772 - protein, 9 aa, Influenza virus
VSWTSNSMV

SEQ ID NO: 334773 - protein, 9 aa, Influenza virus
SWASNSIVT

SEQ ID NO: 334774 - protein, 9 aa, Influenza virus
WASNSIVTF

SEQ ID NO: 334775 - protein, 9 aa, Influenza virus
ASNSIVTFC

SEQ ID NO: 334776 - protein, 9 aa, Influenza virus
SMVTFCGLD

SEQ ID NO: 334777 - protein, 9 aa, Influenza virus
MVTFCGLDN

SEQ ID NO: 334778 - protein, 9 aa, Influenza virus
GLDNEPGSE

SEQ ID NO: 334779 - protein, 9 aa, Influenza virus
GSGDWPDGS

SEQ ID NO: 334780 - protein, 9 aa, Influenza virus
WPDGSDIGF

SEQ ID NO: 334781 - protein, 9 aa, Influenza virus
PDGSDIGFM

SEQ ID NO: 334782 - protein, 9 aa, Influenza virus
DGSDIGFMP

SEQ ID NO: 334783 - protein, 9 aa, Influenza virus
GSDIGFMPK

SEQ ID NO: 334784 - protein, 9 aa, Influenza virus
MNPNQSIIT

SEQ ID NO: 334785 - protein, 9 aa, Influenza virus
NPNQMIITI

SEQ ID NO: 334786 - protein, 9 aa, Influenza virus
PNQSIITIG

SEQ ID NO: 334787 - protein, 9 aa, Influenza virus
RSKIITIGS

SEQ ID NO: 334788 - protein, 9 aa, Influenza virus
IITIGSASI

SEQ ID NO: 334789 - protein, 9 aa, Influenza virus
TTVGLLLQV

SEQ ID NO: 334790 - protein, 9 aa, Influenza virus
TVGLLLQII

SEQ ID NO: 334791 - protein, 9 aa, Influenza virus
VGLLLQIIS

SEQ ID NO: 334792 - protein, 9 aa, Influenza virus
GLLLQVTSL

SEQ ID NO: 334793 - protein, 9 aa, Influenza virus
LLLQVTSLC

SEQ ID NO: 334794 - protein, 9 aa, Influenza virus
WFSHYNQMK

SEQ ID NO: 334795 - protein, 9 aa, Influenza virus
FSHYNQMKQ

SEQ ID NO: 334796 - protein, 9 aa, Influenza virus
SHYNQVTQP

SEQ ID NO: 334797 - protein, 9 aa, Influenza virus
NETFVNMTN

SEQ ID NO: 334798 - protein, 9 aa, Influenza virus
ETFVNITNV

SEQ ID NO: 334799 - protein, 9 aa, Influenza virus
TFVNITNVQ

SEQ ID NO: 334800 - protein, 9 aa, Influenza virus
FVNMTNVQN

SEQ ID NO: 334801 - protein, 9 aa, Influenza virus
VNVTNVQND

SEQ ID NO: 334802 - protein, 9 aa, Influenza virus
NVTNVQNDY

SEQ ID NO: 334803 - protein, 9 aa, Influenza virus
VTNVQNDYT

SEQ ID NO: 334804 - protein, 9 aa, Influenza virus
TNVQNDYTT

SEQ ID NO: 334805 - protein, 9 aa, Influenza virus
HVQNNYTTV

SEQ ID NO: 334806 - protein, 9 aa, Influenza virus
LCPIKGWAP

SEQ ID NO: 334807 - protein, 9 aa, Influenza virus
CPIKGWAPL

SEQ ID NO: 334808 - protein, 9 aa, Influenza virus
PIKGWAPLS

SEQ ID NO: 334809 - protein, 9 aa, Influenza virus
IKGWAPLSK

SEQ ID NO: 334810 - protein, 9 aa, Influenza virus
VFVIREPFV

SEQ ID NO: 334811 - protein, 9 aa, Influenza virus
FVIREPCIS

SEQ ID NO: 334812 - protein, 9 aa, Influenza virus
REPFVSCSI

SEQ ID NO: 334813 - protein, 9 aa, Influenza virus
ISCSIDECR

SEQ ID NO: 334814 - protein, 9 aa, Influenza virus
SCSIDECRT

SEQ ID NO: 334815 - protein, 9 aa, Influenza virus
CSIDECRTF

SEQ ID NO: 334816 - protein, 9 aa, Influenza virus
SIDECRTFF

SEQ ID NO: 334817 - protein, 9 aa, Influenza virus
IDECRTFFL

SEQ ID NO: 334818 - protein, 9 aa, Influenza virus
DECRTFFLT

SEQ ID NO: 334819 - protein, 9 aa, Influenza virus
FRTLMSCPV

SEQ ID NO: 334820 - protein, 9 aa, Influenza virus
RTLMSCPVG

SEQ ID NO: 334821 - protein, 9 aa, Influenza virus
TLMSCPVGV

SEQ ID NO: 334822 - protein, 9 aa, Influenza virus
LMSCPVGVA

SEQ ID NO: 334823 - protein, 9 aa, Influenza virus
MSCPVGVAP

SEQ ID NO: 334824 - protein, 9 aa, Influenza virus
SCPVGVAPS

SEQ ID NO: 334825 - protein, 9 aa, Influenza virus
CPVGVAPSP

SEQ ID NO: 334826 - protein, 9 aa, Influenza virus
PVGVAPSPS

SEQ ID NO: 334827 - protein, 9 aa, Influenza virus
VGVAPSPSN

SEQ ID NO: 334828 - protein, 9 aa, Influenza virus
SDGSGWLTL

SEQ ID NO: 334829 - protein, 9 aa, Influenza virus
DGSGWLTLG

SEQ ID NO: 334830 - protein, 9 aa, Influenza virus
GSGWLTLGI

SEQ ID NO: 334831 - protein, 9 aa, Influenza virus
SGWLTLGIT

SEQ ID NO: 334832 - protein, 9 aa, Influenza virus
TLGITGPDT

SEQ ID NO: 334833 - protein, 9 aa, Influenza virus
LGITGPDTT

SEQ ID NO: 334834 - protein, 9 aa, Influenza virus
GITGPDTTA

SEQ ID NO: 334835 - protein, 9 aa, Influenza virus
ITGPDTTAV

SEQ ID NO: 334836 - protein, 9 aa, Influenza virus
TGPDTTAVA

SEQ ID NO: 334837 - protein, 9 aa, Influenza virus
GPDTTAVAV

SEQ ID NO: 334838 - protein, 9 aa, Influenza virus
PDTTAVAVL

SEQ ID NO: 334839 - protein, 9 aa, Influenza virus
DTTAVAVLK

SEQ ID NO: 334840 - protein, 9 aa, Influenza virus
TTAVAVLKY

SEQ ID NO: 334841 - protein, 9 aa, Influenza virus
VAVLKYNGV

SEQ ID NO: 334842 - protein, 9 aa, Influenza virus
AVLKYNGVI

SEQ ID NO: 334843 - protein, 9 aa, Influenza virus
VLKYNGVIT

SEQ ID NO: 334844 - protein, 9 aa, Influenza virus
LKYNGVITD

SEQ ID NO: 334845 - protein, 9 aa, Influenza virus
YNGIITDTF

SEQ ID NO: 334846 - protein, 9 aa, Influenza virus
NGIITDTFK

SEQ ID NO: 334847 - protein, 9 aa, Influenza virus
GIITDTFKS

SEQ ID NO: 334848 - protein, 9 aa, Influenza virus
IITDTFKSW

SEQ ID NO: 334849 - protein, 9 aa, Influenza virus
QDEFCYTLV

SEQ ID NO: 334850 - protein, 9 aa, Influenza virus
DEFCYTLVT

SEQ ID NO: 334851 - protein, 9 aa, Influenza virus
EFCYTLVTD

SEQ ID NO: 334852 - protein, 9 aa, Influenza virus
FCYTLVTDG

SEQ ID NO: 334853 - protein, 9 aa, Influenza virus
CYTLVTDGP

SEQ ID NO: 334854 - protein, 9 aa, Influenza virus
YTLVTDGPS

SEQ ID NO: 334855 - protein, 9 aa, Influenza virus
TLITDGPSN

SEQ ID NO: 334856 - protein, 9 aa, Influenza virus
LITDGPSNA

SEQ ID NO: 334857 - protein, 9 aa, Influenza virus
ITDGPSNAQ

SEQ ID NO: 334858 - protein, 9 aa, Influenza virus
SDAQAFYKL

SEQ ID NO: 334859 - protein, 9 aa, Influenza virus
DAQAFYKLL

SEQ ID NO: 334860 - protein, 9 aa, Influenza virus
ILKIKKGKL

SEQ ID NO: 334861 - protein, 9 aa, Influenza virus
LKIRKGKIM

SEQ ID NO: 334862 - protein, 9 aa, Influenza virus
APGFHFEEC

SEQ ID NO: 334863 - protein, 9 aa, Influenza virus
PGFHFEECS

SEQ ID NO: 334864 - protein, 9 aa, Influenza virus
CSCYPSGES

SEQ ID NO: 334865 - protein, 9 aa, Influenza virus
DVECVCRDN

SEQ ID NO: 334866 - protein, 9 aa, Influenza virus
PWIRFNSDP

SEQ ID NO: 334867 - protein, 9 aa, Influenza virus
WVRFNSDLD

SEQ ID NO: 334868 - protein, 9 aa, Influenza virus
VRFNSDLDY

SEQ ID NO: 334869 - protein, 9 aa, Influenza virus
RFNSDPDYQ

SEQ ID NO: 334870 - protein, 9 aa, Influenza virus
FNSDLNYQI

SEQ ID NO: 334871 - protein, 9 aa, Influenza virus
NSDPDYQIG

SEQ ID NO: 334872 - protein, 9 aa, Influenza virus
SDLNYQIGY

SEQ ID NO: 334873 - protein, 9 aa, Influenza virus
NLDYQIGYV

SEQ ID NO: 334874 - protein, 9 aa, Influenza virus
PDYQIGYVC

SEQ ID NO: 334875 - protein, 9 aa, Influenza virus
QIGYICSGV

SEQ ID NO: 334876 - protein, 9 aa, Influenza virus
IGYICSGVF

SEQ ID NO: 334877 - protein, 9 aa, Influenza virus
GYICSGVFG

SEQ ID NO: 334878 - protein, 9 aa, Influenza virus
YICSGVFGD

SEQ ID NO: 334879 - protein, 9 aa, Influenza virus
ICSGVFGDN

SEQ ID NO: 334880 - protein, 9 aa, Influenza virus
GIFGDSPRP

SEQ ID NO: 334881 - protein, 9 aa, Influenza virus
FGDNPRPMD

SEQ ID NO: 334882 - protein, 9 aa, Influenza virus
GDNPRPMDS

SEQ ID NO: 334883 - protein, 9 aa, Influenza virus
PRPVDGIGS

SEQ ID NO: 334884 - protein, 9 aa, Influenza virus
RPVDGIGSC

SEQ ID NO: 334885 - protein, 9 aa, Influenza virus
SPINNGKGR

SEQ ID NO: 334886 - protein, 9 aa, Influenza virus
RGFEMVWDA

SEQ ID NO: 334887 - protein, 9 aa, Influenza virus
VWDANGWVT

SEQ ID NO: 334888 - protein, 9 aa, Influenza virus
NGWVTADKD

SEQ ID NO: 334889 - protein, 9 aa, Influenza virus
GWVTADKDS

SEQ ID NO: 334890 - protein, 9 aa, Influenza virus
WVSTDKSSN

SEQ ID NO: 334891 - protein, 9 aa, Influenza virus
VSTDKSSNG

SEQ ID NO: 334892 - protein, 9 aa, Influenza virus
TADKDSNGV

SEQ ID NO: 334893 - protein, 9 aa, Influenza virus
ADKDSNGVQ

SEQ ID NO: 334894 - protein, 9 aa, Influenza virus
IRGQPKERT

SEQ ID NO: 334895 - protein, 9 aa, Influenza virus
RGQPKERTI

SEQ ID NO: 334896 - protein, 9 aa, Influenza virus
GQPNERTIW

SEQ ID NO: 334897 - protein, 9 aa, Influenza virus
QPNERTIWT

SEQ ID NO: 334898 - protein, 9 aa, Influenza virus
PKERTIWTS

SEQ ID NO: 334899 - protein, 9 aa, Influenza virus
KERTIWTSG

SEQ ID NO: 334900 - protein, 9 aa, Influenza virus
ERTIWTSGS

SEQ ID NO: 334901 - protein, 9 aa, Influenza virus
RTIWTSGSS

SEQ ID NO: 334902 - protein, 9 aa, Influenza virus
IAFCGVNFD

SEQ ID NO: 334903 - protein, 9 aa, Influenza virus
AFCGVNFDL

SEQ ID NO: 334904 - protein, 9 aa, Influenza virus
CGVDSDTTS

SEQ ID NO: 334905 - protein, 9 aa, Influenza virus
GVDSDTTSW

SEQ ID NO: 334906 - protein, 9 aa, Influenza virus
SDTTCWSWP

SEQ ID NO: 334907 - protein, 9 aa, Influenza virus
DTTCWSWPD

SEQ ID NO: 334908 - protein, 9 aa, Influenza virus
TTCWSWPDG

SEQ ID NO: 334909 - protein, 9 aa, Influenza virus
TCWSWPDGA

SEQ ID NO: 334910 - protein, 9 aa, Influenza virus
GWPWPDGAL

SEQ ID NO: 334911 - protein, 9 aa, Influenza virus
QKIITIGSA

SEQ ID NO: 334912 - protein, 9 aa, Influenza virus
KIITIGSAS

SEQ ID NO: 334913 - protein, 9 aa, Influenza virus
IITIGSASL

SEQ ID NO: 334914 - protein, 9 aa, Influenza virus
TIGSASLGL

SEQ ID NO: 334915 - protein, 9 aa, Influenza virus
NILLHIVSI

SEQ ID NO: 334916 - protein, 9 aa, Influenza virus
ITEIYNETV

SEQ ID NO: 334917 - protein, 9 aa, Influenza virus
TEVYSETVR

SEQ ID NO: 334918 - protein, 9 aa, Influenza virus
EVYNETVRV

SEQ ID NO: 334919 - protein, 9 aa, Influenza virus
VYNETVRVE

SEQ ID NO: 334920 - protein, 9 aa, Influenza virus
YSETVRVET

SEQ ID NO: 334921 - protein, 9 aa, Influenza virus
TIPVNNTIY

SEQ ID NO: 334922 - protein, 9 aa, Influenza virus
EFFNNTEPL

SEQ ID NO: 334923 - protein, 9 aa, Influenza virus
LNNTEPLCD

SEQ ID NO: 334924 - protein, 9 aa, Influenza virus
NNTEPLCDV

SEQ ID NO: 334925 - protein, 9 aa, Influenza virus
NTEPLCDVS

SEQ ID NO: 334926 - protein, 9 aa, Influenza virus
TEPLCDVSG

SEQ ID NO: 334927 - protein, 9 aa, Influenza virus
EPLCDVSGF

SEQ ID NO: 334928 - protein, 9 aa, Influenza virus
PLCDVSGFA

SEQ ID NO: 334929 - protein, 9 aa, Influenza virus
LCDVSGFAI

SEQ ID NO: 334930 - protein, 9 aa, Influenza virus
SGFAIISKD

SEQ ID NO: 334931 - protein, 9 aa, Influenza virus
GFAIISKDN

SEQ ID NO: 334932 - protein, 9 aa, Influenza virus
FAIFSKDNG

SEQ ID NO: 334933 - protein, 9 aa, Influenza virus
AIISKDNGI

SEQ ID NO: 334934 - protein, 9 aa, Influenza virus
IISKDNGIR

SEQ ID NO: 334935 - protein, 9 aa, Influenza virus
FSKDNGIRI

SEQ ID NO: 334936 - protein, 9 aa, Influenza virus
IRVGSRGHV

SEQ ID NO: 334937 - protein, 9 aa, Influenza virus
RVGSRGHVF

SEQ ID NO: 334938 - protein, 9 aa, Influenza virus
VGSRGHVFV

SEQ ID NO: 334939 - protein, 9 aa, Influenza virus
IREPFVACS

SEQ ID NO: 334940 - protein, 9 aa, Influenza virus
REPFVACSP

SEQ ID NO: 334941 - protein, 9 aa, Influenza virus
EPFVSCGPS

SEQ ID NO: 334942 - protein, 9 aa, Influenza virus
PFVSCGPSE

SEQ ID NO: 334943 - protein, 9 aa, Influenza virus
FVSCGPSEC

SEQ ID NO: 334944 - protein, 9 aa, Influenza virus
VSCGPSECR

SEQ ID NO: 334945 - protein, 9 aa, Influenza virus
SCGPSECRT

SEQ ID NO: 334946 - protein, 9 aa, Influenza virus
CGPAECRTF

SEQ ID NO: 334947 - protein, 9 aa, Influenza virus
GPAECRTFF

SEQ ID NO: 334948 - protein, 9 aa, Influenza virus
PAECRTFFL

SEQ ID NO: 334949 - protein, 9 aa, Influenza virus
AECRTFFLT

SEQ ID NO: 334950 - protein, 9 aa, Influenza virus
MSVLLGSSP

SEQ ID NO: 334951 - protein, 9 aa, Influenza virus
SVPMGSSPN

SEQ ID NO: 334952 - protein, 9 aa, Influenza virus
VLLGSSPNA

SEQ ID NO: 334953 - protein, 9 aa, Influenza virus
PLGSSSNAY

SEQ ID NO: 334954 - protein, 9 aa, Influenza virus
SSSNAYQAK

SEQ ID NO: 334955 - protein, 9 aa, Influenza virus
SPNAYQAQF

SEQ ID NO: 334956 - protein, 9 aa, Influenza virus
PNAYQAQFE

SEQ ID NO: 334957 - protein, 9 aa, Influenza virus
AYQAQFESV

SEQ ID NO: 334958 - protein, 9 aa, Influenza virus
FESVEWSAT

SEQ ID NO: 334959 - protein, 9 aa, Influenza virus
ESIAWSATA

SEQ ID NO: 334960 - protein, 9 aa, Influenza virus
SIAWSATAC

SEQ ID NO: 334961 - protein, 9 aa, Influenza virus
IAWSATACH

SEQ ID NO: 334962 - protein, 9 aa, Influenza virus
ATACHDGKG

SEQ ID NO: 334963 - protein, 9 aa, Influenza virus
TACHDGKGW

SEQ ID NO: 334964 - protein, 9 aa, Influenza virus
ACHDGKEWM

SEQ ID NO: 334965 - protein, 9 aa, Influenza virus
GVSGADNDA

SEQ ID NO: 334966 - protein, 9 aa, Influenza virus
VSGADNDAY

SEQ ID NO: 334967 - protein, 9 aa, Influenza virus
SGADDEAYA

SEQ ID NO: 334968 - protein, 9 aa, Influenza virus
GADDEAYAV

SEQ ID NO: 334969 - protein, 9 aa, Influenza virus
ADDEAYAVI

SEQ ID NO: 334970 - protein, 9 aa, Influenza virus
YAVIHYGGI

SEQ ID NO: 334971 - protein, 9 aa, Influenza virus
AVIHYGGIP

SEQ ID NO: 334972 - protein, 9 aa, Influenza virus
VIHYGGIPT

SEQ ID NO: 334973 - protein, 9 aa, Influenza virus
IHYGGIPTD

SEQ ID NO: 334974 - protein, 9 aa, Influenza virus
HYGGIPTDV

SEQ ID NO: 334975 - protein, 9 aa, Influenza virus
YGGIPTDVV

SEQ ID NO: 334976 - protein, 9 aa, Influenza virus
GGIPTDVVR

SEQ ID NO: 334977 - protein, 9 aa, Influenza virus
GIPTDVVRS

SEQ ID NO: 334978 - protein, 9 aa, Influenza virus
IPTDVVRSW

SEQ ID NO: 334979 - protein, 9 aa, Influenza virus
PTDVIRSWR

SEQ ID NO: 334980 - protein, 9 aa, Influenza virus
TDVIRSWRK

SEQ ID NO: 334981 - protein, 9 aa, Influenza virus
DVIRSWRKQ

SEQ ID NO: 334982 - protein, 9 aa, Influenza virus
VIRSWRKQI

SEQ ID NO: 334983 - protein, 9 aa, Influenza virus
IRSWRKQIL

SEQ ID NO: 334984 - protein, 9 aa, Influenza virus
RSWRKKILR

SEQ ID NO: 334985 - protein, 9 aa, Influenza virus
SWRKKILRT

SEQ ID NO: 334986 - protein, 9 aa, Influenza virus
WRKKILRTQ

SEQ ID NO: 334987 - protein, 9 aa, Influenza virus
RKKILRTQE

SEQ ID NO: 334988 - protein, 9 aa, Influenza virus
RQILRTQES

SEQ ID NO: 334989 - protein, 9 aa, Influenza virus
TQESSCVCI

SEQ ID NO: 334990 - protein, 9 aa, Influenza virus
QESSCVCVK

SEQ ID NO: 334991 - protein, 9 aa, Influenza virus
ESSCVCVKG

SEQ ID NO: 334992 - protein, 9 aa, Influenza virus
VMTDGPANK

SEQ ID NO: 334993 - protein, 9 aa, Influenza virus
MTDGPANKQ

SEQ ID NO: 334994 - protein, 9 aa, Influenza virus
TDGPANKQA

SEQ ID NO: 334995 - protein, 9 aa, Influenza virus
DGPANKQAS

SEQ ID NO: 334996 - protein, 9 aa, Influenza virus
GPASNQASY

SEQ ID NO: 334997 - protein, 9 aa, Influenza virus
PASNQASYK

SEQ ID NO: 334998 - protein, 9 aa, Influenza virus
ASNQASYKI

SEQ ID NO: 334999 - protein, 9 aa, Influenza virus
NKQASYKIF

SEQ ID NO: 335000 - protein, 9 aa, Influenza virus
KQASYKIFK

SEQ ID NO: 335001 - protein, 9 aa, Influenza virus
ASYKIFKSY

SEQ ID NO: 335002 - protein, 9 aa, Influenza virus
EVLFQGGHI

SEQ ID NO: 335003 - protein, 9 aa, Influenza virus
VLFQGGHIE

SEQ ID NO: 335004 - protein, 9 aa, Influenza virus
SFQSGHIEE

SEQ ID NO: 335005 - protein, 9 aa, Influenza virus
EECSCYPNS

SEQ ID NO: 335006 - protein, 9 aa, Influenza virus
ECSCYPNSG

SEQ ID NO: 335007 - protein, 9 aa, Influenza virus
CSCYPNSGK

SEQ ID NO: 335008 - protein, 9 aa, Influenza virus
SCYPNSGKV

SEQ ID NO: 335009 - protein, 9 aa, Influenza virus
CYPNSGKVE

SEQ ID NO: 335010 - protein, 9 aa, Influenza virus
YPNSGKVEC

SEQ ID NO: 335011 - protein, 9 aa, Influenza virus
PNSGKVECV

SEQ ID NO: 335012 - protein, 9 aa, Influenza virus
NSGKVECVC

SEQ ID NO: 335013 - protein, 9 aa, Influenza virus
SGKVECVCR

SEQ ID NO: 335014 - protein, 9 aa, Influenza virus
GIVECVCRD

SEQ ID NO: 335015 - protein, 9 aa, Influenza virus
YKVGYLCAG

SEQ ID NO: 335016 - protein, 9 aa, Influenza virus
DVGYLCAGI

SEQ ID NO: 335017 - protein, 9 aa, Influenza virus
TDTPRIQDS

SEQ ID NO: 335018 - protein, 9 aa, Influenza virus
AVGGSGTDN

SEQ ID NO: 335019 - protein, 9 aa, Influenza virus
VGGSGTDNY

SEQ ID NO: 335020 - protein, 9 aa, Influenza virus
GFAFKQGNS

SEQ ID NO: 335021 - protein, 9 aa, Influenza virus
FAFKQGNSV

SEQ ID NO: 335022 - protein, 9 aa, Influenza virus
AFKQGNSVW

SEQ ID NO: 335023 - protein, 9 aa, Influenza virus
FRQGNNVWA

SEQ ID NO: 335024 - protein, 9 aa, Influenza virus
KQGNSVWAG

SEQ ID NO: 335025 - protein, 9 aa, Influenza virus
TSVWAGRTI

SEQ ID NO: 335026 - protein, 9 aa, Influenza virus
SVWAGRTMS

SEQ ID NO: 335027 - protein, 9 aa, Influenza virus
SVSSRSGFE

SEQ ID NO: 335028 - protein, 9 aa, Influenza virus
SSRNGFEIL

SEQ ID NO: 335029 - protein, 9 aa, Influenza virus
SRSGFEVLF

SEQ ID NO: 335030 - protein, 9 aa, Influenza virus
RSGFEVLFI

SEQ ID NO: 335031 - protein, 9 aa, Influenza virus
SGFEVLFIE

SEQ ID NO: 335032 - protein, 9 aa, Influenza virus
GFEILLIEE

SEQ ID NO: 335033 - protein, 9 aa, Influenza virus
FEILLIEEG

SEQ ID NO: 335034 - protein, 9 aa, Influenza virus
EILLIEEGW

SEQ ID NO: 335035 - protein, 9 aa, Influenza virus
EILNNKNWS

SEQ ID NO: 335036 - protein, 9 aa, Influenza virus
VLDNKNWSG

SEQ ID NO: 335037 - protein, 9 aa, Influenza virus
LNNKHWSGY

SEQ ID NO: 335038 - protein, 9 aa, Influenza virus
NNRNWSGYS

SEQ ID NO: 335039 - protein, 9 aa, Influenza virus
NKHWSGYSG

SEQ ID NO: 335040 - protein, 9 aa, Influenza virus
MNWSGYSGS

SEQ ID NO: 335041 - protein, 9 aa, Influenza virus
SGYSGAFTV

SEQ ID NO: 335042 - protein, 9 aa, Influenza virus
GYSGAFTVP

SEQ ID NO: 335043 - protein, 9 aa, Influenza virus
YSGSFTIPT

SEQ ID NO: 335044 - protein, 9 aa, Influenza virus
LEMIRGKPK

SEQ ID NO: 335045 - protein, 9 aa, Influenza virus
EMIRGKPKE

SEQ ID NO: 335046 - protein, 9 aa, Influenza virus
MIRGKPEEG

SEQ ID NO: 335047 - protein, 9 aa, Influenza virus
PKERTSIWT

SEQ ID NO: 335048 - protein, 9 aa, Influenza virus
KERTSIWTS

SEQ ID NO: 335049 - protein, 9 aa, Influenza virus
ERPSIWTSS

SEQ ID NO: 335050 - protein, 9 aa, Influenza virus
RNSIWTSSS

SEQ ID NO: 335051 - protein, 9 aa, Influenza virus
CGVSSEVPE

SEQ ID NO: 335052 - protein, 9 aa, Influenza virus
GVSSEVPEW

SEQ ID NO: 335053 - protein, 9 aa, Influenza virus
VSSEAPGWS

SEQ ID NO: 335054 - protein, 9 aa, Influenza virus
SSEAPGWSW

SEQ ID NO: 335055 - protein, 9 aa, Influenza virus
SEAPGWSWD

SEQ ID NO: 335056 - protein, 9 aa, Influenza virus
EVPGWSWGD

SEQ ID NO: 335057 - protein, 9 aa, Influenza virus
VPEWSWDDG

SEQ ID NO: 335058 - protein, 9 aa, Influenza virus
DDGAILPLT

SEQ ID NO: 335059 - protein, 9 aa, Influenza virus
MNPNQKIMC

SEQ ID NO: 335060 - protein, 9 aa, Influenza virus
NPNQKIMCI

SEQ ID NO: 335061 - protein, 9 aa, Influenza virus
PNQKIMCIS

SEQ ID NO: 335062 - protein, 9 aa, Influenza virus
NQKIMCISA

SEQ ID NO: 335063 - protein, 9 aa, Influenza virus
CISTTGMTL

SEQ ID NO: 335064 - protein, 9 aa, Influenza virus
ISTTGMTLS

SEQ ID NO: 335065 - protein, 9 aa, Influenza virus
STTGMTLSV

SEQ ID NO: 335066 - protein, 9 aa, Influenza virus
TTGMTLSVV

SEQ ID NO: 335067 - protein, 9 aa, Influenza virus
TGMALSVVS

SEQ ID NO: 335068 - protein, 9 aa, Influenza virus
GMILSVVSL

SEQ ID NO: 335069 - protein, 9 aa, Influenza virus
MALSVVSLL

SEQ ID NO: 335070 - protein, 9 aa, Influenza virus
LSVVNLLIG

SEQ ID NO: 335071 - protein, 9 aa, Influenza virus
GVANLGLNI

SEQ ID NO: 335072 - protein, 9 aa, Influenza virus
VANLGLNIG

SEQ ID NO: 335073 - protein, 9 aa, Influenza virus
ANLGLNVGL

SEQ ID NO: 335074 - protein, 9 aa, Influenza virus
NLGLNVGLH

SEQ ID NO: 335075 - protein, 9 aa, Influenza virus
KPLCAVNSW

SEQ ID NO: 335076 - protein, 9 aa, Influenza virus
PLCAVNSWH

SEQ ID NO: 335077 - protein, 9 aa, Influenza virus
LCAVNSWHI

SEQ ID NO: 335078 - protein, 9 aa, Influenza virus
CAVNSWHIL

SEQ ID NO: 335079 - protein, 9 aa, Influenza virus
AVNSWHILS

SEQ ID NO: 335080 - protein, 9 aa, Influenza virus
VNSWHIFSK

SEQ ID NO: 335081 - protein, 9 aa, Influenza virus
NSWHIFSKD

SEQ ID NO: 335082 - protein, 9 aa, Influenza virus
HILSKDNAV

SEQ ID NO: 335083 - protein, 9 aa, Influenza virus
DNAIRIGEE

SEQ ID NO: 335084 - protein, 9 aa, Influenza virus
NAIRIGEEA

SEQ ID NO: 335085 - protein, 9 aa, Influenza virus
AIRIGEEAH

SEQ ID NO: 335086 - protein, 9 aa, Influenza virus
RIGEEAHIL

SEQ ID NO: 335087 - protein, 9 aa, Influenza virus
EAHILVTRE

SEQ ID NO: 335088 - protein, 9 aa, Influenza virus
ECKMFALSQ

SEQ ID NO: 335089 - protein, 9 aa, Influenza virus
SQGTTLKGR

SEQ ID NO: 335090 - protein, 9 aa, Influenza virus
QGTTLKGRH

SEQ ID NO: 335091 - protein, 9 aa, Influenza virus
GTTLKGRHA

SEQ ID NO: 335092 - protein, 9 aa, Influenza virus
TTLKGRHAN

SEQ ID NO: 335093 - protein, 9 aa, Influenza virus
TLKGRHANG

SEQ ID NO: 335094 - protein, 9 aa, Influenza virus
LKGRHANGT

SEQ ID NO: 335095 - protein, 9 aa, Influenza virus
RGRHANGTM

SEQ ID NO: 335096 - protein, 9 aa, Influenza virus
GRHANGTMH

SEQ ID NO: 335097 - protein, 9 aa, Influenza virus
RHANGTMHD

SEQ ID NO: 335098 - protein, 9 aa, Influenza virus
HANGTINDR

SEQ ID NO: 335099 - protein, 9 aa, Influenza virus
ANGTINDRS

SEQ ID NO: 335100 - protein, 9 aa, Influenza virus
NGTMHDRSP

SEQ ID NO: 335101 - protein, 9 aa, Influenza virus
GTIHDRSPY

SEQ ID NO: 335102 - protein, 9 aa, Influenza virus
TIHDRSPYR

SEQ ID NO: 335103 - protein, 9 aa, Influenza virus
IHDRSPYRA

SEQ ID NO: 335104 - protein, 9 aa, Influenza virus
HDRSPYRAL

SEQ ID NO: 335105 - protein, 9 aa, Influenza virus
DRSQFRALI

SEQ ID NO: 335106 - protein, 9 aa, Influenza virus
RSQFRALIS

SEQ ID NO: 335107 - protein, 9 aa, Influenza virus
SQFRALISW

SEQ ID NO: 335108 - protein, 9 aa, Influenza virus
QFRALISWE

SEQ ID NO: 335109 - protein, 9 aa, Influenza virus
YRALISWEM

SEQ ID NO: 335110 - protein, 9 aa, Influenza virus
RALISWGMG

SEQ ID NO: 335111 - protein, 9 aa, Influenza virus
ALISWGMGQ

SEQ ID NO: 335112 - protein, 9 aa, Influenza virus
LISWGMGQA

SEQ ID NO: 335113 - protein, 9 aa, Influenza virus
ISWGMGQAP

SEQ ID NO: 335114 - protein, 9 aa, Influenza virus
SWEMGLAPS

SEQ ID NO: 335115 - protein, 9 aa, Influenza virus
WEMGLAPSP

SEQ ID NO: 335116 - protein, 9 aa, Influenza virus
EMGLAPSPY

SEQ ID NO: 335117 - protein, 9 aa, Influenza virus
MGLAPSPYN

SEQ ID NO: 335118 - protein, 9 aa, Influenza virus
IECIGWSST

SEQ ID NO: 335119 - protein, 9 aa, Influenza virus
SSTSCHDGV

SEQ ID NO: 335120 - protein, 9 aa, Influenza virus
STSCHDGVS

SEQ ID NO: 335121 - protein, 9 aa, Influenza virus
TSCHDGVSR

SEQ ID NO: 335122 - protein, 9 aa, Influenza virus
SCHDGVSRM

SEQ ID NO: 335123 - protein, 9 aa, Influenza virus
CHDGVSRMS

SEQ ID NO: 335124 - protein, 9 aa, Influenza virus
SRMSVCMSG

SEQ ID NO: 335125 - protein, 9 aa, Influenza virus
RMSVCMSGP

SEQ ID NO: 335126 - protein, 9 aa, Influenza virus
MSVCMSGPN

SEQ ID NO: 335127 - protein, 9 aa, Influenza virus
SICMSGPND

SEQ ID NO: 335128 - protein, 9 aa, Influenza virus
ICMSGPNDN

SEQ ID NO: 335129 - protein, 9 aa, Influenza virus
CMSGPNDNA

SEQ ID NO: 335130 - protein, 9 aa, Influenza virus
MSGPNDNAS

SEQ ID NO: 335131 - protein, 9 aa, Influenza virus
PNNNASAVI

SEQ ID NO: 335132 - protein, 9 aa, Influenza virus
NNNASAVIW

SEQ ID NO: 335133 - protein, 9 aa, Influenza virus
NNASAVIWY

SEQ ID NO: 335134 - protein, 9 aa, Influenza virus
TEIPSWEGN

SEQ ID NO: 335135 - protein, 9 aa, Influenza virus
EIPSWEGNI

SEQ ID NO: 335136 - protein, 9 aa, Influenza virus
IPSWEGNIL

SEQ ID NO: 335137 - protein, 9 aa, Influenza virus
PSWEGNILR

SEQ ID NO: 335138 - protein, 9 aa, Influenza virus
SECVCHKGV

SEQ ID NO: 335139 - protein, 9 aa, Influenza virus
ECVCHKGVC

SEQ ID NO: 335140 - protein, 9 aa, Influenza virus
CVCHKGVCP

SEQ ID NO: 335141 - protein, 9 aa, Influenza virus
VCHKGVCPV

SEQ ID NO: 335142 - protein, 9 aa, Influenza virus
CHKGVCPVV

SEQ ID NO: 335143 - protein, 9 aa, Influenza virus
VVMTDGPAD

SEQ ID NO: 335144 - protein, 9 aa, Influenza virus
TDGPASNKA

SEQ ID NO: 335145 - protein, 9 aa, Influenza virus
GSAEHIEEC

SEQ ID NO: 335146 - protein, 9 aa, Influenza virus
SAEHIEECS

SEQ ID NO: 335147 - protein, 9 aa, Influenza virus
IKCVCRDNW

SEQ ID NO: 335148 - protein, 9 aa, Influenza virus
KCICRDNWR

SEQ ID NO: 335149 - protein, 9 aa, Influenza virus
CICRDNWRG

SEQ ID NO: 335150 - protein, 9 aa, Influenza virus
ICRDNWRGA

SEQ ID NO: 335151 - protein, 9 aa, Influenza virus
NWRGANRPV

SEQ ID NO: 335152 - protein, 9 aa, Influenza virus
WRGANRPVI

SEQ ID NO: 335153 - protein, 9 aa, Influenza virus
KGANRPVII

SEQ ID NO: 335154 - protein, 9 aa, Influenza virus
GANRPIITI

SEQ ID NO: 335155 - protein, 9 aa, Influenza virus
ANRPVIIID

SEQ ID NO: 335156 - protein, 9 aa, Influenza virus
MTHTSRYLC

SEQ ID NO: 335157 - protein, 9 aa, Influenza virus
THTSRYLCS

SEQ ID NO: 335158 - protein, 9 aa, Influenza virus
YLCSRILTD

SEQ ID NO: 335159 - protein, 9 aa, Influenza virus
LCSRILTDT

SEQ ID NO: 335160 - protein, 9 aa, Influenza virus
CSRILTDTS

SEQ ID NO: 335161 - protein, 9 aa, Influenza virus
SRILTDTSR

SEQ ID NO: 335162 - protein, 9 aa, Influenza virus
RILTDTSRP

SEQ ID NO: 335163 - protein, 9 aa, Influenza virus
LTDTSRPTD

SEQ ID NO: 335164 - protein, 9 aa, Influenza virus
TDTSRPTDP

SEQ ID NO: 335165 - protein, 9 aa, Influenza virus
GGNPDPGVK

SEQ ID NO: 335166 - protein, 9 aa, Influenza virus
GTPDPGVKG

SEQ ID NO: 335167 - protein, 9 aa, Influenza virus
TPDPGVKGF

SEQ ID NO: 335168 - protein, 9 aa, Influenza virus
GIKGFAFLD

SEQ ID NO: 335169 - protein, 9 aa, Influenza virus
VKGFAFLDE

SEQ ID NO: 335170 - protein, 9 aa, Influenza virus
LGRTISKDL

SEQ ID NO: 335171 - protein, 9 aa, Influenza virus
GRTISKDLR

SEQ ID NO: 335172 - protein, 9 aa, Influenza virus
RTISKDLRS

SEQ ID NO: 335173 - protein, 9 aa, Influenza virus
TISKDLRSG

SEQ ID NO: 335174 - protein, 9 aa, Influenza virus
ISKDLRSGY

SEQ ID NO: 335175 - protein, 9 aa, Influenza virus
SKDTRSGYE

SEQ ID NO: 335176 - protein, 9 aa, Influenza virus
KDSRSGYEI

SEQ ID NO: 335177 - protein, 9 aa, Influenza virus
DSRSGYEIL

SEQ ID NO: 335178 - protein, 9 aa, Influenza virus
SRSGYEILK

SEQ ID NO: 335179 - protein, 9 aa, Influenza virus
RSGYEILKV

SEQ ID NO: 335180 - protein, 9 aa, Influenza virus
SGYEILKVP

SEQ ID NO: 335181 - protein, 9 aa, Influenza virus
GYEILKVPN

SEQ ID NO: 335182 - protein, 9 aa, Influenza virus
YEILKVPNA

SEQ ID NO: 335183 - protein, 9 aa, Influenza virus
EILKVPNAE

SEQ ID NO: 335184 - protein, 9 aa, Influenza virus
IINNQNWSG

SEQ ID NO: 335185 - protein, 9 aa, Influenza virus
INNQNWSGY

SEQ ID NO: 335186 - protein, 9 aa, Influenza virus
DNQNWSGYS

SEQ ID NO: 335187 - protein, 9 aa, Influenza virus
QDWSGYSGA

SEQ ID NO: 335188 - protein, 9 aa, Influenza virus
DWSGYSGAF

SEQ ID NO: 335189 - protein, 9 aa, Influenza virus
WSGYSGAFM

SEQ ID NO: 335190 - protein, 9 aa, Influenza virus
SGYSGAFMD

SEQ ID NO: 335191 - protein, 9 aa, Influenza virus
GYSGAFMDY

SEQ ID NO: 335192 - protein, 9 aa, Influenza virus
YSGAFMDYW

SEQ ID NO: 335193 - protein, 9 aa, Influenza virus
VELIRGRPR

SEQ ID NO: 335194 - protein, 9 aa, Influenza virus
ELIRGRPRE

SEQ ID NO: 335195 - protein, 9 aa, Influenza virus
LIRGMPKES

SEQ ID NO: 335196 - protein, 9 aa, Influenza virus
ESNVLWTSN

SEQ ID NO: 335197 - protein, 9 aa, Influenza virus
VLWTSNSVV

SEQ ID NO: 335198 - protein, 9 aa, Influenza virus
LWTSNSMVA

SEQ ID NO: 335199 - protein, 9 aa, Influenza virus
IVALCGSKK

SEQ ID NO: 335200 - protein, 9 aa, Influenza virus
VALCGSKEQ

SEQ ID NO: 335201 - protein, 9 aa, Influenza virus
ALCGSKEQL

SEQ ID NO: 335202 - protein, 9 aa, Influenza virus
LCGSKEQLG

SEQ ID NO: 335203 - protein, 9 aa, Influenza virus
CGSKEQLGS

SEQ ID NO: 335204 - protein, 9 aa, Influenza virus
GSKEQLGSW

SEQ ID NO: 335205 - protein, 9 aa, Influenza virus
SKEQLGSWS

SEQ ID NO: 335206 - protein, 9 aa, Influenza virus
KEQLGSWSW

SEQ ID NO: 335207 - protein, 9 aa, Influenza virus
KRLGSWSWH

SEQ ID NO: 335208 - protein, 9 aa, Influenza virus
DGAEIIYFE

SEQ ID NO: 335209 - protein, 9 aa, Influenza virus
MNPSQKLFA

SEQ ID NO: 335210 - protein, 9 aa, Influenza virus
NPNQKLFTL

SEQ ID NO: 335211 - protein, 9 aa, Influenza virus
PNQKLFTLS

SEQ ID NO: 335212 - protein, 9 aa, Influenza virus
NQKLFTLSG

SEQ ID NO: 335213 - protein, 9 aa, Influenza virus
QKLFTLSGV

SEQ ID NO: 335214 - protein, 9 aa, Influenza virus
KLFTLSGVA

SEQ ID NO: 335215 - protein, 9 aa, Influenza virus
LFTLSGVAI

SEQ ID NO: 335216 - protein, 9 aa, Influenza virus
INLLIGISN

SEQ ID NO: 335217 - protein, 9 aa, Influenza virus
NLLIGISNM

SEQ ID NO: 335218 - protein, 9 aa, Influenza virus
LLIGISNMS

SEQ ID NO: 335219 - protein, 9 aa, Influenza virus
LIGISNMSL

SEQ ID NO: 335220 - protein, 9 aa, Influenza virus
IGVSNVGLN

SEQ ID NO: 335221 - protein, 9 aa, Influenza virus
SNVVLNVSL

SEQ ID NO: 335222 - protein, 9 aa, Influenza virus
NVVLNVSLH

SEQ ID NO: 335223 - protein, 9 aa, Influenza virus
VVLNVSLHL

SEQ ID NO: 335224 - protein, 9 aa, Influenza virus
VLNVSLHLK

SEQ ID NO: 335225 - protein, 9 aa, Influenza virus
KNTYVNNTT

SEQ ID NO: 335226 - protein, 9 aa, Influenza virus
NTYINNTTI

SEQ ID NO: 335227 - protein, 9 aa, Influenza virus
TYINNTTII

SEQ ID NO: 335228 - protein, 9 aa, Influenza virus
YLVLNKSLC

SEQ ID NO: 335229 - protein, 9 aa, Influenza virus
LVLNKSLCK

SEQ ID NO: 335230 - protein, 9 aa, Influenza virus
VLNKSLCKV

SEQ ID NO: 335231 - protein, 9 aa, Influenza virus
GWVAVAKDN

SEQ ID NO: 335232 - protein, 9 aa, Influenza virus
WVAVAKDNA

SEQ ID NO: 335233 - protein, 9 aa, Influenza virus
VVIAKDNAI

SEQ ID NO: 335234 - protein, 9 aa, Influenza virus
VIAKDNAIR

SEQ ID NO: 335235 - protein, 9 aa, Influenza virus
IAKDNAIRF

SEQ ID NO: 335236 - protein, 9 aa, Influenza virus
IRFGESEQV

SEQ ID NO: 335237 - protein, 9 aa, Influenza virus
RFGEGEQII

SEQ ID NO: 335238 - protein, 9 aa, Influenza virus
FGEGEQIIV

SEQ ID NO: 335239 - protein, 9 aa, Influenza virus
GEGEQIIVT

SEQ ID NO: 335240 - protein, 9 aa, Influenza virus
EGEQIIVTR

SEQ ID NO: 335241 - protein, 9 aa, Influenza virus
GEQIIVTRE

SEQ ID NO: 335242 - protein, 9 aa, Influenza virus
EPYVSCDPS

SEQ ID NO: 335243 - protein, 9 aa, Influenza virus
SCKMYALHQ

SEQ ID NO: 335244 - protein, 9 aa, Influenza virus
TIRNRHSNG

SEQ ID NO: 335245 - protein, 9 aa, Influenza virus
IRNRHSNGT

SEQ ID NO: 335246 - protein, 9 aa, Influenza virus
RNKHSNGTT

SEQ ID NO: 335247 - protein, 9 aa, Influenza virus
NKHSNGTTH

SEQ ID NO: 335248 - protein, 9 aa, Influenza virus
KHSNGTTHD

SEQ ID NO: 335249 - protein, 9 aa, Influenza virus
HSNGTTHDR

SEQ ID NO: 335250 - protein, 9 aa, Influenza virus
SNGTTHDRT

SEQ ID NO: 335251 - protein, 9 aa, Influenza virus
TIHDRTTFR

SEQ ID NO: 335252 - protein, 9 aa, Influenza virus
IHDRTTFRG

SEQ ID NO: 335253 - protein, 9 aa, Influenza virus
HDRAAFRGL

SEQ ID NO: 335254 - protein, 9 aa, Influenza virus
DRTTFRGLL

SEQ ID NO: 335255 - protein, 9 aa, Influenza virus
RTTFRGLIS

SEQ ID NO: 335256 - protein, 9 aa, Influenza virus
TTFRGLIST

SEQ ID NO: 335257 - protein, 9 aa, Influenza virus
AFRGLMSTP

SEQ ID NO: 335258 - protein, 9 aa, Influenza virus
FRGLMSTPL

SEQ ID NO: 335259 - protein, 9 aa, Influenza virus
RGLISTHLG

SEQ ID NO: 335260 - protein, 9 aa, Influenza virus
SNSDFICVG

SEQ ID NO: 335261 - protein, 9 aa, Influenza virus
NSDFICVGW

SEQ ID NO: 335262 - protein, 9 aa, Influenza virus
SDFICVGWS

SEQ ID NO: 335263 - protein, 9 aa, Influenza virus
DFICVGWSS

SEQ ID NO: 335264 - protein, 9 aa, Influenza virus
FICVGWSST

SEQ ID NO: 335265 - protein, 9 aa, Influenza virus
ICVGWSSTS

SEQ ID NO: 335266 - protein, 9 aa, Influenza virus
SSTSCHDGV

SEQ ID NO: 335267 - protein, 9 aa, Influenza virus
CHDGVNRMT

SEQ ID NO: 335268 - protein, 9 aa, Influenza virus
HDGVNRMTI

SEQ ID NO: 335269 - protein, 9 aa, Influenza virus
DGVSRMTIC

SEQ ID NO: 335270 - protein, 9 aa, Influenza virus
ARMTICIQG

SEQ ID NO: 335271 - protein, 9 aa, Influenza virus
RMTICVQGD

SEQ ID NO: 335272 - protein, 9 aa, Influenza virus
MTICVQGDN

SEQ ID NO: 335273 - protein, 9 aa, Influenza virus
QGDNENATA

SEQ ID NO: 335274 - protein, 9 aa, Influenza virus
GDNENATAT

SEQ ID NO: 335275 - protein, 9 aa, Influenza virus
DNENATATV

SEQ ID NO: 335276 - protein, 9 aa, Influenza virus
NENATATVY

SEQ ID NO: 335277 - protein, 9 aa, Influenza virus
ENATATVYY

SEQ ID NO: 335278 - protein, 9 aa, Influenza virus
ATATVYYNK

SEQ ID NO: 335279 - protein, 9 aa, Influenza virus
TATVYYNKR

SEQ ID NO: 335280 - protein, 9 aa, Influenza virus
ATVYYNKRL

SEQ ID NO: 335281 - protein, 9 aa, Influenza virus
TVYYNKRLT

SEQ ID NO: 335282 - protein, 9 aa, Influenza virus
VYYNKRLTT

SEQ ID NO: 335283 - protein, 9 aa, Influenza virus
YYNKRLTTT

SEQ ID NO: 335284 - protein, 9 aa, Influenza virus
YNKRLTTTI

SEQ ID NO: 335285 - protein, 9 aa, Influenza virus
GRLTTTIKT

SEQ ID NO: 335286 - protein, 9 aa, Influenza virus
RPTTTIKTW

SEQ ID NO: 335287 - protein, 9 aa, Influenza virus
LTTTIRTWA

SEQ ID NO: 335288 - protein, 9 aa, Influenza virus
TTTIKTWAK

SEQ ID NO: 335289 - protein, 9 aa, Influenza virus
TTIKTWAKN

SEQ ID NO: 335290 - protein, 9 aa, Influenza virus
TIKTWAKNI

SEQ ID NO: 335291 - protein, 9 aa, Influenza virus
IKTWAKNIL

SEQ ID NO: 335292 - protein, 9 aa, Influenza virus
KTWAKNILR

SEQ ID NO: 335293 - protein, 9 aa, Influenza virus
TWAKNILRT

SEQ ID NO: 335294 - protein, 9 aa, Influenza virus
WAKNILRTQ

SEQ ID NO: 335295 - protein, 9 aa, Influenza virus
AKNILRTQE

SEQ ID NO: 335296 - protein, 9 aa, Influenza virus
KNILRTQES

SEQ ID NO: 335297 - protein, 9 aa, Influenza virus
ESECVRHNG

SEQ ID NO: 335298 - protein, 9 aa, Influenza virus
SECVCHDGT

SEQ ID NO: 335299 - protein, 9 aa, Influenza virus
ECVCHDGTC

SEQ ID NO: 335300 - protein, 9 aa, Influenza virus
CVCHNSTCV

SEQ ID NO: 335301 - protein, 9 aa, Influenza virus
GTCVVVMTD

SEQ ID NO: 335302 - protein, 9 aa, Influenza virus
TCVVVMTDG

SEQ ID NO: 335303 - protein, 9 aa, Influenza virus
MTDGPASSQ

SEQ ID NO: 335304 - protein, 9 aa, Influenza virus
TDGPASSQA

SEQ ID NO: 335305 - protein, 9 aa, Influenza virus
LRGSARHIE

SEQ ID NO: 335306 - protein, 9 aa, Influenza virus
RGSARHIEE

SEQ ID NO: 335307 - protein, 9 aa, Influenza virus
GSARHVEEC

SEQ ID NO: 335308 - protein, 9 aa, Influenza virus
SAMHIEECS

SEQ ID NO: 335309 - protein, 9 aa, Influenza virus
ARHIEECPC

SEQ ID NO: 335310 - protein, 9 aa, Influenza virus
RHIEECPCY

SEQ ID NO: 335311 - protein, 9 aa, Influenza virus
EECSCYGHD

SEQ ID NO: 335312 - protein, 9 aa, Influenza virus
KATCVCRDN

SEQ ID NO: 335313 - protein, 9 aa, Influenza virus
ITCVCRDNW

SEQ ID NO: 335314 - protein, 9 aa, Influenza virus
TCICRDNWQ

SEQ ID NO: 335315 - protein, 9 aa, Influenza virus
QGANRPVIK

SEQ ID NO: 335316 - protein, 9 aa, Influenza virus
GANRPVIKI

SEQ ID NO: 335317 - protein, 9 aa, Influenza virus
ANRPVIKID

SEQ ID NO: 335318 - protein, 9 aa, Influenza virus
NRPVIKIDM

SEQ ID NO: 335319 - protein, 9 aa, Influenza virus
HTSRYICTG

SEQ ID NO: 335320 - protein, 9 aa, Influenza virus
VLTDTSRPK

SEQ ID NO: 335321 - protein, 9 aa, Influenza virus
LTDTSRPKD

SEQ ID NO: 335322 - protein, 9 aa, Influenza virus
TDTSRPKDK

SEQ ID NO: 335323 - protein, 9 aa, Influenza virus
GECFNPITG

SEQ ID NO: 335324 - protein, 9 aa, Influenza virus
ECFNPITGS

SEQ ID NO: 335325 - protein, 9 aa, Influenza virus
CFNPITGSP

SEQ ID NO: 335326 - protein, 9 aa, Influenza virus
FNPITGSPG

SEQ ID NO: 335327 - protein, 9 aa, Influenza virus
NPITGSPGV

SEQ ID NO: 335328 - protein, 9 aa, Influenza virus
PITGSPGVP

SEQ ID NO: 335329 - protein, 9 aa, Influenza virus
ITGSPGVPG

SEQ ID NO: 335330 - protein, 9 aa, Influenza virus
VPGVKGFGF

SEQ ID NO: 335331 - protein, 9 aa, Influenza virus
GIKGFGFLN

SEQ ID NO: 335332 - protein, 9 aa, Influenza virus
SNTWLGRTI

SEQ ID NO: 335333 - protein, 9 aa, Influenza virus
WLGRTISTR

SEQ ID NO: 335334 - protein, 9 aa, Influenza virus
LGRTISPRL

SEQ ID NO: 335335 - protein, 9 aa, Influenza virus
GRTISPKLR

SEQ ID NO: 335336 - protein, 9 aa, Influenza virus
TISPKLRSG

SEQ ID NO: 335337 - protein, 9 aa, Influenza virus
ISPRLRSGF

SEQ ID NO: 335338 - protein, 9 aa, Influenza virus
SPRLRSGFE

SEQ ID NO: 335339 - protein, 9 aa, Influenza virus
PKLRSGFEM

SEQ ID NO: 335340 - protein, 9 aa, Influenza virus
RLRSGFEML

SEQ ID NO: 335341 - protein, 9 aa, Influenza virus
SRSGFEMLR

SEQ ID NO: 335342 - protein, 9 aa, Influenza virus
RSGFEVLKV

SEQ ID NO: 335343 - protein, 9 aa, Influenza virus
SGFEVLKVP

SEQ ID NO: 335344 - protein, 9 aa, Influenza virus
GFEMLKIHN

SEQ ID NO: 335345 - protein, 9 aa, Influenza virus
FEMLRIPNA

SEQ ID NO: 335346 - protein, 9 aa, Influenza virus
EMLKVPNAE

SEQ ID NO: 335347 - protein, 9 aa, Influenza virus
LKIPNAGID

SEQ ID NO: 335348 - protein, 9 aa, Influenza virus
KIPNAGIDP

SEQ ID NO: 335349 - protein, 9 aa, Influenza virus
NRSGYSGSF

SEQ ID NO: 335350 - protein, 9 aa, Influenza virus
GSFIDYWDD

SEQ ID NO: 335351 - protein, 9 aa, Influenza virus
SVCYNPCFY

SEQ ID NO: 335352 - protein, 9 aa, Influenza virus
ACYNPCFYV

SEQ ID NO: 335353 - protein, 9 aa, Influenza virus
RPEEVKYVW

SEQ ID NO: 335354 - protein, 9 aa, Influenza virus
PEEVKYVWW

SEQ ID NO: 335355 - protein, 9 aa, Influenza virus
EEAKYVWWA

SEQ ID NO: 335356 - protein, 9 aa, Influenza virus
EAKYVWWAS

SEQ ID NO: 335357 - protein, 9 aa, Influenza virus
AKYVWWASN

SEQ ID NO: 335358 - protein, 9 aa, Influenza virus
KYVWWASNS

SEQ ID NO: 335359 - protein, 9 aa, Influenza virus
YVWWASNSL

SEQ ID NO: 335360 - protein, 9 aa, Influenza virus
VEWTSNSLI

SEQ ID NO: 335361 - protein, 9 aa, Influenza virus
EWTSNSLIA

SEQ ID NO: 335362 - protein, 9 aa, Influenza virus
WASNSLIAL

SEQ ID NO: 335363 - protein, 9 aa, Influenza virus
ASNSLIALC

SEQ ID NO: 335364 - protein, 9 aa, Influenza virus
LIALCGSPF

SEQ ID NO: 335365 - protein, 9 aa, Influenza virus
PVGPGSFPD

SEQ ID NO: 335366 - protein, 9 aa, Influenza virus
VGSGSFPNG

SEQ ID NO: 335367 - protein, 9 aa, Influenza virus
GSGSFPNGA

SEQ ID NO: 335368 - protein, 9 aa, Influenza virus
SGFFPDGPQ

SEQ ID NO: 335369 - protein, 9 aa, Influenza virus
GFFPDGPQI

SEQ ID NO: 335370 - protein, 9 aa, Influenza virus
SLPDGAQIQ

SEQ ID NO: 335371 - protein, 9 aa, Influenza virus
FPDGAKIQY

SEQ ID NO: 335372 - protein, 9 aa, Influenza virus
PDGARIQYF

SEQ ID NO: 335373 - protein, 9 aa, Influenza virus
DGARIQYFS

SEQ ID NO: 335374 - protein, 9 aa, Influenza virus
EYNETIRIE

SEQ ID NO: 335375 - protein, 9 aa, Influenza virus
RGFAPFSKD

SEQ ID NO: 335376 - protein, 9 aa, Influenza virus
IRIGSKGHV

SEQ ID NO: 335377 - protein, 9 aa, Influenza virus
RIGSKGHVF

SEQ ID NO: 335378 - protein, 9 aa, Influenza virus
IGSKGHVFV

SEQ ID NO: 335379 - protein, 9 aa, Influenza virus
GSKGHVFVI

SEQ ID NO: 335380 - protein, 9 aa, Influenza virus
SKGHVFVIR

SEQ ID NO: 335381 - protein, 9 aa, Influenza virus
KGHVFVIRE

SEQ ID NO: 335382 - protein, 9 aa, Influenza virus
VFIIREPFV

SEQ ID NO: 335383 - protein, 9 aa, Influenza virus
FVIREPFIS

SEQ ID NO: 335384 - protein, 9 aa, Influenza virus
ECRTFFLTH

SEQ ID NO: 335385 - protein, 9 aa, Influenza virus
FITQGSLLN

SEQ ID NO: 335386 - protein, 9 aa, Influenza virus
LTQGSLPND

SEQ ID NO: 335387 - protein, 9 aa, Influenza virus
THGSLLNDK

SEQ ID NO: 335388 - protein, 9 aa, Influenza virus
HGSLLNDKH

SEQ ID NO: 335389 - protein, 9 aa, Influenza virus
GSLLNDKHF

SEQ ID NO: 335390 - protein, 9 aa, Influenza virus
SLLNDKHSS

SEQ ID NO: 335391 - protein, 9 aa, Influenza virus
LLNDKHFNG

SEQ ID NO: 335392 - protein, 9 aa, Influenza virus
PNDKHSNGT

SEQ ID NO: 335393 - protein, 9 aa, Influenza virus
NDRHSNGTV

SEQ ID NO: 335394 - protein, 9 aa, Influenza virus
DRHSNGTVK

SEQ ID NO: 335395 - protein, 9 aa, Influenza virus
RHSNGTVKD

SEQ ID NO: 335396 - protein, 9 aa, Influenza virus
HSNGTMKDR

SEQ ID NO: 335397 - protein, 9 aa, Influenza virus
SNGTMKDRS

SEQ ID NO: 335398 - protein, 9 aa, Influenza virus
NGTMKDRSP

SEQ ID NO: 335399 - protein, 9 aa, Influenza virus
GTIKDRSPY

SEQ ID NO: 335400 - protein, 9 aa, Influenza virus
TIKDRSPYR

SEQ ID NO: 335401 - protein, 9 aa, Influenza virus
IKDRSPYRT

SEQ ID NO: 335402 - protein, 9 aa, Influenza virus
PFRTLMSVE

SEQ ID NO: 335403 - protein, 9 aa, Influenza virus
RTLMSVEVG

SEQ ID NO: 335404 - protein, 9 aa, Influenza virus
TLMSVEVGQ

SEQ ID NO: 335405 - protein, 9 aa, Influenza virus
IGQSANVYQ

SEQ ID NO: 335406 - protein, 9 aa, Influenza virus
GLSPNVYQA

SEQ ID NO: 335407 - protein, 9 aa, Influenza virus
QSPNVYQSR

SEQ ID NO: 335408 - protein, 9 aa, Influenza virus
SPNVYQSRF

SEQ ID NO: 335409 - protein, 9 aa, Influenza virus
PNVYQSRFE

SEQ ID NO: 335410 - protein, 9 aa, Influenza virus
NVYQAKFES

SEQ ID NO: 335411 - protein, 9 aa, Influenza virus
VYQAKFESV

SEQ ID NO: 335412 - protein, 9 aa, Influenza virus
YQAKFESVA

SEQ ID NO: 335413 - protein, 9 aa, Influenza virus
QAKFESVAW

SEQ ID NO: 335414 - protein, 9 aa, Influenza virus
AKFESVAWS

SEQ ID NO: 335415 - protein, 9 aa, Influenza virus
KFESVAWSA

SEQ ID NO: 335416 - protein, 9 aa, Influenza virus
ACHDGKKWT

SEQ ID NO: 335417 - protein, 9 aa, Influenza virus
CHDGKKWMA

SEQ ID NO: 335418 - protein, 9 aa, Influenza virus
SWEGDILRT

SEQ ID NO: 335419 - protein, 9 aa, Influenza virus
GDIMRTQES

SEQ ID NO: 335420 - protein, 9 aa, Influenza virus
DIMRTQESS

SEQ ID NO: 335421 - protein, 9 aa, Influenza virus
QESSCTCIR

SEQ ID NO: 335422 - protein, 9 aa, Influenza virus
ESSCTCIRG

SEQ ID NO: 335423 - protein, 9 aa, Influenza virus
GECFWVMTD

SEQ ID NO: 335424 - protein, 9 aa, Influenza virus
ECFWVMTDG

SEQ ID NO: 335425 - protein, 9 aa, Influenza virus
VMTDGPANS

SEQ ID NO: 335426 - protein, 9 aa, Influenza virus
MTDGPANSQ

SEQ ID NO: 335427 - protein, 9 aa, Influenza virus
TDGPANSQA

SEQ ID NO: 335428 - protein, 9 aa, Influenza virus
FDGGHIEEC

SEQ ID NO: 335429 - protein, 9 aa, Influenza virus
DGGHIEECS

SEQ ID NO: 335430 - protein, 9 aa, Influenza virus
SCYPNNGKV

SEQ ID NO: 335431 - protein, 9 aa, Influenza virus
CYPNNGKVE

SEQ ID NO: 335432 - protein, 9 aa, Influenza virus
YPNNGKVEC

SEQ ID NO: 335433 - protein, 9 aa, Influenza virus
PNDGKVECV

SEQ ID NO: 335434 - protein, 9 aa, Influenza virus
NDGKVECVC

SEQ ID NO: 335435 - protein, 9 aa, Influenza virus
DGKVECVCR

SEQ ID NO: 335436 - protein, 9 aa, Influenza virus
TGTNRPVLI

SEQ ID NO: 335437 - protein, 9 aa, Influenza virus
GTNRPVLII

SEQ ID NO: 335438 - protein, 9 aa, Influenza virus
TNRPVLIIS

SEQ ID NO: 335439 - protein, 9 aa, Influenza virus
LIISPDLSY

SEQ ID NO: 335440 - protein, 9 aa, Influenza virus
LSYKVGYLC

SEQ ID NO: 335441 - protein, 9 aa, Influenza virus
SYKVGYLCA

SEQ ID NO: 335442 - protein, 9 aa, Influenza virus
YKVGYLCAG

SEQ ID NO: 335443 - protein, 9 aa, Influenza virus
GYLCAGIPS

SEQ ID NO: 335444 - protein, 9 aa, Influenza virus
YLCAGIPSD

SEQ ID NO: 335445 - protein, 9 aa, Influenza virus
LCAGIPSDT

SEQ ID NO: 335446 - protein, 9 aa, Influenza virus
CAGIPSDTP

SEQ ID NO: 335447 - protein, 9 aa, Influenza virus
AGIPSDTPR

SEQ ID NO: 335448 - protein, 9 aa, Influenza virus
GIPSDTPRG

SEQ ID NO: 335449 - protein, 9 aa, Influenza virus
IPSDTPRGE

SEQ ID NO: 335450 - protein, 9 aa, Influenza virus
SDTPRGEDA

SEQ ID NO: 335451 - protein, 9 aa, Influenza virus
DTPRGEDNQ

SEQ ID NO: 335452 - protein, 9 aa, Influenza virus
TPRGEDNQF

SEQ ID NO: 335453 - protein, 9 aa, Influenza virus
LGYGVKGFG

SEQ ID NO: 335454 - protein, 9 aa, Influenza virus
KGFGFRQGD

SEQ ID NO: 335455 - protein, 9 aa, Influenza virus
GFGFRQGDD

SEQ ID NO: 335456 - protein, 9 aa, Influenza virus
FGFRQGDDV

SEQ ID NO: 335457 - protein, 9 aa, Influenza virus
GFRQGDDVW

SEQ ID NO: 335458 - protein, 9 aa, Influenza virus
DNSNWSGYS

SEQ ID NO: 335459 - protein, 9 aa, Influenza virus
NSNWSGYSG

SEQ ID NO: 335460 - protein, 9 aa, Influenza virus
SNWSGYSGS

SEQ ID NO: 335461 - protein, 9 aa, Influenza virus
SGSFTLPVG

SEQ ID NO: 335462 - protein, 9 aa, Influenza virus
GSFTLPVEM

SEQ ID NO: 335463 - protein, 9 aa, Influenza virus
GCLVPCFWV

SEQ ID NO: 335464 - protein, 9 aa, Influenza virus
FWVEMIRGE

SEQ ID NO: 335465 - protein, 9 aa, Influenza virus
WVEMIRGRP

SEQ ID NO: 335466 - protein, 9 aa, Influenza virus
VEMIRGRPE

SEQ ID NO: 335467 - protein, 9 aa, Influenza virus
EMIRGEPEE

SEQ ID NO: 335468 - protein, 9 aa, Influenza virus
AIWTSSSSI

SEQ ID NO: 335469 - protein, 9 aa, Influenza virus
SSIVMCGVN

SEQ ID NO: 335470 - protein, 9 aa, Influenza virus
SVVMCGVDH

SEQ ID NO: 335471 - protein, 9 aa, Influenza virus
ANWSWHDGA

SEQ ID NO: 335472 - protein, 9 aa, Influenza virus
DWSWHDGAV

SEQ ID NO: 335473 - protein, 9 aa, Influenza virus
WHDGAILPL

SEQ ID NO: 335474 - protein, 9 aa, Influenza virus
DGAILPFDF

SEQ ID NO: 335475 - protein, 9 aa, Influenza virus
MNPNQKIQC

SEQ ID NO: 335476 - protein, 9 aa, Influenza virus
NPNQKILFA

SEQ ID NO: 335477 - protein, 9 aa, Influenza virus
PNQKILFAS

SEQ ID NO: 335478 - protein, 9 aa, Influenza virus
NQKILFASA

SEQ ID NO: 335479 - protein, 9 aa, Influenza virus
QKILCASAT

SEQ ID NO: 335480 - protein, 9 aa, Influenza virus
KILCASATA

SEQ ID NO: 335481 - protein, 9 aa, Influenza virus
ILCASATAI

SEQ ID NO: 335482 - protein, 9 aa, Influenza virus
TNLGLNIGL

SEQ ID NO: 335483 - protein, 9 aa, Influenza virus
GLNVGLHLK

SEQ ID NO: 335484 - protein, 9 aa, Influenza virus
LNVGLHLKP

SEQ ID NO: 335485 - protein, 9 aa, Influenza virus
SQTIINNYH

SEQ ID NO: 335486 - protein, 9 aa, Influenza virus
QTIINNYHN

SEQ ID NO: 335487 - protein, 9 aa, Influenza virus
TIINNYYNK

SEQ ID NO: 335488 - protein, 9 aa, Influenza virus
IINNYYNKT

SEQ ID NO: 335489 - protein, 9 aa, Influenza virus
INNYHNETN

SEQ ID NO: 335490 - protein, 9 aa, Influenza virus
ITQISNINI

SEQ ID NO: 335491 - protein, 9 aa, Influenza virus
FNNLTRGLC

SEQ ID NO: 335492 - protein, 9 aa, Influenza virus
NNLTRGLCT

SEQ ID NO: 335493 - protein, 9 aa, Influenza virus
NLTRGLCTI

SEQ ID NO: 335494 - protein, 9 aa, Influenza virus
LTRGLCTIN

SEQ ID NO: 335495 - protein, 9 aa, Influenza virus
TRGLCTINS

SEQ ID NO: 335496 - protein, 9 aa, Influenza virus
RGLCTINSW

SEQ ID NO: 335497 - protein, 9 aa, Influenza virus
RLCTINSWH

SEQ ID NO: 335498 - protein, 9 aa, Influenza virus
CIINSWHIY

SEQ ID NO: 335499 - protein, 9 aa, Influenza virus
KINSWHIFG

SEQ ID NO: 335500 - protein, 9 aa, Influenza virus
HIFGKDNAV

SEQ ID NO: 335501 - protein, 9 aa, Influenza virus
IFGKDNAVR

SEQ ID NO: 335502 - protein, 9 aa, Influenza virus
FGKDNAVRI

SEQ ID NO: 335503 - protein, 9 aa, Influenza virus
DNAIRIGEN

SEQ ID NO: 335504 - protein, 9 aa, Influenza virus
NAIRIGENS

SEQ ID NO: 335505 - protein, 9 aa, Influenza virus
RIGEDSDIL

SEQ ID NO: 335506 - protein, 9 aa, Influenza virus
IGEDSDILV

SEQ ID NO: 335507 - protein, 9 aa, Influenza virus
GEDSDILVT

SEQ ID NO: 335508 - protein, 9 aa, Influenza virus
EDSDILVTR

SEQ ID NO: 335509 - protein, 9 aa, Influenza virus
DSDILVTRE

SEQ ID NO: 335510 - protein, 9 aa, Influenza virus
EPYVSCDPN

SEQ ID NO: 335511 - protein, 9 aa, Influenza virus
PYVSCDPDG

SEQ ID NO: 335512 - protein, 9 aa, Influenza virus
YVSCDPDGC

SEQ ID NO: 335513 - protein, 9 aa, Influenza virus
VSCEPDECR

SEQ ID NO: 335514 - protein, 9 aa, Influenza virus
SCDPDGCRF

SEQ ID NO: 335515 - protein, 9 aa, Influenza virus
CDPDGCRFY

SEQ ID NO: 335516 - protein, 9 aa, Influenza virus
DPDGCRFYA

SEQ ID NO: 335517 - protein, 9 aa, Influenza virus
PNECRFYAL

SEQ ID NO: 335518 - protein, 9 aa, Influenza virus
NECRFYALS

SEQ ID NO: 335519 - protein, 9 aa, Influenza virus
DRSQYRALV

SEQ ID NO: 335520 - protein, 9 aa, Influenza virus
RSQYRALVS

SEQ ID NO: 335521 - protein, 9 aa, Influenza virus
SQYRALVSW

SEQ ID NO: 335522 - protein, 9 aa, Influenza virus
QYRALVSWP

SEQ ID NO: 335523 - protein, 9 aa, Influenza virus
YRALVSWPL

SEQ ID NO: 335524 - protein, 9 aa, Influenza virus
RALVSWPLS

SEQ ID NO: 335525 - protein, 9 aa, Influenza virus
ALVSWPLSS

SEQ ID NO: 335526 - protein, 9 aa, Influenza virus
LISWPQSSP

SEQ ID NO: 335527 - protein, 9 aa, Influenza virus
ISWPQSSPP

SEQ ID NO: 335528 - protein, 9 aa, Influenza virus
SSPPTVYNN

SEQ ID NO: 335529 - protein, 9 aa, Influenza virus
SPPTVYNNR

SEQ ID NO: 335530 - protein, 9 aa, Influenza virus
KVECIGWSS

SEQ ID NO: 335531 - protein, 9 aa, Influenza virus
STSCHDGKA

SEQ ID NO: 335532 - protein, 9 aa, Influenza virus
TSCHDGKAR

SEQ ID NO: 335533 - protein, 9 aa, Influenza virus
SCHDGKARM

SEQ ID NO: 335534 - protein, 9 aa, Influenza virus
CHDGKARMS

SEQ ID NO: 335535 - protein, 9 aa, Influenza virus
RMSVCISGP

SEQ ID NO: 335536 - protein, 9 aa, Influenza virus
MSVCISGPN

SEQ ID NO: 335537 - protein, 9 aa, Influenza virus
SVCISGPNN

SEQ ID NO: 335538 - protein, 9 aa, Influenza virus
VCISGPNNN

SEQ ID NO: 335539 - protein, 9 aa, Influenza virus
PNNNASAIV

SEQ ID NO: 335540 - protein, 9 aa, Influenza virus
NNNASAIVW

SEQ ID NO: 335541 - protein, 9 aa, Influenza virus
NNASAIVWY

SEQ ID NO: 335542 - protein, 9 aa, Influenza virus
NASAVIWYK

SEQ ID NO: 335543 - protein, 9 aa, Influenza virus
GRPITEINT

SEQ ID NO: 335544 - protein, 9 aa, Influenza virus
RPITEINTW

SEQ ID NO: 335545 - protein, 9 aa, Influenza virus
PITEINTWA

SEQ ID NO: 335546 - protein, 9 aa, Influenza virus
ITEINTWAR

SEQ ID NO: 335547 - protein, 9 aa, Influenza virus
EESECVCHN

SEQ ID NO: 335548 - protein, 9 aa, Influenza virus
SECVCHSGI

SEQ ID NO: 335549 - protein, 9 aa, Influenza virus
ECVCHSGIC

SEQ ID NO: 335550 - protein, 9 aa, Influenza virus
CVCHSGICP

SEQ ID NO: 335551 - protein, 9 aa, Influenza virus
VCHSGICPV

SEQ ID NO: 335552 - protein, 9 aa, Influenza virus
CHSGICPVV

SEQ ID NO: 335553 - protein, 9 aa, Influenza virus
HSGICPVVF

SEQ ID NO: 335554 - protein, 9 aa, Influenza virus
SGICPVVFT

SEQ ID NO: 335555 - protein, 9 aa, Influenza virus
ATGPADTRI

SEQ ID NO: 335556 - protein, 9 aa, Influenza virus
TGPADTRIY

SEQ ID NO: 335557 - protein, 9 aa, Influenza virus
GPADTRIYY

SEQ ID NO: 335558 - protein, 9 aa, Influenza virus
PADTRIYYF

SEQ ID NO: 335559 - protein, 9 aa, Influenza virus
TRVYYFREG

SEQ ID NO: 335560 - protein, 9 aa, Influenza virus
GKTLKWEPL

SEQ ID NO: 335561 - protein, 9 aa, Influenza virus
KWEPLAGTA

SEQ ID NO: 335562 - protein, 9 aa, Influenza virus
LNGTAKHIE

SEQ ID NO: 335563 - protein, 9 aa, Influenza virus
NGTAKHIEE

SEQ ID NO: 335564 - protein, 9 aa, Influenza virus
IEECSCYGK

SEQ ID NO: 335565 - protein, 9 aa, Influenza virus
IICTCRDNW

SEQ ID NO: 335566 - protein, 9 aa, Influenza virus
SNRPVIRID

SEQ ID NO: 335567 - protein, 9 aa, Influenza virus
NRPVIRIDP

SEQ ID NO: 335568 - protein, 9 aa, Influenza virus
MMTHTSQYI

SEQ ID NO: 335569 - protein, 9 aa, Influenza virus
DNPRPNDPN

SEQ ID NO: 335570 - protein, 9 aa, Influenza virus
VGKCNEPYP

SEQ ID NO: 335571 - protein, 9 aa, Influenza virus
NDPYPGNSN

SEQ ID NO: 335572 - protein, 9 aa, Influenza virus
DPYPGNNNG

SEQ ID NO: 335573 - protein, 9 aa, Influenza virus
PYPGNNBNG

SEQ ID NO: 335574 - protein, 9 aa, Influenza virus
YPGNNNGVK

SEQ ID NO: 335575 - protein, 9 aa, Influenza virus
PGNNNGVKG

SEQ ID NO: 335576 - protein, 9 aa, Influenza virus
GNNNGVKGF

SEQ ID NO: 335577 - protein, 9 aa, Influenza virus
NSNNGVKGF

SEQ ID NO: 335578 - protein, 9 aa, Influenza virus
NBNGVKGFS

SEQ ID NO: 335579 - protein, 9 aa, Influenza virus
GVKGFAYLD

SEQ ID NO: 335580 - protein, 9 aa, Influenza virus
VKGFAYLDG

SEQ ID NO: 335581 - protein, 9 aa, Influenza virus
NTWVGRTIS

SEQ ID NO: 335582 - protein, 9 aa, Influenza virus
TWLGRTLNT

SEQ ID NO: 335583 - protein, 9 aa, Influenza virus
WLGRTLNTA

SEQ ID NO: 335584 - protein, 9 aa, Influenza virus
VGRTISIAS

SEQ ID NO: 335585 - protein, 9 aa, Influenza virus
GRTINTASR

SEQ ID NO: 335586 - protein, 9 aa, Influenza virus
RTLNTASRS

SEQ ID NO: 335587 - protein, 9 aa, Influenza virus
TISTASRYG

SEQ ID NO: 335588 - protein, 9 aa, Influenza virus
LNTASRSGY

SEQ ID NO: 335589 - protein, 9 aa, Influenza virus
NTASRSGYE

SEQ ID NO: 335590 - protein, 9 aa, Influenza virus
TASRAGYEM

SEQ ID NO: 335591 - protein, 9 aa, Influenza virus
ASRYGYEML

SEQ ID NO: 335592 - protein, 9 aa, Influenza virus
SRAGYEMLK

SEQ ID NO: 335593 - protein, 9 aa, Influenza virus
RSGYEILKV

SEQ ID NO: 335594 - protein, 9 aa, Influenza virus
AGYEMLKVP

SEQ ID NO: 335595 - protein, 9 aa, Influenza virus
KVPNALIDD

SEQ ID NO: 335596 - protein, 9 aa, Influenza virus
VPNALTDNR

SEQ ID NO: 335597 - protein, 9 aa, Influenza virus
PNALTDNRS

SEQ ID NO: 335598 - protein, 9 aa, Influenza virus
NALTDNRSK

SEQ ID NO: 335599 - protein, 9 aa, Influenza virus
ALTDDKSKP

SEQ ID NO: 335600 - protein, 9 aa, Influenza virus
QGQTIVSNT

SEQ ID NO: 335601 - protein, 9 aa, Influenza virus
GQTIVSNTD

SEQ ID NO: 335602 - protein, 9 aa, Influenza virus
QTIVSNTDW

SEQ ID NO: 335603 - protein, 9 aa, Influenza virus
TIVSNTDWS

SEQ ID NO: 335604 - protein, 9 aa, Influenza virus
IVSNTDWSG

SEQ ID NO: 335605 - protein, 9 aa, Influenza virus
WSGYSGSFV

SEQ ID NO: 335606 - protein, 9 aa, Influenza virus
SGYSGSFVD

SEQ ID NO: 335607 - protein, 9 aa, Influenza virus
GYSGSFVDY

SEQ ID NO: 335608 - protein, 9 aa, Influenza virus
YSGSFVDYW

SEQ ID NO: 335609 - protein, 9 aa, Influenza virus
SGSFVDYWA

SEQ ID NO: 335610 - protein, 9 aa, Influenza virus
GSFIDYWAE

SEQ ID NO: 335611 - protein, 9 aa, Influenza virus
SFVDYWAEG

SEQ ID NO: 335612 - protein, 9 aa, Influenza virus
DYWAKGECY

SEQ ID NO: 335613 - protein, 9 aa, Influenza virus
YWAKGECYR

SEQ ID NO: 335614 - protein, 9 aa, Influenza virus
WAKGECYRA

SEQ ID NO: 335615 - protein, 9 aa, Influenza virus
AKGECYRAC

SEQ ID NO: 335616 - protein, 9 aa, Influenza virus
KGECYRACF

SEQ ID NO: 335617 - protein, 9 aa, Influenza virus
EECYRACFY

SEQ ID NO: 335618 - protein, 9 aa, Influenza virus
IRGRPKEDR

SEQ ID NO: 335619 - protein, 9 aa, Influenza virus
RGRPKEDRV

SEQ ID NO: 335620 - protein, 9 aa, Influenza virus
GRPKEDRVW

SEQ ID NO: 335621 - protein, 9 aa, Influenza virus
RPKEDRVWW

SEQ ID NO: 335622 - protein, 9 aa, Influenza virus
PKEDRVWWT

SEQ ID NO: 335623 - protein, 9 aa, Influenza virus
KEDRVWWTS

SEQ ID NO: 335624 - protein, 9 aa, Influenza virus
EDRVWWTSN

SEQ ID NO: 335625 - protein, 9 aa, Influenza virus
DRVWWTSNS

SEQ ID NO: 335626 - protein, 9 aa, Influenza virus
EVWWTSNSI

SEQ ID NO: 335627 - protein, 9 aa, Influenza virus
QWNWPDGAE

SEQ ID NO: 335628 - protein, 9 aa, Influenza virus
WNWPDGAEI

SEQ ID NO: 335629 - protein, 9 aa, Influenza virus
NWPDGAEIE

SEQ ID NO: 335630 - protein, 9 aa, Influenza virus
WPDGAKIET

SEQ ID NO: 335631 - protein, 9 aa, Influenza virus
PDGAKIKYF

SEQ ID NO: 335632 - protein, 9 aa, Influenza virus
DGAKIKYFL

SEQ ID NO: 335633 - protein, 9 aa, Influenza virus
GLDRICLGH

SEQ ID NO: 335634 - protein, 9 aa, Influenza virus
LDRICLGHH

SEQ ID NO: 335635 - protein, 9 aa, Influenza virus
ICLGHHAVA

SEQ ID NO: 335636 - protein, 9 aa, Influenza virus
CLGHHAVAN

SEQ ID NO: 335637 - protein, 9 aa, Influenza virus
LGHHAVANG

SEQ ID NO: 335638 - protein, 9 aa, Influenza virus
GHHAVANGT

SEQ ID NO: 335639 - protein, 9 aa, Influenza virus
NGTTVKTLT

SEQ ID NO: 335640 - protein, 9 aa, Influenza virus
HEEVTNATE

SEQ ID NO: 335641 - protein, 9 aa, Influenza virus
KDLGNCHPV

SEQ ID NO: 335642 - protein, 9 aa, Influenza virus
DLGNCHPVG

SEQ ID NO: 335643 - protein, 9 aa, Influenza virus
LGNCHPVGM

SEQ ID NO: 335644 - protein, 9 aa, Influenza virus
GTWNTLIER

SEQ ID NO: 335645 - protein, 9 aa, Influenza virus
VNEGALRQK

SEQ ID NO: 335646 - protein, 9 aa, Influenza virus
SEEALRQKI

SEQ ID NO: 335647 - protein, 9 aa, Influenza virus
QKIMESGEI

SEQ ID NO: 335648 - protein, 9 aa, Influenza virus
SFYAELRWL

SEQ ID NO: 335649 - protein, 9 aa, Influenza virus
GQNFPRTTN

SEQ ID NO: 335650 - protein, 9 aa, Influenza virus
QNFPRTTNT

SEQ ID NO: 335651 - protein, 9 aa, Influenza virus
SFPQTTNTY

SEQ ID NO: 335652 - protein, 9 aa, Influenza virus
FPRTTNTYR

SEQ ID NO: 335653 - protein, 9 aa, Influenza virus
PRTTNTYRN

SEQ ID NO: 335654 - protein, 9 aa, Influenza virus
RTTNTYRNT

SEQ ID NO: 335655 - protein, 9 aa, Influenza virus
ANTYRNTDS

SEQ ID NO: 335656 - protein, 9 aa, Influenza virus
WGIHHPSNT

SEQ ID NO: 335657 - protein, 9 aa, Influenza virus
LYGTQPLSI

SEQ ID NO: 335658 - protein, 9 aa, Influenza virus
YGAQSLSIS

SEQ ID NO: 335659 - protein, 9 aa, Influenza virus
GTQPLSISV

SEQ ID NO: 335660 - protein, 9 aa, Influenza virus
TQSLSISVE

SEQ ID NO: 335661 - protein, 9 aa, Influenza virus
QSLSISVES

SEQ ID NO: 335662 - protein, 9 aa, Influenza virus
SLSISVESS

SEQ ID NO: 335663 - protein, 9 aa, Influenza virus
LSISVESST

SEQ ID NO: 335664 - protein, 9 aa, Influenza virus
SISIGSSTY

SEQ ID NO: 335665 - protein, 9 aa, Influenza virus
ISVESSTYQ

SEQ ID NO: 335666 - protein, 9 aa, Influenza virus
SVESSTYQN

SEQ ID NO: 335667 - protein, 9 aa, Influenza virus
VESSTYQNN

SEQ ID NO: 335668 - protein, 9 aa, Influenza virus
ESSTYQNNF

SEQ ID NO: 335669 - protein, 9 aa, Influenza virus
SSTYHNSFV

SEQ ID NO: 335670 - protein, 9 aa, Influenza virus
SIYQNSFVP

SEQ ID NO: 335671 - protein, 9 aa, Influenza virus
TYHNSFVPV

SEQ ID NO: 335672 - protein, 9 aa, Influenza virus
YQNNFVPVI

SEQ ID NO: 335673 - protein, 9 aa, Influenza virus
QNNFVPVIG

SEQ ID NO: 335674 - protein, 9 aa, Influenza virus
NNFVPVIGA

SEQ ID NO: 335675 - protein, 9 aa, Influenza virus
NFVPVIGAR

SEQ ID NO: 335676 - protein, 9 aa, Influenza virus
FVPVVRARP

SEQ ID NO: 335677 - protein, 9 aa, Influenza virus
VPVVRARPQ

SEQ ID NO: 335678 - protein, 9 aa, Influenza virus
PVVRARPQV

SEQ ID NO: 335679 - protein, 9 aa, Influenza virus
VMGARPQVN

SEQ ID NO: 335680 - protein, 9 aa, Influenza virus
VRARPQVNG

SEQ ID NO: 335681 - protein, 9 aa, Influenza virus
GARPLVNGQ

SEQ ID NO: 335682 - protein, 9 aa, Influenza virus
ARPLVNGQS

SEQ ID NO: 335683 - protein, 9 aa, Influenza virus
RPLVNGQRG

SEQ ID NO: 335684 - protein, 9 aa, Influenza virus
PLVNGQRGR

SEQ ID NO: 335685 - protein, 9 aa, Influenza virus
KVNGQSGRI

SEQ ID NO: 335686 - protein, 9 aa, Influenza virus
VNGQRGRID

SEQ ID NO: 335687 - protein, 9 aa, Influenza virus
NGQRGRIDF

SEQ ID NO: 335688 - protein, 9 aa, Influenza virus
GQSGRIVFH

SEQ ID NO: 335689 - protein, 9 aa, Influenza virus
QSGRIVFHW

SEQ ID NO: 335690 - protein, 9 aa, Influenza virus
PGDNIIFSH

SEQ ID NO: 335691 - protein, 9 aa, Influenza virus
GHNITFSHN

SEQ ID NO: 335692 - protein, 9 aa, Influenza virus
DNITFSDNG

SEQ ID NO: 335693 - protein, 9 aa, Influenza virus
HITFSHNGG

SEQ ID NO: 335694 - protein, 9 aa, Influenza virus
ITFSDNGGL

SEQ ID NO: 335695 - protein, 9 aa, Influenza virus
IFSHNGGLI

SEQ ID NO: 335696 - protein, 9 aa, Influenza virus
FLHNGGLIA

SEQ ID NO: 335697 - protein, 9 aa, Influenza virus
LHNGGLIAP

SEQ ID NO: 335698 - protein, 9 aa, Influenza virus
HNGGLIAPN

SEQ ID NO: 335699 - protein, 9 aa, Influenza virus
NGGLIAPNR

SEQ ID NO: 335700 - protein, 9 aa, Influenza virus
GGLIAPNRV

SEQ ID NO: 335701 - protein, 9 aa, Influenza virus
CKSKCFWRG

SEQ ID NO: 335702 - protein, 9 aa, Influenza virus
ESKCFWKSG

SEQ ID NO: 335703 - protein, 9 aa, Influenza virus
SKCFWKGGT

SEQ ID NO: 335704 - protein, 9 aa, Influenza virus
KCFWKSGSI

SEQ ID NO: 335705 - protein, 9 aa, Influenza virus
CFWKGGSIK

SEQ ID NO: 335706 - protein, 9 aa, Influenza virus
FWKGGSIKT

SEQ ID NO: 335707 - protein, 9 aa, Influenza virus
GGSIKTKLP

SEQ ID NO: 335708 - protein, 9 aa, Influenza virus
GSIKTKLPF

SEQ ID NO: 335709 - protein, 9 aa, Influenza virus
SIKTKLPFQ

SEQ ID NO: 335710 - protein, 9 aa, Influenza virus
IKTKLPFQN

SEQ ID NO: 335711 - protein, 9 aa, Influenza virus
KTKLPFQNL

SEQ ID NO: 335712 - protein, 9 aa, Influenza virus
TELPFQNLS

SEQ ID NO: 335713 - protein, 9 aa, Influenza virus
ELPFQNLSP

SEQ ID NO: 335714 - protein, 9 aa, Influenza virus
VGQCPKYVK

SEQ ID NO: 335715 - protein, 9 aa, Influenza virus
GQCPKYVNQ

SEQ ID NO: 335716 - protein, 9 aa, Influenza virus
KSLMLATGM

SEQ ID NO: 335717 - protein, 9 aa, Influenza virus
TGMRNVPET

SEQ ID NO: 335718 - protein, 9 aa, Influenza virus
QGRGLFGAK

SEQ ID NO: 335719 - protein, 9 aa, Influenza virus
GRGLFGAKA

SEQ ID NO: 335720 - protein, 9 aa, Influenza virus
QNAQGTGLA

SEQ ID NO: 335721 - protein, 9 aa, Influenza virus
NAQGTGLAA

SEQ ID NO: 335722 - protein, 9 aa, Influenza virus
DQGTGQAAD

SEQ ID NO: 335723 - protein, 9 aa, Influenza virus
GTGQAADYE

SEQ ID NO: 335724 - protein, 9 aa, Influenza virus
TGQAADYES

SEQ ID NO: 335725 - protein, 9 aa, Influenza virus
AADYESTQA

SEQ ID NO: 335726 - protein, 9 aa, Influenza virus
ADYKSTQKT

SEQ ID NO: 335727 - protein, 9 aa, Influenza virus
DYKSTQTAI

SEQ ID NO: 335728 - protein, 9 aa, Influenza virus
AIVQITGKL

SEQ ID NO: 335729 - protein, 9 aa, Influenza virus
IDQVTGKLN

SEQ ID NO: 335730 - protein, 9 aa, Influenza virus
DQVTGKLNR

SEQ ID NO: 335731 - protein, 9 aa, Influenza virus
SIESEFSET

SEQ ID NO: 335732 - protein, 9 aa, Influenza virus
IESEFSETE

SEQ ID NO: 335733 - protein, 9 aa, Influenza virus
ESEFSETEH

SEQ ID NO: 335734 - protein, 9 aa, Influenza virus
SEFSETEHQ

SEQ ID NO: 335735 - protein, 9 aa, Influenza virus
EFSETEHQI

SEQ ID NO: 335736 - protein, 9 aa, Influenza virus
FSETEHQIG

SEQ ID NO: 335737 - protein, 9 aa, Influenza virus
SETEHQIGN

SEQ ID NO: 335738 - protein, 9 aa, Influenza virus
EIEYQIGNV

SEQ ID NO: 335739 - protein, 9 aa, Influenza virus
IEHQISNVI

SEQ ID NO: 335740 - protein, 9 aa, Influenza virus
HTIDMGDSE

SEQ ID NO: 335741 - protein, 9 aa, Influenza virus
TIDLADSEM

SEQ ID NO: 335742 - protein, 9 aa, Influenza virus
IDMADSTML

SEQ ID NO: 335743 - protein, 9 aa, Influenza virus
EMTDSEMLN

SEQ ID NO: 335744 - protein, 9 aa, Influenza virus
MADSTMLNL

SEQ ID NO: 335745 - protein, 9 aa, Influenza virus
GCFEIYHTC

SEQ ID NO: 335746 - protein, 9 aa, Influenza virus
DCMESIRNN

SEQ ID NO: 335747 - protein, 9 aa, Influenza virus
ESIRNNTYN

SEQ ID NO: 335748 - protein, 9 aa, Influenza virus
RIRNNTYDH

SEQ ID NO: 335749 - protein, 9 aa, Influenza virus
IRNNTYDHA

SEQ ID NO: 335750 - protein, 9 aa, Influenza virus
RNNTYDHAQ

SEQ ID NO: 335751 - protein, 9 aa, Influenza virus
NNTYDHAQY

SEQ ID NO: 335752 - protein, 9 aa, Influenza virus
NTYDHAQYR

SEQ ID NO: 335753 - protein, 9 aa, Influenza virus
TYDHAQYRE

SEQ ID NO: 335754 - protein, 9 aa, Influenza virus
YDHAQYREE

SEQ ID NO: 335755 - protein, 9 aa, Influenza virus
HAQYREEAL

SEQ ID NO: 335756 - protein, 9 aa, Influenza virus
AQYREEALL

SEQ ID NO: 335757 - protein, 9 aa, Influenza virus
HYREEALLN

SEQ ID NO: 335758 - protein, 9 aa, Influenza virus
REEALLNRI

SEQ ID NO: 335759 - protein, 9 aa, Influenza virus
EESLLNRLS

SEQ ID NO: 335760 - protein, 9 aa, Influenza virus
ESLLNRLSI

SEQ ID NO: 335761 - protein, 9 aa, Influenza virus
SLLNRLSIN

SEQ ID NO: 335762 - protein, 9 aa, Influenza virus
LLNRLSINP

SEQ ID NO: 335763 - protein, 9 aa, Influenza virus
LNRLSINPV

SEQ ID NO: 335764 - protein, 9 aa, Influenza virus
INPVTLSSG

SEQ ID NO: 335765 - protein, 9 aa, Influenza virus
NPVTLSSGY

SEQ ID NO: 335766 - protein, 9 aa, Influenza virus
PVTLSSGYK

SEQ ID NO: 335767 - protein, 9 aa, Influenza virus
VKLSSSYKD

SEQ ID NO: 335768 - protein, 9 aa, Influenza virus
LFSGYKDII

SEQ ID NO: 335769 - protein, 9 aa, Influenza virus
FSGYKDIIL

SEQ ID NO: 335770 - protein, 9 aa, Influenza virus
FSFGASSFV

SEQ ID NO: 335771 - protein, 9 aa, Influenza virus
SFGASSFVL

SEQ ID NO: 335772 - protein, 9 aa, Influenza virus
FGASSFVLL

SEQ ID NO: 335773 - protein, 9 aa, Influenza virus
GASSFVLLA

SEQ ID NO: 335774 - protein, 9 aa, Influenza virus
SFCLKNGNM

SEQ ID NO: 335775 - protein, 9 aa, Influenza virus
FCLKNGNMQ

SEQ ID NO: 335776 - protein, 9 aa, Influenza virus
GLDRICLGH

SEQ ID NO: 335777 - protein, 9 aa, Influenza virus
LDRICLGHH

SEQ ID NO: 335778 - protein, 9 aa, Influenza virus
ICLGHHAVA

SEQ ID NO: 335779 - protein, 9 aa, Influenza virus
CLGHHAVAN

SEQ ID NO: 335780 - protein, 9 aa, Influenza virus
LGHHAVANG

SEQ ID NO: 335781 - protein, 9 aa, Influenza virus
GHHAVANGT

SEQ ID NO: 335782 - protein, 9 aa, Influenza virus
HHAVANGTI

SEQ ID NO: 335783 - protein, 9 aa, Influenza virus
ANGTIVKTL

SEQ ID NO: 335784 - protein, 9 aa, Influenza virus
GTIIKTLTN

SEQ ID NO: 335785 - protein, 9 aa, Influenza virus
TVVKTLTNE

SEQ ID NO: 335786 - protein, 9 aa, Influenza virus
IVKTLTSEK

SEQ ID NO: 335787 - protein, 9 aa, Influenza virus
VKTLTSEKE

SEQ ID NO: 335788 - protein, 9 aa, Influenza virus
KTLTSEKEE

SEQ ID NO: 335789 - protein, 9 aa, Influenza virus
TLTSEKEEV

SEQ ID NO: 335790 - protein, 9 aa, Influenza virus
EKEEVINAT

SEQ ID NO: 335791 - protein, 9 aa, Influenza virus
HEEVTNATE

SEQ ID NO: 335792 - protein, 9 aa, Influenza virus
NATETVESR

SEQ ID NO: 335793 - protein, 9 aa, Influenza virus
HKDLGNCHP

SEQ ID NO: 335794 - protein, 9 aa, Influenza virus
KDLGNCHPV

SEQ ID NO: 335795 - protein, 9 aa, Influenza virus
DLDNCHPIG

SEQ ID NO: 335796 - protein, 9 aa, Influenza virus
LGNCHPVGM

SEQ ID NO: 335797 - protein, 9 aa, Influenza virus
CHPIGMLIG

SEQ ID NO: 335798 - protein, 9 aa, Influenza virus
GTPACDLYL

SEQ ID NO: 335799 - protein, 9 aa, Influenza virus
TPVCDPHLT

SEQ ID NO: 335800 - protein, 9 aa, Influenza virus
PACDLYLTG

SEQ ID NO: 335801 - protein, 9 aa, Influenza virus
CDLYLTGTW

SEQ ID NO: 335802 - protein, 9 aa, Influenza virus
DPHLTGTWD

SEQ ID NO: 335803 - protein, 9 aa, Influenza virus
LYLTGTWDT

SEQ ID NO: 335804 - protein, 9 aa, Influenza virus
HLTGKWDTL

SEQ ID NO: 335805 - protein, 9 aa, Influenza virus
LTGMWDTLI

SEQ ID NO: 335806 - protein, 9 aa, Influenza virus
TGIWDTLIE

SEQ ID NO: 335807 - protein, 9 aa, Influenza virus
GMWDTLIER

SEQ ID NO: 335808 - protein, 9 aa, Influenza virus
TWDTLIERG

SEQ ID NO: 335809 - protein, 9 aa, Influenza virus
WDTLIERGS

SEQ ID NO: 335810 - protein, 9 aa, Influenza virus
DTLIERENS

SEQ ID NO: 335811 - protein, 9 aa, Influenza virus
IAYCYPGTT

SEQ ID NO: 335812 - protein, 9 aa, Influenza virus
AYCYPGTTV

SEQ ID NO: 335813 - protein, 9 aa, Influenza virus
YCYPGTTVN

SEQ ID NO: 335814 - protein, 9 aa, Influenza virus
CYPGTTVNE

SEQ ID NO: 335815 - protein, 9 aa, Influenza virus
YPGTTVNEE

SEQ ID NO: 335816 - protein, 9 aa, Influenza virus
PGTTVNEEA

SEQ ID NO: 335817 - protein, 9 aa, Influenza virus
GTTVNEEAL

SEQ ID NO: 335818 - protein, 9 aa, Influenza virus
TTVNEEALR

SEQ ID NO: 335819 - protein, 9 aa, Influenza virus
TVNEGALRQ

SEQ ID NO: 335820 - protein, 9 aa, Influenza virus
VNEGALRQK

SEQ ID NO: 335821 - protein, 9 aa, Influenza virus
MESGGISKM

SEQ ID NO: 335822 - protein, 9 aa, Influenza virus
ESGGISKIS

SEQ ID NO: 335823 - protein, 9 aa, Influenza virus
SGGISKIST

SEQ ID NO: 335824 - protein, 9 aa, Influenza virus
FAYGSSINS

SEQ ID NO: 335825 - protein, 9 aa, Influenza virus
YGSSITSAG

SEQ ID NO: 335826 - protein, 9 aa, Influenza virus
GKNSFYAEL

SEQ ID NO: 335827 - protein, 9 aa, Influenza virus
KNSFYAELK

SEQ ID NO: 335828 - protein, 9 aa, Influenza virus
ELKWLVSKN

SEQ ID NO: 335829 - protein, 9 aa, Influenza virus
LKWLVSKNK

SEQ ID NO: 335830 - protein, 9 aa, Influenza virus
KWLVSKNKG

SEQ ID NO: 335831 - protein, 9 aa, Influenza virus
WLVSKNKGQ

SEQ ID NO: 335832 - protein, 9 aa, Influenza virus
QNFPRTTNT

SEQ ID NO: 335833 - protein, 9 aa, Influenza virus
NFPRTTNTY

SEQ ID NO: 335834 - protein, 9 aa, Influenza virus
FPRTTNTYR

SEQ ID NO: 335835 - protein, 9 aa, Influenza virus
PRTTNTYRN

SEQ ID NO: 335836 - protein, 9 aa, Influenza virus
RTTNTYRNT

SEQ ID NO: 335837 - protein, 9 aa, Influenza virus
TNTYRNTDT

SEQ ID NO: 335838 - protein, 9 aa, Influenza virus
EHLITWGIH

SEQ ID NO: 335839 - protein, 9 aa, Influenza virus
HLIMWGIHH

SEQ ID NO: 335840 - protein, 9 aa, Influenza virus
LIMWGIHHP

SEQ ID NO: 335841 - protein, 9 aa, Influenza virus
IMWGIHHPS

SEQ ID NO: 335842 - protein, 9 aa, Influenza virus
MWGIHHPSS

SEQ ID NO: 335843 - protein, 9 aa, Influenza virus
GIHHPSSAQ

SEQ ID NO: 335844 - protein, 9 aa, Influenza virus
IHHPSSAQE

SEQ ID NO: 335845 - protein, 9 aa, Influenza virus
HHPSSAQEK

SEQ ID NO: 335846 - protein, 9 aa, Influenza virus
HPSSAQEKN

SEQ ID NO: 335847 - protein, 9 aa, Influenza virus
PSSAQEKND

SEQ ID NO: 335848 - protein, 9 aa, Influenza virus
SSAQEKNDL

SEQ ID NO: 335849 - protein, 9 aa, Influenza virus
SAQEKNDLY

SEQ ID NO: 335850 - protein, 9 aa, Influenza virus
AQEKNDLYG

SEQ ID NO: 335851 - protein, 9 aa, Influenza virus
KEKNELYGT

SEQ ID NO: 335852 - protein, 9 aa, Influenza virus
EKNALYGTQ

SEQ ID NO: 335853 - protein, 9 aa, Influenza virus
KNELYGTQS

SEQ ID NO: 335854 - protein, 9 aa, Influenza virus
NDLYGTQPL

SEQ ID NO: 335855 - protein, 9 aa, Influenza virus
DLYGTQPLS

SEQ ID NO: 335856 - protein, 9 aa, Influenza virus
GTQPLSISV

SEQ ID NO: 335857 - protein, 9 aa, Influenza virus
TQPLSISVG

SEQ ID NO: 335858 - protein, 9 aa, Influenza virus
QSLSISIGS

SEQ ID NO: 335859 - protein, 9 aa, Influenza virus
PLSISVGSS

SEQ ID NO: 335860 - protein, 9 aa, Influenza virus
LSISIGSST

SEQ ID NO: 335861 - protein, 9 aa, Influenza virus
SISIGSSTY

SEQ ID NO: 335862 - protein, 9 aa, Influenza virus
ISIGSSTYQ

SEQ ID NO: 335863 - protein, 9 aa, Influenza virus
SIGSSTYQN

SEQ ID NO: 335864 - protein, 9 aa, Influenza virus
VESSTYQNN

SEQ ID NO: 335865 - protein, 9 aa, Influenza virus
ESSTYQNNF

SEQ ID NO: 335866 - protein, 9 aa, Influenza virus
SSIYQNSFV

SEQ ID NO: 335867 - protein, 9 aa, Influenza virus
SIYQNSFVP

SEQ ID NO: 335868 - protein, 9 aa, Influenza virus
TYHNSFVPV

SEQ ID NO: 335869 - protein, 9 aa, Influenza virus
YQNNFVPVI

SEQ ID NO: 335870 - protein, 9 aa, Influenza virus
HNSFVPVVG

SEQ ID NO: 335871 - protein, 9 aa, Influenza virus
SGRIDFHWA

SEQ ID NO: 335872 - protein, 9 aa, Influenza virus
IQPGDNITF

SEQ ID NO: 335873 - protein, 9 aa, Influenza virus
QPGDNIIFS

SEQ ID NO: 335874 - protein, 9 aa, Influenza virus
PGDNIIFSH

SEQ ID NO: 335875 - protein, 9 aa, Influenza virus
GDNITFLHN

SEQ ID NO: 335876 - protein, 9 aa, Influenza virus
DNITFSDNG

SEQ ID NO: 335877 - protein, 9 aa, Influenza virus
NIIFSHNGG

SEQ ID NO: 335878 - protein, 9 aa, Influenza virus
IIFSHNGGL

SEQ ID NO: 335879 - protein, 9 aa, Influenza virus
TFLHNGGLI

SEQ ID NO: 335880 - protein, 9 aa, Influenza virus
FSHNGGLVA

SEQ ID NO: 335881 - protein, 9 aa, Influenza virus
SHNGGLVAP

SEQ ID NO: 335882 - protein, 9 aa, Influenza virus
HNGGLVAPS

SEQ ID NO: 335883 - protein, 9 aa, Influenza virus
GLIAPDRVS

SEQ ID NO: 335884 - protein, 9 aa, Influenza virus
LVAPSRVSK

SEQ ID NO: 335885 - protein, 9 aa, Influenza virus
VAPSRVSKL

SEQ ID NO: 335886 - protein, 9 aa, Influenza virus
APSRVTKLK

SEQ ID NO: 335887 - protein, 9 aa, Influenza virus
PSRVTKLKG

SEQ ID NO: 335888 - protein, 9 aa, Influenza virus
GRGLGIQSD

SEQ ID NO: 335889 - protein, 9 aa, Influenza virus
DNSCESKCF

SEQ ID NO: 335890 - protein, 9 aa, Influenza virus
NSCESKCFW

SEQ ID NO: 335891 - protein, 9 aa, Influenza virus
CFWRGGSIN

SEQ ID NO: 335892 - protein, 9 aa, Influenza virus
FWRGGSINT

SEQ ID NO: 335893 - protein, 9 aa, Influenza virus
WRGGSINTK

SEQ ID NO: 335894 - protein, 9 aa, Influenza virus
RGGSINTKL

SEQ ID NO: 335895 - protein, 9 aa, Influenza virus
GGSINTRLP

SEQ ID NO: 335896 - protein, 9 aa, Influenza virus
GSINTRLPF

SEQ ID NO: 335897 - protein, 9 aa, Influenza virus
SINTRLPFQ

SEQ ID NO: 335898 - protein, 9 aa, Influenza virus
INTRLPFQN

SEQ ID NO: 335899 - protein, 9 aa, Influenza virus
NTRLPFQNL

SEQ ID NO: 335900 - protein, 9 aa, Influenza virus
GQCPKYVNQ

SEQ ID NO: 335901 - protein, 9 aa, Influenza virus
KSLMLATGM

SEQ ID NO: 335902 - protein, 9 aa, Influenza virus
TGMRNVPET

SEQ ID NO: 335903 - protein, 9 aa, Influenza virus
AADYKSTQK

SEQ ID NO: 335904 - protein, 9 aa, Influenza virus
ADYESTQAA

SEQ ID NO: 335905 - protein, 9 aa, Influenza virus
DYESTQAAI

SEQ ID NO: 335906 - protein, 9 aa, Influenza virus
YKSTQKTID

SEQ ID NO: 335907 - protein, 9 aa, Influenza virus
KSTQKTIDQ

SEQ ID NO: 335908 - protein, 9 aa, Influenza virus
STQKTIDQV

SEQ ID NO: 335909 - protein, 9 aa, Influenza virus
TQKTIDQVT

SEQ ID NO: 335910 - protein, 9 aa, Influenza virus
QKTIDQVTG

SEQ ID NO: 335911 - protein, 9 aa, Influenza virus
KTIDQVTGK

SEQ ID NO: 335912 - protein, 9 aa, Influenza virus
TIDQVTGKL

SEQ ID NO: 335913 - protein, 9 aa, Influenza virus
IDQVTGKLN

SEQ ID NO: 335914 - protein, 9 aa, Influenza virus
SIESEFSET

SEQ ID NO: 335915 - protein, 9 aa, Influenza virus
IESEFSETE

SEQ ID NO: 335916 - protein, 9 aa, Influenza virus
ESEFSETEH

SEQ ID NO: 335917 - protein, 9 aa, Influenza virus
SEFSETEHQ

SEQ ID NO: 335918 - protein, 9 aa, Influenza virus
EFSETEHQI

SEQ ID NO: 335919 - protein, 9 aa, Influenza virus
FSETEHQIG

SEQ ID NO: 335920 - protein, 9 aa, Influenza virus
SETEHQIGN

SEQ ID NO: 335921 - protein, 9 aa, Influenza virus
EIEYQIGNV

SEQ ID NO: 335922 - protein, 9 aa, Influenza virus
IEYQIGNVI

SEQ ID NO: 335923 - protein, 9 aa, Influenza virus
STMLNLYER

SEQ ID NO: 335924 - protein, 9 aa, Influenza virus
TMLNLYERV

SEQ ID NO: 335925 - protein, 9 aa, Influenza virus
KGCFEIYHT

SEQ ID NO: 335926 - protein, 9 aa, Influenza virus
GCFEIYHTC

SEQ ID NO: 335927 - protein, 9 aa, Influenza virus
CFEIYHTCD

SEQ ID NO: 335928 - protein, 9 aa, Influenza virus
CDNNCMESI

SEQ ID NO: 335929 - protein, 9 aa, Influenza virus
DNNCMESIR

SEQ ID NO: 335930 - protein, 9 aa, Influenza virus
NNCMESIRN

SEQ ID NO: 335931 - protein, 9 aa, Influenza virus
NCMESIRDN

SEQ ID NO: 335932 - protein, 9 aa, Influenza virus
IRNNTYDHS

SEQ ID NO: 335933 - protein, 9 aa, Influenza virus
RNNTYDHSQ

SEQ ID NO: 335934 - protein, 9 aa, Influenza virus
NNTYDHSQY

SEQ ID NO: 335935 - protein, 9 aa, Influenza virus
NTYDHSQYR

SEQ ID NO: 335936 - protein, 9 aa, Influenza virus
TYDHSQYRE

SEQ ID NO: 335937 - protein, 9 aa, Influenza virus
YDHSQYREE

SEQ ID NO: 335938 - protein, 9 aa, Influenza virus
DHSQYREEA

SEQ ID NO: 335939 - protein, 9 aa, Influenza virus
HSQYREEAL

SEQ ID NO: 335940 - protein, 9 aa, Influenza virus
SQYREEALL

SEQ ID NO: 335941 - protein, 9 aa, Influenza virus
LLNRLSINP

SEQ ID NO: 335942 - protein, 9 aa, Influenza virus
LNRLSINPV

SEQ ID NO: 335943 - protein, 9 aa, Influenza virus
NRLSINPVK

SEQ ID NO: 335944 - protein, 9 aa, Influenza virus
RLSINPVKL

SEQ ID NO: 335945 - protein, 9 aa, Influenza virus
LSINPVKLS

SEQ ID NO: 335946 - protein, 9 aa, Influenza virus
SINPVKLSS

SEQ ID NO: 335947 - protein, 9 aa, Influenza virus
INPVTLSSG

SEQ ID NO: 335948 - protein, 9 aa, Influenza virus
NPVTLSSGY

SEQ ID NO: 335949 - protein, 9 aa, Influenza virus
PVTLSSGYK

SEQ ID NO: 335950 - protein, 9 aa, Influenza virus
VRLSSGYKD

SEQ ID NO: 335951 - protein, 9 aa, Influenza virus
TLSSGYKDI

SEQ ID NO: 335952 - protein, 9 aa, Influenza virus
ASCFVLLAA

SEQ ID NO: 335953 - protein, 9 aa, Influenza virus
SCFILLAVI

SEQ ID NO: 335954 - protein, 9 aa, Influenza virus
IVGLVFFCL

SEQ ID NO: 335955 - protein, 9 aa, Influenza virus
MGLFFFCLK

SEQ ID NO: 335956 - protein, 9 aa, Influenza virus
GLFFFCLKN

SEQ ID NO: 335957 - protein, 9 aa, Influenza virus
LFFFCLKNG

SEQ ID NO: 335958 - protein, 9 aa, Influenza virus
FFFCLKNGN

SEQ ID NO: 335959 - protein, 9 aa, Influenza virus
MNPKSKLFT

SEQ ID NO: 335960 - protein, 9 aa, Influenza virus
NPKSKLFTL

SEQ ID NO: 335961 - protein, 9 aa, Influenza virus
PNQNLFTLS

SEQ ID NO: 335962 - protein, 9 aa, Influenza virus
KSKLFTLSG

SEQ ID NO: 335963 - protein, 9 aa, Influenza virus
QNLFTLSGV

SEQ ID NO: 335964 - protein, 9 aa, Influenza virus
LFALSGVAV

SEQ ID NO: 335965 - protein, 9 aa, Influenza virus
FALSGVAVA

SEQ ID NO: 335966 - protein, 9 aa, Influenza virus
ALSGVAVAL

SEQ ID NO: 335967 - protein, 9 aa, Influenza virus
LSGVAIALN

SEQ ID NO: 335968 - protein, 9 aa, Influenza virus
MNLLIGISN

SEQ ID NO: 335969 - protein, 9 aa, Influenza virus
GLNISLHLK

SEQ ID NO: 335970 - protein, 9 aa, Influenza virus
EKGPKQEEN

SEQ ID NO: 335971 - protein, 9 aa, Influenza virus
NQNNTTVVE

SEQ ID NO: 335972 - protein, 9 aa, Influenza virus
TNTTLIENT

SEQ ID NO: 335973 - protein, 9 aa, Influenza virus
VVENKYVNN

SEQ ID NO: 335974 - protein, 9 aa, Influenza virus
IENTYVNKT

SEQ ID NO: 335975 - protein, 9 aa, Influenza virus
NKYVNNTTI

SEQ ID NO: 335976 - protein, 9 aa, Influenza virus
KYVNNTTII

SEQ ID NO: 335977 - protein, 9 aa, Influenza virus
YVNNTTIIS

SEQ ID NO: 335978 - protein, 9 aa, Influenza virus
VNKTTVINK

SEQ ID NO: 335979 - protein, 9 aa, Influenza virus
YLVLNKSLC

SEQ ID NO: 335980 - protein, 9 aa, Influenza virus
LLLNKSLCN

SEQ ID NO: 335981 - protein, 9 aa, Influenza virus
LLNKSLCNV

SEQ ID NO: 335982 - protein, 9 aa, Influenza virus
LNKSLCSVE

SEQ ID NO: 335983 - protein, 9 aa, Influenza virus
NKSLCSVEG

SEQ ID NO: 335984 - protein, 9 aa, Influenza virus
KSLCSVEGW

SEQ ID NO: 335985 - protein, 9 aa, Influenza virus
SLCSVEGWV

SEQ ID NO: 335986 - protein, 9 aa, Influenza virus
LCSVEGWVV

SEQ ID NO: 335987 - protein, 9 aa, Influenza virus
CSVEGWVVI

SEQ ID NO: 335988 - protein, 9 aa, Influenza virus
SVEGWVVIA

SEQ ID NO: 335989 - protein, 9 aa, Influenza virus
VVIAKDNAI

SEQ ID NO: 335990 - protein, 9 aa, Influenza virus
VIAKDNAIR

SEQ ID NO: 335991 - protein, 9 aa, Influenza virus
IAKDNAIRF

SEQ ID NO: 335992 - protein, 9 aa, Influenza virus
DNAIRFGEG

SEQ ID NO: 335993 - protein, 9 aa, Influenza virus
NAIRFGEGE

SEQ ID NO: 335994 - protein, 9 aa, Influenza virus
AIRFGEGEQ

SEQ ID NO: 335995 - protein, 9 aa, Influenza virus
VRFGESEQI

SEQ ID NO: 335996 - protein, 9 aa, Influenza virus
RFGEGEQII

SEQ ID NO: 335997 - protein, 9 aa, Influenza virus
FGEGEQIIV

SEQ ID NO: 335998 - protein, 9 aa, Influenza virus
GEGEQIIVT

SEQ ID NO: 335999 - protein, 9 aa, Influenza virus
EGEQIIVTR

SEQ ID NO: 336000 - protein, 9 aa, Influenza virus
GEQIIVTRE

SEQ ID NO: 336001 - protein, 9 aa, Influenza virus
EPYVSCDPS

SEQ ID NO: 336002 - protein, 9 aa, Influenza virus
PYVSCDPTG

SEQ ID NO: 336003 - protein, 9 aa, Influenza virus
YVSCDPSGC

SEQ ID NO: 336004 - protein, 9 aa, Influenza virus
VSCDPTGCK

SEQ ID NO: 336005 - protein, 9 aa, Influenza virus
SCDPSGCKM

SEQ ID NO: 336006 - protein, 9 aa, Influenza virus
CDPSGCKMY

SEQ ID NO: 336007 - protein, 9 aa, Influenza virus
DPSGCKMYA

SEQ ID NO: 336008 - protein, 9 aa, Influenza virus
PSGCKMYAL

SEQ ID NO: 336009 - protein, 9 aa, Influenza virus
TGCKMYALH

SEQ ID NO: 336010 - protein, 9 aa, Influenza virus
GLMSTPLGS

SEQ ID NO: 336011 - protein, 9 aa, Influenza virus
LMSTPLGTP

SEQ ID NO: 336012 - protein, 9 aa, Influenza virus
MSTPLGTPP

SEQ ID NO: 336013 - protein, 9 aa, Influenza virus
STPLGTPPT

SEQ ID NO: 336014 - protein, 9 aa, Influenza virus
TPLGTPPTV

SEQ ID NO: 336015 - protein, 9 aa, Influenza virus
PLGTPPTVS

SEQ ID NO: 336016 - protein, 9 aa, Influenza virus
LGTPPTVSN

SEQ ID NO: 336017 - protein, 9 aa, Influenza virus
GTPPTVSNS

SEQ ID NO: 336018 - protein, 9 aa, Influenza virus
TPPTVSNSD

SEQ ID NO: 336019 - protein, 9 aa, Influenza virus
PPTVSNSDF

SEQ ID NO: 336020 - protein, 9 aa, Influenza virus
VSNSDFICV

SEQ ID NO: 336021 - protein, 9 aa, Influenza virus
SNSDFICVG

SEQ ID NO: 336022 - protein, 9 aa, Influenza virus
NSDFICVGW

SEQ ID NO: 336023 - protein, 9 aa, Influenza virus
SDFICVGWS

SEQ ID NO: 336024 - protein, 9 aa, Influenza virus
DFICVGWSS

SEQ ID NO: 336025 - protein, 9 aa, Influenza virus
FMCVGWSST

SEQ ID NO: 336026 - protein, 9 aa, Influenza virus
MCVGWSSTT

SEQ ID NO: 336027 - protein, 9 aa, Influenza virus
SSTTCHDGI

SEQ ID NO: 336028 - protein, 9 aa, Influenza virus
STTCHDGIG

SEQ ID NO: 336029 - protein, 9 aa, Influenza virus
TTCHDGIGR

SEQ ID NO: 336030 - protein, 9 aa, Influenza virus
TCHDGIGRM

SEQ ID NO: 336031 - protein, 9 aa, Influenza virus
GIGRMTICI

SEQ ID NO: 336032 - protein, 9 aa, Influenza virus
IGRMTICIQ

SEQ ID NO: 336033 - protein, 9 aa, Influenza virus
RMTICVQGK

SEQ ID NO: 336034 - protein, 9 aa, Influenza virus
MIICIQGNN

SEQ ID NO: 336035 - protein, 9 aa, Influenza virus
TICIQGNND

SEQ ID NO: 336036 - protein, 9 aa, Influenza virus
ICIQGNNDN

SEQ ID NO: 336037 - protein, 9 aa, Influenza virus
CIQGNNDNA

SEQ ID NO: 336038 - protein, 9 aa, Influenza virus
IQGNNDNAT

SEQ ID NO: 336039 - protein, 9 aa, Influenza virus
QGNNKNATA

SEQ ID NO: 336040 - protein, 9 aa, Influenza virus
GNNKNATAT

SEQ ID NO: 336041 - protein, 9 aa, Influenza virus
NNKNATATV

SEQ ID NO: 336042 - protein, 9 aa, Influenza virus
NKNATATVY

SEQ ID NO: 336043 - protein, 9 aa, Influenza virus
KNATATVYY

SEQ ID NO: 336044 - protein, 9 aa, Influenza virus
ATATVYYER

SEQ ID NO: 336045 - protein, 9 aa, Influenza virus
TATVYYNGR

SEQ ID NO: 336046 - protein, 9 aa, Influenza virus
ATVYYERRL

SEQ ID NO: 336047 - protein, 9 aa, Influenza virus
TVYYERRLT

SEQ ID NO: 336048 - protein, 9 aa, Influenza virus
VYYNGRLTT

SEQ ID NO: 336049 - protein, 9 aa, Influenza virus
YYNGRLTTT

SEQ ID NO: 336050 - protein, 9 aa, Influenza virus
YERRLTTTI

SEQ ID NO: 336051 - protein, 9 aa, Influenza virus
NRRPTTTIK

SEQ ID NO: 336052 - protein, 9 aa, Influenza virus
GRLTTTIKT

SEQ ID NO: 336053 - protein, 9 aa, Influenza virus
TTTIKPWAR

SEQ ID NO: 336054 - protein, 9 aa, Influenza virus
TTIKPWARN

SEQ ID NO: 336055 - protein, 9 aa, Influenza virus
TIKPWARNI

SEQ ID NO: 336056 - protein, 9 aa, Influenza virus
IKPWARNIL

SEQ ID NO: 336057 - protein, 9 aa, Influenza virus
KPWARNILR

SEQ ID NO: 336058 - protein, 9 aa, Influenza virus
PWARNILRT

SEQ ID NO: 336059 - protein, 9 aa, Influenza virus
WAGKILRTQ

SEQ ID NO: 336060 - protein, 9 aa, Influenza virus
AGKILRTQE

SEQ ID NO: 336061 - protein, 9 aa, Influenza virus
GKILRTQES

SEQ ID NO: 336062 - protein, 9 aa, Influenza virus
CHNGTCAVV

SEQ ID NO: 336063 - protein, 9 aa, Influenza virus
HNGTCAVVM

SEQ ID NO: 336064 - protein, 9 aa, Influenza virus
NGTCAVVMT

SEQ ID NO: 336065 - protein, 9 aa, Influenza virus
GTCAVVMTD

SEQ ID NO: 336066 - protein, 9 aa, Influenza virus
TCAVVMTDG

SEQ ID NO: 336067 - protein, 9 aa, Influenza virus
CAVVMTDGS

SEQ ID NO: 336068 - protein, 9 aa, Influenza virus
AVVMTDGSA

SEQ ID NO: 336069 - protein, 9 aa, Influenza virus
VIMTDGPAS

SEQ ID NO: 336070 - protein, 9 aa, Influenza virus
IMTDGPASS

SEQ ID NO: 336071 - protein, 9 aa, Influenza virus
MTDGPASSQ

SEQ ID NO: 336072 - protein, 9 aa, Influenza virus
TDGSANSQA

SEQ ID NO: 336073 - protein, 9 aa, Influenza virus
DGPANSQAY

SEQ ID NO: 336074 - protein, 9 aa, Influenza virus
GSANSQAYT

SEQ ID NO: 336075 - protein, 9 aa, Influenza virus
PANSQAYTK

SEQ ID NO: 336076 - protein, 9 aa, Influenza virus
ASSQAYTKI

SEQ ID NO: 336077 - protein, 9 aa, Influenza virus
QAYTKVMYF

SEQ ID NO: 336078 - protein, 9 aa, Influenza virus
AYTKVMYFH

SEQ ID NO: 336079 - protein, 9 aa, Influenza virus
YTKVMYFHK

SEQ ID NO: 336080 - protein, 9 aa, Influenza virus
TKILYFHKG

SEQ ID NO: 336081 - protein, 9 aa, Influenza virus
KVMYFHKGL

SEQ ID NO: 336082 - protein, 9 aa, Influenza virus
YFHKGIVIK

SEQ ID NO: 336083 - protein, 9 aa, Influenza virus
FHKGIVIKE

SEQ ID NO: 336084 - protein, 9 aa, Influenza virus
HKGIVIKEE

SEQ ID NO: 336085 - protein, 9 aa, Influenza virus
KEEVLKGSA

SEQ ID NO: 336086 - protein, 9 aa, Influenza virus
EEVLKGSAR

SEQ ID NO: 336087 - protein, 9 aa, Influenza virus
EVLKGSARH

SEQ ID NO: 336088 - protein, 9 aa, Influenza virus
LQGSARHIE

SEQ ID NO: 336089 - protein, 9 aa, Influenza virus
QGSARHIEE

SEQ ID NO: 336090 - protein, 9 aa, Influenza virus
SARHIEECP

SEQ ID NO: 336091 - protein, 9 aa, Influenza virus
ARHIEECPC

SEQ ID NO: 336092 - protein, 9 aa, Influenza virus
RHIEECPCY

SEQ ID NO: 336093 - protein, 9 aa, Influenza virus
EECSCYGHS

SEQ ID NO: 336094 - protein, 9 aa, Influenza virus
ECSCYGHNQ

SEQ ID NO: 336095 - protein, 9 aa, Influenza virus
CSCYGHNQK

SEQ ID NO: 336096 - protein, 9 aa, Influenza virus
CYGHNQKIT

SEQ ID NO: 336097 - protein, 9 aa, Influenza virus
YGHNQKITC

SEQ ID NO: 336098 - protein, 9 aa, Influenza virus
QKITCVCRD

SEQ ID NO: 336099 - protein, 9 aa, Influenza virus
KATCVCRDN

SEQ ID NO: 336100 - protein, 9 aa, Influenza virus
VTCICRDNW

SEQ ID NO: 336101 - protein, 9 aa, Influenza virus
QGANRPVIK

SEQ ID NO: 336102 - protein, 9 aa, Influenza virus
GANRPVIKI

SEQ ID NO: 336103 - protein, 9 aa, Influenza virus
ANRPIIEID

SEQ ID NO: 336104 - protein, 9 aa, Influenza virus
NRPIIEIDM

SEQ ID NO: 336105 - protein, 9 aa, Influenza virus
VMEHTSQYL

SEQ ID NO: 336106 - protein, 9 aa, Influenza virus
MKHTSQYLC

SEQ ID NO: 336107 - protein, 9 aa, Influenza virus
DHTSQYLCT

SEQ ID NO: 336108 - protein, 9 aa, Influenza virus
TSQYLCTGI

SEQ ID NO: 336109 - protein, 9 aa, Influenza virus
SQYLCTGIL

SEQ ID NO: 336110 - protein, 9 aa, Influenza virus
QYLCTGILT

SEQ ID NO: 336111 - protein, 9 aa, Influenza virus
YLCTGILTD

SEQ ID NO: 336112 - protein, 9 aa, Influenza virus
LCTGILTDT

SEQ ID NO: 336113 - protein, 9 aa, Influenza virus
ILTDTSRPS

SEQ ID NO: 336114 - protein, 9 aa, Influenza virus
TDTSKPSDK

SEQ ID NO: 336115 - protein, 9 aa, Influenza virus
SNPITGSPS

SEQ ID NO: 336116 - protein, 9 aa, Influenza virus
VKGFGFLDG

SEQ ID NO: 336117 - protein, 9 aa, Influenza virus
DNTWLGRTI

SEQ ID NO: 336118 - protein, 9 aa, Influenza virus
WLGRTFSPR

SEQ ID NO: 336119 - protein, 9 aa, Influenza virus
LGGTISPRS

SEQ ID NO: 336120 - protein, 9 aa, Influenza virus
GRTFSPRSR

SEQ ID NO: 336121 - protein, 9 aa, Influenza virus
RTFSPRSRS

SEQ ID NO: 336122 - protein, 9 aa, Influenza virus
EMLKVPNAG

SEQ ID NO: 336123 - protein, 9 aa, Influenza virus
MLKVPNAGT

SEQ ID NO: 336124 - protein, 9 aa, Influenza virus
LKVPNAGTD

SEQ ID NO: 336125 - protein, 9 aa, Influenza virus
KVPNAGTDP

SEQ ID NO: 336126 - protein, 9 aa, Influenza virus
IPNAETDPS

SEQ ID NO: 336127 - protein, 9 aa, Influenza virus
PNAETDPSS

SEQ ID NO: 336128 - protein, 9 aa, Influenza virus
TGRQEIVDN

SEQ ID NO: 336129 - protein, 9 aa, Influenza virus
GRQEIVDNN

SEQ ID NO: 336130 - protein, 9 aa, Influenza virus
NSDWSGYSG

SEQ ID NO: 336131 - protein, 9 aa, Influenza virus
SDWSGYSGS

SEQ ID NO: 336132 - protein, 9 aa, Influenza virus
NLSGYSGSF

SEQ ID NO: 336133 - protein, 9 aa, Influenza virus
GSFIDYWND

SEQ ID NO: 336134 - protein, 9 aa, Influenza virus
SVCYNPCFY

SEQ ID NO: 336135 - protein, 9 aa, Influenza virus
ACYNPCFYV

SEQ ID NO: 336136 - protein, 9 aa, Influenza virus
LIALCGSPF

SEQ ID NO: 336137 - protein, 9 aa, Influenza virus
VALCGSPVP

SEQ ID NO: 336138 - protein, 9 aa, Influenza virus
ALCGSPVPV

SEQ ID NO: 336139 - protein, 9 aa, Influenza virus
LCGSPVPVG

SEQ ID NO: 336140 - protein, 9 aa, Influenza virus
CGSPVPVGS

SEQ ID NO: 336141 - protein, 9 aa, Influenza virus
GSPVPVGSG

SEQ ID NO: 336142 - protein, 9 aa, Influenza virus
SPVPVGSGS

SEQ ID NO: 336143 - protein, 9 aa, Influenza virus
PVPVGSGSF

SEQ ID NO: 336144 - protein, 9 aa, Influenza virus
VPVGSGSFP

SEQ ID NO: 336145 - protein, 9 aa, Influenza virus
SGSFPNGAQ

SEQ ID NO: 336146 - protein, 9 aa, Influenza virus
GSFPDGAKI

SEQ ID NO: 336147 - protein, 9 aa, Influenza virus
SFPDGARIQ

SEQ ID NO: 336148 - protein, 9 aa, Influenza virus
FPDGARIQY

SEQ ID NO: 336149 - protein, 9 aa, Influenza virus
PNGAQIQYF

SEQ ID NO: 336150 - protein, 9 aa, Influenza virus
NGAQIQYFS

SEQ ID NO: 336151 - protein, 9 aa, Influenza virus
RADEICIGY

SEQ ID NO: 336152 - protein, 9 aa, Influenza virus
ADEICIGHL

SEQ ID NO: 336153 - protein, 9 aa, Influenza virus
DEICIGHLS

SEQ ID NO: 336154 - protein, 9 aa, Influenza virus
KICIGYLSN

SEQ ID NO: 336155 - protein, 9 aa, Influenza virus
GYMSNNSTE

SEQ ID NO: 336156 - protein, 9 aa, Influenza virus
YLSNNSTER

SEQ ID NO: 336157 - protein, 9 aa, Influenza virus
LSNNSTERV

SEQ ID NO: 336158 - protein, 9 aa, Influenza virus
SNNSTDKVN

SEQ ID NO: 336159 - protein, 9 aa, Influenza virus
NNSTDKVNT

SEQ ID NO: 336160 - protein, 9 aa, Influenza virus
NSTDKVNTI

SEQ ID NO: 336161 - protein, 9 aa, Influenza virus
STDKVNTII

SEQ ID NO: 336162 - protein, 9 aa, Influenza virus
TDKVNTIIE

SEQ ID NO: 336163 - protein, 9 aa, Influenza virus
DKVNTIIEN

SEQ ID NO: 336164 - protein, 9 aa, Influenza virus
KVNTIIENN

SEQ ID NO: 336165 - protein, 9 aa, Influenza virus
VNTIIENNV

SEQ ID NO: 336166 - protein, 9 aa, Influenza virus
NTIIENNVT

SEQ ID NO: 336167 - protein, 9 aa, Influenza virus
IESNITVTS

SEQ ID NO: 336168 - protein, 9 aa, Influenza virus
ESNVTVTNS

SEQ ID NO: 336169 - protein, 9 aa, Influenza virus
SNVTVTSSI

SEQ ID NO: 336170 - protein, 9 aa, Influenza virus
NITVTSSVE

SEQ ID NO: 336171 - protein, 9 aa, Influenza virus
ITVTSSVEL

SEQ ID NO: 336172 - protein, 9 aa, Influenza virus
TSSIELVEN

SEQ ID NO: 336173 - protein, 9 aa, Influenza virus
YTGSFCSID

SEQ ID NO: 336174 - protein, 9 aa, Influenza virus
TGTFCSING

SEQ ID NO: 336175 - protein, 9 aa, Influenza virus
GSFCSINGR

SEQ ID NO: 336176 - protein, 9 aa, Influenza virus
FCSINGKAP

SEQ ID NO: 336177 - protein, 9 aa, Influenza virus
CSINGKAPI

SEQ ID NO: 336178 - protein, 9 aa, Influenza virus
SINGKAPIS

SEQ ID NO: 336179 - protein, 9 aa, Influenza virus
INGKAPISL

SEQ ID NO: 336180 - protein, 9 aa, Influenza virus
NGKAPISLG

SEQ ID NO: 336181 - protein, 9 aa, Influenza virus
GKEPISLGD

SEQ ID NO: 336182 - protein, 9 aa, Influenza virus
KEPISLGDC

SEQ ID NO: 336183 - protein, 9 aa, Influenza virus
EPISLGDCS

SEQ ID NO: 336184 - protein, 9 aa, Influenza virus
GDCSFTGWI

SEQ ID NO: 336185 - protein, 9 aa, Influenza virus
GCSFAGWIL

SEQ ID NO: 336186 - protein, 9 aa, Influenza virus
AGWLLGNPM

SEQ ID NO: 336187 - protein, 9 aa, Influenza virus
ILGNPRCDD

SEQ ID NO: 336188 - protein, 9 aa, Influenza virus
LGNPRCDDL

SEQ ID NO: 336189 - protein, 9 aa, Influenza virus
GNPRCDDLI

SEQ ID NO: 336190 - protein, 9 aa, Influenza virus
NPRCDDLIG

SEQ ID NO: 336191 - protein, 9 aa, Influenza virus
PRCDDLIGK

SEQ ID NO: 336192 - protein, 9 aa, Influenza virus
CDNLIGKTS

SEQ ID NO: 336193 - protein, 9 aa, Influenza virus
DNLIGKTSW

SEQ ID NO: 336194 - protein, 9 aa, Influenza virus
NLIGKTSWS

SEQ ID NO: 336195 - protein, 9 aa, Influenza virus
SWSYIVEKS

SEQ ID NO: 336196 - protein, 9 aa, Influenza virus
WSYIVERPN

SEQ ID NO: 336197 - protein, 9 aa, Influenza virus
SYIVERPNP

SEQ ID NO: 336198 - protein, 9 aa, Influenza virus
NPVNGICYP

SEQ ID NO: 336199 - protein, 9 aa, Influenza virus
PVNGICYPG

SEQ ID NO: 336200 - protein, 9 aa, Influenza virus
NGICYPGIL

SEQ ID NO: 336201 - protein, 9 aa, Influenza virus
GICYPGILE

SEQ ID NO: 336202 - protein, 9 aa, Influenza virus
AFFRNMVWL

SEQ ID NO: 336203 - protein, 9 aa, Influenza virus
FFRNMIWLI

SEQ ID NO: 336204 - protein, 9 aa, Influenza virus
WLIHQSETY

SEQ ID NO: 336205 - protein, 9 aa, Influenza virus
LIHQSETYP

SEQ ID NO: 336206 - protein, 9 aa, Influenza virus
HQSGTYPII

SEQ ID NO: 336207 - protein, 9 aa, Influenza virus
FNNTKGRYV

SEQ ID NO: 336208 - protein, 9 aa, Influenza virus
NNTKGGDVL

SEQ ID NO: 336209 - protein, 9 aa, Influenza virus
LYKKDNSYV

SEQ ID NO: 336210 - protein, 9 aa, Influenza virus
AGRMTFYWA

SEQ ID NO: 336211 - protein, 9 aa, Influenza virus
GRMTFYWTM

SEQ ID NO: 336212 - protein, 9 aa, Influenza virus
RMTFYWTMV

SEQ ID NO: 336213 - protein, 9 aa, Influenza virus
TFESDGAFL

SEQ ID NO: 336214 - protein, 9 aa, Influenza virus
FESDGAFLA

SEQ ID NO: 336215 - protein, 9 aa, Influenza virus
ESDGAFLAP

SEQ ID NO: 336216 - protein, 9 aa, Influenza virus
SDGAFLAPR

SEQ ID NO: 336217 - protein, 9 aa, Influenza virus
DGAFLAPRY

SEQ ID NO: 336218 - protein, 9 aa, Influenza virus
GVFLAPRYA

SEQ ID NO: 336219 - protein, 9 aa, Influenza virus
FLAPRYSFE

SEQ ID NO: 336220 - protein, 9 aa, Influenza virus
IAPRYAFEL

SEQ ID NO: 336221 - protein, 9 aa, Influenza virus
APRYSFELV

SEQ ID NO: 336222 - protein, 9 aa, Influenza virus
PRYAFELVF

SEQ ID NO: 336223 - protein, 9 aa, Influenza virus
KCQTEVGGI

SEQ ID NO: 336224 - protein, 9 aa, Influenza virus
CQTEVGGIN

SEQ ID NO: 336225 - protein, 9 aa, Influenza virus
QTEVGGINT

SEQ ID NO: 336226 - protein, 9 aa, Influenza virus
HNVHRSTIG

SEQ ID NO: 336227 - protein, 9 aa, Influenza virus
SVHRNTFGD

SEQ ID NO: 336228 - protein, 9 aa, Influenza virus
VHRNAIGDC

SEQ ID NO: 336229 - protein, 9 aa, Influenza virus
HRSTIGDCP

SEQ ID NO: 336230 - protein, 9 aa, Influenza virus
RNTFGDCPK

SEQ ID NO: 336231 - protein, 9 aa, Influenza virus
NTFGDCPKY

SEQ ID NO: 336232 - protein, 9 aa, Influenza virus
TFGDCPKYV

SEQ ID NO: 336233 - protein, 9 aa, Influenza virus
IGNCPKYVN

SEQ ID NO: 336234 - protein, 9 aa, Influenza virus
GDCPKYVNI

SEQ ID NO: 336235 - protein, 9 aa, Influenza virus
DCPKYMNVK

SEQ ID NO: 336236 - protein, 9 aa, Influenza virus
CPKYMNVKS

SEQ ID NO: 336237 - protein, 9 aa, Influenza virus
PKYVNVRSL

SEQ ID NO: 336238 - protein, 9 aa, Influenza virus
KYMNVKSLK

SEQ ID NO: 336239 - protein, 9 aa, Influenza virus
YMNVKSLKL

SEQ ID NO: 336240 - protein, 9 aa, Influenza virus
MNVKSLKLA

SEQ ID NO: 336241 - protein, 9 aa, Influenza virus
NIKSLKLAT

SEQ ID NO: 336242 - protein, 9 aa, Influenza virus
IKSLKLATG

SEQ ID NO: 336243 - protein, 9 aa, Influenza virus
RSLKLATGL

SEQ ID NO: 336244 - protein, 9 aa, Influenza virus
SLKLASGLR

SEQ ID NO: 336245 - protein, 9 aa, Influenza virus
LKLASGLRN

SEQ ID NO: 336246 - protein, 9 aa, Influenza virus
KLATGPRNV

SEQ ID NO: 336247 - protein, 9 aa, Influenza virus
LATGPRNVP

SEQ ID NO: 336248 - protein, 9 aa, Influenza virus
ATGPRNVPA

SEQ ID NO: 336249 - protein, 9 aa, Influenza virus
TGPRNVPAI

SEQ ID NO: 336250 - protein, 9 aa, Influenza virus
GPRNVPAIA

SEQ ID NO: 336251 - protein, 9 aa, Influenza virus
ARGLFGAIA

SEQ ID NO: 336252 - protein, 9 aa, Influenza virus
HRNDEGTGI

SEQ ID NO: 336253 - protein, 9 aa, Influenza virus
RDEEGTGIA

SEQ ID NO: 336254 - protein, 9 aa, Influenza virus
DEEGTGIAA

SEQ ID NO: 336255 - protein, 9 aa, Influenza virus
AADKESTQT

SEQ ID NO: 336256 - protein, 9 aa, Influenza virus
ADKESTQTA

SEQ ID NO: 336257 - protein, 9 aa, Influenza virus
IEEGINQLS

SEQ ID NO: 336258 - protein, 9 aa, Influenza virus
DIWSYNAKL

SEQ ID NO: 336259 - protein, 9 aa, Influenza virus
LWSYNAQLL

SEQ ID NO: 336260 - protein, 9 aa, Influenza virus
SYNARLLVL

SEQ ID NO: 336261 - protein, 9 aa, Influenza virus
YNAKLLVLL

SEQ ID NO: 336262 - protein, 9 aa, Influenza virus
NAKLLVLLE

SEQ ID NO: 336263 - protein, 9 aa, Influenza virus
AKLLVLLEN

SEQ ID NO: 336264 - protein, 9 aa, Influenza virus
KLLVLLENE

SEQ ID NO: 336265 - protein, 9 aa, Influenza virus
DLHDSNVKN

SEQ ID NO: 336266 - protein, 9 aa, Influenza virus
LHDSNVKNL

SEQ ID NO: 336267 - protein, 9 aa, Influenza virus
HDSNVKNLH

SEQ ID NO: 336268 - protein, 9 aa, Influenza virus
DSNVTNLHE

SEQ ID NO: 336269 - protein, 9 aa, Influenza virus
SNVRSLHEK

SEQ ID NO: 336270 - protein, 9 aa, Influenza virus
LHEKVRRIL

SEQ ID NO: 336271 - protein, 9 aa, Influenza virus
LKGNAKDEG

SEQ ID NO: 336272 - protein, 9 aa, Influenza virus
KGNAKDEGN

SEQ ID NO: 336273 - protein, 9 aa, Influenza virus
NNAKDEGNG

SEQ ID NO: 336274 - protein, 9 aa, Influenza virus
CFPFYHKCD

SEQ ID NO: 336275 - protein, 9 aa, Influenza virus
FTFYHKCNN

SEQ ID NO: 336276 - protein, 9 aa, Influenza virus
FYHKCDDEC

SEQ ID NO: 336277 - protein, 9 aa, Influenza virus
YHKCDDECI

SEQ ID NO: 336278 - protein, 9 aa, Influenza virus
HKCDDECIE

SEQ ID NO: 336279 - protein, 9 aa, Influenza virus
NKCIERVRN

SEQ ID NO: 336280 - protein, 9 aa, Influenza virus
KCIERVRNG

SEQ ID NO: 336281 - protein, 9 aa, Influenza virus
CIEKIRNGT

SEQ ID NO: 336282 - protein, 9 aa, Influenza virus
IEKIRNGTY

SEQ ID NO: 336283 - protein, 9 aa, Influenza virus
EKIRNGTYD

SEQ ID NO: 336284 - protein, 9 aa, Influenza virus
KIRNGTYDH

SEQ ID NO: 336285 - protein, 9 aa, Influenza virus
TYDHKDFEE

SEQ ID NO: 336286 - protein, 9 aa, Influenza virus
YDHKEFKEE

SEQ ID NO: 336287 - protein, 9 aa, Influenza virus
DHKDFEEES

SEQ ID NO: 336288 - protein, 9 aa, Influenza virus
HKEFEKESR

SEQ ID NO: 336289 - protein, 9 aa, Influenza virus
EESRLNRQE

SEQ ID NO: 336290 - protein, 9 aa, Influenza virus
ESRLNRQEI

SEQ ID NO: 336291 - protein, 9 aa, Influenza virus
SRLNRQEIE

SEQ ID NO: 336292 - protein, 9 aa, Influenza virus
RLNRQEIEG

SEQ ID NO: 336293 - protein, 9 aa, Influenza virus
LNRQEIGGV

SEQ ID NO: 336294 - protein, 9 aa, Influenza virus
NRQEIGGVK

SEQ ID NO: 336295 - protein, 9 aa, Influenza virus
RQEIGGVKL

SEQ ID NO: 336296 - protein, 9 aa, Influenza virus
QEIEGVRLD

SEQ ID NO: 336297 - protein, 9 aa, Influenza virus
GDVYKILSI

SEQ ID NO: 336298 - protein, 9 aa, Influenza virus
NVYKILSIC

SEQ ID NO: 336299 - protein, 9 aa, Influenza virus
YSCVASSLV

SEQ ID NO: 336300 - protein, 9 aa, Influenza virus
ASSLILAAI

SEQ ID NO: 336301 - protein, 9 aa, Influenza virus
SSLILAAII

SEQ ID NO: 336302 - protein, 9 aa, Influenza virus
SLILAAIIM

SEQ ID NO: 336303 - protein, 9 aa, Influenza virus
LILAAIIMG

SEQ ID NO: 336304 - protein, 9 aa, Influenza virus
WACNNGSCR

SEQ ID NO: 336305 - protein, 9 aa, Influenza virus
ACNNGSCRC

SEQ ID NO: 336306 - protein, 9 aa, Influenza virus
CGNGSCRCT

SEQ ID NO: 336307 - protein, 9 aa, Influenza virus
GNGSCRCTI

SEQ ID NO: 336308 - protein, 9 aa, Influenza virus
MEKFITLST

SEQ ID NO: 336309 - protein, 9 aa, Influenza virus
VAYDKICIG

SEQ ID NO: 336310 - protein, 9 aa, Influenza virus
STETVNTLS

SEQ ID NO: 336311 - protein, 9 aa, Influenza virus
TETVNTLSE

SEQ ID NO: 336312 - protein, 9 aa, Influenza virus
ETVNTLSEQ

SEQ ID NO: 336313 - protein, 9 aa, Influenza virus
TVNTLTEQN

SEQ ID NO: 336314 - protein, 9 aa, Influenza virus
VNTLTEQNV

SEQ ID NO: 336315 - protein, 9 aa, Influenza virus
NTLTEQNVP

SEQ ID NO: 336316 - protein, 9 aa, Influenza virus
TLTEQNVPV

SEQ ID NO: 336317 - protein, 9 aa, Influenza virus
LTEQNVPVT

SEQ ID NO: 336318 - protein, 9 aa, Influenza virus
TEQNVPVTQ

SEQ ID NO: 336319 - protein, 9 aa, Influenza virus
QVEELVHRG

SEQ ID NO: 336320 - protein, 9 aa, Influenza virus
VEELVHGGV

SEQ ID NO: 336321 - protein, 9 aa, Influenza virus
EELVHGGVD

SEQ ID NO: 336322 - protein, 9 aa, Influenza virus
ELVHGGVDP

SEQ ID NO: 336323 - protein, 9 aa, Influenza virus
TKLGSPLVL

SEQ ID NO: 336324 - protein, 9 aa, Influenza virus
KLGSPLVLD

SEQ ID NO: 336325 - protein, 9 aa, Influenza virus
LDDCSLKGL

SEQ ID NO: 336326 - protein, 9 aa, Influenza virus
DDCSLEGLV

SEQ ID NO: 336327 - protein, 9 aa, Influenza virus
DCSLKGLIL

SEQ ID NO: 336328 - protein, 9 aa, Influenza virus
CSLEGLVLG

SEQ ID NO: 336329 - protein, 9 aa, Influenza virus
SLKGLILGN

SEQ ID NO: 336330 - protein, 9 aa, Influenza virus
LEGLILSNP

SEQ ID NO: 336331 - protein, 9 aa, Influenza virus
EGLILSNPK

SEQ ID NO: 336332 - protein, 9 aa, Influenza virus
GLILSNPKC

SEQ ID NO: 336333 - protein, 9 aa, Influenza virus
LILSNPKCD

SEQ ID NO: 336334 - protein, 9 aa, Influenza virus
VLGNPKCDL

SEQ ID NO: 336335 - protein, 9 aa, Influenza virus
LSNPKCDLY

SEQ ID NO: 336336 - protein, 9 aa, Influenza virus
SNPKCDLYL

SEQ ID NO: 336337 - protein, 9 aa, Influenza virus
NPKCDLYLS

SEQ ID NO: 336338 - protein, 9 aa, Influenza virus
PKCDLYLSG

SEQ ID NO: 336339 - protein, 9 aa, Influenza virus
KCDLYLSGR

SEQ ID NO: 336340 - protein, 9 aa, Influenza virus
CDLYLSGRE

SEQ ID NO: 336341 - protein, 9 aa, Influenza virus
DLYLSGREW

SEQ ID NO: 336342 - protein, 9 aa, Influenza virus
LYLSGREWS

SEQ ID NO: 336343 - protein, 9 aa, Influenza virus
YIVERPKEI

SEQ ID NO: 336344 - protein, 9 aa, Influenza virus
IVERPKEIE

SEQ ID NO: 336345 - protein, 9 aa, Influenza virus
VERPKEIEG

SEQ ID NO: 336346 - protein, 9 aa, Influenza virus
ERTKEMEGI

SEQ ID NO: 336347 - protein, 9 aa, Influenza virus
RTKEMEGIC

SEQ ID NO: 336348 - protein, 9 aa, Influenza virus
TKEMEGICY

SEQ ID NO: 336349 - protein, 9 aa, Influenza virus
KEIEGICYP

SEQ ID NO: 336350 - protein, 9 aa, Influenza virus
EIEGICYPG

SEQ ID NO: 336351 - protein, 9 aa, Influenza virus
IEGICYPGS

SEQ ID NO: 336352 - protein, 9 aa, Influenza virus
EGICYPGSV

SEQ ID NO: 336353 - protein, 9 aa, Influenza virus
GVCYPGSIK

SEQ ID NO: 336354 - protein, 9 aa, Influenza virus
VCYPGSIKN

SEQ ID NO: 336355 - protein, 9 aa, Influenza virus
CYPGSIKNQ

SEQ ID NO: 336356 - protein, 9 aa, Influenza virus
YPGSVENQE

SEQ ID NO: 336357 - protein, 9 aa, Influenza virus
PGSVENQEE

SEQ ID NO: 336358 - protein, 9 aa, Influenza virus
GSVENQEEL

SEQ ID NO: 336359 - protein, 9 aa, Influenza virus
SIKNQEELR

SEQ ID NO: 336360 - protein, 9 aa, Influenza virus
IKNQEELRS

SEQ ID NO: 336361 - protein, 9 aa, Influenza virus
ENQEELKSL

SEQ ID NO: 336362 - protein, 9 aa, Influenza virus
NQEELKSLF

SEQ ID NO: 336363 - protein, 9 aa, Influenza virus
QEELKSLFS

SEQ ID NO: 336364 - protein, 9 aa, Influenza virus
EELKSLFSS

SEQ ID NO: 336365 - protein, 9 aa, Influenza virus
ELKSLFSSI

SEQ ID NO: 336366 - protein, 9 aa, Influenza virus
LKSLFSSIK

SEQ ID NO: 336367 - protein, 9 aa, Influenza virus
RSLFSSIKR

SEQ ID NO: 336368 - protein, 9 aa, Influenza virus
SLFSSIKRY

SEQ ID NO: 336369 - protein, 9 aa, Influenza virus
ERVKMFDFI

SEQ ID NO: 336370 - protein, 9 aa, Influenza virus
RVKMFDFIK

SEQ ID NO: 336371 - protein, 9 aa, Influenza virus
VKMFDFIKW

SEQ ID NO: 336372 - protein, 9 aa, Influenza virus
KMFDFIKWN

SEQ ID NO: 336373 - protein, 9 aa, Influenza virus
MFDFIKWNV

SEQ ID NO: 336374 - protein, 9 aa, Influenza virus
FDFIKWNVT

SEQ ID NO: 336375 - protein, 9 aa, Influenza virus
DFIKWNVTY

SEQ ID NO: 336376 - protein, 9 aa, Influenza virus
FTKWNVTHT

SEQ ID NO: 336377 - protein, 9 aa, Influenza virus
IKWNVTYTG

SEQ ID NO: 336378 - protein, 9 aa, Influenza virus
KWNVTHTGT

SEQ ID NO: 336379 - protein, 9 aa, Influenza virus
WNVTHTGTS

SEQ ID NO: 336380 - protein, 9 aa, Influenza virus
NVTYTGISK

SEQ ID NO: 336381 - protein, 9 aa, Influenza virus
VTYTGISKA

SEQ ID NO: 336382 - protein, 9 aa, Influenza virus
TYTGISKAC

SEQ ID NO: 336383 - protein, 9 aa, Influenza virus
YTGISKACN

SEQ ID NO: 336384 - protein, 9 aa, Influenza virus
SRACNNTSN

SEQ ID NO: 336385 - protein, 9 aa, Influenza virus
TSNRGSFYR

SEQ ID NO: 336386 - protein, 9 aa, Influenza virus
SNRGSFYRS

SEQ ID NO: 336387 - protein, 9 aa, Influenza virus
NQGSFYRNM

SEQ ID NO: 336388 - protein, 9 aa, Influenza virus
RGSFYRSMR

SEQ ID NO: 336389 - protein, 9 aa, Influenza virus
GSFYRNMRW

SEQ ID NO: 336390 - protein, 9 aa, Influenza virus
SFYRSIRWL

SEQ ID NO: 336391 - protein, 9 aa, Influenza virus
FYRNMRWLT

SEQ ID NO: 336392 - protein, 9 aa, Influenza virus
YRNMRWLTL

SEQ ID NO: 336393 - protein, 9 aa, Influenza virus
RSIRWLTLK

SEQ ID NO: 336394 - protein, 9 aa, Influenza virus
SIRWLTLKS

SEQ ID NO: 336395 - protein, 9 aa, Influenza virus
MRWLTLKLG

SEQ ID NO: 336396 - protein, 9 aa, Influenza virus
RWLTLKLGQ

SEQ ID NO: 336397 - protein, 9 aa, Influenza virus
WLTLKLGQF

SEQ ID NO: 336398 - protein, 9 aa, Influenza virus
LTLKLGQFP

SEQ ID NO: 336399 - protein, 9 aa, Influenza virus
TLKLGQFPV

SEQ ID NO: 336400 - protein, 9 aa, Influenza virus
LKLGQFPVQ

SEQ ID NO: 336401 - protein, 9 aa, Influenza virus
KLGQFPVQT

SEQ ID NO: 336402 - protein, 9 aa, Influenza virus
LGQFPVQTD

SEQ ID NO: 336403 - protein, 9 aa, Influenza virus
EYKNTGDSD

SEQ ID NO: 336404 - protein, 9 aa, Influenza virus
YKNTRDSNI

SEQ ID NO: 336405 - protein, 9 aa, Influenza virus
FIWAIHHPP

SEQ ID NO: 336406 - protein, 9 aa, Influenza virus
IWAIHHPPT

SEQ ID NO: 336407 - protein, 9 aa, Influenza virus
AIHHPPTTD

SEQ ID NO: 336408 - protein, 9 aa, Influenza virus
IHHPPTTDE

SEQ ID NO: 336409 - protein, 9 aa, Influenza virus
HHPPTTDEQ

SEQ ID NO: 336410 - protein, 9 aa, Influenza virus
HPPTSDEQI

SEQ ID NO: 336411 - protein, 9 aa, Influenza virus
EINRIFRPN

SEQ ID NO: 336412 - protein, 9 aa, Influenza virus
INRIFRPNI

SEQ ID NO: 336413 - protein, 9 aa, Influenza virus
NRIFRPNIG

SEQ ID NO: 336414 - protein, 9 aa, Influenza virus
RIFRPNIGP

SEQ ID NO: 336415 - protein, 9 aa, Influenza virus
IFRPNIGPR

SEQ ID NO: 336416 - protein, 9 aa, Influenza virus
RPNIGPRPL

SEQ ID NO: 336417 - protein, 9 aa, Influenza virus
PNIGPRPLI

SEQ ID NO: 336418 - protein, 9 aa, Influenza virus
NIGPRPLIR

SEQ ID NO: 336419 - protein, 9 aa, Influenza virus
IGPRPLVRE

SEQ ID NO: 336420 - protein, 9 aa, Influenza virus
GPRPLVREQ

SEQ ID NO: 336421 - protein, 9 aa, Influenza virus
PRPLVREQQ

SEQ ID NO: 336422 - protein, 9 aa, Influenza virus
RPLVREQQG

SEQ ID NO: 336423 - protein, 9 aa, Influenza virus
PLVREQQGR

SEQ ID NO: 336424 - protein, 9 aa, Influenza virus
LVREQQGRM

SEQ ID NO: 336425 - protein, 9 aa, Influenza virus
VMGQQGRMD

SEQ ID NO: 336426 - protein, 9 aa, Influenza virus
MGQQGRMDY

SEQ ID NO: 336427 - protein, 9 aa, Influenza virus
GQTVKIKTN

SEQ ID NO: 336428 - protein, 9 aa, Influenza virus
QTVKIKTNG

SEQ ID NO: 336429 - protein, 9 aa, Influenza virus
TVKIKTNGN

SEQ ID NO: 336430 - protein, 9 aa, Influenza virus
VKIQTSGNL

SEQ ID NO: 336431 - protein, 9 aa, Influenza virus
KIKTNGNLI

SEQ ID NO: 336432 - protein, 9 aa, Influenza virus
IQTSGNLIA

SEQ ID NO: 336433 - protein, 9 aa, Influenza virus
KTNGNLIAP

SEQ ID NO: 336434 - protein, 9 aa, Influenza virus
IAPEYGYLI

SEQ ID NO: 336435 - protein, 9 aa, Influenza virus
APEYGYLIT

SEQ ID NO: 336436 - protein, 9 aa, Influenza virus
PEYGYLITG

SEQ ID NO: 336437 - protein, 9 aa, Influenza virus
EYGYLITGK

SEQ ID NO: 336438 - protein, 9 aa, Influenza virus
YGYLITGKS

SEQ ID NO: 336439 - protein, 9 aa, Influenza virus
GHLTTGKSH

SEQ ID NO: 336440 - protein, 9 aa, Influenza virus
YLITGKSHG

SEQ ID NO: 336441 - protein, 9 aa, Influenza virus
LTTGKSHGR

SEQ ID NO: 336442 - protein, 9 aa, Influenza virus
VTGKSHGRI

SEQ ID NO: 336443 - protein, 9 aa, Influenza virus
SHGRVLKNN

SEQ ID NO: 336444 - protein, 9 aa, Influenza virus
HGRVLKNNL

SEQ ID NO: 336445 - protein, 9 aa, Influenza virus
GRVLKNNLP

SEQ ID NO: 336446 - protein, 9 aa, Influenza virus
TKCQLNEGV

SEQ ID NO: 336447 - protein, 9 aa, Influenza virus
GCQLNEGVM

SEQ ID NO: 336448 - protein, 9 aa, Influenza virus
CQLNEGVIN

SEQ ID NO: 336449 - protein, 9 aa, Influenza virus
QLNEGVINT

SEQ ID NO: 336450 - protein, 9 aa, Influenza virus
LNEGIMNTS

SEQ ID NO: 336451 - protein, 9 aa, Influenza virus
NEGVINTSK

SEQ ID NO: 336452 - protein, 9 aa, Influenza virus
EGVINTSKP

SEQ ID NO: 336453 - protein, 9 aa, Influenza virus
GVMNTSKPL

SEQ ID NO: 336454 - protein, 9 aa, Influenza virus
VINTSKPFQ

SEQ ID NO: 336455 - protein, 9 aa, Influenza virus
INTSKPFQN

SEQ ID NO: 336456 - protein, 9 aa, Influenza virus
NTSKPLQNT

SEQ ID NO: 336457 - protein, 9 aa, Influenza virus
TSKPFQNIC

SEQ ID NO: 336458 - protein, 9 aa, Influenza virus
SKPFQNTSR

SEQ ID NO: 336459 - protein, 9 aa, Influenza virus
KPFQNTSRH

SEQ ID NO: 336460 - protein, 9 aa, Influenza virus
PFQNTSRHY

SEQ ID NO: 336461 - protein, 9 aa, Influenza virus
FQNICKPYI

SEQ ID NO: 336462 - protein, 9 aa, Influenza virus
QNTSRHYIG

SEQ ID NO: 336463 - protein, 9 aa, Influenza virus
NTSRHYIGK

SEQ ID NO: 336464 - protein, 9 aa, Influenza virus
TSRHYIGKC

SEQ ID NO: 336465 - protein, 9 aa, Influenza virus
SRHYIGKCP

SEQ ID NO: 336466 - protein, 9 aa, Influenza virus
KPYIGKCPK

SEQ ID NO: 336467 - protein, 9 aa, Influenza virus
PYIGKCPKY

SEQ ID NO: 336468 - protein, 9 aa, Influenza virus
IGKCPKYIS

SEQ ID NO: 336469 - protein, 9 aa, Influenza virus
GKCPKYISS

SEQ ID NO: 336470 - protein, 9 aa, Influenza virus
KCPRYIPSG

SEQ ID NO: 336471 - protein, 9 aa, Influenza virus
CPRYIPSGS

SEQ ID NO: 336472 - protein, 9 aa, Influenza virus
PRYIPSGSL

SEQ ID NO: 336473 - protein, 9 aa, Influenza virus
RYIPSGSLK

SEQ ID NO: 336474 - protein, 9 aa, Influenza virus
YIPSRSLKL

SEQ ID NO: 336475 - protein, 9 aa, Influenza virus
ISSGSLKLA

SEQ ID NO: 336476 - protein, 9 aa, Influenza virus
PSRSLKLAI

SEQ ID NO: 336477 - protein, 9 aa, Influenza virus
SRSLKLAIG

SEQ ID NO: 336478 - protein, 9 aa, Influenza virus
GSLKLAIGP

SEQ ID NO: 336479 - protein, 9 aa, Influenza virus
IGPRNVPQA

SEQ ID NO: 336480 - protein, 9 aa, Influenza virus
GPRNVPQVQ

SEQ ID NO: 336481 - protein, 9 aa, Influenza virus
RNVPQAQNR

SEQ ID NO: 336482 - protein, 9 aa, Influenza virus
NVPQAQNRG

SEQ ID NO: 336483 - protein, 9 aa, Influenza virus
VPQAQNRGL

SEQ ID NO: 336484 - protein, 9 aa, Influenza virus
PQAQNRGLF

SEQ ID NO: 336485 - protein, 9 aa, Influenza virus
QAQNRGLFG

SEQ ID NO: 336486 - protein, 9 aa, Influenza virus
AQNRGLFGA

SEQ ID NO: 336487 - protein, 9 aa, Influenza virus
QNRGLFGAK

SEQ ID NO: 336488 - protein, 9 aa, Influenza virus
NRGLFGAKA

SEQ ID NO: 336489 - protein, 9 aa, Influenza virus
AIAGFIEGR

SEQ ID NO: 336490 - protein, 9 aa, Influenza virus
IAGFIEGRW

SEQ ID NO: 336491 - protein, 9 aa, Influenza virus
FQHQNAEGI

SEQ ID NO: 336492 - protein, 9 aa, Influenza virus
QHQNAEGIG

SEQ ID NO: 336493 - protein, 9 aa, Influenza virus
HQNSEGTGI

SEQ ID NO: 336494 - protein, 9 aa, Influenza virus
QNSEGTGIA

SEQ ID NO: 336495 - protein, 9 aa, Influenza virus
NSEGTGIAA

SEQ ID NO: 336496 - protein, 9 aa, Influenza virus
SEGTGIAAD

SEQ ID NO: 336497 - protein, 9 aa, Influenza virus
EGTGIVADR

SEQ ID NO: 336498 - protein, 9 aa, Influenza virus
GTGIAADRG

SEQ ID NO: 336499 - protein, 9 aa, Influenza virus
TGIVADRDS

SEQ ID NO: 336500 - protein, 9 aa, Influenza virus
GIVADRDST

SEQ ID NO: 336501 - protein, 9 aa, Influenza virus
IAADRGSTQ

SEQ ID NO: 336502 - protein, 9 aa, Influenza virus
AADRDSTQM

SEQ ID NO: 336503 - protein, 9 aa, Influenza virus
ADRDSTQMA

SEQ ID NO: 336504 - protein, 9 aa, Influenza virus
DRDSTQMAI

SEQ ID NO: 336505 - protein, 9 aa, Influenza virus
RDSTQMAID

SEQ ID NO: 336506 - protein, 9 aa, Influenza virus
DSTQMAIDN

SEQ ID NO: 336507 - protein, 9 aa, Influenza virus
STQMAIDNM

SEQ ID NO: 336508 - protein, 9 aa, Influenza virus
TQMAIDNMQ

SEQ ID NO: 336509 - protein, 9 aa, Influenza virus
QMAIDNMQN

SEQ ID NO: 336510 - protein, 9 aa, Influenza virus
MAIDNMQNK

SEQ ID NO: 336511 - protein, 9 aa, Influenza virus
AIDNMQNRL

SEQ ID NO: 336512 - protein, 9 aa, Influenza virus
IDNMQNRLN

SEQ ID NO: 336513 - protein, 9 aa, Influenza virus
DIMQNKLNN

SEQ ID NO: 336514 - protein, 9 aa, Influenza virus
NMQNRLNNV

SEQ ID NO: 336515 - protein, 9 aa, Influenza virus
NNVIDKMNN

SEQ ID NO: 336516 - protein, 9 aa, Influenza virus
NVIDKMNNQ

SEQ ID NO: 336517 - protein, 9 aa, Influenza virus
VIDKMYKQF

SEQ ID NO: 336518 - protein, 9 aa, Influenza virus
EFSEVETRI

SEQ ID NO: 336519 - protein, 9 aa, Influenza virus
FSEVETRIN

SEQ ID NO: 336520 - protein, 9 aa, Influenza virus
VGSRINMIN

SEQ ID NO: 336521 - protein, 9 aa, Influenza virus
EIRINMINS

SEQ ID NO: 336522 - protein, 9 aa, Influenza virus
IRINMINSK

SEQ ID NO: 336523 - protein, 9 aa, Influenza virus
RINMINSQI

SEQ ID NO: 336524 - protein, 9 aa, Influenza virus
INTINSKID

SEQ ID NO: 336525 - protein, 9 aa, Influenza virus
NMINSQIDD

SEQ ID NO: 336526 - protein, 9 aa, Influenza virus
MINSKINDQ

SEQ ID NO: 336527 - protein, 9 aa, Influenza virus
INSKINDQI

SEQ ID NO: 336528 - protein, 9 aa, Influenza virus
INDQITDIW

SEQ ID NO: 336529 - protein, 9 aa, Influenza virus
DDQIIDIWA

SEQ ID NO: 336530 - protein, 9 aa, Influenza virus
DQIIDIWAY

SEQ ID NO: 336531 - protein, 9 aa, Influenza virus
QIIDIWAYN

SEQ ID NO: 336532 - protein, 9 aa, Influenza virus
IIDIWAYNA

SEQ ID NO: 336533 - protein, 9 aa, Influenza virus
NVRNLHERI

SEQ ID NO: 336534 - protein, 9 aa, Influenza virus
VRNLHDRVK

SEQ ID NO: 336535 - protein, 9 aa, Influenza virus
RNLHDRVKR

SEQ ID NO: 336536 - protein, 9 aa, Influenza virus
RVLKENAID

SEQ ID NO: 336537 - protein, 9 aa, Influenza virus
ENALDTGDG

SEQ ID NO: 336538 - protein, 9 aa, Influenza virus
NALDTGDGC

SEQ ID NO: 336539 - protein, 9 aa, Influenza virus
AVDTGDGCF

SEQ ID NO: 336540 - protein, 9 aa, Influenza virus
IDAGDGCFE

SEQ ID NO: 336541 - protein, 9 aa, Influenza virus
DNGDGCFEI

SEQ ID NO: 336542 - protein, 9 aa, Influenza virus
NGDGCFEIL

SEQ ID NO: 336543 - protein, 9 aa, Influenza virus
CFEILHRCN

SEQ ID NO: 336544 - protein, 9 aa, Influenza virus
FEILHRCDD

SEQ ID NO: 336545 - protein, 9 aa, Influenza virus
TIRTGTYNH

SEQ ID NO: 336546 - protein, 9 aa, Influenza virus
IKNGTYNHQ

SEQ ID NO: 336547 - protein, 9 aa, Influenza virus
GTYNHQDYE

SEQ ID NO: 336548 - protein, 9 aa, Influenza virus
YEDESRIER

SEQ ID NO: 336549 - protein, 9 aa, Influenza virus
EEESRIERQ

SEQ ID NO: 336550 - protein, 9 aa, Influenza virus
EESKLERQR

SEQ ID NO: 336551 - protein, 9 aa, Influenza virus
ESRIERQKI

SEQ ID NO: 336552 - protein, 9 aa, Influenza virus
ERQKVNGVK

SEQ ID NO: 336553 - protein, 9 aa, Influenza virus
RQKVNGVKL

SEQ ID NO: 336554 - protein, 9 aa, Influenza virus
QKVNGVKLE

SEQ ID NO: 336555 - protein, 9 aa, Influenza virus
KVNGVKLEE

SEQ ID NO: 336556 - protein, 9 aa, Influenza virus
ISGVKLEEN

SEQ ID NO: 336557 - protein, 9 aa, Influenza virus
ADKICVGYL

SEQ ID NO: 336558 - protein, 9 aa, Influenza virus
DRICIGYLS

SEQ ID NO: 336559 - protein, 9 aa, Influenza virus
RICIGYLST

SEQ ID NO: 336560 - protein, 9 aa, Influenza virus
IGYLSTNSS

SEQ ID NO: 336561 - protein, 9 aa, Influenza virus
GYLSTNSSD

SEQ ID NO: 336562 - protein, 9 aa, Influenza virus
YLSTNSTEK

SEQ ID NO: 336563 - protein, 9 aa, Influenza virus
LSTNSTEKV

SEQ ID NO: 336564 - protein, 9 aa, Influenza virus
STNSTEKVD

SEQ ID NO: 336565 - protein, 9 aa, Influenza virus
TNSTEKVDT

SEQ ID NO: 336566 - protein, 9 aa, Influenza virus
NSTEKVDTL

SEQ ID NO: 336567 - protein, 9 aa, Influenza virus
STEKVDTLL

SEQ ID NO: 336568 - protein, 9 aa, Influenza virus
TEKVDTLLE

SEQ ID NO: 336569 - protein, 9 aa, Influenza virus
EKVNTLLEN

SEQ ID NO: 336570 - protein, 9 aa, Influenza virus
VDTLLENNV

SEQ ID NO: 336571 - protein, 9 aa, Influenza virus
DTLLENNVP

SEQ ID NO: 336572 - protein, 9 aa, Influenza virus
TLLENNVPV

SEQ ID NO: 336573 - protein, 9 aa, Influenza virus
LLENNVPVT

SEQ ID NO: 336574 - protein, 9 aa, Influenza virus
LENNVPVTS

SEQ ID NO: 336575 - protein, 9 aa, Influenza virus
ENNVPVTSS

SEQ ID NO: 336576 - protein, 9 aa, Influenza virus
VPVTSTIDL

SEQ ID NO: 336577 - protein, 9 aa, Influenza virus
PVTSSIDLI

SEQ ID NO: 336578 - protein, 9 aa, Influenza virus
VTSSIDLIE

SEQ ID NO: 336579 - protein, 9 aa, Influenza virus
TSSIDLIET

SEQ ID NO: 336580 - protein, 9 aa, Influenza virus
DLVETSHTG

SEQ ID NO: 336581 - protein, 9 aa, Influenza virus
LVETSHTGT

SEQ ID NO: 336582 - protein, 9 aa, Influenza virus
VETSHTGTY

SEQ ID NO: 336583 - protein, 9 aa, Influenza virus
ETTHTGTYC

SEQ ID NO: 336584 - protein, 9 aa, Influenza virus
TTHTGTYCS

SEQ ID NO: 336585 - protein, 9 aa, Influenza virus
THTGTYCSL

SEQ ID NO: 336586 - protein, 9 aa, Influenza virus
HTGTYCSLG

SEQ ID NO: 336587 - protein, 9 aa, Influenza virus
TGTYCSLGG

SEQ ID NO: 336588 - protein, 9 aa, Influenza virus
SPVHLGDCN

SEQ ID NO: 336589 - protein, 9 aa, Influenza virus
PVHLGDCNF

SEQ ID NO: 336590 - protein, 9 aa, Influenza virus
VHLGDCNFE

SEQ ID NO: 336591 - protein, 9 aa, Influenza virus
HLGDCNFEG

SEQ ID NO: 336592 - protein, 9 aa, Influenza virus
LGDCNFEGW

SEQ ID NO: 336593 - protein, 9 aa, Influenza virus
GDCNFEGWI

SEQ ID NO: 336594 - protein, 9 aa, Influenza virus
DCNFEGWIV

SEQ ID NO: 336595 - protein, 9 aa, Influenza virus
CNFEGWIVG

SEQ ID NO: 336596 - protein, 9 aa, Influenza virus
SFEGWIGGN

SEQ ID NO: 336597 - protein, 9 aa, Influenza virus
EGWIGGNPA

SEQ ID NO: 336598 - protein, 9 aa, Influenza virus
GWIGGNPAC

SEQ ID NO: 336599 - protein, 9 aa, Influenza virus
GTREWSYLI

SEQ ID NO: 336600 - protein, 9 aa, Influenza virus
TREWSYLIE

SEQ ID NO: 336601 - protein, 9 aa, Influenza virus
WSYLIEDPA

SEQ ID NO: 336602 - protein, 9 aa, Influenza virus
SYLIEDPAA

SEQ ID NO: 336603 - protein, 9 aa, Influenza virus
YLIEDPAAP

SEQ ID NO: 336604 - protein, 9 aa, Influenza virus
LIEDPAAPH

SEQ ID NO: 336605 - protein, 9 aa, Influenza virus
IEDPTAPHG

SEQ ID NO: 336606 - protein, 9 aa, Influenza virus
EDPTAPHGL

SEQ ID NO: 336607 - protein, 9 aa, Influenza virus
DPTAPHGLC

SEQ ID NO: 336608 - protein, 9 aa, Influenza virus
PTAPHGLCY

SEQ ID NO: 336609 - protein, 9 aa, Influenza virus
AAPHGLCYP

SEQ ID NO: 336610 - protein, 9 aa, Influenza virus
RLCYPGELD

SEQ ID NO: 336611 - protein, 9 aa, Influenza virus
GIKSFSRTQ

SEQ ID NO: 336612 - protein, 9 aa, Influenza virus
IKSFSRTQL

SEQ ID NO: 336613 - protein, 9 aa, Influenza virus
KSFSRTQLI

SEQ ID NO: 336614 - protein, 9 aa, Influenza virus
SFSRTQLIA

SEQ ID NO: 336615 - protein, 9 aa, Influenza virus
FSRTQLIAP

SEQ ID NO: 336616 - protein, 9 aa, Influenza virus
TGTNSFYRN

SEQ ID NO: 336617 - protein, 9 aa, Influenza virus
GFYRNLVWF

SEQ ID NO: 336618 - protein, 9 aa, Influenza virus
FYRNLVWFI

SEQ ID NO: 336619 - protein, 9 aa, Influenza virus
RTYNNTTGR

SEQ ID NO: 336620 - protein, 9 aa, Influenza virus
VYNNTTGRD

SEQ ID NO: 336621 - protein, 9 aa, Influenza virus
TTGRDVLVI

SEQ ID NO: 336622 - protein, 9 aa, Influenza virus
TGRDVLVIW

SEQ ID NO: 336623 - protein, 9 aa, Influenza virus
GRDVLVIWG

SEQ ID NO: 336624 - protein, 9 aa, Influenza virus
RDVLVIWGI

SEQ ID NO: 336625 - protein, 9 aa, Influenza virus
DVLVIWGIH

SEQ ID NO: 336626 - protein, 9 aa, Influenza virus
VLVIWGIHH

SEQ ID NO: 336627 - protein, 9 aa, Influenza virus
LVIWGIHHP

SEQ ID NO: 336628 - protein, 9 aa, Influenza virus
PYTLVSTGS

SEQ ID NO: 336629 - protein, 9 aa, Influenza virus
YTLVSTGSW

SEQ ID NO: 336630 - protein, 9 aa, Influenza virus
TLVSTGSWS

SEQ ID NO: 336631 - protein, 9 aa, Influenza virus
GTRPGYNGQ

SEQ ID NO: 336632 - protein, 9 aa, Influenza virus
VRPGYNGQK

SEQ ID NO: 336633 - protein, 9 aa, Influenza virus
RPRYNGQRS

SEQ ID NO: 336634 - protein, 9 aa, Influenza virus
PRYNGQRSW

SEQ ID NO: 336635 - protein, 9 aa, Influenza virus
RYNGQRSWM

SEQ ID NO: 336636 - protein, 9 aa, Influenza virus
YNGQKSWTK

SEQ ID NO: 336637 - protein, 9 aa, Influenza virus
NGQKSWTKI

SEQ ID NO: 336638 - protein, 9 aa, Influenza virus
GQKSWTKIY

SEQ ID NO: 336639 - protein, 9 aa, Influenza virus
QKSWTKIYW

SEQ ID NO: 336640 - protein, 9 aa, Influenza virus
SWMKIYWVL

SEQ ID NO: 336641 - protein, 9 aa, Influenza virus
ITFESNGGF

SEQ ID NO: 336642 - protein, 9 aa, Influenza virus
TFESNGGFL

SEQ ID NO: 336643 - protein, 9 aa, Influenza virus
SNGGFLAPR

SEQ ID NO: 336644 - protein, 9 aa, Influenza virus
NGGFLAPRY

SEQ ID NO: 336645 - protein, 9 aa, Influenza virus
GGFLAPRYG

SEQ ID NO: 336646 - protein, 9 aa, Influenza virus
GFLAPRYGY

SEQ ID NO: 336647 - protein, 9 aa, Influenza virus
FLAPRYGYI

SEQ ID NO: 336648 - protein, 9 aa, Influenza virus
GKGRIFQSH

SEQ ID NO: 336649 - protein, 9 aa, Influenza virus
KGRIFQSHI

SEQ ID NO: 336650 - protein, 9 aa, Influenza virus
GRIFQSHIR

SEQ ID NO: 336651 - protein, 9 aa, Influenza virus
RCNTRCQTS

SEQ ID NO: 336652 - protein, 9 aa, Influenza virus
SVGGIDTNK

SEQ ID NO: 336653 - protein, 9 aa, Influenza virus
VGGIDTNKT

SEQ ID NO: 336654 - protein, 9 aa, Influenza virus
GGIDTNKTF

SEQ ID NO: 336655 - protein, 9 aa, Influenza virus
GIDTNKTFQ

SEQ ID NO: 336656 - protein, 9 aa, Influenza virus
IDTNKTFQN

SEQ ID NO: 336657 - protein, 9 aa, Influenza virus
DTNKTFQNI

SEQ ID NO: 336658 - protein, 9 aa, Influenza virus
TNKTFQNID

SEQ ID NO: 336659 - protein, 9 aa, Influenza virus
NRTFQNIDR

SEQ ID NO: 336660 - protein, 9 aa, Influenza virus
RTFQNIDRN

SEQ ID NO: 336661 - protein, 9 aa, Influenza virus
TFQNIDRNA

SEQ ID NO: 336662 - protein, 9 aa, Influenza virus
FQNIDRNAL

SEQ ID NO: 336663 - protein, 9 aa, Influenza virus
QNIDRNALG

SEQ ID NO: 336664 - protein, 9 aa, Influenza virus
NIERNALGN

SEQ ID NO: 336665 - protein, 9 aa, Influenza virus
IERNALGNC

SEQ ID NO: 336666 - protein, 9 aa, Influenza virus
ERNALGNCP

SEQ ID NO: 336667 - protein, 9 aa, Influenza virus
RNALGNCPK

SEQ ID NO: 336668 - protein, 9 aa, Influenza virus
NALGECPKY

SEQ ID NO: 336669 - protein, 9 aa, Influenza virus
ALGECPKYI

SEQ ID NO: 336670 - protein, 9 aa, Influenza virus
LGECPKYIK

SEQ ID NO: 336671 - protein, 9 aa, Influenza virus
GECPKYIKS

SEQ ID NO: 336672 - protein, 9 aa, Influenza virus
ECPKYIKSD

SEQ ID NO: 336673 - protein, 9 aa, Influenza virus
KLATGLKNV

SEQ ID NO: 336674 - protein, 9 aa, Influenza virus
LATGLKNVP

SEQ ID NO: 336675 - protein, 9 aa, Influenza virus
ATGLRNIPA

SEQ ID NO: 336676 - protein, 9 aa, Influenza virus
RGFFGAIAG

SEQ ID NO: 336677 - protein, 9 aa, Influenza virus
AVDGTIAGF

SEQ ID NO: 336678 - protein, 9 aa, Influenza virus
FFGAIAGFI

SEQ ID NO: 336679 - protein, 9 aa, Influenza virus
DGTIAGFIE

SEQ ID NO: 336680 - protein, 9 aa, Influenza virus
FQHQNEQGM

SEQ ID NO: 336681 - protein, 9 aa, Influenza virus
QHQNEQGMG

SEQ ID NO: 336682 - protein, 9 aa, Influenza virus
HQNEQGVGI

SEQ ID NO: 336683 - protein, 9 aa, Influenza virus
QNEQGVGIA

SEQ ID NO: 336684 - protein, 9 aa, Influenza virus
NEQGVGIAA

SEQ ID NO: 336685 - protein, 9 aa, Influenza virus
EQGVGIAAD

SEQ ID NO: 336686 - protein, 9 aa, Influenza virus
QGVGIAADK

SEQ ID NO: 336687 - protein, 9 aa, Influenza virus
GVGIAADKE

SEQ ID NO: 336688 - protein, 9 aa, Influenza virus
VGIAADKES

SEQ ID NO: 336689 - protein, 9 aa, Influenza virus
GIAAEKEST

SEQ ID NO: 336690 - protein, 9 aa, Influenza virus
IAAEKESTQ

SEQ ID NO: 336691 - protein, 9 aa, Influenza virus
RGEFNQVEN

SEQ ID NO: 336692 - protein, 9 aa, Influenza virus
GEFNQVENR

SEQ ID NO: 336693 - protein, 9 aa, Influenza virus
EFNQVENRI

SEQ ID NO: 336694 - protein, 9 aa, Influenza virus
FNQVENRIN

SEQ ID NO: 336695 - protein, 9 aa, Influenza virus
NQVENRINM

SEQ ID NO: 336696 - protein, 9 aa, Influenza virus
QVENRINML

SEQ ID NO: 336697 - protein, 9 aa, Influenza virus
VENRINMLA

SEQ ID NO: 336698 - protein, 9 aa, Influenza virus
ENRINMLAD

SEQ ID NO: 336699 - protein, 9 aa, Influenza virus
NRINMLADR

SEQ ID NO: 336700 - protein, 9 aa, Influenza virus
TDIWSYNAR

SEQ ID NO: 336701 - protein, 9 aa, Influenza virus
DIWSYNARL

SEQ ID NO: 336702 - protein, 9 aa, Influenza virus
IWSYNARLL

SEQ ID NO: 336703 - protein, 9 aa, Influenza virus
LENDKTLDL

SEQ ID NO: 336704 - protein, 9 aa, Influenza virus
ENDKTLNMH

SEQ ID NO: 336705 - protein, 9 aa, Influenza virus
NDKTLDLHD

SEQ ID NO: 336706 - protein, 9 aa, Influenza virus
DKTLDLHDA

SEQ ID NO: 336707 - protein, 9 aa, Influenza virus
KTLDLHDAN

SEQ ID NO: 336708 - protein, 9 aa, Influenza virus
TLNMHDANV

SEQ ID NO: 336709 - protein, 9 aa, Influenza virus
LDLHDANVR

SEQ ID NO: 336710 - protein, 9 aa, Influenza virus
DLHDANVRN

SEQ ID NO: 336711 - protein, 9 aa, Influenza virus
LHDANVRNL

SEQ ID NO: 336712 - protein, 9 aa, Influenza virus
DANVKNLHE

SEQ ID NO: 336713 - protein, 9 aa, Influenza virus
ANVKNLHEQ

SEQ ID NO: 336714 - protein, 9 aa, Influenza virus
NVKNLHEQV

SEQ ID NO: 336715 - protein, 9 aa, Influenza virus
VKNLHEQVR

SEQ ID NO: 336716 - protein, 9 aa, Influenza virus
NAINEGNGC

SEQ ID NO: 336717 - protein, 9 aa, Influenza virus
AINEGNGCF

SEQ ID NO: 336718 - protein, 9 aa, Influenza virus
INEGNGCFE

SEQ ID NO: 336719 - protein, 9 aa, Influenza virus
ELLHKCNNT

SEQ ID NO: 336720 - protein, 9 aa, Influenza virus
LLHKCNNTC

SEQ ID NO: 336721 - protein, 9 aa, Influenza virus
LHKCNNTCM

SEQ ID NO: 336722 - protein, 9 aa, Influenza virus
HKCNDSCMD

SEQ ID NO: 336723 - protein, 9 aa, Influenza virus
KCNDSCMDT

SEQ ID NO: 336724 - protein, 9 aa, Influenza virus
CNDSCMDTI

SEQ ID NO: 336725 - protein, 9 aa, Influenza virus
NDSCMDTIR

SEQ ID NO: 336726 - protein, 9 aa, Influenza virus
DSCMDTIRN

SEQ ID NO: 336727 - protein, 9 aa, Influenza virus
TCMETIRNG

SEQ ID NO: 336728 - protein, 9 aa, Influenza virus
DTIRNGTYN

SEQ ID NO: 336729 - protein, 9 aa, Influenza virus
IRNGTYNHA

SEQ ID NO: 336730 - protein, 9 aa, Influenza virus
KYEEESKLK

SEQ ID NO: 336731 - protein, 9 aa, Influenza virus
SKLKRQEID

SEQ ID NO: 336732 - protein, 9 aa, Influenza virus
KLKRQEIDG

SEQ ID NO: 336733 - protein, 9 aa, Influenza virus
LKRQEIDGI

SEQ ID NO: 336734 - protein, 9 aa, Influenza virus
KRQEIDGIK

SEQ ID NO: 336735 - protein, 9 aa, Influenza virus
RQEIDGIKL

SEQ ID NO: 336736 - protein, 9 aa, Influenza virus
QEIDGIKLK

SEQ ID NO: 336737 - protein, 9 aa, Influenza virus
EIDGIKLKS

SEQ ID NO: 336738 - protein, 9 aa, Influenza virus
SDDNVYKAL

SEQ ID NO: 336739 - protein, 9 aa, Influenza virus
DDNVYKALS

SEQ ID NO: 336740 - protein, 9 aa, Influenza virus
DGVYKALSI

SEQ ID NO: 336741 - protein, 9 aa, Influenza virus
GVYKALSIY

SEQ ID NO: 336742 - protein, 9 aa, Influenza virus
SCIASSIVM

SEQ ID NO: 336743 - protein, 9 aa, Influenza virus
CIASSIVMV

SEQ ID NO: 336744 - protein, 9 aa, Influenza virus
IASSIVMVG

SEQ ID NO: 336745 - protein, 9 aa, Influenza virus
ASSIVMVGL

SEQ ID NO: 336746 - protein, 9 aa, Influenza virus
SSIVMVGLI

SEQ ID NO: 336747 - protein, 9 aa, Influenza virus
SIVMVGLIL

SEQ ID NO: 336748 - protein, 9 aa, Influenza virus
VMVGLILAF

SEQ ID NO: 336749 - protein, 9 aa, Influenza virus
MVGLILAFI

SEQ ID NO: 336750 - protein, 9 aa, Influenza virus
VGPILSFIM

SEQ ID NO: 336751 - protein, 9 aa, Influenza virus
GPILSFIMW

SEQ ID NO: 336752 - protein, 9 aa, Influenza virus
LILAFIMWT

SEQ ID NO: 336753 - protein, 9 aa, Influenza virus
ILAFIMWTC

SEQ ID NO: 336754 - protein, 9 aa, Influenza virus
FIMWTCNSG

SEQ ID NO: 336755 - protein, 9 aa, Influenza virus
IMWTCNSGN

SEQ ID NO: 336756 - protein, 9 aa, Influenza virus
MWTCNSGNC

SEQ ID NO: 336757 - protein, 9 aa, Influenza virus
WTCNSGNCR

SEQ ID NO: 336758 - protein, 9 aa, Influenza virus
TCNSGNCRF

SEQ ID NO: 336759 - protein, 9 aa, Influenza virus
CSNGSCRFN

SEQ ID NO: 336760 - protein, 9 aa, Influenza virus
EMKWLSSSG

SEQ ID NO: 336761 - protein, 9 aa, Influenza virus
MKWLSSSGN

SEQ ID NO: 336762 - protein, 9 aa, Influenza virus
KWLLSSKDN

SEQ ID NO: 336763 - protein, 9 aa, Influenza virus
WLLSSKDNQ

SEQ ID NO: 336764 - protein, 9 aa, Influenza virus
LLSSKDNQV

SEQ ID NO: 336765 - protein, 9 aa, Influenza virus
SSSGNNQVF

SEQ ID NO: 336766 - protein, 9 aa, Influenza virus
SSGNNQVFP

SEQ ID NO: 336767 - protein, 9 aa, Influenza virus
SGNNQVFPQ

SEQ ID NO: 336768 - protein, 9 aa, Influenza virus
GNNQVFPQL

SEQ ID NO: 336769 - protein, 9 aa, Influenza virus
DNQVFPQLN

SEQ ID NO: 336770 - protein, 9 aa, Influenza virus
KNVPEKIRV

SEQ ID NO: 336771 - protein, 9 aa, Influenza virus
NVPEKIRVK

SEQ ID NO: 336772 - protein, 9 aa, Influenza virus
VPEKIRVKR

SEQ ID NO: 336773 - protein, 9 aa, Influenza virus
PEKIRVKRR

SEQ ID NO: 336774 - protein, 9 aa, Influenza virus
EKIRVKRRP

SEQ ID NO: 336775 - protein, 9 aa, Influenza virus
KIRVKRRPV

SEQ ID NO: 336776 - protein, 9 aa, Influenza virus
IRVKRRPVA

SEQ ID NO: 336777 - protein, 9 aa, Influenza virus
RVKRRPVAK

SEQ ID NO: 336778 - protein, 9 aa, Influenza virus
GRYSIADKI

SEQ ID NO: 336779 - protein, 9 aa, Influenza virus
RYSIADKIC

SEQ ID NO: 336780 - protein, 9 aa, Influenza virus
YSIADKICI

SEQ ID NO: 336781 - protein, 9 aa, Influenza virus
SIADKICIG

SEQ ID NO: 336782 - protein, 9 aa, Influenza virus
IADKICIGY

SEQ ID NO: 336783 - protein, 9 aa, Influenza virus
IGYLSNNAT

SEQ ID NO: 336784 - protein, 9 aa, Influenza virus
GYLSNNATD

SEQ ID NO: 336785 - protein, 9 aa, Influenza virus
YLSNNSTDT

SEQ ID NO: 336786 - protein, 9 aa, Influenza virus
LSNNSTDTV

SEQ ID NO: 336787 - protein, 9 aa, Influenza virus
SNNSTDTVD

SEQ ID NO: 336788 - protein, 9 aa, Influenza virus
NNSTDTVDT

SEQ ID NO: 336789 - protein, 9 aa, Influenza virus
NSTDTVDTL

SEQ ID NO: 336790 - protein, 9 aa, Influenza virus
STDTVDTLT

SEQ ID NO: 336791 - protein, 9 aa, Influenza virus
TDKVDTLTE

SEQ ID NO: 336792 - protein, 9 aa, Influenza virus
DKIDTLTET

SEQ ID NO: 336793 - protein, 9 aa, Influenza virus
KIDTLTETG

SEQ ID NO: 336794 - protein, 9 aa, Influenza virus
VDTLTETGV

SEQ ID NO: 336795 - protein, 9 aa, Influenza virus
TGVPVTSSV

SEQ ID NO: 336796 - protein, 9 aa, Influenza virus
CSLNGVSPV

SEQ ID NO: 336797 - protein, 9 aa, Influenza virus
SLNGVSPVH

SEQ ID NO: 336798 - protein, 9 aa, Influenza virus
LNGVSPVHL

SEQ ID NO: 336799 - protein, 9 aa, Influenza virus
NGVSPVHLG

SEQ ID NO: 336800 - protein, 9 aa, Influenza virus
GVSPVHLGD

SEQ ID NO: 336801 - protein, 9 aa, Influenza virus
VSPVHLGDC

SEQ ID NO: 336802 - protein, 9 aa, Influenza virus
EDPNAPNKF

SEQ ID NO: 336803 - protein, 9 aa, Influenza virus
DPNAPNKFC

SEQ ID NO: 336804 - protein, 9 aa, Influenza virus
PNAPNKLCY

SEQ ID NO: 336805 - protein, 9 aa, Influenza virus
NAPNKLCYP

SEQ ID NO: 336806 - protein, 9 aa, Influenza virus
APNKLCYPG

SEQ ID NO: 336807 - protein, 9 aa, Influenza virus
PNKLCYPGE

SEQ ID NO: 336808 - protein, 9 aa, Influenza virus
KLCFPGEVD

SEQ ID NO: 336809 - protein, 9 aa, Influenza virus
LCFPGEVDN

SEQ ID NO: 336810 - protein, 9 aa, Influenza virus
CFPGEVDNN

SEQ ID NO: 336811 - protein, 9 aa, Influenza virus
FPGEVDNNG

SEQ ID NO: 336812 - protein, 9 aa, Influenza virus
SFSRTELIP

SEQ ID NO: 336813 - protein, 9 aa, Influenza virus
FSRTELIPP

SEQ ID NO: 336814 - protein, 9 aa, Influenza virus
SRTELINPS

SEQ ID NO: 336815 - protein, 9 aa, Influenza virus
RTELIPPSK

SEQ ID NO: 336816 - protein, 9 aa, Influenza virus
TELIPPSKW

SEQ ID NO: 336817 - protein, 9 aa, Influenza virus
ELINPSKWG

SEQ ID NO: 336818 - protein, 9 aa, Influenza virus
PSKWGDVLD

SEQ ID NO: 336819 - protein, 9 aa, Influenza virus
SKWGDVLDG

SEQ ID NO: 336820 - protein, 9 aa, Influenza virus
KWGDVLDGV

SEQ ID NO: 336821 - protein, 9 aa, Influenza virus
WGDVLDGVT

SEQ ID NO: 336822 - protein, 9 aa, Influenza virus
GDVLDGVTA

SEQ ID NO: 336823 - protein, 9 aa, Influenza virus
DVLDGVTAS

SEQ ID NO: 336824 - protein, 9 aa, Influenza virus
ILDGVTASC

SEQ ID NO: 336825 - protein, 9 aa, Influenza virus
LDGVTASCR

SEQ ID NO: 336826 - protein, 9 aa, Influenza virus
DGVTASCRD

SEQ ID NO: 336827 - protein, 9 aa, Influenza virus
GVTASCLDK

SEQ ID NO: 336828 - protein, 9 aa, Influenza virus
VTASCLDKG

SEQ ID NO: 336829 - protein, 9 aa, Influenza virus
TASCLDKGA

SEQ ID NO: 336830 - protein, 9 aa, Influenza virus
GADSFYRNL

SEQ ID NO: 336831 - protein, 9 aa, Influenza virus
NSFYRNLIW

SEQ ID NO: 336832 - protein, 9 aa, Influenza virus
SFYRNLVWI

SEQ ID NO: 336833 - protein, 9 aa, Influenza virus
FYRNLVWIV

SEQ ID NO: 336834 - protein, 9 aa, Influenza virus
YRNLVWIVK

SEQ ID NO: 336835 - protein, 9 aa, Influenza virus
IKGDYNNTT

SEQ ID NO: 336836 - protein, 9 aa, Influenza virus
RGDYNNTTG

SEQ ID NO: 336837 - protein, 9 aa, Influenza virus
GIHHPDSET

SEQ ID NO: 336838 - protein, 9 aa, Influenza virus
IHHPDTEAT

SEQ ID NO: 336839 - protein, 9 aa, Influenza virus
HHPDTEATA

SEQ ID NO: 336840 - protein, 9 aa, Influenza virus
ANKLYVNKN

SEQ ID NO: 336841 - protein, 9 aa, Influenza virus
NKLYVNKNP

SEQ ID NO: 336842 - protein, 9 aa, Influenza virus
NLYASKNPY

SEQ ID NO: 336843 - protein, 9 aa, Influenza virus
KRYELEIGA

SEQ ID NO: 336844 - protein, 9 aa, Influenza virus
LEIGTRIGE

SEQ ID NO: 336845 - protein, 9 aa, Influenza virus
EGQRSWMKI

SEQ ID NO: 336846 - protein, 9 aa, Influenza virus
MKLYWHLMH

SEQ ID NO: 336847 - protein, 9 aa, Influenza virus
KLYWHLMHP

SEQ ID NO: 336848 - protein, 9 aa, Influenza virus
LYWHLMHPG

SEQ ID NO: 336849 - protein, 9 aa, Influenza virus
YWHLMSPGE

SEQ ID NO: 336850 - protein, 9 aa, Influenza virus
WHLMSPGER

SEQ ID NO: 336851 - protein, 9 aa, Influenza virus
HLMSPGERI

SEQ ID NO: 336852 - protein, 9 aa, Influenza virus
PGERTTFES

SEQ ID NO: 336853 - protein, 9 aa, Influenza virus
GERITFESS

SEQ ID NO: 336854 - protein, 9 aa, Influenza virus
ERITFESSG

SEQ ID NO: 336855 - protein, 9 aa, Influenza virus
RITFESSGG

SEQ ID NO: 336856 - protein, 9 aa, Influenza virus
ITFESSGGL

SEQ ID NO: 336857 - protein, 9 aa, Influenza virus
TFESSGGLL

SEQ ID NO: 336858 - protein, 9 aa, Influenza virus
FESSGGLLA

SEQ ID NO: 336859 - protein, 9 aa, Influenza virus
ESSGGLLAP

SEQ ID NO: 336860 - protein, 9 aa, Influenza virus
SSGGLLAPR

SEQ ID NO: 336861 - protein, 9 aa, Influenza virus
SGGLLAPRY

SEQ ID NO: 336862 - protein, 9 aa, Influenza virus
GTGRIFQSR

SEQ ID NO: 336863 - protein, 9 aa, Influenza virus
TGRIFQSGI

SEQ ID NO: 336864 - protein, 9 aa, Influenza virus
GRIFQSRIR

SEQ ID NO: 336865 - protein, 9 aa, Influenza virus
RIFQSGIRM

SEQ ID NO: 336866 - protein, 9 aa, Influenza virus
IFQSGIRMA

SEQ ID NO: 336867 - protein, 9 aa, Influenza virus
RMARCNTKC

SEQ ID NO: 336868 - protein, 9 aa, Influenza virus
MARCNTKCQ

SEQ ID NO: 336869 - protein, 9 aa, Influenza virus
GKCNTKCQT

SEQ ID NO: 336870 - protein, 9 aa, Influenza virus
CNTKCQTSL

SEQ ID NO: 336871 - protein, 9 aa, Influenza virus
NTKCQTSLG

SEQ ID NO: 336872 - protein, 9 aa, Influenza virus
TKCQTSLGG

SEQ ID NO: 336873 - protein, 9 aa, Influenza virus
KCQTSLGGI

SEQ ID NO: 336874 - protein, 9 aa, Influenza virus
GGIDTNKTF

SEQ ID NO: 336875 - protein, 9 aa, Influenza virus
GIDTNKTFQ

SEQ ID NO: 336876 - protein, 9 aa, Influenza virus
IDTNKTFQN

SEQ ID NO: 336877 - protein, 9 aa, Influenza virus
NKTFQNIEK

SEQ ID NO: 336878 - protein, 9 aa, Influenza virus
KTFQNIEKN

SEQ ID NO: 336879 - protein, 9 aa, Influenza virus
TFQNIEKNA

SEQ ID NO: 336880 - protein, 9 aa, Influenza virus
FQNIEKNAL

SEQ ID NO: 336881 - protein, 9 aa, Influenza virus
QNIEKNALG

SEQ ID NO: 336882 - protein, 9 aa, Influenza virus
NIEKNALGD

SEQ ID NO: 336883 - protein, 9 aa, Influenza virus
IEKNALGDC

SEQ ID NO: 336884 - protein, 9 aa, Influenza virus
EKNALGDCP

SEQ ID NO: 336885 - protein, 9 aa, Influenza virus
KNALGDCPK

SEQ ID NO: 336886 - protein, 9 aa, Influenza virus
TGLRNVPSV

SEQ ID NO: 336887 - protein, 9 aa, Influenza virus
NERGLFGAI

SEQ ID NO: 336888 - protein, 9 aa, Influenza virus
GTGIAADKV

SEQ ID NO: 336889 - protein, 9 aa, Influenza virus
TGIAADKVS

SEQ ID NO: 336890 - protein, 9 aa, Influenza virus
GIAADKVST

SEQ ID NO: 336891 - protein, 9 aa, Influenza virus
IAADKVSTQ

SEQ ID NO: 336892 - protein, 9 aa, Influenza virus
AADKVSTQK

SEQ ID NO: 336893 - protein, 9 aa, Influenza virus
ADKVSTQKA

SEQ ID NO: 336894 - protein, 9 aa, Influenza virus
DKVSTQKAI

SEQ ID NO: 336895 - protein, 9 aa, Influenza virus
KTSTQKAIN

SEQ ID NO: 336896 - protein, 9 aa, Influenza virus
TSTQKAINE

SEQ ID NO: 336897 - protein, 9 aa, Influenza virus
STQKALNEI

SEQ ID NO: 336898 - protein, 9 aa, Influenza virus
TQKALNEIT

SEQ ID NO: 336899 - protein, 9 aa, Influenza virus
QKALNEITT

SEQ ID NO: 336900 - protein, 9 aa, Influenza virus
KALNEITTK

SEQ ID NO: 336901 - protein, 9 aa, Influenza virus
ALNEITTKI

SEQ ID NO: 336902 - protein, 9 aa, Influenza virus
LNEITTKIN

SEQ ID NO: 336903 - protein, 9 aa, Influenza virus
KRINMLADW

SEQ ID NO: 336904 - protein, 9 aa, Influenza virus
RINMLADWV

SEQ ID NO: 336905 - protein, 9 aa, Influenza virus
INMLADWVD

SEQ ID NO: 336906 - protein, 9 aa, Influenza virus
NMLADWVDD

SEQ ID NO: 336907 - protein, 9 aa, Influenza virus
MLADWVDDA

SEQ ID NO: 336908 - protein, 9 aa, Influenza virus
LADWVDDAV

SEQ ID NO: 336909 - protein, 9 aa, Influenza virus
WVDDAVTDI

SEQ ID NO: 336910 - protein, 9 aa, Influenza virus
KLLVLLEND

SEQ ID NO: 336911 - protein, 9 aa, Influenza virus
LLVLLENDR

SEQ ID NO: 336912 - protein, 9 aa, Influenza virus
LVLLENDRT

SEQ ID NO: 336913 - protein, 9 aa, Influenza virus
VLLENDRTL

SEQ ID NO: 336914 - protein, 9 aa, Influenza virus
LLENDRTLD

SEQ ID NO: 336915 - protein, 9 aa, Influenza virus
LENDRTLDL

SEQ ID NO: 336916 - protein, 9 aa, Influenza virus
ENGRTLGLH

SEQ ID NO: 336917 - protein, 9 aa, Influenza virus
NGRTLGLHD

SEQ ID NO: 336918 - protein, 9 aa, Influenza virus
GRTLGLHDA

SEQ ID NO: 336919 - protein, 9 aa, Influenza virus
LGLHDANVR

SEQ ID NO: 336920 - protein, 9 aa, Influenza virus
GLHDANVRN

SEQ ID NO: 336921 - protein, 9 aa, Influenza virus
DANVKNLHE

SEQ ID NO: 336922 - protein, 9 aa, Influenza virus
ANVKNLHEQ

SEQ ID NO: 336923 - protein, 9 aa, Influenza virus
NVRNLHDQI

SEQ ID NO: 336924 - protein, 9 aa, Influenza virus
VKNLHEQVK

SEQ ID NO: 336925 - protein, 9 aa, Influenza virus
KNLHEQVKR

SEQ ID NO: 336926 - protein, 9 aa, Influenza virus
LKSNAIDEG

SEQ ID NO: 336927 - protein, 9 aa, Influenza virus
KSNAIDEGD

SEQ ID NO: 336928 - protein, 9 aa, Influenza virus
SNAIDEGDG

SEQ ID NO: 336929 - protein, 9 aa, Influenza virus
DEGDGCFSL

SEQ ID NO: 336930 - protein, 9 aa, Influenza virus
EGDGCFSLL

SEQ ID NO: 336931 - protein, 9 aa, Influenza virus
GDGCFSLLH

SEQ ID NO: 336932 - protein, 9 aa, Influenza virus
DGCFSLLHK

SEQ ID NO: 336933 - protein, 9 aa, Influenza virus
GCFSLLHKC

SEQ ID NO: 336934 - protein, 9 aa, Influenza virus
CFSLLHKCN

SEQ ID NO: 336935 - protein, 9 aa, Influenza virus
FSLLHKCND

SEQ ID NO: 336936 - protein, 9 aa, Influenza virus
SLLHKCNDS

SEQ ID NO: 336937 - protein, 9 aa, Influenza virus
FFHKCNDSC

SEQ ID NO: 336938 - protein, 9 aa, Influenza virus
YREESQLKK

SEQ ID NO: 336939 - protein, 9 aa, Influenza virus
REESQLKKQ

SEQ ID NO: 336940 - protein, 9 aa, Influenza virus
IKLKSEDNV

SEQ ID NO: 336941 - protein, 9 aa, Influenza virus
KLKSEDNVY

SEQ ID NO: 336942 - protein, 9 aa, Influenza virus
LKSEDNVYK

SEQ ID NO: 336943 - protein, 9 aa, Influenza virus
KTEDNIYKI

SEQ ID NO: 336944 - protein, 9 aa, Influenza virus
TEDNIYKIL

SEQ ID NO: 336945 - protein, 9 aa, Influenza virus
EDNIYKILS

SEQ ID NO: 336946 - protein, 9 aa, Influenza virus
DNIYKILSI

SEQ ID NO: 336947 - protein, 9 aa, Influenza virus
NIYKILSIY

SEQ ID NO: 336948 - protein, 9 aa, Influenza virus
VYKVLAIYS

SEQ ID NO: 336949 - protein, 9 aa, Influenza virus
YKVLAIYSC

SEQ ID NO: 336950 - protein, 9 aa, Influenza virus
KVLAIYSCI

SEQ ID NO: 336951 - protein, 9 aa, Influenza virus
VLAIYSCIA

SEQ ID NO: 336952 - protein, 9 aa, Influenza virus
IYSCIASSV

SEQ ID NO: 336953 - protein, 9 aa, Influenza virus
YSCIASSVV

SEQ ID NO: 336954 - protein, 9 aa, Influenza virus
SCIASSIVM

SEQ ID NO: 336955 - protein, 9 aa, Influenza virus
CIASSVVLV

SEQ ID NO: 336956 - protein, 9 aa, Influenza virus
IASSVVLVG

SEQ ID NO: 336957 - protein, 9 aa, Influenza virus
ASSIVLVGL

SEQ ID NO: 336958 - protein, 9 aa, Influenza virus
SSIVLVGLI

SEQ ID NO: 336959 - protein, 9 aa, Influenza virus
SIVMVGLIL

SEQ ID NO: 336960 - protein, 9 aa, Influenza virus
IVLVGLILA

SEQ ID NO: 336961 - protein, 9 aa, Influenza virus
AFILWACSS

SEQ ID NO: 336962 - protein, 9 aa, Influenza virus
FILWACSSG

SEQ ID NO: 336963 - protein, 9 aa, Influenza virus
ILWACSSGN

SEQ ID NO: 336964 - protein, 9 aa, Influenza virus
LWACSSGNC

SEQ ID NO: 336965 - protein, 9 aa, Influenza virus
WACSNGNCR

SEQ ID NO: 336966 - protein, 9 aa, Influenza virus
ACSNGNCRF

SEQ ID NO: 336967 - protein, 9 aa, Influenza virus
CSNGNCRFN

SEQ ID NO: 336968 - protein, 9 aa, Influenza virus
SNGNCRFNV

SEQ ID NO: 336969 - protein, 9 aa, Influenza virus
SGNCRFSVC

SEQ ID NO: 336970 - protein, 9 aa, Influenza virus
GNCRFSVCI

SEQ ID NO: 336971 - protein, 9 aa, Influenza virus
KATKMKAII

SEQ ID NO: 336972 - protein, 9 aa, Influenza virus
QPNDGQVLY

SEQ ID NO: 336973 - protein, 9 aa, Influenza virus
PNDGQVLYF

SEQ ID NO: 336974 - protein, 9 aa, Influenza virus
AGFIENGWE

SEQ ID NO: 336975 - protein, 9 aa, Influenza virus
GFIENGWEG

SEQ ID NO: 336976 - protein, 9 aa, Influenza virus
FIENGWEGM

SEQ ID NO: 336977 - protein, 9 aa, Influenza virus
IEGGWPGLI

SEQ ID NO: 336978 - protein, 9 aa, Influenza virus
EGGWPGLIN

SEQ ID NO: 336979 - protein, 9 aa, Influenza virus
GGWPGLING

SEQ ID NO: 336980 - protein, 9 aa, Influenza virus
GWPGLINGW

SEQ ID NO: 336981 - protein, 9 aa, Influenza virus
WPGLINGWY

SEQ ID NO: 336982 - protein, 9 aa, Influenza virus
PGLINGWYG

SEQ ID NO: 336983 - protein, 9 aa, Influenza virus
GLINGWYGF

SEQ ID NO: 336984 - protein, 9 aa, Influenza virus
LINGWYGFQ

SEQ ID NO: 336985 - protein, 9 aa, Influenza virus
INGWYGFQH

SEQ ID NO: 336986 - protein, 9 aa, Influenza virus
NGWYGFQHR

SEQ ID NO: 336987 - protein, 9 aa, Influenza virus
GWYGFQHRN

SEQ ID NO: 336988 - protein, 9 aa, Influenza virus
YNAELLILL

SEQ ID NO: 336989 - protein, 9 aa, Influenza virus
NAELLILLE

SEQ ID NO: 336990 - protein, 9 aa, Influenza virus
AELLILLEN

SEQ ID NO: 336991 - protein, 9 aa, Influenza virus
LLENEKTLD

SEQ ID NO: 336992 - protein, 9 aa, Influenza virus
GNGCFTFYH

SEQ ID NO: 336993 - protein, 9 aa, Influenza virus
ILWFSFGAS

SEQ ID NO: 336994 - protein, 9 aa, Influenza virus
RCTISLVKT

SEQ ID NO: 336995 - protein, 9 aa, Influenza virus
CTISLVKTT

SEQ ID NO: 336996 - protein, 9 aa, Influenza virus
RICIDFRDM

SEQ ID NO: 336997 - protein, 9 aa, Influenza virus
ICILDQNFR

SEQ ID NO: 336998 - protein, 9 aa, Influenza virus
CIDFRDMRK

SEQ ID NO: 336999 - protein, 9 aa, Influenza virus
KATKMKAII

SEQ ID NO: 337000 - protein, 9 aa, Influenza virus
ATKMEAILV

SEQ ID NO: 337001 - protein, 9 aa, Influenza virus
TKMEAILVV

SEQ ID NO: 337002 - protein, 9 aa, Influenza virus
EREAKLFVL

SEQ ID NO: 337003 - protein, 9 aa, Influenza virus
ADTICVGYH

SEQ ID NO: 337004 - protein, 9 aa, Influenza virus
DTICVGYHA

SEQ ID NO: 337005 - protein, 9 aa, Influenza virus
TICVGYHAN

SEQ ID NO: 337006 - protein, 9 aa, Influenza virus
ICVGYHANN

SEQ ID NO: 337007 - protein, 9 aa, Influenza virus
STDTVDTLL

SEQ ID NO: 337008 - protein, 9 aa, Influenza virus
TDTVDTLLE

SEQ ID NO: 337009 - protein, 9 aa, Influenza virus
DTVDTVLER

SEQ ID NO: 337010 - protein, 9 aa, Influenza virus
TVDTVLERN

SEQ ID NO: 337011 - protein, 9 aa, Influenza virus
VDTVLERNV

SEQ ID NO: 337012 - protein, 9 aa, Influenza virus
DTVLERNVT

SEQ ID NO: 337013 - protein, 9 aa, Influenza virus
TVLERNVTV

SEQ ID NO: 337014 - protein, 9 aa, Influenza virus
VLERNVTVT

SEQ ID NO: 337015 - protein, 9 aa, Influenza virus
VTVTHSVDL

SEQ ID NO: 337016 - protein, 9 aa, Influenza virus
TVTHSVDLL

SEQ ID NO: 337017 - protein, 9 aa, Influenza virus
IAGWLLGNP

SEQ ID NO: 337018 - protein, 9 aa, Influenza virus
AGWILGNPK

SEQ ID NO: 337019 - protein, 9 aa, Influenza virus
GWILGNPKC

SEQ ID NO: 337020 - protein, 9 aa, Influenza virus
DYEELKEQL

SEQ ID NO: 337021 - protein, 9 aa, Influenza virus
EELREQLST

SEQ ID NO: 337022 - protein, 9 aa, Influenza virus
ELREQLSTV

SEQ ID NO: 337023 - protein, 9 aa, Influenza virus
LREQLSTVS

SEQ ID NO: 337024 - protein, 9 aa, Influenza virus
REQLSTVSS

SEQ ID NO: 337025 - protein, 9 aa, Influenza virus
EHLSSVSSF

SEQ ID NO: 337026 - protein, 9 aa, Influenza virus
HLSSVSSFE

SEQ ID NO: 337027 - protein, 9 aa, Influenza virus
LSTVSSFER

SEQ ID NO: 337028 - protein, 9 aa, Influenza virus
STVSSFERF

SEQ ID NO: 337029 - protein, 9 aa, Influenza virus
TVSSFERFE

SEQ ID NO: 337030 - protein, 9 aa, Influenza virus
VSSFERFEM

SEQ ID NO: 337031 - protein, 9 aa, Influenza virus
SSFERFEMF

SEQ ID NO: 337032 - protein, 9 aa, Influenza virus
SFERFEMFP

SEQ ID NO: 337033 - protein, 9 aa, Influenza virus
FERFEMFPK

SEQ ID NO: 337034 - protein, 9 aa, Influenza virus
VLVIWGVHH

SEQ ID NO: 337035 - protein, 9 aa, Influenza virus
LVIWGVHHP

SEQ ID NO: 337036 - protein, 9 aa, Influenza virus
GRMNYHWTL

SEQ ID NO: 337037 - protein, 9 aa, Influenza virus
DTITFEATG

SEQ ID NO: 337038 - protein, 9 aa, Influenza virus
TITFEATGN

SEQ ID NO: 337039 - protein, 9 aa, Influenza virus
IIFEATGNL

SEQ ID NO: 337040 - protein, 9 aa, Influenza virus
FEATGNLIA

SEQ ID NO: 337041 - protein, 9 aa, Influenza virus
EATGNLIAP

SEQ ID NO: 337042 - protein, 9 aa, Influenza virus
SLPFHNIHP

SEQ ID NO: 337043 - protein, 9 aa, Influenza virus
PITIGECPK

SEQ ID NO: 337044 - protein, 9 aa, Influenza virus
ITIGECPKY

SEQ ID NO: 337045 - protein, 9 aa, Influenza virus
TIGKCSKYV

SEQ ID NO: 337046 - protein, 9 aa, Influenza virus
IGECPKYVK

SEQ ID NO: 337047 - protein, 9 aa, Influenza virus
GECPKYVKS

SEQ ID NO: 337048 - protein, 9 aa, Influenza virus
ECPKYVKST

SEQ ID NO: 337049 - protein, 9 aa, Influenza virus
KLRMATGLR

SEQ ID NO: 337050 - protein, 9 aa, Influenza virus
LRMATGLRN

SEQ ID NO: 337051 - protein, 9 aa, Influenza virus
RMATGLRNI

SEQ ID NO: 337052 - protein, 9 aa, Influenza virus
MATGLRNIP

SEQ ID NO: 337053 - protein, 9 aa, Influenza virus
ATGLRNIPS

SEQ ID NO: 337054 - protein, 9 aa, Influenza virus
LRNIPSVQS

SEQ ID NO: 337055 - protein, 9 aa, Influenza virus
RNIPSVQSR

SEQ ID NO: 337056 - protein, 9 aa, Influenza virus
NIPSVQSRG

SEQ ID NO: 337057 - protein, 9 aa, Influenza virus
IPSVQSRGL

SEQ ID NO: 337058 - protein, 9 aa, Influenza virus
YHHQNAQGS

SEQ ID NO: 337059 - protein, 9 aa, Influenza virus
HHQNAQGSG

SEQ ID NO: 337060 - protein, 9 aa, Influenza virus
HQNAQGSGY

SEQ ID NO: 337061 - protein, 9 aa, Influenza virus
QNAQGSGYA

SEQ ID NO: 337062 - protein, 9 aa, Influenza virus
QGSGYAADR

SEQ ID NO: 337063 - protein, 9 aa, Influenza virus
GSGYAADRK

SEQ ID NO: 337064 - protein, 9 aa, Influenza virus
SGYAADRKS

SEQ ID NO: 337065 - protein, 9 aa, Influenza virus
GYAADRKST

SEQ ID NO: 337066 - protein, 9 aa, Influenza virus
YAADRKSTQ

SEQ ID NO: 337067 - protein, 9 aa, Influenza virus
ITNKVNSII

SEQ ID NO: 337068 - protein, 9 aa, Influenza virus
TNKVNSIIE

SEQ ID NO: 337069 - protein, 9 aa, Influenza virus
NKVNSVVEK

SEQ ID NO: 337070 - protein, 9 aa, Influenza virus
KVNSVVEKM

SEQ ID NO: 337071 - protein, 9 aa, Influenza virus
VNSVVEKMN

SEQ ID NO: 337072 - protein, 9 aa, Influenza virus
NSIIEKMNT

SEQ ID NO: 337073 - protein, 9 aa, Influenza virus
SIIEKMNTQ

SEQ ID NO: 337074 - protein, 9 aa, Influenza virus
IIEKMNTQF

SEQ ID NO: 337075 - protein, 9 aa, Influenza virus
EKMNIQFTA

SEQ ID NO: 337076 - protein, 9 aa, Influenza virus
KMNIQFTAV

SEQ ID NO: 337077 - protein, 9 aa, Influenza virus
MNIQFTAVG

SEQ ID NO: 337078 - protein, 9 aa, Influenza virus
NIQFTAVGK

SEQ ID NO: 337079 - protein, 9 aa, Influenza virus
IQFTAVGKE

SEQ ID NO: 337080 - protein, 9 aa, Influenza virus
FTSVGKEFN

SEQ ID NO: 337081 - protein, 9 aa, Influenza virus
RIENLNKKI

SEQ ID NO: 337082 - protein, 9 aa, Influenza virus
IENLNKKID

SEQ ID NO: 337083 - protein, 9 aa, Influenza virus
ENLNRKVDD

SEQ ID NO: 337084 - protein, 9 aa, Influenza virus
NLNRKVDDG

SEQ ID NO: 337085 - protein, 9 aa, Influenza virus
LNKKVDDGL

SEQ ID NO: 337086 - protein, 9 aa, Influenza virus
NKKIDDGFL

SEQ ID NO: 337087 - protein, 9 aa, Influenza virus
KKIDDGFLD

SEQ ID NO: 337088 - protein, 9 aa, Influenza virus
DDGFLDVWT

SEQ ID NO: 337089 - protein, 9 aa, Influenza virus
DGFLDVWTY

SEQ ID NO: 337090 - protein, 9 aa, Influenza virus
GFLDVWTYN

SEQ ID NO: 337091 - protein, 9 aa, Influenza virus
FLDVWTYNA

SEQ ID NO: 337092 - protein, 9 aa, Influenza virus
LDVWTYNAE

SEQ ID NO: 337093 - protein, 9 aa, Influenza virus
ERTLDFHDL

SEQ ID NO: 337094 - protein, 9 aa, Influenza virus
NNAKEVGNG

SEQ ID NO: 337095 - protein, 9 aa, Influenza virus
NAKEVGNGC

SEQ ID NO: 337096 - protein, 9 aa, Influenza virus
AKEVGNGCF

SEQ ID NO: 337097 - protein, 9 aa, Influenza virus
KEVGNGCFE

SEQ ID NO: 337098 - protein, 9 aa, Influenza virus
EVGNGCFEF

SEQ ID NO: 337099 - protein, 9 aa, Influenza virus
VGNGCFEFY

SEQ ID NO: 337100 - protein, 9 aa, Influenza virus
FEFYHKCDD

SEQ ID NO: 337101 - protein, 9 aa, Influenza virus
CMESIKNGT

SEQ ID NO: 337102 - protein, 9 aa, Influenza virus
MESIKNGTY

SEQ ID NO: 337103 - protein, 9 aa, Influenza virus
ESVRNGTYD

SEQ ID NO: 337104 - protein, 9 aa, Influenza virus
SVRNGTYDY

SEQ ID NO: 337105 - protein, 9 aa, Influenza virus
VRNGTYDYP

SEQ ID NO: 337106 - protein, 9 aa, Influenza virus
RNGTYDYPK

SEQ ID NO: 337107 - protein, 9 aa, Influenza virus
TYDYPKYSK

SEQ ID NO: 337108 - protein, 9 aa, Influenza virus
YDYPKYSKE

SEQ ID NO: 337109 - protein, 9 aa, Influenza virus
NYPKYSEES

SEQ ID NO: 337110 - protein, 9 aa, Influenza virus
YPKYSEESR

SEQ ID NO: 337111 - protein, 9 aa, Influenza virus
PKYSEESRL

SEQ ID NO: 337112 - protein, 9 aa, Influenza virus
IHQILAIYS

SEQ ID NO: 337113 - protein, 9 aa, Influenza virus
IYSTVASSS

SEQ ID NO: 337114 - protein, 9 aa, Influenza virus
YSTVASSSV

SEQ ID NO: 337115 - protein, 9 aa, Influenza virus
STVASSSVL

SEQ ID NO: 337116 - protein, 9 aa, Influenza virus
ASSSVLLVS

SEQ ID NO: 337117 - protein, 9 aa, Influenza virus
SSSVLLVSL

SEQ ID NO: 337118 - protein, 9 aa, Influenza virus
SSVLLVSLG

SEQ ID NO: 337119 - protein, 9 aa, Influenza virus
SVLLVSLGA

SEQ ID NO: 337120 - protein, 9 aa, Influenza virus
VLIVSLGAI

SEQ ID NO: 337121 - protein, 9 aa, Influenza virus
LIVSLGAIS

SEQ ID NO: 337122 - protein, 9 aa, Influenza virus
IVSLGAISF

SEQ ID NO: 337123 - protein, 9 aa, Influenza virus
AVSFWMCSN

SEQ ID NO: 337124 - protein, 9 aa, Influenza virus
VSFWMCSNG

SEQ ID NO: 337125 - protein, 9 aa, Influenza virus
GFWMCSNGS

SEQ ID NO: 337126 - protein, 9 aa, Influenza virus
MCSGHSCRI

SEQ ID NO: 337127 - protein, 9 aa, Influenza virus
CSGHSCRIC

SEQ ID NO: 337128 - protein, 9 aa, Influenza virus
SNGSLRCRI

SEQ ID NO: 337129 - protein, 9 aa, Influenza virus
NGSLRCRIC

SEQ ID NO: 337130 - protein, 9 aa, Influenza virus
GSLRCRICI

SEQ ID NO: 337131 - protein, 9 aa, Influenza virus
QCRICILDQ

SEQ ID NO: 337132 - protein, 9 aa, Influenza virus
CRICIDFRD

SEQ ID NO: 337133 - protein, 9 aa, Influenza virus
GWAIHTKDN

SEQ ID NO: 337134 - protein, 9 aa, Influenza virus
WAIYSKDNG

SEQ ID NO: 337135 - protein, 9 aa, Influenza virus
YSKDNSVRI

SEQ ID NO: 337136 - protein, 9 aa, Influenza virus
SKDNSVRIG

SEQ ID NO: 337137 - protein, 9 aa, Influenza virus
KDNGIRIGS

SEQ ID NO: 337138 - protein, 9 aa, Influenza virus
DNGIRIGSK

SEQ ID NO: 337139 - protein, 9 aa, Influenza virus
NGIRIGSKG

SEQ ID NO: 337140 - protein, 9 aa, Influenza virus
GIRIGSKGD

SEQ ID NO: 337141 - protein, 9 aa, Influenza virus
IRIGSKGDI

SEQ ID NO: 337142 - protein, 9 aa, Influenza virus
GSKGDIFVM

SEQ ID NO: 337143 - protein, 9 aa, Influenza virus
SKGDIFVMR

SEQ ID NO: 337144 - protein, 9 aa, Influenza virus
KGDIFVMRE

SEQ ID NO: 337145 - protein, 9 aa, Influenza virus
GDIFVMREP

SEQ ID NO: 337146 - protein, 9 aa, Influenza virus
DIFVMREPF

SEQ ID NO: 337147 - protein, 9 aa, Influenza virus
IFVMREPFI

SEQ ID NO: 337148 - protein, 9 aa, Influenza virus
REPFISCSQ

SEQ ID NO: 337149 - protein, 9 aa, Influenza virus
EPFISCSQL

SEQ ID NO: 337150 - protein, 9 aa, Influenza virus
PFISCSQLE

SEQ ID NO: 337151 - protein, 9 aa, Influenza virus
FISCSQLEC

SEQ ID NO: 337152 - protein, 9 aa, Influenza virus
ISCSHLECK

SEQ ID NO: 337153 - protein, 9 aa, Influenza virus
NDRHSNGTV

SEQ ID NO: 337154 - protein, 9 aa, Influenza virus
DRHSNGTVK

SEQ ID NO: 337155 - protein, 9 aa, Influenza virus
HSNGTAKDR

SEQ ID NO: 337156 - protein, 9 aa, Influenza virus
SNGTAKDRS

SEQ ID NO: 337157 - protein, 9 aa, Influenza virus
KDRSPHRTL

SEQ ID NO: 337158 - protein, 9 aa, Influenza virus
DRSPHRTLM

SEQ ID NO: 337159 - protein, 9 aa, Influenza virus
PHRTLMSCP

SEQ ID NO: 337160 - protein, 9 aa, Influenza virus
RTLMSCPVG

SEQ ID NO: 337161 - protein, 9 aa, Influenza virus
TLMSCPVGE

SEQ ID NO: 337162 - protein, 9 aa, Influenza virus
LMSCPIGEA

SEQ ID NO: 337163 - protein, 9 aa, Influenza virus
MSCPIGEAP

SEQ ID NO: 337164 - protein, 9 aa, Influenza virus
SCPIGEAPS

SEQ ID NO: 337165 - protein, 9 aa, Influenza virus
CPIGEAPSP

SEQ ID NO: 337166 - protein, 9 aa, Influenza virus
PIGEAPSPY

SEQ ID NO: 337167 - protein, 9 aa, Influenza virus
IGEAPSPYN

SEQ ID NO: 337168 - protein, 9 aa, Influenza virus
EAPSPYNSR

SEQ ID NO: 337169 - protein, 9 aa, Influenza virus
APSPYNSRF

SEQ ID NO: 337170 - protein, 9 aa, Influenza virus
SASACHDGT

SEQ ID NO: 337171 - protein, 9 aa, Influenza virus
SWLTIGISG

SEQ ID NO: 337172 - protein, 9 aa, Influenza virus
ISGPDNEAV

SEQ ID NO: 337173 - protein, 9 aa, Influenza virus
PDNEAVAVL

SEQ ID NO: 337174 - protein, 9 aa, Influenza virus
DNEAVAVLK

SEQ ID NO: 337175 - protein, 9 aa, Influenza virus
VAVLKYNDI

SEQ ID NO: 337176 - protein, 9 aa, Influenza virus
LKYNGIITE

SEQ ID NO: 337177 - protein, 9 aa, Influenza virus
KYNGIITET

SEQ ID NO: 337178 - protein, 9 aa, Influenza virus
GIITETIKS

SEQ ID NO: 337179 - protein, 9 aa, Influenza virus
IITETIKSW

SEQ ID NO: 337180 - protein, 9 aa, Influenza virus
RILRTQESE

SEQ ID NO: 337181 - protein, 9 aa, Influenza virus
TQESECVCV

SEQ ID NO: 337182 - protein, 9 aa, Influenza virus
QESECVCVN

SEQ ID NO: 337183 - protein, 9 aa, Influenza virus
ESECVCVNG

SEQ ID NO: 337184 - protein, 9 aa, Influenza virus
SECVCVNGS

SEQ ID NO: 337185 - protein, 9 aa, Influenza virus
ECVCVNGSC

SEQ ID NO: 337186 - protein, 9 aa, Influenza virus
NGSCFTVLT

SEQ ID NO: 337187 - protein, 9 aa, Influenza virus
GSCFTVLTD

SEQ ID NO: 337188 - protein, 9 aa, Influenza virus
SCFTVLTDG

SEQ ID NO: 337189 - protein, 9 aa, Influenza virus
CFTVLTDGP

SEQ ID NO: 337190 - protein, 9 aa, Influenza virus
FTVLTDGPS

SEQ ID NO: 337191 - protein, 9 aa, Influenza virus
APNFYYEEC

SEQ ID NO: 337192 - protein, 9 aa, Influenza virus
PNFYYEECS

SEQ ID NO: 337193 - protein, 9 aa, Influenza virus
NFYYEECSC

SEQ ID NO: 337194 - protein, 9 aa, Influenza virus
FYYEECSCY

SEQ ID NO: 337195 - protein, 9 aa, Influenza virus
EECSCYPDA

SEQ ID NO: 337196 - protein, 9 aa, Influenza virus
VVCVCRDNW

SEQ ID NO: 337197 - protein, 9 aa, Influenza virus
VCVCRDNWH

SEQ ID NO: 337198 - protein, 9 aa, Influenza virus
HASNRPWIS

SEQ ID NO: 337199 - protein, 9 aa, Influenza virus
ASNRPWISF

SEQ ID NO: 337200 - protein, 9 aa, Influenza virus
SNRPWISFD

SEQ ID NO: 337201 - protein, 9 aa, Influenza virus
NRPWISFDQ

SEQ ID NO: 337202 - protein, 9 aa, Influenza virus
RPWVSFNQD

SEQ ID NO: 337203 - protein, 9 aa, Influenza virus
PWVSFNQDL

SEQ ID NO: 337204 - protein, 9 aa, Influenza virus
YQVGYICSG

SEQ ID NO: 337205 - protein, 9 aa, Influenza virus
MGYICSGIF

SEQ ID NO: 337206 - protein, 9 aa, Influenza virus
GVFGDNPRS

SEQ ID NO: 337207 - protein, 9 aa, Influenza virus
GAYGVKGFS

SEQ ID NO: 337208 - protein, 9 aa, Influenza virus
ADGVKGFSY

SEQ ID NO: 337209 - protein, 9 aa, Influenza virus
GVKGFSFRY

SEQ ID NO: 337210 - protein, 9 aa, Influenza virus
VKGFSFRYG

SEQ ID NO: 337211 - protein, 9 aa, Influenza virus
KGFSFRYGN

SEQ ID NO: 337212 - protein, 9 aa, Influenza virus
GFSFRYGNG

SEQ ID NO: 337213 - protein, 9 aa, Influenza virus
FSFRYGNGV

SEQ ID NO: 337214 - protein, 9 aa, Influenza virus
SFRYGNGVW

SEQ ID NO: 337215 - protein, 9 aa, Influenza virus
KYDNGVWIG

SEQ ID NO: 337216 - protein, 9 aa, Influenza virus
YGNGVWMGR

SEQ ID NO: 337217 - protein, 9 aa, Influenza virus
GNGVWMGRT

SEQ ID NO: 337218 - protein, 9 aa, Influenza virus
VWIGRTKST

SEQ ID NO: 337219 - protein, 9 aa, Influenza virus
GFEMVWDPN

SEQ ID NO: 337220 - protein, 9 aa, Influenza virus
FEMVWDPNG

SEQ ID NO: 337221 - protein, 9 aa, Influenza virus
MVWDPNGWT

SEQ ID NO: 337222 - protein, 9 aa, Influenza virus
NDWSGYSGS

SEQ ID NO: 337223 - protein, 9 aa, Influenza virus
QHPELTGLN

SEQ ID NO: 337224 - protein, 9 aa, Influenza virus
HPELTGLNC

SEQ ID NO: 337225 - protein, 9 aa, Influenza virus
PELTGMNCI

SEQ ID NO: 337226 - protein, 9 aa, Influenza virus
NCIRPCFWV

SEQ ID NO: 337227 - protein, 9 aa, Influenza virus
CIKPCFWVE

SEQ ID NO: 337228 - protein, 9 aa, Influenza virus
IKPCFWVEL

SEQ ID NO: 337229 - protein, 9 aa, Influenza virus
KPCFWVELI

SEQ ID NO: 337230 - protein, 9 aa, Influenza virus
FWVELIRGQ

SEQ ID NO: 337231 - protein, 9 aa, Influenza virus
WVELIRGQP

SEQ ID NO: 337232 - protein, 9 aa, Influenza virus
TIWTSASSI

SEQ ID NO: 337233 - protein, 9 aa, Influenza virus
IWTSGSIIS

SEQ ID NO: 337234 - protein, 9 aa, Influenza virus
WTSGSIISF

SEQ ID NO: 337235 - protein, 9 aa, Influenza virus
TSGSIISFC

SEQ ID NO: 337236 - protein, 9 aa, Influenza virus
SIISFCGVN

SEQ ID NO: 337237 - protein, 9 aa, Influenza virus
SISFCGVNG

SEQ ID NO: 337238 - protein, 9 aa, Influenza virus
SWSWPDGAD

SEQ ID NO: 337239 - protein, 9 aa, Influenza virus
WSWPDGAKL

SEQ ID NO: 337240 - protein, 9 aa, Influenza virus
SWPDGAKLP

SEQ ID NO: 337241 - protein, 9 aa, Influenza virus
WPDGAKLPF

SEQ ID NO: 337242 - protein, 9 aa, Influenza virus
PDGAKLPFT

SEQ ID NO: 337243 - protein, 9 aa, Influenza virus
DGAKLPFTI

SEQ ID NO: 337244 - protein, 9 aa, Influenza virus
DTICVGYHA

SEQ ID NO: 337245 - protein, 9 aa, Influenza virus
TICVGYHAN

SEQ ID NO: 337246 - protein, 9 aa, Influenza virus
ICVGYHANN

SEQ ID NO: 337247 - protein, 9 aa, Influenza virus
HANNSTDTI

SEQ ID NO: 337248 - protein, 9 aa, Influenza virus
ANNSTDTID

SEQ ID NO: 337249 - protein, 9 aa, Influenza virus
NNSTDTIDT

SEQ ID NO: 337250 - protein, 9 aa, Influenza virus
KNVTVTHSI

SEQ ID NO: 337251 - protein, 9 aa, Influenza virus
NVTVTHSIN

SEQ ID NO: 337252 - protein, 9 aa, Influenza virus
VTVTHSINL

SEQ ID NO: 337253 - protein, 9 aa, Influenza virus
KVTHRENLL

SEQ ID NO: 337254 - protein, 9 aa, Influenza virus
IAGWILGNP

SEQ ID NO: 337255 - protein, 9 aa, Influenza virus
GWILGNPKC

SEQ ID NO: 337256 - protein, 9 aa, Influenza virus
YEELREQLN

SEQ ID NO: 337257 - protein, 9 aa, Influenza virus
PFQNVHPIT

SEQ ID NO: 337258 - protein, 9 aa, Influenza virus
FQNVHPITI

SEQ ID NO: 337259 - protein, 9 aa, Influenza virus
QNVHPITIG

SEQ ID NO: 337260 - protein, 9 aa, Influenza virus
HPATIGECP

SEQ ID NO: 337261 - protein, 9 aa, Influenza virus
PATIGECPK

SEQ ID NO: 337262 - protein, 9 aa, Influenza virus
ATIGECPKY

SEQ ID NO: 337263 - protein, 9 aa, Influenza virus
IGKCPKYVK

SEQ ID NO: 337264 - protein, 9 aa, Influenza virus
GKCPKYVKS

SEQ ID NO: 337265 - protein, 9 aa, Influenza virus
LKMATGLRN

SEQ ID NO: 337266 - protein, 9 aa, Influenza virus
SVQSRGLFG

SEQ ID NO: 337267 - protein, 9 aa, Influenza virus
IQTRGLFGA

SEQ ID NO: 337268 - protein, 9 aa, Influenza virus
QSKGLFGAI

SEQ ID NO: 337269 - protein, 9 aa, Influenza virus
TRGLFGAIA

SEQ ID NO: 337270 - protein, 9 aa, Influenza virus
EGGWTGMVN

SEQ ID NO: 337271 - protein, 9 aa, Influenza virus
GGWTGMVNG

SEQ ID NO: 337272 - protein, 9 aa, Influenza virus
GWTGMVNGW

SEQ ID NO: 337273 - protein, 9 aa, Influenza virus
WTGMVNGWY

SEQ ID NO: 337274 - protein, 9 aa, Influenza virus
TGMVNGWYG

SEQ ID NO: 337275 - protein, 9 aa, Influenza virus
GMVNGWYGY

SEQ ID NO: 337276 - protein, 9 aa, Influenza virus
NDQGSGYAA

SEQ ID NO: 337277 - protein, 9 aa, Influenza virus
DQGSGYAAD

SEQ ID NO: 337278 - protein, 9 aa, Influenza virus
ENLNKKIDD

SEQ ID NO: 337279 - protein, 9 aa, Influenza virus
SLNNKVDDG

SEQ ID NO: 337280 - protein, 9 aa, Influenza virus
LNNKVDDGF

SEQ ID NO: 337281 - protein, 9 aa, Influenza virus
DLWTYNAEL

SEQ ID NO: 337282 - protein, 9 aa, Influenza virus
LWTYNAELL

SEQ ID NO: 337283 - protein, 9 aa, Influenza virus
LENERTLDL

SEQ ID NO: 337284 - protein, 9 aa, Influenza virus
ENERTLDLH

SEQ ID NO: 337285 - protein, 9 aa, Influenza virus
NERTLDLHD

SEQ ID NO: 337286 - protein, 9 aa, Influenza virus
ERTLDLHDS

SEQ ID NO: 337287 - protein, 9 aa, Influenza virus
RTLDLHDSN

SEQ ID NO: 337288 - protein, 9 aa, Influenza virus
TLDLHDSNV

SEQ ID NO: 337289 - protein, 9 aa, Influenza virus
NNAQEIGNG

SEQ ID NO: 337290 - protein, 9 aa, Influenza virus
NAKETGNGC

SEQ ID NO: 337291 - protein, 9 aa, Influenza virus
ARELGNGCF

SEQ ID NO: 337292 - protein, 9 aa, Influenza virus
QEIGNGCFE

SEQ ID NO: 337293 - protein, 9 aa, Influenza virus
CFEFYHRCD

SEQ ID NO: 337294 - protein, 9 aa, Influenza virus
FEFYHKCND

SEQ ID NO: 337295 - protein, 9 aa, Influenza virus
CMESVRNGT

SEQ ID NO: 337296 - protein, 9 aa, Influenza virus
MESVRNGTY

SEQ ID NO: 337297 - protein, 9 aa, Influenza virus
SVKNGTYNY

SEQ ID NO: 337298 - protein, 9 aa, Influenza virus
GFWMCSNGS

SEQ ID NO: 337299 - protein, 9 aa, Influenza virus
MCPNGSLQC

SEQ ID NO: 337300 - protein, 9 aa, Influenza virus
CSNGSLHGR

SEQ ID NO: 337301 - protein, 9 aa, Influenza virus
SNGSLQCRV

SEQ ID NO: 337302 - protein, 9 aa, Influenza virus
NGSLQCRVC

SEQ ID NO: 337303 - protein, 9 aa, Influenza virus
GSLQCRVCI

SEQ ID NO: 337304 - protein, 9 aa, Influenza virus
YRDWSKPQC

SEQ ID NO: 337305 - protein, 9 aa, Influenza virus
VTGFAPFSK

SEQ ID NO: 337306 - protein, 9 aa, Influenza virus
TGFASFSKD

SEQ ID NO: 337307 - protein, 9 aa, Influenza virus
SIRLSASGD

SEQ ID NO: 337308 - protein, 9 aa, Influenza virus
IRLSASGDI

SEQ ID NO: 337309 - protein, 9 aa, Influenza virus
RVSAGGDIW

SEQ ID NO: 337310 - protein, 9 aa, Influenza virus
LSAGGDIWI

SEQ ID NO: 337311 - protein, 9 aa, Influenza virus
SAGGDIWIT

SEQ ID NO: 337312 - protein, 9 aa, Influenza virus
AGGDIWITR

SEQ ID NO: 337313 - protein, 9 aa, Influenza virus
GGDIWITRE

SEQ ID NO: 337314 - protein, 9 aa, Influenza virus
GDIWITREP

SEQ ID NO: 337315 - protein, 9 aa, Influenza virus
DIWITREPY

SEQ ID NO: 337316 - protein, 9 aa, Influenza virus
VWVTREPYV

SEQ ID NO: 337317 - protein, 9 aa, Influenza virus
TREPYVSCS

SEQ ID NO: 337318 - protein, 9 aa, Influenza virus
ALGQGTTLK

SEQ ID NO: 337319 - protein, 9 aa, Influenza virus
LGQGTTLSN

SEQ ID NO: 337320 - protein, 9 aa, Influenza virus
DRIPHRTLL

SEQ ID NO: 337321 - protein, 9 aa, Influenza virus
RIPHRTLLM

SEQ ID NO: 337322 - protein, 9 aa, Influenza virus
SYRTLLMNE

SEQ ID NO: 337323 - protein, 9 aa, Influenza virus
HRTLLMSEL

SEQ ID NO: 337324 - protein, 9 aa, Influenza virus
MNELGVPFY

SEQ ID NO: 337325 - protein, 9 aa, Influenza virus
NELGVPFYL

SEQ ID NO: 337326 - protein, 9 aa, Influenza virus
ELGVPFYLG

SEQ ID NO: 337327 - protein, 9 aa, Influenza virus
LGVPFYLGT

SEQ ID NO: 337328 - protein, 9 aa, Influenza virus
GIPFHLGTK

SEQ ID NO: 337329 - protein, 9 aa, Influenza virus
PFYLGTKQV

SEQ ID NO: 337330 - protein, 9 aa, Influenza virus
FYLGTKQVC

SEQ ID NO: 337331 - protein, 9 aa, Influenza virus
LGTRQVCMA

SEQ ID NO: 337332 - protein, 9 aa, Influenza virus
GTRQVCMAW

SEQ ID NO: 337333 - protein, 9 aa, Influenza virus
TRQVCMAWS

SEQ ID NO: 337334 - protein, 9 aa, Influenza virus
RQVCMAWSS

SEQ ID NO: 337335 - protein, 9 aa, Influenza virus
IAWSSSSCY

SEQ ID NO: 337336 - protein, 9 aa, Influenza virus
SSSSCHDGR

SEQ ID NO: 337337 - protein, 9 aa, Influenza virus
SSSCHDGRA

SEQ ID NO: 337338 - protein, 9 aa, Influenza virus
SSCHDGRAW

SEQ ID NO: 337339 - protein, 9 aa, Influenza virus
SCHDGRAWL

SEQ ID NO: 337340 - protein, 9 aa, Influenza virus
CHDGRAWLH

SEQ ID NO: 337341 - protein, 9 aa, Influenza virus
HDGRAWLHV

SEQ ID NO: 337342 - protein, 9 aa, Influenza virus
DGKSWLHVC

SEQ ID NO: 337343 - protein, 9 aa, Influenza virus
SWLHVCVTG

SEQ ID NO: 337344 - protein, 9 aa, Influenza virus
RILRTQESE

SEQ ID NO: 337345 - protein, 9 aa, Influenza virus
LRTHESECV

SEQ ID NO: 337346 - protein, 9 aa, Influenza virus
RTHESECVC

SEQ ID NO: 337347 - protein, 9 aa, Influenza virus
TQESECVCV

SEQ ID NO: 337348 - protein, 9 aa, Influenza virus
TCTVIMTDG

SEQ ID NO: 337349 - protein, 9 aa, Influenza virus
CTVIMTDGS

SEQ ID NO: 337350 - protein, 9 aa, Influenza virus
TVIMTDGSA

SEQ ID NO: 337351 - protein, 9 aa, Influenza virus
VVMTDGSAT

SEQ ID NO: 337352 - protein, 9 aa, Influenza virus
VMTDGSALG

SEQ ID NO: 337353 - protein, 9 aa, Influenza virus
GGAQHVEEC

SEQ ID NO: 337354 - protein, 9 aa, Influenza virus
GAQHVEECS

SEQ ID NO: 337355 - protein, 9 aa, Influenza virus
EECSCYPRS

SEQ ID NO: 337356 - protein, 9 aa, Influenza virus
ECSCYPRSP

SEQ ID NO: 337357 - protein, 9 aa, Influenza virus
RCVCRDNWR

SEQ ID NO: 337358 - protein, 9 aa, Influenza virus
CVCRDNWRG

SEQ ID NO: 337359 - protein, 9 aa, Influenza virus
VCRDNWRGS

SEQ ID NO: 337360 - protein, 9 aa, Influenza virus
NWRGSNRPI

SEQ ID NO: 337361 - protein, 9 aa, Influenza virus
WKGSNRPII

SEQ ID NO: 337362 - protein, 9 aa, Influenza virus
KGSNRPIID

SEQ ID NO: 337363 - protein, 9 aa, Influenza virus
GSNRPIIDI

SEQ ID NO: 337364 - protein, 9 aa, Influenza virus
SSYICSGLV

SEQ ID NO: 337365 - protein, 9 aa, Influenza virus
SYICSGLVG

SEQ ID NO: 337366 - protein, 9 aa, Influenza virus
YICSGLVGD

SEQ ID NO: 337367 - protein, 9 aa, Influenza virus
ICSGLVGDT

SEQ ID NO: 337368 - protein, 9 aa, Influenza virus
GNPGVKGWA

SEQ ID NO: 337369 - protein, 9 aa, Influenza virus
NPGVKGWAF

SEQ ID NO: 337370 - protein, 9 aa, Influenza virus
GVKGWAFDY

SEQ ID NO: 337371 - protein, 9 aa, Influenza virus
RSGYETFRV

SEQ ID NO: 337372 - protein, 9 aa, Influenza virus
SGYETFRVI

SEQ ID NO: 337373 - protein, 9 aa, Influenza virus
RSGYSGVFS

SEQ ID NO: 337374 - protein, 9 aa, Influenza virus
SGYSGIFSI

SEQ ID NO: 337375 - protein, 9 aa, Influenza virus
GYSGIFSIE

SEQ ID NO: 337376 - protein, 9 aa, Influenza virus
RCINRCFYV

SEQ ID NO: 337377 - protein, 9 aa, Influenza virus
YVELIRGRN

SEQ ID NO: 337378 - protein, 9 aa, Influenza virus
VGWTSNSIV

SEQ ID NO: 337379 - protein, 9 aa, Influenza virus
GWTSNSIVV

SEQ ID NO: 337380 - protein, 9 aa, Influenza virus
STSIVVFCG

SEQ ID NO: 337381 - protein, 9 aa, Influenza virus
NSIVEFCGT

SEQ ID NO: 337382 - protein, 9 aa, Influenza virus
SIVAFCGTS

SEQ ID NO: 337383 - protein, 9 aa, Influenza virus
IVAFCGTSG

SEQ ID NO: 337384 - protein, 9 aa, Influenza virus
VVFCGTSGI

SEQ ID NO: 337385 - protein, 9 aa, Influenza virus
VFCSTSGTY

SEQ ID NO: 337386 - protein, 9 aa, Influenza virus
FCGASGTYG

SEQ ID NO: 337387 - protein, 9 aa, Influenza virus
GTYGSGSWP

SEQ ID NO: 337388 - protein, 9 aa, Influenza virus
TYGSGSWPD

SEQ ID NO: 337389 - protein, 9 aa, Influenza virus
YGSGSWPDG

SEQ ID NO: 337390 - protein, 9 aa, Influenza virus
GSGSWPDGA

SEQ ID NO: 337391 - protein, 9 aa, Influenza virus
GTWPDGADI

SEQ ID NO: 337392 - protein, 9 aa, Influenza virus
MDNKTKKMT

SEQ ID NO: 337393 - protein, 9 aa, Influenza virus
DNKTKKMTI

SEQ ID NO: 337394 - protein, 9 aa, Influenza virus
NKTKKMTIT

SEQ ID NO: 337395 - protein, 9 aa, Influenza virus
KTKKMTITF

SEQ ID NO: 337396 - protein, 9 aa, Influenza virus
GDRICIGYH

SEQ ID NO: 337397 - protein, 9 aa, Influenza virus
DQICVGYHS

SEQ ID NO: 337398 - protein, 9 aa, Influenza virus
QICVGYHSN

SEQ ID NO: 337399 - protein, 9 aa, Influenza virus
ICVGYHSNN

SEQ ID NO: 337400 - protein, 9 aa, Influenza virus
CVGYHSNNS

SEQ ID NO: 337401 - protein, 9 aa, Influenza virus
VGYHSNNST

SEQ ID NO: 337402 - protein, 9 aa, Influenza virus
YHANNSTET

SEQ ID NO: 337403 - protein, 9 aa, Influenza virus
NNSTERVDT

SEQ ID NO: 337404 - protein, 9 aa, Influenza virus
DTILEKNVT

SEQ ID NO: 337405 - protein, 9 aa, Influenza virus
TILEKNVTV

SEQ ID NO: 337406 - protein, 9 aa, Influenza virus
ILEKNVTVT

SEQ ID NO: 337407 - protein, 9 aa, Influenza virus
LEKNVTVTH

SEQ ID NO: 337408 - protein, 9 aa, Influenza virus
EKNVTVTHA

SEQ ID NO: 337409 - protein, 9 aa, Influenza virus
QNVTVTHAK

SEQ ID NO: 337410 - protein, 9 aa, Influenza virus
NVTVTHAKN

SEQ ID NO: 337411 - protein, 9 aa, Influenza virus
VTVTHAKNI

SEQ ID NO: 337412 - protein, 9 aa, Influenza virus
TVTHAKNIL

SEQ ID NO: 337413 - protein, 9 aa, Influenza virus
VTHAKNILE

SEQ ID NO: 337414 - protein, 9 aa, Influenza virus
THAKNILEK

SEQ ID NO: 337415 - protein, 9 aa, Influenza virus
DILEKVHNG

SEQ ID NO: 337416 - protein, 9 aa, Influenza virus
ILERTHNGK

SEQ ID NO: 337417 - protein, 9 aa, Influenza virus
LERTHNGKL

SEQ ID NO: 337418 - protein, 9 aa, Influenza virus
ERTHNGKLC

SEQ ID NO: 337419 - protein, 9 aa, Influenza virus
VHNGKLCRL

SEQ ID NO: 337420 - protein, 9 aa, Influenza virus
HNGKLCRLR

SEQ ID NO: 337421 - protein, 9 aa, Influenza virus
NGKLCRLRG

SEQ ID NO: 337422 - protein, 9 aa, Influenza virus
LRGIPPLEL

SEQ ID NO: 337423 - protein, 9 aa, Influenza virus
GIPPLVLGD

SEQ ID NO: 337424 - protein, 9 aa, Influenza virus
IPPLVLGDC

SEQ ID NO: 337425 - protein, 9 aa, Influenza virus
PPLVLGDCS

SEQ ID NO: 337426 - protein, 9 aa, Influenza virus
PLVLGDCSI

SEQ ID NO: 337427 - protein, 9 aa, Influenza virus
LVLGDCSIA

SEQ ID NO: 337428 - protein, 9 aa, Influenza virus
VLGDCSIAG

SEQ ID NO: 337429 - protein, 9 aa, Influenza virus
LLGNPECDL

SEQ ID NO: 337430 - protein, 9 aa, Influenza virus
LGNPECDLL

SEQ ID NO: 337431 - protein, 9 aa, Influenza virus
GNPECDLLL

SEQ ID NO: 337432 - protein, 9 aa, Influenza virus
VPEWSYIIE

SEQ ID NO: 337433 - protein, 9 aa, Influenza virus
PEWSYIVER

SEQ ID NO: 337434 - protein, 9 aa, Influenza virus
EWSYIVERE

SEQ ID NO: 337435 - protein, 9 aa, Influenza virus
PSFFRNMIW

SEQ ID NO: 337436 - protein, 9 aa, Influenza virus
GSYNNTNGE

SEQ ID NO: 337437 - protein, 9 aa, Influenza virus
SYNNTSGKQ

SEQ ID NO: 337438 - protein, 9 aa, Influenza virus
YNNTSGEQI

SEQ ID NO: 337439 - protein, 9 aa, Influenza virus
NNTSGEQIL

SEQ ID NO: 337440 - protein, 9 aa, Influenza virus
RMEFFWTLL

SEQ ID NO: 337441 - protein, 9 aa, Influenza virus
INFESNGNL

SEQ ID NO: 337442 - protein, 9 aa, Influenza virus
SFESTGNLI

SEQ ID NO: 337443 - protein, 9 aa, Influenza virus
FESNGNLIA

SEQ ID NO: 337444 - protein, 9 aa, Influenza virus
ESNGNLIAP

SEQ ID NO: 337445 - protein, 9 aa, Influenza virus
SNGNLIAPE

SEQ ID NO: 337446 - protein, 9 aa, Influenza virus
NGNLIAPEY

SEQ ID NO: 337447 - protein, 9 aa, Influenza virus
LIAPEYGFR

SEQ ID NO: 337448 - protein, 9 aa, Influenza virus
IAPEYGFRI

SEQ ID NO: 337449 - protein, 9 aa, Influenza virus
GFRISKRGS

SEQ ID NO: 337450 - protein, 9 aa, Influenza virus
FKISKRGNS

SEQ ID NO: 337451 - protein, 9 aa, Influenza virus
KISKRGNSG

SEQ ID NO: 337452 - protein, 9 aa, Influenza virus
ISKRGNSGI

SEQ ID NO: 337453 - protein, 9 aa, Influenza virus
SKRGSSGIV

SEQ ID NO: 337454 - protein, 9 aa, Influenza virus
KRGSSGIVK

SEQ ID NO: 337455 - protein, 9 aa, Influenza virus
RGNSGIMKT

SEQ ID NO: 337456 - protein, 9 aa, Influenza virus
CETQCQTPL

SEQ ID NO: 337457 - protein, 9 aa, Influenza virus
ETQCQTPLG

SEQ ID NO: 337458 - protein, 9 aa, Influenza virus
TQCQTPLGA

SEQ ID NO: 337459 - protein, 9 aa, Influenza virus
QCQTPLGAI

SEQ ID NO: 337460 - protein, 9 aa, Influenza virus
CQSPLGAIN

SEQ ID NO: 337461 - protein, 9 aa, Influenza virus
QSPLGAINT

SEQ ID NO: 337462 - protein, 9 aa, Influenza virus
SPLGAINTT

SEQ ID NO: 337463 - protein, 9 aa, Influenza virus
PFHNIHPLA

SEQ ID NO: 337464 - protein, 9 aa, Influenza virus
FHNIHPLAI

SEQ ID NO: 337465 - protein, 9 aa, Influenza virus
HNIHPLAIG

SEQ ID NO: 337466 - protein, 9 aa, Influenza virus
NIHPLAIGE

SEQ ID NO: 337467 - protein, 9 aa, Influenza virus
IHPLAIGEC

SEQ ID NO: 337468 - protein, 9 aa, Influenza virus
TIGECPKYI

SEQ ID NO: 337469 - protein, 9 aa, Influenza virus
IGECPKYVR

SEQ ID NO: 337470 - protein, 9 aa, Influenza virus
GECPKYVRS

SEQ ID NO: 337471 - protein, 9 aa, Influenza virus
LVLAAGLRN

SEQ ID NO: 337472 - protein, 9 aa, Influenza virus
PQIEPRGLF

SEQ ID NO: 337473 - protein, 9 aa, Influenza virus
QMESRGLFG

SEQ ID NO: 337474 - protein, 9 aa, Influenza virus
IEPRGLFGA

SEQ ID NO: 337475 - protein, 9 aa, Influenza virus
EARGLFGAI

SEQ ID NO: 337476 - protein, 9 aa, Influenza virus
ARGLFGAIA

SEQ ID NO: 337477 - protein, 9 aa, Influenza virus
GSGYAADKA

SEQ ID NO: 337478 - protein, 9 aa, Influenza virus
SGYAADKAS

SEQ ID NO: 337479 - protein, 9 aa, Influenza virus
AADKASTQK

SEQ ID NO: 337480 - protein, 9 aa, Influenza virus
ADKASTQKA

SEQ ID NO: 337481 - protein, 9 aa, Influenza virus
NSVIEKINT

SEQ ID NO: 337482 - protein, 9 aa, Influenza virus
VGKEFNSLE

SEQ ID NO: 337483 - protein, 9 aa, Influenza virus
SLERRLENL

SEQ ID NO: 337484 - protein, 9 aa, Influenza virus
LEKRLGNLN

SEQ ID NO: 337485 - protein, 9 aa, Influenza virus
EKRLGNLNK

SEQ ID NO: 337486 - protein, 9 aa, Influenza virus
KRLGNLNKK

SEQ ID NO: 337487 - protein, 9 aa, Influenza virus
RLGNLNKKM

SEQ ID NO: 337488 - protein, 9 aa, Influenza virus
LGNLNKKME

SEQ ID NO: 337489 - protein, 9 aa, Influenza virus
GNLNKKMED

SEQ ID NO: 337490 - protein, 9 aa, Influenza virus
NLSKRMEDG

SEQ ID NO: 337491 - protein, 9 aa, Influenza virus
LSKRMEDGF

SEQ ID NO: 337492 - protein, 9 aa, Influenza virus
VWTYNAEVL

SEQ ID NO: 337493 - protein, 9 aa, Influenza virus
WTYNAEVLV

SEQ ID NO: 337494 - protein, 9 aa, Influenza virus
TYNAEVLVL

SEQ ID NO: 337495 - protein, 9 aa, Influenza virus
YNAEVLVLM

SEQ ID NO: 337496 - protein, 9 aa, Influenza virus
NAEVLVLME

SEQ ID NO: 337497 - protein, 9 aa, Influenza virus
VELLVLMEN

SEQ ID NO: 337498 - protein, 9 aa, Influenza virus
LMENERILD

SEQ ID NO: 337499 - protein, 9 aa, Influenza virus
MENEMTLDF

SEQ ID NO: 337500 - protein, 9 aa, Influenza virus
ENEMTLDFH

SEQ ID NO: 337501 - protein, 9 aa, Influenza virus
NEMTLDFHD

SEQ ID NO: 337502 - protein, 9 aa, Influenza virus
EMTLDFHDS

SEQ ID NO: 337503 - protein, 9 aa, Influenza virus
MTLDFHDSN

SEQ ID NO: 337504 - protein, 9 aa, Influenza virus
TLDFHDSSV

SEQ ID NO: 337505 - protein, 9 aa, Influenza virus
LDYHDSNVK

SEQ ID NO: 337506 - protein, 9 aa, Influenza virus
DFHDSNVKS

SEQ ID NO: 337507 - protein, 9 aa, Influenza virus
FHDSNVKSL

SEQ ID NO: 337508 - protein, 9 aa, Influenza virus
HDSNVKSLY

SEQ ID NO: 337509 - protein, 9 aa, Influenza virus
DSNVKSLYD

SEQ ID NO: 337510 - protein, 9 aa, Influenza virus
SLYDKVRMQ

SEQ ID NO: 337511 - protein, 9 aa, Influenza virus
LYEKVRMQL

SEQ ID NO: 337512 - protein, 9 aa, Influenza virus
YDKVRMQLK

SEQ ID NO: 337513 - protein, 9 aa, Influenza virus
DRVRMQLRD

SEQ ID NO: 337514 - protein, 9 aa, Influenza virus
RVRMQLRDN

SEQ ID NO: 337515 - protein, 9 aa, Influenza virus
VRMQLKDNA

SEQ ID NO: 337516 - protein, 9 aa, Influenza virus
RMQLKDNAK

SEQ ID NO: 337517 - protein, 9 aa, Influenza virus
MQLKDNAKE

SEQ ID NO: 337518 - protein, 9 aa, Influenza virus
QLRDNAKEL

SEQ ID NO: 337519 - protein, 9 aa, Influenza virus
LRDNAKELG

SEQ ID NO: 337520 - protein, 9 aa, Influenza virus
DNAKELGNG

SEQ ID NO: 337521 - protein, 9 aa, Influenza virus
NAKELGNGC

SEQ ID NO: 337522 - protein, 9 aa, Influenza virus
AKELGNGCF

SEQ ID NO: 337523 - protein, 9 aa, Influenza virus
KEVGNGCFE

SEQ ID NO: 337524 - protein, 9 aa, Influenza virus
EVGNGCFEF

SEQ ID NO: 337525 - protein, 9 aa, Influenza virus
VGNGCFEFY

SEQ ID NO: 337526 - protein, 9 aa, Influenza virus
FEFYHKCND

SEQ ID NO: 337527 - protein, 9 aa, Influenza virus
EFYHKCNDE

SEQ ID NO: 337528 - protein, 9 aa, Influenza virus
FYHKCNDEC

SEQ ID NO: 337529 - protein, 9 aa, Influenza virus
YHKCNDECM

SEQ ID NO: 337530 - protein, 9 aa, Influenza virus
HKCDNECMD

SEQ ID NO: 337531 - protein, 9 aa, Influenza virus
KCDNECMDS

SEQ ID NO: 337532 - protein, 9 aa, Influenza virus
SVRNGTYNY

SEQ ID NO: 337533 - protein, 9 aa, Influenza virus
NGTYNYPKY

SEQ ID NO: 337534 - protein, 9 aa, Influenza virus
GTYNYPKYE

SEQ ID NO: 337535 - protein, 9 aa, Influenza virus
TYNYPKYEE

SEQ ID NO: 337536 - protein, 9 aa, Influenza virus
YNYPKYEEE

SEQ ID NO: 337537 - protein, 9 aa, Influenza virus
NYPKYEEES

SEQ ID NO: 337538 - protein, 9 aa, Influenza virus
YPKYEEESR

SEQ ID NO: 337539 - protein, 9 aa, Influenza virus
PKYEEESRL

SEQ ID NO: 337540 - protein, 9 aa, Influenza virus
KYEEESRLN

SEQ ID NO: 337541 - protein, 9 aa, Influenza virus
YEEESRLNR

SEQ ID NO: 337542 - protein, 9 aa, Influenza virus
EEESKLNRT

SEQ ID NO: 337543 - protein, 9 aa, Influenza virus
EESKLNRTE

SEQ ID NO: 337544 - protein, 9 aa, Influenza virus
ESKLNRTEI

SEQ ID NO: 337545 - protein, 9 aa, Influenza virus
SKLNRTEIK

SEQ ID NO: 337546 - protein, 9 aa, Influenza virus
KLNRTEIKG

SEQ ID NO: 337547 - protein, 9 aa, Influenza virus
MGVYQILVI

SEQ ID NO: 337548 - protein, 9 aa, Influenza virus
GVYQVLAIY

SEQ ID NO: 337549 - protein, 9 aa, Influenza virus
VYQILVIYA

SEQ ID NO: 337550 - protein, 9 aa, Influenza virus
GSLSLAIMV

SEQ ID NO: 337551 - protein, 9 aa, Influenza virus
SLSLAIMVA

SEQ ID NO: 337552 - protein, 9 aa, Influenza virus
LSLAIMVAG

SEQ ID NO: 337553 - protein, 9 aa, Influenza virus
SLAIMVAGI

SEQ ID NO: 337554 - protein, 9 aa, Influenza virus
LAIMVAGIS

SEQ ID NO: 337555 - protein, 9 aa, Influenza virus
AGISIWMCS

SEQ ID NO: 337556 - protein, 9 aa, Influenza virus
GISIWMCSN

SEQ ID NO: 337557 - protein, 9 aa, Influenza virus
ISIWMCSNG

SEQ ID NO: 337558 - protein, 9 aa, Influenza virus
SIWMCSNGS

SEQ ID NO: 337559 - protein, 9 aa, Influenza virus
IWMCSNGSL

SEQ ID NO: 337560 - protein, 9 aa, Influenza virus
VRGDQICVG

SEQ ID NO: 337561 - protein, 9 aa, Influenza virus
RGDQICVGY

SEQ ID NO: 337562 - protein, 9 aa, Influenza virus
GDRICIGYH

SEQ ID NO: 337563 - protein, 9 aa, Influenza virus
DQICVGYHS

SEQ ID NO: 337564 - protein, 9 aa, Influenza virus
QICVGYHSN

SEQ ID NO: 337565 - protein, 9 aa, Influenza virus
ICVGYHSNN

SEQ ID NO: 337566 - protein, 9 aa, Influenza virus
CVGYHSNNS

SEQ ID NO: 337567 - protein, 9 aa, Influenza virus
VGYHSNNST

SEQ ID NO: 337568 - protein, 9 aa, Influenza virus
YHANNSTET

SEQ ID NO: 337569 - protein, 9 aa, Influenza virus
NNSTKKVDT

SEQ ID NO: 337570 - protein, 9 aa, Influenza virus
KADTILERN

SEQ ID NO: 337571 - protein, 9 aa, Influenza virus
VDTNLERNV

SEQ ID NO: 337572 - protein, 9 aa, Influenza virus
NVTVTHAKN

SEQ ID NO: 337573 - protein, 9 aa, Influenza virus
VTVTHAKNI

SEQ ID NO: 337574 - protein, 9 aa, Influenza virus
TVTHAKNIL

SEQ ID NO: 337575 - protein, 9 aa, Influenza virus
VTHAKNILE

SEQ ID NO: 337576 - protein, 9 aa, Influenza virus
THAKNILEK

SEQ ID NO: 337577 - protein, 9 aa, Influenza virus
HAKNILEKT

SEQ ID NO: 337578 - protein, 9 aa, Influenza virus
AKNILEKTH

SEQ ID NO: 337579 - protein, 9 aa, Influenza virus
KNILEKTHN

SEQ ID NO: 337580 - protein, 9 aa, Influenza virus
DILEKAHNG

SEQ ID NO: 337581 - protein, 9 aa, Influenza virus
ILEKAHNGK

SEQ ID NO: 337582 - protein, 9 aa, Influenza virus
LERTHNGKL

SEQ ID NO: 337583 - protein, 9 aa, Influenza virus
ERTHNGKLC

SEQ ID NO: 337584 - protein, 9 aa, Influenza virus
KAHNGKLCR

SEQ ID NO: 337585 - protein, 9 aa, Influenza virus
THNGRLCKL

SEQ ID NO: 337586 - protein, 9 aa, Influenza virus
HNGKLCRLR

SEQ ID NO: 337587 - protein, 9 aa, Influenza virus
NGKLCRLRG

SEQ ID NO: 337588 - protein, 9 aa, Influenza virus
GKLCRLRGI

SEQ ID NO: 337589 - protein, 9 aa, Influenza virus
KLCRLRGIP

SEQ ID NO: 337590 - protein, 9 aa, Influenza virus
LCRLRGIPP

SEQ ID NO: 337591 - protein, 9 aa, Influenza virus
CRLRGIPPL

SEQ ID NO: 337592 - protein, 9 aa, Influenza virus
RLRGIPPLE

SEQ ID NO: 337593 - protein, 9 aa, Influenza virus
LRGIPPLEL

SEQ ID NO: 337594 - protein, 9 aa, Influenza virus
RGIPPLELG

SEQ ID NO: 337595 - protein, 9 aa, Influenza virus
NPECDRLLT

SEQ ID NO: 337596 - protein, 9 aa, Influenza virus
LTVPEWSYI

SEQ ID NO: 337597 - protein, 9 aa, Influenza virus
VPEWSYIIE

SEQ ID NO: 337598 - protein, 9 aa, Influenza virus
PEWSYIVEK

SEQ ID NO: 337599 - protein, 9 aa, Influenza virus
EWSYIVEKE

SEQ ID NO: 337600 - protein, 9 aa, Influenza virus
WSYIVERET

SEQ ID NO: 337601 - protein, 9 aa, Influenza virus
SYIVERETP

SEQ ID NO: 337602 - protein, 9 aa, Influenza virus
SLCYPGSLN

SEQ ID NO: 337603 - protein, 9 aa, Influenza virus
LCYPGNFND

SEQ ID NO: 337604 - protein, 9 aa, Influenza virus
CYPGSLNDY

SEQ ID NO: 337605 - protein, 9 aa, Influenza virus
YPGSLNDYE

SEQ ID NO: 337606 - protein, 9 aa, Influenza virus
PGSLNDYEE

SEQ ID NO: 337607 - protein, 9 aa, Influenza virus
GSLNDYEEL

SEQ ID NO: 337608 - protein, 9 aa, Influenza virus
SLNDYEELK

SEQ ID NO: 337609 - protein, 9 aa, Influenza virus
LNDYEELKH

SEQ ID NO: 337610 - protein, 9 aa, Influenza virus
NDYEELKHF

SEQ ID NO: 337611 - protein, 9 aa, Influenza virus
VKHFEKVRI

SEQ ID NO: 337612 - protein, 9 aa, Influenza virus
KHFEKVRIL

SEQ ID NO: 337613 - protein, 9 aa, Influenza virus
HFEKIKILP

SEQ ID NO: 337614 - protein, 9 aa, Influenza virus
FEKVRILPK

SEQ ID NO: 337615 - protein, 9 aa, Influenza virus
EKVRILPKD

SEQ ID NO: 337616 - protein, 9 aa, Influenza virus
PSFFRNMIW

SEQ ID NO: 337617 - protein, 9 aa, Influenza virus
VAKRSYNNT

SEQ ID NO: 337618 - protein, 9 aa, Influenza virus
AQGSYNNTS

SEQ ID NO: 337619 - protein, 9 aa, Influenza virus
KGSYNNTNG

SEQ ID NO: 337620 - protein, 9 aa, Influenza virus
GSYNNTNGE

SEQ ID NO: 337621 - protein, 9 aa, Influenza virus
YNNTSGKQM

SEQ ID NO: 337622 - protein, 9 aa, Influenza virus
NNTSGEQVL

SEQ ID NO: 337623 - protein, 9 aa, Influenza virus
NTNGEQILI

SEQ ID NO: 337624 - protein, 9 aa, Influenza virus
TNGEQILII

SEQ ID NO: 337625 - protein, 9 aa, Influenza virus
NGEQILIIW

SEQ ID NO: 337626 - protein, 9 aa, Influenza virus
GEQILIIWG

SEQ ID NO: 337627 - protein, 9 aa, Influenza virus
LVIWGIHHP

SEQ ID NO: 337628 - protein, 9 aa, Influenza virus
IWGVHHPID

SEQ ID NO: 337629 - protein, 9 aa, Influenza virus
WGVHHPIDE

SEQ ID NO: 337630 - protein, 9 aa, Influenza virus
LYQEVGTYV

SEQ ID NO: 337631 - protein, 9 aa, Influenza virus
YQEVGTYVS

SEQ ID NO: 337632 - protein, 9 aa, Influenza virus
RMEFFWTLL

SEQ ID NO: 337633 - protein, 9 aa, Influenza virus
WDVISFEST

SEQ ID NO: 337634 - protein, 9 aa, Influenza virus
DVISFESTG

SEQ ID NO: 337635 - protein, 9 aa, Influenza virus
VISFESTGN

SEQ ID NO: 337636 - protein, 9 aa, Influenza virus
SFESTGNLI

SEQ ID NO: 337637 - protein, 9 aa, Influenza virus
LVVPEYGFK

SEQ ID NO: 337638 - protein, 9 aa, Influenza virus
VVPEYGFKI

SEQ ID NO: 337639 - protein, 9 aa, Influenza virus
GFRISKRGS

SEQ ID NO: 337640 - protein, 9 aa, Influenza virus
FRISKRGSS

SEQ ID NO: 337641 - protein, 9 aa, Influenza virus
KISRRGNSG

SEQ ID NO: 337642 - protein, 9 aa, Influenza virus
ISKRGSSGV

SEQ ID NO: 337643 - protein, 9 aa, Influenza virus
SKRGSSGVM

SEQ ID NO: 337644 - protein, 9 aa, Influenza virus
KRGSSGVMK

SEQ ID NO: 337645 - protein, 9 aa, Influenza virus
RGSSGVMKT

SEQ ID NO: 337646 - protein, 9 aa, Influenza virus
GSSGIMKTG

SEQ ID NO: 337647 - protein, 9 aa, Influenza virus
SGIMKTGGT

SEQ ID NO: 337648 - protein, 9 aa, Influenza virus
GIMKTGGTL

SEQ ID NO: 337649 - protein, 9 aa, Influenza virus
DCETKCQTP

SEQ ID NO: 337650 - protein, 9 aa, Influenza virus
CDTKCQTPL

SEQ ID NO: 337651 - protein, 9 aa, Influenza virus
DTKCQTPLG

SEQ ID NO: 337652 - protein, 9 aa, Influenza virus
IKCQTPLGA

SEQ ID NO: 337653 - protein, 9 aa, Influenza virus
KCQSPLGAI

SEQ ID NO: 337654 - protein, 9 aa, Influenza virus
CQSPLGAIN

SEQ ID NO: 337655 - protein, 9 aa, Influenza virus
QSPLGAINT

SEQ ID NO: 337656 - protein, 9 aa, Influenza virus
SPLGAINTT

SEQ ID NO: 337657 - protein, 9 aa, Influenza virus
FHNVHPLAI

SEQ ID NO: 337658 - protein, 9 aa, Influenza virus
HNVHPLAIG

SEQ ID NO: 337659 - protein, 9 aa, Influenza virus
NVHPLAIGE

SEQ ID NO: 337660 - protein, 9 aa, Influenza virus
VHPLAIGEC

SEQ ID NO: 337661 - protein, 9 aa, Influenza virus
PLTMGECPK

SEQ ID NO: 337662 - protein, 9 aa, Influenza virus
LTMGECPKY

SEQ ID NO: 337663 - protein, 9 aa, Influenza virus
AIGECPKYV

SEQ ID NO: 337664 - protein, 9 aa, Influenza virus
MGECPKYVK

SEQ ID NO: 337665 - protein, 9 aa, Influenza virus
ECPKYVRSE

SEQ ID NO: 337666 - protein, 9 aa, Influenza virus
CPKYVKSER

SEQ ID NO: 337667 - protein, 9 aa, Influenza virus
PKYVKSERL

SEQ ID NO: 337668 - protein, 9 aa, Influenza virus
KYVKSERLV

SEQ ID NO: 337669 - protein, 9 aa, Influenza virus
YVKSERLVL

SEQ ID NO: 337670 - protein, 9 aa, Influenza virus
VKSERLVLA

SEQ ID NO: 337671 - protein, 9 aa, Influenza virus
KSERLVLAT

SEQ ID NO: 337672 - protein, 9 aa, Influenza virus
SERLVLATG

SEQ ID NO: 337673 - protein, 9 aa, Influenza virus
ERLVLATGL

SEQ ID NO: 337674 - protein, 9 aa, Influenza virus
KLVLATGPR

SEQ ID NO: 337675 - protein, 9 aa, Influenza virus
VLATGPRNV

SEQ ID NO: 337676 - protein, 9 aa, Influenza virus
LATGPRNVP

SEQ ID NO: 337677 - protein, 9 aa, Influenza virus
ATGPRNVPQ

SEQ ID NO: 337678 - protein, 9 aa, Influenza virus
TGPRNVPQI

SEQ ID NO: 337679 - protein, 9 aa, Influenza virus
GPRNVPQIE

SEQ ID NO: 337680 - protein, 9 aa, Influenza virus
RNVPQMESR

SEQ ID NO: 337681 - protein, 9 aa, Influenza virus
NVPQMESRG

SEQ ID NO: 337682 - protein, 9 aa, Influenza virus
VPQMESRGL

SEQ ID NO: 337683 - protein, 9 aa, Influenza virus
PQIEARGLF

SEQ ID NO: 337684 - protein, 9 aa, Influenza virus
QIEPRGLFG

SEQ ID NO: 337685 - protein, 9 aa, Influenza virus
IEARGLFGA

SEQ ID NO: 337686 - protein, 9 aa, Influenza virus
GAGYAADKE

SEQ ID NO: 337687 - protein, 9 aa, Influenza virus
AGYAADKES

SEQ ID NO: 337688 - protein, 9 aa, Influenza virus
AADKESTQR

SEQ ID NO: 337689 - protein, 9 aa, Influenza virus
ADKESTQRA

SEQ ID NO: 337690 - protein, 9 aa, Influenza virus
DKASTQKAI

SEQ ID NO: 337691 - protein, 9 aa, Influenza virus
VNFVIEKMN

SEQ ID NO: 337692 - protein, 9 aa, Influenza virus
NFVIEKMNT

SEQ ID NO: 337693 - protein, 9 aa, Influenza virus
FVIEKMNTQ

SEQ ID NO: 337694 - protein, 9 aa, Influenza virus
IEKINTQFE

SEQ ID NO: 337695 - protein, 9 aa, Influenza virus
AVGKEFGNL

SEQ ID NO: 337696 - protein, 9 aa, Influenza virus
VGKEFGNLE

SEQ ID NO: 337697 - protein, 9 aa, Influenza virus
KEFNNLERR

SEQ ID NO: 337698 - protein, 9 aa, Influenza virus
EFNNLERRL

SEQ ID NO: 337699 - protein, 9 aa, Influenza virus
FNNLERRLE

SEQ ID NO: 337700 - protein, 9 aa, Influenza virus
NNLERRLEN

SEQ ID NO: 337701 - protein, 9 aa, Influenza virus
LEKRLENLD

SEQ ID NO: 337702 - protein, 9 aa, Influenza virus
EKRLENLDK

SEQ ID NO: 337703 - protein, 9 aa, Influenza virus
RRLENLNKR

SEQ ID NO: 337704 - protein, 9 aa, Influenza virus
RLGNLNKKM

SEQ ID NO: 337705 - protein, 9 aa, Influenza virus
LENLSKRME

SEQ ID NO: 337706 - protein, 9 aa, Influenza virus
ENLDKKMED

SEQ ID NO: 337707 - protein, 9 aa, Influenza virus
NLSKRMEDG

SEQ ID NO: 337708 - protein, 9 aa, Influenza virus
LSKRMEDGF

SEQ ID NO: 337709 - protein, 9 aa, Influenza virus
VEDGFLDVW

SEQ ID NO: 337710 - protein, 9 aa, Influenza virus
EDGLLDVWT

SEQ ID NO: 337711 - protein, 9 aa, Influenza virus
DGFLGVWTY

SEQ ID NO: 337712 - protein, 9 aa, Influenza virus
GFRDVWTYN

SEQ ID NO: 337713 - protein, 9 aa, Influenza virus
FLGVWTYNA

SEQ ID NO: 337714 - protein, 9 aa, Influenza virus
LDVWTYNTE

SEQ ID NO: 337715 - protein, 9 aa, Influenza virus
LMENERILD

SEQ ID NO: 337716 - protein, 9 aa, Influenza virus
MENERILDF

SEQ ID NO: 337717 - protein, 9 aa, Influenza virus
ENERTLGFH

SEQ ID NO: 337718 - protein, 9 aa, Influenza virus
NERILDFHD

SEQ ID NO: 337719 - protein, 9 aa, Influenza virus
ERILDFHDS

SEQ ID NO: 337720 - protein, 9 aa, Influenza virus
RTLDFHDSS

SEQ ID NO: 337721 - protein, 9 aa, Influenza virus
ILDFHDSNV

SEQ ID NO: 337722 - protein, 9 aa, Influenza virus
LGFHDSNVK

SEQ ID NO: 337723 - protein, 9 aa, Influenza virus
DFHDSNVRN

SEQ ID NO: 337724 - protein, 9 aa, Influenza virus
FHDSNVRNL

SEQ ID NO: 337725 - protein, 9 aa, Influenza virus
HDSNVRNLY

SEQ ID NO: 337726 - protein, 9 aa, Influenza virus
DSNVKNLYN

SEQ ID NO: 337727 - protein, 9 aa, Influenza virus
VKNLYNKVR

SEQ ID NO: 337728 - protein, 9 aa, Influenza virus
KNLYNKVRM

SEQ ID NO: 337729 - protein, 9 aa, Influenza virus
NLYNKVRMQ

SEQ ID NO: 337730 - protein, 9 aa, Influenza virus
LYEKVRMQL

SEQ ID NO: 337731 - protein, 9 aa, Influenza virus
YEKVRMQLR

SEQ ID NO: 337732 - protein, 9 aa, Influenza virus
EKVRMQLRD

SEQ ID NO: 337733 - protein, 9 aa, Influenza virus
QLRDNAKEL

SEQ ID NO: 337734 - protein, 9 aa, Influenza virus
LRDNAKELG

SEQ ID NO: 337735 - protein, 9 aa, Influenza virus
RDNAKELGN

SEQ ID NO: 337736 - protein, 9 aa, Influenza virus
DNAKELGNG

SEQ ID NO: 337737 - protein, 9 aa, Influenza virus
NAKELGNGC

SEQ ID NO: 337738 - protein, 9 aa, Influenza virus
AKELGNGCF

SEQ ID NO: 337739 - protein, 9 aa, Influenza virus
FEFYHKCND

SEQ ID NO: 337740 - protein, 9 aa, Influenza virus
EFYHKCNDE

SEQ ID NO: 337741 - protein, 9 aa, Influenza virus
FYHKCNDEC

SEQ ID NO: 337742 - protein, 9 aa, Influenza virus
YHKCNDECM

SEQ ID NO: 337743 - protein, 9 aa, Influenza virus
CMDSVKNGT

SEQ ID NO: 337744 - protein, 9 aa, Influenza virus
MDSVKNGTY

SEQ ID NO: 337745 - protein, 9 aa, Influenza virus
SVKNGTYYY

SEQ ID NO: 337746 - protein, 9 aa, Influenza virus
KNGTYYYPK

SEQ ID NO: 337747 - protein, 9 aa, Influenza virus
NGTYNYPKY

SEQ ID NO: 337748 - protein, 9 aa, Influenza virus
GTYNYPKYE

SEQ ID NO: 337749 - protein, 9 aa, Influenza virus
TYNYPKYEE

SEQ ID NO: 337750 - protein, 9 aa, Influenza virus
YDYPKYEKE

SEQ ID NO: 337751 - protein, 9 aa, Influenza virus
DYSKYEEES

SEQ ID NO: 337752 - protein, 9 aa, Influenza virus
YPKYEKESK

SEQ ID NO: 337753 - protein, 9 aa, Influenza virus
SKYEEESKL

SEQ ID NO: 337754 - protein, 9 aa, Influenza virus
KYEEESRLN

SEQ ID NO: 337755 - protein, 9 aa, Influenza virus
YEEESRLNR

SEQ ID NO: 337756 - protein, 9 aa, Influenza virus
EEESRLNRN

SEQ ID NO: 337757 - protein, 9 aa, Influenza virus
EESRLNRNE

SEQ ID NO: 337758 - protein, 9 aa, Influenza virus
ESRLNRNEI

SEQ ID NO: 337759 - protein, 9 aa, Influenza virus
SRLNRNEIK

SEQ ID NO: 337760 - protein, 9 aa, Influenza virus
RLNRNEIKG

SEQ ID NO: 337761 - protein, 9 aa, Influenza virus
LNKNEIKGV

SEQ ID NO: 337762 - protein, 9 aa, Influenza virus
KRNEIKGVE

SEQ ID NO: 337763 - protein, 9 aa, Influenza virus
KNEIKGVKL

SEQ ID NO: 337764 - protein, 9 aa, Influenza virus
EIKGVELSS

SEQ ID NO: 337765 - protein, 9 aa, Influenza virus
IKGVELSSM

SEQ ID NO: 337766 - protein, 9 aa, Influenza virus
KGVELSSMG

SEQ ID NO: 337767 - protein, 9 aa, Influenza virus
GVKLSNMGI

SEQ ID NO: 337768 - protein, 9 aa, Influenza virus
VKLSNMGIY

SEQ ID NO: 337769 - protein, 9 aa, Influenza virus
KLSNMGIYQ

SEQ ID NO: 337770 - protein, 9 aa, Influenza virus
LSNMGIYQI

SEQ ID NO: 337771 - protein, 9 aa, Influenza virus
SNMGIYQIL

SEQ ID NO: 337772 - protein, 9 aa, Influenza virus
NMGIYQILA

SEQ ID NO: 337773 - protein, 9 aa, Influenza virus
MGVYQILVI

SEQ ID NO: 337774 - protein, 9 aa, Influenza virus
GVYQVLAIY

SEQ ID NO: 337775 - protein, 9 aa, Influenza virus
VYQILVIYA

SEQ ID NO: 337776 - protein, 9 aa, Influenza virus
GSLSLAIMV

SEQ ID NO: 337777 - protein, 9 aa, Influenza virus
SLSLAIMVA

SEQ ID NO: 337778 - protein, 9 aa, Influenza virus
LSLAIMVAG

SEQ ID NO: 337779 - protein, 9 aa, Influenza virus
SLAIMVAGI

SEQ ID NO: 337780 - protein, 9 aa, Influenza virus
LAIMVAGIS

SEQ ID NO: 337781 - protein, 9 aa, Influenza virus
AGIFLWMCS

SEQ ID NO: 337782 - protein, 9 aa, Influenza virus
GIFLWMCSN

SEQ ID NO: 337783 - protein, 9 aa, Influenza virus
IFLWMCSNG

SEQ ID NO: 337784 - protein, 9 aa, Influenza virus
FLWMCSNGS

SEQ ID NO: 337785 - protein, 9 aa, Influenza virus
SNQKIITIG

SEQ ID NO: 337786 - protein, 9 aa, Influenza virus
NQKIITMGS

SEQ ID NO: 337787 - protein, 9 aa, Influenza virus
QKTITIGSV

SEQ ID NO: 337788 - protein, 9 aa, Influenza virus
KTITIGSVS

SEQ ID NO: 337789 - protein, 9 aa, Influenza virus
TITIGSVSL

SEQ ID NO: 337790 - protein, 9 aa, Influenza virus
ITIGSVSLI

SEQ ID NO: 337791 - protein, 9 aa, Influenza virus
QIAILAATV

SEQ ID NO: 337792 - protein, 9 aa, Influenza virus
IAILATTIT

SEQ ID NO: 337793 - protein, 9 aa, Influenza virus
AILAATVTL

SEQ ID NO: 337794 - protein, 9 aa, Influenza virus
ILAATVTLH

SEQ ID NO: 337795 - protein, 9 aa, Influenza virus
LATTITLHF

SEQ ID NO: 337796 - protein, 9 aa, Influenza virus
AATVTLHFK

SEQ ID NO: 337797 - protein, 9 aa, Influenza virus
ATVTLHFKQ

SEQ ID NO: 337798 - protein, 9 aa, Influenza virus
TITLHFKQN

SEQ ID NO: 337799 - protein, 9 aa, Influenza virus
VTLHFKQHK

SEQ ID NO: 337800 - protein, 9 aa, Influenza virus
TLHFKQHDC

SEQ ID NO: 337801 - protein, 9 aa, Influenza virus
LHFKQHECN

SEQ ID NO: 337802 - protein, 9 aa, Influenza virus
PCEPIIIEK

SEQ ID NO: 337803 - protein, 9 aa, Influenza virus
CEPIIIEKN

SEQ ID NO: 337804 - protein, 9 aa, Influenza virus
TEIVYLNST

SEQ ID NO: 337805 - protein, 9 aa, Influenza virus
EIVYLNSTT

SEQ ID NO: 337806 - protein, 9 aa, Influenza virus
YRDWSKPQC

SEQ ID NO: 337807 - protein, 9 aa, Influenza virus
WSKTQCQIT

SEQ ID NO: 337808 - protein, 9 aa, Influenza virus
SKPQCHITG

SEQ ID NO: 337809 - protein, 9 aa, Influenza virus
KPQCQIAGF

SEQ ID NO: 337810 - protein, 9 aa, Influenza virus
TQCQITGFA

SEQ ID NO: 337811 - protein, 9 aa, Influenza virus
QCHITGFAP

SEQ ID NO: 337812 - protein, 9 aa, Influenza virus
CHITGFAPF

SEQ ID NO: 337813 - protein, 9 aa, Influenza virus
HITGFAPFS

SEQ ID NO: 337814 - protein, 9 aa, Influenza virus
DNSIRLSAD

SEQ ID NO: 337815 - protein, 9 aa, Influenza virus
NSIRLSADG

SEQ ID NO: 337816 - protein, 9 aa, Influenza virus
SIRLSASGD

SEQ ID NO: 337817 - protein, 9 aa, Influenza virus
IRLSASGDI

SEQ ID NO: 337818 - protein, 9 aa, Influenza virus
RLSGGGDIW

SEQ ID NO: 337819 - protein, 9 aa, Influenza virus
LSGGGDIWV

SEQ ID NO: 337820 - protein, 9 aa, Influenza virus
SASGDIWVT

SEQ ID NO: 337821 - protein, 9 aa, Influenza virus
ADGDIWVTR

SEQ ID NO: 337822 - protein, 9 aa, Influenza virus
SGDIWVTRE

SEQ ID NO: 337823 - protein, 9 aa, Influenza virus
TREPYVSCG

SEQ ID NO: 337824 - protein, 9 aa, Influenza virus
REPYVSCSP

SEQ ID NO: 337825 - protein, 9 aa, Influenza virus
VKCYQFALG

SEQ ID NO: 337826 - protein, 9 aa, Influenza virus
ALGQGTTLE

SEQ ID NO: 337827 - protein, 9 aa, Influenza virus
LGQGTTLNN

SEQ ID NO: 337828 - protein, 9 aa, Influenza virus
GQGTTLENK

SEQ ID NO: 337829 - protein, 9 aa, Influenza virus
QGTTLNNKH

SEQ ID NO: 337830 - protein, 9 aa, Influenza virus
GTTLNNKHS

SEQ ID NO: 337831 - protein, 9 aa, Influenza virus
TTLNNKHSN

SEQ ID NO: 337832 - protein, 9 aa, Influenza virus
TLNNKHSNG

SEQ ID NO: 337833 - protein, 9 aa, Influenza virus
LNNKHSNGT

SEQ ID NO: 337834 - protein, 9 aa, Influenza virus
DNKHSNDTV

SEQ ID NO: 337835 - protein, 9 aa, Influenza virus
NKHSNDTVH

SEQ ID NO: 337836 - protein, 9 aa, Influenza virus
KHSNDTVHD

SEQ ID NO: 337837 - protein, 9 aa, Influenza virus
HSNDTVHDR

SEQ ID NO: 337838 - protein, 9 aa, Influenza virus
TIHDRTPHR

SEQ ID NO: 337839 - protein, 9 aa, Influenza virus
IHDRTPHRT

SEQ ID NO: 337840 - protein, 9 aa, Influenza virus
HDRSPHRTL

SEQ ID NO: 337841 - protein, 9 aa, Influenza virus
DRSPHRTLL

SEQ ID NO: 337842 - protein, 9 aa, Influenza virus
RSPHRTLLM

SEQ ID NO: 337843 - protein, 9 aa, Influenza virus
SPHRTLLMN

SEQ ID NO: 337844 - protein, 9 aa, Influenza virus
GVSFHLGTK

SEQ ID NO: 337845 - protein, 9 aa, Influenza virus
VSFHLGTKQ

SEQ ID NO: 337846 - protein, 9 aa, Influenza virus
SFHLGTKQV

SEQ ID NO: 337847 - protein, 9 aa, Influenza virus
HLGTKQVCI

SEQ ID NO: 337848 - protein, 9 aa, Influenza virus
LGTKQVCIA

SEQ ID NO: 337849 - protein, 9 aa, Influenza virus
GTKQVCIAW

SEQ ID NO: 337850 - protein, 9 aa, Influenza virus
TKQVCIAWS

SEQ ID NO: 337851 - protein, 9 aa, Influenza virus
KQVCIAWSS

SEQ ID NO: 337852 - protein, 9 aa, Influenza virus
QVCAAWSSS

SEQ ID NO: 337853 - protein, 9 aa, Influenza virus
VCAAWSSSS

SEQ ID NO: 337854 - protein, 9 aa, Influenza virus
CAAWSSSSC

SEQ ID NO: 337855 - protein, 9 aa, Influenza virus
AAWSSSSCH

SEQ ID NO: 337856 - protein, 9 aa, Influenza virus
HDGKAWLHI

SEQ ID NO: 337857 - protein, 9 aa, Influenza virus
DGKAWLHIC

SEQ ID NO: 337858 - protein, 9 aa, Influenza virus
GRAWLHVCV

SEQ ID NO: 337859 - protein, 9 aa, Influenza virus
RAWLHVCVT

SEQ ID NO: 337860 - protein, 9 aa, Influenza virus
AWLHICVTG

SEQ ID NO: 337861 - protein, 9 aa, Influenza virus
WLHICVTGD

SEQ ID NO: 337862 - protein, 9 aa, Influenza virus
LHICVTGDD

SEQ ID NO: 337863 - protein, 9 aa, Influenza virus
CITGDDKNA

SEQ ID NO: 337864 - protein, 9 aa, Influenza virus
ITGDDKNAT

SEQ ID NO: 337865 - protein, 9 aa, Influenza virus
TGYEKNATA

SEQ ID NO: 337866 - protein, 9 aa, Influenza virus
GYEKNATAS

SEQ ID NO: 337867 - protein, 9 aa, Influenza virus
DDRNATASL

SEQ ID NO: 337868 - protein, 9 aa, Influenza virus
DRNATASLI

SEQ ID NO: 337869 - protein, 9 aa, Influenza virus
RNATASLIY

SEQ ID NO: 337870 - protein, 9 aa, Influenza virus
NATASLIYD

SEQ ID NO: 337871 - protein, 9 aa, Influenza virus
ATASLIYDG

SEQ ID NO: 337872 - protein, 9 aa, Influenza virus
DSVGSWSQN

SEQ ID NO: 337873 - protein, 9 aa, Influenza virus
SVGSWSQNI

SEQ ID NO: 337874 - protein, 9 aa, Influenza virus
IGSWSHNIL

SEQ ID NO: 337875 - protein, 9 aa, Influenza virus
GSWSHNILR

SEQ ID NO: 337876 - protein, 9 aa, Influenza virus
QESECICIN

SEQ ID NO: 337877 - protein, 9 aa, Influenza virus
SECVCINGI

SEQ ID NO: 337878 - protein, 9 aa, Influenza virus
ECVCINGIC

SEQ ID NO: 337879 - protein, 9 aa, Influenza virus
CVCINGICT

SEQ ID NO: 337880 - protein, 9 aa, Influenza virus
VCINGICTV

SEQ ID NO: 337881 - protein, 9 aa, Influenza virus
CINGICTVV

SEQ ID NO: 337882 - protein, 9 aa, Influenza virus
INGICTVVM

SEQ ID NO: 337883 - protein, 9 aa, Influenza virus
NGICTVVMT

SEQ ID NO: 337884 - protein, 9 aa, Influenza virus
GICTVVMTD

SEQ ID NO: 337885 - protein, 9 aa, Influenza virus
ICTVVMTDG

SEQ ID NO: 337886 - protein, 9 aa, Influenza virus
SASGRADTK

SEQ ID NO: 337887 - protein, 9 aa, Influenza virus
ASGRADTKI

SEQ ID NO: 337888 - protein, 9 aa, Influenza virus
SGRADTKIL

SEQ ID NO: 337889 - protein, 9 aa, Influenza virus
GRADTKILF

SEQ ID NO: 337890 - protein, 9 aa, Influenza virus
KADTRILFV

SEQ ID NO: 337891 - protein, 9 aa, Influenza virus
ADTRILFVK

SEQ ID NO: 337892 - protein, 9 aa, Influenza virus
DTRILFVKE

SEQ ID NO: 337893 - protein, 9 aa, Influenza virus
TRILFVKEG

SEQ ID NO: 337894 - protein, 9 aa, Influenza virus
RILFVKEGK

SEQ ID NO: 337895 - protein, 9 aa, Influenza virus
ILFVKEGKI

SEQ ID NO: 337896 - protein, 9 aa, Influenza virus
EGKIVHIGP

SEQ ID NO: 337897 - protein, 9 aa, Influenza virus
GKIVHIGPL

SEQ ID NO: 337898 - protein, 9 aa, Influenza virus
VHIGPLSGS

SEQ ID NO: 337899 - protein, 9 aa, Influenza virus
HISPLAGSA

SEQ ID NO: 337900 - protein, 9 aa, Influenza virus
VSPLSGSAQ

SEQ ID NO: 337901 - protein, 9 aa, Influenza virus
SPLAGSAQH

SEQ ID NO: 337902 - protein, 9 aa, Influenza virus
PLAGSAQHV

SEQ ID NO: 337903 - protein, 9 aa, Influenza virus
LAGSAQHVE

SEQ ID NO: 337904 - protein, 9 aa, Influenza virus
AGSAQHVEE

SEQ ID NO: 337905 - protein, 9 aa, Influenza virus
IEECSCYPQ

SEQ ID NO: 337906 - protein, 9 aa, Influenza virus
CSCYPRYPN

SEQ ID NO: 337907 - protein, 9 aa, Influenza virus
SCYPRYPNV

SEQ ID NO: 337908 - protein, 9 aa, Influenza virus
CYPRYPNVR

SEQ ID NO: 337909 - protein, 9 aa, Influenza virus
YPRYPNVRC

SEQ ID NO: 337910 - protein, 9 aa, Influenza virus
RYPNVRCVC

SEQ ID NO: 337911 - protein, 9 aa, Influenza virus
YPNVRCVCR

SEQ ID NO: 337912 - protein, 9 aa, Influenza virus
PNVRCVCRD

SEQ ID NO: 337913 - protein, 9 aa, Influenza virus
NVRCVCRDN

SEQ ID NO: 337914 - protein, 9 aa, Influenza virus
VRCICKDNW

SEQ ID NO: 337915 - protein, 9 aa, Influenza virus
RCVCRDNWR

SEQ ID NO: 337916 - protein, 9 aa, Influenza virus
CVCRDNWRG

SEQ ID NO: 337917 - protein, 9 aa, Influenza virus
VCRDNWRGS

SEQ ID NO: 337918 - protein, 9 aa, Influenza virus
NWRGSNRPV

SEQ ID NO: 337919 - protein, 9 aa, Influenza virus
GSNRPIIDI

SEQ ID NO: 337920 - protein, 9 aa, Influenza virus
SNRPIIDIN

SEQ ID NO: 337921 - protein, 9 aa, Influenza virus
DISMEDYSI

SEQ ID NO: 337922 - protein, 9 aa, Influenza virus
ISMEDYSID

SEQ ID NO: 337923 - protein, 9 aa, Influenza virus
SMEDYSIDS

SEQ ID NO: 337924 - protein, 9 aa, Influenza virus
EYSIDSSYV

SEQ ID NO: 337925 - protein, 9 aa, Influenza virus
YSIDSNYVC

SEQ ID NO: 337926 - protein, 9 aa, Influenza virus
SIDSNYVCS

SEQ ID NO: 337927 - protein, 9 aa, Influenza virus
IDSGYVCSG

SEQ ID NO: 337928 - protein, 9 aa, Influenza virus
DSNYVCSGL

SEQ ID NO: 337929 - protein, 9 aa, Influenza virus
SNYVCSGLV

SEQ ID NO: 337930 - protein, 9 aa, Influenza virus
NYVCSGLVG

SEQ ID NO: 337931 - protein, 9 aa, Influenza virus
LVGDTPRSD

SEQ ID NO: 337932 - protein, 9 aa, Influenza virus
VGDTPRNND

SEQ ID NO: 337933 - protein, 9 aa, Influenza virus
GDTPRNGDS

SEQ ID NO: 337934 - protein, 9 aa, Influenza virus
DTPRNGDSS

SEQ ID NO: 337935 - protein, 9 aa, Influenza virus
TPRNGDSSS

SEQ ID NO: 337936 - protein, 9 aa, Influenza virus
SSSNCRDPN

SEQ ID NO: 337937 - protein, 9 aa, Influenza virus
SSNCRDPNN

SEQ ID NO: 337938 - protein, 9 aa, Influenza virus
SNCKDPNNE

SEQ ID NO: 337939 - protein, 9 aa, Influenza virus
NCRNPNNEK

SEQ ID NO: 337940 - protein, 9 aa, Influenza virus
CRNPNNEKG

SEQ ID NO: 337941 - protein, 9 aa, Influenza virus
PNNEKGNQG

SEQ ID NO: 337942 - protein, 9 aa, Influenza virus
NNEKGNQGV

SEQ ID NO: 337943 - protein, 9 aa, Influenza virus
NEKGNQGVK

SEQ ID NO: 337944 - protein, 9 aa, Influenza virus
EKGNQGVKG

SEQ ID NO: 337945 - protein, 9 aa, Influenza virus
KGNQGVKGW

SEQ ID NO: 337946 - protein, 9 aa, Influenza virus
GTQGVKGWA

SEQ ID NO: 337947 - protein, 9 aa, Influenza virus
TQGVKGWAF

SEQ ID NO: 337948 - protein, 9 aa, Influenza virus
GVKGWAFDD

SEQ ID NO: 337949 - protein, 9 aa, Influenza virus
VKGWAFDDG

SEQ ID NO: 337950 - protein, 9 aa, Influenza virus
GSDVWMGRT

SEQ ID NO: 337951 - protein, 9 aa, Influenza virus
SDVWMGRTI

SEQ ID NO: 337952 - protein, 9 aa, Influenza virus
DLWMGRTIS

SEQ ID NO: 337953 - protein, 9 aa, Influenza virus
RDSRSGYET

SEQ ID NO: 337954 - protein, 9 aa, Influenza virus
ESRSGYETF

SEQ ID NO: 337955 - protein, 9 aa, Influenza virus
SRSGYETFR

SEQ ID NO: 337956 - protein, 9 aa, Influenza virus
SGYETFRVT

SEQ ID NO: 337957 - protein, 9 aa, Influenza virus
TFRVIGGWA

SEQ ID NO: 337958 - protein, 9 aa, Influenza virus
FRVIGGWAT

SEQ ID NO: 337959 - protein, 9 aa, Influenza virus
SNNWSGYSG

SEQ ID NO: 337960 - protein, 9 aa, Influenza virus
NNRSGYSGI

SEQ ID NO: 337961 - protein, 9 aa, Influenza virus
YSGIFSVEH

SEQ ID NO: 337962 - protein, 9 aa, Influenza virus
SGIFSVENK

SEQ ID NO: 337963 - protein, 9 aa, Influenza virus
KRCINRCFY

SEQ ID NO: 337964 - protein, 9 aa, Influenza virus
RCINRCFYV

SEQ ID NO: 337965 - protein, 9 aa, Influenza virus
YVELIRGRQ

SEQ ID NO: 337966 - protein, 9 aa, Influenza virus
VELIRGRQQ

SEQ ID NO: 337967 - protein, 9 aa, Influenza virus
ELIRGRQQE

SEQ ID NO: 337968 - protein, 9 aa, Influenza virus
QQETRVWWT

SEQ ID NO: 337969 - protein, 9 aa, Influenza virus
TSNSIVVFV

SEQ ID NO: 337970 - protein, 9 aa, Influenza virus
SSSIVVFCG

SEQ ID NO: 337971 - protein, 9 aa, Influenza virus
NSIVVFVAP

SEQ ID NO: 337972 - protein, 9 aa, Influenza virus
SWPDGANID

SEQ ID NO: 337973 - protein, 9 aa, Influenza virus
WPDGADINF

SEQ ID NO: 337974 - protein, 9 aa, Influenza virus
PDGADINFM

SEQ ID NO: 337975 - protein, 9 aa, Influenza virus
DGADINFMP

SEQ ID NO: 337976 - protein, 9 aa, Influenza virus
GADINFMPI

SEQ ID NO: 337977 - protein, 9 aa, Influenza virus
IFIFLLLTH

SEQ ID NO: 337978 - protein, 9 aa, Influenza virus
FIFLLLTHW

SEQ ID NO: 337979 - protein, 9 aa, Influenza virus
AATLCLGHH

SEQ ID NO: 337980 - protein, 9 aa, Influenza virus
LCLGHHAVQ

SEQ ID NO: 337981 - protein, 9 aa, Influenza virus
CLGHHAVQN

SEQ ID NO: 337982 - protein, 9 aa, Influenza virus
LGHHAVQNG

SEQ ID NO: 337983 - protein, 9 aa, Influenza virus
GHHAVQNGT

SEQ ID NO: 337984 - protein, 9 aa, Influenza virus
DQVEVTNAT

SEQ ID NO: 337985 - protein, 9 aa, Influenza virus
QVEVTNATE

SEQ ID NO: 337986 - protein, 9 aa, Influenza virus
TNATELVQI

SEQ ID NO: 337987 - protein, 9 aa, Influenza virus
CTLIDAMLG

SEQ ID NO: 337988 - protein, 9 aa, Influenza virus
TLIDAMLGD

SEQ ID NO: 337989 - protein, 9 aa, Influenza virus
LIDAMLGDP

SEQ ID NO: 337990 - protein, 9 aa, Influenza virus
DAMLGDPHC

SEQ ID NO: 337991 - protein, 9 aa, Influenza virus
AMLGDPHCD

SEQ ID NO: 337992 - protein, 9 aa, Influenza virus
SLRSIVASS

SEQ ID NO: 337993 - protein, 9 aa, Influenza virus
LRSIVASSG

SEQ ID NO: 337994 - protein, 9 aa, Influenza virus
RSIVASSGT

SEQ ID NO: 337995 - protein, 9 aa, Influenza virus
SIVASSGTL

SEQ ID NO: 337996 - protein, 9 aa, Influenza virus
IVASSGTLE

SEQ ID NO: 337997 - protein, 9 aa, Influenza virus
VASSGTVEF

SEQ ID NO: 337998 - protein, 9 aa, Influenza virus
GFFRRLNWL

SEQ ID NO: 337999 - protein, 9 aa, Influenza virus
FFSRLNWLY

SEQ ID NO: 338000 - protein, 9 aa, Influenza virus
FDKLYIWGI

SEQ ID NO: 338001 - protein, 9 aa, Influenza virus
DKLYIWGIH

SEQ ID NO: 338002 - protein, 9 aa, Influenza virus
KLYIWGIHH

SEQ ID NO: 338003 - protein, 9 aa, Influenza virus
LYIWGIHHP

SEQ ID NO: 338004 - protein, 9 aa, Influenza virus
YWTIVKSGD

SEQ ID NO: 338005 - protein, 9 aa, Influenza virus
SNGNLVAPR

SEQ ID NO: 338006 - protein, 9 aa, Influenza virus
NGNLVAPRG

SEQ ID NO: 338007 - protein, 9 aa, Influenza virus
LIAPRGYFR

SEQ ID NO: 338008 - protein, 9 aa, Influenza virus
SGCITPNGS

SEQ ID NO: 338009 - protein, 9 aa, Influenza virus
GCITPNGSI

SEQ ID NO: 338010 - protein, 9 aa, Influenza virus
TPNGSIPNE

SEQ ID NO: 338011 - protein, 9 aa, Influenza virus
GSIPNEKPF

SEQ ID NO: 338012 - protein, 9 aa, Influenza virus
SIPNEKPFQ

SEQ ID NO: 338013 - protein, 9 aa, Influenza virus
IPNEKPFQN

SEQ ID NO: 338014 - protein, 9 aa, Influenza virus
NNKPFQNVN

SEQ ID NO: 338015 - protein, 9 aa, Influenza virus
KPFQNVNKV

SEQ ID NO: 338016 - protein, 9 aa, Influenza virus
PFQNVNKVT

SEQ ID NO: 338017 - protein, 9 aa, Influenza virus
FQNVNKVTY

SEQ ID NO: 338018 - protein, 9 aa, Influenza virus
QNVNKVTYG

SEQ ID NO: 338019 - protein, 9 aa, Influenza virus
TGMRNIPEK

SEQ ID NO: 338020 - protein, 9 aa, Influenza virus
GMRNIPEKQ

SEQ ID NO: 338021 - protein, 9 aa, Influenza virus
IRGIFGAIA

SEQ ID NO: 338022 - protein, 9 aa, Influenza virus
KGLFGAIAG

SEQ ID NO: 338023 - protein, 9 aa, Influenza virus
IENGWEGMM

SEQ ID NO: 338024 - protein, 9 aa, Influenza virus
ENGWEGMMD

SEQ ID NO: 338025 - protein, 9 aa, Influenza virus
NGWEGMMDG

SEQ ID NO: 338026 - protein, 9 aa, Influenza virus
GWEGMMDGW

SEQ ID NO: 338027 - protein, 9 aa, Influenza virus
WEGMMDGWY

SEQ ID NO: 338028 - protein, 9 aa, Influenza virus
EGMMDGWYG

SEQ ID NO: 338029 - protein, 9 aa, Influenza virus
GMMDGWYGF

SEQ ID NO: 338030 - protein, 9 aa, Influenza virus
MMDGWYGFR

SEQ ID NO: 338031 - protein, 9 aa, Influenza virus
MDGWYGFRH

SEQ ID NO: 338032 - protein, 9 aa, Influenza virus
NGWYGFRHQ

SEQ ID NO: 338033 - protein, 9 aa, Influenza virus
WYGFRHHNS

SEQ ID NO: 338034 - protein, 9 aa, Influenza virus
YGFRHLNSE

SEQ ID NO: 338035 - protein, 9 aa, Influenza virus
GFRHHNSEG

SEQ ID NO: 338036 - protein, 9 aa, Influenza virus
NSEGRGQAA

SEQ ID NO: 338037 - protein, 9 aa, Influenza virus
SEGRGQAAD

SEQ ID NO: 338038 - protein, 9 aa, Influenza virus
EGRGQAADL

SEQ ID NO: 338039 - protein, 9 aa, Influenza virus
GRGQAADLK

SEQ ID NO: 338040 - protein, 9 aa, Influenza virus
RGQAADLKS

SEQ ID NO: 338041 - protein, 9 aa, Influenza virus
DFKSTQAAI

SEQ ID NO: 338042 - protein, 9 aa, Influenza virus
LKSTQTAID

SEQ ID NO: 338043 - protein, 9 aa, Influenza virus
KSTQTAIDQ

SEQ ID NO: 338044 - protein, 9 aa, Influenza virus
STQTAIDQI

SEQ ID NO: 338045 - protein, 9 aa, Influenza virus
IERTNEKFH

SEQ ID NO: 338046 - protein, 9 aa, Influenza virus
ERTNEKFHQ

SEQ ID NO: 338047 - protein, 9 aa, Influenza virus
FTEVEGRIQ

SEQ ID NO: 338048 - protein, 9 aa, Influenza virus
TEVEGRIQD

SEQ ID NO: 338049 - protein, 9 aa, Influenza virus
ERYVEDTKI

SEQ ID NO: 338050 - protein, 9 aa, Influenza virus
RYVEDTKID

SEQ ID NO: 338051 - protein, 9 aa, Influenza virus
IDLWSYNAG

SEQ ID NO: 338052 - protein, 9 aa, Influenza virus
WSYNADVLV

SEQ ID NO: 338053 - protein, 9 aa, Influenza virus
SYNADVLVA

SEQ ID NO: 338054 - protein, 9 aa, Influenza virus
YNADVLVAL

SEQ ID NO: 338055 - protein, 9 aa, Influenza virus
NADVLVALE

SEQ ID NO: 338056 - protein, 9 aa, Influenza virus
ADVLVALEN

SEQ ID NO: 338057 - protein, 9 aa, Influenza virus
DVLVALENQ

SEQ ID NO: 338058 - protein, 9 aa, Influenza virus
LLVALENQN

SEQ ID NO: 338059 - protein, 9 aa, Influenza virus
ALENQNTID

SEQ ID NO: 338060 - protein, 9 aa, Influenza virus
LENQNTIDL

SEQ ID NO: 338061 - protein, 9 aa, Influenza virus
ENQHTIDLA

SEQ ID NO: 338062 - protein, 9 aa, Influenza virus
NQHTIDLAD

SEQ ID NO: 338063 - protein, 9 aa, Influenza virus
QHTIHLTDS

SEQ ID NO: 338064 - protein, 9 aa, Influenza virus
HTIHLTDSE

SEQ ID NO: 338065 - protein, 9 aa, Influenza virus
TIHLTDSEM

SEQ ID NO: 338066 - protein, 9 aa, Influenza virus
IDLTDSEMS

SEQ ID NO: 338067 - protein, 9 aa, Influenza virus
DLTDSEMSK

SEQ ID NO: 338068 - protein, 9 aa, Influenza virus
LTDSEMSKL

SEQ ID NO: 338069 - protein, 9 aa, Influenza virus
TDSEMSKLF

SEQ ID NO: 338070 - protein, 9 aa, Influenza virus
DSEMSKLFE

SEQ ID NO: 338071 - protein, 9 aa, Influenza virus
EMSKLFEKT

SEQ ID NO: 338072 - protein, 9 aa, Influenza virus
TRKQLRENA

SEQ ID NO: 338073 - protein, 9 aa, Influenza virus
RKQLRENAE

SEQ ID NO: 338074 - protein, 9 aa, Influenza virus
RENAEDMGD

SEQ ID NO: 338075 - protein, 9 aa, Influenza virus
ENAEDMGDG

SEQ ID NO: 338076 - protein, 9 aa, Influenza virus
NAEDMGDGC

SEQ ID NO: 338077 - protein, 9 aa, Influenza virus
AEDMGNGCL

SEQ ID NO: 338078 - protein, 9 aa, Influenza virus
GNGCFTIYH

SEQ ID NO: 338079 - protein, 9 aa, Influenza virus
GCLKIYHKC

SEQ ID NO: 338080 - protein, 9 aa, Influenza virus
CLKIYHKCD

SEQ ID NO: 338081 - protein, 9 aa, Influenza virus
LKIYHKCDN

SEQ ID NO: 338082 - protein, 9 aa, Influenza virus
IYHKCDNTC

SEQ ID NO: 338083 - protein, 9 aa, Influenza virus
SIRTGTYDH

SEQ ID NO: 338084 - protein, 9 aa, Influenza virus
YRNEALNNR

SEQ ID NO: 338085 - protein, 9 aa, Influenza virus
EYKDWILWI

SEQ ID NO: 338086 - protein, 9 aa, Influenza virus
YKNWILWIS

SEQ ID NO: 338087 - protein, 9 aa, Influenza virus
NWILWISFA

SEQ ID NO: 338088 - protein, 9 aa, Influenza virus
WILWISFAT

SEQ ID NO: 338089 - protein, 9 aa, Influenza virus
ILWISFATS

SEQ ID NO: 338090 - protein, 9 aa, Influenza virus
LWISFAMSC

SEQ ID NO: 338091 - protein, 9 aa, Influenza virus
WISFAMSCF

SEQ ID NO: 338092 - protein, 9 aa, Influenza virus
ISFAMSCFL

SEQ ID NO: 338093 - protein, 9 aa, Influenza virus
SFATSCFLL

SEQ ID NO: 338094 - protein, 9 aa, Influenza virus
FATSCFLLC

SEQ ID NO: 338095 - protein, 9 aa, Influenza virus
LGFIMWTCQ

SEQ ID NO: 338096 - protein, 9 aa, Influenza virus
GFIVWACQR

SEQ ID NO: 338097 - protein, 9 aa, Influenza virus
FIVWACQRG

SEQ ID NO: 338098 - protein, 9 aa, Influenza virus
IVWACQRGN

SEQ ID NO: 338099 - protein, 9 aa, Influenza virus
VWACQRGNI

SEQ ID NO: 338100 - protein, 9 aa, Influenza virus
WACQKGNIK

SEQ ID NO: 338101 - protein, 9 aa, Influenza virus
ACQKGNIKC

SEQ ID NO: 338102 - protein, 9 aa, Influenza virus
CQKGNIKCN

SEQ ID NO: 338103 - protein, 9 aa, Influenza virus
QKGNIKCNI

SEQ ID NO: 338104 - protein, 9 aa, Influenza virus
KGNIKCNIC

SEQ ID NO: 338105 - protein, 9 aa, Influenza virus
GNIRCDICI

SEQ ID NO: 338106 - protein, 9 aa, Influenza virus
AATLCLGHH

SEQ ID NO: 338107 - protein, 9 aa, Influenza virus
HHAVPNGTV

SEQ ID NO: 338108 - protein, 9 aa, Influenza virus
HAVPNGTVV

SEQ ID NO: 338109 - protein, 9 aa, Influenza virus
AVPNGTVVK

SEQ ID NO: 338110 - protein, 9 aa, Influenza virus
VPNGTVVKT

SEQ ID NO: 338111 - protein, 9 aa, Influenza virus
PNGTVVKTI

SEQ ID NO: 338112 - protein, 9 aa, Influenza virus
NGTVVKTIT

SEQ ID NO: 338113 - protein, 9 aa, Influenza virus
DQVEVTNAT

SEQ ID NO: 338114 - protein, 9 aa, Influenza virus
QVEVTNATE

SEQ ID NO: 338115 - protein, 9 aa, Influenza virus
TNATELVQI

SEQ ID NO: 338116 - protein, 9 aa, Influenza virus
CTLVDALLG

SEQ ID NO: 338117 - protein, 9 aa, Influenza virus
TLVDALLGD

SEQ ID NO: 338118 - protein, 9 aa, Influenza virus
LVDALLGDP

SEQ ID NO: 338119 - protein, 9 aa, Influenza virus
MDALLGDPH

SEQ ID NO: 338120 - protein, 9 aa, Influenza virus
CYPYDVPDH

SEQ ID NO: 338121 - protein, 9 aa, Influenza virus
SLRSIVASS

SEQ ID NO: 338122 - protein, 9 aa, Influenza virus
LRSIVASSG

SEQ ID NO: 338123 - protein, 9 aa, Influenza virus
RSIVASSGT

SEQ ID NO: 338124 - protein, 9 aa, Influenza virus
SIVASSGTL

SEQ ID NO: 338125 - protein, 9 aa, Influenza virus
IVASSGTLE

SEQ ID NO: 338126 - protein, 9 aa, Influenza virus
VASSGNLEF

SEQ ID NO: 338127 - protein, 9 aa, Influenza virus
GFFRRLNWL

SEQ ID NO: 338128 - protein, 9 aa, Influenza virus
FFSRLNWLY

SEQ ID NO: 338129 - protein, 9 aa, Influenza virus
SDKLYIWGV

SEQ ID NO: 338130 - protein, 9 aa, Influenza virus
DKLYIWGIH

SEQ ID NO: 338131 - protein, 9 aa, Influenza virus
KLYIWGIHH

SEQ ID NO: 338132 - protein, 9 aa, Influenza virus
LYIWGIHHP

SEQ ID NO: 338133 - protein, 9 aa, Influenza virus
SIHWTIVKP

SEQ ID NO: 338134 - protein, 9 aa, Influenza virus
IHWTIVKPG

SEQ ID NO: 338135 - protein, 9 aa, Influenza virus
HWTIVKPGD

SEQ ID NO: 338136 - protein, 9 aa, Influenza virus
CTGNLIAPR

SEQ ID NO: 338137 - protein, 9 aa, Influenza virus
LIAPRGYYK

SEQ ID NO: 338138 - protein, 9 aa, Influenza virus
IAPRGYFKV

SEQ ID NO: 338139 - protein, 9 aa, Influenza virus
SGCITPNGS

SEQ ID NO: 338140 - protein, 9 aa, Influenza virus
GCITPNGSI

SEQ ID NO: 338141 - protein, 9 aa, Influenza virus
TPNGSISND

SEQ ID NO: 338142 - protein, 9 aa, Influenza virus
PNGSISNDK

SEQ ID NO: 338143 - protein, 9 aa, Influenza virus
NGSISNDKP

SEQ ID NO: 338144 - protein, 9 aa, Influenza virus
GSISNDKPF

SEQ ID NO: 338145 - protein, 9 aa, Influenza virus
SISNDKPFQ

SEQ ID NO: 338146 - protein, 9 aa, Influenza virus
ISNDKPFQN

SEQ ID NO: 338147 - protein, 9 aa, Influenza virus
SNDKPFQNV

SEQ ID NO: 338148 - protein, 9 aa, Influenza virus
NGKPFQNVN

SEQ ID NO: 338149 - protein, 9 aa, Influenza virus
EKPFQNVNK

SEQ ID NO: 338150 - protein, 9 aa, Influenza virus
NVNRITYGP

SEQ ID NO: 338151 - protein, 9 aa, Influenza virus
VNRITYGPC

SEQ ID NO: 338152 - protein, 9 aa, Influenza virus
NRITYGPCP

SEQ ID NO: 338153 - protein, 9 aa, Influenza virus
ITYGPCPRY

SEQ ID NO: 338154 - protein, 9 aa, Influenza virus
TYGPCPRYV

SEQ ID NO: 338155 - protein, 9 aa, Influenza virus
YIKQNTLKL

SEQ ID NO: 338156 - protein, 9 aa, Influenza virus
IKQNTLKLA

SEQ ID NO: 338157 - protein, 9 aa, Influenza virus
KQKTLKLAT

SEQ ID NO: 338158 - protein, 9 aa, Influenza virus
QKTLKLATG

SEQ ID NO: 338159 - protein, 9 aa, Influenza virus
KTLKLATGM

SEQ ID NO: 338160 - protein, 9 aa, Influenza virus
TGMRNVPET

SEQ ID NO: 338161 - protein, 9 aa, Influenza virus
GMRNVPERQ

SEQ ID NO: 338162 - protein, 9 aa, Influenza virus
MRNVPERQT

SEQ ID NO: 338163 - protein, 9 aa, Influenza virus
RNVPERQTR

SEQ ID NO: 338164 - protein, 9 aa, Influenza virus
NVPERQTRG

SEQ ID NO: 338165 - protein, 9 aa, Influenza virus
PETQTRGIF

SEQ ID NO: 338166 - protein, 9 aa, Influenza virus
ETQTRGIFG

SEQ ID NO: 338167 - protein, 9 aa, Influenza virus
TQTRGIFGA

SEQ ID NO: 338168 - protein, 9 aa, Influenza virus
IENGWEGMI

SEQ ID NO: 338169 - protein, 9 aa, Influenza virus
ENGWEGMID

SEQ ID NO: 338170 - protein, 9 aa, Influenza virus
NGWEGMIDG

SEQ ID NO: 338171 - protein, 9 aa, Influenza virus
GWEGMIDGW

SEQ ID NO: 338172 - protein, 9 aa, Influenza virus
WEGMIDGWY

SEQ ID NO: 338173 - protein, 9 aa, Influenza virus
EGMIDGWYG

SEQ ID NO: 338174 - protein, 9 aa, Influenza virus
GMIDGWYGF

SEQ ID NO: 338175 - protein, 9 aa, Influenza virus
MIDGWYGFR

SEQ ID NO: 338176 - protein, 9 aa, Influenza virus
IDGWYGFRH

SEQ ID NO: 338177 - protein, 9 aa, Influenza virus
DGWYGFRHH

SEQ ID NO: 338178 - protein, 9 aa, Influenza virus
WYGFRHLNS

SEQ ID NO: 338179 - protein, 9 aa, Influenza virus
YGFRHLNSE

SEQ ID NO: 338180 - protein, 9 aa, Influenza virus
GFRHLNSEG

SEQ ID NO: 338181 - protein, 9 aa, Influenza virus
RHQNSEGRG

SEQ ID NO: 338182 - protein, 9 aa, Influenza virus
HQNSEGRGQ

SEQ ID NO: 338183 - protein, 9 aa, Influenza virus
NSEGRGQAA

SEQ ID NO: 338184 - protein, 9 aa, Influenza virus
SEGRGQAAD

SEQ ID NO: 338185 - protein, 9 aa, Influenza virus
EGRGQAADL

SEQ ID NO: 338186 - protein, 9 aa, Influenza virus
GRGQAADLK

SEQ ID NO: 338187 - protein, 9 aa, Influenza virus
RGQAADLKS

SEQ ID NO: 338188 - protein, 9 aa, Influenza virus
LKSTQAAVN

SEQ ID NO: 338189 - protein, 9 aa, Influenza virus
KSTQAAVNQ

SEQ ID NO: 338190 - protein, 9 aa, Influenza virus
STQAAIDQV

SEQ ID NO: 338191 - protein, 9 aa, Influenza virus
IKKTNEKFH

SEQ ID NO: 338192 - protein, 9 aa, Influenza virus
KKTNEKFHQ

SEQ ID NO: 338193 - protein, 9 aa, Influenza virus
ERYVEDTKI

SEQ ID NO: 338194 - protein, 9 aa, Influenza virus
RYVEDTKID

SEQ ID NO: 338195 - protein, 9 aa, Influenza virus
VDLWSYNAE

SEQ ID NO: 338196 - protein, 9 aa, Influenza virus
SYNAELLIA

SEQ ID NO: 338197 - protein, 9 aa, Influenza virus
YNAEFLVAL

SEQ ID NO: 338198 - protein, 9 aa, Influenza virus
NAEFLVALE

SEQ ID NO: 338199 - protein, 9 aa, Influenza virus
AEFLVALEN

SEQ ID NO: 338200 - protein, 9 aa, Influenza virus
EFLVALENQ

SEQ ID NO: 338201 - protein, 9 aa, Influenza virus
FLVALENQH

SEQ ID NO: 338202 - protein, 9 aa, Influenza virus
QNTIDLTDS

SEQ ID NO: 338203 - protein, 9 aa, Influenza virus
NTIDLTDSE

SEQ ID NO: 338204 - protein, 9 aa, Influenza virus
IHLTDSEMN

SEQ ID NO: 338205 - protein, 9 aa, Influenza virus
HLTDSEMNK

SEQ ID NO: 338206 - protein, 9 aa, Influenza virus
MTDSEMNKL

SEQ ID NO: 338207 - protein, 9 aa, Influenza virus
SEMSKLFER

SEQ ID NO: 338208 - protein, 9 aa, Influenza virus
EMSKLFERT

SEQ ID NO: 338209 - protein, 9 aa, Influenza virus
TRRQLRENA

SEQ ID NO: 338210 - protein, 9 aa, Influenza virus
RRQLRENAE

SEQ ID NO: 338211 - protein, 9 aa, Influenza virus
AEEMGNGCF

SEQ ID NO: 338212 - protein, 9 aa, Influenza virus
EDMGNGCLK

SEQ ID NO: 338213 - protein, 9 aa, Influenza virus
DMGNGCLKI

SEQ ID NO: 338214 - protein, 9 aa, Influenza virus
MGNGCLKIY

SEQ ID NO: 338215 - protein, 9 aa, Influenza virus
GNGCLKIYH

SEQ ID NO: 338216 - protein, 9 aa, Influenza virus
NGCLKIYHK

SEQ ID NO: 338217 - protein, 9 aa, Influenza virus
GCLKIYHKC

SEQ ID NO: 338218 - protein, 9 aa, Influenza virus
CLKIYHKCD

SEQ ID NO: 338219 - protein, 9 aa, Influenza virus
LKIYHKCDN

SEQ ID NO: 338220 - protein, 9 aa, Influenza virus
IYHKCDNTC

SEQ ID NO: 338221 - protein, 9 aa, Influenza virus
CIGSIRNET

SEQ ID NO: 338222 - protein, 9 aa, Influenza virus
IGSIRNETY

SEQ ID NO: 338223 - protein, 9 aa, Influenza virus
GSIRNETYD

SEQ ID NO: 338224 - protein, 9 aa, Influenza virus
SIRNETYDH

SEQ ID NO: 338225 - protein, 9 aa, Influenza virus
IRNGTYNHD

SEQ ID NO: 338226 - protein, 9 aa, Influenza virus
YRNEALNNR

SEQ ID NO: 338227 - protein, 9 aa, Influenza virus
RNEALNNRF

SEQ ID NO: 338228 - protein, 9 aa, Influenza virus
NEALNNRFQ

SEQ ID NO: 338229 - protein, 9 aa, Influenza virus
EALNNRSQI

SEQ ID NO: 338230 - protein, 9 aa, Influenza virus
ALNNRSQIK

SEQ ID NO: 338231 - protein, 9 aa, Influenza virus
EYKDWILWI

SEQ ID NO: 338232 - protein, 9 aa, Influenza virus
YKNWILWIS

SEQ ID NO: 338233 - protein, 9 aa, Influenza virus
KNWILWISF

SEQ ID NO: 338234 - protein, 9 aa, Influenza virus
NWILWISFA

SEQ ID NO: 338235 - protein, 9 aa, Influenza virus
WILWISFAT

SEQ ID NO: 338236 - protein, 9 aa, Influenza virus
ILWISFATS

SEQ ID NO: 338237 - protein, 9 aa, Influenza virus
LWISFAMSC

SEQ ID NO: 338238 - protein, 9 aa, Influenza virus
WISFAMSCF

SEQ ID NO: 338239 - protein, 9 aa, Influenza virus
ISFAMSCFL

SEQ ID NO: 338240 - protein, 9 aa, Influenza virus
SFAMSCFLL

SEQ ID NO: 338241 - protein, 9 aa, Influenza virus
FAMSCFLLC

SEQ ID NO: 338242 - protein, 9 aa, Influenza virus
LGFIMWTCQ

SEQ ID NO: 338243 - protein, 9 aa, Influenza virus
GFIMWTCQK

SEQ ID NO: 338244 - protein, 9 aa, Influenza virus
FIMWTCQKG

SEQ ID NO: 338245 - protein, 9 aa, Influenza virus
IMWTCQKGN

SEQ ID NO: 338246 - protein, 9 aa, Influenza virus
MWTCQKGNI

SEQ ID NO: 338247 - protein, 9 aa, Influenza virus
WACQKGNIK

SEQ ID NO: 338248 - protein, 9 aa, Influenza virus
ACQKGNIKC

SEQ ID NO: 338249 - protein, 9 aa, Influenza virus
CQKGNIKCN

SEQ ID NO: 338250 - protein, 9 aa, Influenza virus
QKGNIKCNI

SEQ ID NO: 338251 - protein, 9 aa, Influenza virus
KGNIKCNIC

SEQ ID NO: 338252 - protein, 9 aa, Influenza virus
GNIRCDICI

SEQ ID NO: 338253 - protein, 9 aa, Influenza virus
MNPNKKIIT

SEQ ID NO: 338254 - protein, 9 aa, Influenza virus
YRDWSKPQC

SEQ ID NO: 338255 - protein, 9 aa, Influenza virus
SIRLAAGGD

SEQ ID NO: 338256 - protein, 9 aa, Influenza virus
IRLAAGGDI

SEQ ID NO: 338257 - protein, 9 aa, Influenza virus
RLAAGGDIW

SEQ ID NO: 338258 - protein, 9 aa, Influenza virus
LAAGGDIWV

SEQ ID NO: 338259 - protein, 9 aa, Influenza virus
AAGGDIWVT

SEQ ID NO: 338260 - protein, 9 aa, Influenza virus
GAIWVTREP

SEQ ID NO: 338261 - protein, 9 aa, Influenza virus
AIWVTREPY

SEQ ID NO: 338262 - protein, 9 aa, Influenza virus
TREPYVSCG

SEQ ID NO: 338263 - protein, 9 aa, Influenza virus
SKCYQFALG

SEQ ID NO: 338264 - protein, 9 aa, Influenza virus
ALGQGTTLS

SEQ ID NO: 338265 - protein, 9 aa, Influenza virus
LGQGTTLSN

SEQ ID NO: 338266 - protein, 9 aa, Influenza virus
RTPHRTLLM

SEQ ID NO: 338267 - protein, 9 aa, Influenza virus
TPHRTLLMN

SEQ ID NO: 338268 - protein, 9 aa, Influenza virus
NELGIPFHL

SEQ ID NO: 338269 - protein, 9 aa, Influenza virus
GVPFYLGTK

SEQ ID NO: 338270 - protein, 9 aa, Influenza virus
VPFYLGTKQ

SEQ ID NO: 338271 - protein, 9 aa, Influenza virus
HLGTRQVCM

SEQ ID NO: 338272 - protein, 9 aa, Influenza virus
LGTRQVCMA

SEQ ID NO: 338273 - protein, 9 aa, Influenza virus
GTRQVCMAW

SEQ ID NO: 338274 - protein, 9 aa, Influenza virus
TRQVCMAWS

SEQ ID NO: 338275 - protein, 9 aa, Influenza virus
RQVCMAWSS

SEQ ID NO: 338276 - protein, 9 aa, Influenza virus
RNATASFIY

SEQ ID NO: 338277 - protein, 9 aa, Influenza virus
NATASFIYG

SEQ ID NO: 338278 - protein, 9 aa, Influenza virus
ATASFIYGG

SEQ ID NO: 338279 - protein, 9 aa, Influenza virus
NILRTQESE

SEQ ID NO: 338280 - protein, 9 aa, Influenza virus
CICINGTCT

SEQ ID NO: 338281 - protein, 9 aa, Influenza virus
ICINGTCTV

SEQ ID NO: 338282 - protein, 9 aa, Influenza virus
CISGTCAVV

SEQ ID NO: 338283 - protein, 9 aa, Influenza virus
ISGTCAVVM

SEQ ID NO: 338284 - protein, 9 aa, Influenza virus
SGTCAVVMT

SEQ ID NO: 338285 - protein, 9 aa, Influenza virus
CTVVMTDGN

SEQ ID NO: 338286 - protein, 9 aa, Influenza virus
TVVMTDGNA

SEQ ID NO: 338287 - protein, 9 aa, Influenza virus
VMTDGSASD

SEQ ID NO: 338288 - protein, 9 aa, Influenza virus
LLGSAQHVE

SEQ ID NO: 338289 - protein, 9 aa, Influenza virus
LGSAQHVEE

SEQ ID NO: 338290 - protein, 9 aa, Influenza virus
ECSCYPRYS

SEQ ID NO: 338291 - protein, 9 aa, Influenza virus
CSCYPRYPD

SEQ ID NO: 338292 - protein, 9 aa, Influenza virus
IRCVCRDNW

SEQ ID NO: 338293 - protein, 9 aa, Influenza virus
RCVCRDNWR

SEQ ID NO: 338294 - protein, 9 aa, Influenza virus
CVCRDNWRG

SEQ ID NO: 338295 - protein, 9 aa, Influenza virus
VCRDNWRGS

SEQ ID NO: 338296 - protein, 9 aa, Influenza virus
WKGSNRPVI

SEQ ID NO: 338297 - protein, 9 aa, Influenza virus
KGSNRPVID

SEQ ID NO: 338298 - protein, 9 aa, Influenza virus
GSNRPVIDI

SEQ ID NO: 338299 - protein, 9 aa, Influenza virus
SNRPVIDIN

SEQ ID NO: 338300 - protein, 9 aa, Influenza virus
SSYMCSGLV

SEQ ID NO: 338301 - protein, 9 aa, Influenza virus
SYMCSGLVG

SEQ ID NO: 338302 - protein, 9 aa, Influenza virus
YLCSGLVGD

SEQ ID NO: 338303 - protein, 9 aa, Influenza virus
LCSGLVGDT

SEQ ID NO: 338304 - protein, 9 aa, Influenza virus
QGVKGWAFD

SEQ ID NO: 338305 - protein, 9 aa, Influenza virus
VKGWAFDNE

SEQ ID NO: 338306 - protein, 9 aa, Influenza virus
ENDVWMGRT

SEQ ID NO: 338307 - protein, 9 aa, Influenza virus
NDIWMGRTI

SEQ ID NO: 338308 - protein, 9 aa, Influenza virus
DVWMGRTIG

SEQ ID NO: 338309 - protein, 9 aa, Influenza virus
RSGYETFRV

SEQ ID NO: 338310 - protein, 9 aa, Influenza virus
SGYETFRVI

SEQ ID NO: 338311 - protein, 9 aa, Influenza virus
MSGYSGIFS

SEQ ID NO: 338312 - protein, 9 aa, Influenza virus
YSGIFSVEN

SEQ ID NO: 338313 - protein, 9 aa, Influenza virus
SGIFSVENK

SEQ ID NO: 338314 - protein, 9 aa, Influenza virus
KNCINRCFY

SEQ ID NO: 338315 - protein, 9 aa, Influenza virus
NCINRCFYV

SEQ ID NO: 338316 - protein, 9 aa, Influenza virus
RVWWTSNSI

SEQ ID NO: 338317 - protein, 9 aa, Influenza virus
SGSWPDGAD

SEQ ID NO: 338318 - protein, 9 aa, Influenza virus
GSWPDGADL

SEQ ID NO: 338319 - protein, 9 aa, Influenza virus
ADIKSHAYI

SEQ ID NO: 338320 - protein, 9 aa, Influenza virus
DINLMPIYS

SEQ ID NO: 338321 - protein, 9 aa, Influenza virus
YTENPVICL

SEQ ID NO: 338322 - protein, 9 aa, Influenza virus
TENPVICLG

SEQ ID NO: 338323 - protein, 9 aa, Influenza virus
PVICLGHHS

SEQ ID NO: 338324 - protein, 9 aa, Influenza virus
VICLGHHSV

SEQ ID NO: 338325 - protein, 9 aa, Influenza virus
GHHAVANGT

SEQ ID NO: 338326 - protein, 9 aa, Influenza virus
VANGTMVKT

SEQ ID NO: 338327 - protein, 9 aa, Influenza virus
NGTIVKTLT

SEQ ID NO: 338328 - protein, 9 aa, Influenza virus
GTMVKTLAD

SEQ ID NO: 338329 - protein, 9 aa, Influenza virus
IEVVAAQEL

SEQ ID NO: 338330 - protein, 9 aa, Influenza virus
EVITAQELV

SEQ ID NO: 338331 - protein, 9 aa, Influenza virus
VTAQELVEA

SEQ ID NO: 338332 - protein, 9 aa, Influenza virus
TAQELVEAQ

SEQ ID NO: 338333 - protein, 9 aa, Influenza virus
ELCPKPLKL

SEQ ID NO: 338334 - protein, 9 aa, Influenza virus
LCPSPLKLI

SEQ ID NO: 338335 - protein, 9 aa, Influenza virus
CPSPLKLID

SEQ ID NO: 338336 - protein, 9 aa, Influenza virus
SPLKLIDGQ

SEQ ID NO: 338337 - protein, 9 aa, Influenza virus
CDIVNSALG

SEQ ID NO: 338338 - protein, 9 aa, Influenza virus
DIVNSALGS

SEQ ID NO: 338339 - protein, 9 aa, Influenza virus
IVNSALGSP

SEQ ID NO: 338340 - protein, 9 aa, Influenza virus
VNSALGSPG

SEQ ID NO: 338341 - protein, 9 aa, Influenza virus
AALGSPGCD

SEQ ID NO: 338342 - protein, 9 aa, Influenza virus
EWDVYIERP

SEQ ID NO: 338343 - protein, 9 aa, Influenza virus
TCYPFDVPG

SEQ ID NO: 338344 - protein, 9 aa, Influenza virus
CYPFDVPNY

SEQ ID NO: 338345 - protein, 9 aa, Influenza virus
YPFDVPGYQ

SEQ ID NO: 338346 - protein, 9 aa, Influenza virus
PFDVPNYQS

SEQ ID NO: 338347 - protein, 9 aa, Influenza virus
DVPDYQSIR

SEQ ID NO: 338348 - protein, 9 aa, Influenza virus
VPGYQSLRS

SEQ ID NO: 338349 - protein, 9 aa, Influenza virus
PNYQSLRSI

SEQ ID NO: 338350 - protein, 9 aa, Influenza virus
GYQSLRSIL

SEQ ID NO: 338351 - protein, 9 aa, Influenza virus
NNGKFEFIV

SEQ ID NO: 338352 - protein, 9 aa, Influenza virus
NGKFEFIVE

SEQ ID NO: 338353 - protein, 9 aa, Influenza virus
GKFEFIAED

SEQ ID NO: 338354 - protein, 9 aa, Influenza virus
KFEFIAEDF

SEQ ID NO: 338355 - protein, 9 aa, Influenza virus
TVKQDGKSS

SEQ ID NO: 338356 - protein, 9 aa, Influenza virus
VKQDGKSSA

SEQ ID NO: 338357 - protein, 9 aa, Influenza virus
KQDGKSSAC

SEQ ID NO: 338358 - protein, 9 aa, Influenza virus
QDGKSSACK

SEQ ID NO: 338359 - protein, 9 aa, Influenza virus
DGKSSACKR

SEQ ID NO: 338360 - protein, 9 aa, Influenza virus
KSGACKRAD

SEQ ID NO: 338361 - protein, 9 aa, Influenza virus
DDFFNRLNW

SEQ ID NO: 338362 - protein, 9 aa, Influenza virus
DFFKRLNWL

SEQ ID NO: 338363 - protein, 9 aa, Influenza virus
AYPFQNLTK

SEQ ID NO: 338364 - protein, 9 aa, Influenza virus
YPLQNLTKT

SEQ ID NO: 338365 - protein, 9 aa, Influenza virus
PLQNLTKTN

SEQ ID NO: 338366 - protein, 9 aa, Influenza virus
QNLTKVNSG

SEQ ID NO: 338367 - protein, 9 aa, Influenza virus
NLTKVNSGD

SEQ ID NO: 338368 - protein, 9 aa, Influenza virus
LTKVNNGNY

SEQ ID NO: 338369 - protein, 9 aa, Influenza virus
NSGDYARLY

SEQ ID NO: 338370 - protein, 9 aa, Influenza virus
NGNYARLYI

SEQ ID NO: 338371 - protein, 9 aa, Influenza virus
GNYARLYIW

SEQ ID NO: 338372 - protein, 9 aa, Influenza virus
NYARLYIWG

SEQ ID NO: 338373 - protein, 9 aa, Influenza virus
GVHHPSTDA

SEQ ID NO: 338374 - protein, 9 aa, Influenza virus
VHHPSTDAE

SEQ ID NO: 338375 - protein, 9 aa, Influenza virus
HHPSTDAEQ

SEQ ID NO: 338376 - protein, 9 aa, Influenza virus
LYENNPGRV

SEQ ID NO: 338377 - protein, 9 aa, Influenza virus
YKNNPGRVS

SEQ ID NO: 338378 - protein, 9 aa, Influenza virus
NNPGRVSVS

SEQ ID NO: 338379 - protein, 9 aa, Influenza virus
NPGRVSVST

SEQ ID NO: 338380 - protein, 9 aa, Influenza virus
PGRVTVSTR

SEQ ID NO: 338381 - protein, 9 aa, Influenza virus
QTSIVPNIG

SEQ ID NO: 338382 - protein, 9 aa, Influenza virus
RPLVRSQSG

SEQ ID NO: 338383 - protein, 9 aa, Influenza virus
PLVRSQSGR

SEQ ID NO: 338384 - protein, 9 aa, Influenza virus
VRSQSGRIS

SEQ ID NO: 338385 - protein, 9 aa, Influenza virus
RSQSGRISF

SEQ ID NO: 338386 - protein, 9 aa, Influenza virus
SQSGRISFY

SEQ ID NO: 338387 - protein, 9 aa, Influenza virus
LSSRISFYW

SEQ ID NO: 338388 - protein, 9 aa, Influenza virus
SSRISFYWT

SEQ ID NO: 338389 - protein, 9 aa, Influenza virus
SRISFYWTI

SEQ ID NO: 338390 - protein, 9 aa, Influenza virus
ISFYWTIVD

SEQ ID NO: 338391 - protein, 9 aa, Influenza virus
SLYWTIVEP

SEQ ID NO: 338392 - protein, 9 aa, Influenza virus
FYWTIVEPE

SEQ ID NO: 338393 - protein, 9 aa, Influenza virus
YWTIVEPED

SEQ ID NO: 338394 - protein, 9 aa, Influenza virus
PGDLILFNT

SEQ ID NO: 338395 - protein, 9 aa, Influenza virus
GDLILFNTI

SEQ ID NO: 338396 - protein, 9 aa, Influenza virus
DLILFNTIG

SEQ ID NO: 338397 - protein, 9 aa, Influenza virus
LILFNTIGN

SEQ ID NO: 338398 - protein, 9 aa, Influenza virus
LFNTIGNLI

SEQ ID NO: 338399 - protein, 9 aa, Influenza virus
LIAPRGHYR

SEQ ID NO: 338400 - protein, 9 aa, Influenza virus
IAPRGHYRL

SEQ ID NO: 338401 - protein, 9 aa, Influenza virus
IGSCESKCH

SEQ ID NO: 338402 - protein, 9 aa, Influenza virus
GSCESKCHT

SEQ ID NO: 338403 - protein, 9 aa, Influenza virus
SRCHTDKGS

SEQ ID NO: 338404 - protein, 9 aa, Influenza virus
KPFQNVSRI

SEQ ID NO: 338405 - protein, 9 aa, Influenza virus
PFQNISRVS

SEQ ID NO: 338406 - protein, 9 aa, Influenza virus
GECPKYVKQ

SEQ ID NO: 338407 - protein, 9 aa, Influenza virus
DCPKYIKQG

SEQ ID NO: 338408 - protein, 9 aa, Influenza virus
CPRYVKQGS

SEQ ID NO: 338409 - protein, 9 aa, Influenza virus
PRYVKQGSL

SEQ ID NO: 338410 - protein, 9 aa, Influenza virus
RYVKQGSLK

SEQ ID NO: 338411 - protein, 9 aa, Influenza virus
YVKQGSLRL

SEQ ID NO: 338412 - protein, 9 aa, Influenza virus
VKQGSLRLA

SEQ ID NO: 338413 - protein, 9 aa, Influenza virus
KSTQAAIDK

SEQ ID NO: 338414 - protein, 9 aa, Influenza virus
STQAAIDQV

SEQ ID NO: 338415 - protein, 9 aa, Influenza virus
TQTAIDQIT

SEQ ID NO: 338416 - protein, 9 aa, Influenza virus
QTAIDQITG

SEQ ID NO: 338417 - protein, 9 aa, Influenza virus
TAIDQITGK

SEQ ID NO: 338418 - protein, 9 aa, Influenza virus
AIDQVNGKL

SEQ ID NO: 338419 - protein, 9 aa, Influenza virus
IDKINGKLN

SEQ ID NO: 338420 - protein, 9 aa, Influenza virus
NQINGKLNR

SEQ ID NO: 338421 - protein, 9 aa, Influenza virus
KINGKLNRL

SEQ ID NO: 338422 - protein, 9 aa, Influenza virus
NRLIEKTND

SEQ ID NO: 338423 - protein, 9 aa, Influenza virus
RLIERTNEK

SEQ ID NO: 338424 - protein, 9 aa, Influenza virus
LIEKTNDKY

SEQ ID NO: 338425 - protein, 9 aa, Influenza virus
IERTNEKYH

SEQ ID NO: 338426 - protein, 9 aa, Influenza virus
ERTNEKYHQ

SEQ ID NO: 338427 - protein, 9 aa, Influenza virus
KTNDKYHQI

SEQ ID NO: 338428 - protein, 9 aa, Influenza virus
EFEQVEGRT

SEQ ID NO: 338429 - protein, 9 aa, Influenza virus
FEQVEGRTQ

SEQ ID NO: 338430 - protein, 9 aa, Influenza virus
EQVEGRTQD

SEQ ID NO: 338431 - protein, 9 aa, Influenza virus
QVEGRTQDL

SEQ ID NO: 338432 - protein, 9 aa, Influenza virus
VEGRIQYLE

SEQ ID NO: 338433 - protein, 9 aa, Influenza virus
QDLENYVED

SEQ ID NO: 338434 - protein, 9 aa, Influenza virus
YLEKYVEDT

SEQ ID NO: 338435 - protein, 9 aa, Influenza virus
LENYVEDTK

SEQ ID NO: 338436 - protein, 9 aa, Influenza virus
ERYVEDTKI

SEQ ID NO: 338437 - protein, 9 aa, Influenza virus
RYVEDTKID

SEQ ID NO: 338438 - protein, 9 aa, Influenza virus
QHIIDVTDS

SEQ ID NO: 338439 - protein, 9 aa, Influenza virus
HIIDVTDSE

SEQ ID NO: 338440 - protein, 9 aa, Influenza virus
IIDVTDSEM

SEQ ID NO: 338441 - protein, 9 aa, Influenza virus
IDMTDSEMN

SEQ ID NO: 338442 - protein, 9 aa, Influenza virus
DMTDSEMNK

SEQ ID NO: 338443 - protein, 9 aa, Influenza virus
VTDSEMDKL

SEQ ID NO: 338444 - protein, 9 aa, Influenza virus
TDSEMDKLF

SEQ ID NO: 338445 - protein, 9 aa, Influenza virus
DSEMDKLFE

SEQ ID NO: 338446 - protein, 9 aa, Influenza virus
SEMNRLFER

SEQ ID NO: 338447 - protein, 9 aa, Influenza virus
EMDKLFERV

SEQ ID NO: 338448 - protein, 9 aa, Influenza virus
MNRLFERVR

SEQ ID NO: 338449 - protein, 9 aa, Influenza virus
KLFERVKRQ

SEQ ID NO: 338450 - protein, 9 aa, Influenza virus
LFERVKRQL

SEQ ID NO: 338451 - protein, 9 aa, Influenza virus
FERVKRQLR

SEQ ID NO: 338452 - protein, 9 aa, Influenza virus
ERVKRQLRE

SEQ ID NO: 338453 - protein, 9 aa, Influenza virus
RVKRQLREN

SEQ ID NO: 338454 - protein, 9 aa, Influenza virus
VKRQLRENA

SEQ ID NO: 338455 - protein, 9 aa, Influenza virus
NGCFEIFHR

SEQ ID NO: 338456 - protein, 9 aa, Influenza virus
GCFEIFHRC

SEQ ID NO: 338457 - protein, 9 aa, Influenza virus
CFEIFHRCD

SEQ ID NO: 338458 - protein, 9 aa, Influenza virus
FEIFHRCDN

SEQ ID NO: 338459 - protein, 9 aa, Influenza virus
CDNKCIESI

SEQ ID NO: 338460 - protein, 9 aa, Influenza virus
DNKCIESIR

SEQ ID NO: 338461 - protein, 9 aa, Influenza virus
NKCIESIRN

SEQ ID NO: 338462 - protein, 9 aa, Influenza virus
KCIESIRNG

SEQ ID NO: 338463 - protein, 9 aa, Influenza virus
IRNGTYDHN

SEQ ID NO: 338464 - protein, 9 aa, Influenza virus
HDIYRNEAI

SEQ ID NO: 338465 - protein, 9 aa, Influenza virus
YRNEAINNR

SEQ ID NO: 338466 - protein, 9 aa, Influenza virus
RNEAINNRF

SEQ ID NO: 338467 - protein, 9 aa, Influenza virus
NEAINNRFQ

SEQ ID NO: 338468 - protein, 9 aa, Influenza virus
EAINSRFQI

SEQ ID NO: 338469 - protein, 9 aa, Influenza virus
AINSRFQIQ

SEQ ID NO: 338470 - protein, 9 aa, Influenza virus
INSRFQIQG

SEQ ID NO: 338471 - protein, 9 aa, Influenza virus
NSRFQIQGV

SEQ ID NO: 338472 - protein, 9 aa, Influenza virus
SRFQIQGVK

SEQ ID NO: 338473 - protein, 9 aa, Influenza virus
RFQIQGIKL

SEQ ID NO: 338474 - protein, 9 aa, Influenza virus
FQIQGVKLA

SEQ ID NO: 338475 - protein, 9 aa, Influenza virus
QIQGVKLAQ

SEQ ID NO: 338476 - protein, 9 aa, Influenza virus
IQGVKLAQG

SEQ ID NO: 338477 - protein, 9 aa, Influenza virus
QGVKLAQGY

SEQ ID NO: 338478 - protein, 9 aa, Influenza virus
GVKLAQGYK

SEQ ID NO: 338479 - protein, 9 aa, Influenza virus
VKLAQGYKD

SEQ ID NO: 338480 - protein, 9 aa, Influenza virus
KLAQGYKDI

SEQ ID NO: 338481 - protein, 9 aa, Influenza virus
LIQGYKDII

SEQ ID NO: 338482 - protein, 9 aa, Influenza virus
IQGYKDIIL

SEQ ID NO: 338483 - protein, 9 aa, Influenza virus
GYKDIILWF

SEQ ID NO: 338484 - protein, 9 aa, Influenza virus
YKDIILWFS

SEQ ID NO: 338485 - protein, 9 aa, Influenza virus
KDIILWFSF

SEQ ID NO: 338486 - protein, 9 aa, Influenza virus
DVILWISFS

SEQ ID NO: 338487 - protein, 9 aa, Influenza virus
IILWFSFSI

SEQ ID NO: 338488 - protein, 9 aa, Influenza virus
FSISCFLLI

SEQ ID NO: 338489 - protein, 9 aa, Influenza virus
SISCFLLIA

SEQ ID NO: 338490 - protein, 9 aa, Influenza virus
ISCFLLIAL

SEQ ID NO: 338491 - protein, 9 aa, Influenza virus
SCFLLIALL

SEQ ID NO: 338492 - protein, 9 aa, Influenza virus
CFLLVALLI

SEQ ID NO: 338493 - protein, 9 aa, Influenza virus
ALLLAFVLW

SEQ ID NO: 338494 - protein, 9 aa, Influenza virus
LLLAFVLWA

SEQ ID NO: 338495 - protein, 9 aa, Influenza virus
LLAFVLWAC

SEQ ID NO: 338496 - protein, 9 aa, Influenza virus
LAFMLWACQ

SEQ ID NO: 338497 - protein, 9 aa, Influenza virus
AFMLWACQN

SEQ ID NO: 338498 - protein, 9 aa, Influenza virus
FMLWACQNG

SEQ ID NO: 338499 - protein, 9 aa, Influenza virus
MLWACQNGN

SEQ ID NO: 338500 - protein, 9 aa, Influenza virus
LWACQNGNV

SEQ ID NO: 338501 - protein, 9 aa, Influenza virus
WACQNGNVR

SEQ ID NO: 338502 - protein, 9 aa, Influenza virus
ACQNGNVRC

SEQ ID NO: 338503 - protein, 9 aa, Influenza virus
CQNGNVRCQ

SEQ ID NO: 338504 - protein, 9 aa, Influenza virus
QNGNVRCQI

SEQ ID NO: 338505 - protein, 9 aa, Influenza virus
NGNVRCQIC

SEQ ID NO: 338506 - protein, 9 aa, Influenza virus
GNVRCQICI

SEQ ID NO: 338507 - protein, 9 aa, Influenza virus
SDHICIGYH

SEQ ID NO: 338508 - protein, 9 aa, Influenza virus
DRICIGYHA

SEQ ID NO: 338509 - protein, 9 aa, Influenza virus
RICIGYHAN

SEQ ID NO: 338510 - protein, 9 aa, Influenza virus
GYHANNSTV

SEQ ID NO: 338511 - protein, 9 aa, Influenza virus
QVDTIMERN

SEQ ID NO: 338512 - protein, 9 aa, Influenza virus
IDTIMEKNV

SEQ ID NO: 338513 - protein, 9 aa, Influenza virus
IMEKNITVT

SEQ ID NO: 338514 - protein, 9 aa, Influenza virus
MEKNITVTH

SEQ ID NO: 338515 - protein, 9 aa, Influenza virus
EKNITVTHA

SEQ ID NO: 338516 - protein, 9 aa, Influenza virus
KNVTVTHAK

SEQ ID NO: 338517 - protein, 9 aa, Influenza virus
NVTVTHAKD

SEQ ID NO: 338518 - protein, 9 aa, Influenza virus
VTVTHAKDI

SEQ ID NO: 338519 - protein, 9 aa, Influenza virus
TVTHAKDIL

SEQ ID NO: 338520 - protein, 9 aa, Influenza virus
VTHAKDILE

SEQ ID NO: 338521 - protein, 9 aa, Influenza virus
THAQNILEK

SEQ ID NO: 338522 - protein, 9 aa, Influenza virus
RPLILKDCS

SEQ ID NO: 338523 - protein, 9 aa, Influenza virus
PLILKDCSI

SEQ ID NO: 338524 - protein, 9 aa, Influenza virus
ILKDCSIAG

SEQ ID NO: 338525 - protein, 9 aa, Influenza virus
LKDCSIAGW

SEQ ID NO: 338526 - protein, 9 aa, Influenza virus
KDCSIAGWL

SEQ ID NO: 338527 - protein, 9 aa, Influenza virus
DCSVSGWLL

SEQ ID NO: 338528 - protein, 9 aa, Influenza virus
SGWLLGNPM

SEQ ID NO: 338529 - protein, 9 aa, Influenza virus
LLGNPMCDK

SEQ ID NO: 338530 - protein, 9 aa, Influenza virus
LGNPMCDKF

SEQ ID NO: 338531 - protein, 9 aa, Influenza virus
APEWSYIVE

SEQ ID NO: 338532 - protein, 9 aa, Influenza virus
PEWSYIVER

SEQ ID NO: 338533 - protein, 9 aa, Influenza virus
SGRSSFFRN

SEQ ID NO: 338534 - protein, 9 aa, Influenza virus
LLIIWGIHH

SEQ ID NO: 338535 - protein, 9 aa, Influenza virus
YISIGTSTL

SEQ ID NO: 338536 - protein, 9 aa, Influenza virus
ISIGTSTLN

SEQ ID NO: 338537 - protein, 9 aa, Influenza virus
SVGTSTLNL

SEQ ID NO: 338538 - protein, 9 aa, Influenza virus
VGTSTLNLR

SEQ ID NO: 338539 - protein, 9 aa, Influenza virus
GTSTLNLRL

SEQ ID NO: 338540 - protein, 9 aa, Influenza virus
FDSNGNFIA

SEQ ID NO: 338541 - protein, 9 aa, Influenza virus
DSNGNFIAP

SEQ ID NO: 338542 - protein, 9 aa, Influenza virus
SNGNFITPE

SEQ ID NO: 338543 - protein, 9 aa, Influenza virus
TGNFIAPEY

SEQ ID NO: 338544 - protein, 9 aa, Influenza virus
FIAPEYAYI

SEQ ID NO: 338545 - protein, 9 aa, Influenza virus
IAPEYAYIV

SEQ ID NO: 338546 - protein, 9 aa, Influenza virus
CQTPVGAIN

SEQ ID NO: 338547 - protein, 9 aa, Influenza virus
SSLPFHNVH

SEQ ID NO: 338548 - protein, 9 aa, Influenza virus
SLPFHNVHP

SEQ ID NO: 338549 - protein, 9 aa, Influenza virus
MPFHNVHPF

SEQ ID NO: 338550 - protein, 9 aa, Influenza virus
PFHNVHPFT

SEQ ID NO: 338551 - protein, 9 aa, Influenza virus
FHNVHPFTI

SEQ ID NO: 338552 - protein, 9 aa, Influenza virus
HNVHPFTIG

SEQ ID NO: 338553 - protein, 9 aa, Influenza virus
HPLTIGKCP

SEQ ID NO: 338554 - protein, 9 aa, Influenza virus
PFTIGECPR

SEQ ID NO: 338555 - protein, 9 aa, Influenza virus
FTIGECPRY

SEQ ID NO: 338556 - protein, 9 aa, Influenza virus
TIGKCPKYV

SEQ ID NO: 338557 - protein, 9 aa, Influenza virus
IGKCPKYVK

SEQ ID NO: 338558 - protein, 9 aa, Influenza virus
GKCPKYVKS

SEQ ID NO: 338559 - protein, 9 aa, Influenza virus
LILATGLRN

SEQ ID NO: 338560 - protein, 9 aa, Influenza virus
RRRKRGLFG

SEQ ID NO: 338561 - protein, 9 aa, Influenza virus
GMIDGWYGY

SEQ ID NO: 338562 - protein, 9 aa, Influenza virus
MIDGWYGYH

SEQ ID NO: 338563 - protein, 9 aa, Influenza virus
IDGWYGYHH

SEQ ID NO: 338564 - protein, 9 aa, Influenza virus
DGWYGYHHN

SEQ ID NO: 338565 - protein, 9 aa, Influenza virus
GWYGYHHNN

SEQ ID NO: 338566 - protein, 9 aa, Influenza virus
NDQGSGYAA

SEQ ID NO: 338567 - protein, 9 aa, Influenza virus
DQGSGYAAD

SEQ ID NO: 338568 - protein, 9 aa, Influenza virus
QGSGYAADR

SEQ ID NO: 338569 - protein, 9 aa, Influenza virus
GSGYAADKK

SEQ ID NO: 338570 - protein, 9 aa, Influenza virus
SGYAADKKS

SEQ ID NO: 338571 - protein, 9 aa, Influenza virus
GYAADKKST

SEQ ID NO: 338572 - protein, 9 aa, Influenza virus
YAADKKSTQ

SEQ ID NO: 338573 - protein, 9 aa, Influenza virus
AADQESTQK

SEQ ID NO: 338574 - protein, 9 aa, Influenza virus
ADQESTQKA

SEQ ID NO: 338575 - protein, 9 aa, Influenza virus
ESTQKAING

SEQ ID NO: 338576 - protein, 9 aa, Influenza virus
NGITNKVNS

SEQ ID NO: 338577 - protein, 9 aa, Influenza virus
GITNKINSI

SEQ ID NO: 338578 - protein, 9 aa, Influenza virus
ITNKINSII

SEQ ID NO: 338579 - protein, 9 aa, Influenza virus
TNKVNSIIG

SEQ ID NO: 338580 - protein, 9 aa, Influenza virus
KVNSIIGKM

SEQ ID NO: 338581 - protein, 9 aa, Influenza virus
VNSIIGKMN

SEQ ID NO: 338582 - protein, 9 aa, Influenza virus
NSIIGKMNT

SEQ ID NO: 338583 - protein, 9 aa, Influenza virus
IIGKMNTQF

SEQ ID NO: 338584 - protein, 9 aa, Influenza virus
LERRIESLN

SEQ ID NO: 338585 - protein, 9 aa, Influenza virus
LNKKMEDDF

SEQ ID NO: 338586 - protein, 9 aa, Influenza virus
GFIDVWTYN

SEQ ID NO: 338587 - protein, 9 aa, Influenza virus
FIDVWTYNA

SEQ ID NO: 338588 - protein, 9 aa, Influenza virus
IDVWTYNAE

SEQ ID NO: 338589 - protein, 9 aa, Influenza virus
GVWTYNAEL

SEQ ID NO: 338590 - protein, 9 aa, Influenza virus
LDFHDSNVR

SEQ ID NO: 338591 - protein, 9 aa, Influenza virus
DFHDSNVRN

SEQ ID NO: 338592 - protein, 9 aa, Influenza virus
FHDSNVRNL

SEQ ID NO: 338593 - protein, 9 aa, Influenza virus
DSNVRNLYD

SEQ ID NO: 338594 - protein, 9 aa, Influenza virus
SNVRNLYDK

SEQ ID NO: 338595 - protein, 9 aa, Influenza virus
NVRNLYDKV

SEQ ID NO: 338596 - protein, 9 aa, Influenza virus
VRNLYDKVR

SEQ ID NO: 338597 - protein, 9 aa, Influenza virus
NLYDRVRLQ

SEQ ID NO: 338598 - protein, 9 aa, Influenza virus
LYDRVRLQL

SEQ ID NO: 338599 - protein, 9 aa, Influenza virus
RVRLQLRDN

SEQ ID NO: 338600 - protein, 9 aa, Influenza virus
RLQLKDNAR

SEQ ID NO: 338601 - protein, 9 aa, Influenza virus
LQLKDNARE

SEQ ID NO: 338602 - protein, 9 aa, Influenza virus
QLKDNAREL

SEQ ID NO: 338603 - protein, 9 aa, Influenza virus
LKDNARELG

SEQ ID NO: 338604 - protein, 9 aa, Influenza virus
KDNARELGN

SEQ ID NO: 338605 - protein, 9 aa, Influenza virus
CFEFYHKCN

SEQ ID NO: 338606 - protein, 9 aa, Influenza virus
FEFYHKCDD

SEQ ID NO: 338607 - protein, 9 aa, Influenza virus
CMESVKNGT

SEQ ID NO: 338608 - protein, 9 aa, Influenza virus
MESVKNGTY

SEQ ID NO: 338609 - protein, 9 aa, Influenza virus
VYQILSIYS

SEQ ID NO: 338610 - protein, 9 aa, Influenza virus
QILSLYSTV

SEQ ID NO: 338611 - protein, 9 aa, Influenza virus
ILSIYSTVV

SEQ ID NO: 338612 - protein, 9 aa, Influenza virus
LSIYSTVVS

SEQ ID NO: 338613 - protein, 9 aa, Influenza virus
SIYSTVVSS

SEQ ID NO: 338614 - protein, 9 aa, Influenza virus
IYSTVVSSL

SEQ ID NO: 338615 - protein, 9 aa, Influenza virus
AGLFLWMCS

SEQ ID NO: 338616 - protein, 9 aa, Influenza virus
GLFLWMCSN

SEQ ID NO: 338617 - protein, 9 aa, Influenza virus
LFLWMCSNG

SEQ ID NO: 338618 - protein, 9 aa, Influenza virus
FLWMCSNGS

SEQ ID NO: 338619 - protein, 9 aa, Influenza virus
LWMCFNGSL

SEQ ID NO: 338620 - protein, 9 aa, Influenza virus
WMCSNGSYN

SEQ ID NO: 338621 - protein, 9 aa, Influenza virus
SNGSLQCKI

SEQ ID NO: 338622 - protein, 9 aa, Influenza virus
NGSLQCRIA

SEQ ID NO: 338623 - protein, 9 aa, Influenza virus
GSLQCKICI

SEQ ID NO: 338624 - protein, 9 aa, Influenza virus
IKICESRLR

SEQ ID NO: 338625 - protein, 9 aa, Influenza virus
GDQICIGYH

SEQ ID NO: 338626 - protein, 9 aa, Influenza virus
DQICVGYHA

SEQ ID NO: 338627 - protein, 9 aa, Influenza virus
QICVGYHAN

SEQ ID NO: 338628 - protein, 9 aa, Influenza virus
GYHANNSTV

SEQ ID NO: 338629 - protein, 9 aa, Influenza virus
YHANNSTVQ

SEQ ID NO: 338630 - protein, 9 aa, Influenza virus
HANNSTVQV

SEQ ID NO: 338631 - protein, 9 aa, Influenza virus
ANNSTVQVD

SEQ ID NO: 338632 - protein, 9 aa, Influenza virus
NNSTVQVDT

SEQ ID NO: 338633 - protein, 9 aa, Influenza virus
NSTVQVDTI

SEQ ID NO: 338634 - protein, 9 aa, Influenza virus
STVQVDTIM

SEQ ID NO: 338635 - protein, 9 aa, Influenza virus
TVQVDTIME

SEQ ID NO: 338636 - protein, 9 aa, Influenza virus
VQVDTIMEK

SEQ ID NO: 338637 - protein, 9 aa, Influenza virus
RVDTIMEKN

SEQ ID NO: 338638 - protein, 9 aa, Influenza virus
MEKNITVTH

SEQ ID NO: 338639 - protein, 9 aa, Influenza virus
EKNITVTHA

SEQ ID NO: 338640 - protein, 9 aa, Influenza virus
KNVTVTHAK

SEQ ID NO: 338641 - protein, 9 aa, Influenza virus
NVTVTHAKD

SEQ ID NO: 338642 - protein, 9 aa, Influenza virus
VTVTHAKDI

SEQ ID NO: 338643 - protein, 9 aa, Influenza virus
TVTHAKDIL

SEQ ID NO: 338644 - protein, 9 aa, Influenza virus
THAQNILEK

SEQ ID NO: 338645 - protein, 9 aa, Influenza virus
DILEKAHNG

SEQ ID NO: 338646 - protein, 9 aa, Influenza virus
LKGVRPLIL

SEQ ID NO: 338647 - protein, 9 aa, Influenza virus
GVRPLILKD

SEQ ID NO: 338648 - protein, 9 aa, Influenza virus
VRPLILKDC

SEQ ID NO: 338649 - protein, 9 aa, Influenza virus
RPLILRDCS

SEQ ID NO: 338650 - protein, 9 aa, Influenza virus
PLILKDCSI

SEQ ID NO: 338651 - protein, 9 aa, Influenza virus
LILKDCSIA

SEQ ID NO: 338652 - protein, 9 aa, Influenza virus
ILKDCSIAG

SEQ ID NO: 338653 - protein, 9 aa, Influenza virus
LGNPMCDKF

SEQ ID NO: 338654 - protein, 9 aa, Influenza virus
DVPEWSYIV

SEQ ID NO: 338655 - protein, 9 aa, Influenza virus
LNDYEELKH

SEQ ID NO: 338656 - protein, 9 aa, Influenza virus
SDYEELKHL

SEQ ID NO: 338657 - protein, 9 aa, Influenza virus
DYEELKHLM

SEQ ID NO: 338658 - protein, 9 aa, Influenza virus
YEELKHLLN

SEQ ID NO: 338659 - protein, 9 aa, Influenza virus
EELKHLLSS

SEQ ID NO: 338660 - protein, 9 aa, Influenza virus
ELKHLLSST

SEQ ID NO: 338661 - protein, 9 aa, Influenza virus
SFFRNVIWL

SEQ ID NO: 338662 - protein, 9 aa, Influenza virus
LLVMWGIHH

SEQ ID NO: 338663 - protein, 9 aa, Influenza virus
TYVSVGTST

SEQ ID NO: 338664 - protein, 9 aa, Influenza virus
YVSVGTSTL

SEQ ID NO: 338665 - protein, 9 aa, Influenza virus
VSVGTSTLN

SEQ ID NO: 338666 - protein, 9 aa, Influenza virus
SVGTSTLNL

SEQ ID NO: 338667 - protein, 9 aa, Influenza virus
VGTSTLNLR

SEQ ID NO: 338668 - protein, 9 aa, Influenza virus
GTSTLNQRS

SEQ ID NO: 338669 - protein, 9 aa, Influenza virus
ISFESNGNF

SEQ ID NO: 338670 - protein, 9 aa, Influenza virus
SFESNGNFI

SEQ ID NO: 338671 - protein, 9 aa, Influenza virus
FESNGNFIT

SEQ ID NO: 338672 - protein, 9 aa, Influenza virus
NGNFITPEY

SEQ ID NO: 338673 - protein, 9 aa, Influenza virus
FIAPEYAYI

SEQ ID NO: 338674 - protein, 9 aa, Influenza virus
IAPEYAYIV

SEQ ID NO: 338675 - protein, 9 aa, Influenza virus
PEYAYIVKK

SEQ ID NO: 338676 - protein, 9 aa, Influenza virus
AYIVKKGDS

SEQ ID NO: 338677 - protein, 9 aa, Influenza virus
YIVKKGDSA

SEQ ID NO: 338678 - protein, 9 aa, Influenza virus
CQTPVGAIN

SEQ ID NO: 338679 - protein, 9 aa, Influenza virus
QTPVGAINS

SEQ ID NO: 338680 - protein, 9 aa, Influenza virus
TPVGAINSS

SEQ ID NO: 338681 - protein, 9 aa, Influenza virus
VGAINSSMP

SEQ ID NO: 338682 - protein, 9 aa, Influenza virus
GAINSSMPL

SEQ ID NO: 338683 - protein, 9 aa, Influenza virus
AINSSMPLH

SEQ ID NO: 338684 - protein, 9 aa, Influenza virus
INSSMPLHN

SEQ ID NO: 338685 - protein, 9 aa, Influenza virus
NSSMPLHNI

SEQ ID NO: 338686 - protein, 9 aa, Influenza virus
MPLHNIHPL

SEQ ID NO: 338687 - protein, 9 aa, Influenza virus
NIHPLTIGK

SEQ ID NO: 338688 - protein, 9 aa, Influenza virus
IHPLTIGKC

SEQ ID NO: 338689 - protein, 9 aa, Influenza virus
ECPKYVKSS

SEQ ID NO: 338690 - protein, 9 aa, Influenza virus
RLILATGLR

SEQ ID NO: 338691 - protein, 9 aa, Influenza virus
RRKRGLFGA

SEQ ID NO: 338692 - protein, 9 aa, Influenza virus
RKRGLFGAI

SEQ ID NO: 338693 - protein, 9 aa, Influenza virus
GMIDGWYGY

SEQ ID NO: 338694 - protein, 9 aa, Influenza virus
MIDGWYGYH

SEQ ID NO: 338695 - protein, 9 aa, Influenza virus
IDGWYGYHH

SEQ ID NO: 338696 - protein, 9 aa, Influenza virus
DGWYGYHHN

SEQ ID NO: 338697 - protein, 9 aa, Influenza virus
GWYGYHHNN

SEQ ID NO: 338698 - protein, 9 aa, Influenza virus
WYGYHHSNG

SEQ ID NO: 338699 - protein, 9 aa, Influenza virus
GYHHSNGQG

SEQ ID NO: 338700 - protein, 9 aa, Influenza virus
HHNNEQGSG

SEQ ID NO: 338701 - protein, 9 aa, Influenza virus
HNNEQGSGY

SEQ ID NO: 338702 - protein, 9 aa, Influenza virus
NNEQGSGYA

SEQ ID NO: 338703 - protein, 9 aa, Influenza virus
QGSGYAADR

SEQ ID NO: 338704 - protein, 9 aa, Influenza virus
GSGYAADRE

SEQ ID NO: 338705 - protein, 9 aa, Influenza virus
SGYAADRES

SEQ ID NO: 338706 - protein, 9 aa, Influenza virus
GYAADREST

SEQ ID NO: 338707 - protein, 9 aa, Influenza virus
YAADRESTQ

SEQ ID NO: 338708 - protein, 9 aa, Influenza virus
AADQESTQK

SEQ ID NO: 338709 - protein, 9 aa, Influenza virus
ADQESTQKA

SEQ ID NO: 338710 - protein, 9 aa, Influenza virus
ESTQKAING

SEQ ID NO: 338711 - protein, 9 aa, Influenza virus
STQRAIDGV

SEQ ID NO: 338712 - protein, 9 aa, Influenza virus
TQRAIDGVT

SEQ ID NO: 338713 - protein, 9 aa, Influenza virus
QRAIDGVTN

SEQ ID NO: 338714 - protein, 9 aa, Influenza virus
RAIDGVTNK

SEQ ID NO: 338715 - protein, 9 aa, Influenza virus
AINGVTNKV

SEQ ID NO: 338716 - protein, 9 aa, Influenza virus
INGVTNKVN

SEQ ID NO: 338717 - protein, 9 aa, Influenza virus
NGVTNKVNS

SEQ ID NO: 338718 - protein, 9 aa, Influenza virus
TNKINSIID

SEQ ID NO: 338719 - protein, 9 aa, Influenza virus
NKVNSIIGK

SEQ ID NO: 338720 - protein, 9 aa, Influenza virus
KVNSIIGKM

SEQ ID NO: 338721 - protein, 9 aa, Influenza virus
VNSIIGKMN

SEQ ID NO: 338722 - protein, 9 aa, Influenza virus
SIIGKMNTQ

SEQ ID NO: 338723 - protein, 9 aa, Influenza virus
IIGKMNTQF

SEQ ID NO: 338724 - protein, 9 aa, Influenza virus
IGKMNTQFE

SEQ ID NO: 338725 - protein, 9 aa, Influenza virus
GKMNTQFEA

SEQ ID NO: 338726 - protein, 9 aa, Influenza virus
KMNTQFETV

SEQ ID NO: 338727 - protein, 9 aa, Influenza virus
MNTRFEAVG

SEQ ID NO: 338728 - protein, 9 aa, Influenza virus
NTQFEAIGR

SEQ ID NO: 338729 - protein, 9 aa, Influenza virus
TQFEAIGRE

SEQ ID NO: 338730 - protein, 9 aa, Influenza virus
QFEAIGREF

SEQ ID NO: 338731 - protein, 9 aa, Influenza virus
FEAVGREFS

SEQ ID NO: 338732 - protein, 9 aa, Influenza virus
ERRIESLNK

SEQ ID NO: 338733 - protein, 9 aa, Influenza virus
RRIESLNKK

SEQ ID NO: 338734 - protein, 9 aa, Influenza virus
RIENLNRKM

SEQ ID NO: 338735 - protein, 9 aa, Influenza virus
IENLNRKME

SEQ ID NO: 338736 - protein, 9 aa, Influenza virus
ENLNRKMED

SEQ ID NO: 338737 - protein, 9 aa, Influenza virus
NLNRKMEDG

SEQ ID NO: 338738 - protein, 9 aa, Influenza virus
DSNVRNLYD

SEQ ID NO: 338739 - protein, 9 aa, Influenza virus
SNVRNLYDK

SEQ ID NO: 338740 - protein, 9 aa, Influenza virus
NVRNLYDKV

SEQ ID NO: 338741 - protein, 9 aa, Influenza virus
VRNLYDKVR

SEQ ID NO: 338742 - protein, 9 aa, Influenza virus
RNLYDKVRL

SEQ ID NO: 338743 - protein, 9 aa, Influenza virus
NLYDRVRLQ

SEQ ID NO: 338744 - protein, 9 aa, Influenza virus
LYDRVRLQL

SEQ ID NO: 338745 - protein, 9 aa, Influenza virus
YEKVRLQLR

SEQ ID NO: 338746 - protein, 9 aa, Influenza virus
EKVRLQLRD

SEQ ID NO: 338747 - protein, 9 aa, Influenza virus
RVRLQLRDN

SEQ ID NO: 338748 - protein, 9 aa, Influenza virus
CFEFYHKCN

SEQ ID NO: 338749 - protein, 9 aa, Influenza virus
FEFYHKCDD

SEQ ID NO: 338750 - protein, 9 aa, Influenza virus
CMESVKNGT

SEQ ID NO: 338751 - protein, 9 aa, Influenza virus
MESVKNGTY

SEQ ID NO: 338752 - protein, 9 aa, Influenza virus
SVKNGTYDY

SEQ ID NO: 338753 - protein, 9 aa, Influenza virus
NGTYSYPQY

SEQ ID NO: 338754 - protein, 9 aa, Influenza virus
VTYQILSIY

SEQ ID NO: 338755 - protein, 9 aa, Influenza virus
VYQILSIYS

SEQ ID NO: 338756 - protein, 9 aa, Influenza virus
ILSIYSTVT

SEQ ID NO: 338757 - protein, 9 aa, Influenza virus
LSIYSTVVS

SEQ ID NO: 338758 - protein, 9 aa, Influenza virus
SIYSTVVSS

SEQ ID NO: 338759 - protein, 9 aa, Influenza virus
IYSTVVSSL

SEQ ID NO: 338760 - protein, 9 aa, Influenza virus
YSTAASSLA

SEQ ID NO: 338761 - protein, 9 aa, Influenza virus
STAASSLAL

SEQ ID NO: 338762 - protein, 9 aa, Influenza virus
TAASSLALA

SEQ ID NO: 338763 - protein, 9 aa, Influenza virus
AASSLALAI

SEQ ID NO: 338764 - protein, 9 aa, Influenza virus
ASSLTLAIM

SEQ ID NO: 338765 - protein, 9 aa, Influenza virus
AGLSFWMCS

SEQ ID NO: 338766 - protein, 9 aa, Influenza virus
GLSFWMCSN

SEQ ID NO: 338767 - protein, 9 aa, Influenza virus
LSFWMCSNG

SEQ ID NO: 338768 - protein, 9 aa, Influenza virus
SFWMCSNGS

SEQ ID NO: 338769 - protein, 9 aa, Influenza virus
LWMCSNGSY

SEQ ID NO: 338770 - protein, 9 aa, Influenza virus
WMCSNGALQ

SEQ ID NO: 338771 - protein, 9 aa, Influenza virus
SNGSLQCKI

SEQ ID NO: 338772 - protein, 9 aa, Influenza virus
NGSLQCRIA

SEQ ID NO: 338773 - protein, 9 aa, Influenza virus
IRFVNSDCS

SEQ ID NO: 338774 - protein, 9 aa, Influenza virus
VFREQKQEF

SEQ ID NO: 338775 - protein, 9 aa, Influenza virus
FREQKQEFK

SEQ ID NO: 338776 - protein, 9 aa, Influenza virus
KMNPNQKIM

SEQ ID NO: 338777 - protein, 9 aa, Influenza virus
YKNNTWVNQ

SEQ ID NO: 338778 - protein, 9 aa, Influenza virus
QNSTWVSQT

SEQ ID NO: 338779 - protein, 9 aa, Influenza virus
NSTWVSQTY

SEQ ID NO: 338780 - protein, 9 aa, Influenza virus
GWAIHSKDN

SEQ ID NO: 338781 - protein, 9 aa, Influenza virus
YSKDNGIRI

SEQ ID NO: 338782 - protein, 9 aa, Influenza virus
SKDNNIRIG

SEQ ID NO: 338783 - protein, 9 aa, Influenza virus
KDNNIRIGS

SEQ ID NO: 338784 - protein, 9 aa, Influenza virus
DNGIRIGSK

SEQ ID NO: 338785 - protein, 9 aa, Influenza virus
NGIRIGSKG

SEQ ID NO: 338786 - protein, 9 aa, Influenza virus
GIRIGSKGD

SEQ ID NO: 338787 - protein, 9 aa, Influenza virus
IGSRGDVFI

SEQ ID NO: 338788 - protein, 9 aa, Influenza virus
GDVFVTREP

SEQ ID NO: 338789 - protein, 9 aa, Influenza virus
DVFVTREPF

SEQ ID NO: 338790 - protein, 9 aa, Influenza virus
FVIREPFVS

SEQ ID NO: 338791 - protein, 9 aa, Influenza virus
IREPFVSCS

SEQ ID NO: 338792 - protein, 9 aa, Influenza virus
REPFISCSQ

SEQ ID NO: 338793 - protein, 9 aa, Influenza virus
EPFISCSHS

SEQ ID NO: 338794 - protein, 9 aa, Influenza virus
PFISCSHSE

SEQ ID NO: 338795 - protein, 9 aa, Influenza virus
FISCSHSEC

SEQ ID NO: 338796 - protein, 9 aa, Influenza virus
VSCSHLECR

SEQ ID NO: 338797 - protein, 9 aa, Influenza virus
SCSHSECRT

SEQ ID NO: 338798 - protein, 9 aa, Influenza virus
CSHSECRTF

SEQ ID NO: 338799 - protein, 9 aa, Influenza virus
SHSECRTFF

SEQ ID NO: 338800 - protein, 9 aa, Influenza virus
HSECRTFFL

SEQ ID NO: 338801 - protein, 9 aa, Influenza virus
SECRTFFLT

SEQ ID NO: 338802 - protein, 9 aa, Influenza virus
RTFFLTHGA

SEQ ID NO: 338803 - protein, 9 aa, Influenza virus
TFFLTHGAL

SEQ ID NO: 338804 - protein, 9 aa, Influenza virus
FFLTHGALL

SEQ ID NO: 338805 - protein, 9 aa, Influenza virus
FLTHGALLN

SEQ ID NO: 338806 - protein, 9 aa, Influenza virus
THGALLNDK

SEQ ID NO: 338807 - protein, 9 aa, Influenza virus
HGALLNDKH

SEQ ID NO: 338808 - protein, 9 aa, Influenza virus
NDKHSNETV

SEQ ID NO: 338809 - protein, 9 aa, Influenza virus
KHSNGTVND

SEQ ID NO: 338810 - protein, 9 aa, Influenza virus
HSNETVKDR

SEQ ID NO: 338811 - protein, 9 aa, Influenza virus
SNETVKDRS

SEQ ID NO: 338812 - protein, 9 aa, Influenza virus
NETVKDRSP

SEQ ID NO: 338813 - protein, 9 aa, Influenza virus
KDRSPHRAL

SEQ ID NO: 338814 - protein, 9 aa, Influenza virus
DRSPHRALM

SEQ ID NO: 338815 - protein, 9 aa, Influenza virus
RSPHRALMS

SEQ ID NO: 338816 - protein, 9 aa, Influenza virus
SPHRALMSC

SEQ ID NO: 338817 - protein, 9 aa, Influenza virus
PHRALMSCP

SEQ ID NO: 338818 - protein, 9 aa, Influenza virus
RALMSCPVG

SEQ ID NO: 338819 - protein, 9 aa, Influenza virus
PIGEAPSPY

SEQ ID NO: 338820 - protein, 9 aa, Influenza virus
GVAPSPYNS

SEQ ID NO: 338821 - protein, 9 aa, Influenza virus
EVPSPYNSR

SEQ ID NO: 338822 - protein, 9 aa, Influenza virus
VPSPYNSRF

SEQ ID NO: 338823 - protein, 9 aa, Influenza virus
SASACHDGS

SEQ ID NO: 338824 - protein, 9 aa, Influenza virus
ASACHDGTN

SEQ ID NO: 338825 - protein, 9 aa, Influenza virus
SACHDGTNW

SEQ ID NO: 338826 - protein, 9 aa, Influenza virus
ACHDGTNWL

SEQ ID NO: 338827 - protein, 9 aa, Influenza virus
CHDGTNWLT

SEQ ID NO: 338828 - protein, 9 aa, Influenza virus
HDGTNWLTI

SEQ ID NO: 338829 - protein, 9 aa, Influenza virus
SWLTIGVSG

SEQ ID NO: 338830 - protein, 9 aa, Influenza virus
TIGVSGPDN

SEQ ID NO: 338831 - protein, 9 aa, Influenza virus
IGISGPDSG

SEQ ID NO: 338832 - protein, 9 aa, Influenza virus
GISGPDSGA

SEQ ID NO: 338833 - protein, 9 aa, Influenza virus
ISGPDSGAV

SEQ ID NO: 338834 - protein, 9 aa, Influenza virus
SGPDSGAVA

SEQ ID NO: 338835 - protein, 9 aa, Influenza virus
GPDSGAVAV

SEQ ID NO: 338836 - protein, 9 aa, Influenza virus
PDSGAVAVL

SEQ ID NO: 338837 - protein, 9 aa, Influenza virus
DSGAVAVLK

SEQ ID NO: 338838 - protein, 9 aa, Influenza virus
SGAVAVLKY

SEQ ID NO: 338839 - protein, 9 aa, Influenza virus
GAVAVVKYN

SEQ ID NO: 338840 - protein, 9 aa, Influenza virus
AVAVLKYDG

SEQ ID NO: 338841 - protein, 9 aa, Influenza virus
KYDGIITDT

SEQ ID NO: 338842 - protein, 9 aa, Influenza virus
YDGIITDTI

SEQ ID NO: 338843 - protein, 9 aa, Influenza virus
GLITDTIKS

SEQ ID NO: 338844 - protein, 9 aa, Influenza virus
LITDTIKSW

SEQ ID NO: 338845 - protein, 9 aa, Influenza virus
ITDTIRSWR

SEQ ID NO: 338846 - protein, 9 aa, Influenza virus
NTLRTQESE

SEQ ID NO: 338847 - protein, 9 aa, Influenza virus
TLRTQESEC

SEQ ID NO: 338848 - protein, 9 aa, Influenza virus
QESECACAN

SEQ ID NO: 338849 - protein, 9 aa, Influenza virus
ESECACANG

SEQ ID NO: 338850 - protein, 9 aa, Influenza virus
GFCFTVMTD

SEQ ID NO: 338851 - protein, 9 aa, Influenza virus
FCFTVMTDG

SEQ ID NO: 338852 - protein, 9 aa, Influenza virus
FTVMTDGPN

SEQ ID NO: 338853 - protein, 9 aa, Influenza virus
APNYYYEEC

SEQ ID NO: 338854 - protein, 9 aa, Influenza virus
PNYYYEECS

SEQ ID NO: 338855 - protein, 9 aa, Influenza virus
EECSCYPNA

SEQ ID NO: 338856 - protein, 9 aa, Influenza virus
ECSCYPDSG

SEQ ID NO: 338857 - protein, 9 aa, Influenza virus
CSCYPDSGE

SEQ ID NO: 338858 - protein, 9 aa, Influenza virus
MCVCRDNWH

SEQ ID NO: 338859 - protein, 9 aa, Influenza virus
WHGSNRPWL

SEQ ID NO: 338860 - protein, 9 aa, Influenza virus
HGSNRPWLS

SEQ ID NO: 338861 - protein, 9 aa, Influenza virus
GSNRPWLSF

SEQ ID NO: 338862 - protein, 9 aa, Influenza virus
SNRPWLSFN

SEQ ID NO: 338863 - protein, 9 aa, Influenza virus
NRPWLSFNQ

SEQ ID NO: 338864 - protein, 9 aa, Influenza virus
YKIGYICSG

SEQ ID NO: 338865 - protein, 9 aa, Influenza virus
IGYICSGFF

SEQ ID NO: 338866 - protein, 9 aa, Influenza virus
GYICSGFFG

SEQ ID NO: 338867 - protein, 9 aa, Influenza virus
YICSGFFGD

SEQ ID NO: 338868 - protein, 9 aa, Influenza virus
ICSGVFGDT

SEQ ID NO: 338869 - protein, 9 aa, Influenza virus
CSGVFGDTP

SEQ ID NO: 338870 - protein, 9 aa, Influenza virus
SGVFGDTPR

SEQ ID NO: 338871 - protein, 9 aa, Influenza virus
GVFGDTPRP

SEQ ID NO: 338872 - protein, 9 aa, Influenza virus
FGDSPRPND

SEQ ID NO: 338873 - protein, 9 aa, Influenza virus
GDSPRPNDG

SEQ ID NO: 338874 - protein, 9 aa, Influenza virus
GVKGFAFKY

SEQ ID NO: 338875 - protein, 9 aa, Influenza virus
VKGFAFKYG

SEQ ID NO: 338876 - protein, 9 aa, Influenza virus
KGFAFKYGN

SEQ ID NO: 338877 - protein, 9 aa, Influenza virus
GFAFKYGNG

SEQ ID NO: 338878 - protein, 9 aa, Influenza virus
FKYGDGVWI

SEQ ID NO: 338879 - protein, 9 aa, Influenza virus
KYGNGAWIG

SEQ ID NO: 338880 - protein, 9 aa, Influenza virus
YGDGVWIGR

SEQ ID NO: 338881 - protein, 9 aa, Influenza virus
GDGVWIGRT

SEQ ID NO: 338882 - protein, 9 aa, Influenza virus
VWIGRTKSI

SEQ ID NO: 338883 - protein, 9 aa, Influenza virus
SRSGFEIIW

SEQ ID NO: 338884 - protein, 9 aa, Influenza virus
RSGFEIIWD

SEQ ID NO: 338885 - protein, 9 aa, Influenza virus
SGFEIIWDP

SEQ ID NO: 338886 - protein, 9 aa, Influenza virus
GFEMIWDPD

SEQ ID NO: 338887 - protein, 9 aa, Influenza virus
FEMIWDPDG

SEQ ID NO: 338888 - protein, 9 aa, Influenza virus
EMIWDPDGW

SEQ ID NO: 338889 - protein, 9 aa, Influenza virus
TTDWSGYSG

SEQ ID NO: 338890 - protein, 9 aa, Influenza virus
GSFVQHPEM

SEQ ID NO: 338891 - protein, 9 aa, Influenza virus
SFVQHPEMT

SEQ ID NO: 338892 - protein, 9 aa, Influenza virus
FVQHPEMTG

SEQ ID NO: 338893 - protein, 9 aa, Influenza virus
VQHPEMTGL

SEQ ID NO: 338894 - protein, 9 aa, Influenza virus
QHPEMTGLD

SEQ ID NO: 338895 - protein, 9 aa, Influenza virus
HPEMTGLDC

SEQ ID NO: 338896 - protein, 9 aa, Influenza virus
TGLNCIRPC

SEQ ID NO: 338897 - protein, 9 aa, Influenza virus
NCIRPCFWV

SEQ ID NO: 338898 - protein, 9 aa, Influenza virus
CIKPCFWVE

SEQ ID NO: 338899 - protein, 9 aa, Influenza virus
IKPCFWVEL

SEQ ID NO: 338900 - protein, 9 aa, Influenza virus
KPCFWVELI

SEQ ID NO: 338901 - protein, 9 aa, Influenza virus
FWVELVRGR

SEQ ID NO: 338902 - protein, 9 aa, Influenza virus
WVELVRGRP

SEQ ID NO: 338903 - protein, 9 aa, Influenza virus
VELVRGRPK

SEQ ID NO: 338904 - protein, 9 aa, Influenza virus
ELVRGRPKE

SEQ ID NO: 338905 - protein, 9 aa, Influenza virus
TVWTSGSII

SEQ ID NO: 338906 - protein, 9 aa, Influenza virus
VWTSGSIIS

SEQ ID NO: 338907 - protein, 9 aa, Influenza virus
WASGSSISF

SEQ ID NO: 338908 - protein, 9 aa, Influenza virus
ASGSSISFC

SEQ ID NO: 338909 - protein, 9 aa, Influenza virus
SSISFCGVD

SEQ ID NO: 338910 - protein, 9 aa, Influenza virus
GWSWPDDAE

SEQ ID NO: 338911 - protein, 9 aa, Influenza virus
WPDGAELPS

SEQ ID NO: 338912 - protein, 9 aa, Influenza virus
GDRICIGYH

SEQ ID NO: 338913 - protein, 9 aa, Influenza virus
DRICVGYHA

SEQ ID NO: 338914 - protein, 9 aa, Influenza virus
QICIGHHAN

SEQ ID NO: 338915 - protein, 9 aa, Influenza virus
IGHHANNST

SEQ ID NO: 338916 - protein, 9 aa, Influenza virus
GHHANNSTE

SEQ ID NO: 338917 - protein, 9 aa, Influenza virus
YHANNSKKQ

SEQ ID NO: 338918 - protein, 9 aa, Influenza virus
HANNSTKQI

SEQ ID NO: 338919 - protein, 9 aa, Influenza virus
ANNSTKQID

SEQ ID NO: 338920 - protein, 9 aa, Influenza virus
NNSTKQIDT

SEQ ID NO: 338921 - protein, 9 aa, Influenza virus
NSTKQIDTI

SEQ ID NO: 338922 - protein, 9 aa, Influenza virus
KQIDTIMEK

SEQ ID NO: 338923 - protein, 9 aa, Influenza virus
QVDTIMERN

SEQ ID NO: 338924 - protein, 9 aa, Influenza virus
VDTIMERNV

SEQ ID NO: 338925 - protein, 9 aa, Influenza virus
DTIMEKNVI

SEQ ID NO: 338926 - protein, 9 aa, Influenza virus
TIVEKNVTV

SEQ ID NO: 338927 - protein, 9 aa, Influenza virus
IREKNVTVT

SEQ ID NO: 338928 - protein, 9 aa, Influenza virus
EKNVTVTRA

SEQ ID NO: 338929 - protein, 9 aa, Influenza virus
KSVTVSHAQ

SEQ ID NO: 338930 - protein, 9 aa, Influenza virus
IVTVTHAQD

SEQ ID NO: 338931 - protein, 9 aa, Influenza virus
AGWLIGNPK

SEQ ID NO: 338932 - protein, 9 aa, Influenza virus
GLVLGNPMC

SEQ ID NO: 338933 - protein, 9 aa, Influenza virus
TPEWSYIVE

SEQ ID NO: 338934 - protein, 9 aa, Influenza virus
EWSYIVEKA

SEQ ID NO: 338935 - protein, 9 aa, Influenza virus
WSYIVEKNN

SEQ ID NO: 338936 - protein, 9 aa, Influenza virus
SYIVEKNNP

SEQ ID NO: 338937 - protein, 9 aa, Influenza virus
PSFFRNVVW

SEQ ID NO: 338938 - protein, 9 aa, Influenza virus
SFFRNIVWL

SEQ ID NO: 338939 - protein, 9 aa, Influenza virus
FFRNVVWLV

SEQ ID NO: 338940 - protein, 9 aa, Influenza virus
FRNVVWLVK

SEQ ID NO: 338941 - protein, 9 aa, Influenza virus
RNVVWLVKK

SEQ ID NO: 338942 - protein, 9 aa, Influenza virus
GTSTLNKRS

SEQ ID NO: 338943 - protein, 9 aa, Influenza virus
IATRPRVNG

SEQ ID NO: 338944 - protein, 9 aa, Influenza virus
ATRPRVNGQ

SEQ ID NO: 338945 - protein, 9 aa, Influenza virus
RPRVNGQSG

SEQ ID NO: 338946 - protein, 9 aa, Influenza virus
FIAPEYAFK

SEQ ID NO: 338947 - protein, 9 aa, Influenza virus
IAPEYAFKI

SEQ ID NO: 338948 - protein, 9 aa, Influenza virus
PEYAYKIAK

SEQ ID NO: 338949 - protein, 9 aa, Influenza virus
YGNCNAKCQ

SEQ ID NO: 338950 - protein, 9 aa, Influenza virus
GNCNAKCQT

SEQ ID NO: 338951 - protein, 9 aa, Influenza virus
NCNAKCQTP

SEQ ID NO: 338952 - protein, 9 aa, Influenza virus
KTRGLFGAI

SEQ ID NO: 338953 - protein, 9 aa, Influenza virus
IEGGWQGLV

SEQ ID NO: 338954 - protein, 9 aa, Influenza virus
EGGWQGLVD

SEQ ID NO: 338955 - protein, 9 aa, Influenza virus
GGWQGLVDG

SEQ ID NO: 338956 - protein, 9 aa, Influenza virus
GWQGLVDGW

SEQ ID NO: 338957 - protein, 9 aa, Influenza virus
WQGLVDGWY

SEQ ID NO: 338958 - protein, 9 aa, Influenza virus
QGLVDGWYG

SEQ ID NO: 338959 - protein, 9 aa, Influenza virus
GLVDGWYGY

SEQ ID NO: 338960 - protein, 9 aa, Influenza virus
LVDGWYGYH

SEQ ID NO: 338961 - protein, 9 aa, Influenza virus
DGWYGYHHT

SEQ ID NO: 338962 - protein, 9 aa, Influenza virus
GWYGYHHTN

SEQ ID NO: 338963 - protein, 9 aa, Influenza virus
NDQGSGYAA

SEQ ID NO: 338964 - protein, 9 aa, Influenza virus
DQGSGYAAD

SEQ ID NO: 338965 - protein, 9 aa, Influenza virus
HGSGYAADK

SEQ ID NO: 338966 - protein, 9 aa, Influenza virus
GSGYAADRK

SEQ ID NO: 338967 - protein, 9 aa, Influenza virus
SGYAADRKS

SEQ ID NO: 338968 - protein, 9 aa, Influenza virus
GYAADRKST

SEQ ID NO: 338969 - protein, 9 aa, Influenza virus
YAADRKSTQ

SEQ ID NO: 338970 - protein, 9 aa, Influenza virus
AADKESTQR

SEQ ID NO: 338971 - protein, 9 aa, Influenza virus
ADKESTQRA

SEQ ID NO: 338972 - protein, 9 aa, Influenza virus
KSTQKAIDG

SEQ ID NO: 338973 - protein, 9 aa, Influenza virus
STQRAIDGI

SEQ ID NO: 338974 - protein, 9 aa, Influenza virus
TQRAIDGIT

SEQ ID NO: 338975 - protein, 9 aa, Influenza virus
VWTYNAELF

SEQ ID NO: 338976 - protein, 9 aa, Influenza virus
WTYNAELFV

SEQ ID NO: 338977 - protein, 9 aa, Influenza virus
TYNAELFVL

SEQ ID NO: 338978 - protein, 9 aa, Influenza virus
YNTELLVLM

SEQ ID NO: 338979 - protein, 9 aa, Influenza virus
NAELLVLIE

SEQ ID NO: 338980 - protein, 9 aa, Influenza virus
AELLVLIEN

SEQ ID NO: 338981 - protein, 9 aa, Influenza virus
ELFVLMENE

SEQ ID NO: 338982 - protein, 9 aa, Influenza virus
LLVLIENER

SEQ ID NO: 338983 - protein, 9 aa, Influenza virus
LVLIENERT

SEQ ID NO: 338984 - protein, 9 aa, Influenza virus
LIENERTLD

SEQ ID NO: 338985 - protein, 9 aa, Influenza virus
MENERTLYF

SEQ ID NO: 338986 - protein, 9 aa, Influenza virus
ENERTLYFH

SEQ ID NO: 338987 - protein, 9 aa, Influenza virus
NERTLYFHD

SEQ ID NO: 338988 - protein, 9 aa, Influenza virus
ERTLYFHDS

SEQ ID NO: 338989 - protein, 9 aa, Influenza virus
RTLYFHDSN

SEQ ID NO: 338990 - protein, 9 aa, Influenza virus
TLYFHDSNV

SEQ ID NO: 338991 - protein, 9 aa, Influenza virus
LDFHDSNVR

SEQ ID NO: 338992 - protein, 9 aa, Influenza virus
DFHDSNVRN

SEQ ID NO: 338993 - protein, 9 aa, Influenza virus
FHDSNVRNL

SEQ ID NO: 338994 - protein, 9 aa, Influenza virus
DSNVKNLYN

SEQ ID NO: 338995 - protein, 9 aa, Influenza virus
SNVKNLYNK

SEQ ID NO: 338996 - protein, 9 aa, Influenza virus
NVKNLYNKV

SEQ ID NO: 338997 - protein, 9 aa, Influenza virus
VKNLYNKVR

SEQ ID NO: 338998 - protein, 9 aa, Influenza virus
NLYDKVRHQ

SEQ ID NO: 338999 - protein, 9 aa, Influenza virus
LYDKVRHQL

SEQ ID NO: 339000 - protein, 9 aa, Influenza virus
VRHQLRDNA

SEQ ID NO: 339001 - protein, 9 aa, Influenza virus
DNAKEMGNG

SEQ ID NO: 339002 - protein, 9 aa, Influenza virus
NAKEMGNGC

SEQ ID NO: 339003 - protein, 9 aa, Influenza virus
AKEMGNGCF

SEQ ID NO: 339004 - protein, 9 aa, Influenza virus
KEMGNGCFE

SEQ ID NO: 339005 - protein, 9 aa, Influenza virus
EWGNGCFEF

SEQ ID NO: 339006 - protein, 9 aa, Influenza virus
WGNGCFEFY

SEQ ID NO: 339007 - protein, 9 aa, Influenza virus
CFEFYHKCN

SEQ ID NO: 339008 - protein, 9 aa, Influenza virus
FEFYHRCDN

SEQ ID NO: 339009 - protein, 9 aa, Influenza virus
KCMESVRNG

SEQ ID NO: 339010 - protein, 9 aa, Influenza virus
CIESVRNGT

SEQ ID NO: 339011 - protein, 9 aa, Influenza virus
IESVRNGTY

SEQ ID NO: 339012 - protein, 9 aa, Influenza virus
ESVKNGTYD

SEQ ID NO: 339013 - protein, 9 aa, Influenza virus
SVKNGTYDY

SEQ ID NO: 339014 - protein, 9 aa, Influenza virus
ILSIYSSVA

SEQ ID NO: 339015 - protein, 9 aa, Influenza virus
LSIYSSVAS

SEQ ID NO: 339016 - protein, 9 aa, Influenza virus
SIYSSVASS

SEQ ID NO: 339017 - protein, 9 aa, Influenza virus
IYSSVASSL

SEQ ID NO: 339018 - protein, 9 aa, Influenza virus
VASSLVLAI

SEQ ID NO: 339019 - protein, 9 aa, Influenza virus
LAIMMAGLS

SEQ ID NO: 339020 - protein, 9 aa, Influenza virus
AIMMAGLSF

SEQ ID NO: 339021 - protein, 9 aa, Influenza virus
IMMAGLSFW

SEQ ID NO: 339022 - protein, 9 aa, Influenza virus
MAGLSFWMC

SEQ ID NO: 339023 - protein, 9 aa, Influenza virus
SLCMCSNGS

SEQ ID NO: 339024 - protein, 9 aa, Influenza virus
LCMCSNGSL

SEQ ID NO: 339025 - protein, 9 aa, Influenza virus
SNGSLQCTI

SEQ ID NO: 339026 - protein, 9 aa, Influenza virus
NGSLQCRVC

SEQ ID NO: 339027 - protein, 9 aa, Influenza virus
GSLQCRVCI

SEQ ID NO: 339028 - protein, 9 aa, Influenza virus
IITIGSASL

SEQ ID NO: 339029 - protein, 9 aa, Influenza virus
YWNWSKPQC

SEQ ID NO: 339030 - protein, 9 aa, Influenza virus
KPQCQIAGF

SEQ ID NO: 339031 - protein, 9 aa, Influenza virus
PQCQIAGFA

SEQ ID NO: 339032 - protein, 9 aa, Influenza virus
QCQIAGFAP

SEQ ID NO: 339033 - protein, 9 aa, Influenza virus
CQIAGFAPF

SEQ ID NO: 339034 - protein, 9 aa, Influenza virus
IAGFAPFSK

SEQ ID NO: 339035 - protein, 9 aa, Influenza virus
RLSAGGSIW

SEQ ID NO: 339036 - protein, 9 aa, Influenza virus
TREPYVSCG

SEQ ID NO: 339037 - protein, 9 aa, Influenza virus
ALGQGTTLK

SEQ ID NO: 339038 - protein, 9 aa, Influenza virus
LGQGTTLDH

SEQ ID NO: 339039 - protein, 9 aa, Influenza virus
RHSNGTIHD

SEQ ID NO: 339040 - protein, 9 aa, Influenza virus
SNGTIHDRS

SEQ ID NO: 339041 - protein, 9 aa, Influenza virus
SYRTLLMNE

SEQ ID NO: 339042 - protein, 9 aa, Influenza virus
YRTLLMNEL

SEQ ID NO: 339043 - protein, 9 aa, Influenza virus
TLLMNELGI

SEQ ID NO: 339044 - protein, 9 aa, Influenza virus
LLMNELGIP

SEQ ID NO: 339045 - protein, 9 aa, Influenza virus
LMNELGIPF

SEQ ID NO: 339046 - protein, 9 aa, Influenza virus
MNELGIPFH

SEQ ID NO: 339047 - protein, 9 aa, Influenza virus
NELGIPFHL

SEQ ID NO: 339048 - protein, 9 aa, Influenza virus
GIPFHLGTK

SEQ ID NO: 339049 - protein, 9 aa, Influenza virus
IPFHLGTKQ

SEQ ID NO: 339050 - protein, 9 aa, Influenza virus
HLGTKQVCM

SEQ ID NO: 339051 - protein, 9 aa, Influenza virus
LGTKQVCMA

SEQ ID NO: 339052 - protein, 9 aa, Influenza virus
GTKQVCMAW

SEQ ID NO: 339053 - protein, 9 aa, Influenza virus
TKQVCMAWS

SEQ ID NO: 339054 - protein, 9 aa, Influenza virus
KQVCMAWSS

SEQ ID NO: 339055 - protein, 9 aa, Influenza virus
QVCVAWSSS

SEQ ID NO: 339056 - protein, 9 aa, Influenza virus
VCVAWSSSS

SEQ ID NO: 339057 - protein, 9 aa, Influenza virus
CVAWSSSSC

SEQ ID NO: 339058 - protein, 9 aa, Influenza virus
VAWSSSSCH

SEQ ID NO: 339059 - protein, 9 aa, Influenza virus
AWSSSSCYD

SEQ ID NO: 339060 - protein, 9 aa, Influenza virus
SSSSCHDGN

SEQ ID NO: 339061 - protein, 9 aa, Influenza virus
SSSCHDGNA

SEQ ID NO: 339062 - protein, 9 aa, Influenza virus
SSCHDGNAW

SEQ ID NO: 339063 - protein, 9 aa, Influenza virus
SCHDGNAWL

SEQ ID NO: 339064 - protein, 9 aa, Influenza virus
CHDGNAWLH

SEQ ID NO: 339065 - protein, 9 aa, Influenza virus
HDGNAWLHV

SEQ ID NO: 339066 - protein, 9 aa, Influenza virus
DGNAWLHVC

SEQ ID NO: 339067 - protein, 9 aa, Influenza virus
GNAWLHVCV

SEQ ID NO: 339068 - protein, 9 aa, Influenza virus
AWLHVCITG

SEQ ID NO: 339069 - protein, 9 aa, Influenza virus
WLHVCITGD

SEQ ID NO: 339070 - protein, 9 aa, Influenza virus
LHVCITGDD

SEQ ID NO: 339071 - protein, 9 aa, Influenza virus
TGDDGNATA

SEQ ID NO: 339072 - protein, 9 aa, Influenza virus
GDDGNATAS

SEQ ID NO: 339073 - protein, 9 aa, Influenza virus
SWSQNILKK

SEQ ID NO: 339074 - protein, 9 aa, Influenza virus
CSQNILRTQ

SEQ ID NO: 339075 - protein, 9 aa, Influenza virus
TQESECVCV

SEQ ID NO: 339076 - protein, 9 aa, Influenza virus
QESECVCID

SEQ ID NO: 339077 - protein, 9 aa, Influenza virus
CTVIMTDGS

SEQ ID NO: 339078 - protein, 9 aa, Influenza virus
TVIMTDGSA

SEQ ID NO: 339079 - protein, 9 aa, Influenza virus
VIMTDGSAS

SEQ ID NO: 339080 - protein, 9 aa, Influenza virus
VMTDGNASG

SEQ ID NO: 339081 - protein, 9 aa, Influenza virus
TDGNASGRA

SEQ ID NO: 339082 - protein, 9 aa, Influenza virus
SSLSGSAQH

SEQ ID NO: 339083 - protein, 9 aa, Influenza virus
PLSGSAQHV

SEQ ID NO: 339084 - protein, 9 aa, Influenza virus
LSGSAQHVE

SEQ ID NO: 339085 - protein, 9 aa, Influenza virus
GSAQATEEC

SEQ ID NO: 339086 - protein, 9 aa, Influenza virus
GAQHIEECS

SEQ ID NO: 339087 - protein, 9 aa, Influenza virus
VRCICRDNW

SEQ ID NO: 339088 - protein, 9 aa, Influenza virus
RCVCRDNWM

SEQ ID NO: 339089 - protein, 9 aa, Influenza virus
CVCRDNWMG

SEQ ID NO: 339090 - protein, 9 aa, Influenza virus
VCRDNWMGS

SEQ ID NO: 339091 - protein, 9 aa, Influenza virus
NWMGSNRPV

SEQ ID NO: 339092 - protein, 9 aa, Influenza virus
SRYICSGLV

SEQ ID NO: 339093 - protein, 9 aa, Influenza virus
RYICSGLVG

SEQ ID NO: 339094 - protein, 9 aa, Influenza virus
GDTPRNNDS

SEQ ID NO: 339095 - protein, 9 aa, Influenza virus
SNSNCRDPN

SEQ ID NO: 339096 - protein, 9 aa, Influenza virus
NSNCRDPNN

SEQ ID NO: 339097 - protein, 9 aa, Influenza virus
SNCRDSNNE

SEQ ID NO: 339098 - protein, 9 aa, Influenza virus
NCRDPNNEK

SEQ ID NO: 339099 - protein, 9 aa, Influenza virus
GSQGVKGWA

SEQ ID NO: 339100 - protein, 9 aa, Influenza virus
SQGVKGWAF

SEQ ID NO: 339101 - protein, 9 aa, Influenza virus
GVKGWAFDD

SEQ ID NO: 339102 - protein, 9 aa, Influenza virus
DVWMGRTVS

SEQ ID NO: 339103 - protein, 9 aa, Influenza virus
GRTVSKDSR

SEQ ID NO: 339104 - protein, 9 aa, Influenza virus
SRDSRSGYE

SEQ ID NO: 339105 - protein, 9 aa, Influenza virus
EDSRSGYET

SEQ ID NO: 339106 - protein, 9 aa, Influenza virus
SGYETFRVT

SEQ ID NO: 339107 - protein, 9 aa, Influenza virus
NRSGYSGIF

SEQ ID NO: 339108 - protein, 9 aa, Influenza virus
RSGYSGIFS

SEQ ID NO: 339109 - protein, 9 aa, Influenza virus
SGYSGIFSI

SEQ ID NO: 339110 - protein, 9 aa, Influenza virus
GYSGIFSIE

SEQ ID NO: 339111 - protein, 9 aa, Influenza virus
GCINRCFYV

SEQ ID NO: 339112 - protein, 9 aa, Influenza virus
LELIRGRPQ

SEQ ID NO: 339113 - protein, 9 aa, Influenza virus
WWTSNSIIV

SEQ ID NO: 339114 - protein, 9 aa, Influenza virus
WTTNSIVVF

SEQ ID NO: 339115 - protein, 9 aa, Influenza virus
TTNSIVVFC

SEQ ID NO: 339116 - protein, 9 aa, Influenza virus
TNSIVVFCG

SEQ ID NO: 339117 - protein, 9 aa, Influenza virus
WPDGADINF

SEQ ID NO: 339118 - protein, 9 aa, Influenza virus
PDGADINFM

SEQ ID NO: 339119 - protein, 9 aa, Influenza virus
DGANINFMA

SEQ ID NO: 339120 - protein, 9 aa, Influenza virus
SKSDRICIG

SEQ ID NO: 339121 - protein, 9 aa, Influenza virus
KSDRICIGY

SEQ ID NO: 339122 - protein, 9 aa, Influenza virus
SHKICIGYH

SEQ ID NO: 339123 - protein, 9 aa, Influenza virus
HKICIGYHA

SEQ ID NO: 339124 - protein, 9 aa, Influenza virus
HANNSTTQI

SEQ ID NO: 339125 - protein, 9 aa, Influenza virus
ANNSTTQVN

SEQ ID NO: 339126 - protein, 9 aa, Influenza virus
NNSTTQVNT

SEQ ID NO: 339127 - protein, 9 aa, Influenza virus
NSTTQVDTL

SEQ ID NO: 339128 - protein, 9 aa, Influenza virus
VDTILERNV

SEQ ID NO: 339129 - protein, 9 aa, Influenza virus
DTILERNVT

SEQ ID NO: 339130 - protein, 9 aa, Influenza virus
TILERNVTV

SEQ ID NO: 339131 - protein, 9 aa, Influenza virus
ILERNVTVT

SEQ ID NO: 339132 - protein, 9 aa, Influenza virus
LEKNITVTH

SEQ ID NO: 339133 - protein, 9 aa, Influenza virus
EKNITVTHS

SEQ ID NO: 339134 - protein, 9 aa, Influenza virus
RNVTVTHSV

SEQ ID NO: 339135 - protein, 9 aa, Influenza virus
NITVTHSVE

SEQ ID NO: 339136 - protein, 9 aa, Influenza virus
ITVTHSVEL

SEQ ID NO: 339137 - protein, 9 aa, Influenza virus
THSIELLEN

SEQ ID NO: 339138 - protein, 9 aa, Influenza virus
DGWILGNPQ

SEQ ID NO: 339139 - protein, 9 aa, Influenza virus
GWILGNPKC

SEQ ID NO: 339140 - protein, 9 aa, Influenza virus
WILGNPRCG

SEQ ID NO: 339141 - protein, 9 aa, Influenza virus
QSWSYVVER

SEQ ID NO: 339142 - protein, 9 aa, Influenza virus
SWSYIVERL

SEQ ID NO: 339143 - protein, 9 aa, Influenza virus
ARNGICYPG

SEQ ID NO: 339144 - protein, 9 aa, Influenza virus
SSFYRNLVW

SEQ ID NO: 339145 - protein, 9 aa, Influenza virus
SFYRNLLWM

SEQ ID NO: 339146 - protein, 9 aa, Influenza virus
SVLYFWGIH

SEQ ID NO: 339147 - protein, 9 aa, Influenza virus
VLYFWGIHH

SEQ ID NO: 339148 - protein, 9 aa, Influenza virus
KGRIDYYWS

SEQ ID NO: 339149 - protein, 9 aa, Influenza virus
RIDYYWSIL

SEQ ID NO: 339150 - protein, 9 aa, Influenza virus
WSVLRPGET

SEQ ID NO: 339151 - protein, 9 aa, Influenza virus
SVLRPGETL

SEQ ID NO: 339152 - protein, 9 aa, Influenza virus
VLRPGETLN

SEQ ID NO: 339153 - protein, 9 aa, Influenza virus
LKPGETLKV

SEQ ID NO: 339154 - protein, 9 aa, Influenza virus
KPGETLKVE

SEQ ID NO: 339155 - protein, 9 aa, Influenza virus
PGETLNIES

SEQ ID NO: 339156 - protein, 9 aa, Influenza virus
GETLNIESN

SEQ ID NO: 339157 - protein, 9 aa, Influenza virus
ETLNIESNG

SEQ ID NO: 339158 - protein, 9 aa, Influenza virus
TLNIESNGN

SEQ ID NO: 339159 - protein, 9 aa, Influenza virus
LNIESNGNL

SEQ ID NO: 339160 - protein, 9 aa, Influenza virus
KVESNGNLI

SEQ ID NO: 339161 - protein, 9 aa, Influenza virus
IESNGNLIA

SEQ ID NO: 339162 - protein, 9 aa, Influenza virus
NLIAPWYAF

SEQ ID NO: 339163 - protein, 9 aa, Influenza virus
LVAPWYAYK

SEQ ID NO: 339164 - protein, 9 aa, Influenza virus
TNRTFQNVS

SEQ ID NO: 339165 - protein, 9 aa, Influenza virus
NRTFQNVSP

SEQ ID NO: 339166 - protein, 9 aa, Influenza virus
KTFQNVSPV

SEQ ID NO: 339167 - protein, 9 aa, Influenza virus
TFQNVSPVW

SEQ ID NO: 339168 - protein, 9 aa, Influenza virus
FQNVSPVWI

SEQ ID NO: 339169 - protein, 9 aa, Influenza virus
QNVSPVWIG

SEQ ID NO: 339170 - protein, 9 aa, Influenza virus
WIGGCPKYV

SEQ ID NO: 339171 - protein, 9 aa, Influenza virus
GECPKYVRS

SEQ ID NO: 339172 - protein, 9 aa, Influenza virus
NLKLATGLR

SEQ ID NO: 339173 - protein, 9 aa, Influenza virus
RLATGLRNI

SEQ ID NO: 339174 - protein, 9 aa, Influenza virus
ATGLRNVPK

SEQ ID NO: 339175 - protein, 9 aa, Influenza virus
NRGLFGAIA

SEQ ID NO: 339176 - protein, 9 aa, Influenza virus
IEGGWTGLI

SEQ ID NO: 339177 - protein, 9 aa, Influenza virus
EGGWTGLID

SEQ ID NO: 339178 - protein, 9 aa, Influenza virus
GGWTGLIDG

SEQ ID NO: 339179 - protein, 9 aa, Influenza virus
GWTGLIDGW

SEQ ID NO: 339180 - protein, 9 aa, Influenza virus
WTGLIDGWY

SEQ ID NO: 339181 - protein, 9 aa, Influenza virus
TGLIDGWYG

SEQ ID NO: 339182 - protein, 9 aa, Influenza virus
GLIDGWYGY

SEQ ID NO: 339183 - protein, 9 aa, Influenza virus
LIDGWYGYH

SEQ ID NO: 339184 - protein, 9 aa, Influenza virus
AADRESTQR

SEQ ID NO: 339185 - protein, 9 aa, Influenza virus
ADRESTQRA

SEQ ID NO: 339186 - protein, 9 aa, Influenza virus
ITNKANSII

SEQ ID NO: 339187 - protein, 9 aa, Influenza virus
NSIIEKMNT

SEQ ID NO: 339188 - protein, 9 aa, Influenza virus
IIEKMNTQF

SEQ ID NO: 339189 - protein, 9 aa, Influenza virus
KVNTQFEAV

SEQ ID NO: 339190 - protein, 9 aa, Influenza virus
HEFSNLEKR

SEQ ID NO: 339191 - protein, 9 aa, Influenza virus
EFSNLEKRI

SEQ ID NO: 339192 - protein, 9 aa, Influenza virus
NMNKRMEDG

SEQ ID NO: 339193 - protein, 9 aa, Influenza virus
MNKRMEDGF

SEQ ID NO: 339194 - protein, 9 aa, Influenza virus
NKRMQDGFM

SEQ ID NO: 339195 - protein, 9 aa, Influenza virus
DGFMDVWTY

SEQ ID NO: 339196 - protein, 9 aa, Influenza virus
GFMDVWTYN

SEQ ID NO: 339197 - protein, 9 aa, Influenza virus
FMDVWTYNA

SEQ ID NO: 339198 - protein, 9 aa, Influenza virus
MDVWTYNAE

SEQ ID NO: 339199 - protein, 9 aa, Influenza virus
GVWTYNAEL

SEQ ID NO: 339200 - protein, 9 aa, Influenza virus
AELLVLLED

SEQ ID NO: 339201 - protein, 9 aa, Influenza virus
ELLVLLENG

SEQ ID NO: 339202 - protein, 9 aa, Influenza virus
LLVLLENGR

SEQ ID NO: 339203 - protein, 9 aa, Influenza virus
LVLLENGRT

SEQ ID NO: 339204 - protein, 9 aa, Influenza virus
VLLENGRTL

SEQ ID NO: 339205 - protein, 9 aa, Influenza virus
LLEDERTLD

SEQ ID NO: 339206 - protein, 9 aa, Influenza virus
ENGRTLDMH

SEQ ID NO: 339207 - protein, 9 aa, Influenza virus
NGRTLDMHD

SEQ ID NO: 339208 - protein, 9 aa, Influenza virus
GRTLDMHDA

SEQ ID NO: 339209 - protein, 9 aa, Influenza virus
RTLDQHDAN

SEQ ID NO: 339210 - protein, 9 aa, Influenza virus
TLDQHDANV

SEQ ID NO: 339211 - protein, 9 aa, Influenza virus
LDMHDVNVK

SEQ ID NO: 339212 - protein, 9 aa, Influenza virus
VKSQLKDNA

SEQ ID NO: 339213 - protein, 9 aa, Influenza virus
SQLKDNAKD

SEQ ID NO: 339214 - protein, 9 aa, Influenza virus
LKDNAKDLG

SEQ ID NO: 339215 - protein, 9 aa, Influenza virus
KDNAKDLGN

SEQ ID NO: 339216 - protein, 9 aa, Influenza virus
FEFWHKCNN

SEQ ID NO: 339217 - protein, 9 aa, Influenza virus
EFWHKCDND

SEQ ID NO: 339218 - protein, 9 aa, Influenza virus
FWHKCDNDC

SEQ ID NO: 339219 - protein, 9 aa, Influenza virus
SVKKGTYDY

SEQ ID NO: 339220 - protein, 9 aa, Influenza virus
KKGTYDYPK

SEQ ID NO: 339221 - protein, 9 aa, Influenza virus
KGTYDYPKY

SEQ ID NO: 339222 - protein, 9 aa, Influenza virus
GTYNYPKYH

SEQ ID NO: 339223 - protein, 9 aa, Influenza virus
FDVYQILAI

SEQ ID NO: 339224 - protein, 9 aa, Influenza virus
GIYQILAIY

SEQ ID NO: 339225 - protein, 9 aa, Influenza virus
VYQILSIYS

SEQ ID NO: 339226 - protein, 9 aa, Influenza virus
SIYSTVSSS

SEQ ID NO: 339227 - protein, 9 aa, Influenza virus
TVSSGLVLV

SEQ ID NO: 339228 - protein, 9 aa, Influenza virus
VSSGLVLVG

SEQ ID NO: 339229 - protein, 9 aa, Influenza virus
SSSLVLAGL

SEQ ID NO: 339230 - protein, 9 aa, Influenza virus
SSLVLMGLI

SEQ ID NO: 339231 - protein, 9 aa, Influenza virus
WMCLNGSMQ

SEQ ID NO: 339232 - protein, 9 aa, Influenza virus
MCLNGSMQC

SEQ ID NO: 339233 - protein, 9 aa, Influenza virus
CSNGSMQCN

SEQ ID NO: 339234 - protein, 9 aa, Influenza virus
GSMQCNVCI

SEQ ID NO: 339235 - protein, 9 aa, Influenza virus
KSRGYKMNI

SEQ ID NO: 339236 - protein, 9 aa, Influenza virus
SRGYKMNTR

SEQ ID NO: 339237 - protein, 9 aa, Influenza virus
RGYKMNTRI

SEQ ID NO: 339238 - protein, 9 aa, Influenza virus
GYKMNNQIL

SEQ ID NO: 339239 - protein, 9 aa, Influenza virus
NGTRVNTLT

SEQ ID NO: 339240 - protein, 9 aa, Influenza virus
TLTEKGIEV

SEQ ID NO: 339241 - protein, 9 aa, Influenza virus
LTEKGIEVV

SEQ ID NO: 339242 - protein, 9 aa, Influenza virus
TEKGIEVVN

SEQ ID NO: 339243 - protein, 9 aa, Influenza virus
EKGIEVVNA

SEQ ID NO: 339244 - protein, 9 aa, Influenza virus
KGIEVVNAT

SEQ ID NO: 339245 - protein, 9 aa, Influenza virus
GVEVVDATE

SEQ ID NO: 339246 - protein, 9 aa, Influenza virus
VEVVDATET

SEQ ID NO: 339247 - protein, 9 aa, Influenza virus
VNATETVEQ

SEQ ID NO: 339248 - protein, 9 aa, Influenza virus
GPPQCDRFL

SEQ ID NO: 339249 - protein, 9 aa, Influenza virus
PPQCDRFLE

SEQ ID NO: 339250 - protein, 9 aa, Influenza virus
PQCDRFLEF

SEQ ID NO: 339251 - protein, 9 aa, Influenza virus
SSFYAEMEW

SEQ ID NO: 339252 - protein, 9 aa, Influenza virus
AEMEWLLSN

SEQ ID NO: 339253 - protein, 9 aa, Influenza virus
ALIVWGIHH

SEQ ID NO: 339254 - protein, 9 aa, Influenza virus
NGQFGRINF

SEQ ID NO: 339255 - protein, 9 aa, Influenza virus
GQSGRINFH

SEQ ID NO: 339256 - protein, 9 aa, Influenza virus
QSGRINFHW

SEQ ID NO: 339257 - protein, 9 aa, Influenza virus
FSFNGAFVA

SEQ ID NO: 339258 - protein, 9 aa, Influenza virus
SFNGAFVAP

SEQ ID NO: 339259 - protein, 9 aa, Influenza virus
FNGAFVAPD

SEQ ID NO: 339260 - protein, 9 aa, Influenza virus
NGAFVAPDR

SEQ ID NO: 339261 - protein, 9 aa, Influenza virus
GAFIAPNRA

SEQ ID NO: 339262 - protein, 9 aa, Influenza virus
AFIAPNRAS

SEQ ID NO: 339263 - protein, 9 aa, Influenza virus
FIAPNRASF

SEQ ID NO: 339264 - protein, 9 aa, Influenza virus
GKCPRYVRQ

SEQ ID NO: 339265 - protein, 9 aa, Influenza virus
SLMLATGMK

SEQ ID NO: 339266 - protein, 9 aa, Influenza virus
LMLATGMKN

SEQ ID NO: 339267 - protein, 9 aa, Influenza virus
MLATGMKNV

SEQ ID NO: 339268 - protein, 9 aa, Influenza virus
LATGMRNIP

SEQ ID NO: 339269 - protein, 9 aa, Influenza virus
ATGMRNIPE

SEQ ID NO: 339270 - protein, 9 aa, Influenza virus
IHKQLTHHM

SEQ ID NO: 339271 - protein, 9 aa, Influenza virus
RKTRGLFGA

SEQ ID NO: 339272 - protein, 9 aa, Influenza virus
KTRGLFGAI

SEQ ID NO: 339273 - protein, 9 aa, Influenza virus
KRGLFGAIA

SEQ ID NO: 339274 - protein, 9 aa, Influenza virus
ENGWEGLVD

SEQ ID NO: 339275 - protein, 9 aa, Influenza virus
NGWEGLVDG

SEQ ID NO: 339276 - protein, 9 aa, Influenza virus
GWEGLVDGW

SEQ ID NO: 339277 - protein, 9 aa, Influenza virus
WEGLVDGWY

SEQ ID NO: 339278 - protein, 9 aa, Influenza virus
EGLVDGWYG

SEQ ID NO: 339279 - protein, 9 aa, Influenza virus
GLVDGWYGF

SEQ ID NO: 339280 - protein, 9 aa, Influenza virus
LVDGWYGFR

SEQ ID NO: 339281 - protein, 9 aa, Influenza virus
VDGWYGFRH

SEQ ID NO: 339282 - protein, 9 aa, Influenza virus
DGWYGYRHQ

SEQ ID NO: 339283 - protein, 9 aa, Influenza virus
GWYGFKHQN

SEQ ID NO: 339284 - protein, 9 aa, Influenza virus
WYGFRHQNS

SEQ ID NO: 339285 - protein, 9 aa, Influenza virus
YGFRHQNSQ

SEQ ID NO: 339286 - protein, 9 aa, Influenza virus
GFRHQNSQG

SEQ ID NO: 339287 - protein, 9 aa, Influenza virus
FRHQNSQGE

SEQ ID NO: 339288 - protein, 9 aa, Influenza virus
RHQNSQGEG

SEQ ID NO: 339289 - protein, 9 aa, Influenza virus
HQNSQGEGT

SEQ ID NO: 339290 - protein, 9 aa, Influenza virus
QNSQGEGTA

SEQ ID NO: 339291 - protein, 9 aa, Influenza virus
NSQGEGTAA

SEQ ID NO: 339292 - protein, 9 aa, Influenza virus
SQGEGTAAD

SEQ ID NO: 339293 - protein, 9 aa, Influenza virus
YKSTQSAVD

SEQ ID NO: 339294 - protein, 9 aa, Influenza virus
KSTQSAVDQ

SEQ ID NO: 339295 - protein, 9 aa, Influenza virus
STQSAINQI

SEQ ID NO: 339296 - protein, 9 aa, Influenza virus
TQSAINQIT

SEQ ID NO: 339297 - protein, 9 aa, Influenza virus
QSAINQITG

SEQ ID NO: 339298 - protein, 9 aa, Influenza virus
SAINQITGK

SEQ ID NO: 339299 - protein, 9 aa, Influenza virus
AINQITGKL

SEQ ID NO: 339300 - protein, 9 aa, Influenza virus
INQITGKLN

SEQ ID NO: 339301 - protein, 9 aa, Influenza virus
NQITGKLNR

SEQ ID NO: 339302 - protein, 9 aa, Influenza virus
QITGKLNRI

SEQ ID NO: 339303 - protein, 9 aa, Influenza virus
ITGKLNRII

SEQ ID NO: 339304 - protein, 9 aa, Influenza virus
KTNQQFKLI

SEQ ID NO: 339305 - protein, 9 aa, Influenza virus
ERQIGNVIN

SEQ ID NO: 339306 - protein, 9 aa, Influenza virus
RQIGNVINW

SEQ ID NO: 339307 - protein, 9 aa, Influenza virus
LGNVINWTR

SEQ ID NO: 339308 - protein, 9 aa, Influenza virus
NVINWTQDA

SEQ ID NO: 339309 - protein, 9 aa, Influenza virus
WSYNAELLI

SEQ ID NO: 339310 - protein, 9 aa, Influenza virus
SYNAELLIA

SEQ ID NO: 339311 - protein, 9 aa, Influenza virus
AELLIAMEN

SEQ ID NO: 339312 - protein, 9 aa, Influenza virus
ELLIAMENQ

SEQ ID NO: 339313 - protein, 9 aa, Influenza virus
LLIAMENQH

SEQ ID NO: 339314 - protein, 9 aa, Influenza virus
LIAMENQHT

SEQ ID NO: 339315 - protein, 9 aa, Influenza virus
IAMENQHTI

SEQ ID NO: 339316 - protein, 9 aa, Influenza virus
ALENQHTID

SEQ ID NO: 339317 - protein, 9 aa, Influenza virus
LENQHTIDL

SEQ ID NO: 339318 - protein, 9 aa, Influenza virus
QHIIDLADS

SEQ ID NO: 339319 - protein, 9 aa, Influenza virus
HIIDLADSE

SEQ ID NO: 339320 - protein, 9 aa, Influenza virus
IIDLADSEM

SEQ ID NO: 339321 - protein, 9 aa, Influenza virus
SEMNKLYEK

SEQ ID NO: 339322 - protein, 9 aa, Influenza virus
EMNKLYEKV

SEQ ID NO: 339323 - protein, 9 aa, Influenza virus
VRRQLRENA

SEQ ID NO: 339324 - protein, 9 aa, Influenza virus
RRQLRENAE

SEQ ID NO: 339325 - protein, 9 aa, Influenza virus
RLLRENAEE

SEQ ID NO: 339326 - protein, 9 aa, Influenza virus
FEIFHKCDN

SEQ ID NO: 339327 - protein, 9 aa, Influenza virus
CMASIRNST

SEQ ID NO: 339328 - protein, 9 aa, Influenza virus
MASIRNSTY

SEQ ID NO: 339329 - protein, 9 aa, Influenza virus
ESIRNNTYN

SEQ ID NO: 339330 - protein, 9 aa, Influenza virus
SIRNSTYDH

SEQ ID NO: 339331 - protein, 9 aa, Influenza virus
YRAESLQNR

SEQ ID NO: 339332 - protein, 9 aa, Influenza virus
SGYKEVILW

SEQ ID NO: 339333 - protein, 9 aa, Influenza virus
GYKEVILWF

SEQ ID NO: 339334 - protein, 9 aa, Influenza virus
YKEVILWFS

SEQ ID NO: 339335 - protein, 9 aa, Influenza virus
KEVILWFSF

SEQ ID NO: 339336 - protein, 9 aa, Influenza virus
EVILWFSFG

SEQ ID NO: 339337 - protein, 9 aa, Influenza virus
FSFGASCLI

SEQ ID NO: 339338 - protein, 9 aa, Influenza virus
SFGASCFLF

SEQ ID NO: 339339 - protein, 9 aa, Influenza virus
FGASCFLLI

SEQ ID NO: 339340 - protein, 9 aa, Influenza virus
GASCFLLIA

SEQ ID NO: 339341 - protein, 9 aa, Influenza virus
FMCVKNGNM

SEQ ID NO: 339342 - protein, 9 aa, Influenza virus
RNGNMRCTI

SEQ ID NO: 339343 - protein, 9 aa, Influenza virus
TNADKICLG

SEQ ID NO: 339344 - protein, 9 aa, Influenza virus
RGDKICLGH

SEQ ID NO: 339345 - protein, 9 aa, Influenza virus
AVSNGTKIN

SEQ ID NO: 339346 - protein, 9 aa, Influenza virus
VSNGTKINT

SEQ ID NO: 339347 - protein, 9 aa, Influenza virus
SNGTKINTL

SEQ ID NO: 339348 - protein, 9 aa, Influenza virus
TKINTLTER

SEQ ID NO: 339349 - protein, 9 aa, Influenza virus
KINTLTERG

SEQ ID NO: 339350 - protein, 9 aa, Influenza virus
VNTLTERGV

SEQ ID NO: 339351 - protein, 9 aa, Influenza virus
NTLTERGVE

SEQ ID NO: 339352 - protein, 9 aa, Influenza virus
TLTERGVEV

SEQ ID NO: 339353 - protein, 9 aa, Influenza virus
LTERGVEVV

SEQ ID NO: 339354 - protein, 9 aa, Influenza virus
TERGVEVVN

SEQ ID NO: 339355 - protein, 9 aa, Influenza virus
ERGVEVVNA

SEQ ID NO: 339356 - protein, 9 aa, Influenza virus
RGVEVVNAT

SEQ ID NO: 339357 - protein, 9 aa, Influenza virus
NATETVERT

SEQ ID NO: 339358 - protein, 9 aa, Influenza virus
LGQCGLLGI

SEQ ID NO: 339359 - protein, 9 aa, Influenza virus
CGLLGTITG

SEQ ID NO: 339360 - protein, 9 aa, Influenza virus
GLLGTITGP

SEQ ID NO: 339361 - protein, 9 aa, Influenza virus
LLGTITGPP

SEQ ID NO: 339362 - protein, 9 aa, Influenza virus
IGPPQCDKF

SEQ ID NO: 339363 - protein, 9 aa, Influenza virus
GPPHCDQFL

SEQ ID NO: 339364 - protein, 9 aa, Influenza virus
PPHCDQFLE

SEQ ID NO: 339365 - protein, 9 aa, Influenza virus
SDLIIERKE

SEQ ID NO: 339366 - protein, 9 aa, Influenza virus
LIIERREGA

SEQ ID NO: 339367 - protein, 9 aa, Influenza virus
IIERKEGTD

SEQ ID NO: 339368 - protein, 9 aa, Influenza virus
EGNDVCYPG

SEQ ID NO: 339369 - protein, 9 aa, Influenza virus
CYPGKFVNE

SEQ ID NO: 339370 - protein, 9 aa, Influenza virus
YPGKFVNEE

SEQ ID NO: 339371 - protein, 9 aa, Influenza virus
FVNGEALRQ

SEQ ID NO: 339372 - protein, 9 aa, Influenza virus
VNGEALRQI

SEQ ID NO: 339373 - protein, 9 aa, Influenza virus
NGEALRQIL

SEQ ID NO: 339374 - protein, 9 aa, Influenza virus
GEALRQILR

SEQ ID NO: 339375 - protein, 9 aa, Influenza virus
LRQILRESG

SEQ ID NO: 339376 - protein, 9 aa, Influenza virus
RQILRESGG

SEQ ID NO: 339377 - protein, 9 aa, Influenza virus
QILRESGGI

SEQ ID NO: 339378 - protein, 9 aa, Influenza virus
RGSGGIDKE

SEQ ID NO: 339379 - protein, 9 aa, Influenza virus
GFTYSEIRT

SEQ ID NO: 339380 - protein, 9 aa, Influenza virus
FIYSGIRTN

SEQ ID NO: 339381 - protein, 9 aa, Influenza virus
TYSEIRTNG

SEQ ID NO: 339382 - protein, 9 aa, Influenza virus
YSGIRTNGT

SEQ ID NO: 339383 - protein, 9 aa, Influenza virus
RSSSSFYAE

SEQ ID NO: 339384 - protein, 9 aa, Influenza virus
SGSSFYAEL

SEQ ID NO: 339385 - protein, 9 aa, Influenza virus
SSSFYAEMK

SEQ ID NO: 339386 - protein, 9 aa, Influenza virus
EMKWLLSSS

SEQ ID NO: 339387 - protein, 9 aa, Influenza virus
MKWLLSSSD

SEQ ID NO: 339388 - protein, 9 aa, Influenza virus
KWLLSSSDN

SEQ ID NO: 339389 - protein, 9 aa, Influenza virus
ALIVWGIHH

SEQ ID NO: 339390 - protein, 9 aa, Influenza virus
LIVWGIHHS

SEQ ID NO: 339391 - protein, 9 aa, Influenza virus
TEQTKLYGS

SEQ ID NO: 339392 - protein, 9 aa, Influenza virus
QTKLYGSGS

SEQ ID NO: 339393 - protein, 9 aa, Influenza virus
TKLYGSGSK

SEQ ID NO: 339394 - protein, 9 aa, Influenza virus
KLYGSGSKL

SEQ ID NO: 339395 - protein, 9 aa, Influenza virus
LYGNGNKLV

SEQ ID NO: 339396 - protein, 9 aa, Influenza virus
PGTRRIDFH

SEQ ID NO: 339397 - protein, 9 aa, Influenza virus
GTRRIDFHW

SEQ ID NO: 339398 - protein, 9 aa, Influenza virus
TRRIDFHWL

SEQ ID NO: 339399 - protein, 9 aa, Influenza virus
RRIDFNWLL

SEQ ID NO: 339400 - protein, 9 aa, Influenza virus
GRIDFHWLI

SEQ ID NO: 339401 - protein, 9 aa, Influenza virus
RIDFHWLIL

SEQ ID NO: 339402 - protein, 9 aa, Influenza virus
NDTVTFIFN

SEQ ID NO: 339403 - protein, 9 aa, Influenza virus
DTVTFIFNG

SEQ ID NO: 339404 - protein, 9 aa, Influenza virus
TVTFIFNGA

SEQ ID NO: 339405 - protein, 9 aa, Influenza virus
VTFIFNGAF

SEQ ID NO: 339406 - protein, 9 aa, Influenza virus
TFIFNGAFI

SEQ ID NO: 339407 - protein, 9 aa, Influenza virus
FIFNGAFIA

SEQ ID NO: 339408 - protein, 9 aa, Influenza virus
IFNGAFIAP

SEQ ID NO: 339409 - protein, 9 aa, Influenza virus
IAPNRASFF

SEQ ID NO: 339410 - protein, 9 aa, Influenza virus
APNRASFFR

SEQ ID NO: 339411 - protein, 9 aa, Influenza virus
PNRASFFRG

SEQ ID NO: 339412 - protein, 9 aa, Influenza virus
GGTIISSLP

SEQ ID NO: 339413 - protein, 9 aa, Influenza virus
GTIISSLPF

SEQ ID NO: 339414 - protein, 9 aa, Influenza virus
TIISSLPFQ

SEQ ID NO: 339415 - protein, 9 aa, Influenza virus
IISSLPFQN

SEQ ID NO: 339416 - protein, 9 aa, Influenza virus
ISSLPFQNI

SEQ ID NO: 339417 - protein, 9 aa, Influenza virus
SSLPFQNIS

SEQ ID NO: 339418 - protein, 9 aa, Influenza virus
NLPFQNINS

SEQ ID NO: 339419 - protein, 9 aa, Influenza virus
LPFQNINPK

SEQ ID NO: 339420 - protein, 9 aa, Influenza virus
AVGKCPRYV

SEQ ID NO: 339421 - protein, 9 aa, Influenza virus
VGKCPKYVK

SEQ ID NO: 339422 - protein, 9 aa, Influenza virus
GKCPRYIKQ

SEQ ID NO: 339423 - protein, 9 aa, Influenza virus
CPRYVKQES

SEQ ID NO: 339424 - protein, 9 aa, Influenza virus
VKQESLLLA

SEQ ID NO: 339425 - protein, 9 aa, Influenza virus
KQESLLLAT

SEQ ID NO: 339426 - protein, 9 aa, Influenza virus
QESLLLATG

SEQ ID NO: 339427 - protein, 9 aa, Influenza virus
ESLLLATGM

SEQ ID NO: 339428 - protein, 9 aa, Influenza virus
SLMLATGMK

SEQ ID NO: 339429 - protein, 9 aa, Influenza virus
LMLATGMKN

SEQ ID NO: 339430 - protein, 9 aa, Influenza virus
LLATGMRNI

SEQ ID NO: 339431 - protein, 9 aa, Influenza virus
LATGMRNIP

SEQ ID NO: 339432 - protein, 9 aa, Influenza virus
ATGMRNIPE

SEQ ID NO: 339433 - protein, 9 aa, Influenza virus
TGMKNVPEI

SEQ ID NO: 339434 - protein, 9 aa, Influenza virus
GMKNVPEIP

SEQ ID NO: 339435 - protein, 9 aa, Influenza virus
MKNVPEIPK

SEQ ID NO: 339436 - protein, 9 aa, Influenza virus
PKTRGLFGA

SEQ ID NO: 339437 - protein, 9 aa, Influenza virus
KTRGLFGAI

SEQ ID NO: 339438 - protein, 9 aa, Influenza virus
TRGLFGAIA

SEQ ID NO: 339439 - protein, 9 aa, Influenza virus
ENGWEGLVD

SEQ ID NO: 339440 - protein, 9 aa, Influenza virus
NGWEGLVDG

SEQ ID NO: 339441 - protein, 9 aa, Influenza virus
GWEGLVDGW

SEQ ID NO: 339442 - protein, 9 aa, Influenza virus
WEGLVDGWY

SEQ ID NO: 339443 - protein, 9 aa, Influenza virus
EGLVDGWYG

SEQ ID NO: 339444 - protein, 9 aa, Influenza virus
GLVDGWYGF

SEQ ID NO: 339445 - protein, 9 aa, Influenza virus
LVDGWYGFR

SEQ ID NO: 339446 - protein, 9 aa, Influenza virus
VDGWYGFRH

SEQ ID NO: 339447 - protein, 9 aa, Influenza virus
TGKLNRLIS

SEQ ID NO: 339448 - protein, 9 aa, Influenza virus
GKLNRLISK

SEQ ID NO: 339449 - protein, 9 aa, Influenza virus
KLNRLISKT

SEQ ID NO: 339450 - protein, 9 aa, Influenza virus
LNRLISKTN

SEQ ID NO: 339451 - protein, 9 aa, Influenza virus
NRLIEKTNQ

SEQ ID NO: 339452 - protein, 9 aa, Influenza virus
RLISKTNQQ

SEQ ID NO: 339453 - protein, 9 aa, Influenza virus
LISKTNQQF

SEQ ID NO: 339454 - protein, 9 aa, Influenza virus
ISKTNQQFE

SEQ ID NO: 339455 - protein, 9 aa, Influenza virus
EKTNQQFEL

SEQ ID NO: 339456 - protein, 9 aa, Influenza virus
TNQQFGLID

SEQ ID NO: 339457 - protein, 9 aa, Influenza virus
NKQFELIDN

SEQ ID NO: 339458 - protein, 9 aa, Influenza virus
KQFELIDNE

SEQ ID NO: 339459 - protein, 9 aa, Influenza virus
QFELIDHEF

SEQ ID NO: 339460 - protein, 9 aa, Influenza virus
FELIDNEFT

SEQ ID NO: 339461 - protein, 9 aa, Influenza virus
ELIDNEFTE

SEQ ID NO: 339462 - protein, 9 aa, Influenza virus
NEFTEVEKQ

SEQ ID NO: 339463 - protein, 9 aa, Influenza virus
EFTEVEKQI

SEQ ID NO: 339464 - protein, 9 aa, Influenza virus
FTEVEKQIG

SEQ ID NO: 339465 - protein, 9 aa, Influenza virus
TEVEKQIGN

SEQ ID NO: 339466 - protein, 9 aa, Influenza virus
EVEKQIGNV

SEQ ID NO: 339467 - protein, 9 aa, Influenza virus
VEKQIGNVI

SEQ ID NO: 339468 - protein, 9 aa, Influenza virus
NVINWTRDS

SEQ ID NO: 339469 - protein, 9 aa, Influenza virus
VINWTRDSM

SEQ ID NO: 339470 - protein, 9 aa, Influenza virus
INWTRDSMT

SEQ ID NO: 339471 - protein, 9 aa, Influenza virus
NWTRDSMTE

SEQ ID NO: 339472 - protein, 9 aa, Influenza virus
WTRDSMTEV

SEQ ID NO: 339473 - protein, 9 aa, Influenza virus
TRDSMTEVW

SEQ ID NO: 339474 - protein, 9 aa, Influenza virus
RDSMTEVWS

SEQ ID NO: 339475 - protein, 9 aa, Influenza virus
DSMTEVWSY

SEQ ID NO: 339476 - protein, 9 aa, Influenza virus
SMTEVWSYN

SEQ ID NO: 339477 - protein, 9 aa, Influenza virus
ITEVWSYNA

SEQ ID NO: 339478 - protein, 9 aa, Influenza virus
LVAIENQHT

SEQ ID NO: 339479 - protein, 9 aa, Influenza virus
VAIENQHTI

SEQ ID NO: 339480 - protein, 9 aa, Influenza virus
AIENQHTID

SEQ ID NO: 339481 - protein, 9 aa, Influenza virus
IDLTDSEMS

SEQ ID NO: 339482 - protein, 9 aa, Influenza virus
DLTDSEMSK

SEQ ID NO: 339483 - protein, 9 aa, Influenza virus
LTDSEMSKL

SEQ ID NO: 339484 - protein, 9 aa, Influenza virus
TDSEMSKLY

SEQ ID NO: 339485 - protein, 9 aa, Influenza virus
DSEMKKLYE

SEQ ID NO: 339486 - protein, 9 aa, Influenza virus
SEMKKLYER

SEQ ID NO: 339487 - protein, 9 aa, Influenza virus
EMKKLYERV

SEQ ID NO: 339488 - protein, 9 aa, Influenza virus
MNKLYERVR

SEQ ID NO: 339489 - protein, 9 aa, Influenza virus
KLYERVRRQ

SEQ ID NO: 339490 - protein, 9 aa, Influenza virus
LYERVRRQL

SEQ ID NO: 339491 - protein, 9 aa, Influenza virus
YERVRRQLR

SEQ ID NO: 339492 - protein, 9 aa, Influenza virus
ERVRRQLRE

SEQ ID NO: 339493 - protein, 9 aa, Influenza virus
RVRRQLREN

SEQ ID NO: 339494 - protein, 9 aa, Influenza virus
VRRQLRENA

SEQ ID NO: 339495 - protein, 9 aa, Influenza virus
RRQLRENAE

SEQ ID NO: 339496 - protein, 9 aa, Influenza virus
EIFHKCDDD

SEQ ID NO: 339497 - protein, 9 aa, Influenza virus
IFHKCDDDC

SEQ ID NO: 339498 - protein, 9 aa, Influenza virus
FHKCDDDCM

SEQ ID NO: 339499 - protein, 9 aa, Influenza virus
HKCDDDCMA

SEQ ID NO: 339500 - protein, 9 aa, Influenza virus
KCDDDCMAS

SEQ ID NO: 339501 - protein, 9 aa, Influenza virus
CDDDCMASI

SEQ ID NO: 339502 - protein, 9 aa, Influenza virus
DDDCMASIR

SEQ ID NO: 339503 - protein, 9 aa, Influenza virus
DDCMASIRN

SEQ ID NO: 339504 - protein, 9 aa, Influenza virus
DCMASIRNN

SEQ ID NO: 339505 - protein, 9 aa, Influenza virus
ESIRNNTYN

SEQ ID NO: 339506 - protein, 9 aa, Influenza virus
IRNNTYNHT

SEQ ID NO: 339507 - protein, 9 aa, Influenza virus
RNNTYDHTK

SEQ ID NO: 339508 - protein, 9 aa, Influenza virus
NNTYNHTQY

SEQ ID NO: 339509 - protein, 9 aa, Influenza virus
NTYNHTQYR

SEQ ID NO: 339510 - protein, 9 aa, Influenza virus
HTKYRTESL

SEQ ID NO: 339511 - protein, 9 aa, Influenza virus
KYRTESLQN

SEQ ID NO: 339512 - protein, 9 aa, Influenza virus
RKEAMQNRI

SEQ ID NO: 339513 - protein, 9 aa, Influenza virus
KEAMQNRIQ

SEQ ID NO: 339514 - protein, 9 aa, Influenza virus
LQNRIQIDS

SEQ ID NO: 339515 - protein, 9 aa, Influenza virus
QNRIQIDQV

SEQ ID NO: 339516 - protein, 9 aa, Influenza virus
NRIQIDQVK

SEQ ID NO: 339517 - protein, 9 aa, Influenza virus
RIQIDQVKL

SEQ ID NO: 339518 - protein, 9 aa, Influenza virus
IQIDQVKLS

SEQ ID NO: 339519 - protein, 9 aa, Influenza virus
QIDQVKLSS

SEQ ID NO: 339520 - protein, 9 aa, Influenza virus
IDQVKLSSG

SEQ ID NO: 339521 - protein, 9 aa, Influenza virus
DQVKLSSGY

SEQ ID NO: 339522 - protein, 9 aa, Influenza virus
QVKLSSGYK

SEQ ID NO: 339523 - protein, 9 aa, Influenza virus
KLSGGYKDI

SEQ ID NO: 339524 - protein, 9 aa, Influenza virus
LSGGYKDII

SEQ ID NO: 339525 - protein, 9 aa, Influenza virus
SGGYKDIIL

SEQ ID NO: 339526 - protein, 9 aa, Influenza virus
GGYKDIILW

SEQ ID NO: 339527 - protein, 9 aa, Influenza virus
ASCFLLLAV

SEQ ID NO: 339528 - protein, 9 aa, Influenza virus
SCFLLLAIV

SEQ ID NO: 339529 - protein, 9 aa, Influenza virus
LLAVVMGLV

SEQ ID NO: 339530 - protein, 9 aa, Influenza virus
LAVVMGLVF

SEQ ID NO: 339531 - protein, 9 aa, Influenza virus
AIAMGLVFM

SEQ ID NO: 339532 - protein, 9 aa, Influenza virus
IAMGLVFMC

SEQ ID NO: 339533 - protein, 9 aa, Influenza virus
AMGLVFMCV

SEQ ID NO: 339534 - protein, 9 aa, Influenza virus
MGLVFICVK

SEQ ID NO: 339535 - protein, 9 aa, Influenza virus
GLVFICVKN

SEQ ID NO: 339536 - protein, 9 aa, Influenza virus
LVFICVKNG

SEQ ID NO: 339537 - protein, 9 aa, Influenza virus
VFICVKNGN

SEQ ID NO: 339538 - protein, 9 aa, Influenza virus
FICVKNGNM

SEQ ID NO: 339539 - protein, 9 aa, Influenza virus
MCVKNGNMR

SEQ ID NO: 339540 - protein, 9 aa, Influenza virus
CVKNGNMRC

SEQ ID NO: 339541 - protein, 9 aa, Influenza virus
VKNGNMRCT

SEQ ID NO: 339542 - protein, 9 aa, Influenza virus
IGSISLTIA

SEQ ID NO: 339543 - protein, 9 aa, Influenza virus
GSVSLIIAT

SEQ ID NO: 339544 - protein, 9 aa, Influenza virus
CFLMQIATL

SEQ ID NO: 339545 - protein, 9 aa, Influenza virus
EKNITEIVY

SEQ ID NO: 339546 - protein, 9 aa, Influenza virus
RNVTETLYL

SEQ ID NO: 339547 - protein, 9 aa, Influenza virus
NVTETLYLN

SEQ ID NO: 339548 - protein, 9 aa, Influenza virus
ITEIVYLNS

SEQ ID NO: 339549 - protein, 9 aa, Influenza virus
TEIVYLNST

SEQ ID NO: 339550 - protein, 9 aa, Influenza virus
YRDWSKPQC

SEQ ID NO: 339551 - protein, 9 aa, Influenza virus
RDWSKPQCQ

SEQ ID NO: 339552 - protein, 9 aa, Influenza virus
DWSKPQCQI

SEQ ID NO: 339553 - protein, 9 aa, Influenza virus
WSKPQCQII

SEQ ID NO: 339554 - protein, 9 aa, Influenza virus
SKPQCQIIG

SEQ ID NO: 339555 - protein, 9 aa, Influenza virus
QCQIIGFAP

SEQ ID NO: 339556 - protein, 9 aa, Influenza virus
APFSKDNSV

SEQ ID NO: 339557 - protein, 9 aa, Influenza virus
PFSKDNSVR

SEQ ID NO: 339558 - protein, 9 aa, Influenza virus
FSKDNSVRL

SEQ ID NO: 339559 - protein, 9 aa, Influenza virus
SKDNSVRLS

SEQ ID NO: 339560 - protein, 9 aa, Influenza virus
SIRLSAGGN

SEQ ID NO: 339561 - protein, 9 aa, Influenza virus
VRLSASGDI

SEQ ID NO: 339562 - protein, 9 aa, Influenza virus
RLSAGGNIW

SEQ ID NO: 339563 - protein, 9 aa, Influenza virus
LSAGGDIWV

SEQ ID NO: 339564 - protein, 9 aa, Influenza virus
SAGGDIWVT

SEQ ID NO: 339565 - protein, 9 aa, Influenza virus
AGGDIWVTR

SEQ ID NO: 339566 - protein, 9 aa, Influenza virus
GGDIWVTRE

SEQ ID NO: 339567 - protein, 9 aa, Influenza virus
GDIWVTREP

SEQ ID NO: 339568 - protein, 9 aa, Influenza virus
DIWVTREPY

SEQ ID NO: 339569 - protein, 9 aa, Influenza virus
TREPYVSCG

SEQ ID NO: 339570 - protein, 9 aa, Influenza virus
REPYVSCSL

SEQ ID NO: 339571 - protein, 9 aa, Influenza virus
GKCYQFALG

SEQ ID NO: 339572 - protein, 9 aa, Influenza virus
ALGQGTTLE

SEQ ID NO: 339573 - protein, 9 aa, Influenza virus
LGQGTTLEN

SEQ ID NO: 339574 - protein, 9 aa, Influenza virus
GQGTTLYNK

SEQ ID NO: 339575 - protein, 9 aa, Influenza virus
QGTTLYNKH

SEQ ID NO: 339576 - protein, 9 aa, Influenza virus
GTTLYNKHS

SEQ ID NO: 339577 - protein, 9 aa, Influenza virus
TTLYNKHSN

SEQ ID NO: 339578 - protein, 9 aa, Influenza virus
TLYNKHSNG

SEQ ID NO: 339579 - protein, 9 aa, Influenza virus
LYNKHSNGT

SEQ ID NO: 339580 - protein, 9 aa, Influenza virus
NEHSNGTTH

SEQ ID NO: 339581 - protein, 9 aa, Influenza virus
EHSNGTTHD

SEQ ID NO: 339582 - protein, 9 aa, Influenza virus
SNGTTHDRI

SEQ ID NO: 339583 - protein, 9 aa, Influenza virus
HDRTSHRTL

SEQ ID NO: 339584 - protein, 9 aa, Influenza virus
DRTSHRTLL

SEQ ID NO: 339585 - protein, 9 aa, Influenza virus
RTSHRTLLM

SEQ ID NO: 339586 - protein, 9 aa, Influenza virus
TSHRTLLMN

SEQ ID NO: 339587 - protein, 9 aa, Influenza virus
LGTKQVCMA

SEQ ID NO: 339588 - protein, 9 aa, Influenza virus
GTKQVCMAW

SEQ ID NO: 339589 - protein, 9 aa, Influenza virus
TKQVCMAWS

SEQ ID NO: 339590 - protein, 9 aa, Influenza virus
GKAWLHICV

SEQ ID NO: 339591 - protein, 9 aa, Influenza virus
KAWLHICVT

SEQ ID NO: 339592 - protein, 9 aa, Influenza virus
AWLHVCITG

SEQ ID NO: 339593 - protein, 9 aa, Influenza virus
WLHVCITGD

SEQ ID NO: 339594 - protein, 9 aa, Influenza virus
LHVCITGDD

SEQ ID NO: 339595 - protein, 9 aa, Influenza virus
HICVTGDDR

SEQ ID NO: 339596 - protein, 9 aa, Influenza virus
VCITGDDRN

SEQ ID NO: 339597 - protein, 9 aa, Influenza virus
CVTGDDKNA

SEQ ID NO: 339598 - protein, 9 aa, Influenza virus
VTGDDKNAT

SEQ ID NO: 339599 - protein, 9 aa, Influenza virus
DDRNATASL

SEQ ID NO: 339600 - protein, 9 aa, Influenza virus
DRNATASLI

SEQ ID NO: 339601 - protein, 9 aa, Influenza virus
RNATASLIY

SEQ ID NO: 339602 - protein, 9 aa, Influenza virus
NATASLIYN

SEQ ID NO: 339603 - protein, 9 aa, Influenza virus
ATASLIYNG

SEQ ID NO: 339604 - protein, 9 aa, Influenza virus
LIDSIGSWS

SEQ ID NO: 339605 - protein, 9 aa, Influenza virus
IDSIGSWSQ

SEQ ID NO: 339606 - protein, 9 aa, Influenza virus
CVCINGSCA

SEQ ID NO: 339607 - protein, 9 aa, Influenza virus
VCINGSCAV

SEQ ID NO: 339608 - protein, 9 aa, Influenza virus
CINGSCAVV

SEQ ID NO: 339609 - protein, 9 aa, Influenza virus
INGSCAVVM

SEQ ID NO: 339610 - protein, 9 aa, Influenza virus
NGSCAVVMT

SEQ ID NO: 339611 - protein, 9 aa, Influenza virus
GTCAVVMTD

SEQ ID NO: 339612 - protein, 9 aa, Influenza virus
SCAVVMTDG

SEQ ID NO: 339613 - protein, 9 aa, Influenza virus
CAVVMTDGS

SEQ ID NO: 339614 - protein, 9 aa, Influenza virus
AVVMTDGSA

SEQ ID NO: 339615 - protein, 9 aa, Influenza virus
MTDGSASGR

SEQ ID NO: 339616 - protein, 9 aa, Influenza virus
TDGSASGRA

SEQ ID NO: 339617 - protein, 9 aa, Influenza virus
DGSASGKAE

SEQ ID NO: 339618 - protein, 9 aa, Influenza virus
GSASGKAET

SEQ ID NO: 339619 - protein, 9 aa, Influenza virus
ASGRADTRI

SEQ ID NO: 339620 - protein, 9 aa, Influenza virus
EGKIAHISP

SEQ ID NO: 339621 - protein, 9 aa, Influenza virus
GKIAHISPL

SEQ ID NO: 339622 - protein, 9 aa, Influenza virus
KIAHISPLS

SEQ ID NO: 339623 - protein, 9 aa, Influenza virus
IAHISPLSG

SEQ ID NO: 339624 - protein, 9 aa, Influenza virus
AHISPLSGS

SEQ ID NO: 339625 - protein, 9 aa, Influenza virus
CSCYPRYPD

SEQ ID NO: 339626 - protein, 9 aa, Influenza virus
SCYPRYPDV

SEQ ID NO: 339627 - protein, 9 aa, Influenza virus
CYPRYPDVR

SEQ ID NO: 339628 - protein, 9 aa, Influenza virus
YPRYPDVRC

SEQ ID NO: 339629 - protein, 9 aa, Influenza virus
PRYPDVRCV

SEQ ID NO: 339630 - protein, 9 aa, Influenza virus
RYPDVRCVC

SEQ ID NO: 339631 - protein, 9 aa, Influenza virus
WKGSNRPVV

SEQ ID NO: 339632 - protein, 9 aa, Influenza virus
KGSNRPVVD

SEQ ID NO: 339633 - protein, 9 aa, Influenza virus
GSNRPIIDI

SEQ ID NO: 339634 - protein, 9 aa, Influenza virus
SNRPIIDIN

SEQ ID NO: 339635 - protein, 9 aa, Influenza virus
NRPIIDINM

SEQ ID NO: 339636 - protein, 9 aa, Influenza virus
IDSSYLCSG

SEQ ID NO: 339637 - protein, 9 aa, Influenza virus
DSSYLCSGL

SEQ ID NO: 339638 - protein, 9 aa, Influenza virus
GDTPRNDDS

SEQ ID NO: 339639 - protein, 9 aa, Influenza virus
DTPRNDDSS

SEQ ID NO: 339640 - protein, 9 aa, Influenza virus
TPRNDDSSS

SEQ ID NO: 339641 - protein, 9 aa, Influenza virus
PRNDDSSSS

SEQ ID NO: 339642 - protein, 9 aa, Influenza virus
RNDDSSSSS

SEQ ID NO: 339643 - protein, 9 aa, Influenza virus
NDDSSSSSN

SEQ ID NO: 339644 - protein, 9 aa, Influenza virus
DDSSSSSNC

SEQ ID NO: 339645 - protein, 9 aa, Influenza virus
SNSNCKDPN

SEQ ID NO: 339646 - protein, 9 aa, Influenza virus
SNCRDPNDE

SEQ ID NO: 339647 - protein, 9 aa, Influenza virus
DPNNERGNP

SEQ ID NO: 339648 - protein, 9 aa, Influenza virus
PNNERGNPG

SEQ ID NO: 339649 - protein, 9 aa, Influenza virus
NNERGNPGV

SEQ ID NO: 339650 - protein, 9 aa, Influenza virus
NERGNPGVK

SEQ ID NO: 339651 - protein, 9 aa, Influenza virus
ERGSPGVKG

SEQ ID NO: 339652 - protein, 9 aa, Influenza virus
RGSPGVKGW

SEQ ID NO: 339653 - protein, 9 aa, Influenza virus
GVKGWAFDY

SEQ ID NO: 339654 - protein, 9 aa, Influenza virus
VKGWAFDYG

SEQ ID NO: 339655 - protein, 9 aa, Influenza virus
KGWAFDYGN

SEQ ID NO: 339656 - protein, 9 aa, Influenza virus
GWAFDYGND

SEQ ID NO: 339657 - protein, 9 aa, Influenza virus
YGNDVWMGR

SEQ ID NO: 339658 - protein, 9 aa, Influenza virus
EDDVWMGRT

SEQ ID NO: 339659 - protein, 9 aa, Influenza virus
VWMGRTISM

SEQ ID NO: 339660 - protein, 9 aa, Influenza virus
WMGRTISMD

SEQ ID NO: 339661 - protein, 9 aa, Influenza virus
MGRTISMDS

SEQ ID NO: 339662 - protein, 9 aa, Influenza virus
GRTISMDSR

SEQ ID NO: 339663 - protein, 9 aa, Influenza virus
RTISMDSRS

SEQ ID NO: 339664 - protein, 9 aa, Influenza virus
TISMDSRSG

SEQ ID NO: 339665 - protein, 9 aa, Influenza virus
ISMDSRSGY

SEQ ID NO: 339666 - protein, 9 aa, Influenza virus
SMDSRSGYE

SEQ ID NO: 339667 - protein, 9 aa, Influenza virus
MDSRSGYET

SEQ ID NO: 339668 - protein, 9 aa, Influenza virus
GYETFRVID

SEQ ID NO: 339669 - protein, 9 aa, Influenza virus
YETFRVIDG

SEQ ID NO: 339670 - protein, 9 aa, Influenza virus
ETFRVIDGW

SEQ ID NO: 339671 - protein, 9 aa, Influenza virus
TFRVISGWT

SEQ ID NO: 339672 - protein, 9 aa, Influenza virus
VIGGWTIAN

SEQ ID NO: 339673 - protein, 9 aa, Influenza virus
IGGWTIANS

SEQ ID NO: 339674 - protein, 9 aa, Influenza virus
GGWTIANSK

SEQ ID NO: 339675 - protein, 9 aa, Influenza virus
GWTIANSKS

SEQ ID NO: 339676 - protein, 9 aa, Influenza virus
WTIANSKSQ

SEQ ID NO: 339677 - protein, 9 aa, Influenza virus
RQIIVDNNN

SEQ ID NO: 339678 - protein, 9 aa, Influenza virus
QIIVDNNNW

SEQ ID NO: 339679 - protein, 9 aa, Influenza virus
IVDNSNWSG

SEQ ID NO: 339680 - protein, 9 aa, Influenza virus
VDNNNWFGY

SEQ ID NO: 339681 - protein, 9 aa, Influenza virus
DNSNWSGYS

SEQ ID NO: 339682 - protein, 9 aa, Influenza virus
NSNWSGYSG

SEQ ID NO: 339683 - protein, 9 aa, Influenza virus
NNWFGYFGI

SEQ ID NO: 339684 - protein, 9 aa, Influenza virus
SWSGYSGIF

SEQ ID NO: 339685 - protein, 9 aa, Influenza virus
KRCINRCFY

SEQ ID NO: 339686 - protein, 9 aa, Influenza virus
RCINRCFYV

SEQ ID NO: 339687 - protein, 9 aa, Influenza virus
VELIRGMPQ

SEQ ID NO: 339688 - protein, 9 aa, Influenza virus
ELIRGMPQE

SEQ ID NO: 339689 - protein, 9 aa, Influenza virus
LIRGMPQET

SEQ ID NO: 339690 - protein, 9 aa, Influenza virus
PQENRVWWT

SEQ ID NO: 339691 - protein, 9 aa, Influenza virus
QENRVWWTS

SEQ ID NO: 339692 - protein, 9 aa, Influenza virus
EARVWWTSN

SEQ ID NO: 339693 - protein, 9 aa, Influenza virus
TTVWWTSNS

SEQ ID NO: 339694 - protein, 9 aa, Influenza virus
IVVFCGTSA

SEQ ID NO: 339695 - protein, 9 aa, Influenza virus
VVFCGTSGN

SEQ ID NO: 339696 - protein, 9 aa, Influenza virus
SWPDGANID

SEQ ID NO: 339697 - protein, 9 aa, Influenza virus
WPDGANIDF

SEQ ID NO: 339698 - protein, 9 aa, Influenza virus
PDGANINLM

SEQ ID NO: 339699 - protein, 9 aa, Influenza virus
DGANIDFVP

SEQ ID NO: 339700 - protein, 9 aa, Influenza virus
SRGYKMNTR

SEQ ID NO: 339701 - protein, 9 aa, Influenza virus
RGYKMNTRI

SEQ ID NO: 339702 - protein, 9 aa, Influenza virus
GYKMNTRIL

SEQ ID NO: 339703 - protein, 9 aa, Influenza virus
YKMNTRILI

SEQ ID NO: 339704 - protein, 9 aa, Influenza virus
KMNNQILIL

SEQ ID NO: 339705 - protein, 9 aa, Influenza virus
ICLGHHAVP

SEQ ID NO: 339706 - protein, 9 aa, Influenza virus
CLGHHAVPN

SEQ ID NO: 339707 - protein, 9 aa, Influenza virus
LGHHAVPNG

SEQ ID NO: 339708 - protein, 9 aa, Influenza virus
GHHAVPNGT

SEQ ID NO: 339709 - protein, 9 aa, Influenza virus
HHAVPNGTK

SEQ ID NO: 339710 - protein, 9 aa, Influenza virus
HAVPNGTKV

SEQ ID NO: 339711 - protein, 9 aa, Influenza virus
NGTKVDTLT

SEQ ID NO: 339712 - protein, 9 aa, Influenza virus
GTKVDTLTE

SEQ ID NO: 339713 - protein, 9 aa, Influenza virus
VNTLTEKGI

SEQ ID NO: 339714 - protein, 9 aa, Influenza virus
NTLTEKGIE

SEQ ID NO: 339715 - protein, 9 aa, Influenza virus
TLTEKGIEV

SEQ ID NO: 339716 - protein, 9 aa, Influenza virus
LTEKGIEVV

SEQ ID NO: 339717 - protein, 9 aa, Influenza virus
TEKGIEVVN

SEQ ID NO: 339718 - protein, 9 aa, Influenza virus
EKGIEVVNA

SEQ ID NO: 339719 - protein, 9 aa, Influenza virus
KGIEVVNAT

SEQ ID NO: 339720 - protein, 9 aa, Influenza virus
GVEVVDATE

SEQ ID NO: 339721 - protein, 9 aa, Influenza virus
VEVVDATET

SEQ ID NO: 339722 - protein, 9 aa, Influenza virus
VDATETVER

SEQ ID NO: 339723 - protein, 9 aa, Influenza virus
IDLGQCGLL

SEQ ID NO: 339724 - protein, 9 aa, Influenza virus
DMGQCGLLG

SEQ ID NO: 339725 - protein, 9 aa, Influenza virus
LGQCGLLGI

SEQ ID NO: 339726 - protein, 9 aa, Influenza virus
GQCGLLGTV

SEQ ID NO: 339727 - protein, 9 aa, Influenza virus
CGLLGTVTG

SEQ ID NO: 339728 - protein, 9 aa, Influenza virus
GLLGTVTGP

SEQ ID NO: 339729 - protein, 9 aa, Influenza virus
LLGTVTGPP

SEQ ID NO: 339730 - protein, 9 aa, Influenza virus
LGTVTGPPQ

SEQ ID NO: 339731 - protein, 9 aa, Influenza virus
GTVTGPPQC

SEQ ID NO: 339732 - protein, 9 aa, Influenza virus
TVTGPPQCD

SEQ ID NO: 339733 - protein, 9 aa, Influenza virus
IGPPQCDLF

SEQ ID NO: 339734 - protein, 9 aa, Influenza virus
GPPQCDRFL

SEQ ID NO: 339735 - protein, 9 aa, Influenza virus
PPQCDRFLE

SEQ ID NO: 339736 - protein, 9 aa, Influenza virus
PQCDRFLEF

SEQ ID NO: 339737 - protein, 9 aa, Influenza virus
DLIVERQEG

SEQ ID NO: 339738 - protein, 9 aa, Influenza virus
DVCYPGKFA

SEQ ID NO: 339739 - protein, 9 aa, Influenza virus
VCYPGKFAN

SEQ ID NO: 339740 - protein, 9 aa, Influenza virus
LRQILRRSG

SEQ ID NO: 339741 - protein, 9 aa, Influenza virus
RQILRRSGG

SEQ ID NO: 339742 - protein, 9 aa, Influenza virus
QILRRSGGI

SEQ ID NO: 339743 - protein, 9 aa, Influenza virus
GFTYSGMRT

SEQ ID NO: 339744 - protein, 9 aa, Influenza virus
GPSFYAEMK

SEQ ID NO: 339745 - protein, 9 aa, Influenza virus
EMKWLLSNN

SEQ ID NO: 339746 - protein, 9 aa, Influenza virus
MKWLLSNND

SEQ ID NO: 339747 - protein, 9 aa, Influenza virus
KWLLSNNDN

SEQ ID NO: 339748 - protein, 9 aa, Influenza virus
PALIVWGIH

SEQ ID NO: 339749 - protein, 9 aa, Influenza virus
ALIVWGIHH

SEQ ID NO: 339750 - protein, 9 aa, Influenza virus
LIVWGIHHS

SEQ ID NO: 339751 - protein, 9 aa, Influenza virus
EQAKLYGSG

SEQ ID NO: 339752 - protein, 9 aa, Influenza virus
KLYGSGAKL

SEQ ID NO: 339753 - protein, 9 aa, Influenza virus
LYGSGSKLI

SEQ ID NO: 339754 - protein, 9 aa, Influenza virus
YGSGSKLIT

SEQ ID NO: 339755 - protein, 9 aa, Influenza virus
GSGSKLITV

SEQ ID NO: 339756 - protein, 9 aa, Influenza virus
SSNYHQSFV

SEQ ID NO: 339757 - protein, 9 aa, Influenza virus
SNYHQSFVP

SEQ ID NO: 339758 - protein, 9 aa, Influenza virus
NYHQSFVPS

SEQ ID NO: 339759 - protein, 9 aa, Influenza virus
YHQSFVPSP

SEQ ID NO: 339760 - protein, 9 aa, Influenza virus
HQSFVPSPG

SEQ ID NO: 339761 - protein, 9 aa, Influenza virus
QSFVPSPGV

SEQ ID NO: 339762 - protein, 9 aa, Influenza virus
SFVPSPGVR

SEQ ID NO: 339763 - protein, 9 aa, Influenza virus
QVNGQTGRI

SEQ ID NO: 339764 - protein, 9 aa, Influenza virus
VDGQSGRID

SEQ ID NO: 339765 - protein, 9 aa, Influenza virus
NGQTGRIDF

SEQ ID NO: 339766 - protein, 9 aa, Influenza virus
GQTGRIDFH

SEQ ID NO: 339767 - protein, 9 aa, Influenza virus
QTGRIDFHW

SEQ ID NO: 339768 - protein, 9 aa, Influenza virus
TGRIDFHWL

SEQ ID NO: 339769 - protein, 9 aa, Influenza virus
FHWLILNPN

SEQ ID NO: 339770 - protein, 9 aa, Influenza virus
WLILNPNDT

SEQ ID NO: 339771 - protein, 9 aa, Influenza virus
ILNPNDTVT

SEQ ID NO: 339772 - protein, 9 aa, Influenza virus
LNPNDTITF

SEQ ID NO: 339773 - protein, 9 aa, Influenza virus
NDTVIFSFN

SEQ ID NO: 339774 - protein, 9 aa, Influenza virus
DTVIFSFNG

SEQ ID NO: 339775 - protein, 9 aa, Influenza virus
FSFNGAFVA

SEQ ID NO: 339776 - protein, 9 aa, Influenza virus
SFNGAFVAP

SEQ ID NO: 339777 - protein, 9 aa, Influenza virus
GAFVAPDRV

SEQ ID NO: 339778 - protein, 9 aa, Influenza virus
AFIAPDRAT

SEQ ID NO: 339779 - protein, 9 aa, Influenza virus
FIAPDRATF

SEQ ID NO: 339780 - protein, 9 aa, Influenza virus
IAPDRVSFL

SEQ ID NO: 339781 - protein, 9 aa, Influenza virus
GGTITSPLP

SEQ ID NO: 339782 - protein, 9 aa, Influenza virus
GTITSPLPF

SEQ ID NO: 339783 - protein, 9 aa, Influenza virus
TITSPLPFQ

SEQ ID NO: 339784 - protein, 9 aa, Influenza virus
ITSPLPFQN

SEQ ID NO: 339785 - protein, 9 aa, Influenza virus
TSPLPFQNI

SEQ ID NO: 339786 - protein, 9 aa, Influenza virus
SPLPFQNIN

SEQ ID NO: 339787 - protein, 9 aa, Influenza virus
SLPFQNINS

SEQ ID NO: 339788 - protein, 9 aa, Influenza virus
LPFQNVNSR

SEQ ID NO: 339789 - protein, 9 aa, Influenza virus
PFQNINSRT

SEQ ID NO: 339790 - protein, 9 aa, Influenza virus
VGKCPRYVR

SEQ ID NO: 339791 - protein, 9 aa, Influenza virus
GKCPRYVRQ

SEQ ID NO: 339792 - protein, 9 aa, Influenza virus
SLMLATGMK

SEQ ID NO: 339793 - protein, 9 aa, Influenza virus
LMLATGMKN

SEQ ID NO: 339794 - protein, 9 aa, Influenza virus
MLATGMKNV

SEQ ID NO: 339795 - protein, 9 aa, Influenza virus
TGMKNVPET

SEQ ID NO: 339796 - protein, 9 aa, Influenza virus
GMKNVPETP

SEQ ID NO: 339797 - protein, 9 aa, Influenza virus
MKNVPETPK

SEQ ID NO: 339798 - protein, 9 aa, Influenza virus
KRKRGLFGA

SEQ ID NO: 339799 - protein, 9 aa, Influenza virus
SPLSRCRKT

SEQ ID NO: 339800 - protein, 9 aa, Influenza virus
LSRCRKTRG

SEQ ID NO: 339801 - protein, 9 aa, Influenza virus
YRKRMTRGL

SEQ ID NO: 339802 - protein, 9 aa, Influenza virus
RCRKTRGLF

SEQ ID NO: 339803 - protein, 9 aa, Influenza virus
CRKTRGLFG

SEQ ID NO: 339804 - protein, 9 aa, Influenza virus
RKTRGLFGA

SEQ ID NO: 339805 - protein, 9 aa, Influenza virus
KTRGLFGAI

SEQ ID NO: 339806 - protein, 9 aa, Influenza virus
PRGLFGAIA

SEQ ID NO: 339807 - protein, 9 aa, Influenza virus
ENGWEGLIN

SEQ ID NO: 339808 - protein, 9 aa, Influenza virus
NGWEGLING

SEQ ID NO: 339809 - protein, 9 aa, Influenza virus
GWEGLINGW

SEQ ID NO: 339810 - protein, 9 aa, Influenza virus
WEGLINGWY

SEQ ID NO: 339811 - protein, 9 aa, Influenza virus
EGLINGWYG

SEQ ID NO: 339812 - protein, 9 aa, Influenza virus
GLINGWYGF

SEQ ID NO: 339813 - protein, 9 aa, Influenza virus
LINGWYGFR

SEQ ID NO: 339814 - protein, 9 aa, Influenza virus
INGWYGFRH

SEQ ID NO: 339815 - protein, 9 aa, Influenza virus
DGWYGFKHQ

SEQ ID NO: 339816 - protein, 9 aa, Influenza virus
TAADYKSTP

SEQ ID NO: 339817 - protein, 9 aa, Influenza virus
DYKSTPSAI

SEQ ID NO: 339818 - protein, 9 aa, Influenza virus
YKSTQSAVD

SEQ ID NO: 339819 - protein, 9 aa, Influenza virus
KSTQSAVDQ

SEQ ID NO: 339820 - protein, 9 aa, Influenza virus
STQSAVDQI

SEQ ID NO: 339821 - protein, 9 aa, Influenza virus
TQSAVDQIT

SEQ ID NO: 339822 - protein, 9 aa, Influenza virus
QSAVDQITG

SEQ ID NO: 339823 - protein, 9 aa, Influenza virus
SAVDQITGK

SEQ ID NO: 339824 - protein, 9 aa, Influenza virus
AVDQITGKL

SEQ ID NO: 339825 - protein, 9 aa, Influenza virus
VDQITGKLN

SEQ ID NO: 339826 - protein, 9 aa, Influenza virus
TGKLNRIIE

SEQ ID NO: 339827 - protein, 9 aa, Influenza virus
GKLNRIIEK

SEQ ID NO: 339828 - protein, 9 aa, Influenza virus
KLNRIIEKT

SEQ ID NO: 339829 - protein, 9 aa, Influenza virus
LNRIIEKTN

SEQ ID NO: 339830 - protein, 9 aa, Influenza virus
NRIIEKTNQ

SEQ ID NO: 339831 - protein, 9 aa, Influenza virus
RIIEKTNQQ

SEQ ID NO: 339832 - protein, 9 aa, Influenza virus
IIEKTNQQF

SEQ ID NO: 339833 - protein, 9 aa, Influenza virus
IEKTNQQFK

SEQ ID NO: 339834 - protein, 9 aa, Influenza virus
DKTNQQFEM

SEQ ID NO: 339835 - protein, 9 aa, Influenza virus
KTNQQFKLI

SEQ ID NO: 339836 - protein, 9 aa, Influenza virus
TNQQFKLID

SEQ ID NO: 339837 - protein, 9 aa, Influenza virus
NQQFKLIDN

SEQ ID NO: 339838 - protein, 9 aa, Influenza virus
QQFKLIDNE

SEQ ID NO: 339839 - protein, 9 aa, Influenza virus
QFKLIDNEF

SEQ ID NO: 339840 - protein, 9 aa, Influenza virus
IDNEFSEIE

SEQ ID NO: 339841 - protein, 9 aa, Influenza virus
FSEIEQQIG

SEQ ID NO: 339842 - protein, 9 aa, Influenza virus
SEIEQQIGN

SEQ ID NO: 339843 - protein, 9 aa, Influenza virus
EVERQIGNV

SEQ ID NO: 339844 - protein, 9 aa, Influenza virus
VERQIGNVI

SEQ ID NO: 339845 - protein, 9 aa, Influenza virus
ERQIGNVIN

SEQ ID NO: 339846 - protein, 9 aa, Influenza virus
RQIGNVINW

SEQ ID NO: 339847 - protein, 9 aa, Influenza virus
VINWTRDSV

SEQ ID NO: 339848 - protein, 9 aa, Influenza virus
INWTRDSVT

SEQ ID NO: 339849 - protein, 9 aa, Influenza virus
NWTRDSVTE

SEQ ID NO: 339850 - protein, 9 aa, Influenza virus
WTRDSITEV

SEQ ID NO: 339851 - protein, 9 aa, Influenza virus
TRDSITEVW

SEQ ID NO: 339852 - protein, 9 aa, Influenza virus
RDSITEVWS

SEQ ID NO: 339853 - protein, 9 aa, Influenza virus
DSITEVWSY

SEQ ID NO: 339854 - protein, 9 aa, Influenza virus
SITEVWSYN

SEQ ID NO: 339855 - protein, 9 aa, Influenza virus
ITEVWSYNA

SEQ ID NO: 339856 - protein, 9 aa, Influenza virus
TELWSYNAE

SEQ ID NO: 339857 - protein, 9 aa, Influenza virus
ELWSYNAEL

SEQ ID NO: 339858 - protein, 9 aa, Influenza virus
LWSYNAELL

SEQ ID NO: 339859 - protein, 9 aa, Influenza virus
IDQADSEMN

SEQ ID NO: 339860 - protein, 9 aa, Influenza virus
DQADSEMNK

SEQ ID NO: 339861 - protein, 9 aa, Influenza virus
LANSEMNKL

SEQ ID NO: 339862 - protein, 9 aa, Influenza virus
ADSEMSKLY

SEQ ID NO: 339863 - protein, 9 aa, Influenza virus
DSEMNNLYE

SEQ ID NO: 339864 - protein, 9 aa, Influenza virus
SEMDKLYTR

SEQ ID NO: 339865 - protein, 9 aa, Influenza virus
EMSKLYERV

SEQ ID NO: 339866 - protein, 9 aa, Influenza virus
KLYERVKRQ

SEQ ID NO: 339867 - protein, 9 aa, Influenza virus
LYERVKRQL

SEQ ID NO: 339868 - protein, 9 aa, Influenza virus
YERVKRQLR

SEQ ID NO: 339869 - protein, 9 aa, Influenza virus
ERVKRQLRE

SEQ ID NO: 339870 - protein, 9 aa, Influenza virus
RVKRQLREN

SEQ ID NO: 339871 - protein, 9 aa, Influenza virus
VKRQLRENA

SEQ ID NO: 339872 - protein, 9 aa, Influenza virus
KRQLRENAE

SEQ ID NO: 339873 - protein, 9 aa, Influenza virus
CMASIRNST

SEQ ID NO: 339874 - protein, 9 aa, Influenza virus
MASIRNSTY

SEQ ID NO: 339875 - protein, 9 aa, Influenza virus
ASIRNSTYD

SEQ ID NO: 339876 - protein, 9 aa, Influenza virus
IRNSTYDHS

SEQ ID NO: 339877 - protein, 9 aa, Influenza virus
RYREEAMQN

SEQ ID NO: 339878 - protein, 9 aa, Influenza virus
YRAESLQNR

SEQ ID NO: 339879 - protein, 9 aa, Influenza virus
RAESLQNRI

SEQ ID NO: 339880 - protein, 9 aa, Influenza virus
ESLQNRIRI

SEQ ID NO: 339881 - protein, 9 aa, Influenza virus
QNRIRIDPV

SEQ ID NO: 339882 - protein, 9 aa, Influenza virus
NRIRIDPVK

SEQ ID NO: 339883 - protein, 9 aa, Influenza virus
RIRIDPVKL

SEQ ID NO: 339884 - protein, 9 aa, Influenza virus
DPVKLSGGY

SEQ ID NO: 339885 - protein, 9 aa, Influenza virus
PVKLNSGYK

SEQ ID NO: 339886 - protein, 9 aa, Influenza virus
VKLSGGYKD

SEQ ID NO: 339887 - protein, 9 aa, Influenza virus
SSGYKEVIL

SEQ ID NO: 339888 - protein, 9 aa, Influenza virus
SGYKEVILW

SEQ ID NO: 339889 - protein, 9 aa, Influenza virus
GYKEVILWF

SEQ ID NO: 339890 - protein, 9 aa, Influenza virus
YKEVILWFS

SEQ ID NO: 339891 - protein, 9 aa, Influenza virus
KEVILWFSF

SEQ ID NO: 339892 - protein, 9 aa, Influenza virus
EVILWFSFG

SEQ ID NO: 339893 - protein, 9 aa, Influenza virus
SFGASCFLF

SEQ ID NO: 339894 - protein, 9 aa, Influenza virus
FGASCFLLI

SEQ ID NO: 339895 - protein, 9 aa, Influenza virus
GASCFLLIA

SEQ ID NO: 339896 - protein, 9 aa, Influenza virus
ASCFLLIAI

SEQ ID NO: 339897 - protein, 9 aa, Influenza virus
FMCVKNGNM

SEQ ID NO: 339898 - protein, 9 aa, Influenza virus
MCVKNGNMR

SEQ ID NO: 339899 - protein, 9 aa, Influenza virus
CIKNGNMQC

SEQ ID NO: 339900 - protein, 9 aa, Influenza virus
IKDGNMRCT

SEQ ID NO: 339901 - protein, 9 aa, Influenza virus
GAVNTTLST

SEQ ID NO: 339902 - protein, 9 aa, Influenza virus
AVNTTLSTI

SEQ ID NO: 339903 - protein, 9 aa, Influenza virus
VNTILSTKA

SEQ ID NO: 339904 - protein, 9 aa, Influenza virus
NTALSTIAL

SEQ ID NO: 339905 - protein, 9 aa, Influenza virus
TTLSTIALF

SEQ ID NO: 339906 - protein, 9 aa, Influenza virus
TLSTIALFI

SEQ ID NO: 339907 - protein, 9 aa, Influenza virus
LSTIALFIG

SEQ ID NO: 339908 - protein, 9 aa, Influenza virus
STIALIIGV

SEQ ID NO: 339909 - protein, 9 aa, Influenza virus
TIALIIGVG

SEQ ID NO: 339910 - protein, 9 aa, Influenza virus
IALIIGVGN

SEQ ID NO: 339911 - protein, 9 aa, Influenza virus
ALIIGVGNL

SEQ ID NO: 339912 - protein, 9 aa, Influenza virus
IGIGNLVFN

SEQ ID NO: 339913 - protein, 9 aa, Influenza virus
GIGNLVFNT

SEQ ID NO: 339914 - protein, 9 aa, Influenza virus
IGNLVFNTV

SEQ ID NO: 339915 - protein, 9 aa, Influenza virus
GNLAFNTVI

SEQ ID NO: 339916 - protein, 9 aa, Influenza virus
NLAFNAVIH

SEQ ID NO: 339917 - protein, 9 aa, Influenza virus
LIFNTVIHE

SEQ ID NO: 339918 - protein, 9 aa, Influenza virus
ITYNNTVVN

SEQ ID NO: 339919 - protein, 9 aa, Influenza virus
TYNNTVVNN

SEQ ID NO: 339920 - protein, 9 aa, Influenza virus
YNNTVVNNI

SEQ ID NO: 339921 - protein, 9 aa, Influenza virus
NNTVVNNIT

SEQ ID NO: 339922 - protein, 9 aa, Influenza virus
NTVVNNITT

SEQ ID NO: 339923 - protein, 9 aa, Influenza virus
TTINNITNV

SEQ ID NO: 339924 - protein, 9 aa, Influenza virus
VINNMTTTI

SEQ ID NO: 339925 - protein, 9 aa, Influenza virus
VNNITTTII

SEQ ID NO: 339926 - protein, 9 aa, Influenza virus
NNITTTIIA

SEQ ID NO: 339927 - protein, 9 aa, Influenza virus
FKPPLPLCP

SEQ ID NO: 339928 - protein, 9 aa, Influenza virus
KPPLPLCPF

SEQ ID NO: 339929 - protein, 9 aa, Influenza virus
SLPLCPFQG

SEQ ID NO: 339930 - protein, 9 aa, Influenza virus
LPLCPFKGF

SEQ ID NO: 339931 - protein, 9 aa, Influenza virus
PLCPFKGFF

SEQ ID NO: 339932 - protein, 9 aa, Influenza virus
LCPFKGFFP

SEQ ID NO: 339933 - protein, 9 aa, Influenza virus
CPFKGFFPF

SEQ ID NO: 339934 - protein, 9 aa, Influenza virus
PFKGFFPFH

SEQ ID NO: 339935 - protein, 9 aa, Influenza virus
FKGFFPFHK

SEQ ID NO: 339936 - protein, 9 aa, Influenza virus
KGFFPFHKD

SEQ ID NO: 339937 - protein, 9 aa, Influenza virus
FHKDNALRL

SEQ ID NO: 339938 - protein, 9 aa, Influenza virus
HKDNAIRPG

SEQ ID NO: 339939 - protein, 9 aa, Influenza virus
KGNSARLIH

SEQ ID NO: 339940 - protein, 9 aa, Influenza virus
GNSARLIHH

SEQ ID NO: 339941 - protein, 9 aa, Influenza virus
NAIRPGENK

SEQ ID NO: 339942 - protein, 9 aa, Influenza virus
GVIVTREPY

SEQ ID NO: 339943 - protein, 9 aa, Influenza virus
VIITREPYV

SEQ ID NO: 339944 - protein, 9 aa, Influenza virus
IITREPYVS

SEQ ID NO: 339945 - protein, 9 aa, Influenza virus
ITREPYVSC

SEQ ID NO: 339946 - protein, 9 aa, Influenza virus
REPYISCDN

SEQ ID NO: 339947 - protein, 9 aa, Influenza virus
HCWSFALAQ

SEQ ID NO: 339948 - protein, 9 aa, Influenza virus
FALAQGVLL

SEQ ID NO: 339949 - protein, 9 aa, Influenza virus
ALAQGVLLG

SEQ ID NO: 339950 - protein, 9 aa, Influenza virus
LAQGVLLGT

SEQ ID NO: 339951 - protein, 9 aa, Influenza virus
AQGALVGTK

SEQ ID NO: 339952 - protein, 9 aa, Influenza virus
QGALVGTKH

SEQ ID NO: 339953 - protein, 9 aa, Influenza virus
GALVGTKHS

SEQ ID NO: 339954 - protein, 9 aa, Influenza virus
ALVGTKHSN

SEQ ID NO: 339955 - protein, 9 aa, Influenza virus
LLGTNHSNG

SEQ ID NO: 339956 - protein, 9 aa, Influenza virus
VGTKHSNGT

SEQ ID NO: 339957 - protein, 9 aa, Influenza virus
HSNGTIEDR

SEQ ID NO: 339958 - protein, 9 aa, Influenza virus
KDRAPYRSL

SEQ ID NO: 339959 - protein, 9 aa, Influenza virus
DKTPYRSLI

SEQ ID NO: 339960 - protein, 9 aa, Influenza virus
RTSYRSLIR

SEQ ID NO: 339961 - protein, 9 aa, Influenza virus
TSYRSLIRF

SEQ ID NO: 339962 - protein, 9 aa, Influenza virus
SYRSLIRFP

SEQ ID NO: 339963 - protein, 9 aa, Influenza virus
YRSLIQFPI

SEQ ID NO: 339964 - protein, 9 aa, Influenza virus
RSLIQFPMG

SEQ ID NO: 339965 - protein, 9 aa, Influenza virus
SLIQFPMGT

SEQ ID NO: 339966 - protein, 9 aa, Influenza virus
LIQFPIGTA

SEQ ID NO: 339967 - protein, 9 aa, Influenza virus
IQFPIGTAP

SEQ ID NO: 339968 - protein, 9 aa, Influenza virus
FPMGTAPVL

SEQ ID NO: 339969 - protein, 9 aa, Influenza virus
PMGTAPVLG

SEQ ID NO: 339970 - protein, 9 aa, Influenza virus
MGTAPVLGN

SEQ ID NO: 339971 - protein, 9 aa, Influenza virus
GTAPILGNY

SEQ ID NO: 339972 - protein, 9 aa, Influenza virus
TAPVLGNYR

SEQ ID NO: 339973 - protein, 9 aa, Influenza virus
APILGNYKE

SEQ ID NO: 339974 - protein, 9 aa, Influenza virus
PILGNYKEI

SEQ ID NO: 339975 - protein, 9 aa, Influenza virus
ILGNYKEIC

SEQ ID NO: 339976 - protein, 9 aa, Influenza virus
LGNYREICI

SEQ ID NO: 339977 - protein, 9 aa, Influenza virus
GNYREICIA

SEQ ID NO: 339978 - protein, 9 aa, Influenza virus
NYREICIAW

SEQ ID NO: 339979 - protein, 9 aa, Influenza virus
YREICIAWS

SEQ ID NO: 339980 - protein, 9 aa, Influenza virus
REICIAWSS

SEQ ID NO: 339981 - protein, 9 aa, Influenza virus
EICVAWSST

SEQ ID NO: 339982 - protein, 9 aa, Influenza virus
ICVAWSSTS

SEQ ID NO: 339983 - protein, 9 aa, Influenza virus
CVAWSSTSC

SEQ ID NO: 339984 - protein, 9 aa, Influenza virus
VAWSSTSCF

SEQ ID NO: 339985 - protein, 9 aa, Influenza virus
DGKEWMHIC

SEQ ID NO: 339986 - protein, 9 aa, Influenza virus
GKEWLHVCI

SEQ ID NO: 339987 - protein, 9 aa, Influenza virus
KEWMHICMT

SEQ ID NO: 339988 - protein, 9 aa, Influenza virus
EWLHVCITG

SEQ ID NO: 339989 - protein, 9 aa, Influenza virus
GKMRDSIKS

SEQ ID NO: 339990 - protein, 9 aa, Influenza virus
KMRDSIKSW

SEQ ID NO: 339991 - protein, 9 aa, Influenza virus
MADSIKSWR

SEQ ID NO: 339992 - protein, 9 aa, Influenza virus
RDSIKSWRN

SEQ ID NO: 339993 - protein, 9 aa, Influenza virus
TQESECLCI

SEQ ID NO: 339994 - protein, 9 aa, Influenza virus
QESECQCIS

SEQ ID NO: 339995 - protein, 9 aa, Influenza virus
ESECQCISG

SEQ ID NO: 339996 - protein, 9 aa, Influenza virus
GICVVAVTD

SEQ ID NO: 339997 - protein, 9 aa, Influenza virus
ICVVAVTDG

SEQ ID NO: 339998 - protein, 9 aa, Influenza virus
CIVAVTDGP

SEQ ID NO: 339999 - protein, 9 aa, Influenza virus
IVAVTDGPA

SEQ ID NO: 340000 - protein, 9 aa, Influenza virus
VSVTDGPAA

SEQ ID NO: 340001 - protein, 9 aa, Influenza virus
AVTDGPADN

SEQ ID NO: 340002 - protein, 9 aa, Influenza virus
DGPAANSAH

SEQ ID NO: 340003 - protein, 9 aa, Influenza virus
GPAANSAHH

SEQ ID NO: 340004 - protein, 9 aa, Influenza virus
PAANSAHHR

SEQ ID NO: 340005 - protein, 9 aa, Influenza virus
AANNADHRI

SEQ ID NO: 340006 - protein, 9 aa, Influenza virus
ANNADHRIY

SEQ ID NO: 340007 - protein, 9 aa, Influenza virus
NNADHRIYW

SEQ ID NO: 340008 - protein, 9 aa, Influenza virus
NADHRIYWI

SEQ ID NO: 340009 - protein, 9 aa, Influenza virus
AHHRVYWIR

SEQ ID NO: 340010 - protein, 9 aa, Influenza virus
DHRIYWIRK

SEQ ID NO: 340011 - protein, 9 aa, Influenza virus
HRIYWIRKG

SEQ ID NO: 340012 - protein, 9 aa, Influenza virus
RIYWIRKGR

SEQ ID NO: 340013 - protein, 9 aa, Influenza virus
RIQHLEECS

SEQ ID NO: 340014 - protein, 9 aa, Influenza virus
IRHLEECSC

SEQ ID NO: 340015 - protein, 9 aa, Influenza virus
RHLEECSCY

SEQ ID NO: 340016 - protein, 9 aa, Influenza virus
HLEECSCYT

SEQ ID NO: 340017 - protein, 9 aa, Influenza virus
LEECSCYTD

SEQ ID NO: 340018 - protein, 9 aa, Influenza virus
EECSCYVDV

SEQ ID NO: 340019 - protein, 9 aa, Influenza virus
ECSCYVDTD

SEQ ID NO: 340020 - protein, 9 aa, Influenza virus
CSCYMDIDV

SEQ ID NO: 340021 - protein, 9 aa, Influenza virus
SCYMDIDVY

SEQ ID NO: 340022 - protein, 9 aa, Influenza virus
CYMDIDVYC

SEQ ID NO: 340023 - protein, 9 aa, Influenza virus
DIDVYCVCR

SEQ ID NO: 340024 - protein, 9 aa, Influenza virus
IDVYCVCRD

SEQ ID NO: 340025 - protein, 9 aa, Influenza virus
DVYCVCRDN

SEQ ID NO: 340026 - protein, 9 aa, Influenza virus
VYCVCRDNW

SEQ ID NO: 340027 - protein, 9 aa, Influenza virus
WKGSNRPWV

SEQ ID NO: 340028 - protein, 9 aa, Influenza virus
KGSNRPWVR

SEQ ID NO: 340029 - protein, 9 aa, Influenza virus
GSNRPWVRI

SEQ ID NO: 340030 - protein, 9 aa, Influenza virus
SNRPWMRIS

SEQ ID NO: 340031 - protein, 9 aa, Influenza virus
NRPWMRISN

SEQ ID NO: 340032 - protein, 9 aa, Influenza virus
RPWMRISNE

SEQ ID NO: 340033 - protein, 9 aa, Influenza virus
PWMRISNET

SEQ ID NO: 340034 - protein, 9 aa, Influenza virus
WMRISNETI

SEQ ID NO: 340035 - protein, 9 aa, Influenza virus
MRISNETIL

SEQ ID NO: 340036 - protein, 9 aa, Influenza virus
RINNETIVE

SEQ ID NO: 340037 - protein, 9 aa, Influenza virus
INNETIVET

SEQ ID NO: 340038 - protein, 9 aa, Influenza virus
NNETIVETG

SEQ ID NO: 340039 - protein, 9 aa, Influenza virus
ETILETRYV

SEQ ID NO: 340040 - protein, 9 aa, Influenza virus
TILETRYVC

SEQ ID NO: 340041 - protein, 9 aa, Influenza virus
IVETGYVCS

SEQ ID NO: 340042 - protein, 9 aa, Influenza virus
LETGYICSK

SEQ ID NO: 340043 - protein, 9 aa, Influenza virus
FHSDTPRPT

SEQ ID NO: 340044 - protein, 9 aa, Influenza virus
HSDTPRPTD

SEQ ID NO: 340045 - protein, 9 aa, Influenza virus
SDTPRPTDP

SEQ ID NO: 340046 - protein, 9 aa, Influenza virus
DTPRPTDPS

SEQ ID NO: 340047 - protein, 9 aa, Influenza virus
DPSTISCDS

SEQ ID NO: 340048 - protein, 9 aa, Influenza virus
PSTISCDSP

SEQ ID NO: 340049 - protein, 9 aa, Influenza virus
STISCDSPS

SEQ ID NO: 340050 - protein, 9 aa, Influenza virus
TISCDSPSN

SEQ ID NO: 340051 - protein, 9 aa, Influenza virus
SCDSPSNVK

SEQ ID NO: 340052 - protein, 9 aa, Influenza virus
CDSPSNVKG

SEQ ID NO: 340053 - protein, 9 aa, Influenza virus
DSPSNINGE

SEQ ID NO: 340054 - protein, 9 aa, Influenza virus
NGEPGVKGF

SEQ ID NO: 340055 - protein, 9 aa, Influenza virus
GEPGVKGFG

SEQ ID NO: 340056 - protein, 9 aa, Influenza virus
EPGVKGFGF

SEQ ID NO: 340057 - protein, 9 aa, Influenza virus
GVKGFGFKK

SEQ ID NO: 340058 - protein, 9 aa, Influenza virus
VKGFGFKKG

SEQ ID NO: 340059 - protein, 9 aa, Influenza virus
GSDVWLGRT

SEQ ID NO: 340060 - protein, 9 aa, Influenza virus
SDVWLGRTV

SEQ ID NO: 340061 - protein, 9 aa, Influenza virus
VWLGRTVSI

SEQ ID NO: 340062 - protein, 9 aa, Influenza virus
WLGRTVSIS

SEQ ID NO: 340063 - protein, 9 aa, Influenza virus
LGRTVSISG

SEQ ID NO: 340064 - protein, 9 aa, Influenza virus
GRTVSISGR

SEQ ID NO: 340065 - protein, 9 aa, Influenza virus
RTVSINGRS

SEQ ID NO: 340066 - protein, 9 aa, Influenza virus
NGRSGFEVI

SEQ ID NO: 340067 - protein, 9 aa, Influenza virus
RSGFEVIRV

SEQ ID NO: 340068 - protein, 9 aa, Influenza virus
VTDGWINSP

SEQ ID NO: 340069 - protein, 9 aa, Influenza virus
DGWINSPNH

SEQ ID NO: 340070 - protein, 9 aa, Influenza virus
GWINSPSQA

SEQ ID NO: 340071 - protein, 9 aa, Influenza virus
WINSPSQAK

SEQ ID NO: 340072 - protein, 9 aa, Influenza virus
INSPSQAKS

SEQ ID NO: 340073 - protein, 9 aa, Influenza virus
VKSITQTLV

SEQ ID NO: 340074 - protein, 9 aa, Influenza virus
KSLTQTLVS

SEQ ID NO: 340075 - protein, 9 aa, Influenza virus
AATQTLVSN

SEQ ID NO: 340076 - protein, 9 aa, Influenza virus
LTQTLVSNN

SEQ ID NO: 340077 - protein, 9 aa, Influenza virus
SGYSGSFVM

SEQ ID NO: 340078 - protein, 9 aa, Influenza virus
GGCFQPCFY

SEQ ID NO: 340079 - protein, 9 aa, Influenza virus
GCFQPCFYV

SEQ ID NO: 340080 - protein, 9 aa, Influenza virus
QSCFYVELI

SEQ ID NO: 340081 - protein, 9 aa, Influenza virus
PCFYVELTR

SEQ ID NO: 340082 - protein, 9 aa, Influenza virus
FYIELIRGK

SEQ ID NO: 340083 - protein, 9 aa, Influenza virus
YIELIRGKP

SEQ ID NO: 340084 - protein, 9 aa, Influenza virus
IELIRGKPN

SEQ ID NO: 340085 - protein, 9 aa, Influenza virus
NDEVSWTSN

SEQ ID NO: 340086 - protein, 9 aa, Influenza virus
DEVSWTSNS

SEQ ID NO: 340087 - protein, 9 aa, Influenza virus
EVSWTSNSI

SEQ ID NO: 340088 - protein, 9 aa, Influenza virus
LDNEPGSGK

SEQ ID NO: 340089 - protein, 9 aa, Influenza virus
DNEPGSGKL

SEQ ID NO: 340090 - protein, 9 aa, Influenza virus
SGHWPDGSN

SEQ ID NO: 340091 - protein, 9 aa, Influenza virus
GNWPDGANI

SEQ ID NO: 340092 - protein, 9 aa, Influenza virus
HWPDGSNIG

SEQ ID NO: 340093 - protein, 9 aa, Influenza virus
SRGYKMNIQ

SEQ ID NO: 340094 - protein, 9 aa, Influenza virus
RGYKMNIQI

SEQ ID NO: 340095 - protein, 9 aa, Influenza virus
GYKMNTKIL

SEQ ID NO: 340096 - protein, 9 aa, Influenza virus
YKMNTKILV

SEQ ID NO: 340097 - protein, 9 aa, Influenza virus
KMNTQILIF

SEQ ID NO: 340098 - protein, 9 aa, Influenza virus
ADKICLGRH

SEQ ID NO: 340099 - protein, 9 aa, Influenza virus
KISLGHHAV

SEQ ID NO: 340100 - protein, 9 aa, Influenza virus
NGAKVNTLT

SEQ ID NO: 340101 - protein, 9 aa, Influenza virus
GIKVDTLTE

SEQ ID NO: 340102 - protein, 9 aa, Influenza virus
IKVDTLTEK

SEQ ID NO: 340103 - protein, 9 aa, Influenza virus
KVNTLTERE

SEQ ID NO: 340104 - protein, 9 aa, Influenza virus
VNTLTERGI

SEQ ID NO: 340105 - protein, 9 aa, Influenza virus
NTLTERGIE

SEQ ID NO: 340106 - protein, 9 aa, Influenza virus
TLTERGIEV

SEQ ID NO: 340107 - protein, 9 aa, Influenza virus
LTERGIEVV

SEQ ID NO: 340108 - protein, 9 aa, Influenza virus
TERGIEVVN

SEQ ID NO: 340109 - protein, 9 aa, Influenza virus
ERGIEVVNA

SEQ ID NO: 340110 - protein, 9 aa, Influenza virus
RGIEVVNAT

SEQ ID NO: 340111 - protein, 9 aa, Influenza virus
EVEVVNATE

SEQ ID NO: 340112 - protein, 9 aa, Influenza virus
VNATETVET

SEQ ID NO: 340113 - protein, 9 aa, Influenza virus
DLSQCGLLG

SEQ ID NO: 340114 - protein, 9 aa, Influenza virus
LSQCGLLGT

SEQ ID NO: 340115 - protein, 9 aa, Influenza virus
TGPPQCDLF

SEQ ID NO: 340116 - protein, 9 aa, Influenza virus
NLIVERREG

SEQ ID NO: 340117 - protein, 9 aa, Influenza virus
EESLRQILR

SEQ ID NO: 340118 - protein, 9 aa, Influenza virus
LRQILRGSG

SEQ ID NO: 340119 - protein, 9 aa, Influenza virus
RQILRGSGG

SEQ ID NO: 340120 - protein, 9 aa, Influenza virus
TGFTYSGIR

SEQ ID NO: 340121 - protein, 9 aa, Influenza virus
RFTYSGIRT

SEQ ID NO: 340122 - protein, 9 aa, Influenza virus
FTYSGIRTD

SEQ ID NO: 340123 - protein, 9 aa, Influenza virus
TYSGIRTDG

SEQ ID NO: 340124 - protein, 9 aa, Influenza virus
RSESSFYAE

SEQ ID NO: 340125 - protein, 9 aa, Influenza virus
SESSFYAEM

SEQ ID NO: 340126 - protein, 9 aa, Influenza virus
ESSFYAEME

SEQ ID NO: 340127 - protein, 9 aa, Influenza virus
SSFYAEMEW

SEQ ID NO: 340128 - protein, 9 aa, Influenza virus
AEMEWLLSN

SEQ ID NO: 340129 - protein, 9 aa, Influenza virus
FPQMTKSYR

SEQ ID NO: 340130 - protein, 9 aa, Influenza virus
PQMTKSYRN

SEQ ID NO: 340131 - protein, 9 aa, Influenza virus
PALIIWGVH

SEQ ID NO: 340132 - protein, 9 aa, Influenza virus
ALIIWGVHH

SEQ ID NO: 340133 - protein, 9 aa, Influenza virus
EQTKLYGNG

SEQ ID NO: 340134 - protein, 9 aa, Influenza virus
TVWSSKYQQ

SEQ ID NO: 340135 - protein, 9 aa, Influenza virus
VWSSKYQQS

SEQ ID NO: 340136 - protein, 9 aa, Influenza virus
RPQMNGQSG

SEQ ID NO: 340137 - protein, 9 aa, Influenza virus
PQMNGQSGR

SEQ ID NO: 340138 - protein, 9 aa, Influenza virus
QMNGQSGRI

SEQ ID NO: 340139 - protein, 9 aa, Influenza virus
MNGQSGRID

SEQ ID NO: 340140 - protein, 9 aa, Influenza virus
SGRIDFHWM

SEQ ID NO: 340141 - protein, 9 aa, Influenza virus
NDTITFSFN

SEQ ID NO: 340142 - protein, 9 aa, Influenza virus
DTITFSFNG

SEQ ID NO: 340143 - protein, 9 aa, Influenza virus
TITFSFNGA

SEQ ID NO: 340144 - protein, 9 aa, Influenza virus
ITFSFNGAF

SEQ ID NO: 340145 - protein, 9 aa, Influenza virus
TFSFNGAFV

SEQ ID NO: 340146 - protein, 9 aa, Influenza virus
FSFNGAFVA

SEQ ID NO: 340147 - protein, 9 aa, Influenza virus
SFNGAFVAP

SEQ ID NO: 340148 - protein, 9 aa, Influenza virus
FNGAFIAPN

SEQ ID NO: 340149 - protein, 9 aa, Influenza virus
NGAFIAPNR

SEQ ID NO: 340150 - protein, 9 aa, Influenza virus
GAFIAPNRA

SEQ ID NO: 340151 - protein, 9 aa, Influenza virus
AFIAPNRAS

SEQ ID NO: 340152 - protein, 9 aa, Influenza virus
FIAPNRASF

SEQ ID NO: 340153 - protein, 9 aa, Influenza virus
SNLPFQNVN

SEQ ID NO: 340154 - protein, 9 aa, Influenza virus
LPFQNVNSR

SEQ ID NO: 340155 - protein, 9 aa, Influenza virus
PFQNINPRT

SEQ ID NO: 340156 - protein, 9 aa, Influenza virus
VGKCPKYVK

SEQ ID NO: 340157 - protein, 9 aa, Influenza virus
GRCPRYVKQ

SEQ ID NO: 340158 - protein, 9 aa, Influenza virus
SLLLATGMR

SEQ ID NO: 340159 - protein, 9 aa, Influenza virus
LLLATGMRN

SEQ ID NO: 340160 - protein, 9 aa, Influenza virus
LLATGMRNV

SEQ ID NO: 340161 - protein, 9 aa, Influenza virus
IHKQLTHHM

SEQ ID NO: 340162 - protein, 9 aa, Influenza virus
KKKKKRGLF

SEQ ID NO: 340163 - protein, 9 aa, Influenza virus
KRKKRGLFG

SEQ ID NO: 340164 - protein, 9 aa, Influenza virus
KKKRGLFGA

SEQ ID NO: 340165 - protein, 9 aa, Influenza virus
RKRGLFGAI

SEQ ID NO: 340166 - protein, 9 aa, Influenza virus
GLIDGWYGY

SEQ ID NO: 340167 - protein, 9 aa, Influenza virus
LIDGWYGYR

SEQ ID NO: 340168 - protein, 9 aa, Influenza virus
IDGWYGYRH

SEQ ID NO: 340169 - protein, 9 aa, Influenza virus
DGWYGYKHQ

SEQ ID NO: 340170 - protein, 9 aa, Influenza virus
GWYGYKHQN

SEQ ID NO: 340171 - protein, 9 aa, Influenza virus
WYGYKHQNA

SEQ ID NO: 340172 - protein, 9 aa, Influenza virus
YGYKHQNAQ

SEQ ID NO: 340173 - protein, 9 aa, Influenza virus
GFRHQNSQG

SEQ ID NO: 340174 - protein, 9 aa, Influenza virus
FRHQNSQGE

SEQ ID NO: 340175 - protein, 9 aa, Influenza virus
RHQNSQGEG

SEQ ID NO: 340176 - protein, 9 aa, Influenza virus
HQNAQGEGI

SEQ ID NO: 340177 - protein, 9 aa, Influenza virus
QKAQGEGTA

SEQ ID NO: 340178 - protein, 9 aa, Influenza virus
NAQGEGIAA

SEQ ID NO: 340179 - protein, 9 aa, Influenza virus
YKSTQAAID

SEQ ID NO: 340180 - protein, 9 aa, Influenza virus
KSTQSAVNQ

SEQ ID NO: 340181 - protein, 9 aa, Influenza virus
STQSAVNQI

SEQ ID NO: 340182 - protein, 9 aa, Influenza virus
TQSAVNQIT

SEQ ID NO: 340183 - protein, 9 aa, Influenza virus
QSAIDQITR

SEQ ID NO: 340184 - protein, 9 aa, Influenza virus
SAIDQITRK

SEQ ID NO: 340185 - protein, 9 aa, Influenza virus
AIDQITGTL

SEQ ID NO: 340186 - protein, 9 aa, Influenza virus
IDQITRKLN

SEQ ID NO: 340187 - protein, 9 aa, Influenza virus
DQITGTLNR

SEQ ID NO: 340188 - protein, 9 aa, Influenza virus
TGTLNRLID

SEQ ID NO: 340189 - protein, 9 aa, Influenza virus
GKLNRLIER

SEQ ID NO: 340190 - protein, 9 aa, Influenza virus
KLNRLIERT

SEQ ID NO: 340191 - protein, 9 aa, Influenza virus
LNRLIERTN

SEQ ID NO: 340192 - protein, 9 aa, Influenza virus
NRLIERTNQ

SEQ ID NO: 340193 - protein, 9 aa, Influenza virus
RLIERTNQQ

SEQ ID NO: 340194 - protein, 9 aa, Influenza virus
LIERTNQQF

SEQ ID NO: 340195 - protein, 9 aa, Influenza virus
IERTNQQFE

SEQ ID NO: 340196 - protein, 9 aa, Influenza virus
ERTNQQFEL

SEQ ID NO: 340197 - protein, 9 aa, Influenza virus
KTNQQFEMI

SEQ ID NO: 340198 - protein, 9 aa, Influenza virus
QQFELIDNK

SEQ ID NO: 340199 - protein, 9 aa, Influenza virus
QFELIDNKF

SEQ ID NO: 340200 - protein, 9 aa, Influenza virus
FELIDNEFS

SEQ ID NO: 340201 - protein, 9 aa, Influenza virus
ELIDNEFSE

SEQ ID NO: 340202 - protein, 9 aa, Influenza virus
IDNEFSEIE

SEQ ID NO: 340203 - protein, 9 aa, Influenza virus
EIEQQIGNV

SEQ ID NO: 340204 - protein, 9 aa, Influenza virus
IEQQIGNVI

SEQ ID NO: 340205 - protein, 9 aa, Influenza virus
ERQIGNVIN

SEQ ID NO: 340206 - protein, 9 aa, Influenza virus
RQIGNVINW

SEQ ID NO: 340207 - protein, 9 aa, Influenza virus
VINWTRDSL

SEQ ID NO: 340208 - protein, 9 aa, Influenza virus
INWTRDSII

SEQ ID NO: 340209 - protein, 9 aa, Influenza virus
NWTRDSIIE

SEQ ID NO: 340210 - protein, 9 aa, Influenza virus
IEIWSYNAE

SEQ ID NO: 340211 - protein, 9 aa, Influenza virus
EIWSYNAEF

SEQ ID NO: 340212 - protein, 9 aa, Influenza virus
IWSYNAEFL

SEQ ID NO: 340213 - protein, 9 aa, Influenza virus
WSYNADLLV

SEQ ID NO: 340214 - protein, 9 aa, Influenza virus
SYNAELLIA

SEQ ID NO: 340215 - protein, 9 aa, Influenza virus
YNADLLVAM

SEQ ID NO: 340216 - protein, 9 aa, Influenza virus
NAELLIAME

SEQ ID NO: 340217 - protein, 9 aa, Influenza virus
ADLLVAMEN

SEQ ID NO: 340218 - protein, 9 aa, Influenza virus
ELLIAMENQ

SEQ ID NO: 340219 - protein, 9 aa, Influenza virus
LLIAMENQH

SEQ ID NO: 340220 - protein, 9 aa, Influenza virus
LIAMENQHT

SEQ ID NO: 340221 - protein, 9 aa, Influenza virus
IAMENQHTI

SEQ ID NO: 340222 - protein, 9 aa, Influenza virus
MENQHIIDL

SEQ ID NO: 340223 - protein, 9 aa, Influenza virus
ENQHIIDLA

SEQ ID NO: 340224 - protein, 9 aa, Influenza virus
NQHTIDSTD

SEQ ID NO: 340225 - protein, 9 aa, Influenza virus
QHTIDLTNS

SEQ ID NO: 340226 - protein, 9 aa, Influenza virus
HTIDLAESE

SEQ ID NO: 340227 - protein, 9 aa, Influenza virus
IIDLADSEM

SEQ ID NO: 340228 - protein, 9 aa, Influenza virus
IDLTNSEMN

SEQ ID NO: 340229 - protein, 9 aa, Influenza virus
DSTDSEMNK

SEQ ID NO: 340230 - protein, 9 aa, Influenza virus
LTNSEMNKL

SEQ ID NO: 340231 - protein, 9 aa, Influenza virus
AESEMNKLY

SEQ ID NO: 340232 - protein, 9 aa, Influenza virus
MNKLYEKVR

SEQ ID NO: 340233 - protein, 9 aa, Influenza virus
NKLYEKVRR

SEQ ID NO: 340234 - protein, 9 aa, Influenza virus
KLYEKVRRQ

SEQ ID NO: 340235 - protein, 9 aa, Influenza virus
LYEKVRRQL

SEQ ID NO: 340236 - protein, 9 aa, Influenza virus
YEKVRRQLR

SEQ ID NO: 340237 - protein, 9 aa, Influenza virus
EKVRRQLRE

SEQ ID NO: 340238 - protein, 9 aa, Influenza virus
KVRRQLREN

SEQ ID NO: 340239 - protein, 9 aa, Influenza virus
VRKQLRENA

SEQ ID NO: 340240 - protein, 9 aa, Influenza virus
RKQLRENAE

SEQ ID NO: 340241 - protein, 9 aa, Influenza virus
RENAEEDCT

SEQ ID NO: 340242 - protein, 9 aa, Influenza virus
ENAEEDCTG

SEQ ID NO: 340243 - protein, 9 aa, Influenza virus
NAEEDCTGC

SEQ ID NO: 340244 - protein, 9 aa, Influenza virus
AEEDCTGCF

SEQ ID NO: 340245 - protein, 9 aa, Influenza virus
EEDCTGCFE

SEQ ID NO: 340246 - protein, 9 aa, Influenza virus
EDCTGCFEI

SEQ ID NO: 340247 - protein, 9 aa, Influenza virus
DCTGCFEIF

SEQ ID NO: 340248 - protein, 9 aa, Influenza virus
CTGCFEIFH

SEQ ID NO: 340249 - protein, 9 aa, Influenza virus
TACFEIFHK

SEQ ID NO: 340250 - protein, 9 aa, Influenza virus
GCFELFHKC

SEQ ID NO: 340251 - protein, 9 aa, Influenza virus
EIFHKCDDQ

SEQ ID NO: 340252 - protein, 9 aa, Influenza virus
IFHKCDDQC

SEQ ID NO: 340253 - protein, 9 aa, Influenza virus
FHKCDDQCM

SEQ ID NO: 340254 - protein, 9 aa, Influenza virus
CMTSIRNNT

SEQ ID NO: 340255 - protein, 9 aa, Influenza virus
MTSIRNNTY

SEQ ID NO: 340256 - protein, 9 aa, Influenza virus
ANIRNNTYD

SEQ ID NO: 340257 - protein, 9 aa, Influenza virus
IRNNTYDHT

SEQ ID NO: 340258 - protein, 9 aa, Influenza virus
RNNTYDHTQ

SEQ ID NO: 340259 - protein, 9 aa, Influenza virus
NNTYDHTQY

SEQ ID NO: 340260 - protein, 9 aa, Influenza virus
NTYDHTQYR

SEQ ID NO: 340261 - protein, 9 aa, Influenza virus
QNRVKIDPV

SEQ ID NO: 340262 - protein, 9 aa, Influenza virus
VKIDPVKLS

SEQ ID NO: 340263 - protein, 9 aa, Influenza virus
INPVKLSSG

SEQ ID NO: 340264 - protein, 9 aa, Influenza virus
NPVKLSSGY

SEQ ID NO: 340265 - protein, 9 aa, Influenza virus
PVELSSGYK

SEQ ID NO: 340266 - protein, 9 aa, Influenza virus
VKLSGGYKD

SEQ ID NO: 340267 - protein, 9 aa, Influenza virus
KLSGGYKDV

SEQ ID NO: 340268 - protein, 9 aa, Influenza virus
LSGGYKDVI

SEQ ID NO: 340269 - protein, 9 aa, Influenza virus
SGGYKDVIL

SEQ ID NO: 340270 - protein, 9 aa, Influenza virus
SGYKEVILW

SEQ ID NO: 340271 - protein, 9 aa, Influenza virus
GYKEVILWF

SEQ ID NO: 340272 - protein, 9 aa, Influenza virus
YKEVILWFS

SEQ ID NO: 340273 - protein, 9 aa, Influenza virus
KDVILWFSL

SEQ ID NO: 340274 - protein, 9 aa, Influenza virus
DVILWFSLG

SEQ ID NO: 340275 - protein, 9 aa, Influenza virus
VILWFSLGA

SEQ ID NO: 340276 - protein, 9 aa, Influenza virus
FSFGASCFT

SEQ ID NO: 340277 - protein, 9 aa, Influenza virus
SFGASCFLF

SEQ ID NO: 340278 - protein, 9 aa, Influenza virus
GASCFLFLA

SEQ ID NO: 340279 - protein, 9 aa, Influenza virus
ASCFLFLAI

SEQ ID NO: 340280 - protein, 9 aa, Influenza virus
LAFICIKNG

SEQ ID NO: 340281 - protein, 9 aa, Influenza virus
VFICIKNGN

SEQ ID NO: 340282 - protein, 9 aa, Influenza virus
FICIKNGNM

SEQ ID NO: 340283 - protein, 9 aa, Influenza virus
ICIKNGNMR

SEQ ID NO: 340284 - protein, 9 aa, Influenza virus
CVKNGNMQC

SEQ ID NO: 340285 - protein, 9 aa, Influenza virus
VKNGNMQCT

SEQ ID NO: 340286 - protein, 9 aa, Influenza virus
KNGNHAVHY

SEQ ID NO: 340287 - protein, 9 aa, Influenza virus
NGNHAVHYC

SEQ ID NO: 340288 - protein, 9 aa, Influenza virus
GNMRCTSCI

SEQ ID NO: 340289 - protein, 9 aa, Influenza virus
MNPNQKLFT

SEQ ID NO: 340290 - protein, 9 aa, Influenza virus
NPSQKLFAL

SEQ ID NO: 340291 - protein, 9 aa, Influenza virus
PSQKLFALS

SEQ ID NO: 340292 - protein, 9 aa, Influenza virus
SQKLFALSG

SEQ ID NO: 340293 - protein, 9 aa, Influenza virus
QKLFTLSGV

SEQ ID NO: 340294 - protein, 9 aa, Influenza virus
KLFTLSGVA

SEQ ID NO: 340295 - protein, 9 aa, Influenza virus
LFTLSGVAI

SEQ ID NO: 340296 - protein, 9 aa, Influenza virus
FASSGIAIA

SEQ ID NO: 340297 - protein, 9 aa, Influenza virus
ASSGIAIAL

SEQ ID NO: 340298 - protein, 9 aa, Influenza virus
SSGIAIALG

SEQ ID NO: 340299 - protein, 9 aa, Influenza virus
SGIAIVLGI

SEQ ID NO: 340300 - protein, 9 aa, Influenza virus
GIAIVLGII

SEQ ID NO: 340301 - protein, 9 aa, Influenza virus
IAIVLGIIN

SEQ ID NO: 340302 - protein, 9 aa, Influenza virus
AIVLGIINL

SEQ ID NO: 340303 - protein, 9 aa, Influenza virus
IVLGIINLL

SEQ ID NO: 340304 - protein, 9 aa, Influenza virus
VLGIINLLI

SEQ ID NO: 340305 - protein, 9 aa, Influenza virus
LGIINLLIG

SEQ ID NO: 340306 - protein, 9 aa, Influenza virus
GIINLLIGI

SEQ ID NO: 340307 - protein, 9 aa, Influenza virus
IINLLIGIS

SEQ ID NO: 340308 - protein, 9 aa, Influenza virus
LNLLIGVSN

SEQ ID NO: 340309 - protein, 9 aa, Influenza virus
NLLIGVSNV

SEQ ID NO: 340310 - protein, 9 aa, Influenza virus
LLIGVSNVG

SEQ ID NO: 340311 - protein, 9 aa, Influenza virus
LIGVSNVGL

SEQ ID NO: 340312 - protein, 9 aa, Influenza virus
IGVSNVGLN

SEQ ID NO: 340313 - protein, 9 aa, Influenza virus
SNVVLNVSL

SEQ ID NO: 340314 - protein, 9 aa, Influenza virus
NVVLNVSLH

SEQ ID NO: 340315 - protein, 9 aa, Influenza virus
VVLNVSLHL

SEQ ID NO: 340316 - protein, 9 aa, Influenza virus
VLNVSLHLK

SEQ ID NO: 340317 - protein, 9 aa, Influenza virus
ENKYVNNTT

SEQ ID NO: 340318 - protein, 9 aa, Influenza virus
NTYINNATI

SEQ ID NO: 340319 - protein, 9 aa, Influenza virus
TYINNATII

SEQ ID NO: 340320 - protein, 9 aa, Influenza virus
GYLLLNKSL

SEQ ID NO: 340321 - protein, 9 aa, Influenza virus
LLLNKSLCS

SEQ ID NO: 340322 - protein, 9 aa, Influenza virus
LLNKSLCSV

SEQ ID NO: 340323 - protein, 9 aa, Influenza virus
LNKSLCSVE

SEQ ID NO: 340324 - protein, 9 aa, Influenza virus
NKSLCSVEG

SEQ ID NO: 340325 - protein, 9 aa, Influenza virus
KSLCSVEGW

SEQ ID NO: 340326 - protein, 9 aa, Influenza virus
SLCSVEGWV

SEQ ID NO: 340327 - protein, 9 aa, Influenza virus
LCSVEGWVV

SEQ ID NO: 340328 - protein, 9 aa, Influenza virus
CNVEGWVVV

SEQ ID NO: 340329 - protein, 9 aa, Influenza virus
VEGWVVIAQ

SEQ ID NO: 340330 - protein, 9 aa, Influenza virus
EGWVVIEKD

SEQ ID NO: 340331 - protein, 9 aa, Influenza virus
GWVVIEKDN

SEQ ID NO: 340332 - protein, 9 aa, Influenza virus
WVVIAQDNA

SEQ ID NO: 340333 - protein, 9 aa, Influenza virus
VVIAKDNAI

SEQ ID NO: 340334 - protein, 9 aa, Influenza virus
VIAKDNAIR

SEQ ID NO: 340335 - protein, 9 aa, Influenza virus
IAKDNAIRF

SEQ ID NO: 340336 - protein, 9 aa, Influenza virus
EKDNAVRFG

SEQ ID NO: 340337 - protein, 9 aa, Influenza virus
QDNAIRFGE

SEQ ID NO: 340338 - protein, 9 aa, Influenza virus
IRFGESEQV

SEQ ID NO: 340339 - protein, 9 aa, Influenza virus
RFGESEQIV

SEQ ID NO: 340340 - protein, 9 aa, Influenza virus
FGESEQIVV

SEQ ID NO: 340341 - protein, 9 aa, Influenza virus
GESEQIVVT

SEQ ID NO: 340342 - protein, 9 aa, Influenza virus
ESEQIVVTR

SEQ ID NO: 340343 - protein, 9 aa, Influenza virus
SEQIVVTRE

SEQ ID NO: 340344 - protein, 9 aa, Influenza virus
EQIVVTREP

SEQ ID NO: 340345 - protein, 9 aa, Influenza virus
QIVVTREPY

SEQ ID NO: 340346 - protein, 9 aa, Influenza virus
IVVTREPYV

SEQ ID NO: 340347 - protein, 9 aa, Influenza virus
EPYVSCDPS

SEQ ID NO: 340348 - protein, 9 aa, Influenza virus
GCRMYALHQ

SEQ ID NO: 340349 - protein, 9 aa, Influenza virus
RNKHSNGTT

SEQ ID NO: 340350 - protein, 9 aa, Influenza virus
NKHSNGTTH

SEQ ID NO: 340351 - protein, 9 aa, Influenza virus
KHSNGTTHD

SEQ ID NO: 340352 - protein, 9 aa, Influenza virus
HSNGTTHDR

SEQ ID NO: 340353 - protein, 9 aa, Influenza virus
SNGTTHDRT

SEQ ID NO: 340354 - protein, 9 aa, Influenza virus
NGTTHDRTA

SEQ ID NO: 340355 - protein, 9 aa, Influenza virus
GTTHDRTAF

SEQ ID NO: 340356 - protein, 9 aa, Influenza virus
TIHDRTTFR

SEQ ID NO: 340357 - protein, 9 aa, Influenza virus
IHDRTTFRG

SEQ ID NO: 340358 - protein, 9 aa, Influenza virus
HDRAAFRGL

SEQ ID NO: 340359 - protein, 9 aa, Influenza virus
DRTTFRGLI

SEQ ID NO: 340360 - protein, 9 aa, Influenza virus
RTTFRGLIS

SEQ ID NO: 340361 - protein, 9 aa, Influenza virus
TTFRGLIST

SEQ ID NO: 340362 - protein, 9 aa, Influenza virus
FRGLISTQL

SEQ ID NO: 340363 - protein, 9 aa, Influenza virus
RGLISTQLG

SEQ ID NO: 340364 - protein, 9 aa, Influenza virus
SNSDFICVG

SEQ ID NO: 340365 - protein, 9 aa, Influenza virus
NSDFLCVGW

SEQ ID NO: 340366 - protein, 9 aa, Influenza virus
SDFLCVGWS

SEQ ID NO: 340367 - protein, 9 aa, Influenza virus
DFICVGWSS

SEQ ID NO: 340368 - protein, 9 aa, Influenza virus
FLCVGWSST

SEQ ID NO: 340369 - protein, 9 aa, Influenza virus
LCVGWSSTS

SEQ ID NO: 340370 - protein, 9 aa, Influenza virus
SSTSCHDGV

SEQ ID NO: 340371 - protein, 9 aa, Influenza virus
CHDGVNRMT

SEQ ID NO: 340372 - protein, 9 aa, Influenza virus
HDGIARMTI

SEQ ID NO: 340373 - protein, 9 aa, Influenza virus
DGIARMTIC

SEQ ID NO: 340374 - protein, 9 aa, Influenza virus
ARMTICIQG

SEQ ID NO: 340375 - protein, 9 aa, Influenza virus
RMTICVQGD

SEQ ID NO: 340376 - protein, 9 aa, Influenza virus
MTICVQGDN

SEQ ID NO: 340377 - protein, 9 aa, Influenza virus
QGNNENATA

SEQ ID NO: 340378 - protein, 9 aa, Influenza virus
GNNENATAT

SEQ ID NO: 340379 - protein, 9 aa, Influenza virus
NNENATATV

SEQ ID NO: 340380 - protein, 9 aa, Influenza virus
NNNATATVY

SEQ ID NO: 340381 - protein, 9 aa, Influenza virus
NNATATVYY

SEQ ID NO: 340382 - protein, 9 aa, Influenza virus
ATATVYYNK

SEQ ID NO: 340383 - protein, 9 aa, Influenza virus
TATVYYNKR

SEQ ID NO: 340384 - protein, 9 aa, Influenza virus
ATVYYNKRL

SEQ ID NO: 340385 - protein, 9 aa, Influenza virus
TVYYNKRLT

SEQ ID NO: 340386 - protein, 9 aa, Influenza virus
VYYNKRLTT

SEQ ID NO: 340387 - protein, 9 aa, Influenza virus
YYNKRLTTT

SEQ ID NO: 340388 - protein, 9 aa, Influenza virus
YNKRLTTTI

SEQ ID NO: 340389 - protein, 9 aa, Influenza virus
GRLTTTIKT

SEQ ID NO: 340390 - protein, 9 aa, Influenza virus
RLTTTVKTW

SEQ ID NO: 340391 - protein, 9 aa, Influenza virus
LTTTVKTWA

SEQ ID NO: 340392 - protein, 9 aa, Influenza virus
TTTIKTWAG

SEQ ID NO: 340393 - protein, 9 aa, Influenza virus
TTIKTWAGN

SEQ ID NO: 340394 - protein, 9 aa, Influenza virus
TIKTWAGNI

SEQ ID NO: 340395 - protein, 9 aa, Influenza virus
IKTWAGNIL

SEQ ID NO: 340396 - protein, 9 aa, Influenza virus
KTWAGNILR

SEQ ID NO: 340397 - protein, 9 aa, Influenza virus
TWAGNILRT

SEQ ID NO: 340398 - protein, 9 aa, Influenza virus
WAGNILRTQ

SEQ ID NO: 340399 - protein, 9 aa, Influenza virus
AGNILRTQE

SEQ ID NO: 340400 - protein, 9 aa, Influenza virus
GNILRTQES

SEQ ID NO: 340401 - protein, 9 aa, Influenza virus
RTQDSECVS

SEQ ID NO: 340402 - protein, 9 aa, Influenza virus
TQDSECVSH

SEQ ID NO: 340403 - protein, 9 aa, Influenza virus
QDSECVSHN

SEQ ID NO: 340404 - protein, 9 aa, Influenza virus
ESECVRHNG

SEQ ID NO: 340405 - protein, 9 aa, Influenza virus
SECVSHNGT

SEQ ID NO: 340406 - protein, 9 aa, Influenza virus
ECVRHNGTC

SEQ ID NO: 340407 - protein, 9 aa, Influenza virus
CVCHNSTCV

SEQ ID NO: 340408 - protein, 9 aa, Influenza virus
VCHNSTCVV

SEQ ID NO: 340409 - protein, 9 aa, Influenza virus
HNGTCVVIM

SEQ ID NO: 340410 - protein, 9 aa, Influenza virus
NGTCVVIMT

SEQ ID NO: 340411 - protein, 9 aa, Influenza virus
GTCVVIMTD

SEQ ID NO: 340412 - protein, 9 aa, Influenza virus
TCVVIMTDG

SEQ ID NO: 340413 - protein, 9 aa, Influenza virus
VVIMTDGSA

SEQ ID NO: 340414 - protein, 9 aa, Influenza virus
VIMTDGSAS

SEQ ID NO: 340415 - protein, 9 aa, Influenza virus
IMTDGSASS

SEQ ID NO: 340416 - protein, 9 aa, Influenza virus
MTDGPASSQ

SEQ ID NO: 340417 - protein, 9 aa, Influenza virus
TDGPASSQA

SEQ ID NO: 340418 - protein, 9 aa, Influenza virus
LRGSARHIE

SEQ ID NO: 340419 - protein, 9 aa, Influenza virus
RGSARHIEE

SEQ ID NO: 340420 - protein, 9 aa, Influenza virus
GSARHIEEW

SEQ ID NO: 340421 - protein, 9 aa, Influenza virus
SARHIEEWS

SEQ ID NO: 340422 - protein, 9 aa, Influenza virus
ARHIEEWSC

SEQ ID NO: 340423 - protein, 9 aa, Influenza virus
RHIEEWSCY

SEQ ID NO: 340424 - protein, 9 aa, Influenza virus
EECSCYGHD

SEQ ID NO: 340425 - protein, 9 aa, Influenza virus
ITCVCRDNW

SEQ ID NO: 340426 - protein, 9 aa, Influenza virus
TCGCRDNWQ

SEQ ID NO: 340427 - protein, 9 aa, Influenza virus
RPIIEIDMT

SEQ ID NO: 340428 - protein, 9 aa, Influenza virus
MEHTSQYLC

SEQ ID NO: 340429 - protein, 9 aa, Influenza virus
EHTSQYLCT

SEQ ID NO: 340430 - protein, 9 aa, Influenza virus
HTSQYLCTG

SEQ ID NO: 340431 - protein, 9 aa, Influenza virus
YICTGVLTD

SEQ ID NO: 340432 - protein, 9 aa, Influenza virus
ICTGVLTDT

SEQ ID NO: 340433 - protein, 9 aa, Influenza virus
VLTDTSRPK

SEQ ID NO: 340434 - protein, 9 aa, Influenza virus
LTDTSRPKD

SEQ ID NO: 340435 - protein, 9 aa, Influenza virus
TDTSRPKDK

SEQ ID NO: 340436 - protein, 9 aa, Influenza virus
GECFNPITG

SEQ ID NO: 340437 - protein, 9 aa, Influenza virus
ECFNPITGS

SEQ ID NO: 340438 - protein, 9 aa, Influenza virus
CFNPITGSP

SEQ ID NO: 340439 - protein, 9 aa, Influenza virus
FNPITGSPG

SEQ ID NO: 340440 - protein, 9 aa, Influenza virus
NPITGSPCA

SEQ ID NO: 340441 - protein, 9 aa, Influenza virus
PITGSPGSP

SEQ ID NO: 340442 - protein, 9 aa, Influenza virus
ITGSPGSPG

SEQ ID NO: 340443 - protein, 9 aa, Influenza virus
VPGVKGFGF

SEQ ID NO: 340444 - protein, 9 aa, Influenza virus
PGTKGFGFL

SEQ ID NO: 340445 - protein, 9 aa, Influenza virus
GIKGFGFLN

SEQ ID NO: 340446 - protein, 9 aa, Influenza virus
IKGFGFLNE

SEQ ID NO: 340447 - protein, 9 aa, Influenza virus
SNTWLGRTI

SEQ ID NO: 340448 - protein, 9 aa, Influenza virus
LGRTISPKL

SEQ ID NO: 340449 - protein, 9 aa, Influenza virus
GRTISPKLR

SEQ ID NO: 340450 - protein, 9 aa, Influenza virus
RTISPKLRS

SEQ ID NO: 340451 - protein, 9 aa, Influenza virus
TISPKLRSG

SEQ ID NO: 340452 - protein, 9 aa, Influenza virus
ISPKLRSGF

SEQ ID NO: 340453 - protein, 9 aa, Influenza virus
SPKLRSGFE

SEQ ID NO: 340454 - protein, 9 aa, Influenza virus
PKLRSGFEM

SEQ ID NO: 340455 - protein, 9 aa, Influenza virus
KLRSGFEML

SEQ ID NO: 340456 - protein, 9 aa, Influenza virus
SRSGFEMLR

SEQ ID NO: 340457 - protein, 9 aa, Influenza virus
RSGFEMLRI

SEQ ID NO: 340458 - protein, 9 aa, Influenza virus
NGFEMLKIP

SEQ ID NO: 340459 - protein, 9 aa, Influenza virus
GFEMLRIPN

SEQ ID NO: 340460 - protein, 9 aa, Influenza virus
FEMLRIPNA

SEQ ID NO: 340461 - protein, 9 aa, Influenza virus
EMLRIPNAG

SEQ ID NO: 340462 - protein, 9 aa, Influenza virus
MLKIPNAGI

SEQ ID NO: 340463 - protein, 9 aa, Influenza virus
LKIPNAGID

SEQ ID NO: 340464 - protein, 9 aa, Influenza virus
KIPNAGIDP

SEQ ID NO: 340465 - protein, 9 aa, Influenza virus
RQEIVGNDN

SEQ ID NO: 340466 - protein, 9 aa, Influenza virus
QEIVGNDNW

SEQ ID NO: 340467 - protein, 9 aa, Influenza virus
EIVGNDNWS

SEQ ID NO: 340468 - protein, 9 aa, Influenza virus
IVGNDNWSG

SEQ ID NO: 340469 - protein, 9 aa, Influenza virus
VGNDNWSGY

SEQ ID NO: 340470 - protein, 9 aa, Influenza virus
GNDNWSGYS

SEQ ID NO: 340471 - protein, 9 aa, Influenza virus
NSNWSGYSG

SEQ ID NO: 340472 - protein, 9 aa, Influenza virus
SNWSGYSGS

SEQ ID NO: 340473 - protein, 9 aa, Influenza virus
GSFIDYWDD

SEQ ID NO: 340474 - protein, 9 aa, Influenza virus
EEAKYVWWA

SEQ ID NO: 340475 - protein, 9 aa, Influenza virus
EAKYVWWAS

SEQ ID NO: 340476 - protein, 9 aa, Influenza virus
AKYVWWASN

SEQ ID NO: 340477 - protein, 9 aa, Influenza virus
KYVWWASNS

SEQ ID NO: 340478 - protein, 9 aa, Influenza virus
YVWWASNSL

SEQ ID NO: 340479 - protein, 9 aa, Influenza virus
VEWTSNSLI

SEQ ID NO: 340480 - protein, 9 aa, Influenza virus
EWTSNSLIA

SEQ ID NO: 340481 - protein, 9 aa, Influenza virus
WASNSLIAL

SEQ ID NO: 340482 - protein, 9 aa, Influenza virus
ASNSLIALC

SEQ ID NO: 340483 - protein, 9 aa, Influenza virus
PVGPGSFPD

SEQ ID NO: 340484 - protein, 9 aa, Influenza virus
IGSGFFPDG

SEQ ID NO: 340485 - protein, 9 aa, Influenza virus
GSGFFPDGP

SEQ ID NO: 340486 - protein, 9 aa, Influenza virus
SGFFPDGPQ

SEQ ID NO: 340487 - protein, 9 aa, Influenza virus
FFPDGPQIQ

SEQ ID NO: 340488 - protein, 9 aa, Influenza virus
FPDGPQIQY

SEQ ID NO: 340489 - protein, 9 aa, Influenza virus
PDGPQIQYF

SEQ ID NO: 340490 - protein, 9 aa, Influenza virus
DGPQIQYFS

SEQ ID NO: 340491 - protein, 9 aa, Influenza virus
LLMSTNAYD

SEQ ID NO: 340492 - protein, 9 aa, Influenza virus
LASTNAHDR

SEQ ID NO: 340493 - protein, 9 aa, Influenza virus
MSTNAYDRI

SEQ ID NO: 340494 - protein, 9 aa, Influenza virus
SNNSTDTVD

SEQ ID NO: 340495 - protein, 9 aa, Influenza virus
NNSTNTVNT

SEQ ID NO: 340496 - protein, 9 aa, Influenza virus
NSTNTVNTL

SEQ ID NO: 340497 - protein, 9 aa, Influenza virus
STDTVDTLI

SEQ ID NO: 340498 - protein, 9 aa, Influenza virus
TDTVNTLTE

SEQ ID NO: 340499 - protein, 9 aa, Influenza virus
DTVNTLMEQ

SEQ ID NO: 340500 - protein, 9 aa, Influenza virus
TVNTLIEQK

SEQ ID NO: 340501 - protein, 9 aa, Influenza virus
TLIEQKVPV

SEQ ID NO: 340502 - protein, 9 aa, Influenza virus
LIEQKVPVT

SEQ ID NO: 340503 - protein, 9 aa, Influenza virus
MEQNVPVTQ

SEQ ID NO: 340504 - protein, 9 aa, Influenza virus
EQKVPVTQT

SEQ ID NO: 340505 - protein, 9 aa, Influenza virus
QNIPVTQTM

SEQ ID NO: 340506 - protein, 9 aa, Influenza virus
NIPVTQTME

SEQ ID NO: 340507 - protein, 9 aa, Influenza virus
IPVTQTMEL

SEQ ID NO: 340508 - protein, 9 aa, Influenza virus
TQAMELVEA

SEQ ID NO: 340509 - protein, 9 aa, Influenza virus
QAMELVEAE

SEQ ID NO: 340510 - protein, 9 aa, Influenza virus
AMELVEAEK

SEQ ID NO: 340511 - protein, 9 aa, Influenza virus
MELVETKKH

SEQ ID NO: 340512 - protein, 9 aa, Influenza virus
KKHPAYCNT

SEQ ID NO: 340513 - protein, 9 aa, Influenza virus
KNPAYCNTD

SEQ ID NO: 340514 - protein, 9 aa, Influenza virus
HLAYCNTDL

SEQ ID NO: 340515 - protein, 9 aa, Influenza virus
LAYCNTDLG

SEQ ID NO: 340516 - protein, 9 aa, Influenza virus
AYCNTDLGS

SEQ ID NO: 340517 - protein, 9 aa, Influenza virus
YCNTDLGSP

SEQ ID NO: 340518 - protein, 9 aa, Influenza virus
CNTDLGSPL

SEQ ID NO: 340519 - protein, 9 aa, Influenza virus
NTDLGSPLE

SEQ ID NO: 340520 - protein, 9 aa, Influenza virus
TDLGSPLEL

SEQ ID NO: 340521 - protein, 9 aa, Influenza virus
DLGSPLELR

SEQ ID NO: 340522 - protein, 9 aa, Influenza virus
LGSPLELRD

SEQ ID NO: 340523 - protein, 9 aa, Influenza virus
GSPLELRDC

SEQ ID NO: 340524 - protein, 9 aa, Influenza virus
SPLELRDCK

SEQ ID NO: 340525 - protein, 9 aa, Influenza virus
IYGNPKCDT

SEQ ID NO: 340526 - protein, 9 aa, Influenza virus
YGNPKCDTH

SEQ ID NO: 340527 - protein, 9 aa, Influenza virus
GNPKCDTHL

SEQ ID NO: 340528 - protein, 9 aa, Influenza virus
NPKCDTHLK

SEQ ID NO: 340529 - protein, 9 aa, Influenza virus
PKCDTHLKD

SEQ ID NO: 340530 - protein, 9 aa, Influenza virus
KCDTHLKDQ

SEQ ID NO: 340531 - protein, 9 aa, Influenza virus
HLKDQDWSY

SEQ ID NO: 340532 - protein, 9 aa, Influenza virus
LKDQSWSYI

SEQ ID NO: 340533 - protein, 9 aa, Influenza virus
KDQSWSYIV

SEQ ID NO: 340534 - protein, 9 aa, Influenza virus
DQDWSYIVE

SEQ ID NO: 340535 - protein, 9 aa, Influenza virus
QSWSYIVER

SEQ ID NO: 340536 - protein, 9 aa, Influenza virus
DWSYIVERP

SEQ ID NO: 340537 - protein, 9 aa, Influenza virus
EGMCYPGFV

SEQ ID NO: 340538 - protein, 9 aa, Influenza virus
GMCYPGFVE

SEQ ID NO: 340539 - protein, 9 aa, Influenza virus
MCYPGFVEN

SEQ ID NO: 340540 - protein, 9 aa, Influenza virus
CYPGFVENL

SEQ ID NO: 340541 - protein, 9 aa, Influenza virus
YPGFVENLE

SEQ ID NO: 340542 - protein, 9 aa, Influenza virus
PGFVENLEE

SEQ ID NO: 340543 - protein, 9 aa, Influenza virus
GFVENLEEL

SEQ ID NO: 340544 - protein, 9 aa, Influenza virus
FVENLEELR

SEQ ID NO: 340545 - protein, 9 aa, Influenza virus
EELRFVFSI

SEQ ID NO: 340546 - protein, 9 aa, Influenza virus
ELRFVFSIA

SEQ ID NO: 340547 - protein, 9 aa, Influenza virus
LRFVFSIAA

SEQ ID NO: 340548 - protein, 9 aa, Influenza virus
RFVFSIAAS

SEQ ID NO: 340549 - protein, 9 aa, Influenza virus
FVFSIAASY

SEQ ID NO: 340550 - protein, 9 aa, Influenza virus
VFSIAASYK

SEQ ID NO: 340551 - protein, 9 aa, Influenza virus
FSIAASYKR

SEQ ID NO: 340552 - protein, 9 aa, Influenza virus
SIAASYKRI

SEQ ID NO: 340553 - protein, 9 aa, Influenza virus
IAASYKRIR

SEQ ID NO: 340554 - protein, 9 aa, Influenza virus
RVRLFDYSR

SEQ ID NO: 340555 - protein, 9 aa, Influenza virus
IRLFDYSGW

SEQ ID NO: 340556 - protein, 9 aa, Influenza virus
RLFDYSGWN

SEQ ID NO: 340557 - protein, 9 aa, Influenza virus
LFDYSGWNV

SEQ ID NO: 340558 - protein, 9 aa, Influenza virus
FDYSKWNVS

SEQ ID NO: 340559 - protein, 9 aa, Influenza virus
WNVSSSGTS

SEQ ID NO: 340560 - protein, 9 aa, Influenza virus
NVSSSGTSK

SEQ ID NO: 340561 - protein, 9 aa, Influenza virus
VSSSGTSKA

SEQ ID NO: 340562 - protein, 9 aa, Influenza virus
SSSGTSKAC

SEQ ID NO: 340563 - protein, 9 aa, Influenza virus
SSGTSKACS

SEQ ID NO: 340564 - protein, 9 aa, Influenza virus
GTSKACNAL

SEQ ID NO: 340565 - protein, 9 aa, Influenza virus
TSKACNALT

SEQ ID NO: 340566 - protein, 9 aa, Influenza virus
SKACNALTG

SEQ ID NO: 340567 - protein, 9 aa, Influenza virus
KACNALTGG

SEQ ID NO: 340568 - protein, 9 aa, Influenza virus
ACNALTGGQ

SEQ ID NO: 340569 - protein, 9 aa, Influenza virus
CSASTGGQS

SEQ ID NO: 340570 - protein, 9 aa, Influenza virus
SASTGGQSF

SEQ ID NO: 340571 - protein, 9 aa, Influenza virus
ALTGGQSFY

SEQ ID NO: 340572 - protein, 9 aa, Influenza virus
LTGGQSFYR

SEQ ID NO: 340573 - protein, 9 aa, Influenza virus
TGAQSFYRS

SEQ ID NO: 340574 - protein, 9 aa, Influenza virus
GAQSFYRSI

SEQ ID NO: 340575 - protein, 9 aa, Influenza virus
AQSFYRSIN

SEQ ID NO: 340576 - protein, 9 aa, Influenza virus
INWLTKKEP

SEQ ID NO: 340577 - protein, 9 aa, Influenza virus
NWLTKKEPD

SEQ ID NO: 340578 - protein, 9 aa, Influenza virus
WLTKKKPDI

SEQ ID NO: 340579 - protein, 9 aa, Influenza virus
LTKKEPDTY

SEQ ID NO: 340580 - protein, 9 aa, Influenza virus
TKKKPDIYD

SEQ ID NO: 340581 - protein, 9 aa, Influenza virus
KKKPDIYDF

SEQ ID NO: 340582 - protein, 9 aa, Influenza virus
KEPDTYDFN

SEQ ID NO: 340583 - protein, 9 aa, Influenza virus
EPDTYDFNE

SEQ ID NO: 340584 - protein, 9 aa, Influenza virus
PDIYDFNEG

SEQ ID NO: 340585 - protein, 9 aa, Influenza virus
DTYDFNEGA

SEQ ID NO: 340586 - protein, 9 aa, Influenza virus
TYDFNEGAY

SEQ ID NO: 340587 - protein, 9 aa, Influenza virus
FNEGTYVNN

SEQ ID NO: 340588 - protein, 9 aa, Influenza virus
NNKDGDIIF

SEQ ID NO: 340589 - protein, 9 aa, Influenza virus
NENGDIIFL

SEQ ID NO: 340590 - protein, 9 aa, Influenza virus
KDGDIIFLW

SEQ ID NO: 340591 - protein, 9 aa, Influenza virus
EGDIIFLWG

SEQ ID NO: 340592 - protein, 9 aa, Influenza virus
WGIHHPPNT

SEQ ID NO: 340593 - protein, 9 aa, Influenza virus
GIHHPPNTK

SEQ ID NO: 340594 - protein, 9 aa, Influenza virus
IHHPPNTKE

SEQ ID NO: 340595 - protein, 9 aa, Influenza virus
HHPPNTKEQ

SEQ ID NO: 340596 - protein, 9 aa, Influenza virus
HPPNTKEQT

SEQ ID NO: 340597 - protein, 9 aa, Influenza virus
AKEQTALYK

SEQ ID NO: 340598 - protein, 9 aa, Influenza virus
TEQTKLYKN

SEQ ID NO: 340599 - protein, 9 aa, Influenza virus
EQTKLYKNT

SEQ ID NO: 340600 - protein, 9 aa, Influenza virus
QTKLYKNTN

SEQ ID NO: 340601 - protein, 9 aa, Influenza virus
TKLYKNTNT

SEQ ID NO: 340602 - protein, 9 aa, Influenza virus
KLYKNTNTL

SEQ ID NO: 340603 - protein, 9 aa, Influenza virus
LYKNANTLT

SEQ ID NO: 340604 - protein, 9 aa, Influenza virus
YKNANTLTS

SEQ ID NO: 340605 - protein, 9 aa, Influenza virus
KNANTLTSV

SEQ ID NO: 340606 - protein, 9 aa, Influenza virus
NANTLSSVN

SEQ ID NO: 340607 - protein, 9 aa, Influenza virus
ANTLSSVNT

SEQ ID NO: 340608 - protein, 9 aa, Influenza virus
NTLTSVTTN

SEQ ID NO: 340609 - protein, 9 aa, Influenza virus
TLTSVTTNT

SEQ ID NO: 340610 - protein, 9 aa, Influenza virus
LTSVTTNTI

SEQ ID NO: 340611 - protein, 9 aa, Influenza virus
TSVTTNTIN

SEQ ID NO: 340612 - protein, 9 aa, Influenza virus
VNTNTINRS

SEQ ID NO: 340613 - protein, 9 aa, Influenza virus
NTNTINRSF

SEQ ID NO: 340614 - protein, 9 aa, Influenza virus
TNTINRSFR

SEQ ID NO: 340615 - protein, 9 aa, Influenza virus
NTINRSFRP

SEQ ID NO: 340616 - protein, 9 aa, Influenza virus
TINRIFQPN

SEQ ID NO: 340617 - protein, 9 aa, Influenza virus
INRIFQPNI

SEQ ID NO: 340618 - protein, 9 aa, Influenza virus
NRSFRPNIG

SEQ ID NO: 340619 - protein, 9 aa, Influenza virus
RSFRPNIGP

SEQ ID NO: 340620 - protein, 9 aa, Influenza virus
SFRPNIGPR

SEQ ID NO: 340621 - protein, 9 aa, Influenza virus
FQPNIGPRA

SEQ ID NO: 340622 - protein, 9 aa, Influenza virus
QPNIGPRAL

SEQ ID NO: 340623 - protein, 9 aa, Influenza virus
IGPRALVRG

SEQ ID NO: 340624 - protein, 9 aa, Influenza virus
GPRALVRGQ

SEQ ID NO: 340625 - protein, 9 aa, Influenza virus
PRALVRGQQ

SEQ ID NO: 340626 - protein, 9 aa, Influenza virus
RPLVREQQG

SEQ ID NO: 340627 - protein, 9 aa, Influenza virus
PLVRGQQGW

SEQ ID NO: 340628 - protein, 9 aa, Influenza virus
LVREQQGRM

SEQ ID NO: 340629 - protein, 9 aa, Influenza virus
VRGQQGTMD

SEQ ID NO: 340630 - protein, 9 aa, Influenza virus
RGQQGTMDY

SEQ ID NO: 340631 - protein, 9 aa, Influenza virus
GQQGWMDYY

SEQ ID NO: 340632 - protein, 9 aa, Influenza virus
QQGTMDYYW

SEQ ID NO: 340633 - protein, 9 aa, Influenza virus
QGTMDYYWG

SEQ ID NO: 340634 - protein, 9 aa, Influenza virus
GWMDYYWGI

SEQ ID NO: 340635 - protein, 9 aa, Influenza virus
WMDYYWGIL

SEQ ID NO: 340636 - protein, 9 aa, Influenza virus
GYLLRGESH

SEQ ID NO: 340637 - protein, 9 aa, Influenza virus
YLLRGESHG

SEQ ID NO: 340638 - protein, 9 aa, Influenza virus
LLRGESHGR

SEQ ID NO: 340639 - protein, 9 aa, Influenza virus
GESHCRIIQ

SEQ ID NO: 340640 - protein, 9 aa, Influenza virus
ESHCRIIQN

SEQ ID NO: 340641 - protein, 9 aa, Influenza virus
SHCRIIQNE

SEQ ID NO: 340642 - protein, 9 aa, Influenza virus
HGRTIQNED

SEQ ID NO: 340643 - protein, 9 aa, Influenza virus
GKIIQNEDI

SEQ ID NO: 340644 - protein, 9 aa, Influenza virus
RTIQNEDIP

SEQ ID NO: 340645 - protein, 9 aa, Influenza virus
QNEDIPIEN

SEQ ID NO: 340646 - protein, 9 aa, Influenza virus
NEDIPIENC

SEQ ID NO: 340647 - protein, 9 aa, Influenza virus
SCHTKCQTY

SEQ ID NO: 340648 - protein, 9 aa, Influenza virus
CYTKCQTYA

SEQ ID NO: 340649 - protein, 9 aa, Influenza virus
HTKCQTYTG

SEQ ID NO: 340650 - protein, 9 aa, Influenza virus
KCQTYAGAV

SEQ ID NO: 340651 - protein, 9 aa, Influenza virus
CQTYAGAVN

SEQ ID NO: 340652 - protein, 9 aa, Influenza virus
QTYAGAVNS

SEQ ID NO: 340653 - protein, 9 aa, Influenza virus
TYAGAVNSS

SEQ ID NO: 340654 - protein, 9 aa, Influenza virus
YAGAINSSR

SEQ ID NO: 340655 - protein, 9 aa, Influenza virus
AGAINSSRP

SEQ ID NO: 340656 - protein, 9 aa, Influenza virus
GAINSSKPL

SEQ ID NO: 340657 - protein, 9 aa, Influenza virus
AVNSSKPFQ

SEQ ID NO: 340658 - protein, 9 aa, Influenza virus
VNSSKPFQN

SEQ ID NO: 340659 - protein, 9 aa, Influenza virus
NSSKPFQNT

SEQ ID NO: 340660 - protein, 9 aa, Influenza virus
SSKPLQNAS

SEQ ID NO: 340661 - protein, 9 aa, Influenza virus
SKPFQNTSR

SEQ ID NO: 340662 - protein, 9 aa, Influenza virus
KPLQNASRH

SEQ ID NO: 340663 - protein, 9 aa, Influenza virus
PFQNTSRHY

SEQ ID NO: 340664 - protein, 9 aa, Influenza virus
LQNASRHYM

SEQ ID NO: 340665 - protein, 9 aa, Influenza virus
QNASRYYMG

SEQ ID NO: 340666 - protein, 9 aa, Influenza virus
NASRHHMGE

SEQ ID NO: 340667 - protein, 9 aa, Influenza virus
TSRHYMGEC

SEQ ID NO: 340668 - protein, 9 aa, Influenza virus
SRYYMGECP

SEQ ID NO: 340669 - protein, 9 aa, Influenza virus
RYYMGECPK

SEQ ID NO: 340670 - protein, 9 aa, Influenza virus
HHMGECPKY

SEQ ID NO: 340671 - protein, 9 aa, Influenza virus
HMGECPKYV

SEQ ID NO: 340672 - protein, 9 aa, Influenza virus
MGECPEYVK

SEQ ID NO: 340673 - protein, 9 aa, Influenza virus
GECPNYVKK

SEQ ID NO: 340674 - protein, 9 aa, Influenza virus
YVRKASLRL

SEQ ID NO: 340675 - protein, 9 aa, Influenza virus
VRKASLRLA

SEQ ID NO: 340676 - protein, 9 aa, Influenza virus
RKASLRLAV

SEQ ID NO: 340677 - protein, 9 aa, Influenza virus
KESLRLALG

SEQ ID NO: 340678 - protein, 9 aa, Influenza virus
ESLRLALGL

SEQ ID NO: 340679 - protein, 9 aa, Influenza virus
SLRLAIGLR

SEQ ID NO: 340680 - protein, 9 aa, Influenza virus
LRLAIGLRN

SEQ ID NO: 340681 - protein, 9 aa, Influenza virus
RLAIGLRNT

SEQ ID NO: 340682 - protein, 9 aa, Influenza virus
LAIGLRNTP

SEQ ID NO: 340683 - protein, 9 aa, Influenza virus
AIGLRNTPS

SEQ ID NO: 340684 - protein, 9 aa, Influenza virus
LGLRNTPSI

SEQ ID NO: 340685 - protein, 9 aa, Influenza virus
GLRNTPSID

SEQ ID NO: 340686 - protein, 9 aa, Influenza virus
LRNTPSIDP

SEQ ID NO: 340687 - protein, 9 aa, Influenza virus
RNTPSVEPK

SEQ ID NO: 340688 - protein, 9 aa, Influenza virus
NTPSVEPKG

SEQ ID NO: 340689 - protein, 9 aa, Influenza virus
TPSVEPRGL

SEQ ID NO: 340690 - protein, 9 aa, Influenza virus
PSVEPKGLF

SEQ ID NO: 340691 - protein, 9 aa, Influenza virus
SVEPRGLFG

SEQ ID NO: 340692 - protein, 9 aa, Influenza virus
VEPKGLFGA

SEQ ID NO: 340693 - protein, 9 aa, Influenza virus
DPKGLFGAI

SEQ ID NO: 340694 - protein, 9 aa, Influenza virus
QKSTQEAIE

SEQ ID NO: 340695 - protein, 9 aa, Influenza virus
KSTQEAIGK

SEQ ID NO: 340696 - protein, 9 aa, Influenza virus
STQEAIEKI

SEQ ID NO: 340697 - protein, 9 aa, Influenza virus
TQEAINKIT

SEQ ID NO: 340698 - protein, 9 aa, Influenza virus
QEAIEKITN

SEQ ID NO: 340699 - protein, 9 aa, Influenza virus
EAIGKITNK

SEQ ID NO: 340700 - protein, 9 aa, Influenza virus
AIGKITNKV

SEQ ID NO: 340701 - protein, 9 aa, Influenza virus
INKITNKVN

SEQ ID NO: 340702 - protein, 9 aa, Influenza virus
NKITNKVNN

SEQ ID NO: 340703 - protein, 9 aa, Influenza virus
KMNREFEVM

SEQ ID NO: 340704 - protein, 9 aa, Influenza virus
MNREFEVMN

SEQ ID NO: 340705 - protein, 9 aa, Influenza virus
NREFEVMNH

SEQ ID NO: 340706 - protein, 9 aa, Influenza virus
REFEVMNHE

SEQ ID NO: 340707 - protein, 9 aa, Influenza virus
EFEVMNHEF

SEQ ID NO: 340708 - protein, 9 aa, Influenza virus
FEVMNHEFS

SEQ ID NO: 340709 - protein, 9 aa, Influenza virus
EKRTNMIND

SEQ ID NO: 340710 - protein, 9 aa, Influenza virus
KRINVINDK

SEQ ID NO: 340711 - protein, 9 aa, Influenza virus
RINMISDKI

SEQ ID NO: 340712 - protein, 9 aa, Influenza virus
INVINDKID

SEQ ID NO: 340713 - protein, 9 aa, Influenza virus
NMISDKIDD

SEQ ID NO: 340714 - protein, 9 aa, Influenza virus
VINDKIDDQ

SEQ ID NO: 340715 - protein, 9 aa, Influenza virus
ISDKIDDQI

SEQ ID NO: 340716 - protein, 9 aa, Influenza virus
SDKIDDQIE

SEQ ID NO: 340717 - protein, 9 aa, Influenza virus
DKIDDQIEG

SEQ ID NO: 340718 - protein, 9 aa, Influenza virus
KIDDQIENL

SEQ ID NO: 340719 - protein, 9 aa, Influenza virus
IDDQIEGLW

SEQ ID NO: 340720 - protein, 9 aa, Influenza virus
DDQIENLWA

SEQ ID NO: 340721 - protein, 9 aa, Influenza virus
DQIEGLWAY

SEQ ID NO: 340722 - protein, 9 aa, Influenza virus
QIEGLWAYN

SEQ ID NO: 340723 - protein, 9 aa, Influenza virus
IEGLWAYNA

SEQ ID NO: 340724 - protein, 9 aa, Influenza virus
ENLWAYNAE

SEQ ID NO: 340725 - protein, 9 aa, Influenza virus
NLWAYNAEL

SEQ ID NO: 340726 - protein, 9 aa, Influenza virus
LENQKILDE

SEQ ID NO: 340727 - protein, 9 aa, Influenza virus
ENQKTLDKH

SEQ ID NO: 340728 - protein, 9 aa, Influenza virus
NQKTLDKHD

SEQ ID NO: 340729 - protein, 9 aa, Influenza virus
QKTLDKHDS

SEQ ID NO: 340730 - protein, 9 aa, Influenza virus
KILDEHDSN

SEQ ID NO: 340731 - protein, 9 aa, Influenza virus
TLDKHDSNV

SEQ ID NO: 340732 - protein, 9 aa, Influenza virus
LDEHDSNVE

SEQ ID NO: 340733 - protein, 9 aa, Influenza virus
DKHDSNVKN

SEQ ID NO: 340734 - protein, 9 aa, Influenza virus
EHDSNVENL

SEQ ID NO: 340735 - protein, 9 aa, Influenza virus
VENLFDEVR

SEQ ID NO: 340736 - protein, 9 aa, Influenza virus
ENLFDEVRR

SEQ ID NO: 340737 - protein, 9 aa, Influenza virus
DEVRRRLSA

SEQ ID NO: 340738 - protein, 9 aa, Influenza virus
EVRRRLSAN

SEQ ID NO: 340739 - protein, 9 aa, Influenza virus
VRRRLSANA

SEQ ID NO: 340740 - protein, 9 aa, Influenza virus
RRLSTNAMD

SEQ ID NO: 340741 - protein, 9 aa, Influenza virus
NAMDAGNGC

SEQ ID NO: 340742 - protein, 9 aa, Influenza virus
AMDAGNGCF

SEQ ID NO: 340743 - protein, 9 aa, Influenza virus
MDAGNGCFD

SEQ ID NO: 340744 - protein, 9 aa, Influenza virus
DTGKGCFDI

SEQ ID NO: 340745 - protein, 9 aa, Influenza virus
TGKGCFDIL

SEQ ID NO: 340746 - protein, 9 aa, Influenza virus
DILHKCDNK

SEQ ID NO: 340747 - protein, 9 aa, Influenza virus
ILHKCDNKC

SEQ ID NO: 340748 - protein, 9 aa, Influenza virus
LHKCDNKCM

SEQ ID NO: 340749 - protein, 9 aa, Influenza virus
HKCDNKCME

SEQ ID NO: 340750 - protein, 9 aa, Influenza virus
KCDNKCMET

SEQ ID NO: 340751 - protein, 9 aa, Influenza virus
CDNKCMETI

SEQ ID NO: 340752 - protein, 9 aa, Influenza virus
DNKCMETIK

SEQ ID NO: 340753 - protein, 9 aa, Influenza virus
TIKNGTYNR

SEQ ID NO: 340754 - protein, 9 aa, Influenza virus
IKNGTYNRK

SEQ ID NO: 340755 - protein, 9 aa, Influenza virus
KNGTYNRKE

SEQ ID NO: 340756 - protein, 9 aa, Influenza virus
NGTYNHKDY

SEQ ID NO: 340757 - protein, 9 aa, Influenza virus
GTYNRKEYE

SEQ ID NO: 340758 - protein, 9 aa, Influenza virus
TYNRKEYEE

SEQ ID NO: 340759 - protein, 9 aa, Influenza virus
YNHKDYEEE

SEQ ID NO: 340760 - protein, 9 aa, Influenza virus
NRKEYEEEA

SEQ ID NO: 340761 - protein, 9 aa, Influenza virus
RKEYEEEAK

SEQ ID NO: 340762 - protein, 9 aa, Influenza virus
KLEKSRING

SEQ ID NO: 340763 - protein, 9 aa, Influenza virus
LERSKINEV

SEQ ID NO: 340764 - protein, 9 aa, Influenza virus
ERSKINEVK

SEQ ID NO: 340765 - protein, 9 aa, Influenza virus
RSKINGVRL

SEQ ID NO: 340766 - protein, 9 aa, Influenza virus
SKINEVKLE

SEQ ID NO: 340767 - protein, 9 aa, Influenza virus
KINGVRLEE

SEQ ID NO: 340768 - protein, 9 aa, Influenza virus
INEVKLEEN

SEQ ID NO: 340769 - protein, 9 aa, Influenza virus
NEVKLEENT

SEQ ID NO: 340770 - protein, 9 aa, Influenza virus
GVILEENTT

SEQ ID NO: 340771 - protein, 9 aa, Influenza virus
VKLEENTSY

SEQ ID NO: 340772 - protein, 9 aa, Influenza virus
KLEENTTYR

SEQ ID NO: 340773 - protein, 9 aa, Influenza virus
LEENTTYRI

SEQ ID NO: 340774 - protein, 9 aa, Influenza virus
EENTSYKIL

SEQ ID NO: 340775 - protein, 9 aa, Influenza virus
ENTTYRILS

SEQ ID NO: 340776 - protein, 9 aa, Influenza virus
NTSYKILSI

SEQ ID NO: 340777 - protein, 9 aa, Influenza virus
TTYRILSIY

SEQ ID NO: 340778 - protein, 9 aa, Influenza virus
TYRILSIYS

SEQ ID NO: 340779 - protein, 9 aa, Influenza virus
ASLCLAILV

SEQ ID NO: 340780 - protein, 9 aa, Influenza virus
SLCLAVLIA

SEQ ID NO: 340781 - protein, 9 aa, Influenza virus
LCLAVLIAG

SEQ ID NO: 340782 - protein, 9 aa, Influenza virus
CLAILVAGG

SEQ ID NO: 340783 - protein, 9 aa, Influenza virus
LAILVAGGL

SEQ ID NO: 340784 - protein, 9 aa, Influenza virus
AVLIAGGLI

SEQ ID NO: 340785 - protein, 9 aa, Influenza virus
VLIAGGLIL

SEQ ID NO: 340786 - protein, 9 aa, Influenza virus
GYLSTNSTE

SEQ ID NO: 340787 - protein, 9 aa, Influenza virus
YQSTNSTEA

SEQ ID NO: 340788 - protein, 9 aa, Influenza virus
LSTNSTETV

SEQ ID NO: 340789 - protein, 9 aa, Influenza virus
TNSTEAVDT

SEQ ID NO: 340790 - protein, 9 aa, Influenza virus
EHNGLLCAT

SEQ ID NO: 340791 - protein, 9 aa, Influenza virus
VEGLIYGNP

SEQ ID NO: 340792 - protein, 9 aa, Influenza virus
EGLVYGNPA

SEQ ID NO: 340793 - protein, 9 aa, Influenza virus
GLVYGNPAC

SEQ ID NO: 340794 - protein, 9 aa, Influenza virus
LVYGNPACD

SEQ ID NO: 340795 - protein, 9 aa, Influenza virus
WSYIVERPT

SEQ ID NO: 340796 - protein, 9 aa, Influenza virus
SYIVERPTA

SEQ ID NO: 340797 - protein, 9 aa, Influenza virus
FYRGMRWLT

SEQ ID NO: 340798 - protein, 9 aa, Influenza virus
VLRPGQTLR

SEQ ID NO: 340799 - protein, 9 aa, Influenza virus
LRPGQTLRV

SEQ ID NO: 340800 - protein, 9 aa, Influenza virus
KPGQTLRVK

SEQ ID NO: 340801 - protein, 9 aa, Influenza virus
PGQTLRVKS

SEQ ID NO: 340802 - protein, 9 aa, Influenza virus
GQTLRVRSD

SEQ ID NO: 340803 - protein, 9 aa, Influenza virus
QTLRVRSDG

SEQ ID NO: 340804 - protein, 9 aa, Influenza virus
TLRVRSDGN

SEQ ID NO: 340805 - protein, 9 aa, Influenza virus
LRVRSDGNL

SEQ ID NO: 340806 - protein, 9 aa, Influenza virus
VRSDGNLIA

SEQ ID NO: 340807 - protein, 9 aa, Influenza virus
KSNGNLIAP

SEQ ID NO: 340808 - protein, 9 aa, Influenza virus
SNGNLIAPL

SEQ ID NO: 340809 - protein, 9 aa, Influenza virus
DGNLIAPWY

SEQ ID NO: 340810 - protein, 9 aa, Influenza virus
GNLIAPLYG

SEQ ID NO: 340811 - protein, 9 aa, Influenza virus
NLIAPWYGY

SEQ ID NO: 340812 - protein, 9 aa, Influenza virus
LPFHNISKY

SEQ ID NO: 340813 - protein, 9 aa, Influenza virus
FHNISKYAF

SEQ ID NO: 340814 - protein, 9 aa, Influenza virus
HNISKYAFG

SEQ ID NO: 340815 - protein, 9 aa, Influenza virus
SLKLAVGMR

SEQ ID NO: 340816 - protein, 9 aa, Influenza virus
LKLAVGMRN

SEQ ID NO: 340817 - protein, 9 aa, Influenza virus
IEGGWSGLI

SEQ ID NO: 340818 - protein, 9 aa, Influenza virus
EGGWSGLIA

SEQ ID NO: 340819 - protein, 9 aa, Influenza virus
GGWSGLIAG

SEQ ID NO: 340820 - protein, 9 aa, Influenza virus
GWSGLIAGW

SEQ ID NO: 340821 - protein, 9 aa, Influenza virus
WSGLIAGWY

SEQ ID NO: 340822 - protein, 9 aa, Influenza virus
SGLIAGWYG

SEQ ID NO: 340823 - protein, 9 aa, Influenza virus
WYGFQHSNE

SEQ ID NO: 340824 - protein, 9 aa, Influenza virus
YGFQHSNEQ

SEQ ID NO: 340825 - protein, 9 aa, Influenza virus
GFQHSNEQG

SEQ ID NO: 340826 - protein, 9 aa, Influenza virus
DQIQNIWAY

SEQ ID NO: 340827 - protein, 9 aa, Influenza virus
QIQNIWAYN

SEQ ID NO: 340828 - protein, 9 aa, Influenza virus
IQNIWAYNA

SEQ ID NO: 340829 - protein, 9 aa, Influenza virus
QNIWAYNAE

SEQ ID NO: 340830 - protein, 9 aa, Influenza virus
NIWAYNAEL

SEQ ID NO: 340831 - protein, 9 aa, Influenza virus
LWAYNAELL

SEQ ID NO: 340832 - protein, 9 aa, Influenza virus
ELLVLIENQ

SEQ ID NO: 340833 - protein, 9 aa, Influenza virus
LLVLIENQK

SEQ ID NO: 340834 - protein, 9 aa, Influenza virus
LVLIENQKT

SEQ ID NO: 340835 - protein, 9 aa, Influenza virus
VLIENQKTL

SEQ ID NO: 340836 - protein, 9 aa, Influenza virus
LIENQKTLD

SEQ ID NO: 340837 - protein, 9 aa, Influenza virus
IENQKTLDE

SEQ ID NO: 340838 - protein, 9 aa, Influenza virus
ENQKPLDEH

SEQ ID NO: 340839 - protein, 9 aa, Influenza virus
NQKPLDEHD

SEQ ID NO: 340840 - protein, 9 aa, Influenza virus
EDGKGCFDL

SEQ ID NO: 340841 - protein, 9 aa, Influenza virus
DGKGCFDLY

SEQ ID NO: 340842 - protein, 9 aa, Influenza virus
GKGCFDLYH

SEQ ID NO: 340843 - protein, 9 aa, Influenza virus
KGCFDLYHK

SEQ ID NO: 340844 - protein, 9 aa, Influenza virus
GCFELYHRC

SEQ ID NO: 340845 - protein, 9 aa, Influenza virus
CFELYHRCD

SEQ ID NO: 340846 - protein, 9 aa, Influenza virus
CMGTIRNGT

SEQ ID NO: 340847 - protein, 9 aa, Influenza virus
MGTIRNGTY

SEQ ID NO: 340848 - protein, 9 aa, Influenza virus
EETYKILTI

SEQ ID NO: 340849 - protein, 9 aa, Influenza virus
ETYKILTIY

SEQ ID NO: 340850 - protein, 9 aa, Influenza virus
AYKILTIYS

SEQ ID NO: 340851 - protein, 9 aa, Influenza virus
ILSIYSTVA

SEQ ID NO: 340852 - protein, 9 aa, Influenza virus
SIYSTVASS

SEQ ID NO: 340853 - protein, 9 aa, Influenza virus
IYSTVASSI

SEQ ID NO: 340854 - protein, 9 aa, Influenza virus
GYLSTNSTE

SEQ ID NO: 340855 - protein, 9 aa, Influenza virus
YQSTNSTEA

SEQ ID NO: 340856 - protein, 9 aa, Influenza virus
LSTNSTETV

SEQ ID NO: 340857 - protein, 9 aa, Influenza virus
TNSTEAVDT

SEQ ID NO: 340858 - protein, 9 aa, Influenza virus
EHNGLLCAT

SEQ ID NO: 340859 - protein, 9 aa, Influenza virus
VEGLIYGNP

SEQ ID NO: 340860 - protein, 9 aa, Influenza virus
EGLVYGNPA

SEQ ID NO: 340861 - protein, 9 aa, Influenza virus
GLVYGNPAC

SEQ ID NO: 340862 - protein, 9 aa, Influenza virus
LVYGNPACD

SEQ ID NO: 340863 - protein, 9 aa, Influenza virus
WSYIVERPT

SEQ ID NO: 340864 - protein, 9 aa, Influenza virus
SYIVERPTA

SEQ ID NO: 340865 - protein, 9 aa, Influenza virus
FYRGMRWLT

SEQ ID NO: 340866 - protein, 9 aa, Influenza virus
SILKPGQTL

SEQ ID NO: 340867 - protein, 9 aa, Influenza virus
VLRPGQTLR

SEQ ID NO: 340868 - protein, 9 aa, Influenza virus
LRPGQTLRV

SEQ ID NO: 340869 - protein, 9 aa, Influenza virus
KPGQTLRVK

SEQ ID NO: 340870 - protein, 9 aa, Influenza virus
PGQTLRVKS

SEQ ID NO: 340871 - protein, 9 aa, Influenza virus
GQTLRVRSD

SEQ ID NO: 340872 - protein, 9 aa, Influenza virus
QTLRVRSDG

SEQ ID NO: 340873 - protein, 9 aa, Influenza virus
TLRVRSDGN

SEQ ID NO: 340874 - protein, 9 aa, Influenza virus
LRVRSDGNL

SEQ ID NO: 340875 - protein, 9 aa, Influenza virus
VRSDGNLIA

SEQ ID NO: 340876 - protein, 9 aa, Influenza virus
KSNGNLIAP

SEQ ID NO: 340877 - protein, 9 aa, Influenza virus
SNGNLIAPL

SEQ ID NO: 340878 - protein, 9 aa, Influenza virus
DGNLIAPWY

SEQ ID NO: 340879 - protein, 9 aa, Influenza virus
GNLIAPLYG

SEQ ID NO: 340880 - protein, 9 aa, Influenza virus
NLIAPLYGH

SEQ ID NO: 340881 - protein, 9 aa, Influenza virus
LPFHNISKY

SEQ ID NO: 340882 - protein, 9 aa, Influenza virus
FHNISKYAF

SEQ ID NO: 340883 - protein, 9 aa, Influenza virus
HNISKYAFG

SEQ ID NO: 340884 - protein, 9 aa, Influenza virus
YAFGTCPKY

SEQ ID NO: 340885 - protein, 9 aa, Influenza virus
SLKLAVGMR

SEQ ID NO: 340886 - protein, 9 aa, Influenza virus
LKLAVGMRN

SEQ ID NO: 340887 - protein, 9 aa, Influenza virus
IEGGWSGLI

SEQ ID NO: 340888 - protein, 9 aa, Influenza virus
EGGWSGLIA

SEQ ID NO: 340889 - protein, 9 aa, Influenza virus
GGWSGLIAG

SEQ ID NO: 340890 - protein, 9 aa, Influenza virus
GWSGLIAGW

SEQ ID NO: 340891 - protein, 9 aa, Influenza virus
WSGLIAGWY

SEQ ID NO: 340892 - protein, 9 aa, Influenza virus
SGLIAGWYG

SEQ ID NO: 340893 - protein, 9 aa, Influenza virus
WYGFQHSNE

SEQ ID NO: 340894 - protein, 9 aa, Influenza virus
YGFQHSNEQ

SEQ ID NO: 340895 - protein, 9 aa, Influenza virus
GFQHSNEQG

SEQ ID NO: 340896 - protein, 9 aa, Influenza virus
DDQIQNIWA

SEQ ID NO: 340897 - protein, 9 aa, Influenza virus
DQIQNIWAY

SEQ ID NO: 340898 - protein, 9 aa, Influenza virus
QIQNIWAYN

SEQ ID NO: 340899 - protein, 9 aa, Influenza virus
IQNIWAYNA

SEQ ID NO: 340900 - protein, 9 aa, Influenza virus
QNIWAYNAE

SEQ ID NO: 340901 - protein, 9 aa, Influenza virus
NIWAYNAEL

SEQ ID NO: 340902 - protein, 9 aa, Influenza virus
LWAYNAELL

SEQ ID NO: 340903 - protein, 9 aa, Influenza virus
LLVLIENQK

SEQ ID NO: 340904 - protein, 9 aa, Influenza virus
LVLIENQKT

SEQ ID NO: 340905 - protein, 9 aa, Influenza virus
VLIENQKTL

SEQ ID NO: 340906 - protein, 9 aa, Influenza virus
LIENQKTLD

SEQ ID NO: 340907 - protein, 9 aa, Influenza virus
IENQKTLDE

SEQ ID NO: 340908 - protein, 9 aa, Influenza virus
NQKTLDEHV

SEQ ID NO: 340909 - protein, 9 aa, Influenza virus
QKTLDEHVA

SEQ ID NO: 340910 - protein, 9 aa, Influenza virus
KTLDEHEAN

SEQ ID NO: 340911 - protein, 9 aa, Influenza virus
LDEHDANAN

SEQ ID NO: 340912 - protein, 9 aa, Influenza virus
EDGKGCFDL

SEQ ID NO: 340913 - protein, 9 aa, Influenza virus
DGKGCFDLY

SEQ ID NO: 340914 - protein, 9 aa, Influenza virus
GKGCFDLYH

SEQ ID NO: 340915 - protein, 9 aa, Influenza virus
KGCFDLYHK

SEQ ID NO: 340916 - protein, 9 aa, Influenza virus
GCFELYHRC

SEQ ID NO: 340917 - protein, 9 aa, Influenza virus
CFELYHRCD

SEQ ID NO: 340918 - protein, 9 aa, Influenza virus
CMGTIRNGT

SEQ ID NO: 340919 - protein, 9 aa, Influenza virus
MGTIRNGTY

SEQ ID NO: 340920 - protein, 9 aa, Influenza virus
EETYKILTI

SEQ ID NO: 340921 - protein, 9 aa, Influenza virus
ETYKILTIY

SEQ ID NO: 340922 - protein, 9 aa, Influenza virus
AYKILTIYS

SEQ ID NO: 340923 - protein, 9 aa, Influenza virus
ILSIYSTVA

SEQ ID NO: 340924 - protein, 9 aa, Influenza virus
SIYSTVASS

SEQ ID NO: 340925 - protein, 9 aa, Influenza virus
IYSTVASSI

SEQ ID NO: 340926 - protein, 9 aa, Influenza virus
WSKPQCLIT

SEQ ID NO: 340927 - protein, 9 aa, Influenza virus
SKPQCQIAG

SEQ ID NO: 340928 - protein, 9 aa, Influenza virus
KPQCQIAGF

SEQ ID NO: 340929 - protein, 9 aa, Influenza virus
PQCLITGFA

SEQ ID NO: 340930 - protein, 9 aa, Influenza virus
QCQIAGFAP

SEQ ID NO: 340931 - protein, 9 aa, Influenza virus
RLSAGGSIW

SEQ ID NO: 340932 - protein, 9 aa, Influenza virus
ITREPYVSC

SEQ ID NO: 340933 - protein, 9 aa, Influenza virus
RCYQFALGQ

SEQ ID NO: 340934 - protein, 9 aa, Influenza virus
NQFALGQGT

SEQ ID NO: 340935 - protein, 9 aa, Influenza virus
QFALGQGAT

SEQ ID NO: 340936 - protein, 9 aa, Influenza virus
FALGQGATL

SEQ ID NO: 340937 - protein, 9 aa, Influenza virus
PHRTLLMSE

SEQ ID NO: 340938 - protein, 9 aa, Influenza virus
HRTLLMSEL

SEQ ID NO: 340939 - protein, 9 aa, Influenza virus
LMNELGVPL

SEQ ID NO: 340940 - protein, 9 aa, Influenza virus
MNELGVPLH

SEQ ID NO: 340941 - protein, 9 aa, Influenza virus
NELGVPLHL

SEQ ID NO: 340942 - protein, 9 aa, Influenza virus
TRQVCIAWS

SEQ ID NO: 340943 - protein, 9 aa, Influenza virus
RQVCIAWSS

SEQ ID NO: 340944 - protein, 9 aa, Influenza virus
QVCIAWSSA

SEQ ID NO: 340945 - protein, 9 aa, Influenza virus
VCIAWSSAS

SEQ ID NO: 340946 - protein, 9 aa, Influenza virus
CIAWSSASC

SEQ ID NO: 340947 - protein, 9 aa, Influenza virus
IAWSSSSCY

SEQ ID NO: 340948 - protein, 9 aa, Influenza virus
AWSSASCHD

SEQ ID NO: 340949 - protein, 9 aa, Influenza virus
WSSASCHDG

SEQ ID NO: 340950 - protein, 9 aa, Influenza virus
SSSSCYDGK

SEQ ID NO: 340951 - protein, 9 aa, Influenza virus
SSSCYDGKA

SEQ ID NO: 340952 - protein, 9 aa, Influenza virus
SSCYDGKAW

SEQ ID NO: 340953 - protein, 9 aa, Influenza virus
SCYDGKAWL

SEQ ID NO: 340954 - protein, 9 aa, Influenza virus
CYDGKAWLH

SEQ ID NO: 340955 - protein, 9 aa, Influenza virus
TILRTQESE

SEQ ID NO: 340956 - protein, 9 aa, Influenza virus
LITQESECV

SEQ ID NO: 340957 - protein, 9 aa, Influenza virus
ITQESECVC

SEQ ID NO: 340958 - protein, 9 aa, Influenza virus
TQESDCVCI

SEQ ID NO: 340959 - protein, 9 aa, Influenza virus
ESECICING

SEQ ID NO: 340960 - protein, 9 aa, Influenza virus
ISGTCAVVM

SEQ ID NO: 340961 - protein, 9 aa, Influenza virus
GICTVVMTD

SEQ ID NO: 340962 - protein, 9 aa, Influenza virus
GNAQHVEEC

SEQ ID NO: 340963 - protein, 9 aa, Influenza virus
GAQHVEECS

SEQ ID NO: 340964 - protein, 9 aa, Influenza virus
AKHVEECSC

SEQ ID NO: 340965 - protein, 9 aa, Influenza virus
VEECSCYPQ

SEQ ID NO: 340966 - protein, 9 aa, Influenza virus
EECSCYPSY

SEQ ID NO: 340967 - protein, 9 aa, Influenza virus
CVYRDNWKG

SEQ ID NO: 340968 - protein, 9 aa, Influenza virus
VYRDNWKGS

SEQ ID NO: 340969 - protein, 9 aa, Influenza virus
YRDNWKGSN

SEQ ID NO: 340970 - protein, 9 aa, Influenza virus
NWKGSNRPI

SEQ ID NO: 340971 - protein, 9 aa, Influenza virus
YFLDVFAGD

SEQ ID NO: 340972 - protein, 9 aa, Influenza virus
GLVGDTPRD

SEQ ID NO: 340973 - protein, 9 aa, Influenza virus
PGVKGWGFD

SEQ ID NO: 340974 - protein, 9 aa, Influenza virus
FYVELIRGK

SEQ ID NO: 340975 - protein, 9 aa, Influenza virus
YVELIRGKP

SEQ ID NO: 340976 - protein, 9 aa, Influenza virus
FCGTTGTYG

SEQ ID NO: 340977 - protein, 9 aa, Influenza virus
GTYGAGSWP

SEQ ID NO: 340978 - protein, 9 aa, Influenza virus
TYGAGSWPD

SEQ ID NO: 340979 - protein, 9 aa, Influenza virus
AGSWPDGAN

SEQ ID NO: 340980 - protein, 9 aa, Influenza virus
GSWADGANI

SEQ ID NO: 340981 - protein, 9 aa, Influenza virus
VETYVLSVI

SEQ ID NO: 340982 - protein, 9 aa, Influenza virus
ETYVLSVIP

SEQ ID NO: 340983 - protein, 9 aa, Influenza virus
TYVLSVIPS

SEQ ID NO: 340984 - protein, 9 aa, Influenza virus
YVLSVIPSG

SEQ ID NO: 340985 - protein, 9 aa, Influenza virus
LSVIPSGPL

SEQ ID NO: 340986 - protein, 9 aa, Influenza virus
AEIAQKLED

SEQ ID NO: 340987 - protein, 9 aa, Influenza virus
EIAQKLEDV

SEQ ID NO: 340988 - protein, 9 aa, Influenza virus
IAQKLEDVF

SEQ ID NO: 340989 - protein, 9 aa, Influenza virus
AQKLEDVFA

SEQ ID NO: 340990 - protein, 9 aa, Influenza virus
QKLEDVFAG

SEQ ID NO: 340991 - protein, 9 aa, Influenza virus
KLEDVFAGK

SEQ ID NO: 340992 - protein, 9 aa, Influenza virus
LEGVFAGKN

SEQ ID NO: 340993 - protein, 9 aa, Influenza virus
VFAGKNSDL

SEQ ID NO: 340994 - protein, 9 aa, Influenza virus
FAGKNSDLE

SEQ ID NO: 340995 - protein, 9 aa, Influenza virus
AGKNSDLEA

SEQ ID NO: 340996 - protein, 9 aa, Influenza virus
GKNSDLEAL

SEQ ID NO: 340997 - protein, 9 aa, Influenza virus
KNSDLEALM

SEQ ID NO: 340998 - protein, 9 aa, Influenza virus
NSDLEALME

SEQ ID NO: 340999 - protein, 9 aa, Influenza virus
SDLEALMEW

SEQ ID NO: 341000 - protein, 9 aa, Influenza virus
LTKGVLGFV

SEQ ID NO: 341001 - protein, 9 aa, Influenza virus
TKGVLGFVF

SEQ ID NO: 341002 - protein, 9 aa, Influenza virus
RRFIQNALN

SEQ ID NO: 341003 - protein, 9 aa, Influenza virus
RFIQNALNG

SEQ ID NO: 341004 - protein, 9 aa, Influenza virus
FIQNALNGN

SEQ ID NO: 341005 - protein, 9 aa, Influenza virus
IQNALNGNG

SEQ ID NO: 341006 - protein, 9 aa, Influenza virus
GDPSNMDRA

SEQ ID NO: 341007 - protein, 9 aa, Influenza virus
DPSNMDRAV

SEQ ID NO: 341008 - protein, 9 aa, Influenza virus
PSNMDRAVK

SEQ ID NO: 341009 - protein, 9 aa, Influenza virus
SNMDRAVKL

SEQ ID NO: 341010 - protein, 9 aa, Influenza virus
NMARAVKLY

SEQ ID NO: 341011 - protein, 9 aa, Influenza virus
MDKAVKLYR

SEQ ID NO: 341012 - protein, 9 aa, Influenza virus
DKAVKLYRK

SEQ ID NO: 341013 - protein, 9 aa, Influenza virus
KAVKLYRKL

SEQ ID NO: 341014 - protein, 9 aa, Influenza virus
LYKKLKREM

SEQ ID NO: 341015 - protein, 9 aa, Influenza virus
YKKLKREMT

SEQ ID NO: 341016 - protein, 9 aa, Influenza virus
KKLKREMTF

SEQ ID NO: 341017 - protein, 9 aa, Influenza virus
EITFYGAKE

SEQ ID NO: 341018 - protein, 9 aa, Influenza virus
MTFHGAKEV

SEQ ID NO: 341019 - protein, 9 aa, Influenza virus
TFHGAKEVS

SEQ ID NO: 341020 - protein, 9 aa, Influenza virus
FHGAKEVSL

SEQ ID NO: 341021 - protein, 9 aa, Influenza virus
GAKEVSLSY

SEQ ID NO: 341022 - protein, 9 aa, Influenza virus
AKEVSLSYS

SEQ ID NO: 341023 - protein, 9 aa, Influenza virus
EVSLSYSTG

SEQ ID NO: 341024 - protein, 9 aa, Influenza virus
VSLSYSTGA

SEQ ID NO: 341025 - protein, 9 aa, Influenza virus
SLSYSTGAL

SEQ ID NO: 341026 - protein, 9 aa, Influenza virus
LGYSTGALA

SEQ ID NO: 341027 - protein, 9 aa, Influenza virus
GYSTGALAS

SEQ ID NO: 341028 - protein, 9 aa, Influenza virus
LIYNRMGTI

SEQ ID NO: 341029 - protein, 9 aa, Influenza virus
IYNRMGTVA

SEQ ID NO: 341030 - protein, 9 aa, Influenza virus
ALGLVCATC

SEQ ID NO: 341031 - protein, 9 aa, Influenza virus
LGLVCATCE

SEQ ID NO: 341032 - protein, 9 aa, Influenza virus
TCEQIADSH

SEQ ID NO: 341033 - protein, 9 aa, Influenza virus
CEQIADSHH

SEQ ID NO: 341034 - protein, 9 aa, Influenza virus
EQIADAQHR

SEQ ID NO: 341035 - protein, 9 aa, Influenza virus
QIADAQHRS

SEQ ID NO: 341036 - protein, 9 aa, Influenza virus
IADAQHRSH

SEQ ID NO: 341037 - protein, 9 aa, Influenza virus
ADAQHRSHR

SEQ ID NO: 341038 - protein, 9 aa, Influenza virus
DAQHRSHRQ

SEQ ID NO: 341039 - protein, 9 aa, Influenza virus
AQHRSHRQM

SEQ ID NO: 341040 - protein, 9 aa, Influenza virus
QHKSHRQMV

SEQ ID NO: 341041 - protein, 9 aa, Influenza virus
TITNPLIRH

SEQ ID NO: 341042 - protein, 9 aa, Influenza virus
ITNPLIRHE

SEQ ID NO: 341043 - protein, 9 aa, Influenza virus
IRHENRMVI

SEQ ID NO: 341044 - protein, 9 aa, Influenza virus
RHENRMVIA

SEQ ID NO: 341045 - protein, 9 aa, Influenza virus
IAGSSEQAA

SEQ ID NO: 341046 - protein, 9 aa, Influenza virus
SEQAAEAIE

SEQ ID NO: 341047 - protein, 9 aa, Influenza virus
EQAAEAIEV

SEQ ID NO: 341048 - protein, 9 aa, Influenza virus
QAAEAIEVA

SEQ ID NO: 341049 - protein, 9 aa, Influenza virus
ARRMVQAMR

SEQ ID NO: 341050 - protein, 9 aa, Influenza virus
RQMVQAMRA

SEQ ID NO: 341051 - protein, 9 aa, Influenza virus
MVQAMRAIG

SEQ ID NO: 341052 - protein, 9 aa, Influenza virus
VQAMRAIGT

SEQ ID NO: 341053 - protein, 9 aa, Influenza virus
AMRTVGTHP

SEQ ID NO: 341054 - protein, 9 aa, Influenza virus
NLLENLQAY

SEQ ID NO: 341055 - protein, 9 aa, Influenza virus
LIENLQAYQ

SEQ ID NO: 341056 - protein, 9 aa, Influenza virus
IENLQAYQK

SEQ ID NO: 341057 - protein, 9 aa, Influenza virus
DNLQAYQKR

SEQ ID NO: 341058 - protein, 9 aa, Influenza virus
QAYQKRMGL

SEQ ID NO: 341059 - protein, 9 aa, Influenza virus
AYQKRMGLQ

SEQ ID NO: 341060 - protein, 9 aa, Influenza virus
YQKRMGVQI

SEQ ID NO: 341061 - protein, 9 aa, Influenza virus
QKRMGVQIQ

SEQ ID NO: 341062 - protein, 9 aa, Influenza virus
KRMGVQIQR

SEQ ID NO: 341063 - protein, 9 aa, Influenza virus
RMGVQIQRF

SEQ ID NO: 341064 - protein, 9 aa, Influenza virus
MGVQIQRFK

SEQ ID NO: 341065 - protein, 9 aa, Influenza virus
SLLTEVETH

SEQ ID NO: 341066 - protein, 9 aa, Influenza virus
GVLHLILWI

SEQ ID NO: 341067 - protein, 9 aa, Influenza virus
GIPESMREE

SEQ ID NO: 341068 - protein, 9 aa, Influenza virus
IPESMREEY

SEQ ID NO: 341069 - protein, 9 aa, Influenza virus
PKSMREEYR

SEQ ID NO: 341070 - protein, 9 aa, Influenza virus
SMREEYRKE

SEQ ID NO: 341071 - protein, 9 aa, Influenza virus
MSDIEAMAT

SEQ ID NO: 341072 - protein, 9 aa, Influenza virus
SDIGAMASQ

SEQ ID NO: 341073 - protein, 9 aa, Influenza virus
DIEIMASQG

SEQ ID NO: 341074 - protein, 9 aa, Influenza virus
IEIMASQGT

SEQ ID NO: 341075 - protein, 9 aa, Influenza virus
EAMATQGTK

SEQ ID NO: 341076 - protein, 9 aa, Influenza virus
MASQGTKRP

SEQ ID NO: 341077 - protein, 9 aa, Influenza virus
ALQGTKRSY

SEQ ID NO: 341078 - protein, 9 aa, Influenza virus
LQGTKRSYE

SEQ ID NO: 341079 - protein, 9 aa, Influenza virus
RSYEQMETS

SEQ ID NO: 341080 - protein, 9 aa, Influenza virus
SYEQMETSG

SEQ ID NO: 341081 - protein, 9 aa, Influenza virus
YEQMETDGE

SEQ ID NO: 341082 - protein, 9 aa, Influenza virus
EQMETDGER

SEQ ID NO: 341083 - protein, 9 aa, Influenza virus
QMETDGERQ

SEQ ID NO: 341084 - protein, 9 aa, Influenza virus
TTEIRASVG

SEQ ID NO: 341085 - protein, 9 aa, Influenza virus
TEIRSSVGK

SEQ ID NO: 341086 - protein, 9 aa, Influenza virus
EIRSSVGKM

SEQ ID NO: 341087 - protein, 9 aa, Influenza virus
IRASVGKMI

SEQ ID NO: 341088 - protein, 9 aa, Influenza virus
SGIGRFYIQ

SEQ ID NO: 341089 - protein, 9 aa, Influenza virus
GIGKFYIQM

SEQ ID NO: 341090 - protein, 9 aa, Influenza virus
IGKFYIQMC

SEQ ID NO: 341091 - protein, 9 aa, Influenza virus
GKFYIQMCT

SEQ ID NO: 341092 - protein, 9 aa, Influenza virus
KFYIQMCTE

SEQ ID NO: 341093 - protein, 9 aa, Influenza virus
YIQMCTELQ

SEQ ID NO: 341094 - protein, 9 aa, Influenza virus
IQMCTELQL

SEQ ID NO: 341095 - protein, 9 aa, Influenza virus
QMCTELQLS

SEQ ID NO: 341096 - protein, 9 aa, Influenza virus
MCTELQLSD

SEQ ID NO: 341097 - protein, 9 aa, Influenza virus
HEGRLIQNS

SEQ ID NO: 341098 - protein, 9 aa, Influenza virus
DGRLIQNSI

SEQ ID NO: 341099 - protein, 9 aa, Influenza virus
GRLIQNSMT

SEQ ID NO: 341100 - protein, 9 aa, Influenza virus
RLIQNSMTI

SEQ ID NO: 341101 - protein, 9 aa, Influenza virus
LIQNSMTIE

SEQ ID NO: 341102 - protein, 9 aa, Influenza virus
QNSLTIERM

SEQ ID NO: 341103 - protein, 9 aa, Influenza virus
TVERMVLSA

SEQ ID NO: 341104 - protein, 9 aa, Influenza virus
VERMVLSAF

SEQ ID NO: 341105 - protein, 9 aa, Influenza virus
NKYLEEHPN

SEQ ID NO: 341106 - protein, 9 aa, Influenza virus
KYLEEHPNA

SEQ ID NO: 341107 - protein, 9 aa, Influenza virus
YLEEHPNAG

SEQ ID NO: 341108 - protein, 9 aa, Influenza virus
LEEHPSTGK

SEQ ID NO: 341109 - protein, 9 aa, Influenza virus
EEHPSTGKD

SEQ ID NO: 341110 - protein, 9 aa, Influenza virus
EHPSTGKDP

SEQ ID NO: 341111 - protein, 9 aa, Influenza virus
HPSTGKDPK

SEQ ID NO: 341112 - protein, 9 aa, Influenza virus
PSTGKDPKK

SEQ ID NO: 341113 - protein, 9 aa, Influenza virus
STGKDPKKT

SEQ ID NO: 341114 - protein, 9 aa, Influenza virus
KTGGPIYKK

SEQ ID NO: 341115 - protein, 9 aa, Influenza virus
EIMRIWRQA

SEQ ID NO: 341116 - protein, 9 aa, Influenza virus
IMRIWRQAN

SEQ ID NO: 341117 - protein, 9 aa, Influenza virus
MRIWRQANN

SEQ ID NO: 341118 - protein, 9 aa, Influenza virus
RNWRQANNG

SEQ ID NO: 341119 - protein, 9 aa, Influenza virus
IWRQANNGD

SEQ ID NO: 341120 - protein, 9 aa, Influenza virus
WRQANNGEE

SEQ ID NO: 341121 - protein, 9 aa, Influenza virus
RQANNGEDS

SEQ ID NO: 341122 - protein, 9 aa, Influenza virus
AGLTHMMIW

SEQ ID NO: 341123 - protein, 9 aa, Influenza virus
GLTHMMIWH

SEQ ID NO: 341124 - protein, 9 aa, Influenza virus
LTHMMIWHS

SEQ ID NO: 341125 - protein, 9 aa, Influenza virus
THMMIWHSN

SEQ ID NO: 341126 - protein, 9 aa, Influenza virus
HMMIWHSNL

SEQ ID NO: 341127 - protein, 9 aa, Influenza virus
MMIWHSNLN

SEQ ID NO: 341128 - protein, 9 aa, Influenza virus
AAGAAIKGV

SEQ ID NO: 341129 - protein, 9 aa, Influenza virus
AGAAIKGVG

SEQ ID NO: 341130 - protein, 9 aa, Influenza virus
GAAIKGVGT

SEQ ID NO: 341131 - protein, 9 aa, Influenza virus
AAVKGIGTM

SEQ ID NO: 341132 - protein, 9 aa, Influenza virus
VMELIRMVK

SEQ ID NO: 341133 - protein, 9 aa, Influenza virus
LELIRMIKR

SEQ ID NO: 341134 - protein, 9 aa, Influenza virus
ELVRMIKRG

SEQ ID NO: 341135 - protein, 9 aa, Influenza virus
LVRMIKRGI

SEQ ID NO: 341136 - protein, 9 aa, Influenza virus
VRMIKRGIN

SEQ ID NO: 341137 - protein, 9 aa, Influenza virus
RMIKRGVND

SEQ ID NO: 341138 - protein, 9 aa, Influenza virus
MIKRGVNDR

SEQ ID NO: 341139 - protein, 9 aa, Influenza virus
IKRGVNDRN

SEQ ID NO: 341140 - protein, 9 aa, Influenza virus
FWRGDNGRR

SEQ ID NO: 341141 - protein, 9 aa, Influenza virus
WRGDNGRRT

SEQ ID NO: 341142 - protein, 9 aa, Influenza virus
RGDNGRRTR

SEQ ID NO: 341143 - protein, 9 aa, Influenza virus
TRSAYERMC

SEQ ID NO: 341144 - protein, 9 aa, Influenza virus
RSAYERMCN

SEQ ID NO: 341145 - protein, 9 aa, Influenza virus
SAYERMCNI

SEQ ID NO: 341146 - protein, 9 aa, Influenza virus
QTAAQKAMM

SEQ ID NO: 341147 - protein, 9 aa, Influenza virus
TAAQKAMMD

SEQ ID NO: 341148 - protein, 9 aa, Influenza virus
AAQKAMMDQ

SEQ ID NO: 341149 - protein, 9 aa, Influenza virus
AQKAMMDQV

SEQ ID NO: 341150 - protein, 9 aa, Influenza virus
QKAMMDQVR

SEQ ID NO: 341151 - protein, 9 aa, Influenza virus
KAMMDQVRE

SEQ ID NO: 341152 - protein, 9 aa, Influenza virus
AMMDQVREG

SEQ ID NO: 341153 - protein, 9 aa, Influenza virus
MMDQVREGR

SEQ ID NO: 341154 - protein, 9 aa, Influenza virus
MDQVREGRN

SEQ ID NO: 341155 - protein, 9 aa, Influenza virus
SRSPGNAEI

SEQ ID NO: 341156 - protein, 9 aa, Influenza virus
AEIEDLIFS

SEQ ID NO: 341157 - protein, 9 aa, Influenza virus
EIEDLIFSA

SEQ ID NO: 341158 - protein, 9 aa, Influenza virus
IEDLIFSAR

SEQ ID NO: 341159 - protein, 9 aa, Influenza virus
EDLIFSARS

SEQ ID NO: 341160 - protein, 9 aa, Influenza virus
DLIFSARSA

SEQ ID NO: 341161 - protein, 9 aa, Influenza virus
LIFSARSAL

SEQ ID NO: 341162 - protein, 9 aa, Influenza virus
IFSARSALI

SEQ ID NO: 341163 - protein, 9 aa, Influenza virus
FMARSALIL

SEQ ID NO: 341164 - protein, 9 aa, Influenza virus
MARSALILR

SEQ ID NO: 341165 - protein, 9 aa, Influenza virus
SALILRGAV

SEQ ID NO: 341166 - protein, 9 aa, Influenza virus
ALILRGAVA

SEQ ID NO: 341167 - protein, 9 aa, Influenza virus
LILRGAVAH

SEQ ID NO: 341168 - protein, 9 aa, Influenza virus
ILRGAVAHK

SEQ ID NO: 341169 - protein, 9 aa, Influenza virus
HKSCLPACI

SEQ ID NO: 341170 - protein, 9 aa, Influenza virus
KSCLPACIY

SEQ ID NO: 341171 - protein, 9 aa, Influenza virus
SCLPACIYG

SEQ ID NO: 341172 - protein, 9 aa, Influenza virus
CLPACAYGP

SEQ ID NO: 341173 - protein, 9 aa, Influenza virus
LPACAYGPA

SEQ ID NO: 341174 - protein, 9 aa, Influenza virus
PACAYGPAV

SEQ ID NO: 341175 - protein, 9 aa, Influenza virus
SGYDFEKEG

SEQ ID NO: 341176 - protein, 9 aa, Influenza virus
GYDFEKEGY

SEQ ID NO: 341177 - protein, 9 aa, Influenza virus
YDFEKEGYS

SEQ ID NO: 341178 - protein, 9 aa, Influenza virus
NFEKEGYSL

SEQ ID NO: 341179 - protein, 9 aa, Influenza virus
KEGYSLVGV

SEQ ID NO: 341180 - protein, 9 aa, Influenza virus
SLVGVDPFK

SEQ ID NO: 341181 - protein, 9 aa, Influenza virus
LVGVDPFKL

SEQ ID NO: 341182 - protein, 9 aa, Influenza virus
VGVDPFKLL

SEQ ID NO: 341183 - protein, 9 aa, Influenza virus
GVDPFKLLQ

SEQ ID NO: 341184 - protein, 9 aa, Influenza virus
DPFKLLQTS

SEQ ID NO: 341185 - protein, 9 aa, Influenza virus
PFKLLQTSQ

SEQ ID NO: 341186 - protein, 9 aa, Influenza virus
FKLLQNSQI

SEQ ID NO: 341187 - protein, 9 aa, Influenza virus
SLIRPKENP

SEQ ID NO: 341188 - protein, 9 aa, Influenza virus
RPKENPAHK

SEQ ID NO: 341189 - protein, 9 aa, Influenza virus
PKENPAHKS

SEQ ID NO: 341190 - protein, 9 aa, Influenza virus
KENPAHKSQ

SEQ ID NO: 341191 - protein, 9 aa, Influenza virus
NPAHKSQLI

SEQ ID NO: 341192 - protein, 9 aa, Influenza virus
PAHKSQLIW

SEQ ID NO: 341193 - protein, 9 aa, Influenza virus
AHKSQLIWM

SEQ ID NO: 341194 - protein, 9 aa, Influenza virus
SQLIWMACH

SEQ ID NO: 341195 - protein, 9 aa, Influenza virus
QLIWMACHS

SEQ ID NO: 341196 - protein, 9 aa, Influenza virus
LIWMACHSA

SEQ ID NO: 341197 - protein, 9 aa, Influenza virus
IWMACHSAA

SEQ ID NO: 341198 - protein, 9 aa, Influenza virus
SAAFEDLRI

SEQ ID NO: 341199 - protein, 9 aa, Influenza virus
AAFEDLRVL

SEQ ID NO: 341200 - protein, 9 aa, Influenza virus
PRGQLATRG

SEQ ID NO: 341201 - protein, 9 aa, Influenza virus
LSTRGIQIA

SEQ ID NO: 341202 - protein, 9 aa, Influenza virus
STRGIQIAS

SEQ ID NO: 341203 - protein, 9 aa, Influenza virus
TRGIQIASN

SEQ ID NO: 341204 - protein, 9 aa, Influenza virus
RGIQIASNE

SEQ ID NO: 341205 - protein, 9 aa, Influenza virus
GIQIASNEN

SEQ ID NO: 341206 - protein, 9 aa, Influenza virus
TLELRSKYW

SEQ ID NO: 341207 - protein, 9 aa, Influenza virus
LELRSKYWA

SEQ ID NO: 341208 - protein, 9 aa, Influenza virus
ELRSKYWAI

SEQ ID NO: 341209 - protein, 9 aa, Influenza virus
LRSKYWAIR

SEQ ID NO: 341210 - protein, 9 aa, Influenza virus
RSKYWAIRT

SEQ ID NO: 341211 - protein, 9 aa, Influenza virus
SKYWAIRTR

SEQ ID NO: 341212 - protein, 9 aa, Influenza virus
KYWAIRTRS

SEQ ID NO: 341213 - protein, 9 aa, Influenza virus
RTRSGGNNN

SEQ ID NO: 341214 - protein, 9 aa, Influenza virus
TRSGGNNNQ

SEQ ID NO: 341215 - protein, 9 aa, Influenza virus
ASAGQISTQ

SEQ ID NO: 341216 - protein, 9 aa, Influenza virus
SAGQISTQP

SEQ ID NO: 341217 - protein, 9 aa, Influenza virus
SIQPTFSVQ

SEQ ID NO: 341218 - protein, 9 aa, Influenza virus
IQPTFSVQR

SEQ ID NO: 341219 - protein, 9 aa, Influenza virus
QPTFSVQRS

SEQ ID NO: 341220 - protein, 9 aa, Influenza virus
PTFSVQRSL

SEQ ID NO: 341221 - protein, 9 aa, Influenza virus
TFSVQRSLP

SEQ ID NO: 341222 - protein, 9 aa, Influenza virus
SVQRSLPFE

SEQ ID NO: 341223 - protein, 9 aa, Influenza virus
VQRNLPFDK

SEQ ID NO: 341224 - protein, 9 aa, Influenza virus
GNAEGRTSD

SEQ ID NO: 341225 - protein, 9 aa, Influenza virus
AEGRTSDMR

SEQ ID NO: 341226 - protein, 9 aa, Influenza virus
RTSDMRTEV

SEQ ID NO: 341227 - protein, 9 aa, Influenza virus
TSDMRTEVI

SEQ ID NO: 341228 - protein, 9 aa, Influenza virus
SDMRAEIIR

SEQ ID NO: 341229 - protein, 9 aa, Influenza virus
EVSFRGRGV

SEQ ID NO: 341230 - protein, 9 aa, Influenza virus
VSFRGRGVF

SEQ ID NO: 341231 - protein, 9 aa, Influenza virus
FQGRGVFEF

SEQ ID NO: 341232 - protein, 9 aa, Influenza virus
QGRGVFEFS

SEQ ID NO: 341233 - protein, 9 aa, Influenza virus
GVFEFSDER

SEQ ID NO: 341234 - protein, 9 aa, Influenza virus
VFEFSDERA

SEQ ID NO: 341235 - protein, 9 aa, Influenza virus
FELSDEKAA

SEQ ID NO: 341236 - protein, 9 aa, Influenza virus
ATSPIVPSF

SEQ ID NO: 341237 - protein, 9 aa, Influenza virus
ANPIVPSFD

SEQ ID NO: 341238 - protein, 9 aa, Influenza virus
SPIVPSFDM

SEQ ID NO: 341239 - protein, 9 aa, Influenza virus
PIVPSFEMS

SEQ ID NO: 341240 - protein, 9 aa, Influenza virus
IVPSFEMSN

SEQ ID NO: 341241 - protein, 9 aa, Influenza virus
VPSFEMSNE

SEQ ID NO: 341242 - protein, 9 aa, Influenza virus
PSFEMSNEG

SEQ ID NO: 341243 - protein, 9 aa, Influenza virus
FEMSNEGSY

SEQ ID NO: 341244 - protein, 9 aa, Influenza virus
MSKEGSYFF

SEQ ID NO: 341245 - protein, 9 aa, Influenza virus
SKEGSYFFG

SEQ ID NO: 341246 - protein, 9 aa, Influenza virus
YFFGDNAKE

SEQ ID NO: 341247 - protein, 9 aa, Influenza virus
FFGDNAKEY

SEQ ID NO: 341248 - protein, 9 aa, Influenza virus
LSFQVDCFL

SEQ ID NO: 341249 - protein, 9 aa, Influenza virus
FQVDCFIWH

SEQ ID NO: 341250 - protein, 9 aa, Influenza virus
QVDCYLWHI

SEQ ID NO: 341251 - protein, 9 aa, Influenza virus
VDCYLWHIR

SEQ ID NO: 341252 - protein, 9 aa, Influenza virus
CDAPFDDRL

SEQ ID NO: 341253 - protein, 9 aa, Influenza virus
DAPFLDRIR

SEQ ID NO: 341254 - protein, 9 aa, Influenza virus
APFLDRIRR

SEQ ID NO: 341255 - protein, 9 aa, Influenza virus
PFLDRIRRD

SEQ ID NO: 341256 - protein, 9 aa, Influenza virus
FLDRIRRDQ

SEQ ID NO: 341257 - protein, 9 aa, Influenza virus
DRLRRDQKA

SEQ ID NO: 341258 - protein, 9 aa, Influenza virus
RLRRDQKAL

SEQ ID NO: 341259 - protein, 9 aa, Influenza virus
RRDQRSLRG

SEQ ID NO: 341260 - protein, 9 aa, Influenza virus
RDQRSLRGR

SEQ ID NO: 341261 - protein, 9 aa, Influenza virus
KMPASRYLT

SEQ ID NO: 341262 - protein, 9 aa, Influenza virus
MPASRYLTD

SEQ ID NO: 341263 - protein, 9 aa, Influenza virus
PASRYLIDM

SEQ ID NO: 341264 - protein, 9 aa, Influenza virus
VRHRLKITE

SEQ ID NO: 341265 - protein, 9 aa, Influenza virus
QKFEEIKWL

SEQ ID NO: 341266 - protein, 9 aa, Influenza virus
KFEEIKWLI

SEQ ID NO: 341267 - protein, 9 aa, Influenza virus
SSFEQITFM

SEQ ID NO: 341268 - protein, 9 aa, Influenza virus
SFEQITFIQ

SEQ ID NO: 341269 - protein, 9 aa, Influenza virus
FEQITFIQA

SEQ ID NO: 341270 - protein, 9 aa, Influenza virus
ITFIQALQL

SEQ ID NO: 341271 - protein, 9 aa, Influenza virus
TFIQALQLL

SEQ ID NO: 341272 - protein, 9 aa, Influenza virus
FLQALQLLL

SEQ ID NO: 341273 - protein, 9 aa, Influenza virus
LQALQLLLE

SEQ ID NO: 341274 - protein, 9 aa, Influenza virus
LQLLLEVES

SEQ ID NO: 341275 - protein, 9 aa, Influenza virus
QLLLEVESE

SEQ ID NO: 341276 - protein, 9 aa, Influenza virus
EVESEIRTF

SEQ ID NO: 341277 - protein, 9 aa, Influenza virus
VESEIRTFS

SEQ ID NO: 341278 - protein, 9 aa, Influenza virus
EMRTFSFQL

SEQ ID NO: 341279 - protein, 9 aa, Influenza virus
MRTFSFQLI

SEQ ID NO: 341280 - protein, 9 aa, Influenza virus
TFSFQLILL

SEQ ID NO: 341281 - protein, 9 aa, Influenza virus
MEGFVRQCF

SEQ ID NO: 341282 - protein, 9 aa, Influenza virus
EGFVRQCFN

SEQ ID NO: 341283 - protein, 9 aa, Influenza virus
GFVRQCFNP

SEQ ID NO: 341284 - protein, 9 aa, Influenza virus
VRQCFNPMT

SEQ ID NO: 341285 - protein, 9 aa, Influenza virus
RQCFNPMVV

SEQ ID NO: 341286 - protein, 9 aa, Influenza virus
QCFNPMVVE

SEQ ID NO: 341287 - protein, 9 aa, Influenza virus
CFNPMVVEL

SEQ ID NO: 341288 - protein, 9 aa, Influenza virus
FNPMVVELA

SEQ ID NO: 341289 - protein, 9 aa, Influenza virus
NPMVVELAE

SEQ ID NO: 341290 - protein, 9 aa, Influenza virus
PMVVELAEK

SEQ ID NO: 341291 - protein, 9 aa, Influenza virus
IELAEKAMK

SEQ ID NO: 341292 - protein, 9 aa, Influenza virus
ELAERAMKE

SEQ ID NO: 341293 - protein, 9 aa, Influenza virus
LAEKAMKEH

SEQ ID NO: 341294 - protein, 9 aa, Influenza virus
AEKAMKEHG

SEQ ID NO: 341295 - protein, 9 aa, Influenza virus
EKAMKEHGE

SEQ ID NO: 341296 - protein, 9 aa, Influenza virus
ETNKFASIC

SEQ ID NO: 341297 - protein, 9 aa, Influenza virus
TNKFASICT

SEQ ID NO: 341298 - protein, 9 aa, Influenza virus
NKFASICTH

SEQ ID NO: 341299 - protein, 9 aa, Influenza virus
KLAAICTHL

SEQ ID NO: 341300 - protein, 9 aa, Influenza virus
LAAICTHLE

SEQ ID NO: 341301 - protein, 9 aa, Influenza virus
AAICTHLEI

SEQ ID NO: 341302 - protein, 9 aa, Influenza virus
AICTHLEIC

SEQ ID NO: 341303 - protein, 9 aa, Influenza virus
ICTHLEICF

SEQ ID NO: 341304 - protein, 9 aa, Influenza virus
CTHLEICFM

SEQ ID NO: 341305 - protein, 9 aa, Influenza virus
THLEICFMY

SEQ ID NO: 341306 - protein, 9 aa, Influenza virus
HLEICFMYS

SEQ ID NO: 341307 - protein, 9 aa, Influenza virus
LEICFMYSD

SEQ ID NO: 341308 - protein, 9 aa, Influenza virus
SDFHFINER

SEQ ID NO: 341309 - protein, 9 aa, Influenza virus
DPNVLLKHR

SEQ ID NO: 341310 - protein, 9 aa, Influenza virus
PNVLLKHRF

SEQ ID NO: 341311 - protein, 9 aa, Influenza virus
EIIEGRDRN

SEQ ID NO: 341312 - protein, 9 aa, Influenza virus
AWTMVNSIC

SEQ ID NO: 341313 - protein, 9 aa, Influenza virus
KPRYLPDLY

SEQ ID NO: 341314 - protein, 9 aa, Influenza virus
PRYLPDLYD

SEQ ID NO: 341315 - protein, 9 aa, Influenza virus
RYLPDLYDY

SEQ ID NO: 341316 - protein, 9 aa, Influenza virus
SLPDLYDYK

SEQ ID NO: 341317 - protein, 9 aa, Influenza virus
PDLYDYKES

SEQ ID NO: 341318 - protein, 9 aa, Influenza virus
DLYDYKESR

SEQ ID NO: 341319 - protein, 9 aa, Influenza virus
LYDYKESRF

SEQ ID NO: 341320 - protein, 9 aa, Influenza virus
RFLEIGVTR

SEQ ID NO: 341321 - protein, 9 aa, Influenza virus
FLEIGVTRR

SEQ ID NO: 341322 - protein, 9 aa, Influenza virus
LEIGVTRRE

SEQ ID NO: 341323 - protein, 9 aa, Influenza virus
GVTRREVHV

SEQ ID NO: 341324 - protein, 9 aa, Influenza virus
VTRREVHVY

SEQ ID NO: 341325 - protein, 9 aa, Influenza virus
TRREVHVYY

SEQ ID NO: 341326 - protein, 9 aa, Influenza virus
RREVHVYYL

SEQ ID NO: 341327 - protein, 9 aa, Influenza virus
REVHVYYLE

SEQ ID NO: 341328 - protein, 9 aa, Influenza virus
EVHVYYLEK

SEQ ID NO: 341329 - protein, 9 aa, Influenza virus
VHVYYLEKA

SEQ ID NO: 341330 - protein, 9 aa, Influenza virus
LEKASKIKS

SEQ ID NO: 341331 - protein, 9 aa, Influenza virus
EKASKIKSE

SEQ ID NO: 341332 - protein, 9 aa, Influenza virus
EETHIHIFS

SEQ ID NO: 341333 - protein, 9 aa, Influenza virus
ETHIHIFSF

SEQ ID NO: 341334 - protein, 9 aa, Influenza virus
SFTGEEMAS

SEQ ID NO: 341335 - protein, 9 aa, Influenza virus
FNGEEMATK

SEQ ID NO: 341336 - protein, 9 aa, Influenza virus
EYTLDEESR

SEQ ID NO: 341337 - protein, 9 aa, Influenza virus
FTIRQEMAI

SEQ ID NO: 341338 - protein, 9 aa, Influenza virus
TIRQEMAIR

SEQ ID NO: 341339 - protein, 9 aa, Influenza virus
KGLWDSFRQ

SEQ ID NO: 341340 - protein, 9 aa, Influenza virus
GLWDPFRQS

SEQ ID NO: 341341 - protein, 9 aa, Influenza virus
QSERGEETV

SEQ ID NO: 341342 - protein, 9 aa, Influenza virus
SERGEETVE

SEQ ID NO: 341343 - protein, 9 aa, Influenza virus
ERGEETVEE

SEQ ID NO: 341344 - protein, 9 aa, Influenza virus
RGEDTIEER

SEQ ID NO: 341345 - protein, 9 aa, Influenza virus
GEDTIEERF

SEQ ID NO: 341346 - protein, 9 aa, Influenza virus
EDTIEERFE

SEQ ID NO: 341347 - protein, 9 aa, Influenza virus
DTIEERFEI

SEQ ID NO: 341348 - protein, 9 aa, Influenza virus
LANYSLPPN

SEQ ID NO: 341349 - protein, 9 aa, Influenza virus
ANYSLPPNF

SEQ ID NO: 341350 - protein, 9 aa, Influenza virus
NYSLPPNFS

SEQ ID NO: 341351 - protein, 9 aa, Influenza virus
YSLPPNFSS

SEQ ID NO: 341352 - protein, 9 aa, Influenza virus
NFRTYVDGF

SEQ ID NO: 341353 - protein, 9 aa, Influenza virus
FRVYVDGFE

SEQ ID NO: 341354 - protein, 9 aa, Influenza virus
RVYVDGFEP

SEQ ID NO: 341355 - protein, 9 aa, Influenza virus
VYVDGFEPN

SEQ ID NO: 341356 - protein, 9 aa, Influenza virus
VDGFKPNGC

SEQ ID NO: 341357 - protein, 9 aa, Influenza virus
DGFKPNGCI

SEQ ID NO: 341358 - protein, 9 aa, Influenza virus
GFKPNGCIE

SEQ ID NO: 341359 - protein, 9 aa, Influenza virus
FKPNGCIEG

SEQ ID NO: 341360 - protein, 9 aa, Influenza virus
KPNGCIEGK

SEQ ID NO: 341361 - protein, 9 aa, Influenza virus
PNGCIESKL

SEQ ID NO: 341362 - protein, 9 aa, Influenza virus
NGCIESKLS

SEQ ID NO: 341363 - protein, 9 aa, Influenza virus
GCIESKLSQ

SEQ ID NO: 341364 - protein, 9 aa, Influenza virus
CIESKLSQM

SEQ ID NO: 341365 - protein, 9 aa, Influenza virus
ESKLSQMSK

SEQ ID NO: 341366 - protein, 9 aa, Influenza virus
KLSQMSKKV

SEQ ID NO: 341367 - protein, 9 aa, Influenza virus
CYQRSKFLL

SEQ ID NO: 341368 - protein, 9 aa, Influenza virus
YQRSKFLLM

SEQ ID NO: 341369 - protein, 9 aa, Influenza virus
LKLSIEDPD

SEQ ID NO: 341370 - protein, 9 aa, Influenza virus
KLSIEDPDH

SEQ ID NO: 341371 - protein, 9 aa, Influenza virus
LSIEDPDHE

SEQ ID NO: 341372 - protein, 9 aa, Influenza virus
SIEDPDHEG

SEQ ID NO: 341373 - protein, 9 aa, Influenza virus
IEDPDHEGE

SEQ ID NO: 341374 - protein, 9 aa, Influenza virus
EDPDHEGEG

SEQ ID NO: 341375 - protein, 9 aa, Influenza virus
DPDHEGEGI

SEQ ID NO: 341376 - protein, 9 aa, Influenza virus
PDHEGEGIP

SEQ ID NO: 341377 - protein, 9 aa, Influenza virus
DHEGEGIPL

SEQ ID NO: 341378 - protein, 9 aa, Influenza virus
EGIPLHDAI

SEQ ID NO: 341379 - protein, 9 aa, Influenza virus
GIPLHDAIK

SEQ ID NO: 341380 - protein, 9 aa, Influenza virus
IPLHDAIKC

SEQ ID NO: 341381 - protein, 9 aa, Influenza virus
KCMRTFFGW

SEQ ID NO: 341382 - protein, 9 aa, Influenza virus
CMRTFFGWK

SEQ ID NO: 341383 - protein, 9 aa, Influenza virus
KTFFGWREP

SEQ ID NO: 341384 - protein, 9 aa, Influenza virus
LKWVLGENM

SEQ ID NO: 341385 - protein, 9 aa, Influenza virus
KWVLGENMA

SEQ ID NO: 341386 - protein, 9 aa, Influenza virus
WTLGENMAP

SEQ ID NO: 341387 - protein, 9 aa, Influenza virus
TLGENMAPE

SEQ ID NO: 341388 - protein, 9 aa, Influenza virus
GENMAPEKI

SEQ ID NO: 341389 - protein, 9 aa, Influenza virus
ENMAPEKID

SEQ ID NO: 341390 - protein, 9 aa, Influenza virus
NMAPEKIDF

SEQ ID NO: 341391 - protein, 9 aa, Influenza virus
MAPEKMDFE

SEQ ID NO: 341392 - protein, 9 aa, Influenza virus
WVQNEFNKA

SEQ ID NO: 341393 - protein, 9 aa, Influenza virus
VQNEFNKAC

SEQ ID NO: 341394 - protein, 9 aa, Influenza virus
KACELTDSV

SEQ ID NO: 341395 - protein, 9 aa, Influenza virus
ACELTDSVW

SEQ ID NO: 341396 - protein, 9 aa, Influenza virus
WMELDEIGE

SEQ ID NO: 341397 - protein, 9 aa, Influenza virus
MELDEIGED

SEQ ID NO: 341398 - protein, 9 aa, Influenza virus
ELDEIGEDL

SEQ ID NO: 341399 - protein, 9 aa, Influenza virus
LDEIGEDLA

SEQ ID NO: 341400 - protein, 9 aa, Influenza virus
DEIGEDLAP

SEQ ID NO: 341401 - protein, 9 aa, Influenza virus
EIGEDLAPI

SEQ ID NO: 341402 - protein, 9 aa, Influenza virus
IGEDLAPIE

SEQ ID NO: 341403 - protein, 9 aa, Influenza virus
GEDIAPIEH

SEQ ID NO: 341404 - protein, 9 aa, Influenza virus
APIEYVASM

SEQ ID NO: 341405 - protein, 9 aa, Influenza virus
PIEYVASMR

SEQ ID NO: 341406 - protein, 9 aa, Influenza virus
IEYVASMRR

SEQ ID NO: 341407 - protein, 9 aa, Influenza virus
IASMRRDYF

SEQ ID NO: 341408 - protein, 9 aa, Influenza virus
ASIRRNYFT

SEQ ID NO: 341409 - protein, 9 aa, Influenza virus
RRSYFTAEV

SEQ ID NO: 341410 - protein, 9 aa, Influenza virus
RSYFTAEVS

SEQ ID NO: 341411 - protein, 9 aa, Influenza virus
YFTAEVSYC

SEQ ID NO: 341412 - protein, 9 aa, Influenza virus
FTAEVSYCR

SEQ ID NO: 341413 - protein, 9 aa, Influenza virus
TAEVSYCRA

SEQ ID NO: 341414 - protein, 9 aa, Influenza virus
AEVSYCRAT

SEQ ID NO: 341415 - protein, 9 aa, Influenza virus
HCRATEYMM

SEQ ID NO: 341416 - protein, 9 aa, Influenza virus
TEYIIKGVY

SEQ ID NO: 341417 - protein, 9 aa, Influenza virus
MKGVYMNTA

SEQ ID NO: 341418 - protein, 9 aa, Influenza virus
KGVYMNTAL

SEQ ID NO: 341419 - protein, 9 aa, Influenza virus
GVYMNTALL

SEQ ID NO: 341420 - protein, 9 aa, Influenza virus
VYMNTALLN

SEQ ID NO: 341421 - protein, 9 aa, Influenza virus
YMNTALLNA

SEQ ID NO: 341422 - protein, 9 aa, Influenza virus
MNTALLNAS

SEQ ID NO: 341423 - protein, 9 aa, Influenza virus
NASCAAMED

SEQ ID NO: 341424 - protein, 9 aa, Influenza virus
ASCAAMEDF

SEQ ID NO: 341425 - protein, 9 aa, Influenza virus
SCAAMEDFQ

SEQ ID NO: 341426 - protein, 9 aa, Influenza virus
CAAMEDFQL

SEQ ID NO: 341427 - protein, 9 aa, Influenza virus
AAMEDFQLI

SEQ ID NO: 341428 - protein, 9 aa, Influenza virus
AMEDFQLIP

SEQ ID NO: 341429 - protein, 9 aa, Influenza virus
EDFQLIPMI

SEQ ID NO: 341430 - protein, 9 aa, Influenza virus
IPMISKSRT

SEQ ID NO: 341431 - protein, 9 aa, Influenza virus
PMISKCKTK

SEQ ID NO: 341432 - protein, 9 aa, Influenza virus
MISKCKTKE

SEQ ID NO: 341433 - protein, 9 aa, Influenza virus
ISKCKTKEG

SEQ ID NO: 341434 - protein, 9 aa, Influenza virus
SKCKTKEGR

SEQ ID NO: 341435 - protein, 9 aa, Influenza virus
KCKTKEGRR

SEQ ID NO: 341436 - protein, 9 aa, Influenza virus
CRTKEGRRR

SEQ ID NO: 341437 - protein, 9 aa, Influenza virus
RTKEGRRRT

SEQ ID NO: 341438 - protein, 9 aa, Influenza virus
TKEGRRRTN

SEQ ID NO: 341439 - protein, 9 aa, Influenza virus
KEGRRRTNL

SEQ ID NO: 341440 - protein, 9 aa, Influenza virus
RTNLYGFII

SEQ ID NO: 341441 - protein, 9 aa, Influenza virus
NDTDVVNFL

SEQ ID NO: 341442 - protein, 9 aa, Influenza virus
DTDVVNFLS

SEQ ID NO: 341443 - protein, 9 aa, Influenza virus
TDVVNFLSM

SEQ ID NO: 341444 - protein, 9 aa, Influenza virus
DVVNFLSME

SEQ ID NO: 341445 - protein, 9 aa, Influenza virus
VVNFLSMEF

SEQ ID NO: 341446 - protein, 9 aa, Influenza virus
VNFLSMEFS

SEQ ID NO: 341447 - protein, 9 aa, Influenza virus
NFLSMEFSL

SEQ ID NO: 341448 - protein, 9 aa, Influenza virus
FLSMEFSLT

SEQ ID NO: 341449 - protein, 9 aa, Influenza virus
EFSLTDPKL

SEQ ID NO: 341450 - protein, 9 aa, Influenza virus
FSLTDPKLE

SEQ ID NO: 341451 - protein, 9 aa, Influenza virus
KWERYCVLE

SEQ ID NO: 341452 - protein, 9 aa, Influenza virus
PIFLYVRTN

SEQ ID NO: 341453 - protein, 9 aa, Influenza virus
IFLYVRTNG

SEQ ID NO: 341454 - protein, 9 aa, Influenza virus
IRTNGTSKI

SEQ ID NO: 341455 - protein, 9 aa, Influenza virus
IKMKWGMEL

SEQ ID NO: 341456 - protein, 9 aa, Influenza virus
SLQQIESII

SEQ ID NO: 341457 - protein, 9 aa, Influenza virus
LQQIESIIE

SEQ ID NO: 341458 - protein, 9 aa, Influenza virus
QQIESIIEA

SEQ ID NO: 341459 - protein, 9 aa, Influenza virus
QIESIIEAE

SEQ ID NO: 341460 - protein, 9 aa, Influenza virus
IESIIEAES

SEQ ID NO: 341461 - protein, 9 aa, Influenza virus
ESIIEAESS

SEQ ID NO: 341462 - protein, 9 aa, Influenza virus
SMVEAESSV

SEQ ID NO: 341463 - protein, 9 aa, Influenza virus
MVEAESSVK

SEQ ID NO: 341464 - protein, 9 aa, Influenza virus
VEAESSVKE

SEQ ID NO: 341465 - protein, 9 aa, Influenza virus
EAESSVREK

SEQ ID NO: 341466 - protein, 9 aa, Influenza virus
AESSVREKD

SEQ ID NO: 341467 - protein, 9 aa, Influenza virus
ESSVREKDM

SEQ ID NO: 341468 - protein, 9 aa, Influenza virus
SSVREKDMT

SEQ ID NO: 341469 - protein, 9 aa, Influenza virus
SVKEKDMTR

SEQ ID NO: 341470 - protein, 9 aa, Influenza virus
VKEKDMTRE

SEQ ID NO: 341471 - protein, 9 aa, Influenza virus
REKDMTKEF

SEQ ID NO: 341472 - protein, 9 aa, Influenza virus
EKDLTKEFF

SEQ ID NO: 341473 - protein, 9 aa, Influenza virus
KDLTKEFFE

SEQ ID NO: 341474 - protein, 9 aa, Influenza virus
EKWPIGESP

SEQ ID NO: 341475 - protein, 9 aa, Influenza virus
WPIGESPEG

SEQ ID NO: 341476 - protein, 9 aa, Influenza virus
GVEDGSIGK

SEQ ID NO: 341477 - protein, 9 aa, Influenza virus
VEDGSIGKV

SEQ ID NO: 341478 - protein, 9 aa, Influenza virus
EDGSIGKVC

SEQ ID NO: 341479 - protein, 9 aa, Influenza virus
DGSIGKVCR

SEQ ID NO: 341480 - protein, 9 aa, Influenza virus
GSIGKVCRA

SEQ ID NO: 341481 - protein, 9 aa, Influenza virus
LLAKSVFNN

SEQ ID NO: 341482 - protein, 9 aa, Influenza virus
LAKSVFNNL

SEQ ID NO: 341483 - protein, 9 aa, Influenza virus
AKSVFNNLY

SEQ ID NO: 341484 - protein, 9 aa, Influenza virus
KSVFNNLYA

SEQ ID NO: 341485 - protein, 9 aa, Influenza virus
SVFNNLYAS

SEQ ID NO: 341486 - protein, 9 aa, Influenza virus
VFNCLYASP

SEQ ID NO: 341487 - protein, 9 aa, Influenza virus
FNCLYASPQ

SEQ ID NO: 341488 - protein, 9 aa, Influenza virus
NCLYASPQL

SEQ ID NO: 341489 - protein, 9 aa, Influenza virus
CLYASPQLE

SEQ ID NO: 341490 - protein, 9 aa, Influenza virus
LYSSPQLEG

SEQ ID NO: 341491 - protein, 9 aa, Influenza virus
YSSPQLEGF

SEQ ID NO: 341492 - protein, 9 aa, Influenza virus
AESRKMLLI

SEQ ID NO: 341493 - protein, 9 aa, Influenza virus
ESRKLLLIA

SEQ ID NO: 341494 - protein, 9 aa, Influenza virus
SRKLLLIAQ

SEQ ID NO: 341495 - protein, 9 aa, Influenza virus
RKLLLIAQA

SEQ ID NO: 341496 - protein, 9 aa, Influenza virus
LLIAQALRD

SEQ ID NO: 341497 - protein, 9 aa, Influenza virus
QAFRDNLEP

SEQ ID NO: 341498 - protein, 9 aa, Influenza virus
AFRDNLEPG

SEQ ID NO: 341499 - protein, 9 aa, Influenza virus
FRDNLEPGT

SEQ ID NO: 341500 - protein, 9 aa, Influenza virus
KDNLEPGTF

SEQ ID NO: 341501 - protein, 9 aa, Influenza virus
SLEPGTFDL

SEQ ID NO: 341502 - protein, 9 aa, Influenza virus
LEPGTFDIG

SEQ ID NO: 341503 - protein, 9 aa, Influenza virus
EPGTFDIGG

SEQ ID NO: 341504 - protein, 9 aa, Influenza virus
PGTFDIGGL

SEQ ID NO: 341505 - protein, 9 aa, Influenza virus
GTFDIGGLY

SEQ ID NO: 341506 - protein, 9 aa, Influenza virus
GLYDAIEEC

SEQ ID NO: 341507 - protein, 9 aa, Influenza virus
LYDAIEECL

SEQ ID NO: 341508 - protein, 9 aa, Influenza virus
YDAIEECLI

SEQ ID NO: 341509 - protein, 9 aa, Influenza virus
DAIEECLIN

SEQ ID NO: 341510 - protein, 9 aa, Influenza virus
ASWFNSFLV

SEQ ID NO: 341511 - protein, 9 aa, Influenza virus
SWFNSFLVH

SEQ ID NO: 341512 - protein, 9 aa, Influenza virus
SFLVHALKS

SEQ ID NO: 341513 - protein, 9 aa, Influenza virus
FLTHALRFL

SEQ ID NO: 341514 - protein, 9 aa, Influenza virus
HPTLLFLKV

SEQ ID NO: 341515 - protein, 9 aa, Influenza virus
PTLLFLEVP

SEQ ID NO: 341516 - protein, 9 aa, Influenza virus
LLFLKVPVQ

SEQ ID NO: 341517 - protein, 9 aa, Influenza virus
KVPVQNAIS

SEQ ID NO: 341518 - protein, 9 aa, Influenza virus
VPVQNAIST

SEQ ID NO: 341519 - protein, 9 aa, Influenza virus
PAQNAISIT

SEQ ID NO: 341520 - protein, 9 aa, Influenza virus
AQNAISITF

SEQ ID NO: 341521 - protein, 9 aa, Influenza virus
SRTHQYSEK

SEQ ID NO: 341522 - protein, 9 aa, Influenza virus
THQYSERGK

SEQ ID NO: 341523 - protein, 9 aa, Influenza virus
HQYSERGKW

SEQ ID NO: 341524 - protein, 9 aa, Influenza virus
NTEIGAPQL

SEQ ID NO: 341525 - protein, 9 aa, Influenza virus
TEIGAPQLN

SEQ ID NO: 341526 - protein, 9 aa, Influenza virus
ETKAPQLNP

SEQ ID NO: 341527 - protein, 9 aa, Influenza virus
TKAPQLNPI

SEQ ID NO: 341528 - protein, 9 aa, Influenza virus
GALQLNPID

SEQ ID NO: 341529 - protein, 9 aa, Influenza virus
NPIDGPLPD

SEQ ID NO: 341530 - protein, 9 aa, Influenza virus
NNEPSGYAQ

SEQ ID NO: 341531 - protein, 9 aa, Influenza virus
NDPSGYAQT

SEQ ID NO: 341532 - protein, 9 aa, Influenza virus
DPSGYAQTD

SEQ ID NO: 341533 - protein, 9 aa, Influenza virus
LEAMAFLEN

SEQ ID NO: 341534 - protein, 9 aa, Influenza virus
EAMAFLENS

SEQ ID NO: 341535 - protein, 9 aa, Influenza virus
AMAFLENSH

SEQ ID NO: 341536 - protein, 9 aa, Influenza virus
MAFLENSHP

SEQ ID NO: 341537 - protein, 9 aa, Influenza virus
AFLENSHPG

SEQ ID NO: 341538 - protein, 9 aa, Influenza virus
LEESHPGLF

SEQ ID NO: 341539 - protein, 9 aa, Influenza virus
EESHPGLFE

SEQ ID NO: 341540 - protein, 9 aa, Influenza virus
SHPGIFGNS

SEQ ID NO: 341541 - protein, 9 aa, Influenza virus
HPGIFGNSC

SEQ ID NO: 341542 - protein, 9 aa, Influenza virus
PGLFENSCL

SEQ ID NO: 341543 - protein, 9 aa, Influenza virus
GLFENSCLE

SEQ ID NO: 341544 - protein, 9 aa, Influenza virus
LFENSCLET

SEQ ID NO: 341545 - protein, 9 aa, Influenza virus
VQQTRVDRL

SEQ ID NO: 341546 - protein, 9 aa, Influenza virus
RLTQGRQTY

SEQ ID NO: 341547 - protein, 9 aa, Influenza virus
ANTIEVFRL

SEQ ID NO: 341548 - protein, 9 aa, Influenza virus
NTIEVFRLN

SEQ ID NO: 341549 - protein, 9 aa, Influenza virus
NESGRLMDF

SEQ ID NO: 341550 - protein, 9 aa, Influenza virus
LIDFLKDVV

SEQ ID NO: 341551 - protein, 9 aa, Influenza virus
EIVTHFQRK

SEQ ID NO: 341552 - protein, 9 aa, Influenza virus
IVTHFQRKR

SEQ ID NO: 341553 - protein, 9 aa, Influenza virus
ITHFQRKRR

SEQ ID NO: 341554 - protein, 9 aa, Influenza virus
FHRKRRVRD

SEQ ID NO: 341555 - protein, 9 aa, Influenza virus
HRKRRVRDN

SEQ ID NO: 341556 - protein, 9 aa, Influenza virus
RKRRIRDNM

SEQ ID NO: 341557 - protein, 9 aa, Influenza virus
KRRIRDNMT

SEQ ID NO: 341558 - protein, 9 aa, Influenza virus
TKRMVTQRT

SEQ ID NO: 341559 - protein, 9 aa, Influenza virus
RMVTQRTIG

SEQ ID NO: 341560 - protein, 9 aa, Influenza virus
MVTQRTVGK

SEQ ID NO: 341561 - protein, 9 aa, Influenza virus
VTQRTVGKK

SEQ ID NO: 341562 - protein, 9 aa, Influenza virus
TQRTIGKRK

SEQ ID NO: 341563 - protein, 9 aa, Influenza virus
QRTVGKKKQ

SEQ ID NO: 341564 - protein, 9 aa, Influenza virus
NYLIRALTL

SEQ ID NO: 341565 - protein, 9 aa, Influenza virus
YIIRALTLN

SEQ ID NO: 341566 - protein, 9 aa, Influenza virus
IIRALTLNT

SEQ ID NO: 341567 - protein, 9 aa, Influenza virus
RGFVHFVEA

SEQ ID NO: 341568 - protein, 9 aa, Influenza virus
GFVHFVEAL

SEQ ID NO: 341569 - protein, 9 aa, Influenza virus
FVHFVEALA

SEQ ID NO: 341570 - protein, 9 aa, Influenza virus
VHFVEALAR

SEQ ID NO: 341571 - protein, 9 aa, Influenza virus
VETLARRIC

SEQ ID NO: 341572 - protein, 9 aa, Influenza virus
LARCICEKL

SEQ ID NO: 341573 - protein, 9 aa, Influenza virus
ARCICEKLE

SEQ ID NO: 341574 - protein, 9 aa, Influenza virus
RCICEKLEQ

SEQ ID NO: 341575 - protein, 9 aa, Influenza virus
CICEKLEQS

SEQ ID NO: 341576 - protein, 9 aa, Influenza virus
VRKMMTNSH

SEQ ID NO: 341577 - protein, 9 aa, Influenza virus
TSSQDTELS

SEQ ID NO: 341578 - protein, 9 aa, Influenza virus
SSQDTELSF

SEQ ID NO: 341579 - protein, 9 aa, Influenza virus
QDTELSFTV

SEQ ID NO: 341580 - protein, 9 aa, Influenza virus
DTELSFTVT

SEQ ID NO: 341581 - protein, 9 aa, Influenza virus
TELSFTVTG

SEQ ID NO: 341582 - protein, 9 aa, Influenza virus
ELSFTVTGD

SEQ ID NO: 341583 - protein, 9 aa, Influenza virus
LSFTVTGDN

SEQ ID NO: 341584 - protein, 9 aa, Influenza virus
WNENQNPRI

SEQ ID NO: 341585 - protein, 9 aa, Influenza virus
NENQNPRIF

SEQ ID NO: 341586 - protein, 9 aa, Influenza virus
ENQNPRIFL

SEQ ID NO: 341587 - protein, 9 aa, Influenza virus
NQNPRVFLA

SEQ ID NO: 341588 - protein, 9 aa, Influenza virus
QNPRVFLAM

SEQ ID NO: 341589 - protein, 9 aa, Influenza virus
NPRVFLAMI

SEQ ID NO: 341590 - protein, 9 aa, Influenza virus
PRVFLAMIT

SEQ ID NO: 341591 - protein, 9 aa, Influenza virus
RVFLAMITY

SEQ ID NO: 341592 - protein, 9 aa, Influenza virus
VFLAMITYI

SEQ ID NO: 341593 - protein, 9 aa, Influenza virus
LTMITYITR

SEQ ID NO: 341594 - protein, 9 aa, Influenza virus
QPGWFRNVL

SEQ ID NO: 341595 - protein, 9 aa, Influenza virus
PGWFRNVLS

SEQ ID NO: 341596 - protein, 9 aa, Influenza virus
WFRNILSIA

SEQ ID NO: 341597 - protein, 9 aa, Influenza virus
FRNILSIAP

SEQ ID NO: 341598 - protein, 9 aa, Influenza virus
RNILSIAPI

SEQ ID NO: 341599 - protein, 9 aa, Influenza virus
NILSIAPIM

SEQ ID NO: 341600 - protein, 9 aa, Influenza virus
ILSIAPIMF

SEQ ID NO: 341601 - protein, 9 aa, Influenza virus
LSVAPIMFS

SEQ ID NO: 341602 - protein, 9 aa, Influenza virus
SVAPIMFSN

SEQ ID NO: 341603 - protein, 9 aa, Influenza virus
VAPIMFSNK

SEQ ID NO: 341604 - protein, 9 aa, Influenza virus
SNKVARLGK

SEQ ID NO: 341605 - protein, 9 aa, Influenza virus
NKVARLGKG

SEQ ID NO: 341606 - protein, 9 aa, Influenza virus
KVARLGKGY

SEQ ID NO: 341607 - protein, 9 aa, Influenza virus
VARLGKGYM

SEQ ID NO: 341608 - protein, 9 aa, Influenza virus
GYMFESKNM

SEQ ID NO: 341609 - protein, 9 aa, Influenza virus
GTVSLSPGM

SEQ ID NO: 341610 - protein, 9 aa, Influenza virus
TVSLSPGMM

SEQ ID NO: 341611 - protein, 9 aa, Influenza virus
VSVLNLGQK

SEQ ID NO: 341612 - protein, 9 aa, Influenza virus
LNLGQKEYT

SEQ ID NO: 341613 - protein, 9 aa, Influenza virus
TSYWWDGLQ

SEQ ID NO: 341614 - protein, 9 aa, Influenza virus
SYWWDGLQS

SEQ ID NO: 341615 - protein, 9 aa, Influenza virus
DFALIVNAL

SEQ ID NO: 341616 - protein, 9 aa, Influenza virus
GVQAGVDRF

SEQ ID NO: 341617 - protein, 9 aa, Influenza virus
AGVNRFYRT

SEQ ID NO: 341618 - protein, 9 aa, Influenza virus
GVNRFYRTC

SEQ ID NO: 341619 - protein, 9 aa, Influenza virus
VNRFYRTCK

SEQ ID NO: 341620 - protein, 9 aa, Influenza virus
NRFYRTCKL

SEQ ID NO: 341621 - protein, 9 aa, Influenza virus
RFYRICKLV

SEQ ID NO: 341622 - protein, 9 aa, Influenza virus
FYRICKLVG

SEQ ID NO: 341623 - protein, 9 aa, Influenza virus
YRICKLVGI

SEQ ID NO: 341624 - protein, 9 aa, Influenza virus
RICKLVGIN

SEQ ID NO: 341625 - protein, 9 aa, Influenza virus
ICKLVGINM

SEQ ID NO: 341626 - protein, 9 aa, Influenza virus
LVGINMSKR

SEQ ID NO: 341627 - protein, 9 aa, Influenza virus
VGINMSKRK

SEQ ID NO: 341628 - protein, 9 aa, Influenza virus
ADMSIGVAV

SEQ ID NO: 341629 - protein, 9 aa, Influenza virus
DMSIGVAVI

SEQ ID NO: 341630 - protein, 9 aa, Influenza virus
MSIGVTVIR

SEQ ID NO: 341631 - protein, 9 aa, Influenza virus
SIGVTVIRN

SEQ ID NO: 341632 - protein, 9 aa, Influenza virus
IGVTVIRNN

SEQ ID NO: 341633 - protein, 9 aa, Influenza virus
GVTVIRNNM

SEQ ID NO: 341634 - protein, 9 aa, Influenza virus
VTVIRNNMI

SEQ ID NO: 341635 - protein, 9 aa, Influenza virus
TVIKNNMVN

SEQ ID NO: 341636 - protein, 9 aa, Influenza virus
VIKNNMVNN

SEQ ID NO: 341637 - protein, 9 aa, Influenza virus
TYRCHRGDM

SEQ ID NO: 341638 - protein, 9 aa, Influenza virus
YRCHRGDMQ

SEQ ID NO: 341639 - protein, 9 aa, Influenza virus
RCHRGDMQI

SEQ ID NO: 341640 - protein, 9 aa, Influenza virus
QIQTRRAFE

SEQ ID NO: 341641 - protein, 9 aa, Influenza virus
IQTKRSFEL

SEQ ID NO: 341642 - protein, 9 aa, Influenza virus
QTKRSFELK

SEQ ID NO: 341643 - protein, 9 aa, Influenza virus
GLLVADGGP

SEQ ID NO: 341644 - protein, 9 aa, Influenza virus
LLVADGGPN

SEQ ID NO: 341645 - protein, 9 aa, Influenza virus
LVADGGPNL

SEQ ID NO: 341646 - protein, 9 aa, Influenza virus
VADGGPNLY

SEQ ID NO: 341647 - protein, 9 aa, Influenza virus
IPEAGLKWE

SEQ ID NO: 341648 - protein, 9 aa, Influenza virus
PEAGLKWEL

SEQ ID NO: 341649 - protein, 9 aa, Influenza virus
EAGLKWELM

SEQ ID NO: 341650 - protein, 9 aa, Influenza virus
YKGRLCNPL

SEQ ID NO: 341651 - protein, 9 aa, Influenza virus
KGRLCNPLN

SEQ ID NO: 341652 - protein, 9 aa, Influenza virus
CNPLNPFVT

SEQ ID NO: 341653 - protein, 9 aa, Influenza virus
NPLNPFVTH

SEQ ID NO: 341654 - protein, 9 aa, Influenza virus
VEYDAVATT

SEQ ID NO: 341655 - protein, 9 aa, Influenza virus
AVATTHSWT

SEQ ID NO: 341656 - protein, 9 aa, Influenza virus
VATTHSWTP

SEQ ID NO: 341657 - protein, 9 aa, Influenza virus
ATTHSWTPK

SEQ ID NO: 341658 - protein, 9 aa, Influenza virus
TTHSWTPKR

SEQ ID NO: 341659 - protein, 9 aa, Influenza virus
THSWTPKRN

SEQ ID NO: 341660 - protein, 9 aa, Influenza virus
HSWTPKRNR

SEQ ID NO: 341661 - protein, 9 aa, Influenza virus
SWTPKRNRS

SEQ ID NO: 341662 - protein, 9 aa, Influenza virus
WTPKRNRSI

SEQ ID NO: 341663 - protein, 9 aa, Influenza virus
TPKRNRSIL

SEQ ID NO: 341664 - protein, 9 aa, Influenza virus
KGILEDEQM

SEQ ID NO: 341665 - protein, 9 aa, Influenza virus
EQMYQKCCS

SEQ ID NO: 341666 - protein, 9 aa, Influenza virus
QMYQKCCSL

SEQ ID NO: 341667 - protein, 9 aa, Influenza virus
MYQKCCSLF

SEQ ID NO: 341668 - protein, 9 aa, Influenza virus
YQKCCSLFE

SEQ ID NO: 341669 - protein, 9 aa, Influenza virus
QKCCSLFEK

SEQ ID NO: 341670 - protein, 9 aa, Influenza virus
KCCSLFEKF

SEQ ID NO: 341671 - protein, 9 aa, Influenza virus
CCTLFEKFF

SEQ ID NO: 341672 - protein, 9 aa, Influenza virus
CTLFEKFFP

SEQ ID NO: 341673 - protein, 9 aa, Influenza virus
TLFEKFFPS

SEQ ID NO: 341674 - protein, 9 aa, Influenza virus
RPVGISSMG

SEQ ID NO: 341675 - protein, 9 aa, Influenza virus
PVGISSMGE

SEQ ID NO: 341676 - protein, 9 aa, Influenza virus
VGISSMGEA

SEQ ID NO: 341677 - protein, 9 aa, Influenza virus
GISSMGEAM

SEQ ID NO: 341678 - protein, 9 aa, Influenza virus
ISSMGEAMV

SEQ ID NO: 341679 - protein, 9 aa, Influenza virus
SSMGEAMVS

SEQ ID NO: 341680 - protein, 9 aa, Influenza virus
SMGEAMVSR

SEQ ID NO: 341681 - protein, 9 aa, Influenza virus
MGEAMVSRA

SEQ ID NO: 341682 - protein, 9 aa, Influenza virus
GEAMVSRAR

SEQ ID NO: 341683 - protein, 9 aa, Influenza virus
EAMMSRARI

SEQ ID NO: 341684 - protein, 9 aa, Influenza virus
AMMSRARID

SEQ ID NO: 341685 - protein, 9 aa, Influenza virus
MMSRARIDA

SEQ ID NO: 341686 - protein, 9 aa, Influenza virus
MSRARIDAR

SEQ ID NO: 341687 - protein, 9 aa, Influenza virus
ARIDARVDS

SEQ ID NO: 341688 - protein, 9 aa, Influenza virus
RIDFESGRM

SEQ ID NO: 341689 - protein, 9 aa, Influenza virus
SKSRSIIFN

SEQ ID NO: 341690 - protein, 9 aa, Influenza virus
KSRSIIFNM

SEQ ID NO: 341691 - protein, 9 aa, Influenza virus
LMSQSRTRG

SEQ ID NO: 341692 - protein, 9 aa, Influenza virus
MSQSRTRGI

SEQ ID NO: 341693 - protein, 9 aa, Influenza virus
SQSRTRGIL

SEQ ID NO: 341694 - protein, 9 aa, Influenza virus
SRTRGILTK

SEQ ID NO: 341695 - protein, 9 aa, Influenza virus
RTREILTKI

SEQ ID NO: 341696 - protein, 9 aa, Influenza virus
TREILTKIT

SEQ ID NO: 341697 - protein, 9 aa, Influenza virus
REILTKITV

SEQ ID NO: 341698 - protein, 9 aa, Influenza virus
EILTKITVD

SEQ ID NO: 341699 - protein, 9 aa, Influenza virus
ILTKITVDH

SEQ ID NO: 341700 - protein, 9 aa, Influenza virus
LTKITVDHM

SEQ ID NO: 341701 - protein, 9 aa, Influenza virus
TKITVDHMA

SEQ ID NO: 341702 - protein, 9 aa, Influenza virus
KITVDHMAI

SEQ ID NO: 341703 - protein, 9 aa, Influenza virus
SARQEKNPA

SEQ ID NO: 341704 - protein, 9 aa, Influenza virus
ARQEKNPAL

SEQ ID NO: 341705 - protein, 9 aa, Influenza virus
AMKYPITAE

SEQ ID NO: 341706 - protein, 9 aa, Influenza virus
IPERNEHGQ

SEQ ID NO: 341707 - protein, 9 aa, Influenza virus
RNEQGQILW

SEQ ID NO: 341708 - protein, 9 aa, Influenza virus
IVSPLAVTW

SEQ ID NO: 341709 - protein, 9 aa, Influenza virus
LAVTWWNRS

SEQ ID NO: 341710 - protein, 9 aa, Influenza virus
AVTWWNRSG

SEQ ID NO: 341711 - protein, 9 aa, Influenza virus
VTWWNRSGP

SEQ ID NO: 341712 - protein, 9 aa, Influenza virus
HYPKVYRTY

SEQ ID NO: 341713 - protein, 9 aa, Influenza virus
YPKVYRTYF

SEQ ID NO: 341714 - protein, 9 aa, Influenza virus
GIFGPVHFR

SEQ ID NO: 341715 - protein, 9 aa, Influenza virus
IFGPVHFRN

SEQ ID NO: 341716 - protein, 9 aa, Influenza virus
FGPVHFRSQ

SEQ ID NO: 341717 - protein, 9 aa, Influenza virus
GPVHFQNQV

SEQ ID NO: 341718 - protein, 9 aa, Influenza virus
PVHFQNQVK

SEQ ID NO: 341719 - protein, 9 aa, Influenza virus
VHFQNQVKI

SEQ ID NO: 341720 - protein, 9 aa, Influenza virus
HFQNQVKIR

SEQ ID NO: 341721 - protein, 9 aa, Influenza virus
FQNQVKIRR

SEQ ID NO: 341722 - protein, 9 aa, Influenza virus
QNQVKIRRR

SEQ ID NO: 341723 - protein, 9 aa, Influenza virus
VKIRRRVDV

SEQ ID NO: 341724 - protein, 9 aa, Influenza virus
KIRRRVDVN

SEQ ID NO: 341725 - protein, 9 aa, Influenza virus
IRRRVDVNP

SEQ ID NO: 341726 - protein, 9 aa, Influenza virus
RRRVDVNPG

SEQ ID NO: 341727 - protein, 9 aa, Influenza virus
RRVDVNPGH

SEQ ID NO: 341728 - protein, 9 aa, Influenza virus
RVDVNPGHA

SEQ ID NO: 341729 - protein, 9 aa, Influenza virus
VDVNPGHAD

SEQ ID NO: 341730 - protein, 9 aa, Influenza virus
TKEAQDVIM

SEQ ID NO: 341731 - protein, 9 aa, Influenza virus
NEVGARIIT

SEQ ID NO: 341732 - protein, 9 aa, Influenza virus
EVGARIITS

SEQ ID NO: 341733 - protein, 9 aa, Influenza virus
VGARIITSE

SEQ ID NO: 341734 - protein, 9 aa, Influenza virus
GARIITSES

SEQ ID NO: 341735 - protein, 9 aa, Influenza virus
ARIITSESQ

SEQ ID NO: 341736 - protein, 9 aa, Influenza virus
RILTSESQM

SEQ ID NO: 341737 - protein, 9 aa, Influenza virus
IAPLMMAYM

SEQ ID NO: 341738 - protein, 9 aa, Influenza virus
APLMMAYML

SEQ ID NO: 341739 - protein, 9 aa, Influenza virus
RKTRFLPVT

SEQ ID NO: 341740 - protein, 9 aa, Influenza virus
KTRFLPVTG

SEQ ID NO: 341741 - protein, 9 aa, Influenza virus
TRFLPVTGG

SEQ ID NO: 341742 - protein, 9 aa, Influenza virus
RFLPVTGGT

SEQ ID NO: 341743 - protein, 9 aa, Influenza virus
FLPVSGGTS

SEQ ID NO: 341744 - protein, 9 aa, Influenza virus
LPVSGGTSS

SEQ ID NO: 341745 - protein, 9 aa, Influenza virus
GGTSSIYIE

SEQ ID NO: 341746 - protein, 9 aa, Influenza virus
GTSSIYIEV

SEQ ID NO: 341747 - protein, 9 aa, Influenza virus
TSSIYIEVL

SEQ ID NO: 341748 - protein, 9 aa, Influenza virus
SSIYIEVLH

SEQ ID NO: 341749 - protein, 9 aa, Influenza virus
SVYVEVLHL

SEQ ID NO: 341750 - protein, 9 aa, Influenza virus
VYVEVLHLT

SEQ ID NO: 341751 - protein, 9 aa, Influenza virus
TQGTCWEQL

SEQ ID NO: 341752 - protein, 9 aa, Influenza virus
QGTCWEQLY

SEQ ID NO: 341753 - protein, 9 aa, Influenza virus
GTCWEQLYT

SEQ ID NO: 341754 - protein, 9 aa, Influenza virus
TCWEQLYTP

SEQ ID NO: 341755 - protein, 9 aa, Influenza virus
EQLYTPGGE

SEQ ID NO: 341756 - protein, 9 aa, Influenza virus
QLYTPGGEV

SEQ ID NO: 341757 - protein, 9 aa, Influenza virus
YTPGGEVKN

SEQ ID NO: 341758 - protein, 9 aa, Influenza virus
TPGGEVKND

SEQ ID NO: 341759 - protein, 9 aa, Influenza virus
VKNDDVDQS

SEQ ID NO: 341760 - protein, 9 aa, Influenza virus
KNDDVDQSL

SEQ ID NO: 341761 - protein, 9 aa, Influenza virus
NDDVDQSLV

SEQ ID NO: 341762 - protein, 9 aa, Influenza virus
DDVDQSLVI

SEQ ID NO: 341763 - protein, 9 aa, Influenza virus
DVDQSLVIA

SEQ ID NO: 341764 - protein, 9 aa, Influenza virus
VDQSLVIAA

SEQ ID NO: 341765 - protein, 9 aa, Influenza virus
QSLVIAARN

SEQ ID NO: 341766 - protein, 9 aa, Influenza virus
SLVIAARNI

SEQ ID NO: 341767 - protein, 9 aa, Influenza virus
LVIAARNIV

SEQ ID NO: 341768 - protein, 9 aa, Influenza virus
VIAARNIVR

SEQ ID NO: 341769 - protein, 9 aa, Influenza virus
ARSIVRRAT

SEQ ID NO: 341770 - protein, 9 aa, Influenza virus
RSIVRRATV

SEQ ID NO: 341771 - protein, 9 aa, Influenza virus
SIVRRATVS

SEQ ID NO: 341772 - protein, 9 aa, Influenza virus
IVRRAIVSA

SEQ ID NO: 341773 - protein, 9 aa, Influenza virus
VRRAIVSAD

SEQ ID NO: 341774 - protein, 9 aa, Influenza virus
RRAIVSADP

SEQ ID NO: 341775 - protein, 9 aa, Influenza virus
RAIVSADPL

SEQ ID NO: 341776 - protein, 9 aa, Influenza virus
AIVSADPLA

SEQ ID NO: 341777 - protein, 9 aa, Influenza virus
IVSADPLAS

SEQ ID NO: 341778 - protein, 9 aa, Influenza virus
ADPLVSLLE

SEQ ID NO: 341779 - protein, 9 aa, Influenza virus
LSLLEMCHS

SEQ ID NO: 341780 - protein, 9 aa, Influenza virus
LLEMCHGTQ

SEQ ID NO: 341781 - protein, 9 aa, Influenza virus
LEMCHGTQI

SEQ ID NO: 341782 - protein, 9 aa, Influenza virus
EMCHGTQIG

SEQ ID NO: 341783 - protein, 9 aa, Influenza virus
MCHGTQIGG

SEQ ID NO: 341784 - protein, 9 aa, Influenza virus
DILKHNPTE

SEQ ID NO: 341785 - protein, 9 aa, Influenza virus
ILKHNPTEE

SEQ ID NO: 341786 - protein, 9 aa, Influenza virus
LKHNPTEEQ

SEQ ID NO: 341787 - protein, 9 aa, Influenza virus
NPTEEQAVN

SEQ ID NO: 341788 - protein, 9 aa, Influenza virus
PTEEQAVNI

SEQ ID NO: 341789 - protein, 9 aa, Influenza virus
TEEQAVNIC

SEQ ID NO: 341790 - protein, 9 aa, Influenza virus
EEQAVNICK

SEQ ID NO: 341791 - protein, 9 aa, Influenza virus
EQAVNICKA

SEQ ID NO: 341792 - protein, 9 aa, Influenza virus
QAVNICKAA

SEQ ID NO: 341793 - protein, 9 aa, Influenza virus
AVGICKAAM

SEQ ID NO: 341794 - protein, 9 aa, Influenza virus
VGICKAAMG

SEQ ID NO: 341795 - protein, 9 aa, Influenza virus
ICKAALGLR

SEQ ID NO: 341796 - protein, 9 aa, Influenza virus
CKAALGLRI

SEQ ID NO: 341797 - protein, 9 aa, Influenza virus
KAALGLRIS

SEQ ID NO: 341798 - protein, 9 aa, Influenza virus
AALGLRISS

SEQ ID NO: 341799 - protein, 9 aa, Influenza virus
ALGLRISSS

SEQ ID NO: 341800 - protein, 9 aa, Influenza virus
LGLRISSSF

SEQ ID NO: 341801 - protein, 9 aa, Influenza virus
GGFTFKRTN

SEQ ID NO: 341802 - protein, 9 aa, Influenza virus
GFTFKRTNG

SEQ ID NO: 341803 - protein, 9 aa, Influenza virus
FTFKRTKGF

SEQ ID NO: 341804 - protein, 9 aa, Influenza virus
TFKRTKGFS

SEQ ID NO: 341805 - protein, 9 aa, Influenza virus
EEELLTGNL

SEQ ID NO: 341806 - protein, 9 aa, Influenza virus
EELLTGNLQ

SEQ ID NO: 341807 - protein, 9 aa, Influenza virus
EVLTGNLQA

SEQ ID NO: 341808 - protein, 9 aa, Influenza virus
VLTGNLQAL

SEQ ID NO: 341809 - protein, 9 aa, Influenza virus
TGNLQTLRI

SEQ ID NO: 341810 - protein, 9 aa, Influenza virus
EGYEEFTIV

SEQ ID NO: 341811 - protein, 9 aa, Influenza virus
GYEEFTIVG

SEQ ID NO: 341812 - protein, 9 aa, Influenza virus
RATAIIRKA

SEQ ID NO: 341813 - protein, 9 aa, Influenza virus
ATAIIRKAT

SEQ ID NO: 341814 - protein, 9 aa, Influenza virus
TAILRKATK

SEQ ID NO: 341815 - protein, 9 aa, Influenza virus
KKATRRLIQ

SEQ ID NO: 341816 - protein, 9 aa, Influenza virus
KATRRMIQL

SEQ ID NO: 341817 - protein, 9 aa, Influenza virus
TRRMIQLIV

SEQ ID NO: 341818 - protein, 9 aa, Influenza virus
RMIQLIVSG

SEQ ID NO: 341819 - protein, 9 aa, Influenza virus
LVQLIVSGK

SEQ ID NO: 341820 - protein, 9 aa, Influenza virus
AIVFSQEDC

SEQ ID NO: 341821 - protein, 9 aa, Influenza virus
MVFSQEDCV

SEQ ID NO: 341822 - protein, 9 aa, Influenza virus
VFSQEECMI

SEQ ID NO: 341823 - protein, 9 aa, Influenza virus
FSQEECMIK

SEQ ID NO: 341824 - protein, 9 aa, Influenza virus
SQEECMIKA

SEQ ID NO: 341825 - protein, 9 aa, Influenza virus
QEECMIKAV

SEQ ID NO: 341826 - protein, 9 aa, Influenza virus
EECMIKAVR

SEQ ID NO: 341827 - protein, 9 aa, Influenza virus
ECMIKAVRG

SEQ ID NO: 341828 - protein, 9 aa, Influenza virus
CMMKAVRGD

SEQ ID NO: 341829 - protein, 9 aa, Influenza virus
MMKAVRGDL

SEQ ID NO: 341830 - protein, 9 aa, Influenza virus
LRHFQKNAK

SEQ ID NO: 341831 - protein, 9 aa, Influenza virus
RHFQKDARV

SEQ ID NO: 341832 - protein, 9 aa, Influenza virus
HFQKDARVL

SEQ ID NO: 341833 - protein, 9 aa, Influenza virus
RVSKVGVDE

SEQ ID NO: 341834 - protein, 9 aa, Influenza virus
VSKVGVDEY

SEQ ID NO: 341835 - protein, 9 aa, Influenza virus
SKTGVDEYS

SEQ ID NO: 341836 - protein, 9 aa, Influenza virus
KVGVDEYSS

SEQ ID NO: 341837 - protein, 9 aa, Influenza virus
VGVDEYSST

SEQ ID NO: 341838 - protein, 9 aa, Influenza virus
GVDEYSSAE

SEQ ID NO: 341839 - protein, 9 aa, Influenza virus
VDEYSNAEK

SEQ ID NO: 341840 - protein, 9 aa, Influenza virus
VVNIDRFLR

SEQ ID NO: 341841 - protein, 9 aa, Influenza virus
SIDRFLRVK

SEQ ID NO: 341842 - protein, 9 aa, Influenza virus
RFLRVKDQQ

SEQ ID NO: 341843 - protein, 9 aa, Influenza virus
FLRVKDQQG

SEQ ID NO: 341844 - protein, 9 aa, Influenza virus
LRVKDQQGN

SEQ ID NO: 341845 - protein, 9 aa, Influenza virus
RGNILLSPE

SEQ ID NO: 341846 - protein, 9 aa, Influenza virus
EEVSETQGM

SEQ ID NO: 341847 - protein, 9 aa, Influenza virus
EVSETQGME

SEQ ID NO: 341848 - protein, 9 aa, Influenza virus
EKLTIIYSS

SEQ ID NO: 341849 - protein, 9 aa, Influenza virus
KLTIIYSSS

SEQ ID NO: 341850 - protein, 9 aa, Influenza virus
LTIIYSSSM

SEQ ID NO: 341851 - protein, 9 aa, Influenza virus
TIIYSSSMM

SEQ ID NO: 341852 - protein, 9 aa, Influenza virus
IIYSSSMMW

SEQ ID NO: 341853 - protein, 9 aa, Influenza virus
IYSSSMMWE

SEQ ID NO: 341854 - protein, 9 aa, Influenza virus
YSSSMMWEV

SEQ ID NO: 341855 - protein, 9 aa, Influenza virus
SSSMMWEVN

SEQ ID NO: 341856 - protein, 9 aa, Influenza virus
SSMMWEVNG

SEQ ID NO: 341857 - protein, 9 aa, Influenza virus
SMMWEVNGP

SEQ ID NO: 341858 - protein, 9 aa, Influenza virus
MMWEVNGPE

SEQ ID NO: 341859 - protein, 9 aa, Influenza virus
MWEINGPDS

SEQ ID NO: 341860 - protein, 9 aa, Influenza virus
WEINGPDSV

SEQ ID NO: 341861 - protein, 9 aa, Influenza virus
EINGPDSVL

SEQ ID NO: 341862 - protein, 9 aa, Influenza virus
VNGPESVLV

SEQ ID NO: 341863 - protein, 9 aa, Influenza virus
NGPDSVLVN

SEQ ID NO: 341864 - protein, 9 aa, Influenza virus
GPDSVLVNT

SEQ ID NO: 341865 - protein, 9 aa, Influenza virus
PDSVLVNTY

SEQ ID NO: 341866 - protein, 9 aa, Influenza virus
VLVNTYQWV

SEQ ID NO: 341867 - protein, 9 aa, Influenza virus
LVNTYQWVI

SEQ ID NO: 341868 - protein, 9 aa, Influenza virus
VNTYQWVIR

SEQ ID NO: 341869 - protein, 9 aa, Influenza virus
NTYQWIIKN

SEQ ID NO: 341870 - protein, 9 aa, Influenza virus
TYQWIIKNW

SEQ ID NO: 341871 - protein, 9 aa, Influenza virus
YQWIIKNWE

SEQ ID NO: 341872 - protein, 9 aa, Influenza virus
KIQWSQNPT

SEQ ID NO: 341873 - protein, 9 aa, Influenza virus
LYNKVEFEP

SEQ ID NO: 341874 - protein, 9 aa, Influenza virus
YNKVEFEPF

SEQ ID NO: 341875 - protein, 9 aa, Influenza virus
NKVEFEPFQ

SEQ ID NO: 341876 - protein, 9 aa, Influenza virus
KVEFEPFQS

SEQ ID NO: 341877 - protein, 9 aa, Influenza virus
VEFEPFQSL

SEQ ID NO: 341878 - protein, 9 aa, Influenza virus
EPFQSLIPK

SEQ ID NO: 341879 - protein, 9 aa, Influenza virus
PFQSLIPKA

SEQ ID NO: 341880 - protein, 9 aa, Influenza virus
RSQYSGFVR

SEQ ID NO: 341881 - protein, 9 aa, Influenza virus
LYSGFVRTL

SEQ ID NO: 341882 - protein, 9 aa, Influenza virus
MRDVIGTFD

SEQ ID NO: 341883 - protein, 9 aa, Influenza virus
RDVIGTFDT

SEQ ID NO: 341884 - protein, 9 aa, Influenza virus
GTFDTAQII

SEQ ID NO: 341885 - protein, 9 aa, Influenza virus
TFDTAQIIK

SEQ ID NO: 341886 - protein, 9 aa, Influenza virus
TAQIIKLLP

SEQ ID NO: 341887 - protein, 9 aa, Influenza virus
AQIIKLLPF

SEQ ID NO: 341888 - protein, 9 aa, Influenza virus
IIKLLPFAS

SEQ ID NO: 341889 - protein, 9 aa, Influenza virus
LPFAAAPPV

SEQ ID NO: 341890 - protein, 9 aa, Influenza virus
PFAAAPPVQ

SEQ ID NO: 341891 - protein, 9 aa, Influenza virus
FAAAPPVQS

SEQ ID NO: 341892 - protein, 9 aa, Influenza virus
SAPPEQSRM

SEQ ID NO: 341893 - protein, 9 aa, Influenza virus
APPVQSRMQ

SEQ ID NO: 341894 - protein, 9 aa, Influenza virus
PPVQSRMQF

SEQ ID NO: 341895 - protein, 9 aa, Influenza virus
PVQSRMQFS

SEQ ID NO: 341896 - protein, 9 aa, Influenza virus
VQSRMQFSS

SEQ ID NO: 341897 - protein, 9 aa, Influenza virus
QNRMQFSSL

SEQ ID NO: 341898 - protein, 9 aa, Influenza virus
NRMQFSSLT

SEQ ID NO: 341899 - protein, 9 aa, Influenza virus
RMQFSSLAV

SEQ ID NO: 341900 - protein, 9 aa, Influenza virus
MQFSSLAVN

SEQ ID NO: 341901 - protein, 9 aa, Influenza virus
QFSSLAVNV

SEQ ID NO: 341902 - protein, 9 aa, Influenza virus
FSSLAVNVR

SEQ ID NO: 341903 - protein, 9 aa, Influenza virus
SSLAVNVRG

SEQ ID NO: 341904 - protein, 9 aa, Influenza virus
SLTVSVRGS

SEQ ID NO: 341905 - protein, 9 aa, Influenza virus
LTVSVRGSG

SEQ ID NO: 341906 - protein, 9 aa, Influenza virus
TVNVRGTGM

SEQ ID NO: 341907 - protein, 9 aa, Influenza virus
VNVRGTGMR

SEQ ID NO: 341908 - protein, 9 aa, Influenza virus
NVRGTGMRI

SEQ ID NO: 341909 - protein, 9 aa, Influenza virus
VRGTGMRIL

SEQ ID NO: 341910 - protein, 9 aa, Influenza virus
RGSGMRILI

SEQ ID NO: 341911 - protein, 9 aa, Influenza virus
GSGMRILIR

SEQ ID NO: 341912 - protein, 9 aa, Influenza virus
SGMRILIRG

SEQ ID NO: 341913 - protein, 9 aa, Influenza virus
GMRILIRGN

SEQ ID NO: 341914 - protein, 9 aa, Influenza virus
MRILIRGNS

SEQ ID NO: 341915 - protein, 9 aa, Influenza virus
RVLIRGNSP

SEQ ID NO: 341916 - protein, 9 aa, Influenza virus
LVRGNSPAF

SEQ ID NO: 341917 - protein, 9 aa, Influenza virus
VRGNSPAFN

SEQ ID NO: 341918 - protein, 9 aa, Influenza virus
RGNSPAFNY

SEQ ID NO: 341919 - protein, 9 aa, Influenza virus
GNSPAFNYN

SEQ ID NO: 341920 - protein, 9 aa, Influenza virus
NSPIFNYNK

SEQ ID NO: 341921 - protein, 9 aa, Influenza virus
TKRLTIIGK

SEQ ID NO: 341922 - protein, 9 aa, Influenza virus
KRLTIIGKD

SEQ ID NO: 341923 - protein, 9 aa, Influenza virus
RLTIIGKDA

SEQ ID NO: 341924 - protein, 9 aa, Influenza virus
TGVESAVLR

SEQ ID NO: 341925 - protein, 9 aa, Influenza virus
LRGFLILGR

SEQ ID NO: 341926 - protein, 9 aa, Influenza virus
RGFLILGRE

SEQ ID NO: 341927 - protein, 9 aa, Influenza virus
GFLILGKEN

SEQ ID NO: 341928 - protein, 9 aa, Influenza virus
FLILGKEDR

SEQ ID NO: 341929 - protein, 9 aa, Influenza virus
GREDKRYGP

SEQ ID NO: 341930 - protein, 9 aa, Influenza virus
REDKRYGPA

SEQ ID NO: 341931 - protein, 9 aa, Influenza virus
ENKRYGPAL

SEQ ID NO: 341932 - protein, 9 aa, Influenza virus
NKRYGPALS

SEQ ID NO: 341933 - protein, 9 aa, Influenza virus
KKYGPALSI

SEQ ID NO: 341934 - protein, 9 aa, Influenza virus
KYGPALSIN

SEQ ID NO: 341935 - protein, 9 aa, Influenza virus
PALSINELG

SEQ ID NO: 341936 - protein, 9 aa, Influenza virus
ALSINELSK

SEQ ID NO: 341937 - protein, 9 aa, Influenza virus
LARGEKANV

SEQ ID NO: 341938 - protein, 9 aa, Influenza virus
ARGEKANVL

SEQ ID NO: 341939 - protein, 9 aa, Influenza virus
ATKRIRMAT

SEQ ID NO: 341940 - protein, 9 aa, Influenza virus
RIRMAINYS

SEQ ID NO: 341941 - protein, 9 aa, Influenza virus
MKSRGYKMN

SEQ ID NO: 341942 - protein, 9 aa, Influenza virus
KRKKRGLFG

SEQ ID NO: 341943 - protein, 9 aa, Influenza virus
QMTRGLFGA

SEQ ID NO: 341944 - protein, 9 aa, Influenza virus
ARGLFGAIA

SEQ ID NO: 341945 - protein, 9 aa, Influenza virus
AGVKMNPNQ

SEQ ID NO: 341946 - protein, 9 aa, Influenza virus
GVKMNPNQK

SEQ ID NO: 341947 - protein, 9 aa, Influenza virus
VKMNPNQKI

SEQ ID NO: 341948 - protein, 9 aa, Influenza virus
RTQESECQC

SEQ ID NO: 341949 - protein, 9 aa, Influenza virus
IRHLEECSC

SEQ ID NO: 341950 - protein, 9 aa, Influenza virus
GWAVHSKDN

SEQ ID NO: 341951 - protein, 9 aa, Influenza virus
SKDNGIRIG

SEQ ID NO: 341952 - protein, 9 aa, Influenza virus
KDNNIRIGS

SEQ ID NO: 341953 - protein, 9 aa, Influenza virus
DNSIRIGSR

SEQ ID NO: 341954 - protein, 9 aa, Influenza virus
NSIRIGSRG

SEQ ID NO: 341955 - protein, 9 aa, Influenza virus
SIRIGSRGD

SEQ ID NO: 341956 - protein, 9 aa, Influenza virus
IRIGSRGDV

SEQ ID NO: 341957 - protein, 9 aa, Influenza virus
GDVFVMREP

SEQ ID NO: 341958 - protein, 9 aa, Influenza virus
DVFVMREPF

SEQ ID NO: 341959 - protein, 9 aa, Influenza virus
FIIREPFIS

SEQ ID NO: 341960 - protein, 9 aa, Influenza virus
SECRTFFLT

SEQ ID NO: 341961 - protein, 9 aa, Influenza virus
NDKHSNGTA

SEQ ID NO: 341962 - protein, 9 aa, Influenza virus
DRSPHRALM

SEQ ID NO: 341963 - protein, 9 aa, Influenza virus
PHRALMSCP

SEQ ID NO: 341964 - protein, 9 aa, Influenza virus
RALMSCPIG

SEQ ID NO: 341965 - protein, 9 aa, Influenza virus
IGEAPSPYN

SEQ ID NO: 341966 - protein, 9 aa, Influenza virus
SASACHDGL

SEQ ID NO: 341967 - protein, 9 aa, Influenza virus
GWITIGISG

SEQ ID NO: 341968 - protein, 9 aa, Influenza virus
IGISGPDSG

SEQ ID NO: 341969 - protein, 9 aa, Influenza virus
GISGPDSGA

SEQ ID NO: 341970 - protein, 9 aa, Influenza virus
ISGPDSGAV

SEQ ID NO: 341971 - protein, 9 aa, Influenza virus
SGPDSGAVA

SEQ ID NO: 341972 - protein, 9 aa, Influenza virus
GPDSGAVAV

SEQ ID NO: 341973 - protein, 9 aa, Influenza virus
PDSGAVAVL

SEQ ID NO: 341974 - protein, 9 aa, Influenza virus
DSGAVAVLK

SEQ ID NO: 341975 - protein, 9 aa, Influenza virus
SGAVAVLKY

SEQ ID NO: 341976 - protein, 9 aa, Influenza virus
GAVAVLKYK

SEQ ID NO: 341977 - protein, 9 aa, Influenza virus
AVLKYKGII

SEQ ID NO: 341978 - protein, 9 aa, Influenza virus
VLKYKGIIT

SEQ ID NO: 341979 - protein, 9 aa, Influenza virus
NGFCFTVMT

SEQ ID NO: 341980 - protein, 9 aa, Influenza virus
GSCFTLMTD

SEQ ID NO: 341981 - protein, 9 aa, Influenza virus
SCFTLMTDG

SEQ ID NO: 341982 - protein, 9 aa, Influenza virus
FTVMTDGPN

SEQ ID NO: 341983 - protein, 9 aa, Influenza virus
APNSHYEEC

SEQ ID NO: 341984 - protein, 9 aa, Influenza virus
PNSHYEECS

SEQ ID NO: 341985 - protein, 9 aa, Influenza virus
NSHYEECSC

SEQ ID NO: 341986 - protein, 9 aa, Influenza virus
SHYEECSCY

SEQ ID NO: 341987 - protein, 9 aa, Influenza virus
EECSCYPES

SEQ ID NO: 341988 - protein, 9 aa, Influenza virus
ICVCRDNWH

SEQ ID NO: 341989 - protein, 9 aa, Influenza virus
HGANRPWVS

SEQ ID NO: 341990 - protein, 9 aa, Influenza virus
GANRPWVSF

SEQ ID NO: 341991 - protein, 9 aa, Influenza virus
SNRPWISFD

SEQ ID NO: 341992 - protein, 9 aa, Influenza virus
NRPWISFNQ

SEQ ID NO: 341993 - protein, 9 aa, Influenza virus
YQVGYICSG

SEQ ID NO: 341994 - protein, 9 aa, Influenza virus
ICSGVLGDN

SEQ ID NO: 341995 - protein, 9 aa, Influenza virus
CSGVLGDNP

SEQ ID NO: 341996 - protein, 9 aa, Influenza virus
SGVLGDNPR

SEQ ID NO: 341997 - protein, 9 aa, Influenza virus
GVFGDSPRP

SEQ ID NO: 341998 - protein, 9 aa, Influenza virus
GIKGFSFKY

SEQ ID NO: 341999 - protein, 9 aa, Influenza virus
KYGNGVWMG

SEQ ID NO: 342000 - protein, 9 aa, Influenza virus
YGNGVWMGR

SEQ ID NO: 342001 - protein, 9 aa, Influenza virus
GNGVWMGRT

SEQ ID NO: 342002 - protein, 9 aa, Influenza virus
TNWSGYSGS

SEQ ID NO: 342003 - protein, 9 aa, Influenza virus
QHPELTGMD

SEQ ID NO: 342004 - protein, 9 aa, Influenza virus
HPELTGMDC

SEQ ID NO: 342005 - protein, 9 aa, Influenza virus
NCMRPCFWV

SEQ ID NO: 342006 - protein, 9 aa, Influenza virus
FWVELVRGR

SEQ ID NO: 342007 - protein, 9 aa, Influenza virus
WVELVRGRP

SEQ ID NO: 342008 - protein, 9 aa, Influenza virus
TIWTSGSII

SEQ ID NO: 342009 - protein, 9 aa, Influenza virus
IWTSGSIIS

SEQ ID NO: 342010 - protein, 9 aa, Influenza virus
SIISFCGVN

SEQ ID NO: 342011 - protein, 9 aa, Influenza virus
WSWPDDAEL

SEQ ID NO: 342012 - protein, 9 aa, Influenza virus
SWPDDAELP

SEQ ID NO: 342013 - protein, 9 aa, Influenza virus
WPDGAKLPF

SEQ ID NO: 342014 - protein, 9 aa, Influenza virus
GFAPFTKDN

SEQ ID NO: 342015 - protein, 9 aa, Influenza virus
FAPFTKDNS

SEQ ID NO: 342016 - protein, 9 aa, Influenza virus
APFTKDNSI

SEQ ID NO: 342017 - protein, 9 aa, Influenza virus
PLSKDNSIR

SEQ ID NO: 342018 - protein, 9 aa, Influenza virus
LSKDNSIRL

SEQ ID NO: 342019 - protein, 9 aa, Influenza virus
SKDNSVRLS

SEQ ID NO: 342020 - protein, 9 aa, Influenza virus
DNSIRLAAG

SEQ ID NO: 342021 - protein, 9 aa, Influenza virus
NSIRLAAGG

SEQ ID NO: 342022 - protein, 9 aa, Influenza virus
VWVTREPYV

SEQ ID NO: 342023 - protein, 9 aa, Influenza virus
TREPYVSCE

SEQ ID NO: 342024 - protein, 9 aa, Influenza virus
PYRTLLMSE

SEQ ID NO: 342025 - protein, 9 aa, Influenza virus
YRTLLMSEL

SEQ ID NO: 342026 - protein, 9 aa, Influenza virus
GIPFHLGTK

SEQ ID NO: 342027 - protein, 9 aa, Influenza virus
IPFHLGTKQ

SEQ ID NO: 342028 - protein, 9 aa, Influenza virus
TRQVCMAWS

SEQ ID NO: 342029 - protein, 9 aa, Influenza virus
RQVCMAWSS

SEQ ID NO: 342030 - protein, 9 aa, Influenza virus
IAWSSSSCY

SEQ ID NO: 342031 - protein, 9 aa, Influenza virus
SSSCHDGNA

SEQ ID NO: 342032 - protein, 9 aa, Influenza virus
SSCHDGNAW

SEQ ID NO: 342033 - protein, 9 aa, Influenza virus
SCHDGNAWL

SEQ ID NO: 342034 - protein, 9 aa, Influenza virus
CHDGNAWLH

SEQ ID NO: 342035 - protein, 9 aa, Influenza virus
DGNAWLHVC

SEQ ID NO: 342036 - protein, 9 aa, Influenza virus
DILRTQESE

SEQ ID NO: 342037 - protein, 9 aa, Influenza virus
ESECVCIDG

SEQ ID NO: 342038 - protein, 9 aa, Influenza virus
CTVIMTDGS

SEQ ID NO: 342039 - protein, 9 aa, Influenza virus
TVIMTDGSA

SEQ ID NO: 342040 - protein, 9 aa, Influenza virus
VMTDGSASD

SEQ ID NO: 342041 - protein, 9 aa, Influenza virus
IEECSCYPQ

SEQ ID NO: 342042 - protein, 9 aa, Influenza virus
EECSCYPRH

SEQ ID NO: 342043 - protein, 9 aa, Influenza virus
KCVCRDNWK

SEQ ID NO: 342044 - protein, 9 aa, Influenza virus
NWRGSNRPI

SEQ ID NO: 342045 - protein, 9 aa, Influenza virus
GLVGDTPRD

SEQ ID NO: 342046 - protein, 9 aa, Influenza virus
GVKGWAFDY

SEQ ID NO: 342047 - protein, 9 aa, Influenza virus
RAGYETFRV

SEQ ID NO: 342048 - protein, 9 aa, Influenza virus
VWWTANSII

SEQ ID NO: 342049 - protein, 9 aa, Influenza virus
WTSNSIIAF

SEQ ID NO: 342050 - protein, 9 aa, Influenza virus
TSNSIIAFC

SEQ ID NO: 342051 - protein, 9 aa, Influenza virus
SNSIIAFCG

SEQ ID NO: 342052 - protein, 9 aa, Influenza virus
NSIIAFCGT

SEQ ID NO: 342053 - protein, 9 aa, Influenza virus
SIIAFCGTS

SEQ ID NO: 342054 - protein, 9 aa, Influenza virus
IIAFCGTSG

SEQ ID NO: 342055 - protein, 9 aa, Influenza virus
VAFCGTSGT

SEQ ID NO: 342056 - protein, 9 aa, Influenza virus
TSGTYGTGT

SEQ ID NO: 342057 - protein, 9 aa, Influenza virus
SGTYGTGTW

SEQ ID NO: 342058 - protein, 9 aa, Influenza virus
GTYGTGTWP

SEQ ID NO: 342059 - protein, 9 aa, Influenza virus
GTGTWPDGA

SEQ ID NO: 342060 - protein, 9 aa, Influenza virus
GSWPDGAEI

SEQ ID NO: 342061 - protein, 9 aa, Influenza virus
ADINLMPIY

SEQ ID NO: 342062 - protein, 9 aa, Influenza virus
NINFMPYIS

SEQ ID NO: 342063 - protein, 9 aa, Influenza virus
INFMPYISF

SEQ ID NO: 342064 - protein, 9 aa, Influenza virus
SCLYKLSQF

SEQ ID NO: 342065 - protein, 9 aa, Influenza virus
ALIIGVGNL

SEQ ID NO: 342066 - protein, 9 aa, Influenza virus
GNLIFNAVI

SEQ ID NO: 342067 - protein, 9 aa, Influenza virus
NLIFNAVIH

SEQ ID NO: 342068 - protein, 9 aa, Influenza virus
DNAIRLGET

SEQ ID NO: 342069 - protein, 9 aa, Influenza virus
IITREPYVS

SEQ ID NO: 342070 - protein, 9 aa, Influenza virus
REPYVSCDS

SEQ ID NO: 342071 - protein, 9 aa, Influenza virus
HCWSFALAQ

SEQ ID NO: 342072 - protein, 9 aa, Influenza virus
FALSQGALL

SEQ ID NO: 342073 - protein, 9 aa, Influenza virus
ALSQGALLG

SEQ ID NO: 342074 - protein, 9 aa, Influenza virus
LAQGVLLGT

SEQ ID NO: 342075 - protein, 9 aa, Influenza virus
LLGTRHSNG

SEQ ID NO: 342076 - protein, 9 aa, Influenza virus
LGTRHSNGT

SEQ ID NO: 342077 - protein, 9 aa, Influenza virus
HSNGTIEDR

SEQ ID NO: 342078 - protein, 9 aa, Influenza virus
SNGTIEDRT

SEQ ID NO: 342079 - protein, 9 aa, Influenza virus
KDRAPYRSL

SEQ ID NO: 342080 - protein, 9 aa, Influenza virus
RAPYRSLIR

SEQ ID NO: 342081 - protein, 9 aa, Influenza virus
APYRSLIRF

SEQ ID NO: 342082 - protein, 9 aa, Influenza virus
PYRSLIKFP

SEQ ID NO: 342083 - protein, 9 aa, Influenza virus
YRSLIQFPM

SEQ ID NO: 342084 - protein, 9 aa, Influenza virus
RSLIQFPMG

SEQ ID NO: 342085 - protein, 9 aa, Influenza virus
GAAPVLGNY

SEQ ID NO: 342086 - protein, 9 aa, Influenza virus
APVLGNCKE

SEQ ID NO: 342087 - protein, 9 aa, Influenza virus
FDGREWMHV

SEQ ID NO: 342088 - protein, 9 aa, Influenza virus
DGREWMHVC

SEQ ID NO: 342089 - protein, 9 aa, Influenza virus
KNILRTQES

SEQ ID NO: 342090 - protein, 9 aa, Influenza virus
TDGPADNKA

SEQ ID NO: 342091 - protein, 9 aa, Influenza virus
ADHRIYWVR

SEQ ID NO: 342092 - protein, 9 aa, Influenza virus
KVQHLEECS

SEQ ID NO: 342093 - protein, 9 aa, Influenza virus
IRHLEECSC

SEQ ID NO: 342094 - protein, 9 aa, Influenza virus
DIYCVCRDN

SEQ ID NO: 342095 - protein, 9 aa, Influenza virus
IYCVCRDNW

SEQ ID NO: 342096 - protein, 9 aa, Influenza virus
GSNRPWIRI

SEQ ID NO: 342097 - protein, 9 aa, Influenza virus
SNRPWVRIN

SEQ ID NO: 342098 - protein, 9 aa, Influenza virus
NRPWVRINN

SEQ ID NO: 342099 - protein, 9 aa, Influenza virus
RPWVRINNE

SEQ ID NO: 342100 - protein, 9 aa, Influenza virus
PWVRINNET

SEQ ID NO: 342101 - protein, 9 aa, Influenza virus
WVRINNETI

SEQ ID NO: 342102 - protein, 9 aa, Influenza virus
INNETIIET

SEQ ID NO: 342103 - protein, 9 aa, Influenza virus
NNETIVETG

SEQ ID NO: 342104 - protein, 9 aa, Influenza virus
ETIVETGYV

SEQ ID NO: 342105 - protein, 9 aa, Influenza virus
TIVETGYVC

SEQ ID NO: 342106 - protein, 9 aa, Influenza virus
IVETGYVCS

SEQ ID NO: 342107 - protein, 9 aa, Influenza virus
VETGYVCSK

SEQ ID NO: 342108 - protein, 9 aa, Influenza virus
FHSDTPRPS

SEQ ID NO: 342109 - protein, 9 aa, Influenza virus
HSDTPRPSD

SEQ ID NO: 342110 - protein, 9 aa, Influenza virus
SDTPRPSDP

SEQ ID NO: 342111 - protein, 9 aa, Influenza virus
DTPRPSDPS

SEQ ID NO: 342112 - protein, 9 aa, Influenza virus
EPGVKGFGF

SEQ ID NO: 342113 - protein, 9 aa, Influenza virus
PGVKGFGFR

SEQ ID NO: 342114 - protein, 9 aa, Influenza virus
GSDVWLGRT

SEQ ID NO: 342115 - protein, 9 aa, Influenza virus
SDVWLGRTV

SEQ ID NO: 342116 - protein, 9 aa, Influenza virus
RSGFEVIRV

SEQ ID NO: 342117 - protein, 9 aa, Influenza virus
TQTLVANND

SEQ ID NO: 342118 - protein, 9 aa, Influenza virus
SGYSGSFSV

SEQ ID NO: 342119 - protein, 9 aa, Influenza virus
ACFQPCFYV

SEQ ID NO: 342120 - protein, 9 aa, Influenza virus
FYVELTRGV

SEQ ID NO: 342121 - protein, 9 aa, Influenza virus
VSWTSNSII

SEQ ID NO: 342122 - protein, 9 aa, Influenza virus
FWTSNSIVT

SEQ ID NO: 342123 - protein, 9 aa, Influenza virus
VVTFCGLDN

SEQ ID NO: 342124 - protein, 9 aa, Influenza virus
GSGNWPDGP

SEQ ID NO: 342125 - protein, 9 aa, Influenza virus
WPDGYNIGF

SEQ ID NO: 342126 - protein, 9 aa, Influenza virus
PDGSNIGFV

SEQ ID NO: 342127 - protein, 9 aa, Influenza virus
DGSNIKFMP

SEQ ID NO: 342128 - protein, 9 aa, Influenza virus
NQMIITIGS

SEQ ID NO: 342129 - protein, 9 aa, Influenza virus
IITIGSISV

SEQ ID NO: 342130 - protein, 9 aa, Influenza virus
TIGLLLQII

SEQ ID NO: 342131 - protein, 9 aa, Influenza virus
IGLLLQIIS

SEQ ID NO: 342132 - protein, 9 aa, Influenza virus
WFSHYNQVA

SEQ ID NO: 342133 - protein, 9 aa, Influenza virus
FSHYNQVAQ

SEQ ID NO: 342134 - protein, 9 aa, Influenza virus
SHYNQMKQA

SEQ ID NO: 342135 - protein, 9 aa, Influenza virus
VNMTNVQNN

SEQ ID NO: 342136 - protein, 9 aa, Influenza virus
NMTNVQNNY

SEQ ID NO: 342137 - protein, 9 aa, Influenza virus
MTNVQNNYT

SEQ ID NO: 342138 - protein, 9 aa, Influenza virus
NVQNDYTTV

SEQ ID NO: 342139 - protein, 9 aa, Influenza virus
ISCSVSECR

SEQ ID NO: 342140 - protein, 9 aa, Influenza virus
SCSIHECRT

SEQ ID NO: 342141 - protein, 9 aa, Influenza virus
CSIHECRTF

SEQ ID NO: 342142 - protein, 9 aa, Influenza virus
SIHECRTFF

SEQ ID NO: 342143 - protein, 9 aa, Influenza virus
IHECRTFFL

SEQ ID NO: 342144 - protein, 9 aa, Influenza virus
HECRTFFLT

SEQ ID NO: 342145 - protein, 9 aa, Influenza virus
LMSCPIGVV

SEQ ID NO: 342146 - protein, 9 aa, Influenza virus
MSCHIGVAP

SEQ ID NO: 342147 - protein, 9 aa, Influenza virus
SCHIGVAPS

SEQ ID NO: 342148 - protein, 9 aa, Influenza virus
CHIGVAPSP

SEQ ID NO: 342149 - protein, 9 aa, Influenza virus
PIGVVPSPS

SEQ ID NO: 342150 - protein, 9 aa, Influenza virus
TIGITGPDA

SEQ ID NO: 342151 - protein, 9 aa, Influenza virus
IGITGPDAT

SEQ ID NO: 342152 - protein, 9 aa, Influenza virus
PDATAVVVL

SEQ ID NO: 342153 - protein, 9 aa, Influenza virus
DATAVAVIK

SEQ ID NO: 342154 - protein, 9 aa, Influenza virus
ATAVAVIKY

SEQ ID NO: 342155 - protein, 9 aa, Influenza virus
TLVTDGPSD

SEQ ID NO: 342156 - protein, 9 aa, Influenza virus
LVTDGPSDA

SEQ ID NO: 342157 - protein, 9 aa, Influenza virus
VTDGPSDAQ

SEQ ID NO: 342158 - protein, 9 aa, Influenza virus
LKIKKGKIM

SEQ ID NO: 342159 - protein, 9 aa, Influenza virus
AAGFHFEEC

SEQ ID NO: 342160 - protein, 9 aa, Influenza virus
IGFHFEECS

SEQ ID NO: 342161 - protein, 9 aa, Influenza virus
CSCYPSGED

SEQ ID NO: 342162 - protein, 9 aa, Influenza virus
NIECVCRDN

SEQ ID NO: 342163 - protein, 9 aa, Influenza virus
WIRFNSDPD

SEQ ID NO: 342164 - protein, 9 aa, Influenza virus
IRFNSDLNY

SEQ ID NO: 342165 - protein, 9 aa, Influenza virus
DPDYQIGYV

SEQ ID NO: 342166 - protein, 9 aa, Influenza virus
ICSGIFGDN

SEQ ID NO: 342167 - protein, 9 aa, Influenza virus
FGDNPRSVD

SEQ ID NO: 342168 - protein, 9 aa, Influenza virus
GDNPRPMDG

SEQ ID NO: 342169 - protein, 9 aa, Influenza virus
PRPMDSTGS

SEQ ID NO: 342170 - protein, 9 aa, Influenza virus
RPMDSTGSC

SEQ ID NO: 342171 - protein, 9 aa, Influenza virus
CGVNSDTTS

SEQ ID NO: 342172 - protein, 9 aa, Influenza virus
GVNSDTTSW

SEQ ID NO: 342173 - protein, 9 aa, Influenza virus
SDTTGWPWP

SEQ ID NO: 342174 - protein, 9 aa, Influenza virus
NTTGWSWPD

SEQ ID NO: 342175 - protein, 9 aa, Influenza virus
QKIITIGSM

SEQ ID NO: 342176 - protein, 9 aa, Influenza virus
KIMTIGSVS

SEQ ID NO: 342177 - protein, 9 aa, Influenza virus
IMTIGSVSL

SEQ ID NO: 342178 - protein, 9 aa, Influenza virus
TIGSVSLTL

SEQ ID NO: 342179 - protein, 9 aa, Influenza virus
TTEVYSETV

SEQ ID NO: 342180 - protein, 9 aa, Influenza virus
TKVYNETVR

SEQ ID NO: 342181 - protein, 9 aa, Influenza virus
EVYSETVRV

SEQ ID NO: 342182 - protein, 9 aa, Influenza virus
VYSETVRVE

SEQ ID NO: 342183 - protein, 9 aa, Influenza virus
YNETVRVKT

SEQ ID NO: 342184 - protein, 9 aa, Influenza virus
VIPVNNTIY

SEQ ID NO: 342185 - protein, 9 aa, Influenza virus
KFLNNTEPL

SEQ ID NO: 342186 - protein, 9 aa, Influenza virus
FNNTEPLCE

SEQ ID NO: 342187 - protein, 9 aa, Influenza virus
PLCEVSGFV

SEQ ID NO: 342188 - protein, 9 aa, Influenza virus
LCEVSGFVI

SEQ ID NO: 342189 - protein, 9 aa, Influenza virus
SGFAVVSKD

SEQ ID NO: 342190 - protein, 9 aa, Influenza virus
GFVIVSKDN

SEQ ID NO: 342191 - protein, 9 aa, Influenza virus
FVIVSKDNG

SEQ ID NO: 342192 - protein, 9 aa, Influenza virus
AIASKDNGI

SEQ ID NO: 342193 - protein, 9 aa, Influenza virus
IASKDNGIR

SEQ ID NO: 342194 - protein, 9 aa, Influenza virus
ISKDNGIRI

SEQ ID NO: 342195 - protein, 9 aa, Influenza virus
EPFVACGPA

SEQ ID NO: 342196 - protein, 9 aa, Influenza virus
PFVACGPAE

SEQ ID NO: 342197 - protein, 9 aa, Influenza virus
FVACGPAEC

SEQ ID NO: 342198 - protein, 9 aa, Influenza virus
VACGPAECR

SEQ ID NO: 342199 - protein, 9 aa, Influenza virus
ACGPAECRT

SEQ ID NO: 342200 - protein, 9 aa, Influenza virus
CSPSECRTF

SEQ ID NO: 342201 - protein, 9 aa, Influenza virus
SPSECRTFF

SEQ ID NO: 342202 - protein, 9 aa, Influenza virus
ACHDGKGWL

SEQ ID NO: 342203 - protein, 9 aa, Influenza virus
GVSGTDDDA

SEQ ID NO: 342204 - protein, 9 aa, Influenza virus
VSGTDDDAY

SEQ ID NO: 342205 - protein, 9 aa, Influenza virus
YGGVPTDVI

SEQ ID NO: 342206 - protein, 9 aa, Influenza virus
GGVPTDVIR

SEQ ID NO: 342207 - protein, 9 aa, Influenza virus
GVPTDVIRS

SEQ ID NO: 342208 - protein, 9 aa, Influenza virus
VPTDVIRSW

SEQ ID NO: 342209 - protein, 9 aa, Influenza virus
TDVVRSWRR

SEQ ID NO: 342210 - protein, 9 aa, Influenza virus
DVVRSWRKK

SEQ ID NO: 342211 - protein, 9 aa, Influenza virus
VVRSWRKKI

SEQ ID NO: 342212 - protein, 9 aa, Influenza virus
VRSWRKKIL

SEQ ID NO: 342213 - protein, 9 aa, Influenza virus
RSWRRQILR

SEQ ID NO: 342214 - protein, 9 aa, Influenza virus
SWRRQILRT

SEQ ID NO: 342215 - protein, 9 aa, Influenza virus
WRRQILRTQ

SEQ ID NO: 342216 - protein, 9 aa, Influenza virus
RRQILRTQE

SEQ ID NO: 342217 - protein, 9 aa, Influenza virus
QESSCVCIK

SEQ ID NO: 342218 - protein, 9 aa, Influenza virus
ESSCVCIKG

SEQ ID NO: 342219 - protein, 9 aa, Influenza virus
VMTDGPASN

SEQ ID NO: 342220 - protein, 9 aa, Influenza virus
MTDGPASNQ

SEQ ID NO: 342221 - protein, 9 aa, Influenza virus
TDGPASNQA

SEQ ID NO: 342222 - protein, 9 aa, Influenza virus
DGPASNQAS

SEQ ID NO: 342223 - protein, 9 aa, Influenza virus
GPANKQASY

SEQ ID NO: 342224 - protein, 9 aa, Influenza virus
PANKQASYK

SEQ ID NO: 342225 - protein, 9 aa, Influenza virus
ANKQASYKI

SEQ ID NO: 342226 - protein, 9 aa, Influenza virus
SNQASYKIF

SEQ ID NO: 342227 - protein, 9 aa, Influenza virus
NQASYRIFK

SEQ ID NO: 342228 - protein, 9 aa, Influenza virus
ASYKIFKSR

SEQ ID NO: 342229 - protein, 9 aa, Influenza virus
EVSFRGGHI

SEQ ID NO: 342230 - protein, 9 aa, Influenza virus
ISFQSGHIE

SEQ ID NO: 342231 - protein, 9 aa, Influenza virus
CSCYPNLGQ

SEQ ID NO: 342232 - protein, 9 aa, Influenza virus
SCYPNLGQV

SEQ ID NO: 342233 - protein, 9 aa, Influenza virus
CYPNLGQVE

SEQ ID NO: 342234 - protein, 9 aa, Influenza virus
YPNLGQVEC

SEQ ID NO: 342235 - protein, 9 aa, Influenza virus
PNLGQVECV

SEQ ID NO: 342236 - protein, 9 aa, Influenza virus
NLGQVECVC

SEQ ID NO: 342237 - protein, 9 aa, Influenza virus
LGQVECVCR

SEQ ID NO: 342238 - protein, 9 aa, Influenza virus
YDVGYLCAG

SEQ ID NO: 342239 - protein, 9 aa, Influenza virus
KVGYLCAGI

SEQ ID NO: 342240 - protein, 9 aa, Influenza virus
TDTPRVQDD

SEQ ID NO: 342241 - protein, 9 aa, Influenza virus
AIGGSGTDN

SEQ ID NO: 342242 - protein, 9 aa, Influenza virus
VGRSGTNNY

SEQ ID NO: 342243 - protein, 9 aa, Influenza virus
NSVWAGRTM

SEQ ID NO: 342244 - protein, 9 aa, Influenza virus
NVWAGRTVS

SEQ ID NO: 342245 - protein, 9 aa, Influenza virus
SISSRNGFE

SEQ ID NO: 342246 - protein, 9 aa, Influenza virus
GFEVLFIED

SEQ ID NO: 342247 - protein, 9 aa, Influenza virus
FEVLFIEDG

SEQ ID NO: 342248 - protein, 9 aa, Influenza virus
EVLFIEDGW

SEQ ID NO: 342249 - protein, 9 aa, Influenza virus
EVLNNRNWS

SEQ ID NO: 342250 - protein, 9 aa, Influenza virus
VLNNMNWSG

SEQ ID NO: 342251 - protein, 9 aa, Influenza virus
LNNMNWSGY

SEQ ID NO: 342252 - protein, 9 aa, Influenza virus
DNKNWSGYS

SEQ ID NO: 342253 - protein, 9 aa, Influenza virus
RNWSGYSGS

SEQ ID NO: 342254 - protein, 9 aa, Influenza virus
YSGAFTVPI

SEQ ID NO: 342255 - protein, 9 aa, Influenza virus
MIRGKPKER

SEQ ID NO: 342256 - protein, 9 aa, Influenza virus
PEERNSIWT

SEQ ID NO: 342257 - protein, 9 aa, Influenza virus
EEKTSIWTS

SEQ ID NO: 342258 - protein, 9 aa, Influenza virus
ERNSIWTSS

SEQ ID NO: 342259 - protein, 9 aa, Influenza virus
KTSIWTSSS

SEQ ID NO: 342260 - protein, 9 aa, Influenza virus
GVSSEVPGC

SEQ ID NO: 342261 - protein, 9 aa, Influenza virus
VSSEVPGCT

SEQ ID NO: 342262 - protein, 9 aa, Influenza virus
SSEVPEWSW

SEQ ID NO: 342263 - protein, 9 aa, Influenza virus
SEVPGWSWG

SEQ ID NO: 342264 - protein, 9 aa, Influenza virus
NQKIICIST

SEQ ID NO: 342265 - protein, 9 aa, Influenza virus
CISATGMAL

SEQ ID NO: 342266 - protein, 9 aa, Influenza virus
ISATGMILS

SEQ ID NO: 342267 - protein, 9 aa, Influenza virus
SATGMILSV

SEQ ID NO: 342268 - protein, 9 aa, Influenza virus
ATGMILSVV

SEQ ID NO: 342269 - protein, 9 aa, Influenza virus
TGMILSVVS

SEQ ID NO: 342270 - protein, 9 aa, Influenza virus
GMALSVVSL

SEQ ID NO: 342271 - protein, 9 aa, Influenza virus
MILSVVSLL

SEQ ID NO: 342272 - protein, 9 aa, Influenza virus
GLANLGLNV

SEQ ID NO: 342273 - protein, 9 aa, Influenza virus
LANLGLNVG

SEQ ID NO: 342274 - protein, 9 aa, Influenza virus
VNLGLNIGL

SEQ ID NO: 342275 - protein, 9 aa, Influenza virus
KSLCEVNSW

SEQ ID NO: 342276 - protein, 9 aa, Influenza virus
SLCEVNSWH

SEQ ID NO: 342277 - protein, 9 aa, Influenza virus
CEVNSWHIF

SEQ ID NO: 342278 - protein, 9 aa, Influenza virus
EVNSWHIFS

SEQ ID NO: 342279 - protein, 9 aa, Influenza virus
DNAVRIGED

SEQ ID NO: 342280 - protein, 9 aa, Influenza virus
NAVRIGEDA

SEQ ID NO: 342281 - protein, 9 aa, Influenza virus
AVRIGEDAH

SEQ ID NO: 342282 - protein, 9 aa, Influenza virus
RIGEDAHVL

SEQ ID NO: 342283 - protein, 9 aa, Influenza virus
DAHVLVTRE

SEQ ID NO: 342284 - protein, 9 aa, Influenza virus
KGRHANGTI

SEQ ID NO: 342285 - protein, 9 aa, Influenza virus
GRHANGTIN

SEQ ID NO: 342286 - protein, 9 aa, Influenza virus
RHANGTIND

SEQ ID NO: 342287 - protein, 9 aa, Influenza virus
NGTINDRSP

SEQ ID NO: 342288 - protein, 9 aa, Influenza virus
GTMHDRSPF

SEQ ID NO: 342289 - protein, 9 aa, Influenza virus
TMHDRSPFR

SEQ ID NO: 342290 - protein, 9 aa, Influenza virus
MHDRSPFRA

SEQ ID NO: 342291 - protein, 9 aa, Influenza virus
NDRSPFRAL

SEQ ID NO: 342292 - protein, 9 aa, Influenza virus
DRSPYRALI

SEQ ID NO: 342293 - protein, 9 aa, Influenza virus
RSPYRALIS

SEQ ID NO: 342294 - protein, 9 aa, Influenza virus
SPYRALISW

SEQ ID NO: 342295 - protein, 9 aa, Influenza virus
PYRALISWE

SEQ ID NO: 342296 - protein, 9 aa, Influenza virus
FRALISWGM

SEQ ID NO: 342297 - protein, 9 aa, Influenza virus
ALISWEMGL

SEQ ID NO: 342298 - protein, 9 aa, Influenza virus
LISWEMGLA

SEQ ID NO: 342299 - protein, 9 aa, Influenza virus
ISWEMGLAP

SEQ ID NO: 342300 - protein, 9 aa, Influenza virus
IECVGWSST

SEQ ID NO: 342301 - protein, 9 aa, Influenza virus
SSTSCHDGR

SEQ ID NO: 342302 - protein, 9 aa, Influenza virus
STSCHDGRS

SEQ ID NO: 342303 - protein, 9 aa, Influenza virus
TSCHDGRSR

SEQ ID NO: 342304 - protein, 9 aa, Influenza virus
SCHDGRSRM

SEQ ID NO: 342305 - protein, 9 aa, Influenza virus
CHDGRSRMS

SEQ ID NO: 342306 - protein, 9 aa, Influenza virus
SVCMSGPNN

SEQ ID NO: 342307 - protein, 9 aa, Influenza virus
VCMSGPNNN

SEQ ID NO: 342308 - protein, 9 aa, Influenza virus
IEIPSWAGN

SEQ ID NO: 342309 - protein, 9 aa, Influenza virus
EIPTWAGNI

SEQ ID NO: 342310 - protein, 9 aa, Influenza virus
IPSWAGNVL

SEQ ID NO: 342311 - protein, 9 aa, Influenza virus
PSWAGNVLR

SEQ ID NO: 342312 - protein, 9 aa, Influenza virus
SECVCHNGV

SEQ ID NO: 342313 - protein, 9 aa, Influenza virus
ECVCHNGVC

SEQ ID NO: 342314 - protein, 9 aa, Influenza virus
CVCHNGVCP

SEQ ID NO: 342315 - protein, 9 aa, Influenza virus
VCHNGVCPV

SEQ ID NO: 342316 - protein, 9 aa, Influenza virus
CHNGVCPVV

SEQ ID NO: 342317 - protein, 9 aa, Influenza virus
VIMTDGPAN

SEQ ID NO: 342318 - protein, 9 aa, Influenza virus
TDGPANDRA

SEQ ID NO: 342319 - protein, 9 aa, Influenza virus
GKAQHIEEC

SEQ ID NO: 342320 - protein, 9 aa, Influenza virus
TAQHIEECS

SEQ ID NO: 342321 - protein, 9 aa, Influenza virus
RGANRPVIT

SEQ ID NO: 342322 - protein, 9 aa, Influenza virus
ANRPIITIN

SEQ ID NO: 342323 - protein, 9 aa, Influenza virus
MTHSSKYLC

SEQ ID NO: 342324 - protein, 9 aa, Influenza virus
THSSKYLCS

SEQ ID NO: 342325 - protein, 9 aa, Influenza virus
YLCSRVLTD

SEQ ID NO: 342326 - protein, 9 aa, Influenza virus
LCSRVLTDT

SEQ ID NO: 342327 - protein, 9 aa, Influenza virus
CSRVLTDTS

SEQ ID NO: 342328 - protein, 9 aa, Influenza virus
SRVLTDTSR

SEQ ID NO: 342329 - protein, 9 aa, Influenza virus
RVLTDTSRP

SEQ ID NO: 342330 - protein, 9 aa, Influenza virus
GGTPDPGVK

SEQ ID NO: 342331 - protein, 9 aa, Influenza virus
GNPDPGVKG

SEQ ID NO: 342332 - protein, 9 aa, Influenza virus
NPDPGVKGF

SEQ ID NO: 342333 - protein, 9 aa, Influenza virus
VKGFAFLDR

SEQ ID NO: 342334 - protein, 9 aa, Influenza virus
LGRTISKDT

SEQ ID NO: 342335 - protein, 9 aa, Influenza virus
GRTISKDTR

SEQ ID NO: 342336 - protein, 9 aa, Influenza virus
RTISKDTRS

SEQ ID NO: 342337 - protein, 9 aa, Influenza virus
TISKDTRSG

SEQ ID NO: 342338 - protein, 9 aa, Influenza virus
ISKDTRSGY

SEQ ID NO: 342339 - protein, 9 aa, Influenza virus
KDLRSGYEM

SEQ ID NO: 342340 - protein, 9 aa, Influenza virus
DLRSGYEML

SEQ ID NO: 342341 - protein, 9 aa, Influenza virus
LRSGYEMLK

SEQ ID NO: 342342 - protein, 9 aa, Influenza virus
GYEVLKVPD

SEQ ID NO: 342343 - protein, 9 aa, Influenza virus
YEVLKVPDA

SEQ ID NO: 342344 - protein, 9 aa, Influenza virus
EVLKVPDAE

SEQ ID NO: 342345 - protein, 9 aa, Influenza virus
IVDNQNWSG

SEQ ID NO: 342346 - protein, 9 aa, Influenza virus
VNNPNWSGY

SEQ ID NO: 342347 - protein, 9 aa, Influenza virus
QKWSGYSGA

SEQ ID NO: 342348 - protein, 9 aa, Influenza virus
WSGYSGAFV

SEQ ID NO: 342349 - protein, 9 aa, Influenza virus
SGYSGAFVD

SEQ ID NO: 342350 - protein, 9 aa, Influenza virus
GYSGAFVDY

SEQ ID NO: 342351 - protein, 9 aa, Influenza virus
YSGAFVDYW

SEQ ID NO: 342352 - protein, 9 aa, Influenza virus
VELIRGRPG

SEQ ID NO: 342353 - protein, 9 aa, Influenza virus
LIRGRPRES

SEQ ID NO: 342354 - protein, 9 aa, Influenza virus
ENSVLWTSN

SEQ ID NO: 342355 - protein, 9 aa, Influenza virus
VLWTSNSMV

SEQ ID NO: 342356 - protein, 9 aa, Influenza virus
LWTSNSVVA

SEQ ID NO: 342357 - protein, 9 aa, Influenza virus
LCGSKKRLG

SEQ ID NO: 342358 - protein, 9 aa, Influenza virus
CGSKKRLGS

SEQ ID NO: 342359 - protein, 9 aa, Influenza virus
GSKKRLGSW

SEQ ID NO: 342360 - protein, 9 aa, Influenza virus
SKKRLGSWS

SEQ ID NO: 342361 - protein, 9 aa, Influenza virus
KKRLGSWSW

SEQ ID NO: 342362 - protein, 9 aa, Influenza virus
MNPKSKLFT

SEQ ID NO: 342363 - protein, 9 aa, Influenza virus
NPSQKLFAL

SEQ ID NO: 342364 - protein, 9 aa, Influenza virus
PSQKLFALS

SEQ ID NO: 342365 - protein, 9 aa, Influenza virus
SQKLFALSG

SEQ ID NO: 342366 - protein, 9 aa, Influenza virus
QNLFTLSGV

SEQ ID NO: 342367 - protein, 9 aa, Influenza virus
LFALSGVAV

SEQ ID NO: 342368 - protein, 9 aa, Influenza virus
MNLLIGISN

SEQ ID NO: 342369 - protein, 9 aa, Influenza virus
NLLIGVSNV

SEQ ID NO: 342370 - protein, 9 aa, Influenza virus
LLIGVSNVG

SEQ ID NO: 342371 - protein, 9 aa, Influenza virus
LIGVSNVGL

SEQ ID NO: 342372 - protein, 9 aa, Influenza virus
IGISNVVLN

SEQ ID NO: 342373 - protein, 9 aa, Influenza virus
SNVGLKVSL

SEQ ID NO: 342374 - protein, 9 aa, Influenza virus
NVGLKVSLH

SEQ ID NO: 342375 - protein, 9 aa, Influenza virus
VGLNISLHL

SEQ ID NO: 342376 - protein, 9 aa, Influenza virus
GLNVSLHLR

SEQ ID NO: 342377 - protein, 9 aa, Influenza virus
ENTYVNKTT

SEQ ID NO: 342378 - protein, 9 aa, Influenza virus
NTYINNATI

SEQ ID NO: 342379 - protein, 9 aa, Influenza virus
TYINNATII

SEQ ID NO: 342380 - protein, 9 aa, Influenza virus
YLMLSKSLC

SEQ ID NO: 342381 - protein, 9 aa, Influenza virus
LLLNKSLCS

SEQ ID NO: 342382 - protein, 9 aa, Influenza virus
LLNKSLCSV

SEQ ID NO: 342383 - protein, 9 aa, Influenza virus
GWVVIEKDN

SEQ ID NO: 342384 - protein, 9 aa, Influenza virus
VAVAKDNAI

SEQ ID NO: 342385 - protein, 9 aa, Influenza virus
AVAKDNAIR

SEQ ID NO: 342386 - protein, 9 aa, Influenza virus
VAKDNAVRF

SEQ ID NO: 342387 - protein, 9 aa, Influenza virus
IRFGEGEQI

SEQ ID NO: 342388 - protein, 9 aa, Influenza virus
EPYVSCDPI

SEQ ID NO: 342389 - protein, 9 aa, Influenza virus
GCKMFALHQ

SEQ ID NO: 342390 - protein, 9 aa, Influenza virus
RNRHSNGTI

SEQ ID NO: 342391 - protein, 9 aa, Influenza virus
NRHSNGTIH

SEQ ID NO: 342392 - protein, 9 aa, Influenza virus
RHSNGTIHD

SEQ ID NO: 342393 - protein, 9 aa, Influenza virus
SNGTIHDRN

SEQ ID NO: 342394 - protein, 9 aa, Influenza virus
TIHDRAAFR

SEQ ID NO: 342395 - protein, 9 aa, Influenza virus
INDRTAFRG

SEQ ID NO: 342396 - protein, 9 aa, Influenza virus
HDRNAFRGL

SEQ ID NO: 342397 - protein, 9 aa, Influenza virus
DRTTFRGLI

SEQ ID NO: 342398 - protein, 9 aa, Influenza virus
RNAFRGLIS

SEQ ID NO: 342399 - protein, 9 aa, Influenza virus
NAFRGLIST

SEQ ID NO: 342400 - protein, 9 aa, Influenza virus
AFRGLISTQ

SEQ ID NO: 342401 - protein, 9 aa, Influenza virus
FRGLISTQL

SEQ ID NO: 342402 - protein, 9 aa, Influenza virus
RGLISTQLG

SEQ ID NO: 342403 - protein, 9 aa, Influenza virus
SNSEFICVG

SEQ ID NO: 342404 - protein, 9 aa, Influenza virus
NSEFICVGW

SEQ ID NO: 342405 - protein, 9 aa, Influenza virus
SEFICVGWS

SEQ ID NO: 342406 - protein, 9 aa, Influenza virus
EFICVGWSS

SEQ ID NO: 342407 - protein, 9 aa, Influenza virus
ICVGWSSTT

SEQ ID NO: 342408 - protein, 9 aa, Influenza virus
SSTTCHDGV

SEQ ID NO: 342409 - protein, 9 aa, Influenza virus
CHDGVSRMT

SEQ ID NO: 342410 - protein, 9 aa, Influenza virus
HDGIARMTI

SEQ ID NO: 342411 - protein, 9 aa, Influenza virus
DGIARMTIC

SEQ ID NO: 342412 - protein, 9 aa, Influenza virus
SRMTICVQG

SEQ ID NO: 342413 - protein, 9 aa, Influenza virus
QGNNENATA

SEQ ID NO: 342414 - protein, 9 aa, Influenza virus
GNNENATAT

SEQ ID NO: 342415 - protein, 9 aa, Influenza virus
NNENATATV

SEQ ID NO: 342416 - protein, 9 aa, Influenza virus
ATATVYYNG

SEQ ID NO: 342417 - protein, 9 aa, Influenza virus
TATVYYNGR

SEQ ID NO: 342418 - protein, 9 aa, Influenza virus
ATVYYNGRL

SEQ ID NO: 342419 - protein, 9 aa, Influenza virus
TVYYNGRLT

SEQ ID NO: 342420 - protein, 9 aa, Influenza virus
VYYNGRLTT

SEQ ID NO: 342421 - protein, 9 aa, Influenza virus
YYNGRLTTT

SEQ ID NO: 342422 - protein, 9 aa, Influenza virus
YNGRLTTTI

SEQ ID NO: 342423 - protein, 9 aa, Influenza virus
RRLTTTIKP

SEQ ID NO: 342424 - protein, 9 aa, Influenza virus
TTTIKPWAR

SEQ ID NO: 342425 - protein, 9 aa, Influenza virus
TTIKTWAGK

SEQ ID NO: 342426 - protein, 9 aa, Influenza virus
TIKTWAGKI

SEQ ID NO: 342427 - protein, 9 aa, Influenza virus
IKTWAGKIL

SEQ ID NO: 342428 - protein, 9 aa, Influenza virus
KTWAGKILR

SEQ ID NO: 342429 - protein, 9 aa, Influenza virus
TWAGKILRT

SEQ ID NO: 342430 - protein, 9 aa, Influenza virus
WAGKILRTQ

SEQ ID NO: 342431 - protein, 9 aa, Influenza virus
AGKILRTQE

SEQ ID NO: 342432 - protein, 9 aa, Influenza virus
GKILRTQES

SEQ ID NO: 342433 - protein, 9 aa, Influenza virus
CVRHNGTCA

SEQ ID NO: 342434 - protein, 9 aa, Influenza virus
STCVVVMTD

SEQ ID NO: 342435 - protein, 9 aa, Influenza virus
TCVAVMTDG

SEQ ID NO: 342436 - protein, 9 aa, Influenza virus
MTDGSASGQ

SEQ ID NO: 342437 - protein, 9 aa, Influenza virus
TDGSASGQA

SEQ ID NO: 342438 - protein, 9 aa, Influenza virus
LQGSARHIE

SEQ ID NO: 342439 - protein, 9 aa, Influenza virus
QGSARHIEE

SEQ ID NO: 342440 - protein, 9 aa, Influenza virus
SARHVEECS

SEQ ID NO: 342441 - protein, 9 aa, Influenza virus
ARHIEEWSC

SEQ ID NO: 342442 - protein, 9 aa, Influenza virus
RHIEEWSCY

SEQ ID NO: 342443 - protein, 9 aa, Influenza virus
KITCVCRDN

SEQ ID NO: 342444 - protein, 9 aa, Influenza virus
VSCVCRDNW

SEQ ID NO: 342445 - protein, 9 aa, Influenza virus
ANRPVIEIN

SEQ ID NO: 342446 - protein, 9 aa, Influenza virus
NRPVIEINM

SEQ ID NO: 342447 - protein, 9 aa, Influenza virus
HTSRYMCTG

SEQ ID NO: 342448 - protein, 9 aa, Influenza virus
VLTDTSRPG

SEQ ID NO: 342449 - protein, 9 aa, Influenza virus
TDTSRPGDR

SEQ ID NO: 342450 - protein, 9 aa, Influenza virus
SNPITGSPS

SEQ ID NO: 342451 - protein, 9 aa, Influenza virus
NPITGSPEA

SEQ ID NO: 342452 - protein, 9 aa, Influenza virus
PITGSPEAP

SEQ ID NO: 342453 - protein, 9 aa, Influenza virus
ITGSPEAPG

SEQ ID NO: 342454 - protein, 9 aa, Influenza virus
NNTWLGRTI

SEQ ID NO: 342455 - protein, 9 aa, Influenza virus
WLGRTFSPR

SEQ ID NO: 342456 - protein, 9 aa, Influenza virus
LGRTISPHS

SEQ ID NO: 342457 - protein, 9 aa, Influenza virus
GRTISTRSR

SEQ ID NO: 342458 - protein, 9 aa, Influenza virus
TISPRSRNG

SEQ ID NO: 342459 - protein, 9 aa, Influenza virus
ISTRSRSGF

SEQ ID NO: 342460 - protein, 9 aa, Influenza virus
STRSRSGFE

SEQ ID NO: 342461 - protein, 9 aa, Influenza virus
PRSRNGFEM

SEQ ID NO: 342462 - protein, 9 aa, Influenza virus
RSRSGFEVL

SEQ ID NO: 342463 - protein, 9 aa, Influenza virus
SGFEMLRIP

SEQ ID NO: 342464 - protein, 9 aa, Influenza virus
EMLKVPNAG

SEQ ID NO: 342465 - protein, 9 aa, Influenza virus
LKVPNAEKD

SEQ ID NO: 342466 - protein, 9 aa, Influenza virus
KVPNAEKDP

SEQ ID NO: 342467 - protein, 9 aa, Influenza virus
SACYNPCFY

SEQ ID NO: 342468 - protein, 9 aa, Influenza virus
EEVKYVWWT

SEQ ID NO: 342469 - protein, 9 aa, Influenza virus
EVKYVWWTS

SEQ ID NO: 342470 - protein, 9 aa, Influenza virus
VKYVWWTSN

SEQ ID NO: 342471 - protein, 9 aa, Influenza virus
VWWASNSLI

SEQ ID NO: 342472 - protein, 9 aa, Influenza virus
WWASNSLIA

SEQ ID NO: 342473 - protein, 9 aa, Influenza virus
LIALCGSPI

SEQ ID NO: 342474 - protein, 9 aa, Influenza virus
PIGSGFFPD

SEQ ID NO: 342475 - protein, 9 aa, Influenza virus
SGSLPDGAQ

SEQ ID NO: 342476 - protein, 9 aa, Influenza virus
GSFPDGAKI

SEQ ID NO: 342477 - protein, 9 aa, Influenza virus
SFPDGAKIQ

SEQ ID NO: 342478 - protein, 9 aa, Influenza virus
LPDGAQIQY

SEQ ID NO: 342479 - protein, 9 aa, Influenza virus
PDGPQIQYF

SEQ ID NO: 342480 - protein, 9 aa, Influenza virus
DGAKIQYFS

SEQ ID NO: 342481 - protein, 9 aa, Influenza virus
EYNETVKVE

SEQ ID NO: 342482 - protein, 9 aa, Influenza virus
EGFAPFSKD

SEQ ID NO: 342483 - protein, 9 aa, Influenza virus
DCRTFFLTQ

SEQ ID NO: 342484 - protein, 9 aa, Influenza virus
SLPNDKHSN

SEQ ID NO: 342485 - protein, 9 aa, Influenza virus
LLNDKHSSG

SEQ ID NO: 342486 - protein, 9 aa, Influenza virus
LNDKHFNGT

SEQ ID NO: 342487 - protein, 9 aa, Influenza virus
NDKHSNGTM

SEQ ID NO: 342488 - protein, 9 aa, Influenza virus
DKHSNGTMK

SEQ ID NO: 342489 - protein, 9 aa, Influenza virus
KHSNGTMKD

SEQ ID NO: 342490 - protein, 9 aa, Influenza virus
SSGTVKDRS

SEQ ID NO: 342491 - protein, 9 aa, Influenza virus
GTMKDRSPY

SEQ ID NO: 342492 - protein, 9 aa, Influenza virus
TMKDRSPYR

SEQ ID NO: 342493 - protein, 9 aa, Influenza virus
MKDRSPYRT

SEQ ID NO: 342494 - protein, 9 aa, Influenza virus
PFRTLMSVK

SEQ ID NO: 342495 - protein, 9 aa, Influenza virus
RTLMSVKVG

SEQ ID NO: 342496 - protein, 9 aa, Influenza virus
TLMSVKVGQ

SEQ ID NO: 342497 - protein, 9 aa, Influenza virus
IGLSPNVYQ

SEQ ID NO: 342498 - protein, 9 aa, Influenza virus
LSPNVYQAR

SEQ ID NO: 342499 - protein, 9 aa, Influenza virus
NVYQSRFEA

SEQ ID NO: 342500 - protein, 9 aa, Influenza virus
VYQSRFEAV

SEQ ID NO: 342501 - protein, 9 aa, Influenza virus
YQSRFEAVA

SEQ ID NO: 342502 - protein, 9 aa, Influenza virus
QSRFEAVAW

SEQ ID NO: 342503 - protein, 9 aa, Influenza virus
SRFEAVAWS

SEQ ID NO: 342504 - protein, 9 aa, Influenza virus
KFEAVAWSA

SEQ ID NO: 342505 - protein, 9 aa, Influenza virus
CHDGNKWMT

SEQ ID NO: 342506 - protein, 9 aa, Influenza virus
SWAGDIMRT

SEQ ID NO: 342507 - protein, 9 aa, Influenza virus
WDILRTQES

SEQ ID NO: 342508 - protein, 9 aa, Influenza virus
QESSCTCIL

SEQ ID NO: 342509 - protein, 9 aa, Influenza virus
ESSCTCILG

SEQ ID NO: 342510 - protein, 9 aa, Influenza virus
GNCYWVMTD

SEQ ID NO: 342511 - protein, 9 aa, Influenza virus
NCYWVMTDG

SEQ ID NO: 342512 - protein, 9 aa, Influenza virus
VMTDGPANN

SEQ ID NO: 342513 - protein, 9 aa, Influenza virus
MTDGPANNQ

SEQ ID NO: 342514 - protein, 9 aa, Influenza virus
TDGPANNQA

SEQ ID NO: 342515 - protein, 9 aa, Influenza virus
FNEGHIEEC

SEQ ID NO: 342516 - protein, 9 aa, Influenza virus
NEGHIEECS

SEQ ID NO: 342517 - protein, 9 aa, Influenza virus
PNNGKVECI

SEQ ID NO: 342518 - protein, 9 aa, Influenza virus
NGKVECICR

SEQ ID NO: 342519 - protein, 9 aa, Influenza virus
TGTNRPVVV

SEQ ID NO: 342520 - protein, 9 aa, Influenza virus
GTNRPVLVV

SEQ ID NO: 342521 - protein, 9 aa, Influenza virus
TNRPVLVVS

SEQ ID NO: 342522 - protein, 9 aa, Influenza virus
LVISTDLSY

SEQ ID NO: 342523 - protein, 9 aa, Influenza virus
LSYQVGYLC

SEQ ID NO: 342524 - protein, 9 aa, Influenza virus
SYQVGYLCA

SEQ ID NO: 342525 - protein, 9 aa, Influenza virus
YQVGYLCAG

SEQ ID NO: 342526 - protein, 9 aa, Influenza virus
SDTPRGEDN

SEQ ID NO: 342527 - protein, 9 aa, Influenza virus
DTPRGEDGQ

SEQ ID NO: 342528 - protein, 9 aa, Influenza virus
TPRGEDGQF

SEQ ID NO: 342529 - protein, 9 aa, Influenza virus
FGFRQGSDV

SEQ ID NO: 342530 - protein, 9 aa, Influenza virus
GFRQGSDVW

SEQ ID NO: 342531 - protein, 9 aa, Influenza virus
DNPNWSGYS

SEQ ID NO: 342532 - protein, 9 aa, Influenza virus
NPNWSGYSG

SEQ ID NO: 342533 - protein, 9 aa, Influenza virus
GSFTLPVGL

SEQ ID NO: 342534 - protein, 9 aa, Influenza virus
SCLVPCFWV

SEQ ID NO: 342535 - protein, 9 aa, Influenza virus
TVWTSSSSI

SEQ ID NO: 342536 - protein, 9 aa, Influenza virus
SIVMCGVNY

SEQ ID NO: 342537 - protein, 9 aa, Influenza virus
ADWSWQDGA

SEQ ID NO: 342538 - protein, 9 aa, Influenza virus
SWSWHDGAV

SEQ ID NO: 342539 - protein, 9 aa, Influenza virus
DGAILPFGI

SEQ ID NO: 342540 - protein, 9 aa, Influenza virus
NPNQKIQCT

SEQ ID NO: 342541 - protein, 9 aa, Influenza virus
PNQRILCTS

SEQ ID NO: 342542 - protein, 9 aa, Influenza virus
SQKILCTSA

SEQ ID NO: 342543 - protein, 9 aa, Influenza virus
QKILFASAT

SEQ ID NO: 342544 - protein, 9 aa, Influenza virus
KILFASATA

SEQ ID NO: 342545 - protein, 9 aa, Influenza virus
ILCTSATAL

SEQ ID NO: 342546 - protein, 9 aa, Influenza virus
ANLGLNVGL

SEQ ID NO: 342547 - protein, 9 aa, Influenza virus
NQTIINNYY

SEQ ID NO: 342548 - protein, 9 aa, Influenza virus
TIINNYHNE

SEQ ID NO: 342549 - protein, 9 aa, Influenza virus
IINNYHNET

SEQ ID NO: 342550 - protein, 9 aa, Influenza virus
INNYYNDTN

SEQ ID NO: 342551 - protein, 9 aa, Influenza virus
LTQISNTNI

SEQ ID NO: 342552 - protein, 9 aa, Influenza virus
FNNLTKRLC

SEQ ID NO: 342553 - protein, 9 aa, Influenza virus
NNLTKRLCT

SEQ ID NO: 342554 - protein, 9 aa, Influenza virus
NLTKRLCTI

SEQ ID NO: 342555 - protein, 9 aa, Influenza virus
LTKRLCTIN

SEQ ID NO: 342556 - protein, 9 aa, Influenza virus
TKRLCTINS

SEQ ID NO: 342557 - protein, 9 aa, Influenza virus
KRLCTINSW

SEQ ID NO: 342558 - protein, 9 aa, Influenza virus
HIYGKDNAI

SEQ ID NO: 342559 - protein, 9 aa, Influenza virus
IYGKDNAIR

SEQ ID NO: 342560 - protein, 9 aa, Influenza virus
YGKDNAIRI

SEQ ID NO: 342561 - protein, 9 aa, Influenza virus
DNAIRIGED

SEQ ID NO: 342562 - protein, 9 aa, Influenza virus
NAIRIGEDS

SEQ ID NO: 342563 - protein, 9 aa, Influenza virus
RIGGNSDVL

SEQ ID NO: 342564 - protein, 9 aa, Influenza virus
IGGNSDVLV

SEQ ID NO: 342565 - protein, 9 aa, Influenza virus
GENSGVLVT

SEQ ID NO: 342566 - protein, 9 aa, Influenza virus
ESSDVLVTR

SEQ ID NO: 342567 - protein, 9 aa, Influenza virus
KSDVLVTRE

SEQ ID NO: 342568 - protein, 9 aa, Influenza virus
PYVSCDPNE

SEQ ID NO: 342569 - protein, 9 aa, Influenza virus
VSCDPNECR

SEQ ID NO: 342570 - protein, 9 aa, Influenza virus
SCDPNECRF

SEQ ID NO: 342571 - protein, 9 aa, Influenza virus
CDPNECRFY

SEQ ID NO: 342572 - protein, 9 aa, Influenza virus
DPNECRFYA

SEQ ID NO: 342573 - protein, 9 aa, Influenza virus
YRALISWPQ

SEQ ID NO: 342574 - protein, 9 aa, Influenza virus
RALISWPQS

SEQ ID NO: 342575 - protein, 9 aa, Influenza virus
ALISWPQSS

SEQ ID NO: 342576 - protein, 9 aa, Influenza virus
SPPTVYNSK

SEQ ID NO: 342577 - protein, 9 aa, Influenza virus
STSCHDGKF

SEQ ID NO: 342578 - protein, 9 aa, Influenza virus
TSCHDGKFR

SEQ ID NO: 342579 - protein, 9 aa, Influenza virus
SCHDGKFRM

SEQ ID NO: 342580 - protein, 9 aa, Influenza virus
CHDGKFRMS

SEQ ID NO: 342581 - protein, 9 aa, Influenza virus
PNNNASAII

SEQ ID NO: 342582 - protein, 9 aa, Influenza virus
NNNASPVIW

SEQ ID NO: 342583 - protein, 9 aa, Influenza virus
NNASTVIWY

SEQ ID NO: 342584 - protein, 9 aa, Influenza virus
NASAIVWYN

SEQ ID NO: 342585 - protein, 9 aa, Influenza virus
KRPVTEINT

SEQ ID NO: 342586 - protein, 9 aa, Influenza virus
RPTTEINTW

SEQ ID NO: 342587 - protein, 9 aa, Influenza virus
PTTEINTWA

SEQ ID NO: 342588 - protein, 9 aa, Influenza virus
TTEINTWAR

SEQ ID NO: 342589 - protein, 9 aa, Influenza virus
SECVCQNGV

SEQ ID NO: 342590 - protein, 9 aa, Influenza virus
ECVCHDGVC

SEQ ID NO: 342591 - protein, 9 aa, Influenza virus
CVCHSGVCP

SEQ ID NO: 342592 - protein, 9 aa, Influenza virus
VCHSGVCPV

SEQ ID NO: 342593 - protein, 9 aa, Influenza virus
CHSGVCPVV

SEQ ID NO: 342594 - protein, 9 aa, Influenza virus
HNGICPVAF

SEQ ID NO: 342595 - protein, 9 aa, Influenza virus
SGVCPVVFT

SEQ ID NO: 342596 - protein, 9 aa, Influenza virus
ATGPADTRV

SEQ ID NO: 342597 - protein, 9 aa, Influenza virus
TGPADTRVY

SEQ ID NO: 342598 - protein, 9 aa, Influenza virus
GPADTRVYY

SEQ ID NO: 342599 - protein, 9 aa, Influenza virus
PADTRVYYF

SEQ ID NO: 342600 - protein, 9 aa, Influenza virus
TRVYYFKKG

SEQ ID NO: 342601 - protein, 9 aa, Influenza virus
GRILKWEPL

SEQ ID NO: 342602 - protein, 9 aa, Influenza virus
KWESLAGTA

SEQ ID NO: 342603 - protein, 9 aa, Influenza virus
TMTHTSQYI

SEQ ID NO: 342604 - protein, 9 aa, Influenza virus
DNPRPNDPV

SEQ ID NO: 342605 - protein, 9 aa, Influenza virus
DPYPGSNNN

SEQ ID NO: 342606 - protein, 9 aa, Influenza virus
PYPGNSNNG

SEQ ID NO: 342607 - protein, 9 aa, Influenza virus
YPGNSNNGV

SEQ ID NO: 342608 - protein, 9 aa, Influenza virus
PGSNNNGVK

SEQ ID NO: 342609 - protein, 9 aa, Influenza virus
GNSNNGVKG

SEQ ID NO: 342610 - protein, 9 aa, Influenza virus
TWLGRTTST

SEQ ID NO: 342611 - protein, 9 aa, Influenza virus
WLGRTTSTA

SEQ ID NO: 342612 - protein, 9 aa, Influenza virus
LGRTTSTAS

SEQ ID NO: 342613 - protein, 9 aa, Influenza virus
RTTSTASRS

SEQ ID NO: 342614 - protein, 9 aa, Influenza virus
TISTASRAG

SEQ ID NO: 342615 - protein, 9 aa, Influenza virus
ISTASRAGY

SEQ ID NO: 342616 - protein, 9 aa, Influenza virus
TASRSGYEV

SEQ ID NO: 342617 - protein, 9 aa, Influenza virus
KVPNALTDE

SEQ ID NO: 342618 - protein, 9 aa, Influenza virus
VPNALTDER

SEQ ID NO: 342619 - protein, 9 aa, Influenza virus
PNALTDERS

SEQ ID NO: 342620 - protein, 9 aa, Influenza virus
NALTNDRSK

SEQ ID NO: 342621 - protein, 9 aa, Influenza virus
ALIDDRSKP

SEQ ID NO: 342622 - protein, 9 aa, Influenza virus
QGQIIVLNT

SEQ ID NO: 342623 - protein, 9 aa, Influenza virus
GQIIVLNTD

SEQ ID NO: 342624 - protein, 9 aa, Influenza virus
QIIVLNTDW

SEQ ID NO: 342625 - protein, 9 aa, Influenza virus
TIVLTTDWS

SEQ ID NO: 342626 - protein, 9 aa, Influenza virus
GSFVDYWAE

SEQ ID NO: 342627 - protein, 9 aa, Influenza virus
SFIDYWAEG

SEQ ID NO: 342628 - protein, 9 aa, Influenza virus
DYWAKGDCY

SEQ ID NO: 342629 - protein, 9 aa, Influenza virus
YWAKGDCYR

SEQ ID NO: 342630 - protein, 9 aa, Influenza virus
WAKGDCYRA

SEQ ID NO: 342631 - protein, 9 aa, Influenza virus
AKGDCYRAC

SEQ ID NO: 342632 - protein, 9 aa, Influenza virus
KGDCYRACF

SEQ ID NO: 342633 - protein, 9 aa, Influenza virus
RGRPKEDEV

SEQ ID NO: 342634 - protein, 9 aa, Influenza virus
GRPKEDEVW

SEQ ID NO: 342635 - protein, 9 aa, Influenza virus
RPKEDEVWW

SEQ ID NO: 342636 - protein, 9 aa, Influenza virus
PKEDEVWWT

SEQ ID NO: 342637 - protein, 9 aa, Influenza virus
KEDEVWWTS

SEQ ID NO: 342638 - protein, 9 aa, Influenza virus
EDEVWWTSN

SEQ ID NO: 342639 - protein, 9 aa, Influenza virus
DEVWWTSNS

SEQ ID NO: 342640 - protein, 9 aa, Influenza virus
PDGAKIEYS

SEQ ID NO: 342641 - protein, 9 aa, Influenza virus
SLDKICLGH

SEQ ID NO: 342642 - protein, 9 aa, Influenza virus
ICLGHHAVT

SEQ ID NO: 342643 - protein, 9 aa, Influenza virus
CLGHHAVTN

SEQ ID NO: 342644 - protein, 9 aa, Influenza virus
LGHHAVTNG

SEQ ID NO: 342645 - protein, 9 aa, Influenza virus
GHHAVTNGT

SEQ ID NO: 342646 - protein, 9 aa, Influenza virus
NGTIVTTLT

SEQ ID NO: 342647 - protein, 9 aa, Influenza virus
REEVTNATE

SEQ ID NO: 342648 - protein, 9 aa, Influenza virus
KDLDNCHPI

SEQ ID NO: 342649 - protein, 9 aa, Influenza virus
DLDNCHPIG

SEQ ID NO: 342650 - protein, 9 aa, Influenza virus
LDNCHPIGM

SEQ ID NO: 342651 - protein, 9 aa, Influenza virus
GTWDTIIER

SEQ ID NO: 342652 - protein, 9 aa, Influenza virus
INEGALRQK

SEQ ID NO: 342653 - protein, 9 aa, Influenza virus
SFYGELKWL

SEQ ID NO: 342654 - protein, 9 aa, Influenza virus
GQSFPQTTN

SEQ ID NO: 342655 - protein, 9 aa, Influenza virus
QSFPQTTNT

SEQ ID NO: 342656 - protein, 9 aa, Influenza virus
NFPRTTNTY

SEQ ID NO: 342657 - protein, 9 aa, Influenza virus
TNTYRNTDP

SEQ ID NO: 342658 - protein, 9 aa, Influenza virus
WGIHHPSSI

SEQ ID NO: 342659 - protein, 9 aa, Influenza virus
GAQSLSISV

SEQ ID NO: 342660 - protein, 9 aa, Influenza virus
TQPLSISVG

SEQ ID NO: 342661 - protein, 9 aa, Influenza virus
QPLSISVGS

SEQ ID NO: 342662 - protein, 9 aa, Influenza virus
PLSISVGSS

SEQ ID NO: 342663 - protein, 9 aa, Influenza virus
ISVGSSIYQ

SEQ ID NO: 342664 - protein, 9 aa, Influenza virus
SVGSSTYHN

SEQ ID NO: 342665 - protein, 9 aa, Influenza virus
IGSSTYQNN

SEQ ID NO: 342666 - protein, 9 aa, Influenza virus
GSSTYQSNF

SEQ ID NO: 342667 - protein, 9 aa, Influenza virus
YQNNFVPVM

SEQ ID NO: 342668 - protein, 9 aa, Influenza virus
QNNFVPVVR

SEQ ID NO: 342669 - protein, 9 aa, Influenza virus
NNFVPVVRA

SEQ ID NO: 342670 - protein, 9 aa, Influenza virus
NFVPVMGAR

SEQ ID NO: 342671 - protein, 9 aa, Influenza virus
FVPVMGARP

SEQ ID NO: 342672 - protein, 9 aa, Influenza virus
VPVMGARPQ

SEQ ID NO: 342673 - protein, 9 aa, Influenza virus
PVMGARPQV

SEQ ID NO: 342674 - protein, 9 aa, Influenza virus
VVRARPQVN

SEQ ID NO: 342675 - protein, 9 aa, Influenza virus
MGARPQVNG

SEQ ID NO: 342676 - protein, 9 aa, Influenza virus
LVNGQRGRI

SEQ ID NO: 342677 - protein, 9 aa, Influenza virus
VNGQSGRIN

SEQ ID NO: 342678 - protein, 9 aa, Influenza virus
NGQSGRINF

SEQ ID NO: 342679 - protein, 9 aa, Influenza virus
GQRGRIDFH

SEQ ID NO: 342680 - protein, 9 aa, Influenza virus
QSGRINFHW

SEQ ID NO: 342681 - protein, 9 aa, Influenza virus
PGDNITFSD

SEQ ID NO: 342682 - protein, 9 aa, Influenza virus
GDNIIFSHN

SEQ ID NO: 342683 - protein, 9 aa, Influenza virus
DNITFLHNG

SEQ ID NO: 342684 - protein, 9 aa, Influenza virus
NITFSDNGG

SEQ ID NO: 342685 - protein, 9 aa, Influenza virus
TFLHNGGLI

SEQ ID NO: 342686 - protein, 9 aa, Influenza virus
HNGGRIAPS

SEQ ID NO: 342687 - protein, 9 aa, Influenza virus
NGGRIAPSR

SEQ ID NO: 342688 - protein, 9 aa, Influenza virus
GGRIAPSRV

SEQ ID NO: 342689 - protein, 9 aa, Influenza virus
CFWRGGSII

SEQ ID NO: 342690 - protein, 9 aa, Influenza virus
FWRGGSIIT

SEQ ID NO: 342691 - protein, 9 aa, Influenza virus
GGSIITELP

SEQ ID NO: 342692 - protein, 9 aa, Influenza virus
GSIITELPF

SEQ ID NO: 342693 - protein, 9 aa, Influenza virus
SIITELPFQ

SEQ ID NO: 342694 - protein, 9 aa, Influenza virus
IITELPFQN

SEQ ID NO: 342695 - protein, 9 aa, Influenza virus
ITELPFQNL

SEQ ID NO: 342696 - protein, 9 aa, Influenza virus
GQCPKYVKK

SEQ ID NO: 342697 - protein, 9 aa, Influenza virus
RSLMLATGM

SEQ ID NO: 342698 - protein, 9 aa, Influenza virus
AADYKSTQK

SEQ ID NO: 342699 - protein, 9 aa, Influenza virus
ADYESTQAA

SEQ ID NO: 342700 - protein, 9 aa, Influenza virus
DYESTQAAI

SEQ ID NO: 342701 - protein, 9 aa, Influenza virus
AINQITGKL

SEQ ID NO: 342702 - protein, 9 aa, Influenza virus
IVQITGKLN

SEQ ID NO: 342703 - protein, 9 aa, Influenza virus
NQITGKLNR

SEQ ID NO: 342704 - protein, 9 aa, Influenza virus
ESEFNEIEY

SEQ ID NO: 342705 - protein, 9 aa, Influenza virus
SEFNEIEYQ

SEQ ID NO: 342706 - protein, 9 aa, Influenza virus
EFNEIEYQI

SEQ ID NO: 342707 - protein, 9 aa, Influenza virus
FSEIEHQIS

SEQ ID NO: 342708 - protein, 9 aa, Influenza virus
SEIEHQISN

SEQ ID NO: 342709 - protein, 9 aa, Influenza virus
EIEHQISNV

SEQ ID NO: 342710 - protein, 9 aa, Influenza virus
GCFEIYHNC

SEQ ID NO: 342711 - protein, 9 aa, Influenza virus
SCMERIRNN

SEQ ID NO: 342712 - protein, 9 aa, Influenza virus
IRNNTYNHT

SEQ ID NO: 342713 - protein, 9 aa, Influenza virus
RNNTYDHSH

SEQ ID NO: 342714 - protein, 9 aa, Influenza virus
NNTYNHTQY

SEQ ID NO: 342715 - protein, 9 aa, Influenza virus
NTYNHTQYR

SEQ ID NO: 342716 - protein, 9 aa, Influenza virus
TYDHSHYRE

SEQ ID NO: 342717 - protein, 9 aa, Influenza virus
YNHTQYREE

SEQ ID NO: 342718 - protein, 9 aa, Influenza virus
HSHYREEAL

SEQ ID NO: 342719 - protein, 9 aa, Influenza virus
SHYREEALL

SEQ ID NO: 342720 - protein, 9 aa, Influenza virus
EEAPLNRLN

SEQ ID NO: 342721 - protein, 9 aa, Influenza virus
EAPLNRLNI

SEQ ID NO: 342722 - protein, 9 aa, Influenza virus
ALLSRLNIN

SEQ ID NO: 342723 - protein, 9 aa, Influenza virus
LLNRININP

SEQ ID NO: 342724 - protein, 9 aa, Influenza virus
INPVELSSG

SEQ ID NO: 342725 - protein, 9 aa, Influenza virus
NPVKLSSSY

SEQ ID NO: 342726 - protein, 9 aa, Influenza virus
PVELSSGYK

SEQ ID NO: 342727 - protein, 9 aa, Influenza virus
VELSSGYKD

SEQ ID NO: 342728 - protein, 9 aa, Influenza virus
FFCLKDGNM

SEQ ID NO: 342729 - protein, 9 aa, Influenza virus
LCLKNGNMR

SEQ ID NO: 342730 - protein, 9 aa, Influenza virus
SLDKICLGH

SEQ ID NO: 342731 - protein, 9 aa, Influenza virus
ICLGHHAIP

SEQ ID NO: 342732 - protein, 9 aa, Influenza virus
CLGHHAIPN

SEQ ID NO: 342733 - protein, 9 aa, Influenza virus
LGHHAIPNG

SEQ ID NO: 342734 - protein, 9 aa, Influenza virus
GHHAVTNGT

SEQ ID NO: 342735 - protein, 9 aa, Influenza virus
HHAVTNGTI

SEQ ID NO: 342736 - protein, 9 aa, Influenza virus
ANGTVVKTL

SEQ ID NO: 342737 - protein, 9 aa, Influenza virus
VVKTLTNEH

SEQ ID NO: 342738 - protein, 9 aa, Influenza virus
VKTLTNEHE

SEQ ID NO: 342739 - protein, 9 aa, Influenza virus
KTLTNEKEK

SEQ ID NO: 342740 - protein, 9 aa, Influenza virus
TLTNEHEEV

SEQ ID NO: 342741 - protein, 9 aa, Influenza virus
EHEEVTNAT

SEQ ID NO: 342742 - protein, 9 aa, Influenza virus
KEEVINATE

SEQ ID NO: 342743 - protein, 9 aa, Influenza virus
NATETVENK

SEQ ID NO: 342744 - protein, 9 aa, Influenza virus
YKDLDNCHP

SEQ ID NO: 342745 - protein, 9 aa, Influenza virus
KDLDNCHPI

SEQ ID NO: 342746 - protein, 9 aa, Influenza virus
DLGNCHPVG

SEQ ID NO: 342747 - protein, 9 aa, Influenza virus
LDNCHPIGM

SEQ ID NO: 342748 - protein, 9 aa, Influenza virus
CHPVGMLIG

SEQ ID NO: 342749 - protein, 9 aa, Influenza virus
GAPACDLHL

SEQ ID NO: 342750 - protein, 9 aa, Influenza virus
APACDLHLT

SEQ ID NO: 342751 - protein, 9 aa, Influenza virus
PSCDLHLTG

SEQ ID NO: 342752 - protein, 9 aa, Influenza virus
CDLHLTGKW

SEQ ID NO: 342753 - protein, 9 aa, Influenza virus
DLHLTGIWD

SEQ ID NO: 342754 - protein, 9 aa, Influenza virus
LHLTGMWDT

SEQ ID NO: 342755 - protein, 9 aa, Influenza virus
HLTGIWDTL

SEQ ID NO: 342756 - protein, 9 aa, Influenza virus
IWDTLIERD

SEQ ID NO: 342757 - protein, 9 aa, Influenza virus
DTLIERGSS

SEQ ID NO: 342758 - protein, 9 aa, Influenza virus
IAYCYPGST

SEQ ID NO: 342759 - protein, 9 aa, Influenza virus
AYCYPGSTV

SEQ ID NO: 342760 - protein, 9 aa, Influenza virus
YCYPGSTVN

SEQ ID NO: 342761 - protein, 9 aa, Influenza virus
CYPGSTVNE

SEQ ID NO: 342762 - protein, 9 aa, Influenza virus
YPGSTVNEE

SEQ ID NO: 342763 - protein, 9 aa, Influenza virus
PGATVNEGA

SEQ ID NO: 342764 - protein, 9 aa, Influenza virus
GATVNEGAL

SEQ ID NO: 342765 - protein, 9 aa, Influenza virus
ATVNEGALR

SEQ ID NO: 342766 - protein, 9 aa, Influenza virus
MESGGIDKV

SEQ ID NO: 342767 - protein, 9 aa, Influenza virus
ESGGISKMS

SEQ ID NO: 342768 - protein, 9 aa, Influenza virus
SGGISKMST

SEQ ID NO: 342769 - protein, 9 aa, Influenza virus
FTYESSINP

SEQ ID NO: 342770 - protein, 9 aa, Influenza virus
YGASINSAG

SEQ ID NO: 342771 - protein, 9 aa, Influenza virus
GRNSFYAEL

SEQ ID NO: 342772 - protein, 9 aa, Influenza virus
RNSFYAELK

SEQ ID NO: 342773 - protein, 9 aa, Influenza virus
ELKWLISKS

SEQ ID NO: 342774 - protein, 9 aa, Influenza virus
LKWLISKSK

SEQ ID NO: 342775 - protein, 9 aa, Influenza virus
KWLISKSKE

SEQ ID NO: 342776 - protein, 9 aa, Influenza virus
WLVSKDKGR

SEQ ID NO: 342777 - protein, 9 aa, Influenza virus
QSFPQTTNT

SEQ ID NO: 342778 - protein, 9 aa, Influenza virus
SFPQTTNTY

SEQ ID NO: 342779 - protein, 9 aa, Influenza virus
TNTYRNTDP

SEQ ID NO: 342780 - protein, 9 aa, Influenza virus
EHLIMWGIH

SEQ ID NO: 342781 - protein, 9 aa, Influenza virus
HLITWGIHH

SEQ ID NO: 342782 - protein, 9 aa, Influenza virus
LITWGIHHP

SEQ ID NO: 342783 - protein, 9 aa, Influenza virus
ITWGIHHPS

SEQ ID NO: 342784 - protein, 9 aa, Influenza virus
TWGIHHPSS

SEQ ID NO: 342785 - protein, 9 aa, Influenza virus
PSSTKEKNE

SEQ ID NO: 342786 - protein, 9 aa, Influenza virus
SSTKEKNEL

SEQ ID NO: 342787 - protein, 9 aa, Influenza virus
STKEKNELY

SEQ ID NO: 342788 - protein, 9 aa, Influenza virus
TKEKNELYG

SEQ ID NO: 342789 - protein, 9 aa, Influenza virus
QERNDLYGT

SEQ ID NO: 342790 - protein, 9 aa, Influenza virus
ERNDLYGTQ

SEQ ID NO: 342791 - protein, 9 aa, Influenza virus
KNALYGTQS

SEQ ID NO: 342792 - protein, 9 aa, Influenza virus
NALYGTQSL

SEQ ID NO: 342793 - protein, 9 aa, Influenza virus
ALYGTQSLS

SEQ ID NO: 342794 - protein, 9 aa, Influenza virus
TQSLSISIG

SEQ ID NO: 342795 - protein, 9 aa, Influenza virus
QPLSISVGS

SEQ ID NO: 342796 - protein, 9 aa, Influenza virus
SLSISIGSS

SEQ ID NO: 342797 - protein, 9 aa, Influenza virus
ISVGSSIYQ

SEQ ID NO: 342798 - protein, 9 aa, Influenza virus
SVGSSIYQN

SEQ ID NO: 342799 - protein, 9 aa, Influenza virus
IGSSTYQNN

SEQ ID NO: 342800 - protein, 9 aa, Influenza virus
GSSTYHNSF

SEQ ID NO: 342801 - protein, 9 aa, Influenza virus
TFSDNGGLI

SEQ ID NO: 342802 - protein, 9 aa, Influenza virus
APSRVSKLI

SEQ ID NO: 342803 - protein, 9 aa, Influenza virus
PSRVSKLTG

SEQ ID NO: 342804 - protein, 9 aa, Influenza virus
GRDLGIQSE

SEQ ID NO: 342805 - protein, 9 aa, Influenza virus
WRGGSINTR

SEQ ID NO: 342806 - protein, 9 aa, Influenza virus
RGGSINTRL

SEQ ID NO: 342807 - protein, 9 aa, Influenza virus
GQCPKYVSQ

SEQ ID NO: 342808 - protein, 9 aa, Influenza virus
GSLLLATGM

SEQ ID NO: 342809 - protein, 9 aa, Influenza virus
DYKSTQKTI

SEQ ID NO: 342810 - protein, 9 aa, Influenza virus
YESTQAAID

SEQ ID NO: 342811 - protein, 9 aa, Influenza virus
ESTQAAIDQ

SEQ ID NO: 342812 - protein, 9 aa, Influenza virus
STQATIDQI

SEQ ID NO: 342813 - protein, 9 aa, Influenza virus
TQAAIDQMT

SEQ ID NO: 342814 - protein, 9 aa, Influenza virus
QATIDQITG

SEQ ID NO: 342815 - protein, 9 aa, Influenza virus
AAIDQMTGK

SEQ ID NO: 342816 - protein, 9 aa, Influenza virus
TIDQITGKL

SEQ ID NO: 342817 - protein, 9 aa, Influenza virus
ESEFNEIEY

SEQ ID NO: 342818 - protein, 9 aa, Influenza virus
SEFNEIEYQ

SEQ ID NO: 342819 - protein, 9 aa, Influenza virus
EFNEIEYQI

SEQ ID NO: 342820 - protein, 9 aa, Influenza virus
FNEIEYQIG

SEQ ID NO: 342821 - protein, 9 aa, Influenza virus
NEIEYQIGN

SEQ ID NO: 342822 - protein, 9 aa, Influenza virus
KGCFEIYHN

SEQ ID NO: 342823 - protein, 9 aa, Influenza virus
GCFEIYHNC

SEQ ID NO: 342824 - protein, 9 aa, Influenza virus
CFEIYHNCD

SEQ ID NO: 342825 - protein, 9 aa, Influenza virus
CNDNCMESI

SEQ ID NO: 342826 - protein, 9 aa, Influenza virus
DDNCMERIR

SEQ ID NO: 342827 - protein, 9 aa, Influenza virus
DNCMERIRN

SEQ ID NO: 342828 - protein, 9 aa, Influenza virus
NCMERIRNN

SEQ ID NO: 342829 - protein, 9 aa, Influenza virus
NRLNINPVT

SEQ ID NO: 342830 - protein, 9 aa, Influenza virus
RLNINPVTL

SEQ ID NO: 342831 - protein, 9 aa, Influenza virus
LNINPVTLS

SEQ ID NO: 342832 - protein, 9 aa, Influenza virus
NINPVTLSS

SEQ ID NO: 342833 - protein, 9 aa, Influenza virus
RLSSGYKDI

SEQ ID NO: 342834 - protein, 9 aa, Influenza virus
ASCFVLLAI

SEQ ID NO: 342835 - protein, 9 aa, Influenza virus
SCFVLLAAI

SEQ ID NO: 342836 - protein, 9 aa, Influenza virus
IMGLFFFCL

SEQ ID NO: 342837 - protein, 9 aa, Influenza virus
VGLVFFCLK

SEQ ID NO: 342838 - protein, 9 aa, Influenza virus
FALSGVAIT

SEQ ID NO: 342839 - protein, 9 aa, Influenza virus
ALSGVAISL

SEQ ID NO: 342840 - protein, 9 aa, Influenza virus
LSGVAISLS

SEQ ID NO: 342841 - protein, 9 aa, Influenza virus
FNLLIGISN

SEQ ID NO: 342842 - protein, 9 aa, Influenza virus
ERGTKQEEN

SEQ ID NO: 342843 - protein, 9 aa, Influenza virus
TGTAKQNYL

SEQ ID NO: 342844 - protein, 9 aa, Influenza virus
YVNNTTIIN

SEQ ID NO: 342845 - protein, 9 aa, Influenza virus
VNNTTIINK

SEQ ID NO: 342846 - protein, 9 aa, Influenza virus
YLMLSKSLC

SEQ ID NO: 342847 - protein, 9 aa, Influenza virus
LLLNKSLCS

SEQ ID NO: 342848 - protein, 9 aa, Influenza virus
LLNKSLCSV

SEQ ID NO: 342849 - protein, 9 aa, Influenza virus
LSKSLCKVE

SEQ ID NO: 342850 - protein, 9 aa, Influenza virus
SKSLCKVEG

SEQ ID NO: 342851 - protein, 9 aa, Influenza virus
KRLCKVEGW

SEQ ID NO: 342852 - protein, 9 aa, Influenza virus
SLCKVEEWV

SEQ ID NO: 342853 - protein, 9 aa, Influenza virus
IRFGEGEQI

SEQ ID NO: 342854 - protein, 9 aa, Influenza virus
VSCDPSGCK

SEQ ID NO: 342855 - protein, 9 aa, Influenza virus
SCDPTGCKM

SEQ ID NO: 342856 - protein, 9 aa, Influenza virus
CDPTGCKMY

SEQ ID NO: 342857 - protein, 9 aa, Influenza virus
DPTGCKMYA

SEQ ID NO: 342858 - protein, 9 aa, Influenza virus
PTGCKMYAL

SEQ ID NO: 342859 - protein, 9 aa, Influenza virus
SGCKMYALH

SEQ ID NO: 342860 - protein, 9 aa, Influenza virus
STPLGSPPM

SEQ ID NO: 342861 - protein, 9 aa, Influenza virus
TPLGSPPMV

SEQ ID NO: 342862 - protein, 9 aa, Influenza virus
PLGSPPMVS

SEQ ID NO: 342863 - protein, 9 aa, Influenza virus
LGSPPMVSN

SEQ ID NO: 342864 - protein, 9 aa, Influenza virus
GSPPMVSNS

SEQ ID NO: 342865 - protein, 9 aa, Influenza virus
SPPIVSNSE

SEQ ID NO: 342866 - protein, 9 aa, Influenza virus
PPIVSNSEF

SEQ ID NO: 342867 - protein, 9 aa, Influenza virus
VSNSDFMCV

SEQ ID NO: 342868 - protein, 9 aa, Influenza virus
SNSDFMCVG

SEQ ID NO: 342869 - protein, 9 aa, Influenza virus
NSDFMCVGW

SEQ ID NO: 342870 - protein, 9 aa, Influenza virus
SDFMCVGWS

SEQ ID NO: 342871 - protein, 9 aa, Influenza virus
DFMCVGWSS

SEQ ID NO: 342872 - protein, 9 aa, Influenza virus
ICVGWSSTT

SEQ ID NO: 342873 - protein, 9 aa, Influenza virus
GVGRMTICI

SEQ ID NO: 342874 - protein, 9 aa, Influenza virus
VGRMTICIQ

SEQ ID NO: 342875 - protein, 9 aa, Influenza virus
TICVQGNNK

SEQ ID NO: 342876 - protein, 9 aa, Influenza virus
ICVQGNNKN

SEQ ID NO: 342877 - protein, 9 aa, Influenza virus
CVQGNNKNA

SEQ ID NO: 342878 - protein, 9 aa, Influenza virus
VQGNNKNAT

SEQ ID NO: 342879 - protein, 9 aa, Influenza virus
ATVYYNRRP

SEQ ID NO: 342880 - protein, 9 aa, Influenza virus
TVYYNRRPT

SEQ ID NO: 342881 - protein, 9 aa, Influenza virus
VYYERRLTT

SEQ ID NO: 342882 - protein, 9 aa, Influenza virus
YYNRRPTTT

SEQ ID NO: 342883 - protein, 9 aa, Influenza virus
YNGRLTTTI

SEQ ID NO: 342884 - protein, 9 aa, Influenza virus
ERRLTTTIK

SEQ ID NO: 342885 - protein, 9 aa, Influenza virus
TTIKTWAGK

SEQ ID NO: 342886 - protein, 9 aa, Influenza virus
TIKTWAGKI

SEQ ID NO: 342887 - protein, 9 aa, Influenza virus
IKTWAGKIL

SEQ ID NO: 342888 - protein, 9 aa, Influenza virus
KTWAGKILR

SEQ ID NO: 342889 - protein, 9 aa, Influenza virus
TWAGKILRT

SEQ ID NO: 342890 - protein, 9 aa, Influenza virus
CVVIMTDGP

SEQ ID NO: 342891 - protein, 9 aa, Influenza virus
VVIMTDGPA

SEQ ID NO: 342892 - protein, 9 aa, Influenza virus
VIMTDGSAN

SEQ ID NO: 342893 - protein, 9 aa, Influenza virus
VMTDGSASG

SEQ ID NO: 342894 - protein, 9 aa, Influenza virus
MTDGSANSQ

SEQ ID NO: 342895 - protein, 9 aa, Influenza virus
TDGPASSQA

SEQ ID NO: 342896 - protein, 9 aa, Influenza virus
DGSASGQAY

SEQ ID NO: 342897 - protein, 9 aa, Influenza virus
GSASGQAYT

SEQ ID NO: 342898 - protein, 9 aa, Influenza virus
PASSQAYTK

SEQ ID NO: 342899 - protein, 9 aa, Influenza virus
ANSQAYTKV

SEQ ID NO: 342900 - protein, 9 aa, Influenza virus
QAYTKIMYF

SEQ ID NO: 342901 - protein, 9 aa, Influenza virus
AYTKIMYFH

SEQ ID NO: 342902 - protein, 9 aa, Influenza virus
YTKIMYFHK

SEQ ID NO: 342903 - protein, 9 aa, Influenza virus
TKIMYFHKG

SEQ ID NO: 342904 - protein, 9 aa, Influenza virus
KIMYFHKGL

SEQ ID NO: 342905 - protein, 9 aa, Influenza virus
YFHKGLVVK

SEQ ID NO: 342906 - protein, 9 aa, Influenza virus
FHKGLVVKE

SEQ ID NO: 342907 - protein, 9 aa, Influenza virus
HKGLVVKEE

SEQ ID NO: 342908 - protein, 9 aa, Influenza virus
KEEALQGSA

SEQ ID NO: 342909 - protein, 9 aa, Influenza virus
EETLKGSAR

SEQ ID NO: 342910 - protein, 9 aa, Influenza virus
ETLKGSARH

SEQ ID NO: 342911 - protein, 9 aa, Influenza virus
ECSCYGHSQ

SEQ ID NO: 342912 - protein, 9 aa, Influenza virus
CSCYGHSQK

SEQ ID NO: 342913 - protein, 9 aa, Influenza virus
CYGHSQKVT

SEQ ID NO: 342914 - protein, 9 aa, Influenza virus
YGHSQKVTC

SEQ ID NO: 342915 - protein, 9 aa, Influenza virus
SKVTCICRD

SEQ ID NO: 342916 - protein, 9 aa, Influenza virus
ANRPVIEIN

SEQ ID NO: 342917 - protein, 9 aa, Influenza virus
NRPVIEINM

SEQ ID NO: 342918 - protein, 9 aa, Influenza virus
AMDHTSQYL

SEQ ID NO: 342919 - protein, 9 aa, Influenza virus
MDHTSQYLC

SEQ ID NO: 342920 - protein, 9 aa, Influenza virus
KHTSQYLCT

SEQ ID NO: 342921 - protein, 9 aa, Influenza virus
TDTSRPSDR

SEQ ID NO: 342922 - protein, 9 aa, Influenza virus
DNPITGSPG

SEQ ID NO: 342923 - protein, 9 aa, Influenza virus
VKGFGFLDN

SEQ ID NO: 342924 - protein, 9 aa, Influenza virus
DNTWLGGTI

SEQ ID NO: 342925 - protein, 9 aa, Influenza virus
MLKIPNAGI

SEQ ID NO: 342926 - protein, 9 aa, Influenza virus
LKIPNAGID

SEQ ID NO: 342927 - protein, 9 aa, Influenza virus
KIPNAGIDP

SEQ ID NO: 342928 - protein, 9 aa, Influenza virus
VPNAGTDPN

SEQ ID NO: 342929 - protein, 9 aa, Influenza virus
PNAGIDPNS

SEQ ID NO: 342930 - protein, 9 aa, Influenza virus
TERQEIVGN

SEQ ID NO: 342931 - protein, 9 aa, Influenza virus
ERQEIVGNN

SEQ ID NO: 342932 - protein, 9 aa, Influenza virus
NRNWSGYSG

SEQ ID NO: 342933 - protein, 9 aa, Influenza virus
RNWSGYSGS

SEQ ID NO: 342934 - protein, 9 aa, Influenza virus
SACYNPCFY

SEQ ID NO: 342935 - protein, 9 aa, Influenza virus
KCYNPCFYV

SEQ ID NO: 342936 - protein, 9 aa, Influenza virus
IALCGSPFP

SEQ ID NO: 342937 - protein, 9 aa, Influenza virus
ALCGSPFPV

SEQ ID NO: 342938 - protein, 9 aa, Influenza virus
LCGSPFPVG

SEQ ID NO: 342939 - protein, 9 aa, Influenza virus
CGSPFPVGS

SEQ ID NO: 342940 - protein, 9 aa, Influenza virus
GSPFPVGSG

SEQ ID NO: 342941 - protein, 9 aa, Influenza virus
SPFPVGSGS

SEQ ID NO: 342942 - protein, 9 aa, Influenza virus
PFPVGSGSF

SEQ ID NO: 342943 - protein, 9 aa, Influenza virus
FPVGSGSFP

SEQ ID NO: 342944 - protein, 9 aa, Influenza virus
YMSNNSTEK

SEQ ID NO: 342945 - protein, 9 aa, Influenza virus
MSNNSTEKV

SEQ ID NO: 342946 - protein, 9 aa, Influenza virus
SNNSTERVD

SEQ ID NO: 342947 - protein, 9 aa, Influenza virus
NNSTERVDT

SEQ ID NO: 342948 - protein, 9 aa, Influenza virus
NSTERVDTI

SEQ ID NO: 342949 - protein, 9 aa, Influenza virus
STERVDTII

SEQ ID NO: 342950 - protein, 9 aa, Influenza virus
TERVDTIIE

SEQ ID NO: 342951 - protein, 9 aa, Influenza virus
ERVDTIIES

SEQ ID NO: 342952 - protein, 9 aa, Influenza virus
RVDTIIESN

SEQ ID NO: 342953 - protein, 9 aa, Influenza virus
VDTIIESNI

SEQ ID NO: 342954 - protein, 9 aa, Influenza virus
NTIIESNVT

SEQ ID NO: 342955 - protein, 9 aa, Influenza virus
SNITVTSSV

SEQ ID NO: 342956 - protein, 9 aa, Influenza virus
HTGTFCSIN

SEQ ID NO: 342957 - protein, 9 aa, Influenza virus
GSFCSLDGK

SEQ ID NO: 342958 - protein, 9 aa, Influenza virus
FCSINGKEP

SEQ ID NO: 342959 - protein, 9 aa, Influenza virus
CSINGRAPI

SEQ ID NO: 342960 - protein, 9 aa, Influenza virus
SINGRAPIS

SEQ ID NO: 342961 - protein, 9 aa, Influenza virus
INGRAPISL

SEQ ID NO: 342962 - protein, 9 aa, Influenza virus
NGKEPISLG

SEQ ID NO: 342963 - protein, 9 aa, Influenza virus
GKAPISLGG

SEQ ID NO: 342964 - protein, 9 aa, Influenza virus
RAPISLGDC

SEQ ID NO: 342965 - protein, 9 aa, Influenza virus
ILGNPMCDY

SEQ ID NO: 342966 - protein, 9 aa, Influenza virus
LGNPMCDYL

SEQ ID NO: 342967 - protein, 9 aa, Influenza virus
GNPMCDNLI

SEQ ID NO: 342968 - protein, 9 aa, Influenza virus
NPMCDYLIG

SEQ ID NO: 342969 - protein, 9 aa, Influenza virus
PMCDYLIGK

SEQ ID NO: 342970 - protein, 9 aa, Influenza virus
CDYLIGKTS

SEQ ID NO: 342971 - protein, 9 aa, Influenza virus
DYLIGKTSW

SEQ ID NO: 342972 - protein, 9 aa, Influenza virus
YLIGKTSWS

SEQ ID NO: 342973 - protein, 9 aa, Influenza virus
SWSYIVEKL

SEQ ID NO: 342974 - protein, 9 aa, Influenza virus
WSYIVEKSN

SEQ ID NO: 342975 - protein, 9 aa, Influenza virus
SYIVEKSNP

SEQ ID NO: 342976 - protein, 9 aa, Influenza virus
NPINGICYP

SEQ ID NO: 342977 - protein, 9 aa, Influenza virus
PINGICYPG

SEQ ID NO: 342978 - protein, 9 aa, Influenza virus
GICYPGTLG

SEQ ID NO: 342979 - protein, 9 aa, Influenza virus
SFFRNMIWL

SEQ ID NO: 342980 - protein, 9 aa, Influenza virus
FFRNMVWLV

SEQ ID NO: 342981 - protein, 9 aa, Influenza virus
WLIYQSGTY

SEQ ID NO: 342982 - protein, 9 aa, Influenza virus
LTHQSGTYP

SEQ ID NO: 342983 - protein, 9 aa, Influenza virus
HQSETYPVI

SEQ ID NO: 342984 - protein, 9 aa, Influenza virus
FNNIKGRDV

SEQ ID NO: 342985 - protein, 9 aa, Influenza virus
KNTKGRDVL

SEQ ID NO: 342986 - protein, 9 aa, Influenza virus
LYKKDISYV

SEQ ID NO: 342987 - protein, 9 aa, Influenza virus
AGRMTFYWI

SEQ ID NO: 342988 - protein, 9 aa, Influenza virus
GRMTFYWAI

SEQ ID NO: 342989 - protein, 9 aa, Influenza virus
RMTFYWAIV

SEQ ID NO: 342990 - protein, 9 aa, Influenza virus
TFESNGALL

SEQ ID NO: 342991 - protein, 9 aa, Influenza virus
FESNGALLA

SEQ ID NO: 342992 - protein, 9 aa, Influenza virus
ESNGVFLAP

SEQ ID NO: 342993 - protein, 9 aa, Influenza virus
SNGALLAPR

SEQ ID NO: 342994 - protein, 9 aa, Influenza virus
NGALLAPRY

SEQ ID NO: 342995 - protein, 9 aa, Influenza virus
GALLAPRYA

SEQ ID NO: 342996 - protein, 9 aa, Influenza virus
FLAPGYAFE

SEQ ID NO: 342997 - protein, 9 aa, Influenza virus
LAPGYAFEI

SEQ ID NO: 342998 - protein, 9 aa, Influenza virus
APGYAFEIV

SEQ ID NO: 342999 - protein, 9 aa, Influenza virus
PRYSFELVS

SEQ ID NO: 343000 - protein, 9 aa, Influenza virus
RCQSEIGGI

SEQ ID NO: 343001 - protein, 9 aa, Influenza virus
CQSEIGWIN

SEQ ID NO: 343002 - protein, 9 aa, Influenza virus
QSEIGWINT

SEQ ID NO: 343003 - protein, 9 aa, Influenza virus
HSVHRNTFG

SEQ ID NO: 343004 - protein, 9 aa, Influenza virus
NVHRSTIGD

SEQ ID NO: 343005 - protein, 9 aa, Influenza virus
VHRSTIGDC

SEQ ID NO: 343006 - protein, 9 aa, Influenza virus
HRNTIGNCP

SEQ ID NO: 343007 - protein, 9 aa, Influenza virus
RNTIGNCPK

SEQ ID NO: 343008 - protein, 9 aa, Influenza virus
STIGDCPKY

SEQ ID NO: 343009 - protein, 9 aa, Influenza virus
AIGDCPKYV

SEQ ID NO: 343010 - protein, 9 aa, Influenza virus
DCPKYVNIK

SEQ ID NO: 343011 - protein, 9 aa, Influenza virus
CPKYVNIKS

SEQ ID NO: 343012 - protein, 9 aa, Influenza virus
PKYVNIKSL

SEQ ID NO: 343013 - protein, 9 aa, Influenza virus
KYVNIKSLK

SEQ ID NO: 343014 - protein, 9 aa, Influenza virus
YVNIKSLKL

SEQ ID NO: 343015 - protein, 9 aa, Influenza virus
VNIKSLKLA

SEQ ID NO: 343016 - protein, 9 aa, Influenza virus
NVKSLKLAS

SEQ ID NO: 343017 - protein, 9 aa, Influenza virus
VKSLKLASG

SEQ ID NO: 343018 - protein, 9 aa, Influenza virus
KSLKLASGL

SEQ ID NO: 343019 - protein, 9 aa, Influenza virus
SLKLVTGLR

SEQ ID NO: 343020 - protein, 9 aa, Influenza virus
LKLAIGPRN

SEQ ID NO: 343021 - protein, 9 aa, Influenza virus
KLASGLRNV

SEQ ID NO: 343022 - protein, 9 aa, Influenza virus
LASGLRNVP

SEQ ID NO: 343023 - protein, 9 aa, Influenza virus
ASGLRNVPA

SEQ ID NO: 343024 - protein, 9 aa, Influenza virus
SGLRNVPAI

SEQ ID NO: 343025 - protein, 9 aa, Influenza virus
GLRNVPAIT

SEQ ID NO: 343026 - protein, 9 aa, Influenza virus
SRGLFGAKA

SEQ ID NO: 343027 - protein, 9 aa, Influenza virus
AADKESTQE

SEQ ID NO: 343028 - protein, 9 aa, Influenza virus
ADKESTQEA

SEQ ID NO: 343029 - protein, 9 aa, Influenza virus
IGERINQLS

SEQ ID NO: 343030 - protein, 9 aa, Influenza virus
DIWSYNARL

SEQ ID NO: 343031 - protein, 9 aa, Influenza virus
SNVKNLHEK

SEQ ID NO: 343032 - protein, 9 aa, Influenza virus
LHEKIRRML

SEQ ID NO: 343033 - protein, 9 aa, Influenza virus
LKNNAKDEG

SEQ ID NO: 343034 - protein, 9 aa, Influenza virus
QDNAKDEGN

SEQ ID NO: 343035 - protein, 9 aa, Influenza virus
FTFYHRCDN

SEQ ID NO: 343036 - protein, 9 aa, Influenza virus
FYHKCNNEC

SEQ ID NO: 343037 - protein, 9 aa, Influenza virus
YHKCNNECI

SEQ ID NO: 343038 - protein, 9 aa, Influenza virus
HKCNNECIE

SEQ ID NO: 343039 - protein, 9 aa, Influenza virus
DECIEKVRN

SEQ ID NO: 343040 - protein, 9 aa, Influenza virus
ECIEKIRNG

SEQ ID NO: 343041 - protein, 9 aa, Influenza virus
HKEFKEESK

SEQ ID NO: 343042 - protein, 9 aa, Influenza virus
EESRINRQE

SEQ ID NO: 343043 - protein, 9 aa, Influenza virus
ESRINRQEI

SEQ ID NO: 343044 - protein, 9 aa, Influenza virus
SRINRQEIE

SEQ ID NO: 343045 - protein, 9 aa, Influenza virus
RINRQEIEG

SEQ ID NO: 343046 - protein, 9 aa, Influenza virus
INRQEVEGV

SEQ ID NO: 343047 - protein, 9 aa, Influenza virus
NRQEIEGAR

SEQ ID NO: 343048 - protein, 9 aa, Influenza virus
RQEIEGARL

SEQ ID NO: 343049 - protein, 9 aa, Influenza virus
QEIGGVKLD

SEQ ID NO: 343050 - protein, 9 aa, Influenza virus
ASSLVLAAS

SEQ ID NO: 343051 - protein, 9 aa, Influenza virus
SSLILAALI

SEQ ID NO: 343052 - protein, 9 aa, Influenza virus
SLVLAASIM

SEQ ID NO: 343053 - protein, 9 aa, Influenza virus
LVLAALNMG

SEQ ID NO: 343054 - protein, 9 aa, Influenza virus
WACGNGSCR

SEQ ID NO: 343055 - protein, 9 aa, Influenza virus
VCSNGSCRC

SEQ ID NO: 343056 - protein, 9 aa, Influenza virus
MEKFIVLSV

SEQ ID NO: 343057 - protein, 9 aa, Influenza virus
STETVNTLT

SEQ ID NO: 343058 - protein, 9 aa, Influenza virus
TETVNTLTE

SEQ ID NO: 343059 - protein, 9 aa, Influenza virus
ETVNTLTEQ

SEQ ID NO: 343060 - protein, 9 aa, Influenza virus
VNTLIEQNI

SEQ ID NO: 343061 - protein, 9 aa, Influenza virus
NTLIEQNIP

SEQ ID NO: 343062 - protein, 9 aa, Influenza virus
TLIEQNIPV

SEQ ID NO: 343063 - protein, 9 aa, Influenza virus
LIEQNIPVT

SEQ ID NO: 343064 - protein, 9 aa, Influenza virus
IEQNIPVTQ

SEQ ID NO: 343065 - protein, 9 aa, Influenza virus
VEELVHRGI

SEQ ID NO: 343066 - protein, 9 aa, Influenza virus
EELVHGGIN

SEQ ID NO: 343067 - protein, 9 aa, Influenza virus
ELVHRGIDP

SEQ ID NO: 343068 - protein, 9 aa, Influenza virus
DDCSLKGLI

SEQ ID NO: 343069 - protein, 9 aa, Influenza virus
DCSLEGLVL

SEQ ID NO: 343070 - protein, 9 aa, Influenza virus
CSLEGLILS

SEQ ID NO: 343071 - protein, 9 aa, Influenza virus
SLEGLVLGN

SEQ ID NO: 343072 - protein, 9 aa, Influenza virus
LKGLILGNP

SEQ ID NO: 343073 - protein, 9 aa, Influenza virus
EGLVLGNPK

SEQ ID NO: 343074 - protein, 9 aa, Influenza virus
GLVLGNPKC

SEQ ID NO: 343075 - protein, 9 aa, Influenza virus
LVLGNPKCD

SEQ ID NO: 343076 - protein, 9 aa, Influenza virus
ILSNPKCDL

SEQ ID NO: 343077 - protein, 9 aa, Influenza virus
ERPKEIEGI

SEQ ID NO: 343078 - protein, 9 aa, Influenza virus
RPKEIEGIC

SEQ ID NO: 343079 - protein, 9 aa, Influenza virus
PKEIEGICY

SEQ ID NO: 343080 - protein, 9 aa, Influenza virus
GICYPGSVE

SEQ ID NO: 343081 - protein, 9 aa, Influenza virus
ICYPGSVEN

SEQ ID NO: 343082 - protein, 9 aa, Influenza virus
SVENQEELR

SEQ ID NO: 343083 - protein, 9 aa, Influenza virus
VENQEELRS

SEQ ID NO: 343084 - protein, 9 aa, Influenza virus
KNQEELRSL

SEQ ID NO: 343085 - protein, 9 aa, Influenza virus
KSLFSSIKK

SEQ ID NO: 343086 - protein, 9 aa, Influenza virus
DFTKWNVTH

SEQ ID NO: 343087 - protein, 9 aa, Influenza virus
FIKWNVTYT

SEQ ID NO: 343088 - protein, 9 aa, Influenza virus
TKWNVTHTG

SEQ ID NO: 343089 - protein, 9 aa, Influenza virus
NVTHTGTSK

SEQ ID NO: 343090 - protein, 9 aa, Influenza virus
VTHTGTSKA

SEQ ID NO: 343091 - protein, 9 aa, Influenza virus
THTGTSKAC

SEQ ID NO: 343092 - protein, 9 aa, Influenza virus
HTGTSKACN

SEQ ID NO: 343093 - protein, 9 aa, Influenza virus
SKACNDISN

SEQ ID NO: 343094 - protein, 9 aa, Influenza virus
TSNQDSFYR

SEQ ID NO: 343095 - protein, 9 aa, Influenza virus
SNQDSFYRS

SEQ ID NO: 343096 - protein, 9 aa, Influenza virus
NRGSFYRSM

SEQ ID NO: 343097 - protein, 9 aa, Influenza virus
QGSFYRSIR

SEQ ID NO: 343098 - protein, 9 aa, Influenza virus
DSFYRSMKW

SEQ ID NO: 343099 - protein, 9 aa, Influenza virus
SFYRSMKWL

SEQ ID NO: 343100 - protein, 9 aa, Influenza virus
FYRSMKWLT

SEQ ID NO: 343101 - protein, 9 aa, Influenza virus
YRSMKWLTL

SEQ ID NO: 343102 - protein, 9 aa, Influenza virus
RSMKWLTLK

SEQ ID NO: 343103 - protein, 9 aa, Influenza virus
SMRWLTLKL

SEQ ID NO: 343104 - protein, 9 aa, Influenza virus
IRWLTLKSG

SEQ ID NO: 343105 - protein, 9 aa, Influenza virus
KWLTLKSGQ

SEQ ID NO: 343106 - protein, 9 aa, Influenza virus
AIHHPPTSA

SEQ ID NO: 343107 - protein, 9 aa, Influenza virus
IHHPPTSAE

SEQ ID NO: 343108 - protein, 9 aa, Influenza virus
HHPPTSAEQ

SEQ ID NO: 343109 - protein, 9 aa, Influenza virus
HPPTTDEQM

SEQ ID NO: 343110 - protein, 9 aa, Influenza virus
EIDRSFRPN

SEQ ID NO: 343111 - protein, 9 aa, Influenza virus
INRNFKPNI

SEQ ID NO: 343112 - protein, 9 aa, Influenza virus
NRNFKPNIG

SEQ ID NO: 343113 - protein, 9 aa, Influenza virus
RNFKPNIGP

SEQ ID NO: 343114 - protein, 9 aa, Influenza virus
NFKPNIGPR

SEQ ID NO: 343115 - protein, 9 aa, Influenza virus
NIGPRPLVM

SEQ ID NO: 343116 - protein, 9 aa, Influenza virus
IGPRPLVMG

SEQ ID NO: 343117 - protein, 9 aa, Influenza virus
GPRPLIRGQ

SEQ ID NO: 343118 - protein, 9 aa, Influenza virus
PRPLVMGQQ

SEQ ID NO: 343119 - protein, 9 aa, Influenza virus
RPLVMGQQG

SEQ ID NO: 343120 - protein, 9 aa, Influenza virus
PLVMGQQGR

SEQ ID NO: 343121 - protein, 9 aa, Influenza virus
LVMGQQGRM

SEQ ID NO: 343122 - protein, 9 aa, Influenza virus
IRGQQGRMD

SEQ ID NO: 343123 - protein, 9 aa, Influenza virus
IAPEYGHLT

SEQ ID NO: 343124 - protein, 9 aa, Influenza virus
APEYGHLTT

SEQ ID NO: 343125 - protein, 9 aa, Influenza virus
PEYGHLTTG

SEQ ID NO: 343126 - protein, 9 aa, Influenza virus
EYGHLTTGK

SEQ ID NO: 343127 - protein, 9 aa, Influenza virus
YGHLTTGKS

SEQ ID NO: 343128 - protein, 9 aa, Influenza virus
GYLITGKSH

SEQ ID NO: 343129 - protein, 9 aa, Influenza virus
HLTTGKSHG

SEQ ID NO: 343130 - protein, 9 aa, Influenza virus
TTGKSHGRI

SEQ ID NO: 343131 - protein, 9 aa, Influenza virus
TECQLNEGI

SEQ ID NO: 343132 - protein, 9 aa, Influenza virus
ECQLNEGVI

SEQ ID NO: 343133 - protein, 9 aa, Influenza virus
GIMNTSKPF

SEQ ID NO: 343134 - protein, 9 aa, Influenza virus
VMNTSKPLQ

SEQ ID NO: 343135 - protein, 9 aa, Influenza virus
SKPLQNTSK

SEQ ID NO: 343136 - protein, 9 aa, Influenza virus
KPFQNICKP

SEQ ID NO: 343137 - protein, 9 aa, Influenza virus
PLQNTSKHY

SEQ ID NO: 343138 - protein, 9 aa, Influenza virus
LQNTSKHYI

SEQ ID NO: 343139 - protein, 9 aa, Influenza virus
RHYIGKCPK

SEQ ID NO: 343140 - protein, 9 aa, Influenza virus
KCPKYIPSR

SEQ ID NO: 343141 - protein, 9 aa, Influenza virus
CPKYIPSRS

SEQ ID NO: 343142 - protein, 9 aa, Influenza virus
PKYISSGSL

SEQ ID NO: 343143 - protein, 9 aa, Influenza virus
KYISSGSLK

SEQ ID NO: 343144 - protein, 9 aa, Influenza virus
YISSGSLKL

SEQ ID NO: 343145 - protein, 9 aa, Influenza virus
IPSRSLKLA

SEQ ID NO: 343146 - protein, 9 aa, Influenza virus
SSGSLKLAI

SEQ ID NO: 343147 - protein, 9 aa, Influenza virus
RSLKLAIGL

SEQ ID NO: 343148 - protein, 9 aa, Influenza virus
IGPRNVPQV

SEQ ID NO: 343149 - protein, 9 aa, Influenza virus
GLRNVPQIQ

SEQ ID NO: 343150 - protein, 9 aa, Influenza virus
RNVPQVQDR

SEQ ID NO: 343151 - protein, 9 aa, Influenza virus
NVPQVQDRG

SEQ ID NO: 343152 - protein, 9 aa, Influenza virus
VPQVQDRGL

SEQ ID NO: 343153 - protein, 9 aa, Influenza virus
PQVQDRGLF

SEQ ID NO: 343154 - protein, 9 aa, Influenza virus
QVQDRGLFG

SEQ ID NO: 343155 - protein, 9 aa, Influenza virus
VQDRGLFGA

SEQ ID NO: 343156 - protein, 9 aa, Influenza virus
QDRGLFGAK

SEQ ID NO: 343157 - protein, 9 aa, Influenza virus
DRGLFGAKA

SEQ ID NO: 343158 - protein, 9 aa, Influenza virus
HQNAEGIGI

SEQ ID NO: 343159 - protein, 9 aa, Influenza virus
QNAEGIGIA

SEQ ID NO: 343160 - protein, 9 aa, Influenza virus
NAEGIGIAA

SEQ ID NO: 343161 - protein, 9 aa, Influenza virus
AEGIGIAAD

SEQ ID NO: 343162 - protein, 9 aa, Influenza virus
EGIGIAADR

SEQ ID NO: 343163 - protein, 9 aa, Influenza virus
GTGIVADRD

SEQ ID NO: 343164 - protein, 9 aa, Influenza virus
TGIAADRGS

SEQ ID NO: 343165 - protein, 9 aa, Influenza virus
GIAADRGST

SEQ ID NO: 343166 - protein, 9 aa, Influenza virus
IVADRDSTQ

SEQ ID NO: 343167 - protein, 9 aa, Influenza virus
VADRDSTQK

SEQ ID NO: 343168 - protein, 9 aa, Influenza virus
ADRGSTQKA

SEQ ID NO: 343169 - protein, 9 aa, Influenza virus
DRGSTQKAI

SEQ ID NO: 343170 - protein, 9 aa, Influenza virus
RGSTQKAID

SEQ ID NO: 343171 - protein, 9 aa, Influenza virus
GSTQKAIDN

SEQ ID NO: 343172 - protein, 9 aa, Influenza virus
STQKAIDIM

SEQ ID NO: 343173 - protein, 9 aa, Influenza virus
TQKAIDIMQ

SEQ ID NO: 343174 - protein, 9 aa, Influenza virus
QKAIDIMQN

SEQ ID NO: 343175 - protein, 9 aa, Influenza virus
KAIDNMQNR

SEQ ID NO: 343176 - protein, 9 aa, Influenza virus
VIDKMNKQL

SEQ ID NO: 343177 - protein, 9 aa, Influenza virus
EFSEVEIRI

SEQ ID NO: 343178 - protein, 9 aa, Influenza virus
FSEVEIRIN

SEQ ID NO: 343179 - protein, 9 aa, Influenza virus
VEIRINMIN

SEQ ID NO: 343180 - protein, 9 aa, Influenza virus
GSRINMINS

SEQ ID NO: 343181 - protein, 9 aa, Influenza virus
SRINTINSK

SEQ ID NO: 343182 - protein, 9 aa, Influenza virus
INMINSQID

SEQ ID NO: 343183 - protein, 9 aa, Influenza virus
NMINSKIND

SEQ ID NO: 343184 - protein, 9 aa, Influenza virus
MINSQIDDQ

SEQ ID NO: 343185 - protein, 9 aa, Influenza virus
INSKIEDQI

SEQ ID NO: 343186 - protein, 9 aa, Influenza virus
IEDQITDIW

SEQ ID NO: 343187 - protein, 9 aa, Influenza virus
EDQITDIWA

SEQ ID NO: 343188 - protein, 9 aa, Influenza virus
NVRNLHDRT

SEQ ID NO: 343189 - protein, 9 aa, Influenza virus
VRNLHERIR

SEQ ID NO: 343190 - protein, 9 aa, Influenza virus
RNLHERIRR

SEQ ID NO: 343191 - protein, 9 aa, Influenza virus
RVLRENAVD

SEQ ID NO: 343192 - protein, 9 aa, Influenza virus
ENAVDTGDG

SEQ ID NO: 343193 - protein, 9 aa, Influenza virus
NAIDAGDGC

SEQ ID NO: 343194 - protein, 9 aa, Influenza virus
AIDAGDGCF

SEQ ID NO: 343195 - protein, 9 aa, Influenza virus
VDTGDGCFE

SEQ ID NO: 343196 - protein, 9 aa, Influenza virus
CFEILHKCN

SEQ ID NO: 343197 - protein, 9 aa, Influenza virus
FEILHRCND

SEQ ID NO: 343198 - protein, 9 aa, Influenza virus
IRNGTYNHQ

SEQ ID NO: 343199 - protein, 9 aa, Influenza virus
GTYNHQEYE

SEQ ID NO: 343200 - protein, 9 aa, Influenza virus
YEEESRIER

SEQ ID NO: 343201 - protein, 9 aa, Influenza virus
EDESRIERQ

SEQ ID NO: 343202 - protein, 9 aa, Influenza virus
DESRIERQK

SEQ ID NO: 343203 - protein, 9 aa, Influenza virus
ESKLERQRI

SEQ ID NO: 343204 - protein, 9 aa, Influenza virus
ERQKISGVK

SEQ ID NO: 343205 - protein, 9 aa, Influenza virus
RQKISGVKL

SEQ ID NO: 343206 - protein, 9 aa, Influenza virus
QKISGVKLE

SEQ ID NO: 343207 - protein, 9 aa, Influenza virus
KISGVKLEE

SEQ ID NO: 343208 - protein, 9 aa, Influenza virus
YLSTNSSDK

SEQ ID NO: 343209 - protein, 9 aa, Influenza virus
LSTNSSDKV

SEQ ID NO: 343210 - protein, 9 aa, Influenza virus
STNSSDKVD

SEQ ID NO: 343211 - protein, 9 aa, Influenza virus
TNSSDKVDT

SEQ ID NO: 343212 - protein, 9 aa, Influenza virus
NSSDKVDTL

SEQ ID NO: 343213 - protein, 9 aa, Influenza virus
SSEKVNTLL

SEQ ID NO: 343214 - protein, 9 aa, Influenza virus
SEKVNTLLE

SEQ ID NO: 343215 - protein, 9 aa, Influenza virus
DKVDTLLEN

SEQ ID NO: 343216 - protein, 9 aa, Influenza virus
VNTLLENDV

SEQ ID NO: 343217 - protein, 9 aa, Influenza virus
NTLLENDVP

SEQ ID NO: 343218 - protein, 9 aa, Influenza virus
TLLESDVPV

SEQ ID NO: 343219 - protein, 9 aa, Influenza virus
LLESDVPVT

SEQ ID NO: 343220 - protein, 9 aa, Influenza virus
LESDVPVTS

SEQ ID NO: 343221 - protein, 9 aa, Influenza virus
ENGVPVTST

SEQ ID NO: 343222 - protein, 9 aa, Influenza virus
PVTSSIDLV

SEQ ID NO: 343223 - protein, 9 aa, Influenza virus
VTSSIDLVE

SEQ ID NO: 343224 - protein, 9 aa, Influenza virus
TSSIDLVET

SEQ ID NO: 343225 - protein, 9 aa, Influenza virus
DLIETTHTG

SEQ ID NO: 343226 - protein, 9 aa, Influenza virus
LIETTHTGT

SEQ ID NO: 343227 - protein, 9 aa, Influenza virus
IETTHTGTY

SEQ ID NO: 343228 - protein, 9 aa, Influenza virus
HTGTYCSLS

SEQ ID NO: 343229 - protein, 9 aa, Influenza virus
TGTYCSLSG

SEQ ID NO: 343230 - protein, 9 aa, Influenza virus
DCSFEGWIG

SEQ ID NO: 343231 - protein, 9 aa, Influenza virus
CSFEGWIGG

SEQ ID NO: 343232 - protein, 9 aa, Influenza virus
NFEGWIVGN

SEQ ID NO: 343233 - protein, 9 aa, Influenza virus
WSYLIEDPT

SEQ ID NO: 343234 - protein, 9 aa, Influenza virus
SYLIEDPTA

SEQ ID NO: 343235 - protein, 9 aa, Influenza virus
YLIEDPTAP

SEQ ID NO: 343236 - protein, 9 aa, Influenza virus
LIEDPTAPH

SEQ ID NO: 343237 - protein, 9 aa, Influenza virus
IEDPAAPHG

SEQ ID NO: 343238 - protein, 9 aa, Influenza virus
EDPAAPHGL

SEQ ID NO: 343239 - protein, 9 aa, Influenza virus
DPAAPHGLC

SEQ ID NO: 343240 - protein, 9 aa, Influenza virus
PAAPHGLCY

SEQ ID NO: 343241 - protein, 9 aa, Influenza virus
TAPHGLCYP

SEQ ID NO: 343242 - protein, 9 aa, Influenza virus
RGTNSFYRN

SEQ ID NO: 343243 - protein, 9 aa, Influenza virus
SFYRNLAWF

SEQ ID NO: 343244 - protein, 9 aa, Influenza virus
FYRNLVWLV

SEQ ID NO: 343245 - protein, 9 aa, Influenza virus
GAYNNTTGR

SEQ ID NO: 343246 - protein, 9 aa, Influenza virus
RDVLVMWGL

SEQ ID NO: 343247 - protein, 9 aa, Influenza virus
DVLVMWGLH

SEQ ID NO: 343248 - protein, 9 aa, Influenza virus
VLVMWGLHH

SEQ ID NO: 343249 - protein, 9 aa, Influenza virus
LVMWGLHHP

SEQ ID NO: 343250 - protein, 9 aa, Influenza virus
PYTLVTTSS

SEQ ID NO: 343251 - protein, 9 aa, Influenza virus
YTLVSTRSW

SEQ ID NO: 343252 - protein, 9 aa, Influenza virus
TLVTTSSWS

SEQ ID NO: 343253 - protein, 9 aa, Influenza virus
GVRPRYNGQ

SEQ ID NO: 343254 - protein, 9 aa, Influenza virus
TRPGYNGQK

SEQ ID NO: 343255 - protein, 9 aa, Influenza virus
GYNGQKSWT

SEQ ID NO: 343256 - protein, 9 aa, Influenza virus
SWTKIYWYL

SEQ ID NO: 343257 - protein, 9 aa, Influenza virus
VSFESNGGL

SEQ ID NO: 343258 - protein, 9 aa, Influenza virus
GRGRIFQSR

SEQ ID NO: 343259 - protein, 9 aa, Influenza virus
RGRIFQSRI

SEQ ID NO: 343260 - protein, 9 aa, Influenza virus
GRIFQSRII

SEQ ID NO: 343261 - protein, 9 aa, Influenza virus
NKTFQNIDK

SEQ ID NO: 343262 - protein, 9 aa, Influenza virus
KTFQNIDKN

SEQ ID NO: 343263 - protein, 9 aa, Influenza virus
NIDKNALGE

SEQ ID NO: 343264 - protein, 9 aa, Influenza virus
IDKNALGEC

SEQ ID NO: 343265 - protein, 9 aa, Influenza virus
DRNALGDCP

SEQ ID NO: 343266 - protein, 9 aa, Influenza virus
KNALGECPK

SEQ ID NO: 343267 - protein, 9 aa, Influenza virus
ATGLRNVPS

SEQ ID NO: 343268 - protein, 9 aa, Influenza virus
RGLLGAIAG

SEQ ID NO: 343269 - protein, 9 aa, Influenza virus
GLLGAIAGF

SEQ ID NO: 343270 - protein, 9 aa, Influenza virus
VDGTIAGFI

SEQ ID NO: 343271 - protein, 9 aa, Influenza virus
HQNEQGMGM

SEQ ID NO: 343272 - protein, 9 aa, Influenza virus
QNEQGMGMA

SEQ ID NO: 343273 - protein, 9 aa, Influenza virus
NEQGMGMAA

SEQ ID NO: 343274 - protein, 9 aa, Influenza virus
EQGTGIAAE

SEQ ID NO: 343275 - protein, 9 aa, Influenza virus
QGTGIAAEK

SEQ ID NO: 343276 - protein, 9 aa, Influenza virus
GTGIAAEKE

SEQ ID NO: 343277 - protein, 9 aa, Influenza virus
TGIAAEKES

SEQ ID NO: 343278 - protein, 9 aa, Influenza virus
RGEFSQVER

SEQ ID NO: 343279 - protein, 9 aa, Influenza virus
GEFSQVERR

SEQ ID NO: 343280 - protein, 9 aa, Influenza virus
EFSQVERRI

SEQ ID NO: 343281 - protein, 9 aa, Influenza virus
FSQVERRIN

SEQ ID NO: 343282 - protein, 9 aa, Influenza virus
SQVERRINM

SEQ ID NO: 343283 - protein, 9 aa, Influenza virus
QVERRINML

SEQ ID NO: 343284 - protein, 9 aa, Influenza virus
VERRINMLA

SEQ ID NO: 343285 - protein, 9 aa, Influenza virus
ERRINMLAD

SEQ ID NO: 343286 - protein, 9 aa, Influenza virus
RRINMLADR

SEQ ID NO: 343287 - protein, 9 aa, Influenza virus
LNMHDANVR

SEQ ID NO: 343288 - protein, 9 aa, Influenza virus
NMHDANVRN

SEQ ID NO: 343289 - protein, 9 aa, Influenza virus
NVRNLHDQI

SEQ ID NO: 343290 - protein, 9 aa, Influenza virus
VRNLHEQIK

SEQ ID NO: 343291 - protein, 9 aa, Influenza virus
HKCNNTCME

SEQ ID NO: 343292 - protein, 9 aa, Influenza virus
KCNNTCMET

SEQ ID NO: 343293 - protein, 9 aa, Influenza virus
CNNTCMETI

SEQ ID NO: 343294 - protein, 9 aa, Influenza virus
NNTCMETIR

SEQ ID NO: 343295 - protein, 9 aa, Influenza virus
NTCMETIRN

SEQ ID NO: 343296 - protein, 9 aa, Influenza virus
IRNGTYNHI

SEQ ID NO: 343297 - protein, 9 aa, Influenza virus
KRQEIEGIR

SEQ ID NO: 343298 - protein, 9 aa, Influenza virus
RQEIEGIRL

SEQ ID NO: 343299 - protein, 9 aa, Influenza virus
QEIEGIRLK

SEQ ID NO: 343300 - protein, 9 aa, Influenza virus
EIEGIRLKS

SEQ ID NO: 343301 - protein, 9 aa, Influenza virus
SEDGVYKAL

SEQ ID NO: 343302 - protein, 9 aa, Influenza virus
EDGVYKALS

SEQ ID NO: 343303 - protein, 9 aa, Influenza virus
DNVYRALSI

SEQ ID NO: 343304 - protein, 9 aa, Influenza virus
NVYRALSIY

SEQ ID NO: 343305 - protein, 9 aa, Influenza virus
ASSVVLVGP

SEQ ID NO: 343306 - protein, 9 aa, Influenza virus
SSVVLVGPI

SEQ ID NO: 343307 - protein, 9 aa, Influenza virus
SVVLVGPIL

SEQ ID NO: 343308 - protein, 9 aa, Influenza virus
VLVGPILSF

SEQ ID NO: 343309 - protein, 9 aa, Influenza virus
LVGPILSFI

SEQ ID NO: 343310 - protein, 9 aa, Influenza virus
VGLILTFIM

SEQ ID NO: 343311 - protein, 9 aa, Influenza virus
GLILTFIMW

SEQ ID NO: 343312 - protein, 9 aa, Influenza virus
LILTFIMWA

SEQ ID NO: 343313 - protein, 9 aa, Influenza virus
ILSFIMWAG

SEQ ID NO: 343314 - protein, 9 aa, Influenza virus
FIMWACNSG

SEQ ID NO: 343315 - protein, 9 aa, Influenza virus
IMWACNSGN

SEQ ID NO: 343316 - protein, 9 aa, Influenza virus
MWACNSGNC

SEQ ID NO: 343317 - protein, 9 aa, Influenza virus
WACNSGNCR

SEQ ID NO: 343318 - protein, 9 aa, Influenza virus
ACNSGNCRF

SEQ ID NO: 343319 - protein, 9 aa, Influenza virus
CSNGNCRFN

SEQ ID NO: 343320 - protein, 9 aa, Influenza virus
MKWLLSSKD

SEQ ID NO: 343321 - protein, 9 aa, Influenza virus
KWLSSSGNN

SEQ ID NO: 343322 - protein, 9 aa, Influenza virus
WLSSSGNNQ

SEQ ID NO: 343323 - protein, 9 aa, Influenza virus
LSSSGNNQV

SEQ ID NO: 343324 - protein, 9 aa, Influenza virus
LSSKDNQVF

SEQ ID NO: 343325 - protein, 9 aa, Influenza virus
SSKDNQVFP

SEQ ID NO: 343326 - protein, 9 aa, Influenza virus
SKDNQVFPQ

SEQ ID NO: 343327 - protein, 9 aa, Influenza virus
KDNQVFPQL

SEQ ID NO: 343328 - protein, 9 aa, Influenza virus
GRYSRADKI

SEQ ID NO: 343329 - protein, 9 aa, Influenza virus
RYSRADKIC

SEQ ID NO: 343330 - protein, 9 aa, Influenza virus
YLSNNATDT

SEQ ID NO: 343331 - protein, 9 aa, Influenza virus
LSNNSTDKI

SEQ ID NO: 343332 - protein, 9 aa, Influenza virus
SNNSTDKID

SEQ ID NO: 343333 - protein, 9 aa, Influenza virus
NNSTDKIDT

SEQ ID NO: 343334 - protein, 9 aa, Influenza virus
NSTDKIDTL

SEQ ID NO: 343335 - protein, 9 aa, Influenza virus
STDKIDTLT

SEQ ID NO: 343336 - protein, 9 aa, Influenza virus
TDKIDTLTE

SEQ ID NO: 343337 - protein, 9 aa, Influenza virus
DKVDTLTET

SEQ ID NO: 343338 - protein, 9 aa, Influenza virus
KVDTLTETG

SEQ ID NO: 343339 - protein, 9 aa, Influenza virus
CSLNGISPV

SEQ ID NO: 343340 - protein, 9 aa, Influenza virus
SLNGISPVH

SEQ ID NO: 343341 - protein, 9 aa, Influenza virus
LNGISPVHL

SEQ ID NO: 343342 - protein, 9 aa, Influenza virus
NGISPVHLG

SEQ ID NO: 343343 - protein, 9 aa, Influenza virus
GISPVHLGD

SEQ ID NO: 343344 - protein, 9 aa, Influenza virus
ISPVHLGDC

SEQ ID NO: 343345 - protein, 9 aa, Influenza virus
PNAPHKLCY

SEQ ID NO: 343346 - protein, 9 aa, Influenza virus
NAPHKLCYP

SEQ ID NO: 343347 - protein, 9 aa, Influenza virus
APHKLCYPG

SEQ ID NO: 343348 - protein, 9 aa, Influenza virus
PHKLCYPGE

SEQ ID NO: 343349 - protein, 9 aa, Influenza virus
KFCYPGELD

SEQ ID NO: 343350 - protein, 9 aa, Influenza virus
LCYPGEVDN

SEQ ID NO: 343351 - protein, 9 aa, Influenza virus
CYPGEVDNN

SEQ ID NO: 343352 - protein, 9 aa, Influenza virus
YPGEVDNNG

SEQ ID NO: 343353 - protein, 9 aa, Influenza virus
SRTELINPN

SEQ ID NO: 343354 - protein, 9 aa, Influenza virus
RTELINPNK

SEQ ID NO: 343355 - protein, 9 aa, Influenza virus
TELINPNKW

SEQ ID NO: 343356 - protein, 9 aa, Influenza virus
ELINPNKWG

SEQ ID NO: 343357 - protein, 9 aa, Influenza virus
PNKWGNVLD

SEQ ID NO: 343358 - protein, 9 aa, Influenza virus
NKWGNVLDG

SEQ ID NO: 343359 - protein, 9 aa, Influenza virus
KWGDILDGV

SEQ ID NO: 343360 - protein, 9 aa, Influenza virus
WGDILDGVT

SEQ ID NO: 343361 - protein, 9 aa, Influenza virus
GDILDGVTA

SEQ ID NO: 343362 - protein, 9 aa, Influenza virus
DILDGVTAS

SEQ ID NO: 343363 - protein, 9 aa, Influenza virus
GVTASCRDN

SEQ ID NO: 343364 - protein, 9 aa, Influenza virus
VTASCRDNG

SEQ ID NO: 343365 - protein, 9 aa, Influenza virus
TASCRDNGA

SEQ ID NO: 343366 - protein, 9 aa, Influenza virus
GAKSFYRNL

SEQ ID NO: 343367 - protein, 9 aa, Influenza virus
KSFYRNLVW

SEQ ID NO: 343368 - protein, 9 aa, Influenza virus
YRNLIWLVK

SEQ ID NO: 343369 - protein, 9 aa, Influenza virus
VRGDYNNTT

SEQ ID NO: 343370 - protein, 9 aa, Influenza virus
GIHHPDTEE

SEQ ID NO: 343371 - protein, 9 aa, Influenza virus
IHHPDTEEV

SEQ ID NO: 343372 - protein, 9 aa, Influenza virus
HHPDTEAVA

SEQ ID NO: 343373 - protein, 9 aa, Influenza virus
AINLYASKN

SEQ ID NO: 343374 - protein, 9 aa, Influenza virus
INLYASKNP

SEQ ID NO: 343375 - protein, 9 aa, Influenza virus
RLYVNKNPY

SEQ ID NO: 343376 - protein, 9 aa, Influenza virus
MKLYWHLMS

SEQ ID NO: 343377 - protein, 9 aa, Influenza virus
KLYWHLMSP

SEQ ID NO: 343378 - protein, 9 aa, Influenza virus
LYWHLMSPG

SEQ ID NO: 343379 - protein, 9 aa, Influenza virus
HLMRPGERT

SEQ ID NO: 343380 - protein, 9 aa, Influenza virus
GERTTFESN

SEQ ID NO: 343381 - protein, 9 aa, Influenza virus
ERTTFESNG

SEQ ID NO: 343382 - protein, 9 aa, Influenza virus
RTTFESNGG

SEQ ID NO: 343383 - protein, 9 aa, Influenza virus
TTFESNGGL

SEQ ID NO: 343384 - protein, 9 aa, Influenza virus
MFESNGGLL

SEQ ID NO: 343385 - protein, 9 aa, Influenza virus
TGRIFQSRI

SEQ ID NO: 343386 - protein, 9 aa, Influenza virus
RIFQSRIRM

SEQ ID NO: 343387 - protein, 9 aa, Influenza virus
IFQSGVRVA

SEQ ID NO: 343388 - protein, 9 aa, Influenza virus
RMGKCNTKC

SEQ ID NO: 343389 - protein, 9 aa, Influenza virus
MGKCNTKCQ

SEQ ID NO: 343390 - protein, 9 aa, Influenza virus
KCQTSMGGV

SEQ ID NO: 343391 - protein, 9 aa, Influenza virus
SERGLFGAI

SEQ ID NO: 343392 - protein, 9 aa, Influenza virus
DKVSTQKAL

SEQ ID NO: 343393 - protein, 9 aa, Influenza virus
KVSTQKAIN

SEQ ID NO: 343394 - protein, 9 aa, Influenza virus
VSTQKAINE

SEQ ID NO: 343395 - protein, 9 aa, Influenza virus
LLENGRTLG

SEQ ID NO: 343396 - protein, 9 aa, Influenza virus
LENGRTLGL

SEQ ID NO: 343397 - protein, 9 aa, Influenza virus
DANVKNLHD

SEQ ID NO: 343398 - protein, 9 aa, Influenza virus
ANVKNLHDQ

SEQ ID NO: 343399 - protein, 9 aa, Influenza virus
NVKNLHEQV

SEQ ID NO: 343400 - protein, 9 aa, Influenza virus
VRNLHDQIK

SEQ ID NO: 343401 - protein, 9 aa, Influenza virus
RNLHDQIKR

SEQ ID NO: 343402 - protein, 9 aa, Influenza virus
LQNNAIDEG

SEQ ID NO: 343403 - protein, 9 aa, Influenza virus
QNNAIDEGD

SEQ ID NO: 343404 - protein, 9 aa, Influenza virus
DEGDGCFNF

SEQ ID NO: 343405 - protein, 9 aa, Influenza virus
EGDGCFNFF

SEQ ID NO: 343406 - protein, 9 aa, Influenza virus
GDGCFNFFH

SEQ ID NO: 343407 - protein, 9 aa, Influenza virus
DGCFNFFHK

SEQ ID NO: 343408 - protein, 9 aa, Influenza virus
GCFNFFHKC

SEQ ID NO: 343409 - protein, 9 aa, Influenza virus
CFNFFHKCN

SEQ ID NO: 343410 - protein, 9 aa, Influenza virus
FNFFHKCND

SEQ ID NO: 343411 - protein, 9 aa, Influenza virus
NFFHKCNDS

SEQ ID NO: 343412 - protein, 9 aa, Influenza virus
KSEDNVYKV

SEQ ID NO: 343413 - protein, 9 aa, Influenza virus
SEDNVYKVL

SEQ ID NO: 343414 - protein, 9 aa, Influenza virus
EDNVYKVLA

SEQ ID NO: 343415 - protein, 9 aa, Influenza virus
DNVYKVLAI

SEQ ID NO: 343416 - protein, 9 aa, Influenza virus
NVYKVLAIY

SEQ ID NO: 343417 - protein, 9 aa, Influenza virus
IYKILSIYS

SEQ ID NO: 343418 - protein, 9 aa, Influenza virus
SCIASSTVL

SEQ ID NO: 343419 - protein, 9 aa, Influenza virus
CIASSTVLV

SEQ ID NO: 343420 - protein, 9 aa, Influenza virus
IASSTVLVG

SEQ ID NO: 343421 - protein, 9 aa, Influenza virus
ASSTVLVGL

SEQ ID NO: 343422 - protein, 9 aa, Influenza virus
SSTVLVGLI

SEQ ID NO: 343423 - protein, 9 aa, Influenza virus
STVLVGLIL

SEQ ID NO: 343424 - protein, 9 aa, Influenza virus
TVLVGLILA

SEQ ID NO: 343425 - protein, 9 aa, Influenza virus
IMWACSNGN

SEQ ID NO: 343426 - protein, 9 aa, Influenza virus
MWACSNGNC

SEQ ID NO: 343427 - protein, 9 aa, Influenza virus
CSSGNCRFS

SEQ ID NO: 343428 - protein, 9 aa, Influenza virus
SSGNCRFSV

SEQ ID NO: 343429 - protein, 9 aa, Influenza virus
NGNCRFNVC

SEQ ID NO: 343430 - protein, 9 aa, Influenza virus
ATKMEAILV

SEQ ID NO: 343431 - protein, 9 aa, Influenza virus
TKMEAILVV

SEQ ID NO: 343432 - protein, 9 aa, Influenza virus
IENGWEGMV

SEQ ID NO: 343433 - protein, 9 aa, Influenza virus
ENGWEGMVD

SEQ ID NO: 343434 - protein, 9 aa, Influenza virus
NGWEGMVDG

SEQ ID NO: 343435 - protein, 9 aa, Influenza virus
GWEGMVDGW

SEQ ID NO: 343436 - protein, 9 aa, Influenza virus
WEGMVDGWY

SEQ ID NO: 343437 - protein, 9 aa, Influenza virus
EGMVDGWYG

SEQ ID NO: 343438 - protein, 9 aa, Influenza virus
GMVDGWYGF

SEQ ID NO: 343439 - protein, 9 aa, Influenza virus
MVDGWYGFR

SEQ ID NO: 343440 - protein, 9 aa, Influenza virus
VDGWYGFRH

SEQ ID NO: 343441 - protein, 9 aa, Influenza virus
NGWYGFQHQ

SEQ ID NO: 343442 - protein, 9 aa, Influenza virus
GWYGFQHQN

SEQ ID NO: 343443 - protein, 9 aa, Influenza virus
YNAQLLVLL

SEQ ID NO: 343444 - protein, 9 aa, Influenza virus
NAQLLVLLE

SEQ ID NO: 343445 - protein, 9 aa, Influenza virus
AQLLVLLEN

SEQ ID NO: 343446 - protein, 9 aa, Influenza virus
LLENQKTLD

SEQ ID NO: 343447 - protein, 9 aa, Influenza virus
GDGCFEILH

SEQ ID NO: 343448 - protein, 9 aa, Influenza virus
LAIYSTAAS

SEQ ID NO: 343449 - protein, 9 aa, Influenza virus
QCRICILDQ

SEQ ID NO: 343450 - protein, 9 aa, Influenza virus
CRICIDFRD

SEQ ID NO: 343451 - protein, 9 aa, Influenza virus
KMEAILVVL

SEQ ID NO: 343452 - protein, 9 aa, Influenza virus
TDTVDTVRE

SEQ ID NO: 343453 - protein, 9 aa, Influenza virus
DTVDTLLEK

SEQ ID NO: 343454 - protein, 9 aa, Influenza virus
TVDTLLEKN

SEQ ID NO: 343455 - protein, 9 aa, Influenza virus
VDTLLEKNV

SEQ ID NO: 343456 - protein, 9 aa, Influenza virus
DTLLEKNVT

SEQ ID NO: 343457 - protein, 9 aa, Influenza virus
TLLEKNVTV

SEQ ID NO: 343458 - protein, 9 aa, Influenza virus
LLEKNVTVT

SEQ ID NO: 343459 - protein, 9 aa, Influenza virus
VAGWLLGNP

SEQ ID NO: 343460 - protein, 9 aa, Influenza virus
NYEELREHL

SEQ ID NO: 343461 - protein, 9 aa, Influenza virus
EELREHLSS

SEQ ID NO: 343462 - protein, 9 aa, Influenza virus
ELREHLSSV

SEQ ID NO: 343463 - protein, 9 aa, Influenza virus
LREHLSSVS

SEQ ID NO: 343464 - protein, 9 aa, Influenza virus
REHLSSVSS

SEQ ID NO: 343465 - protein, 9 aa, Influenza virus
QLSSVSSFK

SEQ ID NO: 343466 - protein, 9 aa, Influenza virus
LSSVSSFKR

SEQ ID NO: 343467 - protein, 9 aa, Influenza virus
SSVSSFKRF

SEQ ID NO: 343468 - protein, 9 aa, Influenza virus
SVSSFKRFE

SEQ ID NO: 343469 - protein, 9 aa, Influenza virus
VSSFKRFEI

SEQ ID NO: 343470 - protein, 9 aa, Influenza virus
FERFEIFPN

SEQ ID NO: 343471 - protein, 9 aa, Influenza virus
VLVLWAIHH

SEQ ID NO: 343472 - protein, 9 aa, Influenza virus
LVLWAIHHP

SEQ ID NO: 343473 - protein, 9 aa, Influenza virus
GRMDYYWTL

SEQ ID NO: 343474 - protein, 9 aa, Influenza virus
DTIIFEASG

SEQ ID NO: 343475 - protein, 9 aa, Influenza virus
TIIFEASGN

SEQ ID NO: 343476 - protein, 9 aa, Influenza virus
FEATGNLLV

SEQ ID NO: 343477 - protein, 9 aa, Influenza virus
EATGNLLVP

SEQ ID NO: 343478 - protein, 9 aa, Influenza virus
NLPFQNVHP

SEQ ID NO: 343479 - protein, 9 aa, Influenza virus
SITIGKCPK

SEQ ID NO: 343480 - protein, 9 aa, Influenza virus
ITIGKCSKY

SEQ ID NO: 343481 - protein, 9 aa, Influenza virus
ECPKYVRST

SEQ ID NO: 343482 - protein, 9 aa, Influenza virus
QLRMATGLR

SEQ ID NO: 343483 - protein, 9 aa, Influenza virus
RLATGLRNI

SEQ ID NO: 343484 - protein, 9 aa, Influenza virus
LATGLRNIP

SEQ ID NO: 343485 - protein, 9 aa, Influenza virus
ITNKVNSVV

SEQ ID NO: 343486 - protein, 9 aa, Influenza virus
TNKVNSVVE

SEQ ID NO: 343487 - protein, 9 aa, Influenza virus
NSVVEKMNT

SEQ ID NO: 343488 - protein, 9 aa, Influenza virus
SVVEKMNTQ

SEQ ID NO: 343489 - protein, 9 aa, Influenza virus
EKMNTQFTV

SEQ ID NO: 343490 - protein, 9 aa, Influenza virus
MNTQFTVVG

SEQ ID NO: 343491 - protein, 9 aa, Influenza virus
NTQFTSVGK

SEQ ID NO: 343492 - protein, 9 aa, Influenza virus
TQFTSVGKE

SEQ ID NO: 343493 - protein, 9 aa, Influenza virus
RIENLNRKV

SEQ ID NO: 343494 - protein, 9 aa, Influenza virus
IENLNRKVD

SEQ ID NO: 343495 - protein, 9 aa, Influenza virus
LNRKVDDGF

SEQ ID NO: 343496 - protein, 9 aa, Influenza virus
NKKVDDGLL

SEQ ID NO: 343497 - protein, 9 aa, Influenza virus
KKVDDGLLD

SEQ ID NO: 343498 - protein, 9 aa, Influenza virus
DDGLLDVWT

SEQ ID NO: 343499 - protein, 9 aa, Influenza virus
DGLLDVWTY

SEQ ID NO: 343500 - protein, 9 aa, Influenza virus
GLLDVWTYN

SEQ ID NO: 343501 - protein, 9 aa, Influenza virus
LLDVWTYNA

SEQ ID NO: 343502 - protein, 9 aa, Influenza virus
IDVWTYNAE

SEQ ID NO: 343503 - protein, 9 aa, Influenza virus
ERTLDFHDF

SEQ ID NO: 343504 - protein, 9 aa, Influenza virus
FEFYHKCNN

SEQ ID NO: 343505 - protein, 9 aa, Influenza virus
ESIKNGTYD

SEQ ID NO: 343506 - protein, 9 aa, Influenza virus
DYPKYSKES

SEQ ID NO: 343507 - protein, 9 aa, Influenza virus
YPKYSKESK

SEQ ID NO: 343508 - protein, 9 aa, Influenza virus
PKYSKESKL

SEQ ID NO: 343509 - protein, 9 aa, Influenza virus
VHQILAIYS

SEQ ID NO: 343510 - protein, 9 aa, Influenza virus
STVASSLIL

SEQ ID NO: 343511 - protein, 9 aa, Influenza virus
ASSLVLIVS

SEQ ID NO: 343512 - protein, 9 aa, Influenza virus
SSLVLIVSL

SEQ ID NO: 343513 - protein, 9 aa, Influenza virus
SLVLIVSLG

SEQ ID NO: 343514 - protein, 9 aa, Influenza virus
LVLIVSLGA

SEQ ID NO: 343515 - protein, 9 aa, Influenza virus
VLLVSLGAV

SEQ ID NO: 343516 - protein, 9 aa, Influenza virus
LLVSLGAVS

SEQ ID NO: 343517 - protein, 9 aa, Influenza virus
LVSLGAVSF

SEQ ID NO: 343518 - protein, 9 aa, Influenza virus
IGFWMCSNG

SEQ ID NO: 343519 - protein, 9 aa, Influenza virus
SGHSCRICI

SEQ ID NO: 343520 - protein, 9 aa, Influenza virus
WSLQCRICI

SEQ ID NO: 343521 - protein, 9 aa, Influenza virus
WAIHTKDNS

SEQ ID NO: 343522 - protein, 9 aa, Influenza virus
YSKDNGIRI

SEQ ID NO: 343523 - protein, 9 aa, Influenza virus
SKDNGIRIG

SEQ ID NO: 343524 - protein, 9 aa, Influenza virus
DNGVRIGSK

SEQ ID NO: 343525 - protein, 9 aa, Influenza virus
GSKGDVFVM

SEQ ID NO: 343526 - protein, 9 aa, Influenza virus
SKGDVFVMR

SEQ ID NO: 343527 - protein, 9 aa, Influenza virus
KGDVFVMRE

SEQ ID NO: 343528 - protein, 9 aa, Influenza virus
EPFISCSHF

SEQ ID NO: 343529 - protein, 9 aa, Influenza virus
PFISCSHFE

SEQ ID NO: 343530 - protein, 9 aa, Influenza virus
FISCSHFEC

SEQ ID NO: 343531 - protein, 9 aa, Influenza virus
ISCSQLECR

SEQ ID NO: 343532 - protein, 9 aa, Influenza virus
NDKHSNGTA

SEQ ID NO: 343533 - protein, 9 aa, Influenza virus
DKHSNGTAK

SEQ ID NO: 343534 - protein, 9 aa, Influenza virus
HSNGTVKNR

SEQ ID NO: 343535 - protein, 9 aa, Influenza virus
SNGTVKNRS

SEQ ID NO: 343536 - protein, 9 aa, Influenza virus
KNRSPYRAL

SEQ ID NO: 343537 - protein, 9 aa, Influenza virus
NRSPYRALM

SEQ ID NO: 343538 - protein, 9 aa, Influenza virus
RALMSCPIG

SEQ ID NO: 343539 - protein, 9 aa, Influenza virus
ALMSCPIGE

SEQ ID NO: 343540 - protein, 9 aa, Influenza virus
LMSCPVGEA

SEQ ID NO: 343541 - protein, 9 aa, Influenza virus
MSCPVGEAP

SEQ ID NO: 343542 - protein, 9 aa, Influenza virus
SCPVGEAPS

SEQ ID NO: 343543 - protein, 9 aa, Influenza virus
CPVGEAPSP

SEQ ID NO: 343544 - protein, 9 aa, Influenza virus
PVGEAPSPY

SEQ ID NO: 343545 - protein, 9 aa, Influenza virus
VGEAPSPYN

SEQ ID NO: 343546 - protein, 9 aa, Influenza virus
SASACHDGL

SEQ ID NO: 343547 - protein, 9 aa, Influenza virus
GWITIGISG

SEQ ID NO: 343548 - protein, 9 aa, Influenza virus
LKYNDIITD

SEQ ID NO: 343549 - protein, 9 aa, Influenza virus
KYKGIITGT

SEQ ID NO: 343550 - protein, 9 aa, Influenza virus
DIITDTIKS

SEQ ID NO: 343551 - protein, 9 aa, Influenza virus
VITDTIKSW

SEQ ID NO: 343552 - protein, 9 aa, Influenza virus
KILRTQESE

SEQ ID NO: 343553 - protein, 9 aa, Influenza virus
TQESECVCI

SEQ ID NO: 343554 - protein, 9 aa, Influenza virus
QESECVCIN

SEQ ID NO: 343555 - protein, 9 aa, Influenza virus
ESECVCING

SEQ ID NO: 343556 - protein, 9 aa, Influenza virus
SECVCINGS

SEQ ID NO: 343557 - protein, 9 aa, Influenza virus
ECVCINGSC

SEQ ID NO: 343558 - protein, 9 aa, Influenza virus
FTIMTDGPN

SEQ ID NO: 343559 - protein, 9 aa, Influenza virus
APNSHYEEC

SEQ ID NO: 343560 - protein, 9 aa, Influenza virus
PNSHYEECS

SEQ ID NO: 343561 - protein, 9 aa, Influenza virus
NSHYEECSC

SEQ ID NO: 343562 - protein, 9 aa, Influenza virus
SHYEECSCY

SEQ ID NO: 343563 - protein, 9 aa, Influenza virus
EECSCYPES

SEQ ID NO: 343564 - protein, 9 aa, Influenza virus
IICVCRDNW

SEQ ID NO: 343565 - protein, 9 aa, Influenza virus
RPWISFDQN

SEQ ID NO: 343566 - protein, 9 aa, Influenza virus
PWISFDQNL

SEQ ID NO: 343567 - protein, 9 aa, Influenza virus
YRIGYICSG

SEQ ID NO: 343568 - protein, 9 aa, Influenza virus
VGYICSGVF

SEQ ID NO: 343569 - protein, 9 aa, Influenza virus
GVLGDNPRP

SEQ ID NO: 343570 - protein, 9 aa, Influenza virus
GTNGVKGFS

SEQ ID NO: 343571 - protein, 9 aa, Influenza virus
AYGVKGFSF

SEQ ID NO: 343572 - protein, 9 aa, Influenza virus
GVKGFSYRY

SEQ ID NO: 343573 - protein, 9 aa, Influenza virus
VKGFSYKYD

SEQ ID NO: 343574 - protein, 9 aa, Influenza virus
KGFSYKYDN

SEQ ID NO: 343575 - protein, 9 aa, Influenza virus
GFSYKYDNG

SEQ ID NO: 343576 - protein, 9 aa, Influenza virus
FSYKYDNGV

SEQ ID NO: 343577 - protein, 9 aa, Influenza virus
SYKYDNGVW

SEQ ID NO: 343578 - protein, 9 aa, Influenza virus
KYGNGVWMG

SEQ ID NO: 343579 - protein, 9 aa, Influenza virus
VWMGRTKSN

SEQ ID NO: 343580 - protein, 9 aa, Influenza virus
TNWSGYSGS

SEQ ID NO: 343581 - protein, 9 aa, Influenza virus
QHPELTGMD

SEQ ID NO: 343582 - protein, 9 aa, Influenza virus
HPELTGMDC

SEQ ID NO: 343583 - protein, 9 aa, Influenza virus
PELTGLNCI

SEQ ID NO: 343584 - protein, 9 aa, Influenza virus
NCIKPCFWV

SEQ ID NO: 343585 - protein, 9 aa, Influenza virus
TIWTSGSII

SEQ ID NO: 343586 - protein, 9 aa, Influenza virus
IWTSASSIS

SEQ ID NO: 343587 - protein, 9 aa, Influenza virus
IISFCGVNS

SEQ ID NO: 343588 - protein, 9 aa, Influenza virus
DWSWPDGAE

SEQ ID NO: 343589 - protein, 9 aa, Influenza virus
PDGAELPFA

SEQ ID NO: 343590 - protein, 9 aa, Influenza virus
DGAELPFAI

SEQ ID NO: 343591 - protein, 9 aa, Influenza virus
DPICIGYHA

SEQ ID NO: 343592 - protein, 9 aa, Influenza virus
TLCICYHAN

SEQ ID NO: 343593 - protein, 9 aa, Influenza virus
KNVAVTHSV

SEQ ID NO: 343594 - protein, 9 aa, Influenza virus
KLTVTHSVN

SEQ ID NO: 343595 - protein, 9 aa, Influenza virus
VKVTHRENL

SEQ ID NO: 343596 - protein, 9 aa, Influenza virus
VAGWLLGNP

SEQ ID NO: 343597 - protein, 9 aa, Influenza virus
GWLLGNPAC

SEQ ID NO: 343598 - protein, 9 aa, Influenza virus
YEELKEQLS

SEQ ID NO: 343599 - protein, 9 aa, Influenza virus
PFQNIHPIT

SEQ ID NO: 343600 - protein, 9 aa, Influenza virus
FQNIHPITI

SEQ ID NO: 343601 - protein, 9 aa, Influenza virus
QNIHPITIG

SEQ ID NO: 343602 - protein, 9 aa, Influenza virus
HPVTIGKCP

SEQ ID NO: 343603 - protein, 9 aa, Influenza virus
PVTIGKCPK

SEQ ID NO: 343604 - protein, 9 aa, Influenza virus
VTIGKCPKY

SEQ ID NO: 343605 - protein, 9 aa, Influenza virus
LRLATGLRN

SEQ ID NO: 343606 - protein, 9 aa, Influenza virus
SIHSRGLFG

SEQ ID NO: 343607 - protein, 9 aa, Influenza virus
VQSRGLFGA

SEQ ID NO: 343608 - protein, 9 aa, Influenza virus
HSRGLFGAI

SEQ ID NO: 343609 - protein, 9 aa, Influenza virus
EQGSGYAAN

SEQ ID NO: 343610 - protein, 9 aa, Influenza virus
ENLNRKVDD

SEQ ID NO: 343611 - protein, 9 aa, Influenza virus
NLNRKVDDG

SEQ ID NO: 343612 - protein, 9 aa, Influenza virus
LNKKIDDGF

SEQ ID NO: 343613 - protein, 9 aa, Influenza virus
DVWTYNVEL

SEQ ID NO: 343614 - protein, 9 aa, Influenza virus
ERTLDFHDF

SEQ ID NO: 343615 - protein, 9 aa, Influenza virus
RTLDFHDFN

SEQ ID NO: 343616 - protein, 9 aa, Influenza virus
TLDFHDFNV

SEQ ID NO: 343617 - protein, 9 aa, Influenza virus
NKVKEIGNG

SEQ ID NO: 343618 - protein, 9 aa, Influenza virus
KVKEIGNGC

SEQ ID NO: 343619 - protein, 9 aa, Influenza virus
AKETGNGCF

SEQ ID NO: 343620 - protein, 9 aa, Influenza virus
RELGNGCFE

SEQ ID NO: 343621 - protein, 9 aa, Influenza virus
FEFYHKCDN

SEQ ID NO: 343622 - protein, 9 aa, Influenza virus
CMESIKNGT

SEQ ID NO: 343623 - protein, 9 aa, Influenza virus
MESIKNGTY

SEQ ID NO: 343624 - protein, 9 aa, Influenza virus
SVKNGTYEY

SEQ ID NO: 343625 - protein, 9 aa, Influenza virus
SFWMCPNGS

SEQ ID NO: 343626 - protein, 9 aa, Influenza virus
CSNGSLQFR

SEQ ID NO: 343627 - protein, 9 aa, Influenza virus
SNGSLHGRI

SEQ ID NO: 343628 - protein, 9 aa, Influenza virus
NGSLHGRIC

SEQ ID NO: 343629 - protein, 9 aa, Influenza virus
GSLHGRICI

SEQ ID NO: 343630 - protein, 9 aa, Influenza virus
YRSWSKPQC

SEQ ID NO: 343631 - protein, 9 aa, Influenza virus
ITGFASFSK

SEQ ID NO: 343632 - protein, 9 aa, Influenza virus
NGFAPFSKD

SEQ ID NO: 343633 - protein, 9 aa, Influenza virus
IRLSASGDV

SEQ ID NO: 343634 - protein, 9 aa, Influenza virus
LSAGGAVWV

SEQ ID NO: 343635 - protein, 9 aa, Influenza virus
SASGDIWVT

SEQ ID NO: 343636 - protein, 9 aa, Influenza virus
AGGDIWATR

SEQ ID NO: 343637 - protein, 9 aa, Influenza virus
GGDIWATRE

SEQ ID NO: 343638 - protein, 9 aa, Influenza virus
GAVWVTREP

SEQ ID NO: 343639 - protein, 9 aa, Influenza virus
DIWVTRKPY

SEQ ID NO: 343640 - protein, 9 aa, Influenza virus
TREPYVSCG

SEQ ID NO: 343641 - protein, 9 aa, Influenza virus
ALGQGTTLS

SEQ ID NO: 343642 - protein, 9 aa, Influenza virus
LGQGTTLKN

SEQ ID NO: 343643 - protein, 9 aa, Influenza virus
DRTSYRTLL

SEQ ID NO: 343644 - protein, 9 aa, Influenza virus
RTSYRTLLM

SEQ ID NO: 343645 - protein, 9 aa, Influenza virus
PHRTLLMSE

SEQ ID NO: 343646 - protein, 9 aa, Influenza virus
GVPFYLGTR

SEQ ID NO: 343647 - protein, 9 aa, Influenza virus
PFYLGTRQV

SEQ ID NO: 343648 - protein, 9 aa, Influenza virus
FYLGTRQVC

SEQ ID NO: 343649 - protein, 9 aa, Influenza virus
LGTKQVCMA

SEQ ID NO: 343650 - protein, 9 aa, Influenza virus
GTKQVCMAW

SEQ ID NO: 343651 - protein, 9 aa, Influenza virus
TKQVCMAWS

SEQ ID NO: 343652 - protein, 9 aa, Influenza virus
KQVCMAWSS

SEQ ID NO: 343653 - protein, 9 aa, Influenza virus
SSSCHDGKS

SEQ ID NO: 343654 - protein, 9 aa, Influenza virus
SSCHDGKSW

SEQ ID NO: 343655 - protein, 9 aa, Influenza virus
SCHDGKSWL

SEQ ID NO: 343656 - protein, 9 aa, Influenza virus
CHDGKSWLH

SEQ ID NO: 343657 - protein, 9 aa, Influenza virus
HDGKSWLHV

SEQ ID NO: 343658 - protein, 9 aa, Influenza virus
DGKAWLHIC

SEQ ID NO: 343659 - protein, 9 aa, Influenza virus
AWLHICVTG

SEQ ID NO: 343660 - protein, 9 aa, Influenza virus
KILRTHESE

SEQ ID NO: 343661 - protein, 9 aa, Influenza virus
THESECVCI

SEQ ID NO: 343662 - protein, 9 aa, Influenza virus
TCAVVMTDG

SEQ ID NO: 343663 - protein, 9 aa, Influenza virus
VVMTDGSVS

SEQ ID NO: 343664 - protein, 9 aa, Influenza virus
IMIDGSASG

SEQ ID NO: 343665 - protein, 9 aa, Influenza virus
GNAQHVEEC

SEQ ID NO: 343666 - protein, 9 aa, Influenza virus
NAQHVEECS

SEQ ID NO: 343667 - protein, 9 aa, Influenza virus
ECSCYPQYP

SEQ ID NO: 343668 - protein, 9 aa, Influenza virus
WRGSNRPIV

SEQ ID NO: 343669 - protein, 9 aa, Influenza virus
RGSNRPIVD

SEQ ID NO: 343670 - protein, 9 aa, Influenza virus
GSNRPVIDI

SEQ ID NO: 343671 - protein, 9 aa, Influenza virus
GDHGVKGWA

SEQ ID NO: 343672 - protein, 9 aa, Influenza virus
DHGVKGWAF

SEQ ID NO: 343673 - protein, 9 aa, Influenza virus
GVKGWAFDS

SEQ ID NO: 343674 - protein, 9 aa, Influenza virus
LGYETFKVV

SEQ ID NO: 343675 - protein, 9 aa, Influenza virus
MSGYSGIFS

SEQ ID NO: 343676 - protein, 9 aa, Influenza virus
SGYFGVFSV

SEQ ID NO: 343677 - protein, 9 aa, Influenza virus
GYFGVFSVE

SEQ ID NO: 343678 - protein, 9 aa, Influenza virus
SCVNRCFYV

SEQ ID NO: 343679 - protein, 9 aa, Influenza virus
YVELIRGRP

SEQ ID NO: 343680 - protein, 9 aa, Influenza virus
WWTSNSVVV

SEQ ID NO: 343681 - protein, 9 aa, Influenza virus
NSIVVFCST

SEQ ID NO: 343682 - protein, 9 aa, Influenza virus
SVVVFCGTS

SEQ ID NO: 343683 - protein, 9 aa, Influenza virus
VVVFCGTSG

SEQ ID NO: 343684 - protein, 9 aa, Influenza virus
VAFCGTSGT

SEQ ID NO: 343685 - protein, 9 aa, Influenza virus
VFCGTPGTY

SEQ ID NO: 343686 - protein, 9 aa, Influenza virus
GTCGTGSWP

SEQ ID NO: 343687 - protein, 9 aa, Influenza virus
TYGKGSWPD

SEQ ID NO: 343688 - protein, 9 aa, Influenza virus
CGTGSWPDG

SEQ ID NO: 343689 - protein, 9 aa, Influenza virus
GTGAWPDGA

SEQ ID NO: 343690 - protein, 9 aa, Influenza virus
GSWPDGRTS

SEQ ID NO: 343691 - protein, 9 aa, Influenza virus
MDKQTKTMT

SEQ ID NO: 343692 - protein, 9 aa, Influenza virus
DNQTKKMTI

SEQ ID NO: 343693 - protein, 9 aa, Influenza virus
NQTKKMTIT

SEQ ID NO: 343694 - protein, 9 aa, Influenza virus
DRICIGYHA

SEQ ID NO: 343695 - protein, 9 aa, Influenza virus
RICIGYHAN

SEQ ID NO: 343696 - protein, 9 aa, Influenza virus
YHANNSTER

SEQ ID NO: 343697 - protein, 9 aa, Influenza virus
NNSTEKIDT

SEQ ID NO: 343698 - protein, 9 aa, Influenza virus
KNVTVTHAQ

SEQ ID NO: 343699 - protein, 9 aa, Influenza virus
NVTVTHAQN

SEQ ID NO: 343700 - protein, 9 aa, Influenza virus
VTVTHAEDI

SEQ ID NO: 343701 - protein, 9 aa, Influenza virus
THAQDILER

SEQ ID NO: 343702 - protein, 9 aa, Influenza virus
DILERTHNG

SEQ ID NO: 343703 - protein, 9 aa, Influenza virus
ILEKTHNGR

SEQ ID NO: 343704 - protein, 9 aa, Influenza virus
LEKAHNGKL

SEQ ID NO: 343705 - protein, 9 aa, Influenza virus
EKTHNGRLC

SEQ ID NO: 343706 - protein, 9 aa, Influenza virus
AHNGKLCRL

SEQ ID NO: 343707 - protein, 9 aa, Influenza virus
HNGKLCKLS

SEQ ID NO: 343708 - protein, 9 aa, Influenza virus
NGKLCKLSG

SEQ ID NO: 343709 - protein, 9 aa, Influenza virus
LSGIPPLVL

SEQ ID NO: 343710 - protein, 9 aa, Influenza virus
GVPPLELGD

SEQ ID NO: 343711 - protein, 9 aa, Influenza virus
VPPLELGDC

SEQ ID NO: 343712 - protein, 9 aa, Influenza virus
LLGNPKCDR

SEQ ID NO: 343713 - protein, 9 aa, Influenza virus
LGNPECDLF

SEQ ID NO: 343714 - protein, 9 aa, Influenza virus
GNPECDLFL

SEQ ID NO: 343715 - protein, 9 aa, Influenza virus
PEWSYIIEK

SEQ ID NO: 343716 - protein, 9 aa, Influenza virus
EWSYIIEKE

SEQ ID NO: 343717 - protein, 9 aa, Influenza virus
RSYNNTSGK

SEQ ID NO: 343718 - protein, 9 aa, Influenza virus
YNNTSGKQM

SEQ ID NO: 343719 - protein, 9 aa, Influenza virus
NNTSGKQML

SEQ ID NO: 343720 - protein, 9 aa, Influenza virus
SFESTGNLV

SEQ ID NO: 343721 - protein, 9 aa, Influenza virus
GFKISKRGN

SEQ ID NO: 343722 - protein, 9 aa, Influenza virus
FRISKRGSS

SEQ ID NO: 343723 - protein, 9 aa, Influenza virus
RISKRGSSG

SEQ ID NO: 343724 - protein, 9 aa, Influenza virus
ISKRGSSGV

SEQ ID NO: 343725 - protein, 9 aa, Influenza virus
SKRGNSGIM

SEQ ID NO: 343726 - protein, 9 aa, Influenza virus
KRGNSGIMK

SEQ ID NO: 343727 - protein, 9 aa, Influenza virus
RGSSGIVKT

SEQ ID NO: 343728 - protein, 9 aa, Influenza virus
CETKCQSPL

SEQ ID NO: 343729 - protein, 9 aa, Influenza virus
ETKCQSPLG

SEQ ID NO: 343730 - protein, 9 aa, Influenza virus
TKCQSPLGA

SEQ ID NO: 343731 - protein, 9 aa, Influenza virus
KCQTPLGAL

SEQ ID NO: 343732 - protein, 9 aa, Influenza virus
LILATGLRN

SEQ ID NO: 343733 - protein, 9 aa, Influenza virus
PQTESRGLF

SEQ ID NO: 343734 - protein, 9 aa, Influenza virus
QIEARGLFG

SEQ ID NO: 343735 - protein, 9 aa, Influenza virus
IEARGLFGA

SEQ ID NO: 343736 - protein, 9 aa, Influenza virus
NSIIEKMNT

SEQ ID NO: 343737 - protein, 9 aa, Influenza virus
VGKEFGNLE

SEQ ID NO: 343738 - protein, 9 aa, Influenza virus
RRLENLNKR

SEQ ID NO: 343739 - protein, 9 aa, Influenza virus
RLENLNKRM

SEQ ID NO: 343740 - protein, 9 aa, Influenza virus
LENLSKRME

SEQ ID NO: 343741 - protein, 9 aa, Influenza virus
ENLDKKMED

SEQ ID NO: 343742 - protein, 9 aa, Influenza virus
LNKRMEDGF

SEQ ID NO: 343743 - protein, 9 aa, Influenza virus
VWTYNTELL

SEQ ID NO: 343744 - protein, 9 aa, Influenza virus
MENERILDF

SEQ ID NO: 343745 - protein, 9 aa, Influenza virus
ENERTLGFH

SEQ ID NO: 343746 - protein, 9 aa, Influenza virus
NERILDFHD

SEQ ID NO: 343747 - protein, 9 aa, Influenza virus
ERILDFHDS

SEQ ID NO: 343748 - protein, 9 aa, Influenza virus
RTLDFHDSS

SEQ ID NO: 343749 - protein, 9 aa, Influenza virus
TLEFHDSNV

SEQ ID NO: 343750 - protein, 9 aa, Influenza virus
LGFHDSNVK

SEQ ID NO: 343751 - protein, 9 aa, Influenza virus
DYHDSNVKN

SEQ ID NO: 343752 - protein, 9 aa, Influenza virus
YHDSNVKNL

SEQ ID NO: 343753 - protein, 9 aa, Influenza virus
DSNVKNLYN

SEQ ID NO: 343754 - protein, 9 aa, Influenza virus
NLYEKVRMQ

SEQ ID NO: 343755 - protein, 9 aa, Influenza virus
LYDRVRMQL

SEQ ID NO: 343756 - protein, 9 aa, Influenza virus
YDRVRMQLR

SEQ ID NO: 343757 - protein, 9 aa, Influenza virus
EKVRMQLRD

SEQ ID NO: 343758 - protein, 9 aa, Influenza virus
KMQLRDNAK

SEQ ID NO: 343759 - protein, 9 aa, Influenza virus
QLRDNAKET

SEQ ID NO: 343760 - protein, 9 aa, Influenza virus
LKDNAKEVG

SEQ ID NO: 343761 - protein, 9 aa, Influenza virus
DNAKETGNG

SEQ ID NO: 343762 - protein, 9 aa, Influenza virus
NAKETGNGC

SEQ ID NO: 343763 - protein, 9 aa, Influenza virus
AKEVGNGCF

SEQ ID NO: 343764 - protein, 9 aa, Influenza virus
KETGNGCFE

SEQ ID NO: 343765 - protein, 9 aa, Influenza virus
ETGNGCFEF

SEQ ID NO: 343766 - protein, 9 aa, Influenza virus
TGNGCFEFY

SEQ ID NO: 343767 - protein, 9 aa, Influenza virus
HKCDDECMS

SEQ ID NO: 343768 - protein, 9 aa, Influenza virus
KCDDECMSS

SEQ ID NO: 343769 - protein, 9 aa, Influenza virus
SIRNGTYDY

SEQ ID NO: 343770 - protein, 9 aa, Influenza virus
NGTYYYPKY

SEQ ID NO: 343771 - protein, 9 aa, Influenza virus
GTYYYPKYE

SEQ ID NO: 343772 - protein, 9 aa, Influenza virus
TYYYPKYEE

SEQ ID NO: 343773 - protein, 9 aa, Influenza virus
YYYPKYEEE

SEQ ID NO: 343774 - protein, 9 aa, Influenza virus
YYPKYEEES

SEQ ID NO: 343775 - protein, 9 aa, Influenza virus
EEESRLNRN

SEQ ID NO: 343776 - protein, 9 aa, Influenza virus
EESRLNRNE

SEQ ID NO: 343777 - protein, 9 aa, Influenza virus
ESRLNRNEI

SEQ ID NO: 343778 - protein, 9 aa, Influenza virus
SRLNRNEIK

SEQ ID NO: 343779 - protein, 9 aa, Influenza virus
RLNRNEIKG

SEQ ID NO: 343780 - protein, 9 aa, Influenza virus
LAIMIAGIF

SEQ ID NO: 343781 - protein, 9 aa, Influenza virus
AGIFLWMCS

SEQ ID NO: 343782 - protein, 9 aa, Influenza virus
GIFLWMCSN

SEQ ID NO: 343783 - protein, 9 aa, Influenza virus
IFLWMCSNG

SEQ ID NO: 343784 - protein, 9 aa, Influenza virus
FLWMCSNGS

SEQ ID NO: 343785 - protein, 9 aa, Influenza virus
VKGDRICIG

SEQ ID NO: 343786 - protein, 9 aa, Influenza virus
KGDRICIGY

SEQ ID NO: 343787 - protein, 9 aa, Influenza virus
DRICIGYHA

SEQ ID NO: 343788 - protein, 9 aa, Influenza virus
RICIGYHAN

SEQ ID NO: 343789 - protein, 9 aa, Influenza virus
YHSNNSTKK

SEQ ID NO: 343790 - protein, 9 aa, Influenza virus
NNSTEMVDT

SEQ ID NO: 343791 - protein, 9 aa, Influenza virus
KIDTILERN

SEQ ID NO: 343792 - protein, 9 aa, Influenza virus
THAQDILER

SEQ ID NO: 343793 - protein, 9 aa, Influenza virus
HAQNILEKT

SEQ ID NO: 343794 - protein, 9 aa, Influenza virus
AQDILERTH

SEQ ID NO: 343795 - protein, 9 aa, Influenza virus
QNILEKTHN

SEQ ID NO: 343796 - protein, 9 aa, Influenza virus
KTHNGRLCK

SEQ ID NO: 343797 - protein, 9 aa, Influenza virus
NPECDRLLN

SEQ ID NO: 343798 - protein, 9 aa, Influenza virus
LNVPEWSYI

SEQ ID NO: 343799 - protein, 9 aa, Influenza virus
PEWSYIIEK

SEQ ID NO: 343800 - protein, 9 aa, Influenza virus
EWSYIIEKE

SEQ ID NO: 343801 - protein, 9 aa, Influenza virus
WSYIVEKEN

SEQ ID NO: 343802 - protein, 9 aa, Influenza virus
SYIVEKENP

SEQ ID NO: 343803 - protein, 9 aa, Influenza virus
SLCYPGNFN

SEQ ID NO: 343804 - protein, 9 aa, Influenza virus
LCYPGSLND

SEQ ID NO: 343805 - protein, 9 aa, Influenza virus
CYPGNFNDY

SEQ ID NO: 343806 - protein, 9 aa, Influenza virus
YPGNFNDYE

SEQ ID NO: 343807 - protein, 9 aa, Influenza virus
PGNFNDYEE

SEQ ID NO: 343808 - protein, 9 aa, Influenza virus
GNFNDYEEL

SEQ ID NO: 343809 - protein, 9 aa, Influenza virus
NFNDYEELK

SEQ ID NO: 343810 - protein, 9 aa, Influenza virus
FNDYEELKL

SEQ ID NO: 343811 - protein, 9 aa, Influenza virus
NDYEELKYL

SEQ ID NO: 343812 - protein, 9 aa, Influenza virus
VRHFEKVKI

SEQ ID NO: 343813 - protein, 9 aa, Influenza virus
RHFEKVKIL

SEQ ID NO: 343814 - protein, 9 aa, Influenza virus
HFEKVKILA

SEQ ID NO: 343815 - protein, 9 aa, Influenza virus
FEKVKILAR

SEQ ID NO: 343816 - protein, 9 aa, Influenza virus
EKVKILARN

SEQ ID NO: 343817 - protein, 9 aa, Influenza virus
VAQGSYNNT

SEQ ID NO: 343818 - protein, 9 aa, Influenza virus
AKGSYNNTN

SEQ ID NO: 343819 - protein, 9 aa, Influenza virus
RGSYNNTSG

SEQ ID NO: 343820 - protein, 9 aa, Influenza virus
NTSGKQMLI

SEQ ID NO: 343821 - protein, 9 aa, Influenza virus
TSGEQVLVI

SEQ ID NO: 343822 - protein, 9 aa, Influenza virus
SGKQMLIIW

SEQ ID NO: 343823 - protein, 9 aa, Influenza virus
GEQVLVIWG

SEQ ID NO: 343824 - protein, 9 aa, Influenza virus
IWGVHHPKD

SEQ ID NO: 343825 - protein, 9 aa, Influenza virus
WGVHHPKDE

SEQ ID NO: 343826 - protein, 9 aa, Influenza virus
LYQNVETYV

SEQ ID NO: 343827 - protein, 9 aa, Influenza virus
YQNVETYVS

SEQ ID NO: 343828 - protein, 9 aa, Influenza virus
RMEFSWILL

SEQ ID NO: 343829 - protein, 9 aa, Influenza virus
LDTINFEST

SEQ ID NO: 343830 - protein, 9 aa, Influenza virus
DTISFESTG

SEQ ID NO: 343831 - protein, 9 aa, Influenza virus
TISFESTGN

SEQ ID NO: 343832 - protein, 9 aa, Influenza virus
SFESTGNLV

SEQ ID NO: 343833 - protein, 9 aa, Influenza virus
GSSGVMKTE

SEQ ID NO: 343834 - protein, 9 aa, Influenza virus
SGVMKTEGT

SEQ ID NO: 343835 - protein, 9 aa, Influenza virus
GVMKTEGTL

SEQ ID NO: 343836 - protein, 9 aa, Influenza virus
NCDTKCQTP

SEQ ID NO: 343837 - protein, 9 aa, Influenza virus
CETQCQTPL

SEQ ID NO: 343838 - protein, 9 aa, Influenza virus
EIKCQTPLG

SEQ ID NO: 343839 - protein, 9 aa, Influenza virus
ECPRYVKSE

SEQ ID NO: 343840 - protein, 9 aa, Influenza virus
CPKYVRSEK

SEQ ID NO: 343841 - protein, 9 aa, Influenza virus
PKYVRSEKL

SEQ ID NO: 343842 - protein, 9 aa, Influenza virus
KYVRSEKLV

SEQ ID NO: 343843 - protein, 9 aa, Influenza virus
YVRSEKLVL

SEQ ID NO: 343844 - protein, 9 aa, Influenza virus
VRSEKLVLA

SEQ ID NO: 343845 - protein, 9 aa, Influenza virus
RSEKLVLAT

SEQ ID NO: 343846 - protein, 9 aa, Influenza virus
SDRLVLAIG

SEQ ID NO: 343847 - protein, 9 aa, Influenza virus
EKLVLATGP

SEQ ID NO: 343848 - protein, 9 aa, Influenza virus
VLATGLRNA

SEQ ID NO: 343849 - protein, 9 aa, Influenza virus
LATGLRNAH

SEQ ID NO: 343850 - protein, 9 aa, Influenza virus
ATGLRNAHK

SEQ ID NO: 343851 - protein, 9 aa, Influenza virus
TGLRNVPQM

SEQ ID NO: 343852 - protein, 9 aa, Influenza virus
GLRNVPQME

SEQ ID NO: 343853 - protein, 9 aa, Influenza virus
RNAHKMESR

SEQ ID NO: 343854 - protein, 9 aa, Influenza virus
NVPQIEPRG

SEQ ID NO: 343855 - protein, 9 aa, Influenza virus
VPQIEPRGL

SEQ ID NO: 343856 - protein, 9 aa, Influenza virus
HKMESRGLF

SEQ ID NO: 343857 - protein, 9 aa, Influenza virus
QIEARGLFG

SEQ ID NO: 343858 - protein, 9 aa, Influenza virus
DKESTQKAV

SEQ ID NO: 343859 - protein, 9 aa, Influenza virus
ENSVIEKMN

SEQ ID NO: 343860 - protein, 9 aa, Influenza virus
NSVIEKMNI

SEQ ID NO: 343861 - protein, 9 aa, Influenza virus
SVIEKMNIQ

SEQ ID NO: 343862 - protein, 9 aa, Influenza virus
IEKMNTQFG

SEQ ID NO: 343863 - protein, 9 aa, Influenza virus
AVEKEFSNL

SEQ ID NO: 343864 - protein, 9 aa, Influenza virus
VEKEFSNLE

SEQ ID NO: 343865 - protein, 9 aa, Influenza virus
KEFNNLEKR

SEQ ID NO: 343866 - protein, 9 aa, Influenza virus
EFNNLEKRL

SEQ ID NO: 343867 - protein, 9 aa, Influenza virus
FNNLEKRLE

SEQ ID NO: 343868 - protein, 9 aa, Influenza virus
NNLEKRLEN

SEQ ID NO: 343869 - protein, 9 aa, Influenza virus
LERRLENLS

SEQ ID NO: 343870 - protein, 9 aa, Influenza virus
EKRLGNLNK

SEQ ID NO: 343871 - protein, 9 aa, Influenza virus
RRLENLSKR

SEQ ID NO: 343872 - protein, 9 aa, Influenza virus
RLENLNKRM

SEQ ID NO: 343873 - protein, 9 aa, Influenza virus
LENLDKKME

SEQ ID NO: 343874 - protein, 9 aa, Influenza virus
GNLNKKMED

SEQ ID NO: 343875 - protein, 9 aa, Influenza virus
NLNKRMEDG

SEQ ID NO: 343876 - protein, 9 aa, Influenza virus
LNKRMEDGF

SEQ ID NO: 343877 - protein, 9 aa, Influenza virus
MEDGFLGVW

SEQ ID NO: 343878 - protein, 9 aa, Influenza virus
EDGFLGVWT

SEQ ID NO: 343879 - protein, 9 aa, Influenza virus
DGLLDVWTY

SEQ ID NO: 343880 - protein, 9 aa, Influenza virus
GFLGVWTYN

SEQ ID NO: 343881 - protein, 9 aa, Influenza virus
FLDVWTYNT

SEQ ID NO: 343882 - protein, 9 aa, Influenza virus
RDVWTYNAE

SEQ ID NO: 343883 - protein, 9 aa, Influenza virus
RTLGFHDSN

SEQ ID NO: 343884 - protein, 9 aa, Influenza virus
DFHDSSVKN

SEQ ID NO: 343885 - protein, 9 aa, Influenza virus
DSNVKNLYE

SEQ ID NO: 343886 - protein, 9 aa, Influenza virus
VKNLYEKVR

SEQ ID NO: 343887 - protein, 9 aa, Influenza virus
KNLYEKVRM

SEQ ID NO: 343888 - protein, 9 aa, Influenza virus
NLYEKVRMQ

SEQ ID NO: 343889 - protein, 9 aa, Influenza virus
YDKVRMQLK

SEQ ID NO: 343890 - protein, 9 aa, Influenza virus
DRVRMQLRD

SEQ ID NO: 343891 - protein, 9 aa, Influenza virus
KDNAKEIGN

SEQ ID NO: 343892 - protein, 9 aa, Influenza virus
CMSSVKNGT

SEQ ID NO: 343893 - protein, 9 aa, Influenza virus
MSSVKNGTY

SEQ ID NO: 343894 - protein, 9 aa, Influenza virus
SVRNGTYNY

SEQ ID NO: 343895 - protein, 9 aa, Influenza virus
RNGTYNYPK

SEQ ID NO: 343896 - protein, 9 aa, Influenza virus
NGTYDYSKY

SEQ ID NO: 343897 - protein, 9 aa, Influenza virus
TYDYPKYEK

SEQ ID NO: 343898 - protein, 9 aa, Influenza virus
YNYPKYEEE

SEQ ID NO: 343899 - protein, 9 aa, Influenza virus
DYPKYEKES

SEQ ID NO: 343900 - protein, 9 aa, Influenza virus
YEEESKLNK

SEQ ID NO: 343901 - protein, 9 aa, Influenza virus
EKESKLNRN

SEQ ID NO: 343902 - protein, 9 aa, Influenza virus
EESKLNKNE

SEQ ID NO: 343903 - protein, 9 aa, Influenza virus
NKNEIKGVK

SEQ ID NO: 343904 - protein, 9 aa, Influenza virus
GVKLSSMGI

SEQ ID NO: 343905 - protein, 9 aa, Influenza virus
VKLSSMGIY

SEQ ID NO: 343906 - protein, 9 aa, Influenza virus
KLSSMGIYQ

SEQ ID NO: 343907 - protein, 9 aa, Influenza virus
LSSMGIYQI

SEQ ID NO: 343908 - protein, 9 aa, Influenza virus
SSMGIYQIL

SEQ ID NO: 343909 - protein, 9 aa, Influenza virus
SMGIYQILA

SEQ ID NO: 343910 - protein, 9 aa, Influenza virus
LAIMIAGIF

SEQ ID NO: 343911 - protein, 9 aa, Influenza virus
AGIFFWMCS

SEQ ID NO: 343912 - protein, 9 aa, Influenza virus
GIFFWMCSN

SEQ ID NO: 343913 - protein, 9 aa, Influenza virus
IFFWMCSNG

SEQ ID NO: 343914 - protein, 9 aa, Influenza virus
FFWMCSNGS

SEQ ID NO: 343915 - protein, 9 aa, Influenza virus
PNQKIITMG

SEQ ID NO: 343916 - protein, 9 aa, Influenza virus
NQKIITIDS

SEQ ID NO: 343917 - protein, 9 aa, Influenza virus
QKIITIDSV

SEQ ID NO: 343918 - protein, 9 aa, Influenza virus
KIITMGSVS

SEQ ID NO: 343919 - protein, 9 aa, Influenza virus
IITIDSVSL

SEQ ID NO: 343920 - protein, 9 aa, Influenza virus
ITIDSVSLT

SEQ ID NO: 343921 - protein, 9 aa, Influenza virus
QIAILATTI

SEQ ID NO: 343922 - protein, 9 aa, Influenza virus
IAILAATVT

SEQ ID NO: 343923 - protein, 9 aa, Influenza virus
AILATTITL

SEQ ID NO: 343924 - protein, 9 aa, Influenza virus
ILATTITLH

SEQ ID NO: 343925 - protein, 9 aa, Influenza virus
LAATVTLHF

SEQ ID NO: 343926 - protein, 9 aa, Influenza virus
ATTITLHFK

SEQ ID NO: 343927 - protein, 9 aa, Influenza virus
VTLHFKQHD

SEQ ID NO: 343928 - protein, 9 aa, Influenza virus
TLHFKQHKC

SEQ ID NO: 343929 - protein, 9 aa, Influenza virus
LHFKQHDCD

SEQ ID NO: 343930 - protein, 9 aa, Influenza virus
PCEPTIIER

SEQ ID NO: 343931 - protein, 9 aa, Influenza virus
CEPTIIERN

SEQ ID NO: 343932 - protein, 9 aa, Influenza virus
TEIMYLNNT

SEQ ID NO: 343933 - protein, 9 aa, Influenza virus
EIVYLNNTI

SEQ ID NO: 343934 - protein, 9 aa, Influenza virus
WSKPQCQIA

SEQ ID NO: 343935 - protein, 9 aa, Influenza virus
SKTQCQITG

SEQ ID NO: 343936 - protein, 9 aa, Influenza virus
KPQCHITGF

SEQ ID NO: 343937 - protein, 9 aa, Influenza virus
PQCHITGFA

SEQ ID NO: 343938 - protein, 9 aa, Influenza virus
LSASGDIWV

SEQ ID NO: 343939 - protein, 9 aa, Influenza virus
SADGDIWVT

SEQ ID NO: 343940 - protein, 9 aa, Influenza virus
ASGDIWVTR

SEQ ID NO: 343941 - protein, 9 aa, Influenza virus
GGDIWVMRE

SEQ ID NO: 343942 - protein, 9 aa, Influenza virus
REPYVSCDS

SEQ ID NO: 343943 - protein, 9 aa, Influenza virus
NKCYQFALG

SEQ ID NO: 343944 - protein, 9 aa, Influenza virus
TLENKHSNG

SEQ ID NO: 343945 - protein, 9 aa, Influenza virus
LENKHSNGT

SEQ ID NO: 343946 - protein, 9 aa, Influenza virus
NNKHSNGTI

SEQ ID NO: 343947 - protein, 9 aa, Influenza virus
NKHSNGTKH

SEQ ID NO: 343948 - protein, 9 aa, Influenza virus
KHSNGTKHD

SEQ ID NO: 343949 - protein, 9 aa, Influenza virus
HSNGTKHDR

SEQ ID NO: 343950 - protein, 9 aa, Influenza virus
TKHDRIPHR

SEQ ID NO: 343951 - protein, 9 aa, Influenza virus
IHDRSPHRT

SEQ ID NO: 343952 - protein, 9 aa, Influenza virus
HLGTRQVCV

SEQ ID NO: 343953 - protein, 9 aa, Influenza virus
LGTRQVCVA

SEQ ID NO: 343954 - protein, 9 aa, Influenza virus
GTRQVCVAW

SEQ ID NO: 343955 - protein, 9 aa, Influenza virus
TRQVCVAWS

SEQ ID NO: 343956 - protein, 9 aa, Influenza virus
RQVCVAWSS

SEQ ID NO: 343957 - protein, 9 aa, Influenza virus
GKAWLHICV

SEQ ID NO: 343958 - protein, 9 aa, Influenza virus
KAWLHICVT

SEQ ID NO: 343959 - protein, 9 aa, Influenza virus
CITGDDRNA

SEQ ID NO: 343960 - protein, 9 aa, Influenza virus
ITGDDRNAT

SEQ ID NO: 343961 - protein, 9 aa, Influenza virus
DDENATASF

SEQ ID NO: 343962 - protein, 9 aa, Influenza virus
EKNATASFI

SEQ ID NO: 343963 - protein, 9 aa, Influenza virus
RNATASFVY

SEQ ID NO: 343964 - protein, 9 aa, Influenza virus
NATASFVYD

SEQ ID NO: 343965 - protein, 9 aa, Influenza virus
ATASFIYEG

SEQ ID NO: 343966 - protein, 9 aa, Influenza virus
DSIGSWSHN

SEQ ID NO: 343967 - protein, 9 aa, Influenza virus
SIGSWSHNI

SEQ ID NO: 343968 - protein, 9 aa, Influenza virus
VGSWSQNIL

SEQ ID NO: 343969 - protein, 9 aa, Influenza virus
SECVCISGT

SEQ ID NO: 343970 - protein, 9 aa, Influenza virus
ECVCISGTC

SEQ ID NO: 343971 - protein, 9 aa, Influenza virus
CVCISGTCA

SEQ ID NO: 343972 - protein, 9 aa, Influenza virus
VCISGTCAV

SEQ ID NO: 343973 - protein, 9 aa, Influenza virus
CISGTCAVV

SEQ ID NO: 343974 - protein, 9 aa, Influenza virus
ISGTCAVVM

SEQ ID NO: 343975 - protein, 9 aa, Influenza virus
SGTCAVVMT

SEQ ID NO: 343976 - protein, 9 aa, Influenza virus
GTCAVVMTD

SEQ ID NO: 343977 - protein, 9 aa, Influenza virus
TCAVVMTDG

SEQ ID NO: 343978 - protein, 9 aa, Influenza virus
RADTKILFI

SEQ ID NO: 343979 - protein, 9 aa, Influenza virus
ADTRILFIR

SEQ ID NO: 343980 - protein, 9 aa, Influenza virus
DTKILFIEE

SEQ ID NO: 343981 - protein, 9 aa, Influenza virus
TRILFIREG

SEQ ID NO: 343982 - protein, 9 aa, Influenza virus
KILFIEEGK

SEQ ID NO: 343983 - protein, 9 aa, Influenza virus
ILFIREGKI

SEQ ID NO: 343984 - protein, 9 aa, Influenza virus
EGKVVHISP

SEQ ID NO: 343985 - protein, 9 aa, Influenza virus
GKIVHVSPL

SEQ ID NO: 343986 - protein, 9 aa, Influenza virus
VHVSPLSGS

SEQ ID NO: 343987 - protein, 9 aa, Influenza virus
HVSPLSGSA

SEQ ID NO: 343988 - protein, 9 aa, Influenza virus
ISPLAGSAQ

SEQ ID NO: 343989 - protein, 9 aa, Influenza virus
CSCYSRYPN

SEQ ID NO: 343990 - protein, 9 aa, Influenza virus
SCYPQYPDV

SEQ ID NO: 343991 - protein, 9 aa, Influenza virus
CYSRYPNVR

SEQ ID NO: 343992 - protein, 9 aa, Influenza virus
YPQYPDVRC

SEQ ID NO: 343993 - protein, 9 aa, Influenza virus
RYPDVRCVC

SEQ ID NO: 343994 - protein, 9 aa, Influenza virus
YPDVRCVCR

SEQ ID NO: 343995 - protein, 9 aa, Influenza virus
PDVRCVCRD

SEQ ID NO: 343996 - protein, 9 aa, Influenza virus
DVRCVCRDN

SEQ ID NO: 343997 - protein, 9 aa, Influenza virus
RCTCRDNWK

SEQ ID NO: 343998 - protein, 9 aa, Influenza virus
CTCRDNWKG

SEQ ID NO: 343999 - protein, 9 aa, Influenza virus
TCRDNWKGS

SEQ ID NO: 344000 - protein, 9 aa, Influenza virus
GSNRPVLDI

SEQ ID NO: 344001 - protein, 9 aa, Influenza virus
SNRPVLDIS

SEQ ID NO: 344002 - protein, 9 aa, Influenza virus
DINIAEYSI

SEQ ID NO: 344003 - protein, 9 aa, Influenza virus
INIAEYSID

SEQ ID NO: 344004 - protein, 9 aa, Influenza virus
NIAEYSIDS

SEQ ID NO: 344005 - protein, 9 aa, Influenza virus
DYSIDSNYV

SEQ ID NO: 344006 - protein, 9 aa, Influenza virus
YSIDSGYVC

SEQ ID NO: 344007 - protein, 9 aa, Influenza virus
SIDSGYVCS

SEQ ID NO: 344008 - protein, 9 aa, Influenza virus
IDSNYVCSG

SEQ ID NO: 344009 - protein, 9 aa, Influenza virus
DSGYVCSGL

SEQ ID NO: 344010 - protein, 9 aa, Influenza virus
SGYVCSGLV

SEQ ID NO: 344011 - protein, 9 aa, Influenza virus
GYVCSGLVG

SEQ ID NO: 344012 - protein, 9 aa, Influenza virus
GDTPRSDDS

SEQ ID NO: 344013 - protein, 9 aa, Influenza virus
DTPRNDDRF

SEQ ID NO: 344014 - protein, 9 aa, Influenza virus
TPRNDDRFS

SEQ ID NO: 344015 - protein, 9 aa, Influenza virus
SNSNCKDPN

SEQ ID NO: 344016 - protein, 9 aa, Influenza virus
NSNCKDPNN

SEQ ID NO: 344017 - protein, 9 aa, Influenza virus
NCKDPNNER

SEQ ID NO: 344018 - protein, 9 aa, Influenza virus
CKDPNNERG

SEQ ID NO: 344019 - protein, 9 aa, Influenza virus
PNNERGTQG

SEQ ID NO: 344020 - protein, 9 aa, Influenza virus
NNERGTQGV

SEQ ID NO: 344021 - protein, 9 aa, Influenza virus
NERGTQGVK

SEQ ID NO: 344022 - protein, 9 aa, Influenza virus
ERGTQGVKG

SEQ ID NO: 344023 - protein, 9 aa, Influenza virus
RGTQGVKGW

SEQ ID NO: 344024 - protein, 9 aa, Influenza virus
GYPGVKGWA

SEQ ID NO: 344025 - protein, 9 aa, Influenza virus
NHGVKGWAF

SEQ ID NO: 344026 - protein, 9 aa, Influenza virus
GVKGWAFDY

SEQ ID NO: 344027 - protein, 9 aa, Influenza virus
VKGWAFDYG

SEQ ID NO: 344028 - protein, 9 aa, Influenza virus
GNDLWMGRT

SEQ ID NO: 344029 - protein, 9 aa, Influenza virus
NDLWMGRTI

SEQ ID NO: 344030 - protein, 9 aa, Influenza virus
DVWMGRTIG

SEQ ID NO: 344031 - protein, 9 aa, Influenza virus
KESRSGYET

SEQ ID NO: 344032 - protein, 9 aa, Influenza virus
TFRVIGGWT

SEQ ID NO: 344033 - protein, 9 aa, Influenza virus
FRVIGGWTT

SEQ ID NO: 344034 - protein, 9 aa, Influenza virus
SNNRSGYSG

SEQ ID NO: 344035 - protein, 9 aa, Influenza virus
KSCVNRCFY

SEQ ID NO: 344036 - protein, 9 aa, Influenza virus
SCVNRCFYV

SEQ ID NO: 344037 - protein, 9 aa, Influenza virus
YVELIRGRS

SEQ ID NO: 344038 - protein, 9 aa, Influenza virus
VELIRGRSQ

SEQ ID NO: 344039 - protein, 9 aa, Influenza virus
ELIRGRSQE

SEQ ID NO: 344040 - protein, 9 aa, Influenza virus
SQETRVWWT

SEQ ID NO: 344041 - protein, 9 aa, Influenza virus
SWPDGANIS

SEQ ID NO: 344042 - protein, 9 aa, Influenza virus
WPDGANIDF

SEQ ID NO: 344043 - protein, 9 aa, Influenza virus
PDGANIDFM

SEQ ID NO: 344044 - protein, 9 aa, Influenza virus
DGANIDFMP

SEQ ID NO: 344045 - protein, 9 aa, Influenza virus
GANISFMPI

SEQ ID NO: 344046 - protein, 9 aa, Influenza virus
TAMLCLGHH

SEQ ID NO: 344047 - protein, 9 aa, Influenza virus
LCLGHHAVS

SEQ ID NO: 344048 - protein, 9 aa, Influenza virus
CLGHHAVSN

SEQ ID NO: 344049 - protein, 9 aa, Influenza virus
LGHHAVSNG

SEQ ID NO: 344050 - protein, 9 aa, Influenza virus
DRIEVTNAT

SEQ ID NO: 344051 - protein, 9 aa, Influenza virus
TNATELVQG

SEQ ID NO: 344052 - protein, 9 aa, Influenza virus
CTLVDALLG

SEQ ID NO: 344053 - protein, 9 aa, Influenza virus
TLVDALLGD

SEQ ID NO: 344054 - protein, 9 aa, Influenza virus
LVDALLGDP

SEQ ID NO: 344055 - protein, 9 aa, Influenza virus
SLLGDPHCD

SEQ ID NO: 344056 - protein, 9 aa, Influenza virus
TLRSLVASS

SEQ ID NO: 344057 - protein, 9 aa, Influenza virus
RSLVASSGN

SEQ ID NO: 344058 - protein, 9 aa, Influenza virus
SIVASSGTV

SEQ ID NO: 344059 - protein, 9 aa, Influenza virus
IVASSGTVE

SEQ ID NO: 344060 - protein, 9 aa, Influenza virus
VASSGNLEF

SEQ ID NO: 344061 - protein, 9 aa, Influenza virus
SFFSKLNWL

SEQ ID NO: 344062 - protein, 9 aa, Influenza virus
FFRRLNWLT

SEQ ID NO: 344063 - protein, 9 aa, Influenza virus
SDKLYIWGV

SEQ ID NO: 344064 - protein, 9 aa, Influenza virus
DKLYVWGIH

SEQ ID NO: 344065 - protein, 9 aa, Influenza virus
HWTIVKPGD

SEQ ID NO: 344066 - protein, 9 aa, Influenza virus
CTGNLIAPR

SEQ ID NO: 344067 - protein, 9 aa, Influenza virus
FECITPNGS

SEQ ID NO: 344068 - protein, 9 aa, Influenza virus
TPNGSIPNN

SEQ ID NO: 344069 - protein, 9 aa, Influenza virus
GSIPNNKPF

SEQ ID NO: 344070 - protein, 9 aa, Influenza virus
SIPNNKPFQ

SEQ ID NO: 344071 - protein, 9 aa, Influenza virus
IPNNKPFQN

SEQ ID NO: 344072 - protein, 9 aa, Influenza virus
NGKPFQNVN

SEQ ID NO: 344073 - protein, 9 aa, Influenza virus
TGMRNVPET

SEQ ID NO: 344074 - protein, 9 aa, Influenza virus
GMRNVPETQ

SEQ ID NO: 344075 - protein, 9 aa, Influenza virus
TKGLFGAIA

SEQ ID NO: 344076 - protein, 9 aa, Influenza virus
ENGWEGMVN

SEQ ID NO: 344077 - protein, 9 aa, Influenza virus
NGWEGMVNG

SEQ ID NO: 344078 - protein, 9 aa, Influenza virus
GWEGMVNGW

SEQ ID NO: 344079 - protein, 9 aa, Influenza virus
WEGMVNGWY

SEQ ID NO: 344080 - protein, 9 aa, Influenza virus
EGMVNGWYG

SEQ ID NO: 344081 - protein, 9 aa, Influenza virus
GMVNGWYGF

SEQ ID NO: 344082 - protein, 9 aa, Influenza virus
MVNGWYGFR

SEQ ID NO: 344083 - protein, 9 aa, Influenza virus
VDGWYGFRY

SEQ ID NO: 344084 - protein, 9 aa, Influenza virus
DGWYGFRHH

SEQ ID NO: 344085 - protein, 9 aa, Influenza virus
WYGFRHLNS

SEQ ID NO: 344086 - protein, 9 aa, Influenza virus
YGFRHHNSE

SEQ ID NO: 344087 - protein, 9 aa, Influenza virus
GFRHLNSEG

SEQ ID NO: 344088 - protein, 9 aa, Influenza virus
NSEGMGQAA

SEQ ID NO: 344089 - protein, 9 aa, Influenza virus
SEGMGQAAD

SEQ ID NO: 344090 - protein, 9 aa, Influenza virus
EGMGQAADL

SEQ ID NO: 344091 - protein, 9 aa, Influenza virus
GMGQAADLK

SEQ ID NO: 344092 - protein, 9 aa, Influenza virus
MGQAADLKS

SEQ ID NO: 344093 - protein, 9 aa, Influenza virus
LKSTQAAVN

SEQ ID NO: 344094 - protein, 9 aa, Influenza virus
KSTQAAVNQ

SEQ ID NO: 344095 - protein, 9 aa, Influenza virus
STQAAIDQV

SEQ ID NO: 344096 - protein, 9 aa, Influenza virus
IKKTNEKFH

SEQ ID NO: 344097 - protein, 9 aa, Influenza virus
KKTNEKFHQ

SEQ ID NO: 344098 - protein, 9 aa, Influenza virus
YNAEFLVAL

SEQ ID NO: 344099 - protein, 9 aa, Influenza virus
NAEFLVALE

SEQ ID NO: 344100 - protein, 9 aa, Influenza virus
AEFLVALEN

SEQ ID NO: 344101 - protein, 9 aa, Influenza virus
EFLVALENQ

SEQ ID NO: 344102 - protein, 9 aa, Influenza virus
FLVALENQH

SEQ ID NO: 344103 - protein, 9 aa, Influenza virus
QHTIDLADS

SEQ ID NO: 344104 - protein, 9 aa, Influenza virus
HTIDLADSE

SEQ ID NO: 344105 - protein, 9 aa, Influenza virus
TIDLADSEM

SEQ ID NO: 344106 - protein, 9 aa, Influenza virus
IHLTDSEMN

SEQ ID NO: 344107 - protein, 9 aa, Influenza virus
HLTDSEMNK

SEQ ID NO: 344108 - protein, 9 aa, Influenza virus
LADSEMNKL

SEQ ID NO: 344109 - protein, 9 aa, Influenza virus
ADSEMNKLF

SEQ ID NO: 344110 - protein, 9 aa, Influenza virus
EMSKLFERT

SEQ ID NO: 344111 - protein, 9 aa, Influenza virus
KRQLRENAE

SEQ ID NO: 344112 - protein, 9 aa, Influenza virus
RENAEDIGN

SEQ ID NO: 344113 - protein, 9 aa, Influenza virus
ENAEDIGNG

SEQ ID NO: 344114 - protein, 9 aa, Influenza virus
NAEDIGNGC

SEQ ID NO: 344115 - protein, 9 aa, Influenza virus
AEDMGDGCF

SEQ ID NO: 344116 - protein, 9 aa, Influenza virus
GDGCFKIYH

SEQ ID NO: 344117 - protein, 9 aa, Influenza virus
GCFKIYHRC

SEQ ID NO: 344118 - protein, 9 aa, Influenza virus
CFKIYHRCD

SEQ ID NO: 344119 - protein, 9 aa, Influenza virus
FRIYHKCDN

SEQ ID NO: 344120 - protein, 9 aa, Influenza virus
IYHKCDNVC

SEQ ID NO: 344121 - protein, 9 aa, Influenza virus
SIRNETYDH

SEQ ID NO: 344122 - protein, 9 aa, Influenza virus
YRDEALSNR

SEQ ID NO: 344123 - protein, 9 aa, Influenza virus
GYKNWILWI

SEQ ID NO: 344124 - protein, 9 aa, Influenza virus
WILWISFAM

SEQ ID NO: 344125 - protein, 9 aa, Influenza virus
ILWISFAMS

SEQ ID NO: 344126 - protein, 9 aa, Influenza virus
SFAMSCFLL

SEQ ID NO: 344127 - protein, 9 aa, Influenza virus
FAMSCFLLC

SEQ ID NO: 344128 - protein, 9 aa, Influenza virus
LGFVMWACQ

SEQ ID NO: 344129 - protein, 9 aa, Influenza virus
GFIMWTCQK

SEQ ID NO: 344130 - protein, 9 aa, Influenza virus
FIMWTCQKG

SEQ ID NO: 344131 - protein, 9 aa, Influenza virus
IMWTCQKGN

SEQ ID NO: 344132 - protein, 9 aa, Influenza virus
CQKGNIRCD

SEQ ID NO: 344133 - protein, 9 aa, Influenza virus
QKGNIRCDI

SEQ ID NO: 344134 - protein, 9 aa, Influenza virus
KGNIRCDIC

SEQ ID NO: 344135 - protein, 9 aa, Influenza virus
AVPNGTIVR

SEQ ID NO: 344136 - protein, 9 aa, Influenza virus
VPNGTIVRT

SEQ ID NO: 344137 - protein, 9 aa, Influenza virus
PNGTIVRTI

SEQ ID NO: 344138 - protein, 9 aa, Influenza virus
NGTIVRTIT

SEQ ID NO: 344139 - protein, 9 aa, Influenza virus
VDALLGDPH

SEQ ID NO: 344140 - protein, 9 aa, Influenza virus
CYPYDVPEY

SEQ ID NO: 344141 - protein, 9 aa, Influenza virus
TLRSLVASS

SEQ ID NO: 344142 - protein, 9 aa, Influenza virus
LVASSGNLE

SEQ ID NO: 344143 - protein, 9 aa, Influenza virus
FFRRLNWLT

SEQ ID NO: 344144 - protein, 9 aa, Influenza virus
FDKLYIWGI

SEQ ID NO: 344145 - protein, 9 aa, Influenza virus
SVYWTIVKP

SEQ ID NO: 344146 - protein, 9 aa, Influenza virus
IYWTVVKPG

SEQ ID NO: 344147 - protein, 9 aa, Influenza virus
IAPRGYYKM

SEQ ID NO: 344148 - protein, 9 aa, Influenza virus
FECITPNGS

SEQ ID NO: 344149 - protein, 9 aa, Influenza virus
TPNGSIPNG

SEQ ID NO: 344150 - protein, 9 aa, Influenza virus
PNGSIPNGK

SEQ ID NO: 344151 - protein, 9 aa, Influenza virus
NGSIPNNKP

SEQ ID NO: 344152 - protein, 9 aa, Influenza virus
GSIPNNKPF

SEQ ID NO: 344153 - protein, 9 aa, Influenza virus
SIPNGKPFQ

SEQ ID NO: 344154 - protein, 9 aa, Influenza virus
IPNNKPFQN

SEQ ID NO: 344155 - protein, 9 aa, Influenza virus
PNNKPFQNV

SEQ ID NO: 344156 - protein, 9 aa, Influenza virus
NNKPFQNVN

SEQ ID NO: 344157 - protein, 9 aa, Influenza virus
GKPFQNVNR

SEQ ID NO: 344158 - protein, 9 aa, Influenza virus
NVNRITYGV

SEQ ID NO: 344159 - protein, 9 aa, Influenza virus
VNRITYGVC

SEQ ID NO: 344160 - protein, 9 aa, Influenza virus
NRITYGVCP

SEQ ID NO: 344161 - protein, 9 aa, Influenza virus
ITYGVCPRY

SEQ ID NO: 344162 - protein, 9 aa, Influenza virus
TYGACPKYI

SEQ ID NO: 344163 - protein, 9 aa, Influenza virus
YVKQKTLKL

SEQ ID NO: 344164 - protein, 9 aa, Influenza virus
VKQKTLKLA

SEQ ID NO: 344165 - protein, 9 aa, Influenza virus
TGMRNVPER

SEQ ID NO: 344166 - protein, 9 aa, Influenza virus
GMRNIPEKQ

SEQ ID NO: 344167 - protein, 9 aa, Influenza virus
MRNIPEKQT

SEQ ID NO: 344168 - protein, 9 aa, Influenza virus
RNIPEKQTR

SEQ ID NO: 344169 - protein, 9 aa, Influenza virus
NIPEKQTRG

SEQ ID NO: 344170 - protein, 9 aa, Influenza virus
PERQTRGIF

SEQ ID NO: 344171 - protein, 9 aa, Influenza virus
ERQTRGIFG

SEQ ID NO: 344172 - protein, 9 aa, Influenza virus
RQTRGIFGA

SEQ ID NO: 344173 - protein, 9 aa, Influenza virus
ENGWEGMVN

SEQ ID NO: 344174 - protein, 9 aa, Influenza virus
NGWEGMVNG

SEQ ID NO: 344175 - protein, 9 aa, Influenza virus
GWEGMVNGW

SEQ ID NO: 344176 - protein, 9 aa, Influenza virus
WEGMVNGWY

SEQ ID NO: 344177 - protein, 9 aa, Influenza virus
EGMVNGWYG

SEQ ID NO: 344178 - protein, 9 aa, Influenza virus
GMVNGWYGF

SEQ ID NO: 344179 - protein, 9 aa, Influenza virus
MVNGWYGFR

SEQ ID NO: 344180 - protein, 9 aa, Influenza virus
VNGWYGFRH

SEQ ID NO: 344181 - protein, 9 aa, Influenza virus
RHHNSEGTG

SEQ ID NO: 344182 - protein, 9 aa, Influenza virus
HHNSEGTGQ

SEQ ID NO: 344183 - protein, 9 aa, Influenza virus
FKSTQAAIN

SEQ ID NO: 344184 - protein, 9 aa, Influenza virus
STQAAVNQI

SEQ ID NO: 344185 - protein, 9 aa, Influenza virus
VEKTNEKFH

SEQ ID NO: 344186 - protein, 9 aa, Influenza virus
YNAEILVAL

SEQ ID NO: 344187 - protein, 9 aa, Influenza virus
NAEILVALE

SEQ ID NO: 344188 - protein, 9 aa, Influenza virus
AEILVALEN

SEQ ID NO: 344189 - protein, 9 aa, Influenza virus
EILVALENQ

SEQ ID NO: 344190 - protein, 9 aa, Influenza virus
ILVALENQH

SEQ ID NO: 344191 - protein, 9 aa, Influenza virus
DLADSEMNK

SEQ ID NO: 344192 - protein, 9 aa, Influenza virus
SEMSKLFEK

SEQ ID NO: 344193 - protein, 9 aa, Influenza virus
EMSKLFEKT

SEQ ID NO: 344194 - protein, 9 aa, Influenza virus
EDMGNGCFR

SEQ ID NO: 344195 - protein, 9 aa, Influenza virus
DMGNGCFRI

SEQ ID NO: 344196 - protein, 9 aa, Influenza virus
MGNGCFRIY

SEQ ID NO: 344197 - protein, 9 aa, Influenza virus
CFKIYHKCN

SEQ ID NO: 344198 - protein, 9 aa, Influenza virus
FKIYHKCNN

SEQ ID NO: 344199 - protein, 9 aa, Influenza virus
IYHKCDNVC

SEQ ID NO: 344200 - protein, 9 aa, Influenza virus
CMESIRNGT

SEQ ID NO: 344201 - protein, 9 aa, Influenza virus
MESIRNGTY

SEQ ID NO: 344202 - protein, 9 aa, Influenza virus
GSIRNGTYN

SEQ ID NO: 344203 - protein, 9 aa, Influenza virus
IRNETYDHD

SEQ ID NO: 344204 - protein, 9 aa, Influenza virus
RDEALNNRS

SEQ ID NO: 344205 - protein, 9 aa, Influenza virus
DEALNNRSQ

SEQ ID NO: 344206 - protein, 9 aa, Influenza virus
EALSNRFQI

SEQ ID NO: 344207 - protein, 9 aa, Influenza virus
ALSNRFQIK

SEQ ID NO: 344208 - protein, 9 aa, Influenza virus
GYKDWFLWI

SEQ ID NO: 344209 - protein, 9 aa, Influenza virus
WILWISFAM

SEQ ID NO: 344210 - protein, 9 aa, Influenza virus
ILWISFAMS

SEQ ID NO: 344211 - protein, 9 aa, Influenza virus
GFIVWACQR

SEQ ID NO: 344212 - protein, 9 aa, Influenza virus
FIVWACQRG

SEQ ID NO: 344213 - protein, 9 aa, Influenza virus
IVWACQRGN

SEQ ID NO: 344214 - protein, 9 aa, Influenza virus
CQKGNIRCD

SEQ ID NO: 344215 - protein, 9 aa, Influenza virus
QKGNIRCDI

SEQ ID NO: 344216 - protein, 9 aa, Influenza virus
KGNIRCDIC

SEQ ID NO: 344217 - protein, 9 aa, Influenza virus
MNPIKKIIT

SEQ ID NO: 344218 - protein, 9 aa, Influenza virus
YRSWSKPQC

SEQ ID NO: 344219 - protein, 9 aa, Influenza virus
DIWVTRVPY

SEQ ID NO: 344220 - protein, 9 aa, Influenza virus
TRELYVSCD

SEQ ID NO: 344221 - protein, 9 aa, Influenza virus
NKCYQFALG

SEQ ID NO: 344222 - protein, 9 aa, Influenza virus
HLGTKQVCM

SEQ ID NO: 344223 - protein, 9 aa, Influenza virus
NNATASFIY

SEQ ID NO: 344224 - protein, 9 aa, Influenza virus
NATASFVYD

SEQ ID NO: 344225 - protein, 9 aa, Influenza virus
ATASFVYDG

SEQ ID NO: 344226 - protein, 9 aa, Influenza virus
DILRTQESE

SEQ ID NO: 344227 - protein, 9 aa, Influenza virus
CVCISGTCA

SEQ ID NO: 344228 - protein, 9 aa, Influenza virus
VCISGTCAV

SEQ ID NO: 344229 - protein, 9 aa, Influenza virus
CINGTCTVI

SEQ ID NO: 344230 - protein, 9 aa, Influenza virus
INGTCTVIM

SEQ ID NO: 344231 - protein, 9 aa, Influenza virus
NGTCTVIMT

SEQ ID NO: 344232 - protein, 9 aa, Influenza virus
VMTDGNASG

SEQ ID NO: 344233 - protein, 9 aa, Influenza virus
LSGNAQHVE

SEQ ID NO: 344234 - protein, 9 aa, Influenza virus
SGNAQHVEE

SEQ ID NO: 344235 - protein, 9 aa, Influenza virus
CSCYPRFPG

SEQ ID NO: 344236 - protein, 9 aa, Influenza virus
WKGSNRPII

SEQ ID NO: 344237 - protein, 9 aa, Influenza virus
KGSNRPIID

SEQ ID NO: 344238 - protein, 9 aa, Influenza virus
GSNRPIIDI

SEQ ID NO: 344239 - protein, 9 aa, Influenza virus
SNRPIIDIN

SEQ ID NO: 344240 - protein, 9 aa, Influenza virus
SSYLCSGLV

SEQ ID NO: 344241 - protein, 9 aa, Influenza virus
SYLCSGLVG

SEQ ID NO: 344242 - protein, 9 aa, Influenza virus
VKGWAFDYG

SEQ ID NO: 344243 - protein, 9 aa, Influenza virus
GNDIWMGRT

SEQ ID NO: 344244 - protein, 9 aa, Influenza virus
NDLWMGRTI

SEQ ID NO: 344245 - protein, 9 aa, Influenza virus
DIWMGRTIS

SEQ ID NO: 344246 - protein, 9 aa, Influenza virus
LGYETFKVV

SEQ ID NO: 344247 - protein, 9 aa, Influenza virus
RSGYSGVFS

SEQ ID NO: 344248 - protein, 9 aa, Influenza virus
YSGVFSVEG

SEQ ID NO: 344249 - protein, 9 aa, Influenza virus
SGVFSVEGK

SEQ ID NO: 344250 - protein, 9 aa, Influenza virus
KVWWTSNSI

SEQ ID NO: 344251 - protein, 9 aa, Influenza virus
TGSWPDGAE

SEQ ID NO: 344252 - protein, 9 aa, Influenza virus
GSWPDGAEI

SEQ ID NO: 344253 - protein, 9 aa, Influenza virus
YTGNLVICL

SEQ ID NO: 344254 - protein, 9 aa, Influenza virus
GHHSVPNGT

SEQ ID NO: 344255 - protein, 9 aa, Influenza virus
VANGTIVKT

SEQ ID NO: 344256 - protein, 9 aa, Influenza virus
GTVVKTLTD

SEQ ID NO: 344257 - protein, 9 aa, Influenza virus
VEVVAAQEL

SEQ ID NO: 344258 - protein, 9 aa, Influenza virus
ITAQELVES

SEQ ID NO: 344259 - protein, 9 aa, Influenza virus
TAQELVESK

SEQ ID NO: 344260 - protein, 9 aa, Influenza virus
ELCSSPLRL

SEQ ID NO: 344261 - protein, 9 aa, Influenza virus
LCPSPLKLV

SEQ ID NO: 344262 - protein, 9 aa, Influenza virus
CPSPLKLVD

SEQ ID NO: 344263 - protein, 9 aa, Influenza virus
SPLKLVDGQ

SEQ ID NO: 344264 - protein, 9 aa, Influenza virus
CDIVNAALG

SEQ ID NO: 344265 - protein, 9 aa, Influenza virus
DIVNAALGS

SEQ ID NO: 344266 - protein, 9 aa, Influenza virus
IVNAALGSP

SEQ ID NO: 344267 - protein, 9 aa, Influenza virus
EWDVFVERP

SEQ ID NO: 344268 - protein, 9 aa, Influenza virus
TCYPFDVPN

SEQ ID NO: 344269 - protein, 9 aa, Influenza virus
CYPFDVPGY

SEQ ID NO: 344270 - protein, 9 aa, Influenza virus
YPFDVPNYQ

SEQ ID NO: 344271 - protein, 9 aa, Influenza virus
PFDVPGYQS

SEQ ID NO: 344272 - protein, 9 aa, Influenza virus
DVPGYQSLR

SEQ ID NO: 344273 - protein, 9 aa, Influenza virus
VPDYQSIRS

SEQ ID NO: 344274 - protein, 9 aa, Influenza virus
PDYQSIRSI

SEQ ID NO: 344275 - protein, 9 aa, Influenza virus
DYQSIRSIL

SEQ ID NO: 344276 - protein, 9 aa, Influenza virus
NNGKLEFIA

SEQ ID NO: 344277 - protein, 9 aa, Influenza virus
NGKLEFIAE

SEQ ID NO: 344278 - protein, 9 aa, Influenza virus
GKLEFIAEE

SEQ ID NO: 344279 - protein, 9 aa, Influenza virus
KLEFIAEEF

SEQ ID NO: 344280 - protein, 9 aa, Influenza virus
TIKQNGKSG

SEQ ID NO: 344281 - protein, 9 aa, Influenza virus
IKQNGKSGA

SEQ ID NO: 344282 - protein, 9 aa, Influenza virus
NDFFKRLNW

SEQ ID NO: 344283 - protein, 9 aa, Influenza virus
YPIQNLTKV

SEQ ID NO: 344284 - protein, 9 aa, Influenza virus
PIQNLTKVN

SEQ ID NO: 344285 - protein, 9 aa, Influenza virus
QNLTKTNNG

SEQ ID NO: 344286 - protein, 9 aa, Influenza virus
NLTKVNNGN

SEQ ID NO: 344287 - protein, 9 aa, Influenza virus
LTKVNSGDY

SEQ ID NO: 344288 - protein, 9 aa, Influenza virus
NNGNYARLY

SEQ ID NO: 344289 - protein, 9 aa, Influenza virus
SGDYARLYI

SEQ ID NO: 344290 - protein, 9 aa, Influenza virus
LYKSNPGRV

SEQ ID NO: 344291 - protein, 9 aa, Influenza virus
YENNPGRVT

SEQ ID NO: 344292 - protein, 9 aa, Influenza virus
SNPGRVTVS

SEQ ID NO: 344293 - protein, 9 aa, Influenza virus
PGRVSVSTK

SEQ ID NO: 344294 - protein, 9 aa, Influenza virus
QTSVVPDIG

SEQ ID NO: 344295 - protein, 9 aa, Influenza virus
GPWVRGQSG

SEQ ID NO: 344296 - protein, 9 aa, Influenza virus
VRGLSSRIS

SEQ ID NO: 344297 - protein, 9 aa, Influenza virus
RGLSSRISF

SEQ ID NO: 344298 - protein, 9 aa, Influenza virus
GLSSRISFY

SEQ ID NO: 344299 - protein, 9 aa, Influenza virus
ISFYWTIVV

SEQ ID NO: 344300 - protein, 9 aa, Influenza virus
PEDLIVFNT

SEQ ID NO: 344301 - protein, 9 aa, Influenza virus
GDVIVFNTI

SEQ ID NO: 344302 - protein, 9 aa, Influenza virus
NLIVFNTIG

SEQ ID NO: 344303 - protein, 9 aa, Influenza virus
IGSCISKCH

SEQ ID NO: 344304 - protein, 9 aa, Influenza virus
GSCISKCHT

SEQ ID NO: 344305 - protein, 9 aa, Influenza virus
SKCHTEKGS

SEQ ID NO: 344306 - protein, 9 aa, Influenza virus
KPFQNVSRT

SEQ ID NO: 344307 - protein, 9 aa, Influenza virus
PFQNVSRIA

SEQ ID NO: 344308 - protein, 9 aa, Influenza virus
GDCPRYVKQ

SEQ ID NO: 344309 - protein, 9 aa, Influenza virus
DCPRYVKQG

SEQ ID NO: 344310 - protein, 9 aa, Influenza virus
KYVKQGSLR

SEQ ID NO: 344311 - protein, 9 aa, Influenza virus
STQAAIDKI

SEQ ID NO: 344312 - protein, 9 aa, Influenza virus
TQAAIDKIN

SEQ ID NO: 344313 - protein, 9 aa, Influenza virus
QAAIDKING

SEQ ID NO: 344314 - protein, 9 aa, Influenza virus
AAINQINGK

SEQ ID NO: 344315 - protein, 9 aa, Influenza virus
AINQINGKL

SEQ ID NO: 344316 - protein, 9 aa, Influenza virus
INQINGKLN

SEQ ID NO: 344317 - protein, 9 aa, Influenza virus
DQISGKLNR

SEQ ID NO: 344318 - protein, 9 aa, Influenza virus
EQVEGRIQY

SEQ ID NO: 344319 - protein, 9 aa, Influenza virus
KIEGRVQDL

SEQ ID NO: 344320 - protein, 9 aa, Influenza virus
IEGRVQDLE

SEQ ID NO: 344321 - protein, 9 aa, Influenza virus
QYLEKYVED

SEQ ID NO: 344322 - protein, 9 aa, Influenza virus
DLENYVEDT

SEQ ID NO: 344323 - protein, 9 aa, Influenza virus
EEYVEDTKI

SEQ ID NO: 344324 - protein, 9 aa, Influenza virus
IDVTDSEMS

SEQ ID NO: 344325 - protein, 9 aa, Influenza virus
DVTDSEMDK

SEQ ID NO: 344326 - protein, 9 aa, Influenza virus
MTDSEMNKL

SEQ ID NO: 344327 - protein, 9 aa, Influenza virus
ADSEMNKLF

SEQ ID NO: 344328 - protein, 9 aa, Influenza virus
SEMSKLFER

SEQ ID NO: 344329 - protein, 9 aa, Influenza virus
EMSKLFERV

SEQ ID NO: 344330 - protein, 9 aa, Influenza virus
MDKLFERVR

SEQ ID NO: 344331 - protein, 9 aa, Influenza virus
RLFERVRRQ

SEQ ID NO: 344332 - protein, 9 aa, Influenza virus
FEIFHQCNN

SEQ ID NO: 344333 - protein, 9 aa, Influenza virus
CDNTCIESI

SEQ ID NO: 344334 - protein, 9 aa, Influenza virus
GNNCIESIR

SEQ ID NO: 344335 - protein, 9 aa, Influenza virus
IRNGTYNHN

SEQ ID NO: 344336 - protein, 9 aa, Influenza virus
HNIYRDEAI

SEQ ID NO: 344337 - protein, 9 aa, Influenza virus
YRDEAINSR

SEQ ID NO: 344338 - protein, 9 aa, Influenza virus
RDEAINSRF

SEQ ID NO: 344339 - protein, 9 aa, Influenza virus
DEAINSRFQ

SEQ ID NO: 344340 - protein, 9 aa, Influenza virus
DAINNRFQI

SEQ ID NO: 344341 - protein, 9 aa, Influenza virus
NNRFQIQGI

SEQ ID NO: 344342 - protein, 9 aa, Influenza virus
NRFQIQGIK

SEQ ID NO: 344343 - protein, 9 aa, Influenza virus
FQIQGVKLI

SEQ ID NO: 344344 - protein, 9 aa, Influenza virus
QIQGVKLIQ

SEQ ID NO: 344345 - protein, 9 aa, Influenza virus
IQGVKLIQG

SEQ ID NO: 344346 - protein, 9 aa, Influenza virus
QGVKLIQGY

SEQ ID NO: 344347 - protein, 9 aa, Influenza virus
GVKLIQGYK

SEQ ID NO: 344348 - protein, 9 aa, Influenza virus
VKLIQGYKD

SEQ ID NO: 344349 - protein, 9 aa, Influenza virus
KLIQGYKDI

SEQ ID NO: 344350 - protein, 9 aa, Influenza virus
IILWISFSM

SEQ ID NO: 344351 - protein, 9 aa, Influenza virus
SCFLLVALF

SEQ ID NO: 344352 - protein, 9 aa, Influenza virus
CFLLIALLL

SEQ ID NO: 344353 - protein, 9 aa, Influenza virus
ALLLAFMLW

SEQ ID NO: 344354 - protein, 9 aa, Influenza virus
LLLAFMLWA

SEQ ID NO: 344355 - protein, 9 aa, Influenza virus
LLAFMLWAC

SEQ ID NO: 344356 - protein, 9 aa, Influenza virus
LAFVLWACQ

SEQ ID NO: 344357 - protein, 9 aa, Influenza virus
TFILWACQN

SEQ ID NO: 344358 - protein, 9 aa, Influenza virus
ILWACQTGN

SEQ ID NO: 344359 - protein, 9 aa, Influenza virus
LWACQTGNI

SEQ ID NO: 344360 - protein, 9 aa, Influenza virus
ACQTGNIRC

SEQ ID NO: 344361 - protein, 9 aa, Influenza virus
CQTGNIRCQ

SEQ ID NO: 344362 - protein, 9 aa, Influenza virus
QNGNIRWPD

SEQ ID NO: 344363 - protein, 9 aa, Influenza virus
GDRICIGYH

SEQ ID NO: 344364 - protein, 9 aa, Influenza virus
DQICVGYHA

SEQ ID NO: 344365 - protein, 9 aa, Influenza virus
QICVGYHAN

SEQ ID NO: 344366 - protein, 9 aa, Influenza virus
HVDTIMEKN

SEQ ID NO: 344367 - protein, 9 aa, Influenza virus
KNITVTHAQ

SEQ ID NO: 344368 - protein, 9 aa, Influenza virus
NITVTHAQD

SEQ ID NO: 344369 - protein, 9 aa, Influenza virus
ITVTHAQDI

SEQ ID NO: 344370 - protein, 9 aa, Influenza virus
TVTHAQDLL

SEQ ID NO: 344371 - protein, 9 aa, Influenza virus
VTHAQDLLE

SEQ ID NO: 344372 - protein, 9 aa, Influenza virus
THAKDILEK

SEQ ID NO: 344373 - protein, 9 aa, Influenza virus
RPLILRDCS

SEQ ID NO: 344374 - protein, 9 aa, Influenza virus
PLILGDCSV

SEQ ID NO: 344375 - protein, 9 aa, Influenza virus
ILGDCSVAG

SEQ ID NO: 344376 - protein, 9 aa, Influenza virus
LKDCSVSGW

SEQ ID NO: 344377 - protein, 9 aa, Influenza virus
GDCSVAGWL

SEQ ID NO: 344378 - protein, 9 aa, Influenza virus
LLGNPMCDA

SEQ ID NO: 344379 - protein, 9 aa, Influenza virus
LGNPTCDEF

SEQ ID NO: 344380 - protein, 9 aa, Influenza virus
LLVMWGIHH

SEQ ID NO: 344381 - protein, 9 aa, Influenza virus
YVSIGTSTL

SEQ ID NO: 344382 - protein, 9 aa, Influenza virus
VSIGTSTLN

SEQ ID NO: 344383 - protein, 9 aa, Influenza virus
GTSTLNQRM

SEQ ID NO: 344384 - protein, 9 aa, Influenza virus
FESNGNFIT

SEQ ID NO: 344385 - protein, 9 aa, Influenza virus
NGNFITPEY

SEQ ID NO: 344386 - protein, 9 aa, Influenza virus
FITPEYAYK

SEQ ID NO: 344387 - protein, 9 aa, Influenza virus
ITPEYAYKI

SEQ ID NO: 344388 - protein, 9 aa, Influenza virus
CQTPLGAIN

SEQ ID NO: 344389 - protein, 9 aa, Influenza virus
SSMPLHNIH

SEQ ID NO: 344390 - protein, 9 aa, Influenza virus
SMPLHNIHP

SEQ ID NO: 344391 - protein, 9 aa, Influenza virus
LPFHNVHPF

SEQ ID NO: 344392 - protein, 9 aa, Influenza virus
PLHNIHPLT

SEQ ID NO: 344393 - protein, 9 aa, Influenza virus
LHNIHPLTI

SEQ ID NO: 344394 - protein, 9 aa, Influenza virus
HNVHPLAIG

SEQ ID NO: 344395 - protein, 9 aa, Influenza virus
PLTIGKCPK

SEQ ID NO: 344396 - protein, 9 aa, Influenza virus
LTIGKCPKY

SEQ ID NO: 344397 - protein, 9 aa, Influenza virus
KRKKRGLFG

SEQ ID NO: 344398 - protein, 9 aa, Influenza virus
DGWYGYHHI

SEQ ID NO: 344399 - protein, 9 aa, Influenza virus
GWYGYHHIN

SEQ ID NO: 344400 - protein, 9 aa, Influenza virus
GSGYAADRE

SEQ ID NO: 344401 - protein, 9 aa, Influenza virus
SGYAADRES

SEQ ID NO: 344402 - protein, 9 aa, Influenza virus
GYAADREST

SEQ ID NO: 344403 - protein, 9 aa, Influenza virus
YAADRESTQ

SEQ ID NO: 344404 - protein, 9 aa, Influenza virus
AADKKSTQK

SEQ ID NO: 344405 - protein, 9 aa, Influenza virus
ADKKSTQKA

SEQ ID NO: 344406 - protein, 9 aa, Influenza virus
KSTQKAIDG

SEQ ID NO: 344407 - protein, 9 aa, Influenza virus
NGVTNKVNS

SEQ ID NO: 344408 - protein, 9 aa, Influenza virus
ITNRVNSII

SEQ ID NO: 344409 - protein, 9 aa, Influenza virus
TNKINSIID

SEQ ID NO: 344410 - protein, 9 aa, Influenza virus
KINSIIDKM

SEQ ID NO: 344411 - protein, 9 aa, Influenza virus
INSIIDKMN

SEQ ID NO: 344412 - protein, 9 aa, Influenza virus
NSIIDKMNI

SEQ ID NO: 344413 - protein, 9 aa, Influenza virus
IIDKMNTRF

SEQ ID NO: 344414 - protein, 9 aa, Influenza virus
LEGRIENLN

SEQ ID NO: 344415 - protein, 9 aa, Influenza virus
LNKKMEEGF

SEQ ID NO: 344416 - protein, 9 aa, Influenza virus
DFLDVWTYN

SEQ ID NO: 344417 - protein, 9 aa, Influenza virus
FLGVWTYNA

SEQ ID NO: 344418 - protein, 9 aa, Influenza virus
LGVWTYNAE

SEQ ID NO: 344419 - protein, 9 aa, Influenza virus
DIWTYNAEL

SEQ ID NO: 344420 - protein, 9 aa, Influenza virus
DSNVKNLYN

SEQ ID NO: 344421 - protein, 9 aa, Influenza virus
SNVKNLYNK

SEQ ID NO: 344422 - protein, 9 aa, Influenza virus
NVKNLYNKV

SEQ ID NO: 344423 - protein, 9 aa, Influenza virus
VKNLYNKVR

SEQ ID NO: 344424 - protein, 9 aa, Influenza virus
NLYNKVRLQ

SEQ ID NO: 344425 - protein, 9 aa, Influenza virus
LYNKVRLQL

SEQ ID NO: 344426 - protein, 9 aa, Influenza virus
KVRHQLRDN

SEQ ID NO: 344427 - protein, 9 aa, Influenza virus
RLQLRDNAR

SEQ ID NO: 344428 - protein, 9 aa, Influenza virus
LQLRDNARE

SEQ ID NO: 344429 - protein, 9 aa, Influenza virus
FEFYHKCNN

SEQ ID NO: 344430 - protein, 9 aa, Influenza virus
CIESVRNGT

SEQ ID NO: 344431 - protein, 9 aa, Influenza virus
IESVRNGTY

SEQ ID NO: 344432 - protein, 9 aa, Influenza virus
TYQILSVYS

SEQ ID NO: 344433 - protein, 9 aa, Influenza virus
ILSIYSTVT

SEQ ID NO: 344434 - protein, 9 aa, Influenza virus
LSIYSTVTS

SEQ ID NO: 344435 - protein, 9 aa, Influenza virus
SIYSTVTSS

SEQ ID NO: 344436 - protein, 9 aa, Influenza virus
IYSTVTSSL

SEQ ID NO: 344437 - protein, 9 aa, Influenza virus
AGLLLWMCS

SEQ ID NO: 344438 - protein, 9 aa, Influenza virus
GLLLWMCSN

SEQ ID NO: 344439 - protein, 9 aa, Influenza virus
LLLWMCSNG

SEQ ID NO: 344440 - protein, 9 aa, Influenza virus
LLWMCSNGS

SEQ ID NO: 344441 - protein, 9 aa, Influenza virus
LWMCSNGSY

SEQ ID NO: 344442 - protein, 9 aa, Influenza virus
NGSLQCKIC

SEQ ID NO: 344443 - protein, 9 aa, Influenza virus
IRFVNSDCS

SEQ ID NO: 344444 - protein, 9 aa, Influenza virus
SDQICVGYH

SEQ ID NO: 344445 - protein, 9 aa, Influenza virus
YHANNSTER

SEQ ID NO: 344446 - protein, 9 aa, Influenza virus
HANNSTEHV

SEQ ID NO: 344447 - protein, 9 aa, Influenza virus
ANNSTERVD

SEQ ID NO: 344448 - protein, 9 aa, Influenza virus
NNSTERVDT

SEQ ID NO: 344449 - protein, 9 aa, Influenza virus
NSTERVDTI

SEQ ID NO: 344450 - protein, 9 aa, Influenza virus
STERVDTIM

SEQ ID NO: 344451 - protein, 9 aa, Influenza virus
TERVDTIME

SEQ ID NO: 344452 - protein, 9 aa, Influenza virus
EQVDTIMER

SEQ ID NO: 344453 - protein, 9 aa, Influenza virus
DILEKEHNG

SEQ ID NO: 344454 - protein, 9 aa, Influenza virus
LDGVRPLIL

SEQ ID NO: 344455 - protein, 9 aa, Influenza virus
GVRPLILRD

SEQ ID NO: 344456 - protein, 9 aa, Influenza virus
VRPLILRDC

SEQ ID NO: 344457 - protein, 9 aa, Influenza virus
RPLILKDCS

SEQ ID NO: 344458 - protein, 9 aa, Influenza virus
KVPEWSYIV

SEQ ID NO: 344459 - protein, 9 aa, Influenza virus
FSDYEELKH

SEQ ID NO: 344460 - protein, 9 aa, Influenza virus
EELKHLLNR

SEQ ID NO: 344461 - protein, 9 aa, Influenza virus
ELKHLLNRI

SEQ ID NO: 344462 - protein, 9 aa, Influenza virus
SFFRNVVWI

SEQ ID NO: 344463 - protein, 9 aa, Influenza virus
LLIIWGIHH

SEQ ID NO: 344464 - protein, 9 aa, Influenza virus
TYVSIGTST

SEQ ID NO: 344465 - protein, 9 aa, Influenza virus
YVSIGTSTL

SEQ ID NO: 344466 - protein, 9 aa, Influenza virus
VSIGTSTLN

SEQ ID NO: 344467 - protein, 9 aa, Influenza virus
INFDSNGNF

SEQ ID NO: 344468 - protein, 9 aa, Influenza virus
NFDSNGNFI

SEQ ID NO: 344469 - protein, 9 aa, Influenza virus
FITPEYAYK

SEQ ID NO: 344470 - protein, 9 aa, Influenza virus
ITPEYAYKI

SEQ ID NO: 344471 - protein, 9 aa, Influenza virus
PEYAYKVVK

SEQ ID NO: 344472 - protein, 9 aa, Influenza virus
AYKIVKTGD

SEQ ID NO: 344473 - protein, 9 aa, Influenza virus
YKIIKKGDS

SEQ ID NO: 344474 - protein, 9 aa, Influenza virus
CQTPLGAIN

SEQ ID NO: 344475 - protein, 9 aa, Influenza virus
QTPLGAINS

SEQ ID NO: 344476 - protein, 9 aa, Influenza virus
TPLGAINSS

SEQ ID NO: 344477 - protein, 9 aa, Influenza virus
LGAINSSMP

SEQ ID NO: 344478 - protein, 9 aa, Influenza virus
AINTSMPFH

SEQ ID NO: 344479 - protein, 9 aa, Influenza virus
ECPKYVKST

SEQ ID NO: 344480 - protein, 9 aa, Influenza virus
KLILATGLR

SEQ ID NO: 344481 - protein, 9 aa, Influenza virus
WYGYHHNNE

SEQ ID NO: 344482 - protein, 9 aa, Influenza virus
GYHHNNEQG

SEQ ID NO: 344483 - protein, 9 aa, Influenza virus
HHSKEQGSG

SEQ ID NO: 344484 - protein, 9 aa, Influenza virus
HSKEQGSGY

SEQ ID NO: 344485 - protein, 9 aa, Influenza virus
SKEQGSGYA

SEQ ID NO: 344486 - protein, 9 aa, Influenza virus
AADRESTQK

SEQ ID NO: 344487 - protein, 9 aa, Influenza virus
ADRESTQKA

SEQ ID NO: 344488 - protein, 9 aa, Influenza virus
ESTQKAMDG

SEQ ID NO: 344489 - protein, 9 aa, Influenza virus
STQKAINGV

SEQ ID NO: 344490 - protein, 9 aa, Influenza virus
TQKAINGVT

SEQ ID NO: 344491 - protein, 9 aa, Influenza virus
QKAINGVTN

SEQ ID NO: 344492 - protein, 9 aa, Influenza virus
KAINGVTNK

SEQ ID NO: 344493 - protein, 9 aa, Influenza virus
AIDGITNKI

SEQ ID NO: 344494 - protein, 9 aa, Influenza virus
IDGITNKIN

SEQ ID NO: 344495 - protein, 9 aa, Influenza virus
IDKMNTRFE

SEQ ID NO: 344496 - protein, 9 aa, Influenza virus
DKMNTQFET

SEQ ID NO: 344497 - protein, 9 aa, Influenza virus
NIQFEAVGR

SEQ ID NO: 344498 - protein, 9 aa, Influenza virus
IQFEAVGRE

SEQ ID NO: 344499 - protein, 9 aa, Influenza virus
FEAIGREFN

SEQ ID NO: 344500 - protein, 9 aa, Influenza virus
ERRIENLNR

SEQ ID NO: 344501 - protein, 9 aa, Influenza virus
RRIENLNRK

SEQ ID NO: 344502 - protein, 9 aa, Influenza virus
SNVKNLYDR

SEQ ID NO: 344503 - protein, 9 aa, Influenza virus
NVKNLYDRV

SEQ ID NO: 344504 - protein, 9 aa, Influenza virus
VKNLYDRVR

SEQ ID NO: 344505 - protein, 9 aa, Influenza virus
KNLYDRVRL

SEQ ID NO: 344506 - protein, 9 aa, Influenza virus
YDRVRLQLR

SEQ ID NO: 344507 - protein, 9 aa, Influenza virus
DRVRLQLRD

SEQ ID NO: 344508 - protein, 9 aa, Influenza virus
FEFYHKCNN

SEQ ID NO: 344509 - protein, 9 aa, Influenza virus
CIESVRNGT

SEQ ID NO: 344510 - protein, 9 aa, Influenza virus
IESVRNGTY

SEQ ID NO: 344511 - protein, 9 aa, Influenza virus
SVRNGTYNY

SEQ ID NO: 344512 - protein, 9 aa, Influenza virus
NGTYDYPHY

SEQ ID NO: 344513 - protein, 9 aa, Influenza virus
GVYQILSIY

SEQ ID NO: 344514 - protein, 9 aa, Influenza virus
ILSIYSTVV

SEQ ID NO: 344515 - protein, 9 aa, Influenza virus
LSIYSTVTS

SEQ ID NO: 344516 - protein, 9 aa, Influenza virus
SIYSTVTSS

SEQ ID NO: 344517 - protein, 9 aa, Influenza virus
IYSTVTSSL

SEQ ID NO: 344518 - protein, 9 aa, Influenza virus
YSTVASSLT

SEQ ID NO: 344519 - protein, 9 aa, Influenza virus
STVASSLTL

SEQ ID NO: 344520 - protein, 9 aa, Influenza virus
TVASSLTLA

SEQ ID NO: 344521 - protein, 9 aa, Influenza virus
VASSLTLAI

SEQ ID NO: 344522 - protein, 9 aa, Influenza virus
ASSLALAII

SEQ ID NO: 344523 - protein, 9 aa, Influenza virus
AGLLLWMCS

SEQ ID NO: 344524 - protein, 9 aa, Influenza virus
GLLLWMCSN

SEQ ID NO: 344525 - protein, 9 aa, Influenza virus
LLWMCSNGS

SEQ ID NO: 344526 - protein, 9 aa, Influenza virus
NGSLQCKIC

SEQ ID NO: 344527 - protein, 9 aa, Influenza virus
IKFVSSDCS

SEQ ID NO: 344528 - protein, 9 aa, Influenza virus
NQNSTWVSQ

SEQ ID NO: 344529 - protein, 9 aa, Influenza virus
ENTTWVNQT

SEQ ID NO: 344530 - protein, 9 aa, Influenza virus
NTTWVNQTY

SEQ ID NO: 344531 - protein, 9 aa, Influenza virus
GWAIYSKDN

SEQ ID NO: 344532 - protein, 9 aa, Influenza virus
HSKDNNIRI

SEQ ID NO: 344533 - protein, 9 aa, Influenza virus
DNNIRIGSK

SEQ ID NO: 344534 - protein, 9 aa, Influenza virus
NNIRIGSKG

SEQ ID NO: 344535 - protein, 9 aa, Influenza virus
NIRIGSKGD

SEQ ID NO: 344536 - protein, 9 aa, Influenza virus
GDVFIIREP

SEQ ID NO: 344537 - protein, 9 aa, Influenza virus
DVFIIREPF

SEQ ID NO: 344538 - protein, 9 aa, Influenza virus
FIIREPFIS

SEQ ID NO: 344539 - protein, 9 aa, Influenza virus
TREPFISCS

SEQ ID NO: 344540 - protein, 9 aa, Influenza virus
EPFVSCSHL

SEQ ID NO: 344541 - protein, 9 aa, Influenza virus
PFVSCSHLE

SEQ ID NO: 344542 - protein, 9 aa, Influenza virus
FVSCSHLEC

SEQ ID NO: 344543 - protein, 9 aa, Influenza virus
ISCSHSECR

SEQ ID NO: 344544 - protein, 9 aa, Influenza virus
SCSYLECRT

SEQ ID NO: 344545 - protein, 9 aa, Influenza virus
CSYLECRTF

SEQ ID NO: 344546 - protein, 9 aa, Influenza virus
SYLECRTFF

SEQ ID NO: 344547 - protein, 9 aa, Influenza virus
YLECRTFFL

SEQ ID NO: 344548 - protein, 9 aa, Influenza virus
NDKHSNGTA

SEQ ID NO: 344549 - protein, 9 aa, Influenza virus
KHSNETVKD

SEQ ID NO: 344550 - protein, 9 aa, Influenza virus
HSNGTVNDR

SEQ ID NO: 344551 - protein, 9 aa, Influenza virus
SNGTVNDRS

SEQ ID NO: 344552 - protein, 9 aa, Influenza virus
NGTVNDRSP

SEQ ID NO: 344553 - protein, 9 aa, Influenza virus
NDRSPHRTL

SEQ ID NO: 344554 - protein, 9 aa, Influenza virus
DRSPQRTLM

SEQ ID NO: 344555 - protein, 9 aa, Influenza virus
RSPQRTLMS

SEQ ID NO: 344556 - protein, 9 aa, Influenza virus
SPQRTLMSC

SEQ ID NO: 344557 - protein, 9 aa, Influenza virus
PQRTLMSCP

SEQ ID NO: 344558 - protein, 9 aa, Influenza virus
RTLMSCPIG

SEQ ID NO: 344559 - protein, 9 aa, Influenza virus
PVGEVPSPY

SEQ ID NO: 344560 - protein, 9 aa, Influenza virus
VAPSPYNSR

SEQ ID NO: 344561 - protein, 9 aa, Influenza virus
ASACHDGSS

SEQ ID NO: 344562 - protein, 9 aa, Influenza virus
SACHDGSSW

SEQ ID NO: 344563 - protein, 9 aa, Influenza virus
ACHDGSSWL

SEQ ID NO: 344564 - protein, 9 aa, Influenza virus
CHDGSSWLT

SEQ ID NO: 344565 - protein, 9 aa, Influenza virus
HDGSSWLTI

SEQ ID NO: 344566 - protein, 9 aa, Influenza virus
IIGISGPDN

SEQ ID NO: 344567 - protein, 9 aa, Influenza virus
IGVSGPDNG

SEQ ID NO: 344568 - protein, 9 aa, Influenza virus
GVSGPDNGA

SEQ ID NO: 344569 - protein, 9 aa, Influenza virus
VSGPDNGAV

SEQ ID NO: 344570 - protein, 9 aa, Influenza virus
PDNGAVAVV

SEQ ID NO: 344571 - protein, 9 aa, Influenza virus
DNGAVAVVK

SEQ ID NO: 344572 - protein, 9 aa, Influenza virus
NGAVAVVKY

SEQ ID NO: 344573 - protein, 9 aa, Influenza virus
GAVAVLKYD

SEQ ID NO: 344574 - protein, 9 aa, Influenza virus
AVAVLKYKG

SEQ ID NO: 344575 - protein, 9 aa, Influenza virus
KYKGIITDT

SEQ ID NO: 344576 - protein, 9 aa, Influenza virus
YKGIITDTI

SEQ ID NO: 344577 - protein, 9 aa, Influenza virus
GIITDTIRS

SEQ ID NO: 344578 - protein, 9 aa, Influenza virus
IITDTIRSW

SEQ ID NO: 344579 - protein, 9 aa, Influenza virus
ITDTIKSWK

SEQ ID NO: 344580 - protein, 9 aa, Influenza virus
SILRTQESE

SEQ ID NO: 344581 - protein, 9 aa, Influenza virus
GYCFTVMTD

SEQ ID NO: 344582 - protein, 9 aa, Influenza virus
YCFTVMTDG

SEQ ID NO: 344583 - protein, 9 aa, Influenza virus
ECSCYPNAG

SEQ ID NO: 344584 - protein, 9 aa, Influenza virus
CSCYPDAGK

SEQ ID NO: 344585 - protein, 9 aa, Influenza virus
TCVCRDSWH

SEQ ID NO: 344586 - protein, 9 aa, Influenza virus
SNRPWVSFD

SEQ ID NO: 344587 - protein, 9 aa, Influenza virus
NRPWVSFDQ

SEQ ID NO: 344588 - protein, 9 aa, Influenza virus
YQVGYICSG

SEQ ID NO: 344589 - protein, 9 aa, Influenza virus
IGYICSGVL

SEQ ID NO: 344590 - protein, 9 aa, Influenza virus
ICSGVFGDS

SEQ ID NO: 344591 - protein, 9 aa, Influenza virus
CSGVFGDSP

SEQ ID NO: 344592 - protein, 9 aa, Influenza virus
SGVFGDSPR

SEQ ID NO: 344593 - protein, 9 aa, Influenza virus
GVFGDSPRP

SEQ ID NO: 344594 - protein, 9 aa, Influenza virus
FGDNPRPSD

SEQ ID NO: 344595 - protein, 9 aa, Influenza virus
GDNPRPSDG

SEQ ID NO: 344596 - protein, 9 aa, Influenza virus
GVKGFSFRY

SEQ ID NO: 344597 - protein, 9 aa, Influenza virus
VKGFSFRYG

SEQ ID NO: 344598 - protein, 9 aa, Influenza virus
KGFSFKYGD

SEQ ID NO: 344599 - protein, 9 aa, Influenza virus
GFSFKYGDG

SEQ ID NO: 344600 - protein, 9 aa, Influenza virus
FKYGNGAWI

SEQ ID NO: 344601 - protein, 9 aa, Influenza virus
KYGDGVWIG

SEQ ID NO: 344602 - protein, 9 aa, Influenza virus
VWIGRTKSA

SEQ ID NO: 344603 - protein, 9 aa, Influenza virus
ITEWSGYSG

SEQ ID NO: 344604 - protein, 9 aa, Influenza virus
QHPELTGVD

SEQ ID NO: 344605 - protein, 9 aa, Influenza virus
HPELTGVDC

SEQ ID NO: 344606 - protein, 9 aa, Influenza virus
TGLNCMRPC

SEQ ID NO: 344607 - protein, 9 aa, Influenza virus
NCMRPCFWV

SEQ ID NO: 344608 - protein, 9 aa, Influenza virus
FWIELIRGR

SEQ ID NO: 344609 - protein, 9 aa, Influenza virus
WIELIRGRP

SEQ ID NO: 344610 - protein, 9 aa, Influenza virus
VELIRGRPE

SEQ ID NO: 344611 - protein, 9 aa, Influenza virus
ELIRGRPEE

SEQ ID NO: 344612 - protein, 9 aa, Influenza virus
TIWASGSSI

SEQ ID NO: 344613 - protein, 9 aa, Influenza virus
IWASGSSIS

SEQ ID NO: 344614 - protein, 9 aa, Influenza virus
SIISFCGVN

SEQ ID NO: 344615 - protein, 9 aa, Influenza virus
SWSWPDDAE

SEQ ID NO: 344616 - protein, 9 aa, Influenza virus
WPDDAELPL

SEQ ID NO: 344617 - protein, 9 aa, Influenza virus
SDRICIGYH

SEQ ID NO: 344618 - protein, 9 aa, Influenza virus
DQICIGHHA

SEQ ID NO: 344619 - protein, 9 aa, Influenza virus
RICVGYHAN

SEQ ID NO: 344620 - protein, 9 aa, Influenza virus
VGYHANNST

SEQ ID NO: 344621 - protein, 9 aa, Influenza virus
GYHANNSKK

SEQ ID NO: 344622 - protein, 9 aa, Influenza virus
HHANNSTEQ

SEQ ID NO: 344623 - protein, 9 aa, Influenza virus
HANNSKKQI

SEQ ID NO: 344624 - protein, 9 aa, Influenza virus
ANNSKKQID

SEQ ID NO: 344625 - protein, 9 aa, Influenza virus
NNSKKQIDT

SEQ ID NO: 344626 - protein, 9 aa, Influenza virus
NSKKQIDTI

SEQ ID NO: 344627 - protein, 9 aa, Influenza virus
EQVDTIMER

SEQ ID NO: 344628 - protein, 9 aa, Influenza virus
QVDTIMEKI

SEQ ID NO: 344629 - protein, 9 aa, Influenza virus
VDTIMEKIV

SEQ ID NO: 344630 - protein, 9 aa, Influenza virus
DTTMEKNVT

SEQ ID NO: 344631 - protein, 9 aa, Influenza virus
TIREKNVTV

SEQ ID NO: 344632 - protein, 9 aa, Influenza virus
IIEKNVTVT

SEQ ID NO: 344633 - protein, 9 aa, Influenza virus
EKIVTVTHA

SEQ ID NO: 344634 - protein, 9 aa, Influenza virus
KNVIFTHAQ

SEQ ID NO: 344635 - protein, 9 aa, Influenza virus
NVTVTHARD

SEQ ID NO: 344636 - protein, 9 aa, Influenza virus
AGWILGNPM

SEQ ID NO: 344637 - protein, 9 aa, Influenza virus
GWILGNPMC

SEQ ID NO: 344638 - protein, 9 aa, Influenza virus
WSYIVEKDK

SEQ ID NO: 344639 - protein, 9 aa, Influenza virus
SYIVEKDKP

SEQ ID NO: 344640 - protein, 9 aa, Influenza virus
SSFFRNIVW

SEQ ID NO: 344641 - protein, 9 aa, Influenza virus
FYRNVVWLI

SEQ ID NO: 344642 - protein, 9 aa, Influenza virus
YRNVVWLIK

SEQ ID NO: 344643 - protein, 9 aa, Influenza virus
GTPTLNQRS

SEQ ID NO: 344644 - protein, 9 aa, Influenza virus
IAIRPKVNG

SEQ ID NO: 344645 - protein, 9 aa, Influenza virus
AIRPKVNGQ

SEQ ID NO: 344646 - protein, 9 aa, Influenza virus
RSKVNGQSG

SEQ ID NO: 344647 - protein, 9 aa, Influenza virus
PEYAFKIAK

SEQ ID NO: 344648 - protein, 9 aa, Influenza virus
YGNCDAKCQ

SEQ ID NO: 344649 - protein, 9 aa, Influenza virus
GNCDAKCQT

SEQ ID NO: 344650 - protein, 9 aa, Influenza virus
NCDAKCQTP

SEQ ID NO: 344651 - protein, 9 aa, Influenza virus
ETKGLFGAI

SEQ ID NO: 344652 - protein, 9 aa, Influenza virus
DGWYGYHHN

SEQ ID NO: 344653 - protein, 9 aa, Influenza virus
GWYGYHHNN

SEQ ID NO: 344654 - protein, 9 aa, Influenza virus
NAQGSGYAA

SEQ ID NO: 344655 - protein, 9 aa, Influenza virus
AQGSGYAAD

SEQ ID NO: 344656 - protein, 9 aa, Influenza virus
GSGYAANKE

SEQ ID NO: 344657 - protein, 9 aa, Influenza virus
GGYAADKES

SEQ ID NO: 344658 - protein, 9 aa, Influenza virus
GYAADKDST

SEQ ID NO: 344659 - protein, 9 aa, Influenza virus
YAADKASTQ

SEQ ID NO: 344660 - protein, 9 aa, Influenza virus
AADRKSTQK

SEQ ID NO: 344661 - protein, 9 aa, Influenza virus
ADRKSTQKA

SEQ ID NO: 344662 - protein, 9 aa, Influenza virus
ESTQRAIDG

SEQ ID NO: 344663 - protein, 9 aa, Influenza virus
STQKAIDGV

SEQ ID NO: 344664 - protein, 9 aa, Influenza virus
TQKAIDGVT

SEQ ID NO: 344665 - protein, 9 aa, Influenza virus
YNAELLVLI

SEQ ID NO: 344666 - protein, 9 aa, Influenza virus
NAELFVLME

SEQ ID NO: 344667 - protein, 9 aa, Influenza virus
AELFVLMEN

SEQ ID NO: 344668 - protein, 9 aa, Influenza virus
LLVLMETER

SEQ ID NO: 344669 - protein, 9 aa, Influenza virus
METERTLDF

SEQ ID NO: 344670 - protein, 9 aa, Influenza virus
YFHDSNVKN

SEQ ID NO: 344671 - protein, 9 aa, Influenza virus
KLYDRVRLQ

SEQ ID NO: 344672 - protein, 9 aa, Influenza virus
LYDKVRFQL

SEQ ID NO: 344673 - protein, 9 aa, Influenza virus
VRFQLKDNA

SEQ ID NO: 344674 - protein, 9 aa, Influenza virus
NNAKELGNG

SEQ ID NO: 344675 - protein, 9 aa, Influenza virus
AKEWGNGCF

SEQ ID NO: 344676 - protein, 9 aa, Influenza virus
KEWGNGCFE

SEQ ID NO: 344677 - protein, 9 aa, Influenza virus
FEFYHRCDD

SEQ ID NO: 344678 - protein, 9 aa, Influenza virus
VCMESVRNG

SEQ ID NO: 344679 - protein, 9 aa, Influenza virus
ESVKNGTYN

SEQ ID NO: 344680 - protein, 9 aa, Influenza virus
SVKNGTYNY

SEQ ID NO: 344681 - protein, 9 aa, Influenza virus
ILSVYSTVA

SEQ ID NO: 344682 - protein, 9 aa, Influenza virus
LSVYSTVAS

SEQ ID NO: 344683 - protein, 9 aa, Influenza virus
SVYSTVASS

SEQ ID NO: 344684 - protein, 9 aa, Influenza virus
VYSTVASSL

SEQ ID NO: 344685 - protein, 9 aa, Influenza virus
VASSLTLAI

SEQ ID NO: 344686 - protein, 9 aa, Influenza virus
LAIMIAGLF

SEQ ID NO: 344687 - protein, 9 aa, Influenza virus
AIMIAGLFF

SEQ ID NO: 344688 - protein, 9 aa, Influenza virus
IMIAGLFFW

SEQ ID NO: 344689 - protein, 9 aa, Influenza virus
IAGLFFWMC

SEQ ID NO: 344690 - protein, 9 aa, Influenza virus
IIAIGSVSL

SEQ ID NO: 344691 - protein, 9 aa, Influenza virus
YRSWSKPQC

SEQ ID NO: 344692 - protein, 9 aa, Influenza virus
KPQCEITGF

SEQ ID NO: 344693 - protein, 9 aa, Influenza virus
PQCEITGFA

SEQ ID NO: 344694 - protein, 9 aa, Influenza virus
QCEITGFAP

SEQ ID NO: 344695 - protein, 9 aa, Influenza virus
CEITGFAPF

SEQ ID NO: 344696 - protein, 9 aa, Influenza virus
RLSAGGGIW

SEQ ID NO: 344697 - protein, 9 aa, Influenza virus
LGQGTPLNN

SEQ ID NO: 344698 - protein, 9 aa, Influenza virus
SNDTIHDRT

SEQ ID NO: 344699 - protein, 9 aa, Influenza virus
SHRTLLMNE

SEQ ID NO: 344700 - protein, 9 aa, Influenza virus
NELGVPFHM

SEQ ID NO: 344701 - protein, 9 aa, Influenza virus
HLGTKQVCV

SEQ ID NO: 344702 - protein, 9 aa, Influenza virus
LGTKQVCVA

SEQ ID NO: 344703 - protein, 9 aa, Influenza virus
KQVCVAWSS

SEQ ID NO: 344704 - protein, 9 aa, Influenza virus
IAWSRSSCH

SEQ ID NO: 344705 - protein, 9 aa, Influenza virus
SRSSCHDGK

SEQ ID NO: 344706 - protein, 9 aa, Influenza virus
SSSCYDGKA

SEQ ID NO: 344707 - protein, 9 aa, Influenza virus
SSCYDGKAW

SEQ ID NO: 344708 - protein, 9 aa, Influenza virus
SCYDGKAWL

SEQ ID NO: 344709 - protein, 9 aa, Influenza virus
HDGKAWLHI

SEQ ID NO: 344710 - protein, 9 aa, Influenza virus
DGKAWLHIC

SEQ ID NO: 344711 - protein, 9 aa, Influenza virus
GKAWLHICV

SEQ ID NO: 344712 - protein, 9 aa, Influenza virus
TGNDRNATA

SEQ ID NO: 344713 - protein, 9 aa, Influenza virus
GDDRKATAS

SEQ ID NO: 344714 - protein, 9 aa, Influenza virus
SCSQNILRT

SEQ ID NO: 344715 - protein, 9 aa, Influenza virus
QESECVCVN

SEQ ID NO: 344716 - protein, 9 aa, Influenza virus
CAVVMTDGN

SEQ ID NO: 344717 - protein, 9 aa, Influenza virus
AVVMTDGNA

SEQ ID NO: 344718 - protein, 9 aa, Influenza virus
VMTDGSASR

SEQ ID NO: 344719 - protein, 9 aa, Influenza virus
TDGSATGKA

SEQ ID NO: 344720 - protein, 9 aa, Influenza virus
SPLSGNAQH

SEQ ID NO: 344721 - protein, 9 aa, Influenza virus
SLSGSAQHI

SEQ ID NO: 344722 - protein, 9 aa, Influenza virus
LSGNAQHIE

SEQ ID NO: 344723 - protein, 9 aa, Influenza virus
VTCVCRDNW

SEQ ID NO: 344724 - protein, 9 aa, Influenza virus
TCVCRDNWK

SEQ ID NO: 344725 - protein, 9 aa, Influenza virus
NWKSSNRPV

SEQ ID NO: 344726 - protein, 9 aa, Influenza virus
SHYVCSGLV

SEQ ID NO: 344727 - protein, 9 aa, Influenza virus
HYVCSGLVG

SEQ ID NO: 344728 - protein, 9 aa, Influenza virus
GDTPRNDDI

SEQ ID NO: 344729 - protein, 9 aa, Influenza virus
SSSNCKDPN

SEQ ID NO: 344730 - protein, 9 aa, Influenza virus
SSNCKDPNN

SEQ ID NO: 344731 - protein, 9 aa, Influenza virus
NCRDPNNES

SEQ ID NO: 344732 - protein, 9 aa, Influenza virus
GSPGVKGWA

SEQ ID NO: 344733 - protein, 9 aa, Influenza virus
SPGVKGWAF

SEQ ID NO: 344734 - protein, 9 aa, Influenza virus
GVKGWAFDI

SEQ ID NO: 344735 - protein, 9 aa, Influenza virus
DVWMGRTIN

SEQ ID NO: 344736 - protein, 9 aa, Influenza virus
GRTISRDSR

SEQ ID NO: 344737 - protein, 9 aa, Influenza virus
SEDSRSGYE

SEQ ID NO: 344738 - protein, 9 aa, Influenza virus
SGYETFRVL

SEQ ID NO: 344739 - protein, 9 aa, Influenza virus
HCINRCFYV

SEQ ID NO: 344740 - protein, 9 aa, Influenza virus
DGADINFMP

SEQ ID NO: 344741 - protein, 9 aa, Influenza virus
SKSDKICIG

SEQ ID NO: 344742 - protein, 9 aa, Influenza virus
RSHKICIGY

SEQ ID NO: 344743 - protein, 9 aa, Influenza virus
ANNSTTQID

SEQ ID NO: 344744 - protein, 9 aa, Influenza virus
NNSTTQIDT

SEQ ID NO: 344745 - protein, 9 aa, Influenza virus
NSTTQVNTI

SEQ ID NO: 344746 - protein, 9 aa, Influenza virus
VDTILEKNI

SEQ ID NO: 344747 - protein, 9 aa, Influenza virus
DTILEKNIT

SEQ ID NO: 344748 - protein, 9 aa, Influenza virus
TILEKNITV

SEQ ID NO: 344749 - protein, 9 aa, Influenza virus
ILEKNITVT

SEQ ID NO: 344750 - protein, 9 aa, Influenza virus
KNITVTHSV

SEQ ID NO: 344751 - protein, 9 aa, Influenza virus
THSIELLES

SEQ ID NO: 344752 - protein, 9 aa, Influenza virus
EGWILGNPK

SEQ ID NO: 344753 - protein, 9 aa, Influenza virus
WILGNPKCD

SEQ ID NO: 344754 - protein, 9 aa, Influenza virus
QRWSYIVER

SEQ ID NO: 344755 - protein, 9 aa, Influenza virus
RWSYIVERP

SEQ ID NO: 344756 - protein, 9 aa, Influenza virus
AKNGICYPG

SEQ ID NO: 344757 - protein, 9 aa, Influenza virus
SILYFWGVH

SEQ ID NO: 344758 - protein, 9 aa, Influenza virus
RSRIDYYWS

SEQ ID NO: 344759 - protein, 9 aa, Influenza virus
RIDYYWSML

SEQ ID NO: 344760 - protein, 9 aa, Influenza virus
WSMLKPGET

SEQ ID NO: 344761 - protein, 9 aa, Influenza virus
SVLQPGETL

SEQ ID NO: 344762 - protein, 9 aa, Influenza virus
VLKPGETLK

SEQ ID NO: 344763 - protein, 9 aa, Influenza virus
LKPGETLNI

SEQ ID NO: 344764 - protein, 9 aa, Influenza virus
KPGETLNIE

SEQ ID NO: 344765 - protein, 9 aa, Influenza virus
NIESNGNLI

SEQ ID NO: 344766 - protein, 9 aa, Influenza virus
LIAPWYAFR

SEQ ID NO: 344767 - protein, 9 aa, Influenza virus
TNKTFQNAS

SEQ ID NO: 344768 - protein, 9 aa, Influenza virus
KTFQNVSPI

SEQ ID NO: 344769 - protein, 9 aa, Influenza virus
TFQNVSPIW

SEQ ID NO: 344770 - protein, 9 aa, Influenza virus
FQNVSPIWI

SEQ ID NO: 344771 - protein, 9 aa, Influenza virus
QNVSPIWIG

SEQ ID NO: 344772 - protein, 9 aa, Influenza virus
WVGECPKYV

SEQ ID NO: 344773 - protein, 9 aa, Influenza virus
GGCPKYVKS

SEQ ID NO: 344774 - protein, 9 aa, Influenza virus
ARGLFGAIA

SEQ ID NO: 344775 - protein, 9 aa, Influenza virus
AADKESTQR

SEQ ID NO: 344776 - protein, 9 aa, Influenza virus
ADKESTQRA

SEQ ID NO: 344777 - protein, 9 aa, Influenza virus
ITSKVNSII

SEQ ID NO: 344778 - protein, 9 aa, Influenza virus
NSIIDKVNT

SEQ ID NO: 344779 - protein, 9 aa, Influenza virus
IIDKVNTQF

SEQ ID NO: 344780 - protein, 9 aa, Influenza virus
KMNTQFDAV

SEQ ID NO: 344781 - protein, 9 aa, Influenza virus
SLNKRMEDG

SEQ ID NO: 344782 - protein, 9 aa, Influenza virus
LNKRMENGF

SEQ ID NO: 344783 - protein, 9 aa, Influenza virus
NKRMENGFL

SEQ ID NO: 344784 - protein, 9 aa, Influenza virus
NGFLDVWTY

SEQ ID NO: 344785 - protein, 9 aa, Influenza virus
GLLDVWTYN

SEQ ID NO: 344786 - protein, 9 aa, Influenza virus
LLDVWTYNA

SEQ ID NO: 344787 - protein, 9 aa, Influenza virus
LLVLLEDER

SEQ ID NO: 344788 - protein, 9 aa, Influenza virus
LVLLEDERT

SEQ ID NO: 344789 - protein, 9 aa, Influenza virus
VLLEDERTL

SEQ ID NO: 344790 - protein, 9 aa, Influenza virus
ENERTLDQH

SEQ ID NO: 344791 - protein, 9 aa, Influenza virus
NERTLDQHD

SEQ ID NO: 344792 - protein, 9 aa, Influenza virus
ERTLDQHDA

SEQ ID NO: 344793 - protein, 9 aa, Influenza virus
LDLHDANVR

SEQ ID NO: 344794 - protein, 9 aa, Influenza virus
VKSLLRDNA

SEQ ID NO: 344795 - protein, 9 aa, Influenza virus
SLLRDNAKD

SEQ ID NO: 344796 - protein, 9 aa, Influenza virus
LKDNANDLG

SEQ ID NO: 344797 - protein, 9 aa, Influenza virus
KDNANDLGN

SEQ ID NO: 344798 - protein, 9 aa, Influenza virus
EFWHKCNNE

SEQ ID NO: 344799 - protein, 9 aa, Influenza virus
FWHKCNNEC

SEQ ID NO: 344800 - protein, 9 aa, Influenza virus
SVENGTYDY

SEQ ID NO: 344801 - protein, 9 aa, Influenza virus
KNGTYKYPK

SEQ ID NO: 344802 - protein, 9 aa, Influenza virus
LGIYQILAI

SEQ ID NO: 344803 - protein, 9 aa, Influenza virus
GVYQILSIY

SEQ ID NO: 344804 - protein, 9 aa, Influenza virus
WMCSNGSMP

SEQ ID NO: 344805 - protein, 9 aa, Influenza virus
CSNSSMQCR

SEQ ID NO: 344806 - protein, 9 aa, Influenza virus
SSMQCRICI

SEQ ID NO: 344807 - protein, 9 aa, Influenza virus
SRGYKMNTK

SEQ ID NO: 344808 - protein, 9 aa, Influenza virus
RGYKMNTKI

SEQ ID NO: 344809 - protein, 9 aa, Influenza virus
GYKMNIQIL

SEQ ID NO: 344810 - protein, 9 aa, Influenza virus
NGTKINTLT

SEQ ID NO: 344811 - protein, 9 aa, Influenza virus
TLTEREVEV

SEQ ID NO: 344812 - protein, 9 aa, Influenza virus
LTEREVEVV

SEQ ID NO: 344813 - protein, 9 aa, Influenza virus
TERGVEVVD

SEQ ID NO: 344814 - protein, 9 aa, Influenza virus
ERGVEVVDA

SEQ ID NO: 344815 - protein, 9 aa, Influenza virus
RGVEVVDAT

SEQ ID NO: 344816 - protein, 9 aa, Influenza virus
VDATETVER

SEQ ID NO: 344817 - protein, 9 aa, Influenza virus
GPPQCDKFL

SEQ ID NO: 344818 - protein, 9 aa, Influenza virus
PPQCDKFLE

SEQ ID NO: 344819 - protein, 9 aa, Influenza virus
PQCDKFLEF

SEQ ID NO: 344820 - protein, 9 aa, Influenza virus
ALIVWGVHH

SEQ ID NO: 344821 - protein, 9 aa, Influenza virus
NGQFGRIDF

SEQ ID NO: 344822 - protein, 9 aa, Influenza virus
GQFGRINFH

SEQ ID NO: 344823 - protein, 9 aa, Influenza virus
QFGRINFHW

SEQ ID NO: 344824 - protein, 9 aa, Influenza virus
FIFNGAFIA

SEQ ID NO: 344825 - protein, 9 aa, Influenza virus
IFNGAFIAP

SEQ ID NO: 344826 - protein, 9 aa, Influenza virus
GAFVAPDRV

SEQ ID NO: 344827 - protein, 9 aa, Influenza virus
AFVAPDRVS

SEQ ID NO: 344828 - protein, 9 aa, Influenza virus
FVAPDRVSF

SEQ ID NO: 344829 - protein, 9 aa, Influenza virus
GKCPKYVKQ

SEQ ID NO: 344830 - protein, 9 aa, Influenza virus
LLATGMRNI

SEQ ID NO: 344831 - protein, 9 aa, Influenza virus
QMTRGLFGA

SEQ ID NO: 344832 - protein, 9 aa, Influenza virus
GLIDGWYGY

SEQ ID NO: 344833 - protein, 9 aa, Influenza virus
LIDGWYGYR

SEQ ID NO: 344834 - protein, 9 aa, Influenza virus
IDGWYGYRH

SEQ ID NO: 344835 - protein, 9 aa, Influenza virus
DGWYGFKHQ

SEQ ID NO: 344836 - protein, 9 aa, Influenza virus
WYGFKHQNA

SEQ ID NO: 344837 - protein, 9 aa, Influenza virus
YGFKHQNAQ

SEQ ID NO: 344838 - protein, 9 aa, Influenza virus
GFKHQNAQG

SEQ ID NO: 344839 - protein, 9 aa, Influenza virus
FKHQNAQGE

SEQ ID NO: 344840 - protein, 9 aa, Influenza virus
STQSAVDQI

SEQ ID NO: 344841 - protein, 9 aa, Influenza virus
TQSAVDQIT

SEQ ID NO: 344842 - protein, 9 aa, Influenza virus
QSAVDQITG

SEQ ID NO: 344843 - protein, 9 aa, Influenza virus
SAVDQITGK

SEQ ID NO: 344844 - protein, 9 aa, Influenza virus
AVDQITGKL

SEQ ID NO: 344845 - protein, 9 aa, Influenza virus
VDQITGKLN

SEQ ID NO: 344846 - protein, 9 aa, Influenza virus
DQITGKLNH

SEQ ID NO: 344847 - protein, 9 aa, Influenza virus
QITGKLNHL

SEQ ID NO: 344848 - protein, 9 aa, Influenza virus
ITGKLNHLI

SEQ ID NO: 344849 - protein, 9 aa, Influenza virus
RTNQQFELI

SEQ ID NO: 344850 - protein, 9 aa, Influenza virus
EKQLGNVIN

SEQ ID NO: 344851 - protein, 9 aa, Influenza virus
KQLGNVINW

SEQ ID NO: 344852 - protein, 9 aa, Influenza virus
AELLVALEN

SEQ ID NO: 344853 - protein, 9 aa, Influenza virus
ELLVALENQ

SEQ ID NO: 344854 - protein, 9 aa, Influenza virus
LLVALENQH

SEQ ID NO: 344855 - protein, 9 aa, Influenza virus
LVALENQHT

SEQ ID NO: 344856 - protein, 9 aa, Influenza virus
VALENQHTI

SEQ ID NO: 344857 - protein, 9 aa, Influenza virus
IENQHTIDL

SEQ ID NO: 344858 - protein, 9 aa, Influenza virus
SEMDKLYER

SEQ ID NO: 344859 - protein, 9 aa, Influenza virus
EMDKLYERV

SEQ ID NO: 344860 - protein, 9 aa, Influenza virus
VKRQLRENA

SEQ ID NO: 344861 - protein, 9 aa, Influenza virus
KRQLRENAE

SEQ ID NO: 344862 - protein, 9 aa, Influenza virus
ASIRNSTYD

SEQ ID NO: 344863 - protein, 9 aa, Influenza virus
YRKEAIQNR

SEQ ID NO: 344864 - protein, 9 aa, Influenza virus
GGYKDIILW

SEQ ID NO: 344865 - protein, 9 aa, Influenza virus
SFGASCLIL

SEQ ID NO: 344866 - protein, 9 aa, Influenza virus
FGASCFLFL

SEQ ID NO: 344867 - protein, 9 aa, Influenza virus
GASCFLFLA

SEQ ID NO: 344868 - protein, 9 aa, Influenza virus
FICVRNGNM

SEQ ID NO: 344869 - protein, 9 aa, Influenza virus
TKGDKICLG

SEQ ID NO: 344870 - protein, 9 aa, Influenza virus
INTLTERGV

SEQ ID NO: 344871 - protein, 9 aa, Influenza virus
NATETVETV

SEQ ID NO: 344872 - protein, 9 aa, Influenza virus
CGLLGILIG

SEQ ID NO: 344873 - protein, 9 aa, Influenza virus
GLLGILIGP

SEQ ID NO: 344874 - protein, 9 aa, Influenza virus
LLGILIGPP

SEQ ID NO: 344875 - protein, 9 aa, Influenza virus
IGPPHCDQF

SEQ ID NO: 344876 - protein, 9 aa, Influenza virus
LIIERKEGT

SEQ ID NO: 344877 - protein, 9 aa, Influenza virus
IIERREGAD

SEQ ID NO: 344878 - protein, 9 aa, Influenza virus
EGADVCYPG

SEQ ID NO: 344879 - protein, 9 aa, Influenza virus
CYPGKFVNG

SEQ ID NO: 344880 - protein, 9 aa, Influenza virus
YPGKFVNGE

SEQ ID NO: 344881 - protein, 9 aa, Influenza virus
FTNEEPLRQ

SEQ ID NO: 344882 - protein, 9 aa, Influenza virus
TNEEPLRQI

SEQ ID NO: 344883 - protein, 9 aa, Influenza virus
NEESLRQVL

SEQ ID NO: 344884 - protein, 9 aa, Influenza virus
EEPLRQILR

SEQ ID NO: 344885 - protein, 9 aa, Influenza virus
LRQILRKSG

SEQ ID NO: 344886 - protein, 9 aa, Influenza virus
RQILRKSGG

SEQ ID NO: 344887 - protein, 9 aa, Influenza virus
QILRKSGGI

SEQ ID NO: 344888 - protein, 9 aa, Influenza virus
RESGGIDKE

SEQ ID NO: 344889 - protein, 9 aa, Influenza virus
GFIYSGIRT

SEQ ID NO: 344890 - protein, 9 aa, Influenza virus
YSGIRTNGV

SEQ ID NO: 344891 - protein, 9 aa, Influenza virus
RSGPSFYAE

SEQ ID NO: 344892 - protein, 9 aa, Influenza virus
SSSSFYAEM

SEQ ID NO: 344893 - protein, 9 aa, Influenza virus
EMKWLLSST

SEQ ID NO: 344894 - protein, 9 aa, Influenza virus
MKWLLSSTD

SEQ ID NO: 344895 - protein, 9 aa, Influenza virus
KWLLSSTDN

SEQ ID NO: 344896 - protein, 9 aa, Influenza virus
ALIVWGVHH

SEQ ID NO: 344897 - protein, 9 aa, Influenza virus
LIVWGVHHS

SEQ ID NO: 344898 - protein, 9 aa, Influenza virus
AEQTKLYGS

SEQ ID NO: 344899 - protein, 9 aa, Influenza virus
LYGNGNKLI

SEQ ID NO: 344900 - protein, 9 aa, Influenza virus
TGARRIDFH

SEQ ID NO: 344901 - protein, 9 aa, Influenza virus
GARRIDFNW

SEQ ID NO: 344902 - protein, 9 aa, Influenza virus
ARRIDFNWL

SEQ ID NO: 344903 - protein, 9 aa, Influenza virus
RRIDFHWLF

SEQ ID NO: 344904 - protein, 9 aa, Influenza virus
GRIDFHWLV

SEQ ID NO: 344905 - protein, 9 aa, Influenza virus
RIDFHWLFL

SEQ ID NO: 344906 - protein, 9 aa, Influenza virus
NDTVTFNFN

SEQ ID NO: 344907 - protein, 9 aa, Influenza virus
DTVTFNFNG

SEQ ID NO: 344908 - protein, 9 aa, Influenza virus
TITFSFNGA

SEQ ID NO: 344909 - protein, 9 aa, Influenza virus
APDRASFFK

SEQ ID NO: 344910 - protein, 9 aa, Influenza virus
PDRASFFKG

SEQ ID NO: 344911 - protein, 9 aa, Influenza virus
GGTIASSLP

SEQ ID NO: 344912 - protein, 9 aa, Influenza virus
IVSSLPFQS

SEQ ID NO: 344913 - protein, 9 aa, Influenza virus
VSSLPFQSI

SEQ ID NO: 344914 - protein, 9 aa, Influenza virus
SLPFQNISP

SEQ ID NO: 344915 - protein, 9 aa, Influenza virus
LPFQNISPR

SEQ ID NO: 344916 - protein, 9 aa, Influenza virus
TVGKCPRYI

SEQ ID NO: 344917 - protein, 9 aa, Influenza virus
VGKCPRYIK

SEQ ID NO: 344918 - protein, 9 aa, Influenza virus
GKCPKYVKQ

SEQ ID NO: 344919 - protein, 9 aa, Influenza virus
CPRYIKQKS

SEQ ID NO: 344920 - protein, 9 aa, Influenza virus
VKQESLMLA

SEQ ID NO: 344921 - protein, 9 aa, Influenza virus
KQESLMLAT

SEQ ID NO: 344922 - protein, 9 aa, Influenza virus
QESLMLATG

SEQ ID NO: 344923 - protein, 9 aa, Influenza virus
ESLMLATGM

SEQ ID NO: 344924 - protein, 9 aa, Influenza virus
MLATGMKNV

SEQ ID NO: 344925 - protein, 9 aa, Influenza virus
TGMRNIPEN

SEQ ID NO: 344926 - protein, 9 aa, Influenza virus
GMRNIPENP

SEQ ID NO: 344927 - protein, 9 aa, Influenza virus
MRNIPENPK

SEQ ID NO: 344928 - protein, 9 aa, Influenza virus
PKGRGLFGA

SEQ ID NO: 344929 - protein, 9 aa, Influenza virus
KGRGLFGAI

SEQ ID NO: 344930 - protein, 9 aa, Influenza virus
GRGLFGAIA

SEQ ID NO: 344931 - protein, 9 aa, Influenza virus
TGKLNRLIE

SEQ ID NO: 344932 - protein, 9 aa, Influenza virus
GKLNRLIEK

SEQ ID NO: 344933 - protein, 9 aa, Influenza virus
KLNRLIEKT

SEQ ID NO: 344934 - protein, 9 aa, Influenza virus
LNRLIEKTN

SEQ ID NO: 344935 - protein, 9 aa, Influenza virus
NRLISKTNQ

SEQ ID NO: 344936 - protein, 9 aa, Influenza virus
RLIEKTNQQ

SEQ ID NO: 344937 - protein, 9 aa, Influenza virus
LIEKTNQQF

SEQ ID NO: 344938 - protein, 9 aa, Influenza virus
IEKTNQQFE

SEQ ID NO: 344939 - protein, 9 aa, Influenza virus
SKTNQQFEL

SEQ ID NO: 344940 - protein, 9 aa, Influenza virus
NQQFEMIDN

SEQ ID NO: 344941 - protein, 9 aa, Influenza virus
QQFEMIDNE

SEQ ID NO: 344942 - protein, 9 aa, Influenza virus
QFGLIDNEF

SEQ ID NO: 344943 - protein, 9 aa, Influenza virus
FELIDNEFS

SEQ ID NO: 344944 - protein, 9 aa, Influenza virus
ELIDNEFSE

SEQ ID NO: 344945 - protein, 9 aa, Influenza virus
NEFSEIEQQ

SEQ ID NO: 344946 - protein, 9 aa, Influenza virus
EFSEIEQQI

SEQ ID NO: 344947 - protein, 9 aa, Influenza virus
FSEIEQQIG

SEQ ID NO: 344948 - protein, 9 aa, Influenza virus
SEIEQQIGN

SEQ ID NO: 344949 - protein, 9 aa, Influenza virus
VINWTRDSI

SEQ ID NO: 344950 - protein, 9 aa, Influenza virus
INWTRDSIT

SEQ ID NO: 344951 - protein, 9 aa, Influenza virus
NWTRDSITE

SEQ ID NO: 344952 - protein, 9 aa, Influenza virus
WTRDAMTEV

SEQ ID NO: 344953 - protein, 9 aa, Influenza virus
TRDAMTEVW

SEQ ID NO: 344954 - protein, 9 aa, Influenza virus
RDAMTEVWS

SEQ ID NO: 344955 - protein, 9 aa, Influenza virus
DSITEVWSY

SEQ ID NO: 344956 - protein, 9 aa, Influenza virus
SITEVWSYN

SEQ ID NO: 344957 - protein, 9 aa, Influenza virus
IDLTDSEMN

SEQ ID NO: 344958 - protein, 9 aa, Influenza virus
DLTDSEMNK

SEQ ID NO: 344959 - protein, 9 aa, Influenza virus
LADSEMKKL

SEQ ID NO: 344960 - protein, 9 aa, Influenza virus
TDSEMNKLY

SEQ ID NO: 344961 - protein, 9 aa, Influenza virus
DSEIKKLYE

SEQ ID NO: 344962 - protein, 9 aa, Influenza virus
MNKLYERVK

SEQ ID NO: 344963 - protein, 9 aa, Influenza virus
KLYERVKRQ

SEQ ID NO: 344964 - protein, 9 aa, Influenza virus
LYERVKRQL

SEQ ID NO: 344965 - protein, 9 aa, Influenza virus
YERVKRQLR

SEQ ID NO: 344966 - protein, 9 aa, Influenza virus
ERVKRQLRE

SEQ ID NO: 344967 - protein, 9 aa, Influenza virus
RVKRQLREN

SEQ ID NO: 344968 - protein, 9 aa, Influenza virus
VKRQLRENA

SEQ ID NO: 344969 - protein, 9 aa, Influenza virus
KRQLRENAE

SEQ ID NO: 344970 - protein, 9 aa, Influenza virus
EIFHKCDNQ

SEQ ID NO: 344971 - protein, 9 aa, Influenza virus
IFHKCDNQC

SEQ ID NO: 344972 - protein, 9 aa, Influenza virus
FHKCDNQCM

SEQ ID NO: 344973 - protein, 9 aa, Influenza virus
HKCDNQCME

SEQ ID NO: 344974 - protein, 9 aa, Influenza virus
KCDNQCMES

SEQ ID NO: 344975 - protein, 9 aa, Influenza virus
CDNQCMESI

SEQ ID NO: 344976 - protein, 9 aa, Influenza virus
DNQCMESIR

SEQ ID NO: 344977 - protein, 9 aa, Influenza virus
NQCMESIRN

SEQ ID NO: 344978 - protein, 9 aa, Influenza virus
RNNTYNHTQ

SEQ ID NO: 344979 - protein, 9 aa, Influenza virus
NNTYDHTKY

SEQ ID NO: 344980 - protein, 9 aa, Influenza virus
NTYDHTKYR

SEQ ID NO: 344981 - protein, 9 aa, Influenza virus
HSRYREEAM

SEQ ID NO: 344982 - protein, 9 aa, Influenza virus
RYREEAMQN

SEQ ID NO: 344983 - protein, 9 aa, Influenza virus
LQNRIQIDQ

SEQ ID NO: 344984 - protein, 9 aa, Influenza virus
QIDPVKLSG

SEQ ID NO: 344985 - protein, 9 aa, Influenza virus
IDPVKLSGG

SEQ ID NO: 344986 - protein, 9 aa, Influenza virus
DPVKLSGGY

SEQ ID NO: 344987 - protein, 9 aa, Influenza virus
PVKLSGGYK

SEQ ID NO: 344988 - protein, 9 aa, Influenza virus
SCFLLLAVV

SEQ ID NO: 344989 - protein, 9 aa, Influenza virus
  MOD_RES (4)..(4): Leu or Ile
LLAXVMGLV

SEQ ID NO: 344990 - protein, 9 aa, Influenza virus
LTIAMGLVF

SEQ ID NO: 344991 - protein, 9 aa, Influenza virus
AVVMGLVFI

SEQ ID NO: 344992 - protein, 9 aa, Influenza virus
VVMGLVFIC

SEQ ID NO: 344993 - protein, 9 aa, Influenza virus
AMGLVFICV

SEQ ID NO: 344994 - protein, 9 aa, Influenza virus
MGLVFICMK

SEQ ID NO: 344995 - protein, 9 aa, Influenza virus
LVFICMKNG

SEQ ID NO: 344996 - protein, 9 aa, Influenza virus
FICIKNGNV

SEQ ID NO: 344997 - protein, 9 aa, Influenza virus
ICVKNGNMR

SEQ ID NO: 344998 - protein, 9 aa, Influenza virus
CMKNGNMQC

SEQ ID NO: 344999 - protein, 9 aa, Influenza virus
MKNGNMQCT

SEQ ID NO: 345000 - protein, 9 aa, Influenza virus
GSVSLTIAI

SEQ ID NO: 345001 - protein, 9 aa, Influenza virus
CFFMQIAIL

SEQ ID NO: 345002 - protein, 9 aa, Influenza virus
EKNITKIVY

SEQ ID NO: 345003 - protein, 9 aa, Influenza virus
KNITKIVYL

SEQ ID NO: 345004 - protein, 9 aa, Influenza virus
VTETLYLNH

SEQ ID NO: 345005 - protein, 9 aa, Influenza virus
TKIVYLNST

SEQ ID NO: 345006 - protein, 9 aa, Influenza virus
YRIWSKPQC

SEQ ID NO: 345007 - protein, 9 aa, Influenza virus
RIWSKPQCQ

SEQ ID NO: 345008 - protein, 9 aa, Influenza virus
IWSKPQCQI

SEQ ID NO: 345009 - protein, 9 aa, Influenza virus
WSKPQCQIR

SEQ ID NO: 345010 - protein, 9 aa, Influenza virus
SKPQCQIRG

SEQ ID NO: 345011 - protein, 9 aa, Influenza virus
QCRITGFAP

SEQ ID NO: 345012 - protein, 9 aa, Influenza virus
SVRLSASGD

SEQ ID NO: 345013 - protein, 9 aa, Influenza virus
IRLSAGGNI

SEQ ID NO: 345014 - protein, 9 aa, Influenza virus
RLSASGDIW

SEQ ID NO: 345015 - protein, 9 aa, Influenza virus
LSASGDIWI

SEQ ID NO: 345016 - protein, 9 aa, Influenza virus
SAGGNIWIT

SEQ ID NO: 345017 - protein, 9 aa, Influenza virus
ASGDIWITR

SEQ ID NO: 345018 - protein, 9 aa, Influenza virus
GGNIWITRE

SEQ ID NO: 345019 - protein, 9 aa, Influenza virus
GNIWITREP

SEQ ID NO: 345020 - protein, 9 aa, Influenza virus
NIWITREPY

SEQ ID NO: 345021 - protein, 9 aa, Influenza virus
REPYVSCDN

SEQ ID NO: 345022 - protein, 9 aa, Influenza virus
DKCYQFALG

SEQ ID NO: 345023 - protein, 9 aa, Influenza virus
ALGQGTTLN

SEQ ID NO: 345024 - protein, 9 aa, Influenza virus
LGQGTTLNN

SEQ ID NO: 345025 - protein, 9 aa, Influenza virus
GQGTTLENK

SEQ ID NO: 345026 - protein, 9 aa, Influenza virus
QGTTLENKH

SEQ ID NO: 345027 - protein, 9 aa, Influenza virus
GTTLENKHS

SEQ ID NO: 345028 - protein, 9 aa, Influenza virus
TTLENKHSN

SEQ ID NO: 345029 - protein, 9 aa, Influenza virus
TLENKHSNG

SEQ ID NO: 345030 - protein, 9 aa, Influenza virus
LENKHSNGT

SEQ ID NO: 345031 - protein, 9 aa, Influenza virus
SNGTTHDRT

SEQ ID NO: 345032 - protein, 9 aa, Influenza virus
HDRISHRTL

SEQ ID NO: 345033 - protein, 9 aa, Influenza virus
DRISHRTLL

SEQ ID NO: 345034 - protein, 9 aa, Influenza virus
RISHRTLLM

SEQ ID NO: 345035 - protein, 9 aa, Influenza virus
ISHRTLLMN

SEQ ID NO: 345036 - protein, 9 aa, Influenza virus
HVCVTGDDK

SEQ ID NO: 345037 - protein, 9 aa, Influenza virus
ICVTGDDRN

SEQ ID NO: 345038 - protein, 9 aa, Influenza virus
ATASLIYDG

SEQ ID NO: 345039 - protein, 9 aa, Influenza virus
CVCINGTCA

SEQ ID NO: 345040 - protein, 9 aa, Influenza virus
VCINGTCAV

SEQ ID NO: 345041 - protein, 9 aa, Influenza virus
CINGTCAVV

SEQ ID NO: 345042 - protein, 9 aa, Influenza virus
INGTCAVVM

SEQ ID NO: 345043 - protein, 9 aa, Influenza virus
NGTCAVVMT

SEQ ID NO: 345044 - protein, 9 aa, Influenza virus
GSCAVVMTD

SEQ ID NO: 345045 - protein, 9 aa, Influenza virus
TCAVVMTDG

SEQ ID NO: 345046 - protein, 9 aa, Influenza virus
MTDGSASRK

SEQ ID NO: 345047 - protein, 9 aa, Influenza virus
TDGSASRKA

SEQ ID NO: 345048 - protein, 9 aa, Influenza virus
DGSASGRAD

SEQ ID NO: 345049 - protein, 9 aa, Influenza virus
GSASGRADT

SEQ ID NO: 345050 - protein, 9 aa, Influenza virus
ASRKADTRI

SEQ ID NO: 345051 - protein, 9 aa, Influenza virus
EGKISHISP

SEQ ID NO: 345052 - protein, 9 aa, Influenza virus
GKISHISPL

SEQ ID NO: 345053 - protein, 9 aa, Influenza virus
KISHISPLS

SEQ ID NO: 345054 - protein, 9 aa, Influenza virus
ISHISPLSG

SEQ ID NO: 345055 - protein, 9 aa, Influenza virus
SHISPLSGS

SEQ ID NO: 345056 - protein, 9 aa, Influenza virus
GSNRPVVDI

SEQ ID NO: 345057 - protein, 9 aa, Influenza virus
SNRPVVDIN

SEQ ID NO: 345058 - protein, 9 aa, Influenza virus
IDSSYMCSG

SEQ ID NO: 345059 - protein, 9 aa, Influenza virus
GSSYVCSGL

SEQ ID NO: 345060 - protein, 9 aa, Influenza virus
PRNEDSSSN

SEQ ID NO: 345061 - protein, 9 aa, Influenza virus
RNDDSSSNS

SEQ ID NO: 345062 - protein, 9 aa, Influenza virus
NEDSSSNSN

SEQ ID NO: 345063 - protein, 9 aa, Influenza virus
EDSSSNSNC

SEQ ID NO: 345064 - protein, 9 aa, Influenza virus
SNSNCRDPN

SEQ ID NO: 345065 - protein, 9 aa, Influenza virus
SNCKDPNNE

SEQ ID NO: 345066 - protein, 9 aa, Influenza virus
DPNNEKGNP

SEQ ID NO: 345067 - protein, 9 aa, Influenza virus
PNNEKGNPG

SEQ ID NO: 345068 - protein, 9 aa, Influenza virus
NNEKGNPGV

SEQ ID NO: 345069 - protein, 9 aa, Influenza virus
NEKGNPGVK

SEQ ID NO: 345070 - protein, 9 aa, Influenza virus
KGWAFDNGN

SEQ ID NO: 345071 - protein, 9 aa, Influenza virus
GWAFDYGSD

SEQ ID NO: 345072 - protein, 9 aa, Influenza virus
YGSDVWMGR

SEQ ID NO: 345073 - protein, 9 aa, Influenza virus
GYETFKVIG

SEQ ID NO: 345074 - protein, 9 aa, Influenza virus
YETFKVIGG

SEQ ID NO: 345075 - protein, 9 aa, Influenza virus
ETFKVIGGW

SEQ ID NO: 345076 - protein, 9 aa, Influenza virus
TFRVIDGWT

SEQ ID NO: 345077 - protein, 9 aa, Influenza virus
VISGWTTAN

SEQ ID NO: 345078 - protein, 9 aa, Influenza virus
ISGWTTANS

SEQ ID NO: 345079 - protein, 9 aa, Influenza virus
SGWTTANSK

SEQ ID NO: 345080 - protein, 9 aa, Influenza virus
WTTANSKSK

SEQ ID NO: 345081 - protein, 9 aa, Influenza virus
RQVIVDNNS

SEQ ID NO: 345082 - protein, 9 aa, Influenza virus
QVIVDNNSW

SEQ ID NO: 345083 - protein, 9 aa, Influenza virus
IVDNNSWSG

SEQ ID NO: 345084 - protein, 9 aa, Influenza virus
VDNNSWSGY

SEQ ID NO: 345085 - protein, 9 aa, Influenza virus
DNNSWSGYS

SEQ ID NO: 345086 - protein, 9 aa, Influenza virus
NSWSGYSGI

SEQ ID NO: 345087 - protein, 9 aa, Influenza virus
LIRGRPQEN

SEQ ID NO: 345088 - protein, 9 aa, Influenza virus
PQEDRVWWT

SEQ ID NO: 345089 - protein, 9 aa, Influenza virus
QETKVWWTS

SEQ ID NO: 345090 - protein, 9 aa, Influenza virus
ETGVWWTSN

SEQ ID NO: 345091 - protein, 9 aa, Influenza virus
TKVWWTSNS

SEQ ID NO: 345092 - protein, 9 aa, Influenza virus
WPDGANINL

SEQ ID NO: 345093 - protein, 9 aa, Influenza virus
PDGANIDFV

SEQ ID NO: 345094 - protein, 9 aa, Influenza virus
DGANINLMP

SEQ ID NO: 345095 - protein, 9 aa, Influenza virus
YKMNTQILI

SEQ ID NO: 345096 - protein, 9 aa, Influenza virus
KMNTQILIF

SEQ ID NO: 345097 - protein, 9 aa, Influenza virus
ICLGHHAVT

SEQ ID NO: 345098 - protein, 9 aa, Influenza virus
CLGHHAVTN

SEQ ID NO: 345099 - protein, 9 aa, Influenza virus
LGHHAVTNG

SEQ ID NO: 345100 - protein, 9 aa, Influenza virus
GHHAVTNGT

SEQ ID NO: 345101 - protein, 9 aa, Influenza virus
HHAVANGTR

SEQ ID NO: 345102 - protein, 9 aa, Influenza virus
HAVANGTRV

SEQ ID NO: 345103 - protein, 9 aa, Influenza virus
GTKVNTLAE

SEQ ID NO: 345104 - protein, 9 aa, Influenza virus
VDTLTEKGI

SEQ ID NO: 345105 - protein, 9 aa, Influenza virus
DTLTEKGIE

SEQ ID NO: 345106 - protein, 9 aa, Influenza virus
TLTGRGIEV

SEQ ID NO: 345107 - protein, 9 aa, Influenza virus
LTGRGIEVV

SEQ ID NO: 345108 - protein, 9 aa, Influenza virus
TERGVEVVD

SEQ ID NO: 345109 - protein, 9 aa, Influenza virus
ERGVEVVDA

SEQ ID NO: 345110 - protein, 9 aa, Influenza virus
RGVEVVDAT

SEQ ID NO: 345111 - protein, 9 aa, Influenza virus
VNATETVEQ

SEQ ID NO: 345112 - protein, 9 aa, Influenza virus
TDLGQCGIL

SEQ ID NO: 345113 - protein, 9 aa, Influenza virus
MGQCGLLGT

SEQ ID NO: 345114 - protein, 9 aa, Influenza virus
GQCGILGIL

SEQ ID NO: 345115 - protein, 9 aa, Influenza virus
CGILGILTG

SEQ ID NO: 345116 - protein, 9 aa, Influenza virus
GILGILTGP

SEQ ID NO: 345117 - protein, 9 aa, Influenza virus
ILGILTGPP

SEQ ID NO: 345118 - protein, 9 aa, Influenza virus
LGILTGPPQ

SEQ ID NO: 345119 - protein, 9 aa, Influenza virus
GILTGPPQC

SEQ ID NO: 345120 - protein, 9 aa, Influenza virus
ILTGPPQCD

SEQ ID NO: 345121 - protein, 9 aa, Influenza virus
IGPPQCDRF

SEQ ID NO: 345122 - protein, 9 aa, Influenza virus
DLIVERQDG

SEQ ID NO: 345123 - protein, 9 aa, Influenza virus
DVCYPGKFS

SEQ ID NO: 345124 - protein, 9 aa, Influenza virus
VCYPGKFSN

SEQ ID NO: 345125 - protein, 9 aa, Influenza virus
LRQVLRESG

SEQ ID NO: 345126 - protein, 9 aa, Influenza virus
RQVLRESGG

SEQ ID NO: 345127 - protein, 9 aa, Influenza virus
QVLRESGGI

SEQ ID NO: 345128 - protein, 9 aa, Influenza virus
GFTYSEIRT

SEQ ID NO: 345129 - protein, 9 aa, Influenza virus
DSSFYAEMK

SEQ ID NO: 345130 - protein, 9 aa, Influenza virus
EMKWLLSNA

SEQ ID NO: 345131 - protein, 9 aa, Influenza virus
MKWLLSNAD

SEQ ID NO: 345132 - protein, 9 aa, Influenza virus
KWLLSNADN

SEQ ID NO: 345133 - protein, 9 aa, Influenza virus
PALIVWGVH

SEQ ID NO: 345134 - protein, 9 aa, Influenza virus
ALIVWGVHH

SEQ ID NO: 345135 - protein, 9 aa, Influenza virus
LIVWGVHHS

SEQ ID NO: 345136 - protein, 9 aa, Influenza virus
EQTKLYGNG

SEQ ID NO: 345137 - protein, 9 aa, Influenza virus
KLYGSGSKL

SEQ ID NO: 345138 - protein, 9 aa, Influenza virus
LYGSGNKLV

SEQ ID NO: 345139 - protein, 9 aa, Influenza virus
YGSGNKLVT

SEQ ID NO: 345140 - protein, 9 aa, Influenza virus
GSGNKLVTV

SEQ ID NO: 345141 - protein, 9 aa, Influenza virus
SSKCQQSFT

SEQ ID NO: 345142 - protein, 9 aa, Influenza virus
SKCQQSFTP

SEQ ID NO: 345143 - protein, 9 aa, Influenza virus
LQSFTPSPG

SEQ ID NO: 345144 - protein, 9 aa, Influenza virus
QSFVPSPGS

SEQ ID NO: 345145 - protein, 9 aa, Influenza virus
SFTPSPGTR

SEQ ID NO: 345146 - protein, 9 aa, Influenza virus
PVNGQSGRI

SEQ ID NO: 345147 - protein, 9 aa, Influenza virus
VNGQSGRIN

SEQ ID NO: 345148 - protein, 9 aa, Influenza virus
NGQSGRINF

SEQ ID NO: 345149 - protein, 9 aa, Influenza virus
GQSGRINFH

SEQ ID NO: 345150 - protein, 9 aa, Influenza virus
QSGRINFHW

SEQ ID NO: 345151 - protein, 9 aa, Influenza virus
SGRINFHWL

SEQ ID NO: 345152 - protein, 9 aa, Influenza virus
FHWLMLNSN

SEQ ID NO: 345153 - protein, 9 aa, Influenza virus
WLMLNPNGT

SEQ ID NO: 345154 - protein, 9 aa, Influenza virus
MLNPNDTIT

SEQ ID NO: 345155 - protein, 9 aa, Influenza virus
LNPNDTVIF

SEQ ID NO: 345156 - protein, 9 aa, Influenza virus
NDTITFSFN

SEQ ID NO: 345157 - protein, 9 aa, Influenza virus
DTITFSFNG

SEQ ID NO: 345158 - protein, 9 aa, Influenza virus
GSFNGAFIA

SEQ ID NO: 345159 - protein, 9 aa, Influenza virus
NFNGAFIAP

SEQ ID NO: 345160 - protein, 9 aa, Influenza virus
AFVAPDRVS

SEQ ID NO: 345161 - protein, 9 aa, Influenza virus
FVAPDRVSF

SEQ ID NO: 345162 - protein, 9 aa, Influenza virus
IAPDRATFL

SEQ ID NO: 345163 - protein, 9 aa, Influenza virus
GGTITSNLP

SEQ ID NO: 345164 - protein, 9 aa, Influenza virus
GTITSNLPF

SEQ ID NO: 345165 - protein, 9 aa, Influenza virus
TITSNLPFQ

SEQ ID NO: 345166 - protein, 9 aa, Influenza virus
ITSNLPFQN

SEQ ID NO: 345167 - protein, 9 aa, Influenza virus
TSNLPFQNV

SEQ ID NO: 345168 - protein, 9 aa, Influenza virus
SNLPFQNVN

SEQ ID NO: 345169 - protein, 9 aa, Influenza virus
PLPFQNINP

SEQ ID NO: 345170 - protein, 9 aa, Influenza virus
PFQNVNSRA

SEQ ID NO: 345171 - protein, 9 aa, Influenza virus
VGRCPRYVK

SEQ ID NO: 345172 - protein, 9 aa, Influenza virus
TGMRNVPEK

SEQ ID NO: 345173 - protein, 9 aa, Influenza virus
GMRNVPEKP

SEQ ID NO: 345174 - protein, 9 aa, Influenza virus
MRNVPEKPK

SEQ ID NO: 345175 - protein, 9 aa, Influenza virus
RRRGLFGAI

SEQ ID NO: 345176 - protein, 9 aa, Influenza virus
AYQKRMTRG

SEQ ID NO: 345177 - protein, 9 aa, Influenza virus
YQKRMTRGL

SEQ ID NO: 345178 - protein, 9 aa, Influenza virus
QKRMTRGLF

SEQ ID NO: 345179 - protein, 9 aa, Influenza virus
KQMTRGLFG

SEQ ID NO: 345180 - protein, 9 aa, Influenza virus
QMTRGLFGA

SEQ ID NO: 345181 - protein, 9 aa, Influenza virus
LIDGWYGFK

SEQ ID NO: 345182 - protein, 9 aa, Influenza virus
IDGWYGFKH

SEQ ID NO: 345183 - protein, 9 aa, Influenza virus
YKSTPSAID

SEQ ID NO: 345184 - protein, 9 aa, Influenza virus
KSTPSAIDQ

SEQ ID NO: 345185 - protein, 9 aa, Influenza virus
STPSAIDQI

SEQ ID NO: 345186 - protein, 9 aa, Influenza virus
TPSAIDQIT

SEQ ID NO: 345187 - protein, 9 aa, Influenza virus
PSAIDQITG

SEQ ID NO: 345188 - protein, 9 aa, Influenza virus
TGKLNRFIE

SEQ ID NO: 345189 - protein, 9 aa, Influenza virus
GKLNRLIDR

SEQ ID NO: 345190 - protein, 9 aa, Influenza virus
KLNRFIEKT

SEQ ID NO: 345191 - protein, 9 aa, Influenza virus
LNRLIDRTN

SEQ ID NO: 345192 - protein, 9 aa, Influenza virus
NRLIDRTNH

SEQ ID NO: 345193 - protein, 9 aa, Influenza virus
RFIEKTNQQ

SEQ ID NO: 345194 - protein, 9 aa, Influenza virus
LIDRTNHQF

SEQ ID NO: 345195 - protein, 9 aa, Influenza virus
IDRTNHQFE

SEQ ID NO: 345196 - protein, 9 aa, Influenza virus
EKTNQQFKL

SEQ ID NO: 345197 - protein, 9 aa, Influenza virus
TNHQFELID

SEQ ID NO: 345198 - protein, 9 aa, Influenza virus
NHQFELIDN

SEQ ID NO: 345199 - protein, 9 aa, Influenza virus
HQFELIDNE

SEQ ID NO: 345200 - protein, 9 aa, Influenza virus
IDNEFIEVE

SEQ ID NO: 345201 - protein, 9 aa, Influenza virus
FIEVEKQIG

SEQ ID NO: 345202 - protein, 9 aa, Influenza virus
IEVEKQIGN

SEQ ID NO: 345203 - protein, 9 aa, Influenza virus
VINWTRDAM

SEQ ID NO: 345204 - protein, 9 aa, Influenza virus
WTRDSVTEL

SEQ ID NO: 345205 - protein, 9 aa, Influenza virus
TRDSVTELW

SEQ ID NO: 345206 - protein, 9 aa, Influenza virus
RDSVTELWS

SEQ ID NO: 345207 - protein, 9 aa, Influenza virus
DSVTELWSY

SEQ ID NO: 345208 - protein, 9 aa, Influenza virus
SVTELWSYN

SEQ ID NO: 345209 - protein, 9 aa, Influenza virus
VTELWSYNA

SEQ ID NO: 345210 - protein, 9 aa, Influenza virus
DLADSEMSK

SEQ ID NO: 345211 - protein, 9 aa, Influenza virus
QADSEMNKL

SEQ ID NO: 345212 - protein, 9 aa, Influenza virus
ADSEMNKLH

SEQ ID NO: 345213 - protein, 9 aa, Influenza virus
DSEMSKLYE

SEQ ID NO: 345214 - protein, 9 aa, Influenza virus
SEMNKLHER

SEQ ID NO: 345215 - protein, 9 aa, Influenza virus
EMDKLYTRV

SEQ ID NO: 345216 - protein, 9 aa, Influenza virus
KLYERVKKQ

SEQ ID NO: 345217 - protein, 9 aa, Influenza virus
LYERVKKQL

SEQ ID NO: 345218 - protein, 9 aa, Influenza virus
HERVRKQLR

SEQ ID NO: 345219 - protein, 9 aa, Influenza virus
TRVKRQLRE

SEQ ID NO: 345220 - protein, 9 aa, Influenza virus
IRNNTYDHN

SEQ ID NO: 345221 - protein, 9 aa, Influenza virus
QYRAESLQN

SEQ ID NO: 345222 - protein, 9 aa, Influenza virus
REEAMQNRM

SEQ ID NO: 345223 - protein, 9 aa, Influenza virus
EAMQNRMQI

SEQ ID NO: 345224 - protein, 9 aa, Influenza virus
QNRMQINPV

SEQ ID NO: 345225 - protein, 9 aa, Influenza virus
NRMQINPVK

SEQ ID NO: 345226 - protein, 9 aa, Influenza virus
RMQINPVKL

SEQ ID NO: 345227 - protein, 9 aa, Influenza virus
DPVKLSNGY

SEQ ID NO: 345228 - protein, 9 aa, Influenza virus
PVKLSNGYK

SEQ ID NO: 345229 - protein, 9 aa, Influenza virus
VKLNSGYKD

SEQ ID NO: 345230 - protein, 9 aa, Influenza virus
SGGYKDIIL

SEQ ID NO: 345231 - protein, 9 aa, Influenza virus
GGYKDIILW

SEQ ID NO: 345232 - protein, 9 aa, Influenza virus
SFGASCFVL

SEQ ID NO: 345233 - protein, 9 aa, Influenza virus
FGASCFLFL

SEQ ID NO: 345234 - protein, 9 aa, Influenza virus
GASCFLFLA

SEQ ID NO: 345235 - protein, 9 aa, Influenza virus
ASCFLFLAI

SEQ ID NO: 345236 - protein, 9 aa, Influenza virus
YICVKNGNM

SEQ ID NO: 345237 - protein, 9 aa, Influenza virus
ICVKNGNHA

SEQ ID NO: 345238 - protein, 9 aa, Influenza virus
GVVNTALST

SEQ ID NO: 345239 - protein, 9 aa, Influenza virus
VVNTALSTI

SEQ ID NO: 345240 - protein, 9 aa, Influenza virus
TALSTIALL

SEQ ID NO: 345241 - protein, 9 aa, Influenza virus
VLSIIALLI

SEQ ID NO: 345242 - protein, 9 aa, Influenza virus
LSTKALLIG

SEQ ID NO: 345243 - protein, 9 aa, Influenza virus
STIALFIGV

SEQ ID NO: 345244 - protein, 9 aa, Influenza virus
TIALFIGVG

SEQ ID NO: 345245 - protein, 9 aa, Influenza virus
IALFIGVGN

SEQ ID NO: 345246 - protein, 9 aa, Influenza virus
ALFIGVGNL

SEQ ID NO: 345247 - protein, 9 aa, Influenza virus
IGVGNLAFN

SEQ ID NO: 345248 - protein, 9 aa, Influenza virus
GVGNLAFNT

SEQ ID NO: 345249 - protein, 9 aa, Influenza virus
VGNLAFNTV

SEQ ID NO: 345250 - protein, 9 aa, Influenza virus
LAFNTVIHE

SEQ ID NO: 345251 - protein, 9 aa, Influenza virus
ITYNKTVIN

SEQ ID NO: 345252 - protein, 9 aa, Influenza virus
TYNKTVINN

SEQ ID NO: 345253 - protein, 9 aa, Influenza virus
YNKTVINNI

SEQ ID NO: 345254 - protein, 9 aa, Influenza virus
NKTVINNIT

SEQ ID NO: 345255 - protein, 9 aa, Influenza virus
KTVINNITT

SEQ ID NO: 345256 - protein, 9 aa, Influenza virus
INNITTTIT

SEQ ID NO: 345257 - protein, 9 aa, Influenza virus
NNMTTTIIN

SEQ ID NO: 345258 - protein, 9 aa, Influenza virus
FKPSLPLCP

SEQ ID NO: 345259 - protein, 9 aa, Influenza virus
KPSLPLCPF

SEQ ID NO: 345260 - protein, 9 aa, Influenza virus
SLPLCPFKG

SEQ ID NO: 345261 - protein, 9 aa, Influenza virus
NSARLIHHT

SEQ ID NO: 345262 - protein, 9 aa, Influenza virus
NVIVTREPY

SEQ ID NO: 345263 - protein, 9 aa, Influenza virus
VLVTREPYI

SEQ ID NO: 345264 - protein, 9 aa, Influenza virus
LVTREPYIS

SEQ ID NO: 345265 - protein, 9 aa, Influenza virus
GCWSFALAQ

SEQ ID NO: 345266 - protein, 9 aa, Influenza virus
AQGALLGTR

SEQ ID NO: 345267 - protein, 9 aa, Influenza virus
QGALLGTRH

SEQ ID NO: 345268 - protein, 9 aa, Influenza virus
GALLGTRHS

SEQ ID NO: 345269 - protein, 9 aa, Influenza virus
ALLGTRHSN

SEQ ID NO: 345270 - protein, 9 aa, Influenza virus
LLGTRHSNG

SEQ ID NO: 345271 - protein, 9 aa, Influenza virus
LGTRHSNGT

SEQ ID NO: 345272 - protein, 9 aa, Influenza virus
HSNGTINDR

SEQ ID NO: 345273 - protein, 9 aa, Influenza virus
NDRTPYRSL

SEQ ID NO: 345274 - protein, 9 aa, Influenza virus
KTPYRSLIR

SEQ ID NO: 345275 - protein, 9 aa, Influenza virus
YRSLIRFPV

SEQ ID NO: 345276 - protein, 9 aa, Influenza virus
RSLIRFPVG

SEQ ID NO: 345277 - protein, 9 aa, Influenza virus
SLIQFPIGT

SEQ ID NO: 345278 - protein, 9 aa, Influenza virus
LIQFPMGTA

SEQ ID NO: 345279 - protein, 9 aa, Influenza virus
IQFPMGTAP

SEQ ID NO: 345280 - protein, 9 aa, Influenza virus
FPVGTAPVL

SEQ ID NO: 345281 - protein, 9 aa, Influenza virus
PVGTAPVLG

SEQ ID NO: 345282 - protein, 9 aa, Influenza virus
IGTAPILGN

SEQ ID NO: 345283 - protein, 9 aa, Influenza virus
TAPILGNYK

SEQ ID NO: 345284 - protein, 9 aa, Influenza virus
PVLGNYREV

SEQ ID NO: 345285 - protein, 9 aa, Influenza virus
VLGNYREVC

SEQ ID NO: 345286 - protein, 9 aa, Influenza virus
LGNYREVCI

SEQ ID NO: 345287 - protein, 9 aa, Influenza virus
GNYKEMCAA

SEQ ID NO: 345288 - protein, 9 aa, Influenza virus
NYREVCIAW

SEQ ID NO: 345289 - protein, 9 aa, Influenza virus
YREVCIAWS

SEQ ID NO: 345290 - protein, 9 aa, Influenza virus
KEMCAAWSS

SEQ ID NO: 345291 - protein, 9 aa, Influenza virus
EMCAAWSSS

SEQ ID NO: 345292 - protein, 9 aa, Influenza virus
IRIAWSSSS

SEQ ID NO: 345293 - protein, 9 aa, Influenza virus
RIAWSSSSC

SEQ ID NO: 345294 - protein, 9 aa, Influenza virus
GKEWMHICM

SEQ ID NO: 345295 - protein, 9 aa, Influenza virus
KEWMHVCMA

SEQ ID NO: 345296 - protein, 9 aa, Influenza virus
EWMHICMTG

SEQ ID NO: 345297 - protein, 9 aa, Influenza virus
GRVTDSIKS

SEQ ID NO: 345298 - protein, 9 aa, Influenza virus
RMADSIKSW

SEQ ID NO: 345299 - protein, 9 aa, Influenza virus
VTDSIKSWR

SEQ ID NO: 345300 - protein, 9 aa, Influenza virus
SDSIKSWRK

SEQ ID NO: 345301 - protein, 9 aa, Influenza virus
QESECQRID

SEQ ID NO: 345302 - protein, 9 aa, Influenza virus
ESECQRIDG

SEQ ID NO: 345303 - protein, 9 aa, Influenza virus
GTCIVAVTD

SEQ ID NO: 345304 - protein, 9 aa, Influenza virus
TCIVAVTDG

SEQ ID NO: 345305 - protein, 9 aa, Influenza virus
AANNADHRV

SEQ ID NO: 345306 - protein, 9 aa, Influenza virus
ANSAHHRVY

SEQ ID NO: 345307 - protein, 9 aa, Influenza virus
NNADHRVYW

SEQ ID NO: 345308 - protein, 9 aa, Influenza virus
KADHRIYWI

SEQ ID NO: 345309 - protein, 9 aa, Influenza virus
DHRIYWIKE

SEQ ID NO: 345310 - protein, 9 aa, Influenza virus
RIYWIREGK

SEQ ID NO: 345311 - protein, 9 aa, Influenza virus
KIRHLEECS

SEQ ID NO: 345312 - protein, 9 aa, Influenza virus
EECSCYVDT

SEQ ID NO: 345313 - protein, 9 aa, Influenza virus
ECSCYVDVD

SEQ ID NO: 345314 - protein, 9 aa, Influenza virus
CSCYVDTDV

SEQ ID NO: 345315 - protein, 9 aa, Influenza virus
SCYVDTDVY

SEQ ID NO: 345316 - protein, 9 aa, Influenza virus
CYVDTDVYC

SEQ ID NO: 345317 - protein, 9 aa, Influenza virus
DTDVYCICR

SEQ ID NO: 345318 - protein, 9 aa, Influenza virus
VDVYCICRD

SEQ ID NO: 345319 - protein, 9 aa, Influenza virus
SNRPWVRIN

SEQ ID NO: 345320 - protein, 9 aa, Influenza virus
NRPWVRMNN

SEQ ID NO: 345321 - protein, 9 aa, Influenza virus
RPWVRINNE

SEQ ID NO: 345322 - protein, 9 aa, Influenza virus
PWVRMNNET

SEQ ID NO: 345323 - protein, 9 aa, Influenza virus
WVRMNNETI

SEQ ID NO: 345324 - protein, 9 aa, Influenza virus
VRMNNETIL

SEQ ID NO: 345325 - protein, 9 aa, Influenza virus
FHSDTPRPV

SEQ ID NO: 345326 - protein, 9 aa, Influenza virus
HSDTPRPVD

SEQ ID NO: 345327 - protein, 9 aa, Influenza virus
SDTPRPVDP

SEQ ID NO: 345328 - protein, 9 aa, Influenza virus
DTPRPVDPS

SEQ ID NO: 345329 - protein, 9 aa, Influenza virus
DPSIMSCDS

SEQ ID NO: 345330 - protein, 9 aa, Influenza virus
PSIMSCDSP

SEQ ID NO: 345331 - protein, 9 aa, Influenza virus
SIMSCDSPS

SEQ ID NO: 345332 - protein, 9 aa, Influenza virus
IMSCDSPSN

SEQ ID NO: 345333 - protein, 9 aa, Influenza virus
SCSSPSGIE

SEQ ID NO: 345334 - protein, 9 aa, Influenza virus
CSSPSGIEG

SEQ ID NO: 345335 - protein, 9 aa, Influenza virus
DSPSNVKGG

SEQ ID NO: 345336 - protein, 9 aa, Influenza virus
KGGPGVKGF

SEQ ID NO: 345337 - protein, 9 aa, Influenza virus
GVKGFGFKV

SEQ ID NO: 345338 - protein, 9 aa, Influenza virus
VKGFGFKVG

SEQ ID NO: 345339 - protein, 9 aa, Influenza virus
WLGRTVSIN

SEQ ID NO: 345340 - protein, 9 aa, Influenza virus
LGRTVSING

SEQ ID NO: 345341 - protein, 9 aa, Influenza virus
GRTVSINGR

SEQ ID NO: 345342 - protein, 9 aa, Influenza virus
RTVSISGRS

SEQ ID NO: 345343 - protein, 9 aa, Influenza virus
SGRSSFEII

SEQ ID NO: 345344 - protein, 9 aa, Influenza virus
RSGFEIIRV

SEQ ID NO: 345345 - protein, 9 aa, Influenza virus
VTEGWIDSP

SEQ ID NO: 345346 - protein, 9 aa, Influenza virus
EGWIDSPNH

SEQ ID NO: 345347 - protein, 9 aa, Influenza virus
GWIDSPNHA

SEQ ID NO: 345348 - protein, 9 aa, Influenza virus
WIDSPNHAK

SEQ ID NO: 345349 - protein, 9 aa, Influenza virus
IDSPNHAKS

SEQ ID NO: 345350 - protein, 9 aa, Influenza virus
AKSLTQTLV

SEQ ID NO: 345351 - protein, 9 aa, Influenza virus
ATQTLVSNN

SEQ ID NO: 345352 - protein, 9 aa, Influenza virus
KGCFQPCFY

SEQ ID NO: 345353 - protein, 9 aa, Influenza virus
YVELIRGRL

SEQ ID NO: 345354 - protein, 9 aa, Influenza virus
VELIRGRLN

SEQ ID NO: 345355 - protein, 9 aa, Influenza virus
NDDVSWASN

SEQ ID NO: 345356 - protein, 9 aa, Influenza virus
DDVSWASNS

SEQ ID NO: 345357 - protein, 9 aa, Influenza virus
DVSWASNSI

SEQ ID NO: 345358 - protein, 9 aa, Influenza virus
YKMNTQILI

SEQ ID NO: 345359 - protein, 9 aa, Influenza virus
KMNIQILIL

SEQ ID NO: 345360 - protein, 9 aa, Influenza virus
KICLGHHAE

SEQ ID NO: 345361 - protein, 9 aa, Influenza virus
NGIKVDTLT

SEQ ID NO: 345362 - protein, 9 aa, Influenza virus
GAKVNTLTE

SEQ ID NO: 345363 - protein, 9 aa, Influenza virus
AKVNTLTER

SEQ ID NO: 345364 - protein, 9 aa, Influenza virus
KVNTLTEKG

SEQ ID NO: 345365 - protein, 9 aa, Influenza virus
VNTLTEKGI

SEQ ID NO: 345366 - protein, 9 aa, Influenza virus
NTLTEKGIE

SEQ ID NO: 345367 - protein, 9 aa, Influenza virus
TLTEREVEV

SEQ ID NO: 345368 - protein, 9 aa, Influenza virus
LTEREVEVV

SEQ ID NO: 345369 - protein, 9 aa, Influenza virus
TEREVEVVN

SEQ ID NO: 345370 - protein, 9 aa, Influenza virus
EREVEVVNA

SEQ ID NO: 345371 - protein, 9 aa, Influenza virus
REVEVVNAT

SEQ ID NO: 345372 - protein, 9 aa, Influenza virus
DLGRCGLLG

SEQ ID NO: 345373 - protein, 9 aa, Influenza virus
LGRCGLLGT

SEQ ID NO: 345374 - protein, 9 aa, Influenza virus
IGPPQCDLF

SEQ ID NO: 345375 - protein, 9 aa, Influenza virus
DLIIERRDG

SEQ ID NO: 345376 - protein, 9 aa, Influenza virus
EETLRKILR

SEQ ID NO: 345377 - protein, 9 aa, Influenza virus
LRKILRKSG

SEQ ID NO: 345378 - protein, 9 aa, Influenza virus
RKILRKSGG

SEQ ID NO: 345379 - protein, 9 aa, Influenza virus
MRFTYSGIR

SEQ ID NO: 345380 - protein, 9 aa, Influenza virus
FTYTGVRTD

SEQ ID NO: 345381 - protein, 9 aa, Influenza virus
TYTGVRTDG

SEQ ID NO: 345382 - protein, 9 aa, Influenza virus
RSGPSFYAE

SEQ ID NO: 345383 - protein, 9 aa, Influenza virus
SGPSFYAEM

SEQ ID NO: 345384 - protein, 9 aa, Influenza virus
GPSFYAEMK

SEQ ID NO: 345385 - protein, 9 aa, Influenza virus
AEMKWLLSD

SEQ ID NO: 345386 - protein, 9 aa, Influenza virus
FPQMTRSYK

SEQ ID NO: 345387 - protein, 9 aa, Influenza virus
PQMTRSYKN

SEQ ID NO: 345388 - protein, 9 aa, Influenza virus
PALITWGIH

SEQ ID NO: 345389 - protein, 9 aa, Influenza virus
ALITWGIHH

SEQ ID NO: 345390 - protein, 9 aa, Influenza virus
EQIKLYGSG

SEQ ID NO: 345391 - protein, 9 aa, Influenza virus
TVWSSKYQR

SEQ ID NO: 345392 - protein, 9 aa, Influenza virus
VWSSKYQRS

SEQ ID NO: 345393 - protein, 9 aa, Influenza virus
RPPVNGQSG

SEQ ID NO: 345394 - protein, 9 aa, Influenza virus
PPVNGQSGR

SEQ ID NO: 345395 - protein, 9 aa, Influenza virus
PVNGQSGRI

SEQ ID NO: 345396 - protein, 9 aa, Influenza virus
NDTVNFSFN

SEQ ID NO: 345397 - protein, 9 aa, Influenza virus
DTVNFSFNG

SEQ ID NO: 345398 - protein, 9 aa, Influenza virus
TVNFSFNGA

SEQ ID NO: 345399 - protein, 9 aa, Influenza virus
VNFSFNGAF

SEQ ID NO: 345400 - protein, 9 aa, Influenza virus
NFSFNGAFI

SEQ ID NO: 345401 - protein, 9 aa, Influenza virus
FNFNGAFVA

SEQ ID NO: 345402 - protein, 9 aa, Influenza virus
NFNGAFVAP

SEQ ID NO: 345403 - protein, 9 aa, Influenza virus
AFVAPDRAS

SEQ ID NO: 345404 - protein, 9 aa, Influenza virus
FVAPDRASF

SEQ ID NO: 345405 - protein, 9 aa, Influenza virus
SKLPFQNIN

SEQ ID NO: 345406 - protein, 9 aa, Influenza virus
PFQNVNSRA

SEQ ID NO: 345407 - protein, 9 aa, Influenza virus
VGRCPRYVK

SEQ ID NO: 345408 - protein, 9 aa, Influenza virus
GECPRYVKQ

SEQ ID NO: 345409 - protein, 9 aa, Influenza virus
KKKKKKRGL

SEQ ID NO: 345410 - protein, 9 aa, Influenza virus
KKRRKRGLF

SEQ ID NO: 345411 - protein, 9 aa, Influenza virus
KKRGLFGAI

SEQ ID NO: 345412 - protein, 9 aa, Influenza virus
LIDGWYGYK

SEQ ID NO: 345413 - protein, 9 aa, Influenza virus
IDGWYGYKH

SEQ ID NO: 345414 - protein, 9 aa, Influenza virus
GWYGFRHQK

SEQ ID NO: 345415 - protein, 9 aa, Influenza virus
WYGFRHQNS

SEQ ID NO: 345416 - protein, 9 aa, Influenza virus
YGFRHQNSQ

SEQ ID NO: 345417 - protein, 9 aa, Influenza virus
GYKHQNAQG

SEQ ID NO: 345418 - protein, 9 aa, Influenza virus
YKHQNAQGE

SEQ ID NO: 345419 - protein, 9 aa, Influenza virus
QAAIDQITG

SEQ ID NO: 345420 - protein, 9 aa, Influenza virus
SAIDQITGT

SEQ ID NO: 345421 - protein, 9 aa, Influenza virus
AIDQITRKL

SEQ ID NO: 345422 - protein, 9 aa, Influenza virus
VNQITGKLN

SEQ ID NO: 345423 - protein, 9 aa, Influenza virus
GTLNRLIDK

SEQ ID NO: 345424 - protein, 9 aa, Influenza virus
DKTNQQFEM

SEQ ID NO: 345425 - protein, 9 aa, Influenza virus
FEMIDNEFN

SEQ ID NO: 345426 - protein, 9 aa, Influenza virus
EMIDNEFNE

SEQ ID NO: 345427 - protein, 9 aa, Influenza virus
IDNEFSEVE

SEQ ID NO: 345428 - protein, 9 aa, Influenza virus
EVERQIGNV

SEQ ID NO: 345429 - protein, 9 aa, Influenza virus
VERQIGNVI

SEQ ID NO: 345430 - protein, 9 aa, Influenza virus
EKQLGNVIN

SEQ ID NO: 345431 - protein, 9 aa, Influenza virus
KQLGNVINW

SEQ ID NO: 345432 - protein, 9 aa, Influenza virus
INWTRDSLT

SEQ ID NO: 345433 - protein, 9 aa, Influenza virus
NWTRDSLTE

SEQ ID NO: 345434 - protein, 9 aa, Influenza virus
TEMWSYNAE

SEQ ID NO: 345435 - protein, 9 aa, Influenza virus
EMWSYNAEL

SEQ ID NO: 345436 - protein, 9 aa, Influenza virus
MWSYNAELL

SEQ ID NO: 345437 - protein, 9 aa, Influenza virus
WSYNAELLI

SEQ ID NO: 345438 - protein, 9 aa, Influenza virus
SYNADLLVA

SEQ ID NO: 345439 - protein, 9 aa, Influenza virus
YNAELLIAM

SEQ ID NO: 345440 - protein, 9 aa, Influenza virus
NADLLVAME

SEQ ID NO: 345441 - protein, 9 aa, Influenza virus
AELLIAMEN

SEQ ID NO: 345442 - protein, 9 aa, Influenza virus
DLLVAMENQ

SEQ ID NO: 345443 - protein, 9 aa, Influenza virus
NQHTIDLAE

SEQ ID NO: 345444 - protein, 9 aa, Influenza virus
QHTIDSTDS

SEQ ID NO: 345445 - protein, 9 aa, Influenza virus
HTIDSTDSE

SEQ ID NO: 345446 - protein, 9 aa, Influenza virus
TIDLTNSEM

SEQ ID NO: 345447 - protein, 9 aa, Influenza virus
IDSTDSEMN

SEQ ID NO: 345448 - protein, 9 aa, Influenza virus
DLTNSEMNK

SEQ ID NO: 345449 - protein, 9 aa, Influenza virus
STDSEMNKL

SEQ ID NO: 345450 - protein, 9 aa, Influenza virus
NKLYERVRK

SEQ ID NO: 345451 - protein, 9 aa, Influenza virus
KLYERVRKQ

SEQ ID NO: 345452 - protein, 9 aa, Influenza virus
LYERVRKQL

SEQ ID NO: 345453 - protein, 9 aa, Influenza virus
YERVRKQLR

SEQ ID NO: 345454 - protein, 9 aa, Influenza virus
ERVRKQLRE

SEQ ID NO: 345455 - protein, 9 aa, Influenza virus
RVRKQLREN

SEQ ID NO: 345456 - protein, 9 aa, Influenza virus
EDGTGCFEL

SEQ ID NO: 345457 - protein, 9 aa, Influenza virus
DGTGCFELF

SEQ ID NO: 345458 - protein, 9 aa, Influenza virus
GTACFEIFH

SEQ ID NO: 345459 - protein, 9 aa, Influenza virus
ELFHKCDDD

SEQ ID NO: 345460 - protein, 9 aa, Influenza virus
LFHKCDDDC

SEQ ID NO: 345461 - protein, 9 aa, Influenza virus
FHKCDDRCM

SEQ ID NO: 345462 - protein, 9 aa, Influenza virus
CMASIRNNS

SEQ ID NO: 345463 - protein, 9 aa, Influenza virus
MGSIRNNTY

SEQ ID NO: 345464 - protein, 9 aa, Influenza virus
TSIRNNTYD

SEQ ID NO: 345465 - protein, 9 aa, Influenza virus
IRNNSYDHS

SEQ ID NO: 345466 - protein, 9 aa, Influenza virus
RNNTYDHST

SEQ ID NO: 345467 - protein, 9 aa, Influenza virus
NNTYDHSTY

SEQ ID NO: 345468 - protein, 9 aa, Influenza virus
NTYDHSTYR

SEQ ID NO: 345469 - protein, 9 aa, Influenza virus
QNRIQINPV

SEQ ID NO: 345470 - protein, 9 aa, Influenza virus
IQINPVKLS

SEQ ID NO: 345471 - protein, 9 aa, Influenza virus
IDPVKLSGG

SEQ ID NO: 345472 - protein, 9 aa, Influenza virus
DPVELSSGY

SEQ ID NO: 345473 - protein, 9 aa, Influenza virus
PVKLSGGYK

SEQ ID NO: 345474 - protein, 9 aa, Influenza virus
VELSSGYKD

SEQ ID NO: 345475 - protein, 9 aa, Influenza virus
KLSSGYKEV

SEQ ID NO: 345476 - protein, 9 aa, Influenza virus
LSSGYKEVI

SEQ ID NO: 345477 - protein, 9 aa, Influenza virus
SSGYKEVIL

SEQ ID NO: 345478 - protein, 9 aa, Influenza virus
GGYKDVILW

SEQ ID NO: 345479 - protein, 9 aa, Influenza virus
GYKEIILWF

SEQ ID NO: 345480 - protein, 9 aa, Influenza virus
YKEIILWFS

SEQ ID NO: 345481 - protein, 9 aa, Influenza virus
KEVILWFSF

SEQ ID NO: 345482 - protein, 9 aa, Influenza virus
EVILWFSFG

SEQ ID NO: 345483 - protein, 9 aa, Influenza virus
FSLGASCFL

SEQ ID NO: 345484 - protein, 9 aa, Influenza virus
SFGASCFTL

SEQ ID NO: 345485 - protein, 9 aa, Influenza virus
GASCFLLIA

SEQ ID NO: 345486 - protein, 9 aa, Influenza virus
ASCFLLIAI

SEQ ID NO: 345487 - protein, 9 aa, Influenza virus
LVFICIKNG

SEQ ID NO: 345488 - protein, 9 aa, Influenza virus
AFICIKNGN

SEQ ID NO: 345489 - protein, 9 aa, Influenza virus
ICVKNGNMQ

SEQ ID NO: 345490 - protein, 9 aa, Influenza virus
CVKNGNMRG

SEQ ID NO: 345491 - protein, 9 aa, Influenza virus
VKNGNHAVH

SEQ ID NO: 345492 - protein, 9 aa, Influenza virus
KNGNMRGTN

SEQ ID NO: 345493 - protein, 9 aa, Influenza virus
NGNMRCTSC

SEQ ID NO: 345494 - protein, 9 aa, Influenza virus
GNMRGTNWI

SEQ ID NO: 345495 - protein, 9 aa, Influenza virus
NPNQKLFTL

SEQ ID NO: 345496 - protein, 9 aa, Influenza virus
PNQKLFTLS

SEQ ID NO: 345497 - protein, 9 aa, Influenza virus
NQKLFTLSG

SEQ ID NO: 345498 - protein, 9 aa, Influenza virus
FTLSGVAIA

SEQ ID NO: 345499 - protein, 9 aa, Influenza virus
TLSGVAIAL

SEQ ID NO: 345500 - protein, 9 aa, Influenza virus
SGIAIALGI

SEQ ID NO: 345501 - protein, 9 aa, Influenza virus
GIAIALGII

SEQ ID NO: 345502 - protein, 9 aa, Influenza virus
IAIALGIIN

SEQ ID NO: 345503 - protein, 9 aa, Influenza virus
AIALGIINL

SEQ ID NO: 345504 - protein, 9 aa, Influenza virus
IALGIINLL

SEQ ID NO: 345505 - protein, 9 aa, Influenza virus
ALGIINLLI

SEQ ID NO: 345506 - protein, 9 aa, Influenza virus
SVLNLLIGV

SEQ ID NO: 345507 - protein, 9 aa, Influenza virus
VLNLLIGVS

SEQ ID NO: 345508 - protein, 9 aa, Influenza virus
NLLIGISNI

SEQ ID NO: 345509 - protein, 9 aa, Influenza virus
LLIGISNVV

SEQ ID NO: 345510 - protein, 9 aa, Influenza virus
LIGISNVVL

SEQ ID NO: 345511 - protein, 9 aa, Influenza virus
IGISNVVLN

SEQ ID NO: 345512 - protein, 9 aa, Influenza virus
SNVGLNMSL

SEQ ID NO: 345513 - protein, 9 aa, Influenza virus
NVGLNMSLH

SEQ ID NO: 345514 - protein, 9 aa, Influenza virus
IGLNVSLHL

SEQ ID NO: 345515 - protein, 9 aa, Influenza virus
GLNMSLHLK

SEQ ID NO: 345516 - protein, 9 aa, Influenza virus
GNTYVNNTT

SEQ ID NO: 345517 - protein, 9 aa, Influenza virus
NTYINNTTI

SEQ ID NO: 345518 - protein, 9 aa, Influenza virus
TYINNTTII

SEQ ID NO: 345519 - protein, 9 aa, Influenza virus
NYLLLNKSL

SEQ ID NO: 345520 - protein, 9 aa, Influenza virus
MLNKSLCKI

SEQ ID NO: 345521 - protein, 9 aa, Influenza virus
LNKSLCKIE

SEQ ID NO: 345522 - protein, 9 aa, Influenza virus
NKSLCKIEG

SEQ ID NO: 345523 - protein, 9 aa, Influenza virus
KSLCKIEGW

SEQ ID NO: 345524 - protein, 9 aa, Influenza virus
SLCKIEGWV

SEQ ID NO: 345525 - protein, 9 aa, Influenza virus
LCKIEGWVV

SEQ ID NO: 345526 - protein, 9 aa, Influenza virus
CSVEGWVVI

SEQ ID NO: 345527 - protein, 9 aa, Influenza virus
IEGWVVVAK

SEQ ID NO: 345528 - protein, 9 aa, Influenza virus
EGWVVIAQD

SEQ ID NO: 345529 - protein, 9 aa, Influenza virus
GWVVIAQDN

SEQ ID NO: 345530 - protein, 9 aa, Influenza virus
WVVIEKDNA

SEQ ID NO: 345531 - protein, 9 aa, Influenza virus
VVIAQDNAI

SEQ ID NO: 345532 - protein, 9 aa, Influenza virus
VIAQDNAIR

SEQ ID NO: 345533 - protein, 9 aa, Influenza virus
IEKDNAVRF

SEQ ID NO: 345534 - protein, 9 aa, Influenza virus
AQDNAIRFG

SEQ ID NO: 345535 - protein, 9 aa, Influenza virus
EPYVSCDPI

SEQ ID NO: 345536 - protein, 9 aa, Influenza virus
SNGTIHDRA

SEQ ID NO: 345537 - protein, 9 aa, Influenza virus
NGTIHDRTT

SEQ ID NO: 345538 - protein, 9 aa, Influenza virus
GTIHDRTTF

SEQ ID NO: 345539 - protein, 9 aa, Influenza virus
TIHDRAAFR

SEQ ID NO: 345540 - protein, 9 aa, Influenza virus
IHDRAAFRG

SEQ ID NO: 345541 - protein, 9 aa, Influenza virus
DRAAFRGLI

SEQ ID NO: 345542 - protein, 9 aa, Influenza virus
RTTFRGLLS

SEQ ID NO: 345543 - protein, 9 aa, Influenza virus
TAFRGLMST

SEQ ID NO: 345544 - protein, 9 aa, Influenza virus
FRGLMSTPL

SEQ ID NO: 345545 - protein, 9 aa, Influenza virus
RGLMSTPLG

SEQ ID NO: 345546 - protein, 9 aa, Influenza virus
SNSEFICVG

SEQ ID NO: 345547 - protein, 9 aa, Influenza virus
NSEFICVGW

SEQ ID NO: 345548 - protein, 9 aa, Influenza virus
SEFICVGWS

SEQ ID NO: 345549 - protein, 9 aa, Influenza virus
EFICVGWSS

SEQ ID NO: 345550 - protein, 9 aa, Influenza virus
ICVGWSSTT

SEQ ID NO: 345551 - protein, 9 aa, Influenza virus
SSTTCHDGV

SEQ ID NO: 345552 - protein, 9 aa, Influenza virus
CHDGIARMT

SEQ ID NO: 345553 - protein, 9 aa, Influenza virus
HDGVNRMTI

SEQ ID NO: 345554 - protein, 9 aa, Influenza virus
DGVNRMTIC

SEQ ID NO: 345555 - protein, 9 aa, Influenza virus
NRMTICVQG

SEQ ID NO: 345556 - protein, 9 aa, Influenza virus
QGNNNNATA

SEQ ID NO: 345557 - protein, 9 aa, Influenza virus
GNNNNATAT

SEQ ID NO: 345558 - protein, 9 aa, Influenza virus
NNNNATATV

SEQ ID NO: 345559 - protein, 9 aa, Influenza virus
ATATVYYNG

SEQ ID NO: 345560 - protein, 9 aa, Influenza virus
TATVYYNGR

SEQ ID NO: 345561 - protein, 9 aa, Influenza virus
ATVYYNGRL

SEQ ID NO: 345562 - protein, 9 aa, Influenza virus
TVYYNGRLT

SEQ ID NO: 345563 - protein, 9 aa, Influenza virus
VYYNGRLTT

SEQ ID NO: 345564 - protein, 9 aa, Influenza virus
YYNGRLTTT

SEQ ID NO: 345565 - protein, 9 aa, Influenza virus
YNGRLTTTI

SEQ ID NO: 345566 - protein, 9 aa, Influenza virus
RRLTTTVKT

SEQ ID NO: 345567 - protein, 9 aa, Influenza virus
TTTVKTWAG

SEQ ID NO: 345568 - protein, 9 aa, Influenza virus
TTIRTWAKN

SEQ ID NO: 345569 - protein, 9 aa, Influenza virus
TIRTWAKNI

SEQ ID NO: 345570 - protein, 9 aa, Influenza virus
IRTWAKNIL

SEQ ID NO: 345571 - protein, 9 aa, Influenza virus
RTWAKNILR

SEQ ID NO: 345572 - protein, 9 aa, Influenza virus
ARNILRTQD

SEQ ID NO: 345573 - protein, 9 aa, Influenza virus
RNILRTQDS

SEQ ID NO: 345574 - protein, 9 aa, Influenza virus
DSECVSHNG

SEQ ID NO: 345575 - protein, 9 aa, Influenza virus
SECVRHNGT

SEQ ID NO: 345576 - protein, 9 aa, Influenza virus
ECVSHNGTW

SEQ ID NO: 345577 - protein, 9 aa, Influenza virus
CVSHNGTWA

SEQ ID NO: 345578 - protein, 9 aa, Influenza virus
VRHNGTCAV

SEQ ID NO: 345579 - protein, 9 aa, Influenza virus
HNGTCVVVM

SEQ ID NO: 345580 - protein, 9 aa, Influenza virus
NGTCVVVMT

SEQ ID NO: 345581 - protein, 9 aa, Influenza virus
GTCVVVMTD

SEQ ID NO: 345582 - protein, 9 aa, Influenza virus
TWAVVMTDG

SEQ ID NO: 345583 - protein, 9 aa, Influenza virus
VVVMTDGSA

SEQ ID NO: 345584 - protein, 9 aa, Influenza virus
VVMTDGPAS

SEQ ID NO: 345585 - protein, 9 aa, Influenza virus
VMTDGPASS

SEQ ID NO: 345586 - protein, 9 aa, Influenza virus
MTDGSASSR

SEQ ID NO: 345587 - protein, 9 aa, Influenza virus
TDGSASSRA

SEQ ID NO: 345588 - protein, 9 aa, Influenza virus
EEWSCYGHS

SEQ ID NO: 345589 - protein, 9 aa, Influenza virus
VSCVCRDNW

SEQ ID NO: 345590 - protein, 9 aa, Influenza virus
RPIIEIDMS

SEQ ID NO: 345591 - protein, 9 aa, Influenza virus
LEHTSKYVC

SEQ ID NO: 345592 - protein, 9 aa, Influenza virus
DHTSQYLCT

SEQ ID NO: 345593 - protein, 9 aa, Influenza virus
HTSKYVCTG

SEQ ID NO: 345594 - protein, 9 aa, Influenza virus
YVCTGVLTD

SEQ ID NO: 345595 - protein, 9 aa, Influenza virus
VCTGVLTDT

SEQ ID NO: 345596 - protein, 9 aa, Influenza virus
VLTDTSRPG

SEQ ID NO: 345597 - protein, 9 aa, Influenza virus
TDTSRPGDR

SEQ ID NO: 345598 - protein, 9 aa, Influenza virus
SNPITGSPC

SEQ ID NO: 345599 - protein, 9 aa, Influenza virus
NPITGSPGS

SEQ ID NO: 345600 - protein, 9 aa, Influenza virus
PITGSPCAP

SEQ ID NO: 345601 - protein, 9 aa, Influenza virus
ITGSPCAPG

SEQ ID NO: 345602 - protein, 9 aa, Influenza virus
APGTKGFGF

SEQ ID NO: 345603 - protein, 9 aa, Influenza virus
GVKGFGFLS

SEQ ID NO: 345604 - protein, 9 aa, Influenza virus
VKGFGFLSG

SEQ ID NO: 345605 - protein, 9 aa, Influenza virus
NNTWLGRTI

SEQ ID NO: 345606 - protein, 9 aa, Influenza virus
RTISPRSRN

SEQ ID NO: 345607 - protein, 9 aa, Influenza virus
TISPRSRNG

SEQ ID NO: 345608 - protein, 9 aa, Influenza virus
ISPRSRNGF

SEQ ID NO: 345609 - protein, 9 aa, Influenza virus
SPRSRNGFE

SEQ ID NO: 345610 - protein, 9 aa, Influenza virus
PRSRNGFEM

SEQ ID NO: 345611 - protein, 9 aa, Influenza virus
RSRNGFEML

SEQ ID NO: 345612 - protein, 9 aa, Influenza virus
SRNGFEMLK

SEQ ID NO: 345613 - protein, 9 aa, Influenza virus
SGFEMLKIH

SEQ ID NO: 345614 - protein, 9 aa, Influenza virus
EMLKIHNAG

SEQ ID NO: 345615 - protein, 9 aa, Influenza virus
MLKIHNAGT

SEQ ID NO: 345616 - protein, 9 aa, Influenza virus
LRIPNAGID

SEQ ID NO: 345617 - protein, 9 aa, Influenza virus
RIPNAGIDP

SEQ ID NO: 345618 - protein, 9 aa, Influenza virus
RQEIVDNSN

SEQ ID NO: 345619 - protein, 9 aa, Influenza virus
QEIVDNKNW

SEQ ID NO: 345620 - protein, 9 aa, Influenza virus
EIVDNKNWS

SEQ ID NO: 345621 - protein, 9 aa, Influenza virus
IVDNSNWSG

SEQ ID NO: 345622 - protein, 9 aa, Influenza virus
VDNSNWSGY

SEQ ID NO: 345623 - protein, 9 aa, Influenza virus
DNSNWSGYS

SEQ ID NO: 345624 - protein, 9 aa, Influenza virus
NKNWSGYSG

SEQ ID NO: 345625 - protein, 9 aa, Influenza virus
KNWSGYSGS

SEQ ID NO: 345626 - protein, 9 aa, Influenza virus
VWWASNSLI

SEQ ID NO: 345627 - protein, 9 aa, Influenza virus
WWASNSLIA

SEQ ID NO: 345628 - protein, 9 aa, Influenza virus
PIGSGFFPD

SEQ ID NO: 345629 - protein, 9 aa, Influenza virus
LLASTNAHD

SEQ ID NO: 345630 - protein, 9 aa, Influenza virus
LMSTNAYDR

SEQ ID NO: 345631 - protein, 9 aa, Influenza virus
ASTNAHDRI

SEQ ID NO: 345632 - protein, 9 aa, Influenza virus
STDTVNTLM

SEQ ID NO: 345633 - protein, 9 aa, Influenza virus
TDTVDTLIE

SEQ ID NO: 345634 - protein, 9 aa, Influenza virus
DTVNTLTEQ

SEQ ID NO: 345635 - protein, 9 aa, Influenza virus
TVDTLIEQN

SEQ ID NO: 345636 - protein, 9 aa, Influenza virus
TLTEQNVPV

SEQ ID NO: 345637 - protein, 9 aa, Influenza virus
LMEQNVPVT

SEQ ID NO: 345638 - protein, 9 aa, Influenza virus
IEQKVPVTQ

SEQ ID NO: 345639 - protein, 9 aa, Influenza virus
EQNIPVTQT

SEQ ID NO: 345640 - protein, 9 aa, Influenza virus
QKVPVTQTM

SEQ ID NO: 345641 - protein, 9 aa, Influenza virus
KVPVTQTME

SEQ ID NO: 345642 - protein, 9 aa, Influenza virus
QTMELVETK

SEQ ID NO: 345643 - protein, 9 aa, Influenza virus
TMELVETKK

SEQ ID NO: 345644 - protein, 9 aa, Influenza virus
MELVETEKN

SEQ ID NO: 345645 - protein, 9 aa, Influenza virus
EKNPAYCNT

SEQ ID NO: 345646 - protein, 9 aa, Influenza virus
KHLAYCNTD

SEQ ID NO: 345647 - protein, 9 aa, Influenza virus
NPAYCNTDL

SEQ ID NO: 345648 - protein, 9 aa, Influenza virus
NPKCDIHLR

SEQ ID NO: 345649 - protein, 9 aa, Influenza virus
PKCDIHLRD

SEQ ID NO: 345650 - protein, 9 aa, Influenza virus
KCDIHLRDQ

SEQ ID NO: 345651 - protein, 9 aa, Influenza virus
HLRDQGWSY

SEQ ID NO: 345652 - protein, 9 aa, Influenza virus
LRDQGWSYI

SEQ ID NO: 345653 - protein, 9 aa, Influenza virus
RDQGWSYIV

SEQ ID NO: 345654 - protein, 9 aa, Influenza virus
DQAWSYIVE

SEQ ID NO: 345655 - protein, 9 aa, Influenza virus
QAWSYIVER

SEQ ID NO: 345656 - protein, 9 aa, Influenza virus
AWSYIVERP

SEQ ID NO: 345657 - protein, 9 aa, Influenza virus
SSAASYKRV

SEQ ID NO: 345658 - protein, 9 aa, Influenza virus
SAASYKRVR

SEQ ID NO: 345659 - protein, 9 aa, Influenza virus
RIRLFDYSG

SEQ ID NO: 345660 - protein, 9 aa, Influenza virus
VRLFDYSRW

SEQ ID NO: 345661 - protein, 9 aa, Influenza virus
FDYSGWNVT

SEQ ID NO: 345662 - protein, 9 aa, Influenza virus
KACNASTGA

SEQ ID NO: 345663 - protein, 9 aa, Influenza virus
ACNASTGAQ

SEQ ID NO: 345664 - protein, 9 aa, Influenza virus
CNALTGGQS

SEQ ID NO: 345665 - protein, 9 aa, Influenza virus
NALTGGQSF

SEQ ID NO: 345666 - protein, 9 aa, Influenza virus
ASTGAQSFY

SEQ ID NO: 345667 - protein, 9 aa, Influenza virus
STGAQSFYR

SEQ ID NO: 345668 - protein, 9 aa, Influenza virus
WLTKKEPDT

SEQ ID NO: 345669 - protein, 9 aa, Influenza virus
LTKKKPDIY

SEQ ID NO: 345670 - protein, 9 aa, Influenza virus
TKKEPDTYD

SEQ ID NO: 345671 - protein, 9 aa, Influenza virus
KKEPDTYDF

SEQ ID NO: 345672 - protein, 9 aa, Influenza virus
KKPDIYDFN

SEQ ID NO: 345673 - protein, 9 aa, Influenza virus
KPDIYDFNE

SEQ ID NO: 345674 - protein, 9 aa, Influenza virus
EAYNFNEGS

SEQ ID NO: 345675 - protein, 9 aa, Influenza virus
AYNFNEGSY

SEQ ID NO: 345676 - protein, 9 aa, Influenza virus
FNEGAYVNN

SEQ ID NO: 345677 - protein, 9 aa, Influenza virus
NNENGDIIF

SEQ ID NO: 345678 - protein, 9 aa, Influenza virus
NEEGDIIFL

SEQ ID NO: 345679 - protein, 9 aa, Influenza virus
ENGDIIFLW

SEQ ID NO: 345680 - protein, 9 aa, Influenza virus
NGDIIFLWG

SEQ ID NO: 345681 - protein, 9 aa, Influenza virus
WGIHHPPDE

SEQ ID NO: 345682 - protein, 9 aa, Influenza virus
GIHHPPDET

SEQ ID NO: 345683 - protein, 9 aa, Influenza virus
IHHPPDETE

SEQ ID NO: 345684 - protein, 9 aa, Influenza virus
HHPPDETEQ

SEQ ID NO: 345685 - protein, 9 aa, Influenza virus
HPPDETEQT

SEQ ID NO: 345686 - protein, 9 aa, Influenza virus
ETEQTKLYK

SEQ ID NO: 345687 - protein, 9 aa, Influenza virus
NANTLTSVT

SEQ ID NO: 345688 - protein, 9 aa, Influenza virus
ANTLTSVTT

SEQ ID NO: 345689 - protein, 9 aa, Influenza virus
VTTNTINRN

SEQ ID NO: 345690 - protein, 9 aa, Influenza virus
TTNTINRNF

SEQ ID NO: 345691 - protein, 9 aa, Influenza virus
TNTINRNFQ

SEQ ID NO: 345692 - protein, 9 aa, Influenza virus
NTINRNFQP

SEQ ID NO: 345693 - protein, 9 aa, Influenza virus
TINRNFQPN

SEQ ID NO: 345694 - protein, 9 aa, Influenza virus
INRNFQPNI

SEQ ID NO: 345695 - protein, 9 aa, Influenza virus
NRNFQPNIG

SEQ ID NO: 345696 - protein, 9 aa, Influenza virus
RNFQPNIGP

SEQ ID NO: 345697 - protein, 9 aa, Influenza virus
NFQPNIGPR

SEQ ID NO: 345698 - protein, 9 aa, Influenza virus
PLVREQQGR

SEQ ID NO: 345699 - protein, 9 aa, Influenza virus
LVRGQQGWM

SEQ ID NO: 345700 - protein, 9 aa, Influenza virus
VREQQGRMD

SEQ ID NO: 345701 - protein, 9 aa, Influenza virus
RGQQGWMDY

SEQ ID NO: 345702 - protein, 9 aa, Influenza virus
GQQGTMDYY

SEQ ID NO: 345703 - protein, 9 aa, Influenza virus
YLLKGESHC

SEQ ID NO: 345704 - protein, 9 aa, Influenza virus
LLKGESHCR

SEQ ID NO: 345705 - protein, 9 aa, Influenza virus
GESHGKIIQ

SEQ ID NO: 345706 - protein, 9 aa, Influenza virus
ESHGKIIQN

SEQ ID NO: 345707 - protein, 9 aa, Influenza virus
SHGRTIQNE

SEQ ID NO: 345708 - protein, 9 aa, Influenza virus
HCRIIQNED

SEQ ID NO: 345709 - protein, 9 aa, Influenza virus
GRTIQNEDI

SEQ ID NO: 345710 - protein, 9 aa, Influenza virus
NCYTKCQTY

SEQ ID NO: 345711 - protein, 9 aa, Influenza virus
CKTKCQTYA

SEQ ID NO: 345712 - protein, 9 aa, Influenza virus
KTKCQTYAG

SEQ ID NO: 345713 - protein, 9 aa, Influenza virus
YTGAINSSR

SEQ ID NO: 345714 - protein, 9 aa, Influenza virus
AGAVNSSKP

SEQ ID NO: 345715 - protein, 9 aa, Influenza virus
GAVNSSKPF

SEQ ID NO: 345716 - protein, 9 aa, Influenza virus
AINSSKPLQ

SEQ ID NO: 345717 - protein, 9 aa, Influenza virus
INSSKPLQN

SEQ ID NO: 345718 - protein, 9 aa, Influenza virus
NSSKPLQNA

SEQ ID NO: 345719 - protein, 9 aa, Influenza virus
SSKPFQNTS

SEQ ID NO: 345720 - protein, 9 aa, Influenza virus
SKPLQNASR

SEQ ID NO: 345721 - protein, 9 aa, Influenza virus
KPFQNTSRH

SEQ ID NO: 345722 - protein, 9 aa, Influenza virus
PFQNASRHH

SEQ ID NO: 345723 - protein, 9 aa, Influenza virus
FQNASRYYM

SEQ ID NO: 345724 - protein, 9 aa, Influenza virus
QNTSRHYMG

SEQ ID NO: 345725 - protein, 9 aa, Influenza virus
NTSRHYMGE

SEQ ID NO: 345726 - protein, 9 aa, Influenza virus
ASRYYMGEC

SEQ ID NO: 345727 - protein, 9 aa, Influenza virus
RHYMGECPN

SEQ ID NO: 345728 - protein, 9 aa, Influenza virus
YYMGECPKY

SEQ ID NO: 345729 - protein, 9 aa, Influenza virus
YMGECPNYV

SEQ ID NO: 345730 - protein, 9 aa, Influenza virus
MGECPNYVK

SEQ ID NO: 345731 - protein, 9 aa, Influenza virus
GECPKYAKK

SEQ ID NO: 345732 - protein, 9 aa, Influenza virus
YAKKASLRL

SEQ ID NO: 345733 - protein, 9 aa, Influenza virus
AKKASLRLA

SEQ ID NO: 345734 - protein, 9 aa, Influenza virus
KKESLRLAL

SEQ ID NO: 345735 - protein, 9 aa, Influenza virus
KESLRLAIG

SEQ ID NO: 345736 - protein, 9 aa, Influenza virus
ESLRLAIGL

SEQ ID NO: 345737 - protein, 9 aa, Influenza virus
IGLRNTPSI

SEQ ID NO: 345738 - protein, 9 aa, Influenza virus
RNTPSIEPR

SEQ ID NO: 345739 - protein, 9 aa, Influenza virus
NTPSIEPRG

SEQ ID NO: 345740 - protein, 9 aa, Influenza virus
TPSIEPRGL

SEQ ID NO: 345741 - protein, 9 aa, Influenza virus
PSIEPRGLF

SEQ ID NO: 345742 - protein, 9 aa, Influenza virus
SIEPRGLFG

SEQ ID NO: 345743 - protein, 9 aa, Influenza virus
IEPRGLFGA

SEQ ID NO: 345744 - protein, 9 aa, Influenza virus
QKSTQEAIN

SEQ ID NO: 345745 - protein, 9 aa, Influenza virus
KSTQEAINK

SEQ ID NO: 345746 - protein, 9 aa, Influenza virus
STQEAIGKI

SEQ ID NO: 345747 - protein, 9 aa, Influenza virus
TQEAIGKIT

SEQ ID NO: 345748 - protein, 9 aa, Influenza virus
QEAIGKITN

SEQ ID NO: 345749 - protein, 9 aa, Influenza virus
EAINKITNK

SEQ ID NO: 345750 - protein, 9 aa, Influenza virus
AINKITNKV

SEQ ID NO: 345751 - protein, 9 aa, Influenza virus
IGKITNKVN

SEQ ID NO: 345752 - protein, 9 aa, Influenza virus
EKITNKVNN

SEQ ID NO: 345753 - protein, 9 aa, Influenza virus
MNREFEVVD

SEQ ID NO: 345754 - protein, 9 aa, Influenza virus
NREFEVVDH

SEQ ID NO: 345755 - protein, 9 aa, Influenza virus
REFEVVDHE

SEQ ID NO: 345756 - protein, 9 aa, Influenza virus
EFEVVDHEF

SEQ ID NO: 345757 - protein, 9 aa, Influenza virus
FEVVDHEFS

SEQ ID NO: 345758 - protein, 9 aa, Influenza virus
EKRINVIND

SEQ ID NO: 345759 - protein, 9 aa, Influenza virus
KRINMISDK

SEQ ID NO: 345760 - protein, 9 aa, Influenza virus
RINVINDKI

SEQ ID NO: 345761 - protein, 9 aa, Influenza virus
TNMINDKID

SEQ ID NO: 345762 - protein, 9 aa, Influenza virus
NVINDKIDD

SEQ ID NO: 345763 - protein, 9 aa, Influenza virus
MISDKIDDQ

SEQ ID NO: 345764 - protein, 9 aa, Influenza virus
DKIDDQIEN

SEQ ID NO: 345765 - protein, 9 aa, Influenza virus
KIDDQIEGL

SEQ ID NO: 345766 - protein, 9 aa, Influenza virus
IDDQIENLW

SEQ ID NO: 345767 - protein, 9 aa, Influenza virus
DDQIEGLWA

SEQ ID NO: 345768 - protein, 9 aa, Influenza virus
DQIEELWAY

SEQ ID NO: 345769 - protein, 9 aa, Influenza virus
QIEELWAYN

SEQ ID NO: 345770 - protein, 9 aa, Influenza virus
IEELWAYNA

SEQ ID NO: 345771 - protein, 9 aa, Influenza virus
EELWAYNAE

SEQ ID NO: 345772 - protein, 9 aa, Influenza virus
ELWAYNAEL

SEQ ID NO: 345773 - protein, 9 aa, Influenza virus
DEVRRRLST

SEQ ID NO: 345774 - protein, 9 aa, Influenza virus
EVRRRLSTN

SEQ ID NO: 345775 - protein, 9 aa, Influenza virus
VRRRLSTNA

SEQ ID NO: 345776 - protein, 9 aa, Influenza virus
RRLSVNAID

SEQ ID NO: 345777 - protein, 9 aa, Influenza virus
NAIDTGKGC

SEQ ID NO: 345778 - protein, 9 aa, Influenza virus
AIDTGKGCF

SEQ ID NO: 345779 - protein, 9 aa, Influenza virus
VDTGNGCFD

SEQ ID NO: 345780 - protein, 9 aa, Influenza virus
KNGTYNHKD

SEQ ID NO: 345781 - protein, 9 aa, Influenza virus
NGTYDHKDY

SEQ ID NO: 345782 - protein, 9 aa, Influenza virus
GTYDHKDYE

SEQ ID NO: 345783 - protein, 9 aa, Influenza virus
TYNHKDYEE

SEQ ID NO: 345784 - protein, 9 aa, Influenza virus
YDHKDYEEE

SEQ ID NO: 345785 - protein, 9 aa, Influenza virus
DHKDYEEEA

SEQ ID NO: 345786 - protein, 9 aa, Influenza virus
ERSKINGVI

SEQ ID NO: 345787 - protein, 9 aa, Influenza virus
RSKINGVIL

SEQ ID NO: 345788 - protein, 9 aa, Influenza virus
SKINGVILE

SEQ ID NO: 345789 - protein, 9 aa, Influenza virus
RINGVKLEE

SEQ ID NO: 345790 - protein, 9 aa, Influenza virus
INGVRLEEN

SEQ ID NO: 345791 - protein, 9 aa, Influenza virus
NGVRLEENT

SEQ ID NO: 345792 - protein, 9 aa, Influenza virus
GVRLEENTT

SEQ ID NO: 345793 - protein, 9 aa, Influenza virus
VILEENTTY

SEQ ID NO: 345794 - protein, 9 aa, Influenza virus
ILEENTTYK

SEQ ID NO: 345795 - protein, 9 aa, Influenza virus
VHQSTNSTE

SEQ ID NO: 345796 - protein, 9 aa, Influenza virus
YLSTNSTET

SEQ ID NO: 345797 - protein, 9 aa, Influenza virus
TNSTETVYT

SEQ ID NO: 345798 - protein, 9 aa, Influenza virus
EHNGVLCAT

SEQ ID NO: 345799 - protein, 9 aa, Influenza virus
VEGLVYGNP

SEQ ID NO: 345800 - protein, 9 aa, Influenza virus
LIYGNPSCN

SEQ ID NO: 345801 - protein, 9 aa, Influenza virus
WSYIVERPL

SEQ ID NO: 345802 - protein, 9 aa, Influenza virus
SYIIERPSA

SEQ ID NO: 345803 - protein, 9 aa, Influenza virus
FYKSMRWLT

SEQ ID NO: 345804 - protein, 9 aa, Influenza virus
LLKPGQTLR

SEQ ID NO: 345805 - protein, 9 aa, Influenza virus
RPGQTLRVR

SEQ ID NO: 345806 - protein, 9 aa, Influenza virus
GQTLRVKSN

SEQ ID NO: 345807 - protein, 9 aa, Influenza virus
QTLRVKSNG

SEQ ID NO: 345808 - protein, 9 aa, Influenza virus
TLRVKSNGN

SEQ ID NO: 345809 - protein, 9 aa, Influenza virus
LRVKSNGNL

SEQ ID NO: 345810 - protein, 9 aa, Influenza virus
VKSNGNLIA

SEQ ID NO: 345811 - protein, 9 aa, Influenza virus
RSNGNLVAP

SEQ ID NO: 345812 - protein, 9 aa, Influenza virus
SNGNLVAPW

SEQ ID NO: 345813 - protein, 9 aa, Influenza virus
NGNLIAPLY

SEQ ID NO: 345814 - protein, 9 aa, Influenza virus
ENLIAPWYG

SEQ ID NO: 345815 - protein, 9 aa, Influenza virus
NLIAPLYGH

SEQ ID NO: 345816 - protein, 9 aa, Influenza virus
LPFQNISKY

SEQ ID NO: 345817 - protein, 9 aa, Influenza virus
FQNISKYAF

SEQ ID NO: 345818 - protein, 9 aa, Influenza virus
QNISKYAFG

SEQ ID NO: 345819 - protein, 9 aa, Influenza virus
SLKLAVGLK

SEQ ID NO: 345820 - protein, 9 aa, Influenza virus
LKLAVGLKN

SEQ ID NO: 345821 - protein, 9 aa, Influenza virus
WYGFQHTND

SEQ ID NO: 345822 - protein, 9 aa, Influenza virus
YGFQHTNDQ

SEQ ID NO: 345823 - protein, 9 aa, Influenza virus
GFQHTNDQG

SEQ ID NO: 345824 - protein, 9 aa, Influenza virus
DQIQDLWAY

SEQ ID NO: 345825 - protein, 9 aa, Influenza virus
QIQDLWAYN

SEQ ID NO: 345826 - protein, 9 aa, Influenza virus
IQDLWAYNA

SEQ ID NO: 345827 - protein, 9 aa, Influenza virus
QDLWAYNAE

SEQ ID NO: 345828 - protein, 9 aa, Influenza virus
DLWAYNAEL

SEQ ID NO: 345829 - protein, 9 aa, Influenza virus
LVLLENQKI

SEQ ID NO: 345830 - protein, 9 aa, Influenza virus
VLLENQKPL

SEQ ID NO: 345831 - protein, 9 aa, Influenza virus
LLENQKPLD

SEQ ID NO: 345832 - protein, 9 aa, Influenza virus
LENQKPLDE

SEQ ID NO: 345833 - protein, 9 aa, Influenza virus
NQKILDEHD

SEQ ID NO: 345834 - protein, 9 aa, Influenza virus
ENGNGCFEL

SEQ ID NO: 345835 - protein, 9 aa, Influenza virus
NGNGCFELY

SEQ ID NO: 345836 - protein, 9 aa, Influenza virus
KGCFELYHR

SEQ ID NO: 345837 - protein, 9 aa, Influenza virus
CFELYHKCN

SEQ ID NO: 345838 - protein, 9 aa, Influenza virus
CMEAIRNGT

SEQ ID NO: 345839 - protein, 9 aa, Influenza virus
MEAIRNGTY

SEQ ID NO: 345840 - protein, 9 aa, Influenza virus
EGAYKILTI

SEQ ID NO: 345841 - protein, 9 aa, Influenza virus
GAYKILTIY

SEQ ID NO: 345842 - protein, 9 aa, Influenza virus
IYSTVASSF

SEQ ID NO: 345843 - protein, 9 aa, Influenza virus
VHQSTNSTE

SEQ ID NO: 345844 - protein, 9 aa, Influenza virus
YLSTNSTET

SEQ ID NO: 345845 - protein, 9 aa, Influenza virus
TNSTETVYT

SEQ ID NO: 345846 - protein, 9 aa, Influenza virus
EHNGVLCAT

SEQ ID NO: 345847 - protein, 9 aa, Influenza virus
VEGLVYGNP

SEQ ID NO: 345848 - protein, 9 aa, Influenza virus
LIYGNPSCN

SEQ ID NO: 345849 - protein, 9 aa, Influenza virus
WSYIVERPL

SEQ ID NO: 345850 - protein, 9 aa, Influenza virus
SYIVERSSP

SEQ ID NO: 345851 - protein, 9 aa, Influenza virus
FYKSMRWLT

SEQ ID NO: 345852 - protein, 9 aa, Influenza virus
PVLKPGQTL

SEQ ID NO: 345853 - protein, 9 aa, Influenza virus
LLKPGQTLR

SEQ ID NO: 345854 - protein, 9 aa, Influenza virus
RPGQTLRVR

SEQ ID NO: 345855 - protein, 9 aa, Influenza virus
GQTLRVKSN

SEQ ID NO: 345856 - protein, 9 aa, Influenza virus
QTLRVKSNG

SEQ ID NO: 345857 - protein, 9 aa, Influenza virus
TLRVKSNGN

SEQ ID NO: 345858 - protein, 9 aa, Influenza virus
LRVKSNGNL

SEQ ID NO: 345859 - protein, 9 aa, Influenza virus
VKSNGNLIA

SEQ ID NO: 345860 - protein, 9 aa, Influenza virus
RSNGNLVAP

SEQ ID NO: 345861 - protein, 9 aa, Influenza virus
SNENLIAPW

SEQ ID NO: 345862 - protein, 9 aa, Influenza virus
NGNLIAPLY

SEQ ID NO: 345863 - protein, 9 aa, Influenza virus
ENLIAPWYG

SEQ ID NO: 345864 - protein, 9 aa, Influenza virus
NLIAPWYGY

SEQ ID NO: 345865 - protein, 9 aa, Influenza virus
LPFQNISKY

SEQ ID NO: 345866 - protein, 9 aa, Influenza virus
FQNISKYAF

SEQ ID NO: 345867 - protein, 9 aa, Influenza virus
QNISKYAFG

SEQ ID NO: 345868 - protein, 9 aa, Influenza virus
YAFGICPKY

SEQ ID NO: 345869 - protein, 9 aa, Influenza virus
SLKLAVGLK

SEQ ID NO: 345870 - protein, 9 aa, Influenza virus
LKLAVGLKN

SEQ ID NO: 345871 - protein, 9 aa, Influenza virus
WYGFQHTND

SEQ ID NO: 345872 - protein, 9 aa, Influenza virus
YGFQHTNDQ

SEQ ID NO: 345873 - protein, 9 aa, Influenza virus
GFQHTNDQG

SEQ ID NO: 345874 - protein, 9 aa, Influenza virus
DDQIQDLWA

SEQ ID NO: 345875 - protein, 9 aa, Influenza virus
DQIQDLWAY

SEQ ID NO: 345876 - protein, 9 aa, Influenza virus
QIQDLWAYN

SEQ ID NO: 345877 - protein, 9 aa, Influenza virus
IQDLWAYNA

SEQ ID NO: 345878 - protein, 9 aa, Influenza virus
QDLWAYNAE

SEQ ID NO: 345879 - protein, 9 aa, Influenza virus
DLWAYNAEL

SEQ ID NO: 345880 - protein, 9 aa, Influenza virus
LVLLENQKP

SEQ ID NO: 345881 - protein, 9 aa, Influenza virus
NQKTLDEHE

SEQ ID NO: 345882 - protein, 9 aa, Influenza virus
QKTLDEHDS

SEQ ID NO: 345883 - protein, 9 aa, Influenza virus
KTLDEHDTN

SEQ ID NO: 345884 - protein, 9 aa, Influenza virus
LDEHVANVN

SEQ ID NO: 345885 - protein, 9 aa, Influenza virus
ENGNGCFEL

SEQ ID NO: 345886 - protein, 9 aa, Influenza virus
NGNGCFELY

SEQ ID NO: 345887 - protein, 9 aa, Influenza virus
KGCFELYHR

SEQ ID NO: 345888 - protein, 9 aa, Influenza virus
CFELYHKCN

SEQ ID NO: 345889 - protein, 9 aa, Influenza virus
CMEAIRNGT

SEQ ID NO: 345890 - protein, 9 aa, Influenza virus
MEAIRNGTY

SEQ ID NO: 345891 - protein, 9 aa, Influenza virus
EGAYKILTI

SEQ ID NO: 345892 - protein, 9 aa, Influenza virus
GAYKILTIY

SEQ ID NO: 345893 - protein, 9 aa, Influenza virus
IYSTVASSF

SEQ ID NO: 345894 - protein, 9 aa, Influenza virus
WSKPQCQIA

SEQ ID NO: 345895 - protein, 9 aa, Influenza virus
SKPQCLITG

SEQ ID NO: 345896 - protein, 9 aa, Influenza virus
KPQCQITGS

SEQ ID NO: 345897 - protein, 9 aa, Influenza virus
PQCQIAGFA

SEQ ID NO: 345898 - protein, 9 aa, Influenza virus
QCLITGFAP

SEQ ID NO: 345899 - protein, 9 aa, Influenza virus
RLSAGGGIW

SEQ ID NO: 345900 - protein, 9 aa, Influenza virus
VNREPYVSC

SEQ ID NO: 345901 - protein, 9 aa, Influenza virus
KCYQFALGH

SEQ ID NO: 345902 - protein, 9 aa, Influenza virus
YQFALGQGA

SEQ ID NO: 345903 - protein, 9 aa, Influenza virus
SYRTLLMSE

SEQ ID NO: 345904 - protein, 9 aa, Influenza virus
MSELGVPFN

SEQ ID NO: 345905 - protein, 9 aa, Influenza virus
NELGVPFNL

SEQ ID NO: 345906 - protein, 9 aa, Influenza virus
TQQVCIAWS

SEQ ID NO: 345907 - protein, 9 aa, Influenza virus
QQVCIAWSS

SEQ ID NO: 345908 - protein, 9 aa, Influenza virus
IAWSSASCH

SEQ ID NO: 345909 - protein, 9 aa, Influenza virus
SSASCHDGR

SEQ ID NO: 345910 - protein, 9 aa, Influenza virus
SASCHDGRA

SEQ ID NO: 345911 - protein, 9 aa, Influenza virus
ASCHDGRAW

SEQ ID NO: 345912 - protein, 9 aa, Influenza virus
SCHDGKEWL

SEQ ID NO: 345913 - protein, 9 aa, Influenza virus
CHDGKEWLH

SEQ ID NO: 345914 - protein, 9 aa, Influenza virus
NILITQESE

SEQ ID NO: 345915 - protein, 9 aa, Influenza virus
RTQESGCVC

SEQ ID NO: 345916 - protein, 9 aa, Influenza virus
TQEYECVCI

SEQ ID NO: 345917 - protein, 9 aa, Influenza virus
ESECVCIDG

SEQ ID NO: 345918 - protein, 9 aa, Influenza virus
INGICTVVM

SEQ ID NO: 345919 - protein, 9 aa, Influenza virus
GTCTAVMTD

SEQ ID NO: 345920 - protein, 9 aa, Influenza virus
GGAQHVEEC

SEQ ID NO: 345921 - protein, 9 aa, Influenza virus
NAQHVEECS

SEQ ID NO: 345922 - protein, 9 aa, Influenza virus
VEECSCYPS

SEQ ID NO: 345923 - protein, 9 aa, Influenza virus
EECSCYPRH

SEQ ID NO: 345924 - protein, 9 aa, Influenza virus
CVCWDNWRG

SEQ ID NO: 345925 - protein, 9 aa, Influenza virus
VCWDNWRGS

SEQ ID NO: 345926 - protein, 9 aa, Influenza virus
NWRGSNRPI

SEQ ID NO: 345927 - protein, 9 aa, Influenza virus
GLVGDTPRT

SEQ ID NO: 345928 - protein, 9 aa, Influenza virus
FCGTPGTYG

SEQ ID NO: 345929 - protein, 9 aa, Influenza virus
GTCGTGSWP

SEQ ID NO: 345930 - protein, 9 aa, Influenza virus
THGTGSWPD

SEQ ID NO: 345931 - protein, 9 aa, Influenza virus
TGSWADGAN

SEQ ID NO: 345932 - protein, 9 aa, Influenza virus
GSWPDGANV

SEQ ID NO: 345933 - protein, 9 aa, Influenza virus
AEIAQRLEG

SEQ ID NO: 345934 - protein, 9 aa, Influenza virus
EIAQRLEGV

SEQ ID NO: 345935 - protein, 9 aa, Influenza virus
IAQRLEGVF

SEQ ID NO: 345936 - protein, 9 aa, Influenza virus
AQRLEGVFA

SEQ ID NO: 345937 - protein, 9 aa, Influenza virus
QRLEGVFAG

SEQ ID NO: 345938 - protein, 9 aa, Influenza virus
RLEGVFAGK

SEQ ID NO: 345939 - protein, 9 aa, Influenza virus
LENVFAGKN

SEQ ID NO: 345940 - protein, 9 aa, Influenza virus
AGKNTDLEV

SEQ ID NO: 345941 - protein, 9 aa, Influenza virus
GKNTDLEVL

SEQ ID NO: 345942 - protein, 9 aa, Influenza virus
KNTDLEVLM

SEQ ID NO: 345943 - protein, 9 aa, Influenza virus
NTDLEVLME

SEQ ID NO: 345944 - protein, 9 aa, Influenza virus
PNNMARAVK

SEQ ID NO: 345945 - protein, 9 aa, Influenza virus
NNMARAVKL

SEQ ID NO: 345946 - protein, 9 aa, Influenza virus
MDKAVKLYK

SEQ ID NO: 345947 - protein, 9 aa, Influenza virus
DKAVKLYKK

SEQ ID NO: 345948 - protein, 9 aa, Influenza virus
KAVKLYKKL

SEQ ID NO: 345949 - protein, 9 aa, Influenza virus
VTFHGAKEV

SEQ ID NO: 345950 - protein, 9 aa, Influenza virus
TFHGAKEIS

SEQ ID NO: 345951 - protein, 9 aa, Influenza virus
FHGAKEISL

SEQ ID NO: 345952 - protein, 9 aa, Influenza virus
GAKEVALGY

SEQ ID NO: 345953 - protein, 9 aa, Influenza virus
AKEVALGYS

SEQ ID NO: 345954 - protein, 9 aa, Influenza virus
EVALSYSAG

SEQ ID NO: 345955 - protein, 9 aa, Influenza virus
VALSYSAGA

SEQ ID NO: 345956 - protein, 9 aa, Influenza virus
ALGYSTGAL

SEQ ID NO: 345957 - protein, 9 aa, Influenza virus
IYNRMGTIT

SEQ ID NO: 345958 - protein, 9 aa, Influenza virus
EQIADSHHR

SEQ ID NO: 345959 - protein, 9 aa, Influenza virus
QIADSHHRS

SEQ ID NO: 345960 - protein, 9 aa, Influenza virus
IADSHHRSH

SEQ ID NO: 345961 - protein, 9 aa, Influenza virus
ADSHHRSHR

SEQ ID NO: 345962 - protein, 9 aa, Influenza virus
DSHHRSHRQ

SEQ ID NO: 345963 - protein, 9 aa, Influenza virus
SHHRSHRQM

SEQ ID NO: 345964 - protein, 9 aa, Influenza virus
HHRSHRQMA

SEQ ID NO: 345965 - protein, 9 aa, Influenza virus
ATTNPLIRH

SEQ ID NO: 345966 - protein, 9 aa, Influenza virus
EQAAEAMDI

SEQ ID NO: 345967 - protein, 9 aa, Influenza virus
ARQMVHAMR

SEQ ID NO: 345968 - protein, 9 aa, Influenza virus
RRMVQAMRA

SEQ ID NO: 345969 - protein, 9 aa, Influenza virus
MVQAMRTVG

SEQ ID NO: 345970 - protein, 9 aa, Influenza virus
VQAMRTVGT

SEQ ID NO: 345971 - protein, 9 aa, Influenza virus
AMRAVGTHP

SEQ ID NO: 345972 - protein, 9 aa, Influenza virus
DLIENLQAY

SEQ ID NO: 345973 - protein, 9 aa, Influenza virus
LLDNLQAYQ

SEQ ID NO: 345974 - protein, 9 aa, Influenza virus
LDNLQAYQK

SEQ ID NO: 345975 - protein, 9 aa, Influenza virus
YQKRMGLQM

SEQ ID NO: 345976 - protein, 9 aa, Influenza virus
QKRMGLQMQ

SEQ ID NO: 345977 - protein, 9 aa, Influenza virus
KRMGLQMQR

SEQ ID NO: 345978 - protein, 9 aa, Influenza virus
RMGLQMQRF

SEQ ID NO: 345979 - protein, 9 aa, Influenza virus
MGLQMQRFK

SEQ ID NO: 345980 - protein, 9 aa, Influenza virus
SQLTEVETP

SEQ ID NO: 345981 - protein, 9 aa, Influenza virus
GILHLVLWI

SEQ ID NO: 345982 - protein, 9 aa, Influenza virus
GMPESMREE

SEQ ID NO: 345983 - protein, 9 aa, Influenza virus
MPESMREEY

SEQ ID NO: 345984 - protein, 9 aa, Influenza virus
SMREEYREE

SEQ ID NO: 345985 - protein, 9 aa, Influenza virus
MSDIGAMAS

SEQ ID NO: 345986 - protein, 9 aa, Influenza virus
SDIEAMATQ

SEQ ID NO: 345987 - protein, 9 aa, Influenza virus
DIEAMATQG

SEQ ID NO: 345988 - protein, 9 aa, Influenza virus
IEAMATQGT

SEQ ID NO: 345989 - protein, 9 aa, Influenza virus
GAMASQGTK

SEQ ID NO: 345990 - protein, 9 aa, Influenza virus
ASQGTKRPY

SEQ ID NO: 345991 - protein, 9 aa, Influenza virus
SQGTKRPYE

SEQ ID NO: 345992 - protein, 9 aa, Influenza virus
RSHEQMETG

SEQ ID NO: 345993 - protein, 9 aa, Influenza virus
SHEQMETGG

SEQ ID NO: 345994 - protein, 9 aa, Influenza virus
YEQMETSGE

SEQ ID NO: 345995 - protein, 9 aa, Influenza virus
EQMETSGER

SEQ ID NO: 345996 - protein, 9 aa, Influenza virus
QMETSGERQ

SEQ ID NO: 345997 - protein, 9 aa, Influenza virus
ANEIRASVG

SEQ ID NO: 345998 - protein, 9 aa, Influenza virus
TEIRTSVGR

SEQ ID NO: 345999 - protein, 9 aa, Influenza virus
IRSSVGKMI

SEQ ID NO: 346000 - protein, 9 aa, Influenza virus
GGIGRFYVQ

SEQ ID NO: 346001 - protein, 9 aa, Influenza virus
MCTELKLSE

SEQ ID NO: 346002 - protein, 9 aa, Influenza virus
QEGRLIQNS

SEQ ID NO: 346003 - protein, 9 aa, Influenza virus
EGRLIQNSM

SEQ ID NO: 346004 - protein, 9 aa, Influenza virus
RLVQNSITI

SEQ ID NO: 346005 - protein, 9 aa, Influenza virus
LVQNSITIE

SEQ ID NO: 346006 - protein, 9 aa, Influenza virus
QNSMTIERM

SEQ ID NO: 346007 - protein, 9 aa, Influenza virus
NRYLEENPS

SEQ ID NO: 346008 - protein, 9 aa, Influenza virus
RYLEENPSA

SEQ ID NO: 346009 - protein, 9 aa, Influenza virus
YLEENPSAG

SEQ ID NO: 346010 - protein, 9 aa, Influenza virus
LEENPSAGK

SEQ ID NO: 346011 - protein, 9 aa, Influenza virus
EENPSAGKD

SEQ ID NO: 346012 - protein, 9 aa, Influenza virus
ENPSAGKDP

SEQ ID NO: 346013 - protein, 9 aa, Influenza virus
NPSAGKDPK

SEQ ID NO: 346014 - protein, 9 aa, Influenza virus
PSAGRDPKK

SEQ ID NO: 346015 - protein, 9 aa, Influenza virus
SAGRDPKKT

SEQ ID NO: 346016 - protein, 9 aa, Influenza virus
EVRRIWRQA

SEQ ID NO: 346017 - protein, 9 aa, Influenza virus
VRRIWRQAN

SEQ ID NO: 346018 - protein, 9 aa, Influenza virus
RRNWRQANN

SEQ ID NO: 346019 - protein, 9 aa, Influenza virus
NWRQANNGE

SEQ ID NO: 346020 - protein, 9 aa, Influenza virus
RQANNGEEA

SEQ ID NO: 346021 - protein, 9 aa, Influenza virus
SGLTHIMIW

SEQ ID NO: 346022 - protein, 9 aa, Influenza virus
AAIKGVGTM

SEQ ID NO: 346023 - protein, 9 aa, Influenza virus
VLELIRMIK

SEQ ID NO: 346024 - protein, 9 aa, Influenza virus
MELVRMIKR

SEQ ID NO: 346025 - protein, 9 aa, Influenza virus
LIRMIKRGV

SEQ ID NO: 346026 - protein, 9 aa, Influenza virus
IRMIKRGVN

SEQ ID NO: 346027 - protein, 9 aa, Influenza virus
TRTAYERMC

SEQ ID NO: 346028 - protein, 9 aa, Influenza virus
RTAYERMCN

SEQ ID NO: 346029 - protein, 9 aa, Influenza virus
TAYERMCNI

SEQ ID NO: 346030 - protein, 9 aa, Influenza virus
AEIEDLIFM

SEQ ID NO: 346031 - protein, 9 aa, Influenza virus
EIEDLIFMA

SEQ ID NO: 346032 - protein, 9 aa, Influenza virus
IEDLIFMAR

SEQ ID NO: 346033 - protein, 9 aa, Influenza virus
EDLIFMARS

SEQ ID NO: 346034 - protein, 9 aa, Influenza virus
DLIFMARSA

SEQ ID NO: 346035 - protein, 9 aa, Influenza virus
LIFMARSAL

SEQ ID NO: 346036 - protein, 9 aa, Influenza virus
IFMARSALI

SEQ ID NO: 346037 - protein, 9 aa, Influenza virus
CLPACIYGL

SEQ ID NO: 346038 - protein, 9 aa, Influenza virus
LPACIYGLV

SEQ ID NO: 346039 - protein, 9 aa, Influenza virus
PACIYGLVV

SEQ ID NO: 346040 - protein, 9 aa, Influenza virus
SGYNFEKEG

SEQ ID NO: 346041 - protein, 9 aa, Influenza virus
GYNFEKEGY

SEQ ID NO: 346042 - protein, 9 aa, Influenza virus
YNFEKEGYS

SEQ ID NO: 346043 - protein, 9 aa, Influenza virus
LVGVDPFRL

SEQ ID NO: 346044 - protein, 9 aa, Influenza virus
VGVDPFRLL

SEQ ID NO: 346045 - protein, 9 aa, Influenza virus
GVDPFRLLQ

SEQ ID NO: 346046 - protein, 9 aa, Influenza virus
DPFRLLQSS

SEQ ID NO: 346047 - protein, 9 aa, Influenza virus
PFRLLQSSQ

SEQ ID NO: 346048 - protein, 9 aa, Influenza virus
FKLLQTSQV

SEQ ID NO: 346049 - protein, 9 aa, Influenza virus
SLIRSNENP

SEQ ID NO: 346050 - protein, 9 aa, Influenza virus
RPNENPVHK

SEQ ID NO: 346051 - protein, 9 aa, Influenza virus
PNENPVHKS

SEQ ID NO: 346052 - protein, 9 aa, Influenza virus
AAFEDLRIS

SEQ ID NO: 346053 - protein, 9 aa, Influenza virus
PRGRLSTRG

SEQ ID NO: 346054 - protein, 9 aa, Influenza virus
LATRGVQIA

SEQ ID NO: 346055 - protein, 9 aa, Influenza virus
ATRGVQIAS

SEQ ID NO: 346056 - protein, 9 aa, Influenza virus
RTKSGGNTN

SEQ ID NO: 346057 - protein, 9 aa, Influenza virus
TRSGGNTNH

SEQ ID NO: 346058 - protein, 9 aa, Influenza virus
ASAGQISIQ

SEQ ID NO: 346059 - protein, 9 aa, Influenza virus
SAGQISIQP

SEQ ID NO: 346060 - protein, 9 aa, Influenza virus
SVQPAFSVQ

SEQ ID NO: 346061 - protein, 9 aa, Influenza virus
VQPAFSVQR

SEQ ID NO: 346062 - protein, 9 aa, Influenza virus
VQRSLPFER

SEQ ID NO: 346063 - protein, 9 aa, Influenza virus
GNSEGRTSD

SEQ ID NO: 346064 - protein, 9 aa, Influenza virus
SEGRTSDMR

SEQ ID NO: 346065 - protein, 9 aa, Influenza virus
SDMRAEIIK

SEQ ID NO: 346066 - protein, 9 aa, Influenza virus
EVSFQGRGV

SEQ ID NO: 346067 - protein, 9 aa, Influenza virus
MSFQGRGVF

SEQ ID NO: 346068 - protein, 9 aa, Influenza virus
FELSDERAA

SEQ ID NO: 346069 - protein, 9 aa, Influenza virus
ATNPVVPSF

SEQ ID NO: 346070 - protein, 9 aa, Influenza virus
TSPIVPSFD

SEQ ID NO: 346071 - protein, 9 aa, Influenza virus
NPVVPSFDM

SEQ ID NO: 346072 - protein, 9 aa, Influenza virus
PVVPSFDMS

SEQ ID NO: 346073 - protein, 9 aa, Influenza virus
IVPSFDMSK

SEQ ID NO: 346074 - protein, 9 aa, Influenza virus
VPSFDMSKE

SEQ ID NO: 346075 - protein, 9 aa, Influenza virus
PSFDMSKEG

SEQ ID NO: 346076 - protein, 9 aa, Influenza virus
FDMSKEGSY

SEQ ID NO: 346077 - protein, 9 aa, Influenza virus
ISNEGSYFF

SEQ ID NO: 346078 - protein, 9 aa, Influenza virus
SSFQVDCFI

SEQ ID NO: 346079 - protein, 9 aa, Influenza virus
QVDCFIWHI

SEQ ID NO: 346080 - protein, 9 aa, Influenza virus
VDCFIWHIR

SEQ ID NO: 346081 - protein, 9 aa, Influenza virus
GDAPFLDRI

SEQ ID NO: 346082 - protein, 9 aa, Influenza virus
FIDRLRRDQ

SEQ ID NO: 346083 - protein, 9 aa, Influenza virus
DRLRRDQRA

SEQ ID NO: 346084 - protein, 9 aa, Influenza virus
RLRRDQRAL

SEQ ID NO: 346085 - protein, 9 aa, Influenza virus
RRDQKALKG

SEQ ID NO: 346086 - protein, 9 aa, Influenza virus
RDQKALKGR

SEQ ID NO: 346087 - protein, 9 aa, Influenza virus
SVPASRYLT

SEQ ID NO: 346088 - protein, 9 aa, Influenza virus
VPASRYLTD

SEQ ID NO: 346089 - protein, 9 aa, Influenza virus
QKFEEMRWL

SEQ ID NO: 346090 - protein, 9 aa, Influenza virus
KFEEMRWLI

SEQ ID NO: 346091 - protein, 9 aa, Influenza virus
NSFEQITFI

SEQ ID NO: 346092 - protein, 9 aa, Influenza virus
FIQALQLLL

SEQ ID NO: 346093 - protein, 9 aa, Influenza virus
IQALQLLLE

SEQ ID NO: 346094 - protein, 9 aa, Influenza virus
LQLLLEVEN

SEQ ID NO: 346095 - protein, 9 aa, Influenza virus
QLLLEVENE

SEQ ID NO: 346096 - protein, 9 aa, Influenza virus
EVEQEMRTF

SEQ ID NO: 346097 - protein, 9 aa, Influenza virus
VEQEMRTFS

SEQ ID NO: 346098 - protein, 9 aa, Influenza virus
EIRTFSFQF

SEQ ID NO: 346099 - protein, 9 aa, Influenza virus
IRTFSFQFI

SEQ ID NO: 346100 - protein, 9 aa, Influenza virus
MEEFVRQCF

SEQ ID NO: 346101 - protein, 9 aa, Influenza virus
EEFVRQCFN

SEQ ID NO: 346102 - protein, 9 aa, Influenza virus
EFVRQCFNP

SEQ ID NO: 346103 - protein, 9 aa, Influenza virus
RQCFNPMTV

SEQ ID NO: 346104 - protein, 9 aa, Influenza virus
QCFNPMTVE

SEQ ID NO: 346105 - protein, 9 aa, Influenza virus
CFNPMTVEL

SEQ ID NO: 346106 - protein, 9 aa, Influenza virus
FNPMTVELA

SEQ ID NO: 346107 - protein, 9 aa, Influenza virus
NPMTVELAE

SEQ ID NO: 346108 - protein, 9 aa, Influenza virus
PMTVELAEK

SEQ ID NO: 346109 - protein, 9 aa, Influenza virus
AELAEKAMK

SEQ ID NO: 346110 - protein, 9 aa, Influenza virus
LAERAMKEY

SEQ ID NO: 346111 - protein, 9 aa, Influenza virus
TNKFAAVCT

SEQ ID NO: 346112 - protein, 9 aa, Influenza virus
KFASICTHL

SEQ ID NO: 346113 - protein, 9 aa, Influenza virus
FASICTHLE

SEQ ID NO: 346114 - protein, 9 aa, Influenza virus
ASICTHLEV

SEQ ID NO: 346115 - protein, 9 aa, Influenza virus
SICTHLEVC

SEQ ID NO: 346116 - protein, 9 aa, Influenza virus
SDFHFIDEQ

SEQ ID NO: 346117 - protein, 9 aa, Influenza virus
DPNTLLKHR

SEQ ID NO: 346118 - protein, 9 aa, Influenza virus
EIIEGRDRA

SEQ ID NO: 346119 - protein, 9 aa, Influenza virus
AWTVINSIC

SEQ ID NO: 346120 - protein, 9 aa, Influenza virus
KPKYLPDLY

SEQ ID NO: 346121 - protein, 9 aa, Influenza virus
PKYLPDLYD

SEQ ID NO: 346122 - protein, 9 aa, Influenza virus
KYLPDLYDY

SEQ ID NO: 346123 - protein, 9 aa, Influenza virus
PDLYDYKKN

SEQ ID NO: 346124 - protein, 9 aa, Influenza virus
DLYDYKKNR

SEQ ID NO: 346125 - protein, 9 aa, Influenza virus
LYDYKKNRF

SEQ ID NO: 346126 - protein, 9 aa, Influenza virus
RFTEIGVTR

SEQ ID NO: 346127 - protein, 9 aa, Influenza virus
FTEIGVTRR

SEQ ID NO: 346128 - protein, 9 aa, Influenza virus
TEIGVTRRE

SEQ ID NO: 346129 - protein, 9 aa, Influenza virus
GVTRREIHI

SEQ ID NO: 346130 - protein, 9 aa, Influenza virus
VTRREIHIY

SEQ ID NO: 346131 - protein, 9 aa, Influenza virus
TRREIHIYY

SEQ ID NO: 346132 - protein, 9 aa, Influenza virus
RREIHIYYL

SEQ ID NO: 346133 - protein, 9 aa, Influenza virus
REIHIYYLE

SEQ ID NO: 346134 - protein, 9 aa, Influenza virus
EIHIYYLEK

SEQ ID NO: 346135 - protein, 9 aa, Influenza virus
IHIYYLEKA

SEQ ID NO: 346136 - protein, 9 aa, Influenza virus
MEKANKIKS

SEQ ID NO: 346137 - protein, 9 aa, Influenza virus
EKSNKIKSE

SEQ ID NO: 346138 - protein, 9 aa, Influenza virus
ERTHIHIFS

SEQ ID NO: 346139 - protein, 9 aa, Influenza virus
RTHIHIFSF

SEQ ID NO: 346140 - protein, 9 aa, Influenza virus
SFIGEEMAT

SEQ ID NO: 346141 - protein, 9 aa, Influenza virus
FTGEEMASK

SEQ ID NO: 346142 - protein, 9 aa, Influenza virus
DYILDEESR

SEQ ID NO: 346143 - protein, 9 aa, Influenza virus
FTIRQELAS

SEQ ID NO: 346144 - protein, 9 aa, Influenza virus
TIRQELASR

SEQ ID NO: 346145 - protein, 9 aa, Influenza virus
RGLWDPFRQ

SEQ ID NO: 346146 - protein, 9 aa, Influenza virus
RGEETVEER

SEQ ID NO: 346147 - protein, 9 aa, Influenza virus
GEETVEERF

SEQ ID NO: 346148 - protein, 9 aa, Influenza virus
EETVEERFE

SEQ ID NO: 346149 - protein, 9 aa, Influenza virus
ETVEERFEI

SEQ ID NO: 346150 - protein, 9 aa, Influenza virus
DQSLPPNFP

SEQ ID NO: 346151 - protein, 9 aa, Influenza virus
QSLPPNFPS

SEQ ID NO: 346152 - protein, 9 aa, Influenza virus
SFRAYVDGF

SEQ ID NO: 346153 - protein, 9 aa, Influenza virus
FRTYVDGFE

SEQ ID NO: 346154 - protein, 9 aa, Influenza virus
RTYVDGFEP

SEQ ID NO: 346155 - protein, 9 aa, Influenza virus
TYVDGFEPN

SEQ ID NO: 346156 - protein, 9 aa, Influenza virus
IDGFEPNGC

SEQ ID NO: 346157 - protein, 9 aa, Influenza virus
FEPNGCIES

SEQ ID NO: 346158 - protein, 9 aa, Influenza virus
EPNGCIESK

SEQ ID NO: 346159 - protein, 9 aa, Influenza virus
KLSQMPKEV

SEQ ID NO: 346160 - protein, 9 aa, Influenza virus
CFQRSKFLL

SEQ ID NO: 346161 - protein, 9 aa, Influenza virus
FQRSKFLLM

SEQ ID NO: 346162 - protein, 9 aa, Influenza virus
LKLSIENPS

SEQ ID NO: 346163 - protein, 9 aa, Influenza virus
KLSIENPSH

SEQ ID NO: 346164 - protein, 9 aa, Influenza virus
LSIENPSHE

SEQ ID NO: 346165 - protein, 9 aa, Influenza virus
SIENPSHEG

SEQ ID NO: 346166 - protein, 9 aa, Influenza virus
IENPSHEGE

SEQ ID NO: 346167 - protein, 9 aa, Influenza virus
ENPSHEGEG

SEQ ID NO: 346168 - protein, 9 aa, Influenza virus
NPSHEGEGI

SEQ ID NO: 346169 - protein, 9 aa, Influenza virus
GIPLYDAVK

SEQ ID NO: 346170 - protein, 9 aa, Influenza virus
IPLYDAVKC

SEQ ID NO: 346171 - protein, 9 aa, Influenza virus
RCMKTFFGW

SEQ ID NO: 346172 - protein, 9 aa, Influenza virus
CIRTFFGWK

SEQ ID NO: 346173 - protein, 9 aa, Influenza virus
LKWTLGENM

SEQ ID NO: 346174 - protein, 9 aa, Influenza virus
KWTLGENMA

SEQ ID NO: 346175 - protein, 9 aa, Influenza virus
ENIAPEKVD

SEQ ID NO: 346176 - protein, 9 aa, Influenza virus
NIAPEKVDF

SEQ ID NO: 346177 - protein, 9 aa, Influenza virus
MAPEKIDFE

SEQ ID NO: 346178 - protein, 9 aa, Influenza virus
WVQSEFNKA

SEQ ID NO: 346179 - protein, 9 aa, Influenza virus
VQSEFNKAC

SEQ ID NO: 346180 - protein, 9 aa, Influenza virus
KACELTDST

SEQ ID NO: 346181 - protein, 9 aa, Influenza virus
ACELTDSTW

SEQ ID NO: 346182 - protein, 9 aa, Influenza virus
WVELDEIGE

SEQ ID NO: 346183 - protein, 9 aa, Influenza virus
VELDEIGED

SEQ ID NO: 346184 - protein, 9 aa, Influenza virus
EFDEIGEDV

SEQ ID NO: 346185 - protein, 9 aa, Influenza virus
GEDIAPIEY

SEQ ID NO: 346186 - protein, 9 aa, Influenza virus
APIEHVASM

SEQ ID NO: 346187 - protein, 9 aa, Influenza virus
PIEHVASMR

SEQ ID NO: 346188 - protein, 9 aa, Influenza virus
IEHVASMRR

SEQ ID NO: 346189 - protein, 9 aa, Influenza virus
IASIRRNYF

SEQ ID NO: 346190 - protein, 9 aa, Influenza virus
ASMRRSYFT

SEQ ID NO: 346191 - protein, 9 aa, Influenza virus
RRDYFTAEV

SEQ ID NO: 346192 - protein, 9 aa, Influenza virus
RDYFTAEVS

SEQ ID NO: 346193 - protein, 9 aa, Influenza virus
YFTTEVSHC

SEQ ID NO: 346194 - protein, 9 aa, Influenza virus
FTTEVSHCR

SEQ ID NO: 346195 - protein, 9 aa, Influenza virus
TTEVSHCRA

SEQ ID NO: 346196 - protein, 9 aa, Influenza virus
TEVSHCRAT

SEQ ID NO: 346197 - protein, 9 aa, Influenza virus
IKGVYINTA

SEQ ID NO: 346198 - protein, 9 aa, Influenza virus
KGVYINTAM

SEQ ID NO: 346199 - protein, 9 aa, Influenza virus
GVYINTAML

SEQ ID NO: 346200 - protein, 9 aa, Influenza virus
VYINTAMLN

SEQ ID NO: 346201 - protein, 9 aa, Influenza virus
YINTAMLNA

SEQ ID NO: 346202 - protein, 9 aa, Influenza virus
INTAMLNAS

SEQ ID NO: 346203 - protein, 9 aa, Influenza virus
NSSCAAMDD

SEQ ID NO: 346204 - protein, 9 aa, Influenza virus
SSCAAMDDF

SEQ ID NO: 346205 - protein, 9 aa, Influenza virus
PMISKSRTK

SEQ ID NO: 346206 - protein, 9 aa, Influenza virus
MISKSRTKE

SEQ ID NO: 346207 - protein, 9 aa, Influenza virus
FSLVDPRLE

SEQ ID NO: 346208 - protein, 9 aa, Influenza virus
KWEKYCVIE

SEQ ID NO: 346209 - protein, 9 aa, Influenza virus
PLFLYVRTN

SEQ ID NO: 346210 - protein, 9 aa, Influenza virus
LFLYVRTNG

SEQ ID NO: 346211 - protein, 9 aa, Influenza virus
QVESMIEAE

SEQ ID NO: 346212 - protein, 9 aa, Influenza virus
VESMIEAES

SEQ ID NO: 346213 - protein, 9 aa, Influenza virus
SIIEAESSV

SEQ ID NO: 346214 - protein, 9 aa, Influenza virus
MIEAESSVR

SEQ ID NO: 346215 - protein, 9 aa, Influenza virus
IEAESSVRE

SEQ ID NO: 346216 - protein, 9 aa, Influenza virus
ESSVKEKDL

SEQ ID NO: 346217 - protein, 9 aa, Influenza virus
SSVKEKDLT

SEQ ID NO: 346218 - protein, 9 aa, Influenza virus
SVREKDMTK

SEQ ID NO: 346219 - protein, 9 aa, Influenza virus
VREKDMTKE

SEQ ID NO: 346220 - protein, 9 aa, Influenza virus
KEKDLTKEF

SEQ ID NO: 346221 - protein, 9 aa, Influenza virus
KDMTKDFFE

SEQ ID NO: 346222 - protein, 9 aa, Influenza virus
EMWPIGESP

SEQ ID NO: 346223 - protein, 9 aa, Influenza virus
WPVGESPKG

SEQ ID NO: 346224 - protein, 9 aa, Influenza virus
RVEEGSIGK

SEQ ID NO: 346225 - protein, 9 aa, Influenza virus
MEEGSIGKV

SEQ ID NO: 346226 - protein, 9 aa, Influenza virus
AKSVFNSIY

SEQ ID NO: 346227 - protein, 9 aa, Influenza virus
KSVFNSLYS

SEQ ID NO: 346228 - protein, 9 aa, Influenza virus
SVFNSLYSS

SEQ ID NO: 346229 - protein, 9 aa, Influenza virus
VFNSLYSSP

SEQ ID NO: 346230 - protein, 9 aa, Influenza virus
FNSLYSSPQ

SEQ ID NO: 346231 - protein, 9 aa, Influenza virus
NSLYSSPQL

SEQ ID NO: 346232 - protein, 9 aa, Influenza virus
SLYSSPQLE

SEQ ID NO: 346233 - protein, 9 aa, Influenza virus
ESRKMLLIV

SEQ ID NO: 346234 - protein, 9 aa, Influenza virus
SRKMLLIVQ

SEQ ID NO: 346235 - protein, 9 aa, Influenza virus
RKMLLIVQA

SEQ ID NO: 346236 - protein, 9 aa, Influenza virus
LLIVQAFRD

SEQ ID NO: 346237 - protein, 9 aa, Influenza virus
QALKDNLEP

SEQ ID NO: 346238 - protein, 9 aa, Influenza virus
ALKDNLEPG

SEQ ID NO: 346239 - protein, 9 aa, Influenza virus
LKDNLEPGT

SEQ ID NO: 346240 - protein, 9 aa, Influenza virus
LEPGTFDIE

SEQ ID NO: 346241 - protein, 9 aa, Influenza virus
EPGTFDIEG

SEQ ID NO: 346242 - protein, 9 aa, Influenza virus
PGTFDIEGL

SEQ ID NO: 346243 - protein, 9 aa, Influenza virus
GTFDIEGLY

SEQ ID NO: 346244 - protein, 9 aa, Influenza virus
GLYGAIEEC

SEQ ID NO: 346245 - protein, 9 aa, Influenza virus
LYGAIEECL

SEQ ID NO: 346246 - protein, 9 aa, Influenza virus
YGAIEECLI

SEQ ID NO: 346247 - protein, 9 aa, Influenza virus
GAIEECLIN

SEQ ID NO: 346248 - protein, 9 aa, Influenza virus
ASWFNSFLI

SEQ ID NO: 346249 - protein, 9 aa, Influenza virus
SWFNSFLIH

SEQ ID NO: 346250 - protein, 9 aa, Influenza virus
SFLTHALRF

SEQ ID NO: 346251 - protein, 9 aa, Influenza virus
NPTLLFLKM

SEQ ID NO: 346252 - protein, 9 aa, Influenza virus
PTLLFLKMP

SEQ ID NO: 346253 - protein, 9 aa, Influenza virus
LLFLKIPVQ

SEQ ID NO: 346254 - protein, 9 aa, Influenza virus
KIPVQNAIS

SEQ ID NO: 346255 - protein, 9 aa, Influenza virus
VPAQNAISI

SEQ ID NO: 346256 - protein, 9 aa, Influenza virus
THQYSEKGR

SEQ ID NO: 346257 - protein, 9 aa, Influenza virus
HQYSEKGRW

SEQ ID NO: 346258 - protein, 9 aa, Influenza virus
NTETKAPQL

SEQ ID NO: 346259 - protein, 9 aa, Influenza virus
TETKAPQLN

SEQ ID NO: 346260 - protein, 9 aa, Influenza virus
ETGALQLNP

SEQ ID NO: 346261 - protein, 9 aa, Influenza virus
TGALQLNPI

SEQ ID NO: 346262 - protein, 9 aa, Influenza virus
GAPQLNPVD

SEQ ID NO: 346263 - protein, 9 aa, Influenza virus
NPIDGPLPV

SEQ ID NO: 346264 - protein, 9 aa, Influenza virus
DNDPSGYAQ

SEQ ID NO: 346265 - protein, 9 aa, Influenza virus
LEAMALLEE

SEQ ID NO: 346266 - protein, 9 aa, Influenza virus
EAMALLEES

SEQ ID NO: 346267 - protein, 9 aa, Influenza virus
AMALLEESH

SEQ ID NO: 346268 - protein, 9 aa, Influenza virus
MALLEESHP

SEQ ID NO: 346269 - protein, 9 aa, Influenza virus
ALLEESHPG

SEQ ID NO: 346270 - protein, 9 aa, Influenza virus
LENSHPGIF

SEQ ID NO: 346271 - protein, 9 aa, Influenza virus
ENSHPGIFE

SEQ ID NO: 346272 - protein, 9 aa, Influenza virus
SHPGIFESS

SEQ ID NO: 346273 - protein, 9 aa, Influenza virus
PGIFGNSCL

SEQ ID NO: 346274 - protein, 9 aa, Influenza virus
GIFGNSCLE

SEQ ID NO: 346275 - protein, 9 aa, Influenza virus
IFGNSCLET

SEQ ID NO: 346276 - protein, 9 aa, Influenza virus
ANTIEVFKS

SEQ ID NO: 346277 - protein, 9 aa, Influenza virus
NTIEVFKSN

SEQ ID NO: 346278 - protein, 9 aa, Influenza virus
LMDFLKDVM

SEQ ID NO: 346279 - protein, 9 aa, Influenza virus
EIITHFQRK

SEQ ID NO: 346280 - protein, 9 aa, Influenza virus
IITHFQRKR

SEQ ID NO: 346281 - protein, 9 aa, Influenza virus
RKRRVRDNI

SEQ ID NO: 346282 - protein, 9 aa, Influenza virus
KRRVRDNIT

SEQ ID NO: 346283 - protein, 9 aa, Influenza virus
TRKMVTQRT

SEQ ID NO: 346284 - protein, 9 aa, Influenza virus
KMVTQRTVG

SEQ ID NO: 346285 - protein, 9 aa, Influenza virus
MVTQRTMGK

SEQ ID NO: 346286 - protein, 9 aa, Influenza virus
VTQRTIGKR

SEQ ID NO: 346287 - protein, 9 aa, Influenza virus
TQRTMGKKK

SEQ ID NO: 346288 - protein, 9 aa, Influenza virus
QRTIGKRKQ

SEQ ID NO: 346289 - protein, 9 aa, Influenza virus
SYLIRTLTL

SEQ ID NO: 346290 - protein, 9 aa, Influenza virus
RGFVYFVEI

SEQ ID NO: 346291 - protein, 9 aa, Influenza virus
GFVYFVEIL

SEQ ID NO: 346292 - protein, 9 aa, Influenza virus
FVYFVEILA

SEQ ID NO: 346293 - protein, 9 aa, Influenza virus
VYFVEILAR

SEQ ID NO: 346294 - protein, 9 aa, Influenza virus
VETLARCIC

SEQ ID NO: 346295 - protein, 9 aa, Influenza virus
LARNICEKL

SEQ ID NO: 346296 - protein, 9 aa, Influenza virus
ARNICEKLE

SEQ ID NO: 346297 - protein, 9 aa, Influenza virus
RNICEKLEQ

SEQ ID NO: 346298 - protein, 9 aa, Influenza virus
NICEKLEQS

SEQ ID NO: 346299 - protein, 9 aa, Influenza virus
TNSQDTEVS

SEQ ID NO: 346300 - protein, 9 aa, Influenza virus
NSQDTEVSF

SEQ ID NO: 346301 - protein, 9 aa, Influenza virus
QDTEVSFTI

SEQ ID NO: 346302 - protein, 9 aa, Influenza virus
NQNPRVFLT

SEQ ID NO: 346303 - protein, 9 aa, Influenza virus
QNPRVFLTM

SEQ ID NO: 346304 - protein, 9 aa, Influenza virus
NPRVFLTMI

SEQ ID NO: 346305 - protein, 9 aa, Influenza virus
PRVFLTMIT

SEQ ID NO: 346306 - protein, 9 aa, Influenza virus
RVFLTMITY

SEQ ID NO: 346307 - protein, 9 aa, Influenza virus
VFLTMITYI

SEQ ID NO: 346308 - protein, 9 aa, Influenza virus
QPKWFRNVL

SEQ ID NO: 346309 - protein, 9 aa, Influenza virus
PKWFRNVLS

SEQ ID NO: 346310 - protein, 9 aa, Influenza virus
WFRNVLSVA

SEQ ID NO: 346311 - protein, 9 aa, Influenza virus
FRNVLSVAP

SEQ ID NO: 346312 - protein, 9 aa, Influenza virus
RNVLSVAPI

SEQ ID NO: 346313 - protein, 9 aa, Influenza virus
NVLSVAPIM

SEQ ID NO: 346314 - protein, 9 aa, Influenza virus
VLSVAPIMF

SEQ ID NO: 346315 - protein, 9 aa, Influenza virus
GYMFESKKM

SEQ ID NO: 346316 - protein, 9 aa, Influenza virus
GTAALSPGM

SEQ ID NO: 346317 - protein, 9 aa, Influenza virus
LNLGQRKYT

SEQ ID NO: 346318 - protein, 9 aa, Influenza virus
TVYWWDGLQ

SEQ ID NO: 346319 - protein, 9 aa, Influenza virus
VYWWDGLQS

SEQ ID NO: 346320 - protein, 9 aa, Influenza virus
DFALILNAP

SEQ ID NO: 346321 - protein, 9 aa, Influenza virus
IGVAVIKNN

SEQ ID NO: 346322 - protein, 9 aa, Influenza virus
VTVIKNNMV

SEQ ID NO: 346323 - protein, 9 aa, Influenza virus
YRCHRGDTH

SEQ ID NO: 346324 - protein, 9 aa, Influenza virus
RCHRGDTHI

SEQ ID NO: 346325 - protein, 9 aa, Influenza virus
HIQTRRSFE

SEQ ID NO: 346326 - protein, 9 aa, Influenza virus
IQTRRAFEL

SEQ ID NO: 346327 - protein, 9 aa, Influenza virus
QTRRSFELR

SEQ ID NO: 346328 - protein, 9 aa, Influenza virus
YQGRLCNPM

SEQ ID NO: 346329 - protein, 9 aa, Influenza virus
QGRLCNPMN

SEQ ID NO: 346330 - protein, 9 aa, Influenza virus
CNPMNPFVS

SEQ ID NO: 346331 - protein, 9 aa, Influenza virus
NPMNPFVSH

SEQ ID NO: 346332 - protein, 9 aa, Influenza virus
EQMYQKCCT

SEQ ID NO: 346333 - protein, 9 aa, Influenza virus
QMYQKCCTL

SEQ ID NO: 346334 - protein, 9 aa, Influenza virus
MYQKCCTLF

SEQ ID NO: 346335 - protein, 9 aa, Influenza virus
YQKCCTLFE

SEQ ID NO: 346336 - protein, 9 aa, Influenza virus
QKCCTLFEK

SEQ ID NO: 346337 - protein, 9 aa, Influenza virus
KCCTLFEKF

SEQ ID NO: 346338 - protein, 9 aa, Influenza virus
RPVGISSMM

SEQ ID NO: 346339 - protein, 9 aa, Influenza virus
PVGISSMME

SEQ ID NO: 346340 - protein, 9 aa, Influenza virus
VGISSMMEA

SEQ ID NO: 346341 - protein, 9 aa, Influenza virus
ISSMVEAMI

SEQ ID NO: 346342 - protein, 9 aa, Influenza virus
SSMVEAMIS

SEQ ID NO: 346343 - protein, 9 aa, Influenza virus
SMVEAMISR

SEQ ID NO: 346344 - protein, 9 aa, Influenza virus
MVEAMISRA

SEQ ID NO: 346345 - protein, 9 aa, Influenza virus
VEAMISRAR

SEQ ID NO: 346346 - protein, 9 aa, Influenza virus
RVDSESGRI

SEQ ID NO: 346347 - protein, 9 aa, Influenza virus
RTRGILTKT

SEQ ID NO: 346348 - protein, 9 aa, Influenza virus
TRGILTKTT

SEQ ID NO: 346349 - protein, 9 aa, Influenza virus
AMKYPITAN

SEQ ID NO: 346350 - protein, 9 aa, Influenza virus
RNEQGQALW

SEQ ID NO: 346351 - protein, 9 aa, Influenza virus
MVSPLAITW

SEQ ID NO: 346352 - protein, 9 aa, Influenza virus
HYSKVYKTY

SEQ ID NO: 346353 - protein, 9 aa, Influenza virus
YSKVYKTYF

SEQ ID NO: 346354 - protein, 9 aa, Influenza virus
GAFGPVHFR

SEQ ID NO: 346355 - protein, 9 aa, Influenza virus
TFGPVHFRS

SEQ ID NO: 346356 - protein, 9 aa, Influenza virus
GPVHFRSQV

SEQ ID NO: 346357 - protein, 9 aa, Influenza virus
PVHFRSQVK

SEQ ID NO: 346358 - protein, 9 aa, Influenza virus
VHFRSQVKI

SEQ ID NO: 346359 - protein, 9 aa, Influenza virus
HFRSQVKIR

SEQ ID NO: 346360 - protein, 9 aa, Influenza virus
IKIRRRVDI

SEQ ID NO: 346361 - protein, 9 aa, Influenza virus
KIRRRVDMN

SEQ ID NO: 346362 - protein, 9 aa, Influenza virus
IRRRVDMNP

SEQ ID NO: 346363 - protein, 9 aa, Influenza virus
RRRVDMNPG

SEQ ID NO: 346364 - protein, 9 aa, Influenza virus
RRVDMNPGH

SEQ ID NO: 346365 - protein, 9 aa, Influenza virus
RVDMNPGHA

SEQ ID NO: 346366 - protein, 9 aa, Influenza virus
VDMNPGHAD

SEQ ID NO: 346367 - protein, 9 aa, Influenza virus
VKEAQDVIM

SEQ ID NO: 346368 - protein, 9 aa, Influenza virus
VGARILASE

SEQ ID NO: 346369 - protein, 9 aa, Influenza virus
GARILASES

SEQ ID NO: 346370 - protein, 9 aa, Influenza virus
ARILASESQ

SEQ ID NO: 346371 - protein, 9 aa, Influenza virus
RIITSESQL

SEQ ID NO: 346372 - protein, 9 aa, Influenza virus
FLPVTGGTS

SEQ ID NO: 346373 - protein, 9 aa, Influenza virus
LPVTGGTSS

SEQ ID NO: 346374 - protein, 9 aa, Influenza virus
GGTSSVYVE

SEQ ID NO: 346375 - protein, 9 aa, Influenza virus
GTSSVYVEV

SEQ ID NO: 346376 - protein, 9 aa, Influenza virus
TSSVYVEVL

SEQ ID NO: 346377 - protein, 9 aa, Influenza virus
SSVYVEVLH

SEQ ID NO: 346378 - protein, 9 aa, Influenza virus
EQMYTPGGK

SEQ ID NO: 346379 - protein, 9 aa, Influenza virus
QMYTPGGKV

SEQ ID NO: 346380 - protein, 9 aa, Influenza virus
YTPGGKVRN

SEQ ID NO: 346381 - protein, 9 aa, Influenza virus
TPGGKVRND

SEQ ID NO: 346382 - protein, 9 aa, Influenza virus
VKNDDIDQS

SEQ ID NO: 346383 - protein, 9 aa, Influenza virus
KNDDIDQSL

SEQ ID NO: 346384 - protein, 9 aa, Influenza virus
DEVDQSLII

SEQ ID NO: 346385 - protein, 9 aa, Influenza virus
ARNIVRRAI

SEQ ID NO: 346386 - protein, 9 aa, Influenza virus
RNIVRRAIV

SEQ ID NO: 346387 - protein, 9 aa, Influenza virus
NIVRRAIVS

SEQ ID NO: 346388 - protein, 9 aa, Influenza virus
ATVSADPLL

SEQ ID NO: 346389 - protein, 9 aa, Influenza virus
TVSADPLLS

SEQ ID NO: 346390 - protein, 9 aa, Influenza virus
DILRQNPSE

SEQ ID NO: 346391 - protein, 9 aa, Influenza virus
NPTEEQAVE

SEQ ID NO: 346392 - protein, 9 aa, Influenza virus
AVDICKAAL

SEQ ID NO: 346393 - protein, 9 aa, Influenza virus
VDICKAALG

SEQ ID NO: 346394 - protein, 9 aa, Influenza virus
ICKAAMGLK

SEQ ID NO: 346395 - protein, 9 aa, Influenza virus
CKAAMGLKI

SEQ ID NO: 346396 - protein, 9 aa, Influenza virus
KAAMGLKIS

SEQ ID NO: 346397 - protein, 9 aa, Influenza virus
AAMGLKISS

SEQ ID NO: 346398 - protein, 9 aa, Influenza virus
AMGLKISSS

SEQ ID NO: 346399 - protein, 9 aa, Influenza virus
MGLKISSSF

SEQ ID NO: 346400 - protein, 9 aa, Influenza virus
FTFKRTSGT

SEQ ID NO: 346401 - protein, 9 aa, Influenza virus
TFKRTSGTS

SEQ ID NO: 346402 - protein, 9 aa, Influenza virus
TGNLQTLKV

SEQ ID NO: 346403 - protein, 9 aa, Influenza virus
EGFEEFTMV

SEQ ID NO: 346404 - protein, 9 aa, Influenza virus
GFEEFTMVG

SEQ ID NO: 346405 - protein, 9 aa, Influenza virus
KATAILRKA

SEQ ID NO: 346406 - protein, 9 aa, Influenza virus
ATAIFRKAT

SEQ ID NO: 346407 - protein, 9 aa, Influenza virus
TAIIRKATR

SEQ ID NO: 346408 - protein, 9 aa, Influenza virus
RKATRRMIQ

SEQ ID NO: 346409 - protein, 9 aa, Influenza virus
KATKRLIQL

SEQ ID NO: 346410 - protein, 9 aa, Influenza virus
TKRLIQLIV

SEQ ID NO: 346411 - protein, 9 aa, Influenza virus
KLIQLIVSG

SEQ ID NO: 346412 - protein, 9 aa, Influenza virus
LIQLIVSGK

SEQ ID NO: 346413 - protein, 9 aa, Influenza virus
VFSQEDCMM

SEQ ID NO: 346414 - protein, 9 aa, Influenza virus
FSQEDCMMK

SEQ ID NO: 346415 - protein, 9 aa, Influenza virus
SQEDCMMKA

SEQ ID NO: 346416 - protein, 9 aa, Influenza virus
QEDCMMKAV

SEQ ID NO: 346417 - protein, 9 aa, Influenza virus
EDCMMKAVR

SEQ ID NO: 346418 - protein, 9 aa, Influenza virus
DCMMKAVRG

SEQ ID NO: 346419 - protein, 9 aa, Influenza virus
RMIKAVRGD

SEQ ID NO: 346420 - protein, 9 aa, Influenza virus
RHFQKNAKV

SEQ ID NO: 346421 - protein, 9 aa, Influenza virus
HFQKNAKVL

SEQ ID NO: 346422 - protein, 9 aa, Influenza virus
RVSKTGVDE

SEQ ID NO: 346423 - protein, 9 aa, Influenza virus
VSKTGVDEY

SEQ ID NO: 346424 - protein, 9 aa, Influenza virus
SRMGVDEYS

SEQ ID NO: 346425 - protein, 9 aa, Influenza virus
KTGVDEYSS

SEQ ID NO: 346426 - protein, 9 aa, Influenza virus
TGVDEYSST

SEQ ID NO: 346427 - protein, 9 aa, Influenza virus
VDEYSSAER

SEQ ID NO: 346428 - protein, 9 aa, Influenza virus
AVSIDRFLR

SEQ ID NO: 346429 - protein, 9 aa, Influenza virus
RFLRVRDQL

SEQ ID NO: 346430 - protein, 9 aa, Influenza virus
FLRVRDQLG

SEQ ID NO: 346431 - protein, 9 aa, Influenza virus
LRVRDQLGN

SEQ ID NO: 346432 - protein, 9 aa, Influenza virus
QGNILLSPE

SEQ ID NO: 346433 - protein, 9 aa, Influenza virus
EEVSEAQGT

SEQ ID NO: 346434 - protein, 9 aa, Influenza virus
EVSEAQGTE

SEQ ID NO: 346435 - protein, 9 aa, Influenza virus
KLTITYSSP

SEQ ID NO: 346436 - protein, 9 aa, Influenza virus
LTITYSSPM

SEQ ID NO: 346437 - protein, 9 aa, Influenza virus
TITYSSPMM

SEQ ID NO: 346438 - protein, 9 aa, Influenza virus
ITYSSPMMW

SEQ ID NO: 346439 - protein, 9 aa, Influenza virus
TYSSPMMWE

SEQ ID NO: 346440 - protein, 9 aa, Influenza virus
YSSPMMWEI

SEQ ID NO: 346441 - protein, 9 aa, Influenza virus
SSPMMWEIN

SEQ ID NO: 346442 - protein, 9 aa, Influenza virus
SPMMWEING

SEQ ID NO: 346443 - protein, 9 aa, Influenza virus
PMMWEINGP

SEQ ID NO: 346444 - protein, 9 aa, Influenza virus
MMWEINGPD

SEQ ID NO: 346445 - protein, 9 aa, Influenza virus
INGPDSVLV

SEQ ID NO: 346446 - protein, 9 aa, Influenza virus
VNTYQWIIK

SEQ ID NO: 346447 - protein, 9 aa, Influenza virus
KIQWSQNPS

SEQ ID NO: 346448 - protein, 9 aa, Influenza virus
LYNKLEFEP

SEQ ID NO: 346449 - protein, 9 aa, Influenza virus
YNKLEFEPF

SEQ ID NO: 346450 - protein, 9 aa, Influenza virus
NKLEFEPFQ

SEQ ID NO: 346451 - protein, 9 aa, Influenza virus
KLEFEPFQS

SEQ ID NO: 346452 - protein, 9 aa, Influenza virus
RSLYSGFVR

SEQ ID NO: 346453 - protein, 9 aa, Influenza virus
GTFDTIQII

SEQ ID NO: 346454 - protein, 9 aa, Influenza virus
TFDTIQIIK

SEQ ID NO: 346455 - protein, 9 aa, Influenza virus
TIQIIKLLP

SEQ ID NO: 346456 - protein, 9 aa, Influenza virus
IQIIKLLPF

SEQ ID NO: 346457 - protein, 9 aa, Influenza virus
FASAPPEQS

SEQ ID NO: 346458 - protein, 9 aa, Influenza virus
AAPPVQSRM

SEQ ID NO: 346459 - protein, 9 aa, Influenza virus
APPVQSKMQ

SEQ ID NO: 346460 - protein, 9 aa, Influenza virus
PPVQSKMQF

SEQ ID NO: 346461 - protein, 9 aa, Influenza virus
PVQSKMQFS

SEQ ID NO: 346462 - protein, 9 aa, Influenza virus
VQSKMQFSS

SEQ ID NO: 346463 - protein, 9 aa, Influenza virus
SRMQFSSLA

SEQ ID NO: 346464 - protein, 9 aa, Influenza virus
SLAVNVRGS

SEQ ID NO: 346465 - protein, 9 aa, Influenza virus
LAVNVRGSG

SEQ ID NO: 346466 - protein, 9 aa, Influenza virus
TVSVRGSGM

SEQ ID NO: 346467 - protein, 9 aa, Influenza virus
SVRGSGMRI

SEQ ID NO: 346468 - protein, 9 aa, Influenza virus
RGTGMRILV

SEQ ID NO: 346469 - protein, 9 aa, Influenza virus
GTGMRILVR

SEQ ID NO: 346470 - protein, 9 aa, Influenza virus
TGMRILVRG

SEQ ID NO: 346471 - protein, 9 aa, Influenza virus
GLRILIRGN

SEQ ID NO: 346472 - protein, 9 aa, Influenza virus
LRILIRGNS

SEQ ID NO: 346473 - protein, 9 aa, Influenza virus
LIRGNSPIF

SEQ ID NO: 346474 - protein, 9 aa, Influenza virus
IRGNSPIFN

SEQ ID NO: 346475 - protein, 9 aa, Influenza virus
NSPAFNYNK

SEQ ID NO: 346476 - protein, 9 aa, Influenza virus
TRRLTVLGK

SEQ ID NO: 346477 - protein, 9 aa, Influenza virus
RRLTVLGKD

SEQ ID NO: 346478 - protein, 9 aa, Influenza virus
GGVESAVLR

SEQ ID NO: 346479 - protein, 9 aa, Influenza virus
GFLILGRED

SEQ ID NO: 346480 - protein, 9 aa, Influenza virus
FLILGKENK

SEQ ID NO: 346481 - protein, 9 aa, Influenza virus
GKENKRYGP

SEQ ID NO: 346482 - protein, 9 aa, Influenza virus
KENKRYGPA

SEQ ID NO: 346483 - protein, 9 aa, Influenza virus
ENKKYGPAL

SEQ ID NO: 346484 - protein, 9 aa, Influenza virus
NKKYGPALS

SEQ ID NO: 346485 - protein, 9 aa, Influenza virus
ALSISELSN

SEQ ID NO: 346486 - protein, 9 aa, Influenza virus
IAKGEKANV

SEQ ID NO: 346487 - protein, 9 aa, Influenza virus
ATKRIRLAI

SEQ ID NO: 346488 - protein, 9 aa, Influenza virus
RIRMAINLV

SEQ ID NO: 346489 - protein, 9 aa, Influenza virus
RRKRRGLFG

SEQ ID NO: 346490 - protein, 9 aa, Influenza virus
RTQESSCVC

SEQ ID NO: 346491 - protein, 9 aa, Influenza virus
GWAIHSKDN

SEQ ID NO: 346492 - protein, 9 aa, Influenza virus
SKDNNIRIG

SEQ ID NO: 346493 - protein, 9 aa, Influenza virus
DNNIRIGSK

SEQ ID NO: 346494 - protein, 9 aa, Influenza virus
NNIRIGSKG

SEQ ID NO: 346495 - protein, 9 aa, Influenza virus
NIRIGSKGD

SEQ ID NO: 346496 - protein, 9 aa, Influenza virus
GDVFVVREP

SEQ ID NO: 346497 - protein, 9 aa, Influenza virus
DVFVVREPF

SEQ ID NO: 346498 - protein, 9 aa, Influenza virus
NDRHSNGTI

SEQ ID NO: 346499 - protein, 9 aa, Influenza virus
DRSPFRALM

SEQ ID NO: 346500 - protein, 9 aa, Influenza virus
RALMSCPVG

SEQ ID NO: 346501 - protein, 9 aa, Influenza virus
VGEVPSPYN

SEQ ID NO: 346502 - protein, 9 aa, Influenza virus
SASACHDGV

SEQ ID NO: 346503 - protein, 9 aa, Influenza virus
IGVSGPDNG

SEQ ID NO: 346504 - protein, 9 aa, Influenza virus
VSGPDNGAV

SEQ ID NO: 346505 - protein, 9 aa, Influenza virus
PDNGAVAVV

SEQ ID NO: 346506 - protein, 9 aa, Influenza virus
DNGAVAVVK

SEQ ID NO: 346507 - protein, 9 aa, Influenza virus
NGAVAVVKY

SEQ ID NO: 346508 - protein, 9 aa, Influenza virus
AVLKYNGVI

SEQ ID NO: 346509 - protein, 9 aa, Influenza virus
VLKYNGVIT

SEQ ID NO: 346510 - protein, 9 aa, Influenza virus
NGYCFTVMT

SEQ ID NO: 346511 - protein, 9 aa, Influenza virus
FTIMTDGPN

SEQ ID NO: 346512 - protein, 9 aa, Influenza virus
APNYYYEEC

SEQ ID NO: 346513 - protein, 9 aa, Influenza virus
PNYYYEECS

SEQ ID NO: 346514 - protein, 9 aa, Influenza virus
NYYYEECSC

SEQ ID NO: 346515 - protein, 9 aa, Influenza virus
YYYEECSCY

SEQ ID NO: 346516 - protein, 9 aa, Influenza virus
NRPWVSFNH

SEQ ID NO: 346517 - protein, 9 aa, Influenza virus
YRIGYICSG

SEQ ID NO: 346518 - protein, 9 aa, Influenza virus
GVFGDTPRP

SEQ ID NO: 346519 - protein, 9 aa, Influenza virus
GVKGFSYRY

SEQ ID NO: 346520 - protein, 9 aa, Influenza virus
KYGDGVWIG

SEQ ID NO: 346521 - protein, 9 aa, Influenza virus
NCIKPCFWV

SEQ ID NO: 346522 - protein, 9 aa, Influenza virus
TIWTSASSI

SEQ ID NO: 346523 - protein, 9 aa, Influenza virus
IWTSASSIS

SEQ ID NO: 346524 - protein, 9 aa, Influenza virus
WPDDAELPF

SEQ ID NO: 346525 - protein, 9 aa, Influenza virus
FAPLSKDNS

SEQ ID NO: 346526 - protein, 9 aa, Influenza virus
APLSKDNSI

SEQ ID NO: 346527 - protein, 9 aa, Influenza virus
PFSKDNSVR

SEQ ID NO: 346528 - protein, 9 aa, Influenza virus
FSKDNSVRL

SEQ ID NO: 346529 - protein, 9 aa, Influenza virus
SKDNSIRLA

SEQ ID NO: 346530 - protein, 9 aa, Influenza virus
TRELYVSCD

SEQ ID NO: 346531 - protein, 9 aa, Influenza virus
SHRTLLMNE

SEQ ID NO: 346532 - protein, 9 aa, Influenza virus
GVPFYLGTK

SEQ ID NO: 346533 - protein, 9 aa, Influenza virus
VPFYLGTKQ

SEQ ID NO: 346534 - protein, 9 aa, Influenza virus
TKQVCVAWS

SEQ ID NO: 346535 - protein, 9 aa, Influenza virus
KQVCVAWSS

SEQ ID NO: 346536 - protein, 9 aa, Influenza virus
SILRTQESE

SEQ ID NO: 346537 - protein, 9 aa, Influenza virus
ESECVCINE

SEQ ID NO: 346538 - protein, 9 aa, Influenza virus
IMTDGSASG

SEQ ID NO: 346539 - protein, 9 aa, Influenza virus
EECSCYPSY

SEQ ID NO: 346540 - protein, 9 aa, Influenza virus
GLVGDTPRE

SEQ ID NO: 346541 - protein, 9 aa, Influenza virus
GVKGWAFDV

SEQ ID NO: 346542 - protein, 9 aa, Influenza virus
RAGYETFKV

SEQ ID NO: 346543 - protein, 9 aa, Influenza virus
WTANSIIVF

SEQ ID NO: 346544 - protein, 9 aa, Influenza virus
TANSIIVFC

SEQ ID NO: 346545 - protein, 9 aa, Influenza virus
ANSIIVFCG

SEQ ID NO: 346546 - protein, 9 aa, Influenza virus
GTWPDGADI

SEQ ID NO: 346547 - protein, 9 aa, Influenza virus
ANINFMPYI

SEQ ID NO: 346548 - protein, 9 aa, Influenza virus
DINLMPIYS

SEQ ID NO: 346549 - protein, 9 aa, Influenza virus
ALLVGIGNL

SEQ ID NO: 346550 - protein, 9 aa, Influenza virus
IATREPYVS

SEQ ID NO: 346551 - protein, 9 aa, Influenza virus
VCWSFALAQ

SEQ ID NO: 346552 - protein, 9 aa, Influenza virus
SNGTIRDRT

SEQ ID NO: 346553 - protein, 9 aa, Influenza virus
RDRTPYRSL

SEQ ID NO: 346554 - protein, 9 aa, Influenza virus
RTPYRSLIK

SEQ ID NO: 346555 - protein, 9 aa, Influenza virus
TPYRSLIKF

SEQ ID NO: 346556 - protein, 9 aa, Influenza virus
YRSLIKFPI

SEQ ID NO: 346557 - protein, 9 aa, Influenza virus
RNILRTQES

SEQ ID NO: 346558 - protein, 9 aa, Influenza virus
TDDPAANSA

SEQ ID NO: 346559 - protein, 9 aa, Influenza virus
ADYRVYWIR

SEQ ID NO: 346560 - protein, 9 aa, Influenza virus
KIRHLEECS

SEQ ID NO: 346561 - protein, 9 aa, Influenza virus
SNRPWIRIN

SEQ ID NO: 346562 - protein, 9 aa, Influenza virus
NRPWIRINN

SEQ ID NO: 346563 - protein, 9 aa, Influenza virus
RPWIRINNE

SEQ ID NO: 346564 - protein, 9 aa, Influenza virus
PWIRINNET

SEQ ID NO: 346565 - protein, 9 aa, Influenza virus
WIRINNETI

SEQ ID NO: 346566 - protein, 9 aa, Influenza virus
INNETIVET

SEQ ID NO: 346567 - protein, 9 aa, Influenza virus
ILETGYVCG

SEQ ID NO: 346568 - protein, 9 aa, Influenza virus
LETGYVCGK

SEQ ID NO: 346569 - protein, 9 aa, Influenza virus
FHSDTPRPT

SEQ ID NO: 346570 - protein, 9 aa, Influenza virus
HSDTPRPTD

SEQ ID NO: 346571 - protein, 9 aa, Influenza virus
SDTPRPTDP

SEQ ID NO: 346572 - protein, 9 aa, Influenza virus
DTPRPTDPS

SEQ ID NO: 346573 - protein, 9 aa, Influenza virus
RPGVKGFGF

SEQ ID NO: 346574 - protein, 9 aa, Influenza virus
SNDVWLGRT

SEQ ID NO: 346575 - protein, 9 aa, Influenza virus
NQTLVSNND

SEQ ID NO: 346576 - protein, 9 aa, Influenza virus
PDGANIGLC

SEQ ID NO: 346577 - protein, 9 aa, Influenza virus
DGSKIGFMP

SEQ ID NO: 346578 - protein, 9 aa, Influenza virus
IVTIGSVSI

SEQ ID NO: 346579 - protein, 9 aa, Influenza virus
TVGLLLQVT

SEQ ID NO: 346580 - protein, 9 aa, Influenza virus
IGPLLQITS

SEQ ID NO: 346581 - protein, 9 aa, Influenza virus
SHYNQITQT

SEQ ID NO: 346582 - protein, 9 aa, Influenza virus
HVQNNYTTI

SEQ ID NO: 346583 - protein, 9 aa, Influenza virus
ISCSIHECR

SEQ ID NO: 346584 - protein, 9 aa, Influenza virus
SCSVSECRT

SEQ ID NO: 346585 - protein, 9 aa, Influenza virus
CSVSECRTF

SEQ ID NO: 346586 - protein, 9 aa, Influenza virus
SVSECRTFF

SEQ ID NO: 346587 - protein, 9 aa, Influenza virus
VSECRTFFL

SEQ ID NO: 346588 - protein, 9 aa, Influenza virus
ATGFHLEEC

SEQ ID NO: 346589 - protein, 9 aa, Influenza virus
AGFHFEECS

SEQ ID NO: 346590 - protein, 9 aa, Influenza virus
SIECVCRDN

SEQ ID NO: 346591 - protein, 9 aa, Influenza virus
GDNPRSVDG

SEQ ID NO: 346592 - protein, 9 aa, Influenza virus
PRPMDGTGS

SEQ ID NO: 346593 - protein, 9 aa, Influenza virus
RPMDGTGSC

SEQ ID NO: 346594 - protein, 9 aa, Influenza virus
CGVNSNTTG

SEQ ID NO: 346595 - protein, 9 aa, Influenza virus
GVNSNTTGW

SEQ ID NO: 346596 - protein, 9 aa, Influenza virus
TIGSMSLAL

SEQ ID NO: 346597 - protein, 9 aa, Influenza virus
VTKVYNETV

SEQ ID NO: 346598 - protein, 9 aa, Influenza virus
EMYNETVRV

SEQ ID NO: 346599 - protein, 9 aa, Influenza virus
VYNETVRVK

SEQ ID NO: 346600 - protein, 9 aa, Influenza virus
YNETVRVEI

SEQ ID NO: 346601 - protein, 9 aa, Influenza virus
TIPINNTIY

SEQ ID NO: 346602 - protein, 9 aa, Influenza virus
LCEISGFAI

SEQ ID NO: 346603 - protein, 9 aa, Influenza virus
SGFAIASKD

SEQ ID NO: 346604 - protein, 9 aa, Influenza virus
GFAVVSKDN

SEQ ID NO: 346605 - protein, 9 aa, Influenza virus
FAIASKDNG

SEQ ID NO: 346606 - protein, 9 aa, Influenza virus
AVVSKDNGI

SEQ ID NO: 346607 - protein, 9 aa, Influenza virus
EPFVACSPS

SEQ ID NO: 346608 - protein, 9 aa, Influenza virus
PFVACSPSE

SEQ ID NO: 346609 - protein, 9 aa, Influenza virus
FVACSPSEC

SEQ ID NO: 346610 - protein, 9 aa, Influenza virus
VACSPSECR

SEQ ID NO: 346611 - protein, 9 aa, Influenza virus
ACSPSECRT

SEQ ID NO: 346612 - protein, 9 aa, Influenza virus
ACHDGKKWM

SEQ ID NO: 346613 - protein, 9 aa, Influenza virus
YGGIPTDVI

SEQ ID NO: 346614 - protein, 9 aa, Influenza virus
GGIPTDVIR

SEQ ID NO: 346615 - protein, 9 aa, Influenza virus
GVPTDVMRS

SEQ ID NO: 346616 - protein, 9 aa, Influenza virus
VPTDVMRSW

SEQ ID NO: 346617 - protein, 9 aa, Influenza virus
DVVRSWRRQ

SEQ ID NO: 346618 - protein, 9 aa, Influenza virus
VVRSWRRQI

SEQ ID NO: 346619 - protein, 9 aa, Influenza virus
VRSWRRQIL

SEQ ID NO: 346620 - protein, 9 aa, Influenza virus
PANNQASYR

SEQ ID NO: 346621 - protein, 9 aa, Influenza virus
ANNQASYRI

SEQ ID NO: 346622 - protein, 9 aa, Influenza virus
NNQASYRIF

SEQ ID NO: 346623 - protein, 9 aa, Influenza virus
ASYRIFKSH

SEQ ID NO: 346624 - protein, 9 aa, Influenza virus
CSCYPNLCQ

SEQ ID NO: 346625 - protein, 9 aa, Influenza virus
SCYPNLGIV

SEQ ID NO: 346626 - protein, 9 aa, Influenza virus
CYPNLCQVE

SEQ ID NO: 346627 - protein, 9 aa, Influenza virus
YPNLCQVEC

SEQ ID NO: 346628 - protein, 9 aa, Influenza virus
PNLGIVECV

SEQ ID NO: 346629 - protein, 9 aa, Influenza virus
NLCQVECVC

SEQ ID NO: 346630 - protein, 9 aa, Influenza virus
LGIVECVCR

SEQ ID NO: 346631 - protein, 9 aa, Influenza virus
TDTPRVQDG

SEQ ID NO: 346632 - protein, 9 aa, Influenza virus
TSVWAGRTV

SEQ ID NO: 346633 - protein, 9 aa, Influenza virus
NISSRSGFE

SEQ ID NO: 346634 - protein, 9 aa, Influenza virus
EVLNNKHWS

SEQ ID NO: 346635 - protein, 9 aa, Influenza virus
ILNNKNWSG

SEQ ID NO: 346636 - protein, 9 aa, Influenza virus
YSGAFTIPV

SEQ ID NO: 346637 - protein, 9 aa, Influenza virus
PEERPSIWT

SEQ ID NO: 346638 - protein, 9 aa, Influenza virus
EERNSIWTS

SEQ ID NO: 346639 - protein, 9 aa, Influenza virus
SEVPEWSWD

SEQ ID NO: 346640 - protein, 9 aa, Influenza virus
CISATGMIL

SEQ ID NO: 346641 - protein, 9 aa, Influenza virus
ISATGMALS

SEQ ID NO: 346642 - protein, 9 aa, Influenza virus
SATGMALSV

SEQ ID NO: 346643 - protein, 9 aa, Influenza virus
ATGMALSVV

SEQ ID NO: 346644 - protein, 9 aa, Influenza virus
TGMTLSVVN

SEQ ID NO: 346645 - protein, 9 aa, Influenza virus
GLVNLGLNI

SEQ ID NO: 346646 - protein, 9 aa, Influenza virus
LVNLGLNIG

SEQ ID NO: 346647 - protein, 9 aa, Influenza virus
NAIRIGEGA

SEQ ID NO: 346648 - protein, 9 aa, Influenza virus
AIRIGEGAH

SEQ ID NO: 346649 - protein, 9 aa, Influenza virus
RIGEGAHIL

SEQ ID NO: 346650 - protein, 9 aa, Influenza virus
GAHILVTRE

SEQ ID NO: 346651 - protein, 9 aa, Influenza virus
GTINDRSPF

SEQ ID NO: 346652 - protein, 9 aa, Influenza virus
TINDRSPFR

SEQ ID NO: 346653 - protein, 9 aa, Influenza virus
INDRSPFRA

SEQ ID NO: 346654 - protein, 9 aa, Influenza virus
PFRALISWG

SEQ ID NO: 346655 - protein, 9 aa, Influenza virus
SSTSCHDGK

SEQ ID NO: 346656 - protein, 9 aa, Influenza virus
STSCHDGKS

SEQ ID NO: 346657 - protein, 9 aa, Influenza virus
TSCHDGKSR

SEQ ID NO: 346658 - protein, 9 aa, Influenza virus
SCHDGKSRM

SEQ ID NO: 346659 - protein, 9 aa, Influenza virus
CHDGKSRMS

SEQ ID NO: 346660 - protein, 9 aa, Influenza virus
SICVSGPNN

SEQ ID NO: 346661 - protein, 9 aa, Influenza virus
CHNGTCPVV

SEQ ID NO: 346662 - protein, 9 aa, Influenza virus
TDGPANSRA

SEQ ID NO: 346663 - protein, 9 aa, Influenza virus
ANRPIITID

SEQ ID NO: 346664 - protein, 9 aa, Influenza virus
MTHISKYLC

SEQ ID NO: 346665 - protein, 9 aa, Influenza virus
THISKYLCS

SEQ ID NO: 346666 - protein, 9 aa, Influenza virus
YLCSKTLTD

SEQ ID NO: 346667 - protein, 9 aa, Influenza virus
LCSKTLTDT

SEQ ID NO: 346668 - protein, 9 aa, Influenza virus
CSKTLTDTS

SEQ ID NO: 346669 - protein, 9 aa, Influenza virus
SKTLTDTSR

SEQ ID NO: 346670 - protein, 9 aa, Influenza virus
KTLTDTSRP

SEQ ID NO: 346671 - protein, 9 aa, Influenza virus
IKGFAFLDG

SEQ ID NO: 346672 - protein, 9 aa, Influenza virus
KDTRSGYEM

SEQ ID NO: 346673 - protein, 9 aa, Influenza virus
DTRSGYEML

SEQ ID NO: 346674 - protein, 9 aa, Influenza virus
TRSGYEMLK

SEQ ID NO: 346675 - protein, 9 aa, Influenza virus
GYEMLKVPD

SEQ ID NO: 346676 - protein, 9 aa, Influenza virus
YEMLKVPDA

SEQ ID NO: 346677 - protein, 9 aa, Influenza virus
EMLKVPDAE

SEQ ID NO: 346678 - protein, 9 aa, Influenza virus
LVRGRPKES

SEQ ID NO: 346679 - protein, 9 aa, Influenza virus
ESGVLWTSN

SEQ ID NO: 346680 - protein, 9 aa, Influenza virus
KSKLFTLSG

SEQ ID NO: 346681 - protein, 9 aa, Influenza virus
LNLLIGVSN

SEQ ID NO: 346682 - protein, 9 aa, Influenza virus
LLIGISNVV

SEQ ID NO: 346683 - protein, 9 aa, Influenza virus
LIGISNVVL

SEQ ID NO: 346684 - protein, 9 aa, Influenza virus
SNVGLNMSL

SEQ ID NO: 346685 - protein, 9 aa, Influenza virus
NIGLNVSLH

SEQ ID NO: 346686 - protein, 9 aa, Influenza virus
IGLNVSLHL

SEQ ID NO: 346687 - protein, 9 aa, Influenza virus
GLKVSLHLK

SEQ ID NO: 346688 - protein, 9 aa, Influenza virus
NKYVNNTTI

SEQ ID NO: 346689 - protein, 9 aa, Influenza virus
KYVNNTTII

SEQ ID NO: 346690 - protein, 9 aa, Influenza virus
LMLSKSLCK

SEQ ID NO: 346691 - protein, 9 aa, Influenza virus
MLSKSLCKV

SEQ ID NO: 346692 - protein, 9 aa, Influenza virus
VVIAQDNAI

SEQ ID NO: 346693 - protein, 9 aa, Influenza virus
VIEKDNAVR

SEQ ID NO: 346694 - protein, 9 aa, Influenza virus
SNGTIHDGT

SEQ ID NO: 346695 - protein, 9 aa, Influenza virus
TIHDGTAFR

SEQ ID NO: 346696 - protein, 9 aa, Influenza virus
IHDRAAFRG

SEQ ID NO: 346697 - protein, 9 aa, Influenza virus
DGTAFRGLI

SEQ ID NO: 346698 - protein, 9 aa, Influenza virus
RTTFRGLLS

SEQ ID NO: 346699 - protein, 9 aa, Influenza virus
TFRGLLSTP

SEQ ID NO: 346700 - protein, 9 aa, Influenza virus
SNSEFLCVG

SEQ ID NO: 346701 - protein, 9 aa, Influenza virus
NSEFLCVGW

SEQ ID NO: 346702 - protein, 9 aa, Influenza virus
SEFLCVGWS

SEQ ID NO: 346703 - protein, 9 aa, Influenza virus
EFLCVGWSS

SEQ ID NO: 346704 - protein, 9 aa, Influenza virus
CHDGIARMT

SEQ ID NO: 346705 - protein, 9 aa, Influenza virus
HDGVSRMTI

SEQ ID NO: 346706 - protein, 9 aa, Influenza virus
DGVNRMTIC

SEQ ID NO: 346707 - protein, 9 aa, Influenza virus
NRMTICVQG

SEQ ID NO: 346708 - protein, 9 aa, Influenza virus
QGNNKNATA

SEQ ID NO: 346709 - protein, 9 aa, Influenza virus
GNNKNATAT

SEQ ID NO: 346710 - protein, 9 aa, Influenza virus
NNKNATATV

SEQ ID NO: 346711 - protein, 9 aa, Influenza virus
YNRRPTTTI

SEQ ID NO: 346712 - protein, 9 aa, Influenza virus
RRLTTTIRT

SEQ ID NO: 346713 - protein, 9 aa, Influenza virus
TTIKPWARN

SEQ ID NO: 346714 - protein, 9 aa, Influenza virus
TIKPWARNI

SEQ ID NO: 346715 - protein, 9 aa, Influenza virus
IKPWARNIL

SEQ ID NO: 346716 - protein, 9 aa, Influenza virus
KPWARNILR

SEQ ID NO: 346717 - protein, 9 aa, Influenza virus
PWARNILRT

SEQ ID NO: 346718 - protein, 9 aa, Influenza virus
CVSHNGTWA

SEQ ID NO: 346719 - protein, 9 aa, Influenza virus
GTCVAVMTD

SEQ ID NO: 346720 - protein, 9 aa, Influenza virus
MTDGPANSQ

SEQ ID NO: 346721 - protein, 9 aa, Influenza virus
TDGPANSQA

SEQ ID NO: 346722 - protein, 9 aa, Influenza virus
KVSCVCRDN

SEQ ID NO: 346723 - protein, 9 aa, Influenza virus
ILTDTSRPS

SEQ ID NO: 346724 - protein, 9 aa, Influenza virus
TDTSKPSDK

SEQ ID NO: 346725 - protein, 9 aa, Influenza virus
SNPITGSPC

SEQ ID NO: 346726 - protein, 9 aa, Influenza virus
DNTWLGGTI

SEQ ID NO: 346727 - protein, 9 aa, Influenza virus
LGGTISPRS

SEQ ID NO: 346728 - protein, 9 aa, Influenza virus
GRTISPHSR

SEQ ID NO: 346729 - protein, 9 aa, Influenza virus
TISPHSRSG

SEQ ID NO: 346730 - protein, 9 aa, Influenza virus
FSPRSRSGF

SEQ ID NO: 346731 - protein, 9 aa, Influenza virus
TRSRSGFEM

SEQ ID NO: 346732 - protein, 9 aa, Influenza virus
EMLRIPNAG

SEQ ID NO: 346733 - protein, 9 aa, Influenza virus
LKVPNAGTD

SEQ ID NO: 346734 - protein, 9 aa, Influenza virus
KVPNAGTDP

SEQ ID NO: 346735 - protein, 9 aa, Influenza virus
SKCYNPCFY

SEQ ID NO: 346736 - protein, 9 aa, Influenza virus
LIALCGSPV

SEQ ID NO: 346737 - protein, 9 aa, Influenza virus
SGSFPDGAK

SEQ ID NO: 346738 - protein, 9 aa, Influenza virus
FFPDGPQIQ

SEQ ID NO: 346739 - protein, 9 aa, Influenza virus
FPDGPQIQY

SEQ ID NO: 346740 - protein, 9 aa, Influenza virus
EYNETVRTE

SEQ ID NO: 346741 - protein, 9 aa, Influenza virus
TLMSVGIGQ

SEQ ID NO: 346742 - protein, 9 aa, Influenza virus
NVYQAKFEA

SEQ ID NO: 346743 - protein, 9 aa, Influenza virus
VYQAKFEAV

SEQ ID NO: 346744 - protein, 9 aa, Influenza virus
YQAKFEAVA

SEQ ID NO: 346745 - protein, 9 aa, Influenza virus
QAKFEAVAW

SEQ ID NO: 346746 - protein, 9 aa, Influenza virus
AKFEAVAWS

SEQ ID NO: 346747 - protein, 9 aa, Influenza virus
SRAGDILRT

SEQ ID NO: 346748 - protein, 9 aa, Influenza virus
EDILRTQES

SEQ ID NO: 346749 - protein, 9 aa, Influenza virus
FTEGHIEEC

SEQ ID NO: 346750 - protein, 9 aa, Influenza virus
TEGHIEECS

SEQ ID NO: 346751 - protein, 9 aa, Influenza virus
LVVSPDLSY

SEQ ID NO: 346752 - protein, 9 aa, Influenza virus
LSYSVGYLC

SEQ ID NO: 346753 - protein, 9 aa, Influenza virus
SYSVGYLCA

SEQ ID NO: 346754 - protein, 9 aa, Influenza virus
YSVGYLCAG

SEQ ID NO: 346755 - protein, 9 aa, Influenza virus
SDTPRGEDG

SEQ ID NO: 346756 - protein, 9 aa, Influenza virus
ECLVPCFWV

SEQ ID NO: 346757 - protein, 9 aa, Influenza virus
SIVMCGVEH

SEQ ID NO: 346758 - protein, 9 aa, Influenza virus
NWSWHDGAI

SEQ ID NO: 346759 - protein, 9 aa, Influenza virus
DGAILPLTS

SEQ ID NO: 346760 - protein, 9 aa, Influenza virus
RILCTSATA

SEQ ID NO: 346761 - protein, 9 aa, Influenza virus
ILFASATAI

SEQ ID NO: 346762 - protein, 9 aa, Influenza virus
TIINNYYND

SEQ ID NO: 346763 - protein, 9 aa, Influenza virus
IINNYYNDT

SEQ ID NO: 346764 - protein, 9 aa, Influenza virus
VTQINNTNI

SEQ ID NO: 346765 - protein, 9 aa, Influenza virus
NNLTRGLCK

SEQ ID NO: 346766 - protein, 9 aa, Influenza virus
NLTKELCTI

SEQ ID NO: 346767 - protein, 9 aa, Influenza virus
LTKELCTIN

SEQ ID NO: 346768 - protein, 9 aa, Influenza virus
TKGLCIINS

SEQ ID NO: 346769 - protein, 9 aa, Influenza virus
KGLCIINSW

SEQ ID NO: 346770 - protein, 9 aa, Influenza virus
DNAVRIGES

SEQ ID NO: 346771 - protein, 9 aa, Influenza virus
NAIRIGGNS

SEQ ID NO: 346772 - protein, 9 aa, Influenza virus
RIGENSGVL

SEQ ID NO: 346773 - protein, 9 aa, Influenza virus
IGESSDVLV

SEQ ID NO: 346774 - protein, 9 aa, Influenza virus
GESSDVLVT

SEQ ID NO: 346775 - protein, 9 aa, Influenza virus
GNSDVLVTR

SEQ ID NO: 346776 - protein, 9 aa, Influenza virus
SPPTVYSSR

SEQ ID NO: 346777 - protein, 9 aa, Influenza virus
STSCHDGKT

SEQ ID NO: 346778 - protein, 9 aa, Influenza virus
TSCHDGKTR

SEQ ID NO: 346779 - protein, 9 aa, Influenza virus
NASPVIWYN

SEQ ID NO: 346780 - protein, 9 aa, Influenza virus
GRPTTEINT

SEQ ID NO: 346781 - protein, 9 aa, Influenza virus
CHNGICPVA

SEQ ID NO: 346782 - protein, 9 aa, Influenza virus
HSGVCPVVF

SEQ ID NO: 346783 - protein, 9 aa, Influenza virus
TRVYYFKGG

SEQ ID NO: 346784 - protein, 9 aa, Influenza virus
GKIIKWEPL

SEQ ID NO: 346785 - protein, 9 aa, Influenza virus
KWESLNGTA

SEQ ID NO: 346786 - protein, 9 aa, Influenza virus
AMKHTSQYI

SEQ ID NO: 346787 - protein, 9 aa, Influenza virus
DNPRPNDPS

SEQ ID NO: 346788 - protein, 9 aa, Influenza virus
DPYPGNNBN

SEQ ID NO: 346789 - protein, 9 aa, Influenza virus
RTINTASRS

SEQ ID NO: 346790 - protein, 9 aa, Influenza virus
TINTASRSG

SEQ ID NO: 346791 - protein, 9 aa, Influenza virus
ISTASRYGY

SEQ ID NO: 346792 - protein, 9 aa, Influenza virus
NALIDDRSK

SEQ ID NO: 346793 - protein, 9 aa, Influenza virus
ALTDERSKP

SEQ ID NO: 346794 - protein, 9 aa, Influenza virus
SFIDYWAKE

SEQ ID NO: 346795 - protein, 9 aa, Influenza virus
DYWAKEECY

SEQ ID NO: 346796 - protein, 9 aa, Influenza virus
YWAKEECYR

SEQ ID NO: 346797 - protein, 9 aa, Influenza virus
WAKEECYRA

SEQ ID NO: 346798 - protein, 9 aa, Influenza virus
AKEECYRAC

SEQ ID NO: 346799 - protein, 9 aa, Influenza virus
KEECYRACF

SEQ ID NO: 346800 - protein, 9 aa, Influenza virus
MEEVTNATE

SEQ ID NO: 346801 - protein, 9 aa, Influenza virus
RDLGNCHPI

SEQ ID NO: 346802 - protein, 9 aa, Influenza virus
LGNCHPIGI

SEQ ID NO: 346803 - protein, 9 aa, Influenza virus
GIWDTLIER

SEQ ID NO: 346804 - protein, 9 aa, Influenza virus
VSEEALRQK

SEQ ID NO: 346805 - protein, 9 aa, Influenza virus
SFYAEVKWL

SEQ ID NO: 346806 - protein, 9 aa, Influenza virus
EQNFPQTTN

SEQ ID NO: 346807 - protein, 9 aa, Influenza virus
RNFPQTTNT

SEQ ID NO: 346808 - protein, 9 aa, Influenza virus
AQSLSISVG

SEQ ID NO: 346809 - protein, 9 aa, Influenza virus
LVGSSTYQN

SEQ ID NO: 346810 - protein, 9 aa, Influenza virus
VGSSTYHNS

SEQ ID NO: 346811 - protein, 9 aa, Influenza virus
QNNFVPVMG

SEQ ID NO: 346812 - protein, 9 aa, Influenza virus
NNFVPVMGA

SEQ ID NO: 346813 - protein, 9 aa, Influenza virus
NFVPVVRAR

SEQ ID NO: 346814 - protein, 9 aa, Influenza virus
VPVVGDRPL

SEQ ID NO: 346815 - protein, 9 aa, Influenza virus
PVVGARPKV

SEQ ID NO: 346816 - protein, 9 aa, Influenza virus
VVGDRPLVN

SEQ ID NO: 346817 - protein, 9 aa, Influenza virus
VGARPKVNG

SEQ ID NO: 346818 - protein, 9 aa, Influenza virus
VNGQSGRIV

SEQ ID NO: 346819 - protein, 9 aa, Influenza virus
NGQSGRIVF

SEQ ID NO: 346820 - protein, 9 aa, Influenza virus
GQSGRINFH

SEQ ID NO: 346821 - protein, 9 aa, Influenza virus
QRGRIDFHW

SEQ ID NO: 346822 - protein, 9 aa, Influenza virus
PGDHITFSH

SEQ ID NO: 346823 - protein, 9 aa, Influenza virus
GDHITFSHN

SEQ ID NO: 346824 - protein, 9 aa, Influenza virus
DHITFSHNG

SEQ ID NO: 346825 - protein, 9 aa, Influenza virus
DNGGLIAPS

SEQ ID NO: 346826 - protein, 9 aa, Influenza virus
CFWKGGTIN

SEQ ID NO: 346827 - protein, 9 aa, Influenza virus
FWKGGTINT

SEQ ID NO: 346828 - protein, 9 aa, Influenza virus
EGSINTRLP

SEQ ID NO: 346829 - protein, 9 aa, Influenza virus
GQCPKYVSQ

SEQ ID NO: 346830 - protein, 9 aa, Influenza virus
GSLLLATGM

SEQ ID NO: 346831 - protein, 9 aa, Influenza virus
DYKSTQKTI

SEQ ID NO: 346832 - protein, 9 aa, Influenza virus
TIDQVTGKL

SEQ ID NO: 346833 - protein, 9 aa, Influenza virus
INQITGKLN

SEQ ID NO: 346834 - protein, 9 aa, Influenza virus
FNEIEYQIG

SEQ ID NO: 346835 - protein, 9 aa, Influenza virus
NEIEYQIGN

SEQ ID NO: 346836 - protein, 9 aa, Influenza virus
GCFEIYHVC

SEQ ID NO: 346837 - protein, 9 aa, Influenza virus
NCMESIRDN

SEQ ID NO: 346838 - protein, 9 aa, Influenza virus
RNNTYNHTQ

SEQ ID NO: 346839 - protein, 9 aa, Influenza virus
NNTYDHSHY

SEQ ID NO: 346840 - protein, 9 aa, Influenza virus
NTYDHSHYR

SEQ ID NO: 346841 - protein, 9 aa, Influenza virus
TYNHTQYRE

SEQ ID NO: 346842 - protein, 9 aa, Influenza virus
YDHSHYREE

SEQ ID NO: 346843 - protein, 9 aa, Influenza virus
HTQYREESL

SEQ ID NO: 346844 - protein, 9 aa, Influenza virus
TQYREESLL

SEQ ID NO: 346845 - protein, 9 aa, Influenza virus
INSVKLFSG

SEQ ID NO: 346846 - protein, 9 aa, Influenza virus
NPVELSSGY

SEQ ID NO: 346847 - protein, 9 aa, Influenza virus
PVKLSSSYK

SEQ ID NO: 346848 - protein, 9 aa, Influenza virus
VKLSSGYKN

SEQ ID NO: 346849 - protein, 9 aa, Influenza virus
FFCLKNGNT

SEQ ID NO: 346850 - protein, 9 aa, Influenza virus
FWLKNGNMR

SEQ ID NO: 346851 - protein, 9 aa, Influenza virus
HHAVANGTV

SEQ ID NO: 346852 - protein, 9 aa, Influenza virus
SNGTIIKTL

SEQ ID NO: 346853 - protein, 9 aa, Influenza virus
IVKTLTNER

SEQ ID NO: 346854 - protein, 9 aa, Influenza virus
IKTLTNEKE

SEQ ID NO: 346855 - protein, 9 aa, Influenza virus
KTLTNEHEE

SEQ ID NO: 346856 - protein, 9 aa, Influenza virus
TLTNEREEV

SEQ ID NO: 346857 - protein, 9 aa, Influenza virus
EREEVTNAT

SEQ ID NO: 346858 - protein, 9 aa, Influenza virus
KEKVTNATE

SEQ ID NO: 346859 - protein, 9 aa, Influenza virus
YRDLGNCHP

SEQ ID NO: 346860 - protein, 9 aa, Influenza virus
RDLGNCHPI

SEQ ID NO: 346861 - protein, 9 aa, Influenza virus
CHPIGMVVG

SEQ ID NO: 346862 - protein, 9 aa, Influenza virus
GAPSCDLHL

SEQ ID NO: 346863 - protein, 9 aa, Influenza virus
APSCDLHLT

SEQ ID NO: 346864 - protein, 9 aa, Influenza virus
CDLHLTGIW

SEQ ID NO: 346865 - protein, 9 aa, Influenza virus
DLHLTGMWD

SEQ ID NO: 346866 - protein, 9 aa, Influenza virus
LHLTGKWDT

SEQ ID NO: 346867 - protein, 9 aa, Influenza virus
MWDTLIERD

SEQ ID NO: 346868 - protein, 9 aa, Influenza virus
DTLIERDNA

SEQ ID NO: 346869 - protein, 9 aa, Influenza virus
IANCYPGAT

SEQ ID NO: 346870 - protein, 9 aa, Influenza virus
AYCYPGATM

SEQ ID NO: 346871 - protein, 9 aa, Influenza virus
NCYPGATVN

SEQ ID NO: 346872 - protein, 9 aa, Influenza virus
YPGATVNEG

SEQ ID NO: 346873 - protein, 9 aa, Influenza virus
PGSTVNEEA

SEQ ID NO: 346874 - protein, 9 aa, Influenza virus
GSTVNEEAL

SEQ ID NO: 346875 - protein, 9 aa, Influenza virus
STVNEEALR

SEQ ID NO: 346876 - protein, 9 aa, Influenza virus
ESGGIDKVS

SEQ ID NO: 346877 - protein, 9 aa, Influenza virus
SGGIDKVST

SEQ ID NO: 346878 - protein, 9 aa, Influenza virus
FTYGSSITS

SEQ ID NO: 346879 - protein, 9 aa, Influenza virus
ELKWLVSKD

SEQ ID NO: 346880 - protein, 9 aa, Influenza virus
LKWLVSKDK

SEQ ID NO: 346881 - protein, 9 aa, Influenza virus
KWLVSKDKG

SEQ ID NO: 346882 - protein, 9 aa, Influenza virus
WLISKSKEQ

SEQ ID NO: 346883 - protein, 9 aa, Influenza virus
RNFPQTTNT

SEQ ID NO: 346884 - protein, 9 aa, Influenza virus
EHLVMWGIH

SEQ ID NO: 346885 - protein, 9 aa, Influenza virus
HIIMWGIHH

SEQ ID NO: 346886 - protein, 9 aa, Influenza virus
LVMWGIHHP

SEQ ID NO: 346887 - protein, 9 aa, Influenza virus
PSSTQEKNA

SEQ ID NO: 346888 - protein, 9 aa, Influenza virus
SSTQERNDL

SEQ ID NO: 346889 - protein, 9 aa, Influenza virus
STQERNDLY

SEQ ID NO: 346890 - protein, 9 aa, Influenza virus
TQERNDLYG

SEQ ID NO: 346891 - protein, 9 aa, Influenza virus
QEKNDLYGA

SEQ ID NO: 346892 - protein, 9 aa, Influenza virus
RNDLYGTQS

SEQ ID NO: 346893 - protein, 9 aa, Influenza virus
VGSSIYQNS

SEQ ID NO: 346894 - protein, 9 aa, Influenza virus
APSRVSKLT

SEQ ID NO: 346895 - protein, 9 aa, Influenza virus
PSRVSKLIG

SEQ ID NO: 346896 - protein, 9 aa, Influenza virus
GKGLGIQSG

SEQ ID NO: 346897 - protein, 9 aa, Influenza virus
RSLMLATGM

SEQ ID NO: 346898 - protein, 9 aa, Influenza virus
RGCFEIYHK

SEQ ID NO: 346899 - protein, 9 aa, Influenza virus
CFEIYHRCD

SEQ ID NO: 346900 - protein, 9 aa, Influenza virus
CDDPCMESI

SEQ ID NO: 346901 - protein, 9 aa, Influenza virus
NDNCMESIR

SEQ ID NO: 346902 - protein, 9 aa, Influenza virus
DNCMESIRD

SEQ ID NO: 346903 - protein, 9 aa, Influenza virus
NRLNINPVR

SEQ ID NO: 346904 - protein, 9 aa, Influenza virus
ASCFVLLAD

SEQ ID NO: 346905 - protein, 9 aa, Influenza virus
SCFVLLAIV

SEQ ID NO: 346906 - protein, 9 aa, Influenza virus
FALSGVAIS

SEQ ID NO: 346907 - protein, 9 aa, Influenza virus
ALSGMAIAL

SEQ ID NO: 346908 - protein, 9 aa, Influenza virus
LSGMAIALS

SEQ ID NO: 346909 - protein, 9 aa, Influenza virus
YVNNTTVIS

SEQ ID NO: 346910 - protein, 9 aa, Influenza virus
VNNTTIISK

SEQ ID NO: 346911 - protein, 9 aa, Influenza virus
LMLSKSLCK

SEQ ID NO: 346912 - protein, 9 aa, Influenza virus
MLSKSLCKV

SEQ ID NO: 346913 - protein, 9 aa, Influenza virus
NKRLCKVEG

SEQ ID NO: 346914 - protein, 9 aa, Influenza virus
SCDPIGCKM

SEQ ID NO: 346915 - protein, 9 aa, Influenza virus
CDPIGCKMY

SEQ ID NO: 346916 - protein, 9 aa, Influenza virus
DPIGCKMYA

SEQ ID NO: 346917 - protein, 9 aa, Influenza virus
PIGCKMYAL

SEQ ID NO: 346918 - protein, 9 aa, Influenza virus
LGCKTYALH

SEQ ID NO: 346919 - protein, 9 aa, Influenza virus
SPPMVSNSD

SEQ ID NO: 346920 - protein, 9 aa, Influenza virus
PPMVSNSDF

SEQ ID NO: 346921 - protein, 9 aa, Influenza virus
IICIQGNND

SEQ ID NO: 346922 - protein, 9 aa, Influenza virus
IMTDGSANS

SEQ ID NO: 346923 - protein, 9 aa, Influenza virus
DGSANSQAY

SEQ ID NO: 346924 - protein, 9 aa, Influenza virus
GPANSQAYT

SEQ ID NO: 346925 - protein, 9 aa, Influenza virus
SASGQAYTK

SEQ ID NO: 346926 - protein, 9 aa, Influenza virus
ASSQAHTKI

SEQ ID NO: 346927 - protein, 9 aa, Influenza virus
QAYTKILYF

SEQ ID NO: 346928 - protein, 9 aa, Influenza virus
AYTKILYFH

SEQ ID NO: 346929 - protein, 9 aa, Influenza virus
HTKILYFHK

SEQ ID NO: 346930 - protein, 9 aa, Influenza virus
KILYFHKGL

SEQ ID NO: 346931 - protein, 9 aa, Influenza virus
YFHKGLLIK

SEQ ID NO: 346932 - protein, 9 aa, Influenza virus
FHKGLLIKE

SEQ ID NO: 346933 - protein, 9 aa, Influenza virus
HKGLLIKEE

SEQ ID NO: 346934 - protein, 9 aa, Influenza virus
KEETLKGSA

SEQ ID NO: 346935 - protein, 9 aa, Influenza virus
EEALQGSAR

SEQ ID NO: 346936 - protein, 9 aa, Influenza virus
EALQGSARH

SEQ ID NO: 346937 - protein, 9 aa, Influenza virus
CYGHNQKVT

SEQ ID NO: 346938 - protein, 9 aa, Influenza virus
YGHSQKATC

SEQ ID NO: 346939 - protein, 9 aa, Influenza virus
ANRPAIEID

SEQ ID NO: 346940 - protein, 9 aa, Influenza virus
NRPIIEINM

SEQ ID NO: 346941 - protein, 9 aa, Influenza virus
AMKHTSQYL

SEQ ID NO: 346942 - protein, 9 aa, Influenza virus
IPNAGIDPN

SEQ ID NO: 346943 - protein, 9 aa, Influenza virus
IERQEIVDN

SEQ ID NO: 346944 - protein, 9 aa, Influenza virus
ERQEIVDNR

SEQ ID NO: 346945 - protein, 9 aa, Influenza virus
NNNLSGYSG

SEQ ID NO: 346946 - protein, 9 aa, Influenza virus
NNLSGYSGS

SEQ ID NO: 346947 - protein, 9 aa, Influenza virus
SKCYNPCFY

SEQ ID NO: 346948 - protein, 9 aa, Influenza virus
IALCGSPFS

SEQ ID NO: 346949 - protein, 9 aa, Influenza virus
EKVDTIIEN

SEQ ID NO: 346950 - protein, 9 aa, Influenza virus
FCSLDGKAP

SEQ ID NO: 346951 - protein, 9 aa, Influenza virus
CSINGKEPI

SEQ ID NO: 346952 - protein, 9 aa, Influenza virus
SINGKEPIS

SEQ ID NO: 346953 - protein, 9 aa, Influenza virus
INGKEPISL

SEQ ID NO: 346954 - protein, 9 aa, Influenza virus
ILGNPMCDN

SEQ ID NO: 346955 - protein, 9 aa, Influenza virus
LGNPMCDNL

SEQ ID NO: 346956 - protein, 9 aa, Influenza virus
GNPMCDYLI

SEQ ID NO: 346957 - protein, 9 aa, Influenza virus
NPMCDNLIG

SEQ ID NO: 346958 - protein, 9 aa, Influenza virus
PMCDNLIGK

SEQ ID NO: 346959 - protein, 9 aa, Influenza virus
CDDLIGKNS

SEQ ID NO: 346960 - protein, 9 aa, Influenza virus
DDLIEKTSW

SEQ ID NO: 346961 - protein, 9 aa, Influenza virus
DLIGKNSWS

SEQ ID NO: 346962 - protein, 9 aa, Influenza virus
WLIDQSGTY

SEQ ID NO: 346963 - protein, 9 aa, Influenza virus
LIDQSGTYP

SEQ ID NO: 346964 - protein, 9 aa, Influenza virus
YQSGTYPVI

SEQ ID NO: 346965 - protein, 9 aa, Influenza virus
FKNTKGRDV

SEQ ID NO: 346966 - protein, 9 aa, Influenza virus
NNIKGRDVL

SEQ ID NO: 346967 - protein, 9 aa, Influenza virus
LYKKDSSHV

SEQ ID NO: 346968 - protein, 9 aa, Influenza virus
RMTFYWTII

SEQ ID NO: 346969 - protein, 9 aa, Influenza virus
TFESNGVFL

SEQ ID NO: 346970 - protein, 9 aa, Influenza virus
SNGAFLAPG

SEQ ID NO: 346971 - protein, 9 aa, Influenza virus
NGAFLAPGY

SEQ ID NO: 346972 - protein, 9 aa, Influenza virus
GAFLAPRYS

SEQ ID NO: 346973 - protein, 9 aa, Influenza virus
FLAPRYALE

SEQ ID NO: 346974 - protein, 9 aa, Influenza virus
LAPRYALEL

SEQ ID NO: 346975 - protein, 9 aa, Influenza virus
PRYALELVS

SEQ ID NO: 346976 - protein, 9 aa, Influenza virus
KCQSEIGWI

SEQ ID NO: 346977 - protein, 9 aa, Influenza virus
CQSEIGGIS

SEQ ID NO: 346978 - protein, 9 aa, Influenza virus
QSEIGGIST

SEQ ID NO: 346979 - protein, 9 aa, Influenza virus
HNVHRNAIG

SEQ ID NO: 346980 - protein, 9 aa, Influenza virus
NVHRNTIGN

SEQ ID NO: 346981 - protein, 9 aa, Influenza virus
NVKSLKLVT

SEQ ID NO: 346982 - protein, 9 aa, Influenza virus
VKSLKLAIG

SEQ ID NO: 346983 - protein, 9 aa, Influenza virus
KSLKLVTGL

SEQ ID NO: 346984 - protein, 9 aa, Influenza virus
KLAIGPRNV

SEQ ID NO: 346985 - protein, 9 aa, Influenza virus
LAIGPRNVP

SEQ ID NO: 346986 - protein, 9 aa, Influenza virus
VTGLRNVPA

SEQ ID NO: 346987 - protein, 9 aa, Influenza virus
IGPRNVPAI

SEQ ID NO: 346988 - protein, 9 aa, Influenza virus
GLRNVPAIS

SEQ ID NO: 346989 - protein, 9 aa, Influenza virus
ADKESTQKT

SEQ ID NO: 346990 - protein, 9 aa, Influenza virus
IEKRINQLS

SEQ ID NO: 346991 - protein, 9 aa, Influenza virus
LHEKVRQML

SEQ ID NO: 346992 - protein, 9 aa, Influenza virus
LQDNAKDEG

SEQ ID NO: 346993 - protein, 9 aa, Influenza virus
KNNAKDEGN

SEQ ID NO: 346994 - protein, 9 aa, Influenza virus
FYHRCDNEC

SEQ ID NO: 346995 - protein, 9 aa, Influenza virus
YHKCDNGCI

SEQ ID NO: 346996 - protein, 9 aa, Influenza virus
HRCDNECIE

SEQ ID NO: 346997 - protein, 9 aa, Influenza virus
NECIEKIRN

SEQ ID NO: 346998 - protein, 9 aa, Influenza virus
HKEFEKESK

SEQ ID NO: 346999 - protein, 9 aa, Influenza virus
KESRLNRQE

SEQ ID NO: 347000 - protein, 9 aa, Influenza virus
SKLNRQEIG

SEQ ID NO: 347001 - protein, 9 aa, Influenza virus
KLNRQEIGG

SEQ ID NO: 347002 - protein, 9 aa, Influenza virus
QEIEGARLD

SEQ ID NO: 347003 - protein, 9 aa, Influenza virus
SSLVLAALN

SEQ ID NO: 347004 - protein, 9 aa, Influenza virus
SLILAALIM

SEQ ID NO: 347005 - protein, 9 aa, Influenza virus
LVLAASIMG

SEQ ID NO: 347006 - protein, 9 aa, Influenza virus
WVCSNGSCR

SEQ ID NO: 347007 - protein, 9 aa, Influenza virus
ACGNGSCRC

SEQ ID NO: 347008 - protein, 9 aa, Influenza virus
MKKFIILST

SEQ ID NO: 347009 - protein, 9 aa, Influenza virus
STDTVNTLT

SEQ ID NO: 347010 - protein, 9 aa, Influenza virus
TDTVNTLTE

SEQ ID NO: 347011 - protein, 9 aa, Influenza virus
DTVNTLTEQ

SEQ ID NO: 347012 - protein, 9 aa, Influenza virus
EELVHRGID

SEQ ID NO: 347013 - protein, 9 aa, Influenza virus
ELVHGGINP

SEQ ID NO: 347014 - protein, 9 aa, Influenza virus
CSLKGLILG

SEQ ID NO: 347015 - protein, 9 aa, Influenza virus
SLEGLILSN

SEQ ID NO: 347016 - protein, 9 aa, Influenza virus
LEGLVLGNP

SEQ ID NO: 347017 - protein, 9 aa, Influenza virus
KGLILGNPK

SEQ ID NO: 347018 - protein, 9 aa, Influenza virus
IENQEELKS

SEQ ID NO: 347019 - protein, 9 aa, Influenza virus
SKACNSISN

SEQ ID NO: 347020 - protein, 9 aa, Influenza virus
NQDSFYRSM

SEQ ID NO: 347021 - protein, 9 aa, Influenza virus
QDSFYRSMK

SEQ ID NO: 347022 - protein, 9 aa, Influenza virus
SMKWLTLKS

SEQ ID NO: 347023 - protein, 9 aa, Influenza virus
MKWLTLKSG

SEQ ID NO: 347024 - protein, 9 aa, Influenza virus
HPPTSAEQV

SEQ ID NO: 347025 - protein, 9 aa, Influenza virus
EINRNFKPN

SEQ ID NO: 347026 - protein, 9 aa, Influenza virus
IDRSFRPNI

SEQ ID NO: 347027 - protein, 9 aa, Influenza virus
DRSFRPNIG

SEQ ID NO: 347028 - protein, 9 aa, Influenza virus
IGPRPLIRG

SEQ ID NO: 347029 - protein, 9 aa, Influenza virus
GPRPLVMGQ

SEQ ID NO: 347030 - protein, 9 aa, Influenza virus
PRPLIRGQQ

SEQ ID NO: 347031 - protein, 9 aa, Influenza virus
RPLIRGQQG

SEQ ID NO: 347032 - protein, 9 aa, Influenza virus
PLIRGQQGR

SEQ ID NO: 347033 - protein, 9 aa, Influenza virus
LIRGQQGRM

SEQ ID NO: 347034 - protein, 9 aa, Influenza virus
ECQLNEGIM

SEQ ID NO: 347035 - protein, 9 aa, Influenza virus
KCPKYISSG

SEQ ID NO: 347036 - protein, 9 aa, Influenza virus
CPKYISSGS

SEQ ID NO: 347037 - protein, 9 aa, Influenza virus
PKYIPSRSL

SEQ ID NO: 347038 - protein, 9 aa, Influenza virus
KYIPSRSLK

SEQ ID NO: 347039 - protein, 9 aa, Influenza virus
IGLRNVPQI

SEQ ID NO: 347040 - protein, 9 aa, Influenza virus
GPRNVPQAQ

SEQ ID NO: 347041 - protein, 9 aa, Influenza virus
RNVPQIQNR

SEQ ID NO: 347042 - protein, 9 aa, Influenza virus
NVPQIQNRG

SEQ ID NO: 347043 - protein, 9 aa, Influenza virus
VPQIQNRGL

SEQ ID NO: 347044 - protein, 9 aa, Influenza virus
PQIQNRGLF

SEQ ID NO: 347045 - protein, 9 aa, Influenza virus
QIQNRGLFG

SEQ ID NO: 347046 - protein, 9 aa, Influenza virus
IQNRGLFGA

SEQ ID NO: 347047 - protein, 9 aa, Influenza virus
QNSEGTGIV

SEQ ID NO: 347048 - protein, 9 aa, Influenza virus
NSEGTGIVA

SEQ ID NO: 347049 - protein, 9 aa, Influenza virus
SEGTGIVAD

SEQ ID NO: 347050 - protein, 9 aa, Influenza virus
GIGIAADRD

SEQ ID NO: 347051 - protein, 9 aa, Influenza virus
IGIAADRDS

SEQ ID NO: 347052 - protein, 9 aa, Influenza virus
AADRGSTQK

SEQ ID NO: 347053 - protein, 9 aa, Influenza virus
DSTQKAIDI

SEQ ID NO: 347054 - protein, 9 aa, Influenza virus
KAIDIMQNK

SEQ ID NO: 347055 - protein, 9 aa, Influenza virus
EFSEVGSRI

SEQ ID NO: 347056 - protein, 9 aa, Influenza virus
FSEVGSRIN

SEQ ID NO: 347057 - protein, 9 aa, Influenza virus
VESRINTIN

SEQ ID NO: 347058 - protein, 9 aa, Influenza virus
ESRINTINS

SEQ ID NO: 347059 - protein, 9 aa, Influenza virus
SRINMINSQ

SEQ ID NO: 347060 - protein, 9 aa, Influenza virus
INMINSKIN

SEQ ID NO: 347061 - protein, 9 aa, Influenza virus
NTINSKIDD

SEQ ID NO: 347062 - protein, 9 aa, Influenza virus
MINSKIEDQ

SEQ ID NO: 347063 - protein, 9 aa, Influenza virus
INSQIDDQI

SEQ ID NO: 347064 - protein, 9 aa, Influenza virus
IDDQIIDIW

SEQ ID NO: 347065 - protein, 9 aa, Influenza virus
NDQITDIWA

SEQ ID NO: 347066 - protein, 9 aa, Influenza virus
VRNLHDRTR

SEQ ID NO: 347067 - protein, 9 aa, Influenza virus
RNLHDRTRR

SEQ ID NO: 347068 - protein, 9 aa, Influenza virus
RILKENALD

SEQ ID NO: 347069 - protein, 9 aa, Influenza virus
ENAIDNGDG

SEQ ID NO: 347070 - protein, 9 aa, Influenza virus
NAIDNGDGC

SEQ ID NO: 347071 - protein, 9 aa, Influenza virus
AIDNGDGCF

SEQ ID NO: 347072 - protein, 9 aa, Influenza virus
IDNGDGCFE

SEQ ID NO: 347073 - protein, 9 aa, Influenza virus
FEILHKCND

SEQ ID NO: 347074 - protein, 9 aa, Influenza virus
IRTGTYNHR

SEQ ID NO: 347075 - protein, 9 aa, Influenza virus
GTYNHKDYE

SEQ ID NO: 347076 - protein, 9 aa, Influenza virus
EESRIERQK

SEQ ID NO: 347077 - protein, 9 aa, Influenza virus
ESKIERQKV

SEQ ID NO: 347078 - protein, 9 aa, Influenza virus
STNSSEKVN

SEQ ID NO: 347079 - protein, 9 aa, Influenza virus
TNSSEKVNT

SEQ ID NO: 347080 - protein, 9 aa, Influenza virus
NSSEKVNTL

SEQ ID NO: 347081 - protein, 9 aa, Influenza virus
SSDKVDTLL

SEQ ID NO: 347082 - protein, 9 aa, Influenza virus
SDKVDTLLE

SEQ ID NO: 347083 - protein, 9 aa, Influenza virus
EKVDTLLES

SEQ ID NO: 347084 - protein, 9 aa, Influenza virus
VDTLLESDV

SEQ ID NO: 347085 - protein, 9 aa, Influenza virus
DTLLESDVP

SEQ ID NO: 347086 - protein, 9 aa, Influenza virus
ESDVPVTSS

SEQ ID NO: 347087 - protein, 9 aa, Influenza virus
PVTSTIDLI

SEQ ID NO: 347088 - protein, 9 aa, Influenza virus
VTSTIDLIE

SEQ ID NO: 347089 - protein, 9 aa, Influenza virus
TSTIDLIET

SEQ ID NO: 347090 - protein, 9 aa, Influenza virus
IEDPSAPHR

SEQ ID NO: 347091 - protein, 9 aa, Influenza virus
EDPSAPHRL

SEQ ID NO: 347092 - protein, 9 aa, Influenza virus
DPSAPHRLC

SEQ ID NO: 347093 - protein, 9 aa, Influenza virus
PSAPHRLCY

SEQ ID NO: 347094 - protein, 9 aa, Influenza virus
SAPHRLCYP

SEQ ID NO: 347095 - protein, 9 aa, Influenza virus
KGFNSFYRN

SEQ ID NO: 347096 - protein, 9 aa, Influenza virus
SFYRNLVWL

SEQ ID NO: 347097 - protein, 9 aa, Influenza virus
FYRNLAWFV

SEQ ID NO: 347098 - protein, 9 aa, Influenza virus
GVYNNTTGR

SEQ ID NO: 347099 - protein, 9 aa, Influenza virus
PYTLVSTRS

SEQ ID NO: 347100 - protein, 9 aa, Influenza virus
YTLVTTSSW

SEQ ID NO: 347101 - protein, 9 aa, Influenza virus
TLVSTRSWS

SEQ ID NO: 347102 - protein, 9 aa, Influenza virus
VRPRYNGQR

SEQ ID NO: 347103 - protein, 9 aa, Influenza virus
SWMKIYWDL

SEQ ID NO: 347104 - protein, 9 aa, Influenza virus
NIDRNALGD

SEQ ID NO: 347105 - protein, 9 aa, Influenza virus
IDRNALGDC

SEQ ID NO: 347106 - protein, 9 aa, Influenza virus
DKNALGECP

SEQ ID NO: 347107 - protein, 9 aa, Influenza virus
ATGLKNVPA

SEQ ID NO: 347108 - protein, 9 aa, Influenza virus
EQGMGMAAD

SEQ ID NO: 347109 - protein, 9 aa, Influenza virus
QGMGMAADK

SEQ ID NO: 347110 - protein, 9 aa, Influenza virus
GMGMAADKE

SEQ ID NO: 347111 - protein, 9 aa, Influenza virus
MGMAADKES

SEQ ID NO: 347112 - protein, 9 aa, Influenza virus
RGEFNQVEQ

SEQ ID NO: 347113 - protein, 9 aa, Influenza virus
GEFNQVEQR

SEQ ID NO: 347114 - protein, 9 aa, Influenza virus
EFNQVEQRI

SEQ ID NO: 347115 - protein, 9 aa, Influenza virus
FNQVEQRIN

SEQ ID NO: 347116 - protein, 9 aa, Influenza virus
NQVEQRINM

SEQ ID NO: 347117 - protein, 9 aa, Influenza virus
NVRNLHEQI

SEQ ID NO: 347118 - protein, 9 aa, Influenza virus
VRNLHDQIR

SEQ ID NO: 347119 - protein, 9 aa, Influenza virus
IRNGTYNHS

SEQ ID NO: 347120 - protein, 9 aa, Influenza virus
QEIEGIKLE

SEQ ID NO: 347121 - protein, 9 aa, Influenza virus
EIEGIKLES

SEQ ID NO: 347122 - protein, 9 aa, Influenza virus
SEDNVYRAL

SEQ ID NO: 347123 - protein, 9 aa, Influenza virus
EDNVYRALS

SEQ ID NO: 347124 - protein, 9 aa, Influenza virus
VLVGLILTF

SEQ ID NO: 347125 - protein, 9 aa, Influenza virus
LVGLILTFI

SEQ ID NO: 347126 - protein, 9 aa, Influenza virus
PILSFIMWA

SEQ ID NO: 347127 - protein, 9 aa, Influenza virus
ILTFIMWAC

SEQ ID NO: 347128 - protein, 9 aa, Influenza virus
IMWACSNGN

SEQ ID NO: 347129 - protein, 9 aa, Influenza virus
MWACSNGNC

SEQ ID NO: 347130 - protein, 9 aa, Influenza virus
WACSNGNCR

SEQ ID NO: 347131 - protein, 9 aa, Influenza virus
ACSNGNCRF

SEQ ID NO: 347132 - protein, 9 aa, Influenza virus
CSNGNCRFH

SEQ ID NO: 347133 - protein, 9 aa, Influenza virus
SRYSKADKI

SEQ ID NO: 347134 - protein, 9 aa, Influenza virus
LSNNATDTV

SEQ ID NO: 347135 - protein, 9 aa, Influenza virus
SNNATDTVD

SEQ ID NO: 347136 - protein, 9 aa, Influenza virus
NNATDTVDT

SEQ ID NO: 347137 - protein, 9 aa, Influenza virus
NATDTVDTL

SEQ ID NO: 347138 - protein, 9 aa, Influenza virus
ATDTVDTLT

SEQ ID NO: 347139 - protein, 9 aa, Influenza virus
PNAPNKFCY

SEQ ID NO: 347140 - protein, 9 aa, Influenza virus
NAPNKFCYP

SEQ ID NO: 347141 - protein, 9 aa, Influenza virus
APNKFCYPG

SEQ ID NO: 347142 - protein, 9 aa, Influenza virus
PNKFCYPGE

SEQ ID NO: 347143 - protein, 9 aa, Influenza virus
KLCYPGEVD

SEQ ID NO: 347144 - protein, 9 aa, Influenza virus
FCYPGELDN

SEQ ID NO: 347145 - protein, 9 aa, Influenza virus
SRTELISPN

SEQ ID NO: 347146 - protein, 9 aa, Influenza virus
RTELISPNK

SEQ ID NO: 347147 - protein, 9 aa, Influenza virus
TELISPNKW

SEQ ID NO: 347148 - protein, 9 aa, Influenza virus
ELISPNKWG

SEQ ID NO: 347149 - protein, 9 aa, Influenza virus
PNKWGDILD

SEQ ID NO: 347150 - protein, 9 aa, Influenza virus
NKWGDILDG

SEQ ID NO: 347151 - protein, 9 aa, Influenza virus
TASCLDRGT

SEQ ID NO: 347152 - protein, 9 aa, Influenza virus
GTSSFYRNL

SEQ ID NO: 347153 - protein, 9 aa, Influenza virus
DSFYRNLIW

SEQ ID NO: 347154 - protein, 9 aa, Influenza virus
YRNLIWLVQ

SEQ ID NO: 347155 - protein, 9 aa, Influenza virus
IHHPDTEAV

SEQ ID NO: 347156 - protein, 9 aa, Influenza virus
HHPDTEEVA

SEQ ID NO: 347157 - protein, 9 aa, Influenza virus
ATRLYVNKN

SEQ ID NO: 347158 - protein, 9 aa, Influenza virus
TRLYVNKNP

SEQ ID NO: 347159 - protein, 9 aa, Influenza virus
TFESNGGLI

SEQ ID NO: 347160 - protein, 9 aa, Influenza virus
RIFQSGVRV

SEQ ID NO: 347161 - protein, 9 aa, Influenza virus
IFQSRIRMG

SEQ ID NO: 347162 - protein, 9 aa, Influenza virus
RVARCNTKC

SEQ ID NO: 347163 - protein, 9 aa, Influenza virus
VARCNTKCQ

SEQ ID NO: 347164 - protein, 9 aa, Influenza virus
KCQTSLGGV

SEQ ID NO: 347165 - protein, 9 aa, Influenza virus
DERGLFGAI

SEQ ID NO: 347166 - protein, 9 aa, Influenza virus
KVSTQKALN

SEQ ID NO: 347167 - protein, 9 aa, Influenza virus
VSTQKALNE

SEQ ID NO: 347168 - protein, 9 aa, Influenza virus
NVKNLHDQI

SEQ ID NO: 347169 - protein, 9 aa, Influenza virus
VKNLHDQIK

SEQ ID NO: 347170 - protein, 9 aa, Influenza virus
KNLHDQIKR

SEQ ID NO: 347171 - protein, 9 aa, Influenza virus
SCIASSTVM

SEQ ID NO: 347172 - protein, 9 aa, Influenza virus
CIASSTVMV

SEQ ID NO: 347173 - protein, 9 aa, Influenza virus
IASSTVMVG

SEQ ID NO: 347174 - protein, 9 aa, Influenza virus
ASSTVMVGL

SEQ ID NO: 347175 - protein, 9 aa, Influenza virus
SSTVMVGLI

SEQ ID NO: 347176 - protein, 9 aa, Influenza virus
STVMVGLIL

SEQ ID NO: 347177 - protein, 9 aa, Influenza virus
TVMVGLILA

SEQ ID NO: 347178 - protein, 9 aa, Influenza virus
IEGGWPGLV

SEQ ID NO: 347179 - protein, 9 aa, Influenza virus
EGGWPGLVA

SEQ ID NO: 347180 - protein, 9 aa, Influenza virus
GGWPGLVAG

SEQ ID NO: 347181 - protein, 9 aa, Influenza virus
GWPGLVAGW

SEQ ID NO: 347182 - protein, 9 aa, Influenza virus
WPGLVAGWY

SEQ ID NO: 347183 - protein, 9 aa, Influenza virus
PGLVAGWYG

SEQ ID NO: 347184 - protein, 9 aa, Influenza virus
GLVAGWYGF

SEQ ID NO: 347185 - protein, 9 aa, Influenza virus
LVAGWYGFQ

SEQ ID NO: 347186 - protein, 9 aa, Influenza virus
VAGWYGFQH

SEQ ID NO: 347187 - protein, 9 aa, Influenza virus
AGWYGFQHQ

SEQ ID NO: 347188 - protein, 9 aa, Influenza virus
YNAKLLVLL

SEQ ID NO: 347189 - protein, 9 aa, Influenza virus
NAKLLVLLE

SEQ ID NO: 347190 - protein, 9 aa, Influenza virus
AKLLVLLEN

SEQ ID NO: 347191 - protein, 9 aa, Influenza virus
LLENDKTLD

SEQ ID NO: 347192 - protein, 9 aa, Influenza virus
GNGCFELLH

SEQ ID NO: 347193 - protein, 9 aa, Influenza virus
LSIYSSVAS

SEQ ID NO: 347194 - protein, 9 aa, Influenza virus
DTVDTVREK

SEQ ID NO: 347195 - protein, 9 aa, Influenza virus
VDTVREKNV

SEQ ID NO: 347196 - protein, 9 aa, Influenza virus
DTVREKNVT

SEQ ID NO: 347197 - protein, 9 aa, Influenza virus
VLVIWGIHH

SEQ ID NO: 347198 - protein, 9 aa, Influenza virus
LVIWGIHHP

SEQ ID NO: 347199 - protein, 9 aa, Influenza virus
GRMNYYWTI

SEQ ID NO: 347200 - protein, 9 aa, Influenza virus
DTIIFEATG

SEQ ID NO: 347201 - protein, 9 aa, Influenza virus
TIIFEATGN

SEQ ID NO: 347202 - protein, 9 aa, Influenza virus
FEATGNLVA

SEQ ID NO: 347203 - protein, 9 aa, Influenza virus
EATGNLVAP

SEQ ID NO: 347204 - protein, 9 aa, Influenza virus
SLPFQNIHS

SEQ ID NO: 347205 - protein, 9 aa, Influenza virus
PITIGKCSK

SEQ ID NO: 347206 - protein, 9 aa, Influenza virus
KCSKYVKST

SEQ ID NO: 347207 - protein, 9 aa, Influenza virus
RLRMATGLR

SEQ ID NO: 347208 - protein, 9 aa, Influenza virus
RMATGLRNV

SEQ ID NO: 347209 - protein, 9 aa, Influenza virus
MATGLRNVP

SEQ ID NO: 347210 - protein, 9 aa, Influenza virus
ITNKVNTVI

SEQ ID NO: 347211 - protein, 9 aa, Influenza virus
TNKVNTVIE

SEQ ID NO: 347212 - protein, 9 aa, Influenza virus
MNTQFTSVG

SEQ ID NO: 347213 - protein, 9 aa, Influenza virus
TQFTVVGKE

SEQ ID NO: 347214 - protein, 9 aa, Influenza virus
NRKVDDGFL

SEQ ID NO: 347215 - protein, 9 aa, Influenza virus
RKVDDGFLD

SEQ ID NO: 347216 - protein, 9 aa, Influenza virus
DDGFIDVWT

SEQ ID NO: 347217 - protein, 9 aa, Influenza virus
DGFIDVWTY

SEQ ID NO: 347218 - protein, 9 aa, Influenza virus
GFIDVWTYN

SEQ ID NO: 347219 - protein, 9 aa, Influenza virus
FIDVWTYNA

SEQ ID NO: 347220 - protein, 9 aa, Influenza virus
ERTLDYHDF

SEQ ID NO: 347221 - protein, 9 aa, Influenza virus
PKYSKEAKL

SEQ ID NO: 347222 - protein, 9 aa, Influenza virus
ASTLVLLVS

SEQ ID NO: 347223 - protein, 9 aa, Influenza virus
STLVLLVSL

SEQ ID NO: 347224 - protein, 9 aa, Influenza virus
TLVLLVSLG

SEQ ID NO: 347225 - protein, 9 aa, Influenza virus
LVSLGAIGF

SEQ ID NO: 347226 - protein, 9 aa, Influenza virus
SWSLQCRIC

SEQ ID NO: 347227 - protein, 9 aa, Influenza virus
HTKDNSIRI

SEQ ID NO: 347228 - protein, 9 aa, Influenza virus
ISCSHFECR

SEQ ID NO: 347229 - protein, 9 aa, Influenza virus
DRHSNGTIK

SEQ ID NO: 347230 - protein, 9 aa, Influenza virus
HSNGTVKBR

SEQ ID NO: 347231 - protein, 9 aa, Influenza virus
SNGTVKBRS

SEQ ID NO: 347232 - protein, 9 aa, Influenza virus
KDRSPFRAL

SEQ ID NO: 347233 - protein, 9 aa, Influenza virus
SASACHDGV

SEQ ID NO: 347234 - protein, 9 aa, Influenza virus
LKYKGIITG

SEQ ID NO: 347235 - protein, 9 aa, Influenza virus
KYNDIITDT

SEQ ID NO: 347236 - protein, 9 aa, Influenza virus
GVITDTIKS

SEQ ID NO: 347237 - protein, 9 aa, Influenza virus
TQESECACI

SEQ ID NO: 347238 - protein, 9 aa, Influenza virus
QESECACIN

SEQ ID NO: 347239 - protein, 9 aa, Influenza virus
ESECACING

SEQ ID NO: 347240 - protein, 9 aa, Influenza virus
SECACINGS

SEQ ID NO: 347241 - protein, 9 aa, Influenza virus
ECACINGSC

SEQ ID NO: 347242 - protein, 9 aa, Influenza virus
APNYYYEEC

SEQ ID NO: 347243 - protein, 9 aa, Influenza virus
PNYYYEECS

SEQ ID NO: 347244 - protein, 9 aa, Influenza virus
NYYYEECSC

SEQ ID NO: 347245 - protein, 9 aa, Influenza virus
YYYEECSCY

SEQ ID NO: 347246 - protein, 9 aa, Influenza virus
RPWVSFNHN

SEQ ID NO: 347247 - protein, 9 aa, Influenza virus
PWVSFNHNL

SEQ ID NO: 347248 - protein, 9 aa, Influenza virus
MGYICSGVF

SEQ ID NO: 347249 - protein, 9 aa, Influenza virus
TNGVKGFSF

SEQ ID NO: 347250 - protein, 9 aa, Influenza virus
VKGFSYRYG

SEQ ID NO: 347251 - protein, 9 aa, Influenza virus
KGFSYRYGN

SEQ ID NO: 347252 - protein, 9 aa, Influenza virus
GFSYRYGNG

SEQ ID NO: 347253 - protein, 9 aa, Influenza virus
FSYRYGNGV

SEQ ID NO: 347254 - protein, 9 aa, Influenza virus
SYRYGNGVW

SEQ ID NO: 347255 - protein, 9 aa, Influenza virus
IWIGRTKST

SEQ ID NO: 347256 - protein, 9 aa, Influenza virus
PELTGMDCI

SEQ ID NO: 347257 - protein, 9 aa, Influenza virus
NCMRPCFWV

SEQ ID NO: 347258 - protein, 9 aa, Influenza virus
SISFCGVSS

SEQ ID NO: 347259 - protein, 9 aa, Influenza virus
GWSWPDGAK

SEQ ID NO: 347260 - protein, 9 aa, Influenza virus
PDGAELPFI

SEQ ID NO: 347261 - protein, 9 aa, Influenza virus
DGAELPFII

SEQ ID NO: 347262 - protein, 9 aa, Influenza virus
KNVTVTHAV

SEQ ID NO: 347263 - protein, 9 aa, Influenza virus
VVGWISGNP

SEQ ID NO: 347264 - protein, 9 aa, Influenza virus
GWLLGNPGC

SEQ ID NO: 347265 - protein, 9 aa, Influenza virus
YEELREQMS

SEQ ID NO: 347266 - protein, 9 aa, Influenza virus
PFQNIHPAT

SEQ ID NO: 347267 - protein, 9 aa, Influenza virus
FQNIHPATI

SEQ ID NO: 347268 - protein, 9 aa, Influenza virus
QNIHPATIG

SEQ ID NO: 347269 - protein, 9 aa, Influenza virus
LRMARGLRN

SEQ ID NO: 347270 - protein, 9 aa, Influenza virus
SIQTRGLFG

SEQ ID NO: 347271 - protein, 9 aa, Influenza virus
IQSKGLFGA

SEQ ID NO: 347272 - protein, 9 aa, Influenza virus
EQGYGYAAD

SEQ ID NO: 347273 - protein, 9 aa, Influenza virus
ENLNKRVDD

SEQ ID NO: 347274 - protein, 9 aa, Influenza virus
NLNKRVDDG

SEQ ID NO: 347275 - protein, 9 aa, Influenza virus
LNRKVDDGF

SEQ ID NO: 347276 - protein, 9 aa, Influenza virus
RTLDYHDSH

SEQ ID NO: 347277 - protein, 9 aa, Influenza virus
NNARELGNG

SEQ ID NO: 347278 - protein, 9 aa, Influenza virus
FEFYHRCDD

SEQ ID NO: 347279 - protein, 9 aa, Influenza virus
SIKNGTYDY

SEQ ID NO: 347280 - protein, 9 aa, Influenza virus
CPNGSLQCT

SEQ ID NO: 347281 - protein, 9 aa, Influenza virus
SHGSLQCRI

SEQ ID NO: 347282 - protein, 9 aa, Influenza virus
HGSLQCRIC

SEQ ID NO: 347283 - protein, 9 aa, Influenza virus
GSLQCRICM

SEQ ID NO: 347284 - protein, 9 aa, Influenza virus
YRNWAKPQC

SEQ ID NO: 347285 - protein, 9 aa, Influenza virus
INGFAPFSK

SEQ ID NO: 347286 - protein, 9 aa, Influenza virus
VSAGGDIWV

SEQ ID NO: 347287 - protein, 9 aa, Influenza virus
SGDVWVTRE

SEQ ID NO: 347288 - protein, 9 aa, Influenza virus
TREPYVSCK

SEQ ID NO: 347289 - protein, 9 aa, Influenza virus
DRSPYRTLL

SEQ ID NO: 347290 - protein, 9 aa, Influenza virus
RSPYRTLLM

SEQ ID NO: 347291 - protein, 9 aa, Influenza virus
GIPFHLGTR

SEQ ID NO: 347292 - protein, 9 aa, Influenza virus
YDGKAWLHI

SEQ ID NO: 347293 - protein, 9 aa, Influenza virus
ICAVVMTDG

SEQ ID NO: 347294 - protein, 9 aa, Influenza virus
VMTDGSATG

SEQ ID NO: 347295 - protein, 9 aa, Influenza virus
WKGSNRPVI

SEQ ID NO: 347296 - protein, 9 aa, Influenza virus
KGSNRPVID

SEQ ID NO: 347297 - protein, 9 aa, Influenza virus
GSHGVKGWA

SEQ ID NO: 347298 - protein, 9 aa, Influenza virus
SHGVKGWAF

SEQ ID NO: 347299 - protein, 9 aa, Influenza virus
GVKGWAFDE

SEQ ID NO: 347300 - protein, 9 aa, Influenza virus
SGYETFRVT

SEQ ID NO: 347301 - protein, 9 aa, Influenza virus
WSGYSGVFS

SEQ ID NO: 347302 - protein, 9 aa, Influenza virus
YVELIRGRE

SEQ ID NO: 347303 - protein, 9 aa, Influenza virus
VFCGTSGTC

SEQ ID NO: 347304 - protein, 9 aa, Influenza virus
GTYGTGAWP

SEQ ID NO: 347305 - protein, 9 aa, Influenza virus
TYGAGSWPD

SEQ ID NO: 347306 - protein, 9 aa, Influenza virus
YGTGSWPDV

SEQ ID NO: 347307 - protein, 9 aa, Influenza virus
GKGSWPDGA

SEQ ID NO: 347308 - protein, 9 aa, Influenza virus
DQICVGYHA

SEQ ID NO: 347309 - protein, 9 aa, Influenza virus
QICVGYHAN

SEQ ID NO: 347310 - protein, 9 aa, Influenza virus
YHSNNSTKK

SEQ ID NO: 347311 - protein, 9 aa, Influenza virus
NNSTKKVDT

SEQ ID NO: 347312 - protein, 9 aa, Influenza virus
THAEDILEK

SEQ ID NO: 347313 - protein, 9 aa, Influenza virus
HNGKLCRLN

SEQ ID NO: 347314 - protein, 9 aa, Influenza virus
NGKLCRLNG

SEQ ID NO: 347315 - protein, 9 aa, Influenza virus
LNGVPPLEL

SEQ ID NO: 347316 - protein, 9 aa, Influenza virus
GISPLELGD

SEQ ID NO: 347317 - protein, 9 aa, Influenza virus
IPPLELGNC

SEQ ID NO: 347318 - protein, 9 aa, Influenza virus
LGNPKCDRL

SEQ ID NO: 347319 - protein, 9 aa, Influenza virus
GNPKCDRLL

SEQ ID NO: 347320 - protein, 9 aa, Influenza virus
EWSYIMEKK

SEQ ID NO: 347321 - protein, 9 aa, Influenza virus
RSYNNTSGG

SEQ ID NO: 347322 - protein, 9 aa, Influenza virus
YNNTSGEQV

SEQ ID NO: 347323 - protein, 9 aa, Influenza virus
NNTSGEQVL

SEQ ID NO: 347324 - protein, 9 aa, Influenza virus
NFESNGNLI

SEQ ID NO: 347325 - protein, 9 aa, Influenza virus
SKRGSSGVM

SEQ ID NO: 347326 - protein, 9 aa, Influenza virus
KRGSSGVMK

SEQ ID NO: 347327 - protein, 9 aa, Influenza virus
RGSSGVMKT

SEQ ID NO: 347328 - protein, 9 aa, Influenza virus
CDTKCQTPL

SEQ ID NO: 347329 - protein, 9 aa, Influenza virus
DTKCQTPLG

SEQ ID NO: 347330 - protein, 9 aa, Influenza virus
KCQSPLGAI

SEQ ID NO: 347331 - protein, 9 aa, Influenza virus
LILATGVRN

SEQ ID NO: 347332 - protein, 9 aa, Influenza virus
PQIEARGLF

SEQ ID NO: 347333 - protein, 9 aa, Influenza virus
QTESRGLFG

SEQ ID NO: 347334 - protein, 9 aa, Influenza virus
TESRGLFGA

SEQ ID NO: 347335 - protein, 9 aa, Influenza virus
NSVIEKMNI

SEQ ID NO: 347336 - protein, 9 aa, Influenza virus
RTLGFHDSN

SEQ ID NO: 347337 - protein, 9 aa, Influenza virus
EFHDSNVKN

SEQ ID NO: 347338 - protein, 9 aa, Influenza virus
DSNVKNLYE

SEQ ID NO: 347339 - protein, 9 aa, Influenza virus
NLYDRVRMQ

SEQ ID NO: 347340 - protein, 9 aa, Influenza virus
YEKVRMQLR

SEQ ID NO: 347341 - protein, 9 aa, Influenza virus
DKVRMQLKD

SEQ ID NO: 347342 - protein, 9 aa, Influenza virus
QLKDNAKEV

SEQ ID NO: 347343 - protein, 9 aa, Influenza virus
LRDNAKETG

SEQ ID NO: 347344 - protein, 9 aa, Influenza virus
DNAKEVGNG

SEQ ID NO: 347345 - protein, 9 aa, Influenza virus
NAKEVGNGC

SEQ ID NO: 347346 - protein, 9 aa, Influenza virus
AKETGNGCF

SEQ ID NO: 347347 - protein, 9 aa, Influenza virus
HKCNDECMN

SEQ ID NO: 347348 - protein, 9 aa, Influenza virus
KCNDECMNS

SEQ ID NO: 347349 - protein, 9 aa, Influenza virus
SVKNGTYYY

SEQ ID NO: 347350 - protein, 9 aa, Influenza virus
NGTYNYSKY

SEQ ID NO: 347351 - protein, 9 aa, Influenza virus
TYDYPKYEK

SEQ ID NO: 347352 - protein, 9 aa, Influenza virus
YNYSKYEEE

SEQ ID NO: 347353 - protein, 9 aa, Influenza virus
NYSKYEEES

SEQ ID NO: 347354 - protein, 9 aa, Influenza virus
EEESKLNRS

SEQ ID NO: 347355 - protein, 9 aa, Influenza virus
EESKLNRSE

SEQ ID NO: 347356 - protein, 9 aa, Influenza virus
ESKLNRSEI

SEQ ID NO: 347357 - protein, 9 aa, Influenza virus
SKLNRSEIK

SEQ ID NO: 347358 - protein, 9 aa, Influenza virus
KLNRSEIKG

SEQ ID NO: 347359 - protein, 9 aa, Influenza virus
LAIMMAGIF

SEQ ID NO: 347360 - protein, 9 aa, Influenza virus
AGIFFWMCS

SEQ ID NO: 347361 - protein, 9 aa, Influenza virus
GIFFWMCSN

SEQ ID NO: 347362 - protein, 9 aa, Influenza virus
IFFWMCSNG

SEQ ID NO: 347363 - protein, 9 aa, Influenza virus
FFWMCSNGS

SEQ ID NO: 347364 - protein, 9 aa, Influenza virus
NNSTEKIDT

SEQ ID NO: 347365 - protein, 9 aa, Influenza virus
MVDTILERN

SEQ ID NO: 347366 - protein, 9 aa, Influenza virus
HAKDILEKA

SEQ ID NO: 347367 - protein, 9 aa, Influenza virus
AQNILEKTH

SEQ ID NO: 347368 - protein, 9 aa, Influenza virus
KDILEKAHN

SEQ ID NO: 347369 - protein, 9 aa, Influenza virus
NPECDRFLS

SEQ ID NO: 347370 - protein, 9 aa, Influenza virus
LIVPEWSYI

SEQ ID NO: 347371 - protein, 9 aa, Influenza virus
WSYIIEKEN

SEQ ID NO: 347372 - protein, 9 aa, Influenza virus
SYIIEKENP

SEQ ID NO: 347373 - protein, 9 aa, Influenza virus
NLCYPGSLN

SEQ ID NO: 347374 - protein, 9 aa, Influenza virus
FNDYEELKY

SEQ ID NO: 347375 - protein, 9 aa, Influenza virus
NDYEELKLL

SEQ ID NO: 347376 - protein, 9 aa, Influenza virus
VTHFEKIKI

SEQ ID NO: 347377 - protein, 9 aa, Influenza virus
THFEKIKIL

SEQ ID NO: 347378 - protein, 9 aa, Influenza virus
FEKIKILPR

SEQ ID NO: 347379 - protein, 9 aa, Influenza virus
EKIKILPRD

SEQ ID NO: 347380 - protein, 9 aa, Influenza virus
VARGSYNNT

SEQ ID NO: 347381 - protein, 9 aa, Influenza virus
ARGSYNNTS

SEQ ID NO: 347382 - protein, 9 aa, Influenza virus
QGSYNNTSG

SEQ ID NO: 347383 - protein, 9 aa, Influenza virus
WGIHHPNDE

SEQ ID NO: 347384 - protein, 9 aa, Influenza virus
WDTISFEST

SEQ ID NO: 347385 - protein, 9 aa, Influenza virus
GIMKTERTL

SEQ ID NO: 347386 - protein, 9 aa, Influenza virus
NCETQCQTP

SEQ ID NO: 347387 - protein, 9 aa, Influenza virus
CPKYVKSKR

SEQ ID NO: 347388 - protein, 9 aa, Influenza virus
PRYVKSEKL

SEQ ID NO: 347389 - protein, 9 aa, Influenza virus
KYVKSKRLV

SEQ ID NO: 347390 - protein, 9 aa, Influenza virus
KSKRLVLAT

SEQ ID NO: 347391 - protein, 9 aa, Influenza virus
KRLVLATGL

SEQ ID NO: 347392 - protein, 9 aa, Influenza virus
TGLRNAHKM

SEQ ID NO: 347393 - protein, 9 aa, Influenza virus
RNVPQIEAR

SEQ ID NO: 347394 - protein, 9 aa, Influenza virus
NVPQIEARG

SEQ ID NO: 347395 - protein, 9 aa, Influenza virus
VPQIEARGL

SEQ ID NO: 347396 - protein, 9 aa, Influenza virus
DKESTQRAF

SEQ ID NO: 347397 - protein, 9 aa, Influenza virus
VNSVIEKIN

SEQ ID NO: 347398 - protein, 9 aa, Influenza virus
NSVIEKINT

SEQ ID NO: 347399 - protein, 9 aa, Influenza virus
SVIEKINTQ

SEQ ID NO: 347400 - protein, 9 aa, Influenza virus
IEKMNTQSE

SEQ ID NO: 347401 - protein, 9 aa, Influenza virus
SVGKEFSNL

SEQ ID NO: 347402 - protein, 9 aa, Influenza virus
KEFGNLERR

SEQ ID NO: 347403 - protein, 9 aa, Influenza virus
EFGNLERRL

SEQ ID NO: 347404 - protein, 9 aa, Influenza virus
FGNLERRLE

SEQ ID NO: 347405 - protein, 9 aa, Influenza virus
GNLERRLEN

SEQ ID NO: 347406 - protein, 9 aa, Influenza virus
KRLENLDKK

SEQ ID NO: 347407 - protein, 9 aa, Influenza virus
RLENLDKKM

SEQ ID NO: 347408 - protein, 9 aa, Influenza virus
LGNLNKKME

SEQ ID NO: 347409 - protein, 9 aa, Influenza virus
ENLNKRMED

SEQ ID NO: 347410 - protein, 9 aa, Influenza virus
LDKKMEDGF

SEQ ID NO: 347411 - protein, 9 aa, Influenza virus
MEDGFRDVW

SEQ ID NO: 347412 - protein, 9 aa, Influenza virus
LLDVWTYNA

SEQ ID NO: 347413 - protein, 9 aa, Influenza virus
DSNVRNLYD

SEQ ID NO: 347414 - protein, 9 aa, Influenza virus
VRNLYDKVR

SEQ ID NO: 347415 - protein, 9 aa, Influenza virus
RNLYDKVRM

SEQ ID NO: 347416 - protein, 9 aa, Influenza virus
CMNSVKTGT

SEQ ID NO: 347417 - protein, 9 aa, Influenza virus
MNSVKTGTY

SEQ ID NO: 347418 - protein, 9 aa, Influenza virus
SVKTGTYDY

SEQ ID NO: 347419 - protein, 9 aa, Influenza virus
KTGTYDYPK

SEQ ID NO: 347420 - protein, 9 aa, Influenza virus
GVELSSMGV

SEQ ID NO: 347421 - protein, 9 aa, Influenza virus
VELSSMGVY

SEQ ID NO: 347422 - protein, 9 aa, Influenza virus
ELSSMGVYQ

SEQ ID NO: 347423 - protein, 9 aa, Influenza virus
NMGVYQVLA

SEQ ID NO: 347424 - protein, 9 aa, Influenza virus
LAIMMAGIF

SEQ ID NO: 347425 - protein, 9 aa, Influenza virus
QKIITMGSV

SEQ ID NO: 347426 - protein, 9 aa, Influenza virus
KIITIDSVS

SEQ ID NO: 347427 - protein, 9 aa, Influenza virus
IITMGSVSL

SEQ ID NO: 347428 - protein, 9 aa, Influenza virus
ITIGFVSLI

SEQ ID NO: 347429 - protein, 9 aa, Influenza virus
HIAILVTTV

SEQ ID NO: 347430 - protein, 9 aa, Influenza virus
ITLHFKQNE

SEQ ID NO: 347431 - protein, 9 aa, Influenza virus
LHFKQHKCD

SEQ ID NO: 347432 - protein, 9 aa, Influenza virus
KEIVYLNNT

SEQ ID NO: 347433 - protein, 9 aa, Influenza virus
EIMYLNNTT

SEQ ID NO: 347434 - protein, 9 aa, Influenza virus
SGGGDIWVT

SEQ ID NO: 347435 - protein, 9 aa, Influenza virus
GGGDIWVTR

SEQ ID NO: 347436 - protein, 9 aa, Influenza virus
REPYVSCNP

SEQ ID NO: 347437 - protein, 9 aa, Influenza virus
DKCYQFALG

SEQ ID NO: 347438 - protein, 9 aa, Influenza virus
ENKHSNGTK

SEQ ID NO: 347439 - protein, 9 aa, Influenza virus
TIHDRSPHR

SEQ ID NO: 347440 - protein, 9 aa, Influenza virus
KHDRIPHRT

SEQ ID NO: 347441 - protein, 9 aa, Influenza virus
HLGTKQVCA

SEQ ID NO: 347442 - protein, 9 aa, Influenza virus
LGTKQVCAA

SEQ ID NO: 347443 - protein, 9 aa, Influenza virus
GTKQVCAAW

SEQ ID NO: 347444 - protein, 9 aa, Influenza virus
TKQVCAAWS

SEQ ID NO: 347445 - protein, 9 aa, Influenza virus
KQVCAAWSS

SEQ ID NO: 347446 - protein, 9 aa, Influenza virus
CVTGYEKNA

SEQ ID NO: 347447 - protein, 9 aa, Influenza virus
VTGYEKNAT

SEQ ID NO: 347448 - protein, 9 aa, Influenza virus
DENATASFI

SEQ ID NO: 347449 - protein, 9 aa, Influenza virus
NATASFIYE

SEQ ID NO: 347450 - protein, 9 aa, Influenza virus
ATASFIYGG

SEQ ID NO: 347451 - protein, 9 aa, Influenza virus
ADTKILFIE

SEQ ID NO: 347452 - protein, 9 aa, Influenza virus
DTRILFIRE

SEQ ID NO: 347453 - protein, 9 aa, Influenza virus
TKILFIEEG

SEQ ID NO: 347454 - protein, 9 aa, Influenza virus
RILFIREGK

SEQ ID NO: 347455 - protein, 9 aa, Influenza virus
ILFIEEGKV

SEQ ID NO: 347456 - protein, 9 aa, Influenza virus
EGKIVHVSP

SEQ ID NO: 347457 - protein, 9 aa, Influenza virus
GKVVHISPL

SEQ ID NO: 347458 - protein, 9 aa, Influenza virus
VHISPLAGS

SEQ ID NO: 347459 - protein, 9 aa, Influenza virus
RYPDVRCTC

SEQ ID NO: 347460 - protein, 9 aa, Influenza virus
YPDVRCTCR

SEQ ID NO: 347461 - protein, 9 aa, Influenza virus
PDVRCTCRD

SEQ ID NO: 347462 - protein, 9 aa, Influenza virus
DVRCICKDN

SEQ ID NO: 347463 - protein, 9 aa, Influenza virus
GSNRPIVDI

SEQ ID NO: 347464 - protein, 9 aa, Influenza virus
SNRPIVDIN

SEQ ID NO: 347465 - protein, 9 aa, Influenza virus
ISMEDYSIG

SEQ ID NO: 347466 - protein, 9 aa, Influenza virus
NMVDYSIDS

SEQ ID NO: 347467 - protein, 9 aa, Influenza virus
DYSIDSGYV

SEQ ID NO: 347468 - protein, 9 aa, Influenza virus
DTPRSDDSS

SEQ ID NO: 347469 - protein, 9 aa, Influenza virus
TPRSDDSSS

SEQ ID NO: 347470 - protein, 9 aa, Influenza virus
SSSNCRNPN

SEQ ID NO: 347471 - protein, 9 aa, Influenza virus
SSNCRNPNN

SEQ ID NO: 347472 - protein, 9 aa, Influenza virus
PNNERGYPG

SEQ ID NO: 347473 - protein, 9 aa, Influenza virus
NNERGYPGV

SEQ ID NO: 347474 - protein, 9 aa, Influenza virus
NERGNHGVK

SEQ ID NO: 347475 - protein, 9 aa, Influenza virus
ERGNHGVKG

SEQ ID NO: 347476 - protein, 9 aa, Influenza virus
RGYPGVKGW

SEQ ID NO: 347477 - protein, 9 aa, Influenza virus
GDDVLMGRT

SEQ ID NO: 347478 - protein, 9 aa, Influenza virus
DDVLMGRTI

SEQ ID NO: 347479 - protein, 9 aa, Influenza virus
DLWMGTTIS

SEQ ID NO: 347480 - protein, 9 aa, Influenza virus
TFRVIGGWV

SEQ ID NO: 347481 - protein, 9 aa, Influenza virus
FRVIGGWVT

SEQ ID NO: 347482 - protein, 9 aa, Influenza virus
KNNWSGYSG

SEQ ID NO: 347483 - protein, 9 aa, Influenza virus
KNCINRCFY

SEQ ID NO: 347484 - protein, 9 aa, Influenza virus
NCINRCFYV

SEQ ID NO: 347485 - protein, 9 aa, Influenza virus
YVELIRGMP

SEQ ID NO: 347486 - protein, 9 aa, Influenza virus
VELIRGRRQ

SEQ ID NO: 347487 - protein, 9 aa, Influenza virus
ELIRGMPQE

SEQ ID NO: 347488 - protein, 9 aa, Influenza virus
PQEARVWWT

SEQ ID NO: 347489 - protein, 9 aa, Influenza virus
WPDGANTNF

SEQ ID NO: 347490 - protein, 9 aa, Influenza virus
PDGANISFM

SEQ ID NO: 347491 - protein, 9 aa, Influenza virus
DGANISFMP

SEQ ID NO: 347492 - protein, 9 aa, Influenza virus
GANIDFMPV

SEQ ID NO: 347493 - protein, 9 aa, Influenza virus
DNIEVTNAT

SEQ ID NO: 347494 - protein, 9 aa, Influenza virus
SLVASSGNL

SEQ ID NO: 347495 - protein, 9 aa, Influenza virus
LVASSGNLE

SEQ ID NO: 347496 - protein, 9 aa, Influenza virus
FFARLNWLT

SEQ ID NO: 347497 - protein, 9 aa, Influenza virus
FDKLYVWGI

SEQ ID NO: 347498 - protein, 9 aa, Influenza virus
TPNGSIPNG

SEQ ID NO: 347499 - protein, 9 aa, Influenza virus
GSIPNGKPF

SEQ ID NO: 347500 - protein, 9 aa, Influenza virus
SIPNGKPFQ

SEQ ID NO: 347501 - protein, 9 aa, Influenza virus
IPNGKPFQN

SEQ ID NO: 347502 - protein, 9 aa, Influenza virus
TGMRNIPER

SEQ ID NO: 347503 - protein, 9 aa, Influenza virus
GMRNIPERQ

SEQ ID NO: 347504 - protein, 9 aa, Influenza virus
TRGLFGAKA

SEQ ID NO: 347505 - protein, 9 aa, Influenza virus
VNGWYGFRH

SEQ ID NO: 347506 - protein, 9 aa, Influenza virus
FKSTQAAIN

SEQ ID NO: 347507 - protein, 9 aa, Influenza virus
STQAAVNQI

SEQ ID NO: 347508 - protein, 9 aa, Influenza virus
VEKTNEKFH

SEQ ID NO: 347509 - protein, 9 aa, Influenza virus
NTIDLTDSE

SEQ ID NO: 347510 - protein, 9 aa, Influenza virus
IDLADSEMN

SEQ ID NO: 347511 - protein, 9 aa, Influenza virus
DLADSEMNK

SEQ ID NO: 347512 - protein, 9 aa, Influenza virus
MTDSEMNKL

SEQ ID NO: 347513 - protein, 9 aa, Influenza virus
AEDIGNGCF

SEQ ID NO: 347514 - protein, 9 aa, Influenza virus
GNGCLKIYH

SEQ ID NO: 347515 - protein, 9 aa, Influenza virus
CFRIYHKCD

SEQ ID NO: 347516 - protein, 9 aa, Influenza virus
FKIYHRCDN

SEQ ID NO: 347517 - protein, 9 aa, Influenza virus
IYHKCNNAC

SEQ ID NO: 347518 - protein, 9 aa, Influenza virus
GYKDWFLWI

SEQ ID NO: 347519 - protein, 9 aa, Influenza virus
SFAISCLLL

SEQ ID NO: 347520 - protein, 9 aa, Influenza virus
FAISCLLLC

SEQ ID NO: 347521 - protein, 9 aa, Influenza virus
FVMWACQKG

SEQ ID NO: 347522 - protein, 9 aa, Influenza virus
AVPNGTMVK

SEQ ID NO: 347523 - protein, 9 aa, Influenza virus
VPNGTMVKT

SEQ ID NO: 347524 - protein, 9 aa, Influenza virus
PNGTMVKTI

SEQ ID NO: 347525 - protein, 9 aa, Influenza virus
IDSLLGDPH

SEQ ID NO: 347526 - protein, 9 aa, Influenza virus
CYPYDVQDY

SEQ ID NO: 347527 - protein, 9 aa, Influenza virus
SIYWTVVKP

SEQ ID NO: 347528 - protein, 9 aa, Influenza virus
VYWTIVKPG

SEQ ID NO: 347529 - protein, 9 aa, Influenza virus
TPNGSIPNN

SEQ ID NO: 347530 - protein, 9 aa, Influenza virus
PNGSIPNNK

SEQ ID NO: 347531 - protein, 9 aa, Influenza virus
NGSIPNGKP

SEQ ID NO: 347532 - protein, 9 aa, Influenza virus
GSIPNGKPF

SEQ ID NO: 347533 - protein, 9 aa, Influenza virus
SIPNNKPFQ

SEQ ID NO: 347534 - protein, 9 aa, Influenza virus
IPNGKPFQN

SEQ ID NO: 347535 - protein, 9 aa, Influenza virus
PNGKPFQNV

SEQ ID NO: 347536 - protein, 9 aa, Influenza virus
NKPFQNVNK

SEQ ID NO: 347537 - protein, 9 aa, Influenza virus
NINRITYGA

SEQ ID NO: 347538 - protein, 9 aa, Influenza virus
INRITYGAC

SEQ ID NO: 347539 - protein, 9 aa, Influenza virus
TYGACPRYI

SEQ ID NO: 347540 - protein, 9 aa, Influenza virus
YVRQNTLKL

SEQ ID NO: 347541 - protein, 9 aa, Influenza virus
TGMRNIPER

SEQ ID NO: 347542 - protein, 9 aa, Influenza virus
GMRNIPERQ

SEQ ID NO: 347543 - protein, 9 aa, Influenza virus
MRNIPERQT

SEQ ID NO: 347544 - protein, 9 aa, Influenza virus
RNIPERQTR

SEQ ID NO: 347545 - protein, 9 aa, Influenza virus
NIPERQTRG

SEQ ID NO: 347546 - protein, 9 aa, Influenza virus
PERQTRGLF

SEQ ID NO: 347547 - protein, 9 aa, Influenza virus
ERQTRGLFG

SEQ ID NO: 347548 - protein, 9 aa, Influenza virus
RQTRGLFGA

SEQ ID NO: 347549 - protein, 9 aa, Influenza virus
RHQNSEGMG

SEQ ID NO: 347550 - protein, 9 aa, Influenza virus
HQNSEGMGQ

SEQ ID NO: 347551 - protein, 9 aa, Influenza virus
LKSTQAAIT

SEQ ID NO: 347552 - protein, 9 aa, Influenza virus
EDLGNGCFK

SEQ ID NO: 347553 - protein, 9 aa, Influenza virus
EMGNGCFKI

SEQ ID NO: 347554 - protein, 9 aa, Influenza virus
DEALSNRFQ

SEQ ID NO: 347555 - protein, 9 aa, Influenza virus
MNPNQRIIT

SEQ ID NO: 347556 - protein, 9 aa, Influenza virus
YRNWTKPQC

SEQ ID NO: 347557 - protein, 9 aa, Influenza virus
RNATASFVY

SEQ ID NO: 347558 - protein, 9 aa, Influenza virus
INGICTVVM

SEQ ID NO: 347559 - protein, 9 aa, Influenza virus
LSGGAQHVE

SEQ ID NO: 347560 - protein, 9 aa, Influenza virus
CSCYPRYSG

SEQ ID NO: 347561 - protein, 9 aa, Influenza virus
WRGSNRPIV

SEQ ID NO: 347562 - protein, 9 aa, Influenza virus
RGSNRPIVD

SEQ ID NO: 347563 - protein, 9 aa, Influenza virus
SNRPVVDIR

SEQ ID NO: 347564 - protein, 9 aa, Influenza virus
GNDLWMGRT

SEQ ID NO: 347565 - protein, 9 aa, Influenza virus
DVLWTSNSI

SEQ ID NO: 347566 - protein, 9 aa, Influenza virus
HTGNPVICL

SEQ ID NO: 347567 - protein, 9 aa, Influenza virus
GHHAVTNGT

SEQ ID NO: 347568 - protein, 9 aa, Influenza virus
VTNGTMVKT

SEQ ID NO: 347569 - protein, 9 aa, Influenza virus
GTMVKTLTG

SEQ ID NO: 347570 - protein, 9 aa, Influenza virus
VEVITAQEL

SEQ ID NO: 347571 - protein, 9 aa, Influenza virus
TAQELVEPQ

SEQ ID NO: 347572 - protein, 9 aa, Influenza virus
LCPKPLKLV

SEQ ID NO: 347573 - protein, 9 aa, Influenza virus
CSSPLRLVD

SEQ ID NO: 347574 - protein, 9 aa, Influenza virus
KPLKLVDGQ

SEQ ID NO: 347575 - protein, 9 aa, Influenza virus
DVPNYQSLR

SEQ ID NO: 347576 - protein, 9 aa, Influenza virus
VPNYQSLRS

SEQ ID NO: 347577 - protein, 9 aa, Influenza virus
PGYQSLRSI

SEQ ID NO: 347578 - protein, 9 aa, Influenza virus
NYQSLRSIL

SEQ ID NO: 347579 - protein, 9 aa, Influenza virus
GKFEFIVEK

SEQ ID NO: 347580 - protein, 9 aa, Influenza virus
KFEFIVEKF

SEQ ID NO: 347581 - protein, 9 aa, Influenza virus
AVKQNGKSG

SEQ ID NO: 347582 - protein, 9 aa, Influenza virus
NLTKTNNGD

SEQ ID NO: 347583 - protein, 9 aa, Influenza virus
LTKTNNGDY

SEQ ID NO: 347584 - protein, 9 aa, Influenza virus
YKSNPGRVT

SEQ ID NO: 347585 - protein, 9 aa, Influenza virus
QTSVIPNIG

SEQ ID NO: 347586 - protein, 9 aa, Influenza virus
RPWVRGLSS

SEQ ID NO: 347587 - protein, 9 aa, Influenza virus
GNLIVFNTI

SEQ ID NO: 347588 - protein, 9 aa, Influenza virus
IGSCVSRCH

SEQ ID NO: 347589 - protein, 9 aa, Influenza virus
GSCVSRCHT

SEQ ID NO: 347590 - protein, 9 aa, Influenza virus
SKCHTNRGS

SEQ ID NO: 347591 - protein, 9 aa, Influenza virus
KPFHNISRI

SEQ ID NO: 347592 - protein, 9 aa, Influenza virus
PFQNVSRTA

SEQ ID NO: 347593 - protein, 9 aa, Influenza virus
GNCPKYVKQ

SEQ ID NO: 347594 - protein, 9 aa, Influenza virus
NCPKYVKQG

SEQ ID NO: 347595 - protein, 9 aa, Influenza virus
TQAAIDQVN

SEQ ID NO: 347596 - protein, 9 aa, Influenza virus
QAAIDQVNG

SEQ ID NO: 347597 - protein, 9 aa, Influenza virus
AAIDQISGK

SEQ ID NO: 347598 - protein, 9 aa, Influenza virus
EKVEGRIQD

SEQ ID NO: 347599 - protein, 9 aa, Influenza virus
DVADSEMNK

SEQ ID NO: 347600 - protein, 9 aa, Influenza virus
VADSEMNKL

SEQ ID NO: 347601 - protein, 9 aa, Influenza virus
MNKLFERIR

SEQ ID NO: 347602 - protein, 9 aa, Influenza virus
CGNNCIESI

SEQ ID NO: 347603 - protein, 9 aa, Influenza virus
DNTCIESIR

SEQ ID NO: 347604 - protein, 9 aa, Influenza virus
HNVYRDEAI

SEQ ID NO: 347605 - protein, 9 aa, Influenza virus
DDAINNRFQ

SEQ ID NO: 347606 - protein, 9 aa, Influenza virus
FQIQGIKLT

SEQ ID NO: 347607 - protein, 9 aa, Influenza virus
QIQGIKLTQ

SEQ ID NO: 347608 - protein, 9 aa, Influenza virus
CFLLVALFL

SEQ ID NO: 347609 - protein, 9 aa, Influenza virus
ALFLAFILW

SEQ ID NO: 347610 - protein, 9 aa, Influenza virus
LFLAFILWA

SEQ ID NO: 347611 - protein, 9 aa, Influenza virus
FLAFILWAC

SEQ ID NO: 347612 - protein, 9 aa, Influenza virus
FIWGLSEWK

SEQ ID NO: 347613 - protein, 9 aa, Influenza virus
SDQICVGYH

SEQ ID NO: 347614 - protein, 9 aa, Influenza virus
VTVTHAQDL

SEQ ID NO: 347615 - protein, 9 aa, Influenza virus
THAQDLLEK

SEQ ID NO: 347616 - protein, 9 aa, Influenza virus
KPLILGDCS

SEQ ID NO: 347617 - protein, 9 aa, Influenza virus
PFILKDCSV

SEQ ID NO: 347618 - protein, 9 aa, Influenza virus
ILKDCSVSG

SEQ ID NO: 347619 - protein, 9 aa, Influenza virus
LGDCSVAGW

SEQ ID NO: 347620 - protein, 9 aa, Influenza virus
KDCSVSGWL

SEQ ID NO: 347621 - protein, 9 aa, Influenza virus
LLVLWGVHH

SEQ ID NO: 347622 - protein, 9 aa, Influenza virus
HISVGTSTL

SEQ ID NO: 347623 - protein, 9 aa, Influenza virus
GTSTLNQKL

SEQ ID NO: 347624 - protein, 9 aa, Influenza virus
IAPEYAYKV

SEQ ID NO: 347625 - protein, 9 aa, Influenza virus
CQTPMGAVN

SEQ ID NO: 347626 - protein, 9 aa, Influenza virus
SSKPFHNIH

SEQ ID NO: 347627 - protein, 9 aa, Influenza virus
MPLHNIHPL

SEQ ID NO: 347628 - protein, 9 aa, Influenza virus
FHNVHPLAI

SEQ ID NO: 347629 - protein, 9 aa, Influenza virus
PLAIGECPK

SEQ ID NO: 347630 - protein, 9 aa, Influenza virus
LAIGECPKY

SEQ ID NO: 347631 - protein, 9 aa, Influenza virus
RRKRRGLFG

SEQ ID NO: 347632 - protein, 9 aa, Influenza virus
AADRESTQK

SEQ ID NO: 347633 - protein, 9 aa, Influenza virus
ADRESTQKA

SEQ ID NO: 347634 - protein, 9 aa, Influenza virus
ESTQKAVDG

SEQ ID NO: 347635 - protein, 9 aa, Influenza virus
DGITNKINS

SEQ ID NO: 347636 - protein, 9 aa, Influenza virus
TNRVNSIID

SEQ ID NO: 347637 - protein, 9 aa, Influenza virus
RVNSIIDKM

SEQ ID NO: 347638 - protein, 9 aa, Influenza virus
IIDKMNIQF

SEQ ID NO: 347639 - protein, 9 aa, Influenza virus
LNNKMEDGF

SEQ ID NO: 347640 - protein, 9 aa, Influenza virus
GFLGVWTYN

SEQ ID NO: 347641 - protein, 9 aa, Influenza virus
FLDIWTYNA

SEQ ID NO: 347642 - protein, 9 aa, Influenza virus
SNVKNLYDR

SEQ ID NO: 347643 - protein, 9 aa, Influenza virus
NVKNLYDRV

SEQ ID NO: 347644 - protein, 9 aa, Influenza virus
VKNLYDRVR

SEQ ID NO: 347645 - protein, 9 aa, Influenza virus
NLYDKVRHQ

SEQ ID NO: 347646 - protein, 9 aa, Influenza virus
CMDSVRNGT

SEQ ID NO: 347647 - protein, 9 aa, Influenza virus
MDSVRNGTY

SEQ ID NO: 347648 - protein, 9 aa, Influenza virus
ILSVYSTVA

SEQ ID NO: 347649 - protein, 9 aa, Influenza virus
LSVYSTVAS

SEQ ID NO: 347650 - protein, 9 aa, Influenza virus
SVYSTVASS

SEQ ID NO: 347651 - protein, 9 aa, Influenza virus
AGLSLWMCF

SEQ ID NO: 347652 - protein, 9 aa, Influenza virus
GLSLWMCFN

SEQ ID NO: 347653 - protein, 9 aa, Influenza virus
YHANNSTEH

SEQ ID NO: 347654 - protein, 9 aa, Influenza virus
HANNSTERV

SEQ ID NO: 347655 - protein, 9 aa, Influenza virus
ANNSTEHVD

SEQ ID NO: 347656 - protein, 9 aa, Influenza virus
NNSTEHVDT

SEQ ID NO: 347657 - protein, 9 aa, Influenza virus
NSTEHVDTI

SEQ ID NO: 347658 - protein, 9 aa, Influenza virus
ERVDTIMEK

SEQ ID NO: 347659 - protein, 9 aa, Influenza virus
DILEKKHNG

SEQ ID NO: 347660 - protein, 9 aa, Influenza virus
LEGVKPLIL

SEQ ID NO: 347661 - protein, 9 aa, Influenza virus
GVKPLILRN

SEQ ID NO: 347662 - protein, 9 aa, Influenza virus
VKPLILRNC

SEQ ID NO: 347663 - protein, 9 aa, Influenza virus
FRDYEELKH

SEQ ID NO: 347664 - protein, 9 aa, Influenza virus
ELKHLLSRT

SEQ ID NO: 347665 - protein, 9 aa, Influenza virus
THISVGTST

SEQ ID NO: 347666 - protein, 9 aa, Influenza virus
AYKIIKKGD

SEQ ID NO: 347667 - protein, 9 aa, Influenza virus
YKIVKTGDS

SEQ ID NO: 347668 - protein, 9 aa, Influenza virus
CQTPMGAVN

SEQ ID NO: 347669 - protein, 9 aa, Influenza virus
QTPMGAVNS

SEQ ID NO: 347670 - protein, 9 aa, Influenza virus
TPMGAVNSS

SEQ ID NO: 347671 - protein, 9 aa, Influenza virus
MGAVNSSMP

SEQ ID NO: 347672 - protein, 9 aa, Influenza virus
WYGYHHSKE

SEQ ID NO: 347673 - protein, 9 aa, Influenza virus
GYHHSKEQG

SEQ ID NO: 347674 - protein, 9 aa, Influenza virus
RHSNEQGSG

SEQ ID NO: 347675 - protein, 9 aa, Influenza virus
MDGVTNKVN

SEQ ID NO: 347676 - protein, 9 aa, Influenza virus
DKMNTRFEA

SEQ ID NO: 347677 - protein, 9 aa, Influenza virus
CMDSVRNGT

SEQ ID NO: 347678 - protein, 9 aa, Influenza virus
MDSVRNGTY

SEQ ID NO: 347679 - protein, 9 aa, Influenza virus
SIRNGTYSY

SEQ ID NO: 347680 - protein, 9 aa, Influenza virus
NGTYDYPRY

SEQ ID NO: 347681 - protein, 9 aa, Influenza virus
YSTVVSSLA

SEQ ID NO: 347682 - protein, 9 aa, Influenza virus
STVVSSLAL

SEQ ID NO: 347683 - protein, 9 aa, Influenza virus
TVVSSLALA

SEQ ID NO: 347684 - protein, 9 aa, Influenza virus
VVSSLALAI

SEQ ID NO: 347685 - protein, 9 aa, Influenza virus
VSSLALAIM

SEQ ID NO: 347686 - protein, 9 aa, Influenza virus
AGLSLWMCF

SEQ ID NO: 347687 - protein, 9 aa, Influenza virus
HSKDNGIRI

SEQ ID NO: 347688 - protein, 9 aa, Influenza virus
DVFAIREPF

SEQ ID NO: 347689 - protein, 9 aa, Influenza virus
FVTREPFIS

SEQ ID NO: 347690 - protein, 9 aa, Influenza virus
APFISCSYL

SEQ ID NO: 347691 - protein, 9 aa, Influenza virus
PFISCSYLE

SEQ ID NO: 347692 - protein, 9 aa, Influenza virus
FISCSYLEC

SEQ ID NO: 347693 - protein, 9 aa, Influenza virus
KHSNGTAKD

SEQ ID NO: 347694 - protein, 9 aa, Influenza virus
HSNGTAKDR

SEQ ID NO: 347695 - protein, 9 aa, Influenza virus
SNGTAKDRS

SEQ ID NO: 347696 - protein, 9 aa, Influenza virus
NGTAKDRSP

SEQ ID NO: 347697 - protein, 9 aa, Influenza virus
KDRSPQRTL

SEQ ID NO: 347698 - protein, 9 aa, Influenza virus
SPHRSLMSC

SEQ ID NO: 347699 - protein, 9 aa, Influenza virus
PHRSLMSCP

SEQ ID NO: 347700 - protein, 9 aa, Influenza virus
RSLMSCPVG

SEQ ID NO: 347701 - protein, 9 aa, Influenza virus
PVGVAPSPY

SEQ ID NO: 347702 - protein, 9 aa, Influenza virus
ASACHDGAS

SEQ ID NO: 347703 - protein, 9 aa, Influenza virus
SACHDGASW

SEQ ID NO: 347704 - protein, 9 aa, Influenza virus
ACHDGASWL

SEQ ID NO: 347705 - protein, 9 aa, Influenza virus
CHDGASWLT

SEQ ID NO: 347706 - protein, 9 aa, Influenza virus
HDGASWLTI

SEQ ID NO: 347707 - protein, 9 aa, Influenza virus
ISGPDDGAV

SEQ ID NO: 347708 - protein, 9 aa, Influenza virus
PDDGAVAVL

SEQ ID NO: 347709 - protein, 9 aa, Influenza virus
DDGAVAVLK

SEQ ID NO: 347710 - protein, 9 aa, Influenza virus
GAVAVLKYK

SEQ ID NO: 347711 - protein, 9 aa, Influenza virus
KYNGLITDT

SEQ ID NO: 347712 - protein, 9 aa, Influenza virus
YNGLITDTI

SEQ ID NO: 347713 - protein, 9 aa, Influenza virus
GVITDTIKS

SEQ ID NO: 347714 - protein, 9 aa, Influenza virus
NVLRTQESE

SEQ ID NO: 347715 - protein, 9 aa, Influenza virus
CSCYPNAGE

SEQ ID NO: 347716 - protein, 9 aa, Influenza virus
NRPWVSFTQ

SEQ ID NO: 347717 - protein, 9 aa, Influenza virus
MGYICSGVF

SEQ ID NO: 347718 - protein, 9 aa, Influenza virus
ICSGFFGDN

SEQ ID NO: 347719 - protein, 9 aa, Influenza virus
CSGFFGDNP

SEQ ID NO: 347720 - protein, 9 aa, Influenza virus
SGFFGDNPR

SEQ ID NO: 347721 - protein, 9 aa, Influenza virus
GFFGDNPRP

SEQ ID NO: 347722 - protein, 9 aa, Influenza virus
FGDNPRPDD

SEQ ID NO: 347723 - protein, 9 aa, Influenza virus
GDNPRPDDG

SEQ ID NO: 347724 - protein, 9 aa, Influenza virus
GIKGFSFRY

SEQ ID NO: 347725 - protein, 9 aa, Influenza virus
IKGFSFRYG

SEQ ID NO: 347726 - protein, 9 aa, Influenza virus
KGFSYKYGN

SEQ ID NO: 347727 - protein, 9 aa, Influenza virus
GFSYKYGNG

SEQ ID NO: 347728 - protein, 9 aa, Influenza virus
YKYGNGVWI

SEQ ID NO: 347729 - protein, 9 aa, Influenza virus
AWIGRTKST

SEQ ID NO: 347730 - protein, 9 aa, Influenza virus
VTDWSGYSG

SEQ ID NO: 347731 - protein, 9 aa, Influenza virus
TGVDCIRPC

SEQ ID NO: 347732 - protein, 9 aa, Influenza virus
DCIKPCFWV

SEQ ID NO: 347733 - protein, 9 aa, Influenza virus
IELIRGRPK

SEQ ID NO: 347734 - protein, 9 aa, Influenza virus
TIWTSGSII

SEQ ID NO: 347735 - protein, 9 aa, Influenza virus
IWTSGSIIS

SEQ ID NO: 347736 - protein, 9 aa, Influenza virus
DWSWPDGAE

SEQ ID NO: 347737 - protein, 9 aa, Influenza virus
WPDRAELPF

SEQ ID NO: 347738 - protein, 9 aa, Influenza virus
SDQICIGHH

SEQ ID NO: 347739 - protein, 9 aa, Influenza virus
EQVDTIREK

SEQ ID NO: 347740 - protein, 9 aa, Influenza virus
QVDTIVEKN

SEQ ID NO: 347741 - protein, 9 aa, Influenza virus
VDTIREKNV

SEQ ID NO: 347742 - protein, 9 aa, Influenza virus
DTIMEKSVT

SEQ ID NO: 347743 - protein, 9 aa, Influenza virus
TTMEKNVTV

SEQ ID NO: 347744 - protein, 9 aa, Influenza virus
IMEKIVTVT

SEQ ID NO: 347745 - protein, 9 aa, Influenza virus
KNVTVTHTQ

SEQ ID NO: 347746 - protein, 9 aa, Influenza virus
NVTVTQAQD

SEQ ID NO: 347747 - protein, 9 aa, Influenza virus
WSYIVEKAN

SEQ ID NO: 347748 - protein, 9 aa, Influenza virus
SYIVEKANP

SEQ ID NO: 347749 - protein, 9 aa, Influenza virus
FFRNIVWLI

SEQ ID NO: 347750 - protein, 9 aa, Influenza virus
GTSTLNHRS

SEQ ID NO: 347751 - protein, 9 aa, Influenza virus
IATRSKVNG

SEQ ID NO: 347752 - protein, 9 aa, Influenza virus
ATRSKVNGQ

SEQ ID NO: 347753 - protein, 9 aa, Influenza virus
RLKVNGQSG

SEQ ID NO: 347754 - protein, 9 aa, Influenza virus
PEYAYRIIK

SEQ ID NO: 347755 - protein, 9 aa, Influenza virus
NEQGGGYAA

SEQ ID NO: 347756 - protein, 9 aa, Influenza virus
EHGSGYAAD

SEQ ID NO: 347757 - protein, 9 aa, Influenza virus
GGGYAADKE

SEQ ID NO: 347758 - protein, 9 aa, Influenza virus
SGYGEDNES

SEQ ID NO: 347759 - protein, 9 aa, Influenza virus
AADKDSTQK

SEQ ID NO: 347760 - protein, 9 aa, Influenza virus
ADKDSTQKA

SEQ ID NO: 347761 - protein, 9 aa, Influenza virus
ESTQKAVDG

SEQ ID NO: 347762 - protein, 9 aa, Influenza virus
STQKAVDGI

SEQ ID NO: 347763 - protein, 9 aa, Influenza virus
TQKAVDGIT

SEQ ID NO: 347764 - protein, 9 aa, Influenza virus
AEFLVLMEN

SEQ ID NO: 347765 - protein, 9 aa, Influenza virus
MVNERTLDF

SEQ ID NO: 347766 - protein, 9 aa, Influenza virus
NLYDKVRFQ

SEQ ID NO: 347767 - protein, 9 aa, Influenza virus
LYDRVRLQL

SEQ ID NO: 347768 - protein, 9 aa, Influenza virus
VRLQLRNNA

SEQ ID NO: 347769 - protein, 9 aa, Influenza virus
FKFYHKCDN

SEQ ID NO: 347770 - protein, 9 aa, Influenza virus
ECIESVRNG

SEQ ID NO: 347771 - protein, 9 aa, Influenza virus
ESVRNGTYK

SEQ ID NO: 347772 - protein, 9 aa, Influenza virus
SVRNGTYKY

SEQ ID NO: 347773 - protein, 9 aa, Influenza virus
ILTIYSTVA

SEQ ID NO: 347774 - protein, 9 aa, Influenza virus
LTIYSTVAS

SEQ ID NO: 347775 - protein, 9 aa, Influenza virus
TIYSTVASS

SEQ ID NO: 347776 - protein, 9 aa, Influenza virus
VVSSLALAI

SEQ ID NO: 347777 - protein, 9 aa, Influenza virus
LAIIIAGLS

SEQ ID NO: 347778 - protein, 9 aa, Influenza virus
AIIIAGLSF

SEQ ID NO: 347779 - protein, 9 aa, Influenza virus
IIIAGLSFW

SEQ ID NO: 347780 - protein, 9 aa, Influenza virus
VAGLSLWMC

SEQ ID NO: 347781 - protein, 9 aa, Influenza virus
IITVGSVSL

SEQ ID NO: 347782 - protein, 9 aa, Influenza virus
YKNWSKPQC

SEQ ID NO: 347783 - protein, 9 aa, Influenza virus
KPQCKITGF

SEQ ID NO: 347784 - protein, 9 aa, Influenza virus
PQCKITGFA

SEQ ID NO: 347785 - protein, 9 aa, Influenza virus
QCKITGFAP

SEQ ID NO: 347786 - protein, 9 aa, Influenza virus
CKITGFAPF

SEQ ID NO: 347787 - protein, 9 aa, Influenza virus
QLSAGGDIW

SEQ ID NO: 347788 - protein, 9 aa, Influenza virus
LGQGTTLDS

SEQ ID NO: 347789 - protein, 9 aa, Influenza virus
PYRTLLMNE

SEQ ID NO: 347790 - protein, 9 aa, Influenza virus
RSSCHDGKA

SEQ ID NO: 347791 - protein, 9 aa, Influenza virus
HDGRAWLHI

SEQ ID NO: 347792 - protein, 9 aa, Influenza virus
DGRAWLHIC

SEQ ID NO: 347793 - protein, 9 aa, Influenza virus
GKAWLHVCI

SEQ ID NO: 347794 - protein, 9 aa, Influenza virus
TGDDRKATA

SEQ ID NO: 347795 - protein, 9 aa, Influenza virus
GHDKNATAS

SEQ ID NO: 347796 - protein, 9 aa, Influenza virus
TDGSASRKA

SEQ ID NO: 347797 - protein, 9 aa, Influenza virus
VPPLGSAQA

SEQ ID NO: 347798 - protein, 9 aa, Influenza virus
PPLGSAQAT

SEQ ID NO: 347799 - protein, 9 aa, Influenza virus
PLGSAQATE

SEQ ID NO: 347800 - protein, 9 aa, Influenza virus
SSSNCRDSN

SEQ ID NO: 347801 - protein, 9 aa, Influenza virus
SSNCRDSNN

SEQ ID NO: 347802 - protein, 9 aa, Influenza virus
NCRDSNNER

SEQ ID NO: 347803 - protein, 9 aa, Influenza virus
GHPGVKGWA

SEQ ID NO: 347804 - protein, 9 aa, Influenza virus
GVKGWAFDS

SEQ ID NO: 347805 - protein, 9 aa, Influenza virus
GRTISEDSR

SEQ ID NO: 347806 - protein, 9 aa, Influenza virus
SGYETFRII

SEQ ID NO: 347807 - protein, 9 aa, Influenza virus
NCINRCFYV

SEQ ID NO: 347808 - protein, 9 aa, Influenza virus
DGANINFMS

SEQ ID NO: 347809 - protein, 9 aa, Influenza virus
GKSDRICIG

SEQ ID NO: 347810 - protein, 9 aa, Influenza virus
NSTTQIDTI

SEQ ID NO: 347811 - protein, 9 aa, Influenza virus
VNTILEKNV

SEQ ID NO: 347812 - protein, 9 aa, Influenza virus
NTILEKNVT

SEQ ID NO: 347813 - protein, 9 aa, Influenza virus
THSVELLED

SEQ ID NO: 347814 - protein, 9 aa, Influenza virus
KGWILGNPR

SEQ ID NO: 347815 - protein, 9 aa, Influenza virus
QSWSCIVER

SEQ ID NO: 347816 - protein, 9 aa, Influenza virus
SWSCIVERP

SEQ ID NO: 347817 - protein, 9 aa, Influenza virus
AQYGICYPG

SEQ ID NO: 347818 - protein, 9 aa, Influenza virus
PVLYFWGVH

SEQ ID NO: 347819 - protein, 9 aa, Influenza virus
KARIDYYWS

SEQ ID NO: 347820 - protein, 9 aa, Influenza virus
RIDYYWSFL

SEQ ID NO: 347821 - protein, 9 aa, Influenza virus
WSVLQPGET

SEQ ID NO: 347822 - protein, 9 aa, Influenza virus
SMLKPGETL

SEQ ID NO: 347823 - protein, 9 aa, Influenza virus
MLKPGETLN

SEQ ID NO: 347824 - protein, 9 aa, Influenza virus
LVAPWYAYR

SEQ ID NO: 347825 - protein, 9 aa, Influenza virus
RTFQNVSPL

SEQ ID NO: 347826 - protein, 9 aa, Influenza virus
FQNVSPLWV

SEQ ID NO: 347827 - protein, 9 aa, Influenza virus
QNVSPLWVG

SEQ ID NO: 347828 - protein, 9 aa, Influenza virus
WNGECPKYV

SEQ ID NO: 347829 - protein, 9 aa, Influenza virus
NSSVSRMST

SEQ ID NO: 347830 - protein, 9 aa, Influenza virus
KMNTQFETV

SEQ ID NO: 347831 - protein, 9 aa, Influenza virus
NLNKRMENG

SEQ ID NO: 347832 - protein, 9 aa, Influenza virus
LNKRMEDGL

SEQ ID NO: 347833 - protein, 9 aa, Influenza virus
NKRMEDGLL

SEQ ID NO: 347834 - protein, 9 aa, Influenza virus
DGLLDVWTY

SEQ ID NO: 347835 - protein, 9 aa, Influenza virus
LDQHDANVK

SEQ ID NO: 347836 - protein, 9 aa, Influenza virus
SQLKDNAND

SEQ ID NO: 347837 - protein, 9 aa, Influenza virus
LRDNAMILG

SEQ ID NO: 347838 - protein, 9 aa, Influenza virus
RDNAMILGN

SEQ ID NO: 347839 - protein, 9 aa, Influenza virus
SIKNGTYDY

SEQ ID NO: 347840 - protein, 9 aa, Influenza virus
ENGTYDYPK

SEQ ID NO: 347841 - protein, 9 aa, Influenza virus
IGVYQILAI

SEQ ID NO: 347842 - protein, 9 aa, Influenza virus
CLNGSMQCR

SEQ ID NO: 347843 - protein, 9 aa, Influenza virus
GSMQCRVCI

SEQ ID NO: 347844 - protein, 9 aa, Influenza virus
SRGYKMNIQ

SEQ ID NO: 347845 - protein, 9 aa, Influenza virus
RGYKMNIQI

SEQ ID NO: 347846 - protein, 9 aa, Influenza virus
GYKMNTKIL

SEQ ID NO: 347847 - protein, 9 aa, Influenza virus
NGAKVNTLT

SEQ ID NO: 347848 - protein, 9 aa, Influenza virus
VNATETVEN

SEQ ID NO: 347849 - protein, 9 aa, Influenza virus
ALITWGIHH

SEQ ID NO: 347850 - protein, 9 aa, Influenza virus
GQTGRIDFH

SEQ ID NO: 347851 - protein, 9 aa, Influenza virus
QFGRIDFHW

SEQ ID NO: 347852 - protein, 9 aa, Influenza virus
AFIAPDRAT

SEQ ID NO: 347853 - protein, 9 aa, Influenza virus
FIAPDRATF

SEQ ID NO: 347854 - protein, 9 aa, Influenza virus
LIDGWYGFK

SEQ ID NO: 347855 - protein, 9 aa, Influenza virus
IDGWYGFKH

SEQ ID NO: 347856 - protein, 9 aa, Influenza virus
WYGYKHQNA

SEQ ID NO: 347857 - protein, 9 aa, Influenza virus
YGYKHQNAQ

SEQ ID NO: 347858 - protein, 9 aa, Influenza virus
GYKHQNAQG

SEQ ID NO: 347859 - protein, 9 aa, Influenza virus
YKHQNAQGE

SEQ ID NO: 347860 - protein, 9 aa, Influenza virus
KTNQQFELD

SEQ ID NO: 347861 - protein, 9 aa, Influenza virus
QQIGNVINC

SEQ ID NO: 347862 - protein, 9 aa, Influenza virus
AELLVAIEN

SEQ ID NO: 347863 - protein, 9 aa, Influenza virus
EFLVAMENQ

SEQ ID NO: 347864 - protein, 9 aa, Influenza virus
FLVAMENQH

SEQ ID NO: 347865 - protein, 9 aa, Influenza virus
SEMKKLYER

SEQ ID NO: 347866 - protein, 9 aa, Influenza virus
EMKKLYERV

SEQ ID NO: 347867 - protein, 9 aa, Influenza virus
VKRLLRENA

SEQ ID NO: 347868 - protein, 9 aa, Influenza virus
KRLLRENAE

SEQ ID NO: 347869 - protein, 9 aa, Influenza virus
ASIRNNTYN

SEQ ID NO: 347870 - protein, 9 aa, Influenza virus
YREEAIQNR

SEQ ID NO: 347871 - protein, 9 aa, Influenza virus
NGYKDVILW

SEQ ID NO: 347872 - protein, 9 aa, Influenza virus
SFGASCFTL

SEQ ID NO: 347873 - protein, 9 aa, Influenza virus
FGASCLILL

SEQ ID NO: 347874 - protein, 9 aa, Influenza virus
GASCLILLA

SEQ ID NO: 347875 - protein, 9 aa, Influenza virus
ARGDKICLG

SEQ ID NO: 347876 - protein, 9 aa, Influenza virus
CGLLGTVTG

SEQ ID NO: 347877 - protein, 9 aa, Influenza virus
GLLGTVTGP

SEQ ID NO: 347878 - protein, 9 aa, Influenza virus
LLGTVTGPP

SEQ ID NO: 347879 - protein, 9 aa, Influenza virus
LIIERREGS

SEQ ID NO: 347880 - protein, 9 aa, Influenza virus
IIERREGSD

SEQ ID NO: 347881 - protein, 9 aa, Influenza virus
EGSDVCYPG

SEQ ID NO: 347882 - protein, 9 aa, Influenza virus
CYPGGFTNE

SEQ ID NO: 347883 - protein, 9 aa, Influenza virus
YPGKFANEE

SEQ ID NO: 347884 - protein, 9 aa, Influenza virus
ANEESLRQI

SEQ ID NO: 347885 - protein, 9 aa, Influenza virus
NEEPLRQIL

SEQ ID NO: 347886 - protein, 9 aa, Influenza virus
EESLRQVLR

SEQ ID NO: 347887 - protein, 9 aa, Influenza virus
QIIRRSGGI

SEQ ID NO: 347888 - protein, 9 aa, Influenza virus
RKSGGIGKE

SEQ ID NO: 347889 - protein, 9 aa, Influenza virus
TGSSFYAEM

SEQ ID NO: 347890 - protein, 9 aa, Influenza virus
ALVIWGVHH

SEQ ID NO: 347891 - protein, 9 aa, Influenza virus
LVIWGVHHS

SEQ ID NO: 347892 - protein, 9 aa, Influenza virus
DEQTKLYGS

SEQ ID NO: 347893 - protein, 9 aa, Influenza virus
LYGSGSKLI

SEQ ID NO: 347894 - protein, 9 aa, Influenza virus
PGARRIDFN

SEQ ID NO: 347895 - protein, 9 aa, Influenza virus
RIDFNWLLL

SEQ ID NO: 347896 - protein, 9 aa, Influenza virus
EGTIVSSLP

SEQ ID NO: 347897 - protein, 9 aa, Influenza virus
LPFQSINPR

SEQ ID NO: 347898 - protein, 9 aa, Influenza virus
AVGKCPKYV

SEQ ID NO: 347899 - protein, 9 aa, Influenza virus
CPKYVKQES

SEQ ID NO: 347900 - protein, 9 aa, Influenza virus
VKQKSILLA

SEQ ID NO: 347901 - protein, 9 aa, Influenza virus
TGMRNIPEK

SEQ ID NO: 347902 - protein, 9 aa, Influenza virus
GMRNIPEKP

SEQ ID NO: 347903 - protein, 9 aa, Influenza virus
MRNIPEKPK

SEQ ID NO: 347904 - protein, 9 aa, Influenza virus
NHLIGKTNQ

SEQ ID NO: 347905 - protein, 9 aa, Influenza virus
HLIGKTNQQ

SEQ ID NO: 347906 - protein, 9 aa, Influenza virus
IGRTNQQFE

SEQ ID NO: 347907 - protein, 9 aa, Influenza virus
GRTNQQFEL

SEQ ID NO: 347908 - protein, 9 aa, Influenza virus
NQQFELIDH

SEQ ID NO: 347909 - protein, 9 aa, Influenza virus
QQFELIDSE

SEQ ID NO: 347910 - protein, 9 aa, Influenza virus
FGLIDNEFN

SEQ ID NO: 347911 - protein, 9 aa, Influenza virus
ELIDSEFNE

SEQ ID NO: 347912 - protein, 9 aa, Influenza virus
NEFTEIEQQ

SEQ ID NO: 347913 - protein, 9 aa, Influenza virus
WTRDSITEV

SEQ ID NO: 347914 - protein, 9 aa, Influenza virus
TRDSITEVW

SEQ ID NO: 347915 - protein, 9 aa, Influenza virus
RDSITEVWS

SEQ ID NO: 347916 - protein, 9 aa, Influenza virus
IDLADSEMK

SEQ ID NO: 347917 - protein, 9 aa, Influenza virus
DLADSEMKK

SEQ ID NO: 347918 - protein, 9 aa, Influenza virus
LTDSEMNKL

SEQ ID NO: 347919 - protein, 9 aa, Influenza virus
ADSEMKKLY

SEQ ID NO: 347920 - protein, 9 aa, Influenza virus
MKKLYERVR

SEQ ID NO: 347921 - protein, 9 aa, Influenza virus
RNNTYDHSR

SEQ ID NO: 347922 - protein, 9 aa, Influenza virus
NNTYDHSRY

SEQ ID NO: 347923 - protein, 9 aa, Influenza virus
NTYDHSRYR

SEQ ID NO: 347924 - protein, 9 aa, Influenza virus
HTQYRTGSL

SEQ ID NO: 347925 - protein, 9 aa, Influenza virus
QYRTGSLQN

SEQ ID NO: 347926 - protein, 9 aa, Influenza virus
SCFILLAIV

SEQ ID NO: 347927 - protein, 9 aa, Influenza virus
LLAIAMGLG

SEQ ID NO: 347928 - protein, 9 aa, Influenza virus
  MOD_RES (3)..(3): Leu or Ile
LAXVMGLVF

SEQ ID NO: 347929 - protein, 9 aa, Influenza virus
AIAMGFVFI

SEQ ID NO: 347930 - protein, 9 aa, Influenza virus
AMGLVFICM

SEQ ID NO: 347931 - protein, 9 aa, Influenza virus
ICMKNGNMQ

SEQ ID NO: 347932 - protein, 9 aa, Influenza virus
GSISLTIAA

SEQ ID NO: 347933 - protein, 9 aa, Influenza virus
CFLMQITIL

SEQ ID NO: 347934 - protein, 9 aa, Influenza virus
ERNVTETLY

SEQ ID NO: 347935 - protein, 9 aa, Influenza virus
ITKIVYLNS

SEQ ID NO: 347936 - protein, 9 aa, Influenza virus
TEIVYLNHT

SEQ ID NO: 347937 - protein, 9 aa, Influenza virus
KSWSKPQCQ

SEQ ID NO: 347938 - protein, 9 aa, Influenza virus
WSKPQCRIT

SEQ ID NO: 347939 - protein, 9 aa, Influenza virus
SKPQCKITG

SEQ ID NO: 347940 - protein, 9 aa, Influenza virus
QCQIRGFAP

SEQ ID NO: 347941 - protein, 9 aa, Influenza virus
VRLSAGGDI

SEQ ID NO: 347942 - protein, 9 aa, Influenza virus
LSAGGNIWI

SEQ ID NO: 347943 - protein, 9 aa, Influenza virus
SASGDIWIT

SEQ ID NO: 347944 - protein, 9 aa, Influenza virus
AGGNIWITR

SEQ ID NO: 347945 - protein, 9 aa, Influenza virus
SGDIWITRE

SEQ ID NO: 347946 - protein, 9 aa, Influenza virus
REPYVSCSP

SEQ ID NO: 347947 - protein, 9 aa, Influenza virus
NRCYQFALG

SEQ ID NO: 347948 - protein, 9 aa, Influenza virus
GQGTTLNNK

SEQ ID NO: 347949 - protein, 9 aa, Influenza virus
QGTTLNNKH

SEQ ID NO: 347950 - protein, 9 aa, Influenza virus
GTTLNNKHS

SEQ ID NO: 347951 - protein, 9 aa, Influenza virus
TTLNNKHSN

SEQ ID NO: 347952 - protein, 9 aa, Influenza virus
TLNNKHSNG

SEQ ID NO: 347953 - protein, 9 aa, Influenza virus
LNNKHSNGT

SEQ ID NO: 347954 - protein, 9 aa, Influenza virus
IPHRTLLMS

SEQ ID NO: 347955 - protein, 9 aa, Influenza virus
HVCVTGDDG

SEQ ID NO: 347956 - protein, 9 aa, Influenza virus
VCVTGDDGN

SEQ ID NO: 347957 - protein, 9 aa, Influenza virus
CVCINGSCI

SEQ ID NO: 347958 - protein, 9 aa, Influenza virus
VCINGSCIV

SEQ ID NO: 347959 - protein, 9 aa, Influenza virus
CINGSCIVV

SEQ ID NO: 347960 - protein, 9 aa, Influenza virus
INGSCIVVM

SEQ ID NO: 347961 - protein, 9 aa, Influenza virus
DGSASRKAD

SEQ ID NO: 347962 - protein, 9 aa, Influenza virus
GSASRKADT

SEQ ID NO: 347963 - protein, 9 aa, Influenza virus
EGKVVHISP

SEQ ID NO: 347964 - protein, 9 aa, Influenza virus
GKVVHISPL

SEQ ID NO: 347965 - protein, 9 aa, Influenza virus
KVVHISPLS

SEQ ID NO: 347966 - protein, 9 aa, Influenza virus
VVHISPLSG

SEQ ID NO: 347967 - protein, 9 aa, Influenza virus
PRNDDSSSN

SEQ ID NO: 347968 - protein, 9 aa, Influenza virus
RNEDSSSNS

SEQ ID NO: 347969 - protein, 9 aa, Influenza virus
NDDSSSNSN

SEQ ID NO: 347970 - protein, 9 aa, Influenza virus
DDSSSNSNC

SEQ ID NO: 347971 - protein, 9 aa, Influenza virus
SNCKDPNEE

SEQ ID NO: 347972 - protein, 9 aa, Influenza virus
DPNEERGSP

SEQ ID NO: 347973 - protein, 9 aa, Influenza virus
PNEERGSPG

SEQ ID NO: 347974 - protein, 9 aa, Influenza virus
NEERGSPGV

SEQ ID NO: 347975 - protein, 9 aa, Influenza virus
EERGSPGVK

SEQ ID NO: 347976 - protein, 9 aa, Influenza virus
KGWAFDYGS

SEQ ID NO: 347977 - protein, 9 aa, Influenza virus
GWAFDNGND

SEQ ID NO: 347978 - protein, 9 aa, Influenza virus
NGNDVWMGR

SEQ ID NO: 347979 - protein, 9 aa, Influenza virus
TFKVIGGWT

SEQ ID NO: 347980 - protein, 9 aa, Influenza virus
VIDGWTTAN

SEQ ID NO: 347981 - protein, 9 aa, Influenza virus
IDGWTTANS

SEQ ID NO: 347982 - protein, 9 aa, Influenza virus
DGWTTANSK

SEQ ID NO: 347983 - protein, 9 aa, Influenza virus
QVMVDNNNW

SEQ ID NO: 347984 - protein, 9 aa, Influenza virus
IVGNNNWSG

SEQ ID NO: 347985 - protein, 9 aa, Influenza virus
DNNNRSGYS

SEQ ID NO: 347986 - protein, 9 aa, Influenza virus
LVRGRPQET

SEQ ID NO: 347987 - protein, 9 aa, Influenza virus
DGANINFMH

SEQ ID NO: 347988 - protein, 9 aa, Influenza virus
HHAVTNGTK

SEQ ID NO: 347989 - protein, 9 aa, Influenza virus
HAVTNGTKV

SEQ ID NO: 347990 - protein, 9 aa, Influenza virus
VNTLAERGV

SEQ ID NO: 347991 - protein, 9 aa, Influenza virus
NTLAERGVE

SEQ ID NO: 347992 - protein, 9 aa, Influenza virus
TGRGIEVVN

SEQ ID NO: 347993 - protein, 9 aa, Influenza virus
GRGIEVVNA

SEQ ID NO: 347994 - protein, 9 aa, Influenza virus
VNATETVEN

SEQ ID NO: 347995 - protein, 9 aa, Influenza virus
TDMGQCGLL

SEQ ID NO: 347996 - protein, 9 aa, Influenza virus
GQCGLLGII

SEQ ID NO: 347997 - protein, 9 aa, Influenza virus
CGLLGIITG

SEQ ID NO: 347998 - protein, 9 aa, Influenza virus
GLLGIITGP

SEQ ID NO: 347999 - protein, 9 aa, Influenza virus
LLGIITGPP

SEQ ID NO: 348000 - protein, 9 aa, Influenza virus
LGIITGPPQ

SEQ ID NO: 348001 - protein, 9 aa, Influenza virus
GIITGPPQC

SEQ ID NO: 348002 - protein, 9 aa, Influenza virus
IITGPPQCD

SEQ ID NO: 348003 - protein, 9 aa, Influenza virus
DICYPGKFT

SEQ ID NO: 348004 - protein, 9 aa, Influenza virus
ICYPGKFTN

SEQ ID NO: 348005 - protein, 9 aa, Influenza virus
QILRGSGGV

SEQ ID NO: 348006 - protein, 9 aa, Influenza virus
GFTYSGVRT

SEQ ID NO: 348007 - protein, 9 aa, Influenza virus
GSSSFYAEM

SEQ ID NO: 348008 - protein, 9 aa, Influenza virus
KWLLSNSNN

SEQ ID NO: 348009 - protein, 9 aa, Influenza virus
RLYGSENKL

SEQ ID NO: 348010 - protein, 9 aa, Influenza virus
LYGNGAKLI

SEQ ID NO: 348011 - protein, 9 aa, Influenza virus
YGSENKLIT

SEQ ID NO: 348012 - protein, 9 aa, Influenza virus
GNGNKLITV

SEQ ID NO: 348013 - protein, 9 aa, Influenza virus
SYNYHQSFV

SEQ ID NO: 348014 - protein, 9 aa, Influenza virus
YNYHQSFVP

SEQ ID NO: 348015 - protein, 9 aa, Influenza virus
QSFTPSPGT

SEQ ID NO: 348016 - protein, 9 aa, Influenza virus
SFVPSPGSR

SEQ ID NO: 348017 - protein, 9 aa, Influenza virus
QVDGQSGRI

SEQ ID NO: 348018 - protein, 9 aa, Influenza virus
VNGQTGRID

SEQ ID NO: 348019 - protein, 9 aa, Influenza virus
DGQSGRIDF

SEQ ID NO: 348020 - protein, 9 aa, Influenza virus
SGRIDFHWM

SEQ ID NO: 348021 - protein, 9 aa, Influenza virus
FHWMMLNPN

SEQ ID NO: 348022 - protein, 9 aa, Influenza virus
WLMLNSNDT

SEQ ID NO: 348023 - protein, 9 aa, Influenza virus
MLNPNDTVI

SEQ ID NO: 348024 - protein, 9 aa, Influenza virus
LNPNGTITF

SEQ ID NO: 348025 - protein, 9 aa, Influenza virus
NDTVTFNFN

SEQ ID NO: 348026 - protein, 9 aa, Influenza virus
DTVTFNFNG

SEQ ID NO: 348027 - protein, 9 aa, Influenza virus
FTFNGSFIA

SEQ ID NO: 348028 - protein, 9 aa, Influenza virus
VAPDRVSFF

SEQ ID NO: 348029 - protein, 9 aa, Influenza virus
GGTIASSLP

SEQ ID NO: 348030 - protein, 9 aa, Influenza virus
GTIASSLPF

SEQ ID NO: 348031 - protein, 9 aa, Influenza virus
TIASSLPFQ

SEQ ID NO: 348032 - protein, 9 aa, Influenza virus
IASSLPFQN

SEQ ID NO: 348033 - protein, 9 aa, Influenza virus
ASSLPFQNI

SEQ ID NO: 348034 - protein, 9 aa, Influenza virus
NLPFQNVNS

SEQ ID NO: 348035 - protein, 9 aa, Influenza virus
PFQNINSRV

SEQ ID NO: 348036 - protein, 9 aa, Influenza virus
LGKCPRYVK

SEQ ID NO: 348037 - protein, 9 aa, Influenza virus
MKNVPEIPR

SEQ ID NO: 348038 - protein, 9 aa, Influenza virus
KKRGLFGAI

SEQ ID NO: 348039 - protein, 9 aa, Influenza virus
AYQKQMTRG

SEQ ID NO: 348040 - protein, 9 aa, Influenza virus
YQKQMTRGL

SEQ ID NO: 348041 - protein, 9 aa, Influenza virus
QKQMTRGLF

SEQ ID NO: 348042 - protein, 9 aa, Influenza virus
GKLNRFIEK

SEQ ID NO: 348043 - protein, 9 aa, Influenza virus
KLNRLIDRT

SEQ ID NO: 348044 - protein, 9 aa, Influenza virus
LNRFIEKTN

SEQ ID NO: 348045 - protein, 9 aa, Influenza virus
NRFIEKTNQ

SEQ ID NO: 348046 - protein, 9 aa, Influenza virus
RLIDRTNHQ

SEQ ID NO: 348047 - protein, 9 aa, Influenza virus
FIEKTNQQF

SEQ ID NO: 348048 - protein, 9 aa, Influenza virus
DRTNHQFEL

SEQ ID NO: 348049 - protein, 9 aa, Influenza virus
IDNEFNEVE

SEQ ID NO: 348050 - protein, 9 aa, Influenza virus
FNEVEKQIG

SEQ ID NO: 348051 - protein, 9 aa, Influenza virus
TEVERQIGN

SEQ ID NO: 348052 - protein, 9 aa, Influenza virus
TRDSITELW

SEQ ID NO: 348053 - protein, 9 aa, Influenza virus
RDSMTEVMV

SEQ ID NO: 348054 - protein, 9 aa, Influenza virus
DSMTEVMVV

SEQ ID NO: 348055 - protein, 9 aa, Influenza virus
AMTEIWSYN

SEQ ID NO: 348056 - protein, 9 aa, Influenza virus
NSEMNKLYE

SEQ ID NO: 348057 - protein, 9 aa, Influenza virus
NLYERVRKQ

SEQ ID NO: 348058 - protein, 9 aa, Influenza virus
TYREEAMQN

SEQ ID NO: 348059 - protein, 9 aa, Influenza virus
REEAMQNRV

SEQ ID NO: 348060 - protein, 9 aa, Influenza virus
EAMQNRVKI

SEQ ID NO: 348061 - protein, 9 aa, Influenza virus
QNRVKIDPV

SEQ ID NO: 348062 - protein, 9 aa, Influenza virus
NRVKIDPVK

SEQ ID NO: 348063 - protein, 9 aa, Influenza virus
RVKIDPVKL

SEQ ID NO: 348064 - protein, 9 aa, Influenza virus
NPVKLNSGY

SEQ ID NO: 348065 - protein, 9 aa, Influenza virus
VKLSNGYKD

SEQ ID NO: 348066 - protein, 9 aa, Influenza virus
SNGYKDVIL

SEQ ID NO: 348067 - protein, 9 aa, Influenza virus
ASCFIFLAI

SEQ ID NO: 348068 - protein, 9 aa, Influenza virus
GSVNTVLSI

SEQ ID NO: 348069 - protein, 9 aa, Influenza virus
SVNTVLSII

SEQ ID NO: 348070 - protein, 9 aa, Influenza virus
TVLSIIALL

SEQ ID NO: 348071 - protein, 9 aa, Influenza virus
ILSTKALLI

SEQ ID NO: 348072 - protein, 9 aa, Influenza virus
STKALLIGI

SEQ ID NO: 348073 - protein, 9 aa, Influenza virus
IIALLIGIG

SEQ ID NO: 348074 - protein, 9 aa, Influenza virus
IGIGNLIFN

SEQ ID NO: 348075 - protein, 9 aa, Influenza virus
GIGNLAFNA

SEQ ID NO: 348076 - protein, 9 aa, Influenza virus
IGNLIFNTV

SEQ ID NO: 348077 - protein, 9 aa, Influenza virus
LVFNTVIHG

SEQ ID NO: 348078 - protein, 9 aa, Influenza virus
VTYNNTVIN

SEQ ID NO: 348079 - protein, 9 aa, Influenza virus
YNNTVINNM

SEQ ID NO: 348080 - protein, 9 aa, Influenza virus
NHTTINNIT

SEQ ID NO: 348081 - protein, 9 aa, Influenza virus
NTVINNMTT

SEQ ID NO: 348082 - protein, 9 aa, Influenza virus
INNITNVVL

SEQ ID NO: 348083 - protein, 9 aa, Influenza virus
NNITTTITT

SEQ ID NO: 348084 - protein, 9 aa, Influenza virus
RLPLPLCPF

SEQ ID NO: 348085 - protein, 9 aa, Influenza virus
PLPLCPFKG

SEQ ID NO: 348086 - protein, 9 aa, Influenza virus
DVLVTREPY

SEQ ID NO: 348087 - protein, 9 aa, Influenza virus
AQGVLLGTK

SEQ ID NO: 348088 - protein, 9 aa, Influenza virus
QGVLLGTKH

SEQ ID NO: 348089 - protein, 9 aa, Influenza virus
GVLLGTKHS

SEQ ID NO: 348090 - protein, 9 aa, Influenza virus
VLLGTKHSN

SEQ ID NO: 348091 - protein, 9 aa, Influenza virus
HSNGTIKDK

SEQ ID NO: 348092 - protein, 9 aa, Influenza virus
EDRTPYRSL

SEQ ID NO: 348093 - protein, 9 aa, Influenza virus
SLIRFPVGT

SEQ ID NO: 348094 - protein, 9 aa, Influenza virus
LIRFPVGTA

SEQ ID NO: 348095 - protein, 9 aa, Influenza virus
IRFPVGTAP

SEQ ID NO: 348096 - protein, 9 aa, Influenza virus
FPIGTAPIL

SEQ ID NO: 348097 - protein, 9 aa, Influenza virus
PIGTAPILG

SEQ ID NO: 348098 - protein, 9 aa, Influenza virus
VGTAPVLGN

SEQ ID NO: 348099 - protein, 9 aa, Influenza virus
VLGNYKEIR

SEQ ID NO: 348100 - protein, 9 aa, Influenza virus
LGNYKEMCA

SEQ ID NO: 348101 - protein, 9 aa, Influenza virus
GNYREVCIA

SEQ ID NO: 348102 - protein, 9 aa, Influenza virus
NYKEIRIAW

SEQ ID NO: 348103 - protein, 9 aa, Influenza virus
YKEIRIAWS

SEQ ID NO: 348104 - protein, 9 aa, Influenza virus
REVCIAWSS

SEQ ID NO: 348105 - protein, 9 aa, Influenza virus
EIRIAWSSS

SEQ ID NO: 348106 - protein, 9 aa, Influenza virus
VCIAWSSSS

SEQ ID NO: 348107 - protein, 9 aa, Influenza virus
KEWMHVSMT

SEQ ID NO: 348108 - protein, 9 aa, Influenza virus
EWMHVCMAG

SEQ ID NO: 348109 - protein, 9 aa, Influenza virus
GRMSDSIKS

SEQ ID NO: 348110 - protein, 9 aa, Influenza virus
RMSDSIKSW

SEQ ID NO: 348111 - protein, 9 aa, Influenza virus
QESECQCLY

SEQ ID NO: 348112 - protein, 9 aa, Influenza virus
ESECQCLYG

SEQ ID NO: 348113 - protein, 9 aa, Influenza virus
AANSAHHRV

SEQ ID NO: 348114 - protein, 9 aa, Influenza virus
ANNADHRVY

SEQ ID NO: 348115 - protein, 9 aa, Influenza virus
NKADHRIYW

SEQ ID NO: 348116 - protein, 9 aa, Influenza virus
NADHRVYWI

SEQ ID NO: 348117 - protein, 9 aa, Influenza virus
RIYWIREGR

SEQ ID NO: 348118 - protein, 9 aa, Influenza virus
CSCYVDVDV

SEQ ID NO: 348119 - protein, 9 aa, Influenza virus
SCYVDVDVY

SEQ ID NO: 348120 - protein, 9 aa, Influenza virus
CYVDVDVYC

SEQ ID NO: 348121 - protein, 9 aa, Influenza virus
DVDVYCICR

SEQ ID NO: 348122 - protein, 9 aa, Influenza virus
TDVYCICRD

SEQ ID NO: 348123 - protein, 9 aa, Influenza virus
VRINNETIL

SEQ ID NO: 348124 - protein, 9 aa, Influenza virus
DPSVVSCDS

SEQ ID NO: 348125 - protein, 9 aa, Influenza virus
PSVVSCDSP

SEQ ID NO: 348126 - protein, 9 aa, Influenza virus
SVVSCDSPS

SEQ ID NO: 348127 - protein, 9 aa, Influenza virus
VVSCDSPSN

SEQ ID NO: 348128 - protein, 9 aa, Influenza virus
DSPSNANGG

SEQ ID NO: 348129 - protein, 9 aa, Influenza virus
GVKGFGFKS

SEQ ID NO: 348130 - protein, 9 aa, Influenza virus
VKGFGFKSG

SEQ ID NO: 348131 - protein, 9 aa, Influenza virus
RTISYSSRS

SEQ ID NO: 348132 - protein, 9 aa, Influenza virus
SGRLGFEII

SEQ ID NO: 348133 - protein, 9 aa, Influenza virus
RSSFEIIKV

SEQ ID NO: 348134 - protein, 9 aa, Influenza virus
VIEGWINSP

SEQ ID NO: 348135 - protein, 9 aa, Influenza virus
VKSVTQTLV

SEQ ID NO: 348136 - protein, 9 aa, Influenza virus
ITQTLVSNS

SEQ ID NO: 348137 - protein, 9 aa, Influenza virus
KDCFQSCFY

SEQ ID NO: 348138 - protein, 9 aa, Influenza virus
VELIRGRPI

SEQ ID NO: 348139 - protein, 9 aa, Influenza virus
DDDVSWTSN

SEQ ID NO: 348140 - protein, 9 aa, Influenza virus
TKVNTLTEK

SEQ ID NO: 348141 - protein, 9 aa, Influenza virus
VNTLTEREV

SEQ ID NO: 348142 - protein, 9 aa, Influenza virus
NTLTEREVE

SEQ ID NO: 348143 - protein, 9 aa, Influenza virus
LGQCGFLGT

SEQ ID NO: 348144 - protein, 9 aa, Influenza virus
NLIIERSEG

SEQ ID NO: 348145 - protein, 9 aa, Influenza virus
GEALRQILR

SEQ ID NO: 348146 - protein, 9 aa, Influenza virus
LRQILRRSG

SEQ ID NO: 348147 - protein, 9 aa, Influenza virus
RQILRRSGG

SEQ ID NO: 348148 - protein, 9 aa, Influenza virus
TRFTYSGIR

SEQ ID NO: 348149 - protein, 9 aa, Influenza virus
RLGSSFYAE

SEQ ID NO: 348150 - protein, 9 aa, Influenza virus
LGSSFYAEM

SEQ ID NO: 348151 - protein, 9 aa, Influenza virus
TVWSSKYRR

SEQ ID NO: 348152 - protein, 9 aa, Influenza virus
VESSNYQQS

SEQ ID NO: 348153 - protein, 9 aa, Influenza virus
NDTVTFNFN

SEQ ID NO: 348154 - protein, 9 aa, Influenza virus
DTVTFNFNG

SEQ ID NO: 348155 - protein, 9 aa, Influenza virus
TVTFNFNGA

SEQ ID NO: 348156 - protein, 9 aa, Influenza virus
VTFNFNGAF

SEQ ID NO: 348157 - protein, 9 aa, Influenza virus
TFNFNGAFV

SEQ ID NO: 348158 - protein, 9 aa, Influenza virus
NNLPFQNIN

SEQ ID NO: 348159 - protein, 9 aa, Influenza virus
VGECPRYVK

SEQ ID NO: 348160 - protein, 9 aa, Influenza virus
KKRGLFGAI

SEQ ID NO: 348161 - protein, 9 aa, Influenza virus
WYGFRHQKA

SEQ ID NO: 348162 - protein, 9 aa, Influenza virus
YGFRHQKAQ

SEQ ID NO: 348163 - protein, 9 aa, Influenza virus
GFKHQNAQG

SEQ ID NO: 348164 - protein, 9 aa, Influenza virus
FKHQNAQGE

SEQ ID NO: 348165 - protein, 9 aa, Influenza virus
SAVNQITGK

SEQ ID NO: 348166 - protein, 9 aa, Influenza virus
FELIDNKFN

SEQ ID NO: 348167 - protein, 9 aa, Influenza virus
KLIDNEFTE

SEQ ID NO: 348168 - protein, 9 aa, Influenza virus
IDNEFTEIE

SEQ ID NO: 348169 - protein, 9 aa, Influenza virus
EVEKQLGNV

SEQ ID NO: 348170 - protein, 9 aa, Influenza virus
VEKQLGNVI

SEQ ID NO: 348171 - protein, 9 aa, Influenza virus
TEVWSYNAD

SEQ ID NO: 348172 - protein, 9 aa, Influenza virus
EVWSYNADL

SEQ ID NO: 348173 - protein, 9 aa, Influenza virus
VWSYNADLL

SEQ ID NO: 348174 - protein, 9 aa, Influenza virus
NQHTIDLTN

SEQ ID NO: 348175 - protein, 9 aa, Influenza virus
QHTIDLAES

SEQ ID NO: 348176 - protein, 9 aa, Influenza virus
HTIDLTNSE

SEQ ID NO: 348177 - protein, 9 aa, Influenza virus
TIDSTDSEM

SEQ ID NO: 348178 - protein, 9 aa, Influenza virus
EIFHKCDDR

SEQ ID NO: 348179 - protein, 9 aa, Influenza virus
IFHKCDDNC

SEQ ID NO: 348180 - protein, 9 aa, Influenza virus
CMGSIRNNT

SEQ ID NO: 348181 - protein, 9 aa, Influenza virus
MANIRNNTY

SEQ ID NO: 348182 - protein, 9 aa, Influenza virus
ASIRNNSYD

SEQ ID NO: 348183 - protein, 9 aa, Influenza virus
RNNSYDHSK

SEQ ID NO: 348184 - protein, 9 aa, Influenza virus
NNSYDHSKY

SEQ ID NO: 348185 - protein, 9 aa, Influenza virus
NTYDHRKYK

SEQ ID NO: 348186 - protein, 9 aa, Influenza virus
QNIIQIDPV

SEQ ID NO: 348187 - protein, 9 aa, Influenza virus
VKIDPVELS

SEQ ID NO: 348188 - protein, 9 aa, Influenza virus
IDPVELSSG

SEQ ID NO: 348189 - protein, 9 aa, Influenza virus
DPVKLSGGY

SEQ ID NO: 348190 - protein, 9 aa, Influenza virus
ELSSGYKDV

SEQ ID NO: 348191 - protein, 9 aa, Influenza virus
SSGYKDVII

SEQ ID NO: 348192 - protein, 9 aa, Influenza virus
SGYKEIILW

SEQ ID NO: 348193 - protein, 9 aa, Influenza virus
KDVIIWFSF

SEQ ID NO: 348194 - protein, 9 aa, Influenza virus
EIILWFSFG

SEQ ID NO: 348195 - protein, 9 aa, Influenza virus
SLGASCFLL

SEQ ID NO: 348196 - protein, 9 aa, Influenza virus
GASCFTLLA

SEQ ID NO: 348197 - protein, 9 aa, Influenza virus
ASCFTLLAI

SEQ ID NO: 348198 - protein, 9 aa, Influenza virus
LIFMCVKNG

SEQ ID NO: 348199 - protein, 9 aa, Influenza virus
IFMCVKNGN

SEQ ID NO: 348200 - protein, 9 aa, Influenza virus
LLIGISNIG

SEQ ID NO: 348201 - protein, 9 aa, Influenza virus
LIGISNIGL

SEQ ID NO: 348202 - protein, 9 aa, Influenza virus
IGISNIGLN

SEQ ID NO: 348203 - protein, 9 aa, Influenza virus
SNIGLNVSL

SEQ ID NO: 348204 - protein, 9 aa, Influenza virus
NIGLNVSLH

SEQ ID NO: 348205 - protein, 9 aa, Influenza virus
VGLNMSLHL

SEQ ID NO: 348206 - protein, 9 aa, Influenza virus
GLNVSLHLR

SEQ ID NO: 348207 - protein, 9 aa, Influenza virus
NKYVNNTTI

SEQ ID NO: 348208 - protein, 9 aa, Influenza virus
KYVNNTTII

SEQ ID NO: 348209 - protein, 9 aa, Influenza virus
CKIEGWVVV

SEQ ID NO: 348210 - protein, 9 aa, Influenza virus
VEGWVVIEK

SEQ ID NO: 348211 - protein, 9 aa, Influenza virus
VVIEKDNAV

SEQ ID NO: 348212 - protein, 9 aa, Influenza virus
VIEKDNAVR

SEQ ID NO: 348213 - protein, 9 aa, Influenza virus
IAQDNAIRF

SEQ ID NO: 348214 - protein, 9 aa, Influenza virus
EPYVSCDPK

SEQ ID NO: 348215 - protein, 9 aa, Influenza virus
NGTIHDRAA

SEQ ID NO: 348216 - protein, 9 aa, Influenza virus
GTIHDRAAF

SEQ ID NO: 348217 - protein, 9 aa, Influenza virus
DRTAFRGLM

SEQ ID NO: 348218 - protein, 9 aa, Influenza virus
RAAFRGLIS

SEQ ID NO: 348219 - protein, 9 aa, Influenza virus
TTFRGLLST

SEQ ID NO: 348220 - protein, 9 aa, Influenza virus
FRGLLSTPL

SEQ ID NO: 348221 - protein, 9 aa, Influenza virus
RGLLSTPLG

SEQ ID NO: 348222 - protein, 9 aa, Influenza virus
CHDGVSRMT

SEQ ID NO: 348223 - protein, 9 aa, Influenza virus
HDGVSRMTI

SEQ ID NO: 348224 - protein, 9 aa, Influenza virus
DGVSRMTIC

SEQ ID NO: 348225 - protein, 9 aa, Influenza virus
SRMTICVQG

SEQ ID NO: 348226 - protein, 9 aa, Influenza virus
YDRRLTTTV

SEQ ID NO: 348227 - protein, 9 aa, Influenza virus
RRLTTTIRT

SEQ ID NO: 348228 - protein, 9 aa, Influenza virus
TTTIRTWAK

SEQ ID NO: 348229 - protein, 9 aa, Influenza virus
TTVKTWAGN

SEQ ID NO: 348230 - protein, 9 aa, Influenza virus
TVKTWAGNI

SEQ ID NO: 348231 - protein, 9 aa, Influenza virus
VKTWAGNIL

SEQ ID NO: 348232 - protein, 9 aa, Influenza virus
CVRHNGTCA

SEQ ID NO: 348233 - protein, 9 aa, Influenza virus
VSHNGTWAV

SEQ ID NO: 348234 - protein, 9 aa, Influenza virus
HNGTWAVVM

SEQ ID NO: 348235 - protein, 9 aa, Influenza virus
NGTWAVVMT

SEQ ID NO: 348236 - protein, 9 aa, Influenza virus
GTWAVVMTD

SEQ ID NO: 348237 - protein, 9 aa, Influenza virus
AVVMTDGPA

SEQ ID NO: 348238 - protein, 9 aa, Influenza virus
VMTDGSASG

SEQ ID NO: 348239 - protein, 9 aa, Influenza virus
MTDGSASGQ

SEQ ID NO: 348240 - protein, 9 aa, Influenza virus
TDGSASGQA

SEQ ID NO: 348241 - protein, 9 aa, Influenza virus
VTCGCRDNW

SEQ ID NO: 348242 - protein, 9 aa, Influenza virus
RPVIEIDMS

SEQ ID NO: 348243 - protein, 9 aa, Influenza virus
MDHTSQYLC

SEQ ID NO: 348244 - protein, 9 aa, Influenza virus
EHTSKYVCT

SEQ ID NO: 348245 - protein, 9 aa, Influenza virus
YICTGILTD

SEQ ID NO: 348246 - protein, 9 aa, Influenza virus
ICTGILTDT

SEQ ID NO: 348247 - protein, 9 aa, Influenza virus
SPGVKGFGF

SEQ ID NO: 348248 - protein, 9 aa, Influenza virus
GTKGFGFLN

SEQ ID NO: 348249 - protein, 9 aa, Influenza virus
TKGFGFLNE

SEQ ID NO: 348250 - protein, 9 aa, Influenza virus
DSTWLGRTI

SEQ ID NO: 348251 - protein, 9 aa, Influenza virus
MLRIPNAGI

SEQ ID NO: 348252 - protein, 9 aa, Influenza virus
LKIHNAGTD

SEQ ID NO: 348253 - protein, 9 aa, Influenza virus
KIHNAGTDP

SEQ ID NO: 348254 - protein, 9 aa, Influenza virus
RQEIVDNKN

SEQ ID NO: 348255 - protein, 9 aa, Influenza virus
QEIVDNSNW

SEQ ID NO: 348256 - protein, 9 aa, Influenza virus
EIVDNSNWS

SEQ ID NO: 348257 - protein, 9 aa, Influenza virus
IVDNKNWSG

SEQ ID NO: 348258 - protein, 9 aa, Influenza virus
VDNKNWSGY

SEQ ID NO: 348259 - protein, 9 aa, Influenza virus
DNKNWSGYS

SEQ ID NO: 348260 - protein, 9 aa, Influenza virus
SNRSGYSGS

SEQ ID NO: 348261 - protein, 9 aa, Influenza virus
ILVSTNAYD

SEQ ID NO: 348262 - protein, 9 aa, Influenza virus
STDTVNTLT

SEQ ID NO: 348263 - protein, 9 aa, Influenza virus
TDTVNTLME

SEQ ID NO: 348264 - protein, 9 aa, Influenza virus
NTVNTLIEQ

SEQ ID NO: 348265 - protein, 9 aa, Influenza virus
TVNTLTEQN

SEQ ID NO: 348266 - protein, 9 aa, Influenza virus
TLIEQNIPV

SEQ ID NO: 348267 - protein, 9 aa, Influenza virus
LTEQNVPVT

SEQ ID NO: 348268 - protein, 9 aa, Influenza virus
TEQNVPVTQ

SEQ ID NO: 348269 - protein, 9 aa, Influenza virus
EKHLAYCNT

SEQ ID NO: 348270 - protein, 9 aa, Influenza virus
HLKDQAWSY

SEQ ID NO: 348271 - protein, 9 aa, Influenza virus
LKDQAWSYI

SEQ ID NO: 348272 - protein, 9 aa, Influenza virus
KDQAWSYIV

SEQ ID NO: 348273 - protein, 9 aa, Influenza virus
CNASTGAQS

SEQ ID NO: 348274 - protein, 9 aa, Influenza virus
NASTGAQSF

SEQ ID NO: 348275 - protein, 9 aa, Influenza virus
DIYDFNEGS

SEQ ID NO: 348276 - protein, 9 aa, Influenza virus
IYDFNEGSY

SEQ ID NO: 348277 - protein, 9 aa, Influenza virus
FNEGSYINN

SEQ ID NO: 348278 - protein, 9 aa, Influenza virus
NNEEGDIIF

SEQ ID NO: 348279 - protein, 9 aa, Influenza virus
NKDGDIIFL

SEQ ID NO: 348280 - protein, 9 aa, Influenza virus
EEGDIIFLW

SEQ ID NO: 348281 - protein, 9 aa, Influenza virus
TKEQTALYK

SEQ ID NO: 348282 - protein, 9 aa, Influenza virus
ALVRGQQGR

SEQ ID NO: 348283 - protein, 9 aa, Influenza virus
LLKGESHGK

SEQ ID NO: 348284 - protein, 9 aa, Influenza virus
GESHGRTIQ

SEQ ID NO: 348285 - protein, 9 aa, Influenza virus
ESHGRTIQN

SEQ ID NO: 348286 - protein, 9 aa, Influenza virus
SHGKIIQNE

SEQ ID NO: 348287 - protein, 9 aa, Influenza virus
HGKIIQNED

SEQ ID NO: 348288 - protein, 9 aa, Influenza virus
NCKTKCQTY

SEQ ID NO: 348289 - protein, 9 aa, Influenza virus
CHTKCQTYT

SEQ ID NO: 348290 - protein, 9 aa, Influenza virus
YTKCQTYAG

SEQ ID NO: 348291 - protein, 9 aa, Influenza virus
YTGAINSSK

SEQ ID NO: 348292 - protein, 9 aa, Influenza virus
TGAINSSRP

SEQ ID NO: 348293 - protein, 9 aa, Influenza virus
KPFQNASRY

SEQ ID NO: 348294 - protein, 9 aa, Influenza virus
PLQNASRHY

SEQ ID NO: 348295 - protein, 9 aa, Influenza virus
FQNTSRHYM

SEQ ID NO: 348296 - protein, 9 aa, Influenza virus
RHYMGECPE

SEQ ID NO: 348297 - protein, 9 aa, Influenza virus
HYMGECPEY

SEQ ID NO: 348298 - protein, 9 aa, Influenza virus
YMGECPKYA

SEQ ID NO: 348299 - protein, 9 aa, Influenza virus
MGECPKYAK

SEQ ID NO: 348300 - protein, 9 aa, Influenza virus
GECPEYVKK

SEQ ID NO: 348301 - protein, 9 aa, Influenza virus
KKESLRLAI

SEQ ID NO: 348302 - protein, 9 aa, Influenza virus
RNTPSIDPK

SEQ ID NO: 348303 - protein, 9 aa, Influenza virus
NTPSIDPKG

SEQ ID NO: 348304 - protein, 9 aa, Influenza virus
TPSIDPKGL

SEQ ID NO: 348305 - protein, 9 aa, Influenza virus
PSIDPKGLF

SEQ ID NO: 348306 - protein, 9 aa, Influenza virus
SIDPKGLFG

SEQ ID NO: 348307 - protein, 9 aa, Influenza virus
IDPKGLFGA

SEQ ID NO: 348308 - protein, 9 aa, Influenza virus
AIEKITNKV

SEQ ID NO: 348309 - protein, 9 aa, Influenza virus
IEKITNKVN

SEQ ID NO: 348310 - protein, 9 aa, Influenza virus
GKITNKVNN

SEQ ID NO: 348311 - protein, 9 aa, Influenza virus
EKRINMISD

SEQ ID NO: 348312 - protein, 9 aa, Influenza virus
KRTNMINDK

SEQ ID NO: 348313 - protein, 9 aa, Influenza virus
RTNMINDKI

SEQ ID NO: 348314 - protein, 9 aa, Influenza virus
INMISDKID

SEQ ID NO: 348315 - protein, 9 aa, Influenza virus
DKIDDQIEE

SEQ ID NO: 348316 - protein, 9 aa, Influenza virus
KIDDQIEEL

SEQ ID NO: 348317 - protein, 9 aa, Influenza virus
IDDQIEELW

SEQ ID NO: 348318 - protein, 9 aa, Influenza virus
DDQIEELWA

SEQ ID NO: 348319 - protein, 9 aa, Influenza virus
DEVRRRLSV

SEQ ID NO: 348320 - protein, 9 aa, Influenza virus
EVRRRLSVN

SEQ ID NO: 348321 - protein, 9 aa, Influenza virus
VRRRLSVNA

SEQ ID NO: 348322 - protein, 9 aa, Influenza virus
RRLSANAVD

SEQ ID NO: 348323 - protein, 9 aa, Influenza virus
NAVDTGNGC

SEQ ID NO: 348324 - protein, 9 aa, Influenza virus
AVDTGNGCF

SEQ ID NO: 348325 - protein, 9 aa, Influenza virus
IDTGKGCFD

SEQ ID NO: 348326 - protein, 9 aa, Influenza virus
KNGTYDHKD

SEQ ID NO: 348327 - protein, 9 aa, Influenza virus
NGTYNRKEY

SEQ ID NO: 348328 - protein, 9 aa, Influenza virus
GTYNHKDYE

SEQ ID NO: 348329 - protein, 9 aa, Influenza virus
TYDHKDYEE

SEQ ID NO: 348330 - protein, 9 aa, Influenza virus
YNRKEYEEE

SEQ ID NO: 348331 - protein, 9 aa, Influenza virus
NHKDYEEEA

SEQ ID NO: 348332 - protein, 9 aa, Influenza virus
ERSKINGVR

SEQ ID NO: 348333 - protein, 9 aa, Influenza virus
KSRINGVKL

SEQ ID NO: 348334 - protein, 9 aa, Influenza virus
SRINGVKLE

SEQ ID NO: 348335 - protein, 9 aa, Influenza virus
KINGVILEE

SEQ ID NO: 348336 - protein, 9 aa, Influenza virus
EVKLEENTT

SEQ ID NO: 348337 - protein, 9 aa, Influenza virus
RLEENTTYK

SEQ ID NO: 348338 - protein, 9 aa, Influenza virus
GHQSTNSTD

SEQ ID NO: 348339 - protein, 9 aa, Influenza virus
YQSTNSTEI

SEQ ID NO: 348340 - protein, 9 aa, Influenza virus
TNSTDTVDT

SEQ ID NO: 348341 - protein, 9 aa, Influenza virus
GHNGMLCAT

SEQ ID NO: 348342 - protein, 9 aa, Influenza virus
LIYGNPFCD

SEQ ID NO: 348343 - protein, 9 aa, Influenza virus
SYIVERQSA

SEQ ID NO: 348344 - protein, 9 aa, Influenza virus
FYRSVRWLT

SEQ ID NO: 348345 - protein, 9 aa, Influenza virus
GQTLRIISN

SEQ ID NO: 348346 - protein, 9 aa, Influenza virus
QTLRIRSNE

SEQ ID NO: 348347 - protein, 9 aa, Influenza virus
TLRIISNGN

SEQ ID NO: 348348 - protein, 9 aa, Influenza virus
LRIISNGNL

SEQ ID NO: 348349 - protein, 9 aa, Influenza virus
IRSNGNLVA

SEQ ID NO: 348350 - protein, 9 aa, Influenza virus
RSNENLIAP

SEQ ID NO: 348351 - protein, 9 aa, Influenza virus
NGNLVAPWY

SEQ ID NO: 348352 - protein, 9 aa, Influenza virus
NLVAPWYGH

SEQ ID NO: 348353 - protein, 9 aa, Influenza virus
LPFQNVSRY

SEQ ID NO: 348354 - protein, 9 aa, Influenza virus
FQNVSRYAF

SEQ ID NO: 348355 - protein, 9 aa, Influenza virus
QNVSRYAFG

SEQ ID NO: 348356 - protein, 9 aa, Influenza virus
SLKLAVGPR

SEQ ID NO: 348357 - protein, 9 aa, Influenza virus
LKLAVGPRN

SEQ ID NO: 348358 - protein, 9 aa, Influenza virus
DRIQDIWAY

SEQ ID NO: 348359 - protein, 9 aa, Influenza virus
RIQDIWAYN

SEQ ID NO: 348360 - protein, 9 aa, Influenza virus
LVLLENQKP

SEQ ID NO: 348361 - protein, 9 aa, Influenza virus
NQKTLDEHV

SEQ ID NO: 348362 - protein, 9 aa, Influenza virus
DGKGCSELY

SEQ ID NO: 348363 - protein, 9 aa, Influenza virus
CMETTRNGT

SEQ ID NO: 348364 - protein, 9 aa, Influenza virus
METTRNGTY

SEQ ID NO: 348365 - protein, 9 aa, Influenza virus
DGTYKILTI

SEQ ID NO: 348366 - protein, 9 aa, Influenza virus
GHQSTNSTD

SEQ ID NO: 348367 - protein, 9 aa, Influenza virus
YQSTNSTEI

SEQ ID NO: 348368 - protein, 9 aa, Influenza virus
TNSTETVGT

SEQ ID NO: 348369 - protein, 9 aa, Influenza virus
GHNGMLCAT

SEQ ID NO: 348370 - protein, 9 aa, Influenza virus
LIYGNPFCD

SEQ ID NO: 348371 - protein, 9 aa, Influenza virus
SYIIERPSA

SEQ ID NO: 348372 - protein, 9 aa, Influenza virus
FYRSVRWLT

SEQ ID NO: 348373 - protein, 9 aa, Influenza virus
SVLRPGQTL

SEQ ID NO: 348374 - protein, 9 aa, Influenza virus
GQTLRIISN

SEQ ID NO: 348375 - protein, 9 aa, Influenza virus
QTLRIRSNE

SEQ ID NO: 348376 - protein, 9 aa, Influenza virus
TLRIRSNEN

SEQ ID NO: 348377 - protein, 9 aa, Influenza virus
LRIRSNENL

SEQ ID NO: 348378 - protein, 9 aa, Influenza virus
IRSNGNLVA

SEQ ID NO: 348379 - protein, 9 aa, Influenza virus
RSNENLIAP

SEQ ID NO: 348380 - protein, 9 aa, Influenza virus
NGNLVAPWY

SEQ ID NO: 348381 - protein, 9 aa, Influenza virus
NLVAPWYGH

SEQ ID NO: 348382 - protein, 9 aa, Influenza virus
LPFQNVSRY

SEQ ID NO: 348383 - protein, 9 aa, Influenza virus
FQNVSRYAF

SEQ ID NO: 348384 - protein, 9 aa, Influenza virus
QNVSRYAFG

SEQ ID NO: 348385 - protein, 9 aa, Influenza virus
YAFGNCPMY

SEQ ID NO: 348386 - protein, 9 aa, Influenza virus
SLKLAVGPR

SEQ ID NO: 348387 - protein, 9 aa, Influenza virus
LKLAVGPRN

SEQ ID NO: 348388 - protein, 9 aa, Influenza virus
EDQIQDIWA

SEQ ID NO: 348389 - protein, 9 aa, Influenza virus
QKTLDEHDT

SEQ ID NO: 348390 - protein, 9 aa, Influenza virus
KTLDEHVAN

SEQ ID NO: 348391 - protein, 9 aa, Influenza virus
LDEHDSNVN

SEQ ID NO: 348392 - protein, 9 aa, Influenza virus
DGKGCFETY

SEQ ID NO: 348393 - protein, 9 aa, Influenza virus
CMETTRNGT

SEQ ID NO: 348394 - protein, 9 aa, Influenza virus
METTRNGTY

SEQ ID NO: 348395 - protein, 9 aa, Influenza virus
WSKPQCHIT

SEQ ID NO: 348396 - protein, 9 aa, Influenza virus
PQCQITGSA

SEQ ID NO: 348397 - protein, 9 aa, Influenza virus
QCQITGSAP

SEQ ID NO: 348398 - protein, 9 aa, Influenza virus
RLAAAGDIW

SEQ ID NO: 348399 - protein, 9 aa, Influenza virus
VAREPYVSC

SEQ ID NO: 348400 - protein, 9 aa, Influenza virus
KCNQFALGQ

SEQ ID NO: 348401 - protein, 9 aa, Influenza virus
MNELGVPFN

SEQ ID NO: 348402 - protein, 9 aa, Influenza virus
NEIGVPFHL

SEQ ID NO: 348403 - protein, 9 aa, Influenza virus
TKQLCIAWS

SEQ ID NO: 348404 - protein, 9 aa, Influenza virus
KQVCIAYSS

SEQ ID NO: 348405 - protein, 9 aa, Influenza virus
NILKTQESE

SEQ ID NO: 348406 - protein, 9 aa, Influenza virus
RTHESECVC

SEQ ID NO: 348407 - protein, 9 aa, Influenza virus
GSECVCING

SEQ ID NO: 348408 - protein, 9 aa, Influenza virus
IDGTCTVVM

SEQ ID NO: 348409 - protein, 9 aa, Influenza virus
GTCTVVLTD

SEQ ID NO: 348410 - protein, 9 aa, Influenza virus
GSAKHVEEC

SEQ ID NO: 348411 - protein, 9 aa, Influenza virus
SAKHVEECS

SEQ ID NO: 348412 - protein, 9 aa, Influenza virus
IEECSCYPQ

SEQ ID NO: 348413 - protein, 9 aa, Influenza virus
EECSCYPQH

SEQ ID NO: 348414 - protein, 9 aa, Influenza virus
DCRDNWKGS

SEQ ID NO: 348415 - protein, 9 aa, Influenza virus
FCGTSGTCG

SEQ ID NO: 348416 - protein, 9 aa, Influenza virus
GTHGTGSWP

SEQ ID NO: 348417 - protein, 9 aa, Influenza virus
TYGTGSWAD

SEQ ID NO: 348418 - protein, 9 aa, Influenza virus
GSWPDGANF

SEQ ID NO: 348419 - protein, 9 aa, Influenza virus
AEIAQRLEN

SEQ ID NO: 348420 - protein, 9 aa, Influenza virus
EIAQRLENV

SEQ ID NO: 348421 - protein, 9 aa, Influenza virus
IAQRLENVF

SEQ ID NO: 348422 - protein, 9 aa, Influenza virus
AQRLENVFA

SEQ ID NO: 348423 - protein, 9 aa, Influenza virus
QRLENVFAG

SEQ ID NO: 348424 - protein, 9 aa, Influenza virus
RLENVFAGK

SEQ ID NO: 348425 - protein, 9 aa, Influenza virus
LEDVFSGKN

SEQ ID NO: 348426 - protein, 9 aa, Influenza virus
MARAVKLYK

SEQ ID NO: 348427 - protein, 9 aa, Influenza virus
ITFHRAKEV

SEQ ID NO: 348428 - protein, 9 aa, Influenza virus
FHRAKEVAL

SEQ ID NO: 348429 - protein, 9 aa, Influenza virus
GAKEISLSY

SEQ ID NO: 348430 - protein, 9 aa, Influenza virus
EVALGYSTG

SEQ ID NO: 348431 - protein, 9 aa, Influenza virus
VALGYSTGA

SEQ ID NO: 348432 - protein, 9 aa, Influenza virus
TRQMVQAMR

SEQ ID NO: 348433 - protein, 9 aa, Influenza virus
MVQAMRAVG

SEQ ID NO: 348434 - protein, 9 aa, Influenza virus
VQAMRAVGT

SEQ ID NO: 348435 - protein, 9 aa, Influenza virus
AMRTIGTQP

SEQ ID NO: 348436 - protein, 9 aa, Influenza virus
DLLDNLQAY

SEQ ID NO: 348437 - protein, 9 aa, Influenza virus
QKRMGVQMH

SEQ ID NO: 348438 - protein, 9 aa, Influenza virus
KRMGVQMHR

SEQ ID NO: 348439 - protein, 9 aa, Influenza virus
MGVQMHRFK

SEQ ID NO: 348440 - protein, 9 aa, Influenza virus
SMREEYRQK

SEQ ID NO: 348441 - protein, 9 aa, Influenza virus
SYEQMETGE

SEQ ID NO: 348442 - protein, 9 aa, Influenza virus
HEQMETGGE

SEQ ID NO: 348443 - protein, 9 aa, Influenza virus
QMETGERQN

SEQ ID NO: 348444 - protein, 9 aa, Influenza virus
ATEIRTSVG

SEQ ID NO: 348445 - protein, 9 aa, Influenza virus
NEIRASVGR

SEQ ID NO: 348446 - protein, 9 aa, Influenza virus
IRTSVGRMV

SEQ ID NO: 348447 - protein, 9 aa, Influenza virus
GGIGKFYIQ

SEQ ID NO: 348448 - protein, 9 aa, Influenza virus
NEGRLIQNS

SEQ ID NO: 348449 - protein, 9 aa, Influenza virus
KYLEEHPST

SEQ ID NO: 348450 - protein, 9 aa, Influenza virus
LEEHPSAGR

SEQ ID NO: 348451 - protein, 9 aa, Influenza virus
EEHPSAGRD

SEQ ID NO: 348452 - protein, 9 aa, Influenza virus
EHPSAGRDP

SEQ ID NO: 348453 - protein, 9 aa, Influenza virus
HPSAGRDPK

SEQ ID NO: 348454 - protein, 9 aa, Influenza virus
ELRRIWRQA

SEQ ID NO: 348455 - protein, 9 aa, Influenza virus
LRRIWRQAN

SEQ ID NO: 348456 - protein, 9 aa, Influenza virus
RQANSGEDA

SEQ ID NO: 348457 - protein, 9 aa, Influenza virus
AAIKGIGTM

SEQ ID NO: 348458 - protein, 9 aa, Influenza virus
VMELVRMIK

SEQ ID NO: 348459 - protein, 9 aa, Influenza virus
TRGAYERMC

SEQ ID NO: 348460 - protein, 9 aa, Influenza virus
RGAYERMCN

SEQ ID NO: 348461 - protein, 9 aa, Influenza virus
GAYERMCNI

SEQ ID NO: 348462 - protein, 9 aa, Influenza virus
EIEDLIFLT

SEQ ID NO: 348463 - protein, 9 aa, Influenza virus
IEDLIFLTR

SEQ ID NO: 348464 - protein, 9 aa, Influenza virus
LPACVYGLV

SEQ ID NO: 348465 - protein, 9 aa, Influenza virus
PACVYGLVV

SEQ ID NO: 348466 - protein, 9 aa, Influenza virus
GGYDFEREG

SEQ ID NO: 348467 - protein, 9 aa, Influenza virus
FRLLQSSQV

SEQ ID NO: 348468 - protein, 9 aa, Influenza virus
PRGQLTTRG

SEQ ID NO: 348469 - protein, 9 aa, Influenza virus
LTTRGVQIA

SEQ ID NO: 348470 - protein, 9 aa, Influenza virus
ASAGQVSVQ

SEQ ID NO: 348471 - protein, 9 aa, Influenza virus
SAGQVSVQP

SEQ ID NO: 348472 - protein, 9 aa, Influenza virus
GNPEGRTSD

SEQ ID NO: 348473 - protein, 9 aa, Influenza virus
SDMRTEIIK

SEQ ID NO: 348474 - protein, 9 aa, Influenza virus
EMSFQGRGV

SEQ ID NO: 348475 - protein, 9 aa, Influenza virus
FEFSDERAA

SEQ ID NO: 348476 - protein, 9 aa, Influenza virus
TNPVVPSFD

SEQ ID NO: 348477 - protein, 9 aa, Influenza virus
TPIVPSFDM

SEQ ID NO: 348478 - protein, 9 aa, Influenza virus
VVPSFDMSN

SEQ ID NO: 348479 - protein, 9 aa, Influenza virus
VPSFDMSND

SEQ ID NO: 348480 - protein, 9 aa, Influenza virus
PSFDMSNDG

SEQ ID NO: 348481 - protein, 9 aa, Influenza virus
FDMSNDGSY

SEQ ID NO: 348482 - protein, 9 aa, Influenza virus
QVDCFLWYV

SEQ ID NO: 348483 - protein, 9 aa, Influenza virus
VDCFLWYVR

SEQ ID NO: 348484 - protein, 9 aa, Influenza virus
GDAPFIDRL

SEQ ID NO: 348485 - protein, 9 aa, Influenza virus
DRIRRDQKS

SEQ ID NO: 348486 - protein, 9 aa, Influenza virus
RIRRDQKSL

SEQ ID NO: 348487 - protein, 9 aa, Influenza virus
RRDQRALKG

SEQ ID NO: 348488 - protein, 9 aa, Influenza virus
RDQRALKGR

SEQ ID NO: 348489 - protein, 9 aa, Influenza virus
QKFEEIRWM

SEQ ID NO: 348490 - protein, 9 aa, Influenza virus
KFEEIRWMI

SEQ ID NO: 348491 - protein, 9 aa, Influenza virus
EVENEIRTF

SEQ ID NO: 348492 - protein, 9 aa, Influenza virus
VENEIRTFS

SEQ ID NO: 348493 - protein, 9 aa, Influenza virus
GDFVRQCFN

SEQ ID NO: 348494 - protein, 9 aa, Influenza virus
QCFNPMIAE

SEQ ID NO: 348495 - protein, 9 aa, Influenza virus
CFNPMIAEL

SEQ ID NO: 348496 - protein, 9 aa, Influenza virus
FNPMIAELA

SEQ ID NO: 348497 - protein, 9 aa, Influenza virus
NPMIAELAE

SEQ ID NO: 348498 - protein, 9 aa, Influenza virus
PMIAELAEK

SEQ ID NO: 348499 - protein, 9 aa, Influenza virus
VELAERAMK

SEQ ID NO: 348500 - protein, 9 aa, Influenza virus
SDFHFINEL

SEQ ID NO: 348501 - protein, 9 aa, Influenza virus
AWTAVNSIC

SEQ ID NO: 348502 - protein, 9 aa, Influenza virus
KPKSLPDLY

SEQ ID NO: 348503 - protein, 9 aa, Influenza virus
PKSLPDLYD

SEQ ID NO: 348504 - protein, 9 aa, Influenza virus
KSLPDLYDY

SEQ ID NO: 348505 - protein, 9 aa, Influenza virus
GVTRREVHM

SEQ ID NO: 348506 - protein, 9 aa, Influenza virus
VTRREVHMY

SEQ ID NO: 348507 - protein, 9 aa, Influenza virus
RREVHMYYL

SEQ ID NO: 348508 - protein, 9 aa, Influenza virus
REVHMYYLE

SEQ ID NO: 348509 - protein, 9 aa, Influenza virus
EVHMYYLEK

SEQ ID NO: 348510 - protein, 9 aa, Influenza virus
VHMYYLEKA

SEQ ID NO: 348511 - protein, 9 aa, Influenza virus
EKANKIKAE

SEQ ID NO: 348512 - protein, 9 aa, Influenza virus
EDTHIHIFS

SEQ ID NO: 348513 - protein, 9 aa, Influenza virus
DTHIHIFSF

SEQ ID NO: 348514 - protein, 9 aa, Influenza virus
FIGEEMATK

SEQ ID NO: 348515 - protein, 9 aa, Influenza virus
FTIRQEMAG

SEQ ID NO: 348516 - protein, 9 aa, Influenza virus
TIRQEMASK

SEQ ID NO: 348517 - protein, 9 aa, Influenza virus
RTYVDGFKP

SEQ ID NO: 348518 - protein, 9 aa, Influenza virus
FEPNGSIEG

SEQ ID NO: 348519 - protein, 9 aa, Influenza virus
EPNGSIEGK

SEQ ID NO: 348520 - protein, 9 aa, Influenza virus
KLSQMSKNV

SEQ ID NO: 348521 - protein, 9 aa, Influenza virus
LSIEEPSHE

SEQ ID NO: 348522 - protein, 9 aa, Influenza virus
SIEEPSHEG

SEQ ID NO: 348523 - protein, 9 aa, Influenza virus
KCIRTFFGW

SEQ ID NO: 348524 - protein, 9 aa, Influenza virus
CMKTFFGWR

SEQ ID NO: 348525 - protein, 9 aa, Influenza virus
LMWALGENM

SEQ ID NO: 348526 - protein, 9 aa, Influenza virus
MWALGENMA

SEQ ID NO: 348527 - protein, 9 aa, Influenza virus
IAPEKVDFE

SEQ ID NO: 348528 - protein, 9 aa, Influenza virus
KACELTGSS

SEQ ID NO: 348529 - protein, 9 aa, Influenza virus
ACELTGSSW

SEQ ID NO: 348530 - protein, 9 aa, Influenza virus
IEFDEIGED

SEQ ID NO: 348531 - protein, 9 aa, Influenza virus
GEDLAPIEY

SEQ ID NO: 348532 - protein, 9 aa, Influenza virus
APIEHIASI

SEQ ID NO: 348533 - protein, 9 aa, Influenza virus
PIEHIASIR

SEQ ID NO: 348534 - protein, 9 aa, Influenza virus
IEHIASIRR

SEQ ID NO: 348535 - protein, 9 aa, Influenza virus
IASMRRSYF

SEQ ID NO: 348536 - protein, 9 aa, Influenza virus
RRNYFTTEV

SEQ ID NO: 348537 - protein, 9 aa, Influenza virus
RNYFTTEVS

SEQ ID NO: 348538 - protein, 9 aa, Influenza virus
SMFLYVRTN

SEQ ID NO: 348539 - protein, 9 aa, Influenza virus
IIEAESSVK

SEQ ID NO: 348540 - protein, 9 aa, Influenza virus
SVKEKDLTK

SEQ ID NO: 348541 - protein, 9 aa, Influenza virus
VKEKDLTKE

SEQ ID NO: 348542 - protein, 9 aa, Influenza virus
KDMTKEFFV

SEQ ID NO: 348543 - protein, 9 aa, Influenza virus
ETWPVGESP

SEQ ID NO: 348544 - protein, 9 aa, Influenza virus
WPIGESPKR

SEQ ID NO: 348545 - protein, 9 aa, Influenza virus
GMEEGSIGK

SEQ ID NO: 348546 - protein, 9 aa, Influenza virus
IEEGSIGKV

SEQ ID NO: 348547 - protein, 9 aa, Influenza virus
KSVFNSIYA

SEQ ID NO: 348548 - protein, 9 aa, Influenza virus
VFNSIYASP

SEQ ID NO: 348549 - protein, 9 aa, Influenza virus
FNSIYASPQ

SEQ ID NO: 348550 - protein, 9 aa, Influenza virus
NSIYASPQL

SEQ ID NO: 348551 - protein, 9 aa, Influenza virus
SIYASPQLE

SEQ ID NO: 348552 - protein, 9 aa, Influenza virus
ESRKLLLIT

SEQ ID NO: 348553 - protein, 9 aa, Influenza virus
SRKLLLITQ

SEQ ID NO: 348554 - protein, 9 aa, Influenza virus
RKLLLITQA

SEQ ID NO: 348555 - protein, 9 aa, Influenza virus
LLITQALRD

SEQ ID NO: 348556 - protein, 9 aa, Influenza virus
EAVEECLIN

SEQ ID NO: 348557 - protein, 9 aa, Influenza virus
ASWFNSFLK

SEQ ID NO: 348558 - protein, 9 aa, Influenza virus
SWFNSFLKH

SEQ ID NO: 348559 - protein, 9 aa, Influenza virus
NPTLLFLEV

SEQ ID NO: 348560 - protein, 9 aa, Influenza virus
LLFLEVPAQ

SEQ ID NO: 348561 - protein, 9 aa, Influenza virus
EVPAQNAIS

SEQ ID NO: 348562 - protein, 9 aa, Influenza virus
IPVQNAIST

SEQ ID NO: 348563 - protein, 9 aa, Influenza virus
NTETGALQL

SEQ ID NO: 348564 - protein, 9 aa, Influenza virus
TETGALQLN

SEQ ID NO: 348565 - protein, 9 aa, Influenza virus
TGAPQLNPV

SEQ ID NO: 348566 - protein, 9 aa, Influenza virus
DNEPNGYAQ

SEQ ID NO: 348567 - protein, 9 aa, Influenza virus
LEAMAFLED

SEQ ID NO: 348568 - protein, 9 aa, Influenza virus
EAMAFLEDS

SEQ ID NO: 348569 - protein, 9 aa, Influenza virus
AMAFLEDSH

SEQ ID NO: 348570 - protein, 9 aa, Influenza virus
MAFLEDSHP

SEQ ID NO: 348571 - protein, 9 aa, Influenza virus
AFLEDSHPG

SEQ ID NO: 348572 - protein, 9 aa, Influenza virus
EESHPGIFG

SEQ ID NO: 348573 - protein, 9 aa, Influenza virus
PGIFESSCL

SEQ ID NO: 348574 - protein, 9 aa, Influenza virus
GIFESSCLE

SEQ ID NO: 348575 - protein, 9 aa, Influenza virus
IFESSCLET

SEQ ID NO: 348576 - protein, 9 aa, Influenza virus
LIDFLKDVT

SEQ ID NO: 348577 - protein, 9 aa, Influenza virus
GITTHFQRK

SEQ ID NO: 348578 - protein, 9 aa, Influenza virus
RKRRVRDSM

SEQ ID NO: 348579 - protein, 9 aa, Influenza virus
KRRVRDSMT

SEQ ID NO: 348580 - protein, 9 aa, Influenza virus
RMITQRTIG

SEQ ID NO: 348581 - protein, 9 aa, Influenza virus
QRTMGKKKQ

SEQ ID NO: 348582 - protein, 9 aa, Influenza virus
SYIIRALTL

SEQ ID NO: 348583 - protein, 9 aa, Influenza virus
VYFVETLAK

SEQ ID NO: 348584 - protein, 9 aa, Influenza virus
VETLARNIC

SEQ ID NO: 348585 - protein, 9 aa, Influenza virus
TSSQDTEIS

SEQ ID NO: 348586 - protein, 9 aa, Influenza virus
QSPRMFLAM

SEQ ID NO: 348587 - protein, 9 aa, Influenza virus
SPRMFLAMI

SEQ ID NO: 348588 - protein, 9 aa, Influenza virus
TFLAMITYI

SEQ ID NO: 348589 - protein, 9 aa, Influenza virus
PDWFRNVLS

SEQ ID NO: 348590 - protein, 9 aa, Influenza virus
RNALSIAPI

SEQ ID NO: 348591 - protein, 9 aa, Influenza virus
NALSIAPIM

SEQ ID NO: 348592 - protein, 9 aa, Influenza virus
ALSIAPIMF

SEQ ID NO: 348593 - protein, 9 aa, Influenza virus
LNLGQKRHT

SEQ ID NO: 348594 - protein, 9 aa, Influenza virus
TAYWWDGLQ

SEQ ID NO: 348595 - protein, 9 aa, Influenza virus
AYWWDGLQS

SEQ ID NO: 348596 - protein, 9 aa, Influenza virus
YRCHRGDAQ

SEQ ID NO: 348597 - protein, 9 aa, Influenza virus
RCHRGDAQI

SEQ ID NO: 348598 - protein, 9 aa, Influenza virus
QTRRAFELK

SEQ ID NO: 348599 - protein, 9 aa, Influenza virus
NPLNPFVGH

SEQ ID NO: 348600 - protein, 9 aa, Influenza virus
ERMYQKCCN

SEQ ID NO: 348601 - protein, 9 aa, Influenza virus
RMYQKCCNL

SEQ ID NO: 348602 - protein, 9 aa, Influenza virus
ISSMVEAMM

SEQ ID NO: 348603 - protein, 9 aa, Influenza virus
SSMVEAMMS

SEQ ID NO: 348604 - protein, 9 aa, Influenza virus
SMVEAMMSR

SEQ ID NO: 348605 - protein, 9 aa, Influenza virus
MVEAMMSRA

SEQ ID NO: 348606 - protein, 9 aa, Influenza virus
VEAMMSRAR

SEQ ID NO: 348607 - protein, 9 aa, Influenza virus
RIDFESGRV

SEQ ID NO: 348608 - protein, 9 aa, Influenza virus
RNEQGQMLW

SEQ ID NO: 348609 - protein, 9 aa, Influenza virus
HYPKVYKPY

SEQ ID NO: 348610 - protein, 9 aa, Influenza virus
YPKVYKPYF

SEQ ID NO: 348611 - protein, 9 aa, Influenza virus
AFGPVHFRN

SEQ ID NO: 348612 - protein, 9 aa, Influenza virus
VKIRRRVDM

SEQ ID NO: 348613 - protein, 9 aa, Influenza virus
RVDINPGHS

SEQ ID NO: 348614 - protein, 9 aa, Influenza virus
VDINPGHSD

SEQ ID NO: 348615 - protein, 9 aa, Influenza virus
RILASESQL

SEQ ID NO: 348616 - protein, 9 aa, Influenza virus
GTGSIYIEV

SEQ ID NO: 348617 - protein, 9 aa, Influenza virus
TGSIYIEVL

SEQ ID NO: 348618 - protein, 9 aa, Influenza virus
GSIYIEVLH

SEQ ID NO: 348619 - protein, 9 aa, Influenza virus
YTPGGEVIN

SEQ ID NO: 348620 - protein, 9 aa, Influenza virus
TPGGEVIND

SEQ ID NO: 348621 - protein, 9 aa, Influenza virus
VKNDEVDQS

SEQ ID NO: 348622 - protein, 9 aa, Influenza virus
KNDEVDQSL

SEQ ID NO: 348623 - protein, 9 aa, Influenza virus
ATVSADPLV

SEQ ID NO: 348624 - protein, 9 aa, Influenza virus
TVSADPLVS

SEQ ID NO: 348625 - protein, 9 aa, Influenza virus
AVNICKAAM

SEQ ID NO: 348626 - protein, 9 aa, Influenza virus
VNICKAAMG

SEQ ID NO: 348627 - protein, 9 aa, Influenza virus
ICKAAMGMR

SEQ ID NO: 348628 - protein, 9 aa, Influenza virus
CKAAMGMRI

SEQ ID NO: 348629 - protein, 9 aa, Influenza virus
KAAMGMRIS

SEQ ID NO: 348630 - protein, 9 aa, Influenza virus
AAMGMRISS

SEQ ID NO: 348631 - protein, 9 aa, Influenza virus
AMGMRISSS

SEQ ID NO: 348632 - protein, 9 aa, Influenza virus
TGNLQALKI

SEQ ID NO: 348633 - protein, 9 aa, Influenza virus
EGYEEFTMI

SEQ ID NO: 348634 - protein, 9 aa, Influenza virus
RATAIFRKA

SEQ ID NO: 348635 - protein, 9 aa, Influenza virus
TAIFRKATR

SEQ ID NO: 348636 - protein, 9 aa, Influenza virus
RKATKRLIQ

SEQ ID NO: 348637 - protein, 9 aa, Influenza virus
KATRKLIQL

SEQ ID NO: 348638 - protein, 9 aa, Influenza virus
TRKLIQLIV

SEQ ID NO: 348639 - protein, 9 aa, Influenza virus
MIQLIVSGR

SEQ ID NO: 348640 - protein, 9 aa, Influenza virus
FSQEDRMIK

SEQ ID NO: 348641 - protein, 9 aa, Influenza virus
SQEDRMIKA

SEQ ID NO: 348642 - protein, 9 aa, Influenza virus
QEDRMIKAV

SEQ ID NO: 348643 - protein, 9 aa, Influenza virus
EDRMIKAVR

SEQ ID NO: 348644 - protein, 9 aa, Influenza virus
DRMIKAVRG

SEQ ID NO: 348645 - protein, 9 aa, Influenza virus
RHFQKDAKM

SEQ ID NO: 348646 - protein, 9 aa, Influenza virus
HFQKDAKML

SEQ ID NO: 348647 - protein, 9 aa, Influenza virus
RVSRMGVDE

SEQ ID NO: 348648 - protein, 9 aa, Influenza virus
VSRMGVDEY

SEQ ID NO: 348649 - protein, 9 aa, Influenza virus
RMGVDEYSS

SEQ ID NO: 348650 - protein, 9 aa, Influenza virus
MGVDEYSSA

SEQ ID NO: 348651 - protein, 9 aa, Influenza virus
VDEYSSTEK

SEQ ID NO: 348652 - protein, 9 aa, Influenza virus
TVSIDRFLR

SEQ ID NO: 348653 - protein, 9 aa, Influenza virus
RFLRVRDQM

SEQ ID NO: 348654 - protein, 9 aa, Influenza virus
FLRVRDQMG

SEQ ID NO: 348655 - protein, 9 aa, Influenza virus
LRVRDQMGN

SEQ ID NO: 348656 - protein, 9 aa, Influenza virus
LGNILLSPE

SEQ ID NO: 348657 - protein, 9 aa, Influenza virus
EEISETQGT

SEQ ID NO: 348658 - protein, 9 aa, Influenza virus
EISETQGTE

SEQ ID NO: 348659 - protein, 9 aa, Influenza virus
KIQWSQEPT

SEQ ID NO: 348660 - protein, 9 aa, Influenza virus
RCQYSGFVR

SEQ ID NO: 348661 - protein, 9 aa, Influenza virus
GTFDTVQVI

SEQ ID NO: 348662 - protein, 9 aa, Influenza virus
TFDTVQVIK

SEQ ID NO: 348663 - protein, 9 aa, Influenza virus
TVQVIKLLP

SEQ ID NO: 348664 - protein, 9 aa, Influenza virus
VQVIKLLPF

SEQ ID NO: 348665 - protein, 9 aa, Influenza virus
AAPPVQSKM

SEQ ID NO: 348666 - protein, 9 aa, Influenza virus
PPEQSKMQF

SEQ ID NO: 348667 - protein, 9 aa, Influenza virus
PEQSKMQFS

SEQ ID NO: 348668 - protein, 9 aa, Influenza virus
EQSKMQFSS

SEQ ID NO: 348669 - protein, 9 aa, Influenza virus
RGSGLRILI

SEQ ID NO: 348670 - protein, 9 aa, Influenza virus
GSGLRILIR

SEQ ID NO: 348671 - protein, 9 aa, Influenza virus
SGLRILIRG

SEQ ID NO: 348672 - protein, 9 aa, Influenza virus
TKRLAVLGK

SEQ ID NO: 348673 - protein, 9 aa, Influenza virus
KRLAVLGKD

SEQ ID NO: 348674 - protein, 9 aa, Influenza virus
FLILGREDK

SEQ ID NO: 348675 - protein, 9 aa, Influenza virus
GKENKKYGP

SEQ ID NO: 348676 - protein, 9 aa, Influenza virus
KENKKYGPA

SEQ ID NO: 348677 - protein, 9 aa, Influenza virus
ALSINELGN

SEQ ID NO: 348678 - protein, 9 aa, Influenza virus
RIRMAINWG

SEQ ID NO: 348679 - protein, 10 aa, Influenza virus
KQGKTKATKM

SEQ ID NO: 348680 - protein, 10 aa, Influenza virus
QGKTKATKMK

SEQ ID NO: 348681 - protein, 10 aa, Influenza virus
IFIFILLTHW

SEQ ID NO: 348682 - protein, 10 aa, Influenza virus
FIFILLTHWA

SEQ ID NO: 348683 - protein, 10 aa, Influenza virus
RFSYVFCLAL

SEQ ID NO: 348684 - protein, 10 aa, Influenza virus
SQITNGTTGN

SEQ ID NO: 348685 - protein, 10 aa, Influenza virus
QITNGTTGNP

SEQ ID NO: 348686 - protein, 10 aa, Influenza virus
ITNGTTGNPI

SEQ ID NO: 348687 - protein, 10 aa, Influenza virus
TNGTTGNPII

SEQ ID NO: 348688 - protein, 10 aa, Influenza virus
NGTTGNPIIC

SEQ ID NO: 348689 - protein, 10 aa, Influenza virus
GTTGNPIICL

SEQ ID NO: 348690 - protein, 10 aa, Influenza virus
TTGNPIICLG

SEQ ID NO: 348691 - protein, 10 aa, Influenza virus
NNNNNTATLC

SEQ ID NO: 348692 - protein, 10 aa, Influenza virus
NNSTATLCLG

SEQ ID NO: 348693 - protein, 10 aa, Influenza virus
GVIPLTTTPT

SEQ ID NO: 348694 - protein, 10 aa, Influenza virus
VIPLTTTPTK

SEQ ID NO: 348695 - protein, 10 aa, Influenza virus
IPLTTTPTKS

SEQ ID NO: 348696 - protein, 10 aa, Influenza virus
PLTTTPTKSY

SEQ ID NO: 348697 - protein, 10 aa, Influenza virus
LTTTPTKSYF

SEQ ID NO: 348698 - protein, 10 aa, Influenza virus
TTTPTKSYFA

SEQ ID NO: 348699 - protein, 10 aa, Influenza virus
TTPTKSYFAN

SEQ ID NO: 348700 - protein, 10 aa, Influenza virus
TPTKSYFANL

SEQ ID NO: 348701 - protein, 10 aa, Influenza virus
PTKSYFANLK

SEQ ID NO: 348702 - protein, 10 aa, Influenza virus
TKSYFANLKG

SEQ ID NO: 348703 - protein, 10 aa, Influenza virus
KSYFANLKGT

SEQ ID NO: 348704 - protein, 10 aa, Influenza virus
SYFANLKGTR

SEQ ID NO: 348705 - protein, 10 aa, Influenza virus
IMHDRTKIRQ

SEQ ID NO: 348706 - protein, 10 aa, Influenza virus
MHDRTKIRQL

SEQ ID NO: 348707 - protein, 10 aa, Influenza virus
EKENSYPMIN

SEQ ID NO: 348708 - protein, 10 aa, Influenza virus
LTVEVPYVCT

SEQ ID NO: 348709 - protein, 10 aa, Influenza virus
GVTTHYVSQI

SEQ ID NO: 348710 - protein, 10 aa, Influenza virus
DEGLPQSGRI

SEQ ID NO: 348711 - protein, 10 aa, Influenza virus
EGLPQSGRIV

SEQ ID NO: 348712 - protein, 10 aa, Influenza virus
GLPQSGRIVV

SEQ ID NO: 348713 - protein, 10 aa, Influenza virus
LPQSGRIVVD

SEQ ID NO: 348714 - protein, 10 aa, Influenza virus
PQSGRIVVDY

SEQ ID NO: 348715 - protein, 10 aa, Influenza virus
APSGIEYNGK

SEQ ID NO: 348716 - protein, 10 aa, Influenza virus
SGIEYNGKSL

SEQ ID NO: 348717 - protein, 10 aa, Influenza virus
GIEYNGKSLG

SEQ ID NO: 348718 - protein, 10 aa, Influenza virus
IEYNGKSLGI

SEQ ID NO: 348719 - protein, 10 aa, Influenza virus
EYNGKSLGIQ

SEQ ID NO: 348720 - protein, 10 aa, Influenza virus
YNGKSLGIQS

SEQ ID NO: 348721 - protein, 10 aa, Influenza virus
NGKSLGIQSD

SEQ ID NO: 348722 - protein, 10 aa, Influenza virus
PSVKLPMGAI

SEQ ID NO: 348723 - protein, 10 aa, Influenza virus
GAIGAIDSSM

SEQ ID NO: 348724 - protein, 10 aa, Influenza virus
AIGAIDSSMP

SEQ ID NO: 348725 - protein, 10 aa, Influenza virus
YGGLNKSKPY

SEQ ID NO: 348726 - protein, 10 aa, Influenza virus
TSLTSLPFQN

SEQ ID NO: 348727 - protein, 10 aa, Influenza virus
SLTSLPFQNI

SEQ ID NO: 348728 - protein, 10 aa, Influenza virus
LTSLPFQNIH

SEQ ID NO: 348729 - protein, 10 aa, Influenza virus
GEHAKAIGNC

SEQ ID NO: 348730 - protein, 10 aa, Influenza virus
PAKLLKERGF

SEQ ID NO: 348731 - protein, 10 aa, Influenza virus
REREGGRRRK

SEQ ID NO: 348732 - protein, 10 aa, Influenza virus
EREGGRRRKR

SEQ ID NO: 348733 - protein, 10 aa, Influenza virus
RRKKRGLFGA

SEQ ID NO: 348734 - protein, 10 aa, Influenza virus
KKKRGLFGAI

SEQ ID NO: 348735 - protein, 10 aa, Influenza virus
KRRKKRGLFG

SEQ ID NO: 348736 - protein, 10 aa, Influenza virus
RRQKRGLFGA

SEQ ID NO: 348737 - protein, 10 aa, Influenza virus
RKKRGLFGAI

SEQ ID NO: 348738 - protein, 10 aa, Influenza virus
KKRGLFGAIA

SEQ ID NO: 348739 - protein, 10 aa, Influenza virus
THKQLTHHMR

SEQ ID NO: 348740 - protein, 10 aa, Influenza virus
HKQLTHHMRK

SEQ ID NO: 348741 - protein, 10 aa, Influenza virus
KQLTHHMRKK

SEQ ID NO: 348742 - protein, 10 aa, Influenza virus
QLTHHMRKKR

SEQ ID NO: 348743 - protein, 10 aa, Influenza virus
LTHHMRKKRG

SEQ ID NO: 348744 - protein, 10 aa, Influenza virus
THHMRKKRGL

SEQ ID NO: 348745 - protein, 10 aa, Influenza virus
HHMRKKRGLF

SEQ ID NO: 348746 - protein, 10 aa, Influenza virus
HMRKKRGLFG

SEQ ID NO: 348747 - protein, 10 aa, Influenza virus
MRKKRGLFGA

SEQ ID NO: 348748 - protein, 10 aa, Influenza virus
RKKRGLFGAI

SEQ ID NO: 348749 - protein, 10 aa, Influenza virus
RMTRGLFGAI

SEQ ID NO: 348750 - protein, 10 aa, Influenza virus
MTRGLFGAIA

SEQ ID NO: 348751 - protein, 10 aa, Influenza virus
PRGLFGAIAG

SEQ ID NO: 348752 - protein, 10 aa, Influenza virus
TKPRPRRGLF

SEQ ID NO: 348753 - protein, 10 aa, Influenza virus
KPRPRRGLFG

SEQ ID NO: 348754 - protein, 10 aa, Influenza virus
PRPRRGLFGA

SEQ ID NO: 348755 - protein, 10 aa, Influenza virus
RPRRGLFGAI

SEQ ID NO: 348756 - protein, 10 aa, Influenza virus
PRRGLFGAIA

SEQ ID NO: 348757 - protein, 10 aa, Influenza virus
RRGLFGAIAG

SEQ ID NO: 348758 - protein, 10 aa, Influenza virus
RGLFGAIAGF

SEQ ID NO: 348759 - protein, 10 aa, Influenza virus
GLFGAIAGFI

SEQ ID NO: 348760 - protein, 10 aa, Influenza virus
LFGAIAGFIE

SEQ ID NO: 348761 - protein, 10 aa, Influenza virus
FGAIAGFIEG

SEQ ID NO: 348762 - protein, 10 aa, Influenza virus
GAIAGFIEGG

SEQ ID NO: 348763 - protein, 10 aa, Influenza virus
AIAGFIEGGW

SEQ ID NO: 348764 - protein, 10 aa, Influenza virus
GRLVRFRHQN

SEQ ID NO: 348765 - protein, 10 aa, Influenza virus
RLVRFRHQNS

SEQ ID NO: 348766 - protein, 10 aa, Influenza virus
LPTFDSLNIT

SEQ ID NO: 348767 - protein, 10 aa, Influenza virus
PTFDSLNITA

SEQ ID NO: 348768 - protein, 10 aa, Influenza virus
TFDSLNITAA

SEQ ID NO: 348769 - protein, 10 aa, Influenza virus
FDSLNITAAS

SEQ ID NO: 348770 - protein, 10 aa, Influenza virus
DSLNITAASL

SEQ ID NO: 348771 - protein, 10 aa, Influenza virus
SLNITAASLN

SEQ ID NO: 348772 - protein, 10 aa, Influenza virus
LNITAASLND

SEQ ID NO: 348773 - protein, 10 aa, Influenza virus
NITAASLNDD

SEQ ID NO: 348774 - protein, 10 aa, Influenza virus
ITAASLNDDG

SEQ ID NO: 348775 - protein, 10 aa, Influenza virus
VTTRQASPSC

SEQ ID NO: 348776 - protein, 10 aa, Influenza virus
TTRQASPSCL

SEQ ID NO: 348777 - protein, 10 aa, Influenza virus
TRQASPSCLV

SEQ ID NO: 348778 - protein, 10 aa, Influenza virus
RQASPSCLVV

SEQ ID NO: 348779 - protein, 10 aa, Influenza virus
QASPSCLVVR

SEQ ID NO: 348780 - protein, 10 aa, Influenza virus
ASPSCLVVRK

SEQ ID NO: 348781 - protein, 10 aa, Influenza virus
EFPSTGNHGS

SEQ ID NO: 348782 - protein, 10 aa, Influenza virus
FPSTGNHGSL

SEQ ID NO: 348783 - protein, 10 aa, Influenza virus
PSTGNHGSLV

SEQ ID NO: 348784 - protein, 10 aa, Influenza virus
STGNHGSLVL

SEQ ID NO: 348785 - protein, 10 aa, Influenza virus
TGNHGSLVLS

SEQ ID NO: 348786 - protein, 10 aa, Influenza virus
GNHGSLVLSL

SEQ ID NO: 348787 - protein, 10 aa, Influenza virus
NHGSLVLSLW

SEQ ID NO: 348788 - protein, 10 aa, Influenza virus
SGSLQCRICI

SEQ ID NO: 348789 - protein, 10 aa, Influenza virus
LCSVEYASKT

SEQ ID NO: 348790 - protein, 10 aa, Influenza virus
CSVEYASKTR

SEQ ID NO: 348791 - protein, 10 aa, Influenza virus
SVEYASKTRI

SEQ ID NO: 348792 - protein, 10 aa, Influenza virus
VEYASKTRIS

SEQ ID NO: 348793 - protein, 10 aa, Influenza virus
EYASKTRISE

SEQ ID NO: 348794 - protein, 10 aa, Influenza virus
YASKTRISEI

SEQ ID NO: 348795 - protein, 10 aa, Influenza virus
ILDQNFRNIR

SEQ ID NO: 348796 - protein, 10 aa, Influenza virus
DFRDMRKNTL

SEQ ID NO: 348797 - protein, 10 aa, Influenza virus
IGLREQKQEF

SEQ ID NO: 348798 - protein, 10 aa, Influenza virus
GLREQKQEFK

SEQ ID NO: 348799 - protein, 10 aa, Influenza virus
LREQKQEFKM

SEQ ID NO: 348800 - protein, 10 aa, Influenza virus
REQKQEFKMN

SEQ ID NO: 348801 - protein, 10 aa, Influenza virus
EQKQEFKMNP

SEQ ID NO: 348802 - protein, 10 aa, Influenza virus
QKQEFKMNPN

SEQ ID NO: 348803 - protein, 10 aa, Influenza virus
KQEFKMNPNK

SEQ ID NO: 348804 - protein, 10 aa, Influenza virus
QEFKMNPNKK

SEQ ID NO: 348805 - protein, 10 aa, Influenza virus
EFKMNPNKKI

SEQ ID NO: 348806 - protein, 10 aa, Influenza virus
FKMNPNKKII

SEQ ID NO: 348807 - protein, 10 aa, Influenza virus
KMNPNKKIIT

SEQ ID NO: 348808 - protein, 10 aa, Influenza virus
IIIAIGSVSR

SEQ ID NO: 348809 - protein, 10 aa, Influenza virus
NRDITIGSIC

SEQ ID NO: 348810 - protein, 10 aa, Influenza virus
RDITIGSICM

SEQ ID NO: 348811 - protein, 10 aa, Influenza virus
DITIGSICMV

SEQ ID NO: 348812 - protein, 10 aa, Influenza virus
VPLVPCEPII

SEQ ID NO: 348813 - protein, 10 aa, Influenza virus
PLVPCEPIII

SEQ ID NO: 348814 - protein, 10 aa, Influenza virus
LVPCEPIIIE

SEQ ID NO: 348815 - protein, 10 aa, Influenza virus
IRKGLILEYY

SEQ ID NO: 348816 - protein, 10 aa, Influenza virus
REGLILEYYF

SEQ ID NO: 348817 - protein, 10 aa, Influenza virus
YKYKIFKNGK

SEQ ID NO: 348818 - protein, 10 aa, Influenza virus
KYKIFKNGKK

SEQ ID NO: 348819 - protein, 10 aa, Influenza virus
GKKGKWLNQS

SEQ ID NO: 348820 - protein, 10 aa, Influenza virus
IQHLEECSCY

SEQ ID NO: 348821 - protein, 10 aa, Influenza virus
SYPNVRCVCR

SEQ ID NO: 348822 - protein, 10 aa, Influenza virus
KLDINMADYS

SEQ ID NO: 348823 - protein, 10 aa, Influenza virus
NNYGVKGFGF

SEQ ID NO: 348824 - protein, 10 aa, Influenza virus
NYGVKGFGFR

SEQ ID NO: 348825 - protein, 10 aa, Influenza virus
IFLWCKIVTT

SEQ ID NO: 348826 - protein, 10 aa, Influenza virus
FLWCKIVTTV

SEQ ID NO: 348827 - protein, 10 aa, Influenza virus
LWCKIVTTVG

SEQ ID NO: 348828 - protein, 10 aa, Influenza virus
WCKIVTTVGW

SEQ ID NO: 348829 - protein, 10 aa, Influenza virus
CKIVTTVGWS

SEQ ID NO: 348830 - protein, 10 aa, Influenza virus
KIVTTVGWSW

SEQ ID NO: 348831 - protein, 10 aa, Influenza virus
IVTTVGWSWP

SEQ ID NO: 348832 - protein, 10 aa, Influenza virus
VTTVGWSWPD

SEQ ID NO: 348833 - protein, 10 aa, Influenza virus
TTVGWSWPDG

SEQ ID NO: 348834 - protein, 10 aa, Influenza virus
RTSISCLYKL

SEQ ID NO: 348835 - protein, 10 aa, Influenza virus
NLHAYISFRN

SEQ ID NO: 348836 - protein, 10 aa, Influenza virus
LHAYISFRNL

SEQ ID NO: 348837 - protein, 10 aa, Influenza virus
IGLREQKQEF

SEQ ID NO: 348838 - protein, 10 aa, Influenza virus
GLREQKQEFK

SEQ ID NO: 348839 - protein, 10 aa, Influenza virus
LREQKQEFKM

SEQ ID NO: 348840 - protein, 10 aa, Influenza virus
REQKQEFKMN

SEQ ID NO: 348841 - protein, 10 aa, Influenza virus
EQKQEFKMNP

SEQ ID NO: 348842 - protein, 10 aa, Influenza virus
QKQEFKMNPN

SEQ ID NO: 348843 - protein, 10 aa, Influenza virus
KQEFKMNPNK

SEQ ID NO: 348844 - protein, 10 aa, Influenza virus
QEFKMNPNKK

SEQ ID NO: 348845 - protein, 10 aa, Influenza virus
EFKMNPNKKI

SEQ ID NO: 348846 - protein, 10 aa, Influenza virus
FKMNPNKKII

SEQ ID NO: 348847 - protein, 10 aa, Influenza virus
KMNPNKKIIT

SEQ ID NO: 348848 - protein, 10 aa, Influenza virus
NRDITIGSIC

SEQ ID NO: 348849 - protein, 10 aa, Influenza virus
RDITIGSICM

SEQ ID NO: 348850 - protein, 10 aa, Influenza virus
DITIGSICMV

SEQ ID NO: 348851 - protein, 10 aa, Influenza virus
DLNMGQPFYS

SEQ ID NO: 348852 - protein, 10 aa, Influenza virus
SKDNSIRIGS

SEQ ID NO: 348853 - protein, 10 aa, Influenza virus
KDNSIRIGSK

SEQ ID NO: 348854 - protein, 10 aa, Influenza virus
DNSIRIGSKG

SEQ ID NO: 348855 - protein, 10 aa, Influenza virus
NSIRIGSKGD

SEQ ID NO: 348856 - protein, 10 aa, Influenza virus
IRIGSKGDVF

SEQ ID NO: 348857 - protein, 10 aa, Influenza virus
RIGSKGDVFV

SEQ ID NO: 348858 - protein, 10 aa, Influenza virus
GDVFVIREPF

SEQ ID NO: 348859 - protein, 10 aa, Influenza virus
FVIREPFISC

SEQ ID NO: 348860 - protein, 10 aa, Influenza virus
VIREPFISCS

SEQ ID NO: 348861 - protein, 10 aa, Influenza virus
LECRTFFLTQ

SEQ ID NO: 348862 - protein, 10 aa, Influenza virus
ECRTFFLTQG

SEQ ID NO: 348863 - protein, 10 aa, Influenza virus
CRTFFLTQGA

SEQ ID NO: 348864 - protein, 10 aa, Influenza virus
RTFFLTQGAL

SEQ ID NO: 348865 - protein, 10 aa, Influenza virus
TFFLTQGALL

SEQ ID NO: 348866 - protein, 10 aa, Influenza virus
FFLTQGALLN

SEQ ID NO: 348867 - protein, 10 aa, Influenza virus
FLTQGALLND

SEQ ID NO: 348868 - protein, 10 aa, Influenza virus
LTQGALLNDK

SEQ ID NO: 348869 - protein, 10 aa, Influenza virus
TQGALLNDKH

SEQ ID NO: 348870 - protein, 10 aa, Influenza virus
QGALLNDKHS

SEQ ID NO: 348871 - protein, 10 aa, Influenza virus
GALLNDKHSN

SEQ ID NO: 348872 - protein, 10 aa, Influenza virus
ALLNDKHSNG

SEQ ID NO: 348873 - protein, 10 aa, Influenza virus
LLNDKHSNGT

SEQ ID NO: 348874 - protein, 10 aa, Influenza virus
LNDKHSNGTI

SEQ ID NO: 348875 - protein, 10 aa, Influenza virus
DRSPYRTLMS

SEQ ID NO: 348876 - protein, 10 aa, Influenza virus
RSPYRTLMSC

SEQ ID NO: 348877 - protein, 10 aa, Influenza virus
SPYRTLMSCP

SEQ ID NO: 348878 - protein, 10 aa, Influenza virus
IGEVPSPYNS

SEQ ID NO: 348879 - protein, 10 aa, Influenza virus
GEVPSPYNSR

SEQ ID NO: 348880 - protein, 10 aa, Influenza virus
EVPSPYNSRF

SEQ ID NO: 348881 - protein, 10 aa, Influenza virus
VPSPYNSRFE

SEQ ID NO: 348882 - protein, 10 aa, Influenza virus
PSPYNSRFES

SEQ ID NO: 348883 - protein, 10 aa, Influenza virus
SPYNSRFESV

SEQ ID NO: 348884 - protein, 10 aa, Influenza virus
PYNSRFESVA

SEQ ID NO: 348885 - protein, 10 aa, Influenza virus
YNSRFESVAW

SEQ ID NO: 348886 - protein, 10 aa, Influenza virus
NSRFESVAWS

SEQ ID NO: 348887 - protein, 10 aa, Influenza virus
SRFESVAWSA

SEQ ID NO: 348888 - protein, 10 aa, Influenza virus
RFESVAWSAS

SEQ ID NO: 348889 - protein, 10 aa, Influenza virus
FESVAWSASA

SEQ ID NO: 348890 - protein, 10 aa, Influenza virus
ESVAWSASAC

SEQ ID NO: 348891 - protein, 10 aa, Influenza virus
SVAWSASACH

SEQ ID NO: 348892 - protein, 10 aa, Influenza virus
VAWSASACHD

SEQ ID NO: 348893 - protein, 10 aa, Influenza virus
AWSASACHDG

SEQ ID NO: 348894 - protein, 10 aa, Influenza virus
WSASACHDGI

SEQ ID NO: 348895 - protein, 10 aa, Influenza virus
NWLTIGISGP

SEQ ID NO: 348896 - protein, 10 aa, Influenza virus
WLTIGISGPD

SEQ ID NO: 348897 - protein, 10 aa, Influenza virus
TIGISGPDNG

SEQ ID NO: 348898 - protein, 10 aa, Influenza virus
IGISGPDNGA

SEQ ID NO: 348899 - protein, 10 aa, Influenza virus
GISGPDNGAV

SEQ ID NO: 348900 - protein, 10 aa, Influenza virus
ISGPDNGAVA

SEQ ID NO: 348901 - protein, 10 aa, Influenza virus
SGPDNGAVAV

SEQ ID NO: 348902 - protein, 10 aa, Influenza virus
GPDNGAVAVL

SEQ ID NO: 348903 - protein, 10 aa, Influenza virus
PDNGAVAVLK

SEQ ID NO: 348904 - protein, 10 aa, Influenza virus
DNGAVAVLKY

SEQ ID NO: 348905 - protein, 10 aa, Influenza virus
GAVAVLKYNG

SEQ ID NO: 348906 - protein, 10 aa, Influenza virus
AVLKYNGIIT

SEQ ID NO: 348907 - protein, 10 aa, Influenza virus
ILRTQESECA

SEQ ID NO: 348908 - protein, 10 aa, Influenza virus
LRTQESECAC

SEQ ID NO: 348909 - protein, 10 aa, Influenza virus
NGSCFTVMTD

SEQ ID NO: 348910 - protein, 10 aa, Influenza virus
GSCFTVMTDG

SEQ ID NO: 348911 - protein, 10 aa, Influenza virus
SCFTVMTDGP

SEQ ID NO: 348912 - protein, 10 aa, Influenza virus
CFTVMTDGPS

SEQ ID NO: 348913 - protein, 10 aa, Influenza virus
VMGQASYKIF

SEQ ID NO: 348914 - protein, 10 aa, Influenza virus
YKYKIFKNGK

SEQ ID NO: 348915 - protein, 10 aa, Influenza virus
KYKIFKNGKK

SEQ ID NO: 348916 - protein, 10 aa, Influenza virus
GKKGKWLNQS

SEQ ID NO: 348917 - protein, 10 aa, Influenza virus
APNYHYEECS

SEQ ID NO: 348918 - protein, 10 aa, Influenza virus
PNYHYEECSC

SEQ ID NO: 348919 - protein, 10 aa, Influenza virus
NYHYEECSCY

SEQ ID NO: 348920 - protein, 10 aa, Influenza virus
YHYEECSCYP

SEQ ID NO: 348921 - protein, 10 aa, Influenza virus
HYEECSCYPD

SEQ ID NO: 348922 - protein, 10 aa, Influenza virus
YEECSCYPDS

SEQ ID NO: 348923 - protein, 10 aa, Influenza virus
CVCRDNWHGS

SEQ ID NO: 348924 - protein, 10 aa, Influenza virus
VCRDNWHGSN

SEQ ID NO: 348925 - protein, 10 aa, Influenza virus
CRDNWHGSNR

SEQ ID NO: 348926 - protein, 10 aa, Influenza virus
RDNWHGSNRP

SEQ ID NO: 348927 - protein, 10 aa, Influenza virus
DNWHGSNRPW

SEQ ID NO: 348928 - protein, 10 aa, Influenza virus
NWHGSNRPWV

SEQ ID NO: 348929 - protein, 10 aa, Influenza virus
WHGSNRPWVS

SEQ ID NO: 348930 - protein, 10 aa, Influenza virus
HGSNRPWVSF

SEQ ID NO: 348931 - protein, 10 aa, Influenza virus
GYICSGVFGD

SEQ ID NO: 348932 - protein, 10 aa, Influenza virus
YICSGVFGDN

SEQ ID NO: 348933 - protein, 10 aa, Influenza virus
ICSGVFGDNP

SEQ ID NO: 348934 - protein, 10 aa, Influenza virus
CSGVFGDNPR

SEQ ID NO: 348935 - protein, 10 aa, Influenza virus
KYGNGVWIGR

SEQ ID NO: 348936 - protein, 10 aa, Influenza virus
YGNGVWIGRT

SEQ ID NO: 348937 - protein, 10 aa, Influenza virus
GNGVWIGRTK

SEQ ID NO: 348938 - protein, 10 aa, Influenza virus
NGVWIGRTKS

SEQ ID NO: 348939 - protein, 10 aa, Influenza virus
GFEMIWDPNG

SEQ ID NO: 348940 - protein, 10 aa, Influenza virus
FEMIWDPNGW

SEQ ID NO: 348941 - protein, 10 aa, Influenza virus
TDWSGYSGSF

SEQ ID NO: 348942 - protein, 10 aa, Influenza virus
DWSGYSGSFV

SEQ ID NO: 348943 - protein, 10 aa, Influenza virus
WSGYSGSFVQ

SEQ ID NO: 348944 - protein, 10 aa, Influenza virus
SGYSGSFVQH

SEQ ID NO: 348945 - protein, 10 aa, Influenza virus
GYSGSFVQHP

SEQ ID NO: 348946 - protein, 10 aa, Influenza virus
YSGSFVQHPE

SEQ ID NO: 348947 - protein, 10 aa, Influenza virus
SGSFVQHPEL

SEQ ID NO: 348948 - protein, 10 aa, Influenza virus
GSFVQHPELT

SEQ ID NO: 348949 - protein, 10 aa, Influenza virus
SFVQHPELTG

SEQ ID NO: 348950 - protein, 10 aa, Influenza virus
FVQHPELTGL

SEQ ID NO: 348951 - protein, 10 aa, Influenza virus
QHPELTGLDC

SEQ ID NO: 348952 - protein, 10 aa, Influenza virus
DCIRPCFWVE

SEQ ID NO: 348953 - protein, 10 aa, Influenza virus
CIRPCFWVEL

SEQ ID NO: 348954 - protein, 10 aa, Influenza virus
IRPCFWVELI

SEQ ID NO: 348955 - protein, 10 aa, Influenza virus
RPCFWVELIR

SEQ ID NO: 348956 - protein, 10 aa, Influenza virus
PCFWVELIRG

SEQ ID NO: 348957 - protein, 10 aa, Influenza virus
CFWVELIRGR

SEQ ID NO: 348958 - protein, 10 aa, Influenza virus
FWVELIRGRP

SEQ ID NO: 348959 - protein, 10 aa, Influenza virus
TTIWTSGSSI

SEQ ID NO: 348960 - protein, 10 aa, Influenza virus
TIWTSGSSIS

SEQ ID NO: 348961 - protein, 10 aa, Influenza virus
IWTSGSSISF

SEQ ID NO: 348962 - protein, 10 aa, Influenza virus
WTSGSSISFC

SEQ ID NO: 348963 - protein, 10 aa, Influenza virus
TSGSSISFCG

SEQ ID NO: 348964 - protein, 10 aa, Influenza virus
SGSSISFCGV

SEQ ID NO: 348965 - protein, 10 aa, Influenza virus
GSSISFCGVN

SEQ ID NO: 348966 - protein, 10 aa, Influenza virus
IFLWCKIVTT

SEQ ID NO: 348967 - protein, 10 aa, Influenza virus
FLWCKIVTTV

SEQ ID NO: 348968 - protein, 10 aa, Influenza virus
LWCKIVTTVG

SEQ ID NO: 348969 - protein, 10 aa, Influenza virus
WCKIVTTVGW

SEQ ID NO: 348970 - protein, 10 aa, Influenza virus
CKIVTTVGWS

SEQ ID NO: 348971 - protein, 10 aa, Influenza virus
KIVTTVGWSW

SEQ ID NO: 348972 - protein, 10 aa, Influenza virus
IVTTVGWSWP

SEQ ID NO: 348973 - protein, 10 aa, Influenza virus
VTTVGWSWPD

SEQ ID NO: 348974 - protein, 10 aa, Influenza virus
TTVGWSWPDG

SEQ ID NO: 348975 - protein, 10 aa, Influenza virus
WSWPDGAELP

SEQ ID NO: 348976 - protein, 10 aa, Influenza virus
SWPDGAELPF

SEQ ID NO: 348977 - protein, 10 aa, Influenza virus
AKAGVKMNPN

SEQ ID NO: 348978 - protein, 10 aa, Influenza virus
KAGVKMNPNQ

SEQ ID NO: 348979 - protein, 10 aa, Influenza virus
AGVKMNPNQK

SEQ ID NO: 348980 - protein, 10 aa, Influenza virus
GVKMNPNQKI

SEQ ID NO: 348981 - protein, 10 aa, Influenza virus
VKMNPNQKII

SEQ ID NO: 348982 - protein, 10 aa, Influenza virus
KMNPNQKIIT

SEQ ID NO: 348983 - protein, 10 aa, Influenza virus
IIIAIGSVSR

SEQ ID NO: 348984 - protein, 10 aa, Influenza virus
KNNQVILCEP

SEQ ID NO: 348985 - protein, 10 aa, Influenza virus
VPLVPCEPII

SEQ ID NO: 348986 - protein, 10 aa, Influenza virus
PLVPCEPIII

SEQ ID NO: 348987 - protein, 10 aa, Influenza virus
LVPCEPIIIE

SEQ ID NO: 348988 - protein, 10 aa, Influenza virus
KTVVHLNSTT

SEQ ID NO: 348989 - protein, 10 aa, Influenza virus
EKEKEICSVV

SEQ ID NO: 348990 - protein, 10 aa, Influenza virus
KEKEICSVVL

SEQ ID NO: 348991 - protein, 10 aa, Influenza virus
GFAPFSKDNS

SEQ ID NO: 348992 - protein, 10 aa, Influenza virus
PFSKDNSIRL

SEQ ID NO: 348993 - protein, 10 aa, Influenza virus
SKDNSIRLSA

SEQ ID NO: 348994 - protein, 10 aa, Influenza virus
KDNSIRLSAG

SEQ ID NO: 348995 - protein, 10 aa, Influenza virus
DNSIRLSAGG

SEQ ID NO: 348996 - protein, 10 aa, Influenza virus
IWVTREPYVS

SEQ ID NO: 348997 - protein, 10 aa, Influenza virus
WVTREPYVSC

SEQ ID NO: 348998 - protein, 10 aa, Influenza virus
KCYQFALGQG

SEQ ID NO: 348999 - protein, 10 aa, Influenza virus
CYQFALGQGT

SEQ ID NO: 349000 - protein, 10 aa, Influenza virus
YQFALGQGTT

SEQ ID NO: 349001 - protein, 10 aa, Influenza virus
QFALGQGTTL

SEQ ID NO: 349002 - protein, 10 aa, Influenza virus
PYRTLLMNEL

SEQ ID NO: 349003 - protein, 10 aa, Influenza virus
YRTLLMNELG

SEQ ID NO: 349004 - protein, 10 aa, Influenza virus
RTLLMNELGV

SEQ ID NO: 349005 - protein, 10 aa, Influenza virus
TLLMNELGVP

SEQ ID NO: 349006 - protein, 10 aa, Influenza virus
LLMNELGVPF

SEQ ID NO: 349007 - protein, 10 aa, Influenza virus
LMNELGVPFH

SEQ ID NO: 349008 - protein, 10 aa, Influenza virus
MNELGVPFHL

SEQ ID NO: 349009 - protein, 10 aa, Influenza virus
NELGVPFHLG

SEQ ID NO: 349010 - protein, 10 aa, Influenza virus
ELGVPFHLGT

SEQ ID NO: 349011 - protein, 10 aa, Influenza virus
LGVPFHLGTK

SEQ ID NO: 349012 - protein, 10 aa, Influenza virus
GVPFHLGTKQ

SEQ ID NO: 349013 - protein, 10 aa, Influenza virus
VPFHLGTKQV

SEQ ID NO: 349014 - protein, 10 aa, Influenza virus
PFHLGTKQVC

SEQ ID NO: 349015 - protein, 10 aa, Influenza virus
TKQVCIAWSS

SEQ ID NO: 349016 - protein, 10 aa, Influenza virus
KQVCIAWSSS

SEQ ID NO: 349017 - protein, 10 aa, Influenza virus
QVCIAWSSSS

SEQ ID NO: 349018 - protein, 10 aa, Influenza virus
VCIAWSSSSC

SEQ ID NO: 349019 - protein, 10 aa, Influenza virus
CIAWSSSSCH

SEQ ID NO: 349020 - protein, 10 aa, Influenza virus
IAWSSSSCHD

SEQ ID NO: 349021 - protein, 10 aa, Influenza virus
AWSSSSCHDG

SEQ ID NO: 349022 - protein, 10 aa, Influenza virus
WSSSSCHDGK

SEQ ID NO: 349023 - protein, 10 aa, Influenza virus
SSSSCHDGKA

SEQ ID NO: 349024 - protein, 10 aa, Influenza virus
SSSCHDGKAW

SEQ ID NO: 349025 - protein, 10 aa, Influenza virus
SSCHDGKAWL

SEQ ID NO: 349026 - protein, 10 aa, Influenza virus
SCHDGKAWLH

SEQ ID NO: 349027 - protein, 10 aa, Influenza virus
NILRTQESEC

SEQ ID NO: 349028 - protein, 10 aa, Influenza virus
ILRTQESECV

SEQ ID NO: 349029 - protein, 10 aa, Influenza virus
LRTQESECVC

SEQ ID NO: 349030 - protein, 10 aa, Influenza virus
RTQESECVCI

SEQ ID NO: 349031 - protein, 10 aa, Influenza virus
TQESECVCIN

SEQ ID NO: 349032 - protein, 10 aa, Influenza virus
CTVVMTDGSA

SEQ ID NO: 349033 - protein, 10 aa, Influenza virus
TVVMTDGSAS

SEQ ID NO: 349034 - protein, 10 aa, Influenza virus
IRKGLILEYY

SEQ ID NO: 349035 - protein, 10 aa, Influenza virus
RKGLILEYYS

SEQ ID NO: 349036 - protein, 10 aa, Influenza virus
GSAQHVEECS

SEQ ID NO: 349037 - protein, 10 aa, Influenza virus
SAQHVEECSC

SEQ ID NO: 349038 - protein, 10 aa, Influenza virus
AQHVEECSCY

SEQ ID NO: 349039 - protein, 10 aa, Influenza virus
QHVEECSCYP

SEQ ID NO: 349040 - protein, 10 aa, Influenza virus
HVEECSCYPR

SEQ ID NO: 349041 - protein, 10 aa, Influenza virus
SYPNVRCVCR

SEQ ID NO: 349042 - protein, 10 aa, Influenza virus
VRCVCRDNWK

SEQ ID NO: 349043 - protein, 10 aa, Influenza virus
RCVCRDNWKG

SEQ ID NO: 349044 - protein, 10 aa, Influenza virus
CVCRDNWKGS

SEQ ID NO: 349045 - protein, 10 aa, Influenza virus
VCRDNWKGSN

SEQ ID NO: 349046 - protein, 10 aa, Influenza virus
CRDNWKGSNR

SEQ ID NO: 349047 - protein, 10 aa, Influenza virus
RDNWKGSNRP

SEQ ID NO: 349048 - protein, 10 aa, Influenza virus
DNWKGSNRPI

SEQ ID NO: 349049 - protein, 10 aa, Influenza virus
KLDINMADYS

SEQ ID NO: 349050 - protein, 10 aa, Influenza virus
YVCSGLVGDT

SEQ ID NO: 349051 - protein, 10 aa, Influenza virus
VCSGLVGDTP

SEQ ID NO: 349052 - protein, 10 aa, Influenza virus
CSGLVGDTPR

SEQ ID NO: 349053 - protein, 10 aa, Influenza virus
SGLVGDTPRK

SEQ ID NO: 349054 - protein, 10 aa, Influenza virus
SGYSGIFSVE

SEQ ID NO: 349055 - protein, 10 aa, Influenza virus
CINRCFYVEL

SEQ ID NO: 349056 - protein, 10 aa, Influenza virus
INRCFYVELI

SEQ ID NO: 349057 - protein, 10 aa, Influenza virus
NRCFYVELIR

SEQ ID NO: 349058 - protein, 10 aa, Influenza virus
RCFYVELIRG

SEQ ID NO: 349059 - protein, 10 aa, Influenza virus
CFYVELIRGR

SEQ ID NO: 349060 - protein, 10 aa, Influenza virus
WTSNSIVVFC

SEQ ID NO: 349061 - protein, 10 aa, Influenza virus
TSNSIVVFCG

SEQ ID NO: 349062 - protein, 10 aa, Influenza virus
SNSIVVFCGT

SEQ ID NO: 349063 - protein, 10 aa, Influenza virus
NSIVVFCGTS

SEQ ID NO: 349064 - protein, 10 aa, Influenza virus
SIVVFCGTSG

SEQ ID NO: 349065 - protein, 10 aa, Influenza virus
IVVFCGTSGT

SEQ ID NO: 349066 - protein, 10 aa, Influenza virus
VVFCGTSGTY

SEQ ID NO: 349067 - protein, 10 aa, Influenza virus
VFCGTSGTYG

SEQ ID NO: 349068 - protein, 10 aa, Influenza virus
FCGTSGTYGT

SEQ ID NO: 349069 - protein, 10 aa, Influenza virus
CGTSGTYGTG

SEQ ID NO: 349070 - protein, 10 aa, Influenza virus
GTSGTYGTGS

SEQ ID NO: 349071 - protein, 10 aa, Influenza virus
TSGTYGTGSW

SEQ ID NO: 349072 - protein, 10 aa, Influenza virus
SGTYGTGSWP

SEQ ID NO: 349073 - protein, 10 aa, Influenza virus
GTYGTGSWPD

SEQ ID NO: 349074 - protein, 10 aa, Influenza virus
TYGTGSWPDG

SEQ ID NO: 349075 - protein, 10 aa, Influenza virus
YGTGSWPDGA

SEQ ID NO: 349076 - protein, 10 aa, Influenza virus
RTSISCLYKL

SEQ ID NO: 349077 - protein, 10 aa, Influenza virus
ADINLHAYIS

SEQ ID NO: 349078 - protein, 10 aa, Influenza virus
DINLHAYISF

SEQ ID NO: 349079 - protein, 10 aa, Influenza virus
INLHAYISFR

SEQ ID NO: 349080 - protein, 10 aa, Influenza virus
NLHAYISFRN

SEQ ID NO: 349081 - protein, 10 aa, Influenza virus
LHAYISFRNL

SEQ ID NO: 349082 - protein, 10 aa, Influenza virus
GNLVFNTVIH

SEQ ID NO: 349083 - protein, 10 aa, Influenza virus
LPLCPFRGFF

SEQ ID NO: 349084 - protein, 10 aa, Influenza virus
PLCPFRGFFP

SEQ ID NO: 349085 - protein, 10 aa, Influenza virus
LCPFRGFFPF

SEQ ID NO: 349086 - protein, 10 aa, Influenza virus
CPFRGFFPFH

SEQ ID NO: 349087 - protein, 10 aa, Influenza virus
PFRGFFPFHK

SEQ ID NO: 349088 - protein, 10 aa, Influenza virus
FRGFFPFHKD

SEQ ID NO: 349089 - protein, 10 aa, Influenza virus
RGFFPFHKDN

SEQ ID NO: 349090 - protein, 10 aa, Influenza virus
GFFPFHKDNA

SEQ ID NO: 349091 - protein, 10 aa, Influenza virus
FFPFHKDNAI

SEQ ID NO: 349092 - protein, 10 aa, Influenza virus
FPFHKDNAIR

SEQ ID NO: 349093 - protein, 10 aa, Influenza virus
PFHKDNAIRL

SEQ ID NO: 349094 - protein, 10 aa, Influenza virus
FHKDNAIRLG

SEQ ID NO: 349095 - protein, 10 aa, Influenza virus
HKDNAIRLGE

SEQ ID NO: 349096 - protein, 10 aa, Influenza virus
KDNAIRLGEN

SEQ ID NO: 349097 - protein, 10 aa, Influenza virus
IVTREPYVSC

SEQ ID NO: 349098 - protein, 10 aa, Influenza virus
VTREPYVSCD

SEQ ID NO: 349099 - protein, 10 aa, Influenza virus
TREPYVSCDN

SEQ ID NO: 349100 - protein, 10 aa, Influenza virus
NCWSFALAQG

SEQ ID NO: 349101 - protein, 10 aa, Influenza virus
CWSFALAQGA

SEQ ID NO: 349102 - protein, 10 aa, Influenza virus
WSFALAQGAL

SEQ ID NO: 349103 - protein, 10 aa, Influenza virus
SFALAQGALL

SEQ ID NO: 349104 - protein, 10 aa, Influenza virus
FALAQGALLG

SEQ ID NO: 349105 - protein, 10 aa, Influenza virus
ALAQGALLGT

SEQ ID NO: 349106 - protein, 10 aa, Influenza virus
LLGTKHSNGT

SEQ ID NO: 349107 - protein, 10 aa, Influenza virus
HSNGTIKDRT

SEQ ID NO: 349108 - protein, 10 aa, Influenza virus
KDRTPYRSLI

SEQ ID NO: 349109 - protein, 10 aa, Influenza virus
DRTPYRSLIR

SEQ ID NO: 349110 - protein, 10 aa, Influenza virus
RTPYRSLIRF

SEQ ID NO: 349111 - protein, 10 aa, Influenza virus
TPYRSLIRFP

SEQ ID NO: 349112 - protein, 10 aa, Influenza virus
YRSLIRFPIG

SEQ ID NO: 349113 - protein, 10 aa, Influenza virus
CIAWSSSSCF

SEQ ID NO: 349114 - protein, 10 aa, Influenza virus
IAWSSSSCFD

SEQ ID NO: 349115 - protein, 10 aa, Influenza virus
AWSSSSCFDG

SEQ ID NO: 349116 - protein, 10 aa, Influenza virus
WSSSSCFDGK

SEQ ID NO: 349117 - protein, 10 aa, Influenza virus
SSSSCFDGKE

SEQ ID NO: 349118 - protein, 10 aa, Influenza virus
SSSCFDGKEW

SEQ ID NO: 349119 - protein, 10 aa, Influenza virus
SSCFDGKEWM

SEQ ID NO: 349120 - protein, 10 aa, Influenza virus
SCFDGKEWMH

SEQ ID NO: 349121 - protein, 10 aa, Influenza virus
CFDGKEWMHV

SEQ ID NO: 349122 - protein, 10 aa, Influenza virus
FDGKEWMHVC

SEQ ID NO: 349123 - protein, 10 aa, Influenza virus
KDILRTQESE

SEQ ID NO: 349124 - protein, 10 aa, Influenza virus
DILRTQESEC

SEQ ID NO: 349125 - protein, 10 aa, Influenza virus
ILRTQESECQ

SEQ ID NO: 349126 - protein, 10 aa, Influenza virus
LRTQESECQC

SEQ ID NO: 349127 - protein, 10 aa, Influenza virus
RTQESECQCI

SEQ ID NO: 349128 - protein, 10 aa, Influenza virus
KIQHLEECSC

SEQ ID NO: 349129 - protein, 10 aa, Influenza virus
IQHLEECSCY

SEQ ID NO: 349130 - protein, 10 aa, Influenza virus
QHLEECSCYV

SEQ ID NO: 349131 - protein, 10 aa, Influenza virus
HLEECSCYVD

SEQ ID NO: 349132 - protein, 10 aa, Influenza virus
DVYCICRDNW

SEQ ID NO: 349133 - protein, 10 aa, Influenza virus
VYCICRDNWK

SEQ ID NO: 349134 - protein, 10 aa, Influenza virus
YCICRDNWKG

SEQ ID NO: 349135 - protein, 10 aa, Influenza virus
CICRDNWKGS

SEQ ID NO: 349136 - protein, 10 aa, Influenza virus
ICRDNWKGSN

SEQ ID NO: 349137 - protein, 10 aa, Influenza virus
CRDNWKGSNR

SEQ ID NO: 349138 - protein, 10 aa, Influenza virus
RDNWKGSNRP

SEQ ID NO: 349139 - protein, 10 aa, Influenza virus
DNWKGSNRPW

SEQ ID NO: 349140 - protein, 10 aa, Influenza virus
NWKGSNRPWM

SEQ ID NO: 349141 - protein, 10 aa, Influenza virus
WKGSNRPWMR

SEQ ID NO: 349142 - protein, 10 aa, Influenza virus
KGSNRPWMRI

SEQ ID NO: 349143 - protein, 10 aa, Influenza virus
GSNRPWMRIN

SEQ ID NO: 349144 - protein, 10 aa, Influenza virus
SNRPWMRINN

SEQ ID NO: 349145 - protein, 10 aa, Influenza virus
NRPWMRINNE

SEQ ID NO: 349146 - protein, 10 aa, Influenza virus
RPWMRINNET

SEQ ID NO: 349147 - protein, 10 aa, Influenza virus
PWMRINNETI

SEQ ID NO: 349148 - protein, 10 aa, Influenza virus
INNETILETG

SEQ ID NO: 349149 - protein, 10 aa, Influenza virus
NNETILETGY

SEQ ID NO: 349150 - protein, 10 aa, Influenza virus
NETILETGYV

SEQ ID NO: 349151 - protein, 10 aa, Influenza virus
ETILETGYVC

SEQ ID NO: 349152 - protein, 10 aa, Influenza virus
TILETGYVCS

SEQ ID NO: 349153 - protein, 10 aa, Influenza virus
ILETGYVCSK

SEQ ID NO: 349154 - protein, 10 aa, Influenza virus
LETGYVCSKF

SEQ ID NO: 349155 - protein, 10 aa, Influenza virus
ETGYVCSKFH

SEQ ID NO: 349156 - protein, 10 aa, Influenza virus
TGYVCSKFHS

SEQ ID NO: 349157 - protein, 10 aa, Influenza virus
GYVCSKFHSD

SEQ ID NO: 349158 - protein, 10 aa, Influenza virus
YVCSKFHSDT

SEQ ID NO: 349159 - protein, 10 aa, Influenza virus
VCSKFHSDTP

SEQ ID NO: 349160 - protein, 10 aa, Influenza virus
CSKFHSDTPR

SEQ ID NO: 349161 - protein, 10 aa, Influenza virus
SKFHSDTPRP

SEQ ID NO: 349162 - protein, 10 aa, Influenza virus
KFHSDTPRPA

SEQ ID NO: 349163 - protein, 10 aa, Influenza virus
FHSDTPRPAD

SEQ ID NO: 349164 - protein, 10 aa, Influenza virus
HSDTPRPADP

SEQ ID NO: 349165 - protein, 10 aa, Influenza virus
SDTPRPADPS

SEQ ID NO: 349166 - protein, 10 aa, Influenza virus
GNDVWLGRTV

SEQ ID NO: 349167 - protein, 10 aa, Influenza virus
NDVWLGRTVS

SEQ ID NO: 349168 - protein, 10 aa, Influenza virus
TQTLVSNNDW

SEQ ID NO: 349169 - protein, 10 aa, Influenza virus
QTLVSNNDWS

SEQ ID NO: 349170 - protein, 10 aa, Influenza virus
TLVSNNDWSG

SEQ ID NO: 349171 - protein, 10 aa, Influenza virus
LVSNNDWSGY

SEQ ID NO: 349172 - protein, 10 aa, Influenza virus
VSNNDWSGYS

SEQ ID NO: 349173 - protein, 10 aa, Influenza virus
SNNDWSGYSG

SEQ ID NO: 349174 - protein, 10 aa, Influenza virus
NNDWSGYSGS

SEQ ID NO: 349175 - protein, 10 aa, Influenza virus
NDWSGYSGSF

SEQ ID NO: 349176 - protein, 10 aa, Influenza virus
DWSGYSGSFI

SEQ ID NO: 349177 - protein, 10 aa, Influenza virus
WSGYSGSFIV

SEQ ID NO: 349178 - protein, 10 aa, Influenza virus
DCFQPCFYVE

SEQ ID NO: 349179 - protein, 10 aa, Influenza virus
CFQPCFYVEL

SEQ ID NO: 349180 - protein, 10 aa, Influenza virus
FQPCFYVELI

SEQ ID NO: 349181 - protein, 10 aa, Influenza virus
QPCFYVELIR

SEQ ID NO: 349182 - protein, 10 aa, Influenza virus
PCFYVELIRG

SEQ ID NO: 349183 - protein, 10 aa, Influenza virus
CFYVELIRGR

SEQ ID NO: 349184 - protein, 10 aa, Influenza virus
VSWTSNSIVT

SEQ ID NO: 349185 - protein, 10 aa, Influenza virus
SWTSNSIVTF

SEQ ID NO: 349186 - protein, 10 aa, Influenza virus
WTSNSIVTFC

SEQ ID NO: 349187 - protein, 10 aa, Influenza virus
TSNSIVTFCG

SEQ ID NO: 349188 - protein, 10 aa, Influenza virus
SNSIVTFCGL

SEQ ID NO: 349189 - protein, 10 aa, Influenza virus
NSIVTFCGLD

SEQ ID NO: 349190 - protein, 10 aa, Influenza virus
SIVTFCGLDN

SEQ ID NO: 349191 - protein, 10 aa, Influenza virus
IVTFCGLDNE

SEQ ID NO: 349192 - protein, 10 aa, Influenza virus
VTFCGLDNEP

SEQ ID NO: 349193 - protein, 10 aa, Influenza virus
TFCGLDNEPG

SEQ ID NO: 349194 - protein, 10 aa, Influenza virus
FCGLDNEPGS

SEQ ID NO: 349195 - protein, 10 aa, Influenza virus
CGLDNEPGSG

SEQ ID NO: 349196 - protein, 10 aa, Influenza virus
DNEPGSGNWP

SEQ ID NO: 349197 - protein, 10 aa, Influenza virus
NEPGSGNWPD

SEQ ID NO: 349198 - protein, 10 aa, Influenza virus
EPGSGNWPDG

SEQ ID NO: 349199 - protein, 10 aa, Influenza virus
PGSGNWPDGS

SEQ ID NO: 349200 - protein, 10 aa, Influenza virus
WPDGSNIGFM

SEQ ID NO: 349201 - protein, 10 aa, Influenza virus
PDGSNIGFMP

SEQ ID NO: 349202 - protein, 10 aa, Influenza virus
DGSNIGFMPK

SEQ ID NO: 349203 - protein, 10 aa, Influenza virus
MNPNQKIITI

SEQ ID NO: 349204 - protein, 10 aa, Influenza virus
NPNQKIITIG

SEQ ID NO: 349205 - protein, 10 aa, Influenza virus
PNQKIITIGS

SEQ ID NO: 349206 - protein, 10 aa, Influenza virus
LTTVGLLLQI

SEQ ID NO: 349207 - protein, 10 aa, Influenza virus
TTVGLLLQIT

SEQ ID NO: 349208 - protein, 10 aa, Influenza virus
TVGLLLQITS

SEQ ID NO: 349209 - protein, 10 aa, Influenza virus
VGLLLQITSL

SEQ ID NO: 349210 - protein, 10 aa, Influenza virus
GLLLQITSLC

SEQ ID NO: 349211 - protein, 10 aa, Influenza virus
LLLQITSLCS

SEQ ID NO: 349212 - protein, 10 aa, Influenza virus
LLQITSLCSI

SEQ ID NO: 349213 - protein, 10 aa, Influenza virus
LQITSLCSIW

SEQ ID NO: 349214 - protein, 10 aa, Influenza virus
QITSLCSIWF

SEQ ID NO: 349215 - protein, 10 aa, Influenza virus
ITSLCSIWFS

SEQ ID NO: 349216 - protein, 10 aa, Influenza virus
TSLCSIWFSH

SEQ ID NO: 349217 - protein, 10 aa, Influenza virus
SLCSIWFSHY

SEQ ID NO: 349218 - protein, 10 aa, Influenza virus
LCSIWFSHYN

SEQ ID NO: 349219 - protein, 10 aa, Influenza virus
CSIWFSHYNQ

SEQ ID NO: 349220 - protein, 10 aa, Influenza virus
SIWFSHYNQV

SEQ ID NO: 349221 - protein, 10 aa, Influenza virus
IWFSHYNQVT

SEQ ID NO: 349222 - protein, 10 aa, Influenza virus
WFSHYNQVTQ

SEQ ID NO: 349223 - protein, 10 aa, Influenza virus
FSHYNQVTQT

SEQ ID NO: 349224 - protein, 10 aa, Influenza virus
CSNNTTNYYN

SEQ ID NO: 349225 - protein, 10 aa, Influenza virus
SNNTTNYYNE

SEQ ID NO: 349226 - protein, 10 aa, Influenza virus
NNTTNYYNET

SEQ ID NO: 349227 - protein, 10 aa, Influenza virus
NTTNYYNETF

SEQ ID NO: 349228 - protein, 10 aa, Influenza virus
TTNYYNETFV

SEQ ID NO: 349229 - protein, 10 aa, Influenza virus
TNYYNETFVN

SEQ ID NO: 349230 - protein, 10 aa, Influenza virus
NYYNETFVNV

SEQ ID NO: 349231 - protein, 10 aa, Influenza virus
YYNETFVNVT

SEQ ID NO: 349232 - protein, 10 aa, Influenza virus
YNETFVNVTN

SEQ ID NO: 349233 - protein, 10 aa, Influenza virus
NETFVNVTNV

SEQ ID NO: 349234 - protein, 10 aa, Influenza virus
ETFVNVTNVQ

SEQ ID NO: 349235 - protein, 10 aa, Influenza virus
TFVNVTNVQN

SEQ ID NO: 349236 - protein, 10 aa, Influenza virus
FVNVTNVQNN

SEQ ID NO: 349237 - protein, 10 aa, Influenza virus
VNVTNVQNNY

SEQ ID NO: 349238 - protein, 10 aa, Influenza virus
NVTNVQNNYT

SEQ ID NO: 349239 - protein, 10 aa, Influenza virus
VTNVQNNYTT

SEQ ID NO: 349240 - protein, 10 aa, Influenza virus
TNVQNNYTTV

SEQ ID NO: 349241 - protein, 10 aa, Influenza virus
LCPIRGWAPL

SEQ ID NO: 349242 - protein, 10 aa, Influenza virus
CPIRGWAPLS

SEQ ID NO: 349243 - protein, 10 aa, Influenza virus
PIRGWAPLSK

SEQ ID NO: 349244 - protein, 10 aa, Influenza virus
IRGWAPLSKD

SEQ ID NO: 349245 - protein, 10 aa, Influenza virus
RGWAPLSKDN

SEQ ID NO: 349246 - protein, 10 aa, Influenza virus
GWAPLSKDNG

SEQ ID NO: 349247 - protein, 10 aa, Influenza virus
WAPLSKDNGI

SEQ ID NO: 349248 - protein, 10 aa, Influenza virus
APLSKDNGIR

SEQ ID NO: 349249 - protein, 10 aa, Influenza virus
PLSKDNGIRI

SEQ ID NO: 349250 - protein, 10 aa, Influenza virus
LSKDNGIRIG

SEQ ID NO: 349251 - protein, 10 aa, Influenza virus
SKDNGIRIGS

SEQ ID NO: 349252 - protein, 10 aa, Influenza virus
KDNGIRIGSR

SEQ ID NO: 349253 - protein, 10 aa, Influenza virus
DNGIRIGSRG

SEQ ID NO: 349254 - protein, 10 aa, Influenza virus
NGIRIGSRGE

SEQ ID NO: 349255 - protein, 10 aa, Influenza virus
GIRIGSRGEV

SEQ ID NO: 349256 - protein, 10 aa, Influenza virus
IRIGSRGEVF

SEQ ID NO: 349257 - protein, 10 aa, Influenza virus
RIGSRGEVFV

SEQ ID NO: 349258 - protein, 10 aa, Influenza virus
IGSRGEVFVI

SEQ ID NO: 349259 - protein, 10 aa, Influenza virus
GSRGEVFVIR

SEQ ID NO: 349260 - protein, 10 aa, Influenza virus
SRGEVFVIRE

SEQ ID NO: 349261 - protein, 10 aa, Influenza virus
RGEVFVIREP

SEQ ID NO: 349262 - protein, 10 aa, Influenza virus
GEVFVIREPF

SEQ ID NO: 349263 - protein, 10 aa, Influenza virus
EVFVIREPFI

SEQ ID NO: 349264 - protein, 10 aa, Influenza virus
VFVIREPFIS

SEQ ID NO: 349265 - protein, 10 aa, Influenza virus
FVIREPFISC

SEQ ID NO: 349266 - protein, 10 aa, Influenza virus
VIREPFISCS

SEQ ID NO: 349267 - protein, 10 aa, Influenza virus
IREPFISCSI

SEQ ID NO: 349268 - protein, 10 aa, Influenza virus
ISCSISECRT

SEQ ID NO: 349269 - protein, 10 aa, Influenza virus
SCSISECRTF

SEQ ID NO: 349270 - protein, 10 aa, Influenza virus
CSISECRTFF

SEQ ID NO: 349271 - protein, 10 aa, Influenza virus
SISECRTFFL

SEQ ID NO: 349272 - protein, 10 aa, Influenza virus
ISECRTFFLT

SEQ ID NO: 349273 - protein, 10 aa, Influenza virus
SECRTFFLTQ

SEQ ID NO: 349274 - protein, 10 aa, Influenza virus
ECRTFFLTQG

SEQ ID NO: 349275 - protein, 10 aa, Influenza virus
CRTFFLTQGA

SEQ ID NO: 349276 - protein, 10 aa, Influenza virus
RTFFLTQGAL

SEQ ID NO: 349277 - protein, 10 aa, Influenza virus
TFFLTQGALL

SEQ ID NO: 349278 - protein, 10 aa, Influenza virus
FFLTQGALLN

SEQ ID NO: 349279 - protein, 10 aa, Influenza virus
FLTQGALLND

SEQ ID NO: 349280 - protein, 10 aa, Influenza virus
LTQGALLNDK

SEQ ID NO: 349281 - protein, 10 aa, Influenza virus
TQGALLNDKH

SEQ ID NO: 349282 - protein, 10 aa, Influenza virus
QGALLNDKHS

SEQ ID NO: 349283 - protein, 10 aa, Influenza virus
GALLNDKHSN

SEQ ID NO: 349284 - protein, 10 aa, Influenza virus
ALLNDKHSNG

SEQ ID NO: 349285 - protein, 10 aa, Influenza virus
LLNDKHSNGT

SEQ ID NO: 349286 - protein, 10 aa, Influenza virus
LNDKHSNGTV

SEQ ID NO: 349287 - protein, 10 aa, Influenza virus
NDKHSNGTVK

SEQ ID NO: 349288 - protein, 10 aa, Influenza virus
DKHSNGTVKD

SEQ ID NO: 349289 - protein, 10 aa, Influenza virus
KHSNGTVKDR

SEQ ID NO: 349290 - protein, 10 aa, Influenza virus
HSNGTVKDRS

SEQ ID NO: 349291 - protein, 10 aa, Influenza virus
SNGTVKDRSP

SEQ ID NO: 349292 - protein, 10 aa, Influenza virus
NGTVKDRSPF

SEQ ID NO: 349293 - protein, 10 aa, Influenza virus
GTVKDRSPFR

SEQ ID NO: 349294 - protein, 10 aa, Influenza virus
TVKDRSPFRT

SEQ ID NO: 349295 - protein, 10 aa, Influenza virus
VKDRSPFRTL

SEQ ID NO: 349296 - protein, 10 aa, Influenza virus
KDRSPFRTLM

SEQ ID NO: 349297 - protein, 10 aa, Influenza virus
DRSPFRTLMS

SEQ ID NO: 349298 - protein, 10 aa, Influenza virus
RSPFRTLMSC

SEQ ID NO: 349299 - protein, 10 aa, Influenza virus
SPFRTLMSCP

SEQ ID NO: 349300 - protein, 10 aa, Influenza virus
PFRTLMSCPI

SEQ ID NO: 349301 - protein, 10 aa, Influenza virus
FRTLMSCPIG

SEQ ID NO: 349302 - protein, 10 aa, Influenza virus
RTLMSCPIGV

SEQ ID NO: 349303 - protein, 10 aa, Influenza virus
TLMSCPIGVA

SEQ ID NO: 349304 - protein, 10 aa, Influenza virus
LMSCPIGVAP

SEQ ID NO: 349305 - protein, 10 aa, Influenza virus
MSCPIGVAPS

SEQ ID NO: 349306 - protein, 10 aa, Influenza virus
SCPIGVAPSP

SEQ ID NO: 349307 - protein, 10 aa, Influenza virus
CPIGVAPSPS

SEQ ID NO: 349308 - protein, 10 aa, Influenza virus
PIGVAPSPSN

SEQ ID NO: 349309 - protein, 10 aa, Influenza virus
IGVAPSPSNS

SEQ ID NO: 349310 - protein, 10 aa, Influenza virus
GVAPSPSNSR

SEQ ID NO: 349311 - protein, 10 aa, Influenza virus
VAPSPSNSRF

SEQ ID NO: 349312 - protein, 10 aa, Influenza virus
APSPSNSRFE

SEQ ID NO: 349313 - protein, 10 aa, Influenza virus
PSPSNSRFES

SEQ ID NO: 349314 - protein, 10 aa, Influenza virus
SPSNSRFESV

SEQ ID NO: 349315 - protein, 10 aa, Influenza virus
PSNSRFESVA

SEQ ID NO: 349316 - protein, 10 aa, Influenza virus
SNSRFESVAW

SEQ ID NO: 349317 - protein, 10 aa, Influenza virus
NSRFESVAWS

SEQ ID NO: 349318 - protein, 10 aa, Influenza virus
SRFESVAWSA

SEQ ID NO: 349319 - protein, 10 aa, Influenza virus
RFESVAWSAT

SEQ ID NO: 349320 - protein, 10 aa, Influenza virus
FESVAWSATA

SEQ ID NO: 349321 - protein, 10 aa, Influenza virus
ESVAWSATAC

SEQ ID NO: 349322 - protein, 10 aa, Influenza virus
SVAWSATACS

SEQ ID NO: 349323 - protein, 10 aa, Influenza virus
VAWSATACSD

SEQ ID NO: 349324 - protein, 10 aa, Influenza virus
AWSATACSDG

SEQ ID NO: 349325 - protein, 10 aa, Influenza virus
WSATACSDGP

SEQ ID NO: 349326 - protein, 10 aa, Influenza virus
SATACSDGPG

SEQ ID NO: 349327 - protein, 10 aa, Influenza virus
ATACSDGPGW

SEQ ID NO: 349328 - protein, 10 aa, Influenza virus
TACSDGPGWL

SEQ ID NO: 349329 - protein, 10 aa, Influenza virus
ACSDGPGWLT

SEQ ID NO: 349330 - protein, 10 aa, Influenza virus
CSDGPGWLTL

SEQ ID NO: 349331 - protein, 10 aa, Influenza virus
SDGPGWLTLG

SEQ ID NO: 349332 - protein, 10 aa, Influenza virus
DGPGWLTLGI

SEQ ID NO: 349333 - protein, 10 aa, Influenza virus
GPGWLTLGIT

SEQ ID NO: 349334 - protein, 10 aa, Influenza virus
PGWLTLGITG

SEQ ID NO: 349335 - protein, 10 aa, Influenza virus
GWLTLGITGP

SEQ ID NO: 349336 - protein, 10 aa, Influenza virus
WLTLGITGPD

SEQ ID NO: 349337 - protein, 10 aa, Influenza virus
LTLGITGPDA

SEQ ID NO: 349338 - protein, 10 aa, Influenza virus
TLGITGPDAT

SEQ ID NO: 349339 - protein, 10 aa, Influenza virus
LGITGPDATA

SEQ ID NO: 349340 - protein, 10 aa, Influenza virus
GITGPDATAV

SEQ ID NO: 349341 - protein, 10 aa, Influenza virus
ITGPDATAVA

SEQ ID NO: 349342 - protein, 10 aa, Influenza virus
TGPDATAVAV

SEQ ID NO: 349343 - protein, 10 aa, Influenza virus
GPDATAVAVL

SEQ ID NO: 349344 - protein, 10 aa, Influenza virus
PDATAVAVLK

SEQ ID NO: 349345 - protein, 10 aa, Influenza virus
DATAVAVLKY

SEQ ID NO: 349346 - protein, 10 aa, Influenza virus
ATAVAVLKYN

SEQ ID NO: 349347 - protein, 10 aa, Influenza virus
TAVAVLKYNG

SEQ ID NO: 349348 - protein, 10 aa, Influenza virus
AVAVLKYNGI

SEQ ID NO: 349349 - protein, 10 aa, Influenza virus
VAVLKYNGII

SEQ ID NO: 349350 - protein, 10 aa, Influenza virus
AVLKYNGIIT

SEQ ID NO: 349351 - protein, 10 aa, Influenza virus
VLKYNGIITD

SEQ ID NO: 349352 - protein, 10 aa, Influenza virus
LKYNGIITDT

SEQ ID NO: 349353 - protein, 10 aa, Influenza virus
KYNGIITDTL

SEQ ID NO: 349354 - protein, 10 aa, Influenza virus
YNGIITDTLK

SEQ ID NO: 349355 - protein, 10 aa, Influenza virus
NGIITDTLKS

SEQ ID NO: 349356 - protein, 10 aa, Influenza virus
GIITDTLKSW

SEQ ID NO: 349357 - protein, 10 aa, Influenza virus
IITDTLKSWK

SEQ ID NO: 349358 - protein, 10 aa, Influenza virus
ITDTLKSWKG

SEQ ID NO: 349359 - protein, 10 aa, Influenza virus
TDTLKSWKGN

SEQ ID NO: 349360 - protein, 10 aa, Influenza virus
DTLKSWKGNI

SEQ ID NO: 349361 - protein, 10 aa, Influenza virus
TLKSWKGNIM

SEQ ID NO: 349362 - protein, 10 aa, Influenza virus
LKSWKGNIMR

SEQ ID NO: 349363 - protein, 10 aa, Influenza virus
KSWKGNIMRT

SEQ ID NO: 349364 - protein, 10 aa, Influenza virus
SWKGNIMRTQ

SEQ ID NO: 349365 - protein, 10 aa, Influenza virus
WKGNIMRTQE

SEQ ID NO: 349366 - protein, 10 aa, Influenza virus
KGNIMRTQES

SEQ ID NO: 349367 - protein, 10 aa, Influenza virus
GNIMRTQESE

SEQ ID NO: 349368 - protein, 10 aa, Influenza virus
NIMRTQESEC

SEQ ID NO: 349369 - protein, 10 aa, Influenza virus
IMRTQESECV

SEQ ID NO: 349370 - protein, 10 aa, Influenza virus
MRTQESECVC

SEQ ID NO: 349371 - protein, 10 aa, Influenza virus
RTQESECVCQ

SEQ ID NO: 349372 - protein, 10 aa, Influenza virus
TQESECVCQD

SEQ ID NO: 349373 - protein, 10 aa, Influenza virus
QESECVCQDE

SEQ ID NO: 349374 - protein, 10 aa, Influenza virus
ESECVCQDEF

SEQ ID NO: 349375 - protein, 10 aa, Influenza virus
SECVCQDEFC

SEQ ID NO: 349376 - protein, 10 aa, Influenza virus
ECVCQDEFCY

SEQ ID NO: 349377 - protein, 10 aa, Influenza virus
CVCQDEFCYT

SEQ ID NO: 349378 - protein, 10 aa, Influenza virus
VCQDEFCYTL

SEQ ID NO: 349379 - protein, 10 aa, Influenza virus
CQDEFCYTLI

SEQ ID NO: 349380 - protein, 10 aa, Influenza virus
QDEFCYTLIT

SEQ ID NO: 349381 - protein, 10 aa, Influenza virus
DEFCYTLITD

SEQ ID NO: 349382 - protein, 10 aa, Influenza virus
EFCYTLITDG

SEQ ID NO: 349383 - protein, 10 aa, Influenza virus
FCYTLITDGP

SEQ ID NO: 349384 - protein, 10 aa, Influenza virus
CYTLITDGPS

SEQ ID NO: 349385 - protein, 10 aa, Influenza virus
YTLITDGPSD

SEQ ID NO: 349386 - protein, 10 aa, Influenza virus
TLITDGPSDA

SEQ ID NO: 349387 - protein, 10 aa, Influenza virus
LITDGPSDAQ

SEQ ID NO: 349388 - protein, 10 aa, Influenza virus
ITDGPSDAQA

SEQ ID NO: 349389 - protein, 10 aa, Influenza virus
TDGPSDAQAF

SEQ ID NO: 349390 - protein, 10 aa, Influenza virus
DGPSDAQAFY

SEQ ID NO: 349391 - protein, 10 aa, Influenza virus
GPSDAQAFYK

SEQ ID NO: 349392 - protein, 10 aa, Influenza virus
PSDAQAFYKI

SEQ ID NO: 349393 - protein, 10 aa, Influenza virus
SDAQAFYKIL

SEQ ID NO: 349394 - protein, 10 aa, Influenza virus
DAQAFYKILK

SEQ ID NO: 349395 - protein, 10 aa, Influenza virus
AQAFYKILKI

SEQ ID NO: 349396 - protein, 10 aa, Influenza virus
QAFYKILKIR

SEQ ID NO: 349397 - protein, 10 aa, Influenza virus
AFYKILKIRK

SEQ ID NO: 349398 - protein, 10 aa, Influenza virus
FYKILKIRKG

SEQ ID NO: 349399 - protein, 10 aa, Influenza virus
YKILKIRKGK

SEQ ID NO: 349400 - protein, 10 aa, Influenza virus
KILKIRKGKI

SEQ ID NO: 349401 - protein, 10 aa, Influenza virus
ILKIRKGKIV

SEQ ID NO: 349402 - protein, 10 aa, Influenza virus
ATGFHFEECS

SEQ ID NO: 349403 - protein, 10 aa, Influenza virus
TGFHFEECSC

SEQ ID NO: 349404 - protein, 10 aa, Influenza virus
GFHFEECSCY

SEQ ID NO: 349405 - protein, 10 aa, Influenza virus
FHFEECSCYP

SEQ ID NO: 349406 - protein, 10 aa, Influenza virus
HFEECSCYPS

SEQ ID NO: 349407 - protein, 10 aa, Influenza virus
FEECSCYPSG

SEQ ID NO: 349408 - protein, 10 aa, Influenza virus
EECSCYPSGT

SEQ ID NO: 349409 - protein, 10 aa, Influenza virus
ECSCYPSGTD

SEQ ID NO: 349410 - protein, 10 aa, Influenza virus
DIECVCRDNW

SEQ ID NO: 349411 - protein, 10 aa, Influenza virus
IECVCRDNWR

SEQ ID NO: 349412 - protein, 10 aa, Influenza virus
ECVCRDNWRG

SEQ ID NO: 349413 - protein, 10 aa, Influenza virus
CVCRDNWRGS

SEQ ID NO: 349414 - protein, 10 aa, Influenza virus
VCRDNWRGSN

SEQ ID NO: 349415 - protein, 10 aa, Influenza virus
CRDNWRGSNR

SEQ ID NO: 349416 - protein, 10 aa, Influenza virus
RDNWRGSNRP

SEQ ID NO: 349417 - protein, 10 aa, Influenza virus
DNWRGSNRPW

SEQ ID NO: 349418 - protein, 10 aa, Influenza virus
NWRGSNRPWI

SEQ ID NO: 349419 - protein, 10 aa, Influenza virus
WRGSNRPWIR

SEQ ID NO: 349420 - protein, 10 aa, Influenza virus
RGSNRPWIRF

SEQ ID NO: 349421 - protein, 10 aa, Influenza virus
GSNRPWIRFN

SEQ ID NO: 349422 - protein, 10 aa, Influenza virus
SNRPWIRFNS

SEQ ID NO: 349423 - protein, 10 aa, Influenza virus
NRPWIRFNSD

SEQ ID NO: 349424 - protein, 10 aa, Influenza virus
RPWIRFNSDL

SEQ ID NO: 349425 - protein, 10 aa, Influenza virus
PWIRFNSDLD

SEQ ID NO: 349426 - protein, 10 aa, Influenza virus
WIRFNSDLDY

SEQ ID NO: 349427 - protein, 10 aa, Influenza virus
IRFNSDLDYQ

SEQ ID NO: 349428 - protein, 10 aa, Influenza virus
RFNSDLDYQI

SEQ ID NO: 349429 - protein, 10 aa, Influenza virus
FNSDLDYQIG

SEQ ID NO: 349430 - protein, 10 aa, Influenza virus
NSDLDYQIGY

SEQ ID NO: 349431 - protein, 10 aa, Influenza virus
SDLDYQIGYV

SEQ ID NO: 349432 - protein, 10 aa, Influenza virus
DLDYQIGYVC

SEQ ID NO: 349433 - protein, 10 aa, Influenza virus
LDYQIGYVCS

SEQ ID NO: 349434 - protein, 10 aa, Influenza virus
DYQIGYVCSG

SEQ ID NO: 349435 - protein, 10 aa, Influenza virus
YQIGYVCSGI

SEQ ID NO: 349436 - protein, 10 aa, Influenza virus
QIGYVCSGIF

SEQ ID NO: 349437 - protein, 10 aa, Influenza virus
IGYVCSGIFG

SEQ ID NO: 349438 - protein, 10 aa, Influenza virus
GYVCSGIFGD

SEQ ID NO: 349439 - protein, 10 aa, Influenza virus
YVCSGIFGDN

SEQ ID NO: 349440 - protein, 10 aa, Influenza virus
VCSGIFGDNP

SEQ ID NO: 349441 - protein, 10 aa, Influenza virus
CSGIFGDNPR

SEQ ID NO: 349442 - protein, 10 aa, Influenza virus
SGIFGDNPRP

SEQ ID NO: 349443 - protein, 10 aa, Influenza virus
FGDNPRPVDG

SEQ ID NO: 349444 - protein, 10 aa, Influenza virus
PRPVDGTGSC

SEQ ID NO: 349445 - protein, 10 aa, Influenza virus
SPVNNGKGRY

SEQ ID NO: 349446 - protein, 10 aa, Influenza virus
PVNNGKGRYG

SEQ ID NO: 349447 - protein, 10 aa, Influenza virus
VNNGKGRYGV

SEQ ID NO: 349448 - protein, 10 aa, Influenza virus
NNGKGRYGVK

SEQ ID NO: 349449 - protein, 10 aa, Influenza virus
NGKGRYGVKG

SEQ ID NO: 349450 - protein, 10 aa, Influenza virus
GKGRYGVKGF

SEQ ID NO: 349451 - protein, 10 aa, Influenza virus
KGRYGVKGFS

SEQ ID NO: 349452 - protein, 10 aa, Influenza virus
GRYGVKGFSF

SEQ ID NO: 349453 - protein, 10 aa, Influenza virus
RYGVKGFSFR

SEQ ID NO: 349454 - protein, 10 aa, Influenza virus
YGVKGFSFRY

SEQ ID NO: 349455 - protein, 10 aa, Influenza virus
GVKGFSFRYG

SEQ ID NO: 349456 - protein, 10 aa, Influenza virus
VKGFSFRYGD

SEQ ID NO: 349457 - protein, 10 aa, Influenza virus
KGFSFRYGDG

SEQ ID NO: 349458 - protein, 10 aa, Influenza virus
GFSFRYGDGV

SEQ ID NO: 349459 - protein, 10 aa, Influenza virus
FSFRYGDGVW

SEQ ID NO: 349460 - protein, 10 aa, Influenza virus
SFRYGDGVWI

SEQ ID NO: 349461 - protein, 10 aa, Influenza virus
FRYGDGVWIG

SEQ ID NO: 349462 - protein, 10 aa, Influenza virus
RYGDGVWIGR

SEQ ID NO: 349463 - protein, 10 aa, Influenza virus
YGDGVWIGRT

SEQ ID NO: 349464 - protein, 10 aa, Influenza virus
GDGVWIGRTK

SEQ ID NO: 349465 - protein, 10 aa, Influenza virus
DGVWIGRTKS

SEQ ID NO: 349466 - protein, 10 aa, Influenza virus
GVWIGRTKSL

SEQ ID NO: 349467 - protein, 10 aa, Influenza virus
VWIGRTKSLE

SEQ ID NO: 349468 - protein, 10 aa, Influenza virus
WIGRTKSLES

SEQ ID NO: 349469 - protein, 10 aa, Influenza virus
IGRTKSLESR

SEQ ID NO: 349470 - protein, 10 aa, Influenza virus
GRTKSLESRS

SEQ ID NO: 349471 - protein, 10 aa, Influenza virus
RTKSLESRSG

SEQ ID NO: 349472 - protein, 10 aa, Influenza virus
TKSLESRSGF

SEQ ID NO: 349473 - protein, 10 aa, Influenza virus
KSLESRSGFE

SEQ ID NO: 349474 - protein, 10 aa, Influenza virus
SLESRSGFEM

SEQ ID NO: 349475 - protein, 10 aa, Influenza virus
LESRSGFEMV

SEQ ID NO: 349476 - protein, 10 aa, Influenza virus
ESRSGFEMVW

SEQ ID NO: 349477 - protein, 10 aa, Influenza virus
SRSGFEMVWD

SEQ ID NO: 349478 - protein, 10 aa, Influenza virus
RSGFEMVWDA

SEQ ID NO: 349479 - protein, 10 aa, Influenza virus
SGFEMVWDAN

SEQ ID NO: 349480 - protein, 10 aa, Influenza virus
GFEMVWDANG

SEQ ID NO: 349481 - protein, 10 aa, Influenza virus
FEMVWDANGW

SEQ ID NO: 349482 - protein, 10 aa, Influenza virus
EMVWDANGWV

SEQ ID NO: 349483 - protein, 10 aa, Influenza virus
MVWDANGWVS

SEQ ID NO: 349484 - protein, 10 aa, Influenza virus
VWDANGWVST

SEQ ID NO: 349485 - protein, 10 aa, Influenza virus
WDANGWVSTD

SEQ ID NO: 349486 - protein, 10 aa, Influenza virus
DANGWVSTDK

SEQ ID NO: 349487 - protein, 10 aa, Influenza virus
ANGWVSTDKD

SEQ ID NO: 349488 - protein, 10 aa, Influenza virus
NGWVSTDKDS

SEQ ID NO: 349489 - protein, 10 aa, Influenza virus
GWVSTDKDSN

SEQ ID NO: 349490 - protein, 10 aa, Influenza virus
WVSTDKDSNG

SEQ ID NO: 349491 - protein, 10 aa, Influenza virus
VSTDKDSNGV

SEQ ID NO: 349492 - protein, 10 aa, Influenza virus
STDKDSNGVQ

SEQ ID NO: 349493 - protein, 10 aa, Influenza virus
TDKDSNGVQD

SEQ ID NO: 349494 - protein, 10 aa, Influenza virus
DKDSNGVQDI

SEQ ID NO: 349495 - protein, 10 aa, Influenza virus
KDSNGVQDII

SEQ ID NO: 349496 - protein, 10 aa, Influenza virus
DSNGVQDIID

SEQ ID NO: 349497 - protein, 10 aa, Influenza virus
SNGVQDIIDN

SEQ ID NO: 349498 - protein, 10 aa, Influenza virus
NGVQDIIDND

SEQ ID NO: 349499 - protein, 10 aa, Influenza virus
GVQDIIDNDN

SEQ ID NO: 349500 - protein, 10 aa, Influenza virus
VQDIIDNDNW

SEQ ID NO: 349501 - protein, 10 aa, Influenza virus
QDIIDNDNWS

SEQ ID NO: 349502 - protein, 10 aa, Influenza virus
DIIDNDNWSG

SEQ ID NO: 349503 - protein, 10 aa, Influenza virus
IIDNDNWSGY

SEQ ID NO: 349504 - protein, 10 aa, Influenza virus
IDNDNWSGYS

SEQ ID NO: 349505 - protein, 10 aa, Influenza virus
DNDNWSGYSG

SEQ ID NO: 349506 - protein, 10 aa, Influenza virus
NDNWSGYSGS

SEQ ID NO: 349507 - protein, 10 aa, Influenza virus
DNWSGYSGSF

SEQ ID NO: 349508 - protein, 10 aa, Influenza virus
NWSGYSGSFS

SEQ ID NO: 349509 - protein, 10 aa, Influenza virus
WSGYSGSFSI

SEQ ID NO: 349510 - protein, 10 aa, Influenza virus
SGYSGSFSIR

SEQ ID NO: 349511 - protein, 10 aa, Influenza virus
GYSGSFSIRG

SEQ ID NO: 349512 - protein, 10 aa, Influenza virus
YSGSFSIRGE

SEQ ID NO: 349513 - protein, 10 aa, Influenza virus
SGSFSIRGET

SEQ ID NO: 349514 - protein, 10 aa, Influenza virus
GSFSIRGETT

SEQ ID NO: 349515 - protein, 10 aa, Influenza virus
SFSIRGETTG

SEQ ID NO: 349516 - protein, 10 aa, Influenza virus
FSIRGETTGR

SEQ ID NO: 349517 - protein, 10 aa, Influenza virus
SIRGETTGRN

SEQ ID NO: 349518 - protein, 10 aa, Influenza virus
IRGETTGRNC

SEQ ID NO: 349519 - protein, 10 aa, Influenza virus
RGETTGRNCT

SEQ ID NO: 349520 - protein, 10 aa, Influenza virus
GETTGRNCTV

SEQ ID NO: 349521 - protein, 10 aa, Influenza virus
ETTGRNCTVP

SEQ ID NO: 349522 - protein, 10 aa, Influenza virus
TTGRNCTVPC

SEQ ID NO: 349523 - protein, 10 aa, Influenza virus
TGRNCTVPCF

SEQ ID NO: 349524 - protein, 10 aa, Influenza virus
GRNCTVPCFW

SEQ ID NO: 349525 - protein, 10 aa, Influenza virus
RNCTVPCFWV

SEQ ID NO: 349526 - protein, 10 aa, Influenza virus
NCTVPCFWVE

SEQ ID NO: 349527 - protein, 10 aa, Influenza virus
CTVPCFWVEM

SEQ ID NO: 349528 - protein, 10 aa, Influenza virus
TVPCFWVEMI

SEQ ID NO: 349529 - protein, 10 aa, Influenza virus
VPCFWVEMIR

SEQ ID NO: 349530 - protein, 10 aa, Influenza virus
PCFWVEMIRG

SEQ ID NO: 349531 - protein, 10 aa, Influenza virus
CFWVEMIRGQ

SEQ ID NO: 349532 - protein, 10 aa, Influenza virus
FWVEMIRGQP

SEQ ID NO: 349533 - protein, 10 aa, Influenza virus
WVEMIRGQPK

SEQ ID NO: 349534 - protein, 10 aa, Influenza virus
VEMIRGQPKE

SEQ ID NO: 349535 - protein, 10 aa, Influenza virus
EMIRGQPKEK

SEQ ID NO: 349536 - protein, 10 aa, Influenza virus
MIRGQPKEKT

SEQ ID NO: 349537 - protein, 10 aa, Influenza virus
IRGQPKEKTI

SEQ ID NO: 349538 - protein, 10 aa, Influenza virus
RGQPKEKTIW

SEQ ID NO: 349539 - protein, 10 aa, Influenza virus
GQPKEKTIWT

SEQ ID NO: 349540 - protein, 10 aa, Influenza virus
QPKEKTIWTS

SEQ ID NO: 349541 - protein, 10 aa, Influenza virus
PKEKTIWTSG

SEQ ID NO: 349542 - protein, 10 aa, Influenza virus
KEKTIWTSGS

SEQ ID NO: 349543 - protein, 10 aa, Influenza virus
EKTIWTSGSS

SEQ ID NO: 349544 - protein, 10 aa, Influenza virus
KTIWTSGSSI

SEQ ID NO: 349545 - protein, 10 aa, Influenza virus
TIWTSGSSIA

SEQ ID NO: 349546 - protein, 10 aa, Influenza virus
IWTSGSSIAF

SEQ ID NO: 349547 - protein, 10 aa, Influenza virus
WTSGSSIAFC

SEQ ID NO: 349548 - protein, 10 aa, Influenza virus
TSGSSIAFCG

SEQ ID NO: 349549 - protein, 10 aa, Influenza virus
SGSSIAFCGV

SEQ ID NO: 349550 - protein, 10 aa, Influenza virus
GSSIAFCGVN

SEQ ID NO: 349551 - protein, 10 aa, Influenza virus
SSIAFCGVNS

SEQ ID NO: 349552 - protein, 10 aa, Influenza virus
SIAFCGVNSD

SEQ ID NO: 349553 - protein, 10 aa, Influenza virus
IAFCGVNSDT

SEQ ID NO: 349554 - protein, 10 aa, Influenza virus
AFCGVNSDTT

SEQ ID NO: 349555 - protein, 10 aa, Influenza virus
FCGVNSDTTG

SEQ ID NO: 349556 - protein, 10 aa, Influenza virus
CGVNSDTTGW

SEQ ID NO: 349557 - protein, 10 aa, Influenza virus
SDTTGWSWPD

SEQ ID NO: 349558 - protein, 10 aa, Influenza virus
DTTGWSWPDG

SEQ ID NO: 349559 - protein, 10 aa, Influenza virus
TTGWSWPDGA

SEQ ID NO: 349560 - protein, 10 aa, Influenza virus
TGWSWPDGAL

SEQ ID NO: 349561 - protein, 10 aa, Influenza virus
GWSWPDGALL

SEQ ID NO: 349562 - protein, 10 aa, Influenza virus
WSWPDGALLP

SEQ ID NO: 349563 - protein, 10 aa, Influenza virus
SWPDGALLPF

SEQ ID NO: 349564 - protein, 10 aa, Influenza virus
WPDGALLPFD

SEQ ID NO: 349565 - protein, 10 aa, Influenza virus
PDGALLPFDI

SEQ ID NO: 349566 - protein, 10 aa, Influenza virus
DGALLPFDID

SEQ ID NO: 349567 - protein, 10 aa, Influenza virus
GALLPFDIDK

SEQ ID NO: 349568 - protein, 10 aa, Influenza virus
MNPNQKIITI

SEQ ID NO: 349569 - protein, 10 aa, Influenza virus
NPNQKIITIG

SEQ ID NO: 349570 - protein, 10 aa, Influenza virus
PNQKIITIGS

SEQ ID NO: 349571 - protein, 10 aa, Influenza virus
NQKIITIGSV

SEQ ID NO: 349572 - protein, 10 aa, Influenza virus
QKIITIGSVS

SEQ ID NO: 349573 - protein, 10 aa, Influenza virus
KIITIGSVSL

SEQ ID NO: 349574 - protein, 10 aa, Influenza virus
IITIGSVSLA

SEQ ID NO: 349575 - protein, 10 aa, Influenza virus
TTEVYNETVR

SEQ ID NO: 349576 - protein, 10 aa, Influenza virus
TEIYNETVRL

SEQ ID NO: 349577 - protein, 10 aa, Influenza virus
EFLNNTEPLC

SEQ ID NO: 349578 - protein, 10 aa, Influenza virus
FLNNTEPLCN

SEQ ID NO: 349579 - protein, 10 aa, Influenza virus
LNNTEPLCNV

SEQ ID NO: 349580 - protein, 10 aa, Influenza virus
NNTEPLCNVS

SEQ ID NO: 349581 - protein, 10 aa, Influenza virus
NTEPLCNVSG

SEQ ID NO: 349582 - protein, 10 aa, Influenza virus
TEPLCNVSGF

SEQ ID NO: 349583 - protein, 10 aa, Influenza virus
EPLCNVSGFA

SEQ ID NO: 349584 - protein, 10 aa, Influenza virus
PLCNVSGFAI

SEQ ID NO: 349585 - protein, 10 aa, Influenza virus
SGFAIVSKDN

SEQ ID NO: 349586 - protein, 10 aa, Influenza virus
GFAIVSKDNG

SEQ ID NO: 349587 - protein, 10 aa, Influenza virus
FAIVSKDNGI

SEQ ID NO: 349588 - protein, 10 aa, Influenza virus
AIVSKDNGIR

SEQ ID NO: 349589 - protein, 10 aa, Influenza virus
IVSKDNGIRI

SEQ ID NO: 349590 - protein, 10 aa, Influenza virus
VSKDNGIRIG

SEQ ID NO: 349591 - protein, 10 aa, Influenza virus
SKDNGIRIGS

SEQ ID NO: 349592 - protein, 10 aa, Influenza virus
KDNGIRIGSR

SEQ ID NO: 349593 - protein, 10 aa, Influenza virus
DNGIRIGSRG

SEQ ID NO: 349594 - protein, 10 aa, Influenza virus
NGIRIGSRGH

SEQ ID NO: 349595 - protein, 10 aa, Influenza virus
GIRIGSRGHV

SEQ ID NO: 349596 - protein, 10 aa, Influenza virus
IRIGSRGHVF

SEQ ID NO: 349597 - protein, 10 aa, Influenza virus
RIGSRGHVFV

SEQ ID NO: 349598 - protein, 10 aa, Influenza virus
IGSRGHVFVI

SEQ ID NO: 349599 - protein, 10 aa, Influenza virus
GSRGHVFVIR

SEQ ID NO: 349600 - protein, 10 aa, Influenza virus
SRGHVFVIRE

SEQ ID NO: 349601 - protein, 10 aa, Influenza virus
RGHVFVIREP

SEQ ID NO: 349602 - protein, 10 aa, Influenza virus
GHVFVIREPF

SEQ ID NO: 349603 - protein, 10 aa, Influenza virus
HVFVIREPFV

SEQ ID NO: 349604 - protein, 10 aa, Influenza virus
VFVIREPFVA

SEQ ID NO: 349605 - protein, 10 aa, Influenza virus
FVIREPFVAC

SEQ ID NO: 349606 - protein, 10 aa, Influenza virus
VIREPFVACG

SEQ ID NO: 349607 - protein, 10 aa, Influenza virus
IREPFVACGP

SEQ ID NO: 349608 - protein, 10 aa, Influenza virus
REPFVACGPT

SEQ ID NO: 349609 - protein, 10 aa, Influenza virus
EPFVACGPTE

SEQ ID NO: 349610 - protein, 10 aa, Influenza virus
PFVACGPTEC

SEQ ID NO: 349611 - protein, 10 aa, Influenza virus
FVACGPTECR

SEQ ID NO: 349612 - protein, 10 aa, Influenza virus
VACGPTECRT

SEQ ID NO: 349613 - protein, 10 aa, Influenza virus
ACGPTECRTF

SEQ ID NO: 349614 - protein, 10 aa, Influenza virus
CGPTECRTFF

SEQ ID NO: 349615 - protein, 10 aa, Influenza virus
GPTECRTFFL

SEQ ID NO: 349616 - protein, 10 aa, Influenza virus
PTECRTFFLT

SEQ ID NO: 349617 - protein, 10 aa, Influenza virus
TECRTFFLTQ

SEQ ID NO: 349618 - protein, 10 aa, Influenza virus
ECRTFFLTQG

SEQ ID NO: 349619 - protein, 10 aa, Influenza virus
CRTFFLTQGA

SEQ ID NO: 349620 - protein, 10 aa, Influenza virus
RTFFLTQGAL

SEQ ID NO: 349621 - protein, 10 aa, Influenza virus
TFFLTQGALL

SEQ ID NO: 349622 - protein, 10 aa, Influenza virus
FFLTQGALLN

SEQ ID NO: 349623 - protein, 10 aa, Influenza virus
FLTQGALLND

SEQ ID NO: 349624 - protein, 10 aa, Influenza virus
LTQGALLNDK

SEQ ID NO: 349625 - protein, 10 aa, Influenza virus
TQGALLNDKH

SEQ ID NO: 349626 - protein, 10 aa, Influenza virus
QGALLNDKHS

SEQ ID NO: 349627 - protein, 10 aa, Influenza virus
GALLNDKHSN

SEQ ID NO: 349628 - protein, 10 aa, Influenza virus
ALLNDKHSNN

SEQ ID NO: 349629 - protein, 10 aa, Influenza virus
LLNDKHSNNT

SEQ ID NO: 349630 - protein, 10 aa, Influenza virus
LNDKHSNNTV

SEQ ID NO: 349631 - protein, 10 aa, Influenza virus
NDKHSNNTVK

SEQ ID NO: 349632 - protein, 10 aa, Influenza virus
DKHSNNTVKD

SEQ ID NO: 349633 - protein, 10 aa, Influenza virus
KHSNNTVKDR

SEQ ID NO: 349634 - protein, 10 aa, Influenza virus
HSNNTVKDRS

SEQ ID NO: 349635 - protein, 10 aa, Influenza virus
SNNTVKDRSP

SEQ ID NO: 349636 - protein, 10 aa, Influenza virus
NNTVKDRSPY

SEQ ID NO: 349637 - protein, 10 aa, Influenza virus
NTVKDRSPYR

SEQ ID NO: 349638 - protein, 10 aa, Influenza virus
TVKDRSPYRA

SEQ ID NO: 349639 - protein, 10 aa, Influenza virus
VKDRSPYRAL

SEQ ID NO: 349640 - protein, 10 aa, Influenza virus
KDRSPYRALM

SEQ ID NO: 349641 - protein, 10 aa, Influenza virus
DRSPYRALMS

SEQ ID NO: 349642 - protein, 10 aa, Influenza virus
RSPYRALMSV

SEQ ID NO: 349643 - protein, 10 aa, Influenza virus
SPYRALMSVP

SEQ ID NO: 349644 - protein, 10 aa, Influenza virus
PYRALMSVPL

SEQ ID NO: 349645 - protein, 10 aa, Influenza virus
YRALMSVPLG

SEQ ID NO: 349646 - protein, 10 aa, Influenza virus
RALMSVPLGS

SEQ ID NO: 349647 - protein, 10 aa, Influenza virus
ALMSVPLGSS

SEQ ID NO: 349648 - protein, 10 aa, Influenza virus
LMSVPLGSSP

SEQ ID NO: 349649 - protein, 10 aa, Influenza virus
MSVPLGSSPN

SEQ ID NO: 349650 - protein, 10 aa, Influenza virus
SVPLGSSPNA

SEQ ID NO: 349651 - protein, 10 aa, Influenza virus
VPLGSSPNAY

SEQ ID NO: 349652 - protein, 10 aa, Influenza virus
PLGSSPNAYQ

SEQ ID NO: 349653 - protein, 10 aa, Influenza virus
LGSSPNAYQA

SEQ ID NO: 349654 - protein, 10 aa, Influenza virus
GSSPNAYQAK

SEQ ID NO: 349655 - protein, 10 aa, Influenza virus
SSPNAYQAKF

SEQ ID NO: 349656 - protein, 10 aa, Influenza virus
SPNAYQAKFE

SEQ ID NO: 349657 - protein, 10 aa, Influenza virus
PNAYQAKFES

SEQ ID NO: 349658 - protein, 10 aa, Influenza virus
NAYQAKFESV

SEQ ID NO: 349659 - protein, 10 aa, Influenza virus
FESVAWSATA

SEQ ID NO: 349660 - protein, 10 aa, Influenza virus
ESVAWSATAC

SEQ ID NO: 349661 - protein, 10 aa, Influenza virus
SVAWSATACH

SEQ ID NO: 349662 - protein, 10 aa, Influenza virus
VAWSATACHD

SEQ ID NO: 349663 - protein, 10 aa, Influenza virus
AWSATACHDG

SEQ ID NO: 349664 - protein, 10 aa, Influenza virus
WSATACHDGK

SEQ ID NO: 349665 - protein, 10 aa, Influenza virus
SATACHDGKE

SEQ ID NO: 349666 - protein, 10 aa, Influenza virus
ATACHDGKEW

SEQ ID NO: 349667 - protein, 10 aa, Influenza virus
TACHDGKEWL

SEQ ID NO: 349668 - protein, 10 aa, Influenza virus
GISGADDDAY

SEQ ID NO: 349669 - protein, 10 aa, Influenza virus
ISGADDDAYA

SEQ ID NO: 349670 - protein, 10 aa, Influenza virus
SGADDDAYAV

SEQ ID NO: 349671 - protein, 10 aa, Influenza virus
GADDDAYAVI

SEQ ID NO: 349672 - protein, 10 aa, Influenza virus
ADDDAYAVIH

SEQ ID NO: 349673 - protein, 10 aa, Influenza virus
DDDAYAVIHY

SEQ ID NO: 349674 - protein, 10 aa, Influenza virus
DDAYAVIHYG

SEQ ID NO: 349675 - protein, 10 aa, Influenza virus
DAYAVIHYGG

SEQ ID NO: 349676 - protein, 10 aa, Influenza virus
AYAVIHYGGM

SEQ ID NO: 349677 - protein, 10 aa, Influenza virus
YAVIHYGGMP

SEQ ID NO: 349678 - protein, 10 aa, Influenza virus
AVIHYGGMPT

SEQ ID NO: 349679 - protein, 10 aa, Influenza virus
VIHYGGMPTD

SEQ ID NO: 349680 - protein, 10 aa, Influenza virus
IHYGGMPTDV

SEQ ID NO: 349681 - protein, 10 aa, Influenza virus
HYGGMPTDVV

SEQ ID NO: 349682 - protein, 10 aa, Influenza virus
YGGMPTDVVR

SEQ ID NO: 349683 - protein, 10 aa, Influenza virus
GGMPTDVVRS

SEQ ID NO: 349684 - protein, 10 aa, Influenza virus
GMPTDVVRSW

SEQ ID NO: 349685 - protein, 10 aa, Influenza virus
PTDVVRSWRK

SEQ ID NO: 349686 - protein, 10 aa, Influenza virus
TDVVRSWRKQ

SEQ ID NO: 349687 - protein, 10 aa, Influenza virus
DVVRSWRKQI

SEQ ID NO: 349688 - protein, 10 aa, Influenza virus
VVRSWRKQIL

SEQ ID NO: 349689 - protein, 10 aa, Influenza virus
VRSWRKQILR

SEQ ID NO: 349690 - protein, 10 aa, Influenza virus
RSWRKQILRT

SEQ ID NO: 349691 - protein, 10 aa, Influenza virus
SWRKQILRTQ

SEQ ID NO: 349692 - protein, 10 aa, Influenza virus
WRKQILRTQE

SEQ ID NO: 349693 - protein, 10 aa, Influenza virus
RKQILRTQES

SEQ ID NO: 349694 - protein, 10 aa, Influenza virus
KQILRTQESS

SEQ ID NO: 349695 - protein, 10 aa, Influenza virus
QILRTQESSC

SEQ ID NO: 349696 - protein, 10 aa, Influenza virus
ILRTQESSCV

SEQ ID NO: 349697 - protein, 10 aa, Influenza virus
LRTQESSCVC

SEQ ID NO: 349698 - protein, 10 aa, Influenza virus
RTQESSCVCM

SEQ ID NO: 349699 - protein, 10 aa, Influenza virus
TQESSCVCMK

SEQ ID NO: 349700 - protein, 10 aa, Influenza virus
QESSCVCMKG

SEQ ID NO: 349701 - protein, 10 aa, Influenza virus
CYWVMTDGPA

SEQ ID NO: 349702 - protein, 10 aa, Influenza virus
YWVMTDGPAN

SEQ ID NO: 349703 - protein, 10 aa, Influenza virus
WVMTDGPANN

SEQ ID NO: 349704 - protein, 10 aa, Influenza virus
VMTDGPANNQ

SEQ ID NO: 349705 - protein, 10 aa, Influenza virus
MTDGPANNQA

SEQ ID NO: 349706 - protein, 10 aa, Influenza virus
TDGPANNQAS

SEQ ID NO: 349707 - protein, 10 aa, Influenza virus
DGPANNQASY

SEQ ID NO: 349708 - protein, 10 aa, Influenza virus
GPANNQASYK

SEQ ID NO: 349709 - protein, 10 aa, Influenza virus
PANNQASYKI

SEQ ID NO: 349710 - protein, 10 aa, Influenza virus
ANNQASYKIF

SEQ ID NO: 349711 - protein, 10 aa, Influenza virus
NNQASYKIFK

SEQ ID NO: 349712 - protein, 10 aa, Influenza virus
NQASYKIFKS

SEQ ID NO: 349713 - protein, 10 aa, Influenza virus
QASYKIFKSH

SEQ ID NO: 349714 - protein, 10 aa, Influenza virus
EVSFQGGHIE

SEQ ID NO: 349715 - protein, 10 aa, Influenza virus
VSFQGGHIEE

SEQ ID NO: 349716 - protein, 10 aa, Influenza virus
SFQGGHIEEC

SEQ ID NO: 349717 - protein, 10 aa, Influenza virus
FQGGHIEECS

SEQ ID NO: 349718 - protein, 10 aa, Influenza virus
QGGHIEECSC

SEQ ID NO: 349719 - protein, 10 aa, Influenza virus
GGHIEECSCY

SEQ ID NO: 349720 - protein, 10 aa, Influenza virus
GHIEECSCYP

SEQ ID NO: 349721 - protein, 10 aa, Influenza virus
HIEECSCYPN

SEQ ID NO: 349722 - protein, 10 aa, Influenza virus
IEECSCYPNL

SEQ ID NO: 349723 - protein, 10 aa, Influenza virus
EECSCYPNLG

SEQ ID NO: 349724 - protein, 10 aa, Influenza virus
ECSCYPNLGK

SEQ ID NO: 349725 - protein, 10 aa, Influenza virus
CSCYPNLGKV

SEQ ID NO: 349726 - protein, 10 aa, Influenza virus
SCYPNLGKVE

SEQ ID NO: 349727 - protein, 10 aa, Influenza virus
CYPNLGKVEC

SEQ ID NO: 349728 - protein, 10 aa, Influenza virus
YPNLGKVECV

SEQ ID NO: 349729 - protein, 10 aa, Influenza virus
PNLGKVECVC

SEQ ID NO: 349730 - protein, 10 aa, Influenza virus
NLGKVECVCR

SEQ ID NO: 349731 - protein, 10 aa, Influenza virus
LGKVECVCRD

SEQ ID NO: 349732 - protein, 10 aa, Influenza virus
GKVECVCRDN

SEQ ID NO: 349733 - protein, 10 aa, Influenza virus
KVECVCRDNW

SEQ ID NO: 349734 - protein, 10 aa, Influenza virus
VECVCRDNWN

SEQ ID NO: 349735 - protein, 10 aa, Influenza virus
ECVCRDNWNG

SEQ ID NO: 349736 - protein, 10 aa, Influenza virus
CVCRDNWNGM

SEQ ID NO: 349737 - protein, 10 aa, Influenza virus
VCRDNWNGMN

SEQ ID NO: 349738 - protein, 10 aa, Influenza virus
CRDNWNGMNR

SEQ ID NO: 349739 - protein, 10 aa, Influenza virus
RDNWNGMNRP

SEQ ID NO: 349740 - protein, 10 aa, Influenza virus
DNWNGMNRPI

SEQ ID NO: 349741 - protein, 10 aa, Influenza virus
NWNGMNRPIL

SEQ ID NO: 349742 - protein, 10 aa, Influenza virus
YEVGYLCAGI

SEQ ID NO: 349743 - protein, 10 aa, Influenza virus
EVGYLCAGIP

SEQ ID NO: 349744 - protein, 10 aa, Influenza virus
VGYLCAGIPT

SEQ ID NO: 349745 - protein, 10 aa, Influenza virus
GYLCAGIPTD

SEQ ID NO: 349746 - protein, 10 aa, Influenza virus
YLCAGIPTDT

SEQ ID NO: 349747 - protein, 10 aa, Influenza virus
LCAGIPTDTP

SEQ ID NO: 349748 - protein, 10 aa, Influenza virus
CAGIPTDTPR

SEQ ID NO: 349749 - protein, 10 aa, Influenza virus
AGIPTDTPRV

SEQ ID NO: 349750 - protein, 10 aa, Influenza virus
GIPTDTPRVQ

SEQ ID NO: 349751 - protein, 10 aa, Influenza virus
IPTDTPRVQD

SEQ ID NO: 349752 - protein, 10 aa, Influenza virus
PTDTPRVQDS

SEQ ID NO: 349753 - protein, 10 aa, Influenza virus
AVGGSGTNNY

SEQ ID NO: 349754 - protein, 10 aa, Influenza virus
VGGSGTNNYG

SEQ ID NO: 349755 - protein, 10 aa, Influenza virus
GGSGTNNYGV

SEQ ID NO: 349756 - protein, 10 aa, Influenza virus
GSGTNNYGVK

SEQ ID NO: 349757 - protein, 10 aa, Influenza virus
SGTNNYGVKG

SEQ ID NO: 349758 - protein, 10 aa, Influenza virus
GTNNYGVKGF

SEQ ID NO: 349759 - protein, 10 aa, Influenza virus
TNNYGVKGFG

SEQ ID NO: 349760 - protein, 10 aa, Influenza virus
NNYGVKGFGF

SEQ ID NO: 349761 - protein, 10 aa, Influenza virus
NYGVKGFGFR

SEQ ID NO: 349762 - protein, 10 aa, Influenza virus
YGVKGFGFRQ

SEQ ID NO: 349763 - protein, 10 aa, Influenza virus
GVKGFGFRQG

SEQ ID NO: 349764 - protein, 10 aa, Influenza virus
VKGFGFRQGN

SEQ ID NO: 349765 - protein, 10 aa, Influenza virus
KGFGFRQGNS

SEQ ID NO: 349766 - protein, 10 aa, Influenza virus
GFGFRQGNSV

SEQ ID NO: 349767 - protein, 10 aa, Influenza virus
FGFRQGNSVW

SEQ ID NO: 349768 - protein, 10 aa, Influenza virus
GFRQGNSVWA

SEQ ID NO: 349769 - protein, 10 aa, Influenza virus
FRQGNSVWAG

SEQ ID NO: 349770 - protein, 10 aa, Influenza virus
RQGNSVWAGR

SEQ ID NO: 349771 - protein, 10 aa, Influenza virus
QGNSVWAGRT

SEQ ID NO: 349772 - protein, 10 aa, Influenza virus
GNSVWAGRTV

SEQ ID NO: 349773 - protein, 10 aa, Influenza virus
SSRSGFEILL

SEQ ID NO: 349774 - protein, 10 aa, Influenza virus
SRSGFEILLI

SEQ ID NO: 349775 - protein, 10 aa, Influenza virus
RSGFEILLIE

SEQ ID NO: 349776 - protein, 10 aa, Influenza virus
SGFEILLIED

SEQ ID NO: 349777 - protein, 10 aa, Influenza virus
GFEILLIEDG

SEQ ID NO: 349778 - protein, 10 aa, Influenza virus
FEILLIEDGW

SEQ ID NO: 349779 - protein, 10 aa, Influenza virus
EVLNNKNWSG

SEQ ID NO: 349780 - protein, 10 aa, Influenza virus
VLNNKNWSGY

SEQ ID NO: 349781 - protein, 10 aa, Influenza virus
LNNKNWSGYS

SEQ ID NO: 349782 - protein, 10 aa, Influenza virus
NNKNWSGYSG

SEQ ID NO: 349783 - protein, 10 aa, Influenza virus
NKNWSGYSGA

SEQ ID NO: 349784 - protein, 10 aa, Influenza virus
KNWSGYSGAF

SEQ ID NO: 349785 - protein, 10 aa, Influenza virus
NWSGYSGAFT

SEQ ID NO: 349786 - protein, 10 aa, Influenza virus
WSGYSGAFTI

SEQ ID NO: 349787 - protein, 10 aa, Influenza virus
SGYSGAFTIP

SEQ ID NO: 349788 - protein, 10 aa, Influenza virus
GYSGAFTIPI

SEQ ID NO: 349789 - protein, 10 aa, Influenza virus
CLVPCFWLEM

SEQ ID NO: 349790 - protein, 10 aa, Influenza virus
LVPCFWLEMI

SEQ ID NO: 349791 - protein, 10 aa, Influenza virus
VPCFWLEMIR

SEQ ID NO: 349792 - protein, 10 aa, Influenza virus
PCFWLEMIRG

SEQ ID NO: 349793 - protein, 10 aa, Influenza virus
CFWLEMIRGK

SEQ ID NO: 349794 - protein, 10 aa, Influenza virus
FWLEMIRGKP

SEQ ID NO: 349795 - protein, 10 aa, Influenza virus
WLEMIRGKPE

SEQ ID NO: 349796 - protein, 10 aa, Influenza virus
LEMIRGKPEE

SEQ ID NO: 349797 - protein, 10 aa, Influenza virus
EMIRGKPEER

SEQ ID NO: 349798 - protein, 10 aa, Influenza virus
PEERTSIWTS

SEQ ID NO: 349799 - protein, 10 aa, Influenza virus
EERTSIWTSS

SEQ ID NO: 349800 - protein, 10 aa, Influenza virus
ERTSIWTSSS

SEQ ID NO: 349801 - protein, 10 aa, Influenza virus
RTSIWTSSSS

SEQ ID NO: 349802 - protein, 10 aa, Influenza virus
TSIWTSSSST

SEQ ID NO: 349803 - protein, 10 aa, Influenza virus
SIWTSSSSTV

SEQ ID NO: 349804 - protein, 10 aa, Influenza virus
IWTSSSSTVF

SEQ ID NO: 349805 - protein, 10 aa, Influenza virus
WTSSSSTVFC

SEQ ID NO: 349806 - protein, 10 aa, Influenza virus
TSSSSTVFCG

SEQ ID NO: 349807 - protein, 10 aa, Influenza virus
SSSSTVFCGV

SEQ ID NO: 349808 - protein, 10 aa, Influenza virus
SSSTVFCGVS

SEQ ID NO: 349809 - protein, 10 aa, Influenza virus
SSTVFCGVSS

SEQ ID NO: 349810 - protein, 10 aa, Influenza virus
STVFCGVSSE

SEQ ID NO: 349811 - protein, 10 aa, Influenza virus
TVFCGVSSEV

SEQ ID NO: 349812 - protein, 10 aa, Influenza virus
VFCGVSSEVP

SEQ ID NO: 349813 - protein, 10 aa, Influenza virus
FCGVSSEVPG

SEQ ID NO: 349814 - protein, 10 aa, Influenza virus
CGVSSEVPGW

SEQ ID NO: 349815 - protein, 10 aa, Influenza virus
GVSSEVPGWS

SEQ ID NO: 349816 - protein, 10 aa, Influenza virus
VSSEVPGWSW

SEQ ID NO: 349817 - protein, 10 aa, Influenza virus
SSEVPGWSWD

SEQ ID NO: 349818 - protein, 10 aa, Influenza virus
SEVPGWSWDD

SEQ ID NO: 349819 - protein, 10 aa, Influenza virus
EVPGWSWDDG

SEQ ID NO: 349820 - protein, 10 aa, Influenza virus
VPGWSWDDGA

SEQ ID NO: 349821 - protein, 10 aa, Influenza virus
PGWSWDDGAI

SEQ ID NO: 349822 - protein, 10 aa, Influenza virus
GWSWDDGAIL

SEQ ID NO: 349823 - protein, 10 aa, Influenza virus
WSWDDGAILP

SEQ ID NO: 349824 - protein, 10 aa, Influenza virus
SWDDGAILPF

SEQ ID NO: 349825 - protein, 10 aa, Influenza virus
WDDGAILPFD

SEQ ID NO: 349826 - protein, 10 aa, Influenza virus
DDGAILPFDI

SEQ ID NO: 349827 - protein, 10 aa, Influenza virus
DGAILPFDID

SEQ ID NO: 349828 - protein, 10 aa, Influenza virus
GAILPFDIDK

SEQ ID NO: 349829 - protein, 10 aa, Influenza virus
AILPFDIDKM

SEQ ID NO: 349830 - protein, 10 aa, Influenza virus
MNPNQKIICI

SEQ ID NO: 349831 - protein, 10 aa, Influenza virus
NPNQKIICIS

SEQ ID NO: 349832 - protein, 10 aa, Influenza virus
PNQKIICISA

SEQ ID NO: 349833 - protein, 10 aa, Influenza virus
CISATGMTLS

SEQ ID NO: 349834 - protein, 10 aa, Influenza virus
ISATGMTLSV

SEQ ID NO: 349835 - protein, 10 aa, Influenza virus
SATGMTLSVV

SEQ ID NO: 349836 - protein, 10 aa, Influenza virus
TGMTLSVVSL

SEQ ID NO: 349837 - protein, 10 aa, Influenza virus
GMTLSVVSLL

SEQ ID NO: 349838 - protein, 10 aa, Influenza virus
GLANLGLNIG

SEQ ID NO: 349839 - protein, 10 aa, Influenza virus
ANLGLNIGLH

SEQ ID NO: 349840 - protein, 10 aa, Influenza virus
TTTTIINNNT

SEQ ID NO: 349841 - protein, 10 aa, Influenza virus
KPLCEVNSWH

SEQ ID NO: 349842 - protein, 10 aa, Influenza virus
PLCEVNSWHI

SEQ ID NO: 349843 - protein, 10 aa, Influenza virus
LCEVNSWHIL

SEQ ID NO: 349844 - protein, 10 aa, Influenza virus
CEVNSWHILS

SEQ ID NO: 349845 - protein, 10 aa, Influenza virus
EVNSWHILSK

SEQ ID NO: 349846 - protein, 10 aa, Influenza virus
VNSWHILSKD

SEQ ID NO: 349847 - protein, 10 aa, Influenza virus
NSWHILSKDN

SEQ ID NO: 349848 - protein, 10 aa, Influenza virus
SWHILSKDNA

SEQ ID NO: 349849 - protein, 10 aa, Influenza virus
WHILSKDNAI

SEQ ID NO: 349850 - protein, 10 aa, Influenza virus
HILSKDNAIR

SEQ ID NO: 349851 - protein, 10 aa, Influenza virus
ILSKDNAIRI

SEQ ID NO: 349852 - protein, 10 aa, Influenza virus
LSKDNAIRIG

SEQ ID NO: 349853 - protein, 10 aa, Influenza virus
SKDNAIRIGE

SEQ ID NO: 349854 - protein, 10 aa, Influenza virus
KDNAIRIGED

SEQ ID NO: 349855 - protein, 10 aa, Influenza virus
DNAIRIGEDA

SEQ ID NO: 349856 - protein, 10 aa, Influenza virus
NAIRIGEDAH

SEQ ID NO: 349857 - protein, 10 aa, Influenza virus
DAHILVTREP

SEQ ID NO: 349858 - protein, 10 aa, Influenza virus
AHILVTREPY

SEQ ID NO: 349859 - protein, 10 aa, Influenza virus
HILVTREPYL

SEQ ID NO: 349860 - protein, 10 aa, Influenza virus
ILVTREPYLS

SEQ ID NO: 349861 - protein, 10 aa, Influenza virus
LVTREPYLSC

SEQ ID NO: 349862 - protein, 10 aa, Influenza virus
VTREPYLSCG

SEQ ID NO: 349863 - protein, 10 aa, Influenza virus
TREPYLSCGP

SEQ ID NO: 349864 - protein, 10 aa, Influenza virus
ECRMFALSQG

SEQ ID NO: 349865 - protein, 10 aa, Influenza virus
CRMFALSQGT

SEQ ID NO: 349866 - protein, 10 aa, Influenza virus
RMFALSQGTT

SEQ ID NO: 349867 - protein, 10 aa, Influenza virus
MFALSQGTTL

SEQ ID NO: 349868 - protein, 10 aa, Influenza virus
FALSQGTTLR

SEQ ID NO: 349869 - protein, 10 aa, Influenza virus
ALSQGTTLRG

SEQ ID NO: 349870 - protein, 10 aa, Influenza virus
LSQGTTLRGR

SEQ ID NO: 349871 - protein, 10 aa, Influenza virus
SQGTTLRGRH

SEQ ID NO: 349872 - protein, 10 aa, Influenza virus
QGTTLRGRHA

SEQ ID NO: 349873 - protein, 10 aa, Influenza virus
GTTLRGRHAN

SEQ ID NO: 349874 - protein, 10 aa, Influenza virus
TTLRGRHANG

SEQ ID NO: 349875 - protein, 10 aa, Influenza virus
TLRGRHANGT

SEQ ID NO: 349876 - protein, 10 aa, Influenza virus
LRGRHANGTI

SEQ ID NO: 349877 - protein, 10 aa, Influenza virus
RGRHANGTIH

SEQ ID NO: 349878 - protein, 10 aa, Influenza virus
GRHANGTIHD

SEQ ID NO: 349879 - protein, 10 aa, Influenza virus
RHANGTIHDR

SEQ ID NO: 349880 - protein, 10 aa, Influenza virus
HANGTIHDRS

SEQ ID NO: 349881 - protein, 10 aa, Influenza virus
ANGTIHDRSP

SEQ ID NO: 349882 - protein, 10 aa, Influenza virus
NGTIHDRSPF

SEQ ID NO: 349883 - protein, 10 aa, Influenza virus
GTIHDRSPFR

SEQ ID NO: 349884 - protein, 10 aa, Influenza virus
TIHDRSPFRA

SEQ ID NO: 349885 - protein, 10 aa, Influenza virus
IHDRSPFRAL

SEQ ID NO: 349886 - protein, 10 aa, Influenza virus
HDRSPFRALI

SEQ ID NO: 349887 - protein, 10 aa, Influenza virus
DRSPFRALIS

SEQ ID NO: 349888 - protein, 10 aa, Influenza virus
RSPFRALISW

SEQ ID NO: 349889 - protein, 10 aa, Influenza virus
SPFRALISWE

SEQ ID NO: 349890 - protein, 10 aa, Influenza virus
PFRALISWEM

SEQ ID NO: 349891 - protein, 10 aa, Influenza virus
FRALISWEMG

SEQ ID NO: 349892 - protein, 10 aa, Influenza virus
RALISWEMGQ

SEQ ID NO: 349893 - protein, 10 aa, Influenza virus
ALISWEMGQA

SEQ ID NO: 349894 - protein, 10 aa, Influenza virus
LISWEMGQAP

SEQ ID NO: 349895 - protein, 10 aa, Influenza virus
ISWEMGQAPS

SEQ ID NO: 349896 - protein, 10 aa, Influenza virus
SWEMGQAPSP

SEQ ID NO: 349897 - protein, 10 aa, Influenza virus
WEMGQAPSPY

SEQ ID NO: 349898 - protein, 10 aa, Influenza virus
EMGQAPSPYN

SEQ ID NO: 349899 - protein, 10 aa, Influenza virus
VECVGWSSTS

SEQ ID NO: 349900 - protein, 10 aa, Influenza virus
ECVGWSSTSC

SEQ ID NO: 349901 - protein, 10 aa, Influenza virus
CVGWSSTSCH

SEQ ID NO: 349902 - protein, 10 aa, Influenza virus
VGWSSTSCHD

SEQ ID NO: 349903 - protein, 10 aa, Influenza virus
GWSSTSCHDG

SEQ ID NO: 349904 - protein, 10 aa, Influenza virus
WSSTSCHDGI

SEQ ID NO: 349905 - protein, 10 aa, Influenza virus
SSTSCHDGIS

SEQ ID NO: 349906 - protein, 10 aa, Influenza virus
STSCHDGISR

SEQ ID NO: 349907 - protein, 10 aa, Influenza virus
TSCHDGISRM

SEQ ID NO: 349908 - protein, 10 aa, Influenza virus
SCHDGISRMS

SEQ ID NO: 349909 - protein, 10 aa, Influenza virus
SRMSICMSGP

SEQ ID NO: 349910 - protein, 10 aa, Influenza virus
RMSICMSGPN

SEQ ID NO: 349911 - protein, 10 aa, Influenza virus
MSICMSGPNN

SEQ ID NO: 349912 - protein, 10 aa, Influenza virus
SICMSGPNNN

SEQ ID NO: 349913 - protein, 10 aa, Influenza virus
ICMSGPNNNA

SEQ ID NO: 349914 - protein, 10 aa, Influenza virus
CMSGPNNNAS

SEQ ID NO: 349915 - protein, 10 aa, Influenza virus
MSGPNNNASA

SEQ ID NO: 349916 - protein, 10 aa, Influenza virus
SGPNNNASAV

SEQ ID NO: 349917 - protein, 10 aa, Influenza virus
GPNNNASAVV

SEQ ID NO: 349918 - protein, 10 aa, Influenza virus
PNNNASAVVW

SEQ ID NO: 349919 - protein, 10 aa, Influenza virus
NNNASAVVWY

SEQ ID NO: 349920 - protein, 10 aa, Influenza virus
TEIASWAGNI

SEQ ID NO: 349921 - protein, 10 aa, Influenza virus
EIASWAGNIL

SEQ ID NO: 349922 - protein, 10 aa, Influenza virus
IASWAGNILR

SEQ ID NO: 349923 - protein, 10 aa, Influenza virus
ASWAGNILRT

SEQ ID NO: 349924 - protein, 10 aa, Influenza virus
SWAGNILRTQ

SEQ ID NO: 349925 - protein, 10 aa, Influenza virus
WAGNILRTQE

SEQ ID NO: 349926 - protein, 10 aa, Influenza virus
AGNILRTQES

SEQ ID NO: 349927 - protein, 10 aa, Influenza virus
GNILRTQESE

SEQ ID NO: 349928 - protein, 10 aa, Influenza virus
NILRTQESEC

SEQ ID NO: 349929 - protein, 10 aa, Influenza virus
ILRTQESECV

SEQ ID NO: 349930 - protein, 10 aa, Influenza virus
LRTQESECVC

SEQ ID NO: 349931 - protein, 10 aa, Influenza virus
RTQESECVCH

SEQ ID NO: 349932 - protein, 10 aa, Influenza virus
TQESECVCHN

SEQ ID NO: 349933 - protein, 10 aa, Influenza virus
QESECVCHNG

SEQ ID NO: 349934 - protein, 10 aa, Influenza virus
ESECVCHNGI

SEQ ID NO: 349935 - protein, 10 aa, Influenza virus
SECVCHNGIC

SEQ ID NO: 349936 - protein, 10 aa, Influenza virus
ECVCHNGICP

SEQ ID NO: 349937 - protein, 10 aa, Influenza virus
CVCHNGICPV

SEQ ID NO: 349938 - protein, 10 aa, Influenza virus
VCHNGICPVV

SEQ ID NO: 349939 - protein, 10 aa, Influenza virus
GICPVVMTDG

SEQ ID NO: 349940 - protein, 10 aa, Influenza virus
ICPVVMTDGP

SEQ ID NO: 349941 - protein, 10 aa, Influenza virus
CPVVMTDGPA

SEQ ID NO: 349942 - protein, 10 aa, Influenza virus
PVVMTDGPAN

SEQ ID NO: 349943 - protein, 10 aa, Influenza virus
GSAQHIEECS

SEQ ID NO: 349944 - protein, 10 aa, Influenza virus
SAQHIEECSC

SEQ ID NO: 349945 - protein, 10 aa, Influenza virus
AQHIEECSCY

SEQ ID NO: 349946 - protein, 10 aa, Influenza virus
QHIEECSCYG

SEQ ID NO: 349947 - protein, 10 aa, Influenza virus
HIEECSCYGA

SEQ ID NO: 349948 - protein, 10 aa, Influenza virus
IKCICRDNWK

SEQ ID NO: 349949 - protein, 10 aa, Influenza virus
KCICRDNWKG

SEQ ID NO: 349950 - protein, 10 aa, Influenza virus
CICRDNWKGA

SEQ ID NO: 349951 - protein, 10 aa, Influenza virus
ICRDNWKGAN

SEQ ID NO: 349952 - protein, 10 aa, Influenza virus
CRDNWKGANR

SEQ ID NO: 349953 - protein, 10 aa, Influenza virus
RDNWKGANRP

SEQ ID NO: 349954 - protein, 10 aa, Influenza virus
DNWKGANRPV

SEQ ID NO: 349955 - protein, 10 aa, Influenza virus
NWKGANRPVI

SEQ ID NO: 349956 - protein, 10 aa, Influenza virus
WKGANRPVIT

SEQ ID NO: 349957 - protein, 10 aa, Influenza virus
KGANRPVITI

SEQ ID NO: 349958 - protein, 10 aa, Influenza virus
GANRPVITIN

SEQ ID NO: 349959 - protein, 10 aa, Influenza virus
MTHTSKYLCS

SEQ ID NO: 349960 - protein, 10 aa, Influenza virus
YLCSKILTDT

SEQ ID NO: 349961 - protein, 10 aa, Influenza virus
LCSKILTDTS

SEQ ID NO: 349962 - protein, 10 aa, Influenza virus
CSKILTDTSR

SEQ ID NO: 349963 - protein, 10 aa, Influenza virus
SKILTDTSRP

SEQ ID NO: 349964 - protein, 10 aa, Influenza virus
LTDTSRPNDP

SEQ ID NO: 349965 - protein, 10 aa, Influenza virus
GGSPDPGVKG

SEQ ID NO: 349966 - protein, 10 aa, Influenza virus
GSPDPGVKGF

SEQ ID NO: 349967 - protein, 10 aa, Influenza virus
SPDPGVKGFA

SEQ ID NO: 349968 - protein, 10 aa, Influenza virus
PDPGVKGFAF

SEQ ID NO: 349969 - protein, 10 aa, Influenza virus
DPGVKGFAFL

SEQ ID NO: 349970 - protein, 10 aa, Influenza virus
PGVKGFAFLD

SEQ ID NO: 349971 - protein, 10 aa, Influenza virus
GVKGFAFLDG

SEQ ID NO: 349972 - protein, 10 aa, Influenza virus
NSWLGRTISK

SEQ ID NO: 349973 - protein, 10 aa, Influenza virus
SWLGRTISKD

SEQ ID NO: 349974 - protein, 10 aa, Influenza virus
WLGRTISKDS

SEQ ID NO: 349975 - protein, 10 aa, Influenza virus
LGRTISKDSR

SEQ ID NO: 349976 - protein, 10 aa, Influenza virus
GRTISKDSRS

SEQ ID NO: 349977 - protein, 10 aa, Influenza virus
RTISKDSRSG

SEQ ID NO: 349978 - protein, 10 aa, Influenza virus
TISKDSRSGY

SEQ ID NO: 349979 - protein, 10 aa, Influenza virus
ISKDSRSGYE

SEQ ID NO: 349980 - protein, 10 aa, Influenza virus
DSRSGYEMLK

SEQ ID NO: 349981 - protein, 10 aa, Influenza virus
SRSGYEMLKV

SEQ ID NO: 349982 - protein, 10 aa, Influenza virus
RSGYEMLKVP

SEQ ID NO: 349983 - protein, 10 aa, Influenza virus
SGYEMLKVPN

SEQ ID NO: 349984 - protein, 10 aa, Influenza virus
GYEMLKVPNA

SEQ ID NO: 349985 - protein, 10 aa, Influenza virus
YEMLKVPNAE

SEQ ID NO: 349986 - protein, 10 aa, Influenza virus
IVNNQNWSGY

SEQ ID NO: 349987 - protein, 10 aa, Influenza virus
VNNQNWSGYS

SEQ ID NO: 349988 - protein, 10 aa, Influenza virus
NNQNWSGYSG

SEQ ID NO: 349989 - protein, 10 aa, Influenza virus
NQNWSGYSGA

SEQ ID NO: 349990 - protein, 10 aa, Influenza virus
QNWSGYSGAF

SEQ ID NO: 349991 - protein, 10 aa, Influenza virus
NWSGYSGAFI

SEQ ID NO: 349992 - protein, 10 aa, Influenza virus
WSGYSGAFID

SEQ ID NO: 349993 - protein, 10 aa, Influenza virus
SGYSGAFIDY

SEQ ID NO: 349994 - protein, 10 aa, Influenza virus
GYSGAFIDYW

SEQ ID NO: 349995 - protein, 10 aa, Influenza virus
RECFNPCFYV

SEQ ID NO: 349996 - protein, 10 aa, Influenza virus
ECFNPCFYVE

SEQ ID NO: 349997 - protein, 10 aa, Influenza virus
CFNPCFYVEL

SEQ ID NO: 349998 - protein, 10 aa, Influenza virus
FNPCFYVELI

SEQ ID NO: 349999 - protein, 10 aa, Influenza virus
NPCFYVELIR

SEQ ID NO: 350000 - protein, 10 aa, Influenza virus
PCFYVELIRG

SEQ ID NO: 350001 - protein, 10 aa, Influenza virus
CFYVELIRGR

SEQ ID NO: 350002 - protein, 10 aa, Influenza virus
FYVELIRGRP

SEQ ID NO: 350003 - protein, 10 aa, Influenza virus
YVELIRGRPK

SEQ ID NO: 350004 - protein, 10 aa, Influenza virus
VELIRGRPKE

SEQ ID NO: 350005 - protein, 10 aa, Influenza virus
ELIRGRPKES

SEQ ID NO: 350006 - protein, 10 aa, Influenza virus
VLWTSNSIVA

SEQ ID NO: 350007 - protein, 10 aa, Influenza virus
LWTSNSIVAL

SEQ ID NO: 350008 - protein, 10 aa, Influenza virus
WTSNSIVALC

SEQ ID NO: 350009 - protein, 10 aa, Influenza virus
TSNSIVALCG

SEQ ID NO: 350010 - protein, 10 aa, Influenza virus
SNSIVALCGS

SEQ ID NO: 350011 - protein, 10 aa, Influenza virus
NSIVALCGSK

SEQ ID NO: 350012 - protein, 10 aa, Influenza virus
SIVALCGSKE

SEQ ID NO: 350013 - protein, 10 aa, Influenza virus
IVALCGSKER

SEQ ID NO: 350014 - protein, 10 aa, Influenza virus
VALCGSKERL

SEQ ID NO: 350015 - protein, 10 aa, Influenza virus
ALCGSKERLG

SEQ ID NO: 350016 - protein, 10 aa, Influenza virus
LCGSKERLGS

SEQ ID NO: 350017 - protein, 10 aa, Influenza virus
CGSKERLGSW

SEQ ID NO: 350018 - protein, 10 aa, Influenza virus
GSKERLGSWS

SEQ ID NO: 350019 - protein, 10 aa, Influenza virus
SKERLGSWSW

SEQ ID NO: 350020 - protein, 10 aa, Influenza virus
KERLGSWSWH

SEQ ID NO: 350021 - protein, 10 aa, Influenza virus
ERLGSWSWHD

SEQ ID NO: 350022 - protein, 10 aa, Influenza virus
RLGSWSWHDG

SEQ ID NO: 350023 - protein, 10 aa, Influenza virus
LGSWSWHDGA

SEQ ID NO: 350024 - protein, 10 aa, Influenza virus
GSWSWHDGAE

SEQ ID NO: 350025 - protein, 10 aa, Influenza virus
SWSWHDGAEI

SEQ ID NO: 350026 - protein, 10 aa, Influenza virus
WSWHDGAEII

SEQ ID NO: 350027 - protein, 10 aa, Influenza virus
SWHDGAEIIY

SEQ ID NO: 350028 - protein, 10 aa, Influenza virus
WHDGAEIIYF

SEQ ID NO: 350029 - protein, 10 aa, Influenza virus
HDGAEIIYFK

SEQ ID NO: 350030 - protein, 10 aa, Influenza virus
MNPNQKLFAL

SEQ ID NO: 350031 - protein, 10 aa, Influenza virus
NPNQKLFALS

SEQ ID NO: 350032 - protein, 10 aa, Influenza virus
PNQKLFALSG

SEQ ID NO: 350033 - protein, 10 aa, Influenza virus
NQKLFALSGV

SEQ ID NO: 350034 - protein, 10 aa, Influenza virus
QKLFALSGVA

SEQ ID NO: 350035 - protein, 10 aa, Influenza virus
KLFALSGVAI

SEQ ID NO: 350036 - protein, 10 aa, Influenza virus
NLLIGISNVG

SEQ ID NO: 350037 - protein, 10 aa, Influenza virus
LLIGISNVGL

SEQ ID NO: 350038 - protein, 10 aa, Influenza virus
LIGISNVGLN

SEQ ID NO: 350039 - protein, 10 aa, Influenza virus
SNVGLNVSLH

SEQ ID NO: 350040 - protein, 10 aa, Influenza virus
NVGLNVSLHL

SEQ ID NO: 350041 - protein, 10 aa, Influenza virus
ENTYVNNTTV

SEQ ID NO: 350042 - protein, 10 aa, Influenza virus
NTYVNNTTVI

SEQ ID NO: 350043 - protein, 10 aa, Influenza virus
YLMLNKSLCK

SEQ ID NO: 350044 - protein, 10 aa, Influenza virus
LMLNKSLCKV

SEQ ID NO: 350045 - protein, 10 aa, Influenza virus
GWVVVAKDNA

SEQ ID NO: 350046 - protein, 10 aa, Influenza virus
WVVVAKDNAI

SEQ ID NO: 350047 - protein, 10 aa, Influenza virus
VVVAKDNAIR

SEQ ID NO: 350048 - protein, 10 aa, Influenza virus
VVAKDNAIRF

SEQ ID NO: 350049 - protein, 10 aa, Influenza virus
VAKDNAIRFG

SEQ ID NO: 350050 - protein, 10 aa, Influenza virus
AKDNAIRFGE

SEQ ID NO: 350051 - protein, 10 aa, Influenza virus
KDNAIRFGES

SEQ ID NO: 350052 - protein, 10 aa, Influenza virus
DNAIRFGESE

SEQ ID NO: 350053 - protein, 10 aa, Influenza virus
NAIRFGESEQ

SEQ ID NO: 350054 - protein, 10 aa, Influenza virus
AIRFGESEQI

SEQ ID NO: 350055 - protein, 10 aa, Influenza virus
IRFGESEQII

SEQ ID NO: 350056 - protein, 10 aa, Influenza virus
RFGESEQIIV

SEQ ID NO: 350057 - protein, 10 aa, Influenza virus
FGESEQIIVT

SEQ ID NO: 350058 - protein, 10 aa, Influenza virus
GESEQIIVTR

SEQ ID NO: 350059 - protein, 10 aa, Influenza virus
ESEQIIVTRE

SEQ ID NO: 350060 - protein, 10 aa, Influenza virus
SEQIIVTREP

SEQ ID NO: 350061 - protein, 10 aa, Influenza virus
EQIIVTREPY

SEQ ID NO: 350062 - protein, 10 aa, Influenza virus
QIIVTREPYV

SEQ ID NO: 350063 - protein, 10 aa, Influenza virus
IIVTREPYVS

SEQ ID NO: 350064 - protein, 10 aa, Influenza virus
IVTREPYVSC

SEQ ID NO: 350065 - protein, 10 aa, Influenza virus
VTREPYVSCD

SEQ ID NO: 350066 - protein, 10 aa, Influenza virus
TREPYVSCDP

SEQ ID NO: 350067 - protein, 10 aa, Influenza virus
REPYVSCDPL

SEQ ID NO: 350068 - protein, 10 aa, Influenza virus
GCKMYALHQG

SEQ ID NO: 350069 - protein, 10 aa, Influenza virus
CKMYALHQGT

SEQ ID NO: 350070 - protein, 10 aa, Influenza virus
KMYALHQGTT

SEQ ID NO: 350071 - protein, 10 aa, Influenza virus
MYALHQGTTI

SEQ ID NO: 350072 - protein, 10 aa, Influenza virus
YALHQGTTIR

SEQ ID NO: 350073 - protein, 10 aa, Influenza virus
ALHQGTTIRN

SEQ ID NO: 350074 - protein, 10 aa, Influenza virus
LHQGTTIRNK

SEQ ID NO: 350075 - protein, 10 aa, Influenza virus
HQGTTIRNKH

SEQ ID NO: 350076 - protein, 10 aa, Influenza virus
QGTTIRNKHS

SEQ ID NO: 350077 - protein, 10 aa, Influenza virus
GTTIRNKHSN

SEQ ID NO: 350078 - protein, 10 aa, Influenza virus
TTIRNKHSNG

SEQ ID NO: 350079 - protein, 10 aa, Influenza virus
TIRNKHSNGT

SEQ ID NO: 350080 - protein, 10 aa, Influenza virus
IRNKHSNGTI

SEQ ID NO: 350081 - protein, 10 aa, Influenza virus
RNKHSNGTIH

SEQ ID NO: 350082 - protein, 10 aa, Influenza virus
NKHSNGTIHD

SEQ ID NO: 350083 - protein, 10 aa, Influenza virus
KHSNGTIHDR

SEQ ID NO: 350084 - protein, 10 aa, Influenza virus
HSNGTIHDRT

SEQ ID NO: 350085 - protein, 10 aa, Influenza virus
TIHDRTAFRG

SEQ ID NO: 350086 - protein, 10 aa, Influenza virus
IHDRTAFRGL

SEQ ID NO: 350087 - protein, 10 aa, Influenza virus
DRTAFRGLIS

SEQ ID NO: 350088 - protein, 10 aa, Influenza virus
RTAFRGLIST

SEQ ID NO: 350089 - protein, 10 aa, Influenza virus
AFRGLISTPL

SEQ ID NO: 350090 - protein, 10 aa, Influenza virus
FRGLISTPLG

SEQ ID NO: 350091 - protein, 10 aa, Influenza virus
SNSDFLCVGW

SEQ ID NO: 350092 - protein, 10 aa, Influenza virus
NSDFLCVGWS

SEQ ID NO: 350093 - protein, 10 aa, Influenza virus
SDFLCVGWSS

SEQ ID NO: 350094 - protein, 10 aa, Influenza virus
DFLCVGWSST

SEQ ID NO: 350095 - protein, 10 aa, Influenza virus
FLCVGWSSTS

SEQ ID NO: 350096 - protein, 10 aa, Influenza virus
LCVGWSSTSC

SEQ ID NO: 350097 - protein, 10 aa, Influenza virus
CVGWSSTSCH

SEQ ID NO: 350098 - protein, 10 aa, Influenza virus
VGWSSTSCHD

SEQ ID NO: 350099 - protein, 10 aa, Influenza virus
GWSSTSCHDG

SEQ ID NO: 350100 - protein, 10 aa, Influenza virus
WSSTSCHDGI

SEQ ID NO: 350101 - protein, 10 aa, Influenza virus
CHDGIGRMTI

SEQ ID NO: 350102 - protein, 10 aa, Influenza virus
HDGIGRMTIC

SEQ ID NO: 350103 - protein, 10 aa, Influenza virus
RMTICVQGNN

SEQ ID NO: 350104 - protein, 10 aa, Influenza virus
QGNNDNATAT

SEQ ID NO: 350105 - protein, 10 aa, Influenza virus
GNNDNATATV

SEQ ID NO: 350106 - protein, 10 aa, Influenza virus
NNDNATATVY

SEQ ID NO: 350107 - protein, 10 aa, Influenza virus
NDNATATVYY

SEQ ID NO: 350108 - protein, 10 aa, Influenza virus
DNATATVYYD

SEQ ID NO: 350109 - protein, 10 aa, Influenza virus
NATATVYYDR

SEQ ID NO: 350110 - protein, 10 aa, Influenza virus
ATATVYYDRR

SEQ ID NO: 350111 - protein, 10 aa, Influenza virus
TATVYYDRRL

SEQ ID NO: 350112 - protein, 10 aa, Influenza virus
ATVYYDRRLT

SEQ ID NO: 350113 - protein, 10 aa, Influenza virus
TVYYDRRLTT

SEQ ID NO: 350114 - protein, 10 aa, Influenza virus
VYYDRRLTTT

SEQ ID NO: 350115 - protein, 10 aa, Influenza virus
YYDRRLTTTI

SEQ ID NO: 350116 - protein, 10 aa, Influenza virus
RRLTTTIKTW

SEQ ID NO: 350117 - protein, 10 aa, Influenza virus
RLTTTIKTWA

SEQ ID NO: 350118 - protein, 10 aa, Influenza virus
LTTTIKTWAG

SEQ ID NO: 350119 - protein, 10 aa, Influenza virus
TTTIKTWAGN

SEQ ID NO: 350120 - protein, 10 aa, Influenza virus
TTIKTWAGNI

SEQ ID NO: 350121 - protein, 10 aa, Influenza virus
TIKTWAGNIL

SEQ ID NO: 350122 - protein, 10 aa, Influenza virus
IKTWAGNILR

SEQ ID NO: 350123 - protein, 10 aa, Influenza virus
KTWAGNILRT

SEQ ID NO: 350124 - protein, 10 aa, Influenza virus
TWAGNILRTQ

SEQ ID NO: 350125 - protein, 10 aa, Influenza virus
WAGNILRTQE

SEQ ID NO: 350126 - protein, 10 aa, Influenza virus
AGNILRTQES

SEQ ID NO: 350127 - protein, 10 aa, Influenza virus
GNILRTQESE

SEQ ID NO: 350128 - protein, 10 aa, Influenza virus
NILRTQESEC

SEQ ID NO: 350129 - protein, 10 aa, Influenza virus
ILRTQESECV

SEQ ID NO: 350130 - protein, 10 aa, Influenza virus
LRTQESECVC

SEQ ID NO: 350131 - protein, 10 aa, Influenza virus
RTQESECVCH

SEQ ID NO: 350132 - protein, 10 aa, Influenza virus
TQESECVCHN

SEQ ID NO: 350133 - protein, 10 aa, Influenza virus
QESECVCHNG

SEQ ID NO: 350134 - protein, 10 aa, Influenza virus
ESECVCHNGT

SEQ ID NO: 350135 - protein, 10 aa, Influenza virus
SECVCHNGTC

SEQ ID NO: 350136 - protein, 10 aa, Influenza virus
ECVCHNGTCV

SEQ ID NO: 350137 - protein, 10 aa, Influenza virus
GTCVVIMTDG

SEQ ID NO: 350138 - protein, 10 aa, Influenza virus
MTDGSASSQA

SEQ ID NO: 350139 - protein, 10 aa, Influenza virus
LKGSARHIEE

SEQ ID NO: 350140 - protein, 10 aa, Influenza virus
KGSARHIEEC

SEQ ID NO: 350141 - protein, 10 aa, Influenza virus
GSARHIEECS

SEQ ID NO: 350142 - protein, 10 aa, Influenza virus
SARHIEECSC

SEQ ID NO: 350143 - protein, 10 aa, Influenza virus
ARHIEECSCY

SEQ ID NO: 350144 - protein, 10 aa, Influenza virus
RHIEECSCYG

SEQ ID NO: 350145 - protein, 10 aa, Influenza virus
HIEECSCYGH

SEQ ID NO: 350146 - protein, 10 aa, Influenza virus
IEECSCYGHN

SEQ ID NO: 350147 - protein, 10 aa, Influenza virus
KVTCVCRDNW

SEQ ID NO: 350148 - protein, 10 aa, Influenza virus
VTCVCRDNWQ

SEQ ID NO: 350149 - protein, 10 aa, Influenza virus
TCVCRDNWQG

SEQ ID NO: 350150 - protein, 10 aa, Influenza virus
CVCRDNWQGA

SEQ ID NO: 350151 - protein, 10 aa, Influenza virus
VCRDNWQGAN

SEQ ID NO: 350152 - protein, 10 aa, Influenza virus
CRDNWQGANR

SEQ ID NO: 350153 - protein, 10 aa, Influenza virus
RDNWQGANRP

SEQ ID NO: 350154 - protein, 10 aa, Influenza virus
DNWQGANRPV

SEQ ID NO: 350155 - protein, 10 aa, Influenza virus
NWQGANRPVI

SEQ ID NO: 350156 - protein, 10 aa, Influenza virus
WQGANRPVIE

SEQ ID NO: 350157 - protein, 10 aa, Influenza virus
QGANRPVIEI

SEQ ID NO: 350158 - protein, 10 aa, Influenza virus
GANRPVIEID

SEQ ID NO: 350159 - protein, 10 aa, Influenza virus
ANRPVIEIDM

SEQ ID NO: 350160 - protein, 10 aa, Influenza virus
CTGVLTDTSR

SEQ ID NO: 350161 - protein, 10 aa, Influenza virus
TGVLTDTSRP

SEQ ID NO: 350162 - protein, 10 aa, Influenza virus
GVLTDTSRPS

SEQ ID NO: 350163 - protein, 10 aa, Influenza virus
VLTDTSRPSD

SEQ ID NO: 350164 - protein, 10 aa, Influenza virus
LTDTSRPSDK

SEQ ID NO: 350165 - protein, 10 aa, Influenza virus
GDCNNPITGS

SEQ ID NO: 350166 - protein, 10 aa, Influenza virus
DCNNPITGSP

SEQ ID NO: 350167 - protein, 10 aa, Influenza virus
CNNPITGSPG

SEQ ID NO: 350168 - protein, 10 aa, Influenza virus
NPITGSPGAP

SEQ ID NO: 350169 - protein, 10 aa, Influenza virus
PITGSPGAPG

SEQ ID NO: 350170 - protein, 10 aa, Influenza virus
APGVKGFGFL

SEQ ID NO: 350171 - protein, 10 aa, Influenza virus
PGVKGFGFLD

SEQ ID NO: 350172 - protein, 10 aa, Influenza virus
GNTWLGRTIS

SEQ ID NO: 350173 - protein, 10 aa, Influenza virus
NTWLGRTISP

SEQ ID NO: 350174 - protein, 10 aa, Influenza virus
TWLGRTISPR

SEQ ID NO: 350175 - protein, 10 aa, Influenza virus
WLGRTISPRS

SEQ ID NO: 350176 - protein, 10 aa, Influenza virus
LGRTISPRSR

SEQ ID NO: 350177 - protein, 10 aa, Influenza virus
TISPRSRSGF

SEQ ID NO: 350178 - protein, 10 aa, Influenza virus
ISPRSRSGFE

SEQ ID NO: 350179 - protein, 10 aa, Influenza virus
SPRSRSGFEM

SEQ ID NO: 350180 - protein, 10 aa, Influenza virus
PRSRSGFEML

SEQ ID NO: 350181 - protein, 10 aa, Influenza virus
RSRSGFEMLK

SEQ ID NO: 350182 - protein, 10 aa, Influenza virus
SRSGFEMLKI

SEQ ID NO: 350183 - protein, 10 aa, Influenza virus
RSGFEMLKIP

SEQ ID NO: 350184 - protein, 10 aa, Influenza virus
SGFEMLKIPN

SEQ ID NO: 350185 - protein, 10 aa, Influenza virus
GFEMLKIPNA

SEQ ID NO: 350186 - protein, 10 aa, Influenza virus
FEMLKIPNAG

SEQ ID NO: 350187 - protein, 10 aa, Influenza virus
LKIPNAGTDP

SEQ ID NO: 350188 - protein, 10 aa, Influenza virus
NWSGYSGSFI

SEQ ID NO: 350189 - protein, 10 aa, Influenza virus
WSGYSGSFID

SEQ ID NO: 350190 - protein, 10 aa, Influenza virus
SGYSGSFIDY

SEQ ID NO: 350191 - protein, 10 aa, Influenza virus
GYSGSFIDYW

SEQ ID NO: 350192 - protein, 10 aa, Influenza virus
YSGSFIDYWD

SEQ ID NO: 350193 - protein, 10 aa, Influenza virus
SGSFIDYWDE

SEQ ID NO: 350194 - protein, 10 aa, Influenza virus
SECYNPCFYV

SEQ ID NO: 350195 - protein, 10 aa, Influenza virus
ECYNPCFYVE

SEQ ID NO: 350196 - protein, 10 aa, Influenza virus
CYNPCFYVEL

SEQ ID NO: 350197 - protein, 10 aa, Influenza virus
YNPCFYVELI

SEQ ID NO: 350198 - protein, 10 aa, Influenza virus
NPCFYVELIR

SEQ ID NO: 350199 - protein, 10 aa, Influenza virus
PCFYVELIRG

SEQ ID NO: 350200 - protein, 10 aa, Influenza virus
CFYVELIRGR

SEQ ID NO: 350201 - protein, 10 aa, Influenza virus
FYVELIRGRP

SEQ ID NO: 350202 - protein, 10 aa, Influenza virus
YVELIRGRPE

SEQ ID NO: 350203 - protein, 10 aa, Influenza virus
VELIRGRPEE

SEQ ID NO: 350204 - protein, 10 aa, Influenza virus
ELIRGRPEEA

SEQ ID NO: 350205 - protein, 10 aa, Influenza virus
LIRGRPEEAK

SEQ ID NO: 350206 - protein, 10 aa, Influenza virus
IRGRPEEAKY

SEQ ID NO: 350207 - protein, 10 aa, Influenza virus
RGRPEEAKYV

SEQ ID NO: 350208 - protein, 10 aa, Influenza virus
GRPEEAKYVW

SEQ ID NO: 350209 - protein, 10 aa, Influenza virus
RPEEAKYVWW

SEQ ID NO: 350210 - protein, 10 aa, Influenza virus
PEEAKYVWWT

SEQ ID NO: 350211 - protein, 10 aa, Influenza virus
EEAKYVWWTS

SEQ ID NO: 350212 - protein, 10 aa, Influenza virus
EAKYVWWTSN

SEQ ID NO: 350213 - protein, 10 aa, Influenza virus
AKYVWWTSNS

SEQ ID NO: 350214 - protein, 10 aa, Influenza virus
KYVWWTSNSL

SEQ ID NO: 350215 - protein, 10 aa, Influenza virus
YVWWTSNSLV

SEQ ID NO: 350216 - protein, 10 aa, Influenza virus
VWWTSNSLVA

SEQ ID NO: 350217 - protein, 10 aa, Influenza virus
WWTSNSLVAL

SEQ ID NO: 350218 - protein, 10 aa, Influenza virus
WTSNSLVALC

SEQ ID NO: 350219 - protein, 10 aa, Influenza virus
TSNSLVALCG

SEQ ID NO: 350220 - protein, 10 aa, Influenza virus
SNSLVALCGS

SEQ ID NO: 350221 - protein, 10 aa, Influenza virus
NSLVALCGSP

SEQ ID NO: 350222 - protein, 10 aa, Influenza virus
SLVALCGSPI

SEQ ID NO: 350223 - protein, 10 aa, Influenza virus
SVGSGSFPDG

SEQ ID NO: 350224 - protein, 10 aa, Influenza virus
VGSGSFPDGA

SEQ ID NO: 350225 - protein, 10 aa, Influenza virus
GSGSFPDGAQ

SEQ ID NO: 350226 - protein, 10 aa, Influenza virus
SGSFPDGAQI

SEQ ID NO: 350227 - protein, 10 aa, Influenza virus
GSFPDGAQIQ

SEQ ID NO: 350228 - protein, 10 aa, Influenza virus
SFPDGAQIQY

SEQ ID NO: 350229 - protein, 10 aa, Influenza virus
FPDGAQIQYF

SEQ ID NO: 350230 - protein, 10 aa, Influenza virus
PDGAQIQYFS

SEQ ID NO: 350231 - protein, 10 aa, Influenza virus
KGFAPFSKDN

SEQ ID NO: 350232 - protein, 10 aa, Influenza virus
GFAPFSKDNG

SEQ ID NO: 350233 - protein, 10 aa, Influenza virus
FAPFSKDNGI

SEQ ID NO: 350234 - protein, 10 aa, Influenza virus
APFSKDNGIR

SEQ ID NO: 350235 - protein, 10 aa, Influenza virus
PFSKDNGIRI

SEQ ID NO: 350236 - protein, 10 aa, Influenza virus
FSKDNGIRIG

SEQ ID NO: 350237 - protein, 10 aa, Influenza virus
SKDNGIRIGS

SEQ ID NO: 350238 - protein, 10 aa, Influenza virus
KDNGIRIGSR

SEQ ID NO: 350239 - protein, 10 aa, Influenza virus
DNGIRIGSRG

SEQ ID NO: 350240 - protein, 10 aa, Influenza virus
NGIRIGSRGH

SEQ ID NO: 350241 - protein, 10 aa, Influenza virus
GIRIGSRGHV

SEQ ID NO: 350242 - protein, 10 aa, Influenza virus
IRIGSRGHVF

SEQ ID NO: 350243 - protein, 10 aa, Influenza virus
RIGSRGHVFV

SEQ ID NO: 350244 - protein, 10 aa, Influenza virus
IGSRGHVFVI

SEQ ID NO: 350245 - protein, 10 aa, Influenza virus
GSRGHVFVIR

SEQ ID NO: 350246 - protein, 10 aa, Influenza virus
SRGHVFVIRE

SEQ ID NO: 350247 - protein, 10 aa, Influenza virus
RGHVFVIREP

SEQ ID NO: 350248 - protein, 10 aa, Influenza virus
GHVFVIREPF

SEQ ID NO: 350249 - protein, 10 aa, Influenza virus
HVFVIREPFV

SEQ ID NO: 350250 - protein, 10 aa, Influenza virus
VFVIREPFVS

SEQ ID NO: 350251 - protein, 10 aa, Influenza virus
FVIREPFVSC

SEQ ID NO: 350252 - protein, 10 aa, Influenza virus
VIREPFVSCS

SEQ ID NO: 350253 - protein, 10 aa, Influenza virus
IREPFVSCSP

SEQ ID NO: 350254 - protein, 10 aa, Influenza virus
ECRTFFLTQG

SEQ ID NO: 350255 - protein, 10 aa, Influenza virus
CRTFFLTQGS

SEQ ID NO: 350256 - protein, 10 aa, Influenza virus
RTFFLTQGSL

SEQ ID NO: 350257 - protein, 10 aa, Influenza virus
TFFLTQGSLL

SEQ ID NO: 350258 - protein, 10 aa, Influenza virus
FFLTQGSLLN

SEQ ID NO: 350259 - protein, 10 aa, Influenza virus
FLTQGSLLND

SEQ ID NO: 350260 - protein, 10 aa, Influenza virus
LTQGSLLNDK

SEQ ID NO: 350261 - protein, 10 aa, Influenza virus
TQGSLLNDKH

SEQ ID NO: 350262 - protein, 10 aa, Influenza virus
QGSLLNDKHS

SEQ ID NO: 350263 - protein, 10 aa, Influenza virus
GSLLNDKHSN

SEQ ID NO: 350264 - protein, 10 aa, Influenza virus
SLLNDKHSNG

SEQ ID NO: 350265 - protein, 10 aa, Influenza virus
LLNDKHSNGT

SEQ ID NO: 350266 - protein, 10 aa, Influenza virus
NDKHSNGTVK

SEQ ID NO: 350267 - protein, 10 aa, Influenza virus
DKHSNGTVKD

SEQ ID NO: 350268 - protein, 10 aa, Influenza virus
KHSNGTVKDR

SEQ ID NO: 350269 - protein, 10 aa, Influenza virus
HSNGTVKDRS

SEQ ID NO: 350270 - protein, 10 aa, Influenza virus
SNGTVKDRSP

SEQ ID NO: 350271 - protein, 10 aa, Influenza virus
NGTVKDRSPY

SEQ ID NO: 350272 - protein, 10 aa, Influenza virus
GTVKDRSPYR

SEQ ID NO: 350273 - protein, 10 aa, Influenza virus
TVKDRSPYRT

SEQ ID NO: 350274 - protein, 10 aa, Influenza virus
VKDRSPYRTL

SEQ ID NO: 350275 - protein, 10 aa, Influenza virus
KDRSPYRTLM

SEQ ID NO: 350276 - protein, 10 aa, Influenza virus
DRSPYRTLMS

SEQ ID NO: 350277 - protein, 10 aa, Influenza virus
RSPYRTLMSV

SEQ ID NO: 350278 - protein, 10 aa, Influenza virus
SPYRTLMSVE

SEQ ID NO: 350279 - protein, 10 aa, Influenza virus
RTLMSVEIGQ

SEQ ID NO: 350280 - protein, 10 aa, Influenza virus
IGQSPNVYQA

SEQ ID NO: 350281 - protein, 10 aa, Influenza virus
GQSPNVYQAR

SEQ ID NO: 350282 - protein, 10 aa, Influenza virus
QSPNVYQARF

SEQ ID NO: 350283 - protein, 10 aa, Influenza virus
SPNVYQARFE

SEQ ID NO: 350284 - protein, 10 aa, Influenza virus
PNVYQARFEA

SEQ ID NO: 350285 - protein, 10 aa, Influenza virus
NVYQARFEAV

SEQ ID NO: 350286 - protein, 10 aa, Influenza virus
VYQARFEAVA

SEQ ID NO: 350287 - protein, 10 aa, Influenza virus
YQARFEAVAW

SEQ ID NO: 350288 - protein, 10 aa, Influenza virus
QARFEAVAWS

SEQ ID NO: 350289 - protein, 10 aa, Influenza virus
ARFEAVAWSA

SEQ ID NO: 350290 - protein, 10 aa, Influenza virus
RFEAVAWSAT

SEQ ID NO: 350291 - protein, 10 aa, Influenza virus
FEAVAWSATA

SEQ ID NO: 350292 - protein, 10 aa, Influenza virus
EAVAWSATAC

SEQ ID NO: 350293 - protein, 10 aa, Influenza virus
AVAWSATACH

SEQ ID NO: 350294 - protein, 10 aa, Influenza virus
VAWSATACHD

SEQ ID NO: 350295 - protein, 10 aa, Influenza virus
AWSATACHDG

SEQ ID NO: 350296 - protein, 10 aa, Influenza virus
WSATACHDGK

SEQ ID NO: 350297 - protein, 10 aa, Influenza virus
SATACHDGKK

SEQ ID NO: 350298 - protein, 10 aa, Influenza virus
ATACHDGKKW

SEQ ID NO: 350299 - protein, 10 aa, Influenza virus
TACHDGKKWM

SEQ ID NO: 350300 - protein, 10 aa, Influenza virus
ACHDGKKWMT

SEQ ID NO: 350301 - protein, 10 aa, Influenza virus
GDILRTQESS

SEQ ID NO: 350302 - protein, 10 aa, Influenza virus
DILRTQESSC

SEQ ID NO: 350303 - protein, 10 aa, Influenza virus
ILRTQESSCT

SEQ ID NO: 350304 - protein, 10 aa, Influenza virus
LRTQESSCTC

SEQ ID NO: 350305 - protein, 10 aa, Influenza virus
RTQESSCTCI

SEQ ID NO: 350306 - protein, 10 aa, Influenza virus
TQESSCTCIQ

SEQ ID NO: 350307 - protein, 10 aa, Influenza virus
QESSCTCIQG

SEQ ID NO: 350308 - protein, 10 aa, Influenza virus
GECYWVMTDG

SEQ ID NO: 350309 - protein, 10 aa, Influenza virus
ECYWVMTDGP

SEQ ID NO: 350310 - protein, 10 aa, Influenza virus
CYWVMTDGPA

SEQ ID NO: 350311 - protein, 10 aa, Influenza virus
YWVMTDGPAN

SEQ ID NO: 350312 - protein, 10 aa, Influenza virus
WVMTDGPANR

SEQ ID NO: 350313 - protein, 10 aa, Influenza virus
VMTDGPANRQ

SEQ ID NO: 350314 - protein, 10 aa, Influenza virus
MTDGPANRQA

SEQ ID NO: 350315 - protein, 10 aa, Influenza virus
FNGGHIEECS

SEQ ID NO: 350316 - protein, 10 aa, Influenza virus
NGGHIEECSC

SEQ ID NO: 350317 - protein, 10 aa, Influenza virus
GGHIEECSCY

SEQ ID NO: 350318 - protein, 10 aa, Influenza virus
GHIEECSCYP

SEQ ID NO: 350319 - protein, 10 aa, Influenza virus
HIEECSCYPN

SEQ ID NO: 350320 - protein, 10 aa, Influenza virus
IEECSCYPNE

SEQ ID NO: 350321 - protein, 10 aa, Influenza virus
EECSCYPNEG

SEQ ID NO: 350322 - protein, 10 aa, Influenza virus
ECSCYPNEGK

SEQ ID NO: 350323 - protein, 10 aa, Influenza virus
CSCYPNEGKV

SEQ ID NO: 350324 - protein, 10 aa, Influenza virus
SCYPNEGKVE

SEQ ID NO: 350325 - protein, 10 aa, Influenza virus
CYPNEGKVEC

SEQ ID NO: 350326 - protein, 10 aa, Influenza virus
YPNEGKVECV

SEQ ID NO: 350327 - protein, 10 aa, Influenza virus
PNEGKVECVC

SEQ ID NO: 350328 - protein, 10 aa, Influenza virus
NEGKVECVCR

SEQ ID NO: 350329 - protein, 10 aa, Influenza virus
EGKVECVCRD

SEQ ID NO: 350330 - protein, 10 aa, Influenza virus
GKVECVCRDN

SEQ ID NO: 350331 - protein, 10 aa, Influenza virus
KVECVCRDNW

SEQ ID NO: 350332 - protein, 10 aa, Influenza virus
VECVCRDNWT

SEQ ID NO: 350333 - protein, 10 aa, Influenza virus
ECVCRDNWTG

SEQ ID NO: 350334 - protein, 10 aa, Influenza virus
CVCRDNWTGT

SEQ ID NO: 350335 - protein, 10 aa, Influenza virus
VCRDNWTGTN

SEQ ID NO: 350336 - protein, 10 aa, Influenza virus
CRDNWTGTNR

SEQ ID NO: 350337 - protein, 10 aa, Influenza virus
RDNWTGTNRP

SEQ ID NO: 350338 - protein, 10 aa, Influenza virus
DNWTGTNRPV

SEQ ID NO: 350339 - protein, 10 aa, Influenza virus
NWTGTNRPVL

SEQ ID NO: 350340 - protein, 10 aa, Influenza virus
WTGTNRPVLV

SEQ ID NO: 350341 - protein, 10 aa, Influenza virus
TGTNRPVLVI

SEQ ID NO: 350342 - protein, 10 aa, Influenza virus
GTNRPVLVIS

SEQ ID NO: 350343 - protein, 10 aa, Influenza virus
LSYRVGYLCA

SEQ ID NO: 350344 - protein, 10 aa, Influenza virus
SYRVGYLCAG

SEQ ID NO: 350345 - protein, 10 aa, Influenza virus
VGYLCAGLPS

SEQ ID NO: 350346 - protein, 10 aa, Influenza virus
GYLCAGLPSD

SEQ ID NO: 350347 - protein, 10 aa, Influenza virus
YLCAGLPSDT

SEQ ID NO: 350348 - protein, 10 aa, Influenza virus
LCAGLPSDTP

SEQ ID NO: 350349 - protein, 10 aa, Influenza virus
CAGLPSDTPR

SEQ ID NO: 350350 - protein, 10 aa, Influenza virus
AGLPSDTPRG

SEQ ID NO: 350351 - protein, 10 aa, Influenza virus
GLPSDTPRGE

SEQ ID NO: 350352 - protein, 10 aa, Influenza virus
LPSDTPRGED

SEQ ID NO: 350353 - protein, 10 aa, Influenza virus
PSDTPRGEDS

SEQ ID NO: 350354 - protein, 10 aa, Influenza virus
SDTPRGEDSQ

SEQ ID NO: 350355 - protein, 10 aa, Influenza virus
DTPRGEDSQF

SEQ ID NO: 350356 - protein, 10 aa, Influenza virus
QGYGVKGFGF

SEQ ID NO: 350357 - protein, 10 aa, Influenza virus
GYGVKGFGFR

SEQ ID NO: 350358 - protein, 10 aa, Influenza virus
YGVKGFGFRQ

SEQ ID NO: 350359 - protein, 10 aa, Influenza virus
GVKGFGFRQG

SEQ ID NO: 350360 - protein, 10 aa, Influenza virus
VKGFGFRQGN

SEQ ID NO: 350361 - protein, 10 aa, Influenza virus
KGFGFRQGND

SEQ ID NO: 350362 - protein, 10 aa, Influenza virus
GFGFRQGNDV

SEQ ID NO: 350363 - protein, 10 aa, Influenza virus
FGFRQGNDVW

SEQ ID NO: 350364 - protein, 10 aa, Influenza virus
DNLNWSGYSG

SEQ ID NO: 350365 - protein, 10 aa, Influenza virus
NLNWSGYSGS

SEQ ID NO: 350366 - protein, 10 aa, Influenza virus
LNWSGYSGSF

SEQ ID NO: 350367 - protein, 10 aa, Influenza virus
NWSGYSGSFT

SEQ ID NO: 350368 - protein, 10 aa, Influenza virus
WSGYSGSFTL

SEQ ID NO: 350369 - protein, 10 aa, Influenza virus
SGYSGSFTLP

SEQ ID NO: 350370 - protein, 10 aa, Influenza virus
GYSGSFTLPV

SEQ ID NO: 350371 - protein, 10 aa, Influenza virus
YSGSFTLPVE

SEQ ID NO: 350372 - protein, 10 aa, Influenza virus
SGSFTLPVEL

SEQ ID NO: 350373 - protein, 10 aa, Influenza virus
NCLVPCFWVE

SEQ ID NO: 350374 - protein, 10 aa, Influenza virus
CLVPCFWVEM

SEQ ID NO: 350375 - protein, 10 aa, Influenza virus
LVPCFWVEMI

SEQ ID NO: 350376 - protein, 10 aa, Influenza virus
VPCFWVEMIR

SEQ ID NO: 350377 - protein, 10 aa, Influenza virus
PCFWVEMIRG

SEQ ID NO: 350378 - protein, 10 aa, Influenza virus
CFWVEMIRGK

SEQ ID NO: 350379 - protein, 10 aa, Influenza virus
FWVEMIRGKP

SEQ ID NO: 350380 - protein, 10 aa, Influenza virus
WVEMIRGKPE

SEQ ID NO: 350381 - protein, 10 aa, Influenza virus
VEMIRGKPEE

SEQ ID NO: 350382 - protein, 10 aa, Influenza virus
TIWTSSSSIV

SEQ ID NO: 350383 - protein, 10 aa, Influenza virus
IWTSSSSIVM

SEQ ID NO: 350384 - protein, 10 aa, Influenza virus
WTSSSSIVMC

SEQ ID NO: 350385 - protein, 10 aa, Influenza virus
TSSSSIVMCG

SEQ ID NO: 350386 - protein, 10 aa, Influenza virus
SSSSIVMCGV

SEQ ID NO: 350387 - protein, 10 aa, Influenza virus
SSSIVMCGVD

SEQ ID NO: 350388 - protein, 10 aa, Influenza virus
SSIVMCGVDH

SEQ ID NO: 350389 - protein, 10 aa, Influenza virus
ADWSWHDGAI

SEQ ID NO: 350390 - protein, 10 aa, Influenza virus
DWSWHDGAIL

SEQ ID NO: 350391 - protein, 10 aa, Influenza virus
WSWHDGAILP

SEQ ID NO: 350392 - protein, 10 aa, Influenza virus
SWHDGAILPF

SEQ ID NO: 350393 - protein, 10 aa, Influenza virus
ILPFDIDKII

SEQ ID NO: 350394 - protein, 10 aa, Influenza virus
LPFDIDKIIT

SEQ ID NO: 350395 - protein, 10 aa, Influenza virus
MNPNQKILCT

SEQ ID NO: 350396 - protein, 10 aa, Influenza virus
NPNQKILCTS

SEQ ID NO: 350397 - protein, 10 aa, Influenza virus
PNQKILCTSA

SEQ ID NO: 350398 - protein, 10 aa, Influenza virus
NQKILCTSAT

SEQ ID NO: 350399 - protein, 10 aa, Influenza virus
QKILCTSATA

SEQ ID NO: 350400 - protein, 10 aa, Influenza virus
ANLGLNIGLH

SEQ ID NO: 350401 - protein, 10 aa, Influenza virus
NLGLNIGLHL

SEQ ID NO: 350402 - protein, 10 aa, Influenza virus
LGLNIGLHLK

SEQ ID NO: 350403 - protein, 10 aa, Influenza virus
GLNIGLHLKP

SEQ ID NO: 350404 - protein, 10 aa, Influenza virus
SQTIINNYYN

SEQ ID NO: 350405 - protein, 10 aa, Influenza virus
QTIINNYYNE

SEQ ID NO: 350406 - protein, 10 aa, Influenza virus
TIINNYYNET

SEQ ID NO: 350407 - protein, 10 aa, Influenza virus
IINNYYNETN

SEQ ID NO: 350408 - protein, 10 aa, Influenza virus
FNNLTKGLCT

SEQ ID NO: 350409 - protein, 10 aa, Influenza virus
NNLTKGLCTI

SEQ ID NO: 350410 - protein, 10 aa, Influenza virus
NLTKGLCTIN

SEQ ID NO: 350411 - protein, 10 aa, Influenza virus
LTKGLCTINS

SEQ ID NO: 350412 - protein, 10 aa, Influenza virus
TKGLCTINSW

SEQ ID NO: 350413 - protein, 10 aa, Influenza virus
KGLCTINSWH

SEQ ID NO: 350414 - protein, 10 aa, Influenza virus
GLCTINSWHI

SEQ ID NO: 350415 - protein, 10 aa, Influenza virus
LCTINSWHIY

SEQ ID NO: 350416 - protein, 10 aa, Influenza virus
CTINSWHIYG

SEQ ID NO: 350417 - protein, 10 aa, Influenza virus
TINSWHIYGK

SEQ ID NO: 350418 - protein, 10 aa, Influenza virus
INSWHIYGKD

SEQ ID NO: 350419 - protein, 10 aa, Influenza virus
NSWHIYGKDN

SEQ ID NO: 350420 - protein, 10 aa, Influenza virus
SWHIYGKDNA

SEQ ID NO: 350421 - protein, 10 aa, Influenza virus
WHIYGKDNAV

SEQ ID NO: 350422 - protein, 10 aa, Influenza virus
HIYGKDNAVR

SEQ ID NO: 350423 - protein, 10 aa, Influenza virus
IYGKDNAVRI

SEQ ID NO: 350424 - protein, 10 aa, Influenza virus
YGKDNAVRIG

SEQ ID NO: 350425 - protein, 10 aa, Influenza virus
GKDNAVRIGE

SEQ ID NO: 350426 - protein, 10 aa, Influenza virus
KDNAVRIGED

SEQ ID NO: 350427 - protein, 10 aa, Influenza virus
DNAVRIGEDS

SEQ ID NO: 350428 - protein, 10 aa, Influenza virus
RIGEDSDVLV

SEQ ID NO: 350429 - protein, 10 aa, Influenza virus
IGEDSDVLVT

SEQ ID NO: 350430 - protein, 10 aa, Influenza virus
GEDSDVLVTR

SEQ ID NO: 350431 - protein, 10 aa, Influenza virus
EDSDVLVTRE

SEQ ID NO: 350432 - protein, 10 aa, Influenza virus
DSDVLVTREP

SEQ ID NO: 350433 - protein, 10 aa, Influenza virus
SDVLVTREPY

SEQ ID NO: 350434 - protein, 10 aa, Influenza virus
DVLVTREPYV

SEQ ID NO: 350435 - protein, 10 aa, Influenza virus
VLVTREPYVS

SEQ ID NO: 350436 - protein, 10 aa, Influenza virus
LVTREPYVSC

SEQ ID NO: 350437 - protein, 10 aa, Influenza virus
VTREPYVSCD

SEQ ID NO: 350438 - protein, 10 aa, Influenza virus
TREPYVSCDP

SEQ ID NO: 350439 - protein, 10 aa, Influenza virus
REPYVSCDPD

SEQ ID NO: 350440 - protein, 10 aa, Influenza virus
EPYVSCDPDE

SEQ ID NO: 350441 - protein, 10 aa, Influenza virus
PYVSCDPDEC

SEQ ID NO: 350442 - protein, 10 aa, Influenza virus
YVSCDPDECR

SEQ ID NO: 350443 - protein, 10 aa, Influenza virus
VSCDPDECRF

SEQ ID NO: 350444 - protein, 10 aa, Influenza virus
SCDPDECRFY

SEQ ID NO: 350445 - protein, 10 aa, Influenza virus
CDPDECRFYA

SEQ ID NO: 350446 - protein, 10 aa, Influenza virus
DPDECRFYAL

SEQ ID NO: 350447 - protein, 10 aa, Influenza virus
PDECRFYALS

SEQ ID NO: 350448 - protein, 10 aa, Influenza virus
DECRFYALSQ

SEQ ID NO: 350449 - protein, 10 aa, Influenza virus
ECRFYALSQG

SEQ ID NO: 350450 - protein, 10 aa, Influenza virus
CRFYALSQGT

SEQ ID NO: 350451 - protein, 10 aa, Influenza virus
RFYALSQGTT

SEQ ID NO: 350452 - protein, 10 aa, Influenza virus
FYALSQGTTI

SEQ ID NO: 350453 - protein, 10 aa, Influenza virus
YALSQGTTIR

SEQ ID NO: 350454 - protein, 10 aa, Influenza virus
ALSQGTTIRG

SEQ ID NO: 350455 - protein, 10 aa, Influenza virus
LSQGTTIRGK

SEQ ID NO: 350456 - protein, 10 aa, Influenza virus
SQGTTIRGKH

SEQ ID NO: 350457 - protein, 10 aa, Influenza virus
QGTTIRGKHS

SEQ ID NO: 350458 - protein, 10 aa, Influenza virus
GTTIRGKHSN

SEQ ID NO: 350459 - protein, 10 aa, Influenza virus
TTIRGKHSNG

SEQ ID NO: 350460 - protein, 10 aa, Influenza virus
TIRGKHSNGT

SEQ ID NO: 350461 - protein, 10 aa, Influenza virus
IRGKHSNGTI

SEQ ID NO: 350462 - protein, 10 aa, Influenza virus
RGKHSNGTIH

SEQ ID NO: 350463 - protein, 10 aa, Influenza virus
GKHSNGTIHD

SEQ ID NO: 350464 - protein, 10 aa, Influenza virus
KHSNGTIHDR

SEQ ID NO: 350465 - protein, 10 aa, Influenza virus
HSNGTIHDRS

SEQ ID NO: 350466 - protein, 10 aa, Influenza virus
SNGTIHDRSQ

SEQ ID NO: 350467 - protein, 10 aa, Influenza virus
NGTIHDRSQY

SEQ ID NO: 350468 - protein, 10 aa, Influenza virus
GTIHDRSQYR

SEQ ID NO: 350469 - protein, 10 aa, Influenza virus
TIHDRSQYRA

SEQ ID NO: 350470 - protein, 10 aa, Influenza virus
IHDRSQYRAL

SEQ ID NO: 350471 - protein, 10 aa, Influenza virus
HDRSQYRALI

SEQ ID NO: 350472 - protein, 10 aa, Influenza virus
DRSQYRALIS

SEQ ID NO: 350473 - protein, 10 aa, Influenza virus
RSQYRALISW

SEQ ID NO: 350474 - protein, 10 aa, Influenza virus
SQYRALISWP

SEQ ID NO: 350475 - protein, 10 aa, Influenza virus
QYRALISWPL

SEQ ID NO: 350476 - protein, 10 aa, Influenza virus
YRALISWPLS

SEQ ID NO: 350477 - protein, 10 aa, Influenza virus
RALISWPLSS

SEQ ID NO: 350478 - protein, 10 aa, Influenza virus
ALISWPLSSP

SEQ ID NO: 350479 - protein, 10 aa, Influenza virus
LISWPLSSPP

SEQ ID NO: 350480 - protein, 10 aa, Influenza virus
ISWPLSSPPT

SEQ ID NO: 350481 - protein, 10 aa, Influenza virus
SWPLSSPPTV

SEQ ID NO: 350482 - protein, 10 aa, Influenza virus
WPLSSPPTVY

SEQ ID NO: 350483 - protein, 10 aa, Influenza virus
PLSSPPTVYN

SEQ ID NO: 350484 - protein, 10 aa, Influenza virus
LSSPPTVYNS

SEQ ID NO: 350485 - protein, 10 aa, Influenza virus
SSPPTVYNSR

SEQ ID NO: 350486 - protein, 10 aa, Influenza virus
RVECIGWSST

SEQ ID NO: 350487 - protein, 10 aa, Influenza virus
VECIGWSSTS

SEQ ID NO: 350488 - protein, 10 aa, Influenza virus
ECIGWSSTSC

SEQ ID NO: 350489 - protein, 10 aa, Influenza virus
CIGWSSTSCH

SEQ ID NO: 350490 - protein, 10 aa, Influenza virus
IGWSSTSCHD

SEQ ID NO: 350491 - protein, 10 aa, Influenza virus
GWSSTSCHDG

SEQ ID NO: 350492 - protein, 10 aa, Influenza virus
WSSTSCHDGR

SEQ ID NO: 350493 - protein, 10 aa, Influenza virus
SSTSCHDGRA

SEQ ID NO: 350494 - protein, 10 aa, Influenza virus
STSCHDGRAR

SEQ ID NO: 350495 - protein, 10 aa, Influenza virus
TSCHDGRARM

SEQ ID NO: 350496 - protein, 10 aa, Influenza virus
SCHDGRARMS

SEQ ID NO: 350497 - protein, 10 aa, Influenza virus
RMSICISGPN

SEQ ID NO: 350498 - protein, 10 aa, Influenza virus
MSICISGPNN

SEQ ID NO: 350499 - protein, 10 aa, Influenza virus
SICISGPNNN

SEQ ID NO: 350500 - protein, 10 aa, Influenza virus
ICISGPNNNA

SEQ ID NO: 350501 - protein, 10 aa, Influenza virus
CISGPNNNAS

SEQ ID NO: 350502 - protein, 10 aa, Influenza virus
ISGPNNNASA

SEQ ID NO: 350503 - protein, 10 aa, Influenza virus
SGPNNNASAV

SEQ ID NO: 350504 - protein, 10 aa, Influenza virus
GPNNNASAVI

SEQ ID NO: 350505 - protein, 10 aa, Influenza virus
PNNNASAVIW

SEQ ID NO: 350506 - protein, 10 aa, Influenza virus
NNNASAVIWY

SEQ ID NO: 350507 - protein, 10 aa, Influenza virus
NNASAVIWYN

SEQ ID NO: 350508 - protein, 10 aa, Influenza virus
RRPVTEINTW

SEQ ID NO: 350509 - protein, 10 aa, Influenza virus
RPVTEINTWA

SEQ ID NO: 350510 - protein, 10 aa, Influenza virus
PVTEINTWAR

SEQ ID NO: 350511 - protein, 10 aa, Influenza virus
VTEINTWARN

SEQ ID NO: 350512 - protein, 10 aa, Influenza virus
TEINTWARNI

SEQ ID NO: 350513 - protein, 10 aa, Influenza virus
EINTWARNIL

SEQ ID NO: 350514 - protein, 10 aa, Influenza virus
INTWARNILR

SEQ ID NO: 350515 - protein, 10 aa, Influenza virus
NTWARNILRT

SEQ ID NO: 350516 - protein, 10 aa, Influenza virus
TWARNILRTQ

SEQ ID NO: 350517 - protein, 10 aa, Influenza virus
WARNILRTQE

SEQ ID NO: 350518 - protein, 10 aa, Influenza virus
ARNILRTQES

SEQ ID NO: 350519 - protein, 10 aa, Influenza virus
RNILRTQESE

SEQ ID NO: 350520 - protein, 10 aa, Influenza virus
NILRTQESEC

SEQ ID NO: 350521 - protein, 10 aa, Influenza virus
ILRTQESECV

SEQ ID NO: 350522 - protein, 10 aa, Influenza virus
LRTQESECVC

SEQ ID NO: 350523 - protein, 10 aa, Influenza virus
RTQESECVCH

SEQ ID NO: 350524 - protein, 10 aa, Influenza virus
TQESECVCHN

SEQ ID NO: 350525 - protein, 10 aa, Influenza virus
QESECVCHNG

SEQ ID NO: 350526 - protein, 10 aa, Influenza virus
ESECVCHNGV

SEQ ID NO: 350527 - protein, 10 aa, Influenza virus
SECVCHNGVC

SEQ ID NO: 350528 - protein, 10 aa, Influenza virus
ECVCHNGVCP

SEQ ID NO: 350529 - protein, 10 aa, Influenza virus
CVCHNGVCPV

SEQ ID NO: 350530 - protein, 10 aa, Influenza virus
VCHNGVCPVV

SEQ ID NO: 350531 - protein, 10 aa, Influenza virus
CHNGVCPVVF

SEQ ID NO: 350532 - protein, 10 aa, Influenza virus
HNGVCPVVFT

SEQ ID NO: 350533 - protein, 10 aa, Influenza virus
NGVCPVVFTD

SEQ ID NO: 350534 - protein, 10 aa, Influenza virus
GVCPVVFTDG

SEQ ID NO: 350535 - protein, 10 aa, Influenza virus
VCPVVFTDGS

SEQ ID NO: 350536 - protein, 10 aa, Influenza virus
CPVVFTDGSA

SEQ ID NO: 350537 - protein, 10 aa, Influenza virus
PVVFTDGSAT

SEQ ID NO: 350538 - protein, 10 aa, Influenza virus
VVFTDGSATG

SEQ ID NO: 350539 - protein, 10 aa, Influenza virus
VFTDGSATGP

SEQ ID NO: 350540 - protein, 10 aa, Influenza virus
FTDGSATGPA

SEQ ID NO: 350541 - protein, 10 aa, Influenza virus
TDGSATGPAE

SEQ ID NO: 350542 - protein, 10 aa, Influenza virus
DGSATGPAET

SEQ ID NO: 350543 - protein, 10 aa, Influenza virus
GSATGPAETR

SEQ ID NO: 350544 - protein, 10 aa, Influenza virus
SATGPAETRV

SEQ ID NO: 350545 - protein, 10 aa, Influenza virus
ATGPAETRVY

SEQ ID NO: 350546 - protein, 10 aa, Influenza virus
TGPAETRVYY

SEQ ID NO: 350547 - protein, 10 aa, Influenza virus
GPAETRVYYF

SEQ ID NO: 350548 - protein, 10 aa, Influenza virus
LTGTAKHIEE

SEQ ID NO: 350549 - protein, 10 aa, Influenza virus
TGTAKHIEEC

SEQ ID NO: 350550 - protein, 10 aa, Influenza virus
GTAKHIEECS

SEQ ID NO: 350551 - protein, 10 aa, Influenza virus
TAKHIEECSC

SEQ ID NO: 350552 - protein, 10 aa, Influenza virus
AKHIEECSCY

SEQ ID NO: 350553 - protein, 10 aa, Influenza virus
KHIEECSCYG

SEQ ID NO: 350554 - protein, 10 aa, Influenza virus
HIEECSCYGE

SEQ ID NO: 350555 - protein, 10 aa, Influenza virus
ITCTCRDNWQ

SEQ ID NO: 350556 - protein, 10 aa, Influenza virus
TCTCRDNWQG

SEQ ID NO: 350557 - protein, 10 aa, Influenza virus
CTCRDNWQGS

SEQ ID NO: 350558 - protein, 10 aa, Influenza virus
TCRDNWQGSN

SEQ ID NO: 350559 - protein, 10 aa, Influenza virus
CRDNWQGSNR

SEQ ID NO: 350560 - protein, 10 aa, Influenza virus
RDNWQGSNRP

SEQ ID NO: 350561 - protein, 10 aa, Influenza virus
DNWQGSNRPV

SEQ ID NO: 350562 - protein, 10 aa, Influenza virus
NWQGSNRPVI

SEQ ID NO: 350563 - protein, 10 aa, Influenza virus
WQGSNRPVIQ

SEQ ID NO: 350564 - protein, 10 aa, Influenza virus
QGSNRPVIQI

SEQ ID NO: 350565 - protein, 10 aa, Influenza virus
GSNRPVIQID

SEQ ID NO: 350566 - protein, 10 aa, Influenza virus
SNRPVIQIDP

SEQ ID NO: 350567 - protein, 10 aa, Influenza virus
AMTHTSQYIC

SEQ ID NO: 350568 - protein, 10 aa, Influenza virus
MTHTSQYICS

SEQ ID NO: 350569 - protein, 10 aa, Influenza virus
THTSQYICSP

SEQ ID NO: 350570 - protein, 10 aa, Influenza virus
HTSQYICSPV

SEQ ID NO: 350571 - protein, 10 aa, Influenza virus
TSQYICSPVL

SEQ ID NO: 350572 - protein, 10 aa, Influenza virus
SQYICSPVLT

SEQ ID NO: 350573 - protein, 10 aa, Influenza virus
QYICSPVLTD

SEQ ID NO: 350574 - protein, 10 aa, Influenza virus
YICSPVLTDN

SEQ ID NO: 350575 - protein, 10 aa, Influenza virus
ICSPVLTDNP

SEQ ID NO: 350576 - protein, 10 aa, Influenza virus
CSPVLTDNPR

SEQ ID NO: 350577 - protein, 10 aa, Influenza virus
SPVLTDNPRP

SEQ ID NO: 350578 - protein, 10 aa, Influenza virus
PVLTDNPRPN

SEQ ID NO: 350579 - protein, 10 aa, Influenza virus
VLTDNPRPND

SEQ ID NO: 350580 - protein, 10 aa, Influenza virus
LTDNPRPNDP

SEQ ID NO: 350581 - protein, 10 aa, Influenza virus
TDNPRPNDPA

SEQ ID NO: 350582 - protein, 10 aa, Influenza virus
VGKCNDPYPG

SEQ ID NO: 350583 - protein, 10 aa, Influenza virus
GKCNDPYPGN

SEQ ID NO: 350584 - protein, 10 aa, Influenza virus
KCNDPYPGNN

SEQ ID NO: 350585 - protein, 10 aa, Influenza virus
CNDPYPGNNN

SEQ ID NO: 350586 - protein, 10 aa, Influenza virus
NDPYPGNNNN

SEQ ID NO: 350587 - protein, 10 aa, Influenza virus
DPYPGNNNNG

SEQ ID NO: 350588 - protein, 10 aa, Influenza virus
PYPGNNNNGV

SEQ ID NO: 350589 - protein, 10 aa, Influenza virus
YPGNNNNGVK

SEQ ID NO: 350590 - protein, 10 aa, Influenza virus
PGNNNNGVKG

SEQ ID NO: 350591 - protein, 10 aa, Influenza virus
GNNNNGVKGF

SEQ ID NO: 350592 - protein, 10 aa, Influenza virus
NNNNGVKGFS

SEQ ID NO: 350593 - protein, 10 aa, Influenza virus
NNNGVKGFSY

SEQ ID NO: 350594 - protein, 10 aa, Influenza virus
NNGVKGFSYL

SEQ ID NO: 350595 - protein, 10 aa, Influenza virus
NGVKGFSYLD

SEQ ID NO: 350596 - protein, 10 aa, Influenza virus
GVKGFSYLDG

SEQ ID NO: 350597 - protein, 10 aa, Influenza virus
NTWLGRTIST

SEQ ID NO: 350598 - protein, 10 aa, Influenza virus
TWLGRTISTA

SEQ ID NO: 350599 - protein, 10 aa, Influenza virus
WLGRTISTAS

SEQ ID NO: 350600 - protein, 10 aa, Influenza virus
LGRTISTASR

SEQ ID NO: 350601 - protein, 10 aa, Influenza virus
GRTISTASRS

SEQ ID NO: 350602 - protein, 10 aa, Influenza virus
RTISTASRSG

SEQ ID NO: 350603 - protein, 10 aa, Influenza virus
TISTASRSGY

SEQ ID NO: 350604 - protein, 10 aa, Influenza virus
ISTASRSGYE

SEQ ID NO: 350605 - protein, 10 aa, Influenza virus
STASRSGYEM

SEQ ID NO: 350606 - protein, 10 aa, Influenza virus
TASRSGYEML

SEQ ID NO: 350607 - protein, 10 aa, Influenza virus
ASRSGYEMLK

SEQ ID NO: 350608 - protein, 10 aa, Influenza virus
SRSGYEMLKV

SEQ ID NO: 350609 - protein, 10 aa, Influenza virus
RSGYEMLKVP

SEQ ID NO: 350610 - protein, 10 aa, Influenza virus
SGYEMLKVPN

SEQ ID NO: 350611 - protein, 10 aa, Influenza virus
GYEMLKVPNA

SEQ ID NO: 350612 - protein, 10 aa, Influenza virus
YEMLKVPNAL

SEQ ID NO: 350613 - protein, 10 aa, Influenza virus
EMLKVPNALT

SEQ ID NO: 350614 - protein, 10 aa, Influenza virus
MLKVPNALTD

SEQ ID NO: 350615 - protein, 10 aa, Influenza virus
LKVPNALTDD

SEQ ID NO: 350616 - protein, 10 aa, Influenza virus
KVPNALTDDR

SEQ ID NO: 350617 - protein, 10 aa, Influenza virus
VPNALTDDRS

SEQ ID NO: 350618 - protein, 10 aa, Influenza virus
PNALTDDRSK

SEQ ID NO: 350619 - protein, 10 aa, Influenza virus
NALTDDRSKP

SEQ ID NO: 350620 - protein, 10 aa, Influenza virus
QGQTIVLNTD

SEQ ID NO: 350621 - protein, 10 aa, Influenza virus
GQTIVLNTDW

SEQ ID NO: 350622 - protein, 10 aa, Influenza virus
QTIVLNTDWS

SEQ ID NO: 350623 - protein, 10 aa, Influenza virus
TIVLNTDWSG

SEQ ID NO: 350624 - protein, 10 aa, Influenza virus
IVLNTDWSGY

SEQ ID NO: 350625 - protein, 10 aa, Influenza virus
VLNTDWSGYS

SEQ ID NO: 350626 - protein, 10 aa, Influenza virus
LNTDWSGYSG

SEQ ID NO: 350627 - protein, 10 aa, Influenza virus
NTDWSGYSGS

SEQ ID NO: 350628 - protein, 10 aa, Influenza virus
TDWSGYSGSF

SEQ ID NO: 350629 - protein, 10 aa, Influenza virus
DWSGYSGSFM

SEQ ID NO: 350630 - protein, 10 aa, Influenza virus
WSGYSGSFMD

SEQ ID NO: 350631 - protein, 10 aa, Influenza virus
SGYSGSFMDY

SEQ ID NO: 350632 - protein, 10 aa, Influenza virus
GYSGSFMDYW

SEQ ID NO: 350633 - protein, 10 aa, Influenza virus
YSGSFMDYWA

SEQ ID NO: 350634 - protein, 10 aa, Influenza virus
SGSFMDYWAE

SEQ ID NO: 350635 - protein, 10 aa, Influenza virus
GSFMDYWAEG

SEQ ID NO: 350636 - protein, 10 aa, Influenza virus
DYWAEGECYR

SEQ ID NO: 350637 - protein, 10 aa, Influenza virus
YWAEGECYRA

SEQ ID NO: 350638 - protein, 10 aa, Influenza virus
WAEGECYRAC

SEQ ID NO: 350639 - protein, 10 aa, Influenza virus
AEGECYRACF

SEQ ID NO: 350640 - protein, 10 aa, Influenza virus
EGECYRACFY

SEQ ID NO: 350641 - protein, 10 aa, Influenza virus
GECYRACFYV

SEQ ID NO: 350642 - protein, 10 aa, Influenza virus
ECYRACFYVE

SEQ ID NO: 350643 - protein, 10 aa, Influenza virus
CYRACFYVEL

SEQ ID NO: 350644 - protein, 10 aa, Influenza virus
YRACFYVELI

SEQ ID NO: 350645 - protein, 10 aa, Influenza virus
RACFYVELIR

SEQ ID NO: 350646 - protein, 10 aa, Influenza virus
ACFYVELIRG

SEQ ID NO: 350647 - protein, 10 aa, Influenza virus
CFYVELIRGR

SEQ ID NO: 350648 - protein, 10 aa, Influenza virus
FYVELIRGRP

SEQ ID NO: 350649 - protein, 10 aa, Influenza virus
YVELIRGRPK

SEQ ID NO: 350650 - protein, 10 aa, Influenza virus
VELIRGRPKE

SEQ ID NO: 350651 - protein, 10 aa, Influenza virus
ELIRGRPKED

SEQ ID NO: 350652 - protein, 10 aa, Influenza virus
LIRGRPKEDK

SEQ ID NO: 350653 - protein, 10 aa, Influenza virus
IRGRPKEDKV

SEQ ID NO: 350654 - protein, 10 aa, Influenza virus
RGRPKEDKVW

SEQ ID NO: 350655 - protein, 10 aa, Influenza virus
GRPKEDKVWW

SEQ ID NO: 350656 - protein, 10 aa, Influenza virus
RPKEDKVWWT

SEQ ID NO: 350657 - protein, 10 aa, Influenza virus
PKEDKVWWTS

SEQ ID NO: 350658 - protein, 10 aa, Influenza virus
KEDKVWWTSN

SEQ ID NO: 350659 - protein, 10 aa, Influenza virus
EDKVWWTSNS

SEQ ID NO: 350660 - protein, 10 aa, Influenza virus
DKVWWTSNSI

SEQ ID NO: 350661 - protein, 10 aa, Influenza virus
KVWWTSNSIV

SEQ ID NO: 350662 - protein, 10 aa, Influenza virus
VWWTSNSIVS

SEQ ID NO: 350663 - protein, 10 aa, Influenza virus
WWTSNSIVSM

SEQ ID NO: 350664 - protein, 10 aa, Influenza virus
WTSNSIVSMC

SEQ ID NO: 350665 - protein, 10 aa, Influenza virus
TSNSIVSMCS

SEQ ID NO: 350666 - protein, 10 aa, Influenza virus
SNSIVSMCSS

SEQ ID NO: 350667 - protein, 10 aa, Influenza virus
NSIVSMCSST

SEQ ID NO: 350668 - protein, 10 aa, Influenza virus
SIVSMCSSTE

SEQ ID NO: 350669 - protein, 10 aa, Influenza virus
IVSMCSSTEF

SEQ ID NO: 350670 - protein, 10 aa, Influenza virus
VSMCSSTEFL

SEQ ID NO: 350671 - protein, 10 aa, Influenza virus
SMCSSTEFLG

SEQ ID NO: 350672 - protein, 10 aa, Influenza virus
MCSSTEFLGQ

SEQ ID NO: 350673 - protein, 10 aa, Influenza virus
CSSTEFLGQW

SEQ ID NO: 350674 - protein, 10 aa, Influenza virus
SSTEFLGQWN

SEQ ID NO: 350675 - protein, 10 aa, Influenza virus
STEFLGQWNW

SEQ ID NO: 350676 - protein, 10 aa, Influenza virus
TEFLGQWNWP

SEQ ID NO: 350677 - protein, 10 aa, Influenza virus
EFLGQWNWPD

SEQ ID NO: 350678 - protein, 10 aa, Influenza virus
FLGQWNWPDG

SEQ ID NO: 350679 - protein, 10 aa, Influenza virus
LGQWNWPDGA

SEQ ID NO: 350680 - protein, 10 aa, Influenza virus
GQWNWPDGAK

SEQ ID NO: 350681 - protein, 10 aa, Influenza virus
QWNWPDGAKI

SEQ ID NO: 350682 - protein, 10 aa, Influenza virus
WNWPDGAKIE

SEQ ID NO: 350683 - protein, 10 aa, Influenza virus
NWPDGAKIEY

SEQ ID NO: 350684 - protein, 10 aa, Influenza virus
WPDGAKIEYF

SEQ ID NO: 350685 - protein, 10 aa, Influenza virus
PDGAKIEYFL

SEQ ID NO: 350686 - protein, 10 aa, Influenza virus
GLDKICLGHH

SEQ ID NO: 350687 - protein, 10 aa, Influenza virus
LDKICLGHHA

SEQ ID NO: 350688 - protein, 10 aa, Influenza virus
DKICLGHHAV

SEQ ID NO: 350689 - protein, 10 aa, Influenza virus
KICLGHHAVS

SEQ ID NO: 350690 - protein, 10 aa, Influenza virus
ICLGHHAVSN

SEQ ID NO: 350691 - protein, 10 aa, Influenza virus
CLGHHAVSNG

SEQ ID NO: 350692 - protein, 10 aa, Influenza virus
LGHHAVSNGT

SEQ ID NO: 350693 - protein, 10 aa, Influenza virus
KEEVTNATET

SEQ ID NO: 350694 - protein, 10 aa, Influenza virus
EEVTNATETV

SEQ ID NO: 350695 - protein, 10 aa, Influenza virus
EVTNATETVE

SEQ ID NO: 350696 - protein, 10 aa, Influenza virus
VTNATETVES

SEQ ID NO: 350697 - protein, 10 aa, Influenza virus
KDLGNCHPIG

SEQ ID NO: 350698 - protein, 10 aa, Influenza virus
DLGNCHPIGM

SEQ ID NO: 350699 - protein, 10 aa, Influenza virus
NEEALRQKIM

SEQ ID NO: 350700 - protein, 10 aa, Influenza virus
EEALRQKIME

SEQ ID NO: 350701 - protein, 10 aa, Influenza virus
EALRQKIMES

SEQ ID NO: 350702 - protein, 10 aa, Influenza virus
ALRQKIMESG

SEQ ID NO: 350703 - protein, 10 aa, Influenza virus
LRQKIMESGG

SEQ ID NO: 350704 - protein, 10 aa, Influenza virus
RQKIMESGGI

SEQ ID NO: 350705 - protein, 10 aa, Influenza virus
QNFPQTTNTY

SEQ ID NO: 350706 - protein, 10 aa, Influenza virus
NFPQTTNTYR

SEQ ID NO: 350707 - protein, 10 aa, Influenza virus
FPQTTNTYRN

SEQ ID NO: 350708 - protein, 10 aa, Influenza virus
PQTTNTYRNT

SEQ ID NO: 350709 - protein, 10 aa, Influenza virus
QTTNTYRNTD

SEQ ID NO: 350710 - protein, 10 aa, Influenza virus
TTNTYRNTDS

SEQ ID NO: 350711 - protein, 10 aa, Influenza virus
LYGTQSLSIS

SEQ ID NO: 350712 - protein, 10 aa, Influenza virus
YGTQSLSISV

SEQ ID NO: 350713 - protein, 10 aa, Influenza virus
GTQSLSISVG

SEQ ID NO: 350714 - protein, 10 aa, Influenza virus
TQSLSISVGS

SEQ ID NO: 350715 - protein, 10 aa, Influenza virus
QSLSISVGSS

SEQ ID NO: 350716 - protein, 10 aa, Influenza virus
SLSISVGSST

SEQ ID NO: 350717 - protein, 10 aa, Influenza virus
LSISVGSSTY

SEQ ID NO: 350718 - protein, 10 aa, Influenza virus
SISVGSSTYQ

SEQ ID NO: 350719 - protein, 10 aa, Influenza virus
ISVGSSTYQN

SEQ ID NO: 350720 - protein, 10 aa, Influenza virus
VGSSTYQNNF

SEQ ID NO: 350721 - protein, 10 aa, Influenza virus
GSSTYQNNFV

SEQ ID NO: 350722 - protein, 10 aa, Influenza virus
SSTYQNNFVP

SEQ ID NO: 350723 - protein, 10 aa, Influenza virus
STYQNNFVPV

SEQ ID NO: 350724 - protein, 10 aa, Influenza virus
TYQNNFVPVV

SEQ ID NO: 350725 - protein, 10 aa, Influenza virus
YQNNFVPVVG

SEQ ID NO: 350726 - protein, 10 aa, Influenza virus
NNFVPVVGAR

SEQ ID NO: 350727 - protein, 10 aa, Influenza virus
NFVPVVGARP

SEQ ID NO: 350728 - protein, 10 aa, Influenza virus
FVPVVGARPQ

SEQ ID NO: 350729 - protein, 10 aa, Influenza virus
VPVVGARPQV

SEQ ID NO: 350730 - protein, 10 aa, Influenza virus
PVVGARPQVN

SEQ ID NO: 350731 - protein, 10 aa, Influenza virus
VVGARPQVNG

SEQ ID NO: 350732 - protein, 10 aa, Influenza virus
VGARPQVNGQ

SEQ ID NO: 350733 - protein, 10 aa, Influenza virus
GARPQVNGQS

SEQ ID NO: 350734 - protein, 10 aa, Influenza virus
ARPQVNGQSG

SEQ ID NO: 350735 - protein, 10 aa, Influenza virus
RPQVNGQSGR

SEQ ID NO: 350736 - protein, 10 aa, Influenza virus
PQVNGQSGRI

SEQ ID NO: 350737 - protein, 10 aa, Influenza virus
VNGQSGRIDF

SEQ ID NO: 350738 - protein, 10 aa, Influenza virus
NGQSGRIDFH

SEQ ID NO: 350739 - protein, 10 aa, Influenza virus
GQSGRIDFHW

SEQ ID NO: 350740 - protein, 10 aa, Influenza virus
PGDNITFSHN

SEQ ID NO: 350741 - protein, 10 aa, Influenza virus
GDNITFSHNG

SEQ ID NO: 350742 - protein, 10 aa, Influenza virus
DNITFSHNGG

SEQ ID NO: 350743 - protein, 10 aa, Influenza virus
NITFSHNGGL

SEQ ID NO: 350744 - protein, 10 aa, Influenza virus
ITFSHNGGLI

SEQ ID NO: 350745 - protein, 10 aa, Influenza virus
TFSHNGGLIA

SEQ ID NO: 350746 - protein, 10 aa, Influenza virus
FSHNGGLIAP

SEQ ID NO: 350747 - protein, 10 aa, Influenza virus
HNGGLIAPSR

SEQ ID NO: 350748 - protein, 10 aa, Influenza virus
NGGLIAPSRV

SEQ ID NO: 350749 - protein, 10 aa, Influenza virus
CESKCFWKGG

SEQ ID NO: 350750 - protein, 10 aa, Influenza virus
ESKCFWKGGS

SEQ ID NO: 350751 - protein, 10 aa, Influenza virus
SKCFWKGGSI

SEQ ID NO: 350752 - protein, 10 aa, Influenza virus
KCFWKGGSIN

SEQ ID NO: 350753 - protein, 10 aa, Influenza virus
CFWKGGSINT

SEQ ID NO: 350754 - protein, 10 aa, Influenza virus
GGSINTKLPF

SEQ ID NO: 350755 - protein, 10 aa, Influenza virus
GSINTKLPFQ

SEQ ID NO: 350756 - protein, 10 aa, Influenza virus
SINTKLPFQN

SEQ ID NO: 350757 - protein, 10 aa, Influenza virus
INTKLPFQNL

SEQ ID NO: 350758 - protein, 10 aa, Influenza virus
NTKLPFQNLS

SEQ ID NO: 350759 - protein, 10 aa, Influenza virus
TKLPFQNLSP

SEQ ID NO: 350760 - protein, 10 aa, Influenza virus
KLPFQNLSPR

SEQ ID NO: 350761 - protein, 10 aa, Influenza virus
LPFQNLSPRT

SEQ ID NO: 350762 - protein, 10 aa, Influenza virus
PFQNLSPRTV

SEQ ID NO: 350763 - protein, 10 aa, Influenza virus
FQNLSPRTVG

SEQ ID NO: 350764 - protein, 10 aa, Influenza virus
QNLSPRTVGQ

SEQ ID NO: 350765 - protein, 10 aa, Influenza virus
NLSPRTVGQC

SEQ ID NO: 350766 - protein, 10 aa, Influenza virus
LSPRTVGQCP

SEQ ID NO: 350767 - protein, 10 aa, Influenza virus
SPRTVGQCPK

SEQ ID NO: 350768 - protein, 10 aa, Influenza virus
PRTVGQCPKY

SEQ ID NO: 350769 - protein, 10 aa, Influenza virus
RTVGQCPKYV

SEQ ID NO: 350770 - protein, 10 aa, Influenza virus
TVGQCPKYVN

SEQ ID NO: 350771 - protein, 10 aa, Influenza virus
KSLLLATGMR

SEQ ID NO: 350772 - protein, 10 aa, Influenza virus
SLLLATGMRN

SEQ ID NO: 350773 - protein, 10 aa, Influenza virus
LLLATGMRNV

SEQ ID NO: 350774 - protein, 10 aa, Influenza virus
LLATGMRNVP

SEQ ID NO: 350775 - protein, 10 aa, Influenza virus
LATGMRNVPE

SEQ ID NO: 350776 - protein, 10 aa, Influenza virus
ATGMRNVPEV

SEQ ID NO: 350777 - protein, 10 aa, Influenza virus
QGRGLFGAIA

SEQ ID NO: 350778 - protein, 10 aa, Influenza virus
GRGLFGAIAG

SEQ ID NO: 350779 - protein, 10 aa, Influenza virus
RGLFGAIAGF

SEQ ID NO: 350780 - protein, 10 aa, Influenza virus
GLFGAIAGFI

SEQ ID NO: 350781 - protein, 10 aa, Influenza virus
LFGAIAGFIE

SEQ ID NO: 350782 - protein, 10 aa, Influenza virus
FGAIAGFIEN

SEQ ID NO: 350783 - protein, 10 aa, Influenza virus
GAIAGFIENG

SEQ ID NO: 350784 - protein, 10 aa, Influenza virus
AIAGFIENGW

SEQ ID NO: 350785 - protein, 10 aa, Influenza virus
IAGFIENGWE

SEQ ID NO: 350786 - protein, 10 aa, Influenza virus
AGFIENGWEG

SEQ ID NO: 350787 - protein, 10 aa, Influenza virus
GFIENGWEGM

SEQ ID NO: 350788 - protein, 10 aa, Influenza virus
FIENGWEGMV

SEQ ID NO: 350789 - protein, 10 aa, Influenza virus
IENGWEGMVD

SEQ ID NO: 350790 - protein, 10 aa, Influenza virus
ENGWEGMVDG

SEQ ID NO: 350791 - protein, 10 aa, Influenza virus
NGWEGMVDGW

SEQ ID NO: 350792 - protein, 10 aa, Influenza virus
GWEGMVDGWY

SEQ ID NO: 350793 - protein, 10 aa, Influenza virus
WEGMVDGWYG

SEQ ID NO: 350794 - protein, 10 aa, Influenza virus
EGMVDGWYGF

SEQ ID NO: 350795 - protein, 10 aa, Influenza virus
GMVDGWYGFR

SEQ ID NO: 350796 - protein, 10 aa, Influenza virus
MVDGWYGFRH

SEQ ID NO: 350797 - protein, 10 aa, Influenza virus
VDGWYGFRHQ

SEQ ID NO: 350798 - protein, 10 aa, Influenza virus
DGWYGFRHQN

SEQ ID NO: 350799 - protein, 10 aa, Influenza virus
GWYGFRHQNA

SEQ ID NO: 350800 - protein, 10 aa, Influenza virus
WYGFRHQNAQ

SEQ ID NO: 350801 - protein, 10 aa, Influenza virus
YGFRHQNAQG

SEQ ID NO: 350802 - protein, 10 aa, Influenza virus
GFRHQNAQGT

SEQ ID NO: 350803 - protein, 10 aa, Influenza virus
FRHQNAQGTG

SEQ ID NO: 350804 - protein, 10 aa, Influenza virus
RHQNAQGTGQ

SEQ ID NO: 350805 - protein, 10 aa, Influenza virus
HQNAQGTGQA

SEQ ID NO: 350806 - protein, 10 aa, Influenza virus
QNAQGTGQAA

SEQ ID NO: 350807 - protein, 10 aa, Influenza virus
NAQGTGQAAD

SEQ ID NO: 350808 - protein, 10 aa, Influenza virus
AQGTGQAADY

SEQ ID NO: 350809 - protein, 10 aa, Influenza virus
QGTGQAADYK

SEQ ID NO: 350810 - protein, 10 aa, Influenza virus
GTGQAADYKS

SEQ ID NO: 350811 - protein, 10 aa, Influenza virus
TGQAADYKST

SEQ ID NO: 350812 - protein, 10 aa, Influenza virus
GQAADYKSTQ

SEQ ID NO: 350813 - protein, 10 aa, Influenza virus
QAADYKSTQA

SEQ ID NO: 350814 - protein, 10 aa, Influenza virus
AADYKSTQAA

SEQ ID NO: 350815 - protein, 10 aa, Influenza virus
ADYKSTQAAI

SEQ ID NO: 350816 - protein, 10 aa, Influenza virus
AIDQITGKLN

SEQ ID NO: 350817 - protein, 10 aa, Influenza virus
IDQITGKLNR

SEQ ID NO: 350818 - protein, 10 aa, Influenza virus
DQITGKLNRL

SEQ ID NO: 350819 - protein, 10 aa, Influenza virus
QITGKLNRLI

SEQ ID NO: 350820 - protein, 10 aa, Influenza virus
ITGKLNRLIE

SEQ ID NO: 350821 - protein, 10 aa, Influenza virus
TGKLNRLIEK

SEQ ID NO: 350822 - protein, 10 aa, Influenza virus
GKLNRLIEKT

SEQ ID NO: 350823 - protein, 10 aa, Influenza virus
KLNRLIEKTN

SEQ ID NO: 350824 - protein, 10 aa, Influenza virus
LNRLIEKTNT

SEQ ID NO: 350825 - protein, 10 aa, Influenza virus
NRLIEKTNTE

SEQ ID NO: 350826 - protein, 10 aa, Influenza virus
RLIEKTNTEF

SEQ ID NO: 350827 - protein, 10 aa, Influenza virus
LIEKTNTEFE

SEQ ID NO: 350828 - protein, 10 aa, Influenza virus
IEKTNTEFES

SEQ ID NO: 350829 - protein, 10 aa, Influenza virus
EKTNTEFESI

SEQ ID NO: 350830 - protein, 10 aa, Influenza virus
KTNTEFESIE

SEQ ID NO: 350831 - protein, 10 aa, Influenza virus
TNTEFESIES

SEQ ID NO: 350832 - protein, 10 aa, Influenza virus
NTEFESIESE

SEQ ID NO: 350833 - protein, 10 aa, Influenza virus
TEFESIESEF

SEQ ID NO: 350834 - protein, 10 aa, Influenza virus
EFESIESEFS

SEQ ID NO: 350835 - protein, 10 aa, Influenza virus
FESIESEFSE

SEQ ID NO: 350836 - protein, 10 aa, Influenza virus
ESIESEFSEI

SEQ ID NO: 350837 - protein, 10 aa, Influenza virus
SIESEFSEIE

SEQ ID NO: 350838 - protein, 10 aa, Influenza virus
IESEFSEIEH

SEQ ID NO: 350839 - protein, 10 aa, Influenza virus
ESEFSEIEHQ

SEQ ID NO: 350840 - protein, 10 aa, Influenza virus
SEFSEIEHQI

SEQ ID NO: 350841 - protein, 10 aa, Influenza virus
EFSEIEHQIG

SEQ ID NO: 350842 - protein, 10 aa, Influenza virus
FSEIEHQIGN

SEQ ID NO: 350843 - protein, 10 aa, Influenza virus
SEIEHQIGNV

SEQ ID NO: 350844 - protein, 10 aa, Influenza virus
EIEHQIGNVI

SEQ ID NO: 350845 - protein, 10 aa, Influenza virus
IEHQIGNVIN

SEQ ID NO: 350846 - protein, 10 aa, Influenza virus
EHQIGNVINW

SEQ ID NO: 350847 - protein, 10 aa, Influenza virus
HQIGNVINWT

SEQ ID NO: 350848 - protein, 10 aa, Influenza virus
QIGNVINWTK

SEQ ID NO: 350849 - protein, 10 aa, Influenza virus
IGNVINWTKD

SEQ ID NO: 350850 - protein, 10 aa, Influenza virus
GNVINWTKDS

SEQ ID NO: 350851 - protein, 10 aa, Influenza virus
NVINWTKDSI

SEQ ID NO: 350852 - protein, 10 aa, Influenza virus
VINWTKDSIT

SEQ ID NO: 350853 - protein, 10 aa, Influenza virus
INWTKDSITD

SEQ ID NO: 350854 - protein, 10 aa, Influenza virus
NWTKDSITDI

SEQ ID NO: 350855 - protein, 10 aa, Influenza virus
WTKDSITDIW

SEQ ID NO: 350856 - protein, 10 aa, Influenza virus
TKDSITDIWT

SEQ ID NO: 350857 - protein, 10 aa, Influenza virus
KDSITDIWTY

SEQ ID NO: 350858 - protein, 10 aa, Influenza virus
DSITDIWTYQ

SEQ ID NO: 350859 - protein, 10 aa, Influenza virus
SITDIWTYQA

SEQ ID NO: 350860 - protein, 10 aa, Influenza virus
ITDIWTYQAE

SEQ ID NO: 350861 - protein, 10 aa, Influenza virus
TDIWTYQAEL

SEQ ID NO: 350862 - protein, 10 aa, Influenza virus
DIWTYQAELL

SEQ ID NO: 350863 - protein, 10 aa, Influenza virus
IWTYQAELLV

SEQ ID NO: 350864 - protein, 10 aa, Influenza virus
WTYQAELLVA

SEQ ID NO: 350865 - protein, 10 aa, Influenza virus
TYQAELLVAM

SEQ ID NO: 350866 - protein, 10 aa, Influenza virus
YQAELLVAME

SEQ ID NO: 350867 - protein, 10 aa, Influenza virus
QAELLVAMEN

SEQ ID NO: 350868 - protein, 10 aa, Influenza virus
AELLVAMENQ

SEQ ID NO: 350869 - protein, 10 aa, Influenza virus
ELLVAMENQH

SEQ ID NO: 350870 - protein, 10 aa, Influenza virus
LLVAMENQHT

SEQ ID NO: 350871 - protein, 10 aa, Influenza virus
LVAMENQHTI

SEQ ID NO: 350872 - protein, 10 aa, Influenza virus
VAMENQHTID

SEQ ID NO: 350873 - protein, 10 aa, Influenza virus
AMENQHTIDM

SEQ ID NO: 350874 - protein, 10 aa, Influenza virus
MENQHTIDMA

SEQ ID NO: 350875 - protein, 10 aa, Influenza virus
ENQHTIDMAD

SEQ ID NO: 350876 - protein, 10 aa, Influenza virus
NQHTIDMADS

SEQ ID NO: 350877 - protein, 10 aa, Influenza virus
QHTIDMADSE

SEQ ID NO: 350878 - protein, 10 aa, Influenza virus
HTIDMADSEM

SEQ ID NO: 350879 - protein, 10 aa, Influenza virus
TIDMADSEML

SEQ ID NO: 350880 - protein, 10 aa, Influenza virus
IDMADSEMLN

SEQ ID NO: 350881 - protein, 10 aa, Influenza virus
DMADSEMLNL

SEQ ID NO: 350882 - protein, 10 aa, Influenza virus
MADSEMLNLY

SEQ ID NO: 350883 - protein, 10 aa, Influenza virus
ADSEMLNLYE

SEQ ID NO: 350884 - protein, 10 aa, Influenza virus
DSEMLNLYER

SEQ ID NO: 350885 - protein, 10 aa, Influenza virus
SEMLNLYERV

SEQ ID NO: 350886 - protein, 10 aa, Influenza virus
EMLNLYERVR

SEQ ID NO: 350887 - protein, 10 aa, Influenza virus
MLNLYERVRK

SEQ ID NO: 350888 - protein, 10 aa, Influenza virus
LNLYERVRKQ

SEQ ID NO: 350889 - protein, 10 aa, Influenza virus
NLYERVRKQL

SEQ ID NO: 350890 - protein, 10 aa, Influenza virus
LYERVRKQLR

SEQ ID NO: 350891 - protein, 10 aa, Influenza virus
YERVRKQLRQ

SEQ ID NO: 350892 - protein, 10 aa, Influenza virus
ERVRKQLRQN

SEQ ID NO: 350893 - protein, 10 aa, Influenza virus
RVRKQLRQNA

SEQ ID NO: 350894 - protein, 10 aa, Influenza virus
VRKQLRQNAE

SEQ ID NO: 350895 - protein, 10 aa, Influenza virus
RKQLRQNAEE

SEQ ID NO: 350896 - protein, 10 aa, Influenza virus
KQLRQNAEED

SEQ ID NO: 350897 - protein, 10 aa, Influenza virus
QLRQNAEEDG

SEQ ID NO: 350898 - protein, 10 aa, Influenza virus
LRQNAEEDGK

SEQ ID NO: 350899 - protein, 10 aa, Influenza virus
RQNAEEDGKG

SEQ ID NO: 350900 - protein, 10 aa, Influenza virus
QNAEEDGKGC

SEQ ID NO: 350901 - protein, 10 aa, Influenza virus
NAEEDGKGCF

SEQ ID NO: 350902 - protein, 10 aa, Influenza virus
AEEDGKGCFE

SEQ ID NO: 350903 - protein, 10 aa, Influenza virus
EEDGKGCFEI

SEQ ID NO: 350904 - protein, 10 aa, Influenza virus
EDGKGCFEIY

SEQ ID NO: 350905 - protein, 10 aa, Influenza virus
DGKGCFEIYH

SEQ ID NO: 350906 - protein, 10 aa, Influenza virus
NCMESIRNNT

SEQ ID NO: 350907 - protein, 10 aa, Influenza virus
CMESIRNNTY

SEQ ID NO: 350908 - protein, 10 aa, Influenza virus
MESIRNNTYD

SEQ ID NO: 350909 - protein, 10 aa, Influenza virus
ESIRNNTYDH

SEQ ID NO: 350910 - protein, 10 aa, Influenza virus
IRNNTYDHTQ

SEQ ID NO: 350911 - protein, 10 aa, Influenza virus
RNNTYDHTQY

SEQ ID NO: 350912 - protein, 10 aa, Influenza virus
NNTYDHTQYR

SEQ ID NO: 350913 - protein, 10 aa, Influenza virus
NTYDHTQYRE

SEQ ID NO: 350914 - protein, 10 aa, Influenza virus
TYDHTQYREE

SEQ ID NO: 350915 - protein, 10 aa, Influenza virus
HTQYREEALL

SEQ ID NO: 350916 - protein, 10 aa, Influenza virus
QYREEALLNR

SEQ ID NO: 350917 - protein, 10 aa, Influenza virus
YREEALLNRL

SEQ ID NO: 350918 - protein, 10 aa, Influenza virus
REEALLNRLN

SEQ ID NO: 350919 - protein, 10 aa, Influenza virus
EEALLNRLNI

SEQ ID NO: 350920 - protein, 10 aa, Influenza virus
EALLNRLNIN

SEQ ID NO: 350921 - protein, 10 aa, Influenza virus
ALLNRLNINP

SEQ ID NO: 350922 - protein, 10 aa, Influenza virus
LLNRLNINPV

SEQ ID NO: 350923 - protein, 10 aa, Influenza virus
INPVKLSSGY

SEQ ID NO: 350924 - protein, 10 aa, Influenza virus
NPVKLSSGYK

SEQ ID NO: 350925 - protein, 10 aa, Influenza virus
LSSGYKDVIL

SEQ ID NO: 350926 - protein, 10 aa, Influenza virus
SSGYKDVILW

SEQ ID NO: 350927 - protein, 10 aa, Influenza virus
SGYKDVILWF

SEQ ID NO: 350928 - protein, 10 aa, Influenza virus
GYKDVILWFS

SEQ ID NO: 350929 - protein, 10 aa, Influenza virus
YKDVILWFSF

SEQ ID NO: 350930 - protein, 10 aa, Influenza virus
KDVILWFSFG

SEQ ID NO: 350931 - protein, 10 aa, Influenza virus
DVILWFSFGA

SEQ ID NO: 350932 - protein, 10 aa, Influenza virus
VILWFSFGAS

SEQ ID NO: 350933 - protein, 10 aa, Influenza virus
ILWFSFGASC

SEQ ID NO: 350934 - protein, 10 aa, Influenza virus
LWFSFGASCF

SEQ ID NO: 350935 - protein, 10 aa, Influenza virus
WFSFGASCFV

SEQ ID NO: 350936 - protein, 10 aa, Influenza virus
FSFGASCFVL

SEQ ID NO: 350937 - protein, 10 aa, Influenza virus
SFGASCFVLL

SEQ ID NO: 350938 - protein, 10 aa, Influenza virus
FGASCFVLLA

SEQ ID NO: 350939 - protein, 10 aa, Influenza virus
GNMRCTISLV

SEQ ID NO: 350940 - protein, 10 aa, Influenza virus
NMRCTISLVK

SEQ ID NO: 350941 - protein, 10 aa, Influenza virus
MRCTISLVKT

SEQ ID NO: 350942 - protein, 10 aa, Influenza virus
RCTISLVKTT

SEQ ID NO: 350943 - protein, 10 aa, Influenza virus
CTISLVKTTL

SEQ ID NO: 350944 - protein, 10 aa, Influenza virus
TISLVKTTLF

SEQ ID NO: 350945 - protein, 10 aa, Influenza virus
ISLVKTTLFL

SEQ ID NO: 350946 - protein, 10 aa, Influenza virus
GLDKICLGHH

SEQ ID NO: 350947 - protein, 10 aa, Influenza virus
LDKICLGHHA

SEQ ID NO: 350948 - protein, 10 aa, Influenza virus
DKICLGHHAV

SEQ ID NO: 350949 - protein, 10 aa, Influenza virus
KICLGHHAVS

SEQ ID NO: 350950 - protein, 10 aa, Influenza virus
ICLGHHAVSN

SEQ ID NO: 350951 - protein, 10 aa, Influenza virus
CLGHHAVSNG

SEQ ID NO: 350952 - protein, 10 aa, Influenza virus
LGHHAVSNGT

SEQ ID NO: 350953 - protein, 10 aa, Influenza virus
GHHAVSNGTI

SEQ ID NO: 350954 - protein, 10 aa, Influenza virus
SNGTIVKTLT

SEQ ID NO: 350955 - protein, 10 aa, Influenza virus
NGTIVKTLTN

SEQ ID NO: 350956 - protein, 10 aa, Influenza virus
GTIVKTLTNE

SEQ ID NO: 350957 - protein, 10 aa, Influenza virus
TIVKTLTNEK

SEQ ID NO: 350958 - protein, 10 aa, Influenza virus
IVKTLTNEKE

SEQ ID NO: 350959 - protein, 10 aa, Influenza virus
KTLTNEKEEV

SEQ ID NO: 350960 - protein, 10 aa, Influenza virus
EKEEVTNATE

SEQ ID NO: 350961 - protein, 10 aa, Influenza virus
KEEVTNATET

SEQ ID NO: 350962 - protein, 10 aa, Influenza virus
EEVTNATETV

SEQ ID NO: 350963 - protein, 10 aa, Influenza virus
EVTNATETVE

SEQ ID NO: 350964 - protein, 10 aa, Influenza virus
VTNATETVES

SEQ ID NO: 350965 - protein, 10 aa, Influenza virus
TNATETVESK

SEQ ID NO: 350966 - protein, 10 aa, Influenza virus
KDLGNCHPIG

SEQ ID NO: 350967 - protein, 10 aa, Influenza virus
DLGNCHPIGM

SEQ ID NO: 350968 - protein, 10 aa, Influenza virus
GTPACDLHLT

SEQ ID NO: 350969 - protein, 10 aa, Influenza virus
TPACDLHLTG

SEQ ID NO: 350970 - protein, 10 aa, Influenza virus
CDLHLTGTWD

SEQ ID NO: 350971 - protein, 10 aa, Influenza virus
DLHLTGTWDT

SEQ ID NO: 350972 - protein, 10 aa, Influenza virus
LHLTGTWDTL

SEQ ID NO: 350973 - protein, 10 aa, Influenza virus
HLTGTWDTLI

SEQ ID NO: 350974 - protein, 10 aa, Influenza virus
LTGTWDTLIE

SEQ ID NO: 350975 - protein, 10 aa, Influenza virus
TGTWDTLIER

SEQ ID NO: 350976 - protein, 10 aa, Influenza virus
GTWDTLIERD

SEQ ID NO: 350977 - protein, 10 aa, Influenza virus
TWDTLIERDN

SEQ ID NO: 350978 - protein, 10 aa, Influenza virus
WDTLIERDNS

SEQ ID NO: 350979 - protein, 10 aa, Influenza virus
AYCYPGATVN

SEQ ID NO: 350980 - protein, 10 aa, Influenza virus
YCYPGATVNE

SEQ ID NO: 350981 - protein, 10 aa, Influenza virus
CYPGATVNEE

SEQ ID NO: 350982 - protein, 10 aa, Influenza virus
YPGATVNEEA

SEQ ID NO: 350983 - protein, 10 aa, Influenza virus
PGATVNEEAL

SEQ ID NO: 350984 - protein, 10 aa, Influenza virus
GATVNEEALR

SEQ ID NO: 350985 - protein, 10 aa, Influenza virus
ATVNEEALRQ

SEQ ID NO: 350986 - protein, 10 aa, Influenza virus
TVNEEALRQK

SEQ ID NO: 350987 - protein, 10 aa, Influenza virus
VNEEALRQKI

SEQ ID NO: 350988 - protein, 10 aa, Influenza virus
NEEALRQKIM

SEQ ID NO: 350989 - protein, 10 aa, Influenza virus
EEALRQKIME

SEQ ID NO: 350990 - protein, 10 aa, Influenza virus
EALRQKIMES

SEQ ID NO: 350991 - protein, 10 aa, Influenza virus
ALRQKIMESG

SEQ ID NO: 350992 - protein, 10 aa, Influenza virus
LRQKIMESGG

SEQ ID NO: 350993 - protein, 10 aa, Influenza virus
RQKIMESGGI

SEQ ID NO: 350994 - protein, 10 aa, Influenza virus
QKIMESGGID

SEQ ID NO: 350995 - protein, 10 aa, Influenza virus
KIMESGGIDK

SEQ ID NO: 350996 - protein, 10 aa, Influenza virus
IMESGGIDKI

SEQ ID NO: 350997 - protein, 10 aa, Influenza virus
MESGGIDKIS

SEQ ID NO: 350998 - protein, 10 aa, Influenza virus
ESGGIDKIST

SEQ ID NO: 350999 - protein, 10 aa, Influenza virus
GGNSFYAELK

SEQ ID NO: 351000 - protein, 10 aa, Influenza virus
GNSFYAELKW

SEQ ID NO: 351001 - protein, 10 aa, Influenza virus
NSFYAELKWL

SEQ ID NO: 351002 - protein, 10 aa, Influenza virus
SFYAELKWLV

SEQ ID NO: 351003 - protein, 10 aa, Influenza virus
FYAELKWLVS

SEQ ID NO: 351004 - protein, 10 aa, Influenza virus
YAELKWLVSK

SEQ ID NO: 351005 - protein, 10 aa, Influenza virus
AELKWLVSKS

SEQ ID NO: 351006 - protein, 10 aa, Influenza virus
ELKWLVSKSK

SEQ ID NO: 351007 - protein, 10 aa, Influenza virus
LKWLVSKSKG

SEQ ID NO: 351008 - protein, 10 aa, Influenza virus
KWLVSKSKGQ

SEQ ID NO: 351009 - protein, 10 aa, Influenza virus
QNFPQTTNTY

SEQ ID NO: 351010 - protein, 10 aa, Influenza virus
NFPQTTNTYR

SEQ ID NO: 351011 - protein, 10 aa, Influenza virus
FPQTTNTYRN

SEQ ID NO: 351012 - protein, 10 aa, Influenza virus
PQTTNTYRNT

SEQ ID NO: 351013 - protein, 10 aa, Influenza virus
QTTNTYRNTD

SEQ ID NO: 351014 - protein, 10 aa, Influenza virus
TTNTYRNTDS

SEQ ID NO: 351015 - protein, 10 aa, Influenza virus
EHLIIWGIHH

SEQ ID NO: 351016 - protein, 10 aa, Influenza virus
HLIIWGIHHP

SEQ ID NO: 351017 - protein, 10 aa, Influenza virus
LIIWGIHHPS

SEQ ID NO: 351018 - protein, 10 aa, Influenza virus
IIWGIHHPSS

SEQ ID NO: 351019 - protein, 10 aa, Influenza virus
WGIHHPSSTQ

SEQ ID NO: 351020 - protein, 10 aa, Influenza virus
GIHHPSSTQE

SEQ ID NO: 351021 - protein, 10 aa, Influenza virus
IHHPSSTQEK

SEQ ID NO: 351022 - protein, 10 aa, Influenza virus
HHPSSTQEKN

SEQ ID NO: 351023 - protein, 10 aa, Influenza virus
HPSSTQEKND

SEQ ID NO: 351024 - protein, 10 aa, Influenza virus
PSSTQEKNDL

SEQ ID NO: 351025 - protein, 10 aa, Influenza virus
SSTQEKNDLY

SEQ ID NO: 351026 - protein, 10 aa, Influenza virus
STQEKNDLYG

SEQ ID NO: 351027 - protein, 10 aa, Influenza virus
QEKNDLYGTQ

SEQ ID NO: 351028 - protein, 10 aa, Influenza virus
EKNDLYGTQS

SEQ ID NO: 351029 - protein, 10 aa, Influenza virus
KNDLYGTQSL

SEQ ID NO: 351030 - protein, 10 aa, Influenza virus
NDLYGTQSLS

SEQ ID NO: 351031 - protein, 10 aa, Influenza virus
DLYGTQSLSI

SEQ ID NO: 351032 - protein, 10 aa, Influenza virus
LYGTQSLSIS

SEQ ID NO: 351033 - protein, 10 aa, Influenza virus
YGTQSLSISV

SEQ ID NO: 351034 - protein, 10 aa, Influenza virus
GTQSLSISVG

SEQ ID NO: 351035 - protein, 10 aa, Influenza virus
TQSLSISVGS

SEQ ID NO: 351036 - protein, 10 aa, Influenza virus
QSLSISVGSS

SEQ ID NO: 351037 - protein, 10 aa, Influenza virus
SLSISVGSST

SEQ ID NO: 351038 - protein, 10 aa, Influenza virus
LSISVGSSTY

SEQ ID NO: 351039 - protein, 10 aa, Influenza virus
SISVGSSTYQ

SEQ ID NO: 351040 - protein, 10 aa, Influenza virus
ISVGSSTYQN

SEQ ID NO: 351041 - protein, 10 aa, Influenza virus
SVGSSTYQNN

SEQ ID NO: 351042 - protein, 10 aa, Influenza virus
VGSSTYQNNF

SEQ ID NO: 351043 - protein, 10 aa, Influenza virus
GSSTYQNNFV

SEQ ID NO: 351044 - protein, 10 aa, Influenza virus
SSTYQNNFVP

SEQ ID NO: 351045 - protein, 10 aa, Influenza virus
STYQNNFVPV

SEQ ID NO: 351046 - protein, 10 aa, Influenza virus
TYQNNFVPVV

SEQ ID NO: 351047 - protein, 10 aa, Influenza virus
YQNNFVPVVG

SEQ ID NO: 351048 - protein, 10 aa, Influenza virus
QNNFVPVVGA

SEQ ID NO: 351049 - protein, 10 aa, Influenza virus
NNFVPVVGAR

SEQ ID NO: 351050 - protein, 10 aa, Influenza virus
NFVPVVGARP

SEQ ID NO: 351051 - protein, 10 aa, Influenza virus
FVPVVGARPQ

SEQ ID NO: 351052 - protein, 10 aa, Influenza virus
VPVVGARPQV

SEQ ID NO: 351053 - protein, 10 aa, Influenza virus
PVVGARPQVN

SEQ ID NO: 351054 - protein, 10 aa, Influenza virus
VVGARPQVNG

SEQ ID NO: 351055 - protein, 10 aa, Influenza virus
VGARPQVNGQ

SEQ ID NO: 351056 - protein, 10 aa, Influenza virus
GARPQVNGQS

SEQ ID NO: 351057 - protein, 10 aa, Influenza virus
ARPQVNGQSG

SEQ ID NO: 351058 - protein, 10 aa, Influenza virus
RPQVNGQSGR

SEQ ID NO: 351059 - protein, 10 aa, Influenza virus
PQVNGQSGRI

SEQ ID NO: 351060 - protein, 10 aa, Influenza virus
QVNGQSGRID

SEQ ID NO: 351061 - protein, 10 aa, Influenza virus
VNGQSGRIDF

SEQ ID NO: 351062 - protein, 10 aa, Influenza virus
NGQSGRIDFH

SEQ ID NO: 351063 - protein, 10 aa, Influenza virus
GQSGRIDFHW

SEQ ID NO: 351064 - protein, 10 aa, Influenza virus
QSGRIDFHWT

SEQ ID NO: 351065 - protein, 10 aa, Influenza virus
VQPGDNITFS

SEQ ID NO: 351066 - protein, 10 aa, Influenza virus
QPGDNITFSH

SEQ ID NO: 351067 - protein, 10 aa, Influenza virus
PGDNITFSHN

SEQ ID NO: 351068 - protein, 10 aa, Influenza virus
GDNITFSHNG

SEQ ID NO: 351069 - protein, 10 aa, Influenza virus
DNITFSHNGG

SEQ ID NO: 351070 - protein, 10 aa, Influenza virus
NITFSHNGGL

SEQ ID NO: 351071 - protein, 10 aa, Influenza virus
ITFSHNGGLI

SEQ ID NO: 351072 - protein, 10 aa, Influenza virus
TFSHNGGLIA

SEQ ID NO: 351073 - protein, 10 aa, Influenza virus
FSHNGGLIAP

SEQ ID NO: 351074 - protein, 10 aa, Influenza virus
SHNGGLIAPS

SEQ ID NO: 351075 - protein, 10 aa, Influenza virus
HNGGLIAPSR

SEQ ID NO: 351076 - protein, 10 aa, Influenza virus
NGGLIAPSRV

SEQ ID NO: 351077 - protein, 10 aa, Influenza virus
GGLIAPSRVS

SEQ ID NO: 351078 - protein, 10 aa, Influenza virus
GLIAPSRVSK

SEQ ID NO: 351079 - protein, 10 aa, Influenza virus
LIAPSRVSKL

SEQ ID NO: 351080 - protein, 10 aa, Influenza virus
APSRVSKLKG

SEQ ID NO: 351081 - protein, 10 aa, Influenza virus
DNDCESKCFW

SEQ ID NO: 351082 - protein, 10 aa, Influenza virus
CESKCFWKGG

SEQ ID NO: 351083 - protein, 10 aa, Influenza virus
ESKCFWKGGS

SEQ ID NO: 351084 - protein, 10 aa, Influenza virus
SKCFWKGGSI

SEQ ID NO: 351085 - protein, 10 aa, Influenza virus
KCFWKGGSIN

SEQ ID NO: 351086 - protein, 10 aa, Influenza virus
CFWKGGSINT

SEQ ID NO: 351087 - protein, 10 aa, Influenza virus
FWKGGSINTK

SEQ ID NO: 351088 - protein, 10 aa, Influenza virus
WKGGSINTKL

SEQ ID NO: 351089 - protein, 10 aa, Influenza virus
KGGSINTKLP

SEQ ID NO: 351090 - protein, 10 aa, Influenza virus
GGSINTKLPF

SEQ ID NO: 351091 - protein, 10 aa, Influenza virus
GSINTKLPFQ

SEQ ID NO: 351092 - protein, 10 aa, Influenza virus
SINTKLPFQN

SEQ ID NO: 351093 - protein, 10 aa, Influenza virus
INTKLPFQNL

SEQ ID NO: 351094 - protein, 10 aa, Influenza virus
NTKLPFQNLS

SEQ ID NO: 351095 - protein, 10 aa, Influenza virus
TKLPFQNLSP

SEQ ID NO: 351096 - protein, 10 aa, Influenza virus
KLPFQNLSPR

SEQ ID NO: 351097 - protein, 10 aa, Influenza virus
LPFQNLSPRT

SEQ ID NO: 351098 - protein, 10 aa, Influenza virus
PFQNLSPRTV

SEQ ID NO: 351099 - protein, 10 aa, Influenza virus
FQNLSPRTVG

SEQ ID NO: 351100 - protein, 10 aa, Influenza virus
QNLSPRTVGQ

SEQ ID NO: 351101 - protein, 10 aa, Influenza virus
NLSPRTVGQC

SEQ ID NO: 351102 - protein, 10 aa, Influenza virus
LSPRTVGQCP

SEQ ID NO: 351103 - protein, 10 aa, Influenza virus
SPRTVGQCPK

SEQ ID NO: 351104 - protein, 10 aa, Influenza virus
PRTVGQCPKY

SEQ ID NO: 351105 - protein, 10 aa, Influenza virus
RTVGQCPKYV

SEQ ID NO: 351106 - protein, 10 aa, Influenza virus
TVGQCPKYVN

SEQ ID NO: 351107 - protein, 10 aa, Influenza virus
VGQCPKYVNK

SEQ ID NO: 351108 - protein, 10 aa, Influenza virus
KSLLLATGMR

SEQ ID NO: 351109 - protein, 10 aa, Influenza virus
SLLLATGMRN

SEQ ID NO: 351110 - protein, 10 aa, Influenza virus
LLLATGMRNV

SEQ ID NO: 351111 - protein, 10 aa, Influenza virus
LLATGMRNVP

SEQ ID NO: 351112 - protein, 10 aa, Influenza virus
LATGMRNVPE

SEQ ID NO: 351113 - protein, 10 aa, Influenza virus
ATGMRNVPEV

SEQ ID NO: 351114 - protein, 10 aa, Influenza virus
QGRGLFGAIA

SEQ ID NO: 351115 - protein, 10 aa, Influenza virus
GRGLFGAIAG

SEQ ID NO: 351116 - protein, 10 aa, Influenza virus
RGLFGAIAGF

SEQ ID NO: 351117 - protein, 10 aa, Influenza virus
GLFGAIAGFI

SEQ ID NO: 351118 - protein, 10 aa, Influenza virus
LFGAIAGFIE

SEQ ID NO: 351119 - protein, 10 aa, Influenza virus
FGAIAGFIEN

SEQ ID NO: 351120 - protein, 10 aa, Influenza virus
GAIAGFIENG

SEQ ID NO: 351121 - protein, 10 aa, Influenza virus
AIAGFIENGW

SEQ ID NO: 351122 - protein, 10 aa, Influenza virus
IAGFIENGWE

SEQ ID NO: 351123 - protein, 10 aa, Influenza virus
AGFIENGWEG

SEQ ID NO: 351124 - protein, 10 aa, Influenza virus
GFIENGWEGM

SEQ ID NO: 351125 - protein, 10 aa, Influenza virus
FIENGWEGMV

SEQ ID NO: 351126 - protein, 10 aa, Influenza virus
IENGWEGMVD

SEQ ID NO: 351127 - protein, 10 aa, Influenza virus
ENGWEGMVDG

SEQ ID NO: 351128 - protein, 10 aa, Influenza virus
NGWEGMVDGW

SEQ ID NO: 351129 - protein, 10 aa, Influenza virus
GWEGMVDGWY

SEQ ID NO: 351130 - protein, 10 aa, Influenza virus
WEGMVDGWYG

SEQ ID NO: 351131 - protein, 10 aa, Influenza virus
EGMVDGWYGF

SEQ ID NO: 351132 - protein, 10 aa, Influenza virus
GMVDGWYGFR

SEQ ID NO: 351133 - protein, 10 aa, Influenza virus
MVDGWYGFRH

SEQ ID NO: 351134 - protein, 10 aa, Influenza virus
VDGWYGFRHQ

SEQ ID NO: 351135 - protein, 10 aa, Influenza virus
DGWYGFRHQN

SEQ ID NO: 351136 - protein, 10 aa, Influenza virus
GWYGFRHQNA

SEQ ID NO: 351137 - protein, 10 aa, Influenza virus
WYGFRHQNAQ

SEQ ID NO: 351138 - protein, 10 aa, Influenza virus
YGFRHQNAQG

SEQ ID NO: 351139 - protein, 10 aa, Influenza virus
GFRHQNAQGT

SEQ ID NO: 351140 - protein, 10 aa, Influenza virus
FRHQNAQGTG

SEQ ID NO: 351141 - protein, 10 aa, Influenza virus
RHQNAQGTGQ

SEQ ID NO: 351142 - protein, 10 aa, Influenza virus
HQNAQGTGQA

SEQ ID NO: 351143 - protein, 10 aa, Influenza virus
QNAQGTGQAA

SEQ ID NO: 351144 - protein, 10 aa, Influenza virus
NAQGTGQAAD

SEQ ID NO: 351145 - protein, 10 aa, Influenza virus
AQGTGQAADY

SEQ ID NO: 351146 - protein, 10 aa, Influenza virus
QGTGQAADYK

SEQ ID NO: 351147 - protein, 10 aa, Influenza virus
GTGQAADYKS

SEQ ID NO: 351148 - protein, 10 aa, Influenza virus
TGQAADYKST

SEQ ID NO: 351149 - protein, 10 aa, Influenza virus
GQAADYKSTQ

SEQ ID NO: 351150 - protein, 10 aa, Influenza virus
QAADYKSTQA

SEQ ID NO: 351151 - protein, 10 aa, Influenza virus
AADYKSTQAA

SEQ ID NO: 351152 - protein, 10 aa, Influenza virus
ADYKSTQAAI

SEQ ID NO: 351153 - protein, 10 aa, Influenza virus
DYKSTQAAID

SEQ ID NO: 351154 - protein, 10 aa, Influenza virus
YKSTQAAIDQ

SEQ ID NO: 351155 - protein, 10 aa, Influenza virus
KSTQAAIDQI

SEQ ID NO: 351156 - protein, 10 aa, Influenza virus
STQAAIDQIT

SEQ ID NO: 351157 - protein, 10 aa, Influenza virus
TQAAIDQITG

SEQ ID NO: 351158 - protein, 10 aa, Influenza virus
QAAIDQITGK

SEQ ID NO: 351159 - protein, 10 aa, Influenza virus
AAIDQITGKL

SEQ ID NO: 351160 - protein, 10 aa, Influenza virus
AIDQITGKLN

SEQ ID NO: 351161 - protein, 10 aa, Influenza virus
IDQITGKLNR

SEQ ID NO: 351162 - protein, 10 aa, Influenza virus
DQITGKLNRL

SEQ ID NO: 351163 - protein, 10 aa, Influenza virus
QITGKLNRLI

SEQ ID NO: 351164 - protein, 10 aa, Influenza virus
ITGKLNRLIE

SEQ ID NO: 351165 - protein, 10 aa, Influenza virus
TGKLNRLIEK

SEQ ID NO: 351166 - protein, 10 aa, Influenza virus
GKLNRLIEKT

SEQ ID NO: 351167 - protein, 10 aa, Influenza virus
KLNRLIEKTN

SEQ ID NO: 351168 - protein, 10 aa, Influenza virus
LNRLIEKTNT

SEQ ID NO: 351169 - protein, 10 aa, Influenza virus
NRLIEKTNTE

SEQ ID NO: 351170 - protein, 10 aa, Influenza virus
RLIEKTNTEF

SEQ ID NO: 351171 - protein, 10 aa, Influenza virus
LIEKTNTEFE

SEQ ID NO: 351172 - protein, 10 aa, Influenza virus
IEKTNTEFES

SEQ ID NO: 351173 - protein, 10 aa, Influenza virus
EKTNTEFESI

SEQ ID NO: 351174 - protein, 10 aa, Influenza virus
KTNTEFESIE

SEQ ID NO: 351175 - protein, 10 aa, Influenza virus
TNTEFESIES

SEQ ID NO: 351176 - protein, 10 aa, Influenza virus
NTEFESIESE

SEQ ID NO: 351177 - protein, 10 aa, Influenza virus
TEFESIESEF

SEQ ID NO: 351178 - protein, 10 aa, Influenza virus
EFESIESEFS

SEQ ID NO: 351179 - protein, 10 aa, Influenza virus
FESIESEFSE

SEQ ID NO: 351180 - protein, 10 aa, Influenza virus
ESIESEFSEI

SEQ ID NO: 351181 - protein, 10 aa, Influenza virus
SIESEFSEIE

SEQ ID NO: 351182 - protein, 10 aa, Influenza virus
IESEFSEIEH

SEQ ID NO: 351183 - protein, 10 aa, Influenza virus
ESEFSEIEHQ

SEQ ID NO: 351184 - protein, 10 aa, Influenza virus
SEFSEIEHQI

SEQ ID NO: 351185 - protein, 10 aa, Influenza virus
EFSEIEHQIG

SEQ ID NO: 351186 - protein, 10 aa, Influenza virus
FSEIEHQIGN

SEQ ID NO: 351187 - protein, 10 aa, Influenza virus
SEIEHQIGNV

SEQ ID NO: 351188 - protein, 10 aa, Influenza virus
EIEHQIGNVI

SEQ ID NO: 351189 - protein, 10 aa, Influenza virus
IEHQIGNVIN

SEQ ID NO: 351190 - protein, 10 aa, Influenza virus
EHQIGNVINW

SEQ ID NO: 351191 - protein, 10 aa, Influenza virus
HQIGNVINWT

SEQ ID NO: 351192 - protein, 10 aa, Influenza virus
QIGNVINWTK

SEQ ID NO: 351193 - protein, 10 aa, Influenza virus
IGNVINWTKD

SEQ ID NO: 351194 - protein, 10 aa, Influenza virus
GNVINWTKDS

SEQ ID NO: 351195 - protein, 10 aa, Influenza virus
NVINWTKDSI

SEQ ID NO: 351196 - protein, 10 aa, Influenza virus
VINWTKDSIT

SEQ ID NO: 351197 - protein, 10 aa, Influenza virus
INWTKDSITD

SEQ ID NO: 351198 - protein, 10 aa, Influenza virus
NWTKDSITDI

SEQ ID NO: 351199 - protein, 10 aa, Influenza virus
WTKDSITDIW

SEQ ID NO: 351200 - protein, 10 aa, Influenza virus
TKDSITDIWT

SEQ ID NO: 351201 - protein, 10 aa, Influenza virus
KDSITDIWTY

SEQ ID NO: 351202 - protein, 10 aa, Influenza virus
DSITDIWTYQ

SEQ ID NO: 351203 - protein, 10 aa, Influenza virus
SITDIWTYQA

SEQ ID NO: 351204 - protein, 10 aa, Influenza virus
ITDIWTYQAE

SEQ ID NO: 351205 - protein, 10 aa, Influenza virus
TDIWTYQAEL

SEQ ID NO: 351206 - protein, 10 aa, Influenza virus
DIWTYQAELL

SEQ ID NO: 351207 - protein, 10 aa, Influenza virus
IWTYQAELLV

SEQ ID NO: 351208 - protein, 10 aa, Influenza virus
WTYQAELLVA

SEQ ID NO: 351209 - protein, 10 aa, Influenza virus
TYQAELLVAM

SEQ ID NO: 351210 - protein, 10 aa, Influenza virus
YQAELLVAME

SEQ ID NO: 351211 - protein, 10 aa, Influenza virus
QAELLVAMEN

SEQ ID NO: 351212 - protein, 10 aa, Influenza virus
AELLVAMENQ

SEQ ID NO: 351213 - protein, 10 aa, Influenza virus
ELLVAMENQH

SEQ ID NO: 351214 - protein, 10 aa, Influenza virus
LLVAMENQHT

SEQ ID NO: 351215 - protein, 10 aa, Influenza virus
LVAMENQHTI

SEQ ID NO: 351216 - protein, 10 aa, Influenza virus
VAMENQHTID

SEQ ID NO: 351217 - protein, 10 aa, Influenza virus
AMENQHTIDM

SEQ ID NO: 351218 - protein, 10 aa, Influenza virus
MENQHTIDMA

SEQ ID NO: 351219 - protein, 10 aa, Influenza virus
ENQHTIDMAD

SEQ ID NO: 351220 - protein, 10 aa, Influenza virus
NQHTIDMADS

SEQ ID NO: 351221 - protein, 10 aa, Influenza virus
QHTIDMADSE

SEQ ID NO: 351222 - protein, 10 aa, Influenza virus
HTIDMADSEM

SEQ ID NO: 351223 - protein, 10 aa, Influenza virus
TIDMADSEML

SEQ ID NO: 351224 - protein, 10 aa, Influenza virus
IDMADSEMLN

SEQ ID NO: 351225 - protein, 10 aa, Influenza virus
DMADSEMLNL

SEQ ID NO: 351226 - protein, 10 aa, Influenza virus
MADSEMLNLY

SEQ ID NO: 351227 - protein, 10 aa, Influenza virus
ADSEMLNLYE

SEQ ID NO: 351228 - protein, 10 aa, Influenza virus
DSEMLNLYER

SEQ ID NO: 351229 - protein, 10 aa, Influenza virus
SEMLNLYERV

SEQ ID NO: 351230 - protein, 10 aa, Influenza virus
EMLNLYERVR

SEQ ID NO: 351231 - protein, 10 aa, Influenza virus
MLNLYERVRK

SEQ ID NO: 351232 - protein, 10 aa, Influenza virus
LNLYERVRKQ

SEQ ID NO: 351233 - protein, 10 aa, Influenza virus
NLYERVRKQL

SEQ ID NO: 351234 - protein, 10 aa, Influenza virus
LYERVRKQLR

SEQ ID NO: 351235 - protein, 10 aa, Influenza virus
YERVRKQLRQ

SEQ ID NO: 351236 - protein, 10 aa, Influenza virus
ERVRKQLRQN

SEQ ID NO: 351237 - protein, 10 aa, Influenza virus
RVRKQLRQNA

SEQ ID NO: 351238 - protein, 10 aa, Influenza virus
VRKQLRQNAE

SEQ ID NO: 351239 - protein, 10 aa, Influenza virus
RKQLRQNAEE

SEQ ID NO: 351240 - protein, 10 aa, Influenza virus
KQLRQNAEED

SEQ ID NO: 351241 - protein, 10 aa, Influenza virus
QLRQNAEEDG

SEQ ID NO: 351242 - protein, 10 aa, Influenza virus
LRQNAEEDGK

SEQ ID NO: 351243 - protein, 10 aa, Influenza virus
RQNAEEDGKG

SEQ ID NO: 351244 - protein, 10 aa, Influenza virus
QNAEEDGKGC

SEQ ID NO: 351245 - protein, 10 aa, Influenza virus
NAEEDGKGCF

SEQ ID NO: 351246 - protein, 10 aa, Influenza virus
AEEDGKGCFE

SEQ ID NO: 351247 - protein, 10 aa, Influenza virus
EEDGKGCFEI

SEQ ID NO: 351248 - protein, 10 aa, Influenza virus
EDGKGCFEIY

SEQ ID NO: 351249 - protein, 10 aa, Influenza virus
DGKGCFEIYH

SEQ ID NO: 351250 - protein, 10 aa, Influenza virus
GKGCFEIYHK

SEQ ID NO: 351251 - protein, 10 aa, Influenza virus
KGCFEIYHKC

SEQ ID NO: 351252 - protein, 10 aa, Influenza virus
GCFEIYHKCD

SEQ ID NO: 351253 - protein, 10 aa, Influenza virus
CDDNCMESIR

SEQ ID NO: 351254 - protein, 10 aa, Influenza virus
DNCMESIRNN

SEQ ID NO: 351255 - protein, 10 aa, Influenza virus
NCMESIRNNT

SEQ ID NO: 351256 - protein, 10 aa, Influenza virus
CMESIRNNTY

SEQ ID NO: 351257 - protein, 10 aa, Influenza virus
MESIRNNTYD

SEQ ID NO: 351258 - protein, 10 aa, Influenza virus
ESIRNNTYDH

SEQ ID NO: 351259 - protein, 10 aa, Influenza virus
SIRNNTYDHT

SEQ ID NO: 351260 - protein, 10 aa, Influenza virus
IRNNTYDHTQ

SEQ ID NO: 351261 - protein, 10 aa, Influenza virus
RNNTYDHTQY

SEQ ID NO: 351262 - protein, 10 aa, Influenza virus
NNTYDHTQYR

SEQ ID NO: 351263 - protein, 10 aa, Influenza virus
NTYDHTQYRE

SEQ ID NO: 351264 - protein, 10 aa, Influenza virus
TYDHTQYREE

SEQ ID NO: 351265 - protein, 10 aa, Influenza virus
YDHTQYREEA

SEQ ID NO: 351266 - protein, 10 aa, Influenza virus
DHTQYREEAL

SEQ ID NO: 351267 - protein, 10 aa, Influenza virus
HTQYREEALL

SEQ ID NO: 351268 - protein, 10 aa, Influenza virus
TQYREEALLN

SEQ ID NO: 351269 - protein, 10 aa, Influenza virus
QYREEALLNR

SEQ ID NO: 351270 - protein, 10 aa, Influenza virus
YREEALLNRL

SEQ ID NO: 351271 - protein, 10 aa, Influenza virus
REEALLNRLN

SEQ ID NO: 351272 - protein, 10 aa, Influenza virus
EEALLNRLNI

SEQ ID NO: 351273 - protein, 10 aa, Influenza virus
EALLNRLNIN

SEQ ID NO: 351274 - protein, 10 aa, Influenza virus
ALLNRLNINP

SEQ ID NO: 351275 - protein, 10 aa, Influenza virus
LLNRLNINPV

SEQ ID NO: 351276 - protein, 10 aa, Influenza virus
LNRLNINPVK

SEQ ID NO: 351277 - protein, 10 aa, Influenza virus
NRLNINPVKL

SEQ ID NO: 351278 - protein, 10 aa, Influenza virus
RLNINPVKLS

SEQ ID NO: 351279 - protein, 10 aa, Influenza virus
LNINPVKLSS

SEQ ID NO: 351280 - protein, 10 aa, Influenza virus
NINPVKLSSG

SEQ ID NO: 351281 - protein, 10 aa, Influenza virus
INPVKLSSGY

SEQ ID NO: 351282 - protein, 10 aa, Influenza virus
NPVKLSSGYK

SEQ ID NO: 351283 - protein, 10 aa, Influenza virus
PVKLSSGYKD

SEQ ID NO: 351284 - protein, 10 aa, Influenza virus
VKLSSGYKDV

SEQ ID NO: 351285 - protein, 10 aa, Influenza virus
KLSSGYKDVI

SEQ ID NO: 351286 - protein, 10 aa, Influenza virus
LSSGYKDVIL

SEQ ID NO: 351287 - protein, 10 aa, Influenza virus
SSGYKDVILW

SEQ ID NO: 351288 - protein, 10 aa, Influenza virus
SGYKDVILWF

SEQ ID NO: 351289 - protein, 10 aa, Influenza virus
GYKDVILWFS

SEQ ID NO: 351290 - protein, 10 aa, Influenza virus
YKDVILWFSF

SEQ ID NO: 351291 - protein, 10 aa, Influenza virus
KDVILWFSFG

SEQ ID NO: 351292 - protein, 10 aa, Influenza virus
DVILWFSFGA

SEQ ID NO: 351293 - protein, 10 aa, Influenza virus
VILWFSFGAS

SEQ ID NO: 351294 - protein, 10 aa, Influenza virus
ILWFSFGASC

SEQ ID NO: 351295 - protein, 10 aa, Influenza virus
LWFSFGASCF

SEQ ID NO: 351296 - protein, 10 aa, Influenza virus
WFSFGASCFV

SEQ ID NO: 351297 - protein, 10 aa, Influenza virus
FSFGASCFVL

SEQ ID NO: 351298 - protein, 10 aa, Influenza virus
SFGASCFVLL

SEQ ID NO: 351299 - protein, 10 aa, Influenza virus
FGASCFVLLA

SEQ ID NO: 351300 - protein, 10 aa, Influenza virus
GASCFVLLAV

SEQ ID NO: 351301 - protein, 10 aa, Influenza virus
IMGLVFFCLK

SEQ ID NO: 351302 - protein, 10 aa, Influenza virus
MGLVFFCLKN

SEQ ID NO: 351303 - protein, 10 aa, Influenza virus
GLVFFCLKNG

SEQ ID NO: 351304 - protein, 10 aa, Influenza virus
LVFFCLKNGN

SEQ ID NO: 351305 - protein, 10 aa, Influenza virus
VFFCLKNGNM

SEQ ID NO: 351306 - protein, 10 aa, Influenza virus
FFCLKNGNMR

SEQ ID NO: 351307 - protein, 10 aa, Influenza virus
FCLKNGNMRC

SEQ ID NO: 351308 - protein, 10 aa, Influenza virus
CLKNGNMRCT

SEQ ID NO: 351309 - protein, 10 aa, Influenza virus
LKNGNMRCTI

SEQ ID NO: 351310 - protein, 10 aa, Influenza virus
KNGNMRCTIC

SEQ ID NO: 351311 - protein, 10 aa, Influenza virus
NGNMRCTICI

SEQ ID NO: 351312 - protein, 10 aa, Influenza virus
MNPNQKLFAL

SEQ ID NO: 351313 - protein, 10 aa, Influenza virus
NPNQKLFALS

SEQ ID NO: 351314 - protein, 10 aa, Influenza virus
PNQKLFALSG

SEQ ID NO: 351315 - protein, 10 aa, Influenza virus
NQKLFALSGV

SEQ ID NO: 351316 - protein, 10 aa, Influenza virus
QKLFALSGVA

SEQ ID NO: 351317 - protein, 10 aa, Influenza virus
KLFALSGVAI

SEQ ID NO: 351318 - protein, 10 aa, Influenza virus
LFALSGVAIA

SEQ ID NO: 351319 - protein, 10 aa, Influenza virus
FALSGVAIAL

SEQ ID NO: 351320 - protein, 10 aa, Influenza virus
LNLLIGISNV

SEQ ID NO: 351321 - protein, 10 aa, Influenza virus
NLLIGISNVG

SEQ ID NO: 351322 - protein, 10 aa, Influenza virus
LLIGISNVGL

SEQ ID NO: 351323 - protein, 10 aa, Influenza virus
LIGISNVGLN

SEQ ID NO: 351324 - protein, 10 aa, Influenza virus
IGISNVGLNV

SEQ ID NO: 351325 - protein, 10 aa, Influenza virus
GISNVGLNVS

SEQ ID NO: 351326 - protein, 10 aa, Influenza virus
ISNVGLNVSL

SEQ ID NO: 351327 - protein, 10 aa, Influenza virus
SNVGLNVSLH

SEQ ID NO: 351328 - protein, 10 aa, Influenza virus
NVGLNVSLHL

SEQ ID NO: 351329 - protein, 10 aa, Influenza virus
VGLNVSLHLK

SEQ ID NO: 351330 - protein, 10 aa, Influenza virus
EKGTKQEENL

SEQ ID NO: 351331 - protein, 10 aa, Influenza virus
TQNNTTLIEN

SEQ ID NO: 351332 - protein, 10 aa, Influenza virus
QNNTTLIENT

SEQ ID NO: 351333 - protein, 10 aa, Influenza virus
NNTTLIENTY

SEQ ID NO: 351334 - protein, 10 aa, Influenza virus
NTTLIENTYV

SEQ ID NO: 351335 - protein, 10 aa, Influenza virus
TTLIENTYVN

SEQ ID NO: 351336 - protein, 10 aa, Influenza virus
TLIENTYVNN

SEQ ID NO: 351337 - protein, 10 aa, Influenza virus
LIENTYVNNT

SEQ ID NO: 351338 - protein, 10 aa, Influenza virus
IENTYVNNTT

SEQ ID NO: 351339 - protein, 10 aa, Influenza virus
ENTYVNNTTV

SEQ ID NO: 351340 - protein, 10 aa, Influenza virus
NTYVNNTTVI

SEQ ID NO: 351341 - protein, 10 aa, Influenza virus
YVNNTTVINK

SEQ ID NO: 351342 - protein, 10 aa, Influenza virus
YLMLNKSLCK

SEQ ID NO: 351343 - protein, 10 aa, Influenza virus
LMLNKSLCKV

SEQ ID NO: 351344 - protein, 10 aa, Influenza virus
MLNKSLCKVE

SEQ ID NO: 351345 - protein, 10 aa, Influenza virus
LNKSLCKVEG

SEQ ID NO: 351346 - protein, 10 aa, Influenza virus
NKSLCKVEGW

SEQ ID NO: 351347 - protein, 10 aa, Influenza virus
KSLCKVEGWV

SEQ ID NO: 351348 - protein, 10 aa, Influenza virus
SLCKVEGWVV

SEQ ID NO: 351349 - protein, 10 aa, Influenza virus
LCKVEGWVVV

SEQ ID NO: 351350 - protein, 10 aa, Influenza virus
CKVEGWVVVA

SEQ ID NO: 351351 - protein, 10 aa, Influenza virus
KVEGWVVVAK

SEQ ID NO: 351352 - protein, 10 aa, Influenza virus
VEGWVVVAKD

SEQ ID NO: 351353 - protein, 10 aa, Influenza virus
EGWVVVAKDN

SEQ ID NO: 351354 - protein, 10 aa, Influenza virus
GWVVVAKDNA

SEQ ID NO: 351355 - protein, 10 aa, Influenza virus
WVVVAKDNAI

SEQ ID NO: 351356 - protein, 10 aa, Influenza virus
VVVAKDNAIR

SEQ ID NO: 351357 - protein, 10 aa, Influenza virus
VVAKDNAIRF

SEQ ID NO: 351358 - protein, 10 aa, Influenza virus
VAKDNAIRFG

SEQ ID NO: 351359 - protein, 10 aa, Influenza virus
AKDNAIRFGE

SEQ ID NO: 351360 - protein, 10 aa, Influenza virus
KDNAIRFGES

SEQ ID NO: 351361 - protein, 10 aa, Influenza virus
DNAIRFGESE

SEQ ID NO: 351362 - protein, 10 aa, Influenza virus
NAIRFGESEQ

SEQ ID NO: 351363 - protein, 10 aa, Influenza virus
AIRFGESEQI

SEQ ID NO: 351364 - protein, 10 aa, Influenza virus
IRFGESEQII

SEQ ID NO: 351365 - protein, 10 aa, Influenza virus
RFGESEQIIV

SEQ ID NO: 351366 - protein, 10 aa, Influenza virus
FGESEQIIVT

SEQ ID NO: 351367 - protein, 10 aa, Influenza virus
GESEQIIVTR

SEQ ID NO: 351368 - protein, 10 aa, Influenza virus
ESEQIIVTRE

SEQ ID NO: 351369 - protein, 10 aa, Influenza virus
SEQIIVTREP

SEQ ID NO: 351370 - protein, 10 aa, Influenza virus
EQIIVTREPY

SEQ ID NO: 351371 - protein, 10 aa, Influenza virus
QIIVTREPYV

SEQ ID NO: 351372 - protein, 10 aa, Influenza virus
IIVTREPYVS

SEQ ID NO: 351373 - protein, 10 aa, Influenza virus
IVTREPYVSC

SEQ ID NO: 351374 - protein, 10 aa, Influenza virus
VTREPYVSCD

SEQ ID NO: 351375 - protein, 10 aa, Influenza virus
TREPYVSCDP

SEQ ID NO: 351376 - protein, 10 aa, Influenza virus
REPYVSCDPL

SEQ ID NO: 351377 - protein, 10 aa, Influenza virus
EPYVSCDPLG

SEQ ID NO: 351378 - protein, 10 aa, Influenza virus
PYVSCDPLGC

SEQ ID NO: 351379 - protein, 10 aa, Influenza virus
YVSCDPLGCK

SEQ ID NO: 351380 - protein, 10 aa, Influenza virus
VSCDPLGCKM

SEQ ID NO: 351381 - protein, 10 aa, Influenza virus
SCDPLGCKMY

SEQ ID NO: 351382 - protein, 10 aa, Influenza virus
CDPLGCKMYA

SEQ ID NO: 351383 - protein, 10 aa, Influenza virus
DPLGCKMYAL

SEQ ID NO: 351384 - protein, 10 aa, Influenza virus
PLGCKMYALH

SEQ ID NO: 351385 - protein, 10 aa, Influenza virus
LGCKMYALHQ

SEQ ID NO: 351386 - protein, 10 aa, Influenza virus
GCKMYALHQG

SEQ ID NO: 351387 - protein, 10 aa, Influenza virus
CKMYALHQGT

SEQ ID NO: 351388 - protein, 10 aa, Influenza virus
KMYALHQGTT

SEQ ID NO: 351389 - protein, 10 aa, Influenza virus
MYALHQGTTI

SEQ ID NO: 351390 - protein, 10 aa, Influenza virus
YALHQGTTIR

SEQ ID NO: 351391 - protein, 10 aa, Influenza virus
ALHQGTTIRN

SEQ ID NO: 351392 - protein, 10 aa, Influenza virus
LHQGTTIRNK

SEQ ID NO: 351393 - protein, 10 aa, Influenza virus
HQGTTIRNKH

SEQ ID NO: 351394 - protein, 10 aa, Influenza virus
QGTTIRNKHS

SEQ ID NO: 351395 - protein, 10 aa, Influenza virus
GTTIRNKHSN

SEQ ID NO: 351396 - protein, 10 aa, Influenza virus
TTIRNKHSNG

SEQ ID NO: 351397 - protein, 10 aa, Influenza virus
TIRNKHSNGT

SEQ ID NO: 351398 - protein, 10 aa, Influenza virus
IRNKHSNGTI

SEQ ID NO: 351399 - protein, 10 aa, Influenza virus
RNKHSNGTIH

SEQ ID NO: 351400 - protein, 10 aa, Influenza virus
NKHSNGTIHD

SEQ ID NO: 351401 - protein, 10 aa, Influenza virus
KHSNGTIHDR

SEQ ID NO: 351402 - protein, 10 aa, Influenza virus
HSNGTIHDRT

SEQ ID NO: 351403 - protein, 10 aa, Influenza virus
SNGTIHDRTA

SEQ ID NO: 351404 - protein, 10 aa, Influenza virus
NGTIHDRTAF

SEQ ID NO: 351405 - protein, 10 aa, Influenza virus
GTIHDRTAFR

SEQ ID NO: 351406 - protein, 10 aa, Influenza virus
TIHDRTAFRG

SEQ ID NO: 351407 - protein, 10 aa, Influenza virus
IHDRTAFRGL

SEQ ID NO: 351408 - protein, 10 aa, Influenza virus
HDRTAFRGLI

SEQ ID NO: 351409 - protein, 10 aa, Influenza virus
DRTAFRGLIS

SEQ ID NO: 351410 - protein, 10 aa, Influenza virus
RTAFRGLIST

SEQ ID NO: 351411 - protein, 10 aa, Influenza virus
TAFRGLISTP

SEQ ID NO: 351412 - protein, 10 aa, Influenza virus
AFRGLISTPL

SEQ ID NO: 351413 - protein, 10 aa, Influenza virus
FRGLISTPLG

SEQ ID NO: 351414 - protein, 10 aa, Influenza virus
RGLISTPLGS

SEQ ID NO: 351415 - protein, 10 aa, Influenza virus
GLISTPLGSP

SEQ ID NO: 351416 - protein, 10 aa, Influenza virus
LISTPLGSPP

SEQ ID NO: 351417 - protein, 10 aa, Influenza virus
ISTPLGSPPI

SEQ ID NO: 351418 - protein, 10 aa, Influenza virus
STPLGSPPIV

SEQ ID NO: 351419 - protein, 10 aa, Influenza virus
TPLGSPPIVS

SEQ ID NO: 351420 - protein, 10 aa, Influenza virus
PLGSPPIVSN

SEQ ID NO: 351421 - protein, 10 aa, Influenza virus
LGSPPIVSNS

SEQ ID NO: 351422 - protein, 10 aa, Influenza virus
GSPPIVSNSD

SEQ ID NO: 351423 - protein, 10 aa, Influenza virus
SPPIVSNSDF

SEQ ID NO: 351424 - protein, 10 aa, Influenza virus
VSNSDFLCVG

SEQ ID NO: 351425 - protein, 10 aa, Influenza virus
SNSDFLCVGW

SEQ ID NO: 351426 - protein, 10 aa, Influenza virus
NSDFLCVGWS

SEQ ID NO: 351427 - protein, 10 aa, Influenza virus
SDFLCVGWSS

SEQ ID NO: 351428 - protein, 10 aa, Influenza virus
DFLCVGWSST

SEQ ID NO: 351429 - protein, 10 aa, Influenza virus
FLCVGWSSTS

SEQ ID NO: 351430 - protein, 10 aa, Influenza virus
LCVGWSSTSC

SEQ ID NO: 351431 - protein, 10 aa, Influenza virus
CVGWSSTSCH

SEQ ID NO: 351432 - protein, 10 aa, Influenza virus
VGWSSTSCHD

SEQ ID NO: 351433 - protein, 10 aa, Influenza virus
GWSSTSCHDG

SEQ ID NO: 351434 - protein, 10 aa, Influenza virus
WSSTSCHDGI

SEQ ID NO: 351435 - protein, 10 aa, Influenza virus
SSTSCHDGIG

SEQ ID NO: 351436 - protein, 10 aa, Influenza virus
STSCHDGIGR

SEQ ID NO: 351437 - protein, 10 aa, Influenza virus
TSCHDGIGRM

SEQ ID NO: 351438 - protein, 10 aa, Influenza virus
SCHDGIGRMT

SEQ ID NO: 351439 - protein, 10 aa, Influenza virus
CHDGIGRMTI

SEQ ID NO: 351440 - protein, 10 aa, Influenza virus
HDGIGRMTIC

SEQ ID NO: 351441 - protein, 10 aa, Influenza virus
DGIGRMTICV

SEQ ID NO: 351442 - protein, 10 aa, Influenza virus
GIGRMTICVQ

SEQ ID NO: 351443 - protein, 10 aa, Influenza virus
IGRMTICVQG

SEQ ID NO: 351444 - protein, 10 aa, Influenza virus
GRMTICVQGN

SEQ ID NO: 351445 - protein, 10 aa, Influenza virus
RMTICVQGNN

SEQ ID NO: 351446 - protein, 10 aa, Influenza virus
MTICVQGNND

SEQ ID NO: 351447 - protein, 10 aa, Influenza virus
TICVQGNNDN

SEQ ID NO: 351448 - protein, 10 aa, Influenza virus
ICVQGNNDNA

SEQ ID NO: 351449 - protein, 10 aa, Influenza virus
CVQGNNDNAT

SEQ ID NO: 351450 - protein, 10 aa, Influenza virus
VQGNNDNATA

SEQ ID NO: 351451 - protein, 10 aa, Influenza virus
QGNNDNATAT

SEQ ID NO: 351452 - protein, 10 aa, Influenza virus
GNNDNATATV

SEQ ID NO: 351453 - protein, 10 aa, Influenza virus
NNDNATATVY

SEQ ID NO: 351454 - protein, 10 aa, Influenza virus
NDNATATVYY

SEQ ID NO: 351455 - protein, 10 aa, Influenza virus
DNATATVYYD

SEQ ID NO: 351456 - protein, 10 aa, Influenza virus
NATATVYYDR

SEQ ID NO: 351457 - protein, 10 aa, Influenza virus
ATATVYYDRR

SEQ ID NO: 351458 - protein, 10 aa, Influenza virus
TATVYYDRRL

SEQ ID NO: 351459 - protein, 10 aa, Influenza virus
ATVYYDRRLT

SEQ ID NO: 351460 - protein, 10 aa, Influenza virus
TVYYDRRLTT

SEQ ID NO: 351461 - protein, 10 aa, Influenza virus
VYYDRRLTTT

SEQ ID NO: 351462 - protein, 10 aa, Influenza virus
YYDRRLTTTI

SEQ ID NO: 351463 - protein, 10 aa, Influenza virus
YDRRLTTTIK

SEQ ID NO: 351464 - protein, 10 aa, Influenza virus
DRRLTTTIKT

SEQ ID NO: 351465 - protein, 10 aa, Influenza virus
RRLTTTIKTW

SEQ ID NO: 351466 - protein, 10 aa, Influenza virus
RLTTTIKTWA

SEQ ID NO: 351467 - protein, 10 aa, Influenza virus
LTTTIKTWAG

SEQ ID NO: 351468 - protein, 10 aa, Influenza virus
TTTIKTWAGN

SEQ ID NO: 351469 - protein, 10 aa, Influenza virus
TTIKTWAGNI

SEQ ID NO: 351470 - protein, 10 aa, Influenza virus
TIKTWAGNIL

SEQ ID NO: 351471 - protein, 10 aa, Influenza virus
IKTWAGNILR

SEQ ID NO: 351472 - protein, 10 aa, Influenza virus
KTWAGNILRT

SEQ ID NO: 351473 - protein, 10 aa, Influenza virus
TWAGNILRTQ

SEQ ID NO: 351474 - protein, 10 aa, Influenza virus
WAGNILRTQE

SEQ ID NO: 351475 - protein, 10 aa, Influenza virus
AGNILRTQES

SEQ ID NO: 351476 - protein, 10 aa, Influenza virus
GNILRTQESE

SEQ ID NO: 351477 - protein, 10 aa, Influenza virus
NILRTQESEC

SEQ ID NO: 351478 - protein, 10 aa, Influenza virus
ILRTQESECV

SEQ ID NO: 351479 - protein, 10 aa, Influenza virus
LRTQESECVC

SEQ ID NO: 351480 - protein, 10 aa, Influenza virus
RTQESECVCH

SEQ ID NO: 351481 - protein, 10 aa, Influenza virus
TQESECVCHN

SEQ ID NO: 351482 - protein, 10 aa, Influenza virus
QESECVCHNG

SEQ ID NO: 351483 - protein, 10 aa, Influenza virus
ESECVCHNGT

SEQ ID NO: 351484 - protein, 10 aa, Influenza virus
SECVCHNGTC

SEQ ID NO: 351485 - protein, 10 aa, Influenza virus
ECVCHNGTCV

SEQ ID NO: 351486 - protein, 10 aa, Influenza virus
CVCHNGTCVV

SEQ ID NO: 351487 - protein, 10 aa, Influenza virus
VCHNGTCVVI

SEQ ID NO: 351488 - protein, 10 aa, Influenza virus
CHNGTCVVIM

SEQ ID NO: 351489 - protein, 10 aa, Influenza virus
HNGTCVVIMT

SEQ ID NO: 351490 - protein, 10 aa, Influenza virus
NGTCVVIMTD

SEQ ID NO: 351491 - protein, 10 aa, Influenza virus
GTCVVIMTDG

SEQ ID NO: 351492 - protein, 10 aa, Influenza virus
TCVVIMTDGS

SEQ ID NO: 351493 - protein, 10 aa, Influenza virus
CVVIMTDGSA

SEQ ID NO: 351494 - protein, 10 aa, Influenza virus
VVIMTDGSAS

SEQ ID NO: 351495 - protein, 10 aa, Influenza virus
VIMTDGSASS

SEQ ID NO: 351496 - protein, 10 aa, Influenza virus
IMTDGSASSQ

SEQ ID NO: 351497 - protein, 10 aa, Influenza virus
MTDGSASSQA

SEQ ID NO: 351498 - protein, 10 aa, Influenza virus
TDGSASSQAY

SEQ ID NO: 351499 - protein, 10 aa, Influenza virus
DGSASSQAYT

SEQ ID NO: 351500 - protein, 10 aa, Influenza virus
GSASSQAYTK

SEQ ID NO: 351501 - protein, 10 aa, Influenza virus
QAYTKVLYFH

SEQ ID NO: 351502 - protein, 10 aa, Influenza virus
AYTKVLYFHK

SEQ ID NO: 351503 - protein, 10 aa, Influenza virus
YTKVLYFHKG

SEQ ID NO: 351504 - protein, 10 aa, Influenza virus
TKVLYFHKGL

SEQ ID NO: 351505 - protein, 10 aa, Influenza virus
YFHKGLVIKE

SEQ ID NO: 351506 - protein, 10 aa, Influenza virus
FHKGLVIKEE

SEQ ID NO: 351507 - protein, 10 aa, Influenza virus
KEEALKGSAR

SEQ ID NO: 351508 - protein, 10 aa, Influenza virus
EEALKGSARH

SEQ ID NO: 351509 - protein, 10 aa, Influenza virus
LKGSARHIEE

SEQ ID NO: 351510 - protein, 10 aa, Influenza virus
KGSARHIEEC

SEQ ID NO: 351511 - protein, 10 aa, Influenza virus
GSARHIEECS

SEQ ID NO: 351512 - protein, 10 aa, Influenza virus
SARHIEECSC

SEQ ID NO: 351513 - protein, 10 aa, Influenza virus
ARHIEECSCY

SEQ ID NO: 351514 - protein, 10 aa, Influenza virus
RHIEECSCYG

SEQ ID NO: 351515 - protein, 10 aa, Influenza virus
HIEECSCYGH

SEQ ID NO: 351516 - protein, 10 aa, Influenza virus
IEECSCYGHN

SEQ ID NO: 351517 - protein, 10 aa, Influenza virus
EECSCYGHNS

SEQ ID NO: 351518 - protein, 10 aa, Influenza virus
ECSCYGHNSK

SEQ ID NO: 351519 - protein, 10 aa, Influenza virus
CYGHNSKVTC

SEQ ID NO: 351520 - protein, 10 aa, Influenza virus
SKVTCVCRDN

SEQ ID NO: 351521 - protein, 10 aa, Influenza virus
KVTCVCRDNW

SEQ ID NO: 351522 - protein, 10 aa, Influenza virus
VTCVCRDNWQ

SEQ ID NO: 351523 - protein, 10 aa, Influenza virus
TCVCRDNWQG

SEQ ID NO: 351524 - protein, 10 aa, Influenza virus
CVCRDNWQGA

SEQ ID NO: 351525 - protein, 10 aa, Influenza virus
VCRDNWQGAN

SEQ ID NO: 351526 - protein, 10 aa, Influenza virus
CRDNWQGANR

SEQ ID NO: 351527 - protein, 10 aa, Influenza virus
RDNWQGANRP

SEQ ID NO: 351528 - protein, 10 aa, Influenza virus
DNWQGANRPV

SEQ ID NO: 351529 - protein, 10 aa, Influenza virus
NWQGANRPVI

SEQ ID NO: 351530 - protein, 10 aa, Influenza virus
WQGANRPVIE

SEQ ID NO: 351531 - protein, 10 aa, Influenza virus
QGANRPVIEI

SEQ ID NO: 351532 - protein, 10 aa, Influenza virus
GANRPVIEID

SEQ ID NO: 351533 - protein, 10 aa, Influenza virus
ANRPVIEIDM

SEQ ID NO: 351534 - protein, 10 aa, Influenza virus
AMEHTSQYLC

SEQ ID NO: 351535 - protein, 10 aa, Influenza virus
MEHTSQYLCT

SEQ ID NO: 351536 - protein, 10 aa, Influenza virus
EHTSQYLCTG

SEQ ID NO: 351537 - protein, 10 aa, Influenza virus
HTSQYLCTGV

SEQ ID NO: 351538 - protein, 10 aa, Influenza virus
TSQYLCTGVL

SEQ ID NO: 351539 - protein, 10 aa, Influenza virus
SQYLCTGVLT

SEQ ID NO: 351540 - protein, 10 aa, Influenza virus
QYLCTGVLTD

SEQ ID NO: 351541 - protein, 10 aa, Influenza virus
YLCTGVLTDT

SEQ ID NO: 351542 - protein, 10 aa, Influenza virus
LCTGVLTDTS

SEQ ID NO: 351543 - protein, 10 aa, Influenza virus
CTGVLTDTSR

SEQ ID NO: 351544 - protein, 10 aa, Influenza virus
TGVLTDTSRP

SEQ ID NO: 351545 - protein, 10 aa, Influenza virus
GVLTDTSRPS

SEQ ID NO: 351546 - protein, 10 aa, Influenza virus
VLTDTSRPSD

SEQ ID NO: 351547 - protein, 10 aa, Influenza virus
LTDTSRPSDK

SEQ ID NO: 351548 - protein, 10 aa, Influenza virus
GDCNNPITGS

SEQ ID NO: 351549 - protein, 10 aa, Influenza virus
DCNNPITGSP

SEQ ID NO: 351550 - protein, 10 aa, Influenza virus
CNNPITGSPG

SEQ ID NO: 351551 - protein, 10 aa, Influenza virus
NNPITGSPGA

SEQ ID NO: 351552 - protein, 10 aa, Influenza virus
NPITGSPGAP

SEQ ID NO: 351553 - protein, 10 aa, Influenza virus
PITGSPGAPG

SEQ ID NO: 351554 - protein, 10 aa, Influenza virus
ITGSPGAPGV

SEQ ID NO: 351555 - protein, 10 aa, Influenza virus
TGSPGAPGVK

SEQ ID NO: 351556 - protein, 10 aa, Influenza virus
GSPGAPGVKG

SEQ ID NO: 351557 - protein, 10 aa, Influenza virus
SPGAPGVKGF

SEQ ID NO: 351558 - protein, 10 aa, Influenza virus
PGAPGVKGFG

SEQ ID NO: 351559 - protein, 10 aa, Influenza virus
GAPGVKGFGF

SEQ ID NO: 351560 - protein, 10 aa, Influenza virus
APGVKGFGFL

SEQ ID NO: 351561 - protein, 10 aa, Influenza virus
PGVKGFGFLD

SEQ ID NO: 351562 - protein, 10 aa, Influenza virus
GVKGFGFLDS

SEQ ID NO: 351563 - protein, 10 aa, Influenza virus
GNTWLGRTIS

SEQ ID NO: 351564 - protein, 10 aa, Influenza virus
NTWLGRTISP

SEQ ID NO: 351565 - protein, 10 aa, Influenza virus
TWLGRTISPR

SEQ ID NO: 351566 - protein, 10 aa, Influenza virus
WLGRTISPRS

SEQ ID NO: 351567 - protein, 10 aa, Influenza virus
LGRTISPRSR

SEQ ID NO: 351568 - protein, 10 aa, Influenza virus
GRTISPRSRS

SEQ ID NO: 351569 - protein, 10 aa, Influenza virus
RTISPRSRSG

SEQ ID NO: 351570 - protein, 10 aa, Influenza virus
TISPRSRSGF

SEQ ID NO: 351571 - protein, 10 aa, Influenza virus
ISPRSRSGFE

SEQ ID NO: 351572 - protein, 10 aa, Influenza virus
SPRSRSGFEM

SEQ ID NO: 351573 - protein, 10 aa, Influenza virus
PRSRSGFEML

SEQ ID NO: 351574 - protein, 10 aa, Influenza virus
RSRSGFEMLK

SEQ ID NO: 351575 - protein, 10 aa, Influenza virus
SRSGFEMLKI

SEQ ID NO: 351576 - protein, 10 aa, Influenza virus
RSGFEMLKIP

SEQ ID NO: 351577 - protein, 10 aa, Influenza virus
SGFEMLKIPN

SEQ ID NO: 351578 - protein, 10 aa, Influenza virus
GFEMLKIPNA

SEQ ID NO: 351579 - protein, 10 aa, Influenza virus
FEMLKIPNAG

SEQ ID NO: 351580 - protein, 10 aa, Influenza virus
EMLKIPNAGT

SEQ ID NO: 351581 - protein, 10 aa, Influenza virus
MLKIPNAGTD

SEQ ID NO: 351582 - protein, 10 aa, Influenza virus
LKIPNAGTDP

SEQ ID NO: 351583 - protein, 10 aa, Influenza virus
KIPNAGTDPN

SEQ ID NO: 351584 - protein, 10 aa, Influenza virus
IPNAGTDPNS

SEQ ID NO: 351585 - protein, 10 aa, Influenza virus
NNNWSGYSGS

SEQ ID NO: 351586 - protein, 10 aa, Influenza virus
NNWSGYSGSF

SEQ ID NO: 351587 - protein, 10 aa, Influenza virus
NWSGYSGSFI

SEQ ID NO: 351588 - protein, 10 aa, Influenza virus
WSGYSGSFID

SEQ ID NO: 351589 - protein, 10 aa, Influenza virus
SGYSGSFIDY

SEQ ID NO: 351590 - protein, 10 aa, Influenza virus
GYSGSFIDYW

SEQ ID NO: 351591 - protein, 10 aa, Influenza virus
YSGSFIDYWD

SEQ ID NO: 351592 - protein, 10 aa, Influenza virus
SGSFIDYWDE

SEQ ID NO: 351593 - protein, 10 aa, Influenza virus
SECYNPCFYV

SEQ ID NO: 351594 - protein, 10 aa, Influenza virus
ECYNPCFYVE

SEQ ID NO: 351595 - protein, 10 aa, Influenza virus
CYNPCFYVEL

SEQ ID NO: 351596 - protein, 10 aa, Influenza virus
YNPCFYVELI

SEQ ID NO: 351597 - protein, 10 aa, Influenza virus
NPCFYVELIR

SEQ ID NO: 351598 - protein, 10 aa, Influenza virus
PCFYVELIRG

SEQ ID NO: 351599 - protein, 10 aa, Influenza virus
CFYVELIRGR

SEQ ID NO: 351600 - protein, 10 aa, Influenza virus
FYVELIRGRP

SEQ ID NO: 351601 - protein, 10 aa, Influenza virus
YVELIRGRPE

SEQ ID NO: 351602 - protein, 10 aa, Influenza virus
VELIRGRPEE

SEQ ID NO: 351603 - protein, 10 aa, Influenza virus
ELIRGRPEEA

SEQ ID NO: 351604 - protein, 10 aa, Influenza virus
LIRGRPEEAK

SEQ ID NO: 351605 - protein, 10 aa, Influenza virus
IRGRPEEAKY

SEQ ID NO: 351606 - protein, 10 aa, Influenza virus
RGRPEEAKYV

SEQ ID NO: 351607 - protein, 10 aa, Influenza virus
GRPEEAKYVW

SEQ ID NO: 351608 - protein, 10 aa, Influenza virus
RPEEAKYVWW

SEQ ID NO: 351609 - protein, 10 aa, Influenza virus
PEEAKYVWWT

SEQ ID NO: 351610 - protein, 10 aa, Influenza virus
EEAKYVWWTS

SEQ ID NO: 351611 - protein, 10 aa, Influenza virus
EAKYVWWTSN

SEQ ID NO: 351612 - protein, 10 aa, Influenza virus
AKYVWWTSNS

SEQ ID NO: 351613 - protein, 10 aa, Influenza virus
KYVWWTSNSL

SEQ ID NO: 351614 - protein, 10 aa, Influenza virus
YVWWTSNSLV

SEQ ID NO: 351615 - protein, 10 aa, Influenza virus
VWWTSNSLVA

SEQ ID NO: 351616 - protein, 10 aa, Influenza virus
WWTSNSLVAL

SEQ ID NO: 351617 - protein, 10 aa, Influenza virus
WTSNSLVALC

SEQ ID NO: 351618 - protein, 10 aa, Influenza virus
TSNSLVALCG

SEQ ID NO: 351619 - protein, 10 aa, Influenza virus
SNSLVALCGS

SEQ ID NO: 351620 - protein, 10 aa, Influenza virus
NSLVALCGSP

SEQ ID NO: 351621 - protein, 10 aa, Influenza virus
SLVALCGSPI

SEQ ID NO: 351622 - protein, 10 aa, Influenza virus
LVALCGSPIS

SEQ ID NO: 351623 - protein, 10 aa, Influenza virus
VALCGSPISV

SEQ ID NO: 351624 - protein, 10 aa, Influenza virus
ALCGSPISVG

SEQ ID NO: 351625 - protein, 10 aa, Influenza virus
LCGSPISVGS

SEQ ID NO: 351626 - protein, 10 aa, Influenza virus
CGSPISVGSG

SEQ ID NO: 351627 - protein, 10 aa, Influenza virus
GSPISVGSGS

SEQ ID NO: 351628 - protein, 10 aa, Influenza virus
SPISVGSGSF

SEQ ID NO: 351629 - protein, 10 aa, Influenza virus
PISVGSGSFP

SEQ ID NO: 351630 - protein, 10 aa, Influenza virus
ISVGSGSFPD

SEQ ID NO: 351631 - protein, 10 aa, Influenza virus
SVGSGSFPDG

SEQ ID NO: 351632 - protein, 10 aa, Influenza virus
VGSGSFPDGA

SEQ ID NO: 351633 - protein, 10 aa, Influenza virus
GSGSFPDGAQ

SEQ ID NO: 351634 - protein, 10 aa, Influenza virus
SGSFPDGAQI

SEQ ID NO: 351635 - protein, 10 aa, Influenza virus
GSFPDGAQIQ

SEQ ID NO: 351636 - protein, 10 aa, Influenza virus
SFPDGAQIQY

SEQ ID NO: 351637 - protein, 10 aa, Influenza virus
FPDGAQIQYF

SEQ ID NO: 351638 - protein, 10 aa, Influenza virus
PDGAQIQYFS

SEQ ID NO: 351639 - protein, 10 aa, Influenza virus
QADEICIGYL

SEQ ID NO: 351640 - protein, 10 aa, Influenza virus
ADEICIGYLS

SEQ ID NO: 351641 - protein, 10 aa, Influenza virus
DEICIGYLSN

SEQ ID NO: 351642 - protein, 10 aa, Influenza virus
EICIGYLSNN

SEQ ID NO: 351643 - protein, 10 aa, Influenza virus
ICIGYLSNNS

SEQ ID NO: 351644 - protein, 10 aa, Influenza virus
CIGYLSNNST

SEQ ID NO: 351645 - protein, 10 aa, Influenza virus
IGYLSNNSTE

SEQ ID NO: 351646 - protein, 10 aa, Influenza virus
GYLSNNSTEK

SEQ ID NO: 351647 - protein, 10 aa, Influenza virus
YLSNNSTEKV

SEQ ID NO: 351648 - protein, 10 aa, Influenza virus
LSNNSTEKVD

SEQ ID NO: 351649 - protein, 10 aa, Influenza virus
SNNSTEKVDT

SEQ ID NO: 351650 - protein, 10 aa, Influenza virus
NNSTEKVDTI

SEQ ID NO: 351651 - protein, 10 aa, Influenza virus
NSTEKVDTII

SEQ ID NO: 351652 - protein, 10 aa, Influenza virus
STEKVDTIIE

SEQ ID NO: 351653 - protein, 10 aa, Influenza virus
TEKVDTIIES

SEQ ID NO: 351654 - protein, 10 aa, Influenza virus
EKVDTIIESN

SEQ ID NO: 351655 - protein, 10 aa, Influenza virus
KVDTIIESNV

SEQ ID NO: 351656 - protein, 10 aa, Influenza virus
VDTIIESNVT

SEQ ID NO: 351657 - protein, 10 aa, Influenza virus
DTIIESNVTV

SEQ ID NO: 351658 - protein, 10 aa, Influenza virus
TIIESNVTVT

SEQ ID NO: 351659 - protein, 10 aa, Influenza virus
IIESNVTVTS

SEQ ID NO: 351660 - protein, 10 aa, Influenza virus
IESNVTVTSS

SEQ ID NO: 351661 - protein, 10 aa, Influenza virus
ESNVTVTSSV

SEQ ID NO: 351662 - protein, 10 aa, Influenza virus
SNVTVTSSVE

SEQ ID NO: 351663 - protein, 10 aa, Influenza virus
NVTVTSSVEL

SEQ ID NO: 351664 - protein, 10 aa, Influenza virus
VTVTSSVELV

SEQ ID NO: 351665 - protein, 10 aa, Influenza virus
TVTSSVELVE

SEQ ID NO: 351666 - protein, 10 aa, Influenza virus
VTSSVELVEN

SEQ ID NO: 351667 - protein, 10 aa, Influenza virus
HTGSFCSIDG

SEQ ID NO: 351668 - protein, 10 aa, Influenza virus
TGSFCSIDGK

SEQ ID NO: 351669 - protein, 10 aa, Influenza virus
FCSIDGKAPI

SEQ ID NO: 351670 - protein, 10 aa, Influenza virus
CSIDGKAPIS

SEQ ID NO: 351671 - protein, 10 aa, Influenza virus
SIDGKAPISL

SEQ ID NO: 351672 - protein, 10 aa, Influenza virus
IDGKAPISLG

SEQ ID NO: 351673 - protein, 10 aa, Influenza virus
DGKAPISLGD

SEQ ID NO: 351674 - protein, 10 aa, Influenza virus
GKAPISLGDC

SEQ ID NO: 351675 - protein, 10 aa, Influenza virus
KAPISLGDCS

SEQ ID NO: 351676 - protein, 10 aa, Influenza virus
APISLGDCSF

SEQ ID NO: 351677 - protein, 10 aa, Influenza virus
PISLGDCSFA

SEQ ID NO: 351678 - protein, 10 aa, Influenza virus
ISLGDCSFAG

SEQ ID NO: 351679 - protein, 10 aa, Influenza virus
SLGDCSFAGW

SEQ ID NO: 351680 - protein, 10 aa, Influenza virus
LGDCSFAGWI

SEQ ID NO: 351681 - protein, 10 aa, Influenza virus
GDCSFAGWIL

SEQ ID NO: 351682 - protein, 10 aa, Influenza virus
DCSFAGWILG

SEQ ID NO: 351683 - protein, 10 aa, Influenza virus
CSFAGWILGN

SEQ ID NO: 351684 - protein, 10 aa, Influenza virus
SFAGWILGNP

SEQ ID NO: 351685 - protein, 10 aa, Influenza virus
FAGWILGNPM

SEQ ID NO: 351686 - protein, 10 aa, Influenza virus
AGWILGNPMC

SEQ ID NO: 351687 - protein, 10 aa, Influenza virus
GWILGNPMCD

SEQ ID NO: 351688 - protein, 10 aa, Influenza virus
WILGNPMCDD

SEQ ID NO: 351689 - protein, 10 aa, Influenza virus
ILGNPMCDDL

SEQ ID NO: 351690 - protein, 10 aa, Influenza virus
LGNPMCDDLI

SEQ ID NO: 351691 - protein, 10 aa, Influenza virus
GNPMCDDLIG

SEQ ID NO: 351692 - protein, 10 aa, Influenza virus
NPMCDDLIGK

SEQ ID NO: 351693 - protein, 10 aa, Influenza virus
CDDLIGKTSW

SEQ ID NO: 351694 - protein, 10 aa, Influenza virus
DDLIGKTSWS

SEQ ID NO: 351695 - protein, 10 aa, Influenza virus
DLIGKTSWSY

SEQ ID NO: 351696 - protein, 10 aa, Influenza virus
LIGKTSWSYI

SEQ ID NO: 351697 - protein, 10 aa, Influenza virus
IGKTSWSYIV

SEQ ID NO: 351698 - protein, 10 aa, Influenza virus
GKTSWSYIVE

SEQ ID NO: 351699 - protein, 10 aa, Influenza virus
KTSWSYIVEK

SEQ ID NO: 351700 - protein, 10 aa, Influenza virus
TSWSYIVEKP

SEQ ID NO: 351701 - protein, 10 aa, Influenza virus
SWSYIVEKPN

SEQ ID NO: 351702 - protein, 10 aa, Influenza virus
WSYIVEKPNP

SEQ ID NO: 351703 - protein, 10 aa, Influenza virus
NPTNGICYPG

SEQ ID NO: 351704 - protein, 10 aa, Influenza virus
NGICYPGTLE

SEQ ID NO: 351705 - protein, 10 aa, Influenza virus
SFFRNMVWLI

SEQ ID NO: 351706 - protein, 10 aa, Influenza virus
WLIHQSGTYP

SEQ ID NO: 351707 - protein, 10 aa, Influenza virus
FNNTKGRDVL

SEQ ID NO: 351708 - protein, 10 aa, Influenza virus
VNGQAGRMTF

SEQ ID NO: 351709 - protein, 10 aa, Influenza virus
NGQAGRMTFY

SEQ ID NO: 351710 - protein, 10 aa, Influenza virus
GQAGRMTFYW

SEQ ID NO: 351711 - protein, 10 aa, Influenza virus
QAGRMTFYWT

SEQ ID NO: 351712 - protein, 10 aa, Influenza virus
AGRMTFYWTI

SEQ ID NO: 351713 - protein, 10 aa, Influenza virus
GRMTFYWTIV

SEQ ID NO: 351714 - protein, 10 aa, Influenza virus
TFESNGAFLA

SEQ ID NO: 351715 - protein, 10 aa, Influenza virus
FESNGAFLAP

SEQ ID NO: 351716 - protein, 10 aa, Influenza virus
ESNGAFLAPR

SEQ ID NO: 351717 - protein, 10 aa, Influenza virus
SNGAFLAPRY

SEQ ID NO: 351718 - protein, 10 aa, Influenza virus
LAPRYAFELV

SEQ ID NO: 351719 - protein, 10 aa, Influenza virus
APRYAFELVS

SEQ ID NO: 351720 - protein, 10 aa, Influenza virus
CQSEIGGINT

SEQ ID NO: 351721 - protein, 10 aa, Influenza virus
NVHRNTIGDC

SEQ ID NO: 351722 - protein, 10 aa, Influenza virus
VHRNTIGDCP

SEQ ID NO: 351723 - protein, 10 aa, Influenza virus
HRNTIGDCPK

SEQ ID NO: 351724 - protein, 10 aa, Influenza virus
RNTIGDCPKY

SEQ ID NO: 351725 - protein, 10 aa, Influenza virus
NTIGDCPKYV

SEQ ID NO: 351726 - protein, 10 aa, Influenza virus
TIGDCPKYVN

SEQ ID NO: 351727 - protein, 10 aa, Influenza virus
IGDCPKYVNV

SEQ ID NO: 351728 - protein, 10 aa, Influenza virus
GDCPKYVNVK

SEQ ID NO: 351729 - protein, 10 aa, Influenza virus
DCPKYVNVKS

SEQ ID NO: 351730 - protein, 10 aa, Influenza virus
CPKYVNVKSL

SEQ ID NO: 351731 - protein, 10 aa, Influenza virus
PKYVNVKSLK

SEQ ID NO: 351732 - protein, 10 aa, Influenza virus
KYVNVKSLKL

SEQ ID NO: 351733 - protein, 10 aa, Influenza virus
YVNVKSLKLA

SEQ ID NO: 351734 - protein, 10 aa, Influenza virus
NVKSLKLATG

SEQ ID NO: 351735 - protein, 10 aa, Influenza virus
KSLKLATGLR

SEQ ID NO: 351736 - protein, 10 aa, Influenza virus
SLKLATGLRN

SEQ ID NO: 351737 - protein, 10 aa, Influenza virus
LKLATGLRNV

SEQ ID NO: 351738 - protein, 10 aa, Influenza virus
KLATGLRNVP

SEQ ID NO: 351739 - protein, 10 aa, Influenza virus
LATGLRNVPA

SEQ ID NO: 351740 - protein, 10 aa, Influenza virus
TRGLFGAIAG

SEQ ID NO: 351741 - protein, 10 aa, Influenza virus
RGLFGAIAGF

SEQ ID NO: 351742 - protein, 10 aa, Influenza virus
GLFGAIAGFI

SEQ ID NO: 351743 - protein, 10 aa, Influenza virus
LFGAIAGFIE

SEQ ID NO: 351744 - protein, 10 aa, Influenza virus
FGAIAGFIEG

SEQ ID NO: 351745 - protein, 10 aa, Influenza virus
GAIAGFIEGG

SEQ ID NO: 351746 - protein, 10 aa, Influenza virus
AIAGFIEGGW

SEQ ID NO: 351747 - protein, 10 aa, Influenza virus
IAGFIEGGWP

SEQ ID NO: 351748 - protein, 10 aa, Influenza virus
AGFIEGGWPG

SEQ ID NO: 351749 - protein, 10 aa, Influenza virus
GFIEGGWPGL

SEQ ID NO: 351750 - protein, 10 aa, Influenza virus
FIEGGWPGLI

SEQ ID NO: 351751 - protein, 10 aa, Influenza virus
IEGGWPGLIN

SEQ ID NO: 351752 - protein, 10 aa, Influenza virus
EGGWPGLING

SEQ ID NO: 351753 - protein, 10 aa, Influenza virus
GGWPGLINGW

SEQ ID NO: 351754 - protein, 10 aa, Influenza virus
GWPGLINGWY

SEQ ID NO: 351755 - protein, 10 aa, Influenza virus
WPGLINGWYG

SEQ ID NO: 351756 - protein, 10 aa, Influenza virus
PGLINGWYGF

SEQ ID NO: 351757 - protein, 10 aa, Influenza virus
GLINGWYGFQ

SEQ ID NO: 351758 - protein, 10 aa, Influenza virus
LINGWYGFQH

SEQ ID NO: 351759 - protein, 10 aa, Influenza virus
INGWYGFQHR

SEQ ID NO: 351760 - protein, 10 aa, Influenza virus
NGWYGFQHRN

SEQ ID NO: 351761 - protein, 10 aa, Influenza virus
GWYGFQHRNE

SEQ ID NO: 351762 - protein, 10 aa, Influenza virus
WYGFQHRNEE

SEQ ID NO: 351763 - protein, 10 aa, Influenza virus
YGFQHRNEEG

SEQ ID NO: 351764 - protein, 10 aa, Influenza virus
GFQHRNEEGT

SEQ ID NO: 351765 - protein, 10 aa, Influenza virus
FQHRNEEGTG

SEQ ID NO: 351766 - protein, 10 aa, Influenza virus
QHRNEEGTGI

SEQ ID NO: 351767 - protein, 10 aa, Influenza virus
HRNEEGTGIA

SEQ ID NO: 351768 - protein, 10 aa, Influenza virus
RNEEGTGIAA

SEQ ID NO: 351769 - protein, 10 aa, Influenza virus
NEEGTGIAAD

SEQ ID NO: 351770 - protein, 10 aa, Influenza virus
EEGTGIAADK

SEQ ID NO: 351771 - protein, 10 aa, Influenza virus
EGTGIAADKE

SEQ ID NO: 351772 - protein, 10 aa, Influenza virus
GTGIAADKES

SEQ ID NO: 351773 - protein, 10 aa, Influenza virus
TGIAADKEST

SEQ ID NO: 351774 - protein, 10 aa, Influenza virus
GIAADKESTQ

SEQ ID NO: 351775 - protein, 10 aa, Influenza virus
IAADKESTQK

SEQ ID NO: 351776 - protein, 10 aa, Influenza virus
AADKESTQKA

SEQ ID NO: 351777 - protein, 10 aa, Influenza virus
DIWSYNAQLL

SEQ ID NO: 351778 - protein, 10 aa, Influenza virus
IWSYNAQLLV

SEQ ID NO: 351779 - protein, 10 aa, Influenza virus
WSYNAQLLVL

SEQ ID NO: 351780 - protein, 10 aa, Influenza virus
SYNAQLLVLL

SEQ ID NO: 351781 - protein, 10 aa, Influenza virus
YNAQLLVLLE

SEQ ID NO: 351782 - protein, 10 aa, Influenza virus
NAQLLVLLEN

SEQ ID NO: 351783 - protein, 10 aa, Influenza virus
AQLLVLLENE

SEQ ID NO: 351784 - protein, 10 aa, Influenza virus
QLLVLLENEK

SEQ ID NO: 351785 - protein, 10 aa, Influenza virus
LLVLLENEKT

SEQ ID NO: 351786 - protein, 10 aa, Influenza virus
LVLLENEKTL

SEQ ID NO: 351787 - protein, 10 aa, Influenza virus
VLLENEKTLD

SEQ ID NO: 351788 - protein, 10 aa, Influenza virus
LLENEKTLDL

SEQ ID NO: 351789 - protein, 10 aa, Influenza virus
LENEKTLDLH

SEQ ID NO: 351790 - protein, 10 aa, Influenza virus
ENEKTLDLHD

SEQ ID NO: 351791 - protein, 10 aa, Influenza virus
NEKTLDLHDS

SEQ ID NO: 351792 - protein, 10 aa, Influenza virus
EKTLDLHDSN

SEQ ID NO: 351793 - protein, 10 aa, Influenza virus
KTLDLHDSNV

SEQ ID NO: 351794 - protein, 10 aa, Influenza virus
TLDLHDSNVR

SEQ ID NO: 351795 - protein, 10 aa, Influenza virus
LDLHDSNVRN

SEQ ID NO: 351796 - protein, 10 aa, Influenza virus
DLHDSNVRNL

SEQ ID NO: 351797 - protein, 10 aa, Influenza virus
LHDSNVRNLH

SEQ ID NO: 351798 - protein, 10 aa, Influenza virus
HDSNVRNLHE

SEQ ID NO: 351799 - protein, 10 aa, Influenza virus
DSNVRNLHEK

SEQ ID NO: 351800 - protein, 10 aa, Influenza virus
LKDNAKDEGN

SEQ ID NO: 351801 - protein, 10 aa, Influenza virus
KDNAKDEGNG

SEQ ID NO: 351802 - protein, 10 aa, Influenza virus
DNAKDEGNGC

SEQ ID NO: 351803 - protein, 10 aa, Influenza virus
NAKDEGNGCF

SEQ ID NO: 351804 - protein, 10 aa, Influenza virus
AKDEGNGCFT

SEQ ID NO: 351805 - protein, 10 aa, Influenza virus
KDEGNGCFTF

SEQ ID NO: 351806 - protein, 10 aa, Influenza virus
DEGNGCFTFY

SEQ ID NO: 351807 - protein, 10 aa, Influenza virus
EGNGCFTFYH

SEQ ID NO: 351808 - protein, 10 aa, Influenza virus
GNGCFTFYHK

SEQ ID NO: 351809 - protein, 10 aa, Influenza virus
NGCFTFYHKC

SEQ ID NO: 351810 - protein, 10 aa, Influenza virus
GCFTFYHKCD

SEQ ID NO: 351811 - protein, 10 aa, Influenza virus
CFTFYHKCDN

SEQ ID NO: 351812 - protein, 10 aa, Influenza virus
FYHKCDNECI

SEQ ID NO: 351813 - protein, 10 aa, Influenza virus
YHKCDNECIE

SEQ ID NO: 351814 - protein, 10 aa, Influenza virus
NECIEKVRNG

SEQ ID NO: 351815 - protein, 10 aa, Influenza virus
ECIEKVRNGT

SEQ ID NO: 351816 - protein, 10 aa, Influenza virus
CIEKVRNGTY

SEQ ID NO: 351817 - protein, 10 aa, Influenza virus
IEKVRNGTYD

SEQ ID NO: 351818 - protein, 10 aa, Influenza virus
EKVRNGTYDH

SEQ ID NO: 351819 - protein, 10 aa, Influenza virus
KVRNGTYDHK

SEQ ID NO: 351820 - protein, 10 aa, Influenza virus
VRNGTYDHKE

SEQ ID NO: 351821 - protein, 10 aa, Influenza virus
RNGTYDHKEF

SEQ ID NO: 351822 - protein, 10 aa, Influenza virus
NGTYDHKEFE

SEQ ID NO: 351823 - protein, 10 aa, Influenza virus
GTYDHKEFEE

SEQ ID NO: 351824 - protein, 10 aa, Influenza virus
TYDHKEFEEE

SEQ ID NO: 351825 - protein, 10 aa, Influenza virus
YDHKEFEEES

SEQ ID NO: 351826 - protein, 10 aa, Influenza virus
DHKEFEEESK

SEQ ID NO: 351827 - protein, 10 aa, Influenza virus
ESKLNRQEIE

SEQ ID NO: 351828 - protein, 10 aa, Influenza virus
SKLNRQEIEG

SEQ ID NO: 351829 - protein, 10 aa, Influenza virus
LNRQEIEGVK

SEQ ID NO: 351830 - protein, 10 aa, Influenza virus
NRQEIEGVKL

SEQ ID NO: 351831 - protein, 10 aa, Influenza virus
RQEIEGVKLD

SEQ ID NO: 351832 - protein, 10 aa, Influenza virus
GNVYKILSIY

SEQ ID NO: 351833 - protein, 10 aa, Influenza virus
NVYKILSIYS

SEQ ID NO: 351834 - protein, 10 aa, Influenza virus
VYKILSIYSC

SEQ ID NO: 351835 - protein, 10 aa, Influenza virus
YKILSIYSCI

SEQ ID NO: 351836 - protein, 10 aa, Influenza virus
KILSIYSCIA

SEQ ID NO: 351837 - protein, 10 aa, Influenza virus
ILSIYSCIAS

SEQ ID NO: 351838 - protein, 10 aa, Influenza virus
LSIYSCIASS

SEQ ID NO: 351839 - protein, 10 aa, Influenza virus
SIYSCIASSL

SEQ ID NO: 351840 - protein, 10 aa, Influenza virus
IYSCIASSLV

SEQ ID NO: 351841 - protein, 10 aa, Influenza virus
YSCIASSLVL

SEQ ID NO: 351842 - protein, 10 aa, Influenza virus
SCIASSLVLA

SEQ ID NO: 351843 - protein, 10 aa, Influenza virus
CIASSLVLAA

SEQ ID NO: 351844 - protein, 10 aa, Influenza virus
IASSLVLAAI

SEQ ID NO: 351845 - protein, 10 aa, Influenza virus
ASSLVLAAII

SEQ ID NO: 351846 - protein, 10 aa, Influenza virus
SSLVLAAIIM

SEQ ID NO: 351847 - protein, 10 aa, Influenza virus
SLVLAAIIMG

SEQ ID NO: 351848 - protein, 10 aa, Influenza virus
WACSNGSCRC

SEQ ID NO: 351849 - protein, 10 aa, Influenza virus
ACSNGSCRCT

SEQ ID NO: 351850 - protein, 10 aa, Influenza virus
CSNGSCRCTI

SEQ ID NO: 351851 - protein, 10 aa, Influenza virus
SNGSCRCTIC

SEQ ID NO: 351852 - protein, 10 aa, Influenza virus
NGSCRCTICI

SEQ ID NO: 351853 - protein, 10 aa, Influenza virus
FAYDKICIGY

SEQ ID NO: 351854 - protein, 10 aa, Influenza virus
AYDKICIGYQ

SEQ ID NO: 351855 - protein, 10 aa, Influenza virus
YDKICIGYQT

SEQ ID NO: 351856 - protein, 10 aa, Influenza virus
DKICIGYQTN

SEQ ID NO: 351857 - protein, 10 aa, Influenza virus
KICIGYQTNN

SEQ ID NO: 351858 - protein, 10 aa, Influenza virus
ICIGYQTNNS

SEQ ID NO: 351859 - protein, 10 aa, Influenza virus
CIGYQTNNST

SEQ ID NO: 351860 - protein, 10 aa, Influenza virus
IGYQTNNSTE

SEQ ID NO: 351861 - protein, 10 aa, Influenza virus
GYQTNNSTET

SEQ ID NO: 351862 - protein, 10 aa, Influenza virus
YQTNNSTETV

SEQ ID NO: 351863 - protein, 10 aa, Influenza virus
QTNNSTETVN

SEQ ID NO: 351864 - protein, 10 aa, Influenza virus
TNNSTETVNT

SEQ ID NO: 351865 - protein, 10 aa, Influenza virus
NNSTETVNTL

SEQ ID NO: 351866 - protein, 10 aa, Influenza virus
NSTETVNTLI

SEQ ID NO: 351867 - protein, 10 aa, Influenza virus
STETVNTLIE

SEQ ID NO: 351868 - protein, 10 aa, Influenza virus
TETVNTLIEQ

SEQ ID NO: 351869 - protein, 10 aa, Influenza virus
ETVNTLIEQN

SEQ ID NO: 351870 - protein, 10 aa, Influenza virus
TVNTLIEQNV

SEQ ID NO: 351871 - protein, 10 aa, Influenza virus
VNTLIEQNVP

SEQ ID NO: 351872 - protein, 10 aa, Influenza virus
NTLIEQNVPV

SEQ ID NO: 351873 - protein, 10 aa, Influenza virus
TLIEQNVPVT

SEQ ID NO: 351874 - protein, 10 aa, Influenza virus
LIEQNVPVTQ

SEQ ID NO: 351875 - protein, 10 aa, Influenza virus
IEQNVPVTQV

SEQ ID NO: 351876 - protein, 10 aa, Influenza virus
EQNVPVTQVE

SEQ ID NO: 351877 - protein, 10 aa, Influenza virus
QNVPVTQVEE

SEQ ID NO: 351878 - protein, 10 aa, Influenza virus
NVPVTQVEEL

SEQ ID NO: 351879 - protein, 10 aa, Influenza virus
VPVTQVEELV

SEQ ID NO: 351880 - protein, 10 aa, Influenza virus
PVTQVEELVH

SEQ ID NO: 351881 - protein, 10 aa, Influenza virus
VTQVEELVHG

SEQ ID NO: 351882 - protein, 10 aa, Influenza virus
TQVEELVHGG

SEQ ID NO: 351883 - protein, 10 aa, Influenza virus
QVEELVHGGI

SEQ ID NO: 351884 - protein, 10 aa, Influenza virus
VEELVHGGID

SEQ ID NO: 351885 - protein, 10 aa, Influenza virus
EELVHGGIDP

SEQ ID NO: 351886 - protein, 10 aa, Influenza virus
TELGSPLVLD

SEQ ID NO: 351887 - protein, 10 aa, Influenza virus
ELGSPLVLDD

SEQ ID NO: 351888 - protein, 10 aa, Influenza virus
LGSPLVLDDC

SEQ ID NO: 351889 - protein, 10 aa, Influenza virus
GSPLVLDDCS

SEQ ID NO: 351890 - protein, 10 aa, Influenza virus
SPLVLDDCSL

SEQ ID NO: 351891 - protein, 10 aa, Influenza virus
PLVLDDCSLE

SEQ ID NO: 351892 - protein, 10 aa, Influenza virus
LVLDDCSLEG

SEQ ID NO: 351893 - protein, 10 aa, Influenza virus
VLDDCSLEGL

SEQ ID NO: 351894 - protein, 10 aa, Influenza virus
LDDCSLEGLI

SEQ ID NO: 351895 - protein, 10 aa, Influenza virus
DDCSLEGLIL

SEQ ID NO: 351896 - protein, 10 aa, Influenza virus
DCSLEGLILG

SEQ ID NO: 351897 - protein, 10 aa, Influenza virus
CSLEGLILGN

SEQ ID NO: 351898 - protein, 10 aa, Influenza virus
SLEGLILGNP

SEQ ID NO: 351899 - protein, 10 aa, Influenza virus
LEGLILGNPK

SEQ ID NO: 351900 - protein, 10 aa, Influenza virus
EGLILGNPKC

SEQ ID NO: 351901 - protein, 10 aa, Influenza virus
GLILGNPKCD

SEQ ID NO: 351902 - protein, 10 aa, Influenza virus
LILGNPKCDL

SEQ ID NO: 351903 - protein, 10 aa, Influenza virus
ILGNPKCDLY

SEQ ID NO: 351904 - protein, 10 aa, Influenza virus
LGNPKCDLYL

SEQ ID NO: 351905 - protein, 10 aa, Influenza virus
GNPKCDLYLN

SEQ ID NO: 351906 - protein, 10 aa, Influenza virus
NPKCDLYLNG

SEQ ID NO: 351907 - protein, 10 aa, Influenza virus
PKCDLYLNGR

SEQ ID NO: 351908 - protein, 10 aa, Influenza virus
KCDLYLNGRE

SEQ ID NO: 351909 - protein, 10 aa, Influenza virus
CDLYLNGREW

SEQ ID NO: 351910 - protein, 10 aa, Influenza virus
DLYLNGREWS

SEQ ID NO: 351911 - protein, 10 aa, Influenza virus
LYLNGREWSY

SEQ ID NO: 351912 - protein, 10 aa, Influenza virus
YLNGREWSYI

SEQ ID NO: 351913 - protein, 10 aa, Influenza virus
LNGREWSYIV

SEQ ID NO: 351914 - protein, 10 aa, Influenza virus
NGREWSYIVE

SEQ ID NO: 351915 - protein, 10 aa, Influenza virus
GREWSYIVER

SEQ ID NO: 351916 - protein, 10 aa, Influenza virus
REWSYIVERP

SEQ ID NO: 351917 - protein, 10 aa, Influenza virus
EWSYIVERPK

SEQ ID NO: 351918 - protein, 10 aa, Influenza virus
WSYIVERPKE

SEQ ID NO: 351919 - protein, 10 aa, Influenza virus
SYIVERPKEM

SEQ ID NO: 351920 - protein, 10 aa, Influenza virus
YIVERPKEME

SEQ ID NO: 351921 - protein, 10 aa, Influenza virus
IVERPKEMEG

SEQ ID NO: 351922 - protein, 10 aa, Influenza virus
VERPKEMEGI

SEQ ID NO: 351923 - protein, 10 aa, Influenza virus
ERPKEMEGIC

SEQ ID NO: 351924 - protein, 10 aa, Influenza virus
RPKEMEGICY

SEQ ID NO: 351925 - protein, 10 aa, Influenza virus
PKEMEGICYP

SEQ ID NO: 351926 - protein, 10 aa, Influenza virus
KEMEGICYPG

SEQ ID NO: 351927 - protein, 10 aa, Influenza virus
EMEGICYPGS

SEQ ID NO: 351928 - protein, 10 aa, Influenza virus
MEGICYPGSI

SEQ ID NO: 351929 - protein, 10 aa, Influenza virus
EGICYPGSIE

SEQ ID NO: 351930 - protein, 10 aa, Influenza virus
GICYPGSIEN

SEQ ID NO: 351931 - protein, 10 aa, Influenza virus
ICYPGSIENQ

SEQ ID NO: 351932 - protein, 10 aa, Influenza virus
CYPGSIENQE

SEQ ID NO: 351933 - protein, 10 aa, Influenza virus
YPGSIENQEE

SEQ ID NO: 351934 - protein, 10 aa, Influenza virus
PGSIENQEEL

SEQ ID NO: 351935 - protein, 10 aa, Influenza virus
GSIENQEELR

SEQ ID NO: 351936 - protein, 10 aa, Influenza virus
SIENQEELRS

SEQ ID NO: 351937 - protein, 10 aa, Influenza virus
IENQEELRSL

SEQ ID NO: 351938 - protein, 10 aa, Influenza virus
ENQEELRSLF

SEQ ID NO: 351939 - protein, 10 aa, Influenza virus
NQEELRSLFS

SEQ ID NO: 351940 - protein, 10 aa, Influenza virus
QEELRSLFSS

SEQ ID NO: 351941 - protein, 10 aa, Influenza virus
EELRSLFSSI

SEQ ID NO: 351942 - protein, 10 aa, Influenza virus
ELRSLFSSIK

SEQ ID NO: 351943 - protein, 10 aa, Influenza virus
LRSLFSSIKK

SEQ ID NO: 351944 - protein, 10 aa, Influenza virus
RSLFSSIKKY

SEQ ID NO: 351945 - protein, 10 aa, Influenza virus
SLFSSIKKYE

SEQ ID NO: 351946 - protein, 10 aa, Influenza virus
LFSSIKKYER

SEQ ID NO: 351947 - protein, 10 aa, Influenza virus
FSSIKKYERV

SEQ ID NO: 351948 - protein, 10 aa, Influenza virus
SSIKKYERVK

SEQ ID NO: 351949 - protein, 10 aa, Influenza virus
SIKKYERVKM

SEQ ID NO: 351950 - protein, 10 aa, Influenza virus
IKKYERVKMF

SEQ ID NO: 351951 - protein, 10 aa, Influenza virus
KKYERVKMFD

SEQ ID NO: 351952 - protein, 10 aa, Influenza virus
KYERVKMFDF

SEQ ID NO: 351953 - protein, 10 aa, Influenza virus
YERVKMFDFT

SEQ ID NO: 351954 - protein, 10 aa, Influenza virus
ERVKMFDFTK

SEQ ID NO: 351955 - protein, 10 aa, Influenza virus
RVKMFDFTKW

SEQ ID NO: 351956 - protein, 10 aa, Influenza virus
VKMFDFTKWN

SEQ ID NO: 351957 - protein, 10 aa, Influenza virus
KMFDFTKWNV

SEQ ID NO: 351958 - protein, 10 aa, Influenza virus
MFDFTKWNVT

SEQ ID NO: 351959 - protein, 10 aa, Influenza virus
FDFTKWNVTY

SEQ ID NO: 351960 - protein, 10 aa, Influenza virus
DFTKWNVTYT

SEQ ID NO: 351961 - protein, 10 aa, Influenza virus
FTKWNVTYTG

SEQ ID NO: 351962 - protein, 10 aa, Influenza virus
TKWNVTYTGT

SEQ ID NO: 351963 - protein, 10 aa, Influenza virus
KWNVTYTGTS

SEQ ID NO: 351964 - protein, 10 aa, Influenza virus
WNVTYTGTSK

SEQ ID NO: 351965 - protein, 10 aa, Influenza virus
NVTYTGTSKA

SEQ ID NO: 351966 - protein, 10 aa, Influenza virus
VTYTGTSKAC

SEQ ID NO: 351967 - protein, 10 aa, Influenza virus
TYTGTSKACN

SEQ ID NO: 351968 - protein, 10 aa, Influenza virus
TSNQGSFYRS

SEQ ID NO: 351969 - protein, 10 aa, Influenza virus
SNQGSFYRSM

SEQ ID NO: 351970 - protein, 10 aa, Influenza virus
NQGSFYRSMR

SEQ ID NO: 351971 - protein, 10 aa, Influenza virus
QGSFYRSMRW

SEQ ID NO: 351972 - protein, 10 aa, Influenza virus
GSFYRSMRWL

SEQ ID NO: 351973 - protein, 10 aa, Influenza virus
SFYRSMRWLT

SEQ ID NO: 351974 - protein, 10 aa, Influenza virus
FYRSMRWLTL

SEQ ID NO: 351975 - protein, 10 aa, Influenza virus
YRSMRWLTLK

SEQ ID NO: 351976 - protein, 10 aa, Influenza virus
RSMRWLTLKS

SEQ ID NO: 351977 - protein, 10 aa, Influenza virus
MRWLTLKSGQ

SEQ ID NO: 351978 - protein, 10 aa, Influenza virus
RWLTLKSGQF

SEQ ID NO: 351979 - protein, 10 aa, Influenza virus
WLTLKSGQFP

SEQ ID NO: 351980 - protein, 10 aa, Influenza virus
LTLKSGQFPV

SEQ ID NO: 351981 - protein, 10 aa, Influenza virus
TLKSGQFPVQ

SEQ ID NO: 351982 - protein, 10 aa, Influenza virus
LKSGQFPVQT

SEQ ID NO: 351983 - protein, 10 aa, Influenza virus
KSGQFPVQTD

SEQ ID NO: 351984 - protein, 10 aa, Influenza virus
SGQFPVQTDE

SEQ ID NO: 351985 - protein, 10 aa, Influenza virus
GQFPVQTDEY

SEQ ID NO: 351986 - protein, 10 aa, Influenza virus
QFPVQTDEYK

SEQ ID NO: 351987 - protein, 10 aa, Influenza virus
FPVQTDEYKN

SEQ ID NO: 351988 - protein, 10 aa, Influenza virus
PVQTDEYKNT

SEQ ID NO: 351989 - protein, 10 aa, Influenza virus
VQTDEYKNTR

SEQ ID NO: 351990 - protein, 10 aa, Influenza virus
QTDEYKNTRD

SEQ ID NO: 351991 - protein, 10 aa, Influenza virus
TDEYKNTRDS

SEQ ID NO: 351992 - protein, 10 aa, Influenza virus
DEYKNTRDSD

SEQ ID NO: 351993 - protein, 10 aa, Influenza virus
EYKNTRDSDI

SEQ ID NO: 351994 - protein, 10 aa, Influenza virus
FTWAIHHPPT

SEQ ID NO: 351995 - protein, 10 aa, Influenza virus
TWAIHHPPTS

SEQ ID NO: 351996 - protein, 10 aa, Influenza virus
WAIHHPPTSD

SEQ ID NO: 351997 - protein, 10 aa, Influenza virus
AIHHPPTSDE

SEQ ID NO: 351998 - protein, 10 aa, Influenza virus
IHHPPTSDEQ

SEQ ID NO: 351999 - protein, 10 aa, Influenza virus
HHPPTSDEQV

SEQ ID NO: 352000 - protein, 10 aa, Influenza virus
EINRSFKPNI

SEQ ID NO: 352001 - protein, 10 aa, Influenza virus
INRSFKPNIG

SEQ ID NO: 352002 - protein, 10 aa, Influenza virus
NRSFKPNIGP

SEQ ID NO: 352003 - protein, 10 aa, Influenza virus
RSFKPNIGPR

SEQ ID NO: 352004 - protein, 10 aa, Influenza virus
SFKPNIGPRP

SEQ ID NO: 352005 - protein, 10 aa, Influenza virus
FKPNIGPRPL

SEQ ID NO: 352006 - protein, 10 aa, Influenza virus
KPNIGPRPLV

SEQ ID NO: 352007 - protein, 10 aa, Influenza virus
PNIGPRPLVR

SEQ ID NO: 352008 - protein, 10 aa, Influenza virus
NIGPRPLVRG

SEQ ID NO: 352009 - protein, 10 aa, Influenza virus
IGPRPLVRGQ

SEQ ID NO: 352010 - protein, 10 aa, Influenza virus
GPRPLVRGQQ

SEQ ID NO: 352011 - protein, 10 aa, Influenza virus
PRPLVRGQQG

SEQ ID NO: 352012 - protein, 10 aa, Influenza virus
RPLVRGQQGR

SEQ ID NO: 352013 - protein, 10 aa, Influenza virus
PLVRGQQGRM

SEQ ID NO: 352014 - protein, 10 aa, Influenza virus
LVRGQQGRMD

SEQ ID NO: 352015 - protein, 10 aa, Influenza virus
VRGQQGRMDY

SEQ ID NO: 352016 - protein, 10 aa, Influenza virus
RGQQGRMDYY

SEQ ID NO: 352017 - protein, 10 aa, Influenza virus
GQQGRMDYYW

SEQ ID NO: 352018 - protein, 10 aa, Influenza virus
QQGRMDYYWA

SEQ ID NO: 352019 - protein, 10 aa, Influenza virus
QGRMDYYWAV

SEQ ID NO: 352020 - protein, 10 aa, Influenza virus
GRMDYYWAVL

SEQ ID NO: 352021 - protein, 10 aa, Influenza virus
RMDYYWAVLK

SEQ ID NO: 352022 - protein, 10 aa, Influenza virus
MDYYWAVLKP

SEQ ID NO: 352023 - protein, 10 aa, Influenza virus
DYYWAVLKPG

SEQ ID NO: 352024 - protein, 10 aa, Influenza virus
YYWAVLKPGQ

SEQ ID NO: 352025 - protein, 10 aa, Influenza virus
YWAVLKPGQT

SEQ ID NO: 352026 - protein, 10 aa, Influenza virus
WAVLKPGQTV

SEQ ID NO: 352027 - protein, 10 aa, Influenza virus
AVLKPGQTVK

SEQ ID NO: 352028 - protein, 10 aa, Influenza virus
VLKPGQTVKI

SEQ ID NO: 352029 - protein, 10 aa, Influenza virus
LKPGQTVKIQ

SEQ ID NO: 352030 - protein, 10 aa, Influenza virus
KPGQTVKIQT

SEQ ID NO: 352031 - protein, 10 aa, Influenza virus
PGQTVKIQTN

SEQ ID NO: 352032 - protein, 10 aa, Influenza virus
GQTVKIQTNG

SEQ ID NO: 352033 - protein, 10 aa, Influenza virus
QTVKIQTNGN

SEQ ID NO: 352034 - protein, 10 aa, Influenza virus
TVKIQTNGNL

SEQ ID NO: 352035 - protein, 10 aa, Influenza virus
VKIQTNGNLI

SEQ ID NO: 352036 - protein, 10 aa, Influenza virus
KIQTNGNLIA

SEQ ID NO: 352037 - protein, 10 aa, Influenza virus
IQTNGNLIAP

SEQ ID NO: 352038 - protein, 10 aa, Influenza virus
QTNGNLIAPE

SEQ ID NO: 352039 - protein, 10 aa, Influenza virus
TNGNLIAPEY

SEQ ID NO: 352040 - protein, 10 aa, Influenza virus
NGNLIAPEYG

SEQ ID NO: 352041 - protein, 10 aa, Influenza virus
GNLIAPEYGH

SEQ ID NO: 352042 - protein, 10 aa, Influenza virus
NLIAPEYGHL

SEQ ID NO: 352043 - protein, 10 aa, Influenza virus
LIAPEYGHLI

SEQ ID NO: 352044 - protein, 10 aa, Influenza virus
IAPEYGHLIT

SEQ ID NO: 352045 - protein, 10 aa, Influenza virus
APEYGHLITG

SEQ ID NO: 352046 - protein, 10 aa, Influenza virus
PEYGHLITGK

SEQ ID NO: 352047 - protein, 10 aa, Influenza virus
EYGHLITGKS

SEQ ID NO: 352048 - protein, 10 aa, Influenza virus
YGHLITGKSH

SEQ ID NO: 352049 - protein, 10 aa, Influenza virus
GHLITGKSHG

SEQ ID NO: 352050 - protein, 10 aa, Influenza virus
HLITGKSHGR

SEQ ID NO: 352051 - protein, 10 aa, Influenza virus
LITGKSHGRI

SEQ ID NO: 352052 - protein, 10 aa, Influenza virus
ITGKSHGRIL

SEQ ID NO: 352053 - protein, 10 aa, Influenza virus
TGKSHGRILK

SEQ ID NO: 352054 - protein, 10 aa, Influenza virus
GKSHGRILKN

SEQ ID NO: 352055 - protein, 10 aa, Influenza virus
KSHGRILKNN

SEQ ID NO: 352056 - protein, 10 aa, Influenza virus
SHGRILKNNL

SEQ ID NO: 352057 - protein, 10 aa, Influenza virus
HGRILKNNLP

SEQ ID NO: 352058 - protein, 10 aa, Influenza virus
TECQLNEGVM

SEQ ID NO: 352059 - protein, 10 aa, Influenza virus
ECQLNEGVMN

SEQ ID NO: 352060 - protein, 10 aa, Influenza virus
CQLNEGVMNT

SEQ ID NO: 352061 - protein, 10 aa, Influenza virus
QLNEGVMNTS

SEQ ID NO: 352062 - protein, 10 aa, Influenza virus
LNEGVMNTSK

SEQ ID NO: 352063 - protein, 10 aa, Influenza virus
NEGVMNTSKP

SEQ ID NO: 352064 - protein, 10 aa, Influenza virus
EGVMNTSKPF

SEQ ID NO: 352065 - protein, 10 aa, Influenza virus
GVMNTSKPFQ

SEQ ID NO: 352066 - protein, 10 aa, Influenza virus
VMNTSKPFQN

SEQ ID NO: 352067 - protein, 10 aa, Influenza virus
MNTSKPFQNT

SEQ ID NO: 352068 - protein, 10 aa, Influenza virus
NTSKPFQNTS

SEQ ID NO: 352069 - protein, 10 aa, Influenza virus
TSKPFQNTSK

SEQ ID NO: 352070 - protein, 10 aa, Influenza virus
SKPFQNTSKH

SEQ ID NO: 352071 - protein, 10 aa, Influenza virus
KPFQNTSKHY

SEQ ID NO: 352072 - protein, 10 aa, Influenza virus
PFQNTSKHYI

SEQ ID NO: 352073 - protein, 10 aa, Influenza virus
FQNTSKHYIG

SEQ ID NO: 352074 - protein, 10 aa, Influenza virus
QNTSKHYIGK

SEQ ID NO: 352075 - protein, 10 aa, Influenza virus
NTSKHYIGKC

SEQ ID NO: 352076 - protein, 10 aa, Influenza virus
TSKHYIGKCP

SEQ ID NO: 352077 - protein, 10 aa, Influenza virus
SKHYIGKCPK

SEQ ID NO: 352078 - protein, 10 aa, Influenza virus
KHYIGKCPKY

SEQ ID NO: 352079 - protein, 10 aa, Influenza virus
HYIGKCPKYI

SEQ ID NO: 352080 - protein, 10 aa, Influenza virus
YIGKCPKYIP

SEQ ID NO: 352081 - protein, 10 aa, Influenza virus
IGKCPKYIPS

SEQ ID NO: 352082 - protein, 10 aa, Influenza virus
GKCPKYIPSG

SEQ ID NO: 352083 - protein, 10 aa, Influenza virus
KCPKYIPSGS

SEQ ID NO: 352084 - protein, 10 aa, Influenza virus
CPKYIPSGSL

SEQ ID NO: 352085 - protein, 10 aa, Influenza virus
PKYIPSGSLK

SEQ ID NO: 352086 - protein, 10 aa, Influenza virus
KYIPSGSLKL

SEQ ID NO: 352087 - protein, 10 aa, Influenza virus
YIPSGSLKLA

SEQ ID NO: 352088 - protein, 10 aa, Influenza virus
IPSGSLKLAI

SEQ ID NO: 352089 - protein, 10 aa, Influenza virus
PSGSLKLAIG

SEQ ID NO: 352090 - protein, 10 aa, Influenza virus
SGSLKLAIGL

SEQ ID NO: 352091 - protein, 10 aa, Influenza virus
GSLKLAIGLR

SEQ ID NO: 352092 - protein, 10 aa, Influenza virus
SLKLAIGLRN

SEQ ID NO: 352093 - protein, 10 aa, Influenza virus
LKLAIGLRNV

SEQ ID NO: 352094 - protein, 10 aa, Influenza virus
KLAIGLRNVP

SEQ ID NO: 352095 - protein, 10 aa, Influenza virus
LAIGLRNVPQ

SEQ ID NO: 352096 - protein, 10 aa, Influenza virus
AIGLRNVPQA

SEQ ID NO: 352097 - protein, 10 aa, Influenza virus
IGLRNVPQAQ

SEQ ID NO: 352098 - protein, 10 aa, Influenza virus
RNVPQAQDRG

SEQ ID NO: 352099 - protein, 10 aa, Influenza virus
NVPQAQDRGL

SEQ ID NO: 352100 - protein, 10 aa, Influenza virus
VPQAQDRGLF

SEQ ID NO: 352101 - protein, 10 aa, Influenza virus
PQAQDRGLFG

SEQ ID NO: 352102 - protein, 10 aa, Influenza virus
QAQDRGLFGA

SEQ ID NO: 352103 - protein, 10 aa, Influenza virus
QNRGLFGAIA

SEQ ID NO: 352104 - protein, 10 aa, Influenza virus
NRGLFGAIAG

SEQ ID NO: 352105 - protein, 10 aa, Influenza virus
RGLFGAIAGF

SEQ ID NO: 352106 - protein, 10 aa, Influenza virus
GLFGAIAGFI

SEQ ID NO: 352107 - protein, 10 aa, Influenza virus
LFGAIAGFIE

SEQ ID NO: 352108 - protein, 10 aa, Influenza virus
FGAIAGFIEG

SEQ ID NO: 352109 - protein, 10 aa, Influenza virus
GAIAGFIEGG

SEQ ID NO: 352110 - protein, 10 aa, Influenza virus
AIAGFIEGGW

SEQ ID NO: 352111 - protein, 10 aa, Influenza virus
IAGFIEGGWP

SEQ ID NO: 352112 - protein, 10 aa, Influenza virus
AGFIEGGWPG

SEQ ID NO: 352113 - protein, 10 aa, Influenza virus
GFIEGGWPGL

SEQ ID NO: 352114 - protein, 10 aa, Influenza virus
FIEGGWPGLV

SEQ ID NO: 352115 - protein, 10 aa, Influenza virus
IEGGWPGLVA

SEQ ID NO: 352116 - protein, 10 aa, Influenza virus
EGGWPGLVAG

SEQ ID NO: 352117 - protein, 10 aa, Influenza virus
GGWPGLVAGW

SEQ ID NO: 352118 - protein, 10 aa, Influenza virus
GWPGLVAGWY

SEQ ID NO: 352119 - protein, 10 aa, Influenza virus
WPGLVAGWYG

SEQ ID NO: 352120 - protein, 10 aa, Influenza virus
PGLVAGWYGF

SEQ ID NO: 352121 - protein, 10 aa, Influenza virus
GLVAGWYGFQ

SEQ ID NO: 352122 - protein, 10 aa, Influenza virus
LVAGWYGFQH

SEQ ID NO: 352123 - protein, 10 aa, Influenza virus
VAGWYGFQHQ

SEQ ID NO: 352124 - protein, 10 aa, Influenza virus
AGWYGFQHQN

SEQ ID NO: 352125 - protein, 10 aa, Influenza virus
GWYGFQHQNA

SEQ ID NO: 352126 - protein, 10 aa, Influenza virus
WYGFQHQNAE

SEQ ID NO: 352127 - protein, 10 aa, Influenza virus
YGFQHQNAEG

SEQ ID NO: 352128 - protein, 10 aa, Influenza virus
GFQHQNAEGT

SEQ ID NO: 352129 - protein, 10 aa, Influenza virus
FQHQNAEGTG

SEQ ID NO: 352130 - protein, 10 aa, Influenza virus
QHQNAEGTGI

SEQ ID NO: 352131 - protein, 10 aa, Influenza virus
HQNAEGTGIA

SEQ ID NO: 352132 - protein, 10 aa, Influenza virus
QNAEGTGIAA

SEQ ID NO: 352133 - protein, 10 aa, Influenza virus
NAEGTGIAAD

SEQ ID NO: 352134 - protein, 10 aa, Influenza virus
AEGTGIAADR

SEQ ID NO: 352135 - protein, 10 aa, Influenza virus
EGTGIAADRD

SEQ ID NO: 352136 - protein, 10 aa, Influenza virus
GTGIAADRDS

SEQ ID NO: 352137 - protein, 10 aa, Influenza virus
TGIAADRDST

SEQ ID NO: 352138 - protein, 10 aa, Influenza virus
GIAADRDSTQ

SEQ ID NO: 352139 - protein, 10 aa, Influenza virus
AADRDSTQKA

SEQ ID NO: 352140 - protein, 10 aa, Influenza virus
ADRDSTQKAI

SEQ ID NO: 352141 - protein, 10 aa, Influenza virus
DRDSTQKAID

SEQ ID NO: 352142 - protein, 10 aa, Influenza virus
RDSTQKAIDN

SEQ ID NO: 352143 - protein, 10 aa, Influenza virus
DSTQKAIDNM

SEQ ID NO: 352144 - protein, 10 aa, Influenza virus
STQKAIDNMQ

SEQ ID NO: 352145 - protein, 10 aa, Influenza virus
TQKAIDNMQN

SEQ ID NO: 352146 - protein, 10 aa, Influenza virus
QKAIDNMQNK

SEQ ID NO: 352147 - protein, 10 aa, Influenza virus
KAIDNMQNKL

SEQ ID NO: 352148 - protein, 10 aa, Influenza virus
AIDNMQNKLN

SEQ ID NO: 352149 - protein, 10 aa, Influenza virus
IDNMQNKLNN

SEQ ID NO: 352150 - protein, 10 aa, Influenza virus
DNMQNKLNNV

SEQ ID NO: 352151 - protein, 10 aa, Influenza virus
NMQNKLNNVI

SEQ ID NO: 352152 - protein, 10 aa, Influenza virus
MQNKLNNVID

SEQ ID NO: 352153 - protein, 10 aa, Influenza virus
QNKLNNVIDK

SEQ ID NO: 352154 - protein, 10 aa, Influenza virus
NKLNNVIDKM

SEQ ID NO: 352155 - protein, 10 aa, Influenza virus
KLNNVIDKMN

SEQ ID NO: 352156 - protein, 10 aa, Influenza virus
LNNVIDKMNK

SEQ ID NO: 352157 - protein, 10 aa, Influenza virus
NNVIDKMNKQ

SEQ ID NO: 352158 - protein, 10 aa, Influenza virus
NVIDKMNKQF

SEQ ID NO: 352159 - protein, 10 aa, Influenza virus
EFSEVESRIN

SEQ ID NO: 352160 - protein, 10 aa, Influenza virus
VESRINMINS

SEQ ID NO: 352161 - protein, 10 aa, Influenza virus
SRINMINSKI

SEQ ID NO: 352162 - protein, 10 aa, Influenza virus
RINMINSKID

SEQ ID NO: 352163 - protein, 10 aa, Influenza virus
INMINSKIDD

SEQ ID NO: 352164 - protein, 10 aa, Influenza virus
NMINSKIDDQ

SEQ ID NO: 352165 - protein, 10 aa, Influenza virus
IDDQITDIWA

SEQ ID NO: 352166 - protein, 10 aa, Influenza virus
DDQITDIWAY

SEQ ID NO: 352167 - protein, 10 aa, Influenza virus
DQITDIWAYN

SEQ ID NO: 352168 - protein, 10 aa, Influenza virus
QITDIWAYNA

SEQ ID NO: 352169 - protein, 10 aa, Influenza virus
ITDIWAYNAE

SEQ ID NO: 352170 - protein, 10 aa, Influenza virus
TDIWAYNAEL

SEQ ID NO: 352171 - protein, 10 aa, Influenza virus
DIWAYNAELL

SEQ ID NO: 352172 - protein, 10 aa, Influenza virus
IWAYNAELLV

SEQ ID NO: 352173 - protein, 10 aa, Influenza virus
WAYNAELLVL

SEQ ID NO: 352174 - protein, 10 aa, Influenza virus
AYNAELLVLL

SEQ ID NO: 352175 - protein, 10 aa, Influenza virus
YNAELLVLLE

SEQ ID NO: 352176 - protein, 10 aa, Influenza virus
NAELLVLLEN

SEQ ID NO: 352177 - protein, 10 aa, Influenza virus
AELLVLLENQ

SEQ ID NO: 352178 - protein, 10 aa, Influenza virus
ELLVLLENQK

SEQ ID NO: 352179 - protein, 10 aa, Influenza virus
LLVLLENQKT

SEQ ID NO: 352180 - protein, 10 aa, Influenza virus
LVLLENQKTL

SEQ ID NO: 352181 - protein, 10 aa, Influenza virus
VLLENQKTLD

SEQ ID NO: 352182 - protein, 10 aa, Influenza virus
LLENQKTLDE

SEQ ID NO: 352183 - protein, 10 aa, Influenza virus
LENQKTLDEH

SEQ ID NO: 352184 - protein, 10 aa, Influenza virus
ENQKTLDEHD

SEQ ID NO: 352185 - protein, 10 aa, Influenza virus
NQKTLDEHDA

SEQ ID NO: 352186 - protein, 10 aa, Influenza virus
QKTLDEHDAN

SEQ ID NO: 352187 - protein, 10 aa, Influenza virus
KTLDEHDANV

SEQ ID NO: 352188 - protein, 10 aa, Influenza virus
TLDEHDANVR

SEQ ID NO: 352189 - protein, 10 aa, Influenza virus
LDEHDANVRN

SEQ ID NO: 352190 - protein, 10 aa, Influenza virus
DEHDANVRNL

SEQ ID NO: 352191 - protein, 10 aa, Influenza virus
EHDANVRNLH

SEQ ID NO: 352192 - protein, 10 aa, Influenza virus
HDANVRNLHD

SEQ ID NO: 352193 - protein, 10 aa, Influenza virus
DANVRNLHDR

SEQ ID NO: 352194 - protein, 10 aa, Influenza virus
ANVRNLHDRV

SEQ ID NO: 352195 - protein, 10 aa, Influenza virus
NVRNLHDRVR

SEQ ID NO: 352196 - protein, 10 aa, Influenza virus
VRNLHDRVRR

SEQ ID NO: 352197 - protein, 10 aa, Influenza virus
ENAIDTGDGC

SEQ ID NO: 352198 - protein, 10 aa, Influenza virus
NAIDTGDGCF

SEQ ID NO: 352199 - protein, 10 aa, Influenza virus
AIDTGDGCFE

SEQ ID NO: 352200 - protein, 10 aa, Influenza virus
IDTGDGCFEI

SEQ ID NO: 352201 - protein, 10 aa, Influenza virus
DTGDGCFEIL

SEQ ID NO: 352202 - protein, 10 aa, Influenza virus
TGDGCFEILH

SEQ ID NO: 352203 - protein, 10 aa, Influenza virus
GDGCFEILHK

SEQ ID NO: 352204 - protein, 10 aa, Influenza virus
DGCFEILHKC

SEQ ID NO: 352205 - protein, 10 aa, Influenza virus
GCFEILHKCD

SEQ ID NO: 352206 - protein, 10 aa, Influenza virus
CFEILHKCDN

SEQ ID NO: 352207 - protein, 10 aa, Influenza virus
TIRNGTYNHK

SEQ ID NO: 352208 - protein, 10 aa, Influenza virus
YEEESKIERQ

SEQ ID NO: 352209 - protein, 10 aa, Influenza virus
EEESKIERQK

SEQ ID NO: 352210 - protein, 10 aa, Influenza virus
ERQKINGVKL

SEQ ID NO: 352211 - protein, 10 aa, Influenza virus
RQKINGVKLE

SEQ ID NO: 352212 - protein, 10 aa, Influenza virus
QKINGVKLEE

SEQ ID NO: 352213 - protein, 10 aa, Influenza virus
KINGVKLEEN

SEQ ID NO: 352214 - protein, 10 aa, Influenza virus
INGVKLEENS

SEQ ID NO: 352215 - protein, 10 aa, Influenza virus
NGVKLEENST

SEQ ID NO: 352216 - protein, 10 aa, Influenza virus
GVKLEENSTY

SEQ ID NO: 352217 - protein, 10 aa, Influenza virus
VKLEENSTYK

SEQ ID NO: 352218 - protein, 10 aa, Influenza virus
KLEENSTYKI

SEQ ID NO: 352219 - protein, 10 aa, Influenza virus
LEENSTYKIL

SEQ ID NO: 352220 - protein, 10 aa, Influenza virus
EENSTYKILS

SEQ ID NO: 352221 - protein, 10 aa, Influenza virus
ENSTYKILSI

SEQ ID NO: 352222 - protein, 10 aa, Influenza virus
NSTYKILSIY

SEQ ID NO: 352223 - protein, 10 aa, Influenza virus
STYKILSIYS

SEQ ID NO: 352224 - protein, 10 aa, Influenza virus
TYKILSIYSS

SEQ ID NO: 352225 - protein, 10 aa, Influenza virus
YKILSIYSSV

SEQ ID NO: 352226 - protein, 10 aa, Influenza virus
KILSIYSSVA

SEQ ID NO: 352227 - protein, 10 aa, Influenza virus
ILSIYSSVAS

SEQ ID NO: 352228 - protein, 10 aa, Influenza virus
LSIYSSVASS

SEQ ID NO: 352229 - protein, 10 aa, Influenza virus
SIYSSVASSL

SEQ ID NO: 352230 - protein, 10 aa, Influenza virus
IYSSVASSLV

SEQ ID NO: 352231 - protein, 10 aa, Influenza virus
YSSVASSLVL

SEQ ID NO: 352232 - protein, 10 aa, Influenza virus
SSVASSLVLL

SEQ ID NO: 352233 - protein, 10 aa, Influenza virus
SVASSLVLLL

SEQ ID NO: 352234 - protein, 10 aa, Influenza virus
VASSLVLLLM

SEQ ID NO: 352235 - protein, 10 aa, Influenza virus
ASSLVLLLMI

SEQ ID NO: 352236 - protein, 10 aa, Influenza virus
SSLVLLLMII

SEQ ID NO: 352237 - protein, 10 aa, Influenza virus
SLVLLLMIIG

SEQ ID NO: 352238 - protein, 10 aa, Influenza virus
LVLLLMIIGG

SEQ ID NO: 352239 - protein, 10 aa, Influenza virus
VLLLMIIGGF

SEQ ID NO: 352240 - protein, 10 aa, Influenza virus
LLLMIIGGFI

SEQ ID NO: 352241 - protein, 10 aa, Influenza virus
LLMIIGGFIF

SEQ ID NO: 352242 - protein, 10 aa, Influenza virus
LMIIGGFIFG

SEQ ID NO: 352243 - protein, 10 aa, Influenza virus
MIIGGFIFGC

SEQ ID NO: 352244 - protein, 10 aa, Influenza virus
IIGGFIFGCQ

SEQ ID NO: 352245 - protein, 10 aa, Influenza virus
IGGFIFGCQN

SEQ ID NO: 352246 - protein, 10 aa, Influenza virus
GGFIFGCQNG

SEQ ID NO: 352247 - protein, 10 aa, Influenza virus
GFIFGCQNGN

SEQ ID NO: 352248 - protein, 10 aa, Influenza virus
FIFGCQNGNV

SEQ ID NO: 352249 - protein, 10 aa, Influenza virus
IFGCQNGNVR

SEQ ID NO: 352250 - protein, 10 aa, Influenza virus
FGCQNGNVRC

SEQ ID NO: 352251 - protein, 10 aa, Influenza virus
GCQNGNVRCT

SEQ ID NO: 352252 - protein, 10 aa, Influenza virus
CQNGNVRCTF

SEQ ID NO: 352253 - protein, 10 aa, Influenza virus
QNGNVRCTFC

SEQ ID NO: 352254 - protein, 10 aa, Influenza virus
NGNVRCTFCI

SEQ ID NO: 352255 - protein, 10 aa, Influenza virus
ADRICVGYLS

SEQ ID NO: 352256 - protein, 10 aa, Influenza virus
DRICVGYLST

SEQ ID NO: 352257 - protein, 10 aa, Influenza virus
RICVGYLSTN

SEQ ID NO: 352258 - protein, 10 aa, Influenza virus
ICVGYLSTNS

SEQ ID NO: 352259 - protein, 10 aa, Influenza virus
CVGYLSTNSS

SEQ ID NO: 352260 - protein, 10 aa, Influenza virus
VGYLSTNSSE

SEQ ID NO: 352261 - protein, 10 aa, Influenza virus
GYLSTNSSER

SEQ ID NO: 352262 - protein, 10 aa, Influenza virus
YLSTNSSERV

SEQ ID NO: 352263 - protein, 10 aa, Influenza virus
LSTNSSERVD

SEQ ID NO: 352264 - protein, 10 aa, Influenza virus
STNSSERVDT

SEQ ID NO: 352265 - protein, 10 aa, Influenza virus
TNSSERVDTL

SEQ ID NO: 352266 - protein, 10 aa, Influenza virus
NSSERVDTLL

SEQ ID NO: 352267 - protein, 10 aa, Influenza virus
SSERVDTLLE

SEQ ID NO: 352268 - protein, 10 aa, Influenza virus
VDTLLENGVP

SEQ ID NO: 352269 - protein, 10 aa, Influenza virus
DTLLENGVPV

SEQ ID NO: 352270 - protein, 10 aa, Influenza virus
TLLENGVPVT

SEQ ID NO: 352271 - protein, 10 aa, Influenza virus
LLENGVPVTS

SEQ ID NO: 352272 - protein, 10 aa, Influenza virus
LENGVPVTSS

SEQ ID NO: 352273 - protein, 10 aa, Influenza virus
VPVTSSVDLV

SEQ ID NO: 352274 - protein, 10 aa, Influenza virus
PVTSSVDLVE

SEQ ID NO: 352275 - protein, 10 aa, Influenza virus
VTSSVDLVET

SEQ ID NO: 352276 - protein, 10 aa, Influenza virus
DLVETNHTGT

SEQ ID NO: 352277 - protein, 10 aa, Influenza virus
LVETNHTGTY

SEQ ID NO: 352278 - protein, 10 aa, Influenza virus
VETNHTGTYC

SEQ ID NO: 352279 - protein, 10 aa, Influenza virus
ETNHTGTYCS

SEQ ID NO: 352280 - protein, 10 aa, Influenza virus
TNHTGTYCSL

SEQ ID NO: 352281 - protein, 10 aa, Influenza virus
HTGTYCSLNG

SEQ ID NO: 352282 - protein, 10 aa, Influenza virus
GISPVHLGDC

SEQ ID NO: 352283 - protein, 10 aa, Influenza virus
ISPVHLGDCS

SEQ ID NO: 352284 - protein, 10 aa, Influenza virus
SPVHLGDCSF

SEQ ID NO: 352285 - protein, 10 aa, Influenza virus
PVHLGDCSFE

SEQ ID NO: 352286 - protein, 10 aa, Influenza virus
VHLGDCSFEG

SEQ ID NO: 352287 - protein, 10 aa, Influenza virus
HLGDCSFEGW

SEQ ID NO: 352288 - protein, 10 aa, Influenza virus
LGDCSFEGWI

SEQ ID NO: 352289 - protein, 10 aa, Influenza virus
GDCSFEGWIV

SEQ ID NO: 352290 - protein, 10 aa, Influenza virus
DCSFEGWIVG

SEQ ID NO: 352291 - protein, 10 aa, Influenza virus
CSFEGWIVGN

SEQ ID NO: 352292 - protein, 10 aa, Influenza virus
SFEGWIVGNP

SEQ ID NO: 352293 - protein, 10 aa, Influenza virus
FEGWIVGNPA

SEQ ID NO: 352294 - protein, 10 aa, Influenza virus
EGWIVGNPAC

SEQ ID NO: 352295 - protein, 10 aa, Influenza virus
GIREWSYLIE

SEQ ID NO: 352296 - protein, 10 aa, Influenza virus
IREWSYLIED

SEQ ID NO: 352297 - protein, 10 aa, Influenza virus
REWSYLIEDP

SEQ ID NO: 352298 - protein, 10 aa, Influenza virus
EWSYLIEDPS

SEQ ID NO: 352299 - protein, 10 aa, Influenza virus
WSYLIEDPSA

SEQ ID NO: 352300 - protein, 10 aa, Influenza virus
SYLIEDPSAP

SEQ ID NO: 352301 - protein, 10 aa, Influenza virus
YLIEDPSAPH

SEQ ID NO: 352302 - protein, 10 aa, Influenza virus
LIEDPSAPHG

SEQ ID NO: 352303 - protein, 10 aa, Influenza virus
IEDPSAPHGL

SEQ ID NO: 352304 - protein, 10 aa, Influenza virus
EDPSAPHGLC

SEQ ID NO: 352305 - protein, 10 aa, Influenza virus
DPSAPHGLCY

SEQ ID NO: 352306 - protein, 10 aa, Influenza virus
PSAPHGLCYP

SEQ ID NO: 352307 - protein, 10 aa, Influenza virus
SAPHGLCYPG

SEQ ID NO: 352308 - protein, 10 aa, Influenza virus
APHGLCYPGE

SEQ ID NO: 352309 - protein, 10 aa, Influenza virus
PHGLCYPGEL

SEQ ID NO: 352310 - protein, 10 aa, Influenza virus
HGLCYPGELD

SEQ ID NO: 352311 - protein, 10 aa, Influenza virus
GLCYPGELDN

SEQ ID NO: 352312 - protein, 10 aa, Influenza virus
LCYPGELDNN

SEQ ID NO: 352313 - protein, 10 aa, Influenza virus
CYPGELDNNG

SEQ ID NO: 352314 - protein, 10 aa, Influenza virus
YPGELDNNGE

SEQ ID NO: 352315 - protein, 10 aa, Influenza virus
PGELDNNGEL

SEQ ID NO: 352316 - protein, 10 aa, Influenza virus
GELDNNGELR

SEQ ID NO: 352317 - protein, 10 aa, Influenza virus
ELDNNGELRH

SEQ ID NO: 352318 - protein, 10 aa, Influenza virus
LDNNGELRHL

SEQ ID NO: 352319 - protein, 10 aa, Influenza virus
DNNGELRHLF

SEQ ID NO: 352320 - protein, 10 aa, Influenza virus
NNGELRHLFS

SEQ ID NO: 352321 - protein, 10 aa, Influenza virus
NGELRHLFSG

SEQ ID NO: 352322 - protein, 10 aa, Influenza virus
GELRHLFSGI

SEQ ID NO: 352323 - protein, 10 aa, Influenza virus
ELRHLFSGIR

SEQ ID NO: 352324 - protein, 10 aa, Influenza virus
LRHLFSGIRS

SEQ ID NO: 352325 - protein, 10 aa, Influenza virus
RHLFSGIRSF

SEQ ID NO: 352326 - protein, 10 aa, Influenza virus
HLFSGIRSFS

SEQ ID NO: 352327 - protein, 10 aa, Influenza virus
LFSGIRSFSR

SEQ ID NO: 352328 - protein, 10 aa, Influenza virus
FSGIRSFSRT

SEQ ID NO: 352329 - protein, 10 aa, Influenza virus
SGIRSFSRTE

SEQ ID NO: 352330 - protein, 10 aa, Influenza virus
GIRSFSRTEL

SEQ ID NO: 352331 - protein, 10 aa, Influenza virus
IRSFSRTELI

SEQ ID NO: 352332 - protein, 10 aa, Influenza virus
RSFSRTELIP

SEQ ID NO: 352333 - protein, 10 aa, Influenza virus
SFSRTELIAP

SEQ ID NO: 352334 - protein, 10 aa, Influenza virus
KGTNSFYRNL

SEQ ID NO: 352335 - protein, 10 aa, Influenza virus
GGYPVIKKTY

SEQ ID NO: 352336 - protein, 10 aa, Influenza virus
KTYNNTTGRD

SEQ ID NO: 352337 - protein, 10 aa, Influenza virus
TYNNTTGRDV

SEQ ID NO: 352338 - protein, 10 aa, Influenza virus
YNNTTGRDVL

SEQ ID NO: 352339 - protein, 10 aa, Influenza virus
NNTTGRDVLV

SEQ ID NO: 352340 - protein, 10 aa, Influenza virus
NTTGRDVLVL

SEQ ID NO: 352341 - protein, 10 aa, Influenza virus
TTGRDVLVLW

SEQ ID NO: 352342 - protein, 10 aa, Influenza virus
TGRDVLVLWG

SEQ ID NO: 352343 - protein, 10 aa, Influenza virus
GRDVLVLWGI

SEQ ID NO: 352344 - protein, 10 aa, Influenza virus
RDVLVLWGIH

SEQ ID NO: 352345 - protein, 10 aa, Influenza virus
DVLVLWGIHH

SEQ ID NO: 352346 - protein, 10 aa, Influenza virus
VLVLWGIHHP

SEQ ID NO: 352347 - protein, 10 aa, Influenza virus
PYTLVSTSSW

SEQ ID NO: 352348 - protein, 10 aa, Influenza virus
YTLVSTSSWS

SEQ ID NO: 352349 - protein, 10 aa, Influenza virus
GVRPGYNGQR

SEQ ID NO: 352350 - protein, 10 aa, Influenza virus
VRPGYNGQRS

SEQ ID NO: 352351 - protein, 10 aa, Influenza virus
RPGYNGQKSW

SEQ ID NO: 352352 - protein, 10 aa, Influenza virus
PGYNGQRSWM

SEQ ID NO: 352353 - protein, 10 aa, Influenza virus
GYNGQRSWMK

SEQ ID NO: 352354 - protein, 10 aa, Influenza virus
YNGQRSWMKI

SEQ ID NO: 352355 - protein, 10 aa, Influenza virus
NGQRSWMKIY

SEQ ID NO: 352356 - protein, 10 aa, Influenza virus
GQRSWMKIYW

SEQ ID NO: 352357 - protein, 10 aa, Influenza virus
ISFESNGGLL

SEQ ID NO: 352358 - protein, 10 aa, Influenza virus
SFESNGGLLA

SEQ ID NO: 352359 - protein, 10 aa, Influenza virus
FESNGGLLAP

SEQ ID NO: 352360 - protein, 10 aa, Influenza virus
ESNGGLLAPR

SEQ ID NO: 352361 - protein, 10 aa, Influenza virus
SNGGLLAPRY

SEQ ID NO: 352362 - protein, 10 aa, Influenza virus
NGGLLAPRYG

SEQ ID NO: 352363 - protein, 10 aa, Influenza virus
GGLLAPRYGY

SEQ ID NO: 352364 - protein, 10 aa, Influenza virus
GLLAPRYGYI

SEQ ID NO: 352365 - protein, 10 aa, Influenza virus
LLAPRYGYII

SEQ ID NO: 352366 - protein, 10 aa, Influenza virus
LAPRYGYIIE

SEQ ID NO: 352367 - protein, 10 aa, Influenza virus
APRYGYIIEE

SEQ ID NO: 352368 - protein, 10 aa, Influenza virus
PRYGYIIEEY

SEQ ID NO: 352369 - protein, 10 aa, Influenza virus
RYGYIIEEYG

SEQ ID NO: 352370 - protein, 10 aa, Influenza virus
YGYIIEEYGK

SEQ ID NO: 352371 - protein, 10 aa, Influenza virus
GYIIEEYGKG

SEQ ID NO: 352372 - protein, 10 aa, Influenza virus
YIIEEYGKGR

SEQ ID NO: 352373 - protein, 10 aa, Influenza virus
IIEEYGKGRI

SEQ ID NO: 352374 - protein, 10 aa, Influenza virus
IEEYGKGRIF

SEQ ID NO: 352375 - protein, 10 aa, Influenza virus
EEYGKGRIFQ

SEQ ID NO: 352376 - protein, 10 aa, Influenza virus
EYGKGRIFQS

SEQ ID NO: 352377 - protein, 10 aa, Influenza virus
YGKGRIFQSR

SEQ ID NO: 352378 - protein, 10 aa, Influenza virus
GKGRIFQSRI

SEQ ID NO: 352379 - protein, 10 aa, Influenza virus
KGRIFQSRIR

SEQ ID NO: 352380 - protein, 10 aa, Influenza virus
KCNTKCQTSV

SEQ ID NO: 352381 - protein, 10 aa, Influenza virus
CNTKCQTSVG

SEQ ID NO: 352382 - protein, 10 aa, Influenza virus
NTKCQTSVGG

SEQ ID NO: 352383 - protein, 10 aa, Influenza virus
TKCQTSVGGI

SEQ ID NO: 352384 - protein, 10 aa, Influenza virus
KCQTSVGGIN

SEQ ID NO: 352385 - protein, 10 aa, Influenza virus
CQTSVGGINT

SEQ ID NO: 352386 - protein, 10 aa, Influenza virus
QTSVGGINTN

SEQ ID NO: 352387 - protein, 10 aa, Influenza virus
TSVGGINTNK

SEQ ID NO: 352388 - protein, 10 aa, Influenza virus
SVGGINTNKT

SEQ ID NO: 352389 - protein, 10 aa, Influenza virus
VGGINTNKTF

SEQ ID NO: 352390 - protein, 10 aa, Influenza virus
GGINTNKTFQ

SEQ ID NO: 352391 - protein, 10 aa, Influenza virus
GINTNKTFQN

SEQ ID NO: 352392 - protein, 10 aa, Influenza virus
INTNKTFQNI

SEQ ID NO: 352393 - protein, 10 aa, Influenza virus
NTNKTFQNIE

SEQ ID NO: 352394 - protein, 10 aa, Influenza virus
TNKTFQNIER

SEQ ID NO: 352395 - protein, 10 aa, Influenza virus
NKTFQNIERN

SEQ ID NO: 352396 - protein, 10 aa, Influenza virus
KTFQNIERNA

SEQ ID NO: 352397 - protein, 10 aa, Influenza virus
TFQNIERNAL

SEQ ID NO: 352398 - protein, 10 aa, Influenza virus
FQNIERNALG

SEQ ID NO: 352399 - protein, 10 aa, Influenza virus
QNIERNALGD

SEQ ID NO: 352400 - protein, 10 aa, Influenza virus
NIERNALGDC

SEQ ID NO: 352401 - protein, 10 aa, Influenza virus
IERNALGDCP

SEQ ID NO: 352402 - protein, 10 aa, Influenza virus
ERNALGDCPK

SEQ ID NO: 352403 - protein, 10 aa, Influenza virus
RNALGDCPKY

SEQ ID NO: 352404 - protein, 10 aa, Influenza virus
NALGDCPKYI

SEQ ID NO: 352405 - protein, 10 aa, Influenza virus
ALGDCPKYIK

SEQ ID NO: 352406 - protein, 10 aa, Influenza virus
LGDCPKYIKS

SEQ ID NO: 352407 - protein, 10 aa, Influenza virus
GDCPKYIKSG

SEQ ID NO: 352408 - protein, 10 aa, Influenza virus
DCPKYIKSGQ

SEQ ID NO: 352409 - protein, 10 aa, Influenza virus
CPKYIKSGQL

SEQ ID NO: 352410 - protein, 10 aa, Influenza virus
PKYIKSGQLK

SEQ ID NO: 352411 - protein, 10 aa, Influenza virus
KYIKSGQLKL

SEQ ID NO: 352412 - protein, 10 aa, Influenza virus
YIKSGQLKLA

SEQ ID NO: 352413 - protein, 10 aa, Influenza virus
IKSGQLKLAT

SEQ ID NO: 352414 - protein, 10 aa, Influenza virus
KSGQLKLATG

SEQ ID NO: 352415 - protein, 10 aa, Influenza virus
SGQLKLATGL

SEQ ID NO: 352416 - protein, 10 aa, Influenza virus
GQLKLATGLR

SEQ ID NO: 352417 - protein, 10 aa, Influenza virus
QLKLATGLRN

SEQ ID NO: 352418 - protein, 10 aa, Influenza virus
LKLATGLRNV

SEQ ID NO: 352419 - protein, 10 aa, Influenza virus
KLATGLRNVP

SEQ ID NO: 352420 - protein, 10 aa, Influenza virus
LATGLRNVPA

SEQ ID NO: 352421 - protein, 10 aa, Influenza virus
RGLFGAIAGF

SEQ ID NO: 352422 - protein, 10 aa, Influenza virus
GLFGAIAGFI

SEQ ID NO: 352423 - protein, 10 aa, Influenza virus
LFGAIAGFIE

SEQ ID NO: 352424 - protein, 10 aa, Influenza virus
FGAIAGFIEG

SEQ ID NO: 352425 - protein, 10 aa, Influenza virus
GAIAGFIEGG

SEQ ID NO: 352426 - protein, 10 aa, Influenza virus
AIAGFIEGGW

SEQ ID NO: 352427 - protein, 10 aa, Influenza virus
IAGFIEGGWP

SEQ ID NO: 352428 - protein, 10 aa, Influenza virus
AGFIEGGWPG

SEQ ID NO: 352429 - protein, 10 aa, Influenza virus
GFIEGGWPGL

SEQ ID NO: 352430 - protein, 10 aa, Influenza virus
FIEGGWPGLI

SEQ ID NO: 352431 - protein, 10 aa, Influenza virus
IEGGWPGLIN

SEQ ID NO: 352432 - protein, 10 aa, Influenza virus
EGGWPGLING

SEQ ID NO: 352433 - protein, 10 aa, Influenza virus
GGWPGLINGW

SEQ ID NO: 352434 - protein, 10 aa, Influenza virus
GWPGLINGWY

SEQ ID NO: 352435 - protein, 10 aa, Influenza virus
WPGLINGWYG

SEQ ID NO: 352436 - protein, 10 aa, Influenza virus
PGLINGWYGF

SEQ ID NO: 352437 - protein, 10 aa, Influenza virus
GLINGWYGFQ

SEQ ID NO: 352438 - protein, 10 aa, Influenza virus
LINGWYGFQH

SEQ ID NO: 352439 - protein, 10 aa, Influenza virus
INGWYGFQHQ

SEQ ID NO: 352440 - protein, 10 aa, Influenza virus
NGWYGFQHQN

SEQ ID NO: 352441 - protein, 10 aa, Influenza virus
GWYGFQHQNE

SEQ ID NO: 352442 - protein, 10 aa, Influenza virus
WYGFQHQNEQ

SEQ ID NO: 352443 - protein, 10 aa, Influenza virus
YGFQHQNEQG

SEQ ID NO: 352444 - protein, 10 aa, Influenza virus
GFQHQNEQGV

SEQ ID NO: 352445 - protein, 10 aa, Influenza virus
FQHQNEQGVG

SEQ ID NO: 352446 - protein, 10 aa, Influenza virus
QHQNEQGTGI

SEQ ID NO: 352447 - protein, 10 aa, Influenza virus
HQNEQGTGIA

SEQ ID NO: 352448 - protein, 10 aa, Influenza virus
QNEQGTGIAA

SEQ ID NO: 352449 - protein, 10 aa, Influenza virus
NEQGTGIAAD

SEQ ID NO: 352450 - protein, 10 aa, Influenza virus
EQGTGIAADK

SEQ ID NO: 352451 - protein, 10 aa, Influenza virus
QGTGIAADKE

SEQ ID NO: 352452 - protein, 10 aa, Influenza virus
GTGIAADKES

SEQ ID NO: 352453 - protein, 10 aa, Influenza virus
TGIAADKEST

SEQ ID NO: 352454 - protein, 10 aa, Influenza virus
GIAADKESTQ

SEQ ID NO: 352455 - protein, 10 aa, Influenza virus
IAADKESTQK

SEQ ID NO: 352456 - protein, 10 aa, Influenza virus
AADKESTQKA

SEQ ID NO: 352457 - protein, 10 aa, Influenza virus
ADKESTQKAI

SEQ ID NO: 352458 - protein, 10 aa, Influenza virus
DKESTQKAID

SEQ ID NO: 352459 - protein, 10 aa, Influenza virus
KESTQKAIDQ

SEQ ID NO: 352460 - protein, 10 aa, Influenza virus
ESTQKAIDQI

SEQ ID NO: 352461 - protein, 10 aa, Influenza virus
STQKAIDQIT

SEQ ID NO: 352462 - protein, 10 aa, Influenza virus
TQKAIDQITT

SEQ ID NO: 352463 - protein, 10 aa, Influenza virus
QKAIDQITTK

SEQ ID NO: 352464 - protein, 10 aa, Influenza virus
KAIDQITTKI

SEQ ID NO: 352465 - protein, 10 aa, Influenza virus
AIDQITTKIN

SEQ ID NO: 352466 - protein, 10 aa, Influenza virus
IDQITTKINN

SEQ ID NO: 352467 - protein, 10 aa, Influenza virus
DQITTKINNI

SEQ ID NO: 352468 - protein, 10 aa, Influenza virus
QITTKINNII

SEQ ID NO: 352469 - protein, 10 aa, Influenza virus
ITTKINNIID

SEQ ID NO: 352470 - protein, 10 aa, Influenza virus
TTKINNIIDK

SEQ ID NO: 352471 - protein, 10 aa, Influenza virus
TKINNIIDKM

SEQ ID NO: 352472 - protein, 10 aa, Influenza virus
KINNIIDKMN

SEQ ID NO: 352473 - protein, 10 aa, Influenza virus
INNIIDKMNG

SEQ ID NO: 352474 - protein, 10 aa, Influenza virus
NNIIDKMNGN

SEQ ID NO: 352475 - protein, 10 aa, Influenza virus
NIIDKMNGNY

SEQ ID NO: 352476 - protein, 10 aa, Influenza virus
IIDKMNGNYD

SEQ ID NO: 352477 - protein, 10 aa, Influenza virus
IDKMNGNYDS

SEQ ID NO: 352478 - protein, 10 aa, Influenza virus
DKMNGNYDSI

SEQ ID NO: 352479 - protein, 10 aa, Influenza virus
KMNGNYDSIR

SEQ ID NO: 352480 - protein, 10 aa, Influenza virus
MNGNYDSIRG

SEQ ID NO: 352481 - protein, 10 aa, Influenza virus
NGNYDSIRGE

SEQ ID NO: 352482 - protein, 10 aa, Influenza virus
GNYDSIRGEF

SEQ ID NO: 352483 - protein, 10 aa, Influenza virus
NYDSIRGEFN

SEQ ID NO: 352484 - protein, 10 aa, Influenza virus
YDSIRGEFNQ

SEQ ID NO: 352485 - protein, 10 aa, Influenza virus
DSIRGEFNQV

SEQ ID NO: 352486 - protein, 10 aa, Influenza virus
SIRGEFNQVE

SEQ ID NO: 352487 - protein, 10 aa, Influenza virus
IRGEFNQVEK

SEQ ID NO: 352488 - protein, 10 aa, Influenza virus
RGEFNQVEKR

SEQ ID NO: 352489 - protein, 10 aa, Influenza virus
GEFNQVEKRI

SEQ ID NO: 352490 - protein, 10 aa, Influenza virus
EFNQVEKRIN

SEQ ID NO: 352491 - protein, 10 aa, Influenza virus
FNQVEKRINM

SEQ ID NO: 352492 - protein, 10 aa, Influenza virus
NQVEKRINML

SEQ ID NO: 352493 - protein, 10 aa, Influenza virus
QVEQRINMLA

SEQ ID NO: 352494 - protein, 10 aa, Influenza virus
VEQRINMLAD

SEQ ID NO: 352495 - protein, 10 aa, Influenza virus
EQRINMLADR

SEQ ID NO: 352496 - protein, 10 aa, Influenza virus
QRINMLADRI

SEQ ID NO: 352497 - protein, 10 aa, Influenza virus
RINMLADRID

SEQ ID NO: 352498 - protein, 10 aa, Influenza virus
INMLADRIDD

SEQ ID NO: 352499 - protein, 10 aa, Influenza virus
NMLADRIDDA

SEQ ID NO: 352500 - protein, 10 aa, Influenza virus
MLADRIDDAV

SEQ ID NO: 352501 - protein, 10 aa, Influenza virus
LADRIDDAVT

SEQ ID NO: 352502 - protein, 10 aa, Influenza virus
ADRIDDAVTD

SEQ ID NO: 352503 - protein, 10 aa, Influenza virus
DRIDDAVTDV

SEQ ID NO: 352504 - protein, 10 aa, Influenza virus
RIDDAVTDVW

SEQ ID NO: 352505 - protein, 10 aa, Influenza virus
IDDAVTDVWS

SEQ ID NO: 352506 - protein, 10 aa, Influenza virus
DDAVTDVWSY

SEQ ID NO: 352507 - protein, 10 aa, Influenza virus
DAVTDVWSYN

SEQ ID NO: 352508 - protein, 10 aa, Influenza virus
AVTDVWSYNA

SEQ ID NO: 352509 - protein, 10 aa, Influenza virus
VTDVWSYNAK

SEQ ID NO: 352510 - protein, 10 aa, Influenza virus
TDVWSYNAKL

SEQ ID NO: 352511 - protein, 10 aa, Influenza virus
DVWSYNAKLL

SEQ ID NO: 352512 - protein, 10 aa, Influenza virus
VWSYNAKLLV

SEQ ID NO: 352513 - protein, 10 aa, Influenza virus
WSYNAKLLVL

SEQ ID NO: 352514 - protein, 10 aa, Influenza virus
SYNAKLLVLL

SEQ ID NO: 352515 - protein, 10 aa, Influenza virus
YNAKLLVLLE

SEQ ID NO: 352516 - protein, 10 aa, Influenza virus
NAKLLVLLEN

SEQ ID NO: 352517 - protein, 10 aa, Influenza virus
AKLLVLLEND

SEQ ID NO: 352518 - protein, 10 aa, Influenza virus
KLLVLLENDK

SEQ ID NO: 352519 - protein, 10 aa, Influenza virus
LLVLLENDKT

SEQ ID NO: 352520 - protein, 10 aa, Influenza virus
LVLLENDKTL

SEQ ID NO: 352521 - protein, 10 aa, Influenza virus
VLLENDKTLD

SEQ ID NO: 352522 - protein, 10 aa, Influenza virus
LLENDKTLDM

SEQ ID NO: 352523 - protein, 10 aa, Influenza virus
LENDKTLDMH

SEQ ID NO: 352524 - protein, 10 aa, Influenza virus
ENDKTLDMHD

SEQ ID NO: 352525 - protein, 10 aa, Influenza virus
NDKTLDMHDA

SEQ ID NO: 352526 - protein, 10 aa, Influenza virus
DKTLDMHDAN

SEQ ID NO: 352527 - protein, 10 aa, Influenza virus
KTLDMHDANV

SEQ ID NO: 352528 - protein, 10 aa, Influenza virus
TLDMHDANVR

SEQ ID NO: 352529 - protein, 10 aa, Influenza virus
LDMHDANVRN

SEQ ID NO: 352530 - protein, 10 aa, Influenza virus
DMHDANVRNL

SEQ ID NO: 352531 - protein, 10 aa, Influenza virus
MHDANVRNLH

SEQ ID NO: 352532 - protein, 10 aa, Influenza virus
HDANVRNLHD

SEQ ID NO: 352533 - protein, 10 aa, Influenza virus
DANVRNLHDQ

SEQ ID NO: 352534 - protein, 10 aa, Influenza virus
ANVRNLHDQV

SEQ ID NO: 352535 - protein, 10 aa, Influenza virus
NVRNLHDQVR

SEQ ID NO: 352536 - protein, 10 aa, Influenza virus
NAIDEGNGCF

SEQ ID NO: 352537 - protein, 10 aa, Influenza virus
AIDEGNGCFE

SEQ ID NO: 352538 - protein, 10 aa, Influenza virus
IDEGNGCFEL

SEQ ID NO: 352539 - protein, 10 aa, Influenza virus
DEGNGCFELL

SEQ ID NO: 352540 - protein, 10 aa, Influenza virus
EGNGCFELLH

SEQ ID NO: 352541 - protein, 10 aa, Influenza virus
GNGCFELLHK

SEQ ID NO: 352542 - protein, 10 aa, Influenza virus
NGCFELLHKC

SEQ ID NO: 352543 - protein, 10 aa, Influenza virus
GCFELLHKCN

SEQ ID NO: 352544 - protein, 10 aa, Influenza virus
CFELLHKCND

SEQ ID NO: 352545 - protein, 10 aa, Influenza virus
FELLHKCNDS

SEQ ID NO: 352546 - protein, 10 aa, Influenza virus
ELLHKCNDSC

SEQ ID NO: 352547 - protein, 10 aa, Influenza virus
LLHKCNDSCM

SEQ ID NO: 352548 - protein, 10 aa, Influenza virus
LHKCNDSCME

SEQ ID NO: 352549 - protein, 10 aa, Influenza virus
HKCNDSCMET

SEQ ID NO: 352550 - protein, 10 aa, Influenza virus
KCNDSCMETI

SEQ ID NO: 352551 - protein, 10 aa, Influenza virus
CNDSCMETIR

SEQ ID NO: 352552 - protein, 10 aa, Influenza virus
NDSCMETIRN

SEQ ID NO: 352553 - protein, 10 aa, Influenza virus
DSCMETIRNG

SEQ ID NO: 352554 - protein, 10 aa, Influenza virus
SCMETIRNGT

SEQ ID NO: 352555 - protein, 10 aa, Influenza virus
CMETIRNGTY

SEQ ID NO: 352556 - protein, 10 aa, Influenza virus
METIRNGTYN

SEQ ID NO: 352557 - protein, 10 aa, Influenza virus
ETIRNGTYNH

SEQ ID NO: 352558 - protein, 10 aa, Influenza virus
TIRNGTYNHT

SEQ ID NO: 352559 - protein, 10 aa, Influenza virus
EYAEESKLKR

SEQ ID NO: 352560 - protein, 10 aa, Influenza virus
YAEESKLKRQ

SEQ ID NO: 352561 - protein, 10 aa, Influenza virus
AEESKLKRQE

SEQ ID NO: 352562 - protein, 10 aa, Influenza virus
EESKLKRQEI

SEQ ID NO: 352563 - protein, 10 aa, Influenza virus
ESKLKRQEIE

SEQ ID NO: 352564 - protein, 10 aa, Influenza virus
SKLKRQEIEG

SEQ ID NO: 352565 - protein, 10 aa, Influenza virus
KLKRQEIEGI

SEQ ID NO: 352566 - protein, 10 aa, Influenza virus
LKRQEIEGIK

SEQ ID NO: 352567 - protein, 10 aa, Influenza virus
KRQEIEGIKL

SEQ ID NO: 352568 - protein, 10 aa, Influenza virus
RQEIEGIKLK

SEQ ID NO: 352569 - protein, 10 aa, Influenza virus
QEIEGIKLKS

SEQ ID NO: 352570 - protein, 10 aa, Influenza virus
SEDNVYKALS

SEQ ID NO: 352571 - protein, 10 aa, Influenza virus
EDNVYKALSI

SEQ ID NO: 352572 - protein, 10 aa, Influenza virus
DNVYKALSIY

SEQ ID NO: 352573 - protein, 10 aa, Influenza virus
NVYKALSIYS

SEQ ID NO: 352574 - protein, 10 aa, Influenza virus
VYKALSIYSC

SEQ ID NO: 352575 - protein, 10 aa, Influenza virus
YKALSIYSCI

SEQ ID NO: 352576 - protein, 10 aa, Influenza virus
KALSIYSCIA

SEQ ID NO: 352577 - protein, 10 aa, Influenza virus
ALSIYSCIAS

SEQ ID NO: 352578 - protein, 10 aa, Influenza virus
LSIYSCIASS

SEQ ID NO: 352579 - protein, 10 aa, Influenza virus
SIYSCIASSV

SEQ ID NO: 352580 - protein, 10 aa, Influenza virus
IYSCIASSVV

SEQ ID NO: 352581 - protein, 10 aa, Influenza virus
YSCIASSVVL

SEQ ID NO: 352582 - protein, 10 aa, Influenza virus
SCIASSVVLV

SEQ ID NO: 352583 - protein, 10 aa, Influenza virus
CIASSVVLVG

SEQ ID NO: 352584 - protein, 10 aa, Influenza virus
IASSVVLVGL

SEQ ID NO: 352585 - protein, 10 aa, Influenza virus
ASSVVLVGLI

SEQ ID NO: 352586 - protein, 10 aa, Influenza virus
SSVVLVGLIL

SEQ ID NO: 352587 - protein, 10 aa, Influenza virus
VLVGLILAFI

SEQ ID NO: 352588 - protein, 10 aa, Influenza virus
LVGLILAFIM

SEQ ID NO: 352589 - protein, 10 aa, Influenza virus
VGLILAFIMW

SEQ ID NO: 352590 - protein, 10 aa, Influenza virus
GLILAFIMWA

SEQ ID NO: 352591 - protein, 10 aa, Influenza virus
LILAFIMWAC

SEQ ID NO: 352592 - protein, 10 aa, Influenza virus
FIMWACSSGN

SEQ ID NO: 352593 - protein, 10 aa, Influenza virus
IMWACSSGNC

SEQ ID NO: 352594 - protein, 10 aa, Influenza virus
MWACSSGNCR

SEQ ID NO: 352595 - protein, 10 aa, Influenza virus
WACSSGNCRF

SEQ ID NO: 352596 - protein, 10 aa, Influenza virus
MIALILVALA

SEQ ID NO: 352597 - protein, 10 aa, Influenza virus
IALILVALAL

SEQ ID NO: 352598 - protein, 10 aa, Influenza virus
ALILVALALS

SEQ ID NO: 352599 - protein, 10 aa, Influenza virus
LILVALALSH

SEQ ID NO: 352600 - protein, 10 aa, Influenza virus
ILVALALSHT

SEQ ID NO: 352601 - protein, 10 aa, Influenza virus
LVALALSHTA

SEQ ID NO: 352602 - protein, 10 aa, Influenza virus
VALALSHTAY

SEQ ID NO: 352603 - protein, 10 aa, Influenza virus
ALALSHTAYS

SEQ ID NO: 352604 - protein, 10 aa, Influenza virus
LALSHTAYSQ

SEQ ID NO: 352605 - protein, 10 aa, Influenza virus
ALSHTAYSQI

SEQ ID NO: 352606 - protein, 10 aa, Influenza virus
LSHTAYSQIT

SEQ ID NO: 352607 - protein, 10 aa, Influenza virus
SHTAYSQITN

SEQ ID NO: 352608 - protein, 10 aa, Influenza virus
HTAYSQITNG

SEQ ID NO: 352609 - protein, 10 aa, Influenza virus
TAYSQITNGT

SEQ ID NO: 352610 - protein, 10 aa, Influenza virus
AYSQITNGTT

SEQ ID NO: 352611 - protein, 10 aa, Influenza virus
YSQITNGTTG

SEQ ID NO: 352612 - protein, 10 aa, Influenza virus
SQITNGTTGN

SEQ ID NO: 352613 - protein, 10 aa, Influenza virus
QITNGTTGNP

SEQ ID NO: 352614 - protein, 10 aa, Influenza virus
ITNGTTGNPI

SEQ ID NO: 352615 - protein, 10 aa, Influenza virus
TNGTTGNPII

SEQ ID NO: 352616 - protein, 10 aa, Influenza virus
NGTTGNPIIC

SEQ ID NO: 352617 - protein, 10 aa, Influenza virus
GTTGNPIICL

SEQ ID NO: 352618 - protein, 10 aa, Influenza virus
TTGNPIICLG

SEQ ID NO: 352619 - protein, 10 aa, Influenza virus
TGNPIICLGH

SEQ ID NO: 352620 - protein, 10 aa, Influenza virus
GNPIICLGHH

SEQ ID NO: 352621 - protein, 10 aa, Influenza virus
NPIICLGHHA

SEQ ID NO: 352622 - protein, 10 aa, Influenza virus
PIICLGHHAV

SEQ ID NO: 352623 - protein, 10 aa, Influenza virus
IICLGHHAVE

SEQ ID NO: 352624 - protein, 10 aa, Influenza virus
ICLGHHAVEN

SEQ ID NO: 352625 - protein, 10 aa, Influenza virus
CLGHHAVENG

SEQ ID NO: 352626 - protein, 10 aa, Influenza virus
LGHHAVENGT

SEQ ID NO: 352627 - protein, 10 aa, Influenza virus
GHHAVENGTS

SEQ ID NO: 352628 - protein, 10 aa, Influenza virus
HHAVENGTSV

SEQ ID NO: 352629 - protein, 10 aa, Influenza virus
HAVENGTSVK

SEQ ID NO: 352630 - protein, 10 aa, Influenza virus
AVENGTSVKT

SEQ ID NO: 352631 - protein, 10 aa, Influenza virus
VENGTSVKTL

SEQ ID NO: 352632 - protein, 10 aa, Influenza virus
ENGTSVKTLT

SEQ ID NO: 352633 - protein, 10 aa, Influenza virus
NGTSVKTLTD

SEQ ID NO: 352634 - protein, 10 aa, Influenza virus
GTSVKTLTDN

SEQ ID NO: 352635 - protein, 10 aa, Influenza virus
TSVKTLTDNH

SEQ ID NO: 352636 - protein, 10 aa, Influenza virus
SVKTLTDNHV

SEQ ID NO: 352637 - protein, 10 aa, Influenza virus
VKTLTDNHVE

SEQ ID NO: 352638 - protein, 10 aa, Influenza virus
KTLTDNHVEV

SEQ ID NO: 352639 - protein, 10 aa, Influenza virus
TLTDNHVEVV

SEQ ID NO: 352640 - protein, 10 aa, Influenza virus
LTDNHVEVVS

SEQ ID NO: 352641 - protein, 10 aa, Influenza virus
TDNHVEVVSA

SEQ ID NO: 352642 - protein, 10 aa, Influenza virus
DNHVEVVSAK

SEQ ID NO: 352643 - protein, 10 aa, Influenza virus
NHVEVVSAKE

SEQ ID NO: 352644 - protein, 10 aa, Influenza virus
HVEVVSAKEL

SEQ ID NO: 352645 - protein, 10 aa, Influenza virus
VEVVSAKELV

SEQ ID NO: 352646 - protein, 10 aa, Influenza virus
EVVSAKELVE

SEQ ID NO: 352647 - protein, 10 aa, Influenza virus
VVSAKELVET

SEQ ID NO: 352648 - protein, 10 aa, Influenza virus
VSAKELVETN

SEQ ID NO: 352649 - protein, 10 aa, Influenza virus
SAKELVETNH

SEQ ID NO: 352650 - protein, 10 aa, Influenza virus
AKELVETNHT

SEQ ID NO: 352651 - protein, 10 aa, Influenza virus
KELVETNHTD

SEQ ID NO: 352652 - protein, 10 aa, Influenza virus
ELVETNHTDE

SEQ ID NO: 352653 - protein, 10 aa, Influenza virus
LVETNHTDEL

SEQ ID NO: 352654 - protein, 10 aa, Influenza virus
VETNHTDELC

SEQ ID NO: 352655 - protein, 10 aa, Influenza virus
ETNHTDELCP

SEQ ID NO: 352656 - protein, 10 aa, Influenza virus
TNHTDELCPS

SEQ ID NO: 352657 - protein, 10 aa, Influenza virus
NHTDELCPSP

SEQ ID NO: 352658 - protein, 10 aa, Influenza virus
HTDELCPSPL

SEQ ID NO: 352659 - protein, 10 aa, Influenza virus
TDELCPSPLK

SEQ ID NO: 352660 - protein, 10 aa, Influenza virus
DELCPSPLKL

SEQ ID NO: 352661 - protein, 10 aa, Influenza virus
ELCPSPLKLV

SEQ ID NO: 352662 - protein, 10 aa, Influenza virus
LCPSPLKLVD

SEQ ID NO: 352663 - protein, 10 aa, Influenza virus
CPSPLKLVDG

SEQ ID NO: 352664 - protein, 10 aa, Influenza virus
PSPLKLVDGQ

SEQ ID NO: 352665 - protein, 10 aa, Influenza virus
SPLKLVDGQD

SEQ ID NO: 352666 - protein, 10 aa, Influenza virus
PLKLVDGQDC

SEQ ID NO: 352667 - protein, 10 aa, Influenza virus
LKLVDGQDCD

SEQ ID NO: 352668 - protein, 10 aa, Influenza virus
KLVDGQDCDL

SEQ ID NO: 352669 - protein, 10 aa, Influenza virus
LVDGQDCDLI

SEQ ID NO: 352670 - protein, 10 aa, Influenza virus
VDGQDCDLIN

SEQ ID NO: 352671 - protein, 10 aa, Influenza virus
DGQDCDLING

SEQ ID NO: 352672 - protein, 10 aa, Influenza virus
GQDCDLINGA

SEQ ID NO: 352673 - protein, 10 aa, Influenza virus
QDCDLINGAL

SEQ ID NO: 352674 - protein, 10 aa, Influenza virus
DCDLINGALG

SEQ ID NO: 352675 - protein, 10 aa, Influenza virus
CDLINGALGS

SEQ ID NO: 352676 - protein, 10 aa, Influenza virus
DLINGALGSP

SEQ ID NO: 352677 - protein, 10 aa, Influenza virus
LINGALGSPG

SEQ ID NO: 352678 - protein, 10 aa, Influenza virus
INGALGSPGC

SEQ ID NO: 352679 - protein, 10 aa, Influenza virus
NGALGSPGCD

SEQ ID NO: 352680 - protein, 10 aa, Influenza virus
GALGSPGCDR

SEQ ID NO: 352681 - protein, 10 aa, Influenza virus
ALGSPGCDRL

SEQ ID NO: 352682 - protein, 10 aa, Influenza virus
LGSPGCDRLQ

SEQ ID NO: 352683 - protein, 10 aa, Influenza virus
GSPGCDRLQD

SEQ ID NO: 352684 - protein, 10 aa, Influenza virus
SPGCDRLQDT

SEQ ID NO: 352685 - protein, 10 aa, Influenza virus
PGCDRLQDTT

SEQ ID NO: 352686 - protein, 10 aa, Influenza virus
GCDRLQDTTW

SEQ ID NO: 352687 - protein, 10 aa, Influenza virus
CDRLQDTTWD

SEQ ID NO: 352688 - protein, 10 aa, Influenza virus
DRLQDTTWDV

SEQ ID NO: 352689 - protein, 10 aa, Influenza virus
RLQDTTWDVF

SEQ ID NO: 352690 - protein, 10 aa, Influenza virus
LQDTTWDVFI

SEQ ID NO: 352691 - protein, 10 aa, Influenza virus
QDTTWDVFIE

SEQ ID NO: 352692 - protein, 10 aa, Influenza virus
DTTWDVFIER

SEQ ID NO: 352693 - protein, 10 aa, Influenza virus
TTWDVFIERP

SEQ ID NO: 352694 - protein, 10 aa, Influenza virus
TWDVFIERPT

SEQ ID NO: 352695 - protein, 10 aa, Influenza virus
WDVFIERPTA

SEQ ID NO: 352696 - protein, 10 aa, Influenza virus
DVFIERPTAV

SEQ ID NO: 352697 - protein, 10 aa, Influenza virus
VFIERPTAVD

SEQ ID NO: 352698 - protein, 10 aa, Influenza virus
FIERPTAVDT

SEQ ID NO: 352699 - protein, 10 aa, Influenza virus
IERPTAVDTC

SEQ ID NO: 352700 - protein, 10 aa, Influenza virus
ERPTAVDTCY

SEQ ID NO: 352701 - protein, 10 aa, Influenza virus
RPTAVDTCYP

SEQ ID NO: 352702 - protein, 10 aa, Influenza virus
PTAVDTCYPF

SEQ ID NO: 352703 - protein, 10 aa, Influenza virus
TAVDTCYPFD

SEQ ID NO: 352704 - protein, 10 aa, Influenza virus
AVDTCYPFDV

SEQ ID NO: 352705 - protein, 10 aa, Influenza virus
VDTCYPFDVP

SEQ ID NO: 352706 - protein, 10 aa, Influenza virus
DTCYPFDVPD

SEQ ID NO: 352707 - protein, 10 aa, Influenza virus
TCYPFDVPDY

SEQ ID NO: 352708 - protein, 10 aa, Influenza virus
CYPFDVPDYQ

SEQ ID NO: 352709 - protein, 10 aa, Influenza virus
YPFDVPDYQS

SEQ ID NO: 352710 - protein, 10 aa, Influenza virus
PFDVPDYQSL

SEQ ID NO: 352711 - protein, 10 aa, Influenza virus
FDVPDYQSLR

SEQ ID NO: 352712 - protein, 10 aa, Influenza virus
DVPDYQSLRS

SEQ ID NO: 352713 - protein, 10 aa, Influenza virus
VPDYQSLRSI

SEQ ID NO: 352714 - protein, 10 aa, Influenza virus
PDYQSLRSIL

SEQ ID NO: 352715 - protein, 10 aa, Influenza virus
DYQSLRSILA

SEQ ID NO: 352716 - protein, 10 aa, Influenza virus
YQSLRSILAS

SEQ ID NO: 352717 - protein, 10 aa, Influenza virus
QSLRSILASS

SEQ ID NO: 352718 - protein, 10 aa, Influenza virus
SLRSILASSG

SEQ ID NO: 352719 - protein, 10 aa, Influenza virus
LRSILASSGS

SEQ ID NO: 352720 - protein, 10 aa, Influenza virus
RSILASSGSL

SEQ ID NO: 352721 - protein, 10 aa, Influenza virus
SILASSGSLE

SEQ ID NO: 352722 - protein, 10 aa, Influenza virus
ILASSGSLEF

SEQ ID NO: 352723 - protein, 10 aa, Influenza virus
LASSGSLEFI

SEQ ID NO: 352724 - protein, 10 aa, Influenza virus
ASSGSLEFIA

SEQ ID NO: 352725 - protein, 10 aa, Influenza virus
SSGSLEFIAE

SEQ ID NO: 352726 - protein, 10 aa, Influenza virus
SGSLEFIAEQ

SEQ ID NO: 352727 - protein, 10 aa, Influenza virus
GSLEFIAEQF

SEQ ID NO: 352728 - protein, 10 aa, Influenza virus
SLEFIAEQFT

SEQ ID NO: 352729 - protein, 10 aa, Influenza virus
LEFIAEQFTW

SEQ ID NO: 352730 - protein, 10 aa, Influenza virus
EFIAEQFTWN

SEQ ID NO: 352731 - protein, 10 aa, Influenza virus
FIAEQFTWNG

SEQ ID NO: 352732 - protein, 10 aa, Influenza virus
IAEQFTWNGV

SEQ ID NO: 352733 - protein, 10 aa, Influenza virus
AEQFTWNGVK

SEQ ID NO: 352734 - protein, 10 aa, Influenza virus
EQFTWNGVKV

SEQ ID NO: 352735 - protein, 10 aa, Influenza virus
QFTWNGVKVD

SEQ ID NO: 352736 - protein, 10 aa, Influenza virus
FTWNGVKVDG

SEQ ID NO: 352737 - protein, 10 aa, Influenza virus
TWNGVKVDGS

SEQ ID NO: 352738 - protein, 10 aa, Influenza virus
WNGVKVDGSS

SEQ ID NO: 352739 - protein, 10 aa, Influenza virus
NGVKVDGSSS

SEQ ID NO: 352740 - protein, 10 aa, Influenza virus
GVKVDGSSSA

SEQ ID NO: 352741 - protein, 10 aa, Influenza virus
VKVDGSSSAC

SEQ ID NO: 352742 - protein, 10 aa, Influenza virus
KVDGSSSACL

SEQ ID NO: 352743 - protein, 10 aa, Influenza virus
VDGSSSACLR

SEQ ID NO: 352744 - protein, 10 aa, Influenza virus
DGSSSACLRG

SEQ ID NO: 352745 - protein, 10 aa, Influenza virus
GSSSACLRGG

SEQ ID NO: 352746 - protein, 10 aa, Influenza virus
SSSACLRGGR

SEQ ID NO: 352747 - protein, 10 aa, Influenza virus
SSACLRGGRN

SEQ ID NO: 352748 - protein, 10 aa, Influenza virus
SACLRGGRNS

SEQ ID NO: 352749 - protein, 10 aa, Influenza virus
ACLRGGRNSF

SEQ ID NO: 352750 - protein, 10 aa, Influenza virus
CLRGGRNSFF

SEQ ID NO: 352751 - protein, 10 aa, Influenza virus
LRGGRNSFFS

SEQ ID NO: 352752 - protein, 10 aa, Influenza virus
RGGRNSFFSR

SEQ ID NO: 352753 - protein, 10 aa, Influenza virus
GGRNSFFSRL

SEQ ID NO: 352754 - protein, 10 aa, Influenza virus
GRNSFFSRLN

SEQ ID NO: 352755 - protein, 10 aa, Influenza virus
RNSFFSRLNW

SEQ ID NO: 352756 - protein, 10 aa, Influenza virus
NSFFSRLNWL

SEQ ID NO: 352757 - protein, 10 aa, Influenza virus
SFFSRLNWLT

SEQ ID NO: 352758 - protein, 10 aa, Influenza virus
FFSRLNWLTK

SEQ ID NO: 352759 - protein, 10 aa, Influenza virus
FSRLNWLTKA

SEQ ID NO: 352760 - protein, 10 aa, Influenza virus
SRLNWLTKAT

SEQ ID NO: 352761 - protein, 10 aa, Influenza virus
RLNWLTKATN

SEQ ID NO: 352762 - protein, 10 aa, Influenza virus
LNWLTKATNG

SEQ ID NO: 352763 - protein, 10 aa, Influenza virus
NWLTKATNGN

SEQ ID NO: 352764 - protein, 10 aa, Influenza virus
WLTKATNGNY

SEQ ID NO: 352765 - protein, 10 aa, Influenza virus
LTKATNGNYG

SEQ ID NO: 352766 - protein, 10 aa, Influenza virus
TKATNGNYGP

SEQ ID NO: 352767 - protein, 10 aa, Influenza virus
KATNGNYGPI

SEQ ID NO: 352768 - protein, 10 aa, Influenza virus
ATNGNYGPIN

SEQ ID NO: 352769 - protein, 10 aa, Influenza virus
TNGNYGPINV

SEQ ID NO: 352770 - protein, 10 aa, Influenza virus
NGNYGPINVT

SEQ ID NO: 352771 - protein, 10 aa, Influenza virus
GNYGPINVTK

SEQ ID NO: 352772 - protein, 10 aa, Influenza virus
NYGPINVTKE

SEQ ID NO: 352773 - protein, 10 aa, Influenza virus
YGPINVTKEN

SEQ ID NO: 352774 - protein, 10 aa, Influenza virus
GPINVTKENT

SEQ ID NO: 352775 - protein, 10 aa, Influenza virus
PINVTKENTG

SEQ ID NO: 352776 - protein, 10 aa, Influenza virus
INVTKENTGS

SEQ ID NO: 352777 - protein, 10 aa, Influenza virus
NVTKENTGSY

SEQ ID NO: 352778 - protein, 10 aa, Influenza virus
VTKENTGSYV

SEQ ID NO: 352779 - protein, 10 aa, Influenza virus
TKENTGSYVR

SEQ ID NO: 352780 - protein, 10 aa, Influenza virus
KENTGSYVRL

SEQ ID NO: 352781 - protein, 10 aa, Influenza virus
ENTGSYVRLY

SEQ ID NO: 352782 - protein, 10 aa, Influenza virus
NTGSYVRLYL

SEQ ID NO: 352783 - protein, 10 aa, Influenza virus
TGSYVRLYLW

SEQ ID NO: 352784 - protein, 10 aa, Influenza virus
GSYVRLYLWG

SEQ ID NO: 352785 - protein, 10 aa, Influenza virus
SYVRLYLWGV

SEQ ID NO: 352786 - protein, 10 aa, Influenza virus
YVRLYLWGVH

SEQ ID NO: 352787 - protein, 10 aa, Influenza virus
VRLYLWGVHH

SEQ ID NO: 352788 - protein, 10 aa, Influenza virus
RLYLWGVHHP

SEQ ID NO: 352789 - protein, 10 aa, Influenza virus
LYLWGVHHPS

SEQ ID NO: 352790 - protein, 10 aa, Influenza virus
YLWGVHHPSS

SEQ ID NO: 352791 - protein, 10 aa, Influenza virus
LWGVHHPSSD

SEQ ID NO: 352792 - protein, 10 aa, Influenza virus
WGVHHPSSDN

SEQ ID NO: 352793 - protein, 10 aa, Influenza virus
GVHHPSSDNE

SEQ ID NO: 352794 - protein, 10 aa, Influenza virus
VHHPSSDNEQ

SEQ ID NO: 352795 - protein, 10 aa, Influenza virus
HHPSSDNEQT

SEQ ID NO: 352796 - protein, 10 aa, Influenza virus
HPSSDNEQTD

SEQ ID NO: 352797 - protein, 10 aa, Influenza virus
PSSDNEQTDL

SEQ ID NO: 352798 - protein, 10 aa, Influenza virus
SSDNEQTDLY

SEQ ID NO: 352799 - protein, 10 aa, Influenza virus
SDNEQTDLYK

SEQ ID NO: 352800 - protein, 10 aa, Influenza virus
DNEQTDLYKV

SEQ ID NO: 352801 - protein, 10 aa, Influenza virus
NEQTDLYKVA

SEQ ID NO: 352802 - protein, 10 aa, Influenza virus
EQTDLYKVAT

SEQ ID NO: 352803 - protein, 10 aa, Influenza virus
QTDLYKVATG

SEQ ID NO: 352804 - protein, 10 aa, Influenza virus
TDLYKVATGR

SEQ ID NO: 352805 - protein, 10 aa, Influenza virus
DLYKVATGRV

SEQ ID NO: 352806 - protein, 10 aa, Influenza virus
LYKVATGRVT

SEQ ID NO: 352807 - protein, 10 aa, Influenza virus
YKVATGRVTV

SEQ ID NO: 352808 - protein, 10 aa, Influenza virus
KVATGRVTVS

SEQ ID NO: 352809 - protein, 10 aa, Influenza virus
VATGRVTVST

SEQ ID NO: 352810 - protein, 10 aa, Influenza virus
ATGRVTVSTR

SEQ ID NO: 352811 - protein, 10 aa, Influenza virus
TGRVTVSTRS

SEQ ID NO: 352812 - protein, 10 aa, Influenza virus
GRVTVSTRSD

SEQ ID NO: 352813 - protein, 10 aa, Influenza virus
RVTVSTRSDQ

SEQ ID NO: 352814 - protein, 10 aa, Influenza virus
VTVSTRSDQI

SEQ ID NO: 352815 - protein, 10 aa, Influenza virus
TVSTRSDQIS

SEQ ID NO: 352816 - protein, 10 aa, Influenza virus
VSTRSDQISI

SEQ ID NO: 352817 - protein, 10 aa, Influenza virus
STRSDQISIV

SEQ ID NO: 352818 - protein, 10 aa, Influenza virus
TRSDQISIVP

SEQ ID NO: 352819 - protein, 10 aa, Influenza virus
RSDQISIVPN

SEQ ID NO: 352820 - protein, 10 aa, Influenza virus
SDQISIVPNI

SEQ ID NO: 352821 - protein, 10 aa, Influenza virus
DQISIVPNIG

SEQ ID NO: 352822 - protein, 10 aa, Influenza virus
QISIVPNIGS

SEQ ID NO: 352823 - protein, 10 aa, Influenza virus
ISIVPNIGSR

SEQ ID NO: 352824 - protein, 10 aa, Influenza virus
SIVPNIGSRP

SEQ ID NO: 352825 - protein, 10 aa, Influenza virus
IVPNIGSRPR

SEQ ID NO: 352826 - protein, 10 aa, Influenza virus
VPNIGSRPRV

SEQ ID NO: 352827 - protein, 10 aa, Influenza virus
PNIGSRPRVR

SEQ ID NO: 352828 - protein, 10 aa, Influenza virus
NIGSRPRVRN

SEQ ID NO: 352829 - protein, 10 aa, Influenza virus
IGSRPRVRNQ

SEQ ID NO: 352830 - protein, 10 aa, Influenza virus
GSRPRVRNQS

SEQ ID NO: 352831 - protein, 10 aa, Influenza virus
SRPRVRNQSG

SEQ ID NO: 352832 - protein, 10 aa, Influenza virus
RPRVRNQSGR

SEQ ID NO: 352833 - protein, 10 aa, Influenza virus
PRVRNQSGRI

SEQ ID NO: 352834 - protein, 10 aa, Influenza virus
RVRNQSGRIS

SEQ ID NO: 352835 - protein, 10 aa, Influenza virus
VRNQSGRISI

SEQ ID NO: 352836 - protein, 10 aa, Influenza virus
RNQSGRISIY

SEQ ID NO: 352837 - protein, 10 aa, Influenza virus
NQSGRISIYW

SEQ ID NO: 352838 - protein, 10 aa, Influenza virus
QSGRISIYWT

SEQ ID NO: 352839 - protein, 10 aa, Influenza virus
SGRISIYWTL

SEQ ID NO: 352840 - protein, 10 aa, Influenza virus
GRISIYWTLV

SEQ ID NO: 352841 - protein, 10 aa, Influenza virus
RISIYWTLVN

SEQ ID NO: 352842 - protein, 10 aa, Influenza virus
ISIYWTLVNP

SEQ ID NO: 352843 - protein, 10 aa, Influenza virus
SIYWTLVNPG

SEQ ID NO: 352844 - protein, 10 aa, Influenza virus
IYWTLVNPGD

SEQ ID NO: 352845 - protein, 10 aa, Influenza virus
YWTLVNPGDS

SEQ ID NO: 352846 - protein, 10 aa, Influenza virus
WTLVNPGDSI

SEQ ID NO: 352847 - protein, 10 aa, Influenza virus
TLVNPGDSII

SEQ ID NO: 352848 - protein, 10 aa, Influenza virus
LVNPGDSIIF

SEQ ID NO: 352849 - protein, 10 aa, Influenza virus
VNPGDSIIFN

SEQ ID NO: 352850 - protein, 10 aa, Influenza virus
NPGDSIIFNS

SEQ ID NO: 352851 - protein, 10 aa, Influenza virus
PGDSIIFNSI

SEQ ID NO: 352852 - protein, 10 aa, Influenza virus
GDSIIFNSIG

SEQ ID NO: 352853 - protein, 10 aa, Influenza virus
DSIIFNSIGN

SEQ ID NO: 352854 - protein, 10 aa, Influenza virus
SIIFNSIGNL

SEQ ID NO: 352855 - protein, 10 aa, Influenza virus
IIFNSIGNLI

SEQ ID NO: 352856 - protein, 10 aa, Influenza virus
IFNSIGNLIA

SEQ ID NO: 352857 - protein, 10 aa, Influenza virus
FNSIGNLIAP

SEQ ID NO: 352858 - protein, 10 aa, Influenza virus
NSIGNLIAPR

SEQ ID NO: 352859 - protein, 10 aa, Influenza virus
SIGNLIAPRG

SEQ ID NO: 352860 - protein, 10 aa, Influenza virus
IGNLIAPRGH

SEQ ID NO: 352861 - protein, 10 aa, Influenza virus
GNLIAPRGHY

SEQ ID NO: 352862 - protein, 10 aa, Influenza virus
NLIAPRGHYK

SEQ ID NO: 352863 - protein, 10 aa, Influenza virus
LIAPRGHYKI

SEQ ID NO: 352864 - protein, 10 aa, Influenza virus
IAPRGHYKIS

SEQ ID NO: 352865 - protein, 10 aa, Influenza virus
APRGHYKISK

SEQ ID NO: 352866 - protein, 10 aa, Influenza virus
PRGHYKISKS

SEQ ID NO: 352867 - protein, 10 aa, Influenza virus
RGHYKISKST

SEQ ID NO: 352868 - protein, 10 aa, Influenza virus
GHYKISKSTK

SEQ ID NO: 352869 - protein, 10 aa, Influenza virus
HYKISKSTKS

SEQ ID NO: 352870 - protein, 10 aa, Influenza virus
YKISKSTKST

SEQ ID NO: 352871 - protein, 10 aa, Influenza virus
KISKSTKSTV

SEQ ID NO: 352872 - protein, 10 aa, Influenza virus
ISKSTKSTVL

SEQ ID NO: 352873 - protein, 10 aa, Influenza virus
SKSTKSTVLK

SEQ ID NO: 352874 - protein, 10 aa, Influenza virus
KSTKSTVLKS

SEQ ID NO: 352875 - protein, 10 aa, Influenza virus
STKSTVLKSD

SEQ ID NO: 352876 - protein, 10 aa, Influenza virus
TKSTVLKSDK

SEQ ID NO: 352877 - protein, 10 aa, Influenza virus
KSTVLKSDKR

SEQ ID NO: 352878 - protein, 10 aa, Influenza virus
STVLKSDKRI

SEQ ID NO: 352879 - protein, 10 aa, Influenza virus
TVLKSDKRIG

SEQ ID NO: 352880 - protein, 10 aa, Influenza virus
VLKSDKRIGS

SEQ ID NO: 352881 - protein, 10 aa, Influenza virus
LKSDKRIGSC

SEQ ID NO: 352882 - protein, 10 aa, Influenza virus
KSDKRIGSCT

SEQ ID NO: 352883 - protein, 10 aa, Influenza virus
SDKRIGSCTS

SEQ ID NO: 352884 - protein, 10 aa, Influenza virus
DKRIGSCTSP

SEQ ID NO: 352885 - protein, 10 aa, Influenza virus
KRIGSCTSPC

SEQ ID NO: 352886 - protein, 10 aa, Influenza virus
RIGSCTSPCL

SEQ ID NO: 352887 - protein, 10 aa, Influenza virus
IGSCTSPCLT

SEQ ID NO: 352888 - protein, 10 aa, Influenza virus
GSCTSPCLTD

SEQ ID NO: 352889 - protein, 10 aa, Influenza virus
SCTSPCLTDK

SEQ ID NO: 352890 - protein, 10 aa, Influenza virus
CTSPCLTDKG

SEQ ID NO: 352891 - protein, 10 aa, Influenza virus
TSPCLTDKGS

SEQ ID NO: 352892 - protein, 10 aa, Influenza virus
SPCLTDKGSI

SEQ ID NO: 352893 - protein, 10 aa, Influenza virus
PCLTDKGSIQ

SEQ ID NO: 352894 - protein, 10 aa, Influenza virus
CLTDKGSIQS

SEQ ID NO: 352895 - protein, 10 aa, Influenza virus
LTDKGSIQSD

SEQ ID NO: 352896 - protein, 10 aa, Influenza virus
TDKGSIQSDK

SEQ ID NO: 352897 - protein, 10 aa, Influenza virus
DKGSIQSDKP

SEQ ID NO: 352898 - protein, 10 aa, Influenza virus
KGSIQSDKPF

SEQ ID NO: 352899 - protein, 10 aa, Influenza virus
GSIQSDKPFQ

SEQ ID NO: 352900 - protein, 10 aa, Influenza virus
SIQSDKPFQN

SEQ ID NO: 352901 - protein, 10 aa, Influenza virus
IQSDKPFQNV

SEQ ID NO: 352902 - protein, 10 aa, Influenza virus
QSDKPFQNVS

SEQ ID NO: 352903 - protein, 10 aa, Influenza virus
SDKPFQNVSR

SEQ ID NO: 352904 - protein, 10 aa, Influenza virus
DKPFQNVSRI

SEQ ID NO: 352905 - protein, 10 aa, Influenza virus
KPFQNVSRIA

SEQ ID NO: 352906 - protein, 10 aa, Influenza virus
PFQNVSRIAI

SEQ ID NO: 352907 - protein, 10 aa, Influenza virus
FQNVSRIAIG

SEQ ID NO: 352908 - protein, 10 aa, Influenza virus
QNVSRIAIGN

SEQ ID NO: 352909 - protein, 10 aa, Influenza virus
NVSRIAIGNC

SEQ ID NO: 352910 - protein, 10 aa, Influenza virus
VSRIAIGNCP

SEQ ID NO: 352911 - protein, 10 aa, Influenza virus
SRIAIGNCPK

SEQ ID NO: 352912 - protein, 10 aa, Influenza virus
RIAIGNCPKY

SEQ ID NO: 352913 - protein, 10 aa, Influenza virus
IAIGNCPKYV

SEQ ID NO: 352914 - protein, 10 aa, Influenza virus
AIGNCPKYVK

SEQ ID NO: 352915 - protein, 10 aa, Influenza virus
IGNCPKYVKQ

SEQ ID NO: 352916 - protein, 10 aa, Influenza virus
GNCPKYVKQG

SEQ ID NO: 352917 - protein, 10 aa, Influenza virus
NCPKYVKQGS

SEQ ID NO: 352918 - protein, 10 aa, Influenza virus
CPKYVKQGSL

SEQ ID NO: 352919 - protein, 10 aa, Influenza virus
PKYVKQGSLM

SEQ ID NO: 352920 - protein, 10 aa, Influenza virus
KYVKQGSLML

SEQ ID NO: 352921 - protein, 10 aa, Influenza virus
YVKQGSLMLA

SEQ ID NO: 352922 - protein, 10 aa, Influenza virus
VKQGSLMLAT

SEQ ID NO: 352923 - protein, 10 aa, Influenza virus
KQGSLMLATG

SEQ ID NO: 352924 - protein, 10 aa, Influenza virus
QGSLMLATGM

SEQ ID NO: 352925 - protein, 10 aa, Influenza virus
GSLMLATGMR

SEQ ID NO: 352926 - protein, 10 aa, Influenza virus
SLMLATGMRN

SEQ ID NO: 352927 - protein, 10 aa, Influenza virus
LMLATGMRNI

SEQ ID NO: 352928 - protein, 10 aa, Influenza virus
MLATGMRNIP

SEQ ID NO: 352929 - protein, 10 aa, Influenza virus
LATGMRNIPG

SEQ ID NO: 352930 - protein, 10 aa, Influenza virus
ATGMRNIPGK

SEQ ID NO: 352931 - protein, 10 aa, Influenza virus
TGMRNIPGKQ

SEQ ID NO: 352932 - protein, 10 aa, Influenza virus
GMRNIPGKQA

SEQ ID NO: 352933 - protein, 10 aa, Influenza virus
MRNIPGKQAK

SEQ ID NO: 352934 - protein, 10 aa, Influenza virus
RNIPGKQAKG

SEQ ID NO: 352935 - protein, 10 aa, Influenza virus
NIPGKQAKGL

SEQ ID NO: 352936 - protein, 10 aa, Influenza virus
IPGKQAKGLF

SEQ ID NO: 352937 - protein, 10 aa, Influenza virus
PGKQAKGLFG

SEQ ID NO: 352938 - protein, 10 aa, Influenza virus
GKQAKGLFGA

SEQ ID NO: 352939 - protein, 10 aa, Influenza virus
KQAKGLFGAI

SEQ ID NO: 352940 - protein, 10 aa, Influenza virus
QAKGLFGAIA

SEQ ID NO: 352941 - protein, 10 aa, Influenza virus
AKGLFGAIAG

SEQ ID NO: 352942 - protein, 10 aa, Influenza virus
KGLFGAIAGF

SEQ ID NO: 352943 - protein, 10 aa, Influenza virus
GLFGAIAGFI

SEQ ID NO: 352944 - protein, 10 aa, Influenza virus
LFGAIAGFIE

SEQ ID NO: 352945 - protein, 10 aa, Influenza virus
FGAIAGFIEN

SEQ ID NO: 352946 - protein, 10 aa, Influenza virus
GAIAGFIENG

SEQ ID NO: 352947 - protein, 10 aa, Influenza virus
AIAGFIENGW

SEQ ID NO: 352948 - protein, 10 aa, Influenza virus
IAGFIENGWQ

SEQ ID NO: 352949 - protein, 10 aa, Influenza virus
AGFIENGWQG

SEQ ID NO: 352950 - protein, 10 aa, Influenza virus
GFIENGWQGL

SEQ ID NO: 352951 - protein, 10 aa, Influenza virus
FIENGWQGLI

SEQ ID NO: 352952 - protein, 10 aa, Influenza virus
IENGWQGLID

SEQ ID NO: 352953 - protein, 10 aa, Influenza virus
ENGWQGLIDG

SEQ ID NO: 352954 - protein, 10 aa, Influenza virus
NGWQGLIDGW

SEQ ID NO: 352955 - protein, 10 aa, Influenza virus
GWQGLIDGWY

SEQ ID NO: 352956 - protein, 10 aa, Influenza virus
WQGLIDGWYG

SEQ ID NO: 352957 - protein, 10 aa, Influenza virus
QGLIDGWYGF

SEQ ID NO: 352958 - protein, 10 aa, Influenza virus
GLIDGWYGFR

SEQ ID NO: 352959 - protein, 10 aa, Influenza virus
LIDGWYGFRH

SEQ ID NO: 352960 - protein, 10 aa, Influenza virus
IDGWYGFRHQ

SEQ ID NO: 352961 - protein, 10 aa, Influenza virus
DGWYGFRHQN

SEQ ID NO: 352962 - protein, 10 aa, Influenza virus
GWYGFRHQNA

SEQ ID NO: 352963 - protein, 10 aa, Influenza virus
WYGFRHQNAE

SEQ ID NO: 352964 - protein, 10 aa, Influenza virus
YGFRHQNAEG

SEQ ID NO: 352965 - protein, 10 aa, Influenza virus
GFRHQNAEGT

SEQ ID NO: 352966 - protein, 10 aa, Influenza virus
FRHQNAEGTG

SEQ ID NO: 352967 - protein, 10 aa, Influenza virus
RHQNAEGTGT

SEQ ID NO: 352968 - protein, 10 aa, Influenza virus
HQNAEGTGTA

SEQ ID NO: 352969 - protein, 10 aa, Influenza virus
QNAEGTGTAA

SEQ ID NO: 352970 - protein, 10 aa, Influenza virus
NAEGTGTAAD

SEQ ID NO: 352971 - protein, 10 aa, Influenza virus
AEGTGTAADL

SEQ ID NO: 352972 - protein, 10 aa, Influenza virus
EGTGTAADLK

SEQ ID NO: 352973 - protein, 10 aa, Influenza virus
GTGTAADLKS

SEQ ID NO: 352974 - protein, 10 aa, Influenza virus
TGTAADLKST

SEQ ID NO: 352975 - protein, 10 aa, Influenza virus
GTAADLKSTQ

SEQ ID NO: 352976 - protein, 10 aa, Influenza virus
TAADLKSTQA

SEQ ID NO: 352977 - protein, 10 aa, Influenza virus
AADLKSTQAA

SEQ ID NO: 352978 - protein, 10 aa, Influenza virus
ADLKSTQAAI

SEQ ID NO: 352979 - protein, 10 aa, Influenza virus
DLKSTQAAID

SEQ ID NO: 352980 - protein, 10 aa, Influenza virus
LKSTQAAIDQ

SEQ ID NO: 352981 - protein, 10 aa, Influenza virus
KSTQAAIDQI

SEQ ID NO: 352982 - protein, 10 aa, Influenza virus
STQAAIDQIN

SEQ ID NO: 352983 - protein, 10 aa, Influenza virus
TQAAIDQING

SEQ ID NO: 352984 - protein, 10 aa, Influenza virus
QAAIDQINGK

SEQ ID NO: 352985 - protein, 10 aa, Influenza virus
AAIDQINGKL

SEQ ID NO: 352986 - protein, 10 aa, Influenza virus
AIDQINGKLN

SEQ ID NO: 352987 - protein, 10 aa, Influenza virus
IDQINGKLNR

SEQ ID NO: 352988 - protein, 10 aa, Influenza virus
DQINGKLNRL

SEQ ID NO: 352989 - protein, 10 aa, Influenza virus
QINGKLNRLI

SEQ ID NO: 352990 - protein, 10 aa, Influenza virus
INGKLNRLIE

SEQ ID NO: 352991 - protein, 10 aa, Influenza virus
NGKLNRLIEK

SEQ ID NO: 352992 - protein, 10 aa, Influenza virus
GKLNRLIEKT

SEQ ID NO: 352993 - protein, 10 aa, Influenza virus
KLNRLIEKTN

SEQ ID NO: 352994 - protein, 10 aa, Influenza virus
LNRLIEKTNE

SEQ ID NO: 352995 - protein, 10 aa, Influenza virus
NRLIEKTNEK

SEQ ID NO: 352996 - protein, 10 aa, Influenza virus
RLIEKTNEKY

SEQ ID NO: 352997 - protein, 10 aa, Influenza virus
LIEKTNEKYH

SEQ ID NO: 352998 - protein, 10 aa, Influenza virus
IEKTNEKYHQ

SEQ ID NO: 352999 - protein, 10 aa, Influenza virus
EKTNEKYHQI

SEQ ID NO: 353000 - protein, 10 aa, Influenza virus
KTNEKYHQIE

SEQ ID NO: 353001 - protein, 10 aa, Influenza virus
TNEKYHQIEK

SEQ ID NO: 353002 - protein, 10 aa, Influenza virus
NEKYHQIEKE

SEQ ID NO: 353003 - protein, 10 aa, Influenza virus
EKYHQIEKEF

SEQ ID NO: 353004 - protein, 10 aa, Influenza virus
KYHQIEKEFE

SEQ ID NO: 353005 - protein, 10 aa, Influenza virus
YHQIEKEFEQ

SEQ ID NO: 353006 - protein, 10 aa, Influenza virus
HQIEKEFEQV

SEQ ID NO: 353007 - protein, 10 aa, Influenza virus
QIEKEFEQVE

SEQ ID NO: 353008 - protein, 10 aa, Influenza virus
IEKEFEQVEG

SEQ ID NO: 353009 - protein, 10 aa, Influenza virus
EKEFEQVEGR

SEQ ID NO: 353010 - protein, 10 aa, Influenza virus
KEFEQVEGRI

SEQ ID NO: 353011 - protein, 10 aa, Influenza virus
EFEQVEGRIQ

SEQ ID NO: 353012 - protein, 10 aa, Influenza virus
FEQVEGRIQD

SEQ ID NO: 353013 - protein, 10 aa, Influenza virus
EQVEGRIQDL

SEQ ID NO: 353014 - protein, 10 aa, Influenza virus
QVEGRIQDLE

SEQ ID NO: 353015 - protein, 10 aa, Influenza virus
VEGRIQDLEK

SEQ ID NO: 353016 - protein, 10 aa, Influenza virus
EGRIQDLEKY

SEQ ID NO: 353017 - protein, 10 aa, Influenza virus
GRIQDLEKYV

SEQ ID NO: 353018 - protein, 10 aa, Influenza virus
RIQDLEKYVE

SEQ ID NO: 353019 - protein, 10 aa, Influenza virus
IQDLEKYVED

SEQ ID NO: 353020 - protein, 10 aa, Influenza virus
QDLEKYVEDT

SEQ ID NO: 353021 - protein, 10 aa, Influenza virus
DLEKYVEDTK

SEQ ID NO: 353022 - protein, 10 aa, Influenza virus
LEKYVEDTKI

SEQ ID NO: 353023 - protein, 10 aa, Influenza virus
EKYVEDTKID

SEQ ID NO: 353024 - protein, 10 aa, Influenza virus
KYVEDTKIDL

SEQ ID NO: 353025 - protein, 10 aa, Influenza virus
YVEDTKIDLW

SEQ ID NO: 353026 - protein, 10 aa, Influenza virus
VEDTKIDLWS

SEQ ID NO: 353027 - protein, 10 aa, Influenza virus
EDTKIDLWSY

SEQ ID NO: 353028 - protein, 10 aa, Influenza virus
DTKIDLWSYN

SEQ ID NO: 353029 - protein, 10 aa, Influenza virus
TKIDLWSYNA

SEQ ID NO: 353030 - protein, 10 aa, Influenza virus
KIDLWSYNAE

SEQ ID NO: 353031 - protein, 10 aa, Influenza virus
IDLWSYNAEL

SEQ ID NO: 353032 - protein, 10 aa, Influenza virus
DLWSYNAELL

SEQ ID NO: 353033 - protein, 10 aa, Influenza virus
LWSYNAELLV

SEQ ID NO: 353034 - protein, 10 aa, Influenza virus
WSYNAELLVA

SEQ ID NO: 353035 - protein, 10 aa, Influenza virus
SYNAELLVAL

SEQ ID NO: 353036 - protein, 10 aa, Influenza virus
YNAELLVALE

SEQ ID NO: 353037 - protein, 10 aa, Influenza virus
NAELLVALEN

SEQ ID NO: 353038 - protein, 10 aa, Influenza virus
AELLVALENQ

SEQ ID NO: 353039 - protein, 10 aa, Influenza virus
ELLVALENQH

SEQ ID NO: 353040 - protein, 10 aa, Influenza virus
LLVALENQHT

SEQ ID NO: 353041 - protein, 10 aa, Influenza virus
LVALENQHTI

SEQ ID NO: 353042 - protein, 10 aa, Influenza virus
VALENQHTID

SEQ ID NO: 353043 - protein, 10 aa, Influenza virus
ALENQHTIDV

SEQ ID NO: 353044 - protein, 10 aa, Influenza virus
LENQHTIDVT

SEQ ID NO: 353045 - protein, 10 aa, Influenza virus
ENQHTIDVTD

SEQ ID NO: 353046 - protein, 10 aa, Influenza virus
NQHTIDVTDS

SEQ ID NO: 353047 - protein, 10 aa, Influenza virus
QHTIDVTDSE

SEQ ID NO: 353048 - protein, 10 aa, Influenza virus
HTIDVTDSEM

SEQ ID NO: 353049 - protein, 10 aa, Influenza virus
TIDVTDSEMN

SEQ ID NO: 353050 - protein, 10 aa, Influenza virus
IDVTDSEMNK

SEQ ID NO: 353051 - protein, 10 aa, Influenza virus
DVTDSEMNKL

SEQ ID NO: 353052 - protein, 10 aa, Influenza virus
VTDSEMNKLF

SEQ ID NO: 353053 - protein, 10 aa, Influenza virus
TDSEMNKLFE

SEQ ID NO: 353054 - protein, 10 aa, Influenza virus
DSEMNKLFER

SEQ ID NO: 353055 - protein, 10 aa, Influenza virus
SEMNKLFERV

SEQ ID NO: 353056 - protein, 10 aa, Influenza virus
EMNKLFERVR

SEQ ID NO: 353057 - protein, 10 aa, Influenza virus
MNKLFERVRR

SEQ ID NO: 353058 - protein, 10 aa, Influenza virus
NKLFERVRRQ

SEQ ID NO: 353059 - protein, 10 aa, Influenza virus
KLFERVRRQL

SEQ ID NO: 353060 - protein, 10 aa, Influenza virus
LFERVRRQLR

SEQ ID NO: 353061 - protein, 10 aa, Influenza virus
FERVRRQLRE

SEQ ID NO: 353062 - protein, 10 aa, Influenza virus
ERVRRQLREN

SEQ ID NO: 353063 - protein, 10 aa, Influenza virus
RVRRQLRENA

SEQ ID NO: 353064 - protein, 10 aa, Influenza virus
VRRQLRENAE

SEQ ID NO: 353065 - protein, 10 aa, Influenza virus
RRQLRENAED

SEQ ID NO: 353066 - protein, 10 aa, Influenza virus
RQLRENAEDQ

SEQ ID NO: 353067 - protein, 10 aa, Influenza virus
QLRENAEDQG

SEQ ID NO: 353068 - protein, 10 aa, Influenza virus
LRENAEDQGN

SEQ ID NO: 353069 - protein, 10 aa, Influenza virus
RENAEDQGNG

SEQ ID NO: 353070 - protein, 10 aa, Influenza virus
ENAEDQGNGC

SEQ ID NO: 353071 - protein, 10 aa, Influenza virus
NAEDQGNGCF

SEQ ID NO: 353072 - protein, 10 aa, Influenza virus
AEDQGNGCFE

SEQ ID NO: 353073 - protein, 10 aa, Influenza virus
EDQGNGCFEI

SEQ ID NO: 353074 - protein, 10 aa, Influenza virus
DQGNGCFEIF

SEQ ID NO: 353075 - protein, 10 aa, Influenza virus
QGNGCFEIFH

SEQ ID NO: 353076 - protein, 10 aa, Influenza virus
GNGCFEIFHQ

SEQ ID NO: 353077 - protein, 10 aa, Influenza virus
NGCFEIFHQC

SEQ ID NO: 353078 - protein, 10 aa, Influenza virus
GCFEIFHQCD

SEQ ID NO: 353079 - protein, 10 aa, Influenza virus
CFEIFHQCDN

SEQ ID NO: 353080 - protein, 10 aa, Influenza virus
FEIFHQCDNN

SEQ ID NO: 353081 - protein, 10 aa, Influenza virus
EIFHQCDNNC

SEQ ID NO: 353082 - protein, 10 aa, Influenza virus
IFHQCDNNCI

SEQ ID NO: 353083 - protein, 10 aa, Influenza virus
FHQCDNNCIE

SEQ ID NO: 353084 - protein, 10 aa, Influenza virus
HQCDNNCIES

SEQ ID NO: 353085 - protein, 10 aa, Influenza virus
QCDNNCIESI

SEQ ID NO: 353086 - protein, 10 aa, Influenza virus
CDNNCIESIR

SEQ ID NO: 353087 - protein, 10 aa, Influenza virus
DNNCIESIRN

SEQ ID NO: 353088 - protein, 10 aa, Influenza virus
NNCIESIRNG

SEQ ID NO: 353089 - protein, 10 aa, Influenza virus
NCIESIRNGT

SEQ ID NO: 353090 - protein, 10 aa, Influenza virus
CIESIRNGTY

SEQ ID NO: 353091 - protein, 10 aa, Influenza virus
IESIRNGTYD

SEQ ID NO: 353092 - protein, 10 aa, Influenza virus
ESIRNGTYDH

SEQ ID NO: 353093 - protein, 10 aa, Influenza virus
SIRNGTYDHN

SEQ ID NO: 353094 - protein, 10 aa, Influenza virus
IRNGTYDHNI

SEQ ID NO: 353095 - protein, 10 aa, Influenza virus
RNGTYDHNIY

SEQ ID NO: 353096 - protein, 10 aa, Influenza virus
NGTYDHNIYR

SEQ ID NO: 353097 - protein, 10 aa, Influenza virus
GTYDHNIYRD

SEQ ID NO: 353098 - protein, 10 aa, Influenza virus
TYDHNIYRDE

SEQ ID NO: 353099 - protein, 10 aa, Influenza virus
YDHNIYRDEA

SEQ ID NO: 353100 - protein, 10 aa, Influenza virus
DHNIYRDEAI

SEQ ID NO: 353101 - protein, 10 aa, Influenza virus
HNIYRDEAIN

SEQ ID NO: 353102 - protein, 10 aa, Influenza virus
NIYRDEAINN

SEQ ID NO: 353103 - protein, 10 aa, Influenza virus
IYRDEAINNR

SEQ ID NO: 353104 - protein, 10 aa, Influenza virus
YRDEAINNRI

SEQ ID NO: 353105 - protein, 10 aa, Influenza virus
RDEAINNRIK

SEQ ID NO: 353106 - protein, 10 aa, Influenza virus
DEAINNRIKI

SEQ ID NO: 353107 - protein, 10 aa, Influenza virus
EAINNRIKIN

SEQ ID NO: 353108 - protein, 10 aa, Influenza virus
AINNRIKINP

SEQ ID NO: 353109 - protein, 10 aa, Influenza virus
INNRIKINPV

SEQ ID NO: 353110 - protein, 10 aa, Influenza virus
NNRIKINPVT

SEQ ID NO: 353111 - protein, 10 aa, Influenza virus
NRIKINPVTL

SEQ ID NO: 353112 - protein, 10 aa, Influenza virus
RIKINPVTLT

SEQ ID NO: 353113 - protein, 10 aa, Influenza virus
IKINPVTLTM

SEQ ID NO: 353114 - protein, 10 aa, Influenza virus
KINPVTLTMG

SEQ ID NO: 353115 - protein, 10 aa, Influenza virus
INPVTLTMGY

SEQ ID NO: 353116 - protein, 10 aa, Influenza virus
NPVTLTMGYK

SEQ ID NO: 353117 - protein, 10 aa, Influenza virus
PVTLTMGYKD

SEQ ID NO: 353118 - protein, 10 aa, Influenza virus
VTLTMGYKDI

SEQ ID NO: 353119 - protein, 10 aa, Influenza virus
TLTMGYKDII

SEQ ID NO: 353120 - protein, 10 aa, Influenza virus
LTMGYKDIIL

SEQ ID NO: 353121 - protein, 10 aa, Influenza virus
TMGYKDIILW

SEQ ID NO: 353122 - protein, 10 aa, Influenza virus
MGYKDIILWI

SEQ ID NO: 353123 - protein, 10 aa, Influenza virus
GYKDIILWIS

SEQ ID NO: 353124 - protein, 10 aa, Influenza virus
YKDIILWISF

SEQ ID NO: 353125 - protein, 10 aa, Influenza virus
KDIILWISFS

SEQ ID NO: 353126 - protein, 10 aa, Influenza virus
DIILWISFSM

SEQ ID NO: 353127 - protein, 10 aa, Influenza virus
IILWISFSMS

SEQ ID NO: 353128 - protein, 10 aa, Influenza virus
ILWISFSMSC

SEQ ID NO: 353129 - protein, 10 aa, Influenza virus
LWISFSMSCF

SEQ ID NO: 353130 - protein, 10 aa, Influenza virus
WISFSMSCFV

SEQ ID NO: 353131 - protein, 10 aa, Influenza virus
ISFSMSCFVF

SEQ ID NO: 353132 - protein, 10 aa, Influenza virus
SFSMSCFVFV

SEQ ID NO: 353133 - protein, 10 aa, Influenza virus
FSMSCFVFVA

SEQ ID NO: 353134 - protein, 10 aa, Influenza virus
SMSCFVFVAL

SEQ ID NO: 353135 - protein, 10 aa, Influenza virus
MSCFVFVALI

SEQ ID NO: 353136 - protein, 10 aa, Influenza virus
SCFVFVALIL

SEQ ID NO: 353137 - protein, 10 aa, Influenza virus
CFVFVALILG

SEQ ID NO: 353138 - protein, 10 aa, Influenza virus
FVFVALILGF

SEQ ID NO: 353139 - protein, 10 aa, Influenza virus
VFVALILGFV

SEQ ID NO: 353140 - protein, 10 aa, Influenza virus
FVALILGFVL

SEQ ID NO: 353141 - protein, 10 aa, Influenza virus
VALILGFVLW

SEQ ID NO: 353142 - protein, 10 aa, Influenza virus
ALILGFVLWA

SEQ ID NO: 353143 - protein, 10 aa, Influenza virus
LILGFVLWAC

SEQ ID NO: 353144 - protein, 10 aa, Influenza virus
ILGFVLWACQ

SEQ ID NO: 353145 - protein, 10 aa, Influenza virus
LGFVLWACQN

SEQ ID NO: 353146 - protein, 10 aa, Influenza virus
GFVLWACQNG

SEQ ID NO: 353147 - protein, 10 aa, Influenza virus
FVLWACQNGN

SEQ ID NO: 353148 - protein, 10 aa, Influenza virus
VLWACQNGNI

SEQ ID NO: 353149 - protein, 10 aa, Influenza virus
LWACQNGNIR

SEQ ID NO: 353150 - protein, 10 aa, Influenza virus
WACQNGNIRC

SEQ ID NO: 353151 - protein, 10 aa, Influenza virus
ACQNGNIRCQ

SEQ ID NO: 353152 - protein, 10 aa, Influenza virus
CQNGNIRCQI

SEQ ID NO: 353153 - protein, 10 aa, Influenza virus
QNGNIRCQIC

SEQ ID NO: 353154 - protein, 10 aa, Influenza virus
NGNIRCQICI

SEQ ID NO: 353155 - protein, 10 aa, Influenza virus
MNTQIIVILV

SEQ ID NO: 353156 - protein, 10 aa, Influenza virus
NTQIIVILVL

SEQ ID NO: 353157 - protein, 10 aa, Influenza virus
TQIIVILVLG

SEQ ID NO: 353158 - protein, 10 aa, Influenza virus
QIIVILVLGL

SEQ ID NO: 353159 - protein, 10 aa, Influenza virus
IIVILVLGLS

SEQ ID NO: 353160 - protein, 10 aa, Influenza virus
IVILVLGLSM

SEQ ID NO: 353161 - protein, 10 aa, Influenza virus
VILVLGLSMV

SEQ ID NO: 353162 - protein, 10 aa, Influenza virus
ILVLGLSMVK

SEQ ID NO: 353163 - protein, 10 aa, Influenza virus
LVLGLSMVKS

SEQ ID NO: 353164 - protein, 10 aa, Influenza virus
VLGLSMVKSD

SEQ ID NO: 353165 - protein, 10 aa, Influenza virus
LGLSMVKSDK

SEQ ID NO: 353166 - protein, 10 aa, Influenza virus
GLSMVKSDKI

SEQ ID NO: 353167 - protein, 10 aa, Influenza virus
LSMVKSDKIC

SEQ ID NO: 353168 - protein, 10 aa, Influenza virus
SMVKSDKICL

SEQ ID NO: 353169 - protein, 10 aa, Influenza virus
MVKSDKICLG

SEQ ID NO: 353170 - protein, 10 aa, Influenza virus
VKSDKICLGH

SEQ ID NO: 353171 - protein, 10 aa, Influenza virus
KSDKICLGHH

SEQ ID NO: 353172 - protein, 10 aa, Influenza virus
SDKICLGHHA

SEQ ID NO: 353173 - protein, 10 aa, Influenza virus
DKICLGHHAV

SEQ ID NO: 353174 - protein, 10 aa, Influenza virus
KICLGHHAVA

SEQ ID NO: 353175 - protein, 10 aa, Influenza virus
ICLGHHAVAN

SEQ ID NO: 353176 - protein, 10 aa, Influenza virus
CLGHHAVANG

SEQ ID NO: 353177 - protein, 10 aa, Influenza virus
LGHHAVANGT

SEQ ID NO: 353178 - protein, 10 aa, Influenza virus
GHHAVANGTK

SEQ ID NO: 353179 - protein, 10 aa, Influenza virus
HHAVANGTKV

SEQ ID NO: 353180 - protein, 10 aa, Influenza virus
HAVANGTKVN

SEQ ID NO: 353181 - protein, 10 aa, Influenza virus
AVANGTKVNT

SEQ ID NO: 353182 - protein, 10 aa, Influenza virus
VANGTKVNTL

SEQ ID NO: 353183 - protein, 10 aa, Influenza virus
ANGTKVNTLT

SEQ ID NO: 353184 - protein, 10 aa, Influenza virus
NGTKVNTLTE

SEQ ID NO: 353185 - protein, 10 aa, Influenza virus
GTKVNTLTER

SEQ ID NO: 353186 - protein, 10 aa, Influenza virus
TKVNTLTERG

SEQ ID NO: 353187 - protein, 10 aa, Influenza virus
KVNTLTERGV

SEQ ID NO: 353188 - protein, 10 aa, Influenza virus
VNTLTERGVE

SEQ ID NO: 353189 - protein, 10 aa, Influenza virus
NTLTERGVEV

SEQ ID NO: 353190 - protein, 10 aa, Influenza virus
TLTERGVEVV

SEQ ID NO: 353191 - protein, 10 aa, Influenza virus
LTERGVEVVN

SEQ ID NO: 353192 - protein, 10 aa, Influenza virus
TERGVEVVNA

SEQ ID NO: 353193 - protein, 10 aa, Influenza virus
ERGVEVVNAT

SEQ ID NO: 353194 - protein, 10 aa, Influenza virus
RGVEVVNATE

SEQ ID NO: 353195 - protein, 10 aa, Influenza virus
GVEVVNATET

SEQ ID NO: 353196 - protein, 10 aa, Influenza virus
VEVVNATETV

SEQ ID NO: 353197 - protein, 10 aa, Influenza virus
EVVNATETVE

SEQ ID NO: 353198 - protein, 10 aa, Influenza virus
VVNATETVEI

SEQ ID NO: 353199 - protein, 10 aa, Influenza virus
VNATETVEIT

SEQ ID NO: 353200 - protein, 10 aa, Influenza virus
NATETVEITG

SEQ ID NO: 353201 - protein, 10 aa, Influenza virus
ATETVEITGI

SEQ ID NO: 353202 - protein, 10 aa, Influenza virus
TETVEITGID

SEQ ID NO: 353203 - protein, 10 aa, Influenza virus
ETVEITGIDK

SEQ ID NO: 353204 - protein, 10 aa, Influenza virus
TVEITGIDKV

SEQ ID NO: 353205 - protein, 10 aa, Influenza virus
VEITGIDKVC

SEQ ID NO: 353206 - protein, 10 aa, Influenza virus
EITGIDKVCT

SEQ ID NO: 353207 - protein, 10 aa, Influenza virus
ITGIDKVCTK

SEQ ID NO: 353208 - protein, 10 aa, Influenza virus
TGIDKVCTKG

SEQ ID NO: 353209 - protein, 10 aa, Influenza virus
GIDKVCTKGK

SEQ ID NO: 353210 - protein, 10 aa, Influenza virus
IDKVCTKGKK

SEQ ID NO: 353211 - protein, 10 aa, Influenza virus
DKVCTKGKKA

SEQ ID NO: 353212 - protein, 10 aa, Influenza virus
KVCTKGKKAV

SEQ ID NO: 353213 - protein, 10 aa, Influenza virus
VCTKGKKAVD

SEQ ID NO: 353214 - protein, 10 aa, Influenza virus
CTKGKKAVDL

SEQ ID NO: 353215 - protein, 10 aa, Influenza virus
TKGKKAVDLG

SEQ ID NO: 353216 - protein, 10 aa, Influenza virus
KGKKAVDLGS

SEQ ID NO: 353217 - protein, 10 aa, Influenza virus
GKKAVDLGSC

SEQ ID NO: 353218 - protein, 10 aa, Influenza virus
KKAVDLGSCG

SEQ ID NO: 353219 - protein, 10 aa, Influenza virus
KAVDLGSCGI

SEQ ID NO: 353220 - protein, 10 aa, Influenza virus
AVDLGSCGIL

SEQ ID NO: 353221 - protein, 10 aa, Influenza virus
VDLGSCGILG

SEQ ID NO: 353222 - protein, 10 aa, Influenza virus
DLGSCGILGT

SEQ ID NO: 353223 - protein, 10 aa, Influenza virus
LGSCGILGTI

SEQ ID NO: 353224 - protein, 10 aa, Influenza virus
GSCGILGTII

SEQ ID NO: 353225 - protein, 10 aa, Influenza virus
SCGILGTIIG

SEQ ID NO: 353226 - protein, 10 aa, Influenza virus
CGILGTIIGP

SEQ ID NO: 353227 - protein, 10 aa, Influenza virus
GILGTIIGPP

SEQ ID NO: 353228 - protein, 10 aa, Influenza virus
ILGTIIGPPQ

SEQ ID NO: 353229 - protein, 10 aa, Influenza virus
LGTIIGPPQC

SEQ ID NO: 353230 - protein, 10 aa, Influenza virus
GTIIGPPQCD

SEQ ID NO: 353231 - protein, 10 aa, Influenza virus
TIIGPPQCDL

SEQ ID NO: 353232 - protein, 10 aa, Influenza virus
IIGPPQCDLH

SEQ ID NO: 353233 - protein, 10 aa, Influenza virus
IGPPQCDLHL

SEQ ID NO: 353234 - protein, 10 aa, Influenza virus
GPPQCDLHLE

SEQ ID NO: 353235 - protein, 10 aa, Influenza virus
PPQCDLHLEF

SEQ ID NO: 353236 - protein, 10 aa, Influenza virus
PQCDLHLEFK

SEQ ID NO: 353237 - protein, 10 aa, Influenza virus
QCDLHLEFKA

SEQ ID NO: 353238 - protein, 10 aa, Influenza virus
CDLHLEFKAD

SEQ ID NO: 353239 - protein, 10 aa, Influenza virus
DLHLEFKADL

SEQ ID NO: 353240 - protein, 10 aa, Influenza virus
LHLEFKADLI

SEQ ID NO: 353241 - protein, 10 aa, Influenza virus
HLEFKADLII

SEQ ID NO: 353242 - protein, 10 aa, Influenza virus
LEFKADLIIE

SEQ ID NO: 353243 - protein, 10 aa, Influenza virus
EFKADLIIER

SEQ ID NO: 353244 - protein, 10 aa, Influenza virus
FKADLIIERR

SEQ ID NO: 353245 - protein, 10 aa, Influenza virus
KADLIIERRN

SEQ ID NO: 353246 - protein, 10 aa, Influenza virus
ADLIIERRNS

SEQ ID NO: 353247 - protein, 10 aa, Influenza virus
DLIIERRNSS

SEQ ID NO: 353248 - protein, 10 aa, Influenza virus
LIIERRNSSD

SEQ ID NO: 353249 - protein, 10 aa, Influenza virus
IIERRNSSDI

SEQ ID NO: 353250 - protein, 10 aa, Influenza virus
IERRNSSDIC

SEQ ID NO: 353251 - protein, 10 aa, Influenza virus
ERRNSSDICY

SEQ ID NO: 353252 - protein, 10 aa, Influenza virus
RRNSSDICYP

SEQ ID NO: 353253 - protein, 10 aa, Influenza virus
RNSSDICYPG

SEQ ID NO: 353254 - protein, 10 aa, Influenza virus
NSSDICYPGR

SEQ ID NO: 353255 - protein, 10 aa, Influenza virus
SSDICYPGRF

SEQ ID NO: 353256 - protein, 10 aa, Influenza virus
SDICYPGRFT

SEQ ID NO: 353257 - protein, 10 aa, Influenza virus
DICYPGRFTN

SEQ ID NO: 353258 - protein, 10 aa, Influenza virus
ICYPGRFTNE

SEQ ID NO: 353259 - protein, 10 aa, Influenza virus
CYPGRFTNEE

SEQ ID NO: 353260 - protein, 10 aa, Influenza virus
YPGRFTNEEA

SEQ ID NO: 353261 - protein, 10 aa, Influenza virus
PGRFTNEEAL

SEQ ID NO: 353262 - protein, 10 aa, Influenza virus
GRFTNEEALR

SEQ ID NO: 353263 - protein, 10 aa, Influenza virus
RFTNEEALRQ

SEQ ID NO: 353264 - protein, 10 aa, Influenza virus
FTNEEALRQI

SEQ ID NO: 353265 - protein, 10 aa, Influenza virus
TNEEALRQII

SEQ ID NO: 353266 - protein, 10 aa, Influenza virus
NEEALRQIIR

SEQ ID NO: 353267 - protein, 10 aa, Influenza virus
EEALRQIIRE

SEQ ID NO: 353268 - protein, 10 aa, Influenza virus
EALRQIIRES

SEQ ID NO: 353269 - protein, 10 aa, Influenza virus
ALRQIIRESG

SEQ ID NO: 353270 - protein, 10 aa, Influenza virus
LRQIIRESGG

SEQ ID NO: 353271 - protein, 10 aa, Influenza virus
RQIIRESGGI

SEQ ID NO: 353272 - protein, 10 aa, Influenza virus
QIIRESGGID

SEQ ID NO: 353273 - protein, 10 aa, Influenza virus
IIRESGGIDK

SEQ ID NO: 353274 - protein, 10 aa, Influenza virus
IRESGGIDKE

SEQ ID NO: 353275 - protein, 10 aa, Influenza virus
RESGGIDKES

SEQ ID NO: 353276 - protein, 10 aa, Influenza virus
ESGGIDKESM

SEQ ID NO: 353277 - protein, 10 aa, Influenza virus
SGGIDKESMG

SEQ ID NO: 353278 - protein, 10 aa, Influenza virus
GGIDKESMGF

SEQ ID NO: 353279 - protein, 10 aa, Influenza virus
GIDKESMGFR

SEQ ID NO: 353280 - protein, 10 aa, Influenza virus
IDKESMGFRY

SEQ ID NO: 353281 - protein, 10 aa, Influenza virus
DKESMGFRYS

SEQ ID NO: 353282 - protein, 10 aa, Influenza virus
KESMGFRYSG

SEQ ID NO: 353283 - protein, 10 aa, Influenza virus
ESMGFRYSGI

SEQ ID NO: 353284 - protein, 10 aa, Influenza virus
SMGFRYSGIR

SEQ ID NO: 353285 - protein, 10 aa, Influenza virus
MGFRYSGIRT

SEQ ID NO: 353286 - protein, 10 aa, Influenza virus
GFRYSGIRTD

SEQ ID NO: 353287 - protein, 10 aa, Influenza virus
FRYSGIRTDG

SEQ ID NO: 353288 - protein, 10 aa, Influenza virus
RYSGIRTDGA

SEQ ID NO: 353289 - protein, 10 aa, Influenza virus
YSGIRTDGAT

SEQ ID NO: 353290 - protein, 10 aa, Influenza virus
SGIRTDGATS

SEQ ID NO: 353291 - protein, 10 aa, Influenza virus
GIRTDGATSA

SEQ ID NO: 353292 - protein, 10 aa, Influenza virus
IRTDGATSAC

SEQ ID NO: 353293 - protein, 10 aa, Influenza virus
RTDGATSACK

SEQ ID NO: 353294 - protein, 10 aa, Influenza virus
TDGATSACKR

SEQ ID NO: 353295 - protein, 10 aa, Influenza virus
DGATSACKRT

SEQ ID NO: 353296 - protein, 10 aa, Influenza virus
GATSACKRTV

SEQ ID NO: 353297 - protein, 10 aa, Influenza virus
ATSACKRTVS

SEQ ID NO: 353298 - protein, 10 aa, Influenza virus
TSACKRTVSS

SEQ ID NO: 353299 - protein, 10 aa, Influenza virus
SACKRTVSSF

SEQ ID NO: 353300 - protein, 10 aa, Influenza virus
ACKRTVSSFY

SEQ ID NO: 353301 - protein, 10 aa, Influenza virus
CKRTVSSFYS

SEQ ID NO: 353302 - protein, 10 aa, Influenza virus
KRTVSSFYSE

SEQ ID NO: 353303 - protein, 10 aa, Influenza virus
RTVSSFYSEM

SEQ ID NO: 353304 - protein, 10 aa, Influenza virus
TVSSFYSEMK

SEQ ID NO: 353305 - protein, 10 aa, Influenza virus
VSSFYSEMKW

SEQ ID NO: 353306 - protein, 10 aa, Influenza virus
SSFYSEMKWL

SEQ ID NO: 353307 - protein, 10 aa, Influenza virus
SFYSEMKWLS

SEQ ID NO: 353308 - protein, 10 aa, Influenza virus
FYSEMKWLSS

SEQ ID NO: 353309 - protein, 10 aa, Influenza virus
YSEMKWLSSS

SEQ ID NO: 353310 - protein, 10 aa, Influenza virus
SEMKWLSSSM

SEQ ID NO: 353311 - protein, 10 aa, Influenza virus
EMKWLSSSMN

SEQ ID NO: 353312 - protein, 10 aa, Influenza virus
MKWLSSSMNN

SEQ ID NO: 353313 - protein, 10 aa, Influenza virus
KWLSSSMNNQ

SEQ ID NO: 353314 - protein, 10 aa, Influenza virus
WLSSSMNNQV

SEQ ID NO: 353315 - protein, 10 aa, Influenza virus
LSSSMNNQVF

SEQ ID NO: 353316 - protein, 10 aa, Influenza virus
SSSMNNQVFP

SEQ ID NO: 353317 - protein, 10 aa, Influenza virus
SSMNNQVFPQ

SEQ ID NO: 353318 - protein, 10 aa, Influenza virus
SMNNQVFPQL

SEQ ID NO: 353319 - protein, 10 aa, Influenza virus
MNNQVFPQLN

SEQ ID NO: 353320 - protein, 10 aa, Influenza virus
NNQVFPQLNQ

SEQ ID NO: 353321 - protein, 10 aa, Influenza virus
NQVFPQLNQT

SEQ ID NO: 353322 - protein, 10 aa, Influenza virus
QVFPQLNQTY

SEQ ID NO: 353323 - protein, 10 aa, Influenza virus
VFPQLNQTYR

SEQ ID NO: 353324 - protein, 10 aa, Influenza virus
FPQLNQTYRN

SEQ ID NO: 353325 - protein, 10 aa, Influenza virus
PQLNQTYRNT

SEQ ID NO: 353326 - protein, 10 aa, Influenza virus
QLNQTYRNTR

SEQ ID NO: 353327 - protein, 10 aa, Influenza virus
LNQTYRNTRK

SEQ ID NO: 353328 - protein, 10 aa, Influenza virus
NQTYRNTRKE

SEQ ID NO: 353329 - protein, 10 aa, Influenza virus
QTYRNTRKEP

SEQ ID NO: 353330 - protein, 10 aa, Influenza virus
TYRNTRKEPA

SEQ ID NO: 353331 - protein, 10 aa, Influenza virus
YRNTRKEPAL

SEQ ID NO: 353332 - protein, 10 aa, Influenza virus
RNTRKEPALI

SEQ ID NO: 353333 - protein, 10 aa, Influenza virus
NTRKEPALIV

SEQ ID NO: 353334 - protein, 10 aa, Influenza virus
TRKEPALIVW

SEQ ID NO: 353335 - protein, 10 aa, Influenza virus
RKEPALIVWG

SEQ ID NO: 353336 - protein, 10 aa, Influenza virus
KEPALIVWGV

SEQ ID NO: 353337 - protein, 10 aa, Influenza virus
EPALIVWGVH

SEQ ID NO: 353338 - protein, 10 aa, Influenza virus
PALIVWGVHH

SEQ ID NO: 353339 - protein, 10 aa, Influenza virus
ALIVWGVHHS

SEQ ID NO: 353340 - protein, 10 aa, Influenza virus
LIVWGVHHSS

SEQ ID NO: 353341 - protein, 10 aa, Influenza virus
IVWGVHHSSS

SEQ ID NO: 353342 - protein, 10 aa, Influenza virus
VWGVHHSSSL

SEQ ID NO: 353343 - protein, 10 aa, Influenza virus
WGVHHSSSLD

SEQ ID NO: 353344 - protein, 10 aa, Influenza virus
GVHHSSSLDE

SEQ ID NO: 353345 - protein, 10 aa, Influenza virus
VHHSSSLDEQ

SEQ ID NO: 353346 - protein, 10 aa, Influenza virus
HHSSSLDEQN

SEQ ID NO: 353347 - protein, 10 aa, Influenza virus
HSSSLDEQNK

SEQ ID NO: 353348 - protein, 10 aa, Influenza virus
SSSLDEQNKL

SEQ ID NO: 353349 - protein, 10 aa, Influenza virus
SSLDEQNKLY

SEQ ID NO: 353350 - protein, 10 aa, Influenza virus
SLDEQNKLYG

SEQ ID NO: 353351 - protein, 10 aa, Influenza virus
LDEQNKLYGT

SEQ ID NO: 353352 - protein, 10 aa, Influenza virus
DEQNKLYGTG

SEQ ID NO: 353353 - protein, 10 aa, Influenza virus
EQNKLYGTGN

SEQ ID NO: 353354 - protein, 10 aa, Influenza virus
QNKLYGTGNK

SEQ ID NO: 353355 - protein, 10 aa, Influenza virus
NKLYGTGNKL

SEQ ID NO: 353356 - protein, 10 aa, Influenza virus
KLYGTGNKLI

SEQ ID NO: 353357 - protein, 10 aa, Influenza virus
LYGTGNKLIT

SEQ ID NO: 353358 - protein, 10 aa, Influenza virus
YGTGNKLITV

SEQ ID NO: 353359 - protein, 10 aa, Influenza virus
GTGNKLITVG

SEQ ID NO: 353360 - protein, 10 aa, Influenza virus
TGNKLITVGS

SEQ ID NO: 353361 - protein, 10 aa, Influenza virus
GNKLITVGSS

SEQ ID NO: 353362 - protein, 10 aa, Influenza virus
NKLITVGSSK

SEQ ID NO: 353363 - protein, 10 aa, Influenza virus
KLITVGSSKY

SEQ ID NO: 353364 - protein, 10 aa, Influenza virus
LITVGSSKYQ

SEQ ID NO: 353365 - protein, 10 aa, Influenza virus
ITVGSSKYQQ

SEQ ID NO: 353366 - protein, 10 aa, Influenza virus
TVGSSKYQQS

SEQ ID NO: 353367 - protein, 10 aa, Influenza virus
VGSSKYQQSF

SEQ ID NO: 353368 - protein, 10 aa, Influenza virus
GSSKYQQSFS

SEQ ID NO: 353369 - protein, 10 aa, Influenza virus
SSKYQQSFSP

SEQ ID NO: 353370 - protein, 10 aa, Influenza virus
SKYQQSFSPS

SEQ ID NO: 353371 - protein, 10 aa, Influenza virus
KYQQSFSPSP

SEQ ID NO: 353372 - protein, 10 aa, Influenza virus
YQQSFSPSPG

SEQ ID NO: 353373 - protein, 10 aa, Influenza virus
QQSFSPSPGA

SEQ ID NO: 353374 - protein, 10 aa, Influenza virus
QSFSPSPGAR

SEQ ID NO: 353375 - protein, 10 aa, Influenza virus
SFSPSPGARP

SEQ ID NO: 353376 - protein, 10 aa, Influenza virus
FSPSPGARPK

SEQ ID NO: 353377 - protein, 10 aa, Influenza virus
SPSPGARPKV

SEQ ID NO: 353378 - protein, 10 aa, Influenza virus
PSPGARPKVN

SEQ ID NO: 353379 - protein, 10 aa, Influenza virus
SPGARPKVNG

SEQ ID NO: 353380 - protein, 10 aa, Influenza virus
PGARPKVNGQ

SEQ ID NO: 353381 - protein, 10 aa, Influenza virus
GARPKVNGQA

SEQ ID NO: 353382 - protein, 10 aa, Influenza virus
ARPKVNGQAG

SEQ ID NO: 353383 - protein, 10 aa, Influenza virus
RPKVNGQAGR

SEQ ID NO: 353384 - protein, 10 aa, Influenza virus
PKVNGQAGRI

SEQ ID NO: 353385 - protein, 10 aa, Influenza virus
KVNGQAGRID

SEQ ID NO: 353386 - protein, 10 aa, Influenza virus
VNGQAGRIDF

SEQ ID NO: 353387 - protein, 10 aa, Influenza virus
NGQAGRIDFH

SEQ ID NO: 353388 - protein, 10 aa, Influenza virus
GQAGRIDFHW

SEQ ID NO: 353389 - protein, 10 aa, Influenza virus
QAGRIDFHWM

SEQ ID NO: 353390 - protein, 10 aa, Influenza virus
AGRIDFHWML

SEQ ID NO: 353391 - protein, 10 aa, Influenza virus
GRIDFHWMLL

SEQ ID NO: 353392 - protein, 10 aa, Influenza virus
RIDFHWMLLD

SEQ ID NO: 353393 - protein, 10 aa, Influenza virus
IDFHWMLLDP

SEQ ID NO: 353394 - protein, 10 aa, Influenza virus
DFHWMLLDPG

SEQ ID NO: 353395 - protein, 10 aa, Influenza virus
FHWMLLDPGD

SEQ ID NO: 353396 - protein, 10 aa, Influenza virus
HWMLLDPGDT

SEQ ID NO: 353397 - protein, 10 aa, Influenza virus
WMLLDPGDTV

SEQ ID NO: 353398 - protein, 10 aa, Influenza virus
MLLDPGDTVT

SEQ ID NO: 353399 - protein, 10 aa, Influenza virus
LLDPGDTVTF

SEQ ID NO: 353400 - protein, 10 aa, Influenza virus
LDPGDTVTFT

SEQ ID NO: 353401 - protein, 10 aa, Influenza virus
DPGDTVTFTF

SEQ ID NO: 353402 - protein, 10 aa, Influenza virus
PGDTVTFTFN

SEQ ID NO: 353403 - protein, 10 aa, Influenza virus
GDTVTFTFNG

SEQ ID NO: 353404 - protein, 10 aa, Influenza virus
DTVTFTFNGA

SEQ ID NO: 353405 - protein, 10 aa, Influenza virus
TVTFTFNGAF

SEQ ID NO: 353406 - protein, 10 aa, Influenza virus
VTFTFNGAFI

SEQ ID NO: 353407 - protein, 10 aa, Influenza virus
TFTFNGAFIA

SEQ ID NO: 353408 - protein, 10 aa, Influenza virus
FTFNGAFIAP

SEQ ID NO: 353409 - protein, 10 aa, Influenza virus
TFNGAFIAPD

SEQ ID NO: 353410 - protein, 10 aa, Influenza virus
FNGAFIAPDR

SEQ ID NO: 353411 - protein, 10 aa, Influenza virus
NGAFIAPDRA

SEQ ID NO: 353412 - protein, 10 aa, Influenza virus
GAFIAPDRAT

SEQ ID NO: 353413 - protein, 10 aa, Influenza virus
AFIAPDRATF

SEQ ID NO: 353414 - protein, 10 aa, Influenza virus
FIAPDRATFL

SEQ ID NO: 353415 - protein, 10 aa, Influenza virus
IAPDRATFLR

SEQ ID NO: 353416 - protein, 10 aa, Influenza virus
APDRATFLRS

SEQ ID NO: 353417 - protein, 10 aa, Influenza virus
PDRATFLRSN

SEQ ID NO: 353418 - protein, 10 aa, Influenza virus
DRATFLRSNA

SEQ ID NO: 353419 - protein, 10 aa, Influenza virus
RATFLRSNAP

SEQ ID NO: 353420 - protein, 10 aa, Influenza virus
ATFLRSNAPS

SEQ ID NO: 353421 - protein, 10 aa, Influenza virus
TFLRSNAPSG

SEQ ID NO: 353422 - protein, 10 aa, Influenza virus
FLRSNAPSGI

SEQ ID NO: 353423 - protein, 10 aa, Influenza virus
LRSNAPSGIE

SEQ ID NO: 353424 - protein, 10 aa, Influenza virus
RSNAPSGIEY

SEQ ID NO: 353425 - protein, 10 aa, Influenza virus
SNAPSGIEYN

SEQ ID NO: 353426 - protein, 10 aa, Influenza virus
NAPSGIEYNG

SEQ ID NO: 353427 - protein, 10 aa, Influenza virus
APSGIEYNGK

SEQ ID NO: 353428 - protein, 10 aa, Influenza virus
PSGIEYNGKS

SEQ ID NO: 353429 - protein, 10 aa, Influenza virus
SGIEYNGKSL

SEQ ID NO: 353430 - protein, 10 aa, Influenza virus
GIEYNGKSLG

SEQ ID NO: 353431 - protein, 10 aa, Influenza virus
IEYNGKSLGI

SEQ ID NO: 353432 - protein, 10 aa, Influenza virus
EYNGKSLGIQ

SEQ ID NO: 353433 - protein, 10 aa, Influenza virus
YNGKSLGIQS

SEQ ID NO: 353434 - protein, 10 aa, Influenza virus
NGKSLGIQSD

SEQ ID NO: 353435 - protein, 10 aa, Influenza virus
GKSLGIQSDA

SEQ ID NO: 353436 - protein, 10 aa, Influenza virus
KSLGIQSDAQ

SEQ ID NO: 353437 - protein, 10 aa, Influenza virus
SLGIQSDAQI

SEQ ID NO: 353438 - protein, 10 aa, Influenza virus
LGIQSDAQID

SEQ ID NO: 353439 - protein, 10 aa, Influenza virus
GIQSDAQIDE

SEQ ID NO: 353440 - protein, 10 aa, Influenza virus
IQSDAQIDES

SEQ ID NO: 353441 - protein, 10 aa, Influenza virus
QSDAQIDESC

SEQ ID NO: 353442 - protein, 10 aa, Influenza virus
SDAQIDESCE

SEQ ID NO: 353443 - protein, 10 aa, Influenza virus
DAQIDESCEG

SEQ ID NO: 353444 - protein, 10 aa, Influenza virus
AQIDESCEGE

SEQ ID NO: 353445 - protein, 10 aa, Influenza virus
QIDESCEGEC

SEQ ID NO: 353446 - protein, 10 aa, Influenza virus
IDESCEGECF

SEQ ID NO: 353447 - protein, 10 aa, Influenza virus
DESCEGECFY

SEQ ID NO: 353448 - protein, 10 aa, Influenza virus
ESCEGECFYS

SEQ ID NO: 353449 - protein, 10 aa, Influenza virus
SCEGECFYSG

SEQ ID NO: 353450 - protein, 10 aa, Influenza virus
CEGECFYSGG

SEQ ID NO: 353451 - protein, 10 aa, Influenza virus
EGECFYSGGT

SEQ ID NO: 353452 - protein, 10 aa, Influenza virus
GECFYSGGTI

SEQ ID NO: 353453 - protein, 10 aa, Influenza virus
ECFYSGGTIN

SEQ ID NO: 353454 - protein, 10 aa, Influenza virus
CFYSGGTINS

SEQ ID NO: 353455 - protein, 10 aa, Influenza virus
FYSGGTINSP

SEQ ID NO: 353456 - protein, 10 aa, Influenza virus
YSGGTINSPL

SEQ ID NO: 353457 - protein, 10 aa, Influenza virus
SGGTINSPLP

SEQ ID NO: 353458 - protein, 10 aa, Influenza virus
GGTINSPLPF

SEQ ID NO: 353459 - protein, 10 aa, Influenza virus
GTINSPLPFQ

SEQ ID NO: 353460 - protein, 10 aa, Influenza virus
TINSPLPFQN

SEQ ID NO: 353461 - protein, 10 aa, Influenza virus
INSPLPFQNI

SEQ ID NO: 353462 - protein, 10 aa, Influenza virus
NSPLPFQNID

SEQ ID NO: 353463 - protein, 10 aa, Influenza virus
SPLPFQNIDS

SEQ ID NO: 353464 - protein, 10 aa, Influenza virus
PLPFQNIDSR

SEQ ID NO: 353465 - protein, 10 aa, Influenza virus
LPFQNIDSRA

SEQ ID NO: 353466 - protein, 10 aa, Influenza virus
PFQNIDSRAV

SEQ ID NO: 353467 - protein, 10 aa, Influenza virus
FQNIDSRAVG

SEQ ID NO: 353468 - protein, 10 aa, Influenza virus
QNIDSRAVGK

SEQ ID NO: 353469 - protein, 10 aa, Influenza virus
NIDSRAVGKC

SEQ ID NO: 353470 - protein, 10 aa, Influenza virus
IDSRAVGKCP

SEQ ID NO: 353471 - protein, 10 aa, Influenza virus
DSRAVGKCPR

SEQ ID NO: 353472 - protein, 10 aa, Influenza virus
SRAVGKCPRY

SEQ ID NO: 353473 - protein, 10 aa, Influenza virus
RAVGKCPRYV

SEQ ID NO: 353474 - protein, 10 aa, Influenza virus
AVGKCPRYVK

SEQ ID NO: 353475 - protein, 10 aa, Influenza virus
VGKCPRYVKQ

SEQ ID NO: 353476 - protein, 10 aa, Influenza virus
GKCPRYVKQS

SEQ ID NO: 353477 - protein, 10 aa, Influenza virus
KCPRYVKQSS

SEQ ID NO: 353478 - protein, 10 aa, Influenza virus
CPRYVKQSSL

SEQ ID NO: 353479 - protein, 10 aa, Influenza virus
PRYVKQSSLP

SEQ ID NO: 353480 - protein, 10 aa, Influenza virus
RYVKQSSLPL

SEQ ID NO: 353481 - protein, 10 aa, Influenza virus
YVKQSSLPLA

SEQ ID NO: 353482 - protein, 10 aa, Influenza virus
VKQSSLPLAL

SEQ ID NO: 353483 - protein, 10 aa, Influenza virus
KQSSLPLALG

SEQ ID NO: 353484 - protein, 10 aa, Influenza virus
QSSLPLALGM

SEQ ID NO: 353485 - protein, 10 aa, Influenza virus
SSLPLALGMK

SEQ ID NO: 353486 - protein, 10 aa, Influenza virus
SLPLALGMKN

SEQ ID NO: 353487 - protein, 10 aa, Influenza virus
LPLALGMKNV

SEQ ID NO: 353488 - protein, 10 aa, Influenza virus
PLALGMKNVP

SEQ ID NO: 353489 - protein, 10 aa, Influenza virus
LALGMKNVPE

SEQ ID NO: 353490 - protein, 10 aa, Influenza virus
ALGMKNVPEK

SEQ ID NO: 353491 - protein, 10 aa, Influenza virus
LGMKNVPEKI

SEQ ID NO: 353492 - protein, 10 aa, Influenza virus
GMKNVPEKIR

SEQ ID NO: 353493 - protein, 10 aa, Influenza virus
MKNVPEKIRT

SEQ ID NO: 353494 - protein, 10 aa, Influenza virus
KNVPEKIRTR

SEQ ID NO: 353495 - protein, 10 aa, Influenza virus
NVPEKIRTRG

SEQ ID NO: 353496 - protein, 10 aa, Influenza virus
VPEKIRTRGL

SEQ ID NO: 353497 - protein, 10 aa, Influenza virus
PEKIRTRGLF

SEQ ID NO: 353498 - protein, 10 aa, Influenza virus
EKIRTRGLFG

SEQ ID NO: 353499 - protein, 10 aa, Influenza virus
KIRTRGLFGA

SEQ ID NO: 353500 - protein, 10 aa, Influenza virus
IRTRGLFGAI

SEQ ID NO: 353501 - protein, 10 aa, Influenza virus
RTRGLFGAIA

SEQ ID NO: 353502 - protein, 10 aa, Influenza virus
TRGLFGAIAG

SEQ ID NO: 353503 - protein, 10 aa, Influenza virus
RGLFGAIAGF

SEQ ID NO: 353504 - protein, 10 aa, Influenza virus
GLFGAIAGFI

SEQ ID NO: 353505 - protein, 10 aa, Influenza virus
LFGAIAGFIE

SEQ ID NO: 353506 - protein, 10 aa, Influenza virus
FGAIAGFIEN

SEQ ID NO: 353507 - protein, 10 aa, Influenza virus
GAIAGFIENG

SEQ ID NO: 353508 - protein, 10 aa, Influenza virus
AIAGFIENGW

SEQ ID NO: 353509 - protein, 10 aa, Influenza virus
IAGFIENGWE

SEQ ID NO: 353510 - protein, 10 aa, Influenza virus
AGFIENGWEG

SEQ ID NO: 353511 - protein, 10 aa, Influenza virus
GFIENGWEGL

SEQ ID NO: 353512 - protein, 10 aa, Influenza virus
FIENGWEGLI

SEQ ID NO: 353513 - protein, 10 aa, Influenza virus
IENGWEGLID

SEQ ID NO: 353514 - protein, 10 aa, Influenza virus
ENGWEGLIDG

SEQ ID NO: 353515 - protein, 10 aa, Influenza virus
NGWEGLIDGW

SEQ ID NO: 353516 - protein, 10 aa, Influenza virus
GWEGLIDGWY

SEQ ID NO: 353517 - protein, 10 aa, Influenza virus
WEGLIDGWYG

SEQ ID NO: 353518 - protein, 10 aa, Influenza virus
EGLIDGWYGF

SEQ ID NO: 353519 - protein, 10 aa, Influenza virus
GLIDGWYGFR

SEQ ID NO: 353520 - protein, 10 aa, Influenza virus
LIDGWYGFRH

SEQ ID NO: 353521 - protein, 10 aa, Influenza virus
IDGWYGFRHQ

SEQ ID NO: 353522 - protein, 10 aa, Influenza virus
DGWYGFRHQN

SEQ ID NO: 353523 - protein, 10 aa, Influenza virus
GWYGFRHQNA

SEQ ID NO: 353524 - protein, 10 aa, Influenza virus
WYGFRHQNAQ

SEQ ID NO: 353525 - protein, 10 aa, Influenza virus
YGFRHQNAQG

SEQ ID NO: 353526 - protein, 10 aa, Influenza virus
GFRHQNAQGQ

SEQ ID NO: 353527 - protein, 10 aa, Influenza virus
FRHQNAQGQG

SEQ ID NO: 353528 - protein, 10 aa, Influenza virus
RHQNAQGQGT

SEQ ID NO: 353529 - protein, 10 aa, Influenza virus
HQNAQGQGTA

SEQ ID NO: 353530 - protein, 10 aa, Influenza virus
QNAQGQGTAA

SEQ ID NO: 353531 - protein, 10 aa, Influenza virus
NAQGQGTAAD

SEQ ID NO: 353532 - protein, 10 aa, Influenza virus
AQGQGTAADY

SEQ ID NO: 353533 - protein, 10 aa, Influenza virus
QGQGTAADYK

SEQ ID NO: 353534 - protein, 10 aa, Influenza virus
GQGTAADYKS

SEQ ID NO: 353535 - protein, 10 aa, Influenza virus
QGTAADYKST

SEQ ID NO: 353536 - protein, 10 aa, Influenza virus
GTAADYKSTQ

SEQ ID NO: 353537 - protein, 10 aa, Influenza virus
TAADYKSTQA

SEQ ID NO: 353538 - protein, 10 aa, Influenza virus
AADYKSTQAA

SEQ ID NO: 353539 - protein, 10 aa, Influenza virus
ADYKSTQAAI

SEQ ID NO: 353540 - protein, 10 aa, Influenza virus
DYKSTQAAID

SEQ ID NO: 353541 - protein, 10 aa, Influenza virus
YKSTQAAIDQ

SEQ ID NO: 353542 - protein, 10 aa, Influenza virus
KSTQAAIDQI

SEQ ID NO: 353543 - protein, 10 aa, Influenza virus
STQAAIDQIT

SEQ ID NO: 353544 - protein, 10 aa, Influenza virus
TQAAIDQITG

SEQ ID NO: 353545 - protein, 10 aa, Influenza virus
QAAIDQITGK

SEQ ID NO: 353546 - protein, 10 aa, Influenza virus
AAIDQITGKL

SEQ ID NO: 353547 - protein, 10 aa, Influenza virus
AIDQITGKLN

SEQ ID NO: 353548 - protein, 10 aa, Influenza virus
IDQITGKLNR

SEQ ID NO: 353549 - protein, 10 aa, Influenza virus
DQITGKLNRL

SEQ ID NO: 353550 - protein, 10 aa, Influenza virus
QITGKLNRLI

SEQ ID NO: 353551 - protein, 10 aa, Influenza virus
ITGKLNRLIE

SEQ ID NO: 353552 - protein, 10 aa, Influenza virus
TGKLNRLIEK

SEQ ID NO: 353553 - protein, 10 aa, Influenza virus
GKLNRLIEKT

SEQ ID NO: 353554 - protein, 10 aa, Influenza virus
KLNRLIEKTN

SEQ ID NO: 353555 - protein, 10 aa, Influenza virus
LNRLIEKTNK

SEQ ID NO: 353556 - protein, 10 aa, Influenza virus
NRLIEKTNKQ

SEQ ID NO: 353557 - protein, 10 aa, Influenza virus
RLIEKTNKQF

SEQ ID NO: 353558 - protein, 10 aa, Influenza virus
LIEKTNKQFE

SEQ ID NO: 353559 - protein, 10 aa, Influenza virus
IEKTNKQFEL

SEQ ID NO: 353560 - protein, 10 aa, Influenza virus
EKTNKQFELI

SEQ ID NO: 353561 - protein, 10 aa, Influenza virus
KTNKQFELID

SEQ ID NO: 353562 - protein, 10 aa, Influenza virus
TNKQFELIDN

SEQ ID NO: 353563 - protein, 10 aa, Influenza virus
NKQFELIDNE

SEQ ID NO: 353564 - protein, 10 aa, Influenza virus
KQFELIDNEF

SEQ ID NO: 353565 - protein, 10 aa, Influenza virus
QFELIDNEFT

SEQ ID NO: 353566 - protein, 10 aa, Influenza virus
FELIDNEFTE

SEQ ID NO: 353567 - protein, 10 aa, Influenza virus
ELIDNEFTEV

SEQ ID NO: 353568 - protein, 10 aa, Influenza virus
LIDNEFTEVE

SEQ ID NO: 353569 - protein, 10 aa, Influenza virus
IDNEFTEVEQ

SEQ ID NO: 353570 - protein, 10 aa, Influenza virus
DNEFTEVEQQ

SEQ ID NO: 353571 - protein, 10 aa, Influenza virus
NEFTEVEQQI

SEQ ID NO: 353572 - protein, 10 aa, Influenza virus
EFTEVEQQIG

SEQ ID NO: 353573 - protein, 10 aa, Influenza virus
FTEVEQQIGN

SEQ ID NO: 353574 - protein, 10 aa, Influenza virus
TEVEQQIGNV

SEQ ID NO: 353575 - protein, 10 aa, Influenza virus
EVEQQIGNVI

SEQ ID NO: 353576 - protein, 10 aa, Influenza virus
VEQQIGNVIN

SEQ ID NO: 353577 - protein, 10 aa, Influenza virus
EQQIGNVINW

SEQ ID NO: 353578 - protein, 10 aa, Influenza virus
QQIGNVINWT

SEQ ID NO: 353579 - protein, 10 aa, Influenza virus
QIGNVINWTR

SEQ ID NO: 353580 - protein, 10 aa, Influenza virus
IGNVINWTRD

SEQ ID NO: 353581 - protein, 10 aa, Influenza virus
GNVINWTRDS

SEQ ID NO: 353582 - protein, 10 aa, Influenza virus
NVINWTRDSL

SEQ ID NO: 353583 - protein, 10 aa, Influenza virus
VINWTRDSLT

SEQ ID NO: 353584 - protein, 10 aa, Influenza virus
INWTRDSLTE

SEQ ID NO: 353585 - protein, 10 aa, Influenza virus
NWTRDSLTEI

SEQ ID NO: 353586 - protein, 10 aa, Influenza virus
WTRDSLTEIW

SEQ ID NO: 353587 - protein, 10 aa, Influenza virus
TRDSLTEIWS

SEQ ID NO: 353588 - protein, 10 aa, Influenza virus
RDSLTEIWSY

SEQ ID NO: 353589 - protein, 10 aa, Influenza virus
DSLTEIWSYN

SEQ ID NO: 353590 - protein, 10 aa, Influenza virus
SLTEIWSYNA

SEQ ID NO: 353591 - protein, 10 aa, Influenza virus
LTEIWSYNAE

SEQ ID NO: 353592 - protein, 10 aa, Influenza virus
TEIWSYNAEL

SEQ ID NO: 353593 - protein, 10 aa, Influenza virus
EIWSYNAELL

SEQ ID NO: 353594 - protein, 10 aa, Influenza virus
IWSYNAELLV

SEQ ID NO: 353595 - protein, 10 aa, Influenza virus
WSYNAELLVA

SEQ ID NO: 353596 - protein, 10 aa, Influenza virus
SYNAELLVAM

SEQ ID NO: 353597 - protein, 10 aa, Influenza virus
YNAELLVAME

SEQ ID NO: 353598 - protein, 10 aa, Influenza virus
NAELLVAMEN

SEQ ID NO: 353599 - protein, 10 aa, Influenza virus
AELLVAMENQ

SEQ ID NO: 353600 - protein, 10 aa, Influenza virus
ELLVAMENQH

SEQ ID NO: 353601 - protein, 10 aa, Influenza virus
LLVAMENQHT

SEQ ID NO: 353602 - protein, 10 aa, Influenza virus
LVAMENQHTI

SEQ ID NO: 353603 - protein, 10 aa, Influenza virus
VAMENQHTID

SEQ ID NO: 353604 - protein, 10 aa, Influenza virus
AMENQHTIDL

SEQ ID NO: 353605 - protein, 10 aa, Influenza virus
MENQHTIDLA

SEQ ID NO: 353606 - protein, 10 aa, Influenza virus
ENQHTIDLAD

SEQ ID NO: 353607 - protein, 10 aa, Influenza virus
NQHTIDLADS

SEQ ID NO: 353608 - protein, 10 aa, Influenza virus
QHTIDLADSE

SEQ ID NO: 353609 - protein, 10 aa, Influenza virus
HTIDLADSEM

SEQ ID NO: 353610 - protein, 10 aa, Influenza virus
TIDLADSEMN

SEQ ID NO: 353611 - protein, 10 aa, Influenza virus
IDLADSEMNK

SEQ ID NO: 353612 - protein, 10 aa, Influenza virus
DLADSEMNKL

SEQ ID NO: 353613 - protein, 10 aa, Influenza virus
LADSEMNKLY

SEQ ID NO: 353614 - protein, 10 aa, Influenza virus
ADSEMNKLYE

SEQ ID NO: 353615 - protein, 10 aa, Influenza virus
DSEMNKLYER

SEQ ID NO: 353616 - protein, 10 aa, Influenza virus
SEMNKLYERV

SEQ ID NO: 353617 - protein, 10 aa, Influenza virus
EMNKLYERVR

SEQ ID NO: 353618 - protein, 10 aa, Influenza virus
MNKLYERVRR

SEQ ID NO: 353619 - protein, 10 aa, Influenza virus
NKLYERVRRQ

SEQ ID NO: 353620 - protein, 10 aa, Influenza virus
KLYERVRRQL

SEQ ID NO: 353621 - protein, 10 aa, Influenza virus
LYERVRRQLR

SEQ ID NO: 353622 - protein, 10 aa, Influenza virus
YERVRRQLRE

SEQ ID NO: 353623 - protein, 10 aa, Influenza virus
ERVRRQLREN

SEQ ID NO: 353624 - protein, 10 aa, Influenza virus
RVRRQLRENA

SEQ ID NO: 353625 - protein, 10 aa, Influenza virus
VRRQLRENAE

SEQ ID NO: 353626 - protein, 10 aa, Influenza virus
RRQLRENAEE

SEQ ID NO: 353627 - protein, 10 aa, Influenza virus
RQLRENAEED

SEQ ID NO: 353628 - protein, 10 aa, Influenza virus
QLRENAEEDG

SEQ ID NO: 353629 - protein, 10 aa, Influenza virus
LRENAEEDGT

SEQ ID NO: 353630 - protein, 10 aa, Influenza virus
RENAEEDGTG

SEQ ID NO: 353631 - protein, 10 aa, Influenza virus
ENAEEDGTGC

SEQ ID NO: 353632 - protein, 10 aa, Influenza virus
NAEEDGTGCF

SEQ ID NO: 353633 - protein, 10 aa, Influenza virus
AEEDGTGCFE

SEQ ID NO: 353634 - protein, 10 aa, Influenza virus
EEDGTGCFEI

SEQ ID NO: 353635 - protein, 10 aa, Influenza virus
EDGTGCFEIF

SEQ ID NO: 353636 - protein, 10 aa, Influenza virus
DGTGCFEIFH

SEQ ID NO: 353637 - protein, 10 aa, Influenza virus
GTGCFEIFHR

SEQ ID NO: 353638 - protein, 10 aa, Influenza virus
TGCFEIFHRC

SEQ ID NO: 353639 - protein, 10 aa, Influenza virus
GCFEIFHRCD

SEQ ID NO: 353640 - protein, 10 aa, Influenza virus
CFEIFHRCDD

SEQ ID NO: 353641 - protein, 10 aa, Influenza virus
FEIFHRCDDQ

SEQ ID NO: 353642 - protein, 10 aa, Influenza virus
EIFHRCDDQC

SEQ ID NO: 353643 - protein, 10 aa, Influenza virus
IFHRCDDQCM

SEQ ID NO: 353644 - protein, 10 aa, Influenza virus
FHRCDDQCME

SEQ ID NO: 353645 - protein, 10 aa, Influenza virus
HRCDDQCMES

SEQ ID NO: 353646 - protein, 10 aa, Influenza virus
RCDDQCMESI

SEQ ID NO: 353647 - protein, 10 aa, Influenza virus
CDDQCMESIR

SEQ ID NO: 353648 - protein, 10 aa, Influenza virus
DDQCMESIRN

SEQ ID NO: 353649 - protein, 10 aa, Influenza virus
DQCMESIRNN

SEQ ID NO: 353650 - protein, 10 aa, Influenza virus
QCMESIRNNT

SEQ ID NO: 353651 - protein, 10 aa, Influenza virus
CMESIRNNTY

SEQ ID NO: 353652 - protein, 10 aa, Influenza virus
MESIRNNTYN

SEQ ID NO: 353653 - protein, 10 aa, Influenza virus
ESIRNNTYNH

SEQ ID NO: 353654 - protein, 10 aa, Influenza virus
SIRNNTYNHT

SEQ ID NO: 353655 - protein, 10 aa, Influenza virus
IRNNTYNHTE

SEQ ID NO: 353656 - protein, 10 aa, Influenza virus
RNNTYNHTEY

SEQ ID NO: 353657 - protein, 10 aa, Influenza virus
NNTYNHTEYR

SEQ ID NO: 353658 - protein, 10 aa, Influenza virus
NTYNHTEYRQ

SEQ ID NO: 353659 - protein, 10 aa, Influenza virus
TYNHTEYRQE

SEQ ID NO: 353660 - protein, 10 aa, Influenza virus
YNHTEYRQEA

SEQ ID NO: 353661 - protein, 10 aa, Influenza virus
NHTEYRQEAL

SEQ ID NO: 353662 - protein, 10 aa, Influenza virus
HTEYRQEALQ

SEQ ID NO: 353663 - protein, 10 aa, Influenza virus
TEYRQEALQN

SEQ ID NO: 353664 - protein, 10 aa, Influenza virus
EYRQEALQNR

SEQ ID NO: 353665 - protein, 10 aa, Influenza virus
YRQEALQNRI

SEQ ID NO: 353666 - protein, 10 aa, Influenza virus
RQEALQNRIM

SEQ ID NO: 353667 - protein, 10 aa, Influenza virus
QEALQNRIMI

SEQ ID NO: 353668 - protein, 10 aa, Influenza virus
EALQNRIMIN

SEQ ID NO: 353669 - protein, 10 aa, Influenza virus
ALQNRIMINP

SEQ ID NO: 353670 - protein, 10 aa, Influenza virus
LQNRIMINPV

SEQ ID NO: 353671 - protein, 10 aa, Influenza virus
QNRIMINPVK

SEQ ID NO: 353672 - protein, 10 aa, Influenza virus
NRIMINPVKL

SEQ ID NO: 353673 - protein, 10 aa, Influenza virus
RIMINPVKLS

SEQ ID NO: 353674 - protein, 10 aa, Influenza virus
IMINPVKLSS

SEQ ID NO: 353675 - protein, 10 aa, Influenza virus
MINPVKLSSG

SEQ ID NO: 353676 - protein, 10 aa, Influenza virus
INPVKLSSGY

SEQ ID NO: 353677 - protein, 10 aa, Influenza virus
NPVKLSSGYK

SEQ ID NO: 353678 - protein, 10 aa, Influenza virus
PVKLSSGYKD

SEQ ID NO: 353679 - protein, 10 aa, Influenza virus
VKLSSGYKDV

SEQ ID NO: 353680 - protein, 10 aa, Influenza virus
KLSSGYKDVI

SEQ ID NO: 353681 - protein, 10 aa, Influenza virus
LSSGYKDVIL

SEQ ID NO: 353682 - protein, 10 aa, Influenza virus
SSGYKDVILW

SEQ ID NO: 353683 - protein, 10 aa, Influenza virus
SGYKDVILWF

SEQ ID NO: 353684 - protein, 10 aa, Influenza virus
GYKDVILWFS

SEQ ID NO: 353685 - protein, 10 aa, Influenza virus
YKDVILWFSF

SEQ ID NO: 353686 - protein, 10 aa, Influenza virus
KDVILWFSFG

SEQ ID NO: 353687 - protein, 10 aa, Influenza virus
DVILWFSFGA

SEQ ID NO: 353688 - protein, 10 aa, Influenza virus
VILWFSFGAS

SEQ ID NO: 353689 - protein, 10 aa, Influenza virus
ILWFSFGASC

SEQ ID NO: 353690 - protein, 10 aa, Influenza virus
LWFSFGASCV

SEQ ID NO: 353691 - protein, 10 aa, Influenza virus
WFSFGASCVM

SEQ ID NO: 353692 - protein, 10 aa, Influenza virus
FSFGASCVML

SEQ ID NO: 353693 - protein, 10 aa, Influenza virus
SFGASCVMLL

SEQ ID NO: 353694 - protein, 10 aa, Influenza virus
FGASCVMLLA

SEQ ID NO: 353695 - protein, 10 aa, Influenza virus
GASCVMLLAI

SEQ ID NO: 353696 - protein, 10 aa, Influenza virus
ASCVMLLAIA

SEQ ID NO: 353697 - protein, 10 aa, Influenza virus
SCVMLLAIAM

SEQ ID NO: 353698 - protein, 10 aa, Influenza virus
CVMLLAIAMG

SEQ ID NO: 353699 - protein, 10 aa, Influenza virus
VMLLAIAMGL

SEQ ID NO: 353700 - protein, 10 aa, Influenza virus
MLLAIAMGLI

SEQ ID NO: 353701 - protein, 10 aa, Influenza virus
LLAIAMGLIF

SEQ ID NO: 353702 - protein, 10 aa, Influenza virus
LAIAMGLIFM

SEQ ID NO: 353703 - protein, 10 aa, Influenza virus
AIAMGLIFMC

SEQ ID NO: 353704 - protein, 10 aa, Influenza virus
IAMGLIFMCV

SEQ ID NO: 353705 - protein, 10 aa, Influenza virus
AMGLIFMCVK

SEQ ID NO: 353706 - protein, 10 aa, Influenza virus
MGLIFMCVKN

SEQ ID NO: 353707 - protein, 10 aa, Influenza virus
GLIFMCVKNG

SEQ ID NO: 353708 - protein, 10 aa, Influenza virus
LIFMCVKNGN

SEQ ID NO: 353709 - protein, 10 aa, Influenza virus
IFMCVKNGNL

SEQ ID NO: 353710 - protein, 10 aa, Influenza virus
FMCVKNGNLR

SEQ ID NO: 353711 - protein, 10 aa, Influenza virus
MCVKNGNLRC

SEQ ID NO: 353712 - protein, 10 aa, Influenza virus
CVKNGNLRCT

SEQ ID NO: 353713 - protein, 10 aa, Influenza virus
VKNGNLRCTI

SEQ ID NO: 353714 - protein, 10 aa, Influenza virus
KNGNLRCTIC

SEQ ID NO: 353715 - protein, 10 aa, Influenza virus
NGNLRCTICI

SEQ ID NO: 353716 - protein, 10 aa, Influenza virus
QPNDGQVLYF

SEQ ID NO: 353717 - protein, 10 aa, Influenza virus
PNDGQVLYFL

SEQ ID NO: 353718 - protein, 10 aa, Influenza virus
GRYSKADKIC

SEQ ID NO: 353719 - protein, 10 aa, Influenza virus
RYSKADKICI

SEQ ID NO: 353720 - protein, 10 aa, Influenza virus
YSKADKICIG

SEQ ID NO: 353721 - protein, 10 aa, Influenza virus
SKADKICIGY

SEQ ID NO: 353722 - protein, 10 aa, Influenza virus
KADKICIGYL

SEQ ID NO: 353723 - protein, 10 aa, Influenza virus
ADKICIGYLS

SEQ ID NO: 353724 - protein, 10 aa, Influenza virus
DKICIGYLSN

SEQ ID NO: 353725 - protein, 10 aa, Influenza virus
KICIGYLSNN

SEQ ID NO: 353726 - protein, 10 aa, Influenza virus
ICIGYLSNNS

SEQ ID NO: 353727 - protein, 10 aa, Influenza virus
CIGYLSNNSS

SEQ ID NO: 353728 - protein, 10 aa, Influenza virus
IGYLSNNSSD

SEQ ID NO: 353729 - protein, 10 aa, Influenza virus
GYLSNNSSDT

SEQ ID NO: 353730 - protein, 10 aa, Influenza virus
YLSNNSSDTV

SEQ ID NO: 353731 - protein, 10 aa, Influenza virus
LSNNSSDTVD

SEQ ID NO: 353732 - protein, 10 aa, Influenza virus
SNNSSDTVDT

SEQ ID NO: 353733 - protein, 10 aa, Influenza virus
NNSSDTVDTL

SEQ ID NO: 353734 - protein, 10 aa, Influenza virus
NSSDTVDTLT

SEQ ID NO: 353735 - protein, 10 aa, Influenza virus
SSDTVDTLTE

SEQ ID NO: 353736 - protein, 10 aa, Influenza virus
SDTVDTLTEN

SEQ ID NO: 353737 - protein, 10 aa, Influenza virus
DTVDTLTENG

SEQ ID NO: 353738 - protein, 10 aa, Influenza virus
TVDTLTENGV

SEQ ID NO: 353739 - protein, 10 aa, Influenza virus
VDTLTENGVP

SEQ ID NO: 353740 - protein, 10 aa, Influenza virus
DTLTENGVPV

SEQ ID NO: 353741 - protein, 10 aa, Influenza virus
TLTENGVPVT

SEQ ID NO: 353742 - protein, 10 aa, Influenza virus
LTENGVPVTS

SEQ ID NO: 353743 - protein, 10 aa, Influenza virus
TENGVPVTSS

SEQ ID NO: 353744 - protein, 10 aa, Influenza virus
ENGVPVTSSI

SEQ ID NO: 353745 - protein, 10 aa, Influenza virus
NGVPVTSSID

SEQ ID NO: 353746 - protein, 10 aa, Influenza virus
GVPVTSSVDL

SEQ ID NO: 353747 - protein, 10 aa, Influenza virus
VPVTSSVDLV

SEQ ID NO: 353748 - protein, 10 aa, Influenza virus
PVTSSVDLVE

SEQ ID NO: 353749 - protein, 10 aa, Influenza virus
VTSSVDLVET

SEQ ID NO: 353750 - protein, 10 aa, Influenza virus
TSSVDLVETN

SEQ ID NO: 353751 - protein, 10 aa, Influenza virus
SSVDLVETNH

SEQ ID NO: 353752 - protein, 10 aa, Influenza virus
SVDLVETNHT

SEQ ID NO: 353753 - protein, 10 aa, Influenza virus
VDLVETNHTG

SEQ ID NO: 353754 - protein, 10 aa, Influenza virus
DLVETNHTGT

SEQ ID NO: 353755 - protein, 10 aa, Influenza virus
LVETNHTGTY

SEQ ID NO: 353756 - protein, 10 aa, Influenza virus
VETNHTGTYC

SEQ ID NO: 353757 - protein, 10 aa, Influenza virus
ETNHTGTYCS

SEQ ID NO: 353758 - protein, 10 aa, Influenza virus
TNHTGTYCSL

SEQ ID NO: 353759 - protein, 10 aa, Influenza virus
NHTGTYCSLN

SEQ ID NO: 353760 - protein, 10 aa, Influenza virus
HTGTYCSLNG

SEQ ID NO: 353761 - protein, 10 aa, Influenza virus
TGTYCSLNGV

SEQ ID NO: 353762 - protein, 10 aa, Influenza virus
GTYCSLNGVS

SEQ ID NO: 353763 - protein, 10 aa, Influenza virus
TYCSLNGVSP

SEQ ID NO: 353764 - protein, 10 aa, Influenza virus
YCSLNGVSPI

SEQ ID NO: 353765 - protein, 10 aa, Influenza virus
CSLNGVSPIH

SEQ ID NO: 353766 - protein, 10 aa, Influenza virus
SLNGVSPIHL

SEQ ID NO: 353767 - protein, 10 aa, Influenza virus
LNGVSPIHLG

SEQ ID NO: 353768 - protein, 10 aa, Influenza virus
NGVSPIHLGD

SEQ ID NO: 353769 - protein, 10 aa, Influenza virus
GVSPIHLGDC

SEQ ID NO: 353770 - protein, 10 aa, Influenza virus
VSPIHLGDCS

SEQ ID NO: 353771 - protein, 10 aa, Influenza virus
SPIHLGDCSF

SEQ ID NO: 353772 - protein, 10 aa, Influenza virus
PIHLGDCSFE

SEQ ID NO: 353773 - protein, 10 aa, Influenza virus
IHLGDCSFEG

SEQ ID NO: 353774 - protein, 10 aa, Influenza virus
HLGDCSFEGW

SEQ ID NO: 353775 - protein, 10 aa, Influenza virus
LGDCSFEGWI

SEQ ID NO: 353776 - protein, 10 aa, Influenza virus
GDCSFEGWIV

SEQ ID NO: 353777 - protein, 10 aa, Influenza virus
DCSFEGWIVG

SEQ ID NO: 353778 - protein, 10 aa, Influenza virus
CSFEGWIVGN

SEQ ID NO: 353779 - protein, 10 aa, Influenza virus
SFEGWIVGNP

SEQ ID NO: 353780 - protein, 10 aa, Influenza virus
FEGWIVGNPS

SEQ ID NO: 353781 - protein, 10 aa, Influenza virus
EGWIVGNPSC

SEQ ID NO: 353782 - protein, 10 aa, Influenza virus
GWIVGNPSCA

SEQ ID NO: 353783 - protein, 10 aa, Influenza virus
WIVGNPSCAT

SEQ ID NO: 353784 - protein, 10 aa, Influenza virus
IVGNPSCATN

SEQ ID NO: 353785 - protein, 10 aa, Influenza virus
VGNPSCATNI

SEQ ID NO: 353786 - protein, 10 aa, Influenza virus
GNPSCATNIN

SEQ ID NO: 353787 - protein, 10 aa, Influenza virus
NPSCATNINI

SEQ ID NO: 353788 - protein, 10 aa, Influenza virus
PSCATNINIR

SEQ ID NO: 353789 - protein, 10 aa, Influenza virus
SCATNINIRE

SEQ ID NO: 353790 - protein, 10 aa, Influenza virus
CATNINIREW

SEQ ID NO: 353791 - protein, 10 aa, Influenza virus
ATNINIREWS

SEQ ID NO: 353792 - protein, 10 aa, Influenza virus
TNINIREWSY

SEQ ID NO: 353793 - protein, 10 aa, Influenza virus
NINIREWSYL

SEQ ID NO: 353794 - protein, 10 aa, Influenza virus
INIREWSYLI

SEQ ID NO: 353795 - protein, 10 aa, Influenza virus
NIREWSYLIE

SEQ ID NO: 353796 - protein, 10 aa, Influenza virus
IREWSYLIED

SEQ ID NO: 353797 - protein, 10 aa, Influenza virus
REWSYLIEDP

SEQ ID NO: 353798 - protein, 10 aa, Influenza virus
EWSYLIEDPN

SEQ ID NO: 353799 - protein, 10 aa, Influenza virus
WSYLIEDPNA

SEQ ID NO: 353800 - protein, 10 aa, Influenza virus
SYLIEDPNAP

SEQ ID NO: 353801 - protein, 10 aa, Influenza virus
YLIEDPNAPN

SEQ ID NO: 353802 - protein, 10 aa, Influenza virus
LIEDPNAPNK

SEQ ID NO: 353803 - protein, 10 aa, Influenza virus
IEDPNAPNKL

SEQ ID NO: 353804 - protein, 10 aa, Influenza virus
EDPNAPNKLC

SEQ ID NO: 353805 - protein, 10 aa, Influenza virus
DPNAPNKLCF

SEQ ID NO: 353806 - protein, 10 aa, Influenza virus
PNAPNKLCFP

SEQ ID NO: 353807 - protein, 10 aa, Influenza virus
NAPHKLCFPG

SEQ ID NO: 353808 - protein, 10 aa, Influenza virus
APHKLCFPGE

SEQ ID NO: 353809 - protein, 10 aa, Influenza virus
KLCFPGELDN

SEQ ID NO: 353810 - protein, 10 aa, Influenza virus
LCFPGELDNN

SEQ ID NO: 353811 - protein, 10 aa, Influenza virus
CFPGELDNNG

SEQ ID NO: 353812 - protein, 10 aa, Influenza virus
FPGELDNNGE

SEQ ID NO: 353813 - protein, 10 aa, Influenza virus
PGELDNNGEL

SEQ ID NO: 353814 - protein, 10 aa, Influenza virus
GELDNNGELR

SEQ ID NO: 353815 - protein, 10 aa, Influenza virus
ELDNNGELRH

SEQ ID NO: 353816 - protein, 10 aa, Influenza virus
LDNNGELRHL

SEQ ID NO: 353817 - protein, 10 aa, Influenza virus
DNNGELRHLF

SEQ ID NO: 353818 - protein, 10 aa, Influenza virus
NNGELRHLFS

SEQ ID NO: 353819 - protein, 10 aa, Influenza virus
NGELRHLFSG

SEQ ID NO: 353820 - protein, 10 aa, Influenza virus
GELRHLFSGV

SEQ ID NO: 353821 - protein, 10 aa, Influenza virus
ELRHLFSGVN

SEQ ID NO: 353822 - protein, 10 aa, Influenza virus
LRHLFSGVNS

SEQ ID NO: 353823 - protein, 10 aa, Influenza virus
RHLFSGVNSF

SEQ ID NO: 353824 - protein, 10 aa, Influenza virus
HLFSGVNSFS

SEQ ID NO: 353825 - protein, 10 aa, Influenza virus
LFSGVNSFSR

SEQ ID NO: 353826 - protein, 10 aa, Influenza virus
FSGVNSFSRT

SEQ ID NO: 353827 - protein, 10 aa, Influenza virus
SGVNSFSRTE

SEQ ID NO: 353828 - protein, 10 aa, Influenza virus
GVNSFSRTEL

SEQ ID NO: 353829 - protein, 10 aa, Influenza virus
VNSFSRTELI

SEQ ID NO: 353830 - protein, 10 aa, Influenza virus
NSFSRTELIS

SEQ ID NO: 353831 - protein, 10 aa, Influenza virus
SFSRTELISP

SEQ ID NO: 353832 - protein, 10 aa, Influenza virus
FSRTELISPS

SEQ ID NO: 353833 - protein, 10 aa, Influenza virus
SRTELISPSK

SEQ ID NO: 353834 - protein, 10 aa, Influenza virus
RTELISPSKW

SEQ ID NO: 353835 - protein, 10 aa, Influenza virus
TELISPSKWG

SEQ ID NO: 353836 - protein, 10 aa, Influenza virus
PSKWGNVLDG

SEQ ID NO: 353837 - protein, 10 aa, Influenza virus
SKWGNVLDGV

SEQ ID NO: 353838 - protein, 10 aa, Influenza virus
KWGNVLDGVT

SEQ ID NO: 353839 - protein, 10 aa, Influenza virus
WGNVLDGVTA

SEQ ID NO: 353840 - protein, 10 aa, Influenza virus
GNVLDGVTAS

SEQ ID NO: 353841 - protein, 10 aa, Influenza virus
NVLDGVTASC

SEQ ID NO: 353842 - protein, 10 aa, Influenza virus
VLDGVTASCL

SEQ ID NO: 353843 - protein, 10 aa, Influenza virus
LDGVTASCLD

SEQ ID NO: 353844 - protein, 10 aa, Influenza virus
DGVTASCLDR

SEQ ID NO: 353845 - protein, 10 aa, Influenza virus
GVTASCLDRG

SEQ ID NO: 353846 - protein, 10 aa, Influenza virus
VTASCLDRGA

SEQ ID NO: 353847 - protein, 10 aa, Influenza virus
SFYRNLVWLV

SEQ ID NO: 353848 - protein, 10 aa, Influenza virus
FYRNLVWLVK

SEQ ID NO: 353849 - protein, 10 aa, Influenza virus
NGKYPVIKGD

SEQ ID NO: 353850 - protein, 10 aa, Influenza virus
VKGEYNNTTG

SEQ ID NO: 353851 - protein, 10 aa, Influenza virus
KGDYNNTTGR

SEQ ID NO: 353852 - protein, 10 aa, Influenza virus
GDYNNTTGRD

SEQ ID NO: 353853 - protein, 10 aa, Influenza virus
DYNNTTGRDV

SEQ ID NO: 353854 - protein, 10 aa, Influenza virus
YNNTTGRDVL

SEQ ID NO: 353855 - protein, 10 aa, Influenza virus
NNTTGRDVLV

SEQ ID NO: 353856 - protein, 10 aa, Influenza virus
NTTGRDVLVL

SEQ ID NO: 353857 - protein, 10 aa, Influenza virus
TTGRDVLVLW

SEQ ID NO: 353858 - protein, 10 aa, Influenza virus
TGRDVLVLWG

SEQ ID NO: 353859 - protein, 10 aa, Influenza virus
GRDVLVLWGI

SEQ ID NO: 353860 - protein, 10 aa, Influenza virus
RDVLVLWGIH

SEQ ID NO: 353861 - protein, 10 aa, Influenza virus
DVLVLWGIHH

SEQ ID NO: 353862 - protein, 10 aa, Influenza virus
VLVLWGIHHP

SEQ ID NO: 353863 - protein, 10 aa, Influenza virus
LVLWGIHHPD

SEQ ID NO: 353864 - protein, 10 aa, Influenza virus
VLWGIHHPDT

SEQ ID NO: 353865 - protein, 10 aa, Influenza virus
LWGIHHPDTE

SEQ ID NO: 353866 - protein, 10 aa, Influenza virus
WGIHHPDTEA

SEQ ID NO: 353867 - protein, 10 aa, Influenza virus
GIHHPDTETT

SEQ ID NO: 353868 - protein, 10 aa, Influenza virus
IHHPDTETTA

SEQ ID NO: 353869 - protein, 10 aa, Influenza virus
ATNLYVNKNP

SEQ ID NO: 353870 - protein, 10 aa, Influenza virus
TNLYVNKNPY

SEQ ID NO: 353871 - protein, 10 aa, Influenza virus
KLYVNKNPYT

SEQ ID NO: 353872 - protein, 10 aa, Influenza virus
LYVNKNPYTL

SEQ ID NO: 353873 - protein, 10 aa, Influenza virus
YVNKNPYTLV

SEQ ID NO: 353874 - protein, 10 aa, Influenza virus
VNKNPYTLVS

SEQ ID NO: 353875 - protein, 10 aa, Influenza virus
NKNPYTLVST

SEQ ID NO: 353876 - protein, 10 aa, Influenza virus
KNPYTLVSTK

SEQ ID NO: 353877 - protein, 10 aa, Influenza virus
NPYTLVSTKE

SEQ ID NO: 353878 - protein, 10 aa, Influenza virus
PYTLVSTKEW

SEQ ID NO: 353879 - protein, 10 aa, Influenza virus
YTLVSTKEWS

SEQ ID NO: 353880 - protein, 10 aa, Influenza virus
TLVSTKEWSK

SEQ ID NO: 353881 - protein, 10 aa, Influenza virus
LVSTKEWSKR

SEQ ID NO: 353882 - protein, 10 aa, Influenza virus
VSTKEWSKRY

SEQ ID NO: 353883 - protein, 10 aa, Influenza virus
STKEWSKRYE

SEQ ID NO: 353884 - protein, 10 aa, Influenza virus
TKEWSKRYEL

SEQ ID NO: 353885 - protein, 10 aa, Influenza virus
KEWSKRYELE

SEQ ID NO: 353886 - protein, 10 aa, Influenza virus
EWSKRYELEI

SEQ ID NO: 353887 - protein, 10 aa, Influenza virus
WSKRYELEIG

SEQ ID NO: 353888 - protein, 10 aa, Influenza virus
SKRYELEIGT

SEQ ID NO: 353889 - protein, 10 aa, Influenza virus
KRYELEIGTR

SEQ ID NO: 353890 - protein, 10 aa, Influenza virus
RYELEIGTRI

SEQ ID NO: 353891 - protein, 10 aa, Influenza virus
YELEIGTRIG

SEQ ID NO: 353892 - protein, 10 aa, Influenza virus
ELEIGTRIGD

SEQ ID NO: 353893 - protein, 10 aa, Influenza virus
LEIGTRIGDG

SEQ ID NO: 353894 - protein, 10 aa, Influenza virus
EIGTRIGDGQ

SEQ ID NO: 353895 - protein, 10 aa, Influenza virus
IGTRIGDGQR

SEQ ID NO: 353896 - protein, 10 aa, Influenza virus
GTRIGDGQRS

SEQ ID NO: 353897 - protein, 10 aa, Influenza virus
TRIGDGQRSW

SEQ ID NO: 353898 - protein, 10 aa, Influenza virus
RIGDGQRSWM

SEQ ID NO: 353899 - protein, 10 aa, Influenza virus
IGDGQRSWMK

SEQ ID NO: 353900 - protein, 10 aa, Influenza virus
GDGQRSWMKL

SEQ ID NO: 353901 - protein, 10 aa, Influenza virus
DGQRSWMKLY

SEQ ID NO: 353902 - protein, 10 aa, Influenza virus
GQRSWMKLYW

SEQ ID NO: 353903 - protein, 10 aa, Influenza virus
QRSWMKLYWH

SEQ ID NO: 353904 - protein, 10 aa, Influenza virus
RSWMKLYWHL

SEQ ID NO: 353905 - protein, 10 aa, Influenza virus
SWMKLYWHLM

SEQ ID NO: 353906 - protein, 10 aa, Influenza virus
WMKIYWHLMH

SEQ ID NO: 353907 - protein, 10 aa, Influenza virus
MKIYWHLMHP

SEQ ID NO: 353908 - protein, 10 aa, Influenza virus
KIYWHLMHPG

SEQ ID NO: 353909 - protein, 10 aa, Influenza virus
IYWHLMHPGE

SEQ ID NO: 353910 - protein, 10 aa, Influenza virus
YWHLMHPGER

SEQ ID NO: 353911 - protein, 10 aa, Influenza virus
WHLMHPGERI

SEQ ID NO: 353912 - protein, 10 aa, Influenza virus
PGERITFESN

SEQ ID NO: 353913 - protein, 10 aa, Influenza virus
GERITFESNG

SEQ ID NO: 353914 - protein, 10 aa, Influenza virus
ERITFESNGG

SEQ ID NO: 353915 - protein, 10 aa, Influenza virus
RITFESNGGL

SEQ ID NO: 353916 - protein, 10 aa, Influenza virus
TFESNGGLLA

SEQ ID NO: 353917 - protein, 10 aa, Influenza virus
FESNGGLLAP

SEQ ID NO: 353918 - protein, 10 aa, Influenza virus
ESNGGLLAPR

SEQ ID NO: 353919 - protein, 10 aa, Influenza virus
SNGGLLAPRY

SEQ ID NO: 353920 - protein, 10 aa, Influenza virus
NGGLLAPRYG

SEQ ID NO: 353921 - protein, 10 aa, Influenza virus
GGLLAPRYGY

SEQ ID NO: 353922 - protein, 10 aa, Influenza virus
GLLAPRYGYI

SEQ ID NO: 353923 - protein, 10 aa, Influenza virus
LLAPRYGYII

SEQ ID NO: 353924 - protein, 10 aa, Influenza virus
LAPRYGYIIE

SEQ ID NO: 353925 - protein, 10 aa, Influenza virus
APRYGYIIEK

SEQ ID NO: 353926 - protein, 10 aa, Influenza virus
PRYGYIIEKY

SEQ ID NO: 353927 - protein, 10 aa, Influenza virus
RYGYIIEKYG

SEQ ID NO: 353928 - protein, 10 aa, Influenza virus
YGYIIEKYGT

SEQ ID NO: 353929 - protein, 10 aa, Influenza virus
GYIIEKYGTG

SEQ ID NO: 353930 - protein, 10 aa, Influenza virus
YIIEKYGTGR

SEQ ID NO: 353931 - protein, 10 aa, Influenza virus
IIEKYGTGRI

SEQ ID NO: 353932 - protein, 10 aa, Influenza virus
IEKYGTGRIF

SEQ ID NO: 353933 - protein, 10 aa, Influenza virus
EKYGTGRIFQ

SEQ ID NO: 353934 - protein, 10 aa, Influenza virus
KYGTGRIFQS

SEQ ID NO: 353935 - protein, 10 aa, Influenza virus
YGTGRIFQSG

SEQ ID NO: 353936 - protein, 10 aa, Influenza virus
GTGRIFQSGV

SEQ ID NO: 353937 - protein, 10 aa, Influenza virus
TGRIFQSGVR

SEQ ID NO: 353938 - protein, 10 aa, Influenza virus
GRIFQSGVRM

SEQ ID NO: 353939 - protein, 10 aa, Influenza virus
RIFQSGVRMA

SEQ ID NO: 353940 - protein, 10 aa, Influenza virus
RMAKCNTKCQ

SEQ ID NO: 353941 - protein, 10 aa, Influenza virus
MAKCNTKCQT

SEQ ID NO: 353942 - protein, 10 aa, Influenza virus
AKCNTKCQTS

SEQ ID NO: 353943 - protein, 10 aa, Influenza virus
KCNTKCQTSM

SEQ ID NO: 353944 - protein, 10 aa, Influenza virus
CNTKCQTSMG

SEQ ID NO: 353945 - protein, 10 aa, Influenza virus
NTKCQTSMGG

SEQ ID NO: 353946 - protein, 10 aa, Influenza virus
TKCQTSVGGI

SEQ ID NO: 353947 - protein, 10 aa, Influenza virus
GGINTNKTFQ

SEQ ID NO: 353948 - protein, 10 aa, Influenza virus
GINTNKTFQN

SEQ ID NO: 353949 - protein, 10 aa, Influenza virus
INTNKTFQNI

SEQ ID NO: 353950 - protein, 10 aa, Influenza virus
NTNKTFQNIE

SEQ ID NO: 353951 - protein, 10 aa, Influenza virus
TNKTFQNIER

SEQ ID NO: 353952 - protein, 10 aa, Influenza virus
NKTFQNIERN

SEQ ID NO: 353953 - protein, 10 aa, Influenza virus
KTFQNIERNA

SEQ ID NO: 353954 - protein, 10 aa, Influenza virus
TFQNIERNAL

SEQ ID NO: 353955 - protein, 10 aa, Influenza virus
FQNIERNALG

SEQ ID NO: 353956 - protein, 10 aa, Influenza virus
QNIERNALGD

SEQ ID NO: 353957 - protein, 10 aa, Influenza virus
NIERNALGDC

SEQ ID NO: 353958 - protein, 10 aa, Influenza virus
IERNALGDCP

SEQ ID NO: 353959 - protein, 10 aa, Influenza virus
ERNALGDCPK

SEQ ID NO: 353960 - protein, 10 aa, Influenza virus
RNALGDCPKY

SEQ ID NO: 353961 - protein, 10 aa, Influenza virus
NALGDCPKYI

SEQ ID NO: 353962 - protein, 10 aa, Influenza virus
ALGDCPKYIK

SEQ ID NO: 353963 - protein, 10 aa, Influenza virus
LGDCPKYIKS

SEQ ID NO: 353964 - protein, 10 aa, Influenza virus
GDCPKYIKSG

SEQ ID NO: 353965 - protein, 10 aa, Influenza virus
DCPKYIKSGQ

SEQ ID NO: 353966 - protein, 10 aa, Influenza virus
CPKYIKSGQL

SEQ ID NO: 353967 - protein, 10 aa, Influenza virus
PKYIKSGQLK

SEQ ID NO: 353968 - protein, 10 aa, Influenza virus
KYIKSGQLKL

SEQ ID NO: 353969 - protein, 10 aa, Influenza virus
YIKSGQLKLA

SEQ ID NO: 353970 - protein, 10 aa, Influenza virus
IKSGQLKLAT

SEQ ID NO: 353971 - protein, 10 aa, Influenza virus
KSGQLKLATG

SEQ ID NO: 353972 - protein, 10 aa, Influenza virus
SGQLKLATGL

SEQ ID NO: 353973 - protein, 10 aa, Influenza virus
GQLKLATGLR

SEQ ID NO: 353974 - protein, 10 aa, Influenza virus
QLKLATGLRN

SEQ ID NO: 353975 - protein, 10 aa, Influenza virus
LKLATGLRNV

SEQ ID NO: 353976 - protein, 10 aa, Influenza virus
KLATGLRNVP

SEQ ID NO: 353977 - protein, 10 aa, Influenza virus
LATGLRNVPS

SEQ ID NO: 353978 - protein, 10 aa, Influenza virus
ATGLRNVPSI

SEQ ID NO: 353979 - protein, 10 aa, Influenza virus
IPIGERGLFG

SEQ ID NO: 353980 - protein, 10 aa, Influenza virus
GERGLFGAIA

SEQ ID NO: 353981 - protein, 10 aa, Influenza virus
ERGLFGAIAG

SEQ ID NO: 353982 - protein, 10 aa, Influenza virus
RGLFGAIAGF

SEQ ID NO: 353983 - protein, 10 aa, Influenza virus
GLFGAIAGFI

SEQ ID NO: 353984 - protein, 10 aa, Influenza virus
LFGAIAGFIE

SEQ ID NO: 353985 - protein, 10 aa, Influenza virus
FGAIAGFIEG

SEQ ID NO: 353986 - protein, 10 aa, Influenza virus
GAIAGFIEGG

SEQ ID NO: 353987 - protein, 10 aa, Influenza virus
AIAGFIEGGW

SEQ ID NO: 353988 - protein, 10 aa, Influenza virus
IAGFIEGGWP

SEQ ID NO: 353989 - protein, 10 aa, Influenza virus
AGFIEGGWPG

SEQ ID NO: 353990 - protein, 10 aa, Influenza virus
GFIEGGWPGL

SEQ ID NO: 353991 - protein, 10 aa, Influenza virus
FIEGGWPGLI

SEQ ID NO: 353992 - protein, 10 aa, Influenza virus
IEGGWPGLIN

SEQ ID NO: 353993 - protein, 10 aa, Influenza virus
EGGWPGLING

SEQ ID NO: 353994 - protein, 10 aa, Influenza virus
GGWPGLINGW

SEQ ID NO: 353995 - protein, 10 aa, Influenza virus
GWPGLINGWY

SEQ ID NO: 353996 - protein, 10 aa, Influenza virus
WPGLINGWYG

SEQ ID NO: 353997 - protein, 10 aa, Influenza virus
PGLINGWYGF

SEQ ID NO: 353998 - protein, 10 aa, Influenza virus
GLINGWYGFQ

SEQ ID NO: 353999 - protein, 10 aa, Influenza virus
LINGWYGFQH

SEQ ID NO: 354000 - protein, 10 aa, Influenza virus
INGWYGFQHQ

SEQ ID NO: 354001 - protein, 10 aa, Influenza virus
NGWYGFQHQN

SEQ ID NO: 354002 - protein, 10 aa, Influenza virus
GWYGFQHQNE

SEQ ID NO: 354003 - protein, 10 aa, Influenza virus
WYGFQHQNEQ

SEQ ID NO: 354004 - protein, 10 aa, Influenza virus
YGFQHQNEQG

SEQ ID NO: 354005 - protein, 10 aa, Influenza virus
GFQHQNEQGT

SEQ ID NO: 354006 - protein, 10 aa, Influenza virus
FQHQNEQGTG

SEQ ID NO: 354007 - protein, 10 aa, Influenza virus
QHQNEQGTGI

SEQ ID NO: 354008 - protein, 10 aa, Influenza virus
HQNEQGTGIA

SEQ ID NO: 354009 - protein, 10 aa, Influenza virus
QNEQGTGIAA

SEQ ID NO: 354010 - protein, 10 aa, Influenza virus
NEQGTGIAAD

SEQ ID NO: 354011 - protein, 10 aa, Influenza virus
EQGTGIAADK

SEQ ID NO: 354012 - protein, 10 aa, Influenza virus
QGTGIAADKA

SEQ ID NO: 354013 - protein, 10 aa, Influenza virus
GTGIAADKAS

SEQ ID NO: 354014 - protein, 10 aa, Influenza virus
TGIAADKAST

SEQ ID NO: 354015 - protein, 10 aa, Influenza virus
GIAADKASTQ

SEQ ID NO: 354016 - protein, 10 aa, Influenza virus
IAADKASTQK

SEQ ID NO: 354017 - protein, 10 aa, Influenza virus
AADKASTQKA

SEQ ID NO: 354018 - protein, 10 aa, Influenza virus
ADKASTQKAI

SEQ ID NO: 354019 - protein, 10 aa, Influenza virus
DKASTQKAID

SEQ ID NO: 354020 - protein, 10 aa, Influenza virus
KASTQKAIDE

SEQ ID NO: 354021 - protein, 10 aa, Influenza virus
ASTQKAIDEI

SEQ ID NO: 354022 - protein, 10 aa, Influenza virus
STQKAINEIT

SEQ ID NO: 354023 - protein, 10 aa, Influenza virus
TQKAINEITT

SEQ ID NO: 354024 - protein, 10 aa, Influenza virus
QKAINEITTK

SEQ ID NO: 354025 - protein, 10 aa, Influenza virus
KAINEITTKI

SEQ ID NO: 354026 - protein, 10 aa, Influenza virus
AINEITTKIN

SEQ ID NO: 354027 - protein, 10 aa, Influenza virus
INEITTKINN

SEQ ID NO: 354028 - protein, 10 aa, Influenza virus
NEITTKINNI

SEQ ID NO: 354029 - protein, 10 aa, Influenza virus
EITTKINNII

SEQ ID NO: 354030 - protein, 10 aa, Influenza virus
ITTKINNIIE

SEQ ID NO: 354031 - protein, 10 aa, Influenza virus
TTKINNIIEK

SEQ ID NO: 354032 - protein, 10 aa, Influenza virus
TKINNIIEKM

SEQ ID NO: 354033 - protein, 10 aa, Influenza virus
KINNIIEKMN

SEQ ID NO: 354034 - protein, 10 aa, Influenza virus
INNIIEKMNG

SEQ ID NO: 354035 - protein, 10 aa, Influenza virus
NNIIEKMNGN

SEQ ID NO: 354036 - protein, 10 aa, Influenza virus
NIIEKMNGNY

SEQ ID NO: 354037 - protein, 10 aa, Influenza virus
IIEKMNGNYD

SEQ ID NO: 354038 - protein, 10 aa, Influenza virus
IEKMNGNYDS

SEQ ID NO: 354039 - protein, 10 aa, Influenza virus
EKMNGNYDSI

SEQ ID NO: 354040 - protein, 10 aa, Influenza virus
KMNGNYDSIR

SEQ ID NO: 354041 - protein, 10 aa, Influenza virus
MNGNYDSIRG

SEQ ID NO: 354042 - protein, 10 aa, Influenza virus
NGNYDSIRGE

SEQ ID NO: 354043 - protein, 10 aa, Influenza virus
GNYDSIRGEF

SEQ ID NO: 354044 - protein, 10 aa, Influenza virus
NYDSIRGEFN

SEQ ID NO: 354045 - protein, 10 aa, Influenza virus
YDSIRGEFNQ

SEQ ID NO: 354046 - protein, 10 aa, Influenza virus
DSIRGEFNQV

SEQ ID NO: 354047 - protein, 10 aa, Influenza virus
SIRGEFNQVE

SEQ ID NO: 354048 - protein, 10 aa, Influenza virus
IRGEFNQVEK

SEQ ID NO: 354049 - protein, 10 aa, Influenza virus
RGEFNQVEKR

SEQ ID NO: 354050 - protein, 10 aa, Influenza virus
GEFNQVEKRI

SEQ ID NO: 354051 - protein, 10 aa, Influenza virus
EFNQVEKRIN

SEQ ID NO: 354052 - protein, 10 aa, Influenza virus
FNQVEKRINM

SEQ ID NO: 354053 - protein, 10 aa, Influenza virus
NQVEKRINML

SEQ ID NO: 354054 - protein, 10 aa, Influenza virus
QVEKRINMLA

SEQ ID NO: 354055 - protein, 10 aa, Influenza virus
VEKRINMLAD

SEQ ID NO: 354056 - protein, 10 aa, Influenza virus
EKRINMLADR

SEQ ID NO: 354057 - protein, 10 aa, Influenza virus
KRINMLADRV

SEQ ID NO: 354058 - protein, 10 aa, Influenza virus
RINMLADRVD

SEQ ID NO: 354059 - protein, 10 aa, Influenza virus
INMLADRVDD

SEQ ID NO: 354060 - protein, 10 aa, Influenza virus
NMLADRVDDA

SEQ ID NO: 354061 - protein, 10 aa, Influenza virus
MLADRVDDAV

SEQ ID NO: 354062 - protein, 10 aa, Influenza virus
LADRVDDAVT

SEQ ID NO: 354063 - protein, 10 aa, Influenza virus
ADRVDDAVTD

SEQ ID NO: 354064 - protein, 10 aa, Influenza virus
DRVDDAVTDI

SEQ ID NO: 354065 - protein, 10 aa, Influenza virus
RVDDAVTDIW

SEQ ID NO: 354066 - protein, 10 aa, Influenza virus
VDDAVTDIWS

SEQ ID NO: 354067 - protein, 10 aa, Influenza virus
DDAVTDIWSY

SEQ ID NO: 354068 - protein, 10 aa, Influenza virus
DAVTDIWSYN

SEQ ID NO: 354069 - protein, 10 aa, Influenza virus
AVTDIWSYNA

SEQ ID NO: 354070 - protein, 10 aa, Influenza virus
VTDIWSYNAK

SEQ ID NO: 354071 - protein, 10 aa, Influenza virus
TDIWSYNAKL

SEQ ID NO: 354072 - protein, 10 aa, Influenza virus
DIWSYNAKLL

SEQ ID NO: 354073 - protein, 10 aa, Influenza virus
IWSYNAKLLV

SEQ ID NO: 354074 - protein, 10 aa, Influenza virus
WSYNAKLLVL

SEQ ID NO: 354075 - protein, 10 aa, Influenza virus
SYNAKLLVLI

SEQ ID NO: 354076 - protein, 10 aa, Influenza virus
YNAKLLVLIE

SEQ ID NO: 354077 - protein, 10 aa, Influenza virus
NAKLLVLIEN

SEQ ID NO: 354078 - protein, 10 aa, Influenza virus
AKLLVLIEND

SEQ ID NO: 354079 - protein, 10 aa, Influenza virus
KLLVLIENDR

SEQ ID NO: 354080 - protein, 10 aa, Influenza virus
LLVLIENDRT

SEQ ID NO: 354081 - protein, 10 aa, Influenza virus
LVLIENDRTL

SEQ ID NO: 354082 - protein, 10 aa, Influenza virus
VLIENDRTLD

SEQ ID NO: 354083 - protein, 10 aa, Influenza virus
LIENDRTLDL

SEQ ID NO: 354084 - protein, 10 aa, Influenza virus
IENDRTLDLH

SEQ ID NO: 354085 - protein, 10 aa, Influenza virus
ENDRTLDLHD

SEQ ID NO: 354086 - protein, 10 aa, Influenza virus
NDRTLDLHDA

SEQ ID NO: 354087 - protein, 10 aa, Influenza virus
DRTLDLHDAN

SEQ ID NO: 354088 - protein, 10 aa, Influenza virus
RTLDLHDANV

SEQ ID NO: 354089 - protein, 10 aa, Influenza virus
TLDLHDANVR

SEQ ID NO: 354090 - protein, 10 aa, Influenza virus
LDLHDANVRN

SEQ ID NO: 354091 - protein, 10 aa, Influenza virus
DLHDANVRNL

SEQ ID NO: 354092 - protein, 10 aa, Influenza virus
LHDANVRNLH

SEQ ID NO: 354093 - protein, 10 aa, Influenza virus
HDANVRNLHD

SEQ ID NO: 354094 - protein, 10 aa, Influenza virus
DANVRNLHDQ

SEQ ID NO: 354095 - protein, 10 aa, Influenza virus
ANVRNLHDQV

SEQ ID NO: 354096 - protein, 10 aa, Influenza virus
NVRNLHDQVK

SEQ ID NO: 354097 - protein, 10 aa, Influenza virus
VRNLHDQVKR

SEQ ID NO: 354098 - protein, 10 aa, Influenza virus
LKNNAIDEGD

SEQ ID NO: 354099 - protein, 10 aa, Influenza virus
KNNAIDEGDG

SEQ ID NO: 354100 - protein, 10 aa, Influenza virus
NNAIDEGDGC

SEQ ID NO: 354101 - protein, 10 aa, Influenza virus
NAIDEGDGCF

SEQ ID NO: 354102 - protein, 10 aa, Influenza virus
AIDEGDGCFN

SEQ ID NO: 354103 - protein, 10 aa, Influenza virus
IDEGDGCFNL

SEQ ID NO: 354104 - protein, 10 aa, Influenza virus
DEGDGCFNLL

SEQ ID NO: 354105 - protein, 10 aa, Influenza virus
EGDGCFNLLH

SEQ ID NO: 354106 - protein, 10 aa, Influenza virus
GDGCFNLLHK

SEQ ID NO: 354107 - protein, 10 aa, Influenza virus
DGCFNLLHKC

SEQ ID NO: 354108 - protein, 10 aa, Influenza virus
GCFNLLHKCN

SEQ ID NO: 354109 - protein, 10 aa, Influenza virus
CFNLLHKCND

SEQ ID NO: 354110 - protein, 10 aa, Influenza virus
FNLLHKCNDS

SEQ ID NO: 354111 - protein, 10 aa, Influenza virus
NLLHKCNDSC

SEQ ID NO: 354112 - protein, 10 aa, Influenza virus
LLHKCNDSCM

SEQ ID NO: 354113 - protein, 10 aa, Influenza virus
LHKCNDSCME

SEQ ID NO: 354114 - protein, 10 aa, Influenza virus
HKCNDSCMET

SEQ ID NO: 354115 - protein, 10 aa, Influenza virus
KCNDSCMETI

SEQ ID NO: 354116 - protein, 10 aa, Influenza virus
CNDSCMETIR

SEQ ID NO: 354117 - protein, 10 aa, Influenza virus
NDSCMETIRN

SEQ ID NO: 354118 - protein, 10 aa, Influenza virus
DSCMETIRNG

SEQ ID NO: 354119 - protein, 10 aa, Influenza virus
SCMETIRNGT

SEQ ID NO: 354120 - protein, 10 aa, Influenza virus
CMETIRNGTY

SEQ ID NO: 354121 - protein, 10 aa, Influenza virus
METIRNGTYN

SEQ ID NO: 354122 - protein, 10 aa, Influenza virus
ETIRNGTYNH

SEQ ID NO: 354123 - protein, 10 aa, Influenza virus
TIRNGTYNHE

SEQ ID NO: 354124 - protein, 10 aa, Influenza virus
IRNGTYNHED

SEQ ID NO: 354125 - protein, 10 aa, Influenza virus
RNGTYNHEDY

SEQ ID NO: 354126 - protein, 10 aa, Influenza virus
NGTYNHEDYK

SEQ ID NO: 354127 - protein, 10 aa, Influenza virus
GTYNHEDYKE

SEQ ID NO: 354128 - protein, 10 aa, Influenza virus
TYNHEDYKEE

SEQ ID NO: 354129 - protein, 10 aa, Influenza virus
YNHEDYKEES

SEQ ID NO: 354130 - protein, 10 aa, Influenza virus
NHEDYKEESQ

SEQ ID NO: 354131 - protein, 10 aa, Influenza virus
HEDYKEESQL

SEQ ID NO: 354132 - protein, 10 aa, Influenza virus
EDYKEESQLK

SEQ ID NO: 354133 - protein, 10 aa, Influenza virus
DYKEESQLKR

SEQ ID NO: 354134 - protein, 10 aa, Influenza virus
YKEESQLKRQ

SEQ ID NO: 354135 - protein, 10 aa, Influenza virus
KEESQLKRQE

SEQ ID NO: 354136 - protein, 10 aa, Influenza virus
EESQLKRQEI

SEQ ID NO: 354137 - protein, 10 aa, Influenza virus
ESQLKRQEIE

SEQ ID NO: 354138 - protein, 10 aa, Influenza virus
SQLKRQEIEG

SEQ ID NO: 354139 - protein, 10 aa, Influenza virus
QLKRQEIEGI

SEQ ID NO: 354140 - protein, 10 aa, Influenza virus
LKRQEIEGIK

SEQ ID NO: 354141 - protein, 10 aa, Influenza virus
KRQEIEGIKL

SEQ ID NO: 354142 - protein, 10 aa, Influenza virus
RQEIEGIKLK

SEQ ID NO: 354143 - protein, 10 aa, Influenza virus
QEIEGIKLKT

SEQ ID NO: 354144 - protein, 10 aa, Influenza virus
EIEGIKLKTE

SEQ ID NO: 354145 - protein, 10 aa, Influenza virus
IEGIKLKTED

SEQ ID NO: 354146 - protein, 10 aa, Influenza virus
EGIKLKTEDN

SEQ ID NO: 354147 - protein, 10 aa, Influenza virus
GIKLKTEDNV

SEQ ID NO: 354148 - protein, 10 aa, Influenza virus
IKLKTEDNVY

SEQ ID NO: 354149 - protein, 10 aa, Influenza virus
KLKTEDNVYK

SEQ ID NO: 354150 - protein, 10 aa, Influenza virus
LKTEDNVYKV

SEQ ID NO: 354151 - protein, 10 aa, Influenza virus
KTEDNVYKVL

SEQ ID NO: 354152 - protein, 10 aa, Influenza virus
TEDNVYKILS

SEQ ID NO: 354153 - protein, 10 aa, Influenza virus
EDNVYKVLSI

SEQ ID NO: 354154 - protein, 10 aa, Influenza virus
DNVYKVLSIY

SEQ ID NO: 354155 - protein, 10 aa, Influenza virus
NVYKVLSIYS

SEQ ID NO: 354156 - protein, 10 aa, Influenza virus
VYKVLSIYSC

SEQ ID NO: 354157 - protein, 10 aa, Influenza virus
YKILSIYSCI

SEQ ID NO: 354158 - protein, 10 aa, Influenza virus
KILSIYSCIA

SEQ ID NO: 354159 - protein, 10 aa, Influenza virus
ILSIYSCIAS

SEQ ID NO: 354160 - protein, 10 aa, Influenza virus
LSIYSCIASS

SEQ ID NO: 354161 - protein, 10 aa, Influenza virus
SIYSCIASSI

SEQ ID NO: 354162 - protein, 10 aa, Influenza virus
IYSCIASSIV

SEQ ID NO: 354163 - protein, 10 aa, Influenza virus
YSCIASSVVL

SEQ ID NO: 354164 - protein, 10 aa, Influenza virus
SCIASSVVLV

SEQ ID NO: 354165 - protein, 10 aa, Influenza virus
CIASSVVLVG

SEQ ID NO: 354166 - protein, 10 aa, Influenza virus
IASSIVMVGL

SEQ ID NO: 354167 - protein, 10 aa, Influenza virus
ASSIVMVGLI

SEQ ID NO: 354168 - protein, 10 aa, Influenza virus
SSVVLVGLIL

SEQ ID NO: 354169 - protein, 10 aa, Influenza virus
SIVMVGLILA

SEQ ID NO: 354170 - protein, 10 aa, Influenza virus
IVLVGLILAF

SEQ ID NO: 354171 - protein, 10 aa, Influenza virus
VLVGLILAFI

SEQ ID NO: 354172 - protein, 10 aa, Influenza virus
LVGLILAFIM

SEQ ID NO: 354173 - protein, 10 aa, Influenza virus
VGLILAFIMW

SEQ ID NO: 354174 - protein, 10 aa, Influenza virus
GLILAFIMWA

SEQ ID NO: 354175 - protein, 10 aa, Influenza virus
LILAFIMWAC

SEQ ID NO: 354176 - protein, 10 aa, Influenza virus
ILAFIMWACS

SEQ ID NO: 354177 - protein, 10 aa, Influenza virus
LAFIMWACSS

SEQ ID NO: 354178 - protein, 10 aa, Influenza virus
AFIMWACSSG

SEQ ID NO: 354179 - protein, 10 aa, Influenza virus
FIMWACSSGN

SEQ ID NO: 354180 - protein, 10 aa, Influenza virus
IMWACSSGNC

SEQ ID NO: 354181 - protein, 10 aa, Influenza virus
MWACSSGNCR

SEQ ID NO: 354182 - protein, 10 aa, Influenza virus
WACSSGNCRF

SEQ ID NO: 354183 - protein, 10 aa, Influenza virus
ACSSGNCRFN

SEQ ID NO: 354184 - protein, 10 aa, Influenza virus
CSSGNCRFNV

SEQ ID NO: 354185 - protein, 10 aa, Influenza virus
SSGNCRFNVC

SEQ ID NO: 354186 - protein, 10 aa, Influenza virus
SGNCRFNVCI

SEQ ID NO: 354187 - protein, 10 aa, Influenza virus
KQGKTKATKM

SEQ ID NO: 354188 - protein, 10 aa, Influenza virus
QGKTKATKMK

SEQ ID NO: 354189 - protein, 10 aa, Influenza virus
GKTKATKMKA

SEQ ID NO: 354190 - protein, 10 aa, Influenza virus
KTKATKMKAI

SEQ ID NO: 354191 - protein, 10 aa, Influenza virus
TKATKMKAIL

SEQ ID NO: 354192 - protein, 10 aa, Influenza virus
KATKMKAILV

SEQ ID NO: 354193 - protein, 10 aa, Influenza virus
ATKMKAILVV

SEQ ID NO: 354194 - protein, 10 aa, Influenza virus
TKMKAILVVL

SEQ ID NO: 354195 - protein, 10 aa, Influenza virus
TAYSQITNGT

SEQ ID NO: 354196 - protein, 10 aa, Influenza virus
AYSQITNGTT

SEQ ID NO: 354197 - protein, 10 aa, Influenza virus
YSQITNGTTG

SEQ ID NO: 354198 - protein, 10 aa, Influenza virus
SQITNGTTGN

SEQ ID NO: 354199 - protein, 10 aa, Influenza virus
QITNGTTGNP

SEQ ID NO: 354200 - protein, 10 aa, Influenza virus
ITNGTTGNPI

SEQ ID NO: 354201 - protein, 10 aa, Influenza virus
TNGTTGNPII

SEQ ID NO: 354202 - protein, 10 aa, Influenza virus
NGTTGNPIIC

SEQ ID NO: 354203 - protein, 10 aa, Influenza virus
GTTGNPIICL

SEQ ID NO: 354204 - protein, 10 aa, Influenza virus
TTGNPIICLG

SEQ ID NO: 354205 - protein, 10 aa, Influenza virus
TGNPIICLGH

SEQ ID NO: 354206 - protein, 10 aa, Influenza virus
SNAPSGIEYN

SEQ ID NO: 354207 - protein, 10 aa, Influenza virus
NAPSGIEYNG

SEQ ID NO: 354208 - protein, 10 aa, Influenza virus
APSGIEYNGK

SEQ ID NO: 354209 - protein, 10 aa, Influenza virus
PSGIEYNGKS

SEQ ID NO: 354210 - protein, 10 aa, Influenza virus
SGIEYNGKSL

SEQ ID NO: 354211 - protein, 10 aa, Influenza virus
GIEYNGKSLG

SEQ ID NO: 354212 - protein, 10 aa, Influenza virus
IEYNGKSLGI

SEQ ID NO: 354213 - protein, 10 aa, Influenza virus
EYNGKSLGIQ

SEQ ID NO: 354214 - protein, 10 aa, Influenza virus
YNGKSLGIQS

SEQ ID NO: 354215 - protein, 10 aa, Influenza virus
NGKSLGIQSD

SEQ ID NO: 354216 - protein, 10 aa, Influenza virus
TSLTSLPFQN

SEQ ID NO: 354217 - protein, 10 aa, Influenza virus
SLTSLPFQNI

SEQ ID NO: 354218 - protein, 10 aa, Influenza virus
LTSLPFQNIH

SEQ ID NO: 354219 - protein, 10 aa, Influenza virus
RGLFGAIAGF

SEQ ID NO: 354220 - protein, 10 aa, Influenza virus
GLFGAIAGFI

SEQ ID NO: 354221 - protein, 10 aa, Influenza virus
LFGAIAGFIE

SEQ ID NO: 354222 - protein, 10 aa, Influenza virus
FGAIAGFIEG

SEQ ID NO: 354223 - protein, 10 aa, Influenza virus
GAIAGFIEGG

SEQ ID NO: 354224 - protein, 10 aa, Influenza virus
AIAGFIEGGW

SEQ ID NO: 354225 - protein, 10 aa, Influenza virus
IAGFIEGGWT

SEQ ID NO: 354226 - protein, 10 aa, Influenza virus
AGFIEGGWTG

SEQ ID NO: 354227 - protein, 10 aa, Influenza virus
GFIEGGWTGM

SEQ ID NO: 354228 - protein, 10 aa, Influenza virus
FIEGGWTGMV

SEQ ID NO: 354229 - protein, 10 aa, Influenza virus
IEGGWTGMVD

SEQ ID NO: 354230 - protein, 10 aa, Influenza virus
EGGWTGMVDG

SEQ ID NO: 354231 - protein, 10 aa, Influenza virus
GGWTGMVDGW

SEQ ID NO: 354232 - protein, 10 aa, Influenza virus
GWTGMVDGWY

SEQ ID NO: 354233 - protein, 10 aa, Influenza virus
WTGMVDGWYG

SEQ ID NO: 354234 - protein, 10 aa, Influenza virus
TGMVDGWYGY

SEQ ID NO: 354235 - protein, 10 aa, Influenza virus
GMVDGWYGYH

SEQ ID NO: 354236 - protein, 10 aa, Influenza virus
MVDGWYGYHH

SEQ ID NO: 354237 - protein, 10 aa, Influenza virus
DGWYGYHHQN

SEQ ID NO: 354238 - protein, 10 aa, Influenza virus
YNAELLVLLE

SEQ ID NO: 354239 - protein, 10 aa, Influenza virus
NAELLVLLEN

SEQ ID NO: 354240 - protein, 10 aa, Influenza virus
SGSLQCRICI

SEQ ID NO: 354241 - protein, 10 aa, Influenza virus
LCSVEYASKT

SEQ ID NO: 354242 - protein, 10 aa, Influenza virus
CSVEYASKTR

SEQ ID NO: 354243 - protein, 10 aa, Influenza virus
SVEYASKTRI

SEQ ID NO: 354244 - protein, 10 aa, Influenza virus
VEYASKTRIS

SEQ ID NO: 354245 - protein, 10 aa, Influenza virus
EYASKTRISE

SEQ ID NO: 354246 - protein, 10 aa, Influenza virus
YASKTRISEI

SEQ ID NO: 354247 - protein, 10 aa, Influenza virus
LQCRICIRAD

SEQ ID NO: 354248 - protein, 10 aa, Influenza virus
QCRICIRADG

SEQ ID NO: 354249 - protein, 10 aa, Influenza virus
CRICILDQNF

SEQ ID NO: 354250 - protein, 10 aa, Influenza virus
RICILDQNFR

SEQ ID NO: 354251 - protein, 10 aa, Influenza virus
ICILDQNFRN

SEQ ID NO: 354252 - protein, 10 aa, Influenza virus
CIDFRDMRKN

SEQ ID NO: 354253 - protein, 10 aa, Influenza virus
IDFRDMRKNT

SEQ ID NO: 354254 - protein, 10 aa, Influenza virus
DFRDMRKNTL

SEQ ID NO: 354255 - protein, 10 aa, Influenza virus
KQGKTKATKM

SEQ ID NO: 354256 - protein, 10 aa, Influenza virus
QGKTKATKMK

SEQ ID NO: 354257 - protein, 10 aa, Influenza virus
GKTKATKMKA

SEQ ID NO: 354258 - protein, 10 aa, Influenza virus
KTKATKMKAI

SEQ ID NO: 354259 - protein, 10 aa, Influenza virus
TKATKMKAIL

SEQ ID NO: 354260 - protein, 10 aa, Influenza virus
KATKMKAILV

SEQ ID NO: 354261 - protein, 10 aa, Influenza virus
ATKMKAILVV

SEQ ID NO: 354262 - protein, 10 aa, Influenza virus
TKMKAILVVL

SEQ ID NO: 354263 - protein, 10 aa, Influenza virus
KMKAILVVLL

SEQ ID NO: 354264 - protein, 10 aa, Influenza virus
IIIVVLLYTF

SEQ ID NO: 354265 - protein, 10 aa, Influenza virus
ADTLCIGYHA

SEQ ID NO: 354266 - protein, 10 aa, Influenza virus
DTLCIGYHAN

SEQ ID NO: 354267 - protein, 10 aa, Influenza virus
TLCIGYHANN

SEQ ID NO: 354268 - protein, 10 aa, Influenza virus
LCIGYHANNS

SEQ ID NO: 354269 - protein, 10 aa, Influenza virus
CIGYHANNST

SEQ ID NO: 354270 - protein, 10 aa, Influenza virus
IGYHANNSTD

SEQ ID NO: 354271 - protein, 10 aa, Influenza virus
GYHANNSTDT

SEQ ID NO: 354272 - protein, 10 aa, Influenza virus
YHANNSTDTV

SEQ ID NO: 354273 - protein, 10 aa, Influenza virus
HANNSTDTVD

SEQ ID NO: 354274 - protein, 10 aa, Influenza virus
ANNSTDTVDT

SEQ ID NO: 354275 - protein, 10 aa, Influenza virus
NNSTDTVDTV

SEQ ID NO: 354276 - protein, 10 aa, Influenza virus
NSTDTVDTVL

SEQ ID NO: 354277 - protein, 10 aa, Influenza virus
STDTVDTVLE

SEQ ID NO: 354278 - protein, 10 aa, Influenza virus
TDTVDTVLEK

SEQ ID NO: 354279 - protein, 10 aa, Influenza virus
DTVDTVLEKN

SEQ ID NO: 354280 - protein, 10 aa, Influenza virus
TVDTVLEKNV

SEQ ID NO: 354281 - protein, 10 aa, Influenza virus
VDTVLEKNVT

SEQ ID NO: 354282 - protein, 10 aa, Influenza virus
DTVLEKNVTV

SEQ ID NO: 354283 - protein, 10 aa, Influenza virus
TVLEKNVTVT

SEQ ID NO: 354284 - protein, 10 aa, Influenza virus
VLEKNVTVTH

SEQ ID NO: 354285 - protein, 10 aa, Influenza virus
LEKNVTVTHS

SEQ ID NO: 354286 - protein, 10 aa, Influenza virus
EKNVTVTHSV

SEQ ID NO: 354287 - protein, 10 aa, Influenza virus
KNVTVTHSVN

SEQ ID NO: 354288 - protein, 10 aa, Influenza virus
NVTVTHSVNL

SEQ ID NO: 354289 - protein, 10 aa, Influenza virus
VTVTHSVNLL

SEQ ID NO: 354290 - protein, 10 aa, Influenza virus
TVTHSVNLLE

SEQ ID NO: 354291 - protein, 10 aa, Influenza virus
IAGWILGNPE

SEQ ID NO: 354292 - protein, 10 aa, Influenza virus
AGWILGNPEC

SEQ ID NO: 354293 - protein, 10 aa, Influenza virus
DYEELREQLS

SEQ ID NO: 354294 - protein, 10 aa, Influenza virus
YEELREQLSS

SEQ ID NO: 354295 - protein, 10 aa, Influenza virus
EELREQLSSV

SEQ ID NO: 354296 - protein, 10 aa, Influenza virus
ELREQLSSVS

SEQ ID NO: 354297 - protein, 10 aa, Influenza virus
LREQLSSVSS

SEQ ID NO: 354298 - protein, 10 aa, Influenza virus
REQLSSVSSF

SEQ ID NO: 354299 - protein, 10 aa, Influenza virus
EQLSSVSSFE

SEQ ID NO: 354300 - protein, 10 aa, Influenza virus
QLSSVSSFER

SEQ ID NO: 354301 - protein, 10 aa, Influenza virus
LSSVSSFERF

SEQ ID NO: 354302 - protein, 10 aa, Influenza virus
SSVSSFERFE

SEQ ID NO: 354303 - protein, 10 aa, Influenza virus
SVSSFERFEI

SEQ ID NO: 354304 - protein, 10 aa, Influenza virus
VSSFERFEIF

SEQ ID NO: 354305 - protein, 10 aa, Influenza virus
SSFERFEIFP

SEQ ID NO: 354306 - protein, 10 aa, Influenza virus
SFERFEIFPK

SEQ ID NO: 354307 - protein, 10 aa, Influenza virus
KEKENSYPMI

SEQ ID NO: 354308 - protein, 10 aa, Influenza virus
EKENSYPMIN

SEQ ID NO: 354309 - protein, 10 aa, Influenza virus
DKITFEATGN

SEQ ID NO: 354310 - protein, 10 aa, Influenza virus
KITFEATGNL

SEQ ID NO: 354311 - protein, 10 aa, Influenza virus
FEATGNLVVP

SEQ ID NO: 354312 - protein, 10 aa, Influenza virus
TSLTSLPFQN

SEQ ID NO: 354313 - protein, 10 aa, Influenza virus
SLTSLPFQNI

SEQ ID NO: 354314 - protein, 10 aa, Influenza virus
LTSLPFQNIH

SEQ ID NO: 354315 - protein, 10 aa, Influenza virus
ITIGKCPKYV

SEQ ID NO: 354316 - protein, 10 aa, Influenza virus
TIGKCPKYVK

SEQ ID NO: 354317 - protein, 10 aa, Influenza virus
IGKCPKYVKS

SEQ ID NO: 354318 - protein, 10 aa, Influenza virus
GKCPKYVKST

SEQ ID NO: 354319 - protein, 10 aa, Influenza virus
KLRLATGLRN

SEQ ID NO: 354320 - protein, 10 aa, Influenza virus
LRLATGLRNV

SEQ ID NO: 354321 - protein, 10 aa, Influenza virus
RLATGLRNVP

SEQ ID NO: 354322 - protein, 10 aa, Influenza virus
LATGLRNVPS

SEQ ID NO: 354323 - protein, 10 aa, Influenza virus
ATGLRNVPSI

SEQ ID NO: 354324 - protein, 10 aa, Influenza virus
TGLRNVPSIQ

SEQ ID NO: 354325 - protein, 10 aa, Influenza virus
GLRNVPSIQS

SEQ ID NO: 354326 - protein, 10 aa, Influenza virus
LRNVPSIQSR

SEQ ID NO: 354327 - protein, 10 aa, Influenza virus
RNVPSIQSRG

SEQ ID NO: 354328 - protein, 10 aa, Influenza virus
NVPSIQSRGL

SEQ ID NO: 354329 - protein, 10 aa, Influenza virus
VPSIQSRGLF

SEQ ID NO: 354330 - protein, 10 aa, Influenza virus
PSIQSRGLFG

SEQ ID NO: 354331 - protein, 10 aa, Influenza virus
SIQSRGLFGA

SEQ ID NO: 354332 - protein, 10 aa, Influenza virus
IQSRGLFGAI

SEQ ID NO: 354333 - protein, 10 aa, Influenza virus
QSRGLFGAIA

SEQ ID NO: 354334 - protein, 10 aa, Influenza virus
SRGLFGAIAG

SEQ ID NO: 354335 - protein, 10 aa, Influenza virus
RGLFGAIAGF

SEQ ID NO: 354336 - protein, 10 aa, Influenza virus
GLFGAIAGFI

SEQ ID NO: 354337 - protein, 10 aa, Influenza virus
LFGAIAGFIE

SEQ ID NO: 354338 - protein, 10 aa, Influenza virus
FGAIAGFIEG

SEQ ID NO: 354339 - protein, 10 aa, Influenza virus
GAIAGFIEGG

SEQ ID NO: 354340 - protein, 10 aa, Influenza virus
AIAGFIEGGW

SEQ ID NO: 354341 - protein, 10 aa, Influenza virus
IAGFIEGGWT

SEQ ID NO: 354342 - protein, 10 aa, Influenza virus
AGFIEGGWTG

SEQ ID NO: 354343 - protein, 10 aa, Influenza virus
GFIEGGWTGM

SEQ ID NO: 354344 - protein, 10 aa, Influenza virus
FIEGGWTGMV

SEQ ID NO: 354345 - protein, 10 aa, Influenza virus
IEGGWTGMVD

SEQ ID NO: 354346 - protein, 10 aa, Influenza virus
EGGWTGMVDG

SEQ ID NO: 354347 - protein, 10 aa, Influenza virus
GGWTGMVDGW

SEQ ID NO: 354348 - protein, 10 aa, Influenza virus
GWTGMVDGWY

SEQ ID NO: 354349 - protein, 10 aa, Influenza virus
WTGMVDGWYG

SEQ ID NO: 354350 - protein, 10 aa, Influenza virus
TGMVDGWYGY

SEQ ID NO: 354351 - protein, 10 aa, Influenza virus
GMVDGWYGYH

SEQ ID NO: 354352 - protein, 10 aa, Influenza virus
MVDGWYGYHH

SEQ ID NO: 354353 - protein, 10 aa, Influenza virus
VDGWYGYHHQ

SEQ ID NO: 354354 - protein, 10 aa, Influenza virus
DGWYGYHHQN

SEQ ID NO: 354355 - protein, 10 aa, Influenza virus
GWYGYHHQNE

SEQ ID NO: 354356 - protein, 10 aa, Influenza virus
WYGYHHQNEQ

SEQ ID NO: 354357 - protein, 10 aa, Influenza virus
YGYHHQNEQG

SEQ ID NO: 354358 - protein, 10 aa, Influenza virus
GYHHQNEQGS

SEQ ID NO: 354359 - protein, 10 aa, Influenza virus
YHHQNEQGSG

SEQ ID NO: 354360 - protein, 10 aa, Influenza virus
HHQNEQGSGY

SEQ ID NO: 354361 - protein, 10 aa, Influenza virus
HQNEQGSGYA

SEQ ID NO: 354362 - protein, 10 aa, Influenza virus
QNEQGSGYAA

SEQ ID NO: 354363 - protein, 10 aa, Influenza virus
NEQGSGYAAD

SEQ ID NO: 354364 - protein, 10 aa, Influenza virus
EQGSGYAADL

SEQ ID NO: 354365 - protein, 10 aa, Influenza virus
QGSGYAADLK

SEQ ID NO: 354366 - protein, 10 aa, Influenza virus
GSGYAADLKS

SEQ ID NO: 354367 - protein, 10 aa, Influenza virus
SGYAADLKST

SEQ ID NO: 354368 - protein, 10 aa, Influenza virus
GYAADLKSTQ

SEQ ID NO: 354369 - protein, 10 aa, Influenza virus
NKVNSVIEKM

SEQ ID NO: 354370 - protein, 10 aa, Influenza virus
KVNSVIEKMN

SEQ ID NO: 354371 - protein, 10 aa, Influenza virus
NSVIEKMNTQ

SEQ ID NO: 354372 - protein, 10 aa, Influenza virus
SVIEKMNTQF

SEQ ID NO: 354373 - protein, 10 aa, Influenza virus
VIEKMNTQFT

SEQ ID NO: 354374 - protein, 10 aa, Influenza virus
IEKMNTQFTA

SEQ ID NO: 354375 - protein, 10 aa, Influenza virus
EKMNTQFTAV

SEQ ID NO: 354376 - protein, 10 aa, Influenza virus
KMNTQFTAVG

SEQ ID NO: 354377 - protein, 10 aa, Influenza virus
MNTQFTAVGK

SEQ ID NO: 354378 - protein, 10 aa, Influenza virus
NTQFTAVGKE

SEQ ID NO: 354379 - protein, 10 aa, Influenza virus
TQFTAVGKEF

SEQ ID NO: 354380 - protein, 10 aa, Influenza virus
QFTAVGKEFN

SEQ ID NO: 354381 - protein, 10 aa, Influenza virus
RIENLNKKVD

SEQ ID NO: 354382 - protein, 10 aa, Influenza virus
IENLNKKVDD

SEQ ID NO: 354383 - protein, 10 aa, Influenza virus
ENLNKKVDDG

SEQ ID NO: 354384 - protein, 10 aa, Influenza virus
NLNKKVDDGF

SEQ ID NO: 354385 - protein, 10 aa, Influenza virus
LNKKVDDGFL

SEQ ID NO: 354386 - protein, 10 aa, Influenza virus
NKKVDDGFLD

SEQ ID NO: 354387 - protein, 10 aa, Influenza virus
DDGFLDIWTY

SEQ ID NO: 354388 - protein, 10 aa, Influenza virus
DGFLDIWTYN

SEQ ID NO: 354389 - protein, 10 aa, Influenza virus
GFLDIWTYNA

SEQ ID NO: 354390 - protein, 10 aa, Influenza virus
FLDIWTYNAE

SEQ ID NO: 354391 - protein, 10 aa, Influenza virus
LDIWTYNAEL

SEQ ID NO: 354392 - protein, 10 aa, Influenza virus
DIWTYNAELL

SEQ ID NO: 354393 - protein, 10 aa, Influenza virus
IWTYNAELLV

SEQ ID NO: 354394 - protein, 10 aa, Influenza virus
WTYNAELLVL

SEQ ID NO: 354395 - protein, 10 aa, Influenza virus
TYNAELLVLL

SEQ ID NO: 354396 - protein, 10 aa, Influenza virus
YNAELLVLLE

SEQ ID NO: 354397 - protein, 10 aa, Influenza virus
NAELLVLLEN

SEQ ID NO: 354398 - protein, 10 aa, Influenza virus
AELLVLLENE

SEQ ID NO: 354399 - protein, 10 aa, Influenza virus
ELLVLLENER

SEQ ID NO: 354400 - protein, 10 aa, Influenza virus
LLVLLENERT

SEQ ID NO: 354401 - protein, 10 aa, Influenza virus
LVLLENERTL

SEQ ID NO: 354402 - protein, 10 aa, Influenza virus
VLLENERTLD

SEQ ID NO: 354403 - protein, 10 aa, Influenza virus
LLENERTLDY

SEQ ID NO: 354404 - protein, 10 aa, Influenza virus
LENERTLDYH

SEQ ID NO: 354405 - protein, 10 aa, Influenza virus
ENERTLDYHD

SEQ ID NO: 354406 - protein, 10 aa, Influenza virus
NERTLDYHDS

SEQ ID NO: 354407 - protein, 10 aa, Influenza virus
NNAKEIGNGC

SEQ ID NO: 354408 - protein, 10 aa, Influenza virus
NAKEIGNGCF

SEQ ID NO: 354409 - protein, 10 aa, Influenza virus
AKEIGNGCFE

SEQ ID NO: 354410 - protein, 10 aa, Influenza virus
KEIGNGCFEF

SEQ ID NO: 354411 - protein, 10 aa, Influenza virus
EIGNGCFEFY

SEQ ID NO: 354412 - protein, 10 aa, Influenza virus
IGNGCFEFYH

SEQ ID NO: 354413 - protein, 10 aa, Influenza virus
GNGCFEFYHK

SEQ ID NO: 354414 - protein, 10 aa, Influenza virus
NGCFEFYHKC

SEQ ID NO: 354415 - protein, 10 aa, Influenza virus
GCFEFYHKCD

SEQ ID NO: 354416 - protein, 10 aa, Influenza virus
CFEFYHKCDN

SEQ ID NO: 354417 - protein, 10 aa, Influenza virus
CMESVKNGTY

SEQ ID NO: 354418 - protein, 10 aa, Influenza virus
MESVKNGTYD

SEQ ID NO: 354419 - protein, 10 aa, Influenza virus
ESVKNGTYDY

SEQ ID NO: 354420 - protein, 10 aa, Influenza virus
SVKNGTYDYP

SEQ ID NO: 354421 - protein, 10 aa, Influenza virus
VKNGTYDYPK

SEQ ID NO: 354422 - protein, 10 aa, Influenza virus
KNGTYDYPKY

SEQ ID NO: 354423 - protein, 10 aa, Influenza virus
NGTYDYPKYS

SEQ ID NO: 354424 - protein, 10 aa, Influenza virus
GTYDYPKYSE

SEQ ID NO: 354425 - protein, 10 aa, Influenza virus
TYDYPKYSEE

SEQ ID NO: 354426 - protein, 10 aa, Influenza virus
YDYPKYSEEA

SEQ ID NO: 354427 - protein, 10 aa, Influenza virus
YPKYSEEAKL

SEQ ID NO: 354428 - protein, 10 aa, Influenza virus
IYQILAIYST

SEQ ID NO: 354429 - protein, 10 aa, Influenza virus
YQILAIYSTV

SEQ ID NO: 354430 - protein, 10 aa, Influenza virus
QILAIYSTVA

SEQ ID NO: 354431 - protein, 10 aa, Influenza virus
ILAIYSTVAS

SEQ ID NO: 354432 - protein, 10 aa, Influenza virus
LAIYSTVASS

SEQ ID NO: 354433 - protein, 10 aa, Influenza virus
AIYSTVASSL

SEQ ID NO: 354434 - protein, 10 aa, Influenza virus
IYSTVASSLV

SEQ ID NO: 354435 - protein, 10 aa, Influenza virus
YSTVASSLVL

SEQ ID NO: 354436 - protein, 10 aa, Influenza virus
ASSLVLVVSL

SEQ ID NO: 354437 - protein, 10 aa, Influenza virus
SSLVLVVSLG

SEQ ID NO: 354438 - protein, 10 aa, Influenza virus
SLVLVVSLGA

SEQ ID NO: 354439 - protein, 10 aa, Influenza virus
LVVSLGAISF

SEQ ID NO: 354440 - protein, 10 aa, Influenza virus
VVSLGAISFW

SEQ ID NO: 354441 - protein, 10 aa, Influenza virus
VSLGAISFWM

SEQ ID NO: 354442 - protein, 10 aa, Influenza virus
SLGAISFWMC

SEQ ID NO: 354443 - protein, 10 aa, Influenza virus
LGAISFWMCS

SEQ ID NO: 354444 - protein, 10 aa, Influenza virus
GAISFWMCSN

SEQ ID NO: 354445 - protein, 10 aa, Influenza virus
AISFWMCSNG

SEQ ID NO: 354446 - protein, 10 aa, Influenza virus
ISFWMCSNGS

SEQ ID NO: 354447 - protein, 10 aa, Influenza virus
SFWMCSNGSL

SEQ ID NO: 354448 - protein, 10 aa, Influenza virus
FWMCSNGSLQ

SEQ ID NO: 354449 - protein, 10 aa, Influenza virus
WMCSNGSLQC

SEQ ID NO: 354450 - protein, 10 aa, Influenza virus
MCSNGSLQCR

SEQ ID NO: 354451 - protein, 10 aa, Influenza virus
CSNGSLQCRI

SEQ ID NO: 354452 - protein, 10 aa, Influenza virus
SNGSLQCRIC

SEQ ID NO: 354453 - protein, 10 aa, Influenza virus
NGSLQCRICI

SEQ ID NO: 354454 - protein, 10 aa, Influenza virus
SGSLQCRICI

SEQ ID NO: 354455 - protein, 10 aa, Influenza virus
LCSVEYASKT

SEQ ID NO: 354456 - protein, 10 aa, Influenza virus
CSVEYASKTR

SEQ ID NO: 354457 - protein, 10 aa, Influenza virus
SVEYASKTRI

SEQ ID NO: 354458 - protein, 10 aa, Influenza virus
VEYASKTRIS

SEQ ID NO: 354459 - protein, 10 aa, Influenza virus
EYASKTRISE

SEQ ID NO: 354460 - protein, 10 aa, Influenza virus
YASKTRISEI

SEQ ID NO: 354461 - protein, 10 aa, Influenza virus
LQCRICIRAD

SEQ ID NO: 354462 - protein, 10 aa, Influenza virus
QCRICIRADG

SEQ ID NO: 354463 - protein, 10 aa, Influenza virus
CRICILDQNF

SEQ ID NO: 354464 - protein, 10 aa, Influenza virus
RICILDQNFR

SEQ ID NO: 354465 - protein, 10 aa, Influenza virus
ICILDQNFRN

SEQ ID NO: 354466 - protein, 10 aa, Influenza virus
CIDFRDMRKN

SEQ ID NO: 354467 - protein, 10 aa, Influenza virus
ILDQNFRNIR

SEQ ID NO: 354468 - protein, 10 aa, Influenza virus
DFRDMRKNTL

SEQ ID NO: 354469 - protein, 10 aa, Influenza virus
IGLREQKQEF

SEQ ID NO: 354470 - protein, 10 aa, Influenza virus
GLREQKQEFK

SEQ ID NO: 354471 - protein, 10 aa, Influenza virus
LREQKQEFKM

SEQ ID NO: 354472 - protein, 10 aa, Influenza virus
REQKQEFKMN

SEQ ID NO: 354473 - protein, 10 aa, Influenza virus
EQKQEFKMNP

SEQ ID NO: 354474 - protein, 10 aa, Influenza virus
QKQEFKMNPN

SEQ ID NO: 354475 - protein, 10 aa, Influenza virus
KQEFKMNPNQ

SEQ ID NO: 354476 - protein, 10 aa, Influenza virus
QEFKMNPNQK

SEQ ID NO: 354477 - protein, 10 aa, Influenza virus
EFKMNPNQKI

SEQ ID NO: 354478 - protein, 10 aa, Influenza virus
FKMNPNQKII

SEQ ID NO: 354479 - protein, 10 aa, Influenza virus
KMNPNQKIII

SEQ ID NO: 354480 - protein, 10 aa, Influenza virus
GWAIYSKDNS

SEQ ID NO: 354481 - protein, 10 aa, Influenza virus
SKDNSIRIGS

SEQ ID NO: 354482 - protein, 10 aa, Influenza virus
KDNSIRIGSK

SEQ ID NO: 354483 - protein, 10 aa, Influenza virus
DNSIRIGSKG

SEQ ID NO: 354484 - protein, 10 aa, Influenza virus
NSIRIGSKGD

SEQ ID NO: 354485 - protein, 10 aa, Influenza virus
SIRIGSKGDV

SEQ ID NO: 354486 - protein, 10 aa, Influenza virus
IRIGSKGDVF

SEQ ID NO: 354487 - protein, 10 aa, Influenza virus
RIGSKGDVFV

SEQ ID NO: 354488 - protein, 10 aa, Influenza virus
IGSKGDVFVI

SEQ ID NO: 354489 - protein, 10 aa, Influenza virus
GSKGDVFVIR

SEQ ID NO: 354490 - protein, 10 aa, Influenza virus
SKGDVFVIRE

SEQ ID NO: 354491 - protein, 10 aa, Influenza virus
KGDVFVIREP

SEQ ID NO: 354492 - protein, 10 aa, Influenza virus
GDVFVIREPF

SEQ ID NO: 354493 - protein, 10 aa, Influenza virus
DVFVIREPFI

SEQ ID NO: 354494 - protein, 10 aa, Influenza virus
VFVIREPFIS

SEQ ID NO: 354495 - protein, 10 aa, Influenza virus
FVIREPFISC

SEQ ID NO: 354496 - protein, 10 aa, Influenza virus
VIREPFISCS

SEQ ID NO: 354497 - protein, 10 aa, Influenza virus
IREPFISCSP

SEQ ID NO: 354498 - protein, 10 aa, Influenza virus
REPFISCSPL

SEQ ID NO: 354499 - protein, 10 aa, Influenza virus
EPFISCSPLE

SEQ ID NO: 354500 - protein, 10 aa, Influenza virus
PFISCSPLEC

SEQ ID NO: 354501 - protein, 10 aa, Influenza virus
LECRTFFLTQ

SEQ ID NO: 354502 - protein, 10 aa, Influenza virus
ECRTFFLTQG

SEQ ID NO: 354503 - protein, 10 aa, Influenza virus
CRTFFLTQGA

SEQ ID NO: 354504 - protein, 10 aa, Influenza virus
RTFFLTQGAL

SEQ ID NO: 354505 - protein, 10 aa, Influenza virus
TFFLTQGALL

SEQ ID NO: 354506 - protein, 10 aa, Influenza virus
FFLTQGALLN

SEQ ID NO: 354507 - protein, 10 aa, Influenza virus
FLTQGALLND

SEQ ID NO: 354508 - protein, 10 aa, Influenza virus
LTQGALLNDK

SEQ ID NO: 354509 - protein, 10 aa, Influenza virus
TQGALLNDKH

SEQ ID NO: 354510 - protein, 10 aa, Influenza virus
QGALLNDKHS

SEQ ID NO: 354511 - protein, 10 aa, Influenza virus
GALLNDKHSN

SEQ ID NO: 354512 - protein, 10 aa, Influenza virus
ALLNDKHSNG

SEQ ID NO: 354513 - protein, 10 aa, Influenza virus
LLNDKHSNGT

SEQ ID NO: 354514 - protein, 10 aa, Influenza virus
LNDKHSNGTI

SEQ ID NO: 354515 - protein, 10 aa, Influenza virus
NDKHSNGTIK

SEQ ID NO: 354516 - protein, 10 aa, Influenza virus
HSNGTIKDRS

SEQ ID NO: 354517 - protein, 10 aa, Influenza virus
KDRSPYRTLM

SEQ ID NO: 354518 - protein, 10 aa, Influenza virus
DRSPYRTLMS

SEQ ID NO: 354519 - protein, 10 aa, Influenza virus
RSPYRTLMSC

SEQ ID NO: 354520 - protein, 10 aa, Influenza virus
SPYRTLMSCP

SEQ ID NO: 354521 - protein, 10 aa, Influenza virus
RTLMSCPIGE

SEQ ID NO: 354522 - protein, 10 aa, Influenza virus
LMSCPIGEVP

SEQ ID NO: 354523 - protein, 10 aa, Influenza virus
MSCPIGEVPS

SEQ ID NO: 354524 - protein, 10 aa, Influenza virus
SCPIGEVPSP

SEQ ID NO: 354525 - protein, 10 aa, Influenza virus
CPIGEVPSPY

SEQ ID NO: 354526 - protein, 10 aa, Influenza virus
PIGEVPSPYN

SEQ ID NO: 354527 - protein, 10 aa, Influenza virus
IGEVPSPYNS

SEQ ID NO: 354528 - protein, 10 aa, Influenza virus
GEVPSPYNSR

SEQ ID NO: 354529 - protein, 10 aa, Influenza virus
EVPSPYNSRF

SEQ ID NO: 354530 - protein, 10 aa, Influenza virus
VPSPYNSRFE

SEQ ID NO: 354531 - protein, 10 aa, Influenza virus
PSPYNSRFES

SEQ ID NO: 354532 - protein, 10 aa, Influenza virus
SPYNSRFESV

SEQ ID NO: 354533 - protein, 10 aa, Influenza virus
PYNSRFESVA

SEQ ID NO: 354534 - protein, 10 aa, Influenza virus
YNSRFESVAW

SEQ ID NO: 354535 - protein, 10 aa, Influenza virus
NSRFESVAWS

SEQ ID NO: 354536 - protein, 10 aa, Influenza virus
SRFESVAWSA

SEQ ID NO: 354537 - protein, 10 aa, Influenza virus
RFESVAWSAS

SEQ ID NO: 354538 - protein, 10 aa, Influenza virus
FESVAWSASA

SEQ ID NO: 354539 - protein, 10 aa, Influenza virus
ESVAWSASAC

SEQ ID NO: 354540 - protein, 10 aa, Influenza virus
SVAWSASACH

SEQ ID NO: 354541 - protein, 10 aa, Influenza virus
VAWSASACHD

SEQ ID NO: 354542 - protein, 10 aa, Influenza virus
AWSASACHDG

SEQ ID NO: 354543 - protein, 10 aa, Influenza virus
WSASACHDGI

SEQ ID NO: 354544 - protein, 10 aa, Influenza virus
NWLTIGISGP

SEQ ID NO: 354545 - protein, 10 aa, Influenza virus
WLTIGISGPD

SEQ ID NO: 354546 - protein, 10 aa, Influenza virus
LTIGISGPDN

SEQ ID NO: 354547 - protein, 10 aa, Influenza virus
TIGISGPDNG

SEQ ID NO: 354548 - protein, 10 aa, Influenza virus
IGISGPDNGA

SEQ ID NO: 354549 - protein, 10 aa, Influenza virus
GISGPDNGAV

SEQ ID NO: 354550 - protein, 10 aa, Influenza virus
ISGPDNGAVA

SEQ ID NO: 354551 - protein, 10 aa, Influenza virus
SGPDNGAVAV

SEQ ID NO: 354552 - protein, 10 aa, Influenza virus
GPDNGAVAVL

SEQ ID NO: 354553 - protein, 10 aa, Influenza virus
PDNGAVAVLK

SEQ ID NO: 354554 - protein, 10 aa, Influenza virus
DNGAVAVLKY

SEQ ID NO: 354555 - protein, 10 aa, Influenza virus
NGAVAVLKYN

SEQ ID NO: 354556 - protein, 10 aa, Influenza virus
GAVAVLKYNG

SEQ ID NO: 354557 - protein, 10 aa, Influenza virus
AVAVLKYNGI

SEQ ID NO: 354558 - protein, 10 aa, Influenza virus
VAVLKYNGII

SEQ ID NO: 354559 - protein, 10 aa, Influenza virus
AVLKYNGIIT

SEQ ID NO: 354560 - protein, 10 aa, Influenza virus
VLKYNGIITD

SEQ ID NO: 354561 - protein, 10 aa, Influenza virus
LKYNGIITDT

SEQ ID NO: 354562 - protein, 10 aa, Influenza virus
GIITDTIKSW

SEQ ID NO: 354563 - protein, 10 aa, Influenza virus
NILRTQESEC

SEQ ID NO: 354564 - protein, 10 aa, Influenza virus
ILRTQESECA

SEQ ID NO: 354565 - protein, 10 aa, Influenza virus
LRTQESECAC

SEQ ID NO: 354566 - protein, 10 aa, Influenza virus
RTQESECACV

SEQ ID NO: 354567 - protein, 10 aa, Influenza virus
TQESECACVN

SEQ ID NO: 354568 - protein, 10 aa, Influenza virus
QESECACVNG

SEQ ID NO: 354569 - protein, 10 aa, Influenza virus
ESECACVNGS

SEQ ID NO: 354570 - protein, 10 aa, Influenza virus
SECACVNGSC

SEQ ID NO: 354571 - protein, 10 aa, Influenza virus
NGSCFTVMTD

SEQ ID NO: 354572 - protein, 10 aa, Influenza virus
GSCFTVMTDG

SEQ ID NO: 354573 - protein, 10 aa, Influenza virus
SCFTVMTDGP

SEQ ID NO: 354574 - protein, 10 aa, Influenza virus
CFTVMTDGPS

SEQ ID NO: 354575 - protein, 10 aa, Influenza virus
VMGQASYKIF

SEQ ID NO: 354576 - protein, 10 aa, Influenza virus
APNYHYEECS

SEQ ID NO: 354577 - protein, 10 aa, Influenza virus
PNYHYEECSC

SEQ ID NO: 354578 - protein, 10 aa, Influenza virus
NYHYEECSCY

SEQ ID NO: 354579 - protein, 10 aa, Influenza virus
YHYEECSCYP

SEQ ID NO: 354580 - protein, 10 aa, Influenza virus
HYEECSCYPD

SEQ ID NO: 354581 - protein, 10 aa, Influenza virus
YEECSCYPDS

SEQ ID NO: 354582 - protein, 10 aa, Influenza virus
ITCVCRDNWH

SEQ ID NO: 354583 - protein, 10 aa, Influenza virus
TCVCRDNWHG

SEQ ID NO: 354584 - protein, 10 aa, Influenza virus
CVCRDNWHGS

SEQ ID NO: 354585 - protein, 10 aa, Influenza virus
VCRDNWHGSN

SEQ ID NO: 354586 - protein, 10 aa, Influenza virus
CRDNWHGSNR

SEQ ID NO: 354587 - protein, 10 aa, Influenza virus
RDNWHGSNRP

SEQ ID NO: 354588 - protein, 10 aa, Influenza virus
DNWHGSNRPW

SEQ ID NO: 354589 - protein, 10 aa, Influenza virus
NWHGSNRPWV

SEQ ID NO: 354590 - protein, 10 aa, Influenza virus
WHGSNRPWVS

SEQ ID NO: 354591 - protein, 10 aa, Influenza virus
HGSNRPWVSF

SEQ ID NO: 354592 - protein, 10 aa, Influenza virus
GSNRPWVSFN

SEQ ID NO: 354593 - protein, 10 aa, Influenza virus
SNRPWVSFNQ

SEQ ID NO: 354594 - protein, 10 aa, Influenza virus
NRPWVSFNQN

SEQ ID NO: 354595 - protein, 10 aa, Influenza virus
RPWVSFNQNL

SEQ ID NO: 354596 - protein, 10 aa, Influenza virus
IGYICSGIFG

SEQ ID NO: 354597 - protein, 10 aa, Influenza virus
GYICSGIFGD

SEQ ID NO: 354598 - protein, 10 aa, Influenza virus
YICSGIFGDN

SEQ ID NO: 354599 - protein, 10 aa, Influenza virus
ICSGIFGDNP

SEQ ID NO: 354600 - protein, 10 aa, Influenza virus
CSGIFGDNPR

SEQ ID NO: 354601 - protein, 10 aa, Influenza virus
SGIFGDNPRP

SEQ ID NO: 354602 - protein, 10 aa, Influenza virus
GANGVKGFSF

SEQ ID NO: 354603 - protein, 10 aa, Influenza virus
GVKGFSFKYG

SEQ ID NO: 354604 - protein, 10 aa, Influenza virus
KGFSFKYGNG

SEQ ID NO: 354605 - protein, 10 aa, Influenza virus
GFSFKYGNGV

SEQ ID NO: 354606 - protein, 10 aa, Influenza virus
FSFKYGNGVW

SEQ ID NO: 354607 - protein, 10 aa, Influenza virus
KYGNGVWIGR

SEQ ID NO: 354608 - protein, 10 aa, Influenza virus
YGNGVWIGRT

SEQ ID NO: 354609 - protein, 10 aa, Influenza virus
GNGVWIGRTK

SEQ ID NO: 354610 - protein, 10 aa, Influenza virus
NGVWIGRTKS

SEQ ID NO: 354611 - protein, 10 aa, Influenza virus
GVWIGRTKSI

SEQ ID NO: 354612 - protein, 10 aa, Influenza virus
GFEMIWDPNG

SEQ ID NO: 354613 - protein, 10 aa, Influenza virus
FEMIWDPNGW

SEQ ID NO: 354614 - protein, 10 aa, Influenza virus
EMIWDPNGWT

SEQ ID NO: 354615 - protein, 10 aa, Influenza virus
NEWSGYSGSF

SEQ ID NO: 354616 - protein, 10 aa, Influenza virus
EWSGYSGSFV

SEQ ID NO: 354617 - protein, 10 aa, Influenza virus
WSGYSGSFVQ

SEQ ID NO: 354618 - protein, 10 aa, Influenza virus
SGYSGSFVQH

SEQ ID NO: 354619 - protein, 10 aa, Influenza virus
GYSGSFVQHP

SEQ ID NO: 354620 - protein, 10 aa, Influenza virus
YSGSFVQHPE

SEQ ID NO: 354621 - protein, 10 aa, Influenza virus
SGSFVQHPEL

SEQ ID NO: 354622 - protein, 10 aa, Influenza virus
GSFVQHPELT

SEQ ID NO: 354623 - protein, 10 aa, Influenza virus
SFVQHPELTG

SEQ ID NO: 354624 - protein, 10 aa, Influenza virus
FVQHPELTGL

SEQ ID NO: 354625 - protein, 10 aa, Influenza virus
VQHPELTGLD

SEQ ID NO: 354626 - protein, 10 aa, Influenza virus
QHPELTGLDC

SEQ ID NO: 354627 - protein, 10 aa, Influenza virus
HPELTGLDCI

SEQ ID NO: 354628 - protein, 10 aa, Influenza virus
DCIRPCFWVE

SEQ ID NO: 354629 - protein, 10 aa, Influenza virus
CIRPCFWVEL

SEQ ID NO: 354630 - protein, 10 aa, Influenza virus
IRPCFWVELI

SEQ ID NO: 354631 - protein, 10 aa, Influenza virus
RPCFWVELIR

SEQ ID NO: 354632 - protein, 10 aa, Influenza virus
PCFWVELIRG

SEQ ID NO: 354633 - protein, 10 aa, Influenza virus
CFWVELIRGR

SEQ ID NO: 354634 - protein, 10 aa, Influenza virus
FWVELIRGRP

SEQ ID NO: 354635 - protein, 10 aa, Influenza virus
TTIWTSGSSI

SEQ ID NO: 354636 - protein, 10 aa, Influenza virus
TIWTSGSSIS

SEQ ID NO: 354637 - protein, 10 aa, Influenza virus
IWTSGSSISF

SEQ ID NO: 354638 - protein, 10 aa, Influenza virus
WTSGSSISFC

SEQ ID NO: 354639 - protein, 10 aa, Influenza virus
TSGSSISFCG

SEQ ID NO: 354640 - protein, 10 aa, Influenza virus
SGSSISFCGV

SEQ ID NO: 354641 - protein, 10 aa, Influenza virus
GSSISFCGVN

SEQ ID NO: 354642 - protein, 10 aa, Influenza virus
SSISFCGVNS

SEQ ID NO: 354643 - protein, 10 aa, Influenza virus
WSWPDGAELP

SEQ ID NO: 354644 - protein, 10 aa, Influenza virus
SWPDGAELPF

SEQ ID NO: 354645 - protein, 10 aa, Influenza virus
WPDGAELPFT

SEQ ID NO: 354646 - protein, 10 aa, Influenza virus
PDGAELPFTI

SEQ ID NO: 354647 - protein, 10 aa, Influenza virus
ADLPFTQEQK

SEQ ID NO: 354648 - protein, 10 aa, Influenza virus
DTICIGYHAN

SEQ ID NO: 354649 - protein, 10 aa, Influenza virus
TICIGYHANN

SEQ ID NO: 354650 - protein, 10 aa, Influenza virus
ICIGYHANNS

SEQ ID NO: 354651 - protein, 10 aa, Influenza virus
CIGYHANNST

SEQ ID NO: 354652 - protein, 10 aa, Influenza virus
IGYHANNSTD

SEQ ID NO: 354653 - protein, 10 aa, Influenza virus
GYHANNSTDT

SEQ ID NO: 354654 - protein, 10 aa, Influenza virus
YHANNSTDTV

SEQ ID NO: 354655 - protein, 10 aa, Influenza virus
HANNSTDTVD

SEQ ID NO: 354656 - protein, 10 aa, Influenza virus
ANNSTDTVDT

SEQ ID NO: 354657 - protein, 10 aa, Influenza virus
KNVTVTHSVN

SEQ ID NO: 354658 - protein, 10 aa, Influenza virus
NVTVTHSVNL

SEQ ID NO: 354659 - protein, 10 aa, Influenza virus
VTVTHSVNLL

SEQ ID NO: 354660 - protein, 10 aa, Influenza virus
TVTHSVNLLE

SEQ ID NO: 354661 - protein, 10 aa, Influenza virus
PFQNVHPVTI

SEQ ID NO: 354662 - protein, 10 aa, Influenza virus
FQNVHPVTIG

SEQ ID NO: 354663 - protein, 10 aa, Influenza virus
HPVTIGECPK

SEQ ID NO: 354664 - protein, 10 aa, Influenza virus
PVTIGECPKY

SEQ ID NO: 354665 - protein, 10 aa, Influenza virus
VTIGECPKYV

SEQ ID NO: 354666 - protein, 10 aa, Influenza virus
TIGECPKYVK

SEQ ID NO: 354667 - protein, 10 aa, Influenza virus
IGECPKYVKS

SEQ ID NO: 354668 - protein, 10 aa, Influenza virus
SIQSRGLFGA

SEQ ID NO: 354669 - protein, 10 aa, Influenza virus
IQSRGLFGAI

SEQ ID NO: 354670 - protein, 10 aa, Influenza virus
QSRGLFGAIA

SEQ ID NO: 354671 - protein, 10 aa, Influenza virus
SRGLFGAIAG

SEQ ID NO: 354672 - protein, 10 aa, Influenza virus
RGLFGAIAGF

SEQ ID NO: 354673 - protein, 10 aa, Influenza virus
GLFGAIAGFI

SEQ ID NO: 354674 - protein, 10 aa, Influenza virus
LFGAIAGFIE

SEQ ID NO: 354675 - protein, 10 aa, Influenza virus
FGAIAGFIEG

SEQ ID NO: 354676 - protein, 10 aa, Influenza virus
GAIAGFIEGG

SEQ ID NO: 354677 - protein, 10 aa, Influenza virus
AIAGFIEGGW

SEQ ID NO: 354678 - protein, 10 aa, Influenza virus
IAGFIEGGWT

SEQ ID NO: 354679 - protein, 10 aa, Influenza virus
AGFIEGGWTG

SEQ ID NO: 354680 - protein, 10 aa, Influenza virus
GFIEGGWTGM

SEQ ID NO: 354681 - protein, 10 aa, Influenza virus
FIEGGWTGMI

SEQ ID NO: 354682 - protein, 10 aa, Influenza virus
IEGGWTGMID

SEQ ID NO: 354683 - protein, 10 aa, Influenza virus
EGGWTGMIDG

SEQ ID NO: 354684 - protein, 10 aa, Influenza virus
GGWTGMIDGW

SEQ ID NO: 354685 - protein, 10 aa, Influenza virus
GWTGMIDGWY

SEQ ID NO: 354686 - protein, 10 aa, Influenza virus
WTGMIDGWYG

SEQ ID NO: 354687 - protein, 10 aa, Influenza virus
TGMIDGWYGY

SEQ ID NO: 354688 - protein, 10 aa, Influenza virus
NEQGSGYAAD

SEQ ID NO: 354689 - protein, 10 aa, Influenza virus
ENLNKKVDDG

SEQ ID NO: 354690 - protein, 10 aa, Influenza virus
DIWTYNAELL

SEQ ID NO: 354691 - protein, 10 aa, Influenza virus
IWTYNAELLV

SEQ ID NO: 354692 - protein, 10 aa, Influenza virus
WTYNAELLVL

SEQ ID NO: 354693 - protein, 10 aa, Influenza virus
TYNAELLVLL

SEQ ID NO: 354694 - protein, 10 aa, Influenza virus
YNAELLVLLE

SEQ ID NO: 354695 - protein, 10 aa, Influenza virus
NAELLVLLEN

SEQ ID NO: 354696 - protein, 10 aa, Influenza virus
AELLVLLENE

SEQ ID NO: 354697 - protein, 10 aa, Influenza virus
ELLVLLENER

SEQ ID NO: 354698 - protein, 10 aa, Influenza virus
LLVLLENERT

SEQ ID NO: 354699 - protein, 10 aa, Influenza virus
LVLLENERTL

SEQ ID NO: 354700 - protein, 10 aa, Influenza virus
VLLENERTLD

SEQ ID NO: 354701 - protein, 10 aa, Influenza virus
LLENERTLDF

SEQ ID NO: 354702 - protein, 10 aa, Influenza virus
LENERTLDFH

SEQ ID NO: 354703 - protein, 10 aa, Influenza virus
ENERTLDFHD

SEQ ID NO: 354704 - protein, 10 aa, Influenza virus
NERTLDFHDS

SEQ ID NO: 354705 - protein, 10 aa, Influenza virus
ERTLDFHDSN

SEQ ID NO: 354706 - protein, 10 aa, Influenza virus
RTLDFHDSNV

SEQ ID NO: 354707 - protein, 10 aa, Influenza virus
NNAKEIGNGC

SEQ ID NO: 354708 - protein, 10 aa, Influenza virus
NAKEIGNGCF

SEQ ID NO: 354709 - protein, 10 aa, Influenza virus
AKEIGNGCFE

SEQ ID NO: 354710 - protein, 10 aa, Influenza virus
KEIGNGCFEF

SEQ ID NO: 354711 - protein, 10 aa, Influenza virus
EIGNGCFEFY

SEQ ID NO: 354712 - protein, 10 aa, Influenza virus
IGNGCFEFYH

SEQ ID NO: 354713 - protein, 10 aa, Influenza virus
GNGCFEFYHK

SEQ ID NO: 354714 - protein, 10 aa, Influenza virus
NGCFEFYHKC

SEQ ID NO: 354715 - protein, 10 aa, Influenza virus
GCFEFYHKCN

SEQ ID NO: 354716 - protein, 10 aa, Influenza virus
CFEFYHKCNN

SEQ ID NO: 354717 - protein, 10 aa, Influenza virus
CMESVKNGTY

SEQ ID NO: 354718 - protein, 10 aa, Influenza virus
SFWMCSNGSL

SEQ ID NO: 354719 - protein, 10 aa, Influenza virus
FWMCSNGSLQ

SEQ ID NO: 354720 - protein, 10 aa, Influenza virus
WMCSNGSLQC

SEQ ID NO: 354721 - protein, 10 aa, Influenza virus
MCSNGSLQCR

SEQ ID NO: 354722 - protein, 10 aa, Influenza virus
CSNGSLQCRI

SEQ ID NO: 354723 - protein, 10 aa, Influenza virus
KNNQVILCEP

SEQ ID NO: 354724 - protein, 10 aa, Influenza virus
ITGFAPFSKD

SEQ ID NO: 354725 - protein, 10 aa, Influenza virus
TGFAPFSKDN

SEQ ID NO: 354726 - protein, 10 aa, Influenza virus
GFAPFSKDNS

SEQ ID NO: 354727 - protein, 10 aa, Influenza virus
FAPFSKDNSI

SEQ ID NO: 354728 - protein, 10 aa, Influenza virus
APFSKDNSIR

SEQ ID NO: 354729 - protein, 10 aa, Influenza virus
PFSKDNSIRL

SEQ ID NO: 354730 - protein, 10 aa, Influenza virus
FSKDNSIRLS

SEQ ID NO: 354731 - protein, 10 aa, Influenza virus
SKDNSIRLSA

SEQ ID NO: 354732 - protein, 10 aa, Influenza virus
KDNSIRLSAG

SEQ ID NO: 354733 - protein, 10 aa, Influenza virus
DNSIRLSAGG

SEQ ID NO: 354734 - protein, 10 aa, Influenza virus
NSIRLSAGGD

SEQ ID NO: 354735 - protein, 10 aa, Influenza virus
SIRLSAGGDI

SEQ ID NO: 354736 - protein, 10 aa, Influenza virus
IRLSAGGDIW

SEQ ID NO: 354737 - protein, 10 aa, Influenza virus
RLSAGGDIWV

SEQ ID NO: 354738 - protein, 10 aa, Influenza virus
LSAGGDIWVT

SEQ ID NO: 354739 - protein, 10 aa, Influenza virus
SAGGDIWVTR

SEQ ID NO: 354740 - protein, 10 aa, Influenza virus
AGGDIWVTRE

SEQ ID NO: 354741 - protein, 10 aa, Influenza virus
GGDIWVTREP

SEQ ID NO: 354742 - protein, 10 aa, Influenza virus
GDIWVTREPY

SEQ ID NO: 354743 - protein, 10 aa, Influenza virus
DIWVTREPYV

SEQ ID NO: 354744 - protein, 10 aa, Influenza virus
IWVTREPYVS

SEQ ID NO: 354745 - protein, 10 aa, Influenza virus
WVTREPYVSC

SEQ ID NO: 354746 - protein, 10 aa, Influenza virus
KCYQFALGQG

SEQ ID NO: 354747 - protein, 10 aa, Influenza virus
CYQFALGQGT

SEQ ID NO: 354748 - protein, 10 aa, Influenza virus
YQFALGQGTT

SEQ ID NO: 354749 - protein, 10 aa, Influenza virus
QFALGQGTTL

SEQ ID NO: 354750 - protein, 10 aa, Influenza virus
FALGQGTTLN

SEQ ID NO: 354751 - protein, 10 aa, Influenza virus
ALGQGTTLNN

SEQ ID NO: 354752 - protein, 10 aa, Influenza virus
DRTPYRTLLM

SEQ ID NO: 354753 - protein, 10 aa, Influenza virus
PYRTLLMNEL

SEQ ID NO: 354754 - protein, 10 aa, Influenza virus
YRTLLMNELG

SEQ ID NO: 354755 - protein, 10 aa, Influenza virus
RTLLMNELGV

SEQ ID NO: 354756 - protein, 10 aa, Influenza virus
TLLMNELGVP

SEQ ID NO: 354757 - protein, 10 aa, Influenza virus
LLMNELGVPF

SEQ ID NO: 354758 - protein, 10 aa, Influenza virus
LMNELGVPFH

SEQ ID NO: 354759 - protein, 10 aa, Influenza virus
MNELGVPFHL

SEQ ID NO: 354760 - protein, 10 aa, Influenza virus
NELGVPFHLG

SEQ ID NO: 354761 - protein, 10 aa, Influenza virus
ELGVPFHLGT

SEQ ID NO: 354762 - protein, 10 aa, Influenza virus
LGVPFHLGTK

SEQ ID NO: 354763 - protein, 10 aa, Influenza virus
PFHLGTKQVC

SEQ ID NO: 354764 - protein, 10 aa, Influenza virus
LGTKQVCIAW

SEQ ID NO: 354765 - protein, 10 aa, Influenza virus
GTKQVCIAWS

SEQ ID NO: 354766 - protein, 10 aa, Influenza virus
TKQVCIAWSS

SEQ ID NO: 354767 - protein, 10 aa, Influenza virus
KQVCIAWSSS

SEQ ID NO: 354768 - protein, 10 aa, Influenza virus
QVCIAWSSSS

SEQ ID NO: 354769 - protein, 10 aa, Influenza virus
VCIAWSSSSC

SEQ ID NO: 354770 - protein, 10 aa, Influenza virus
CIAWSSSSCH

SEQ ID NO: 354771 - protein, 10 aa, Influenza virus
IAWSSSSCHD

SEQ ID NO: 354772 - protein, 10 aa, Influenza virus
AWSSSSCHDG

SEQ ID NO: 354773 - protein, 10 aa, Influenza virus
WSSSSCHDGK

SEQ ID NO: 354774 - protein, 10 aa, Influenza virus
SSSSCHDGKA

SEQ ID NO: 354775 - protein, 10 aa, Influenza virus
SSSCHDGKAW

SEQ ID NO: 354776 - protein, 10 aa, Influenza virus
SSCHDGKAWL

SEQ ID NO: 354777 - protein, 10 aa, Influenza virus
SCHDGKAWLH

SEQ ID NO: 354778 - protein, 10 aa, Influenza virus
CHDGKAWLHV

SEQ ID NO: 354779 - protein, 10 aa, Influenza virus
HDGKAWLHVC

SEQ ID NO: 354780 - protein, 10 aa, Influenza virus
NILRTQESEC

SEQ ID NO: 354781 - protein, 10 aa, Influenza virus
ILRTQESECV

SEQ ID NO: 354782 - protein, 10 aa, Influenza virus
LRTQESECVC

SEQ ID NO: 354783 - protein, 10 aa, Influenza virus
RTQESECVCI

SEQ ID NO: 354784 - protein, 10 aa, Influenza virus
TCTVVMTDGS

SEQ ID NO: 354785 - protein, 10 aa, Influenza virus
CTVVMTDGSA

SEQ ID NO: 354786 - protein, 10 aa, Influenza virus
TVVMTDGSAS

SEQ ID NO: 354787 - protein, 10 aa, Influenza virus
VVMTDGSASG

SEQ ID NO: 354788 - protein, 10 aa, Influenza virus
GSAQHVEECS

SEQ ID NO: 354789 - protein, 10 aa, Influenza virus
SAQHVEECSC

SEQ ID NO: 354790 - protein, 10 aa, Influenza virus
AQHVEECSCY

SEQ ID NO: 354791 - protein, 10 aa, Influenza virus
QHVEECSCYP

SEQ ID NO: 354792 - protein, 10 aa, Influenza virus
HVEECSCYPR

SEQ ID NO: 354793 - protein, 10 aa, Influenza virus
VEECSCYPRY

SEQ ID NO: 354794 - protein, 10 aa, Influenza virus
EECSCYPRYP

SEQ ID NO: 354795 - protein, 10 aa, Influenza virus
VRCVCRDNWK

SEQ ID NO: 354796 - protein, 10 aa, Influenza virus
RCVCRDNWKG

SEQ ID NO: 354797 - protein, 10 aa, Influenza virus
CVCRDNWKGS

SEQ ID NO: 354798 - protein, 10 aa, Influenza virus
VCRDNWKGSN

SEQ ID NO: 354799 - protein, 10 aa, Influenza virus
CRDNWKGSNR

SEQ ID NO: 354800 - protein, 10 aa, Influenza virus
RDNWKGSNRP

SEQ ID NO: 354801 - protein, 10 aa, Influenza virus
DNWKGSNRPI

SEQ ID NO: 354802 - protein, 10 aa, Influenza virus
NWKGSNRPIV

SEQ ID NO: 354803 - protein, 10 aa, Influenza virus
WKGSNRPIVD

SEQ ID NO: 354804 - protein, 10 aa, Influenza virus
KGSNRPIVDI

SEQ ID NO: 354805 - protein, 10 aa, Influenza virus
SSYVCSGLVG

SEQ ID NO: 354806 - protein, 10 aa, Influenza virus
SYVCSGLVGD

SEQ ID NO: 354807 - protein, 10 aa, Influenza virus
YVCSGLVGDT

SEQ ID NO: 354808 - protein, 10 aa, Influenza virus
VCSGLVGDTP

SEQ ID NO: 354809 - protein, 10 aa, Influenza virus
CSGLVGDTPR

SEQ ID NO: 354810 - protein, 10 aa, Influenza virus
GGHGVKGWAF

SEQ ID NO: 354811 - protein, 10 aa, Influenza virus
GHGVKGWAFD

SEQ ID NO: 354812 - protein, 10 aa, Influenza virus
RSGYETFKVI

SEQ ID NO: 354813 - protein, 10 aa, Influenza virus
SGYSGIFSVE

SEQ ID NO: 354814 - protein, 10 aa, Influenza virus
SCINRCFYVE

SEQ ID NO: 354815 - protein, 10 aa, Influenza virus
CINRCFYVEL

SEQ ID NO: 354816 - protein, 10 aa, Influenza virus
INRCFYVELI

SEQ ID NO: 354817 - protein, 10 aa, Influenza virus
NRCFYVELIR

SEQ ID NO: 354818 - protein, 10 aa, Influenza virus
RCFYVELIRG

SEQ ID NO: 354819 - protein, 10 aa, Influenza virus
CFYVELIRGR

SEQ ID NO: 354820 - protein, 10 aa, Influenza virus
FYVELIRGRK

SEQ ID NO: 354821 - protein, 10 aa, Influenza virus
VWWTSNSIVV

SEQ ID NO: 354822 - protein, 10 aa, Influenza virus
WWTSNSIVVF

SEQ ID NO: 354823 - protein, 10 aa, Influenza virus
WTSNSIVVFC

SEQ ID NO: 354824 - protein, 10 aa, Influenza virus
TSNSIVVFCG

SEQ ID NO: 354825 - protein, 10 aa, Influenza virus
SNSIVVFCGT

SEQ ID NO: 354826 - protein, 10 aa, Influenza virus
NSIVVFCGTS

SEQ ID NO: 354827 - protein, 10 aa, Influenza virus
SIVVFCGTSG

SEQ ID NO: 354828 - protein, 10 aa, Influenza virus
IVVFCGTSGT

SEQ ID NO: 354829 - protein, 10 aa, Influenza virus
VVFCGTSGTY

SEQ ID NO: 354830 - protein, 10 aa, Influenza virus
VFCGTSGTYG

SEQ ID NO: 354831 - protein, 10 aa, Influenza virus
GTYGTGSWPD

SEQ ID NO: 354832 - protein, 10 aa, Influenza virus
RTSISCLYKL

SEQ ID NO: 354833 - protein, 10 aa, Influenza virus
TSISCLYKLS

SEQ ID NO: 354834 - protein, 10 aa, Influenza virus
SISCLYKLSQ

SEQ ID NO: 354835 - protein, 10 aa, Influenza virus
ISCLYKLSQF

SEQ ID NO: 354836 - protein, 10 aa, Influenza virus
MDNQTKTMTI

SEQ ID NO: 354837 - protein, 10 aa, Influenza virus
DNQTKTMTIT

SEQ ID NO: 354838 - protein, 10 aa, Influenza virus
NQTKTMTITF

SEQ ID NO: 354839 - protein, 10 aa, Influenza virus
QTKTMTITFL

SEQ ID NO: 354840 - protein, 10 aa, Influenza virus
TKTMTITFLI

SEQ ID NO: 354841 - protein, 10 aa, Influenza virus
KTMTITFLIL

SEQ ID NO: 354842 - protein, 10 aa, Influenza virus
TMTITFLILL

SEQ ID NO: 354843 - protein, 10 aa, Influenza virus
GDQICIGYHA

SEQ ID NO: 354844 - protein, 10 aa, Influenza virus
DQICIGYHAN

SEQ ID NO: 354845 - protein, 10 aa, Influenza virus
QICIGYHANN

SEQ ID NO: 354846 - protein, 10 aa, Influenza virus
ICIGYHANNS

SEQ ID NO: 354847 - protein, 10 aa, Influenza virus
CIGYHANNST

SEQ ID NO: 354848 - protein, 10 aa, Influenza virus
IGYHANNSTE

SEQ ID NO: 354849 - protein, 10 aa, Influenza virus
GYHANNSTEK

SEQ ID NO: 354850 - protein, 10 aa, Influenza virus
DTILERNVTV

SEQ ID NO: 354851 - protein, 10 aa, Influenza virus
TILERNVTVT

SEQ ID NO: 354852 - protein, 10 aa, Influenza virus
ILERNVTVTH

SEQ ID NO: 354853 - protein, 10 aa, Influenza virus
LERNVTVTHA

SEQ ID NO: 354854 - protein, 10 aa, Influenza virus
ERNVTVTHAK

SEQ ID NO: 354855 - protein, 10 aa, Influenza virus
NVTVTHAKDI

SEQ ID NO: 354856 - protein, 10 aa, Influenza virus
VTVTHAKDIL

SEQ ID NO: 354857 - protein, 10 aa, Influenza virus
TVTHAKDILE

SEQ ID NO: 354858 - protein, 10 aa, Influenza virus
VTHAKDILEK

SEQ ID NO: 354859 - protein, 10 aa, Influenza virus
DILEKTHNGK

SEQ ID NO: 354860 - protein, 10 aa, Influenza virus
ILEKTHNGKL

SEQ ID NO: 354861 - protein, 10 aa, Influenza virus
LEKTHNGKLC

SEQ ID NO: 354862 - protein, 10 aa, Influenza virus
HNGKLCKLNG

SEQ ID NO: 354863 - protein, 10 aa, Influenza virus
GIPPLELGDC

SEQ ID NO: 354864 - protein, 10 aa, Influenza virus
IPPLELGDCS

SEQ ID NO: 354865 - protein, 10 aa, Influenza virus
PPLELGDCSI

SEQ ID NO: 354866 - protein, 10 aa, Influenza virus
PLELGDCSIA

SEQ ID NO: 354867 - protein, 10 aa, Influenza virus
LELGDCSIAG

SEQ ID NO: 354868 - protein, 10 aa, Influenza virus
ELGDCSIAGW

SEQ ID NO: 354869 - protein, 10 aa, Influenza virus
LGDCSIAGWL

SEQ ID NO: 354870 - protein, 10 aa, Influenza virus
GDCSIAGWLL

SEQ ID NO: 354871 - protein, 10 aa, Influenza virus
DCSIAGWLLG

SEQ ID NO: 354872 - protein, 10 aa, Influenza virus
CSIAGWLLGN

SEQ ID NO: 354873 - protein, 10 aa, Influenza virus
SIAGWLLGNP

SEQ ID NO: 354874 - protein, 10 aa, Influenza virus
IAGWLLGNPE

SEQ ID NO: 354875 - protein, 10 aa, Influenza virus
AGWLLGNPEC

SEQ ID NO: 354876 - protein, 10 aa, Influenza virus
GWLLGNPECD

SEQ ID NO: 354877 - protein, 10 aa, Influenza virus
WLLGNPECDR

SEQ ID NO: 354878 - protein, 10 aa, Influenza virus
LLGNPECDRL

SEQ ID NO: 354879 - protein, 10 aa, Influenza virus
LGNPECDRLL

SEQ ID NO: 354880 - protein, 10 aa, Influenza virus
VPEWSYIVEK

SEQ ID NO: 354881 - protein, 10 aa, Influenza virus
PEWSYIVEKE

SEQ ID NO: 354882 - protein, 10 aa, Influenza virus
PSFFRNMVWL

SEQ ID NO: 354883 - protein, 10 aa, Influenza virus
SFFRNMVWLT

SEQ ID NO: 354884 - protein, 10 aa, Influenza virus
RSYNNTSGEQ

SEQ ID NO: 354885 - protein, 10 aa, Influenza virus
SYNNTSGEQM

SEQ ID NO: 354886 - protein, 10 aa, Influenza virus
YNNTSGEQML

SEQ ID NO: 354887 - protein, 10 aa, Influenza virus
INFESTGNLI

SEQ ID NO: 354888 - protein, 10 aa, Influenza virus
NFESTGNLIA

SEQ ID NO: 354889 - protein, 10 aa, Influenza virus
FESTGNLIAP

SEQ ID NO: 354890 - protein, 10 aa, Influenza virus
ESTGNLIAPE

SEQ ID NO: 354891 - protein, 10 aa, Influenza virus
STGNLIAPEY

SEQ ID NO: 354892 - protein, 10 aa, Influenza virus
TGNLIAPEYG

SEQ ID NO: 354893 - protein, 10 aa, Influenza virus
GNLIAPEYGF

SEQ ID NO: 354894 - protein, 10 aa, Influenza virus
NLIAPEYGFK

SEQ ID NO: 354895 - protein, 10 aa, Influenza virus
LIAPEYGFKI

SEQ ID NO: 354896 - protein, 10 aa, Influenza virus
IAPEYGFKIS

SEQ ID NO: 354897 - protein, 10 aa, Influenza virus
APEYGFKISK

SEQ ID NO: 354898 - protein, 10 aa, Influenza virus
PEYGFKISKR

SEQ ID NO: 354899 - protein, 10 aa, Influenza virus
EYGFKISKRG

SEQ ID NO: 354900 - protein, 10 aa, Influenza virus
YGFKISKRGS

SEQ ID NO: 354901 - protein, 10 aa, Influenza virus
GFKISKRGSS

SEQ ID NO: 354902 - protein, 10 aa, Influenza virus
FKISKRGSSG

SEQ ID NO: 354903 - protein, 10 aa, Influenza virus
KISKRGSSGI

SEQ ID NO: 354904 - protein, 10 aa, Influenza virus
ISKRGSSGIM

SEQ ID NO: 354905 - protein, 10 aa, Influenza virus
SKRGSSGIMK

SEQ ID NO: 354906 - protein, 10 aa, Influenza virus
KRGSSGIMKT

SEQ ID NO: 354907 - protein, 10 aa, Influenza virus
CETKCQTPLG

SEQ ID NO: 354908 - protein, 10 aa, Influenza virus
ETKCQTPLGA

SEQ ID NO: 354909 - protein, 10 aa, Influenza virus
TKCQTPLGAI

SEQ ID NO: 354910 - protein, 10 aa, Influenza virus
KCQTPLGAIN

SEQ ID NO: 354911 - protein, 10 aa, Influenza virus
CQTPLGAINT

SEQ ID NO: 354912 - protein, 10 aa, Influenza virus
QTPLGAINTT

SEQ ID NO: 354913 - protein, 10 aa, Influenza virus
TPLGAINTTL

SEQ ID NO: 354914 - protein, 10 aa, Influenza virus
PLGAINTTLP

SEQ ID NO: 354915 - protein, 10 aa, Influenza virus
LGAINTTLPF

SEQ ID NO: 354916 - protein, 10 aa, Influenza virus
GAINTTLPFH

SEQ ID NO: 354917 - protein, 10 aa, Influenza virus
AINTTLPFHN

SEQ ID NO: 354918 - protein, 10 aa, Influenza virus
INTTLPFHNI

SEQ ID NO: 354919 - protein, 10 aa, Influenza virus
NTTLPFHNIH

SEQ ID NO: 354920 - protein, 10 aa, Influenza virus
TTLPFHNIHP

SEQ ID NO: 354921 - protein, 10 aa, Influenza virus
TLPFHNIHPL

SEQ ID NO: 354922 - protein, 10 aa, Influenza virus
LPFHNIHPLT

SEQ ID NO: 354923 - protein, 10 aa, Influenza virus
PFHNIHPLTI

SEQ ID NO: 354924 - protein, 10 aa, Influenza virus
FHNIHPLTIG

SEQ ID NO: 354925 - protein, 10 aa, Influenza virus
HNIHPLTIGE

SEQ ID NO: 354926 - protein, 10 aa, Influenza virus
NIHPLTIGEC

SEQ ID NO: 354927 - protein, 10 aa, Influenza virus
IHPLTIGECP

SEQ ID NO: 354928 - protein, 10 aa, Influenza virus
HPLTIGECPK

SEQ ID NO: 354929 - protein, 10 aa, Influenza virus
PLTIGECPKY

SEQ ID NO: 354930 - protein, 10 aa, Influenza virus
LTIGECPKYV

SEQ ID NO: 354931 - protein, 10 aa, Influenza virus
TIGECPKYVK

SEQ ID NO: 354932 - protein, 10 aa, Influenza virus
IGECPKYVKS

SEQ ID NO: 354933 - protein, 10 aa, Influenza virus
PQIESRGLFG

SEQ ID NO: 354934 - protein, 10 aa, Influenza virus
QIESRGLFGA

SEQ ID NO: 354935 - protein, 10 aa, Influenza virus
IESRGLFGAI

SEQ ID NO: 354936 - protein, 10 aa, Influenza virus
ESRGLFGAIA

SEQ ID NO: 354937 - protein, 10 aa, Influenza virus
SRGLFGAIAG

SEQ ID NO: 354938 - protein, 10 aa, Influenza virus
RGLFGAIAGF

SEQ ID NO: 354939 - protein, 10 aa, Influenza virus
GLFGAIAGFI

SEQ ID NO: 354940 - protein, 10 aa, Influenza virus
LFGAIAGFIE

SEQ ID NO: 354941 - protein, 10 aa, Influenza virus
FGAIAGFIEG

SEQ ID NO: 354942 - protein, 10 aa, Influenza virus
GAIAGFIEGG

SEQ ID NO: 354943 - protein, 10 aa, Influenza virus
AIAGFIEGGW

SEQ ID NO: 354944 - protein, 10 aa, Influenza virus
IAGFIEGGWQ

SEQ ID NO: 354945 - protein, 10 aa, Influenza virus
AGFIEGGWQG

SEQ ID NO: 354946 - protein, 10 aa, Influenza virus
GFIEGGWQGM

SEQ ID NO: 354947 - protein, 10 aa, Influenza virus
FIEGGWQGMV

SEQ ID NO: 354948 - protein, 10 aa, Influenza virus
IEGGWQGMVD

SEQ ID NO: 354949 - protein, 10 aa, Influenza virus
EGGWQGMVDG

SEQ ID NO: 354950 - protein, 10 aa, Influenza virus
GGWQGMVDGW

SEQ ID NO: 354951 - protein, 10 aa, Influenza virus
GWQGMVDGWY

SEQ ID NO: 354952 - protein, 10 aa, Influenza virus
WQGMVDGWYG

SEQ ID NO: 354953 - protein, 10 aa, Influenza virus
QGMVDGWYGY

SEQ ID NO: 354954 - protein, 10 aa, Influenza virus
GMVDGWYGYH

SEQ ID NO: 354955 - protein, 10 aa, Influenza virus
MVDGWYGYHH

SEQ ID NO: 354956 - protein, 10 aa, Influenza virus
VDGWYGYHHS

SEQ ID NO: 354957 - protein, 10 aa, Influenza virus
DGWYGYHHSN

SEQ ID NO: 354958 - protein, 10 aa, Influenza virus
GWYGYHHSND

SEQ ID NO: 354959 - protein, 10 aa, Influenza virus
WYGYHHSNDQ

SEQ ID NO: 354960 - protein, 10 aa, Influenza virus
YGYHHSNDQG

SEQ ID NO: 354961 - protein, 10 aa, Influenza virus
GYHHSNDQGS

SEQ ID NO: 354962 - protein, 10 aa, Influenza virus
YHHSNDQGSG

SEQ ID NO: 354963 - protein, 10 aa, Influenza virus
HHSNDQGSGY

SEQ ID NO: 354964 - protein, 10 aa, Influenza virus
HSNDQGSGYA

SEQ ID NO: 354965 - protein, 10 aa, Influenza virus
SNDQGSGYAA

SEQ ID NO: 354966 - protein, 10 aa, Influenza virus
NDQGSGYAAD

SEQ ID NO: 354967 - protein, 10 aa, Influenza virus
DQGSGYAADK

SEQ ID NO: 354968 - protein, 10 aa, Influenza virus
QGSGYAADKE

SEQ ID NO: 354969 - protein, 10 aa, Influenza virus
GSGYAADKES

SEQ ID NO: 354970 - protein, 10 aa, Influenza virus
SGYAADKEST

SEQ ID NO: 354971 - protein, 10 aa, Influenza virus
GYAADKESTQ

SEQ ID NO: 354972 - protein, 10 aa, Influenza virus
YAADKESTQK

SEQ ID NO: 354973 - protein, 10 aa, Influenza virus
AADKESTQKA

SEQ ID NO: 354974 - protein, 10 aa, Influenza virus
NLERRLENLN

SEQ ID NO: 354975 - protein, 10 aa, Influenza virus
LERRLENLNK

SEQ ID NO: 354976 - protein, 10 aa, Influenza virus
ERRLENLNKK

SEQ ID NO: 354977 - protein, 10 aa, Influenza virus
RLENLNKKME

SEQ ID NO: 354978 - protein, 10 aa, Influenza virus
LENLNKKMED

SEQ ID NO: 354979 - protein, 10 aa, Influenza virus
ENLNKKMEDG

SEQ ID NO: 354980 - protein, 10 aa, Influenza virus
NLNKKMEDGF

SEQ ID NO: 354981 - protein, 10 aa, Influenza virus
VWTYNAELLV

SEQ ID NO: 354982 - protein, 10 aa, Influenza virus
WTYNAELLVL

SEQ ID NO: 354983 - protein, 10 aa, Influenza virus
TYNAELLVLM

SEQ ID NO: 354984 - protein, 10 aa, Influenza virus
YNAELLVLME

SEQ ID NO: 354985 - protein, 10 aa, Influenza virus
NAELLVLMEN

SEQ ID NO: 354986 - protein, 10 aa, Influenza virus
AELLVLMENE

SEQ ID NO: 354987 - protein, 10 aa, Influenza virus
ELLVLMENER

SEQ ID NO: 354988 - protein, 10 aa, Influenza virus
LLVLMENERT

SEQ ID NO: 354989 - protein, 10 aa, Influenza virus
LVLMENERTL

SEQ ID NO: 354990 - protein, 10 aa, Influenza virus
VLMENERTLD

SEQ ID NO: 354991 - protein, 10 aa, Influenza virus
LMENERTLDF

SEQ ID NO: 354992 - protein, 10 aa, Influenza virus
MENERTLDFH

SEQ ID NO: 354993 - protein, 10 aa, Influenza virus
ENERTLDFHD

SEQ ID NO: 354994 - protein, 10 aa, Influenza virus
NERTLDFHDS

SEQ ID NO: 354995 - protein, 10 aa, Influenza virus
ERTLDFHDSN

SEQ ID NO: 354996 - protein, 10 aa, Influenza virus
RTLDFHDSNV

SEQ ID NO: 354997 - protein, 10 aa, Influenza virus
TLDFHDSNVK

SEQ ID NO: 354998 - protein, 10 aa, Influenza virus
LDFHDSNVKN

SEQ ID NO: 354999 - protein, 10 aa, Influenza virus
DFHDSNVKNL

SEQ ID NO: 355000 - protein, 10 aa, Influenza virus
FHDSNVKNLY

SEQ ID NO: 355001 - protein, 10 aa, Influenza virus
HDSNVKNLYD

SEQ ID NO: 355002 - protein, 10 aa, Influenza virus
NLYDKVRMQL

SEQ ID NO: 355003 - protein, 10 aa, Influenza virus
LYDKVRMQLR

SEQ ID NO: 355004 - protein, 10 aa, Influenza virus
YDKVRMQLRD

SEQ ID NO: 355005 - protein, 10 aa, Influenza virus
DKVRMQLRDN

SEQ ID NO: 355006 - protein, 10 aa, Influenza virus
KVRMQLRDNA

SEQ ID NO: 355007 - protein, 10 aa, Influenza virus
VRMQLRDNAK

SEQ ID NO: 355008 - protein, 10 aa, Influenza virus
RMQLRDNAKE

SEQ ID NO: 355009 - protein, 10 aa, Influenza virus
MQLRDNAKEI

SEQ ID NO: 355010 - protein, 10 aa, Influenza virus
QLRDNAKEIG

SEQ ID NO: 355011 - protein, 10 aa, Influenza virus
DNAKEIGNGC

SEQ ID NO: 355012 - protein, 10 aa, Influenza virus
NAKEIGNGCF

SEQ ID NO: 355013 - protein, 10 aa, Influenza virus
AKEIGNGCFE

SEQ ID NO: 355014 - protein, 10 aa, Influenza virus
KEIGNGCFEF

SEQ ID NO: 355015 - protein, 10 aa, Influenza virus
EIGNGCFEFY

SEQ ID NO: 355016 - protein, 10 aa, Influenza virus
IGNGCFEFYH

SEQ ID NO: 355017 - protein, 10 aa, Influenza virus
GNGCFEFYHK

SEQ ID NO: 355018 - protein, 10 aa, Influenza virus
NGCFEFYHKC

SEQ ID NO: 355019 - protein, 10 aa, Influenza virus
GCFEFYHKCD

SEQ ID NO: 355020 - protein, 10 aa, Influenza virus
CFEFYHKCDD

SEQ ID NO: 355021 - protein, 10 aa, Influenza virus
FEFYHKCDDE

SEQ ID NO: 355022 - protein, 10 aa, Influenza virus
EFYHKCDDEC

SEQ ID NO: 355023 - protein, 10 aa, Influenza virus
FYHKCDDECM

SEQ ID NO: 355024 - protein, 10 aa, Influenza virus
YHKCDDECMN

SEQ ID NO: 355025 - protein, 10 aa, Influenza virus
HKCDDECMNS

SEQ ID NO: 355026 - protein, 10 aa, Influenza virus
NGTYDYPKYE

SEQ ID NO: 355027 - protein, 10 aa, Influenza virus
GTYDYPKYEE

SEQ ID NO: 355028 - protein, 10 aa, Influenza virus
TYDYPKYEEE

SEQ ID NO: 355029 - protein, 10 aa, Influenza virus
YDYPKYEEES

SEQ ID NO: 355030 - protein, 10 aa, Influenza virus
YPKYEEESKL

SEQ ID NO: 355031 - protein, 10 aa, Influenza virus
PKYEEESKLN

SEQ ID NO: 355032 - protein, 10 aa, Influenza virus
KYEEESKLNR

SEQ ID NO: 355033 - protein, 10 aa, Influenza virus
YEEESKLNRN

SEQ ID NO: 355034 - protein, 10 aa, Influenza virus
EEESKLNRNE

SEQ ID NO: 355035 - protein, 10 aa, Influenza virus
EESKLNRNEI

SEQ ID NO: 355036 - protein, 10 aa, Influenza virus
ESKLNRNEIK

SEQ ID NO: 355037 - protein, 10 aa, Influenza virus
SKLNRNEIKG

SEQ ID NO: 355038 - protein, 10 aa, Influenza virus
MGVYQILAIY

SEQ ID NO: 355039 - protein, 10 aa, Influenza virus
GVYQILAIYA

SEQ ID NO: 355040 - protein, 10 aa, Influenza virus
VYQILAIYAT

SEQ ID NO: 355041 - protein, 10 aa, Influenza virus
YQILAIYATV

SEQ ID NO: 355042 - protein, 10 aa, Influenza virus
QILAIYATVA

SEQ ID NO: 355043 - protein, 10 aa, Influenza virus
ILAIYATVAG

SEQ ID NO: 355044 - protein, 10 aa, Influenza virus
LAIYATVAGS

SEQ ID NO: 355045 - protein, 10 aa, Influenza virus
AIYATVAGSL

SEQ ID NO: 355046 - protein, 10 aa, Influenza virus
IYATVAGSLS

SEQ ID NO: 355047 - protein, 10 aa, Influenza virus
YATVAGSLSL

SEQ ID NO: 355048 - protein, 10 aa, Influenza virus
ATVAGSLSLA

SEQ ID NO: 355049 - protein, 10 aa, Influenza virus
TVAGSLSLAI

SEQ ID NO: 355050 - protein, 10 aa, Influenza virus
VAGSLSLAIM

SEQ ID NO: 355051 - protein, 10 aa, Influenza virus
AGSLSLAIMI

SEQ ID NO: 355052 - protein, 10 aa, Influenza virus
GSLSLAIMIA

SEQ ID NO: 355053 - protein, 10 aa, Influenza virus
SLSLAIMIAG

SEQ ID NO: 355054 - protein, 10 aa, Influenza virus
LSLAIMIAGI

SEQ ID NO: 355055 - protein, 10 aa, Influenza virus
SLAIMIAGIS

SEQ ID NO: 355056 - protein, 10 aa, Influenza virus
AGISFWMCSN

SEQ ID NO: 355057 - protein, 10 aa, Influenza virus
GISFWMCSNG

SEQ ID NO: 355058 - protein, 10 aa, Influenza virus
ISFWMCSNGS

SEQ ID NO: 355059 - protein, 10 aa, Influenza virus
SFWMCSNGSL

SEQ ID NO: 355060 - protein, 10 aa, Influenza virus
FWMCSNGSLQ

SEQ ID NO: 355061 - protein, 10 aa, Influenza virus
WMCSNGSLQC

SEQ ID NO: 355062 - protein, 10 aa, Influenza virus
MCSNGSLQCR

SEQ ID NO: 355063 - protein, 10 aa, Influenza virus
CSNGSLQCRI

SEQ ID NO: 355064 - protein, 10 aa, Influenza virus
SNGSLQCRIC

SEQ ID NO: 355065 - protein, 10 aa, Influenza virus
NGSLQCRICI

SEQ ID NO: 355066 - protein, 10 aa, Influenza virus
VRGDQICIGY

SEQ ID NO: 355067 - protein, 10 aa, Influenza virus
RGDQICIGYH

SEQ ID NO: 355068 - protein, 10 aa, Influenza virus
GDQICIGYHA

SEQ ID NO: 355069 - protein, 10 aa, Influenza virus
DQICIGYHAN

SEQ ID NO: 355070 - protein, 10 aa, Influenza virus
QICIGYHANN

SEQ ID NO: 355071 - protein, 10 aa, Influenza virus
ICIGYHANNS

SEQ ID NO: 355072 - protein, 10 aa, Influenza virus
CIGYHANNST

SEQ ID NO: 355073 - protein, 10 aa, Influenza virus
IGYHANNSTE

SEQ ID NO: 355074 - protein, 10 aa, Influenza virus
GYHANNSTEK

SEQ ID NO: 355075 - protein, 10 aa, Influenza virus
KVDTILERNV

SEQ ID NO: 355076 - protein, 10 aa, Influenza virus
VDTILERNVT

SEQ ID NO: 355077 - protein, 10 aa, Influenza virus
DTILERNVTV

SEQ ID NO: 355078 - protein, 10 aa, Influenza virus
TILERNVTVT

SEQ ID NO: 355079 - protein, 10 aa, Influenza virus
ILERNVTVTH

SEQ ID NO: 355080 - protein, 10 aa, Influenza virus
LERNVTVTHA

SEQ ID NO: 355081 - protein, 10 aa, Influenza virus
ERNVTVTHAK

SEQ ID NO: 355082 - protein, 10 aa, Influenza virus
RNVTVTHAKD

SEQ ID NO: 355083 - protein, 10 aa, Influenza virus
NVTVTHAKDI

SEQ ID NO: 355084 - protein, 10 aa, Influenza virus
VTVTHAKDIL

SEQ ID NO: 355085 - protein, 10 aa, Influenza virus
TVTHAKDILE

SEQ ID NO: 355086 - protein, 10 aa, Influenza virus
VTHAKDILEK

SEQ ID NO: 355087 - protein, 10 aa, Influenza virus
THAKDILEKT

SEQ ID NO: 355088 - protein, 10 aa, Influenza virus
HAKDILEKTH

SEQ ID NO: 355089 - protein, 10 aa, Influenza virus
AKDILEKTHN

SEQ ID NO: 355090 - protein, 10 aa, Influenza virus
KDILEKTHNG

SEQ ID NO: 355091 - protein, 10 aa, Influenza virus
DILEKTHNGK

SEQ ID NO: 355092 - protein, 10 aa, Influenza virus
ILEKTHNGKL

SEQ ID NO: 355093 - protein, 10 aa, Influenza virus
LEKTHNGKLC

SEQ ID NO: 355094 - protein, 10 aa, Influenza virus
EKTHNGKLCK

SEQ ID NO: 355095 - protein, 10 aa, Influenza virus
KTHNGKLCKL

SEQ ID NO: 355096 - protein, 10 aa, Influenza virus
THNGKLCKLN

SEQ ID NO: 355097 - protein, 10 aa, Influenza virus
HNGKLCKLNG

SEQ ID NO: 355098 - protein, 10 aa, Influenza virus
NGKLCKLNGI

SEQ ID NO: 355099 - protein, 10 aa, Influenza virus
GKLCKLNGIP

SEQ ID NO: 355100 - protein, 10 aa, Influenza virus
KLCKLNGIPP

SEQ ID NO: 355101 - protein, 10 aa, Influenza virus
LCKLNGIPPL

SEQ ID NO: 355102 - protein, 10 aa, Influenza virus
CKLNGIPPLE

SEQ ID NO: 355103 - protein, 10 aa, Influenza virus
KLNGIPPLEL

SEQ ID NO: 355104 - protein, 10 aa, Influenza virus
LNGIPPLELG

SEQ ID NO: 355105 - protein, 10 aa, Influenza virus
NGIPPLELGD

SEQ ID NO: 355106 - protein, 10 aa, Influenza virus
GIPPLELGDC

SEQ ID NO: 355107 - protein, 10 aa, Influenza virus
IPPLELGDCS

SEQ ID NO: 355108 - protein, 10 aa, Influenza virus
PPLELGDCSI

SEQ ID NO: 355109 - protein, 10 aa, Influenza virus
PLELGDCSIA

SEQ ID NO: 355110 - protein, 10 aa, Influenza virus
LELGDCSIAG

SEQ ID NO: 355111 - protein, 10 aa, Influenza virus
ELGDCSIAGW

SEQ ID NO: 355112 - protein, 10 aa, Influenza virus
LGDCSIAGWL

SEQ ID NO: 355113 - protein, 10 aa, Influenza virus
GDCSIAGWLL

SEQ ID NO: 355114 - protein, 10 aa, Influenza virus
DCSIAGWLLG

SEQ ID NO: 355115 - protein, 10 aa, Influenza virus
CSIAGWLLGN

SEQ ID NO: 355116 - protein, 10 aa, Influenza virus
SIAGWLLGNP

SEQ ID NO: 355117 - protein, 10 aa, Influenza virus
IAGWLLGNPE

SEQ ID NO: 355118 - protein, 10 aa, Influenza virus
AGWLLGNPEC

SEQ ID NO: 355119 - protein, 10 aa, Influenza virus
GWLLGNPECD

SEQ ID NO: 355120 - protein, 10 aa, Influenza virus
WLLGNPECDR

SEQ ID NO: 355121 - protein, 10 aa, Influenza virus
LLGNPECDRL

SEQ ID NO: 355122 - protein, 10 aa, Influenza virus
LGNPECDRLL

SEQ ID NO: 355123 - protein, 10 aa, Influenza virus
GNPECDRLLS

SEQ ID NO: 355124 - protein, 10 aa, Influenza virus
VPEWSYIMEK

SEQ ID NO: 355125 - protein, 10 aa, Influenza virus
PEWSYIMEKE

SEQ ID NO: 355126 - protein, 10 aa, Influenza virus
EWSYIMEKEN

SEQ ID NO: 355127 - protein, 10 aa, Influenza virus
WSYIMEKENP

SEQ ID NO: 355128 - protein, 10 aa, Influenza virus
LCYPGSFNDY

SEQ ID NO: 355129 - protein, 10 aa, Influenza virus
CYPGSFNDYE

SEQ ID NO: 355130 - protein, 10 aa, Influenza virus
YPGSFNDYEE

SEQ ID NO: 355131 - protein, 10 aa, Influenza virus
PGSFNDYEEL

SEQ ID NO: 355132 - protein, 10 aa, Influenza virus
GSFNDYEELK

SEQ ID NO: 355133 - protein, 10 aa, Influenza virus
VKHFEKVKIL

SEQ ID NO: 355134 - protein, 10 aa, Influenza virus
HFEKVKILPK

SEQ ID NO: 355135 - protein, 10 aa, Influenza virus
FEKVKILPKD

SEQ ID NO: 355136 - protein, 10 aa, Influenza virus
PSFFRNMVWL

SEQ ID NO: 355137 - protein, 10 aa, Influenza virus
SFFRNMVWLT

SEQ ID NO: 355138 - protein, 10 aa, Influenza virus
AKGSYNNTSG

SEQ ID NO: 355139 - protein, 10 aa, Influenza virus
KGSYNNTSGE

SEQ ID NO: 355140 - protein, 10 aa, Influenza virus
GSYNNTSGEQ

SEQ ID NO: 355141 - protein, 10 aa, Influenza virus
SYNNTSGEQM

SEQ ID NO: 355142 - protein, 10 aa, Influenza virus
YNNTSGEQML

SEQ ID NO: 355143 - protein, 10 aa, Influenza virus
NNTSGEQMLI

SEQ ID NO: 355144 - protein, 10 aa, Influenza virus
NTSGEQMLII

SEQ ID NO: 355145 - protein, 10 aa, Influenza virus
TSGEQMLIIW

SEQ ID NO: 355146 - protein, 10 aa, Influenza virus
SGEQMLIIWG

SEQ ID NO: 355147 - protein, 10 aa, Influenza virus
IWGVHHPNDE

SEQ ID NO: 355148 - protein, 10 aa, Influenza virus
LYQNVGTYVS

SEQ ID NO: 355149 - protein, 10 aa, Influenza virus
WDTINFESTG

SEQ ID NO: 355150 - protein, 10 aa, Influenza virus
DTINFESTGN

SEQ ID NO: 355151 - protein, 10 aa, Influenza virus
TINFESTGNL

SEQ ID NO: 355152 - protein, 10 aa, Influenza virus
INFESTGNLI

SEQ ID NO: 355153 - protein, 10 aa, Influenza virus
NFESTGNLIA

SEQ ID NO: 355154 - protein, 10 aa, Influenza virus
FESTGNLIAP

SEQ ID NO: 355155 - protein, 10 aa, Influenza virus
ESTGNLIAPE

SEQ ID NO: 355156 - protein, 10 aa, Influenza virus
STGNLIAPEY

SEQ ID NO: 355157 - protein, 10 aa, Influenza virus
TGNLIAPEYG

SEQ ID NO: 355158 - protein, 10 aa, Influenza virus
GNLIAPEYGF

SEQ ID NO: 355159 - protein, 10 aa, Influenza virus
NLIAPEYGFK

SEQ ID NO: 355160 - protein, 10 aa, Influenza virus
LIAPEYGFKI

SEQ ID NO: 355161 - protein, 10 aa, Influenza virus
IAPEYGFKIS

SEQ ID NO: 355162 - protein, 10 aa, Influenza virus
APEYGFKISK

SEQ ID NO: 355163 - protein, 10 aa, Influenza virus
PEYGFKISKR

SEQ ID NO: 355164 - protein, 10 aa, Influenza virus
EYGFKISKRG

SEQ ID NO: 355165 - protein, 10 aa, Influenza virus
YGFKISKRGS

SEQ ID NO: 355166 - protein, 10 aa, Influenza virus
GFKISKRGSS

SEQ ID NO: 355167 - protein, 10 aa, Influenza virus
FKISKRGSSG

SEQ ID NO: 355168 - protein, 10 aa, Influenza virus
KISKRGSSGI

SEQ ID NO: 355169 - protein, 10 aa, Influenza virus
ISKRGSSGIM

SEQ ID NO: 355170 - protein, 10 aa, Influenza virus
SKRGSSGIMK

SEQ ID NO: 355171 - protein, 10 aa, Influenza virus
KRGSSGIMKT

SEQ ID NO: 355172 - protein, 10 aa, Influenza virus
RGSSGIMKTE

SEQ ID NO: 355173 - protein, 10 aa, Influenza virus
SGIMKTEGTL

SEQ ID NO: 355174 - protein, 10 aa, Influenza virus
NCETKCQTPL

SEQ ID NO: 355175 - protein, 10 aa, Influenza virus
CETKCQTPLG

SEQ ID NO: 355176 - protein, 10 aa, Influenza virus
ETKCQTPLGA

SEQ ID NO: 355177 - protein, 10 aa, Influenza virus
TKCQTPLGAI

SEQ ID NO: 355178 - protein, 10 aa, Influenza virus
KCQTPLGAIN

SEQ ID NO: 355179 - protein, 10 aa, Influenza virus
CQTPLGAINT

SEQ ID NO: 355180 - protein, 10 aa, Influenza virus
QTPLGAINTT

SEQ ID NO: 355181 - protein, 10 aa, Influenza virus
TPLGAINTTL

SEQ ID NO: 355182 - protein, 10 aa, Influenza virus
PLGAINTTLP

SEQ ID NO: 355183 - protein, 10 aa, Influenza virus
LGAINTTLPF

SEQ ID NO: 355184 - protein, 10 aa, Influenza virus
GAINTTLPFH

SEQ ID NO: 355185 - protein, 10 aa, Influenza virus
AINTTLPFHN

SEQ ID NO: 355186 - protein, 10 aa, Influenza virus
INTTLPFHNV

SEQ ID NO: 355187 - protein, 10 aa, Influenza virus
NTTLPFHNVH

SEQ ID NO: 355188 - protein, 10 aa, Influenza virus
TTLPFHNVHP

SEQ ID NO: 355189 - protein, 10 aa, Influenza virus
TLPFHNVHPL

SEQ ID NO: 355190 - protein, 10 aa, Influenza virus
LPFHNVHPLT

SEQ ID NO: 355191 - protein, 10 aa, Influenza virus
PFHNVHPLTI

SEQ ID NO: 355192 - protein, 10 aa, Influenza virus
FHNVHPLTIG

SEQ ID NO: 355193 - protein, 10 aa, Influenza virus
HNVHPLTIGE

SEQ ID NO: 355194 - protein, 10 aa, Influenza virus
NVHPLTIGEC

SEQ ID NO: 355195 - protein, 10 aa, Influenza virus
VHPLTIGECP

SEQ ID NO: 355196 - protein, 10 aa, Influenza virus
HPLTIGECPK

SEQ ID NO: 355197 - protein, 10 aa, Influenza virus
PLTIGECPKY

SEQ ID NO: 355198 - protein, 10 aa, Influenza virus
LTIGECPKYV

SEQ ID NO: 355199 - protein, 10 aa, Influenza virus
TIGECPKYVK

SEQ ID NO: 355200 - protein, 10 aa, Influenza virus
IGECPKYVKS

SEQ ID NO: 355201 - protein, 10 aa, Influenza virus
GECPKYVKSE

SEQ ID NO: 355202 - protein, 10 aa, Influenza virus
ECPKYVKSEK

SEQ ID NO: 355203 - protein, 10 aa, Influenza virus
CPKYVKSEKL

SEQ ID NO: 355204 - protein, 10 aa, Influenza virus
PKYVKSEKLV

SEQ ID NO: 355205 - protein, 10 aa, Influenza virus
KYVKSEKLVL

SEQ ID NO: 355206 - protein, 10 aa, Influenza virus
YVKSEKLVLA

SEQ ID NO: 355207 - protein, 10 aa, Influenza virus
VKSEKLVLAT

SEQ ID NO: 355208 - protein, 10 aa, Influenza virus
KSEKLVLATG

SEQ ID NO: 355209 - protein, 10 aa, Influenza virus
SEKLVLATGL

SEQ ID NO: 355210 - protein, 10 aa, Influenza virus
EKLVLATGLR

SEQ ID NO: 355211 - protein, 10 aa, Influenza virus
KLVLATGLRN

SEQ ID NO: 355212 - protein, 10 aa, Influenza virus
LVLATGLRNV

SEQ ID NO: 355213 - protein, 10 aa, Influenza virus
VLATGLRNVP

SEQ ID NO: 355214 - protein, 10 aa, Influenza virus
LATGLRNVPQ

SEQ ID NO: 355215 - protein, 10 aa, Influenza virus
ATGLRNVPQI

SEQ ID NO: 355216 - protein, 10 aa, Influenza virus
TGLRNVPQIE

SEQ ID NO: 355217 - protein, 10 aa, Influenza virus
RNVPQIESRG

SEQ ID NO: 355218 - protein, 10 aa, Influenza virus
NVPQIESRGL

SEQ ID NO: 355219 - protein, 10 aa, Influenza virus
VPQIESRGLF

SEQ ID NO: 355220 - protein, 10 aa, Influenza virus
PQIESRGLFG

SEQ ID NO: 355221 - protein, 10 aa, Influenza virus
QIESRGLFGA

SEQ ID NO: 355222 - protein, 10 aa, Influenza virus
IESRGLFGAI

SEQ ID NO: 355223 - protein, 10 aa, Influenza virus
ESRGLFGAIA

SEQ ID NO: 355224 - protein, 10 aa, Influenza virus
SRGLFGAIAG

SEQ ID NO: 355225 - protein, 10 aa, Influenza virus
RGLFGAIAGF

SEQ ID NO: 355226 - protein, 10 aa, Influenza virus
GLFGAIAGFI

SEQ ID NO: 355227 - protein, 10 aa, Influenza virus
LFGAIAGFIE

SEQ ID NO: 355228 - protein, 10 aa, Influenza virus
FGAIAGFIEG

SEQ ID NO: 355229 - protein, 10 aa, Influenza virus
GAIAGFIEGG

SEQ ID NO: 355230 - protein, 10 aa, Influenza virus
AIAGFIEGGW

SEQ ID NO: 355231 - protein, 10 aa, Influenza virus
IAGFIEGGWQ

SEQ ID NO: 355232 - protein, 10 aa, Influenza virus
AGFIEGGWQG

SEQ ID NO: 355233 - protein, 10 aa, Influenza virus
GFIEGGWQGM

SEQ ID NO: 355234 - protein, 10 aa, Influenza virus
FIEGGWQGMV

SEQ ID NO: 355235 - protein, 10 aa, Influenza virus
IEGGWQGMVD

SEQ ID NO: 355236 - protein, 10 aa, Influenza virus
EGGWQGMVDG

SEQ ID NO: 355237 - protein, 10 aa, Influenza virus
GGWQGMVDGW

SEQ ID NO: 355238 - protein, 10 aa, Influenza virus
GWQGMVDGWY

SEQ ID NO: 355239 - protein, 10 aa, Influenza virus
WQGMVDGWYG

SEQ ID NO: 355240 - protein, 10 aa, Influenza virus
QGMVDGWYGY

SEQ ID NO: 355241 - protein, 10 aa, Influenza virus
GMVDGWYGYH

SEQ ID NO: 355242 - protein, 10 aa, Influenza virus
MVDGWYGYHH

SEQ ID NO: 355243 - protein, 10 aa, Influenza virus
VDGWYGYHHS

SEQ ID NO: 355244 - protein, 10 aa, Influenza virus
DGWYGYHHSN

SEQ ID NO: 355245 - protein, 10 aa, Influenza virus
GWYGYHHSND

SEQ ID NO: 355246 - protein, 10 aa, Influenza virus
WYGYHHSNDQ

SEQ ID NO: 355247 - protein, 10 aa, Influenza virus
YGYHHSNDQG

SEQ ID NO: 355248 - protein, 10 aa, Influenza virus
GYHHSNDQGS

SEQ ID NO: 355249 - protein, 10 aa, Influenza virus
YHHSNDQGSG

SEQ ID NO: 355250 - protein, 10 aa, Influenza virus
HHSNDQGSGY

SEQ ID NO: 355251 - protein, 10 aa, Influenza virus
HSNDQGSGYA

SEQ ID NO: 355252 - protein, 10 aa, Influenza virus
SNDQGSGYAA

SEQ ID NO: 355253 - protein, 10 aa, Influenza virus
NDQGSGYAAD

SEQ ID NO: 355254 - protein, 10 aa, Influenza virus
DQGSGYAADK

SEQ ID NO: 355255 - protein, 10 aa, Influenza virus
QGSGYAADKE

SEQ ID NO: 355256 - protein, 10 aa, Influenza virus
GSGYAADKES

SEQ ID NO: 355257 - protein, 10 aa, Influenza virus
SGYAADKEST

SEQ ID NO: 355258 - protein, 10 aa, Influenza virus
GYAADKESTQ

SEQ ID NO: 355259 - protein, 10 aa, Influenza virus
YAADKESTQK

SEQ ID NO: 355260 - protein, 10 aa, Influenza virus
AADKESTQKA

SEQ ID NO: 355261 - protein, 10 aa, Influenza virus
ADKESTQKAF

SEQ ID NO: 355262 - protein, 10 aa, Influenza virus
NSVIEKMNTQ

SEQ ID NO: 355263 - protein, 10 aa, Influenza virus
AVGKEFSNLE

SEQ ID NO: 355264 - protein, 10 aa, Influenza virus
KEFSNLERRL

SEQ ID NO: 355265 - protein, 10 aa, Influenza virus
EFSNLERRLE

SEQ ID NO: 355266 - protein, 10 aa, Influenza virus
FSNLERRLEN

SEQ ID NO: 355267 - protein, 10 aa, Influenza virus
SNLERRLENL

SEQ ID NO: 355268 - protein, 10 aa, Influenza virus
NLERRLENLN

SEQ ID NO: 355269 - protein, 10 aa, Influenza virus
LERRLENLNK

SEQ ID NO: 355270 - protein, 10 aa, Influenza virus
ERRLENLNKK

SEQ ID NO: 355271 - protein, 10 aa, Influenza virus
RLENLNKKME

SEQ ID NO: 355272 - protein, 10 aa, Influenza virus
LENLNKKMED

SEQ ID NO: 355273 - protein, 10 aa, Influenza virus
ENLNKKMEDG

SEQ ID NO: 355274 - protein, 10 aa, Influenza virus
NLNKKMEDGF

SEQ ID NO: 355275 - protein, 10 aa, Influenza virus
MEDGFLDVWT

SEQ ID NO: 355276 - protein, 10 aa, Influenza virus
EDGFLDVWTY

SEQ ID NO: 355277 - protein, 10 aa, Influenza virus
DGFLDVWTYN

SEQ ID NO: 355278 - protein, 10 aa, Influenza virus
GFLDVWTYNA

SEQ ID NO: 355279 - protein, 10 aa, Influenza virus
FLDVWTYNAE

SEQ ID NO: 355280 - protein, 10 aa, Influenza virus
LDVWTYNAEL

SEQ ID NO: 355281 - protein, 10 aa, Influenza virus
DVWTYNAELL

SEQ ID NO: 355282 - protein, 10 aa, Influenza virus
VWTYNAELLV

SEQ ID NO: 355283 - protein, 10 aa, Influenza virus
WTYNAELLVL

SEQ ID NO: 355284 - protein, 10 aa, Influenza virus
TYNAELLVLM

SEQ ID NO: 355285 - protein, 10 aa, Influenza virus
YNAELLVLME

SEQ ID NO: 355286 - protein, 10 aa, Influenza virus
NAELLVLMEN

SEQ ID NO: 355287 - protein, 10 aa, Influenza virus
AELLVLMENE

SEQ ID NO: 355288 - protein, 10 aa, Influenza virus
ELLVLMENER

SEQ ID NO: 355289 - protein, 10 aa, Influenza virus
LLVLMENERT

SEQ ID NO: 355290 - protein, 10 aa, Influenza virus
LVLMENERTL

SEQ ID NO: 355291 - protein, 10 aa, Influenza virus
VLMENERTLD

SEQ ID NO: 355292 - protein, 10 aa, Influenza virus
LMENERTLDF

SEQ ID NO: 355293 - protein, 10 aa, Influenza virus
MENERTLDFH

SEQ ID NO: 355294 - protein, 10 aa, Influenza virus
ENERTLDFHD

SEQ ID NO: 355295 - protein, 10 aa, Influenza virus
NERTLDFHDS

SEQ ID NO: 355296 - protein, 10 aa, Influenza virus
ERTLDFHDSN

SEQ ID NO: 355297 - protein, 10 aa, Influenza virus
RTLDFHDSNV

SEQ ID NO: 355298 - protein, 10 aa, Influenza virus
TLDFHDSNVK

SEQ ID NO: 355299 - protein, 10 aa, Influenza virus
LDFHDSNVKN

SEQ ID NO: 355300 - protein, 10 aa, Influenza virus
DFHDSNVKNL

SEQ ID NO: 355301 - protein, 10 aa, Influenza virus
FHDSNVKNLY

SEQ ID NO: 355302 - protein, 10 aa, Influenza virus
HDSNVKNLYD

SEQ ID NO: 355303 - protein, 10 aa, Influenza virus
VKNLYDKVRM

SEQ ID NO: 355304 - protein, 10 aa, Influenza virus
KNLYDKVRMQ

SEQ ID NO: 355305 - protein, 10 aa, Influenza virus
NLYDKVRMQL

SEQ ID NO: 355306 - protein, 10 aa, Influenza virus
LYDKVRMQLR

SEQ ID NO: 355307 - protein, 10 aa, Influenza virus
YDKVRMQLRD

SEQ ID NO: 355308 - protein, 10 aa, Influenza virus
DKVRMQLRDN

SEQ ID NO: 355309 - protein, 10 aa, Influenza virus
KVRMQLRDNV

SEQ ID NO: 355310 - protein, 10 aa, Influenza virus
VRMQLRDNVK

SEQ ID NO: 355311 - protein, 10 aa, Influenza virus
RMQLRDNVKE

SEQ ID NO: 355312 - protein, 10 aa, Influenza virus
MQLRDNVKEL

SEQ ID NO: 355313 - protein, 10 aa, Influenza virus
QLRDNVKELG

SEQ ID NO: 355314 - protein, 10 aa, Influenza virus
LRDNVKELGN

SEQ ID NO: 355315 - protein, 10 aa, Influenza virus
RDNVKELGNG

SEQ ID NO: 355316 - protein, 10 aa, Influenza virus
DNVKELGNGC

SEQ ID NO: 355317 - protein, 10 aa, Influenza virus
NVKELGNGCF

SEQ ID NO: 355318 - protein, 10 aa, Influenza virus
VKELGNGCFE

SEQ ID NO: 355319 - protein, 10 aa, Influenza virus
KELGNGCFEF

SEQ ID NO: 355320 - protein, 10 aa, Influenza virus
ELGNGCFEFY

SEQ ID NO: 355321 - protein, 10 aa, Influenza virus
LGNGCFEFYH

SEQ ID NO: 355322 - protein, 10 aa, Influenza virus
GNGCFEFYHK

SEQ ID NO: 355323 - protein, 10 aa, Influenza virus
NGCFEFYHKC

SEQ ID NO: 355324 - protein, 10 aa, Influenza virus
GCFEFYHKCD

SEQ ID NO: 355325 - protein, 10 aa, Influenza virus
CFEFYHKCDD

SEQ ID NO: 355326 - protein, 10 aa, Influenza virus
FEFYHKCDDE

SEQ ID NO: 355327 - protein, 10 aa, Influenza virus
EFYHKCDDEC

SEQ ID NO: 355328 - protein, 10 aa, Influenza virus
FYHKCDDECM

SEQ ID NO: 355329 - protein, 10 aa, Influenza virus
CMNSVKNGTY

SEQ ID NO: 355330 - protein, 10 aa, Influenza virus
KNGTYDYPKY

SEQ ID NO: 355331 - protein, 10 aa, Influenza virus
NGTYDYPKYE

SEQ ID NO: 355332 - protein, 10 aa, Influenza virus
GTYDYPKYEE

SEQ ID NO: 355333 - protein, 10 aa, Influenza virus
TYDYPKYEEE

SEQ ID NO: 355334 - protein, 10 aa, Influenza virus
YDYPKYEEES

SEQ ID NO: 355335 - protein, 10 aa, Influenza virus
DYPKYEEESK

SEQ ID NO: 355336 - protein, 10 aa, Influenza virus
YPKYEEESKL

SEQ ID NO: 355337 - protein, 10 aa, Influenza virus
PKYEEESKLN

SEQ ID NO: 355338 - protein, 10 aa, Influenza virus
KYEEESKLNR

SEQ ID NO: 355339 - protein, 10 aa, Influenza virus
YEEESKLNRN

SEQ ID NO: 355340 - protein, 10 aa, Influenza virus
EEESKLNRNE

SEQ ID NO: 355341 - protein, 10 aa, Influenza virus
EESKLNRNEI

SEQ ID NO: 355342 - protein, 10 aa, Influenza virus
ESKLNRNEIK

SEQ ID NO: 355343 - protein, 10 aa, Influenza virus
SKLNRNEIKG

SEQ ID NO: 355344 - protein, 10 aa, Influenza virus
KLNRNEIKGV

SEQ ID NO: 355345 - protein, 10 aa, Influenza virus
LNRNEIKGVK

SEQ ID NO: 355346 - protein, 10 aa, Influenza virus
NRNEIKGVKL

SEQ ID NO: 355347 - protein, 10 aa, Influenza virus
RNEIKGVKLS

SEQ ID NO: 355348 - protein, 10 aa, Influenza virus
NEIKGVKLSS

SEQ ID NO: 355349 - protein, 10 aa, Influenza virus
EIKGVKLSSM

SEQ ID NO: 355350 - protein, 10 aa, Influenza virus
IKGVKLSSMG

SEQ ID NO: 355351 - protein, 10 aa, Influenza virus
KGVKLSSMGV

SEQ ID NO: 355352 - protein, 10 aa, Influenza virus
GVKLSSMGVY

SEQ ID NO: 355353 - protein, 10 aa, Influenza virus
VKLSSMGVYQ

SEQ ID NO: 355354 - protein, 10 aa, Influenza virus
KLSSMGVYQI

SEQ ID NO: 355355 - protein, 10 aa, Influenza virus
LSSMGVYQIL

SEQ ID NO: 355356 - protein, 10 aa, Influenza virus
SSMGVYQILA

SEQ ID NO: 355357 - protein, 10 aa, Influenza virus
SMGVYQILAI

SEQ ID NO: 355358 - protein, 10 aa, Influenza virus
MGVYQILAIY

SEQ ID NO: 355359 - protein, 10 aa, Influenza virus
GVYQILAIYA

SEQ ID NO: 355360 - protein, 10 aa, Influenza virus
VYQILAIYAT

SEQ ID NO: 355361 - protein, 10 aa, Influenza virus
YQILAIYATV

SEQ ID NO: 355362 - protein, 10 aa, Influenza virus
QILAIYATVA

SEQ ID NO: 355363 - protein, 10 aa, Influenza virus
ILAIYATVAG

SEQ ID NO: 355364 - protein, 10 aa, Influenza virus
LAIYATVAGS

SEQ ID NO: 355365 - protein, 10 aa, Influenza virus
AIYATVAGSL

SEQ ID NO: 355366 - protein, 10 aa, Influenza virus
IYATVAGSLS

SEQ ID NO: 355367 - protein, 10 aa, Influenza virus
YATVAGSLSL

SEQ ID NO: 355368 - protein, 10 aa, Influenza virus
ATVAGSLSLA

SEQ ID NO: 355369 - protein, 10 aa, Influenza virus
TVAGSLSLAI

SEQ ID NO: 355370 - protein, 10 aa, Influenza virus
VAGSLSLAIM

SEQ ID NO: 355371 - protein, 10 aa, Influenza virus
AGSLSLAIMM

SEQ ID NO: 355372 - protein, 10 aa, Influenza virus
GSLSLAIMMA

SEQ ID NO: 355373 - protein, 10 aa, Influenza virus
SLSLAIMMAG

SEQ ID NO: 355374 - protein, 10 aa, Influenza virus
LSLAIMMAGI

SEQ ID NO: 355375 - protein, 10 aa, Influenza virus
SLAIMMAGIS

SEQ ID NO: 355376 - protein, 10 aa, Influenza virus
AGISFWMCSN

SEQ ID NO: 355377 - protein, 10 aa, Influenza virus
GISFWMCSNG

SEQ ID NO: 355378 - protein, 10 aa, Influenza virus
ISFWMCSNGS

SEQ ID NO: 355379 - protein, 10 aa, Influenza virus
SFWMCSNGSL

SEQ ID NO: 355380 - protein, 10 aa, Influenza virus
FWMCSNGSLQ

SEQ ID NO: 355381 - protein, 10 aa, Influenza virus
WMCSNGSLQC

SEQ ID NO: 355382 - protein, 10 aa, Influenza virus
MCSNGSLQCR

SEQ ID NO: 355383 - protein, 10 aa, Influenza virus
CSNGSLQCRI

SEQ ID NO: 355384 - protein, 10 aa, Influenza virus
SNGSLQCRIC

SEQ ID NO: 355385 - protein, 10 aa, Influenza virus
NGSLQCRICI

SEQ ID NO: 355386 - protein, 10 aa, Influenza virus
MNPNQKIITI

SEQ ID NO: 355387 - protein, 10 aa, Influenza virus
NPNQKIITIG

SEQ ID NO: 355388 - protein, 10 aa, Influenza virus
PNQKIITIGS

SEQ ID NO: 355389 - protein, 10 aa, Influenza virus
NQKIITIGSV

SEQ ID NO: 355390 - protein, 10 aa, Influenza virus
QKIITIGSVS

SEQ ID NO: 355391 - protein, 10 aa, Influenza virus
KIITIGSVSL

SEQ ID NO: 355392 - protein, 10 aa, Influenza virus
QIAILATTVT

SEQ ID NO: 355393 - protein, 10 aa, Influenza virus
IAILATTVTL

SEQ ID NO: 355394 - protein, 10 aa, Influenza virus
AILATTVTLH

SEQ ID NO: 355395 - protein, 10 aa, Influenza virus
ILATTVTLHF

SEQ ID NO: 355396 - protein, 10 aa, Influenza virus
LATTVTLHFK

SEQ ID NO: 355397 - protein, 10 aa, Influenza virus
ATTVTLHFKQ

SEQ ID NO: 355398 - protein, 10 aa, Influenza virus
TTVTLHFKQH

SEQ ID NO: 355399 - protein, 10 aa, Influenza virus
TVTLHFKQHE

SEQ ID NO: 355400 - protein, 10 aa, Influenza virus
VTLHFKQHEC

SEQ ID NO: 355401 - protein, 10 aa, Influenza virus
TLHFKQHECD

SEQ ID NO: 355402 - protein, 10 aa, Influenza virus
PCEPIIIERN

SEQ ID NO: 355403 - protein, 10 aa, Influenza virus
WSKPQCQITG

SEQ ID NO: 355404 - protein, 10 aa, Influenza virus
SKPQCQITGF

SEQ ID NO: 355405 - protein, 10 aa, Influenza virus
KPQCQITGFA

SEQ ID NO: 355406 - protein, 10 aa, Influenza virus
PQCQITGFAP

SEQ ID NO: 355407 - protein, 10 aa, Influenza virus
QCQITGFAPF

SEQ ID NO: 355408 - protein, 10 aa, Influenza virus
CQITGFAPFS

SEQ ID NO: 355409 - protein, 10 aa, Influenza virus
QITGFAPFSK

SEQ ID NO: 355410 - protein, 10 aa, Influenza virus
ITGFAPFSKD

SEQ ID NO: 355411 - protein, 10 aa, Influenza virus
TGFAPFSKDN

SEQ ID NO: 355412 - protein, 10 aa, Influenza virus
GFAPFSKDNS

SEQ ID NO: 355413 - protein, 10 aa, Influenza virus
FAPFSKDNSI

SEQ ID NO: 355414 - protein, 10 aa, Influenza virus
APFSKDNSIR

SEQ ID NO: 355415 - protein, 10 aa, Influenza virus
PFSKDNSIRL

SEQ ID NO: 355416 - protein, 10 aa, Influenza virus
FSKDNSIRLS

SEQ ID NO: 355417 - protein, 10 aa, Influenza virus
SKDNSIRLSA

SEQ ID NO: 355418 - protein, 10 aa, Influenza virus
KDNSIRLSAG

SEQ ID NO: 355419 - protein, 10 aa, Influenza virus
DNSIRLSAGG

SEQ ID NO: 355420 - protein, 10 aa, Influenza virus
NSIRLSAGGD

SEQ ID NO: 355421 - protein, 10 aa, Influenza virus
SIRLSAGGDI

SEQ ID NO: 355422 - protein, 10 aa, Influenza virus
IRLSAGGDIW

SEQ ID NO: 355423 - protein, 10 aa, Influenza virus
RLSAGGDIWV

SEQ ID NO: 355424 - protein, 10 aa, Influenza virus
LSAGGDIWVT

SEQ ID NO: 355425 - protein, 10 aa, Influenza virus
SAGGDIWVTR

SEQ ID NO: 355426 - protein, 10 aa, Influenza virus
AGGDIWVTRE

SEQ ID NO: 355427 - protein, 10 aa, Influenza virus
GGDIWVTREP

SEQ ID NO: 355428 - protein, 10 aa, Influenza virus
GDIWVTREPY

SEQ ID NO: 355429 - protein, 10 aa, Influenza virus
DIWVTREPYV

SEQ ID NO: 355430 - protein, 10 aa, Influenza virus
IWVTREPYVS

SEQ ID NO: 355431 - protein, 10 aa, Influenza virus
WVTREPYVSC

SEQ ID NO: 355432 - protein, 10 aa, Influenza virus
VTREPYVSCD

SEQ ID NO: 355433 - protein, 10 aa, Influenza virus
TREPYVSCDP

SEQ ID NO: 355434 - protein, 10 aa, Influenza virus
GKCYQFALGQ

SEQ ID NO: 355435 - protein, 10 aa, Influenza virus
KCYQFALGQG

SEQ ID NO: 355436 - protein, 10 aa, Influenza virus
CYQFALGQGT

SEQ ID NO: 355437 - protein, 10 aa, Influenza virus
YQFALGQGTT

SEQ ID NO: 355438 - protein, 10 aa, Influenza virus
QFALGQGTTL

SEQ ID NO: 355439 - protein, 10 aa, Influenza virus
FALGQGTTLD

SEQ ID NO: 355440 - protein, 10 aa, Influenza virus
ALGQGTTLDN

SEQ ID NO: 355441 - protein, 10 aa, Influenza virus
LGQGTTLDNK

SEQ ID NO: 355442 - protein, 10 aa, Influenza virus
GQGTTLDNKH

SEQ ID NO: 355443 - protein, 10 aa, Influenza virus
QGTTLDNKHS

SEQ ID NO: 355444 - protein, 10 aa, Influenza virus
GTTLDNKHSN

SEQ ID NO: 355445 - protein, 10 aa, Influenza virus
TTLDNKHSNG

SEQ ID NO: 355446 - protein, 10 aa, Influenza virus
TLDNKHSNGT

SEQ ID NO: 355447 - protein, 10 aa, Influenza virus
LDNKHSNGTI

SEQ ID NO: 355448 - protein, 10 aa, Influenza virus
DNKHSNGTIH

SEQ ID NO: 355449 - protein, 10 aa, Influenza virus
NKHSNGTIHD

SEQ ID NO: 355450 - protein, 10 aa, Influenza virus
KHSNGTIHDR

SEQ ID NO: 355451 - protein, 10 aa, Influenza virus
TIHDRIPHRT

SEQ ID NO: 355452 - protein, 10 aa, Influenza virus
IHDRIPHRTL

SEQ ID NO: 355453 - protein, 10 aa, Influenza virus
HDRIPHRTLL

SEQ ID NO: 355454 - protein, 10 aa, Influenza virus
DRIPHRTLLM

SEQ ID NO: 355455 - protein, 10 aa, Influenza virus
RIPHRTLLMN

SEQ ID NO: 355456 - protein, 10 aa, Influenza virus
IPHRTLLMNE

SEQ ID NO: 355457 - protein, 10 aa, Influenza virus
PHRTLLMNEL

SEQ ID NO: 355458 - protein, 10 aa, Influenza virus
HRTLLMNELG

SEQ ID NO: 355459 - protein, 10 aa, Influenza virus
RTLLMNELGV

SEQ ID NO: 355460 - protein, 10 aa, Influenza virus
TLLMNELGVP

SEQ ID NO: 355461 - protein, 10 aa, Influenza virus
LLMNELGVPF

SEQ ID NO: 355462 - protein, 10 aa, Influenza virus
LMNELGVPFH

SEQ ID NO: 355463 - protein, 10 aa, Influenza virus
MNELGVPFHL

SEQ ID NO: 355464 - protein, 10 aa, Influenza virus
NELGVPFHLG

SEQ ID NO: 355465 - protein, 10 aa, Influenza virus
ELGVPFHLGT

SEQ ID NO: 355466 - protein, 10 aa, Influenza virus
LGVPFHLGTK

SEQ ID NO: 355467 - protein, 10 aa, Influenza virus
GVPFHLGTKQ

SEQ ID NO: 355468 - protein, 10 aa, Influenza virus
VPFHLGTKQV

SEQ ID NO: 355469 - protein, 10 aa, Influenza virus
PFHLGTKQVC

SEQ ID NO: 355470 - protein, 10 aa, Influenza virus
FHLGTKQVCV

SEQ ID NO: 355471 - protein, 10 aa, Influenza virus
HLGTKQVCVA

SEQ ID NO: 355472 - protein, 10 aa, Influenza virus
LGTKQVCVAW

SEQ ID NO: 355473 - protein, 10 aa, Influenza virus
GTKQVCVAWS

SEQ ID NO: 355474 - protein, 10 aa, Influenza virus
TKQVCVAWSS

SEQ ID NO: 355475 - protein, 10 aa, Influenza virus
KQVCVAWSSS

SEQ ID NO: 355476 - protein, 10 aa, Influenza virus
QVCVAWSSSS

SEQ ID NO: 355477 - protein, 10 aa, Influenza virus
VCVAWSSSSC

SEQ ID NO: 355478 - protein, 10 aa, Influenza virus
CVAWSSSSCH

SEQ ID NO: 355479 - protein, 10 aa, Influenza virus
VAWSSSSCHD

SEQ ID NO: 355480 - protein, 10 aa, Influenza virus
AWSSSSCHDG

SEQ ID NO: 355481 - protein, 10 aa, Influenza virus
WSSSSCHDGK

SEQ ID NO: 355482 - protein, 10 aa, Influenza virus
SSSSCHDGKA

SEQ ID NO: 355483 - protein, 10 aa, Influenza virus
SSSCHDGKAW

SEQ ID NO: 355484 - protein, 10 aa, Influenza virus
SSCHDGKAWL

SEQ ID NO: 355485 - protein, 10 aa, Influenza virus
SCHDGKAWLH

SEQ ID NO: 355486 - protein, 10 aa, Influenza virus
CHDGKAWLHV

SEQ ID NO: 355487 - protein, 10 aa, Influenza virus
HDGKAWLHVC

SEQ ID NO: 355488 - protein, 10 aa, Influenza virus
DGKAWLHVCV

SEQ ID NO: 355489 - protein, 10 aa, Influenza virus
GKAWLHVCVT

SEQ ID NO: 355490 - protein, 10 aa, Influenza virus
KAWLHVCVTG

SEQ ID NO: 355491 - protein, 10 aa, Influenza virus
AWLHVCVTGD

SEQ ID NO: 355492 - protein, 10 aa, Influenza virus
WLHVCVTGDD

SEQ ID NO: 355493 - protein, 10 aa, Influenza virus
CVTGDDRNAT

SEQ ID NO: 355494 - protein, 10 aa, Influenza virus
VTGDDRNATA

SEQ ID NO: 355495 - protein, 10 aa, Influenza virus
TGDDRNATAS

SEQ ID NO: 355496 - protein, 10 aa, Influenza virus
GDDRNATASF

SEQ ID NO: 355497 - protein, 10 aa, Influenza virus
DDRNATASFI

SEQ ID NO: 355498 - protein, 10 aa, Influenza virus
DRNATASFIY

SEQ ID NO: 355499 - protein, 10 aa, Influenza virus
NATASFIYDG

SEQ ID NO: 355500 - protein, 10 aa, Influenza virus
DSIGSWSQNI

SEQ ID NO: 355501 - protein, 10 aa, Influenza virus
SIGSWSQNIL

SEQ ID NO: 355502 - protein, 10 aa, Influenza virus
IGSWSQNILR

SEQ ID NO: 355503 - protein, 10 aa, Influenza virus
GSWSQNILRT

SEQ ID NO: 355504 - protein, 10 aa, Influenza virus
SWSQNILRTQ

SEQ ID NO: 355505 - protein, 10 aa, Influenza virus
WSQNILRTQE

SEQ ID NO: 355506 - protein, 10 aa, Influenza virus
SQNILRTQES

SEQ ID NO: 355507 - protein, 10 aa, Influenza virus
QNILRTQESE

SEQ ID NO: 355508 - protein, 10 aa, Influenza virus
NILRTQESEC

SEQ ID NO: 355509 - protein, 10 aa, Influenza virus
ILRTQESECV

SEQ ID NO: 355510 - protein, 10 aa, Influenza virus
LRTQESECVC

SEQ ID NO: 355511 - protein, 10 aa, Influenza virus
RTQESECVCI

SEQ ID NO: 355512 - protein, 10 aa, Influenza virus
TQESECVCIN

SEQ ID NO: 355513 - protein, 10 aa, Influenza virus
QESECVCING

SEQ ID NO: 355514 - protein, 10 aa, Influenza virus
ESECVCINGT

SEQ ID NO: 355515 - protein, 10 aa, Influenza virus
SECVCINGTC

SEQ ID NO: 355516 - protein, 10 aa, Influenza virus
ECVCINGTCT

SEQ ID NO: 355517 - protein, 10 aa, Influenza virus
CVCINGTCTV

SEQ ID NO: 355518 - protein, 10 aa, Influenza virus
VCINGTCTVV

SEQ ID NO: 355519 - protein, 10 aa, Influenza virus
CINGTCTVVM

SEQ ID NO: 355520 - protein, 10 aa, Influenza virus
INGTCTVVMT

SEQ ID NO: 355521 - protein, 10 aa, Influenza virus
NGTCTVVMTD

SEQ ID NO: 355522 - protein, 10 aa, Influenza virus
GTCTVVMTDG

SEQ ID NO: 355523 - protein, 10 aa, Influenza virus
TCTVVMTDGS

SEQ ID NO: 355524 - protein, 10 aa, Influenza virus
CTVVMTDGSA

SEQ ID NO: 355525 - protein, 10 aa, Influenza virus
TVVMTDGSAS

SEQ ID NO: 355526 - protein, 10 aa, Influenza virus
VVMTDGSASG

SEQ ID NO: 355527 - protein, 10 aa, Influenza virus
VMTDGSASGR

SEQ ID NO: 355528 - protein, 10 aa, Influenza virus
MTDGSASGRA

SEQ ID NO: 355529 - protein, 10 aa, Influenza virus
TDGSASGRAD

SEQ ID NO: 355530 - protein, 10 aa, Influenza virus
DGSASGRADT

SEQ ID NO: 355531 - protein, 10 aa, Influenza virus
GSASGRADTR

SEQ ID NO: 355532 - protein, 10 aa, Influenza virus
SASGRADTRI

SEQ ID NO: 355533 - protein, 10 aa, Influenza virus
ASGRADTRIL

SEQ ID NO: 355534 - protein, 10 aa, Influenza virus
SGRADTRILF

SEQ ID NO: 355535 - protein, 10 aa, Influenza virus
GRADTRILFI

SEQ ID NO: 355536 - protein, 10 aa, Influenza virus
ADTRILFIKE

SEQ ID NO: 355537 - protein, 10 aa, Influenza virus
DTRILFIKEG

SEQ ID NO: 355538 - protein, 10 aa, Influenza virus
TRILFIKEGK

SEQ ID NO: 355539 - protein, 10 aa, Influenza virus
EGKIVHISPL

SEQ ID NO: 355540 - protein, 10 aa, Influenza virus
VHISPLSGSA

SEQ ID NO: 355541 - protein, 10 aa, Influenza virus
HISPLSGSAQ

SEQ ID NO: 355542 - protein, 10 aa, Influenza virus
ISPLSGSAQH

SEQ ID NO: 355543 - protein, 10 aa, Influenza virus
SPLSGSAQHI

SEQ ID NO: 355544 - protein, 10 aa, Influenza virus
PLSGSAQHIE

SEQ ID NO: 355545 - protein, 10 aa, Influenza virus
LSGSAQHIEE

SEQ ID NO: 355546 - protein, 10 aa, Influenza virus
SGSAQHIEEC

SEQ ID NO: 355547 - protein, 10 aa, Influenza virus
GSAQHIEECS

SEQ ID NO: 355548 - protein, 10 aa, Influenza virus
SAQHIEECSC

SEQ ID NO: 355549 - protein, 10 aa, Influenza virus
AQHIEECSCY

SEQ ID NO: 355550 - protein, 10 aa, Influenza virus
QHIEECSCYP

SEQ ID NO: 355551 - protein, 10 aa, Influenza virus
HIEECSCYPR

SEQ ID NO: 355552 - protein, 10 aa, Influenza virus
IEECSCYPRY

SEQ ID NO: 355553 - protein, 10 aa, Influenza virus
EECSCYPRYP

SEQ ID NO: 355554 - protein, 10 aa, Influenza virus
ECSCYPRYPD

SEQ ID NO: 355555 - protein, 10 aa, Influenza virus
CSCYPRYPDV

SEQ ID NO: 355556 - protein, 10 aa, Influenza virus
SCYPRYPDVR

SEQ ID NO: 355557 - protein, 10 aa, Influenza virus
CYPRYPDVRC

SEQ ID NO: 355558 - protein, 10 aa, Influenza virus
YPDVRCICRD

SEQ ID NO: 355559 - protein, 10 aa, Influenza virus
PDVRCICRDN

SEQ ID NO: 355560 - protein, 10 aa, Influenza virus
DVRCICRDNW

SEQ ID NO: 355561 - protein, 10 aa, Influenza virus
VRCICRDNWK

SEQ ID NO: 355562 - protein, 10 aa, Influenza virus
RCICRDNWKG

SEQ ID NO: 355563 - protein, 10 aa, Influenza virus
CICRDNWKGS

SEQ ID NO: 355564 - protein, 10 aa, Influenza virus
ICRDNWKGSN

SEQ ID NO: 355565 - protein, 10 aa, Influenza virus
CRDNWKGSNR

SEQ ID NO: 355566 - protein, 10 aa, Influenza virus
RDNWKGSNRP

SEQ ID NO: 355567 - protein, 10 aa, Influenza virus
DNWKGSNRPV

SEQ ID NO: 355568 - protein, 10 aa, Influenza virus
GSNRPVIDIN

SEQ ID NO: 355569 - protein, 10 aa, Influenza virus
DINMEDYSID

SEQ ID NO: 355570 - protein, 10 aa, Influenza virus
INMEDYSIDS

SEQ ID NO: 355571 - protein, 10 aa, Influenza virus
DYSIDSSYVC

SEQ ID NO: 355572 - protein, 10 aa, Influenza virus
YSIDSSYVCS

SEQ ID NO: 355573 - protein, 10 aa, Influenza virus
SIDSSYVCSG

SEQ ID NO: 355574 - protein, 10 aa, Influenza virus
IDSSYVCSGL

SEQ ID NO: 355575 - protein, 10 aa, Influenza virus
DSSYVCSGLV

SEQ ID NO: 355576 - protein, 10 aa, Influenza virus
SSYVCSGLVG

SEQ ID NO: 355577 - protein, 10 aa, Influenza virus
SYVCSGLVGD

SEQ ID NO: 355578 - protein, 10 aa, Influenza virus
YVCSGLVGDT

SEQ ID NO: 355579 - protein, 10 aa, Influenza virus
VCSGLVGDTP

SEQ ID NO: 355580 - protein, 10 aa, Influenza virus
CSGLVGDTPR

SEQ ID NO: 355581 - protein, 10 aa, Influenza virus
SGLVGDTPRN

SEQ ID NO: 355582 - protein, 10 aa, Influenza virus
GLVGDTPRND

SEQ ID NO: 355583 - protein, 10 aa, Influenza virus
LVGDTPRNDD

SEQ ID NO: 355584 - protein, 10 aa, Influenza virus
VGDTPRNDDS

SEQ ID NO: 355585 - protein, 10 aa, Influenza virus
GDTPRNDDSS

SEQ ID NO: 355586 - protein, 10 aa, Influenza virus
DTPRNDDSSS

SEQ ID NO: 355587 - protein, 10 aa, Influenza virus
SNSNCRDPNN

SEQ ID NO: 355588 - protein, 10 aa, Influenza virus
NSNCRDPNNE

SEQ ID NO: 355589 - protein, 10 aa, Influenza virus
SNCRDPNNER

SEQ ID NO: 355590 - protein, 10 aa, Influenza virus
NCRDPNNERG

SEQ ID NO: 355591 - protein, 10 aa, Influenza virus
PNNERGNPGV

SEQ ID NO: 355592 - protein, 10 aa, Influenza virus
NNERGNPGVK

SEQ ID NO: 355593 - protein, 10 aa, Influenza virus
NERGNPGVKG

SEQ ID NO: 355594 - protein, 10 aa, Influenza virus
ERGNPGVKGW

SEQ ID NO: 355595 - protein, 10 aa, Influenza virus
RGNPGVKGWA

SEQ ID NO: 355596 - protein, 10 aa, Influenza virus
GNPGVKGWAF

SEQ ID NO: 355597 - protein, 10 aa, Influenza virus
NPGVKGWAFD

SEQ ID NO: 355598 - protein, 10 aa, Influenza virus
PGVKGWAFDN

SEQ ID NO: 355599 - protein, 10 aa, Influenza virus
GVKGWAFDNG

SEQ ID NO: 355600 - protein, 10 aa, Influenza virus
GDDVWMGRTI

SEQ ID NO: 355601 - protein, 10 aa, Influenza virus
KDLRSGYETF

SEQ ID NO: 355602 - protein, 10 aa, Influenza virus
DLRSGYETFK

SEQ ID NO: 355603 - protein, 10 aa, Influenza virus
LRSGYETFKV

SEQ ID NO: 355604 - protein, 10 aa, Influenza virus
RSGYETFKVI

SEQ ID NO: 355605 - protein, 10 aa, Influenza virus
SGYETFKVIG

SEQ ID NO: 355606 - protein, 10 aa, Influenza virus
GYETFKVIGG

SEQ ID NO: 355607 - protein, 10 aa, Influenza virus
YETFKVIGGW

SEQ ID NO: 355608 - protein, 10 aa, Influenza virus
ETFKVIGGWS

SEQ ID NO: 355609 - protein, 10 aa, Influenza virus
TFKVIGGWST

SEQ ID NO: 355610 - protein, 10 aa, Influenza virus
NNNWSGYSGI

SEQ ID NO: 355611 - protein, 10 aa, Influenza virus
NNWSGYSGIF

SEQ ID NO: 355612 - protein, 10 aa, Influenza virus
NWSGYSGIFS

SEQ ID NO: 355613 - protein, 10 aa, Influenza virus
WSGYSGIFSV

SEQ ID NO: 355614 - protein, 10 aa, Influenza virus
SGYSGIFSVE

SEQ ID NO: 355615 - protein, 10 aa, Influenza virus
GYSGIFSVEG

SEQ ID NO: 355616 - protein, 10 aa, Influenza virus
YSGIFSVEGK

SEQ ID NO: 355617 - protein, 10 aa, Influenza virus
KSCINRCFYV

SEQ ID NO: 355618 - protein, 10 aa, Influenza virus
SCINRCFYVE

SEQ ID NO: 355619 - protein, 10 aa, Influenza virus
CINRCFYVEL

SEQ ID NO: 355620 - protein, 10 aa, Influenza virus
INRCFYVELI

SEQ ID NO: 355621 - protein, 10 aa, Influenza virus
NRCFYVELIR

SEQ ID NO: 355622 - protein, 10 aa, Influenza virus
RCFYVELIRG

SEQ ID NO: 355623 - protein, 10 aa, Influenza virus
CFYVELIRGR

SEQ ID NO: 355624 - protein, 10 aa, Influenza virus
FYVELIRGRP

SEQ ID NO: 355625 - protein, 10 aa, Influenza virus
YVELIRGRPQ

SEQ ID NO: 355626 - protein, 10 aa, Influenza virus
VELIRGRPQE

SEQ ID NO: 355627 - protein, 10 aa, Influenza virus
PQETRVWWTS

SEQ ID NO: 355628 - protein, 10 aa, Influenza virus
QETRVWWTSN

SEQ ID NO: 355629 - protein, 10 aa, Influenza virus
ETRVWWTSNS

SEQ ID NO: 355630 - protein, 10 aa, Influenza virus
TRVWWTSNSI

SEQ ID NO: 355631 - protein, 10 aa, Influenza virus
RVWWTSNSIV

SEQ ID NO: 355632 - protein, 10 aa, Influenza virus
VWWTSNSIVV

SEQ ID NO: 355633 - protein, 10 aa, Influenza virus
WWTSNSIVVF

SEQ ID NO: 355634 - protein, 10 aa, Influenza virus
WTSNSIVVFC

SEQ ID NO: 355635 - protein, 10 aa, Influenza virus
TSNSIVVFCG

SEQ ID NO: 355636 - protein, 10 aa, Influenza virus
SNSIVVFCGT

SEQ ID NO: 355637 - protein, 10 aa, Influenza virus
NSIVVFCGTS

SEQ ID NO: 355638 - protein, 10 aa, Influenza virus
SIVVFCGTSG

SEQ ID NO: 355639 - protein, 10 aa, Influenza virus
IVVFCGTSGT

SEQ ID NO: 355640 - protein, 10 aa, Influenza virus
VVFCGTSGTY

SEQ ID NO: 355641 - protein, 10 aa, Influenza virus
VFCGTSGTYG

SEQ ID NO: 355642 - protein, 10 aa, Influenza virus
FCGTSGTYGT

SEQ ID NO: 355643 - protein, 10 aa, Influenza virus
CGTSGTYGTG

SEQ ID NO: 355644 - protein, 10 aa, Influenza virus
GTSGTYGTGS

SEQ ID NO: 355645 - protein, 10 aa, Influenza virus
TSGTYGTGSW

SEQ ID NO: 355646 - protein, 10 aa, Influenza virus
SGTYGTGSWP

SEQ ID NO: 355647 - protein, 10 aa, Influenza virus
GTYGTGSWPD

SEQ ID NO: 355648 - protein, 10 aa, Influenza virus
TYGTGSWPDG

SEQ ID NO: 355649 - protein, 10 aa, Influenza virus
YGTGSWPDGA

SEQ ID NO: 355650 - protein, 10 aa, Influenza virus
GTGSWPDGAN

SEQ ID NO: 355651 - protein, 10 aa, Influenza virus
TGSWPDGANI

SEQ ID NO: 355652 - protein, 10 aa, Influenza virus
GSWPDGANIN

SEQ ID NO: 355653 - protein, 10 aa, Influenza virus
SWPDGANINF

SEQ ID NO: 355654 - protein, 10 aa, Influenza virus
WPDGANINFM

SEQ ID NO: 355655 - protein, 10 aa, Influenza virus
PDGANINFMP

SEQ ID NO: 355656 - protein, 10 aa, Influenza virus
DGANINFMPI

SEQ ID NO: 355657 - protein, 10 aa, Influenza virus
MLSLIMRTVI

SEQ ID NO: 355658 - protein, 10 aa, Influenza virus
LSLIMRTVIA

SEQ ID NO: 355659 - protein, 10 aa, Influenza virus
SLIMRTVIAL

SEQ ID NO: 355660 - protein, 10 aa, Influenza virus
LIMRTVIALS

SEQ ID NO: 355661 - protein, 10 aa, Influenza virus
SMSGFRSNLP

SEQ ID NO: 355662 - protein, 10 aa, Influenza virus
IFIFILLTHW

SEQ ID NO: 355663 - protein, 10 aa, Influenza virus
FIFILLTHWA

SEQ ID NO: 355664 - protein, 10 aa, Influenza virus
RFSYVFCLAL

SEQ ID NO: 355665 - protein, 10 aa, Influenza virus
NNNNNTATLC

SEQ ID NO: 355666 - protein, 10 aa, Influenza virus
NNSTATLCLG

SEQ ID NO: 355667 - protein, 10 aa, Influenza virus
TATLCLGHHA

SEQ ID NO: 355668 - protein, 10 aa, Influenza virus
ATLCLGHHAV

SEQ ID NO: 355669 - protein, 10 aa, Influenza virus
TLCLGHHAVP

SEQ ID NO: 355670 - protein, 10 aa, Influenza virus
LCLGHHAVPN

SEQ ID NO: 355671 - protein, 10 aa, Influenza virus
CLGHHAVPNG

SEQ ID NO: 355672 - protein, 10 aa, Influenza virus
LGHHAVPNGT

SEQ ID NO: 355673 - protein, 10 aa, Influenza virus
DQIEVTNATE

SEQ ID NO: 355674 - protein, 10 aa, Influenza virus
QIEVTNATEL

SEQ ID NO: 355675 - protein, 10 aa, Influenza virus
IEVTNATELV

SEQ ID NO: 355676 - protein, 10 aa, Influenza virus
EVTNATELVQ

SEQ ID NO: 355677 - protein, 10 aa, Influenza virus
VTNATELVQS

SEQ ID NO: 355678 - protein, 10 aa, Influenza virus
WEKNCTLIDA

SEQ ID NO: 355679 - protein, 10 aa, Influenza virus
CTLIDALLGD

SEQ ID NO: 355680 - protein, 10 aa, Influenza virus
TLIDALLGDP

SEQ ID NO: 355681 - protein, 10 aa, Influenza virus
DALLGDPQCD

SEQ ID NO: 355682 - protein, 10 aa, Influenza virus
SLRSLVASSG

SEQ ID NO: 355683 - protein, 10 aa, Influenza virus
LRSLVASSGT

SEQ ID NO: 355684 - protein, 10 aa, Influenza virus
RSLVASSGTL

SEQ ID NO: 355685 - protein, 10 aa, Influenza virus
SLVASSGTLE

SEQ ID NO: 355686 - protein, 10 aa, Influenza virus
FDKLYIWGVH

SEQ ID NO: 355687 - protein, 10 aa, Influenza virus
DKLYIWGVHH

SEQ ID NO: 355688 - protein, 10 aa, Influenza virus
KLYIWGVHHP

SEQ ID NO: 355689 - protein, 10 aa, Influenza virus
STGNLIAPRG

SEQ ID NO: 355690 - protein, 10 aa, Influenza virus
TGNLIAPRGY

SEQ ID NO: 355691 - protein, 10 aa, Influenza virus
GNLIAPRGYF

SEQ ID NO: 355692 - protein, 10 aa, Influenza virus
NLIAPRGYFK

SEQ ID NO: 355693 - protein, 10 aa, Influenza virus
LNNEIRWPPH

SEQ ID NO: 355694 - protein, 10 aa, Influenza virus
SECITPNGSI

SEQ ID NO: 355695 - protein, 10 aa, Influenza virus
ECITPNGSIP

SEQ ID NO: 355696 - protein, 10 aa, Influenza virus
CITPNGSIPN

SEQ ID NO: 355697 - protein, 10 aa, Influenza virus
ITPNGSIPND

SEQ ID NO: 355698 - protein, 10 aa, Influenza virus
GSIPNDKPFQ

SEQ ID NO: 355699 - protein, 10 aa, Influenza virus
KPFQNVNRIT

SEQ ID NO: 355700 - protein, 10 aa, Influenza virus
PFQNVNRITY

SEQ ID NO: 355701 - protein, 10 aa, Influenza virus
FQNVNRITYG

SEQ ID NO: 355702 - protein, 10 aa, Influenza virus
TLKLATGMRN

SEQ ID NO: 355703 - protein, 10 aa, Influenza virus
LKLATGMRNV

SEQ ID NO: 355704 - protein, 10 aa, Influenza virus
KLATGMRNVP

SEQ ID NO: 355705 - protein, 10 aa, Influenza virus
LATGMRNVPE

SEQ ID NO: 355706 - protein, 10 aa, Influenza virus
ATGMRNVPEK

SEQ ID NO: 355707 - protein, 10 aa, Influenza virus
RGIFGAIAGF

SEQ ID NO: 355708 - protein, 10 aa, Influenza virus
GIFGAIAGFI

SEQ ID NO: 355709 - protein, 10 aa, Influenza virus
IFGAIAGFIE

SEQ ID NO: 355710 - protein, 10 aa, Influenza virus
FGAIAGFIEN

SEQ ID NO: 355711 - protein, 10 aa, Influenza virus
GAIAGFIENG

SEQ ID NO: 355712 - protein, 10 aa, Influenza virus
AIAGFIENGW

SEQ ID NO: 355713 - protein, 10 aa, Influenza virus
IAGFIENGWE

SEQ ID NO: 355714 - protein, 10 aa, Influenza virus
AGFIENGWEG

SEQ ID NO: 355715 - protein, 10 aa, Influenza virus
GFIENGWEGM

SEQ ID NO: 355716 - protein, 10 aa, Influenza virus
FIENGWEGMV

SEQ ID NO: 355717 - protein, 10 aa, Influenza virus
IENGWEGMVD

SEQ ID NO: 355718 - protein, 10 aa, Influenza virus
ENGWEGMVDG

SEQ ID NO: 355719 - protein, 10 aa, Influenza virus
NGWEGMVDGW

SEQ ID NO: 355720 - protein, 10 aa, Influenza virus
GWEGMVDGWY

SEQ ID NO: 355721 - protein, 10 aa, Influenza virus
WEGMVDGWYG

SEQ ID NO: 355722 - protein, 10 aa, Influenza virus
EGMVDGWYGF

SEQ ID NO: 355723 - protein, 10 aa, Influenza virus
GMVDGWYGFR

SEQ ID NO: 355724 - protein, 10 aa, Influenza virus
MVDGWYGFRH

SEQ ID NO: 355725 - protein, 10 aa, Influenza virus
DGWYGFRHQN

SEQ ID NO: 355726 - protein, 10 aa, Influenza virus
GWYGFRHQNS

SEQ ID NO: 355727 - protein, 10 aa, Influenza virus
GRLVRFRHQN

SEQ ID NO: 355728 - protein, 10 aa, Influenza virus
RLVRFRHQNS

SEQ ID NO: 355729 - protein, 10 aa, Influenza virus
WYGFRHQNSE

SEQ ID NO: 355730 - protein, 10 aa, Influenza virus
YGFRHQNSEG

SEQ ID NO: 355731 - protein, 10 aa, Influenza virus
NSEGTGQAAD

SEQ ID NO: 355732 - protein, 10 aa, Influenza virus
SEGTGQAADL

SEQ ID NO: 355733 - protein, 10 aa, Influenza virus
EGTGQAADLK

SEQ ID NO: 355734 - protein, 10 aa, Influenza virus
GTGQAADLKS

SEQ ID NO: 355735 - protein, 10 aa, Influenza virus
TGQAADLKST

SEQ ID NO: 355736 - protein, 10 aa, Influenza virus
GQAADLKSTQ

SEQ ID NO: 355737 - protein, 10 aa, Influenza virus
QAADLKSTQA

SEQ ID NO: 355738 - protein, 10 aa, Influenza virus
AADLKSTQAA

SEQ ID NO: 355739 - protein, 10 aa, Influenza virus
ADLKSTQAAI

SEQ ID NO: 355740 - protein, 10 aa, Influenza virus
DLKSTQAAID

SEQ ID NO: 355741 - protein, 10 aa, Influenza virus
LKSTQAAIDQ

SEQ ID NO: 355742 - protein, 10 aa, Influenza virus
KSTQAAIDQI

SEQ ID NO: 355743 - protein, 10 aa, Influenza virus
IGKTNEKFHQ

SEQ ID NO: 355744 - protein, 10 aa, Influenza virus
GKTNEKFHQI

SEQ ID NO: 355745 - protein, 10 aa, Influenza virus
KTNEKFHQIE

SEQ ID NO: 355746 - protein, 10 aa, Influenza virus
TNEKFHQIEK

SEQ ID NO: 355747 - protein, 10 aa, Influenza virus
NEKFHQIEKE

SEQ ID NO: 355748 - protein, 10 aa, Influenza virus
EKFHQIEKEF

SEQ ID NO: 355749 - protein, 10 aa, Influenza virus
KFHQIEKEFS

SEQ ID NO: 355750 - protein, 10 aa, Influenza virus
FHQIEKEFSE

SEQ ID NO: 355751 - protein, 10 aa, Influenza virus
HQIEKEFSEV

SEQ ID NO: 355752 - protein, 10 aa, Influenza virus
QIEKEFSEVE

SEQ ID NO: 355753 - protein, 10 aa, Influenza virus
IEKEFSEVEG

SEQ ID NO: 355754 - protein, 10 aa, Influenza virus
EKEFSEVEGR

SEQ ID NO: 355755 - protein, 10 aa, Influenza virus
KEFSEVEGRI

SEQ ID NO: 355756 - protein, 10 aa, Influenza virus
EFSEVEGRIQ

SEQ ID NO: 355757 - protein, 10 aa, Influenza virus
FSEVEGRIQD

SEQ ID NO: 355758 - protein, 10 aa, Influenza virus
SEVEGRIQDL

SEQ ID NO: 355759 - protein, 10 aa, Influenza virus
EVEGRIQDLE

SEQ ID NO: 355760 - protein, 10 aa, Influenza virus
VEGRIQDLEK

SEQ ID NO: 355761 - protein, 10 aa, Influenza virus
EGRIQDLEKY

SEQ ID NO: 355762 - protein, 10 aa, Influenza virus
GRIQDLEKYV

SEQ ID NO: 355763 - protein, 10 aa, Influenza virus
RIQDLEKYVE

SEQ ID NO: 355764 - protein, 10 aa, Influenza virus
IQDLEKYVED

SEQ ID NO: 355765 - protein, 10 aa, Influenza virus
QDLEKYVEDT

SEQ ID NO: 355766 - protein, 10 aa, Influenza virus
DLEKYVEDTK

SEQ ID NO: 355767 - protein, 10 aa, Influenza virus
LEKYVEDTKI

SEQ ID NO: 355768 - protein, 10 aa, Influenza virus
EKYVEDTKID

SEQ ID NO: 355769 - protein, 10 aa, Influenza virus
KYVEDTKIDL

SEQ ID NO: 355770 - protein, 10 aa, Influenza virus
YVEDTKIDLW

SEQ ID NO: 355771 - protein, 10 aa, Influenza virus
VEDTKIDLWS

SEQ ID NO: 355772 - protein, 10 aa, Influenza virus
EDTKIDLWSY

SEQ ID NO: 355773 - protein, 10 aa, Influenza virus
DTKIDLWSYN

SEQ ID NO: 355774 - protein, 10 aa, Influenza virus
TKIDLWSYNA

SEQ ID NO: 355775 - protein, 10 aa, Influenza virus
KIDLWSYNAE

SEQ ID NO: 355776 - protein, 10 aa, Influenza virus
IDLWSYNAEL

SEQ ID NO: 355777 - protein, 10 aa, Influenza virus
DLWSYNAELL

SEQ ID NO: 355778 - protein, 10 aa, Influenza virus
LWSYNAELLV

SEQ ID NO: 355779 - protein, 10 aa, Influenza virus
WSYNAELLVA

SEQ ID NO: 355780 - protein, 10 aa, Influenza virus
SYNAELLVAL

SEQ ID NO: 355781 - protein, 10 aa, Influenza virus
YNAELLVALE

SEQ ID NO: 355782 - protein, 10 aa, Influenza virus
NAELLVALEN

SEQ ID NO: 355783 - protein, 10 aa, Influenza virus
AELLVALENQ

SEQ ID NO: 355784 - protein, 10 aa, Influenza virus
ELLVALENQH

SEQ ID NO: 355785 - protein, 10 aa, Influenza virus
LLVALENQHT

SEQ ID NO: 355786 - protein, 10 aa, Influenza virus
LVALENQHTI

SEQ ID NO: 355787 - protein, 10 aa, Influenza virus
VALENQHTID

SEQ ID NO: 355788 - protein, 10 aa, Influenza virus
ALENQHTIDL

SEQ ID NO: 355789 - protein, 10 aa, Influenza virus
LENQHTIDLT

SEQ ID NO: 355790 - protein, 10 aa, Influenza virus
ENQHTIDLTD

SEQ ID NO: 355791 - protein, 10 aa, Influenza virus
NQHTIDLTDS

SEQ ID NO: 355792 - protein, 10 aa, Influenza virus
QHTIDLTDSE

SEQ ID NO: 355793 - protein, 10 aa, Influenza virus
HTIDLTDSEM

SEQ ID NO: 355794 - protein, 10 aa, Influenza virus
TIDLTDSEMN

SEQ ID NO: 355795 - protein, 10 aa, Influenza virus
LTDSEMNKLF

SEQ ID NO: 355796 - protein, 10 aa, Influenza virus
TDSEMNKLFE

SEQ ID NO: 355797 - protein, 10 aa, Influenza virus
TKKQLRENAE

SEQ ID NO: 355798 - protein, 10 aa, Influenza virus
KKQLRENAED

SEQ ID NO: 355799 - protein, 10 aa, Influenza virus
KQLRENAEDM

SEQ ID NO: 355800 - protein, 10 aa, Influenza virus
QLRENAEDMG

SEQ ID NO: 355801 - protein, 10 aa, Influenza virus
LRENAEDMGN

SEQ ID NO: 355802 - protein, 10 aa, Influenza virus
RENAEDMGNG

SEQ ID NO: 355803 - protein, 10 aa, Influenza virus
ENAEDMGNGC

SEQ ID NO: 355804 - protein, 10 aa, Influenza virus
NAEDMGNGCF

SEQ ID NO: 355805 - protein, 10 aa, Influenza virus
GCFKIYHKCD

SEQ ID NO: 355806 - protein, 10 aa, Influenza virus
CFKIYHKCDN

SEQ ID NO: 355807 - protein, 10 aa, Influenza virus
GYKDWILWIS

SEQ ID NO: 355808 - protein, 10 aa, Influenza virus
YKDWILWISF

SEQ ID NO: 355809 - protein, 10 aa, Influenza virus
KDWILWISFA

SEQ ID NO: 355810 - protein, 10 aa, Influenza virus
DWILWISFAI

SEQ ID NO: 355811 - protein, 10 aa, Influenza virus
WILWISFAIS

SEQ ID NO: 355812 - protein, 10 aa, Influenza virus
ILWISFAISC

SEQ ID NO: 355813 - protein, 10 aa, Influenza virus
LWISFAISCF

SEQ ID NO: 355814 - protein, 10 aa, Influenza virus
WISFAISCFL

SEQ ID NO: 355815 - protein, 10 aa, Influenza virus
GFIMWACQKG

SEQ ID NO: 355816 - protein, 10 aa, Influenza virus
FIMWACQKGN

SEQ ID NO: 355817 - protein, 10 aa, Influenza virus
IMWACQKGNI

SEQ ID NO: 355818 - protein, 10 aa, Influenza virus
MWACQKGNIR

SEQ ID NO: 355819 - protein, 10 aa, Influenza virus
WACQKGNIRC

SEQ ID NO: 355820 - protein, 10 aa, Influenza virus
ACQKGNIRCN

SEQ ID NO: 355821 - protein, 10 aa, Influenza virus
CQKGNIRCNI

SEQ ID NO: 355822 - protein, 10 aa, Influenza virus
QKGNIRCNIC

SEQ ID NO: 355823 - protein, 10 aa, Influenza virus
KGNIRCNICI

SEQ ID NO: 355824 - protein, 10 aa, Influenza virus
HSMSGFRSNL

SEQ ID NO: 355825 - protein, 10 aa, Influenza virus
MKTIIIVLSC

SEQ ID NO: 355826 - protein, 10 aa, Influenza virus
NNNNNTATLC

SEQ ID NO: 355827 - protein, 10 aa, Influenza virus
NNSTATLCLG

SEQ ID NO: 355828 - protein, 10 aa, Influenza virus
TATLCLGHHA

SEQ ID NO: 355829 - protein, 10 aa, Influenza virus
ATLCLGHHAV

SEQ ID NO: 355830 - protein, 10 aa, Influenza virus
TLCLGHHAVP

SEQ ID NO: 355831 - protein, 10 aa, Influenza virus
LCLGHHAVPN

SEQ ID NO: 355832 - protein, 10 aa, Influenza virus
CLGHHAVPNG

SEQ ID NO: 355833 - protein, 10 aa, Influenza virus
LGHHAVPNGT

SEQ ID NO: 355834 - protein, 10 aa, Influenza virus
GHHAVPNGTI

SEQ ID NO: 355835 - protein, 10 aa, Influenza virus
HHAVPNGTIV

SEQ ID NO: 355836 - protein, 10 aa, Influenza virus
HAVPNGTIVK

SEQ ID NO: 355837 - protein, 10 aa, Influenza virus
AVPNGTIVKT

SEQ ID NO: 355838 - protein, 10 aa, Influenza virus
VPNGTIVKTI

SEQ ID NO: 355839 - protein, 10 aa, Influenza virus
PNGTIVKTIT

SEQ ID NO: 355840 - protein, 10 aa, Influenza virus
DQIEVTNATE

SEQ ID NO: 355841 - protein, 10 aa, Influenza virus
QIEVTNATEL

SEQ ID NO: 355842 - protein, 10 aa, Influenza virus
IEVTNATELV

SEQ ID NO: 355843 - protein, 10 aa, Influenza virus
EVTNATELVQ

SEQ ID NO: 355844 - protein, 10 aa, Influenza virus
VTNATELVQS

SEQ ID NO: 355845 - protein, 10 aa, Influenza virus
KNCTLIDALL

SEQ ID NO: 355846 - protein, 10 aa, Influenza virus
CTLIDALLGD

SEQ ID NO: 355847 - protein, 10 aa, Influenza virus
TLIDALLGDP

SEQ ID NO: 355848 - protein, 10 aa, Influenza virus
LIDALLGDPQ

SEQ ID NO: 355849 - protein, 10 aa, Influenza virus
IDALLGDPQC

SEQ ID NO: 355850 - protein, 10 aa, Influenza virus
DALLGDPQCD

SEQ ID NO: 355851 - protein, 10 aa, Influenza virus
SLRSLVASSG

SEQ ID NO: 355852 - protein, 10 aa, Influenza virus
LRSLVASSGT

SEQ ID NO: 355853 - protein, 10 aa, Influenza virus
RSLVASSGTL

SEQ ID NO: 355854 - protein, 10 aa, Influenza virus
SLVASSGTLE

SEQ ID NO: 355855 - protein, 10 aa, Influenza virus
LVASSGTLEF

SEQ ID NO: 355856 - protein, 10 aa, Influenza virus
FDKLYIWGVH

SEQ ID NO: 355857 - protein, 10 aa, Influenza virus
DKLYIWGVHH

SEQ ID NO: 355858 - protein, 10 aa, Influenza virus
KLYIWGVHHP

SEQ ID NO: 355859 - protein, 10 aa, Influenza virus
SIYWTIVKPG

SEQ ID NO: 355860 - protein, 10 aa, Influenza virus
IYWTIVKPGD

SEQ ID NO: 355861 - protein, 10 aa, Influenza virus
STGNLIAPRG

SEQ ID NO: 355862 - protein, 10 aa, Influenza virus
TGNLIAPRGY

SEQ ID NO: 355863 - protein, 10 aa, Influenza virus
GNLIAPRGYF

SEQ ID NO: 355864 - protein, 10 aa, Influenza virus
NLIAPRGYFK

SEQ ID NO: 355865 - protein, 10 aa, Influenza virus
LIAPRGYFKI

SEQ ID NO: 355866 - protein, 10 aa, Influenza virus
LNNEIRWPPH

SEQ ID NO: 355867 - protein, 10 aa, Influenza virus
SECITPNGSI

SEQ ID NO: 355868 - protein, 10 aa, Influenza virus
ECITPNGSIP

SEQ ID NO: 355869 - protein, 10 aa, Influenza virus
CITPNGSIPN

SEQ ID NO: 355870 - protein, 10 aa, Influenza virus
ITPNGSIPND

SEQ ID NO: 355871 - protein, 10 aa, Influenza virus
TPNGSIPNDK

SEQ ID NO: 355872 - protein, 10 aa, Influenza virus
PNGSIPNDKP

SEQ ID NO: 355873 - protein, 10 aa, Influenza virus
NGSIPNDKPF

SEQ ID NO: 355874 - protein, 10 aa, Influenza virus
GSIPNDKPFQ

SEQ ID NO: 355875 - protein, 10 aa, Influenza virus
SIPNDKPFQN

SEQ ID NO: 355876 - protein, 10 aa, Influenza virus
PNDKPFQNVN

SEQ ID NO: 355877 - protein, 10 aa, Influenza virus
NDKPFQNVNR

SEQ ID NO: 355878 - protein, 10 aa, Influenza virus
KPFQNVNRIT

SEQ ID NO: 355879 - protein, 10 aa, Influenza virus
PFQNVNRITY

SEQ ID NO: 355880 - protein, 10 aa, Influenza virus
FQNVNRITYG

SEQ ID NO: 355881 - protein, 10 aa, Influenza virus
QNVNRITYGA

SEQ ID NO: 355882 - protein, 10 aa, Influenza virus
NVNRITYGAC

SEQ ID NO: 355883 - protein, 10 aa, Influenza virus
VNRITYGACP

SEQ ID NO: 355884 - protein, 10 aa, Influenza virus
YVKQNTLKLA

SEQ ID NO: 355885 - protein, 10 aa, Influenza virus
VKQNTLKLAT

SEQ ID NO: 355886 - protein, 10 aa, Influenza virus
KQNTLKLATG

SEQ ID NO: 355887 - protein, 10 aa, Influenza virus
QNTLKLATGM

SEQ ID NO: 355888 - protein, 10 aa, Influenza virus
NTLKLATGMR

SEQ ID NO: 355889 - protein, 10 aa, Influenza virus
TLKLATGMRN

SEQ ID NO: 355890 - protein, 10 aa, Influenza virus
LKLATGMRNV

SEQ ID NO: 355891 - protein, 10 aa, Influenza virus
KLATGMRNVP

SEQ ID NO: 355892 - protein, 10 aa, Influenza virus
LATGMRNVPE

SEQ ID NO: 355893 - protein, 10 aa, Influenza virus
ATGMRNVPEK

SEQ ID NO: 355894 - protein, 10 aa, Influenza virus
TGMRNVPEKQ

SEQ ID NO: 355895 - protein, 10 aa, Influenza virus
GMRNVPEKQT

SEQ ID NO: 355896 - protein, 10 aa, Influenza virus
MRNVPEKQTR

SEQ ID NO: 355897 - protein, 10 aa, Influenza virus
RNVPEKQTRG

SEQ ID NO: 355898 - protein, 10 aa, Influenza virus
PEKQTRGIFG

SEQ ID NO: 355899 - protein, 10 aa, Influenza virus
EKQTRGIFGA

SEQ ID NO: 355900 - protein, 10 aa, Influenza virus
KQTRGIFGAI

SEQ ID NO: 355901 - protein, 10 aa, Influenza virus
QTRGIFGAIA

SEQ ID NO: 355902 - protein, 10 aa, Influenza virus
TRGIFGAIAG

SEQ ID NO: 355903 - protein, 10 aa, Influenza virus
RGIFGAIAGF

SEQ ID NO: 355904 - protein, 10 aa, Influenza virus
GIFGAIAGFI

SEQ ID NO: 355905 - protein, 10 aa, Influenza virus
IFGAIAGFIE

SEQ ID NO: 355906 - protein, 10 aa, Influenza virus
FGAIAGFIEN

SEQ ID NO: 355907 - protein, 10 aa, Influenza virus
GAIAGFIENG

SEQ ID NO: 355908 - protein, 10 aa, Influenza virus
AIAGFIENGW

SEQ ID NO: 355909 - protein, 10 aa, Influenza virus
IAGFIENGWE

SEQ ID NO: 355910 - protein, 10 aa, Influenza virus
AGFIENGWEG

SEQ ID NO: 355911 - protein, 10 aa, Influenza virus
GFIENGWEGM

SEQ ID NO: 355912 - protein, 10 aa, Influenza virus
FIENGWEGMV

SEQ ID NO: 355913 - protein, 10 aa, Influenza virus
IENGWEGMVD

SEQ ID NO: 355914 - protein, 10 aa, Influenza virus
ENGWEGMVDG

SEQ ID NO: 355915 - protein, 10 aa, Influenza virus
NGWEGMVDGW

SEQ ID NO: 355916 - protein, 10 aa, Influenza virus
GWEGMVDGWY

SEQ ID NO: 355917 - protein, 10 aa, Influenza virus
WEGMVDGWYG

SEQ ID NO: 355918 - protein, 10 aa, Influenza virus
EGMVDGWYGF

SEQ ID NO: 355919 - protein, 10 aa, Influenza virus
GMVDGWYGFR

SEQ ID NO: 355920 - protein, 10 aa, Influenza virus
MVDGWYGFRH

SEQ ID NO: 355921 - protein, 10 aa, Influenza virus
VDGWYGFRHQ

SEQ ID NO: 355922 - protein, 10 aa, Influenza virus
DGWYGFRHQN

SEQ ID NO: 355923 - protein, 10 aa, Influenza virus
GWYGFRHQNS

SEQ ID NO: 355924 - protein, 10 aa, Influenza virus
GRLVRFRHQN

SEQ ID NO: 355925 - protein, 10 aa, Influenza virus
RLVRFRHQNS

SEQ ID NO: 355926 - protein, 10 aa, Influenza virus
WYGFRHQNSE

SEQ ID NO: 355927 - protein, 10 aa, Influenza virus
YGFRHQNSEG

SEQ ID NO: 355928 - protein, 10 aa, Influenza virus
RHQNSEGTGQ

SEQ ID NO: 355929 - protein, 10 aa, Influenza virus
NSEGTGQAAD

SEQ ID NO: 355930 - protein, 10 aa, Influenza virus
SEGTGQAADL

SEQ ID NO: 355931 - protein, 10 aa, Influenza virus
EGTGQAADLK

SEQ ID NO: 355932 - protein, 10 aa, Influenza virus
GTGQAADLKS

SEQ ID NO: 355933 - protein, 10 aa, Influenza virus
TGQAADLKST

SEQ ID NO: 355934 - protein, 10 aa, Influenza virus
GQAADLKSTQ

SEQ ID NO: 355935 - protein, 10 aa, Influenza virus
QAADLKSTQA

SEQ ID NO: 355936 - protein, 10 aa, Influenza virus
AADLKSTQAA

SEQ ID NO: 355937 - protein, 10 aa, Influenza virus
ADLKSTQAAI

SEQ ID NO: 355938 - protein, 10 aa, Influenza virus
DLKSTQAAIN

SEQ ID NO: 355939 - protein, 10 aa, Influenza virus
LKSTQAAINQ

SEQ ID NO: 355940 - protein, 10 aa, Influenza virus
KSTQAAINQI

SEQ ID NO: 355941 - protein, 10 aa, Influenza virus
IGKTNEKFHQ

SEQ ID NO: 355942 - protein, 10 aa, Influenza virus
GKTNEKFHQI

SEQ ID NO: 355943 - protein, 10 aa, Influenza virus
KTNEKFHQIE

SEQ ID NO: 355944 - protein, 10 aa, Influenza virus
TNEKFHQIEK

SEQ ID NO: 355945 - protein, 10 aa, Influenza virus
NEKFHQIEKE

SEQ ID NO: 355946 - protein, 10 aa, Influenza virus
EKFHQIEKEF

SEQ ID NO: 355947 - protein, 10 aa, Influenza virus
KFHQIEKEFS

SEQ ID NO: 355948 - protein, 10 aa, Influenza virus
FHQIEKEFSE

SEQ ID NO: 355949 - protein, 10 aa, Influenza virus
HQIEKEFSEV

SEQ ID NO: 355950 - protein, 10 aa, Influenza virus
QIEKEFSEVE

SEQ ID NO: 355951 - protein, 10 aa, Influenza virus
IEKEFSEVEG

SEQ ID NO: 355952 - protein, 10 aa, Influenza virus
EKEFSEVEGR

SEQ ID NO: 355953 - protein, 10 aa, Influenza virus
KEFSEVEGRI

SEQ ID NO: 355954 - protein, 10 aa, Influenza virus
EFSEVEGRIQ

SEQ ID NO: 355955 - protein, 10 aa, Influenza virus
FSEVEGRIQD

SEQ ID NO: 355956 - protein, 10 aa, Influenza virus
SEVEGRIQDL

SEQ ID NO: 355957 - protein, 10 aa, Influenza virus
EVEGRIQDLE

SEQ ID NO: 355958 - protein, 10 aa, Influenza virus
VEGRIQDLEK

SEQ ID NO: 355959 - protein, 10 aa, Influenza virus
EGRIQDLEKY

SEQ ID NO: 355960 - protein, 10 aa, Influenza virus
GRIQDLEKYV

SEQ ID NO: 355961 - protein, 10 aa, Influenza virus
RIQDLEKYVE

SEQ ID NO: 355962 - protein, 10 aa, Influenza virus
IQDLEKYVED

SEQ ID NO: 355963 - protein, 10 aa, Influenza virus
QDLEKYVEDT

SEQ ID NO: 355964 - protein, 10 aa, Influenza virus
DLEKYVEDTK

SEQ ID NO: 355965 - protein, 10 aa, Influenza virus
LEKYVEDTKI

SEQ ID NO: 355966 - protein, 10 aa, Influenza virus
EKYVEDTKID

SEQ ID NO: 355967 - protein, 10 aa, Influenza virus
KYVEDTKIDL

SEQ ID NO: 355968 - protein, 10 aa, Influenza virus
YVEDTKIDLW

SEQ ID NO: 355969 - protein, 10 aa, Influenza virus
VEDTKIDLWS

SEQ ID NO: 355970 - protein, 10 aa, Influenza virus
EDTKIDLWSY

SEQ ID NO: 355971 - protein, 10 aa, Influenza virus
DTKIDLWSYN

SEQ ID NO: 355972 - protein, 10 aa, Influenza virus
TKIDLWSYNA
